United States Patent 7,888,497 (BIOINFORMATICALLY DETECTABLE GROUP OF NOVEL REGULATORY OLIGONUCLEOTIDES AND USES THEREOF) - sequence listing, part 55

SEQ ID NO: 2309025 - DNA, 15 bp, Homo sapiens
tctttaatcaaaagt

SEQ ID NO: 2309026 - DNA, 21 bp, Homo sapiens
tctttagtgatgcaataaaca

SEQ ID NO: 2309027 - DNA, 15 bp, Homo sapiens
tctttattacacaaa

SEQ ID NO: 2309028 - DNA, 16 bp, Homo sapiens
tctttcaccctgccac

SEQ ID NO: 2309029 - DNA, 19 bp, Homo sapiens
tctttcagccaagaattct

SEQ ID NO: 2309030 - DNA, 21 bp, Homo sapiens
tctttcagccaagaattctta

SEQ ID NO: 2309031 - DNA, 15 bp, Homo sapiens
tctttctcttcccat

SEQ ID NO: 2309032 - DNA, 15 bp, Homo sapiens
tctttgattgtgaaa

SEQ ID NO: 2309033 - DNA, 18 bp, Homo sapiens
tctttgcagtgaagatgt

SEQ ID NO: 2309034 - DNA, 21 bp, Homo sapiens
tctttgcagtgaagatgtgta

SEQ ID NO: 2309035 - DNA, 22 bp, Homo sapiens
tctttgcagtgaagatgtgtaa

SEQ ID NO: 2309036 - DNA, 10 bp, Homo sapiens
tctttggggt

SEQ ID NO: 2309037 - DNA, 20 bp, Homo sapiens
tctttgtacagacaacaaac

SEQ ID NO: 2309038 - DNA, 19 bp, Homo sapiens
tcttttatataactacatt

SEQ ID NO: 2309039 - DNA, 14 bp, Homo sapiens
tcttttatatctgt

SEQ ID NO: 2309040 - DNA, 15 bp, Homo sapiens
tcttttatatctgta

SEQ ID NO: 2309041 - DNA, 18 bp, Homo sapiens
tcttttatatctgtaaat

SEQ ID NO: 2309042 - DNA, 23 bp, Homo sapiens
tcttttatatctgtaaatttaac

SEQ ID NO: 2309043 - DNA, 19 bp, Homo sapiens
tcttttcagcttgtttcta

SEQ ID NO: 2309044 - DNA, 24 bp, Homo sapiens
tcttttcagcttgtttctatactg

SEQ ID NO: 2309045 - DNA, 18 bp, Homo sapiens
tcttttgtaagtgctaca

SEQ ID NO: 2309046 - DNA, 22 bp, Homo sapiens
tctttttaaaaagttgcacatt

SEQ ID NO: 2309047 - DNA, 13 bp, Homo sapiens
tctttttaaatgt

SEQ ID NO: 2309048 - DNA, 16 bp, Homo sapiens
tctttttgctttgctt

SEQ ID NO: 2309049 - DNA, 17 bp, Homo sapiens
tcttttttgagtgtgca

SEQ ID NO: 2309050 - DNA, 18 bp, Homo sapiens
tgaaaacaccaagagtac

SEQ ID NO: 2309051 - DNA, 17 bp, Homo sapiens
tgaaaactgtttatggt

SEQ ID NO: 2309052 - DNA, 23 bp, Homo sapiens
tgaaaactgtttatggtattttc

SEQ ID NO: 2309053 - DNA, 15 bp, Homo sapiens
tgaaaagaaatgcta

SEQ ID NO: 2309054 - DNA, 16 bp, Homo sapiens
tgaaaagaaatgctaa

SEQ ID NO: 2309055 - DNA, 22 bp, Homo sapiens
tgaaaagaagaaagtctatgct

SEQ ID NO: 2309056 - DNA, 18 bp, Homo sapiens
tgaaaatactggaattca

SEQ ID NO: 2309057 - DNA, 20 bp, Homo sapiens
tgaaaatatttttttctagc

SEQ ID NO: 2309058 - DNA, 12 bp, Homo sapiens
tgaaaattcttg

SEQ ID NO: 2309059 - DNA, 15 bp, Homo sapiens
tgaaacaaaactgga

SEQ ID NO: 2309060 - DNA, 21 bp, Homo sapiens
tgaaacacacaggccatttca

SEQ ID NO: 2309061 - DNA, 16 bp, Homo sapiens
tgaaacctaaggcaac

SEQ ID NO: 2309062 - DNA, 15 bp, Homo sapiens
tgaaacctctgttct

SEQ ID NO: 2309063 - DNA, 16 bp, Homo sapiens
tgaaacctctgttctc

SEQ ID NO: 2309064 - DNA, 17 bp, Homo sapiens
tgaaacctctgttctca

SEQ ID NO: 2309065 - DNA, 20 bp, Homo sapiens
tgaaagatggtaatcttttc

SEQ ID NO: 2309066 - DNA, 21 bp, Homo sapiens
tgaaagatggtaatcttttct

SEQ ID NO: 2309067 - DNA, 19 bp, Homo sapiens
tgaaagtgtttttctttaa

SEQ ID NO: 2309068 - DNA, 21 bp, Homo sapiens
tgaaagtgtttttctttaatc

SEQ ID NO: 2309069 - DNA, 22 bp, Homo sapiens
tgaaatatttgcttatttatat

SEQ ID NO: 2309070 - DNA, 14 bp, Homo sapiens
tgaaatccaaaata

SEQ ID NO: 2309071 - DNA, 21 bp, Homo sapiens
tgaaatccaaaatagtcatgt

SEQ ID NO: 2309072 - DNA, 15 bp, Homo sapiens
tgaaatctacaacat

SEQ ID NO: 2309073 - DNA, 14 bp, Homo sapiens
tgaaatttaaaaat

SEQ ID NO: 2309074 - DNA, 12 bp, Homo sapiens
tgaaatttatga

SEQ ID NO: 2309075 - DNA, 14 bp, Homo sapiens
tgaaatttatgact

SEQ ID NO: 2309076 - DNA, 16 bp, Homo sapiens
tgctaacctcaattta

SEQ ID NO: 2309077 - DNA, 12 bp, Homo sapiens
tgctaagtggaa

SEQ ID NO: 2309078 - DNA, 22 bp, Homo sapiens
tgctaagtggaagacagagatg

SEQ ID NO: 2309079 - DNA, 14 bp, Homo sapiens
tgctaatgtaatca

SEQ ID NO: 2309080 - DNA, 21 bp, Homo sapiens
tgctaatgtaatcatttatct

SEQ ID NO: 2309081 - DNA, 22 bp, Homo sapiens
tgctaatgtaatcatttatctt

SEQ ID NO: 2309082 - DNA, 19 bp, Homo sapiens
tgctacagtagctgtgggg

SEQ ID NO: 2309083 - DNA, 15 bp, Homo sapiens
tgctaggataaacca

SEQ ID NO: 2309084 - DNA, 15 bp, Homo sapiens
tgctatatttgctaa

SEQ ID NO: 2309085 - DNA, 19 bp, Homo sapiens
tgctatggaaatacattta

SEQ ID NO: 2309086 - DNA, 19 bp, Homo sapiens
tgctatgttattttcagtg

SEQ ID NO: 2309087 - DNA, 14 bp, Homo sapiens
tgctattgtttata

SEQ ID NO: 2309088 - DNA, 12 bp, Homo sapiens
tgctcagggccg

SEQ ID NO: 2309089 - DNA, 23 bp, Homo sapiens
tgctcatcacccggatagaggac

SEQ ID NO: 2309090 - DNA, 17 bp, Homo sapiens
tgctccagatcctcttt

SEQ ID NO: 2309091 - DNA, 19 bp, Homo sapiens
tgctccagtgttttcttgt

SEQ ID NO: 2309092 - DNA, 13 bp, Homo sapiens
tgctctccatctc

SEQ ID NO: 2309093 - DNA, 15 bp, Homo sapiens
tgctctccatctctt

SEQ ID NO: 2309094 - DNA, 20 bp, Homo sapiens
tgctctgttcctgtccagca

SEQ ID NO: 2309095 - DNA, 17 bp, Homo sapiens
tgctcttatccccagct

SEQ ID NO: 2309096 - DNA, 22 bp, Homo sapiens
tgctcttctcttacgctctctg

SEQ ID NO: 2309097 - DNA, 20 bp, Homo sapiens
tgctctttcaccctgccacc

SEQ ID NO: 2309098 - DNA, 17 bp, Homo sapiens
tgctgagtggtccacat

SEQ ID NO: 2309099 - DNA, 16 bp, Homo sapiens
tgctgcccccagaccc

SEQ ID NO: 2309100 - DNA, 22 bp, Homo sapiens
tgctgcctgtttggggaggggg

SEQ ID NO: 2309101 - DNA, 23 bp, Homo sapiens
tgctgctcctcggccagagctcc

SEQ ID NO: 2309102 - DNA, 17 bp, Homo sapiens
tgctgctcgggaaggcc

SEQ ID NO: 2309103 - DNA, 13 bp, Homo sapiens
tgctgctgtgcag

SEQ ID NO: 2309104 - DNA, 21 bp, Homo sapiens
tgctgggctggcggccatccc

SEQ ID NO: 2309105 - DNA, 18 bp, Homo sapiens
tgctggtcacccccaccc

SEQ ID NO: 2309106 - DNA, 15 bp, Homo sapiens
tgctgtaagacggcc

SEQ ID NO: 2309107 - DNA, 17 bp, Homo sapiens
tgctgtcccttacgtga

SEQ ID NO: 2309108 - DNA, 17 bp, Homo sapiens
tgctgtcccttttcctt

SEQ ID NO: 2309109 - DNA, 14 bp, Homo sapiens
tgctgttgcttgaa

SEQ ID NO: 2309110 - DNA, 15 bp, Homo sapiens
tgctgttgcttgaat

SEQ ID NO: 2309111 - DNA, 16 bp, Homo sapiens
tgctgttttatgtcat

SEQ ID NO: 2309112 - DNA, 13 bp, Homo sapiens
tgcttaacataaa

SEQ ID NO: 2309113 - DNA, 22 bp, Homo sapiens
tgcttaagatgctaatagaaaa

SEQ ID NO: 2309114 - DNA, 13 bp, Homo sapiens
tgcttaaggaaaa

SEQ ID NO: 2309115 - DNA, 20 bp, Homo sapiens
tgcttaaggaaaagagaaac

SEQ ID NO: 2309116 - DNA, 20 bp, Homo sapiens
tgcttatttatattcagaga

SEQ ID NO: 2309117 - DNA, 16 bp, Homo sapiens
tgcttcaaggatcctg

SEQ ID NO: 2309118 - DNA, 20 bp, Homo sapiens
tgcttcaaggatcctgagcc

SEQ ID NO: 2309119 - DNA, 21 bp, Homo sapiens
tgcttcaaggatcctgagcca

SEQ ID NO: 2309120 - DNA, 24 bp, Homo sapiens
tgcttctaagggatccagagacct

SEQ ID NO: 2309121 - DNA, 19 bp, Homo sapiens
tgcttgagtggacagcagc

SEQ ID NO: 2309122 - DNA, 20 bp, Homo sapiens
tgcttgagtggacagcagct

SEQ ID NO: 2309123 - DNA, 21 bp, Homo sapiens
tgcttgatataataattactt

SEQ ID NO: 2309124 - DNA, 18 bp, Homo sapiens
tgcttggatccatacaaa

SEQ ID NO: 2309125 - DNA, 17 bp, Homo sapiens
tgcttggcttatgaaaa

SEQ ID NO: 2309126 - DNA, 17 bp, Homo sapiens
tgcttgtcattctgcta

SEQ ID NO: 2309127 - DNA, 19 bp, Homo sapiens
tgctttcatccaactggaa

SEQ ID NO: 2309128 - DNA, 16 bp, Homo sapiens
tgctttgaatgcatgt

SEQ ID NO: 2309129 - DNA, 19 bp, Homo sapiens
tgctttgcccttgaattct

SEQ ID NO: 2309130 - DNA, 23 bp, Homo sapiens
tgctttggggcttatcagaactc

SEQ ID NO: 2309131 - DNA, 21 bp, Homo sapiens
tgctttgttttggctgctctc

SEQ ID NO: 2309132 - DNA, 23 bp, Homo sapiens
tgctttgttttggctgctctcca

SEQ ID NO: 2309133 - DNA, 21 bp, Homo sapiens
tgcttttgcatttctcttcct

SEQ ID NO: 2309134 - DNA, 23 bp, Homo sapiens
tgcttttgcatttctcttcctaa

SEQ ID NO: 2309135 - DNA, 22 bp, Homo sapiens
tgctttttaaactgatgtatag

SEQ ID NO: 2309136 - DNA, 22 bp, Homo sapiens
tggaaacaaggaaggacatttc

SEQ ID NO: 2309137 - DNA, 12 bp, Homo sapiens
tggaaatacatt

SEQ ID NO: 2309138 - DNA, 14 bp, Homo sapiens
tggaaatacattta

SEQ ID NO: 2309139 - DNA, 16 bp, Homo sapiens
tggaaatacatttaga

SEQ ID NO: 2309140 - DNA, 20 bp, Homo sapiens
tggaacactaaagagctagg

SEQ ID NO: 2309141 - DNA, 15 bp, Homo sapiens
tggaacactctgaga

SEQ ID NO: 2309142 - DNA, 17 bp, Homo sapiens
tggaacactctgagact

SEQ ID NO: 2309143 - DNA, 14 bp, Homo sapiens
tggaaccatcctct

SEQ ID NO: 2309144 - DNA, 16 bp, Homo sapiens
tggaacttaaaacata

SEQ ID NO: 2309145 - DNA, 14 bp, Homo sapiens
tggaagctggcagg

SEQ ID NO: 2309146 - DNA, 22 bp, Homo sapiens
tggaaggctttattcttccaag

SEQ ID NO: 2309147 - DNA, 22 bp, Homo sapiens
tggaatatacatgtaaaaatgt

SEQ ID NO: 2309148 - DNA, 15 bp, Homo sapiens
tggaatatcaatgcc

SEQ ID NO: 2309149 - DNA, 13 bp, Homo sapiens
tggaatttcttgt

SEQ ID NO: 2309150 - DNA, 14 bp, Homo sapiens
tggaatttcttgtt

SEQ ID NO: 2309151 - DNA, 23 bp, Homo sapiens
tggacagatgggtgtcccctggt

SEQ ID NO: 2309152 - DNA, 15 bp, Homo sapiens
tggacagcagctgga

SEQ ID NO: 2309153 - DNA, 16 bp, Homo sapiens
tggacagcagctggac

SEQ ID NO: 2309154 - DNA, 16 bp, Homo sapiens
tggaccaactgctttg

SEQ ID NO: 2309155 - DNA, 15 bp, Homo sapiens
tggaccactgtttct

SEQ ID NO: 2309156 - DNA, 18 bp, Homo sapiens
tggaccactgtttcttgc

SEQ ID NO: 2309157 - DNA, 23 bp, Homo sapiens
tggaccactgtttcttgcttgta

SEQ ID NO: 2309158 - DNA, 21 bp, Homo sapiens
tggacctggggtcccccctcc

SEQ ID NO: 2309159 - DNA, 23 bp, Homo sapiens
tggacgagtgagctaccaggaag

SEQ ID NO: 2309160 - DNA, 19 bp, Homo sapiens
tggacgtgttatgactcca

SEQ ID NO: 2309161 - DNA, 13 bp, Homo sapiens
tggactcttcaaa

SEQ ID NO: 2309162 - DNA, 16 bp, Homo sapiens
tggactgggaagcatt

SEQ ID NO: 2309163 - DNA, 17 bp, Homo sapiens
tggactgggaagcatta

SEQ ID NO: 2309164 - DNA, 13 bp, Homo sapiens
tggactgtggcct

SEQ ID NO: 2309165 - DNA, 15 bp, Homo sapiens
tggactgtggcctca

SEQ ID NO: 2309166 - DNA, 16 bp, Homo sapiens
tggactgtggcctcag

SEQ ID NO: 2309167 - DNA, 16 bp, Homo sapiens
tggacttaattatgct

SEQ ID NO: 2309168 - DNA, 18 bp, Homo sapiens
tggagacaggattctgac

SEQ ID NO: 2309169 - DNA, 19 bp, Homo sapiens
tggagatgtcagtctgtcc

SEQ ID NO: 2309170 - DNA, 23 bp, Homo sapiens
tggagcacgaggccttcagaaaa

SEQ ID NO: 2309171 - DNA, 22 bp, Homo sapiens
tggagcagagacggcagcccca

SEQ ID NO: 2309172 - DNA, 22 bp, Homo sapiens
tggagcccgcctgcgcccccca

SEQ ID NO: 2309173 - DNA, 15 bp, Homo sapiens
tggagctgcttccag

SEQ ID NO: 2309174 - DNA, 20 bp, Homo sapiens
tggaggatggacgagtgagc

SEQ ID NO: 2309175 - DNA, 21 bp, Homo sapiens
tggaggatggacgagtgagct

SEQ ID NO: 2309176 - DNA, 11 bp, Homo sapiens
tggaggctgga

SEQ ID NO: 2309177 - DNA, 12 bp, Homo sapiens
tggaggctggac

SEQ ID NO: 2309178 - DNA, 13 bp, Homo sapiens
tggagggctgggc

SEQ ID NO: 2309179 - DNA, 15 bp, Homo sapiens
tggagggctgggcag

SEQ ID NO: 2309180 - DNA, 18 bp, Homo sapiens
tggagggctgggcagggc

SEQ ID NO: 2309181 - DNA, 23 bp, Homo sapiens
tggaggttgggaggtccaaggtc

SEQ ID NO: 2309182 - DNA, 16 bp, Homo sapiens
tggagtccagacctgg

SEQ ID NO: 2309183 - DNA, 23 bp, Homo sapiens
tggagtccagacctgggccctgg

SEQ ID NO: 2309184 - DNA, 23 bp, Homo sapiens
tggagtggcatggtcctgtgccc

SEQ ID NO: 2309185 - DNA, 15 bp, Homo sapiens
tggatagaaaaatgc

SEQ ID NO: 2309186 - DNA, 15 bp, Homo sapiens
tggatgtgctttcat

SEQ ID NO: 2309187 - DNA, 23 bp, Homo sapiens
tggattttctttctatgtagaac

SEQ ID NO: 2309188 - DNA, 14 bp, Homo sapiens
tggcacagaacagg

SEQ ID NO: 2309189 - DNA, 21 bp, Homo sapiens
tggcagagcagtctaaacaga

SEQ ID NO: 2309190 - DNA, 15 bp, Homo sapiens
tggcagagccatcca

SEQ ID NO: 2309191 - DNA, 16 bp, Homo sapiens
tggcagagccatccac

SEQ ID NO: 2309192 - DNA, 17 bp, Homo sapiens
tggcaggagtgggctct

SEQ ID NO: 2309193 - DNA, 15 bp, Homo sapiens
tggcagggcaggcag

SEQ ID NO: 2309194 - DNA, 20 bp, Homo sapiens
tggcagggcaggcagagctc

SEQ ID NO: 2309195 - DNA, 21 bp, Homo sapiens
tggcagggcaggcagagctca

SEQ ID NO: 2309196 - DNA, 17 bp, Homo sapiens
tggcaggtggccagggc

SEQ ID NO: 2309197 - DNA, 18 bp, Homo sapiens
tggcagtggcagagaatc

SEQ ID NO: 2309198 - DNA, 18 bp, Homo sapiens
tggcatggtcctgtgccc

SEQ ID NO: 2309199 - DNA, 17 bp, Homo sapiens
tggcatttcgaggttta

SEQ ID NO: 2309200 - DNA, 18 bp, Homo sapiens
tggcattttggctcagag

SEQ ID NO: 2309201 - DNA, 21 bp, Homo sapiens
tggcattttggctcagagtcc

SEQ ID NO: 2309202 - DNA, 14 bp, Homo sapiens
tggccactcctggg

SEQ ID NO: 2309203 - DNA, 17 bp, Homo sapiens
tggccactcctgggccc

SEQ ID NO: 2309204 - DNA, 16 bp, Homo sapiens
tggccccagctggctg

SEQ ID NO: 2309205 - DNA, 20 bp, Homo sapiens
tggcccctaggctgctgctg

SEQ ID NO: 2309206 - DNA, 12 bp, Homo sapiens
tggcccctccca

SEQ ID NO: 2309207 - DNA, 18 bp, Homo sapiens
ttcaattggacaattatt

SEQ ID NO: 2309208 - DNA, 13 bp, Homo sapiens
ttcacaaatatag

SEQ ID NO: 2309209 - DNA, 22 bp, Homo sapiens
ttcacactgtgcgttttagagt

SEQ ID NO: 2309210 - DNA, 17 bp, Homo sapiens
ttcacatatttgtagct

SEQ ID NO: 2309211 - DNA, 15 bp, Homo sapiens
ttcactctccagggt

SEQ ID NO: 2309212 - DNA, 13 bp, Homo sapiens
ttcactctccttg

SEQ ID NO: 2309213 - DNA, 14 bp, Homo sapiens
ttcactctccttgg

SEQ ID NO: 2309214 - DNA, 14 bp, Homo sapiens
ttcactgagtctca

SEQ ID NO: 2309215 - DNA, 14 bp, Homo sapiens
ttcagaaaagacac

SEQ ID NO: 2309216 - DNA, 15 bp, Homo sapiens
ttcagaaaagacact

SEQ ID NO: 2309217 - DNA, 16 bp, Homo sapiens
ttcagaatattttcaa

SEQ ID NO: 2309218 - DNA, 16 bp, Homo sapiens
ttcagcctcgtctctt

SEQ ID NO: 2309219 - DNA, 21 bp, Homo sapiens
ttcagcttgtttctatactgt

SEQ ID NO: 2309220 - DNA, 17 bp, Homo sapiens
ttcaggaccccatctgc

SEQ ID NO: 2309221 - DNA, 20 bp, Homo sapiens
ttcaggaccccatctgctga

SEQ ID NO: 2309222 - DNA, 14 bp, Homo sapiens
ttcagtcttgcctt

SEQ ID NO: 2309223 - DNA, 18 bp, Homo sapiens
ttcagtggagctcagagg

SEQ ID NO: 2309224 - DNA, 13 bp, Homo sapiens
ttcagttctcatc

SEQ ID NO: 2309225 - DNA, 19 bp, Homo sapiens
ttcagttctcatcttgtaa

SEQ ID NO: 2309226 - DNA, 13 bp, Homo sapiens
ttcataatgactt

SEQ ID NO: 2309227 - DNA, 16 bp, Homo sapiens
ttcataattcatttaa

SEQ ID NO: 2309228 - DNA, 15 bp, Homo sapiens
ttcatactaaataaa

SEQ ID NO: 2309229 - DNA, 22 bp, Homo sapiens
ttcatactttccaacattatcc

SEQ ID NO: 2309230 - DNA, 17 bp, Homo sapiens
ttcatagcatcctgatt

SEQ ID NO: 2309231 - DNA, 16 bp, Homo sapiens
ttcatccaactggaag

SEQ ID NO: 2309232 - DNA, 21 bp, Homo sapiens
ttcatccaccaatatcatgtg

SEQ ID NO: 2309233 - DNA, 23 bp, Homo sapiens
ttcatccaccaatatcatgtgta

SEQ ID NO: 2309234 - DNA, 21 bp, Homo sapiens
ttcatcttgaattgtaaggaa

SEQ ID NO: 2309235 - DNA, 12 bp, Homo sapiens
ttcatgaagaaa

SEQ ID NO: 2309236 - DNA, 21 bp, Homo sapiens
ttcatggaactttcatacgta

SEQ ID NO: 2309237 - DNA, 19 bp, Homo sapiens
ttcatgtgtggaaatggga

SEQ ID NO: 2309238 - DNA, 16 bp, Homo sapiens
ttcatgtttaagaaat

SEQ ID NO: 2309239 - DNA, 16 bp, Homo sapiens
ttcattactgcccaga

SEQ ID NO: 2309240 - DNA, 23 bp, Homo sapiens
ttcattcatggaccactgtttct

SEQ ID NO: 2309241 - DNA, 14 bp, Homo sapiens
ttcatttccaccaa

SEQ ID NO: 2309242 - DNA, 15 bp, Homo sapiens
ttcatttttctgtta

SEQ ID NO: 2309243 - DNA, 17 bp, Homo sapiens
ttccaaagctgaagatc

SEQ ID NO: 2309244 - DNA, 11 bp, Homo sapiens
ttccaaatatt

SEQ ID NO: 2309245 - DNA, 19 bp, Homo sapiens
ttccaaatattagccaaag

SEQ ID NO: 2309246 - DNA, 23 bp, Homo sapiens
ttccaaatattctaaaaaagata

SEQ ID NO: 2309247 - DNA, 20 bp, Homo sapiens
ttccaacaaacttactgtca

SEQ ID NO: 2309248 - DNA, 19 bp, Homo sapiens
ttccaacaggggctggagg

SEQ ID NO: 2309249 - DNA, 12 bp, Homo sapiens
ttccacacaggc

SEQ ID NO: 2309250 - DNA, 17 bp, Homo sapiens
ttccacacaggcccatg

SEQ ID NO: 2309251 - DNA, 22 bp, Homo sapiens
ttccaccccaaaggggcctctc

SEQ ID NO: 2309252 - DNA, 23 bp, Homo sapiens
ttccaccttggcgcgcagcccgg

SEQ ID NO: 2309253 - DNA, 17 bp, Homo sapiens
ttccacgtaagtcactg

SEQ ID NO: 2309254 - DNA, 17 bp, Homo sapiens
ttccactgaaacctctg

SEQ ID NO: 2309255 - DNA, 14 bp, Homo sapiens
ttccacttctctag

SEQ ID NO: 2309256 - DNA, 20 bp, Homo sapiens
ttccagcccagacatcctgt

SEQ ID NO: 2309257 - DNA, 18 bp, Homo sapiens
ttccagctcagtcccaca

SEQ ID NO: 2309258 - DNA, 21 bp, Homo sapiens
ttccaggcgtagggccagggc

SEQ ID NO: 2309259 - DNA, 23 bp, Homo sapiens
ttccagttggactgtggcctcag

SEQ ID NO: 2309260 - DNA, 12 bp, Homo sapiens
ttccatctaaaa

SEQ ID NO: 2309261 - DNA, 19 bp, Homo sapiens
ttcccacagcctcttcctc

SEQ ID NO: 2309262 - DNA, 21 bp, Homo sapiens
ttcccatgcaacaccctcttc

SEQ ID NO: 2309263 - DNA, 22 bp, Homo sapiens
ttccccttgggatgggcacagg

SEQ ID NO: 2309264 - DNA, 13 bp, Homo sapiens
ttcccgcagcacc

SEQ ID NO: 2309265 - DNA, 19 bp, Homo sapiens
ttccgaagaccttctgaag

SEQ ID NO: 2309266 - DNA, 16 bp, Homo sapiens
ttccgctaatctcttc

SEQ ID NO: 2309267 - DNA, 18 bp, Homo sapiens
ttcctaaagaaaaagata

SEQ ID NO: 2309268 - DNA, 12 bp, Homo sapiens
ttcctcatcctt

SEQ ID NO: 2309269 - DNA, 19 bp, Homo sapiens
ttcctcatctccatgctct

SEQ ID NO: 2309270 - DNA, 15 bp, Homo sapiens
ttcctcccttctgat

SEQ ID NO: 2309271 - DNA, 19 bp, Homo sapiens
ttcctcctgacaccccact

SEQ ID NO: 2309272 - DNA, 13 bp, Homo sapiens
ttcctgctgcctg

SEQ ID NO: 2309273 - DNA, 14 bp, Homo sapiens
ttcctggattttct

SEQ ID NO: 2309274 - DNA, 20 bp, Homo sapiens
ttcctggattttctttctat

SEQ ID NO: 2309275 - DNA, 13 bp, Homo sapiens
ttcctgtggaaat

SEQ ID NO: 2309276 - DNA, 19 bp, Homo sapiens
ttcctgtggaaatatgcaa

SEQ ID NO: 2309277 - DNA, 15 bp, Homo sapiens
ttccttttcagcatg

SEQ ID NO: 2309278 - DNA, 12 bp, Homo sapiens
ttcgcctcctcc

SEQ ID NO: 2309279 - DNA, 13 bp, Homo sapiens
ttcgcctcctcca

SEQ ID NO: 2309280 - DNA, 16 bp, Homo sapiens
ttcgcctcctccagct

SEQ ID NO: 2309281 - DNA, 12 bp, Homo sapiens
ttcgctggctga

SEQ ID NO: 2309282 - DNA, 14 bp, Homo sapiens
ttcgtgcatttgtg

SEQ ID NO: 2309283 - DNA, 13 bp, Homo sapiens
ttctaaactgttt

SEQ ID NO: 2309284 - DNA, 17 bp, Homo sapiens
ttctaagcttatttcta

SEQ ID NO: 2309285 - DNA, 22 bp, Homo sapiens
ttctaagggatccagagacctg

SEQ ID NO: 2309286 - DNA, 22 bp, Homo sapiens
ttctactcgagttacagacaaa

SEQ ID NO: 2309287 - DNA, 19 bp, Homo sapiens
ttctagaaggatgaacagt

SEQ ID NO: 2309288 - DNA, 22 bp, Homo sapiens
ttctagaaggatgaacagttct

SEQ ID NO: 2309289 - DNA, 19 bp, Homo sapiens
ttctagcagtatgtgtgct

SEQ ID NO: 2309290 - DNA, 22 bp, Homo sapiens
ttctagctataacaactctatt

SEQ ID NO: 2309291 - DNA, 15 bp, Homo sapiens
ttctagtcaactgct

SEQ ID NO: 2309292 - DNA, 15 bp, Homo sapiens
ttctagtctctgatt

SEQ ID NO: 2309293 - DNA, 16 bp, Homo sapiens
ttctagtctctgattt

SEQ ID NO: 2309294 - DNA, 23 bp, Homo sapiens
ttctagtctctgatttgcaaatg

SEQ ID NO: 2309295 - DNA, 15 bp, Homo sapiens
ttctatactttctca

SEQ ID NO: 2309296 - DNA, 14 bp, Homo sapiens
ttctatatttcata

SEQ ID NO: 2309297 - DNA, 16 bp, Homo sapiens
ttctatatttcatatt

SEQ ID NO: 2309298 - DNA, 16 bp, Homo sapiens
ttctatgcctgtattt

SEQ ID NO: 2309299 - DNA, 18 bp, Homo sapiens
ttctatgtactagtactg

SEQ ID NO: 2309300 - DNA, 13 bp, Homo sapiens
ttctatgttcata

SEQ ID NO: 2309301 - DNA, 18 bp, Homo sapiens
ttctatgttcataaaaaa

SEQ ID NO: 2309302 - DNA, 13 bp, Homo sapiens
ttctcaaaaagct

SEQ ID NO: 2309303 - DNA, 22 bp, Homo sapiens
ttctcacatgtggctccccctg

SEQ ID NO: 2309304 - DNA, 16 bp, Homo sapiens
ttctcatcttgtaaat

SEQ ID NO: 2309305 - DNA, 15 bp, Homo sapiens
ttctcattatgaaga

SEQ ID NO: 2309306 - DNA, 21 bp, Homo sapiens
ttctcattatgaagatgtttt

SEQ ID NO: 2309307 - DNA, 14 bp, Homo sapiens
ttctccaaagcttg

SEQ ID NO: 2309308 - DNA, 19 bp, Homo sapiens
ttctcgagtccaaaatcat

SEQ ID NO: 2309309 - DNA, 16 bp, Homo sapiens
ttctcgtactttcaca

SEQ ID NO: 2309310 - DNA, 19 bp, Homo sapiens
ttctctgccctgccctggc

SEQ ID NO: 2309311 - DNA, 18 bp, Homo sapiens
ttctcttacgctctctgt

SEQ ID NO: 2309312 - DNA, 13 bp, Homo sapiens
ttctcttctcaga

SEQ ID NO: 2309313 - DNA, 14 bp, Homo sapiens
ttctgaagatctca

SEQ ID NO: 2309314 - DNA, 16 bp, Homo sapiens
ttctgaagatctcaga

SEQ ID NO: 2309315 - DNA, 17 bp, Homo sapiens
ttctgaattcataaaaa

SEQ ID NO: 2309316 - DNA, 22 bp, Homo sapiens
ttctgacacgacttctgtttca

SEQ ID NO: 2309317 - DNA, 14 bp, Homo sapiens
ttctgacagagcca

SEQ ID NO: 2309318 - DNA, 13 bp, Homo sapiens
ttctgagaaggtg

SEQ ID NO: 2309319 - DNA, 14 bp, Homo sapiens
ttctgcaaacaaac

SEQ ID NO: 2309320 - DNA, 16 bp, Homo sapiens
ttctgcaataacagtt

SEQ ID NO: 2309321 - DNA, 19 bp, Homo sapiens
ttctgcagccactattgtt

SEQ ID NO: 2309322 - DNA, 17 bp, Homo sapiens
ttctgcagtattctgta

SEQ ID NO: 2309323 - DNA, 16 bp, Homo sapiens
ttctgctacctggttt

SEQ ID NO: 2309324 - DNA, 16 bp, Homo sapiens
ttctggaatactgaaa

SEQ ID NO: 2309325 - DNA, 16 bp, Homo sapiens
ttctggctgaaaatgg

SEQ ID NO: 2309326 - DNA, 15 bp, Homo sapiens
ttctgggacccactc

SEQ ID NO: 2309327 - DNA, 16 bp, Homo sapiens
ttctggggccagcccc

SEQ ID NO: 2309328 - DNA, 22 bp, Homo sapiens
ttctggggccagcccctccccg

SEQ ID NO: 2309329 - DNA, 13 bp, Homo sapiens
ttctgtcttgtag

SEQ ID NO: 2309330 - DNA, 14 bp, Homo sapiens
ttctgtgtctgctg

SEQ ID NO: 2309331 - DNA, 16 bp, Homo sapiens
ttctgtgtctgctgta

SEQ ID NO: 2309332 - DNA, 14 bp, Homo sapiens
ttcttaaaatattg

SEQ ID NO: 2309333 - DNA, 18 bp, Homo sapiens
ttcttatcacacttgcaa

SEQ ID NO: 2309334 - DNA, 15 bp, Homo sapiens
ttcttcccatttgta

SEQ ID NO: 2309335 - DNA, 19 bp, Homo sapiens
ttcttgcggcaccgcccac

SEQ ID NO: 2309336 - DNA, 14 bp, Homo sapiens
ttcttgctatgtta

SEQ ID NO: 2309337 - DNA, 23 bp, Homo sapiens
ttcttgcttgtacctctggctga

SEQ ID NO: 2309338 - DNA, 17 bp, Homo sapiens
ttcttgctttcacaaat

SEQ ID NO: 2309339 - DNA, 19 bp, Homo sapiens
ttcttgctttcacaaatat

SEQ ID NO: 2309340 - DNA, 13 bp, Homo sapiens
aaaaaaaaaatgt

SEQ ID NO: 2309341 - DNA, 18 bp, Homo sapiens
aaaaaagatactgtatat

SEQ ID NO: 2309342 - DNA, 12 bp, Homo sapiens
aaaaaatgaata

SEQ ID NO: 2309343 - DNA, 16 bp, Homo sapiens
aaaaacattttaaaat

SEQ ID NO: 2309344 - DNA, 13 bp, Homo sapiens
aaaaactgatttt

SEQ ID NO: 2309345 - DNA, 22 bp, Homo sapiens
aaaaagaagaggttcatttttc

SEQ ID NO: 2309346 - DNA, 17 bp, Homo sapiens
aaaaagtggaatttctt

SEQ ID NO: 2309347 - DNA, 23 bp, Homo sapiens
aaaaatagaatatataaacgata

SEQ ID NO: 2309348 - DNA, 16 bp, Homo sapiens
aaaaatagttttacat

SEQ ID NO: 2309349 - DNA, 17 bp, Homo sapiens
aaaaatagttttacatt

SEQ ID NO: 2309350 - DNA, 21 bp, Homo sapiens
aaaaatgctgttcagaaatat

SEQ ID NO: 2309351 - DNA, 17 bp, Homo sapiens
aaaaatgtgagctataa

SEQ ID NO: 2309352 - DNA, 13 bp, Homo sapiens
aaaaattacagtt

SEQ ID NO: 2309353 - DNA, 14 bp, Homo sapiens
aaaaattacattat

SEQ ID NO: 2309354 - DNA, 23 bp, Homo sapiens
aaaaattctagtctgtttcatta

SEQ ID NO: 2309355 - DNA, 22 bp, Homo sapiens
aaaacactggattcatttcatc

SEQ ID NO: 2309356 - DNA, 12 bp, Homo sapiens
aaaacagatgag

SEQ ID NO: 2309357 - DNA, 15 bp, Homo sapiens
aaaacattttaaaat

SEQ ID NO: 2309358 - DNA, 21 bp, Homo sapiens
aaaacattttaaaatcaactt

SEQ ID NO: 2309359 - DNA, 17 bp, Homo sapiens
aaaacccctaggtcatt

SEQ ID NO: 2309360 - DNA, 19 bp, Homo sapiens
aaaacccctaggtcatttg

SEQ ID NO: 2309361 - DNA, 14 bp, Homo sapiens
aaaacgtggctgct

SEQ ID NO: 2309362 - DNA, 17 bp, Homo sapiens
aaaacgtggctgcttca

SEQ ID NO: 2309363 - DNA, 19 bp, Homo sapiens
aaaactatcggttcaagtt

SEQ ID NO: 2309364 - DNA, 21 bp, Homo sapiens
aaaactcagtctcaaataata

SEQ ID NO: 2309365 - DNA, 17 bp, Homo sapiens
aaaactctagcagttgt

SEQ ID NO: 2309366 - DNA, 22 bp, Homo sapiens
aaaactgatttttttttccttc

SEQ ID NO: 2309367 - DNA, 19 bp, Homo sapiens
aaaagaaatgctaatgtaa

SEQ ID NO: 2309368 - DNA, 13 bp, Homo sapiens
aaaagacacttca

SEQ ID NO: 2309369 - DNA, 22 bp, Homo sapiens
aaaagatactgtatatgtcaaa

SEQ ID NO: 2309370 - DNA, 18 bp, Homo sapiens
aaaagattaaaattagtg

SEQ ID NO: 2309371 - DNA, 23 bp, Homo sapiens
aaaagcagagagaagtacttttg

SEQ ID NO: 2309372 - DNA, 13 bp, Homo sapiens
aaaagctttagat

SEQ ID NO: 2309373 - DNA, 17 bp, Homo sapiens
aaaagctttagattgaa

SEQ ID NO: 2309374 - DNA, 23 bp, Homo sapiens
aaaagctttagattgaaatttat

SEQ ID NO: 2309375 - DNA, 22 bp, Homo sapiens
aaaagtaatgtatatctgtaat

SEQ ID NO: 2309376 - DNA, 13 bp, Homo sapiens
aaaagtagaaaaa

SEQ ID NO: 2309377 - DNA, 19 bp, Homo sapiens
gtgctcttatccccagctg

SEQ ID NO: 2309378 - DNA, 18 bp, Homo sapiens
gtgctcttctgttctcaa

SEQ ID NO: 2309379 - DNA, 16 bp, Homo sapiens
gtgctgaacgacagtc

SEQ ID NO: 2309380 - DNA, 21 bp, Homo sapiens
gtgctgggattacaggtgtga

SEQ ID NO: 2309381 - DNA, 12 bp, Homo sapiens
gtgcttcattgt

SEQ ID NO: 2309382 - DNA, 11 bp, Homo sapiens
gtgcttccttt

SEQ ID NO: 2309383 - DNA, 23 bp, Homo sapiens
gtgctttcatgtttaagaaatga

SEQ ID NO: 2309384 - DNA, 11 bp, Homo sapiens
gtgctttgccc

SEQ ID NO: 2309385 - DNA, 22 bp, Homo sapiens
gtggaaatatgcaacctgtgca

SEQ ID NO: 2309386 - DNA, 23 bp, Homo sapiens
gtggaaatatgcaacctgtgcaa

SEQ ID NO: 2309387 - DNA, 17 bp, Homo sapiens
gtggaaattcatgagag

SEQ ID NO: 2309388 - DNA, 16 bp, Homo sapiens
gtggaagacagagatg

SEQ ID NO: 2309389 - DNA, 21 bp, Homo sapiens
gtggaagacagagatggcaga

SEQ ID NO: 2309390 - DNA, 14 bp, Homo sapiens
gtggaagggcagga

SEQ ID NO: 2309391 - DNA, 15 bp, Homo sapiens
gtggaagggcaggag

SEQ ID NO: 2309392 - DNA, 13 bp, Homo sapiens
gtggacagcagct

SEQ ID NO: 2309393 - DNA, 14 bp, Homo sapiens
gtggacagcagctg

SEQ ID NO: 2309394 - DNA, 20 bp, Homo sapiens
gtggacccgcccgcggccct

SEQ ID NO: 2309395 - DNA, 12 bp, Homo sapiens
gtggaggatgga

SEQ ID NO: 2309396 - DNA, 17 bp, Homo sapiens
gtggagttcatcttgaa

SEQ ID NO: 2309397 - DNA, 15 bp, Homo sapiens
gtggcaacaggcggg

SEQ ID NO: 2309398 - DNA, 16 bp, Homo sapiens
gtggcatggtcctgtg

SEQ ID NO: 2309399 - DNA, 17 bp, Homo sapiens
gtggcatggtcctgtgc

SEQ ID NO: 2309400 - DNA, 22 bp, Homo sapiens
gtggcatggtcctgtgccccga

SEQ ID NO: 2309401 - DNA, 15 bp, Homo sapiens
gtggctcattctttt

SEQ ID NO: 2309402 - DNA, 17 bp, Homo sapiens
gtggctcattcttttca

SEQ ID NO: 2309403 - DNA, 15 bp, Homo sapiens
gtggctccaggagca

SEQ ID NO: 2309404 - DNA, 17 bp, Homo sapiens
gtggctccaggagcagc

SEQ ID NO: 2309405 - DNA, 16 bp, Homo sapiens
gtggctgaccaggccc

SEQ ID NO: 2309406 - DNA, 20 bp, Homo sapiens
gtggctgaccaggccctgct

SEQ ID NO: 2309407 - DNA, 21 bp, Homo sapiens
gtggctgatttcaaatgcagt

SEQ ID NO: 2309408 - DNA, 16 bp, Homo sapiens
gtggctgcttcaagga

SEQ ID NO: 2309409 - DNA, 22 bp, Homo sapiens
gtggctgcttcaaggatcctga

SEQ ID NO: 2309410 - DNA, 21 bp, Homo sapiens
gtggctgtcctcttaagacac

SEQ ID NO: 2309411 - DNA, 13 bp, Homo sapiens
gtggcttcagccc

SEQ ID NO: 2309412 - DNA, 16 bp, Homo sapiens
gtggcttcagcccctg

SEQ ID NO: 2309413 - DNA, 15 bp, Homo sapiens
gtggctttcatttct

SEQ ID NO: 2309414 - DNA, 14 bp, Homo sapiens
gtgggaggaggcct

SEQ ID NO: 2309415 - DNA, 15 bp, Homo sapiens
gtgggagggggcagg

SEQ ID NO: 2309416 - DNA, 13 bp, Homo sapiens
gtgggattattca

SEQ ID NO: 2309417 - DNA, 17 bp, Homo sapiens
gtggggcccatggcccc

SEQ ID NO: 2309418 - DNA, 21 bp, Homo sapiens
gtggggcccatggccccagct

SEQ ID NO: 2309419 - DNA, 12 bp, Homo sapiens
gtgggggtggcc

SEQ ID NO: 2309420 - DNA, 23 bp, Homo sapiens
gtgggtatttcttatttgaaagt

SEQ ID NO: 2309421 - DNA, 17 bp, Homo sapiens
gtggtcagcgattcctg

SEQ ID NO: 2309422 - DNA, 21 bp, Homo sapiens
gtggtgagaggcatccagtat

SEQ ID NO: 2309423 - DNA, 15 bp, Homo sapiens
gtggtgatgcctaaa

SEQ ID NO: 2309424 - DNA, 22 bp, Homo sapiens
gtggtggcagtgcagcaaccag

SEQ ID NO: 2309425 - DNA, 18 bp, Homo sapiens
gtggtgtgaggcccccgg

SEQ ID NO: 2309426 - DNA, 18 bp, Homo sapiens
gtggtgtgatcccagctc

SEQ ID NO: 2309427 - DNA, 11 bp, Homo sapiens
gtgtaactgtt

SEQ ID NO: 2309428 - DNA, 18 bp, Homo sapiens
gtgtacagaaacaactgc

SEQ ID NO: 2309429 - DNA, 20 bp, Homo sapiens
gtgtactatggctgtatttt

SEQ ID NO: 2309430 - DNA, 12 bp, Homo sapiens
gtgtactgtata

SEQ ID NO: 2309431 - DNA, 22 bp, Homo sapiens
gtgtattctgtggattctatat

SEQ ID NO: 2309432 - DNA, 15 bp, Homo sapiens
gtgtcaagcttcctg

SEQ ID NO: 2309433 - DNA, 23 bp, Homo sapiens
gtgtcactaagaatataaatatt

SEQ ID NO: 2309434 - DNA, 12 bp, Homo sapiens
gtgtccacagtg

SEQ ID NO: 2309435 - DNA, 21 bp, Homo sapiens
gtgtccacagtgattagcctc

SEQ ID NO: 2309436 - DNA, 18 bp, Homo sapiens
gtgtccctttcacactgt

SEQ ID NO: 2309437 - DNA, 14 bp, Homo sapiens
gtgtcctcatctat

SEQ ID NO: 2309438 - DNA, 20 bp, Homo sapiens
gtgtctatgaactagagact

SEQ ID NO: 2309439 - DNA, 18 bp, Homo sapiens
gtgtctggtgagggtcct

SEQ ID NO: 2309440 - DNA, 22 bp, Homo sapiens
gtgtgaagtccacttatgtaga

SEQ ID NO: 2309441 - DNA, 15 bp, Homo sapiens
gtgtgatcccagctc

SEQ ID NO: 2309442 - DNA, 21 bp, Homo sapiens
gtgtgctcttatccccagctg

SEQ ID NO: 2309443 - DNA, 15 bp, Homo sapiens
gtgtgcttatgtttt

SEQ ID NO: 2309444 - DNA, 20 bp, Homo sapiens
gtgtggcgggaagggtgggc

SEQ ID NO: 2309445 - DNA, 22 bp, Homo sapiens
gtgtggcgggaagggtgggccc

SEQ ID NO: 2309446 - DNA, 12 bp, Homo sapiens
gtgttctcagag

SEQ ID NO: 2309447 - DNA, 17 bp, Homo sapiens
gtgttctttttaaaaag

SEQ ID NO: 2309448 - DNA, 17 bp, Homo sapiens
gtgttgcccaggctggt

SEQ ID NO: 2309449 - DNA, 20 bp, Homo sapiens
gtgttgcccaggctggtctt

SEQ ID NO: 2309450 - DNA, 15 bp, Homo sapiens
gtgttgggtggagga

SEQ ID NO: 2309451 - DNA, 12 bp, Homo sapiens
gtgttgttttct

SEQ ID NO: 2309452 - DNA, 15 bp, Homo sapiens
gtgttgttttctctg

SEQ ID NO: 2309453 - DNA, 16 bp, Homo sapiens
gtgttgttttctctga

SEQ ID NO: 2309454 - DNA, 14 bp, Homo sapiens
gtgttttcctaaac

SEQ ID NO: 2309455 - DNA, 13 bp, Homo sapiens
gtgttttgggttt

SEQ ID NO: 2309456 - DNA, 18 bp, Homo sapiens
gtgtttttttgaggggaa

SEQ ID NO: 2309457 - DNA, 13 bp, Homo sapiens
gttaaaaaccatt

SEQ ID NO: 2309458 - DNA, 17 bp, Homo sapiens
gttaaacccttctgtct

SEQ ID NO: 2309459 - DNA, 17 bp, Homo sapiens
gttaaagagacaaatag

SEQ ID NO: 2309460 - DNA, 21 bp, Homo sapiens
gttaaagaggcgtcttgtatt

SEQ ID NO: 2309461 - DNA, 21 bp, Homo sapiens
gttaacccagtgttcagcata

SEQ ID NO: 2309462 - DNA, 14 bp, Homo sapiens
gttaagggcagagt

SEQ ID NO: 2309463 - DNA, 18 bp, Homo sapiens
gttaatacgcaggcatct

SEQ ID NO: 2309464 - DNA, 18 bp, Homo sapiens
gttaatcatgggttcctc

SEQ ID NO: 2309465 - DNA, 18 bp, Homo sapiens
gttaatgatggcagagga

SEQ ID NO: 2309466 - DNA, 16 bp, Homo sapiens
gttacaggtgtactat

SEQ ID NO: 2309467 - DNA, 14 bp, Homo sapiens
gttagcaggaaata

SEQ ID NO: 2309468 - DNA, 18 bp, Homo sapiens
gttagcccggccaaggac

SEQ ID NO: 2309469 - DNA, 23 bp, Homo sapiens
gttagcccggccaaggacactga

SEQ ID NO: 2309470 - DNA, 15 bp, Homo sapiens
gttaggaacccggca

SEQ ID NO: 2309471 - DNA, 17 bp, Homo sapiens
gttaggggaaaatagta

SEQ ID NO: 2309472 - DNA, 16 bp, Homo sapiens
gttatagttgatatgt

SEQ ID NO: 2309473 - DNA, 22 bp, Homo sapiens
gttgtgattccccggagctggg

SEQ ID NO: 2309474 - DNA, 23 bp, Homo sapiens
gttgtgattccccggagctggga

SEQ ID NO: 2309475 - DNA, 14 bp, Homo sapiens
gttgttaaatgcta

SEQ ID NO: 2309476 - DNA, 16 bp, Homo sapiens
gttgttaaatgctatg

SEQ ID NO: 2309477 - DNA, 13 bp, Homo sapiens
gttgttttctctg

SEQ ID NO: 2309478 - DNA, 12 bp, Homo sapiens
gtttaaaaatat

SEQ ID NO: 2309479 - DNA, 16 bp, Homo sapiens
gtttaacagatattta

SEQ ID NO: 2309480 - DNA, 19 bp, Homo sapiens
gtttaagaaatgagaaatt

SEQ ID NO: 2309481 - DNA, 15 bp, Homo sapiens
gtttataggaaataa

SEQ ID NO: 2309482 - DNA, 21 bp, Homo sapiens
gtttattatagtctgtacttc

SEQ ID NO: 2309483 - DNA, 15 bp, Homo sapiens
gtttcacatatttgt

SEQ ID NO: 2309484 - DNA, 20 bp, Homo sapiens
gtttcaggcaaggcagctcc

SEQ ID NO: 2309485 - DNA, 17 bp, Homo sapiens
gtttcatgaagaaaaaa

SEQ ID NO: 2309486 - DNA, 23 bp, Homo sapiens
gtttcattactgcccagatgttt

SEQ ID NO: 2309487 - DNA, 16 bp, Homo sapiens
gtttccacacaggccc

SEQ ID NO: 2309488 - DNA, 17 bp, Homo sapiens
gtttccacacaggccca

SEQ ID NO: 2309489 - DNA, 23 bp, Homo sapiens
gtttccacacaggcccatgccct

SEQ ID NO: 2309490 - DNA, 18 bp, Homo sapiens
gtttccaggcatgaccct

SEQ ID NO: 2309491 - DNA, 20 bp, Homo sapiens
gtttccaggcatgaccctgg

SEQ ID NO: 2309492 - DNA, 22 bp, Homo sapiens
gtttccaggcatgaccctggag

SEQ ID NO: 2309493 - DNA, 21 bp, Homo sapiens
gtttctatagcgagacataga

SEQ ID NO: 2309494 - DNA, 19 bp, Homo sapiens
gtttcttgcttgtacctct

SEQ ID NO: 2309495 - DNA, 23 bp, Homo sapiens
gtttcttgctttgaatgcatgtg

SEQ ID NO: 2309496 - DNA, 18 bp, Homo sapiens
gtttgatgactaaaagtg

SEQ ID NO: 2309497 - DNA, 17 bp, Homo sapiens
gtttgcattccagcgtc

SEQ ID NO: 2309498 - DNA, 13 bp, Homo sapiens
gtttgctaagtga

SEQ ID NO: 2309499 - DNA, 15 bp, Homo sapiens
gtttgcttgaatgct

SEQ ID NO: 2309500 - DNA, 13 bp, Homo sapiens
gtttgggcagagc

SEQ ID NO: 2309501 - DNA, 14 bp, Homo sapiens
gtttgtaaatgtta

SEQ ID NO: 2309502 - DNA, 19 bp, Homo sapiens
gtttgtaaatgttatttct

SEQ ID NO: 2309503 - DNA, 18 bp, Homo sapiens
gttttactgatatggttc

SEQ ID NO: 2309504 - DNA, 13 bp, Homo sapiens
gttttagagataa

SEQ ID NO: 2309505 - DNA, 16 bp, Homo sapiens
gttttagtttcaaaat

SEQ ID NO: 2309506 - DNA, 17 bp, Homo sapiens
gttttatgtcatactct

SEQ ID NO: 2309507 - DNA, 11 bp, Homo sapiens
gttttcttttt

SEQ ID NO: 2309508 - DNA, 13 bp, Homo sapiens
gttttgaggcggg

SEQ ID NO: 2309509 - DNA, 22 bp, Homo sapiens
gtttttaaaaaaaatattctgt

SEQ ID NO: 2309510 - DNA, 22 bp, Homo sapiens
gtttttagaggggcaaaaatat

SEQ ID NO: 2309511 - DNA, 21 bp, Homo sapiens
gtttttgaagaagggaaattc

SEQ ID NO: 2309512 - DNA, 21 bp, Homo sapiens
gtttttggatctggcattgaa

SEQ ID NO: 2309513 - DNA, 17 bp, Homo sapiens
taaaaaaaatattctgt

SEQ ID NO: 2309514 - DNA, 16 bp, Homo sapiens
taaaaaagaagaggtt

SEQ ID NO: 2309515 - DNA, 18 bp, Homo sapiens
taaaaaataacatattct

SEQ ID NO: 2309516 - DNA, 12 bp, Homo sapiens
taaaaaatgaat

SEQ ID NO: 2309517 - DNA, 21 bp, Homo sapiens
taaaaaatttaaaaagcccaa

SEQ ID NO: 2309518 - DNA, 12 bp, Homo sapiens
taaaaacatttt

SEQ ID NO: 2309519 - DNA, 13 bp, Homo sapiens
taaaaacatttta

SEQ ID NO: 2309520 - DNA, 20 bp, Homo sapiens
taaaaacattttaaaatcaa

SEQ ID NO: 2309521 - DNA, 16 bp, Homo sapiens
taaaaagcccaacctc

SEQ ID NO: 2309522 - DNA, 20 bp, Homo sapiens
taaaaagcccaacctcttcc

SEQ ID NO: 2309523 - DNA, 15 bp, Homo sapiens
taaaaagttgcacat

SEQ ID NO: 2309524 - DNA, 11 bp, Homo sapiens
taaaaataatt

SEQ ID NO: 2309525 - DNA, 10 bp, Homo sapiens
taaaaatatt

SEQ ID NO: 2309526 - DNA, 16 bp, Homo sapiens
taaaaatctttcagaa

SEQ ID NO: 2309527 - DNA, 14 bp, Homo sapiens
taaaaattccacca

SEQ ID NO: 2309528 - DNA, 17 bp, Homo sapiens
taaaacacaacatcttt

SEQ ID NO: 2309529 - DNA, 14 bp, Homo sapiens
taaaacaggctgct

SEQ ID NO: 2309530 - DNA, 22 bp, Homo sapiens
taaaacccctaggtcatttgta

SEQ ID NO: 2309531 - DNA, 14 bp, Homo sapiens
taaaaccttactta

SEQ ID NO: 2309532 - DNA, 16 bp, Homo sapiens
taaaagcagggcagca

SEQ ID NO: 2309533 - DNA, 13 bp, Homo sapiens
taaaataaattat

SEQ ID NO: 2309534 - DNA, 19 bp, Homo sapiens
taaaatacataaaagaatg

SEQ ID NO: 2309535 - DNA, 20 bp, Homo sapiens
taaaataggtgcattgtcct

SEQ ID NO: 2309536 - DNA, 18 bp, Homo sapiens
taaaatagtttaaaaata

SEQ ID NO: 2309537 - DNA, 21 bp, Homo sapiens
taaaatagtttaaaaatattc

SEQ ID NO: 2309538 - DNA, 20 bp, Homo sapiens
taaaatatacaaacatgtgg

SEQ ID NO: 2309539 - DNA, 14 bp, Homo sapiens
taaaatgagttacc

SEQ ID NO: 2309540 - DNA, 21 bp, Homo sapiens
taaaatgctattttaaaattc

SEQ ID NO: 2309541 - DNA, 13 bp, Homo sapiens
taaaatggtcatg

SEQ ID NO: 2309542 - DNA, 14 bp, Homo sapiens
taaaatgtttacat

SEQ ID NO: 2309543 - DNA, 20 bp, Homo sapiens
taaaatgtttacattttctt

SEQ ID NO: 2309544 - DNA, 21 bp, Homo sapiens
taaaattagtgagatttgtat

SEQ ID NO: 2309545 - DNA, 22 bp, Homo sapiens
taaaattagtgagatttgtatt

SEQ ID NO: 2309546 - DNA, 13 bp, Homo sapiens
taaaattcaacaa

SEQ ID NO: 2309547 - DNA, 16 bp, Homo sapiens
taaaattcatggaact

SEQ ID NO: 2309548 - DNA, 22 bp, Homo sapiens
taaaattcatggaactttcata

SEQ ID NO: 2309549 - DNA, 13 bp, Homo sapiens
taaaattctagtc

SEQ ID NO: 2309550 - DNA, 19 bp, Homo sapiens
taaaattctagtctctgat

SEQ ID NO: 2309551 - DNA, 20 bp, Homo sapiens
taaaattctagtctctgatt

SEQ ID NO: 2309552 - DNA, 17 bp, Homo sapiens
taaaattgttatttcaa

SEQ ID NO: 2309553 - DNA, 22 bp, Homo sapiens
taaacacacttttctttttaaa

SEQ ID NO: 2309554 - DNA, 23 bp, Homo sapiens
taaacacacttttctttttaaat

SEQ ID NO: 2309555 - DNA, 12 bp, Homo sapiens
taaaccaatcat

SEQ ID NO: 2309556 - DNA, 20 bp, Homo sapiens
taaaccataaaataaataat

SEQ ID NO: 2309557 - DNA, 18 bp, Homo sapiens
taaacgatatatgtaaat

SEQ ID NO: 2309558 - DNA, 23 bp, Homo sapiens
taaacgatatatgtaaatataca

SEQ ID NO: 2309559 - DNA, 16 bp, Homo sapiens
taaactctgaaatcag

SEQ ID NO: 2309560 - DNA, 19 bp, Homo sapiens
taaactgaaatttgctata

SEQ ID NO: 2309561 - DNA, 13 bp, Homo sapiens
taaactgatgtat

SEQ ID NO: 2309562 - DNA, 19 bp, Homo sapiens
taaactgatgtatagcttt

SEQ ID NO: 2309563 - DNA, 16 bp, Homo sapiens
taaactgttttcatgt

SEQ ID NO: 2309564 - DNA, 18 bp, Homo sapiens
taaactgttttcatgtgt

SEQ ID NO: 2309565 - DNA, 20 bp, Homo sapiens
taaacttcagagttctctgt

SEQ ID NO: 2309566 - DNA, 22 bp, Homo sapiens
taaagaaaaaaatagttttaca

SEQ ID NO: 2309567 - DNA, 23 bp, Homo sapiens
taaagaaaaaaatagttttacat

SEQ ID NO: 2309568 - DNA, 13 bp, Homo sapiens
taaagaaacactt

SEQ ID NO: 2309569 - DNA, 17 bp, Homo sapiens
taaagaaacactttctt

SEQ ID NO: 2309570 - DNA, 21 bp, Homo sapiens
taaagaagaagtggatctaaa

SEQ ID NO: 2309571 - DNA, 18 bp, Homo sapiens
taaagaatgttttggaat

SEQ ID NO: 2309572 - DNA, 22 bp, Homo sapiens
taaagacatttaaaatagtttt

SEQ ID NO: 2309573 - DNA, 16 bp, Homo sapiens
taaagagacaaatagt

SEQ ID NO: 2309574 - DNA, 18 bp, Homo sapiens
taaagaggcgtcttgtat

SEQ ID NO: 2309575 - DNA, 17 bp, Homo sapiens
taaatgctttaaatagt

SEQ ID NO: 2309576 - DNA, 21 bp, Homo sapiens
taaatggttccgctaatctct

SEQ ID NO: 2309577 - DNA, 17 bp, Homo sapiens
taaatgtgcttcattgt

SEQ ID NO: 2309578 - DNA, 19 bp, Homo sapiens
taaatgtgcttcattgttt

SEQ ID NO: 2309579 - DNA, 12 bp, Homo sapiens
taaatgtgtaaa

SEQ ID NO: 2309580 - DNA, 17 bp, Homo sapiens
taaatgtgtaaatgtgg

SEQ ID NO: 2309581 - DNA, 23 bp, Homo sapiens
taaatgtttcatgaagaaaaaat

SEQ ID NO: 2309582 - DNA, 14 bp, Homo sapiens
taaatgtttctttt

SEQ ID NO: 2309583 - DNA, 17 bp, Homo sapiens
taaatgtttctttttct

SEQ ID NO: 2309584 - DNA, 21 bp, Homo sapiens
taaattataaatgtttcatga

SEQ ID NO: 2309585 - DNA, 21 bp, Homo sapiens
taaattataatgcatctaaac

SEQ ID NO: 2309586 - DNA, 19 bp, Homo sapiens
taaatttaatatactgcat

SEQ ID NO: 2309587 - DNA, 20 bp, Homo sapiens
taaatttggggacagattca

SEQ ID NO: 2309588 - DNA, 15 bp, Homo sapiens
taaattttaatgtaa

SEQ ID NO: 2309589 - DNA, 15 bp, Homo sapiens
taaattttataatgt

SEQ ID NO: 2309590 - DNA, 22 bp, Homo sapiens
taacaaactgaaaaatctagac

SEQ ID NO: 2309591 - DNA, 18 bp, Homo sapiens
taacaacaacttaatgtg

SEQ ID NO: 2309592 - DNA, 17 bp, Homo sapiens
taacagatatttaaatt

SEQ ID NO: 2309593 - DNA, 19 bp, Homo sapiens
taacagatatttaaattta

SEQ ID NO: 2309594 - DNA, 21 bp, Homo sapiens
taacagatgatccatttgaac

SEQ ID NO: 2309595 - DNA, 14 bp, Homo sapiens
taacataaacttgt

SEQ ID NO: 2309596 - DNA, 17 bp, Homo sapiens
taacatagcacagtatt

SEQ ID NO: 2309597 - DNA, 19 bp, Homo sapiens
taacatattcttgctttca

SEQ ID NO: 2309598 - DNA, 15 bp, Homo sapiens
taacatctgaaaaga

SEQ ID NO: 2309599 - DNA, 17 bp, Homo sapiens
taacatctgaaaagaaa

SEQ ID NO: 2309600 - DNA, 14 bp, Homo sapiens
taacatggaagtac

SEQ ID NO: 2309601 - DNA, 15 bp, Homo sapiens
taacatgtctaaagt

SEQ ID NO: 2309602 - DNA, 12 bp, Homo sapiens
taacatttcaca

SEQ ID NO: 2309603 - DNA, 13 bp, Homo sapiens
taacatttcacag

SEQ ID NO: 2309604 - DNA, 21 bp, Homo sapiens
taaccatatgattgaaaagaa

SEQ ID NO: 2309605 - DNA, 22 bp, Homo sapiens
taaccatatgattgaaaagaag

SEQ ID NO: 2309606 - DNA, 15 bp, Homo sapiens
taaccattggaatgg

SEQ ID NO: 2309607 - DNA, 13 bp, Homo sapiens
taacccagtgttc

SEQ ID NO: 2309608 - DNA, 19 bp, Homo sapiens
taacccagtgttcagcata

SEQ ID NO: 2309609 - DNA, 12 bp, Homo sapiens
taacctgtgaat

SEQ ID NO: 2309610 - DNA, 15 bp, Homo sapiens
taactagatctcctg

SEQ ID NO: 2309611 - DNA, 19 bp, Homo sapiens
taactgatgagatacattt

SEQ ID NO: 2309612 - DNA, 11 bp, Homo sapiens
taactggcccc

SEQ ID NO: 2309613 - DNA, 19 bp, Homo sapiens
taactgtccagtccagtga

SEQ ID NO: 2309614 - DNA, 15 bp, Homo sapiens
taactgttaacccag

SEQ ID NO: 2309615 - DNA, 20 bp, Homo sapiens
taactgttctttgcagtgaa

SEQ ID NO: 2309616 - DNA, 15 bp, Homo sapiens
taacttggctaacat

SEQ ID NO: 2309617 - DNA, 13 bp, Homo sapiens
taagaaaaatcat

SEQ ID NO: 2309618 - DNA, 22 bp, Homo sapiens
taagaaatgagaaattgtgcca

SEQ ID NO: 2309619 - DNA, 20 bp, Homo sapiens
taagaataaataaagaagaa

SEQ ID NO: 2309620 - DNA, 18 bp, Homo sapiens
taagacagttgggatcca

SEQ ID NO: 2309621 - DNA, 16 bp, Homo sapiens
taagacgacttatata

SEQ ID NO: 2309622 - DNA, 18 bp, Homo sapiens
taagaggtactaaaaaca

SEQ ID NO: 2309623 - DNA, 17 bp, Homo sapiens
taagattatatacaaag

SEQ ID NO: 2309624 - DNA, 21 bp, Homo sapiens
taagattatatacaaagctgt

SEQ ID NO: 2309625 - DNA, 16 bp, Homo sapiens
taagattgtacatatg

SEQ ID NO: 2309626 - DNA, 18 bp, Homo sapiens
taagattgtacatatgga

SEQ ID NO: 2309627 - DNA, 19 bp, Homo sapiens
taagcgttaagggcagagt

SEQ ID NO: 2309628 - DNA, 15 bp, Homo sapiens
taaggaagaataaaa

SEQ ID NO: 2309629 - DNA, 17 bp, Homo sapiens
taaggcaggtgggcaga

SEQ ID NO: 2309630 - DNA, 19 bp, Homo sapiens
taagggatccagagacctg

SEQ ID NO: 2309631 - DNA, 20 bp, Homo sapiens
taaggtaccaagatcacaaa

SEQ ID NO: 2309632 - DNA, 17 bp, Homo sapiens
taaggtcagctcagagc

SEQ ID NO: 2309633 - DNA, 12 bp, Homo sapiens
taagtccagctc

SEQ ID NO: 2309634 - DNA, 13 bp, Homo sapiens
taagttatttgtc

SEQ ID NO: 2309635 - DNA, 20 bp, Homo sapiens
taataacaacaacttaatgt

SEQ ID NO: 2309636 - DNA, 14 bp, Homo sapiens
taataataataaca

SEQ ID NO: 2309637 - DNA, 17 bp, Homo sapiens
taataattacttaatgt

SEQ ID NO: 2309638 - DNA, 22 bp, Homo sapiens
taatacgcaggcatctgatttg

SEQ ID NO: 2309639 - DNA, 14 bp, Homo sapiens
taatacttccttat

SEQ ID NO: 2309640 - DNA, 19 bp, Homo sapiens
taatagtaatggttctaga

SEQ ID NO: 2309641 - DNA, 14 bp, Homo sapiens
taatatactgcata

SEQ ID NO: 2309642 - DNA, 15 bp, Homo sapiens
taatatagaaagaaa

SEQ ID NO: 2309643 - DNA, 20 bp, Homo sapiens
taatatatatatatatcagt

SEQ ID NO: 2309644 - DNA, 22 bp, Homo sapiens
taatatatatatatatcagttt

SEQ ID NO: 2309645 - DNA, 12 bp, Homo sapiens
taatatcttgaa

SEQ ID NO: 2309646 - DNA, 12 bp, Homo sapiens
taatatgtactt

SEQ ID NO: 2309647 - DNA, 14 bp, Homo sapiens
taatatgtactttt

SEQ ID NO: 2309648 - DNA, 16 bp, Homo sapiens
taatatgtacttttcc

SEQ ID NO: 2309649 - DNA, 18 bp, Homo sapiens
taatatgtacttttccat

SEQ ID NO: 2309650 - DNA, 21 bp, Homo sapiens
taatatgtacttttccattta

SEQ ID NO: 2309651 - DNA, 14 bp, Homo sapiens
taatattacatttc

SEQ ID NO: 2309652 - DNA, 20 bp, Homo sapiens
taatattacatttcatttat

SEQ ID NO: 2309653 - DNA, 15 bp, Homo sapiens
taatattttgtatta

SEQ ID NO: 2309654 - DNA, 14 bp, Homo sapiens
taatcatttatctt

SEQ ID NO: 2309655 - DNA, 15 bp, Homo sapiens
taatctctaaaattc

SEQ ID NO: 2309656 - DNA, 13 bp, Homo sapiens
taatctctgatta

SEQ ID NO: 2309657 - DNA, 19 bp, Homo sapiens
taatgaatgcaaaaagata

SEQ ID NO: 2309658 - DNA, 15 bp, Homo sapiens
taatgatcttccaaa

SEQ ID NO: 2309659 - DNA, 19 bp, Homo sapiens
taatgattcaattaacata

SEQ ID NO: 2309660 - DNA, 17 bp, Homo sapiens
taatgcactcctgcccc

SEQ ID NO: 2309661 - DNA, 18 bp, Homo sapiens
taatgcttaacataaact

SEQ ID NO: 2309662 - DNA, 15 bp, Homo sapiens
taatggaattatgta

SEQ ID NO: 2309663 - DNA, 14 bp, Homo sapiens
taatggccaagtgt

SEQ ID NO: 2309664 - DNA, 20 bp, Homo sapiens
taatggccaagtgtacattt

SEQ ID NO: 2309665 - DNA, 19 bp, Homo sapiens
taatggggactctccaggc

SEQ ID NO: 2309666 - DNA, 21 bp, Homo sapiens
taatggtatctgttactccaa

SEQ ID NO: 2309667 - DNA, 19 bp, Homo sapiens
taatgtaaaattcatagca

SEQ ID NO: 2309668 - DNA, 15 bp, Homo sapiens
taatgtaatcattta

SEQ ID NO: 2309669 - DNA, 20 bp, Homo sapiens
taatgtagacagactttgta

SEQ ID NO: 2309670 - DNA, 18 bp, Homo sapiens
taatgtatcttatttata

SEQ ID NO: 2309671 - DNA, 14 bp, Homo sapiens
taatgtgctgctgc

SEQ ID NO: 2309672 - DNA, 16 bp, Homo sapiens
taatgtgtcaaagaga

SEQ ID NO: 2309673 - DNA, 19 bp, Homo sapiens
taatgtttccctcaagaac

SEQ ID NO: 2309674 - DNA, 14 bp, Homo sapiens
taattaaaaaatag

SEQ ID NO: 2309675 - DNA, 18 bp, Homo sapiens
taattacattaaaatgga

SEQ ID NO: 2309676 - DNA, 15 bp, Homo sapiens
taattacttaatgtg

SEQ ID NO: 2309677 - DNA, 15 bp, Homo sapiens
taattactttcagaa

SEQ ID NO: 2309678 - DNA, 22 bp, Homo sapiens
taattagctatatttttatata

SEQ ID NO: 2309679 - DNA, 15 bp, Homo sapiens
taattcagctttgtc

SEQ ID NO: 2309680 - DNA, 18 bp, Homo sapiens
taattcatttaagaacaa

SEQ ID NO: 2309681 - DNA, 17 bp, Homo sapiens
taattcccatctgcttt

SEQ ID NO: 2309682 - DNA, 16 bp, Homo sapiens
taattctcattatgaa

SEQ ID NO: 2309683 - DNA, 12 bp, Homo sapiens
taattgggtgac

SEQ ID NO: 2309684 - DNA, 17 bp, Homo sapiens
taattgtggctttatga

SEQ ID NO: 2309685 - DNA, 16 bp, Homo sapiens
cccacacctgcctctg

SEQ ID NO: 2309686 - DNA, 19 bp, Homo sapiens
cccacacgccggggctggc

SEQ ID NO: 2309687 - DNA, 17 bp, Homo sapiens
cccacattgcccacacc

SEQ ID NO: 2309688 - DNA, 20 bp, Homo sapiens
cccacattgcccacacctgc

SEQ ID NO: 2309689 - DNA, 13 bp, Homo sapiens
cccacccacaccc

SEQ ID NO: 2309690 - DNA, 16 bp, Homo sapiens
cccacccacaccccgt

SEQ ID NO: 2309691 - DNA, 17 bp, Homo sapiens
cccacccgccccagaga

SEQ ID NO: 2309692 - DNA, 22 bp, Homo sapiens
cccaccctgcttctgctgcctg

SEQ ID NO: 2309693 - DNA, 23 bp, Homo sapiens
cccaccctgcttctgctgcctgt

SEQ ID NO: 2309694 - DNA, 14 bp, Homo sapiens
cccaccctgggcct

SEQ ID NO: 2309695 - DNA, 16 bp, Homo sapiens
cccacgcagagccccg

SEQ ID NO: 2309696 - DNA, 17 bp, Homo sapiens
cccacgcagagccccgg

SEQ ID NO: 2309697 - DNA, 19 bp, Homo sapiens
cccacgcagagccccggag

SEQ ID NO: 2309698 - DNA, 20 bp, Homo sapiens
cccacgcagagccccggagc

SEQ ID NO: 2309699 - DNA, 13 bp, Homo sapiens
cccacggccgtcc

SEQ ID NO: 2309700 - DNA, 21 bp, Homo sapiens
cccactgatatcacgggcccg

SEQ ID NO: 2309701 - DNA, 14 bp, Homo sapiens
cccactttcgcctc

SEQ ID NO: 2309702 - DNA, 15 bp, Homo sapiens
cccactttcgcctcc

SEQ ID NO: 2309703 - DNA, 16 bp, Homo sapiens
cccactttcgcctcct

SEQ ID NO: 2309704 - DNA, 19 bp, Homo sapiens
cccactttcgcctcctcca

SEQ ID NO: 2309705 - DNA, 17 bp, Homo sapiens
cccagaacgggcctccc

SEQ ID NO: 2309706 - DNA, 15 bp, Homo sapiens
cccagaatttcatac

SEQ ID NO: 2309707 - DNA, 15 bp, Homo sapiens
cccagagactgccca

SEQ ID NO: 2309708 - DNA, 18 bp, Homo sapiens
cccagagactgcccaccc

SEQ ID NO: 2309709 - DNA, 20 bp, Homo sapiens
cccagagactgcccaccctg

SEQ ID NO: 2309710 - DNA, 23 bp, Homo sapiens
cccagaggggcggggccaggatg

SEQ ID NO: 2309711 - DNA, 12 bp, Homo sapiens
cccagccccagc

SEQ ID NO: 2309712 - DNA, 16 bp, Homo sapiens
cccagccccctggccc

SEQ ID NO: 2309713 - DNA, 15 bp, Homo sapiens
cccagcctcccccag

SEQ ID NO: 2309714 - DNA, 18 bp, Homo sapiens
cccagcctcccccaggct

SEQ ID NO: 2309715 - DNA, 20 bp, Homo sapiens
cccagcctcccccaggctgc

SEQ ID NO: 2309716 - DNA, 23 bp, Homo sapiens
cccagcctcccccaggctgcgcc

SEQ ID NO: 2309717 - DNA, 16 bp, Homo sapiens
cccagcgagggcccca

SEQ ID NO: 2309718 - DNA, 20 bp, Homo sapiens
cccagcgtgaagccagggcc

SEQ ID NO: 2309719 - DNA, 12 bp, Homo sapiens
cccagctggcag

SEQ ID NO: 2309720 - DNA, 13 bp, Homo sapiens
cccagctggcagc

SEQ ID NO: 2309721 - DNA, 15 bp, Homo sapiens
cccagctggcagcgc

SEQ ID NO: 2309722 - DNA, 19 bp, Homo sapiens
cccagctggcagcgcctcc

SEQ ID NO: 2309723 - DNA, 13 bp, Homo sapiens
cccaggaccctga

SEQ ID NO: 2309724 - DNA, 15 bp, Homo sapiens
cccaggaccctgagg

SEQ ID NO: 2309725 - DNA, 17 bp, Homo sapiens
cccaggacggtctgtgc

SEQ ID NO: 2309726 - DNA, 18 bp, Homo sapiens
cccaggcggaggggcttg

SEQ ID NO: 2309727 - DNA, 13 bp, Homo sapiens
cccaggctgcgcc

SEQ ID NO: 2309728 - DNA, 14 bp, Homo sapiens
cccaggctgcgcct

SEQ ID NO: 2309729 - DNA, 17 bp, Homo sapiens
cccaggctgcgcctgcc

SEQ ID NO: 2309730 - DNA, 18 bp, Homo sapiens
cccaggctgcgcctgccc

SEQ ID NO: 2309731 - DNA, 19 bp, Homo sapiens
cccaggctgcgcctgcccg

SEQ ID NO: 2309732 - DNA, 13 bp, Homo sapiens
cccaggctggtct

SEQ ID NO: 2309733 - DNA, 15 bp, Homo sapiens
cccaggggaggcaca

SEQ ID NO: 2309734 - DNA, 13 bp, Homo sapiens
cccagggtgcagg

SEQ ID NO: 2309735 - DNA, 22 bp, Homo sapiens
cccagtggactcgcgagagggt

SEQ ID NO: 2309736 - DNA, 20 bp, Homo sapiens
cccagtgtccccaggggcac

SEQ ID NO: 2309737 - DNA, 17 bp, Homo sapiens
cccagttagcccggcca

SEQ ID NO: 2309738 - DNA, 19 bp, Homo sapiens
cccagttagcccggccaag

SEQ ID NO: 2309739 - DNA, 22 bp, Homo sapiens
cccatccctccccttgccacat

SEQ ID NO: 2309740 - DNA, 13 bp, Homo sapiens
cccatctgctgag

SEQ ID NO: 2309741 - DNA, 13 bp, Homo sapiens
cccatggccccag

SEQ ID NO: 2309742 - DNA, 16 bp, Homo sapiens
cccatggccccagctg

SEQ ID NO: 2309743 - DNA, 17 bp, Homo sapiens
cccatggccccagctgg

SEQ ID NO: 2309744 - DNA, 21 bp, Homo sapiens
cccatggtcacagacccctgg

SEQ ID NO: 2309745 - DNA, 13 bp, Homo sapiens
cccattcagcctc

SEQ ID NO: 2309746 - DNA, 19 bp, Homo sapiens
cccattctataaattcaac

SEQ ID NO: 2309747 - DNA, 12 bp, Homo sapiens
cccatttgtaat

SEQ ID NO: 2309748 - DNA, 13 bp, Homo sapiens
ccccaattcctct

SEQ ID NO: 2309749 - DNA, 13 bp, Homo sapiens
ccccacaccctgg

SEQ ID NO: 2309750 - DNA, 19 bp, Homo sapiens
ccccacacgccggggctgg

SEQ ID NO: 2309751 - DNA, 12 bp, Homo sapiens
ccccacagatcc

SEQ ID NO: 2309752 - DNA, 20 bp, Homo sapiens
ccccacgcttctggaggtgg

SEQ ID NO: 2309753 - DNA, 19 bp, Homo sapiens
ccccactttcgcctcctcc

SEQ ID NO: 2309754 - DNA, 16 bp, Homo sapiens
ccccagagactgccca

SEQ ID NO: 2309755 - DNA, 14 bp, Homo sapiens
ccccagccccatcc

SEQ ID NO: 2309756 - DNA, 16 bp, Homo sapiens
ccccagccccatccca

SEQ ID NO: 2309757 - DNA, 16 bp, Homo sapiens
ccccagcctcccccag

SEQ ID NO: 2309758 - DNA, 20 bp, Homo sapiens
ccccagcctcccccaggctg

SEQ ID NO: 2309759 - DNA, 22 bp, Homo sapiens
ccccagctggctgggtcgcccc

SEQ ID NO: 2309760 - DNA, 18 bp, Homo sapiens
ccccaggctgcgcctgcc

SEQ ID NO: 2309761 - DNA, 22 bp, Homo sapiens
ccccaggctgcgcctgcccgcc

SEQ ID NO: 2309762 - DNA, 14 bp, Homo sapiens
ccccaggggcacac

SEQ ID NO: 2309763 - DNA, 15 bp, Homo sapiens
ccccagggtgcaggc

SEQ ID NO: 2309764 - DNA, 16 bp, Homo sapiens
ccccagggtgcaggcg

SEQ ID NO: 2309765 - DNA, 20 bp, Homo sapiens
ccccagtgtccccaggggca

SEQ ID NO: 2309766 - DNA, 17 bp, Homo sapiens
ccccatccagccagggg

SEQ ID NO: 2309767 - DNA, 14 bp, Homo sapiens
ccccatccttcccg

SEQ ID NO: 2309768 - DNA, 21 bp, Homo sapiens
ccccatccttcccgcagcacc

SEQ ID NO: 2309769 - DNA, 14 bp, Homo sapiens
ccccatctgctgag

SEQ ID NO: 2309770 - DNA, 18 bp, Homo sapiens
ccccatggtcacagaccc

SEQ ID NO: 2309771 - DNA, 22 bp, Homo sapiens
ccccatggtcacagacccctgg

SEQ ID NO: 2309772 - DNA, 13 bp, Homo sapiens
ccccattctggga

SEQ ID NO: 2309773 - DNA, 14 bp, Homo sapiens
ccccattctgggac

SEQ ID NO: 2309774 - DNA, 14 bp, Homo sapiens
cccccaccctgctt

SEQ ID NO: 2309775 - DNA, 19 bp, Homo sapiens
cccccacggccgtccctga

SEQ ID NO: 2309776 - DNA, 12 bp, Homo sapiens
cccccagcctcc

SEQ ID NO: 2309777 - DNA, 21 bp, Homo sapiens
cccccagcctcccccaggctg

SEQ ID NO: 2309778 - DNA, 12 bp, Homo sapiens
cccccaggaccc

SEQ ID NO: 2309779 - DNA, 15 bp, Homo sapiens
cccccaggctgcgcc

SEQ ID NO: 2309780 - DNA, 18 bp, Homo sapiens
cccccaggctgcgcctgc

SEQ ID NO: 2309781 - DNA, 20 bp, Homo sapiens
cccccaggctgcgcctgccc

SEQ ID NO: 2309782 - DNA, 18 bp, Homo sapiens
cccccgccctcgctccgg

SEQ ID NO: 2309783 - DNA, 20 bp, Homo sapiens
cccccgctctgccatcagcc

SEQ ID NO: 2309784 - DNA, 15 bp, Homo sapiens
cccccggaggcgccc

SEQ ID NO: 2309785 - DNA, 17 bp, Homo sapiens
cccccggaggcgcccac

SEQ ID NO: 2309786 - DNA, 18 bp, Homo sapiens
cccccggaggcgcccacc

SEQ ID NO: 2309787 - DNA, 12 bp, Homo sapiens
ccccgcacccct

SEQ ID NO: 2309788 - DNA, 17 bp, Homo sapiens
ccccgcacccctcctcc

SEQ ID NO: 2309789 - DNA, 13 bp, Homo sapiens
ccccgcctcaagg

SEQ ID NO: 2309790 - DNA, 15 bp, Homo sapiens
ccccgcctcctccct

SEQ ID NO: 2309791 - DNA, 20 bp, Homo sapiens
ccccgcctcctccctgcctg

SEQ ID NO: 2309792 - DNA, 15 bp, Homo sapiens
ccccgctgcctggcg

SEQ ID NO: 2309793 - DNA, 21 bp, Homo sapiens
ccccgctgcctggcgggcagc

SEQ ID NO: 2309794 - DNA, 16 bp, Homo sapiens
ccccggacgctggctc

SEQ ID NO: 2309795 - DNA, 22 bp, Homo sapiens
ccccggaggcgcccacctgccc

SEQ ID NO: 2309796 - DNA, 21 bp, Homo sapiens
ccccggcccaacctcgccctc

SEQ ID NO: 2309797 - DNA, 18 bp, Homo sapiens
ccccgtcccggccccgcg

SEQ ID NO: 2309798 - DNA, 12 bp, Homo sapiens
ccccgtctgccc

SEQ ID NO: 2309799 - DNA, 22 bp, Homo sapiens
cccctaaagatggcgcacccgg

SEQ ID NO: 2309800 - DNA, 20 bp, Homo sapiens
cccctaggtcatttgtagat

SEQ ID NO: 2309801 - DNA, 17 bp, Homo sapiens
cccctcagaacaccctg

SEQ ID NO: 2309802 - DNA, 13 bp, Homo sapiens
cccctccccgcct

SEQ ID NO: 2309803 - DNA, 21 bp, Homo sapiens
cccctccccgcctcctccctg

SEQ ID NO: 2309804 - DNA, 13 bp, Homo sapiens
cccctcccgcttc

SEQ ID NO: 2309805 - DNA, 17 bp, Homo sapiens
cccctcccgcttcctcc

SEQ ID NO: 2309806 - DNA, 22 bp, Homo sapiens
catatgattgaaaagaagaaag

SEQ ID NO: 2309807 - DNA, 20 bp, Homo sapiens
catatgtagcattaaatata

SEQ ID NO: 2309808 - DNA, 21 bp, Homo sapiens
catatgtagcattaaatataa

SEQ ID NO: 2309809 - DNA, 22 bp, Homo sapiens
catatgtagcattaaatataaa

SEQ ID NO: 2309810 - DNA, 23 bp, Homo sapiens
catattatagctcctattaaatt

SEQ ID NO: 2309811 - DNA, 23 bp, Homo sapiens
catattcttgctttcacaaatat

SEQ ID NO: 2309812 - DNA, 22 bp, Homo sapiens
cattgcccacacctgcctctga

SEQ ID NO: 2309813 - DNA, 17 bp, Homo sapiens
cattgctgacagagccc

SEQ ID NO: 2309814 - DNA, 14 bp, Homo sapiens
cattggttacaaat

SEQ ID NO: 2309815 - DNA, 21 bp, Homo sapiens
cattggttacaaatttttact

SEQ ID NO: 2309816 - DNA, 20 bp, Homo sapiens
cattgtagagcacatttagt

SEQ ID NO: 2309817 - DNA, 18 bp, Homo sapiens
cattgtccttttcttttc

SEQ ID NO: 2309818 - DNA, 15 bp, Homo sapiens
cattgtgttttccta

SEQ ID NO: 2309819 - DNA, 15 bp, Homo sapiens
cattgttaaatgttc

SEQ ID NO: 2309820 - DNA, 20 bp, Homo sapiens
catttaaaatagttttctaa

SEQ ID NO: 2309821 - DNA, 22 bp, Homo sapiens
catttaaaatagttttctaaat

SEQ ID NO: 2309822 - DNA, 13 bp, Homo sapiens
catttaagaacaa

SEQ ID NO: 2309823 - DNA, 16 bp, Homo sapiens
catttacaacttccag

SEQ ID NO: 2309824 - DNA, 22 bp, Homo sapiens
catttacaacttccagatttga

SEQ ID NO: 2309825 - DNA, 17 bp, Homo sapiens
catttacctcgcagtgt

SEQ ID NO: 2309826 - DNA, 19 bp, Homo sapiens
catttagaacctgcattta

SEQ ID NO: 2309827 - DNA, 23 bp, Homo sapiens
catttagaacctgcatttaagaa

SEQ ID NO: 2309828 - DNA, 21 bp, Homo sapiens
catttagcattgaaataataa

SEQ ID NO: 2309829 - DNA, 19 bp, Homo sapiens
catttagtccaatgaagat

SEQ ID NO: 2309830 - DNA, 23 bp, Homo sapiens
catttatactgtagcaatatatt

SEQ ID NO: 2309831 - DNA, 15 bp, Homo sapiens
catttatcttatcta

SEQ ID NO: 2309832 - DNA, 15 bp, Homo sapiens
catttcacagtattt

SEQ ID NO: 2309833 - DNA, 23 bp, Homo sapiens
catttcacgggcaacactcactg

SEQ ID NO: 2309834 - DNA, 15 bp, Homo sapiens
catttcccctcccgc

SEQ ID NO: 2309835 - DNA, 19 bp, Homo sapiens
catttcccctcccgcttcc

SEQ ID NO: 2309836 - DNA, 20 bp, Homo sapiens
catttctaactaaggacagg

SEQ ID NO: 2309837 - DNA, 15 bp, Homo sapiens
catttctcttcctaa

SEQ ID NO: 2309838 - DNA, 18 bp, Homo sapiens
catttggccgagtcagca

SEQ ID NO: 2309839 - DNA, 15 bp, Homo sapiens
catttgtaatgtatc

SEQ ID NO: 2309840 - DNA, 21 bp, Homo sapiens
catttgtaatgtatcttattt

SEQ ID NO: 2309841 - DNA, 22 bp, Homo sapiens
catttgtaatgtatcttattta

SEQ ID NO: 2309842 - DNA, 15 bp, Homo sapiens
cattttactgtctgt

SEQ ID NO: 2309843 - DNA, 21 bp, Homo sapiens
cattttagaaacggacagctt

SEQ ID NO: 2309844 - DNA, 12 bp, Homo sapiens
cattttatgcta

SEQ ID NO: 2309845 - DNA, 15 bp, Homo sapiens
cattttctaaactgt

SEQ ID NO: 2309846 - DNA, 13 bp, Homo sapiens
cattttctttcat

SEQ ID NO: 2309847 - DNA, 23 bp, Homo sapiens
cattttggctcagagtccaatgt

SEQ ID NO: 2309848 - DNA, 16 bp, Homo sapiens
ccaaacccttcagtgc

SEQ ID NO: 2309849 - DNA, 17 bp, Homo sapiens
ccaaagaggcattcagc

SEQ ID NO: 2309850 - DNA, 18 bp, Homo sapiens
ccaaaggggcctctcctt

SEQ ID NO: 2309851 - DNA, 21 bp, Homo sapiens
ccaaataaaatgtttacattt

SEQ ID NO: 2309852 - DNA, 13 bp, Homo sapiens
ccaaataaatgtg

SEQ ID NO: 2309853 - DNA, 15 bp, Homo sapiens
ccaaataaatgtgta

SEQ ID NO: 2309854 - DNA, 16 bp, Homo sapiens
ccaaataaatgtgtaa

SEQ ID NO: 2309855 - DNA, 17 bp, Homo sapiens
ccaaataaatgtgtaaa

SEQ ID NO: 2309856 - DNA, 18 bp, Homo sapiens
ccaaataaatgtgtaaat

SEQ ID NO: 2309857 - DNA, 20 bp, Homo sapiens
ccaaataaatgtgtaaatgt

SEQ ID NO: 2309858 - DNA, 17 bp, Homo sapiens
ccaaatcctgggcatcc

SEQ ID NO: 2309859 - DNA, 22 bp, Homo sapiens
ccaaatcctgggcatccccagc

SEQ ID NO: 2309860 - DNA, 13 bp, Homo sapiens
ccaaattctctga

SEQ ID NO: 2309861 - DNA, 19 bp, Homo sapiens
ccaaattttccttcctgtt

SEQ ID NO: 2309862 - DNA, 19 bp, Homo sapiens
ccaacaggggctggagggc

SEQ ID NO: 2309863 - DNA, 20 bp, Homo sapiens
ccaacattttaaaaataaat

SEQ ID NO: 2309864 - DNA, 13 bp, Homo sapiens
ccaacctcttcct

SEQ ID NO: 2309865 - DNA, 14 bp, Homo sapiens
ccaacctcttcctc

SEQ ID NO: 2309866 - DNA, 15 bp, Homo sapiens
ccaacctcttcctcc

SEQ ID NO: 2309867 - DNA, 17 bp, Homo sapiens
ccaacctcttcctcctg

SEQ ID NO: 2309868 - DNA, 15 bp, Homo sapiens
ccaacctggaggctg

SEQ ID NO: 2309869 - DNA, 17 bp, Homo sapiens
ccaacctggaggctgga

SEQ ID NO: 2309870 - DNA, 18 bp, Homo sapiens
ccaactgtaatgcaggat

SEQ ID NO: 2309871 - DNA, 16 bp, Homo sapiens
ccaagcactaccagta

SEQ ID NO: 2309872 - DNA, 21 bp, Homo sapiens
ccaaggacactgatgggtcct

SEQ ID NO: 2309873 - DNA, 22 bp, Homo sapiens
ccaaggacactgatgggtcctg

SEQ ID NO: 2309874 - DNA, 22 bp, Homo sapiens
ccaaggagtctgattgcaggaa

SEQ ID NO: 2309875 - DNA, 12 bp, Homo sapiens
ccaagggcccag

SEQ ID NO: 2309876 - DNA, 13 bp, Homo sapiens
ccaagggcccaga

SEQ ID NO: 2309877 - DNA, 14 bp, Homo sapiens
ccaagggcccagag

SEQ ID NO: 2309878 - DNA, 13 bp, Homo sapiens
ccaataaaagtgt

SEQ ID NO: 2309879 - DNA, 18 bp, Homo sapiens
ccaatatcatgtgtagat

SEQ ID NO: 2309880 - DNA, 24 bp, Homo sapiens
ccaattaatgattcaattaacata

SEQ ID NO: 2309881 - DNA, 22 bp, Homo sapiens
ccacacacagcagctccaacct

SEQ ID NO: 2309882 - DNA, 11 bp, Homo sapiens
ccacacaggcc

SEQ ID NO: 2309883 - DNA, 13 bp, Homo sapiens
ccacacaggccca

SEQ ID NO: 2309884 - DNA, 17 bp, Homo sapiens
ccacaccccgtctgccc

SEQ ID NO: 2309885 - DNA, 14 bp, Homo sapiens
ccacacgccggggc

SEQ ID NO: 2309886 - DNA, 19 bp, Homo sapiens
ccacacgccggggctggcc

SEQ ID NO: 2309887 - DNA, 22 bp, Homo sapiens
ccacacgccggggctggccctg

SEQ ID NO: 2309888 - DNA, 17 bp, Homo sapiens
ccacacgtttgccaaat

SEQ ID NO: 2309889 - DNA, 18 bp, Homo sapiens
ccacagagtttttcagga

SEQ ID NO: 2309890 - DNA, 20 bp, Homo sapiens
ccacagtggggcccatggcc

SEQ ID NO: 2309891 - DNA, 23 bp, Homo sapiens
ccacagtggggcccatggcccca

SEQ ID NO: 2309892 - DNA, 16 bp, Homo sapiens
ccacatcgcagcccct

SEQ ID NO: 2309893 - DNA, 13 bp, Homo sapiens
ccacattctgctg

SEQ ID NO: 2309894 - DNA, 23 bp, Homo sapiens
ccacattgcataagtggacccag

SEQ ID NO: 2309895 - DNA, 17 bp, Homo sapiens
ccacccccgggtgcctg

SEQ ID NO: 2309896 - DNA, 13 bp, Homo sapiens
ccaccccgctgcc

SEQ ID NO: 2309897 - DNA, 14 bp, Homo sapiens
ccaccccgctgcct

SEQ ID NO: 2309898 - DNA, 18 bp, Homo sapiens
ccaccccgctgcctggcg

SEQ ID NO: 2309899 - DNA, 12 bp, Homo sapiens
ccaccccgtccc

SEQ ID NO: 2309900 - DNA, 14 bp, Homo sapiens
ccaccccgtcccgg

SEQ ID NO: 2309901 - DNA, 15 bp, Homo sapiens
ccaccccgtcccggc

SEQ ID NO: 2309902 - DNA, 22 bp, Homo sapiens
ccaccccgtcccggccccgcgc

SEQ ID NO: 2309903 - DNA, 19 bp, Homo sapiens
ccacccgccccagagactg

SEQ ID NO: 2309904 - DNA, 22 bp, Homo sapiens
ccacccgccccagagactgccc

SEQ ID NO: 2309905 - DNA, 21 bp, Homo sapiens
ccaccctctgctgcacagtag

SEQ ID NO: 2309906 - DNA, 13 bp, Homo sapiens
ccaccctgaggag

SEQ ID NO: 2309907 - DNA, 13 bp, Homo sapiens
ccaccctgggcct

SEQ ID NO: 2309908 - DNA, 13 bp, Homo sapiens
ccacctgcccagt

SEQ ID NO: 2309909 - DNA, 21 bp, Homo sapiens
ccacctgcccagttagcccgg

SEQ ID NO: 2309910 - DNA, 15 bp, Homo sapiens
ccacctgggagatgc

SEQ ID NO: 2309911 - DNA, 18 bp, Homo sapiens
ccacctgggagatgctgg

SEQ ID NO: 2309912 - DNA, 20 bp, Homo sapiens
ccacctgggagatgctggga

SEQ ID NO: 2309913 - DNA, 15 bp, Homo sapiens
ccacgcagagccccg

SEQ ID NO: 2309914 - DNA, 17 bp, Homo sapiens
ccacgcagagccccgga

SEQ ID NO: 2309915 - DNA, 16 bp, Homo sapiens
ccacgcttctggaggt

SEQ ID NO: 2309916 - DNA, 18 bp, Homo sapiens
ccacgggggcctagtggc

SEQ ID NO: 2309917 - DNA, 22 bp, Homo sapiens
ccacggggtcgggggaggagca

SEQ ID NO: 2309918 - DNA, 17 bp, Homo sapiens
ccacgtaagtcactgaa

SEQ ID NO: 2309919 - DNA, 15 bp, Homo sapiens
ccactcaagaccaaa

SEQ ID NO: 2309920 - DNA, 14 bp, Homo sapiens
ccactcctgggccc

SEQ ID NO: 2309921 - DNA, 21 bp, Homo sapiens
ccactctctcttgttcttact

SEQ ID NO: 2309922 - DNA, 22 bp, Homo sapiens
ccactgatatcacgggcccgct

SEQ ID NO: 2309923 - DNA, 13 bp, Homo sapiens
ccactttcgcctc

SEQ ID NO: 2309924 - DNA, 15 bp, Homo sapiens
ccactttcgcctcct

SEQ ID NO: 2309925 - DNA, 16 bp, Homo sapiens
ccactttcgcctcctc

SEQ ID NO: 2309926 - DNA, 20 bp, Homo sapiens
ccactttcgcctcctccagc

SEQ ID NO: 2309927 - DNA, 24 bp, Homo sapiens
ccactttcgcctcctccagctcct

SEQ ID NO: 2309928 - DNA, 18 bp, Homo sapiens
ccagaaatgccgctgtgt

SEQ ID NO: 2309929 - DNA, 19 bp, Homo sapiens
ccagaaatgccgctgtgtc

SEQ ID NO: 2309930 - DNA, 15 bp, Homo sapiens
ccagaacaaaagata

SEQ ID NO: 2309931 - DNA, 15 bp, Homo sapiens
ccagaacgccctgtg

SEQ ID NO: 2309932 - DNA, 14 bp, Homo sapiens
ccagaacgggcctc

SEQ ID NO: 2309933 - DNA, 14 bp, Homo sapiens
ccagacagagatca

SEQ ID NO: 2309934 - DNA, 15 bp, Homo sapiens
ccagacagagatcag

SEQ ID NO: 2309935 - DNA, 18 bp, Homo sapiens
ccagacagagatcagaat

SEQ ID NO: 2309936 - DNA, 12 bp, Homo sapiens
ccagaccccatc

SEQ ID NO: 2309937 - DNA, 15 bp, Homo sapiens
ccagaccccatccag

SEQ ID NO: 2309938 - DNA, 17 bp, Homo sapiens
ccagaccccatccagcc

SEQ ID NO: 2309939 - DNA, 21 bp, Homo sapiens
ccagaccccatccagccaggg

SEQ ID NO: 2309940 - DNA, 15 bp, Homo sapiens
ccagacctgggccct

SEQ ID NO: 2309941 - DNA, 15 bp, Homo sapiens
ccagactatgcagct

SEQ ID NO: 2309942 - DNA, 16 bp, Homo sapiens
ccagactcgagagggc

SEQ ID NO: 2309943 - DNA, 18 bp, Homo sapiens
ccagactcgagagggctg

SEQ ID NO: 2309944 - DNA, 18 bp, Homo sapiens
cccaacccccacctcccg

SEQ ID NO: 2309945 - DNA, 12 bp, Homo sapiens
cccaacctcgcc

SEQ ID NO: 2309946 - DNA, 14 bp, Homo sapiens
cccaacctcgccct

SEQ ID NO: 2309947 - DNA, 20 bp, Homo sapiens
cccaacctcgccctctctca

SEQ ID NO: 2309948 - DNA, 18 bp, Homo sapiens
cccaacctcttcctcctg

SEQ ID NO: 2309949 - DNA, 23 bp, Homo sapiens
cccaacctcttcctcctgacacc

SEQ ID NO: 2309950 - DNA, 17 bp, Homo sapiens
cccaagacttgacgcag

SEQ ID NO: 2309951 - DNA, 23 bp, Homo sapiens
cccaagtcttgagcaatgttttt

SEQ ID NO: 2309952 - DNA, 20 bp, Homo sapiens
cccaattttaaaaaataaca

SEQ ID NO: 2309953 - DNA, 19 bp, Homo sapiens
cccacaccccgtctgcccc

SEQ ID NO: 2309954 - DNA, 19 bp, Homo sapiens
aaattctagtctctgattt

SEQ ID NO: 2309955 - DNA, 21 bp, Homo sapiens
aaattctagtctgtttcatta

SEQ ID NO: 2309956 - DNA, 15 bp, Homo sapiens
aaattctataagaga

SEQ ID NO: 2309957 - DNA, 22 bp, Homo sapiens
aaattgcatttttacctttcat

SEQ ID NO: 2309958 - DNA, 21 bp, Homo sapiens
aaattggcctggtatggctgc

SEQ ID NO: 2309959 - DNA, 13 bp, Homo sapiens
aaattgtgccaaa

SEQ ID NO: 2309960 - DNA, 14 bp, Homo sapiens
aaattgtgccaaag

SEQ ID NO: 2309961 - DNA, 20 bp, Homo sapiens
aaattgtgttcttaaaatat

SEQ ID NO: 2309962 - DNA, 21 bp, Homo sapiens
aaattgtgttcttaaaatatt

SEQ ID NO: 2309963 - DNA, 19 bp, Homo sapiens
aaattgttaagagtatcat

SEQ ID NO: 2309964 - DNA, 17 bp, Homo sapiens
aaatttaactgcatata

SEQ ID NO: 2309965 - DNA, 18 bp, Homo sapiens
aaatttaattgtgtaact

SEQ ID NO: 2309966 - DNA, 19 bp, Homo sapiens
aaatttgatcccaatagaa

SEQ ID NO: 2309967 - DNA, 21 bp, Homo sapiens
aaatttggggacagattcagt

SEQ ID NO: 2309968 - DNA, 14 bp, Homo sapiens
aaatttttactcag

SEQ ID NO: 2309969 - DNA, 16 bp, Homo sapiens
aacaaaaaatattcat

SEQ ID NO: 2309970 - DNA, 19 bp, Homo sapiens
aacaaacaccttcttatta

SEQ ID NO: 2309971 - DNA, 22 bp, Homo sapiens
aacaaacctgtttctgcagcca

SEQ ID NO: 2309972 - DNA, 16 bp, Homo sapiens
aacaaactgaaaaatc

SEQ ID NO: 2309973 - DNA, 17 bp, Homo sapiens
aacaaactgaaaaatct

SEQ ID NO: 2309974 - DNA, 17 bp, Homo sapiens
aacaaaggatttgaaaa

SEQ ID NO: 2309975 - DNA, 12 bp, Homo sapiens
aacaaagtcttt

SEQ ID NO: 2309976 - DNA, 13 bp, Homo sapiens
aacaactctattt

SEQ ID NO: 2309977 - DNA, 13 bp, Homo sapiens
aacaactgccaaa

SEQ ID NO: 2309978 - DNA, 17 bp, Homo sapiens
aacaactgccaaataaa

SEQ ID NO: 2309979 - DNA, 18 bp, Homo sapiens
aacaagagcaaaactcag

SEQ ID NO: 2309980 - DNA, 21 bp, Homo sapiens
aacaagccaaacattcttatt

SEQ ID NO: 2309981 - DNA, 20 bp, Homo sapiens
aacaagccacgttgcagaaa

SEQ ID NO: 2309982 - DNA, 21 bp, Homo sapiens
aacaaggcaaggctgtcaatt

SEQ ID NO: 2309983 - DNA, 16 bp, Homo sapiens
aacaatgtaattacat

SEQ ID NO: 2309984 - DNA, 14 bp, Homo sapiens
aacaatttagccag

SEQ ID NO: 2309985 - DNA, 19 bp, Homo sapiens
aacaatttagccagaatgt

SEQ ID NO: 2309986 - DNA, 16 bp, Homo sapiens
aacacacagatctgca

SEQ ID NO: 2309987 - DNA, 15 bp, Homo sapiens
aacacacttagaata

SEQ ID NO: 2309988 - DNA, 15 bp, Homo sapiens
aacactaaagagcta

SEQ ID NO: 2309989 - DNA, 14 bp, Homo sapiens
aacactcacttaat

SEQ ID NO: 2309990 - DNA, 16 bp, Homo sapiens
aacactgcttaaggaa

SEQ ID NO: 2309991 - DNA, 19 bp, Homo sapiens
aacactggattcatttcat

SEQ ID NO: 2309992 - DNA, 14 bp, Homo sapiens
aacactgtgtattt

SEQ ID NO: 2309993 - DNA, 17 bp, Homo sapiens
aacacttattttctgaa

SEQ ID NO: 2309994 - DNA, 21 bp, Homo sapiens
aacacttattttctgaattca

SEQ ID NO: 2309995 - DNA, 14 bp, Homo sapiens
aacagaacagcaag

SEQ ID NO: 2309996 - DNA, 14 bp, Homo sapiens
aacagaccagcata

SEQ ID NO: 2309997 - DNA, 23 bp, Homo sapiens
aacagagtccgggagaatgctgg

SEQ ID NO: 2309998 - DNA, 13 bp, Homo sapiens
aacagatatttaa

SEQ ID NO: 2309999 - DNA, 15 bp, Homo sapiens
aacagcaagtatgaa

SEQ ID NO: 2310000 - DNA, 22 bp, Homo sapiens
aacagcaggggcattagtttca

SEQ ID NO: 2310001 - DNA, 18 bp, Homo sapiens
aacagcatgtctactgct

SEQ ID NO: 2310002 - DNA, 20 bp, Homo sapiens
aacaggaggtgtgaatgcac

SEQ ID NO: 2310003 - DNA, 15 bp, Homo sapiens
aacagggtttctcag

SEQ ID NO: 2310004 - DNA, 18 bp, Homo sapiens
aacagggtttctcagcct

SEQ ID NO: 2310005 - DNA, 19 bp, Homo sapiens
aacaggtgttcctcctccc

SEQ ID NO: 2310006 - DNA, 21 bp, Homo sapiens
aacagtctcattacagattta

SEQ ID NO: 2310007 - DNA, 16 bp, Homo sapiens
aacagtgaaagccctg

SEQ ID NO: 2310008 - DNA, 13 bp, Homo sapiens
aacagttttaaga

SEQ ID NO: 2310009 - DNA, 15 bp, Homo sapiens
aacataaaatataca

SEQ ID NO: 2310010 - DNA, 17 bp, Homo sapiens
aacataatgatactgaa

SEQ ID NO: 2310011 - DNA, 15 bp, Homo sapiens
aacatagatgctaca

SEQ ID NO: 2310012 - DNA, 15 bp, Homo sapiens
aacatagcacagtat

SEQ ID NO: 2310013 - DNA, 17 bp, Homo sapiens
aacatagcacagtattt

SEQ ID NO: 2310014 - DNA, 21 bp, Homo sapiens
aacatattcttgctttcacaa

SEQ ID NO: 2310015 - DNA, 12 bp, Homo sapiens
aacatctgaaaa

SEQ ID NO: 2310016 - DNA, 14 bp, Homo sapiens
aacatgagtttatg

SEQ ID NO: 2310017 - DNA, 22 bp, Homo sapiens
aacatgctatccaatctcatct

SEQ ID NO: 2310018 - DNA, 15 bp, Homo sapiens
aacatggaagtacta

SEQ ID NO: 2310019 - DNA, 19 bp, Homo sapiens
aacattgctttagacaaat

SEQ ID NO: 2310020 - DNA, 13 bp, Homo sapiens
aacattttaaaat

SEQ ID NO: 2310021 - DNA, 19 bp, Homo sapiens
aaccaaagatgcttaaaaa

SEQ ID NO: 2310022 - DNA, 19 bp, Homo sapiens
aaccaaattaacctttcag

SEQ ID NO: 2310023 - DNA, 24 bp, Homo sapiens
aaccaagttacacggggttacact

SEQ ID NO: 2310024 - DNA, 15 bp, Homo sapiens
aaccaatcatcttaa

SEQ ID NO: 2310025 - DNA, 18 bp, Homo sapiens
aaccagagtcagcacagg

SEQ ID NO: 2310026 - DNA, 15 bp, Homo sapiens
aaccagcactcccag

SEQ ID NO: 2310027 - DNA, 16 bp, Homo sapiens
aaccataaaataaata

SEQ ID NO: 2310028 - DNA, 14 bp, Homo sapiens
aaccatagaactgt

SEQ ID NO: 2310029 - DNA, 16 bp, Homo sapiens
aaccatagaactgtcc

SEQ ID NO: 2310030 - DNA, 21 bp, Homo sapiens
aaccatatgattgaaaagaag

SEQ ID NO: 2310031 - DNA, 12 bp, Homo sapiens
aaccatcattga

SEQ ID NO: 2310032 - DNA, 21 bp, Homo sapiens
aaccatcattgaaatcttttt

SEQ ID NO: 2310033 - DNA, 23 bp, Homo sapiens
aaccattttgctgtcccttttcc

SEQ ID NO: 2310034 - DNA, 13 bp, Homo sapiens
aacccaaaagatt

SEQ ID NO: 2310035 - DNA, 12 bp, Homo sapiens
aacccccacctc

SEQ ID NO: 2310036 - DNA, 16 bp, Homo sapiens
aacccccacctcccgg

SEQ ID NO: 2310037 - DNA, 21 bp, Homo sapiens
aacccctaggtcatttgtaga

SEQ ID NO: 2310038 - DNA, 15 bp, Homo sapiens
aaccctgccctgcac

SEQ ID NO: 2310039 - DNA, 13 bp, Homo sapiens
aaccgtcaatgtg

SEQ ID NO: 2310040 - DNA, 18 bp, Homo sapiens
aacctaaggcaacatttc

SEQ ID NO: 2310041 - DNA, 11 bp, Homo sapiens
aacctcaaact

SEQ ID NO: 2310042 - DNA, 14 bp, Homo sapiens
aacctcaatttatg

SEQ ID NO: 2310043 - DNA, 18 bp, Homo sapiens
aacctcaatttatgttaa

SEQ ID NO: 2310044 - DNA, 17 bp, Homo sapiens
aacctcgctccaactcc

SEQ ID NO: 2310045 - DNA, 11 bp, Homo sapiens
aacctctgttc

SEQ ID NO: 2310046 - DNA, 18 bp, Homo sapiens
aacctgggttgttgcaga

SEQ ID NO: 2310047 - DNA, 11 bp, Homo sapiens
aacctgtgcaa

SEQ ID NO: 2310048 - DNA, 13 bp, Homo sapiens
aacctgtgcaaaa

SEQ ID NO: 2310049 - DNA, 17 bp, Homo sapiens
aacctgtgctttcatgt

SEQ ID NO: 2310050 - DNA, 23 bp, Homo sapiens
aacctgtgctttcatgtttaaga

SEQ ID NO: 2310051 - DNA, 12 bp, Homo sapiens
aacctgtgtctc

SEQ ID NO: 2310052 - DNA, 16 bp, Homo sapiens
aacctgttcaggcagg

SEQ ID NO: 2310053 - DNA, 21 bp, Homo sapiens
aacgctagaagcctaagaact

SEQ ID NO: 2310054 - DNA, 14 bp, Homo sapiens
aacgggcctccccg

SEQ ID NO: 2310055 - DNA, 15 bp, Homo sapiens
aacgtggctgcttca

SEQ ID NO: 2310056 - DNA, 22 bp, Homo sapiens
aactaaaacccctaggtcattt

SEQ ID NO: 2310057 - DNA, 16 bp, Homo sapiens
aactaaaatagtttaa

SEQ ID NO: 2310058 - DNA, 21 bp, Homo sapiens
aactaaaatagtttaaaaata

SEQ ID NO: 2310059 - DNA, 17 bp, Homo sapiens
aactaaaattcaacaaa

SEQ ID NO: 2310060 - DNA, 15 bp, Homo sapiens
aactaaggtcagaag

SEQ ID NO: 2310061 - DNA, 17 bp, Homo sapiens
aactaagttgtatttta

SEQ ID NO: 2310062 - DNA, 19 bp, Homo sapiens
aactacattaaaagcttta

SEQ ID NO: 2310063 - DNA, 14 bp, Homo sapiens
aactactaagaata

SEQ ID NO: 2310064 - DNA, 12 bp, Homo sapiens
aactagatctcc

SEQ ID NO: 2310065 - DNA, 17 bp, Homo sapiens
aactatcggttcaagtt

SEQ ID NO: 2310066 - DNA, 19 bp, Homo sapiens
aactcaatgcatgatgact

SEQ ID NO: 2310067 - DNA, 15 bp, Homo sapiens
aactgagatgttaaa

SEQ ID NO: 2310068 - DNA, 17 bp, Homo sapiens
aactgagtgtggcggga

SEQ ID NO: 2310069 - DNA, 18 bp, Homo sapiens
aactgatgagatacattt

SEQ ID NO: 2310070 - DNA, 18 bp, Homo sapiens
aactgatgtatagcttta

SEQ ID NO: 2310071 - DNA, 16 bp, Homo sapiens
aactgcatatagataa

SEQ ID NO: 2310072 - DNA, 18 bp, Homo sapiens
aactgcccattgtaactt

SEQ ID NO: 2310073 - DNA, 15 bp, Homo sapiens
aactgctgttttatg

SEQ ID NO: 2310074 - DNA, 21 bp, Homo sapiens
aactgctgttttatgtcatac

SEQ ID NO: 2310075 - DNA, 19 bp, Homo sapiens
aactggatagaaaaatgct

SEQ ID NO: 2310076 - DNA, 13 bp, Homo sapiens
aactggccccagg

SEQ ID NO: 2310077 - DNA, 14 bp, Homo sapiens
aactggccccaggc

SEQ ID NO: 2310078 - DNA, 15 bp, Homo sapiens
aactgtagtaattgt

SEQ ID NO: 2310079 - DNA, 15 bp, Homo sapiens
aactgtatattattg

SEQ ID NO: 2310080 - DNA, 16 bp, Homo sapiens
aactgtatattattgc

SEQ ID NO: 2310081 - DNA, 17 bp, Homo sapiens
aactgtcccacaaaata

SEQ ID NO: 2310082 - DNA, 13 bp, Homo sapiens
aactgttctttgc

SEQ ID NO: 2310083 - DNA, 14 bp, Homo sapiens
aactgttctttgca

SEQ ID NO: 2310084 - DNA, 17 bp, Homo sapiens
aactgttggataataac

SEQ ID NO: 2310085 - DNA, 14 bp, Homo sapiens
aactgtttatggta

SEQ ID NO: 2310086 - DNA, 19 bp, Homo sapiens
aactgtttatggtattttc

SEQ ID NO: 2310087 - DNA, 15 bp, Homo sapiens
aactgttttgggtag

SEQ ID NO: 2310088 - DNA, 18 bp, Homo sapiens
aatttgccagacagagat

SEQ ID NO: 2310089 - DNA, 20 bp, Homo sapiens
aatttggggacagattcagt

SEQ ID NO: 2310090 - DNA, 22 bp, Homo sapiens
aatttggggacagattcagtct

SEQ ID NO: 2310091 - DNA, 15 bp, Homo sapiens
aattttaaaaaataa

SEQ ID NO: 2310092 - DNA, 22 bp, Homo sapiens
aattttaaaaatctacgtcttt

SEQ ID NO: 2310093 - DNA, 19 bp, Homo sapiens
aattttaacagacatgtat

SEQ ID NO: 2310094 - DNA, 23 bp, Homo sapiens
aattttaatgtaaaattcatagc

SEQ ID NO: 2310095 - DNA, 20 bp, Homo sapiens
acaaaagttctgcgtaatga

SEQ ID NO: 2310096 - DNA, 13 bp, Homo sapiens
acaaaatatttct

SEQ ID NO: 2310097 - DNA, 17 bp, Homo sapiens
acaaaatctgttgccac

SEQ ID NO: 2310098 - DNA, 22 bp, Homo sapiens
acaaaatgaaacgcaaccacca

SEQ ID NO: 2310099 - DNA, 18 bp, Homo sapiens
acaaacctctatatgttg

SEQ ID NO: 2310100 - DNA, 22 bp, Homo sapiens
acaaacctctatatgttgctga

SEQ ID NO: 2310101 - DNA, 17 bp, Homo sapiens
acaaactgaaaaatcta

SEQ ID NO: 2310102 - DNA, 23 bp, Homo sapiens
acaaactgtcgtctttttccaaa

SEQ ID NO: 2310103 - DNA, 14 bp, Homo sapiens
acaaagctgtcact

SEQ ID NO: 2310104 - DNA, 20 bp, Homo sapiens
acaaagctgtcactcacaaa

SEQ ID NO: 2310105 - DNA, 19 bp, Homo sapiens
acaaaggatttgaaaacac

SEQ ID NO: 2310106 - DNA, 15 bp, Homo sapiens
acaaagggcaggcct

SEQ ID NO: 2310107 - DNA, 19 bp, Homo sapiens
acaaaggggatcataaagt

SEQ ID NO: 2310108 - DNA, 16 bp, Homo sapiens
acaaagtctttggggt

SEQ ID NO: 2310109 - DNA, 21 bp, Homo sapiens
acaaagtgcttccttttcagc

SEQ ID NO: 2310110 - DNA, 18 bp, Homo sapiens
acaaagtttggaagtaca

SEQ ID NO: 2310111 - DNA, 15 bp, Homo sapiens
acaacaacaaaatga

SEQ ID NO: 2310112 - DNA, 14 bp, Homo sapiens
acaacagaaacttc

SEQ ID NO: 2310113 - DNA, 19 bp, Homo sapiens
acaaccctgtgtaacaact

SEQ ID NO: 2310114 - DNA, 16 bp, Homo sapiens
acaaccggttatcagt

SEQ ID NO: 2310115 - DNA, 22 bp, Homo sapiens
acaaccggttatcagttggaca

SEQ ID NO: 2310116 - DNA, 20 bp, Homo sapiens
acaactccaggaaaactgtt

SEQ ID NO: 2310117 - DNA, 13 bp, Homo sapiens
acaactctatttt

SEQ ID NO: 2310118 - DNA, 18 bp, Homo sapiens
acaactgtttttgaagaa

SEQ ID NO: 2310119 - DNA, 19 bp, Homo sapiens
acaactgtttttgaagaag

SEQ ID NO: 2310120 - DNA, 15 bp, Homo sapiens
acaagaaaaagtaga

SEQ ID NO: 2310121 - DNA, 17 bp, Homo sapiens
acaagaaggatacaagg

SEQ ID NO: 2310122 - DNA, 21 bp, Homo sapiens
acaagagacccctgtctggca

SEQ ID NO: 2310123 - DNA, 14 bp, Homo sapiens
acaagataccaggc

SEQ ID NO: 2310124 - DNA, 19 bp, Homo sapiens
acaagatttccctaaaaat

SEQ ID NO: 2310125 - DNA, 22 bp, Homo sapiens
acaagcatcatggatcaaccaa

SEQ ID NO: 2310126 - DNA, 13 bp, Homo sapiens
acaagccagagcc

SEQ ID NO: 2310127 - DNA, 19 bp, Homo sapiens
acaaggcaaggctgtcaat

SEQ ID NO: 2310128 - DNA, 14 bp, Homo sapiens
acaaggggtggaag

SEQ ID NO: 2310129 - DNA, 15 bp, Homo sapiens
acaagtgaaaactga

SEQ ID NO: 2310130 - DNA, 15 bp, Homo sapiens
acaagtgctcctgaa

SEQ ID NO: 2310131 - DNA, 15 bp, Homo sapiens
acaatatgttagatt

SEQ ID NO: 2310132 - DNA, 18 bp, Homo sapiens
acaatgcaaaccatcatt

SEQ ID NO: 2310133 - DNA, 21 bp, Homo sapiens
acaatgcaaaccatcattgaa

SEQ ID NO: 2310134 - DNA, 22 bp, Homo sapiens
acaatggtagctctgaagggag

SEQ ID NO: 2310135 - DNA, 15 bp, Homo sapiens
acaatggttttcttg

SEQ ID NO: 2310136 - DNA, 21 bp, Homo sapiens
acaatggttttcttgtgtgtt

SEQ ID NO: 2310137 - DNA, 21 bp, Homo sapiens
acaatgtaattacattaaaat

SEQ ID NO: 2310138 - DNA, 20 bp, Homo sapiens
acaattagagatatttttat

SEQ ID NO: 2310139 - DNA, 19 bp, Homo sapiens
acaattatttttgctctgc

SEQ ID NO: 2310140 - DNA, 18 bp, Homo sapiens
acaattcttttgaaagat

SEQ ID NO: 2310141 - DNA, 11 bp, Homo sapiens
acaatttgcca

SEQ ID NO: 2310142 - DNA, 23 bp, Homo sapiens
acaatttgccatagcagtgctag

SEQ ID NO: 2310143 - DNA, 21 bp, Homo sapiens
acacaaactatggtgtgctta

SEQ ID NO: 2310144 - DNA, 17 bp, Homo sapiens
acacaatcctataaatg

SEQ ID NO: 2310145 - DNA, 13 bp, Homo sapiens
acacacagcagct

SEQ ID NO: 2310146 - DNA, 15 bp, Homo sapiens
acacacagcagctcc

SEQ ID NO: 2310147 - DNA, 20 bp, Homo sapiens
acacacagcagctccaacct

SEQ ID NO: 2310148 - DNA, 13 bp, Homo sapiens
acacagcagctcc

SEQ ID NO: 2310149 - DNA, 12 bp, Homo sapiens
acacaggcccat

SEQ ID NO: 2310150 - DNA, 13 bp, Homo sapiens
acacataaatctg

SEQ ID NO: 2310151 - DNA, 20 bp, Homo sapiens
acacataaatctgtctgatt

SEQ ID NO: 2310152 - DNA, 21 bp, Homo sapiens
acacataaatctgtctgattc

SEQ ID NO: 2310153 - DNA, 16 bp, Homo sapiens
acacatatatctgatg

SEQ ID NO: 2310154 - DNA, 18 bp, Homo sapiens
acacatttccctatttta

SEQ ID NO: 2310155 - DNA, 15 bp, Homo sapiens
acaccaagagtacag

SEQ ID NO: 2310156 - DNA, 23 bp, Homo sapiens
acaccaccaaatgacaagtcaca

SEQ ID NO: 2310157 - DNA, 17 bp, Homo sapiens
acaccactgaacagaaa

SEQ ID NO: 2310158 - DNA, 18 bp, Homo sapiens
acaccactttgtctctga

SEQ ID NO: 2310159 - DNA, 19 bp, Homo sapiens
acaccactttgtctctgag

SEQ ID NO: 2310160 - DNA, 15 bp, Homo sapiens
acacccaagcacaaa

SEQ ID NO: 2310161 - DNA, 20 bp, Homo sapiens
acacccaagcacaaactgtc

SEQ ID NO: 2310162 - DNA, 21 bp, Homo sapiens
acacccaattttaaaaaataa

SEQ ID NO: 2310163 - DNA, 15 bp, Homo sapiens
acaccccgtctgccc

SEQ ID NO: 2310164 - DNA, 17 bp, Homo sapiens
acaccccgtctgcccct

SEQ ID NO: 2310165 - DNA, 19 bp, Homo sapiens
acaccctctccttgtcaca

SEQ ID NO: 2310166 - DNA, 13 bp, Homo sapiens
acaccctggagtg

SEQ ID NO: 2310167 - DNA, 15 bp, Homo sapiens
acacctgccgctgct

SEQ ID NO: 2310168 - DNA, 18 bp, Homo sapiens
acacctgccgctgcttga

SEQ ID NO: 2310169 - DNA, 14 bp, Homo sapiens
acacgaatattgct

SEQ ID NO: 2310170 - DNA, 21 bp, Homo sapiens
acacgaatattgctgatggtg

SEQ ID NO: 2310171 - DNA, 22 bp, Homo sapiens
acacgcacttctggggccagcc

SEQ ID NO: 2310172 - DNA, 19 bp, Homo sapiens
acacgccggggctggccct

SEQ ID NO: 2310173 - DNA, 20 bp, Homo sapiens
acacgccggggctggccctg

SEQ ID NO: 2310174 - DNA, 14 bp, Homo sapiens
acacggaccctgtg

SEQ ID NO: 2310175 - DNA, 16 bp, Homo sapiens
acacggaccctgtgtg

SEQ ID NO: 2310176 - DNA, 13 bp, Homo sapiens
acactaatggcca

SEQ ID NO: 2310177 - DNA, 11 bp, Homo sapiens
acactatttta

SEQ ID NO: 2310178 - DNA, 20 bp, Homo sapiens
acactcacaatcatcttctc

SEQ ID NO: 2310179 - DNA, 15 bp, Homo sapiens
acactgcaatcatat

SEQ ID NO: 2310180 - DNA, 16 bp, Homo sapiens
acactgcaatcatatg

SEQ ID NO: 2310181 - DNA, 19 bp, Homo sapiens
acactgcaatcatatgtga

SEQ ID NO: 2310182 - DNA, 15 bp, Homo sapiens
acactgcagtgttat

SEQ ID NO: 2310183 - DNA, 22 bp, Homo sapiens
acactgcttaaggaaaagagaa

SEQ ID NO: 2310184 - DNA, 19 bp, Homo sapiens
acactgtatctaaaaaata

SEQ ID NO: 2310185 - DNA, 23 bp, Homo sapiens
acactgtatctaaaaaataactg

SEQ ID NO: 2310186 - DNA, 19 bp, Homo sapiens
acactgtgcgttttagagt

SEQ ID NO: 2310187 - DNA, 22 bp, Homo sapiens
acactgtgcgttttagagtatg

SEQ ID NO: 2310188 - DNA, 12 bp, Homo sapiens
acactgtggaac

SEQ ID NO: 2310189 - DNA, 15 bp, Homo sapiens
acacttagaatacta

SEQ ID NO: 2310190 - DNA, 15 bp, Homo sapiens
acacttattttctga

SEQ ID NO: 2310191 - DNA, 18 bp, Homo sapiens
acacttattttctgaatt

SEQ ID NO: 2310192 - DNA, 18 bp, Homo sapiens
acagaaaaaaataaaaac

SEQ ID NO: 2310193 - DNA, 21 bp, Homo sapiens
acagaaacaactgccaaataa

SEQ ID NO: 2310194 - DNA, 20 bp, Homo sapiens
acagaacagcaagtatgaac

SEQ ID NO: 2310195 - DNA, 23 bp, Homo sapiens
acagaacaggaggtgtgaatgca

SEQ ID NO: 2310196 - DNA, 20 bp, Homo sapiens
acagaaggcaaagtttccat

SEQ ID NO: 2310197 - DNA, 22 bp, Homo sapiens
acagaaggcaaagtttccatgt

SEQ ID NO: 2310198 - DNA, 22 bp, Homo sapiens
acagaagtagttttgttcatga

SEQ ID NO: 2310199 - DNA, 16 bp, Homo sapiens
acagaatctccatttc

SEQ ID NO: 2310200 - DNA, 15 bp, Homo sapiens
acagaatgagagaga

SEQ ID NO: 2310201 - DNA, 17 bp, Homo sapiens
acagacccctgggggag

SEQ ID NO: 2310202 - DNA, 19 bp, Homo sapiens
acagacccctgggggaggc

SEQ ID NO: 2310203 - DNA, 19 bp, Homo sapiens
acagacctccagattattt

SEQ ID NO: 2310204 - DNA, 21 bp, Homo sapiens
acagagacccccgtgccaaat

SEQ ID NO: 2310205 - DNA, 23 bp, Homo sapiens
acagagccctatctatgtcctgg

SEQ ID NO: 2310206 - DNA, 12 bp, Homo sapiens
acagaggaccag

SEQ ID NO: 2310207 - DNA, 14 bp, Homo sapiens
acagagtatatatg

SEQ ID NO: 2310208 - DNA, 15 bp, Homo sapiens
acagagtatatatgt

SEQ ID NO: 2310209 - DNA, 20 bp, Homo sapiens
acagagtatatatgtacagt

SEQ ID NO: 2310210 - DNA, 13 bp, Homo sapiens
acagataaaaagt

SEQ ID NO: 2310211 - DNA, 15 bp, Homo sapiens
acagatatttaaatt

SEQ ID NO: 2310212 - DNA, 22 bp, Homo sapiens
acagatatttaaatttagtgct

SEQ ID NO: 2310213 - DNA, 14 bp, Homo sapiens
acagatgggtgtcc

SEQ ID NO: 2310214 - DNA, 13 bp, Homo sapiens
acagattcagtct

SEQ ID NO: 2310215 - DNA, 19 bp, Homo sapiens
acagcaaataaaacagtga

SEQ ID NO: 2310216 - DNA, 15 bp, Homo sapiens
acagcagctccaacc

SEQ ID NO: 2310217 - DNA, 21 bp, Homo sapiens
acagcatccccaaaacaaagt

SEQ ID NO: 2310218 - DNA, 22 bp, Homo sapiens
acagcatgagattgtacatttt

SEQ ID NO: 2310219 - DNA, 18 bp, Homo sapiens
agactgcccaccctgggc

SEQ ID NO: 2310220 - DNA, 19 bp, Homo sapiens
agactgcccaccctgggcc

SEQ ID NO: 2310221 - DNA, 20 bp, Homo sapiens
agactgcccaccctgggcct

SEQ ID NO: 2310222 - DNA, 22 bp, Homo sapiens
agactgcccaccctgggcctcc

SEQ ID NO: 2310223 - DNA, 18 bp, Homo sapiens
agactgctagaaccaagc

SEQ ID NO: 2310224 - DNA, 16 bp, Homo sapiens
agactggaaaatagtc

SEQ ID NO: 2310225 - DNA, 16 bp, Homo sapiens
agacttcgaaaacaga

SEQ ID NO: 2310226 - DNA, 17 bp, Homo sapiens
agacttcgaaaacagat

SEQ ID NO: 2310227 - DNA, 20 bp, Homo sapiens
agacttgacgcagcccccca

SEQ ID NO: 2310228 - DNA, 21 bp, Homo sapiens
agacttgatttacaagcatca

SEQ ID NO: 2310229 - DNA, 21 bp, Homo sapiens
agacttttagcggtttgcaaa

SEQ ID NO: 2310230 - DNA, 19 bp, Homo sapiens
agacttttctttcagccaa

SEQ ID NO: 2310231 - DNA, 19 bp, Homo sapiens
agagaaaagattaaaatta

SEQ ID NO: 2310232 - DNA, 22 bp, Homo sapiens
agagaaaagattaaaattagtg

SEQ ID NO: 2310233 - DNA, 22 bp, Homo sapiens
agagacagggtctcactgtgtt

SEQ ID NO: 2310234 - DNA, 14 bp, Homo sapiens
agagacccccgtgc

SEQ ID NO: 2310235 - DNA, 16 bp, Homo sapiens
agagacctgctccaga

SEQ ID NO: 2310236 - DNA, 15 bp, Homo sapiens
agagacggcagcccc

SEQ ID NO: 2310237 - DNA, 16 bp, Homo sapiens
agagacggcagcccca

SEQ ID NO: 2310238 - DNA, 19 bp, Homo sapiens
agagacggcagccccatcc

SEQ ID NO: 2310239 - DNA, 21 bp, Homo sapiens
agagacggcagccccatcctt

SEQ ID NO: 2310240 - DNA, 16 bp, Homo sapiens
agagactctgtgatct

SEQ ID NO: 2310241 - DNA, 14 bp, Homo sapiens
agagactgcccacc

SEQ ID NO: 2310242 - DNA, 15 bp, Homo sapiens
agagactgcccaccc

SEQ ID NO: 2310243 - DNA, 21 bp, Homo sapiens
agagactgcccaccctgggcc

SEQ ID NO: 2310244 - DNA, 22 bp, Homo sapiens
agagactgcccaccctgggcct

SEQ ID NO: 2310245 - DNA, 20 bp, Homo sapiens
agagagcgcagccgccttca

SEQ ID NO: 2310246 - DNA, 15 bp, Homo sapiens
agagataaatattta

SEQ ID NO: 2310247 - DNA, 17 bp, Homo sapiens
agagataaatatttatg

SEQ ID NO: 2310248 - DNA, 19 bp, Homo sapiens
agagataaatatttatgca

SEQ ID NO: 2310249 - DNA, 14 bp, Homo sapiens
agagatgaggaaat

SEQ ID NO: 2310250 - DNA, 22 bp, Homo sapiens
agagatgaggaaataagacttt

SEQ ID NO: 2310251 - DNA, 20 bp, Homo sapiens
agagatgtaccatgttaaag

SEQ ID NO: 2310252 - DNA, 15 bp, Homo sapiens
agagatgtctgttct

SEQ ID NO: 2310253 - DNA, 19 bp, Homo sapiens
agagatgtctgttctaagt

SEQ ID NO: 2310254 - DNA, 13 bp, Homo sapiens
agagattaatttg

SEQ ID NO: 2310255 - DNA, 17 bp, Homo sapiens
agagattaatttgtgta

SEQ ID NO: 2310256 - DNA, 19 bp, Homo sapiens
agagcaaaactcagtctca

SEQ ID NO: 2310257 - DNA, 17 bp, Homo sapiens
agagcactgtatacccc

SEQ ID NO: 2310258 - DNA, 16 bp, Homo sapiens
agagcagagcccccat

SEQ ID NO: 2310259 - DNA, 19 bp, Homo sapiens
agagccatccaccctgagg

SEQ ID NO: 2310260 - DNA, 22 bp, Homo sapiens
agagccccggagcaccacgggg

SEQ ID NO: 2310261 - DNA, 18 bp, Homo sapiens
agagcgtgcacttgtgat

SEQ ID NO: 2310262 - DNA, 19 bp, Homo sapiens
agagcgtgcacttgtgatc

SEQ ID NO: 2310263 - DNA, 16 bp, Homo sapiens
agagctcagcacagcc

SEQ ID NO: 2310264 - DNA, 18 bp, Homo sapiens
agagctcagcacagcctc

SEQ ID NO: 2310265 - DNA, 11 bp, Homo sapiens
agagctcccag

SEQ ID NO: 2310266 - DNA, 18 bp, Homo sapiens
agagctcccaggacgcag

SEQ ID NO: 2310267 - DNA, 20 bp, Homo sapiens
agagctgagtcggctgggca

SEQ ID NO: 2310268 - DNA, 24 bp, Homo sapiens
agagctgggactcagttcttggcc

SEQ ID NO: 2310269 - DNA, 23 bp, Homo sapiens
agagcttcccctaacctgggttg

SEQ ID NO: 2310270 - DNA, 14 bp, Homo sapiens
agagctttactttg

SEQ ID NO: 2310271 - DNA, 11 bp, Homo sapiens
agaggaaatca

SEQ ID NO: 2310272 - DNA, 20 bp, Homo sapiens
agaggacacggaccctgtgt

SEQ ID NO: 2310273 - DNA, 12 bp, Homo sapiens
agaggaccagca

SEQ ID NO: 2310274 - DNA, 23 bp, Homo sapiens
agaggaccccattctgggactgc

SEQ ID NO: 2310275 - DNA, 11 bp, Homo sapiens
agaggcagggc

SEQ ID NO: 2310276 - DNA, 20 bp, Homo sapiens
agaggcctgggtgtgacctg

SEQ ID NO: 2310277 - DNA, 23 bp, Homo sapiens
agaggcctgggtgtgacctgaca

SEQ ID NO: 2310278 - DNA, 14 bp, Homo sapiens
agaggcgtcttgta

SEQ ID NO: 2310279 - DNA, 19 bp, Homo sapiens
agaggcgtcttgtattttc

SEQ ID NO: 2310280 - DNA, 14 bp, Homo sapiens
agaggctttatgtt

SEQ ID NO: 2310281 - DNA, 18 bp, Homo sapiens
agagggctgagcccctcc

SEQ ID NO: 2310282 - DNA, 20 bp, Homo sapiens
agagggctgagcccctcctc

SEQ ID NO: 2310283 - DNA, 15 bp, Homo sapiens
agaggggaagggcag

SEQ ID NO: 2310284 - DNA, 16 bp, Homo sapiens
agaggggcggggccag

SEQ ID NO: 2310285 - DNA, 17 bp, Homo sapiens
agaggggcggggccagg

SEQ ID NO: 2310286 - DNA, 18 bp, Homo sapiens
agaggggcggggccagga

SEQ ID NO: 2310287 - DNA, 19 bp, Homo sapiens
agagtacaggtcttcttta

SEQ ID NO: 2310288 - DNA, 16 bp, Homo sapiens
agagtatatatgtaca

SEQ ID NO: 2310289 - DNA, 17 bp, Homo sapiens
agagtatgcaagaagaa

SEQ ID NO: 2310290 - DNA, 16 bp, Homo sapiens
agagtattgagatact

SEQ ID NO: 2310291 - DNA, 19 bp, Homo sapiens
agagtgcccttaaaataat

SEQ ID NO: 2310292 - DNA, 21 bp, Homo sapiens
agagtgcccttaaaataatga

SEQ ID NO: 2310293 - DNA, 19 bp, Homo sapiens
agagtggaaattcatgaga

SEQ ID NO: 2310294 - DNA, 15 bp, Homo sapiens
agagttcctttctgg

SEQ ID NO: 2310295 - DNA, 19 bp, Homo sapiens
agagtttaacagatattta

SEQ ID NO: 2310296 - DNA, 20 bp, Homo sapiens
agagtttaacagatatttaa

SEQ ID NO: 2310297 - DNA, 21 bp, Homo sapiens
agagtttaacagatatttaaa

SEQ ID NO: 2310298 - DNA, 16 bp, Homo sapiens
agataaaaagtggaat

SEQ ID NO: 2310299 - DNA, 17 bp, Homo sapiens
agataaaaagtggaatt

SEQ ID NO: 2310300 - DNA, 21 bp, Homo sapiens
agataaaaagtggaatttctt

SEQ ID NO: 2310301 - DNA, 17 bp, Homo sapiens
agataaaactctagcag

SEQ ID NO: 2310302 - DNA, 17 bp, Homo sapiens
agataaactgaaatttg

SEQ ID NO: 2310303 - DNA, 13 bp, Homo sapiens
agataaatattta

SEQ ID NO: 2310304 - DNA, 14 bp, Homo sapiens
agataaatatttat

SEQ ID NO: 2310305 - DNA, 16 bp, Homo sapiens
agataaatatttatgc

SEQ ID NO: 2310306 - DNA, 15 bp, Homo sapiens
agataaatgctttaa

SEQ ID NO: 2310307 - DNA, 21 bp, Homo sapiens
agataaatgctttaaatagtt

SEQ ID NO: 2310308 - DNA, 16 bp, Homo sapiens
agataaggcaacaaaa

SEQ ID NO: 2310309 - DNA, 17 bp, Homo sapiens
agataaggcaacaaaat

SEQ ID NO: 2310310 - DNA, 18 bp, Homo sapiens
agataagtgctcagtatt

SEQ ID NO: 2310311 - DNA, 21 bp, Homo sapiens
agatacaagaaaaagtagaaa

SEQ ID NO: 2310312 - DNA, 22 bp, Homo sapiens
agatactgtatatgtcaaaaat

SEQ ID NO: 2310313 - DNA, 22 bp, Homo sapiens
agatactttttcttttgtaagt

SEQ ID NO: 2310314 - DNA, 23 bp, Homo sapiens
agatactttttcttttgtaagtg

SEQ ID NO: 2310315 - DNA, 18 bp, Homo sapiens
agatagaaaaggtccaaa

SEQ ID NO: 2310316 - DNA, 16 bp, Homo sapiens
agatagaactgtggca

SEQ ID NO: 2310317 - DNA, 18 bp, Homo sapiens
agatatatatttccaaat

SEQ ID NO: 2310318 - DNA, 21 bp, Homo sapiens
agatatatatttccaaatatt

SEQ ID NO: 2310319 - DNA, 15 bp, Homo sapiens
agatattcatacttt

SEQ ID NO: 2310320 - DNA, 17 bp, Homo sapiens
agatattcatactttcc

SEQ ID NO: 2310321 - DNA, 19 bp, Homo sapiens
agatattcatactttccaa

SEQ ID NO: 2310322 - DNA, 15 bp, Homo sapiens
agatcacaaatagtg

SEQ ID NO: 2310323 - DNA, 15 bp, Homo sapiens
agatcagcattcaaa

SEQ ID NO: 2310324 - DNA, 16 bp, Homo sapiens
agatcagcattcaaaa

SEQ ID NO: 2310325 - DNA, 18 bp, Homo sapiens
agatcagcattcaaaata

SEQ ID NO: 2310326 - DNA, 20 bp, Homo sapiens
agatccatccttttgcttca

SEQ ID NO: 2310327 - DNA, 15 bp, Homo sapiens
agatccccattcttt

SEQ ID NO: 2310328 - DNA, 19 bp, Homo sapiens
agatccctcggtcagcacc

SEQ ID NO: 2310329 - DNA, 16 bp, Homo sapiens
agatcctgtcccatgg

SEQ ID NO: 2310330 - DNA, 16 bp, Homo sapiens
agatctcctgtaattt

SEQ ID NO: 2310331 - DNA, 20 bp, Homo sapiens
agatctcctgtaattttgta

SEQ ID NO: 2310332 - DNA, 23 bp, Homo sapiens
agatctcctgtaattttgtagta

SEQ ID NO: 2310333 - DNA, 13 bp, Homo sapiens
agatctgcatctg

SEQ ID NO: 2310334 - DNA, 20 bp, Homo sapiens
agatgaagtgagatacaaag

SEQ ID NO: 2310335 - DNA, 23 bp, Homo sapiens
agatgacacataaatctgtctga

SEQ ID NO: 2310336 - DNA, 19 bp, Homo sapiens
agatgaggaaataagactt

SEQ ID NO: 2310337 - DNA, 23 bp, Homo sapiens
agatgaggaaataagacttttag

SEQ ID NO: 2310338 - DNA, 17 bp, Homo sapiens
agatgatccatttgaac

SEQ ID NO: 2310339 - DNA, 14 bp, Homo sapiens
agatgctattaaag

SEQ ID NO: 2310340 - DNA, 13 bp, Homo sapiens
agatggcagagcc

SEQ ID NO: 2310341 - DNA, 14 bp, Homo sapiens
agatggcagagcca

SEQ ID NO: 2310342 - DNA, 15 bp, Homo sapiens
agatggcgcacccgg

SEQ ID NO: 2310343 - DNA, 19 bp, Homo sapiens
agatggcgcacccggcagc

SEQ ID NO: 2310344 - DNA, 23 bp, Homo sapiens
agatggcgcacccggcagccccc

SEQ ID NO: 2310345 - DNA, 16 bp, Homo sapiens
agatggtaatcttttc

SEQ ID NO: 2310346 - DNA, 18 bp, Homo sapiens
agatggttcaaagataca

SEQ ID NO: 2310347 - DNA, 19 bp, Homo sapiens
agatggttcaaagatacaa

SEQ ID NO: 2310348 - DNA, 20 bp, Homo sapiens
agatgtaccatgttaaagag

SEQ ID NO: 2310349 - DNA, 15 bp, Homo sapiens
agatgtattttcaat

SEQ ID NO: 2310350 - DNA, 21 bp, Homo sapiens
agtgttattttctttgaaatt

SEQ ID NO: 2310351 - DNA, 20 bp, Homo sapiens
agtgttgggtggaggatgga

SEQ ID NO: 2310352 - DNA, 21 bp, Homo sapiens
agtgttgggtggaggatggac

SEQ ID NO: 2310353 - DNA, 19 bp, Homo sapiens
agtgttttaagaaatgtag

SEQ ID NO: 2310354 - DNA, 15 bp, Homo sapiens
agtgtttttctttaa

SEQ ID NO: 2310355 - DNA, 18 bp, Homo sapiens
agttaaagagacaaatag

SEQ ID NO: 2310356 - DNA, 23 bp, Homo sapiens
agttaacagtctcattacagatt

SEQ ID NO: 2310357 - DNA, 17 bp, Homo sapiens
agttaatgatggcagag

SEQ ID NO: 2310358 - DNA, 14 bp, Homo sapiens
agttagcaggaaat

SEQ ID NO: 2310359 - DNA, 17 bp, Homo sapiens
agttagcaggaaatagt

SEQ ID NO: 2310360 - DNA, 19 bp, Homo sapiens
agttagcccggccaaggac

SEQ ID NO: 2310361 - DNA, 22 bp, Homo sapiens
agttatttgtcttcttttcaaa

SEQ ID NO: 2310362 - DNA, 15 bp, Homo sapiens
agttcatcttgaatt

SEQ ID NO: 2310363 - DNA, 19 bp, Homo sapiens
agttcatcttgaattgtaa

SEQ ID NO: 2310364 - DNA, 22 bp, Homo sapiens
agttcatgtgtggaaatgggac

SEQ ID NO: 2310365 - DNA, 15 bp, Homo sapiens
agttccattctatga

SEQ ID NO: 2310366 - DNA, 18 bp, Homo sapiens
agttctattatctgggtt

SEQ ID NO: 2310367 - DNA, 13 bp, Homo sapiens
agttctatttcta

SEQ ID NO: 2310368 - DNA, 22 bp, Homo sapiens
agttctgaaaactgtttatggt

SEQ ID NO: 2310369 - DNA, 13 bp, Homo sapiens
agttgactttcaa

SEQ ID NO: 2310370 - DNA, 23 bp, Homo sapiens
agttgagcacaggcaacattaca

SEQ ID NO: 2310371 - DNA, 20 bp, Homo sapiens
agttgatgaccaatctctgt

SEQ ID NO: 2310372 - DNA, 22 bp, Homo sapiens
agttgatgaccaatctctgtga

SEQ ID NO: 2310373 - DNA, 15 bp, Homo sapiens
agttgctaacctcaa

SEQ ID NO: 2310374 - DNA, 13 bp, Homo sapiens
agttggacagtaa

SEQ ID NO: 2310375 - DNA, 16 bp, Homo sapiens
agttggagctagaaaa

SEQ ID NO: 2310376 - DNA, 20 bp, Homo sapiens
agttggctgtatgactgaag

SEQ ID NO: 2310377 - DNA, 14 bp, Homo sapiens
agttgggcccccat

SEQ ID NO: 2310378 - DNA, 14 bp, Homo sapiens
agttgtatttgaag

SEQ ID NO: 2310379 - DNA, 20 bp, Homo sapiens
agttgtattttaataaagat

SEQ ID NO: 2310380 - DNA, 17 bp, Homo sapiens
agttgtctgagctgctg

SEQ ID NO: 2310381 - DNA, 13 bp, Homo sapiens
agttgtctgtcct

SEQ ID NO: 2310382 - DNA, 14 bp, Homo sapiens
agttgtctgtcctg

SEQ ID NO: 2310383 - DNA, 15 bp, Homo sapiens
agttgtctgtcctgg

SEQ ID NO: 2310384 - DNA, 18 bp, Homo sapiens
agttgtctgtcctggtca

SEQ ID NO: 2310385 - DNA, 12 bp, Homo sapiens
agttgtggcctc

SEQ ID NO: 2310386 - DNA, 15 bp, Homo sapiens
agtttaaaaaaataa

SEQ ID NO: 2310387 - DNA, 14 bp, Homo sapiens
agtttaaaaatatt

SEQ ID NO: 2310388 - DNA, 16 bp, Homo sapiens
agtttaacagatattt

SEQ ID NO: 2310389 - DNA, 16 bp, Homo sapiens
agtttaccaatcaaca

SEQ ID NO: 2310390 - DNA, 18 bp, Homo sapiens
agtttacttcactttcat

SEQ ID NO: 2310391 - DNA, 17 bp, Homo sapiens
agtttattatagtctgt

SEQ ID NO: 2310392 - DNA, 14 bp, Homo sapiens
agtttcaaaatgtt

SEQ ID NO: 2310393 - DNA, 19 bp, Homo sapiens
agtttcacatatttgtagc

SEQ ID NO: 2310394 - DNA, 20 bp, Homo sapiens
agtttcacatatttgtagct

SEQ ID NO: 2310395 - DNA, 23 bp, Homo sapiens
agtttgcatacttcctggatttt

SEQ ID NO: 2310396 - DNA, 14 bp, Homo sapiens
agtttggggcaggg

SEQ ID NO: 2310397 - DNA, 23 bp, Homo sapiens
agtttgtaaatgttatttctgca

SEQ ID NO: 2310398 - DNA, 18 bp, Homo sapiens
agtttgttttctttttct

SEQ ID NO: 2310399 - DNA, 20 bp, Homo sapiens
agtttgttttctttttctgt

SEQ ID NO: 2310400 - DNA, 21 bp, Homo sapiens
agttttagtttcaaaatgtta

SEQ ID NO: 2310401 - DNA, 13 bp, Homo sapiens
agttttcacagag

SEQ ID NO: 2310402 - DNA, 17 bp, Homo sapiens
agttttctaaatgtttc

SEQ ID NO: 2310403 - DNA, 15 bp, Homo sapiens
agtttttcctgtgca

SEQ ID NO: 2310404 - DNA, 14 bp, Homo sapiens
ataaaagttaacat

SEQ ID NO: 2310405 - DNA, 18 bp, Homo sapiens
ataaaagttttttaataa

SEQ ID NO: 2310406 - DNA, 22 bp, Homo sapiens
ataaaatacataaaagaatgta

SEQ ID NO: 2310407 - DNA, 19 bp, Homo sapiens
ataaaatatacaaacatgt

SEQ ID NO: 2310408 - DNA, 16 bp, Homo sapiens
ataaaatgagttacct

SEQ ID NO: 2310409 - DNA, 18 bp, Homo sapiens
ataaaatgagttacctca

SEQ ID NO: 2310410 - DNA, 18 bp, Homo sapiens
ataaacgatatatgtaaa

SEQ ID NO: 2310411 - DNA, 20 bp, Homo sapiens
ataaactgaaatttgctata

SEQ ID NO: 2310412 - DNA, 16 bp, Homo sapiens
ataaacttgtacttac

SEQ ID NO: 2310413 - DNA, 13 bp, Homo sapiens
ataaagaaaaaaa

SEQ ID NO: 2310414 - DNA, 16 bp, Homo sapiens
ataaagttagaatcta

SEQ ID NO: 2310415 - DNA, 17 bp, Homo sapiens
ataaagttagaatctat

SEQ ID NO: 2310416 - DNA, 17 bp, Homo sapiens
ataaataaaaatattct

SEQ ID NO: 2310417 - DNA, 20 bp, Homo sapiens
ataaatctgtctgattctat

SEQ ID NO: 2310418 - DNA, 14 bp, Homo sapiens
ataaatgctttaaa

SEQ ID NO: 2310419 - DNA, 20 bp, Homo sapiens
ataaatgctttaaatagttt

SEQ ID NO: 2310420 - DNA, 15 bp, Homo sapiens
ataaatgtgtaaatg

SEQ ID NO: 2310421 - DNA, 16 bp, Homo sapiens
ataaatgtgtaaatgt

SEQ ID NO: 2310422 - DNA, 19 bp, Homo sapiens
ataaatgtgtaaatgtgga

SEQ ID NO: 2310423 - DNA, 21 bp, Homo sapiens
ataaatgtgtaaatgtggaca

SEQ ID NO: 2310424 - DNA, 22 bp, Homo sapiens
ataaattcaacacttattttct

SEQ ID NO: 2310425 - DNA, 19 bp, Homo sapiens
ataacaacaacttaatgtg

SEQ ID NO: 2310426 - DNA, 23 bp, Homo sapiens
ataacaactgagatgttaaaata

SEQ ID NO: 2310427 - DNA, 20 bp, Homo sapiens
ataacaagccaaacattctt

SEQ ID NO: 2310428 - DNA, 15 bp, Homo sapiens
ataacatattcttgc

SEQ ID NO: 2310429 - DNA, 20 bp, Homo sapiens
ataacatattcttgctttca

SEQ ID NO: 2310430 - DNA, 20 bp, Homo sapiens
ataacatctgaaaagaaatg

SEQ ID NO: 2310431 - DNA, 21 bp, Homo sapiens
ataacatctgaaaagaaatgc

SEQ ID NO: 2310432 - DNA, 20 bp, Homo sapiens
ataaccaaaaaatgtgagct

SEQ ID NO: 2310433 - DNA, 14 bp, Homo sapiens
ataaccaagaatgt

SEQ ID NO: 2310434 - DNA, 18 bp, Homo sapiens
ataactacattaaaagct

SEQ ID NO: 2310435 - DNA, 23 bp, Homo sapiens
ataactacattaaaagctttaga

SEQ ID NO: 2310436 - DNA, 24 bp, Homo sapiens
ataactacattaaaagctttagat

SEQ ID NO: 2310437 - DNA, 16 bp, Homo sapiens
ataactagatctcctg

SEQ ID NO: 2310438 - DNA, 17 bp, Homo sapiens
ataactagatctcctgt

SEQ ID NO: 2310439 - DNA, 10 bp, Homo sapiens
ataagactgg

SEQ ID NO: 2310440 - DNA, 17 bp, Homo sapiens
ataagactggaaaatag

SEQ ID NO: 2310441 - DNA, 22 bp, Homo sapiens
ataagagacaaagtttggaagt

SEQ ID NO: 2310442 - DNA, 13 bp, Homo sapiens
ataagcgtttaat

SEQ ID NO: 2310443 - DNA, 16 bp, Homo sapiens
ataagctggtatcagt

SEQ ID NO: 2310444 - DNA, 15 bp, Homo sapiens
ataagtgctcagtat

SEQ ID NO: 2310445 - DNA, 13 bp, Homo sapiens
ataataacaacaa

SEQ ID NO: 2310446 - DNA, 10 bp, Homo sapiens
ataatatata

SEQ ID NO: 2310447 - DNA, 21 bp, Homo sapiens
ataatatatatatatatcagt

SEQ ID NO: 2310448 - DNA, 17 bp, Homo sapiens
ataatatcttgaagaat

SEQ ID NO: 2310449 - DNA, 19 bp, Homo sapiens
ataatatcttgaagaatat

SEQ ID NO: 2310450 - DNA, 22 bp, Homo sapiens
ataatatcttgaagaatattgt

SEQ ID NO: 2310451 - DNA, 23 bp, Homo sapiens
ataatatcttgaagaatattgtt

SEQ ID NO: 2310452 - DNA, 11 bp, Homo sapiens
ataatatgaat

SEQ ID NO: 2310453 - DNA, 12 bp, Homo sapiens
ataatatgaata

SEQ ID NO: 2310454 - DNA, 14 bp, Homo sapiens
ataatatttaggca

SEQ ID NO: 2310455 - DNA, 15 bp, Homo sapiens
ataatctctttccat

SEQ ID NO: 2310456 - DNA, 17 bp, Homo sapiens
ataatgatctgaatctg

SEQ ID NO: 2310457 - DNA, 15 bp, Homo sapiens
ataatgcaattagat

SEQ ID NO: 2310458 - DNA, 23 bp, Homo sapiens
ataatgcaattagatagaaaagg

SEQ ID NO: 2310459 - DNA, 17 bp, Homo sapiens
ataatgcttaacataaa

SEQ ID NO: 2310460 - DNA, 16 bp, Homo sapiens
ataatggaattatgta

SEQ ID NO: 2310461 - DNA, 20 bp, Homo sapiens
ataattagctatatttttat

SEQ ID NO: 2310462 - DNA, 12 bp, Homo sapiens
ataattcattta

SEQ ID NO: 2310463 - DNA, 17 bp, Homo sapiens
ataatttccaaactgtt

SEQ ID NO: 2310464 - DNA, 23 bp, Homo sapiens
ataatttgccagacagagatcag

SEQ ID NO: 2310465 - DNA, 14 bp, Homo sapiens
atacaaagctgtca

SEQ ID NO: 2310466 - DNA, 15 bp, Homo sapiens
atacactgtatctaa

SEQ ID NO: 2310467 - DNA, 13 bp, Homo sapiens
atacagcatgaga

SEQ ID NO: 2310468 - DNA, 22 bp, Homo sapiens
atacagcatgagattgtacatt

SEQ ID NO: 2310469 - DNA, 23 bp, Homo sapiens
atacagcatgagattgtacattt

SEQ ID NO: 2310470 - DNA, 18 bp, Homo sapiens
atacagtattatagatat

SEQ ID NO: 2310471 - DNA, 18 bp, Homo sapiens
atacataaaagaatgtac

SEQ ID NO: 2310472 - DNA, 22 bp, Homo sapiens
atacataaaagaatgtacagaa

SEQ ID NO: 2310473 - DNA, 17 bp, Homo sapiens
atacatacctctctcta

SEQ ID NO: 2310474 - DNA, 12 bp, Homo sapiens
atacatgtatag

SEQ ID NO: 2310475 - DNA, 13 bp, Homo sapiens
atacatgtatagt

SEQ ID NO: 2310476 - DNA, 15 bp, Homo sapiens
atacatgtatagtga

SEQ ID NO: 2310477 - DNA, 15 bp, Homo sapiens
atacatttagaacct

SEQ ID NO: 2310478 - DNA, 22 bp, Homo sapiens
atacatttagttaacacacata

SEQ ID NO: 2310479 - DNA, 16 bp, Homo sapiens
ataccaactatttcaa

SEQ ID NO: 2310480 - DNA, 17 bp, Homo sapiens
ataccaactatttcaat

SEQ ID NO: 2310481 - DNA, 21 bp, Homo sapiens
ataccaactatttcaataagt

SEQ ID NO: 2310482 - DNA, 15 bp, Homo sapiens
attcatttaagaaca

SEQ ID NO: 2310483 - DNA, 15 bp, Homo sapiens
attcatttacaactt

SEQ ID NO: 2310484 - DNA, 15 bp, Homo sapiens
attcatttttctgtt

SEQ ID NO: 2310485 - DNA, 20 bp, Homo sapiens
attccaacccaggtctgctt

SEQ ID NO: 2310486 - DNA, 15 bp, Homo sapiens
attccaactttcagg

SEQ ID NO: 2310487 - DNA, 21 bp, Homo sapiens
attccagaacgccctgtgtcc

SEQ ID NO: 2310488 - DNA, 20 bp, Homo sapiens
attccagcgtctgctgttga

SEQ ID NO: 2310489 - DNA, 14 bp, Homo sapiens
attccccggagctg

SEQ ID NO: 2310490 - DNA, 16 bp, Homo sapiens
attcctggaaaactgg

SEQ ID NO: 2310491 - DNA, 15 bp, Homo sapiens
attctagtcaactgc

SEQ ID NO: 2310492 - DNA, 17 bp, Homo sapiens
attctatatttcatatt

SEQ ID NO: 2310493 - DNA, 17 bp, Homo sapiens
attctcattttgctttt

SEQ ID NO: 2310494 - DNA, 20 bp, Homo sapiens
attctctagacaaaatccat

SEQ ID NO: 2310495 - DNA, 12 bp, Homo sapiens
attctcttctca

SEQ ID NO: 2310496 - DNA, 18 bp, Homo sapiens
attctgctaatttatgaa

SEQ ID NO: 2310497 - DNA, 20 bp, Homo sapiens
attctgctaatttatgaaga

SEQ ID NO: 2310498 - DNA, 19 bp, Homo sapiens
attctgtggattctatatt

SEQ ID NO: 2310499 - DNA, 21 bp, Homo sapiens
attctgtggctgccatcagaa

SEQ ID NO: 2310500 - DNA, 20 bp, Homo sapiens
attctttaacatacatctaa

SEQ ID NO: 2310501 - DNA, 19 bp, Homo sapiens
attctttctctttgaaaaa

SEQ ID NO: 2310502 - DNA, 23 bp, Homo sapiens
attcttttcagcttgtttctata

SEQ ID NO: 2310503 - DNA, 16 bp, Homo sapiens
attcttttgaaagatg

SEQ ID NO: 2310504 - DNA, 21 bp, Homo sapiens
attcttttttcaatgtactgt

SEQ ID NO: 2310505 - DNA, 15 bp, Homo sapiens
attgaaaaaccattt

SEQ ID NO: 2310506 - DNA, 15 bp, Homo sapiens
attgaaaagaagaaa

SEQ ID NO: 2310507 - DNA, 17 bp, Homo sapiens
attgaaatttatgacta

SEQ ID NO: 2310508 - DNA, 19 bp, Homo sapiens
attgaaccgtcaatgtgaa

SEQ ID NO: 2310509 - DNA, 19 bp, Homo sapiens
attgacgacctacatctga

SEQ ID NO: 2310510 - DNA, 22 bp, Homo sapiens
attgacgacctacatctgaaat

SEQ ID NO: 2310511 - DNA, 20 bp, Homo sapiens
attgagactgctagaaccaa

SEQ ID NO: 2310512 - DNA, 17 bp, Homo sapiens
attgagggaaaacataa

SEQ ID NO: 2310513 - DNA, 13 bp, Homo sapiens
attgattaaaagc

SEQ ID NO: 2310514 - DNA, 16 bp, Homo sapiens
attgcagtatcagagg

SEQ ID NO: 2310515 - DNA, 20 bp, Homo sapiens
attgcataagtggacccagc

SEQ ID NO: 2310516 - DNA, 21 bp, Homo sapiens
attgcataagtggacccagct

SEQ ID NO: 2310517 - DNA, 13 bp, Homo sapiens
attgcctctgtct

SEQ ID NO: 2310518 - DNA, 14 bp, Homo sapiens
attgctgacagagc

SEQ ID NO: 2310519 - DNA, 16 bp, Homo sapiens
attgctgacagagccc

SEQ ID NO: 2310520 - DNA, 15 bp, Homo sapiens
attgctgatggtgca

SEQ ID NO: 2310521 - DNA, 17 bp, Homo sapiens
attggcagtggcagaga

SEQ ID NO: 2310522 - DNA, 15 bp, Homo sapiens
attggcatggatttc

SEQ ID NO: 2310523 - DNA, 16 bp, Homo sapiens
attggttacaaatttt

SEQ ID NO: 2310524 - DNA, 16 bp, Homo sapiens
attgtaaggaatgatt

SEQ ID NO: 2310525 - DNA, 15 bp, Homo sapiens
attgtagagcacatt

SEQ ID NO: 2310526 - DNA, 17 bp, Homo sapiens
attgtagagcacattta

SEQ ID NO: 2310527 - DNA, 13 bp, Homo sapiens
attgtattcctca

SEQ ID NO: 2310528 - DNA, 16 bp, Homo sapiens
attgtcaaagtggtga

SEQ ID NO: 2310529 - DNA, 23 bp, Homo sapiens
attgtcaaagtggtgagaggcat

SEQ ID NO: 2310530 - DNA, 11 bp, Homo sapiens
attgtgccaaa

SEQ ID NO: 2310531 - DNA, 16 bp, Homo sapiens
attgtgtaactgttct

SEQ ID NO: 2310532 - DNA, 17 bp, Homo sapiens
attgtgtaactgttctt

SEQ ID NO: 2310533 - DNA, 12 bp, Homo sapiens
attgtgtaagaa

SEQ ID NO: 2310534 - DNA, 16 bp, Homo sapiens
attgttagtctcttga

SEQ ID NO: 2310535 - DNA, 18 bp, Homo sapiens
attgttatacctttttga

SEQ ID NO: 2310536 - DNA, 15 bp, Homo sapiens
attgttgaatgtatt

SEQ ID NO: 2310537 - DNA, 19 bp, Homo sapiens
attgttgaatgtattcttt

SEQ ID NO: 2310538 - DNA, 15 bp, Homo sapiens
attgtttaattgtag

SEQ ID NO: 2310539 - DNA, 16 bp, Homo sapiens
atttaaaaagcccaac

SEQ ID NO: 2310540 - DNA, 18 bp, Homo sapiens
atttaaaaagcccaacct

SEQ ID NO: 2310541 - DNA, 17 bp, Homo sapiens
atttaaaaagctgacta

SEQ ID NO: 2310542 - DNA, 20 bp, Homo sapiens
atttaaaaatctttcagaat

SEQ ID NO: 2310543 - DNA, 22 bp, Homo sapiens
atttaaaatagttttctaaatg

SEQ ID NO: 2310544 - DNA, 12 bp, Homo sapiens
atttaaaattca

SEQ ID NO: 2310545 - DNA, 16 bp, Homo sapiens
atttaaaggaaagttc

SEQ ID NO: 2310546 - DNA, 15 bp, Homo sapiens
atttaactgcatata

SEQ ID NO: 2310547 - DNA, 18 bp, Homo sapiens
atttaactgcatatagat

SEQ ID NO: 2310548 - DNA, 13 bp, Homo sapiens
atttaagaacaga

SEQ ID NO: 2310549 - DNA, 13 bp, Homo sapiens
atttaagcatttt

SEQ ID NO: 2310550 - DNA, 22 bp, Homo sapiens
atttaatgtcgaggctctattt

SEQ ID NO: 2310551 - DNA, 20 bp, Homo sapiens
atttaattatattatgaata

SEQ ID NO: 2310552 - DNA, 15 bp, Homo sapiens
atttaattgtgtaac

SEQ ID NO: 2310553 - DNA, 16 bp, Homo sapiens
atttacaacttccaga

SEQ ID NO: 2310554 - DNA, 18 bp, Homo sapiens
atttacagttactgccta

SEQ ID NO: 2310555 - DNA, 15 bp, Homo sapiens
atttagccagaatgt

SEQ ID NO: 2310556 - DNA, 16 bp, Homo sapiens
atttagccagaatgtt

SEQ ID NO: 2310557 - DNA, 18 bp, Homo sapiens
atttagccagaatgtttc

SEQ ID NO: 2310558 - DNA, 18 bp, Homo sapiens
atttaggcatgagctctt

SEQ ID NO: 2310559 - DNA, 22 bp, Homo sapiens
atttaggcatgagctcttggca

SEQ ID NO: 2310560 - DNA, 16 bp, Homo sapiens
atttagtatctgtaat

SEQ ID NO: 2310561 - DNA, 20 bp, Homo sapiens
atttagtccaatgaagataa

SEQ ID NO: 2310562 - DNA, 15 bp, Homo sapiens
atttatattcagaga

SEQ ID NO: 2310563 - DNA, 19 bp, Homo sapiens
atttatattcagagatgta

SEQ ID NO: 2310564 - DNA, 23 bp, Homo sapiens
atttatattcagagatgtaccat

SEQ ID NO: 2310565 - DNA, 14 bp, Homo sapiens
atttatcttatcta

SEQ ID NO: 2310566 - DNA, 23 bp, Homo sapiens
atttatcttatctagcaagaaga

SEQ ID NO: 2310567 - DNA, 21 bp, Homo sapiens
atttatcttccatatgctctt

SEQ ID NO: 2310568 - DNA, 16 bp, Homo sapiens
atttatgaagatagtt

SEQ ID NO: 2310569 - DNA, 15 bp, Homo sapiens
atttatgactagcaa

SEQ ID NO: 2310570 - DNA, 15 bp, Homo sapiens
atttatgttctcaac

SEQ ID NO: 2310571 - DNA, 23 bp, Homo sapiens
atttattagttaggtgtgccaaa

SEQ ID NO: 2310572 - DNA, 16 bp, Homo sapiens
atttattcatgtgtac

SEQ ID NO: 2310573 - DNA, 18 bp, Homo sapiens
atttatttatgttctcaa

SEQ ID NO: 2310574 - DNA, 19 bp, Homo sapiens
atttcaaaccagtttcaca

SEQ ID NO: 2310575 - DNA, 16 bp, Homo sapiens
atttcaaagaaaacag

SEQ ID NO: 2310576 - DNA, 16 bp, Homo sapiens
atttcaataagtgttg

SEQ ID NO: 2310577 - DNA, 18 bp, Homo sapiens
atttcaatgattgtttaa

SEQ ID NO: 2310578 - DNA, 23 bp, Homo sapiens
atttcaatgattgtttaattgta

SEQ ID NO: 2310579 - DNA, 21 bp, Homo sapiens
atttcatccaccaatatcatg

SEQ ID NO: 2310580 - DNA, 22 bp, Homo sapiens
atttcatccaccaatatcatgt

SEQ ID NO: 2310581 - DNA, 20 bp, Homo sapiens
atttcatcttgcaaatgttg

SEQ ID NO: 2310582 - DNA, 14 bp, Homo sapiens
atttcatttatact

SEQ ID NO: 2310583 - DNA, 15 bp, Homo sapiens
atttcatttatactg

SEQ ID NO: 2310584 - DNA, 16 bp, Homo sapiens
atttcatttatactgt

SEQ ID NO: 2310585 - DNA, 17 bp, Homo sapiens
atttcatttatactgta

SEQ ID NO: 2310586 - DNA, 16 bp, Homo sapiens
atttcccaaagcagtg

SEQ ID NO: 2310587 - DNA, 15 bp, Homo sapiens
atttcccctcccgct

SEQ ID NO: 2310588 - DNA, 14 bp, Homo sapiens
atttccctatttta

SEQ ID NO: 2310589 - DNA, 22 bp, Homo sapiens
atttccgaagaccttctgaaga

SEQ ID NO: 2310590 - DNA, 23 bp, Homo sapiens
atttccgaagaccttctgaagat

SEQ ID NO: 2310591 - DNA, 16 bp, Homo sapiens
atttccgtgagagtca

SEQ ID NO: 2310592 - DNA, 21 bp, Homo sapiens
atttccgtgagagtcatctca

SEQ ID NO: 2310593 - DNA, 23 bp, Homo sapiens
atttccgtgagagtcatctcaaa

SEQ ID NO: 2310594 - DNA, 16 bp, Homo sapiens
atttcggaaatacact

SEQ ID NO: 2310595 - DNA, 20 bp, Homo sapiens
atttctaactaaggacagga

SEQ ID NO: 2310596 - DNA, 13 bp, Homo sapiens
atttctaactatt

SEQ ID NO: 2310597 - DNA, 18 bp, Homo sapiens
atttctaagcttatttct

SEQ ID NO: 2310598 - DNA, 19 bp, Homo sapiens
atttctaagcttatttcta

SEQ ID NO: 2310599 - DNA, 20 bp, Homo sapiens
atttctaagcttatttctaa

SEQ ID NO: 2310600 - DNA, 17 bp, Homo sapiens
atttctatctgcaaata

SEQ ID NO: 2310601 - DNA, 21 bp, Homo sapiens
atttctatgagacctccccca

SEQ ID NO: 2310602 - DNA, 14 bp, Homo sapiens
atttctcttcctaa

SEQ ID NO: 2310603 - DNA, 20 bp, Homo sapiens
atttctgctcagattccccc

SEQ ID NO: 2310604 - DNA, 20 bp, Homo sapiens
atttcttaccatgcatttct

SEQ ID NO: 2310605 - DNA, 17 bp, Homo sapiens
atttcttatttgaaagt

SEQ ID NO: 2310606 - DNA, 17 bp, Homo sapiens
atttctttccttcccaa

SEQ ID NO: 2310607 - DNA, 18 bp, Homo sapiens
atttctttccttcccaat

SEQ ID NO: 2310608 - DNA, 15 bp, Homo sapiens
atttgaaagaagtca

SEQ ID NO: 2310609 - DNA, 23 bp, Homo sapiens
atttgaaagtgtttttctttaat

SEQ ID NO: 2310610 - DNA, 18 bp, Homo sapiens
atttgaaagtttccttat

SEQ ID NO: 2310611 - DNA, 22 bp, Homo sapiens
atttgaacagttggctgtatga

SEQ ID NO: 2310612 - DNA, 18 bp, Homo sapiens
atttgagctgcctggagg

SEQ ID NO: 2310613 - DNA, 20 bp, Homo sapiens
atttgatcttgtaaaaatag

SEQ ID NO: 2310614 - DNA, 19 bp, Homo sapiens
cactgtatctaaaaaataa

SEQ ID NO: 2310615 - DNA, 20 bp, Homo sapiens
cactgtcataatctctttcc

SEQ ID NO: 2310616 - DNA, 22 bp, Homo sapiens
cactgtctgctaccagggctca

SEQ ID NO: 2310617 - DNA, 15 bp, Homo sapiens
cactgtggaacacta

SEQ ID NO: 2310618 - DNA, 15 bp, Homo sapiens
cactgtttcttgctt

SEQ ID NO: 2310619 - DNA, 18 bp, Homo sapiens
cactgtttcttgcttgta

SEQ ID NO: 2310620 - DNA, 23 bp, Homo sapiens
cacttagaatactacagcataaa

SEQ ID NO: 2310621 - DNA, 23 bp, Homo sapiens
cacttagctgttggaatgttgtt

SEQ ID NO: 2310622 - DNA, 12 bp, Homo sapiens
cacttattttct

SEQ ID NO: 2310623 - DNA, 13 bp, Homo sapiens
cacttctgttatc

SEQ ID NO: 2310624 - DNA, 17 bp, Homo sapiens
cacttgaacaaaatctg

SEQ ID NO: 2310625 - DNA, 13 bp, Homo sapiens
cacttgcaaatga

SEQ ID NO: 2310626 - DNA, 20 bp, Homo sapiens
cactttcatctgagctttta

SEQ ID NO: 2310627 - DNA, 19 bp, Homo sapiens
cactttcgcctcctccagc

SEQ ID NO: 2310628 - DNA, 24 bp, Homo sapiens
cactttcgcctcctccagctcctg

SEQ ID NO: 2310629 - DNA, 18 bp, Homo sapiens
cactttggtaatgtgtca

SEQ ID NO: 2310630 - DNA, 15 bp, Homo sapiens
cagaaacaactgcca

SEQ ID NO: 2310631 - DNA, 21 bp, Homo sapiens
cagaaacaactgccaaataaa

SEQ ID NO: 2310632 - DNA, 19 bp, Homo sapiens
cagaaatgtggatgctctt

SEQ ID NO: 2310633 - DNA, 14 bp, Homo sapiens
cagaaattttctac

SEQ ID NO: 2310634 - DNA, 20 bp, Homo sapiens
cagaacaaacctctatatgt

SEQ ID NO: 2310635 - DNA, 21 bp, Homo sapiens
cagaacaggaggtgtgaatgc

SEQ ID NO: 2310636 - DNA, 15 bp, Homo sapiens
cagaacgggcctccc

SEQ ID NO: 2310637 - DNA, 17 bp, Homo sapiens
cagaacgggcctccccg

SEQ ID NO: 2310638 - DNA, 18 bp, Homo sapiens
cagaacgggcctccccgg

SEQ ID NO: 2310639 - DNA, 17 bp, Homo sapiens
cagaactcctttctaag

SEQ ID NO: 2310640 - DNA, 23 bp, Homo sapiens
cagaagacttctatggaccacaa

SEQ ID NO: 2310641 - DNA, 18 bp, Homo sapiens
cagaagaggggcagcttt

SEQ ID NO: 2310642 - DNA, 15 bp, Homo sapiens
cagaaggagacagaa

SEQ ID NO: 2310643 - DNA, 20 bp, Homo sapiens
cagaaggctctatctgctgg

SEQ ID NO: 2310644 - DNA, 16 bp, Homo sapiens
cagaaggtatttttga

SEQ ID NO: 2310645 - DNA, 22 bp, Homo sapiens
cagaagtagttttgttcatgaa

SEQ ID NO: 2310646 - DNA, 13 bp, Homo sapiens
cagaatacaattc

SEQ ID NO: 2310647 - DNA, 22 bp, Homo sapiens
cagaatatggacaaagaaggca

SEQ ID NO: 2310648 - DNA, 19 bp, Homo sapiens
cagaatgactctggaacca

SEQ ID NO: 2310649 - DNA, 18 bp, Homo sapiens
cagaatgtttcctgtgga

SEQ ID NO: 2310650 - DNA, 19 bp, Homo sapiens
cagaatgtttcctgtggaa

SEQ ID NO: 2310651 - DNA, 13 bp, Homo sapiens
cagaatttcatac

SEQ ID NO: 2310652 - DNA, 14 bp, Homo sapiens
cagaatttcccaaa

SEQ ID NO: 2310653 - DNA, 17 bp, Homo sapiens
cagaatttcccaaagca

SEQ ID NO: 2310654 - DNA, 20 bp, Homo sapiens
cagaatttcccaaagcagtg

SEQ ID NO: 2310655 - DNA, 22 bp, Homo sapiens
cagacaaagcgtggtggacatg

SEQ ID NO: 2310656 - DNA, 12 bp, Homo sapiens
cagacagagatc

SEQ ID NO: 2310657 - DNA, 17 bp, Homo sapiens
cagaccccatccagcca

SEQ ID NO: 2310658 - DNA, 15 bp, Homo sapiens
cagacccctggggga

SEQ ID NO: 2310659 - DNA, 23 bp, Homo sapiens
cagacccctgggggaggcttcca

SEQ ID NO: 2310660 - DNA, 22 bp, Homo sapiens
cagacctccagattattttcta

SEQ ID NO: 2310661 - DNA, 14 bp, Homo sapiens
cagacctgggccct

SEQ ID NO: 2310662 - DNA, 17 bp, Homo sapiens
cagacggacgggacagc

SEQ ID NO: 2310663 - DNA, 17 bp, Homo sapiens
cagactagctaattagc

SEQ ID NO: 2310664 - DNA, 16 bp, Homo sapiens
cagactcgagagggct

SEQ ID NO: 2310665 - DNA, 21 bp, Homo sapiens
cagactcgagagggctgagcc

SEQ ID NO: 2310666 - DNA, 14 bp, Homo sapiens
cagacttgatttac

SEQ ID NO: 2310667 - DNA, 21 bp, Homo sapiens
cagagacctgctccagatcct

SEQ ID NO: 2310668 - DNA, 16 bp, Homo sapiens
cagagacggcagcccc

SEQ ID NO: 2310669 - DNA, 18 bp, Homo sapiens
cagagacggcagccccat

SEQ ID NO: 2310670 - DNA, 22 bp, Homo sapiens
cagagacggcagccccatcctt

SEQ ID NO: 2310671 - DNA, 16 bp, Homo sapiens
cagagactgcccaccc

SEQ ID NO: 2310672 - DNA, 19 bp, Homo sapiens
cagagactgcccaccctgg

SEQ ID NO: 2310673 - DNA, 23 bp, Homo sapiens
cagagactgcccaccctgggcct

SEQ ID NO: 2310674 - DNA, 24 bp, Homo sapiens
cagagactgcccaccctgggcctc

SEQ ID NO: 2310675 - DNA, 17 bp, Homo sapiens
cagagatggcagagcca

SEQ ID NO: 2310676 - DNA, 14 bp, Homo sapiens
cagagatgtaccat

SEQ ID NO: 2310677 - DNA, 20 bp, Homo sapiens
cagagcaagcgaaagagcaa

SEQ ID NO: 2310678 - DNA, 16 bp, Homo sapiens
cagagcactgtatacc

SEQ ID NO: 2310679 - DNA, 17 bp, Homo sapiens
cagagccatccaccctg

SEQ ID NO: 2310680 - DNA, 17 bp, Homo sapiens
cagagccccggagcacc

SEQ ID NO: 2310681 - DNA, 19 bp, Homo sapiens
cagagccctatctatgtcc

SEQ ID NO: 2310682 - DNA, 22 bp, Homo sapiens
cagagccctatctatgtcctgg

SEQ ID NO: 2310683 - DNA, 20 bp, Homo sapiens
cagagccgcaccctggctgg

SEQ ID NO: 2310684 - DNA, 21 bp, Homo sapiens
cagagccgcaccctggctgga

SEQ ID NO: 2310685 - DNA, 21 bp, Homo sapiens
cagagcgaagacccggccagg

SEQ ID NO: 2310686 - DNA, 20 bp, Homo sapiens
cagagctcccaggacgcagg

SEQ ID NO: 2310687 - DNA, 18 bp, Homo sapiens
cagagctgagtcggctgg

SEQ ID NO: 2310688 - DNA, 20 bp, Homo sapiens
cagagctgagtcggctgggc

SEQ ID NO: 2310689 - DNA, 16 bp, Homo sapiens
cagaggaccagcacac

SEQ ID NO: 2310690 - DNA, 19 bp, Homo sapiens
cagaggagggatagagacg

SEQ ID NO: 2310691 - DNA, 15 bp, Homo sapiens
cagaggcagggccct

SEQ ID NO: 2310692 - DNA, 17 bp, Homo sapiens
cagaggcagggccctgg

SEQ ID NO: 2310693 - DNA, 19 bp, Homo sapiens
cagaggcagggccctgggg

SEQ ID NO: 2310694 - DNA, 18 bp, Homo sapiens
cagaggggcggggccagg

SEQ ID NO: 2310695 - DNA, 14 bp, Homo sapiens
cagagggtggagat

SEQ ID NO: 2310696 - DNA, 16 bp, Homo sapiens
cagagtatatatgtac

SEQ ID NO: 2310697 - DNA, 12 bp, Homo sapiens
cagagtcattgt

SEQ ID NO: 2310698 - DNA, 12 bp, Homo sapiens
cagagtccggga

SEQ ID NO: 2310699 - DNA, 15 bp, Homo sapiens
cagatatttaaattt

SEQ ID NO: 2310700 - DNA, 19 bp, Homo sapiens
cagatcctctttccccact

SEQ ID NO: 2310701 - DNA, 20 bp, Homo sapiens
cagatcctctttccccactg

SEQ ID NO: 2310702 - DNA, 13 bp, Homo sapiens
cagatcctgtccc

SEQ ID NO: 2310703 - DNA, 19 bp, Homo sapiens
cagatcctgtcccatgggc

SEQ ID NO: 2310704 - DNA, 19 bp, Homo sapiens
cagatgacacataaatctg

SEQ ID NO: 2310705 - DNA, 22 bp, Homo sapiens
cagatgagaagactagcagcta

SEQ ID NO: 2310706 - DNA, 18 bp, Homo sapiens
cagatgatccatttgaac

SEQ ID NO: 2310707 - DNA, 13 bp, Homo sapiens
cagatgttttaga

SEQ ID NO: 2310708 - DNA, 17 bp, Homo sapiens
cagatgttttagagata

SEQ ID NO: 2310709 - DNA, 15 bp, Homo sapiens
cagattattttctat

SEQ ID NO: 2310710 - DNA, 18 bp, Homo sapiens
cagattattttctatatt

SEQ ID NO: 2310711 - DNA, 20 bp, Homo sapiens
cagattcagtcttgccttac

SEQ ID NO: 2310712 - DNA, 15 bp, Homo sapiens
cagcaaccagagcac

SEQ ID NO: 2310713 - DNA, 18 bp, Homo sapiens
cagcaaccagagcactgt

SEQ ID NO: 2310714 - DNA, 21 bp, Homo sapiens
cagcaccactcaagaccaaat

SEQ ID NO: 2310715 - DNA, 14 bp, Homo sapiens
cagcacctttgtaa

SEQ ID NO: 2310716 - DNA, 14 bp, Homo sapiens
cagcactcccaggg

SEQ ID NO: 2310717 - DNA, 21 bp, Homo sapiens
cagcactcccagggcccgagc

SEQ ID NO: 2310718 - DNA, 19 bp, Homo sapiens
cagcagaaaacctgttcag

SEQ ID NO: 2310719 - DNA, 16 bp, Homo sapiens
cagcagaatgactctg

SEQ ID NO: 2310720 - DNA, 17 bp, Homo sapiens
cagcagaatgactctgg

SEQ ID NO: 2310721 - DNA, 11 bp, Homo sapiens
cagcagctcca

SEQ ID NO: 2310722 - DNA, 14 bp, Homo sapiens
cagcagctccaacc

SEQ ID NO: 2310723 - DNA, 15 bp, Homo sapiens
cagcagctccaacct

SEQ ID NO: 2310724 - DNA, 21 bp, Homo sapiens
cagcagctccaacctggaggc

SEQ ID NO: 2310725 - DNA, 13 bp, Homo sapiens
cagcagctggact

SEQ ID NO: 2310726 - DNA, 23 bp, Homo sapiens
cagcatagttctgcaataacagt

SEQ ID NO: 2310727 - DNA, 14 bp, Homo sapiens
cagcatgaaccttt

SEQ ID NO: 2310728 - DNA, 14 bp, Homo sapiens
cagcatggagagag

SEQ ID NO: 2310729 - DNA, 12 bp, Homo sapiens
cagcatgtctac

SEQ ID NO: 2310730 - DNA, 14 bp, Homo sapiens
cagccaatttcaaa

SEQ ID NO: 2310731 - DNA, 22 bp, Homo sapiens
cagccaatttcaaagaaaacag

SEQ ID NO: 2310732 - DNA, 17 bp, Homo sapiens
cagcccagaacgggcct

SEQ ID NO: 2310733 - DNA, 20 bp, Homo sapiens
cagcccagaacgggcctccc

SEQ ID NO: 2310734 - DNA, 21 bp, Homo sapiens
cagcccagaacgggcctcccc

SEQ ID NO: 2310735 - DNA, 22 bp, Homo sapiens
cagccccatcccaaacccttca

SEQ ID NO: 2310736 - DNA, 12 bp, Homo sapiens
cagccccatcct

SEQ ID NO: 2310737 - DNA, 17 bp, Homo sapiens
cagccccatccttcccg

SEQ ID NO: 2310738 - DNA, 22 bp, Homo sapiens
cagccccccacgcttctggagg

SEQ ID NO: 2310739 - DNA, 12 bp, Homo sapiens
cagccccctggc

SEQ ID NO: 2310740 - DNA, 21 bp, Homo sapiens
cagcccctccccgcctcctcc

SEQ ID NO: 2310741 - DNA, 13 bp, Homo sapiens
cagcccctgctgc

SEQ ID NO: 2310742 - DNA, 23 bp, Homo sapiens
cagcccctgctgctcctcggcca

SEQ ID NO: 2310743 - DNA, 14 bp, Homo sapiens
cagcccctgctgga

SEQ ID NO: 2310744 - DNA, 12 bp, Homo sapiens
cagcccctgggg

SEQ ID NO: 2310745 - DNA, 22 bp, Homo sapiens
cagcccctggggtacttctgtg

SEQ ID NO: 2310746 - DNA, 21 bp, Homo sapiens
ccaggactctgccttccaggc

SEQ ID NO: 2310747 - DNA, 23 bp, Homo sapiens
ccaggagtgggtgggacacagag

SEQ ID NO: 2310748 - DNA, 22 bp, Homo sapiens
ccaggcaatagtgttgaggagg

SEQ ID NO: 2310749 - DNA, 17 bp, Homo sapiens
ccaggcaccgcctgccc

SEQ ID NO: 2310750 - DNA, 19 bp, Homo sapiens
ccaggcaccgcctgccccc

SEQ ID NO: 2310751 - DNA, 21 bp, Homo sapiens
ccaggcatgaccctggagccc

SEQ ID NO: 2310752 - DNA, 23 bp, Homo sapiens
ccaggcggaggggcttggagcag

SEQ ID NO: 2310753 - DNA, 19 bp, Homo sapiens
ccaggcgtagggccagggc

SEQ ID NO: 2310754 - DNA, 21 bp, Homo sapiens
ccaggctgagccgatctggtc

SEQ ID NO: 2310755 - DNA, 20 bp, Homo sapiens
ccagggcccgagcgcgtgcc

SEQ ID NO: 2310756 - DNA, 16 bp, Homo sapiens
ccagggctctggcagg

SEQ ID NO: 2310757 - DNA, 17 bp, Homo sapiens
ccaggggacctcctggg

SEQ ID NO: 2310758 - DNA, 14 bp, Homo sapiens
ccaggggaggcaca

SEQ ID NO: 2310759 - DNA, 23 bp, Homo sapiens
ccaggggaggcacaaagggcagg

SEQ ID NO: 2310760 - DNA, 12 bp, Homo sapiens
ccaggggcacac

SEQ ID NO: 2310761 - DNA, 15 bp, Homo sapiens
ccagggtgcaggcgc

SEQ ID NO: 2310762 - DNA, 20 bp, Homo sapiens
ccaggtaaagtcaaagcttt

SEQ ID NO: 2310763 - DNA, 19 bp, Homo sapiens
ccaggtcctgtgagcaaag

SEQ ID NO: 2310764 - DNA, 20 bp, Homo sapiens
ccaggtcctgtgagcaaagt

SEQ ID NO: 2310765 - DNA, 19 bp, Homo sapiens
ccagtagggggagggaaag

SEQ ID NO: 2310766 - DNA, 19 bp, Homo sapiens
ccagtatcttgaagacttt

SEQ ID NO: 2310767 - DNA, 16 bp, Homo sapiens
ccagtgagaaattaca

SEQ ID NO: 2310768 - DNA, 23 bp, Homo sapiens
ccagtggacccgcccgcggccct

SEQ ID NO: 2310769 - DNA, 13 bp, Homo sapiens
ccagtgtccccag

SEQ ID NO: 2310770 - DNA, 16 bp, Homo sapiens
ccagttgtatttgaag

SEQ ID NO: 2310771 - DNA, 14 bp, Homo sapiens
ccatagcagtgcta

SEQ ID NO: 2310772 - DNA, 18 bp, Homo sapiens
ccatatagtttgttttct

SEQ ID NO: 2310773 - DNA, 20 bp, Homo sapiens
ccatatagtttgttttcttt

SEQ ID NO: 2310774 - DNA, 22 bp, Homo sapiens
ccatatagtttgttttcttttt

SEQ ID NO: 2310775 - DNA, 17 bp, Homo sapiens
ccatatgattgaaaaga

SEQ ID NO: 2310776 - DNA, 22 bp, Homo sapiens
ccatccacacacagcagctcca

SEQ ID NO: 2310777 - DNA, 13 bp, Homo sapiens
ccatccaccctga

SEQ ID NO: 2310778 - DNA, 15 bp, Homo sapiens
ccatccaccctgagg

SEQ ID NO: 2310779 - DNA, 13 bp, Homo sapiens
ccatccagccagg

SEQ ID NO: 2310780 - DNA, 15 bp, Homo sapiens
ccatccagccagggg

SEQ ID NO: 2310781 - DNA, 16 bp, Homo sapiens
ccatccttttgcttca

SEQ ID NO: 2310782 - DNA, 17 bp, Homo sapiens
ccatccttttgcttcat

SEQ ID NO: 2310783 - DNA, 20 bp, Homo sapiens
ccatctcttgtaccagccca

SEQ ID NO: 2310784 - DNA, 15 bp, Homo sapiens
ccatctgctgagctc

SEQ ID NO: 2310785 - DNA, 16 bp, Homo sapiens
ccatgaggaacaaggc

SEQ ID NO: 2310786 - DNA, 20 bp, Homo sapiens
ccatgaggaacaaggcaagg

SEQ ID NO: 2310787 - DNA, 14 bp, Homo sapiens
ccatgatacaaaga

SEQ ID NO: 2310788 - DNA, 17 bp, Homo sapiens
ccatgatagatataaag

SEQ ID NO: 2310789 - DNA, 18 bp, Homo sapiens
ccatgccctccgtcctgg

SEQ ID NO: 2310790 - DNA, 18 bp, Homo sapiens
ccatgcggccggcctggg

SEQ ID NO: 2310791 - DNA, 21 bp, Homo sapiens
ccatggaagctggcaggagac

SEQ ID NO: 2310792 - DNA, 14 bp, Homo sapiens
ccatggagcacgag

SEQ ID NO: 2310793 - DNA, 13 bp, Homo sapiens
ccatggccccagc

SEQ ID NO: 2310794 - DNA, 13 bp, Homo sapiens
ccatgggctctgg

SEQ ID NO: 2310795 - DNA, 14 bp, Homo sapiens
ccatgggctctggc

SEQ ID NO: 2310796 - DNA, 17 bp, Homo sapiens
ccatggtcacagacccc

SEQ ID NO: 2310797 - DNA, 18 bp, Homo sapiens
ccatggtcacagacccct

SEQ ID NO: 2310798 - DNA, 22 bp, Homo sapiens
ccatgtcctaggggccgaggga

SEQ ID NO: 2310799 - DNA, 12 bp, Homo sapiens
ccatgtttctgt

SEQ ID NO: 2310800 - DNA, 18 bp, Homo sapiens
ccattaatacttccttat

SEQ ID NO: 2310801 - DNA, 22 bp, Homo sapiens
ccattaatacttccttataaaa

SEQ ID NO: 2310802 - DNA, 20 bp, Homo sapiens
ccatttcattgagggaaaac

SEQ ID NO: 2310803 - DNA, 22 bp, Homo sapiens
ccatttctgctcagattccccc

SEQ ID NO: 2310804 - DNA, 18 bp, Homo sapiens
ccatttgcaacaggaaga

SEQ ID NO: 2310805 - DNA, 14 bp, Homo sapiens
ccatttgtaatgta

SEQ ID NO: 2310806 - DNA, 17 bp, Homo sapiens
ccatttgtaatgtatct

SEQ ID NO: 2310807 - DNA, 12 bp, Homo sapiens
ccattttctaaa

SEQ ID NO: 2310808 - DNA, 17 bp, Homo sapiens
cccaaaacaaagtcttt

SEQ ID NO: 2310809 - DNA, 23 bp, Homo sapiens
cccaaactgtagtaattgttaca

SEQ ID NO: 2310810 - DNA, 19 bp, Homo sapiens
cccaacccccacctcccgg

SEQ ID NO: 2310811 - DNA, 18 bp, Homo sapiens
cccaaggcattgattgca

SEQ ID NO: 2310812 - DNA, 11 bp, Homo sapiens
cccaatagaat

SEQ ID NO: 2310813 - DNA, 21 bp, Homo sapiens
cccaattttaaaaaataacat

SEQ ID NO: 2310814 - DNA, 12 bp, Homo sapiens
cccacaaaatat

SEQ ID NO: 2310815 - DNA, 19 bp, Homo sapiens
cccacaaaatatttctaag

SEQ ID NO: 2310816 - DNA, 18 bp, Homo sapiens
cccacaataatgaataat

SEQ ID NO: 2310817 - DNA, 15 bp, Homo sapiens
cccacaattcttttg

SEQ ID NO: 2310818 - DNA, 17 bp, Homo sapiens
cccacaccccgtctgcc

SEQ ID NO: 2310819 - DNA, 21 bp, Homo sapiens
cccacacgccggggctggccc

SEQ ID NO: 2310820 - DNA, 14 bp, Homo sapiens
cccacagatccatc

SEQ ID NO: 2310821 - DNA, 12 bp, Homo sapiens
cccacatccccc

SEQ ID NO: 2310822 - DNA, 15 bp, Homo sapiens
cccacattgcccaca

SEQ ID NO: 2310823 - DNA, 21 bp, Homo sapiens
cccacccccgggtgcctgtga

SEQ ID NO: 2310824 - DNA, 15 bp, Homo sapiens
cccacccgccccaga

SEQ ID NO: 2310825 - DNA, 23 bp, Homo sapiens
cccacccgccccagagactgccc

SEQ ID NO: 2310826 - DNA, 15 bp, Homo sapiens
cccaccctgcttctg

SEQ ID NO: 2310827 - DNA, 12 bp, Homo sapiens
cccaccctgggc

SEQ ID NO: 2310828 - DNA, 12 bp, Homo sapiens
cccacgcagagc

SEQ ID NO: 2310829 - DNA, 13 bp, Homo sapiens
cccacgcagagcc

SEQ ID NO: 2310830 - DNA, 21 bp, Homo sapiens
cccacgcagagccccggagca

SEQ ID NO: 2310831 - DNA, 22 bp, Homo sapiens
cccacgcagagccccggagcac

SEQ ID NO: 2310832 - DNA, 14 bp, Homo sapiens
cccacgcctccatc

SEQ ID NO: 2310833 - DNA, 15 bp, Homo sapiens
cccacgcttctggag

SEQ ID NO: 2310834 - DNA, 19 bp, Homo sapiens
cccacgcttctggaggtgg

SEQ ID NO: 2310835 - DNA, 20 bp, Homo sapiens
cccactgatatcacgggccc

SEQ ID NO: 2310836 - DNA, 18 bp, Homo sapiens
cccactttcgcctcctcc

SEQ ID NO: 2310837 - DNA, 14 bp, Homo sapiens
cccagaaagcctca

SEQ ID NO: 2310838 - DNA, 18 bp, Homo sapiens
cccagaaatgccgctgtg

SEQ ID NO: 2310839 - DNA, 21 bp, Homo sapiens
cccagaaatgccgctgtgtcc

SEQ ID NO: 2310840 - DNA, 18 bp, Homo sapiens
cccagaacgggcctcccc

SEQ ID NO: 2310841 - DNA, 17 bp, Homo sapiens
cccagaccccatccagc

SEQ ID NO: 2310842 - DNA, 14 bp, Homo sapiens
cccagacctaggga

SEQ ID NO: 2310843 - DNA, 14 bp, Homo sapiens
cccagagactgccc

SEQ ID NO: 2310844 - DNA, 17 bp, Homo sapiens
cccagagactgcccacc

SEQ ID NO: 2310845 - DNA, 23 bp, Homo sapiens
cccagagactgcccaccctgggc

SEQ ID NO: 2310846 - DNA, 17 bp, Homo sapiens
cccagaggggcggggcc

SEQ ID NO: 2310847 - DNA, 18 bp, Homo sapiens
cccagaggggcggggcca

SEQ ID NO: 2310848 - DNA, 13 bp, Homo sapiens
cccagatgtttta

SEQ ID NO: 2310849 - DNA, 21 bp, Homo sapiens
cccagatgttttagagataaa

SEQ ID NO: 2310850 - DNA, 21 bp, Homo sapiens
cccagccccagcgagtctgga

SEQ ID NO: 2310851 - DNA, 11 bp, Homo sapiens
cccagcctccc

SEQ ID NO: 2310852 - DNA, 16 bp, Homo sapiens
cccagctcactgcagc

SEQ ID NO: 2310853 - DNA, 16 bp, Homo sapiens
cccagctggctgggtc

SEQ ID NO: 2310854 - DNA, 17 bp, Homo sapiens
cccaggacgcagggaga

SEQ ID NO: 2310855 - DNA, 21 bp, Homo sapiens
cccaggacgcagggagaccct

SEQ ID NO: 2310856 - DNA, 23 bp, Homo sapiens
cccaggacgcagggagaccctgg

SEQ ID NO: 2310857 - DNA, 19 bp, Homo sapiens
cccaggacggtctgtgccc

SEQ ID NO: 2310858 - DNA, 20 bp, Homo sapiens
cccaggacggtctgtgcccg

SEQ ID NO: 2310859 - DNA, 22 bp, Homo sapiens
cccaggcaatagtgttgaggag

SEQ ID NO: 2310860 - DNA, 15 bp, Homo sapiens
cccaggcggaggggc

SEQ ID NO: 2310861 - DNA, 20 bp, Homo sapiens
cccaggctgcgcctgcccgc

SEQ ID NO: 2310862 - DNA, 12 bp, Homo sapiens
cccagggagggg

SEQ ID NO: 2310863 - DNA, 20 bp, Homo sapiens
cccaggggcacacttcccct

SEQ ID NO: 2310864 - DNA, 14 bp, Homo sapiens
cccagggtgcaggc

SEQ ID NO: 2310865 - DNA, 16 bp, Homo sapiens
cccagggtgcaggcgc

SEQ ID NO: 2310866 - DNA, 14 bp, Homo sapiens
cccagtgtccccag

SEQ ID NO: 2310867 - DNA, 15 bp, Homo sapiens
cccagtgtccccagg

SEQ ID NO: 2310868 - DNA, 14 bp, Homo sapiens
cccagttagcccgg

SEQ ID NO: 2310869 - DNA, 16 bp, Homo sapiens
cccagttagcccggcc

SEQ ID NO: 2310870 - DNA, 14 bp, Homo sapiens
cccatccagccagg

SEQ ID NO: 2310871 - DNA, 15 bp, Homo sapiens
cccatccagccaggg

SEQ ID NO: 2310872 - DNA, 21 bp, Homo sapiens
cccatccttcccgcagcacca

SEQ ID NO: 2310873 - DNA, 17 bp, Homo sapiens
cccatctcacctctagg

SEQ ID NO: 2310874 - DNA, 23 bp, Homo sapiens
cccatctcacctctaggcctcag

SEQ ID NO: 2310875 - DNA, 21 bp, Homo sapiens
cccatgccctccgtcctggca

SEQ ID NO: 2310876 - DNA, 15 bp, Homo sapiens
cccatggccccagct

SEQ ID NO: 2310877 - DNA, 18 bp, Homo sapiens
cccatggtcacagacccc

SEQ ID NO: 2310878 - DNA, 13 bp, Homo sapiens
cctgcccgcccgc

SEQ ID NO: 2310879 - DNA, 16 bp, Homo sapiens
cctgccctggccactg

SEQ ID NO: 2310880 - DNA, 22 bp, Homo sapiens
cctgccctggccactggccctg

SEQ ID NO: 2310881 - DNA, 18 bp, Homo sapiens
cctgccgacggagccact

SEQ ID NO: 2310882 - DNA, 20 bp, Homo sapiens
cctgcctctgaactgctgct

SEQ ID NO: 2310883 - DNA, 23 bp, Homo sapiens
cctgcgcaaagggcgggcctgtt

SEQ ID NO: 2310884 - DNA, 19 bp, Homo sapiens
cctgcgccccccagtggac

SEQ ID NO: 2310885 - DNA, 22 bp, Homo sapiens
cctgcgccccccagtggactcg

SEQ ID NO: 2310886 - DNA, 13 bp, Homo sapiens
cctgcgctcctct

SEQ ID NO: 2310887 - DNA, 15 bp, Homo sapiens
cctgcgctcctctgc

SEQ ID NO: 2310888 - DNA, 16 bp, Homo sapiens
cctgcgctcctctgca

SEQ ID NO: 2310889 - DNA, 17 bp, Homo sapiens
cctgcgctcctctgcag

SEQ ID NO: 2310890 - DNA, 19 bp, Homo sapiens
cctgcgctcctctgcagcc

SEQ ID NO: 2310891 - DNA, 21 bp, Homo sapiens
cctgcgctcctctgcagcctg

SEQ ID NO: 2310892 - DNA, 17 bp, Homo sapiens
cctgcgtggcctggggc

SEQ ID NO: 2310893 - DNA, 23 bp, Homo sapiens
cctgcgtggcctggggctgccgt

SEQ ID NO: 2310894 - DNA, 17 bp, Homo sapiens
cctgcgtgttctcagag

SEQ ID NO: 2310895 - DNA, 15 bp, Homo sapiens
cctgctagcggctga

SEQ ID NO: 2310896 - DNA, 11 bp, Homo sapiens
cctgctccaga

SEQ ID NO: 2310897 - DNA, 16 bp, Homo sapiens
cctgctccagatcctc

SEQ ID NO: 2310898 - DNA, 23 bp, Homo sapiens
cctgctgagtggtccacattctg

SEQ ID NO: 2310899 - DNA, 14 bp, Homo sapiens
cctgctgcctgcag

SEQ ID NO: 2310900 - DNA, 19 bp, Homo sapiens
cctgctgctcctcggccag

SEQ ID NO: 2310901 - DNA, 23 bp, Homo sapiens
cctgctgctcgggaaggcctgag

SEQ ID NO: 2310902 - DNA, 19 bp, Homo sapiens
cctgcttctgctgcctgtt

SEQ ID NO: 2310903 - DNA, 14 bp, Homo sapiens
cctggacaggcttc

SEQ ID NO: 2310904 - DNA, 20 bp, Homo sapiens
cctggaggctggaccaactg

SEQ ID NO: 2310905 - DNA, 14 bp, Homo sapiens
cctggaggggccca

SEQ ID NO: 2310906 - DNA, 21 bp, Homo sapiens
cctggaggggcccatgtgggc

SEQ ID NO: 2310907 - DNA, 12 bp, Homo sapiens
cctggagtggca

SEQ ID NO: 2310908 - DNA, 18 bp, Homo sapiens
cctggagtggcatggtcc

SEQ ID NO: 2310909 - DNA, 20 bp, Homo sapiens
cctggattttctttctatgt

SEQ ID NO: 2310910 - DNA, 21 bp, Homo sapiens
cctggattttctttctatgta

SEQ ID NO: 2310911 - DNA, 16 bp, Homo sapiens
cctggcaaataatact

SEQ ID NO: 2310912 - DNA, 12 bp, Homo sapiens
cctggcagggca

SEQ ID NO: 2310913 - DNA, 22 bp, Homo sapiens
cctggcagggcaggcagagctc

SEQ ID NO: 2310914 - DNA, 13 bp, Homo sapiens
cctggcatgggaa

SEQ ID NO: 2310915 - DNA, 17 bp, Homo sapiens
cctggcatgggaatgaa

SEQ ID NO: 2310916 - DNA, 13 bp, Homo sapiens
cctggccactggc

SEQ ID NO: 2310917 - DNA, 17 bp, Homo sapiens
cctggccactggccctg

SEQ ID NO: 2310918 - DNA, 19 bp, Homo sapiens
cctggcccctcccacatcc

SEQ ID NO: 2310919 - DNA, 20 bp, Homo sapiens
cctggcccctcccacatccc

SEQ ID NO: 2310920 - DNA, 12 bp, Homo sapiens
cctggcgggcag

SEQ ID NO: 2310921 - DNA, 23 bp, Homo sapiens
cctggcgggcagcccctgctgga

SEQ ID NO: 2310922 - DNA, 13 bp, Homo sapiens
cctggctggaatg

SEQ ID NO: 2310923 - DNA, 20 bp, Homo sapiens
cctggcttgaagctgctcac

SEQ ID NO: 2310924 - DNA, 23 bp, Homo sapiens
cctggcttgagtgatcctcccgc

SEQ ID NO: 2310925 - DNA, 15 bp, Homo sapiens
cctgggagatgctgg

SEQ ID NO: 2310926 - DNA, 21 bp, Homo sapiens
cctgggcatccccagccccct

SEQ ID NO: 2310927 - DNA, 15 bp, Homo sapiens
cctgggccagggtct

SEQ ID NO: 2310928 - DNA, 23 bp, Homo sapiens
cctgggccagggtctcgtcagga

SEQ ID NO: 2310929 - DNA, 15 bp, Homo sapiens
cctgggccccgcctc

SEQ ID NO: 2310930 - DNA, 16 bp, Homo sapiens
cctgggccccgcctca

SEQ ID NO: 2310931 - DNA, 13 bp, Homo sapiens
cctgggccctggt

SEQ ID NO: 2310932 - DNA, 12 bp, Homo sapiens
cctgggctctgg

SEQ ID NO: 2310933 - DNA, 14 bp, Homo sapiens
cctgggctctgggt

SEQ ID NO: 2310934 - DNA, 17 bp, Homo sapiens
cctggggtcccccctcc

SEQ ID NO: 2310935 - DNA, 18 bp, Homo sapiens
cctggggtcccccctccc

SEQ ID NO: 2310936 - DNA, 14 bp, Homo sapiens
cctggggtctctga

SEQ ID NO: 2310937 - DNA, 23 bp, Homo sapiens
cctggggtctctgagcagtgggg

SEQ ID NO: 2310938 - DNA, 15 bp, Homo sapiens
cctgggtgtgacctg

SEQ ID NO: 2310939 - DNA, 15 bp, Homo sapiens
cctggtatggctgca

SEQ ID NO: 2310940 - DNA, 20 bp, Homo sapiens
cctggtcagttttcacagag

SEQ ID NO: 2310941 - DNA, 14 bp, Homo sapiens
cctggtgtctagtt

SEQ ID NO: 2310942 - DNA, 17 bp, Homo sapiens
cctggttcccccaggac

SEQ ID NO: 2310943 - DNA, 21 bp, Homo sapiens
cctggttcccccaggaccctg

SEQ ID NO: 2310944 - DNA, 20 bp, Homo sapiens
cctgtaatgcactcctgccc

SEQ ID NO: 2310945 - DNA, 20 bp, Homo sapiens
cctgtccactctgctcaggg

SEQ ID NO: 2310946 - DNA, 22 bp, Homo sapiens
cctgtcccatgggctctggccc

SEQ ID NO: 2310947 - DNA, 22 bp, Homo sapiens
cctgtctaatgaaacctgtgtc

SEQ ID NO: 2310948 - DNA, 14 bp, Homo sapiens
cctgtctcagctgt

SEQ ID NO: 2310949 - DNA, 16 bp, Homo sapiens
cctgtgaccggggtcc

SEQ ID NO: 2310950 - DNA, 20 bp, Homo sapiens
cctgtgaccggggtcctgag

SEQ ID NO: 2310951 - DNA, 16 bp, Homo sapiens
cctgtgcaaaataaaa

SEQ ID NO: 2310952 - DNA, 11 bp, Homo sapiens
cctgtgctttc

SEQ ID NO: 2310953 - DNA, 23 bp, Homo sapiens
cctgtggaaatatgcaacctgtg

SEQ ID NO: 2310954 - DNA, 15 bp, Homo sapiens
cctgtggctccagga

SEQ ID NO: 2310955 - DNA, 20 bp, Homo sapiens
cctgttaggggaaaatagta

SEQ ID NO: 2310956 - DNA, 16 bp, Homo sapiens
cctgttccctgaggac

SEQ ID NO: 2310957 - DNA, 14 bp, Homo sapiens
cctgttctgtgtct

SEQ ID NO: 2310958 - DNA, 18 bp, Homo sapiens
cctgttctgtgtctgctg

SEQ ID NO: 2310959 - DNA, 14 bp, Homo sapiens
cctgtttggtgagg

SEQ ID NO: 2310960 - DNA, 16 bp, Homo sapiens
ccttaaaataatgatt

SEQ ID NO: 2310961 - DNA, 23 bp, Homo sapiens
ccttactagattcataatgcaat

SEQ ID NO: 2310962 - DNA, 20 bp, Homo sapiens
ccttcaaaaatgtgctgcct

SEQ ID NO: 2310963 - DNA, 13 bp, Homo sapiens
ccttcagtgcctt

SEQ ID NO: 2310964 - DNA, 19 bp, Homo sapiens
ccttcagtgccttatggaa

SEQ ID NO: 2310965 - DNA, 24 bp, Homo sapiens
ccttccaggcgtagggccagggct

SEQ ID NO: 2310966 - DNA, 22 bp, Homo sapiens
ccttcccgcagcaccagcctga

SEQ ID NO: 2310967 - DNA, 20 bp, Homo sapiens
ccttctaaagtgctgggatt

SEQ ID NO: 2310968 - DNA, 18 bp, Homo sapiens
ccttctatactttctcac

SEQ ID NO: 2310969 - DNA, 19 bp, Homo sapiens
ccttgaactgtggccacct

SEQ ID NO: 2310970 - DNA, 15 bp, Homo sapiens
ccttgaattcttttc

SEQ ID NO: 2310971 - DNA, 22 bp, Homo sapiens
ccttgaattcttttcctctctt

SEQ ID NO: 2310972 - DNA, 17 bp, Homo sapiens
ccttgaccccacacgcc

SEQ ID NO: 2310973 - DNA, 23 bp, Homo sapiens
ccttgctcaccaagctgttccac

SEQ ID NO: 2310974 - DNA, 17 bp, Homo sapiens
ccttgcttctaagggat

SEQ ID NO: 2310975 - DNA, 20 bp, Homo sapiens
ccttggacggggacacggcc

SEQ ID NO: 2310976 - DNA, 14 bp, Homo sapiens
ccttgggcacggga

SEQ ID NO: 2310977 - DNA, 19 bp, Homo sapiens
ccttgtacagaaccagcac

SEQ ID NO: 2310978 - DNA, 22 bp, Homo sapiens
ccttgtacagaaccagcactcc

SEQ ID NO: 2310979 - DNA, 18 bp, Homo sapiens
ccttgtgtactttcttcc

SEQ ID NO: 2310980 - DNA, 17 bp, Homo sapiens
cctttaataatgttata

SEQ ID NO: 2310981 - DNA, 19 bp, Homo sapiens
cctttcaaacattgagact

SEQ ID NO: 2310982 - DNA, 21 bp, Homo sapiens
cctttcaataggaaaaactga

SEQ ID NO: 2310983 - DNA, 15 bp, Homo sapiens
cctttggtgaataac

SEQ ID NO: 2310984 - DNA, 17 bp, Homo sapiens
ccttttgagtgccttac

SEQ ID NO: 2310985 - DNA, 15 bp, Homo sapiens
cgaaaacagatgaga

SEQ ID NO: 2310986 - DNA, 15 bp, Homo sapiens
cgaaaggtcacctca

SEQ ID NO: 2310987 - DNA, 18 bp, Homo sapiens
cgaaaggtcacctcactc

SEQ ID NO: 2310988 - DNA, 23 bp, Homo sapiens
cgaaaggtcacctcactcagcac

SEQ ID NO: 2310989 - DNA, 16 bp, Homo sapiens
cgaagaccttctgaag

SEQ ID NO: 2310990 - DNA, 15 bp, Homo sapiens
cgaagtccgaggcct

SEQ ID NO: 2310991 - DNA, 17 bp, Homo sapiens
cgaatattgctgatggt

SEQ ID NO: 2310992 - DNA, 20 bp, Homo sapiens
cgaatggagtccagacctgg

SEQ ID NO: 2310993 - DNA, 23 bp, Homo sapiens
cgaatggcttcgaggagataaac

SEQ ID NO: 2310994 - DNA, 16 bp, Homo sapiens
cgacctacatctgaaa

SEQ ID NO: 2310995 - DNA, 15 bp, Homo sapiens
cgagagggctgagcc

SEQ ID NO: 2310996 - DNA, 17 bp, Homo sapiens
cgagagggctgagcccc

SEQ ID NO: 2310997 - DNA, 18 bp, Homo sapiens
cgagagggctgagcccct

SEQ ID NO: 2310998 - DNA, 21 bp, Homo sapiens
cgagagggctgagcccctcct

SEQ ID NO: 2310999 - DNA, 22 bp, Homo sapiens
cgagagggctgagcccctcctc

SEQ ID NO: 2311000 - DNA, 23 bp, Homo sapiens
cgagcataaaataggtgcattgt

SEQ ID NO: 2311001 - DNA, 22 bp, Homo sapiens
cgagctctcctgggccagggtc

SEQ ID NO: 2311002 - DNA, 18 bp, Homo sapiens
cgaggagataaactgaaa

SEQ ID NO: 2311003 - DNA, 16 bp, Homo sapiens
cgaggcctggctctgg

SEQ ID NO: 2311004 - DNA, 14 bp, Homo sapiens
cgaggttcctgtca

SEQ ID NO: 2311005 - DNA, 15 bp, Homo sapiens
cgaggttttgaggcg

SEQ ID NO: 2311006 - DNA, 13 bp, Homo sapiens
cgagtctggagac

SEQ ID NO: 2311007 - DNA, 16 bp, Homo sapiens
cgagtgagctaccagg

SEQ ID NO: 2311008 - DNA, 17 bp, Homo sapiens
cgagtgagctaccagga

SEQ ID NO: 2311009 - DNA, 14 bp, Homo sapiens
ctgccaccctctgc

SEQ ID NO: 2311010 - DNA, 16 bp, Homo sapiens
ctgccaccctctgctg

SEQ ID NO: 2311011 - DNA, 21 bp, Homo sapiens
ctgccaccctctgctgcacag

SEQ ID NO: 2311012 - DNA, 21 bp, Homo sapiens
ctgccatcagaaattttctac

SEQ ID NO: 2311013 - DNA, 15 bp, Homo sapiens
ctgccatcagcccct

SEQ ID NO: 2311014 - DNA, 16 bp, Homo sapiens
ctgccatcagcccctg

SEQ ID NO: 2311015 - DNA, 21 bp, Homo sapiens
ctgccatcagcccctgctgct

SEQ ID NO: 2311016 - DNA, 21 bp, Homo sapiens
ctgccattagactgaatttaa

SEQ ID NO: 2311017 - DNA, 13 bp, Homo sapiens
ctgcccaccctgg

SEQ ID NO: 2311018 - DNA, 14 bp, Homo sapiens
ctgcccaccctggg

SEQ ID NO: 2311019 - DNA, 15 bp, Homo sapiens
ctgcccaccctgggc

SEQ ID NO: 2311020 - DNA, 21 bp, Homo sapiens
ctgcccaccctgggcctcccg

SEQ ID NO: 2311021 - DNA, 17 bp, Homo sapiens
ctgccccacccctccat

SEQ ID NO: 2311022 - DNA, 18 bp, Homo sapiens
ctgccccacccctccatg

SEQ ID NO: 2311023 - DNA, 12 bp, Homo sapiens
ctgcccccacag

SEQ ID NO: 2311024 - DNA, 14 bp, Homo sapiens
ctgcccccacagat

SEQ ID NO: 2311025 - DNA, 15 bp, Homo sapiens
ctgcccccaccctgc

SEQ ID NO: 2311026 - DNA, 18 bp, Homo sapiens
ctgcccccagcgtggggg

SEQ ID NO: 2311027 - DNA, 19 bp, Homo sapiens
ctgcccccgctctgccatc

SEQ ID NO: 2311028 - DNA, 15 bp, Homo sapiens
ctgccccctcccccg

SEQ ID NO: 2311029 - DNA, 16 bp, Homo sapiens
ctgccccctcccccgc

SEQ ID NO: 2311030 - DNA, 17 bp, Homo sapiens
ctgccccctcccccgca

SEQ ID NO: 2311031 - DNA, 21 bp, Homo sapiens
ctgccccctcccccgcagaca

SEQ ID NO: 2311032 - DNA, 23 bp, Homo sapiens
ctgccccctcccccgcagacaga

SEQ ID NO: 2311033 - DNA, 21 bp, Homo sapiens
ctgccccgccggccgcgcacc

SEQ ID NO: 2311034 - DNA, 14 bp, Homo sapiens
ctgccccggcccaa

SEQ ID NO: 2311035 - DNA, 20 bp, Homo sapiens
ctgccccggcccaacctcgc

SEQ ID NO: 2311036 - DNA, 23 bp, Homo sapiens
ctgccccggcccaacctcgccct

SEQ ID NO: 2311037 - DNA, 22 bp, Homo sapiens
ctgcccctgctactgccaacct

SEQ ID NO: 2311038 - DNA, 19 bp, Homo sapiens
ctgccccttgaccccacac

SEQ ID NO: 2311039 - DNA, 13 bp, Homo sapiens
ctgcccgcccgcc

SEQ ID NO: 2311040 - DNA, 13 bp, Homo sapiens
ctgccctccccca

SEQ ID NO: 2311041 - DNA, 14 bp, Homo sapiens
ctgccctcccccac

SEQ ID NO: 2311042 - DNA, 21 bp, Homo sapiens
ctgccctcccccacggccgtc

SEQ ID NO: 2311043 - DNA, 13 bp, Homo sapiens
ctgccctgcacct

SEQ ID NO: 2311044 - DNA, 20 bp, Homo sapiens
ctgccctgcaccttgggcac

SEQ ID NO: 2311045 - DNA, 13 bp, Homo sapiens
ctgccctgccctg

SEQ ID NO: 2311046 - DNA, 14 bp, Homo sapiens
ctgccgacggagcc

SEQ ID NO: 2311047 - DNA, 16 bp, Homo sapiens
ctgccgacggagccac

SEQ ID NO: 2311048 - DNA, 20 bp, Homo sapiens
ctgccgctgcccccaccctg

SEQ ID NO: 2311049 - DNA, 19 bp, Homo sapiens
ctgccgctgcttgagtgga

SEQ ID NO: 2311050 - DNA, 20 bp, Homo sapiens
ctgccgctgcttgagtggac

SEQ ID NO: 2311051 - DNA, 19 bp, Homo sapiens
ctgccgtgcacggggccag

SEQ ID NO: 2311052 - DNA, 15 bp, Homo sapiens
ctgcctaaatttcac

SEQ ID NO: 2311053 - DNA, 22 bp, Homo sapiens
ctgcctccaagtcatgggagaa

SEQ ID NO: 2311054 - DNA, 14 bp, Homo sapiens
ctgcctctgaaaat

SEQ ID NO: 2311055 - DNA, 14 bp, Homo sapiens
ctgcctctgaactg

SEQ ID NO: 2311056 - DNA, 12 bp, Homo sapiens
ctgcctgcagct

SEQ ID NO: 2311057 - DNA, 18 bp, Homo sapiens
ctgcctggcggcaggggt

SEQ ID NO: 2311058 - DNA, 15 bp, Homo sapiens
ctgcctggcgggcag

SEQ ID NO: 2311059 - DNA, 17 bp, Homo sapiens
ctgcctggcgggcagcc

SEQ ID NO: 2311060 - DNA, 19 bp, Homo sapiens
ctgcctggcgggcagcccc

SEQ ID NO: 2311061 - DNA, 23 bp, Homo sapiens
ctgcctggcgggcagcccctgct

SEQ ID NO: 2311062 - DNA, 14 bp, Homo sapiens
ctgcctgtgagtga

SEQ ID NO: 2311063 - DNA, 19 bp, Homo sapiens
ctgcctgtttggggagggg

SEQ ID NO: 2311064 - DNA, 21 bp, Homo sapiens
ctgcctgtttggggagggggg

SEQ ID NO: 2311065 - DNA, 14 bp, Homo sapiens
ctgccttccaggcg

SEQ ID NO: 2311066 - DNA, 22 bp, Homo sapiens
ctgccttccaggcgtagggcca

SEQ ID NO: 2311067 - DNA, 13 bp, Homo sapiens
ctgcgcaggccct

SEQ ID NO: 2311068 - DNA, 17 bp, Homo sapiens
ctgcgcaggccctccgc

SEQ ID NO: 2311069 - DNA, 14 bp, Homo sapiens
ctgcgccccccagt

SEQ ID NO: 2311070 - DNA, 15 bp, Homo sapiens
ctgcgctcctctgca

SEQ ID NO: 2311071 - DNA, 22 bp, Homo sapiens
ctgcgctcctctgcagcctgag

SEQ ID NO: 2311072 - DNA, 14 bp, Homo sapiens
ctgcgtggcctggg

SEQ ID NO: 2311073 - DNA, 21 bp, Homo sapiens
ctgcgtggcctggggctgccg

SEQ ID NO: 2311074 - DNA, 17 bp, Homo sapiens
ctgcgtgttctcagagg

SEQ ID NO: 2311075 - DNA, 22 bp, Homo sapiens
ctgctaagtggaagacagagat

SEQ ID NO: 2311076 - DNA, 23 bp, Homo sapiens
ctgctaagtggaagacagagatg

SEQ ID NO: 2311077 - DNA, 15 bp, Homo sapiens
ctgctcactgctcac

SEQ ID NO: 2311078 - DNA, 19 bp, Homo sapiens
ctgctcaggctccccaaga

SEQ ID NO: 2311079 - DNA, 23 bp, Homo sapiens
ctgctcaggctccccaagacttg

SEQ ID NO: 2311080 - DNA, 15 bp, Homo sapiens
ctgctcatcacccgg

SEQ ID NO: 2311081 - DNA, 11 bp, Homo sapiens
ctgctccagat

SEQ ID NO: 2311082 - DNA, 19 bp, Homo sapiens
ctgctcctcggccagagct

SEQ ID NO: 2311083 - DNA, 22 bp, Homo sapiens
ctgctcctcggccagagctccc

SEQ ID NO: 2311084 - DNA, 12 bp, Homo sapiens
ctgctcgggaag

SEQ ID NO: 2311085 - DNA, 19 bp, Homo sapiens
ctgctgagctctgacctgc

SEQ ID NO: 2311086 - DNA, 21 bp, Homo sapiens
ctgctgagctctgacctgccc

SEQ ID NO: 2311087 - DNA, 15 bp, Homo sapiens
ctgctgcccccagac

SEQ ID NO: 2311088 - DNA, 18 bp, Homo sapiens
ctgctgcccccagacccc

SEQ ID NO: 2311089 - DNA, 17 bp, Homo sapiens
ctgctgcctccaagtca

SEQ ID NO: 2311090 - DNA, 16 bp, Homo sapiens
ctgctgctcctcggcc

SEQ ID NO: 2311091 - DNA, 17 bp, Homo sapiens
ctgctgctcgggaaggc

SEQ ID NO: 2311092 - DNA, 23 bp, Homo sapiens
ctgctgctcgggaaggcctgagg

SEQ ID NO: 2311093 - DNA, 18 bp, Homo sapiens
ctgctgttgattccactg

SEQ ID NO: 2311094 - DNA, 12 bp, Homo sapiens
ctgctgttttat

SEQ ID NO: 2311095 - DNA, 22 bp, Homo sapiens
ctgcttaaaagaaaatgttcac

SEQ ID NO: 2311096 - DNA, 13 bp, Homo sapiens
ctgcttcaaggat

SEQ ID NO: 2311097 - DNA, 21 bp, Homo sapiens
ctgcttcaaggatcctgagcc

SEQ ID NO: 2311098 - DNA, 17 bp, Homo sapiens
ctgcttctgctgcctgt

SEQ ID NO: 2311099 - DNA, 21 bp, Homo sapiens
ctgcttgagtggacagcagct

SEQ ID NO: 2311100 - DNA, 20 bp, Homo sapiens
ctgcttgtcattctgctaat

SEQ ID NO: 2311101 - DNA, 13 bp, Homo sapiens
ctgctttattgcc

SEQ ID NO: 2311102 - DNA, 22 bp, Homo sapiens
ctgctttattgcctctgtctta

SEQ ID NO: 2311103 - DNA, 23 bp, Homo sapiens
ctgctttggggcttatcagaact

SEQ ID NO: 2311104 - DNA, 19 bp, Homo sapiens
ctggaaccatcctctgtta

SEQ ID NO: 2311105 - DNA, 22 bp, Homo sapiens
ctggaagtgtgtgtttcttgct

SEQ ID NO: 2311106 - DNA, 20 bp, Homo sapiens
ctggaatactgaaaaagaat

SEQ ID NO: 2311107 - DNA, 22 bp, Homo sapiens
ctggacagatgggtgtcccctg

SEQ ID NO: 2311108 - DNA, 23 bp, Homo sapiens
ctggacagatgggtgtcccctgg

SEQ ID NO: 2311109 - DNA, 15 bp, Homo sapiens
ctggaccaactgctt

SEQ ID NO: 2311110 - DNA, 20 bp, Homo sapiens
ctggaccaaggtgcggaccg

SEQ ID NO: 2311111 - DNA, 12 bp, Homo sapiens
ctggacctgggg

SEQ ID NO: 2311112 - DNA, 13 bp, Homo sapiens
ctggacctggggt

SEQ ID NO: 2311113 - DNA, 23 bp, Homo sapiens
ctggacctggggtcccccctccc

SEQ ID NO: 2311114 - DNA, 20 bp, Homo sapiens
ctggactctgtggggccaca

SEQ ID NO: 2311115 - DNA, 14 bp, Homo sapiens
ctggactcttcaaa

SEQ ID NO: 2311116 - DNA, 22 bp, Homo sapiens
ctggactcttcaaaaactgttt

SEQ ID NO: 2311117 - DNA, 13 bp, Homo sapiens
ctggactgggtgg

SEQ ID NO: 2311118 - DNA, 14 bp, Homo sapiens
ctggactgggtggg

SEQ ID NO: 2311119 - DNA, 15 bp, Homo sapiens
ctggagcaaagcaga

SEQ ID NO: 2311120 - DNA, 12 bp, Homo sapiens
ctggagcccgcc

SEQ ID NO: 2311121 - DNA, 21 bp, Homo sapiens
ctggagcccgcctgcgccccc

SEQ ID NO: 2311122 - DNA, 22 bp, Homo sapiens
ctggagcccgcctgcgcccccc

SEQ ID NO: 2311123 - DNA, 23 bp, Homo sapiens
ctggagcccgcctgcgcccccca

SEQ ID NO: 2311124 - DNA, 19 bp, Homo sapiens
ctggagcccggcagtgcac

SEQ ID NO: 2311125 - DNA, 22 bp, Homo sapiens
ctggaggagggtttgggcagag

SEQ ID NO: 2311126 - DNA, 16 bp, Homo sapiens
ctggagggctgggcag

SEQ ID NO: 2311127 - DNA, 20 bp, Homo sapiens
ctggagggctgggcagggcc

SEQ ID NO: 2311128 - DNA, 22 bp, Homo sapiens
ctggagggctgggcagggccct

SEQ ID NO: 2311129 - DNA, 17 bp, Homo sapiens
ctggaggggcccatgtg

SEQ ID NO: 2311130 - DNA, 20 bp, Homo sapiens
ctggaggggcccatgtgggc

SEQ ID NO: 2311131 - DNA, 21 bp, Homo sapiens
ctggaggggcccatgtgggct

SEQ ID NO: 2311132 - DNA, 18 bp, Homo sapiens
ctggaggtggggagggcc

SEQ ID NO: 2311133 - DNA, 20 bp, Homo sapiens
ctggaggtggggagggcctc

SEQ ID NO: 2311134 - DNA, 21 bp, Homo sapiens
ctggaggtggggagggcctct

SEQ ID NO: 2311135 - DNA, 23 bp, Homo sapiens
ctggaggtggggagggcctctgg

SEQ ID NO: 2311136 - DNA, 14 bp, Homo sapiens
ctggagtccctcct

SEQ ID NO: 2311137 - DNA, 23 bp, Homo sapiens
ctggagtgaagtggtgtgatccc

SEQ ID NO: 2311138 - DNA, 15 bp, Homo sapiens
ctggatgtgctttca

SEQ ID NO: 2311139 - DNA, 16 bp, Homo sapiens
ctggatgtgctttcat

SEQ ID NO: 2311140 - DNA, 23 bp, Homo sapiens
gaaatattaatatgtacttttcc

SEQ ID NO: 2311141 - DNA, 18 bp, Homo sapiens
gaaatatttgcttattta

SEQ ID NO: 2311142 - DNA, 21 bp, Homo sapiens
gaaatatttgcttatttatat

SEQ ID NO: 2311143 - DNA, 11 bp, Homo sapiens
gaaatgagaaa

SEQ ID NO: 2311144 - DNA, 18 bp, Homo sapiens
gaaatgtagttgatgtat

SEQ ID NO: 2311145 - DNA, 16 bp, Homo sapiens
gaaatgtggatgctct

SEQ ID NO: 2311146 - DNA, 17 bp, Homo sapiens
gaaattacaggttcctt

SEQ ID NO: 2311147 - DNA, 14 bp, Homo sapiens
gaaattcatgagag

SEQ ID NO: 2311148 - DNA, 16 bp, Homo sapiens
gaaattctataagaga

SEQ ID NO: 2311149 - DNA, 17 bp, Homo sapiens
gaaattgtgccaaagat

SEQ ID NO: 2311150 - DNA, 21 bp, Homo sapiens
gaaattgtgccaaagatagca

SEQ ID NO: 2311151 - DNA, 14 bp, Homo sapiens
gaaattttctacag

SEQ ID NO: 2311152 - DNA, 17 bp, Homo sapiens
gaaatttttaaatcatt

SEQ ID NO: 2311153 - DNA, 20 bp, Homo sapiens
gaaatttttaaatcatttca

SEQ ID NO: 2311154 - DNA, 19 bp, Homo sapiens
gaacaaaaagtaatgtata

SEQ ID NO: 2311155 - DNA, 16 bp, Homo sapiens
gaacaaaaccccagaa

SEQ ID NO: 2311156 - DNA, 15 bp, Homo sapiens
gaacaaggcaaggct

SEQ ID NO: 2311157 - DNA, 20 bp, Homo sapiens
gaacaccactttgtctctga

SEQ ID NO: 2311158 - DNA, 13 bp, Homo sapiens
gaacacccagccc

SEQ ID NO: 2311159 - DNA, 13 bp, Homo sapiens
gaacactctgaga

SEQ ID NO: 2311160 - DNA, 15 bp, Homo sapiens
gaacactctgagact

SEQ ID NO: 2311161 - DNA, 14 bp, Homo sapiens
gaacagagtatata

SEQ ID NO: 2311162 - DNA, 16 bp, Homo sapiens
gaacagggtttctcag

SEQ ID NO: 2311163 - DNA, 16 bp, Homo sapiens
gaacaggtgttcctcc

SEQ ID NO: 2311164 - DNA, 23 bp, Homo sapiens
gaacatttctaactaaggacagg

SEQ ID NO: 2311165 - DNA, 17 bp, Homo sapiens
gaaccagcactcccagg

SEQ ID NO: 2311166 - DNA, 19 bp, Homo sapiens
gaaccagcactcccagggc

SEQ ID NO: 2311167 - DNA, 20 bp, Homo sapiens
gaaccagcactcccagggcc

SEQ ID NO: 2311168 - DNA, 22 bp, Homo sapiens
gaaccagcactcccagggcccg

SEQ ID NO: 2311169 - DNA, 15 bp, Homo sapiens
gaaccctctggggcc

SEQ ID NO: 2311170 - DNA, 19 bp, Homo sapiens
gaaccctctggggcccttt

SEQ ID NO: 2311171 - DNA, 18 bp, Homo sapiens
gaaccgaggactccaggg

SEQ ID NO: 2311172 - DNA, 20 bp, Homo sapiens
gaacctgcatttaagaacag

SEQ ID NO: 2311173 - DNA, 13 bp, Homo sapiens
gaacgccctgtgt

SEQ ID NO: 2311174 - DNA, 15 bp, Homo sapiens
gaacgggcctccccg

SEQ ID NO: 2311175 - DNA, 13 bp, Homo sapiens
gaactcaatgcat

SEQ ID NO: 2311176 - DNA, 20 bp, Homo sapiens
gaactcaatgcatgatgact

SEQ ID NO: 2311177 - DNA, 14 bp, Homo sapiens
gaactccagagtca

SEQ ID NO: 2311178 - DNA, 13 bp, Homo sapiens
gaactgctgctgg

SEQ ID NO: 2311179 - DNA, 20 bp, Homo sapiens
gaactgctgctggtcacccc

SEQ ID NO: 2311180 - DNA, 21 bp, Homo sapiens
gaactgctgctggtcaccccc

SEQ ID NO: 2311181 - DNA, 18 bp, Homo sapiens
gaactgtatattattgct

SEQ ID NO: 2311182 - DNA, 20 bp, Homo sapiens
gaactgtcccacaaaatatt

SEQ ID NO: 2311183 - DNA, 16 bp, Homo sapiens
gaacttaaaacatatg

SEQ ID NO: 2311184 - DNA, 13 bp, Homo sapiens
gaagaaaataacc

SEQ ID NO: 2311185 - DNA, 14 bp, Homo sapiens
gaagaataaaaaag

SEQ ID NO: 2311186 - DNA, 17 bp, Homo sapiens
gaagaataaaaaagaag

SEQ ID NO: 2311187 - DNA, 14 bp, Homo sapiens
gaagaatattgtta

SEQ ID NO: 2311188 - DNA, 23 bp, Homo sapiens
gaagaatgtctcctgccactcct

SEQ ID NO: 2311189 - DNA, 17 bp, Homo sapiens
gaagacagagatggcag

SEQ ID NO: 2311190 - DNA, 22 bp, Homo sapiens
gaagacagagatggcagagcca

SEQ ID NO: 2311191 - DNA, 21 bp, Homo sapiens
gaagactgacaaagtcatcct

SEQ ID NO: 2311192 - DNA, 22 bp, Homo sapiens
gaagaggggcgctgcccccaca

SEQ ID NO: 2311193 - DNA, 15 bp, Homo sapiens
gaagataaatgcttt

SEQ ID NO: 2311194 - DNA, 17 bp, Homo sapiens
gaagatgtgtaaataag

SEQ ID NO: 2311195 - DNA, 22 bp, Homo sapiens
gaagcctcatgggagtcaggga

SEQ ID NO: 2311196 - DNA, 19 bp, Homo sapiens
gaagcctgcctggaagagc

SEQ ID NO: 2311197 - DNA, 15 bp, Homo sapiens
gaagctcaactgttg

SEQ ID NO: 2311198 - DNA, 13 bp, Homo sapiens
gaagctccatgga

SEQ ID NO: 2311199 - DNA, 13 bp, Homo sapiens
gaagctgctcact

SEQ ID NO: 2311200 - DNA, 22 bp, Homo sapiens
gaagctggcaggagacactggt

SEQ ID NO: 2311201 - DNA, 22 bp, Homo sapiens
gaaggagaggatttggctcgct

SEQ ID NO: 2311202 - DNA, 22 bp, Homo sapiens
gaaggattcttttttcaatgta

SEQ ID NO: 2311203 - DNA, 13 bp, Homo sapiens
gaaggcctgaggg

SEQ ID NO: 2311204 - DNA, 23 bp, Homo sapiens
gaaggcctgagggaagcccaccc

SEQ ID NO: 2311205 - DNA, 24 bp, Homo sapiens
gaagggaccgggagcctgcgtggc

SEQ ID NO: 2311206 - DNA, 14 bp, Homo sapiens
gaagggcaggagct

SEQ ID NO: 2311207 - DNA, 16 bp, Homo sapiens
gaaggtatttttgaag

SEQ ID NO: 2311208 - DNA, 22 bp, Homo sapiens
gaagtaactccccttaaaatgt

SEQ ID NO: 2311209 - DNA, 17 bp, Homo sapiens
gaagtaagttctgaaaa

SEQ ID NO: 2311210 - DNA, 17 bp, Homo sapiens
gaagtatacatttagtt

SEQ ID NO: 2311211 - DNA, 20 bp, Homo sapiens
gaagtctgcttaccaaaaca

SEQ ID NO: 2311212 - DNA, 21 bp, Homo sapiens
gaagtctgcttaccaaaacat

SEQ ID NO: 2311213 - DNA, 19 bp, Homo sapiens
gaagtctttgtacagacaa

SEQ ID NO: 2311214 - DNA, 20 bp, Homo sapiens
gaagtggtgtgatcccagct

SEQ ID NO: 2311215 - DNA, 19 bp, Homo sapiens
gaagtgtgtgtttcttgct

SEQ ID NO: 2311216 - DNA, 13 bp, Homo sapiens
gaataaaattgtt

SEQ ID NO: 2311217 - DNA, 21 bp, Homo sapiens
gaataaaattgttatttcaat

SEQ ID NO: 2311218 - DNA, 17 bp, Homo sapiens
gaataaataaagaagaa

SEQ ID NO: 2311219 - DNA, 22 bp, Homo sapiens
gaataaataaagaagaaaataa

SEQ ID NO: 2311220 - DNA, 17 bp, Homo sapiens
gaataatggaattatgt

SEQ ID NO: 2311221 - DNA, 19 bp, Homo sapiens
gaatacttcctgaaataaa

SEQ ID NO: 2311222 - DNA, 18 bp, Homo sapiens
gaatatccagtcaaagac

SEQ ID NO: 2311223 - DNA, 19 bp, Homo sapiens
gaatattgctgatggtgca

SEQ ID NO: 2311224 - DNA, 15 bp, Homo sapiens
gaatattttcaaaat

SEQ ID NO: 2311225 - DNA, 13 bp, Homo sapiens
gaatcaaagacat

SEQ ID NO: 2311226 - DNA, 13 bp, Homo sapiens
gaatcagcacaga

SEQ ID NO: 2311227 - DNA, 20 bp, Homo sapiens
gaatcagtaatcacttttca

SEQ ID NO: 2311228 - DNA, 15 bp, Homo sapiens
gaatccatatcagct

SEQ ID NO: 2311229 - DNA, 17 bp, Homo sapiens
gaatccatatcagctct

SEQ ID NO: 2311230 - DNA, 22 bp, Homo sapiens
gaatcccacttatcaaatcatt

SEQ ID NO: 2311231 - DNA, 20 bp, Homo sapiens
gaatctaacttgatcttgtt

SEQ ID NO: 2311232 - DNA, 18 bp, Homo sapiens
gaatctattttctatgta

SEQ ID NO: 2311233 - DNA, 11 bp, Homo sapiens
gaatcttgatt

SEQ ID NO: 2311234 - DNA, 22 bp, Homo sapiens
gaatgaatgtcagtgtgactga

SEQ ID NO: 2311235 - DNA, 16 bp, Homo sapiens
gaatgactctggaacc

SEQ ID NO: 2311236 - DNA, 14 bp, Homo sapiens
gaatgagagagaaa

SEQ ID NO: 2311237 - DNA, 15 bp, Homo sapiens
gaatgagggaaacaa

SEQ ID NO: 2311238 - DNA, 14 bp, Homo sapiens
gaatgattaattaa

SEQ ID NO: 2311239 - DNA, 14 bp, Homo sapiens
gaatgcacgtttca

SEQ ID NO: 2311240 - DNA, 18 bp, Homo sapiens
gaatggagtccagacctg

SEQ ID NO: 2311241 - DNA, 22 bp, Homo sapiens
gaatgggggccaggctgagccg

SEQ ID NO: 2311242 - DNA, 16 bp, Homo sapiens
gaatgggggtatcctg

SEQ ID NO: 2311243 - DNA, 14 bp, Homo sapiens
gaatgtcagtgtga

SEQ ID NO: 2311244 - DNA, 22 bp, Homo sapiens
gaatgttatatcatcaatactt

SEQ ID NO: 2311245 - DNA, 13 bp, Homo sapiens
gaatgttgttaaa

SEQ ID NO: 2311246 - DNA, 14 bp, Homo sapiens
gaatgttttggaat

SEQ ID NO: 2311247 - DNA, 19 bp, Homo sapiens
gaattctaagattgtacat

SEQ ID NO: 2311248 - DNA, 18 bp, Homo sapiens
gaattgaaccgtcaatgt

SEQ ID NO: 2311249 - DNA, 19 bp, Homo sapiens
gaattgttgaatgtattct

SEQ ID NO: 2311250 - DNA, 20 bp, Homo sapiens
gaattgttgaatgtattctt

SEQ ID NO: 2311251 - DNA, 15 bp, Homo sapiens
gaatttatttatgtt

SEQ ID NO: 2311252 - DNA, 15 bp, Homo sapiens
gaatttcccaaagca

SEQ ID NO: 2311253 - DNA, 11 bp, Homo sapiens
gaatttcttgt

SEQ ID NO: 2311254 - DNA, 13 bp, Homo sapiens
gaattttaaaatg

SEQ ID NO: 2311255 - DNA, 22 bp, Homo sapiens
gacaaatagtaggctaaaaaca

SEQ ID NO: 2311256 - DNA, 23 bp, Homo sapiens
gacaaatagtaggctaaaaacat

SEQ ID NO: 2311257 - DNA, 16 bp, Homo sapiens
gacaaggggtggaagg

SEQ ID NO: 2311258 - DNA, 22 bp, Homo sapiens
gacaatgcaaaccatcattgaa

SEQ ID NO: 2311259 - DNA, 12 bp, Homo sapiens
gacaatttgcca

SEQ ID NO: 2311260 - DNA, 11 bp, Homo sapiens
gacaccccact

SEQ ID NO: 2311261 - DNA, 19 bp, Homo sapiens
gacacctgccgctgcttga

SEQ ID NO: 2311262 - DNA, 18 bp, Homo sapiens
gacacgaatattgctgat

SEQ ID NO: 2311263 - DNA, 21 bp, Homo sapiens
gacacgcacttctggggccag

SEQ ID NO: 2311264 - DNA, 17 bp, Homo sapiens
gacacggaccctgtgtg

SEQ ID NO: 2311265 - DNA, 22 bp, Homo sapiens
gacacggcctctggggagaccg

SEQ ID NO: 2311266 - DNA, 14 bp, Homo sapiens
gacactcaagagcc

SEQ ID NO: 2311267 - DNA, 18 bp, Homo sapiens
gacactgatgggtcctgc

SEQ ID NO: 2311268 - DNA, 18 bp, Homo sapiens
gacactggtctcagagga

SEQ ID NO: 2311269 - DNA, 14 bp, Homo sapiens
gacagaaaaaaata

SEQ ID NO: 2311270 - DNA, 14 bp, Homo sapiens
gacagacagacaga

SEQ ID NO: 2311271 - DNA, 23 bp, Homo sapiens
gacagacggacgggacagcggcc

SEQ ID NO: 2311272 - DNA, 15 bp, Homo sapiens
gatttgtatttatat

SEQ ID NO: 2311273 - DNA, 23 bp, Homo sapiens
gattttaaaacttttctgcattt

SEQ ID NO: 2311274 - DNA, 23 bp, Homo sapiens
gatttttttttccttcagtgcct

SEQ ID NO: 2311275 - DNA, 23 bp, Homo sapiens
gcaaaaaaaaaaattacattatg

SEQ ID NO: 2311276 - DNA, 14 bp, Homo sapiens
gcaaaaaataccct

SEQ ID NO: 2311277 - DNA, 16 bp, Homo sapiens
gcaaaaatattttgca

SEQ ID NO: 2311278 - DNA, 16 bp, Homo sapiens
gcaaaataaaatgagt

SEQ ID NO: 2311279 - DNA, 17 bp, Homo sapiens
gcaaaataaaatgagtt

SEQ ID NO: 2311280 - DNA, 19 bp, Homo sapiens
gcaaaataaaatgagttac

SEQ ID NO: 2311281 - DNA, 15 bp, Homo sapiens
gcaaacaaaatgatg

SEQ ID NO: 2311282 - DNA, 16 bp, Homo sapiens
gcaaaccatcattgaa

SEQ ID NO: 2311283 - DNA, 19 bp, Homo sapiens
gcaaagcatttgagctgtg

SEQ ID NO: 2311284 - DNA, 14 bp, Homo sapiens
gcaaagctggttgt

SEQ ID NO: 2311285 - DNA, 15 bp, Homo sapiens
gcaaagggcgggcct

SEQ ID NO: 2311286 - DNA, 18 bp, Homo sapiens
gcaaatgaatgcctttca

SEQ ID NO: 2311287 - DNA, 19 bp, Homo sapiens
gcaaatgaatgcctttcaa

SEQ ID NO: 2311288 - DNA, 22 bp, Homo sapiens
gcaaatgaatgcctttcaaaca

SEQ ID NO: 2311289 - DNA, 12 bp, Homo sapiens
gcaaatgttgta

SEQ ID NO: 2311290 - DNA, 17 bp, Homo sapiens
gcaaatgttgtatttca

SEQ ID NO: 2311291 - DNA, 13 bp, Homo sapiens
gcaaattattcta

SEQ ID NO: 2311292 - DNA, 16 bp, Homo sapiens
gcaaattattctagtc

SEQ ID NO: 2311293 - DNA, 22 bp, Homo sapiens
gcaaattattctagtcaactgc

SEQ ID NO: 2311294 - DNA, 16 bp, Homo sapiens
gcaacactcactgcct

SEQ ID NO: 2311295 - DNA, 22 bp, Homo sapiens
gcaacactcactgcctgcagct

SEQ ID NO: 2311296 - DNA, 23 bp, Homo sapiens
gcaacactcactgcctgcagctg

SEQ ID NO: 2311297 - DNA, 16 bp, Homo sapiens
gcaacatttccgaaga

SEQ ID NO: 2311298 - DNA, 15 bp, Homo sapiens
gcaaccaataaaagt

SEQ ID NO: 2311299 - DNA, 13 bp, Homo sapiens
gcaaccaccacca

SEQ ID NO: 2311300 - DNA, 15 bp, Homo sapiens
gcaaccagagcactg

SEQ ID NO: 2311301 - DNA, 18 bp, Homo sapiens
gcaaccagagcactgtat

SEQ ID NO: 2311302 - DNA, 12 bp, Homo sapiens
gcaacctgtgca

SEQ ID NO: 2311303 - DNA, 13 bp, Homo sapiens
gcaacctgtgcaa

SEQ ID NO: 2311304 - DNA, 16 bp, Homo sapiens
gcaactgttggataat

SEQ ID NO: 2311305 - DNA, 17 bp, Homo sapiens
gcaagaagattctaaaa

SEQ ID NO: 2311306 - DNA, 19 bp, Homo sapiens
gcaagaagattctaaaaca

SEQ ID NO: 2311307 - DNA, 15 bp, Homo sapiens
gcaagcgaaagagca

SEQ ID NO: 2311308 - DNA, 14 bp, Homo sapiens
gcaagctttaacag

SEQ ID NO: 2311309 - DNA, 16 bp, Homo sapiens
gcaaggcagctcccag

SEQ ID NO: 2311310 - DNA, 11 bp, Homo sapiens
gcaaggctgct

SEQ ID NO: 2311311 - DNA, 14 bp, Homo sapiens
gcaaggggccagga

SEQ ID NO: 2311312 - DNA, 19 bp, Homo sapiens
gcaaggggccaggaagggg

SEQ ID NO: 2311313 - DNA, 20 bp, Homo sapiens
gcaatactgccgctgccccc

SEQ ID NO: 2311314 - DNA, 22 bp, Homo sapiens
gcaatactgccgctgcccccac

SEQ ID NO: 2311315 - DNA, 14 bp, Homo sapiens
gcaatatatttgta

SEQ ID NO: 2311316 - DNA, 15 bp, Homo sapiens
gcaatgacctttcaa

SEQ ID NO: 2311317 - DNA, 23 bp, Homo sapiens
gcaatgacctttcaataggaaaa

SEQ ID NO: 2311318 - DNA, 16 bp, Homo sapiens
gcacaaagggcaggcc

SEQ ID NO: 2311319 - DNA, 17 bp, Homo sapiens
gcacaagaagtttcttc

SEQ ID NO: 2311320 - DNA, 18 bp, Homo sapiens
gcacacattggccgcttc

SEQ ID NO: 2311321 - DNA, 19 bp, Homo sapiens
gcacacgtccatgtttatc

SEQ ID NO: 2311322 - DNA, 12 bp, Homo sapiens
gcacacttcccc

SEQ ID NO: 2311323 - DNA, 11 bp, Homo sapiens
gcacagaacag

SEQ ID NO: 2311324 - DNA, 23 bp, Homo sapiens
gcacagaacaggaggtgtgaatg

SEQ ID NO: 2311325 - DNA, 21 bp, Homo sapiens
gcacagcctcacccctgcagg

SEQ ID NO: 2311326 - DNA, 18 bp, Homo sapiens
gcacaggcaacattacaa

SEQ ID NO: 2311327 - DNA, 18 bp, Homo sapiens
gcacaggccccgaggagc

SEQ ID NO: 2311328 - DNA, 14 bp, Homo sapiens
gcacaggtgtaaat

SEQ ID NO: 2311329 - DNA, 20 bp, Homo sapiens
gcacagtagtgttgggtgga

SEQ ID NO: 2311330 - DNA, 23 bp, Homo sapiens
gcacatttagtccaatgaagata

SEQ ID NO: 2311331 - DNA, 21 bp, Homo sapiens
gcacatttgtcactgaataat

SEQ ID NO: 2311332 - DNA, 13 bp, Homo sapiens
gcaccactcaaga

SEQ ID NO: 2311333 - DNA, 16 bp, Homo sapiens
gcaccagcctgagcca

SEQ ID NO: 2311334 - DNA, 11 bp, Homo sapiens
gcacccccagc

SEQ ID NO: 2311335 - DNA, 12 bp, Homo sapiens
gcacccccagcc

SEQ ID NO: 2311336 - DNA, 19 bp, Homo sapiens
gcacccccagcctccccca

SEQ ID NO: 2311337 - DNA, 21 bp, Homo sapiens
gcacccccagcctcccccagg

SEQ ID NO: 2311338 - DNA, 13 bp, Homo sapiens
gcacccctcctcc

SEQ ID NO: 2311339 - DNA, 22 bp, Homo sapiens
gcacccggcagccccccagtgt

SEQ ID NO: 2311340 - DNA, 20 bp, Homo sapiens
gcaccgccatgcatgatggg

SEQ ID NO: 2311341 - DNA, 20 bp, Homo sapiens
gcaccgcccaacccccacct

SEQ ID NO: 2311342 - DNA, 15 bp, Homo sapiens
gcaccgcccacccac

SEQ ID NO: 2311343 - DNA, 16 bp, Homo sapiens
gcaccgcccacccaca

SEQ ID NO: 2311344 - DNA, 13 bp, Homo sapiens
gcaccgggctggc

SEQ ID NO: 2311345 - DNA, 14 bp, Homo sapiens
gcaccgggctggcc

SEQ ID NO: 2311346 - DNA, 18 bp, Homo sapiens
gcaccgggctggcctgac

SEQ ID NO: 2311347 - DNA, 21 bp, Homo sapiens
gcaccgggctggcctgacaca

SEQ ID NO: 2311348 - DNA, 19 bp, Homo sapiens
gcaccgtggtgtgaggccc

SEQ ID NO: 2311349 - DNA, 21 bp, Homo sapiens
gcaccgtggtgtgaggccccc

SEQ ID NO: 2311350 - DNA, 20 bp, Homo sapiens
gcacctcctcggctggctgt

SEQ ID NO: 2311351 - DNA, 13 bp, Homo sapiens
gcaccttgggcac

SEQ ID NO: 2311352 - DNA, 21 bp, Homo sapiens
gcaccttgggcacgggagagc

SEQ ID NO: 2311353 - DNA, 23 bp, Homo sapiens
gcaccttgggcacgggagagcgc

SEQ ID NO: 2311354 - DNA, 15 bp, Homo sapiens
gcacgggagagcgcc

SEQ ID NO: 2311355 - DNA, 23 bp, Homo sapiens
gcacgtagtttgcattccagcgt

SEQ ID NO: 2311356 - DNA, 20 bp, Homo sapiens
gcactagaatgagaaatcat

SEQ ID NO: 2311357 - DNA, 21 bp, Homo sapiens
gcactcagtgtggactgggaa

SEQ ID NO: 2311358 - DNA, 13 bp, Homo sapiens
gcactccagcctg

SEQ ID NO: 2311359 - DNA, 14 bp, Homo sapiens
gcactcccagggcc

SEQ ID NO: 2311360 - DNA, 19 bp, Homo sapiens
gcactcccagggcccgagc

SEQ ID NO: 2311361 - DNA, 21 bp, Homo sapiens
gcactcccagggcccgagcgc

SEQ ID NO: 2311362 - DNA, 16 bp, Homo sapiens
gcactcctgccccggc

SEQ ID NO: 2311363 - DNA, 19 bp, Homo sapiens
gcactgagagagcgcagcc

SEQ ID NO: 2311364 - DNA, 21 bp, Homo sapiens
gcactgagagagcgcagccgc

SEQ ID NO: 2311365 - DNA, 21 bp, Homo sapiens
gcactgggaatttatttatgt

SEQ ID NO: 2311366 - DNA, 17 bp, Homo sapiens
gcacttctggggccagc

SEQ ID NO: 2311367 - DNA, 21 bp, Homo sapiens
gcacttctggggccagcccct

SEQ ID NO: 2311368 - DNA, 23 bp, Homo sapiens
gcacttctggggccagcccctcc

SEQ ID NO: 2311369 - DNA, 14 bp, Homo sapiens
gcacttgtgatcct

SEQ ID NO: 2311370 - DNA, 21 bp, Homo sapiens
gcagaaggtatttttgaagtc

SEQ ID NO: 2311371 - DNA, 15 bp, Homo sapiens
gcagaatgactctgg

SEQ ID NO: 2311372 - DNA, 23 bp, Homo sapiens
gcagacgaggcctttgctttaca

SEQ ID NO: 2311373 - DNA, 14 bp, Homo sapiens
gcagagacggcagc

SEQ ID NO: 2311374 - DNA, 22 bp, Homo sapiens
gcagagacggcagccccatcct

SEQ ID NO: 2311375 - DNA, 18 bp, Homo sapiens
gcagagccagtcttcctc

SEQ ID NO: 2311376 - DNA, 17 bp, Homo sapiens
gcagagccatccaccct

SEQ ID NO: 2311377 - DNA, 15 bp, Homo sapiens
gcagagccccggagc

SEQ ID NO: 2311378 - DNA, 18 bp, Homo sapiens
gcagagccccggagcacc

SEQ ID NO: 2311379 - DNA, 20 bp, Homo sapiens
gcagagccccggagcaccac

SEQ ID NO: 2311380 - DNA, 17 bp, Homo sapiens
gcagagctcagcacagc

SEQ ID NO: 2311381 - DNA, 12 bp, Homo sapiens
gcagaggcaggg

SEQ ID NO: 2311382 - DNA, 13 bp, Homo sapiens
gcagaggcagggc

SEQ ID NO: 2311383 - DNA, 15 bp, Homo sapiens
gcagaggcagggccc

SEQ ID NO: 2311384 - DNA, 18 bp, Homo sapiens
gcagaggcagggccctgg

SEQ ID NO: 2311385 - DNA, 18 bp, Homo sapiens
gcagatggagaccccttg

SEQ ID NO: 2311386 - DNA, 15 bp, Homo sapiens
gcagcaccagcctga

SEQ ID NO: 2311387 - DNA, 17 bp, Homo sapiens
gcagcaccagcctgagc

SEQ ID NO: 2311388 - DNA, 19 bp, Homo sapiens
gcagcaccagcctgagcca

SEQ ID NO: 2311389 - DNA, 17 bp, Homo sapiens
gcagcagtaccatccca

SEQ ID NO: 2311390 - DNA, 18 bp, Homo sapiens
gcagccccatccttcccg

SEQ ID NO: 2311391 - DNA, 21 bp, Homo sapiens
gcagccccatccttcccgcag

SEQ ID NO: 2311392 - DNA, 21 bp, Homo sapiens
gcagccccccacgcttctgga

SEQ ID NO: 2311393 - DNA, 23 bp, Homo sapiens
gcagccccccagtgtccccaggg

SEQ ID NO: 2311394 - DNA, 14 bp, Homo sapiens
gcagcccctgctgg

SEQ ID NO: 2311395 - DNA, 22 bp, Homo sapiens
gcagcccctgctggaccaaggt

SEQ ID NO: 2311396 - DNA, 15 bp, Homo sapiens
gcagcccgggagatc

SEQ ID NO: 2311397 - DNA, 19 bp, Homo sapiens
gcagccgccttcacagcag

SEQ ID NO: 2311398 - DNA, 17 bp, Homo sapiens
gcagccgcgctctgccc

SEQ ID NO: 2311399 - DNA, 18 bp, Homo sapiens
gcagccgcgctctgcccc

SEQ ID NO: 2311400 - DNA, 11 bp, Homo sapiens
gcagcctgagc

SEQ ID NO: 2311401 - DNA, 13 bp, Homo sapiens
gcagcgcctcccg

SEQ ID NO: 2311402 - DNA, 17 bp, Homo sapiens
gcagcggccccgcaccc

SEQ ID NO: 2311403 - DNA, 16 bp, Homo sapiens
gcagcgtgcaggagca

SEQ ID NO: 2311404 - DNA, 18 bp, Homo sapiens
gctaccaattgtttcttg

SEQ ID NO: 2311405 - DNA, 18 bp, Homo sapiens
gctagtgatacactgtat

SEQ ID NO: 2311406 - DNA, 23 bp, Homo sapiens
gctagtgatacactgtatctaaa

SEQ ID NO: 2311407 - DNA, 15 bp, Homo sapiens
gctatggaaatacat

SEQ ID NO: 2311408 - DNA, 16 bp, Homo sapiens
gctatggaaatacatt

SEQ ID NO: 2311409 - DNA, 18 bp, Homo sapiens
gctatggaaatacattta

SEQ ID NO: 2311410 - DNA, 14 bp, Homo sapiens
gctcaacctctcag

SEQ ID NO: 2311411 - DNA, 14 bp, Homo sapiens
gctcacaagtgaaa

SEQ ID NO: 2311412 - DNA, 15 bp, Homo sapiens
gctcacaagtgaaaa

SEQ ID NO: 2311413 - DNA, 21 bp, Homo sapiens
gctcacaccgcaccgggctgg

SEQ ID NO: 2311414 - DNA, 17 bp, Homo sapiens
gctcacacctgtaatcc

SEQ ID NO: 2311415 - DNA, 16 bp, Homo sapiens
gctcactgcagcctcg

SEQ ID NO: 2311416 - DNA, 13 bp, Homo sapiens
gctcagaatccac

SEQ ID NO: 2311417 - DNA, 18 bp, Homo sapiens
gctcaggctccccaagac

SEQ ID NO: 2311418 - DNA, 22 bp, Homo sapiens
gctcagtcccacagccccttgc

SEQ ID NO: 2311419 - DNA, 19 bp, Homo sapiens
gctcatcacccggatagag

SEQ ID NO: 2311420 - DNA, 14 bp, Homo sapiens
gctccaacctggag

SEQ ID NO: 2311421 - DNA, 13 bp, Homo sapiens
gctccaactccaa

SEQ ID NO: 2311422 - DNA, 13 bp, Homo sapiens
gctccaagagaat

SEQ ID NO: 2311423 - DNA, 17 bp, Homo sapiens
gctccaccctcccctct

SEQ ID NO: 2311424 - DNA, 20 bp, Homo sapiens
gctccagtgttttcttgtgt

SEQ ID NO: 2311425 - DNA, 20 bp, Homo sapiens
gctcccaggacgcagggaga

SEQ ID NO: 2311426 - DNA, 22 bp, Homo sapiens
gctcccaggacgcagggagacc

SEQ ID NO: 2311427 - DNA, 15 bp, Homo sapiens
gctccggcagaggca

SEQ ID NO: 2311428 - DNA, 21 bp, Homo sapiens
gctccggcagaggcagggccc

SEQ ID NO: 2311429 - DNA, 14 bp, Homo sapiens
gctccgggtgcgtg

SEQ ID NO: 2311430 - DNA, 15 bp, Homo sapiens
gctcctcggccagag

SEQ ID NO: 2311431 - DNA, 16 bp, Homo sapiens
gctcctcggccagagc

SEQ ID NO: 2311432 - DNA, 18 bp, Homo sapiens
gctcctcggccagagctc

SEQ ID NO: 2311433 - DNA, 24 bp, Homo sapiens
gctcctcggccagagctcccagga

SEQ ID NO: 2311434 - DNA, 16 bp, Homo sapiens
gctcctctgcagcctg

SEQ ID NO: 2311435 - DNA, 20 bp, Homo sapiens
gctcctctgcagcctgagct

SEQ ID NO: 2311436 - DNA, 23 bp, Homo sapiens
gctcctgccccgccggccgcgca

SEQ ID NO: 2311437 - DNA, 15 bp, Homo sapiens
gctcgcacccccact

SEQ ID NO: 2311438 - DNA, 15 bp, Homo sapiens
gctcgggaaggcctg

SEQ ID NO: 2311439 - DNA, 17 bp, Homo sapiens
gctcgggaaggcctgag

SEQ ID NO: 2311440 - DNA, 14 bp, Homo sapiens
gctcgggactgtct

SEQ ID NO: 2311441 - DNA, 15 bp, Homo sapiens
gctcgggtgcccagg

SEQ ID NO: 2311442 - DNA, 18 bp, Homo sapiens
gctcgggtgcccaggacg

SEQ ID NO: 2311443 - DNA, 15 bp, Homo sapiens
gctctaaagcagaga

SEQ ID NO: 2311444 - DNA, 13 bp, Homo sapiens
gctctatctgctg

SEQ ID NO: 2311445 - DNA, 16 bp, Homo sapiens
gctctatctgctgggc

SEQ ID NO: 2311446 - DNA, 17 bp, Homo sapiens
gctctatctgctgggct

SEQ ID NO: 2311447 - DNA, 20 bp, Homo sapiens
gctctatttcggaaatacac

SEQ ID NO: 2311448 - DNA, 21 bp, Homo sapiens
gctctcccctgcgcaggccct

SEQ ID NO: 2311449 - DNA, 14 bp, Homo sapiens
gctctcctgggcca

SEQ ID NO: 2311450 - DNA, 15 bp, Homo sapiens
gctctcctgggccag

SEQ ID NO: 2311451 - DNA, 20 bp, Homo sapiens
gctctcctgggccagggtct

SEQ ID NO: 2311452 - DNA, 22 bp, Homo sapiens
gctctcctgggccagggtctcg

SEQ ID NO: 2311453 - DNA, 13 bp, Homo sapiens
gctctgaagggag

SEQ ID NO: 2311454 - DNA, 12 bp, Homo sapiens
gctctgacctgc

SEQ ID NO: 2311455 - DNA, 22 bp, Homo sapiens
gctctgccatcagcccctgctg

SEQ ID NO: 2311456 - DNA, 16 bp, Homo sapiens
gctctgcccctccgtc

SEQ ID NO: 2311457 - DNA, 16 bp, Homo sapiens
gctctgcgtcccactg

SEQ ID NO: 2311458 - DNA, 22 bp, Homo sapiens
gctctggaattgttgaatgtat

SEQ ID NO: 2311459 - DNA, 23 bp, Homo sapiens
gctctggaattgttgaatgtatt

SEQ ID NO: 2311460 - DNA, 14 bp, Homo sapiens
gctctggagcccgc

SEQ ID NO: 2311461 - DNA, 15 bp, Homo sapiens
gctctggagcccgcc

SEQ ID NO: 2311462 - DNA, 22 bp, Homo sapiens
gctctggagcccgcctgcgccc

SEQ ID NO: 2311463 - DNA, 14 bp, Homo sapiens
gctcttatccccag

SEQ ID NO: 2311464 - DNA, 16 bp, Homo sapiens
gctcttatccccagct

SEQ ID NO: 2311465 - DNA, 20 bp, Homo sapiens
gctcttatccccagctgtta

SEQ ID NO: 2311466 - DNA, 16 bp, Homo sapiens
gctcttctgttctcaa

SEQ ID NO: 2311467 - DNA, 18 bp, Homo sapiens
gctgactctccagggagc

SEQ ID NO: 2311468 - DNA, 15 bp, Homo sapiens
gctgactgaatgcag

SEQ ID NO: 2311469 - DNA, 19 bp, Homo sapiens
gctgagcccctcctctcct

SEQ ID NO: 2311470 - DNA, 18 bp, Homo sapiens
gctgagctctgacctgcc

SEQ ID NO: 2311471 - DNA, 21 bp, Homo sapiens
gctgaggacggggcagagctg

SEQ ID NO: 2311472 - DNA, 15 bp, Homo sapiens
gctgagtcggctggg

SEQ ID NO: 2311473 - DNA, 17 bp, Homo sapiens
gctgagtcggctgggca

SEQ ID NO: 2311474 - DNA, 21 bp, Homo sapiens
gctgagtcggctgggcagggc

SEQ ID NO: 2311475 - DNA, 21 bp, Homo sapiens
gctgatggtgcaatgaccttt

SEQ ID NO: 2311476 - DNA, 16 bp, Homo sapiens
gctgccatcagaaatt

SEQ ID NO: 2311477 - DNA, 15 bp, Homo sapiens
gctgccccacccctc

SEQ ID NO: 2311478 - DNA, 15 bp, Homo sapiens
gctgcccccacagat

SEQ ID NO: 2311479 - DNA, 22 bp, Homo sapiens
gctgcccccacagatccatcct

SEQ ID NO: 2311480 - DNA, 19 bp, Homo sapiens
gctgccgtgcacggggcca

SEQ ID NO: 2311481 - DNA, 22 bp, Homo sapiens
gctgccgtgcacggggccagca

SEQ ID NO: 2311482 - DNA, 12 bp, Homo sapiens
gctgcctccaag

SEQ ID NO: 2311483 - DNA, 14 bp, Homo sapiens
gctgcctccaagtc

SEQ ID NO: 2311484 - DNA, 17 bp, Homo sapiens
gctgcctctgaaaatat

SEQ ID NO: 2311485 - DNA, 19 bp, Homo sapiens
gctgcctggcgggcagccc

SEQ ID NO: 2311486 - DNA, 20 bp, Homo sapiens
gctgcctggcgggcagcccc

SEQ ID NO: 2311487 - DNA, 22 bp, Homo sapiens
gctgcctgtttggggagggggg

SEQ ID NO: 2311488 - DNA, 14 bp, Homo sapiens
gctgcgcctgcccg

SEQ ID NO: 2311489 - DNA, 15 bp, Homo sapiens
gctgcgcctgcccgc

SEQ ID NO: 2311490 - DNA, 18 bp, Homo sapiens
gctgcgcctgcccgcccg

SEQ ID NO: 2311491 - DNA, 22 bp, Homo sapiens
gctgcgcctgcccgcccgccgg

SEQ ID NO: 2311492 - DNA, 13 bp, Homo sapiens
gctgctaagtgga

SEQ ID NO: 2311493 - DNA, 19 bp, Homo sapiens
gctgctaagtggaagacag

SEQ ID NO: 2311494 - DNA, 22 bp, Homo sapiens
gctgctaagtggaagacagaga

SEQ ID NO: 2311495 - DNA, 23 bp, Homo sapiens
gctgctaagtggaagacagagat

SEQ ID NO: 2311496 - DNA, 21 bp, Homo sapiens
gctgctcactgctcacacgct

SEQ ID NO: 2311497 - DNA, 20 bp, Homo sapiens
gctgctcctcggccagagct

SEQ ID NO: 2311498 - DNA, 19 bp, Homo sapiens
gctgctcgggaaggcctga

SEQ ID NO: 2311499 - DNA, 22 bp, Homo sapiens
gctgctcgggaaggcctgaggg

SEQ ID NO: 2311500 - DNA, 13 bp, Homo sapiens
gctgctctccatc

SEQ ID NO: 2311501 - DNA, 19 bp, Homo sapiens
gctgctgtgcagcatggaa

SEQ ID NO: 2311502 - DNA, 13 bp, Homo sapiens
gctgcttcaagga

SEQ ID NO: 2311503 - DNA, 17 bp, Homo sapiens
gctgcttgagtggacag

SEQ ID NO: 2311504 - DNA, 21 bp, Homo sapiens
gctgcttgagtggacagcagc

SEQ ID NO: 2311505 - DNA, 15 bp, Homo sapiens
gctggaccaaggtgc

SEQ ID NO: 2311506 - DNA, 22 bp, Homo sapiens
gctggacctggggtcccccctc

SEQ ID NO: 2311507 - DNA, 19 bp, Homo sapiens
gctggagggctgggcaggg

SEQ ID NO: 2311508 - DNA, 20 bp, Homo sapiens
gctggagggctgggcagggc

SEQ ID NO: 2311509 - DNA, 15 bp, Homo sapiens
gctggatgtgctttc

SEQ ID NO: 2311510 - DNA, 16 bp, Homo sapiens
gctggatgtgctttca

SEQ ID NO: 2311511 - DNA, 16 bp, Homo sapiens
gctggcagcgcctccc

SEQ ID NO: 2311512 - DNA, 18 bp, Homo sapiens
gctggcagcgcctcccgc

SEQ ID NO: 2311513 - DNA, 23 bp, Homo sapiens
gctggcaggagacactggtctca

SEQ ID NO: 2311514 - DNA, 12 bp, Homo sapiens
gctggccctgcc

SEQ ID NO: 2311515 - DNA, 13 bp, Homo sapiens
gctggccctgccc

SEQ ID NO: 2311516 - DNA, 19 bp, Homo sapiens
gctggcctgacacaatggt

SEQ ID NO: 2311517 - DNA, 21 bp, Homo sapiens
gctggctgggtcgcccctcct

SEQ ID NO: 2311518 - DNA, 16 bp, Homo sapiens
gctggcttctccctgg

SEQ ID NO: 2311519 - DNA, 21 bp, Homo sapiens
gctggcttctccctggactct

SEQ ID NO: 2311520 - DNA, 12 bp, Homo sapiens
gctgggaccctc

SEQ ID NO: 2311521 - DNA, 22 bp, Homo sapiens
gctgggactcagttcttggcct

SEQ ID NO: 2311522 - DNA, 13 bp, Homo sapiens
gctgggcagggcc

SEQ ID NO: 2311523 - DNA, 19 bp, Homo sapiens
gctgggcagggccctgtgg

SEQ ID NO: 2311524 - DNA, 18 bp, Homo sapiens
gctgggcagggccgcagg

SEQ ID NO: 2311525 - DNA, 22 bp, Homo sapiens
gctggggcttttgtgccaggag

SEQ ID NO: 2311526 - DNA, 12 bp, Homo sapiens
gctgggtcgccc

SEQ ID NO: 2311527 - DNA, 16 bp, Homo sapiens
gctgggtcgcccctcc

SEQ ID NO: 2311528 - DNA, 14 bp, Homo sapiens
gctggtaactgtta

SEQ ID NO: 2311529 - DNA, 22 bp, Homo sapiens
gctggtcgtaaacatctcagag

SEQ ID NO: 2311530 - DNA, 16 bp, Homo sapiens
gctgtacgtctggtgt

SEQ ID NO: 2311531 - DNA, 20 bp, Homo sapiens
gctgtagctacaagggaagc

SEQ ID NO: 2311532 - DNA, 16 bp, Homo sapiens
gctgtattttctttta

SEQ ID NO: 2311533 - DNA, 19 bp, Homo sapiens
gctgtattttcttttatat

SEQ ID NO: 2311534 - DNA, 23 bp, Homo sapiens
gctgtattttcttttatatctgt

SEQ ID NO: 2311535 - DNA, 19 bp, Homo sapiens
gctgtatttttagagatta

SEQ ID NO: 2311536 - DNA, 17 bp, Homo sapiens
gggagagcgccacccgc

SEQ ID NO: 2311537 - DNA, 22 bp, Homo sapiens
gggagagcgccacccgcccgcc

SEQ ID NO: 2311538 - DNA, 23 bp, Homo sapiens
gggagagcgccacccgcccgccc

SEQ ID NO: 2311539 - DNA, 23 bp, Homo sapiens
gggagcaggctcgggctccccag

SEQ ID NO: 2311540 - DNA, 18 bp, Homo sapiens
gggaggctgcggcaggag

SEQ ID NO: 2311541 - DNA, 14 bp, Homo sapiens
gggagggcctctgg

SEQ ID NO: 2311542 - DNA, 13 bp, Homo sapiens
gggatccagagac

SEQ ID NO: 2311543 - DNA, 21 bp, Homo sapiens
gggatccagagacctgctcca

SEQ ID NO: 2311544 - DNA, 15 bp, Homo sapiens
gggatgggcacaggc

SEQ ID NO: 2311545 - DNA, 16 bp, Homo sapiens
gggatgggcacaggct

SEQ ID NO: 2311546 - DNA, 15 bp, Homo sapiens
gggattacaggtgtg

SEQ ID NO: 2311547 - DNA, 20 bp, Homo sapiens
gggcaacactcactgcctgc

SEQ ID NO: 2311548 - DNA, 14 bp, Homo sapiens
gggcaaggggccag

SEQ ID NO: 2311549 - DNA, 17 bp, Homo sapiens
gggcaaggggccaggaa

SEQ ID NO: 2311550 - DNA, 19 bp, Homo sapiens
gggcacaggctgccccacc

SEQ ID NO: 2311551 - DNA, 22 bp, Homo sapiens
gggcacgggagagcgccacccg

SEQ ID NO: 2311552 - DNA, 23 bp, Homo sapiens
gggcacgggagagcgccacccgc

SEQ ID NO: 2311553 - DNA, 15 bp, Homo sapiens
gggcagcccctgctg

SEQ ID NO: 2311554 - DNA, 14 bp, Homo sapiens
gggcagcggccccg

SEQ ID NO: 2311555 - DNA, 19 bp, Homo sapiens
gggcagcggccccgcaccc

SEQ ID NO: 2311556 - DNA, 14 bp, Homo sapiens
gggcaggagctcac

SEQ ID NO: 2311557 - DNA, 22 bp, Homo sapiens
gggcaggagctcacaccgcacc

SEQ ID NO: 2311558 - DNA, 14 bp, Homo sapiens
gggcagggccctgt

SEQ ID NO: 2311559 - DNA, 11 bp, Homo sapiens
gggcagggccg

SEQ ID NO: 2311560 - DNA, 15 bp, Homo sapiens
gggcagggccgcagg

SEQ ID NO: 2311561 - DNA, 17 bp, Homo sapiens
gggcagggccgcagggc

SEQ ID NO: 2311562 - DNA, 18 bp, Homo sapiens
gggcagggccgcagggcg

SEQ ID NO: 2311563 - DNA, 20 bp, Homo sapiens
gggcagtgacgtgagtgggg

SEQ ID NO: 2311564 - DNA, 15 bp, Homo sapiens
gggcatttttcttgg

SEQ ID NO: 2311565 - DNA, 13 bp, Homo sapiens
gggccagcccctc

SEQ ID NO: 2311566 - DNA, 21 bp, Homo sapiens
gggccagcccctccccgcctc

SEQ ID NO: 2311567 - DNA, 16 bp, Homo sapiens
gggccaggaaggggac

SEQ ID NO: 2311568 - DNA, 15 bp, Homo sapiens
gggccaggctgagcc

SEQ ID NO: 2311569 - DNA, 14 bp, Homo sapiens
gggcccatggcccc

SEQ ID NO: 2311570 - DNA, 23 bp, Homo sapiens
gggcccgagcgcgtgccttcccc

SEQ ID NO: 2311571 - DNA, 19 bp, Homo sapiens
gggccctggggtctctgag

SEQ ID NO: 2311572 - DNA, 18 bp, Homo sapiens
gggccctggttcccccag

SEQ ID NO: 2311573 - DNA, 19 bp, Homo sapiens
gggccctgtggctccagga

SEQ ID NO: 2311574 - DNA, 16 bp, Homo sapiens
gggccgcagggcgctc

SEQ ID NO: 2311575 - DNA, 13 bp, Homo sapiens
gggccgcctcctc

SEQ ID NO: 2311576 - DNA, 16 bp, Homo sapiens
gggccgcctcctccag

SEQ ID NO: 2311577 - DNA, 22 bp, Homo sapiens
gggcctagtggcttcagcccct

SEQ ID NO: 2311578 - DNA, 23 bp, Homo sapiens
gggcctagtggcttcagcccctg

SEQ ID NO: 2311579 - DNA, 13 bp, Homo sapiens
gggcctcccgtcc

SEQ ID NO: 2311580 - DNA, 17 bp, Homo sapiens
gggcgctccggcagagg

SEQ ID NO: 2311581 - DNA, 18 bp, Homo sapiens
gggcgctgcccccacaga

SEQ ID NO: 2311582 - DNA, 17 bp, Homo sapiens
gggcggtgaggtggggg

SEQ ID NO: 2311583 - DNA, 16 bp, Homo sapiens
gggctaacgggcgcct

SEQ ID NO: 2311584 - DNA, 21 bp, Homo sapiens
gggctccccttcgcgtatttc

SEQ ID NO: 2311585 - DNA, 13 bp, Homo sapiens
gggctctgggttc

SEQ ID NO: 2311586 - DNA, 18 bp, Homo sapiens
gggctgagcccctcctct

SEQ ID NO: 2311587 - DNA, 22 bp, Homo sapiens
gggctggagcagtttggggcag

SEQ ID NO: 2311588 - DNA, 19 bp, Homo sapiens
gggctggagggctgggcag

SEQ ID NO: 2311589 - DNA, 11 bp, Homo sapiens
gggctggccct

SEQ ID NO: 2311590 - DNA, 13 bp, Homo sapiens
gggcttggagcag

SEQ ID NO: 2311591 - DNA, 14 bp, Homo sapiens
gggcttggagcaga

SEQ ID NO: 2311592 - DNA, 18 bp, Homo sapiens
ggggacacggcctctggg

SEQ ID NO: 2311593 - DNA, 13 bp, Homo sapiens
ggggacagattca

SEQ ID NO: 2311594 - DNA, 22 bp, Homo sapiens
ggggacaggaacacccagcccc

SEQ ID NO: 2311595 - DNA, 22 bp, Homo sapiens
ggggacaggattgtctgctgcc

SEQ ID NO: 2311596 - DNA, 13 bp, Homo sapiens
ggggactctccag

SEQ ID NO: 2311597 - DNA, 13 bp, Homo sapiens
ggggagctggtgg

SEQ ID NO: 2311598 - DNA, 13 bp, Homo sapiens
ggggaggagcacc

SEQ ID NO: 2311599 - DNA, 15 bp, Homo sapiens
ggggaggagcacccc

SEQ ID NO: 2311600 - DNA, 18 bp, Homo sapiens
ggggaggagcacccccag

SEQ ID NO: 2311601 - DNA, 17 bp, Homo sapiens
ggggaggcttccagctc

SEQ ID NO: 2311602 - DNA, 15 bp, Homo sapiens
ggggagggcctctgg

SEQ ID NO: 2311603 - DNA, 19 bp, Homo sapiens
ggggaggttttctccccca

SEQ ID NO: 2311604 - DNA, 15 bp, Homo sapiens
ggggatcataaagtt

SEQ ID NO: 2311605 - DNA, 12 bp, Homo sapiens
ggggcagggggt

SEQ ID NO: 2311606 - DNA, 12 bp, Homo sapiens
ggggccagcccc

SEQ ID NO: 2311607 - DNA, 16 bp, Homo sapiens
ggggcccatggcccca

SEQ ID NO: 2311608 - DNA, 17 bp, Homo sapiens
ggggcccatggccccag

SEQ ID NO: 2311609 - DNA, 20 bp, Homo sapiens
ggggcccatggccccagctg

SEQ ID NO: 2311610 - DNA, 17 bp, Homo sapiens
ggggcccattcagcctc

SEQ ID NO: 2311611 - DNA, 19 bp, Homo sapiens
ggggcccattcagcctcgt

SEQ ID NO: 2311612 - DNA, 14 bp, Homo sapiens
ggggcccgccccag

SEQ ID NO: 2311613 - DNA, 18 bp, Homo sapiens
ggggccgggctggcttct

SEQ ID NO: 2311614 - DNA, 23 bp, Homo sapiens
ggggccgggctggcttctccctg

SEQ ID NO: 2311615 - DNA, 22 bp, Homo sapiens
ggggcctagtggcttcagcccc

SEQ ID NO: 2311616 - DNA, 12 bp, Homo sapiens
ggggcggctctg

SEQ ID NO: 2311617 - DNA, 16 bp, Homo sapiens
ggggcgggagtgatga

SEQ ID NO: 2311618 - DNA, 17 bp, Homo sapiens
ggggcggtgaggtgggg

SEQ ID NO: 2311619 - DNA, 21 bp, Homo sapiens
ggggcggtgaggtgggggcag

SEQ ID NO: 2311620 - DNA, 12 bp, Homo sapiens
ggggctcctggc

SEQ ID NO: 2311621 - DNA, 20 bp, Homo sapiens
ggggctcctggcagtgacct

SEQ ID NO: 2311622 - DNA, 12 bp, Homo sapiens
ggggctggccct

SEQ ID NO: 2311623 - DNA, 16 bp, Homo sapiens
ggggctggccctgccc

SEQ ID NO: 2311624 - DNA, 19 bp, Homo sapiens
ggggctggccctgccctcc

SEQ ID NO: 2311625 - DNA, 14 bp, Homo sapiens
ggggcttggagcag

SEQ ID NO: 2311626 - DNA, 13 bp, Homo sapiens
gggggacaggaac

SEQ ID NO: 2311627 - DNA, 22 bp, Homo sapiens
gggggacaggaacacccagccc

SEQ ID NO: 2311628 - DNA, 15 bp, Homo sapiens
gggggccaggctgag

SEQ ID NO: 2311629 - DNA, 10 bp, Homo sapiens
ggggggagaa

SEQ ID NO: 2311630 - DNA, 17 bp, Homo sapiens
ggggtcagttgggcccc

SEQ ID NO: 2311631 - DNA, 23 bp, Homo sapiens
ggggtctattttataagggcact

SEQ ID NO: 2311632 - DNA, 20 bp, Homo sapiens
ggggtctctgagcagtgggg

SEQ ID NO: 2311633 - DNA, 17 bp, Homo sapiens
ggggtttccacacaggc

SEQ ID NO: 2311634 - DNA, 21 bp, Homo sapiens
ggggtttccacacaggcccat

SEQ ID NO: 2311635 - DNA, 20 bp, Homo sapiens
ggggtttgcttttgttttgt

SEQ ID NO: 2311636 - DNA, 16 bp, Homo sapiens
gggtccaccctagcct

SEQ ID NO: 2311637 - DNA, 23 bp, Homo sapiens
gggtccccggacgctggctcggg

SEQ ID NO: 2311638 - DNA, 13 bp, Homo sapiens
gggtcgcccctcc

SEQ ID NO: 2311639 - DNA, 22 bp, Homo sapiens
gggtctctgagcagtggggagc

SEQ ID NO: 2311640 - DNA, 13 bp, Homo sapiens
gggtggaggatgg

SEQ ID NO: 2311641 - DNA, 18 bp, Homo sapiens
gggtggaggatggacgag

SEQ ID NO: 2311642 - DNA, 17 bp, Homo sapiens
gggtgtcccctggtgcc

SEQ ID NO: 2311643 - DNA, 18 bp, Homo sapiens
gggtgtcccctggtgccc

SEQ ID NO: 2311644 - DNA, 21 bp, Homo sapiens
gggtgtcccctggtgcccctc

SEQ ID NO: 2311645 - DNA, 13 bp, Homo sapiens
gggttgttgcaga

SEQ ID NO: 2311646 - DNA, 16 bp, Homo sapiens
gggtttccacacaggc

SEQ ID NO: 2311647 - DNA, 17 bp, Homo sapiens
ggtaaaagcagggcagc

SEQ ID NO: 2311648 - DNA, 20 bp, Homo sapiens
ggtaaattttataatgtcat

SEQ ID NO: 2311649 - DNA, 22 bp, Homo sapiens
ggtaagttggctcacatcatgt

SEQ ID NO: 2311650 - DNA, 23 bp, Homo sapiens
ggtacatagctctcatgtattta

SEQ ID NO: 2311651 - DNA, 20 bp, Homo sapiens
ggtagagttcctttctggga

SEQ ID NO: 2311652 - DNA, 15 bp, Homo sapiens
ggtagctctgaaggg

SEQ ID NO: 2311653 - DNA, 19 bp, Homo sapiens
ggtagctctgaagggaggg

SEQ ID NO: 2311654 - DNA, 17 bp, Homo sapiens
ggtagtaggttgcatta

SEQ ID NO: 2311655 - DNA, 23 bp, Homo sapiens
ggtataggacaaggggtggaagg

SEQ ID NO: 2311656 - DNA, 18 bp, Homo sapiens
ggtatggtaaagagatgt

SEQ ID NO: 2311657 - DNA, 13 bp, Homo sapiens
ggtcacagacccc

SEQ ID NO: 2311658 - DNA, 19 bp, Homo sapiens
ggtcacctcactcagcacc

SEQ ID NO: 2311659 - DNA, 16 bp, Homo sapiens
ggtcatcccggggcca

SEQ ID NO: 2311660 - DNA, 22 bp, Homo sapiens
ggtcatcccggggccatggaag

SEQ ID NO: 2311661 - DNA, 20 bp, Homo sapiens
ggtccacattctgctgcccc

SEQ ID NO: 2311662 - DNA, 18 bp, Homo sapiens
ggtccaccccgtcccggc

SEQ ID NO: 2311663 - DNA, 22 bp, Homo sapiens
ggtccaccccgtcccggccccg

SEQ ID NO: 2311664 - DNA, 23 bp, Homo sapiens
ggtccaccccgtcccggccccgc

SEQ ID NO: 2311665 - DNA, 12 bp, Homo sapiens
ggtcccccctcc

SEQ ID NO: 2311666 - DNA, 17 bp, Homo sapiens
ggtccgatggcccgaga

SEQ ID NO: 2311667 - DNA, 14 bp, Homo sapiens
ggtcctgaggctgg

SEQ ID NO: 2311668 - DNA, 12 bp, Homo sapiens
gttctagaagga

SEQ ID NO: 2311669 - DNA, 17 bp, Homo sapiens
gttctatttctatctgc

SEQ ID NO: 2311670 - DNA, 14 bp, Homo sapiens
gttctcaaatgcta

SEQ ID NO: 2311671 - DNA, 16 bp, Homo sapiens
gttctccttgtacttg

SEQ ID NO: 2311672 - DNA, 15 bp, Homo sapiens
gttctgagaaggtga

SEQ ID NO: 2311673 - DNA, 14 bp, Homo sapiens
gttcttaaaatatt

SEQ ID NO: 2311674 - DNA, 22 bp, Homo sapiens
gttctttttaaaaagttgcaca

SEQ ID NO: 2311675 - DNA, 17 bp, Homo sapiens
gttgaagggaaatcaat

SEQ ID NO: 2311676 - DNA, 22 bp, Homo sapiens
gttgaatgtattcttttatata

SEQ ID NO: 2311677 - DNA, 18 bp, Homo sapiens
gttgaccaggctggagtg

SEQ ID NO: 2311678 - DNA, 20 bp, Homo sapiens
gttgataatagtaatggttc

SEQ ID NO: 2311679 - DNA, 13 bp, Homo sapiens
gttgatgaccaat

SEQ ID NO: 2311680 - DNA, 14 bp, Homo sapiens
gttgatgaccaatc

SEQ ID NO: 2311681 - DNA, 14 bp, Homo sapiens
gttgatttctttcc

SEQ ID NO: 2311682 - DNA, 13 bp, Homo sapiens
gttgcccaggctg

SEQ ID NO: 2311683 - DNA, 20 bp, Homo sapiens
gttgcccaggctggtcttga

SEQ ID NO: 2311684 - DNA, 15 bp, Homo sapiens
gttggaatgttgtta

SEQ ID NO: 2311685 - DNA, 15 bp, Homo sapiens
gttggcacagaacag

SEQ ID NO: 2311686 - DNA, 12 bp, Homo sapiens
gttggtgttcct

SEQ ID NO: 2311687 - DNA, 16 bp, Homo sapiens
gttgtaacatttcaca

SEQ ID NO: 2311688 - DNA, 16 bp, Homo sapiens
gttgtaccatatgtag

SEQ ID NO: 2311689 - DNA, 19 bp, Homo sapiens
gttgtaccatatgtagcat

SEQ ID NO: 2311690 - DNA, 15 bp, Homo sapiens
gttgtaggactaaat

SEQ ID NO: 2311691 - DNA, 13 bp, Homo sapiens
gttgtatttgaag

SEQ ID NO: 2311692 - DNA, 12 bp, Homo sapiens
gttgtctgtcct

SEQ ID NO: 2311693 - DNA, 13 bp, Homo sapiens
gttgttaaatgct

SEQ ID NO: 2311694 - DNA, 18 bp, Homo sapiens
gttgttcagtcctctgca

SEQ ID NO: 2311695 - DNA, 14 bp, Homo sapiens
gtttaaaaaaataa

SEQ ID NO: 2311696 - DNA, 22 bp, Homo sapiens
gtttaacagatatttaaattta

SEQ ID NO: 2311697 - DNA, 16 bp, Homo sapiens
gtttacttattttcca

SEQ ID NO: 2311698 - DNA, 16 bp, Homo sapiens
gtttatactaattcag

SEQ ID NO: 2311699 - DNA, 13 bp, Homo sapiens
gtttattgtcaaa

SEQ ID NO: 2311700 - DNA, 20 bp, Homo sapiens
gtttcaaagctttcctgttt

SEQ ID NO: 2311701 - DNA, 13 bp, Homo sapiens
gtttcacatctgt

SEQ ID NO: 2311702 - DNA, 23 bp, Homo sapiens
gtttcatgtagccagcagaactg

SEQ ID NO: 2311703 - DNA, 14 bp, Homo sapiens
gtttccacacaggc

SEQ ID NO: 2311704 - DNA, 20 bp, Homo sapiens
gtttccacacaggcccatgc

SEQ ID NO: 2311705 - DNA, 19 bp, Homo sapiens
gtttccaggcatgaccctg

SEQ ID NO: 2311706 - DNA, 16 bp, Homo sapiens
gtttcctgtggaaata

SEQ ID NO: 2311707 - DNA, 19 bp, Homo sapiens
gtttctatactgtttgtaa

SEQ ID NO: 2311708 - DNA, 21 bp, Homo sapiens
gtttctatactgtttgtaata

SEQ ID NO: 2311709 - DNA, 20 bp, Homo sapiens
gtttctatgtccaaacctgg

SEQ ID NO: 2311710 - DNA, 23 bp, Homo sapiens
gtttctcgtactttcacatctct

SEQ ID NO: 2311711 - DNA, 18 bp, Homo sapiens
gtttctgcagtattctgt

SEQ ID NO: 2311712 - DNA, 13 bp, Homo sapiens
gtttcttgcttgt

SEQ ID NO: 2311713 - DNA, 21 bp, Homo sapiens
gtttctttttcttttttgagt

SEQ ID NO: 2311714 - DNA, 21 bp, Homo sapiens
gtttgcattccagcgtctgct

SEQ ID NO: 2311715 - DNA, 12 bp, Homo sapiens
gtttgggcagag

SEQ ID NO: 2311716 - DNA, 13 bp, Homo sapiens
gtttggtgaggac

SEQ ID NO: 2311717 - DNA, 15 bp, Homo sapiens
gttttaagaaatgta

SEQ ID NO: 2311718 - DNA, 20 bp, Homo sapiens
gttttagcggggagggggat

SEQ ID NO: 2311719 - DNA, 20 bp, Homo sapiens
gttttctaaatgtttctttt

SEQ ID NO: 2311720 - DNA, 16 bp, Homo sapiens
gttttgctttttaaac

SEQ ID NO: 2311721 - DNA, 11 bp, Homo sapiens
gtttttgtaac

SEQ ID NO: 2311722 - DNA, 13 bp, Homo sapiens
taaaaaaataaca

SEQ ID NO: 2311723 - DNA, 15 bp, Homo sapiens
taaaaaaataacatc

SEQ ID NO: 2311724 - DNA, 12 bp, Homo sapiens
taaaaaagaaga

SEQ ID NO: 2311725 - DNA, 12 bp, Homo sapiens
taaaaaataaca

SEQ ID NO: 2311726 - DNA, 13 bp, Homo sapiens
taaaaaataacat

SEQ ID NO: 2311727 - DNA, 15 bp, Homo sapiens
taaaaaataacatat

SEQ ID NO: 2311728 - DNA, 22 bp, Homo sapiens
taaaaaataacatattcttgct

SEQ ID NO: 2311729 - DNA, 15 bp, Homo sapiens
taaaaaataactgtg

SEQ ID NO: 2311730 - DNA, 21 bp, Homo sapiens
taaaaaataactgtgcactat

SEQ ID NO: 2311731 - DNA, 15 bp, Homo sapiens
taaaaacataaaata

SEQ ID NO: 2311732 - DNA, 21 bp, Homo sapiens
taaaaaccttctatgttcata

SEQ ID NO: 2311733 - DNA, 18 bp, Homo sapiens
taaaaataaagggaagaa

SEQ ID NO: 2311734 - DNA, 15 bp, Homo sapiens
taaaaataattgggt

SEQ ID NO: 2311735 - DNA, 15 bp, Homo sapiens
taaaaatagcaaaat

SEQ ID NO: 2311736 - DNA, 15 bp, Homo sapiens
taaaaatattctcca

SEQ ID NO: 2311737 - DNA, 13 bp, Homo sapiens
taaaaatctttca

SEQ ID NO: 2311738 - DNA, 14 bp, Homo sapiens
taaaaatctttcag

SEQ ID NO: 2311739 - DNA, 15 bp, Homo sapiens
taaaaatctttcaga

SEQ ID NO: 2311740 - DNA, 21 bp, Homo sapiens
taaaaatctttcagaatacaa

SEQ ID NO: 2311741 - DNA, 20 bp, Homo sapiens
taaaaatgtaggctttcatg

SEQ ID NO: 2311742 - DNA, 12 bp, Homo sapiens
taaaaattctag

SEQ ID NO: 2311743 - DNA, 16 bp, Homo sapiens
taaaacaatgtaatta

SEQ ID NO: 2311744 - DNA, 21 bp, Homo sapiens
taaaacccctaggtcatttgt

SEQ ID NO: 2311745 - DNA, 18 bp, Homo sapiens
taaaaccttacttaaagc

SEQ ID NO: 2311746 - DNA, 16 bp, Homo sapiens
taaaagaatgtacaga

SEQ ID NO: 2311747 - DNA, 19 bp, Homo sapiens
taaaagattcctgaatgta

SEQ ID NO: 2311748 - DNA, 21 bp, Homo sapiens
taaaagattcctgaatgtaat

SEQ ID NO: 2311749 - DNA, 15 bp, Homo sapiens
taaaagcagggcagc

SEQ ID NO: 2311750 - DNA, 17 bp, Homo sapiens
taaaagctttagattga

SEQ ID NO: 2311751 - DNA, 21 bp, Homo sapiens
taaaagctttagattgaaatt

SEQ ID NO: 2311752 - DNA, 13 bp, Homo sapiens
taaaagtgtcact

SEQ ID NO: 2311753 - DNA, 18 bp, Homo sapiens
taaaagtgtcactaagaa

SEQ ID NO: 2311754 - DNA, 15 bp, Homo sapiens
taaaataaataatct

SEQ ID NO: 2311755 - DNA, 15 bp, Homo sapiens
taaaataatgattta

SEQ ID NO: 2311756 - DNA, 22 bp, Homo sapiens
taaaataatgatttaagcattt

SEQ ID NO: 2311757 - DNA, 16 bp, Homo sapiens
taaaatacataaaaga

SEQ ID NO: 2311758 - DNA, 17 bp, Homo sapiens
taaaatacataaaagaa

SEQ ID NO: 2311759 - DNA, 16 bp, Homo sapiens
taaaatagtttaaaaa

SEQ ID NO: 2311760 - DNA, 13 bp, Homo sapiens
taaaatagttttc

SEQ ID NO: 2311761 - DNA, 14 bp, Homo sapiens
taaaatagttttct

SEQ ID NO: 2311762 - DNA, 16 bp, Homo sapiens
taaaatagttttctaa

SEQ ID NO: 2311763 - DNA, 18 bp, Homo sapiens
taaaatagttttctaaat

SEQ ID NO: 2311764 - DNA, 22 bp, Homo sapiens
taaaatagttttctaaatgttt

SEQ ID NO: 2311765 - DNA, 14 bp, Homo sapiens
taaaatatacaaac

SEQ ID NO: 2311766 - DNA, 16 bp, Homo sapiens
taaaatatacaaacat

SEQ ID NO: 2311767 - DNA, 17 bp, Homo sapiens
taaaatattgtgtaaga

SEQ ID NO: 2311768 - DNA, 20 bp, Homo sapiens
taaaatattgtgtaagaatc

SEQ ID NO: 2311769 - DNA, 14 bp, Homo sapiens
taaaatctttccat

SEQ ID NO: 2311770 - DNA, 23 bp, Homo sapiens
taaaatctttccatctcattaca

SEQ ID NO: 2311771 - DNA, 15 bp, Homo sapiens
taaaatgagttacct

SEQ ID NO: 2311772 - DNA, 18 bp, Homo sapiens
taaaatgtttacattttc

SEQ ID NO: 2311773 - DNA, 17 bp, Homo sapiens
taaaattagtgagattt

SEQ ID NO: 2311774 - DNA, 15 bp, Homo sapiens
taaaattcaacaaat

SEQ ID NO: 2311775 - DNA, 12 bp, Homo sapiens
taaaattctagt

SEQ ID NO: 2311776 - DNA, 21 bp, Homo sapiens
taaaattctagtctctgattt

SEQ ID NO: 2311777 - DNA, 21 bp, Homo sapiens
taaaattgtgttcttaaaata

SEQ ID NO: 2311778 - DNA, 14 bp, Homo sapiens
taaaattgttattt

SEQ ID NO: 2311779 - DNA, 18 bp, Homo sapiens
taaaattgttatttcaat

SEQ ID NO: 2311780 - DNA, 23 bp, Homo sapiens
taaaatttaaatcagactagaga

SEQ ID NO: 2311781 - DNA, 20 bp, Homo sapiens
taaacaacagaaacttctca

SEQ ID NO: 2311782 - DNA, 19 bp, Homo sapiens
taaacacacttagaatact

SEQ ID NO: 2311783 - DNA, 19 bp, Homo sapiens
taaacagagtccgggagaa

SEQ ID NO: 2311784 - DNA, 13 bp, Homo sapiens
taaacatcataaa

SEQ ID NO: 2311785 - DNA, 20 bp, Homo sapiens
taaacctgtgctttcatgtt

SEQ ID NO: 2311786 - DNA, 17 bp, Homo sapiens
taaacgatatatgtaaa

SEQ ID NO: 2311787 - DNA, 17 bp, Homo sapiens
taaactgatgtatagct

SEQ ID NO: 2311788 - DNA, 14 bp, Homo sapiens
taaactgttttcat

SEQ ID NO: 2311789 - DNA, 13 bp, Homo sapiens
taaacttgtactt

SEQ ID NO: 2311790 - DNA, 20 bp, Homo sapiens
taaacttgtgtatgatccaa

SEQ ID NO: 2311791 - DNA, 14 bp, Homo sapiens
taaactttcctgta

SEQ ID NO: 2311792 - DNA, 23 bp, Homo sapiens
taaagaacactgcagtgttattt

SEQ ID NO: 2311793 - DNA, 14 bp, Homo sapiens
taaagaagaaaata

SEQ ID NO: 2311794 - DNA, 17 bp, Homo sapiens
taaagaagaaaataacc

SEQ ID NO: 2311795 - DNA, 14 bp, Homo sapiens
taaagaatttgaaa

SEQ ID NO: 2311796 - DNA, 16 bp, Homo sapiens
taaagaatttgaaagt

SEQ ID NO: 2311797 - DNA, 14 bp, Homo sapiens
taaagacagaaaaa

SEQ ID NO: 2311798 - DNA, 16 bp, Homo sapiens
taaagactcttggact

SEQ ID NO: 2311799 - DNA, 17 bp, Homo sapiens
taaagagacaaatagta

SEQ ID NO: 2311800 - DNA, 18 bp, Homo sapiens
taaagagacaaatagtag

SEQ ID NO: 2311801 - DNA, 18 bp, Homo sapiens
taaagagttctccttgta

SEQ ID NO: 2311802 - DNA, 20 bp, Homo sapiens
tatatatttccaaatattct

SEQ ID NO: 2311803 - DNA, 11 bp, Homo sapiens
tatatcagctc

SEQ ID NO: 2311804 - DNA, 14 bp, Homo sapiens
tatatctgtaaatt

SEQ ID NO: 2311805 - DNA, 21 bp, Homo sapiens
tatatctgtaaatttaactgc

SEQ ID NO: 2311806 - DNA, 15 bp, Homo sapiens
tatatctgtaatata

SEQ ID NO: 2311807 - DNA, 16 bp, Homo sapiens
tatatgtaaatataca

SEQ ID NO: 2311808 - DNA, 15 bp, Homo sapiens
tatattatgaataaa

SEQ ID NO: 2311809 - DNA, 22 bp, Homo sapiens
tatattattgctatatttgcta

SEQ ID NO: 2311810 - DNA, 17 bp, Homo sapiens
tatattcagagatgtac

SEQ ID NO: 2311811 - DNA, 23 bp, Homo sapiens
tatattcagagatgtaccatgtt

SEQ ID NO: 2311812 - DNA, 18 bp, Homo sapiens
tatatttattattttcat

SEQ ID NO: 2311813 - DNA, 13 bp, Homo sapiens
tatatttcatatt

SEQ ID NO: 2311814 - DNA, 21 bp, Homo sapiens
tatatttccaaatattctaaa

SEQ ID NO: 2311815 - DNA, 23 bp, Homo sapiens
tatatttccaaatattctaaaaa

SEQ ID NO: 2311816 - DNA, 20 bp, Homo sapiens
tatatttgtaggtatactat

SEQ ID NO: 2311817 - DNA, 20 bp, Homo sapiens
tatcaaactactttttaaca

SEQ ID NO: 2311818 - DNA, 20 bp, Homo sapiens
tatcaaatcattcaaaactt

SEQ ID NO: 2311819 - DNA, 15 bp, Homo sapiens
tatcacgggcccgct

SEQ ID NO: 2311820 - DNA, 17 bp, Homo sapiens
tatcacttgccgtgtca

SEQ ID NO: 2311821 - DNA, 14 bp, Homo sapiens
tatcagagggtgga

SEQ ID NO: 2311822 - DNA, 17 bp, Homo sapiens
tatcagagggtggagat

SEQ ID NO: 2311823 - DNA, 19 bp, Homo sapiens
tatcagggcccaaataaca

SEQ ID NO: 2311824 - DNA, 21 bp, Homo sapiens
tatcagtggttcgggggaaat

SEQ ID NO: 2311825 - DNA, 13 bp, Homo sapiens
tatcagtttgatc

SEQ ID NO: 2311826 - DNA, 17 bp, Homo sapiens
tatccaattcattatgt

SEQ ID NO: 2311827 - DNA, 14 bp, Homo sapiens
tatccagtcaaaga

SEQ ID NO: 2311828 - DNA, 18 bp, Homo sapiens
tatcctggcaaataatac

SEQ ID NO: 2311829 - DNA, 17 bp, Homo sapiens
tatcctggtgtctagtt

SEQ ID NO: 2311830 - DNA, 11 bp, Homo sapiens
tatcctgtgca

SEQ ID NO: 2311831 - DNA, 18 bp, Homo sapiens
tatcctgttaggggaaaa

SEQ ID NO: 2311832 - DNA, 21 bp, Homo sapiens
tatccttttttattgaataac

SEQ ID NO: 2311833 - DNA, 16 bp, Homo sapiens
tatctaaaaaataact

SEQ ID NO: 2311834 - DNA, 22 bp, Homo sapiens
tatctccagccaatttcaaaga

SEQ ID NO: 2311835 - DNA, 12 bp, Homo sapiens
tatctctacttt

SEQ ID NO: 2311836 - DNA, 16 bp, Homo sapiens
tatctgaactggacta

SEQ ID NO: 2311837 - DNA, 19 bp, Homo sapiens
tatctgcaaatagtttcaa

SEQ ID NO: 2311838 - DNA, 20 bp, Homo sapiens
tatctgcaaatagtttcaaa

SEQ ID NO: 2311839 - DNA, 19 bp, Homo sapiens
tatctgcccacctcggcct

SEQ ID NO: 2311840 - DNA, 19 bp, Homo sapiens
tatctgggttttagaaatt

SEQ ID NO: 2311841 - DNA, 22 bp, Homo sapiens
tatctgggttttagaaattcta

SEQ ID NO: 2311842 - DNA, 14 bp, Homo sapiens
tatcttgaagactt

SEQ ID NO: 2311843 - DNA, 20 bp, Homo sapiens
tatgaaaacaccactgaaca

SEQ ID NO: 2311844 - DNA, 12 bp, Homo sapiens
tatgaaagagaa

SEQ ID NO: 2311845 - DNA, 15 bp, Homo sapiens
tatgaaagagaaaat

SEQ ID NO: 2311846 - DNA, 23 bp, Homo sapiens
tatgaaagagaaaatgctttctc

SEQ ID NO: 2311847 - DNA, 16 bp, Homo sapiens
tatgaaccacatggaa

SEQ ID NO: 2311848 - DNA, 21 bp, Homo sapiens
tatgaactagagactctgtga

SEQ ID NO: 2311849 - DNA, 13 bp, Homo sapiens
tatgaagacactg

SEQ ID NO: 2311850 - DNA, 17 bp, Homo sapiens
tatgaagttaacagtct

SEQ ID NO: 2311851 - DNA, 12 bp, Homo sapiens
tatgaataaaat

SEQ ID NO: 2311852 - DNA, 14 bp, Homo sapiens
tatgaataaaattg

SEQ ID NO: 2311853 - DNA, 22 bp, Homo sapiens
tatgaataaaattgttatttca

SEQ ID NO: 2311854 - DNA, 21 bp, Homo sapiens
tatgaatctctacgcaaaaaa

SEQ ID NO: 2311855 - DNA, 22 bp, Homo sapiens
tatgacagaatttgtgaatata

SEQ ID NO: 2311856 - DNA, 17 bp, Homo sapiens
tatgactgaagtaataa

SEQ ID NO: 2311857 - DNA, 21 bp, Homo sapiens
tatgactgaagtaataactga

SEQ ID NO: 2311858 - DNA, 17 bp, Homo sapiens
tatgagaaaaaaacagc

SEQ ID NO: 2311859 - DNA, 14 bp, Homo sapiens
tatgattgaaaaga

SEQ ID NO: 2311860 - DNA, 17 bp, Homo sapiens
tatgattgaaaagaaga

SEQ ID NO: 2311861 - DNA, 20 bp, Homo sapiens
tatgatttctgttgttattc

SEQ ID NO: 2311862 - DNA, 16 bp, Homo sapiens
tatgcaacctgtgcaa

SEQ ID NO: 2311863 - DNA, 18 bp, Homo sapiens
tatgcaacctgtgcaaaa

SEQ ID NO: 2311864 - DNA, 13 bp, Homo sapiens
tatgcctgtattt

SEQ ID NO: 2311865 - DNA, 17 bp, Homo sapiens
tatgcctgtatttccaa

SEQ ID NO: 2311866 - DNA, 21 bp, Homo sapiens
tatgcctgtatttccaacaaa

SEQ ID NO: 2311867 - DNA, 13 bp, Homo sapiens
tatgctttcttca

SEQ ID NO: 2311868 - DNA, 15 bp, Homo sapiens
tatggaaatcctgtt

SEQ ID NO: 2311869 - DNA, 13 bp, Homo sapiens
tatggaacactct

SEQ ID NO: 2311870 - DNA, 20 bp, Homo sapiens
tatggtaaagagatgtcaaa

SEQ ID NO: 2311871 - DNA, 14 bp, Homo sapiens
tatggtgtgcttat

SEQ ID NO: 2311872 - DNA, 15 bp, Homo sapiens
tatgtaaatatacag

SEQ ID NO: 2311873 - DNA, 20 bp, Homo sapiens
tatgtaagggctttaaataa

SEQ ID NO: 2311874 - DNA, 18 bp, Homo sapiens
tatgtacttttccattta

SEQ ID NO: 2311875 - DNA, 15 bp, Homo sapiens
tatgtagaactgttc

SEQ ID NO: 2311876 - DNA, 24 bp, Homo sapiens
tatgtagacaaaacttataatttc

SEQ ID NO: 2311877 - DNA, 18 bp, Homo sapiens
tatgtagaggctttatgt

SEQ ID NO: 2311878 - DNA, 18 bp, Homo sapiens
tatgtagcattaaatata

SEQ ID NO: 2311879 - DNA, 12 bp, Homo sapiens
tatgtcaaaaat

SEQ ID NO: 2311880 - DNA, 15 bp, Homo sapiens
tatgtccaaacctgg

SEQ ID NO: 2311881 - DNA, 19 bp, Homo sapiens
tatgtgatctgtcttgtaa

SEQ ID NO: 2311882 - DNA, 20 bp, Homo sapiens
tatgtggagttcatcttgaa

SEQ ID NO: 2311883 - DNA, 22 bp, Homo sapiens
tatgtgtgctcttatccccagc

SEQ ID NO: 2311884 - DNA, 22 bp, Homo sapiens
tatgttagattaggtgtaagac

SEQ ID NO: 2311885 - DNA, 15 bp, Homo sapiens
tatgttcataaaaaa

SEQ ID NO: 2311886 - DNA, 15 bp, Homo sapiens
tatgttgctgaaaca

SEQ ID NO: 2311887 - DNA, 17 bp, Homo sapiens
tattacatttcatttat

SEQ ID NO: 2311888 - DNA, 19 bp, Homo sapiens
tattacatttcatttatac

SEQ ID NO: 2311889 - DNA, 22 bp, Homo sapiens
tattacatttcatttatactgt

SEQ ID NO: 2311890 - DNA, 13 bp, Homo sapiens
tattagaatccaa

SEQ ID NO: 2311891 - DNA, 13 bp, Homo sapiens
tattatatatata

SEQ ID NO: 2311892 - DNA, 14 bp, Homo sapiens
tattatctgggttt

SEQ ID NO: 2311893 - DNA, 18 bp, Homo sapiens
tattatgtatagaaaata

SEQ ID NO: 2311894 - DNA, 16 bp, Homo sapiens
tattattgctgttgct

SEQ ID NO: 2311895 - DNA, 14 bp, Homo sapiens
tattcagagatgta

SEQ ID NO: 2311896 - DNA, 17 bp, Homo sapiens
tattcagagatgtacca

SEQ ID NO: 2311897 - DNA, 19 bp, Homo sapiens
tattcaggaccccatctgc

SEQ ID NO: 2311898 - DNA, 16 bp, Homo sapiens
tattcatactttccaa

SEQ ID NO: 2311899 - DNA, 17 bp, Homo sapiens
tattcatcaaactcttt

SEQ ID NO: 2311900 - DNA, 22 bp, Homo sapiens
tattcatctgttgacaatttgc

SEQ ID NO: 2311901 - DNA, 22 bp, Homo sapiens
tattcatgtgtacagaaacaac

SEQ ID NO: 2311902 - DNA, 23 bp, Homo sapiens
tattcattcatggaccactgttt

SEQ ID NO: 2311903 - DNA, 14 bp, Homo sapiens
tattctaaaaaaga

SEQ ID NO: 2311904 - DNA, 15 bp, Homo sapiens
tattctaaaaaagat

SEQ ID NO: 2311905 - DNA, 18 bp, Homo sapiens
tattctaaaaaagatact

SEQ ID NO: 2311906 - DNA, 10 bp, Homo sapiens
tattctgtca

SEQ ID NO: 2311907 - DNA, 21 bp, Homo sapiens
tattctgtggattctatattt

SEQ ID NO: 2311908 - DNA, 14 bp, Homo sapiens
tattcttccaagtt

SEQ ID NO: 2311909 - DNA, 11 bp, Homo sapiens
tattgaataac

SEQ ID NO: 2311910 - DNA, 13 bp, Homo sapiens
tattgaatgttat

SEQ ID NO: 2311911 - DNA, 21 bp, Homo sapiens
tattgagatcagcattcaaaa

SEQ ID NO: 2311912 - DNA, 19 bp, Homo sapiens
tattgagtaatattacatt

SEQ ID NO: 2311913 - DNA, 14 bp, Homo sapiens
tattgcctctgtct

SEQ ID NO: 2311914 - DNA, 18 bp, Homo sapiens
tattgctatatttgctaa

SEQ ID NO: 2311915 - DNA, 22 bp, Homo sapiens
tattgctgatggtgcaatgacc

SEQ ID NO: 2311916 - DNA, 16 bp, Homo sapiens
tattgctgttgcttga

SEQ ID NO: 2311917 - DNA, 18 bp, Homo sapiens
tattgctgttgcttgaat

SEQ ID NO: 2311918 - DNA, 17 bp, Homo sapiens
tattgtcaaagtggtga

SEQ ID NO: 2311919 - DNA, 20 bp, Homo sapiens
tattgttaaaaccttactta

SEQ ID NO: 2311920 - DNA, 16 bp, Homo sapiens
tattgttgctgctttg

SEQ ID NO: 2311921 - DNA, 20 bp, Homo sapiens
tattgttggcacagaacagg

SEQ ID NO: 2311922 - DNA, 16 bp, Homo sapiens
tattgtttataggaaa

SEQ ID NO: 2311923 - DNA, 20 bp, Homo sapiens
tatttacaagctatttttgc

SEQ ID NO: 2311924 - DNA, 15 bp, Homo sapiens
tatttactgtgctaa

SEQ ID NO: 2311925 - DNA, 17 bp, Homo sapiens
tatttagataacaagaa

SEQ ID NO: 2311926 - DNA, 13 bp, Homo sapiens
tatttagtatctg

SEQ ID NO: 2311927 - DNA, 17 bp, Homo sapiens
tatttattcatgtgtac

SEQ ID NO: 2311928 - DNA, 21 bp, Homo sapiens
tatttatttgttttggaatcc

SEQ ID NO: 2311929 - DNA, 22 bp, Homo sapiens
tatttcaaaccagtttcacata

SEQ ID NO: 2311930 - DNA, 16 bp, Homo sapiens
tatttcaatagtaccc

SEQ ID NO: 2311931 - DNA, 14 bp, Homo sapiens
tatttcatgactgg

SEQ ID NO: 2311932 - DNA, 14 bp, Homo sapiens
tatttccaaatatt

SEQ ID NO: 2311933 - DNA, 21 bp, Homo sapiens
tatttccaaatattctaaaaa

SEQ ID NO: 2311934 - DNA, 13 bp, Homo sapiens
tccctggactctg

SEQ ID NO: 2311935 - DNA, 22 bp, Homo sapiens
tccctgtaatgcactcctgccc

SEQ ID NO: 2311936 - DNA, 17 bp, Homo sapiens
tcccttacgtgagtcct

SEQ ID NO: 2311937 - DNA, 19 bp, Homo sapiens
tccctttcctcccttctga

SEQ ID NO: 2311938 - DNA, 22 bp, Homo sapiens
tccctttctcttctgactggta

SEQ ID NO: 2311939 - DNA, 18 bp, Homo sapiens
tccgactccccctccccg

SEQ ID NO: 2311940 - DNA, 20 bp, Homo sapiens
tccgatggcccgagagctgg

SEQ ID NO: 2311941 - DNA, 21 bp, Homo sapiens
tccgatggcccgagagctggg

SEQ ID NO: 2311942 - DNA, 17 bp, Homo sapiens
tccgcccgcccaccccg

SEQ ID NO: 2311943 - DNA, 20 bp, Homo sapiens
tccgcccgcccaccccgctg

SEQ ID NO: 2311944 - DNA, 12 bp, Homo sapiens
tccggcagaggc

SEQ ID NO: 2311945 - DNA, 13 bp, Homo sapiens
tccggcagaggca

SEQ ID NO: 2311946 - DNA, 16 bp, Homo sapiens
tccggcagaggcaggg

SEQ ID NO: 2311947 - DNA, 17 bp, Homo sapiens
tccggcagaggcagggc

SEQ ID NO: 2311948 - DNA, 16 bp, Homo sapiens
tccggcctgcagccca

SEQ ID NO: 2311949 - DNA, 12 bp, Homo sapiens
tccggctggacc

SEQ ID NO: 2311950 - DNA, 14 bp, Homo sapiens
tccggttgcatact

SEQ ID NO: 2311951 - DNA, 19 bp, Homo sapiens
tccggttgcatactggact

SEQ ID NO: 2311952 - DNA, 21 bp, Homo sapiens
tccgtccccagggtgcaggcg

SEQ ID NO: 2311953 - DNA, 13 bp, Homo sapiens
tccgtccgcccgc

SEQ ID NO: 2311954 - DNA, 15 bp, Homo sapiens
tccgtccgcccgccc

SEQ ID NO: 2311955 - DNA, 20 bp, Homo sapiens
tccgtgagagtcatctcaaa

SEQ ID NO: 2311956 - DNA, 17 bp, Homo sapiens
tcctaaagaaaaagata

SEQ ID NO: 2311957 - DNA, 23 bp, Homo sapiens
tcctaaataatatcctgaataac

SEQ ID NO: 2311958 - DNA, 22 bp, Homo sapiens
tcctaggggccgagggaaatgc

SEQ ID NO: 2311959 - DNA, 22 bp, Homo sapiens
tcctagtaagaacgtactttct

SEQ ID NO: 2311960 - DNA, 22 bp, Homo sapiens
tcctcacatgactgaagggact

SEQ ID NO: 2311961 - DNA, 15 bp, Homo sapiens
tcctcatctccatgc

SEQ ID NO: 2311962 - DNA, 11 bp, Homo sapiens
tcctccaaaac

SEQ ID NO: 2311963 - DNA, 19 bp, Homo sapiens
tcctcccccacgcctccat

SEQ ID NO: 2311964 - DNA, 15 bp, Homo sapiens
tcctccctgcctggc

SEQ ID NO: 2311965 - DNA, 22 bp, Homo sapiens
tcctcctgacaccccacttagc

SEQ ID NO: 2311966 - DNA, 14 bp, Homo sapiens
tcctcggccagagc

SEQ ID NO: 2311967 - DNA, 18 bp, Homo sapiens
tcctcggccagagctccc

SEQ ID NO: 2311968 - DNA, 20 bp, Homo sapiens
tcctcggctggctgtccacc

SEQ ID NO: 2311969 - DNA, 16 bp, Homo sapiens
tcctcgtccggcctgc

SEQ ID NO: 2311970 - DNA, 17 bp, Homo sapiens
tcctcgtccggcctgca

SEQ ID NO: 2311971 - DNA, 14 bp, Homo sapiens
tcctctgcagcctg

SEQ ID NO: 2311972 - DNA, 15 bp, Homo sapiens
tcctctgcagcctga

SEQ ID NO: 2311973 - DNA, 11 bp, Homo sapiens
tcctctgcccc

SEQ ID NO: 2311974 - DNA, 19 bp, Homo sapiens
tcctctgccccctcccccg

SEQ ID NO: 2311975 - DNA, 16 bp, Homo sapiens
tcctctgtgctctcct

SEQ ID NO: 2311976 - DNA, 13 bp, Homo sapiens
tcctctttcccca

SEQ ID NO: 2311977 - DNA, 14 bp, Homo sapiens
tcctctttccccac

SEQ ID NO: 2311978 - DNA, 15 bp, Homo sapiens
tcctgaaataaaact

SEQ ID NO: 2311979 - DNA, 19 bp, Homo sapiens
tcctgacaccccacttagc

SEQ ID NO: 2311980 - DNA, 20 bp, Homo sapiens
tcctgacaccccacttagcc

SEQ ID NO: 2311981 - DNA, 13 bp, Homo sapiens
tcctgagccagat

SEQ ID NO: 2311982 - DNA, 14 bp, Homo sapiens
tcctgagccagatt

SEQ ID NO: 2311983 - DNA, 18 bp, Homo sapiens
tcctgagccagatttcac

SEQ ID NO: 2311984 - DNA, 19 bp, Homo sapiens
tcctgagccagatttcact

SEQ ID NO: 2311985 - DNA, 18 bp, Homo sapiens
tcctgagtagctgggact

SEQ ID NO: 2311986 - DNA, 19 bp, Homo sapiens
tcctgccccggcccaacct

SEQ ID NO: 2311987 - DNA, 16 bp, Homo sapiens
tcctgccgacggagcc

SEQ ID NO: 2311988 - DNA, 17 bp, Homo sapiens
tcctgcctaaatttcac

SEQ ID NO: 2311989 - DNA, 19 bp, Homo sapiens
tcctgcgtgtgcccactga

SEQ ID NO: 2311990 - DNA, 20 bp, Homo sapiens
tcctgctacagtagctgtgg

SEQ ID NO: 2311991 - DNA, 12 bp, Homo sapiens
tcctgctgctcg

SEQ ID NO: 2311992 - DNA, 21 bp, Homo sapiens
tcctgctgctcgggaaggcct

SEQ ID NO: 2311993 - DNA, 22 bp, Homo sapiens
tcctgctgctcgggaaggcctg

SEQ ID NO: 2311994 - DNA, 16 bp, Homo sapiens
tcctggaagtgtgtgt

SEQ ID NO: 2311995 - DNA, 14 bp, Homo sapiens
tcctggcagggcag

SEQ ID NO: 2311996 - DNA, 20 bp, Homo sapiens
tcctggcagggcaggcagag

SEQ ID NO: 2311997 - DNA, 16 bp, Homo sapiens
tcctgggcaaaggtat

SEQ ID NO: 2311998 - DNA, 15 bp, Homo sapiens
tcctgggcatcccca

SEQ ID NO: 2311999 - DNA, 20 bp, Homo sapiens
tcctgggcatccccagcccc

SEQ ID NO: 2312000 - DNA, 17 bp, Homo sapiens
tcctggtctgcacctct

SEQ ID NO: 2312001 - DNA, 16 bp, Homo sapiens
tcctgtaattttgtag

SEQ ID NO: 2312002 - DNA, 19 bp, Homo sapiens
tcctgtaattttgtagtag

SEQ ID NO: 2312003 - DNA, 19 bp, Homo sapiens
tcctgtgcaaaaataaaat

SEQ ID NO: 2312004 - DNA, 15 bp, Homo sapiens
tcctgtggaaatatg

SEQ ID NO: 2312005 - DNA, 16 bp, Homo sapiens
tcctgtggaaatatgc

SEQ ID NO: 2312006 - DNA, 23 bp, Homo sapiens
tcctgtggaaatatgcaacctgt

SEQ ID NO: 2312007 - DNA, 15 bp, Homo sapiens
tccttattttcataa

SEQ ID NO: 2312008 - DNA, 18 bp, Homo sapiens
tccttattttcataattc

SEQ ID NO: 2312009 - DNA, 16 bp, Homo sapiens
tccttcagtgccttat

SEQ ID NO: 2312010 - DNA, 22 bp, Homo sapiens
tccttcagtgccttatggaaca

SEQ ID NO: 2312011 - DNA, 21 bp, Homo sapiens
tccttctaaagtgctgggatt

SEQ ID NO: 2312012 - DNA, 21 bp, Homo sapiens
tccttgaggacctccacctgg

SEQ ID NO: 2312013 - DNA, 14 bp, Homo sapiens
tccttgcctctgct

SEQ ID NO: 2312014 - DNA, 22 bp, Homo sapiens
tccttgcctctgctctgtgcac

SEQ ID NO: 2312015 - DNA, 21 bp, Homo sapiens
tccttggtgtcgggcatgaca

SEQ ID NO: 2312016 - DNA, 13 bp, Homo sapiens
tccttgtcacaga

SEQ ID NO: 2312017 - DNA, 22 bp, Homo sapiens
tccttgtcacagaatctccatt

SEQ ID NO: 2312018 - DNA, 18 bp, Homo sapiens
tcctttgaacctgtgcaa

SEQ ID NO: 2312019 - DNA, 18 bp, Homo sapiens
tcctttgacctctcactt

SEQ ID NO: 2312020 - DNA, 14 bp, Homo sapiens
tccttttcttttct

SEQ ID NO: 2312021 - DNA, 17 bp, Homo sapiens
tccttttgcttcatctg

SEQ ID NO: 2312022 - DNA, 18 bp, Homo sapiens
tccttttgcttcatctgg

SEQ ID NO: 2312023 - DNA, 16 bp, Homo sapiens
tccttttgtctgatag

SEQ ID NO: 2312024 - DNA, 15 bp, Homo sapiens
tcgacctcactgtca

SEQ ID NO: 2312025 - DNA, 17 bp, Homo sapiens
tcgagagggctgagccc

SEQ ID NO: 2312026 - DNA, 13 bp, Homo sapiens
tcgagtccaaaat

SEQ ID NO: 2312027 - DNA, 15 bp, Homo sapiens
tcgagttacagacaa

SEQ ID NO: 2312028 - DNA, 17 bp, Homo sapiens
tcgcagcccctgttgga

SEQ ID NO: 2312029 - DNA, 13 bp, Homo sapiens
tcgccaagccatc

SEQ ID NO: 2312030 - DNA, 16 bp, Homo sapiens
tcgccaagccatcaca

SEQ ID NO: 2312031 - DNA, 18 bp, Homo sapiens
tcgccaagccatcacagg

SEQ ID NO: 2312032 - DNA, 19 bp, Homo sapiens
tcgccaaggctcacatgct

SEQ ID NO: 2312033 - DNA, 14 bp, Homo sapiens
tcgcccctcctcgg

SEQ ID NO: 2312034 - DNA, 12 bp, Homo sapiens
tcgccctctctc

SEQ ID NO: 2312035 - DNA, 14 bp, Homo sapiens
tcgccctctctcac

SEQ ID NO: 2312036 - DNA, 17 bp, Homo sapiens
tcgccctctctcaccag

SEQ ID NO: 2312037 - DNA, 19 bp, Homo sapiens
tcgccctctctcaccagcc

SEQ ID NO: 2312038 - DNA, 22 bp, Homo sapiens
tcgcctgagggaagagtagctg

SEQ ID NO: 2312039 - DNA, 23 bp, Homo sapiens
tcgctccaactccaacatccact

SEQ ID NO: 2312040 - DNA, 20 bp, Homo sapiens
tcgctggctgatcattgcag

SEQ ID NO: 2312041 - DNA, 17 bp, Homo sapiens
tcgcttagctgaaacct

SEQ ID NO: 2312042 - DNA, 21 bp, Homo sapiens
tcggaaatacactacaaatgt

SEQ ID NO: 2312043 - DNA, 18 bp, Homo sapiens
tcggccagagctcccagg

SEQ ID NO: 2312044 - DNA, 20 bp, Homo sapiens
tcggcgccttctacctgcag

SEQ ID NO: 2312045 - DNA, 23 bp, Homo sapiens
tcgggaagaaggacttcctgcta

SEQ ID NO: 2312046 - DNA, 20 bp, Homo sapiens
tcgggaaggcctgagggaag

SEQ ID NO: 2312047 - DNA, 11 bp, Homo sapiens
tcgggcatgac

SEQ ID NO: 2312048 - DNA, 19 bp, Homo sapiens
tcgggccgcctcctccaga

SEQ ID NO: 2312049 - DNA, 21 bp, Homo sapiens
tcgggcgcctgcgctcctctg

SEQ ID NO: 2312050 - DNA, 11 bp, Homo sapiens
tcgggggagga

SEQ ID NO: 2312051 - DNA, 22 bp, Homo sapiens
tcgggggaggagcacccccagc

SEQ ID NO: 2312052 - DNA, 23 bp, Homo sapiens
tcgggggaggagcacccccagcc

SEQ ID NO: 2312053 - DNA, 13 bp, Homo sapiens
tcgggtgcccagg

SEQ ID NO: 2312054 - DNA, 23 bp, Homo sapiens
tcggtgttttgcaaacatttctt

SEQ ID NO: 2312055 - DNA, 17 bp, Homo sapiens
tcggttcaggaggagac

SEQ ID NO: 2312056 - DNA, 13 bp, Homo sapiens
tcgtactttcaca

SEQ ID NO: 2312057 - DNA, 22 bp, Homo sapiens
tcgtcaggaggtgcctgagagc

SEQ ID NO: 2312058 - DNA, 14 bp, Homo sapiens
tcgtccggcctgca

SEQ ID NO: 2312059 - DNA, 14 bp, Homo sapiens
tcgtctcagaaggc

SEQ ID NO: 2312060 - DNA, 15 bp, Homo sapiens
tcgtctttttccaaa

SEQ ID NO: 2312061 - DNA, 13 bp, Homo sapiens
tcgtgcatttgtg

SEQ ID NO: 2312062 - DNA, 14 bp, Homo sapiens
tcgtgttcgctggc

SEQ ID NO: 2312063 - DNA, 17 bp, Homo sapiens
tcgtgttcgctggctga

SEQ ID NO: 2312064 - DNA, 22 bp, Homo sapiens
tctaaaaaagatactgtatatg

SEQ ID NO: 2312065 - DNA, 16 bp, Homo sapiens
tctaaaaaataactgt

SEQ ID NO: 2312066 - DNA, 19 bp, Homo sapiens
tgaaatttatgactagcaa

SEQ ID NO: 2312067 - DNA, 15 bp, Homo sapiens
tgaaatttttaaatc

SEQ ID NO: 2312068 - DNA, 16 bp, Homo sapiens
tgaaatttttaaatca

SEQ ID NO: 2312069 - DNA, 18 bp, Homo sapiens
tgaaatttttaaatcatt

SEQ ID NO: 2312070 - DNA, 21 bp, Homo sapiens
tgaaatttttaaatcatttca

SEQ ID NO: 2312071 - DNA, 19 bp, Homo sapiens
tgaacaccactttgtctct

SEQ ID NO: 2312072 - DNA, 20 bp, Homo sapiens
tgaacaggccgcacatctca

SEQ ID NO: 2312073 - DNA, 15 bp, Homo sapiens
tgaaccgtcaatgtg

SEQ ID NO: 2312074 - DNA, 17 bp, Homo sapiens
tgaaccgtcaatgtgaa

SEQ ID NO: 2312075 - DNA, 20 bp, Homo sapiens
tgaactcaatgcatgatgac

SEQ ID NO: 2312076 - DNA, 14 bp, Homo sapiens
tgaactcttggcct

SEQ ID NO: 2312077 - DNA, 16 bp, Homo sapiens
tgaactgctgctggtc

SEQ ID NO: 2312078 - DNA, 15 bp, Homo sapiens
tgaactgtatattat

SEQ ID NO: 2312079 - DNA, 22 bp, Homo sapiens
tgaacttggctttcctgtttct

SEQ ID NO: 2312080 - DNA, 20 bp, Homo sapiens
tgaagaaaaaattttaaaaa

SEQ ID NO: 2312081 - DNA, 22 bp, Homo sapiens
tgaagaaagtcagctcttgtca

SEQ ID NO: 2312082 - DNA, 13 bp, Homo sapiens
tgaagaatattgt

SEQ ID NO: 2312083 - DNA, 21 bp, Homo sapiens
tgaagacactgtcaatgaggt

SEQ ID NO: 2312084 - DNA, 17 bp, Homo sapiens
tgaagacttttctttca

SEQ ID NO: 2312085 - DNA, 18 bp, Homo sapiens
tgaagataaatgctttaa

SEQ ID NO: 2312086 - DNA, 21 bp, Homo sapiens
tgaagataaatgctttaaata

SEQ ID NO: 2312087 - DNA, 23 bp, Homo sapiens
tgaagataaatgctttaaatagt

SEQ ID NO: 2312088 - DNA, 17 bp, Homo sapiens
tgaagatctcagataaa

SEQ ID NO: 2312089 - DNA, 22 bp, Homo sapiens
tgaagatgtgtaaataagcgtt

SEQ ID NO: 2312090 - DNA, 22 bp, Homo sapiens
tgaagatgtttttagaggggca

SEQ ID NO: 2312091 - DNA, 11 bp, Homo sapiens
tgaagctcaac

SEQ ID NO: 2312092 - DNA, 17 bp, Homo sapiens
tgaagctgctcactgct

SEQ ID NO: 2312093 - DNA, 15 bp, Homo sapiens
tgaaggccttgttaa

SEQ ID NO: 2312094 - DNA, 13 bp, Homo sapiens
tgaagggaaatca

SEQ ID NO: 2312095 - DNA, 24 bp, Homo sapiens
tgaagggaggggaagagagaggcc

SEQ ID NO: 2312096 - DNA, 23 bp, Homo sapiens
tgaagtaagttctgaaaactgtt

SEQ ID NO: 2312097 - DNA, 15 bp, Homo sapiens
tgaagtatacattta

SEQ ID NO: 2312098 - DNA, 17 bp, Homo sapiens
tgaagtatacatttagt

SEQ ID NO: 2312099 - DNA, 19 bp, Homo sapiens
tgaagtccacttatgtaga

SEQ ID NO: 2312100 - DNA, 17 bp, Homo sapiens
tgaagtccagctccctt

SEQ ID NO: 2312101 - DNA, 13 bp, Homo sapiens
tgaagtcttgtat

SEQ ID NO: 2312102 - DNA, 22 bp, Homo sapiens
tgaagtctttgtacagacaaca

SEQ ID NO: 2312103 - DNA, 18 bp, Homo sapiens
tgaagtgatgatggatga

SEQ ID NO: 2312104 - DNA, 16 bp, Homo sapiens
tgaataaaattgttat

SEQ ID NO: 2312105 - DNA, 17 bp, Homo sapiens
tgaataaaattgttatt

SEQ ID NO: 2312106 - DNA, 22 bp, Homo sapiens
tgaataataaccacgattccaa

SEQ ID NO: 2312107 - DNA, 15 bp, Homo sapiens
tgaatcaaagacatt

SEQ ID NO: 2312108 - DNA, 17 bp, Homo sapiens
tgaatcaaagacatttc

SEQ ID NO: 2312109 - DNA, 18 bp, Homo sapiens
tgaatcagtatgaagaca

SEQ ID NO: 2312110 - DNA, 21 bp, Homo sapiens
tgaatcagtatgaagacactg

SEQ ID NO: 2312111 - DNA, 15 bp, Homo sapiens
tgaatgacatcaaca

SEQ ID NO: 2312112 - DNA, 13 bp, Homo sapiens
tgaatgcatgtgt

SEQ ID NO: 2312113 - DNA, 17 bp, Homo sapiens
tgaatgcatgtgtgaag

SEQ ID NO: 2312114 - DNA, 14 bp, Homo sapiens
tgaatgcctttcaa

SEQ ID NO: 2312115 - DNA, 20 bp, Homo sapiens
tgaatgcctttcaaacattg

SEQ ID NO: 2312116 - DNA, 15 bp, Homo sapiens
tgaatgtcagtgtga

SEQ ID NO: 2312117 - DNA, 18 bp, Homo sapiens
tgaatgtcagtgtgactg

SEQ ID NO: 2312118 - DNA, 18 bp, Homo sapiens
tgaatgtccccattctat

SEQ ID NO: 2312119 - DNA, 19 bp, Homo sapiens
tgaattattacactgtaag

SEQ ID NO: 2312120 - DNA, 16 bp, Homo sapiens
tgacaatttgccatag

SEQ ID NO: 2312121 - DNA, 20 bp, Homo sapiens
tgacacaatggtagctctga

SEQ ID NO: 2312122 - DNA, 21 bp, Homo sapiens
tgacacaatggtagctctgaa

SEQ ID NO: 2312123 - DNA, 17 bp, Homo sapiens
tgacacataaatctgtc

SEQ ID NO: 2312124 - DNA, 17 bp, Homo sapiens
tgacaccccacttagcc

SEQ ID NO: 2312125 - DNA, 16 bp, Homo sapiens
tgacacgaatattgct

SEQ ID NO: 2312126 - DNA, 21 bp, Homo sapiens
tgacacgacttctgtttcaca

SEQ ID NO: 2312127 - DNA, 18 bp, Homo sapiens
tgacactaaccagagtca

SEQ ID NO: 2312128 - DNA, 23 bp, Homo sapiens
tgacagaatttgtgaatatattt

SEQ ID NO: 2312129 - DNA, 22 bp, Homo sapiens
tgacagagccatatgtacccta

SEQ ID NO: 2312130 - DNA, 23 bp, Homo sapiens
tgacagagccctatctatgtcct

SEQ ID NO: 2312131 - DNA, 15 bp, Homo sapiens
tgacatattggctct

SEQ ID NO: 2312132 - DNA, 18 bp, Homo sapiens
tgacatgtattttttcct

SEQ ID NO: 2312133 - DNA, 20 bp, Homo sapiens
tgaccaacgtggagaaaccc

SEQ ID NO: 2312134 - DNA, 13 bp, Homo sapiens
tgaccaatctctg

SEQ ID NO: 2312135 - DNA, 14 bp, Homo sapiens
tgaccaatctctgt

SEQ ID NO: 2312136 - DNA, 19 bp, Homo sapiens
tgaccaatctctgtgactc

SEQ ID NO: 2312137 - DNA, 17 bp, Homo sapiens
tgaccaggccctgctca

SEQ ID NO: 2312138 - DNA, 20 bp, Homo sapiens
tgaccaggctcacaactgtt

SEQ ID NO: 2312139 - DNA, 21 bp, Homo sapiens
tgaccaggctcacaactgttt

SEQ ID NO: 2312140 - DNA, 21 bp, Homo sapiens
tgaccaggctggagtgaagtg

SEQ ID NO: 2312141 - DNA, 19 bp, Homo sapiens
tgaccatcatttcccaggc

SEQ ID NO: 2312142 - DNA, 22 bp, Homo sapiens
tgaccccacacgccggggctgg

SEQ ID NO: 2312143 - DNA, 22 bp, Homo sapiens
tgaccgaagggacggggcccgc

SEQ ID NO: 2312144 - DNA, 19 bp, Homo sapiens
tgacctaaatccattttct

SEQ ID NO: 2312145 - DNA, 18 bp, Homo sapiens
tgacctacttcctcctag

SEQ ID NO: 2312146 - DNA, 21 bp, Homo sapiens
tgacctctctaggtgtgtcca

SEQ ID NO: 2312147 - DNA, 14 bp, Homo sapiens
tgacctgacacctg

SEQ ID NO: 2312148 - DNA, 19 bp, Homo sapiens
tgacctgacacctgccgct

SEQ ID NO: 2312149 - DNA, 16 bp, Homo sapiens
tgacctttcaatagga

SEQ ID NO: 2312150 - DNA, 22 bp, Homo sapiens
tgacctttcaataggaaaaact

SEQ ID NO: 2312151 - DNA, 19 bp, Homo sapiens
tgacgacctacatctgaaa

SEQ ID NO: 2312152 - DNA, 15 bp, Homo sapiens
tgacgcagcccccca

SEQ ID NO: 2312153 - DNA, 20 bp, Homo sapiens
tgactagcaaacaaaaatag

SEQ ID NO: 2312154 - DNA, 22 bp, Homo sapiens
tgactagcaaacaaaaatagaa

SEQ ID NO: 2312155 - DNA, 23 bp, Homo sapiens
tgactccagaatttcccaaagca

SEQ ID NO: 2312156 - DNA, 14 bp, Homo sapiens
tgactctccaggga

SEQ ID NO: 2312157 - DNA, 20 bp, Homo sapiens
tgactctggaaccatcctct

SEQ ID NO: 2312158 - DNA, 21 bp, Homo sapiens
tgactctggaaccatcctctg

SEQ ID NO: 2312159 - DNA, 17 bp, Homo sapiens
tgactcttcttatcaca

SEQ ID NO: 2312160 - DNA, 22 bp, Homo sapiens
tgactcttcttatcacacttgc

SEQ ID NO: 2312161 - DNA, 19 bp, Homo sapiens
tgactggtgcgttcctaaa

SEQ ID NO: 2312162 - DNA, 14 bp, Homo sapiens
tgacttcccagctg

SEQ ID NO: 2312163 - DNA, 15 bp, Homo sapiens
tgactttttttcact

SEQ ID NO: 2312164 - DNA, 16 bp, Homo sapiens
tgagaaaaaaacagca

SEQ ID NO: 2312165 - DNA, 13 bp, Homo sapiens
tgagaaattacag

SEQ ID NO: 2312166 - DNA, 21 bp, Homo sapiens
tgagaaattgtgccaaagata

SEQ ID NO: 2312167 - DNA, 19 bp, Homo sapiens
tgagaagcctcatgggagt

SEQ ID NO: 2312168 - DNA, 19 bp, Homo sapiens
tgagaatcgacctcactgt

SEQ ID NO: 2312169 - DNA, 15 bp, Homo sapiens
tgagacctcccccag

SEQ ID NO: 2312170 - DNA, 13 bp, Homo sapiens
tgagaggaaatca

SEQ ID NO: 2312171 - DNA, 23 bp, Homo sapiens
tgagaggcatccagtatcttgaa

SEQ ID NO: 2312172 - DNA, 13 bp, Homo sapiens
tgagatacaaagc

SEQ ID NO: 2312173 - DNA, 17 bp, Homo sapiens
tgagatacatttgatct

SEQ ID NO: 2312174 - DNA, 19 bp, Homo sapiens
tgagatcagcattcaaaat

SEQ ID NO: 2312175 - DNA, 12 bp, Homo sapiens
tgagattccaga

SEQ ID NO: 2312176 - DNA, 13 bp, Homo sapiens
tgagattgtacat

SEQ ID NO: 2312177 - DNA, 19 bp, Homo sapiens
tgagcaatgtttttctcaa

SEQ ID NO: 2312178 - DNA, 20 bp, Homo sapiens
tgagcaatgtttttctcaaa

SEQ ID NO: 2312179 - DNA, 12 bp, Homo sapiens
tgagcagtgggg

SEQ ID NO: 2312180 - DNA, 17 bp, Homo sapiens
tgagcagtggggagcgg

SEQ ID NO: 2312181 - DNA, 21 bp, Homo sapiens
tgagcagttgttatattcatt

SEQ ID NO: 2312182 - DNA, 22 bp, Homo sapiens
tgagcatacctgtctcagctgt

SEQ ID NO: 2312183 - DNA, 15 bp, Homo sapiens
tgagccacagcactc

SEQ ID NO: 2312184 - DNA, 18 bp, Homo sapiens
tgagccacagcactcggc

SEQ ID NO: 2312185 - DNA, 18 bp, Homo sapiens
tgagccagatttcactct

SEQ ID NO: 2312186 - DNA, 20 bp, Homo sapiens
tgagccagatttcactctcc

SEQ ID NO: 2312187 - DNA, 14 bp, Homo sapiens
tgagcccctcctct

SEQ ID NO: 2312188 - DNA, 17 bp, Homo sapiens
tgagccgatctggtctc

SEQ ID NO: 2312189 - DNA, 21 bp, Homo sapiens
tgagctaccaggaagaggggc

SEQ ID NO: 2312190 - DNA, 13 bp, Homo sapiens
tgagctccaccct

SEQ ID NO: 2312191 - DNA, 23 bp, Homo sapiens
tgagctctgacctgcccccgctc

SEQ ID NO: 2312192 - DNA, 16 bp, Homo sapiens
tgagcttttaccacta

SEQ ID NO: 2312193 - DNA, 15 bp, Homo sapiens
tgaggacctccacct

SEQ ID NO: 2312194 - DNA, 16 bp, Homo sapiens
tgaggacctgcggcct

SEQ ID NO: 2312195 - DNA, 18 bp, Homo sapiens
tgaggacggggcagagct

SEQ ID NO: 2312196 - DNA, 19 bp, Homo sapiens
tgaggacggggcagagctg

SEQ ID NO: 2312197 - DNA, 17 bp, Homo sapiens
tggcccctcccacatcc

SEQ ID NO: 2312198 - DNA, 19 bp, Homo sapiens
tggcccctcccacatcccc

SEQ ID NO: 2312199 - DNA, 20 bp, Homo sapiens
tggcccctcccacatccccc

SEQ ID NO: 2312200 - DNA, 18 bp, Homo sapiens
tggcccgagagctgggac

SEQ ID NO: 2312201 - DNA, 12 bp, Homo sapiens
tggccctgccct

SEQ ID NO: 2312202 - DNA, 16 bp, Homo sapiens
tggccctgccctcccc

SEQ ID NO: 2312203 - DNA, 19 bp, Homo sapiens
tggccctgggccccgcctc

SEQ ID NO: 2312204 - DNA, 23 bp, Homo sapiens
tggccctgggccccgcctcaagg

SEQ ID NO: 2312205 - DNA, 22 bp, Homo sapiens
tggccctgtttctccccacacc

SEQ ID NO: 2312206 - DNA, 12 bp, Homo sapiens
tggccggctggc

SEQ ID NO: 2312207 - DNA, 13 bp, Homo sapiens
tggccggctggcc

SEQ ID NO: 2312208 - DNA, 17 bp, Homo sapiens
tggcctcattcagcaga

SEQ ID NO: 2312209 - DNA, 12 bp, Homo sapiens
tggcctgacaca

SEQ ID NO: 2312210 - DNA, 20 bp, Homo sapiens
tggcctggggctgccgtgca

SEQ ID NO: 2312211 - DNA, 12 bp, Homo sapiens
tggcggcagggg

SEQ ID NO: 2312212 - DNA, 21 bp, Homo sapiens
tggcgggaagggtgggccctg

SEQ ID NO: 2312213 - DNA, 14 bp, Homo sapiens
tggcgggcagcccc

SEQ ID NO: 2312214 - DNA, 16 bp, Homo sapiens
tggcgggcagcccctg

SEQ ID NO: 2312215 - DNA, 17 bp, Homo sapiens
tggctcaacacatgaga

SEQ ID NO: 2312216 - DNA, 13 bp, Homo sapiens
tggctcacacctg

SEQ ID NO: 2312217 - DNA, 15 bp, Homo sapiens
tggctccaggagcag

SEQ ID NO: 2312218 - DNA, 17 bp, Homo sapiens
tggctcgcacccccact

SEQ ID NO: 2312219 - DNA, 17 bp, Homo sapiens
tggctcgggtgcccagg

SEQ ID NO: 2312220 - DNA, 14 bp, Homo sapiens
tggctgctctccat

SEQ ID NO: 2312221 - DNA, 11 bp, Homo sapiens
tggctgcttca

SEQ ID NO: 2312222 - DNA, 15 bp, Homo sapiens
tggctgcttcaagga

SEQ ID NO: 2312223 - DNA, 21 bp, Homo sapiens
tggctgcttcaaggatcctga

SEQ ID NO: 2312224 - DNA, 13 bp, Homo sapiens
tggctgtattttt

SEQ ID NO: 2312225 - DNA, 17 bp, Homo sapiens
tggctgtatttttagag

SEQ ID NO: 2312226 - DNA, 18 bp, Homo sapiens
tggctgtatttttagaga

SEQ ID NO: 2312227 - DNA, 22 bp, Homo sapiens
tggctgtcctcttaagacacta

SEQ ID NO: 2312228 - DNA, 14 bp, Homo sapiens
tggcttcagcccct

SEQ ID NO: 2312229 - DNA, 16 bp, Homo sapiens
tggcttcagcccctgg

SEQ ID NO: 2312230 - DNA, 23 bp, Homo sapiens
tggcttcgaggagataaactgaa

SEQ ID NO: 2312231 - DNA, 23 bp, Homo sapiens
tggcttctctgccctgccctggc

SEQ ID NO: 2312232 - DNA, 16 bp, Homo sapiens
tgggaagaacatgcta

SEQ ID NO: 2312233 - DNA, 21 bp, Homo sapiens
tgggaatgaatgtcagtgtga

SEQ ID NO: 2312234 - DNA, 22 bp, Homo sapiens
tgggaatgaatgtcagtgtgac

SEQ ID NO: 2312235 - DNA, 23 bp, Homo sapiens
tgggaattggaatcaaaagagtt

SEQ ID NO: 2312236 - DNA, 14 bp, Homo sapiens
tgggaatttattta

SEQ ID NO: 2312237 - DNA, 17 bp, Homo sapiens
tgggaatttatttatgt

SEQ ID NO: 2312238 - DNA, 15 bp, Homo sapiens
tgggacacagagacc

SEQ ID NO: 2312239 - DNA, 22 bp, Homo sapiens
tgggaccctcggggcaggaagt

SEQ ID NO: 2312240 - DNA, 19 bp, Homo sapiens
tgggactcagttcttggcc

SEQ ID NO: 2312241 - DNA, 13 bp, Homo sapiens
tgggagaagaggg

SEQ ID NO: 2312242 - DNA, 15 bp, Homo sapiens
tgggagaagaggggt

SEQ ID NO: 2312243 - DNA, 22 bp, Homo sapiens
tgggaggccaaacacccaagca

SEQ ID NO: 2312244 - DNA, 14 bp, Homo sapiens
tgggagggggcagg

SEQ ID NO: 2312245 - DNA, 16 bp, Homo sapiens
tgggagggggcagggg

SEQ ID NO: 2312246 - DNA, 14 bp, Homo sapiens
tgggagtcagggag

SEQ ID NO: 2312247 - DNA, 21 bp, Homo sapiens
tgggagtcagggagccctggg

SEQ ID NO: 2312248 - DNA, 21 bp, Homo sapiens
tgggcacgggagagcgccacc

SEQ ID NO: 2312249 - DNA, 20 bp, Homo sapiens
tgggcagggccgcagggcgc

SEQ ID NO: 2312250 - DNA, 21 bp, Homo sapiens
tgggcagggccgcagggcgct

SEQ ID NO: 2312251 - DNA, 22 bp, Homo sapiens
tgggcagggccgcagggcgctc

SEQ ID NO: 2312252 - DNA, 14 bp, Homo sapiens
tgggccagggtctc

SEQ ID NO: 2312253 - DNA, 20 bp, Homo sapiens
tgggccccacagtggtcagc

SEQ ID NO: 2312254 - DNA, 19 bp, Homo sapiens
tgggccctggaggggccca

SEQ ID NO: 2312255 - DNA, 22 bp, Homo sapiens
tgggccctggaggggcccatgt

SEQ ID NO: 2312256 - DNA, 19 bp, Homo sapiens
tgggccctggttcccccag

SEQ ID NO: 2312257 - DNA, 14 bp, Homo sapiens
tgggctctgggttc

SEQ ID NO: 2312258 - DNA, 12 bp, Homo sapiens
tgggctggagca

SEQ ID NO: 2312259 - DNA, 19 bp, Homo sapiens
tggggactctccaggcacc

SEQ ID NO: 2312260 - DNA, 22 bp, Homo sapiens
tggggactctccaggcaccgcc

SEQ ID NO: 2312261 - DNA, 22 bp, Homo sapiens
tggggagaccgagtgtggagct

SEQ ID NO: 2312262 - DNA, 19 bp, Homo sapiens
tggggaggagactcaggcc

SEQ ID NO: 2312263 - DNA, 21 bp, Homo sapiens
tggggaggagttgtctgtcct

SEQ ID NO: 2312264 - DNA, 23 bp, Homo sapiens
tggggaggagttgtctgtcctgg

SEQ ID NO: 2312265 - DNA, 20 bp, Homo sapiens
tggggagggcctctggacag

SEQ ID NO: 2312266 - DNA, 20 bp, Homo sapiens
tggggatggggttgggctct

SEQ ID NO: 2312267 - DNA, 14 bp, Homo sapiens
tggggccagcccct

SEQ ID NO: 2312268 - DNA, 23 bp, Homo sapiens
tggggccagcccctccccgcctc

SEQ ID NO: 2312269 - DNA, 17 bp, Homo sapiens
tggggcccatggcccca

SEQ ID NO: 2312270 - DNA, 18 bp, Homo sapiens
tgggggaggcttccagct

SEQ ID NO: 2312271 - DNA, 16 bp, Homo sapiens
tgggggctcctggcag

SEQ ID NO: 2312272 - DNA, 17 bp, Homo sapiens
tgggggctcctggcagt

SEQ ID NO: 2312273 - DNA, 19 bp, Homo sapiens
tgggggctcctggcagtga

SEQ ID NO: 2312274 - DNA, 11 bp, Homo sapiens
tggggggagaa

SEQ ID NO: 2312275 - DNA, 17 bp, Homo sapiens
tgggggtatcctgtgca

SEQ ID NO: 2312276 - DNA, 18 bp, Homo sapiens
tgggggtatcctgtgcat

SEQ ID NO: 2312277 - DNA, 17 bp, Homo sapiens
tgggggtggccactcct

SEQ ID NO: 2312278 - DNA, 23 bp, Homo sapiens
tggggtctattttataagggcac

SEQ ID NO: 2312279 - DNA, 19 bp, Homo sapiens
tggggtgggagggggcagg

SEQ ID NO: 2312280 - DNA, 17 bp, Homo sapiens
tggggttgggctctgcg

SEQ ID NO: 2312281 - DNA, 18 bp, Homo sapiens
tggggtttccacacaggc

SEQ ID NO: 2312282 - DNA, 14 bp, Homo sapiens
tgggtcgcccctcc

SEQ ID NO: 2312283 - DNA, 22 bp, Homo sapiens
tgggtgggccccacagtggtca

SEQ ID NO: 2312284 - DNA, 21 bp, Homo sapiens
tgggttgttgcagagtaaatc

SEQ ID NO: 2312285 - DNA, 18 bp, Homo sapiens
tggtaaaggtatgtaaac

SEQ ID NO: 2312286 - DNA, 13 bp, Homo sapiens
tggtaatgtgtca

SEQ ID NO: 2312287 - DNA, 16 bp, Homo sapiens
tggtagagttcctttc

SEQ ID NO: 2312288 - DNA, 21 bp, Homo sapiens
tggtattatcaaagcattgct

SEQ ID NO: 2312289 - DNA, 17 bp, Homo sapiens
tggtattttcgtgcatt

SEQ ID NO: 2312290 - DNA, 22 bp, Homo sapiens
tggtattttggcattttggctc

SEQ ID NO: 2312291 - DNA, 13 bp, Homo sapiens
tggtcacagaccc

SEQ ID NO: 2312292 - DNA, 20 bp, Homo sapiens
tggtcacagacccctggggg

SEQ ID NO: 2312293 - DNA, 23 bp, Homo sapiens
tggtcatgaatagaaaaaaaaca

SEQ ID NO: 2312294 - DNA, 18 bp, Homo sapiens
tggtcatgggtctgccct

SEQ ID NO: 2312295 - DNA, 21 bp, Homo sapiens
tggtcatgggtctgcccttga

SEQ ID NO: 2312296 - DNA, 15 bp, Homo sapiens
tggtccacattctgc

SEQ ID NO: 2312297 - DNA, 17 bp, Homo sapiens
tggtccacattctgctg

SEQ ID NO: 2312298 - DNA, 19 bp, Homo sapiens
tggtctcgtgttcgctggc

SEQ ID NO: 2312299 - DNA, 22 bp, Homo sapiens
tggtctcgtgttcgctggctga

SEQ ID NO: 2312300 - DNA, 22 bp, Homo sapiens
tggtgaggacctgcggccttgg

SEQ ID NO: 2312301 - DNA, 20 bp, Homo sapiens
tggtgcaatgacctttcaat

SEQ ID NO: 2312302 - DNA, 16 bp, Homo sapiens
tggtggtgcacacctg

SEQ ID NO: 2312303 - DNA, 18 bp, Homo sapiens
tggtgtcgggcatgacac

SEQ ID NO: 2312304 - DNA, 18 bp, Homo sapiens
tggtgtgatcccagctca

SEQ ID NO: 2312305 - DNA, 21 bp, Homo sapiens
tggtgttctcaatgcttttct

SEQ ID NO: 2312306 - DNA, 16 bp, Homo sapiens
tggtttgcatgacttt

SEQ ID NO: 2312307 - DNA, 18 bp, Homo sapiens
tgtaaaaatagcaaaata

SEQ ID NO: 2312308 - DNA, 20 bp, Homo sapiens
tgtaaacagaagcctgtttc

SEQ ID NO: 2312309 - DNA, 15 bp, Homo sapiens
tgtaaacatcataaa

SEQ ID NO: 2312310 - DNA, 19 bp, Homo sapiens
tgtaaatgttatttctgca

SEQ ID NO: 2312311 - DNA, 19 bp, Homo sapiens
tgtaacatgtctaaagtta

SEQ ID NO: 2312312 - DNA, 17 bp, Homo sapiens
tgtaactgttctttgca

SEQ ID NO: 2312313 - DNA, 19 bp, Homo sapiens
tgtaactgttctttgcagt

SEQ ID NO: 2312314 - DNA, 15 bp, Homo sapiens
tgtaagaggatgtgg

SEQ ID NO: 2312315 - DNA, 20 bp, Homo sapiens
tgtaagaggtactaaaaaca

SEQ ID NO: 2312316 - DNA, 13 bp, Homo sapiens
tgtaaggaatgat

SEQ ID NO: 2312317 - DNA, 18 bp, Homo sapiens
tgtaaggaatgattaatt

SEQ ID NO: 2312318 - DNA, 16 bp, Homo sapiens
tgtaagggctttaaat

SEQ ID NO: 2312319 - DNA, 23 bp, Homo sapiens
tgtaagggctttaaataaaagag

SEQ ID NO: 2312320 - DNA, 18 bp, Homo sapiens
tgtaatagtggctttcat

SEQ ID NO: 2312321 - DNA, 19 bp, Homo sapiens
tgtaatagtggctttcatt

SEQ ID NO: 2312322 - DNA, 22 bp, Homo sapiens
tgtaatagtggctttcatttct

SEQ ID NO: 2312323 - DNA, 23 bp, Homo sapiens
tgtaatagtggctttcatttctt

SEQ ID NO: 2312324 - DNA, 17 bp, Homo sapiens
tgtaatattttgtatta

SEQ ID NO: 2312325 - DNA, 23 bp, Homo sapiens
tgtaatattttgtattattgctg

SEQ ID NO: 2312326 - DNA, 19 bp, Homo sapiens
tgtaatctctgattaaatt

SEQ ID NO: 2312327 - DNA, 14 bp, Homo sapiens
tgtaatgcactcct

SEQ ID NO: 2312328 - DNA, 20 bp, Homo sapiens
tgtgccaaagatagcagaag

SEQ ID NO: 2312329 - DNA, 17 bp, Homo sapiens
tgtgcccatggcttctg

SEQ ID NO: 2312330 - DNA, 19 bp, Homo sapiens
tgtgccccgaccccacctg

SEQ ID NO: 2312331 - DNA, 21 bp, Homo sapiens
tgtgctccagtgttttcttgt

SEQ ID NO: 2312332 - DNA, 13 bp, Homo sapiens
tgtgctctcctag

SEQ ID NO: 2312333 - DNA, 21 bp, Homo sapiens
tgtgctcttatccccagctgt

SEQ ID NO: 2312334 - DNA, 12 bp, Homo sapiens
tgtgctttcatg

SEQ ID NO: 2312335 - DNA, 13 bp, Homo sapiens
tgtgctttcatgt

SEQ ID NO: 2312336 - DNA, 18 bp, Homo sapiens
tgtgcttttccatctaaa

SEQ ID NO: 2312337 - DNA, 20 bp, Homo sapiens
tgtgcttttccatctaaaat

SEQ ID NO: 2312338 - DNA, 14 bp, Homo sapiens
tgtggaaatatgca

SEQ ID NO: 2312339 - DNA, 17 bp, Homo sapiens
tgtggagctgcttccag

SEQ ID NO: 2312340 - DNA, 17 bp, Homo sapiens
tgtggagttcatcttga

SEQ ID NO: 2312341 - DNA, 21 bp, Homo sapiens
tgtggagttcatcttgaattg

SEQ ID NO: 2312342 - DNA, 18 bp, Homo sapiens
tgtggcctcattcagcag

SEQ ID NO: 2312343 - DNA, 22 bp, Homo sapiens
tgtggcgggaagggtgggccct

SEQ ID NO: 2312344 - DNA, 17 bp, Homo sapiens
tgtggctcattcttttc

SEQ ID NO: 2312345 - DNA, 17 bp, Homo sapiens
tgtggctccaggagcag

SEQ ID NO: 2312346 - DNA, 20 bp, Homo sapiens
tgtggctgatttcaaatgca

SEQ ID NO: 2312347 - DNA, 18 bp, Homo sapiens
tgtgggctgaaggatggg

SEQ ID NO: 2312348 - DNA, 14 bp, Homo sapiens
tgtggggagctggt

SEQ ID NO: 2312349 - DNA, 12 bp, Homo sapiens
tgtggggccaca

SEQ ID NO: 2312350 - DNA, 13 bp, Homo sapiens
tgtggggccacac

SEQ ID NO: 2312351 - DNA, 16 bp, Homo sapiens
tgtggtgcagtaacca

SEQ ID NO: 2312352 - DNA, 20 bp, Homo sapiens
tgtgtaactgttctttgcag

SEQ ID NO: 2312353 - DNA, 21 bp, Homo sapiens
tgtgtaactgttctttgcagt

SEQ ID NO: 2312354 - DNA, 17 bp, Homo sapiens
tgtgtactgtatagaca

SEQ ID NO: 2312355 - DNA, 21 bp, Homo sapiens
tgtgtactgtatagacagttt

SEQ ID NO: 2312356 - DNA, 18 bp, Homo sapiens
tgtgtagatattatgtat

SEQ ID NO: 2312357 - DNA, 16 bp, Homo sapiens
tgtgtccataagagaa

SEQ ID NO: 2312358 - DNA, 16 bp, Homo sapiens
tgtgtccatgtgaaat

SEQ ID NO: 2312359 - DNA, 20 bp, Homo sapiens
tgtgtggctcattcttttca

SEQ ID NO: 2312360 - DNA, 22 bp, Homo sapiens
tgtgtgtccagcacctttgtaa

SEQ ID NO: 2312361 - DNA, 19 bp, Homo sapiens
tgtgtgtttattgtcaaag

SEQ ID NO: 2312362 - DNA, 16 bp, Homo sapiens
tgtgttaaatttagtg

SEQ ID NO: 2312363 - DNA, 13 bp, Homo sapiens
tgtgttcttaaaa

SEQ ID NO: 2312364 - DNA, 19 bp, Homo sapiens
tgtgttgcaaattattcta

SEQ ID NO: 2312365 - DNA, 23 bp, Homo sapiens
tgtgttgcccaggctggtcttga

SEQ ID NO: 2312366 - DNA, 15 bp, Homo sapiens
tgtgttgttttctct

SEQ ID NO: 2312367 - DNA, 16 bp, Homo sapiens
tgtgttgttttctctg

SEQ ID NO: 2312368 - DNA, 16 bp, Homo sapiens
tgtgtttattgtcaaa

SEQ ID NO: 2312369 - DNA, 22 bp, Homo sapiens
tgttaaagaggcgtcttgtatt

SEQ ID NO: 2312370 - DNA, 14 bp, Homo sapiens
tgttaaatttagtg

SEQ ID NO: 2312371 - DNA, 17 bp, Homo sapiens
tgttaatataactgtct

SEQ ID NO: 2312372 - DNA, 17 bp, Homo sapiens
tgttacaggtgtactat

SEQ ID NO: 2312373 - DNA, 22 bp, Homo sapiens
tgttacccgcagatcctgtccc

SEQ ID NO: 2312374 - DNA, 20 bp, Homo sapiens
tgttagattaggtgtaagac

SEQ ID NO: 2312375 - DNA, 22 bp, Homo sapiens
tgttagcattattgccaaataa

SEQ ID NO: 2312376 - DNA, 14 bp, Homo sapiens
tgttatgtaaacat

SEQ ID NO: 2312377 - DNA, 16 bp, Homo sapiens
tgttcaagtcattcca

SEQ ID NO: 2312378 - DNA, 22 bp, Homo sapiens
tgttccacttctctagagaaca

SEQ ID NO: 2312379 - DNA, 14 bp, Homo sapiens
tgttcccccagggg

SEQ ID NO: 2312380 - DNA, 22 bp, Homo sapiens
tgttctaaaatgtcaaggcagt

SEQ ID NO: 2312381 - DNA, 19 bp, Homo sapiens
tgttctagttagcaggaaa

SEQ ID NO: 2312382 - DNA, 11 bp, Homo sapiens
tgttcttaaaa

SEQ ID NO: 2312383 - DNA, 15 bp, Homo sapiens
tgttcttaaaatatt

SEQ ID NO: 2312384 - DNA, 19 bp, Homo sapiens
tgttctttcacccttttct

SEQ ID NO: 2312385 - DNA, 19 bp, Homo sapiens
tgttctttttaaaaagttg

SEQ ID NO: 2312386 - DNA, 20 bp, Homo sapiens
tgttgatcagatcttacaag

SEQ ID NO: 2312387 - DNA, 20 bp, Homo sapiens
tgttgatttctttccttccc

SEQ ID NO: 2312388 - DNA, 16 bp, Homo sapiens
tgttgcaaattattct

SEQ ID NO: 2312389 - DNA, 19 bp, Homo sapiens
tgttgcagttaattcttgc

SEQ ID NO: 2312390 - DNA, 21 bp, Homo sapiens
tgttgccaggagatggaatat

SEQ ID NO: 2312391 - DNA, 14 bp, Homo sapiens
tgttgcccaggctg

SEQ ID NO: 2312392 - DNA, 23 bp, Homo sapiens
tgttggataataactagatctcc

SEQ ID NO: 2312393 - DNA, 21 bp, Homo sapiens
tgttggcacagaacaggaggt

SEQ ID NO: 2312394 - DNA, 21 bp, Homo sapiens
tgttgggaaagataaaactct

SEQ ID NO: 2312395 - DNA, 18 bp, Homo sapiens
tgttgggtggaggatgga

SEQ ID NO: 2312396 - DNA, 19 bp, Homo sapiens
tgttgtaccatatgtagca

SEQ ID NO: 2312397 - DNA, 20 bp, Homo sapiens
tgttgtaccatatgtagcat

SEQ ID NO: 2312398 - DNA, 14 bp, Homo sapiens
tgttgttaaatgct

SEQ ID NO: 2312399 - DNA, 16 bp, Homo sapiens
tgttgttaaatgctat

SEQ ID NO: 2312400 - DNA, 13 bp, Homo sapiens
tgttgttttctct

SEQ ID NO: 2312401 - DNA, 15 bp, Homo sapiens
tgtttacattttctt

SEQ ID NO: 2312402 - DNA, 20 bp, Homo sapiens
tgtttacattttctttcata

SEQ ID NO: 2312403 - DNA, 19 bp, Homo sapiens
tgtttccaggcatgaccct

SEQ ID NO: 2312404 - DNA, 23 bp, Homo sapiens
tgtttccaggcatgaccctggag

SEQ ID NO: 2312405 - DNA, 14 bp, Homo sapiens
tgtttccagggtct

SEQ ID NO: 2312406 - DNA, 20 bp, Homo sapiens
tgtttcccgctccaagagaa

SEQ ID NO: 2312407 - DNA, 12 bp, Homo sapiens
tgtttcctgtgg

SEQ ID NO: 2312408 - DNA, 17 bp, Homo sapiens
tgtttcctgtggaaata

SEQ ID NO: 2312409 - DNA, 18 bp, Homo sapiens
tgtttcctgtggaaatat

SEQ ID NO: 2312410 - DNA, 16 bp, Homo sapiens
tgtttctatactgttt

SEQ ID NO: 2312411 - DNA, 22 bp, Homo sapiens
tgtttctatactgtttgtaata

SEQ ID NO: 2312412 - DNA, 14 bp, Homo sapiens
tgtttcttgcttgt

SEQ ID NO: 2312413 - DNA, 22 bp, Homo sapiens
tgtttgagtttctggctgaaaa

SEQ ID NO: 2312414 - DNA, 17 bp, Homo sapiens
tgttttagagataaata

SEQ ID NO: 2312415 - DNA, 19 bp, Homo sapiens
tgttttagagataaatatt

SEQ ID NO: 2312416 - DNA, 14 bp, Homo sapiens
tgttttatgtcata

SEQ ID NO: 2312417 - DNA, 18 bp, Homo sapiens
tgttttatgtcatactct

SEQ ID NO: 2312418 - DNA, 17 bp, Homo sapiens
tgttttggctgctctcc

SEQ ID NO: 2312419 - DNA, 19 bp, Homo sapiens
tgttttgggtagctgccac

SEQ ID NO: 2312420 - DNA, 23 bp, Homo sapiens
tgtttttctcaaaaagctgctat

SEQ ID NO: 2312421 - DNA, 14 bp, Homo sapiens
tgtttttgaagaag

SEQ ID NO: 2312422 - DNA, 18 bp, Homo sapiens
ttaaaaaaaatattctgt

SEQ ID NO: 2312423 - DNA, 19 bp, Homo sapiens
ttaaaaaaaatattctgtc

SEQ ID NO: 2312424 - DNA, 19 bp, Homo sapiens
ttaaaaaaataacatctga

SEQ ID NO: 2312425 - DNA, 19 bp, Homo sapiens
ttaaaaaataacatattct

SEQ ID NO: 2312426 - DNA, 14 bp, Homo sapiens
ttaaaaagcccaac

SEQ ID NO: 2312427 - DNA, 14 bp, Homo sapiens
ttaaaaatctttca

SEQ ID NO: 2312428 - DNA, 13 bp, Homo sapiens
ttaaaacatatgg

SEQ ID NO: 2312429 - DNA, 20 bp, Homo sapiens
ttaaaactgcagttttcaga

SEQ ID NO: 2312430 - DNA, 14 bp, Homo sapiens
ttaaaagctttaga

SEQ ID NO: 2312431 - DNA, 16 bp, Homo sapiens
ttaaaagctttagatt

SEQ ID NO: 2312432 - DNA, 13 bp, Homo sapiens
ttaaaatcaactt

SEQ ID NO: 2312433 - DNA, 13 bp, Homo sapiens
ttaaaattagtga

SEQ ID NO: 2312434 - DNA, 17 bp, Homo sapiens
ttaaaattagtgagatt

SEQ ID NO: 2312435 - DNA, 14 bp, Homo sapiens
ttaaagaatttgaa

SEQ ID NO: 2312436 - DNA, 15 bp, Homo sapiens
ttaaagagacaaata

SEQ ID NO: 2312437 - DNA, 18 bp, Homo sapiens
ttaaataaaagaggtcca

SEQ ID NO: 2312438 - DNA, 19 bp, Homo sapiens
ttaaatagtttacttcact

SEQ ID NO: 2312439 - DNA, 19 bp, Homo sapiens
ttaaatcagactagagaat

SEQ ID NO: 2312440 - DNA, 21 bp, Homo sapiens
ttaacagatgatccatttgaa

SEQ ID NO: 2312441 - DNA, 20 bp, Homo sapiens
ttaacataaacttgtactta

SEQ ID NO: 2312442 - DNA, 13 bp, Homo sapiens
ttaacccagtgtt

SEQ ID NO: 2312443 - DNA, 15 bp, Homo sapiens
ttaacctttcaggaa

SEQ ID NO: 2312444 - DNA, 17 bp, Homo sapiens
ttaactgtccagtccag

SEQ ID NO: 2312445 - DNA, 14 bp, Homo sapiens
ttaagaaatgagaa

SEQ ID NO: 2312446 - DNA, 23 bp, Homo sapiens
ttaagaaatgagaaattgtgcca

SEQ ID NO: 2312447 - DNA, 15 bp, Homo sapiens
ttaagaaatgtagtt

SEQ ID NO: 2312448 - DNA, 20 bp, Homo sapiens
ttaagaatagaaaactgggt

SEQ ID NO: 2312449 - DNA, 23 bp, Homo sapiens
ttaagatgctaatagaaaactgt

SEQ ID NO: 2312450 - DNA, 22 bp, Homo sapiens
ttaagcattttactgtctgtaa

SEQ ID NO: 2312451 - DNA, 15 bp, Homo sapiens
ttaaggaagaataaa

SEQ ID NO: 2312452 - DNA, 13 bp, Homo sapiens
ttaagggcagagt

SEQ ID NO: 2312453 - DNA, 21 bp, Homo sapiens
ttaatacttccttataaaaat

SEQ ID NO: 2312454 - DNA, 21 bp, Homo sapiens
ttaatatactaaccatttctt

SEQ ID NO: 2312455 - DNA, 13 bp, Homo sapiens
ttaatatgtactt

SEQ ID NO: 2312456 - DNA, 17 bp, Homo sapiens
ttaatatgtacttttcc

SEQ ID NO: 2312457 - DNA, 16 bp, Homo sapiens
ttaatcatatcaactt

SEQ ID NO: 2312458 - DNA, 16 bp, Homo sapiens
ttaatcatgggttcct

SEQ ID NO: 2312459 - DNA, 14 bp, Homo sapiens
ttaatctctaaaat

SEQ ID NO: 2312460 - DNA, 14 bp, Homo sapiens
tttaaaaaataaca

SEQ ID NO: 2312461 - DNA, 21 bp, Homo sapiens
tttaaaaaataacatattctt

SEQ ID NO: 2312462 - DNA, 18 bp, Homo sapiens
tttaaaaaataatttaga

SEQ ID NO: 2312463 - DNA, 13 bp, Homo sapiens
tttaaaaaggtgc

SEQ ID NO: 2312464 - DNA, 13 bp, Homo sapiens
tttaaaaatattc

SEQ ID NO: 2312465 - DNA, 15 bp, Homo sapiens
tttaaaatagttttc

SEQ ID NO: 2312466 - DNA, 14 bp, Homo sapiens
tttaaaatcaactt

SEQ ID NO: 2312467 - DNA, 18 bp, Homo sapiens
tttaaatagtttacttca

SEQ ID NO: 2312468 - DNA, 20 bp, Homo sapiens
tttaaatagtttacttcact

SEQ ID NO: 2312469 - DNA, 13 bp, Homo sapiens
tttaaatcatttc

SEQ ID NO: 2312470 - DNA, 15 bp, Homo sapiens
tttaaatgtgcttca

SEQ ID NO: 2312471 - DNA, 12 bp, Homo sapiens
tttaacagacat

SEQ ID NO: 2312472 - DNA, 14 bp, Homo sapiens
tttaacagatattt

SEQ ID NO: 2312473 - DNA, 19 bp, Homo sapiens
tttaacattttgtttccaa

SEQ ID NO: 2312474 - DNA, 15 bp, Homo sapiens
tttaacggactgctt

SEQ ID NO: 2312475 - DNA, 17 bp, Homo sapiens
tttaagaaatgagaaat

SEQ ID NO: 2312476 - DNA, 21 bp, Homo sapiens
tttaagcattttactgtctgt

SEQ ID NO: 2312477 - DNA, 22 bp, Homo sapiens
tttaatatactaaccatttctt

SEQ ID NO: 2312478 - DNA, 12 bp, Homo sapiens
tttaattcagtt

SEQ ID NO: 2312479 - DNA, 22 bp, Homo sapiens
tttacaacttccagatttgagc

SEQ ID NO: 2312480 - DNA, 20 bp, Homo sapiens
tttacactatataaatggtt

SEQ ID NO: 2312481 - DNA, 13 bp, Homo sapiens
tttacattttctt

SEQ ID NO: 2312482 - DNA, 21 bp, Homo sapiens
tttactacataattaaatttt

SEQ ID NO: 2312483 - DNA, 22 bp, Homo sapiens
tttactacataattaaatttta

SEQ ID NO: 2312484 - DNA, 22 bp, Homo sapiens
tttactcacattctgttgttca

SEQ ID NO: 2312485 - DNA, 14 bp, Homo sapiens
tttactgtctgtaa

SEQ ID NO: 2312486 - DNA, 13 bp, Homo sapiens
tttacttcacttt

SEQ ID NO: 2312487 - DNA, 18 bp, Homo sapiens
tttagaacctgcatttaa

SEQ ID NO: 2312488 - DNA, 19 bp, Homo sapiens
tttagaacctgcatttaag

SEQ ID NO: 2312489 - DNA, 18 bp, Homo sapiens
tttagagattaatttgtg

SEQ ID NO: 2312490 - DNA, 15 bp, Homo sapiens
tttagccagaatgtt

SEQ ID NO: 2312491 - DNA, 24 bp, Homo sapiens
tttagtgcaagctttaacagacta

SEQ ID NO: 2312492 - DNA, 21 bp, Homo sapiens
tttataaaccataaaataaat

SEQ ID NO: 2312493 - DNA, 13 bp, Homo sapiens
tttataagacaaa

SEQ ID NO: 2312494 - DNA, 13 bp, Homo sapiens
tttataagggcac

SEQ ID NO: 2312495 - DNA, 19 bp, Homo sapiens
tttatactgtagcaatata

SEQ ID NO: 2312496 - DNA, 16 bp, Homo sapiens
tttatatctgtaaatt

SEQ ID NO: 2312497 - DNA, 22 bp, Homo sapiens
tttatattcagagatgtaccat

SEQ ID NO: 2312498 - DNA, 22 bp, Homo sapiens
tttatctgtgaatcctttgtac

SEQ ID NO: 2312499 - DNA, 22 bp, Homo sapiens
tttatctgtgttgtctctctaa

SEQ ID NO: 2312500 - DNA, 24 bp, Homo sapiens
tttatgtagaggctttatgttgca

SEQ ID NO: 2312501 - DNA, 22 bp, Homo sapiens
tttattaccgataaatgaacat

SEQ ID NO: 2312502 - DNA, 20 bp, Homo sapiens
tttcaaaatgttaacaactt

SEQ ID NO: 2312503 - DNA, 23 bp, Homo sapiens
tttcaaaccagtttcacataagt

SEQ ID NO: 2312504 - DNA, 16 bp, Homo sapiens
tttcaaagaaaacaga

SEQ ID NO: 2312505 - DNA, 21 bp, Homo sapiens
tttcaacatatgaattggggg

SEQ ID NO: 2312506 - DNA, 22 bp, Homo sapiens
tttcaataaagaaaaaaatagt

SEQ ID NO: 2312507 - DNA, 22 bp, Homo sapiens
tttcaataagtgttgtaccata

SEQ ID NO: 2312508 - DNA, 19 bp, Homo sapiens
tttcaataggaaaaactga

SEQ ID NO: 2312509 - DNA, 20 bp, Homo sapiens
tttcaataggaaaaactgat

SEQ ID NO: 2312510 - DNA, 22 bp, Homo sapiens
tttcaataggaaaaactgattt

SEQ ID NO: 2312511 - DNA, 19 bp, Homo sapiens
tttcacataagttatttgt

SEQ ID NO: 2312512 - DNA, 18 bp, Homo sapiens
tttcacatatttgtagct

SEQ ID NO: 2312513 - DNA, 16 bp, Homo sapiens
tttcacatctctgtag

SEQ ID NO: 2312514 - DNA, 13 bp, Homo sapiens
tttcacatctgta

SEQ ID NO: 2312515 - DNA, 16 bp, Homo sapiens
tttcacctgaaacact

SEQ ID NO: 2312516 - DNA, 20 bp, Homo sapiens
tttcagcatggtttgcatga

SEQ ID NO: 2312517 - DNA, 16 bp, Homo sapiens
tttcagcttgtttcta

SEQ ID NO: 2312518 - DNA, 17 bp, Homo sapiens
tttcagcttgtttctat

SEQ ID NO: 2312519 - DNA, 18 bp, Homo sapiens
tttcagcttgtttctata

SEQ ID NO: 2312520 - DNA, 19 bp, Homo sapiens
tttcagcttgtttctatac

SEQ ID NO: 2312521 - DNA, 22 bp, Homo sapiens
tttcagcttgtttctatactgt

SEQ ID NO: 2312522 - DNA, 13 bp, Homo sapiens
tttcataattcat

SEQ ID NO: 2312523 - DNA, 17 bp, Homo sapiens
tttcataattcatttaa

SEQ ID NO: 2312524 - DNA, 20 bp, Homo sapiens
tttcatccaccaatatcatg

SEQ ID NO: 2312525 - DNA, 15 bp, Homo sapiens
tttcatctgagcttt

SEQ ID NO: 2312526 - DNA, 22 bp, Homo sapiens
tttcatgtagccagcagaactg

SEQ ID NO: 2312527 - DNA, 15 bp, Homo sapiens
tttcattattttccc

SEQ ID NO: 2312528 - DNA, 16 bp, Homo sapiens
tttcattattttccca

SEQ ID NO: 2312529 - DNA, 15 bp, Homo sapiens
tttcatttatactgt

SEQ ID NO: 2312530 - DNA, 20 bp, Homo sapiens
tttcatttatactgtagcaa

SEQ ID NO: 2312531 - DNA, 22 bp, Homo sapiens
tttccaaatattctaaaaaaga

SEQ ID NO: 2312532 - DNA, 22 bp, Homo sapiens
tttccaacattatcctgtgtga

SEQ ID NO: 2312533 - DNA, 18 bp, Homo sapiens
tttccacgtaagtcactg

SEQ ID NO: 2312534 - DNA, 12 bp, Homo sapiens
tttcctgtggaa

SEQ ID NO: 2312535 - DNA, 13 bp, Homo sapiens
tttccttattttc

SEQ ID NO: 2312536 - DNA, 22 bp, Homo sapiens
tttccttcagtgccttatggaa

SEQ ID NO: 2312537 - DNA, 13 bp, Homo sapiens
tttccttcccaat

SEQ ID NO: 2312538 - DNA, 21 bp, Homo sapiens
tttcctttgacctctcacttt

SEQ ID NO: 2312539 - DNA, 15 bp, Homo sapiens
tttctaaatgtttct

SEQ ID NO: 2312540 - DNA, 17 bp, Homo sapiens
tttctaaatttgataat

SEQ ID NO: 2312541 - DNA, 13 bp, Homo sapiens
tttctaatttcaa

SEQ ID NO: 2312542 - DNA, 18 bp, Homo sapiens
tttctagctataacaact

SEQ ID NO: 2312543 - DNA, 14 bp, Homo sapiens
tttctatactgttt

SEQ ID NO: 2312544 - DNA, 17 bp, Homo sapiens
tttctatctgcaaatag

SEQ ID NO: 2312545 - DNA, 15 bp, Homo sapiens
tttctcatgcataga

SEQ ID NO: 2312546 - DNA, 14 bp, Homo sapiens
tttctccaaagctt

SEQ ID NO: 2312547 - DNA, 15 bp, Homo sapiens
tttctccatgtctgt

SEQ ID NO: 2312548 - DNA, 16 bp, Homo sapiens
tttctcgagtccaaaa

SEQ ID NO: 2312549 - DNA, 21 bp, Homo sapiens
tttctcgagtccaaaatcatt

SEQ ID NO: 2312550 - DNA, 17 bp, Homo sapiens
tttctcgtactttcaca

SEQ ID NO: 2312551 - DNA, 18 bp, Homo sapiens
tttctcgtactttcacat

SEQ ID NO: 2312552 - DNA, 22 bp, Homo sapiens
tttctgaattcataaaaataac

SEQ ID NO: 2312553 - DNA, 20 bp, Homo sapiens
tttctgaggtttagcgtttt

SEQ ID NO: 2312554 - DNA, 14 bp, Homo sapiens
tttctgcaaacaaa

SEQ ID NO: 2312555 - DNA, 19 bp, Homo sapiens
tttctgcaaacaaacacct

SEQ ID NO: 2312556 - DNA, 21 bp, Homo sapiens
tttctgcagccactattgtta

SEQ ID NO: 2312557 - DNA, 17 bp, Homo sapiens
tttctgcagtattctgt

SEQ ID NO: 2312558 - DNA, 18 bp, Homo sapiens
tttctgcagtattctgta

SEQ ID NO: 2312559 - DNA, 20 bp, Homo sapiens
tttcttacagtaactgagtg

SEQ ID NO: 2312560 - DNA, 12 bp, Homo sapiens
tttcttcccatt

SEQ ID NO: 2312561 - DNA, 23 bp, Homo sapiens
tttcttgctttgaatgcatgtgt

SEQ ID NO: 2312562 - DNA, 19 bp, Homo sapiens
tttcttgtgtgtttattgt

SEQ ID NO: 2312563 - DNA, 13 bp, Homo sapiens
tttcttgtgttgt

SEQ ID NO: 2312564 - DNA, 13 bp, Homo sapiens
tttcttgtttctc

SEQ ID NO: 2312565 - DNA, 17 bp, Homo sapiens
tttctttaatcaaaagt

SEQ ID NO: 2312566 - DNA, 21 bp, Homo sapiens
tttgaacagttggctgtatga

SEQ ID NO: 2312567 - DNA, 21 bp, Homo sapiens
tttgaagaagggaaattcaca

SEQ ID NO: 2312568 - DNA, 21 bp, Homo sapiens
tttgacctctcacttttttat

SEQ ID NO: 2312569 - DNA, 16 bp, Homo sapiens
tttgatatacagacct

SEQ ID NO: 2312570 - DNA, 18 bp, Homo sapiens
tttgatttgatatacaga

SEQ ID NO: 2312571 - DNA, 17 bp, Homo sapiens
tttgcaaacaaaatgat

SEQ ID NO: 2312572 - DNA, 22 bp, Homo sapiens
tttgcaagctctggaattgttg

SEQ ID NO: 2312573 - DNA, 21 bp, Homo sapiens
tttgcactaggaagaatcagt

SEQ ID NO: 2312574 - DNA, 22 bp, Homo sapiens
tttgcagacatattttcttaca

SEQ ID NO: 2312575 - DNA, 13 bp, Homo sapiens
tttgcatttctct

SEQ ID NO: 2312576 - DNA, 22 bp, Homo sapiens
tttggggacagattcagtcttg

SEQ ID NO: 2312577 - DNA, 22 bp, Homo sapiens
tttggggcagggggttctggga

SEQ ID NO: 2312578 - DNA, 17 bp, Homo sapiens
tttggtaatgtgtcaaa

SEQ ID NO: 2312579 - DNA, 16 bp, Homo sapiens
tttggtatggtaaaga

SEQ ID NO: 2312580 - DNA, 23 bp, Homo sapiens
tttggttcctaaagaaaaagata

SEQ ID NO: 2312581 - DNA, 20 bp, Homo sapiens
tttgtaaatatgacagaatt

SEQ ID NO: 2312582 - DNA, 20 bp, Homo sapiens
tttgtaaatgttatttctgc

SEQ ID NO: 2312583 - DNA, 14 bp, Homo sapiens
tttgtaatatacag

SEQ ID NO: 2312584 - DNA, 15 bp, Homo sapiens
tttgtaatgtatctt

SEQ ID NO: 2312585 - DNA, 20 bp, Homo sapiens
tttgtaggtatactatgtaa

SEQ ID NO: 2312586 - DNA, 17 bp, Homo sapiens
tttgtagtagttgatga

SEQ ID NO: 2312587 - DNA, 14 bp, Homo sapiens
tttgtattattgct

SEQ ID NO: 2312588 - DNA, 15 bp, Homo sapiens
tttgtattattgctg

SEQ ID NO: 2312589 - DNA, 12 bp, Homo sapiens
tttgtctcagat

SEQ ID NO: 2312590 - DNA, 22 bp, Homo sapiens
tttgtctgatagagtttaacag

SEQ ID NO: 2312591 - DNA, 20 bp, Homo sapiens
cttctggggcaggctgggcc

SEQ ID NO: 2312592 - DNA, 22 bp, Homo sapiens
cttctggggcaggctgggccat

SEQ ID NO: 2312593 - DNA, 22 bp, Homo sapiens
cttctgtatttttttttctaag

SEQ ID NO: 2312594 - DNA, 15 bp, Homo sapiens
cttctgtgatgagct

SEQ ID NO: 2312595 - DNA, 16 bp, Homo sapiens
cttctgtgatgagctg

SEQ ID NO: 2312596 - DNA, 19 bp, Homo sapiens
cttctgtgatgagctgatc

SEQ ID NO: 2312597 - DNA, 13 bp, Homo sapiens
cttcttcctattg

SEQ ID NO: 2312598 - DNA, 18 bp, Homo sapiens
ctttaacatacaagaaaa

SEQ ID NO: 2312599 - DNA, 21 bp, Homo sapiens
ctttaacatacaagaaaatgt

SEQ ID NO: 2312600 - DNA, 12 bp, Homo sapiens
ctttaagccata

SEQ ID NO: 2312601 - DNA, 19 bp, Homo sapiens
ctttaagccatagaccctg

SEQ ID NO: 2312602 - DNA, 23 bp, Homo sapiens
ctttaagccatagaccctgaggc

SEQ ID NO: 2312603 - DNA, 22 bp, Homo sapiens
ctttaataacaaggagatttct

SEQ ID NO: 2312604 - DNA, 19 bp, Homo sapiens
ctttaattaccaacctgtt

SEQ ID NO: 2312605 - DNA, 12 bp, Homo sapiens
ctttaccactgt

SEQ ID NO: 2312606 - DNA, 13 bp, Homo sapiens
ctttaccactgtg

SEQ ID NO: 2312607 - DNA, 18 bp, Homo sapiens
ctttacccacctagaaca

SEQ ID NO: 2312608 - DNA, 19 bp, Homo sapiens
ctttaccctctttgctgca

SEQ ID NO: 2312609 - DNA, 17 bp, Homo sapiens
ctttaccttttcagggc

SEQ ID NO: 2312610 - DNA, 20 bp, Homo sapiens
ctttaccttttcagggctgg

SEQ ID NO: 2312611 - DNA, 14 bp, Homo sapiens
ctttagagattata

SEQ ID NO: 2312612 - DNA, 16 bp, Homo sapiens
ctttagatctctgaag

SEQ ID NO: 2312613 - DNA, 12 bp, Homo sapiens
ctttagctctct

SEQ ID NO: 2312614 - DNA, 14 bp, Homo sapiens
ctttaggcagcctg

SEQ ID NO: 2312615 - DNA, 15 bp, Homo sapiens
ctttaggcagcctgc

SEQ ID NO: 2312616 - DNA, 19 bp, Homo sapiens
ctttaggcagcctgccgcc

SEQ ID NO: 2312617 - DNA, 15 bp, Homo sapiens
ctttagtgttctgtt

SEQ ID NO: 2312618 - DNA, 19 bp, Homo sapiens
ctttagtgttctgtttgaa

SEQ ID NO: 2312619 - DNA, 21 bp, Homo sapiens
ctttagtttttggttgggaat

SEQ ID NO: 2312620 - DNA, 22 bp, Homo sapiens
ctttatatgaagaaaatcactt

SEQ ID NO: 2312621 - DNA, 14 bp, Homo sapiens
ctttatgtgaattt

SEQ ID NO: 2312622 - DNA, 17 bp, Homo sapiens
ctttatgtgaattttta

SEQ ID NO: 2312623 - DNA, 14 bp, Homo sapiens
ctttattaagtaaa

SEQ ID NO: 2312624 - DNA, 15 bp, Homo sapiens
ctttattaatgtttt

SEQ ID NO: 2312625 - DNA, 14 bp, Homo sapiens
ctttattgaaattc

SEQ ID NO: 2312626 - DNA, 14 bp, Homo sapiens
ctttattttgtgta

SEQ ID NO: 2312627 - DNA, 17 bp, Homo sapiens
ctttattttgtgtaaaa

SEQ ID NO: 2312628 - DNA, 12 bp, Homo sapiens
ctttcaaaatga

SEQ ID NO: 2312629 - DNA, 14 bp, Homo sapiens
ctttcacttcttcc

SEQ ID NO: 2312630 - DNA, 16 bp, Homo sapiens
ctttcatccttgacta

SEQ ID NO: 2312631 - DNA, 22 bp, Homo sapiens
ctttcatggctgctgttgctta

SEQ ID NO: 2312632 - DNA, 14 bp, Homo sapiens
ctttccaaattaaa

SEQ ID NO: 2312633 - DNA, 19 bp, Homo sapiens
ctttccaaattaaaacaaa

SEQ ID NO: 2312634 - DNA, 19 bp, Homo sapiens
ctttccaggcaccctcagg

SEQ ID NO: 2312635 - DNA, 20 bp, Homo sapiens
ctttccataaatccttgatg

SEQ ID NO: 2312636 - DNA, 21 bp, Homo sapiens
ctttcccaccccaacctgctc

SEQ ID NO: 2312637 - DNA, 22 bp, Homo sapiens
ctttcccttattgcctcccagg

SEQ ID NO: 2312638 - DNA, 13 bp, Homo sapiens
ctttcctcacatt

SEQ ID NO: 2312639 - DNA, 12 bp, Homo sapiens
ctttcctccacc

SEQ ID NO: 2312640 - DNA, 14 bp, Homo sapiens
ctttcctctttctg

SEQ ID NO: 2312641 - DNA, 16 bp, Homo sapiens
ctttcctctttctgct

SEQ ID NO: 2312642 - DNA, 11 bp, Homo sapiens
ctttcctgccc

SEQ ID NO: 2312643 - DNA, 22 bp, Homo sapiens
ctttcctgccctgtccaaaagc

SEQ ID NO: 2312644 - DNA, 11 bp, Homo sapiens
ctttccttccc

SEQ ID NO: 2312645 - DNA, 17 bp, Homo sapiens
ctttccttccctctctg

SEQ ID NO: 2312646 - DNA, 18 bp, Homo sapiens
ctttccttccctctctga

SEQ ID NO: 2312647 - DNA, 15 bp, Homo sapiens
ctttccttggcttta

SEQ ID NO: 2312648 - DNA, 14 bp, Homo sapiens
ctttcgaggcctga

SEQ ID NO: 2312649 - DNA, 17 bp, Homo sapiens
ctttctcaatgtcttcc

SEQ ID NO: 2312650 - DNA, 20 bp, Homo sapiens
ctttctcagttttcataagt

SEQ ID NO: 2312651 - DNA, 20 bp, Homo sapiens
ctttctcgtggtagaagcca

SEQ ID NO: 2312652 - DNA, 13 bp, Homo sapiens
ctttctcttccct

SEQ ID NO: 2312653 - DNA, 13 bp, Homo sapiens
ctttctgctctgc

SEQ ID NO: 2312654 - DNA, 19 bp, Homo sapiens
ctttctgctctgccatctt

SEQ ID NO: 2312655 - DNA, 22 bp, Homo sapiens
ctttctgctctgccatcttcag

SEQ ID NO: 2312656 - DNA, 12 bp, Homo sapiens
ctttctgggatg

SEQ ID NO: 2312657 - DNA, 22 bp, Homo sapiens
ctttctggggggatatttccta

SEQ ID NO: 2312658 - DNA, 11 bp, Homo sapiens
ctttcttctgt

SEQ ID NO: 2312659 - DNA, 21 bp, Homo sapiens
ctttcttgtcttttcagaagc

SEQ ID NO: 2312660 - DNA, 16 bp, Homo sapiens
ctttctttttgtagct

SEQ ID NO: 2312661 - DNA, 21 bp, Homo sapiens
ctttctttttgtagctggggc

SEQ ID NO: 2312662 - DNA, 20 bp, Homo sapiens
ctttgaaaaatctcattatt

SEQ ID NO: 2312663 - DNA, 16 bp, Homo sapiens
ctttgaaacctcaggg

SEQ ID NO: 2312664 - DNA, 17 bp, Homo sapiens
ctttgaaacctcagggc

SEQ ID NO: 2312665 - DNA, 20 bp, Homo sapiens
ctttgaaacctcagggctgt

SEQ ID NO: 2312666 - DNA, 15 bp, Homo sapiens
ctttgaatgtaacca

SEQ ID NO: 2312667 - DNA, 16 bp, Homo sapiens
ctttgaatgtaaccaa

SEQ ID NO: 2312668 - DNA, 21 bp, Homo sapiens
ctttgacaattgggagctgcc

SEQ ID NO: 2312669 - DNA, 18 bp, Homo sapiens
ctttgaccagatctttct

SEQ ID NO: 2312670 - DNA, 20 bp, Homo sapiens
ctttgaccagatctttctct

SEQ ID NO: 2312671 - DNA, 21 bp, Homo sapiens
ctttgaccagatctttctctt

SEQ ID NO: 2312672 - DNA, 22 bp, Homo sapiens
ctttgaccagatctttctcttc

SEQ ID NO: 2312673 - DNA, 23 bp, Homo sapiens
ctttgaccagatctttctcttcc

SEQ ID NO: 2312674 - DNA, 17 bp, Homo sapiens
ctttgactttttgcatt

SEQ ID NO: 2312675 - DNA, 15 bp, Homo sapiens
ctttgagaagccttc

SEQ ID NO: 2312676 - DNA, 19 bp, Homo sapiens
ctttgagaagccttcagct

SEQ ID NO: 2312677 - DNA, 13 bp, Homo sapiens
ctttgagacagtt

SEQ ID NO: 2312678 - DNA, 16 bp, Homo sapiens
ctttgagacagtttct

SEQ ID NO: 2312679 - DNA, 18 bp, Homo sapiens
ctttgagacagtttctta

SEQ ID NO: 2312680 - DNA, 15 bp, Homo sapiens
ctttgataatgttaa

SEQ ID NO: 2312681 - DNA, 16 bp, Homo sapiens
ctttgatgttccttcc

SEQ ID NO: 2312682 - DNA, 16 bp, Homo sapiens
ctttgcacctgagacc

SEQ ID NO: 2312683 - DNA, 15 bp, Homo sapiens
ctttgcatattataa

SEQ ID NO: 2312684 - DNA, 18 bp, Homo sapiens
ctttgccatgggcctgct

SEQ ID NO: 2312685 - DNA, 19 bp, Homo sapiens
ctttgccatgggcctgctg

SEQ ID NO: 2312686 - DNA, 15 bp, Homo sapiens
ctttgctcagtgtcc

SEQ ID NO: 2312687 - DNA, 18 bp, Homo sapiens
ctttgctcagtgtccagc

SEQ ID NO: 2312688 - DNA, 19 bp, Homo sapiens
ctttgctcagtgtccagct

SEQ ID NO: 2312689 - DNA, 22 bp, Homo sapiens
ctttgctcagtgtccagcttcc

SEQ ID NO: 2312690 - DNA, 12 bp, Homo sapiens
ctttgctccaga

SEQ ID NO: 2312691 - DNA, 16 bp, Homo sapiens
ctttggaaatagcatg

SEQ ID NO: 2312692 - DNA, 16 bp, Homo sapiens
ctttggacctaatcca

SEQ ID NO: 2312693 - DNA, 14 bp, Homo sapiens
ctttggaggtgctg

SEQ ID NO: 2312694 - DNA, 14 bp, Homo sapiens
ctttggagttaaaa

SEQ ID NO: 2312695 - DNA, 17 bp, Homo sapiens
ctttggagttaaaatgc

SEQ ID NO: 2312696 - DNA, 16 bp, Homo sapiens
ctttgggatcagcctc

SEQ ID NO: 2312697 - DNA, 17 bp, Homo sapiens
ctttgggatcagcctcc

SEQ ID NO: 2312698 - DNA, 17 bp, Homo sapiens
ctttggggggtgtgctg

SEQ ID NO: 2312699 - DNA, 19 bp, Homo sapiens
ctttgggttctttctgggg

SEQ ID NO: 2312700 - DNA, 13 bp, Homo sapiens
ctttgtaaaaatc

SEQ ID NO: 2312701 - DNA, 20 bp, Homo sapiens
ctttgtaaccagaattatac

SEQ ID NO: 2312702 - DNA, 21 bp, Homo sapiens
ctttgtaaccagaattataca

SEQ ID NO: 2312703 - DNA, 21 bp, Homo sapiens
ctttgtaagagtgtagaagca

SEQ ID NO: 2312704 - DNA, 13 bp, Homo sapiens
ctttgtaccaaaa

SEQ ID NO: 2312705 - DNA, 22 bp, Homo sapiens
ctttgtattgtatattacaatg

SEQ ID NO: 2312706 - DNA, 17 bp, Homo sapiens
ctttgtattttgattat

SEQ ID NO: 2312707 - DNA, 16 bp, Homo sapiens
ctttgtgctgcgcctg

SEQ ID NO: 2312708 - DNA, 18 bp, Homo sapiens
ctttgttgcaagatgtga

SEQ ID NO: 2312709 - DNA, 20 bp, Homo sapiens
ctttgttgcaagatgtgaat

SEQ ID NO: 2312710 - DNA, 21 bp, Homo sapiens
ctttgttgcaagatgtgaatt

SEQ ID NO: 2312711 - DNA, 16 bp, Homo sapiens
cttttaaaattcaaaa

SEQ ID NO: 2312712 - DNA, 21 bp, Homo sapiens
cttttaccttttttttttctt

SEQ ID NO: 2312713 - DNA, 21 bp, Homo sapiens
ataacagctgcaattccctgg

SEQ ID NO: 2312714 - DNA, 11 bp, Homo sapiens
ataacataaaa

SEQ ID NO: 2312715 - DNA, 20 bp, Homo sapiens
ataacatctttattgaaatt

SEQ ID NO: 2312716 - DNA, 21 bp, Homo sapiens
ataacatctttattgaaattc

SEQ ID NO: 2312717 - DNA, 14 bp, Homo sapiens
ataacattacctta

SEQ ID NO: 2312718 - DNA, 20 bp, Homo sapiens
ataacattaccttactgtgg

SEQ ID NO: 2312719 - DNA, 14 bp, Homo sapiens
ataacctaattaat

SEQ ID NO: 2312720 - DNA, 20 bp, Homo sapiens
ataacctagttaaagaaagg

SEQ ID NO: 2312721 - DNA, 18 bp, Homo sapiens
ataacgtttttcctttaa

SEQ ID NO: 2312722 - DNA, 15 bp, Homo sapiens
ataactctctttcct

SEQ ID NO: 2312723 - DNA, 20 bp, Homo sapiens
ataactctctttccttgagc

SEQ ID NO: 2312724 - DNA, 13 bp, Homo sapiens
ataactgaaaatg

SEQ ID NO: 2312725 - DNA, 15 bp, Homo sapiens
ataactgtgtactgt

SEQ ID NO: 2312726 - DNA, 11 bp, Homo sapiens
ataagaaaaat

SEQ ID NO: 2312727 - DNA, 14 bp, Homo sapiens
ataagaaacagttt

SEQ ID NO: 2312728 - DNA, 16 bp, Homo sapiens
ataagaaacagtttaa

SEQ ID NO: 2312729 - DNA, 19 bp, Homo sapiens
ataagaaacagtttaacag

SEQ ID NO: 2312730 - DNA, 17 bp, Homo sapiens
ataagacataacgtttt

SEQ ID NO: 2312731 - DNA, 13 bp, Homo sapiens
ataagattaataa

SEQ ID NO: 2312732 - DNA, 15 bp, Homo sapiens
ataagattaataaga

SEQ ID NO: 2312733 - DNA, 16 bp, Homo sapiens
ataagattaataagat

SEQ ID NO: 2312734 - DNA, 13 bp, Homo sapiens
ataagatttttca

SEQ ID NO: 2312735 - DNA, 17 bp, Homo sapiens
ataagatttttcaaaat

SEQ ID NO: 2312736 - DNA, 18 bp, Homo sapiens
ataagatttttcaaaatc

SEQ ID NO: 2312737 - DNA, 20 bp, Homo sapiens
ataagcaagagacaataata

SEQ ID NO: 2312738 - DNA, 14 bp, Homo sapiens
ataagcaagagaga

SEQ ID NO: 2312739 - DNA, 15 bp, Homo sapiens
ataagcaagagagat

SEQ ID NO: 2312740 - DNA, 13 bp, Homo sapiens
ataagcactgtaa

SEQ ID NO: 2312741 - DNA, 16 bp, Homo sapiens
ataagctaaagaggct

SEQ ID NO: 2312742 - DNA, 16 bp, Homo sapiens
ataagtaaatgtcttc

SEQ ID NO: 2312743 - DNA, 22 bp, Homo sapiens
ataagtagtaaatcagaaagta

SEQ ID NO: 2312744 - DNA, 23 bp, Homo sapiens
ataagtgacaaataagattaata

SEQ ID NO: 2312745 - DNA, 12 bp, Homo sapiens
ataagtgccctc

SEQ ID NO: 2312746 - DNA, 12 bp, Homo sapiens
ataagttatttt

SEQ ID NO: 2312747 - DNA, 19 bp, Homo sapiens
ataagttatttttgtacat

SEQ ID NO: 2312748 - DNA, 20 bp, Homo sapiens
ataagttatttttgtacatg

SEQ ID NO: 2312749 - DNA, 18 bp, Homo sapiens
ataataaattttctaaaa

SEQ ID NO: 2312750 - DNA, 13 bp, Homo sapiens
ataataagctaaa

SEQ ID NO: 2312751 - DNA, 21 bp, Homo sapiens
ataatacagaatcttgttttg

SEQ ID NO: 2312752 - DNA, 19 bp, Homo sapiens
ataatagctaataatacct

SEQ ID NO: 2312753 - DNA, 17 bp, Homo sapiens
ataatatcaaataaaat

SEQ ID NO: 2312754 - DNA, 16 bp, Homo sapiens
ataatatgtgagagga

SEQ ID NO: 2312755 - DNA, 16 bp, Homo sapiens
ataatattgaaaattg

SEQ ID NO: 2312756 - DNA, 21 bp, Homo sapiens
ataatattgaaaattgaaaag

SEQ ID NO: 2312757 - DNA, 23 bp, Homo sapiens
ataatattggggaccaaatcaaa

SEQ ID NO: 2312758 - DNA, 20 bp, Homo sapiens
ataatatttttgtatttctc

SEQ ID NO: 2312759 - DNA, 21 bp, Homo sapiens
ataatatttttgtatttctct

SEQ ID NO: 2312760 - DNA, 14 bp, Homo sapiens
ataatcagtaaata

SEQ ID NO: 2312761 - DNA, 14 bp, Homo sapiens
ataatcattacctt

SEQ ID NO: 2312762 - DNA, 17 bp, Homo sapiens
ataatcttctgccttct

SEQ ID NO: 2312763 - DNA, 20 bp, Homo sapiens
ataatcttgtttctgaaaag

SEQ ID NO: 2312764 - DNA, 12 bp, Homo sapiens
ataatgaaaata

SEQ ID NO: 2312765 - DNA, 13 bp, Homo sapiens
ataatgaataaat

SEQ ID NO: 2312766 - DNA, 14 bp, Homo sapiens
ataatgagatgtga

SEQ ID NO: 2312767 - DNA, 18 bp, Homo sapiens
ataatgaggagtttatga

SEQ ID NO: 2312768 - DNA, 14 bp, Homo sapiens
ataatgctacaatt

SEQ ID NO: 2312769 - DNA, 20 bp, Homo sapiens
ataatgctacaattttaaga

SEQ ID NO: 2312770 - DNA, 16 bp, Homo sapiens
ataatggaaaatgcca

SEQ ID NO: 2312771 - DNA, 17 bp, Homo sapiens
ataatggccctgtagct

SEQ ID NO: 2312772 - DNA, 18 bp, Homo sapiens
ataatgttaaatttgtaa

SEQ ID NO: 2312773 - DNA, 19 bp, Homo sapiens
ataatgttaaatttgtaag

SEQ ID NO: 2312774 - DNA, 23 bp, Homo sapiens
ataatgttaaatttgtaagtttc

SEQ ID NO: 2312775 - DNA, 16 bp, Homo sapiens
ataatgtttattaaat

SEQ ID NO: 2312776 - DNA, 19 bp, Homo sapiens
ataatgtttattaaatgct

SEQ ID NO: 2312777 - DNA, 16 bp, Homo sapiens
ataattcatatctaaa

SEQ ID NO: 2312778 - DNA, 19 bp, Homo sapiens
ataatttaaaaatatattt

SEQ ID NO: 2312779 - DNA, 14 bp, Homo sapiens
ataatttcagggtg

SEQ ID NO: 2312780 - DNA, 19 bp, Homo sapiens
ataatttctattaatatca

SEQ ID NO: 2312781 - DNA, 18 bp, Homo sapiens
ataattttaatattcttt

SEQ ID NO: 2312782 - DNA, 17 bp, Homo sapiens
ataattttggaataatt

SEQ ID NO: 2312783 - DNA, 21 bp, Homo sapiens
ataattttggaataatttcta

SEQ ID NO: 2312784 - DNA, 14 bp, Homo sapiens
atacaaaaaaatta

SEQ ID NO: 2312785 - DNA, 15 bp, Homo sapiens
atacaaactctcacc

SEQ ID NO: 2312786 - DNA, 18 bp, Homo sapiens
atacaaactctcaccatg

SEQ ID NO: 2312787 - DNA, 16 bp, Homo sapiens
atacaagaaaatgtat

SEQ ID NO: 2312788 - DNA, 17 bp, Homo sapiens
atacaagaaaatgtatc

SEQ ID NO: 2312789 - DNA, 21 bp, Homo sapiens
atacacagaggagtgcagcct

SEQ ID NO: 2312790 - DNA, 20 bp, Homo sapiens
atacacatagttctgtaata

SEQ ID NO: 2312791 - DNA, 22 bp, Homo sapiens
atacacatttgctactgttgta

SEQ ID NO: 2312792 - DNA, 21 bp, Homo sapiens
atacactttgttgcaagatgt

SEQ ID NO: 2312793 - DNA, 18 bp, Homo sapiens
atacagaatcttgttttg

SEQ ID NO: 2312794 - DNA, 20 bp, Homo sapiens
atacagaatcttgttttgaa

SEQ ID NO: 2312795 - DNA, 21 bp, Homo sapiens
atacagaggatgccttttctg

SEQ ID NO: 2312796 - DNA, 13 bp, Homo sapiens
atacagctgccta

SEQ ID NO: 2312797 - DNA, 18 bp, Homo sapiens
atacaggagagaagctgg

SEQ ID NO: 2312798 - DNA, 18 bp, Homo sapiens
atacataaaagaaataaa

SEQ ID NO: 2312799 - DNA, 13 bp, Homo sapiens
atacatgcatata

SEQ ID NO: 2312800 - DNA, 20 bp, Homo sapiens
atacattccctctaatttga

SEQ ID NO: 2312801 - DNA, 14 bp, Homo sapiens
atacattttctaaa

SEQ ID NO: 2312802 - DNA, 20 bp, Homo sapiens
atacattttttaagcttcag

SEQ ID NO: 2312803 - DNA, 17 bp, Homo sapiens
ataccaaattaaaaaaa

SEQ ID NO: 2312804 - DNA, 18 bp, Homo sapiens
ataccacaaaccctgctg

SEQ ID NO: 2312805 - DNA, 20 bp, Homo sapiens
ataccacaaaccctgctgaa

SEQ ID NO: 2312806 - DNA, 12 bp, Homo sapiens
atacctctgtgt

SEQ ID NO: 2312807 - DNA, 14 bp, Homo sapiens
atacctctgtgtgc

SEQ ID NO: 2312808 - DNA, 13 bp, Homo sapiens
ataccttcttatt

SEQ ID NO: 2312809 - DNA, 17 bp, Homo sapiens
ataccttgcaaagcaac

SEQ ID NO: 2312810 - DNA, 19 bp, Homo sapiens
atactaagagtaaagcaac

SEQ ID NO: 2312811 - DNA, 13 bp, Homo sapiens
atactcctgggct

SEQ ID NO: 2312812 - DNA, 15 bp, Homo sapiens
atactccttgcttcc

SEQ ID NO: 2312813 - DNA, 17 bp, Homo sapiens
atactcttaaattttat

SEQ ID NO: 2312814 - DNA, 12 bp, Homo sapiens
atactgaaggaa

SEQ ID NO: 2312815 - DNA, 13 bp, Homo sapiens
atactgaaggaaa

SEQ ID NO: 2312816 - DNA, 15 bp, Homo sapiens
atactgaaggaaaaa

SEQ ID NO: 2312817 - DNA, 20 bp, Homo sapiens
atactgaaggaaaaacacaa

SEQ ID NO: 2312818 - DNA, 22 bp, Homo sapiens
atactgaaggaaaaacacaagc

SEQ ID NO: 2312819 - DNA, 23 bp, Homo sapiens
atactgggacaccattaccaaaa

SEQ ID NO: 2312820 - DNA, 22 bp, Homo sapiens
atacttagagaacctatagcat

SEQ ID NO: 2312821 - DNA, 15 bp, Homo sapiens
atacttctctcagat

SEQ ID NO: 2312822 - DNA, 19 bp, Homo sapiens
atactttagtacaatttca

SEQ ID NO: 2312823 - DNA, 14 bp, Homo sapiens
atagaaaattattt

SEQ ID NO: 2312824 - DNA, 18 bp, Homo sapiens
atagaaaattatttgtat

SEQ ID NO: 2312825 - DNA, 14 bp, Homo sapiens
atagaaattttgta

SEQ ID NO: 2312826 - DNA, 16 bp, Homo sapiens
atagaaattttgtaag

SEQ ID NO: 2312827 - DNA, 18 bp, Homo sapiens
atagaaattttgtaagaa

SEQ ID NO: 2312828 - DNA, 13 bp, Homo sapiens
atgaataatggaa

SEQ ID NO: 2312829 - DNA, 18 bp, Homo sapiens
atgaatcccacccacatg

SEQ ID NO: 2312830 - DNA, 18 bp, Homo sapiens
atgaatggtctggcaata

SEQ ID NO: 2312831 - DNA, 14 bp, Homo sapiens
atgaattgtacaga

SEQ ID NO: 2312832 - DNA, 14 bp, Homo sapiens
atgaattttaaagt

SEQ ID NO: 2312833 - DNA, 15 bp, Homo sapiens
atgaattttaaagta

SEQ ID NO: 2312834 - DNA, 16 bp, Homo sapiens
atgaattttaaagtat

SEQ ID NO: 2312835 - DNA, 16 bp, Homo sapiens
atgacataataaagta

SEQ ID NO: 2312836 - DNA, 17 bp, Homo sapiens
atgacattaaatgcaat

SEQ ID NO: 2312837 - DNA, 21 bp, Homo sapiens
atgacattaaatgcaataatt

SEQ ID NO: 2312838 - DNA, 12 bp, Homo sapiens
atgaccagaagc

SEQ ID NO: 2312839 - DNA, 22 bp, Homo sapiens
atgacggtaagtgttctcatga

SEQ ID NO: 2312840 - DNA, 15 bp, Homo sapiens
atgactaaagagaga

SEQ ID NO: 2312841 - DNA, 13 bp, Homo sapiens
atgactaatgctt

SEQ ID NO: 2312842 - DNA, 20 bp, Homo sapiens
atgactaatgctttttagaa

SEQ ID NO: 2312843 - DNA, 20 bp, Homo sapiens
atgacttccttatttctgaa

SEQ ID NO: 2312844 - DNA, 14 bp, Homo sapiens
atgacttgctgtcc

SEQ ID NO: 2312845 - DNA, 20 bp, Homo sapiens
atgactttctttttgtagct

SEQ ID NO: 2312846 - DNA, 20 bp, Homo sapiens
atgagaaaaataaatggaaa

SEQ ID NO: 2312847 - DNA, 23 bp, Homo sapiens
atgagaaactttgatctctgctt

SEQ ID NO: 2312848 - DNA, 22 bp, Homo sapiens
atgagagcccagaggtaacaga

SEQ ID NO: 2312849 - DNA, 17 bp, Homo sapiens
atgagcaaccacattta

SEQ ID NO: 2312850 - DNA, 14 bp, Homo sapiens
atgagcaagactgg

SEQ ID NO: 2312851 - DNA, 17 bp, Homo sapiens
atgagctgatctgcgga

SEQ ID NO: 2312852 - DNA, 21 bp, Homo sapiens
atgaggaaaattcttaaaagg

SEQ ID NO: 2312853 - DNA, 14 bp, Homo sapiens
atgaggagggtggg

SEQ ID NO: 2312854 - DNA, 19 bp, Homo sapiens
atgaggagtaaaattcagt

SEQ ID NO: 2312855 - DNA, 19 bp, Homo sapiens
atgagtccttgatttcaaa

SEQ ID NO: 2312856 - DNA, 22 bp, Homo sapiens
atgagttgaaatgttctgtcaa

SEQ ID NO: 2312857 - DNA, 14 bp, Homo sapiens
atgataaaataaat

SEQ ID NO: 2312858 - DNA, 17 bp, Homo sapiens
atgataaaataaataat

SEQ ID NO: 2312859 - DNA, 19 bp, Homo sapiens
atgataaaataaataattt

SEQ ID NO: 2312860 - DNA, 21 bp, Homo sapiens
atgataaaataaataatttta

SEQ ID NO: 2312861 - DNA, 18 bp, Homo sapiens
atgataaactcagatctg

SEQ ID NO: 2312862 - DNA, 22 bp, Homo sapiens
atgataaactcagatctgatca

SEQ ID NO: 2312863 - DNA, 20 bp, Homo sapiens
atgataacaccagtgggaat

SEQ ID NO: 2312864 - DNA, 18 bp, Homo sapiens
atgatcaccgactgaaaa

SEQ ID NO: 2312865 - DNA, 18 bp, Homo sapiens
atgatcagacatacagct

SEQ ID NO: 2312866 - DNA, 21 bp, Homo sapiens
atgatccaactaatgccttac

SEQ ID NO: 2312867 - DNA, 17 bp, Homo sapiens
atgatgctaagctgata

SEQ ID NO: 2312868 - DNA, 18 bp, Homo sapiens
atgatgtacagattcttt

SEQ ID NO: 2312869 - DNA, 20 bp, Homo sapiens
atgattaagggacatttcta

SEQ ID NO: 2312870 - DNA, 20 bp, Homo sapiens
atgatttcagttctaggaaa

SEQ ID NO: 2312871 - DNA, 19 bp, Homo sapiens
atgcaaatgagctctgaaa

SEQ ID NO: 2312872 - DNA, 16 bp, Homo sapiens
atgcaacaaatgtggc

SEQ ID NO: 2312873 - DNA, 18 bp, Homo sapiens
atgcaatgcttcattatt

SEQ ID NO: 2312874 - DNA, 18 bp, Homo sapiens
atgcaatgtatagtgtct

SEQ ID NO: 2312875 - DNA, 18 bp, Homo sapiens
atgcacatatggactctg

SEQ ID NO: 2312876 - DNA, 19 bp, Homo sapiens
atgcacatatggactctgc

SEQ ID NO: 2312877 - DNA, 16 bp, Homo sapiens
atgcaccttgtgtctg

SEQ ID NO: 2312878 - DNA, 19 bp, Homo sapiens
atgcaccttgtgtctgtac

SEQ ID NO: 2312879 - DNA, 18 bp, Homo sapiens
atgcacttttagaaatgc

SEQ ID NO: 2312880 - DNA, 21 bp, Homo sapiens
atgcacttttagaaatgcata

SEQ ID NO: 2312881 - DNA, 16 bp, Homo sapiens
atgcagagagccattt

SEQ ID NO: 2312882 - DNA, 21 bp, Homo sapiens
atgcagagagccattttgtga

SEQ ID NO: 2312883 - DNA, 23 bp, Homo sapiens
atgcagagagccattttgtgaat

SEQ ID NO: 2312884 - DNA, 22 bp, Homo sapiens
atgcaggagcttctgggagatt

SEQ ID NO: 2312885 - DNA, 16 bp, Homo sapiens
atgcaggaggtggaga

SEQ ID NO: 2312886 - DNA, 19 bp, Homo sapiens
atgcaggaggtggagaaaa

SEQ ID NO: 2312887 - DNA, 18 bp, Homo sapiens
atgcagtgatatggcaga

SEQ ID NO: 2312888 - DNA, 19 bp, Homo sapiens
atgcagtgatatggcagaa

SEQ ID NO: 2312889 - DNA, 19 bp, Homo sapiens
atgcagttagctgaagaat

SEQ ID NO: 2312890 - DNA, 15 bp, Homo sapiens
atgcagttctgagca

SEQ ID NO: 2312891 - DNA, 19 bp, Homo sapiens
atgcataaactaaaaacta

SEQ ID NO: 2312892 - DNA, 21 bp, Homo sapiens
atgcatataatgaataaatca

SEQ ID NO: 2312893 - DNA, 18 bp, Homo sapiens
atgcatatcctgagccat

SEQ ID NO: 2312894 - DNA, 17 bp, Homo sapiens
atgcatatttgcaaagt

SEQ ID NO: 2312895 - DNA, 17 bp, Homo sapiens
atgcatcatttcaggag

SEQ ID NO: 2312896 - DNA, 16 bp, Homo sapiens
atgcattattaaattg

SEQ ID NO: 2312897 - DNA, 16 bp, Homo sapiens
atgcatttaataaaga

SEQ ID NO: 2312898 - DNA, 21 bp, Homo sapiens
atgcatttaataaagatgagt

SEQ ID NO: 2312899 - DNA, 17 bp, Homo sapiens
atgccaatttcctctcc

SEQ ID NO: 2312900 - DNA, 18 bp, Homo sapiens
atgccaatttcctctcca

SEQ ID NO: 2312901 - DNA, 18 bp, Homo sapiens
atgccacatcaaaccttt

SEQ ID NO: 2312902 - DNA, 14 bp, Homo sapiens
atgccagtattttt

SEQ ID NO: 2312903 - DNA, 15 bp, Homo sapiens
atgccatttctcacg

SEQ ID NO: 2312904 - DNA, 12 bp, Homo sapiens
atgcccaccccc

SEQ ID NO: 2312905 - DNA, 17 bp, Homo sapiens
atgcccaccccctgccc

SEQ ID NO: 2312906 - DNA, 19 bp, Homo sapiens
atgcccaccccctgccctg

SEQ ID NO: 2312907 - DNA, 18 bp, Homo sapiens
atgcccagctctctgacg

SEQ ID NO: 2312908 - DNA, 20 bp, Homo sapiens
atgccccattccttgcgcct

SEQ ID NO: 2312909 - DNA, 23 bp, Homo sapiens
atgccccattccttgcgcctcag

SEQ ID NO: 2312910 - DNA, 12 bp, Homo sapiens
atgcccttcact

SEQ ID NO: 2312911 - DNA, 18 bp, Homo sapiens
atgccgcggtaggtaagg

SEQ ID NO: 2312912 - DNA, 19 bp, Homo sapiens
atgcctgcgcctgctgcct

SEQ ID NO: 2312913 - DNA, 18 bp, Homo sapiens
atgcctgctttttggaaa

SEQ ID NO: 2312914 - DNA, 19 bp, Homo sapiens
atgcctgctttttggaaag

SEQ ID NO: 2312915 - DNA, 13 bp, Homo sapiens
atgcctttgagac

SEQ ID NO: 2312916 - DNA, 15 bp, Homo sapiens
atgcctttgagacag

SEQ ID NO: 2312917 - DNA, 13 bp, Homo sapiens
atgctaagctgat

SEQ ID NO: 2312918 - DNA, 23 bp, Homo sapiens
atgctaccaggatgctaaagatg

SEQ ID NO: 2312919 - DNA, 15 bp, Homo sapiens
atgctccaaatataa

SEQ ID NO: 2312920 - DNA, 13 bp, Homo sapiens
atgctgctggcca

SEQ ID NO: 2312921 - DNA, 21 bp, Homo sapiens
atgctggtggttaaggccagg

SEQ ID NO: 2312922 - DNA, 17 bp, Homo sapiens
atgctgttgtgaagcta

SEQ ID NO: 2312923 - DNA, 14 bp, Homo sapiens
atgctgtttctaag

SEQ ID NO: 2312924 - DNA, 20 bp, Homo sapiens
atgctgtttctaagaaaatg

SEQ ID NO: 2312925 - DNA, 18 bp, Homo sapiens
atgcttaaataaaaatta

SEQ ID NO: 2312926 - DNA, 14 bp, Homo sapiens
atgcttaaatttca

SEQ ID NO: 2312927 - DNA, 14 bp, Homo sapiens
atgcttaataaaag

SEQ ID NO: 2312928 - DNA, 16 bp, Homo sapiens
atgcttaataaaagaa

SEQ ID NO: 2312929 - DNA, 18 bp, Homo sapiens
atgcttaataaaagaaca

SEQ ID NO: 2312930 - DNA, 15 bp, Homo sapiens
atgcttagtccctca

SEQ ID NO: 2312931 - DNA, 20 bp, Homo sapiens
atgcttcctgacaatcaact

SEQ ID NO: 2312932 - DNA, 15 bp, Homo sapiens
atgcttcctttctct

SEQ ID NO: 2312933 - DNA, 11 bp, Homo sapiens
atgcttctctc

SEQ ID NO: 2312934 - DNA, 13 bp, Homo sapiens
atgcttctctcct

SEQ ID NO: 2312935 - DNA, 17 bp, Homo sapiens
atgcttctctccttgcc

SEQ ID NO: 2312936 - DNA, 18 bp, Homo sapiens
atgcttgcataagagctt

SEQ ID NO: 2312937 - DNA, 18 bp, Homo sapiens
atgcttgcggcaaaagga

SEQ ID NO: 2312938 - DNA, 20 bp, Homo sapiens
atgcttgcggcaaaaggaaa

SEQ ID NO: 2312939 - DNA, 23 bp, Homo sapiens
atgcttgcggcaaaaggaaagct

SEQ ID NO: 2312940 - DNA, 18 bp, Homo sapiens
atgctttattaatgtttt

SEQ ID NO: 2312941 - DNA, 19 bp, Homo sapiens
atgctttattaatgttttc

SEQ ID NO: 2312942 - DNA, 13 bp, Homo sapiens
attactgccattc

SEQ ID NO: 2312943 - DNA, 15 bp, Homo sapiens
attactggtccaaaa

SEQ ID NO: 2312944 - DNA, 12 bp, Homo sapiens
attagagtattt

SEQ ID NO: 2312945 - DNA, 23 bp, Homo sapiens
attagagtatttcccttccaaag

SEQ ID NO: 2312946 - DNA, 23 bp, Homo sapiens
attagagtcaactacacaaagca

SEQ ID NO: 2312947 - DNA, 14 bp, Homo sapiens
attagataatattt

SEQ ID NO: 2312948 - DNA, 16 bp, Homo sapiens
attagatcaaatagtt

SEQ ID NO: 2312949 - DNA, 19 bp, Homo sapiens
attagatcaaatagttgca

SEQ ID NO: 2312950 - DNA, 21 bp, Homo sapiens
attagatcaaatagttgcata

SEQ ID NO: 2312951 - DNA, 13 bp, Homo sapiens
attagccaggatc

SEQ ID NO: 2312952 - DNA, 22 bp, Homo sapiens
attagccaggatcatggtgtaa

SEQ ID NO: 2312953 - DNA, 15 bp, Homo sapiens
attaggaaaatatgg

SEQ ID NO: 2312954 - DNA, 15 bp, Homo sapiens
attaggaagtgttta

SEQ ID NO: 2312955 - DNA, 24 bp, Homo sapiens
attagtctatatggttctccaaga

SEQ ID NO: 2312956 - DNA, 17 bp, Homo sapiens
attagtggtcataaaat

SEQ ID NO: 2312957 - DNA, 18 bp, Homo sapiens
attagtggtcataaaata

SEQ ID NO: 2312958 - DNA, 20 bp, Homo sapiens
attagtgtgacagtttccaa

SEQ ID NO: 2312959 - DNA, 21 bp, Homo sapiens
attagtgtgacagtttccaaa

SEQ ID NO: 2312960 - DNA, 23 bp, Homo sapiens
attagtgtgacagtttccaaatt

SEQ ID NO: 2312961 - DNA, 22 bp, Homo sapiens
attataaaggataaagaaggat

SEQ ID NO: 2312962 - DNA, 13 bp, Homo sapiens
attataacataaa

SEQ ID NO: 2312963 - DNA, 16 bp, Homo sapiens
attataacataaaagc

SEQ ID NO: 2312964 - DNA, 21 bp, Homo sapiens
attataactctgtataataga

SEQ ID NO: 2312965 - DNA, 20 bp, Homo sapiens
attatacatgtgatacattt

SEQ ID NO: 2312966 - DNA, 11 bp, Homo sapiens
attatagaaaa

SEQ ID NO: 2312967 - DNA, 16 bp, Homo sapiens
attatagcaactaatg

SEQ ID NO: 2312968 - DNA, 14 bp, Homo sapiens
attatagtgtagaa

SEQ ID NO: 2312969 - DNA, 16 bp, Homo sapiens
attatataaactgtgc

SEQ ID NO: 2312970 - DNA, 20 bp, Homo sapiens
attatcacattaatctcaaa

SEQ ID NO: 2312971 - DNA, 14 bp, Homo sapiens
attatcattgtttg

SEQ ID NO: 2312972 - DNA, 14 bp, Homo sapiens
attatcccagctgc

SEQ ID NO: 2312973 - DNA, 12 bp, Homo sapiens
attatcttcagc

SEQ ID NO: 2312974 - DNA, 20 bp, Homo sapiens
attatgagctatcctttcaa

SEQ ID NO: 2312975 - DNA, 22 bp, Homo sapiens
attatgagctatcctttcaaac

SEQ ID NO: 2312976 - DNA, 23 bp, Homo sapiens
attatgagctatcctttcaaaca

SEQ ID NO: 2312977 - DNA, 14 bp, Homo sapiens
attatgtaagcatt

SEQ ID NO: 2312978 - DNA, 16 bp, Homo sapiens
attattcaagaatgaa

SEQ ID NO: 2312979 - DNA, 18 bp, Homo sapiens
attattcaagaatgaaaa

SEQ ID NO: 2312980 - DNA, 23 bp, Homo sapiens
attattcaagaatgaaaaatata

SEQ ID NO: 2312981 - DNA, 16 bp, Homo sapiens
attattcataatgtga

SEQ ID NO: 2312982 - DNA, 13 bp, Homo sapiens
attatttaataac

SEQ ID NO: 2312983 - DNA, 14 bp, Homo sapiens
attatttaataaca

SEQ ID NO: 2312984 - DNA, 22 bp, Homo sapiens
attatttaataacattacctta

SEQ ID NO: 2312985 - DNA, 13 bp, Homo sapiens
attatttcaaaat

SEQ ID NO: 2312986 - DNA, 15 bp, Homo sapiens
attatttcttctctt

SEQ ID NO: 2312987 - DNA, 18 bp, Homo sapiens
attatttgaagatttaat

SEQ ID NO: 2312988 - DNA, 16 bp, Homo sapiens
attatttgattattta

SEQ ID NO: 2312989 - DNA, 18 bp, Homo sapiens
attatttgattatttaag

SEQ ID NO: 2312990 - DNA, 21 bp, Homo sapiens
attatttgattatttaagact

SEQ ID NO: 2312991 - DNA, 18 bp, Homo sapiens
attattttttaaaaaggt

SEQ ID NO: 2312992 - DNA, 20 bp, Homo sapiens
attatttttttaaaattttg

SEQ ID NO: 2312993 - DNA, 18 bp, Homo sapiens
attcaaaagtattgaaag

SEQ ID NO: 2312994 - DNA, 16 bp, Homo sapiens
attcaagaatgaaaaa

SEQ ID NO: 2312995 - DNA, 14 bp, Homo sapiens
attcaatctgtaaa

SEQ ID NO: 2312996 - DNA, 14 bp, Homo sapiens
attcacatttagaa

SEQ ID NO: 2312997 - DNA, 15 bp, Homo sapiens
attcacatttagaaa

SEQ ID NO: 2312998 - DNA, 13 bp, Homo sapiens
attcagaggcagt

SEQ ID NO: 2312999 - DNA, 15 bp, Homo sapiens
attcagaggcagtga

SEQ ID NO: 2313000 - DNA, 14 bp, Homo sapiens
attcagatgtatgt

SEQ ID NO: 2313001 - DNA, 21 bp, Homo sapiens
attcagtgagggtcttcttac

SEQ ID NO: 2313002 - DNA, 17 bp, Homo sapiens
attcataataaattttc

SEQ ID NO: 2313003 - DNA, 15 bp, Homo sapiens
attcataatgtgaga

SEQ ID NO: 2313004 - DNA, 18 bp, Homo sapiens
attcataccttctgatga

SEQ ID NO: 2313005 - DNA, 18 bp, Homo sapiens
attcatatctaaatagta

SEQ ID NO: 2313006 - DNA, 16 bp, Homo sapiens
attcatgaggagggtg

SEQ ID NO: 2313007 - DNA, 13 bp, Homo sapiens
attcattaattag

SEQ ID NO: 2313008 - DNA, 12 bp, Homo sapiens
attccaaaatat

SEQ ID NO: 2313009 - DNA, 13 bp, Homo sapiens
attccaaattcat

SEQ ID NO: 2313010 - DNA, 19 bp, Homo sapiens
attccaagtcaacactctt

SEQ ID NO: 2313011 - DNA, 18 bp, Homo sapiens
attccactacacctggct

SEQ ID NO: 2313012 - DNA, 16 bp, Homo sapiens
attccagatctttcag

SEQ ID NO: 2313013 - DNA, 20 bp, Homo sapiens
attccagatctttcagaaat

SEQ ID NO: 2313014 - DNA, 18 bp, Homo sapiens
attccagcagttgttcca

SEQ ID NO: 2313015 - DNA, 22 bp, Homo sapiens
attccagctgtcactctgtgcc

SEQ ID NO: 2313016 - DNA, 15 bp, Homo sapiens
attccagtacagtat

SEQ ID NO: 2313017 - DNA, 15 bp, Homo sapiens
attcccatgtggaac

SEQ ID NO: 2313018 - DNA, 14 bp, Homo sapiens
attcccctgtgtca

SEQ ID NO: 2313019 - DNA, 23 bp, Homo sapiens
attcccttttcaccttttcagga

SEQ ID NO: 2313020 - DNA, 20 bp, Homo sapiens
attcctaacacagcatgtgt

SEQ ID NO: 2313021 - DNA, 14 bp, Homo sapiens
attcctcctgctca

SEQ ID NO: 2313022 - DNA, 20 bp, Homo sapiens
attcctcctgctcatattgt

SEQ ID NO: 2313023 - DNA, 21 bp, Homo sapiens
attcctgtactgtgtctcatg

SEQ ID NO: 2313024 - DNA, 14 bp, Homo sapiens
attccttctttgat

SEQ ID NO: 2313025 - DNA, 15 bp, Homo sapiens
attccttctttgata

SEQ ID NO: 2313026 - DNA, 21 bp, Homo sapiens
attccttctttgataatgtta

SEQ ID NO: 2313027 - DNA, 17 bp, Homo sapiens
attcctttaaaatattg

SEQ ID NO: 2313028 - DNA, 19 bp, Homo sapiens
attcgttgtgttttttaag

SEQ ID NO: 2313029 - DNA, 14 bp, Homo sapiens
attctaaagctcaa

SEQ ID NO: 2313030 - DNA, 19 bp, Homo sapiens
attctatccatctcctggt

SEQ ID NO: 2313031 - DNA, 22 bp, Homo sapiens
attctcaagacctgagtatttt

SEQ ID NO: 2313032 - DNA, 23 bp, Homo sapiens
attctcacataagcccagttcat

SEQ ID NO: 2313033 - DNA, 13 bp, Homo sapiens
attctcactgcta

SEQ ID NO: 2313034 - DNA, 13 bp, Homo sapiens
attctcaggcacc

SEQ ID NO: 2313035 - DNA, 21 bp, Homo sapiens
attctcccaggtaccagctgc

SEQ ID NO: 2313036 - DNA, 24 bp, Homo sapiens
attctcccaggtaccagctgcgct

SEQ ID NO: 2313037 - DNA, 19 bp, Homo sapiens
attctctgtaagtgtagct

SEQ ID NO: 2313038 - DNA, 22 bp, Homo sapiens
attctctgtaagtgtagctcaa

SEQ ID NO: 2313039 - DNA, 14 bp, Homo sapiens
attctgaatctcaa

SEQ ID NO: 2313040 - DNA, 23 bp, Homo sapiens
attctgaattaattaatttggag

SEQ ID NO: 2313041 - DNA, 22 bp, Homo sapiens
attctgattctggctttaagcc

SEQ ID NO: 2313042 - DNA, 14 bp, Homo sapiens
attctgcctctctg

SEQ ID NO: 2313043 - DNA, 12 bp, Homo sapiens
attctggacctc

SEQ ID NO: 2313044 - DNA, 16 bp, Homo sapiens
attcttatttcattta

SEQ ID NO: 2313045 - DNA, 13 bp, Homo sapiens
attcttctgaact

SEQ ID NO: 2313046 - DNA, 14 bp, Homo sapiens
attcttctttcttt

SEQ ID NO: 2313047 - DNA, 17 bp, Homo sapiens
attcttgattcctggct

SEQ ID NO: 2313048 - DNA, 22 bp, Homo sapiens
attcttgttgctgtacaaaagc

SEQ ID NO: 2313049 - DNA, 15 bp, Homo sapiens
attctttcagttctt

SEQ ID NO: 2313050 - DNA, 16 bp, Homo sapiens
attctttccattatga

SEQ ID NO: 2313051 - DNA, 21 bp, Homo sapiens
attctttccattatgattctt

SEQ ID NO: 2313052 - DNA, 22 bp, Homo sapiens
attctttccattatgattcttt

SEQ ID NO: 2313053 - DNA, 21 bp, Homo sapiens
attctttggagttaaaatgca

SEQ ID NO: 2313054 - DNA, 16 bp, Homo sapiens
attcttttaaaattca

SEQ ID NO: 2313055 - DNA, 20 bp, Homo sapiens
attcttttaaaattcaaaag

SEQ ID NO: 2313056 - DNA, 13 bp, Homo sapiens
attcttttctcag

SEQ ID NO: 2313057 - DNA, 20 bp, Homo sapiens
ccacctgccttggcctccca

SEQ ID NO: 2313058 - DNA, 18 bp, Homo sapiens
ccacctggctctcacctc

SEQ ID NO: 2313059 - DNA, 15 bp, Homo sapiens
ccaccttgccagggc

SEQ ID NO: 2313060 - DNA, 18 bp, Homo sapiens
ccaccttgccagggcagg

SEQ ID NO: 2313061 - DNA, 19 bp, Homo sapiens
ccaccttgccagggcaggg

SEQ ID NO: 2313062 - DNA, 20 bp, Homo sapiens
ccacgcccgactagcaggca

SEQ ID NO: 2313063 - DNA, 15 bp, Homo sapiens
ccacgcgtgccgtgg

SEQ ID NO: 2313064 - DNA, 14 bp, Homo sapiens
ccacgcttctccgg

SEQ ID NO: 2313065 - DNA, 14 bp, Homo sapiens
ccactaaaaatatt

SEQ ID NO: 2313066 - DNA, 16 bp, Homo sapiens
ccactaaaaatattgt

SEQ ID NO: 2313067 - DNA, 15 bp, Homo sapiens
ccactccctgggaca

SEQ ID NO: 2313068 - DNA, 20 bp, Homo sapiens
ccactcccttgctggcccca

SEQ ID NO: 2313069 - DNA, 14 bp, Homo sapiens
ccactcctgtccct

SEQ ID NO: 2313070 - DNA, 18 bp, Homo sapiens
ccactcgtgcatccctga

SEQ ID NO: 2313071 - DNA, 21 bp, Homo sapiens
ccactctgccccttgccctcc

SEQ ID NO: 2313072 - DNA, 11 bp, Homo sapiens
ccactctggaa

SEQ ID NO: 2313073 - DNA, 17 bp, Homo sapiens
ccactgagaggacagag

SEQ ID NO: 2313074 - DNA, 18 bp, Homo sapiens
ccactgagaggacagaga

SEQ ID NO: 2313075 - DNA, 13 bp, Homo sapiens
ccactgccagcag

SEQ ID NO: 2313076 - DNA, 14 bp, Homo sapiens
ccactgcttctctt

SEQ ID NO: 2313077 - DNA, 14 bp, Homo sapiens
ccactgtccgcctc

SEQ ID NO: 2313078 - DNA, 15 bp, Homo sapiens
ccactgtccgcctct

SEQ ID NO: 2313079 - DNA, 19 bp, Homo sapiens
ccactgtctccacccacct

SEQ ID NO: 2313080 - DNA, 14 bp, Homo sapiens
ccactgtgccactg

SEQ ID NO: 2313081 - DNA, 18 bp, Homo sapiens
ccactgtgccactgactt

SEQ ID NO: 2313082 - DNA, 16 bp, Homo sapiens
ccactgtgttccttcc

SEQ ID NO: 2313083 - DNA, 19 bp, Homo sapiens
ccactgtttctcttgagct

SEQ ID NO: 2313084 - DNA, 17 bp, Homo sapiens
ccacttgtcaagttcag

SEQ ID NO: 2313085 - DNA, 19 bp, Homo sapiens
ccactttacccacctagaa

SEQ ID NO: 2313086 - DNA, 14 bp, Homo sapiens
ccactttcccacac

SEQ ID NO: 2313087 - DNA, 15 bp, Homo sapiens
ccagaaagcctctct

SEQ ID NO: 2313088 - DNA, 23 bp, Homo sapiens
ccagaaagggtgccagttgggct

SEQ ID NO: 2313089 - DNA, 16 bp, Homo sapiens
ccagaacgtggtttgc

SEQ ID NO: 2313090 - DNA, 17 bp, Homo sapiens
ccagaacttagccttta

SEQ ID NO: 2313091 - DNA, 18 bp, Homo sapiens
ccagaattggtaaaaaca

SEQ ID NO: 2313092 - DNA, 18 bp, Homo sapiens
ccagacaaaatttgagaa

SEQ ID NO: 2313093 - DNA, 20 bp, Homo sapiens
ccagacagggtgggcttcct

SEQ ID NO: 2313094 - DNA, 18 bp, Homo sapiens
ccagacataaaggaaaag

SEQ ID NO: 2313095 - DNA, 18 bp, Homo sapiens
ccagacctagcaggctgt

SEQ ID NO: 2313096 - DNA, 21 bp, Homo sapiens
ccagactaaaggatccagaga

SEQ ID NO: 2313097 - DNA, 17 bp, Homo sapiens
ccagagacagaggatgt

SEQ ID NO: 2313098 - DNA, 16 bp, Homo sapiens
ccagagagcagctccc

SEQ ID NO: 2313099 - DNA, 18 bp, Homo sapiens
ccagagcagatgcagaga

SEQ ID NO: 2313100 - DNA, 20 bp, Homo sapiens
ccagagcagatgcagagagc

SEQ ID NO: 2313101 - DNA, 22 bp, Homo sapiens
ccagagccagaaagggtgccag

SEQ ID NO: 2313102 - DNA, 13 bp, Homo sapiens
ccagagctgcctg

SEQ ID NO: 2313103 - DNA, 18 bp, Homo sapiens
ccagagctggtggaccca

SEQ ID NO: 2313104 - DNA, 22 bp, Homo sapiens
ccagagctggtggacccaggga

SEQ ID NO: 2313105 - DNA, 14 bp, Homo sapiens
ccagaggctgggag

SEQ ID NO: 2313106 - DNA, 15 bp, Homo sapiens
ccagaggctgggagt

SEQ ID NO: 2313107 - DNA, 17 bp, Homo sapiens
ccagaggctgggagtcc

SEQ ID NO: 2313108 - DNA, 18 bp, Homo sapiens
ccagaggctgggagtccc

SEQ ID NO: 2313109 - DNA, 13 bp, Homo sapiens
ccagagggcatgc

SEQ ID NO: 2313110 - DNA, 19 bp, Homo sapiens
ccagaggtaacagaacagc

SEQ ID NO: 2313111 - DNA, 19 bp, Homo sapiens
ccagaggttgtgcactgtt

SEQ ID NO: 2313112 - DNA, 13 bp, Homo sapiens
ccagagtggccca

SEQ ID NO: 2313113 - DNA, 18 bp, Homo sapiens
ccagataactctctttcc

SEQ ID NO: 2313114 - DNA, 24 bp, Homo sapiens
ccagataactctctttccttgagc

SEQ ID NO: 2313115 - DNA, 16 bp, Homo sapiens
ccagatcactgccaca

SEQ ID NO: 2313116 - DNA, 23 bp, Homo sapiens
ccagatctgatttgtaacccact

SEQ ID NO: 2313117 - DNA, 13 bp, Homo sapiens
ccagatctttctc

SEQ ID NO: 2313118 - DNA, 16 bp, Homo sapiens
ccagatctttctcttc

SEQ ID NO: 2313119 - DNA, 21 bp, Homo sapiens
ccagatctttctcttccctga

SEQ ID NO: 2313120 - DNA, 13 bp, Homo sapiens
ccagatgccctgt

SEQ ID NO: 2313121 - DNA, 16 bp, Homo sapiens
ccagattcccctgtgt

SEQ ID NO: 2313122 - DNA, 17 bp, Homo sapiens
ccagattcccctgtgtc

SEQ ID NO: 2313123 - DNA, 14 bp, Homo sapiens
ccagattctgatgc

SEQ ID NO: 2313124 - DNA, 17 bp, Homo sapiens
cctagcaggctgttcca

SEQ ID NO: 2313125 - DNA, 14 bp, Homo sapiens
cctagcccttccct

SEQ ID NO: 2313126 - DNA, 16 bp, Homo sapiens
cctagctctcccagtg

SEQ ID NO: 2313127 - DNA, 17 bp, Homo sapiens
cctagctctcccagtga

SEQ ID NO: 2313128 - DNA, 18 bp, Homo sapiens
cctagctctcccagtgaa

SEQ ID NO: 2313129 - DNA, 14 bp, Homo sapiens
cctagctggctctg

SEQ ID NO: 2313130 - DNA, 18 bp, Homo sapiens
cctagctttagaccctgg

SEQ ID NO: 2313131 - DNA, 16 bp, Homo sapiens
cctaggaaactcacac

SEQ ID NO: 2313132 - DNA, 19 bp, Homo sapiens
cctaggaggaaaattccat

SEQ ID NO: 2313133 - DNA, 16 bp, Homo sapiens
cctaggcattctggac

SEQ ID NO: 2313134 - DNA, 14 bp, Homo sapiens
cctaggtctccagt

SEQ ID NO: 2313135 - DNA, 15 bp, Homo sapiens
cctagttaaagaaag

SEQ ID NO: 2313136 - DNA, 20 bp, Homo sapiens
cctagttaaagaaaggaaaa

SEQ ID NO: 2313137 - DNA, 17 bp, Homo sapiens
cctagtttgtgagaaac

SEQ ID NO: 2313138 - DNA, 15 bp, Homo sapiens
cctatcccaaatgtg

SEQ ID NO: 2313139 - DNA, 18 bp, Homo sapiens
cctatccttggagagcag

SEQ ID NO: 2313140 - DNA, 14 bp, Homo sapiens
cctatctcccacaa

SEQ ID NO: 2313141 - DNA, 14 bp, Homo sapiens
cctatctcctgaca

SEQ ID NO: 2313142 - DNA, 14 bp, Homo sapiens
cctatgcacatatg

SEQ ID NO: 2313143 - DNA, 21 bp, Homo sapiens
cctatgccaagtccctggaaa

SEQ ID NO: 2313144 - DNA, 18 bp, Homo sapiens
cctatgcttaataaaaga

SEQ ID NO: 2313145 - DNA, 21 bp, Homo sapiens
cctatgcttaataaaagaaca

SEQ ID NO: 2313146 - DNA, 20 bp, Homo sapiens
cctgctggaaaccacacttc

SEQ ID NO: 2313147 - DNA, 14 bp, Homo sapiens
cctgctggaagccc

SEQ ID NO: 2313148 - DNA, 22 bp, Homo sapiens
cctgctggaggcctcaggtgct

SEQ ID NO: 2313149 - DNA, 21 bp, Homo sapiens
cctgctggggatccccgcctg

SEQ ID NO: 2313150 - DNA, 20 bp, Homo sapiens
cctgctgtgattccactaca

SEQ ID NO: 2313151 - DNA, 21 bp, Homo sapiens
cctgctgtgcctcgcatccta

SEQ ID NO: 2313152 - DNA, 14 bp, Homo sapiens
cctgcttccaggaa

SEQ ID NO: 2313153 - DNA, 21 bp, Homo sapiens
cctgcttccaggaaactccac

SEQ ID NO: 2313154 - DNA, 15 bp, Homo sapiens
cctgctttttggaaa

SEQ ID NO: 2313155 - DNA, 15 bp, Homo sapiens
cctggaagagcccag

SEQ ID NO: 2313156 - DNA, 16 bp, Homo sapiens
cctggaagagcccagt

SEQ ID NO: 2313157 - DNA, 18 bp, Homo sapiens
cctggaagagcccagtct

SEQ ID NO: 2313158 - DNA, 20 bp, Homo sapiens
cctggactaaaggcatcctt

SEQ ID NO: 2313159 - DNA, 13 bp, Homo sapiens
cctggacttgcct

SEQ ID NO: 2313160 - DNA, 15 bp, Homo sapiens
cctggagaagcacca

SEQ ID NO: 2313161 - DNA, 17 bp, Homo sapiens
cctggagacaaggtgct

SEQ ID NO: 2313162 - DNA, 21 bp, Homo sapiens
cctggcacagtttttgtaaag

SEQ ID NO: 2313163 - DNA, 13 bp, Homo sapiens
cctggcactggga

SEQ ID NO: 2313164 - DNA, 22 bp, Homo sapiens
cctggccaccagccatcctccc

SEQ ID NO: 2313165 - DNA, 12 bp, Homo sapiens
cctggccagatt

SEQ ID NO: 2313166 - DNA, 13 bp, Homo sapiens
cctggccaggagc

SEQ ID NO: 2313167 - DNA, 15 bp, Homo sapiens
cctggccccagcctg

SEQ ID NO: 2313168 - DNA, 20 bp, Homo sapiens
cctggcccccaacctcaggg

SEQ ID NO: 2313169 - DNA, 20 bp, Homo sapiens
cctggccgcttctccccaga

SEQ ID NO: 2313170 - DNA, 13 bp, Homo sapiens
cctggcctggcac

SEQ ID NO: 2313171 - DNA, 23 bp, Homo sapiens
cctggcgcaggtgggctggactt

SEQ ID NO: 2313172 - DNA, 15 bp, Homo sapiens
cctggctccctcctc

SEQ ID NO: 2313173 - DNA, 20 bp, Homo sapiens
cctggctccctcctccaggc

SEQ ID NO: 2313174 - DNA, 23 bp, Homo sapiens
cctggctccctcctccaggcctg

SEQ ID NO: 2313175 - DNA, 16 bp, Homo sapiens
cctggctgaggttcct

SEQ ID NO: 2313176 - DNA, 22 bp, Homo sapiens
cctggctgaggttcctctgcct

SEQ ID NO: 2313177 - DNA, 23 bp, Homo sapiens
cctggctgaggttcctctgcctg

SEQ ID NO: 2313178 - DNA, 13 bp, Homo sapiens
cctggctgccggc

SEQ ID NO: 2313179 - DNA, 16 bp, Homo sapiens
cctggctgctgccccc

SEQ ID NO: 2313180 - DNA, 17 bp, Homo sapiens
cctggctgctgccccca

SEQ ID NO: 2313181 - DNA, 21 bp, Homo sapiens
cctggctgctgcccccacccc

SEQ ID NO: 2313182 - DNA, 22 bp, Homo sapiens
cctggctgctgcccccaccccg

SEQ ID NO: 2313183 - DNA, 18 bp, Homo sapiens
cctggctggaggagcagc

SEQ ID NO: 2313184 - DNA, 21 bp, Homo sapiens
cctggctggaggagcagcagc

SEQ ID NO: 2313185 - DNA, 18 bp, Homo sapiens
cctgggacaactgctccc

SEQ ID NO: 2313186 - DNA, 23 bp, Homo sapiens
cctgggacaactgctcccacctc

SEQ ID NO: 2313187 - DNA, 12 bp, Homo sapiens
cctgggacacag

SEQ ID NO: 2313188 - DNA, 16 bp, Homo sapiens
cctgggacacagaccc

SEQ ID NO: 2313189 - DNA, 17 bp, Homo sapiens
cctgggacacagaccca

SEQ ID NO: 2313190 - DNA, 14 bp, Homo sapiens
cctgggacttccat

SEQ ID NO: 2313191 - DNA, 20 bp, Homo sapiens
cctgggacttccatgcctta

SEQ ID NO: 2313192 - DNA, 22 bp, Homo sapiens
cctgggagaatcgctcctgcag

SEQ ID NO: 2313193 - DNA, 15 bp, Homo sapiens
cctgggatttgagat

SEQ ID NO: 2313194 - DNA, 20 bp, Homo sapiens
cctgggcacgcactgggttg

SEQ ID NO: 2313195 - DNA, 17 bp, Homo sapiens
cctgggcactccgcgcc

SEQ ID NO: 2313196 - DNA, 13 bp, Homo sapiens
cctgggcagggca

SEQ ID NO: 2313197 - DNA, 17 bp, Homo sapiens
cctgggcttggcctgct

SEQ ID NO: 2313198 - DNA, 19 bp, Homo sapiens
cctgggcttggcctgctgt

SEQ ID NO: 2313199 - DNA, 20 bp, Homo sapiens
cctgggcttggcctgctgtg

SEQ ID NO: 2313200 - DNA, 18 bp, Homo sapiens
cctggggcctgactgctc

SEQ ID NO: 2313201 - DNA, 17 bp, Homo sapiens
cctgggggcctgggttg

SEQ ID NO: 2313202 - DNA, 19 bp, Homo sapiens
cctgggtcaaaaaaaagaa

SEQ ID NO: 2313203 - DNA, 15 bp, Homo sapiens
cctgggtgggctctg

SEQ ID NO: 2313204 - DNA, 18 bp, Homo sapiens
cctggtatatccaaaagc

SEQ ID NO: 2313205 - DNA, 19 bp, Homo sapiens
cctggtgaggcccagcctg

SEQ ID NO: 2313206 - DNA, 18 bp, Homo sapiens
cctggttattgatgtggc

SEQ ID NO: 2313207 - DNA, 16 bp, Homo sapiens
cctgtaatcccagcac

SEQ ID NO: 2313208 - DNA, 13 bp, Homo sapiens
cctgtagctcagt

SEQ ID NO: 2313209 - DNA, 16 bp, Homo sapiens
cctgtagctcagtcat

SEQ ID NO: 2313210 - DNA, 17 bp, Homo sapiens
cctgtagctcagtcatc

SEQ ID NO: 2313211 - DNA, 13 bp, Homo sapiens
cctgtagtcccag

SEQ ID NO: 2313212 - DNA, 19 bp, Homo sapiens
cctgtagttgcgtggactc

SEQ ID NO: 2313213 - DNA, 12 bp, Homo sapiens
cctgtccctgag

SEQ ID NO: 2313214 - DNA, 13 bp, Homo sapiens
cctgtccctgtag

SEQ ID NO: 2313215 - DNA, 12 bp, Homo sapiens
cctgtctgcccc

SEQ ID NO: 2313216 - DNA, 22 bp, Homo sapiens
cctgtctgtcccttttctttga

SEQ ID NO: 2313217 - DNA, 17 bp, Homo sapiens
cctgtcttatcctccac

SEQ ID NO: 2313218 - DNA, 18 bp, Homo sapiens
cctgtgcacaccccactc

SEQ ID NO: 2313219 - DNA, 17 bp, Homo sapiens
cctgtgcctggccccag

SEQ ID NO: 2313220 - DNA, 22 bp, Homo sapiens
cctgtgctcccctgccacactg

SEQ ID NO: 2313221 - DNA, 19 bp, Homo sapiens
cctgtggaaggcagagaaa

SEQ ID NO: 2313222 - DNA, 14 bp, Homo sapiens
cctgtggggcctga

SEQ ID NO: 2313223 - DNA, 21 bp, Homo sapiens
cctgtggggtcaacccttctg

SEQ ID NO: 2313224 - DNA, 13 bp, Homo sapiens
cctgtgtcctgaa

SEQ ID NO: 2313225 - DNA, 19 bp, Homo sapiens
cctgttacctactttgact

SEQ ID NO: 2313226 - DNA, 15 bp, Homo sapiens
cctgttccctggagt

SEQ ID NO: 2313227 - DNA, 16 bp, Homo sapiens
cctgttgattatcttc

SEQ ID NO: 2313228 - DNA, 16 bp, Homo sapiens
ccttaaaaccaaagag

SEQ ID NO: 2313229 - DNA, 16 bp, Homo sapiens
ccttaagcaaattttg

SEQ ID NO: 2313230 - DNA, 20 bp, Homo sapiens
ccttaatttcctttttgaca

SEQ ID NO: 2313231 - DNA, 15 bp, Homo sapiens
ccttaccgtcttgat

SEQ ID NO: 2313232 - DNA, 14 bp, Homo sapiens
ccttaggcctctga

SEQ ID NO: 2313233 - DNA, 20 bp, Homo sapiens
ccttattgcctcccaggcaa

SEQ ID NO: 2313234 - DNA, 18 bp, Homo sapiens
ccttattgctgtcctgga

SEQ ID NO: 2313235 - DNA, 19 bp, Homo sapiens
ccttcactgtcaccaccct

SEQ ID NO: 2313236 - DNA, 22 bp, Homo sapiens
ccttcatcttcctgtgtcctga

SEQ ID NO: 2313237 - DNA, 20 bp, Homo sapiens
ccttccagatcactgccaca

SEQ ID NO: 2313238 - DNA, 24 bp, Homo sapiens
ccttccatccatctttccatccat

SEQ ID NO: 2313239 - DNA, 16 bp, Homo sapiens
ccttcccacatgcctg

SEQ ID NO: 2313240 - DNA, 20 bp, Homo sapiens
ccttcccacatgcctgcgcc

SEQ ID NO: 2313241 - DNA, 22 bp, Homo sapiens
ccttccccagctttgctgcctg

SEQ ID NO: 2313242 - DNA, 11 bp, Homo sapiens
ccttccctctc

SEQ ID NO: 2313243 - DNA, 16 bp, Homo sapiens
ccttcctggcctgaga

SEQ ID NO: 2313244 - DNA, 13 bp, Homo sapiens
ccttcctgtccct

SEQ ID NO: 2313245 - DNA, 16 bp, Homo sapiens
ccttcctgtccctgag

SEQ ID NO: 2313246 - DNA, 18 bp, Homo sapiens
ccttcctgtccctgaggt

SEQ ID NO: 2313247 - DNA, 15 bp, Homo sapiens
cccccagtccccacc

SEQ ID NO: 2313248 - DNA, 15 bp, Homo sapiens
ccccctccccccaga

SEQ ID NO: 2313249 - DNA, 18 bp, Homo sapiens
cccccttgaatctgcagg

SEQ ID NO: 2313250 - DNA, 23 bp, Homo sapiens
cccccttgaatctgcagggagca

SEQ ID NO: 2313251 - DNA, 20 bp, Homo sapiens
ccccctttagatctctgaag

SEQ ID NO: 2313252 - DNA, 17 bp, Homo sapiens
ccccgaggtaggggtgg

SEQ ID NO: 2313253 - DNA, 13 bp, Homo sapiens
ccccgcctggcca

SEQ ID NO: 2313254 - DNA, 15 bp, Homo sapiens
ccccgggatattata

SEQ ID NO: 2313255 - DNA, 17 bp, Homo sapiens
ccccggggaccctgtga

SEQ ID NO: 2313256 - DNA, 15 bp, Homo sapiens
ccccggtggctgggc

SEQ ID NO: 2313257 - DNA, 17 bp, Homo sapiens
cccctccggactggtgc

SEQ ID NO: 2313258 - DNA, 13 bp, Homo sapiens
cccctcctccagg

SEQ ID NO: 2313259 - DNA, 16 bp, Homo sapiens
cccctcttcctccctg

SEQ ID NO: 2313260 - DNA, 13 bp, Homo sapiens
cccctgccctgca

SEQ ID NO: 2313261 - DNA, 12 bp, Homo sapiens
cccctgccctgt

SEQ ID NO: 2313262 - DNA, 14 bp, Homo sapiens
cccctgccctgtgg

SEQ ID NO: 2313263 - DNA, 18 bp, Homo sapiens
cccctggaagagcccagt

SEQ ID NO: 2313264 - DNA, 20 bp, Homo sapiens
cccctggaagagcccagtct

SEQ ID NO: 2313265 - DNA, 22 bp, Homo sapiens
cccctggaagagcccagtctgt

SEQ ID NO: 2313266 - DNA, 15 bp, Homo sapiens
cccctggacctggga

SEQ ID NO: 2313267 - DNA, 18 bp, Homo sapiens
cccctgggcttggcctgc

SEQ ID NO: 2313268 - DNA, 19 bp, Homo sapiens
cccctgggcttggcctgct

SEQ ID NO: 2313269 - DNA, 20 bp, Homo sapiens
cccctgggcttggcctgctg

SEQ ID NO: 2313270 - DNA, 22 bp, Homo sapiens
cccctgggcttggcctgctgtg

SEQ ID NO: 2313271 - DNA, 23 bp, Homo sapiens
cccctgggcttggcctgctgtga

SEQ ID NO: 2313272 - DNA, 14 bp, Homo sapiens
cccctggggcccag

SEQ ID NO: 2313273 - DNA, 21 bp, Homo sapiens
cccctgtgctcccctgccaca

SEQ ID NO: 2313274 - DNA, 18 bp, Homo sapiens
ccccttccaaatgtccct

SEQ ID NO: 2313275 - DNA, 18 bp, Homo sapiens
ccccttctatttggggct

SEQ ID NO: 2313276 - DNA, 20 bp, Homo sapiens
cccctttaccctctttgctg

SEQ ID NO: 2313277 - DNA, 14 bp, Homo sapiens
cccctttcccaccc

SEQ ID NO: 2313278 - DNA, 16 bp, Homo sapiens
cccgcccatgctgtcc

SEQ ID NO: 2313279 - DNA, 13 bp, Homo sapiens
cccgccccagagt

SEQ ID NO: 2313280 - DNA, 22 bp, Homo sapiens
ccctggctgttctgtggttcct

SEQ ID NO: 2313281 - DNA, 21 bp, Homo sapiens
ccctgggacacagacccagga

SEQ ID NO: 2313282 - DNA, 24 bp, Homo sapiens
ccctgggagaatcgctcctgcagc

SEQ ID NO: 2313283 - DNA, 13 bp, Homo sapiens
ccctgggcagggc

SEQ ID NO: 2313284 - DNA, 18 bp, Homo sapiens
ccctgggctgggtgctgg

SEQ ID NO: 2313285 - DNA, 13 bp, Homo sapiens
ccctggggcccag

SEQ ID NO: 2313286 - DNA, 17 bp, Homo sapiens
ccctggggcccagcccc

SEQ ID NO: 2313287 - DNA, 18 bp, Homo sapiens
ccctggggcccagcccct

SEQ ID NO: 2313288 - DNA, 14 bp, Homo sapiens
ccctggggcctgac

SEQ ID NO: 2313289 - DNA, 16 bp, Homo sapiens
ccctgtagctcagtca

SEQ ID NO: 2313290 - DNA, 22 bp, Homo sapiens
ccctgtcaaatatcagttaccc

SEQ ID NO: 2313291 - DNA, 22 bp, Homo sapiens
ccctgtccaaaagcgccctcac

SEQ ID NO: 2313292 - DNA, 23 bp, Homo sapiens
ccctgtccaaaagcgccctcact

SEQ ID NO: 2313293 - DNA, 12 bp, Homo sapiens
ccctgtcccagg

SEQ ID NO: 2313294 - DNA, 16 bp, Homo sapiens
ccctgtcccaggccgg

SEQ ID NO: 2313295 - DNA, 19 bp, Homo sapiens
ccctgtgacatggtgcctg

SEQ ID NO: 2313296 - DNA, 20 bp, Homo sapiens
ccctgtgacatggtgcctga

SEQ ID NO: 2313297 - DNA, 22 bp, Homo sapiens
ccctgtgacatggtgcctgaga

SEQ ID NO: 2313298 - DNA, 24 bp, Homo sapiens
ccctgtgacatggtgcctgagagg

SEQ ID NO: 2313299 - DNA, 20 bp, Homo sapiens
ccctgtgctcccctgccaca

SEQ ID NO: 2313300 - DNA, 22 bp, Homo sapiens
ccctgtgctcccctgccacact

SEQ ID NO: 2313301 - DNA, 16 bp, Homo sapiens
ccctgttatctgctag

SEQ ID NO: 2313302 - DNA, 17 bp, Homo sapiens
ccctgttatctgctaga

SEQ ID NO: 2313303 - DNA, 16 bp, Homo sapiens
ccctgttcctgctgct

SEQ ID NO: 2313304 - DNA, 17 bp, Homo sapiens
ccctgttcctgctgctg

SEQ ID NO: 2313305 - DNA, 20 bp, Homo sapiens
ccctgttcctgctgctgtct

SEQ ID NO: 2313306 - DNA, 13 bp, Homo sapiens
catgcccaccccc

SEQ ID NO: 2313307 - DNA, 18 bp, Homo sapiens
catgcccaccccctgccc

SEQ ID NO: 2313308 - DNA, 21 bp, Homo sapiens
catgcccaccccctgccctgc

SEQ ID NO: 2313309 - DNA, 14 bp, Homo sapiens
catgcccagctctc

SEQ ID NO: 2313310 - DNA, 17 bp, Homo sapiens
catgcccagctctctga

SEQ ID NO: 2313311 - DNA, 19 bp, Homo sapiens
catgcccagctctctgacg

SEQ ID NO: 2313312 - DNA, 16 bp, Homo sapiens
catgcctgcgcctgct

SEQ ID NO: 2313313 - DNA, 16 bp, Homo sapiens
catgcgtgtttctgac

SEQ ID NO: 2313314 - DNA, 17 bp, Homo sapiens
catgcgtgtttctgact

SEQ ID NO: 2313315 - DNA, 12 bp, Homo sapiens
catgctccaaat

SEQ ID NO: 2313316 - DNA, 13 bp, Homo sapiens
catgctgaatgcc

SEQ ID NO: 2313317 - DNA, 22 bp, Homo sapiens
catgctgaatgccccctgctta

SEQ ID NO: 2313318 - DNA, 16 bp, Homo sapiens
catgctggcggcgcag

SEQ ID NO: 2313319 - DNA, 22 bp, Homo sapiens
catgctggcggcgcagagggaa

SEQ ID NO: 2313320 - DNA, 23 bp, Homo sapiens
catgctggcggcgcagagggaag

SEQ ID NO: 2313321 - DNA, 21 bp, Homo sapiens
catgcttaaataaaaattatg

SEQ ID NO: 2313322 - DNA, 15 bp, Homo sapiens
catgcttcctttctc

SEQ ID NO: 2313323 - DNA, 18 bp, Homo sapiens
catgcttcctttctctcc

SEQ ID NO: 2313324 - DNA, 19 bp, Homo sapiens
catgcttcctttctctcct

SEQ ID NO: 2313325 - DNA, 21 bp, Homo sapiens
catgcttcctttctctcctgg

SEQ ID NO: 2313326 - DNA, 22 bp, Homo sapiens
catgcttcctttctctcctggc

SEQ ID NO: 2313327 - DNA, 23 bp, Homo sapiens
catgcttcctttctctcctggct

SEQ ID NO: 2313328 - DNA, 18 bp, Homo sapiens
catggaaatgaagcaggg

SEQ ID NO: 2313329 - DNA, 18 bp, Homo sapiens
catggccctgtcccaggc

SEQ ID NO: 2313330 - DNA, 19 bp, Homo sapiens
catggccctgtcccaggcc

SEQ ID NO: 2313331 - DNA, 16 bp, Homo sapiens
catggcctatgcacat

SEQ ID NO: 2313332 - DNA, 17 bp, Homo sapiens
catggcctatgcacata

SEQ ID NO: 2313333 - DNA, 20 bp, Homo sapiens
catggcctgcaaactgggaa

SEQ ID NO: 2313334 - DNA, 22 bp, Homo sapiens
catggcgccctgcctcctggag

SEQ ID NO: 2313335 - DNA, 19 bp, Homo sapiens
catggctacctcagaaaga

SEQ ID NO: 2313336 - DNA, 23 bp, Homo sapiens
catggctgtggttcctaagcctg

SEQ ID NO: 2313337 - DNA, 20 bp, Homo sapiens
catgggcccaggcctcacca

SEQ ID NO: 2313338 - DNA, 13 bp, Homo sapiens
catgggcttcact

SEQ ID NO: 2313339 - DNA, 20 bp, Homo sapiens
catgggcttcactgtataaa

SEQ ID NO: 2313340 - DNA, 17 bp, Homo sapiens
catgggggcacttgagt

SEQ ID NO: 2313341 - DNA, 19 bp, Homo sapiens
catgggggcacttgagttt

SEQ ID NO: 2313342 - DNA, 18 bp, Homo sapiens
catggtgcctgagaggca

SEQ ID NO: 2313343 - DNA, 19 bp, Homo sapiens
catggtgcctgagaggcag

SEQ ID NO: 2313344 - DNA, 21 bp, Homo sapiens
catggtgcctgagaggcaggc

SEQ ID NO: 2313345 - DNA, 15 bp, Homo sapiens
catggtgtaataaga

SEQ ID NO: 2313346 - DNA, 16 bp, Homo sapiens
catggtgtgtttgtaa

SEQ ID NO: 2313347 - DNA, 14 bp, Homo sapiens
catgtaaaatgttt

SEQ ID NO: 2313348 - DNA, 21 bp, Homo sapiens
catgtaaactatttgtggcaa

SEQ ID NO: 2313349 - DNA, 20 bp, Homo sapiens
catgtaaggtcttcttgtgt

SEQ ID NO: 2313350 - DNA, 14 bp, Homo sapiens
catgtatgaatgta

SEQ ID NO: 2313351 - DNA, 17 bp, Homo sapiens
catgtatgtaaatagct

SEQ ID NO: 2313352 - DNA, 13 bp, Homo sapiens
catgtatgtcttg

SEQ ID NO: 2313353 - DNA, 15 bp, Homo sapiens
catgtccaaagaggc

SEQ ID NO: 2313354 - DNA, 16 bp, Homo sapiens
catgtccaaagaggct

SEQ ID NO: 2313355 - DNA, 19 bp, Homo sapiens
catgtccatacactttgtt

SEQ ID NO: 2313356 - DNA, 15 bp, Homo sapiens
catgtcccctcccag

SEQ ID NO: 2313357 - DNA, 16 bp, Homo sapiens
catgtcccctcccaga

SEQ ID NO: 2313358 - DNA, 20 bp, Homo sapiens
catgtctgcagtgtgccccc

SEQ ID NO: 2313359 - DNA, 14 bp, Homo sapiens
catgtcttctccct

SEQ ID NO: 2313360 - DNA, 18 bp, Homo sapiens
cattttatcattaaaaat

SEQ ID NO: 2313361 - DNA, 21 bp, Homo sapiens
cattttccatatcctggtgcc

SEQ ID NO: 2313362 - DNA, 13 bp, Homo sapiens
cattttcctcctc

SEQ ID NO: 2313363 - DNA, 19 bp, Homo sapiens
cattttcctcctctgccta

SEQ ID NO: 2313364 - DNA, 13 bp, Homo sapiens
cattttgaaacaa

SEQ ID NO: 2313365 - DNA, 14 bp, Homo sapiens
cattttgaccatat

SEQ ID NO: 2313366 - DNA, 19 bp, Homo sapiens
cattttgggatccttcagc

SEQ ID NO: 2313367 - DNA, 23 bp, Homo sapiens
cattttgggatccttcagcacag

SEQ ID NO: 2313368 - DNA, 14 bp, Homo sapiens
cattttgtgaatgg

SEQ ID NO: 2313369 - DNA, 14 bp, Homo sapiens
catttttattatat

SEQ ID NO: 2313370 - DNA, 14 bp, Homo sapiens
catttttcaatata

SEQ ID NO: 2313371 - DNA, 15 bp, Homo sapiens
catttttcaatatat

SEQ ID NO: 2313372 - DNA, 21 bp, Homo sapiens
catttttcaatatattgaact

SEQ ID NO: 2313373 - DNA, 13 bp, Homo sapiens
catttttgtaaat

SEQ ID NO: 2313374 - DNA, 13 bp, Homo sapiens
cattttttaagct

SEQ ID NO: 2313375 - DNA, 23 bp, Homo sapiens
cattttttaatttacttgttttg

SEQ ID NO: 2313376 - DNA, 15 bp, Homo sapiens
cattttttgtctgtg

SEQ ID NO: 2313377 - DNA, 11 bp, Homo sapiens
ccaaaaacatt

SEQ ID NO: 2313378 - DNA, 22 bp, Homo sapiens
ccaaaaacatttgattaataaa

SEQ ID NO: 2313379 - DNA, 16 bp, Homo sapiens
ccaaactactgaatga

SEQ ID NO: 2313380 - DNA, 18 bp, Homo sapiens
ccaaactcttccctctct

SEQ ID NO: 2313381 - DNA, 12 bp, Homo sapiens
ccaaagaggctg

SEQ ID NO: 2313382 - DNA, 14 bp, Homo sapiens
ccaaagaggctgcc

SEQ ID NO: 2313383 - DNA, 16 bp, Homo sapiens
ccaaagaggctgcccc

SEQ ID NO: 2313384 - DNA, 23 bp, Homo sapiens
ccaaagagggatgtttggaaaaa

SEQ ID NO: 2313385 - DNA, 19 bp, Homo sapiens
ccaaagatttcatatctaa

SEQ ID NO: 2313386 - DNA, 15 bp, Homo sapiens
ccaaatataagacat

SEQ ID NO: 2313387 - DNA, 18 bp, Homo sapiens
ccaacaactctgccttta

SEQ ID NO: 2313388 - DNA, 23 bp, Homo sapiens
ccaaccctatctcctgacagaag

SEQ ID NO: 2313389 - DNA, 16 bp, Homo sapiens
ccaaccgtgtctgtct

SEQ ID NO: 2313390 - DNA, 14 bp, Homo sapiens
ccaacctcagggct

SEQ ID NO: 2313391 - DNA, 18 bp, Homo sapiens
ccaacctgcctgtgcatg

SEQ ID NO: 2313392 - DNA, 16 bp, Homo sapiens
ccaacctgctctcctc

SEQ ID NO: 2313393 - DNA, 18 bp, Homo sapiens
ccaacctgctctgtcccc

SEQ ID NO: 2313394 - DNA, 13 bp, Homo sapiens
ccaactccagcaa

SEQ ID NO: 2313395 - DNA, 22 bp, Homo sapiens
ccaagaacggcttggcagccag

SEQ ID NO: 2313396 - DNA, 21 bp, Homo sapiens
ccaagacatgtctgttctaca

SEQ ID NO: 2313397 - DNA, 13 bp, Homo sapiens
ccaagagaactcg

SEQ ID NO: 2313398 - DNA, 16 bp, Homo sapiens
ccaagattttcctctt

SEQ ID NO: 2313399 - DNA, 19 bp, Homo sapiens
ccaagattttcctcttgtg

SEQ ID NO: 2313400 - DNA, 18 bp, Homo sapiens
ccaagcaaaatctaaaat

SEQ ID NO: 2313401 - DNA, 18 bp, Homo sapiens
ccaagcaacagcctttga

SEQ ID NO: 2313402 - DNA, 22 bp, Homo sapiens
ccaagcaacagcctttgaatgt

SEQ ID NO: 2313403 - DNA, 17 bp, Homo sapiens
ccaagcaacatttgtat

SEQ ID NO: 2313404 - DNA, 16 bp, Homo sapiens
ccaagcacagagcctg

SEQ ID NO: 2313405 - DNA, 18 bp, Homo sapiens
ccaagctataaaagccca

SEQ ID NO: 2313406 - DNA, 18 bp, Homo sapiens
ccaagctttaaattatgt

SEQ ID NO: 2313407 - DNA, 14 bp, Homo sapiens
ccaaggacctgaga

SEQ ID NO: 2313408 - DNA, 23 bp, Homo sapiens
ccaaggatcggactctgcccctg

SEQ ID NO: 2313409 - DNA, 17 bp, Homo sapiens
ccaaggctgccagacat

SEQ ID NO: 2313410 - DNA, 17 bp, Homo sapiens
ccaagggttgagagcca

SEQ ID NO: 2313411 - DNA, 22 bp, Homo sapiens
ccaaggtggcagatgtcttccc

SEQ ID NO: 2313412 - DNA, 20 bp, Homo sapiens
ccaagtcaacactcttcttg

SEQ ID NO: 2313413 - DNA, 21 bp, Homo sapiens
ccaagtcaacactcttcttga

SEQ ID NO: 2313414 - DNA, 12 bp, Homo sapiens
ccaagtgcctca

SEQ ID NO: 2313415 - DNA, 22 bp, Homo sapiens
ccaagtggggtgctgggaggag

SEQ ID NO: 2313416 - DNA, 17 bp, Homo sapiens
ccaagttgtgcttgagc

SEQ ID NO: 2313417 - DNA, 22 bp, Homo sapiens
ccaatagggctgagctctctgt

SEQ ID NO: 2313418 - DNA, 16 bp, Homo sapiens
ccaatcctactaataa

SEQ ID NO: 2313419 - DNA, 12 bp, Homo sapiens
ccaatgaaatga

SEQ ID NO: 2313420 - DNA, 23 bp, Homo sapiens
ccaatgaataatggaaaatgcca

SEQ ID NO: 2313421 - DNA, 14 bp, Homo sapiens
ccaatgggaagcag

SEQ ID NO: 2313422 - DNA, 19 bp, Homo sapiens
ccaatttcaagttccaagt

SEQ ID NO: 2313423 - DNA, 19 bp, Homo sapiens
cagctacttgggaggctga

SEQ ID NO: 2313424 - DNA, 16 bp, Homo sapiens
cagctcactttttcat

SEQ ID NO: 2313425 - DNA, 20 bp, Homo sapiens
cagctcatagaattttgagt

SEQ ID NO: 2313426 - DNA, 17 bp, Homo sapiens
cagctccctcctgcaca

SEQ ID NO: 2313427 - DNA, 21 bp, Homo sapiens
cagctccctcctgcacacaga

SEQ ID NO: 2313428 - DNA, 20 bp, Homo sapiens
cagctccctttctcaggagc

SEQ ID NO: 2313429 - DNA, 20 bp, Homo sapiens
cagctctccgccaatttctc

SEQ ID NO: 2313430 - DNA, 16 bp, Homo sapiens
cagctctctgacgctt

SEQ ID NO: 2313431 - DNA, 15 bp, Homo sapiens
cagctctttccaaat

SEQ ID NO: 2313432 - DNA, 16 bp, Homo sapiens
cagctctttccaaatt

SEQ ID NO: 2313433 - DNA, 23 bp, Homo sapiens
cagctctttccaaattaaaacaa

SEQ ID NO: 2313434 - DNA, 23 bp, Homo sapiens
cagctgaggctgggggagagccg

SEQ ID NO: 2313435 - DNA, 19 bp, Homo sapiens
cagctgccctatgggcctg

SEQ ID NO: 2313436 - DNA, 20 bp, Homo sapiens
cagctgccctatgggcctgc

SEQ ID NO: 2313437 - DNA, 18 bp, Homo sapiens
cagctgctatccccatct

SEQ ID NO: 2313438 - DNA, 20 bp, Homo sapiens
cagctgctatttattttcct

SEQ ID NO: 2313439 - DNA, 18 bp, Homo sapiens
cagctgctgttctcagga

SEQ ID NO: 2313440 - DNA, 22 bp, Homo sapiens
cagctgctgttctcaggacagc

SEQ ID NO: 2313441 - DNA, 20 bp, Homo sapiens
cagctggagaaatggcatca

SEQ ID NO: 2313442 - DNA, 13 bp, Homo sapiens
cagctggcctgga

SEQ ID NO: 2313443 - DNA, 14 bp, Homo sapiens
cagctggctctcca

SEQ ID NO: 2313444 - DNA, 22 bp, Homo sapiens
cagctggggccagaggctggga

SEQ ID NO: 2313445 - DNA, 18 bp, Homo sapiens
cagctgtagctcccgagc

SEQ ID NO: 2313446 - DNA, 22 bp, Homo sapiens
cagctgtgtctgccaaacacat

SEQ ID NO: 2313447 - DNA, 19 bp, Homo sapiens
cagcttcattttatttttg

SEQ ID NO: 2313448 - DNA, 20 bp, Homo sapiens
cagcttcgtttattttcaag

SEQ ID NO: 2313449 - DNA, 21 bp, Homo sapiens
cagcttgagccgggcccctgg

SEQ ID NO: 2313450 - DNA, 20 bp, Homo sapiens
cagcttggggccaccaaagc

SEQ ID NO: 2313451 - DNA, 17 bp, Homo sapiens
cagctttccctgcctct

SEQ ID NO: 2313452 - DNA, 18 bp, Homo sapiens
cagctttgagaagccttc

SEQ ID NO: 2313453 - DNA, 19 bp, Homo sapiens
cagctttgagaagccttca

SEQ ID NO: 2313454 - DNA, 21 bp, Homo sapiens
caggaaactccacatctgcct

SEQ ID NO: 2313455 - DNA, 22 bp, Homo sapiens
caggaaactccacatctgcctt

SEQ ID NO: 2313456 - DNA, 11 bp, Homo sapiens
caggaaagagc

SEQ ID NO: 2313457 - DNA, 22 bp, Homo sapiens
caggaaatatctgtgaaggact

SEQ ID NO: 2313458 - DNA, 14 bp, Homo sapiens
caggaacaaacagg

SEQ ID NO: 2313459 - DNA, 12 bp, Homo sapiens
caggaagccaga

SEQ ID NO: 2313460 - DNA, 13 bp, Homo sapiens
caggaagccagag

SEQ ID NO: 2313461 - DNA, 17 bp, Homo sapiens
caggaagccagagcccc

SEQ ID NO: 2313462 - DNA, 16 bp, Homo sapiens
caggaaggaggggaga

SEQ ID NO: 2313463 - DNA, 22 bp, Homo sapiens
caggaaggaggggagagacagg

SEQ ID NO: 2313464 - DNA, 22 bp, Homo sapiens
caggaaggccaaaatcaagagt

SEQ ID NO: 2313465 - DNA, 15 bp, Homo sapiens
caggaattctcaaga

SEQ ID NO: 2313466 - DNA, 23 bp, Homo sapiens
caggaattctcaagacctgagta

SEQ ID NO: 2313467 - DNA, 20 bp, Homo sapiens
caggacagcatcccttccca

SEQ ID NO: 2313468 - DNA, 14 bp, Homo sapiens
caggacagcgggaa

SEQ ID NO: 2313469 - DNA, 17 bp, Homo sapiens
caggacagcgggaaaaa

SEQ ID NO: 2313470 - DNA, 19 bp, Homo sapiens
caggacatgcaataaaatt

SEQ ID NO: 2313471 - DNA, 10 bp, Homo sapiens
caggaccagc

SEQ ID NO: 2313472 - DNA, 15 bp, Homo sapiens
caggacccccgaggg

SEQ ID NO: 2313473 - DNA, 13 bp, Homo sapiens
caggacggctcct

SEQ ID NO: 2313474 - DNA, 21 bp, Homo sapiens
caggacggctcctcagagcgc

SEQ ID NO: 2313475 - DNA, 15 bp, Homo sapiens
caggagagagcagca

SEQ ID NO: 2313476 - DNA, 17 bp, Homo sapiens
caggagagagcagcact

SEQ ID NO: 2313477 - DNA, 23 bp, Homo sapiens
caggagataattgtttcattcat

SEQ ID NO: 2313478 - DNA, 15 bp, Homo sapiens
caggagatgggtcca

SEQ ID NO: 2313479 - DNA, 18 bp, Homo sapiens
caggagatgggtccaggg

SEQ ID NO: 2313480 - DNA, 23 bp, Homo sapiens
caggagcttgggcagtgccccag

SEQ ID NO: 2313481 - DNA, 22 bp, Homo sapiens
caggaggcgcccttggcttctg

SEQ ID NO: 2313482 - DNA, 15 bp, Homo sapiens
caggaggtggagaaa

SEQ ID NO: 2313483 - DNA, 17 bp, Homo sapiens
caggataaagttattct

SEQ ID NO: 2313484 - DNA, 19 bp, Homo sapiens
caggatcatggtgtaataa

SEQ ID NO: 2313485 - DNA, 21 bp, Homo sapiens
caggatcatggtgtaataaga

SEQ ID NO: 2313486 - DNA, 22 bp, Homo sapiens
caggatcatggtgtaataagac

SEQ ID NO: 2313487 - DNA, 17 bp, Homo sapiens
caggatggcctttcctt

SEQ ID NO: 2313488 - DNA, 20 bp, Homo sapiens
caggattcccttctgggctt

SEQ ID NO: 2313489 - DNA, 13 bp, Homo sapiens
caggatttaagtt

SEQ ID NO: 2313490 - DNA, 16 bp, Homo sapiens
caggatttgcacagaa

SEQ ID NO: 2313491 - DNA, 17 bp, Homo sapiens
caggcaaagaaaatgaa

SEQ ID NO: 2313492 - DNA, 16 bp, Homo sapiens
caggcaccctcaggga

SEQ ID NO: 2313493 - DNA, 13 bp, Homo sapiens
caggcaccgagaa

SEQ ID NO: 2313494 - DNA, 17 bp, Homo sapiens
caggcaccgagaatgtt

SEQ ID NO: 2313495 - DNA, 16 bp, Homo sapiens
caggcacgggtggtcc

SEQ ID NO: 2313496 - DNA, 19 bp, Homo sapiens
caggcacgggtggtccccg

SEQ ID NO: 2313497 - DNA, 23 bp, Homo sapiens
caggcacgggtggtccccgttcc

SEQ ID NO: 2313498 - DNA, 20 bp, Homo sapiens
caggcagagctggagccccc

SEQ ID NO: 2313499 - DNA, 15 bp, Homo sapiens
caggcagcccagcag

SEQ ID NO: 2313500 - DNA, 17 bp, Homo sapiens
caggcagcctcctttgt

SEQ ID NO: 2313501 - DNA, 18 bp, Homo sapiens
caggcagctccctcctgc

SEQ ID NO: 2313502 - DNA, 12 bp, Homo sapiens
caggcaggggtg

SEQ ID NO: 2313503 - DNA, 13 bp, Homo sapiens
caggcaggggtgg

SEQ ID NO: 2313504 - DNA, 14 bp, Homo sapiens
caggcatagaggct

SEQ ID NO: 2313505 - DNA, 21 bp, Homo sapiens
caggcatagaggcttctccgc

SEQ ID NO: 2313506 - DNA, 19 bp, Homo sapiens
caggccaaagtgccggtga

SEQ ID NO: 2313507 - DNA, 21 bp, Homo sapiens
caggccacctggctctcacct

SEQ ID NO: 2313508 - DNA, 15 bp, Homo sapiens
caggccagcctccga

SEQ ID NO: 2313509 - DNA, 19 bp, Homo sapiens
caggccagcctccgagagg

SEQ ID NO: 2313510 - DNA, 15 bp, Homo sapiens
caggccatttttggt

SEQ ID NO: 2313511 - DNA, 16 bp, Homo sapiens
caggccccagacaggg

SEQ ID NO: 2313512 - DNA, 14 bp, Homo sapiens
caggccctcctctc

SEQ ID NO: 2313513 - DNA, 14 bp, Homo sapiens
caggccctgactcc

SEQ ID NO: 2313514 - DNA, 15 bp, Homo sapiens
caggccctgactcct

SEQ ID NO: 2313515 - DNA, 15 bp, Homo sapiens
caggccggcccagat

SEQ ID NO: 2313516 - DNA, 12 bp, Homo sapiens
caggcctgcctc

SEQ ID NO: 2313517 - DNA, 13 bp, Homo sapiens
caggcctgcctcc

SEQ ID NO: 2313518 - DNA, 15 bp, Homo sapiens
caggcctgcctccca

SEQ ID NO: 2313519 - DNA, 15 bp, Homo sapiens
caggcgcctggtgtg

SEQ ID NO: 2313520 - DNA, 13 bp, Homo sapiens
caggctcactgcc

SEQ ID NO: 2313521 - DNA, 14 bp, Homo sapiens
caggctcactgcca

SEQ ID NO: 2313522 - DNA, 18 bp, Homo sapiens
caggctcactgccaggcc

SEQ ID NO: 2313523 - DNA, 21 bp, Homo sapiens
caggctcactgccaggccagc

SEQ ID NO: 2313524 - DNA, 23 bp, Homo sapiens
caggctcactgccaggccagcct

SEQ ID NO: 2313525 - DNA, 15 bp, Homo sapiens
caggctgaaaacaat

SEQ ID NO: 2313526 - DNA, 23 bp, Homo sapiens
caggctgagaactcgttcacctc

SEQ ID NO: 2313527 - DNA, 18 bp, Homo sapiens
caggctggagtgcagtgg

SEQ ID NO: 2313528 - DNA, 11 bp, Homo sapiens
caggctgggcc

SEQ ID NO: 2313529 - DNA, 12 bp, Homo sapiens
caggctgggcca

SEQ ID NO: 2313530 - DNA, 13 bp, Homo sapiens
caggctgtggggt

SEQ ID NO: 2313531 - DNA, 19 bp, Homo sapiens
caggctgtggggtggagca

SEQ ID NO: 2313532 - DNA, 13 bp, Homo sapiens
caggctgtttcag

SEQ ID NO: 2313533 - DNA, 14 bp, Homo sapiens
caggcttctgctgg

SEQ ID NO: 2313534 - DNA, 16 bp, Homo sapiens
cagggaattcctgggg

SEQ ID NO: 2313535 - DNA, 15 bp, Homo sapiens
cagggacacacagcc

SEQ ID NO: 2313536 - DNA, 23 bp, Homo sapiens
cagggaccggcggaccccagcca

SEQ ID NO: 2313537 - DNA, 16 bp, Homo sapiens
cagggagagctcacca

SEQ ID NO: 2313538 - DNA, 18 bp, Homo sapiens
cagtactggttactttca

SEQ ID NO: 2313539 - DNA, 22 bp, Homo sapiens
cagtagaactccaggccctcct

SEQ ID NO: 2313540 - DNA, 15 bp, Homo sapiens
cagtagaactgtctg

SEQ ID NO: 2313541 - DNA, 14 bp, Homo sapiens
cagtagagccagct

SEQ ID NO: 2313542 - DNA, 15 bp, Homo sapiens
cagtagagccagctt

SEQ ID NO: 2313543 - DNA, 18 bp, Homo sapiens
cagtagcccagagtgagc

SEQ ID NO: 2313544 - DNA, 15 bp, Homo sapiens
cagtatcccacatcc

SEQ ID NO: 2313545 - DNA, 19 bp, Homo sapiens
cagtatgtgggggcttcat

SEQ ID NO: 2313546 - DNA, 19 bp, Homo sapiens
cagtattgacaataagaaa

SEQ ID NO: 2313547 - DNA, 12 bp, Homo sapiens
cagtatttaaca

SEQ ID NO: 2313548 - DNA, 14 bp, Homo sapiens
cagtattttgtgtc

SEQ ID NO: 2313549 - DNA, 17 bp, Homo sapiens
cagtattttgtgtcctc

SEQ ID NO: 2313550 - DNA, 18 bp, Homo sapiens
cagtattttgtgtcctcc

SEQ ID NO: 2313551 - DNA, 13 bp, Homo sapiens
cagtatttttaaa

SEQ ID NO: 2313552 - DNA, 15 bp, Homo sapiens
cagtatttttaaagg

SEQ ID NO: 2313553 - DNA, 17 bp, Homo sapiens
cagtcacaacagagtga

SEQ ID NO: 2313554 - DNA, 22 bp, Homo sapiens
cagtcagagtccagtgctctgc

SEQ ID NO: 2313555 - DNA, 13 bp, Homo sapiens
cagtcatcaaagc

SEQ ID NO: 2313556 - DNA, 12 bp, Homo sapiens
cagtcatctccc

SEQ ID NO: 2313557 - DNA, 20 bp, Homo sapiens
cagtcatgcataaatatgca

SEQ ID NO: 2313558 - DNA, 15 bp, Homo sapiens
cagtccactcctgac

SEQ ID NO: 2313559 - DNA, 21 bp, Homo sapiens
cagtccactgttgagccccag

SEQ ID NO: 2313560 - DNA, 16 bp, Homo sapiens
cagtccagacccaagt

SEQ ID NO: 2313561 - DNA, 19 bp, Homo sapiens
cagtccccatttctgcctc

SEQ ID NO: 2313562 - DNA, 20 bp, Homo sapiens
cagtccccatttctgcctcg

SEQ ID NO: 2313563 - DNA, 14 bp, Homo sapiens
cagtcccctctctc

SEQ ID NO: 2313564 - DNA, 15 bp, Homo sapiens
cagtcctactcaagc

SEQ ID NO: 2313565 - DNA, 20 bp, Homo sapiens
cagtcctactcaagcgggtg

SEQ ID NO: 2313566 - DNA, 18 bp, Homo sapiens
cagtcgtgatgtggagga

SEQ ID NO: 2313567 - DNA, 17 bp, Homo sapiens
cagtcttcctgacactt

SEQ ID NO: 2313568 - DNA, 21 bp, Homo sapiens
cagtcttcctgacactttaat

SEQ ID NO: 2313569 - DNA, 16 bp, Homo sapiens
cagtctttgctcagtg

SEQ ID NO: 2313570 - DNA, 14 bp, Homo sapiens
cagtgaacattccc

SEQ ID NO: 2313571 - DNA, 15 bp, Homo sapiens
cagtgaacattccca

SEQ ID NO: 2313572 - DNA, 17 bp, Homo sapiens
cagtgaactcctgccag

SEQ ID NO: 2313573 - DNA, 14 bp, Homo sapiens
cagtgacacccaga

SEQ ID NO: 2313574 - DNA, 21 bp, Homo sapiens
cagtgacctttgacctcggtg

SEQ ID NO: 2313575 - DNA, 20 bp, Homo sapiens
cagtgagcctcctgtgcctg

SEQ ID NO: 2313576 - DNA, 18 bp, Homo sapiens
cagtgaggatgacagtga

SEQ ID NO: 2313577 - DNA, 18 bp, Homo sapiens
cagtgatgacttgctgtc

SEQ ID NO: 2313578 - DNA, 21 bp, Homo sapiens
cagtgatgacttgctgtccag

SEQ ID NO: 2313579 - DNA, 15 bp, Homo sapiens
cagtgattcatgtag

SEQ ID NO: 2313580 - DNA, 21 bp, Homo sapiens
cagtgcagtttcttttcacat

SEQ ID NO: 2313581 - DNA, 22 bp, Homo sapiens
cagtgcagtttcttttcacatt

SEQ ID NO: 2313582 - DNA, 23 bp, Homo sapiens
cagtgcatagttgtagacaaagt

SEQ ID NO: 2313583 - DNA, 17 bp, Homo sapiens
cagtgcatatgcaatgt

SEQ ID NO: 2313584 - DNA, 14 bp, Homo sapiens
cagtgccccaggga

SEQ ID NO: 2313585 - DNA, 18 bp, Homo sapiens
cagtgccccagggagtcc

SEQ ID NO: 2313586 - DNA, 19 bp, Homo sapiens
cagtgccccagggagtcca

SEQ ID NO: 2313587 - DNA, 22 bp, Homo sapiens
cagtgccccagggagtccaggg

SEQ ID NO: 2313588 - DNA, 22 bp, Homo sapiens
cagtgcctacatcccgggcctc

SEQ ID NO: 2313589 - DNA, 22 bp, Homo sapiens
cagtgccttcctgtttttcaca

SEQ ID NO: 2313590 - DNA, 16 bp, Homo sapiens
cagtgctctcagctgg

SEQ ID NO: 2313591 - DNA, 18 bp, Homo sapiens
cagtgctctgcctcagac

SEQ ID NO: 2313592 - DNA, 20 bp, Homo sapiens
cagtggcgggtgatggccag

SEQ ID NO: 2313593 - DNA, 16 bp, Homo sapiens
cagtggtaagaatagt

SEQ ID NO: 2313594 - DNA, 15 bp, Homo sapiens
cagtgtccagcttcc

SEQ ID NO: 2313595 - DNA, 19 bp, Homo sapiens
cagtgtccagcttccaaag

SEQ ID NO: 2313596 - DNA, 14 bp, Homo sapiens
cagtgtggagaccc

SEQ ID NO: 2313597 - DNA, 22 bp, Homo sapiens
cagtgtggagaccctgccacag

SEQ ID NO: 2313598 - DNA, 19 bp, Homo sapiens
cagtgttacctgtgtgctt

SEQ ID NO: 2313599 - DNA, 14 bp, Homo sapiens
cagtgttgtgcccc

SEQ ID NO: 2313600 - DNA, 18 bp, Homo sapiens
cagtgttttgcaagtgct

SEQ ID NO: 2313601 - DNA, 21 bp, Homo sapiens
cagtgttttgcaagtgctgga

SEQ ID NO: 2313602 - DNA, 18 bp, Homo sapiens
cagttaaatctcctgtgg

SEQ ID NO: 2313603 - DNA, 22 bp, Homo sapiens
cagttatgatttttttttcata

SEQ ID NO: 2313604 - DNA, 23 bp, Homo sapiens
cagttcatcaccatttcctcctt

SEQ ID NO: 2313605 - DNA, 16 bp, Homo sapiens
cagttcatcgattttc

SEQ ID NO: 2313606 - DNA, 19 bp, Homo sapiens
cagttcatcgattttctat

SEQ ID NO: 2313607 - DNA, 15 bp, Homo sapiens
cagttctttcctctt

SEQ ID NO: 2313608 - DNA, 19 bp, Homo sapiens
cagttctttcctctttctg

SEQ ID NO: 2313609 - DNA, 15 bp, Homo sapiens
cagttgatctgctct

SEQ ID NO: 2313610 - DNA, 19 bp, Homo sapiens
cagttgctcaaaaagaaat

SEQ ID NO: 2313611 - DNA, 12 bp, Homo sapiens
cagttgctgtga

SEQ ID NO: 2313612 - DNA, 18 bp, Homo sapiens
cagttggccaagcagaaa

SEQ ID NO: 2313613 - DNA, 13 bp, Homo sapiens
cagtttccaaatt

SEQ ID NO: 2313614 - DNA, 14 bp, Homo sapiens
cagtttctccttga

SEQ ID NO: 2313615 - DNA, 15 bp, Homo sapiens
cagtttcttagcttt

SEQ ID NO: 2313616 - DNA, 13 bp, Homo sapiens
cagttttccttct

SEQ ID NO: 2313617 - DNA, 21 bp, Homo sapiens
cagtttttgtaaagcccttgc

SEQ ID NO: 2313618 - DNA, 13 bp, Homo sapiens
cataaaggaaaag

SEQ ID NO: 2313619 - DNA, 19 bp, Homo sapiens
cataaattcaactttgtaa

SEQ ID NO: 2313620 - DNA, 13 bp, Homo sapiens
cataagcttccat

SEQ ID NO: 2313621 - DNA, 23 bp, Homo sapiens
cataaggctggatggcacctcag

SEQ ID NO: 2313622 - DNA, 14 bp, Homo sapiens
cataataaattttc

SEQ ID NO: 2313623 - DNA, 21 bp, Homo sapiens
cataataagagaatgttccta

SEQ ID NO: 2313624 - DNA, 19 bp, Homo sapiens
cataatcagtaaatagtgt

SEQ ID NO: 2313625 - DNA, 22 bp, Homo sapiens
cataatcttctgccttctcatg

SEQ ID NO: 2313626 - DNA, 20 bp, Homo sapiens
cataatgtactgatttcagt

SEQ ID NO: 2313627 - DNA, 23 bp, Homo sapiens
cataatgtgagatggttcccaat

SEQ ID NO: 2313628 - DNA, 13 bp, Homo sapiens
cataatttaaaaa

SEQ ID NO: 2313629 - DNA, 18 bp, Homo sapiens
cataatttaaaaatatat

SEQ ID NO: 2313630 - DNA, 17 bp, Homo sapiens
catacaaactctcacca

SEQ ID NO: 2313631 - DNA, 22 bp, Homo sapiens
catacaagaaaatgtatccaag

SEQ ID NO: 2313632 - DNA, 21 bp, Homo sapiens
catacagaggatgccttttct

SEQ ID NO: 2313633 - DNA, 13 bp, Homo sapiens
catacagctgcct

SEQ ID NO: 2313634 - DNA, 14 bp, Homo sapiens
catacagctgccta

SEQ ID NO: 2313635 - DNA, 15 bp, Homo sapiens
catacataaaagaaa

SEQ ID NO: 2313636 - DNA, 21 bp, Homo sapiens
catacattccctctaatttga

SEQ ID NO: 2313637 - DNA, 19 bp, Homo sapiens
cataccctgacctggcccc

SEQ ID NO: 2313638 - DNA, 18 bp, Homo sapiens
catactcctgggctcaag

SEQ ID NO: 2313639 - DNA, 15 bp, Homo sapiens
catactgattgggag

SEQ ID NO: 2313640 - DNA, 20 bp, Homo sapiens
catactgattgggaggtgcg

SEQ ID NO: 2313641 - DNA, 20 bp, Homo sapiens
catactttttaaatgtaaag

SEQ ID NO: 2313642 - DNA, 18 bp, Homo sapiens
catagaaaccactagaaa

SEQ ID NO: 2313643 - DNA, 13 bp, Homo sapiens
catagagatgagc

SEQ ID NO: 2313644 - DNA, 16 bp, Homo sapiens
catagagatgagccca

SEQ ID NO: 2313645 - DNA, 15 bp, Homo sapiens
catagaggcttctcc

SEQ ID NO: 2313646 - DNA, 20 bp, Homo sapiens
catagaggcttctccgccag

SEQ ID NO: 2313647 - DNA, 21 bp, Homo sapiens
catagaggcttctccgccagc

SEQ ID NO: 2313648 - DNA, 16 bp, Homo sapiens
catagataatattgtt

SEQ ID NO: 2313649 - DNA, 19 bp, Homo sapiens
catagataatattgtttgg

SEQ ID NO: 2313650 - DNA, 23 bp, Homo sapiens
catagataatattgtttggtaaa

SEQ ID NO: 2313651 - DNA, 20 bp, Homo sapiens
catagatttaagtgaataca

SEQ ID NO: 2313652 - DNA, 14 bp, Homo sapiens
catagcagtatatg

SEQ ID NO: 2313653 - DNA, 17 bp, Homo sapiens
catagcatgcttccttt

SEQ ID NO: 2313654 - DNA, 20 bp, Homo sapiens
catagcatgcttcctttctc

SEQ ID NO: 2313655 - DNA, 15 bp, Homo sapiens
catagctcactgcag

SEQ ID NO: 2313656 - DNA, 17 bp, Homo sapiens
catagctcactgcagcc

SEQ ID NO: 2313657 - DNA, 19 bp, Homo sapiens
catagtaataagatggctg

SEQ ID NO: 2313658 - DNA, 13 bp, Homo sapiens
catagtcacatgg

SEQ ID NO: 2313659 - DNA, 18 bp, Homo sapiens
catagttatttttctctt

SEQ ID NO: 2313660 - DNA, 17 bp, Homo sapiens
catagttctgtaataaa

SEQ ID NO: 2313661 - DNA, 21 bp, Homo sapiens
catagttgtagacaaagtaca

SEQ ID NO: 2313662 - DNA, 12 bp, Homo sapiens
catagtttcttt

SEQ ID NO: 2313663 - DNA, 15 bp, Homo sapiens
catagtttctttatt

SEQ ID NO: 2313664 - DNA, 23 bp, Homo sapiens
catagtttctttattttgtgtaa

SEQ ID NO: 2313665 - DNA, 16 bp, Homo sapiens
catatagacacataca

SEQ ID NO: 2313666 - DNA, 19 bp, Homo sapiens
catatagctcgagcaaaat

SEQ ID NO: 2313667 - DNA, 20 bp, Homo sapiens
catatagttgaggccgagga

SEQ ID NO: 2313668 - DNA, 14 bp, Homo sapiens
catatcctgagcca

SEQ ID NO: 2313669 - DNA, 13 bp, Homo sapiens
catatctaaatag

SEQ ID NO: 2313670 - DNA, 23 bp, Homo sapiens
catatctccatggccctgtccca

SEQ ID NO: 2313671 - DNA, 16 bp, Homo sapiens
catatgagcctgccct

SEQ ID NO: 2313672 - DNA, 18 bp, Homo sapiens
catatgcaccttgtgtct

SEQ ID NO: 2313673 - DNA, 19 bp, Homo sapiens
catatgcaccttgtgtctg

SEQ ID NO: 2313674 - DNA, 23 bp, Homo sapiens
catatgcaccttgtgtctgtaca

SEQ ID NO: 2313675 - DNA, 15 bp, Homo sapiens
catatggactctgca

SEQ ID NO: 2313676 - DNA, 18 bp, Homo sapiens
catatggactctgcacat

SEQ ID NO: 2313677 - DNA, 20 bp, Homo sapiens
catatggactctgcacatga

SEQ ID NO: 2313678 - DNA, 18 bp, Homo sapiens
catattgtgattctgcct

SEQ ID NO: 2313679 - DNA, 23 bp, Homo sapiens
catattgtgcttcacagtagagc

SEQ ID NO: 2313680 - DNA, 13 bp, Homo sapiens
catattgttgaaa

SEQ ID NO: 2313681 - DNA, 15 bp, Homo sapiens
catatttaacaaaat

SEQ ID NO: 2313682 - DNA, 14 bp, Homo sapiens
catatttgatttct

SEQ ID NO: 2313683 - DNA, 17 bp, Homo sapiens
catatttgatttctaat

SEQ ID NO: 2313684 - DNA, 18 bp, Homo sapiens
catcaaacctttgagtag

SEQ ID NO: 2313685 - DNA, 12 bp, Homo sapiens
catcaactgaat

SEQ ID NO: 2313686 - DNA, 14 bp, Homo sapiens
catcaactgaatga

SEQ ID NO: 2313687 - DNA, 17 bp, Homo sapiens
catcaatgataatgcta

SEQ ID NO: 2313688 - DNA, 22 bp, Homo sapiens
catcaatgataatgctaatttt

SEQ ID NO: 2313689 - DNA, 18 bp, Homo sapiens
catcaccatttcctcctt

SEQ ID NO: 2313690 - DNA, 16 bp, Homo sapiens
catcagaacctgagct

SEQ ID NO: 2313691 - DNA, 15 bp, Homo sapiens
catcagatgcctgct

SEQ ID NO: 2313692 - DNA, 15 bp, Homo sapiens
catcaggtgaggtgt

SEQ ID NO: 2313693 - DNA, 16 bp, Homo sapiens
catcatccagatgtgg

SEQ ID NO: 2313694 - DNA, 17 bp, Homo sapiens
catcatccagatgtggc

SEQ ID NO: 2313695 - DNA, 15 bp, Homo sapiens
catccaactccagca

SEQ ID NO: 2313696 - DNA, 16 bp, Homo sapiens
catccagatgtggcta

SEQ ID NO: 2313697 - DNA, 15 bp, Homo sapiens
catccattacctcca

SEQ ID NO: 2313698 - DNA, 18 bp, Homo sapiens
catccattacctccatcc

SEQ ID NO: 2313699 - DNA, 22 bp, Homo sapiens
catcccaggcgggcggcacgcc

SEQ ID NO: 2313700 - DNA, 20 bp, Homo sapiens
catccctccattcatccttc

SEQ ID NO: 2313701 - DNA, 13 bp, Homo sapiens
catcccttcccac

SEQ ID NO: 2313702 - DNA, 15 bp, Homo sapiens
catcctatgcttaat

SEQ ID NO: 2313703 - DNA, 22 bp, Homo sapiens
catcctatgcttaataaaagaa

SEQ ID NO: 2313704 - DNA, 11 bp, Homo sapiens
catcctccctc

SEQ ID NO: 2313705 - DNA, 14 bp, Homo sapiens
catcctcttttaat

SEQ ID NO: 2313706 - DNA, 20 bp, Homo sapiens
catcctgaccaagactgagc

SEQ ID NO: 2313707 - DNA, 22 bp, Homo sapiens
catcctgaccaagactgagcca

SEQ ID NO: 2313708 - DNA, 23 bp, Homo sapiens
catcctgtgccactaaactacat

SEQ ID NO: 2313709 - DNA, 15 bp, Homo sapiens
catctaattctgatt

SEQ ID NO: 2313710 - DNA, 13 bp, Homo sapiens
catctagccagcc

SEQ ID NO: 2313711 - DNA, 22 bp, Homo sapiens
catctagccagcccctcttccc

SEQ ID NO: 2313712 - DNA, 17 bp, Homo sapiens
catctagcctaaagtat

SEQ ID NO: 2313713 - DNA, 17 bp, Homo sapiens
catctatctagttctaa

SEQ ID NO: 2313714 - DNA, 20 bp, Homo sapiens
catctatctcatctatctca

SEQ ID NO: 2313715 - DNA, 15 bp, Homo sapiens
catctcaaaaaaaca

SEQ ID NO: 2313716 - DNA, 18 bp, Homo sapiens
catctcatgaggggagag

SEQ ID NO: 2313717 - DNA, 12 bp, Homo sapiens
catctcccaagg

SEQ ID NO: 2313718 - DNA, 15 bp, Homo sapiens
catctcccctcctgg

SEQ ID NO: 2313719 - DNA, 16 bp, Homo sapiens
catctccctgcctggc

SEQ ID NO: 2313720 - DNA, 19 bp, Homo sapiens
catctccctgcctggcccc

SEQ ID NO: 2313721 - DNA, 20 bp, Homo sapiens
catctcgctccctcccagga

SEQ ID NO: 2313722 - DNA, 22 bp, Homo sapiens
catctcgctccctcccaggact

SEQ ID NO: 2313723 - DNA, 14 bp, Homo sapiens
catctgatatcagg

SEQ ID NO: 2313724 - DNA, 23 bp, Homo sapiens
catctgcaaaaggcctcttgtaa

SEQ ID NO: 2313725 - DNA, 19 bp, Homo sapiens
catctgcaccccttctctc

SEQ ID NO: 2313726 - DNA, 22 bp, Homo sapiens
catctgtaagagcttgctccag

SEQ ID NO: 2313727 - DNA, 20 bp, Homo sapiens
catctgtccagctggggcca

SEQ ID NO: 2313728 - DNA, 15 bp, Homo sapiens
catctgttagggcct

SEQ ID NO: 2313729 - DNA, 19 bp, Homo sapiens
catctgtttgaagattata

SEQ ID NO: 2313730 - DNA, 12 bp, Homo sapiens
catcttcctgtg

SEQ ID NO: 2313731 - DNA, 18 bp, Homo sapiens
catcttcgggaccaggat

SEQ ID NO: 2313732 - DNA, 13 bp, Homo sapiens
catcttgctggct

SEQ ID NO: 2313733 - DNA, 17 bp, Homo sapiens
catctttagcgctggct

SEQ ID NO: 2313734 - DNA, 20 bp, Homo sapiens
catgaaaaacacggcagctg

SEQ ID NO: 2313735 - DNA, 13 bp, Homo sapiens
catgaaaaagcag

SEQ ID NO: 2313736 - DNA, 14 bp, Homo sapiens
catgaaaatgacat

SEQ ID NO: 2313737 - DNA, 19 bp, Homo sapiens
catgaagcaggaggccctt

SEQ ID NO: 2313738 - DNA, 18 bp, Homo sapiens
catgaatctctgcctctc

SEQ ID NO: 2313739 - DNA, 16 bp, Homo sapiens
catgacagatatttta

SEQ ID NO: 2313740 - DNA, 13 bp, Homo sapiens
catgacagcctgc

SEQ ID NO: 2313741 - DNA, 14 bp, Homo sapiens
catgacagcctgca

SEQ ID NO: 2313742 - DNA, 14 bp, Homo sapiens
catgacaggctgtt

SEQ ID NO: 2313743 - DNA, 17 bp, Homo sapiens
catgacataataaagta

SEQ ID NO: 2313744 - DNA, 16 bp, Homo sapiens
catgactaatgctttt

SEQ ID NO: 2313745 - DNA, 20 bp, Homo sapiens
catgacttccttatttctga

SEQ ID NO: 2313746 - DNA, 18 bp, Homo sapiens
catgactttatagttatg

SEQ ID NO: 2313747 - DNA, 14 bp, Homo sapiens
catgagaagccaag

SEQ ID NO: 2313748 - DNA, 21 bp, Homo sapiens
catgagaagccaagcgctcat

SEQ ID NO: 2313749 - DNA, 15 bp, Homo sapiens
catgagcctgctgga

SEQ ID NO: 2313750 - DNA, 16 bp, Homo sapiens
catgagcctgctggaa

SEQ ID NO: 2313751 - DNA, 14 bp, Homo sapiens
catgagctgctcat

SEQ ID NO: 2313752 - DNA, 18 bp, Homo sapiens
catgaggggagaggagac

SEQ ID NO: 2313753 - DNA, 21 bp, Homo sapiens
catgatcagacatacagctgc

SEQ ID NO: 2313754 - DNA, 22 bp, Homo sapiens
catgatcagacatacagctgcc

SEQ ID NO: 2313755 - DNA, 21 bp, Homo sapiens
catgatgtgaagagtttcaca

SEQ ID NO: 2313756 - DNA, 21 bp, Homo sapiens
catgattatagcaactaatgt

SEQ ID NO: 2313757 - DNA, 19 bp, Homo sapiens
catgatttagggaagcagg

SEQ ID NO: 2313758 - DNA, 21 bp, Homo sapiens
catgatttagggaagcaggga

SEQ ID NO: 2313759 - DNA, 16 bp, Homo sapiens
catgcaaaatatgttt

SEQ ID NO: 2313760 - DNA, 17 bp, Homo sapiens
catgcaaaatatgttta

SEQ ID NO: 2313761 - DNA, 14 bp, Homo sapiens
catgcaataaaatt

SEQ ID NO: 2313762 - DNA, 18 bp, Homo sapiens
catgcaataaaatttaaa

SEQ ID NO: 2313763 - DNA, 12 bp, Homo sapiens
catgcagtattt

SEQ ID NO: 2313764 - DNA, 18 bp, Homo sapiens
catgcataaactaaaaac

SEQ ID NO: 2313765 - DNA, 13 bp, Homo sapiens
catgcataaatat

SEQ ID NO: 2313766 - DNA, 18 bp, Homo sapiens
catgcatataatgaataa

SEQ ID NO: 2313767 - DNA, 20 bp, Homo sapiens
catgcatataatgaataaat

SEQ ID NO: 2313768 - DNA, 22 bp, Homo sapiens
catgcatataatgaataaatca

SEQ ID NO: 2313769 - DNA, 14 bp, Homo sapiens
catgcatgcaaatg

SEQ ID NO: 2313770 - DNA, 13 bp, Homo sapiens
catgccagctggc

SEQ ID NO: 2313771 - DNA, 18 bp, Homo sapiens
ctctggctttcccaggag

SEQ ID NO: 2313772 - DNA, 15 bp, Homo sapiens
ctctggcttttggaa

SEQ ID NO: 2313773 - DNA, 16 bp, Homo sapiens
ctctggcttttggaag

SEQ ID NO: 2313774 - DNA, 16 bp, Homo sapiens
ctctggggcgcggcca

SEQ ID NO: 2313775 - DNA, 22 bp, Homo sapiens
ctctgggttgtgcacatttctt

SEQ ID NO: 2313776 - DNA, 18 bp, Homo sapiens
ctctggtggcttaagtga

SEQ ID NO: 2313777 - DNA, 21 bp, Homo sapiens
ctctggtggcttaagtgagca

SEQ ID NO: 2313778 - DNA, 21 bp, Homo sapiens
ctctgtataatagagataagt

SEQ ID NO: 2313779 - DNA, 22 bp, Homo sapiens
ctctgtcccggttcaccttgcc

SEQ ID NO: 2313780 - DNA, 21 bp, Homo sapiens
ctctgtctaggactgcagtgt

SEQ ID NO: 2313781 - DNA, 21 bp, Homo sapiens
ctctgtcttttggagaaccag

SEQ ID NO: 2313782 - DNA, 24 bp, Homo sapiens
ctctgtgagccccacagccctgct

SEQ ID NO: 2313783 - DNA, 17 bp, Homo sapiens
ctctgtgagggtgctga

SEQ ID NO: 2313784 - DNA, 20 bp, Homo sapiens
ctctgtggctccaggccaaa

SEQ ID NO: 2313785 - DNA, 19 bp, Homo sapiens
ctctgttaacatctagcct

SEQ ID NO: 2313786 - DNA, 14 bp, Homo sapiens
ctctgttttgcttt

SEQ ID NO: 2313787 - DNA, 20 bp, Homo sapiens
ctcttactctttcctatttc

SEQ ID NO: 2313788 - DNA, 18 bp, Homo sapiens
ctcttagattcttaattc

SEQ ID NO: 2313789 - DNA, 15 bp, Homo sapiens
ctcttatcctctctc

SEQ ID NO: 2313790 - DNA, 11 bp, Homo sapiens
ctcttatctca

SEQ ID NO: 2313791 - DNA, 15 bp, Homo sapiens
ctcttcatctgcctg

SEQ ID NO: 2313792 - DNA, 12 bp, Homo sapiens
ctcttccccaga

SEQ ID NO: 2313793 - DNA, 22 bp, Homo sapiens
ctcttccctgaacgttttcttc

SEQ ID NO: 2313794 - DNA, 15 bp, Homo sapiens
ctcttcctccctggg

SEQ ID NO: 2313795 - DNA, 17 bp, Homo sapiens
ctcttcctgtgatccac

SEQ ID NO: 2313796 - DNA, 22 bp, Homo sapiens
ctcttctgagctatttcatcta

SEQ ID NO: 2313797 - DNA, 23 bp, Homo sapiens
ctcttctggggcaggctgggcca

SEQ ID NO: 2313798 - DNA, 13 bp, Homo sapiens
ctcttctgtccct

SEQ ID NO: 2313799 - DNA, 17 bp, Homo sapiens
ctcttcttgagcagacc

SEQ ID NO: 2313800 - DNA, 19 bp, Homo sapiens
ctcttctttaagccataga

SEQ ID NO: 2313801 - DNA, 14 bp, Homo sapiens
ctcttgtaaagact

SEQ ID NO: 2313802 - DNA, 17 bp, Homo sapiens
ctcttgtgatttcttta

SEQ ID NO: 2313803 - DNA, 21 bp, Homo sapiens
ctcttgtgcaaggtggccttt

SEQ ID NO: 2313804 - DNA, 17 bp, Homo sapiens
ctctttaacatacaaga

SEQ ID NO: 2313805 - DNA, 17 bp, Homo sapiens
ctctttagtgttctgtt

SEQ ID NO: 2313806 - DNA, 18 bp, Homo sapiens
ctctttagtgttctgttt

SEQ ID NO: 2313807 - DNA, 12 bp, Homo sapiens
ctctttgctgca

SEQ ID NO: 2313808 - DNA, 12 bp, Homo sapiens
ctctttgctttc

SEQ ID NO: 2313809 - DNA, 13 bp, Homo sapiens
ctctttggaaata

SEQ ID NO: 2313810 - DNA, 21 bp, Homo sapiens
ctcttttaccctggcccctct

SEQ ID NO: 2313811 - DNA, 13 bp, Homo sapiens
ctcttttgaaagt

SEQ ID NO: 2313812 - DNA, 14 bp, Homo sapiens
ctctttttcagagc

SEQ ID NO: 2313813 - DNA, 22 bp, Homo sapiens
ctgaaaagtgtgtatatatttt

SEQ ID NO: 2313814 - DNA, 22 bp, Homo sapiens
ctgaaaatattgttttacaata

SEQ ID NO: 2313815 - DNA, 24 bp, Homo sapiens
ctgaaaatattgttttacaatagt

SEQ ID NO: 2313816 - DNA, 12 bp, Homo sapiens
ctgaaaatgtgc

SEQ ID NO: 2313817 - DNA, 17 bp, Homo sapiens
ctgaaaattaaatttta

SEQ ID NO: 2313818 - DNA, 23 bp, Homo sapiens
ctgaaacacacgagcaaacccag

SEQ ID NO: 2313819 - DNA, 19 bp, Homo sapiens
ctgaaacgctcctttgtgt

SEQ ID NO: 2313820 - DNA, 13 bp, Homo sapiens
ctgaaagttttgt

SEQ ID NO: 2313821 - DNA, 16 bp, Homo sapiens
ctgaaagttttgtaaa

SEQ ID NO: 2313822 - DNA, 20 bp, Homo sapiens
ctgaaagttttgtaaaagaa

SEQ ID NO: 2313823 - DNA, 19 bp, Homo sapiens
ctgaaattgcttatttttg

SEQ ID NO: 2313824 - DNA, 18 bp, Homo sapiens
ctgaaattttagaaatat

SEQ ID NO: 2313825 - DNA, 21 bp, Homo sapiens
ctgaaccactgcttctctttt

SEQ ID NO: 2313826 - DNA, 18 bp, Homo sapiens
ctgaaccgcacagctcag

SEQ ID NO: 2313827 - DNA, 20 bp, Homo sapiens
ctgaaccgcacagctcagga

SEQ ID NO: 2313828 - DNA, 16 bp, Homo sapiens
ctgaaccttaatgtgg

SEQ ID NO: 2313829 - DNA, 17 bp, Homo sapiens
ctgaacgttttcttctt

SEQ ID NO: 2313830 - DNA, 20 bp, Homo sapiens
ctgaacgttttcttctttcc

SEQ ID NO: 2313831 - DNA, 23 bp, Homo sapiens
ctgaacgttttcttctttccctg

SEQ ID NO: 2313832 - DNA, 21 bp, Homo sapiens
ctgaactcctgccatagtctt

SEQ ID NO: 2313833 - DNA, 17 bp, Homo sapiens
ctgaagaactctctgga

SEQ ID NO: 2313834 - DNA, 19 bp, Homo sapiens
ctgaagaaggaaggcctga

SEQ ID NO: 2313835 - DNA, 21 bp, Homo sapiens
ctgaagaaggaaggcctgagc

SEQ ID NO: 2313836 - DNA, 23 bp, Homo sapiens
ctgaagaaggaaggcctgagccc

SEQ ID NO: 2313837 - DNA, 12 bp, Homo sapiens
ctgaagagcatt

SEQ ID NO: 2313838 - DNA, 17 bp, Homo sapiens
ctgaagccagctgccct

SEQ ID NO: 2313839 - DNA, 22 bp, Homo sapiens
ctgaaggggtgcacccacctgt

SEQ ID NO: 2313840 - DNA, 15 bp, Homo sapiens
ctgaagttaaaatga

SEQ ID NO: 2313841 - DNA, 21 bp, Homo sapiens
ctgaataatatcaaataaaat

SEQ ID NO: 2313842 - DNA, 16 bp, Homo sapiens
ctgaataatgctacca

SEQ ID NO: 2313843 - DNA, 20 bp, Homo sapiens
ctgaatccaaactaatccat

SEQ ID NO: 2313844 - DNA, 20 bp, Homo sapiens
ctgaatgaggtcagcatgtc

SEQ ID NO: 2313845 - DNA, 21 bp, Homo sapiens
ctgaatgccccctgcttactt

SEQ ID NO: 2313846 - DNA, 18 bp, Homo sapiens
ctgaatgctatttgtgta

SEQ ID NO: 2313847 - DNA, 14 bp, Homo sapiens
ctgaattaattaat

SEQ ID NO: 2313848 - DNA, 18 bp, Homo sapiens
ctgacaaccattaaagtc

SEQ ID NO: 2313849 - DNA, 20 bp, Homo sapiens
ctgacaaccattaaagtcag

SEQ ID NO: 2313850 - DNA, 22 bp, Homo sapiens
ctgacaacttagctcaggtgcc

SEQ ID NO: 2313851 - DNA, 23 bp, Homo sapiens
ctgacaacttagctcaggtgcct

SEQ ID NO: 2313852 - DNA, 21 bp, Homo sapiens
ctgacaatcaactctaatagt

SEQ ID NO: 2313853 - DNA, 23 bp, Homo sapiens
ctgacattcacttccagagagga

SEQ ID NO: 2313854 - DNA, 14 bp, Homo sapiens
ctgacatttcttct

SEQ ID NO: 2313855 - DNA, 17 bp, Homo sapiens
ctgaccccattcctgat

SEQ ID NO: 2313856 - DNA, 14 bp, Homo sapiens
ctgacccctgctca

SEQ ID NO: 2313857 - DNA, 17 bp, Homo sapiens
ctgaccctatgggtcta

SEQ ID NO: 2313858 - DNA, 20 bp, Homo sapiens
ctgaccctcctccactccac

SEQ ID NO: 2313859 - DNA, 16 bp, Homo sapiens
ctgacctccgccatcc

SEQ ID NO: 2313860 - DNA, 14 bp, Homo sapiens
ctgacctgctgacc

SEQ ID NO: 2313861 - DNA, 15 bp, Homo sapiens
ctgacctgctgacct

SEQ ID NO: 2313862 - DNA, 12 bp, Homo sapiens
ctgactcctctg

SEQ ID NO: 2313863 - DNA, 17 bp, Homo sapiens
ctgactcctctggcttt

SEQ ID NO: 2313864 - DNA, 21 bp, Homo sapiens
ctgactcctctggctttccca

SEQ ID NO: 2313865 - DNA, 18 bp, Homo sapiens
ctgactgagcaggctgtg

SEQ ID NO: 2313866 - DNA, 13 bp, Homo sapiens
ctgactgctcaga

SEQ ID NO: 2313867 - DNA, 20 bp, Homo sapiens
ctgacttggggagatggagt

SEQ ID NO: 2313868 - DNA, 18 bp, Homo sapiens
ctgagaacacgttgccag

SEQ ID NO: 2313869 - DNA, 20 bp, Homo sapiens
ctgagaactcgttcacctcc

SEQ ID NO: 2313870 - DNA, 16 bp, Homo sapiens
ctgagaagctctgaag

SEQ ID NO: 2313871 - DNA, 14 bp, Homo sapiens
ctgagaatatacaa

SEQ ID NO: 2313872 - DNA, 22 bp, Homo sapiens
ctgagaccctactgaagtggct

SEQ ID NO: 2313873 - DNA, 13 bp, Homo sapiens
ctgagacctcaat

SEQ ID NO: 2313874 - DNA, 12 bp, Homo sapiens
ctgagactgtgc

SEQ ID NO: 2313875 - DNA, 17 bp, Homo sapiens
ctgagaggacagagaga

SEQ ID NO: 2313876 - DNA, 12 bp, Homo sapiens
ctgagaggcagg

SEQ ID NO: 2313877 - DNA, 17 bp, Homo sapiens
ctgagaggcaggcatag

SEQ ID NO: 2313878 - DNA, 20 bp, Homo sapiens
ctgagagtatttaggcagat

SEQ ID NO: 2313879 - DNA, 22 bp, Homo sapiens
ctgagagtcagctctctgccct

SEQ ID NO: 2313880 - DNA, 15 bp, Homo sapiens
ctgagatatgaacat

SEQ ID NO: 2313881 - DNA, 14 bp, Homo sapiens
ctgagatctgctgt

SEQ ID NO: 2313882 - DNA, 21 bp, Homo sapiens
ctgagattgcagatgtgagcc

SEQ ID NO: 2313883 - DNA, 14 bp, Homo sapiens
ctgagattgtgttt

SEQ ID NO: 2313884 - DNA, 16 bp, Homo sapiens
ctgagattgtgtttgt

SEQ ID NO: 2313885 - DNA, 17 bp, Homo sapiens
ctgagcaatctgaccct

SEQ ID NO: 2313886 - DNA, 13 bp, Homo sapiens
ctgagcacagatg

SEQ ID NO: 2313887 - DNA, 21 bp, Homo sapiens
ctgccacactctccatcaccc

SEQ ID NO: 2313888 - DNA, 15 bp, Homo sapiens
ctgccacagccagag

SEQ ID NO: 2313889 - DNA, 14 bp, Homo sapiens
ctgccaccagcccc

SEQ ID NO: 2313890 - DNA, 12 bp, Homo sapiens
ctgccaccttca

SEQ ID NO: 2313891 - DNA, 15 bp, Homo sapiens
ctgccaccttcaagt

SEQ ID NO: 2313892 - DNA, 17 bp, Homo sapiens
ctgccagacatggacct

SEQ ID NO: 2313893 - DNA, 15 bp, Homo sapiens
ctgccagcagcagca

SEQ ID NO: 2313894 - DNA, 17 bp, Homo sapiens
ctgccagccttgagccc

SEQ ID NO: 2313895 - DNA, 22 bp, Homo sapiens
ctgccaggcacacacagcccct

SEQ ID NO: 2313896 - DNA, 13 bp, Homo sapiens
ctgccaggcaggg

SEQ ID NO: 2313897 - DNA, 19 bp, Homo sapiens
ctgccaggccagcctccga

SEQ ID NO: 2313898 - DNA, 23 bp, Homo sapiens
ctgccaggccagcctccgagagg

SEQ ID NO: 2313899 - DNA, 15 bp, Homo sapiens
ctgccaggctgtttc

SEQ ID NO: 2313900 - DNA, 14 bp, Homo sapiens
ctgccatcttcagg

SEQ ID NO: 2313901 - DNA, 15 bp, Homo sapiens
ctgccatgacagagg

SEQ ID NO: 2313902 - DNA, 16 bp, Homo sapiens
ctgccatgacagaggc

SEQ ID NO: 2313903 - DNA, 17 bp, Homo sapiens
ctgccatgatgtatatc

SEQ ID NO: 2313904 - DNA, 17 bp, Homo sapiens
ctgcccacgcagaggac

SEQ ID NO: 2313905 - DNA, 23 bp, Homo sapiens
ctgcccactgtttctcttgagct

SEQ ID NO: 2313906 - DNA, 16 bp, Homo sapiens
ctgggcttcattctgg

SEQ ID NO: 2313907 - DNA, 20 bp, Homo sapiens
ctgggcttcattctggaaac

SEQ ID NO: 2313908 - DNA, 15 bp, Homo sapiens
ctgggcttggcctgc

SEQ ID NO: 2313909 - DNA, 22 bp, Homo sapiens
ctggggaagggttttcttttct

SEQ ID NO: 2313910 - DNA, 20 bp, Homo sapiens
ctggggacctggcactggga

SEQ ID NO: 2313911 - DNA, 17 bp, Homo sapiens
ctggggacttgtgtctg

SEQ ID NO: 2313912 - DNA, 15 bp, Homo sapiens
ctggggaggaccagg

SEQ ID NO: 2313913 - DNA, 16 bp, Homo sapiens
ctggggaggaccaggg

SEQ ID NO: 2313914 - DNA, 21 bp, Homo sapiens
ctggggaggaccagggccctg

SEQ ID NO: 2313915 - DNA, 12 bp, Homo sapiens
ctggggcaggct

SEQ ID NO: 2313916 - DNA, 15 bp, Homo sapiens
ctggggcaggctggg

SEQ ID NO: 2313917 - DNA, 14 bp, Homo sapiens
ctggggcccagccc

SEQ ID NO: 2313918 - DNA, 22 bp, Homo sapiens
ctggggcctagcgatctctcct

SEQ ID NO: 2313919 - DNA, 15 bp, Homo sapiens
ctggggcctgactgc

SEQ ID NO: 2313920 - DNA, 19 bp, Homo sapiens
ctggggcctgactgctcag

SEQ ID NO: 2313921 - DNA, 15 bp, Homo sapiens
ctggggcctgggaca

SEQ ID NO: 2313922 - DNA, 18 bp, Homo sapiens
ctggggggatatttccta

SEQ ID NO: 2313923 - DNA, 15 bp, Homo sapiens
ctgggtgggctctgt

SEQ ID NO: 2313924 - DNA, 23 bp, Homo sapiens
ctgggttgggatcaggggtagga

SEQ ID NO: 2313925 - DNA, 23 bp, Homo sapiens
ctgggttgggggctagggagacg

SEQ ID NO: 2313926 - DNA, 19 bp, Homo sapiens
ctggtatatccaaaagctt

SEQ ID NO: 2313927 - DNA, 13 bp, Homo sapiens
ctggtatttctaa

SEQ ID NO: 2313928 - DNA, 15 bp, Homo sapiens
ctggtccaaaagatt

SEQ ID NO: 2313929 - DNA, 17 bp, Homo sapiens
ctggtgaggcccagcct

SEQ ID NO: 2313930 - DNA, 19 bp, Homo sapiens
ctggtgaggcccagcctgt

SEQ ID NO: 2313931 - DNA, 20 bp, Homo sapiens
ctggtgccaatttcaagttc

SEQ ID NO: 2313932 - DNA, 20 bp, Homo sapiens
ctggtgccccccacccctgg

SEQ ID NO: 2313933 - DNA, 17 bp, Homo sapiens
ctggtgggacagtggtg

SEQ ID NO: 2313934 - DNA, 17 bp, Homo sapiens
ctggtggttaaggccag

SEQ ID NO: 2313935 - DNA, 19 bp, Homo sapiens
ctggtggttaaggccaggg

SEQ ID NO: 2313936 - DNA, 20 bp, Homo sapiens
ctggtggttaaggccagggc

SEQ ID NO: 2313937 - DNA, 23 bp, Homo sapiens
ctggttcttgcaaatgggagctg

SEQ ID NO: 2313938 - DNA, 14 bp, Homo sapiens
ctggttgtaaaaga

SEQ ID NO: 2313939 - DNA, 16 bp, Homo sapiens
ctggttgtaaaagaga

SEQ ID NO: 2313940 - DNA, 18 bp, Homo sapiens
ctggtttgtggggcacag

SEQ ID NO: 2313941 - DNA, 14 bp, Homo sapiens
ctgtaactgagaga

SEQ ID NO: 2313942 - DNA, 20 bp, Homo sapiens
ctgtaacttccaaataaata

SEQ ID NO: 2313943 - DNA, 13 bp, Homo sapiens
ctgtaagagcttg

SEQ ID NO: 2313944 - DNA, 20 bp, Homo sapiens
ctgtaagcattctgagctgg

SEQ ID NO: 2313945 - DNA, 17 bp, Homo sapiens
ctgtaagtgtagctcaa

SEQ ID NO: 2313946 - DNA, 14 bp, Homo sapiens
ctgtaatcccagca

SEQ ID NO: 2313947 - DNA, 21 bp, Homo sapiens
ctgtacagaaagtatcacaaa

SEQ ID NO: 2313948 - DNA, 17 bp, Homo sapiens
ctgtacgacacgggtgg

SEQ ID NO: 2313949 - DNA, 23 bp, Homo sapiens
ctgtagaaacaaagggttttctt

SEQ ID NO: 2313950 - DNA, 20 bp, Homo sapiens
ctgtagatatgtattctttt

SEQ ID NO: 2313951 - DNA, 23 bp, Homo sapiens
ctgtagccacagctgctgttctc

SEQ ID NO: 2313952 - DNA, 13 bp, Homo sapiens
ctgtagctcagtc

SEQ ID NO: 2313953 - DNA, 20 bp, Homo sapiens
ctgtagttgcgtggactctg

SEQ ID NO: 2313954 - DNA, 15 bp, Homo sapiens
ctgtagtttagttct

SEQ ID NO: 2313955 - DNA, 20 bp, Homo sapiens
ctgtagtttagttctgttga

SEQ ID NO: 2313956 - DNA, 16 bp, Homo sapiens
ctgtataaataggaga

SEQ ID NO: 2313957 - DNA, 19 bp, Homo sapiens
ctgtataaataggagagga

SEQ ID NO: 2313958 - DNA, 22 bp, Homo sapiens
ctgtataagttatttttgtaca

SEQ ID NO: 2313959 - DNA, 19 bp, Homo sapiens
ctgtataatagagataagt

SEQ ID NO: 2313960 - DNA, 21 bp, Homo sapiens
ctgtatacagtgcagagcctt

SEQ ID NO: 2313961 - DNA, 22 bp, Homo sapiens
ctgtatattttgtagttaatat

SEQ ID NO: 2313962 - DNA, 16 bp, Homo sapiens
ctgtatcattttcttt

SEQ ID NO: 2313963 - DNA, 13 bp, Homo sapiens
ctgtatgtgagct

SEQ ID NO: 2313964 - DNA, 22 bp, Homo sapiens
ctgtattttatttagacaagag

SEQ ID NO: 2313965 - DNA, 18 bp, Homo sapiens
ctgtatttttttttctaa

SEQ ID NO: 2313966 - DNA, 16 bp, Homo sapiens
ctgtcaagttgtacat

SEQ ID NO: 2313967 - DNA, 16 bp, Homo sapiens
ctgtcaatgagagcat

SEQ ID NO: 2313968 - DNA, 22 bp, Homo sapiens
ctgtcaatgagagcataattta

SEQ ID NO: 2313969 - DNA, 16 bp, Homo sapiens
ctgtcaccaccctgct

SEQ ID NO: 2313970 - DNA, 23 bp, Homo sapiens
ctgtcacccgtgtgaagatgaag

SEQ ID NO: 2313971 - DNA, 20 bp, Homo sapiens
ctgtcaccctccaccgagcc

SEQ ID NO: 2313972 - DNA, 18 bp, Homo sapiens
ctgtcacggggttccctc

SEQ ID NO: 2313973 - DNA, 20 bp, Homo sapiens
ctgtcacggggttccctcct

SEQ ID NO: 2313974 - DNA, 19 bp, Homo sapiens
ctgtccacgcgtgccgtgg

SEQ ID NO: 2313975 - DNA, 21 bp, Homo sapiens
ctgtccagctggggccagagg

SEQ ID NO: 2313976 - DNA, 13 bp, Homo sapiens
ctgtccaggcagc

SEQ ID NO: 2313977 - DNA, 22 bp, Homo sapiens
ctgtccaggcagctccctcctg

SEQ ID NO: 2313978 - DNA, 13 bp, Homo sapiens
ctgtccagtgcct

SEQ ID NO: 2313979 - DNA, 17 bp, Homo sapiens
ctgtccagtgcctacat

SEQ ID NO: 2313980 - DNA, 22 bp, Homo sapiens
ctgtcccagccccggcaagcca

SEQ ID NO: 2313981 - DNA, 19 bp, Homo sapiens
ctgtcccggttcaccttgc

SEQ ID NO: 2313982 - DNA, 18 bp, Homo sapiens
ctgtccctgtagctcagt

SEQ ID NO: 2313983 - DNA, 22 bp, Homo sapiens
ctgtcccttttctttgaccaga

SEQ ID NO: 2313984 - DNA, 20 bp, Homo sapiens
ctgtccgcctctgcccgcag

SEQ ID NO: 2313985 - DNA, 19 bp, Homo sapiens
ctgtcctggtacagcaggg

SEQ ID NO: 2313986 - DNA, 12 bp, Homo sapiens
ctgtcctttcct

SEQ ID NO: 2313987 - DNA, 13 bp, Homo sapiens
ctgtcctttcctt

SEQ ID NO: 2313988 - DNA, 19 bp, Homo sapiens
ctgtctaggactgcagtgt

SEQ ID NO: 2313989 - DNA, 20 bp, Homo sapiens
ctgtctccctcccctctcag

SEQ ID NO: 2313990 - DNA, 22 bp, Homo sapiens
ctgtctccctcccctctcagaa

SEQ ID NO: 2313991 - DNA, 21 bp, Homo sapiens
ctgtctctcttctcagagtgg

SEQ ID NO: 2313992 - DNA, 13 bp, Homo sapiens
ctgtctgccccag

SEQ ID NO: 2313993 - DNA, 15 bp, Homo sapiens
ctgtctgccccagcc

SEQ ID NO: 2313994 - DNA, 17 bp, Homo sapiens
ctgtctgttatgatttc

SEQ ID NO: 2313995 - DNA, 13 bp, Homo sapiens
ctgtcttcctcaa

SEQ ID NO: 2313996 - DNA, 22 bp, Homo sapiens
ctgtcttgttgcggatggatgg

SEQ ID NO: 2313997 - DNA, 19 bp, Homo sapiens
ctgtgaacagagagaccct

SEQ ID NO: 2313998 - DNA, 19 bp, Homo sapiens
ctgtgaacctgggcactcc

SEQ ID NO: 2313999 - DNA, 17 bp, Homo sapiens
ctgtgacatggtgcctg

SEQ ID NO: 2314000 - DNA, 18 bp, Homo sapiens
ctgtgacatggtgcctga

SEQ ID NO: 2314001 - DNA, 19 bp, Homo sapiens
ctgtgacatggtgcctgag

SEQ ID NO: 2314002 - DNA, 23 bp, Homo sapiens
ctgtgacatggtgcctgagaggc

SEQ ID NO: 2314003 - DNA, 23 bp, Homo sapiens
ctgtgagaacccagtttcccgtc

SEQ ID NO: 2314004 - DNA, 12 bp, Homo sapiens
ctgtgataacag

SEQ ID NO: 2314005 - DNA, 23 bp, Homo sapiens
ctgtgatcaatatttttatatca

SEQ ID NO: 2314006 - DNA, 15 bp, Homo sapiens
ctgtgatcttaaaat

SEQ ID NO: 2314007 - DNA, 22 bp, Homo sapiens
ctgtgatgagctgatctgcgga

SEQ ID NO: 2314008 - DNA, 23 bp, Homo sapiens
ctgtgattgggtgggattttttc

SEQ ID NO: 2314009 - DNA, 17 bp, Homo sapiens
ctgtgcacaccccactc

SEQ ID NO: 2314010 - DNA, 19 bp, Homo sapiens
ctgtgcacctaccccttgg

SEQ ID NO: 2314011 - DNA, 16 bp, Homo sapiens
ctgtgcatgtatgtct

SEQ ID NO: 2314012 - DNA, 23 bp, Homo sapiens
ctgtgccactgacttgctgtgtg

SEQ ID NO: 2314013 - DNA, 17 bp, Homo sapiens
ctgtgcctcgcatccta

SEQ ID NO: 2314014 - DNA, 21 bp, Homo sapiens
ctgtgcctcgcatcctatgct

SEQ ID NO: 2314015 - DNA, 23 bp, Homo sapiens
ctgtgctccgccatggtgtcccg

SEQ ID NO: 2314016 - DNA, 17 bp, Homo sapiens
ctgtgcttgaaggccct

SEQ ID NO: 2314017 - DNA, 22 bp, Homo sapiens
ctgtgcttgaaggccctgctga

SEQ ID NO: 2314018 - DNA, 21 bp, Homo sapiens
ctgtggaggaaggattgtaaa

SEQ ID NO: 2314019 - DNA, 17 bp, Homo sapiens
ctgtggcataaattgca

SEQ ID NO: 2314020 - DNA, 17 bp, Homo sapiens
ctgtggcatttccaaac

SEQ ID NO: 2314021 - DNA, 18 bp, Homo sapiens
ctggaatgtttttccctc

SEQ ID NO: 2314022 - DNA, 22 bp, Homo sapiens
ctggacagccagtgacctttga

SEQ ID NO: 2314023 - DNA, 20 bp, Homo sapiens
ctggacaggcagcctccttt

SEQ ID NO: 2314024 - DNA, 16 bp, Homo sapiens
ctggacatgagatgga

SEQ ID NO: 2314025 - DNA, 20 bp, Homo sapiens
ctggacatgagatggagagg

SEQ ID NO: 2314026 - DNA, 12 bp, Homo sapiens
ctggacctggga

SEQ ID NO: 2314027 - DNA, 21 bp, Homo sapiens
ctggacggcaggctcactgcc

SEQ ID NO: 2314028 - DNA, 20 bp, Homo sapiens
ctggactaaaggcatccttg

SEQ ID NO: 2314029 - DNA, 15 bp, Homo sapiens
ctggacttgcctctg

SEQ ID NO: 2314030 - DNA, 16 bp, Homo sapiens
ctggacttgcctctgc

SEQ ID NO: 2314031 - DNA, 18 bp, Homo sapiens
ctggagacaaggtgctaa

SEQ ID NO: 2314032 - DNA, 20 bp, Homo sapiens
ctggagacccccccccaact

SEQ ID NO: 2314033 - DNA, 16 bp, Homo sapiens
ctggagcccccagcag

SEQ ID NO: 2314034 - DNA, 20 bp, Homo sapiens
ctggagcccccagcagaggc

SEQ ID NO: 2314035 - DNA, 21 bp, Homo sapiens
ctggagcccccagcagaggca

SEQ ID NO: 2314036 - DNA, 14 bp, Homo sapiens
ctggagccctaacc

SEQ ID NO: 2314037 - DNA, 19 bp, Homo sapiens
ctggaggaagtggggtctg

SEQ ID NO: 2314038 - DNA, 13 bp, Homo sapiens
ctggaggaccaga

SEQ ID NO: 2314039 - DNA, 23 bp, Homo sapiens
ctggaggaccagattgctctgcc

SEQ ID NO: 2314040 - DNA, 14 bp, Homo sapiens
ctggaggagcagca

SEQ ID NO: 2314041 - DNA, 17 bp, Homo sapiens
ctggaggagcagcagct

SEQ ID NO: 2314042 - DNA, 18 bp, Homo sapiens
ctggaggcctcaggtgct

SEQ ID NO: 2314043 - DNA, 15 bp, Homo sapiens
ctggaggtgctgctc

SEQ ID NO: 2314044 - DNA, 17 bp, Homo sapiens
ctggaggtgctgctcta

SEQ ID NO: 2314045 - DNA, 17 bp, Homo sapiens
ctggaggttgaagccaa

SEQ ID NO: 2314046 - DNA, 15 bp, Homo sapiens
ctggagtcagggtga

SEQ ID NO: 2314047 - DNA, 13 bp, Homo sapiens
ctggagtctcctg

SEQ ID NO: 2314048 - DNA, 17 bp, Homo sapiens
ctggagttgactgactg

SEQ ID NO: 2314049 - DNA, 20 bp, Homo sapiens
ctggagttgactgactgagc

SEQ ID NO: 2314050 - DNA, 22 bp, Homo sapiens
ctggagttgactgactgagcag

SEQ ID NO: 2314051 - DNA, 13 bp, Homo sapiens
ctggatagacttg

SEQ ID NO: 2314052 - DNA, 14 bp, Homo sapiens
ctggatagacttgg

SEQ ID NO: 2314053 - DNA, 22 bp, Homo sapiens
ctggatgcctcattatgtcaac

SEQ ID NO: 2314054 - DNA, 20 bp, Homo sapiens
ctggatggaaagacaaactg

SEQ ID NO: 2314055 - DNA, 20 bp, Homo sapiens
ctggatggcacctcaggctg

SEQ ID NO: 2314056 - DNA, 17 bp, Homo sapiens
ctggatggggcaggcca

SEQ ID NO: 2314057 - DNA, 24 bp, Homo sapiens
ctggatggggcaggccacctggct

SEQ ID NO: 2314058 - DNA, 19 bp, Homo sapiens
ctggcaaaccctcccagaa

SEQ ID NO: 2314059 - DNA, 20 bp, Homo sapiens
ctggcaaaccctcccagaaa

SEQ ID NO: 2314060 - DNA, 22 bp, Homo sapiens
ctggcaaaccctcccagaaaca

SEQ ID NO: 2314061 - DNA, 14 bp, Homo sapiens
ctggcaacatcttt

SEQ ID NO: 2314062 - DNA, 22 bp, Homo sapiens
ctggcagcccagagactttgta

SEQ ID NO: 2314063 - DNA, 22 bp, Homo sapiens
ctggcagtcctggaagccagct

SEQ ID NO: 2314064 - DNA, 17 bp, Homo sapiens
ctggcagtgcaatgctt

SEQ ID NO: 2314065 - DNA, 18 bp, Homo sapiens
ctggcatcttagacctcc

SEQ ID NO: 2314066 - DNA, 17 bp, Homo sapiens
ctggccaaatagcaaag

SEQ ID NO: 2314067 - DNA, 14 bp, Homo sapiens
ctggccaccagcca

SEQ ID NO: 2314068 - DNA, 15 bp, Homo sapiens
ctggccaccagccat

SEQ ID NO: 2314069 - DNA, 14 bp, Homo sapiens
ctggccaggagcag

SEQ ID NO: 2314070 - DNA, 15 bp, Homo sapiens
ctggccaggagcagg

SEQ ID NO: 2314071 - DNA, 20 bp, Homo sapiens
ctggccatgaatctctgcct

SEQ ID NO: 2314072 - DNA, 15 bp, Homo sapiens
ctggccatggcctgc

SEQ ID NO: 2314073 - DNA, 12 bp, Homo sapiens
ctggcccagaaa

SEQ ID NO: 2314074 - DNA, 18 bp, Homo sapiens
ctggcccagaaagcctct

SEQ ID NO: 2314075 - DNA, 23 bp, Homo sapiens
ctggcccagaaagcctctctctc

SEQ ID NO: 2314076 - DNA, 16 bp, Homo sapiens
ctggccccagccctgc

SEQ ID NO: 2314077 - DNA, 18 bp, Homo sapiens
ctggccccagccctgctg

SEQ ID NO: 2314078 - DNA, 23 bp, Homo sapiens
ctggccccagccctgctggggat

SEQ ID NO: 2314079 - DNA, 16 bp, Homo sapiens
ctggccccagcctggg

SEQ ID NO: 2314080 - DNA, 18 bp, Homo sapiens
ctggccccaggccccaga

SEQ ID NO: 2314081 - DNA, 19 bp, Homo sapiens
ctggccccaggccccagac

SEQ ID NO: 2314082 - DNA, 18 bp, Homo sapiens
ctggcccccaacctcagg

SEQ ID NO: 2314083 - DNA, 22 bp, Homo sapiens
ctggcccccaacctcagggctc

SEQ ID NO: 2314084 - DNA, 23 bp, Homo sapiens
ctggcccccaacctcagggctcc

SEQ ID NO: 2314085 - DNA, 21 bp, Homo sapiens
ctggccctgggagaatcgctc

SEQ ID NO: 2314086 - DNA, 22 bp, Homo sapiens
ctggccgcttctccccagagct

SEQ ID NO: 2314087 - DNA, 22 bp, Homo sapiens
ctggcctatccgctgccagcct

SEQ ID NO: 2314088 - DNA, 15 bp, Homo sapiens
ctggccttctcctac

SEQ ID NO: 2314089 - DNA, 16 bp, Homo sapiens
ctggcgcaggtgggct

SEQ ID NO: 2314090 - DNA, 16 bp, Homo sapiens
ctggcggcgcagaggg

SEQ ID NO: 2314091 - DNA, 17 bp, Homo sapiens
ctggctccccctcccca

SEQ ID NO: 2314092 - DNA, 19 bp, Homo sapiens
ctggctccccctccccagg

SEQ ID NO: 2314093 - DNA, 21 bp, Homo sapiens
ctggctccccctccccaggct

SEQ ID NO: 2314094 - DNA, 13 bp, Homo sapiens
ctggctcctgatc

SEQ ID NO: 2314095 - DNA, 16 bp, Homo sapiens
ctggctctaccttcct

SEQ ID NO: 2314096 - DNA, 18 bp, Homo sapiens
ctggctctaccttcctgt

SEQ ID NO: 2314097 - DNA, 16 bp, Homo sapiens
ctggctctcacctcta

SEQ ID NO: 2314098 - DNA, 14 bp, Homo sapiens
ctggctctccacct

SEQ ID NO: 2314099 - DNA, 17 bp, Homo sapiens
ctggctctcctggccct

SEQ ID NO: 2314100 - DNA, 12 bp, Homo sapiens
ctggctctgtga

SEQ ID NO: 2314101 - DNA, 21 bp, Homo sapiens
ctggctgaggttcctctgcct

SEQ ID NO: 2314102 - DNA, 17 bp, Homo sapiens
ctggctgctgcccccac

SEQ ID NO: 2314103 - DNA, 19 bp, Homo sapiens
ctggctgctgcccccaccc

SEQ ID NO: 2314104 - DNA, 17 bp, Homo sapiens
ctggctggaggagcagc

SEQ ID NO: 2314105 - DNA, 18 bp, Homo sapiens
ctggctggaggagcagca

SEQ ID NO: 2314106 - DNA, 21 bp, Homo sapiens
ctggctggaggagcagcagct

SEQ ID NO: 2314107 - DNA, 18 bp, Homo sapiens
ctggctgtgatcttaaaa

SEQ ID NO: 2314108 - DNA, 20 bp, Homo sapiens
ctggctttgaaacctcaggg

SEQ ID NO: 2314109 - DNA, 14 bp, Homo sapiens
ctggcttttggaag

SEQ ID NO: 2314110 - DNA, 18 bp, Homo sapiens
ctgggaacccctttccca

SEQ ID NO: 2314111 - DNA, 19 bp, Homo sapiens
ctgggaacccctttcccac

SEQ ID NO: 2314112 - DNA, 21 bp, Homo sapiens
ctgggaatggaaggctttgcc

SEQ ID NO: 2314113 - DNA, 18 bp, Homo sapiens
ctgggacacagacccagg

SEQ ID NO: 2314114 - DNA, 18 bp, Homo sapiens
ctgggacctgccaggcag

SEQ ID NO: 2314115 - DNA, 16 bp, Homo sapiens
ctgggacggaccagca

SEQ ID NO: 2314116 - DNA, 17 bp, Homo sapiens
ctgggacttccatgcct

SEQ ID NO: 2314117 - DNA, 20 bp, Homo sapiens
ctgggagtccctacctgctt

SEQ ID NO: 2314118 - DNA, 14 bp, Homo sapiens
ctgggatttgagat

SEQ ID NO: 2314119 - DNA, 14 bp, Homo sapiens
ctgggcacctgact

SEQ ID NO: 2314120 - DNA, 22 bp, Homo sapiens
ctgggcagggcagggcagcctg

SEQ ID NO: 2314121 - DNA, 16 bp, Homo sapiens
ctgggcatgacatcct

SEQ ID NO: 2314122 - DNA, 15 bp, Homo sapiens
ctgggcattttcctc

SEQ ID NO: 2314123 - DNA, 16 bp, Homo sapiens
ctgggcattttcctcc

SEQ ID NO: 2314124 - DNA, 17 bp, Homo sapiens
ctgggcattttcctcct

SEQ ID NO: 2314125 - DNA, 19 bp, Homo sapiens
ctgggcattttcctcctct

SEQ ID NO: 2314126 - DNA, 21 bp, Homo sapiens
ctgggcattttcctcctctgc

SEQ ID NO: 2314127 - DNA, 18 bp, Homo sapiens
ctgggccatgtccaaaga

SEQ ID NO: 2314128 - DNA, 14 bp, Homo sapiens
ctgggcggctgtgc

SEQ ID NO: 2314129 - DNA, 21 bp, Homo sapiens
ctgggctcaagcaatcctcct

SEQ ID NO: 2314130 - DNA, 22 bp, Homo sapiens
ctgggctcaagcaatcctcctg

SEQ ID NO: 2314131 - DNA, 15 bp, Homo sapiens
ctgggctgccaccag

SEQ ID NO: 2314132 - DNA, 17 bp, Homo sapiens
ctgggctgccatgtgaa

SEQ ID NO: 2314133 - DNA, 16 bp, Homo sapiens
ctgggctgggcacctg

SEQ ID NO: 2314134 - DNA, 17 bp, Homo sapiens
ctgggctgggcacctga

SEQ ID NO: 2314135 - DNA, 15 bp, Homo sapiens
ctgggctgggtgctg

SEQ ID NO: 2314136 - DNA, 19 bp, Homo sapiens
ctgggctgggtgctgggaa

SEQ ID NO: 2314137 - DNA, 14 bp, Homo sapiens
ctttagaccctggg

SEQ ID NO: 2314138 - DNA, 13 bp, Homo sapiens
ctttagagattat

SEQ ID NO: 2314139 - DNA, 19 bp, Homo sapiens
ctttagagattataacaaa

SEQ ID NO: 2314140 - DNA, 15 bp, Homo sapiens
ctttagatctctgaa

SEQ ID NO: 2314141 - DNA, 15 bp, Homo sapiens
ctttagcgctggctt

SEQ ID NO: 2314142 - DNA, 16 bp, Homo sapiens
ctttagtacaatttca

SEQ ID NO: 2314143 - DNA, 23 bp, Homo sapiens
ctttagtttttggttgggaatga

SEQ ID NO: 2314144 - DNA, 13 bp, Homo sapiens
ctttatatgaaga

SEQ ID NO: 2314145 - DNA, 16 bp, Homo sapiens
ctttatctcaacggaa

SEQ ID NO: 2314146 - DNA, 17 bp, Homo sapiens
ctttatgatgctaagct

SEQ ID NO: 2314147 - DNA, 15 bp, Homo sapiens
ctttatgtattctct

SEQ ID NO: 2314148 - DNA, 12 bp, Homo sapiens
ctttatgtgaat

SEQ ID NO: 2314149 - DNA, 15 bp, Homo sapiens
ctttatgtgaatttt

SEQ ID NO: 2314150 - DNA, 19 bp, Homo sapiens
ctttattaatgttttcaaa

SEQ ID NO: 2314151 - DNA, 18 bp, Homo sapiens
ctttattggctgagatat

SEQ ID NO: 2314152 - DNA, 16 bp, Homo sapiens
ctttattttgtgtaaa

SEQ ID NO: 2314153 - DNA, 18 bp, Homo sapiens
ctttattttgtgtaaaaa

SEQ ID NO: 2314154 - DNA, 19 bp, Homo sapiens
ctttcacggaaactcccga

SEQ ID NO: 2314155 - DNA, 16 bp, Homo sapiens
ctttcacttcttccta

SEQ ID NO: 2314156 - DNA, 15 bp, Homo sapiens
ctttcagaaatataa

SEQ ID NO: 2314157 - DNA, 10 bp, Homo sapiens
ctttccaaat

SEQ ID NO: 2314158 - DNA, 11 bp, Homo sapiens
ctttccaaatt

SEQ ID NO: 2314159 - DNA, 22 bp, Homo sapiens
ctttccaaattaaaacaaatat

SEQ ID NO: 2314160 - DNA, 11 bp, Homo sapiens
ctttccaggca

SEQ ID NO: 2314161 - DNA, 22 bp, Homo sapiens
ctttcccaccccaacctgctct

SEQ ID NO: 2314162 - DNA, 23 bp, Homo sapiens
ctttcccaccccaacctgctctc

SEQ ID NO: 2314163 - DNA, 13 bp, Homo sapiens
ctttcccaggaga

SEQ ID NO: 2314164 - DNA, 13 bp, Homo sapiens
ctttccctgcctc

SEQ ID NO: 2314165 - DNA, 12 bp, Homo sapiens
ctttccctggac

SEQ ID NO: 2314166 - DNA, 20 bp, Homo sapiens
ctttcccttattgcctccca

SEQ ID NO: 2314167 - DNA, 14 bp, Homo sapiens
ctttcctccaccca

SEQ ID NO: 2314168 - DNA, 15 bp, Homo sapiens
ctttcctctttctgc

SEQ ID NO: 2314169 - DNA, 19 bp, Homo sapiens
ctttcctctttctgctctg

SEQ ID NO: 2314170 - DNA, 20 bp, Homo sapiens
ctttcctctttctgctctgc

SEQ ID NO: 2314171 - DNA, 22 bp, Homo sapiens
ctttcctgaatccaaactaatc

SEQ ID NO: 2314172 - DNA, 13 bp, Homo sapiens
ctttcctgtccca

SEQ ID NO: 2314173 - DNA, 17 bp, Homo sapiens
ctttccttgagctgttg

SEQ ID NO: 2314174 - DNA, 22 bp, Homo sapiens
ctttctagtggtctttgtaaga

SEQ ID NO: 2314175 - DNA, 23 bp, Homo sapiens
ctttctagtggtctttgtaagag

SEQ ID NO: 2314176 - DNA, 15 bp, Homo sapiens
ctttctcagttttca

SEQ ID NO: 2314177 - DNA, 13 bp, Homo sapiens
ctttctccctcaa

SEQ ID NO: 2314178 - DNA, 21 bp, Homo sapiens
ctttctccctcaactgaaggg

SEQ ID NO: 2314179 - DNA, 21 bp, Homo sapiens
ctttctcgtggtagaagccag

SEQ ID NO: 2314180 - DNA, 13 bp, Homo sapiens
ctttctctcctgg

SEQ ID NO: 2314181 - DNA, 13 bp, Homo sapiens
ctttctcttttcc

SEQ ID NO: 2314182 - DNA, 22 bp, Homo sapiens
ctttctcttttcccctttcctg

SEQ ID NO: 2314183 - DNA, 23 bp, Homo sapiens
ctttctcttttcccctttcctgt

SEQ ID NO: 2314184 - DNA, 14 bp, Homo sapiens
ctttctgaattgca

SEQ ID NO: 2314185 - DNA, 18 bp, Homo sapiens
ctttctgggatgtcacag

SEQ ID NO: 2314186 - DNA, 22 bp, Homo sapiens
ctttctgggatgtcacagtcca

SEQ ID NO: 2314187 - DNA, 13 bp, Homo sapiens
ctttcttctgtgt

SEQ ID NO: 2314188 - DNA, 20 bp, Homo sapiens
ctttcttgcatgaatcagat

SEQ ID NO: 2314189 - DNA, 20 bp, Homo sapiens
ctttgaaaagttggaaggat

SEQ ID NO: 2314190 - DNA, 14 bp, Homo sapiens
ctttgaaacctcag

SEQ ID NO: 2314191 - DNA, 12 bp, Homo sapiens
ctttgaagggca

SEQ ID NO: 2314192 - DNA, 13 bp, Homo sapiens
ctttgaagggcaa

SEQ ID NO: 2314193 - DNA, 14 bp, Homo sapiens
ctttgaatgtaacc

SEQ ID NO: 2314194 - DNA, 20 bp, Homo sapiens
ctttgactctataagcaaat

SEQ ID NO: 2314195 - DNA, 17 bp, Homo sapiens
ctttgagaagccttcag

SEQ ID NO: 2314196 - DNA, 22 bp, Homo sapiens
ctttgagaagccttcagctcca

SEQ ID NO: 2314197 - DNA, 15 bp, Homo sapiens
ctttgagagacgcca

SEQ ID NO: 2314198 - DNA, 22 bp, Homo sapiens
ctttgagagacgccactccctg

SEQ ID NO: 2314199 - DNA, 21 bp, Homo sapiens
ctttgagtagatccatttcca

SEQ ID NO: 2314200 - DNA, 16 bp, Homo sapiens
ctttgatctctgctta

SEQ ID NO: 2314201 - DNA, 14 bp, Homo sapiens
ctttgatgttcctt

SEQ ID NO: 2314202 - DNA, 14 bp, Homo sapiens
ctttgcctccctca

SEQ ID NO: 2314203 - DNA, 20 bp, Homo sapiens
ctttgctcagtgtccagctt

SEQ ID NO: 2314204 - DNA, 20 bp, Homo sapiens
ctttggaaatagcatgacag

SEQ ID NO: 2314205 - DNA, 18 bp, Homo sapiens
ctttggaagtttagctct

SEQ ID NO: 2314206 - DNA, 16 bp, Homo sapiens
ctttttattaaaatat

SEQ ID NO: 2314207 - DNA, 18 bp, Homo sapiens
ctttttattaaaatattt

SEQ ID NO: 2314208 - DNA, 14 bp, Homo sapiens
ctttttatttgcat

SEQ ID NO: 2314209 - DNA, 18 bp, Homo sapiens
ctttttcataaattattt

SEQ ID NO: 2314210 - DNA, 13 bp, Homo sapiens
ctttttttaagtg

SEQ ID NO: 2314211 - DNA, 18 bp, Homo sapiens
ctttttttctttaataac

SEQ ID NO: 2314212 - DNA, 12 bp, Homo sapiens
ctttttttgtat

SEQ ID NO: 2314213 - DNA, 13 bp, Homo sapiens
cttttttttcatg

SEQ ID NO: 2314214 - DNA, 16 bp, Homo sapiens
cttttttttttcttgg

SEQ ID NO: 2314215 - DNA, 15 bp, Homo sapiens
gaaaaaaaaaaaagc

SEQ ID NO: 2314216 - DNA, 14 bp, Homo sapiens
gaaaaacacaagca

SEQ ID NO: 2314217 - DNA, 15 bp, Homo sapiens
gaaaaataaaatgtt

SEQ ID NO: 2314218 - DNA, 21 bp, Homo sapiens
gaaaaatataatgttgataat

SEQ ID NO: 2314219 - DNA, 19 bp, Homo sapiens
gaaaaatcgcgagtgtttc

SEQ ID NO: 2314220 - DNA, 11 bp, Homo sapiens
gaaaaatctca

SEQ ID NO: 2314221 - DNA, 17 bp, Homo sapiens
gaaaaatctcattattt

SEQ ID NO: 2314222 - DNA, 19 bp, Homo sapiens
gaaaaatctcattatttca

SEQ ID NO: 2314223 - DNA, 20 bp, Homo sapiens
gaaaaatctcattatttcaa

SEQ ID NO: 2314224 - DNA, 18 bp, Homo sapiens
gaaaaatcttaagtacca

SEQ ID NO: 2314225 - DNA, 22 bp, Homo sapiens
gaaaaatcttaagtaccaatgg

SEQ ID NO: 2314226 - DNA, 16 bp, Homo sapiens
gaaaaattaacttttt

SEQ ID NO: 2314227 - DNA, 15 bp, Homo sapiens
gaaaacatgtaataa

SEQ ID NO: 2314228 - DNA, 15 bp, Homo sapiens
gaaaagaaaacaaaa

SEQ ID NO: 2314229 - DNA, 16 bp, Homo sapiens
gaaaagaaaacaaaaa

SEQ ID NO: 2314230 - DNA, 21 bp, Homo sapiens
gaaaagaaatggtatgtagag

SEQ ID NO: 2314231 - DNA, 13 bp, Homo sapiens
gaaaagagagaaa

SEQ ID NO: 2314232 - DNA, 20 bp, Homo sapiens
gaaaagataaagaccagaaa

SEQ ID NO: 2314233 - DNA, 22 bp, Homo sapiens
gaaaagataaagaccagaaatt

SEQ ID NO: 2314234 - DNA, 19 bp, Homo sapiens
gaaaagcaacttcatttga

SEQ ID NO: 2314235 - DNA, 17 bp, Homo sapiens
gaaaagctattagccag

SEQ ID NO: 2314236 - DNA, 13 bp, Homo sapiens
gaaaaggaagact

SEQ ID NO: 2314237 - DNA, 15 bp, Homo sapiens
gaaaaggaagactag

SEQ ID NO: 2314238 - DNA, 13 bp, Homo sapiens
gaaaaggatctaa

SEQ ID NO: 2314239 - DNA, 19 bp, Homo sapiens
gaaaaggatctaagggaag

SEQ ID NO: 2314240 - DNA, 14 bp, Homo sapiens
gaaaataaaacaca

SEQ ID NO: 2314241 - DNA, 18 bp, Homo sapiens
gaaaataaaacacacctc

SEQ ID NO: 2314242 - DNA, 14 bp, Homo sapiens
gaaaatgaaatgca

SEQ ID NO: 2314243 - DNA, 15 bp, Homo sapiens
gaaaatggccatgca

SEQ ID NO: 2314244 - DNA, 19 bp, Homo sapiens
gaaaatgtattcctttaaa

SEQ ID NO: 2314245 - DNA, 22 bp, Homo sapiens
gaaaatgtattcctttaaaata

SEQ ID NO: 2314246 - DNA, 17 bp, Homo sapiens
gaaaatgtctgtaataa

SEQ ID NO: 2314247 - DNA, 18 bp, Homo sapiens
gaaaatgtgaccctccaa

SEQ ID NO: 2314248 - DNA, 20 bp, Homo sapiens
gaaaatgtgaccctccaaat

SEQ ID NO: 2314249 - DNA, 22 bp, Homo sapiens
gaaaatgtgaccctccaaatgg

SEQ ID NO: 2314250 - DNA, 17 bp, Homo sapiens
gaaaattaaattttaga

SEQ ID NO: 2314251 - DNA, 14 bp, Homo sapiens
gaaaattacaaaaa

SEQ ID NO: 2314252 - DNA, 16 bp, Homo sapiens
gaaacaacatttatat

SEQ ID NO: 2314253 - DNA, 15 bp, Homo sapiens
gaaacagttctcact

SEQ ID NO: 2314254 - DNA, 18 bp, Homo sapiens
gaaacagttctcactggg

SEQ ID NO: 2314255 - DNA, 12 bp, Homo sapiens
gaaacatacaga

SEQ ID NO: 2314256 - DNA, 17 bp, Homo sapiens
gaaacatctcaataaag

SEQ ID NO: 2314257 - DNA, 20 bp, Homo sapiens
gaaaccaccgtgaaccagag

SEQ ID NO: 2314258 - DNA, 14 bp, Homo sapiens
gaaaccctctccat

SEQ ID NO: 2314259 - DNA, 21 bp, Homo sapiens
gaaaccgagtagaaaatgtga

SEQ ID NO: 2314260 - DNA, 20 bp, Homo sapiens
gaaacctcagggctgtccca

SEQ ID NO: 2314261 - DNA, 21 bp, Homo sapiens
gaaacctcagggctgtcccag

SEQ ID NO: 2314262 - DNA, 17 bp, Homo sapiens
gaaaccttttttaagat

SEQ ID NO: 2314263 - DNA, 23 bp, Homo sapiens
gaaaccttttttaagatttttct

SEQ ID NO: 2314264 - DNA, 12 bp, Homo sapiens
gaaactaacaga

SEQ ID NO: 2314265 - DNA, 15 bp, Homo sapiens
gaaactaacagataa

SEQ ID NO: 2314266 - DNA, 13 bp, Homo sapiens
gaaactaagccag

SEQ ID NO: 2314267 - DNA, 14 bp, Homo sapiens
gaaactaagccagg

SEQ ID NO: 2314268 - DNA, 16 bp, Homo sapiens
ctgtggctccaggcca

SEQ ID NO: 2314269 - DNA, 20 bp, Homo sapiens
ctgtggctgatttactaaca

SEQ ID NO: 2314270 - DNA, 21 bp, Homo sapiens
ctgtggctgatttactaacag

SEQ ID NO: 2314271 - DNA, 15 bp, Homo sapiens
ctgtgggctggcagt

SEQ ID NO: 2314272 - DNA, 13 bp, Homo sapiens
ctgtggggcctga

SEQ ID NO: 2314273 - DNA, 22 bp, Homo sapiens
ctgtggggtcaacccttctgga

SEQ ID NO: 2314274 - DNA, 21 bp, Homo sapiens
ctgtggggtggagcactggac

SEQ ID NO: 2314275 - DNA, 23 bp, Homo sapiens
ctgtggggtggagcactggactc

SEQ ID NO: 2314276 - DNA, 13 bp, Homo sapiens
ctgtgggtctctg

SEQ ID NO: 2314277 - DNA, 20 bp, Homo sapiens
ctgtggtgggaacattcgag

SEQ ID NO: 2314278 - DNA, 19 bp, Homo sapiens
ctgtggttcctaagcctgt

SEQ ID NO: 2314279 - DNA, 17 bp, Homo sapiens
ctgtgtacataactgaa

SEQ ID NO: 2314280 - DNA, 15 bp, Homo sapiens
ctgtgtattccaaga

SEQ ID NO: 2314281 - DNA, 19 bp, Homo sapiens
ctgtgtattccaagacatg

SEQ ID NO: 2314282 - DNA, 21 bp, Homo sapiens
ctgtgtctgccaaacacattt

SEQ ID NO: 2314283 - DNA, 16 bp, Homo sapiens
ctgtgttatgaaaata

SEQ ID NO: 2314284 - DNA, 18 bp, Homo sapiens
ctgtgttggtgtggccca

SEQ ID NO: 2314285 - DNA, 18 bp, Homo sapiens
ctgttactgagatgtctt

SEQ ID NO: 2314286 - DNA, 15 bp, Homo sapiens
ctgttagggccttgg

SEQ ID NO: 2314287 - DNA, 15 bp, Homo sapiens
ctgttcagcaaacta

SEQ ID NO: 2314288 - DNA, 18 bp, Homo sapiens
ctgttccctggagtcagg

SEQ ID NO: 2314289 - DNA, 12 bp, Homo sapiens
ctgttcctgctg

SEQ ID NO: 2314290 - DNA, 14 bp, Homo sapiens
ctgttcctgctgct

SEQ ID NO: 2314291 - DNA, 15 bp, Homo sapiens
ctgttcctgctgctg

SEQ ID NO: 2314292 - DNA, 16 bp, Homo sapiens
ctgttcctgctgctgt

SEQ ID NO: 2314293 - DNA, 13 bp, Homo sapiens
ctgttcggaaggg

SEQ ID NO: 2314294 - DNA, 20 bp, Homo sapiens
ctgttctgtggttcctctgc

SEQ ID NO: 2314295 - DNA, 14 bp, Homo sapiens
ctgttgacctgtgc

SEQ ID NO: 2314296 - DNA, 18 bp, Homo sapiens
ctgttgagccccagtgct

SEQ ID NO: 2314297 - DNA, 19 bp, Homo sapiens
ctgttgagccccagtgctg

SEQ ID NO: 2314298 - DNA, 17 bp, Homo sapiens
ctgttgattatcttcag

SEQ ID NO: 2314299 - DNA, 23 bp, Homo sapiens
ctgttgattatcttcagcccagg

SEQ ID NO: 2314300 - DNA, 15 bp, Homo sapiens
ctgttgctgaagtca

SEQ ID NO: 2314301 - DNA, 16 bp, Homo sapiens
ctgttgctgaagtcat

SEQ ID NO: 2314302 - DNA, 15 bp, Homo sapiens
ctgttggtttcacag

SEQ ID NO: 2314303 - DNA, 21 bp, Homo sapiens
ctgttgtaagaattctgattg

SEQ ID NO: 2314304 - DNA, 15 bp, Homo sapiens
ctgttgtacatttat

SEQ ID NO: 2314305 - DNA, 17 bp, Homo sapiens
ctgttgtacatttatga

SEQ ID NO: 2314306 - DNA, 21 bp, Homo sapiens
ctgtttcatgggccccttcaa

SEQ ID NO: 2314307 - DNA, 13 bp, Homo sapiens
ctgtttcctgggc

SEQ ID NO: 2314308 - DNA, 11 bp, Homo sapiens
ctgtttggaaa

SEQ ID NO: 2314309 - DNA, 17 bp, Homo sapiens
ctgtttggaaaagacag

SEQ ID NO: 2314310 - DNA, 20 bp, Homo sapiens
ctgttttctgaaacacacga

SEQ ID NO: 2314311 - DNA, 19 bp, Homo sapiens
ctgttttgtggtttggaat

SEQ ID NO: 2314312 - DNA, 21 bp, Homo sapiens
cttaaaaccaaagagggcttc

SEQ ID NO: 2314313 - DNA, 14 bp, Homo sapiens
cttaaaagcatttt

SEQ ID NO: 2314314 - DNA, 21 bp, Homo sapiens
cttaaaagcatttttattata

SEQ ID NO: 2314315 - DNA, 15 bp, Homo sapiens
cttaaacctggaatc

SEQ ID NO: 2314316 - DNA, 18 bp, Homo sapiens
cttaaagctactgtagaa

SEQ ID NO: 2314317 - DNA, 19 bp, Homo sapiens
cttaaagctactgtagaaa

SEQ ID NO: 2314318 - DNA, 15 bp, Homo sapiens
cttaaagttgtcact

SEQ ID NO: 2314319 - DNA, 15 bp, Homo sapiens
cttaaataggaaagt

SEQ ID NO: 2314320 - DNA, 22 bp, Homo sapiens
cttaaataggaaagtttcttca

SEQ ID NO: 2314321 - DNA, 20 bp, Homo sapiens
cttaaatttcttatgtgaca

SEQ ID NO: 2314322 - DNA, 17 bp, Homo sapiens
cttaactataaggtgcc

SEQ ID NO: 2314323 - DNA, 21 bp, Homo sapiens
cttaactataaggtgcctcag

SEQ ID NO: 2314324 - DNA, 12 bp, Homo sapiens
cttaactgaaat

SEQ ID NO: 2314325 - DNA, 20 bp, Homo sapiens
cttaagtaccaatgggaagc

SEQ ID NO: 2314326 - DNA, 21 bp, Homo sapiens
cttaagtaccaatgggaagca

SEQ ID NO: 2314327 - DNA, 17 bp, Homo sapiens
cttaagtgagcagaaca

SEQ ID NO: 2314328 - DNA, 18 bp, Homo sapiens
cttaagtgagcagaacag

SEQ ID NO: 2314329 - DNA, 15 bp, Homo sapiens
cttaagtgcccacat

SEQ ID NO: 2314330 - DNA, 16 bp, Homo sapiens
cttaataaaagaacat

SEQ ID NO: 2314331 - DNA, 17 bp, Homo sapiens
cttaataaaataaacta

SEQ ID NO: 2314332 - DNA, 15 bp, Homo sapiens
cttaataactgtgta

SEQ ID NO: 2314333 - DNA, 20 bp, Homo sapiens
cttaataactgtgtactgtt

SEQ ID NO: 2314334 - DNA, 13 bp, Homo sapiens
cttaatttccttt

SEQ ID NO: 2314335 - DNA, 17 bp, Homo sapiens
cttaatttcctttttga

SEQ ID NO: 2314336 - DNA, 22 bp, Homo sapiens
cttaatttcctttttgacactg

SEQ ID NO: 2314337 - DNA, 15 bp, Homo sapiens
cttacaatattgatt

SEQ ID NO: 2314338 - DNA, 20 bp, Homo sapiens
cttacaatattgattgggaa

SEQ ID NO: 2314339 - DNA, 16 bp, Homo sapiens
cttacatcttttctaa

SEQ ID NO: 2314340 - DNA, 15 bp, Homo sapiens
cttacctaacatctg

SEQ ID NO: 2314341 - DNA, 19 bp, Homo sapiens
cttacctttttatttgcat

SEQ ID NO: 2314342 - DNA, 13 bp, Homo sapiens
cttactaaaaagt

SEQ ID NO: 2314343 - DNA, 17 bp, Homo sapiens
cttactaaaaagtataa

SEQ ID NO: 2314344 - DNA, 18 bp, Homo sapiens
cttactaaaaagtataaa

SEQ ID NO: 2314345 - DNA, 17 bp, Homo sapiens
cttactaatgtgcccca

SEQ ID NO: 2314346 - DNA, 23 bp, Homo sapiens
cttactaatgtgccccatgtcca

SEQ ID NO: 2314347 - DNA, 17 bp, Homo sapiens
cttactgactttgcatt

SEQ ID NO: 2314348 - DNA, 21 bp, Homo sapiens
cttactgatatattttacaat

SEQ ID NO: 2314349 - DNA, 19 bp, Homo sapiens
cttactgtggaggaaggat

SEQ ID NO: 2314350 - DNA, 17 bp, Homo sapiens
cttagaacgttaaacta

SEQ ID NO: 2314351 - DNA, 13 bp, Homo sapiens
cttagagaccccg

SEQ ID NO: 2314352 - DNA, 22 bp, Homo sapiens
cttagatgggacgcataatcat

SEQ ID NO: 2314353 - DNA, 14 bp, Homo sapiens
cttagattcttaat

SEQ ID NO: 2314354 - DNA, 23 bp, Homo sapiens
cttagggactacccatagacatg

SEQ ID NO: 2314355 - DNA, 14 bp, Homo sapiens
cttaggtgccaggc

SEQ ID NO: 2314356 - DNA, 20 bp, Homo sapiens
cttagtatgtgcatttaatt

SEQ ID NO: 2314357 - DNA, 13 bp, Homo sapiens
cttagtcccaagc

SEQ ID NO: 2314358 - DNA, 15 bp, Homo sapiens
cttagtcccaagcta

SEQ ID NO: 2314359 - DNA, 24 bp, Homo sapiens
cttataaagtggaagtatgtatat

SEQ ID NO: 2314360 - DNA, 21 bp, Homo sapiens
cttataacctagttaaagaaa

SEQ ID NO: 2314361 - DNA, 15 bp, Homo sapiens
cttatcctccaccgt

SEQ ID NO: 2314362 - DNA, 20 bp, Homo sapiens
cttatcctctctctcttcta

SEQ ID NO: 2314363 - DNA, 23 bp, Homo sapiens
cttatcctctctctcttctaggc

SEQ ID NO: 2314364 - DNA, 16 bp, Homo sapiens
cttatcgggctccagc

SEQ ID NO: 2314365 - DNA, 18 bp, Homo sapiens
cttatcgggctccagcca

SEQ ID NO: 2314366 - DNA, 19 bp, Homo sapiens
cttatctcagtcatgcata

SEQ ID NO: 2314367 - DNA, 20 bp, Homo sapiens
cttatctcagtcatgcataa

SEQ ID NO: 2314368 - DNA, 22 bp, Homo sapiens
cttatctcagtcatgcataaat

SEQ ID NO: 2314369 - DNA, 23 bp, Homo sapiens
cttatctcagtcatgcataaata

SEQ ID NO: 2314370 - DNA, 14 bp, Homo sapiens
cttatgtgaaaaat

SEQ ID NO: 2314371 - DNA, 21 bp, Homo sapiens
cttatgtgaaaaattaacttt

SEQ ID NO: 2314372 - DNA, 17 bp, Homo sapiens
cttattattaataatga

SEQ ID NO: 2314373 - DNA, 15 bp, Homo sapiens
cttattctcctccct

SEQ ID NO: 2314374 - DNA, 16 bp, Homo sapiens
cttattctttgagtaa

SEQ ID NO: 2314375 - DNA, 14 bp, Homo sapiens
cttattgaccattt

SEQ ID NO: 2314376 - DNA, 15 bp, Homo sapiens
cttatttaatctttt

SEQ ID NO: 2314377 - DNA, 16 bp, Homo sapiens
cttatttctatgacaa

SEQ ID NO: 2314378 - DNA, 13 bp, Homo sapiens
cttcaatgctgca

SEQ ID NO: 2314379 - DNA, 15 bp, Homo sapiens
cttcaatgctgcagg

SEQ ID NO: 2314380 - DNA, 17 bp, Homo sapiens
cttcacagtagagccag

SEQ ID NO: 2314381 - DNA, 16 bp, Homo sapiens
cttcactgtataaata

SEQ ID NO: 2314382 - DNA, 21 bp, Homo sapiens
cttcagcacaggaattctcaa

SEQ ID NO: 2314383 - DNA, 21 bp, Homo sapiens
cttcaggatattggttcttcc

SEQ ID NO: 2314384 - DNA, 22 bp, Homo sapiens
cttcaggatattggttcttccc

SEQ ID NO: 2314385 - DNA, 17 bp, Homo sapiens
cttcaggatcaagtcct

SEQ ID NO: 2314386 - DNA, 22 bp, Homo sapiens
cttcagtaaatgtgattcacct

SEQ ID NO: 2314387 - DNA, 23 bp, Homo sapiens
cttcagttgcttgtcttctggta

SEQ ID NO: 2314388 - DNA, 12 bp, Homo sapiens
cttcataatcca

SEQ ID NO: 2314389 - DNA, 15 bp, Homo sapiens
cttcatctgcctgcg

SEQ ID NO: 2314390 - DNA, 14 bp, Homo sapiens
cttcatcttcctgt

SEQ ID NO: 2314391 - DNA, 21 bp, Homo sapiens
cttcatcttcctgtgtcctga

SEQ ID NO: 2314392 - DNA, 22 bp, Homo sapiens
cttcatcttcctgtgtcctgaa

SEQ ID NO: 2314393 - DNA, 17 bp, Homo sapiens
cttcattattcaagaat

SEQ ID NO: 2314394 - DNA, 15 bp, Homo sapiens
cttcattattctctg

SEQ ID NO: 2314395 - DNA, 14 bp, Homo sapiens
cttcattctcagac

SEQ ID NO: 2314396 - DNA, 15 bp, Homo sapiens
cttcattctggaaac

SEQ ID NO: 2314397 - DNA, 16 bp, Homo sapiens
cttcatttccaccagg

SEQ ID NO: 2314398 - DNA, 20 bp, Homo sapiens
cttcatttgacacaaagctt

SEQ ID NO: 2314399 - DNA, 22 bp, Homo sapiens
cttccaaagagggatgtttgga

SEQ ID NO: 2314400 - DNA, 13 bp, Homo sapiens
cttccaaagccta

SEQ ID NO: 2314401 - DNA, 17 bp, Homo sapiens
cttccaattaatgcttt

SEQ ID NO: 2314402 - DNA, 17 bp, Homo sapiens
cttccactctggaacct

SEQ ID NO: 2314403 - DNA, 19 bp, Homo sapiens
cttccaggaaactccacat

SEQ ID NO: 2314404 - DNA, 22 bp, Homo sapiens
cttccaggaaactccacatctg

SEQ ID NO: 2314405 - DNA, 23 bp, Homo sapiens
cttccaggaaactccacatctgc

SEQ ID NO: 2314406 - DNA, 20 bp, Homo sapiens
cttccagtgaacattcccag

SEQ ID NO: 2314407 - DNA, 17 bp, Homo sapiens
cttccatccatctttcc

SEQ ID NO: 2314408 - DNA, 22 bp, Homo sapiens
cttccatccatctttccatcca

SEQ ID NO: 2314409 - DNA, 14 bp, Homo sapiens
cttcccacatgcct

SEQ ID NO: 2314410 - DNA, 20 bp, Homo sapiens
cttcccacatgcctgcgcct

SEQ ID NO: 2314411 - DNA, 14 bp, Homo sapiens
cttccccagagagg

SEQ ID NO: 2314412 - DNA, 23 bp, Homo sapiens
cttccccagagaggcactcagtg

SEQ ID NO: 2314413 - DNA, 13 bp, Homo sapiens
cttcccccaccac

SEQ ID NO: 2314414 - DNA, 15 bp, Homo sapiens
cttcccccaccacca

SEQ ID NO: 2314415 - DNA, 22 bp, Homo sapiens
cttccctagctttagaccctgg

SEQ ID NO: 2314416 - DNA, 23 bp, Homo sapiens
cttccctagctttagaccctggg

SEQ ID NO: 2314417 - DNA, 15 bp, Homo sapiens
cttccctctctgatg

SEQ ID NO: 2314418 - DNA, 16 bp, Homo sapiens
cttccctctgggcacg

SEQ ID NO: 2314419 - DNA, 19 bp, Homo sapiens
cttccctctgggcacgcct

SEQ ID NO: 2314420 - DNA, 21 bp, Homo sapiens
cttccctgaacgttttcttct

SEQ ID NO: 2314421 - DNA, 16 bp, Homo sapiens
cttccctgggctgcca

SEQ ID NO: 2314422 - DNA, 22 bp, Homo sapiens
cttccgcttggagctattttcc

SEQ ID NO: 2314423 - DNA, 18 bp, Homo sapiens
cttcctcttgtctgattt

SEQ ID NO: 2314424 - DNA, 15 bp, Homo sapiens
cttcctgacacttta

SEQ ID NO: 2314425 - DNA, 16 bp, Homo sapiens
cttcctgacactttaa

SEQ ID NO: 2314426 - DNA, 18 bp, Homo sapiens
cttcctgacactttaatt

SEQ ID NO: 2314427 - DNA, 21 bp, Homo sapiens
cttcctgcaggcaggaacaaa

SEQ ID NO: 2314428 - DNA, 14 bp, Homo sapiens
cttcctggcctgag

SEQ ID NO: 2314429 - DNA, 19 bp, Homo sapiens
cttcctggcctgagagtca

SEQ ID NO: 2314430 - DNA, 18 bp, Homo sapiens
cttcctggtgaggcccag

SEQ ID NO: 2314431 - DNA, 23 bp, Homo sapiens
cttcctggtgaggcccagcctgt

SEQ ID NO: 2314432 - DNA, 16 bp, Homo sapiens
cttcctgtccctgagg

SEQ ID NO: 2314433 - DNA, 18 bp, Homo sapiens
cttcctgtgatccaccca

SEQ ID NO: 2314434 - DNA, 14 bp, Homo sapiens
cttcctgtgtcctg

SEQ ID NO: 2314435 - DNA, 17 bp, Homo sapiens
cttcctgtttttcacat

SEQ ID NO: 2314436 - DNA, 17 bp, Homo sapiens
cttcctttctctcctgg

SEQ ID NO: 2314437 - DNA, 19 bp, Homo sapiens
cttcctttctctcctggct

SEQ ID NO: 2314438 - DNA, 15 bp, Homo sapiens
cttccttttccctgc

SEQ ID NO: 2314439 - DNA, 22 bp, Homo sapiens
cttccttttccctgcttccagg

SEQ ID NO: 2314440 - DNA, 18 bp, Homo sapiens
cttcgtttattttcaaga

SEQ ID NO: 2314441 - DNA, 12 bp, Homo sapiens
cttctaagagcg

SEQ ID NO: 2314442 - DNA, 19 bp, Homo sapiens
cttctactcacttttccca

SEQ ID NO: 2314443 - DNA, 23 bp, Homo sapiens
cttctaggcccattgtcctcctt

SEQ ID NO: 2314444 - DNA, 14 bp, Homo sapiens
cttctattggtctc

SEQ ID NO: 2314445 - DNA, 13 bp, Homo sapiens
cttctcagaagca

SEQ ID NO: 2314446 - DNA, 16 bp, Homo sapiens
cttctcagagtggtgg

SEQ ID NO: 2314447 - DNA, 12 bp, Homo sapiens
cttctcccactc

SEQ ID NO: 2314448 - DNA, 20 bp, Homo sapiens
cttctccccagagctgcctg

SEQ ID NO: 2314449 - DNA, 21 bp, Homo sapiens
cttctccccagagctgcctgc

SEQ ID NO: 2314450 - DNA, 19 bp, Homo sapiens
cttctccctagctcctccc

SEQ ID NO: 2314451 - DNA, 13 bp, Homo sapiens
cttctccctggaa

SEQ ID NO: 2314452 - DNA, 12 bp, Homo sapiens
cttctccgccag

SEQ ID NO: 2314453 - DNA, 19 bp, Homo sapiens
cttctccgccagcctcctc

SEQ ID NO: 2314454 - DNA, 20 bp, Homo sapiens
cttctcctacttagggaaga

SEQ ID NO: 2314455 - DNA, 19 bp, Homo sapiens
cttctcctcctctgtcttt

SEQ ID NO: 2314456 - DNA, 14 bp, Homo sapiens
cttctctcagatgg

SEQ ID NO: 2314457 - DNA, 18 bp, Homo sapiens
cttctctccacagtgttg

SEQ ID NO: 2314458 - DNA, 19 bp, Homo sapiens
cttctctccacagtgttgt

SEQ ID NO: 2314459 - DNA, 13 bp, Homo sapiens
cttctcttagatt

SEQ ID NO: 2314460 - DNA, 22 bp, Homo sapiens
cttctgaactcaaactgaggaa

SEQ ID NO: 2314461 - DNA, 15 bp, Homo sapiens
cttctgagcacagat

SEQ ID NO: 2314462 - DNA, 22 bp, Homo sapiens
gcattccttctttgataatgtt

SEQ ID NO: 2314463 - DNA, 22 bp, Homo sapiens
gcattcgttgtgttttttaaga

SEQ ID NO: 2314464 - DNA, 17 bp, Homo sapiens
gcattgagtattgttta

SEQ ID NO: 2314465 - DNA, 16 bp, Homo sapiens
gcattgatccaggaga

SEQ ID NO: 2314466 - DNA, 12 bp, Homo sapiens
gcatttaataaa

SEQ ID NO: 2314467 - DNA, 13 bp, Homo sapiens
gcatttaataaag

SEQ ID NO: 2314468 - DNA, 17 bp, Homo sapiens
gcatttaataaagatga

SEQ ID NO: 2314469 - DNA, 16 bp, Homo sapiens
gcatttagcacagtat

SEQ ID NO: 2314470 - DNA, 18 bp, Homo sapiens
gcatttagcacagtattt

SEQ ID NO: 2314471 - DNA, 22 bp, Homo sapiens
gcatttcatgaaaaagctgctt

SEQ ID NO: 2314472 - DNA, 12 bp, Homo sapiens
gcatttccaaac

SEQ ID NO: 2314473 - DNA, 10 bp, Homo sapiens
gcatttccta

SEQ ID NO: 2314474 - DNA, 12 bp, Homo sapiens
gcatttggtctc

SEQ ID NO: 2314475 - DNA, 18 bp, Homo sapiens
gcattttagaaactacaa

SEQ ID NO: 2314476 - DNA, 23 bp, Homo sapiens
gcattttagaaactacaaatata

SEQ ID NO: 2314477 - DNA, 16 bp, Homo sapiens
gcattttcctcctctg

SEQ ID NO: 2314478 - DNA, 15 bp, Homo sapiens
gcattttgaaacaaa

SEQ ID NO: 2314479 - DNA, 18 bp, Homo sapiens
gcatttttgtgaaatgaa

SEQ ID NO: 2314480 - DNA, 21 bp, Homo sapiens
gcatttttgtgaaatgaaaac

SEQ ID NO: 2314481 - DNA, 21 bp, Homo sapiens
gccaaaccaggaccctgtcca

SEQ ID NO: 2314482 - DNA, 21 bp, Homo sapiens
gccaacaactctgcctttatg

SEQ ID NO: 2314483 - DNA, 22 bp, Homo sapiens
gccaacaactctgcctttatga

SEQ ID NO: 2314484 - DNA, 13 bp, Homo sapiens
gccaacagccccc

SEQ ID NO: 2314485 - DNA, 15 bp, Homo sapiens
gccaagctttaaatt

SEQ ID NO: 2314486 - DNA, 18 bp, Homo sapiens
gccaagggaaaggggtgc

SEQ ID NO: 2314487 - DNA, 23 bp, Homo sapiens
gccaagtggggtgctgggaggag

SEQ ID NO: 2314488 - DNA, 16 bp, Homo sapiens
gccaatgtctcctccc

SEQ ID NO: 2314489 - DNA, 15 bp, Homo sapiens
gccaatttctctcag

SEQ ID NO: 2314490 - DNA, 16 bp, Homo sapiens
gcccagcctgtcctgg

SEQ ID NO: 2314491 - DNA, 14 bp, Homo sapiens
gcccagctctctga

SEQ ID NO: 2314492 - DNA, 17 bp, Homo sapiens
gcccagctctctgacgc

SEQ ID NO: 2314493 - DNA, 21 bp, Homo sapiens
gcccagggcatcttgctggct

SEQ ID NO: 2314494 - DNA, 23 bp, Homo sapiens
gcccagggcatcttgctggctac

SEQ ID NO: 2314495 - DNA, 14 bp, Homo sapiens
gcccagtacattta

SEQ ID NO: 2314496 - DNA, 19 bp, Homo sapiens
gcccagtacatttaaattt

SEQ ID NO: 2314497 - DNA, 22 bp, Homo sapiens
gcccagtacatttaaatttttt

SEQ ID NO: 2314498 - DNA, 22 bp, Homo sapiens
gcccagtacctagctggctctg

SEQ ID NO: 2314499 - DNA, 20 bp, Homo sapiens
gcccagtgcatatgcaatgt

SEQ ID NO: 2314500 - DNA, 16 bp, Homo sapiens
gcccatactggttggc

SEQ ID NO: 2314501 - DNA, 13 bp, Homo sapiens
gcccatcctgcca

SEQ ID NO: 2314502 - DNA, 13 bp, Homo sapiens
gcccatgctgtcc

SEQ ID NO: 2314503 - DNA, 17 bp, Homo sapiens
gcccatgctgtccggcc

SEQ ID NO: 2314504 - DNA, 17 bp, Homo sapiens
gcccattcagagctatg

SEQ ID NO: 2314505 - DNA, 15 bp, Homo sapiens
gccccacagccctgc

SEQ ID NO: 2314506 - DNA, 22 bp, Homo sapiens
gccccaccttgccagggcaggg

SEQ ID NO: 2314507 - DNA, 12 bp, Homo sapiens
gccccactcctc

SEQ ID NO: 2314508 - DNA, 21 bp, Homo sapiens
gccccagacagggtgggcttc

SEQ ID NO: 2314509 - DNA, 14 bp, Homo sapiens
gccccagcccagcc

SEQ ID NO: 2314510 - DNA, 17 bp, Homo sapiens
gccccagccctgctggg

SEQ ID NO: 2314511 - DNA, 18 bp, Homo sapiens
gccccagcctgggccatc

SEQ ID NO: 2314512 - DNA, 18 bp, Homo sapiens
gccccaggccccagacag

SEQ ID NO: 2314513 - DNA, 12 bp, Homo sapiens
gccccagtgctg

SEQ ID NO: 2314514 - DNA, 18 bp, Homo sapiens
gccccattctcactgcta

SEQ ID NO: 2314515 - DNA, 22 bp, Homo sapiens
gcccccaccccggggaccctgt

SEQ ID NO: 2314516 - DNA, 12 bp, Homo sapiens
gcccccagcaga

SEQ ID NO: 2314517 - DNA, 18 bp, Homo sapiens
gcccccagtccccacccc

SEQ ID NO: 2314518 - DNA, 19 bp, Homo sapiens
gccccccagccccggtggc

SEQ ID NO: 2314519 - DNA, 14 bp, Homo sapiens
gcccccctgccctg

SEQ ID NO: 2314520 - DNA, 14 bp, Homo sapiens
gcccccgccccaga

SEQ ID NO: 2314521 - DNA, 21 bp, Homo sapiens
gcccccgccccagagtggccc

SEQ ID NO: 2314522 - DNA, 22 bp, Homo sapiens
gccccctcctgaaccgcacagc

SEQ ID NO: 2314523 - DNA, 20 bp, Homo sapiens
gccccctgcttacttggtga

SEQ ID NO: 2314524 - DNA, 15 bp, Homo sapiens
gccccgccccgttgt

SEQ ID NO: 2314525 - DNA, 15 bp, Homo sapiens
gccccgcctgagtca

SEQ ID NO: 2314526 - DNA, 23 bp, Homo sapiens
gccccggacggacgttggttctg

SEQ ID NO: 2314527 - DNA, 15 bp, Homo sapiens
gccccggcaagccac

SEQ ID NO: 2314528 - DNA, 17 bp, Homo sapiens
gccccggcaagccacag

SEQ ID NO: 2314529 - DNA, 18 bp, Homo sapiens
gccccggcaagccacagg

SEQ ID NO: 2314530 - DNA, 17 bp, Homo sapiens
gccccggtggctgggca

SEQ ID NO: 2314531 - DNA, 19 bp, Homo sapiens
gcccctactgctgtgaacc

SEQ ID NO: 2314532 - DNA, 14 bp, Homo sapiens
gcccctcacaacag

SEQ ID NO: 2314533 - DNA, 16 bp, Homo sapiens
gcccctccccctgcca

SEQ ID NO: 2314534 - DNA, 21 bp, Homo sapiens
gcccctctcccttgggctctg

SEQ ID NO: 2314535 - DNA, 23 bp, Homo sapiens
gcccctctcccttgggctctgat

SEQ ID NO: 2314536 - DNA, 16 bp, Homo sapiens
gcccctgacccaggga

SEQ ID NO: 2314537 - DNA, 15 bp, Homo sapiens
gcccctggccgcgct

SEQ ID NO: 2314538 - DNA, 20 bp, Homo sapiens
gcccctggccgcgctccggg

SEQ ID NO: 2314539 - DNA, 12 bp, Homo sapiens
gcccctgggctt

SEQ ID NO: 2314540 - DNA, 18 bp, Homo sapiens
gcccctgggcttggcctg

SEQ ID NO: 2314541 - DNA, 19 bp, Homo sapiens
gcccctgggcttggcctgc

SEQ ID NO: 2314542 - DNA, 21 bp, Homo sapiens
gcccctgggcttggcctgctg

SEQ ID NO: 2314543 - DNA, 22 bp, Homo sapiens
gcccctgggcttggcctgctgt

SEQ ID NO: 2314544 - DNA, 23 bp, Homo sapiens
gcccctgggcttggcctgctgtg

SEQ ID NO: 2314545 - DNA, 15 bp, Homo sapiens
gcccctggggcccag

SEQ ID NO: 2314546 - DNA, 10 bp, Homo sapiens
gccccttcca

SEQ ID NO: 2314547 - DNA, 14 bp, Homo sapiens
gcccctttgcctgt

SEQ ID NO: 2314548 - DNA, 18 bp, Homo sapiens
gcccgaaactaagccagg

SEQ ID NO: 2314549 - DNA, 15 bp, Homo sapiens
gcccgactagcaggc

SEQ ID NO: 2314550 - DNA, 12 bp, Homo sapiens
gcccgcagagcc

SEQ ID NO: 2314551 - DNA, 20 bp, Homo sapiens
gcccgccttcaggctgcccg

SEQ ID NO: 2314552 - DNA, 14 bp, Homo sapiens
gccctatgctgtgc

SEQ ID NO: 2314553 - DNA, 14 bp, Homo sapiens
gccctatgggcctg

SEQ ID NO: 2314554 - DNA, 15 bp, Homo sapiens
gccctatgggcctgc

SEQ ID NO: 2314555 - DNA, 16 bp, Homo sapiens
gccctatgggcctgcc

SEQ ID NO: 2314556 - DNA, 17 bp, Homo sapiens
gccctcactccctctgc

SEQ ID NO: 2314557 - DNA, 19 bp, Homo sapiens
gccctcatgggtcctagcc

SEQ ID NO: 2314558 - DNA, 14 bp, Homo sapiens
gccctcctctccca

SEQ ID NO: 2314559 - DNA, 14 bp, Homo sapiens
gccctcctttccct

SEQ ID NO: 2314560 - DNA, 19 bp, Homo sapiens
gccctctcccaccctcttc

SEQ ID NO: 2314561 - DNA, 15 bp, Homo sapiens
gccctgactcctctg

SEQ ID NO: 2314562 - DNA, 17 bp, Homo sapiens
gccctgactcctctggc

SEQ ID NO: 2314563 - DNA, 19 bp, Homo sapiens
gccctgactcctctggctt

SEQ ID NO: 2314564 - DNA, 21 bp, Homo sapiens
gccctgactcctctggctttc

SEQ ID NO: 2314565 - DNA, 20 bp, Homo sapiens
gccctgaggcggaggctgtg

SEQ ID NO: 2314566 - DNA, 19 bp, Homo sapiens
gccctgcagcccaccagac

SEQ ID NO: 2314567 - DNA, 12 bp, Homo sapiens
gccctgcctcct

SEQ ID NO: 2314568 - DNA, 13 bp, Homo sapiens
gccctgctgagtc

SEQ ID NO: 2314569 - DNA, 10 bp, Homo sapiens
gccctggctg

SEQ ID NO: 2314570 - DNA, 14 bp, Homo sapiens
gccctggctgctgc

SEQ ID NO: 2314571 - DNA, 16 bp, Homo sapiens
gccctggctgctgccc

SEQ ID NO: 2314572 - DNA, 22 bp, Homo sapiens
gccctggctgctgcccccaccc

SEQ ID NO: 2314573 - DNA, 15 bp, Homo sapiens
gccctgtccaaaagc

SEQ ID NO: 2314574 - DNA, 16 bp, Homo sapiens
gccctgtcccaggccg

SEQ ID NO: 2314575 - DNA, 13 bp, Homo sapiens
gccctgttccctg

SEQ ID NO: 2314576 - DNA, 15 bp, Homo sapiens
gccctgttccctgga

SEQ ID NO: 2314577 - DNA, 22 bp, Homo sapiens
gccctgttccctggagtcaggg

SEQ ID NO: 2314578 - DNA, 18 bp, Homo sapiens
gcccttccctctgggcac

SEQ ID NO: 2314579 - DNA, 11 bp, Homo sapiens
gcccttccctg

SEQ ID NO: 2314580 - DNA, 17 bp, Homo sapiens
gcccttcctgctgcgca

SEQ ID NO: 2314581 - DNA, 19 bp, Homo sapiens
gcccttgcacagctggaga

SEQ ID NO: 2314582 - DNA, 22 bp, Homo sapiens
gcccttgcacagctggagaaat

SEQ ID NO: 2314583 - DNA, 13 bp, Homo sapiens
gcccttgcctccc

SEQ ID NO: 2314584 - DNA, 13 bp, Homo sapiens
cttgagccctggc

SEQ ID NO: 2314585 - DNA, 20 bp, Homo sapiens
cttgagccctggctgttctg

SEQ ID NO: 2314586 - DNA, 14 bp, Homo sapiens
cttgagctggcctc

SEQ ID NO: 2314587 - DNA, 16 bp, Homo sapiens
cttgagctggcctctc

SEQ ID NO: 2314588 - DNA, 17 bp, Homo sapiens
cttgagctggcctctct

SEQ ID NO: 2314589 - DNA, 21 bp, Homo sapiens
cttgagctgttgtgagctttg

SEQ ID NO: 2314590 - DNA, 15 bp, Homo sapiens
cttgagggctgcagt

SEQ ID NO: 2314591 - DNA, 14 bp, Homo sapiens
cttgatccagaaga

SEQ ID NO: 2314592 - DNA, 18 bp, Homo sapiens
cttgatccagaagagccc

SEQ ID NO: 2314593 - DNA, 15 bp, Homo sapiens
cttgatcggaaagct

SEQ ID NO: 2314594 - DNA, 22 bp, Homo sapiens
cttgatgactgccttgcctcct

SEQ ID NO: 2314595 - DNA, 14 bp, Homo sapiens
cttgattaaatcaa

SEQ ID NO: 2314596 - DNA, 15 bp, Homo sapiens
cttgattaaatcaac

SEQ ID NO: 2314597 - DNA, 18 bp, Homo sapiens
cttgattttaatacattg

SEQ ID NO: 2314598 - DNA, 19 bp, Homo sapiens
cttgcaacctcaccttcct

SEQ ID NO: 2314599 - DNA, 23 bp, Homo sapiens
cttgcacagtcactgctcttcag

SEQ ID NO: 2314600 - DNA, 13 bp, Homo sapiens
cttgcatgcttgc

SEQ ID NO: 2314601 - DNA, 19 bp, Homo sapiens
cttgccagggcagggtctg

SEQ ID NO: 2314602 - DNA, 15 bp, Homo sapiens
cttgccatcagtgaa

SEQ ID NO: 2314603 - DNA, 16 bp, Homo sapiens
cttgccatttgtagct

SEQ ID NO: 2314604 - DNA, 18 bp, Homo sapiens
cttgccatttgtagcttt

SEQ ID NO: 2314605 - DNA, 13 bp, Homo sapiens
cttgcccatcctg

SEQ ID NO: 2314606 - DNA, 18 bp, Homo sapiens
cttgcccatcctgactga

SEQ ID NO: 2314607 - DNA, 18 bp, Homo sapiens
cttgccccccgccctcat

SEQ ID NO: 2314608 - DNA, 19 bp, Homo sapiens
cttgccccccgccctcatg

SEQ ID NO: 2314609 - DNA, 23 bp, Homo sapiens
cttgccggctccccctccagcca

SEQ ID NO: 2314610 - DNA, 14 bp, Homo sapiens
cttgcctctgcaca

SEQ ID NO: 2314611 - DNA, 17 bp, Homo sapiens
cttgcctttcgaggcct

SEQ ID NO: 2314612 - DNA, 17 bp, Homo sapiens
cttgcgagtccaaggcc

SEQ ID NO: 2314613 - DNA, 13 bp, Homo sapiens
cttgcgcctcagc

SEQ ID NO: 2314614 - DNA, 21 bp, Homo sapiens
cttgcgcctcagccctcagtt

SEQ ID NO: 2314615 - DNA, 15 bp, Homo sapiens
cttgctccagattct

SEQ ID NO: 2314616 - DNA, 17 bp, Homo sapiens
cttgctctgtcccccag

SEQ ID NO: 2314617 - DNA, 18 bp, Homo sapiens
cttgctctgtcccccagg

SEQ ID NO: 2314618 - DNA, 20 bp, Homo sapiens
cttgctgccatgatgtatat

SEQ ID NO: 2314619 - DNA, 13 bp, Homo sapiens
cttgctgctgtct

SEQ ID NO: 2314620 - DNA, 12 bp, Homo sapiens
cttgctggcccc

SEQ ID NO: 2314621 - DNA, 13 bp, Homo sapiens
cttgctggcccca

SEQ ID NO: 2314622 - DNA, 13 bp, Homo sapiens
cttgctggtgcct

SEQ ID NO: 2314623 - DNA, 22 bp, Homo sapiens
cttgctggtgcctgccaccttc

SEQ ID NO: 2314624 - DNA, 18 bp, Homo sapiens
cttgctgtaactcagaca

SEQ ID NO: 2314625 - DNA, 17 bp, Homo sapiens
cttgctgtccaggcagc

SEQ ID NO: 2314626 - DNA, 20 bp, Homo sapiens
cttgctgtccaggcagctcc

SEQ ID NO: 2314627 - DNA, 22 bp, Homo sapiens
cttgctgtgtgaccctgggcaa

SEQ ID NO: 2314628 - DNA, 15 bp, Homo sapiens
cttgcttacctctca

SEQ ID NO: 2314629 - DNA, 19 bp, Homo sapiens
cttgctttaccttttcagg

SEQ ID NO: 2314630 - DNA, 13 bp, Homo sapiens
cttgctttcacat

SEQ ID NO: 2314631 - DNA, 17 bp, Homo sapiens
cttgcttttctgtattt

SEQ ID NO: 2314632 - DNA, 16 bp, Homo sapiens
cttggaaatgtctgct

SEQ ID NO: 2314633 - DNA, 20 bp, Homo sapiens
cttggaagctgtttggaaaa

SEQ ID NO: 2314634 - DNA, 22 bp, Homo sapiens
cttggaagggcgttctaggtag

SEQ ID NO: 2314635 - DNA, 20 bp, Homo sapiens
cttggaccactcctgtccct

SEQ ID NO: 2314636 - DNA, 18 bp, Homo sapiens
cttggaccatgccagatt

SEQ ID NO: 2314637 - DNA, 22 bp, Homo sapiens
cttggagagcagctggctctcc

SEQ ID NO: 2314638 - DNA, 21 bp, Homo sapiens
cttggatgtcactgcctgaca

SEQ ID NO: 2314639 - DNA, 18 bp, Homo sapiens
cttggcacttattgaata

SEQ ID NO: 2314640 - DNA, 22 bp, Homo sapiens
cttggcctcccaaagtgctgag

SEQ ID NO: 2314641 - DNA, 15 bp, Homo sapiens
cttggcctgctgtga

SEQ ID NO: 2314642 - DNA, 21 bp, Homo sapiens
cttggctgcctgtgggcttcc

SEQ ID NO: 2314643 - DNA, 21 bp, Homo sapiens
cttggcttctgtgatgagctg

SEQ ID NO: 2314644 - DNA, 16 bp, Homo sapiens
cttgggaggctgaggc

SEQ ID NO: 2314645 - DNA, 20 bp, Homo sapiens
cttgggcagtgccccaggga

SEQ ID NO: 2314646 - DNA, 21 bp, Homo sapiens
cttgggcagtgccccagggag

SEQ ID NO: 2314647 - DNA, 17 bp, Homo sapiens
cttgggctctgatgaaa

SEQ ID NO: 2314648 - DNA, 20 bp, Homo sapiens
cttggggaaaatggccatgc

SEQ ID NO: 2314649 - DNA, 21 bp, Homo sapiens
cttggggaaaatggccatgca

SEQ ID NO: 2314650 - DNA, 19 bp, Homo sapiens
cttggggccaccaaagctg

SEQ ID NO: 2314651 - DNA, 21 bp, Homo sapiens
cttggggccaccaaagctgcc

SEQ ID NO: 2314652 - DNA, 19 bp, Homo sapiens
cttgggggctcccagggca

SEQ ID NO: 2314653 - DNA, 23 bp, Homo sapiens
cttggtcacaaagctatttaagt

SEQ ID NO: 2314654 - DNA, 20 bp, Homo sapiens
cttggtgattacctgaaagc

SEQ ID NO: 2314655 - DNA, 13 bp, Homo sapiens
cttggtgtaattt

SEQ ID NO: 2314656 - DNA, 16 bp, Homo sapiens
cttggtgtaatttgaa

SEQ ID NO: 2314657 - DNA, 17 bp, Homo sapiens
cttggtgtgtaggttcc

SEQ ID NO: 2314658 - DNA, 19 bp, Homo sapiens
gcctgtgcatgtatgtctt

SEQ ID NO: 2314659 - DNA, 13 bp, Homo sapiens
gcctgtgggcttc

SEQ ID NO: 2314660 - DNA, 13 bp, Homo sapiens
gcctgtgggtctc

SEQ ID NO: 2314661 - DNA, 15 bp, Homo sapiens
gccttaaacacacat

SEQ ID NO: 2314662 - DNA, 13 bp, Homo sapiens
gccttaagcaaat

SEQ ID NO: 2314663 - DNA, 14 bp, Homo sapiens
gccttaagcaaatt

SEQ ID NO: 2314664 - DNA, 19 bp, Homo sapiens
gccttacatcttttctaat

SEQ ID NO: 2314665 - DNA, 16 bp, Homo sapiens
gccttacgatggcaat

SEQ ID NO: 2314666 - DNA, 23 bp, Homo sapiens
gccttatcgggctccagccatct

SEQ ID NO: 2314667 - DNA, 19 bp, Homo sapiens
gccttcaaaactatagctt

SEQ ID NO: 2314668 - DNA, 17 bp, Homo sapiens
gccttcacaatctgtca

SEQ ID NO: 2314669 - DNA, 22 bp, Homo sapiens
gccttcacaatctgtcagttct

SEQ ID NO: 2314670 - DNA, 13 bp, Homo sapiens
gccttcagctcca

SEQ ID NO: 2314671 - DNA, 22 bp, Homo sapiens
gccttccagggatttgcctcac

SEQ ID NO: 2314672 - DNA, 20 bp, Homo sapiens
gccttcccaagttgtgcttg

SEQ ID NO: 2314673 - DNA, 24 bp, Homo sapiens
gccttccctagctttagaccctgg

SEQ ID NO: 2314674 - DNA, 22 bp, Homo sapiens
gctcactgccaggccagcctcc

SEQ ID NO: 2314675 - DNA, 16 bp, Homo sapiens
gctcagaacttgctgc

SEQ ID NO: 2314676 - DNA, 19 bp, Homo sapiens
gctcagaacttgctgctgt

SEQ ID NO: 2314677 - DNA, 20 bp, Homo sapiens
gctcagcaatagggtgcagt

SEQ ID NO: 2314678 - DNA, 17 bp, Homo sapiens
gctcagggtcactgaac

SEQ ID NO: 2314679 - DNA, 23 bp, Homo sapiens
gctcagggtcactgaaccactgc

SEQ ID NO: 2314680 - DNA, 19 bp, Homo sapiens
gctcaggtgccttacatct

SEQ ID NO: 2314681 - DNA, 15 bp, Homo sapiens
gctcagtcatcaaag

SEQ ID NO: 2314682 - DNA, 13 bp, Homo sapiens
gctcagtgtccag

SEQ ID NO: 2314683 - DNA, 16 bp, Homo sapiens
gctcagtgtccagctt

SEQ ID NO: 2314684 - DNA, 18 bp, Homo sapiens
gctcagtgtccagcttcc

SEQ ID NO: 2314685 - DNA, 23 bp, Homo sapiens
gctcataaaacatgaatcaagca

SEQ ID NO: 2314686 - DNA, 18 bp, Homo sapiens
gctccagataactctctt

SEQ ID NO: 2314687 - DNA, 19 bp, Homo sapiens
gctccagataactctcttt

SEQ ID NO: 2314688 - DNA, 22 bp, Homo sapiens
gctccagataactctctttcct

SEQ ID NO: 2314689 - DNA, 16 bp, Homo sapiens
gctccagattctgatg

SEQ ID NO: 2314690 - DNA, 17 bp, Homo sapiens
gctccagattctgatgc

SEQ ID NO: 2314691 - DNA, 14 bp, Homo sapiens
gctccataaagtac

SEQ ID NO: 2314692 - DNA, 21 bp, Homo sapiens
gctcccaggggtctccctggc

SEQ ID NO: 2314693 - DNA, 21 bp, Homo sapiens
gctccccacagcgtccctggc

SEQ ID NO: 2314694 - DNA, 22 bp, Homo sapiens
gctccccacagcgtccctggcg

SEQ ID NO: 2314695 - DNA, 19 bp, Homo sapiens
gctccccctccccaggctg

SEQ ID NO: 2314696 - DNA, 21 bp, Homo sapiens
gctcccctctgcttctcatcc

SEQ ID NO: 2314697 - DNA, 15 bp, Homo sapiens
gctcccctgccacac

SEQ ID NO: 2314698 - DNA, 18 bp, Homo sapiens
gctcccctgccacactga

SEQ ID NO: 2314699 - DNA, 14 bp, Homo sapiens
gctcccgagctact

SEQ ID NO: 2314700 - DNA, 21 bp, Homo sapiens
gctccctaaactttggccttt

SEQ ID NO: 2314701 - DNA, 13 bp, Homo sapiens
gctccctttctca

SEQ ID NO: 2314702 - DNA, 20 bp, Homo sapiens
gctccgccatggtgtcccgg

SEQ ID NO: 2314703 - DNA, 17 bp, Homo sapiens
gctccgcctggcctggc

SEQ ID NO: 2314704 - DNA, 18 bp, Homo sapiens
gctcctcaactcacctaa

SEQ ID NO: 2314705 - DNA, 11 bp, Homo sapiens
gctcctcagag

SEQ ID NO: 2314706 - DNA, 22 bp, Homo sapiens
gctcctcagagcgccaggaagc

SEQ ID NO: 2314707 - DNA, 15 bp, Homo sapiens
gctcctccccttcct

SEQ ID NO: 2314708 - DNA, 23 bp, Homo sapiens
gctcctccccttcctcttgtctg

SEQ ID NO: 2314709 - DNA, 14 bp, Homo sapiens
gctcctgtcccctg

SEQ ID NO: 2314710 - DNA, 19 bp, Homo sapiens
gctcctgtcccctgctaca

SEQ ID NO: 2314711 - DNA, 14 bp, Homo sapiens
gctccttgctgcat

SEQ ID NO: 2314712 - DNA, 19 bp, Homo sapiens
gctcctttgtgtgtgtgtc

SEQ ID NO: 2314713 - DNA, 22 bp, Homo sapiens
gctcctttgtgtgtgtgtcagc

SEQ ID NO: 2314714 - DNA, 15 bp, Homo sapiens
gctcgccccacccag

SEQ ID NO: 2314715 - DNA, 18 bp, Homo sapiens
gctcggggtaaaaagtgg

SEQ ID NO: 2314716 - DNA, 20 bp, Homo sapiens
gctctaaaaggtaatgtgtg

SEQ ID NO: 2314717 - DNA, 12 bp, Homo sapiens
gctctaccctgt

SEQ ID NO: 2314718 - DNA, 15 bp, Homo sapiens
gctctaccctgtctg

SEQ ID NO: 2314719 - DNA, 20 bp, Homo sapiens
gctctaccctgtctgtccct

SEQ ID NO: 2314720 - DNA, 12 bp, Homo sapiens
gctctattaaga

SEQ ID NO: 2314721 - DNA, 12 bp, Homo sapiens
gctctcacctct

SEQ ID NO: 2314722 - DNA, 23 bp, Homo sapiens
gctctcccgtgcatcccccctgc

SEQ ID NO: 2314723 - DNA, 21 bp, Homo sapiens
gctctccggggccatttgcaa

SEQ ID NO: 2314724 - DNA, 15 bp, Homo sapiens
gctctcctcttctac

SEQ ID NO: 2314725 - DNA, 19 bp, Homo sapiens
gctctcgcacacctctgca

SEQ ID NO: 2314726 - DNA, 19 bp, Homo sapiens
gctctctgacgcttgtgac

SEQ ID NO: 2314727 - DNA, 15 bp, Homo sapiens
gctctctgccctgtg

SEQ ID NO: 2314728 - DNA, 19 bp, Homo sapiens
gctctctgtgggctggcag

SEQ ID NO: 2314729 - DNA, 14 bp, Homo sapiens
gctctctttgcaac

SEQ ID NO: 2314730 - DNA, 13 bp, Homo sapiens
gctctgatgaaaa

SEQ ID NO: 2314731 - DNA, 23 bp, Homo sapiens
gctctgatgaaaaattgctgact

SEQ ID NO: 2314732 - DNA, 21 bp, Homo sapiens
gctctgcagtcctactcaagc

SEQ ID NO: 2314733 - DNA, 16 bp, Homo sapiens
gctctgccatcttcag

SEQ ID NO: 2314734 - DNA, 22 bp, Homo sapiens
gctctgccccaccttgccaggg

SEQ ID NO: 2314735 - DNA, 24 bp, Homo sapiens
gctctgcctcagacgttgcctgag

SEQ ID NO: 2314736 - DNA, 17 bp, Homo sapiens
gctctgggatcctgggg

SEQ ID NO: 2314737 - DNA, 23 bp, Homo sapiens
gctctggtggcttaagtgagcag

SEQ ID NO: 2314738 - DNA, 14 bp, Homo sapiens
gctctgtccccaaa

SEQ ID NO: 2314739 - DNA, 16 bp, Homo sapiens
gctctgtcccccaggc

SEQ ID NO: 2314740 - DNA, 14 bp, Homo sapiens
gctcttactctttc

SEQ ID NO: 2314741 - DNA, 20 bp, Homo sapiens
gctcttcctatccctctcct

SEQ ID NO: 2314742 - DNA, 21 bp, Homo sapiens
gctgaaattgcttatttttgg

SEQ ID NO: 2314743 - DNA, 19 bp, Homo sapiens
gctgaaattttagaaatat

SEQ ID NO: 2314744 - DNA, 17 bp, Homo sapiens
gctgaaattttatatgc

SEQ ID NO: 2314745 - DNA, 19 bp, Homo sapiens
gctgacaaccattaaagtc

SEQ ID NO: 2314746 - DNA, 20 bp, Homo sapiens
gctgacaaccattaaagtca

SEQ ID NO: 2314747 - DNA, 22 bp, Homo sapiens
gctgacaaccattaaagtcaga

SEQ ID NO: 2314748 - DNA, 18 bp, Homo sapiens
gctgacaacttagctcag

SEQ ID NO: 2314749 - DNA, 17 bp, Homo sapiens
gctgagacctgggattt

SEQ ID NO: 2314750 - DNA, 21 bp, Homo sapiens
gctgagacctgggatttgaga

SEQ ID NO: 2314751 - DNA, 21 bp, Homo sapiens
gctgagatctgctgtcctgtt

SEQ ID NO: 2314752 - DNA, 14 bp, Homo sapiens
gctgagcagcctct

SEQ ID NO: 2314753 - DNA, 14 bp, Homo sapiens
gctgagggcctgct

SEQ ID NO: 2314754 - DNA, 15 bp, Homo sapiens
gctgagggcctgctg

SEQ ID NO: 2314755 - DNA, 16 bp, Homo sapiens
gctgagggcctgctgg

SEQ ID NO: 2314756 - DNA, 19 bp, Homo sapiens
gctgaggttcctctgcctg

SEQ ID NO: 2314757 - DNA, 20 bp, Homo sapiens
gctgaggttcctctgcctgc

SEQ ID NO: 2314758 - DNA, 15 bp, Homo sapiens
gctgagttctgggtt

SEQ ID NO: 2314759 - DNA, 20 bp, Homo sapiens
gctgatattatttcttctct

SEQ ID NO: 2314760 - DNA, 22 bp, Homo sapiens
gctgatattatttcttctctta

SEQ ID NO: 2314761 - DNA, 20 bp, Homo sapiens
gctgatcagagttcctccta

SEQ ID NO: 2314762 - DNA, 22 bp, Homo sapiens
gctgatggtgtggcctgtggct

SEQ ID NO: 2314763 - DNA, 19 bp, Homo sapiens
gctgatttactaacagtaa

SEQ ID NO: 2314764 - DNA, 16 bp, Homo sapiens
gctgattttcttcttt

SEQ ID NO: 2314765 - DNA, 16 bp, Homo sapiens
gctgcaattccctgga

SEQ ID NO: 2314766 - DNA, 17 bp, Homo sapiens
gctgcacccctgggcca

SEQ ID NO: 2314767 - DNA, 13 bp, Homo sapiens
gctgcactgtgaa

SEQ ID NO: 2314768 - DNA, 13 bp, Homo sapiens
gctgcagagaaac

SEQ ID NO: 2314769 - DNA, 21 bp, Homo sapiens
gctgcagttctactcaggctg

SEQ ID NO: 2314770 - DNA, 16 bp, Homo sapiens
gctgccagccttgagc

SEQ ID NO: 2314771 - DNA, 18 bp, Homo sapiens
gctgccatcaccgctggg

SEQ ID NO: 2314772 - DNA, 19 bp, Homo sapiens
gctgccatgacagaggctg

SEQ ID NO: 2314773 - DNA, 14 bp, Homo sapiens
gctgcctacctaat

SEQ ID NO: 2314774 - DNA, 20 bp, Homo sapiens
gctgcctagattcagggaaa

SEQ ID NO: 2314775 - DNA, 13 bp, Homo sapiens
gctgcctctttcc

SEQ ID NO: 2314776 - DNA, 19 bp, Homo sapiens
gctgcgcctgcaggcagag

SEQ ID NO: 2314777 - DNA, 17 bp, Homo sapiens
gtccagctggcctggac

SEQ ID NO: 2314778 - DNA, 13 bp, Homo sapiens
gtccagctggggc

SEQ ID NO: 2314779 - DNA, 19 bp, Homo sapiens
gtccagctggggccagagg

SEQ ID NO: 2314780 - DNA, 19 bp, Homo sapiens
gtccagcttccaaagccta

SEQ ID NO: 2314781 - DNA, 21 bp, Homo sapiens
gtccaggcagctccctcctgc

SEQ ID NO: 2314782 - DNA, 12 bp, Homo sapiens
gtccagtgctct

SEQ ID NO: 2314783 - DNA, 14 bp, Homo sapiens
gtccagtgctctgc

SEQ ID NO: 2314784 - DNA, 17 bp, Homo sapiens
gtccagtgctctgcctc

SEQ ID NO: 2314785 - DNA, 15 bp, Homo sapiens
gtccatacactttgt

SEQ ID NO: 2314786 - DNA, 21 bp, Homo sapiens
gtccatagagatgagcccacc

SEQ ID NO: 2314787 - DNA, 18 bp, Homo sapiens
gtccatgctaacaaagac

SEQ ID NO: 2314788 - DNA, 21 bp, Homo sapiens
gtcccagactaaaggatccag

SEQ ID NO: 2314789 - DNA, 22 bp, Homo sapiens
gtcccagactaaaggatccaga

SEQ ID NO: 2314790 - DNA, 17 bp, Homo sapiens
gtcccagatgctgtcat

SEQ ID NO: 2314791 - DNA, 15 bp, Homo sapiens
gtcccagttttgttg

SEQ ID NO: 2314792 - DNA, 23 bp, Homo sapiens
gtcccagttttgttgccccagaa

SEQ ID NO: 2314793 - DNA, 21 bp, Homo sapiens
gtcccatccagctaccaccac

SEQ ID NO: 2314794 - DNA, 16 bp, Homo sapiens
gtcccatttttctctt

SEQ ID NO: 2314795 - DNA, 14 bp, Homo sapiens
gtcccccaggctgg

SEQ ID NO: 2314796 - DNA, 15 bp, Homo sapiens
gtcccccaggctgga

SEQ ID NO: 2314797 - DNA, 20 bp, Homo sapiens
gtcccctcacgcaagtgcca

SEQ ID NO: 2314798 - DNA, 22 bp, Homo sapiens
gtcccctcccagagctggtgga

SEQ ID NO: 2314799 - DNA, 18 bp, Homo sapiens
gtcccctcgtcccatcca

SEQ ID NO: 2314800 - DNA, 19 bp, Homo sapiens
gtccctccctgcctgaggg

SEQ ID NO: 2314801 - DNA, 12 bp, Homo sapiens
gtccctgaggat

SEQ ID NO: 2314802 - DNA, 14 bp, Homo sapiens
gtccctggaaaagg

SEQ ID NO: 2314803 - DNA, 12 bp, Homo sapiens
gtccgcctctgc

SEQ ID NO: 2314804 - DNA, 16 bp, Homo sapiens
gtccggaatgccaccc

SEQ ID NO: 2314805 - DNA, 14 bp, Homo sapiens
gtccggatttctaa

SEQ ID NO: 2314806 - DNA, 21 bp, Homo sapiens
gtccggatttctaacagtcct

SEQ ID NO: 2314807 - DNA, 21 bp, Homo sapiens
gtccgtgtgtcccagatgctg

SEQ ID NO: 2314808 - DNA, 15 bp, Homo sapiens
gtcctccaggagctt

SEQ ID NO: 2314809 - DNA, 16 bp, Homo sapiens
gtcctccttttcactt

SEQ ID NO: 2314810 - DNA, 17 bp, Homo sapiens
gtcctttaggcagcctg

SEQ ID NO: 2314811 - DNA, 14 bp, Homo sapiens
gtcctttatgtatt

SEQ ID NO: 2314812 - DNA, 19 bp, Homo sapiens
gtcctttttcactttgaaa

SEQ ID NO: 2314813 - DNA, 21 bp, Homo sapiens
gtcctttttcactttgaaaag

SEQ ID NO: 2314814 - DNA, 20 bp, Homo sapiens
gtcctttttcctctccacac

SEQ ID NO: 2314815 - DNA, 13 bp, Homo sapiens
gtcggatctcaca

SEQ ID NO: 2314816 - DNA, 14 bp, Homo sapiens
gtcggatctcacag

SEQ ID NO: 2314817 - DNA, 11 bp, Homo sapiens
gtctaaagatc

SEQ ID NO: 2314818 - DNA, 23 bp, Homo sapiens
gtctaagactatatatataaatg

SEQ ID NO: 2314819 - DNA, 16 bp, Homo sapiens
gtctaggactgcagtg

SEQ ID NO: 2314820 - DNA, 17 bp, Homo sapiens
gtctaggagatgctttc

SEQ ID NO: 2314821 - DNA, 23 bp, Homo sapiens
gtctatgtagctgaaaataaaat

SEQ ID NO: 2314822 - DNA, 14 bp, Homo sapiens
gtctattatcacat

SEQ ID NO: 2314823 - DNA, 20 bp, Homo sapiens
gtctcaaacttgtggcctca

SEQ ID NO: 2314824 - DNA, 22 bp, Homo sapiens
gtctcaaacttgtggcctcaag

SEQ ID NO: 2314825 - DNA, 13 bp, Homo sapiens
gtctcaggcagca

SEQ ID NO: 2314826 - DNA, 22 bp, Homo sapiens
gtctcaggtttgttttgtgaat

SEQ ID NO: 2314827 - DNA, 19 bp, Homo sapiens
gtctccctcccctctcaga

SEQ ID NO: 2314828 - DNA, 22 bp, Homo sapiens
gtctccctcccctctcagaaca

SEQ ID NO: 2314829 - DNA, 23 bp, Homo sapiens
gtctccctcccctctcagaacat

SEQ ID NO: 2314830 - DNA, 11 bp, Homo sapiens
gtctccctggc

SEQ ID NO: 2314831 - DNA, 15 bp, Homo sapiens
gtctccctggctccc

SEQ ID NO: 2314832 - DNA, 17 bp, Homo sapiens
gtctctactaaaaatac

SEQ ID NO: 2314833 - DNA, 17 bp, Homo sapiens
gtctctctatgcctctc

SEQ ID NO: 2314834 - DNA, 22 bp, Homo sapiens
gtctctctatgcctctctacag

SEQ ID NO: 2314835 - DNA, 12 bp, Homo sapiens
gtctctgaaggg

SEQ ID NO: 2314836 - DNA, 12 bp, Homo sapiens
gtctctgctggg

SEQ ID NO: 2314837 - DNA, 22 bp, Homo sapiens
gtctctgttaacatctagccta

SEQ ID NO: 2314838 - DNA, 23 bp, Homo sapiens
gtctcttttaccctggcccctct

SEQ ID NO: 2314839 - DNA, 19 bp, Homo sapiens
gtctgaagaaggaaggcct

SEQ ID NO: 2314840 - DNA, 16 bp, Homo sapiens
gtctgccatgttgccc

SEQ ID NO: 2314841 - DNA, 21 bp, Homo sapiens
gtctgcccacgcagaggacgc

SEQ ID NO: 2314842 - DNA, 16 bp, Homo sapiens
gtctgctctggtggct

SEQ ID NO: 2314843 - DNA, 17 bp, Homo sapiens
gtctgctggtatttcta

SEQ ID NO: 2314844 - DNA, 14 bp, Homo sapiens
gtctgggctgggca

SEQ ID NO: 2314845 - DNA, 18 bp, Homo sapiens
gtctgggctgggcacctg

SEQ ID NO: 2314846 - DNA, 14 bp, Homo sapiens
gtctgggtgctact

SEQ ID NO: 2314847 - DNA, 20 bp, Homo sapiens
gtctgggtgctactggggaa

SEQ ID NO: 2314848 - DNA, 16 bp, Homo sapiens
gtctgtcaatcacagt

SEQ ID NO: 2314849 - DNA, 23 bp, Homo sapiens
gtctgtctccctcccctctcaga

SEQ ID NO: 2314850 - DNA, 24 bp, Homo sapiens
gtctgtctccctcccctctcagaa

SEQ ID NO: 2314851 - DNA, 21 bp, Homo sapiens
gtctgtgaacagagagaccct

SEQ ID NO: 2314852 - DNA, 21 bp, Homo sapiens
gtctgttcagcaaactaacca

SEQ ID NO: 2314853 - DNA, 22 bp, Homo sapiens
gtctgtttattaactactgaat

SEQ ID NO: 2314854 - DNA, 21 bp, Homo sapiens
gtcttaataaaataaactaga

SEQ ID NO: 2314855 - DNA, 16 bp, Homo sapiens
gtcttccctgggctgc

SEQ ID NO: 2314856 - DNA, 18 bp, Homo sapiens
gtcttcctgacactttaa

SEQ ID NO: 2314857 - DNA, 19 bp, Homo sapiens
gtcttcctgacactttaat

SEQ ID NO: 2314858 - DNA, 16 bp, Homo sapiens
gtcttcttacatgcat

SEQ ID NO: 2314859 - DNA, 12 bp, Homo sapiens
gtcttgctctgt

SEQ ID NO: 2314860 - DNA, 14 bp, Homo sapiens
gtcttgctctgtcc

SEQ ID NO: 2314861 - DNA, 16 bp, Homo sapiens
gtcttgctctgtcccc

SEQ ID NO: 2314862 - DNA, 14 bp, Homo sapiens
gtcttggacactgt

SEQ ID NO: 2314863 - DNA, 17 bp, Homo sapiens
gtcttgtatttaaaaac

SEQ ID NO: 2314864 - DNA, 16 bp, Homo sapiens
gtctttcatggctgct

SEQ ID NO: 2314865 - DNA, 23 bp, Homo sapiens
gtctttcatggctgctgttgctt

SEQ ID NO: 2314866 - DNA, 12 bp, Homo sapiens
gtctttgtaaga

SEQ ID NO: 2314867 - DNA, 20 bp, Homo sapiens
gtctttgtaagagtgtagaa

SEQ ID NO: 2314868 - DNA, 22 bp, Homo sapiens
gtcttttcaaataatgcttttc

SEQ ID NO: 2314869 - DNA, 14 bp, Homo sapiens
gtcttttttttcct

SEQ ID NO: 2314870 - DNA, 17 bp, Homo sapiens
gtgaaaccttttttaag

SEQ ID NO: 2314871 - DNA, 21 bp, Homo sapiens
gtgaaagagagtaccatgctg

SEQ ID NO: 2314872 - DNA, 22 bp, Homo sapiens
gtgaaagtgcatttttgtaaat

SEQ ID NO: 2314873 - DNA, 20 bp, Homo sapiens
gtgaaattgcatactttgta

SEQ ID NO: 2314874 - DNA, 23 bp, Homo sapiens
gtgaaccaagctataaaagccca

SEQ ID NO: 2314875 - DNA, 13 bp, Homo sapiens
gtgaaccagaggg

SEQ ID NO: 2314876 - DNA, 21 bp, Homo sapiens
gtgaaccctggggcctgactg

SEQ ID NO: 2314877 - DNA, 13 bp, Homo sapiens
gtgaactcctgcc

SEQ ID NO: 2314878 - DNA, 19 bp, Homo sapiens
gtgaactcctgccaggcac

SEQ ID NO: 2314879 - DNA, 13 bp, Homo sapiens
gtgaagtgcttgg

SEQ ID NO: 2314880 - DNA, 20 bp, Homo sapiens
gtgaatggattggattattt

SEQ ID NO: 2314881 - DNA, 17 bp, Homo sapiens
gtgaattattgacactg

SEQ ID NO: 2314882 - DNA, 17 bp, Homo sapiens
gtgaatttttaagctgc

SEQ ID NO: 2314883 - DNA, 20 bp, Homo sapiens
gtgacaaataagattaataa

SEQ ID NO: 2314884 - DNA, 15 bp, Homo sapiens
gtgacagtttccaaa

SEQ ID NO: 2314885 - DNA, 16 bp, Homo sapiens
gtgacatggtgcctga

SEQ ID NO: 2314886 - DNA, 19 bp, Homo sapiens
gtgacatggtgcctgagag

SEQ ID NO: 2314887 - DNA, 20 bp, Homo sapiens
gtgacatggtgcctgagagg

SEQ ID NO: 2314888 - DNA, 14 bp, Homo sapiens
gtgacatgtgaaac

SEQ ID NO: 2314889 - DNA, 20 bp, Homo sapiens
gtgacatgtgaaaccttttt

SEQ ID NO: 2314890 - DNA, 20 bp, Homo sapiens
gtgaccctccaaatggagaa

SEQ ID NO: 2314891 - DNA, 19 bp, Homo sapiens
gtgagaaacatctcaataa

SEQ ID NO: 2314892 - DNA, 17 bp, Homo sapiens
gtgagaacccagtttcc

SEQ ID NO: 2314893 - DNA, 23 bp, Homo sapiens
gtgagaatgatcaaggatctgga

SEQ ID NO: 2314894 - DNA, 14 bp, Homo sapiens
gtgagactgcccca

SEQ ID NO: 2314895 - DNA, 14 bp, Homo sapiens
gtgagcagaacagg

SEQ ID NO: 2314896 - DNA, 18 bp, Homo sapiens
gtgagccaccgtgcctgg

SEQ ID NO: 2314897 - DNA, 22 bp, Homo sapiens
gtgagccaccgtgcctggccag

SEQ ID NO: 2314898 - DNA, 20 bp, Homo sapiens
gtgaggacctgtaaggcagg

SEQ ID NO: 2314899 - DNA, 18 bp, Homo sapiens
gtgagtgacgatgatgta

SEQ ID NO: 2314900 - DNA, 18 bp, Homo sapiens
gtgagtttgagctgcctt

SEQ ID NO: 2314901 - DNA, 19 bp, Homo sapiens
gtgataagggaaaagataa

SEQ ID NO: 2314902 - DNA, 14 bp, Homo sapiens
gtgatctgttgtaa

SEQ ID NO: 2314903 - DNA, 16 bp, Homo sapiens
gtgatgacttgctgtc

SEQ ID NO: 2314904 - DNA, 15 bp, Homo sapiens
gtgatggccagcccc

SEQ ID NO: 2314905 - DNA, 22 bp, Homo sapiens
gtgatgtggaggaagagccacc

SEQ ID NO: 2314906 - DNA, 23 bp, Homo sapiens
gtgatttgaaaaatataaaatta

SEQ ID NO: 2314907 - DNA, 20 bp, Homo sapiens
gtgatttggaagagaggcac

SEQ ID NO: 2314908 - DNA, 19 bp, Homo sapiens
gtgatttttaaattaaata

SEQ ID NO: 2314909 - DNA, 21 bp, Homo sapiens
gtgcaaggagtgtaaaatgta

SEQ ID NO: 2314910 - DNA, 16 bp, Homo sapiens
gtgcaaggtggccttt

SEQ ID NO: 2314911 - DNA, 22 bp, Homo sapiens
gtgcaaggtggcctttgtgctg

SEQ ID NO: 2314912 - DNA, 22 bp, Homo sapiens
gtgcacatatccaggcaccagg

SEQ ID NO: 2314913 - DNA, 22 bp, Homo sapiens
gtgcacccacctgttttctgaa

SEQ ID NO: 2314914 - DNA, 13 bp, Homo sapiens
gtgcagccttctc

SEQ ID NO: 2314915 - DNA, 14 bp, Homo sapiens
gtgcagtcactgga

SEQ ID NO: 2314916 - DNA, 21 bp, Homo sapiens
gtgcagtcagcagatgctgtt

SEQ ID NO: 2314917 - DNA, 15 bp, Homo sapiens
gtgcagttttccagg

SEQ ID NO: 2314918 - DNA, 14 bp, Homo sapiens
gtgcataatgataa

SEQ ID NO: 2314919 - DNA, 21 bp, Homo sapiens
gtgcatcccccctgctcagca

SEQ ID NO: 2314920 - DNA, 16 bp, Homo sapiens
gtgcatgtatgtcttg

SEQ ID NO: 2314921 - DNA, 14 bp, Homo sapiens
gtgcatttaattag

SEQ ID NO: 2314922 - DNA, 13 bp, Homo sapiens
gtgcatttttgta

SEQ ID NO: 2314923 - DNA, 22 bp, Homo sapiens
gtgcatttttgtgaaatgaaaa

SEQ ID NO: 2314924 - DNA, 23 bp, Homo sapiens
gtgccactttacccacctagaac

SEQ ID NO: 2314925 - DNA, 21 bp, Homo sapiens
gtgccagaggaatcctggcag

SEQ ID NO: 2314926 - DNA, 13 bp, Homo sapiens
gtgccccagggag

SEQ ID NO: 2314927 - DNA, 21 bp, Homo sapiens
gtgccccagggagtccagggt

SEQ ID NO: 2314928 - DNA, 21 bp, Homo sapiens
gtgccccccacccctggaaga

SEQ ID NO: 2314929 - DNA, 16 bp, Homo sapiens
gtgccccgcctgagtc

SEQ ID NO: 2314930 - DNA, 19 bp, Homo sapiens
gtgccctctcccaccctct

SEQ ID NO: 2314931 - DNA, 15 bp, Homo sapiens
gtgcctgccaccttc

SEQ ID NO: 2314932 - DNA, 19 bp, Homo sapiens
gtgcctggccagatttttc

SEQ ID NO: 2314933 - DNA, 16 bp, Homo sapiens
gtgcctggccccagcc

SEQ ID NO: 2314934 - DNA, 18 bp, Homo sapiens
gtgcctttctacaactga

SEQ ID NO: 2314935 - DNA, 13 bp, Homo sapiens
gtgcgtctccagt

SEQ ID NO: 2314936 - DNA, 21 bp, Homo sapiens
gtgcgtggaatgcccttcact

SEQ ID NO: 2314937 - DNA, 19 bp, Homo sapiens
gtgctactggggaaactgg

SEQ ID NO: 2314938 - DNA, 17 bp, Homo sapiens
gtgctatacacacacac

SEQ ID NO: 2314939 - DNA, 18 bp, Homo sapiens
gtgctatttaacatttta

SEQ ID NO: 2314940 - DNA, 15 bp, Homo sapiens
gtgctcaccagccct

SEQ ID NO: 2314941 - DNA, 23 bp, Homo sapiens
gtgctccatatttgatttctaat

SEQ ID NO: 2314942 - DNA, 12 bp, Homo sapiens
gtgctctgcctc

SEQ ID NO: 2314943 - DNA, 17 bp, Homo sapiens
gtgctgacaacttagct

SEQ ID NO: 2314944 - DNA, 18 bp, Homo sapiens
gtgctgacaacttagctc

SEQ ID NO: 2314945 - DNA, 18 bp, Homo sapiens
gtgctgagattgcagatg

SEQ ID NO: 2314946 - DNA, 16 bp, Homo sapiens
gtgctgcgcctgcagg

SEQ ID NO: 2314947 - DNA, 19 bp, Homo sapiens
gtgctgcgcctgcaggcag

SEQ ID NO: 2314948 - DNA, 15 bp, Homo sapiens
gtgctggaagggagg

SEQ ID NO: 2314949 - DNA, 23 bp, Homo sapiens
gtgctggagtctcctgaggacac

SEQ ID NO: 2314950 - DNA, 15 bp, Homo sapiens
gtgctgggaggaggg

SEQ ID NO: 2314951 - DNA, 17 bp, Homo sapiens
gtgctgggaggagggag

SEQ ID NO: 2314952 - DNA, 15 bp, Homo sapiens
gtgcttgaaggccct

SEQ ID NO: 2314953 - DNA, 18 bp, Homo sapiens
gtgcttgaaggccctgct

SEQ ID NO: 2314954 - DNA, 21 bp, Homo sapiens
gtgcttgaaggccctgctgag

SEQ ID NO: 2314955 - DNA, 19 bp, Homo sapiens
gtgcttttatagaggctag

SEQ ID NO: 2314956 - DNA, 16 bp, Homo sapiens
gtggagcactggactc

SEQ ID NO: 2314957 - DNA, 15 bp, Homo sapiens
gtggaggaaggattg

SEQ ID NO: 2314958 - DNA, 15 bp, Homo sapiens
gtggaggcttcctgc

SEQ ID NO: 2314959 - DNA, 12 bp, Homo sapiens
gtggaggggtgt

SEQ ID NO: 2314960 - DNA, 12 bp, Homo sapiens
gtggagttcacc

SEQ ID NO: 2314961 - DNA, 14 bp, Homo sapiens
gtggagtttctctg

SEQ ID NO: 2314962 - DNA, 15 bp, Homo sapiens
gtggagtttctctgt

SEQ ID NO: 2314963 - DNA, 17 bp, Homo sapiens
gtggataactagccaga

SEQ ID NO: 2314964 - DNA, 18 bp, Homo sapiens
gtggatggccgtggatgc

SEQ ID NO: 2314965 - DNA, 15 bp, Homo sapiens
gtggatgttatgaac

SEQ ID NO: 2314966 - DNA, 17 bp, Homo sapiens
gtggatgttatgaacag

SEQ ID NO: 2314967 - DNA, 17 bp, Homo sapiens
gtggattgcctctgaaa

SEQ ID NO: 2314968 - DNA, 12 bp, Homo sapiens
gtggattgtttt

SEQ ID NO: 2314969 - DNA, 13 bp, Homo sapiens
gtggcaattagtg

SEQ ID NO: 2314970 - DNA, 12 bp, Homo sapiens
gtggcagtattg

SEQ ID NO: 2314971 - DNA, 13 bp, Homo sapiens
gtggccaagccta

SEQ ID NO: 2314972 - DNA, 18 bp, Homo sapiens
gtggcccaaggctggcag

SEQ ID NO: 2314973 - DNA, 13 bp, Homo sapiens
gtggcctgtggct

SEQ ID NO: 2314974 - DNA, 14 bp, Homo sapiens
gtggcctttgtgct

SEQ ID NO: 2314975 - DNA, 14 bp, Homo sapiens
gtggcgggcacctg

SEQ ID NO: 2314976 - DNA, 15 bp, Homo sapiens
gtggctatcctgatt

SEQ ID NO: 2314977 - DNA, 23 bp, Homo sapiens
gtggctgatttactaacagtaac

SEQ ID NO: 2314978 - DNA, 24 bp, Homo sapiens
gtggctggaaccacattgaagaat

SEQ ID NO: 2314979 - DNA, 22 bp, Homo sapiens
gtggctggctctaccttcctgt

SEQ ID NO: 2314980 - DNA, 20 bp, Homo sapiens
gtgggatttccagaaccaca

SEQ ID NO: 2314981 - DNA, 19 bp, Homo sapiens
gtgggctggacttctacct

SEQ ID NO: 2314982 - DNA, 14 bp, Homo sapiens
gtggggcctgggag

SEQ ID NO: 2314983 - DNA, 15 bp, Homo sapiens
gtgggggtggaggct

SEQ ID NO: 2314984 - DNA, 11 bp, Homo sapiens
gttcttcatga

SEQ ID NO: 2314985 - DNA, 16 bp, Homo sapiens
gttctttcctctttct

SEQ ID NO: 2314986 - DNA, 15 bp, Homo sapiens
gttctttctgggggg

SEQ ID NO: 2314987 - DNA, 14 bp, Homo sapiens
gttctttggattct

SEQ ID NO: 2314988 - DNA, 23 bp, Homo sapiens
gttgaaatgttctgtcaaatgtg

SEQ ID NO: 2314989 - DNA, 19 bp, Homo sapiens
gttgaactaatatatgaaa

SEQ ID NO: 2314990 - DNA, 19 bp, Homo sapiens
gttgaagagacagagacaa

SEQ ID NO: 2314991 - DNA, 20 bp, Homo sapiens
gttgaagagacagagacaag

SEQ ID NO: 2314992 - DNA, 22 bp, Homo sapiens
gttgaagagacagagacaagta

SEQ ID NO: 2314993 - DNA, 19 bp, Homo sapiens
gttgaggccactgtgttcc

SEQ ID NO: 2314994 - DNA, 20 bp, Homo sapiens
gttgataaaccaaaaacatt

SEQ ID NO: 2314995 - DNA, 23 bp, Homo sapiens
gttgataaaccaaaaacatttga

SEQ ID NO: 2314996 - DNA, 14 bp, Homo sapiens
gttgcaaagagaca

SEQ ID NO: 2314997 - DNA, 18 bp, Homo sapiens
gttgcaagatgtgaatta

SEQ ID NO: 2314998 - DNA, 23 bp, Homo sapiens
gttgcatagcagtatatgttaat

SEQ ID NO: 2314999 - DNA, 16 bp, Homo sapiens
gttgccaaagctggtc

SEQ ID NO: 2315000 - DNA, 19 bp, Homo sapiens
gttgccacagtagaactgt

SEQ ID NO: 2315001 - DNA, 23 bp, Homo sapiens
gttggatggatgggtggatggcc

SEQ ID NO: 2315002 - DNA, 19 bp, Homo sapiens
gttgggctcgcactgccca

SEQ ID NO: 2315003 - DNA, 21 bp, Homo sapiens
gttgggtgtctccttaagctg

SEQ ID NO: 2315004 - DNA, 16 bp, Homo sapiens
gttgtaagaattctga

SEQ ID NO: 2315005 - DNA, 20 bp, Homo sapiens
gttgtacatttatgatttaa

SEQ ID NO: 2315006 - DNA, 22 bp, Homo sapiens
gttgtcttatgtgaaaaattaa

SEQ ID NO: 2315007 - DNA, 23 bp, Homo sapiens
gttgtcttatgtgaaaaattaac

SEQ ID NO: 2315008 - DNA, 13 bp, Homo sapiens
gttgtgatctgtt

SEQ ID NO: 2315009 - DNA, 16 bp, Homo sapiens
gttgttcgggccaagg

SEQ ID NO: 2315010 - DNA, 13 bp, Homo sapiens
gttgttctgcctg

SEQ ID NO: 2315011 - DNA, 15 bp, Homo sapiens
gttgtttataataaa

SEQ ID NO: 2315012 - DNA, 14 bp, Homo sapiens
gttgtttctttcta

SEQ ID NO: 2315013 - DNA, 19 bp, Homo sapiens
gtttaaaatgtaatttaaa

SEQ ID NO: 2315014 - DNA, 13 bp, Homo sapiens
gtttaaaatgtgt

SEQ ID NO: 2315015 - DNA, 21 bp, Homo sapiens
gtttaatgggtatgctcaggt

SEQ ID NO: 2315016 - DNA, 15 bp, Homo sapiens
gtttagctctgagaa

SEQ ID NO: 2315017 - DNA, 14 bp, Homo sapiens
gtttagttctgttg

SEQ ID NO: 2315018 - DNA, 13 bp, Homo sapiens
gtttataataaaa

SEQ ID NO: 2315019 - DNA, 14 bp, Homo sapiens
gtttataataaaaa

SEQ ID NO: 2315020 - DNA, 15 bp, Homo sapiens
gtttattaaatgctt

SEQ ID NO: 2315021 - DNA, 21 bp, Homo sapiens
gtttattttctacgtttcttt

SEQ ID NO: 2315022 - DNA, 23 bp, Homo sapiens
gtttattttctacgtttctttaa

SEQ ID NO: 2315023 - DNA, 14 bp, Homo sapiens
gtttcaaagtgata

SEQ ID NO: 2315024 - DNA, 21 bp, Homo sapiens
gtttcacagcacttacaattt

SEQ ID NO: 2315025 - DNA, 10 bp, Homo sapiens
gtttcaggtg

SEQ ID NO: 2315026 - DNA, 14 bp, Homo sapiens
gtttcaggtgacat

SEQ ID NO: 2315027 - DNA, 20 bp, Homo sapiens
gtttcaggtgacatgtgaaa

SEQ ID NO: 2315028 - DNA, 15 bp, Homo sapiens
gtttcagtttgttgg

SEQ ID NO: 2315029 - DNA, 21 bp, Homo sapiens
gtttcagtttgttggaaagta

SEQ ID NO: 2315030 - DNA, 16 bp, Homo sapiens
gtttcattcatcctga

SEQ ID NO: 2315031 - DNA, 18 bp, Homo sapiens
gtttcctaggaggaaaat

SEQ ID NO: 2315032 - DNA, 23 bp, Homo sapiens
gtttctaccggagagagaatgta

SEQ ID NO: 2315033 - DNA, 13 bp, Homo sapiens
gtttctctgcaga

SEQ ID NO: 2315034 - DNA, 21 bp, Homo sapiens
gtttctgtcaagctggtgcta

SEQ ID NO: 2315035 - DNA, 14 bp, Homo sapiens
gtttcttctttcta

SEQ ID NO: 2315036 - DNA, 17 bp, Homo sapiens
gtttcttctttctagag

SEQ ID NO: 2315037 - DNA, 21 bp, Homo sapiens
gtttctttaaccttgtataaa

SEQ ID NO: 2315038 - DNA, 18 bp, Homo sapiens
gtttctttctagtggtct

SEQ ID NO: 2315039 - DNA, 23 bp, Homo sapiens
gtttctttctagtggtctttgta

SEQ ID NO: 2315040 - DNA, 18 bp, Homo sapiens
gtttcttttgtttggtaa

SEQ ID NO: 2315041 - DNA, 16 bp, Homo sapiens
gtttgactacatagtc

SEQ ID NO: 2315042 - DNA, 20 bp, Homo sapiens
gtttgcaacctctttgctca

SEQ ID NO: 2315043 - DNA, 20 bp, Homo sapiens
gtttggaaaaaactctgaag

SEQ ID NO: 2315044 - DNA, 16 bp, Homo sapiens
gtttgtagtaaaagtg

SEQ ID NO: 2315045 - DNA, 19 bp, Homo sapiens
gtttgtcctttatgtattc

SEQ ID NO: 2315046 - DNA, 17 bp, Homo sapiens
gtttgttcataataaaa

SEQ ID NO: 2315047 - DNA, 15 bp, Homo sapiens
gtttgttttgtgaat

SEQ ID NO: 2315048 - DNA, 16 bp, Homo sapiens
gttttacaatagttct

SEQ ID NO: 2315049 - DNA, 13 bp, Homo sapiens
gttttatatgatt

SEQ ID NO: 2315050 - DNA, 20 bp, Homo sapiens
gttttatggttacttcttct

SEQ ID NO: 2315051 - DNA, 12 bp, Homo sapiens
gttttattattt

SEQ ID NO: 2315052 - DNA, 21 bp, Homo sapiens
gttttcaggttttgtttttag

SEQ ID NO: 2315053 - DNA, 22 bp, Homo sapiens
gttttcctataatataataaat

SEQ ID NO: 2315054 - DNA, 13 bp, Homo sapiens
gttttctgaaaca

SEQ ID NO: 2315055 - DNA, 14 bp, Homo sapiens
gttttcttctttcc

SEQ ID NO: 2315056 - DNA, 19 bp, Homo sapiens
gttttcttctttccctgga

SEQ ID NO: 2315057 - DNA, 13 bp, Homo sapiens
gttttgaaaagct

SEQ ID NO: 2315058 - DNA, 20 bp, Homo sapiens
gttttggcaaacgctaaaga

SEQ ID NO: 2315059 - DNA, 15 bp, Homo sapiens
gttttgtaaaagaaa

SEQ ID NO: 2315060 - DNA, 17 bp, Homo sapiens
gttttgtctgtctccct

SEQ ID NO: 2315061 - DNA, 19 bp, Homo sapiens
gtttttaaataaagaacaa

SEQ ID NO: 2315062 - DNA, 15 bp, Homo sapiens
gtttttatattttca

SEQ ID NO: 2315063 - DNA, 14 bp, Homo sapiens
gtttttcacatttt

SEQ ID NO: 2315064 - DNA, 16 bp, Homo sapiens
gtttttcacattttcc

SEQ ID NO: 2315065 - DNA, 15 bp, Homo sapiens
gtttttccctcccca

SEQ ID NO: 2315066 - DNA, 18 bp, Homo sapiens
gtttttccctccccagaa

SEQ ID NO: 2315067 - DNA, 12 bp, Homo sapiens
gtttttcctccc

SEQ ID NO: 2315068 - DNA, 19 bp, Homo sapiens
gttttttaagatagtgtaa

SEQ ID NO: 2315069 - DNA, 13 bp, Homo sapiens
gttttttccccct

SEQ ID NO: 2315070 - DNA, 18 bp, Homo sapiens
taaaaaaaaatgcctttg

SEQ ID NO: 2315071 - DNA, 12 bp, Homo sapiens
taaaaaaaccac

SEQ ID NO: 2315072 - DNA, 12 bp, Homo sapiens
taaaaaaattta

SEQ ID NO: 2315073 - DNA, 17 bp, Homo sapiens
taaaaaaatttaagtgc

SEQ ID NO: 2315074 - DNA, 18 bp, Homo sapiens
taaaaaagcgaggtggcc

SEQ ID NO: 2315075 - DNA, 18 bp, Homo sapiens
taaaaacagcagctcata

SEQ ID NO: 2315076 - DNA, 14 bp, Homo sapiens
taaaaacatttttt

SEQ ID NO: 2315077 - DNA, 23 bp, Homo sapiens
taaaaactaacagctacaaactt

SEQ ID NO: 2315078 - DNA, 20 bp, Homo sapiens
taaaaactcaggcaaagaaa

SEQ ID NO: 2315079 - DNA, 21 bp, Homo sapiens
taaaaagaagatgaatggtct

SEQ ID NO: 2315080 - DNA, 21 bp, Homo sapiens
taaaaagtaatgacttagaaa

SEQ ID NO: 2315081 - DNA, 19 bp, Homo sapiens
taaaaagtataaaatagta

SEQ ID NO: 2315082 - DNA, 15 bp, Homo sapiens
taaaaagtggctgcg

SEQ ID NO: 2315083 - DNA, 22 bp, Homo sapiens
taaaaatctagcacactcttct

SEQ ID NO: 2315084 - DNA, 18 bp, Homo sapiens
taaaaatgagatttctta

SEQ ID NO: 2315085 - DNA, 19 bp, Homo sapiens
taaaaatgagatttcttat

SEQ ID NO: 2315086 - DNA, 12 bp, Homo sapiens
taaaaattgtta

SEQ ID NO: 2315087 - DNA, 16 bp, Homo sapiens
taaaacaaataaatat

SEQ ID NO: 2315088 - DNA, 18 bp, Homo sapiens
taaaacaaataaatatga

SEQ ID NO: 2315089 - DNA, 13 bp, Homo sapiens
taaaacagacact

SEQ ID NO: 2315090 - DNA, 18 bp, Homo sapiens
taaaacagacactggcat

SEQ ID NO: 2315091 - DNA, 11 bp, Homo sapiens
taaaaccaaag

SEQ ID NO: 2315092 - DNA, 17 bp, Homo sapiens
taaaactcactgtgatc

SEQ ID NO: 2315093 - DNA, 18 bp, Homo sapiens
taaaagaaatatattttt

SEQ ID NO: 2315094 - DNA, 15 bp, Homo sapiens
taaaagaatgactat

SEQ ID NO: 2315095 - DNA, 19 bp, Homo sapiens
taaaagatggttgtagcat

SEQ ID NO: 2315096 - DNA, 22 bp, Homo sapiens
taaaagatggttgtagcattta

SEQ ID NO: 2315097 - DNA, 18 bp, Homo sapiens
taaaagcaccactgttct

SEQ ID NO: 2315098 - DNA, 21 bp, Homo sapiens
taaaaggtggagtttctctgt

SEQ ID NO: 2315099 - DNA, 16 bp, Homo sapiens
ggctcccctctgcttc

SEQ ID NO: 2315100 - DNA, 20 bp, Homo sapiens
ggctcccctctgcttctcat

SEQ ID NO: 2315101 - DNA, 15 bp, Homo sapiens
ggctccctcctccag

SEQ ID NO: 2315102 - DNA, 18 bp, Homo sapiens
ggctccctcctggagcat

SEQ ID NO: 2315103 - DNA, 12 bp, Homo sapiens
ggctcctcagag

SEQ ID NO: 2315104 - DNA, 17 bp, Homo sapiens
ggctcctcagagcgcca

SEQ ID NO: 2315105 - DNA, 14 bp, Homo sapiens
ggctcgccccaccc

SEQ ID NO: 2315106 - DNA, 19 bp, Homo sapiens
ggctcggggtaaaaagtgg

SEQ ID NO: 2315107 - DNA, 22 bp, Homo sapiens
ggctcggggtaaaaagtggctg

SEQ ID NO: 2315108 - DNA, 17 bp, Homo sapiens
ggctctaccctgtctgt

SEQ ID NO: 2315109 - DNA, 19 bp, Homo sapiens
ggctctaccctgtctgtcc

SEQ ID NO: 2315110 - DNA, 15 bp, Homo sapiens
ggctctaccttcctg

SEQ ID NO: 2315111 - DNA, 17 bp, Homo sapiens
ggctctaccttcctgtc

SEQ ID NO: 2315112 - DNA, 21 bp, Homo sapiens
ggctctaccttcctgtccctg

SEQ ID NO: 2315113 - DNA, 21 bp, Homo sapiens
ggctctccaccttgttacaca

SEQ ID NO: 2315114 - DNA, 22 bp, Homo sapiens
ggctctgatgaaaaattgctga

SEQ ID NO: 2315115 - DNA, 13 bp, Homo sapiens
ggctgaaaacaat

SEQ ID NO: 2315116 - DNA, 20 bp, Homo sapiens
ggctgaaagaggccaatgcc

SEQ ID NO: 2315117 - DNA, 11 bp, Homo sapiens
ggctgagacct

SEQ ID NO: 2315118 - DNA, 20 bp, Homo sapiens
ggctgagctctctgtgggct

SEQ ID NO: 2315119 - DNA, 16 bp, Homo sapiens
ggctgaggcaggagaa

SEQ ID NO: 2315120 - DNA, 13 bp, Homo sapiens
ggctgagggcctg

SEQ ID NO: 2315121 - DNA, 15 bp, Homo sapiens
ggctgagggcctgct

SEQ ID NO: 2315122 - DNA, 21 bp, Homo sapiens
ggctgagggcctgctggaggc

SEQ ID NO: 2315123 - DNA, 14 bp, Homo sapiens
ggctgaggttcctc

SEQ ID NO: 2315124 - DNA, 19 bp, Homo sapiens
ggctgaggttcctctgcct

SEQ ID NO: 2315125 - DNA, 20 bp, Homo sapiens
ggctgaggttcctctgcctg

SEQ ID NO: 2315126 - DNA, 19 bp, Homo sapiens
ggctgcacccctgggccag

SEQ ID NO: 2315127 - DNA, 14 bp, Homo sapiens
ggctgccagacatg

SEQ ID NO: 2315128 - DNA, 18 bp, Homo sapiens
ggctgccatgtgaagagg

SEQ ID NO: 2315129 - DNA, 20 bp, Homo sapiens
ggctgcccctaatctctgta

SEQ ID NO: 2315130 - DNA, 22 bp, Homo sapiens
ggctgcccctaatctctgtagg

SEQ ID NO: 2315131 - DNA, 22 bp, Homo sapiens
ggctgcggtgtttggcaatgct

SEQ ID NO: 2315132 - DNA, 13 bp, Homo sapiens
ggctgctgccccc

SEQ ID NO: 2315133 - DNA, 18 bp, Homo sapiens
ggctgctgcccccacccc

SEQ ID NO: 2315134 - DNA, 20 bp, Homo sapiens
ggctgcttttcttaagtgcc

SEQ ID NO: 2315135 - DNA, 11 bp, Homo sapiens
ggctggctccc

SEQ ID NO: 2315136 - DNA, 14 bp, Homo sapiens
ggctggctccccct

SEQ ID NO: 2315137 - DNA, 23 bp, Homo sapiens
ggctggctctaccttcctgtccc

SEQ ID NO: 2315138 - DNA, 14 bp, Homo sapiens
ggctgggagtccct

SEQ ID NO: 2315139 - DNA, 20 bp, Homo sapiens
ggctgggccatgtccaaaga

SEQ ID NO: 2315140 - DNA, 17 bp, Homo sapiens
ggctgggtccaccctgt

SEQ ID NO: 2315141 - DNA, 20 bp, Homo sapiens
ggctggtagaaaaaggggcc

SEQ ID NO: 2315142 - DNA, 23 bp, Homo sapiens
ggctgtcaccctccaccgagcca

SEQ ID NO: 2315143 - DNA, 16 bp, Homo sapiens
ggctgtcggtgggacc

SEQ ID NO: 2315144 - DNA, 20 bp, Homo sapiens
ggctgtgcttgaaggccctg

SEQ ID NO: 2315145 - DNA, 15 bp, Homo sapiens
ggctgtggcatttcc

SEQ ID NO: 2315146 - DNA, 21 bp, Homo sapiens
ggctgtggggtggagcactgg

SEQ ID NO: 2315147 - DNA, 20 bp, Homo sapiens
ggctgtgttatgaaaatata

SEQ ID NO: 2315148 - DNA, 18 bp, Homo sapiens
ggctgttctgtggttcct

SEQ ID NO: 2315149 - DNA, 12 bp, Homo sapiens
ggcttaaaccag

SEQ ID NO: 2315150 - DNA, 15 bp, Homo sapiens
ggcttcactgtataa

SEQ ID NO: 2315151 - DNA, 21 bp, Homo sapiens
ggcttcctctagaagccaagg

SEQ ID NO: 2315152 - DNA, 19 bp, Homo sapiens
ggcttcctgcccttccctc

SEQ ID NO: 2315153 - DNA, 21 bp, Homo sapiens
ggcttctccgccagcctcctc

SEQ ID NO: 2315154 - DNA, 23 bp, Homo sapiens
ggcttctccgccagcctcctctg

SEQ ID NO: 2315155 - DNA, 13 bp, Homo sapiens
ggcttctctccac

SEQ ID NO: 2315156 - DNA, 15 bp, Homo sapiens
ggcttctgctggggc

SEQ ID NO: 2315157 - DNA, 20 bp, Homo sapiens
ggcttctgctggggcctggg

SEQ ID NO: 2315158 - DNA, 18 bp, Homo sapiens
ggcttctgtgatgagctg

SEQ ID NO: 2315159 - DNA, 12 bp, Homo sapiens
ggcttggcctgc

SEQ ID NO: 2315160 - DNA, 14 bp, Homo sapiens
ggcttggcctgctg

SEQ ID NO: 2315161 - DNA, 16 bp, Homo sapiens
ggcttggcctgctgtg

SEQ ID NO: 2315162 - DNA, 16 bp, Homo sapiens
ggcttggctgccctgt

SEQ ID NO: 2315163 - DNA, 13 bp, Homo sapiens
ggctttcccagga

SEQ ID NO: 2315164 - DNA, 21 bp, Homo sapiens
ggctttgaaacctcagggctg

SEQ ID NO: 2315165 - DNA, 22 bp, Homo sapiens
ggctttgaaacctcagggctgt

SEQ ID NO: 2315166 - DNA, 16 bp, Homo sapiens
ggctttgatgttcctt

SEQ ID NO: 2315167 - DNA, 14 bp, Homo sapiens
gggaaactggccat

SEQ ID NO: 2315168 - DNA, 21 bp, Homo sapiens
gggaacagtaaagaaagcaga

SEQ ID NO: 2315169 - DNA, 15 bp, Homo sapiens
gggaacatgccccct

SEQ ID NO: 2315170 - DNA, 10 bp, Homo sapiens
gggaagaaaa

SEQ ID NO: 2315171 - DNA, 15 bp, Homo sapiens
gggaagaaaaagcaa

SEQ ID NO: 2315172 - DNA, 15 bp, Homo sapiens
gggaagcagggacac

SEQ ID NO: 2315173 - DNA, 19 bp, Homo sapiens
gggaagcgtatatacttaa

SEQ ID NO: 2315174 - DNA, 18 bp, Homo sapiens
gggaaggccctgaggcgg

SEQ ID NO: 2315175 - DNA, 15 bp, Homo sapiens
gggaatccaagcctc

SEQ ID NO: 2315176 - DNA, 21 bp, Homo sapiens
gggaatccaagcctccacagc

SEQ ID NO: 2315177 - DNA, 22 bp, Homo sapiens
gggaatccaagcctccacagcg

SEQ ID NO: 2315178 - DNA, 16 bp, Homo sapiens
gggacaccccccgccc

SEQ ID NO: 2315179 - DNA, 23 bp, Homo sapiens
gggaccctgtgacatggtgcctg

SEQ ID NO: 2315180 - DNA, 18 bp, Homo sapiens
gggacccttgttggggag

SEQ ID NO: 2315181 - DNA, 20 bp, Homo sapiens
gggaccggcggaccccagcc

SEQ ID NO: 2315182 - DNA, 17 bp, Homo sapiens
gggacctgccaggcagg

SEQ ID NO: 2315183 - DNA, 19 bp, Homo sapiens
gggacctgccaggcagggg

SEQ ID NO: 2315184 - DNA, 20 bp, Homo sapiens
gggactacccatagacatga

SEQ ID NO: 2315185 - DNA, 12 bp, Homo sapiens
gggagagcctgc

SEQ ID NO: 2315186 - DNA, 16 bp, Homo sapiens
gggagatgcttctctc

SEQ ID NO: 2315187 - DNA, 15 bp, Homo sapiens
gggagcaactctcca

SEQ ID NO: 2315188 - DNA, 20 bp, Homo sapiens
gggagcacggactgtcagtt

SEQ ID NO: 2315189 - DNA, 20 bp, Homo sapiens
gggaggcagaggttgcagtg

SEQ ID NO: 2315190 - DNA, 16 bp, Homo sapiens
gggaggggaaaagcat

SEQ ID NO: 2315191 - DNA, 14 bp, Homo sapiens
gggagtccagggtt

SEQ ID NO: 2315192 - DNA, 21 bp, Homo sapiens
gggatatttcctaaggcatgt

SEQ ID NO: 2315193 - DNA, 23 bp, Homo sapiens
gggatcagcctccgccattccaa

SEQ ID NO: 2315194 - DNA, 23 bp, Homo sapiens
gggatccccgcctggccaggagc

SEQ ID NO: 2315195 - DNA, 15 bp, Homo sapiens
gggatggaaaaggaa

SEQ ID NO: 2315196 - DNA, 12 bp, Homo sapiens
gggatttgagat

SEQ ID NO: 2315197 - DNA, 21 bp, Homo sapiens
gggcaagcctaagggatcctg

SEQ ID NO: 2315198 - DNA, 20 bp, Homo sapiens
gggcaagggttaaggcctga

SEQ ID NO: 2315199 - DNA, 13 bp, Homo sapiens
gggcacagtccag

SEQ ID NO: 2315200 - DNA, 18 bp, Homo sapiens
gggcacagtccagaccca

SEQ ID NO: 2315201 - DNA, 21 bp, Homo sapiens
gggcactccgcgccgatgcca

SEQ ID NO: 2315202 - DNA, 18 bp, Homo sapiens
gggcagatcttggactca

SEQ ID NO: 2315203 - DNA, 16 bp, Homo sapiens
gggcagattttcagca

SEQ ID NO: 2315204 - DNA, 23 bp, Homo sapiens
gggcaggccacctggctctcacc

SEQ ID NO: 2315205 - DNA, 14 bp, Homo sapiens
gggcaggctgggcc

SEQ ID NO: 2315206 - DNA, 15 bp, Homo sapiens
gggcaggctgggcca

SEQ ID NO: 2315207 - DNA, 12 bp, Homo sapiens
gggcaggcttgg

SEQ ID NO: 2315208 - DNA, 14 bp, Homo sapiens
gggcaggcttgggg

SEQ ID NO: 2315209 - DNA, 16 bp, Homo sapiens
gctgctgttctcagga

SEQ ID NO: 2315210 - DNA, 17 bp, Homo sapiens
gctgctgttctcaggac

SEQ ID NO: 2315211 - DNA, 21 bp, Homo sapiens
gctgctgttctcaggacagca

SEQ ID NO: 2315212 - DNA, 21 bp, Homo sapiens
gctgcttaataccaaacatgc

SEQ ID NO: 2315213 - DNA, 14 bp, Homo sapiens
gctggaagcccagc

SEQ ID NO: 2315214 - DNA, 20 bp, Homo sapiens
gctggaagggaggaaggcct

SEQ ID NO: 2315215 - DNA, 22 bp, Homo sapiens
gctggaagggaggaaggccttt

SEQ ID NO: 2315216 - DNA, 23 bp, Homo sapiens
gctggacatgagatggagaggct

SEQ ID NO: 2315217 - DNA, 16 bp, Homo sapiens
gctggagcccccagca

SEQ ID NO: 2315218 - DNA, 18 bp, Homo sapiens
gctggagcccccagcaga

SEQ ID NO: 2315219 - DNA, 19 bp, Homo sapiens
gctggaggagcagcagctt

SEQ ID NO: 2315220 - DNA, 12 bp, Homo sapiens
gctggaggcctc

SEQ ID NO: 2315221 - DNA, 19 bp, Homo sapiens
gctggaggcctcaggtgct

SEQ ID NO: 2315222 - DNA, 15 bp, Homo sapiens
gctggagtctcctga

SEQ ID NO: 2315223 - DNA, 20 bp, Homo sapiens
gctggcacccaccgtggagg

SEQ ID NO: 2315224 - DNA, 22 bp, Homo sapiens
gctggccatgaatctctgcctc

SEQ ID NO: 2315225 - DNA, 22 bp, Homo sapiens
gctggcccttagagaccccgag

SEQ ID NO: 2315226 - DNA, 19 bp, Homo sapiens
gctggcctctctagcacaa

SEQ ID NO: 2315227 - DNA, 21 bp, Homo sapiens
gctggcctttgtaagtgcagg

SEQ ID NO: 2315228 - DNA, 15 bp, Homo sapiens
gctggcggcgcagag

SEQ ID NO: 2315229 - DNA, 16 bp, Homo sapiens
gctggcggcgcagagg

SEQ ID NO: 2315230 - DNA, 17 bp, Homo sapiens
gctggcggcgcagaggg

SEQ ID NO: 2315231 - DNA, 20 bp, Homo sapiens
gctggctccccctccccagg

SEQ ID NO: 2315232 - DNA, 21 bp, Homo sapiens
gctggctcctgatccactttg

SEQ ID NO: 2315233 - DNA, 13 bp, Homo sapiens
gctggctctccac

SEQ ID NO: 2315234 - DNA, 16 bp, Homo sapiens
gctgggaagggagggt

SEQ ID NO: 2315235 - DNA, 13 bp, Homo sapiens
gctgggagtccct

SEQ ID NO: 2315236 - DNA, 12 bp, Homo sapiens
gctgggcacctg

SEQ ID NO: 2315237 - DNA, 17 bp, Homo sapiens
gctgggccatgtccaaa

SEQ ID NO: 2315238 - DNA, 19 bp, Homo sapiens
gctgggccatgtccaaaga

SEQ ID NO: 2315239 - DNA, 17 bp, Homo sapiens
gctgggccgggacccag

SEQ ID NO: 2315240 - DNA, 22 bp, Homo sapiens
gctggggatccccgcctggcca

SEQ ID NO: 2315241 - DNA, 13 bp, Homo sapiens
gctggggccagag

SEQ ID NO: 2315242 - DNA, 15 bp, Homo sapiens
gctgggtccaccctg

SEQ ID NO: 2315243 - DNA, 13 bp, Homo sapiens
gctggtatttcta

SEQ ID NO: 2315244 - DNA, 17 bp, Homo sapiens
gctggtcagtctttgct

SEQ ID NO: 2315245 - DNA, 22 bp, Homo sapiens
gctggtctcaaacttgtggcct

SEQ ID NO: 2315246 - DNA, 15 bp, Homo sapiens
gctggtgctactgtt

SEQ ID NO: 2315247 - DNA, 21 bp, Homo sapiens
gctggtggacccagggaacag

SEQ ID NO: 2315248 - DNA, 22 bp, Homo sapiens
gctggtggttaaggccagggcc

SEQ ID NO: 2315249 - DNA, 16 bp, Homo sapiens
gctgtaaaaatgttac

SEQ ID NO: 2315250 - DNA, 22 bp, Homo sapiens
gctgtaagcattctgagctggg

SEQ ID NO: 2315251 - DNA, 15 bp, Homo sapiens
gctgtataagttatt

SEQ ID NO: 2315252 - DNA, 19 bp, Homo sapiens
gctgtatatttatctttca

SEQ ID NO: 2315253 - DNA, 22 bp, Homo sapiens
gctgtcaatgggacctgtggct

SEQ ID NO: 2315254 - DNA, 14 bp, Homo sapiens
gctgtccaggcagc

SEQ ID NO: 2315255 - DNA, 14 bp, Homo sapiens
gctgtccagtgcct

SEQ ID NO: 2315256 - DNA, 15 bp, Homo sapiens
gctgtccagtgccta

SEQ ID NO: 2315257 - DNA, 18 bp, Homo sapiens
gctgtccagtgcctacat

SEQ ID NO: 2315258 - DNA, 14 bp, Homo sapiens
gctgtcccagcccc

SEQ ID NO: 2315259 - DNA, 16 bp, Homo sapiens
gctgtcccagccccgg

SEQ ID NO: 2315260 - DNA, 16 bp, Homo sapiens
gctgtcctggaggggc

SEQ ID NO: 2315261 - DNA, 19 bp, Homo sapiens
gctgtcctttttcctctcc

SEQ ID NO: 2315262 - DNA, 20 bp, Homo sapiens
gctgtctgggtgctactggg

SEQ ID NO: 2315263 - DNA, 23 bp, Homo sapiens
gctgtctgggtgctactggggaa

SEQ ID NO: 2315264 - DNA, 20 bp, Homo sapiens
gctgtgaaccctggggcctg

SEQ ID NO: 2315265 - DNA, 20 bp, Homo sapiens
gctgtgcttgaaggccctgc

SEQ ID NO: 2315266 - DNA, 23 bp, Homo sapiens
gctgtgcttgaaggccctgctga

SEQ ID NO: 2315267 - DNA, 18 bp, Homo sapiens
gctgtgggcaagcctaag

SEQ ID NO: 2315268 - DNA, 19 bp, Homo sapiens
gctgtgtctgccaaacaca

SEQ ID NO: 2315269 - DNA, 21 bp, Homo sapiens
gctgtgtctgccaaacacatt

SEQ ID NO: 2315270 - DNA, 19 bp, Homo sapiens
gctgtgttggtgtggccca

SEQ ID NO: 2315271 - DNA, 12 bp, Homo sapiens
gctgttctgtgg

SEQ ID NO: 2315272 - DNA, 15 bp, Homo sapiens
gctgttgtgagcttt

SEQ ID NO: 2315273 - DNA, 19 bp, Homo sapiens
gctgttgtgagctttgaag

SEQ ID NO: 2315274 - DNA, 12 bp, Homo sapiens
gctgtttggaaa

SEQ ID NO: 2315275 - DNA, 17 bp, Homo sapiens
gctgtttgtcctgagat

SEQ ID NO: 2315276 - DNA, 13 bp, Homo sapiens
gctgtttttttgt

SEQ ID NO: 2315277 - DNA, 17 bp, Homo sapiens
gcttaaataggaaagtt

SEQ ID NO: 2315278 - DNA, 17 bp, Homo sapiens
gcttaataaaagaacat

SEQ ID NO: 2315279 - DNA, 18 bp, Homo sapiens
gcttaatgctacatgtga

SEQ ID NO: 2315280 - DNA, 16 bp, Homo sapiens
gcttagagaggacaat

SEQ ID NO: 2315281 - DNA, 16 bp, Homo sapiens
gcttaggtgccaggct

SEQ ID NO: 2315282 - DNA, 22 bp, Homo sapiens
gcttataacctagttaaagaaa

SEQ ID NO: 2315283 - DNA, 23 bp, Homo sapiens
gcttatttctatgacaaattcaa

SEQ ID NO: 2315284 - DNA, 17 bp, Homo sapiens
gcttcacagtagagcca

SEQ ID NO: 2315285 - DNA, 18 bp, Homo sapiens
gcttcacagtagagccag

SEQ ID NO: 2315286 - DNA, 23 bp, Homo sapiens
gcttcaggttatcgaaataacaa

SEQ ID NO: 2315287 - DNA, 13 bp, Homo sapiens
gcttcattctgga

SEQ ID NO: 2315288 - DNA, 12 bp, Homo sapiens
gcttcctttctc

SEQ ID NO: 2315289 - DNA, 13 bp, Homo sapiens
gcttcctttctct

SEQ ID NO: 2315290 - DNA, 20 bp, Homo sapiens
gcttcctttctctcctggct

SEQ ID NO: 2315291 - DNA, 17 bp, Homo sapiens
gcttcgtttattttcaa

SEQ ID NO: 2315292 - DNA, 15 bp, Homo sapiens
gcttctaaagcaggt

SEQ ID NO: 2315293 - DNA, 22 bp, Homo sapiens
gcttctcagatttctgaggaaa

SEQ ID NO: 2315294 - DNA, 14 bp, Homo sapiens
gcttctccccagag

SEQ ID NO: 2315295 - DNA, 22 bp, Homo sapiens
gcttctccccagagctgcctgc

SEQ ID NO: 2315296 - DNA, 15 bp, Homo sapiens
gcttctccgccagcc

SEQ ID NO: 2315297 - DNA, 18 bp, Homo sapiens
gcttctccgccagcctcc

SEQ ID NO: 2315298 - DNA, 14 bp, Homo sapiens
gcttctctccttgc

SEQ ID NO: 2315299 - DNA, 18 bp, Homo sapiens
gcttctgctggggcctgg

SEQ ID NO: 2315300 - DNA, 20 bp, Homo sapiens
gcttctgctggggcctggga

SEQ ID NO: 2315301 - DNA, 13 bp, Homo sapiens
gcttctgcttttc

SEQ ID NO: 2315302 - DNA, 20 bp, Homo sapiens
gcttctgcttttctgccctg

SEQ ID NO: 2315303 - DNA, 20 bp, Homo sapiens
gcttgaactaggctgagcaa

SEQ ID NO: 2315304 - DNA, 11 bp, Homo sapiens
gcttgaagctg

SEQ ID NO: 2315305 - DNA, 13 bp, Homo sapiens
gcttgatccagaa

SEQ ID NO: 2315306 - DNA, 14 bp, Homo sapiens
gcttgatccagaag

SEQ ID NO: 2315307 - DNA, 20 bp, Homo sapiens
gcttgatccagaagagccca

SEQ ID NO: 2315308 - DNA, 18 bp, Homo sapiens
gcttgattttaatacatt

SEQ ID NO: 2315309 - DNA, 21 bp, Homo sapiens
gcttgccaaagtacagaattt

SEQ ID NO: 2315310 - DNA, 22 bp, Homo sapiens
gcttgctccagattctgatgca

SEQ ID NO: 2315311 - DNA, 19 bp, Homo sapiens
gcttggggccaccaaagct

SEQ ID NO: 2315312 - DNA, 20 bp, Homo sapiens
gcttggggccaccaaagctg

SEQ ID NO: 2315313 - DNA, 23 bp, Homo sapiens
gcttggggccaccaaagctgccc

SEQ ID NO: 2315314 - DNA, 15 bp, Homo sapiens
gcttggttctgtgaa

SEQ ID NO: 2315315 - DNA, 22 bp, Homo sapiens
gcttgtgacagtgcctcttcca

SEQ ID NO: 2315316 - DNA, 13 bp, Homo sapiens
gcttgtggggcct

SEQ ID NO: 2315317 - DNA, 17 bp, Homo sapiens
gcttgtggggcctggga

SEQ ID NO: 2315318 - DNA, 21 bp, Homo sapiens
gcttgttcatcatccagatgt

SEQ ID NO: 2315319 - DNA, 13 bp, Homo sapiens
gctttaagccttc

SEQ ID NO: 2315320 - DNA, 18 bp, Homo sapiens
gctttaccttttcagggc

SEQ ID NO: 2315321 - DNA, 22 bp, Homo sapiens
gctttaccttttcagggctggc

SEQ ID NO: 2315322 - DNA, 17 bp, Homo sapiens
gctttagaccctgggtg

SEQ ID NO: 2315323 - DNA, 10 bp, Homo sapiens
gggccagggt

SEQ ID NO: 2315324 - DNA, 20 bp, Homo sapiens
gggccataaacggttcctgg

SEQ ID NO: 2315325 - DNA, 21 bp, Homo sapiens
gggccataaacggttcctggt

SEQ ID NO: 2315326 - DNA, 14 bp, Homo sapiens
gggccatgtccaaa

SEQ ID NO: 2315327 - DNA, 15 bp, Homo sapiens
gggccatgtccaaag

SEQ ID NO: 2315328 - DNA, 23 bp, Homo sapiens
gggccatgtccaaagaggctgcc

SEQ ID NO: 2315329 - DNA, 13 bp, Homo sapiens
gggcccagcccct

SEQ ID NO: 2315330 - DNA, 17 bp, Homo sapiens
gggcccccctgccctgt

SEQ ID NO: 2315331 - DNA, 21 bp, Homo sapiens
gggcccctgggcttggcctgc

SEQ ID NO: 2315332 - DNA, 20 bp, Homo sapiens
gggccgggcgcggtggctca

SEQ ID NO: 2315333 - DNA, 16 bp, Homo sapiens
gggcctcagtgcccca

SEQ ID NO: 2315334 - DNA, 14 bp, Homo sapiens
gggcctgactgctc

SEQ ID NO: 2315335 - DNA, 20 bp, Homo sapiens
gggcctgagtggaggattat

SEQ ID NO: 2315336 - DNA, 20 bp, Homo sapiens
gggcctgccgggctgagggc

SEQ ID NO: 2315337 - DNA, 17 bp, Homo sapiens
gggcctgctgcgtcaga

SEQ ID NO: 2315338 - DNA, 21 bp, Homo sapiens
gggcctgctggaggcctcagg

SEQ ID NO: 2315339 - DNA, 23 bp, Homo sapiens
gggccttgatgactgccttgcct

SEQ ID NO: 2315340 - DNA, 20 bp, Homo sapiens
gggctcaagcaatcctcctg

SEQ ID NO: 2315341 - DNA, 13 bp, Homo sapiens
gggctccagccat

SEQ ID NO: 2315342 - DNA, 13 bp, Homo sapiens
gggctcccagggg

SEQ ID NO: 2315343 - DNA, 14 bp, Homo sapiens
gggctcgcactgcc

SEQ ID NO: 2315344 - DNA, 23 bp, Homo sapiens
gggctcttcatctgcctgcgctc

SEQ ID NO: 2315345 - DNA, 16 bp, Homo sapiens
gggctgagatgagtga

SEQ ID NO: 2315346 - DNA, 14 bp, Homo sapiens
gggctgaggccaga

SEQ ID NO: 2315347 - DNA, 17 bp, Homo sapiens
gggctgagggcctgctg

SEQ ID NO: 2315348 - DNA, 19 bp, Homo sapiens
gggctgccaccagcccccg

SEQ ID NO: 2315349 - DNA, 20 bp, Homo sapiens
gggctgcccctaatctctgt

SEQ ID NO: 2315350 - DNA, 12 bp, Homo sapiens
gggctgctcacc

SEQ ID NO: 2315351 - DNA, 16 bp, Homo sapiens
gggctgctggccatga

SEQ ID NO: 2315352 - DNA, 18 bp, Homo sapiens
gggctggacttctacctg

SEQ ID NO: 2315353 - DNA, 22 bp, Homo sapiens
gggctggctccccctccccagg

SEQ ID NO: 2315354 - DNA, 14 bp, Homo sapiens
gggctggctcctga

SEQ ID NO: 2315355 - DNA, 15 bp, Homo sapiens
gggctgtcccagccc

SEQ ID NO: 2315356 - DNA, 19 bp, Homo sapiens
gggcttcctctagaagcca

SEQ ID NO: 2315357 - DNA, 12 bp, Homo sapiens
gggcttcctgcc

SEQ ID NO: 2315358 - DNA, 14 bp, Homo sapiens
gggcttcctgccct

SEQ ID NO: 2315359 - DNA, 23 bp, Homo sapiens
gggcttcctgcccttccctctgg

SEQ ID NO: 2315360 - DNA, 14 bp, Homo sapiens
gggcttctcctcct

SEQ ID NO: 2315361 - DNA, 16 bp, Homo sapiens
gggcttggcctgctgt

SEQ ID NO: 2315362 - DNA, 17 bp, Homo sapiens
gggcttggcctgctgtg

SEQ ID NO: 2315363 - DNA, 18 bp, Homo sapiens
gggcttgtggggcctggg

SEQ ID NO: 2315364 - DNA, 15 bp, Homo sapiens
gggctttctggggcc

SEQ ID NO: 2315365 - DNA, 14 bp, Homo sapiens
ggggaagctggctt

SEQ ID NO: 2315366 - DNA, 18 bp, Homo sapiens
ggggagagcctgctggca

SEQ ID NO: 2315367 - DNA, 13 bp, Homo sapiens
ggggaggaccagg

SEQ ID NO: 2315368 - DNA, 15 bp, Homo sapiens
ggggagggcaggatg

SEQ ID NO: 2315369 - DNA, 22 bp, Homo sapiens
ggggatccccgcctggccagga

SEQ ID NO: 2315370 - DNA, 15 bp, Homo sapiens
ggggcaactgtatga

SEQ ID NO: 2315371 - DNA, 14 bp, Homo sapiens
ggggccaccaaagc

SEQ ID NO: 2315372 - DNA, 21 bp, Homo sapiens
ggggccataaacggttcctgg

SEQ ID NO: 2315373 - DNA, 22 bp, Homo sapiens
ggggccataaacggttcctggt

SEQ ID NO: 2315374 - DNA, 14 bp, Homo sapiens
ggggcccagcccct

SEQ ID NO: 2315375 - DNA, 21 bp, Homo sapiens
ggggcctagcgatctctcctg

SEQ ID NO: 2315376 - DNA, 14 bp, Homo sapiens
ggggcctgactgct

SEQ ID NO: 2315377 - DNA, 23 bp, Homo sapiens
ggggcctgggacttccatgcctt

SEQ ID NO: 2315378 - DNA, 12 bp, Homo sapiens
ggggcctgggag

SEQ ID NO: 2315379 - DNA, 20 bp, Homo sapiens
ggggctgctcacccacctct

SEQ ID NO: 2315380 - DNA, 22 bp, Homo sapiens
gggggcagatcttggactcatg

SEQ ID NO: 2315381 - DNA, 11 bp, Homo sapiens
gggggcttcat

SEQ ID NO: 2315382 - DNA, 12 bp, Homo sapiens
gggggctttctg

SEQ ID NO: 2315383 - DNA, 20 bp, Homo sapiens
ggggtatttcaattaccttc

SEQ ID NO: 2315384 - DNA, 14 bp, Homo sapiens
ggggtctccctggc

SEQ ID NO: 2315385 - DNA, 14 bp, Homo sapiens
ggggtgctgagtga

SEQ ID NO: 2315386 - DNA, 20 bp, Homo sapiens
ggggtgcttttatagaggct

SEQ ID NO: 2315387 - DNA, 18 bp, Homo sapiens
ggggtgggggtggaggct

SEQ ID NO: 2315388 - DNA, 21 bp, Homo sapiens
ggggttccctcctagctctcc

SEQ ID NO: 2315389 - DNA, 16 bp, Homo sapiens
gggtaaaaagtggctg

SEQ ID NO: 2315390 - DNA, 24 bp, Homo sapiens
gggtaggggaagaagagctatcag

SEQ ID NO: 2315391 - DNA, 15 bp, Homo sapiens
gggtatgctcaggtc

SEQ ID NO: 2315392 - DNA, 20 bp, Homo sapiens
gggtccaccctgtcctatga

SEQ ID NO: 2315393 - DNA, 21 bp, Homo sapiens
gggtccatagagatgagccca

SEQ ID NO: 2315394 - DNA, 14 bp, Homo sapiens
gggtcctagccctt

SEQ ID NO: 2315395 - DNA, 15 bp, Homo sapiens
gggtcctagcccttc

SEQ ID NO: 2315396 - DNA, 18 bp, Homo sapiens
gggtcctagcccttccct

SEQ ID NO: 2315397 - DNA, 16 bp, Homo sapiens
gggtctccctggctcc

SEQ ID NO: 2315398 - DNA, 14 bp, Homo sapiens
gggtctctgaaggg

SEQ ID NO: 2315399 - DNA, 22 bp, Homo sapiens
gggtctctgaagggaccccccc

SEQ ID NO: 2315400 - DNA, 20 bp, Homo sapiens
gggtcttgctctgtccccca

SEQ ID NO: 2315401 - DNA, 19 bp, Homo sapiens
gggtgagtccattctccca

SEQ ID NO: 2315402 - DNA, 19 bp, Homo sapiens
gggtgctactggggaaact

SEQ ID NO: 2315403 - DNA, 17 bp, Homo sapiens
gggtgctgccatgacag

SEQ ID NO: 2315404 - DNA, 18 bp, Homo sapiens
gggtgctgggaggaggga

SEQ ID NO: 2315405 - DNA, 14 bp, Homo sapiens
gggtggaggggtgt

SEQ ID NO: 2315406 - DNA, 17 bp, Homo sapiens
gggtggatcacgaggtc

SEQ ID NO: 2315407 - DNA, 14 bp, Homo sapiens
gggtgggggcagca

SEQ ID NO: 2315408 - DNA, 15 bp, Homo sapiens
gggtgtattctctgt

SEQ ID NO: 2315409 - DNA, 19 bp, Homo sapiens
gggtgtcctgcctgtctgc

SEQ ID NO: 2315410 - DNA, 12 bp, Homo sapiens
gggtgtggcagt

SEQ ID NO: 2315411 - DNA, 15 bp, Homo sapiens
gggttaaggcctgaa

SEQ ID NO: 2315412 - DNA, 14 bp, Homo sapiens
gggttgagagccag

SEQ ID NO: 2315413 - DNA, 20 bp, Homo sapiens
gggttgctgtataagttatt

SEQ ID NO: 2315414 - DNA, 19 bp, Homo sapiens
ggtaaaaacagcagctcat

SEQ ID NO: 2315415 - DNA, 12 bp, Homo sapiens
ggtaaaaagtgg

SEQ ID NO: 2315416 - DNA, 15 bp, Homo sapiens
ggtaaataaaccact

SEQ ID NO: 2315417 - DNA, 10 bp, Homo sapiens
ggtaaatgtt

SEQ ID NO: 2315418 - DNA, 21 bp, Homo sapiens
ggtaaatgtttcttttaaaga

SEQ ID NO: 2315419 - DNA, 18 bp, Homo sapiens
ggtaacagaacagcttca

SEQ ID NO: 2315420 - DNA, 23 bp, Homo sapiens
ggtaagtgttctcatgaagcagg

SEQ ID NO: 2315421 - DNA, 14 bp, Homo sapiens
ggtaccagctgcgc

SEQ ID NO: 2315422 - DNA, 15 bp, Homo sapiens
ggtaccagctgcgct

SEQ ID NO: 2315423 - DNA, 12 bp, Homo sapiens
ggtagaagccag

SEQ ID NO: 2315424 - DNA, 16 bp, Homo sapiens
ggtagcgagctgctct

SEQ ID NO: 2315425 - DNA, 17 bp, Homo sapiens
ggtaggggagggcaggc

SEQ ID NO: 2315426 - DNA, 20 bp, Homo sapiens
ggtagtctcactgcttgaac

SEQ ID NO: 2315427 - DNA, 16 bp, Homo sapiens
ggtatatccaaaagct

SEQ ID NO: 2315428 - DNA, 14 bp, Homo sapiens
ggtatgtctgccat

SEQ ID NO: 2315429 - DNA, 16 bp, Homo sapiens
gtaagtgttctcatga

SEQ ID NO: 2315430 - DNA, 12 bp, Homo sapiens
gtaataaactat

SEQ ID NO: 2315431 - DNA, 14 bp, Homo sapiens
gtaataaactattt

SEQ ID NO: 2315432 - DNA, 13 bp, Homo sapiens
gtaatacttcttt

SEQ ID NO: 2315433 - DNA, 20 bp, Homo sapiens
gtaatcccagcactttggga

SEQ ID NO: 2315434 - DNA, 12 bp, Homo sapiens
gtaattattttc

SEQ ID NO: 2315435 - DNA, 10 bp, Homo sapiens
gtaatttaaa

SEQ ID NO: 2315436 - DNA, 21 bp, Homo sapiens
gtaatttaaatgaaagaaaat

SEQ ID NO: 2315437 - DNA, 12 bp, Homo sapiens
gtaatttcaaaa

SEQ ID NO: 2315438 - DNA, 14 bp, Homo sapiens
gtacacgtgtaaca

SEQ ID NO: 2315439 - DNA, 15 bp, Homo sapiens
gtacacgtgtcctgt

SEQ ID NO: 2315440 - DNA, 23 bp, Homo sapiens
gtacactaccaaacactcagtcc

SEQ ID NO: 2315441 - DNA, 22 bp, Homo sapiens
gtacacttctcttaagtggtct

SEQ ID NO: 2315442 - DNA, 14 bp, Homo sapiens
gtacagaaagctgc

SEQ ID NO: 2315443 - DNA, 18 bp, Homo sapiens
gtacagaatttgaattat

SEQ ID NO: 2315444 - DNA, 20 bp, Homo sapiens
gtacagaggtcagcacacat

SEQ ID NO: 2315445 - DNA, 14 bp, Homo sapiens
gtacagcagggtct

SEQ ID NO: 2315446 - DNA, 20 bp, Homo sapiens
gtacagcggctcccctctgc

SEQ ID NO: 2315447 - DNA, 22 bp, Homo sapiens
gtacatagttatttttctcttt

SEQ ID NO: 2315448 - DNA, 19 bp, Homo sapiens
gtacatgtgtagcctgtgc

SEQ ID NO: 2315449 - DNA, 18 bp, Homo sapiens
gtacatgttcgggtgtgg

SEQ ID NO: 2315450 - DNA, 14 bp, Homo sapiens
gtacatttatgatt

SEQ ID NO: 2315451 - DNA, 22 bp, Homo sapiens
gtacatttatgatttaataaaa

SEQ ID NO: 2315452 - DNA, 16 bp, Homo sapiens
gtaccaaaattttaaa

SEQ ID NO: 2315453 - DNA, 20 bp, Homo sapiens
gtaccaaaattttaaaaaag

SEQ ID NO: 2315454 - DNA, 17 bp, Homo sapiens
gtaccagctgcgcttgc

SEQ ID NO: 2315455 - DNA, 19 bp, Homo sapiens
gtaccagctgcgcttgctt

SEQ ID NO: 2315456 - DNA, 13 bp, Homo sapiens
gtacctaagggag

SEQ ID NO: 2315457 - DNA, 12 bp, Homo sapiens
gtacctctcaag

SEQ ID NO: 2315458 - DNA, 12 bp, Homo sapiens
gtactaatctga

SEQ ID NO: 2315459 - DNA, 16 bp, Homo sapiens
gtactaatctgagatt

SEQ ID NO: 2315460 - DNA, 18 bp, Homo sapiens
gtactgaatttttttgta

SEQ ID NO: 2315461 - DNA, 15 bp, Homo sapiens
gtactgatttcagta

SEQ ID NO: 2315462 - DNA, 23 bp, Homo sapiens
gtactgggaatggaaggctttgc

SEQ ID NO: 2315463 - DNA, 16 bp, Homo sapiens
gtactggttactttca

SEQ ID NO: 2315464 - DNA, 15 bp, Homo sapiens
gtactgtctgttatg

SEQ ID NO: 2315465 - DNA, 17 bp, Homo sapiens
gtactgttcggaagggg

SEQ ID NO: 2315466 - DNA, 18 bp, Homo sapiens
gtagaaaagaactggaaa

SEQ ID NO: 2315467 - DNA, 17 bp, Homo sapiens
gtagaaaatgtgaccct

SEQ ID NO: 2315468 - DNA, 22 bp, Homo sapiens
gtagaaagttgtaaaatagaaa

SEQ ID NO: 2315469 - DNA, 16 bp, Homo sapiens
gtagaactgtctgtga

SEQ ID NO: 2315470 - DNA, 18 bp, Homo sapiens
gtagaagcattccttctt

SEQ ID NO: 2315471 - DNA, 22 bp, Homo sapiens
gtagaagcattccttctttgat

SEQ ID NO: 2315472 - DNA, 12 bp, Homo sapiens
gtagagccagct

SEQ ID NO: 2315473 - DNA, 18 bp, Homo sapiens
gtagagctagctgccact

SEQ ID NO: 2315474 - DNA, 15 bp, Homo sapiens
gtagaggcttgttta

SEQ ID NO: 2315475 - DNA, 14 bp, Homo sapiens
gtagagttaagaag

SEQ ID NO: 2315476 - DNA, 16 bp, Homo sapiens
gtagagttaagaagct

SEQ ID NO: 2315477 - DNA, 18 bp, Homo sapiens
gtagataatttcagggtg

SEQ ID NO: 2315478 - DNA, 17 bp, Homo sapiens
gtagatatgtattcttt

SEQ ID NO: 2315479 - DNA, 18 bp, Homo sapiens
gtagatatgtattctttt

SEQ ID NO: 2315480 - DNA, 22 bp, Homo sapiens
gtagatccatttccattgctta

SEQ ID NO: 2315481 - DNA, 21 bp, Homo sapiens
gtagatctatattagatcaaa

SEQ ID NO: 2315482 - DNA, 22 bp, Homo sapiens
gtagctacctacatgctgaaaa

SEQ ID NO: 2315483 - DNA, 23 bp, Homo sapiens
gtagctggggctttgatgttcct

SEQ ID NO: 2315484 - DNA, 16 bp, Homo sapiens
gtaggggagggcaggc

SEQ ID NO: 2315485 - DNA, 21 bp, Homo sapiens
gtaggggagggcaggcttggg

SEQ ID NO: 2315486 - DNA, 13 bp, Homo sapiens
gtaggtaagactg

SEQ ID NO: 2315487 - DNA, 13 bp, Homo sapiens
gtagttaaataac

SEQ ID NO: 2315488 - DNA, 12 bp, Homo sapiens
gtataaatatac

SEQ ID NO: 2315489 - DNA, 13 bp, Homo sapiens
gtataatgtttat

SEQ ID NO: 2315490 - DNA, 20 bp, Homo sapiens
gtataatgtttattaaatgc

SEQ ID NO: 2315491 - DNA, 14 bp, Homo sapiens
gtatacaactgcct

SEQ ID NO: 2315492 - DNA, 20 bp, Homo sapiens
gtatagcatgaaataaaata

SEQ ID NO: 2315493 - DNA, 13 bp, Homo sapiens
gtatattaaaaaa

SEQ ID NO: 2315494 - DNA, 11 bp, Homo sapiens
gtatattaaac

SEQ ID NO: 2315495 - DNA, 17 bp, Homo sapiens
gtatattacaatgatca

SEQ ID NO: 2315496 - DNA, 16 bp, Homo sapiens
gtatcatatatttaat

SEQ ID NO: 2315497 - DNA, 22 bp, Homo sapiens
gtatctagagcttaatgctaca

SEQ ID NO: 2315498 - DNA, 15 bp, Homo sapiens
gtatctccctggaga

SEQ ID NO: 2315499 - DNA, 20 bp, Homo sapiens
gtatctccctggagaagcac

SEQ ID NO: 2315500 - DNA, 14 bp, Homo sapiens
gtatctcctttaat

SEQ ID NO: 2315501 - DNA, 16 bp, Homo sapiens
gtatctcctttaatat

SEQ ID NO: 2315502 - DNA, 23 bp, Homo sapiens
gtatgaataatgaaaataaaaca

SEQ ID NO: 2315503 - DNA, 14 bp, Homo sapiens
gtatgggaagccat

SEQ ID NO: 2315504 - DNA, 23 bp, Homo sapiens
gtatgtatattaaaaaagagaca

SEQ ID NO: 2315505 - DNA, 13 bp, Homo sapiens
gtatgtcaaagct

SEQ ID NO: 2315506 - DNA, 13 bp, Homo sapiens
gtatgtctgccat

SEQ ID NO: 2315507 - DNA, 16 bp, Homo sapiens
gtatgtgtggctgtgg

SEQ ID NO: 2315508 - DNA, 20 bp, Homo sapiens
gtattaaaactaaatttcac

SEQ ID NO: 2315509 - DNA, 16 bp, Homo sapiens
gtattatgtctcttct

SEQ ID NO: 2315510 - DNA, 20 bp, Homo sapiens
gtattcagaccctgggtcag

SEQ ID NO: 2315511 - DNA, 13 bp, Homo sapiens
gtattcagaggca

SEQ ID NO: 2315512 - DNA, 16 bp, Homo sapiens
gtattctgaggatgtt

SEQ ID NO: 2315513 - DNA, 14 bp, Homo sapiens
gtattgaaagccaa

SEQ ID NO: 2315514 - DNA, 16 bp, Homo sapiens
gtattgacaataagaa

SEQ ID NO: 2315515 - DNA, 21 bp, Homo sapiens
gtattgacaataagaaacagt

SEQ ID NO: 2315516 - DNA, 16 bp, Homo sapiens
gtatttaaaaacattt

SEQ ID NO: 2315517 - DNA, 22 bp, Homo sapiens
gtatttacttgttatgttgtaa

SEQ ID NO: 2315518 - DNA, 10 bp, Homo sapiens
gtatttcctt

SEQ ID NO: 2315519 - DNA, 21 bp, Homo sapiens
gtatttctctattttcataat

SEQ ID NO: 2315520 - DNA, 22 bp, Homo sapiens
gtatttctctattttcataatc

SEQ ID NO: 2315521 - DNA, 22 bp, Homo sapiens
gtattttatcttattttctcaa

SEQ ID NO: 2315522 - DNA, 16 bp, Homo sapiens
gtattttcatgaaaat

SEQ ID NO: 2315523 - DNA, 18 bp, Homo sapiens
gtatttttatacaaacct

SEQ ID NO: 2315524 - DNA, 17 bp, Homo sapiens
gtcaaaaaagaatctgt

SEQ ID NO: 2315525 - DNA, 15 bp, Homo sapiens
gtcaaaagttggtgt

SEQ ID NO: 2315526 - DNA, 11 bp, Homo sapiens
gtcaaatgtgt

SEQ ID NO: 2315527 - DNA, 12 bp, Homo sapiens
gtcaagctgctc

SEQ ID NO: 2315528 - DNA, 12 bp, Homo sapiens
gtcaaggaacct

SEQ ID NO: 2315529 - DNA, 13 bp, Homo sapiens
gtcaatggcttgt

SEQ ID NO: 2315530 - DNA, 14 bp, Homo sapiens
gtcacaacagagtg

SEQ ID NO: 2315531 - DNA, 14 bp, Homo sapiens
gtcacatccatccc

SEQ ID NO: 2315532 - DNA, 19 bp, Homo sapiens
gtcacatccatccctccat

SEQ ID NO: 2315533 - DNA, 16 bp, Homo sapiens
gtcaccctgcagagct

SEQ ID NO: 2315534 - DNA, 19 bp, Homo sapiens
gtcacctgccccagcactc

SEQ ID NO: 2315535 - DNA, 18 bp, Homo sapiens
gtcactgaaccactgctt

SEQ ID NO: 2315536 - DNA, 23 bp, Homo sapiens
gtcactgaaccactgcttctctt

SEQ ID NO: 2315537 - DNA, 20 bp, Homo sapiens
gtcactggaggttgaagcca

SEQ ID NO: 2315538 - DNA, 17 bp, Homo sapiens
gtcactgtttcctgggc

SEQ ID NO: 2315539 - DNA, 19 bp, Homo sapiens
gtcagaaccagagggcatg

SEQ ID NO: 2315540 - DNA, 22 bp, Homo sapiens
gtcagaaccagagggcatgctg

SEQ ID NO: 2315541 - DNA, 18 bp, Homo sapiens
gtcagaccagtactggga

SEQ ID NO: 2315542 - DNA, 23 bp, Homo sapiens
gtcagactttgtgttcatttcat

SEQ ID NO: 2315543 - DNA, 21 bp, Homo sapiens
gtcagagccatgtcttctccc

SEQ ID NO: 2315544 - DNA, 12 bp, Homo sapiens
gtcagctccagc

SEQ ID NO: 2315545 - DNA, 13 bp, Homo sapiens
gtcagctctctgc

SEQ ID NO: 2315546 - DNA, 14 bp, Homo sapiens
gtcagctctctgcc

SEQ ID NO: 2315547 - DNA, 15 bp, Homo sapiens
gtcagctctctgccc

SEQ ID NO: 2315548 - DNA, 17 bp, Homo sapiens
gtcagctgctccctggc

SEQ ID NO: 2315549 - DNA, 19 bp, Homo sapiens
gtcaggacggctcctcaga

SEQ ID NO: 2315550 - DNA, 18 bp, Homo sapiens
gtcataaaatagaataat

SEQ ID NO: 2315551 - DNA, 14 bp, Homo sapiens
gtcatcactagtgg

SEQ ID NO: 2315552 - DNA, 22 bp, Homo sapiens
gtcattccaagaactataaact

SEQ ID NO: 2315553 - DNA, 20 bp, Homo sapiens
gtccaaaagcgccctcacta

SEQ ID NO: 2315554 - DNA, 17 bp, Homo sapiens
gtccaaacgtcctcttt

SEQ ID NO: 2315555 - DNA, 16 bp, Homo sapiens
gtccaacctgcctgtg

SEQ ID NO: 2315556 - DNA, 13 bp, Homo sapiens
gtccaaggccagt

SEQ ID NO: 2315557 - DNA, 18 bp, Homo sapiens
gtccaaggccagtcccca

SEQ ID NO: 2315558 - DNA, 19 bp, Homo sapiens
gtccactgttgagccccag

SEQ ID NO: 2315559 - DNA, 14 bp, Homo sapiens
gtccagctggcctg

SEQ ID NO: 2315560 - DNA, 14 bp, Homo sapiens
taaaccactgtgcg

SEQ ID NO: 2315561 - DNA, 18 bp, Homo sapiens
taaacgtgatttttaaat

SEQ ID NO: 2315562 - DNA, 21 bp, Homo sapiens
taaactattagagtatttccc

SEQ ID NO: 2315563 - DNA, 23 bp, Homo sapiens
taaactattagagtatttccctt

SEQ ID NO: 2315564 - DNA, 18 bp, Homo sapiens
taaactcagatctgatca

SEQ ID NO: 2315565 - DNA, 19 bp, Homo sapiens
taaactcagatctgatcaa

SEQ ID NO: 2315566 - DNA, 15 bp, Homo sapiens
taaactccttcctgg

SEQ ID NO: 2315567 - DNA, 18 bp, Homo sapiens
taaactgtgtacataact

SEQ ID NO: 2315568 - DNA, 13 bp, Homo sapiens
taaacttccaaag

SEQ ID NO: 2315569 - DNA, 21 bp, Homo sapiens
taaacttccaaagaaagttct

SEQ ID NO: 2315570 - DNA, 22 bp, Homo sapiens
taaacttgtttgctgtgaacaa

SEQ ID NO: 2315571 - DNA, 15 bp, Homo sapiens
taaactttggccttt

SEQ ID NO: 2315572 - DNA, 22 bp, Homo sapiens
taaagaaaggaaaagaaaacaa

SEQ ID NO: 2315573 - DNA, 15 bp, Homo sapiens
taaagaatgccattt

SEQ ID NO: 2315574 - DNA, 20 bp, Homo sapiens
taaagaatgccatttctcac

SEQ ID NO: 2315575 - DNA, 13 bp, Homo sapiens
taaagaatgttag

SEQ ID NO: 2315576 - DNA, 23 bp, Homo sapiens
taaagacaggagacaaaagagca

SEQ ID NO: 2315577 - DNA, 15 bp, Homo sapiens
taaagaccagaaatt

SEQ ID NO: 2315578 - DNA, 13 bp, Homo sapiens
taaagactggttt

SEQ ID NO: 2315579 - DNA, 22 bp, Homo sapiens
taaagacttgtatagcatgaaa

SEQ ID NO: 2315580 - DNA, 13 bp, Homo sapiens
taaagagacgaat

SEQ ID NO: 2315581 - DNA, 17 bp, Homo sapiens
taaagagcccttgcctc

SEQ ID NO: 2315582 - DNA, 15 bp, Homo sapiens
taaagatattgtatc

SEQ ID NO: 2315583 - DNA, 16 bp, Homo sapiens
taaagatattgtatct

SEQ ID NO: 2315584 - DNA, 13 bp, Homo sapiens
taaagatcttttt

SEQ ID NO: 2315585 - DNA, 19 bp, Homo sapiens
taaagatctttttttaagt

SEQ ID NO: 2315586 - DNA, 14 bp, Homo sapiens
taaagcatttccta

SEQ ID NO: 2315587 - DNA, 21 bp, Homo sapiens
taaagcctaccctattctatc

SEQ ID NO: 2315588 - DNA, 22 bp, Homo sapiens
taaagctactgtagaaacaaag

SEQ ID NO: 2315589 - DNA, 19 bp, Homo sapiens
taaagctcaaatgaaatgt

SEQ ID NO: 2315590 - DNA, 11 bp, Homo sapiens
taaaggaaaag

SEQ ID NO: 2315591 - DNA, 14 bp, Homo sapiens
taaaggaaaagaca

SEQ ID NO: 2315592 - DNA, 17 bp, Homo sapiens
taaaggaaaagacacat

SEQ ID NO: 2315593 - DNA, 16 bp, Homo sapiens
taaaggatccagagag

SEQ ID NO: 2315594 - DNA, 19 bp, Homo sapiens
taaagggcccaatgaatta

SEQ ID NO: 2315595 - DNA, 21 bp, Homo sapiens
taaagggcccaatgaattatt

SEQ ID NO: 2315596 - DNA, 12 bp, Homo sapiens
taaagtacaaat

SEQ ID NO: 2315597 - DNA, 21 bp, Homo sapiens
taaagtacaaatgaagaaagt

SEQ ID NO: 2315598 - DNA, 22 bp, Homo sapiens
taaagtacaaatgaagaaagtc

SEQ ID NO: 2315599 - DNA, 13 bp, Homo sapiens
taaagtataatgt

SEQ ID NO: 2315600 - DNA, 17 bp, Homo sapiens
taaagttcattgcaatt

SEQ ID NO: 2315601 - DNA, 19 bp, Homo sapiens
taaataaaaatatgtaatt

SEQ ID NO: 2315602 - DNA, 13 bp, Homo sapiens
taaataaaaatta

SEQ ID NO: 2315603 - DNA, 15 bp, Homo sapiens
taaatacatgcatat

SEQ ID NO: 2315604 - DNA, 16 bp, Homo sapiens
taaatacatgcatata

SEQ ID NO: 2315605 - DNA, 15 bp, Homo sapiens
taaataggaaagttt

SEQ ID NO: 2315606 - DNA, 21 bp, Homo sapiens
taaataggaatcattcagaaa

SEQ ID NO: 2315607 - DNA, 23 bp, Homo sapiens
taaataggaatcattcagaaatg

SEQ ID NO: 2315608 - DNA, 13 bp, Homo sapiens
taaatatgaaagt

SEQ ID NO: 2315609 - DNA, 17 bp, Homo sapiens
taaatatgcagtgatat

SEQ ID NO: 2315610 - DNA, 16 bp, Homo sapiens
taaatatttatgtaga

SEQ ID NO: 2315611 - DNA, 17 bp, Homo sapiens
taaatatttatttatgt

SEQ ID NO: 2315612 - DNA, 19 bp, Homo sapiens
taaatcagaaagtaacaat

SEQ ID NO: 2315613 - DNA, 23 bp, Homo sapiens
taaatccaggctttatgtacaaa

SEQ ID NO: 2315614 - DNA, 16 bp, Homo sapiens
taaatcctgaagagca

SEQ ID NO: 2315615 - DNA, 14 bp, Homo sapiens
taaatgcaataatt

SEQ ID NO: 2315616 - DNA, 15 bp, Homo sapiens
taaatgccctcttct

SEQ ID NO: 2315617 - DNA, 20 bp, Homo sapiens
taaatgcttaaatttcagaa

SEQ ID NO: 2315618 - DNA, 19 bp, Homo sapiens
taaatgggtgtatataatt

SEQ ID NO: 2315619 - DNA, 13 bp, Homo sapiens
taaatgtaaagat

SEQ ID NO: 2315620 - DNA, 22 bp, Homo sapiens
taaatgtacatttccaaatgaa

SEQ ID NO: 2315621 - DNA, 22 bp, Homo sapiens
taaatgtataaatatacagtat

SEQ ID NO: 2315622 - DNA, 22 bp, Homo sapiens
taaatgtcttcatgttgatgtg

SEQ ID NO: 2315623 - DNA, 19 bp, Homo sapiens
taaatgtgattcacctctt

SEQ ID NO: 2315624 - DNA, 17 bp, Homo sapiens
taaatgttacttctgat

SEQ ID NO: 2315625 - DNA, 11 bp, Homo sapiens
taaatgtttct

SEQ ID NO: 2315626 - DNA, 21 bp, Homo sapiens
taaatgtttcttttaaagacc

SEQ ID NO: 2315627 - DNA, 19 bp, Homo sapiens
taaatgtttcttttgtttg

SEQ ID NO: 2315628 - DNA, 17 bp, Homo sapiens
taaattacctttacata

SEQ ID NO: 2315629 - DNA, 22 bp, Homo sapiens
taaattatgtgaccataatgta

SEQ ID NO: 2315630 - DNA, 23 bp, Homo sapiens
taaattatttgattatttaagac

SEQ ID NO: 2315631 - DNA, 23 bp, Homo sapiens
taaattctagtgtccataaataa

SEQ ID NO: 2315632 - DNA, 12 bp, Homo sapiens
taaattgcatca

SEQ ID NO: 2315633 - DNA, 18 bp, Homo sapiens
taaattgcatcactgtat

SEQ ID NO: 2315634 - DNA, 22 bp, Homo sapiens
taaattgtagggctttagcttt

SEQ ID NO: 2315635 - DNA, 23 bp, Homo sapiens
taaattgtagggctttagctttc

SEQ ID NO: 2315636 - DNA, 13 bp, Homo sapiens
taaattgtggatg

SEQ ID NO: 2315637 - DNA, 14 bp, Homo sapiens
taaatttaatacca

SEQ ID NO: 2315638 - DNA, 21 bp, Homo sapiens
taaatttcactactagattga

SEQ ID NO: 2315639 - DNA, 16 bp, Homo sapiens
taaatttcttatgtga

SEQ ID NO: 2315640 - DNA, 18 bp, Homo sapiens
taaatttcttatgtgaca

SEQ ID NO: 2315641 - DNA, 12 bp, Homo sapiens
tactcctgggct

SEQ ID NO: 2315642 - DNA, 19 bp, Homo sapiens
tactctacaaaatatagct

SEQ ID NO: 2315643 - DNA, 21 bp, Homo sapiens
tactctccttgagtgtatgag

SEQ ID NO: 2315644 - DNA, 21 bp, Homo sapiens
tactctggaatgtttttccct

SEQ ID NO: 2315645 - DNA, 18 bp, Homo sapiens
tactcttcttgaaatttt

SEQ ID NO: 2315646 - DNA, 19 bp, Homo sapiens
tactgaactacatgcataa

SEQ ID NO: 2315647 - DNA, 19 bp, Homo sapiens
tactgaaggaaaaacacaa

SEQ ID NO: 2315648 - DNA, 14 bp, Homo sapiens
tactgaagtggctg

SEQ ID NO: 2315649 - DNA, 16 bp, Homo sapiens
tactgaagtggctggt

SEQ ID NO: 2315650 - DNA, 12 bp, Homo sapiens
tactgaattttt

SEQ ID NO: 2315651 - DNA, 22 bp, Homo sapiens
tactgacctacctcaaagggca

SEQ ID NO: 2315652 - DNA, 14 bp, Homo sapiens
tactgatatatttt

SEQ ID NO: 2315653 - DNA, 16 bp, Homo sapiens
tactgcactccagcct

SEQ ID NO: 2315654 - DNA, 18 bp, Homo sapiens
tactgcactccagcctgg

SEQ ID NO: 2315655 - DNA, 20 bp, Homo sapiens
tactgcactccagcctgggg

SEQ ID NO: 2315656 - DNA, 18 bp, Homo sapiens
tactgcatactttttaaa

SEQ ID NO: 2315657 - DNA, 22 bp, Homo sapiens
tactgcatactttttaaatgta

SEQ ID NO: 2315658 - DNA, 20 bp, Homo sapiens
tactgccattcacttcataa

SEQ ID NO: 2315659 - DNA, 14 bp, Homo sapiens
tactgcttgatttt

SEQ ID NO: 2315660 - DNA, 16 bp, Homo sapiens
tactggggaaactggc

SEQ ID NO: 2315661 - DNA, 24 bp, Homo sapiens
tactggggaaactggccatggcct

SEQ ID NO: 2315662 - DNA, 13 bp, Homo sapiens
tactggtccaaaa

SEQ ID NO: 2315663 - DNA, 17 bp, Homo sapiens
tactgtaatacttcttt

SEQ ID NO: 2315664 - DNA, 16 bp, Homo sapiens
tactgtctaattaata

SEQ ID NO: 2315665 - DNA, 16 bp, Homo sapiens
tactgtggaggaagga

SEQ ID NO: 2315666 - DNA, 23 bp, Homo sapiens
tactgttcggaaggggttcctca

SEQ ID NO: 2315667 - DNA, 22 bp, Homo sapiens
tactgttgtaagaattctgatt

SEQ ID NO: 2315668 - DNA, 14 bp, Homo sapiens
tacttaaatggtaa

SEQ ID NO: 2315669 - DNA, 24 bp, Homo sapiens
tacttaaatggtaataagcactgt

SEQ ID NO: 2315670 - DNA, 24 bp, Homo sapiens
tacttagggaagaaaaagcaagtg

SEQ ID NO: 2315671 - DNA, 15 bp, Homo sapiens
tacttatattctgca

SEQ ID NO: 2315672 - DNA, 13 bp, Homo sapiens
tacttctctcaga

SEQ ID NO: 2315673 - DNA, 21 bp, Homo sapiens
tacttcttgaatataaaaaat

SEQ ID NO: 2315674 - DNA, 23 bp, Homo sapiens
tacttgctttaccttttcagggc

SEQ ID NO: 2315675 - DNA, 20 bp, Homo sapiens
tactttggtagctgggaaag

SEQ ID NO: 2315676 - DNA, 15 bp, Homo sapiens
tacttttaaactgtg

SEQ ID NO: 2315677 - DNA, 21 bp, Homo sapiens
tacttttaaactgtgtacata

SEQ ID NO: 2315678 - DNA, 16 bp, Homo sapiens
tagaaaaataaaatgt

SEQ ID NO: 2315679 - DNA, 18 bp, Homo sapiens
tagaaaaataaaatgttt

SEQ ID NO: 2315680 - DNA, 16 bp, Homo sapiens
tagaaaacataatctt

SEQ ID NO: 2315681 - DNA, 14 bp, Homo sapiens
tagaaaagaaatgg

SEQ ID NO: 2315682 - DNA, 17 bp, Homo sapiens
tagaaaagtgaattgaa

SEQ ID NO: 2315683 - DNA, 18 bp, Homo sapiens
tagaaaatgtgaccctcc

SEQ ID NO: 2315684 - DNA, 20 bp, Homo sapiens
tagaaaatgtgaccctccaa

SEQ ID NO: 2315685 - DNA, 13 bp, Homo sapiens
tagaaaattattt

SEQ ID NO: 2315686 - DNA, 14 bp, Homo sapiens
tagaaaattatttg

SEQ ID NO: 2315687 - DNA, 21 bp, Homo sapiens
tatttcccatttgtgccagag

SEQ ID NO: 2315688 - DNA, 16 bp, Homo sapiens
tatttcccttccaaag

SEQ ID NO: 2315689 - DNA, 14 bp, Homo sapiens
tatttcctttatgt

SEQ ID NO: 2315690 - DNA, 18 bp, Homo sapiens
tatttcctttatgtgaat

SEQ ID NO: 2315691 - DNA, 14 bp, Homo sapiens
tatttctatgacaa

SEQ ID NO: 2315692 - DNA, 19 bp, Homo sapiens
tatttctatgacaaattca

SEQ ID NO: 2315693 - DNA, 11 bp, Homo sapiens
tatttctattg

SEQ ID NO: 2315694 - DNA, 22 bp, Homo sapiens
tatttcttctcttatcctctct

SEQ ID NO: 2315695 - DNA, 16 bp, Homo sapiens
tatttgaagatttaat

SEQ ID NO: 2315696 - DNA, 17 bp, Homo sapiens
tatttgaagatttaatt

SEQ ID NO: 2315697 - DNA, 15 bp, Homo sapiens
tatttgaataaatta

SEQ ID NO: 2315698 - DNA, 13 bp, Homo sapiens
tatttgatttcta

SEQ ID NO: 2315699 - DNA, 15 bp, Homo sapiens
tatttgatttctaat

SEQ ID NO: 2315700 - DNA, 17 bp, Homo sapiens
tatttgctcataagtaa

SEQ ID NO: 2315701 - DNA, 23 bp, Homo sapiens
tatttgctcataagtaaatgtct

SEQ ID NO: 2315702 - DNA, 14 bp, Homo sapiens
tatttgtgtaactg

SEQ ID NO: 2315703 - DNA, 17 bp, Homo sapiens
tatttgtgtaactgaaa

SEQ ID NO: 2315704 - DNA, 23 bp, Homo sapiens
tattttacaattttttatcatgc

SEQ ID NO: 2315705 - DNA, 17 bp, Homo sapiens
tattttatttagacaag

SEQ ID NO: 2315706 - DNA, 23 bp, Homo sapiens
tattttcagtcccctctctctgg

SEQ ID NO: 2315707 - DNA, 14 bp, Homo sapiens
tattttcatgaaaa

SEQ ID NO: 2315708 - DNA, 13 bp, Homo sapiens
tattttccaggct

SEQ ID NO: 2315709 - DNA, 15 bp, Homo sapiens
tattttctaaagact

SEQ ID NO: 2315710 - DNA, 14 bp, Homo sapiens
tattttctacagtg

SEQ ID NO: 2315711 - DNA, 18 bp, Homo sapiens
tattttctactttaaatt

SEQ ID NO: 2315712 - DNA, 18 bp, Homo sapiens
tattttctcaatctcctc

SEQ ID NO: 2315713 - DNA, 14 bp, Homo sapiens
tattttgctggaat

SEQ ID NO: 2315714 - DNA, 18 bp, Homo sapiens
tattttgtagttaatata

SEQ ID NO: 2315715 - DNA, 12 bp, Homo sapiens
tattttgtgtaa

SEQ ID NO: 2315716 - DNA, 14 bp, Homo sapiens
tattttgtgtgaaa

SEQ ID NO: 2315717 - DNA, 17 bp, Homo sapiens
tatttttaaagaatgtt

SEQ ID NO: 2315718 - DNA, 20 bp, Homo sapiens
tatttttggcagtctgaatt

SEQ ID NO: 2315719 - DNA, 14 bp, Homo sapiens
tatttttgtacatg

SEQ ID NO: 2315720 - DNA, 18 bp, Homo sapiens
tatttttgtatttctcta

SEQ ID NO: 2315721 - DNA, 19 bp, Homo sapiens
tatttttttagattgagaa

SEQ ID NO: 2315722 - DNA, 16 bp, Homo sapiens
tatttttttttctaag

SEQ ID NO: 2315723 - DNA, 19 bp, Homo sapiens
tattttttttttcttcttg

SEQ ID NO: 2315724 - DNA, 18 bp, Homo sapiens
tcaaaaaaaaaaagaaaa

SEQ ID NO: 2315725 - DNA, 17 bp, Homo sapiens
tcaaaaaccagccaggc

SEQ ID NO: 2315726 - DNA, 14 bp, Homo sapiens
tcaaaaagaaatca

SEQ ID NO: 2315727 - DNA, 17 bp, Homo sapiens
tcaaaaagaaatcaata

SEQ ID NO: 2315728 - DNA, 17 bp, Homo sapiens
tcaaaaagaactaaata

SEQ ID NO: 2315729 - DNA, 17 bp, Homo sapiens
tcaaaaccaagtatcac

SEQ ID NO: 2315730 - DNA, 13 bp, Homo sapiens
tcaaaataaaaag

SEQ ID NO: 2315731 - DNA, 13 bp, Homo sapiens
tcaaacaagtatg

SEQ ID NO: 2315732 - DNA, 19 bp, Homo sapiens
tcaaacttgtggcctcaag

SEQ ID NO: 2315733 - DNA, 15 bp, Homo sapiens
tcaaagaacaaacat

SEQ ID NO: 2315734 - DNA, 15 bp, Homo sapiens
tcaaagagattcgaa

SEQ ID NO: 2315735 - DNA, 15 bp, Homo sapiens
tcaaagtatgcaatg

SEQ ID NO: 2315736 - DNA, 17 bp, Homo sapiens
tcaaagtcattaaagac

SEQ ID NO: 2315737 - DNA, 21 bp, Homo sapiens
tcaaagtctgctctcatataa

SEQ ID NO: 2315738 - DNA, 15 bp, Homo sapiens
tcaaagttttgaaaa

SEQ ID NO: 2315739 - DNA, 18 bp, Homo sapiens
tcaaagttttgaaaagct

SEQ ID NO: 2315740 - DNA, 20 bp, Homo sapiens
tcaaagttttgaaaagctat

SEQ ID NO: 2315741 - DNA, 15 bp, Homo sapiens
tcaaataaaatatca

SEQ ID NO: 2315742 - DNA, 16 bp, Homo sapiens
tcaaataaaatatcat

SEQ ID NO: 2315743 - DNA, 18 bp, Homo sapiens
tcaaataaaatatcataa

SEQ ID NO: 2315744 - DNA, 20 bp, Homo sapiens
tcaaataaaatatcataaag

SEQ ID NO: 2315745 - DNA, 23 bp, Homo sapiens
tcaaataaaatatcataaagcat

SEQ ID NO: 2315746 - DNA, 12 bp, Homo sapiens
tcaaataagaaa

SEQ ID NO: 2315747 - DNA, 17 bp, Homo sapiens
tcaaataatgcttttct

SEQ ID NO: 2315748 - DNA, 23 bp, Homo sapiens
tcaaataggctattaaaaaagtc

SEQ ID NO: 2315749 - DNA, 15 bp, Homo sapiens
tcaaatagttgcata

SEQ ID NO: 2315750 - DNA, 13 bp, Homo sapiens
tcaaatgaaatgt

SEQ ID NO: 2315751 - DNA, 15 bp, Homo sapiens
tcaaatgaaatgtat

SEQ ID NO: 2315752 - DNA, 22 bp, Homo sapiens
tcaaatgaatgattaaattatg

SEQ ID NO: 2315753 - DNA, 23 bp, Homo sapiens
tcaaatgtgtctcacatctacac

SEQ ID NO: 2315754 - DNA, 14 bp, Homo sapiens
tcaaattcttctga

SEQ ID NO: 2315755 - DNA, 20 bp, Homo sapiens
tcaacaagatttccttgtgc

SEQ ID NO: 2315756 - DNA, 22 bp, Homo sapiens
tcaaccaggtccagatgtgcta

SEQ ID NO: 2315757 - DNA, 18 bp, Homo sapiens
tcaacctcgcgcttgctg

SEQ ID NO: 2315758 - DNA, 22 bp, Homo sapiens
tcaacggaagccccctcttcct

SEQ ID NO: 2315759 - DNA, 19 bp, Homo sapiens
tcaactcacctaatgttta

SEQ ID NO: 2315760 - DNA, 20 bp, Homo sapiens
tcaactctgaagctaattgt

SEQ ID NO: 2315761 - DNA, 19 bp, Homo sapiens
tcaactgaggttcttggga

SEQ ID NO: 2315762 - DNA, 22 bp, Homo sapiens
tcaactgcccctgacttaactt

SEQ ID NO: 2315763 - DNA, 14 bp, Homo sapiens
tcaactgcctactc

SEQ ID NO: 2315764 - DNA, 16 bp, Homo sapiens
tcaagaaaaaaaggga

SEQ ID NO: 2315765 - DNA, 17 bp, Homo sapiens
tcaagaagatagttgta

SEQ ID NO: 2315766 - DNA, 11 bp, Homo sapiens
tcaagaccccc

SEQ ID NO: 2315767 - DNA, 11 bp, Homo sapiens
tcaagagaaac

SEQ ID NO: 2315768 - DNA, 22 bp, Homo sapiens
tcaagagctagaaaaataaaat

SEQ ID NO: 2315769 - DNA, 20 bp, Homo sapiens
tcaagaggagcccccaccct

SEQ ID NO: 2315770 - DNA, 18 bp, Homo sapiens
tcaagaggataaatttta

SEQ ID NO: 2315771 - DNA, 15 bp, Homo sapiens
tcaagagtccggatt

SEQ ID NO: 2315772 - DNA, 16 bp, Homo sapiens
tcaagattctaaagct

SEQ ID NO: 2315773 - DNA, 17 bp, Homo sapiens
tcaagattctaaagctc

SEQ ID NO: 2315774 - DNA, 13 bp, Homo sapiens
tcaagattttgaa

SEQ ID NO: 2315775 - DNA, 19 bp, Homo sapiens
tcaagattttgaatgcttc

SEQ ID NO: 2315776 - DNA, 16 bp, Homo sapiens
tcaagcaaaacagttc

SEQ ID NO: 2315777 - DNA, 19 bp, Homo sapiens
tcaagcaatccacctgcct

SEQ ID NO: 2315778 - DNA, 20 bp, Homo sapiens
tcaagcaatcctcctgcctc

SEQ ID NO: 2315779 - DNA, 19 bp, Homo sapiens
tcaaggataccttcttatt

SEQ ID NO: 2315780 - DNA, 19 bp, Homo sapiens
tcaaggtcactgtttcctg

SEQ ID NO: 2315781 - DNA, 18 bp, Homo sapiens
tcaatacactagttgttt

SEQ ID NO: 2315782 - DNA, 18 bp, Homo sapiens
tcaatactcttaaatttt

SEQ ID NO: 2315783 - DNA, 16 bp, Homo sapiens
tcaatagatctccagc

SEQ ID NO: 2315784 - DNA, 13 bp, Homo sapiens
tcaatagttgaat

SEQ ID NO: 2315785 - DNA, 16 bp, Homo sapiens
tcaatatattgaactt

SEQ ID NO: 2315786 - DNA, 14 bp, Homo sapiens
tcaatatgaatcta

SEQ ID NO: 2315787 - DNA, 16 bp, Homo sapiens
tcaatatttttatatc

SEQ ID NO: 2315788 - DNA, 14 bp, Homo sapiens
tcaatctcctctct

SEQ ID NO: 2315789 - DNA, 21 bp, Homo sapiens
tcaatctcctctctctttcct

SEQ ID NO: 2315790 - DNA, 17 bp, Homo sapiens
tcaatctgtaaactgtg

SEQ ID NO: 2315791 - DNA, 16 bp, Homo sapiens
tcaatgggacctgtgg

SEQ ID NO: 2315792 - DNA, 14 bp, Homo sapiens
tcaatgtcttccca

SEQ ID NO: 2315793 - DNA, 13 bp, Homo sapiens
tcaattactggtc

SEQ ID NO: 2315794 - DNA, 16 bp, Homo sapiens
tcaattactggtccaa

SEQ ID NO: 2315795 - DNA, 20 bp, Homo sapiens
tcaattgacattcctttgaa

SEQ ID NO: 2315796 - DNA, 16 bp, Homo sapiens
tcacaaagctatttaa

SEQ ID NO: 2315797 - DNA, 18 bp, Homo sapiens
tcacaaagctatttaagt

SEQ ID NO: 2315798 - DNA, 19 bp, Homo sapiens
tcacaatgagaaaaataaa

SEQ ID NO: 2315799 - DNA, 22 bp, Homo sapiens
tcacagataacataaataaaaa

SEQ ID NO: 2315800 - DNA, 18 bp, Homo sapiens
tcacagcacttacaattt

SEQ ID NO: 2315801 - DNA, 14 bp, Homo sapiens
tcacaggctgagaa

SEQ ID NO: 2315802 - DNA, 22 bp, Homo sapiens
tcacattcctctgcccttcctg

SEQ ID NO: 2315803 - DNA, 19 bp, Homo sapiens
tcacatttgaaataaagta

SEQ ID NO: 2315804 - DNA, 16 bp, Homo sapiens
tcacattttccttttc

SEQ ID NO: 2315805 - DNA, 22 bp, Homo sapiens
tcaccaaggatcggactctgcc

SEQ ID NO: 2315806 - DNA, 19 bp, Homo sapiens
tcaccagagactttagggg

SEQ ID NO: 2315807 - DNA, 16 bp, Homo sapiens
tcaccagccctgcagc

SEQ ID NO: 2315808 - DNA, 15 bp, Homo sapiens
tcaccatttcctcct

SEQ ID NO: 2315809 - DNA, 13 bp, Homo sapiens
tcacccacctctt

SEQ ID NO: 2315810 - DNA, 13 bp, Homo sapiens
tcaccgcccatca

SEQ ID NO: 2315811 - DNA, 12 bp, Homo sapiens
tcaccgctgggt

SEQ ID NO: 2315812 - DNA, 14 bp, Homo sapiens
tcacctaatgttta

SEQ ID NO: 2315813 - DNA, 21 bp, Homo sapiens
tcacctaatgtttatgagcca

SEQ ID NO: 2315814 - DNA, 17 bp, Homo sapiens
tcacctcagtagaaaag

SEQ ID NO: 2315815 - DNA, 20 bp, Homo sapiens
tcacctcatgcccaccccct

SEQ ID NO: 2315816 - DNA, 23 bp, Homo sapiens
tcacctcatgcccaccccctgcc

SEQ ID NO: 2315817 - DNA, 20 bp, Homo sapiens
tcacctccaagcatttcatg

SEQ ID NO: 2315818 - DNA, 22 bp, Homo sapiens
tcacctctaggtccccatactc

SEQ ID NO: 2315819 - DNA, 23 bp, Homo sapiens
tcacctctaggtccccatactcc

SEQ ID NO: 2315820 - DNA, 19 bp, Homo sapiens
tcacctgccccagcactca

SEQ ID NO: 2315821 - DNA, 16 bp, Homo sapiens
tcacctgtaaacctga

SEQ ID NO: 2315822 - DNA, 13 bp, Homo sapiens
tcaccttggaagg

SEQ ID NO: 2315823 - DNA, 14 bp, Homo sapiens
tcacgactcttcct

SEQ ID NO: 2315824 - DNA, 20 bp, Homo sapiens
tcacgcaagtgccagggctg

SEQ ID NO: 2315825 - DNA, 14 bp, Homo sapiens
tcacgccccacact

SEQ ID NO: 2315826 - DNA, 16 bp, Homo sapiens
tcacgctctggacatg

SEQ ID NO: 2315827 - DNA, 21 bp, Homo sapiens
tcacggggttccctcctagct

SEQ ID NO: 2315828 - DNA, 22 bp, Homo sapiens
tcacgtggcctccgcagtgtct

SEQ ID NO: 2315829 - DNA, 16 bp, Homo sapiens
tcactaccctgattct

SEQ ID NO: 2315830 - DNA, 22 bp, Homo sapiens
tcactattcttggaccatgcca

SEQ ID NO: 2315831 - DNA, 23 bp, Homo sapiens
tcactcccacctgcatctggggc

SEQ ID NO: 2315832 - DNA, 18 bp, Homo sapiens
tcactctgtgcctttcta

SEQ ID NO: 2315833 - DNA, 16 bp, Homo sapiens
tcactgccaggccagc

SEQ ID NO: 2315834 - DNA, 12 bp, Homo sapiens
tcactggctctc

SEQ ID NO: 2315835 - DNA, 13 bp, Homo sapiens
tcactggctctcc

SEQ ID NO: 2315836 - DNA, 18 bp, Homo sapiens
tcactggctctcctggcc

SEQ ID NO: 2315837 - DNA, 14 bp, Homo sapiens
tcactgtataaata

SEQ ID NO: 2315838 - DNA, 16 bp, Homo sapiens
tcactgtataaatagg

SEQ ID NO: 2315839 - DNA, 18 bp, Homo sapiens
tcactgtatcattttctt

SEQ ID NO: 2315840 - DNA, 21 bp, Homo sapiens
tcactgtgatcaatattttta

SEQ ID NO: 2315841 - DNA, 16 bp, Homo sapiens
tcactgttgctttgaa

SEQ ID NO: 2315842 - DNA, 18 bp, Homo sapiens
tcacttacgtttgtcctt

SEQ ID NO: 2315843 - DNA, 20 bp, Homo sapiens
tcacttattattaataatga

SEQ ID NO: 2315844 - DNA, 16 bp, Homo sapiens
tcacttctaaatgcat

SEQ ID NO: 2315845 - DNA, 12 bp, Homo sapiens
tcacttcttcct

SEQ ID NO: 2315846 - DNA, 17 bp, Homo sapiens
tcacttcttcctattgt

SEQ ID NO: 2315847 - DNA, 14 bp, Homo sapiens
tcactttctcagtt

SEQ ID NO: 2315848 - DNA, 11 bp, Homo sapiens
tcactttgaaa

SEQ ID NO: 2315849 - DNA, 22 bp, Homo sapiens
tcactttgaaaagttggaagga

SEQ ID NO: 2315850 - DNA, 17 bp, Homo sapiens
tatgaaaatatagacat

SEQ ID NO: 2315851 - DNA, 14 bp, Homo sapiens
tatgaaataagtaa

SEQ ID NO: 2315852 - DNA, 13 bp, Homo sapiens
tatgaacagctgt

SEQ ID NO: 2315853 - DNA, 15 bp, Homo sapiens
tatgaacagctgtgt

SEQ ID NO: 2315854 - DNA, 13 bp, Homo sapiens
tatgaatctataa

SEQ ID NO: 2315855 - DNA, 18 bp, Homo sapiens
tatgaattgaattatctt

SEQ ID NO: 2315856 - DNA, 16 bp, Homo sapiens
tatgacaaattcaaga

SEQ ID NO: 2315857 - DNA, 16 bp, Homo sapiens
tatgaccagaagcctt

SEQ ID NO: 2315858 - DNA, 19 bp, Homo sapiens
tatgacggaagaacataga

SEQ ID NO: 2315859 - DNA, 17 bp, Homo sapiens
tatgagccagacaaatg

SEQ ID NO: 2315860 - DNA, 20 bp, Homo sapiens
tatgagctatcctttcaaac

SEQ ID NO: 2315861 - DNA, 16 bp, Homo sapiens
tatgagttgaaatgtt

SEQ ID NO: 2315862 - DNA, 15 bp, Homo sapiens
tatgatagtataaaa

SEQ ID NO: 2315863 - DNA, 22 bp, Homo sapiens
tatgatattttctgtgcctgaa

SEQ ID NO: 2315864 - DNA, 18 bp, Homo sapiens
tatgatttccttcaatgt

SEQ ID NO: 2315865 - DNA, 20 bp, Homo sapiens
tatgcacatatggactctgc

SEQ ID NO: 2315866 - DNA, 13 bp, Homo sapiens
tatgcacttttag

SEQ ID NO: 2315867 - DNA, 20 bp, Homo sapiens
tatgcacttttagaaatgca

SEQ ID NO: 2315868 - DNA, 20 bp, Homo sapiens
tatgcagaaatagacaaaaa

SEQ ID NO: 2315869 - DNA, 22 bp, Homo sapiens
tatgcagaaatagacaaaaagt

SEQ ID NO: 2315870 - DNA, 17 bp, Homo sapiens
tatgcatcatttcagga

SEQ ID NO: 2315871 - DNA, 17 bp, Homo sapiens
tatgcattattaaattg

SEQ ID NO: 2315872 - DNA, 12 bp, Homo sapiens
tatgcattcaca

SEQ ID NO: 2315873 - DNA, 19 bp, Homo sapiens
tatgcattcacatttagaa

SEQ ID NO: 2315874 - DNA, 15 bp, Homo sapiens
tatgctgatctttta

SEQ ID NO: 2315875 - DNA, 20 bp, Homo sapiens
tatgctgatcttttaaaatc

SEQ ID NO: 2315876 - DNA, 16 bp, Homo sapiens
tatgcttactgatata

SEQ ID NO: 2315877 - DNA, 15 bp, Homo sapiens
tatggaaaactgtgt

SEQ ID NO: 2315878 - DNA, 15 bp, Homo sapiens
tatggactctgcaca

SEQ ID NO: 2315879 - DNA, 13 bp, Homo sapiens
tatggcagaagac

SEQ ID NO: 2315880 - DNA, 22 bp, Homo sapiens
tatggcagaagacaccagagca

SEQ ID NO: 2315881 - DNA, 15 bp, Homo sapiens
tatggcttatttcta

SEQ ID NO: 2315882 - DNA, 22 bp, Homo sapiens
tatggcttatttctatgacaaa

SEQ ID NO: 2315883 - DNA, 23 bp, Homo sapiens
tatgggcttttggggagccagaa

SEQ ID NO: 2315884 - DNA, 20 bp, Homo sapiens
tatgggggcatctcttcccc

SEQ ID NO: 2315885 - DNA, 16 bp, Homo sapiens
tatggtggaaaagaac

SEQ ID NO: 2315886 - DNA, 19 bp, Homo sapiens
tatggttacttcttctctt

SEQ ID NO: 2315887 - DNA, 18 bp, Homo sapiens
tatgtagtatctatatga

SEQ ID NO: 2315888 - DNA, 17 bp, Homo sapiens
tatgtctcatgttttat

SEQ ID NO: 2315889 - DNA, 14 bp, Homo sapiens
tatgtctcttctga

SEQ ID NO: 2315890 - DNA, 14 bp, Homo sapiens
tatgtctgccatgt

SEQ ID NO: 2315891 - DNA, 21 bp, Homo sapiens
tatgtgaaaaattaacttttt

SEQ ID NO: 2315892 - DNA, 18 bp, Homo sapiens
tatgtgaatttttaagct

SEQ ID NO: 2315893 - DNA, 14 bp, Homo sapiens
tatgtgacattaac

SEQ ID NO: 2315894 - DNA, 15 bp, Homo sapiens
tatgtgagctgtaaa

SEQ ID NO: 2315895 - DNA, 18 bp, Homo sapiens
tatgtgagctgtaaaaat

SEQ ID NO: 2315896 - DNA, 18 bp, Homo sapiens
tatgtgggatattgaatg

SEQ ID NO: 2315897 - DNA, 13 bp, Homo sapiens
tatgttaaagaga

SEQ ID NO: 2315898 - DNA, 23 bp, Homo sapiens
tatgttgataaaccaaaaacatt

SEQ ID NO: 2315899 - DNA, 20 bp, Homo sapiens
tatgttgtttataataaaaa

SEQ ID NO: 2315900 - DNA, 19 bp, Homo sapiens
tatgtttaaaagaaatata

SEQ ID NO: 2315901 - DNA, 16 bp, Homo sapiens
tatgtttaaaatggca

SEQ ID NO: 2315902 - DNA, 18 bp, Homo sapiens
tattaaaaaacttcatgt

SEQ ID NO: 2315903 - DNA, 16 bp, Homo sapiens
tcgtgctactgcactc

SEQ ID NO: 2315904 - DNA, 14 bp, Homo sapiens
tcgtggattgtttt

SEQ ID NO: 2315905 - DNA, 12 bp, Homo sapiens
tcgtggctgtca

SEQ ID NO: 2315906 - DNA, 17 bp, Homo sapiens
tcgtggtagaagccagt

SEQ ID NO: 2315907 - DNA, 21 bp, Homo sapiens
tcgtgtgtttctattttttga

SEQ ID NO: 2315908 - DNA, 18 bp, Homo sapiens
tctaaaaggtaatgtgtg

SEQ ID NO: 2315909 - DNA, 14 bp, Homo sapiens
tctaaagagcatct

SEQ ID NO: 2315910 - DNA, 15 bp, Homo sapiens
tctaaataaaaatat

SEQ ID NO: 2315911 - DNA, 18 bp, Homo sapiens
tctaaatagtattttgtc

SEQ ID NO: 2315912 - DNA, 14 bp, Homo sapiens
tctaaatgcatatc

SEQ ID NO: 2315913 - DNA, 12 bp, Homo sapiens
tctaagagaagt

SEQ ID NO: 2315914 - DNA, 20 bp, Homo sapiens
tctaagagcgaacttcacat

SEQ ID NO: 2315915 - DNA, 16 bp, Homo sapiens
tctaatacctctgtgt

SEQ ID NO: 2315916 - DNA, 20 bp, Homo sapiens
tctaatacctctgtgtgctc

SEQ ID NO: 2315917 - DNA, 21 bp, Homo sapiens
tctaattaagaaaactattaa

SEQ ID NO: 2315918 - DNA, 12 bp, Homo sapiens
tctaattaatag

SEQ ID NO: 2315919 - DNA, 14 bp, Homo sapiens
tctaattctgattc

SEQ ID NO: 2315920 - DNA, 23 bp, Homo sapiens
tctacaagccaaaagtccctccc

SEQ ID NO: 2315921 - DNA, 22 bp, Homo sapiens
tctacaatctctttttgtttgc

SEQ ID NO: 2315922 - DNA, 19 bp, Homo sapiens
tctacagccttgtccccct

SEQ ID NO: 2315923 - DNA, 19 bp, Homo sapiens
tctaccctgtctgtccctt

SEQ ID NO: 2315924 - DNA, 17 bp, Homo sapiens
tctaccttcctgtccct

SEQ ID NO: 2315925 - DNA, 18 bp, Homo sapiens
tctaccttcctgtccctg

SEQ ID NO: 2315926 - DNA, 21 bp, Homo sapiens
tctacggatcatcaacaagat

SEQ ID NO: 2315927 - DNA, 13 bp, Homo sapiens
tctactaaaaata

SEQ ID NO: 2315928 - DNA, 17 bp, Homo sapiens
tctactaaaaatacaaa

SEQ ID NO: 2315929 - DNA, 22 bp, Homo sapiens
tctactaaaaatacaaaaaaat

SEQ ID NO: 2315930 - DNA, 17 bp, Homo sapiens
tctactagattgtgatc

SEQ ID NO: 2315931 - DNA, 20 bp, Homo sapiens
tctactcacttttcccactc

SEQ ID NO: 2315932 - DNA, 15 bp, Homo sapiens
tctactttaaattgt

SEQ ID NO: 2315933 - DNA, 16 bp, Homo sapiens
tctactttaaattgtg

SEQ ID NO: 2315934 - DNA, 18 bp, Homo sapiens
tctagagcagttggccaa

SEQ ID NO: 2315935 - DNA, 14 bp, Homo sapiens
tctagatgattttt

SEQ ID NO: 2315936 - DNA, 22 bp, Homo sapiens
tctagatgattttttgaaagtt

SEQ ID NO: 2315937 - DNA, 21 bp, Homo sapiens
tctagccagcccctcttcccc

SEQ ID NO: 2315938 - DNA, 13 bp, Homo sapiens
tctaggacacagt

SEQ ID NO: 2315939 - DNA, 21 bp, Homo sapiens
tctaggacacagttcctggga

SEQ ID NO: 2315940 - DNA, 23 bp, Homo sapiens
tctaggacacagttcctgggaac

SEQ ID NO: 2315941 - DNA, 20 bp, Homo sapiens
tctaggactgcagtgtggag

SEQ ID NO: 2315942 - DNA, 21 bp, Homo sapiens
tctaggagcaaggtgagaaat

SEQ ID NO: 2315943 - DNA, 16 bp, Homo sapiens
tctagtgacttcctgg

SEQ ID NO: 2315944 - DNA, 18 bp, Homo sapiens
tctagtgtccataaataa

SEQ ID NO: 2315945 - DNA, 19 bp, Homo sapiens
tctagtgtccataaataaa

SEQ ID NO: 2315946 - DNA, 12 bp, Homo sapiens
tctataaaaata

SEQ ID NO: 2315947 - DNA, 16 bp, Homo sapiens
tctataagtagtaaat

SEQ ID NO: 2315948 - DNA, 17 bp, Homo sapiens
tctataagtagtaaatc

SEQ ID NO: 2315949 - DNA, 20 bp, Homo sapiens
tctatccatctcctggtgtt

SEQ ID NO: 2315950 - DNA, 12 bp, Homo sapiens
tctatctcatct

SEQ ID NO: 2315951 - DNA, 20 bp, Homo sapiens
tctatggcttatttctatga

SEQ ID NO: 2315952 - DNA, 14 bp, Homo sapiens
tctatgggaaaaat

SEQ ID NO: 2315953 - DNA, 15 bp, Homo sapiens
tctattatcacatta

SEQ ID NO: 2315954 - DNA, 17 bp, Homo sapiens
tctattatggaaaactg

SEQ ID NO: 2315955 - DNA, 12 bp, Homo sapiens
tctattcagctt

SEQ ID NO: 2315956 - DNA, 18 bp, Homo sapiens
tctatttggggcttgatg

SEQ ID NO: 2315957 - DNA, 20 bp, Homo sapiens
tctattttttgaaaagcaga

SEQ ID NO: 2315958 - DNA, 17 bp, Homo sapiens
tctcaaagttttgaaaa

SEQ ID NO: 2315959 - DNA, 20 bp, Homo sapiens
tctcaaataggctattaaaa

SEQ ID NO: 2315960 - DNA, 20 bp, Homo sapiens
tctcaacggaagccccctct

SEQ ID NO: 2315961 - DNA, 23 bp, Homo sapiens
tctcaagctagtgtttctagcta

SEQ ID NO: 2315962 - DNA, 19 bp, Homo sapiens
tctcaatgaaccataaatt

SEQ ID NO: 2315963 - DNA, 14 bp, Homo sapiens
tctcactgcttgaa

SEQ ID NO: 2315964 - DNA, 16 bp, Homo sapiens
tctcagaacatactga

SEQ ID NO: 2315965 - DNA, 12 bp, Homo sapiens
tctcagaacctt

SEQ ID NO: 2315966 - DNA, 22 bp, Homo sapiens
tctcagaaccttgtcccagcca

SEQ ID NO: 2315967 - DNA, 16 bp, Homo sapiens
tctcagatttccacag

SEQ ID NO: 2315968 - DNA, 14 bp, Homo sapiens
tctcagatttctga

SEQ ID NO: 2315969 - DNA, 13 bp, Homo sapiens
tctcaggcaccag

SEQ ID NO: 2315970 - DNA, 14 bp, Homo sapiens
tctcagtcatgcat

SEQ ID NO: 2315971 - DNA, 14 bp, Homo sapiens
tctcagtgttggta

SEQ ID NO: 2315972 - DNA, 18 bp, Homo sapiens
tctcagttctcttgcttt

SEQ ID NO: 2315973 - DNA, 15 bp, Homo sapiens
tctcagttttcataa

SEQ ID NO: 2315974 - DNA, 16 bp, Homo sapiens
tctcagttttcataag

SEQ ID NO: 2315975 - DNA, 15 bp, Homo sapiens
tctcatcaactgaat

SEQ ID NO: 2315976 - DNA, 12 bp, Homo sapiens
tctcatccacat

SEQ ID NO: 2315977 - DNA, 17 bp, Homo sapiens
tctcatgagaagccaag

SEQ ID NO: 2315978 - DNA, 20 bp, Homo sapiens
tctcatgaggggagaggaga

SEQ ID NO: 2315979 - DNA, 17 bp, Homo sapiens
tctcatgttttatatga

SEQ ID NO: 2315980 - DNA, 20 bp, Homo sapiens
tctcatgttttatatgatta

SEQ ID NO: 2315981 - DNA, 21 bp, Homo sapiens
tctccaagaaactgaatgaat

SEQ ID NO: 2315982 - DNA, 14 bp, Homo sapiens
tctccacagtgttg

SEQ ID NO: 2315983 - DNA, 21 bp, Homo sapiens
tctccacagtgttgtgcccct

SEQ ID NO: 2315984 - DNA, 12 bp, Homo sapiens
tctccactccat

SEQ ID NO: 2315985 - DNA, 18 bp, Homo sapiens
tctccagtggattcccag

SEQ ID NO: 2315986 - DNA, 20 bp, Homo sapiens
tctccatctcccaaggctgc

SEQ ID NO: 2315987 - DNA, 17 bp, Homo sapiens
tctccattttcaagctg

SEQ ID NO: 2315988 - DNA, 22 bp, Homo sapiens
tctcccaaagtaccttgaactc

SEQ ID NO: 2315989 - DNA, 22 bp, Homo sapiens
tctcccaactcttgcacagtca

SEQ ID NO: 2315990 - DNA, 17 bp, Homo sapiens
tctcccaaggctgccag

SEQ ID NO: 2315991 - DNA, 12 bp, Homo sapiens
tctcccaccctc

SEQ ID NO: 2315992 - DNA, 14 bp, Homo sapiens
tctcccaccctctt

SEQ ID NO: 2315993 - DNA, 15 bp, Homo sapiens
tctcccaccctcttc

SEQ ID NO: 2315994 - DNA, 16 bp, Homo sapiens
tctcccaccctcttcc

SEQ ID NO: 2315995 - DNA, 17 bp, Homo sapiens
tctcccaccctcttcct

SEQ ID NO: 2315996 - DNA, 14 bp, Homo sapiens
tctcccactctcct

SEQ ID NO: 2315997 - DNA, 16 bp, Homo sapiens
tctcccactctcctag

SEQ ID NO: 2315998 - DNA, 14 bp, Homo sapiens
tctcccaggctgtc

SEQ ID NO: 2315999 - DNA, 18 bp, Homo sapiens
tctccccagagctgcctg

SEQ ID NO: 2316000 - DNA, 23 bp, Homo sapiens
tctccccctcctccagggaaggt

SEQ ID NO: 2316001 - DNA, 15 bp, Homo sapiens
tctccctagctcctc

SEQ ID NO: 2316002 - DNA, 17 bp, Homo sapiens
tctccctcccctctcag

SEQ ID NO: 2316003 - DNA, 19 bp, Homo sapiens
tctccctcccctctcagaa

SEQ ID NO: 2316004 - DNA, 23 bp, Homo sapiens
tctccctcccctctcagaacata

SEQ ID NO: 2316005 - DNA, 20 bp, Homo sapiens
tctccctggaatgagttgag

SEQ ID NO: 2316006 - DNA, 15 bp, Homo sapiens
tctccctggagaagc

SEQ ID NO: 2316007 - DNA, 13 bp, Homo sapiens
tctccctggctcc

SEQ ID NO: 2316008 - DNA, 15 bp, Homo sapiens
tctccgccagcctcc

SEQ ID NO: 2316009 - DNA, 18 bp, Homo sapiens
tctccgccagcctcctct

SEQ ID NO: 2316010 - DNA, 21 bp, Homo sapiens
tctccgccagcctcctctgga

SEQ ID NO: 2316011 - DNA, 19 bp, Homo sapiens
tctccggggccatttgcaa

SEQ ID NO: 2316012 - DNA, 19 bp, Homo sapiens
tctcctaggcattctggac

SEQ ID NO: 2316013 - DNA, 19 bp, Homo sapiens
tctcctggcctatccgctg

SEQ ID NO: 2316014 - DNA, 15 bp, Homo sapiens
tctcctggtgttctg

SEQ ID NO: 2316015 - DNA, 20 bp, Homo sapiens
tctccttaagctgcagagat

SEQ ID NO: 2316016 - DNA, 22 bp, Homo sapiens
tctccttaagctgcagagattt

SEQ ID NO: 2316017 - DNA, 16 bp, Homo sapiens
tctccttctcctagct

SEQ ID NO: 2316018 - DNA, 14 bp, Homo sapiens
tctgtaataaaact

SEQ ID NO: 2316019 - DNA, 17 bp, Homo sapiens
tctgtacacgtgtcctg

SEQ ID NO: 2316020 - DNA, 13 bp, Homo sapiens
tctgtatttcctt

SEQ ID NO: 2316021 - DNA, 16 bp, Homo sapiens
tctgtcaatcacagtc

SEQ ID NO: 2316022 - DNA, 20 bp, Homo sapiens
tctgtccagctggggccaga

SEQ ID NO: 2316023 - DNA, 13 bp, Homo sapiens
tctgtcccccagg

SEQ ID NO: 2316024 - DNA, 17 bp, Homo sapiens
tctgtcccccaggctgg

SEQ ID NO: 2316025 - DNA, 22 bp, Homo sapiens
tctgtccccctttagatctctg

SEQ ID NO: 2316026 - DNA, 23 bp, Homo sapiens
tctgtccccctttagatctctga

SEQ ID NO: 2316027 - DNA, 13 bp, Homo sapiens
tctgtcccttttc

SEQ ID NO: 2316028 - DNA, 18 bp, Homo sapiens
tctgtcccttttctttga

SEQ ID NO: 2316029 - DNA, 23 bp, Homo sapiens
tctgtctcaaaaaaaaaaagaaa

SEQ ID NO: 2316030 - DNA, 22 bp, Homo sapiens
tctgtctccctcccctctcaga

SEQ ID NO: 2316031 - DNA, 12 bp, Homo sapiens
tctgtctgcttt

SEQ ID NO: 2316032 - DNA, 14 bp, Homo sapiens
tctgtctgctttgg

SEQ ID NO: 2316033 - DNA, 12 bp, Homo sapiens
tctgtctggcac

SEQ ID NO: 2316034 - DNA, 20 bp, Homo sapiens
tctgtgaaggacttggtgat

SEQ ID NO: 2316035 - DNA, 14 bp, Homo sapiens
tctgtgatgagctg

SEQ ID NO: 2316036 - DNA, 17 bp, Homo sapiens
tctgtgcctgaatattt

SEQ ID NO: 2316037 - DNA, 14 bp, Homo sapiens
tctgtgcctttcta

SEQ ID NO: 2316038 - DNA, 14 bp, Homo sapiens
tctgtgctcctcct

SEQ ID NO: 2316039 - DNA, 15 bp, Homo sapiens
tctgtggctggctct

SEQ ID NO: 2316040 - DNA, 19 bp, Homo sapiens
tctgtggttcctctgctca

SEQ ID NO: 2316041 - DNA, 20 bp, Homo sapiens
tctgtggttcctctgctcac

SEQ ID NO: 2316042 - DNA, 14 bp, Homo sapiens
tctgtgtcagcatt

SEQ ID NO: 2316043 - DNA, 16 bp, Homo sapiens
tctgttaatgcttgct

SEQ ID NO: 2316044 - DNA, 15 bp, Homo sapiens
tctgttcagcaaact

SEQ ID NO: 2316045 - DNA, 11 bp, Homo sapiens
tctgttgtaat

SEQ ID NO: 2316046 - DNA, 19 bp, Homo sapiens
tctgttttgtggtttggaa

SEQ ID NO: 2316047 - DNA, 17 bp, Homo sapiens
tcttaaaaatttataca

SEQ ID NO: 2316048 - DNA, 14 bp, Homo sapiens
tcttaataaaataa

SEQ ID NO: 2316049 - DNA, 21 bp, Homo sapiens
tcttacaatattgattgggaa

SEQ ID NO: 2316050 - DNA, 17 bp, Homo sapiens
tcttagctttttaattg

SEQ ID NO: 2316051 - DNA, 21 bp, Homo sapiens
tcttagctttttaattgttgt

SEQ ID NO: 2316052 - DNA, 18 bp, Homo sapiens
tcttagttcatatatcaa

SEQ ID NO: 2316053 - DNA, 14 bp, Homo sapiens
tcttatctcagtca

SEQ ID NO: 2316054 - DNA, 13 bp, Homo sapiens
tcttatgtgacat

SEQ ID NO: 2316055 - DNA, 19 bp, Homo sapiens
tcttatttcatttattttt

SEQ ID NO: 2316056 - DNA, 14 bp, Homo sapiens
tcttcaaagccttc

SEQ ID NO: 2316057 - DNA, 16 bp, Homo sapiens
tcttcactcaaatttt

SEQ ID NO: 2316058 - DNA, 13 bp, Homo sapiens
tcttcagcccagg

SEQ ID NO: 2316059 - DNA, 22 bp, Homo sapiens
tcttcaggatattggttcttcc

SEQ ID NO: 2316060 - DNA, 23 bp, Homo sapiens
tcttcatggcatcttcaatatga

SEQ ID NO: 2316061 - DNA, 24 bp, Homo sapiens
tcttccaacatgtgatgtgttgct

SEQ ID NO: 2316062 - DNA, 21 bp, Homo sapiens
tcttccagtgaacattcccag

SEQ ID NO: 2316063 - DNA, 13 bp, Homo sapiens
tcttcccatgcat

SEQ ID NO: 2316064 - DNA, 14 bp, Homo sapiens
tcttcccccaccac

SEQ ID NO: 2316065 - DNA, 22 bp, Homo sapiens
tcttccctgaacgttttcttct

SEQ ID NO: 2316066 - DNA, 22 bp, Homo sapiens
tcttcctatccctctcctaact

SEQ ID NO: 2316067 - DNA, 21 bp, Homo sapiens
tcttcctatttgccatgggct

SEQ ID NO: 2316068 - DNA, 16 bp, Homo sapiens
tcttcctgacacttta

SEQ ID NO: 2316069 - DNA, 14 bp, Homo sapiens
tcttcctgtgtcct

SEQ ID NO: 2316070 - DNA, 15 bp, Homo sapiens
tcttcctgtgtcctg

SEQ ID NO: 2316071 - DNA, 16 bp, Homo sapiens
tcttcctgtgtcctga

SEQ ID NO: 2316072 - DNA, 14 bp, Homo sapiens
tcttcgggaccagg

SEQ ID NO: 2316073 - DNA, 22 bp, Homo sapiens
tcttctactcacttttcccact

SEQ ID NO: 2316074 - DNA, 22 bp, Homo sapiens
tcttctagatgattttttgaaa

SEQ ID NO: 2316075 - DNA, 10 bp, Homo sapiens
tcttctatta

SEQ ID NO: 2316076 - DNA, 14 bp, Homo sapiens
tcttctcttatcct

SEQ ID NO: 2316077 - DNA, 21 bp, Homo sapiens
tcttctgagctatttcatcta

SEQ ID NO: 2316078 - DNA, 18 bp, Homo sapiens
tcttctggggcaggctgg

SEQ ID NO: 2316079 - DNA, 13 bp, Homo sapiens
tcttcttgaaatt

SEQ ID NO: 2316080 - DNA, 16 bp, Homo sapiens
tcttctttaagccata

SEQ ID NO: 2316081 - DNA, 14 bp, Homo sapiens
tcttgaatataaaa

SEQ ID NO: 2316082 - DNA, 13 bp, Homo sapiens
tcttgagctggcc

SEQ ID NO: 2316083 - DNA, 14 bp, Homo sapiens
tcttgagctggcct

SEQ ID NO: 2316084 - DNA, 21 bp, Homo sapiens
tcttgagctggcctctctagc

SEQ ID NO: 2316085 - DNA, 14 bp, Homo sapiens
tcttgattcctggc

SEQ ID NO: 2316086 - DNA, 17 bp, Homo sapiens
tcttgattcctggctct

SEQ ID NO: 2316087 - DNA, 14 bp, Homo sapiens
tcttgcccatcctg

SEQ ID NO: 2316088 - DNA, 15 bp, Homo sapiens
tcttgcccatcctga

SEQ ID NO: 2316089 - DNA, 18 bp, Homo sapiens
tcttgcccatcctgactg

SEQ ID NO: 2316090 - DNA, 21 bp, Homo sapiens
tcttgcctgaactcctgccat

SEQ ID NO: 2316091 - DNA, 14 bp, Homo sapiens
tcttgctctgtccc

SEQ ID NO: 2316092 - DNA, 16 bp, Homo sapiens
tcttggacactgtaca

SEQ ID NO: 2316093 - DNA, 16 bp, Homo sapiens
tcttggggctcgcccc

SEQ ID NO: 2316094 - DNA, 20 bp, Homo sapiens
tcttggtagattattcataa

SEQ ID NO: 2316095 - DNA, 14 bp, Homo sapiens
tcttggtgtaattt

SEQ ID NO: 2316096 - DNA, 23 bp, Homo sapiens
tcttggttgaaaataaaaagatc

SEQ ID NO: 2316097 - DNA, 13 bp, Homo sapiens
tcttgtaaagact

SEQ ID NO: 2316098 - DNA, 17 bp, Homo sapiens
tcttgtaaagactggtt

SEQ ID NO: 2316099 - DNA, 15 bp, Homo sapiens
tcttgtatttaaaaa

SEQ ID NO: 2316100 - DNA, 17 bp, Homo sapiens
tcttgtatttaaaaaca

SEQ ID NO: 2316101 - DNA, 20 bp, Homo sapiens
tcttgtgcaaggtggccttt

SEQ ID NO: 2316102 - DNA, 13 bp, Homo sapiens
tcttgtgtcctga

SEQ ID NO: 2316103 - DNA, 13 bp, Homo sapiens
tcttgttttgaaa

SEQ ID NO: 2316104 - DNA, 14 bp, Homo sapiens
tctttaaactatgt

SEQ ID NO: 2316105 - DNA, 17 bp, Homo sapiens
tctttaaccttgtataa

SEQ ID NO: 2316106 - DNA, 18 bp, Homo sapiens
tctttaaccttgtataaa

SEQ ID NO: 2316107 - DNA, 14 bp, Homo sapiens
tctttaagccatag

SEQ ID NO: 2316108 - DNA, 12 bp, Homo sapiens
tctttagttttt

SEQ ID NO: 2316109 - DNA, 22 bp, Homo sapiens
tctttagtttttggttgggaat

SEQ ID NO: 2316110 - DNA, 11 bp, Homo sapiens
tctttatatga

SEQ ID NO: 2316111 - DNA, 12 bp, Homo sapiens
tctttattgaaa

SEQ ID NO: 2316112 - DNA, 14 bp, Homo sapiens
tctttattgaaatt

SEQ ID NO: 2316113 - DNA, 12 bp, Homo sapiens
tctttattttgt

SEQ ID NO: 2316114 - DNA, 10 bp, Homo sapiens
tctttcatgg

SEQ ID NO: 2316115 - DNA, 17 bp, Homo sapiens
tctttccctggacaggc

SEQ ID NO: 2316116 - DNA, 14 bp, Homo sapiens
tctttcctatttca

SEQ ID NO: 2316117 - DNA, 15 bp, Homo sapiens
tctttcctctttctg

SEQ ID NO: 2316118 - DNA, 23 bp, Homo sapiens
tctttcctctttctgctctgcca

SEQ ID NO: 2316119 - DNA, 12 bp, Homo sapiens
tctttcctgccc

SEQ ID NO: 2316120 - DNA, 14 bp, Homo sapiens
tctttcctgccctg

SEQ ID NO: 2316121 - DNA, 17 bp, Homo sapiens
tctttcctgccctgtcc

SEQ ID NO: 2316122 - DNA, 15 bp, Homo sapiens
tctttctagtggtct

SEQ ID NO: 2316123 - DNA, 12 bp, Homo sapiens
tctttctcttcc

SEQ ID NO: 2316124 - DNA, 15 bp, Homo sapiens
tctttctcttccctg

SEQ ID NO: 2316125 - DNA, 16 bp, Homo sapiens
tctttctcttccctga

SEQ ID NO: 2316126 - DNA, 14 bp, Homo sapiens
tctttctgctctgc

SEQ ID NO: 2316127 - DNA, 16 bp, Homo sapiens
tctttgaatatgtagt

SEQ ID NO: 2316128 - DNA, 14 bp, Homo sapiens
tctttgagtaatgt

SEQ ID NO: 2316129 - DNA, 13 bp, Homo sapiens
tctttgctccaga

SEQ ID NO: 2316130 - DNA, 12 bp, Homo sapiens
tctttgctgcag

SEQ ID NO: 2316131 - DNA, 13 bp, Homo sapiens
tctttgtaagagt

SEQ ID NO: 2316132 - DNA, 19 bp, Homo sapiens
tctttgtaagagtgtagaa

SEQ ID NO: 2316133 - DNA, 21 bp, Homo sapiens
tctttgtaagagtgtagaagc

SEQ ID NO: 2316134 - DNA, 24 bp, Homo sapiens
tctttgtaagagtgtagaagcatt

SEQ ID NO: 2316135 - DNA, 21 bp, Homo sapiens
tctttgtaccaaaattttaaa

SEQ ID NO: 2316136 - DNA, 23 bp, Homo sapiens
tctttgtaccaaaattttaaaaa

SEQ ID NO: 2316137 - DNA, 22 bp, Homo sapiens
tctttgtgcctgagtggcctgt

SEQ ID NO: 2316138 - DNA, 18 bp, Homo sapiens
tcttttaaagaccctcct

SEQ ID NO: 2316139 - DNA, 18 bp, Homo sapiens
tcttttaatggcatttct

SEQ ID NO: 2316140 - DNA, 18 bp, Homo sapiens
tcttttatactcagcttt

SEQ ID NO: 2316141 - DNA, 17 bp, Homo sapiens
tcttttcaaataatgct

SEQ ID NO: 2316142 - DNA, 19 bp, Homo sapiens
tcttttcagaagcaagcca

SEQ ID NO: 2316143 - DNA, 19 bp, Homo sapiens
tcttttcccactgtttaag

SEQ ID NO: 2316144 - DNA, 16 bp, Homo sapiens
tcttttgtttggtaaa

SEQ ID NO: 2316145 - DNA, 20 bp, Homo sapiens
tctttttaaaaattgttatt

SEQ ID NO: 2316146 - DNA, 15 bp, Homo sapiens
tctttttcctcctgg

SEQ ID NO: 2316147 - DNA, 20 bp, Homo sapiens
tctttttgtagctggggctt

SEQ ID NO: 2316148 - DNA, 12 bp, Homo sapiens
tctttttgtttg

SEQ ID NO: 2316149 - DNA, 12 bp, Homo sapiens
tcttttttaacc

SEQ ID NO: 2316150 - DNA, 23 bp, Homo sapiens
tctttttttaagtgttctgtggc

SEQ ID NO: 2316151 - DNA, 20 bp, Homo sapiens
tctttttttgagtgacagct

SEQ ID NO: 2316152 - DNA, 17 bp, Homo sapiens
tgaaaaacacggcagct

SEQ ID NO: 2316153 - DNA, 11 bp, Homo sapiens
tgaaaaatata

SEQ ID NO: 2316154 - DNA, 17 bp, Homo sapiens
tgaaaaatataaaatta

SEQ ID NO: 2316155 - DNA, 20 bp, Homo sapiens
tgaaaaatataaaattatga

SEQ ID NO: 2316156 - DNA, 22 bp, Homo sapiens
tgaaaaatctcattatttctgg

SEQ ID NO: 2316157 - DNA, 14 bp, Homo sapiens
tgaaaaattgctga

SEQ ID NO: 2316158 - DNA, 23 bp, Homo sapiens
tgaaaaattgctgactgtagctt

SEQ ID NO: 2316159 - DNA, 15 bp, Homo sapiens
tgaaaagaaggaaag

SEQ ID NO: 2316160 - DNA, 18 bp, Homo sapiens
tgaaaataactgaatttg

SEQ ID NO: 2316161 - DNA, 13 bp, Homo sapiens
tgaaaataccatt

SEQ ID NO: 2316162 - DNA, 22 bp, Homo sapiens
tgaaaatatagacattctcaca

SEQ ID NO: 2316163 - DNA, 17 bp, Homo sapiens
tgaaaatgtgctatact

SEQ ID NO: 2316164 - DNA, 19 bp, Homo sapiens
tgaaaatgtgctatactgc

SEQ ID NO: 2316165 - DNA, 13 bp, Homo sapiens
tgaaaattgaaaa

SEQ ID NO: 2316166 - DNA, 17 bp, Homo sapiens
tgaaaattgaaaagtac

SEQ ID NO: 2316167 - DNA, 19 bp, Homo sapiens
tgaaacaaagtactcttta

SEQ ID NO: 2316168 - DNA, 22 bp, Homo sapiens
tgaaacaaagtactctttaaca

SEQ ID NO: 2316169 - DNA, 17 bp, Homo sapiens
tgaaacacacgagcaaa

SEQ ID NO: 2316170 - DNA, 18 bp, Homo sapiens
tgaaacagttgctgtgaa

SEQ ID NO: 2316171 - DNA, 19 bp, Homo sapiens
tgaaaccttttttaagatt

SEQ ID NO: 2316172 - DNA, 19 bp, Homo sapiens
tgaaactcatagacactga

SEQ ID NO: 2316173 - DNA, 22 bp, Homo sapiens
tgaaagaaaattgagttgcact

SEQ ID NO: 2316174 - DNA, 17 bp, Homo sapiens
tgaaagccaacaactct

SEQ ID NO: 2316175 - DNA, 18 bp, Homo sapiens
tgaaagtagattcatgaa

SEQ ID NO: 2316176 - DNA, 18 bp, Homo sapiens
tgaaagtgcatttttgta

SEQ ID NO: 2316177 - DNA, 20 bp, Homo sapiens
tgaaagtgcatttttgtaaa

SEQ ID NO: 2316178 - DNA, 13 bp, Homo sapiens
tgaaagttgtgat

SEQ ID NO: 2316179 - DNA, 14 bp, Homo sapiens
tgaaagttttgtaa

SEQ ID NO: 2316180 - DNA, 20 bp, Homo sapiens
tgaaagttttgtaaaagaaa

SEQ ID NO: 2316181 - DNA, 12 bp, Homo sapiens
tgaaataaaata

SEQ ID NO: 2316182 - DNA, 17 bp, Homo sapiens
tgaaataagtaaatgta

SEQ ID NO: 2316183 - DNA, 19 bp, Homo sapiens
tgaaatgagtaaaaactag

SEQ ID NO: 2316184 - DNA, 21 bp, Homo sapiens
tgaaattaacacaaaggaagt

SEQ ID NO: 2316185 - DNA, 13 bp, Homo sapiens
tgaaattaagcat

SEQ ID NO: 2316186 - DNA, 17 bp, Homo sapiens
tgaaattgcatactttg

SEQ ID NO: 2316187 - DNA, 14 bp, Homo sapiens
tgaaatttaagcac

SEQ ID NO: 2316188 - DNA, 17 bp, Homo sapiens
tgaaatttaagcacaaa

SEQ ID NO: 2316189 - DNA, 14 bp, Homo sapiens
tgaaattttagaaa

SEQ ID NO: 2316190 - DNA, 16 bp, Homo sapiens
tgaaattttagaaata

SEQ ID NO: 2316191 - DNA, 17 bp, Homo sapiens
tgaacacagtgtctgtt

SEQ ID NO: 2316192 - DNA, 20 bp, Homo sapiens
tgaacacagtgtctgttcag

SEQ ID NO: 2316193 - DNA, 16 bp, Homo sapiens
tgaacagaagctctta

SEQ ID NO: 2316194 - DNA, 21 bp, Homo sapiens
tgaacagaagctcttactctt

SEQ ID NO: 2316195 - DNA, 17 bp, Homo sapiens
tgaacagctgtgtctgc

SEQ ID NO: 2316196 - DNA, 20 bp, Homo sapiens
tgaacagctgtgtctgccaa

SEQ ID NO: 2316197 - DNA, 18 bp, Homo sapiens
tgaacatgtttaatgggt

SEQ ID NO: 2316198 - DNA, 15 bp, Homo sapiens
tgaaccaatctggat

SEQ ID NO: 2316199 - DNA, 20 bp, Homo sapiens
tgaaccactgcttctctttt

SEQ ID NO: 2316200 - DNA, 23 bp, Homo sapiens
tgaaccactgcttctcttttgaa

SEQ ID NO: 2316201 - DNA, 22 bp, Homo sapiens
tgaaccatggtgaagtgcttgg

SEQ ID NO: 2316202 - DNA, 21 bp, Homo sapiens
tgaaccccccgcccatgctgt

SEQ ID NO: 2316203 - DNA, 22 bp, Homo sapiens
tgaaccccccgcccatgctgtc

SEQ ID NO: 2316204 - DNA, 14 bp, Homo sapiens
tgaaccctggggcc

SEQ ID NO: 2316205 - DNA, 14 bp, Homo sapiens
tgaaccgcacagct

SEQ ID NO: 2316206 - DNA, 13 bp, Homo sapiens
tgaacgttttctt

SEQ ID NO: 2316207 - DNA, 15 bp, Homo sapiens
tgaacgttttcttct

SEQ ID NO: 2316208 - DNA, 23 bp, Homo sapiens
tgaacgttttcttctttccctgg

SEQ ID NO: 2316209 - DNA, 18 bp, Homo sapiens
tgaactcaaactgaggaa

SEQ ID NO: 2316210 - DNA, 13 bp, Homo sapiens
tgaactcctgcca

SEQ ID NO: 2316211 - DNA, 15 bp, Homo sapiens
tgaactcctgccagg

SEQ ID NO: 2316212 - DNA, 14 bp, Homo sapiens
tgaactcctgccat

SEQ ID NO: 2316213 - DNA, 22 bp, Homo sapiens
tgaactcttagtgattgagact

SEQ ID NO: 2316214 - DNA, 16 bp, Homo sapiens
tgaacttttgtactga

SEQ ID NO: 2316215 - DNA, 18 bp, Homo sapiens
tgaacttttgtactgaat

SEQ ID NO: 2316216 - DNA, 21 bp, Homo sapiens
tgaagaaaatcacttaggaaa

SEQ ID NO: 2316217 - DNA, 13 bp, Homo sapiens
tgaagaaagtcaa

SEQ ID NO: 2316218 - DNA, 22 bp, Homo sapiens
tgaagaaagtcaaaaaattatt

SEQ ID NO: 2316219 - DNA, 14 bp, Homo sapiens
tgaagaaataaatg

SEQ ID NO: 2316220 - DNA, 17 bp, Homo sapiens
tgaagaaataaatgaaa

SEQ ID NO: 2316221 - DNA, 23 bp, Homo sapiens
tgaagaatgttagagtaatgaaa

SEQ ID NO: 2316222 - DNA, 17 bp, Homo sapiens
tgaagaccctatctccc

SEQ ID NO: 2316223 - DNA, 12 bp, Homo sapiens
tgaagagacaga

SEQ ID NO: 2316224 - DNA, 21 bp, Homo sapiens
tgaagagggagaagcatgaaa

SEQ ID NO: 2316225 - DNA, 18 bp, Homo sapiens
tgaagatgaaggggctct

SEQ ID NO: 2316226 - DNA, 18 bp, Homo sapiens
tgaagattatatgaagtt

SEQ ID NO: 2316227 - DNA, 13 bp, Homo sapiens
tgaagatttaatt

SEQ ID NO: 2316228 - DNA, 13 bp, Homo sapiens
tgaagcaggaggc

SEQ ID NO: 2316229 - DNA, 14 bp, Homo sapiens
tgaagccaaagaaa

SEQ ID NO: 2316230 - DNA, 12 bp, Homo sapiens
tgaagctgcaca

SEQ ID NO: 2316231 - DNA, 19 bp, Homo sapiens
tgaaggagaggaggaatta

SEQ ID NO: 2316232 - DNA, 19 bp, Homo sapiens
tgaaggtgataagggaaaa

SEQ ID NO: 2316233 - DNA, 13 bp, Homo sapiens
tgaagtagaagtt

SEQ ID NO: 2316234 - DNA, 20 bp, Homo sapiens
tgaagtattttgctggaata

SEQ ID NO: 2316235 - DNA, 19 bp, Homo sapiens
tgaagtggctggtagaaaa

SEQ ID NO: 2316236 - DNA, 13 bp, Homo sapiens
tgaagtttcaagt

SEQ ID NO: 2316237 - DNA, 21 bp, Homo sapiens
tgaagtttcaagttttaaagt

SEQ ID NO: 2316238 - DNA, 12 bp, Homo sapiens
tgaataaatgtg

SEQ ID NO: 2316239 - DNA, 18 bp, Homo sapiens
tggctgtcaatgggacct

SEQ ID NO: 2316240 - DNA, 22 bp, Homo sapiens
tggctgtcaatgggacctgtgg

SEQ ID NO: 2316241 - DNA, 22 bp, Homo sapiens
tggctgtggttcctaagcctgt

SEQ ID NO: 2316242 - DNA, 21 bp, Homo sapiens
tggcttaagtgagcagaacag

SEQ ID NO: 2316243 - DNA, 22 bp, Homo sapiens
tggcttctgtgatgagctgatc

SEQ ID NO: 2316244 - DNA, 21 bp, Homo sapiens
tggcttgttcatcatccagat

SEQ ID NO: 2316245 - DNA, 15 bp, Homo sapiens
tggctttaagccttc

SEQ ID NO: 2316246 - DNA, 15 bp, Homo sapiens
tggctttccaggcac

SEQ ID NO: 2316247 - DNA, 19 bp, Homo sapiens
tggctttcccaggagatgg

SEQ ID NO: 2316248 - DNA, 15 bp, Homo sapiens
tggctttttaacatg

SEQ ID NO: 2316249 - DNA, 21 bp, Homo sapiens
tgggaaaaatctaaaatgtgt

SEQ ID NO: 2316250 - DNA, 18 bp, Homo sapiens
tgggaaaccctctccatc

SEQ ID NO: 2316251 - DNA, 17 bp, Homo sapiens
tgggaacttgcgagtcc

SEQ ID NO: 2316252 - DNA, 11 bp, Homo sapiens
tgggaagccat

SEQ ID NO: 2316253 - DNA, 16 bp, Homo sapiens
tgggaagtcctggcac

SEQ ID NO: 2316254 - DNA, 19 bp, Homo sapiens
tgggaatgaaattaacaca

SEQ ID NO: 2316255 - DNA, 17 bp, Homo sapiens
tgggaatgaggtgggag

SEQ ID NO: 2316256 - DNA, 20 bp, Homo sapiens
tgggacacagacccaggacc

SEQ ID NO: 2316257 - DNA, 17 bp, Homo sapiens
tgggacctgccaggcag

SEQ ID NO: 2316258 - DNA, 18 bp, Homo sapiens
tgggacctgccaggcagg

SEQ ID NO: 2316259 - DNA, 13 bp, Homo sapiens
tgggacggaccag

SEQ ID NO: 2316260 - DNA, 23 bp, Homo sapiens
tgggagaatcgctcctgcagccc

SEQ ID NO: 2316261 - DNA, 16 bp, Homo sapiens
tgggagagccatacat

SEQ ID NO: 2316262 - DNA, 18 bp, Homo sapiens
tgggagatttttttgagt

SEQ ID NO: 2316263 - DNA, 20 bp, Homo sapiens
tgggagccatgccgtctgcc

SEQ ID NO: 2316264 - DNA, 19 bp, Homo sapiens
tgggagctgagcagcctct

SEQ ID NO: 2316265 - DNA, 13 bp, Homo sapiens
tgggaggaattca

SEQ ID NO: 2316266 - DNA, 13 bp, Homo sapiens
tgggaggagggag

SEQ ID NO: 2316267 - DNA, 14 bp, Homo sapiens
tgggaggagggaga

SEQ ID NO: 2316268 - DNA, 15 bp, Homo sapiens
tgggaggagggagag

SEQ ID NO: 2316269 - DNA, 18 bp, Homo sapiens
tgggaggagggagaggga

SEQ ID NO: 2316270 - DNA, 20 bp, Homo sapiens
tgggaggcagggctctcccg

SEQ ID NO: 2316271 - DNA, 11 bp, Homo sapiens
tgggaggctga

SEQ ID NO: 2316272 - DNA, 18 bp, Homo sapiens
tgggaggtgcgtgttcag

SEQ ID NO: 2316273 - DNA, 16 bp, Homo sapiens
tgggagtgtgtctgct

SEQ ID NO: 2316274 - DNA, 13 bp, Homo sapiens
tgggatcagcctc

SEQ ID NO: 2316275 - DNA, 14 bp, Homo sapiens
tgggatgaatgcca

SEQ ID NO: 2316276 - DNA, 23 bp, Homo sapiens
tgggatggcatttggtctcaggc

SEQ ID NO: 2316277 - DNA, 22 bp, Homo sapiens
tgggatgtcacagtccaaccag

SEQ ID NO: 2316278 - DNA, 23 bp, Homo sapiens
tgggattgacagaagcttctgcc

SEQ ID NO: 2316279 - DNA, 22 bp, Homo sapiens
tgggatttccagaaccacactt

SEQ ID NO: 2316280 - DNA, 13 bp, Homo sapiens
tgggatttgagat

SEQ ID NO: 2316281 - DNA, 16 bp, Homo sapiens
tgggattttttccctt

SEQ ID NO: 2316282 - DNA, 16 bp, Homo sapiens
tgggcaaagggaagta

SEQ ID NO: 2316283 - DNA, 14 bp, Homo sapiens
tgggcacagtccag

SEQ ID NO: 2316284 - DNA, 21 bp, Homo sapiens
tgggcactccgcgccgatgcc

SEQ ID NO: 2316285 - DNA, 24 bp, Homo sapiens
tgggcactccgcgccgatgccacc

SEQ ID NO: 2316286 - DNA, 16 bp, Homo sapiens
tgggcagagctgcatc

SEQ ID NO: 2316287 - DNA, 21 bp, Homo sapiens
tgggcagccagaccagcaggc

SEQ ID NO: 2316288 - DNA, 15 bp, Homo sapiens
tgggcagtgccccag

SEQ ID NO: 2316289 - DNA, 14 bp, Homo sapiens
tgggcattttcctc

SEQ ID NO: 2316290 - DNA, 19 bp, Homo sapiens
tgggcattttcctcctctg

SEQ ID NO: 2316291 - DNA, 14 bp, Homo sapiens
tgggccagccacag

SEQ ID NO: 2316292 - DNA, 19 bp, Homo sapiens
tgggccagcggggctgctc

SEQ ID NO: 2316293 - DNA, 18 bp, Homo sapiens
tgggccatgtccaaagag

SEQ ID NO: 2316294 - DNA, 19 bp, Homo sapiens
tgggccatgtccaaagagg

SEQ ID NO: 2316295 - DNA, 17 bp, Homo sapiens
tgggccccacatggctt

SEQ ID NO: 2316296 - DNA, 24 bp, Homo sapiens
tgggccgcaccataatgagatgtg

SEQ ID NO: 2316297 - DNA, 20 bp, Homo sapiens
tgggcctgccgggctgaggg

SEQ ID NO: 2316298 - DNA, 13 bp, Homo sapiens
tgggcctgctgcg

SEQ ID NO: 2316299 - DNA, 13 bp, Homo sapiens
tgggccttgctac

SEQ ID NO: 2316300 - DNA, 19 bp, Homo sapiens
tgggctacatgctggggtc

SEQ ID NO: 2316301 - DNA, 13 bp, Homo sapiens
tgggctctccggg

SEQ ID NO: 2316302 - DNA, 16 bp, Homo sapiens
tgggctgccaccagcc

SEQ ID NO: 2316303 - DNA, 16 bp, Homo sapiens
tgggcttcactgtata

SEQ ID NO: 2316304 - DNA, 18 bp, Homo sapiens
tgggcttcactgtataaa

SEQ ID NO: 2316305 - DNA, 13 bp, Homo sapiens
tgggcttcatctg

SEQ ID NO: 2316306 - DNA, 18 bp, Homo sapiens
tgggcttcattctggaaa

SEQ ID NO: 2316307 - DNA, 14 bp, Homo sapiens
tgggcttcctgccc

SEQ ID NO: 2316308 - DNA, 18 bp, Homo sapiens
tgggcttcctgcccttcc

SEQ ID NO: 2316309 - DNA, 15 bp, Homo sapiens
tgggcttggcctgct

SEQ ID NO: 2316310 - DNA, 16 bp, Homo sapiens
tgggcttggcctgctg

SEQ ID NO: 2316311 - DNA, 18 bp, Homo sapiens
tgggcttggcctgctgtg

SEQ ID NO: 2316312 - DNA, 22 bp, Homo sapiens
tgggcttgtggggcctgggagg

SEQ ID NO: 2316313 - DNA, 19 bp, Homo sapiens
tggggaaaatggccatgca

SEQ ID NO: 2316314 - DNA, 22 bp, Homo sapiens
tggggaaaatggccatgcagga

SEQ ID NO: 2316315 - DNA, 23 bp, Homo sapiens
tggggaaaatggccatgcaggag

SEQ ID NO: 2316316 - DNA, 21 bp, Homo sapiens
tggggaagggttttcttttct

SEQ ID NO: 2316317 - DNA, 17 bp, Homo sapiens
tggggacgtgtgtcctt

SEQ ID NO: 2316318 - DNA, 20 bp, Homo sapiens
tggggacgtgtgtcctttgg

SEQ ID NO: 2316319 - DNA, 18 bp, Homo sapiens
tggggatccccgcctggc

SEQ ID NO: 2316320 - DNA, 16 bp, Homo sapiens
tggggcaggctgggcc

SEQ ID NO: 2316321 - DNA, 17 bp, Homo sapiens
tggggcaggctgggcca

SEQ ID NO: 2316322 - DNA, 20 bp, Homo sapiens
tggggccagaggctgggagt

SEQ ID NO: 2316323 - DNA, 22 bp, Homo sapiens
tggggccataaacggttcctgg

SEQ ID NO: 2316324 - DNA, 23 bp, Homo sapiens
tggggccctgtccaggtagaaaa

SEQ ID NO: 2316325 - DNA, 22 bp, Homo sapiens
tggggcctgggacaactgctcc

SEQ ID NO: 2316326 - DNA, 13 bp, Homo sapiens
tggggcctgggag

SEQ ID NO: 2316327 - DNA, 14 bp, Homo sapiens
tggggcctgggagg

SEQ ID NO: 2316328 - DNA, 11 bp, Homo sapiens
tgggggacctt

SEQ ID NO: 2316329 - DNA, 14 bp, Homo sapiens
tgggggcagcccag

SEQ ID NO: 2316330 - DNA, 13 bp, Homo sapiens
tgggggcagggct

SEQ ID NO: 2316331 - DNA, 14 bp, Homo sapiens
tgggggcagggctg

SEQ ID NO: 2316332 - DNA, 15 bp, Homo sapiens
tgggggcagggctgt

SEQ ID NO: 2316333 - DNA, 19 bp, Homo sapiens
tgggggtggaggcttcctg

SEQ ID NO: 2316334 - DNA, 22 bp, Homo sapiens
tggggtggggggatggtaagag

SEQ ID NO: 2316335 - DNA, 17 bp, Homo sapiens
tgggtcacatccatccc

SEQ ID NO: 2316336 - DNA, 16 bp, Homo sapiens
tgggtcagaaccagag

SEQ ID NO: 2316337 - DNA, 13 bp, Homo sapiens
tgggtcctagccc

SEQ ID NO: 2316338 - DNA, 17 bp, Homo sapiens
tgggtcctagcccttcc

SEQ ID NO: 2316339 - DNA, 20 bp, Homo sapiens
tgggtcctagcccttccctg

SEQ ID NO: 2316340 - DNA, 16 bp, Homo sapiens
tgaataatgctaccag

SEQ ID NO: 2316341 - DNA, 16 bp, Homo sapiens
tgaataatggaaaatg

SEQ ID NO: 2316342 - DNA, 12 bp, Homo sapiens
tgaatataaaaa

SEQ ID NO: 2316343 - DNA, 12 bp, Homo sapiens
tgaatatatgat

SEQ ID NO: 2316344 - DNA, 18 bp, Homo sapiens
tgaatcagatgtgtgttc

SEQ ID NO: 2316345 - DNA, 18 bp, Homo sapiens
tgaatcatgagcctgctg

SEQ ID NO: 2316346 - DNA, 14 bp, Homo sapiens
tgaatctgattgca

SEQ ID NO: 2316347 - DNA, 17 bp, Homo sapiens
tgaatctgattgcactg

SEQ ID NO: 2316348 - DNA, 19 bp, Homo sapiens
tgaatgattaaattatgaa

SEQ ID NO: 2316349 - DNA, 17 bp, Homo sapiens
tgtagaagcattccttc

SEQ ID NO: 2316350 - DNA, 14 bp, Homo sapiens
tgtagactgtggct

SEQ ID NO: 2316351 - DNA, 13 bp, Homo sapiens
tgtagagttaaga

SEQ ID NO: 2316352 - DNA, 19 bp, Homo sapiens
tgtagagttaagaagctgt

SEQ ID NO: 2316353 - DNA, 18 bp, Homo sapiens
tgtagccacagctgctgt

SEQ ID NO: 2316354 - DNA, 19 bp, Homo sapiens
tgtagccacagctgctgtt

SEQ ID NO: 2316355 - DNA, 22 bp, Homo sapiens
tgtagccacagctgctgttctc

SEQ ID NO: 2316356 - DNA, 19 bp, Homo sapiens
tgtagctctgaatgctatt

SEQ ID NO: 2316357 - DNA, 19 bp, Homo sapiens
tgtagctgaaaataaaatg

SEQ ID NO: 2316358 - DNA, 21 bp, Homo sapiens
tgtaggaaccgtggtatgtct

SEQ ID NO: 2316359 - DNA, 15 bp, Homo sapiens
tgtaggtaagactgt

SEQ ID NO: 2316360 - DNA, 15 bp, Homo sapiens
tgtagtcagttgcat

SEQ ID NO: 2316361 - DNA, 17 bp, Homo sapiens
tgtagtcttgacgaata

SEQ ID NO: 2316362 - DNA, 13 bp, Homo sapiens
tgtagttaatata

SEQ ID NO: 2316363 - DNA, 15 bp, Homo sapiens
tgtagtttagttctg

SEQ ID NO: 2316364 - DNA, 12 bp, Homo sapiens
tgtataaatata

SEQ ID NO: 2316365 - DNA, 15 bp, Homo sapiens
tgtataaatgtacat

SEQ ID NO: 2316366 - DNA, 23 bp, Homo sapiens
tgtatacagtgcagagccttctc

SEQ ID NO: 2316367 - DNA, 14 bp, Homo sapiens
tgtatataatttta

SEQ ID NO: 2316368 - DNA, 20 bp, Homo sapiens
tgtatatattttgtgtgaaa

SEQ ID NO: 2316369 - DNA, 12 bp, Homo sapiens
tgtatctttgta

SEQ ID NO: 2316370 - DNA, 21 bp, Homo sapiens
tgtatgaaaaattggggagga

SEQ ID NO: 2316371 - DNA, 20 bp, Homo sapiens
tgttgtaatattttgctgct

SEQ ID NO: 2316372 - DNA, 16 bp, Homo sapiens
tgttgtacttaaatgg

SEQ ID NO: 2316373 - DNA, 13 bp, Homo sapiens
tgttgtcaccaga

SEQ ID NO: 2316374 - DNA, 20 bp, Homo sapiens
tgttgtgccccttcactcat

SEQ ID NO: 2316375 - DNA, 18 bp, Homo sapiens
tgttgttctgcctggaga

SEQ ID NO: 2316376 - DNA, 18 bp, Homo sapiens
tgttgttgaactaatata

SEQ ID NO: 2316377 - DNA, 15 bp, Homo sapiens
tgttgtttataataa

SEQ ID NO: 2316378 - DNA, 12 bp, Homo sapiens
tgttgtttcttt

SEQ ID NO: 2316379 - DNA, 14 bp, Homo sapiens
tgttgtttctttct

SEQ ID NO: 2316380 - DNA, 14 bp, Homo sapiens
tgtttaaaataaaa

SEQ ID NO: 2316381 - DNA, 14 bp, Homo sapiens
tgtttaaaatgtaa

SEQ ID NO: 2316382 - DNA, 14 bp, Homo sapiens
tgtttaatggtgaa

SEQ ID NO: 2316383 - DNA, 20 bp, Homo sapiens
tgtttacatggcgccctgcc

SEQ ID NO: 2316384 - DNA, 20 bp, Homo sapiens
tgtttagcagatttaagata

SEQ ID NO: 2316385 - DNA, 22 bp, Homo sapiens
tgtttatgttgtttataataaa

SEQ ID NO: 2316386 - DNA, 15 bp, Homo sapiens
tgtttatgtttaaaa

SEQ ID NO: 2316387 - DNA, 15 bp, Homo sapiens
tgtttattaaatgct

SEQ ID NO: 2316388 - DNA, 18 bp, Homo sapiens
tgtttattaactactgaa

SEQ ID NO: 2316389 - DNA, 12 bp, Homo sapiens
tgtttattgcaa

SEQ ID NO: 2316390 - DNA, 12 bp, Homo sapiens
tgtttattttct

SEQ ID NO: 2316391 - DNA, 22 bp, Homo sapiens
tgtttattttctacgtttcttt

SEQ ID NO: 2316392 - DNA, 12 bp, Homo sapiens
tgtttcaagagg

SEQ ID NO: 2316393 - DNA, 12 bp, Homo sapiens
tgtttcattatg

SEQ ID NO: 2316394 - DNA, 11 bp, Homo sapiens
tgtttccagaa

SEQ ID NO: 2316395 - DNA, 14 bp, Homo sapiens
tgtttctaagaaaa

SEQ ID NO: 2316396 - DNA, 19 bp, Homo sapiens
tgtttctagctaaataaat

SEQ ID NO: 2316397 - DNA, 21 bp, Homo sapiens
tgtttctagctaaataaatgg

SEQ ID NO: 2316398 - DNA, 16 bp, Homo sapiens
tgtttctattttttga

SEQ ID NO: 2316399 - DNA, 19 bp, Homo sapiens
tgtttgaagattatatgaa

SEQ ID NO: 2316400 - DNA, 22 bp, Homo sapiens
tgtttgaagattatatgaagtt

SEQ ID NO: 2316401 - DNA, 21 bp, Homo sapiens
tgtttgatataccaaattaaa

SEQ ID NO: 2316402 - DNA, 18 bp, Homo sapiens
tgtttgccaggacatgca

SEQ ID NO: 2316403 - DNA, 15 bp, Homo sapiens
tgtttggcaatgcta

SEQ ID NO: 2316404 - DNA, 19 bp, Homo sapiens
tgtttgtcctttatgtatt

SEQ ID NO: 2316405 - DNA, 23 bp, Homo sapiens
tgtttgtcctttatgtattctct

SEQ ID NO: 2316406 - DNA, 12 bp, Homo sapiens
tgtttgtttatt

SEQ ID NO: 2316407 - DNA, 17 bp, Homo sapiens
tgttttgtgaattttct

SEQ ID NO: 2316408 - DNA, 12 bp, Homo sapiens
tgttttgtggat

SEQ ID NO: 2316409 - DNA, 19 bp, Homo sapiens
tgttttgtggtttggaata

SEQ ID NO: 2316410 - DNA, 18 bp, Homo sapiens
tgtttttccctccccaga

SEQ ID NO: 2316411 - DNA, 21 bp, Homo sapiens
tgttttttaagatagtgtaac

SEQ ID NO: 2316412 - DNA, 21 bp, Homo sapiens
tgttttttcattgtgttttct

SEQ ID NO: 2316413 - DNA, 18 bp, Homo sapiens
tgtttttttgttattaaa

SEQ ID NO: 2316414 - DNA, 15 bp, Homo sapiens
ttaaaaaaaaaagtc

SEQ ID NO: 2316415 - DNA, 16 bp, Homo sapiens
ttaaaaaaaaaagtca

SEQ ID NO: 2316416 - DNA, 12 bp, Homo sapiens
ttaaaaacattt

SEQ ID NO: 2316417 - DNA, 16 bp, Homo sapiens
ttaaaaagaatgacgt

SEQ ID NO: 2316418 - DNA, 17 bp, Homo sapiens
ttaaaaattacctttaa

SEQ ID NO: 2316419 - DNA, 21 bp, Homo sapiens
ttaaaacagacactggcatgg

SEQ ID NO: 2316420 - DNA, 13 bp, Homo sapiens
ttaaaagaaatat

SEQ ID NO: 2316421 - DNA, 14 bp, Homo sapiens
ttaaaagaatgact

SEQ ID NO: 2316422 - DNA, 16 bp, Homo sapiens
ttaaaaggatgtataa

SEQ ID NO: 2316423 - DNA, 19 bp, Homo sapiens
ttaaaaggatgtataaatt

SEQ ID NO: 2316424 - DNA, 21 bp, Homo sapiens
ttaaaataaaatgaaaattgt

SEQ ID NO: 2316425 - DNA, 15 bp, Homo sapiens
ttaaaataaggattt

SEQ ID NO: 2316426 - DNA, 19 bp, Homo sapiens
ttaaaataattcatatcta

SEQ ID NO: 2316427 - DNA, 12 bp, Homo sapiens
ttaaaatagaaa

SEQ ID NO: 2316428 - DNA, 21 bp, Homo sapiens
ttaaaatagaaattttgtaag

SEQ ID NO: 2316429 - DNA, 16 bp, Homo sapiens
ttaaaatcatgatcct

SEQ ID NO: 2316430 - DNA, 17 bp, Homo sapiens
ttaaaatttgtcttaaa

SEQ ID NO: 2316431 - DNA, 14 bp, Homo sapiens
ttaaacaaagtttc

SEQ ID NO: 2316432 - DNA, 16 bp, Homo sapiens
ttaaacccaaaatata

SEQ ID NO: 2316433 - DNA, 19 bp, Homo sapiens
ttaaacgaagagttccctt

SEQ ID NO: 2316434 - DNA, 18 bp, Homo sapiens
ttaaactatgttcctaac

SEQ ID NO: 2316435 - DNA, 21 bp, Homo sapiens
ttaaactatgttcctaacaaa

SEQ ID NO: 2316436 - DNA, 12 bp, Homo sapiens
ttaaacttacaa

SEQ ID NO: 2316437 - DNA, 17 bp, Homo sapiens
ttaaacttccaaagaaa

SEQ ID NO: 2316438 - DNA, 18 bp, Homo sapiens
ttaaacttccaaagaaag

SEQ ID NO: 2316439 - DNA, 14 bp, Homo sapiens
ttaaagaaaggaaa

SEQ ID NO: 2316440 - DNA, 14 bp, Homo sapiens
ttaaagttcattgc

SEQ ID NO: 2316441 - DNA, 14 bp, Homo sapiens
ttaaataaaattta

SEQ ID NO: 2316442 - DNA, 17 bp, Homo sapiens
ttaaataaaatttaatt

SEQ ID NO: 2316443 - DNA, 20 bp, Homo sapiens
ttaaataagtgcgatcacac

SEQ ID NO: 2316444 - DNA, 15 bp, Homo sapiens
ttaaatcatttttat

SEQ ID NO: 2316445 - DNA, 13 bp, Homo sapiens
ttaaatcctttta

SEQ ID NO: 2316446 - DNA, 19 bp, Homo sapiens
ttaaatccttttacctttt

SEQ ID NO: 2316447 - DNA, 15 bp, Homo sapiens
ttaaatctcctgtgg

SEQ ID NO: 2316448 - DNA, 16 bp, Homo sapiens
ttaaatgaaagaaaat

SEQ ID NO: 2316449 - DNA, 16 bp, Homo sapiens
ttaaatgcaataattt

SEQ ID NO: 2316450 - DNA, 19 bp, Homo sapiens
ttaaatgcaataattttac

SEQ ID NO: 2316451 - DNA, 12 bp, Homo sapiens
ttaaatgtttct

SEQ ID NO: 2316452 - DNA, 18 bp, Homo sapiens
ttaaattacctttacata

SEQ ID NO: 2316453 - DNA, 23 bp, Homo sapiens
ttaaattatcattgtttgtcctt

SEQ ID NO: 2316454 - DNA, 19 bp, Homo sapiens
ttaaattatgaagctcata

SEQ ID NO: 2316455 - DNA, 14 bp, Homo sapiens
ttaaatttcttatg

SEQ ID NO: 2316456 - DNA, 17 bp, Homo sapiens
ttaaatttgtaagtttc

SEQ ID NO: 2316457 - DNA, 17 bp, Homo sapiens
ttaacaagatgtttcat

SEQ ID NO: 2316458 - DNA, 21 bp, Homo sapiens
ttaacatacaagaaaatgtat

SEQ ID NO: 2316459 - DNA, 22 bp, Homo sapiens
ttaacatctagcctaaagtata

SEQ ID NO: 2316460 - DNA, 15 bp, Homo sapiens
ttaacattttacagt

SEQ ID NO: 2316461 - DNA, 22 bp, Homo sapiens
ttaacattttacagtaaatgtt

SEQ ID NO: 2316462 - DNA, 20 bp, Homo sapiens
ttaacctatgatattttctg

SEQ ID NO: 2316463 - DNA, 21 bp, Homo sapiens
ttaacctatgatattttctgt

SEQ ID NO: 2316464 - DNA, 14 bp, Homo sapiens
ttaacggtgctaaa

SEQ ID NO: 2316465 - DNA, 15 bp, Homo sapiens
ttaacggtgctaaaa

SEQ ID NO: 2316466 - DNA, 18 bp, Homo sapiens
ttaactaaattttaaagc

SEQ ID NO: 2316467 - DNA, 19 bp, Homo sapiens
ttaactataaggtgcctca

SEQ ID NO: 2316468 - DNA, 18 bp, Homo sapiens
ttaactatttttttcaaa

SEQ ID NO: 2316469 - DNA, 15 bp, Homo sapiens
ttaagaaaactatta

SEQ ID NO: 2316470 - DNA, 11 bp, Homo sapiens
ttaagaagctg

SEQ ID NO: 2316471 - DNA, 18 bp, Homo sapiens
ttaagaagctgttgtaca

SEQ ID NO: 2316472 - DNA, 20 bp, Homo sapiens
ttaagaagctgttgtacatt

SEQ ID NO: 2316473 - DNA, 22 bp, Homo sapiens
ttaagaatacacaggatatttt

SEQ ID NO: 2316474 - DNA, 17 bp, Homo sapiens
ttaagatttttctcaaa

SEQ ID NO: 2316475 - DNA, 20 bp, Homo sapiens
ttaagatttttctcaaagtt

SEQ ID NO: 2316476 - DNA, 21 bp, Homo sapiens
ttaagatttttctcaaagttt

SEQ ID NO: 2316477 - DNA, 21 bp, Homo sapiens
ttaagcaaattttgtattatt

SEQ ID NO: 2316478 - DNA, 19 bp, Homo sapiens
ttaagcaataaggaaatgt

SEQ ID NO: 2316479 - DNA, 19 bp, Homo sapiens
ttaagctgcaaatctgatg

SEQ ID NO: 2316480 - DNA, 19 bp, Homo sapiens
ttaagctgcagagatttct

SEQ ID NO: 2316481 - DNA, 20 bp, Homo sapiens
ttaaggaaactcttatctca

SEQ ID NO: 2316482 - DNA, 23 bp, Homo sapiens
ttaaggataaatcataaagtcag

SEQ ID NO: 2316483 - DNA, 19 bp, Homo sapiens
ttaaggattaatattcttc

SEQ ID NO: 2316484 - DNA, 15 bp, Homo sapiens
ttaaggcctgaatca

SEQ ID NO: 2316485 - DNA, 21 bp, Homo sapiens
ttaagggatggaaaaggaaga

SEQ ID NO: 2316486 - DNA, 17 bp, Homo sapiens
ttaaggggaagaatgaa

SEQ ID NO: 2316487 - DNA, 20 bp, Homo sapiens
ttaaggggaagaatgaaagc

SEQ ID NO: 2316488 - DNA, 20 bp, Homo sapiens
ttaagtaccaatgggaagca

SEQ ID NO: 2316489 - DNA, 22 bp, Homo sapiens
ttaagtaccaatgggaagcagg

SEQ ID NO: 2316490 - DNA, 19 bp, Homo sapiens
ttaagtgcgtgtgtagagt

SEQ ID NO: 2316491 - DNA, 19 bp, Homo sapiens
ttaagtggactgtatttcg

SEQ ID NO: 2316492 - DNA, 16 bp, Homo sapiens
ttaagtgttctgtggc

SEQ ID NO: 2316493 - DNA, 15 bp, Homo sapiens
ttaagtttgactaca

SEQ ID NO: 2316494 - DNA, 13 bp, Homo sapiens
ttaagtttgtagt

SEQ ID NO: 2316495 - DNA, 12 bp, Homo sapiens
ttaataaaagaa

SEQ ID NO: 2316496 - DNA, 16 bp, Homo sapiens
ttaataaaataattct

SEQ ID NO: 2316497 - DNA, 15 bp, Homo sapiens
ttaataacattacct

SEQ ID NO: 2316498 - DNA, 21 bp, Homo sapiens
ttaataacattaccttactgt

SEQ ID NO: 2316499 - DNA, 19 bp, Homo sapiens
ttaataagatttttcaaaa

SEQ ID NO: 2316500 - DNA, 19 bp, Homo sapiens
ttaatacaagtaatattat

SEQ ID NO: 2316501 - DNA, 23 bp, Homo sapiens
ttaataccagataccttatctta

SEQ ID NO: 2316502 - DNA, 14 bp, Homo sapiens
ttaatataaatgtt

SEQ ID NO: 2316503 - DNA, 23 bp, Homo sapiens
ttaatattcttttgtttccatgg

SEQ ID NO: 2316504 - DNA, 21 bp, Homo sapiens
ttaatcatacaaactctcacc

SEQ ID NO: 2316505 - DNA, 15 bp, Homo sapiens
ttaatcatcaagaga

SEQ ID NO: 2316506 - DNA, 20 bp, Homo sapiens
ttaatcttcaaagccttctc

SEQ ID NO: 2316507 - DNA, 16 bp, Homo sapiens
ttaatgcctgcttttt

SEQ ID NO: 2316508 - DNA, 18 bp, Homo sapiens
ttaatgcctgctttttgg

SEQ ID NO: 2316509 - DNA, 19 bp, Homo sapiens
ttaatgcctgctttttgga

SEQ ID NO: 2316510 - DNA, 21 bp, Homo sapiens
ttaatgcctgctttttggaaa

SEQ ID NO: 2316511 - DNA, 15 bp, Homo sapiens
ttaatgctgtttcta

SEQ ID NO: 2316512 - DNA, 23 bp, Homo sapiens
ttaatgctgtttctaagaaaatg

SEQ ID NO: 2316513 - DNA, 24 bp, Homo sapiens
ttaatgctgtttctaagaaaatgt

SEQ ID NO: 2316514 - DNA, 22 bp, Homo sapiens
ttaatgtctcactttactttca

SEQ ID NO: 2316515 - DNA, 23 bp, Homo sapiens
ttaatgtctcactttactttcaa

SEQ ID NO: 2316516 - DNA, 15 bp, Homo sapiens
ttaattactgctata

SEQ ID NO: 2316517 - DNA, 15 bp, Homo sapiens
ttaattcatgaggag

SEQ ID NO: 2316518 - DNA, 18 bp, Homo sapiens
ttaattgaaatacctatt

SEQ ID NO: 2316519 - DNA, 13 bp, Homo sapiens
ttaattggccatg

SEQ ID NO: 2316520 - DNA, 20 bp, Homo sapiens
ttaattgttgtttctttcta

SEQ ID NO: 2316521 - DNA, 22 bp, Homo sapiens
ttaattgttgtttctttctagt

SEQ ID NO: 2316522 - DNA, 11 bp, Homo sapiens
ttaatttcctt

SEQ ID NO: 2316523 - DNA, 15 bp, Homo sapiens
ttaatttcctttttg

SEQ ID NO: 2316524 - DNA, 18 bp, Homo sapiens
ttaatttcctttttgaca

SEQ ID NO: 2316525 - DNA, 19 bp, Homo sapiens
ttaatttcctttttgacac

SEQ ID NO: 2316526 - DNA, 13 bp, Homo sapiens
ttaatttgtgtgt

SEQ ID NO: 2316527 - DNA, 13 bp, Homo sapiens
ttaattttcctgg

SEQ ID NO: 2316528 - DNA, 16 bp, Homo sapiens
ttacaagggaagattt

SEQ ID NO: 2316529 - DNA, 15 bp, Homo sapiens
ttacaatagttctgt

SEQ ID NO: 2316530 - DNA, 20 bp, Homo sapiens
ttacaattttttatcatgca

SEQ ID NO: 2316531 - DNA, 19 bp, Homo sapiens
ttacacatcttaaaagtgt

SEQ ID NO: 2316532 - DNA, 24 bp, Homo sapiens
ttacaggcaccgagaatgttgtat

SEQ ID NO: 2316533 - DNA, 14 bp, Homo sapiens
ttacagtaaatgtt

SEQ ID NO: 2316534 - DNA, 20 bp, Homo sapiens
ttacagtggcagtattgaca

SEQ ID NO: 2316535 - DNA, 14 bp, Homo sapiens
ttacagttctttcc

SEQ ID NO: 2316536 - DNA, 15 bp, Homo sapiens
ttacagttctttcct

SEQ ID NO: 2316537 - DNA, 22 bp, Homo sapiens
ttacagttctttcctctttctg

SEQ ID NO: 2316538 - DNA, 14 bp, Homo sapiens
ttacatcttttcta

SEQ ID NO: 2316539 - DNA, 16 bp, Homo sapiens
ttacatcttttctaat

SEQ ID NO: 2316540 - DNA, 20 bp, Homo sapiens
ttacattttattaagctttt

SEQ ID NO: 2316541 - DNA, 22 bp, Homo sapiens
ttaccagaggttgtgcactgtt

SEQ ID NO: 2316542 - DNA, 13 bp, Homo sapiens
ttaccattcacaa

SEQ ID NO: 2316543 - DNA, 15 bp, Homo sapiens
ttacccacctagaac

SEQ ID NO: 2316544 - DNA, 17 bp, Homo sapiens
ttaccctggcccctctc

SEQ ID NO: 2316545 - DNA, 13 bp, Homo sapiens
ttacctccatcca

SEQ ID NO: 2316546 - DNA, 15 bp, Homo sapiens
ttacctggatgttct

SEQ ID NO: 2316547 - DNA, 15 bp, Homo sapiens
ttacctgtatacagt

SEQ ID NO: 2316548 - DNA, 18 bp, Homo sapiens
ttacctgtatacagtgca

SEQ ID NO: 2316549 - DNA, 15 bp, Homo sapiens
ttacctttttatttg

SEQ ID NO: 2316550 - DNA, 22 bp, Homo sapiens
ttacgtgaagaaataaatgaaa

SEQ ID NO: 2316551 - DNA, 15 bp, Homo sapiens
ttacgtgctctgtgg

SEQ ID NO: 2316552 - DNA, 13 bp, Homo sapiens
ttacgtttgtcct

SEQ ID NO: 2316553 - DNA, 17 bp, Homo sapiens
ttactaaaatttacaca

SEQ ID NO: 2316554 - DNA, 21 bp, Homo sapiens
ttactaaaatttacacatctt

SEQ ID NO: 2316555 - DNA, 17 bp, Homo sapiens
ttactaacagtaactgc

SEQ ID NO: 2316556 - DNA, 22 bp, Homo sapiens
ttactaacagtaactgccattt

SEQ ID NO: 2316557 - DNA, 18 bp, Homo sapiens
ttactaactaaataccat

SEQ ID NO: 2316558 - DNA, 22 bp, Homo sapiens
ttactccaggttattgcaataa

SEQ ID NO: 2316559 - DNA, 13 bp, Homo sapiens
ttactctttccta

SEQ ID NO: 2316560 - DNA, 14 bp, Homo sapiens
ttactgatatattt

SEQ ID NO: 2316561 - DNA, 19 bp, Homo sapiens
ttactgctttaatcagaaa

SEQ ID NO: 2316562 - DNA, 14 bp, Homo sapiens
ttactggtccaaaa

SEQ ID NO: 2316563 - DNA, 15 bp, Homo sapiens
ttactggtccaaaag

SEQ ID NO: 2316564 - DNA, 18 bp, Homo sapiens
ttactggtccaaaagatt

SEQ ID NO: 2316565 - DNA, 19 bp, Homo sapiens
ttactgtctattaatattc

SEQ ID NO: 2316566 - DNA, 16 bp, Homo sapiens
ttactgtggaggaagg

SEQ ID NO: 2316567 - DNA, 16 bp, Homo sapiens
ttacttctcgaattga

SEQ ID NO: 2316568 - DNA, 15 bp, Homo sapiens
ttacttgttttggat

SEQ ID NO: 2316569 - DNA, 12 bp, Homo sapiens
ttactttcaaaa

SEQ ID NO: 2316570 - DNA, 13 bp, Homo sapiens
ttactttcaaaat

SEQ ID NO: 2316571 - DNA, 13 bp, Homo sapiens
ttactttgctgag

SEQ ID NO: 2316572 - DNA, 14 bp, Homo sapiens
ttacttttaaactg

SEQ ID NO: 2316573 - DNA, 16 bp, Homo sapiens
ttagaaactacaaata

SEQ ID NO: 2316574 - DNA, 19 bp, Homo sapiens
ttagaaactacaaatatag

SEQ ID NO: 2316575 - DNA, 10 bp, Homo sapiens
ttagaaactg

SEQ ID NO: 2316576 - DNA, 11 bp, Homo sapiens
ttagaaatatt

SEQ ID NO: 2316577 - DNA, 20 bp, Homo sapiens
ttagaaattaaatctgtgtc

SEQ ID NO: 2316578 - DNA, 16 bp, Homo sapiens
ttagacaagagatggg

SEQ ID NO: 2316579 - DNA, 13 bp, Homo sapiens
ttagaccctgggt

SEQ ID NO: 2316580 - DNA, 13 bp, Homo sapiens
ttagagattataa

SEQ ID NO: 2316581 - DNA, 19 bp, Homo sapiens
ttagagtatttcccttcca

SEQ ID NO: 2316582 - DNA, 22 bp, Homo sapiens
ttagagtatttcccttccaaag

SEQ ID NO: 2316583 - DNA, 12 bp, Homo sapiens
ttagcctggact

SEQ ID NO: 2316584 - DNA, 21 bp, Homo sapiens
ttagcggcaaacctttccccc

SEQ ID NO: 2316585 - DNA, 16 bp, Homo sapiens
ttagcgttgttttgtg

SEQ ID NO: 2316586 - DNA, 17 bp, Homo sapiens
ttagctcaggtgcctta

SEQ ID NO: 2316587 - DNA, 24 bp, Homo sapiens
ttagctccataaagtacaaatgaa

SEQ ID NO: 2316588 - DNA, 11 bp, Homo sapiens
ttagctctgag

SEQ ID NO: 2316589 - DNA, 12 bp, Homo sapiens
ttagctctgaga

SEQ ID NO: 2316590 - DNA, 18 bp, Homo sapiens
ttagctttttaattgttg

SEQ ID NO: 2316591 - DNA, 20 bp, Homo sapiens
ttaggaagtgtttatgttgt

SEQ ID NO: 2316592 - DNA, 12 bp, Homo sapiens
ttaggaatctct

SEQ ID NO: 2316593 - DNA, 18 bp, Homo sapiens
ttaggaatctcttcacta

SEQ ID NO: 2316594 - DNA, 13 bp, Homo sapiens
ttagggaagaaaa

SEQ ID NO: 2316595 - DNA, 13 bp, Homo sapiens
ttaggtgccaggc

SEQ ID NO: 2316596 - DNA, 15 bp, Homo sapiens
ttagtggatggaata

SEQ ID NO: 2316597 - DNA, 17 bp, Homo sapiens
ttagtgtgacagtttcc

SEQ ID NO: 2316598 - DNA, 22 bp, Homo sapiens
ttagttgggatgccaatttcct

SEQ ID NO: 2316599 - DNA, 13 bp, Homo sapiens
ttataaacagaaa

SEQ ID NO: 2316600 - DNA, 17 bp, Homo sapiens
ttataactctgtataat

SEQ ID NO: 2316601 - DNA, 18 bp, Homo sapiens
ttataactctgtataata

SEQ ID NO: 2316602 - DNA, 18 bp, Homo sapiens
ttataagaagaagttcat

SEQ ID NO: 2316603 - DNA, 23 bp, Homo sapiens
ttataagctatgagttgaaatgt

SEQ ID NO: 2316604 - DNA, 17 bp, Homo sapiens
ttataaggaaattttac

SEQ ID NO: 2316605 - DNA, 20 bp, Homo sapiens
ttataattgtacaaaattaa

SEQ ID NO: 2316606 - DNA, 21 bp, Homo sapiens
ttatacaaacctaccaaaatg

SEQ ID NO: 2316607 - DNA, 15 bp, Homo sapiens
ttatacaccagcaat

SEQ ID NO: 2316608 - DNA, 18 bp, Homo sapiens
ttatagcaacaacaattg

SEQ ID NO: 2316609 - DNA, 20 bp, Homo sapiens
ttatagcaacaacaattggt

SEQ ID NO: 2316610 - DNA, 17 bp, Homo sapiens
ttatagcaactaatgtt

SEQ ID NO: 2316611 - DNA, 20 bp, Homo sapiens
ttatagtctaagactatata

SEQ ID NO: 2316612 - DNA, 14 bp, Homo sapiens
ttatagttatgtct

SEQ ID NO: 2316613 - DNA, 15 bp, Homo sapiens
ttatatgaagaaaat

SEQ ID NO: 2316614 - DNA, 16 bp, Homo sapiens
ttatatgaagtttaaa

SEQ ID NO: 2316615 - DNA, 19 bp, Homo sapiens
ttatatgcttactgatata

SEQ ID NO: 2316616 - DNA, 19 bp, Homo sapiens
ttatattactgacatttct

SEQ ID NO: 2316617 - DNA, 12 bp, Homo sapiens
ttatatttcctt

SEQ ID NO: 2316618 - DNA, 20 bp, Homo sapiens
ttatatttcctttatgtgaa

SEQ ID NO: 2316619 - DNA, 21 bp, Homo sapiens
ttatatttcctttatgtgaat

SEQ ID NO: 2316620 - DNA, 23 bp, Homo sapiens
ttatcaaaatagtctaaggccat

SEQ ID NO: 2316621 - DNA, 13 bp, Homo sapiens
ttatcccagctgc

SEQ ID NO: 2316622 - DNA, 15 bp, Homo sapiens
ttatcccagctgcct

SEQ ID NO: 2316623 - DNA, 16 bp, Homo sapiens
ttatcccagctgccta

SEQ ID NO: 2316624 - DNA, 13 bp, Homo sapiens
ttatcctctctct

SEQ ID NO: 2316625 - DNA, 19 bp, Homo sapiens
ttatcgaaataacaatgtt

SEQ ID NO: 2316626 - DNA, 21 bp, Homo sapiens
ttatcgaaataacaatgttaa

SEQ ID NO: 2316627 - DNA, 20 bp, Homo sapiens
ttatctaatacctctgtgtg

SEQ ID NO: 2316628 - DNA, 17 bp, Homo sapiens
ttatctcagtcatgcat

SEQ ID NO: 2316629 - DNA, 14 bp, Homo sapiens
ttatgaacagctgt

SEQ ID NO: 2316630 - DNA, 15 bp, Homo sapiens
ttatgaacagctgtg

SEQ ID NO: 2316631 - DNA, 17 bp, Homo sapiens
ttatgaacagctgtgtc

SEQ ID NO: 2316632 - DNA, 18 bp, Homo sapiens
ttatgaacagctgtgtct

SEQ ID NO: 2316633 - DNA, 17 bp, Homo sapiens
ttatgatttaataaaat

SEQ ID NO: 2316634 - DNA, 19 bp, Homo sapiens
ttatgatttttttttcata

SEQ ID NO: 2316635 - DNA, 21 bp, Homo sapiens
ttatgcacttttagaaatgca

SEQ ID NO: 2316636 - DNA, 20 bp, Homo sapiens
ttatggttacttcttctctt

SEQ ID NO: 2316637 - DNA, 14 bp, Homo sapiens
ttatgtaattatat

SEQ ID NO: 2316638 - DNA, 15 bp, Homo sapiens
ttatgtagatgtgca

SEQ ID NO: 2316639 - DNA, 14 bp, Homo sapiens
ttatgtattctctt

SEQ ID NO: 2316640 - DNA, 17 bp, Homo sapiens
ttatgtcttgtatttaa

SEQ ID NO: 2316641 - DNA, 16 bp, Homo sapiens
ttatgtgaaaaattaa

SEQ ID NO: 2316642 - DNA, 18 bp, Homo sapiens
ttatgtgaaaaattaact

SEQ ID NO: 2316643 - DNA, 20 bp, Homo sapiens
ttatgtgaatttttaagctg

SEQ ID NO: 2316644 - DNA, 22 bp, Homo sapiens
ttatgttaagggaagaattcca

SEQ ID NO: 2316645 - DNA, 23 bp, Homo sapiens
ttatgttgataaaccaaaaacat

SEQ ID NO: 2316646 - DNA, 14 bp, Homo sapiens
ttatgttgtaatat

SEQ ID NO: 2316647 - DNA, 18 bp, Homo sapiens
ttatgttgtaatattttg

SEQ ID NO: 2316648 - DNA, 19 bp, Homo sapiens
ttatgttgtttataataaa

SEQ ID NO: 2316649 - DNA, 18 bp, Homo sapiens
ttatgtttaaaagaaata

SEQ ID NO: 2316650 - DNA, 18 bp, Homo sapiens
ttatgtttaaaatggcat

SEQ ID NO: 2316651 - DNA, 20 bp, Homo sapiens
ttatgtttaaaatggcattt

SEQ ID NO: 2316652 - DNA, 15 bp, Homo sapiens
ttattaaatgcttca

SEQ ID NO: 2316653 - DNA, 17 bp, Homo sapiens
ttattaaatgcttcatt

SEQ ID NO: 2316654 - DNA, 17 bp, Homo sapiens
ttattaaattgtaaaac

SEQ ID NO: 2316655 - DNA, 23 bp, Homo sapiens
ttattaactactgaataatgcta

SEQ ID NO: 2316656 - DNA, 14 bp, Homo sapiens
ttattaagtaaaat

SEQ ID NO: 2316657 - DNA, 15 bp, Homo sapiens
ttattaataatgaag

SEQ ID NO: 2316658 - DNA, 16 bp, Homo sapiens
ttattaatgttttcaa

SEQ ID NO: 2316659 - DNA, 17 bp, Homo sapiens
ttattaatgttttcaaa

SEQ ID NO: 2316660 - DNA, 21 bp, Homo sapiens
ttattacatagctctgaagtt

SEQ ID NO: 2316661 - DNA, 12 bp, Homo sapiens
ttattagataat

SEQ ID NO: 2316662 - DNA, 16 bp, Homo sapiens
ttattgagattttcca

SEQ ID NO: 2316663 - DNA, 19 bp, Homo sapiens
ttattgagttccagttgaa

SEQ ID NO: 2316664 - DNA, 17 bp, Homo sapiens
ttattgcaataaagtat

SEQ ID NO: 2316665 - DNA, 15 bp, Homo sapiens
ttattgcctcccagg

SEQ ID NO: 2316666 - DNA, 18 bp, Homo sapiens
ttattgcctcccaggcaa

SEQ ID NO: 2316667 - DNA, 22 bp, Homo sapiens
ttattgggagtcttaataaaat

SEQ ID NO: 2316668 - DNA, 12 bp, Homo sapiens
ttatttaataac

SEQ ID NO: 2316669 - DNA, 15 bp, Homo sapiens
ttatttagacaagag

SEQ ID NO: 2316670 - DNA, 15 bp, Homo sapiens
ttatttcttctctta

SEQ ID NO: 2316671 - DNA, 18 bp, Homo sapiens
ttatttgctcataagtaa

SEQ ID NO: 2316672 - DNA, 20 bp, Homo sapiens
ttatttgctcataagtaaat

SEQ ID NO: 2316673 - DNA, 16 bp, Homo sapiens
ttattttaaaatttca

SEQ ID NO: 2316674 - DNA, 13 bp, Homo sapiens
ttattttcaagaa

SEQ ID NO: 2316675 - DNA, 18 bp, Homo sapiens
ttattttctacgtttctt

SEQ ID NO: 2316676 - DNA, 21 bp, Homo sapiens
ttattttttttcttccaacat

SEQ ID NO: 2316677 - DNA, 17 bp, Homo sapiens
ttcaaaaaccagccagg

SEQ ID NO: 2316678 - DNA, 19 bp, Homo sapiens
ttcaaaagtattgaaagcc

SEQ ID NO: 2316679 - DNA, 17 bp, Homo sapiens
ttcaaaatgaattttta

SEQ ID NO: 2316680 - DNA, 19 bp, Homo sapiens
ttcaaaatgatagacatat

SEQ ID NO: 2316681 - DNA, 18 bp, Homo sapiens
ttcaaaatgtctgtagct

SEQ ID NO: 2316682 - DNA, 14 bp, Homo sapiens
ttcaaacaagtatg

SEQ ID NO: 2316683 - DNA, 17 bp, Homo sapiens
ttcaaacaagtatgaat

SEQ ID NO: 2316684 - DNA, 23 bp, Homo sapiens
ttcaaagcatggacatttagaag

SEQ ID NO: 2316685 - DNA, 17 bp, Homo sapiens
ttcaaagccttctccct

SEQ ID NO: 2316686 - DNA, 18 bp, Homo sapiens
ttcaaatagggtctaact

SEQ ID NO: 2316687 - DNA, 21 bp, Homo sapiens
ttcaaccacagatttatacaa

SEQ ID NO: 2316688 - DNA, 12 bp, Homo sapiens
ttcaagattcta

SEQ ID NO: 2316689 - DNA, 21 bp, Homo sapiens
ttcaagattctaaagctcaat

SEQ ID NO: 2316690 - DNA, 15 bp, Homo sapiens
ttcaagcaaaacagt

SEQ ID NO: 2316691 - DNA, 15 bp, Homo sapiens
ttcaagccttccagg

SEQ ID NO: 2316692 - DNA, 16 bp, Homo sapiens
ttcaagttttaaagtt

SEQ ID NO: 2316693 - DNA, 18 bp, Homo sapiens
ttcaataaatgtctgttg

SEQ ID NO: 2316694 - DNA, 15 bp, Homo sapiens
ttcaatatattgaac

SEQ ID NO: 2316695 - DNA, 15 bp, Homo sapiens
ttcaatctgtaaact

SEQ ID NO: 2316696 - DNA, 16 bp, Homo sapiens
ttcaatctgtaaactg

SEQ ID NO: 2316697 - DNA, 17 bp, Homo sapiens
ttcaatctgtaaactgt

SEQ ID NO: 2316698 - DNA, 13 bp, Homo sapiens
ttcacaataaaag

SEQ ID NO: 2316699 - DNA, 15 bp, Homo sapiens
ttcacaataaaagct

SEQ ID NO: 2316700 - DNA, 17 bp, Homo sapiens
ttcacacctcacgctct

SEQ ID NO: 2316701 - DNA, 23 bp, Homo sapiens
ttcacacctcacgctctggacat

SEQ ID NO: 2316702 - DNA, 18 bp, Homo sapiens
ttcacagtagagccagct

SEQ ID NO: 2316703 - DNA, 19 bp, Homo sapiens
ttcacagtagagccagctt

SEQ ID NO: 2316704 - DNA, 19 bp, Homo sapiens
ttcacattttccttttcaa

SEQ ID NO: 2316705 - DNA, 22 bp, Homo sapiens
ttcacccttatagtctaagact

SEQ ID NO: 2316706 - DNA, 21 bp, Homo sapiens
ttcacctccaagcatttcatg

SEQ ID NO: 2316707 - DNA, 18 bp, Homo sapiens
ttcactactcatgcgtga

SEQ ID NO: 2316708 - DNA, 23 bp, Homo sapiens
ttcactgtcaccaccctgctcat

SEQ ID NO: 2316709 - DNA, 22 bp, Homo sapiens
ttcactttgaaaagttggaagg

SEQ ID NO: 2316710 - DNA, 16 bp, Homo sapiens
ttcagaagcaagccag

SEQ ID NO: 2316711 - DNA, 17 bp, Homo sapiens
ttcagaagcaagccaga

SEQ ID NO: 2316712 - DNA, 12 bp, Homo sapiens
ttcagatacatg

SEQ ID NO: 2316713 - DNA, 13 bp, Homo sapiens
ttcagatgtatgt

SEQ ID NO: 2316714 - DNA, 20 bp, Homo sapiens
ttcagcacaggaattctcaa

SEQ ID NO: 2316715 - DNA, 22 bp, Homo sapiens
ttcagcacaggaattctcaaga

SEQ ID NO: 2316716 - DNA, 16 bp, Homo sapiens
ttcagcagaacctgca

SEQ ID NO: 2316717 - DNA, 23 bp, Homo sapiens
ttcagcagaacctgcacacagga

SEQ ID NO: 2316718 - DNA, 17 bp, Homo sapiens
ttcagctctttccaaat

SEQ ID NO: 2316719 - DNA, 23 bp, Homo sapiens
ttcagctgggtcacatccatccc

SEQ ID NO: 2316720 - DNA, 23 bp, Homo sapiens
ttcagggtaaataggaatcattc

SEQ ID NO: 2316721 - DNA, 22 bp, Homo sapiens
tgttcagcagaacctgcacaca

SEQ ID NO: 2316722 - DNA, 17 bp, Homo sapiens
tgttcagctctttccaa

SEQ ID NO: 2316723 - DNA, 18 bp, Homo sapiens
tgttcagctctttccaaa

SEQ ID NO: 2316724 - DNA, 23 bp, Homo sapiens
tgttcaggaaaaggttgaataat

SEQ ID NO: 2316725 - DNA, 14 bp, Homo sapiens
tgttcataataaaa

SEQ ID NO: 2316726 - DNA, 15 bp, Homo sapiens
tgttcatcatccaga

SEQ ID NO: 2316727 - DNA, 21 bp, Homo sapiens
tgttccaaatactgcttagca

SEQ ID NO: 2316728 - DNA, 16 bp, Homo sapiens
tgttcccatttcagct

SEQ ID NO: 2316729 - DNA, 21 bp, Homo sapiens
tgttccccaaatggccatttt

SEQ ID NO: 2316730 - DNA, 11 bp, Homo sapiens
tgttccctgga

SEQ ID NO: 2316731 - DNA, 17 bp, Homo sapiens
tgttcctaacaaaatga

SEQ ID NO: 2316732 - DNA, 22 bp, Homo sapiens
tgttcctactcacacttcagct

SEQ ID NO: 2316733 - DNA, 16 bp, Homo sapiens
tgttcctgctgctgtc

SEQ ID NO: 2316734 - DNA, 15 bp, Homo sapiens
tgttcgggtgtgggt

SEQ ID NO: 2316735 - DNA, 19 bp, Homo sapiens
tgttctccattttcaagct

SEQ ID NO: 2316736 - DNA, 11 bp, Homo sapiens
tgttctgtggc

SEQ ID NO: 2316737 - DNA, 15 bp, Homo sapiens
tgttctttcctgccc

SEQ ID NO: 2316738 - DNA, 16 bp, Homo sapiens
tgttctttcctgccct

SEQ ID NO: 2316739 - DNA, 24 bp, Homo sapiens
tgttgaaaggtaatttgagagaaa

SEQ ID NO: 2316740 - DNA, 17 bp, Homo sapiens
tgttgaactaatatatg

SEQ ID NO: 2316741 - DNA, 12 bp, Homo sapiens
tgttgacataca

SEQ ID NO: 2316742 - DNA, 22 bp, Homo sapiens
tgttgagttagttaagttgggt

SEQ ID NO: 2316743 - DNA, 13 bp, Homo sapiens
tgttgagttatga

SEQ ID NO: 2316744 - DNA, 16 bp, Homo sapiens
tgttgagttatgataa

SEQ ID NO: 2316745 - DNA, 22 bp, Homo sapiens
tgttgataaaccaaaaacattt

SEQ ID NO: 2316746 - DNA, 11 bp, Homo sapiens
tgttgccccag

SEQ ID NO: 2316747 - DNA, 21 bp, Homo sapiens
tgttgcccctttctcttttcc

SEQ ID NO: 2316748 - DNA, 14 bp, Homo sapiens
tgttgggaaagtat

SEQ ID NO: 2316749 - DNA, 17 bp, Homo sapiens
tgttggttcaaactttt

SEQ ID NO: 2316750 - DNA, 19 bp, Homo sapiens
tgttggtttagcgttgttt

SEQ ID NO: 2316751 - DNA, 15 bp, Homo sapiens
tgttgtaagaattct

SEQ ID NO: 2316752 - DNA, 13 bp, Homo sapiens
tgtctttcctgaa

SEQ ID NO: 2316753 - DNA, 22 bp, Homo sapiens
tgtcttttcagaagcaagccag

SEQ ID NO: 2316754 - DNA, 21 bp, Homo sapiens
tgtctttttattaaaatattt

SEQ ID NO: 2316755 - DNA, 12 bp, Homo sapiens
tgtgaaaaatta

SEQ ID NO: 2316756 - DNA, 15 bp, Homo sapiens
tgtgaaaaattaact

SEQ ID NO: 2316757 - DNA, 18 bp, Homo sapiens
tgtgaaattgcatacttt

SEQ ID NO: 2316758 - DNA, 23 bp, Homo sapiens
tgtgaacaagcttcagtaagtta

SEQ ID NO: 2316759 - DNA, 15 bp, Homo sapiens
tgtgaatggattgga

SEQ ID NO: 2316760 - DNA, 22 bp, Homo sapiens
tgtgaattttctaaaagctttc

SEQ ID NO: 2316761 - DNA, 15 bp, Homo sapiens
tgtgaatttttaagc

SEQ ID NO: 2316762 - DNA, 22 bp, Homo sapiens
tgtgacacatatgcaccttgtg

SEQ ID NO: 2316763 - DNA, 14 bp, Homo sapiens
tgtgacagagagag

SEQ ID NO: 2316764 - DNA, 16 bp, Homo sapiens
tgtgacagagccatgg

SEQ ID NO: 2316765 - DNA, 21 bp, Homo sapiens
tgtgacagtgcctcttccagt

SEQ ID NO: 2316766 - DNA, 11 bp, Homo sapiens
tgtgaccctcc

SEQ ID NO: 2316767 - DNA, 15 bp, Homo sapiens
tgtgaccctccaaat

SEQ ID NO: 2316768 - DNA, 17 bp, Homo sapiens
tgtgaccctccaaatgg

SEQ ID NO: 2316769 - DNA, 22 bp, Homo sapiens
tgtgaccctgggcaagtcactt

SEQ ID NO: 2316770 - DNA, 18 bp, Homo sapiens
tgtgagaaacatctcaat

SEQ ID NO: 2316771 - DNA, 21 bp, Homo sapiens
tgtgagattactttgtcccgc

SEQ ID NO: 2316772 - DNA, 19 bp, Homo sapiens
tgtgagccaccgtgcctgg

SEQ ID NO: 2316773 - DNA, 15 bp, Homo sapiens
tgtgagctcttccta

SEQ ID NO: 2316774 - DNA, 13 bp, Homo sapiens
tgtgagctttgaa

SEQ ID NO: 2316775 - DNA, 17 bp, Homo sapiens
tgtgagctttgaagtag

SEQ ID NO: 2316776 - DNA, 22 bp, Homo sapiens
tgtgatacattttttaagcttc

SEQ ID NO: 2316777 - DNA, 22 bp, Homo sapiens
tgtgatcttaaaataattcata

SEQ ID NO: 2316778 - DNA, 18 bp, Homo sapiens
tgtgatggacactccagg

SEQ ID NO: 2316779 - DNA, 16 bp, Homo sapiens
ttcttgaatataaaaa

SEQ ID NO: 2316780 - DNA, 19 bp, Homo sapiens
ttcttgtactctacaaaat

SEQ ID NO: 2316781 - DNA, 17 bp, Homo sapiens
ttcttgtgtcctgatga

SEQ ID NO: 2316782 - DNA, 17 bp, Homo sapiens
ttctttaaaagaatgac

SEQ ID NO: 2316783 - DNA, 19 bp, Homo sapiens
ttctttaaaagaatgacta

SEQ ID NO: 2316784 - DNA, 19 bp, Homo sapiens
ttctttaaccttgtataaa

SEQ ID NO: 2316785 - DNA, 17 bp, Homo sapiens
ttctttccattatgatt

SEQ ID NO: 2316786 - DNA, 13 bp, Homo sapiens
ttctttccctgga

SEQ ID NO: 2316787 - DNA, 21 bp, Homo sapiens
ttctttccctggacaggcagc

SEQ ID NO: 2316788 - DNA, 16 bp, Homo sapiens
ttctttcctctttctg

SEQ ID NO: 2316789 - DNA, 20 bp, Homo sapiens
ttctttcctctttctgctct

SEQ ID NO: 2316790 - DNA, 12 bp, Homo sapiens
ttctttcctgcc

SEQ ID NO: 2316791 - DNA, 14 bp, Homo sapiens
ttctttcctgccct

SEQ ID NO: 2316792 - DNA, 22 bp, Homo sapiens
ttctttgaccagatctttctct

SEQ ID NO: 2316793 - DNA, 17 bp, Homo sapiens
ttctttgagtaatgtga

SEQ ID NO: 2316794 - DNA, 22 bp, Homo sapiens
ttctttgataatgttaaatttg

SEQ ID NO: 2316795 - DNA, 14 bp, Homo sapiens
ttctttgtgcctga

SEQ ID NO: 2316796 - DNA, 14 bp, Homo sapiens
ttcttttaaagacc

SEQ ID NO: 2316797 - DNA, 14 bp, Homo sapiens
ttcttttgtttggt

SEQ ID NO: 2316798 - DNA, 13 bp, Homo sapiens
ttgaaaaatataa

SEQ ID NO: 2316799 - DNA, 19 bp, Homo sapiens
ttgaaaaatataaaattat

SEQ ID NO: 2316800 - DNA, 22 bp, Homo sapiens
ttgaaaagctattagccaggat

SEQ ID NO: 2316801 - DNA, 16 bp, Homo sapiens
ttgaaaagttggaagg

SEQ ID NO: 2316802 - DNA, 16 bp, Homo sapiens
ttgaaaattgaaaagt

SEQ ID NO: 2316803 - DNA, 13 bp, Homo sapiens
ttgaaacctcagg

SEQ ID NO: 2316804 - DNA, 13 bp, Homo sapiens
ttgaaactgtatt

SEQ ID NO: 2316805 - DNA, 21 bp, Homo sapiens
ttgaaactgtatttacttgtt

SEQ ID NO: 2316806 - DNA, 12 bp, Homo sapiens
ttgaaagtagag

SEQ ID NO: 2316807 - DNA, 15 bp, Homo sapiens
ttgaaagtagagcta

SEQ ID NO: 2316808 - DNA, 13 bp, Homo sapiens
ttgaacttttgta

SEQ ID NO: 2316809 - DNA, 14 bp, Homo sapiens
ttgaacttttgtac

SEQ ID NO: 2316810 - DNA, 20 bp, Homo sapiens
ttgaagagacagagacaagt

SEQ ID NO: 2316811 - DNA, 12 bp, Homo sapiens
ttgaaggccagc

SEQ ID NO: 2316812 - DNA, 16 bp, Homo sapiens
ttgaagggcaagaaat

SEQ ID NO: 2316813 - DNA, 23 bp, Homo sapiens
ttgaagtaggtggcttgagctag

SEQ ID NO: 2316814 - DNA, 22 bp, Homo sapiens
ttgaagttgggtgtttccagaa

SEQ ID NO: 2316815 - DNA, 23 bp, Homo sapiens
ttgaagttgggtgtttccagaat

SEQ ID NO: 2316816 - DNA, 22 bp, Homo sapiens
ttgaagtttcaagttttaaagt

SEQ ID NO: 2316817 - DNA, 18 bp, Homo sapiens
ttgaataactctttttca

SEQ ID NO: 2316818 - DNA, 13 bp, Homo sapiens
ttgaatatatgat

SEQ ID NO: 2316819 - DNA, 15 bp, Homo sapiens
ttgaatgtaaccaat

SEQ ID NO: 2316820 - DNA, 20 bp, Homo sapiens
ttgaatgtatttgatttata

SEQ ID NO: 2316821 - DNA, 21 bp, Homo sapiens
ttgaatgttttcaaaaccaag

SEQ ID NO: 2316822 - DNA, 12 bp, Homo sapiens
ttgaattatcag

SEQ ID NO: 2316823 - DNA, 22 bp, Homo sapiens
ttgaattatcttggttgaaaat

SEQ ID NO: 2316824 - DNA, 23 bp, Homo sapiens
ttgacaataagaaacagtttaac

SEQ ID NO: 2316825 - DNA, 18 bp, Homo sapiens
ttgacaccacttagattt

SEQ ID NO: 2316826 - DNA, 15 bp, Homo sapiens
ttgacactgaactta

SEQ ID NO: 2316827 - DNA, 13 bp, Homo sapiens
ttgaccctgaaat

SEQ ID NO: 2316828 - DNA, 23 bp, Homo sapiens
ttgactaactcaaatacacattt

SEQ ID NO: 2316829 - DNA, 20 bp, Homo sapiens
ttgacttttataaagcatgt

SEQ ID NO: 2316830 - DNA, 16 bp, Homo sapiens
ttgactttttgcattt

SEQ ID NO: 2316831 - DNA, 13 bp, Homo sapiens
ttgagacagtttc

SEQ ID NO: 2316832 - DNA, 22 bp, Homo sapiens
ttgagattttccattaactatt

SEQ ID NO: 2316833 - DNA, 20 bp, Homo sapiens
ttgagcatgacagcctgcag

SEQ ID NO: 2316834 - DNA, 20 bp, Homo sapiens
ttgagccgggcccctgggct

SEQ ID NO: 2316835 - DNA, 16 bp, Homo sapiens
ttgagctattcacctc

SEQ ID NO: 2316836 - DNA, 20 bp, Homo sapiens
ttgagctattcacctcagta

SEQ ID NO: 2316837 - DNA, 16 bp, Homo sapiens
ttgagctgccttccct

SEQ ID NO: 2316838 - DNA, 12 bp, Homo sapiens
ttgagctggcct

SEQ ID NO: 2316839 - DNA, 22 bp, Homo sapiens
ttgaggagaagggggtctctgt

SEQ ID NO: 2316840 - DNA, 17 bp, Homo sapiens
ttgggctcgcactgccc

SEQ ID NO: 2316841 - DNA, 13 bp, Homo sapiens
ttgggctctgatg

SEQ ID NO: 2316842 - DNA, 21 bp, Homo sapiens
ttggggccttgatgactgcct

SEQ ID NO: 2316843 - DNA, 17 bp, Homo sapiens
ttggggggtgtgctgac

SEQ ID NO: 2316844 - DNA, 21 bp, Homo sapiens
ttgggtgaatatggtggaaaa

SEQ ID NO: 2316845 - DNA, 21 bp, Homo sapiens
ttgggtggggggcattgagta

SEQ ID NO: 2316846 - DNA, 18 bp, Homo sapiens
ttggtaaaactcactgtg

SEQ ID NO: 2316847 - DNA, 17 bp, Homo sapiens
ttggtaaatgtttcttt

SEQ ID NO: 2316848 - DNA, 20 bp, Homo sapiens
ttggtaatcccctaaaataa

SEQ ID NO: 2316849 - DNA, 17 bp, Homo sapiens
ttggtcacaaagctatt

SEQ ID NO: 2316850 - DNA, 20 bp, Homo sapiens
ttggtgtaatttgaagattg

SEQ ID NO: 2316851 - DNA, 12 bp, Homo sapiens
ttggttcttccc

SEQ ID NO: 2316852 - DNA, 20 bp, Homo sapiens
ttggttgaaaataaaaagat

SEQ ID NO: 2316853 - DNA, 22 bp, Homo sapiens
ttggttgggaatgaggaaaatt

SEQ ID NO: 2316854 - DNA, 19 bp, Homo sapiens
ttggtttgctagtatcttg

SEQ ID NO: 2316855 - DNA, 21 bp, Homo sapiens
ttgtaaaaaaaaatgcctttg

SEQ ID NO: 2316856 - DNA, 23 bp, Homo sapiens
ttgtaaaaaaaaatgcctttgag

SEQ ID NO: 2316857 - DNA, 18 bp, Homo sapiens
ttgtaaaagaaatcatgt

SEQ ID NO: 2316858 - DNA, 17 bp, Homo sapiens
ttgtaaaatagaaaaag

SEQ ID NO: 2316859 - DNA, 19 bp, Homo sapiens
ttgtaaagatattgtatct

SEQ ID NO: 2316860 - DNA, 20 bp, Homo sapiens
ttgtaaagatattgtatctc

SEQ ID NO: 2316861 - DNA, 21 bp, Homo sapiens
ttgtaaccagaattatacagt

SEQ ID NO: 2316862 - DNA, 15 bp, Homo sapiens
ttgtaagaaggcaat

SEQ ID NO: 2316863 - DNA, 17 bp, Homo sapiens
ttgtaagagtgtagaag

SEQ ID NO: 2316864 - DNA, 22 bp, Homo sapiens
ttgtaagagtgtagaagcattc

SEQ ID NO: 2316865 - DNA, 19 bp, Homo sapiens
ttgtaagtgtaaaaaatgt

SEQ ID NO: 2316866 - DNA, 22 bp, Homo sapiens
ttgtaataataaaaccaaagaa

SEQ ID NO: 2316867 - DNA, 22 bp, Homo sapiens
ttgtacagaatatttctattga

SEQ ID NO: 2316868 - DNA, 23 bp, Homo sapiens
ttgtacatttatgatttaataaa

SEQ ID NO: 2316869 - DNA, 14 bp, Homo sapiens
ttgtactgaatttt

SEQ ID NO: 2316870 - DNA, 14 bp, Homo sapiens
ttgtagctggggct

SEQ ID NO: 2316871 - DNA, 15 bp, Homo sapiens
ttgtagtaaaagtgg

SEQ ID NO: 2316872 - DNA, 15 bp, Homo sapiens
ttgtataatattgaa

SEQ ID NO: 2316873 - DNA, 16 bp, Homo sapiens
ttgtataatattgaaa

SEQ ID NO: 2316874 - DNA, 13 bp, Homo sapiens
ttgtatattacaa

SEQ ID NO: 2316875 - DNA, 18 bp, Homo sapiens
ttgtattgtatattacaa

SEQ ID NO: 2316876 - DNA, 19 bp, Homo sapiens
ttgtattgtatattacaat

SEQ ID NO: 2316877 - DNA, 16 bp, Homo sapiens
ttgtatttatgtgtat

SEQ ID NO: 2316878 - DNA, 18 bp, Homo sapiens
ttgtattttgattatttt

SEQ ID NO: 2316879 - DNA, 14 bp, Homo sapiens
ttgtcaccagatct

SEQ ID NO: 2316880 - DNA, 16 bp, Homo sapiens
ttgtcctccttttcac

SEQ ID NO: 2316881 - DNA, 18 bp, Homo sapiens
ttgtcctttatgtattct

SEQ ID NO: 2316882 - DNA, 23 bp, Homo sapiens
ttgtcgaaaagagtcttccaatt

SEQ ID NO: 2316883 - DNA, 13 bp, Homo sapiens
ttgtctaaagatc

SEQ ID NO: 2316884 - DNA, 17 bp, Homo sapiens
ttgtctgtctccctccc

SEQ ID NO: 2316885 - DNA, 16 bp, Homo sapiens
ttgtcttaaaaattta

SEQ ID NO: 2316886 - DNA, 23 bp, Homo sapiens
ttgtcttaaaaatttatacacca

SEQ ID NO: 2316887 - DNA, 20 bp, Homo sapiens
ttgtcttatgtgaaaaatta

SEQ ID NO: 2316888 - DNA, 13 bp, Homo sapiens
ttgtcttttcaga

SEQ ID NO: 2316889 - DNA, 17 bp, Homo sapiens
ttgtgaaatgaaaacat

SEQ ID NO: 2316890 - DNA, 23 bp, Homo sapiens
ttgtgaaatgaaaacatgtaata

SEQ ID NO: 2316891 - DNA, 14 bp, Homo sapiens
ttgtgaatggattg

SEQ ID NO: 2316892 - DNA, 12 bp, Homo sapiens
ttgtgacagtgc

SEQ ID NO: 2316893 - DNA, 15 bp, Homo sapiens
ttgtgacagtgcctc

SEQ ID NO: 2316894 - DNA, 13 bp, Homo sapiens
ttgtgagctggat

SEQ ID NO: 2316895 - DNA, 13 bp, Homo sapiens
ttgtgatctgttg

SEQ ID NO: 2316896 - DNA, 21 bp, Homo sapiens
ttgtgcaaaatatttgactat

SEQ ID NO: 2316897 - DNA, 13 bp, Homo sapiens
ttgtgccagagga

SEQ ID NO: 2316898 - DNA, 23 bp, Homo sapiens
ttcctggctctaccctgtctgtc

SEQ ID NO: 2316899 - DNA, 22 bp, Homo sapiens
ttcctggtgaggcccagcctgt

SEQ ID NO: 2316900 - DNA, 16 bp, Homo sapiens
ttcctgtactgtgtct

SEQ ID NO: 2316901 - DNA, 13 bp, Homo sapiens
ttcctgtccctga

SEQ ID NO: 2316902 - DNA, 14 bp, Homo sapiens
ttcctgtccctgag

SEQ ID NO: 2316903 - DNA, 19 bp, Homo sapiens
ttcctgtcttatcctccac

SEQ ID NO: 2316904 - DNA, 22 bp, Homo sapiens
ttcctgtgggtgttctttcctg

SEQ ID NO: 2316905 - DNA, 14 bp, Homo sapiens
ttccttagatacct

SEQ ID NO: 2316906 - DNA, 12 bp, Homo sapiens
ttccttccgctt

SEQ ID NO: 2316907 - DNA, 12 bp, Homo sapiens
ttccttctttga

SEQ ID NO: 2316908 - DNA, 14 bp, Homo sapiens
ttccttctttgata

SEQ ID NO: 2316909 - DNA, 19 bp, Homo sapiens
ttccttctttgataatgtt

SEQ ID NO: 2316910 - DNA, 22 bp, Homo sapiens
ttccttctttgataatgttaaa

SEQ ID NO: 2316911 - DNA, 16 bp, Homo sapiens
ttcctttaaaaaaatt

SEQ ID NO: 2316912 - DNA, 13 bp, Homo sapiens
ttcctttctctcc

SEQ ID NO: 2316913 - DNA, 15 bp, Homo sapiens
ttccttttccctgct

SEQ ID NO: 2316914 - DNA, 16 bp, Homo sapiens
ttccttttccctgctt

SEQ ID NO: 2316915 - DNA, 15 bp, Homo sapiens
ttcctttttgacact

SEQ ID NO: 2316916 - DNA, 16 bp, Homo sapiens
ttcctttttgacactg

SEQ ID NO: 2316917 - DNA, 17 bp, Homo sapiens
ttcctttttgacactga

SEQ ID NO: 2316918 - DNA, 11 bp, Homo sapiens
ttcgaggcctg

SEQ ID NO: 2316919 - DNA, 13 bp, Homo sapiens
ttcgaggcctgaa

SEQ ID NO: 2316920 - DNA, 15 bp, Homo sapiens
ttcgctgaaattgct

SEQ ID NO: 2316921 - DNA, 20 bp, Homo sapiens
ttcgggccaaggacctgaga

SEQ ID NO: 2316922 - DNA, 20 bp, Homo sapiens
ttcgttgtgttttttaagat

SEQ ID NO: 2316923 - DNA, 17 bp, Homo sapiens
ttctaaaagctttcatg

SEQ ID NO: 2316924 - DNA, 13 bp, Homo sapiens
ttctaaagctcaa

SEQ ID NO: 2316925 - DNA, 23 bp, Homo sapiens
ttctaaatacatgccacatcaaa

SEQ ID NO: 2316926 - DNA, 13 bp, Homo sapiens
ttctaaatgcata

SEQ ID NO: 2316927 - DNA, 23 bp, Homo sapiens
ttctaaatgcatatcctgagcca

SEQ ID NO: 2316928 - DNA, 17 bp, Homo sapiens
ttctaagaaaatgtagt

SEQ ID NO: 2316929 - DNA, 22 bp, Homo sapiens
ttctaagaaaatgtagttagct

SEQ ID NO: 2316930 - DNA, 19 bp, Homo sapiens
ttctaatcacagtgttgca

SEQ ID NO: 2316931 - DNA, 23 bp, Homo sapiens
ttctaattccacaggtcatcaga

SEQ ID NO: 2316932 - DNA, 23 bp, Homo sapiens
ttctaattgtaagtgaaattaag

SEQ ID NO: 2316933 - DNA, 15 bp, Homo sapiens
ttctacagtggtttt

SEQ ID NO: 2316934 - DNA, 14 bp, Homo sapiens
ttctacggatcatc

SEQ ID NO: 2316935 - DNA, 19 bp, Homo sapiens
ttctactcacttttcccac

SEQ ID NO: 2316936 - DNA, 12 bp, Homo sapiens
ttctagaccaat

SEQ ID NO: 2316937 - DNA, 16 bp, Homo sapiens
ttctaggaaaataaaa

SEQ ID NO: 2316938 - DNA, 17 bp, Homo sapiens
ttctaggtaggaagagc

SEQ ID NO: 2316939 - DNA, 17 bp, Homo sapiens
ttctagtggtctttgta

SEQ ID NO: 2316940 - DNA, 19 bp, Homo sapiens
ttctagtggtctttgtaag

SEQ ID NO: 2316941 - DNA, 21 bp, Homo sapiens
ttctagtgtccataaataaag

SEQ ID NO: 2316942 - DNA, 16 bp, Homo sapiens
ttctatgacaaattca

SEQ ID NO: 2316943 - DNA, 19 bp, Homo sapiens
ttctatgacaaattcaaga

SEQ ID NO: 2316944 - DNA, 15 bp, Homo sapiens
ttctattatggaaaa

SEQ ID NO: 2316945 - DNA, 16 bp, Homo sapiens
ttctatttggggcttg

SEQ ID NO: 2316946 - DNA, 17 bp, Homo sapiens
ttctcaaagttttgaaa

SEQ ID NO: 2316947 - DNA, 20 bp, Homo sapiens
ttctcaagacctgagtattt

SEQ ID NO: 2316948 - DNA, 22 bp, Homo sapiens
ttctcagaaatgtcatgattgc

SEQ ID NO: 2316949 - DNA, 21 bp, Homo sapiens
ttctcagaagcacagaatatt

SEQ ID NO: 2316950 - DNA, 16 bp, Homo sapiens
ttctcagatttctgag

SEQ ID NO: 2316951 - DNA, 15 bp, Homo sapiens
ttctcagttttcata

SEQ ID NO: 2316952 - DNA, 13 bp, Homo sapiens
ttctcatgaagca

SEQ ID NO: 2316953 - DNA, 16 bp, Homo sapiens
ttctcattcccatgtg

SEQ ID NO: 2316954 - DNA, 19 bp, Homo sapiens
ttctcccaggtaccagctg

SEQ ID NO: 2316955 - DNA, 23 bp, Homo sapiens
ttctcgtttttatagtcaatggc

SEQ ID NO: 2316956 - DNA, 15 bp, Homo sapiens
ttctctattaaaatg

SEQ ID NO: 2316957 - DNA, 18 bp, Homo sapiens
ttctctattttcataatc

SEQ ID NO: 2316958 - DNA, 14 bp, Homo sapiens
ttctctcctcccca

SEQ ID NO: 2316959 - DNA, 15 bp, Homo sapiens
ttctctcctccccaa

SEQ ID NO: 2316960 - DNA, 17 bp, Homo sapiens
ttctctcctccccaaat

SEQ ID NO: 2316961 - DNA, 12 bp, Homo sapiens
ttctctcctggc

SEQ ID NO: 2316962 - DNA, 23 bp, Homo sapiens
ttctctctcaggccaccacagag

SEQ ID NO: 2316963 - DNA, 11 bp, Homo sapiens
ttctctgcaga

SEQ ID NO: 2316964 - DNA, 21 bp, Homo sapiens
ttctctgtaagtgtagctcaa

SEQ ID NO: 2316965 - DNA, 18 bp, Homo sapiens
ttctcttagcaactcaga

SEQ ID NO: 2316966 - DNA, 14 bp, Homo sapiens
taatcatacaaact

SEQ ID NO: 2316967 - DNA, 22 bp, Homo sapiens
taatcatacaaactctcaccat

SEQ ID NO: 2316968 - DNA, 22 bp, Homo sapiens
taatcatcaagagaatttgggg

SEQ ID NO: 2316969 - DNA, 13 bp, Homo sapiens
taatcattacctt

SEQ ID NO: 2316970 - DNA, 21 bp, Homo sapiens
taatcccagcactttgggagg

SEQ ID NO: 2316971 - DNA, 19 bp, Homo sapiens
taatcccctaaaataacag

SEQ ID NO: 2316972 - DNA, 21 bp, Homo sapiens
taatctcaaagagattcgaat

SEQ ID NO: 2316973 - DNA, 16 bp, Homo sapiens
taatcttcaaagcctt

SEQ ID NO: 2316974 - DNA, 16 bp, Homo sapiens
taatgaaaataaaaca

SEQ ID NO: 2316975 - DNA, 15 bp, Homo sapiens
taatgaaatggagga

SEQ ID NO: 2316976 - DNA, 16 bp, Homo sapiens
taatgacaagtgactt

SEQ ID NO: 2316977 - DNA, 19 bp, Homo sapiens
taatgagatgtgagccttg

SEQ ID NO: 2316978 - DNA, 15 bp, Homo sapiens
ttcatagctgtactt

SEQ ID NO: 2316979 - DNA, 15 bp, Homo sapiens
ttcatcatccagatg

SEQ ID NO: 2316980 - DNA, 14 bp, Homo sapiens
ttcatctctttaga

SEQ ID NO: 2316981 - DNA, 17 bp, Homo sapiens
ttcatctctttagagaa

SEQ ID NO: 2316982 - DNA, 20 bp, Homo sapiens
ttcatcttcctgtgtcctga

SEQ ID NO: 2316983 - DNA, 19 bp, Homo sapiens
ttcatgacataataaagta

SEQ ID NO: 2316984 - DNA, 22 bp, Homo sapiens
ttcatgattatagcaactaatg

SEQ ID NO: 2316985 - DNA, 18 bp, Homo sapiens
ttcatggctgctgttgct

SEQ ID NO: 2316986 - DNA, 15 bp, Homo sapiens
ttcatgtacagaggt

SEQ ID NO: 2316987 - DNA, 23 bp, Homo sapiens
ttcattaattagttccagtttct

SEQ ID NO: 2316988 - DNA, 14 bp, Homo sapiens
ttcattattcaaga

SEQ ID NO: 2316989 - DNA, 13 bp, Homo sapiens
ttcattctggaaa

SEQ ID NO: 2316990 - DNA, 15 bp, Homo sapiens
ttcatttcatttcag

SEQ ID NO: 2316991 - DNA, 17 bp, Homo sapiens
ttcatttgtatgtcaaa

SEQ ID NO: 2316992 - DNA, 20 bp, Homo sapiens
ttccaaactcttccctctct

SEQ ID NO: 2316993 - DNA, 23 bp, Homo sapiens
ttccaaagcctagacaacctttc

SEQ ID NO: 2316994 - DNA, 16 bp, Homo sapiens
ttccaaataaataatt

SEQ ID NO: 2316995 - DNA, 13 bp, Homo sapiens
ttccaaatgaact

SEQ ID NO: 2316996 - DNA, 15 bp, Homo sapiens
ttccaaatgtccctc

SEQ ID NO: 2316997 - DNA, 23 bp, Homo sapiens
ttccaaattgccctatgctgtgc

SEQ ID NO: 2316998 - DNA, 15 bp, Homo sapiens
ttccaagtctccacc

SEQ ID NO: 2316999 - DNA, 16 bp, Homo sapiens
ttccacacgcattaat

SEQ ID NO: 2317000 - DNA, 19 bp, Homo sapiens
ttccaccccaagagaactc

SEQ ID NO: 2317001 - DNA, 20 bp, Homo sapiens
ttccaccccaagagaactcg

SEQ ID NO: 2317002 - DNA, 16 bp, Homo sapiens
ttccactacacctggc

SEQ ID NO: 2317003 - DNA, 19 bp, Homo sapiens
ttccactacacctggctga

SEQ ID NO: 2317004 - DNA, 22 bp, Homo sapiens
ttccactacacctggctgaggt

SEQ ID NO: 2317005 - DNA, 19 bp, Homo sapiens
ttccactcgtgtgtttcta

SEQ ID NO: 2317006 - DNA, 16 bp, Homo sapiens
ttccagatctttcaga

SEQ ID NO: 2317007 - DNA, 20 bp, Homo sapiens
ttccagatctttcagaaata

SEQ ID NO: 2317008 - DNA, 14 bp, Homo sapiens
ttccagatgtggat

SEQ ID NO: 2317009 - DNA, 24 bp, Homo sapiens
ttccaggaaactccacatctgcct

SEQ ID NO: 2317010 - DNA, 14 bp, Homo sapiens
ttccaggcttctgc

SEQ ID NO: 2317011 - DNA, 16 bp, Homo sapiens
ttccaggcttctgctg

SEQ ID NO: 2317012 - DNA, 18 bp, Homo sapiens
ttccaggcttctgctggg

SEQ ID NO: 2317013 - DNA, 19 bp, Homo sapiens
ttccagggatttgcctcac

SEQ ID NO: 2317014 - DNA, 16 bp, Homo sapiens
ttccagtacagtattc

SEQ ID NO: 2317015 - DNA, 17 bp, Homo sapiens
ttccagtacagtattct

SEQ ID NO: 2317016 - DNA, 17 bp, Homo sapiens
ttccagtcttcctgaca

SEQ ID NO: 2317017 - DNA, 14 bp, Homo sapiens
ttccatacttctct

SEQ ID NO: 2317018 - DNA, 20 bp, Homo sapiens
ttccatgtcccctcccagag

SEQ ID NO: 2317019 - DNA, 23 bp, Homo sapiens
ttccattaactatttttttcaaa

SEQ ID NO: 2317020 - DNA, 15 bp, Homo sapiens
ttccattatgattct

SEQ ID NO: 2317021 - DNA, 16 bp, Homo sapiens
ttccattatgattctt

SEQ ID NO: 2317022 - DNA, 22 bp, Homo sapiens
ttcccaccccaacctgctctcc

SEQ ID NO: 2317023 - DNA, 21 bp, Homo sapiens
ttcccactccaagcccagccc

SEQ ID NO: 2317024 - DNA, 15 bp, Homo sapiens
ttcccactgtttaag

SEQ ID NO: 2317025 - DNA, 13 bp, Homo sapiens
ttcccagcccagc

SEQ ID NO: 2317026 - DNA, 12 bp, Homo sapiens
ttcccatctgca

SEQ ID NO: 2317027 - DNA, 13 bp, Homo sapiens
ttcccattaaaaa

SEQ ID NO: 2317028 - DNA, 19 bp, Homo sapiens
ttcccatttccttgtctaa

SEQ ID NO: 2317029 - DNA, 16 bp, Homo sapiens
ttccccaaaccataaa

SEQ ID NO: 2317030 - DNA, 12 bp, Homo sapiens
ttcccccaccac

SEQ ID NO: 2317031 - DNA, 11 bp, Homo sapiens
ttcccctgtgt

SEQ ID NO: 2317032 - DNA, 15 bp, Homo sapiens
ttcccctgtgtcatc

SEQ ID NO: 2317033 - DNA, 17 bp, Homo sapiens
ttctggacctctgggtt

SEQ ID NO: 2317034 - DNA, 18 bp, Homo sapiens
ttctggacctctgggttg

SEQ ID NO: 2317035 - DNA, 17 bp, Homo sapiens
ttctggccttgtaagac

SEQ ID NO: 2317036 - DNA, 20 bp, Homo sapiens
ttctggctgtgatcttaaaa

SEQ ID NO: 2317037 - DNA, 15 bp, Homo sapiens
ttctgggatgtcaca

SEQ ID NO: 2317038 - DNA, 19 bp, Homo sapiens
ttctgggatgtcacagtcc

SEQ ID NO: 2317039 - DNA, 16 bp, Homo sapiens
ttctgggcttcatctg

SEQ ID NO: 2317040 - DNA, 17 bp, Homo sapiens
ttctggggcaggctggg

SEQ ID NO: 2317041 - DNA, 18 bp, Homo sapiens
ttctggggcaggctgggc

SEQ ID NO: 2317042 - DNA, 17 bp, Homo sapiens
ttctggtactttctgtt

SEQ ID NO: 2317043 - DNA, 22 bp, Homo sapiens
ttctggtttaaacttgtttgct

SEQ ID NO: 2317044 - DNA, 23 bp, Homo sapiens
ttctgtaactattgggtgaatat

SEQ ID NO: 2317045 - DNA, 16 bp, Homo sapiens
ttctgtggttcctctg

SEQ ID NO: 2317046 - DNA, 21 bp, Homo sapiens
ttctgtggttcctctgctcac

SEQ ID NO: 2317047 - DNA, 19 bp, Homo sapiens
ttcttagctttttaattgt

SEQ ID NO: 2317048 - DNA, 20 bp, Homo sapiens
ttcttagctttttaattgtt

SEQ ID NO: 2317049 - DNA, 18 bp, Homo sapiens
ttcttaggggaaggagaa

SEQ ID NO: 2317050 - DNA, 14 bp, Homo sapiens
ttcttatgaggagg

SEQ ID NO: 2317051 - DNA, 16 bp, Homo sapiens
ttcttatgtgacatta

SEQ ID NO: 2317052 - DNA, 17 bp, Homo sapiens
ttcttatttcatttatt

SEQ ID NO: 2317053 - DNA, 14 bp, Homo sapiens
ttcttatttttgtc

SEQ ID NO: 2317054 - DNA, 18 bp, Homo sapiens
ttcttcacacagacacta

SEQ ID NO: 2317055 - DNA, 20 bp, Homo sapiens
ttcttctattaatcaagaga

SEQ ID NO: 2317056 - DNA, 23 bp, Homo sapiens
ttcttctgaactcaaactgagga

SEQ ID NO: 2317057 - DNA, 14 bp, Homo sapiens
ttcttctttccctg

SEQ ID NO: 2317058 - DNA, 13 bp, Homo sapiens
ttcttctttctag

SEQ ID NO: 2317059 - DNA, 14 bp, Homo sapiens
ttcttctttctaga

SEQ ID NO: 2317060 - DNA, 19 bp, Homo sapiens
ttcttgctgccatgatgta

SEQ ID NO: 2317061 - DNA, 22 bp, Homo sapiens
ttcttgtgccatagtcacatgg

SEQ ID NO: 2317062 - DNA, 20 bp, Homo sapiens
ttctttaaagttcttctaag

SEQ ID NO: 2317063 - DNA, 16 bp, Homo sapiens
ttctttaaccttgtat

SEQ ID NO: 2317064 - DNA, 14 bp, Homo sapiens
ttctttagagatta

SEQ ID NO: 2317065 - DNA, 14 bp, Homo sapiens
ttctttccattatg

SEQ ID NO: 2317066 - DNA, 21 bp, Homo sapiens
ttctttcctctttctgctctg

SEQ ID NO: 2317067 - DNA, 21 bp, Homo sapiens
ttctttctagtggtctttgta

SEQ ID NO: 2317068 - DNA, 16 bp, Homo sapiens
ttctttgataatgtta

SEQ ID NO: 2317069 - DNA, 18 bp, Homo sapiens
ttctttgataatgttaaa

SEQ ID NO: 2317070 - DNA, 20 bp, Homo sapiens
ttctttggagttaaaatgca

SEQ ID NO: 2317071 - DNA, 22 bp, Homo sapiens
ttcttttaatgatgccatggca

SEQ ID NO: 2317072 - DNA, 13 bp, Homo sapiens
ttcttttctaact

SEQ ID NO: 2317073 - DNA, 15 bp, Homo sapiens
ttcttttctaacttt

SEQ ID NO: 2317074 - DNA, 15 bp, Homo sapiens
ttcttttgtttggta

SEQ ID NO: 2317075 - DNA, 22 bp, Homo sapiens
ttcttttttaaatgtttcttgg

SEQ ID NO: 2317076 - DNA, 20 bp, Homo sapiens
ttctttttttttaagttctt

SEQ ID NO: 2317077 - DNA, 20 bp, Homo sapiens
ttgaaaaatataaaattatg

SEQ ID NO: 2317078 - DNA, 18 bp, Homo sapiens
ttgaaaaatctcattatt

SEQ ID NO: 2317079 - DNA, 15 bp, Homo sapiens
ttgaaaagcagacat

SEQ ID NO: 2317080 - DNA, 13 bp, Homo sapiens
ttgaaaagctatt

SEQ ID NO: 2317081 - DNA, 22 bp, Homo sapiens
ttgaaaataacctaattaatat

SEQ ID NO: 2317082 - DNA, 12 bp, Homo sapiens
ttgaaacaaagt

SEQ ID NO: 2317083 - DNA, 14 bp, Homo sapiens
ttgaaactgtattt

SEQ ID NO: 2317084 - DNA, 19 bp, Homo sapiens
ttgaaagccaacaactctg

SEQ ID NO: 2317085 - DNA, 22 bp, Homo sapiens
ttgaaagccaacaactctgcct

SEQ ID NO: 2317086 - DNA, 16 bp, Homo sapiens
ttgaaatgttctgtca

SEQ ID NO: 2317087 - DNA, 14 bp, Homo sapiens
ttgaaattctattt

SEQ ID NO: 2317088 - DNA, 18 bp, Homo sapiens
ttgaactggaataatatt

SEQ ID NO: 2317089 - DNA, 23 bp, Homo sapiens
ttgaacttttgtactgaattttt

SEQ ID NO: 2317090 - DNA, 11 bp, Homo sapiens
ttgaagccaaa

SEQ ID NO: 2317091 - DNA, 11 bp, Homo sapiens
ttgaaggccag

SEQ ID NO: 2317092 - DNA, 19 bp, Homo sapiens
ttgaagggcaagaaatggc

SEQ ID NO: 2317093 - DNA, 14 bp, Homo sapiens
ttgaataaattatg

SEQ ID NO: 2317094 - DNA, 20 bp, Homo sapiens
ttgaattatcagcaaagaaa

SEQ ID NO: 2317095 - DNA, 18 bp, Homo sapiens
ttgacaataagaaacagt

SEQ ID NO: 2317096 - DNA, 22 bp, Homo sapiens
tgaaaatgtgctatactgcata

SEQ ID NO: 2317097 - DNA, 15 bp, Homo sapiens
tgaaaattaaatttt

SEQ ID NO: 2317098 - DNA, 16 bp, Homo sapiens
tgaaaattgaaaagta

SEQ ID NO: 2317099 - DNA, 13 bp, Homo sapiens
tgaaaattgtatt

SEQ ID NO: 2317100 - DNA, 18 bp, Homo sapiens
tgaaacaaagtactcttt

SEQ ID NO: 2317101 - DNA, 13 bp, Homo sapiens
tgaaacagcctgg

SEQ ID NO: 2317102 - DNA, 22 bp, Homo sapiens
tgaaacagttgctgtgaacttt

SEQ ID NO: 2317103 - DNA, 21 bp, Homo sapiens
tgaaacctcagggctgtccca

SEQ ID NO: 2317104 - DNA, 22 bp, Homo sapiens
tgaaacctcagggctgtcccag

SEQ ID NO: 2317105 - DNA, 20 bp, Homo sapiens
tgaaaccttttttaagattt

SEQ ID NO: 2317106 - DNA, 21 bp, Homo sapiens
tgaaaccttttttaagatttt

SEQ ID NO: 2317107 - DNA, 23 bp, Homo sapiens
tgaaaccttttttaagatttttc

SEQ ID NO: 2317108 - DNA, 20 bp, Homo sapiens
tgaaacgctcctttgtgtgt

SEQ ID NO: 2317109 - DNA, 13 bp, Homo sapiens
tgaaactgtattt

SEQ ID NO: 2317110 - DNA, 15 bp, Homo sapiens
tgaaactgtatttac

SEQ ID NO: 2317111 - DNA, 17 bp, Homo sapiens
tgaaactgtatttactt

SEQ ID NO: 2317112 - DNA, 21 bp, Homo sapiens
tgaaactgtatttacttgtta

SEQ ID NO: 2317113 - DNA, 19 bp, Homo sapiens
tgaaactttgggaaaacat

SEQ ID NO: 2317114 - DNA, 13 bp, Homo sapiens
tgaaagaaaattg

SEQ ID NO: 2317115 - DNA, 23 bp, Homo sapiens
tgccagccttgagccctggctgt

SEQ ID NO: 2317116 - DNA, 18 bp, Homo sapiens
tgccagctggcctttgta

SEQ ID NO: 2317117 - DNA, 19 bp, Homo sapiens
tgccagctggcctttgtaa

SEQ ID NO: 2317118 - DNA, 23 bp, Homo sapiens
tgccaggacatgcaataaaattt

SEQ ID NO: 2317119 - DNA, 20 bp, Homo sapiens
tgccaggcacacacagcccc

SEQ ID NO: 2317120 - DNA, 16 bp, Homo sapiens
tgccaggcaggggtgg

SEQ ID NO: 2317121 - DNA, 18 bp, Homo sapiens
tgccaggccagcctccga

SEQ ID NO: 2317122 - DNA, 21 bp, Homo sapiens
tgccaggctgtaagcattctg

SEQ ID NO: 2317123 - DNA, 13 bp, Homo sapiens
tgccagggcaggg

SEQ ID NO: 2317124 - DNA, 14 bp, Homo sapiens
tgccagggcagggt

SEQ ID NO: 2317125 - DNA, 17 bp, Homo sapiens
tgccagggcagggtctg

SEQ ID NO: 2317126 - DNA, 16 bp, Homo sapiens
tgccaggggcttgaga

SEQ ID NO: 2317127 - DNA, 17 bp, Homo sapiens
tgccagttacttgcttt

SEQ ID NO: 2317128 - DNA, 14 bp, Homo sapiens
tgccagttgggctc

SEQ ID NO: 2317129 - DNA, 19 bp, Homo sapiens
tgccataaatatttctcaa

SEQ ID NO: 2317130 - DNA, 17 bp, Homo sapiens
tgccatagtcttaactg

SEQ ID NO: 2317131 - DNA, 16 bp, Homo sapiens
tgccatctatctagtt

SEQ ID NO: 2317132 - DNA, 22 bp, Homo sapiens
tgccatggctaggtagaagtga

SEQ ID NO: 2317133 - DNA, 15 bp, Homo sapiens
tgccatgggcctgct

SEQ ID NO: 2317134 - DNA, 16 bp, Homo sapiens
tgccatgggcctgctg

SEQ ID NO: 2317135 - DNA, 19 bp, Homo sapiens
tgccatgggcttcactgta

SEQ ID NO: 2317136 - DNA, 21 bp, Homo sapiens
tgccatgttgcccctttctct

SEQ ID NO: 2317137 - DNA, 22 bp, Homo sapiens
tgccattacagaggtattaaaa

SEQ ID NO: 2317138 - DNA, 16 bp, Homo sapiens
tgccattcacttcata

SEQ ID NO: 2317139 - DNA, 20 bp, Homo sapiens
tgccattccaaaatattatg

SEQ ID NO: 2317140 - DNA, 17 bp, Homo sapiens
tgccattttttgtctgt

SEQ ID NO: 2317141 - DNA, 20 bp, Homo sapiens
tgccattttttgtctgtgat

SEQ ID NO: 2317142 - DNA, 15 bp, Homo sapiens
tgcccaatgaataat

SEQ ID NO: 2317143 - DNA, 18 bp, Homo sapiens
tgcccaccccctgccctg

SEQ ID NO: 2317144 - DNA, 19 bp, Homo sapiens
tgcccaccccctgccctgc

SEQ ID NO: 2317145 - DNA, 12 bp, Homo sapiens
tgcccactgttt

SEQ ID NO: 2317146 - DNA, 13 bp, Homo sapiens
tgcccagctctct

SEQ ID NO: 2317147 - DNA, 14 bp, Homo sapiens
tgcccagctctctg

SEQ ID NO: 2317148 - DNA, 18 bp, Homo sapiens
tgcccagctctctgacgc

SEQ ID NO: 2317149 - DNA, 12 bp, Homo sapiens
tgccccaccttg

SEQ ID NO: 2317150 - DNA, 14 bp, Homo sapiens
tgccccagcactca

SEQ ID NO: 2317151 - DNA, 20 bp, Homo sapiens
tgccccagggagtccagggt

SEQ ID NO: 2317152 - DNA, 17 bp, Homo sapiens
tgccccccacccctgga

SEQ ID NO: 2317153 - DNA, 15 bp, Homo sapiens
tgccccccgccctca

SEQ ID NO: 2317154 - DNA, 17 bp, Homo sapiens
tgccccctcccaccctg

SEQ ID NO: 2317155 - DNA, 18 bp, Homo sapiens
tgccccgcctgagtcagt

SEQ ID NO: 2317156 - DNA, 21 bp, Homo sapiens
tgcccctaatctctgtaggaa

SEQ ID NO: 2317157 - DNA, 14 bp, Homo sapiens
tgcccctctcacca

SEQ ID NO: 2317158 - DNA, 15 bp, Homo sapiens
tgcccctctcaccaa

SEQ ID NO: 2317159 - DNA, 14 bp, Homo sapiens
tgccccttcactca

SEQ ID NO: 2317160 - DNA, 12 bp, Homo sapiens
tgccccttccac

SEQ ID NO: 2317161 - DNA, 20 bp, Homo sapiens
tgcccgaaactaagccaggc

SEQ ID NO: 2317162 - DNA, 19 bp, Homo sapiens
tgcccgtgtagtccccaac

SEQ ID NO: 2317163 - DNA, 15 bp, Homo sapiens
tgccctatgggcctg

SEQ ID NO: 2317164 - DNA, 18 bp, Homo sapiens
tgccctcactccctctgc

SEQ ID NO: 2317165 - DNA, 19 bp, Homo sapiens
tgccctcactccctctgca

SEQ ID NO: 2317166 - DNA, 14 bp, Homo sapiens
tgccctcctcactc

SEQ ID NO: 2317167 - DNA, 13 bp, Homo sapiens
tgccctctcccac

SEQ ID NO: 2317168 - DNA, 12 bp, Homo sapiens
tgccctggctgc

SEQ ID NO: 2317169 - DNA, 15 bp, Homo sapiens
tgccctggctgctgc

SEQ ID NO: 2317170 - DNA, 17 bp, Homo sapiens
tgccctggctgctgccc

SEQ ID NO: 2317171 - DNA, 20 bp, Homo sapiens
tgccctggctgctgccccca

SEQ ID NO: 2317172 - DNA, 13 bp, Homo sapiens
tgccctgtgtact

SEQ ID NO: 2317173 - DNA, 15 bp, Homo sapiens
tgcccttccctctgg

SEQ ID NO: 2317174 - DNA, 13 bp, Homo sapiens
tgccgagagaggc

SEQ ID NO: 2317175 - DNA, 16 bp, Homo sapiens
tgccgagagaggcgcg

SEQ ID NO: 2317176 - DNA, 17 bp, Homo sapiens
tgccgccccctcctgaa

SEQ ID NO: 2317177 - DNA, 22 bp, Homo sapiens
tgccgggctgagggcctgctgg

SEQ ID NO: 2317178 - DNA, 23 bp, Homo sapiens
tgccgggctgagggcctgctgga

SEQ ID NO: 2317179 - DNA, 23 bp, Homo sapiens
tgcctaattcctggcatgacact

SEQ ID NO: 2317180 - DNA, 22 bp, Homo sapiens
tgcctacatcccgggcctcagt

SEQ ID NO: 2317181 - DNA, 23 bp, Homo sapiens
tgcctacatcccgggcctcagtg

SEQ ID NO: 2317182 - DNA, 14 bp, Homo sapiens
tgcctatttgtgtg

SEQ ID NO: 2317183 - DNA, 21 bp, Homo sapiens
tgcctcagacgttgcctgaga

SEQ ID NO: 2317184 - DNA, 12 bp, Homo sapiens
tgcctcagtttt

SEQ ID NO: 2317185 - DNA, 19 bp, Homo sapiens
tgcctcagttttccttctg

SEQ ID NO: 2317186 - DNA, 23 bp, Homo sapiens
tgcctcccaggcaagcagctggt

SEQ ID NO: 2317187 - DNA, 17 bp, Homo sapiens
tgcctccccatttccca

SEQ ID NO: 2317188 - DNA, 22 bp, Homo sapiens
tgcctccccatttcccatctgc

SEQ ID NO: 2317189 - DNA, 14 bp, Homo sapiens
tgcctcgcatccta

SEQ ID NO: 2317190 - DNA, 19 bp, Homo sapiens
tgcctcgcatcctatgctt

SEQ ID NO: 2317191 - DNA, 21 bp, Homo sapiens
tgcctctcatcaactgaatga

SEQ ID NO: 2317192 - DNA, 16 bp, Homo sapiens
tgcctctcccaggctg

SEQ ID NO: 2317193 - DNA, 21 bp, Homo sapiens
tgcctctctggaaagaggctc

SEQ ID NO: 2317194 - DNA, 12 bp, Homo sapiens
tgcctcttccag

SEQ ID NO: 2317195 - DNA, 21 bp, Homo sapiens
tgcctcttccagtcttcctga

SEQ ID NO: 2317196 - DNA, 13 bp, Homo sapiens
tgcctgagaggca

SEQ ID NO: 2317197 - DNA, 17 bp, Homo sapiens
tgcctgagaggcaggca

SEQ ID NO: 2317198 - DNA, 19 bp, Homo sapiens
tgcctgagaggcaggcata

SEQ ID NO: 2317199 - DNA, 17 bp, Homo sapiens
tgcctgccccgccccca

SEQ ID NO: 2317200 - DNA, 21 bp, Homo sapiens
tgcctgcccctaccctggact

SEQ ID NO: 2317201 - DNA, 13 bp, Homo sapiens
tggcctatgcaca

SEQ ID NO: 2317202 - DNA, 14 bp, Homo sapiens
tggcctatgcacat

SEQ ID NO: 2317203 - DNA, 13 bp, Homo sapiens
tggcctcccaaag

SEQ ID NO: 2317204 - DNA, 20 bp, Homo sapiens
tggcctcccaaagtgctgag

SEQ ID NO: 2317205 - DNA, 17 bp, Homo sapiens
tggcctccgcagtgtct

SEQ ID NO: 2317206 - DNA, 17 bp, Homo sapiens
tggcctgcaaactggga

SEQ ID NO: 2317207 - DNA, 18 bp, Homo sapiens
tggcctgcaaactgggaa

SEQ ID NO: 2317208 - DNA, 18 bp, Homo sapiens
tggcctggcacacatcag

SEQ ID NO: 2317209 - DNA, 12 bp, Homo sapiens
tggcctgtggct

SEQ ID NO: 2317210 - DNA, 16 bp, Homo sapiens
tggcctgtggctgtcg

SEQ ID NO: 2317211 - DNA, 22 bp, Homo sapiens
tggccttctcctacttagggaa

SEQ ID NO: 2317212 - DNA, 11 bp, Homo sapiens
tggcctttcct

SEQ ID NO: 2317213 - DNA, 16 bp, Homo sapiens
tggcctttccttccct

SEQ ID NO: 2317214 - DNA, 17 bp, Homo sapiens
tggcctttgtaagtgca

SEQ ID NO: 2317215 - DNA, 14 bp, Homo sapiens
tggcctttgtgctg

SEQ ID NO: 2317216 - DNA, 16 bp, Homo sapiens
tggcctttgtgctgcg

SEQ ID NO: 2317217 - DNA, 24 bp, Homo sapiens
tggcctttgtgctgcgcctgcagg

SEQ ID NO: 2317218 - DNA, 14 bp, Homo sapiens
tggcgcaggtgggc

SEQ ID NO: 2317219 - DNA, 21 bp, Homo sapiens
tggcgcaggtgggctggactt

SEQ ID NO: 2317220 - DNA, 14 bp, Homo sapiens
tggcgtctgctctg

SEQ ID NO: 2317221 - DNA, 18 bp, Homo sapiens
tggcgtgggagccagcct

SEQ ID NO: 2317222 - DNA, 16 bp, Homo sapiens
tggctaatttaacacc

SEQ ID NO: 2317223 - DNA, 18 bp, Homo sapiens
tggctacgcctcttctgt

SEQ ID NO: 2317224 - DNA, 23 bp, Homo sapiens
tggctacgcctcttctgtccctg

SEQ ID NO: 2317225 - DNA, 13 bp, Homo sapiens
tggctatcctgat

SEQ ID NO: 2317226 - DNA, 14 bp, Homo sapiens
tggctatcctgatt

SEQ ID NO: 2317227 - DNA, 14 bp, Homo sapiens
tggctccaggccaa

SEQ ID NO: 2317228 - DNA, 19 bp, Homo sapiens
tggctcccgcggtgccatg

SEQ ID NO: 2317229 - DNA, 15 bp, Homo sapiens
tggctccctcctcca

SEQ ID NO: 2317230 - DNA, 21 bp, Homo sapiens
tggctccctcctccaggcctg

SEQ ID NO: 2317231 - DNA, 21 bp, Homo sapiens
tggctctaccttcctgtccct

SEQ ID NO: 2317232 - DNA, 13 bp, Homo sapiens
tggctgagacctg

SEQ ID NO: 2317233 - DNA, 20 bp, Homo sapiens
tggctgagacctgggatttg

SEQ ID NO: 2317234 - DNA, 21 bp, Homo sapiens
tggctgagacctgggatttga

SEQ ID NO: 2317235 - DNA, 16 bp, Homo sapiens
tggctgccacacccag

SEQ ID NO: 2317236 - DNA, 18 bp, Homo sapiens
tggctgccacacccaggg

SEQ ID NO: 2317237 - DNA, 19 bp, Homo sapiens
tggctgccacacccagggg

SEQ ID NO: 2317238 - DNA, 15 bp, Homo sapiens
tggctgctgccccca

SEQ ID NO: 2317239 - DNA, 16 bp, Homo sapiens
tggctgctgcccccac

SEQ ID NO: 2317240 - DNA, 17 bp, Homo sapiens
tggctggaggagcagca

SEQ ID NO: 2317241 - DNA, 11 bp, Homo sapiens
tggctggctct

SEQ ID NO: 2317242 - DNA, 20 bp, Homo sapiens
tggctgggaagactatggtg

SEQ ID NO: 2317243 - DNA, 23 bp, Homo sapiens
tggctggtagaaaaaggggcctg

SEQ ID NO: 2317244 - DNA, 16 bp, Homo sapiens
tggctgtgatcttaaa

SEQ ID NO: 2317245 - DNA, 19 bp, Homo sapiens
tggctgtggcatttccaaa

SEQ ID NO: 2317246 - DNA, 23 bp, Homo sapiens
tggctgtggttcctaagcctgtt

SEQ ID NO: 2317247 - DNA, 20 bp, Homo sapiens
tggctgttgacgcacctgtg

SEQ ID NO: 2317248 - DNA, 20 bp, Homo sapiens
tggcttaagtgagcagaaca

SEQ ID NO: 2317249 - DNA, 22 bp, Homo sapiens
tggcttaagtgagcagaacagg

SEQ ID NO: 2317250 - DNA, 17 bp, Homo sapiens
tggcttctgtgatgagc

SEQ ID NO: 2317251 - DNA, 21 bp, Homo sapiens
tggcttgagctagagataaaa

SEQ ID NO: 2317252 - DNA, 14 bp, Homo sapiens
tggcttgggcattg

SEQ ID NO: 2317253 - DNA, 13 bp, Homo sapiens
tggcttgtctata

SEQ ID NO: 2317254 - DNA, 22 bp, Homo sapiens
tggcttgttcatcatccagatg

SEQ ID NO: 2317255 - DNA, 16 bp, Homo sapiens
tggctttatgcacatt

SEQ ID NO: 2317256 - DNA, 18 bp, Homo sapiens
tggctttgaaacctcagg

SEQ ID NO: 2317257 - DNA, 14 bp, Homo sapiens
tgggaagaagcaag

SEQ ID NO: 2317258 - DNA, 20 bp, Homo sapiens
tgggaagactcctagctgtc

SEQ ID NO: 2317259 - DNA, 22 bp, Homo sapiens
tgggaagactcctagctgtcct

SEQ ID NO: 2317260 - DNA, 23 bp, Homo sapiens
tgggaagactcctagctgtcctt

SEQ ID NO: 2317261 - DNA, 21 bp, Homo sapiens
tgggaagccatattcacacct

SEQ ID NO: 2317262 - DNA, 13 bp, Homo sapiens
tgggaagtcctgg

SEQ ID NO: 2317263 - DNA, 15 bp, Homo sapiens
tgggacaactgctcc

SEQ ID NO: 2317264 - DNA, 16 bp, Homo sapiens
tgggacacagacccag

SEQ ID NO: 2317265 - DNA, 18 bp, Homo sapiens
tgggacacagacccagga

SEQ ID NO: 2317266 - DNA, 21 bp, Homo sapiens
tgggacagtggtgacatagtc

SEQ ID NO: 2317267 - DNA, 20 bp, Homo sapiens
tgggacctgccaggcagggg

SEQ ID NO: 2317268 - DNA, 11 bp, Homo sapiens
tgggacctggc

SEQ ID NO: 2317269 - DNA, 14 bp, Homo sapiens
tgggacctgtggct

SEQ ID NO: 2317270 - DNA, 18 bp, Homo sapiens
tgggacggaccagcatct

SEQ ID NO: 2317271 - DNA, 13 bp, Homo sapiens
tgggacggcggca

SEQ ID NO: 2317272 - DNA, 22 bp, Homo sapiens
tgggactagaggctcagtggtg

SEQ ID NO: 2317273 - DNA, 18 bp, Homo sapiens
tgggacttccatgcctta

SEQ ID NO: 2317274 - DNA, 19 bp, Homo sapiens
tgggagaagtgggggcagc

SEQ ID NO: 2317275 - DNA, 19 bp, Homo sapiens
tgggaggagggagagggag

SEQ ID NO: 2317276 - DNA, 22 bp, Homo sapiens
tgggaggtggaagaagggagaa

SEQ ID NO: 2317277 - DNA, 15 bp, Homo sapiens
tgggagtgtgtctgc

SEQ ID NO: 2317278 - DNA, 19 bp, Homo sapiens
tgggatcaggggtaggaat

SEQ ID NO: 2317279 - DNA, 20 bp, Homo sapiens
tgggatcaggggtaggaatg

SEQ ID NO: 2317280 - DNA, 15 bp, Homo sapiens
tgggatccttcagca

SEQ ID NO: 2317281 - DNA, 12 bp, Homo sapiens
tgggatggggag

SEQ ID NO: 2317282 - DNA, 15 bp, Homo sapiens
tgggatggggaggga

SEQ ID NO: 2317283 - DNA, 19 bp, Homo sapiens
tgggatggtcggatctcac

SEQ ID NO: 2317284 - DNA, 14 bp, Homo sapiens
tgggatgtcacagt

SEQ ID NO: 2317285 - DNA, 16 bp, Homo sapiens
tgggatgtcacagtcc

SEQ ID NO: 2317286 - DNA, 17 bp, Homo sapiens
tgggatgtcacagtcca

SEQ ID NO: 2317287 - DNA, 16 bp, Homo sapiens
tgggcacctgacttgg

SEQ ID NO: 2317288 - DNA, 16 bp, Homo sapiens
tgggcacgcctgctgg

SEQ ID NO: 2317289 - DNA, 23 bp, Homo sapiens
tgggcactccgcgccgatgccac

SEQ ID NO: 2317290 - DNA, 17 bp, Homo sapiens
tgggcagattttcagca

SEQ ID NO: 2317291 - DNA, 12 bp, Homo sapiens
tgggcagccaga

SEQ ID NO: 2317292 - DNA, 21 bp, Homo sapiens
tgggcagggcagggcagcctg

SEQ ID NO: 2317293 - DNA, 16 bp, Homo sapiens
tgggcagtgccccagg

SEQ ID NO: 2317294 - DNA, 17 bp, Homo sapiens
tgggcagtgccccaggg

SEQ ID NO: 2317295 - DNA, 19 bp, Homo sapiens
tgggcagtgccccagggag

SEQ ID NO: 2317296 - DNA, 20 bp, Homo sapiens
tgggcagtgccccagggagt

SEQ ID NO: 2317297 - DNA, 23 bp, Homo sapiens
tgggcagtgccccagggagtcca

SEQ ID NO: 2317298 - DNA, 22 bp, Homo sapiens
tgggcattttcctcctctgcct

SEQ ID NO: 2317299 - DNA, 23 bp, Homo sapiens
tgggccatgtccaaagaggctgc

SEQ ID NO: 2317300 - DNA, 13 bp, Homo sapiens
tgggccccacatg

SEQ ID NO: 2317301 - DNA, 19 bp, Homo sapiens
tgggccgggacccagggcc

SEQ ID NO: 2317302 - DNA, 20 bp, Homo sapiens
tgggctcaagcaatcctcct

SEQ ID NO: 2317303 - DNA, 15 bp, Homo sapiens
tgggctcgcactgcc

SEQ ID NO: 2317304 - DNA, 16 bp, Homo sapiens
tgggctcgcactgccc

SEQ ID NO: 2317305 - DNA, 12 bp, Homo sapiens
tgggctctgtgc

SEQ ID NO: 2317306 - DNA, 17 bp, Homo sapiens
tgggctgctggccatga

SEQ ID NO: 2317307 - DNA, 21 bp, Homo sapiens
tgggctgggcacctgacttgg

SEQ ID NO: 2317308 - DNA, 22 bp, Homo sapiens
tgggcttccccaggtggcctgg

SEQ ID NO: 2317309 - DNA, 15 bp, Homo sapiens
tgggcttcctgccct

SEQ ID NO: 2317310 - DNA, 21 bp, Homo sapiens
tgggcttcctgcccttccctc

SEQ ID NO: 2317311 - DNA, 23 bp, Homo sapiens
tgggcttcctgcccttccctctg

SEQ ID NO: 2317312 - DNA, 11 bp, Homo sapiens
tgtgggaaagc

SEQ ID NO: 2317313 - DNA, 17 bp, Homo sapiens
tgtgggatattgaatgt

SEQ ID NO: 2317314 - DNA, 15 bp, Homo sapiens
tgtgggggcttcatc

SEQ ID NO: 2317315 - DNA, 17 bp, Homo sapiens
tgtggggtggagcactg

SEQ ID NO: 2317316 - DNA, 12 bp, Homo sapiens
tgtgggtctctg

SEQ ID NO: 2317317 - DNA, 15 bp, Homo sapiens
tgtgggtgtcctgcc

SEQ ID NO: 2317318 - DNA, 14 bp, Homo sapiens
tgtgggttctacag

SEQ ID NO: 2317319 - DNA, 18 bp, Homo sapiens
tgtggttcctaagcctgt

SEQ ID NO: 2317320 - DNA, 13 bp, Homo sapiens
tgtggtttggaat

SEQ ID NO: 2317321 - DNA, 18 bp, Homo sapiens
tgtggtttggaatattaa

SEQ ID NO: 2317322 - DNA, 16 bp, Homo sapiens
tgtgtaaaaaaaccac

SEQ ID NO: 2317323 - DNA, 17 bp, Homo sapiens
tgtgtacataactgaaa

SEQ ID NO: 2317324 - DNA, 13 bp, Homo sapiens
tgtgtagagttaa

SEQ ID NO: 2317325 - DNA, 21 bp, Homo sapiens
tgtgtagagttaagaagctgt

SEQ ID NO: 2317326 - DNA, 19 bp, Homo sapiens
tgtgtatatattttgtgtg

SEQ ID NO: 2317327 - DNA, 22 bp, Homo sapiens
tgtgtatatattttgtgtgaaa

SEQ ID NO: 2317328 - DNA, 17 bp, Homo sapiens
tgtgtattcagaggcag

SEQ ID NO: 2317329 - DNA, 17 bp, Homo sapiens
tgtgtatttttcaaggc

SEQ ID NO: 2317330 - DNA, 15 bp, Homo sapiens
tgtgtcccccccagg

SEQ ID NO: 2317331 - DNA, 16 bp, Homo sapiens
tgtgtcccccccaggc

SEQ ID NO: 2317332 - DNA, 20 bp, Homo sapiens
tgtgtcctgaaacgctcctt

SEQ ID NO: 2317333 - DNA, 18 bp, Homo sapiens
tgtgtcctttggtactat

SEQ ID NO: 2317334 - DNA, 12 bp, Homo sapiens
tgtgtctgccaa

SEQ ID NO: 2317335 - DNA, 10 bp, Homo sapiens
tgtgtctgct

SEQ ID NO: 2317336 - DNA, 12 bp, Homo sapiens
tgtgtctgctga

SEQ ID NO: 2317337 - DNA, 13 bp, Homo sapiens
tgtgtctgctgag

SEQ ID NO: 2317338 - DNA, 18 bp, Homo sapiens
tgtgtgtattcagaggca

SEQ ID NO: 2317339 - DNA, 19 bp, Homo sapiens
tgtgttcccatttcagctg

SEQ ID NO: 2317340 - DNA, 22 bp, Homo sapiens
tgtgttgccacagtagaactgt

SEQ ID NO: 2317341 - DNA, 20 bp, Homo sapiens
tgtgttgctctccattcttt

SEQ ID NO: 2317342 - DNA, 16 bp, Homo sapiens
tgtgttttttaagata

SEQ ID NO: 2317343 - DNA, 21 bp, Homo sapiens
tgttaaatttgtaagtttcag

SEQ ID NO: 2317344 - DNA, 15 bp, Homo sapiens
tgttaacccactgca

SEQ ID NO: 2317345 - DNA, 23 bp, Homo sapiens
tgttaacccactgcatgcagaaa

SEQ ID NO: 2317346 - DNA, 21 bp, Homo sapiens
tgttaaggaaactcttatctc

SEQ ID NO: 2317347 - DNA, 20 bp, Homo sapiens
tgttaattgcgtagaggcta

SEQ ID NO: 2317348 - DNA, 20 bp, Homo sapiens
tgttaatttgtgtgttttta

SEQ ID NO: 2317349 - DNA, 16 bp, Homo sapiens
tgttacctactttgac

SEQ ID NO: 2317350 - DNA, 13 bp, Homo sapiens
tgttacctgtgtg

SEQ ID NO: 2317351 - DNA, 17 bp, Homo sapiens
tgttactgagatgtctt

SEQ ID NO: 2317352 - DNA, 14 bp, Homo sapiens
tgttacttctgata

SEQ ID NO: 2317353 - DNA, 12 bp, Homo sapiens
tgttagagaggt

SEQ ID NO: 2317354 - DNA, 23 bp, Homo sapiens
tgttagagaggtagcgagctgct

SEQ ID NO: 2317355 - DNA, 16 bp, Homo sapiens
tgttagggctgctttt

SEQ ID NO: 2317356 - DNA, 19 bp, Homo sapiens
tgttagggctgcttttctt

SEQ ID NO: 2317357 - DNA, 15 bp, Homo sapiens
tgttatgaacagctg

SEQ ID NO: 2317358 - DNA, 17 bp, Homo sapiens
tgttatgtagataacaa

SEQ ID NO: 2317359 - DNA, 14 bp, Homo sapiens
tgttattttttcag

SEQ ID NO: 2317360 - DNA, 16 bp, Homo sapiens
tgttcatcatccagat

SEQ ID NO: 2317361 - DNA, 16 bp, Homo sapiens
tgttcctaacaaaatg

SEQ ID NO: 2317362 - DNA, 13 bp, Homo sapiens
tgttcctgctgct

SEQ ID NO: 2317363 - DNA, 19 bp, Homo sapiens
tgttcgggccaaggacctg

SEQ ID NO: 2317364 - DNA, 22 bp, Homo sapiens
tgttcgggccaaggacctgaga

SEQ ID NO: 2317365 - DNA, 23 bp, Homo sapiens
tgttctgtggttcctctgctcac

SEQ ID NO: 2317366 - DNA, 16 bp, Homo sapiens
tgttctgttcatttcc

SEQ ID NO: 2317367 - DNA, 15 bp, Homo sapiens
ttaagcaaattttgt

SEQ ID NO: 2317368 - DNA, 17 bp, Homo sapiens
ttaagcacaaaaaattt

SEQ ID NO: 2317369 - DNA, 22 bp, Homo sapiens
ttaagcattttgaaacaaagta

SEQ ID NO: 2317370 - DNA, 14 bp, Homo sapiens
ttaagctttttgga

SEQ ID NO: 2317371 - DNA, 14 bp, Homo sapiens
ttaaggaaactctt

SEQ ID NO: 2317372 - DNA, 16 bp, Homo sapiens
ttaaggaaactcttat

SEQ ID NO: 2317373 - DNA, 14 bp, Homo sapiens
ttaaggataaatca

SEQ ID NO: 2317374 - DNA, 11 bp, Homo sapiens
ttaaggcctga

SEQ ID NO: 2317375 - DNA, 15 bp, Homo sapiens
ttaagggacatttct

SEQ ID NO: 2317376 - DNA, 18 bp, Homo sapiens
ttaaggggaagaatgaaa

SEQ ID NO: 2317377 - DNA, 16 bp, Homo sapiens
ttaaggggatctaaaa

SEQ ID NO: 2317378 - DNA, 20 bp, Homo sapiens
ttaaggtgagcataaatcaa

SEQ ID NO: 2317379 - DNA, 18 bp, Homo sapiens
ttaagtgagcagaacagg

SEQ ID NO: 2317380 - DNA, 21 bp, Homo sapiens
ttaagtgcgtgtgtagagtta

SEQ ID NO: 2317381 - DNA, 16 bp, Homo sapiens
ttaagtggactgtatt

SEQ ID NO: 2317382 - DNA, 18 bp, Homo sapiens
ttaagtggactgtatttc

SEQ ID NO: 2317383 - DNA, 20 bp, Homo sapiens
ttaagtggtctagtcaagga

SEQ ID NO: 2317384 - DNA, 22 bp, Homo sapiens
ttaagtgttctgtggctgattt

SEQ ID NO: 2317385 - DNA, 17 bp, Homo sapiens
ttaataaaagaaaatta

SEQ ID NO: 2317386 - DNA, 15 bp, Homo sapiens
ttaataaaatatcta

SEQ ID NO: 2317387 - DNA, 15 bp, Homo sapiens
ttaataaagatgagt

SEQ ID NO: 2317388 - DNA, 17 bp, Homo sapiens
ttaataaattttccatt

SEQ ID NO: 2317389 - DNA, 13 bp, Homo sapiens
ttaataacattac

SEQ ID NO: 2317390 - DNA, 20 bp, Homo sapiens
ttaataacattaccttactg

SEQ ID NO: 2317391 - DNA, 18 bp, Homo sapiens
ttaataagatttttcaaa

SEQ ID NO: 2317392 - DNA, 21 bp, Homo sapiens
ttaataagatttttcaaaatc

SEQ ID NO: 2317393 - DNA, 18 bp, Homo sapiens
ttaatagccaaagatttc

SEQ ID NO: 2317394 - DNA, 23 bp, Homo sapiens
ttaatagtcaccttcatgattat

SEQ ID NO: 2317395 - DNA, 15 bp, Homo sapiens
ttaatatactcctta

SEQ ID NO: 2317396 - DNA, 16 bp, Homo sapiens
ttaatatactccttaa

SEQ ID NO: 2317397 - DNA, 16 bp, Homo sapiens
ttaatatattaaaatt

SEQ ID NO: 2317398 - DNA, 18 bp, Homo sapiens
ttaatatcaactctgaag

SEQ ID NO: 2317399 - DNA, 21 bp, Homo sapiens
ttaatattcttttgtttccat

SEQ ID NO: 2317400 - DNA, 20 bp, Homo sapiens
ttaatatttgcacatgggat

SEQ ID NO: 2317401 - DNA, 12 bp, Homo sapiens
ttaatcaagaga

SEQ ID NO: 2317402 - DNA, 17 bp, Homo sapiens
ttaatcaagagaaactt

SEQ ID NO: 2317403 - DNA, 19 bp, Homo sapiens
ttaatccagttataagaag

SEQ ID NO: 2317404 - DNA, 20 bp, Homo sapiens
ttaatccagttataagaaga

SEQ ID NO: 2317405 - DNA, 21 bp, Homo sapiens
ttaatctcaaagagattcgaa

SEQ ID NO: 2317406 - DNA, 20 bp, Homo sapiens
ttaatcttttcttatttttg

SEQ ID NO: 2317407 - DNA, 17 bp, Homo sapiens
ttaatgataaactcaga

SEQ ID NO: 2317408 - DNA, 19 bp, Homo sapiens
ttaatgctgtttctaagaa

SEQ ID NO: 2317409 - DNA, 16 bp, Homo sapiens
ttaatgttttcaaaag

SEQ ID NO: 2317410 - DNA, 13 bp, Homo sapiens
ttaattgttgttt

SEQ ID NO: 2317411 - DNA, 16 bp, Homo sapiens
ttaattgttgtttctt

SEQ ID NO: 2317412 - DNA, 19 bp, Homo sapiens
ttaattgttgtttctttct

SEQ ID NO: 2317413 - DNA, 12 bp, Homo sapiens
ttaatttccttt

SEQ ID NO: 2317414 - DNA, 16 bp, Homo sapiens
ttaatttcctttttga

SEQ ID NO: 2317415 - DNA, 20 bp, Homo sapiens
ttaatttcctttttgacact

SEQ ID NO: 2317416 - DNA, 21 bp, Homo sapiens
ttaatttcctttttgacactg

SEQ ID NO: 2317417 - DNA, 13 bp, Homo sapiens
ttaattttaaagt

SEQ ID NO: 2317418 - DNA, 18 bp, Homo sapiens
ttaattttaaagtgcaaa

SEQ ID NO: 2317419 - DNA, 13 bp, Homo sapiens
ttaattttaatgc

SEQ ID NO: 2317420 - DNA, 21 bp, Homo sapiens
ttacaaagttaaaattgttat

SEQ ID NO: 2317421 - DNA, 19 bp, Homo sapiens
ttacaactgaccaagtttc

SEQ ID NO: 2317422 - DNA, 18 bp, Homo sapiens
ttacaagggaagatttat

SEQ ID NO: 2317423 - DNA, 20 bp, Homo sapiens
ttacaagggcataaagtaaa

SEQ ID NO: 2317424 - DNA, 18 bp, Homo sapiens
ttacacagaaatgctgct

SEQ ID NO: 2317425 - DNA, 14 bp, Homo sapiens
ttacacatcttaaa

SEQ ID NO: 2317426 - DNA, 15 bp, Homo sapiens
ttatatggaagaaag

SEQ ID NO: 2317427 - DNA, 14 bp, Homo sapiens
ttatatttccttta

SEQ ID NO: 2317428 - DNA, 16 bp, Homo sapiens
ttatatttcctttatg

SEQ ID NO: 2317429 - DNA, 20 bp, Homo sapiens
ttatcaaaatagtctaaggc

SEQ ID NO: 2317430 - DNA, 14 bp, Homo sapiens
ttatcatgaatttt

SEQ ID NO: 2317431 - DNA, 19 bp, Homo sapiens
ttatcatgaattttaaagt

SEQ ID NO: 2317432 - DNA, 18 bp, Homo sapiens
ttatcattaaaaattacc

SEQ ID NO: 2317433 - DNA, 12 bp, Homo sapiens
ttatcattgttt

SEQ ID NO: 2317434 - DNA, 12 bp, Homo sapiens
ttatcctctctc

SEQ ID NO: 2317435 - DNA, 13 bp, Homo sapiens
ttatcgaaataac

SEQ ID NO: 2317436 - DNA, 22 bp, Homo sapiens
ttatcgaaataacaatgttaag

SEQ ID NO: 2317437 - DNA, 22 bp, Homo sapiens
ttatcgtttttgtattttcatg

SEQ ID NO: 2317438 - DNA, 19 bp, Homo sapiens
ttatctaatacctctgtgt

SEQ ID NO: 2317439 - DNA, 14 bp, Homo sapiens
ttatctcaacggaa

SEQ ID NO: 2317440 - DNA, 22 bp, Homo sapiens
ttatctcagtcatgcataaata

SEQ ID NO: 2317441 - DNA, 20 bp, Homo sapiens
ttatcttacaatattgattg

SEQ ID NO: 2317442 - DNA, 17 bp, Homo sapiens
ttatcttggttgaaaat

SEQ ID NO: 2317443 - DNA, 14 bp, Homo sapiens
ttatctttgaatat

SEQ ID NO: 2317444 - DNA, 15 bp, Homo sapiens
ttatgaagctcatat

SEQ ID NO: 2317445 - DNA, 21 bp, Homo sapiens
ttatgatctggcccttgctta

SEQ ID NO: 2317446 - DNA, 15 bp, Homo sapiens
ttatgatttaataaa

SEQ ID NO: 2317447 - DNA, 18 bp, Homo sapiens
ttatgatttttttttcat

SEQ ID NO: 2317448 - DNA, 16 bp, Homo sapiens
ttatgcatcatttcag

SEQ ID NO: 2317449 - DNA, 14 bp, Homo sapiens
ttatggttacttct

SEQ ID NO: 2317450 - DNA, 15 bp, Homo sapiens
ttatgtctcttctga

SEQ ID NO: 2317451 - DNA, 12 bp, Homo sapiens
ttatgtgaaaaa

SEQ ID NO: 2317452 - DNA, 11 bp, Homo sapiens
ttatgtgaatt

SEQ ID NO: 2317453 - DNA, 15 bp, Homo sapiens
ttatgtgacattaac

SEQ ID NO: 2317454 - DNA, 19 bp, Homo sapiens
ttatgttgttgaactaata

SEQ ID NO: 2317455 - DNA, 19 bp, Homo sapiens
ttatgtttaaaagaaatat

SEQ ID NO: 2317456 - DNA, 19 bp, Homo sapiens
ttattaactactgaataat

SEQ ID NO: 2317457 - DNA, 22 bp, Homo sapiens
ttattaatcatacaaactctca

SEQ ID NO: 2317458 - DNA, 12 bp, Homo sapiens
ttattaatgttt

SEQ ID NO: 2317459 - DNA, 18 bp, Homo sapiens
ttattcagtaactgtcag

SEQ ID NO: 2317460 - DNA, 13 bp, Homo sapiens
ttattctcctccc

SEQ ID NO: 2317461 - DNA, 16 bp, Homo sapiens
ttattgaatatatgat

SEQ ID NO: 2317462 - DNA, 14 bp, Homo sapiens
ttattgacactgaa

SEQ ID NO: 2317463 - DNA, 17 bp, Homo sapiens
ttattgacactgaactt

SEQ ID NO: 2317464 - DNA, 22 bp, Homo sapiens
ttattgaccattttttaattta

SEQ ID NO: 2317465 - DNA, 19 bp, Homo sapiens
ttattgcactagagaaaat

SEQ ID NO: 2317466 - DNA, 22 bp, Homo sapiens
ttattggctgagatatgaacat

SEQ ID NO: 2317467 - DNA, 14 bp, Homo sapiens
ttatttaagactaa

SEQ ID NO: 2317468 - DNA, 15 bp, Homo sapiens
ttatttaataacatt

SEQ ID NO: 2317469 - DNA, 19 bp, Homo sapiens
ttatttaataacattacct

SEQ ID NO: 2317470 - DNA, 16 bp, Homo sapiens
ttatttagacaagaga

SEQ ID NO: 2317471 - DNA, 15 bp, Homo sapiens
ttatttccactaaaa

SEQ ID NO: 2317472 - DNA, 18 bp, Homo sapiens
ttatttccactaaaaata

SEQ ID NO: 2317473 - DNA, 19 bp, Homo sapiens
ttatttccactaaaaatat

SEQ ID NO: 2317474 - DNA, 12 bp, Homo sapiens
ttatttcttctc

SEQ ID NO: 2317475 - DNA, 19 bp, Homo sapiens
ttatttgattatttaagac

SEQ ID NO: 2317476 - DNA, 12 bp, Homo sapiens
ttattttctaca

SEQ ID NO: 2317477 - DNA, 16 bp, Homo sapiens
ttatttttataattgt

SEQ ID NO: 2317478 - DNA, 21 bp, Homo sapiens
ttatttttataattgtacaaa

SEQ ID NO: 2317479 - DNA, 16 bp, Homo sapiens
ttatttttgtacatgt

SEQ ID NO: 2317480 - DNA, 17 bp, Homo sapiens
ttatttttgtacatgtt

SEQ ID NO: 2317481 - DNA, 18 bp, Homo sapiens
ttattttttcagactgtg

SEQ ID NO: 2317482 - DNA, 17 bp, Homo sapiens
ttatttttttaaaattt

SEQ ID NO: 2317483 - DNA, 20 bp, Homo sapiens
ttcaaaaggtattatacatg

SEQ ID NO: 2317484 - DNA, 18 bp, Homo sapiens
tgattgggaaaacatttg

SEQ ID NO: 2317485 - DNA, 21 bp, Homo sapiens
tgattgggaaaacatttgctg

SEQ ID NO: 2317486 - DNA, 14 bp, Homo sapiens
tgattgtcagctac

SEQ ID NO: 2317487 - DNA, 17 bp, Homo sapiens
tgattgtctagtgagga

SEQ ID NO: 2317488 - DNA, 13 bp, Homo sapiens
tgatttaataaaa

SEQ ID NO: 2317489 - DNA, 22 bp, Homo sapiens
tgatttaataaaataattctaa

SEQ ID NO: 2317490 - DNA, 16 bp, Homo sapiens
tgatttactaacagta

SEQ ID NO: 2317491 - DNA, 20 bp, Homo sapiens
tgatttcaaagttttgttgt

SEQ ID NO: 2317492 - DNA, 14 bp, Homo sapiens
tgatttcagtaagt

SEQ ID NO: 2317493 - DNA, 19 bp, Homo sapiens
tgatttcagtaagtctcat

SEQ ID NO: 2317494 - DNA, 19 bp, Homo sapiens
tgatttcagttctaggaaa

SEQ ID NO: 2317495 - DNA, 18 bp, Homo sapiens
tgatttctttaaaagaat

SEQ ID NO: 2317496 - DNA, 16 bp, Homo sapiens
tgatttgaaaaatata

SEQ ID NO: 2317497 - DNA, 13 bp, Homo sapiens
tgatttgaattct

SEQ ID NO: 2317498 - DNA, 20 bp, Homo sapiens
tgatttggaagagaggcacc

SEQ ID NO: 2317499 - DNA, 19 bp, Homo sapiens
tgattttcaagcagcatct

SEQ ID NO: 2317500 - DNA, 14 bp, Homo sapiens
tgatttttaaatta

SEQ ID NO: 2317501 - DNA, 17 bp, Homo sapiens
tgatttttaaattaaat

SEQ ID NO: 2317502 - DNA, 21 bp, Homo sapiens
tgatttttgcctcttccagtc

SEQ ID NO: 2317503 - DNA, 18 bp, Homo sapiens
tgatttttttttcataca

SEQ ID NO: 2317504 - DNA, 22 bp, Homo sapiens
tgatttttttttcatacactta

SEQ ID NO: 2317505 - DNA, 18 bp, Homo sapiens
tgcaaaaaattctttaga

SEQ ID NO: 2317506 - DNA, 14 bp, Homo sapiens
tgcaaaaataatca

SEQ ID NO: 2317507 - DNA, 22 bp, Homo sapiens
tgcaaacctgacccctgctcag

SEQ ID NO: 2317508 - DNA, 23 bp, Homo sapiens
tgcaaacctgacccctgctcagt

SEQ ID NO: 2317509 - DNA, 11 bp, Homo sapiens
tgcaaactggg

SEQ ID NO: 2317510 - DNA, 13 bp, Homo sapiens
tgcaaactgggaa

SEQ ID NO: 2317511 - DNA, 14 bp, Homo sapiens
tgaaagaaaattga

SEQ ID NO: 2317512 - DNA, 21 bp, Homo sapiens
tgaaagagagtaccatgctgg

SEQ ID NO: 2317513 - DNA, 21 bp, Homo sapiens
tgaaagaggtaaaattctcta

SEQ ID NO: 2317514 - DNA, 15 bp, Homo sapiens
tgaaaggcaggaagg

SEQ ID NO: 2317515 - DNA, 22 bp, Homo sapiens
tgaaaggcaggaagggaagcgt

SEQ ID NO: 2317516 - DNA, 17 bp, Homo sapiens
tgaaagtagagctagct

SEQ ID NO: 2317517 - DNA, 23 bp, Homo sapiens
tgaaagtagagctagctgccact

SEQ ID NO: 2317518 - DNA, 21 bp, Homo sapiens
tgaaagtgcatttttgtaaat

SEQ ID NO: 2317519 - DNA, 11 bp, Homo sapiens
tgaaagttgtg

SEQ ID NO: 2317520 - DNA, 16 bp, Homo sapiens
tgaaagttttgtaaaa

SEQ ID NO: 2317521 - DNA, 13 bp, Homo sapiens
tgaaataagtaaa

SEQ ID NO: 2317522 - DNA, 21 bp, Homo sapiens
tgaaatattttctactttaaa

SEQ ID NO: 2317523 - DNA, 13 bp, Homo sapiens
tgaaatgagtaaa

SEQ ID NO: 2317524 - DNA, 20 bp, Homo sapiens
tgaaatgagtaaaaactaga

SEQ ID NO: 2317525 - DNA, 13 bp, Homo sapiens
tgaaatgcatatt

SEQ ID NO: 2317526 - DNA, 17 bp, Homo sapiens
tgaaatgcctgctttga

SEQ ID NO: 2317527 - DNA, 16 bp, Homo sapiens
tgaaatgttctgtcaa

SEQ ID NO: 2317528 - DNA, 20 bp, Homo sapiens
tgaaattaacacaaaggaag

SEQ ID NO: 2317529 - DNA, 16 bp, Homo sapiens
tgaaatttaagcacaa

SEQ ID NO: 2317530 - DNA, 14 bp, Homo sapiens
tgaaattttaacct

SEQ ID NO: 2317531 - DNA, 16 bp, Homo sapiens
tgaaattttatatgct

SEQ ID NO: 2317532 - DNA, 19 bp, Homo sapiens
tgaacacagtgtctgttca

SEQ ID NO: 2317533 - DNA, 23 bp, Homo sapiens
tgaacagtactggttactttcaa

SEQ ID NO: 2317534 - DNA, 18 bp, Homo sapiens
tgaacattcccagcccag

SEQ ID NO: 2317535 - DNA, 19 bp, Homo sapiens
tgaacattctcctgtggaa

SEQ ID NO: 2317536 - DNA, 13 bp, Homo sapiens
tgaaccactgctt

SEQ ID NO: 2317537 - DNA, 17 bp, Homo sapiens
tgaaccactgcttctct

SEQ ID NO: 2317538 - DNA, 19 bp, Homo sapiens
tgaaccactgcttctcttt

SEQ ID NO: 2317539 - DNA, 16 bp, Homo sapiens
tgaaccataaattcaa

SEQ ID NO: 2317540 - DNA, 21 bp, Homo sapiens
tgaaccataaattcaactttg

SEQ ID NO: 2317541 - DNA, 22 bp, Homo sapiens
tgaaccataaattcaactttgt

SEQ ID NO: 2317542 - DNA, 20 bp, Homo sapiens
tgaaccatggtgaagtgctt

SEQ ID NO: 2317543 - DNA, 23 bp, Homo sapiens
tgaaccatggtgaagtgcttgga

SEQ ID NO: 2317544 - DNA, 15 bp, Homo sapiens
tgaaccctggggcct

SEQ ID NO: 2317545 - DNA, 21 bp, Homo sapiens
tgaaccctggggcctgactgc

SEQ ID NO: 2317546 - DNA, 21 bp, Homo sapiens
tgaacgttttcttctttccct

SEQ ID NO: 2317547 - DNA, 19 bp, Homo sapiens
tgaactacatgcataaact

SEQ ID NO: 2317548 - DNA, 18 bp, Homo sapiens
tgaactaggctgagcaat

SEQ ID NO: 2317549 - DNA, 17 bp, Homo sapiens
tgaactcaaactgagga

SEQ ID NO: 2317550 - DNA, 14 bp, Homo sapiens
tgaactggaataat

SEQ ID NO: 2317551 - DNA, 22 bp, Homo sapiens
tgaactgtagagtcctatttca

SEQ ID NO: 2317552 - DNA, 22 bp, Homo sapiens
tgaacttaataactgtgtactg

SEQ ID NO: 2317553 - DNA, 23 bp, Homo sapiens
tgaacttaataactgtgtactgt

SEQ ID NO: 2317554 - DNA, 16 bp, Homo sapiens
tgaagaaagtcaaaaa

SEQ ID NO: 2317555 - DNA, 15 bp, Homo sapiens
tgaagaaataaatga

SEQ ID NO: 2317556 - DNA, 19 bp, Homo sapiens
tgaagaactgaggaggaaa

SEQ ID NO: 2317557 - DNA, 23 bp, Homo sapiens
tgaagaaggaaggcctgagcccc

SEQ ID NO: 2317558 - DNA, 19 bp, Homo sapiens
tgaagagacagagacaagt

SEQ ID NO: 2317559 - DNA, 23 bp, Homo sapiens
tgaagagacagagacaagtaatt

SEQ ID NO: 2317560 - DNA, 12 bp, Homo sapiens
tgaagcaggagg

SEQ ID NO: 2317561 - DNA, 22 bp, Homo sapiens
tgaagcatagataatattgttt

SEQ ID NO: 2317562 - DNA, 12 bp, Homo sapiens
tgaagccaaaga

SEQ ID NO: 2317563 - DNA, 14 bp, Homo sapiens
tgaagccatctaaa

SEQ ID NO: 2317564 - DNA, 15 bp, Homo sapiens
tgaagctaatgtcac

SEQ ID NO: 2317565 - DNA, 18 bp, Homo sapiens
tgaaggactttggcccta

SEQ ID NO: 2317566 - DNA, 14 bp, Homo sapiens
tgaaggccctgctg

SEQ ID NO: 2317567 - DNA, 15 bp, Homo sapiens
tgaaggccctgctga

SEQ ID NO: 2317568 - DNA, 15 bp, Homo sapiens
tgaagggaagagaca

SEQ ID NO: 2317569 - DNA, 17 bp, Homo sapiens
tgaagggaccctttggg

SEQ ID NO: 2317570 - DNA, 22 bp, Homo sapiens
tgaaggggctcttcatctgcct

SEQ ID NO: 2317571 - DNA, 21 bp, Homo sapiens
tgaaggggtgcacccacctgt

SEQ ID NO: 2317572 - DNA, 22 bp, Homo sapiens
tgaaggggtgcacccacctgtt

SEQ ID NO: 2317573 - DNA, 23 bp, Homo sapiens
tgaaggtagcattctttggagtt

SEQ ID NO: 2317574 - DNA, 20 bp, Homo sapiens
tgaagtacatattaggaaaa

SEQ ID NO: 2317575 - DNA, 13 bp, Homo sapiens
tgaagtgaatctg

SEQ ID NO: 2317576 - DNA, 13 bp, Homo sapiens
tgaagtgcttgga

SEQ ID NO: 2317577 - DNA, 13 bp, Homo sapiens
tgaagtggctggt

SEQ ID NO: 2317578 - DNA, 15 bp, Homo sapiens
tgaagttagtggaaa

SEQ ID NO: 2317579 - DNA, 17 bp, Homo sapiens
tgaagttgtacaacacc

SEQ ID NO: 2317580 - DNA, 18 bp, Homo sapiens
tgaagtttaaattctagt

SEQ ID NO: 2317581 - DNA, 23 bp, Homo sapiens
tgaagtttcaagttttaaagttc

SEQ ID NO: 2317582 - DNA, 18 bp, Homo sapiens
tgaataaagaatgccatt

SEQ ID NO: 2317583 - DNA, 14 bp, Homo sapiens
tgaataatgaaaat

SEQ ID NO: 2317584 - DNA, 20 bp, Homo sapiens
tgaatacattaacggtgcta

SEQ ID NO: 2317585 - DNA, 18 bp, Homo sapiens
tgaatagactatctagaa

SEQ ID NO: 2317586 - DNA, 15 bp, Homo sapiens
tgaatagcctggcca

SEQ ID NO: 2317587 - DNA, 13 bp, Homo sapiens
tgaatcatgagcc

SEQ ID NO: 2317588 - DNA, 14 bp, Homo sapiens
tgaatcatgagcct

SEQ ID NO: 2317589 - DNA, 15 bp, Homo sapiens
tgaatcatgagcctg

SEQ ID NO: 2317590 - DNA, 20 bp, Homo sapiens
tgaatctgcagggagcaact

SEQ ID NO: 2317591 - DNA, 16 bp, Homo sapiens
tgaatgattaaattat

SEQ ID NO: 2317592 - DNA, 20 bp, Homo sapiens
tgaatgctatttgtgtaact

SEQ ID NO: 2317593 - DNA, 23 bp, Homo sapiens
tgaatgcttttagtgtgtgcata

SEQ ID NO: 2317594 - DNA, 20 bp, Homo sapiens
tgaatggattggattattta

SEQ ID NO: 2317595 - DNA, 21 bp, Homo sapiens
tgaatggattggattatttaa

SEQ ID NO: 2317596 - DNA, 14 bp, Homo sapiens
tgaatgtaaccaat

SEQ ID NO: 2317597 - DNA, 13 bp, Homo sapiens
tgaatgttttcaa

SEQ ID NO: 2317598 - DNA, 18 bp, Homo sapiens
tgaattatcagcaaagaa

SEQ ID NO: 2317599 - DNA, 14 bp, Homo sapiens
tgaattattgacac

SEQ ID NO: 2317600 - DNA, 21 bp, Homo sapiens
tgaattattgacactgaactt

SEQ ID NO: 2317601 - DNA, 12 bp, Homo sapiens
tgaattgaagtt

SEQ ID NO: 2317602 - DNA, 17 bp, Homo sapiens
tgaattgaagtttcaag

SEQ ID NO: 2317603 - DNA, 19 bp, Homo sapiens
tgaattgaagtttcaagtt

SEQ ID NO: 2317604 - DNA, 13 bp, Homo sapiens
tgaattgtacaga

SEQ ID NO: 2317605 - DNA, 23 bp, Homo sapiens
tgaattgtgttttcaggttttgt

SEQ ID NO: 2317606 - DNA, 19 bp, Homo sapiens
tgaatttggggctacttat

SEQ ID NO: 2317607 - DNA, 22 bp, Homo sapiens
tgaatttggggctacttatatt

SEQ ID NO: 2317608 - DNA, 14 bp, Homo sapiens
tgaattttaaagta

SEQ ID NO: 2317609 - DNA, 22 bp, Homo sapiens
tgaattttaaagtatgcattat

SEQ ID NO: 2317610 - DNA, 18 bp, Homo sapiens
tgaatttttttgtaataa

SEQ ID NO: 2317611 - DNA, 16 bp, Homo sapiens
tgacaaataagattaa

SEQ ID NO: 2317612 - DNA, 16 bp, Homo sapiens
tgacaaccattaaagt

SEQ ID NO: 2317613 - DNA, 22 bp, Homo sapiens
tgacaacttagctcaggtgcct

SEQ ID NO: 2317614 - DNA, 21 bp, Homo sapiens
tgacaagtgacttatttgctc

SEQ ID NO: 2317615 - DNA, 15 bp, Homo sapiens
tgacacccttctccc

SEQ ID NO: 2317616 - DNA, 18 bp, Homo sapiens
tgacactagcccaatgaa

SEQ ID NO: 2317617 - DNA, 19 bp, Homo sapiens
tgacactagcccaatgaaa

SEQ ID NO: 2317618 - DNA, 19 bp, Homo sapiens
tgacactgaaagttttgta

SEQ ID NO: 2317619 - DNA, 17 bp, Homo sapiens
tgacagaaggtgccact

SEQ ID NO: 2317620 - DNA, 14 bp, Homo sapiens
tgacagaggctgca

SEQ ID NO: 2317621 - DNA, 16 bp, Homo sapiens
tgacagaggctgcacc

SEQ ID NO: 2317622 - DNA, 17 bp, Homo sapiens
tgacaggtcttttcaaa

SEQ ID NO: 2317623 - DNA, 21 bp, Homo sapiens
tgacagtgcctcttccagtga

SEQ ID NO: 2317624 - DNA, 22 bp, Homo sapiens
tgacagtgcctcttccagtgaa

SEQ ID NO: 2317625 - DNA, 14 bp, Homo sapiens
tgacagtttccaaa

SEQ ID NO: 2317626 - DNA, 21 bp, Homo sapiens
tgacataataaagtattttct

SEQ ID NO: 2317627 - DNA, 21 bp, Homo sapiens
tgacatcctttcttttaatga

SEQ ID NO: 2317628 - DNA, 15 bp, Homo sapiens
tgacatggtgcctga

SEQ ID NO: 2317629 - DNA, 21 bp, Homo sapiens
tgacatggtgcctgagaggca

SEQ ID NO: 2317630 - DNA, 15 bp, Homo sapiens
tgacatgtgaaacct

SEQ ID NO: 2317631 - DNA, 16 bp, Homo sapiens
tgacatgtgaaacctt

SEQ ID NO: 2317632 - DNA, 17 bp, Homo sapiens
tgacatgtgaaaccttt

SEQ ID NO: 2317633 - DNA, 21 bp, Homo sapiens
tgacatgtgaaacctttttta

SEQ ID NO: 2317634 - DNA, 21 bp, Homo sapiens
tgacattaaatgcaataattt

SEQ ID NO: 2317635 - DNA, 16 bp, Homo sapiens
tgacattcctttgaat

SEQ ID NO: 2317636 - DNA, 18 bp, Homo sapiens
tgacattcttagctgtaa

SEQ ID NO: 2317637 - DNA, 13 bp, Homo sapiens
tgacatttttctg

SEQ ID NO: 2317638 - DNA, 19 bp, Homo sapiens
tgaccaagactgagccagc

SEQ ID NO: 2317639 - DNA, 16 bp, Homo sapiens
tgaccagaagccttgg

SEQ ID NO: 2317640 - DNA, 22 bp, Homo sapiens
tgaccagatctttctcttccct

SEQ ID NO: 2317641 - DNA, 22 bp, Homo sapiens
tgaccatatagattttattatg

SEQ ID NO: 2317642 - DNA, 17 bp, Homo sapiens
tgaccattcaattagtg

SEQ ID NO: 2317643 - DNA, 17 bp, Homo sapiens
tgaccctgaaatatttt

SEQ ID NO: 2317644 - DNA, 21 bp, Homo sapiens
tgaccctgaaatattttctac

SEQ ID NO: 2317645 - DNA, 15 bp, Homo sapiens
tgaccctgggcaagt

SEQ ID NO: 2317646 - DNA, 13 bp, Homo sapiens
tgacctaaattag

SEQ ID NO: 2317647 - DNA, 16 bp, Homo sapiens
tgacctaaattagata

SEQ ID NO: 2317648 - DNA, 21 bp, Homo sapiens
tgacctacctcaaagggcagt

SEQ ID NO: 2317649 - DNA, 22 bp, Homo sapiens
tgacctagttttccatgcgtgt

SEQ ID NO: 2317650 - DNA, 19 bp, Homo sapiens
tgacctccgccatccaccc

SEQ ID NO: 2317651 - DNA, 21 bp, Homo sapiens
tgacctgaccccattcctgat

SEQ ID NO: 2317652 - DNA, 11 bp, Homo sapiens
tgacctgctga

SEQ ID NO: 2317653 - DNA, 15 bp, Homo sapiens
tgacctgctgacctg

SEQ ID NO: 2317654 - DNA, 16 bp, Homo sapiens
tgacctggatggggca

SEQ ID NO: 2317655 - DNA, 22 bp, Homo sapiens
tgacctggatggggcaggccac

SEQ ID NO: 2317656 - DNA, 12 bp, Homo sapiens
tgacctggcccc

SEQ ID NO: 2317657 - DNA, 11 bp, Homo sapiens
tgacctgtgca

SEQ ID NO: 2317658 - DNA, 18 bp, Homo sapiens
tgacctttgacctcggtg

SEQ ID NO: 2317659 - DNA, 16 bp, Homo sapiens
tgacgcttgtgacagt

SEQ ID NO: 2317660 - DNA, 19 bp, Homo sapiens
tgacgcttgtgacagtgcc

SEQ ID NO: 2317661 - DNA, 23 bp, Homo sapiens
tgacggtcctttaggcagcctgc

SEQ ID NO: 2317662 - DNA, 23 bp, Homo sapiens
tgacgtcactttttggccatgta

SEQ ID NO: 2317663 - DNA, 18 bp, Homo sapiens
tgacgtttcttctttcta

SEQ ID NO: 2317664 - DNA, 16 bp, Homo sapiens
tgactaaagagagaat

SEQ ID NO: 2317665 - DNA, 14 bp, Homo sapiens
tgactcaaagtctg

SEQ ID NO: 2317666 - DNA, 13 bp, Homo sapiens
tgactcctctggc

SEQ ID NO: 2317667 - DNA, 16 bp, Homo sapiens
tgactcctctggcttt

SEQ ID NO: 2317668 - DNA, 16 bp, Homo sapiens
tgactgccttgcctcc

SEQ ID NO: 2317669 - DNA, 16 bp, Homo sapiens
tgactgctcagaactt

SEQ ID NO: 2317670 - DNA, 15 bp, Homo sapiens
tgactgtagccacag

SEQ ID NO: 2317671 - DNA, 19 bp, Homo sapiens
tgactgtagccacagctgc

SEQ ID NO: 2317672 - DNA, 19 bp, Homo sapiens
tgacttggggagatggagt

SEQ ID NO: 2317673 - DNA, 22 bp, Homo sapiens
tgactttacgcccatctcagga

SEQ ID NO: 2317674 - DNA, 23 bp, Homo sapiens
tgactttttgcatttaaaacaga

SEQ ID NO: 2317675 - DNA, 17 bp, Homo sapiens
tgactttttttgtatgt

SEQ ID NO: 2317676 - DNA, 19 bp, Homo sapiens
tgagaaaaataaatggaaa

SEQ ID NO: 2317677 - DNA, 22 bp, Homo sapiens
tgagaaactttgatctctgctt

SEQ ID NO: 2317678 - DNA, 19 bp, Homo sapiens
tgagaacacgttgccaggg

SEQ ID NO: 2317679 - DNA, 20 bp, Homo sapiens
tgagaaccgtagatgatttc

SEQ ID NO: 2317680 - DNA, 22 bp, Homo sapiens
tgagaaccttggaccactcctg

SEQ ID NO: 2317681 - DNA, 23 bp, Homo sapiens
tgagaactcgttcacctccaagc

SEQ ID NO: 2317682 - DNA, 18 bp, Homo sapiens
tgagaagaagtggctgcc

SEQ ID NO: 2317683 - DNA, 12 bp, Homo sapiens
tgagaagccaag

SEQ ID NO: 2317684 - DNA, 13 bp, Homo sapiens
tgagaagccttca

SEQ ID NO: 2317685 - DNA, 11 bp, Homo sapiens
tgagaaggtta

SEQ ID NO: 2317686 - DNA, 16 bp, Homo sapiens
tgagacaatgttttct

SEQ ID NO: 2317687 - DNA, 20 bp, Homo sapiens
tgagacaatgttttcttcaa

SEQ ID NO: 2317688 - DNA, 22 bp, Homo sapiens
tgagacagggtcttgctctgtc

SEQ ID NO: 2317689 - DNA, 15 bp, Homo sapiens
tgagacagtttctta

SEQ ID NO: 2317690 - DNA, 16 bp, Homo sapiens
tgagacagtttcttag

SEQ ID NO: 2317691 - DNA, 23 bp, Homo sapiens
tgagacagtttcttagcttttta

SEQ ID NO: 2317692 - DNA, 11 bp, Homo sapiens
tgagacctcaa

SEQ ID NO: 2317693 - DNA, 14 bp, Homo sapiens
tgagactgccccac

SEQ ID NO: 2317694 - DNA, 22 bp, Homo sapiens
tgagactgccccacggagacag

SEQ ID NO: 2317695 - DNA, 21 bp, Homo sapiens
tgagactgtgctgttgttctc

SEQ ID NO: 2317696 - DNA, 21 bp, Homo sapiens
tgagagacgccactccctggg

SEQ ID NO: 2317697 - DNA, 12 bp, Homo sapiens
tgagagccagtg

SEQ ID NO: 2317698 - DNA, 14 bp, Homo sapiens
tgagagccagtggc

SEQ ID NO: 2317699 - DNA, 18 bp, Homo sapiens
tgagaggacagattgtta

SEQ ID NO: 2317700 - DNA, 19 bp, Homo sapiens
tgagagtcagctctctgcc

SEQ ID NO: 2317701 - DNA, 15 bp, Homo sapiens
tgagagttccttctc

SEQ ID NO: 2317702 - DNA, 22 bp, Homo sapiens
tgagataccacaaaccctgctg

SEQ ID NO: 2317703 - DNA, 21 bp, Homo sapiens
tgagatcgtgctactgcactc

SEQ ID NO: 2317704 - DNA, 20 bp, Homo sapiens
tgagatctgctgtcctgttt

SEQ ID NO: 2317705 - DNA, 22 bp, Homo sapiens
tgagatctgctgtcctgtttct

SEQ ID NO: 2317706 - DNA, 23 bp, Homo sapiens
tgagatgtcttcaatggaataca

SEQ ID NO: 2317707 - DNA, 15 bp, Homo sapiens
tgagatttcttattt

SEQ ID NO: 2317708 - DNA, 12 bp, Homo sapiens
tgagcagaacag

SEQ ID NO: 2317709 - DNA, 16 bp, Homo sapiens
tgagcagaacaggtag

SEQ ID NO: 2317710 - DNA, 23 bp, Homo sapiens
tgagcagcctctggacagccagt

SEQ ID NO: 2317711 - DNA, 18 bp, Homo sapiens
tgagcaggctgtggggtg

SEQ ID NO: 2317712 - DNA, 17 bp, Homo sapiens
tgagccaccgtgcctgg

SEQ ID NO: 2317713 - DNA, 19 bp, Homo sapiens
tgagccccagtgctggaag

SEQ ID NO: 2317714 - DNA, 19 bp, Homo sapiens
tgagccgggcccctgggct

SEQ ID NO: 2317715 - DNA, 18 bp, Homo sapiens
tgagcctcctgtgcctgg

SEQ ID NO: 2317716 - DNA, 22 bp, Homo sapiens
tgagcctcctgtgcctggcccc

SEQ ID NO: 2317717 - DNA, 24 bp, Homo sapiens
tgagcctcctgtgcctggccccag

SEQ ID NO: 2317718 - DNA, 17 bp, Homo sapiens
tgagcctgctggaagcc

SEQ ID NO: 2317719 - DNA, 21 bp, Homo sapiens
tgagctaaataaagatattgt

SEQ ID NO: 2317720 - DNA, 15 bp, Homo sapiens
tgagctattcacctc

SEQ ID NO: 2317721 - DNA, 15 bp, Homo sapiens
tgagctatttcatct

SEQ ID NO: 2317722 - DNA, 18 bp, Homo sapiens
tgagctattttcctctgg

SEQ ID NO: 2317723 - DNA, 20 bp, Homo sapiens
tgagctcctgtcccctgcta

SEQ ID NO: 2317724 - DNA, 21 bp, Homo sapiens
tgagctcctgtcccctgctac

SEQ ID NO: 2317725 - DNA, 15 bp, Homo sapiens
tgagctctgaaatct

SEQ ID NO: 2317726 - DNA, 11 bp, Homo sapiens
tgagctgcctt

SEQ ID NO: 2317727 - DNA, 15 bp, Homo sapiens
tgagctgccttccct

SEQ ID NO: 2317728 - DNA, 12 bp, Homo sapiens
tgagctgctcat

SEQ ID NO: 2317729 - DNA, 19 bp, Homo sapiens
tgagctggatagacttggg

SEQ ID NO: 2317730 - DNA, 15 bp, Homo sapiens
tgagctgtaaaaatg

SEQ ID NO: 2317731 - DNA, 15 bp, Homo sapiens
tgaggaatatcacac

SEQ ID NO: 2317732 - DNA, 15 bp, Homo sapiens
tgaggaatttcacct

SEQ ID NO: 2317733 - DNA, 22 bp, Homo sapiens
tgaggaggggagggtaaataaa

SEQ ID NO: 2317734 - DNA, 13 bp, Homo sapiens
tgaggagggtggg

SEQ ID NO: 2317735 - DNA, 17 bp, Homo sapiens
tgaggagggtgggggag

SEQ ID NO: 2317736 - DNA, 15 bp, Homo sapiens
tgaggagtaaaattc

SEQ ID NO: 2317737 - DNA, 15 bp, Homo sapiens
tgaggcactggcgag

SEQ ID NO: 2317738 - DNA, 14 bp, Homo sapiens
tgaggcccagcctg

SEQ ID NO: 2317739 - DNA, 16 bp, Homo sapiens
tgaggcccagcctgtc

SEQ ID NO: 2317740 - DNA, 18 bp, Homo sapiens
tgaggcggaggctgtgct

SEQ ID NO: 2317741 - DNA, 19 bp, Homo sapiens
tgaggcggaggctgtgctc

SEQ ID NO: 2317742 - DNA, 19 bp, Homo sapiens
tgaggctgggggagagccg

SEQ ID NO: 2317743 - DNA, 17 bp, Homo sapiens
taactattgggtgaata

SEQ ID NO: 2317744 - DNA, 18 bp, Homo sapiens
taactattgggtgaatat

SEQ ID NO: 2317745 - DNA, 20 bp, Homo sapiens
taactcaaatacacatttgc

SEQ ID NO: 2317746 - DNA, 15 bp, Homo sapiens
taactcaccagcccc

SEQ ID NO: 2317747 - DNA, 22 bp, Homo sapiens
taactcataatttttgcagaaa

SEQ ID NO: 2317748 - DNA, 14 bp, Homo sapiens
taactctctttcct

SEQ ID NO: 2317749 - DNA, 17 bp, Homo sapiens
taactctctttccttga

SEQ ID NO: 2317750 - DNA, 16 bp, Homo sapiens
taactctgtataatag

SEQ ID NO: 2317751 - DNA, 22 bp, Homo sapiens
taactgtcaggctgaaaacaat

SEQ ID NO: 2317752 - DNA, 16 bp, Homo sapiens
taacttaactgaaatg

SEQ ID NO: 2317753 - DNA, 15 bp, Homo sapiens
taacttccaaataaa

SEQ ID NO: 2317754 - DNA, 19 bp, Homo sapiens
taacttccaaataaataat

SEQ ID NO: 2317755 - DNA, 19 bp, Homo sapiens
taacttgcttaaatttctt

SEQ ID NO: 2317756 - DNA, 17 bp, Homo sapiens
tctagtgtccataaata

SEQ ID NO: 2317757 - DNA, 16 bp, Homo sapiens
tctatggcttatttct

SEQ ID NO: 2317758 - DNA, 17 bp, Homo sapiens
tctatggcttatttcta

SEQ ID NO: 2317759 - DNA, 19 bp, Homo sapiens
tctatggcttatttctatg

SEQ ID NO: 2317760 - DNA, 21 bp, Homo sapiens
tctatggcttatttctatgac

SEQ ID NO: 2317761 - DNA, 21 bp, Homo sapiens
tctattaatatcaactctgaa

SEQ ID NO: 2317762 - DNA, 21 bp, Homo sapiens
tctattaatcaagagaaactt

SEQ ID NO: 2317763 - DNA, 14 bp, Homo sapiens
tctatttataatac

SEQ ID NO: 2317764 - DNA, 18 bp, Homo sapiens
tctatttgaataaattat

SEQ ID NO: 2317765 - DNA, 13 bp, Homo sapiens
tctatttggggct

SEQ ID NO: 2317766 - DNA, 15 bp, Homo sapiens
tctattttaattact

SEQ ID NO: 2317767 - DNA, 11 bp, Homo sapiens
tctcaaaggag

SEQ ID NO: 2317768 - DNA, 20 bp, Homo sapiens
tctcaaagttttgaaaagct

SEQ ID NO: 2317769 - DNA, 15 bp, Homo sapiens
tctcaagctagtgtt

SEQ ID NO: 2317770 - DNA, 20 bp, Homo sapiens
tctcaagctagtgtttctag

SEQ ID NO: 2317771 - DNA, 22 bp, Homo sapiens
tctcaagtaacatgacttcctt

SEQ ID NO: 2317772 - DNA, 23 bp, Homo sapiens
tctcaatgtcttcccacaaatgg

SEQ ID NO: 2317773 - DNA, 21 bp, Homo sapiens
tctcacctctaggtccccata

SEQ ID NO: 2317774 - DNA, 16 bp, Homo sapiens
tctcactgcttgaact

SEQ ID NO: 2317775 - DNA, 17 bp, Homo sapiens
tctcactttactttcaa

SEQ ID NO: 2317776 - DNA, 20 bp, Homo sapiens
tctcactttactttcaagta

SEQ ID NO: 2317777 - DNA, 12 bp, Homo sapiens
tctcagaagcac

SEQ ID NO: 2317778 - DNA, 14 bp, Homo sapiens
tctcagaagcacag

SEQ ID NO: 2317779 - DNA, 16 bp, Homo sapiens
tctcagaagcacagaa

SEQ ID NO: 2317780 - DNA, 18 bp, Homo sapiens
tctcagatttctgaggaa

SEQ ID NO: 2317781 - DNA, 13 bp, Homo sapiens
tctcagctttgag

SEQ ID NO: 2317782 - DNA, 19 bp, Homo sapiens
tctcagctttgagaagcct

SEQ ID NO: 2317783 - DNA, 23 bp, Homo sapiens
tctcaggacagcatcccttccca

SEQ ID NO: 2317784 - DNA, 11 bp, Homo sapiens
tctcaggcagc

SEQ ID NO: 2317785 - DNA, 19 bp, Homo sapiens
tctcagtcatgcataaata

SEQ ID NO: 2317786 - DNA, 21 bp, Homo sapiens
tctcagtcatgcataaatatg

SEQ ID NO: 2317787 - DNA, 23 bp, Homo sapiens
tctcagtcatgcataaatatgca

SEQ ID NO: 2317788 - DNA, 14 bp, Homo sapiens
tctcagtgccctcc

SEQ ID NO: 2317789 - DNA, 13 bp, Homo sapiens
tctcagtgttggt

SEQ ID NO: 2317790 - DNA, 16 bp, Homo sapiens
tctcagttctcttgct

SEQ ID NO: 2317791 - DNA, 16 bp, Homo sapiens
tctcataggttaaaaa

SEQ ID NO: 2317792 - DNA, 17 bp, Homo sapiens
tctcataggttaaaaaa

SEQ ID NO: 2317793 - DNA, 14 bp, Homo sapiens
tctcatgaagcagg

SEQ ID NO: 2317794 - DNA, 14 bp, Homo sapiens
tctcatgtcaatga

SEQ ID NO: 2317795 - DNA, 21 bp, Homo sapiens
tctcattcccatgtggaacag

SEQ ID NO: 2317796 - DNA, 20 bp, Homo sapiens
tctccaaccactgtgccact

SEQ ID NO: 2317797 - DNA, 22 bp, Homo sapiens
tctccacagtgttgtgcccctt

SEQ ID NO: 2317798 - DNA, 14 bp, Homo sapiens
tctccacccacctt

SEQ ID NO: 2317799 - DNA, 22 bp, Homo sapiens
tctccacctacacccctgtgct

SEQ ID NO: 2317800 - DNA, 18 bp, Homo sapiens
tctccactgctggacatg

SEQ ID NO: 2317801 - DNA, 21 bp, Homo sapiens
tctccatcaccctcttcctgt

SEQ ID NO: 2317802 - DNA, 16 bp, Homo sapiens
tctccatctcccaagg

SEQ ID NO: 2317803 - DNA, 18 bp, Homo sapiens
tctccattctgctccttc

SEQ ID NO: 2317804 - DNA, 21 bp, Homo sapiens
tctccattctgctccttcccc

SEQ ID NO: 2317805 - DNA, 16 bp, Homo sapiens
tctcccaaggctgcca

SEQ ID NO: 2317806 - DNA, 20 bp, Homo sapiens
tctcccaccctcttcctact

SEQ ID NO: 2317807 - DNA, 15 bp, Homo sapiens
tctcccactctccta

SEQ ID NO: 2317808 - DNA, 21 bp, Homo sapiens
tctcccagtgaactcctgcca

SEQ ID NO: 2317809 - DNA, 14 bp, Homo sapiens
tctccccagagctg

SEQ ID NO: 2317810 - DNA, 19 bp, Homo sapiens
tctccccagagctgcctgc

SEQ ID NO: 2317811 - DNA, 16 bp, Homo sapiens
tctccctagctcctcc

SEQ ID NO: 2317812 - DNA, 19 bp, Homo sapiens
tctccctcaactgaagggg

SEQ ID NO: 2317813 - DNA, 22 bp, Homo sapiens
tctccctccctctctcatgaga

SEQ ID NO: 2317814 - DNA, 17 bp, Homo sapiens
tctccctgcctggcccc

SEQ ID NO: 2317815 - DNA, 20 bp, Homo sapiens
tctccctggctccctcctcc

SEQ ID NO: 2317816 - DNA, 14 bp, Homo sapiens
tctcccttgggctc

SEQ ID NO: 2317817 - DNA, 16 bp, Homo sapiens
tctcccttgggctctg

SEQ ID NO: 2317818 - DNA, 13 bp, Homo sapiens
tctccgccagcct

SEQ ID NO: 2317819 - DNA, 20 bp, Homo sapiens
tctccgccagcctcctctgg

SEQ ID NO: 2317820 - DNA, 14 bp, Homo sapiens
tctcctccccttcc

SEQ ID NO: 2317821 - DNA, 15 bp, Homo sapiens
tctcctctcccccag

SEQ ID NO: 2317822 - DNA, 22 bp, Homo sapiens
tctcctcttcatggcatcttca

SEQ ID NO: 2317823 - DNA, 13 bp, Homo sapiens
tctccttgaaatg

SEQ ID NO: 2317824 - DNA, 15 bp, Homo sapiens
tctcgccatgatcag

SEQ ID NO: 2317825 - DNA, 16 bp, Homo sapiens
tctcgctccctcccag

SEQ ID NO: 2317826 - DNA, 18 bp, Homo sapiens
tctcgctccctcccagga

SEQ ID NO: 2317827 - DNA, 18 bp, Homo sapiens
tctcggccttcacaatct

SEQ ID NO: 2317828 - DNA, 17 bp, Homo sapiens
tctcgtggtagaagcca

SEQ ID NO: 2317829 - DNA, 14 bp, Homo sapiens
tctctactaaaaat

SEQ ID NO: 2317830 - DNA, 13 bp, Homo sapiens
tctctagcacaat

SEQ ID NO: 2317831 - DNA, 17 bp, Homo sapiens
tctctagtagttagaaa

SEQ ID NO: 2317832 - DNA, 14 bp, Homo sapiens
tctctattaaaatg

SEQ ID NO: 2317833 - DNA, 21 bp, Homo sapiens
tctctcaaaagagaaaaacaa

SEQ ID NO: 2317834 - DNA, 19 bp, Homo sapiens
tctctcatgagaagccaag

SEQ ID NO: 2317835 - DNA, 21 bp, Homo sapiens
tctctccctccctctctcatg

SEQ ID NO: 2317836 - DNA, 11 bp, Homo sapiens
tctctcctggc

SEQ ID NO: 2317837 - DNA, 13 bp, Homo sapiens
tctctccttgccc

SEQ ID NO: 2317838 - DNA, 15 bp, Homo sapiens
tctctccttgccccc

SEQ ID NO: 2317839 - DNA, 14 bp, Homo sapiens
tctctctctaaggt

SEQ ID NO: 2317840 - DNA, 19 bp, Homo sapiens
tctctctttcctccaccca

SEQ ID NO: 2317841 - DNA, 13 bp, Homo sapiens
tctctgaagccac

SEQ ID NO: 2317842 - DNA, 20 bp, Homo sapiens
tctctgacgcttgtgacagt

SEQ ID NO: 2317843 - DNA, 14 bp, Homo sapiens
tctctgcagatgtg

SEQ ID NO: 2317844 - DNA, 13 bp, Homo sapiens
tctctgctatata

SEQ ID NO: 2317845 - DNA, 17 bp, Homo sapiens
tctctgctggggaaggg

SEQ ID NO: 2317846 - DNA, 18 bp, Homo sapiens
tctctgtggctccaggcc

SEQ ID NO: 2317847 - DNA, 21 bp, Homo sapiens
tctcttaggtgagacagttgc

SEQ ID NO: 2317848 - DNA, 22 bp, Homo sapiens
tctcttatcctctctctcttct

SEQ ID NO: 2317849 - DNA, 17 bp, Homo sapiens
tctcttcactaccctga

SEQ ID NO: 2317850 - DNA, 19 bp, Homo sapiens
tctcttcattattctctgc

SEQ ID NO: 2317851 - DNA, 13 bp, Homo sapiens
tctcttccccaga

SEQ ID NO: 2317852 - DNA, 17 bp, Homo sapiens
tctcttctcagagtggt

SEQ ID NO: 2317853 - DNA, 22 bp, Homo sapiens
tctcttctgagctatttcatct

SEQ ID NO: 2317854 - DNA, 20 bp, Homo sapiens
tctcttgctttcacattgta

SEQ ID NO: 2317855 - DNA, 14 bp, Homo sapiens
tctctttggaaata

SEQ ID NO: 2317856 - DNA, 21 bp, Homo sapiens
tctcttttcccctttcctgtc

SEQ ID NO: 2317857 - DNA, 20 bp, Homo sapiens
tcttcatgagtagtgggcta

SEQ ID NO: 2317858 - DNA, 18 bp, Homo sapiens
tcttccaacatgtgatgt

SEQ ID NO: 2317859 - DNA, 22 bp, Homo sapiens
tcttccaacatgtgatgtgttg

SEQ ID NO: 2317860 - DNA, 18 bp, Homo sapiens
tcttccagtcttcctgac

SEQ ID NO: 2317861 - DNA, 21 bp, Homo sapiens
tcttccagtcttcctgacact

SEQ ID NO: 2317862 - DNA, 19 bp, Homo sapiens
tcttccctgaacgttttct

SEQ ID NO: 2317863 - DNA, 23 bp, Homo sapiens
tcttccctgaacgttttcttctt

SEQ ID NO: 2317864 - DNA, 13 bp, Homo sapiens
tcttccctgggct

SEQ ID NO: 2317865 - DNA, 20 bp, Homo sapiens
tcttcctactggtctctcta

SEQ ID NO: 2317866 - DNA, 19 bp, Homo sapiens
tcttcctatccctctccta

SEQ ID NO: 2317867 - DNA, 13 bp, Homo sapiens
tcttcctgacact

SEQ ID NO: 2317868 - DNA, 13 bp, Homo sapiens
tcttcctgtgatc

SEQ ID NO: 2317869 - DNA, 17 bp, Homo sapiens
tcttcgggaccaggatt

SEQ ID NO: 2317870 - DNA, 14 bp, Homo sapiens
tcttctaggcccat

SEQ ID NO: 2317871 - DNA, 20 bp, Homo sapiens
tcttctaggcccattgtcct

SEQ ID NO: 2317872 - DNA, 19 bp, Homo sapiens
tcttctattaatcaagaga

SEQ ID NO: 2317873 - DNA, 20 bp, Homo sapiens
tcttctattaatcaagagaa

SEQ ID NO: 2317874 - DNA, 16 bp, Homo sapiens
ctggagacaaggtgct

SEQ ID NO: 2317875 - DNA, 17 bp, Homo sapiens
ctggagacaaggtgcta

SEQ ID NO: 2317876 - DNA, 15 bp, Homo sapiens
ctggagcatcccagg

SEQ ID NO: 2317877 - DNA, 20 bp, Homo sapiens
ctggagctcatctgcaaaag

SEQ ID NO: 2317878 - DNA, 20 bp, Homo sapiens
ctggaggaagtggggtctgg

SEQ ID NO: 2317879 - DNA, 13 bp, Homo sapiens
ctggaggcctcag

SEQ ID NO: 2317880 - DNA, 16 bp, Homo sapiens
ctggaggcctcaggtg

SEQ ID NO: 2317881 - DNA, 16 bp, Homo sapiens
ctggaggttgaagcca

SEQ ID NO: 2317882 - DNA, 16 bp, Homo sapiens
ctggagtgcagtggca

SEQ ID NO: 2317883 - DNA, 16 bp, Homo sapiens
ctggatagacttggga

SEQ ID NO: 2317884 - DNA, 16 bp, Homo sapiens
ctggatgatggattcc

SEQ ID NO: 2317885 - DNA, 18 bp, Homo sapiens
ctggatggcacctcaggc

SEQ ID NO: 2317886 - DNA, 15 bp, Homo sapiens
ctggatggggcaggc

SEQ ID NO: 2317887 - DNA, 17 bp, Homo sapiens
ctggcaaaccctcccag

SEQ ID NO: 2317888 - DNA, 12 bp, Homo sapiens
ctggcacacatc

SEQ ID NO: 2317889 - DNA, 21 bp, Homo sapiens
ctggcacacatcaggagttca

SEQ ID NO: 2317890 - DNA, 18 bp, Homo sapiens
ctggcactgggaggcagg

SEQ ID NO: 2317891 - DNA, 16 bp, Homo sapiens
ctggcagcccagagac

SEQ ID NO: 2317892 - DNA, 20 bp, Homo sapiens
ctggccaccagccatcctcc

SEQ ID NO: 2317893 - DNA, 20 bp, Homo sapiens
ctggccagtccaccctgcct

SEQ ID NO: 2317894 - DNA, 22 bp, Homo sapiens
ctggccagtccaccctgcctgc

SEQ ID NO: 2317895 - DNA, 13 bp, Homo sapiens
ctggccatggcct

SEQ ID NO: 2317896 - DNA, 22 bp, Homo sapiens
ctggccatggcctgcaaactgg

SEQ ID NO: 2317897 - DNA, 17 bp, Homo sapiens
ctggcccagaaagcctc

SEQ ID NO: 2317898 - DNA, 22 bp, Homo sapiens
ctggcccagaaagcctctctct

SEQ ID NO: 2317899 - DNA, 19 bp, Homo sapiens
ctggccccagccctgctgg

SEQ ID NO: 2317900 - DNA, 18 bp, Homo sapiens
ctggccccagcctgggcc

SEQ ID NO: 2317901 - DNA, 12 bp, Homo sapiens
ctggccccaggc

SEQ ID NO: 2317902 - DNA, 14 bp, Homo sapiens
ctggcccctctccc

SEQ ID NO: 2317903 - DNA, 15 bp, Homo sapiens
ctggcccctctccct

SEQ ID NO: 2317904 - DNA, 13 bp, Homo sapiens
ctggccgcagagg

SEQ ID NO: 2317905 - DNA, 14 bp, Homo sapiens
ctggcctctctagc

SEQ ID NO: 2317906 - DNA, 15 bp, Homo sapiens
ctggcctgagagtca

SEQ ID NO: 2317907 - DNA, 19 bp, Homo sapiens
ctggcctgagagtcagctc

SEQ ID NO: 2317908 - DNA, 23 bp, Homo sapiens
ctggcctgagagtcagctctctg

SEQ ID NO: 2317909 - DNA, 23 bp, Homo sapiens
ctggcctggacagtatcccacat

SEQ ID NO: 2317910 - DNA, 17 bp, Homo sapiens
ctggcctggcacacatc

SEQ ID NO: 2317911 - DNA, 22 bp, Homo sapiens
ctggcctggcacacatcaggag

SEQ ID NO: 2317912 - DNA, 19 bp, Homo sapiens
ctggcctggccatactgtg

SEQ ID NO: 2317913 - DNA, 23 bp, Homo sapiens
ctggctccccctccccaggctgg

SEQ ID NO: 2317914 - DNA, 17 bp, Homo sapiens
ctggctccctcctccag

SEQ ID NO: 2317915 - DNA, 17 bp, Homo sapiens
ctggctctaccctgtct

SEQ ID NO: 2317916 - DNA, 22 bp, Homo sapiens
ctggctctaccctgtctgtccc

SEQ ID NO: 2317917 - DNA, 21 bp, Homo sapiens
ctggctctaccttcctgtccc

SEQ ID NO: 2317918 - DNA, 13 bp, Homo sapiens
ctggctctcacct

SEQ ID NO: 2317919 - DNA, 23 bp, Homo sapiens
ctggctgaggttcctctgcctgc

SEQ ID NO: 2317920 - DNA, 16 bp, Homo sapiens
ctggctgctgccccca

SEQ ID NO: 2317921 - DNA, 15 bp, Homo sapiens
ctggctttgctctat

SEQ ID NO: 2317922 - DNA, 23 bp, Homo sapiens
ctgggaacatcacattcctctgc

SEQ ID NO: 2317923 - DNA, 19 bp, Homo sapiens
ctgggaagaagcaagggca

SEQ ID NO: 2317924 - DNA, 21 bp, Homo sapiens
ctgggaagaagcaagggcaag

SEQ ID NO: 2317925 - DNA, 13 bp, Homo sapiens
ctgggaaggagga

SEQ ID NO: 2317926 - DNA, 22 bp, Homo sapiens
ctgggacggaccagcatctgga

SEQ ID NO: 2317927 - DNA, 14 bp, Homo sapiens
ctgggacttccatg

SEQ ID NO: 2317928 - DNA, 14 bp, Homo sapiens
ctgggaggagggag

SEQ ID NO: 2317929 - DNA, 16 bp, Homo sapiens
ctgggaggagggagag

SEQ ID NO: 2317930 - DNA, 17 bp, Homo sapiens
ctgggaggagggagagg

SEQ ID NO: 2317931 - DNA, 19 bp, Homo sapiens
ctgggaggcagggctctcc

SEQ ID NO: 2317932 - DNA, 17 bp, Homo sapiens
ctgggaggctccccttc

SEQ ID NO: 2317933 - DNA, 13 bp, Homo sapiens
ctgggcacctgac

SEQ ID NO: 2317934 - DNA, 19 bp, Homo sapiens
ctgggcacgcctgctggcc

SEQ ID NO: 2317935 - DNA, 21 bp, Homo sapiens
ctgggcacgcctgctggccga

SEQ ID NO: 2317936 - DNA, 13 bp, Homo sapiens
ctgggccatctct

SEQ ID NO: 2317937 - DNA, 17 bp, Homo sapiens
ctgggccatgtccaaag

SEQ ID NO: 2317938 - DNA, 19 bp, Homo sapiens
ctgggccatgtccaaagag

SEQ ID NO: 2317939 - DNA, 23 bp, Homo sapiens
ctgggccatgtccaaagaggctg

SEQ ID NO: 2317940 - DNA, 17 bp, Homo sapiens
ctgggcggctgtgcttc

SEQ ID NO: 2317941 - DNA, 20 bp, Homo sapiens
ctgggctgccaccagccccc

SEQ ID NO: 2317942 - DNA, 20 bp, Homo sapiens
ctgggctgccatgtgaagag

SEQ ID NO: 2317943 - DNA, 13 bp, Homo sapiens
ctgggctgggcac

SEQ ID NO: 2317944 - DNA, 15 bp, Homo sapiens
ctgggcttcattctg

SEQ ID NO: 2317945 - DNA, 17 bp, Homo sapiens
ctgggcttcattctgga

SEQ ID NO: 2317946 - DNA, 18 bp, Homo sapiens
ctgggcttggcctgctgt

SEQ ID NO: 2317947 - DNA, 20 bp, Homo sapiens
ctggggaaacaacatttata

SEQ ID NO: 2317948 - DNA, 17 bp, Homo sapiens
ctggggaaactggccat

SEQ ID NO: 2317949 - DNA, 17 bp, Homo sapiens
ctggggaggaccagggc

SEQ ID NO: 2317950 - DNA, 14 bp, Homo sapiens
ctggggcaggctgg

SEQ ID NO: 2317951 - DNA, 16 bp, Homo sapiens
ctggggcaggctgggc

SEQ ID NO: 2317952 - DNA, 17 bp, Homo sapiens
ctggggcaggctgggcc

SEQ ID NO: 2317953 - DNA, 18 bp, Homo sapiens
ctggggcaggctgggcca

SEQ ID NO: 2317954 - DNA, 21 bp, Homo sapiens
ctggggcaggctgggccatgt

SEQ ID NO: 2317955 - DNA, 13 bp, Homo sapiens
ctggggccagagg

SEQ ID NO: 2317956 - DNA, 13 bp, Homo sapiens
ctggggcccagcc

SEQ ID NO: 2317957 - DNA, 16 bp, Homo sapiens
ctggggcccagcccct

SEQ ID NO: 2317958 - DNA, 24 bp, Homo sapiens
ctggggcctagcgatctctcctgg

SEQ ID NO: 2317959 - DNA, 21 bp, Homo sapiens
ctggtatttctaattccacag

SEQ ID NO: 2317960 - DNA, 12 bp, Homo sapiens
ctggtcagtctt

SEQ ID NO: 2317961 - DNA, 18 bp, Homo sapiens
ctggtcagtctttgctca

SEQ ID NO: 2317962 - DNA, 19 bp, Homo sapiens
ctggtcagtctttgctcag

SEQ ID NO: 2317963 - DNA, 20 bp, Homo sapiens
ctggtcagtctttgctcagt

SEQ ID NO: 2317964 - DNA, 23 bp, Homo sapiens
ctggtctctctatgcctctctac

SEQ ID NO: 2317965 - DNA, 21 bp, Homo sapiens
ctggtctggttgggcagccag

SEQ ID NO: 2317966 - DNA, 13 bp, Homo sapiens
ctggtgactcctg

SEQ ID NO: 2317967 - DNA, 14 bp, Homo sapiens
ctggtgaggcccag

SEQ ID NO: 2317968 - DNA, 16 bp, Homo sapiens
ctggtgaggcccagcc

SEQ ID NO: 2317969 - DNA, 18 bp, Homo sapiens
ctggtgaggcccagcctg

SEQ ID NO: 2317970 - DNA, 19 bp, Homo sapiens
ctggtgaggttgaggaata

SEQ ID NO: 2317971 - DNA, 16 bp, Homo sapiens
ctggtgccaatttcaa

SEQ ID NO: 2317972 - DNA, 15 bp, Homo sapiens
ctggtggacccaggg

SEQ ID NO: 2317973 - DNA, 20 bp, Homo sapiens
ctggtggagaactctggctt

SEQ ID NO: 2317974 - DNA, 20 bp, Homo sapiens
ctggtggcttaagtgagcag

SEQ ID NO: 2317975 - DNA, 23 bp, Homo sapiens
ctggtggcttaagtgagcagaac

SEQ ID NO: 2317976 - DNA, 17 bp, Homo sapiens
ctggttaccactctttt

SEQ ID NO: 2317977 - DNA, 14 bp, Homo sapiens
ctggttactttcaa

SEQ ID NO: 2317978 - DNA, 22 bp, Homo sapiens
ctggtttgtggggcacagatgc

SEQ ID NO: 2317979 - DNA, 12 bp, Homo sapiens
ctgtaaactgtg

SEQ ID NO: 2317980 - DNA, 20 bp, Homo sapiens
ctgtaaactgtgtattccaa

SEQ ID NO: 2317981 - DNA, 16 bp, Homo sapiens
ctgtaactattgggtg

SEQ ID NO: 2317982 - DNA, 16 bp, Homo sapiens
ctgtaacttccaaata

SEQ ID NO: 2317983 - DNA, 19 bp, Homo sapiens
ctgtaacttccaaataaat

SEQ ID NO: 2317984 - DNA, 12 bp, Homo sapiens
ctgtaagagctt

SEQ ID NO: 2317985 - DNA, 20 bp, Homo sapiens
ctgtaagagcttgctccaga

SEQ ID NO: 2317986 - DNA, 12 bp, Homo sapiens
ctgtaataatag

SEQ ID NO: 2317987 - DNA, 17 bp, Homo sapiens
ctgtaatcccagcactt

SEQ ID NO: 2317988 - DNA, 16 bp, Homo sapiens
ctgtacacgtgtcctg

SEQ ID NO: 2317989 - DNA, 17 bp, Homo sapiens
ctgtacacgtgtcctgt

SEQ ID NO: 2317990 - DNA, 17 bp, Homo sapiens
ctgtacttcttgaatat

SEQ ID NO: 2317991 - DNA, 15 bp, Homo sapiens
ctgtagaaacaaagg

SEQ ID NO: 2317992 - DNA, 14 bp, Homo sapiens
ctgtagatatgtat

SEQ ID NO: 2317993 - DNA, 14 bp, Homo sapiens
ctgtagccacagct

SEQ ID NO: 2317994 - DNA, 15 bp, Homo sapiens
ctgtagccacagctg

SEQ ID NO: 2317995 - DNA, 18 bp, Homo sapiens
ctgtagcctaaaacgaat

SEQ ID NO: 2317996 - DNA, 23 bp, Homo sapiens
ctgtagcctaaaacgaatggtct

SEQ ID NO: 2317997 - DNA, 19 bp, Homo sapiens
ctgtagctcccgagctact

SEQ ID NO: 2317998 - DNA, 17 bp, Homo sapiens
ctgtagtttagttctgt

SEQ ID NO: 2317999 - DNA, 20 bp, Homo sapiens
ctgtataaataggagaggat

SEQ ID NO: 2318000 - DNA, 18 bp, Homo sapiens
ctgtataatagagataag

SEQ ID NO: 2318001 - DNA, 13 bp, Homo sapiens
ctgtatacagtgc

SEQ ID NO: 2318002 - DNA, 23 bp, Homo sapiens
ctgtatattttgtagttaatata

SEQ ID NO: 2318003 - DNA, 15 bp, Homo sapiens
ctgtcaatcacagtc

SEQ ID NO: 2318004 - DNA, 20 bp, Homo sapiens
ctgtcaatcacagtctcagt

SEQ ID NO: 2318005 - DNA, 15 bp, Homo sapiens
ctgtcaatgggacct

SEQ ID NO: 2318006 - DNA, 23 bp, Homo sapiens
ctgtcaccaccctgctcatccac

SEQ ID NO: 2318007 - DNA, 19 bp, Homo sapiens
ctgtcaccctccaccgagc

SEQ ID NO: 2318008 - DNA, 18 bp, Homo sapiens
ctgtcaggctgaaaacaa

SEQ ID NO: 2318009 - DNA, 15 bp, Homo sapiens
ctgtcattgcacata

SEQ ID NO: 2318010 - DNA, 19 bp, Homo sapiens
ctgtccaaaagcgccctca

SEQ ID NO: 2318011 - DNA, 22 bp, Homo sapiens
ctgtccaaaagcgccctcacta

SEQ ID NO: 2318012 - DNA, 14 bp, Homo sapiens
ctgtccacgcgtgc

SEQ ID NO: 2318013 - DNA, 22 bp, Homo sapiens
ctgtccagctggggccagaggc

SEQ ID NO: 2318014 - DNA, 23 bp, Homo sapiens
ctgtccagctggggccagaggct

SEQ ID NO: 2318015 - DNA, 12 bp, Homo sapiens
ctgtccaggcag

SEQ ID NO: 2318016 - DNA, 21 bp, Homo sapiens
ctgtccaggcagctccctcct

SEQ ID NO: 2318017 - DNA, 18 bp, Homo sapiens
ctgtccaggtagaaaaga

SEQ ID NO: 2318018 - DNA, 14 bp, Homo sapiens
ctgtccagtgccta

SEQ ID NO: 2318019 - DNA, 13 bp, Homo sapiens
ctgtcccagcccc

SEQ ID NO: 2318020 - DNA, 20 bp, Homo sapiens
ctgtcccaggccggcccaga

SEQ ID NO: 2318021 - DNA, 13 bp, Homo sapiens
ctgtccccaaagg

SEQ ID NO: 2318022 - DNA, 14 bp, Homo sapiens
ctgtcccccaggct

SEQ ID NO: 2318023 - DNA, 16 bp, Homo sapiens
ctgtcccggttcacct

SEQ ID NO: 2318024 - DNA, 13 bp, Homo sapiens
ctgtccctgaggt

SEQ ID NO: 2318025 - DNA, 15 bp, Homo sapiens
ctgtccctgtagctc

SEQ ID NO: 2318026 - DNA, 13 bp, Homo sapiens
ctgtcccttttct

SEQ ID NO: 2318027 - DNA, 14 bp, Homo sapiens
ctgtccgcctctgc

SEQ ID NO: 2318028 - DNA, 16 bp, Homo sapiens
ctgtccgcctctgccc

SEQ ID NO: 2318029 - DNA, 21 bp, Homo sapiens
ctgtccgcctctgcccgcaga

SEQ ID NO: 2318030 - DNA, 20 bp, Homo sapiens
ctgtccggaatgccacccac

SEQ ID NO: 2318031 - DNA, 21 bp, Homo sapiens
ctgtccggaatgccacccaca

SEQ ID NO: 2318032 - DNA, 13 bp, Homo sapiens
ctgtctaggactg

SEQ ID NO: 2318033 - DNA, 20 bp, Homo sapiens
ctgtctaggactgcagtgtg

SEQ ID NO: 2318034 - DNA, 21 bp, Homo sapiens
ctgtctcaaaaaaaaaaagaa

SEQ ID NO: 2318035 - DNA, 23 bp, Homo sapiens
ctgtctcaaaaaaaaaaagaaaa

SEQ ID NO: 2318036 - DNA, 23 bp, Homo sapiens
ctgtctccctcccctctcagaac

SEQ ID NO: 2318037 - DNA, 11 bp, Homo sapiens
ctgtctgcccc

SEQ ID NO: 2318038 - DNA, 18 bp, Homo sapiens
ctgtctgccccagcccag

SEQ ID NO: 2318039 - DNA, 17 bp, Homo sapiens
ctgtctgggtgctactg

SEQ ID NO: 2318040 - DNA, 14 bp, Homo sapiens
ctgtctgtgaacag

SEQ ID NO: 2318041 - DNA, 14 bp, Homo sapiens
ctgtcttcctcaaa

SEQ ID NO: 2318042 - DNA, 15 bp, Homo sapiens
ctgtctttcagatac

SEQ ID NO: 2318043 - DNA, 16 bp, Homo sapiens
ctgtctttcagataca

SEQ ID NO: 2318044 - DNA, 20 bp, Homo sapiens
ctgtctttcagatacatggt

SEQ ID NO: 2318045 - DNA, 20 bp, Homo sapiens
ctgtgaacaagcttcagtaa

SEQ ID NO: 2318046 - DNA, 16 bp, Homo sapiens
ctgtgaactaatgaca

SEQ ID NO: 2318047 - DNA, 14 bp, Homo sapiens
ctgtgaagatctca

SEQ ID NO: 2318048 - DNA, 16 bp, Homo sapiens
ctgtgacatggtgcct

SEQ ID NO: 2318049 - DNA, 22 bp, Homo sapiens
ctgtgacatggtgcctgagagg

SEQ ID NO: 2318050 - DNA, 14 bp, Homo sapiens
ctgtgagccccaca

SEQ ID NO: 2318051 - DNA, 15 bp, Homo sapiens
ctgtgagccccacag

SEQ ID NO: 2318052 - DNA, 16 bp, Homo sapiens
ctgtgagccccacagc

SEQ ID NO: 2318053 - DNA, 20 bp, Homo sapiens
ctgtgagccccacagccctg

SEQ ID NO: 2318054 - DNA, 16 bp, Homo sapiens
gagctgttaccattca

SEQ ID NO: 2318055 - DNA, 21 bp, Homo sapiens
gagcttaatgctacatgtgag

SEQ ID NO: 2318056 - DNA, 18 bp, Homo sapiens
gagcttcttgtttccttg

SEQ ID NO: 2318057 - DNA, 13 bp, Homo sapiens
gagcttgggcagt

SEQ ID NO: 2318058 - DNA, 17 bp, Homo sapiens
gagcttgggcagtgccc

SEQ ID NO: 2318059 - DNA, 20 bp, Homo sapiens
gagcttgggcagtgccccag

SEQ ID NO: 2318060 - DNA, 17 bp, Homo sapiens
gagctttctcaatgtct

SEQ ID NO: 2318061 - DNA, 22 bp, Homo sapiens
gagctttctcaatgtcttccca

SEQ ID NO: 2318062 - DNA, 18 bp, Homo sapiens
gaggaaccagaggcactt

SEQ ID NO: 2318063 - DNA, 18 bp, Homo sapiens
gaggaagagccacctgca

SEQ ID NO: 2318064 - DNA, 14 bp, Homo sapiens
gaggaaggattgta

SEQ ID NO: 2318065 - DNA, 21 bp, Homo sapiens
gaggaaggcaagagggggtgg

SEQ ID NO: 2318066 - DNA, 20 bp, Homo sapiens
gaggaaggcctttcttctgt

SEQ ID NO: 2318067 - DNA, 20 bp, Homo sapiens
gaggaagtggggtctggcct

SEQ ID NO: 2318068 - DNA, 16 bp, Homo sapiens
gaggaccagggccctg

SEQ ID NO: 2318069 - DNA, 20 bp, Homo sapiens
gaggacctatcccaaatgtg

SEQ ID NO: 2318070 - DNA, 20 bp, Homo sapiens
gaggacgcacgctcgctgcc

SEQ ID NO: 2318071 - DNA, 13 bp, Homo sapiens
gaggacttcaagc

SEQ ID NO: 2318072 - DNA, 16 bp, Homo sapiens
gaggaggaaggcaaga

SEQ ID NO: 2318073 - DNA, 17 bp, Homo sapiens
gaggagggagagggagg

SEQ ID NO: 2318074 - DNA, 13 bp, Homo sapiens
gaggaggggaggg

SEQ ID NO: 2318075 - DNA, 19 bp, Homo sapiens
gaggaggggcccccctgcc

SEQ ID NO: 2318076 - DNA, 12 bp, Homo sapiens
gaggagggtggg

SEQ ID NO: 2318077 - DNA, 15 bp, Homo sapiens
gaggagggtggggga

SEQ ID NO: 2318078 - DNA, 16 bp, Homo sapiens
gaggatgagagcccag

SEQ ID NO: 2318079 - DNA, 13 bp, Homo sapiens
gaggatgcctttt

SEQ ID NO: 2318080 - DNA, 15 bp, Homo sapiens
gaggatgccttttct

SEQ ID NO: 2318081 - DNA, 19 bp, Homo sapiens
gaggatgccttttctgtga

SEQ ID NO: 2318082 - DNA, 22 bp, Homo sapiens
gaggatttaagggatggaaaag

SEQ ID NO: 2318083 - DNA, 14 bp, Homo sapiens
gaggcacctgctgg

SEQ ID NO: 2318084 - DNA, 15 bp, Homo sapiens
gaggcacctgctgga

SEQ ID NO: 2318085 - DNA, 20 bp, Homo sapiens
gaggcactcagtgagcctcc

SEQ ID NO: 2318086 - DNA, 21 bp, Homo sapiens
gaggcactcagtgagcctcct

SEQ ID NO: 2318087 - DNA, 22 bp, Homo sapiens
gaggcactcagtgagcctcctg

SEQ ID NO: 2318088 - DNA, 12 bp, Homo sapiens
gaggcaggctgg

SEQ ID NO: 2318089 - DNA, 15 bp, Homo sapiens
gaggcagggctctcc

SEQ ID NO: 2318090 - DNA, 18 bp, Homo sapiens
gaggcatacacacagcag

SEQ ID NO: 2318091 - DNA, 20 bp, Homo sapiens
gaggccagttgatctgctct

SEQ ID NO: 2318092 - DNA, 14 bp, Homo sapiens
gaggccatgtgcat

SEQ ID NO: 2318093 - DNA, 21 bp, Homo sapiens
gaggcccactgtgtctaggca

SEQ ID NO: 2318094 - DNA, 21 bp, Homo sapiens
gaggcccagcctgtcctggta

SEQ ID NO: 2318095 - DNA, 13 bp, Homo sapiens
gaggccctgggct

SEQ ID NO: 2318096 - DNA, 18 bp, Homo sapiens
gaggccctgttccctgga

SEQ ID NO: 2318097 - DNA, 12 bp, Homo sapiens
gaggcccttgtc

SEQ ID NO: 2318098 - DNA, 21 bp, Homo sapiens
gaggcccttgtcgtgggatgg

SEQ ID NO: 2318099 - DNA, 13 bp, Homo sapiens
gaggcctgaagcc

SEQ ID NO: 2318100 - DNA, 14 bp, Homo sapiens
gaggcgcgtctgcc

SEQ ID NO: 2318101 - DNA, 19 bp, Homo sapiens
gaggcggaggctgtgctcc

SEQ ID NO: 2318102 - DNA, 17 bp, Homo sapiens
gaggctgggggagagcc

SEQ ID NO: 2318103 - DNA, 13 bp, Homo sapiens
gaggcttcctgcg

SEQ ID NO: 2318104 - DNA, 21 bp, Homo sapiens
gagggagttttgtctgtctcc

SEQ ID NO: 2318105 - DNA, 18 bp, Homo sapiens
gagggatttccctgcaga

SEQ ID NO: 2318106 - DNA, 18 bp, Homo sapiens
gagggcagactggggcat

SEQ ID NO: 2318107 - DNA, 20 bp, Homo sapiens
gagggcagagggagaatcca

SEQ ID NO: 2318108 - DNA, 13 bp, Homo sapiens
gagggcagctgct

SEQ ID NO: 2318109 - DNA, 21 bp, Homo sapiens
gagggcctgctggaggcctca

SEQ ID NO: 2318110 - DNA, 19 bp, Homo sapiens
gagggcttcctctagaagc

SEQ ID NO: 2318111 - DNA, 21 bp, Homo sapiens
gagggcttcctctagaagcca

SEQ ID NO: 2318112 - DNA, 14 bp, Homo sapiens
gaggggagagacag

SEQ ID NO: 2318113 - DNA, 23 bp, Homo sapiens
gaggggctggggacttgtgtctg

SEQ ID NO: 2318114 - DNA, 14 bp, Homo sapiens
gagggggccgggcg

SEQ ID NO: 2318115 - DNA, 21 bp, Homo sapiens
gagggggccgggcgcggtggc

SEQ ID NO: 2318116 - DNA, 13 bp, Homo sapiens
gagggggtggagg

SEQ ID NO: 2318117 - DNA, 18 bp, Homo sapiens
gaggtaacagaacagctt

SEQ ID NO: 2318118 - DNA, 16 bp, Homo sapiens
gaggtagcgagctgct

SEQ ID NO: 2318119 - DNA, 17 bp, Homo sapiens
gaggtaggggtggggag

SEQ ID NO: 2318120 - DNA, 16 bp, Homo sapiens
gaggtcaagtaagaag

SEQ ID NO: 2318121 - DNA, 18 bp, Homo sapiens
gaggtcactggaaagggg

SEQ ID NO: 2318122 - DNA, 20 bp, Homo sapiens
gaggtcctctggagccctaa

SEQ ID NO: 2318123 - DNA, 21 bp, Homo sapiens
gaggtccttaggcctctgaga

SEQ ID NO: 2318124 - DNA, 19 bp, Homo sapiens
gaggtgcaaggagtgtaaa

SEQ ID NO: 2318125 - DNA, 18 bp, Homo sapiens
gaggtgcactgggaggct

SEQ ID NO: 2318126 - DNA, 19 bp, Homo sapiens
gaggtgcgtgttcagcaga

SEQ ID NO: 2318127 - DNA, 18 bp, Homo sapiens
gaggtggaagaagggaga

SEQ ID NO: 2318128 - DNA, 16 bp, Homo sapiens
gaggtggagggaggga

SEQ ID NO: 2318129 - DNA, 18 bp, Homo sapiens
gaggtgggaggtggaaga

SEQ ID NO: 2318130 - DNA, 17 bp, Homo sapiens
gaggttcctctgcctgc

SEQ ID NO: 2318131 - DNA, 16 bp, Homo sapiens
gaggttgtgcactgtt

SEQ ID NO: 2318132 - DNA, 15 bp, Homo sapiens
gagtaaaaactagaa

SEQ ID NO: 2318133 - DNA, 22 bp, Homo sapiens
gagtaataagcatggtgtcagt

SEQ ID NO: 2318134 - DNA, 18 bp, Homo sapiens
gagtaatactttttaaat

SEQ ID NO: 2318135 - DNA, 19 bp, Homo sapiens
gagtacctactgtgtgcca

SEQ ID NO: 2318136 - DNA, 12 bp, Homo sapiens
gagtagagaagt

SEQ ID NO: 2318137 - DNA, 21 bp, Homo sapiens
gagtagccaggttctgccggt

SEQ ID NO: 2318138 - DNA, 18 bp, Homo sapiens
gagtattgaatggtggtg

SEQ ID NO: 2318139 - DNA, 13 bp, Homo sapiens
gagtatttccctt

SEQ ID NO: 2318140 - DNA, 20 bp, Homo sapiens
gagtattttaagaagacata

SEQ ID NO: 2318141 - DNA, 20 bp, Homo sapiens
gagtcaccttttctgtggct

SEQ ID NO: 2318142 - DNA, 14 bp, Homo sapiens
gctaaagatgatga

SEQ ID NO: 2318143 - DNA, 16 bp, Homo sapiens
gctaccaggatgctaa

SEQ ID NO: 2318144 - DNA, 15 bp, Homo sapiens
gctacgcctcttctg

SEQ ID NO: 2318145 - DNA, 16 bp, Homo sapiens
gctactaatgatgttt

SEQ ID NO: 2318146 - DNA, 20 bp, Homo sapiens
gctactgcactccagcctgg

SEQ ID NO: 2318147 - DNA, 21 bp, Homo sapiens
gctactggggaaactggccat

SEQ ID NO: 2318148 - DNA, 23 bp, Homo sapiens
gctactggggaaactggccatgg

SEQ ID NO: 2318149 - DNA, 11 bp, Homo sapiens
gctactgtaga

SEQ ID NO: 2318150 - DNA, 23 bp, Homo sapiens
gctagcttctgcttttctgccct

SEQ ID NO: 2318151 - DNA, 20 bp, Homo sapiens
gctaggcataggtctctttg

SEQ ID NO: 2318152 - DNA, 21 bp, Homo sapiens
gctatactgcatactttttaa

SEQ ID NO: 2318153 - DNA, 19 bp, Homo sapiens
gctatatgccttaagccaa

SEQ ID NO: 2318154 - DNA, 21 bp, Homo sapiens
gctatccccatctccctgcct

SEQ ID NO: 2318155 - DNA, 22 bp, Homo sapiens
gctatcgccctcctttccctta

SEQ ID NO: 2318156 - DNA, 22 bp, Homo sapiens
gctatgagttgaaatgttctgt

SEQ ID NO: 2318157 - DNA, 20 bp, Homo sapiens
gctatgcaaaaaattcttta

SEQ ID NO: 2318158 - DNA, 20 bp, Homo sapiens
gctatggcaggataagaaag

SEQ ID NO: 2318159 - DNA, 15 bp, Homo sapiens
gctatgtctcatgtt

SEQ ID NO: 2318160 - DNA, 21 bp, Homo sapiens
gctatgtctcatgttttatat

SEQ ID NO: 2318161 - DNA, 12 bp, Homo sapiens
gctattaaaaaa

SEQ ID NO: 2318162 - DNA, 15 bp, Homo sapiens
gctattaaaaaagtc

SEQ ID NO: 2318163 - DNA, 18 bp, Homo sapiens
gctattagccaggatcat

SEQ ID NO: 2318164 - DNA, 23 bp, Homo sapiens
gctattcacctcagtagaaaagg

SEQ ID NO: 2318165 - DNA, 15 bp, Homo sapiens
gctatttaacatttt

SEQ ID NO: 2318166 - DNA, 20 bp, Homo sapiens
gctatttaagtggactgtat

SEQ ID NO: 2318167 - DNA, 15 bp, Homo sapiens
gctatttcatctatt

SEQ ID NO: 2318168 - DNA, 15 bp, Homo sapiens
gctattttccaggct

SEQ ID NO: 2318169 - DNA, 18 bp, Homo sapiens
gctattttctaaagactt

SEQ ID NO: 2318170 - DNA, 22 bp, Homo sapiens
gctattttctaaagacttgtat

SEQ ID NO: 2318171 - DNA, 16 bp, Homo sapiens
gctatttttgtaaagt

SEQ ID NO: 2318172 - DNA, 19 bp, Homo sapiens
gctcaagcaatcctcctgc

SEQ ID NO: 2318173 - DNA, 21 bp, Homo sapiens
gctcaagcaatcctcctgcct

SEQ ID NO: 2318174 - DNA, 23 bp, Homo sapiens
gctcaagcaatcctcctgcctca

SEQ ID NO: 2318175 - DNA, 13 bp, Homo sapiens
gctcaccagccct

SEQ ID NO: 2318176 - DNA, 17 bp, Homo sapiens
gctcaccagccctgcag

SEQ ID NO: 2318177 - DNA, 14 bp, Homo sapiens
gctcacccacctct

SEQ ID NO: 2318178 - DNA, 17 bp, Homo sapiens
gctcaccgctggccctt

SEQ ID NO: 2318179 - DNA, 12 bp, Homo sapiens
gctcactgccag

SEQ ID NO: 2318180 - DNA, 23 bp, Homo sapiens
gctcactgccaggccagcctccg

SEQ ID NO: 2318181 - DNA, 15 bp, Homo sapiens
gctcacttctgggct

SEQ ID NO: 2318182 - DNA, 14 bp, Homo sapiens
gctcaggtcatcta

SEQ ID NO: 2318183 - DNA, 12 bp, Homo sapiens
gctcaggtgcct

SEQ ID NO: 2318184 - DNA, 19 bp, Homo sapiens
gctcataaaacatgaatca

SEQ ID NO: 2318185 - DNA, 16 bp, Homo sapiens
gctcatgttgagccag

SEQ ID NO: 2318186 - DNA, 15 bp, Homo sapiens
gctcattacagttct

SEQ ID NO: 2318187 - DNA, 15 bp, Homo sapiens
gctccagattctgat

SEQ ID NO: 2318188 - DNA, 20 bp, Homo sapiens
gctccagattctgatgcata

SEQ ID NO: 2318189 - DNA, 21 bp, Homo sapiens
gctccagcgatctctccactg

SEQ ID NO: 2318190 - DNA, 21 bp, Homo sapiens
gctccagctttctgccatcta

SEQ ID NO: 2318191 - DNA, 21 bp, Homo sapiens
gctccagggaatccaagcctc

SEQ ID NO: 2318192 - DNA, 22 bp, Homo sapiens
gctccagggaatccaagcctcc

SEQ ID NO: 2318193 - DNA, 18 bp, Homo sapiens
gctcccaggggtctccct

SEQ ID NO: 2318194 - DNA, 19 bp, Homo sapiens
gctcccaggggtctccctg

SEQ ID NO: 2318195 - DNA, 20 bp, Homo sapiens
gctccccacagcgtccctgg

SEQ ID NO: 2318196 - DNA, 14 bp, Homo sapiens
gctccccctcccca

SEQ ID NO: 2318197 - DNA, 21 bp, Homo sapiens
gctccccctccccaggctgga

SEQ ID NO: 2318198 - DNA, 19 bp, Homo sapiens
gctcccgagctactctctt

SEQ ID NO: 2318199 - DNA, 18 bp, Homo sapiens
gctccctaaactttggcc

SEQ ID NO: 2318200 - DNA, 19 bp, Homo sapiens
gctccctcccaggactctg

SEQ ID NO: 2318201 - DNA, 21 bp, Homo sapiens
gctccctcccaggactctgac

SEQ ID NO: 2318202 - DNA, 18 bp, Homo sapiens
gctccctcctccaggcct

SEQ ID NO: 2318203 - DNA, 15 bp, Homo sapiens
gctccctcctgcaca

SEQ ID NO: 2318204 - DNA, 14 bp, Homo sapiens
gctccctttctcag

SEQ ID NO: 2318205 - DNA, 15 bp, Homo sapiens
gctccgcctggcctg

SEQ ID NO: 2318206 - DNA, 13 bp, Homo sapiens
gctcctcagagcg

SEQ ID NO: 2318207 - DNA, 22 bp, Homo sapiens
gctccttgctgcattgatccag

SEQ ID NO: 2318208 - DNA, 20 bp, Homo sapiens
gctcctttgtgtgtgtgtca

SEQ ID NO: 2318209 - DNA, 14 bp, Homo sapiens
gctcgcactgccca

SEQ ID NO: 2318210 - DNA, 18 bp, Homo sapiens
gctcgccccacccagggc

SEQ ID NO: 2318211 - DNA, 12 bp, Homo sapiens
gctcgctgccat

SEQ ID NO: 2318212 - DNA, 19 bp, Homo sapiens
gctcggagaagagcgcagt

SEQ ID NO: 2318213 - DNA, 13 bp, Homo sapiens
gctctaccctgtc

SEQ ID NO: 2318214 - DNA, 14 bp, Homo sapiens
gctctaccctgtct

SEQ ID NO: 2318215 - DNA, 17 bp, Homo sapiens
gctctaccctgtctgtc

SEQ ID NO: 2318216 - DNA, 13 bp, Homo sapiens
gctctagggcagg

SEQ ID NO: 2318217 - DNA, 20 bp, Homo sapiens
gctctccattctgctccttc

SEQ ID NO: 2318218 - DNA, 21 bp, Homo sapiens
gctctccattctgctccttcc

SEQ ID NO: 2318219 - DNA, 22 bp, Homo sapiens
gctctcccagtgaactcctgcc

SEQ ID NO: 2318220 - DNA, 23 bp, Homo sapiens
gctctcccagtgaactcctgcca

SEQ ID NO: 2318221 - DNA, 19 bp, Homo sapiens
gctctccggggccatttgc

SEQ ID NO: 2318222 - DNA, 18 bp, Homo sapiens
gctctctctagaatgagc

SEQ ID NO: 2318223 - DNA, 18 bp, Homo sapiens
gctctctgacgcttgtga

SEQ ID NO: 2318224 - DNA, 14 bp, Homo sapiens
gctctctgccctgt

SEQ ID NO: 2318225 - DNA, 18 bp, Homo sapiens
gctctctgccctgtgtac

SEQ ID NO: 2318226 - DNA, 18 bp, Homo sapiens
gctctgaagttaaaatga

SEQ ID NO: 2318227 - DNA, 20 bp, Homo sapiens
gctctgaatgctatttgtgt

SEQ ID NO: 2318228 - DNA, 21 bp, Homo sapiens
gctctgccccaccttgccagg

SEQ ID NO: 2318229 - DNA, 13 bp, Homo sapiens
gctctgcctcaga

SEQ ID NO: 2318230 - DNA, 14 bp, Homo sapiens
gctctgcctcagac

SEQ ID NO: 2318231 - DNA, 23 bp, Homo sapiens
gctctgcctcagacgttgcctga

SEQ ID NO: 2318232 - DNA, 18 bp, Homo sapiens
gctctggacagcagaagc

SEQ ID NO: 2318233 - DNA, 23 bp, Homo sapiens
gctctggacagcagaagcctcca

SEQ ID NO: 2318234 - DNA, 20 bp, Homo sapiens
gctctggaggtgctgctcta

SEQ ID NO: 2318235 - DNA, 16 bp, Homo sapiens
gctctgtccccaaagg

SEQ ID NO: 2318236 - DNA, 17 bp, Homo sapiens
gctctgtcccccaggct

SEQ ID NO: 2318237 - DNA, 19 bp, Homo sapiens
gctctgtcccccaggctgg

SEQ ID NO: 2318238 - DNA, 15 bp, Homo sapiens
gctctgtgagcccca

SEQ ID NO: 2318239 - DNA, 17 bp, Homo sapiens
gctctgtgagccccaca

SEQ ID NO: 2318240 - DNA, 19 bp, Homo sapiens
gctctgtgagccccacagc

SEQ ID NO: 2318241 - DNA, 14 bp, Homo sapiens
gctctgtgcagtca

SEQ ID NO: 2318242 - DNA, 19 bp, Homo sapiens
gctctgtgcagtcactgga

SEQ ID NO: 2318243 - DNA, 21 bp, Homo sapiens
gctctgttttgcttttccata

SEQ ID NO: 2318244 - DNA, 16 bp, Homo sapiens
gctcttcatctgcctg

SEQ ID NO: 2318245 - DNA, 17 bp, Homo sapiens
gctcttcatctgcctgc

SEQ ID NO: 2318246 - DNA, 19 bp, Homo sapiens
gctcttcctatccctctcc

SEQ ID NO: 2318247 - DNA, 13 bp, Homo sapiens
gctcttctcaggg

SEQ ID NO: 2318248 - DNA, 12 bp, Homo sapiens
gctctttccaaa

SEQ ID NO: 2318249 - DNA, 13 bp, Homo sapiens
gctctttccaaat

SEQ ID NO: 2318250 - DNA, 17 bp, Homo sapiens
gctctttccaaattaaa

SEQ ID NO: 2318251 - DNA, 16 bp, Homo sapiens
gctgaaattttagaaa

SEQ ID NO: 2318252 - DNA, 15 bp, Homo sapiens
gctgaaattttatat

SEQ ID NO: 2318253 - DNA, 22 bp, Homo sapiens
gctgaatgccccctgcttactt

SEQ ID NO: 2318254 - DNA, 14 bp, Homo sapiens
gctgagctctctgt

SEQ ID NO: 2318255 - DNA, 14 bp, Homo sapiens
gctgaggccagagt

SEQ ID NO: 2318256 - DNA, 16 bp, Homo sapiens
gctgagggcagactgg

SEQ ID NO: 2318257 - DNA, 13 bp, Homo sapiens
gctgagggcctgc

SEQ ID NO: 2318258 - DNA, 23 bp, Homo sapiens
gctgagggcctgctggaggcctc

SEQ ID NO: 2318259 - DNA, 13 bp, Homo sapiens
gctgaggttcctc

SEQ ID NO: 2318260 - DNA, 16 bp, Homo sapiens
gctgaggttcctctgc

SEQ ID NO: 2318261 - DNA, 23 bp, Homo sapiens
gctgaggttcctctgcctgcccc

SEQ ID NO: 2318262 - DNA, 15 bp, Homo sapiens
gctgatattatttct

SEQ ID NO: 2318263 - DNA, 18 bp, Homo sapiens
gctgatattatttcttct

SEQ ID NO: 2318264 - DNA, 16 bp, Homo sapiens
gctgatcagtgggcct

SEQ ID NO: 2318265 - DNA, 22 bp, Homo sapiens
gctgatctgcggatctcagctt

SEQ ID NO: 2318266 - DNA, 17 bp, Homo sapiens
gctgatggagccttccc

SEQ ID NO: 2318267 - DNA, 18 bp, Homo sapiens
gctgatttactaacagta

SEQ ID NO: 2318268 - DNA, 14 bp, Homo sapiens
gctgcacccctggg

SEQ ID NO: 2318269 - DNA, 16 bp, Homo sapiens
gctgcacccctgggcc

SEQ ID NO: 2318270 - DNA, 15 bp, Homo sapiens
gctgcaggatggact

SEQ ID NO: 2318271 - DNA, 20 bp, Homo sapiens
gctgcaggctttgccattgt

SEQ ID NO: 2318272 - DNA, 22 bp, Homo sapiens
gctgcagttctactcaggctgg

SEQ ID NO: 2318273 - DNA, 15 bp, Homo sapiens
gctgccaccagcccc

SEQ ID NO: 2318274 - DNA, 15 bp, Homo sapiens
gctgccagacatgga

SEQ ID NO: 2318275 - DNA, 22 bp, Homo sapiens
gctgccagccttgagccctggc

SEQ ID NO: 2318276 - DNA, 23 bp, Homo sapiens
gctgccagccttgagccctggct

SEQ ID NO: 2318277 - DNA, 13 bp, Homo sapiens
gctgccatcaccg

SEQ ID NO: 2318278 - DNA, 13 bp, Homo sapiens
gctgccatgtgaa

SEQ ID NO: 2318279 - DNA, 17 bp, Homo sapiens
gctgccatgtgaagagg

SEQ ID NO: 2318280 - DNA, 18 bp, Homo sapiens
gctgcccactgtttctct

SEQ ID NO: 2318281 - DNA, 13 bp, Homo sapiens
gctgcccctctca

SEQ ID NO: 2318282 - DNA, 17 bp, Homo sapiens
gctgcccgccgcccctc

SEQ ID NO: 2318283 - DNA, 19 bp, Homo sapiens
gctgcccgccgcccctcca

SEQ ID NO: 2318284 - DNA, 18 bp, Homo sapiens
gctgccctatgggcctgc

SEQ ID NO: 2318285 - DNA, 23 bp, Homo sapiens
gctgccctcccctccggactggt

SEQ ID NO: 2318286 - DNA, 16 bp, Homo sapiens
gctgcctgctctgtga

SEQ ID NO: 2318287 - DNA, 16 bp, Homo sapiens
gctgcctgctgagatg

SEQ ID NO: 2318288 - DNA, 16 bp, Homo sapiens
gctgccttccctagct

SEQ ID NO: 2318289 - DNA, 14 bp, Homo sapiens
gctgccttgcttct

SEQ ID NO: 2318290 - DNA, 15 bp, Homo sapiens
gctgcgcttgctttt

SEQ ID NO: 2318291 - DNA, 17 bp, Homo sapiens
gctgcgcttgcttttct

SEQ ID NO: 2318292 - DNA, 17 bp, Homo sapiens
gctgctatccccatctc

SEQ ID NO: 2318293 - DNA, 23 bp, Homo sapiens
gctgctatccccatctccctgcc

SEQ ID NO: 2318294 - DNA, 19 bp, Homo sapiens
gctgctatttattttccta

SEQ ID NO: 2318295 - DNA, 23 bp, Homo sapiens
gctgctcattacagttctttcct

SEQ ID NO: 2318296 - DNA, 21 bp, Homo sapiens
gctgctctgctatatgcctta

SEQ ID NO: 2318297 - DNA, 17 bp, Homo sapiens
gctgctgcccccacccc

SEQ ID NO: 2318298 - DNA, 13 bp, Homo sapiens
gctgctgcctctt

SEQ ID NO: 2318299 - DNA, 11 bp, Homo sapiens
gctgctggcca

SEQ ID NO: 2318300 - DNA, 14 bp, Homo sapiens
gctgctgtccagtg

SEQ ID NO: 2318301 - DNA, 21 bp, Homo sapiens
gctgctgtctgggtgctactg

SEQ ID NO: 2318302 - DNA, 15 bp, Homo sapiens
gctgctgttctcagg

SEQ ID NO: 2318303 - DNA, 12 bp, Homo sapiens
gctgcttttctt

SEQ ID NO: 2318304 - DNA, 13 bp, Homo sapiens
gctggaagcccag

SEQ ID NO: 2318305 - DNA, 21 bp, Homo sapiens
gctggacttctacctgccctc

SEQ ID NO: 2318306 - DNA, 13 bp, Homo sapiens
gctggagccccca

SEQ ID NO: 2318307 - DNA, 21 bp, Homo sapiens
gctggcaaaccctcccagaaa

SEQ ID NO: 2318308 - DNA, 17 bp, Homo sapiens
gctggcagtcctggaag

SEQ ID NO: 2318309 - DNA, 22 bp, Homo sapiens
gctggccagtccaccctgcctg

SEQ ID NO: 2318310 - DNA, 23 bp, Homo sapiens
gctggccatgaatctctgcctct

SEQ ID NO: 2318311 - DNA, 18 bp, Homo sapiens
gctggccccagccctgct

SEQ ID NO: 2318312 - DNA, 22 bp, Homo sapiens
gctggccccagccctgctgggg

SEQ ID NO: 2318313 - DNA, 21 bp, Homo sapiens
gctggccgacccactgaccca

SEQ ID NO: 2318314 - DNA, 19 bp, Homo sapiens
gctggcctttgtaagtgca

SEQ ID NO: 2318315 - DNA, 18 bp, Homo sapiens
gctggctccccctcccca

SEQ ID NO: 2318316 - DNA, 21 bp, Homo sapiens
gctggctccccctccccaggc

SEQ ID NO: 2318317 - DNA, 19 bp, Homo sapiens
gctggctctgtgagggtgc

SEQ ID NO: 2318318 - DNA, 21 bp, Homo sapiens
gctggctttgaaacctcaggg

SEQ ID NO: 2318319 - DNA, 14 bp, Homo sapiens
gctgggaaagcata

SEQ ID NO: 2318320 - DNA, 20 bp, Homo sapiens
gctgggccatgtccaaagag

SEQ ID NO: 2318321 - DNA, 17 bp, Homo sapiens
gctgggcggctgtgctt

SEQ ID NO: 2318322 - DNA, 23 bp, Homo sapiens
gctgggctaggcataggtctctt

SEQ ID NO: 2318323 - DNA, 15 bp, Homo sapiens
gctgggctctgcctt

SEQ ID NO: 2318324 - DNA, 22 bp, Homo sapiens
gctggggaggaccagggccctg

SEQ ID NO: 2318325 - DNA, 21 bp, Homo sapiens
gctggggatccccgcctggcc

SEQ ID NO: 2318326 - DNA, 23 bp, Homo sapiens
gctggggatccccgcctggccag

SEQ ID NO: 2318327 - DNA, 18 bp, Homo sapiens
gctggggccagaggctgg

SEQ ID NO: 2318328 - DNA, 19 bp, Homo sapiens
gctgggtccaccctgtcct

SEQ ID NO: 2318329 - DNA, 13 bp, Homo sapiens
gctgggtggtttt

SEQ ID NO: 2318330 - DNA, 14 bp, Homo sapiens
gctggtatttctaa

SEQ ID NO: 2318331 - DNA, 20 bp, Homo sapiens
gctggtcagtctttgctcag

SEQ ID NO: 2318332 - DNA, 16 bp, Homo sapiens
gctggtggacccaggg

SEQ ID NO: 2318333 - DNA, 18 bp, Homo sapiens
gctgtaactgagagaaag

SEQ ID NO: 2318334 - DNA, 13 bp, Homo sapiens
gctgtaagcattc

SEQ ID NO: 2318335 - DNA, 18 bp, Homo sapiens
gctgtacttcttgaatat

SEQ ID NO: 2318336 - DNA, 15 bp, Homo sapiens
gctgtagctcccgag

SEQ ID NO: 2318337 - DNA, 15 bp, Homo sapiens
gctgtagctgtttca

SEQ ID NO: 2318338 - DNA, 20 bp, Homo sapiens
gctgtcaatgggacctgtgg

SEQ ID NO: 2318339 - DNA, 13 bp, Homo sapiens
gctgtccaggcag

SEQ ID NO: 2318340 - DNA, 19 bp, Homo sapiens
gctgtccaggcagctccct

SEQ ID NO: 2318341 - DNA, 21 bp, Homo sapiens
gctgtccaggcagctccctcc

SEQ ID NO: 2318342 - DNA, 14 bp, Homo sapiens
gctgtcctttttcc

SEQ ID NO: 2318343 - DNA, 19 bp, Homo sapiens
gctgtgaaccctggggcct

SEQ ID NO: 2318344 - DNA, 18 bp, Homo sapiens
gctgtgcttgaaggccct

SEQ ID NO: 2318345 - DNA, 15 bp, Homo sapiens
gctgtggcatttcca

SEQ ID NO: 2318346 - DNA, 22 bp, Homo sapiens
gctgtggcatttccaaacatcc

SEQ ID NO: 2318347 - DNA, 13 bp, Homo sapiens
gctgtgtctgcca

SEQ ID NO: 2318348 - DNA, 20 bp, Homo sapiens
gctgtgtctgccaaacacat

SEQ ID NO: 2318349 - DNA, 15 bp, Homo sapiens
gctgttaccattcac

SEQ ID NO: 2318350 - DNA, 18 bp, Homo sapiens
gctgttaccattcacaat

SEQ ID NO: 2318351 - DNA, 23 bp, Homo sapiens
gctgttctcaggacagcatccct

SEQ ID NO: 2318352 - DNA, 15 bp, Homo sapiens
gctgttggtgggacc

SEQ ID NO: 2318353 - DNA, 12 bp, Homo sapiens
gctgtttctaag

SEQ ID NO: 2318354 - DNA, 19 bp, Homo sapiens
gcttaaaagcatttttatt

SEQ ID NO: 2318355 - DNA, 16 bp, Homo sapiens
gcttaatgctacatgt

SEQ ID NO: 2318356 - DNA, 18 bp, Homo sapiens
gcttaatggagttcttgt

SEQ ID NO: 2318357 - DNA, 13 bp, Homo sapiens
gcttacctcctca

SEQ ID NO: 2318358 - DNA, 17 bp, Homo sapiens
gcttaggtgccaggctg

SEQ ID NO: 2318359 - DNA, 18 bp, Homo sapiens
gcttaggtgccaggctgt

SEQ ID NO: 2318360 - DNA, 19 bp, Homo sapiens
gcttatttctatgacaaat

SEQ ID NO: 2318361 - DNA, 20 bp, Homo sapiens
gcttcacagtagagccagct

SEQ ID NO: 2318362 - DNA, 21 bp, Homo sapiens
gcttcacagtagagccagctt

SEQ ID NO: 2318363 - DNA, 22 bp, Homo sapiens
gcttcacagtagagccagcttg

SEQ ID NO: 2318364 - DNA, 14 bp, Homo sapiens
gcttcactgtataa

SEQ ID NO: 2318365 - DNA, 16 bp, Homo sapiens
gcttcactgtataaat

SEQ ID NO: 2318366 - DNA, 17 bp, Homo sapiens
gcttcatctctttagag

SEQ ID NO: 2318367 - DNA, 18 bp, Homo sapiens
gcttcattctggaaactt

SEQ ID NO: 2318368 - DNA, 18 bp, Homo sapiens
gcttcattttatttttga

SEQ ID NO: 2318369 - DNA, 21 bp, Homo sapiens
gcttccaggaaactccacatc

SEQ ID NO: 2318370 - DNA, 18 bp, Homo sapiens
gcttcctgacaatcaact

SEQ ID NO: 2318371 - DNA, 13 bp, Homo sapiens
gcttcctgccctt

SEQ ID NO: 2318372 - DNA, 18 bp, Homo sapiens
gcttcctgcccttccctc

SEQ ID NO: 2318373 - DNA, 12 bp, Homo sapiens
gcttcctgctgt

SEQ ID NO: 2318374 - DNA, 13 bp, Homo sapiens
gcttcctgctgta

SEQ ID NO: 2318375 - DNA, 18 bp, Homo sapiens
gcttcctgctgtatgtga

SEQ ID NO: 2318376 - DNA, 14 bp, Homo sapiens
gcttcctttctctc

SEQ ID NO: 2318377 - DNA, 16 bp, Homo sapiens
gcttcgtttattttca

SEQ ID NO: 2318378 - DNA, 13 bp, Homo sapiens
gcttctaaagcag

SEQ ID NO: 2318379 - DNA, 14 bp, Homo sapiens
gcttctacctggaa

SEQ ID NO: 2318380 - DNA, 17 bp, Homo sapiens
gcttctccccagagctg

SEQ ID NO: 2318381 - DNA, 16 bp, Homo sapiens
gcttctccgccagcct

SEQ ID NO: 2318382 - DNA, 20 bp, Homo sapiens
gcttctccgccagcctcctc

SEQ ID NO: 2318383 - DNA, 21 bp, Homo sapiens
gcttctccgccagcctcctct

SEQ ID NO: 2318384 - DNA, 13 bp, Homo sapiens
gcttctctccaca

SEQ ID NO: 2318385 - DNA, 17 bp, Homo sapiens
gcttctctccacagtgt

SEQ ID NO: 2318386 - DNA, 21 bp, Homo sapiens
gcttctgcttttctgccctgg

SEQ ID NO: 2318387 - DNA, 23 bp, Homo sapiens
gcttctgcttttctgccctggct

SEQ ID NO: 2318388 - DNA, 16 bp, Homo sapiens
gcttctgtgatgagct

SEQ ID NO: 2318389 - DNA, 18 bp, Homo sapiens
gcttctgtgatgagctga

SEQ ID NO: 2318390 - DNA, 20 bp, Homo sapiens
gcttctgtgatgagctgatc

SEQ ID NO: 2318391 - DNA, 21 bp, Homo sapiens
gcttcttattaatcatacaaa

SEQ ID NO: 2318392 - DNA, 18 bp, Homo sapiens
gcttgaagccaaagaaaa

SEQ ID NO: 2318393 - DNA, 17 bp, Homo sapiens
gcttgaaggccagcagc

SEQ ID NO: 2318394 - DNA, 15 bp, Homo sapiens
gcttgaaggccctgc

SEQ ID NO: 2318395 - DNA, 18 bp, Homo sapiens
gcttgaaggccctgctga

SEQ ID NO: 2318396 - DNA, 23 bp, Homo sapiens
gcttgagctagagataaaacaga

SEQ ID NO: 2318397 - DNA, 15 bp, Homo sapiens
gcttgcataataagc

SEQ ID NO: 2318398 - DNA, 14 bp, Homo sapiens
gcttgccaaagtac

SEQ ID NO: 2318399 - DNA, 16 bp, Homo sapiens
gcttggcctgctgtga

SEQ ID NO: 2318400 - DNA, 21 bp, Homo sapiens
gcttgggaagactcctagctg

SEQ ID NO: 2318401 - DNA, 17 bp, Homo sapiens
gcttgggcagtgcccca

SEQ ID NO: 2318402 - DNA, 12 bp, Homo sapiens
gcttggggaaaa

SEQ ID NO: 2318403 - DNA, 14 bp, Homo sapiens
gcttggtttgcaac

SEQ ID NO: 2318404 - DNA, 14 bp, Homo sapiens
gcttgtgacagtgc

SEQ ID NO: 2318405 - DNA, 16 bp, Homo sapiens
gcttgtggggcctggg

SEQ ID NO: 2318406 - DNA, 14 bp, Homo sapiens
gctttaagccttca

SEQ ID NO: 2318407 - DNA, 21 bp, Homo sapiens
gctttaccttttcagggctgg

SEQ ID NO: 2318408 - DNA, 14 bp, Homo sapiens
gctttagaccctgg

SEQ ID NO: 2318409 - DNA, 16 bp, Homo sapiens
gctttagaccctgggt

SEQ ID NO: 2318410 - DNA, 16 bp, Homo sapiens
gctttattaatgtttt

SEQ ID NO: 2318411 - DNA, 20 bp, Homo sapiens
gctttccaggcaccctcagg

SEQ ID NO: 2318412 - DNA, 20 bp, Homo sapiens
gctttctgggatgtcacagt

SEQ ID NO: 2318413 - DNA, 17 bp, Homo sapiens
gctttctggggcctagc

SEQ ID NO: 2318414 - DNA, 21 bp, Homo sapiens
gctttcttgtcttttcagaag

SEQ ID NO: 2318415 - DNA, 16 bp, Homo sapiens
gctttgagaagccttc

SEQ ID NO: 2318416 - DNA, 20 bp, Homo sapiens
gctttgccatgggcctgctg

SEQ ID NO: 2318417 - DNA, 23 bp, Homo sapiens
gctttggaagtttagctctgaga

SEQ ID NO: 2318418 - DNA, 16 bp, Homo sapiens
gcttttatagaggcta

SEQ ID NO: 2318419 - DNA, 18 bp, Homo sapiens
gcttttatggggccctgt

SEQ ID NO: 2318420 - DNA, 15 bp, Homo sapiens
gcttttctgccctgg

SEQ ID NO: 2318421 - DNA, 16 bp, Homo sapiens
gcttttctgccctggc

SEQ ID NO: 2318422 - DNA, 19 bp, Homo sapiens
gcttttctgccctggctgc

SEQ ID NO: 2318423 - DNA, 18 bp, Homo sapiens
gcttttctgtattttatt

SEQ ID NO: 2318424 - DNA, 23 bp, Homo sapiens
gcttttgctagatggaatggaaa

SEQ ID NO: 2318425 - DNA, 23 bp, Homo sapiens
ggacaactgctcccacctcctga

SEQ ID NO: 2318426 - DNA, 18 bp, Homo sapiens
ggacacagacccaggacc

SEQ ID NO: 2318427 - DNA, 17 bp, Homo sapiens
ggacacagttcctggga

SEQ ID NO: 2318428 - DNA, 19 bp, Homo sapiens
ggacacagttcctgggaac

SEQ ID NO: 2318429 - DNA, 21 bp, Homo sapiens
ggacaccccccgccccccacc

SEQ ID NO: 2318430 - DNA, 13 bp, Homo sapiens
ggacacgagccac

SEQ ID NO: 2318431 - DNA, 14 bp, Homo sapiens
ggacacgagccaca

SEQ ID NO: 2318432 - DNA, 21 bp, Homo sapiens
ggacacgagccacaagctgca

SEQ ID NO: 2318433 - DNA, 22 bp, Homo sapiens
ggacacgagccacaagctgcac

SEQ ID NO: 2318434 - DNA, 23 bp, Homo sapiens
ggacactccagggacacacagcc

SEQ ID NO: 2318435 - DNA, 14 bp, Homo sapiens
ggacagcagaagcc

SEQ ID NO: 2318436 - DNA, 17 bp, Homo sapiens
ggacagcagaagcctcc

SEQ ID NO: 2318437 - DNA, 18 bp, Homo sapiens
ggacagcagaagcctcca

SEQ ID NO: 2318438 - DNA, 18 bp, Homo sapiens
ggacagtatcccacatcc

SEQ ID NO: 2318439 - DNA, 11 bp, Homo sapiens
ggacatgagat

SEQ ID NO: 2318440 - DNA, 19 bp, Homo sapiens
ggacatttgaacatgttta

SEQ ID NO: 2318441 - DNA, 15 bp, Homo sapiens
ggaccaacctgctct

SEQ ID NO: 2318442 - DNA, 19 bp, Homo sapiens
ggaccaacctgctctgtcc

SEQ ID NO: 2318443 - DNA, 21 bp, Homo sapiens
ggaccaacctgctctgtcccc

SEQ ID NO: 2318444 - DNA, 13 bp, Homo sapiens
ggaccactcctgt

SEQ ID NO: 2318445 - DNA, 21 bp, Homo sapiens
ggaccactcctgtccctgtag

SEQ ID NO: 2318446 - DNA, 23 bp, Homo sapiens
ggaccagccagcagcagcccaag

SEQ ID NO: 2318447 - DNA, 19 bp, Homo sapiens
ggaccagggccctgggcag

SEQ ID NO: 2318448 - DNA, 13 bp, Homo sapiens
ggaccctgtccaa

SEQ ID NO: 2318449 - DNA, 16 bp, Homo sapiens
ggacctatcccaaatg

SEQ ID NO: 2318450 - DNA, 21 bp, Homo sapiens
ggacctatcccaaatgtggaa

SEQ ID NO: 2318451 - DNA, 22 bp, Homo sapiens
ggacctgggaacgactggactg

SEQ ID NO: 2318452 - DNA, 13 bp, Homo sapiens
ggacgcctgcagg

SEQ ID NO: 2318453 - DNA, 15 bp, Homo sapiens
ggacggaccagcatc

SEQ ID NO: 2318454 - DNA, 12 bp, Homo sapiens
ggacgtgctggg

SEQ ID NO: 2318455 - DNA, 16 bp, Homo sapiens
ggactctgcccctgga

SEQ ID NO: 2318456 - DNA, 12 bp, Homo sapiens
ggactgcagtgt

SEQ ID NO: 2318457 - DNA, 16 bp, Homo sapiens
ggactgccaggctgtt

SEQ ID NO: 2318458 - DNA, 11 bp, Homo sapiens
ggactggtgcc

SEQ ID NO: 2318459 - DNA, 14 bp, Homo sapiens
ggactggtgccctc

SEQ ID NO: 2318460 - DNA, 15 bp, Homo sapiens
ggacttccatgcctt

SEQ ID NO: 2318461 - DNA, 17 bp, Homo sapiens
ggacttctacctgccct

SEQ ID NO: 2318462 - DNA, 23 bp, Homo sapiens
ggactttcttgcatgaatcagat

SEQ ID NO: 2318463 - DNA, 14 bp, Homo sapiens
ggagaagaatggct

SEQ ID NO: 2318464 - DNA, 15 bp, Homo sapiens
ggagaagaatggctt

SEQ ID NO: 2318465 - DNA, 13 bp, Homo sapiens
ggagaagctgcag

SEQ ID NO: 2318466 - DNA, 14 bp, Homo sapiens
ggagaagctgcagg

SEQ ID NO: 2318467 - DNA, 20 bp, Homo sapiens
ggagacagaggaaagggctg

SEQ ID NO: 2318468 - DNA, 17 bp, Homo sapiens
ggagaccctgccacagc

SEQ ID NO: 2318469 - DNA, 19 bp, Homo sapiens
ggagaccctgccacagcca

SEQ ID NO: 2318470 - DNA, 20 bp, Homo sapiens
ggagaccctgccacagccag

SEQ ID NO: 2318471 - DNA, 22 bp, Homo sapiens
ggagacgtttataaacagaaat

SEQ ID NO: 2318472 - DNA, 21 bp, Homo sapiens
ggagagccatacataaaagaa

SEQ ID NO: 2318473 - DNA, 11 bp, Homo sapiens
ggagagcctgc

SEQ ID NO: 2318474 - DNA, 12 bp, Homo sapiens
ggagagcctgct

SEQ ID NO: 2318475 - DNA, 11 bp, Homo sapiens
ggagaggagac

SEQ ID NO: 2318476 - DNA, 20 bp, Homo sapiens
ggagaggatgagagcccaga

SEQ ID NO: 2318477 - DNA, 21 bp, Homo sapiens
ggagagggatttccctgcaga

SEQ ID NO: 2318478 - DNA, 17 bp, Homo sapiens
ggagatgcttctctcct

SEQ ID NO: 2318479 - DNA, 21 bp, Homo sapiens
ggagatgcttctctccttgcc

SEQ ID NO: 2318480 - DNA, 18 bp, Homo sapiens
ggagatgggtccaggggt

SEQ ID NO: 2318481 - DNA, 12 bp, Homo sapiens
ggagatttctta

SEQ ID NO: 2318482 - DNA, 22 bp, Homo sapiens
ggagatttttttgagtcaaaga

SEQ ID NO: 2318483 - DNA, 15 bp, Homo sapiens
ggagcagggagagct

SEQ ID NO: 2318484 - DNA, 15 bp, Homo sapiens
ggagcatcccaggcg

SEQ ID NO: 2318485 - DNA, 14 bp, Homo sapiens
ggagcccccaccct

SEQ ID NO: 2318486 - DNA, 15 bp, Homo sapiens
ggagcccccaccctg

SEQ ID NO: 2318487 - DNA, 22 bp, Homo sapiens
ggagcccccaccctgttcctgc

SEQ ID NO: 2318488 - DNA, 21 bp, Homo sapiens
ggagcctccccatctgtccag

SEQ ID NO: 2318489 - DNA, 13 bp, Homo sapiens
ggagccttcccaa

SEQ ID NO: 2318490 - DNA, 22 bp, Homo sapiens
ggagccttcccaagttgtgctt

SEQ ID NO: 2318491 - DNA, 13 bp, Homo sapiens
ggagcgtctggga

SEQ ID NO: 2318492 - DNA, 17 bp, Homo sapiens
ggagctcatctgcaaaa

SEQ ID NO: 2318493 - DNA, 22 bp, Homo sapiens
gggccagcggggctgctcaccc

SEQ ID NO: 2318494 - DNA, 17 bp, Homo sapiens
gggccatgtccaaagag

SEQ ID NO: 2318495 - DNA, 21 bp, Homo sapiens
gggccatgtccaaagaggctg

SEQ ID NO: 2318496 - DNA, 22 bp, Homo sapiens
gggccatgtccaaagaggctgc

SEQ ID NO: 2318497 - DNA, 17 bp, Homo sapiens
gggccccactggctgga

SEQ ID NO: 2318498 - DNA, 21 bp, Homo sapiens
gggcctagcgatctctcctgg

SEQ ID NO: 2318499 - DNA, 14 bp, Homo sapiens
gggcctcagtgccc

SEQ ID NO: 2318500 - DNA, 17 bp, Homo sapiens
gggcctgactgctcaga

SEQ ID NO: 2318501 - DNA, 12 bp, Homo sapiens
gggcctgctgcg

SEQ ID NO: 2318502 - DNA, 14 bp, Homo sapiens
gggcctgctggagg

SEQ ID NO: 2318503 - DNA, 15 bp, Homo sapiens
gggcctgctggaggc

SEQ ID NO: 2318504 - DNA, 23 bp, Homo sapiens
gggcgctggacactctctgccct

SEQ ID NO: 2318505 - DNA, 19 bp, Homo sapiens
gggctcaagcaatcctcct

SEQ ID NO: 2318506 - DNA, 22 bp, Homo sapiens
gggctcaagcaatcctcctgcc

SEQ ID NO: 2318507 - DNA, 22 bp, Homo sapiens
gggctcccaggggtctccctgg

SEQ ID NO: 2318508 - DNA, 23 bp, Homo sapiens
gggctcccaggggtctccctggc

SEQ ID NO: 2318509 - DNA, 12 bp, Homo sapiens
gggctccctcct

SEQ ID NO: 2318510 - DNA, 12 bp, Homo sapiens
gggctcctttcc

SEQ ID NO: 2318511 - DNA, 15 bp, Homo sapiens
gggctcgcactgccc

SEQ ID NO: 2318512 - DNA, 17 bp, Homo sapiens
gggctcgcactgcccac

SEQ ID NO: 2318513 - DNA, 16 bp, Homo sapiens
gggctctgtgcagtca

SEQ ID NO: 2318514 - DNA, 19 bp, Homo sapiens
gggctcttcatctgcctgc

SEQ ID NO: 2318515 - DNA, 22 bp, Homo sapiens
gggctcttctcaggggctctag

SEQ ID NO: 2318516 - DNA, 17 bp, Homo sapiens
gggctgccttctggcct

SEQ ID NO: 2318517 - DNA, 14 bp, Homo sapiens
gggctgcttttctt

SEQ ID NO: 2318518 - DNA, 13 bp, Homo sapiens
gggctgggcacct

SEQ ID NO: 2318519 - DNA, 13 bp, Homo sapiens
gggctgtcccagc

SEQ ID NO: 2318520 - DNA, 16 bp, Homo sapiens
gggctgtcccagcccc

SEQ ID NO: 2318521 - DNA, 20 bp, Homo sapiens
gggcttaatggagttcttgt

SEQ ID NO: 2318522 - DNA, 20 bp, Homo sapiens
gggcttcatctctttagaga

SEQ ID NO: 2318523 - DNA, 17 bp, Homo sapiens
gggcttcctgcccttcc

SEQ ID NO: 2318524 - DNA, 13 bp, Homo sapiens
gggcttgaagcca

SEQ ID NO: 2318525 - DNA, 17 bp, Homo sapiens
gggcttgaagccaaaga

SEQ ID NO: 2318526 - DNA, 24 bp, Homo sapiens
gggcttgttgtttttaagtcctgt

SEQ ID NO: 2318527 - DNA, 22 bp, Homo sapiens
gggctttgatgttccttccagt

SEQ ID NO: 2318528 - DNA, 21 bp, Homo sapiens
ggggaaaatggccatgcagga

SEQ ID NO: 2318529 - DNA, 14 bp, Homo sapiens
ggggacagctgtgt

SEQ ID NO: 2318530 - DNA, 14 bp, Homo sapiens
ggggactgtctttc

SEQ ID NO: 2318531 - DNA, 17 bp, Homo sapiens
ggggagagacaggcagc

SEQ ID NO: 2318532 - DNA, 18 bp, Homo sapiens
ggggagagacaggcagcc

SEQ ID NO: 2318533 - DNA, 14 bp, Homo sapiens
ggggagagcctgct

SEQ ID NO: 2318534 - DNA, 16 bp, Homo sapiens
ggggagagcctgctgg

SEQ ID NO: 2318535 - DNA, 21 bp, Homo sapiens
ggggatccccgcctggccagg

SEQ ID NO: 2318536 - DNA, 13 bp, Homo sapiens
ggggcaggctggg

SEQ ID NO: 2318537 - DNA, 15 bp, Homo sapiens
ggggctcgccccacc

SEQ ID NO: 2318538 - DNA, 17 bp, Homo sapiens
ggggctcgccccaccca

SEQ ID NO: 2318539 - DNA, 14 bp, Homo sapiens
ggggcttcatctct

SEQ ID NO: 2318540 - DNA, 17 bp, Homo sapiens
ggggcttgaagccaaag

SEQ ID NO: 2318541 - DNA, 21 bp, Homo sapiens
gggggcagcacaggagggcgg

SEQ ID NO: 2318542 - DNA, 13 bp, Homo sapiens
gggggcagcccag

SEQ ID NO: 2318543 - DNA, 13 bp, Homo sapiens
gggggcagggctg

SEQ ID NO: 2318544 - DNA, 13 bp, Homo sapiens
gggggtggaggct

SEQ ID NO: 2318545 - DNA, 17 bp, Homo sapiens
ggggtccctcaggttcc

SEQ ID NO: 2318546 - DNA, 23 bp, Homo sapiens
ggggtctcgttttgttgccaaag

SEQ ID NO: 2318547 - DNA, 12 bp, Homo sapiens
ggggtctttgtg

SEQ ID NO: 2318548 - DNA, 23 bp, Homo sapiens
ggggttcccttgagggctgcagt

SEQ ID NO: 2318549 - DNA, 16 bp, Homo sapiens
gggtcacatccatccc

SEQ ID NO: 2318550 - DNA, 21 bp, Homo sapiens
gggtcatattcataccttctg

SEQ ID NO: 2318551 - DNA, 14 bp, Homo sapiens
gggtctccctggct

SEQ ID NO: 2318552 - DNA, 21 bp, Homo sapiens
gggtctccctggctccctcct

SEQ ID NO: 2318553 - DNA, 21 bp, Homo sapiens
gggtcttgctctgtcccccag

SEQ ID NO: 2318554 - DNA, 15 bp, Homo sapiens
gggtgcacccacctg

SEQ ID NO: 2318555 - DNA, 15 bp, Homo sapiens
gggtgctactgggga

SEQ ID NO: 2318556 - DNA, 15 bp, Homo sapiens
gggtggaatgagccg

SEQ ID NO: 2318557 - DNA, 17 bp, Homo sapiens
gggtggagcactggact

SEQ ID NO: 2318558 - DNA, 20 bp, Homo sapiens
gggtggccacagcgccagcc

SEQ ID NO: 2318559 - DNA, 20 bp, Homo sapiens
gggtgggattttttcccttt

SEQ ID NO: 2318560 - DNA, 13 bp, Homo sapiens
gggtggggagatg

SEQ ID NO: 2318561 - DNA, 17 bp, Homo sapiens
gggtgtgaacatgttct

SEQ ID NO: 2318562 - DNA, 14 bp, Homo sapiens
gggtgtgggaaagc

SEQ ID NO: 2318563 - DNA, 19 bp, Homo sapiens
gggtgttctttcctgccct

SEQ ID NO: 2318564 - DNA, 18 bp, Homo sapiens
gggttaggaatctcttca

SEQ ID NO: 2318565 - DNA, 16 bp, Homo sapiens
gggttcaaaatgtctg

SEQ ID NO: 2318566 - DNA, 21 bp, Homo sapiens
gggttccctcctagctctccc

SEQ ID NO: 2318567 - DNA, 22 bp, Homo sapiens
gggttccctcctagctctccca

SEQ ID NO: 2318568 - DNA, 13 bp, Homo sapiens
gggttgagagcca

SEQ ID NO: 2318569 - DNA, 15 bp, Homo sapiens
gggttgagagccagt

SEQ ID NO: 2318570 - DNA, 16 bp, Homo sapiens
gggtttctctgtggct

SEQ ID NO: 2318571 - DNA, 12 bp, Homo sapiens
ggtaaaaacagc

SEQ ID NO: 2318572 - DNA, 20 bp, Homo sapiens
ggtaaataaaccactgtgcg

SEQ ID NO: 2318573 - DNA, 15 bp, Homo sapiens
ggtaaatcccacatc

SEQ ID NO: 2318574 - DNA, 11 bp, Homo sapiens
ggtaaatgtta

SEQ ID NO: 2318575 - DNA, 16 bp, Homo sapiens
ggtaaatgtttctttt

SEQ ID NO: 2318576 - DNA, 14 bp, Homo sapiens
ggtaacagaacagc

SEQ ID NO: 2318577 - DNA, 16 bp, Homo sapiens
ggtaacagaacagctt

SEQ ID NO: 2318578 - DNA, 18 bp, Homo sapiens
ggtaagtgttctcatgaa

SEQ ID NO: 2318579 - DNA, 11 bp, Homo sapiens
ggtacagcagg

SEQ ID NO: 2318580 - DNA, 21 bp, Homo sapiens
ggtacagcagggtcttgctgt

SEQ ID NO: 2318581 - DNA, 12 bp, Homo sapiens
ggtaccagctgc

SEQ ID NO: 2318582 - DNA, 16 bp, Homo sapiens
ggtagaaaaaggggcc

SEQ ID NO: 2318583 - DNA, 15 bp, Homo sapiens
ggtagaacactgcta

SEQ ID NO: 2318584 - DNA, 20 bp, Homo sapiens
ggtagagaggcgcggagtga

SEQ ID NO: 2318585 - DNA, 15 bp, Homo sapiens
ggtagcgagctgctc

SEQ ID NO: 2318586 - DNA, 19 bp, Homo sapiens
ggtagcgagctgctctgct

SEQ ID NO: 2318587 - DNA, 20 bp, Homo sapiens
ggtagcgagctgctctgcta

SEQ ID NO: 2318588 - DNA, 14 bp, Homo sapiens
ggtagtactgggaa

SEQ ID NO: 2318589 - DNA, 15 bp, Homo sapiens
ggtagtctcactgct

SEQ ID NO: 2318590 - DNA, 13 bp, Homo sapiens
ggtatgggaagcc

SEQ ID NO: 2318591 - DNA, 15 bp, Homo sapiens
ggtcactggaaaggg

SEQ ID NO: 2318592 - DNA, 13 bp, Homo sapiens
ggtcataaaatag

SEQ ID NO: 2318593 - DNA, 19 bp, Homo sapiens
ggtcatcagatgcctgctt

SEQ ID NO: 2318594 - DNA, 13 bp, Homo sapiens
ggtccagctggcc

SEQ ID NO: 2318595 - DNA, 16 bp, Homo sapiens
ggtcctagcccttccc

SEQ ID NO: 2318596 - DNA, 14 bp, Homo sapiens
ggtcggatctcaca

SEQ ID NO: 2318597 - DNA, 15 bp, Homo sapiens
ggtcggatctcacag

SEQ ID NO: 2318598 - DNA, 22 bp, Homo sapiens
ggtctcaaacttgtggcctcaa

SEQ ID NO: 2318599 - DNA, 20 bp, Homo sapiens
ggtctcccttctctacactc

SEQ ID NO: 2318600 - DNA, 21 bp, Homo sapiens
ggtctcgttttgttgccaaag

SEQ ID NO: 2318601 - DNA, 19 bp, Homo sapiens
ggtctctgctggggaaggg

SEQ ID NO: 2318602 - DNA, 10 bp, Homo sapiens
ggtctctgtt

SEQ ID NO: 2318603 - DNA, 14 bp, Homo sapiens
ggtctgggctgggc

SEQ ID NO: 2318604 - DNA, 21 bp, Homo sapiens
ggtcttcttgtgtcctgatga

SEQ ID NO: 2318605 - DNA, 15 bp, Homo sapiens
ggtcttggctgcctg

SEQ ID NO: 2318606 - DNA, 13 bp, Homo sapiens
ggtctttgtaaga

SEQ ID NO: 2318607 - DNA, 15 bp, Homo sapiens
ggtctttgtaagagt

SEQ ID NO: 2318608 - DNA, 19 bp, Homo sapiens
ggtctttgtaagagtgtag

SEQ ID NO: 2318609 - DNA, 21 bp, Homo sapiens
ggtgaagctcacttctgggct

SEQ ID NO: 2318610 - DNA, 19 bp, Homo sapiens
ggtgagtttgagctgcctt

SEQ ID NO: 2318611 - DNA, 21 bp, Homo sapiens
ggtgtcctgcctgtctgcccc

SEQ ID NO: 2318612 - DNA, 22 bp, Homo sapiens
ggtgtgaggaggacaaaataaa

SEQ ID NO: 2318613 - DNA, 18 bp, Homo sapiens
ggtgtggcccatggctgt

SEQ ID NO: 2318614 - DNA, 19 bp, Homo sapiens
ggtgtgggtgtcctgcctg

SEQ ID NO: 2318615 - DNA, 22 bp, Homo sapiens
ggtgtgggtgtcctgcctgtct

SEQ ID NO: 2318616 - DNA, 17 bp, Homo sapiens
ggtgttctttcctgccc

SEQ ID NO: 2318617 - DNA, 13 bp, Homo sapiens
ggtgtttattgca

SEQ ID NO: 2318618 - DNA, 22 bp, Homo sapiens
ggttaaacggtgcccatcctgc

SEQ ID NO: 2318619 - DNA, 13 bp, Homo sapiens
ggttaaggcctga

SEQ ID NO: 2318620 - DNA, 13 bp, Homo sapiens
ggttactgagtga

SEQ ID NO: 2318621 - DNA, 17 bp, Homo sapiens
ggttaggaatctcttca

SEQ ID NO: 2318622 - DNA, 12 bp, Homo sapiens
ggttataatttt

SEQ ID NO: 2318623 - DNA, 13 bp, Homo sapiens
ggttcaccttgcc

SEQ ID NO: 2318624 - DNA, 22 bp, Homo sapiens
ggttcaccttgccgagagaggc

SEQ ID NO: 2318625 - DNA, 14 bp, Homo sapiens
ggttcctctgcctg

SEQ ID NO: 2318626 - DNA, 18 bp, Homo sapiens
ggttctccccctttctct

SEQ ID NO: 2318627 - DNA, 15 bp, Homo sapiens
ggttgagagccagtg

SEQ ID NO: 2318628 - DNA, 21 bp, Homo sapiens
ggttgctgctgtccagtgcct

SEQ ID NO: 2318629 - DNA, 21 bp, Homo sapiens
ggttggagcccagggcatctt

SEQ ID NO: 2318630 - DNA, 21 bp, Homo sapiens
ggttgtcatcactagtggcaa

SEQ ID NO: 2318631 - DNA, 22 bp, Homo sapiens
ggtttctctgtggctccaggcc

SEQ ID NO: 2318632 - DNA, 13 bp, Homo sapiens
gtaaaaaaaaatg

SEQ ID NO: 2318633 - DNA, 23 bp, Homo sapiens
gtaaaaaaaaatgcctttgagac

SEQ ID NO: 2318634 - DNA, 13 bp, Homo sapiens
gtaaaaaatgtct

SEQ ID NO: 2318635 - DNA, 22 bp, Homo sapiens
gtaaaaaatgtctcatgtcaat

SEQ ID NO: 2318636 - DNA, 22 bp, Homo sapiens
gtaaaaactagaaggcttctct

SEQ ID NO: 2318637 - DNA, 12 bp, Homo sapiens
gtaaaaagtggc

SEQ ID NO: 2318638 - DNA, 16 bp, Homo sapiens
gtaaaaagtggctgcg

SEQ ID NO: 2318639 - DNA, 20 bp, Homo sapiens
gtaaaagtggtctctgctgg

SEQ ID NO: 2318640 - DNA, 17 bp, Homo sapiens
gtaaaatactattgcct

SEQ ID NO: 2318641 - DNA, 22 bp, Homo sapiens
gtaaaatgtatatttttaaaga

SEQ ID NO: 2318642 - DNA, 11 bp, Homo sapiens
gtaaaatgttt

SEQ ID NO: 2318643 - DNA, 12 bp, Homo sapiens
gtaaaatgttta

SEQ ID NO: 2318644 - DNA, 20 bp, Homo sapiens
gtaaactgtgtattccaaga

SEQ ID NO: 2318645 - DNA, 18 bp, Homo sapiens
gtaaagactggttttctg

SEQ ID NO: 2318646 - DNA, 19 bp, Homo sapiens
gtaaagactggttttctgc

SEQ ID NO: 2318647 - DNA, 15 bp, Homo sapiens
gtaaagatattgtat

SEQ ID NO: 2318648 - DNA, 16 bp, Homo sapiens
gtaaagatattgtatc

SEQ ID NO: 2318649 - DNA, 19 bp, Homo sapiens
gtaaagatatttttatctt

SEQ ID NO: 2318650 - DNA, 22 bp, Homo sapiens
gtaaagatatttttatctttat

SEQ ID NO: 2318651 - DNA, 16 bp, Homo sapiens
gtaaatacatgcatat

SEQ ID NO: 2318652 - DNA, 18 bp, Homo sapiens
gtaaatcagaaagtaaca

SEQ ID NO: 2318653 - DNA, 18 bp, Homo sapiens
gtaaatgcttaaatttca

SEQ ID NO: 2318654 - DNA, 16 bp, Homo sapiens
gtaaatggttaaattt

SEQ ID NO: 2318655 - DNA, 21 bp, Homo sapiens
gtaaatggttaaattttacat

SEQ ID NO: 2318656 - DNA, 16 bp, Homo sapiens
gtaaatgtcttcatgt

SEQ ID NO: 2318657 - DNA, 20 bp, Homo sapiens
gtaaatgtcttcatgttgat

SEQ ID NO: 2318658 - DNA, 12 bp, Homo sapiens
gtaaatgtgtac

SEQ ID NO: 2318659 - DNA, 20 bp, Homo sapiens
gtaaattgtcgggggagaga

SEQ ID NO: 2318660 - DNA, 15 bp, Homo sapiens
gtaacaacaattatt

SEQ ID NO: 2318661 - DNA, 18 bp, Homo sapiens
gtaacaatacatgagaaa

SEQ ID NO: 2318662 - DNA, 18 bp, Homo sapiens
gtaacagaacagcttcag

SEQ ID NO: 2318663 - DNA, 21 bp, Homo sapiens
gtaacagaacagcttcaggtt

SEQ ID NO: 2318664 - DNA, 22 bp, Homo sapiens
gtaacagaacagcttcaggtta

SEQ ID NO: 2318665 - DNA, 13 bp, Homo sapiens
gtaacattcatgt

SEQ ID NO: 2318666 - DNA, 18 bp, Homo sapiens
gtaactcagacattccaa

SEQ ID NO: 2318667 - DNA, 15 bp, Homo sapiens
gtaactgagagaaag

SEQ ID NO: 2318668 - DNA, 23 bp, Homo sapiens
gtaactgccattttttgtctgtg

SEQ ID NO: 2318669 - DNA, 23 bp, Homo sapiens
gtaactggccttacgatggcaat

SEQ ID NO: 2318670 - DNA, 12 bp, Homo sapiens
gtaactgtcagg

SEQ ID NO: 2318671 - DNA, 18 bp, Homo sapiens
gtaacttccaaataaata

SEQ ID NO: 2318672 - DNA, 20 bp, Homo sapiens
gtaacttgcttaaatttctt

SEQ ID NO: 2318673 - DNA, 16 bp, Homo sapiens
gtaagagcttgctcca

SEQ ID NO: 2318674 - DNA, 14 bp, Homo sapiens
gtaagagtgtagaa

SEQ ID NO: 2318675 - DNA, 15 bp, Homo sapiens
gtaagcattctgagc

SEQ ID NO: 2318676 - DNA, 19 bp, Homo sapiens
gtaagcattctgagctggg

SEQ ID NO: 2318677 - DNA, 14 bp, Homo sapiens
gtaagtgtaaaaaa

SEQ ID NO: 2318678 - DNA, 17 bp, Homo sapiens
gtaagtgttctcatgaa

SEQ ID NO: 2318679 - DNA, 14 bp, Homo sapiens
gtaagtttcaggtg

SEQ ID NO: 2318680 - DNA, 12 bp, Homo sapiens
gtaataaaactg

SEQ ID NO: 2318681 - DNA, 17 bp, Homo sapiens
gtaatacttccagaagt

SEQ ID NO: 2318682 - DNA, 20 bp, Homo sapiens
gtaatcccctaaaataacag

SEQ ID NO: 2318683 - DNA, 19 bp, Homo sapiens
gtaatctttacctgtatac

SEQ ID NO: 2318684 - DNA, 20 bp, Homo sapiens
gtaatctttacctgtataca

SEQ ID NO: 2318685 - DNA, 16 bp, Homo sapiens
gtaattacctggagaa

SEQ ID NO: 2318686 - DNA, 13 bp, Homo sapiens
gtaatttgaagat

SEQ ID NO: 2318687 - DNA, 14 bp, Homo sapiens
gtacacgtgtcctg

SEQ ID NO: 2318688 - DNA, 13 bp, Homo sapiens
gtacagaaagctg

SEQ ID NO: 2318689 - DNA, 14 bp, Homo sapiens
gtacagaatatttc

SEQ ID NO: 2318690 - DNA, 17 bp, Homo sapiens
gtacagaatatttctat

SEQ ID NO: 2318691 - DNA, 15 bp, Homo sapiens
gtacagaatttgaat

SEQ ID NO: 2318692 - DNA, 15 bp, Homo sapiens
gtacagcagggtctt

SEQ ID NO: 2318693 - DNA, 15 bp, Homo sapiens
gtacagtattctttt

SEQ ID NO: 2318694 - DNA, 14 bp, Homo sapiens
gtacataactgaaa

SEQ ID NO: 2318695 - DNA, 20 bp, Homo sapiens
gtacatagttatttttctct

SEQ ID NO: 2318696 - DNA, 21 bp, Homo sapiens
gtacatgttcgggtgtgggtt

SEQ ID NO: 2318697 - DNA, 13 bp, Homo sapiens
gtacatttaaatt

SEQ ID NO: 2318698 - DNA, 16 bp, Homo sapiens
gtacatttatgattta

SEQ ID NO: 2318699 - DNA, 19 bp, Homo sapiens
gtacatttatgatttaata

SEQ ID NO: 2318700 - DNA, 21 bp, Homo sapiens
gtacatttatgatttaataaa

SEQ ID NO: 2318701 - DNA, 21 bp, Homo sapiens
gtaccatgctggcggcgcaga

SEQ ID NO: 2318702 - DNA, 17 bp, Homo sapiens
gtacctagctggctctg

SEQ ID NO: 2318703 - DNA, 22 bp, Homo sapiens
gtaccttccatacacagaggag

SEQ ID NO: 2318704 - DNA, 22 bp, Homo sapiens
gtccaggggtctgtctgctttg

SEQ ID NO: 2318705 - DNA, 20 bp, Homo sapiens
gtccagggtttctctgcaga

SEQ ID NO: 2318706 - DNA, 15 bp, Homo sapiens
gtccaggtagaaaag

SEQ ID NO: 2318707 - DNA, 15 bp, Homo sapiens
gtccagtgctctgcc

SEQ ID NO: 2318708 - DNA, 18 bp, Homo sapiens
gtccagtgctctgcctca

SEQ ID NO: 2318709 - DNA, 16 bp, Homo sapiens
gtccatagagatgagc

SEQ ID NO: 2318710 - DNA, 23 bp, Homo sapiens
gtccattcattaattagttccag

SEQ ID NO: 2318711 - DNA, 13 bp, Homo sapiens
gtccattctccca

SEQ ID NO: 2318712 - DNA, 15 bp, Homo sapiens
gtcccagatgctgtc

SEQ ID NO: 2318713 - DNA, 19 bp, Homo sapiens
gtcccatttttctcttgcc

SEQ ID NO: 2318714 - DNA, 22 bp, Homo sapiens
gtccccaaccgtgtctgtctgg

SEQ ID NO: 2318715 - DNA, 12 bp, Homo sapiens
gtccccacccct

SEQ ID NO: 2318716 - DNA, 15 bp, Homo sapiens
gtccccacccctgcc

SEQ ID NO: 2318717 - DNA, 14 bp, Homo sapiens
gtccccatttctgc

SEQ ID NO: 2318718 - DNA, 18 bp, Homo sapiens
gtcccccaggctggagtg

SEQ ID NO: 2318719 - DNA, 20 bp, Homo sapiens
gtcccccaggctggagtgca

SEQ ID NO: 2318720 - DNA, 14 bp, Homo sapiens
gtcccctctctctg

SEQ ID NO: 2318721 - DNA, 15 bp, Homo sapiens
gtcccctctctctgg

SEQ ID NO: 2318722 - DNA, 13 bp, Homo sapiens
gtcccctgctaca

SEQ ID NO: 2318723 - DNA, 18 bp, Homo sapiens
gtccctccctgcctgagg

SEQ ID NO: 2318724 - DNA, 22 bp, Homo sapiens
gtccctgaggatgggtcagagc

SEQ ID NO: 2318725 - DNA, 15 bp, Homo sapiens
gtccctggaaaagga

SEQ ID NO: 2318726 - DNA, 16 bp, Homo sapiens
gtccctgtagctcagt

SEQ ID NO: 2318727 - DNA, 21 bp, Homo sapiens
gtccgcctctgcccgcagagc

SEQ ID NO: 2318728 - DNA, 22 bp, Homo sapiens
gtccgcctctgcccgcagagcc

SEQ ID NO: 2318729 - DNA, 18 bp, Homo sapiens
gtcctagcccttccctga

SEQ ID NO: 2318730 - DNA, 14 bp, Homo sapiens
gtcctccaggagct

SEQ ID NO: 2318731 - DNA, 15 bp, Homo sapiens
gtcctcctcacctca

SEQ ID NO: 2318732 - DNA, 17 bp, Homo sapiens
gtcctcctcacctcatg

SEQ ID NO: 2318733 - DNA, 18 bp, Homo sapiens
gtcctctggagccctaac

SEQ ID NO: 2318734 - DNA, 17 bp, Homo sapiens
gtcctctttagtttttg

SEQ ID NO: 2318735 - DNA, 20 bp, Homo sapiens
gtcctgagatggaaaagtgt

SEQ ID NO: 2318736 - DNA, 14 bp, Homo sapiens
gtcctggaggggct

SEQ ID NO: 2318737 - DNA, 21 bp, Homo sapiens
gtcctgtagttgcgtggactc

SEQ ID NO: 2318738 - DNA, 18 bp, Homo sapiens
gtcctgtttctgtcaagc

SEQ ID NO: 2318739 - DNA, 14 bp, Homo sapiens
gtcctttaggcagc

SEQ ID NO: 2318740 - DNA, 16 bp, Homo sapiens
gtcctttaggcagcct

SEQ ID NO: 2318741 - DNA, 19 bp, Homo sapiens
gtcctttaggcagcctgcc

SEQ ID NO: 2318742 - DNA, 21 bp, Homo sapiens
gtcctttaggcagcctgccgc

SEQ ID NO: 2318743 - DNA, 16 bp, Homo sapiens
gtcgccaaaaatacag

SEQ ID NO: 2318744 - DNA, 14 bp, Homo sapiens
gtcgggggagagag

SEQ ID NO: 2318745 - DNA, 14 bp, Homo sapiens
gtcgtgggatggca

SEQ ID NO: 2318746 - DNA, 15 bp, Homo sapiens
gtctaggactgcagt

SEQ ID NO: 2318747 - DNA, 16 bp, Homo sapiens
gtctaggcaggcaaga

SEQ ID NO: 2318748 - DNA, 13 bp, Homo sapiens
gtctattcagctt

SEQ ID NO: 2318749 - DNA, 20 bp, Homo sapiens
gtctcactttactttcaagt

SEQ ID NO: 2318750 - DNA, 19 bp, Homo sapiens
gtctcaggcagcaccacac

SEQ ID NO: 2318751 - DNA, 19 bp, Homo sapiens
gtctcagttctcttgcttt

SEQ ID NO: 2318752 - DNA, 20 bp, Homo sapiens
gtctccacctacacccctgt

SEQ ID NO: 2318753 - DNA, 23 bp, Homo sapiens
gtctccacctacacccctgtgct

SEQ ID NO: 2318754 - DNA, 14 bp, Homo sapiens
gtctcctccccttc

SEQ ID NO: 2318755 - DNA, 18 bp, Homo sapiens
gtctctactaaaaataca

SEQ ID NO: 2318756 - DNA, 10 bp, Homo sapiens
gtctctgaag

SEQ ID NO: 2318757 - DNA, 14 bp, Homo sapiens
gtctcttttaccct

SEQ ID NO: 2318758 - DNA, 15 bp, Homo sapiens
gtctgccaaacacat

SEQ ID NO: 2318759 - DNA, 21 bp, Homo sapiens
gtctgccatgttgcccctttc

SEQ ID NO: 2318760 - DNA, 15 bp, Homo sapiens
gtctgggtgctactg

SEQ ID NO: 2318761 - DNA, 13 bp, Homo sapiens
gtctgtctgcttt

SEQ ID NO: 2318762 - DNA, 14 bp, Homo sapiens
gtctgtctgctttg

SEQ ID NO: 2318763 - DNA, 16 bp, Homo sapiens
gtctgtctttcctgaa

SEQ ID NO: 2318764 - DNA, 16 bp, Homo sapiens
gtctgttatgctgtga

SEQ ID NO: 2318765 - DNA, 11 bp, Homo sapiens
gtctgttgagt

SEQ ID NO: 2318766 - DNA, 18 bp, Homo sapiens
gtcttaaaaatttataca

SEQ ID NO: 2318767 - DNA, 14 bp, Homo sapiens
gtcttagactgcta

SEQ ID NO: 2318768 - DNA, 19 bp, Homo sapiens
gtcttatgtgaaaaattaa

SEQ ID NO: 2318769 - DNA, 23 bp, Homo sapiens
gtcttcctcaaaataaagaagta

SEQ ID NO: 2318770 - DNA, 22 bp, Homo sapiens
gtcttgaagttgggtgtttcca

SEQ ID NO: 2318771 - DNA, 21 bp, Homo sapiens
gtcttggaagctgtttggaaa

SEQ ID NO: 2318772 - DNA, 15 bp, Homo sapiens
gtcttggtgtaattt

SEQ ID NO: 2318773 - DNA, 15 bp, Homo sapiens
gtcttgtacatgtgt

SEQ ID NO: 2318774 - DNA, 20 bp, Homo sapiens
gtcttgttgcggatggatgg

SEQ ID NO: 2318775 - DNA, 13 bp, Homo sapiens
gtctttcatggct

SEQ ID NO: 2318776 - DNA, 19 bp, Homo sapiens
gtctttcatggctgctgtt

SEQ ID NO: 2318777 - DNA, 20 bp, Homo sapiens
gtctttccctttaccactgt

SEQ ID NO: 2318778 - DNA, 15 bp, Homo sapiens
gtctttgtaagagtg

SEQ ID NO: 2318779 - DNA, 21 bp, Homo sapiens
gtctttgtaagagtgtagaag

SEQ ID NO: 2318780 - DNA, 22 bp, Homo sapiens
gtctttgtaagagtgtagaagc

SEQ ID NO: 2318781 - DNA, 23 bp, Homo sapiens
gtcttttcagaagcaagccagac

SEQ ID NO: 2318782 - DNA, 15 bp, Homo sapiens
gtcttttttttcctg

SEQ ID NO: 2318783 - DNA, 14 bp, Homo sapiens
gtgaaacctttttt

SEQ ID NO: 2318784 - DNA, 18 bp, Homo sapiens
gtgaaaccttttttaaga

SEQ ID NO: 2318785 - DNA, 11 bp, Homo sapiens
gtgaaattaag

SEQ ID NO: 2318786 - DNA, 14 bp, Homo sapiens
gtgaacattcccag

SEQ ID NO: 2318787 - DNA, 20 bp, Homo sapiens
gtgaacattcccagcccagc

SEQ ID NO: 2318788 - DNA, 17 bp, Homo sapiens
gtgaaccagagggtgtg

SEQ ID NO: 2318789 - DNA, 21 bp, Homo sapiens
gtgaactaatgacaagtgact

SEQ ID NO: 2318790 - DNA, 20 bp, Homo sapiens
gtgaactgcaaagctttggc

SEQ ID NO: 2318791 - DNA, 19 bp, Homo sapiens
gtgaagagggagaagcatg

SEQ ID NO: 2318792 - DNA, 18 bp, Homo sapiens
gtgaagggaagagacagc

SEQ ID NO: 2318793 - DNA, 18 bp, Homo sapiens
gtgaagttttactgtcta

SEQ ID NO: 2318794 - DNA, 22 bp, Homo sapiens
gtgaatacattaacggtgctaa

SEQ ID NO: 2318795 - DNA, 14 bp, Homo sapiens
gtgaatggattgga

SEQ ID NO: 2318796 - DNA, 19 bp, Homo sapiens
gtgaattattgacactgaa

SEQ ID NO: 2318797 - DNA, 13 bp, Homo sapiens
gtgacagtttcca

SEQ ID NO: 2318798 - DNA, 14 bp, Homo sapiens
gtgacagtttccaa

SEQ ID NO: 2318799 - DNA, 15 bp, Homo sapiens
gtgacatgtgaaacc

SEQ ID NO: 2318800 - DNA, 18 bp, Homo sapiens
gtgacatgtgaaaccttt

SEQ ID NO: 2318801 - DNA, 19 bp, Homo sapiens
gtgacatgtgaaacctttt

SEQ ID NO: 2318802 - DNA, 20 bp, Homo sapiens
gtgaccctgggcaagtcact

SEQ ID NO: 2318803 - DNA, 23 bp, Homo sapiens
gtgagctcttcctatccctctcc

SEQ ID NO: 2318804 - DNA, 19 bp, Homo sapiens
gtgagctggatagacttgg

SEQ ID NO: 2318805 - DNA, 15 bp, Homo sapiens
gtgagtttgagctgc

SEQ ID NO: 2318806 - DNA, 17 bp, Homo sapiens
gtgatagaaaagtgtgg

SEQ ID NO: 2318807 - DNA, 19 bp, Homo sapiens
gtgatatggcagaagacac

SEQ ID NO: 2318808 - DNA, 23 bp, Homo sapiens
gtgatctgttgtaatatcagtta

SEQ ID NO: 2318809 - DNA, 14 bp, Homo sapiens
gtgatgtggaggaa

SEQ ID NO: 2318810 - DNA, 21 bp, Homo sapiens
gtgatgtggaggaagagccac

SEQ ID NO: 2318811 - DNA, 23 bp, Homo sapiens
gtgattcaatctgtaaactgtgt

SEQ ID NO: 2318812 - DNA, 16 bp, Homo sapiens
gtgatttaatccagtt

SEQ ID NO: 2318813 - DNA, 21 bp, Homo sapiens
gtgatttctttaaaagaatga

SEQ ID NO: 2318814 - DNA, 16 bp, Homo sapiens
gtgatttgaattctgt

SEQ ID NO: 2318815 - DNA, 23 bp, Homo sapiens
gtgatttggaagagaggcacctg

SEQ ID NO: 2318816 - DNA, 16 bp, Homo sapiens
gtgatttttaaattaa

SEQ ID NO: 2318817 - DNA, 23 bp, Homo sapiens
gtgcacctaccccttggaaatgt

SEQ ID NO: 2318818 - DNA, 21 bp, Homo sapiens
gtgcactgggaggctcccctt

SEQ ID NO: 2318819 - DNA, 23 bp, Homo sapiens
gtgcagagccttctcagaagcac

SEQ ID NO: 2318820 - DNA, 14 bp, Homo sapiens
cttttataaagcat

SEQ ID NO: 2318821 - DNA, 15 bp, Homo sapiens
cttttatactgacac

SEQ ID NO: 2318822 - DNA, 22 bp, Homo sapiens
cttttcaaatagggtctaactc

SEQ ID NO: 2318823 - DNA, 20 bp, Homo sapiens
cttttcacattaggctgttg

SEQ ID NO: 2318824 - DNA, 16 bp, Homo sapiens
cttttcagggctggct

SEQ ID NO: 2318825 - DNA, 20 bp, Homo sapiens
cttttcagggctggctcctg

SEQ ID NO: 2318826 - DNA, 22 bp, Homo sapiens
cttttcccactccaagcccagc

SEQ ID NO: 2318827 - DNA, 20 bp, Homo sapiens
cttttcccctttcctgtccc

SEQ ID NO: 2318828 - DNA, 21 bp, Homo sapiens
cttttcccctttcctgtccca

SEQ ID NO: 2318829 - DNA, 13 bp, Homo sapiens
cttttccctgctt

SEQ ID NO: 2318830 - DNA, 14 bp, Homo sapiens
cttttccctgcttc

SEQ ID NO: 2318831 - DNA, 15 bp, Homo sapiens
cttttccctgcttcc

SEQ ID NO: 2318832 - DNA, 21 bp, Homo sapiens
cttttctaatcacagtgttgc

SEQ ID NO: 2318833 - DNA, 17 bp, Homo sapiens
cttttctcagtgttggt

SEQ ID NO: 2318834 - DNA, 15 bp, Homo sapiens
cttttctgccctggc

SEQ ID NO: 2318835 - DNA, 19 bp, Homo sapiens
cttttctgccctggctgct

SEQ ID NO: 2318836 - DNA, 13 bp, Homo sapiens
cttttctggaatt

SEQ ID NO: 2318837 - DNA, 18 bp, Homo sapiens
cttttctttttttcttta

SEQ ID NO: 2318838 - DNA, 19 bp, Homo sapiens
cttttgaaaagaccaagac

SEQ ID NO: 2318839 - DNA, 21 bp, Homo sapiens
cttttgaaagtagagctagct

SEQ ID NO: 2318840 - DNA, 12 bp, Homo sapiens
cttttgctgtgc

SEQ ID NO: 2318841 - DNA, 13 bp, Homo sapiens
cttttgctgtgca

SEQ ID NO: 2318842 - DNA, 20 bp, Homo sapiens
cttttgcttgccaaagtaca

SEQ ID NO: 2318843 - DNA, 14 bp, Homo sapiens
cttttgtaataaac

SEQ ID NO: 2318844 - DNA, 23 bp, Homo sapiens
cttttgtactgaatttttttgta

SEQ ID NO: 2318845 - DNA, 21 bp, Homo sapiens
cttttgttagggctgcttttc

SEQ ID NO: 2318846 - DNA, 18 bp, Homo sapiens
ctttttaaaaattgttat

SEQ ID NO: 2318847 - DNA, 20 bp, Homo sapiens
ctttttaaatgtaaagatat

SEQ ID NO: 2318848 - DNA, 22 bp, Homo sapiens
ctttttcaaaaaccagccaggc

SEQ ID NO: 2318849 - DNA, 17 bp, Homo sapiens
ctttttcccctttctgt

SEQ ID NO: 2318850 - DNA, 11 bp, Homo sapiens
ctttttcctcc

SEQ ID NO: 2318851 - DNA, 12 bp, Homo sapiens
ctttttggaatc

SEQ ID NO: 2318852 - DNA, 20 bp, Homo sapiens
cttttttaagatttttctca

SEQ ID NO: 2318853 - DNA, 19 bp, Homo sapiens
cttttttgtggcaattagt

SEQ ID NO: 2318854 - DNA, 20 bp, Homo sapiens
ctttttttaagtgttctgtg

SEQ ID NO: 2318855 - DNA, 13 bp, Homo sapiens
ctttttttttaag

SEQ ID NO: 2318856 - DNA, 18 bp, Homo sapiens
ctttttttttaagttctt

SEQ ID NO: 2318857 - DNA, 21 bp, Homo sapiens
ctttttttttaagttcttatg

SEQ ID NO: 2318858 - DNA, 17 bp, Homo sapiens
gaaaaacacaagcaaaa

SEQ ID NO: 2318859 - DNA, 16 bp, Homo sapiens
gaaaaatataaaatta

SEQ ID NO: 2318860 - DNA, 13 bp, Homo sapiens
gaaaaatctcatt

SEQ ID NO: 2318861 - DNA, 13 bp, Homo sapiens
gaaaaatcttaag

SEQ ID NO: 2318862 - DNA, 14 bp, Homo sapiens
gaaaaattaacttt

SEQ ID NO: 2318863 - DNA, 14 bp, Homo sapiens
gaaaacatgttaat

SEQ ID NO: 2318864 - DNA, 20 bp, Homo sapiens
gaaaacatgttaatgacaat

SEQ ID NO: 2318865 - DNA, 19 bp, Homo sapiens
gaaaactgtgttgccacag

SEQ ID NO: 2318866 - DNA, 15 bp, Homo sapiens
gaaaagaaggaaaga

SEQ ID NO: 2318867 - DNA, 21 bp, Homo sapiens
gaaaagacacattttttagga

SEQ ID NO: 2318868 - DNA, 19 bp, Homo sapiens
gaaaagataaagaccagaa

SEQ ID NO: 2318869 - DNA, 15 bp, Homo sapiens
gaaaagcagacattt

SEQ ID NO: 2318870 - DNA, 16 bp, Homo sapiens
gaaaagcagacatttt

SEQ ID NO: 2318871 - DNA, 19 bp, Homo sapiens
gaaaagctattagccagga

SEQ ID NO: 2318872 - DNA, 20 bp, Homo sapiens
gaaaagctattagccaggat

SEQ ID NO: 2318873 - DNA, 20 bp, Homo sapiens
gaaaaggaagactagaggct

SEQ ID NO: 2318874 - DNA, 23 bp, Homo sapiens
gaaaagtggcgtgggagccagcc

SEQ ID NO: 2318875 - DNA, 16 bp, Homo sapiens
gaaaagttggaaggat

SEQ ID NO: 2318876 - DNA, 15 bp, Homo sapiens
gaaaataactgaatt

SEQ ID NO: 2318877 - DNA, 22 bp, Homo sapiens
gaaaatatagacattctcacat

SEQ ID NO: 2318878 - DNA, 15 bp, Homo sapiens
gaaaatattgtttta

SEQ ID NO: 2318879 - DNA, 14 bp, Homo sapiens
gaaaatatttcatt

SEQ ID NO: 2318880 - DNA, 17 bp, Homo sapiens
gaaaatgaaatgcatat

SEQ ID NO: 2318881 - DNA, 18 bp, Homo sapiens
gaaaatgaaatgcatatt

SEQ ID NO: 2318882 - DNA, 15 bp, Homo sapiens
gaaaatgtatccaag

SEQ ID NO: 2318883 - DNA, 22 bp, Homo sapiens
gaaaattctaacccaggtatcc

SEQ ID NO: 2318884 - DNA, 12 bp, Homo sapiens
gaaaattgtatt

SEQ ID NO: 2318885 - DNA, 17 bp, Homo sapiens
gaaaattttctccttgg

SEQ ID NO: 2318886 - DNA, 17 bp, Homo sapiens
gaaacaaagtactcttt

SEQ ID NO: 2318887 - DNA, 18 bp, Homo sapiens
gaaacaacatttatatgt

SEQ ID NO: 2318888 - DNA, 11 bp, Homo sapiens
gaaacacacga

SEQ ID NO: 2318889 - DNA, 22 bp, Homo sapiens
gaaacacccctctgtctaggac

SEQ ID NO: 2318890 - DNA, 16 bp, Homo sapiens
gaaacactgaaaagaa

SEQ ID NO: 2318891 - DNA, 12 bp, Homo sapiens
gaaacagcctgg

SEQ ID NO: 2318892 - DNA, 17 bp, Homo sapiens
gaaacagttgctgtgaa

SEQ ID NO: 2318893 - DNA, 13 bp, Homo sapiens
gaaacatctctgg

SEQ ID NO: 2318894 - DNA, 14 bp, Homo sapiens
gaaacatctctggc

SEQ ID NO: 2318895 - DNA, 19 bp, Homo sapiens
gaaacctcagggctgtccc

SEQ ID NO: 2318896 - DNA, 18 bp, Homo sapiens
gaaaccttttttaagatt

SEQ ID NO: 2318897 - DNA, 20 bp, Homo sapiens
gaaaccttttttaagatttt

SEQ ID NO: 2318898 - DNA, 21 bp, Homo sapiens
gaaaccttttttaagattttt

SEQ ID NO: 2318899 - DNA, 21 bp, Homo sapiens
gaaactaagccaggcctggct

SEQ ID NO: 2318900 - DNA, 18 bp, Homo sapiens
gaaactcatagacactga

SEQ ID NO: 2318901 - DNA, 20 bp, Homo sapiens
gaaactccacatctgcctta

SEQ ID NO: 2318902 - DNA, 21 bp, Homo sapiens
gaaactcttatctcagtcatg

SEQ ID NO: 2318903 - DNA, 19 bp, Homo sapiens
gaaactttgatctctgctt

SEQ ID NO: 2318904 - DNA, 21 bp, Homo sapiens
gaaactttgggaaaacatgtt

SEQ ID NO: 2318905 - DNA, 20 bp, Homo sapiens
gaaacttttgttagggctgc

SEQ ID NO: 2318906 - DNA, 12 bp, Homo sapiens
gaaagaagccat

SEQ ID NO: 2318907 - DNA, 13 bp, Homo sapiens
gaaagaagccata

SEQ ID NO: 2318908 - DNA, 19 bp, Homo sapiens
gaaagagcagtcagagtcc

SEQ ID NO: 2318909 - DNA, 15 bp, Homo sapiens
gaaagagtctgggac

SEQ ID NO: 2318910 - DNA, 15 bp, Homo sapiens
gaaagcagaatcaac

SEQ ID NO: 2318911 - DNA, 22 bp, Homo sapiens
gaaagcagagttttcattaaat

SEQ ID NO: 2318912 - DNA, 20 bp, Homo sapiens
gaaagcctctctctccctcc

SEQ ID NO: 2318913 - DNA, 17 bp, Homo sapiens
gaaagctgcctggtata

SEQ ID NO: 2318914 - DNA, 15 bp, Homo sapiens
gaaagctgtgtttat

SEQ ID NO: 2318915 - DNA, 12 bp, Homo sapiens
gaaaggaaaaga

SEQ ID NO: 2318916 - DNA, 14 bp, Homo sapiens
gaaaggaaaagaaa

SEQ ID NO: 2318917 - DNA, 22 bp, Homo sapiens
gaaaggaggccctgttccctgg

SEQ ID NO: 2318918 - DNA, 15 bp, Homo sapiens
gaaaggggagagcct

SEQ ID NO: 2318919 - DNA, 20 bp, Homo sapiens
gaaaggggagagcctgctgg

SEQ ID NO: 2318920 - DNA, 21 bp, Homo sapiens
gaaaggggagagcctgctggc

SEQ ID NO: 2318921 - DNA, 14 bp, Homo sapiens
gaaaggggtgcttt

SEQ ID NO: 2318922 - DNA, 15 bp, Homo sapiens
gaaaggggtgctttt

SEQ ID NO: 2318923 - DNA, 22 bp, Homo sapiens
gaaaggttaaaaaagcgaggtg

SEQ ID NO: 2318924 - DNA, 17 bp, Homo sapiens
gaaagtcaaaaaattat

SEQ ID NO: 2318925 - DNA, 18 bp, Homo sapiens
gaaagtcaaaaaattatt

SEQ ID NO: 2318926 - DNA, 20 bp, Homo sapiens
gaaagtgcatttttgtaaat

SEQ ID NO: 2318927 - DNA, 17 bp, Homo sapiens
gaaagttaacattaatg

SEQ ID NO: 2318928 - DNA, 17 bp, Homo sapiens
gaaagttgtgatctgtt

SEQ ID NO: 2318929 - DNA, 17 bp, Homo sapiens
gaaagttttgtaaaaga

SEQ ID NO: 2318930 - DNA, 11 bp, Homo sapiens
gaaagtttttt

SEQ ID NO: 2318931 - DNA, 16 bp, Homo sapiens
gaaataaaatatatct

SEQ ID NO: 2318932 - DNA, 19 bp, Homo sapiens
gtgcagtttcttttcacat

SEQ ID NO: 2318933 - DNA, 14 bp, Homo sapiens
gtgcatagtttctt

SEQ ID NO: 2318934 - DNA, 18 bp, Homo sapiens
gtgcatcccccctgctca

SEQ ID NO: 2318935 - DNA, 23 bp, Homo sapiens
gtgcatgtatgtcttggacactg

SEQ ID NO: 2318936 - DNA, 18 bp, Homo sapiens
gtgcatttttgtgaaatg

SEQ ID NO: 2318937 - DNA, 18 bp, Homo sapiens
gtgccactgacttgctgt

SEQ ID NO: 2318938 - DNA, 22 bp, Homo sapiens
gtgccagaggaatcctggcagc

SEQ ID NO: 2318939 - DNA, 17 bp, Homo sapiens
gtgccatagtcacatgg

SEQ ID NO: 2318940 - DNA, 15 bp, Homo sapiens
gtgcccatcctgcca

SEQ ID NO: 2318941 - DNA, 16 bp, Homo sapiens
gtgcccatcctgccat

SEQ ID NO: 2318942 - DNA, 13 bp, Homo sapiens
gtgccctctccca

SEQ ID NO: 2318943 - DNA, 17 bp, Homo sapiens
gtgccctctcccaccct

SEQ ID NO: 2318944 - DNA, 18 bp, Homo sapiens
gtgccctctcccaccctc

SEQ ID NO: 2318945 - DNA, 12 bp, Homo sapiens
gtgccgtggcac

SEQ ID NO: 2318946 - DNA, 23 bp, Homo sapiens
gtgcctacatcccgggcctcagt

SEQ ID NO: 2318947 - DNA, 15 bp, Homo sapiens
gtgcctcttccagtg

SEQ ID NO: 2318948 - DNA, 19 bp, Homo sapiens
gtgcctcttccagtgaaca

SEQ ID NO: 2318949 - DNA, 14 bp, Homo sapiens
gtgcctgagaggca

SEQ ID NO: 2318950 - DNA, 18 bp, Homo sapiens
gttgtagcatttaaaatg

SEQ ID NO: 2318951 - DNA, 16 bp, Homo sapiens
gttgtcaaggaagaag

SEQ ID NO: 2318952 - DNA, 16 bp, Homo sapiens
gttgtcttatgtgaaa

SEQ ID NO: 2318953 - DNA, 14 bp, Homo sapiens
gttgtcttattgca

SEQ ID NO: 2318954 - DNA, 13 bp, Homo sapiens
gttgtgcttgagc

SEQ ID NO: 2318955 - DNA, 13 bp, Homo sapiens
gttgttcgggcca

SEQ ID NO: 2318956 - DNA, 16 bp, Homo sapiens
gttgtttataataaaa

SEQ ID NO: 2318957 - DNA, 18 bp, Homo sapiens
gttgtttataataaaaat

SEQ ID NO: 2318958 - DNA, 13 bp, Homo sapiens
gttgtttctttct

SEQ ID NO: 2318959 - DNA, 13 bp, Homo sapiens
gttgttttgtgga

SEQ ID NO: 2318960 - DNA, 18 bp, Homo sapiens
gttgttttttcattgtgt

SEQ ID NO: 2318961 - DNA, 21 bp, Homo sapiens
gtttaaaataaaatgaaaatt

SEQ ID NO: 2318962 - DNA, 13 bp, Homo sapiens
gtttaaaatgtaa

SEQ ID NO: 2318963 - DNA, 21 bp, Homo sapiens
gtttaaaatgtaatttaaatg

SEQ ID NO: 2318964 - DNA, 21 bp, Homo sapiens
gtttaacagaaaaatgaaatt

SEQ ID NO: 2318965 - DNA, 23 bp, Homo sapiens
gtttacttctcgaattgaagcaa

SEQ ID NO: 2318966 - DNA, 15 bp, Homo sapiens
gtttagttctgttga

SEQ ID NO: 2318967 - DNA, 21 bp, Homo sapiens
gtttatatggaagaaagtaag

SEQ ID NO: 2318968 - DNA, 14 bp, Homo sapiens
gtttattaaatgct

SEQ ID NO: 2318969 - DNA, 18 bp, Homo sapiens
gtttcagtttgttggaaa

SEQ ID NO: 2318970 - DNA, 12 bp, Homo sapiens
gtttctgactct

SEQ ID NO: 2318971 - DNA, 13 bp, Homo sapiens
gtttctgactctg

SEQ ID NO: 2318972 - DNA, 16 bp, Homo sapiens
gtttcttagcttttta

SEQ ID NO: 2318973 - DNA, 18 bp, Homo sapiens
gtttcttcaagagctgag

SEQ ID NO: 2318974 - DNA, 14 bp, Homo sapiens
gtttcttgctgcca

SEQ ID NO: 2318975 - DNA, 21 bp, Homo sapiens
gtttcttgctgccatgatgta

SEQ ID NO: 2318976 - DNA, 19 bp, Homo sapiens
gtttctttattttgtgtaa

SEQ ID NO: 2318977 - DNA, 20 bp, Homo sapiens
gtttctttattttgtgtaaa

SEQ ID NO: 2318978 - DNA, 14 bp, Homo sapiens
gtttcttttaaaga

SEQ ID NO: 2318979 - DNA, 14 bp, Homo sapiens
gtttcttttgtttg

SEQ ID NO: 2318980 - DNA, 21 bp, Homo sapiens
gtttgaagattatatgaagtt

SEQ ID NO: 2318981 - DNA, 13 bp, Homo sapiens
gtttgagctgcct

SEQ ID NO: 2318982 - DNA, 18 bp, Homo sapiens
gtttgagtttttcctccc

SEQ ID NO: 2318983 - DNA, 15 bp, Homo sapiens
gtttggaatattaaa

SEQ ID NO: 2318984 - DNA, 16 bp, Homo sapiens
gtttggtaaatgtttc

SEQ ID NO: 2318985 - DNA, 13 bp, Homo sapiens
gtttggtgcttct

SEQ ID NO: 2318986 - DNA, 15 bp, Homo sapiens
gtttgtcacaagtgg

SEQ ID NO: 2318987 - DNA, 21 bp, Homo sapiens
gttttaaacccaaaatatata

SEQ ID NO: 2318988 - DNA, 20 bp, Homo sapiens
gttttaaagttcattgcaat

SEQ ID NO: 2318989 - DNA, 13 bp, Homo sapiens
gttttactgtcta

SEQ ID NO: 2318990 - DNA, 21 bp, Homo sapiens
gttttacttttaaactgtgta

SEQ ID NO: 2318991 - DNA, 15 bp, Homo sapiens
gttttatactgaagg

SEQ ID NO: 2318992 - DNA, 13 bp, Homo sapiens
gttttccttctgt

SEQ ID NO: 2318993 - DNA, 11 bp, Homo sapiens
gttttcttctt

SEQ ID NO: 2318994 - DNA, 15 bp, Homo sapiens
gttttcttctttccc

SEQ ID NO: 2318995 - DNA, 22 bp, Homo sapiens
gttttcttctttccctggacag

SEQ ID NO: 2318996 - DNA, 21 bp, Homo sapiens
gttttcttttttaaatgtttc

SEQ ID NO: 2318997 - DNA, 15 bp, Homo sapiens
gttttgaaaagctat

SEQ ID NO: 2318998 - DNA, 16 bp, Homo sapiens
gttttggggactcatt

SEQ ID NO: 2318999 - DNA, 13 bp, Homo sapiens
gttttgtaaaaga

SEQ ID NO: 2319000 - DNA, 17 bp, Homo sapiens
gttttgtggtttggaat

SEQ ID NO: 2319001 - DNA, 15 bp, Homo sapiens
gtttttaagtcctgt

SEQ ID NO: 2319002 - DNA, 20 bp, Homo sapiens
gtttttagcatgttcctcct

SEQ ID NO: 2319003 - DNA, 16 bp, Homo sapiens
gtttttccctccccag

SEQ ID NO: 2319004 - DNA, 17 bp, Homo sapiens
gtttttccctccccaga

SEQ ID NO: 2319005 - DNA, 19 bp, Homo sapiens
gtttttccctccccagaat

SEQ ID NO: 2319006 - DNA, 13 bp, Homo sapiens
gtttttcctccca

SEQ ID NO: 2319007 - DNA, 14 bp, Homo sapiens
gtttttcctttaaa

SEQ ID NO: 2319008 - DNA, 13 bp, Homo sapiens
gtttttttccagt

SEQ ID NO: 2319009 - DNA, 16 bp, Homo sapiens
taaaaaaaaaagtcac

SEQ ID NO: 2319010 - DNA, 15 bp, Homo sapiens
taaaaaaaaatgcct

SEQ ID NO: 2319011 - DNA, 16 bp, Homo sapiens
taaaaaaatttaagtg

SEQ ID NO: 2319012 - DNA, 19 bp, Homo sapiens
taaaaaaccaacaatgtga

SEQ ID NO: 2319013 - DNA, 22 bp, Homo sapiens
taaaaaatcatgccagtatttt

SEQ ID NO: 2319014 - DNA, 14 bp, Homo sapiens
taaaaaatggtcac

SEQ ID NO: 2319015 - DNA, 14 bp, Homo sapiens
taaaaaatggttaa

SEQ ID NO: 2319016 - DNA, 13 bp, Homo sapiens
taaaaaatgtctc

SEQ ID NO: 2319017 - DNA, 19 bp, Homo sapiens
taaaaacaactttcacttc

SEQ ID NO: 2319018 - DNA, 19 bp, Homo sapiens
taaaaacctgcttggtgtg

SEQ ID NO: 2319019 - DNA, 14 bp, Homo sapiens
taaaaagatcactt

SEQ ID NO: 2319020 - DNA, 11 bp, Homo sapiens
taaaaagtggc

SEQ ID NO: 2319021 - DNA, 19 bp, Homo sapiens
taaaaatattgtttctgca

SEQ ID NO: 2319022 - DNA, 17 bp, Homo sapiens
taaaaatcattgattgt

SEQ ID NO: 2319023 - DNA, 11 bp, Homo sapiens
taaaaatcttt

SEQ ID NO: 2319024 - DNA, 22 bp, Homo sapiens
taaaaatttatacaccagcaat

SEQ ID NO: 2319025 - DNA, 15 bp, Homo sapiens
taaaacaaatataca

SEQ ID NO: 2319026 - DNA, 18 bp, Homo sapiens
taaaacagaatcttctgg

SEQ ID NO: 2319027 - DNA, 12 bp, Homo sapiens
taaaacagcttc

SEQ ID NO: 2319028 - DNA, 12 bp, Homo sapiens
taaaacagtggt

SEQ ID NO: 2319029 - DNA, 21 bp, Homo sapiens
taaaacagtggttgttttttc

SEQ ID NO: 2319030 - DNA, 19 bp, Homo sapiens
taaaacccatttaaatttt

SEQ ID NO: 2319031 - DNA, 17 bp, Homo sapiens
taaaacccgttgattac

SEQ ID NO: 2319032 - DNA, 19 bp, Homo sapiens
taaaacgaatggtctttgc

SEQ ID NO: 2319033 - DNA, 21 bp, Homo sapiens
taaaactgtttgacttctcaa

SEQ ID NO: 2319034 - DNA, 12 bp, Homo sapiens
taaaagaaaatt

SEQ ID NO: 2319035 - DNA, 16 bp, Homo sapiens
taaaagaaataaacca

SEQ ID NO: 2319036 - DNA, 21 bp, Homo sapiens
taaaagatggttgtagcattt

SEQ ID NO: 2319037 - DNA, 15 bp, Homo sapiens
taaaagctttcatgt

SEQ ID NO: 2319038 - DNA, 16 bp, Homo sapiens
taaaagctttcatgtc

SEQ ID NO: 2319039 - DNA, 20 bp, Homo sapiens
taaaaggtggagtttctctg

SEQ ID NO: 2319040 - DNA, 20 bp, Homo sapiens
taaaagtggtctctgctggg

SEQ ID NO: 2319041 - DNA, 15 bp, Homo sapiens
taaaagtgtgtaaat

SEQ ID NO: 2319042 - DNA, 17 bp, Homo sapiens
taaaagttgcattttaa

SEQ ID NO: 2319043 - DNA, 13 bp, Homo sapiens
taaaataaactag

SEQ ID NO: 2319044 - DNA, 14 bp, Homo sapiens
taaaataaactaga

SEQ ID NO: 2319045 - DNA, 16 bp, Homo sapiens
taaaataaactagata

SEQ ID NO: 2319046 - DNA, 21 bp, Homo sapiens
taaaataattcatatctaaat

SEQ ID NO: 2319047 - DNA, 23 bp, Homo sapiens
taaaatacagctgcactgaggca

SEQ ID NO: 2319048 - DNA, 16 bp, Homo sapiens
taaaatagaataattc

SEQ ID NO: 2319049 - DNA, 22 bp, Homo sapiens
taaaatagaataattcttttct

SEQ ID NO: 2319050 - DNA, 18 bp, Homo sapiens
taaaatatcataaagcat

SEQ ID NO: 2319051 - DNA, 12 bp, Homo sapiens
taaaatatctat

SEQ ID NO: 2319052 - DNA, 22 bp, Homo sapiens
taaaatccccttcgctgaaatt

SEQ ID NO: 2319053 - DNA, 12 bp, Homo sapiens
taaaatggaaaa

SEQ ID NO: 2319054 - DNA, 17 bp, Homo sapiens
taaaatgtaatttaaat

SEQ ID NO: 2319055 - DNA, 20 bp, Homo sapiens
taaaatgtaatttaaatgaa

SEQ ID NO: 2319056 - DNA, 19 bp, Homo sapiens
taaaatgtttaatggtgaa

SEQ ID NO: 2319057 - DNA, 17 bp, Homo sapiens
taaaatgtttcattatg

SEQ ID NO: 2319058 - DNA, 19 bp, Homo sapiens
taaaatgttttatgacatt

SEQ ID NO: 2319059 - DNA, 21 bp, Homo sapiens
taaaatgttttatgacatttt

SEQ ID NO: 2319060 - DNA, 14 bp, Homo sapiens
taaaattcagtttt

SEQ ID NO: 2319061 - DNA, 21 bp, Homo sapiens
taaaattctctagatttatta

SEQ ID NO: 2319062 - DNA, 15 bp, Homo sapiens
taaaattgttatcaa

SEQ ID NO: 2319063 - DNA, 18 bp, Homo sapiens
taaaattttttattttaa

SEQ ID NO: 2319064 - DNA, 23 bp, Homo sapiens
taaaattttttgatgtcagcctt

SEQ ID NO: 2319065 - DNA, 18 bp, Homo sapiens
taaacaaagtttcagagt

SEQ ID NO: 2319066 - DNA, 18 bp, Homo sapiens
taaacaacgcattgccac

SEQ ID NO: 2319067 - DNA, 22 bp, Homo sapiens
taaacaacgcattgccacggaa

SEQ ID NO: 2319068 - DNA, 21 bp, Homo sapiens
taaacaataaaaacaactttc

SEQ ID NO: 2319069 - DNA, 11 bp, Homo sapiens
taaacattttc

SEQ ID NO: 2319070 - DNA, 14 bp, Homo sapiens
taaaccaaaaacat

SEQ ID NO: 2319071 - DNA, 15 bp, Homo sapiens
taaaccaaaaacatt

SEQ ID NO: 2319072 - DNA, 17 bp, Homo sapiens
taaaccaaggactgagc

SEQ ID NO: 2319073 - DNA, 22 bp, Homo sapiens
taaaccacttaaacgaagagtt

SEQ ID NO: 2319074 - DNA, 15 bp, Homo sapiens
taaaccgtgtattta

SEQ ID NO: 2319075 - DNA, 11 bp, Homo sapiens
taaacctacct

SEQ ID NO: 2319076 - DNA, 16 bp, Homo sapiens
taaacctcctgctgtg

SEQ ID NO: 2319077 - DNA, 21 bp, Homo sapiens
taaacggtgcccatcctgcca

SEQ ID NO: 2319078 - DNA, 14 bp, Homo sapiens
taaacggttcctgg

SEQ ID NO: 2319079 - DNA, 23 bp, Homo sapiens
taaacgtgatttttaaattaaat

SEQ ID NO: 2319080 - DNA, 14 bp, Homo sapiens
taaactaaaaacta

SEQ ID NO: 2319081 - DNA, 16 bp, Homo sapiens
taaactccttcctggc

SEQ ID NO: 2319082 - DNA, 21 bp, Homo sapiens
taaactccttcctggcctgag

SEQ ID NO: 2319083 - DNA, 17 bp, Homo sapiens
taaactgtgtattccaa

SEQ ID NO: 2319084 - DNA, 22 bp, Homo sapiens
taaactgtgtattccaagacat

SEQ ID NO: 2319085 - DNA, 22 bp, Homo sapiens
taaacttctgcaacaagcatgc

SEQ ID NO: 2319086 - DNA, 20 bp, Homo sapiens
taaacttgtttgctgtgaac

SEQ ID NO: 2319087 - DNA, 15 bp, Homo sapiens
taaagaaagcagaat

SEQ ID NO: 2319088 - DNA, 13 bp, Homo sapiens
taaagaaaggaaa

SEQ ID NO: 2319089 - DNA, 16 bp, Homo sapiens
taaagaaaggaaaaga

SEQ ID NO: 2319090 - DNA, 17 bp, Homo sapiens
taaagaaaggaaaagaa

SEQ ID NO: 2319091 - DNA, 16 bp, Homo sapiens
taaagaaggatgatgt

SEQ ID NO: 2319092 - DNA, 19 bp, Homo sapiens
taaagaccctcctattcta

SEQ ID NO: 2319093 - DNA, 23 bp, Homo sapiens
taaagaccctcctattctataaa

SEQ ID NO: 2319094 - DNA, 19 bp, Homo sapiens
taaagactggttttctgcc

SEQ ID NO: 2319095 - DNA, 22 bp, Homo sapiens
taaagactggttttctgccaat

SEQ ID NO: 2319096 - DNA, 13 bp, Homo sapiens
taaagagaatgag

SEQ ID NO: 2319097 - DNA, 18 bp, Homo sapiens
taaagatatttttatctt

SEQ ID NO: 2319098 - DNA, 13 bp, Homo sapiens
taaagatgagttg

SEQ ID NO: 2319099 - DNA, 14 bp, Homo sapiens
taaagcactgagca

SEQ ID NO: 2319100 - DNA, 17 bp, Homo sapiens
taaagccattctgatta

SEQ ID NO: 2319101 - DNA, 20 bp, Homo sapiens
taaagctcaaatgaaatgta

SEQ ID NO: 2319102 - DNA, 20 bp, Homo sapiens
taaaggaagcactctgtata

SEQ ID NO: 2319103 - DNA, 15 bp, Homo sapiens
taaaggatccagaga

SEQ ID NO: 2319104 - DNA, 20 bp, Homo sapiens
taaaggcatccttgtctttt

SEQ ID NO: 2319105 - DNA, 18 bp, Homo sapiens
taaagggcccaatgaatt

SEQ ID NO: 2319106 - DNA, 20 bp, Homo sapiens
taaagggcccaatgaattat

SEQ ID NO: 2319107 - DNA, 15 bp, Homo sapiens
taaagtacaaatgaa

SEQ ID NO: 2319108 - DNA, 18 bp, Homo sapiens
taaagtacaaatgaagaa

SEQ ID NO: 2319109 - DNA, 21 bp, Homo sapiens
taaagtatacaactgcctggg

SEQ ID NO: 2319110 - DNA, 13 bp, Homo sapiens
taaagtattttct

SEQ ID NO: 2319111 - DNA, 14 bp, Homo sapiens
taaagtattttctt

SEQ ID NO: 2319112 - DNA, 21 bp, Homo sapiens
taaagtcagttgctcaaaaag

SEQ ID NO: 2319113 - DNA, 14 bp, Homo sapiens
taaataaaaattca

SEQ ID NO: 2319114 - DNA, 14 bp, Homo sapiens
taaataaaccactg

SEQ ID NO: 2319115 - DNA, 13 bp, Homo sapiens
taaataactgtgt

SEQ ID NO: 2319116 - DNA, 13 bp, Homo sapiens
taaataattttaa

SEQ ID NO: 2319117 - DNA, 20 bp, Homo sapiens
taaatacatgccacatcaaa

SEQ ID NO: 2319118 - DNA, 13 bp, Homo sapiens
taaataggaaagt

SEQ ID NO: 2319119 - DNA, 16 bp, Homo sapiens
taaataggagaggatg

SEQ ID NO: 2319120 - DNA, 18 bp, Homo sapiens
taaatagtgtcatataaa

SEQ ID NO: 2319121 - DNA, 22 bp, Homo sapiens
taaatatgcaatatatgttcat

SEQ ID NO: 2319122 - DNA, 13 bp, Homo sapiens
taaatatgcagtg

SEQ ID NO: 2319123 - DNA, 14 bp, Homo sapiens
taaatatgcagtga

SEQ ID NO: 2319124 - DNA, 16 bp, Homo sapiens
taaatatgcagtgata

SEQ ID NO: 2319125 - DNA, 12 bp, Homo sapiens
taaatcagaaag

SEQ ID NO: 2319126 - DNA, 14 bp, Homo sapiens
taaatcagaaagta

SEQ ID NO: 2319127 - DNA, 17 bp, Homo sapiens
taaatcagaaagtaaca

SEQ ID NO: 2319128 - DNA, 14 bp, Homo sapiens
taaatctcctgtgg

SEQ ID NO: 2319129 - DNA, 22 bp, Homo sapiens
taaatgccctcttctcgtgcct

SEQ ID NO: 2319130 - DNA, 16 bp, Homo sapiens
taaatgcttaaatttc

SEQ ID NO: 2319131 - DNA, 18 bp, Homo sapiens
taaatggtaataagcact

SEQ ID NO: 2319132 - DNA, 18 bp, Homo sapiens
taaatggttaaattttac

SEQ ID NO: 2319133 - DNA, 15 bp, Homo sapiens
taaatgtataaatat

SEQ ID NO: 2319134 - DNA, 15 bp, Homo sapiens
taaatgtcttcatgt

SEQ ID NO: 2319135 - DNA, 19 bp, Homo sapiens
taaatgtgtttcttgctgc

SEQ ID NO: 2319136 - DNA, 12 bp, Homo sapiens
taaatgttacct

SEQ ID NO: 2319137 - DNA, 19 bp, Homo sapiens
taaattatagtgtagaaaa

SEQ ID NO: 2319138 - DNA, 15 bp, Homo sapiens
taaattatcattgtt

SEQ ID NO: 2319139 - DNA, 13 bp, Homo sapiens
taaattatttatg

SEQ ID NO: 2319140 - DNA, 19 bp, Homo sapiens
taaattcaactttgtaaaa

SEQ ID NO: 2319141 - DNA, 19 bp, Homo sapiens
taaattcgtgattttcaag

SEQ ID NO: 2319142 - DNA, 16 bp, Homo sapiens
taaattgcatcactgt

SEQ ID NO: 2319143 - DNA, 13 bp, Homo sapiens
taaattgtaaaac

SEQ ID NO: 2319144 - DNA, 20 bp, Homo sapiens
taaatttgtaagtttcaggt

SEQ ID NO: 2319145 - DNA, 23 bp, Homo sapiens
taaatttgtaagtttcaggtgac

SEQ ID NO: 2319146 - DNA, 14 bp, Homo sapiens
taaattttaaagcc

SEQ ID NO: 2319147 - DNA, 17 bp, Homo sapiens
taaattttaactaaatt

SEQ ID NO: 2319148 - DNA, 13 bp, Homo sapiens
taaattttacatg

SEQ ID NO: 2319149 - DNA, 16 bp, Homo sapiens
taaattttagatcttt

SEQ ID NO: 2319150 - DNA, 13 bp, Homo sapiens
taaattttctaaa

SEQ ID NO: 2319151 - DNA, 13 bp, Homo sapiens
taacaaagacaaa

SEQ ID NO: 2319152 - DNA, 19 bp, Homo sapiens
taacaacaattatttgaag

SEQ ID NO: 2319153 - DNA, 12 bp, Homo sapiens
taacaagatgtt

SEQ ID NO: 2319154 - DNA, 21 bp, Homo sapiens
taacaagatgtttcattttac

SEQ ID NO: 2319155 - DNA, 23 bp, Homo sapiens
taacaatctatggcttatttcta

SEQ ID NO: 2319156 - DNA, 14 bp, Homo sapiens
taacaatgttaagg

SEQ ID NO: 2319157 - DNA, 16 bp, Homo sapiens
taacaatgttaaggaa

SEQ ID NO: 2319158 - DNA, 23 bp, Homo sapiens
taacaatgttaaggaaactctta

SEQ ID NO: 2319159 - DNA, 17 bp, Homo sapiens
taacacagcatgtgtat

SEQ ID NO: 2319160 - DNA, 18 bp, Homo sapiens
taacacaggataaagtta

SEQ ID NO: 2319161 - DNA, 21 bp, Homo sapiens
taacacatttttttgcatgca

SEQ ID NO: 2319162 - DNA, 22 bp, Homo sapiens
taacagaacagcttcaggttat

SEQ ID NO: 2319163 - DNA, 13 bp, Homo sapiens
taacagtaactgc

SEQ ID NO: 2319164 - DNA, 14 bp, Homo sapiens
taacagtaactgcc

SEQ ID NO: 2319165 - DNA, 17 bp, Homo sapiens
taacatctttattgaaa

SEQ ID NO: 2319166 - DNA, 21 bp, Homo sapiens
taacatctttattgaaattct

SEQ ID NO: 2319167 - DNA, 21 bp, Homo sapiens
taacattaatgcctgcttttt

SEQ ID NO: 2319168 - DNA, 12 bp, Homo sapiens
taacattacctt

SEQ ID NO: 2319169 - DNA, 13 bp, Homo sapiens
taacattacctta

SEQ ID NO: 2319170 - DNA, 12 bp, Homo sapiens
taacattttaca

SEQ ID NO: 2319171 - DNA, 16 bp, Homo sapiens
taacattttacagtaa

SEQ ID NO: 2319172 - DNA, 21 bp, Homo sapiens
taaccagcattccctacagcc

SEQ ID NO: 2319173 - DNA, 19 bp, Homo sapiens
taacccttcatcttcctgt

SEQ ID NO: 2319174 - DNA, 21 bp, Homo sapiens
taacccttcatcttcctgtgt

SEQ ID NO: 2319175 - DNA, 21 bp, Homo sapiens
taaccctttgtgtgctctcca

SEQ ID NO: 2319176 - DNA, 22 bp, Homo sapiens
taacctaatcaccatgtaagca

SEQ ID NO: 2319177 - DNA, 21 bp, Homo sapiens
taacctaattaatatattaaa

SEQ ID NO: 2319178 - DNA, 13 bp, Homo sapiens
taaccttgtataa

SEQ ID NO: 2319179 - DNA, 14 bp, Homo sapiens
taacggtgctaaaa

SEQ ID NO: 2319180 - DNA, 18 bp, Homo sapiens
taacgtttttcctttaaa

SEQ ID NO: 2319181 - DNA, 18 bp, Homo sapiens
taactataagatacaata

SEQ ID NO: 2319182 - DNA, 20 bp, Homo sapiens
taactataagatacaataaa

SEQ ID NO: 2319183 - DNA, 23 bp, Homo sapiens
taactataagatacaataaaaca

SEQ ID NO: 2319184 - DNA, 16 bp, Homo sapiens
taactataaggtgcct

SEQ ID NO: 2319185 - DNA, 23 bp, Homo sapiens
ctcaggacagcatcccttcccac

SEQ ID NO: 2319186 - DNA, 20 bp, Homo sapiens
ctcaggaggcgcccttggct

SEQ ID NO: 2319187 - DNA, 14 bp, Homo sapiens
ctcaggcagcacca

SEQ ID NO: 2319188 - DNA, 17 bp, Homo sapiens
ctcagggagcctcccca

SEQ ID NO: 2319189 - DNA, 15 bp, Homo sapiens
ctcagggctcccagg

SEQ ID NO: 2319190 - DNA, 13 bp, Homo sapiens
ctcagggctgtcc

SEQ ID NO: 2319191 - DNA, 16 bp, Homo sapiens
ctcaggtagtactggg

SEQ ID NO: 2319192 - DNA, 14 bp, Homo sapiens
ctcaggtgctgtcc

SEQ ID NO: 2319193 - DNA, 16 bp, Homo sapiens
ctcagtaaagcacttg

SEQ ID NO: 2319194 - DNA, 12 bp, Homo sapiens
ctcagtagaaaa

SEQ ID NO: 2319195 - DNA, 20 bp, Homo sapiens
ctcagtatgtgggggcttca

SEQ ID NO: 2319196 - DNA, 22 bp, Homo sapiens
ctcagtatgtgggggcttcatc

SEQ ID NO: 2319197 - DNA, 23 bp, Homo sapiens
ctcagtccactgttgagccccag

SEQ ID NO: 2319198 - DNA, 13 bp, Homo sapiens
ctcagtgagcctc

SEQ ID NO: 2319199 - DNA, 23 bp, Homo sapiens
ctcagtgagcctcctgtgcctgg

SEQ ID NO: 2319200 - DNA, 19 bp, Homo sapiens
ctcagtgttggtatatttt

SEQ ID NO: 2319201 - DNA, 24 bp, Homo sapiens
ctcagttccttcatttccaccagg

SEQ ID NO: 2319202 - DNA, 13 bp, Homo sapiens
ctcagttttcata

SEQ ID NO: 2319203 - DNA, 14 bp, Homo sapiens
ctcatactcctggg

SEQ ID NO: 2319204 - DNA, 16 bp, Homo sapiens
ctcatactcctgggct

SEQ ID NO: 2319205 - DNA, 18 bp, Homo sapiens
ctcatagcaaccagagga

SEQ ID NO: 2319206 - DNA, 14 bp, Homo sapiens
ctcatcaactgaat

SEQ ID NO: 2319207 - DNA, 20 bp, Homo sapiens
ctcatccacataccctgacc

SEQ ID NO: 2319208 - DNA, 14 bp, Homo sapiens
ctcatctatctcaa

SEQ ID NO: 2319209 - DNA, 17 bp, Homo sapiens
ctcatgaagcaggaggc

SEQ ID NO: 2319210 - DNA, 14 bp, Homo sapiens
ctcatgactttata

SEQ ID NO: 2319211 - DNA, 16 bp, Homo sapiens
ctcatgagaagccaag

SEQ ID NO: 2319212 - DNA, 17 bp, Homo sapiens
ctcatgaggaggggccc

SEQ ID NO: 2319213 - DNA, 19 bp, Homo sapiens
ctcatgaggggagaggaga

SEQ ID NO: 2319214 - DNA, 20 bp, Homo sapiens
ctcatgcaaatcaattactg

SEQ ID NO: 2319215 - DNA, 19 bp, Homo sapiens
ctcatgcccaccccctgcc

SEQ ID NO: 2319216 - DNA, 21 bp, Homo sapiens
ctcatgcccaccccctgccct

SEQ ID NO: 2319217 - DNA, 22 bp, Homo sapiens
ctcatgcccaccccctgccctg

SEQ ID NO: 2319218 - DNA, 23 bp, Homo sapiens
ctcatgcccaccccctgccctgc

SEQ ID NO: 2319219 - DNA, 15 bp, Homo sapiens
ctcatgcccagctct

SEQ ID NO: 2319220 - DNA, 23 bp, Homo sapiens
ctcatgcccagctctctgacgct

SEQ ID NO: 2319221 - DNA, 21 bp, Homo sapiens
ctcatgggaagtcctggcaca

SEQ ID NO: 2319222 - DNA, 23 bp, Homo sapiens
ctcatgggtcctagcccttccct

SEQ ID NO: 2319223 - DNA, 21 bp, Homo sapiens
ctcattacagttctttcctct

SEQ ID NO: 2319224 - DNA, 18 bp, Homo sapiens
ctcattcccatgtggaac

SEQ ID NO: 2319225 - DNA, 22 bp, Homo sapiens
ctcattgacttttataaagcat

SEQ ID NO: 2319226 - DNA, 22 bp, Homo sapiens
ctccaaaatgttggtcatttta

SEQ ID NO: 2319227 - DNA, 17 bp, Homo sapiens
ctccaaccactgtgcca

SEQ ID NO: 2319228 - DNA, 16 bp, Homo sapiens
ctccaagcacagagcc

SEQ ID NO: 2319229 - DNA, 15 bp, Homo sapiens
ctccaagcatttcat

SEQ ID NO: 2319230 - DNA, 20 bp, Homo sapiens
ctccaaggaggggctgtaaa

SEQ ID NO: 2319231 - DNA, 18 bp, Homo sapiens
ctccaaggtgatgttgta

SEQ ID NO: 2319232 - DNA, 16 bp, Homo sapiens
ctccacagcgagggca

SEQ ID NO: 2319233 - DNA, 20 bp, Homo sapiens
ctccacagcgagggcagctg

SEQ ID NO: 2319234 - DNA, 21 bp, Homo sapiens
ctccacagtgttgtgcccctt

SEQ ID NO: 2319235 - DNA, 13 bp, Homo sapiens
ctccacatctgcc

SEQ ID NO: 2319236 - DNA, 17 bp, Homo sapiens
ctccacatctgccttaa

SEQ ID NO: 2319237 - DNA, 16 bp, Homo sapiens
ctccacccactgtccg

SEQ ID NO: 2319238 - DNA, 20 bp, Homo sapiens
ctcctgtccctgtagctcag

SEQ ID NO: 2319239 - DNA, 22 bp, Homo sapiens
ctcctgtccctgtagctcagtc

SEQ ID NO: 2319240 - DNA, 14 bp, Homo sapiens
ctcctgtgcctggc

SEQ ID NO: 2319241 - DNA, 19 bp, Homo sapiens
ctcctgtgcctggccccag

SEQ ID NO: 2319242 - DNA, 14 bp, Homo sapiens
ctccttcctggcct

SEQ ID NO: 2319243 - DNA, 18 bp, Homo sapiens
ctccttctcctagctctg

SEQ ID NO: 2319244 - DNA, 18 bp, Homo sapiens
ctccttctgagctcctgt

SEQ ID NO: 2319245 - DNA, 23 bp, Homo sapiens
ctccttctgagctcctgtcccct

SEQ ID NO: 2319246 - DNA, 15 bp, Homo sapiens
ctccttgcttcctga

SEQ ID NO: 2319247 - DNA, 19 bp, Homo sapiens
ctccttggtgcctggcctg

SEQ ID NO: 2319248 - DNA, 22 bp, Homo sapiens
ctccttggtgcctggcctggca

SEQ ID NO: 2319249 - DNA, 20 bp, Homo sapiens
ctcctttcccttattgcctc

SEQ ID NO: 2319250 - DNA, 21 bp, Homo sapiens
ctcctttcccttattgcctcc

SEQ ID NO: 2319251 - DNA, 20 bp, Homo sapiens
ctcctttgtgtgtattcaga

SEQ ID NO: 2319252 - DNA, 13 bp, Homo sapiens
ctccttttcccaa

SEQ ID NO: 2319253 - DNA, 13 bp, Homo sapiens
ctcgcactgccca

SEQ ID NO: 2319254 - DNA, 18 bp, Homo sapiens
ctcgcagcctctcagtgc

SEQ ID NO: 2319255 - DNA, 22 bp, Homo sapiens
ctcgctcaccgctggcccttag

SEQ ID NO: 2319256 - DNA, 13 bp, Homo sapiens
ctcgctgccatca

SEQ ID NO: 2319257 - DNA, 22 bp, Homo sapiens
ctcgctgccatcaccgctgggt

SEQ ID NO: 2319258 - DNA, 17 bp, Homo sapiens
ctcggagaagagcgcag

SEQ ID NO: 2319259 - DNA, 17 bp, Homo sapiens
ctcggccttcacaatct

SEQ ID NO: 2319260 - DNA, 21 bp, Homo sapiens
ctcggggtaaaaagtggctgc

SEQ ID NO: 2319261 - DNA, 20 bp, Homo sapiens
ctcggtgaccactcttcttt

SEQ ID NO: 2319262 - DNA, 13 bp, Homo sapiens
ctcgtcccatcca

SEQ ID NO: 2319263 - DNA, 17 bp, Homo sapiens
ctcgtgcatccctgaga

SEQ ID NO: 2319264 - DNA, 16 bp, Homo sapiens
ctcgtggtagaagcca

SEQ ID NO: 2319265 - DNA, 22 bp, Homo sapiens
ctctaaaaggtaatgtgtggat

SEQ ID NO: 2319266 - DNA, 14 bp, Homo sapiens
ctctaaagagcatc

SEQ ID NO: 2319267 - DNA, 12 bp, Homo sapiens
ctctaatattgg

SEQ ID NO: 2319268 - DNA, 20 bp, Homo sapiens
ctctaccagataactgagga

SEQ ID NO: 2319269 - DNA, 19 bp, Homo sapiens
ctctaccctgtctgtccct

SEQ ID NO: 2319270 - DNA, 16 bp, Homo sapiens
ctctaccttcctgtcc

SEQ ID NO: 2319271 - DNA, 15 bp, Homo sapiens
ctctagtgacttcct

SEQ ID NO: 2319272 - DNA, 19 bp, Homo sapiens
ctctagtgacttcctggtg

SEQ ID NO: 2319273 - DNA, 13 bp, Homo sapiens
ctctattttaatt

SEQ ID NO: 2319274 - DNA, 21 bp, Homo sapiens
ctctcaagctagtgtttctag

SEQ ID NO: 2319275 - DNA, 19 bp, Homo sapiens
ctctcagatttccacagag

SEQ ID NO: 2319276 - DNA, 14 bp, Homo sapiens
ctctcagctggcag

SEQ ID NO: 2319277 - DNA, 13 bp, Homo sapiens
ctctccaaccact

SEQ ID NO: 2319278 - DNA, 22 bp, Homo sapiens
ctctccacacagtgctcaaggc

SEQ ID NO: 2319279 - DNA, 21 bp, Homo sapiens
ctctccacagtgttgtgcccc

SEQ ID NO: 2319280 - DNA, 22 bp, Homo sapiens
ctctccacagtgttgtgcccct

SEQ ID NO: 2319281 - DNA, 23 bp, Homo sapiens
ctctccacagtgttgtgcccctt

SEQ ID NO: 2319282 - DNA, 13 bp, Homo sapiens
ctctccactccat

SEQ ID NO: 2319283 - DNA, 15 bp, Homo sapiens
ctctccactgctgga

SEQ ID NO: 2319284 - DNA, 22 bp, Homo sapiens
ctctccactgctggacatgaga

SEQ ID NO: 2319285 - DNA, 13 bp, Homo sapiens
ctctccactgtgc

SEQ ID NO: 2319286 - DNA, 19 bp, Homo sapiens
ctctccactgtgctttcag

SEQ ID NO: 2319287 - DNA, 21 bp, Homo sapiens
ctctccattctgctccttccc

SEQ ID NO: 2319288 - DNA, 13 bp, Homo sapiens
ctctcccaccctc

SEQ ID NO: 2319289 - DNA, 16 bp, Homo sapiens
ctctcccaccctcttc

SEQ ID NO: 2319290 - DNA, 17 bp, Homo sapiens
ctctcccaccctcttcc

SEQ ID NO: 2319291 - DNA, 19 bp, Homo sapiens
ctctcccaccctcttccta

SEQ ID NO: 2319292 - DNA, 23 bp, Homo sapiens
ctctcccagtgaactcctgccag

SEQ ID NO: 2319293 - DNA, 18 bp, Homo sapiens
ctctccccctcctccagg

SEQ ID NO: 2319294 - DNA, 19 bp, Homo sapiens
ctctcccttgggctctgat

SEQ ID NO: 2319295 - DNA, 21 bp, Homo sapiens
ctctccggggccatttgcaat

SEQ ID NO: 2319296 - DNA, 18 bp, Homo sapiens
ctctcctactcggctctg

SEQ ID NO: 2319297 - DNA, 16 bp, Homo sapiens
ctctcctctcccccag

SEQ ID NO: 2319298 - DNA, 21 bp, Homo sapiens
ctctcctggcctatccgctgc

SEQ ID NO: 2319299 - DNA, 17 bp, Homo sapiens
ctctcctggctcggggt

SEQ ID NO: 2319300 - DNA, 15 bp, Homo sapiens
ctctcgcacacctct

SEQ ID NO: 2319301 - DNA, 15 bp, Homo sapiens
ctctctagaatgagc

SEQ ID NO: 2319302 - DNA, 13 bp, Homo sapiens
ctctctagcacaa

SEQ ID NO: 2319303 - DNA, 21 bp, Homo sapiens
ctctctcaggccaccacagag

SEQ ID NO: 2319304 - DNA, 21 bp, Homo sapiens
ctctctgacgcttgtgacagt

SEQ ID NO: 2319305 - DNA, 12 bp, Homo sapiens
cggactctgccc

SEQ ID NO: 2319306 - DNA, 15 bp, Homo sapiens
cggaggccgaggcca

SEQ ID NO: 2319307 - DNA, 11 bp, Homo sapiens
cggaggggagt

SEQ ID NO: 2319308 - DNA, 22 bp, Homo sapiens
cggaggttgcagtgagctgaga

SEQ ID NO: 2319309 - DNA, 14 bp, Homo sapiens
cggagtgcggacca

SEQ ID NO: 2319310 - DNA, 15 bp, Homo sapiens
cggatagttgctatt

SEQ ID NO: 2319311 - DNA, 20 bp, Homo sapiens
cggatagttgctatttttgt

SEQ ID NO: 2319312 - DNA, 18 bp, Homo sapiens
cggatggaccaacctgct

SEQ ID NO: 2319313 - DNA, 20 bp, Homo sapiens
cggatggaccaacctgctct

SEQ ID NO: 2319314 - DNA, 22 bp, Homo sapiens
cggatggaccaacctgctctgt

SEQ ID NO: 2319315 - DNA, 16 bp, Homo sapiens
cggatggatggaaggt

SEQ ID NO: 2319316 - DNA, 13 bp, Homo sapiens
cggcaaaaggaaa

SEQ ID NO: 2319317 - DNA, 16 bp, Homo sapiens
cggcaaacctttcccc

SEQ ID NO: 2319318 - DNA, 23 bp, Homo sapiens
cggcacgccaacagcccccccct

SEQ ID NO: 2319319 - DNA, 14 bp, Homo sapiens
cggcaggctcactg

SEQ ID NO: 2319320 - DNA, 17 bp, Homo sapiens
cggcaggctcactgcca

SEQ ID NO: 2319321 - DNA, 20 bp, Homo sapiens
cggcaggctcactgccaggc

SEQ ID NO: 2319322 - DNA, 22 bp, Homo sapiens
cggcaggctcactgccaggcca

SEQ ID NO: 2319323 - DNA, 20 bp, Homo sapiens
cggccgcccctcctcgtgaa

SEQ ID NO: 2319324 - DNA, 20 bp, Homo sapiens
cggcctccttctgagctcct

SEQ ID NO: 2319325 - DNA, 21 bp, Homo sapiens
cggcctccttctgagctcctg

SEQ ID NO: 2319326 - DNA, 22 bp, Homo sapiens
cggcctccttctgagctcctgt

SEQ ID NO: 2319327 - DNA, 12 bp, Homo sapiens
cggctcctcaga

SEQ ID NO: 2319328 - DNA, 13 bp, Homo sapiens
cggctcctcagag

SEQ ID NO: 2319329 - DNA, 16 bp, Homo sapiens
cgggaacatgccccct

SEQ ID NO: 2319330 - DNA, 15 bp, Homo sapiens
cgggatattatagaa

SEQ ID NO: 2319331 - DNA, 17 bp, Homo sapiens
cgggccagggctgcccc

SEQ ID NO: 2319332 - DNA, 18 bp, Homo sapiens
cgggccagggctgcccct

SEQ ID NO: 2319333 - DNA, 15 bp, Homo sapiens
cgggccctgggttcc

SEQ ID NO: 2319334 - DNA, 14 bp, Homo sapiens
cgggcctcagtgcc

SEQ ID NO: 2319335 - DNA, 15 bp, Homo sapiens
cgggctgagggcctg

SEQ ID NO: 2319336 - DNA, 12 bp, Homo sapiens
cggggaccctgt

SEQ ID NO: 2319337 - DNA, 16 bp, Homo sapiens
cggggccccactggct

SEQ ID NO: 2319338 - DNA, 15 bp, Homo sapiens
cggggtaaaaagtgg

SEQ ID NO: 2319339 - DNA, 22 bp, Homo sapiens
cggggtgagtccattctcccag

SEQ ID NO: 2319340 - DNA, 14 bp, Homo sapiens
cggggtggccacag

SEQ ID NO: 2319341 - DNA, 22 bp, Homo sapiens
cgggtcatattcataccttctg

SEQ ID NO: 2319342 - DNA, 15 bp, Homo sapiens
cgggtgtgggaaagc

SEQ ID NO: 2319343 - DNA, 15 bp, Homo sapiens
cggtaagtgttctca

SEQ ID NO: 2319344 - DNA, 15 bp, Homo sapiens
cggtccagctggcct

SEQ ID NO: 2319345 - DNA, 18 bp, Homo sapiens
cggtcctttaggcagcct

SEQ ID NO: 2319346 - DNA, 21 bp, Homo sapiens
cggtcctttaggcagcctgcc

SEQ ID NO: 2319347 - DNA, 19 bp, Homo sapiens
cggtgctaaaaatgaaaat

SEQ ID NO: 2319348 - DNA, 16 bp, Homo sapiens
cggtgctgtgagggag

SEQ ID NO: 2319349 - DNA, 18 bp, Homo sapiens
cggtggataactagccag

SEQ ID NO: 2319350 - DNA, 15 bp, Homo sapiens
cggtggcgggcacct

SEQ ID NO: 2319351 - DNA, 14 bp, Homo sapiens
cggtggctgggcag

SEQ ID NO: 2319352 - DNA, 19 bp, Homo sapiens
cggtgtttggcaatgctaa

SEQ ID NO: 2319353 - DNA, 13 bp, Homo sapiens
cgtaagcagtata

SEQ ID NO: 2319354 - DNA, 15 bp, Homo sapiens
cgtaaggatgtgtga

SEQ ID NO: 2319355 - DNA, 20 bp, Homo sapiens
cgtatatacttaagaataca

SEQ ID NO: 2319356 - DNA, 19 bp, Homo sapiens
cgtcaccatccaccttccc

SEQ ID NO: 2319357 - DNA, 16 bp, Homo sapiens
cgtcaccccagccctc

SEQ ID NO: 2319358 - DNA, 18 bp, Homo sapiens
cgtcactttttggccatg

SEQ ID NO: 2319359 - DNA, 14 bp, Homo sapiens
cgtcaggccctgac

SEQ ID NO: 2319360 - DNA, 11 bp, Homo sapiens
cgtccctggcg

SEQ ID NO: 2319361 - DNA, 17 bp, Homo sapiens
cgtcctcctcacctcat

SEQ ID NO: 2319362 - DNA, 21 bp, Homo sapiens
cgtcctcctcacctcatgccc

SEQ ID NO: 2319363 - DNA, 16 bp, Homo sapiens
cgtctccagtcatctg

SEQ ID NO: 2319364 - DNA, 20 bp, Homo sapiens
cgtctcttttaccctggccc

SEQ ID NO: 2319365 - DNA, 16 bp, Homo sapiens
cgtcttggtgtaattt

SEQ ID NO: 2319366 - DNA, 14 bp, Homo sapiens
cgtgaaccagaggg

SEQ ID NO: 2319367 - DNA, 17 bp, Homo sapiens
cgtgatgtggaggaaga

SEQ ID NO: 2319368 - DNA, 18 bp, Homo sapiens
cgtgatgtggaggaagag

SEQ ID NO: 2319369 - DNA, 22 bp, Homo sapiens
cgtgatgtggaggaagagccac

SEQ ID NO: 2319370 - DNA, 21 bp, Homo sapiens
cgtgcatcccccctgctcagc

SEQ ID NO: 2319371 - DNA, 14 bp, Homo sapiens
cgtgcctggccaga

SEQ ID NO: 2319372 - DNA, 14 bp, Homo sapiens
cgtgctcaggtcat

SEQ ID NO: 2319373 - DNA, 15 bp, Homo sapiens
cgtggcactagaatg

SEQ ID NO: 2319374 - DNA, 19 bp, Homo sapiens
cgtggcccaaggctggcag

SEQ ID NO: 2319375 - DNA, 14 bp, Homo sapiens
cgtgggagccagcc

SEQ ID NO: 2319376 - DNA, 15 bp, Homo sapiens
cgtggtagaagccag

SEQ ID NO: 2319377 - DNA, 10 bp, Homo sapiens
cgtggtttgc

SEQ ID NO: 2319378 - DNA, 23 bp, Homo sapiens
cgtgtgaagatgaaggggctctt

SEQ ID NO: 2319379 - DNA, 15 bp, Homo sapiens
cgtgtgtagagttaa

SEQ ID NO: 2319380 - DNA, 19 bp, Homo sapiens
cgtgtgtcccagatgctgt

SEQ ID NO: 2319381 - DNA, 14 bp, Homo sapiens
cgttgtgagctgga

SEQ ID NO: 2319382 - DNA, 18 bp, Homo sapiens
cgttgtgttttttaagat

SEQ ID NO: 2319383 - DNA, 19 bp, Homo sapiens
cgttgttttgtggataaga

SEQ ID NO: 2319384 - DNA, 14 bp, Homo sapiens
cgtttattttcaag

SEQ ID NO: 2319385 - DNA, 13 bp, Homo sapiens
cgtttttccttta

SEQ ID NO: 2319386 - DNA, 13 bp, Homo sapiens
ctaaaaaaatgtt

SEQ ID NO: 2319387 - DNA, 19 bp, Homo sapiens
ctaaaaaaccaacaatgtg

SEQ ID NO: 2319388 - DNA, 17 bp, Homo sapiens
ctaaaaagtataaaata

SEQ ID NO: 2319389 - DNA, 14 bp, Homo sapiens
ctaaaaatattgtt

SEQ ID NO: 2319390 - DNA, 13 bp, Homo sapiens
ctaaaatgtgtgc

SEQ ID NO: 2319391 - DNA, 15 bp, Homo sapiens
ctaaaatttacacat

SEQ ID NO: 2319392 - DNA, 20 bp, Homo sapiens
ctaaaccaaggactgagcac

SEQ ID NO: 2319393 - DNA, 23 bp, Homo sapiens
ctaaaccaaggactgagcaccct

SEQ ID NO: 2319394 - DNA, 22 bp, Homo sapiens
ctaaactccttcctggcctgag

SEQ ID NO: 2319395 - DNA, 16 bp, Homo sapiens
ctaaagagagaatgta

SEQ ID NO: 2319396 - DNA, 15 bp, Homo sapiens
ctaaagagcccttgc

SEQ ID NO: 2319397 - DNA, 17 bp, Homo sapiens
ctaaagagcccttgcct

SEQ ID NO: 2319398 - DNA, 18 bp, Homo sapiens
ctaaagagcccttgcctc

SEQ ID NO: 2319399 - DNA, 20 bp, Homo sapiens
ctaaagagcccttgcctccc

SEQ ID NO: 2319400 - DNA, 22 bp, Homo sapiens
ctaaagagcccttgcctcccca

SEQ ID NO: 2319401 - DNA, 23 bp, Homo sapiens
ctaaagagcccttgcctccccat

SEQ ID NO: 2319402 - DNA, 18 bp, Homo sapiens
ctaaagaggctgaaagag

SEQ ID NO: 2319403 - DNA, 18 bp, Homo sapiens
ctaaagatctttttttaa

SEQ ID NO: 2319404 - DNA, 21 bp, Homo sapiens
ctaaagatctttttttaagtg

SEQ ID NO: 2319405 - DNA, 16 bp, Homo sapiens
ctaaaggaaaaaactt

SEQ ID NO: 2319406 - DNA, 16 bp, Homo sapiens
ctaaaggatccagaga

SEQ ID NO: 2319407 - DNA, 18 bp, Homo sapiens
ctaaaggatccagagagc

SEQ ID NO: 2319408 - DNA, 20 bp, Homo sapiens
ctaaaggatccagagagcag

SEQ ID NO: 2319409 - DNA, 21 bp, Homo sapiens
ctaaagtatacaactgcctgg

SEQ ID NO: 2319410 - DNA, 11 bp, Homo sapiens
ctaaagttttg

SEQ ID NO: 2319411 - DNA, 14 bp, Homo sapiens
ctaaataaaaatat

SEQ ID NO: 2319412 - DNA, 18 bp, Homo sapiens
ctaaataaaaatatgtaa

SEQ ID NO: 2319413 - DNA, 12 bp, Homo sapiens
ctaaataaatgg

SEQ ID NO: 2319414 - DNA, 15 bp, Homo sapiens
ctaaattagataaat

SEQ ID NO: 2319415 - DNA, 13 bp, Homo sapiens
ctaaatttcacta

SEQ ID NO: 2319416 - DNA, 14 bp, Homo sapiens
ctaacacagcatgt

SEQ ID NO: 2319417 - DNA, 17 bp, Homo sapiens
ctaacagctacaaactt

SEQ ID NO: 2319418 - DNA, 17 bp, Homo sapiens
ctaacagtaactgccat

SEQ ID NO: 2319419 - DNA, 15 bp, Homo sapiens
ctaacagtccttgct

SEQ ID NO: 2319420 - DNA, 19 bp, Homo sapiens
ctaacccaggtatccaaaa

SEQ ID NO: 2319421 - DNA, 13 bp, Homo sapiens
ctaaccccttcca

SEQ ID NO: 2319422 - DNA, 19 bp, Homo sapiens
ctaaccccttccagatcac

SEQ ID NO: 2319423 - DNA, 17 bp, Homo sapiens
ctactggggaaactggc

SEQ ID NO: 2319424 - DNA, 22 bp, Homo sapiens
ctactggggaaactggccatgg

SEQ ID NO: 2319425 - DNA, 15 bp, Homo sapiens
ctactgtgtgccagg

SEQ ID NO: 2319426 - DNA, 14 bp, Homo sapiens
ctacttagggaaga

SEQ ID NO: 2319427 - DNA, 16 bp, Homo sapiens
ctacttagggaagaaa

SEQ ID NO: 2319428 - DNA, 21 bp, Homo sapiens
ctacttagggaagaaaaagca

SEQ ID NO: 2319429 - DNA, 14 bp, Homo sapiens
ctactttaaattgt

SEQ ID NO: 2319430 - DNA, 18 bp, Homo sapiens
ctactttaaattgtggat

SEQ ID NO: 2319431 - DNA, 21 bp, Homo sapiens
ctactttgactttttgcattt

SEQ ID NO: 2319432 - DNA, 14 bp, Homo sapiens
ctagaaaaataaaa

SEQ ID NO: 2319433 - DNA, 19 bp, Homo sapiens
ctagaacactaactcacca

SEQ ID NO: 2319434 - DNA, 21 bp, Homo sapiens
ctagaagccaagggaaagggg

SEQ ID NO: 2319435 - DNA, 21 bp, Homo sapiens
ctagacaacctttctgtagcc

SEQ ID NO: 2319436 - DNA, 14 bp, Homo sapiens
ctagagataaaaca

SEQ ID NO: 2319437 - DNA, 23 bp, Homo sapiens
ctagagcagttggccaagcagaa

SEQ ID NO: 2319438 - DNA, 20 bp, Homo sapiens
ctagatttagcacagtattt

SEQ ID NO: 2319439 - DNA, 21 bp, Homo sapiens
ctagatttattagtcctaatt

SEQ ID NO: 2319440 - DNA, 18 bp, Homo sapiens
ctagcattttcttgaacc

SEQ ID NO: 2319441 - DNA, 16 bp, Homo sapiens
ctagccaaaccaggac

SEQ ID NO: 2319442 - DNA, 18 bp, Homo sapiens
ctagccagcccctcttcc

SEQ ID NO: 2319443 - DNA, 12 bp, Homo sapiens
ctagcccttccc

SEQ ID NO: 2319444 - DNA, 13 bp, Homo sapiens
ctagcccttccct

SEQ ID NO: 2319445 - DNA, 19 bp, Homo sapiens
ctagcctgcattgagcttg

SEQ ID NO: 2319446 - DNA, 16 bp, Homo sapiens
ctagcgatctctcctg

SEQ ID NO: 2319447 - DNA, 20 bp, Homo sapiens
ctagcgatctctcctggcct

SEQ ID NO: 2319448 - DNA, 15 bp, Homo sapiens
ctagctaaataaatg

SEQ ID NO: 2319449 - DNA, 15 bp, Homo sapiens
ctagctaattattta

SEQ ID NO: 2319450 - DNA, 23 bp, Homo sapiens
ctagctgtcctttttcctctcca

SEQ ID NO: 2319451 - DNA, 13 bp, Homo sapiens
ctagcttctgctt

SEQ ID NO: 2319452 - DNA, 16 bp, Homo sapiens
ctagcttctgcttttc

SEQ ID NO: 2319453 - DNA, 18 bp, Homo sapiens
ctagcttctgcttttctg

SEQ ID NO: 2319454 - DNA, 21 bp, Homo sapiens
ctagcttctgcttttctgccc

SEQ ID NO: 2319455 - DNA, 22 bp, Homo sapiens
ctagcttctgcttttctgccct

SEQ ID NO: 2319456 - DNA, 14 bp, Homo sapiens
ctaggaaactcaca

SEQ ID NO: 2319457 - DNA, 20 bp, Homo sapiens
ctaggacacagttcctggga

SEQ ID NO: 2319458 - DNA, 15 bp, Homo sapiens
ctaggactgcagtgt

SEQ ID NO: 2319459 - DNA, 17 bp, Homo sapiens
ctaggcattctggacct

SEQ ID NO: 2319460 - DNA, 20 bp, Homo sapiens
ctaggcattctggacctctg

SEQ ID NO: 2319461 - DNA, 22 bp, Homo sapiens
ctaggcattctggacctctggg

SEQ ID NO: 2319462 - DNA, 18 bp, Homo sapiens
ctaggcccattgtcctcc

SEQ ID NO: 2319463 - DNA, 21 bp, Homo sapiens
ctaggcccattgtcctccttt

SEQ ID NO: 2319464 - DNA, 19 bp, Homo sapiens
ctagggactgccaggctgt

SEQ ID NO: 2319465 - DNA, 13 bp, Homo sapiens
ctagggcagacaa

SEQ ID NO: 2319466 - DNA, 16 bp, Homo sapiens
ctaggtaggaagagcc

SEQ ID NO: 2319467 - DNA, 18 bp, Homo sapiens
ctagtagtatatttaatt

SEQ ID NO: 2319468 - DNA, 13 bp, Homo sapiens
cctgaagagcatt

SEQ ID NO: 2319469 - DNA, 14 bp, Homo sapiens
cctgaagccagctg

SEQ ID NO: 2319470 - DNA, 14 bp, Homo sapiens
cctgaatcatgagc

SEQ ID NO: 2319471 - DNA, 21 bp, Homo sapiens
cctgaatcatgagcctgctgg

SEQ ID NO: 2319472 - DNA, 18 bp, Homo sapiens
cctgacacccttctccca

SEQ ID NO: 2319473 - DNA, 14 bp, Homo sapiens
cctgacactttaat

SEQ ID NO: 2319474 - DNA, 14 bp, Homo sapiens
cctgacagaaggtg

SEQ ID NO: 2319475 - DNA, 17 bp, Homo sapiens
cctgacagaaggtgcca

SEQ ID NO: 2319476 - DNA, 21 bp, Homo sapiens
cctgacattcacttccagaga

SEQ ID NO: 2319477 - DNA, 19 bp, Homo sapiens
cctgaccaagactgagcca

SEQ ID NO: 2319478 - DNA, 15 bp, Homo sapiens
cctgacccagggact

SEQ ID NO: 2319479 - DNA, 17 bp, Homo sapiens
cctgaccccattcctga

SEQ ID NO: 2319480 - DNA, 15 bp, Homo sapiens
cctgacccctgctca

SEQ ID NO: 2319481 - DNA, 23 bp, Homo sapiens
cctgacctaaattagataaattg

SEQ ID NO: 2319482 - DNA, 15 bp, Homo sapiens
cctgacctggccccc

SEQ ID NO: 2319483 - DNA, 14 bp, Homo sapiens
cctgactcctctgg

SEQ ID NO: 2319484 - DNA, 24 bp, Homo sapiens
cctgacttggctggggaggaccag

SEQ ID NO: 2319485 - DNA, 23 bp, Homo sapiens
cctgacttggggagatggagttc

SEQ ID NO: 2319486 - DNA, 19 bp, Homo sapiens
cctgagaagaagtggctgc

SEQ ID NO: 2319487 - DNA, 12 bp, Homo sapiens
cctgagaggcag

SEQ ID NO: 2319488 - DNA, 20 bp, Homo sapiens
cctgagagtcagctctctgc

SEQ ID NO: 2319489 - DNA, 22 bp, Homo sapiens
cctgagagtcagctctctgccc

SEQ ID NO: 2319490 - DNA, 17 bp, Homo sapiens
cctgagctattttcctc

SEQ ID NO: 2319491 - DNA, 23 bp, Homo sapiens
cctgaggccctgggctgggtgct

SEQ ID NO: 2319492 - DNA, 13 bp, Homo sapiens
cctgaggcctaga

SEQ ID NO: 2319493 - DNA, 19 bp, Homo sapiens
cctgaggcctagactctgt

SEQ ID NO: 2319494 - DNA, 15 bp, Homo sapiens
cctgaggcggaggct

SEQ ID NO: 2319495 - DNA, 22 bp, Homo sapiens
cctgaggcggaggctgtgctcc

SEQ ID NO: 2319496 - DNA, 21 bp, Homo sapiens
cctgagggcagtaccctccat

SEQ ID NO: 2319497 - DNA, 15 bp, Homo sapiens
cctgaggtcccctcg

SEQ ID NO: 2319498 - DNA, 21 bp, Homo sapiens
cctgaggttaaacggtgccca

SEQ ID NO: 2319499 - DNA, 22 bp, Homo sapiens
cctgaggttaaacggtgcccat

SEQ ID NO: 2319500 - DNA, 13 bp, Homo sapiens
cctgagtcagtgc

SEQ ID NO: 2319501 - DNA, 15 bp, Homo sapiens
cctgagtcagtgctc

SEQ ID NO: 2319502 - DNA, 21 bp, Homo sapiens
cctgagtcgtacagaaagctg

SEQ ID NO: 2319503 - DNA, 22 bp, Homo sapiens
cctgatcattacatggctgtgg

SEQ ID NO: 2319504 - DNA, 13 bp, Homo sapiens
cctgattcttgat

SEQ ID NO: 2319505 - DNA, 15 bp, Homo sapiens
cctgattcttgattc

SEQ ID NO: 2319506 - DNA, 20 bp, Homo sapiens
cctgattcttgattcctggc

SEQ ID NO: 2319507 - DNA, 16 bp, Homo sapiens
cctgattttttttcct

SEQ ID NO: 2319508 - DNA, 22 bp, Homo sapiens
cctgattttttttccttttaat

SEQ ID NO: 2319509 - DNA, 13 bp, Homo sapiens
cctgcaaactggg

SEQ ID NO: 2319510 - DNA, 14 bp, Homo sapiens
cctgcacacagaat

SEQ ID NO: 2319511 - DNA, 20 bp, Homo sapiens
cctgcacacagaatgctcag

SEQ ID NO: 2319512 - DNA, 19 bp, Homo sapiens
cctgcacacaggacagcgg

SEQ ID NO: 2319513 - DNA, 19 bp, Homo sapiens
cctgcacgtcatgggaggg

SEQ ID NO: 2319514 - DNA, 23 bp, Homo sapiens
cctgcacgtcatgggagggggct

SEQ ID NO: 2319515 - DNA, 15 bp, Homo sapiens
cctgcagacctcaag

SEQ ID NO: 2319516 - DNA, 20 bp, Homo sapiens
cctgcagcccaccagacgtc

SEQ ID NO: 2319517 - DNA, 23 bp, Homo sapiens
cctgcaggagagagcagcactcc

SEQ ID NO: 2319518 - DNA, 12 bp, Homo sapiens
cctgcaggcaga

SEQ ID NO: 2319519 - DNA, 16 bp, Homo sapiens
cctgcaggcagagctg

SEQ ID NO: 2319520 - DNA, 20 bp, Homo sapiens
cctgcaggcagagctggagc

SEQ ID NO: 2319521 - DNA, 15 bp, Homo sapiens
cctgcagggcttctc

SEQ ID NO: 2319522 - DNA, 15 bp, Homo sapiens
cctgcatctggggcc

SEQ ID NO: 2319523 - DNA, 15 bp, Homo sapiens
cctgccacactgatg

SEQ ID NO: 2319524 - DNA, 20 bp, Homo sapiens
cctgccacactgatggctca

SEQ ID NO: 2319525 - DNA, 19 bp, Homo sapiens
cctgccaggcaggggtggg

SEQ ID NO: 2319526 - DNA, 22 bp, Homo sapiens
cctgccaggcaggggtgggggt

SEQ ID NO: 2319527 - DNA, 13 bp, Homo sapiens
cctgccatcctca

SEQ ID NO: 2319528 - DNA, 17 bp, Homo sapiens
cctgccccagcactcac

SEQ ID NO: 2319529 - DNA, 13 bp, Homo sapiens
cctgccccgcccc

SEQ ID NO: 2319530 - DNA, 14 bp, Homo sapiens
cctgccctgtccaa

SEQ ID NO: 2319531 - DNA, 12 bp, Homo sapiens
cctgcctcagcc

SEQ ID NO: 2319532 - DNA, 14 bp, Homo sapiens
cctgcctcagcctt

SEQ ID NO: 2319533 - DNA, 20 bp, Homo sapiens
cctgcctcccacttcactgc

SEQ ID NO: 2319534 - DNA, 20 bp, Homo sapiens
cctgcctcctggaggaccag

SEQ ID NO: 2319535 - DNA, 23 bp, Homo sapiens
cctgcctctcatcaactgaatga

SEQ ID NO: 2319536 - DNA, 15 bp, Homo sapiens
cctgcctgtctgccc

SEQ ID NO: 2319537 - DNA, 14 bp, Homo sapiens
cctgcctgtgcatg

SEQ ID NO: 2319538 - DNA, 15 bp, Homo sapiens
cctgccttggcctcc

SEQ ID NO: 2319539 - DNA, 16 bp, Homo sapiens
cctgcgcctgctgcct

SEQ ID NO: 2319540 - DNA, 16 bp, Homo sapiens
cctgcgggccagggtc

SEQ ID NO: 2319541 - DNA, 18 bp, Homo sapiens
cctgcgggccagggtcct

SEQ ID NO: 2319542 - DNA, 17 bp, Homo sapiens
cctgcgtcctcctcacc

SEQ ID NO: 2319543 - DNA, 16 bp, Homo sapiens
cctgctctcctcttct

SEQ ID NO: 2319544 - DNA, 20 bp, Homo sapiens
cctgctctgtgagccccaca

SEQ ID NO: 2319545 - DNA, 22 bp, Homo sapiens
cctgctgaacacagtgtctgtt

SEQ ID NO: 2319546 - DNA, 14 bp, Homo sapiens
cctgctgcctgctg

SEQ ID NO: 2319547 - DNA, 15 bp, Homo sapiens
cctgctgcctgctga

SEQ ID NO: 2319548 - DNA, 16 bp, Homo sapiens
cctgctgcctgctgag

SEQ ID NO: 2319549 - DNA, 17 bp, Homo sapiens
cctgctgctgtctgggt

SEQ ID NO: 2319550 - DNA, 19 bp, Homo sapiens
cctgctgctgtctgggtgc

SEQ ID NO: 2319551 - DNA, 22 bp, Homo sapiens
cctgctggaaaccacacttctt

SEQ ID NO: 2319552 - DNA, 12 bp, Homo sapiens
cctgctggaggc

SEQ ID NO: 2319553 - DNA, 9 bp, Homo sapiens
cctgctggc

SEQ ID NO: 2319554 - DNA, 15 bp, Homo sapiens
cctgctggcacccac

SEQ ID NO: 2319555 - DNA, 19 bp, Homo sapiens
cctgctggcacccaccgtg

SEQ ID NO: 2319556 - DNA, 18 bp, Homo sapiens
cctgctgtatgtgagctg

SEQ ID NO: 2319557 - DNA, 12 bp, Homo sapiens
cctgcttgataa

SEQ ID NO: 2319558 - DNA, 20 bp, Homo sapiens
cctggaaaaggagcttcagt

SEQ ID NO: 2319559 - DNA, 18 bp, Homo sapiens
cctggaatctacaagcca

SEQ ID NO: 2319560 - DNA, 20 bp, Homo sapiens
ctagtagttagaaattaaat

SEQ ID NO: 2319561 - DNA, 17 bp, Homo sapiens
ctagtgaggaagacaag

SEQ ID NO: 2319562 - DNA, 16 bp, Homo sapiens
ctagtggtctttgtaa

SEQ ID NO: 2319563 - DNA, 20 bp, Homo sapiens
ctagtgtccataaataaagt

SEQ ID NO: 2319564 - DNA, 13 bp, Homo sapiens
ctagtgtttctag

SEQ ID NO: 2319565 - DNA, 23 bp, Homo sapiens
ctagttctcaatcactgctcccc

SEQ ID NO: 2319566 - DNA, 21 bp, Homo sapiens
ctataaaagcccatgcttaaa

SEQ ID NO: 2319567 - DNA, 20 bp, Homo sapiens
ctataagatacaataaaaca

SEQ ID NO: 2319568 - DNA, 12 bp, Homo sapiens
ctataaggtgcc

SEQ ID NO: 2319569 - DNA, 14 bp, Homo sapiens
ctataaggtgcctc

SEQ ID NO: 2319570 - DNA, 15 bp, Homo sapiens
ctataaggtgcctca

SEQ ID NO: 2319571 - DNA, 13 bp, Homo sapiens
ctatacacacaca

SEQ ID NO: 2319572 - DNA, 17 bp, Homo sapiens
ctatactgcatactttt

SEQ ID NO: 2319573 - DNA, 21 bp, Homo sapiens
ctatactgcatactttttaaa

SEQ ID NO: 2319574 - DNA, 14 bp, Homo sapiens
ctatagcactgagc

SEQ ID NO: 2319575 - DNA, 21 bp, Homo sapiens
ctatagcttgcagaactgtag

SEQ ID NO: 2319576 - DNA, 14 bp, Homo sapiens
ctatataatttatt

SEQ ID NO: 2319577 - DNA, 16 bp, Homo sapiens
ctatataatttatttc

SEQ ID NO: 2319578 - DNA, 22 bp, Homo sapiens
ctatatataaaacggtgctgtg

SEQ ID NO: 2319579 - DNA, 23 bp, Homo sapiens
ctatattggtttatgtagtcagt

SEQ ID NO: 2319580 - DNA, 18 bp, Homo sapiens
ctatattttaacctgcat

SEQ ID NO: 2319581 - DNA, 19 bp, Homo sapiens
ctatcagagttgctgcaaa

SEQ ID NO: 2319582 - DNA, 15 bp, Homo sapiens
ctatccatctcctgg

SEQ ID NO: 2319583 - DNA, 22 bp, Homo sapiens
ctatccccatctccctgcctgg

SEQ ID NO: 2319584 - DNA, 15 bp, Homo sapiens
ctatccgctgccagc

SEQ ID NO: 2319585 - DNA, 17 bp, Homo sapiens
ctatccgctgccagcct

SEQ ID NO: 2319586 - DNA, 21 bp, Homo sapiens
ctatccttggagagcagctgg

SEQ ID NO: 2319587 - DNA, 15 bp, Homo sapiens
ctatcgccctccttt

SEQ ID NO: 2319588 - DNA, 18 bp, Homo sapiens
ctatctcaatcctaattt

SEQ ID NO: 2319589 - DNA, 14 bp, Homo sapiens
ctatgacaaattca

SEQ ID NO: 2319590 - DNA, 16 bp, Homo sapiens
ctatgagttgaaatgt

SEQ ID NO: 2319591 - DNA, 13 bp, Homo sapiens
ctatgcaaaaaat

SEQ ID NO: 2319592 - DNA, 13 bp, Homo sapiens
ctatgcacatatg

SEQ ID NO: 2319593 - DNA, 20 bp, Homo sapiens
ctatgcacatatggactctg

SEQ ID NO: 2319594 - DNA, 15 bp, Homo sapiens
ctatgcctctctaca

SEQ ID NO: 2319595 - DNA, 17 bp, Homo sapiens
ctatgcttaataaaaga

SEQ ID NO: 2319596 - DNA, 16 bp, Homo sapiens
ctatggcttatttcta

SEQ ID NO: 2319597 - DNA, 21 bp, Homo sapiens
ctatgggaaaaatctaaaatg

SEQ ID NO: 2319598 - DNA, 13 bp, Homo sapiens
ctatgggcctgcc

SEQ ID NO: 2319599 - DNA, 21 bp, Homo sapiens
ctatggtgctgccttgcttct

SEQ ID NO: 2319600 - DNA, 18 bp, Homo sapiens
ctatgtctcatgttttat

SEQ ID NO: 2319601 - DNA, 17 bp, Homo sapiens
ctattaagattggaaat

SEQ ID NO: 2319602 - DNA, 20 bp, Homo sapiens
ctattaatcaagagaaactt

SEQ ID NO: 2319603 - DNA, 22 bp, Homo sapiens
ctattcaagaggaaatgtcaca

SEQ ID NO: 2319604 - DNA, 20 bp, Homo sapiens
ctattcatggctacctcaga

SEQ ID NO: 2319605 - DNA, 20 bp, Homo sapiens
ctattgtgacagagccatgg

SEQ ID NO: 2319606 - DNA, 11 bp, Homo sapiens
ctatttaagtg

SEQ ID NO: 2319607 - DNA, 18 bp, Homo sapiens
ctattttcataatcagta

SEQ ID NO: 2319608 - DNA, 12 bp, Homo sapiens
ctattttcctct

SEQ ID NO: 2319609 - DNA, 22 bp, Homo sapiens
ctatttttgacatggaaatgaa

SEQ ID NO: 2319610 - DNA, 19 bp, Homo sapiens
ctatttttgtaaagtttcc

SEQ ID NO: 2319611 - DNA, 22 bp, Homo sapiens
ctatttttttagattgagaaat

SEQ ID NO: 2319612 - DNA, 18 bp, Homo sapiens
ctcaaaggagctttctca

SEQ ID NO: 2319613 - DNA, 23 bp, Homo sapiens
ctcaaagggcagttttgaggcat

SEQ ID NO: 2319614 - DNA, 12 bp, Homo sapiens
ctcaaagttttg

SEQ ID NO: 2319615 - DNA, 15 bp, Homo sapiens
ctcaaagttttgaaa

SEQ ID NO: 2319616 - DNA, 16 bp, Homo sapiens
ctcaaatacacatttg

SEQ ID NO: 2319617 - DNA, 20 bp, Homo sapiens
ctcaaataggctattaaaaa

SEQ ID NO: 2319618 - DNA, 22 bp, Homo sapiens
ctcaaccccaccatatgaattg

SEQ ID NO: 2319619 - DNA, 23 bp, Homo sapiens
ctcaactgcctactccaaaatgt

SEQ ID NO: 2319620 - DNA, 18 bp, Homo sapiens
ctcaagacaaggctggca

SEQ ID NO: 2319621 - DNA, 21 bp, Homo sapiens
ctcaagacccccatttgtccc

SEQ ID NO: 2319622 - DNA, 14 bp, Homo sapiens
ctcaagacctgagt

SEQ ID NO: 2319623 - DNA, 22 bp, Homo sapiens
ctcaagcaatccacctgccttg

SEQ ID NO: 2319624 - DNA, 20 bp, Homo sapiens
ctcaagctagtgtttctagc

SEQ ID NO: 2319625 - DNA, 20 bp, Homo sapiens
ctcaaggataccttcttatt

SEQ ID NO: 2319626 - DNA, 18 bp, Homo sapiens
ctgacatttcttctagtg

SEQ ID NO: 2319627 - DNA, 16 bp, Homo sapiens
ctgacccctgctcagt

SEQ ID NO: 2319628 - DNA, 19 bp, Homo sapiens
ctgacctgaccccattcct

SEQ ID NO: 2319629 - DNA, 20 bp, Homo sapiens
ctgacctgaccccattcctg

SEQ ID NO: 2319630 - DNA, 10 bp, Homo sapiens
ctgacctggc

SEQ ID NO: 2319631 - DNA, 13 bp, Homo sapiens
ctgacctggcccc

SEQ ID NO: 2319632 - DNA, 15 bp, Homo sapiens
ctgacgcttgtgaca

SEQ ID NO: 2319633 - DNA, 18 bp, Homo sapiens
ctgacgcttgtgacagtg

SEQ ID NO: 2319634 - DNA, 19 bp, Homo sapiens
ctgacgcttgtgacagtgc

SEQ ID NO: 2319635 - DNA, 23 bp, Homo sapiens
ctgacgcttgtgacagtgcctct

SEQ ID NO: 2319636 - DNA, 13 bp, Homo sapiens
ctgactcctctgg

SEQ ID NO: 2319637 - DNA, 22 bp, Homo sapiens
ctgactcctctggctttcccag

SEQ ID NO: 2319638 - DNA, 17 bp, Homo sapiens
ctgactgagcaggctgt

SEQ ID NO: 2319639 - DNA, 18 bp, Homo sapiens
ctgacttaactttaactt

SEQ ID NO: 2319640 - DNA, 22 bp, Homo sapiens
ctgacttaactttaacttttga

SEQ ID NO: 2319641 - DNA, 16 bp, Homo sapiens
ctgacttggctgggga

SEQ ID NO: 2319642 - DNA, 22 bp, Homo sapiens
ctgacttggggagatggagttc

SEQ ID NO: 2319643 - DNA, 22 bp, Homo sapiens
ctgagaaccgtagatgatttca

SEQ ID NO: 2319644 - DNA, 23 bp, Homo sapiens
ctgagaccctactgaagtggctg

SEQ ID NO: 2319645 - DNA, 19 bp, Homo sapiens
ctgagacctgggatttgag

SEQ ID NO: 2319646 - DNA, 21 bp, Homo sapiens
ctgagacctgggatttgagat

SEQ ID NO: 2319647 - DNA, 21 bp, Homo sapiens
ctgagaggacagagagaaata

SEQ ID NO: 2319648 - DNA, 15 bp, Homo sapiens
ctgagaggcaggcat

SEQ ID NO: 2319649 - DNA, 14 bp, Homo sapiens
ctgagagtcagctc

SEQ ID NO: 2319650 - DNA, 23 bp, Homo sapiens
ctgagatatgaacatattgttga

SEQ ID NO: 2319651 - DNA, 15 bp, Homo sapiens
ctgagatggaaaagt

SEQ ID NO: 2319652 - DNA, 17 bp, Homo sapiens
ctgagattgcagatgtg

SEQ ID NO: 2319653 - DNA, 23 bp, Homo sapiens
ctgagcaccgtgtcaagctgctc

SEQ ID NO: 2319654 - DNA, 19 bp, Homo sapiens
ctgagcagcctctggacag

SEQ ID NO: 2319655 - DNA, 22 bp, Homo sapiens
ctgagcaggctgtggggtggag

SEQ ID NO: 2319656 - DNA, 13 bp, Homo sapiens
ctgagctatttca

SEQ ID NO: 2319657 - DNA, 16 bp, Homo sapiens
ctgagctatttcatct

SEQ ID NO: 2319658 - DNA, 18 bp, Homo sapiens
ctgagctattttcctctg

SEQ ID NO: 2319659 - DNA, 20 bp, Homo sapiens
ctgagctcacatgggactgg

SEQ ID NO: 2319660 - DNA, 17 bp, Homo sapiens
ctgagctcctgtcccct

SEQ ID NO: 2319661 - DNA, 21 bp, Homo sapiens
ctgaggaaattgctttgtatt

SEQ ID NO: 2319662 - DNA, 16 bp, Homo sapiens
ctgaggaatttcacct

SEQ ID NO: 2319663 - DNA, 18 bp, Homo sapiens
ctgaggatgggtcagagc

SEQ ID NO: 2319664 - DNA, 16 bp, Homo sapiens
ctgccctgtctggaac

SEQ ID NO: 2319665 - DNA, 16 bp, Homo sapiens
ctgcccttccctctgg

SEQ ID NO: 2319666 - DNA, 17 bp, Homo sapiens
ctgcccttccctctggg

SEQ ID NO: 2319667 - DNA, 18 bp, Homo sapiens
ctgcccttccctctgggc

SEQ ID NO: 2319668 - DNA, 19 bp, Homo sapiens
ctgccgccccctcctgaac

SEQ ID NO: 2319669 - DNA, 12 bp, Homo sapiens
ctgcctcccact

SEQ ID NO: 2319670 - DNA, 18 bp, Homo sapiens
ctgcctcgctcaccgctg

SEQ ID NO: 2319671 - DNA, 22 bp, Homo sapiens
ctgcctcgctcaccgctggccc

SEQ ID NO: 2319672 - DNA, 22 bp, Homo sapiens
ctgcctctcatcaactgaatga

SEQ ID NO: 2319673 - DNA, 18 bp, Homo sapiens
ctgcctctttccctagga

SEQ ID NO: 2319674 - DNA, 14 bp, Homo sapiens
ctgcctgccccgcc

SEQ ID NO: 2319675 - DNA, 18 bp, Homo sapiens
ctgcctgccccgccccca

SEQ ID NO: 2319676 - DNA, 21 bp, Homo sapiens
ctgcctgccccgcccccagtc

SEQ ID NO: 2319677 - DNA, 22 bp, Homo sapiens
ctgcctgccccgcccccagtcc

SEQ ID NO: 2319678 - DNA, 15 bp, Homo sapiens
ctgcctgctgagatg

SEQ ID NO: 2319679 - DNA, 16 bp, Homo sapiens
ctgcctgctgagatga

SEQ ID NO: 2319680 - DNA, 23 bp, Homo sapiens
ctgcctggagacaaggtgctaac

SEQ ID NO: 2319681 - DNA, 11 bp, Homo sapiens
ctgcctggccc

SEQ ID NO: 2319682 - DNA, 19 bp, Homo sapiens
ctgcctggcccccaacctc

SEQ ID NO: 2319683 - DNA, 13 bp, Homo sapiens
ctgcctgtctgcc

SEQ ID NO: 2319684 - DNA, 16 bp, Homo sapiens
ctgccttaaaaccaaa

SEQ ID NO: 2319685 - DNA, 18 bp, Homo sapiens
ctgccttaaaaccaaaga

SEQ ID NO: 2319686 - DNA, 19 bp, Homo sapiens
ctgccttaaaaccaaagag

SEQ ID NO: 2319687 - DNA, 15 bp, Homo sapiens
ctgccttccctagct

SEQ ID NO: 2319688 - DNA, 17 bp, Homo sapiens
ctgccttccctagcttt

SEQ ID NO: 2319689 - DNA, 18 bp, Homo sapiens
ctgccttctggccttgta

SEQ ID NO: 2319690 - DNA, 13 bp, Homo sapiens
ctgccttgcctcc

SEQ ID NO: 2319691 - DNA, 14 bp, Homo sapiens
ctgccttgcctcct

SEQ ID NO: 2319692 - DNA, 13 bp, Homo sapiens
ctgccttggcctc

SEQ ID NO: 2319693 - DNA, 19 bp, Homo sapiens
ctgccttggcctcccaaag

SEQ ID NO: 2319694 - DNA, 20 bp, Homo sapiens
ctgcctttatgatgctaagc

SEQ ID NO: 2319695 - DNA, 20 bp, Homo sapiens
ctgcgaagaccctcttgccc

SEQ ID NO: 2319696 - DNA, 22 bp, Homo sapiens
ctgcgcccttaactgcatccag

SEQ ID NO: 2319697 - DNA, 18 bp, Homo sapiens
ctgcgcctgcaggcagag

SEQ ID NO: 2319698 - DNA, 15 bp, Homo sapiens
ctgcgcctgctgcct

SEQ ID NO: 2319699 - DNA, 18 bp, Homo sapiens
ctgcgcctgctgcctgct

SEQ ID NO: 2319700 - DNA, 15 bp, Homo sapiens
ctgcgggccagggtc

SEQ ID NO: 2319701 - DNA, 14 bp, Homo sapiens
ctgcgtcctcctca

SEQ ID NO: 2319702 - DNA, 19 bp, Homo sapiens
ctgcgtcctcctcacctca

SEQ ID NO: 2319703 - DNA, 24 bp, Homo sapiens
ctgcgtcctcctcacctcatgccc

SEQ ID NO: 2319704 - DNA, 20 bp, Homo sapiens
ctgctacacctattatccca

SEQ ID NO: 2319705 - DNA, 21 bp, Homo sapiens
ctgctataaataggtttatat

SEQ ID NO: 2319706 - DNA, 21 bp, Homo sapiens
ctgctatccccatctccctgc

SEQ ID NO: 2319707 - DNA, 19 bp, Homo sapiens
ctgctcagaacttgctgct

SEQ ID NO: 2319708 - DNA, 22 bp, Homo sapiens
ctgctcagaacttgctgctgtc

SEQ ID NO: 2319709 - DNA, 18 bp, Homo sapiens
ctgctcattacagttctt

SEQ ID NO: 2319710 - DNA, 15 bp, Homo sapiens
ctgctccttccccat

SEQ ID NO: 2319711 - DNA, 23 bp, Homo sapiens
ctgctccttccccatcgttgccc

SEQ ID NO: 2319712 - DNA, 13 bp, Homo sapiens
ctgctctcctctt

SEQ ID NO: 2319713 - DNA, 14 bp, Homo sapiens
ctgctctcctcttc

SEQ ID NO: 2319714 - DNA, 18 bp, Homo sapiens
ctgctctcctcttctact

SEQ ID NO: 2319715 - DNA, 21 bp, Homo sapiens
ctgctctggtggcttaagtga

SEQ ID NO: 2319716 - DNA, 17 bp, Homo sapiens
ctgctgaacacagtgtc

SEQ ID NO: 2319717 - DNA, 15 bp, Homo sapiens
ctgctgacctgctga

SEQ ID NO: 2319718 - DNA, 22 bp, Homo sapiens
ctgctgaggcccagtgcatatg

SEQ ID NO: 2319719 - DNA, 21 bp, Homo sapiens
ctgctgcccccaccccgggga

SEQ ID NO: 2319720 - DNA, 22 bp, Homo sapiens
ctgctgcccccaccccggggac

SEQ ID NO: 2319721 - DNA, 20 bp, Homo sapiens
ctgctgcctctttccctagg

SEQ ID NO: 2319722 - DNA, 11 bp, Homo sapiens
ctgctgcctgc

SEQ ID NO: 2319723 - DNA, 15 bp, Homo sapiens
ctgctgcctgctgag

SEQ ID NO: 2319724 - DNA, 17 bp, Homo sapiens
ctgctgctgtctgggtg

SEQ ID NO: 2319725 - DNA, 13 bp, Homo sapiens
ctgctggaagccc

SEQ ID NO: 2319726 - DNA, 16 bp, Homo sapiens
ctgctggaagcccagc

SEQ ID NO: 2319727 - DNA, 14 bp, Homo sapiens
ctgctggcacccac

SEQ ID NO: 2319728 - DNA, 16 bp, Homo sapiens
ctgctggcacccaccg

SEQ ID NO: 2319729 - DNA, 17 bp, Homo sapiens
ctgctggcacccaccgt

SEQ ID NO: 2319730 - DNA, 12 bp, Homo sapiens
ctgctggccaaa

SEQ ID NO: 2319731 - DNA, 20 bp, Homo sapiens
ctgctggccaaatagcaaag

SEQ ID NO: 2319732 - DNA, 21 bp, Homo sapiens
ctgctggccatgaatctctgc

SEQ ID NO: 2319733 - DNA, 23 bp, Homo sapiens
ctgctggccatgaatctctgcct

SEQ ID NO: 2319734 - DNA, 19 bp, Homo sapiens
ctgctggggaagggttttc

SEQ ID NO: 2319735 - DNA, 13 bp, Homo sapiens
ctgctggggatcc

SEQ ID NO: 2319736 - DNA, 14 bp, Homo sapiens
ctgctggggatccc

SEQ ID NO: 2319737 - DNA, 16 bp, Homo sapiens
ctgctggggcctggga

SEQ ID NO: 2319738 - DNA, 19 bp, Homo sapiens
ctgctggggcctgggacaa

SEQ ID NO: 2319739 - DNA, 16 bp, Homo sapiens
ctgctggtatttctaa

SEQ ID NO: 2319740 - DNA, 16 bp, Homo sapiens
ctgctgtatgtgagct

SEQ ID NO: 2319741 - DNA, 14 bp, Homo sapiens
ctgctgtccagtgc

SEQ ID NO: 2319742 - DNA, 16 bp, Homo sapiens
ctgctgtccagtgcct

SEQ ID NO: 2319743 - DNA, 20 bp, Homo sapiens
ctgctgtccagtgcctacat

SEQ ID NO: 2319744 - DNA, 22 bp, Homo sapiens
ctgctgtcctgtttctgtcaag

SEQ ID NO: 2319745 - DNA, 14 bp, Homo sapiens
gaagggtttctcta

SEQ ID NO: 2319746 - DNA, 16 bp, Homo sapiens
gaagggtttctctatt

SEQ ID NO: 2319747 - DNA, 15 bp, Homo sapiens
gaagggttttctttt

SEQ ID NO: 2319748 - DNA, 19 bp, Homo sapiens
gaaggtagcattctttgga

SEQ ID NO: 2319749 - DNA, 14 bp, Homo sapiens
gaagtaggtggctt

SEQ ID NO: 2319750 - DNA, 20 bp, Homo sapiens
gaagtcattgtcgctcagca

SEQ ID NO: 2319751 - DNA, 21 bp, Homo sapiens
gaagtcattgtcgctcagcaa

SEQ ID NO: 2319752 - DNA, 12 bp, Homo sapiens
gaagtctggaaa

SEQ ID NO: 2319753 - DNA, 15 bp, Homo sapiens
gaagtctggctttgc

SEQ ID NO: 2319754 - DNA, 15 bp, Homo sapiens
gaagtttcaagtttt

SEQ ID NO: 2319755 - DNA, 21 bp, Homo sapiens
gaataaaaggcttgaagctgt

SEQ ID NO: 2319756 - DNA, 17 bp, Homo sapiens
gaataaagaatgccatt

SEQ ID NO: 2319757 - DNA, 16 bp, Homo sapiens
gaataaatgtgttggg

SEQ ID NO: 2319758 - DNA, 18 bp, Homo sapiens
gaataatcacgctttcct

SEQ ID NO: 2319759 - DNA, 16 bp, Homo sapiens
gaataattttggaata

SEQ ID NO: 2319760 - DNA, 14 bp, Homo sapiens
gaatacataaacaa

SEQ ID NO: 2319761 - DNA, 19 bp, Homo sapiens
gaataccacatcaaataag

SEQ ID NO: 2319762 - DNA, 13 bp, Homo sapiens
gaatataaaaaat

SEQ ID NO: 2319763 - DNA, 21 bp, Homo sapiens
gaatatatcagtacctctcaa

SEQ ID NO: 2319764 - DNA, 23 bp, Homo sapiens
gaatatgtagtatctatatgact

SEQ ID NO: 2319765 - DNA, 14 bp, Homo sapiens
gaatattaaaaaac

SEQ ID NO: 2319766 - DNA, 19 bp, Homo sapiens
gaatattcatggatggctc

SEQ ID NO: 2319767 - DNA, 12 bp, Homo sapiens
gaatatttacta

SEQ ID NO: 2319768 - DNA, 19 bp, Homo sapiens
gaatatttttatatttcct

SEQ ID NO: 2319769 - DNA, 22 bp, Homo sapiens
gaatatttttatatttccttta

SEQ ID NO: 2319770 - DNA, 19 bp, Homo sapiens
gaatcactgttgctttgaa

SEQ ID NO: 2319771 - DNA, 12 bp, Homo sapiens
gaatccaagatt

SEQ ID NO: 2319772 - DNA, 21 bp, Homo sapiens
gaatccaagggttgagagcca

SEQ ID NO: 2319773 - DNA, 14 bp, Homo sapiens
gaatccgaagggaa

SEQ ID NO: 2319774 - DNA, 16 bp, Homo sapiens
gaatcgctcctgcagc

SEQ ID NO: 2319775 - DNA, 15 bp, Homo sapiens
gaatctacaagccaa

SEQ ID NO: 2319776 - DNA, 21 bp, Homo sapiens
gaatctagttggttgatgcct

SEQ ID NO: 2319777 - DNA, 20 bp, Homo sapiens
gaatctataagtagtaaatc

SEQ ID NO: 2319778 - DNA, 15 bp, Homo sapiens
gaatctctgcctctc

SEQ ID NO: 2319779 - DNA, 13 bp, Homo sapiens
gaatctcttcact

SEQ ID NO: 2319780 - DNA, 14 bp, Homo sapiens
gaatcttctgggta

SEQ ID NO: 2319781 - DNA, 12 bp, Homo sapiens
gaatgaaaataa

SEQ ID NO: 2319782 - DNA, 15 bp, Homo sapiens
gaatgaaagctgttc

SEQ ID NO: 2319783 - DNA, 14 bp, Homo sapiens
gaatgaggaaaatt

SEQ ID NO: 2319784 - DNA, 22 bp, Homo sapiens
gaatgaggtgggaggtggaaga

SEQ ID NO: 2319785 - DNA, 16 bp, Homo sapiens
gaatgagttgaggcca

SEQ ID NO: 2319786 - DNA, 16 bp, Homo sapiens
gaatgattaaattatg

SEQ ID NO: 2319787 - DNA, 14 bp, Homo sapiens
gaatgcatgtaagg

SEQ ID NO: 2319788 - DNA, 17 bp, Homo sapiens
gaatgccacccacatct

SEQ ID NO: 2319789 - DNA, 19 bp, Homo sapiens
gaatgccatctatctagtt

SEQ ID NO: 2319790 - DNA, 23 bp, Homo sapiens
gaatgccatttctcacgccctct

SEQ ID NO: 2319791 - DNA, 12 bp, Homo sapiens
gaatgctcaggg

SEQ ID NO: 2319792 - DNA, 22 bp, Homo sapiens
gaatggtctttgctccagataa

SEQ ID NO: 2319793 - DNA, 13 bp, Homo sapiens
gaatggtggtgga

SEQ ID NO: 2319794 - DNA, 19 bp, Homo sapiens
gaatggtgtgaacccggga

SEQ ID NO: 2319795 - DNA, 12 bp, Homo sapiens
gaatgtaaccaa

SEQ ID NO: 2319796 - DNA, 13 bp, Homo sapiens
gaatgtatttgat

SEQ ID NO: 2319797 - DNA, 22 bp, Homo sapiens
gaatgtttttccctccccagaa

SEQ ID NO: 2319798 - DNA, 13 bp, Homo sapiens
gaattatacagta

SEQ ID NO: 2319799 - DNA, 15 bp, Homo sapiens
gaattatcagcaaag

SEQ ID NO: 2319800 - DNA, 20 bp, Homo sapiens
gaattatcagcaaagaaaaa

SEQ ID NO: 2319801 - DNA, 20 bp, Homo sapiens
gaattatcttggttgaaaat

SEQ ID NO: 2319802 - DNA, 12 bp, Homo sapiens
gaattattgaca

SEQ ID NO: 2319803 - DNA, 15 bp, Homo sapiens
gaattgaaatgaggt

SEQ ID NO: 2319804 - DNA, 21 bp, Homo sapiens
gaatttcacctgtaaacctga

SEQ ID NO: 2319805 - DNA, 16 bp, Homo sapiens
gaatttgagaaccttg

SEQ ID NO: 2319806 - DNA, 21 bp, Homo sapiens
gaatttggggctacttatatt

SEQ ID NO: 2319807 - DNA, 18 bp, Homo sapiens
gaatttggggcttccaag

SEQ ID NO: 2319808 - DNA, 12 bp, Homo sapiens
gaatttttaagc

SEQ ID NO: 2319809 - DNA, 13 bp, Homo sapiens
gaatttttcaagt

SEQ ID NO: 2319810 - DNA, 20 bp, Homo sapiens
gacaaaaaaaaaagaagcag

SEQ ID NO: 2319811 - DNA, 22 bp, Homo sapiens
gacaaaaagtatattaaacaaa

SEQ ID NO: 2319812 - DNA, 15 bp, Homo sapiens
gacaaaatttgagaa

SEQ ID NO: 2319813 - DNA, 22 bp, Homo sapiens
gacaaagccttaagcaaatttt

SEQ ID NO: 2319814 - DNA, 15 bp, Homo sapiens
gacaaccattaaagt

SEQ ID NO: 2319815 - DNA, 16 bp, Homo sapiens
gacaaccattaaagtc

SEQ ID NO: 2319816 - DNA, 21 bp, Homo sapiens
gacaactgctcccacctcctg

SEQ ID NO: 2319817 - DNA, 18 bp, Homo sapiens
gacaagagatgggaatga

SEQ ID NO: 2319818 - DNA, 20 bp, Homo sapiens
gacaagagatgggaatgagg

SEQ ID NO: 2319819 - DNA, 14 bp, Homo sapiens
gacaagtgctgttg

SEQ ID NO: 2319820 - DNA, 22 bp, Homo sapiens
gacacaactgtgtgattaaaag

SEQ ID NO: 2319821 - DNA, 14 bp, Homo sapiens
gacacacagcctag

SEQ ID NO: 2319822 - DNA, 15 bp, Homo sapiens
gacacagacccagga

SEQ ID NO: 2319823 - DNA, 16 bp, Homo sapiens
gacacagacccaggac

SEQ ID NO: 2319824 - DNA, 16 bp, Homo sapiens
gacacagttcctggga

SEQ ID NO: 2319825 - DNA, 18 bp, Homo sapiens
gacacattaatgataaac

SEQ ID NO: 2319826 - DNA, 23 bp, Homo sapiens
gacacattttttaggaaatgttt

SEQ ID NO: 2319827 - DNA, 14 bp, Homo sapiens
gacaccagagcaga

SEQ ID NO: 2319828 - DNA, 18 bp, Homo sapiens
gacaccagagcagatgca

SEQ ID NO: 2319829 - DNA, 22 bp, Homo sapiens
gacaccagagcagatgcagaga

SEQ ID NO: 2319830 - DNA, 12 bp, Homo sapiens
gacacccagagg

SEQ ID NO: 2319831 - DNA, 21 bp, Homo sapiens
gacaccccccgccccccacct

SEQ ID NO: 2319832 - DNA, 19 bp, Homo sapiens
gacacgagccacaagctgc

SEQ ID NO: 2319833 - DNA, 22 bp, Homo sapiens
gacactctagtgacttcctggt

SEQ ID NO: 2319834 - DNA, 19 bp, Homo sapiens
gacactgaaagttttgtaa

SEQ ID NO: 2319835 - DNA, 20 bp, Homo sapiens
gacactgaaagttttgtaaa

SEQ ID NO: 2319836 - DNA, 12 bp, Homo sapiens
gacactgtacaa

SEQ ID NO: 2319837 - DNA, 13 bp, Homo sapiens
gacactgtacaag

SEQ ID NO: 2319838 - DNA, 18 bp, Homo sapiens
gacactgttgataaaaac

SEQ ID NO: 2319839 - DNA, 23 bp, Homo sapiens
gacactttaattaccaacctgtt

SEQ ID NO: 2319840 - DNA, 23 bp, Homo sapiens
gacagaaggtgccactttaccca

SEQ ID NO: 2319841 - DNA, 13 bp, Homo sapiens
gacagagctctgg

SEQ ID NO: 2319842 - DNA, 18 bp, Homo sapiens
gacagaggaaagggctgg

SEQ ID NO: 2319843 - DNA, 21 bp, Homo sapiens
gacagaggaaagggctggctc

SEQ ID NO: 2319844 - DNA, 14 bp, Homo sapiens
gacagaggatgtgg

SEQ ID NO: 2319845 - DNA, 13 bp, Homo sapiens
gacagaggctgca

SEQ ID NO: 2319846 - DNA, 17 bp, Homo sapiens
gacagcagaagcctcca

SEQ ID NO: 2319847 - DNA, 20 bp, Homo sapiens
gacagcagaagcctccaagc

SEQ ID NO: 2319848 - DNA, 15 bp, Homo sapiens
gactgcagtgtggag

SEQ ID NO: 2319849 - DNA, 16 bp, Homo sapiens
gactgcagtgtggagt

SEQ ID NO: 2319850 - DNA, 21 bp, Homo sapiens
gactgcagtgtggagttcacc

SEQ ID NO: 2319851 - DNA, 16 bp, Homo sapiens
gactgccaggctgttt

SEQ ID NO: 2319852 - DNA, 22 bp, Homo sapiens
gactgccccacggagacagagg

SEQ ID NO: 2319853 - DNA, 23 bp, Homo sapiens
gactgctcagaacttgctgctgt

SEQ ID NO: 2319854 - DNA, 21 bp, Homo sapiens
gactggcccctgacccaggga

SEQ ID NO: 2319855 - DNA, 14 bp, Homo sapiens
gactggttttctgc

SEQ ID NO: 2319856 - DNA, 16 bp, Homo sapiens
gactggttttctgcca

SEQ ID NO: 2319857 - DNA, 16 bp, Homo sapiens
gactgtagccacagct

SEQ ID NO: 2319858 - DNA, 21 bp, Homo sapiens
gactgtcacggggttccctcc

SEQ ID NO: 2319859 - DNA, 22 bp, Homo sapiens
gactgtcacggggttccctcct

SEQ ID NO: 2319860 - DNA, 13 bp, Homo sapiens
gactgtcagttct

SEQ ID NO: 2319861 - DNA, 16 bp, Homo sapiens
gactgtgcaatactta

SEQ ID NO: 2319862 - DNA, 18 bp, Homo sapiens
gactgtttgaatgttttc

SEQ ID NO: 2319863 - DNA, 12 bp, Homo sapiens
gacttaagaaag

SEQ ID NO: 2319864 - DNA, 22 bp, Homo sapiens
gacttcctggtgaggcccagcc

SEQ ID NO: 2319865 - DNA, 22 bp, Homo sapiens
gacttctcggaattcataataa

SEQ ID NO: 2319866 - DNA, 16 bp, Homo sapiens
gacttcttcctctaga

SEQ ID NO: 2319867 - DNA, 16 bp, Homo sapiens
ccttggaccactcctg

SEQ ID NO: 2319868 - DNA, 15 bp, Homo sapiens
ccttggagagcagct

SEQ ID NO: 2319869 - DNA, 17 bp, Homo sapiens
ccttggagagcagctgg

SEQ ID NO: 2319870 - DNA, 18 bp, Homo sapiens
ccttgtataatattgaaa

SEQ ID NO: 2319871 - DNA, 15 bp, Homo sapiens
ccttgtcccagccag

SEQ ID NO: 2319872 - DNA, 16 bp, Homo sapiens
ccttgtcccagccagt

SEQ ID NO: 2319873 - DNA, 16 bp, Homo sapiens
ccttgtcttttgagct

SEQ ID NO: 2319874 - DNA, 22 bp, Homo sapiens
ccttgtttgagtttttcctccc

SEQ ID NO: 2319875 - DNA, 16 bp, Homo sapiens
cctttagatctctgaa

SEQ ID NO: 2319876 - DNA, 15 bp, Homo sapiens
cctttaggcagcctg

SEQ ID NO: 2319877 - DNA, 16 bp, Homo sapiens
cctttaggcagcctgc

SEQ ID NO: 2319878 - DNA, 13 bp, Homo sapiens
cctttatgtattc

SEQ ID NO: 2319879 - DNA, 13 bp, Homo sapiens
cctttatgtgaat

SEQ ID NO: 2319880 - DNA, 20 bp, Homo sapiens
cctttccataaatccttgat

SEQ ID NO: 2319881 - DNA, 22 bp, Homo sapiens
cctttccataaatccttgatga

SEQ ID NO: 2319882 - DNA, 18 bp, Homo sapiens
cctttcccaccccaacct

SEQ ID NO: 2319883 - DNA, 11 bp, Homo sapiens
cctttcctgtc

SEQ ID NO: 2319884 - DNA, 14 bp, Homo sapiens
cctttcctgtccca

SEQ ID NO: 2319885 - DNA, 17 bp, Homo sapiens
cctttccttccctctct

SEQ ID NO: 2319886 - DNA, 13 bp, Homo sapiens
cctttcgaggcct

SEQ ID NO: 2319887 - DNA, 14 bp, Homo sapiens
cctttcgaggcctg

SEQ ID NO: 2319888 - DNA, 17 bp, Homo sapiens
cctttctctcctggctc

SEQ ID NO: 2319889 - DNA, 20 bp, Homo sapiens
cctttctcttttcccctttc

SEQ ID NO: 2319890 - DNA, 22 bp, Homo sapiens
cctttctcttttcccctttcct

SEQ ID NO: 2319891 - DNA, 11 bp, Homo sapiens
cctttcttctg

SEQ ID NO: 2319892 - DNA, 15 bp, Homo sapiens
cctttgacctcggtg

SEQ ID NO: 2319893 - DNA, 18 bp, Homo sapiens
cctttgggatcagcctcc

SEQ ID NO: 2319894 - DNA, 12 bp, Homo sapiens
cctttgggggtt

SEQ ID NO: 2319895 - DNA, 14 bp, Homo sapiens
cctttgtaagtgca

SEQ ID NO: 2319896 - DNA, 19 bp, Homo sapiens
cctttgtctgtcaatcaca

SEQ ID NO: 2319897 - DNA, 17 bp, Homo sapiens
cctttgtgtgctctcca

SEQ ID NO: 2319898 - DNA, 18 bp, Homo sapiens
cctttgtgtgctctccat

SEQ ID NO: 2319899 - DNA, 14 bp, Homo sapiens
ccttttcaggaaaa

SEQ ID NO: 2319900 - DNA, 12 bp, Homo sapiens
ccttttcagggc

SEQ ID NO: 2319901 - DNA, 16 bp, Homo sapiens
ccttttccacacgcat

SEQ ID NO: 2319902 - DNA, 13 bp, Homo sapiens
ccttttccctgct

SEQ ID NO: 2319903 - DNA, 14 bp, Homo sapiens
ccttttccctgctt

SEQ ID NO: 2319904 - DNA, 15 bp, Homo sapiens
ccttttccctgcttc

SEQ ID NO: 2319905 - DNA, 18 bp, Homo sapiens
cctttttatttgcatgtg

SEQ ID NO: 2319906 - DNA, 17 bp, Homo sapiens
cctttttcactttgaaa

SEQ ID NO: 2319907 - DNA, 19 bp, Homo sapiens
cctttttcataaattattt

SEQ ID NO: 2319908 - DNA, 21 bp, Homo sapiens
ccttttttaagatttttctca

SEQ ID NO: 2319909 - DNA, 17 bp, Homo sapiens
cgaaatatcaaagtcat

SEQ ID NO: 2319910 - DNA, 21 bp, Homo sapiens
cgaacttcacataggaaggga

SEQ ID NO: 2319911 - DNA, 20 bp, Homo sapiens
cgaagaccctcttgcccatc

SEQ ID NO: 2319912 - DNA, 15 bp, Homo sapiens
cgaagagttcccttg

SEQ ID NO: 2319913 - DNA, 15 bp, Homo sapiens
cgaatggtctttgct

SEQ ID NO: 2319914 - DNA, 21 bp, Homo sapiens
cgaatggtctttgctccagat

SEQ ID NO: 2319915 - DNA, 14 bp, Homo sapiens
cgaccatgtggcca

SEQ ID NO: 2319916 - DNA, 13 bp, Homo sapiens
cgacctggccgcg

SEQ ID NO: 2319917 - DNA, 19 bp, Homo sapiens
cgacctggccgcggagcct

SEQ ID NO: 2319918 - DNA, 14 bp, Homo sapiens
cgactcttcctgca

SEQ ID NO: 2319919 - DNA, 16 bp, Homo sapiens
cgagaccatcctggct

SEQ ID NO: 2319920 - DNA, 14 bp, Homo sapiens
cgagagggagagag

SEQ ID NO: 2319921 - DNA, 16 bp, Homo sapiens
cgagagggagagagag

SEQ ID NO: 2319922 - DNA, 20 bp, Homo sapiens
cgagcaaacccagaggtgga

SEQ ID NO: 2319923 - DNA, 18 bp, Homo sapiens
cgagcacctccagcctga

SEQ ID NO: 2319924 - DNA, 16 bp, Homo sapiens
cgagccacaagctgca

SEQ ID NO: 2319925 - DNA, 17 bp, Homo sapiens
cgagccacaagctgcac

SEQ ID NO: 2319926 - DNA, 19 bp, Homo sapiens
cgagccacaagctgcactg

SEQ ID NO: 2319927 - DNA, 22 bp, Homo sapiens
cgagccacgcagtgcctggagt

SEQ ID NO: 2319928 - DNA, 15 bp, Homo sapiens
cgagctgctctgcta

SEQ ID NO: 2319929 - DNA, 10 bp, Homo sapiens
cgaggcctga

SEQ ID NO: 2319930 - DNA, 13 bp, Homo sapiens
cgaggtcaggaga

SEQ ID NO: 2319931 - DNA, 22 bp, Homo sapiens
cgagtagaaaatgtgaccctcc

SEQ ID NO: 2319932 - DNA, 21 bp, Homo sapiens
cgagtctggggacctggcact

SEQ ID NO: 2319933 - DNA, 23 bp, Homo sapiens
cgatgcatttaataaagatgagt

SEQ ID NO: 2319934 - DNA, 24 bp, Homo sapiens
cgatgcatttaataaagatgagtt

SEQ ID NO: 2319935 - DNA, 13 bp, Homo sapiens
cgatgtaaattat

SEQ ID NO: 2319936 - DNA, 20 bp, Homo sapiens
cgatgttgtcaaggatggtt

SEQ ID NO: 2319937 - DNA, 21 bp, Homo sapiens
cgattctcccaaagtaccttg

SEQ ID NO: 2319938 - DNA, 18 bp, Homo sapiens
cgattttcaagattctaa

SEQ ID NO: 2319939 - DNA, 14 bp, Homo sapiens
cgcactacatctga

SEQ ID NO: 2319940 - DNA, 23 bp, Homo sapiens
cgcagaggacgcacgctcgctgc

SEQ ID NO: 2319941 - DNA, 18 bp, Homo sapiens
cgcagggccatgcagacc

SEQ ID NO: 2319942 - DNA, 18 bp, Homo sapiens
cgcaggtgggctggactt

SEQ ID NO: 2319943 - DNA, 11 bp, Homo sapiens
cgcagtgtctc

SEQ ID NO: 2319944 - DNA, 14 bp, Homo sapiens
cgcatcctatgctt

SEQ ID NO: 2319945 - DNA, 14 bp, Homo sapiens
cgccaccgtgcctg

SEQ ID NO: 2319946 - DNA, 16 bp, Homo sapiens
cgccaccgtgcctggc

SEQ ID NO: 2319947 - DNA, 15 bp, Homo sapiens
cgccactccctggga

SEQ ID NO: 2319948 - DNA, 20 bp, Homo sapiens
cgccactccctgggacacag

SEQ ID NO: 2319949 - DNA, 16 bp, Homo sapiens
cgccagcctcctctgg

SEQ ID NO: 2319950 - DNA, 14 bp, Homo sapiens
cgcccatctcagga

SEQ ID NO: 2319951 - DNA, 15 bp, Homo sapiens
cgcccatgctgtccg

SEQ ID NO: 2319952 - DNA, 14 bp, Homo sapiens
cgccccacccaggg

SEQ ID NO: 2319953 - DNA, 12 bp, Homo sapiens
cgccccccacct

SEQ ID NO: 2319954 - DNA, 13 bp, Homo sapiens
cgccccccacctt

SEQ ID NO: 2319955 - DNA, 21 bp, Homo sapiens
cgcccgactagcaggcatgcc

SEQ ID NO: 2319956 - DNA, 15 bp, Homo sapiens
cgccctcactattct

SEQ ID NO: 2319957 - DNA, 12 bp, Homo sapiens
cgccctgcctcc

SEQ ID NO: 2319958 - DNA, 15 bp, Homo sapiens
cgccctgcctcctgg

SEQ ID NO: 2319959 - DNA, 12 bp, Homo sapiens
cgccgatgccac

SEQ ID NO: 2319960 - DNA, 16 bp, Homo sapiens
cgccgatgccaccggc

SEQ ID NO: 2319961 - DNA, 15 bp, Homo sapiens
cgcctcagccctcag

SEQ ID NO: 2319962 - DNA, 16 bp, Homo sapiens
cgcctctgcccgcaga

SEQ ID NO: 2319963 - DNA, 16 bp, Homo sapiens
cgcggagcctgcattt

SEQ ID NO: 2319964 - DNA, 17 bp, Homo sapiens
cgcggggaagctggctt

SEQ ID NO: 2319965 - DNA, 13 bp, Homo sapiens
cgcggtggctcac

SEQ ID NO: 2319966 - DNA, 15 bp, Homo sapiens
cgcgtctgccccacc

SEQ ID NO: 2319967 - DNA, 17 bp, Homo sapiens
cgcgtctgccccaccct

SEQ ID NO: 2319968 - DNA, 21 bp, Homo sapiens
cgctaaagagcccttgcctcc

SEQ ID NO: 2319969 - DNA, 22 bp, Homo sapiens
cgctaaagagcccttgcctccc

SEQ ID NO: 2319970 - DNA, 17 bp, Homo sapiens
cgctcaccgctggccct

SEQ ID NO: 2319971 - DNA, 22 bp, Homo sapiens
cgctcagcaatagggtgcagtt

SEQ ID NO: 2319972 - DNA, 13 bp, Homo sapiens
cgctccctcccag

SEQ ID NO: 2319973 - DNA, 21 bp, Homo sapiens
cgctccctcccaggactctga

SEQ ID NO: 2319974 - DNA, 23 bp, Homo sapiens
cgctccgggctttcacggaaact

SEQ ID NO: 2319975 - DNA, 18 bp, Homo sapiens
cgctcctgcagccccagc

SEQ ID NO: 2319976 - DNA, 15 bp, Homo sapiens
cgctcgctgccatca

SEQ ID NO: 2319977 - DNA, 20 bp, Homo sapiens
cgctgccatcaccgctgggt

SEQ ID NO: 2319978 - DNA, 22 bp, Homo sapiens
cgctgccatcaccgctgggtgg

SEQ ID NO: 2319979 - DNA, 22 bp, Homo sapiens
cgctgtatgaaaggagagagca

SEQ ID NO: 2319980 - DNA, 20 bp, Homo sapiens
cgcttctccccagagctgcc

SEQ ID NO: 2319981 - DNA, 18 bp, Homo sapiens
cgcttgcttttctgtatt

SEQ ID NO: 2319982 - DNA, 22 bp, Homo sapiens
cgcttggagctattttccaggc

SEQ ID NO: 2319983 - DNA, 17 bp, Homo sapiens
cgcttgtgacagtgcct

SEQ ID NO: 2319984 - DNA, 17 bp, Homo sapiens
cggaactgtcctttcct

SEQ ID NO: 2319985 - DNA, 18 bp, Homo sapiens
ccagattcccctgtgtca

SEQ ID NO: 2319986 - DNA, 12 bp, Homo sapiens
ccagattctgat

SEQ ID NO: 2319987 - DNA, 20 bp, Homo sapiens
ccatatatgaccagaagcct

SEQ ID NO: 2319988 - DNA, 12 bp, Homo sapiens
ccatatcctggt

SEQ ID NO: 2319989 - DNA, 15 bp, Homo sapiens
ccatatcctggtgcc

SEQ ID NO: 2319990 - DNA, 18 bp, Homo sapiens
ccatatttgatttctaat

SEQ ID NO: 2319991 - DNA, 18 bp, Homo sapiens
ccatcaccctcttcctgt

SEQ ID NO: 2319992 - DNA, 15 bp, Homo sapiens
ccatcaccgctgggt

SEQ ID NO: 2319993 - DNA, 13 bp, Homo sapiens
ccatccagatgtg

SEQ ID NO: 2319994 - DNA, 17 bp, Homo sapiens
ccatcctgccatcctca

SEQ ID NO: 2319995 - DNA, 21 bp, Homo sapiens
ccatcgttgcccccatttctg

SEQ ID NO: 2319996 - DNA, 21 bp, Homo sapiens
ccatctagactagcaatctct

SEQ ID NO: 2319997 - DNA, 20 bp, Homo sapiens
ccatctcatgaggggagagg

SEQ ID NO: 2319998 - DNA, 15 bp, Homo sapiens
ccatctcccaaggct

SEQ ID NO: 2319999 - DNA, 18 bp, Homo sapiens
ccatctcccaaggctgcc

SEQ ID NO: 2320000 - DNA, 21 bp, Homo sapiens
ccatctcccaaggctgccaga

SEQ ID NO: 2320001 - DNA, 18 bp, Homo sapiens
ccatctccctgcctggcc

SEQ ID NO: 2320002 - DNA, 23 bp, Homo sapiens
ccatctgcaccccttctctcctc

SEQ ID NO: 2320003 - DNA, 12 bp, Homo sapiens
ccatctgtccag

SEQ ID NO: 2320004 - DNA, 24 bp, Homo sapiens
ccatctgtttgaagattatatgaa

SEQ ID NO: 2320005 - DNA, 21 bp, Homo sapiens
ccatgaccctacataaggctg

SEQ ID NO: 2320006 - DNA, 13 bp, Homo sapiens
ccatgagctgctc

SEQ ID NO: 2320007 - DNA, 15 bp, Homo sapiens
ccatgagctgctcat

SEQ ID NO: 2320008 - DNA, 13 bp, Homo sapiens
ccatgatgtatat

SEQ ID NO: 2320009 - DNA, 19 bp, Homo sapiens
ccatgccagattctgcctc

SEQ ID NO: 2320010 - DNA, 20 bp, Homo sapiens
ccatgccagattctgcctct

SEQ ID NO: 2320011 - DNA, 12 bp, Homo sapiens
ccatgccagctg

SEQ ID NO: 2320012 - DNA, 20 bp, Homo sapiens
ccatgctggcggcgcagagg

SEQ ID NO: 2320013 - DNA, 19 bp, Homo sapiens
ccatggaatgaaccccccg

SEQ ID NO: 2320014 - DNA, 16 bp, Homo sapiens
ccatgggcctgctgcg

SEQ ID NO: 2320015 - DNA, 21 bp, Homo sapiens
ccatgggcttcactgtataaa

SEQ ID NO: 2320016 - DNA, 17 bp, Homo sapiens
ccatggtgtgtttgtaa

SEQ ID NO: 2320017 - DNA, 20 bp, Homo sapiens
ccatggtgtgtttgtaataa

SEQ ID NO: 2320018 - DNA, 17 bp, Homo sapiens
ccatgtccaaagaggct

SEQ ID NO: 2320019 - DNA, 23 bp, Homo sapiens
ccatgtccaaagaggctgcccct

SEQ ID NO: 2320020 - DNA, 19 bp, Homo sapiens
ccatgtccaagtccaacct

SEQ ID NO: 2320021 - DNA, 23 bp, Homo sapiens
ccatgtccaagtccaacctgcct

SEQ ID NO: 2320022 - DNA, 15 bp, Homo sapiens
ccatgtcttctccct

SEQ ID NO: 2320023 - DNA, 19 bp, Homo sapiens
ccatgtcttctccctggaa

SEQ ID NO: 2320024 - DNA, 20 bp, Homo sapiens
ccatgtgatggacactccag

SEQ ID NO: 2320025 - DNA, 14 bp, Homo sapiens
ccatgtggccacaa

SEQ ID NO: 2320026 - DNA, 17 bp, Homo sapiens
ccatgttctatttttga

SEQ ID NO: 2320027 - DNA, 21 bp, Homo sapiens
ccattaaaaatgagatttctt

SEQ ID NO: 2320028 - DNA, 15 bp, Homo sapiens
ccattaaggggaaga

SEQ ID NO: 2320029 - DNA, 22 bp, Homo sapiens
ccattacagaggtattaaaact

SEQ ID NO: 2320030 - DNA, 22 bp, Homo sapiens
ccattacctccatccatccttc

SEQ ID NO: 2320031 - DNA, 13 bp, Homo sapiens
ccattcaattagt

SEQ ID NO: 2320032 - DNA, 21 bp, Homo sapiens
ccattcactactcatgcgtga

SEQ ID NO: 2320033 - DNA, 20 bp, Homo sapiens
ccattcagagctatggtgct

SEQ ID NO: 2320034 - DNA, 13 bp, Homo sapiens
ccattcatccttc

SEQ ID NO: 2320035 - DNA, 16 bp, Homo sapiens
ccattcattaattagt

SEQ ID NO: 2320036 - DNA, 15 bp, Homo sapiens
ccattccaaaatatt

SEQ ID NO: 2320037 - DNA, 21 bp, Homo sapiens
ccattccaaaatattatgccc

SEQ ID NO: 2320038 - DNA, 21 bp, Homo sapiens
ccattccaagtcaacactctt

SEQ ID NO: 2320039 - DNA, 15 bp, Homo sapiens
ccattctcccaggta

SEQ ID NO: 2320040 - DNA, 23 bp, Homo sapiens
ccattctcccaggtaccagctgc

SEQ ID NO: 2320041 - DNA, 13 bp, Homo sapiens
ccattctgctcct

SEQ ID NO: 2320042 - DNA, 17 bp, Homo sapiens
ccattgcttattatgta

SEQ ID NO: 2320043 - DNA, 18 bp, Homo sapiens
ccattgcttattatgtag

SEQ ID NO: 2320044 - DNA, 17 bp, Homo sapiens
ccattgtcctccttttc

SEQ ID NO: 2320045 - DNA, 19 bp, Homo sapiens
ccattgtcctccttttcac

SEQ ID NO: 2320046 - DNA, 15 bp, Homo sapiens
ccatttccattgctt

SEQ ID NO: 2320047 - DNA, 14 bp, Homo sapiens
ccatttcccatctg

SEQ ID NO: 2320048 - DNA, 13 bp, Homo sapiens
ccatttctgcctc

SEQ ID NO: 2320049 - DNA, 21 bp, Homo sapiens
ccatttgcaataacagctgca

SEQ ID NO: 2320050 - DNA, 17 bp, Homo sapiens
ccatttgtcccagacta

SEQ ID NO: 2320051 - DNA, 18 bp, Homo sapiens
ccatttgtgccagaggaa

SEQ ID NO: 2320052 - DNA, 12 bp, Homo sapiens
ccatttttcctt

SEQ ID NO: 2320053 - DNA, 14 bp, Homo sapiens
ccatttttctcttg

SEQ ID NO: 2320054 - DNA, 19 bp, Homo sapiens
ccattttttgagtctcctt

SEQ ID NO: 2320055 - DNA, 13 bp, Homo sapiens
cccaaatgtggaa

SEQ ID NO: 2320056 - DNA, 20 bp, Homo sapiens
cccaaccaggcacctcttcc

SEQ ID NO: 2320057 - DNA, 13 bp, Homo sapiens
cccaacctgcacg

SEQ ID NO: 2320058 - DNA, 16 bp, Homo sapiens
cccaacctgctctcct

SEQ ID NO: 2320059 - DNA, 17 bp, Homo sapiens
cccaacctgctctcctc

SEQ ID NO: 2320060 - DNA, 24 bp, Homo sapiens
cccaagagaactcgcgctcagtaa

SEQ ID NO: 2320061 - DNA, 13 bp, Homo sapiens
cccaaggctgcca

SEQ ID NO: 2320062 - DNA, 18 bp, Homo sapiens
cccaaggctgccagacat

SEQ ID NO: 2320063 - DNA, 19 bp, Homo sapiens
cccaaggttggagcccagg

SEQ ID NO: 2320064 - DNA, 21 bp, Homo sapiens
cccaagtcaaagatgccccat

SEQ ID NO: 2320065 - DNA, 12 bp, Homo sapiens
cccaagtgcctc

SEQ ID NO: 2320066 - DNA, 19 bp, Homo sapiens
cccacatccaactccagca

SEQ ID NO: 2320067 - DNA, 17 bp, Homo sapiens
cccacatcccatcgtct

SEQ ID NO: 2320068 - DNA, 13 bp, Homo sapiens
cccacatgcctgc

SEQ ID NO: 2320069 - DNA, 17 bp, Homo sapiens
cccacatgggacctggc

SEQ ID NO: 2320070 - DNA, 16 bp, Homo sapiens
cccacatgtgacacat

SEQ ID NO: 2320071 - DNA, 13 bp, Homo sapiens
cccacatttgatg

SEQ ID NO: 2320072 - DNA, 16 bp, Homo sapiens
cccaccatatgaattg

SEQ ID NO: 2320073 - DNA, 16 bp, Homo sapiens
cccaccccctgccctg

SEQ ID NO: 2320074 - DNA, 19 bp, Homo sapiens
cccaccccctgccctgcac

SEQ ID NO: 2320075 - DNA, 15 bp, Homo sapiens
cccacccctggaaga

SEQ ID NO: 2320076 - DNA, 19 bp, Homo sapiens
cccaccctcaaaccctgtg

SEQ ID NO: 2320077 - DNA, 12 bp, Homo sapiens
cccaccctgttc

SEQ ID NO: 2320078 - DNA, 15 bp, Homo sapiens
cccaccctgttcctg

SEQ ID NO: 2320079 - DNA, 18 bp, Homo sapiens
cccaccggtccagctggc

SEQ ID NO: 2320080 - DNA, 21 bp, Homo sapiens
cccaccggtccagctggcctg

SEQ ID NO: 2320081 - DNA, 19 bp, Homo sapiens
cccaccgtggaggaggaag

SEQ ID NO: 2320082 - DNA, 21 bp, Homo sapiens
cccacctagaacactaactca

SEQ ID NO: 2320083 - DNA, 16 bp, Homo sapiens
cccacctgttttctga

SEQ ID NO: 2320084 - DNA, 23 bp, Homo sapiens
cccacctgttttctgaaacacac

SEQ ID NO: 2320085 - DNA, 14 bp, Homo sapiens
cccaccttgccagg

SEQ ID NO: 2320086 - DNA, 22 bp, Homo sapiens
cccaccttgccagggcagggtc

SEQ ID NO: 2320087 - DNA, 19 bp, Homo sapiens
cccacctttgggatcagcc

SEQ ID NO: 2320088 - DNA, 21 bp, Homo sapiens
cccacctttgggatcagcctc

SEQ ID NO: 2320089 - DNA, 14 bp, Homo sapiens
cccacgcagaggac

SEQ ID NO: 2320090 - DNA, 13 bp, Homo sapiens
cccacggagacag

SEQ ID NO: 2320091 - DNA, 15 bp, Homo sapiens
cccactccagtccac

SEQ ID NO: 2320092 - DNA, 19 bp, Homo sapiens
cccactcccttgctggccc

SEQ ID NO: 2320093 - DNA, 14 bp, Homo sapiens
cccactctcctagg

SEQ ID NO: 2320094 - DNA, 21 bp, Homo sapiens
cccactctcctaggcattctg

SEQ ID NO: 2320095 - DNA, 15 bp, Homo sapiens
cccactgagaggaca

SEQ ID NO: 2320096 - DNA, 21 bp, Homo sapiens
cccactgtttctcttgagctg

SEQ ID NO: 2320097 - DNA, 22 bp, Homo sapiens
cccactgtttctcttgagctgg

SEQ ID NO: 2320098 - DNA, 23 bp, Homo sapiens
cccactgtttctcttgagctggc

SEQ ID NO: 2320099 - DNA, 21 bp, Homo sapiens
cccagaaagcctctctctccc

SEQ ID NO: 2320100 - DNA, 16 bp, Homo sapiens
cccagacataaaggaa

SEQ ID NO: 2320101 - DNA, 18 bp, Homo sapiens
cccttgcctccccatttc

SEQ ID NO: 2320102 - DNA, 20 bp, Homo sapiens
cccttgcctccccatttccc

SEQ ID NO: 2320103 - DNA, 23 bp, Homo sapiens
cccttgcctccccatttcccatc

SEQ ID NO: 2320104 - DNA, 21 bp, Homo sapiens
cccttgctggccccagccctg

SEQ ID NO: 2320105 - DNA, 23 bp, Homo sapiens
cccttgctggccccagccctgct

SEQ ID NO: 2320106 - DNA, 24 bp, Homo sapiens
cccttgctggccccagccctgctg

SEQ ID NO: 2320107 - DNA, 21 bp, Homo sapiens
cccttggaaatgtctgctggt

SEQ ID NO: 2320108 - DNA, 15 bp, Homo sapiens
cccttgggctctgat

SEQ ID NO: 2320109 - DNA, 12 bp, Homo sapiens
ccctttcccacc

SEQ ID NO: 2320110 - DNA, 14 bp, Homo sapiens
ccctttcccacccc

SEQ ID NO: 2320111 - DNA, 9 bp, Homo sapiens
ccctttcct

SEQ ID NO: 2320112 - DNA, 14 bp, Homo sapiens
ccctttctggctct

SEQ ID NO: 2320113 - DNA, 17 bp, Homo sapiens
ccctttgcccagaaaga

SEQ ID NO: 2320114 - DNA, 20 bp, Homo sapiens
ccctttgggggttgaatagg

SEQ ID NO: 2320115 - DNA, 14 bp, Homo sapiens
cccttttctttgac

SEQ ID NO: 2320116 - DNA, 16 bp, Homo sapiens
ccgaccccaagagttt

SEQ ID NO: 2320117 - DNA, 14 bp, Homo sapiens
ccgacgtcatgtat

SEQ ID NO: 2320118 - DNA, 14 bp, Homo sapiens
ccgactagcaggca

SEQ ID NO: 2320119 - DNA, 22 bp, Homo sapiens
ccgagagaggcgcgtctgcccc

SEQ ID NO: 2320120 - DNA, 16 bp, Homo sapiens
ccgagctactctcttg

SEQ ID NO: 2320121 - DNA, 23 bp, Homo sapiens
ccgagctactctcttgccagcat

SEQ ID NO: 2320122 - DNA, 17 bp, Homo sapiens
ccgagtagaaaatgtga

SEQ ID NO: 2320123 - DNA, 11 bp, Homo sapiens
ccgatgccacc

SEQ ID NO: 2320124 - DNA, 12 bp, Homo sapiens
ccgcacagctca

SEQ ID NO: 2320125 - DNA, 14 bp, Homo sapiens
ccgcatcacctcac

SEQ ID NO: 2320126 - DNA, 16 bp, Homo sapiens
ccgccatggtgtcccg

SEQ ID NO: 2320127 - DNA, 13 bp, Homo sapiens
ccgccccagagtg

SEQ ID NO: 2320128 - DNA, 14 bp, Homo sapiens
ccgccccctcctga

SEQ ID NO: 2320129 - DNA, 21 bp, Homo sapiens
ccgccctgtgtgtgtcccctc

SEQ ID NO: 2320130 - DNA, 18 bp, Homo sapiens
ccgcctctgcccgcagag

SEQ ID NO: 2320131 - DNA, 16 bp, Homo sapiens
ccgcgccgatgccacc

SEQ ID NO: 2320132 - DNA, 15 bp, Homo sapiens
ccgcggagcctgcat

SEQ ID NO: 2320133 - DNA, 18 bp, Homo sapiens
ccgcggggaagctggctt

SEQ ID NO: 2320134 - DNA, 20 bp, Homo sapiens
ccgcggggaagctggctttg

SEQ ID NO: 2320135 - DNA, 21 bp, Homo sapiens
ccgcgtagagagccgggcccc

SEQ ID NO: 2320136 - DNA, 19 bp, Homo sapiens
ccgcttctccccagagctg

SEQ ID NO: 2320137 - DNA, 20 bp, Homo sapiens
ccggaatgccacccacatct

SEQ ID NO: 2320138 - DNA, 17 bp, Homo sapiens
ccggactggtgccctcc

SEQ ID NO: 2320139 - DNA, 19 bp, Homo sapiens
ccggcaagccacaggaagg

SEQ ID NO: 2320140 - DNA, 19 bp, Homo sapiens
ccggcccagatgtgtcccc

SEQ ID NO: 2320141 - DNA, 23 bp, Homo sapiens
ccggccccctccccccagactct

SEQ ID NO: 2320142 - DNA, 22 bp, Homo sapiens
ccggcctgggaaaccctctcca

SEQ ID NO: 2320143 - DNA, 21 bp, Homo sapiens
ccggctccccctccagccaga

SEQ ID NO: 2320144 - DNA, 13 bp, Homo sapiens
ccgggccagggct

SEQ ID NO: 2320145 - DNA, 14 bp, Homo sapiens
ccgggccagggctg

SEQ ID NO: 2320146 - DNA, 14 bp, Homo sapiens
ccgggcccctgggc

SEQ ID NO: 2320147 - DNA, 16 bp, Homo sapiens
ccgggcccctgggctt

SEQ ID NO: 2320148 - DNA, 14 bp, Homo sapiens
ccgggcctcagtgc

SEQ ID NO: 2320149 - DNA, 21 bp, Homo sapiens
ccgggcgcggtggcgggcacc

SEQ ID NO: 2320150 - DNA, 16 bp, Homo sapiens
ccgggctgagggcctg

SEQ ID NO: 2320151 - DNA, 21 bp, Homo sapiens
ccgggctgagggcctgctgga

SEQ ID NO: 2320152 - DNA, 21 bp, Homo sapiens
ccggggtggccacagcgccag

SEQ ID NO: 2320153 - DNA, 21 bp, Homo sapiens
ccggtccagctggcctggaca

SEQ ID NO: 2320154 - DNA, 18 bp, Homo sapiens
ccgtccatatcagaactg

SEQ ID NO: 2320155 - DNA, 21 bp, Homo sapiens
ccgtccatatcagaactgtgc

SEQ ID NO: 2320156 - DNA, 14 bp, Homo sapiens
ccgtctctgtcccg

SEQ ID NO: 2320157 - DNA, 22 bp, Homo sapiens
ccgtcttggggctcgccccacc

SEQ ID NO: 2320158 - DNA, 18 bp, Homo sapiens
ccgtgaaccagagggtgt

SEQ ID NO: 2320159 - DNA, 22 bp, Homo sapiens
ccgtgatttggaagagaggcac

SEQ ID NO: 2320160 - DNA, 21 bp, Homo sapiens
ccgtgcatcccccctgctcag

SEQ ID NO: 2320161 - DNA, 13 bp, Homo sapiens
ccgtgcctggcca

SEQ ID NO: 2320162 - DNA, 13 bp, Homo sapiens
ccgtgcctggcta

SEQ ID NO: 2320163 - DNA, 11 bp, Homo sapiens
ccgtggatgcg

SEQ ID NO: 2320164 - DNA, 17 bp, Homo sapiens
ccgtgtctgtctggcac

SEQ ID NO: 2320165 - DNA, 18 bp, Homo sapiens
ccgttccaccccaagaga

SEQ ID NO: 2320166 - DNA, 20 bp, Homo sapiens
ccgttccaccccaagagaac

SEQ ID NO: 2320167 - DNA, 21 bp, Homo sapiens
cctaacatctgacctggcatc

SEQ ID NO: 2320168 - DNA, 14 bp, Homo sapiens
cctaaccccttcca

SEQ ID NO: 2320169 - DNA, 22 bp, Homo sapiens
cctaagagactgcgttctgcaa

SEQ ID NO: 2320170 - DNA, 14 bp, Homo sapiens
cctaattcaatcct

SEQ ID NO: 2320171 - DNA, 20 bp, Homo sapiens
cctaatttctcctcccttcc

SEQ ID NO: 2320172 - DNA, 23 bp, Homo sapiens
cctaatttctcctcccttccttt

SEQ ID NO: 2320173 - DNA, 13 bp, Homo sapiens
cctacacccctgt

SEQ ID NO: 2320174 - DNA, 22 bp, Homo sapiens
cctaccccttggaaatgtctgc

SEQ ID NO: 2320175 - DNA, 23 bp, Homo sapiens
cctaccccttggaaatgtctgct

SEQ ID NO: 2320176 - DNA, 12 bp, Homo sapiens
cctacctgcttc

SEQ ID NO: 2320177 - DNA, 16 bp, Homo sapiens
cctacgtccaaggtgg

SEQ ID NO: 2320178 - DNA, 15 bp, Homo sapiens
cctactaataaacca

SEQ ID NO: 2320179 - DNA, 16 bp, Homo sapiens
cctactagtcaccaga

SEQ ID NO: 2320180 - DNA, 16 bp, Homo sapiens
cctactccaaaatgtt

SEQ ID NO: 2320181 - DNA, 13 bp, Homo sapiens
cctactccctgca

SEQ ID NO: 2320182 - DNA, 21 bp, Homo sapiens
cctactctccttgagtgtatg

SEQ ID NO: 2320183 - DNA, 11 bp, Homo sapiens
cctactgctgt

SEQ ID NO: 2320184 - DNA, 20 bp, Homo sapiens
cctacttagggaagaaaaag

SEQ ID NO: 2320185 - DNA, 17 bp, Homo sapiens
cctagacaacctttctg

SEQ ID NO: 2320186 - DNA, 13 bp, Homo sapiens
cctagcacagcag

SEQ ID NO: 2320187 - DNA, 21 bp, Homo sapiens
cctagctctggaggtgctgct

SEQ ID NO: 2320188 - DNA, 18 bp, Homo sapiens
cctagctgtcctttttcc

SEQ ID NO: 2320189 - DNA, 19 bp, Homo sapiens
cctagctgtcctttttcct

SEQ ID NO: 2320190 - DNA, 20 bp, Homo sapiens
cctagctgtcctttttcctc

SEQ ID NO: 2320191 - DNA, 17 bp, Homo sapiens
cctagctttagaccctg

SEQ ID NO: 2320192 - DNA, 22 bp, Homo sapiens
cctagctttagaccctgggtgg

SEQ ID NO: 2320193 - DNA, 14 bp, Homo sapiens
cctagtaagaagac

SEQ ID NO: 2320194 - DNA, 22 bp, Homo sapiens
cctatcccaaatgtggaattga

SEQ ID NO: 2320195 - DNA, 14 bp, Homo sapiens
cctatccctctcct

SEQ ID NO: 2320196 - DNA, 16 bp, Homo sapiens
cctatccttggagagc

SEQ ID NO: 2320197 - DNA, 15 bp, Homo sapiens
cctatctcctgacag

SEQ ID NO: 2320198 - DNA, 17 bp, Homo sapiens
cctatgatattttctgt

SEQ ID NO: 2320199 - DNA, 21 bp, Homo sapiens
cctatgcacatatggactctg

SEQ ID NO: 2320200 - DNA, 12 bp, Homo sapiens
cctatgctgtgc

SEQ ID NO: 2320201 - DNA, 20 bp, Homo sapiens
cctcagacgttgcctgagaa

SEQ ID NO: 2320202 - DNA, 15 bp, Homo sapiens
cctcagagcgccagg

SEQ ID NO: 2320203 - DNA, 22 bp, Homo sapiens
cctcagagcgccaggaagccag

SEQ ID NO: 2320204 - DNA, 16 bp, Homo sapiens
cctcagggctcccagg

SEQ ID NO: 2320205 - DNA, 17 bp, Homo sapiens
cctcagggctcccaggg

SEQ ID NO: 2320206 - DNA, 14 bp, Homo sapiens
cctcagggctgtcc

SEQ ID NO: 2320207 - DNA, 17 bp, Homo sapiens
cctcagggctgtcccag

SEQ ID NO: 2320208 - DNA, 22 bp, Homo sapiens
cctcagggctgtcccagccccg

SEQ ID NO: 2320209 - DNA, 18 bp, Homo sapiens
cctcaggtgctgtccatg

SEQ ID NO: 2320210 - DNA, 21 bp, Homo sapiens
cctcagtagaaaaggatctaa

SEQ ID NO: 2320211 - DNA, 21 bp, Homo sapiens
cctcagtatgtgggggcttca

SEQ ID NO: 2320212 - DNA, 22 bp, Homo sapiens
cctcagtatgtgggggcttcat

SEQ ID NO: 2320213 - DNA, 14 bp, Homo sapiens
cctcagttccttca

SEQ ID NO: 2320214 - DNA, 15 bp, Homo sapiens
cctcagttttccttc

SEQ ID NO: 2320215 - DNA, 22 bp, Homo sapiens
cctcatagtaataagatggctg

SEQ ID NO: 2320216 - DNA, 14 bp, Homo sapiens
cctcatgcccaccc

SEQ ID NO: 2320217 - DNA, 15 bp, Homo sapiens
cctcatgcccacccc

SEQ ID NO: 2320218 - DNA, 21 bp, Homo sapiens
cctcatgcccaccccctgccc

SEQ ID NO: 2320219 - DNA, 16 bp, Homo sapiens
cctcatgcccagctct

SEQ ID NO: 2320220 - DNA, 17 bp, Homo sapiens
cctcatgcccagctctc

SEQ ID NO: 2320221 - DNA, 16 bp, Homo sapiens
cctcatgggtcctagc

SEQ ID NO: 2320222 - DNA, 23 bp, Homo sapiens
cctccaagcacagagcctggccc

SEQ ID NO: 2320223 - DNA, 14 bp, Homo sapiens
cctccaagcatttc

SEQ ID NO: 2320224 - DNA, 18 bp, Homo sapiens
cctccaagcatttcatga

SEQ ID NO: 2320225 - DNA, 20 bp, Homo sapiens
cctccacagcgagggcagct

SEQ ID NO: 2320226 - DNA, 21 bp, Homo sapiens
cctccacagcgagggcagctg

SEQ ID NO: 2320227 - DNA, 10 bp, Homo sapiens
cctccaccca

SEQ ID NO: 2320228 - DNA, 13 bp, Homo sapiens
cctccacctcaag

SEQ ID NO: 2320229 - DNA, 14 bp, Homo sapiens
cctccactccacct

SEQ ID NO: 2320230 - DNA, 12 bp, Homo sapiens
cctccaggagct

SEQ ID NO: 2320231 - DNA, 15 bp, Homo sapiens
cctccaggcctgcct

SEQ ID NO: 2320232 - DNA, 16 bp, Homo sapiens
cctccaggcctgcctc

SEQ ID NO: 2320233 - DNA, 19 bp, Homo sapiens
cctccaggcctgcctccca

SEQ ID NO: 2320234 - DNA, 20 bp, Homo sapiens
cctccaggcctgcctcccac

SEQ ID NO: 2320235 - DNA, 18 bp, Homo sapiens
cctccagggaaggtggcc

SEQ ID NO: 2320236 - DNA, 14 bp, Homo sapiens
cctccatccatcct

SEQ ID NO: 2320237 - DNA, 18 bp, Homo sapiens
cctccattgggcacagtc

SEQ ID NO: 2320238 - DNA, 17 bp, Homo sapiens
cctcccaggactctgac

SEQ ID NO: 2320239 - DNA, 22 bp, Homo sapiens
cctcccaggactctgaccccag

SEQ ID NO: 2320240 - DNA, 12 bp, Homo sapiens
cctccccagaat

SEQ ID NO: 2320241 - DNA, 21 bp, Homo sapiens
cctccccatctgtccagctgg

SEQ ID NO: 2320242 - DNA, 21 bp, Homo sapiens
cctccccatttcccatctgca

SEQ ID NO: 2320243 - DNA, 22 bp, Homo sapiens
cctccccatttcccatctgcac

SEQ ID NO: 2320244 - DNA, 14 bp, Homo sapiens
cctccccccagact

SEQ ID NO: 2320245 - DNA, 14 bp, Homo sapiens
cctccccctgccag

SEQ ID NO: 2320246 - DNA, 21 bp, Homo sapiens
cctcccctccggactggtgcc

SEQ ID NO: 2320247 - DNA, 16 bp, Homo sapiens
cctcccctctcagaac

SEQ ID NO: 2320248 - DNA, 13 bp, Homo sapiens
cctccctctctca

SEQ ID NO: 2320249 - DNA, 12 bp, Homo sapiens
cctccctgcctg

SEQ ID NO: 2320250 - DNA, 17 bp, Homo sapiens
cctccctgggggcccca

SEQ ID NO: 2320251 - DNA, 16 bp, Homo sapiens
cctcccttccttttcc

SEQ ID NO: 2320252 - DNA, 22 bp, Homo sapiens
cctcccttccttttccctgctt

SEQ ID NO: 2320253 - DNA, 13 bp, Homo sapiens
cctcccttgcctt

SEQ ID NO: 2320254 - DNA, 16 bp, Homo sapiens
cctccggactggtgcc

SEQ ID NO: 2320255 - DNA, 15 bp, Homo sapiens
cctccgtccatatca

SEQ ID NO: 2320256 - DNA, 19 bp, Homo sapiens
cctcctagctctcccagtg

SEQ ID NO: 2320257 - DNA, 12 bp, Homo sapiens
cctcctccaggg

SEQ ID NO: 2320258 - DNA, 15 bp, Homo sapiens
cctcctcccagggcc

SEQ ID NO: 2320259 - DNA, 14 bp, Homo sapiens
cctcctctgcctac

SEQ ID NO: 2320260 - DNA, 15 bp, Homo sapiens
cctcctctgcctaca

SEQ ID NO: 2320261 - DNA, 20 bp, Homo sapiens
cctcctctggacggcaggct

SEQ ID NO: 2320262 - DNA, 14 bp, Homo sapiens
cctcctgcctcagc

SEQ ID NO: 2320263 - DNA, 17 bp, Homo sapiens
cctcctgcctcagcctt

SEQ ID NO: 2320264 - DNA, 12 bp, Homo sapiens
cctcctggacac

SEQ ID NO: 2320265 - DNA, 11 bp, Homo sapiens
cctcctgtgcc

SEQ ID NO: 2320266 - DNA, 17 bp, Homo sapiens
cctcctgtgcctggccc

SEQ ID NO: 2320267 - DNA, 23 bp, Homo sapiens
cctcctgtgcctggccccagcct

SEQ ID NO: 2320268 - DNA, 17 bp, Homo sapiens
cctccttctgagctcct

SEQ ID NO: 2320269 - DNA, 22 bp, Homo sapiens
cctccttctgagctcctgtccc

SEQ ID NO: 2320270 - DNA, 14 bp, Homo sapiens
cctcctttccctta

SEQ ID NO: 2320271 - DNA, 15 bp, Homo sapiens
cctccttttcacttt

SEQ ID NO: 2320272 - DNA, 17 bp, Homo sapiens
cctccttttcttcaccc

SEQ ID NO: 2320273 - DNA, 17 bp, Homo sapiens
cctcgcgcttgctggcc

SEQ ID NO: 2320274 - DNA, 18 bp, Homo sapiens
cctcgctcaccgctggcc

SEQ ID NO: 2320275 - DNA, 19 bp, Homo sapiens
cctcgctcaccgctggccc

SEQ ID NO: 2320276 - DNA, 20 bp, Homo sapiens
cctcgctcaccgctggccct

SEQ ID NO: 2320277 - DNA, 14 bp, Homo sapiens
cctcgtcccatcca

SEQ ID NO: 2320278 - DNA, 22 bp, Homo sapiens
cctcgtcccatccagctaccac

SEQ ID NO: 2320279 - DNA, 14 bp, Homo sapiens
cctctaatgagact

SEQ ID NO: 2320280 - DNA, 15 bp, Homo sapiens
cctctagaagccaag

SEQ ID NO: 2320281 - DNA, 19 bp, Homo sapiens
cctctcagaacatactgat

SEQ ID NO: 2320282 - DNA, 20 bp, Homo sapiens
cctctcagaacatactgatt

SEQ ID NO: 2320283 - DNA, 22 bp, Homo sapiens
cctctccaaccactgtgccact

SEQ ID NO: 2320284 - DNA, 12 bp, Homo sapiens
cctctccactgc

SEQ ID NO: 2320285 - DNA, 14 bp, Homo sapiens
cctctccactgctg

SEQ ID NO: 2320286 - DNA, 16 bp, Homo sapiens
cctctccactgctgga

SEQ ID NO: 2320287 - DNA, 18 bp, Homo sapiens
cctctccactgctggaca

SEQ ID NO: 2320288 - DNA, 19 bp, Homo sapiens
cctctccactgctggacat

SEQ ID NO: 2320289 - DNA, 15 bp, Homo sapiens
cctctcccaccctct

SEQ ID NO: 2320290 - DNA, 13 bp, Homo sapiens
cctctcccccagg

SEQ ID NO: 2320291 - DNA, 18 bp, Homo sapiens
cctctccccctcctccag

SEQ ID NO: 2320292 - DNA, 20 bp, Homo sapiens
cctctccccctcctccaggg

SEQ ID NO: 2320293 - DNA, 22 bp, Homo sapiens
cctctccccctcctccagggaa

SEQ ID NO: 2320294 - DNA, 11 bp, Homo sapiens
cctctccttct

SEQ ID NO: 2320295 - DNA, 16 bp, Homo sapiens
cctctctgatgtccca

SEQ ID NO: 2320296 - DNA, 18 bp, Homo sapiens
cctctgcccctcccccag

SEQ ID NO: 2320297 - DNA, 18 bp, Homo sapiens
cctctgcccgcagagccc

SEQ ID NO: 2320298 - DNA, 14 bp, Homo sapiens
catttcccatctgc

SEQ ID NO: 2320299 - DNA, 17 bp, Homo sapiens
catttcccatctgcacc

SEQ ID NO: 2320300 - DNA, 13 bp, Homo sapiens
catttctctttaa

SEQ ID NO: 2320301 - DNA, 21 bp, Homo sapiens
catttctgaggtgcactggga

SEQ ID NO: 2320302 - DNA, 21 bp, Homo sapiens
catttgacacaaagcttctaa

SEQ ID NO: 2320303 - DNA, 15 bp, Homo sapiens
catttgattaataaa

SEQ ID NO: 2320304 - DNA, 17 bp, Homo sapiens
catttgattaataaaat

SEQ ID NO: 2320305 - DNA, 20 bp, Homo sapiens
catttgattaataaaatatc

SEQ ID NO: 2320306 - DNA, 21 bp, Homo sapiens
catttgcaataacagctgcaa

SEQ ID NO: 2320307 - DNA, 18 bp, Homo sapiens
catttggtctcaggcagc

SEQ ID NO: 2320308 - DNA, 23 bp, Homo sapiens
catttggttatgttgataaacca

SEQ ID NO: 2320309 - DNA, 19 bp, Homo sapiens
catttgtaagtgtaaaaaa

SEQ ID NO: 2320310 - DNA, 19 bp, Homo sapiens
catttgtatgtcaaagctt

SEQ ID NO: 2320311 - DNA, 12 bp, Homo sapiens
catttgtcccag

SEQ ID NO: 2320312 - DNA, 18 bp, Homo sapiens
cattttaagtttgtagta

SEQ ID NO: 2320313 - DNA, 19 bp, Homo sapiens
cattttaagtttgtagtaa

SEQ ID NO: 2320314 - DNA, 18 bp, Homo sapiens
cattttactgtatatttt

SEQ ID NO: 2320315 - DNA, 23 bp, Homo sapiens
cattttagaaactacaaatatag

SEQ ID NO: 2320316 - DNA, 13 bp, Homo sapiens
cattttataatga

SEQ ID NO: 2320317 - DNA, 23 bp, Homo sapiens
cattttattaagctttttggaat

SEQ ID NO: 2320318 - DNA, 16 bp, Homo sapiens
cattttcctcctctgc

SEQ ID NO: 2320319 - DNA, 12 bp, Homo sapiens
cattttcctgag

SEQ ID NO: 2320320 - DNA, 12 bp, Homo sapiens
cattttctaaat

SEQ ID NO: 2320321 - DNA, 18 bp, Homo sapiens
cattttctaaataaaaat

SEQ ID NO: 2320322 - DNA, 17 bp, Homo sapiens
cattttcttttttaacc

SEQ ID NO: 2320323 - DNA, 12 bp, Homo sapiens
cattttgtgaat

SEQ ID NO: 2320324 - DNA, 16 bp, Homo sapiens
cattttgtgaatggat

SEQ ID NO: 2320325 - DNA, 21 bp, Homo sapiens
cattttgtgaatggattggat

SEQ ID NO: 2320326 - DNA, 16 bp, Homo sapiens
cattttttaatttact

SEQ ID NO: 2320327 - DNA, 15 bp, Homo sapiens
cattttttaggaaat

SEQ ID NO: 2320328 - DNA, 14 bp, Homo sapiens
catttttttgcatg

SEQ ID NO: 2320329 - DNA, 16 bp, Homo sapiens
ccaaaagattgctgaa

SEQ ID NO: 2320330 - DNA, 19 bp, Homo sapiens
ccaaaagattgctgaaatt

SEQ ID NO: 2320331 - DNA, 23 bp, Homo sapiens
ccaaaagattgctgaaattttat

SEQ ID NO: 2320332 - DNA, 15 bp, Homo sapiens
ccaaaagcgccctca

SEQ ID NO: 2320333 - DNA, 12 bp, Homo sapiens
ccaaaatcaaga

SEQ ID NO: 2320334 - DNA, 13 bp, Homo sapiens
ccaaacactcagt

SEQ ID NO: 2320335 - DNA, 20 bp, Homo sapiens
ccaaagaggctgcccctctc

SEQ ID NO: 2320336 - DNA, 21 bp, Homo sapiens
ccaaagaggctgcccctctca

SEQ ID NO: 2320337 - DNA, 22 bp, Homo sapiens
ccaaagaggctgcccctctcac

SEQ ID NO: 2320338 - DNA, 23 bp, Homo sapiens
ccaaagaggctgcccctctcacc

SEQ ID NO: 2320339 - DNA, 23 bp, Homo sapiens
ccaaagcctagacaacctttctg

SEQ ID NO: 2320340 - DNA, 15 bp, Homo sapiens
ccaaaggacgcctgc

SEQ ID NO: 2320341 - DNA, 22 bp, Homo sapiens
ccaaagtacagaatttgaatta

SEQ ID NO: 2320342 - DNA, 12 bp, Homo sapiens
ccaaataaataa

SEQ ID NO: 2320343 - DNA, 16 bp, Homo sapiens
ccaaatataagacatt

SEQ ID NO: 2320344 - DNA, 18 bp, Homo sapiens
ccaaatggagaagctgca

SEQ ID NO: 2320345 - DNA, 19 bp, Homo sapiens
ccaaatggagaagctgcag

SEQ ID NO: 2320346 - DNA, 20 bp, Homo sapiens
ccaaatggagaagctgcagg

SEQ ID NO: 2320347 - DNA, 21 bp, Homo sapiens
ccaaatggagaagctgcaggc

SEQ ID NO: 2320348 - DNA, 16 bp, Homo sapiens
ccaaatggccatttta

SEQ ID NO: 2320349 - DNA, 13 bp, Homo sapiens
ccaaatgtccctc

SEQ ID NO: 2320350 - DNA, 14 bp, Homo sapiens
ccaaatgtttattt

SEQ ID NO: 2320351 - DNA, 22 bp, Homo sapiens
ccaacaacaacgaggttcctat

SEQ ID NO: 2320352 - DNA, 17 bp, Homo sapiens
ccaacaactctgccttt

SEQ ID NO: 2320353 - DNA, 17 bp, Homo sapiens
ccaaccactgtgccact

SEQ ID NO: 2320354 - DNA, 20 bp, Homo sapiens
ccaacctcagggctcccagg

SEQ ID NO: 2320355 - DNA, 18 bp, Homo sapiens
ccaacctctttttcctcc

SEQ ID NO: 2320356 - DNA, 21 bp, Homo sapiens
ccaacctctttttcctcctgg

SEQ ID NO: 2320357 - DNA, 15 bp, Homo sapiens
ccaacctgctctcct

SEQ ID NO: 2320358 - DNA, 14 bp, Homo sapiens
ccaacctgctctgt

SEQ ID NO: 2320359 - DNA, 17 bp, Homo sapiens
ccaactagctgggacta

SEQ ID NO: 2320360 - DNA, 15 bp, Homo sapiens
ccaactccagcaact

SEQ ID NO: 2320361 - DNA, 23 bp, Homo sapiens
ccaagagaactcgcgctcagtaa

SEQ ID NO: 2320362 - DNA, 16 bp, Homo sapiens
ccaagcaacatttgta

SEQ ID NO: 2320363 - DNA, 14 bp, Homo sapiens
ccaagcatttcatg

SEQ ID NO: 2320364 - DNA, 11 bp, Homo sapiens
ccaagcttccc

SEQ ID NO: 2320365 - DNA, 12 bp, Homo sapiens
ccaagcttccct

SEQ ID NO: 2320366 - DNA, 13 bp, Homo sapiens
ccaagcttccctc

SEQ ID NO: 2320367 - DNA, 15 bp, Homo sapiens
ccaagctttaaatta

SEQ ID NO: 2320368 - DNA, 22 bp, Homo sapiens
ccaaggactgagcaccctctgg

SEQ ID NO: 2320369 - DNA, 13 bp, Homo sapiens
ccaaggctgccag

SEQ ID NO: 2320370 - DNA, 14 bp, Homo sapiens
ccaaggctgccaga

SEQ ID NO: 2320371 - DNA, 14 bp, Homo sapiens
ccaaggctggcagg

SEQ ID NO: 2320372 - DNA, 18 bp, Homo sapiens
ccaagggttgagagccag

SEQ ID NO: 2320373 - DNA, 15 bp, Homo sapiens
ccaaggtgatgttgt

SEQ ID NO: 2320374 - DNA, 20 bp, Homo sapiens
ccaagtccaacctgcctgtg

SEQ ID NO: 2320375 - DNA, 20 bp, Homo sapiens
ccaagtggaccttgagacca

SEQ ID NO: 2320376 - DNA, 15 bp, Homo sapiens
ccaagtggggtgctg

SEQ ID NO: 2320377 - DNA, 16 bp, Homo sapiens
ccaagtggggtgctgg

SEQ ID NO: 2320378 - DNA, 12 bp, Homo sapiens
ccaagtgtgcta

SEQ ID NO: 2320379 - DNA, 22 bp, Homo sapiens
ccaagttgtgcttgagccagga

SEQ ID NO: 2320380 - DNA, 18 bp, Homo sapiens
ccaatagggctgagctct

SEQ ID NO: 2320381 - DNA, 17 bp, Homo sapiens
ccaatcggactgccaaa

SEQ ID NO: 2320382 - DNA, 19 bp, Homo sapiens
ccaatcggactgccaaatt

SEQ ID NO: 2320383 - DNA, 12 bp, Homo sapiens
ccaatgaataat

SEQ ID NO: 2320384 - DNA, 18 bp, Homo sapiens
ccaatgccccactggcag

SEQ ID NO: 2320385 - DNA, 23 bp, Homo sapiens
ccaatgtttcaagaggagccccc

SEQ ID NO: 2320386 - DNA, 12 bp, Homo sapiens
ccaatttcctct

SEQ ID NO: 2320387 - DNA, 21 bp, Homo sapiens
ccaatttcctctccactgctg

SEQ ID NO: 2320388 - DNA, 23 bp, Homo sapiens
ccaatttcctctccactgctgga

SEQ ID NO: 2320389 - DNA, 13 bp, Homo sapiens
ccacaagctgcac

SEQ ID NO: 2320390 - DNA, 15 bp, Homo sapiens
ccacaagctgcactg

SEQ ID NO: 2320391 - DNA, 21 bp, Homo sapiens
ccacaagctgcactgtgaacc

SEQ ID NO: 2320392 - DNA, 22 bp, Homo sapiens
ccacacagtgctcaaggccagc

SEQ ID NO: 2320393 - DNA, 14 bp, Homo sapiens
ccacacccagggga

SEQ ID NO: 2320394 - DNA, 23 bp, Homo sapiens
ccacactcccaaggttggagccc

SEQ ID NO: 2320395 - DNA, 16 bp, Homo sapiens
ccacactctccatcac

SEQ ID NO: 2320396 - DNA, 14 bp, Homo sapiens
ccacactgatggct

SEQ ID NO: 2320397 - DNA, 12 bp, Homo sapiens
ccacacttcttg

SEQ ID NO: 2320398 - DNA, 22 bp, Homo sapiens
ccacacttcttgaaacagcctg

SEQ ID NO: 2320399 - DNA, 23 bp, Homo sapiens
ccacacttcttgaaacagcctgg

SEQ ID NO: 2320400 - DNA, 22 bp, Homo sapiens
ccacagcaagtacagcggctcc

SEQ ID NO: 2320401 - DNA, 23 bp, Homo sapiens
ccacagcaagtacagcggctccc

SEQ ID NO: 2320402 - DNA, 15 bp, Homo sapiens
ccacagcgagggcag

SEQ ID NO: 2320403 - DNA, 18 bp, Homo sapiens
ccacagcgagggcagctg

SEQ ID NO: 2320404 - DNA, 20 bp, Homo sapiens
ccacagcgagggcagctgct

SEQ ID NO: 2320405 - DNA, 20 bp, Homo sapiens
atcatgaggtcaggagatca

SEQ ID NO: 2320406 - DNA, 19 bp, Homo sapiens
atcatggtgtaataagaca

SEQ ID NO: 2320407 - DNA, 21 bp, Homo sapiens
atcatggtgtaataagacata

SEQ ID NO: 2320408 - DNA, 23 bp, Homo sapiens
atcatggtgtaataagacataac

SEQ ID NO: 2320409 - DNA, 12 bp, Homo sapiens
atcattaaaaat

SEQ ID NO: 2320410 - DNA, 14 bp, Homo sapiens
atcattaaaaatta

SEQ ID NO: 2320411 - DNA, 16 bp, Homo sapiens
atcattcagaaatgtt

SEQ ID NO: 2320412 - DNA, 18 bp, Homo sapiens
atcattcttactaaaaag

SEQ ID NO: 2320413 - DNA, 14 bp, Homo sapiens
atccaactccagca

SEQ ID NO: 2320414 - DNA, 15 bp, Homo sapiens
atccaactccagcaa

SEQ ID NO: 2320415 - DNA, 12 bp, Homo sapiens
atccaagcctcc

SEQ ID NO: 2320416 - DNA, 14 bp, Homo sapiens
atccaagcctccac

SEQ ID NO: 2320417 - DNA, 17 bp, Homo sapiens
atccaagcctccacagc

SEQ ID NO: 2320418 - DNA, 18 bp, Homo sapiens
atccaaggaaacatttta

SEQ ID NO: 2320419 - DNA, 22 bp, Homo sapiens
atccaagggttgagagccagtg

SEQ ID NO: 2320420 - DNA, 21 bp, Homo sapiens
atccaattcccaccactaaaa

SEQ ID NO: 2320421 - DNA, 20 bp, Homo sapiens
atccacccaaccctatctcc

SEQ ID NO: 2320422 - DNA, 15 bp, Homo sapiens
atccactttggggga

SEQ ID NO: 2320423 - DNA, 21 bp, Homo sapiens
atccagtgatccttacaagtt

SEQ ID NO: 2320424 - DNA, 19 bp, Homo sapiens
atccagttataagaagaag

SEQ ID NO: 2320425 - DNA, 14 bp, Homo sapiens
atccatccctccat

SEQ ID NO: 2320426 - DNA, 20 bp, Homo sapiens
atccatgacctagttttcca

SEQ ID NO: 2320427 - DNA, 21 bp, Homo sapiens
atccatgacctagttttccat

SEQ ID NO: 2320428 - DNA, 18 bp, Homo sapiens
atcccaacctctttttcc

SEQ ID NO: 2320429 - DNA, 14 bp, Homo sapiens
atcccacccacatg

SEQ ID NO: 2320430 - DNA, 18 bp, Homo sapiens
atcccacccacatgtgac

SEQ ID NO: 2320431 - DNA, 14 bp, Homo sapiens
atcccagctgccta

SEQ ID NO: 2320432 - DNA, 21 bp, Homo sapiens
atcccatcgtctcggccttca

SEQ ID NO: 2320433 - DNA, 13 bp, Homo sapiens
atccccatctccc

SEQ ID NO: 2320434 - DNA, 15 bp, Homo sapiens
atccccatctccctg

SEQ ID NO: 2320435 - DNA, 19 bp, Homo sapiens
atccccatctccctgcctg

SEQ ID NO: 2320436 - DNA, 20 bp, Homo sapiens
atccccatctccctgcctgg

SEQ ID NO: 2320437 - DNA, 17 bp, Homo sapiens
atccccgcctggccagg

SEQ ID NO: 2320438 - DNA, 21 bp, Homo sapiens
atccccgcctggccaggagca

SEQ ID NO: 2320439 - DNA, 19 bp, Homo sapiens
atccctccattcatccttc

SEQ ID NO: 2320440 - DNA, 15 bp, Homo sapiens
atccctctcctaact

SEQ ID NO: 2320441 - DNA, 20 bp, Homo sapiens
atcccttcccacatgcctgc

SEQ ID NO: 2320442 - DNA, 21 bp, Homo sapiens
atcctaagatgtgttcttatt

SEQ ID NO: 2320443 - DNA, 23 bp, Homo sapiens
atcctaatttctcctcccttcct

SEQ ID NO: 2320444 - DNA, 17 bp, Homo sapiens
atcctactaataaacca

SEQ ID NO: 2320445 - DNA, 19 bp, Homo sapiens
atcctataagcttaaatag

SEQ ID NO: 2320446 - DNA, 18 bp, Homo sapiens
atcctcaaatgcggggtg

SEQ ID NO: 2320447 - DNA, 20 bp, Homo sapiens
atcctcaggtagtactggga

SEQ ID NO: 2320448 - DNA, 14 bp, Homo sapiens
atcctccctccacc

SEQ ID NO: 2320449 - DNA, 18 bp, Homo sapiens
atcctccctccacctcaa

SEQ ID NO: 2320450 - DNA, 19 bp, Homo sapiens
atcctccctccacctcaag

SEQ ID NO: 2320451 - DNA, 20 bp, Homo sapiens
atcctccctccacctcaaga

SEQ ID NO: 2320452 - DNA, 13 bp, Homo sapiens
atcctcctgcctc

SEQ ID NO: 2320453 - DNA, 19 bp, Homo sapiens
atcctcctgcctcagcctt

SEQ ID NO: 2320454 - DNA, 17 bp, Homo sapiens
atcctctccccctcctc

SEQ ID NO: 2320455 - DNA, 20 bp, Homo sapiens
atcctctccccctcctccag

SEQ ID NO: 2320456 - DNA, 21 bp, Homo sapiens
atcctctccccctcctccagg

SEQ ID NO: 2320457 - DNA, 13 bp, Homo sapiens
atcctgaagagca

SEQ ID NO: 2320458 - DNA, 12 bp, Homo sapiens
atcctgagccat

SEQ ID NO: 2320459 - DNA, 15 bp, Homo sapiens
atcctgcagggcttc

SEQ ID NO: 2320460 - DNA, 16 bp, Homo sapiens
atcctggcagcccaga

SEQ ID NO: 2320461 - DNA, 20 bp, Homo sapiens
atcctggcagcccagagact

SEQ ID NO: 2320462 - DNA, 18 bp, Homo sapiens
atccttagaggtcctctg

SEQ ID NO: 2320463 - DNA, 21 bp, Homo sapiens
atccttagaggtcctctggag

SEQ ID NO: 2320464 - DNA, 18 bp, Homo sapiens
atccttcagcacaggaat

SEQ ID NO: 2320465 - DNA, 13 bp, Homo sapiens
atccttccatcca

SEQ ID NO: 2320466 - DNA, 22 bp, Homo sapiens
atccttgatgcaagtgcaacct

SEQ ID NO: 2320467 - DNA, 15 bp, Homo sapiens
atccttggagagcag

SEQ ID NO: 2320468 - DNA, 19 bp, Homo sapiens
atccttggagagcagctgg

SEQ ID NO: 2320469 - DNA, 17 bp, Homo sapiens
atccttgggggctccca

SEQ ID NO: 2320470 - DNA, 18 bp, Homo sapiens
atccttgggggctcccag

SEQ ID NO: 2320471 - DNA, 19 bp, Homo sapiens
atccttgtgttcagctctt

SEQ ID NO: 2320472 - DNA, 19 bp, Homo sapiens
atcgaaaagttattttgta

SEQ ID NO: 2320473 - DNA, 17 bp, Homo sapiens
atcgaaataacaatgtt

SEQ ID NO: 2320474 - DNA, 20 bp, Homo sapiens
atcgaaataacaatgttaag

SEQ ID NO: 2320475 - DNA, 16 bp, Homo sapiens
atcgagaccatcctgg

SEQ ID NO: 2320476 - DNA, 17 bp, Homo sapiens
atcgagaccatcctggc

SEQ ID NO: 2320477 - DNA, 20 bp, Homo sapiens
atcgccaggactggtgaata

SEQ ID NO: 2320478 - DNA, 15 bp, Homo sapiens
atcgccctcctttcc

SEQ ID NO: 2320479 - DNA, 17 bp, Homo sapiens
atcgccctcctttccct

SEQ ID NO: 2320480 - DNA, 22 bp, Homo sapiens
atcgctcctgcagccccagccc

SEQ ID NO: 2320481 - DNA, 21 bp, Homo sapiens
atcggccatcaagggaagaac

SEQ ID NO: 2320482 - DNA, 18 bp, Homo sapiens
atcggtgaaactaacaga

SEQ ID NO: 2320483 - DNA, 17 bp, Homo sapiens
catatgaattgtacaga

SEQ ID NO: 2320484 - DNA, 23 bp, Homo sapiens
catatgagcctgccctcactccc

SEQ ID NO: 2320485 - DNA, 21 bp, Homo sapiens
catatgcaccttgtgtctgta

SEQ ID NO: 2320486 - DNA, 14 bp, Homo sapiens
catatgcagaaata

SEQ ID NO: 2320487 - DNA, 20 bp, Homo sapiens
catatgcagaaatagacaaa

SEQ ID NO: 2320488 - DNA, 20 bp, Homo sapiens
catattaggaaaatatgggt

SEQ ID NO: 2320489 - DNA, 21 bp, Homo sapiens
catattataaaggataaagaa

SEQ ID NO: 2320490 - DNA, 22 bp, Homo sapiens
catattataaaggataaagaag

SEQ ID NO: 2320491 - DNA, 21 bp, Homo sapiens
catatttgatttctaattgta

SEQ ID NO: 2320492 - DNA, 22 bp, Homo sapiens
catatttgatttctaattgtaa

SEQ ID NO: 2320493 - DNA, 22 bp, Homo sapiens
catcaaagcagaagtctggctt

SEQ ID NO: 2320494 - DNA, 23 bp, Homo sapiens
catcaaagcagaagtctggcttt

SEQ ID NO: 2320495 - DNA, 16 bp, Homo sapiens
catcaacaagatttcc

SEQ ID NO: 2320496 - DNA, 14 bp, Homo sapiens
catcaccctcttcc

SEQ ID NO: 2320497 - DNA, 14 bp, Homo sapiens
catcaccgctgggt

SEQ ID NO: 2320498 - DNA, 16 bp, Homo sapiens
catcaccgctgggtgg

SEQ ID NO: 2320499 - DNA, 12 bp, Homo sapiens
catcactgtatc

SEQ ID NO: 2320500 - DNA, 20 bp, Homo sapiens
catcagaacctcaattgaca

SEQ ID NO: 2320501 - DNA, 20 bp, Homo sapiens
catcatgcggtgggtgctgc

SEQ ID NO: 2320502 - DNA, 14 bp, Homo sapiens
catcatttcaggag

SEQ ID NO: 2320503 - DNA, 16 bp, Homo sapiens
catccaactccagcaa

SEQ ID NO: 2320504 - DNA, 18 bp, Homo sapiens
catccaactccagcaact

SEQ ID NO: 2320505 - DNA, 15 bp, Homo sapiens
catccaccttccctt

SEQ ID NO: 2320506 - DNA, 20 bp, Homo sapiens
catccagatgtgtgcaatgt

SEQ ID NO: 2320507 - DNA, 18 bp, Homo sapiens
catccagctaccaccacg

SEQ ID NO: 2320508 - DNA, 19 bp, Homo sapiens
catccattacctccatcca

SEQ ID NO: 2320509 - DNA, 18 bp, Homo sapiens
catcccaaccaggcacct

SEQ ID NO: 2320510 - DNA, 21 bp, Homo sapiens
catcccaacctctttttcctc

SEQ ID NO: 2320511 - DNA, 18 bp, Homo sapiens
catcccagtttctcagaa

SEQ ID NO: 2320512 - DNA, 23 bp, Homo sapiens
catcccgggcctcagtgccccat

SEQ ID NO: 2320513 - DNA, 14 bp, Homo sapiens
catccctccattca

SEQ ID NO: 2320514 - DNA, 23 bp, Homo sapiens
catccctgagacagggagggaag

SEQ ID NO: 2320515 - DNA, 16 bp, Homo sapiens
catccctttgcccaga

SEQ ID NO: 2320516 - DNA, 14 bp, Homo sapiens
catcctatgcttaa

SEQ ID NO: 2320517 - DNA, 17 bp, Homo sapiens
catcctatgcttaataa

SEQ ID NO: 2320518 - DNA, 21 bp, Homo sapiens
catcctcaaacgacagaggag

SEQ ID NO: 2320519 - DNA, 19 bp, Homo sapiens
catcctgaccaagactgag

SEQ ID NO: 2320520 - DNA, 14 bp, Homo sapiens
catccttccatcca

SEQ ID NO: 2320521 - DNA, 14 bp, Homo sapiens
catccttgtctttt

SEQ ID NO: 2320522 - DNA, 20 bp, Homo sapiens
catccttgtcttttgagcta

SEQ ID NO: 2320523 - DNA, 14 bp, Homo sapiens
catctaattctgat

SEQ ID NO: 2320524 - DNA, 16 bp, Homo sapiens
catctaattctgattc

SEQ ID NO: 2320525 - DNA, 17 bp, Homo sapiens
catctccagcatgtaac

SEQ ID NO: 2320526 - DNA, 19 bp, Homo sapiens
catctcccaaggctgccag

SEQ ID NO: 2320527 - DNA, 20 bp, Homo sapiens
catctcccaaggctgccaga

SEQ ID NO: 2320528 - DNA, 17 bp, Homo sapiens
catctcccctcctggcg

SEQ ID NO: 2320529 - DNA, 17 bp, Homo sapiens
catctccctgcctggcc

SEQ ID NO: 2320530 - DNA, 14 bp, Homo sapiens
catctcgctccctc

SEQ ID NO: 2320531 - DNA, 12 bp, Homo sapiens
catctctttaga

SEQ ID NO: 2320532 - DNA, 12 bp, Homo sapiens
catctgcaaaag

SEQ ID NO: 2320533 - DNA, 20 bp, Homo sapiens
catctgcaaaaggcctcttg

SEQ ID NO: 2320534 - DNA, 16 bp, Homo sapiens
catctgcaccccttct

SEQ ID NO: 2320535 - DNA, 22 bp, Homo sapiens
catctgcaccccttctctcctc

SEQ ID NO: 2320536 - DNA, 18 bp, Homo sapiens
catctgccttaaaaccaa

SEQ ID NO: 2320537 - DNA, 17 bp, Homo sapiens
catctgtaagagcttgc

SEQ ID NO: 2320538 - DNA, 15 bp, Homo sapiens
catctgtcccccttt

SEQ ID NO: 2320539 - DNA, 17 bp, Homo sapiens
catcttagacctccaca

SEQ ID NO: 2320540 - DNA, 13 bp, Homo sapiens
catcttcaatatg

SEQ ID NO: 2320541 - DNA, 14 bp, Homo sapiens
catcttcacttcta

SEQ ID NO: 2320542 - DNA, 13 bp, Homo sapiens
catcttcctgtgt

SEQ ID NO: 2320543 - DNA, 15 bp, Homo sapiens
catcttcctgtgtcc

SEQ ID NO: 2320544 - DNA, 14 bp, Homo sapiens
catcttcgggacca

SEQ ID NO: 2320545 - DNA, 17 bp, Homo sapiens
catctttattgaaattc

SEQ ID NO: 2320546 - DNA, 14 bp, Homo sapiens
catctttccatcca

SEQ ID NO: 2320547 - DNA, 21 bp, Homo sapiens
catcttttctaatcacagtgt

SEQ ID NO: 2320548 - DNA, 22 bp, Homo sapiens
catcttttctaatcacagtgtt

SEQ ID NO: 2320549 - DNA, 21 bp, Homo sapiens
catgaaaaacacggcagctgt

SEQ ID NO: 2320550 - DNA, 18 bp, Homo sapiens
catgaaaaagcagctacc

SEQ ID NO: 2320551 - DNA, 23 bp, Homo sapiens
catgaaaaagcagctaccaggtg

SEQ ID NO: 2320552 - DNA, 24 bp, Homo sapiens
catgaaaataccatttagtaagaa

SEQ ID NO: 2320553 - DNA, 19 bp, Homo sapiens
catgaaaggttaaaaaagc

SEQ ID NO: 2320554 - DNA, 13 bp, Homo sapiens
catgaatcaagca

SEQ ID NO: 2320555 - DNA, 21 bp, Homo sapiens
catgaatcccacccacatgtg

SEQ ID NO: 2320556 - DNA, 22 bp, Homo sapiens
catgaattacctggatgttctt

SEQ ID NO: 2320557 - DNA, 14 bp, Homo sapiens
catgaattttaaag

SEQ ID NO: 2320558 - DNA, 21 bp, Homo sapiens
catgaattttaaagtatgcat

SEQ ID NO: 2320559 - DNA, 15 bp, Homo sapiens
catgacagaggctgc

SEQ ID NO: 2320560 - DNA, 22 bp, Homo sapiens
catgacagaggctgcacccctg

SEQ ID NO: 2320561 - DNA, 20 bp, Homo sapiens
catgacagcctgcagcagga

SEQ ID NO: 2320562 - DNA, 22 bp, Homo sapiens
catgagaagccaagcgctcatg

SEQ ID NO: 2320563 - DNA, 17 bp, Homo sapiens
catgagatggagaggct

SEQ ID NO: 2320564 - DNA, 18 bp, Homo sapiens
catgagatggagaggctg

SEQ ID NO: 2320565 - DNA, 18 bp, Homo sapiens
catgagcctgctggaagc

SEQ ID NO: 2320566 - DNA, 19 bp, Homo sapiens
catgagcctgctggaagcc

SEQ ID NO: 2320567 - DNA, 20 bp, Homo sapiens
catgagcctgctggaagccc

SEQ ID NO: 2320568 - DNA, 22 bp, Homo sapiens
catgagcctgctggaagcccag

SEQ ID NO: 2320569 - DNA, 23 bp, Homo sapiens
catgagcctgctggaagcccagc

SEQ ID NO: 2320570 - DNA, 22 bp, Homo sapiens
catgaggaggggcccccctgcc

SEQ ID NO: 2320571 - DNA, 23 bp, Homo sapiens
catgaggaggggcccccctgccc

SEQ ID NO: 2320572 - DNA, 16 bp, Homo sapiens
catgagttatcatgaa

SEQ ID NO: 2320573 - DNA, 21 bp, Homo sapiens
catgatcatagctcactgcag

SEQ ID NO: 2320574 - DNA, 24 bp, Homo sapiens
catgatcatagctcactgcagcct

SEQ ID NO: 2320575 - DNA, 15 bp, Homo sapiens
catgatgtgaagagt

SEQ ID NO: 2320576 - DNA, 22 bp, Homo sapiens
catgatgtgaagagtttcacaa

SEQ ID NO: 2320577 - DNA, 22 bp, Homo sapiens
catgattatagcaactaatgtt

SEQ ID NO: 2320578 - DNA, 22 bp, Homo sapiens
catgatttagggaagcagggac

SEQ ID NO: 2320579 - DNA, 20 bp, Homo sapiens
catgcaaatgagctctgaaa

SEQ ID NO: 2320580 - DNA, 22 bp, Homo sapiens
catgcaaatgagctctgaaatc

SEQ ID NO: 2320581 - DNA, 16 bp, Homo sapiens
catgcagacctcatgc

SEQ ID NO: 2320582 - DNA, 22 bp, Homo sapiens
catgcagacctcatgcccagct

SEQ ID NO: 2320583 - DNA, 15 bp, Homo sapiens
catgcataaatatgc

SEQ ID NO: 2320584 - DNA, 18 bp, Homo sapiens
catgcataaatatgcagt

SEQ ID NO: 2320585 - DNA, 14 bp, Homo sapiens
catgcatataatga

SEQ ID NO: 2320586 - DNA, 19 bp, Homo sapiens
catgcatgcaaatgagctc

SEQ ID NO: 2320587 - DNA, 21 bp, Homo sapiens
catgcatgtcctgtaaaggtt

SEQ ID NO: 2320588 - DNA, 23 bp, Homo sapiens
catgccagattctgcctctctgg

SEQ ID NO: 2320589 - DNA, 14 bp, Homo sapiens
catgccagctggcc

SEQ ID NO: 2320590 - DNA, 16 bp, Homo sapiens
catgccagctggcctt

SEQ ID NO: 2320591 - DNA, 22 bp, Homo sapiens
catgccagctggcctttgtaag

SEQ ID NO: 2320592 - DNA, 17 bp, Homo sapiens
catgcccaccccctgcc

SEQ ID NO: 2320593 - DNA, 20 bp, Homo sapiens
catgcccaccccctgccctg

SEQ ID NO: 2320594 - DNA, 13 bp, Homo sapiens
catgcccagctct

SEQ ID NO: 2320595 - DNA, 11 bp, Homo sapiens
catgccccctg

SEQ ID NO: 2320596 - DNA, 14 bp, Homo sapiens
catgccccctgcag

SEQ ID NO: 2320597 - DNA, 16 bp, Homo sapiens
catgccccctgcagac

SEQ ID NO: 2320598 - DNA, 17 bp, Homo sapiens
attccatacttctctca

SEQ ID NO: 2320599 - DNA, 15 bp, Homo sapiens
attccatgagctgct

SEQ ID NO: 2320600 - DNA, 16 bp, Homo sapiens
attccatgagctgctc

SEQ ID NO: 2320601 - DNA, 20 bp, Homo sapiens
attccattagagagtggcaa

SEQ ID NO: 2320602 - DNA, 17 bp, Homo sapiens
attccattcaatttcat

SEQ ID NO: 2320603 - DNA, 14 bp, Homo sapiens
attcccatgtggaa

SEQ ID NO: 2320604 - DNA, 22 bp, Homo sapiens
attccctggccgcttctcccca

SEQ ID NO: 2320605 - DNA, 16 bp, Homo sapiens
attcctattaatgtct

SEQ ID NO: 2320606 - DNA, 13 bp, Homo sapiens
attcctcctgctc

SEQ ID NO: 2320607 - DNA, 15 bp, Homo sapiens
attcctcctgctcat

SEQ ID NO: 2320608 - DNA, 18 bp, Homo sapiens
attcctgacctccgccat

SEQ ID NO: 2320609 - DNA, 16 bp, Homo sapiens
attcctggcatgacac

SEQ ID NO: 2320610 - DNA, 17 bp, Homo sapiens
attccttctttgataat

SEQ ID NO: 2320611 - DNA, 20 bp, Homo sapiens
attccttctttgataatgtt

SEQ ID NO: 2320612 - DNA, 22 bp, Homo sapiens
attccttctttgataatgttaa

SEQ ID NO: 2320613 - DNA, 23 bp, Homo sapiens
attccttctttgataatgttaaa

SEQ ID NO: 2320614 - DNA, 14 bp, Homo sapiens
attctataaaactc

SEQ ID NO: 2320615 - DNA, 15 bp, Homo sapiens
attctataaaactct

SEQ ID NO: 2320616 - DNA, 21 bp, Homo sapiens
attctcaccaatcgctcccca

SEQ ID NO: 2320617 - DNA, 22 bp, Homo sapiens
attctcccaggtaccagctgcg

SEQ ID NO: 2320618 - DNA, 16 bp, Homo sapiens
attctctagatttatt

SEQ ID NO: 2320619 - DNA, 14 bp, Homo sapiens
attctctgtaagtg

SEQ ID NO: 2320620 - DNA, 20 bp, Homo sapiens
attctctgtaagtgtagctc

SEQ ID NO: 2320621 - DNA, 22 bp, Homo sapiens
attctgccgccccctcctgaac

SEQ ID NO: 2320622 - DNA, 14 bp, Homo sapiens
attctggctttaag

SEQ ID NO: 2320623 - DNA, 17 bp, Homo sapiens
attctgtggtgggaaca

SEQ ID NO: 2320624 - DNA, 15 bp, Homo sapiens
attctgtttgccttt

SEQ ID NO: 2320625 - DNA, 23 bp, Homo sapiens
attcttaaaaggcccatagcagc

SEQ ID NO: 2320626 - DNA, 20 bp, Homo sapiens
attcttagctgtaacttaac

SEQ ID NO: 2320627 - DNA, 21 bp, Homo sapiens
attcttctgaactcaaactga

SEQ ID NO: 2320628 - DNA, 15 bp, Homo sapiens
attcttgattcctgg

SEQ ID NO: 2320629 - DNA, 19 bp, Homo sapiens
attcttggaccatgccaga

SEQ ID NO: 2320630 - DNA, 20 bp, Homo sapiens
attcttggaccatgccagat

SEQ ID NO: 2320631 - DNA, 17 bp, Homo sapiens
attctttccattatgat

SEQ ID NO: 2320632 - DNA, 22 bp, Homo sapiens
attcttttatactcagctttct

SEQ ID NO: 2320633 - DNA, 17 bp, Homo sapiens
attcttttgtttccatg

SEQ ID NO: 2320634 - DNA, 12 bp, Homo sapiens
attgaaaagtac

SEQ ID NO: 2320635 - DNA, 20 bp, Homo sapiens
attgaaaagtttttgtttgg

SEQ ID NO: 2320636 - DNA, 18 bp, Homo sapiens
attgaaaattgaaaagta

SEQ ID NO: 2320637 - DNA, 23 bp, Homo sapiens
attgaaagccaacaactctgcct

SEQ ID NO: 2320638 - DNA, 14 bp, Homo sapiens
attgaacttttgta

SEQ ID NO: 2320639 - DNA, 19 bp, Homo sapiens
attgaacttttgtactgaa

SEQ ID NO: 2320640 - DNA, 20 bp, Homo sapiens
attgaagtttcaagttttaa

SEQ ID NO: 2320641 - DNA, 15 bp, Homo sapiens
attgacactgaactt

SEQ ID NO: 2320642 - DNA, 15 bp, Homo sapiens
attgacttttataaa

SEQ ID NO: 2320643 - DNA, 18 bp, Homo sapiens
attgacttttataaagca

SEQ ID NO: 2320644 - DNA, 14 bp, Homo sapiens
attgagattttcca

SEQ ID NO: 2320645 - DNA, 20 bp, Homo sapiens
attgagtacctactgtgtgc

SEQ ID NO: 2320646 - DNA, 14 bp, Homo sapiens
attgagtattgttt

SEQ ID NO: 2320647 - DNA, 14 bp, Homo sapiens
attgattgggaaaa

SEQ ID NO: 2320648 - DNA, 14 bp, Homo sapiens
attgatttgattgg

SEQ ID NO: 2320649 - DNA, 15 bp, Homo sapiens
attgcaataaagtat

SEQ ID NO: 2320650 - DNA, 23 bp, Homo sapiens
attgcaccatactccttgcttcc

SEQ ID NO: 2320651 - DNA, 16 bp, Homo sapiens
attgcactgttctgat

SEQ ID NO: 2320652 - DNA, 22 bp, Homo sapiens
attgcactgttctgattatgta

SEQ ID NO: 2320653 - DNA, 16 bp, Homo sapiens
attgcatcactgtatc

SEQ ID NO: 2320654 - DNA, 10 bp, Homo sapiens
atttccttta

SEQ ID NO: 2320655 - DNA, 15 bp, Homo sapiens
atttcctttatgtga

SEQ ID NO: 2320656 - DNA, 18 bp, Homo sapiens
atttcctttatgtgaatt

SEQ ID NO: 2320657 - DNA, 18 bp, Homo sapiens
atttcctttttgacactg

SEQ ID NO: 2320658 - DNA, 15 bp, Homo sapiens
atttcggctatgtct

SEQ ID NO: 2320659 - DNA, 12 bp, Homo sapiens
atttctaacagt

SEQ ID NO: 2320660 - DNA, 15 bp, Homo sapiens
atttctaacagtcct

SEQ ID NO: 2320661 - DNA, 16 bp, Homo sapiens
atttctaattccacag

SEQ ID NO: 2320662 - DNA, 12 bp, Homo sapiens
atttctaattgt

SEQ ID NO: 2320663 - DNA, 22 bp, Homo sapiens
atttctataaaaatactacaat

SEQ ID NO: 2320664 - DNA, 19 bp, Homo sapiens
atttctatgacaaattcaa

SEQ ID NO: 2320665 - DNA, 13 bp, Homo sapiens
atttctattaata

SEQ ID NO: 2320666 - DNA, 12 bp, Homo sapiens
atttctcctccc

SEQ ID NO: 2320667 - DNA, 14 bp, Homo sapiens
atttctcctccctt

SEQ ID NO: 2320668 - DNA, 19 bp, Homo sapiens
atttctcctcccttccttt

SEQ ID NO: 2320669 - DNA, 19 bp, Homo sapiens
atttctctttaaactatgt

SEQ ID NO: 2320670 - DNA, 11 bp, Homo sapiens
atttctgcctc

SEQ ID NO: 2320671 - DNA, 18 bp, Homo sapiens
atttcttatgtgacatta

SEQ ID NO: 2320672 - DNA, 19 bp, Homo sapiens
atttcttatgtgacattaa

SEQ ID NO: 2320673 - DNA, 13 bp, Homo sapiens
atttcttctctta

SEQ ID NO: 2320674 - DNA, 20 bp, Homo sapiens
atttcttctcttatcctctc

SEQ ID NO: 2320675 - DNA, 22 bp, Homo sapiens
atttcttctcttatcctctctc

SEQ ID NO: 2320676 - DNA, 21 bp, Homo sapiens
atttctttaaaagaatgacta

SEQ ID NO: 2320677 - DNA, 16 bp, Homo sapiens
atttctttgcattcca

SEQ ID NO: 2320678 - DNA, 11 bp, Homo sapiens
atttgaatgta

SEQ ID NO: 2320679 - DNA, 23 bp, Homo sapiens
atttgaattatcagcaaagaaaa

SEQ ID NO: 2320680 - DNA, 13 bp, Homo sapiens
atttgactattct

SEQ ID NO: 2320681 - DNA, 18 bp, Homo sapiens
atttgcaataacagctgc

SEQ ID NO: 2320682 - DNA, 17 bp, Homo sapiens
atttgcaggattccctt

SEQ ID NO: 2320683 - DNA, 18 bp, Homo sapiens
atttgcctaattcctggc

SEQ ID NO: 2320684 - DNA, 21 bp, Homo sapiens
atttgcctcaccttggggcct

SEQ ID NO: 2320685 - DNA, 16 bp, Homo sapiens
atttgctactgttgta

SEQ ID NO: 2320686 - DNA, 16 bp, Homo sapiens
atttgctcataagtaa

SEQ ID NO: 2320687 - DNA, 20 bp, Homo sapiens
atttgctcataagtaaatgt

SEQ ID NO: 2320688 - DNA, 21 bp, Homo sapiens
atttgctgacaaccattaaag

SEQ ID NO: 2320689 - DNA, 23 bp, Homo sapiens
atttgctgacaaccattaaagtc

SEQ ID NO: 2320690 - DNA, 21 bp, Homo sapiens
atttggaagagaggcacctgc

SEQ ID NO: 2320691 - DNA, 20 bp, Homo sapiens
atttggagcacaaaattcaa

SEQ ID NO: 2320692 - DNA, 15 bp, Homo sapiens
atttggcgtgacccg

SEQ ID NO: 2320693 - DNA, 14 bp, Homo sapiens
atttggtctcaggc

SEQ ID NO: 2320694 - DNA, 17 bp, Homo sapiens
atttgtaagtttcaggt

SEQ ID NO: 2320695 - DNA, 16 bp, Homo sapiens
atttgtagctttgccc

SEQ ID NO: 2320696 - DNA, 14 bp, Homo sapiens
atttgtgccagagg

SEQ ID NO: 2320697 - DNA, 22 bp, Homo sapiens
atttgtggcaattttatgtttt

SEQ ID NO: 2320698 - DNA, 12 bp, Homo sapiens
atttgtgtaact

SEQ ID NO: 2320699 - DNA, 14 bp, Homo sapiens
attttaaaatttca

SEQ ID NO: 2320700 - DNA, 18 bp, Homo sapiens
attttaaagccattctga

SEQ ID NO: 2320701 - DNA, 19 bp, Homo sapiens
attttaaagtatgcattat

SEQ ID NO: 2320702 - DNA, 12 bp, Homo sapiens
attttaatacat

SEQ ID NO: 2320703 - DNA, 20 bp, Homo sapiens
attttaattactgctataaa

SEQ ID NO: 2320704 - DNA, 12 bp, Homo sapiens
attttacaattt

SEQ ID NO: 2320705 - DNA, 24 bp, Homo sapiens
attttagaaactacaaatataggt

SEQ ID NO: 2320706 - DNA, 17 bp, Homo sapiens
attttagaaatattcac

SEQ ID NO: 2320707 - DNA, 15 bp, Homo sapiens
attttatatgcttac

SEQ ID NO: 2320708 - DNA, 14 bp, Homo sapiens
attttatgtttaaa

SEQ ID NO: 2320709 - DNA, 22 bp, Homo sapiens
attttatgtttaaaatggcatt

SEQ ID NO: 2320710 - DNA, 17 bp, Homo sapiens
attttatttagacaaga

SEQ ID NO: 2320711 - DNA, 19 bp, Homo sapiens
attttattttaaaatttca

SEQ ID NO: 2320712 - DNA, 23 bp, Homo sapiens
attttcagagccggcccgcctct

SEQ ID NO: 2320713 - DNA, 21 bp, Homo sapiens
attttcagtcccctctctctg

SEQ ID NO: 2320714 - DNA, 16 bp, Homo sapiens
attttcataatcagta

SEQ ID NO: 2320715 - DNA, 17 bp, Homo sapiens
attttcataatcagtaa

SEQ ID NO: 2320716 - DNA, 14 bp, Homo sapiens
attttcatgaaaat

SEQ ID NO: 2320717 - DNA, 20 bp, Homo sapiens
attttcatgaaaataccatt

SEQ ID NO: 2320718 - DNA, 20 bp, Homo sapiens
attttcccactcattctgaa

SEQ ID NO: 2320719 - DNA, 16 bp, Homo sapiens
attttcctcctctgcc

SEQ ID NO: 2320720 - DNA, 19 bp, Homo sapiens
cagtgcaatgcttgtagaa

SEQ ID NO: 2320721 - DNA, 20 bp, Homo sapiens
cagtgcagagccttctcaga

SEQ ID NO: 2320722 - DNA, 22 bp, Homo sapiens
cagtgcatagttgtagacaaag

SEQ ID NO: 2320723 - DNA, 23 bp, Homo sapiens
cagtgccccagggagtccagggt

SEQ ID NO: 2320724 - DNA, 18 bp, Homo sapiens
cagtgccctccagccccg

SEQ ID NO: 2320725 - DNA, 20 bp, Homo sapiens
cagtgcctcttccagtgaac

SEQ ID NO: 2320726 - DNA, 21 bp, Homo sapiens
cagtgcctcttccagtgaaca

SEQ ID NO: 2320727 - DNA, 22 bp, Homo sapiens
cagtgcctcttccagtgaacat

SEQ ID NO: 2320728 - DNA, 16 bp, Homo sapiens
cagtgctcaccagccc

SEQ ID NO: 2320729 - DNA, 15 bp, Homo sapiens
cagtgctctgcctca

SEQ ID NO: 2320730 - DNA, 17 bp, Homo sapiens
cagtgctctgcctcaga

SEQ ID NO: 2320731 - DNA, 12 bp, Homo sapiens
cagtgctggaag

SEQ ID NO: 2320732 - DNA, 15 bp, Homo sapiens
cagtgctggaaggga

SEQ ID NO: 2320733 - DNA, 21 bp, Homo sapiens
cagtgggatgaaccagccggg

SEQ ID NO: 2320734 - DNA, 23 bp, Homo sapiens
cagtggttgttttttcattgtgt

SEQ ID NO: 2320735 - DNA, 22 bp, Homo sapiens
cagtgtcatttctcatccacat

SEQ ID NO: 2320736 - DNA, 23 bp, Homo sapiens
cagtgtccagcttccaaagccta

SEQ ID NO: 2320737 - DNA, 12 bp, Homo sapiens
cagtgtctccac

SEQ ID NO: 2320738 - DNA, 14 bp, Homo sapiens
cagtgtctgttcag

SEQ ID NO: 2320739 - DNA, 15 bp, Homo sapiens
cagtgtggagaccct

SEQ ID NO: 2320740 - DNA, 19 bp, Homo sapiens
cagtgttgcatatgagcct

SEQ ID NO: 2320741 - DNA, 19 bp, Homo sapiens
cagttacagtggcagtatt

SEQ ID NO: 2320742 - DNA, 20 bp, Homo sapiens
cagttacagtggcagtattg

SEQ ID NO: 2320743 - DNA, 15 bp, Homo sapiens
cagttcctgggaaca

SEQ ID NO: 2320744 - DNA, 15 bp, Homo sapiens
cagttctaacctcct

SEQ ID NO: 2320745 - DNA, 18 bp, Homo sapiens
cagttctaacctcctaag

SEQ ID NO: 2320746 - DNA, 15 bp, Homo sapiens
cagttctaggaaaat

SEQ ID NO: 2320747 - DNA, 20 bp, Homo sapiens
cagttctttcctctttctgc

SEQ ID NO: 2320748 - DNA, 14 bp, Homo sapiens
cagttgatctgctc

SEQ ID NO: 2320749 - DNA, 13 bp, Homo sapiens
cagttgctgtgaa

SEQ ID NO: 2320750 - DNA, 14 bp, Homo sapiens
cagttgctgtgaac

SEQ ID NO: 2320751 - DNA, 11 bp, Homo sapiens
cagtttaacag

SEQ ID NO: 2320752 - DNA, 19 bp, Homo sapiens
cagtttaacagaaaaatga

SEQ ID NO: 2320753 - DNA, 16 bp, Homo sapiens
cagtttctccttgaaa

SEQ ID NO: 2320754 - DNA, 18 bp, Homo sapiens
cagtttcttagcttttta

SEQ ID NO: 2320755 - DNA, 23 bp, Homo sapiens
cagtttcttttcacattaggctg

SEQ ID NO: 2320756 - DNA, 14 bp, Homo sapiens
cagtttgttggaaa

SEQ ID NO: 2320757 - DNA, 18 bp, Homo sapiens
cagttttctcctctgctt

SEQ ID NO: 2320758 - DNA, 13 bp, Homo sapiens
cagtttttgtaaa

SEQ ID NO: 2320759 - DNA, 15 bp, Homo sapiens
cataaactaaaaact

SEQ ID NO: 2320760 - DNA, 20 bp, Homo sapiens
cataaagctcaaatgaaatg

SEQ ID NO: 2320761 - DNA, 19 bp, Homo sapiens
cataaaggaaaagacacat

SEQ ID NO: 2320762 - DNA, 21 bp, Homo sapiens
cataaaggaaaagacacattt

SEQ ID NO: 2320763 - DNA, 14 bp, Homo sapiens
cataaagtaaatac

SEQ ID NO: 2320764 - DNA, 15 bp, Homo sapiens
cataaagtaaataca

SEQ ID NO: 2320765 - DNA, 16 bp, Homo sapiens
cataaagtacaaatga

SEQ ID NO: 2320766 - DNA, 20 bp, Homo sapiens
cataaatatgcagtgatatg

SEQ ID NO: 2320767 - DNA, 11 bp, Homo sapiens
cataaatcaac

SEQ ID NO: 2320768 - DNA, 16 bp, Homo sapiens
cataaatccttgatga

SEQ ID NO: 2320769 - DNA, 12 bp, Homo sapiens
cataaattattt

SEQ ID NO: 2320770 - DNA, 20 bp, Homo sapiens
cataaattcaactttgtaaa

SEQ ID NO: 2320771 - DNA, 15 bp, Homo sapiens
cataacgtttttcct

SEQ ID NO: 2320772 - DNA, 16 bp, Homo sapiens
cataagtaaatgtctt

SEQ ID NO: 2320773 - DNA, 18 bp, Homo sapiens
cataagtaaatgtcttca

SEQ ID NO: 2320774 - DNA, 15 bp, Homo sapiens
cataagtaactttta

SEQ ID NO: 2320775 - DNA, 19 bp, Homo sapiens
cataagtattatgtctctt

SEQ ID NO: 2320776 - DNA, 14 bp, Homo sapiens
cataataaaagtga

SEQ ID NO: 2320777 - DNA, 16 bp, Homo sapiens
cataataaattttcta

SEQ ID NO: 2320778 - DNA, 19 bp, Homo sapiens
cataataaattttctaaaa

SEQ ID NO: 2320779 - DNA, 23 bp, Homo sapiens
cataatcagtaaatagtgtcata

SEQ ID NO: 2320780 - DNA, 20 bp, Homo sapiens
cataatgagatgtgagcctt

SEQ ID NO: 2320781 - DNA, 15 bp, Homo sapiens
cataatgataaaata

SEQ ID NO: 2320782 - DNA, 18 bp, Homo sapiens
cataatgataaaataaat

SEQ ID NO: 2320783 - DNA, 19 bp, Homo sapiens
cataatgataaaataaata

SEQ ID NO: 2320784 - DNA, 15 bp, Homo sapiens
cataatttaaaaata

SEQ ID NO: 2320785 - DNA, 17 bp, Homo sapiens
catacaagaaaatgtat

SEQ ID NO: 2320786 - DNA, 15 bp, Homo sapiens
catacacacagcagt

SEQ ID NO: 2320787 - DNA, 23 bp, Homo sapiens
catacacagaggagtgcagcctt

SEQ ID NO: 2320788 - DNA, 21 bp, Homo sapiens
catacaccccctcttctgagc

SEQ ID NO: 2320789 - DNA, 22 bp, Homo sapiens
catacaccccctcttctgagca

SEQ ID NO: 2320790 - DNA, 18 bp, Homo sapiens
catacagaggatgccttt

SEQ ID NO: 2320791 - DNA, 14 bp, Homo sapiens
catacataaaagaa

SEQ ID NO: 2320792 - DNA, 18 bp, Homo sapiens
catacataaaagaaataa

SEQ ID NO: 2320793 - DNA, 14 bp, Homo sapiens
cataccctgacctg

SEQ ID NO: 2320794 - DNA, 18 bp, Homo sapiens
catactgagaatatacaa

SEQ ID NO: 2320795 - DNA, 17 bp, Homo sapiens
catactgattgggaggt

SEQ ID NO: 2320796 - DNA, 16 bp, Homo sapiens
catactttttaaatgt

SEQ ID NO: 2320797 - DNA, 14 bp, Homo sapiens
catagaattttgag

SEQ ID NO: 2320798 - DNA, 16 bp, Homo sapiens
catagacatgaaaggt

SEQ ID NO: 2320799 - DNA, 14 bp, Homo sapiens
catagaccctgagg

SEQ ID NO: 2320800 - DNA, 22 bp, Homo sapiens
catagataatattgtttggtaa

SEQ ID NO: 2320801 - DNA, 16 bp, Homo sapiens
catagcagatctgttt

SEQ ID NO: 2320802 - DNA, 18 bp, Homo sapiens
catagcatgcttcctttc

SEQ ID NO: 2320803 - DNA, 19 bp, Homo sapiens
catagcatgcttcctttct

SEQ ID NO: 2320804 - DNA, 21 bp, Homo sapiens
catagcatgcttcctttctct

SEQ ID NO: 2320805 - DNA, 22 bp, Homo sapiens
catagctctgaagttaaaatga

SEQ ID NO: 2320806 - DNA, 21 bp, Homo sapiens
cataggtctctttgctttctg

SEQ ID NO: 2320807 - DNA, 15 bp, Homo sapiens
cataggttaaaaaaa

SEQ ID NO: 2320808 - DNA, 23 bp, Homo sapiens
cataggttaaaaaaaaaagtcac

SEQ ID NO: 2320809 - DNA, 20 bp, Homo sapiens
catagtaataagatggctgt

SEQ ID NO: 2320810 - DNA, 17 bp, Homo sapiens
catagtttctttatttt

SEQ ID NO: 2320811 - DNA, 20 bp, Homo sapiens
catataagacaaatattcct

SEQ ID NO: 2320812 - DNA, 12 bp, Homo sapiens
catatatcaaga

SEQ ID NO: 2320813 - DNA, 12 bp, Homo sapiens
catatatttatt

SEQ ID NO: 2320814 - DNA, 15 bp, Homo sapiens
catatcctgagccat

SEQ ID NO: 2320815 - DNA, 22 bp, Homo sapiens
catatctccatggccctgtccc

SEQ ID NO: 2320816 - DNA, 20 bp, Homo sapiens
agaactttattaagtaaaat

SEQ ID NO: 2320817 - DNA, 14 bp, Homo sapiens
agaagaatggcttt

SEQ ID NO: 2320818 - DNA, 15 bp, Homo sapiens
agaagacaaactgct

SEQ ID NO: 2320819 - DNA, 14 bp, Homo sapiens
agaagacaccagag

SEQ ID NO: 2320820 - DNA, 16 bp, Homo sapiens
agaagacaccagagca

SEQ ID NO: 2320821 - DNA, 17 bp, Homo sapiens
agaagacaccagagcag

SEQ ID NO: 2320822 - DNA, 22 bp, Homo sapiens
agaagacaccagagcagatgca

SEQ ID NO: 2320823 - DNA, 12 bp, Homo sapiens
agaagacatgaa

SEQ ID NO: 2320824 - DNA, 15 bp, Homo sapiens
agaagcaagccagac

SEQ ID NO: 2320825 - DNA, 14 bp, Homo sapiens
agaagcaagggcaa

SEQ ID NO: 2320826 - DNA, 21 bp, Homo sapiens
agaagcacagaatatttttat

SEQ ID NO: 2320827 - DNA, 15 bp, Homo sapiens
agaagcatgaaaaag

SEQ ID NO: 2320828 - DNA, 23 bp, Homo sapiens
agaagcattccttctttgataat

SEQ ID NO: 2320829 - DNA, 24 bp, Homo sapiens
agaagcattccttctttgataatg

SEQ ID NO: 2320830 - DNA, 22 bp, Homo sapiens
agaagccaagcgctcatgttga

SEQ ID NO: 2320831 - DNA, 19 bp, Homo sapiens
agaagccaagggaaagggg

SEQ ID NO: 2320832 - DNA, 21 bp, Homo sapiens
agaagccaagggaaaggggtg

SEQ ID NO: 2320833 - DNA, 21 bp, Homo sapiens
agaagccatatatgaccagaa

SEQ ID NO: 2320834 - DNA, 21 bp, Homo sapiens
agaagccgagagccttttgtg

SEQ ID NO: 2320835 - DNA, 23 bp, Homo sapiens
agaagccttggaaccagccccat

SEQ ID NO: 2320836 - DNA, 14 bp, Homo sapiens
agaagctgttgtac

SEQ ID NO: 2320837 - DNA, 20 bp, Homo sapiens
agaaggaaggcctgagcccc

SEQ ID NO: 2320838 - DNA, 22 bp, Homo sapiens
agagaaacactgaaaagaagga

SEQ ID NO: 2320839 - DNA, 10 bp, Homo sapiens
agagaaactt

SEQ ID NO: 2320840 - DNA, 22 bp, Homo sapiens
agagaactcgcgctcagtaaac

SEQ ID NO: 2320841 - DNA, 10 bp, Homo sapiens
agagaatgag

SEQ ID NO: 2320842 - DNA, 14 bp, Homo sapiens
agagaatgttccta

SEQ ID NO: 2320843 - DNA, 13 bp, Homo sapiens
agagacaaaatat

SEQ ID NO: 2320844 - DNA, 16 bp, Homo sapiens
agagacagcccaggat

SEQ ID NO: 2320845 - DNA, 14 bp, Homo sapiens
agagacaggcagcc

SEQ ID NO: 2320846 - DNA, 17 bp, Homo sapiens
agagacaggcagcccag

SEQ ID NO: 2320847 - DNA, 21 bp, Homo sapiens
agagacaggcagcccagcagt

SEQ ID NO: 2320848 - DNA, 15 bp, Homo sapiens
agagacatttcaaaa

SEQ ID NO: 2320849 - DNA, 14 bp, Homo sapiens
agagacgccactcc

SEQ ID NO: 2320850 - DNA, 15 bp, Homo sapiens
agagacgccactccc

SEQ ID NO: 2320851 - DNA, 16 bp, Homo sapiens
agagactgtttgaatg

SEQ ID NO: 2320852 - DNA, 14 bp, Homo sapiens
agagagagaggaca

SEQ ID NO: 2320853 - DNA, 14 bp, Homo sapiens
agagagatgttttg

SEQ ID NO: 2320854 - DNA, 22 bp, Homo sapiens
agagagcagctccctttctcag

SEQ ID NO: 2320855 - DNA, 13 bp, Homo sapiens
agagagccatttt

SEQ ID NO: 2320856 - DNA, 16 bp, Homo sapiens
acattaacggtgctaa

SEQ ID NO: 2320857 - DNA, 17 bp, Homo sapiens
acattaacggtgctaaa

SEQ ID NO: 2320858 - DNA, 17 bp, Homo sapiens
acattaatgataaactc

SEQ ID NO: 2320859 - DNA, 22 bp, Homo sapiens
acattacaaagttaaaattgtt

SEQ ID NO: 2320860 - DNA, 14 bp, Homo sapiens
acattattcttctt

SEQ ID NO: 2320861 - DNA, 22 bp, Homo sapiens
acattccctggccgcttctccc

SEQ ID NO: 2320862 - DNA, 12 bp, Homo sapiens
acattctcacat

SEQ ID NO: 2320863 - DNA, 20 bp, Homo sapiens
acattctggggaaacaacat

SEQ ID NO: 2320864 - DNA, 22 bp, Homo sapiens
acattcttagctgtaacttaac

SEQ ID NO: 2320865 - DNA, 18 bp, Homo sapiens
acattgaaactgtattta

SEQ ID NO: 2320866 - DNA, 12 bp, Homo sapiens
acattgctgcct

SEQ ID NO: 2320867 - DNA, 13 bp, Homo sapiens
acatttcaaaact

SEQ ID NO: 2320868 - DNA, 16 bp, Homo sapiens
acatttctataaaaat

SEQ ID NO: 2320869 - DNA, 18 bp, Homo sapiens
acatttgattaataaaat

SEQ ID NO: 2320870 - DNA, 21 bp, Homo sapiens
acatttgattaataaaatatc

SEQ ID NO: 2320871 - DNA, 19 bp, Homo sapiens
acatttgctactgttgtaa

SEQ ID NO: 2320872 - DNA, 15 bp, Homo sapiens
acatttgctgccatt

SEQ ID NO: 2320873 - DNA, 23 bp, Homo sapiens
acatttgtaagtgtaaaaaatgt

SEQ ID NO: 2320874 - DNA, 20 bp, Homo sapiens
acattttaaaaaatggtcac

SEQ ID NO: 2320875 - DNA, 18 bp, Homo sapiens
acattttatcattaaaaa

SEQ ID NO: 2320876 - DNA, 13 bp, Homo sapiens
acattttctaaat

SEQ ID NO: 2320877 - DNA, 16 bp, Homo sapiens
acattttctaaataaa

SEQ ID NO: 2320878 - DNA, 12 bp, Homo sapiens
accaaaaacaaa

SEQ ID NO: 2320879 - DNA, 13 bp, Homo sapiens
accaaaaacattt

SEQ ID NO: 2320880 - DNA, 14 bp, Homo sapiens
accaaaattttaaa

SEQ ID NO: 2320881 - DNA, 17 bp, Homo sapiens
accaaactactgaatga

SEQ ID NO: 2320882 - DNA, 15 bp, Homo sapiens
accaaagagggcttc

SEQ ID NO: 2320883 - DNA, 19 bp, Homo sapiens
accaaaggaaaatgtctgt

SEQ ID NO: 2320884 - DNA, 16 bp, Homo sapiens
accaaatagtgtgaaa

SEQ ID NO: 2320885 - DNA, 14 bp, Homo sapiens
accaacctgctctg

SEQ ID NO: 2320886 - DNA, 15 bp, Homo sapiens
accaacctgctctgt

SEQ ID NO: 2320887 - DNA, 15 bp, Homo sapiens
accaagaaagctcac

SEQ ID NO: 2320888 - DNA, 23 bp, Homo sapiens
accaagacttttgtctgatcaag

SEQ ID NO: 2320889 - DNA, 16 bp, Homo sapiens
accaagtggaccttga

SEQ ID NO: 2320890 - DNA, 23 bp, Homo sapiens
accaatagggctgagctctctgt

SEQ ID NO: 2320891 - DNA, 19 bp, Homo sapiens
accaatgggaagcagggaa

SEQ ID NO: 2320892 - DNA, 23 bp, Homo sapiens
accacactgggtgcgtctccagt

SEQ ID NO: 2320893 - DNA, 13 bp, Homo sapiens
accacacttgaaa

SEQ ID NO: 2320894 - DNA, 17 bp, Homo sapiens
accacacttgaaacctt

SEQ ID NO: 2320895 - DNA, 13 bp, Homo sapiens
accaccctcactg

SEQ ID NO: 2320896 - DNA, 17 bp, Homo sapiens
accactcctgtccctgt

SEQ ID NO: 2320897 - DNA, 12 bp, Homo sapiens
accactgcttct

SEQ ID NO: 2320898 - DNA, 17 bp, Homo sapiens
accactgtgccactgac

SEQ ID NO: 2320899 - DNA, 14 bp, Homo sapiens
accactgttctgtt

SEQ ID NO: 2320900 - DNA, 16 bp, Homo sapiens
accacttccagagcca

SEQ ID NO: 2320901 - DNA, 20 bp, Homo sapiens
acctacatatgctgatcttt

SEQ ID NO: 2320902 - DNA, 18 bp, Homo sapiens
acctacatgctgaaaaat

SEQ ID NO: 2320903 - DNA, 14 bp, Homo sapiens
acctaccaaaatgg

SEQ ID NO: 2320904 - DNA, 16 bp, Homo sapiens
acctagctaattattt

SEQ ID NO: 2320905 - DNA, 22 bp, Homo sapiens
acctagttaaagaaaggaaaag

SEQ ID NO: 2320906 - DNA, 23 bp, Homo sapiens
acctattcaagaagatagttgta

SEQ ID NO: 2320907 - DNA, 15 bp, Homo sapiens
acctcaaagggcagt

SEQ ID NO: 2320908 - DNA, 14 bp, Homo sapiens
acctcaagaccccc

SEQ ID NO: 2320909 - DNA, 21 bp, Homo sapiens
acctcaagggggactgtcttt

SEQ ID NO: 2320910 - DNA, 16 bp, Homo sapiens
acctcaagtgtcctga

SEQ ID NO: 2320911 - DNA, 17 bp, Homo sapiens
acctcaagtgtcctgaa

SEQ ID NO: 2320912 - DNA, 15 bp, Homo sapiens
acctcaattgacatt

SEQ ID NO: 2320913 - DNA, 15 bp, Homo sapiens
acctcacgctctgga

SEQ ID NO: 2320914 - DNA, 13 bp, Homo sapiens
acctcagggctcc

SEQ ID NO: 2320915 - DNA, 17 bp, Homo sapiens
acctcagggctcccagg

SEQ ID NO: 2320916 - DNA, 20 bp, Homo sapiens
acctcagggctcccaggggt

SEQ ID NO: 2320917 - DNA, 17 bp, Homo sapiens
acctcagggctgtccca

SEQ ID NO: 2320918 - DNA, 20 bp, Homo sapiens
acctcagggctgtcccagcc

SEQ ID NO: 2320919 - DNA, 21 bp, Homo sapiens
acctcagggctgtcccagccc

SEQ ID NO: 2320920 - DNA, 22 bp, Homo sapiens
acctcatgcccaccccctgccc

SEQ ID NO: 2320921 - DNA, 18 bp, Homo sapiens
acctccaagcatttcatg

SEQ ID NO: 2320922 - DNA, 19 bp, Homo sapiens
acctccacacccgtgagaa

SEQ ID NO: 2320923 - DNA, 16 bp, Homo sapiens
acctcctatccttgga

SEQ ID NO: 2320924 - DNA, 17 bp, Homo sapiens
acctcctatccttggag

SEQ ID NO: 2320925 - DNA, 15 bp, Homo sapiens
acctcctcatggcag

SEQ ID NO: 2320926 - DNA, 21 bp, Homo sapiens
acctcctgacacccttctccc

SEQ ID NO: 2320927 - DNA, 19 bp, Homo sapiens
acctctaggtccccatact

SEQ ID NO: 2320928 - DNA, 12 bp, Homo sapiens
acctctgtgtgc

SEQ ID NO: 2320929 - DNA, 15 bp, Homo sapiens
acctcttgtgcaagg

SEQ ID NO: 2320930 - DNA, 13 bp, Homo sapiens
acctctttttcct

SEQ ID NO: 2320931 - DNA, 14 bp, Homo sapiens
acctctttttcctc

SEQ ID NO: 2320932 - DNA, 22 bp, Homo sapiens
acctctttttcctcctggacac

SEQ ID NO: 2320933 - DNA, 13 bp, Homo sapiens
acctgaaagccct

SEQ ID NO: 2320934 - DNA, 16 bp, Homo sapiens
acctgaaagcccttct

SEQ ID NO: 2320935 - DNA, 16 bp, Homo sapiens
acctgacttggctggg

SEQ ID NO: 2320936 - DNA, 19 bp, Homo sapiens
acctgagctattttcctct

SEQ ID NO: 2320937 - DNA, 10 bp, Homo sapiens
acctgcaaga

SEQ ID NO: 2320938 - DNA, 17 bp, Homo sapiens
acctgcacacaggacag

SEQ ID NO: 2320939 - DNA, 14 bp, Homo sapiens
acctgcataaaaag

SEQ ID NO: 2320940 - DNA, 13 bp, Homo sapiens
acctgccaggcag

SEQ ID NO: 2320941 - DNA, 18 bp, Homo sapiens
acctgccaggcaggggtg

SEQ ID NO: 2320942 - DNA, 20 bp, Homo sapiens
acctgccaggcaggggtggg

SEQ ID NO: 2320943 - DNA, 14 bp, Homo sapiens
acctgccccagcac

SEQ ID NO: 2320944 - DNA, 17 bp, Homo sapiens
acctgccccagcactca

SEQ ID NO: 2320945 - DNA, 19 bp, Homo sapiens
acctgccccagcactcaca

SEQ ID NO: 2320946 - DNA, 22 bp, Homo sapiens
acctgccttggcctcccaaagt

SEQ ID NO: 2320947 - DNA, 12 bp, Homo sapiens
acctgctctcct

SEQ ID NO: 2320948 - DNA, 13 bp, Homo sapiens
acctgctctcctc

SEQ ID NO: 2320949 - DNA, 16 bp, Homo sapiens
acctgctctcctcttc

SEQ ID NO: 2320950 - DNA, 19 bp, Homo sapiens
acctggatggggcaggcca

SEQ ID NO: 2320951 - DNA, 14 bp, Homo sapiens
acctggcactggga

SEQ ID NO: 2320952 - DNA, 19 bp, Homo sapiens
acctggcactgggaggcag

SEQ ID NO: 2320953 - DNA, 21 bp, Homo sapiens
acctggccccaggctgtcacc

SEQ ID NO: 2320954 - DNA, 15 bp, Homo sapiens
acctggctctcacct

SEQ ID NO: 2320955 - DNA, 17 bp, Homo sapiens
acctggctctcacctct

SEQ ID NO: 2320956 - DNA, 21 bp, Homo sapiens
acctggctgaggttcctctgc

SEQ ID NO: 2320957 - DNA, 20 bp, Homo sapiens
acctgggaacgactggactg

SEQ ID NO: 2320958 - DNA, 19 bp, Homo sapiens
acctgtgcacaccccactc

SEQ ID NO: 2320959 - DNA, 12 bp, Homo sapiens
acctgtgcacct

SEQ ID NO: 2320960 - DNA, 18 bp, Homo sapiens
acctgttacctactttga

SEQ ID NO: 2320961 - DNA, 13 bp, Homo sapiens
acctgtttaaata

SEQ ID NO: 2320962 - DNA, 19 bp, Homo sapiens
acctgttttctgaaacaca

SEQ ID NO: 2320963 - DNA, 15 bp, Homo sapiens
accttactgtggagg

SEQ ID NO: 2320964 - DNA, 22 bp, Homo sapiens
accttcctgtgggtgttctttc

SEQ ID NO: 2320965 - DNA, 17 bp, Homo sapiens
accttgacgtttcttct

SEQ ID NO: 2320966 - DNA, 17 bp, Homo sapiens
accttgcaacctcacct

SEQ ID NO: 2320967 - DNA, 12 bp, Homo sapiens
accttgccaggg

SEQ ID NO: 2320968 - DNA, 21 bp, Homo sapiens
accttgccagggcagggtctg

SEQ ID NO: 2320969 - DNA, 18 bp, Homo sapiens
accttgccgagagaggcg

SEQ ID NO: 2320970 - DNA, 20 bp, Homo sapiens
accttggaccactcctgtcc

SEQ ID NO: 2320971 - DNA, 23 bp, Homo sapiens
accttggaccactcctgtccctg

SEQ ID NO: 2320972 - DNA, 17 bp, Homo sapiens
accttgtcccagccagt

SEQ ID NO: 2320973 - DNA, 13 bp, Homo sapiens
accttgtgtctgt

SEQ ID NO: 2320974 - DNA, 18 bp, Homo sapiens
accttgtgtctgtacacg

SEQ ID NO: 2320975 - DNA, 13 bp, Homo sapiens
acctttacatata

SEQ ID NO: 2320976 - DNA, 19 bp, Homo sapiens
acctttgggatcagcctcc

SEQ ID NO: 2320977 - DNA, 16 bp, Homo sapiens
aagcaaatgttgggaa

SEQ ID NO: 2320978 - DNA, 17 bp, Homo sapiens
aagcaaattgctttttt

SEQ ID NO: 2320979 - DNA, 12 bp, Homo sapiens
aagcaaattttg

SEQ ID NO: 2320980 - DNA, 18 bp, Homo sapiens
aagcaacatttgtatgga

SEQ ID NO: 2320981 - DNA, 19 bp, Homo sapiens
aagcaactaggccttcagt

SEQ ID NO: 2320982 - DNA, 18 bp, Homo sapiens
aagcaagagagatgtttt

SEQ ID NO: 2320983 - DNA, 23 bp, Homo sapiens
aagcaagaggcaagctgaaattt

SEQ ID NO: 2320984 - DNA, 12 bp, Homo sapiens
aagcaagccaga

SEQ ID NO: 2320985 - DNA, 14 bp, Homo sapiens
aagcaataaggaaa

SEQ ID NO: 2320986 - DNA, 19 bp, Homo sapiens
aagcaatccacctgccttg

SEQ ID NO: 2320987 - DNA, 17 bp, Homo sapiens
aagcaatcctcctgcct

SEQ ID NO: 2320988 - DNA, 20 bp, Homo sapiens
aagcaatcctcctgcctcag

SEQ ID NO: 2320989 - DNA, 13 bp, Homo sapiens
aagcaatggttga

SEQ ID NO: 2320990 - DNA, 20 bp, Homo sapiens
aagcacaaaaaatttaagag

SEQ ID NO: 2320991 - DNA, 15 bp, Homo sapiens
aagcacagaatattt

SEQ ID NO: 2320992 - DNA, 16 bp, Homo sapiens
aagcacagaatatttt

SEQ ID NO: 2320993 - DNA, 22 bp, Homo sapiens
aagcactacaggaggaatgcac

SEQ ID NO: 2320994 - DNA, 19 bp, Homo sapiens
aagcactctggatgatgga

SEQ ID NO: 2320995 - DNA, 16 bp, Homo sapiens
aagcagcatcttctgg

SEQ ID NO: 2320996 - DNA, 22 bp, Homo sapiens
aagcagctggtcagtctttgct

SEQ ID NO: 2320997 - DNA, 18 bp, Homo sapiens
aagcaggaggcccttgtc

SEQ ID NO: 2320998 - DNA, 15 bp, Homo sapiens
aagcagtattttggt

SEQ ID NO: 2320999 - DNA, 21 bp, Homo sapiens
aagcatagataatattgtttg

SEQ ID NO: 2321000 - DNA, 22 bp, Homo sapiens
aagcatagataatattgtttgg

SEQ ID NO: 2321001 - DNA, 14 bp, Homo sapiens
aagcatggacattt

SEQ ID NO: 2321002 - DNA, 13 bp, Homo sapiens
aagcattccttct

SEQ ID NO: 2321003 - DNA, 16 bp, Homo sapiens
aagcattccttctttg

SEQ ID NO: 2321004 - DNA, 20 bp, Homo sapiens
aagcattccttctttgataa

SEQ ID NO: 2321005 - DNA, 18 bp, Homo sapiens
aagcattctgagctgggc

SEQ ID NO: 2321006 - DNA, 12 bp, Homo sapiens
aagcatttcatg

SEQ ID NO: 2321007 - DNA, 23 bp, Homo sapiens
aagcatttcatgaaaaagctgct

SEQ ID NO: 2321008 - DNA, 16 bp, Homo sapiens
aagcattttgaaacaa

SEQ ID NO: 2321009 - DNA, 19 bp, Homo sapiens
aagcattttgaaacaaagt

SEQ ID NO: 2321010 - DNA, 20 bp, Homo sapiens
aagcattttgaaacaaagta

SEQ ID NO: 2321011 - DNA, 18 bp, Homo sapiens
aagcatttttcaatatat

SEQ ID NO: 2321012 - DNA, 12 bp, Homo sapiens
aagccaaagaaa

SEQ ID NO: 2321013 - DNA, 21 bp, Homo sapiens
aagccaaagaaaaataaccct

SEQ ID NO: 2321014 - DNA, 13 bp, Homo sapiens
aagccaagggaaa

SEQ ID NO: 2321015 - DNA, 23 bp, Homo sapiens
aagccaagggaaaggggtgcttt

SEQ ID NO: 2321016 - DNA, 13 bp, Homo sapiens
aagccaagtgggg

SEQ ID NO: 2321017 - DNA, 19 bp, Homo sapiens
aagccaagtggggtgctgg

SEQ ID NO: 2321018 - DNA, 21 bp, Homo sapiens
aagccagacctagcaggctgt

SEQ ID NO: 2321019 - DNA, 12 bp, Homo sapiens
aagccagagccc

SEQ ID NO: 2321020 - DNA, 12 bp, Homo sapiens
aagccagctttc

SEQ ID NO: 2321021 - DNA, 23 bp, Homo sapiens
aagccatatatgaccagaagcct

SEQ ID NO: 2321022 - DNA, 18 bp, Homo sapiens
aagcccagcccatggaga

SEQ ID NO: 2321023 - DNA, 14 bp, Homo sapiens
aagcccagttcatc

SEQ ID NO: 2321024 - DNA, 21 bp, Homo sapiens
aagcccttctcaagaccgagt

SEQ ID NO: 2321025 - DNA, 16 bp, Homo sapiens
aagcccttgcacagct

SEQ ID NO: 2321026 - DNA, 21 bp, Homo sapiens
aagcccttgcacagctggaga

SEQ ID NO: 2321027 - DNA, 22 bp, Homo sapiens
aagcccttgcacagctggagaa

SEQ ID NO: 2321028 - DNA, 14 bp, Homo sapiens
aagcctaaaattga

SEQ ID NO: 2321029 - DNA, 17 bp, Homo sapiens
aagcctaagggatcctg

SEQ ID NO: 2321030 - DNA, 12 bp, Homo sapiens
aagcctccacag

SEQ ID NO: 2321031 - DNA, 16 bp, Homo sapiens
aagcctctctctccct

SEQ ID NO: 2321032 - DNA, 21 bp, Homo sapiens
aagcctgcacaataaaaatgt

SEQ ID NO: 2321033 - DNA, 19 bp, Homo sapiens
aagccttggaaccagcccc

SEQ ID NO: 2321034 - DNA, 19 bp, Homo sapiens
aagcgctcatgttgagcca

SEQ ID NO: 2321035 - DNA, 23 bp, Homo sapiens
aagctaatgacgaggaaccgaaa

SEQ ID NO: 2321036 - DNA, 13 bp, Homo sapiens
aagctaatgtcac

SEQ ID NO: 2321037 - DNA, 20 bp, Homo sapiens
aagctaatgtcacaattatg

SEQ ID NO: 2321038 - DNA, 23 bp, Homo sapiens
aagctaattgtactaatctgaga

SEQ ID NO: 2321039 - DNA, 13 bp, Homo sapiens
aagctagtgtttc

SEQ ID NO: 2321040 - DNA, 14 bp, Homo sapiens
aagctagtgtttct

SEQ ID NO: 2321041 - DNA, 20 bp, Homo sapiens
aagctagtgtttctagctaa

SEQ ID NO: 2321042 - DNA, 21 bp, Homo sapiens
aagctatgagttgaaatgttc

SEQ ID NO: 2321043 - DNA, 14 bp, Homo sapiens
aagctatttaagtg

SEQ ID NO: 2321044 - DNA, 17 bp, Homo sapiens
aagctcaaatgaaatgt

SEQ ID NO: 2321045 - DNA, 16 bp, Homo sapiens
aagctcaattcaagtg

SEQ ID NO: 2321046 - DNA, 16 bp, Homo sapiens
aagctcttactctttc

SEQ ID NO: 2321047 - DNA, 18 bp, Homo sapiens
aagctgaaattttagaaa

SEQ ID NO: 2321048 - DNA, 20 bp, Homo sapiens
aagctgaaattttagaaata

SEQ ID NO: 2321049 - DNA, 22 bp, Homo sapiens
aagctgaaattttagaaatatt

SEQ ID NO: 2321050 - DNA, 22 bp, Homo sapiens
aagctgagttaggtgtctgtcc

SEQ ID NO: 2321051 - DNA, 19 bp, Homo sapiens
aagctgatattatttcttc

SEQ ID NO: 2321052 - DNA, 19 bp, Homo sapiens
aagctgcaaatctgatggc

SEQ ID NO: 2321053 - DNA, 16 bp, Homo sapiens
aagctgcactgtgaac

SEQ ID NO: 2321054 - DNA, 18 bp, Homo sapiens
aatatagacattctcaca

SEQ ID NO: 2321055 - DNA, 13 bp, Homo sapiens
aatatataaacaa

SEQ ID NO: 2321056 - DNA, 23 bp, Homo sapiens
aatatatacacatagttctgtaa

SEQ ID NO: 2321057 - DNA, 16 bp, Homo sapiens
aatatatatacatata

SEQ ID NO: 2321058 - DNA, 21 bp, Homo sapiens
aatatatcttataaagtggaa

SEQ ID NO: 2321059 - DNA, 12 bp, Homo sapiens
aatatatgaaat

SEQ ID NO: 2321060 - DNA, 14 bp, Homo sapiens
aatatatgaaataa

SEQ ID NO: 2321061 - DNA, 20 bp, Homo sapiens
aatatatgccttgtataata

SEQ ID NO: 2321062 - DNA, 19 bp, Homo sapiens
aatatattgaacttttgta

SEQ ID NO: 2321063 - DNA, 20 bp, Homo sapiens
aatatattgaacttttgtac

SEQ ID NO: 2321064 - DNA, 15 bp, Homo sapiens
aatatcagttacagt

SEQ ID NO: 2321065 - DNA, 16 bp, Homo sapiens
aatatcagttacagtg

SEQ ID NO: 2321066 - DNA, 17 bp, Homo sapiens
aatatcagttacagtgg

SEQ ID NO: 2321067 - DNA, 18 bp, Homo sapiens
aatatcagttacagtggc

SEQ ID NO: 2321068 - DNA, 14 bp, Homo sapiens
aatatcatgtgatt

SEQ ID NO: 2321069 - DNA, 17 bp, Homo sapiens
aatatctatttgaataa

SEQ ID NO: 2321070 - DNA, 21 bp, Homo sapiens
aatatgacggaagaacataga

SEQ ID NO: 2321071 - DNA, 15 bp, Homo sapiens
aatatgtaatttcaa

SEQ ID NO: 2321072 - DNA, 19 bp, Homo sapiens
aatatgtaatttcaaaata

SEQ ID NO: 2321073 - DNA, 22 bp, Homo sapiens
aatatgtaatttcaaaatacat

SEQ ID NO: 2321074 - DNA, 18 bp, Homo sapiens
aatattccagatctttca

SEQ ID NO: 2321075 - DNA, 23 bp, Homo sapiens
aatattctgtaactattgggtga

SEQ ID NO: 2321076 - DNA, 17 bp, Homo sapiens
aatattggtatgtaaca

SEQ ID NO: 2321077 - DNA, 20 bp, Homo sapiens
aatattggtgctatttaaca

SEQ ID NO: 2321078 - DNA, 23 bp, Homo sapiens
aatattggtgctatttaacattt

SEQ ID NO: 2321079 - DNA, 16 bp, Homo sapiens
aatattgtttggtaaa

SEQ ID NO: 2321080 - DNA, 11 bp, Homo sapiens
aatatttcatt

SEQ ID NO: 2321081 - DNA, 21 bp, Homo sapiens
aatattttctactttaaattg

SEQ ID NO: 2321082 - DNA, 14 bp, Homo sapiens
aatattttgctgct

SEQ ID NO: 2321083 - DNA, 15 bp, Homo sapiens
aatatttttatatca

SEQ ID NO: 2321084 - DNA, 18 bp, Homo sapiens
aatcaaatgaatgattaa

SEQ ID NO: 2321085 - DNA, 20 bp, Homo sapiens
aatcaaccacctatttttga

SEQ ID NO: 2321086 - DNA, 15 bp, Homo sapiens
aatcaagagaaactt

SEQ ID NO: 2321087 - DNA, 14 bp, Homo sapiens
aatcaatacactag

SEQ ID NO: 2321088 - DNA, 18 bp, Homo sapiens
aatcaatacactagttgt

SEQ ID NO: 2321089 - DNA, 12 bp, Homo sapiens
aatcaatagttg

SEQ ID NO: 2321090 - DNA, 20 bp, Homo sapiens
aatcacaatgagaaaaataa

SEQ ID NO: 2321091 - DNA, 13 bp, Homo sapiens
aatcaccatgtaa

SEQ ID NO: 2321092 - DNA, 15 bp, Homo sapiens
aatcaccatgtaagc

SEQ ID NO: 2321093 - DNA, 13 bp, Homo sapiens
aatcactgctccc

SEQ ID NO: 2321094 - DNA, 22 bp, Homo sapiens
aatcagtcatgtgtaatatgca

SEQ ID NO: 2321095 - DNA, 13 bp, Homo sapiens
aatcataaagtca

SEQ ID NO: 2321096 - DNA, 14 bp, Homo sapiens
aatcataaagtcag

SEQ ID NO: 2321097 - DNA, 13 bp, Homo sapiens
aatcatacaaact

SEQ ID NO: 2321098 - DNA, 14 bp, Homo sapiens
aatcatacaaactc

SEQ ID NO: 2321099 - DNA, 21 bp, Homo sapiens
aatcatacaaactctcaccat

SEQ ID NO: 2321100 - DNA, 13 bp, Homo sapiens
aatcatgagcctg

SEQ ID NO: 2321101 - DNA, 15 bp, Homo sapiens
aatcattcagaaatg

SEQ ID NO: 2321102 - DNA, 16 bp, Homo sapiens
aatcattcagaaatgt

SEQ ID NO: 2321103 - DNA, 16 bp, Homo sapiens
aaccaaaggaaaatgt

SEQ ID NO: 2321104 - DNA, 21 bp, Homo sapiens
aaccaaatgtttattttctac

SEQ ID NO: 2321105 - DNA, 16 bp, Homo sapiens
aaccacattgaagaat

SEQ ID NO: 2321106 - DNA, 20 bp, Homo sapiens
aaccacatttagaaatgttt

SEQ ID NO: 2321107 - DNA, 16 bp, Homo sapiens
aaccactgcttctctt

SEQ ID NO: 2321108 - DNA, 14 bp, Homo sapiens
aaccactgtgccac

SEQ ID NO: 2321109 - DNA, 18 bp, Homo sapiens
aaccactgtgccactgac

SEQ ID NO: 2321110 - DNA, 18 bp, Homo sapiens
aaccagaacgtggtttgc

SEQ ID NO: 2321111 - DNA, 23 bp, Homo sapiens
aaccagagggtgtggctttccag

SEQ ID NO: 2321112 - DNA, 16 bp, Homo sapiens
aaccagccaggcagag

SEQ ID NO: 2321113 - DNA, 14 bp, Homo sapiens
aaccagccggggcc

SEQ ID NO: 2321114 - DNA, 18 bp, Homo sapiens
aaccaggtccagatgtgc

SEQ ID NO: 2321115 - DNA, 14 bp, Homo sapiens
aaccataaattcaa

SEQ ID NO: 2321116 - DNA, 13 bp, Homo sapiens
aaccattaaagtc

SEQ ID NO: 2321117 - DNA, 14 bp, Homo sapiens
aaccattaaagtca

SEQ ID NO: 2321118 - DNA, 15 bp, Homo sapiens
aacccaagtgcctca

SEQ ID NO: 2321119 - DNA, 22 bp, Homo sapiens
aacccagaggtggatgttatga

SEQ ID NO: 2321120 - DNA, 19 bp, Homo sapiens
aaccctatctcctgacaga

SEQ ID NO: 2321121 - DNA, 21 bp, Homo sapiens
aaccctcccagaaacatctct

SEQ ID NO: 2321122 - DNA, 19 bp, Homo sapiens
aacccttcatcttcctgtg

SEQ ID NO: 2321123 - DNA, 20 bp, Homo sapiens
aaccctttgtgtgctctcca

SEQ ID NO: 2321124 - DNA, 16 bp, Homo sapiens
aaccgtctgttatgct

SEQ ID NO: 2321125 - DNA, 18 bp, Homo sapiens
aaccgtctgttatgctgt

SEQ ID NO: 2321126 - DNA, 18 bp, Homo sapiens
aaccgtggtatgtctgcc

SEQ ID NO: 2321127 - DNA, 18 bp, Homo sapiens
aacctacctcccacactc

SEQ ID NO: 2321128 - DNA, 22 bp, Homo sapiens
aacctacctcccacactcccaa

SEQ ID NO: 2321129 - DNA, 18 bp, Homo sapiens
aacctcaactgcctactc

SEQ ID NO: 2321130 - DNA, 20 bp, Homo sapiens
aacctcaccttcctgtgggt

SEQ ID NO: 2321131 - DNA, 18 bp, Homo sapiens
aacctcagggctcccagg

SEQ ID NO: 2321132 - DNA, 19 bp, Homo sapiens
aacctcagggctcccaggg

SEQ ID NO: 2321133 - DNA, 16 bp, Homo sapiens
aacctctcgccatgat

SEQ ID NO: 2321134 - DNA, 16 bp, Homo sapiens
aacctctttttcctcc

SEQ ID NO: 2321135 - DNA, 23 bp, Homo sapiens
aacctctttttcctcctggacac

SEQ ID NO: 2321136 - DNA, 16 bp, Homo sapiens
aacctgacccctgctc

SEQ ID NO: 2321137 - DNA, 17 bp, Homo sapiens
aacctgacccctgctca

SEQ ID NO: 2321138 - DNA, 22 bp, Homo sapiens
aacctgagctattttcctctgg

SEQ ID NO: 2321139 - DNA, 19 bp, Homo sapiens
aacctgcacacaggacagc

SEQ ID NO: 2321140 - DNA, 14 bp, Homo sapiens
aacctgcctgtgca

SEQ ID NO: 2321141 - DNA, 16 bp, Homo sapiens
aacctgctctcctctt

SEQ ID NO: 2321142 - DNA, 17 bp, Homo sapiens
aacctgctctcctcttc

SEQ ID NO: 2321143 - DNA, 18 bp, Homo sapiens
aacctgctctgtccccaa

SEQ ID NO: 2321144 - DNA, 22 bp, Homo sapiens
aacctgtattactgaataatat

SEQ ID NO: 2321145 - DNA, 15 bp, Homo sapiens
aaccttcgtcctttt

SEQ ID NO: 2321146 - DNA, 20 bp, Homo sapiens
aaccttggaccactcctgtc

SEQ ID NO: 2321147 - DNA, 14 bp, Homo sapiens
aaccttgtataaat

SEQ ID NO: 2321148 - DNA, 16 bp, Homo sapiens
aaccttgtataaatta

SEQ ID NO: 2321149 - DNA, 19 bp, Homo sapiens
aaccttgtataaattattc

SEQ ID NO: 2321150 - DNA, 15 bp, Homo sapiens
aaccttttttaagat

SEQ ID NO: 2321151 - DNA, 18 bp, Homo sapiens
aaccttttttaagatttt

SEQ ID NO: 2321152 - DNA, 22 bp, Homo sapiens
aaccttttttaagatttttctc

SEQ ID NO: 2321153 - DNA, 23 bp, Homo sapiens
aaccttttttaagatttttctca

SEQ ID NO: 2321154 - DNA, 18 bp, Homo sapiens
aacgaatggtctttgctc

SEQ ID NO: 2321155 - DNA, 20 bp, Homo sapiens
aacgcattgccacggaaaca

SEQ ID NO: 2321156 - DNA, 19 bp, Homo sapiens
aacgggaacatgccccctg

SEQ ID NO: 2321157 - DNA, 19 bp, Homo sapiens
aacggtgcccatcctgcca

SEQ ID NO: 2321158 - DNA, 15 bp, Homo sapiens
aacggttcctggtga

SEQ ID NO: 2321159 - DNA, 19 bp, Homo sapiens
aacggttcctggtgactcc

SEQ ID NO: 2321160 - DNA, 19 bp, Homo sapiens
aacgtgatttttaaattaa

SEQ ID NO: 2321161 - DNA, 21 bp, Homo sapiens
aacgtgatttttaaattaaat

SEQ ID NO: 2321162 - DNA, 18 bp, Homo sapiens
aacgttttcttctttccc

SEQ ID NO: 2321163 - DNA, 20 bp, Homo sapiens
aacgttttcttctttccctg

SEQ ID NO: 2321164 - DNA, 21 bp, Homo sapiens
aacgttttcttctttccctgg

SEQ ID NO: 2321165 - DNA, 22 bp, Homo sapiens
aacgttttcttctttccctgga

SEQ ID NO: 2321166 - DNA, 15 bp, Homo sapiens
aactaatatatgaaa

SEQ ID NO: 2321167 - DNA, 20 bp, Homo sapiens
aactaatgtttgaacaaagc

SEQ ID NO: 2321168 - DNA, 12 bp, Homo sapiens
aactacaaatat

SEQ ID NO: 2321169 - DNA, 23 bp, Homo sapiens
aactacagtgattcatgtagaga

SEQ ID NO: 2321170 - DNA, 22 bp, Homo sapiens
aactagccagacaaaatttgag

SEQ ID NO: 2321171 - DNA, 21 bp, Homo sapiens
aactataaacttaaagctact

SEQ ID NO: 2321172 - DNA, 20 bp, Homo sapiens
aactataagatacaataaaa

SEQ ID NO: 2321173 - DNA, 20 bp, Homo sapiens
aactatgttcctaacaaaat

SEQ ID NO: 2321174 - DNA, 20 bp, Homo sapiens
aactattagagtatttccct

SEQ ID NO: 2321175 - DNA, 15 bp, Homo sapiens
aactattgggtgaat

SEQ ID NO: 2321176 - DNA, 21 bp, Homo sapiens
aactattgtgctcagagacac

SEQ ID NO: 2321177 - DNA, 22 bp, Homo sapiens
aactcaaggataccttcttatt

SEQ ID NO: 2321178 - DNA, 20 bp, Homo sapiens
aactcaccagccccactgcc

SEQ ID NO: 2321179 - DNA, 21 bp, Homo sapiens
aactcacctaatgtttatgag

SEQ ID NO: 2321180 - DNA, 17 bp, Homo sapiens
aactcacctctcaaggt

SEQ ID NO: 2321181 - DNA, 16 bp, Homo sapiens
aactcagacattccaa

SEQ ID NO: 2321182 - DNA, 24 bp, Homo sapiens
aactcatcctcttttaatggcatt

SEQ ID NO: 2321183 - DNA, 14 bp, Homo sapiens
aactccacatctgc

SEQ ID NO: 2321184 - DNA, 15 bp, Homo sapiens
aactccacatctgcc

SEQ ID NO: 2321185 - DNA, 13 bp, Homo sapiens
aactcctgccagg

SEQ ID NO: 2321186 - DNA, 17 bp, Homo sapiens
aactccttcctggcctg

SEQ ID NO: 2321187 - DNA, 16 bp, Homo sapiens
aactcgcgctcagtaa

SEQ ID NO: 2321188 - DNA, 14 bp, Homo sapiens
aactctctttcctt

SEQ ID NO: 2321189 - DNA, 17 bp, Homo sapiens
aagagcttgctccagat

SEQ ID NO: 2321190 - DNA, 22 bp, Homo sapiens
aagagcttgctccagattctga

SEQ ID NO: 2321191 - DNA, 19 bp, Homo sapiens
aagaggcaagctgaaattt

SEQ ID NO: 2321192 - DNA, 21 bp, Homo sapiens
aagaggctgcccctctcacca

SEQ ID NO: 2321193 - DNA, 22 bp, Homo sapiens
aagagtgtagaagcattccttc

SEQ ID NO: 2321194 - DNA, 19 bp, Homo sapiens
aagagttggggacagaact

SEQ ID NO: 2321195 - DNA, 18 bp, Homo sapiens
aagagtttcagtttgttg

SEQ ID NO: 2321196 - DNA, 21 bp, Homo sapiens
aagagtttcagtttgttggaa

SEQ ID NO: 2321197 - DNA, 23 bp, Homo sapiens
aagagttttgggagttgtagtta

SEQ ID NO: 2321198 - DNA, 16 bp, Homo sapiens
aagatagtcttggaag

SEQ ID NO: 2321199 - DNA, 15 bp, Homo sapiens
aagatagtgtaactt

SEQ ID NO: 2321200 - DNA, 13 bp, Homo sapiens
aagatagttgtaa

SEQ ID NO: 2321201 - DNA, 22 bp, Homo sapiens
aagatattgtatctcctttaat

SEQ ID NO: 2321202 - DNA, 23 bp, Homo sapiens
aagatccgagtgtgatttgaatt

SEQ ID NO: 2321203 - DNA, 16 bp, Homo sapiens
aagatctttttttaag

SEQ ID NO: 2321204 - DNA, 21 bp, Homo sapiens
aagatggacacgagccacaag

SEQ ID NO: 2321205 - DNA, 23 bp, Homo sapiens
aagatgggggcagggctgtgctt

SEQ ID NO: 2321206 - DNA, 11 bp, Homo sapiens
aagatgtgaat

SEQ ID NO: 2321207 - DNA, 15 bp, Homo sapiens
aagatgtgaattatt

SEQ ID NO: 2321208 - DNA, 16 bp, Homo sapiens
aagatgtgaattattg

SEQ ID NO: 2321209 - DNA, 20 bp, Homo sapiens
aagatgtgaattattgacac

SEQ ID NO: 2321210 - DNA, 23 bp, Homo sapiens
aagatgtgaattattgacactga

SEQ ID NO: 2321211 - DNA, 17 bp, Homo sapiens
aagatgtgttcttattt

SEQ ID NO: 2321212 - DNA, 16 bp, Homo sapiens
aagattatatgaagtt

SEQ ID NO: 2321213 - DNA, 15 bp, Homo sapiens
aagatttcatatcta

SEQ ID NO: 2321214 - DNA, 20 bp, Homo sapiens
aagatttcatatctaacttt

SEQ ID NO: 2321215 - DNA, 23 bp, Homo sapiens
aagattttattcttatttcattt

SEQ ID NO: 2321216 - DNA, 16 bp, Homo sapiens
aagattttcctcttgt

SEQ ID NO: 2321217 - DNA, 19 bp, Homo sapiens
aagattttcctcttgtgat

SEQ ID NO: 2321218 - DNA, 15 bp, Homo sapiens
aagatttttctcaaa

SEQ ID NO: 2321219 - DNA, 19 bp, Homo sapiens
aagatttttctcaaagttt

SEQ ID NO: 2321220 - DNA, 21 bp, Homo sapiens
aagatttttctcaaagttttg

SEQ ID NO: 2321221 - DNA, 12 bp, Homo sapiens
aagcaaagggga

SEQ ID NO: 2321222 - DNA, 17 bp, Homo sapiens
aagcaaatgttaaaagt

SEQ ID NO: 2321223 - DNA, 13 bp, Homo sapiens
aatgttaaaggga

SEQ ID NO: 2321224 - DNA, 13 bp, Homo sapiens
aatgttaaatttg

SEQ ID NO: 2321225 - DNA, 17 bp, Homo sapiens
aatgttaaatttgtaag

SEQ ID NO: 2321226 - DNA, 18 bp, Homo sapiens
aatgttaaatttgtaagt

SEQ ID NO: 2321227 - DNA, 18 bp, Homo sapiens
aatgttaaggaaactctt

SEQ ID NO: 2321228 - DNA, 16 bp, Homo sapiens
aatgttacttctgata

SEQ ID NO: 2321229 - DNA, 12 bp, Homo sapiens
aatgttagagta

SEQ ID NO: 2321230 - DNA, 17 bp, Homo sapiens
aatgttgtattcagtga

SEQ ID NO: 2321231 - DNA, 15 bp, Homo sapiens
aatgtttatgagcca

SEQ ID NO: 2321232 - DNA, 12 bp, Homo sapiens
aatgttttatga

SEQ ID NO: 2321233 - DNA, 19 bp, Homo sapiens
aatgttttatgacattttt

SEQ ID NO: 2321234 - DNA, 16 bp, Homo sapiens
aatgttttcaaaaggt

SEQ ID NO: 2321235 - DNA, 18 bp, Homo sapiens
aatgtttttccctcccca

SEQ ID NO: 2321236 - DNA, 20 bp, Homo sapiens
aatgtttttccctccccaga

SEQ ID NO: 2321237 - DNA, 14 bp, Homo sapiens
aattaaaacaaata

SEQ ID NO: 2321238 - DNA, 21 bp, Homo sapiens
aattaaaacaaatatacattt

SEQ ID NO: 2321239 - DNA, 16 bp, Homo sapiens
aattaaaagtcttttt

SEQ ID NO: 2321240 - DNA, 22 bp, Homo sapiens
aattaaacttccaaagaaagtt

SEQ ID NO: 2321241 - DNA, 13 bp, Homo sapiens
aattaaattttag

SEQ ID NO: 2321242 - DNA, 22 bp, Homo sapiens
aattaagcaaatgttaaaagtt

SEQ ID NO: 2321243 - DNA, 16 bp, Homo sapiens
aattaagcattttgaa

SEQ ID NO: 2321244 - DNA, 19 bp, Homo sapiens
aattaatatattaaaattc

SEQ ID NO: 2321245 - DNA, 13 bp, Homo sapiens
aattaccagtttt

SEQ ID NO: 2321246 - DNA, 20 bp, Homo sapiens
aattacctttaattttaatg

SEQ ID NO: 2321247 - DNA, 18 bp, Homo sapiens
aattacctttacatatat

SEQ ID NO: 2321248 - DNA, 16 bp, Homo sapiens
aattacttcttagtat

SEQ ID NO: 2321249 - DNA, 22 bp, Homo sapiens
aattagtgtgacagtttccaaa

SEQ ID NO: 2321250 - DNA, 17 bp, Homo sapiens
aattagttccagtttct

SEQ ID NO: 2321251 - DNA, 19 bp, Homo sapiens
aattagttccagtttctcc

SEQ ID NO: 2321252 - DNA, 19 bp, Homo sapiens
aattatagtgtagaaaaga

SEQ ID NO: 2321253 - DNA, 16 bp, Homo sapiens
aattatcagcaaagaa

SEQ ID NO: 2321254 - DNA, 19 bp, Homo sapiens
aattatcagcaaagaaaaa

SEQ ID NO: 2321255 - DNA, 20 bp, Homo sapiens
aattatcagcaaagaaaaaa

SEQ ID NO: 2321256 - DNA, 21 bp, Homo sapiens
aattatcagcaaagaaaaaaa

SEQ ID NO: 2321257 - DNA, 23 bp, Homo sapiens
aattatcattgtttgtcctttat

SEQ ID NO: 2321258 - DNA, 17 bp, Homo sapiens
aattatgagattggttt

SEQ ID NO: 2321259 - DNA, 21 bp, Homo sapiens
aattatgggagaagtgggggc

SEQ ID NO: 2321260 - DNA, 17 bp, Homo sapiens
aattattgacactgaac

SEQ ID NO: 2321261 - DNA, 12 bp, Homo sapiens
aattatttgaag

SEQ ID NO: 2321262 - DNA, 19 bp, Homo sapiens
aattatttgaagatttaat

SEQ ID NO: 2321263 - DNA, 19 bp, Homo sapiens
aattcaaagcatggacatt

SEQ ID NO: 2321264 - DNA, 20 bp, Homo sapiens
aattcaagagctagaaaaat

SEQ ID NO: 2321265 - DNA, 17 bp, Homo sapiens
aattcaatcctactttt

SEQ ID NO: 2321266 - DNA, 22 bp, Homo sapiens
aattcaatgccgcaacatatag

SEQ ID NO: 2321267 - DNA, 22 bp, Homo sapiens
aattcatggcatgcttaaattt

SEQ ID NO: 2321268 - DNA, 16 bp, Homo sapiens
aattcctggcatgaca

SEQ ID NO: 2321269 - DNA, 21 bp, Homo sapiens
aattctaacccaagacatgac

SEQ ID NO: 2321270 - DNA, 20 bp, Homo sapiens
aattctagtgtccataaata

SEQ ID NO: 2321271 - DNA, 16 bp, Homo sapiens
aattctcaagacctga

SEQ ID NO: 2321272 - DNA, 23 bp, Homo sapiens
aattctgattctggctttaagcc

SEQ ID NO: 2321273 - DNA, 15 bp, Homo sapiens
aattctgtttaattt

SEQ ID NO: 2321274 - DNA, 13 bp, Homo sapiens
aattcttctgaac

SEQ ID NO: 2321275 - DNA, 15 bp, Homo sapiens
aattcttctgaactc

SEQ ID NO: 2321276 - DNA, 14 bp, Homo sapiens
aattcttttctgag

SEQ ID NO: 2321277 - DNA, 17 bp, Homo sapiens
aattgcattattttata

SEQ ID NO: 2321278 - DNA, 15 bp, Homo sapiens
aattgccagcaaata

SEQ ID NO: 2321279 - DNA, 18 bp, Homo sapiens
aattgctgactgtagctt

SEQ ID NO: 2321280 - DNA, 11 bp, Homo sapiens
aattggccatg

SEQ ID NO: 2321281 - DNA, 16 bp, Homo sapiens
aattggtaattacctg

SEQ ID NO: 2321282 - DNA, 17 bp, Homo sapiens
acacagaggagtgcagc

SEQ ID NO: 2321283 - DNA, 16 bp, Homo sapiens
acacaggacagcggga

SEQ ID NO: 2321284 - DNA, 14 bp, Homo sapiens
acacagtgtctgtt

SEQ ID NO: 2321285 - DNA, 16 bp, Homo sapiens
acacatcttaaaagtg

SEQ ID NO: 2321286 - DNA, 16 bp, Homo sapiens
acacattgaaactgta

SEQ ID NO: 2321287 - DNA, 19 bp, Homo sapiens
acacatttgctactgttgt

SEQ ID NO: 2321288 - DNA, 19 bp, Homo sapiens
acaccacttagatttaaag

SEQ ID NO: 2321289 - DNA, 20 bp, Homo sapiens
acaccagagcagatgcagag

SEQ ID NO: 2321290 - DNA, 15 bp, Homo sapiens
acaccattaccaaaa

SEQ ID NO: 2321291 - DNA, 23 bp, Homo sapiens
acacccaggggaaggccctgagg

SEQ ID NO: 2321292 - DNA, 16 bp, Homo sapiens
acacccatttttcctt

SEQ ID NO: 2321293 - DNA, 13 bp, Homo sapiens
acacccctctgtc

SEQ ID NO: 2321294 - DNA, 22 bp, Homo sapiens
acacccttctcccactctccta

SEQ ID NO: 2321295 - DNA, 19 bp, Homo sapiens
acacctattatcccagctg

SEQ ID NO: 2321296 - DNA, 20 bp, Homo sapiens
acacctattatcccagctgc

SEQ ID NO: 2321297 - DNA, 19 bp, Homo sapiens
acacctggctgaggttcct

SEQ ID NO: 2321298 - DNA, 17 bp, Homo sapiens
acaccttttaactcacc

SEQ ID NO: 2321299 - DNA, 17 bp, Homo sapiens
acacgagcaaacccaga

SEQ ID NO: 2321300 - DNA, 18 bp, Homo sapiens
acacgagcaaacccagag

SEQ ID NO: 2321301 - DNA, 19 bp, Homo sapiens
acacgagccacaagctgca

SEQ ID NO: 2321302 - DNA, 14 bp, Homo sapiens
acacgatgcattta

SEQ ID NO: 2321303 - DNA, 21 bp, Homo sapiens
acacgatgcatttaataaaga

SEQ ID NO: 2321304 - DNA, 23 bp, Homo sapiens
acacgatgttgtcaaggatggtt

SEQ ID NO: 2321305 - DNA, 20 bp, Homo sapiens
acacgattttcaagattcta

SEQ ID NO: 2321306 - DNA, 17 bp, Homo sapiens
acacggcagctgtagct

SEQ ID NO: 2321307 - DNA, 20 bp, Homo sapiens
acactaactcaccagcccca

SEQ ID NO: 2321308 - DNA, 16 bp, Homo sapiens
acactaccaaacactc

SEQ ID NO: 2321309 - DNA, 20 bp, Homo sapiens
acactcagtccactgttgag

SEQ ID NO: 2321310 - DNA, 14 bp, Homo sapiens
acactccagggaca

SEQ ID NO: 2321311 - DNA, 20 bp, Homo sapiens
acactcccaaggttggagcc

SEQ ID NO: 2321312 - DNA, 15 bp, Homo sapiens
acactcgtcacccca

SEQ ID NO: 2321313 - DNA, 19 bp, Homo sapiens
acactctagtgacttcctg

SEQ ID NO: 2321314 - DNA, 20 bp, Homo sapiens
acactctagtgacttcctgg

SEQ ID NO: 2321315 - DNA, 23 bp, Homo sapiens
acactctagtgacttcctggtga

SEQ ID NO: 2321316 - DNA, 22 bp, Homo sapiens
acactgaaaagaaggaaagatg

SEQ ID NO: 2321317 - DNA, 12 bp, Homo sapiens
acactgaactta

SEQ ID NO: 2321318 - DNA, 19 bp, Homo sapiens
acactgttgataaaaactc

SEQ ID NO: 2321319 - DNA, 19 bp, Homo sapiens
acacttagggtttggagct

SEQ ID NO: 2321320 - DNA, 13 bp, Homo sapiens
acagaaagctgcc

SEQ ID NO: 2321321 - DNA, 19 bp, Homo sapiens
acagaaatgctgctggcca

SEQ ID NO: 2321322 - DNA, 15 bp, Homo sapiens
acagaacagcttcag

SEQ ID NO: 2321323 - DNA, 17 bp, Homo sapiens
acagaacagcttcaggt

SEQ ID NO: 2321324 - DNA, 21 bp, Homo sapiens
acagaacatatgttgcaagac

SEQ ID NO: 2321325 - DNA, 18 bp, Homo sapiens
acagaagcacatgcacct

SEQ ID NO: 2321326 - DNA, 12 bp, Homo sapiens
acagaatatttc

SEQ ID NO: 2321327 - DNA, 19 bp, Homo sapiens
acagaatatttctattgaa

SEQ ID NO: 2321328 - DNA, 21 bp, Homo sapiens
acagaatatttctattgaatt

SEQ ID NO: 2321329 - DNA, 13 bp, Homo sapiens
acagaatcttctg

SEQ ID NO: 2321330 - DNA, 14 bp, Homo sapiens
acagaatgctcagg

SEQ ID NO: 2321331 - DNA, 15 bp, Homo sapiens
acagaatgctcaggg

SEQ ID NO: 2321332 - DNA, 14 bp, Homo sapiens
acagacactggcat

SEQ ID NO: 2321333 - DNA, 18 bp, Homo sapiens
acagacccctcgcaactg

SEQ ID NO: 2321334 - DNA, 18 bp, Homo sapiens
acagagacaagtaatttc

SEQ ID NO: 2321335 - DNA, 18 bp, Homo sapiens
acagagactgtttgaatg

SEQ ID NO: 2321336 - DNA, 13 bp, Homo sapiens
acagagcctggcc

SEQ ID NO: 2321337 - DNA, 12 bp, Homo sapiens
acagaggaaagg

SEQ ID NO: 2321338 - DNA, 21 bp, Homo sapiens
acagaggctgcacccctgggc

SEQ ID NO: 2321339 - DNA, 22 bp, Homo sapiens
acagaggctgcacccctgggcc

SEQ ID NO: 2321340 - DNA, 13 bp, Homo sapiens
acagataagcaag

SEQ ID NO: 2321341 - DNA, 21 bp, Homo sapiens
acagataagcaagagagatgt

SEQ ID NO: 2321342 - DNA, 20 bp, Homo sapiens
acagattctttcagttcttt

SEQ ID NO: 2321343 - DNA, 17 bp, Homo sapiens
acagcaacaatttatga

SEQ ID NO: 2321344 - DNA, 15 bp, Homo sapiens
acagcatcccttccc

SEQ ID NO: 2321345 - DNA, 22 bp, Homo sapiens
agataccacaaaccctgctgaa

SEQ ID NO: 2321346 - DNA, 19 bp, Homo sapiens
agataccttgcaaagcaac

SEQ ID NO: 2321347 - DNA, 13 bp, Homo sapiens
agatagttgtaaa

SEQ ID NO: 2321348 - DNA, 17 bp, Homo sapiens
agatagttgtaaagata

SEQ ID NO: 2321349 - DNA, 12 bp, Homo sapiens
agatatcctctc

SEQ ID NO: 2321350 - DNA, 13 bp, Homo sapiens
agatatcctctcc

SEQ ID NO: 2321351 - DNA, 17 bp, Homo sapiens
agatatcctctccccct

SEQ ID NO: 2321352 - DNA, 18 bp, Homo sapiens
agatatcctctccccctc

SEQ ID NO: 2321353 - DNA, 18 bp, Homo sapiens
agatattgtgaagtacat

SEQ ID NO: 2321354 - DNA, 20 bp, Homo sapiens
agatatttttatctttatat

SEQ ID NO: 2321355 - DNA, 21 bp, Homo sapiens
agatatttttatctttatatg

SEQ ID NO: 2321356 - DNA, 14 bp, Homo sapiens
agatcaaatagttg

SEQ ID NO: 2321357 - DNA, 23 bp, Homo sapiens
agatcactgtagtttagttctgt

SEQ ID NO: 2321358 - DNA, 17 bp, Homo sapiens
agatccctgcagaaccc

SEQ ID NO: 2321359 - DNA, 14 bp, Homo sapiens
agatcctaagatgt

SEQ ID NO: 2321360 - DNA, 21 bp, Homo sapiens
agatcgagaccatcctggcta

SEQ ID NO: 2321361 - DNA, 23 bp, Homo sapiens
agatctgatttgtaacccactga

SEQ ID NO: 2321362 - DNA, 17 bp, Homo sapiens
agatctttcagaaatat

SEQ ID NO: 2321363 - DNA, 20 bp, Homo sapiens
agatctttcagaaatataac

SEQ ID NO: 2321364 - DNA, 21 bp, Homo sapiens
agatctttcagaaatataaca

SEQ ID NO: 2321365 - DNA, 14 bp, Homo sapiens
agatctttctcttc

SEQ ID NO: 2321366 - DNA, 19 bp, Homo sapiens
agatgagcaaccacattta

SEQ ID NO: 2321367 - DNA, 21 bp, Homo sapiens
agatgaggtcagttgtgtttt

SEQ ID NO: 2321368 - DNA, 15 bp, Homo sapiens
agatgatgatgttaa

SEQ ID NO: 2321369 - DNA, 12 bp, Homo sapiens
agatgcagagag

SEQ ID NO: 2321370 - DNA, 17 bp, Homo sapiens
agatgccaccctagcca

SEQ ID NO: 2321371 - DNA, 15 bp, Homo sapiens
agatgccccattcct

SEQ ID NO: 2321372 - DNA, 23 bp, Homo sapiens
agatgccccattccttgcgcctc

SEQ ID NO: 2321373 - DNA, 16 bp, Homo sapiens
agatgcctgcttgata

SEQ ID NO: 2321374 - DNA, 13 bp, Homo sapiens
agatgcttctctc

SEQ ID NO: 2321375 - DNA, 16 bp, Homo sapiens
agatgcttctctcctt

SEQ ID NO: 2321376 - DNA, 19 bp, Homo sapiens
agatggacacgagccacaa

SEQ ID NO: 2321377 - DNA, 13 bp, Homo sapiens
agatggagaggct

SEQ ID NO: 2321378 - DNA, 14 bp, Homo sapiens
agatggagaggctg

SEQ ID NO: 2321379 - DNA, 22 bp, Homo sapiens
agatggagaggctgagggacag

SEQ ID NO: 2321380 - DNA, 18 bp, Homo sapiens
agatgggaatgaggtggg

SEQ ID NO: 2321381 - DNA, 15 bp, Homo sapiens
agatggttaaacatt

SEQ ID NO: 2321382 - DNA, 21 bp, Homo sapiens
agatgtctatgtagctgaaaa

SEQ ID NO: 2321383 - DNA, 15 bp, Homo sapiens
agatgtcttccctgg

SEQ ID NO: 2321384 - DNA, 16 bp, Homo sapiens
agatgtcttccctggg

SEQ ID NO: 2321385 - DNA, 20 bp, Homo sapiens
agatgtgaattattgacact

SEQ ID NO: 2321386 - DNA, 23 bp, Homo sapiens
agatgtgaattattgacactgaa

SEQ ID NO: 2321387 - DNA, 22 bp, Homo sapiens
agatgtgagccaccgtgcctgg

SEQ ID NO: 2321388 - DNA, 16 bp, Homo sapiens
agatgtggatttggca

SEQ ID NO: 2321389 - DNA, 16 bp, Homo sapiens
agatgtgttcttattt

SEQ ID NO: 2321390 - DNA, 16 bp, Homo sapiens
agatgtttcattttac

SEQ ID NO: 2321391 - DNA, 23 bp, Homo sapiens
agatgtttcattttactgtatat

SEQ ID NO: 2321392 - DNA, 21 bp, Homo sapiens
agattaataagatttttcaaa

SEQ ID NO: 2321393 - DNA, 15 bp, Homo sapiens
agattactttgtccc

SEQ ID NO: 2321394 - DNA, 19 bp, Homo sapiens
agattattcataatgtgag

SEQ ID NO: 2321395 - DNA, 16 bp, Homo sapiens
agattcatgaaaatgt

SEQ ID NO: 2321396 - DNA, 14 bp, Homo sapiens
agattctgatgcat

SEQ ID NO: 2321397 - DNA, 14 bp, Homo sapiens
agattctgcctctc

SEQ ID NO: 2321398 - DNA, 15 bp, Homo sapiens
agattctgcctctct

SEQ ID NO: 2321399 - DNA, 13 bp, Homo sapiens
agattcttaattc

SEQ ID NO: 2321400 - DNA, 21 bp, Homo sapiens
agattctttcagttctttgga

SEQ ID NO: 2321401 - DNA, 21 bp, Homo sapiens
agattgactaactcaaataca

SEQ ID NO: 2321402 - DNA, 17 bp, Homo sapiens
agattgagaaatgtgta

SEQ ID NO: 2321403 - DNA, 17 bp, Homo sapiens
agattgctctgccccac

SEQ ID NO: 2321404 - DNA, 22 bp, Homo sapiens
agattgctgaaattttatatgc

SEQ ID NO: 2321405 - DNA, 12 bp, Homo sapiens
agattggaaatg

SEQ ID NO: 2321406 - DNA, 17 bp, Homo sapiens
agattgggatactgtaa

SEQ ID NO: 2321407 - DNA, 15 bp, Homo sapiens
agattggttttcctg

SEQ ID NO: 2321408 - DNA, 13 bp, Homo sapiens
agattgttagata

SEQ ID NO: 2321409 - DNA, 18 bp, Homo sapiens
agatttctcattgacttt

SEQ ID NO: 2321410 - DNA, 16 bp, Homo sapiens
agattttagaattctt

SEQ ID NO: 2321411 - DNA, 15 bp, Homo sapiens
agattttatgtttaa

SEQ ID NO: 2321412 - DNA, 16 bp, Homo sapiens
agattttatgtttaaa

SEQ ID NO: 2321413 - DNA, 14 bp, Homo sapiens
agattttattatgt

SEQ ID NO: 2321414 - DNA, 19 bp, Homo sapiens
agattttcagcaaactctt

SEQ ID NO: 2321415 - DNA, 14 bp, Homo sapiens
agcaaaaaagagtt

SEQ ID NO: 2321416 - DNA, 18 bp, Homo sapiens
agcaaaatctaaaatgtt

SEQ ID NO: 2321417 - DNA, 17 bp, Homo sapiens
agcaaactcttttccca

SEQ ID NO: 2321418 - DNA, 14 bp, Homo sapiens
agcaaataaatacg

SEQ ID NO: 2321419 - DNA, 17 bp, Homo sapiens
agcaacagcctttgaat

SEQ ID NO: 2321420 - DNA, 22 bp, Homo sapiens
agcaacagcctttgaatgtaac

SEQ ID NO: 2321421 - DNA, 22 bp, Homo sapiens
agcaacattataatggccctgt

SEQ ID NO: 2321422 - DNA, 13 bp, Homo sapiens
agcaacatttgta

SEQ ID NO: 2321423 - DNA, 16 bp, Homo sapiens
agcaactaggccttca

SEQ ID NO: 2321424 - DNA, 18 bp, Homo sapiens
agcaactctccactccat

SEQ ID NO: 2321425 - DNA, 15 bp, Homo sapiens
agcaacttcttctcc

SEQ ID NO: 2321426 - DNA, 15 bp, Homo sapiens
agcaagactgggccc

SEQ ID NO: 2321427 - DNA, 14 bp, Homo sapiens
agcaagccagacct

SEQ ID NO: 2321428 - DNA, 21 bp, Homo sapiens
agcaagtgttcactgctcctt

SEQ ID NO: 2321429 - DNA, 22 bp, Homo sapiens
agcaatcaaggttataattttt

SEQ ID NO: 2321430 - DNA, 13 bp, Homo sapiens
agcaatcctcctg

SEQ ID NO: 2321431 - DNA, 16 bp, Homo sapiens
agcaatcctcctgcct

SEQ ID NO: 2321432 - DNA, 21 bp, Homo sapiens
agcaatcctcctgcctcagcc

SEQ ID NO: 2321433 - DNA, 23 bp, Homo sapiens
agcaatcctcctgcctcagcctt

SEQ ID NO: 2321434 - DNA, 15 bp, Homo sapiens
agcaatctcttcatt

SEQ ID NO: 2321435 - DNA, 18 bp, Homo sapiens
agcaatctcttcattatt

SEQ ID NO: 2321436 - DNA, 16 bp, Homo sapiens
agcaattctctttctt

SEQ ID NO: 2321437 - DNA, 15 bp, Homo sapiens
agcaatttagacaaa

SEQ ID NO: 2321438 - DNA, 15 bp, Homo sapiens
agcacagagcctggc

SEQ ID NO: 2321439 - DNA, 21 bp, Homo sapiens
agcacagagcctggccccagg

SEQ ID NO: 2321440 - DNA, 13 bp, Homo sapiens
agcacagcagctt

SEQ ID NO: 2321441 - DNA, 17 bp, Homo sapiens
agcacagtatttaacat

SEQ ID NO: 2321442 - DNA, 20 bp, Homo sapiens
agcacagtatttaacattct

SEQ ID NO: 2321443 - DNA, 13 bp, Homo sapiens
agcaccctctgga

SEQ ID NO: 2321444 - DNA, 20 bp, Homo sapiens
agcaccgtgtcaagctgctc

SEQ ID NO: 2321445 - DNA, 21 bp, Homo sapiens
agcaccgtgtcaagctgctct

SEQ ID NO: 2321446 - DNA, 14 bp, Homo sapiens
agcacctccagcct

SEQ ID NO: 2321447 - DNA, 20 bp, Homo sapiens
agcactgagctcacatggga

SEQ ID NO: 2321448 - DNA, 12 bp, Homo sapiens
agcactggactc

SEQ ID NO: 2321449 - DNA, 19 bp, Homo sapiens
agcagaaaaaaaagtgtct

SEQ ID NO: 2321450 - DNA, 23 bp, Homo sapiens
agcagaaaaaaaagtgtctcaaa

SEQ ID NO: 2321451 - DNA, 15 bp, Homo sapiens
agcagaacctgcaca

SEQ ID NO: 2321452 - DNA, 18 bp, Homo sapiens
agcagaacctgcacacag

SEQ ID NO: 2321453 - DNA, 22 bp, Homo sapiens
agcagaacctgcacacaggaca

SEQ ID NO: 2321454 - DNA, 13 bp, Homo sapiens
agcagaagcctcc

SEQ ID NO: 2321455 - DNA, 16 bp, Homo sapiens
agcagaagtctggctt

SEQ ID NO: 2321456 - DNA, 11 bp, Homo sapiens
agcagacattt

SEQ ID NO: 2321457 - DNA, 19 bp, Homo sapiens
agcagagttttcattaaat

SEQ ID NO: 2321458 - DNA, 23 bp, Homo sapiens
agcagagttttcattaaatcctt

SEQ ID NO: 2321459 - DNA, 22 bp, Homo sapiens
agcagataccttgcaaagcaac

SEQ ID NO: 2321460 - DNA, 16 bp, Homo sapiens
agcagatgcagagagc

SEQ ID NO: 2321461 - DNA, 22 bp, Homo sapiens
agcagatgctgttgtgaagcta

SEQ ID NO: 2321462 - DNA, 24 bp, Homo sapiens
agccctactccctgcagatgccac

SEQ ID NO: 2321463 - DNA, 16 bp, Homo sapiens
agccctcagttccttc

SEQ ID NO: 2321464 - DNA, 12 bp, Homo sapiens
agcccttccctg

SEQ ID NO: 2321465 - DNA, 13 bp, Homo sapiens
agcccttccctga

SEQ ID NO: 2321466 - DNA, 16 bp, Homo sapiens
aggatctaagggaaga

SEQ ID NO: 2321467 - DNA, 14 bp, Homo sapiens
aggatctctaaaga

SEQ ID NO: 2321468 - DNA, 13 bp, Homo sapiens
aggatctgctgag

SEQ ID NO: 2321469 - DNA, 16 bp, Homo sapiens
aggatctgctgaggcc

SEQ ID NO: 2321470 - DNA, 19 bp, Homo sapiens
aggatctgctgaggcccag

SEQ ID NO: 2321471 - DNA, 17 bp, Homo sapiens
aggatgagagcccagag

SEQ ID NO: 2321472 - DNA, 23 bp, Homo sapiens
aggatgagagcccagaggtaaca

SEQ ID NO: 2321473 - DNA, 24 bp, Homo sapiens
aggatgatgccagttacttgcttt

SEQ ID NO: 2321474 - DNA, 22 bp, Homo sapiens
aggatgcaacaaatgtggccaa

SEQ ID NO: 2321475 - DNA, 16 bp, Homo sapiens
aggatgccttttctgt

SEQ ID NO: 2321476 - DNA, 13 bp, Homo sapiens
aggatgcttggga

SEQ ID NO: 2321477 - DNA, 14 bp, Homo sapiens
aggatggcctttcc

SEQ ID NO: 2321478 - DNA, 18 bp, Homo sapiens
aggatggcctttccttcc

SEQ ID NO: 2321479 - DNA, 16 bp, Homo sapiens
aggatgggtcagagct

SEQ ID NO: 2321480 - DNA, 18 bp, Homo sapiens
aggattcccttctgggct

SEQ ID NO: 2321481 - DNA, 19 bp, Homo sapiens
aggattgtaaaaaaaaatg

SEQ ID NO: 2321482 - DNA, 13 bp, Homo sapiens
aggcaagagatga

SEQ ID NO: 2321483 - DNA, 15 bp, Homo sapiens
aggcaagagatgaat

SEQ ID NO: 2321484 - DNA, 16 bp, Homo sapiens
aggcaagctgaaattt

SEQ ID NO: 2321485 - DNA, 15 bp, Homo sapiens
aggcacacacagccc

SEQ ID NO: 2321486 - DNA, 18 bp, Homo sapiens
aggcacacacagccccta

SEQ ID NO: 2321487 - DNA, 15 bp, Homo sapiens
aggcaccagtccctg

SEQ ID NO: 2321488 - DNA, 15 bp, Homo sapiens
aggcaccctcaggga

SEQ ID NO: 2321489 - DNA, 13 bp, Homo sapiens
aggcacctcttcc

SEQ ID NO: 2321490 - DNA, 16 bp, Homo sapiens
aggcacctgctggaaa

SEQ ID NO: 2321491 - DNA, 16 bp, Homo sapiens
aggcacgggtggtccc

SEQ ID NO: 2321492 - DNA, 19 bp, Homo sapiens
aggcactcagtgagcctcc

SEQ ID NO: 2321493 - DNA, 14 bp, Homo sapiens
aggcagagaaatct

SEQ ID NO: 2321494 - DNA, 13 bp, Homo sapiens
aggcagagctgga

SEQ ID NO: 2321495 - DNA, 23 bp, Homo sapiens
aggcagaggttttaatgtctgtt

SEQ ID NO: 2321496 - DNA, 13 bp, Homo sapiens
aggcagagtcttc

SEQ ID NO: 2321497 - DNA, 14 bp, Homo sapiens
aggcagagtcttct

SEQ ID NO: 2321498 - DNA, 16 bp, Homo sapiens
aggcagcaccacactg

SEQ ID NO: 2321499 - DNA, 12 bp, Homo sapiens
aggcagcctgcc

SEQ ID NO: 2321500 - DNA, 14 bp, Homo sapiens
aggcagcctgccgc

SEQ ID NO: 2321501 - DNA, 14 bp, Homo sapiens
aggcagctccctcc

SEQ ID NO: 2321502 - DNA, 16 bp, Homo sapiens
aggcagctccctcctg

SEQ ID NO: 2321503 - DNA, 14 bp, Homo sapiens
aggcaggaagggaa

SEQ ID NO: 2321504 - DNA, 17 bp, Homo sapiens
aggcaggaagggaagcg

SEQ ID NO: 2321505 - DNA, 22 bp, Homo sapiens
aggcaggcatagaggcttctcc

SEQ ID NO: 2321506 - DNA, 12 bp, Homo sapiens
aggcaggctggg

SEQ ID NO: 2321507 - DNA, 16 bp, Homo sapiens
aggcagggctctcccg

SEQ ID NO: 2321508 - DNA, 19 bp, Homo sapiens
aggcaggggtgggggtgga

SEQ ID NO: 2321509 - DNA, 23 bp, Homo sapiens
aggcaggggtgggggtggaggct

SEQ ID NO: 2321510 - DNA, 24 bp, Homo sapiens
aggcagtgatgacttgctgtccag

SEQ ID NO: 2321511 - DNA, 22 bp, Homo sapiens
aggcatagaggcttctccgcca

SEQ ID NO: 2321512 - DNA, 20 bp, Homo sapiens
aggcatccttgtcttttgag

SEQ ID NO: 2321513 - DNA, 20 bp, Homo sapiens
aggcatgaaattcttcctaa

SEQ ID NO: 2321514 - DNA, 15 bp, Homo sapiens
aggcattctggacct

SEQ ID NO: 2321515 - DNA, 21 bp, Homo sapiens
aggcattctggacctctgggt

SEQ ID NO: 2321516 - DNA, 23 bp, Homo sapiens
aggcatttgcctaattcctggca

SEQ ID NO: 2321517 - DNA, 19 bp, Homo sapiens
aggccactgtgttccttcc

SEQ ID NO: 2321518 - DNA, 11 bp, Homo sapiens
aggccagcctc

SEQ ID NO: 2321519 - DNA, 13 bp, Homo sapiens
aggccagcctccg

SEQ ID NO: 2321520 - DNA, 18 bp, Homo sapiens
aggccagttgatctgctc

SEQ ID NO: 2321521 - DNA, 20 bp, Homo sapiens
aggcccactgtgtctaggca

SEQ ID NO: 2321522 - DNA, 14 bp, Homo sapiens
aggcccagcctgtc

SEQ ID NO: 2321523 - DNA, 17 bp, Homo sapiens
aggcccagcctgtcctg

SEQ ID NO: 2321524 - DNA, 21 bp, Homo sapiens
aggcccagcctgtcctggtac

SEQ ID NO: 2321525 - DNA, 19 bp, Homo sapiens
aggcccagtgcatatgcaa

SEQ ID NO: 2321526 - DNA, 17 bp, Homo sapiens
aggccccagacagggtg

SEQ ID NO: 2321527 - DNA, 18 bp, Homo sapiens
aggccctgactcctctgg

SEQ ID NO: 2321528 - DNA, 15 bp, Homo sapiens
aggccctgaggcgga

SEQ ID NO: 2321529 - DNA, 21 bp, Homo sapiens
aggccctgaggcggaggctgt

SEQ ID NO: 2321530 - DNA, 13 bp, Homo sapiens
aggccctgggctg

SEQ ID NO: 2321531 - DNA, 22 bp, Homo sapiens
aggccctgggctgggtgctggg

SEQ ID NO: 2321532 - DNA, 17 bp, Homo sapiens
aggccctgttccctgga

SEQ ID NO: 2321533 - DNA, 20 bp, Homo sapiens
aggccgaggccatgtgcata

SEQ ID NO: 2321534 - DNA, 14 bp, Homo sapiens
aggccggcccagat

SEQ ID NO: 2321535 - DNA, 14 bp, Homo sapiens
aggcctagactctg

SEQ ID NO: 2321536 - DNA, 16 bp, Homo sapiens
aggcctagactctgtc

SEQ ID NO: 2321537 - DNA, 19 bp, Homo sapiens
aggcctcaggtgctgtcca

SEQ ID NO: 2321538 - DNA, 21 bp, Homo sapiens
aggcctgaagccagctgccct

SEQ ID NO: 2321539 - DNA, 22 bp, Homo sapiens
aggcctgaatcatgagcctgct

SEQ ID NO: 2321540 - DNA, 23 bp, Homo sapiens
aggcctgaatcatgagcctgctg

SEQ ID NO: 2321541 - DNA, 18 bp, Homo sapiens
aggcctgcctcccacttc

SEQ ID NO: 2321542 - DNA, 13 bp, Homo sapiens
aggcctggctgga

SEQ ID NO: 2321543 - DNA, 12 bp, Homo sapiens
aggcctttcttc

SEQ ID NO: 2321544 - DNA, 19 bp, Homo sapiens
aggcctttcttctgtgtta

SEQ ID NO: 2321545 - DNA, 22 bp, Homo sapiens
aggcgctgcccacctgccggcc

SEQ ID NO: 2321546 - DNA, 18 bp, Homo sapiens
aggctagcttctgctttt

SEQ ID NO: 2321547 - DNA, 14 bp, Homo sapiens
aggctattttctaa

SEQ ID NO: 2321548 - DNA, 12 bp, Homo sapiens
aggctcactgcc

SEQ ID NO: 2321549 - DNA, 15 bp, Homo sapiens
aggctcactgccagg

SEQ ID NO: 2321550 - DNA, 23 bp, Homo sapiens
aggctcactgccaggccagcctc

SEQ ID NO: 2321551 - DNA, 18 bp, Homo sapiens
aggctcagtggtgggaga

SEQ ID NO: 2321552 - DNA, 14 bp, Homo sapiens
aggctccagcacat

SEQ ID NO: 2321553 - DNA, 18 bp, Homo sapiens
aggctccagcacatcccc

SEQ ID NO: 2321554 - DNA, 13 bp, Homo sapiens
aggctccccttct

SEQ ID NO: 2321555 - DNA, 15 bp, Homo sapiens
aggctctggacagca

SEQ ID NO: 2321556 - DNA, 21 bp, Homo sapiens
aggctctggacagcagaagcc

SEQ ID NO: 2321557 - DNA, 22 bp, Homo sapiens
aggctctggacagcagaagcct

SEQ ID NO: 2321558 - DNA, 13 bp, Homo sapiens
aggctgaaagagg

SEQ ID NO: 2321559 - DNA, 21 bp, Homo sapiens
aggctgagaactcgttcacct

SEQ ID NO: 2321560 - DNA, 18 bp, Homo sapiens
aggctgagacagtgaatt

SEQ ID NO: 2321561 - DNA, 14 bp, Homo sapiens
aggctgccagacat

SEQ ID NO: 2321562 - DNA, 16 bp, Homo sapiens
aggctgccagacatgg

SEQ ID NO: 2321563 - DNA, 17 bp, Homo sapiens
aggctgccagacatgga

SEQ ID NO: 2321564 - DNA, 12 bp, Homo sapiens
aggctgcccctc

SEQ ID NO: 2321565 - DNA, 15 bp, Homo sapiens
aggctggagaccccc

SEQ ID NO: 2321566 - DNA, 20 bp, Homo sapiens
aggctggagtgcagtggcat

SEQ ID NO: 2321567 - DNA, 19 bp, Homo sapiens
aggctgggacggaccagca

SEQ ID NO: 2321568 - DNA, 10 bp, Homo sapiens
aggctgggcc

SEQ ID NO: 2321569 - DNA, 20 bp, Homo sapiens
aggctgggccatgtccaaag

SEQ ID NO: 2321570 - DNA, 17 bp, Homo sapiens
aggctgtaactgagaga

SEQ ID NO: 2321571 - DNA, 14 bp, Homo sapiens
aggctgtgctccgc

SEQ ID NO: 2321572 - DNA, 21 bp, Homo sapiens
aggctgttccatgttctattt

SEQ ID NO: 2321573 - DNA, 22 bp, Homo sapiens
aggctgttccatgttctatttt

SEQ ID NO: 2321574 - DNA, 21 bp, Homo sapiens
aggctgttggttcaaactttt

SEQ ID NO: 2321575 - DNA, 17 bp, Homo sapiens
aggcttaggtgccaggc

SEQ ID NO: 2321576 - DNA, 10 bp, Homo sapiens
aggcttcctg

SEQ ID NO: 2321577 - DNA, 14 bp, Homo sapiens
aggcttctccgcca

SEQ ID NO: 2321578 - DNA, 12 bp, Homo sapiens
aggcttctctcc

SEQ ID NO: 2321579 - DNA, 20 bp, Homo sapiens
agggaagaaaaagcaagtgt

SEQ ID NO: 2321580 - DNA, 17 bp, Homo sapiens
agggaagggtttctcta

SEQ ID NO: 2321581 - DNA, 13 bp, Homo sapiens
agggaaggtggcc

SEQ ID NO: 2321582 - DNA, 21 bp, Homo sapiens
agggaaggtggccacagcaag

SEQ ID NO: 2321583 - DNA, 17 bp, Homo sapiens
agggaagtaacagacac

SEQ ID NO: 2321584 - DNA, 20 bp, Homo sapiens
agggaatgagagttccttct

SEQ ID NO: 2321585 - DNA, 21 bp, Homo sapiens
agggaatgagagttccttctc

SEQ ID NO: 2321586 - DNA, 15 bp, Homo sapiens
agggaattcctgggg

SEQ ID NO: 2321587 - DNA, 17 bp, Homo sapiens
agggacacacagcctag

SEQ ID NO: 2321588 - DNA, 18 bp, Homo sapiens
agggacacacagcctagc

SEQ ID NO: 2321589 - DNA, 14 bp, Homo sapiens
agggaccggcggac

SEQ ID NO: 2321590 - DNA, 19 bp, Homo sapiens
agggactacccatagacat

SEQ ID NO: 2321591 - DNA, 17 bp, Homo sapiens
agggactgccaggctgt

SEQ ID NO: 2321592 - DNA, 11 bp, Homo sapiens
agggagagaga

SEQ ID NO: 2321593 - DNA, 12 bp, Homo sapiens
agggagggagtt

SEQ ID NO: 2321594 - DNA, 21 bp, Homo sapiens
agggaggtcactggaaagggg

SEQ ID NO: 2321595 - DNA, 22 bp, Homo sapiens
agggatggaaaaggaagactag

SEQ ID NO: 2321596 - DNA, 13 bp, Homo sapiens
agggatttccctg

SEQ ID NO: 2321597 - DNA, 16 bp, Homo sapiens
agggatttccctgcag

SEQ ID NO: 2321598 - DNA, 15 bp, Homo sapiens
agggatttgcctcac

SEQ ID NO: 2321599 - DNA, 16 bp, Homo sapiens
agggcaaggggttccc

SEQ ID NO: 2321600 - DNA, 15 bp, Homo sapiens
agggcagactggggc

SEQ ID NO: 2321601 - DNA, 14 bp, Homo sapiens
agggcagagggaga

SEQ ID NO: 2321602 - DNA, 18 bp, Homo sapiens
agggcagagggagaatcc

SEQ ID NO: 2321603 - DNA, 19 bp, Homo sapiens
agggcagagggagaatcca

SEQ ID NO: 2321604 - DNA, 15 bp, Homo sapiens
agggcagggcagcct

SEQ ID NO: 2321605 - DNA, 18 bp, Homo sapiens
agggcagggtctgggctg

SEQ ID NO: 2321606 - DNA, 13 bp, Homo sapiens
agggcataaagta

SEQ ID NO: 2321607 - DNA, 14 bp, Homo sapiens
agggcataaagtaa

SEQ ID NO: 2321608 - DNA, 20 bp, Homo sapiens
agggcataaagtaaatacat

SEQ ID NO: 2321609 - DNA, 18 bp, Homo sapiens
agggcatcttgctggcta

SEQ ID NO: 2321610 - DNA, 14 bp, Homo sapiens
agggccatgcagac

SEQ ID NO: 2321611 - DNA, 16 bp, Homo sapiens
agggccatgcagacct

SEQ ID NO: 2321612 - DNA, 16 bp, Homo sapiens
agggccctgggcaggg

SEQ ID NO: 2321613 - DNA, 14 bp, Homo sapiens
agggcctgctggag

SEQ ID NO: 2321614 - DNA, 17 bp, Homo sapiens
agggcctgctggaggcc

SEQ ID NO: 2321615 - DNA, 21 bp, Homo sapiens
agggcctgctggaggcctcag

SEQ ID NO: 2321616 - DNA, 23 bp, Homo sapiens
agggcctgctggaggcctcaggt

SEQ ID NO: 2321617 - DNA, 21 bp, Homo sapiens
agggccttggaaattcctgta

SEQ ID NO: 2321618 - DNA, 23 bp, Homo sapiens
agggcgttctaggtaggaagagc

SEQ ID NO: 2321619 - DNA, 19 bp, Homo sapiens
agggctccctcctggagca

SEQ ID NO: 2321620 - DNA, 21 bp, Homo sapiens
agggctgcccctaatctctgt

SEQ ID NO: 2321621 - DNA, 14 bp, Homo sapiens
agggctgcttttct

SEQ ID NO: 2321622 - DNA, 18 bp, Homo sapiens
agggctgcttttcttaag

SEQ ID NO: 2321623 - DNA, 14 bp, Homo sapiens
agggctgtcccagc

SEQ ID NO: 2321624 - DNA, 23 bp, Homo sapiens
agggctgtgcttgaaggccctgc

SEQ ID NO: 2321625 - DNA, 22 bp, Homo sapiens
aggggacaagggatttgaggtg

SEQ ID NO: 2321626 - DNA, 18 bp, Homo sapiens
aggggagagacaggcagc

SEQ ID NO: 2321627 - DNA, 22 bp, Homo sapiens
aggggagagcctgctggcaccc

SEQ ID NO: 2321628 - DNA, 13 bp, Homo sapiens
aggggagggcagg

SEQ ID NO: 2321629 - DNA, 17 bp, Homo sapiens
aggggaggggctccttt

SEQ ID NO: 2321630 - DNA, 16 bp, Homo sapiens
aggggcccccctgccc

SEQ ID NO: 2321631 - DNA, 12 bp, Homo sapiens
aggggcctgagt

SEQ ID NO: 2321632 - DNA, 18 bp, Homo sapiens
aggggctggggacttgtg

SEQ ID NO: 2321633 - DNA, 21 bp, Homo sapiens
aggggctggggacttgtgtct

SEQ ID NO: 2321634 - DNA, 19 bp, Homo sapiens
agggggcttgaagccaaag

SEQ ID NO: 2321635 - DNA, 23 bp, Homo sapiens
aggggggggtatttcaattacct

SEQ ID NO: 2321636 - DNA, 19 bp, Homo sapiens
aggggtgaattgtgtagtg

SEQ ID NO: 2321637 - DNA, 18 bp, Homo sapiens
aggggttcccttgagggc

SEQ ID NO: 2321638 - DNA, 21 bp, Homo sapiens
aggggttgctccgcctggcct

SEQ ID NO: 2321639 - DNA, 16 bp, Homo sapiens
agggtatgggaagcca

SEQ ID NO: 2321640 - DNA, 23 bp, Homo sapiens
agggtctgggctgggcacctgac

SEQ ID NO: 2321641 - DNA, 14 bp, Homo sapiens
agggtcttgctctg

SEQ ID NO: 2321642 - DNA, 18 bp, Homo sapiens
agggtcttgctctgtccc

SEQ ID NO: 2321643 - DNA, 19 bp, Homo sapiens
agggtcttggctgcctgtg

SEQ ID NO: 2321644 - DNA, 21 bp, Homo sapiens
agggtgccccgcctgagtcag

SEQ ID NO: 2321645 - DNA, 19 bp, Homo sapiens
agggtgggcttcctgccct

SEQ ID NO: 2321646 - DNA, 17 bp, Homo sapiens
agggtgggcttgtgggg

SEQ ID NO: 2321647 - DNA, 22 bp, Homo sapiens
agggtgggcttgtggggcctgg

SEQ ID NO: 2321648 - DNA, 19 bp, Homo sapiens
agggtgtctgcgtcgtcac

SEQ ID NO: 2321649 - DNA, 16 bp, Homo sapiens
agggtgtggctttcca

SEQ ID NO: 2321650 - DNA, 23 bp, Homo sapiens
agggtgtggctttccaggcaccc

SEQ ID NO: 2321651 - DNA, 17 bp, Homo sapiens
agggttcaagccttcca

SEQ ID NO: 2321652 - DNA, 16 bp, Homo sapiens
agggttccgccactcc

SEQ ID NO: 2321653 - DNA, 20 bp, Homo sapiens
agggttttcttttttaaatg

SEQ ID NO: 2321654 - DNA, 14 bp, Homo sapiens
aggtaaatggttaa

SEQ ID NO: 2321655 - DNA, 23 bp, Homo sapiens
aggtaacactagggccttggaaa

SEQ ID NO: 2321656 - DNA, 14 bp, Homo sapiens
aggtaacagaacag

SEQ ID NO: 2321657 - DNA, 17 bp, Homo sapiens
aggtaacagaacagctt

SEQ ID NO: 2321658 - DNA, 12 bp, Homo sapiens
aggtagcctatt

SEQ ID NO: 2321659 - DNA, 15 bp, Homo sapiens
aggtagcgagctgct

SEQ ID NO: 2321660 - DNA, 21 bp, Homo sapiens
aggtagcgagctgctctgcta

SEQ ID NO: 2321661 - DNA, 18 bp, Homo sapiens
aggtagtattacaccacc

SEQ ID NO: 2321662 - DNA, 19 bp, Homo sapiens
aggtattaaaactaaattt

SEQ ID NO: 2321663 - DNA, 14 bp, Homo sapiens
aggtcactgtttcc

SEQ ID NO: 2321664 - DNA, 22 bp, Homo sapiens
aggtcaggacggctcctcagag

SEQ ID NO: 2321665 - DNA, 15 bp, Homo sapiens
aggtcatcagatgcc

SEQ ID NO: 2321666 - DNA, 16 bp, Homo sapiens
aggtcatcagatgcct

SEQ ID NO: 2321667 - DNA, 18 bp, Homo sapiens
aggtcttcttgtgtcctg

SEQ ID NO: 2321668 - DNA, 13 bp, Homo sapiens
aggtcttttcaaa

SEQ ID NO: 2321669 - DNA, 14 bp, Homo sapiens
aggtgacatgtgaa

SEQ ID NO: 2321670 - DNA, 20 bp, Homo sapiens
aggtgccacccagtagccca

SEQ ID NO: 2321671 - DNA, 22 bp, Homo sapiens
aggtgccacccagtagcccaga

SEQ ID NO: 2321672 - DNA, 20 bp, Homo sapiens
aggtgcgtgttcagcagaac

SEQ ID NO: 2321673 - DNA, 13 bp, Homo sapiens
aggtgctgcttaa

SEQ ID NO: 2321674 - DNA, 15 bp, Homo sapiens
aggtggaagaaggga

SEQ ID NO: 2321675 - DNA, 16 bp, Homo sapiens
aggtggaagaagggag

SEQ ID NO: 2321676 - DNA, 17 bp, Homo sapiens
aggtggaagaagggaga

SEQ ID NO: 2321677 - DNA, 18 bp, Homo sapiens
aggtggaagaagggagaa

SEQ ID NO: 2321678 - DNA, 16 bp, Homo sapiens
aggtggagtttctctg

SEQ ID NO: 2321679 - DNA, 15 bp, Homo sapiens
aggtggccatgttat

SEQ ID NO: 2321680 - DNA, 19 bp, Homo sapiens
aggtgggccttgctacctc

SEQ ID NO: 2321681 - DNA, 15 bp, Homo sapiens
aggtgtcaccctgca

SEQ ID NO: 2321682 - DNA, 19 bp, Homo sapiens
aggttaaacggtgcccatc

SEQ ID NO: 2321683 - DNA, 15 bp, Homo sapiens
aggttacaagcctgc

SEQ ID NO: 2321684 - DNA, 14 bp, Homo sapiens
aggttactgagtga

SEQ ID NO: 2321685 - DNA, 17 bp, Homo sapiens
agtaaagcagaggatgc

SEQ ID NO: 2321686 - DNA, 23 bp, Homo sapiens
agtaaaggaaataagagcagtca

SEQ ID NO: 2321687 - DNA, 15 bp, Homo sapiens
agtaaatcagaaagt

SEQ ID NO: 2321688 - DNA, 13 bp, Homo sapiens
agtaacaatctat

SEQ ID NO: 2321689 - DNA, 20 bp, Homo sapiens
agtaacatgacttccttatt

SEQ ID NO: 2321690 - DNA, 21 bp, Homo sapiens
agtaactataagatacaataa

SEQ ID NO: 2321691 - DNA, 16 bp, Homo sapiens
agtaacttttaaaatt

SEQ ID NO: 2321692 - DNA, 14 bp, Homo sapiens
agtaatattattac

SEQ ID NO: 2321693 - DNA, 12 bp, Homo sapiens
agtaatttcagt

SEQ ID NO: 2321694 - DNA, 14 bp, Homo sapiens
agtaatttcagtgt

SEQ ID NO: 2321695 - DNA, 20 bp, Homo sapiens
agtacaataataaatcctca

SEQ ID NO: 2321696 - DNA, 19 bp, Homo sapiens
agtacaatagtatacattt

SEQ ID NO: 2321697 - DNA, 13 bp, Homo sapiens
agtacagcggctc

SEQ ID NO: 2321698 - DNA, 18 bp, Homo sapiens
agtacagcggctcccctc

SEQ ID NO: 2321699 - DNA, 23 bp, Homo sapiens
agtacagcggctcccctctgctt

SEQ ID NO: 2321700 - DNA, 21 bp, Homo sapiens
agtacatttaaattttttggc

SEQ ID NO: 2321701 - DNA, 20 bp, Homo sapiens
agtaccaaatccacaagcca

SEQ ID NO: 2321702 - DNA, 22 bp, Homo sapiens
agtaccaatgggaagcagggaa

SEQ ID NO: 2321703 - DNA, 21 bp, Homo sapiens
agtaccctccattgggcacag

SEQ ID NO: 2321704 - DNA, 21 bp, Homo sapiens
agtacctctcaagctagtgtt

SEQ ID NO: 2321705 - DNA, 23 bp, Homo sapiens
agtactggttactttcaaaatga

SEQ ID NO: 2321706 - DNA, 12 bp, Homo sapiens
agtagaaaatgt

SEQ ID NO: 2321707 - DNA, 12 bp, Homo sapiens
agtagacattta

SEQ ID NO: 2321708 - DNA, 12 bp, Homo sapiens
agtagagccagc

SEQ ID NO: 2321709 - DNA, 13 bp, Homo sapiens
agtagagccagct

SEQ ID NO: 2321710 - DNA, 18 bp, Homo sapiens
agtagatgtggcctttga

SEQ ID NO: 2321711 - DNA, 21 bp, Homo sapiens
agtagatgtggcctttgaatt

SEQ ID NO: 2321712 - DNA, 19 bp, Homo sapiens
agtagattcatgaaaatgt

SEQ ID NO: 2321713 - DNA, 21 bp, Homo sapiens
agtagattcatgaaaatgtat

SEQ ID NO: 2321714 - DNA, 23 bp, Homo sapiens
agtaggactccttatttggcgtg

SEQ ID NO: 2321715 - DNA, 18 bp, Homo sapiens
agtagtaaatcagaaagt

SEQ ID NO: 2321716 - DNA, 13 bp, Homo sapiens
agtagttagaaat

SEQ ID NO: 2321717 - DNA, 13 bp, Homo sapiens
agtatacatttta

SEQ ID NO: 2321718 - DNA, 18 bp, Homo sapiens
agtatattgttgaagaga

SEQ ID NO: 2321719 - DNA, 17 bp, Homo sapiens
agtatcacgatttgcag

SEQ ID NO: 2321720 - DNA, 15 bp, Homo sapiens
agtatcagctacaat

SEQ ID NO: 2321721 - DNA, 23 bp, Homo sapiens
agtatcttgggtgtattctctgt

SEQ ID NO: 2321722 - DNA, 19 bp, Homo sapiens
agtatgaaaatggaaattt

SEQ ID NO: 2321723 - DNA, 21 bp, Homo sapiens
agtatgcattattaaattgta

SEQ ID NO: 2321724 - DNA, 18 bp, Homo sapiens
agtatgcttaagctttgg

SEQ ID NO: 2321725 - DNA, 23 bp, Homo sapiens
agtatggtaatctttacctgtat

SEQ ID NO: 2321726 - DNA, 18 bp, Homo sapiens
agtatgtgggggcttcat

SEQ ID NO: 2321727 - DNA, 20 bp, Homo sapiens
agtatgtgggggcttcatct

SEQ ID NO: 2321728 - DNA, 15 bp, Homo sapiens
agtattgtggggctc

SEQ ID NO: 2321729 - DNA, 12 bp, Homo sapiens
agtattgtttaa

SEQ ID NO: 2321730 - DNA, 13 bp, Homo sapiens
agtattgtttaaa

SEQ ID NO: 2321731 - DNA, 19 bp, Homo sapiens
agtattgtttaaaatgtaa

SEQ ID NO: 2321732 - DNA, 22 bp, Homo sapiens
agtattgtttaaaatgtaattt

SEQ ID NO: 2321733 - DNA, 12 bp, Homo sapiens
agtatttaacat

SEQ ID NO: 2321734 - DNA, 13 bp, Homo sapiens
agtatttaacatt

SEQ ID NO: 2321735 - DNA, 19 bp, Homo sapiens
agtatttcccttccaaaga

SEQ ID NO: 2321736 - DNA, 19 bp, Homo sapiens
agtattttaagaagacata

SEQ ID NO: 2321737 - DNA, 21 bp, Homo sapiens
agtcaaaaaattatttgctat

SEQ ID NO: 2321738 - DNA, 13 bp, Homo sapiens
agtcaccttttct

SEQ ID NO: 2321739 - DNA, 12 bp, Homo sapiens
agtcactgctct

SEQ ID NO: 2321740 - DNA, 22 bp, Homo sapiens
agtcactggaggttgaagccaa

SEQ ID NO: 2321741 - DNA, 23 bp, Homo sapiens
agtcactggaggttgaagccaag

SEQ ID NO: 2321742 - DNA, 23 bp, Homo sapiens
agtcactggcatactgagaatat

SEQ ID NO: 2321743 - DNA, 17 bp, Homo sapiens
agtcagctctctgccct

SEQ ID NO: 2321744 - DNA, 22 bp, Homo sapiens
agtcagtgctctcagctggcag

SEQ ID NO: 2321745 - DNA, 23 bp, Homo sapiens
agtcagttgctcaaaaagaaatc

SEQ ID NO: 2321746 - DNA, 21 bp, Homo sapiens
agtcatctgtaagagcttgct

SEQ ID NO: 2321747 - DNA, 19 bp, Homo sapiens
agtcatctgttagggcctt

SEQ ID NO: 2321748 - DNA, 13 bp, Homo sapiens
agtcatgcataaa

SEQ ID NO: 2321749 - DNA, 17 bp, Homo sapiens
agtcatgcataaatatg

SEQ ID NO: 2321750 - DNA, 19 bp, Homo sapiens
agtcatgcataaatatgca

SEQ ID NO: 2321751 - DNA, 21 bp, Homo sapiens
agtcatgcataaatatgcagt

SEQ ID NO: 2321752 - DNA, 21 bp, Homo sapiens
agtcatggctaatttaacacc

SEQ ID NO: 2321753 - DNA, 23 bp, Homo sapiens
agtcattccaagaactataaact

SEQ ID NO: 2321754 - DNA, 18 bp, Homo sapiens
agtccaagcaacagcctt

SEQ ID NO: 2321755 - DNA, 16 bp, Homo sapiens
agtccaccctgcctgc

SEQ ID NO: 2321756 - DNA, 23 bp, Homo sapiens
agtccactcctgacccctctcct

SEQ ID NO: 2321757 - DNA, 18 bp, Homo sapiens
agtccagacccaagtcaa

SEQ ID NO: 2321758 - DNA, 16 bp, Homo sapiens
agtccagtgctctgcc

SEQ ID NO: 2321759 - DNA, 15 bp, Homo sapiens
agtccattctcccag

SEQ ID NO: 2321760 - DNA, 19 bp, Homo sapiens
agtccattctcccaggtac

SEQ ID NO: 2321761 - DNA, 16 bp, Homo sapiens
agtcccaagctaggct

SEQ ID NO: 2321762 - DNA, 17 bp, Homo sapiens
agtccccacccctgccc

SEQ ID NO: 2321763 - DNA, 14 bp, Homo sapiens
agtccctccctgcc

SEQ ID NO: 2321764 - DNA, 15 bp, Homo sapiens
agtccctccctgcct

SEQ ID NO: 2321765 - DNA, 16 bp, Homo sapiens
agtccctccctgcctg

SEQ ID NO: 2321766 - DNA, 15 bp, Homo sapiens
agtccggatttctaa

SEQ ID NO: 2321767 - DNA, 22 bp, Homo sapiens
agtccggatttctaacagtcct

SEQ ID NO: 2321768 - DNA, 21 bp, Homo sapiens
agtcctaattcaatcctactt

SEQ ID NO: 2321769 - DNA, 19 bp, Homo sapiens
agtcctgctacctcccttg

SEQ ID NO: 2321770 - DNA, 21 bp, Homo sapiens
agtcctgctacctcccttgcc

SEQ ID NO: 2321771 - DNA, 20 bp, Homo sapiens
agtcctggaagccagctttc

SEQ ID NO: 2321772 - DNA, 22 bp, Homo sapiens
agtcctggaagccagctttccc

SEQ ID NO: 2321773 - DNA, 17 bp, Homo sapiens
agtcgtgatgtggagga

SEQ ID NO: 2321774 - DNA, 18 bp, Homo sapiens
agtctcactgcttgaact

SEQ ID NO: 2321775 - DNA, 20 bp, Homo sapiens
agtctcgtctcttttaccct

SEQ ID NO: 2321776 - DNA, 15 bp, Homo sapiens
agtctgcacagagca

SEQ ID NO: 2321777 - DNA, 15 bp, Homo sapiens
agtctggggacctgg

SEQ ID NO: 2321778 - DNA, 12 bp, Homo sapiens
agtcttcctgac

SEQ ID NO: 2321779 - DNA, 15 bp, Homo sapiens
agtcttcctgacact

SEQ ID NO: 2321780 - DNA, 13 bp, Homo sapiens
agtctttgctcag

SEQ ID NO: 2321781 - DNA, 16 bp, Homo sapiens
agtctttgctcagtgt

SEQ ID NO: 2321782 - DNA, 20 bp, Homo sapiens
agtgaaattaagcattttga

SEQ ID NO: 2321783 - DNA, 19 bp, Homo sapiens
agtgaacattcccagccca

SEQ ID NO: 2321784 - DNA, 20 bp, Homo sapiens
agtgaactcctgccaggcac

SEQ ID NO: 2321785 - DNA, 15 bp, Homo sapiens
agtgaatctgattgc

SEQ ID NO: 2321786 - DNA, 19 bp, Homo sapiens
agtgaatttgggctgctgt

SEQ ID NO: 2321787 - DNA, 14 bp, Homo sapiens
agtttctccttgaa

SEQ ID NO: 2321788 - DNA, 15 bp, Homo sapiens
agtttcttagctttt

SEQ ID NO: 2321789 - DNA, 15 bp, Homo sapiens
agtttgagctgcctt

SEQ ID NO: 2321790 - DNA, 17 bp, Homo sapiens
agtttgtagaactttat

SEQ ID NO: 2321791 - DNA, 19 bp, Homo sapiens
agtttgtagtaaaagtggt

SEQ ID NO: 2321792 - DNA, 19 bp, Homo sapiens
agttttaaacccaaaatat

SEQ ID NO: 2321793 - DNA, 11 bp, Homo sapiens
agttttaaagt

SEQ ID NO: 2321794 - DNA, 23 bp, Homo sapiens
agttttactgtctattaatattc

SEQ ID NO: 2321795 - DNA, 19 bp, Homo sapiens
agttttacttttaaactgt

SEQ ID NO: 2321796 - DNA, 16 bp, Homo sapiens
agttttccttctgtta

SEQ ID NO: 2321797 - DNA, 17 bp, Homo sapiens
agttttgaaaagctatt

SEQ ID NO: 2321798 - DNA, 23 bp, Homo sapiens
agttttgttgtacttaaatggta

SEQ ID NO: 2321799 - DNA, 12 bp, Homo sapiens
agtttttcctcc

SEQ ID NO: 2321800 - DNA, 12 bp, Homo sapiens
agtttttttgct

SEQ ID NO: 2321801 - DNA, 16 bp, Homo sapiens
ataaaaaatcatgcca

SEQ ID NO: 2321802 - DNA, 21 bp, Homo sapiens
ataaaaaatggttaatgacaa

SEQ ID NO: 2321803 - DNA, 21 bp, Homo sapiens
ataaaaactcaggcaaagaaa

SEQ ID NO: 2321804 - DNA, 15 bp, Homo sapiens
ataaaaatatgtaat

SEQ ID NO: 2321805 - DNA, 12 bp, Homo sapiens
ataaaaatgttt

SEQ ID NO: 2321806 - DNA, 11 bp, Homo sapiens
ataaaactctg

SEQ ID NO: 2321807 - DNA, 23 bp, Homo sapiens
ataaaactgtttgacttctcaag

SEQ ID NO: 2321808 - DNA, 16 bp, Homo sapiens
ataaaagaaaattaca

SEQ ID NO: 2321809 - DNA, 16 bp, Homo sapiens
ataaaagaacatgctt

SEQ ID NO: 2321810 - DNA, 17 bp, Homo sapiens
ataaaagaacatgcttg

SEQ ID NO: 2321811 - DNA, 23 bp, Homo sapiens
ataaaagtgaagtgaatctgatt

SEQ ID NO: 2321812 - DNA, 20 bp, Homo sapiens
ataaaataaataattttaat

SEQ ID NO: 2321813 - DNA, 18 bp, Homo sapiens
ataaaataattctaaagg

SEQ ID NO: 2321814 - DNA, 19 bp, Homo sapiens
ataaaatagaataattctt

SEQ ID NO: 2321815 - DNA, 16 bp, Homo sapiens
ataaaatgaaaattgt

SEQ ID NO: 2321816 - DNA, 18 bp, Homo sapiens
ataaaatgtttcattatg

SEQ ID NO: 2321817 - DNA, 15 bp, Homo sapiens
ataaaattcctatct

SEQ ID NO: 2321818 - DNA, 17 bp, Homo sapiens
ataaaattcctatctca

SEQ ID NO: 2321819 - DNA, 13 bp, Homo sapiens
ataaaatttaatt

SEQ ID NO: 2321820 - DNA, 19 bp, Homo sapiens
ataaacaataaaaacaact

SEQ ID NO: 2321821 - DNA, 14 bp, Homo sapiens
ataaactcatttat

SEQ ID NO: 2321822 - DNA, 14 bp, Homo sapiens
ataaacttaaagct

SEQ ID NO: 2321823 - DNA, 23 bp, Homo sapiens
ataaagaaggatgatgtcttttt

SEQ ID NO: 2321824 - DNA, 12 bp, Homo sapiens
ataaagatgagt

SEQ ID NO: 2321825 - DNA, 16 bp, Homo sapiens
ataaaggaaaagacac

SEQ ID NO: 2321826 - DNA, 14 bp, Homo sapiens
ataaagtacaaatg

SEQ ID NO: 2321827 - DNA, 15 bp, Homo sapiens
ataaagtacaaatga

SEQ ID NO: 2321828 - DNA, 17 bp, Homo sapiens
ataaagtataatgttta

SEQ ID NO: 2321829 - DNA, 22 bp, Homo sapiens
ataaagtggaagtatgtatatt

SEQ ID NO: 2321830 - DNA, 15 bp, Homo sapiens
ataaataattttaat

SEQ ID NO: 2321831 - DNA, 17 bp, Homo sapiens
ataaataggtttatatt

SEQ ID NO: 2321832 - DNA, 22 bp, Homo sapiens
ataaataggtttatattattga

SEQ ID NO: 2321833 - DNA, 12 bp, Homo sapiens
ataaatcataaa

SEQ ID NO: 2321834 - DNA, 16 bp, Homo sapiens
ataaatcataaagtca

SEQ ID NO: 2321835 - DNA, 20 bp, Homo sapiens
ataaatcattcttactaaaa

SEQ ID NO: 2321836 - DNA, 21 bp, Homo sapiens
ataaatcattcttactaaaaa

SEQ ID NO: 2321837 - DNA, 13 bp, Homo sapiens
ataaatgggtgta

SEQ ID NO: 2321838 - DNA, 12 bp, Homo sapiens
ataaatgtacat

SEQ ID NO: 2321839 - DNA, 18 bp, Homo sapiens
ataaatgttgctctaatc

SEQ ID NO: 2321840 - DNA, 19 bp, Homo sapiens
ataaattatttgattattt

SEQ ID NO: 2321841 - DNA, 18 bp, Homo sapiens
ataaattgtagggcttta

SEQ ID NO: 2321842 - DNA, 21 bp, Homo sapiens
ataaatttaaacttacaaact

SEQ ID NO: 2321843 - DNA, 18 bp, Homo sapiens
ataacaaggagatttctt

SEQ ID NO: 2321844 - DNA, 19 bp, Homo sapiens
ataacaaggagatttctta

SEQ ID NO: 2321845 - DNA, 12 bp, Homo sapiens
ataacacatttt

SEQ ID NO: 2321846 - DNA, 22 bp, Homo sapiens
ataacagctgcaattccctgga

SEQ ID NO: 2321847 - DNA, 12 bp, Homo sapiens
ataacataaaag

SEQ ID NO: 2321848 - DNA, 21 bp, Homo sapiens
ataacataaataaaaattcaa

SEQ ID NO: 2321849 - DNA, 14 bp, Homo sapiens
ataacatctttatt

SEQ ID NO: 2321850 - DNA, 18 bp, Homo sapiens
ataacatctttattgaaa

SEQ ID NO: 2321851 - DNA, 17 bp, Homo sapiens
ataacgtttttccttta

SEQ ID NO: 2321852 - DNA, 13 bp, Homo sapiens
ataactagccaga

SEQ ID NO: 2321853 - DNA, 16 bp, Homo sapiens
ataactagccagacaa

SEQ ID NO: 2321854 - DNA, 23 bp, Homo sapiens
ataactagccagacaaaatttga

SEQ ID NO: 2321855 - DNA, 12 bp, Homo sapiens
ataactgaggag

SEQ ID NO: 2321856 - DNA, 15 bp, Homo sapiens
ataagaaaaatgctt

SEQ ID NO: 2321857 - DNA, 18 bp, Homo sapiens
ataagaaacagtttaaca

SEQ ID NO: 2321858 - DNA, 18 bp, Homo sapiens
ataagaaacatgatgtga

SEQ ID NO: 2321859 - DNA, 20 bp, Homo sapiens
ataagaaagcctaaaattga

SEQ ID NO: 2321860 - DNA, 23 bp, Homo sapiens
ataagaagaagttcatgtccaaa

SEQ ID NO: 2321861 - DNA, 23 bp, Homo sapiens
ataagacaaatattcctttgcat

SEQ ID NO: 2321862 - DNA, 23 bp, Homo sapiens
ataagacataacgtttttccttt

SEQ ID NO: 2321863 - DNA, 18 bp, Homo sapiens
ataagacatttgtttgct

SEQ ID NO: 2321864 - DNA, 15 bp, Homo sapiens
ataagagcagtcaca

SEQ ID NO: 2321865 - DNA, 19 bp, Homo sapiens
ataagatacaataaaacaa

SEQ ID NO: 2321866 - DNA, 16 bp, Homo sapiens
ataagcaagagagatg

SEQ ID NO: 2321867 - DNA, 17 bp, Homo sapiens
ataagcaatcaaggtta

SEQ ID NO: 2321868 - DNA, 17 bp, Homo sapiens
ataagcactgtaaactt

SEQ ID NO: 2321869 - DNA, 17 bp, Homo sapiens
ataagctaaagaggctg

SEQ ID NO: 2321870 - DNA, 13 bp, Homo sapiens
ataaggatttttc

SEQ ID NO: 2321871 - DNA, 21 bp, Homo sapiens
ataaggcttaggtgccaggct

SEQ ID NO: 2321872 - DNA, 16 bp, Homo sapiens
ataagggaaaagataa

SEQ ID NO: 2321873 - DNA, 15 bp, Homo sapiens
ataagtaaatgtctt

SEQ ID NO: 2321874 - DNA, 22 bp, Homo sapiens
ataagtccattttttaaaaatg

SEQ ID NO: 2321875 - DNA, 24 bp, Homo sapiens
ataagttcaaattcttctgaactc

SEQ ID NO: 2321876 - DNA, 15 bp, Homo sapiens
ataataaaaatatat

SEQ ID NO: 2321877 - DNA, 12 bp, Homo sapiens
ataataaagtat

SEQ ID NO: 2321878 - DNA, 13 bp, Homo sapiens
ataataatagcta

SEQ ID NO: 2321879 - DNA, 23 bp, Homo sapiens
ataatatataaacaataaaaaca

SEQ ID NO: 2321880 - DNA, 16 bp, Homo sapiens
atacaaactctcacca

SEQ ID NO: 2321881 - DNA, 14 bp, Homo sapiens
atacaactgcctgg

SEQ ID NO: 2321882 - DNA, 17 bp, Homo sapiens
atacaataaaacaaata

SEQ ID NO: 2321883 - DNA, 20 bp, Homo sapiens
atacaataaaacaaataaat

SEQ ID NO: 2321884 - DNA, 13 bp, Homo sapiens
atacacagaggag

SEQ ID NO: 2321885 - DNA, 14 bp, Homo sapiens
atacacatttgcta

SEQ ID NO: 2321886 - DNA, 17 bp, Homo sapiens
atacaccagcaatttag

SEQ ID NO: 2321887 - DNA, 22 bp, Homo sapiens
atacaccccctcttctgagcac

SEQ ID NO: 2321888 - DNA, 23 bp, Homo sapiens
atacaccccctcttctgagcaca

SEQ ID NO: 2321889 - DNA, 17 bp, Homo sapiens
atacactttgttgcaag

SEQ ID NO: 2321890 - DNA, 23 bp, Homo sapiens
atacactttgttgcaagatgtga

SEQ ID NO: 2321891 - DNA, 22 bp, Homo sapiens
atacagaggatgccttttctgt

SEQ ID NO: 2321892 - DNA, 22 bp, Homo sapiens
atacagatctcagggctcggga

SEQ ID NO: 2321893 - DNA, 17 bp, Homo sapiens
atacagtgcagagcctt

SEQ ID NO: 2321894 - DNA, 23 bp, Homo sapiens
atacagtgcagagccttctcaga

SEQ ID NO: 2321895 - DNA, 14 bp, Homo sapiens
atacataaaagaaa

SEQ ID NO: 2321896 - DNA, 20 bp, Homo sapiens
atacataaaagaaataaacc

SEQ ID NO: 2321897 - DNA, 15 bp, Homo sapiens
atacatgagaaagat

SEQ ID NO: 2321898 - DNA, 15 bp, Homo sapiens
atacatgcatataat

SEQ ID NO: 2321899 - DNA, 20 bp, Homo sapiens
atacatgcatataatgaata

SEQ ID NO: 2321900 - DNA, 21 bp, Homo sapiens
atacatgcatataatgaataa

SEQ ID NO: 2321901 - DNA, 19 bp, Homo sapiens
atacattaacggtgctaaa

SEQ ID NO: 2321902 - DNA, 18 bp, Homo sapiens
atacattccctctaattt

SEQ ID NO: 2321903 - DNA, 22 bp, Homo sapiens
atacattttataatgatgaact

SEQ ID NO: 2321904 - DNA, 17 bp, Homo sapiens
atacattttctaaataa

SEQ ID NO: 2321905 - DNA, 18 bp, Homo sapiens
atacattttctaaataaa

SEQ ID NO: 2321906 - DNA, 24 bp, Homo sapiens
atacattttctaaataaaaatatg

SEQ ID NO: 2321907 - DNA, 13 bp, Homo sapiens
ataccaaacatgc

SEQ ID NO: 2321908 - DNA, 22 bp, Homo sapiens
ataccatttagtaagaatacca

SEQ ID NO: 2321909 - DNA, 23 bp, Homo sapiens
ataccccgtctctactaaaaata

SEQ ID NO: 2321910 - DNA, 22 bp, Homo sapiens
atacctattcaagaagatagtt

SEQ ID NO: 2321911 - DNA, 14 bp, Homo sapiens
ataccttctgatga

SEQ ID NO: 2321912 - DNA, 22 bp, Homo sapiens
ataccttctgatgaagttgtac

SEQ ID NO: 2321913 - DNA, 14 bp, Homo sapiens
atacgctaataagt

SEQ ID NO: 2321914 - DNA, 14 bp, Homo sapiens
atactaagagtaaa

SEQ ID NO: 2321915 - DNA, 22 bp, Homo sapiens
atactatatttttctcaatgtt

SEQ ID NO: 2321916 - DNA, 14 bp, Homo sapiens
atactattgcctca

SEQ ID NO: 2321917 - DNA, 12 bp, Homo sapiens
atactccttccc

SEQ ID NO: 2321918 - DNA, 16 bp, Homo sapiens
atactgacctacctca

SEQ ID NO: 2321919 - DNA, 17 bp, Homo sapiens
atactgagaatatacaa

SEQ ID NO: 2321920 - DNA, 17 bp, Homo sapiens
atactgattgggaggtg

SEQ ID NO: 2321921 - DNA, 11 bp, Homo sapiens
atacttaagaa

SEQ ID NO: 2321922 - DNA, 14 bp, Homo sapiens
atacttaagaatac

SEQ ID NO: 2321923 - DNA, 16 bp, Homo sapiens
atacttagagaaccta

SEQ ID NO: 2321924 - DNA, 20 bp, Homo sapiens
atactttagtagacatttat

SEQ ID NO: 2321925 - DNA, 13 bp, Homo sapiens
atagaaaattatt

SEQ ID NO: 2321926 - DNA, 19 bp, Homo sapiens
atagaaaattatttgtatg

SEQ ID NO: 2321927 - DNA, 15 bp, Homo sapiens
atagaactctgggct

SEQ ID NO: 2321928 - DNA, 14 bp, Homo sapiens
atagaataattctt

SEQ ID NO: 2321929 - DNA, 20 bp, Homo sapiens
atagaataattcttttctga

SEQ ID NO: 2321930 - DNA, 16 bp, Homo sapiens
atagaatagcctgagg

SEQ ID NO: 2321931 - DNA, 15 bp, Homo sapiens
atagacttgggatgg

SEQ ID NO: 2321932 - DNA, 12 bp, Homo sapiens
atagaggctagc

SEQ ID NO: 2321933 - DNA, 17 bp, Homo sapiens
atagcaacaacaattgg

SEQ ID NO: 2321934 - DNA, 18 bp, Homo sapiens
atagcaacaacaattggt

SEQ ID NO: 2321935 - DNA, 19 bp, Homo sapiens
atagcagccagttcaaaaa

SEQ ID NO: 2321936 - DNA, 22 bp, Homo sapiens
atagcagtatatgttaatttgt

SEQ ID NO: 2321937 - DNA, 18 bp, Homo sapiens
atagcatcttctcattcc

SEQ ID NO: 2321938 - DNA, 13 bp, Homo sapiens
atagcatgaaata

SEQ ID NO: 2321939 - DNA, 15 bp, Homo sapiens
atagcatgaaataaa

SEQ ID NO: 2321940 - DNA, 18 bp, Homo sapiens
atagcatgcttcctttct

SEQ ID NO: 2321941 - DNA, 23 bp, Homo sapiens
atagcatgcttcctttctctcct

SEQ ID NO: 2321942 - DNA, 22 bp, Homo sapiens
atagcctggccaccagccatcc

SEQ ID NO: 2321943 - DNA, 23 bp, Homo sapiens
atagcctggccaccagccatcct

SEQ ID NO: 2321944 - DNA, 22 bp, Homo sapiens
atagcctttaaatcatttttat

SEQ ID NO: 2321945 - DNA, 16 bp, Homo sapiens
atagctaagatataat

SEQ ID NO: 2321946 - DNA, 16 bp, Homo sapiens
atagctcactgcagcc

SEQ ID NO: 2321947 - DNA, 19 bp, Homo sapiens
atagctcactgcagcctca

SEQ ID NO: 2321948 - DNA, 19 bp, Homo sapiens
atagctcgagcaaaattca

SEQ ID NO: 2321949 - DNA, 17 bp, Homo sapiens
atagcttgcagaactgt

SEQ ID NO: 2321950 - DNA, 18 bp, Homo sapiens
ataggaagggatctgaga

SEQ ID NO: 2321951 - DNA, 20 bp, Homo sapiens
ataggaatgtccaccatgaa

SEQ ID NO: 2321952 - DNA, 14 bp, Homo sapiens
ataggagaggatga

SEQ ID NO: 2321953 - DNA, 20 bp, Homo sapiens
ataggagaggatgagagccc

SEQ ID NO: 2321954 - DNA, 24 bp, Homo sapiens
ataggagaggatgagagcccagag

SEQ ID NO: 2321955 - DNA, 18 bp, Homo sapiens
ataggcagcttctaagag

SEQ ID NO: 2321956 - DNA, 21 bp, Homo sapiens
ataggctattttctaaagact

SEQ ID NO: 2321957 - DNA, 16 bp, Homo sapiens
atagggaaaattctaa

SEQ ID NO: 2321958 - DNA, 15 bp, Homo sapiens
atagggagaatattt

SEQ ID NO: 2321959 - DNA, 15 bp, Homo sapiens
atagggatggcagtg

SEQ ID NO: 2321960 - DNA, 14 bp, Homo sapiens
atagggctgagctc

SEQ ID NO: 2321961 - DNA, 16 bp, Homo sapiens
ataggtctctttgctt

SEQ ID NO: 2321962 - DNA, 22 bp, Homo sapiens
ataggtctctttgctttctggt

SEQ ID NO: 2321963 - DNA, 22 bp, Homo sapiens
ataggtttatattattgattca

SEQ ID NO: 2321964 - DNA, 15 bp, Homo sapiens
atagtaactataaga

SEQ ID NO: 2321965 - DNA, 13 bp, Homo sapiens
atagtaagcatag

SEQ ID NO: 2321966 - DNA, 22 bp, Homo sapiens
atagtaataagatggctgtggc

SEQ ID NO: 2321967 - DNA, 17 bp, Homo sapiens
atagtagttaaataact

SEQ ID NO: 2321968 - DNA, 15 bp, Homo sapiens
atagtatagaagtct

SEQ ID NO: 2321969 - DNA, 19 bp, Homo sapiens
atagtcaatggcttgttca

SEQ ID NO: 2321970 - DNA, 15 bp, Homo sapiens
atagtcgtaagtgga

SEQ ID NO: 2321971 - DNA, 21 bp, Homo sapiens
atagtctaagactatatatat

SEQ ID NO: 2321972 - DNA, 21 bp, Homo sapiens
atagtggggttccatgagtta

SEQ ID NO: 2321973 - DNA, 18 bp, Homo sapiens
atagtgtaacttgcttaa

SEQ ID NO: 2321974 - DNA, 19 bp, Homo sapiens
atagttctgtaataaaact

SEQ ID NO: 2321975 - DNA, 12 bp, Homo sapiens
atagttgtaaag

SEQ ID NO: 2321976 - DNA, 18 bp, Homo sapiens
atagtttctttattttgt

SEQ ID NO: 2321977 - DNA, 23 bp, Homo sapiens
atagttttacttttaaactgtgt

SEQ ID NO: 2321978 - DNA, 16 bp, Homo sapiens
atataaaaaatcatgc

SEQ ID NO: 2321979 - DNA, 12 bp, Homo sapiens
atataaaattat

SEQ ID NO: 2321980 - DNA, 16 bp, Homo sapiens
atataaactcatttat

SEQ ID NO: 2321981 - DNA, 13 bp, Homo sapiens
atataagacaaat

SEQ ID NO: 2321982 - DNA, 16 bp, Homo sapiens
atataagacatttgtt

SEQ ID NO: 2321983 - DNA, 19 bp, Homo sapiens
atataatgaataaatcatt

SEQ ID NO: 2321984 - DNA, 20 bp, Homo sapiens
atataatgttgataatatat

SEQ ID NO: 2321985 - DNA, 16 bp, Homo sapiens
atataatttaaacgtg

SEQ ID NO: 2321986 - DNA, 15 bp, Homo sapiens
atatacattttctaa

SEQ ID NO: 2321987 - DNA, 16 bp, Homo sapiens
atataccaaattaaaa

SEQ ID NO: 2321988 - DNA, 19 bp, Homo sapiens
atataccaaattaaaaaaa

SEQ ID NO: 2321989 - DNA, 15 bp, Homo sapiens
atatacttaagaata

SEQ ID NO: 2321990 - DNA, 12 bp, Homo sapiens
atatagatttta

SEQ ID NO: 2321991 - DNA, 13 bp, Homo sapiens
atataggctattt

SEQ ID NO: 2321992 - DNA, 23 bp, Homo sapiens
atatagttttacttttaaactgt

SEQ ID NO: 2321993 - DNA, 21 bp, Homo sapiens
atatatacacatagttctgta

SEQ ID NO: 2321994 - DNA, 16 bp, Homo sapiens
atatatataaatgtat

SEQ ID NO: 2321995 - DNA, 19 bp, Homo sapiens
atatatcttataaagtgga

SEQ ID NO: 2321996 - DNA, 20 bp, Homo sapiens
atctgctctgttttatacta

SEQ ID NO: 2321997 - DNA, 13 bp, Homo sapiens
atctgctgaggcc

SEQ ID NO: 2321998 - DNA, 21 bp, Homo sapiens
atctgctgaggcccagtgcat

SEQ ID NO: 2321999 - DNA, 15 bp, Homo sapiens
atctgctgtatatgg

SEQ ID NO: 2322000 - DNA, 16 bp, Homo sapiens
atctgctgtcctgttt

SEQ ID NO: 2322001 - DNA, 22 bp, Homo sapiens
atctgctgtcctgtttctgtca

SEQ ID NO: 2322002 - DNA, 20 bp, Homo sapiens
atctggaccccaaagaatag

SEQ ID NO: 2322003 - DNA, 18 bp, Homo sapiens
atctgggcattttcctcc

SEQ ID NO: 2322004 - DNA, 20 bp, Homo sapiens
atctgggcattttcctcctc

SEQ ID NO: 2322005 - DNA, 21 bp, Homo sapiens
atctgggcattttcctcctct

SEQ ID NO: 2322006 - DNA, 22 bp, Homo sapiens
atctgggcattttcctcctctg

SEQ ID NO: 2322007 - DNA, 23 bp, Homo sapiens
atctgggcattttcctcctctgc

SEQ ID NO: 2322008 - DNA, 24 bp, Homo sapiens
atctgggcattttcctcctctgcc

SEQ ID NO: 2322009 - DNA, 17 bp, Homo sapiens
atctgtaagagcttgct

SEQ ID NO: 2322010 - DNA, 13 bp, Homo sapiens
atctgttgtaata

SEQ ID NO: 2322011 - DNA, 15 bp, Homo sapiens
atctgttgtaatatc

SEQ ID NO: 2322012 - DNA, 22 bp, Homo sapiens
atctgttgtaatatcagttaca

SEQ ID NO: 2322013 - DNA, 23 bp, Homo sapiens
atctgttgtaatatcagttacag

SEQ ID NO: 2322014 - DNA, 22 bp, Homo sapiens
atctgttttgtggtttggaata

SEQ ID NO: 2322015 - DNA, 15 bp, Homo sapiens
atcttaaaataattc

SEQ ID NO: 2322016 - DNA, 19 bp, Homo sapiens
atcttaatctgtttattta

SEQ ID NO: 2322017 - DNA, 18 bp, Homo sapiens
atcttagtgcctgagagt

SEQ ID NO: 2322018 - DNA, 16 bp, Homo sapiens
atcttattttctcaat

SEQ ID NO: 2322019 - DNA, 13 bp, Homo sapiens
atcttcagcccag

SEQ ID NO: 2322020 - DNA, 15 bp, Homo sapiens
atcttcgggaccagg

SEQ ID NO: 2322021 - DNA, 14 bp, Homo sapiens
atcttctgccttct

SEQ ID NO: 2322022 - DNA, 22 bp, Homo sapiens
atcttctggtttaaacttgttt

SEQ ID NO: 2322023 - DNA, 21 bp, Homo sapiens
atcttggactcatgaggaggg

SEQ ID NO: 2322024 - DNA, 15 bp, Homo sapiens
atcttgttcaggaaa

SEQ ID NO: 2322025 - DNA, 15 bp, Homo sapiens
atcttgtttctgaaa

SEQ ID NO: 2322026 - DNA, 16 bp, Homo sapiens
atcttgtttctgaaaa

SEQ ID NO: 2322027 - DNA, 14 bp, Homo sapiens
atctttcagaaata

SEQ ID NO: 2322028 - DNA, 13 bp, Homo sapiens
atctttctcttcc

SEQ ID NO: 2322029 - DNA, 15 bp, Homo sapiens
atctttgaatatgta

SEQ ID NO: 2322030 - DNA, 15 bp, Homo sapiens
atctttgtaccaaaa

SEQ ID NO: 2322031 - DNA, 19 bp, Homo sapiens
atctttgtaccaaaatttt

SEQ ID NO: 2322032 - DNA, 20 bp, Homo sapiens
atcttttctaatcacagtgt

SEQ ID NO: 2322033 - DNA, 21 bp, Homo sapiens
atcttttctaatcacagtgtt

SEQ ID NO: 2322034 - DNA, 13 bp, Homo sapiens
atcttttcttatt

SEQ ID NO: 2322035 - DNA, 13 bp, Homo sapiens
atgaaaaatataa

SEQ ID NO: 2322036 - DNA, 17 bp, Homo sapiens
atgaaaataaaacacac

SEQ ID NO: 2322037 - DNA, 18 bp, Homo sapiens
atgaaaataactgaattt

SEQ ID NO: 2322038 - DNA, 22 bp, Homo sapiens
atgaaaataactgaatttggag

SEQ ID NO: 2322039 - DNA, 22 bp, Homo sapiens
atgaaaatatagacattctcac

SEQ ID NO: 2322040 - DNA, 16 bp, Homo sapiens
atgaaagctgttcctt

SEQ ID NO: 2322041 - DNA, 18 bp, Homo sapiens
atgaaagctgttccttgg

SEQ ID NO: 2322042 - DNA, 17 bp, Homo sapiens
atgaaatttaagcacaa

SEQ ID NO: 2322043 - DNA, 12 bp, Homo sapiens
atgaacagctgt

SEQ ID NO: 2322044 - DNA, 21 bp, Homo sapiens
atgaagaaagtcaaaaaatta

SEQ ID NO: 2322045 - DNA, 13 bp, Homo sapiens
atgaagcaggagg

SEQ ID NO: 2322046 - DNA, 14 bp, Homo sapiens
atgaagcaggaggc

SEQ ID NO: 2322047 - DNA, 15 bp, Homo sapiens
atgaagcaggaggcc

SEQ ID NO: 2322048 - DNA, 14 bp, Homo sapiens
atgaagtagaagtt

SEQ ID NO: 2322049 - DNA, 15 bp, Homo sapiens
atgaagtttaaattc

SEQ ID NO: 2322050 - DNA, 15 bp, Homo sapiens
atgaataaagaatgc

SEQ ID NO: 2322051 - DNA, 17 bp, Homo sapiens
atgaataaagaatgcca

SEQ ID NO: 2322052 - DNA, 14 bp, Homo sapiens
atgaataatggaaa

SEQ ID NO: 2322053 - DNA, 20 bp, Homo sapiens
atgaataatggaaaatgcca

SEQ ID NO: 2322054 - DNA, 18 bp, Homo sapiens
atgaatgattaaattatg

SEQ ID NO: 2322055 - DNA, 19 bp, Homo sapiens
atgaatgattaaattatga

SEQ ID NO: 2322056 - DNA, 12 bp, Homo sapiens
atgaatggtctg

SEQ ID NO: 2322057 - DNA, 15 bp, Homo sapiens
atgaatgtaaggatg

SEQ ID NO: 2322058 - DNA, 16 bp, Homo sapiens
atgaattgcattattt

SEQ ID NO: 2322059 - DNA, 17 bp, Homo sapiens
atgaattttaaagtatg

SEQ ID NO: 2322060 - DNA, 17 bp, Homo sapiens
atgaatttttattgaga

SEQ ID NO: 2322061 - DNA, 16 bp, Homo sapiens
atgacagcctgcagca

SEQ ID NO: 2322062 - DNA, 20 bp, Homo sapiens
atgacagccttttttcctgg

SEQ ID NO: 2322063 - DNA, 17 bp, Homo sapiens
atgacataataaagtat

SEQ ID NO: 2322064 - DNA, 22 bp, Homo sapiens
atgacattaaatgcaataattt

SEQ ID NO: 2322065 - DNA, 19 bp, Homo sapiens
atgactaaagagagaatgt

SEQ ID NO: 2322066 - DNA, 17 bp, Homo sapiens
atgactatataatttat

SEQ ID NO: 2322067 - DNA, 14 bp, Homo sapiens
atgactgccttgcc

SEQ ID NO: 2322068 - DNA, 18 bp, Homo sapiens
atgactgccttgcctcct

SEQ ID NO: 2322069 - DNA, 14 bp, Homo sapiens
atgagaaaaataaa

SEQ ID NO: 2322070 - DNA, 14 bp, Homo sapiens
atgtgaattattga

SEQ ID NO: 2322071 - DNA, 16 bp, Homo sapiens
atgtgaattattgaca

SEQ ID NO: 2322072 - DNA, 13 bp, Homo sapiens
atgtgaattttta

SEQ ID NO: 2322073 - DNA, 14 bp, Homo sapiens
atgtgaatttttaa

SEQ ID NO: 2322074 - DNA, 15 bp, Homo sapiens
atgtgaatttttaag

SEQ ID NO: 2322075 - DNA, 18 bp, Homo sapiens
atgtgaatttttaagctg

SEQ ID NO: 2322076 - DNA, 21 bp, Homo sapiens
atgtgaatttttaagctgcaa

SEQ ID NO: 2322077 - DNA, 21 bp, Homo sapiens
atgtgacattaacaaataaaa

SEQ ID NO: 2322078 - DNA, 15 bp, Homo sapiens
atgtgaccataatgt

SEQ ID NO: 2322079 - DNA, 16 bp, Homo sapiens
atgtgaccataatgta

SEQ ID NO: 2322080 - DNA, 14 bp, Homo sapiens
atgtgaccctccaa

SEQ ID NO: 2322081 - DNA, 20 bp, Homo sapiens
atgtgacttggattcaattt

SEQ ID NO: 2322082 - DNA, 17 bp, Homo sapiens
atgtgagccttgtgcat

SEQ ID NO: 2322083 - DNA, 15 bp, Homo sapiens
atgtgagctcttcct

SEQ ID NO: 2322084 - DNA, 22 bp, Homo sapiens
atgtgatacattttttaagctt

SEQ ID NO: 2322085 - DNA, 22 bp, Homo sapiens
atgtgatctgggcattttcctc

SEQ ID NO: 2322086 - DNA, 16 bp, Homo sapiens
atgtgcatagtttctt

SEQ ID NO: 2322087 - DNA, 18 bp, Homo sapiens
atgtgcatagtttcttta

SEQ ID NO: 2322088 - DNA, 14 bp, Homo sapiens
atgtgcatttaatt

SEQ ID NO: 2322089 - DNA, 19 bp, Homo sapiens
atgtgcatttaattagaaa

SEQ ID NO: 2322090 - DNA, 18 bp, Homo sapiens
atgtgctatacacacaca

SEQ ID NO: 2322091 - DNA, 22 bp, Homo sapiens
atgtggaaggaaaatatttcat

SEQ ID NO: 2322092 - DNA, 14 bp, Homo sapiens
atgtggaggaagag

SEQ ID NO: 2322093 - DNA, 16 bp, Homo sapiens
atgtggaggaagagcc

SEQ ID NO: 2322094 - DNA, 21 bp, Homo sapiens
atgtggaggaagagccacctg

SEQ ID NO: 2322095 - DNA, 19 bp, Homo sapiens
atgtgggatattgaatgtt

SEQ ID NO: 2322096 - DNA, 19 bp, Homo sapiens
atgtgtcccccccaggcct

SEQ ID NO: 2322097 - DNA, 20 bp, Homo sapiens
atgtgtgccagatgccctgt

SEQ ID NO: 2322098 - DNA, 19 bp, Homo sapiens
atgtgtggctgtgggtgtg

SEQ ID NO: 2322099 - DNA, 14 bp, Homo sapiens
atgtgtgttttttc

SEQ ID NO: 2322100 - DNA, 13 bp, Homo sapiens
atgtgttcttatt

SEQ ID NO: 2322101 - DNA, 15 bp, Homo sapiens
atgttaaatttgtaa

SEQ ID NO: 2322102 - DNA, 13 bp, Homo sapiens
atgttaaggaaac

SEQ ID NO: 2322103 - DNA, 18 bp, Homo sapiens
atgttaaggaaactctta

SEQ ID NO: 2322104 - DNA, 19 bp, Homo sapiens
atgttaaggaaactcttat

SEQ ID NO: 2322105 - DNA, 20 bp, Homo sapiens
atgttaatttgtgtgttttt

SEQ ID NO: 2322106 - DNA, 21 bp, Homo sapiens
atgttacgtgaagaaataaat

SEQ ID NO: 2322107 - DNA, 14 bp, Homo sapiens
atgttagagtaatg

SEQ ID NO: 2322108 - DNA, 14 bp, Homo sapiens
atgttagtaaagga

SEQ ID NO: 2322109 - DNA, 16 bp, Homo sapiens
atgttagtaaaggaac

SEQ ID NO: 2322110 - DNA, 16 bp, Homo sapiens
atgttcctaacaaaat

SEQ ID NO: 2322111 - DNA, 18 bp, Homo sapiens
atgttcctaacaaaatga

SEQ ID NO: 2322112 - DNA, 21 bp, Homo sapiens
atgttctagtctgctttggta

SEQ ID NO: 2322113 - DNA, 12 bp, Homo sapiens
atgttgataaac

SEQ ID NO: 2322114 - DNA, 21 bp, Homo sapiens
atgttgataaaccaaaaacat

SEQ ID NO: 2322115 - DNA, 16 bp, Homo sapiens
atgttgtaatattttg

SEQ ID NO: 2322116 - DNA, 14 bp, Homo sapiens
atgttgtcaaggat

SEQ ID NO: 2322117 - DNA, 17 bp, Homo sapiens
atgttgttgaactaata

SEQ ID NO: 2322118 - DNA, 16 bp, Homo sapiens
atgttgtttataataa

SEQ ID NO: 2322119 - DNA, 17 bp, Homo sapiens
atgttgtttataataaa

SEQ ID NO: 2322120 - DNA, 19 bp, Homo sapiens
atgtttaaaataaaatgaa

SEQ ID NO: 2322121 - DNA, 21 bp, Homo sapiens
atgtttatgagccagacaaat

SEQ ID NO: 2322122 - DNA, 22 bp, Homo sapiens
attatacatgtgatacattttt

SEQ ID NO: 2322123 - DNA, 22 bp, Homo sapiens
attatagtaatgtgacttggat

SEQ ID NO: 2322124 - DNA, 15 bp, Homo sapiens
attatagtgtagaaa

SEQ ID NO: 2322125 - DNA, 20 bp, Homo sapiens
attatatacatactgcatct

SEQ ID NO: 2322126 - DNA, 15 bp, Homo sapiens
attatatatactata

SEQ ID NO: 2322127 - DNA, 13 bp, Homo sapiens
attatatgaagtt

SEQ ID NO: 2322128 - DNA, 12 bp, Homo sapiens
attatcattgtt

SEQ ID NO: 2322129 - DNA, 15 bp, Homo sapiens
attatgaagctcata

SEQ ID NO: 2322130 - DNA, 23 bp, Homo sapiens
attatgagattggttttcctgtg

SEQ ID NO: 2322131 - DNA, 15 bp, Homo sapiens
attatgtcaaccagg

SEQ ID NO: 2322132 - DNA, 15 bp, Homo sapiens
attatgtgcaaaggt

SEQ ID NO: 2322133 - DNA, 17 bp, Homo sapiens
attatgttagtttaaaa

SEQ ID NO: 2322134 - DNA, 18 bp, Homo sapiens
attatgttagtttaaaag

SEQ ID NO: 2322135 - DNA, 19 bp, Homo sapiens
attatgttagtttaaaagg

SEQ ID NO: 2322136 - DNA, 23 bp, Homo sapiens
attattaaattgtaaaactccaa

SEQ ID NO: 2322137 - DNA, 17 bp, Homo sapiens
attattagataatattt

SEQ ID NO: 2322138 - DNA, 15 bp, Homo sapiens
attattatatacata

SEQ ID NO: 2322139 - DNA, 21 bp, Homo sapiens
attattcaagaatgaaaaata

SEQ ID NO: 2322140 - DNA, 18 bp, Homo sapiens
attattcataatgtgaga

SEQ ID NO: 2322141 - DNA, 14 bp, Homo sapiens
attattgacactga

SEQ ID NO: 2322142 - DNA, 16 bp, Homo sapiens
attattgacactgaac

SEQ ID NO: 2322143 - DNA, 18 bp, Homo sapiens
attattgacactgaactt

SEQ ID NO: 2322144 - DNA, 14 bp, Homo sapiens
attatttaagacta

SEQ ID NO: 2322145 - DNA, 12 bp, Homo sapiens
attatttaataa

SEQ ID NO: 2322146 - DNA, 15 bp, Homo sapiens
attatttaataacat

SEQ ID NO: 2322147 - DNA, 15 bp, Homo sapiens
attatttaattgtcc

SEQ ID NO: 2322148 - DNA, 13 bp, Homo sapiens
attatttcttctc

SEQ ID NO: 2322149 - DNA, 12 bp, Homo sapiens
attatttgctat

SEQ ID NO: 2322150 - DNA, 12 bp, Homo sapiens
attcaaagcatg

SEQ ID NO: 2322151 - DNA, 13 bp, Homo sapiens
attcaactttgta

SEQ ID NO: 2322152 - DNA, 18 bp, Homo sapiens
attcaactttgtaaaaat

SEQ ID NO: 2322153 - DNA, 18 bp, Homo sapiens
attcaagaagatagttgt

SEQ ID NO: 2322154 - DNA, 21 bp, Homo sapiens
attcaagaatgaaaaatataa

SEQ ID NO: 2322155 - DNA, 19 bp, Homo sapiens
attcaagagctagaaaaat

SEQ ID NO: 2322156 - DNA, 20 bp, Homo sapiens
attcaagagctagaaaaata

SEQ ID NO: 2322157 - DNA, 21 bp, Homo sapiens
attcaagtgacacattaatga

SEQ ID NO: 2322158 - DNA, 16 bp, Homo sapiens
attcaatctgtaaact

SEQ ID NO: 2322159 - DNA, 18 bp, Homo sapiens
attcaatctgtaaactgt

SEQ ID NO: 2322160 - DNA, 12 bp, Homo sapiens
attcaattagtg

SEQ ID NO: 2322161 - DNA, 21 bp, Homo sapiens
attcaatttaagtatatttgt

SEQ ID NO: 2322162 - DNA, 21 bp, Homo sapiens
attcaattttaaggcatattt

SEQ ID NO: 2322163 - DNA, 19 bp, Homo sapiens
attcacacctcacgctctg

SEQ ID NO: 2322164 - DNA, 18 bp, Homo sapiens
attcacctcagtagaaaa

SEQ ID NO: 2322165 - DNA, 12 bp, Homo sapiens
attcagaggcag

SEQ ID NO: 2322166 - DNA, 20 bp, Homo sapiens
attcagaggcagtgatgact

SEQ ID NO: 2322167 - DNA, 12 bp, Homo sapiens
attcagatgtat

SEQ ID NO: 2322168 - DNA, 14 bp, Homo sapiens
attcaggtaacact

SEQ ID NO: 2322169 - DNA, 18 bp, Homo sapiens
attcagtaactgtcaggc

SEQ ID NO: 2322170 - DNA, 16 bp, Homo sapiens
attcatatctaaatag

SEQ ID NO: 2322171 - DNA, 19 bp, Homo sapiens
attcatggctacctcagaa

SEQ ID NO: 2322172 - DNA, 13 bp, Homo sapiens
attccaaaatatt

SEQ ID NO: 2322173 - DNA, 15 bp, Homo sapiens
attccaaaatattat

SEQ ID NO: 2322174 - DNA, 14 bp, Homo sapiens
attccaagtctcca

SEQ ID NO: 2322175 - DNA, 19 bp, Homo sapiens
attccactacacctggctg

SEQ ID NO: 2322176 - DNA, 21 bp, Homo sapiens
attccagatctttcagaaata

SEQ ID NO: 2322177 - DNA, 23 bp, Homo sapiens
attccagctgtcactctgtgcct

SEQ ID NO: 2322178 - DNA, 18 bp, Homo sapiens
attccagtacagtattct

SEQ ID NO: 2322179 - DNA, 15 bp, Homo sapiens
aaatagtgtgaaata

SEQ ID NO: 2322180 - DNA, 16 bp, Homo sapiens
aaatataacacatttt

SEQ ID NO: 2322181 - DNA, 19 bp, Homo sapiens
aaatataagacatttgttt

SEQ ID NO: 2322182 - DNA, 19 bp, Homo sapiens
aaatatacattttctaaat

SEQ ID NO: 2322183 - DNA, 17 bp, Homo sapiens
aaatatatcttataaag

SEQ ID NO: 2322184 - DNA, 18 bp, Homo sapiens
aaatatattacttaactg

SEQ ID NO: 2322185 - DNA, 12 bp, Homo sapiens
aaatatcaaagt

SEQ ID NO: 2322186 - DNA, 14 bp, Homo sapiens
aaatatcaaagtca

SEQ ID NO: 2322187 - DNA, 22 bp, Homo sapiens
aaatatcaaagtcattaaagac

SEQ ID NO: 2322188 - DNA, 22 bp, Homo sapiens
aaatatctatttgaataaatta

SEQ ID NO: 2322189 - DNA, 17 bp, Homo sapiens
aaatatgtaatttcaaa

SEQ ID NO: 2322190 - DNA, 19 bp, Homo sapiens
aaatatgtaatttcaaaat

SEQ ID NO: 2322191 - DNA, 19 bp, Homo sapiens
aaatattcctttgcatatt

SEQ ID NO: 2322192 - DNA, 22 bp, Homo sapiens
aaatattgttttacaatagttc

SEQ ID NO: 2322193 - DNA, 13 bp, Homo sapiens
aaatattttctac

SEQ ID NO: 2322194 - DNA, 22 bp, Homo sapiens
aaatcaatacactagttgtttc

SEQ ID NO: 2322195 - DNA, 17 bp, Homo sapiens
aaatcaatagttgaatt

SEQ ID NO: 2322196 - DNA, 15 bp, Homo sapiens
aaatcacaatgagaa

SEQ ID NO: 2322197 - DNA, 16 bp, Homo sapiens
aaatcacaatgagaaa

SEQ ID NO: 2322198 - DNA, 14 bp, Homo sapiens
aaatcactttcata

SEQ ID NO: 2322199 - DNA, 16 bp, Homo sapiens
aaatcataaagtcagt

SEQ ID NO: 2322200 - DNA, 14 bp, Homo sapiens
aaatcattccttag

SEQ ID NO: 2322201 - DNA, 19 bp, Homo sapiens
aaatcattcttactaaaaa

SEQ ID NO: 2322202 - DNA, 21 bp, Homo sapiens
aaatcattcttactaaaaagt

SEQ ID NO: 2322203 - DNA, 20 bp, Homo sapiens
aaatccccttcgctgaaatt

SEQ ID NO: 2322204 - DNA, 17 bp, Homo sapiens
aaatccttttacctttt

SEQ ID NO: 2322205 - DNA, 13 bp, Homo sapiens
aaatctaaaatgt

SEQ ID NO: 2322206 - DNA, 15 bp, Homo sapiens
aaatctcagaacctt

SEQ ID NO: 2322207 - DNA, 17 bp, Homo sapiens
aaatctcattatttcaa

SEQ ID NO: 2322208 - DNA, 20 bp, Homo sapiens
aaatctcattatttcaaaat

SEQ ID NO: 2322209 - DNA, 15 bp, Homo sapiens
aaatgaaatgcatat

SEQ ID NO: 2322210 - DNA, 15 bp, Homo sapiens
aaatgagctctgaaa

SEQ ID NO: 2322211 - DNA, 19 bp, Homo sapiens
aaatgagctctgaaatctt

SEQ ID NO: 2322212 - DNA, 18 bp, Homo sapiens
aaatgagcttgattaaat

SEQ ID NO: 2322213 - DNA, 15 bp, Homo sapiens
aaatgagtaaaaact

SEQ ID NO: 2322214 - DNA, 12 bp, Homo sapiens
aaatgatgattg

SEQ ID NO: 2322215 - DNA, 14 bp, Homo sapiens
aaatgcaataattt

SEQ ID NO: 2322216 - DNA, 12 bp, Homo sapiens
aaatgcatattt

SEQ ID NO: 2322217 - DNA, 14 bp, Homo sapiens
aaatgcctttgaga

SEQ ID NO: 2322218 - DNA, 20 bp, Homo sapiens
aaatgcctttgagacagttt

SEQ ID NO: 2322219 - DNA, 22 bp, Homo sapiens
aaatgcttaaatttcagaatta

SEQ ID NO: 2322220 - DNA, 19 bp, Homo sapiens
aaatgcttgaccctgaaat

SEQ ID NO: 2322221 - DNA, 18 bp, Homo sapiens
aaatgcttgggtacactt

SEQ ID NO: 2322222 - DNA, 23 bp, Homo sapiens
aaatggactggagctcatctgca

SEQ ID NO: 2322223 - DNA, 21 bp, Homo sapiens
aaatggcatttagcacagtat

SEQ ID NO: 2322224 - DNA, 23 bp, Homo sapiens
aaatggcatttagcacagtattt

SEQ ID NO: 2322225 - DNA, 19 bp, Homo sapiens
aaatggccattttaaaatg

SEQ ID NO: 2322226 - DNA, 14 bp, Homo sapiens
aaatggcgtctgct

SEQ ID NO: 2322227 - DNA, 20 bp, Homo sapiens
aaatgggagctgagcagcct

SEQ ID NO: 2322228 - DNA, 20 bp, Homo sapiens
aaatgggtgtatataatttt

SEQ ID NO: 2322229 - DNA, 22 bp, Homo sapiens
aaatgggtgtatataattttat

SEQ ID NO: 2322230 - DNA, 22 bp, Homo sapiens
aaatggtcccaattaagaaatt

SEQ ID NO: 2322231 - DNA, 20 bp, Homo sapiens
aaatggttaaattttacatg

SEQ ID NO: 2322232 - DNA, 22 bp, Homo sapiens
aaatgtaaagatatttttatct

SEQ ID NO: 2322233 - DNA, 13 bp, Homo sapiens
aaatgtaatttaa

SEQ ID NO: 2322234 - DNA, 17 bp, Homo sapiens
aaatgtaatttaaatga

SEQ ID NO: 2322235 - DNA, 18 bp, Homo sapiens
aaatgtaatttaaatgaa

SEQ ID NO: 2322236 - DNA, 12 bp, Homo sapiens
aaatgtacattt

SEQ ID NO: 2322237 - DNA, 15 bp, Homo sapiens
aaatgtataaatata

SEQ ID NO: 2322238 - DNA, 17 bp, Homo sapiens
aaatgtataaatataca

SEQ ID NO: 2322239 - DNA, 19 bp, Homo sapiens
aaatgtataaatatacagt

SEQ ID NO: 2322240 - DNA, 21 bp, Homo sapiens
aaatgtatgttggtttagcgt

SEQ ID NO: 2322241 - DNA, 14 bp, Homo sapiens
aaatgtattccttt

SEQ ID NO: 2322242 - DNA, 21 bp, Homo sapiens
aaatgtattcctttaaaatat

SEQ ID NO: 2322243 - DNA, 14 bp, Homo sapiens
aaatgtggccaagc

SEQ ID NO: 2322244 - DNA, 13 bp, Homo sapiens
aaatgtgtacata

SEQ ID NO: 2322245 - DNA, 18 bp, Homo sapiens
aaatgttaaaagttttat

SEQ ID NO: 2322246 - DNA, 22 bp, Homo sapiens
aaatgttgctctaatcagattg

SEQ ID NO: 2322247 - DNA, 23 bp, Homo sapiens
aaatgtttcattatgcactttta

SEQ ID NO: 2322248 - DNA, 11 bp, Homo sapiens
aaatgtttctt

SEQ ID NO: 2322249 - DNA, 15 bp, Homo sapiens
aaatgtttcttttaa

SEQ ID NO: 2322250 - DNA, 19 bp, Homo sapiens
aaatgtttggatggtttgt

SEQ ID NO: 2322251 - DNA, 15 bp, Homo sapiens
aaatgttttatgaca

SEQ ID NO: 2322252 - DNA, 19 bp, Homo sapiens
aaatgttttatgacatttt

SEQ ID NO: 2322253 - DNA, 12 bp, Homo sapiens
aaatgtttttag

SEQ ID NO: 2322254 - DNA, 22 bp, Homo sapiens
aaatgtttttagaacatgtaaa

SEQ ID NO: 2322255 - DNA, 15 bp, Homo sapiens
aaattaaaaaaaaat

SEQ ID NO: 2322256 - DNA, 12 bp, Homo sapiens
aaattaaaacaa

SEQ ID NO: 2322257 - DNA, 15 bp, Homo sapiens
aaattaaaacaaata

SEQ ID NO: 2322258 - DNA, 19 bp, Homo sapiens
aaattaaaacaaatataca

SEQ ID NO: 2322259 - DNA, 23 bp, Homo sapiens
aaattaacttttttgtggcaatt

SEQ ID NO: 2322260 - DNA, 16 bp, Homo sapiens
aaattacctttaattt

SEQ ID NO: 2322261 - DNA, 20 bp, Homo sapiens
aaattacctttaattttaat

SEQ ID NO: 2322262 - DNA, 13 bp, Homo sapiens
aaattatgaagct

SEQ ID NO: 2322263 - DNA, 17 bp, Homo sapiens
aaattatttgattattt

SEQ ID NO: 2322264 - DNA, 14 bp, Homo sapiens
aaattcaaagcatg

SEQ ID NO: 2322265 - DNA, 15 bp, Homo sapiens
aaattcaactttgta

SEQ ID NO: 2322266 - DNA, 22 bp, Homo sapiens
aaattcaagagctagaaaaata

SEQ ID NO: 2322267 - DNA, 18 bp, Homo sapiens
aaattcatggcatgctta

SEQ ID NO: 2322268 - DNA, 11 bp, Homo sapiens
aaattcctgta

SEQ ID NO: 2322269 - DNA, 20 bp, Homo sapiens
aaattgatttgtcaagagga

SEQ ID NO: 2322270 - DNA, 16 bp, Homo sapiens
aaattgcagtaacaaa

SEQ ID NO: 2322271 - DNA, 23 bp, Homo sapiens
aaattgcatactttgtattttga

SEQ ID NO: 2322272 - DNA, 19 bp, Homo sapiens
aaattgccctatgctgtgc

SEQ ID NO: 2322273 - DNA, 13 bp, Homo sapiens
aaatttaaaaaat

SEQ ID NO: 2322274 - DNA, 11 bp, Homo sapiens
aaatttaagag

SEQ ID NO: 2322275 - DNA, 18 bp, Homo sapiens
aaatttcactactagatt

SEQ ID NO: 2322276 - DNA, 14 bp, Homo sapiens
aaatttcttatgtg

SEQ ID NO: 2322277 - DNA, 20 bp, Homo sapiens
aaatttcttatgtgacatta

SEQ ID NO: 2322278 - DNA, 14 bp, Homo sapiens
aaatttgtaagttt

SEQ ID NO: 2322279 - DNA, 16 bp, Homo sapiens
aaatttgtaagtttca

SEQ ID NO: 2322280 - DNA, 19 bp, Homo sapiens
aaatttgtaagtttcaggt

SEQ ID NO: 2322281 - DNA, 15 bp, Homo sapiens
aaatttgtcttaaaa

SEQ ID NO: 2322282 - DNA, 10 bp, Homo sapiens
aaattttaaa

SEQ ID NO: 2322283 - DNA, 13 bp, Homo sapiens
aaattttaaaaaa

SEQ ID NO: 2322284 - DNA, 14 bp, Homo sapiens
aaattttaaaaaag

SEQ ID NO: 2322285 - DNA, 12 bp, Homo sapiens
aaattttaaagc

SEQ ID NO: 2322286 - DNA, 14 bp, Homo sapiens
aaattttacatgac

SEQ ID NO: 2322287 - DNA, 12 bp, Homo sapiens
aaattttgtaag

SEQ ID NO: 2322288 - DNA, 13 bp, Homo sapiens
aaattttttgact

SEQ ID NO: 2322289 - DNA, 13 bp, Homo sapiens
aaattttttggca

SEQ ID NO: 2322290 - DNA, 13 bp, Homo sapiens
aacaaaaacagaa

SEQ ID NO: 2322291 - DNA, 20 bp, Homo sapiens
aacaaaaaccaaatgtttat

SEQ ID NO: 2322292 - DNA, 23 bp, Homo sapiens
aacaaaaaggtaaatcccacatc

SEQ ID NO: 2322293 - DNA, 15 bp, Homo sapiens
aacaaagggttttct

SEQ ID NO: 2322294 - DNA, 15 bp, Homo sapiens
aagccttaagcaaat

SEQ ID NO: 2322295 - DNA, 16 bp, Homo sapiens
aagccttaagcaaatt

SEQ ID NO: 2322296 - DNA, 22 bp, Homo sapiens
aagccttcaaaactatagcttg

SEQ ID NO: 2322297 - DNA, 16 bp, Homo sapiens
aagccttcagctccag

SEQ ID NO: 2322298 - DNA, 17 bp, Homo sapiens
aagccttcagctccagg

SEQ ID NO: 2322299 - DNA, 19 bp, Homo sapiens
aagccttcagctccaggga

SEQ ID NO: 2322300 - DNA, 12 bp, Homo sapiens
aagcgccctcac

SEQ ID NO: 2322301 - DNA, 19 bp, Homo sapiens
aagctattagccaggatca

SEQ ID NO: 2322302 - DNA, 13 bp, Homo sapiens
aagctatttaagt

SEQ ID NO: 2322303 - DNA, 22 bp, Homo sapiens
aagctatttaagtggactgtat

SEQ ID NO: 2322304 - DNA, 18 bp, Homo sapiens
aagctcaaatgaaatgta

SEQ ID NO: 2322305 - DNA, 20 bp, Homo sapiens
aagctcatatccttttgaag

SEQ ID NO: 2322306 - DNA, 11 bp, Homo sapiens
aagctgaaatt

SEQ ID NO: 2322307 - DNA, 12 bp, Homo sapiens
aagctgaaattt

SEQ ID NO: 2322308 - DNA, 13 bp, Homo sapiens
aagctgaaatttt

SEQ ID NO: 2322309 - DNA, 20 bp, Homo sapiens
aagctgatattatttcttct

SEQ ID NO: 2322310 - DNA, 12 bp, Homo sapiens
aagctgcactgt

SEQ ID NO: 2322311 - DNA, 15 bp, Homo sapiens
aagctgcagagattt

SEQ ID NO: 2322312 - DNA, 23 bp, Homo sapiens
aagctgcagagatttctcattga

SEQ ID NO: 2322313 - DNA, 20 bp, Homo sapiens
aagctgcccactgtttctct

SEQ ID NO: 2322314 - DNA, 20 bp, Homo sapiens
aagctgcctggtatatccaa

SEQ ID NO: 2322315 - DNA, 22 bp, Homo sapiens
aagctggctttgaaacctcagg

SEQ ID NO: 2322316 - DNA, 17 bp, Homo sapiens
aagctggtctagactgt

SEQ ID NO: 2322317 - DNA, 13 bp, Homo sapiens
aagctggtgctac

SEQ ID NO: 2322318 - DNA, 14 bp, Homo sapiens
aagctgtttggaaa

SEQ ID NO: 2322319 - DNA, 15 bp, Homo sapiens
aagcttcagttgctt

SEQ ID NO: 2322320 - DNA, 16 bp, Homo sapiens
aagcttcagttgcttg

SEQ ID NO: 2322321 - DNA, 18 bp, Homo sapiens
aagcttcagttgcttgtc

SEQ ID NO: 2322322 - DNA, 20 bp, Homo sapiens
aaggaaaagaaaacaaaaaa

SEQ ID NO: 2322323 - DNA, 19 bp, Homo sapiens
aaggaaactcttatctcag

SEQ ID NO: 2322324 - DNA, 12 bp, Homo sapiens
aaggaaagctgt

SEQ ID NO: 2322325 - DNA, 18 bp, Homo sapiens
aaggaaagctgtgtttat

SEQ ID NO: 2322326 - DNA, 14 bp, Homo sapiens
aaggaagaagaaat

SEQ ID NO: 2322327 - DNA, 20 bp, Homo sapiens
aaggaagcactctgtatatt

SEQ ID NO: 2322328 - DNA, 15 bp, Homo sapiens
aaggacgcctgcagg

SEQ ID NO: 2322329 - DNA, 19 bp, Homo sapiens
aaggacgcctgcaggagag

SEQ ID NO: 2322330 - DNA, 15 bp, Homo sapiens
aaggagatttcttag

SEQ ID NO: 2322331 - DNA, 17 bp, Homo sapiens
aaggaggggctgtaaaa

SEQ ID NO: 2322332 - DNA, 20 bp, Homo sapiens
aaggataaatcataaagtca

SEQ ID NO: 2322333 - DNA, 22 bp, Homo sapiens
aaggataaatcataaagtcagt

SEQ ID NO: 2322334 - DNA, 20 bp, Homo sapiens
aaggatagtaagcatagaaa

SEQ ID NO: 2322335 - DNA, 18 bp, Homo sapiens
aaggatcggactctgccc

SEQ ID NO: 2322336 - DNA, 12 bp, Homo sapiens
aaggatctgctg

SEQ ID NO: 2322337 - DNA, 15 bp, Homo sapiens
aaggatctgctgagg

SEQ ID NO: 2322338 - DNA, 12 bp, Homo sapiens
aaggattgtaaa

SEQ ID NO: 2322339 - DNA, 14 bp, Homo sapiens
aaggattgtaaaaa

SEQ ID NO: 2322340 - DNA, 23 bp, Homo sapiens
aaggattgtaaaaaaaaatgcct

SEQ ID NO: 2322341 - DNA, 16 bp, Homo sapiens
aaggcaagagatgaat

SEQ ID NO: 2322342 - DNA, 19 bp, Homo sapiens
aaggcaagagggggtggag

SEQ ID NO: 2322343 - DNA, 13 bp, Homo sapiens
aaggcagagaaat

SEQ ID NO: 2322344 - DNA, 20 bp, Homo sapiens
aaggcagattttacagagcg

SEQ ID NO: 2322345 - DNA, 15 bp, Homo sapiens
aaggcaggaagggaa

SEQ ID NO: 2322346 - DNA, 16 bp, Homo sapiens
aaggcatatttaacaa

SEQ ID NO: 2322347 - DNA, 18 bp, Homo sapiens
aaggccctgctgagtcat

SEQ ID NO: 2322348 - DNA, 14 bp, Homo sapiens
aaggcctgagcccc

SEQ ID NO: 2322349 - DNA, 12 bp, Homo sapiens
aaggcgctgaga

SEQ ID NO: 2322350 - DNA, 17 bp, Homo sapiens
aaggcgctgagactgtg

SEQ ID NO: 2322351 - DNA, 23 bp, Homo sapiens
aaggctgagacagtgaatttggg

SEQ ID NO: 2322352 - DNA, 12 bp, Homo sapiens
aaggcttctctc

SEQ ID NO: 2322353 - DNA, 13 bp, Homo sapiens
aaggcttgaagct

SEQ ID NO: 2322354 - DNA, 20 bp, Homo sapiens
aagggaagcgtatatactta

SEQ ID NO: 2322355 - DNA, 19 bp, Homo sapiens
aagggaccctttgggggtt

SEQ ID NO: 2322356 - DNA, 12 bp, Homo sapiens
aagggagaagaa

SEQ ID NO: 2322357 - DNA, 16 bp, Homo sapiens
aagggagaagaaaggt

SEQ ID NO: 2322358 - DNA, 20 bp, Homo sapiens
aagggagaataaaattccta

SEQ ID NO: 2322359 - DNA, 23 bp, Homo sapiens
aagggagaataaaattcctatct

SEQ ID NO: 2322360 - DNA, 16 bp, Homo sapiens
aagggatctgagaaca

SEQ ID NO: 2322361 - DNA, 20 bp, Homo sapiens
aagggcagttttgaggcatg

SEQ ID NO: 2322362 - DNA, 15 bp, Homo sapiens
aagggcataaagtaa

SEQ ID NO: 2322363 - DNA, 21 bp, Homo sapiens
aagggcataaagtaaatacat

SEQ ID NO: 2322364 - DNA, 21 bp, Homo sapiens
aagggccagcgtggctctaaa

SEQ ID NO: 2322365 - DNA, 17 bp, Homo sapiens
aagggctggctccccct

SEQ ID NO: 2322366 - DNA, 22 bp, Homo sapiens
aagggctggctccccctcccca

SEQ ID NO: 2322367 - DNA, 16 bp, Homo sapiens
aaggggacagctgtgt

SEQ ID NO: 2322368 - DNA, 21 bp, Homo sapiens
aaggggatctaaaaaaatgtt

SEQ ID NO: 2322369 - DNA, 20 bp, Homo sapiens
aaggggctcttcatctgcct

SEQ ID NO: 2322370 - DNA, 13 bp, Homo sapiens
aaggggtaaaagg

SEQ ID NO: 2322371 - DNA, 17 bp, Homo sapiens
aagggttgagagccagt

SEQ ID NO: 2322372 - DNA, 18 bp, Homo sapiens
aagggttgagagccagtg

SEQ ID NO: 2322373 - DNA, 22 bp, Homo sapiens
aagggttgagagccagtggcgg

SEQ ID NO: 2322374 - DNA, 13 bp, Homo sapiens
aagggtttctcta

SEQ ID NO: 2322375 - DNA, 17 bp, Homo sapiens
aagggttttcttttctt

SEQ ID NO: 2322376 - DNA, 15 bp, Homo sapiens
aaggtcactgtttcc

SEQ ID NO: 2322377 - DNA, 19 bp, Homo sapiens
aaggtcttcttgtgtcctg

SEQ ID NO: 2322378 - DNA, 18 bp, Homo sapiens
aaggtctttaaaatattg

SEQ ID NO: 2322379 - DNA, 17 bp, Homo sapiens
aaggtgagcataaatca

SEQ ID NO: 2322380 - DNA, 21 bp, Homo sapiens
aaggtgcctcagttttccttc

SEQ ID NO: 2322381 - DNA, 14 bp, Homo sapiens
aaggtgctaacata

SEQ ID NO: 2322382 - DNA, 21 bp, Homo sapiens
aaggtggcagatgtcttccct

SEQ ID NO: 2322383 - DNA, 15 bp, Homo sapiens
aaggttactgagtga

SEQ ID NO: 2322384 - DNA, 13 bp, Homo sapiens
aaggttgaataat

SEQ ID NO: 2322385 - DNA, 17 bp, Homo sapiens
aaggttggagcccaggg

SEQ ID NO: 2322386 - DNA, 21 bp, Homo sapiens
aagtaaatgtcttcatgttga

SEQ ID NO: 2322387 - DNA, 19 bp, Homo sapiens
aagtaacaatctatggctt

SEQ ID NO: 2322388 - DNA, 21 bp, Homo sapiens
aagtaacatgacttccttatt

SEQ ID NO: 2322389 - DNA, 14 bp, Homo sapiens
aagtaagaagacat

SEQ ID NO: 2322390 - DNA, 20 bp, Homo sapiens
aagtaagaagacatgaacca

SEQ ID NO: 2322391 - DNA, 14 bp, Homo sapiens
aagtaatttcagtg

SEQ ID NO: 2322392 - DNA, 16 bp, Homo sapiens
aagtacagaatttgaa

SEQ ID NO: 2322393 - DNA, 19 bp, Homo sapiens
aagtacagaatttgaatta

SEQ ID NO: 2322394 - DNA, 18 bp, Homo sapiens
aagtaccaatgggaagca

SEQ ID NO: 2322395 - DNA, 22 bp, Homo sapiens
aagtaccttgaactcttagtga

SEQ ID NO: 2322396 - DNA, 17 bp, Homo sapiens
aagtaggaggaaacagt

SEQ ID NO: 2322397 - DNA, 15 bp, Homo sapiens
aagtaggtggcttga

SEQ ID NO: 2322398 - DNA, 20 bp, Homo sapiens
aagtatcagctacaattgta

SEQ ID NO: 2322399 - DNA, 21 bp, Homo sapiens
aagtatgcattattaaattgt

SEQ ID NO: 2322400 - DNA, 22 bp, Homo sapiens
aagtatgtatattaaaaaagag

SEQ ID NO: 2322401 - DNA, 13 bp, Homo sapiens
aagtcaaaaaatt

SEQ ID NO: 2322402 - DNA, 20 bp, Homo sapiens
aagtcagctccagctttctg

SEQ ID NO: 2322403 - DNA, 20 bp, Homo sapiens
aagtcagttgctcaaaaaga

SEQ ID NO: 2322404 - DNA, 20 bp, Homo sapiens
aagtccaagcaacagccttt

SEQ ID NO: 2322405 - DNA, 11 bp, Homo sapiens
aagtccctccc

SEQ ID NO: 2322406 - DNA, 20 bp, Homo sapiens
aagtccctccctgcctgagg

SEQ ID NO: 2322407 - DNA, 21 bp, Homo sapiens
aagtctcataggttaaaaaaa

SEQ ID NO: 2322408 - DNA, 18 bp, Homo sapiens
aagtgaaattaagcattt

SEQ ID NO: 2322409 - DNA, 16 bp, Homo sapiens
aatgaaatttaagcac

SEQ ID NO: 2322410 - DNA, 17 bp, Homo sapiens
aatgaaatttaagcaca

SEQ ID NO: 2322411 - DNA, 17 bp, Homo sapiens
aatgaaccataaattca

SEQ ID NO: 2322412 - DNA, 22 bp, Homo sapiens
aatgaagaaagtcaaaaaatta

SEQ ID NO: 2322413 - DNA, 14 bp, Homo sapiens
aatgaagcagtatt

SEQ ID NO: 2322414 - DNA, 15 bp, Homo sapiens
aatgaataatggaaa

SEQ ID NO: 2322415 - DNA, 19 bp, Homo sapiens
aatgaatgattaaattatg

SEQ ID NO: 2322416 - DNA, 22 bp, Homo sapiens
aatgacaagtgacttatttgct

SEQ ID NO: 2322417 - DNA, 23 bp, Homo sapiens
aatgacggtaagtgttctcatga

SEQ ID NO: 2322418 - DNA, 15 bp, Homo sapiens
aatgactatataatt

SEQ ID NO: 2322419 - DNA, 19 bp, Homo sapiens
aatgagagttccttctcac

SEQ ID NO: 2322420 - DNA, 19 bp, Homo sapiens
aatgagatgtgagccttgt

SEQ ID NO: 2322421 - DNA, 17 bp, Homo sapiens
aatgagcttgattaaat

SEQ ID NO: 2322422 - DNA, 18 bp, Homo sapiens
aatgagcttgattaaatc

SEQ ID NO: 2322423 - DNA, 19 bp, Homo sapiens
aatgaggtcagcatgtcta

SEQ ID NO: 2322424 - DNA, 14 bp, Homo sapiens
aatgataaaataaa

SEQ ID NO: 2322425 - DNA, 22 bp, Homo sapiens
aatgataaaataaataatttta

SEQ ID NO: 2322426 - DNA, 23 bp, Homo sapiens
aatgatcctggaaattgcagtaa

SEQ ID NO: 2322427 - DNA, 13 bp, Homo sapiens
aatgattaaatta

SEQ ID NO: 2322428 - DNA, 13 bp, Homo sapiens
aatgatttacata

SEQ ID NO: 2322429 - DNA, 17 bp, Homo sapiens
aatgcaataattttact

SEQ ID NO: 2322430 - DNA, 17 bp, Homo sapiens
aatgcatatttgcaaag

SEQ ID NO: 2322431 - DNA, 23 bp, Homo sapiens
aatgcatatttgcaaagtgtatt

SEQ ID NO: 2322432 - DNA, 21 bp, Homo sapiens
aatgcatgtaaggtcttcttg

SEQ ID NO: 2322433 - DNA, 20 bp, Homo sapiens
aatgcctgctttttggaaag

SEQ ID NO: 2322434 - DNA, 12 bp, Homo sapiens
aatgcctttgag

SEQ ID NO: 2322435 - DNA, 14 bp, Homo sapiens
aatgcctttgagac

SEQ ID NO: 2322436 - DNA, 17 bp, Homo sapiens
aatgcctttgagacagt

SEQ ID NO: 2322437 - DNA, 18 bp, Homo sapiens
aatgcctttgagacagtt

SEQ ID NO: 2322438 - DNA, 19 bp, Homo sapiens
aatgcctttgagacagttt

SEQ ID NO: 2322439 - DNA, 20 bp, Homo sapiens
aatgcctttgagacagtttc

SEQ ID NO: 2322440 - DNA, 15 bp, Homo sapiens
aatgctaccaggatg

SEQ ID NO: 2322441 - DNA, 21 bp, Homo sapiens
aatgctatttgtgtaactgaa

SEQ ID NO: 2322442 - DNA, 14 bp, Homo sapiens
aatgctgctggcca

SEQ ID NO: 2322443 - DNA, 19 bp, Homo sapiens
aatgctgtttctaagaaaa

SEQ ID NO: 2322444 - DNA, 20 bp, Homo sapiens
aatgctgtttctaagaaaat

SEQ ID NO: 2322445 - DNA, 17 bp, Homo sapiens
aatgcttaaatttcaga

SEQ ID NO: 2322446 - DNA, 13 bp, Homo sapiens
aatgcttcattat

SEQ ID NO: 2322447 - DNA, 18 bp, Homo sapiens
aatgcttgaccctgaaat

SEQ ID NO: 2322448 - DNA, 13 bp, Homo sapiens
aatgcttgctttt

SEQ ID NO: 2322449 - DNA, 19 bp, Homo sapiens
aatgcttgtagaagtagga

SEQ ID NO: 2322450 - DNA, 13 bp, Homo sapiens
aatgcttttctaa

SEQ ID NO: 2322451 - DNA, 19 bp, Homo sapiens
aatggaaaattttctcctt

SEQ ID NO: 2322452 - DNA, 17 bp, Homo sapiens
aatggaaacaccactgc

SEQ ID NO: 2322453 - DNA, 15 bp, Homo sapiens
aatggagaagctgca

SEQ ID NO: 2322454 - DNA, 19 bp, Homo sapiens
aatggaggatctctaaaga

SEQ ID NO: 2322455 - DNA, 23 bp, Homo sapiens
aatggcatttagcacagtattta

SEQ ID NO: 2322456 - DNA, 13 bp, Homo sapiens
aatggcatttctc

SEQ ID NO: 2322457 - DNA, 15 bp, Homo sapiens
aatggccatgcagga

SEQ ID NO: 2322458 - DNA, 21 bp, Homo sapiens
aatggccatgcaggaggtgga

SEQ ID NO: 2322459 - DNA, 17 bp, Homo sapiens
aatggcgtctgctctgg

SEQ ID NO: 2322460 - DNA, 23 bp, Homo sapiens
aatgggatggtcggatctcacag

SEQ ID NO: 2322461 - DNA, 15 bp, Homo sapiens
aatgggctctccggg

SEQ ID NO: 2322462 - DNA, 22 bp, Homo sapiens
aatggtcacgtttggtgcttct

SEQ ID NO: 2322463 - DNA, 12 bp, Homo sapiens
aatgtaaccaat

SEQ ID NO: 2322464 - DNA, 17 bp, Homo sapiens
aatgtaatttaaatgaa

SEQ ID NO: 2322465 - DNA, 20 bp, Homo sapiens
aatgtacactaccaaacact

SEQ ID NO: 2322466 - DNA, 21 bp, Homo sapiens
aatgtacatttccaaatgaac

SEQ ID NO: 2322467 - DNA, 22 bp, Homo sapiens
aatgtagttagctccataaagt

SEQ ID NO: 2322468 - DNA, 16 bp, Homo sapiens
aatgtatgtgtggctg

SEQ ID NO: 2322469 - DNA, 17 bp, Homo sapiens
aatgtattcctttaaaa

SEQ ID NO: 2322470 - DNA, 21 bp, Homo sapiens
aatgtattcctttaaaatatt

SEQ ID NO: 2322471 - DNA, 18 bp, Homo sapiens
aatgtcacaattatgtgc

SEQ ID NO: 2322472 - DNA, 22 bp, Homo sapiens
aatgtcacaattatgtgcaaag

SEQ ID NO: 2322473 - DNA, 23 bp, Homo sapiens
aatgtctgtaataatagactgta

SEQ ID NO: 2322474 - DNA, 23 bp, Homo sapiens
aatgtctgtagctcctcaactca

SEQ ID NO: 2322475 - DNA, 23 bp, Homo sapiens
aatgtctgtttattaactactga

SEQ ID NO: 2322476 - DNA, 21 bp, Homo sapiens
aatgtcttcatgttgatgtgt

SEQ ID NO: 2322477 - DNA, 17 bp, Homo sapiens
aatgtgagtagttacta

SEQ ID NO: 2322478 - DNA, 18 bp, Homo sapiens
aatgtggaaggaaaatat

SEQ ID NO: 2322479 - DNA, 18 bp, Homo sapiens
aatgtggccaagcctatc

SEQ ID NO: 2322480 - DNA, 12 bp, Homo sapiens
aatgttaaattt

SEQ ID NO: 2322481 - DNA, 16 bp, Homo sapiens
aatgttaaatttgtaa

SEQ ID NO: 2322482 - DNA, 21 bp, Homo sapiens
aatgttaaatttgtaagtttc

SEQ ID NO: 2322483 - DNA, 13 bp, Homo sapiens
aatgttgggaaag

SEQ ID NO: 2322484 - DNA, 16 bp, Homo sapiens
aatgtttatgagccag

SEQ ID NO: 2322485 - DNA, 22 bp, Homo sapiens
aatgtttatgagccagacaaat

SEQ ID NO: 2322486 - DNA, 16 bp, Homo sapiens
aatgtttattaaatgc

SEQ ID NO: 2322487 - DNA, 17 bp, Homo sapiens
aatgtttcttttgtttg

SEQ ID NO: 2322488 - DNA, 13 bp, Homo sapiens
aatgtttttagaa

SEQ ID NO: 2322489 - DNA, 23 bp, Homo sapiens
aatgtttttagaacatgtaaaat

SEQ ID NO: 2322490 - DNA, 21 bp, Homo sapiens
aatgtttttccctccccagaa

SEQ ID NO: 2322491 - DNA, 16 bp, Homo sapiens
aattaaaaaaaaattg

SEQ ID NO: 2322492 - DNA, 16 bp, Homo sapiens
aattaaaacaaatata

SEQ ID NO: 2322493 - DNA, 19 bp, Homo sapiens
aattaaaacaaatatacat

SEQ ID NO: 2322494 - DNA, 21 bp, Homo sapiens
aattaaacttccaaagaaagt

SEQ ID NO: 2322495 - DNA, 14 bp, Homo sapiens
aattaaataaaatt

SEQ ID NO: 2322496 - DNA, 15 bp, Homo sapiens
aattaacacaaagga

SEQ ID NO: 2322497 - DNA, 13 bp, Homo sapiens
aattaagcaaatg

SEQ ID NO: 2322498 - DNA, 17 bp, Homo sapiens
aattaatatattaaaat

SEQ ID NO: 2322499 - DNA, 18 bp, Homo sapiens
aattacaaaaaaaaattt

SEQ ID NO: 2322500 - DNA, 16 bp, Homo sapiens
aattacctttaatttt

SEQ ID NO: 2322501 - DNA, 14 bp, Homo sapiens
aattactggtccaa

SEQ ID NO: 2322502 - DNA, 17 bp, Homo sapiens
aattagtggtcataaaa

SEQ ID NO: 2322503 - DNA, 21 bp, Homo sapiens
aattagtggtcataaaataga

SEQ ID NO: 2322504 - DNA, 23 bp, Homo sapiens
aattagtgtgacagtttccaaat

SEQ ID NO: 2322505 - DNA, 13 bp, Homo sapiens
aattatacagtaa

SEQ ID NO: 2322506 - DNA, 13 bp, Homo sapiens
aattatatatact

SEQ ID NO: 2322507 - DNA, 15 bp, Homo sapiens
aattatcattgtttg

SEQ ID NO: 2322508 - DNA, 23 bp, Homo sapiens
aattatgagattggttttcctgt

SEQ ID NO: 2322509 - DNA, 20 bp, Homo sapiens
aattatgagtttttcaatta

SEQ ID NO: 2322510 - DNA, 12 bp, Homo sapiens
aattatgtgcaa

SEQ ID NO: 2322511 - DNA, 12 bp, Homo sapiens
aattatttgcta

SEQ ID NO: 2322512 - DNA, 18 bp, Homo sapiens
aattcaaaaagaactaaa

SEQ ID NO: 2322513 - DNA, 13 bp, Homo sapiens
aattcaaagcatg

SEQ ID NO: 2322514 - DNA, 21 bp, Homo sapiens
aattcaaatggcttaagcaat

SEQ ID NO: 2322515 - DNA, 15 bp, Homo sapiens
aattcaactttgtaa

SEQ ID NO: 2322516 - DNA, 16 bp, Homo sapiens
aattcaactttgtaaa

SEQ ID NO: 2322517 - DNA, 14 bp, Homo sapiens
aattcagttttttt

SEQ ID NO: 2322518 - DNA, 17 bp, Homo sapiens
aattcataataaatttt

SEQ ID NO: 2322519 - DNA, 18 bp, Homo sapiens
aattcataataaattttc

SEQ ID NO: 2322520 - DNA, 16 bp, Homo sapiens
aattcatatctaaata

SEQ ID NO: 2322521 - DNA, 20 bp, Homo sapiens
aattccatacttctctcaga

SEQ ID NO: 2322522 - DNA, 15 bp, Homo sapiens
aattctgattgattt

SEQ ID NO: 2322523 - DNA, 23 bp, Homo sapiens
accacatagcatgcttcctttct

SEQ ID NO: 2322524 - DNA, 17 bp, Homo sapiens
accacatcaaataagaa

SEQ ID NO: 2322525 - DNA, 15 bp, Homo sapiens
accacattgaagaat

SEQ ID NO: 2322526 - DNA, 20 bp, Homo sapiens
accacatttagaaatgttta

SEQ ID NO: 2322527 - DNA, 21 bp, Homo sapiens
accacatttagaaatgtttat

SEQ ID NO: 2322528 - DNA, 19 bp, Homo sapiens
accaccctcactggctctc

SEQ ID NO: 2322529 - DNA, 20 bp, Homo sapiens
accaccctcactggctctcc

SEQ ID NO: 2322530 - DNA, 23 bp, Homo sapiens
accaccggccccctccccccaga

SEQ ID NO: 2322531 - DNA, 18 bp, Homo sapiens
accactcttttgctgtgc

SEQ ID NO: 2322532 - DNA, 16 bp, Homo sapiens
accactgcttctcttt

SEQ ID NO: 2322533 - DNA, 12 bp, Homo sapiens
accactgtctcc

SEQ ID NO: 2322534 - DNA, 18 bp, Homo sapiens
accactgtgccactgact

SEQ ID NO: 2322535 - DNA, 16 bp, Homo sapiens
accacttagatttaaa

SEQ ID NO: 2322536 - DNA, 14 bp, Homo sapiens
accacttccagagc

SEQ ID NO: 2322537 - DNA, 18 bp, Homo sapiens
accacttccagagccaga

SEQ ID NO: 2322538 - DNA, 17 bp, Homo sapiens
accagaaacacccctct

SEQ ID NO: 2322539 - DNA, 22 bp, Homo sapiens
accagaaacacccctctgtcta

SEQ ID NO: 2322540 - DNA, 15 bp, Homo sapiens
accagagcagatgca

SEQ ID NO: 2322541 - DNA, 22 bp, Homo sapiens
accagagcagatgcagagagcc

SEQ ID NO: 2322542 - DNA, 14 bp, Homo sapiens
accagagggcatgc

SEQ ID NO: 2322543 - DNA, 19 bp, Homo sapiens
accagataactgaggaggg

SEQ ID NO: 2322544 - DNA, 19 bp, Homo sapiens
accagatctttctcttccc

SEQ ID NO: 2322545 - DNA, 17 bp, Homo sapiens
accagcaattctctttc

SEQ ID NO: 2322546 - DNA, 14 bp, Homo sapiens
accagcatctggaa

SEQ ID NO: 2322547 - DNA, 16 bp, Homo sapiens
accagccccactgcca

SEQ ID NO: 2322548 - DNA, 17 bp, Homo sapiens
accagccccactgccag

SEQ ID NO: 2322549 - DNA, 20 bp, Homo sapiens
accagccccactgccagcag

SEQ ID NO: 2322550 - DNA, 18 bp, Homo sapiens
accagcccccgccccaga

SEQ ID NO: 2322551 - DNA, 20 bp, Homo sapiens
accagcccccgccccagagt

SEQ ID NO: 2322552 - DNA, 20 bp, Homo sapiens
accagctgcgcttgcttttc

SEQ ID NO: 2322553 - DNA, 17 bp, Homo sapiens
accaggcacctcttcct

SEQ ID NO: 2322554 - DNA, 15 bp, Homo sapiens
accaggccattctgc

SEQ ID NO: 2322555 - DNA, 14 bp, Homo sapiens
accaggtgggagcg

SEQ ID NO: 2322556 - DNA, 12 bp, Homo sapiens
accagtccctgt

SEQ ID NO: 2322557 - DNA, 13 bp, Homo sapiens
accagtccctgtc

SEQ ID NO: 2322558 - DNA, 22 bp, Homo sapiens
accataatgagatgtgagcctt

SEQ ID NO: 2322559 - DNA, 22 bp, Homo sapiens
accataatgtactgatttcagt

SEQ ID NO: 2322560 - DNA, 15 bp, Homo sapiens
accatatagatttta

SEQ ID NO: 2322561 - DNA, 21 bp, Homo sapiens
accatatagattttattatgt

SEQ ID NO: 2322562 - DNA, 12 bp, Homo sapiens
accatatgaatt

SEQ ID NO: 2322563 - DNA, 22 bp, Homo sapiens
accatattgtgcttcacagtag

SEQ ID NO: 2322564 - DNA, 19 bp, Homo sapiens
accatccaccttcccttct

SEQ ID NO: 2322565 - DNA, 15 bp, Homo sapiens
accatcgctttattg

SEQ ID NO: 2322566 - DNA, 13 bp, Homo sapiens
accatctgtttga

SEQ ID NO: 2322567 - DNA, 16 bp, Homo sapiens
accatctgtttgaaga

SEQ ID NO: 2322568 - DNA, 12 bp, Homo sapiens
accatgaacttg

SEQ ID NO: 2322569 - DNA, 14 bp, Homo sapiens
accatgaacttgat

SEQ ID NO: 2322570 - DNA, 19 bp, Homo sapiens
accatgccagattctgcct

SEQ ID NO: 2322571 - DNA, 20 bp, Homo sapiens
accatgctggcggcgcagag

SEQ ID NO: 2322572 - DNA, 18 bp, Homo sapiens
accatgtaagcactctgg

SEQ ID NO: 2322573 - DNA, 14 bp, Homo sapiens
accatgtggccaca

SEQ ID NO: 2322574 - DNA, 20 bp, Homo sapiens
accattcacaataaaagctt

SEQ ID NO: 2322575 - DNA, 23 bp, Homo sapiens
accattttttaatttacttgttt

SEQ ID NO: 2322576 - DNA, 17 bp, Homo sapiens
acccaaccctatctcct

SEQ ID NO: 2322577 - DNA, 20 bp, Homo sapiens
acccaaccctatctcctgac

SEQ ID NO: 2322578 - DNA, 16 bp, Homo sapiens
acccaagacatgacat

SEQ ID NO: 2322579 - DNA, 15 bp, Homo sapiens
acccaccgtggagga

SEQ ID NO: 2322580 - DNA, 22 bp, Homo sapiens
acccaccgtggaggaggaaggc

SEQ ID NO: 2322581 - DNA, 15 bp, Homo sapiens
acccaccttgacgtt

SEQ ID NO: 2322582 - DNA, 23 bp, Homo sapiens
acccactcggatggaccaacctg

SEQ ID NO: 2322583 - DNA, 16 bp, Homo sapiens
acccactgtccgcctc

SEQ ID NO: 2322584 - DNA, 13 bp, Homo sapiens
acccagggaacag

SEQ ID NO: 2322585 - DNA, 19 bp, Homo sapiens
acccagggctccctcctgg

SEQ ID NO: 2322586 - DNA, 22 bp, Homo sapiens
acccaggggaaggccctgaggc

SEQ ID NO: 2322587 - DNA, 16 bp, Homo sapiens
acccatcttccccgga

SEQ ID NO: 2322588 - DNA, 17 bp, Homo sapiens
acccattccagtacagt

SEQ ID NO: 2322589 - DNA, 19 bp, Homo sapiens
acccattccagtacagtat

SEQ ID NO: 2322590 - DNA, 22 bp, Homo sapiens
acccattgttgtcaaggaagaa

SEQ ID NO: 2322591 - DNA, 14 bp, Homo sapiens
accccaacctgctc

SEQ ID NO: 2322592 - DNA, 19 bp, Homo sapiens
accccaacctgctctcctc

SEQ ID NO: 2322593 - DNA, 12 bp, Homo sapiens
accccactccca

SEQ ID NO: 2322594 - DNA, 20 bp, Homo sapiens
accccagctcactttttcat

SEQ ID NO: 2322595 - DNA, 15 bp, Homo sapiens
accccctgccctgca

SEQ ID NO: 2322596 - DNA, 17 bp, Homo sapiens
acccccttaaatttaat

SEQ ID NO: 2322597 - DNA, 22 bp, Homo sapiens
accccgaggtaggggtggggag

SEQ ID NO: 2322598 - DNA, 17 bp, Homo sapiens
acccctgcccccagccc

SEQ ID NO: 2322599 - DNA, 18 bp, Homo sapiens
acccctggaagagcccag

SEQ ID NO: 2322600 - DNA, 23 bp, Homo sapiens
acccctggaagagcccagtctgt

SEQ ID NO: 2322601 - DNA, 17 bp, Homo sapiens
accccttctctcctccc

SEQ ID NO: 2322602 - DNA, 23 bp, Homo sapiens
accccttggaaatgtctgctggt

SEQ ID NO: 2322603 - DNA, 16 bp, Homo sapiens
acccctttcccacccc

SEQ ID NO: 2322604 - DNA, 17 bp, Homo sapiens
acccctttcccacccca

SEQ ID NO: 2322605 - DNA, 19 bp, Homo sapiens
acccctttctagaccaata

SEQ ID NO: 2322606 - DNA, 14 bp, Homo sapiens
acccggaggccgag

SEQ ID NO: 2322607 - DNA, 16 bp, Homo sapiens
accctagccaatgtct

SEQ ID NO: 2322608 - DNA, 19 bp, Homo sapiens
accctagccaatgtctcct

SEQ ID NO: 2322609 - DNA, 16 bp, Homo sapiens
accctatctcccacaa

SEQ ID NO: 2322610 - DNA, 18 bp, Homo sapiens
accctcaaaccctgtggg

SEQ ID NO: 2322611 - DNA, 13 bp, Homo sapiens
accctcagggagc

SEQ ID NO: 2322612 - DNA, 17 bp, Homo sapiens
accctcagggagcctcc

SEQ ID NO: 2322613 - DNA, 18 bp, Homo sapiens
accctcagggagcctccc

SEQ ID NO: 2322614 - DNA, 16 bp, Homo sapiens
accctccaccgagcca

SEQ ID NO: 2322615 - DNA, 15 bp, Homo sapiens
accctccagagacaa

SEQ ID NO: 2322616 - DNA, 20 bp, Homo sapiens
accctctccatctcccaagg

SEQ ID NO: 2322617 - DNA, 20 bp, Homo sapiens
accctctggattctgaatct

SEQ ID NO: 2322618 - DNA, 16 bp, Homo sapiens
accctcttcctactgg

SEQ ID NO: 2322619 - DNA, 16 bp, Homo sapiens
accctcttcctgtgat

SEQ ID NO: 2322620 - DNA, 18 bp, Homo sapiens
accctcttgcccatcctg

SEQ ID NO: 2322621 - DNA, 15 bp, Homo sapiens
accctctttgctgca

SEQ ID NO: 2322622 - DNA, 16 bp, Homo sapiens
accctctttgctgcag

SEQ ID NO: 2322623 - DNA, 13 bp, Homo sapiens
accctgcagagct

SEQ ID NO: 2322624 - DNA, 15 bp, Homo sapiens
accctgccacagcca

SEQ ID NO: 2322625 - DNA, 17 bp, Homo sapiens
accctgccacagccaga

SEQ ID NO: 2322626 - DNA, 18 bp, Homo sapiens
accctgcgggccagggtc

SEQ ID NO: 2322627 - DNA, 14 bp, Homo sapiens
accctgctgaacac

SEQ ID NO: 2322628 - DNA, 18 bp, Homo sapiens
accctggcccctctccct

SEQ ID NO: 2322629 - DNA, 18 bp, Homo sapiens
accctggggcctgactgc

SEQ ID NO: 2322630 - DNA, 21 bp, Homo sapiens
accctgggtcaggaaattact

SEQ ID NO: 2322631 - DNA, 18 bp, Homo sapiens
accctgggtgggctctgt

SEQ ID NO: 2322632 - DNA, 20 bp, Homo sapiens
accctgggtgggctctgtgc

SEQ ID NO: 2322633 - DNA, 14 bp, Homo sapiens
accctgtctgtccc

SEQ ID NO: 2322634 - DNA, 16 bp, Homo sapiens
accctgttcctgctgc

SEQ ID NO: 2322635 - DNA, 17 bp, Homo sapiens
accctgttcctgctgct

SEQ ID NO: 2322636 - DNA, 21 bp, Homo sapiens
acccttcatcttcctgtgtcc

SEQ ID NO: 2322637 - DNA, 15 bp, Homo sapiens
acccttctcccactc

SEQ ID NO: 2322638 - DNA, 20 bp, Homo sapiens
acttctttgttattataaca

SEQ ID NO: 2322639 - DNA, 15 bp, Homo sapiens
acttgagacaatgtt

SEQ ID NO: 2322640 - DNA, 21 bp, Homo sapiens
acttgcaaccgtctgttatgc

SEQ ID NO: 2322641 - DNA, 13 bp, Homo sapiens
acttgcctctgca

SEQ ID NO: 2322642 - DNA, 14 bp, Homo sapiens
acttgcgagtccaa

SEQ ID NO: 2322643 - DNA, 15 bp, Homo sapiens
acttgctgctgtctt

SEQ ID NO: 2322644 - DNA, 18 bp, Homo sapiens
acttgctgtccaggcagc

SEQ ID NO: 2322645 - DNA, 15 bp, Homo sapiens
acttggctggggagg

SEQ ID NO: 2322646 - DNA, 22 bp, Homo sapiens
acttggctggggaggaccaggg

SEQ ID NO: 2322647 - DNA, 16 bp, Homo sapiens
acttgggctactgaac

SEQ ID NO: 2322648 - DNA, 20 bp, Homo sapiens
acttggggagatggagttct

SEQ ID NO: 2322649 - DNA, 15 bp, Homo sapiens
acttggttcttgtac

SEQ ID NO: 2322650 - DNA, 10 bp, Homo sapiens
acttgtgttt

SEQ ID NO: 2322651 - DNA, 18 bp, Homo sapiens
acttgttatgttgtaata

SEQ ID NO: 2322652 - DNA, 19 bp, Homo sapiens
acttgttttggatggcttg

SEQ ID NO: 2322653 - DNA, 20 bp, Homo sapiens
acttgttttggatggcttgt

SEQ ID NO: 2322654 - DNA, 17 bp, Homo sapiens
actttaacttttgaaaa

SEQ ID NO: 2322655 - DNA, 14 bp, Homo sapiens
actttacagaaatg

SEQ ID NO: 2322656 - DNA, 18 bp, Homo sapiens
actttacagaaatggact

SEQ ID NO: 2322657 - DNA, 19 bp, Homo sapiens
actttacagaaatggactg

SEQ ID NO: 2322658 - DNA, 17 bp, Homo sapiens
actttacccacctagaa

SEQ ID NO: 2322659 - DNA, 18 bp, Homo sapiens
actttacccacctagaac

SEQ ID NO: 2322660 - DNA, 13 bp, Homo sapiens
actttacccattt

SEQ ID NO: 2322661 - DNA, 15 bp, Homo sapiens
actttacgcccatct

SEQ ID NO: 2322662 - DNA, 14 bp, Homo sapiens
actttactttcaag

SEQ ID NO: 2322663 - DNA, 19 bp, Homo sapiens
actttagggggtgggattc

SEQ ID NO: 2322664 - DNA, 19 bp, Homo sapiens
actttagtacaatttcaac

SEQ ID NO: 2322665 - DNA, 23 bp, Homo sapiens
actttatctaatacctctgtgtg

SEQ ID NO: 2322666 - DNA, 18 bp, Homo sapiens
actttattaagtaaaatc

SEQ ID NO: 2322667 - DNA, 16 bp, Homo sapiens
actttcacttcttcct

SEQ ID NO: 2322668 - DNA, 17 bp, Homo sapiens
actttcacttcttccta

SEQ ID NO: 2322669 - DNA, 19 bp, Homo sapiens
actttcacttcttcctatt

SEQ ID NO: 2322670 - DNA, 18 bp, Homo sapiens
actttctttttgtagctg

SEQ ID NO: 2322671 - DNA, 23 bp, Homo sapiens
actttctttttgtagctggggct

SEQ ID NO: 2322672 - DNA, 12 bp, Homo sapiens
actttgggaggc

SEQ ID NO: 2322673 - DNA, 14 bp, Homo sapiens
actttgggggagga

SEQ ID NO: 2322674 - DNA, 21 bp, Homo sapiens
actttgtaaaaatcttttgaa

SEQ ID NO: 2322675 - DNA, 17 bp, Homo sapiens
actttgtaaccagaatt

SEQ ID NO: 2322676 - DNA, 22 bp, Homo sapiens
actttgtaaccagaattataca

SEQ ID NO: 2322677 - DNA, 13 bp, Homo sapiens
acttttaaactgt

SEQ ID NO: 2322678 - DNA, 15 bp, Homo sapiens
acttttaagatttct

SEQ ID NO: 2322679 - DNA, 19 bp, Homo sapiens
acttttaagatttctctaa

SEQ ID NO: 2322680 - DNA, 22 bp, Homo sapiens
acttttaagatttctctaatat

SEQ ID NO: 2322681 - DNA, 17 bp, Homo sapiens
acttttagaaatgcata

SEQ ID NO: 2322682 - DNA, 18 bp, Homo sapiens
acttttagaaatgcatat

SEQ ID NO: 2322683 - DNA, 14 bp, Homo sapiens
acttttataaagca

SEQ ID NO: 2322684 - DNA, 15 bp, Homo sapiens
acttttcccactcca

SEQ ID NO: 2322685 - DNA, 12 bp, Homo sapiens
acttttctcttt

SEQ ID NO: 2322686 - DNA, 24 bp, Homo sapiens
acttttcttaaaccttcagttatg

SEQ ID NO: 2322687 - DNA, 22 bp, Homo sapiens
acttttgaaaagaccaagactt

SEQ ID NO: 2322688 - DNA, 19 bp, Homo sapiens
acttttttagaaatgcaaa

SEQ ID NO: 2322689 - DNA, 20 bp, Homo sapiens
acttttttgtggcaattagt

SEQ ID NO: 2322690 - DNA, 13 bp, Homo sapiens
actttttttgtat

SEQ ID NO: 2322691 - DNA, 14 bp, Homo sapiens
actttttttgtatg

SEQ ID NO: 2322692 - DNA, 17 bp, Homo sapiens
actttttttgtatgtgt

SEQ ID NO: 2322693 - DNA, 17 bp, Homo sapiens
agaaaaaaagggagaat

SEQ ID NO: 2322694 - DNA, 13 bp, Homo sapiens
agaaaaataaaat

SEQ ID NO: 2322695 - DNA, 15 bp, Homo sapiens
agaaaaataaaatgt

SEQ ID NO: 2322696 - DNA, 18 bp, Homo sapiens
agaaaaatgaaatttaag

SEQ ID NO: 2322697 - DNA, 23 bp, Homo sapiens
agaaaaatgcttgaccctgaaat

SEQ ID NO: 2322698 - DNA, 12 bp, Homo sapiens
agaaaacaaaaa

SEQ ID NO: 2322699 - DNA, 23 bp, Homo sapiens
agaaaacataatcttctgccttc

SEQ ID NO: 2322700 - DNA, 17 bp, Homo sapiens
agaaaagaactggaaac

SEQ ID NO: 2322701 - DNA, 13 bp, Homo sapiens
agaaaagagagaa

SEQ ID NO: 2322702 - DNA, 17 bp, Homo sapiens
agaaaatgaaatgcata

SEQ ID NO: 2322703 - DNA, 11 bp, Homo sapiens
agaaaatgtag

SEQ ID NO: 2322704 - DNA, 13 bp, Homo sapiens
agaaaattgagtt

SEQ ID NO: 2322705 - DNA, 21 bp, Homo sapiens
agaaaattggaactctactca

SEQ ID NO: 2322706 - DNA, 14 bp, Homo sapiens
agaaacaaagggtt

SEQ ID NO: 2322707 - DNA, 15 bp, Homo sapiens
agaaacacccctctg

SEQ ID NO: 2322708 - DNA, 18 bp, Homo sapiens
agaaacacccctctgtct

SEQ ID NO: 2322709 - DNA, 19 bp, Homo sapiens
agaaacacccctctgtcta

SEQ ID NO: 2322710 - DNA, 20 bp, Homo sapiens
agaaacacccctctgtctag

SEQ ID NO: 2322711 - DNA, 22 bp, Homo sapiens
agaaacacccctctgtctagga

SEQ ID NO: 2322712 - DNA, 11 bp, Homo sapiens
agaaacatctc

SEQ ID NO: 2322713 - DNA, 16 bp, Homo sapiens
agaaacttaagcaaag

SEQ ID NO: 2322714 - DNA, 22 bp, Homo sapiens
agaaactttgatctctgcttac

SEQ ID NO: 2322715 - DNA, 14 bp, Homo sapiens
agaaaggaaaagaa

SEQ ID NO: 2322716 - DNA, 15 bp, Homo sapiens
agaaagggattgctt

SEQ ID NO: 2322717 - DNA, 22 bp, Homo sapiens
agaaagtgggcttaatggagtt

SEQ ID NO: 2322718 - DNA, 23 bp, Homo sapiens
agaaataaaccaaaggaaaatgt

SEQ ID NO: 2322719 - DNA, 17 bp, Homo sapiens
agaaataatgctacaat

SEQ ID NO: 2322720 - DNA, 22 bp, Homo sapiens
agaaataatgctacaattttaa

SEQ ID NO: 2322721 - DNA, 13 bp, Homo sapiens
agaaatagacaaa

SEQ ID NO: 2322722 - DNA, 14 bp, Homo sapiens
agaaatagacaaaa

SEQ ID NO: 2322723 - DNA, 18 bp, Homo sapiens
agaaatagacaaaaagta

SEQ ID NO: 2322724 - DNA, 21 bp, Homo sapiens
agaaatagacaaaaagtatat

SEQ ID NO: 2322725 - DNA, 14 bp, Homo sapiens
agaaatatattttt

SEQ ID NO: 2322726 - DNA, 15 bp, Homo sapiens
agaaatcaatagttg

SEQ ID NO: 2322727 - DNA, 15 bp, Homo sapiens
agaaatctaagctgt

SEQ ID NO: 2322728 - DNA, 18 bp, Homo sapiens
agaaatggcgtctgctct

SEQ ID NO: 2322729 - DNA, 20 bp, Homo sapiens
agaaatggcgtctgctctgg

SEQ ID NO: 2322730 - DNA, 18 bp, Homo sapiens
agaaatgtcatgattgcc

SEQ ID NO: 2322731 - DNA, 14 bp, Homo sapiens
agaaattaaatctg

SEQ ID NO: 2322732 - DNA, 21 bp, Homo sapiens
agaaattccatacttctctca

SEQ ID NO: 2322733 - DNA, 13 bp, Homo sapiens
agaaattttgtaa

SEQ ID NO: 2322734 - DNA, 23 bp, Homo sapiens
agaacaggttcttaaaaaggaac

SEQ ID NO: 2322735 - DNA, 11 bp, Homo sapiens
agaacatagaa

SEQ ID NO: 2322736 - DNA, 22 bp, Homo sapiens
agaacccagtgtttccacactt

SEQ ID NO: 2322737 - DNA, 20 bp, Homo sapiens
agaacctgagctattttcct

SEQ ID NO: 2322738 - DNA, 21 bp, Homo sapiens
agaacctgagctattttcctc

SEQ ID NO: 2322739 - DNA, 20 bp, Homo sapiens
agaacctgcacacaggacag

SEQ ID NO: 2322740 - DNA, 21 bp, Homo sapiens
agaactattgtgctcagagac

SEQ ID NO: 2322741 - DNA, 15 bp, Homo sapiens
agaactccaggccct

SEQ ID NO: 2322742 - DNA, 13 bp, Homo sapiens
agaactgtgccac

SEQ ID NO: 2322743 - DNA, 13 bp, Homo sapiens
agaagaaagatgt

SEQ ID NO: 2322744 - DNA, 19 bp, Homo sapiens
agaagaatggctttcaata

SEQ ID NO: 2322745 - DNA, 23 bp, Homo sapiens
agaagaatggctttcaataccct

SEQ ID NO: 2322746 - DNA, 15 bp, Homo sapiens
agaagacaccagagc

SEQ ID NO: 2322747 - DNA, 19 bp, Homo sapiens
agaagacaccagagcagat

SEQ ID NO: 2322748 - DNA, 23 bp, Homo sapiens
agaagacaccagagcagatgcag

SEQ ID NO: 2322749 - DNA, 18 bp, Homo sapiens
agaagacatactgcttga

SEQ ID NO: 2322750 - DNA, 19 bp, Homo sapiens
agaagactttaattatata

SEQ ID NO: 2322751 - DNA, 14 bp, Homo sapiens
agaagagcgcagtg

SEQ ID NO: 2322752 - DNA, 23 bp, Homo sapiens
agaagagcgcagtgttttgcaag

SEQ ID NO: 2322753 - DNA, 23 bp, Homo sapiens
agcagctcatagaattttgagta

SEQ ID NO: 2322754 - DNA, 23 bp, Homo sapiens
agcaggaggcccttgtcgtggga

SEQ ID NO: 2322755 - DNA, 19 bp, Homo sapiens
agcaggcacgggtggtccc

SEQ ID NO: 2322756 - DNA, 19 bp, Homo sapiens
agcagggaattcctggggt

SEQ ID NO: 2322757 - DNA, 21 bp, Homo sapiens
agcagggagagctcaccatgg

SEQ ID NO: 2322758 - DNA, 19 bp, Homo sapiens
agcagggtgggcttgtggg

SEQ ID NO: 2322759 - DNA, 22 bp, Homo sapiens
agcaggtgattggaccaggcca

SEQ ID NO: 2322760 - DNA, 23 bp, Homo sapiens
agcaggtgattggaccaggccat

SEQ ID NO: 2322761 - DNA, 14 bp, Homo sapiens
agcagtatatgtta

SEQ ID NO: 2322762 - DNA, 15 bp, Homo sapiens
agcagtatattagta

SEQ ID NO: 2322763 - DNA, 13 bp, Homo sapiens
agcagtattttgg

SEQ ID NO: 2322764 - DNA, 11 bp, Homo sapiens
agcagtcacaa

SEQ ID NO: 2322765 - DNA, 14 bp, Homo sapiens
agcagtcacaacag

SEQ ID NO: 2322766 - DNA, 16 bp, Homo sapiens
agcagtcagagtccag

SEQ ID NO: 2322767 - DNA, 19 bp, Homo sapiens
agcagtcagagtccagtgc

SEQ ID NO: 2322768 - DNA, 20 bp, Homo sapiens
agcagtgtgaatagcctggc

SEQ ID NO: 2322769 - DNA, 22 bp, Homo sapiens
agcagtgtgaatagcctggcca

SEQ ID NO: 2322770 - DNA, 20 bp, Homo sapiens
agcagttggccaagcagaaa

SEQ ID NO: 2322771 - DNA, 18 bp, Homo sapiens
agcataatttaaaaatat

SEQ ID NO: 2322772 - DNA, 16 bp, Homo sapiens
agcatagaaaccacta

SEQ ID NO: 2322773 - DNA, 15 bp, Homo sapiens
agcatagataatatt

SEQ ID NO: 2322774 - DNA, 14 bp, Homo sapiens
agcatcccttccca

SEQ ID NO: 2322775 - DNA, 23 bp, Homo sapiens
agcatcttcacttctaaatgcat

SEQ ID NO: 2322776 - DNA, 17 bp, Homo sapiens
agcatgaaataaaatat

SEQ ID NO: 2322777 - DNA, 17 bp, Homo sapiens
agcatgcagctttgcaa

SEQ ID NO: 2322778 - DNA, 20 bp, Homo sapiens
agcatggacatttagaagaa

SEQ ID NO: 2322779 - DNA, 19 bp, Homo sapiens
agcatgtgtatttccagtg

SEQ ID NO: 2322780 - DNA, 16 bp, Homo sapiens
agcattccttctttga

SEQ ID NO: 2322781 - DNA, 18 bp, Homo sapiens
agcattccttctttgata

SEQ ID NO: 2322782 - DNA, 24 bp, Homo sapiens
agcattccttctttgataatgtta

SEQ ID NO: 2322783 - DNA, 17 bp, Homo sapiens
agcattctgagctgggc

SEQ ID NO: 2322784 - DNA, 11 bp, Homo sapiens
agcatttccta

SEQ ID NO: 2322785 - DNA, 18 bp, Homo sapiens
agcattttagaaactaca

SEQ ID NO: 2322786 - DNA, 14 bp, Homo sapiens
agcattttgaaaca

SEQ ID NO: 2322787 - DNA, 18 bp, Homo sapiens
agcattttgaaacaaagt

SEQ ID NO: 2322788 - DNA, 20 bp, Homo sapiens
agccaaaagtccctccctgc

SEQ ID NO: 2322789 - DNA, 21 bp, Homo sapiens
agccaaaagtccctccctgcc

SEQ ID NO: 2322790 - DNA, 22 bp, Homo sapiens
agccaaaagtccctccctgcct

SEQ ID NO: 2322791 - DNA, 12 bp, Homo sapiens
agccaaaccagg

SEQ ID NO: 2322792 - DNA, 22 bp, Homo sapiens
agccaagattttcctcttgtga

SEQ ID NO: 2322793 - DNA, 15 bp, Homo sapiens
agccaagctttaaat

SEQ ID NO: 2322794 - DNA, 16 bp, Homo sapiens
agccaagggaaagggg

SEQ ID NO: 2322795 - DNA, 20 bp, Homo sapiens
agccaagggaaaggggtgct

SEQ ID NO: 2322796 - DNA, 19 bp, Homo sapiens
agccaatctacaatctctt

SEQ ID NO: 2322797 - DNA, 19 bp, Homo sapiens
agccaattaaaaacatgaa

SEQ ID NO: 2322798 - DNA, 14 bp, Homo sapiens
agccacaagctgca

SEQ ID NO: 2322799 - DNA, 15 bp, Homo sapiens
agccacaagctgcac

SEQ ID NO: 2322800 - DNA, 17 bp, Homo sapiens
agccacaagctgcactg

SEQ ID NO: 2322801 - DNA, 22 bp, Homo sapiens
agccacagctgctgttctcagg

SEQ ID NO: 2322802 - DNA, 23 bp, Homo sapiens
agccacagctgctgttctcagga

SEQ ID NO: 2322803 - DNA, 13 bp, Homo sapiens
agccacagtggga

SEQ ID NO: 2322804 - DNA, 15 bp, Homo sapiens
agccaccgtgcctgg

SEQ ID NO: 2322805 - DNA, 21 bp, Homo sapiens
agccaccgtgcctggccagat

SEQ ID NO: 2322806 - DNA, 14 bp, Homo sapiens
agccacctgcaaga

SEQ ID NO: 2322807 - DNA, 14 bp, Homo sapiens
agccactcccctcc

SEQ ID NO: 2322808 - DNA, 15 bp, Homo sapiens
agccagaccagcagg

SEQ ID NO: 2322809 - DNA, 19 bp, Homo sapiens
agccagacctagcaggctg

SEQ ID NO: 2322810 - DNA, 17 bp, Homo sapiens
agccagagacagaggat

SEQ ID NO: 2322811 - DNA, 20 bp, Homo sapiens
agccagagacagaggatgtg

SEQ ID NO: 2322812 - DNA, 15 bp, Homo sapiens
agccagagccccaag

SEQ ID NO: 2322813 - DNA, 18 bp, Homo sapiens
agccagctttccctgcct

SEQ ID NO: 2322814 - DNA, 15 bp, Homo sapiens
agccaggatcatggt

SEQ ID NO: 2322815 - DNA, 14 bp, Homo sapiens
agccaggcctggct

SEQ ID NO: 2322816 - DNA, 15 bp, Homo sapiens
agccaggcctggctg

SEQ ID NO: 2322817 - DNA, 17 bp, Homo sapiens
agccaggcctggctgga

SEQ ID NO: 2322818 - DNA, 16 bp, Homo sapiens
agccatacataaaaga

SEQ ID NO: 2322819 - DNA, 21 bp, Homo sapiens
agccatacataaaagaaataa

SEQ ID NO: 2322820 - DNA, 16 bp, Homo sapiens
agccatagaccctgag

SEQ ID NO: 2322821 - DNA, 21 bp, Homo sapiens
agccatagaccctgaggccct

SEQ ID NO: 2322822 - DNA, 15 bp, Homo sapiens
agccatcctccctcc

SEQ ID NO: 2322823 - DNA, 23 bp, Homo sapiens
agccatcctccctccacctcaag

SEQ ID NO: 2322824 - DNA, 23 bp, Homo sapiens
agccatctaaagtaaaaagggaa

SEQ ID NO: 2322825 - DNA, 21 bp, Homo sapiens
agccatctcatgaggggagag

SEQ ID NO: 2322826 - DNA, 16 bp, Homo sapiens
agccatgccagctggc

SEQ ID NO: 2322827 - DNA, 21 bp, Homo sapiens
agccatgccagctggcctttg

SEQ ID NO: 2322828 - DNA, 16 bp, Homo sapiens
agccatgtcttctccc

SEQ ID NO: 2322829 - DNA, 16 bp, Homo sapiens
agccattttgtgaatg

SEQ ID NO: 2322830 - DNA, 15 bp, Homo sapiens
agcccaagcttccct

SEQ ID NO: 2322831 - DNA, 16 bp, Homo sapiens
agcccaatgaaatgaa

SEQ ID NO: 2322832 - DNA, 17 bp, Homo sapiens
agcccagattcccctgt

SEQ ID NO: 2322833 - DNA, 16 bp, Homo sapiens
agcccagccccactcc

SEQ ID NO: 2322834 - DNA, 12 bp, Homo sapiens
agcccagcccct

SEQ ID NO: 2322835 - DNA, 17 bp, Homo sapiens
agcccagcccctactgc

SEQ ID NO: 2322836 - DNA, 19 bp, Homo sapiens
agcccaggatactggcaca

SEQ ID NO: 2322837 - DNA, 19 bp, Homo sapiens
agcccagggcatcttgctg

SEQ ID NO: 2322838 - DNA, 23 bp, Homo sapiens
agcccagggcatcttgctggcta

SEQ ID NO: 2322839 - DNA, 21 bp, Homo sapiens
agcccatggagattgacctgg

SEQ ID NO: 2322840 - DNA, 22 bp, Homo sapiens
agcccatggagattgacctgga

SEQ ID NO: 2322841 - DNA, 20 bp, Homo sapiens
agccccaccacatagcatgc

SEQ ID NO: 2322842 - DNA, 16 bp, Homo sapiens
agccccactgccagca

SEQ ID NO: 2322843 - DNA, 17 bp, Homo sapiens
agccccactgccagcag

SEQ ID NO: 2322844 - DNA, 21 bp, Homo sapiens
agccccagcccagccccactc

SEQ ID NO: 2322845 - DNA, 16 bp, Homo sapiens
agccccaggggacaag

SEQ ID NO: 2322846 - DNA, 18 bp, Homo sapiens
agcccccaccctgttcct

SEQ ID NO: 2322847 - DNA, 19 bp, Homo sapiens
agcccccaccctgttcctg

SEQ ID NO: 2322848 - DNA, 23 bp, Homo sapiens
agcccccaccctgttcctgctgc

SEQ ID NO: 2322849 - DNA, 19 bp, Homo sapiens
agcccccagcagaggcagg

SEQ ID NO: 2322850 - DNA, 23 bp, Homo sapiens
agccccgccccgttgtgagctgg

SEQ ID NO: 2322851 - DNA, 15 bp, Homo sapiens
agccccggcaagcca

SEQ ID NO: 2322852 - DNA, 22 bp, Homo sapiens
agccccggcaagccacaggaag

SEQ ID NO: 2322853 - DNA, 21 bp, Homo sapiens
agcccctatagcactgagctc

SEQ ID NO: 2322854 - DNA, 16 bp, Homo sapiens
agcccctggggcccag

SEQ ID NO: 2322855 - DNA, 19 bp, Homo sapiens
agcccctggggcccagccc

SEQ ID NO: 2322856 - DNA, 20 bp, Homo sapiens
agcccctgtttactggttct

SEQ ID NO: 2322857 - DNA, 21 bp, Homo sapiens
agccctaaccccttccagatc

SEQ ID NO: 2322858 - DNA, 15 bp, Homo sapiens
agccctactccctgc

SEQ ID NO: 2322859 - DNA, 21 bp, Homo sapiens
agccctactccctgcagatgc

SEQ ID NO: 2322860 - DNA, 17 bp, Homo sapiens
agccctcagttccttca

SEQ ID NO: 2322861 - DNA, 18 bp, Homo sapiens
agccctgcagcccaccag

SEQ ID NO: 2322862 - DNA, 19 bp, Homo sapiens
agccctgctggggatcccc

SEQ ID NO: 2322863 - DNA, 11 bp, Homo sapiens
agcccttccct

SEQ ID NO: 2322864 - DNA, 23 bp, Homo sapiens
agcccttccctgagtgcgggctg

SEQ ID NO: 2322865 - DNA, 18 bp, Homo sapiens
agccgggcccctgggctt

SEQ ID NO: 2322866 - DNA, 13 bp, Homo sapiens
agccggggcctta

SEQ ID NO: 2322867 - DNA, 14 bp, Homo sapiens
agggaggaaggcct

SEQ ID NO: 2322868 - DNA, 19 bp, Homo sapiens
agggagttttgtctgtctc

SEQ ID NO: 2322869 - DNA, 21 bp, Homo sapiens
agggagttttgtctgtctccc

SEQ ID NO: 2322870 - DNA, 15 bp, Homo sapiens
agggatggaaaagga

SEQ ID NO: 2322871 - DNA, 21 bp, Homo sapiens
agggatgttattatccttggg

SEQ ID NO: 2322872 - DNA, 14 bp, Homo sapiens
agggatttccctgc

SEQ ID NO: 2322873 - DNA, 16 bp, Homo sapiens
agggatttgcctcacc

SEQ ID NO: 2322874 - DNA, 14 bp, Homo sapiens
agggcaagaaatgg

SEQ ID NO: 2322875 - DNA, 12 bp, Homo sapiens
agggcagctgct

SEQ ID NO: 2322876 - DNA, 22 bp, Homo sapiens
agggcaggatggcctttccttc

SEQ ID NO: 2322877 - DNA, 22 bp, Homo sapiens
agggcaggcttggggaaaatgg

SEQ ID NO: 2322878 - DNA, 18 bp, Homo sapiens
agggcagggcagcctgtc

SEQ ID NO: 2322879 - DNA, 14 bp, Homo sapiens
agggcagggtctgg

SEQ ID NO: 2322880 - DNA, 23 bp, Homo sapiens
agggcagggtctgggctgggcac

SEQ ID NO: 2322881 - DNA, 15 bp, Homo sapiens
agggcagtaccctcc

SEQ ID NO: 2322882 - DNA, 14 bp, Homo sapiens
agggcagttttgag

SEQ ID NO: 2322883 - DNA, 15 bp, Homo sapiens
agggcataaagtaaa

SEQ ID NO: 2322884 - DNA, 19 bp, Homo sapiens
agggcataaagtaaataca

SEQ ID NO: 2322885 - DNA, 20 bp, Homo sapiens
agggccaaaatatttggaat

SEQ ID NO: 2322886 - DNA, 12 bp, Homo sapiens
agggcctgctgg

SEQ ID NO: 2322887 - DNA, 15 bp, Homo sapiens
agggcctgctggagg

SEQ ID NO: 2322888 - DNA, 17 bp, Homo sapiens
agggcggcctccttctg

SEQ ID NO: 2322889 - DNA, 16 bp, Homo sapiens
agggctccctcctgga

SEQ ID NO: 2322890 - DNA, 22 bp, Homo sapiens
agggctccctcctggagcatcc

SEQ ID NO: 2322891 - DNA, 17 bp, Homo sapiens
agggctgagctctctgt

SEQ ID NO: 2322892 - DNA, 20 bp, Homo sapiens
agggctgccttctggccttg

SEQ ID NO: 2322893 - DNA, 15 bp, Homo sapiens
agggctgcttttctt

SEQ ID NO: 2322894 - DNA, 14 bp, Homo sapiens
agggctggctcccc

SEQ ID NO: 2322895 - DNA, 16 bp, Homo sapiens
agggctggctcctgat

SEQ ID NO: 2322896 - DNA, 19 bp, Homo sapiens
agggctggctcctgatcca

SEQ ID NO: 2322897 - DNA, 15 bp, Homo sapiens
aggggaagaatgaaa

SEQ ID NO: 2322898 - DNA, 12 bp, Homo sapiens
aggggaaggccc

SEQ ID NO: 2322899 - DNA, 16 bp, Homo sapiens
aggggaaggccctgag

SEQ ID NO: 2322900 - DNA, 17 bp, Homo sapiens
aggggagagcctgctgg

SEQ ID NO: 2322901 - DNA, 18 bp, Homo sapiens
aggggaggggctcctttc

SEQ ID NO: 2322902 - DNA, 13 bp, Homo sapiens
aggggatctaaaa

SEQ ID NO: 2322903 - DNA, 16 bp, Homo sapiens
aggggatctaaaaaaa

SEQ ID NO: 2322904 - DNA, 13 bp, Homo sapiens
aggggcctgagtg

SEQ ID NO: 2322905 - DNA, 14 bp, Homo sapiens
aggggctggggact

SEQ ID NO: 2322906 - DNA, 14 bp, Homo sapiens
aggggcttgagaag

SEQ ID NO: 2322907 - DNA, 16 bp, Homo sapiens
agggggcaagaggaat

SEQ ID NO: 2322908 - DNA, 16 bp, Homo sapiens
agggggcttgaagcca

SEQ ID NO: 2322909 - DNA, 21 bp, Homo sapiens
aggggtatcatgtatggtgat

SEQ ID NO: 2322910 - DNA, 15 bp, Homo sapiens
aggggtctccctggc

SEQ ID NO: 2322911 - DNA, 13 bp, Homo sapiens
aggggtctgtctg

SEQ ID NO: 2322912 - DNA, 18 bp, Homo sapiens
aggggtggggagatgctt

SEQ ID NO: 2322913 - DNA, 21 bp, Homo sapiens
aggggtggggagatgcttctc

SEQ ID NO: 2322914 - DNA, 16 bp, Homo sapiens
aggggtgtggcagtgg

SEQ ID NO: 2322915 - DNA, 22 bp, Homo sapiens
agggtaaataaaccactgtgcg

SEQ ID NO: 2322916 - DNA, 15 bp, Homo sapiens
agggtcctgtcgcca

SEQ ID NO: 2322917 - DNA, 17 bp, Homo sapiens
agggtctgggctgggca

SEQ ID NO: 2322918 - DNA, 22 bp, Homo sapiens
agggtcttgctctgtcccccag

SEQ ID NO: 2322919 - DNA, 18 bp, Homo sapiens
agggtgccagttgggctc

SEQ ID NO: 2322920 - DNA, 20 bp, Homo sapiens
agggtgccccgcctgagtca

SEQ ID NO: 2322921 - DNA, 17 bp, Homo sapiens
agggtgggggagggagg

SEQ ID NO: 2322922 - DNA, 15 bp, Homo sapiens
agggtgtggctttcc

SEQ ID NO: 2322923 - DNA, 21 bp, Homo sapiens
agggtgtggctttccaggcac

SEQ ID NO: 2322924 - DNA, 16 bp, Homo sapiens
agggttaaggcctgaa

SEQ ID NO: 2322925 - DNA, 16 bp, Homo sapiens
agggtttctctgcaga

SEQ ID NO: 2322926 - DNA, 13 bp, Homo sapiens
agggttttctttt

SEQ ID NO: 2322927 - DNA, 14 bp, Homo sapiens
aggtaaatcccaca

SEQ ID NO: 2322928 - DNA, 16 bp, Homo sapiens
aggtaaatcccacatc

SEQ ID NO: 2322929 - DNA, 18 bp, Homo sapiens
aggtaaatggttaaattt

SEQ ID NO: 2322930 - DNA, 21 bp, Homo sapiens
aggtaacagaacagcttcagg

SEQ ID NO: 2322931 - DNA, 23 bp, Homo sapiens
aggtaacagaacagcttcaggtt

SEQ ID NO: 2322932 - DNA, 13 bp, Homo sapiens
aggtaccagctgc

SEQ ID NO: 2322933 - DNA, 23 bp, Homo sapiens
aggtaccagctgcgcttgctttt

SEQ ID NO: 2322934 - DNA, 14 bp, Homo sapiens
aggtagcgagctgc

SEQ ID NO: 2322935 - DNA, 21 bp, Homo sapiens
aggtatactttagtagacatt

SEQ ID NO: 2322936 - DNA, 21 bp, Homo sapiens
aggtatatgatgagcagactt

SEQ ID NO: 2322937 - DNA, 20 bp, Homo sapiens
aggtattaaaactaaatttc

SEQ ID NO: 2322938 - DNA, 13 bp, Homo sapiens
aggtattatacat

SEQ ID NO: 2322939 - DNA, 18 bp, Homo sapiens
aggtcaagtaagaagaca

SEQ ID NO: 2322940 - DNA, 16 bp, Homo sapiens
aggtcaggacggctcc

SEQ ID NO: 2322941 - DNA, 17 bp, Homo sapiens
aggtcatcagatgcctg

SEQ ID NO: 2322942 - DNA, 19 bp, Homo sapiens
aggtcatcagatgcctgct

SEQ ID NO: 2322943 - DNA, 19 bp, Homo sapiens
aggtccattcattaattag

SEQ ID NO: 2322944 - DNA, 20 bp, Homo sapiens
aggtcccctcgtcccatcca

SEQ ID NO: 2322945 - DNA, 22 bp, Homo sapiens
aggtcccctcgtcccatccagc

SEQ ID NO: 2322946 - DNA, 15 bp, Homo sapiens
aggtcctctggagcc

SEQ ID NO: 2322947 - DNA, 20 bp, Homo sapiens
aggtcctctggagccctaac

SEQ ID NO: 2322948 - DNA, 17 bp, Homo sapiens
aggtcttcttgtgtcct

SEQ ID NO: 2322949 - DNA, 21 bp, Homo sapiens
aggtcttcttgtgtcctgatg

SEQ ID NO: 2322950 - DNA, 14 bp, Homo sapiens
aggtcttttcaaat

SEQ ID NO: 2322951 - DNA, 19 bp, Homo sapiens
aggtgagtttgagctgcct

SEQ ID NO: 2322952 - DNA, 15 bp, Homo sapiens
aggtgcactgggagg

SEQ ID NO: 2322953 - DNA, 13 bp, Homo sapiens
aggtgccaggctg

SEQ ID NO: 2322954 - DNA, 21 bp, Homo sapiens
aggtgcctcagttttccttct

SEQ ID NO: 2322955 - DNA, 20 bp, Homo sapiens
aggtgccttacatcttttct

SEQ ID NO: 2322956 - DNA, 23 bp, Homo sapiens
aggtgccttacatcttttctaat

SEQ ID NO: 2322957 - DNA, 22 bp, Homo sapiens
aggtgcgtgttcagcagaacct

SEQ ID NO: 2322958 - DNA, 15 bp, Homo sapiens
aggtgctaacataga

SEQ ID NO: 2322959 - DNA, 17 bp, Homo sapiens
aggtgctatcctgccca

SEQ ID NO: 2322960 - DNA, 19 bp, Homo sapiens
aggtggaagaagggagaag

SEQ ID NO: 2322961 - DNA, 19 bp, Homo sapiens
aggtggagaaaattggaac

SEQ ID NO: 2322962 - DNA, 20 bp, Homo sapiens
aggtggatgttatgaacagc

SEQ ID NO: 2322963 - DNA, 20 bp, Homo sapiens
aggtggcagatgtcttccct

SEQ ID NO: 2322964 - DNA, 16 bp, Homo sapiens
aggtggcttgagctag

SEQ ID NO: 2322965 - DNA, 19 bp, Homo sapiens
aggtgggcaaagggaagta

SEQ ID NO: 2322966 - DNA, 22 bp, Homo sapiens
aggtgggccttgctacctcaag

SEQ ID NO: 2322967 - DNA, 15 bp, Homo sapiens
aggtgggctggactt

SEQ ID NO: 2322968 - DNA, 18 bp, Homo sapiens
aggtgggggcggggagta

SEQ ID NO: 2322969 - DNA, 17 bp, Homo sapiens
aggtgggggtgggctgc

SEQ ID NO: 2322970 - DNA, 15 bp, Homo sapiens
aggtgggggttgctg

SEQ ID NO: 2322971 - DNA, 14 bp, Homo sapiens
aggtgtataaatgt

SEQ ID NO: 2322972 - DNA, 19 bp, Homo sapiens
aggtgtcaccctgcagagc

SEQ ID NO: 2322973 - DNA, 12 bp, Homo sapiens
aggttaaaaaaa

SEQ ID NO: 2322974 - DNA, 19 bp, Homo sapiens
aggttataattttttttaa

SEQ ID NO: 2322975 - DNA, 20 bp, Homo sapiens
aggttataattttttttaaa

SEQ ID NO: 2322976 - DNA, 17 bp, Homo sapiens
aggttatcgaaataaca

SEQ ID NO: 2322977 - DNA, 19 bp, Homo sapiens
aggttatcgaaataacaat

SEQ ID NO: 2322978 - DNA, 16 bp, Homo sapiens
aggttattgcaataaa

SEQ ID NO: 2322979 - DNA, 15 bp, Homo sapiens
aggttcctctgcctg

SEQ ID NO: 2322980 - DNA, 17 bp, Homo sapiens
aggttcctctgcctgcc

SEQ ID NO: 2322981 - DNA, 19 bp, Homo sapiens
aggttcctctgcctgcccc

SEQ ID NO: 2322982 - DNA, 18 bp, Homo sapiens
agttcaaattcttctgaa

SEQ ID NO: 2322983 - DNA, 21 bp, Homo sapiens
agttcaataaatgtctgttga

SEQ ID NO: 2322984 - DNA, 20 bp, Homo sapiens
agttcatcagagttatggtg

SEQ ID NO: 2322985 - DNA, 15 bp, Homo sapiens
agttccagtttctcc

SEQ ID NO: 2322986 - DNA, 16 bp, Homo sapiens
agttccagtttctcct

SEQ ID NO: 2322987 - DNA, 17 bp, Homo sapiens
agttccagtttctcctt

SEQ ID NO: 2322988 - DNA, 18 bp, Homo sapiens
agttccagtttctccttg

SEQ ID NO: 2322989 - DNA, 22 bp, Homo sapiens
agttcccttgaaactttgggaa

SEQ ID NO: 2322990 - DNA, 18 bp, Homo sapiens
agttcctcctacttacaa

SEQ ID NO: 2322991 - DNA, 22 bp, Homo sapiens
agttcctcttttgtgctgcttc

SEQ ID NO: 2322992 - DNA, 18 bp, Homo sapiens
agttccttctcacttaga

SEQ ID NO: 2322993 - DNA, 16 bp, Homo sapiens
agttctactcaggctg

SEQ ID NO: 2322994 - DNA, 13 bp, Homo sapiens
agttctaggaaaa

SEQ ID NO: 2322995 - DNA, 14 bp, Homo sapiens
agttctaggaaaat

SEQ ID NO: 2322996 - DNA, 14 bp, Homo sapiens
agttctgggtttct

SEQ ID NO: 2322997 - DNA, 19 bp, Homo sapiens
agttctgttgacctgtgca

SEQ ID NO: 2322998 - DNA, 19 bp, Homo sapiens
agttctttcctctttctgc

SEQ ID NO: 2322999 - DNA, 17 bp, Homo sapiens
agttgaagttagtggaa

SEQ ID NO: 2323000 - DNA, 19 bp, Homo sapiens
agttgaagttagtggaaat

SEQ ID NO: 2323001 - DNA, 11 bp, Homo sapiens
agttgaggcca

SEQ ID NO: 2323002 - DNA, 23 bp, Homo sapiens
agttgcacttattgaccattttt

SEQ ID NO: 2323003 - DNA, 17 bp, Homo sapiens
agttgcatagcagtata

SEQ ID NO: 2323004 - DNA, 23 bp, Homo sapiens
agttgcccgaaactaagccaggc

SEQ ID NO: 2323005 - DNA, 16 bp, Homo sapiens
agttgcgtggactctg

SEQ ID NO: 2323006 - DNA, 13 bp, Homo sapiens
agttgctattttt

SEQ ID NO: 2323007 - DNA, 21 bp, Homo sapiens
agttgctgtgaactttcatgt

SEQ ID NO: 2323008 - DNA, 19 bp, Homo sapiens
agttggaaggatctgctga

SEQ ID NO: 2323009 - DNA, 16 bp, Homo sapiens
agttgggtgtctcctt

SEQ ID NO: 2323010 - DNA, 11 bp, Homo sapiens
agttgggtgtt

SEQ ID NO: 2323011 - DNA, 13 bp, Homo sapiens
agttgtaaagata

SEQ ID NO: 2323012 - DNA, 16 bp, Homo sapiens
agttgtagacaaagta

SEQ ID NO: 2323013 - DNA, 23 bp, Homo sapiens
agttgtcttatgtgaaaaattaa

SEQ ID NO: 2323014 - DNA, 20 bp, Homo sapiens
agttgtgatctgttgtaata

SEQ ID NO: 2323015 - DNA, 15 bp, Homo sapiens
agtttagttctgttg

SEQ ID NO: 2323016 - DNA, 16 bp, Homo sapiens
agtttagttctgttga

SEQ ID NO: 2323017 - DNA, 23 bp, Homo sapiens
agtttattttttttcttccaaca

SEQ ID NO: 2323018 - DNA, 22 bp, Homo sapiens
agtttcaagttttaaagttcat

SEQ ID NO: 2323019 - DNA, 14 bp, Homo sapiens
agtttcaggtgaca

SEQ ID NO: 2323020 - DNA, 15 bp, Homo sapiens
agtttcaggtgacat

SEQ ID NO: 2323021 - DNA, 17 bp, Homo sapiens
agtttccgtgcgtggca

SEQ ID NO: 2323022 - DNA, 20 bp, Homo sapiens
agtttccgtgcgtggcactc

SEQ ID NO: 2323023 - DNA, 12 bp, Homo sapiens
agtttctccttg

SEQ ID NO: 2323024 - DNA, 14 bp, Homo sapiens
agtttcttagcttt

SEQ ID NO: 2323025 - DNA, 20 bp, Homo sapiens
agtttctttattttgtgtaa

SEQ ID NO: 2323026 - DNA, 16 bp, Homo sapiens
agtttgagctgccttc

SEQ ID NO: 2323027 - DNA, 23 bp, Homo sapiens
agtttgagctgccttccctagct

SEQ ID NO: 2323028 - DNA, 20 bp, Homo sapiens
agttttacttttaaactgtg

SEQ ID NO: 2323029 - DNA, 10 bp, Homo sapiens
agttttccta

SEQ ID NO: 2323030 - DNA, 13 bp, Homo sapiens
agttttccttctg

SEQ ID NO: 2323031 - DNA, 14 bp, Homo sapiens
agttttccttctgt

SEQ ID NO: 2323032 - DNA, 21 bp, Homo sapiens
agttttccttctgttaaaatg

SEQ ID NO: 2323033 - DNA, 16 bp, Homo sapiens
agttttgaaaagctat

SEQ ID NO: 2323034 - DNA, 22 bp, Homo sapiens
agttttgtaaaagaaatcatgt

SEQ ID NO: 2323035 - DNA, 15 bp, Homo sapiens
agttttgtctgtctc

SEQ ID NO: 2323036 - DNA, 14 bp, Homo sapiens
agttttgttgcccc

SEQ ID NO: 2323037 - DNA, 18 bp, Homo sapiens
agttttgttgtacttaaa

SEQ ID NO: 2323038 - DNA, 13 bp, Homo sapiens
agtttttgatagt

SEQ ID NO: 2323039 - DNA, 17 bp, Homo sapiens
agtttttggttgggaat

SEQ ID NO: 2323040 - DNA, 13 bp, Homo sapiens
ataaaaaatcatg

SEQ ID NO: 2323041 - DNA, 14 bp, Homo sapiens
ataaaaagatcact

SEQ ID NO: 2323042 - DNA, 17 bp, Homo sapiens
ataaaaagtaatgactt

SEQ ID NO: 2323043 - DNA, 13 bp, Homo sapiens
ataaaaatatgta

SEQ ID NO: 2323044 - DNA, 12 bp, Homo sapiens
ataaaagaaaat

SEQ ID NO: 2323045 - DNA, 13 bp, Homo sapiens
ataaaagaaataa

SEQ ID NO: 2323046 - DNA, 12 bp, Homo sapiens
ataaaagaacat

SEQ ID NO: 2323047 - DNA, 23 bp, Homo sapiens
ataaaagcaccactgttctgttc

SEQ ID NO: 2323048 - DNA, 15 bp, Homo sapiens
ataaaagtgaagtga

SEQ ID NO: 2323049 - DNA, 14 bp, Homo sapiens
ataaaataaataat

SEQ ID NO: 2323050 - DNA, 16 bp, Homo sapiens
ataaaataaataattt

SEQ ID NO: 2323051 - DNA, 21 bp, Homo sapiens
ataaaatagaataattctttt

SEQ ID NO: 2323052 - DNA, 15 bp, Homo sapiens
ataaaatatcataaa

SEQ ID NO: 2323053 - DNA, 16 bp, Homo sapiens
ataaaatatcataaag

SEQ ID NO: 2323054 - DNA, 20 bp, Homo sapiens
ataaaatatcataaagcatt

SEQ ID NO: 2323055 - DNA, 17 bp, Homo sapiens
ataaaatgaaaattgta

SEQ ID NO: 2323056 - DNA, 18 bp, Homo sapiens
ataaaatgaaaattgtat

SEQ ID NO: 2323057 - DNA, 17 bp, Homo sapiens
ataaaatgtaattactt

SEQ ID NO: 2323058 - DNA, 16 bp, Homo sapiens
ataaaattcctatctc

SEQ ID NO: 2323059 - DNA, 20 bp, Homo sapiens
ataaaatttaaaaaataaat

SEQ ID NO: 2323060 - DNA, 17 bp, Homo sapiens
ataaaatttttatgtaa

SEQ ID NO: 2323061 - DNA, 23 bp, Homo sapiens
ataaaatttttatgtaattatat

SEQ ID NO: 2323062 - DNA, 13 bp, Homo sapiens
ataaacagaaatg

SEQ ID NO: 2323063 - DNA, 16 bp, Homo sapiens
ataaaccaaaaacatt

SEQ ID NO: 2323064 - DNA, 18 bp, Homo sapiens
ataaaccaaaaacatttg

SEQ ID NO: 2323065 - DNA, 19 bp, Homo sapiens
ataaaccaaaaacatttga

SEQ ID NO: 2323066 - DNA, 18 bp, Homo sapiens
ataaaccgtgtatttatt

SEQ ID NO: 2323067 - DNA, 19 bp, Homo sapiens
ataaacggttcctggtgac

SEQ ID NO: 2323068 - DNA, 22 bp, Homo sapiens
ataaactaaaaactaacagcta

SEQ ID NO: 2323069 - DNA, 18 bp, Homo sapiens
ataaactcagatctgatc

SEQ ID NO: 2323070 - DNA, 24 bp, Homo sapiens
ataaacttaaagctactgtagaaa

SEQ ID NO: 2323071 - DNA, 20 bp, Homo sapiens
ataaagaaaagacattttaa

SEQ ID NO: 2323072 - DNA, 17 bp, Homo sapiens
ataaagaccagaaattc

SEQ ID NO: 2323073 - DNA, 14 bp, Homo sapiens
ataaagatgagttg

SEQ ID NO: 2323074 - DNA, 15 bp, Homo sapiens
ataaagatgagttgg

SEQ ID NO: 2323075 - DNA, 12 bp, Homo sapiens
ataaaggaaaag

SEQ ID NO: 2323076 - DNA, 15 bp, Homo sapiens
ataaaggaaaagaca

SEQ ID NO: 2323077 - DNA, 16 bp, Homo sapiens
ataaagtaatttttat

SEQ ID NO: 2323078 - DNA, 12 bp, Homo sapiens
ataaagtacaaa

SEQ ID NO: 2323079 - DNA, 15 bp, Homo sapiens
ataaataaaaattca

SEQ ID NO: 2323080 - DNA, 11 bp, Homo sapiens
ataaataattt

SEQ ID NO: 2323081 - DNA, 14 bp, Homo sapiens
ataaatatgcagtg

SEQ ID NO: 2323082 - DNA, 14 bp, Homo sapiens
ataaatatttatgt

SEQ ID NO: 2323083 - DNA, 15 bp, Homo sapiens
ataaatcataaagtc

SEQ ID NO: 2323084 - DNA, 21 bp, Homo sapiens
ataaatgaaacttggccagtt

SEQ ID NO: 2323085 - DNA, 23 bp, Homo sapiens
ataaatgggtgtatataatttta

SEQ ID NO: 2323086 - DNA, 13 bp, Homo sapiens
ataaatgtacatt

SEQ ID NO: 2323087 - DNA, 15 bp, Homo sapiens
ataaatgtacatttc

SEQ ID NO: 2323088 - DNA, 20 bp, Homo sapiens
ataaatgtataaatatacag

SEQ ID NO: 2323089 - DNA, 12 bp, Homo sapiens
ataaatgtctgt

SEQ ID NO: 2323090 - DNA, 15 bp, Homo sapiens
ataaatgtctgttga

SEQ ID NO: 2323091 - DNA, 14 bp, Homo sapiens
ataaattaggacca

SEQ ID NO: 2323092 - DNA, 22 bp, Homo sapiens
ataaattatgagctatcctttc

SEQ ID NO: 2323093 - DNA, 14 bp, Homo sapiens
ataaattttctaaa

SEQ ID NO: 2323094 - DNA, 18 bp, Homo sapiens
ataacaaatttttcaaat

SEQ ID NO: 2323095 - DNA, 14 bp, Homo sapiens
ataacaatgttaag

SEQ ID NO: 2323096 - DNA, 16 bp, Homo sapiens
ataacaatgttaagga

SEQ ID NO: 2323097 - DNA, 23 bp, Homo sapiens
ataacacatttttttgcatgcat

SEQ ID NO: 2323098 - DNA, 18 bp, Homo sapiens
caacctgctctgtcccca

SEQ ID NO: 2323099 - DNA, 22 bp, Homo sapiens
caacctgttacctactttgact

SEQ ID NO: 2323100 - DNA, 18 bp, Homo sapiens
caactacacaaagcaggc

SEQ ID NO: 2323101 - DNA, 19 bp, Homo sapiens
caactcgctttaggtcagc

SEQ ID NO: 2323102 - DNA, 18 bp, Homo sapiens
caactgaggttcttggga

SEQ ID NO: 2323103 - DNA, 18 bp, Homo sapiens
caactgcctactccaaaa

SEQ ID NO: 2323104 - DNA, 14 bp, Homo sapiens
caactgctcccacc

SEQ ID NO: 2323105 - DNA, 18 bp, Homo sapiens
caactgctcccacctcct

SEQ ID NO: 2323106 - DNA, 17 bp, Homo sapiens
caactgctggggagaca

SEQ ID NO: 2323107 - DNA, 15 bp, Homo sapiens
caactgtcttcctca

SEQ ID NO: 2323108 - DNA, 16 bp, Homo sapiens
caactgtcttcctcaa

SEQ ID NO: 2323109 - DNA, 12 bp, Homo sapiens
caactgtgtgat

SEQ ID NO: 2323110 - DNA, 16 bp, Homo sapiens
caacttagctcaggtg

SEQ ID NO: 2323111 - DNA, 19 bp, Homo sapiens
caacttagctcaggtgcct

SEQ ID NO: 2323112 - DNA, 19 bp, Homo sapiens
caacttattctttgagtaa

SEQ ID NO: 2323113 - DNA, 14 bp, Homo sapiens
caactttcacttct

SEQ ID NO: 2323114 - DNA, 19 bp, Homo sapiens
caactttgtaaaaatcttt

SEQ ID NO: 2323115 - DNA, 22 bp, Homo sapiens
caactttgtaaaaatcttttga

SEQ ID NO: 2323116 - DNA, 15 bp, Homo sapiens
caagaaactgaatga

SEQ ID NO: 2323117 - DNA, 12 bp, Homo sapiens
caagaaatggcg

SEQ ID NO: 2323118 - DNA, 22 bp, Homo sapiens
caagaaatggcgtctgctctgg

SEQ ID NO: 2323119 - DNA, 16 bp, Homo sapiens
caagaataattttgga

SEQ ID NO: 2323120 - DNA, 17 bp, Homo sapiens
caagaataattttggaa

SEQ ID NO: 2323121 - DNA, 16 bp, Homo sapiens
caagaccctcccatgg

SEQ ID NO: 2323122 - DNA, 24 bp, Homo sapiens
caagagaactcgcgctcagtaaac

SEQ ID NO: 2323123 - DNA, 16 bp, Homo sapiens
caagagatgggaatga

SEQ ID NO: 2323124 - DNA, 16 bp, Homo sapiens
caagaggagcccccac

SEQ ID NO: 2323125 - DNA, 20 bp, Homo sapiens
caagaggcaagctgaaattt

SEQ ID NO: 2323126 - DNA, 18 bp, Homo sapiens
caagagggggtggagggg

SEQ ID NO: 2323127 - DNA, 18 bp, Homo sapiens
caagatgggggcagggct

SEQ ID NO: 2323128 - DNA, 20 bp, Homo sapiens
caagatgggggcagggctgt

SEQ ID NO: 2323129 - DNA, 12 bp, Homo sapiens
caagatgtgaat

SEQ ID NO: 2323130 - DNA, 13 bp, Homo sapiens
caagatgtgaatt

SEQ ID NO: 2323131 - DNA, 18 bp, Homo sapiens
caagatgtgaattattga

SEQ ID NO: 2323132 - DNA, 18 bp, Homo sapiens
caagattttcctcttgtg

SEQ ID NO: 2323133 - DNA, 22 bp, Homo sapiens
caagattttgaatgcttcctga

SEQ ID NO: 2323134 - DNA, 19 bp, Homo sapiens
caagcaaaatctaaaatgt

SEQ ID NO: 2323135 - DNA, 22 bp, Homo sapiens
caagcacagagcctggccccag

SEQ ID NO: 2323136 - DNA, 12 bp, Homo sapiens
caagcagaaaaa

SEQ ID NO: 2323137 - DNA, 15 bp, Homo sapiens
caagcagctggtcag

SEQ ID NO: 2323138 - DNA, 16 bp, Homo sapiens
caagcatttcatgaaa

SEQ ID NO: 2323139 - DNA, 13 bp, Homo sapiens
caagccagaccta

SEQ ID NO: 2323140 - DNA, 21 bp, Homo sapiens
caagccagacctagcaggctg

SEQ ID NO: 2323141 - DNA, 21 bp, Homo sapiens
caagccattttttgaggagag

SEQ ID NO: 2323142 - DNA, 19 bp, Homo sapiens
caagcccagcccatggaga

SEQ ID NO: 2323143 - DNA, 15 bp, Homo sapiens
caagcctccacagcg

SEQ ID NO: 2323144 - DNA, 16 bp, Homo sapiens
caagcctccacagcga

SEQ ID NO: 2323145 - DNA, 17 bp, Homo sapiens
caagcctccacagcgag

SEQ ID NO: 2323146 - DNA, 19 bp, Homo sapiens
caagccttccagggatttg

SEQ ID NO: 2323147 - DNA, 15 bp, Homo sapiens
caagctagtgtttct

SEQ ID NO: 2323148 - DNA, 17 bp, Homo sapiens
caagctataaaagccca

SEQ ID NO: 2323149 - DNA, 18 bp, Homo sapiens
caagctataaaagcccat

SEQ ID NO: 2323150 - DNA, 13 bp, Homo sapiens
caagctgaaattt

SEQ ID NO: 2323151 - DNA, 15 bp, Homo sapiens
caagctggaagaagt

SEQ ID NO: 2323152 - DNA, 16 bp, Homo sapiens
caagctttaaattatg

SEQ ID NO: 2323153 - DNA, 15 bp, Homo sapiens
caagcttttgcttga

SEQ ID NO: 2323154 - DNA, 21 bp, Homo sapiens
caagcttttgcttgatccaga

SEQ ID NO: 2323155 - DNA, 17 bp, Homo sapiens
caaggaagaagaaatct

SEQ ID NO: 2323156 - DNA, 19 bp, Homo sapiens
caaggaagaagaaatcttt

SEQ ID NO: 2323157 - DNA, 15 bp, Homo sapiens
caaggagatttctta

SEQ ID NO: 2323158 - DNA, 18 bp, Homo sapiens
caaggaggggctgtaaaa

SEQ ID NO: 2323159 - DNA, 20 bp, Homo sapiens
caaggatcggactctgcccc

SEQ ID NO: 2323160 - DNA, 22 bp, Homo sapiens
caaggatcggactctgcccctg

SEQ ID NO: 2323161 - DNA, 15 bp, Homo sapiens
caaggctgccagaca

SEQ ID NO: 2323162 - DNA, 22 bp, Homo sapiens
caaggctgccagacatggacct

SEQ ID NO: 2323163 - DNA, 13 bp, Homo sapiens
caaggtaaacttc

SEQ ID NO: 2323164 - DNA, 20 bp, Homo sapiens
caaggtcactgtttcctggg

SEQ ID NO: 2323165 - DNA, 11 bp, Homo sapiens
caaggtgctaa

SEQ ID NO: 2323166 - DNA, 21 bp, Homo sapiens
caaggtggcagatgtcttccc

SEQ ID NO: 2323167 - DNA, 23 bp, Homo sapiens
caaggtggcagatgtcttccctg

SEQ ID NO: 2323168 - DNA, 21 bp, Homo sapiens
caaggttataattttttttaa

SEQ ID NO: 2323169 - DNA, 14 bp, Homo sapiens
caaggttggagccc

SEQ ID NO: 2323170 - DNA, 14 bp, Homo sapiens
caagtaagaagaca

SEQ ID NO: 2323171 - DNA, 23 bp, Homo sapiens
caagtaatttcagtgtaaagtgt

SEQ ID NO: 2323172 - DNA, 20 bp, Homo sapiens
caagtatactaagagtaaag

SEQ ID NO: 2323173 - DNA, 22 bp, Homo sapiens
caagtatggtaggggagggcag

SEQ ID NO: 2323174 - DNA, 20 bp, Homo sapiens
caagtcaacactcttcttga

SEQ ID NO: 2323175 - DNA, 11 bp, Homo sapiens
caagtgcctca

SEQ ID NO: 2323176 - DNA, 12 bp, Homo sapiens
caagtgcctcac

SEQ ID NO: 2323177 - DNA, 13 bp, Homo sapiens
caagtgctggagt

SEQ ID NO: 2323178 - DNA, 19 bp, Homo sapiens
caagtggaccttgagacca

SEQ ID NO: 2323179 - DNA, 17 bp, Homo sapiens
caagtggggtgctggga

SEQ ID NO: 2323180 - DNA, 13 bp, Homo sapiens
caagtgttcactg

SEQ ID NO: 2323181 - DNA, 15 bp, Homo sapiens
caagttataggaaag

SEQ ID NO: 2323182 - DNA, 19 bp, Homo sapiens
caagttgttcgggccaagg

SEQ ID NO: 2323183 - DNA, 21 bp, Homo sapiens
caagttttaaacccaaaatat

SEQ ID NO: 2323184 - DNA, 19 bp, Homo sapiens
caataaaaacaactttcac

SEQ ID NO: 2323185 - DNA, 20 bp, Homo sapiens
caataaaaatgtttaacggt

SEQ ID NO: 2323186 - DNA, 13 bp, Homo sapiens
caataaaatttaa

SEQ ID NO: 2323187 - DNA, 14 bp, Homo sapiens
caataaaatttaaa

SEQ ID NO: 2323188 - DNA, 18 bp, Homo sapiens
caataaagtataatgttt

SEQ ID NO: 2323189 - DNA, 14 bp, Homo sapiens
caataacagctgca

SEQ ID NO: 2323190 - DNA, 13 bp, Homo sapiens
caataagaaacag

SEQ ID NO: 2323191 - DNA, 21 bp, Homo sapiens
caataagaaacagtttaacag

SEQ ID NO: 2323192 - DNA, 15 bp, Homo sapiens
caatacatgagaaag

SEQ ID NO: 2323193 - DNA, 16 bp, Homo sapiens
caatagatctccagcg

SEQ ID NO: 2323194 - DNA, 17 bp, Homo sapiens
caatagtatacatttta

SEQ ID NO: 2323195 - DNA, 20 bp, Homo sapiens
caatagtatacattttataa

SEQ ID NO: 2323196 - DNA, 14 bp, Homo sapiens
caatatattgaact

SEQ ID NO: 2323197 - DNA, 14 bp, Homo sapiens
caatatcatgtgat

SEQ ID NO: 2323198 - DNA, 24 bp, Homo sapiens
caatattaacctaatcaccatgta

SEQ ID NO: 2323199 - DNA, 19 bp, Homo sapiens
caatattccagatctttca

SEQ ID NO: 2323200 - DNA, 16 bp, Homo sapiens
caatattgattgggaa

SEQ ID NO: 2323201 - DNA, 20 bp, Homo sapiens
caatattgattgggaaaaca

SEQ ID NO: 2323202 - DNA, 16 bp, Homo sapiens
caatatttactcatca

SEQ ID NO: 2323203 - DNA, 23 bp, Homo sapiens
caatatttttatatcatgcaaaa

SEQ ID NO: 2323204 - DNA, 22 bp, Homo sapiens
caatcacagtctcagttctctt

SEQ ID NO: 2323205 - DNA, 15 bp, Homo sapiens
caatcactgctcccc

SEQ ID NO: 2323206 - DNA, 17 bp, Homo sapiens
caatcagcctcatgact

SEQ ID NO: 2323207 - DNA, 15 bp, Homo sapiens
caatccacctgcctt

SEQ ID NO: 2323208 - DNA, 18 bp, Homo sapiens
caatccacctgccttggc

SEQ ID NO: 2323209 - DNA, 16 bp, Homo sapiens
caatcggactgccaaa

SEQ ID NO: 2323210 - DNA, 19 bp, Homo sapiens
caatctatggcttatttct

SEQ ID NO: 2323211 - DNA, 20 bp, Homo sapiens
caatctggatgcctcattat

SEQ ID NO: 2323212 - DNA, 15 bp, Homo sapiens
caatctgtaaactgt

SEQ ID NO: 2323213 - DNA, 17 bp, Homo sapiens
cagccagcagcagccca

SEQ ID NO: 2323214 - DNA, 21 bp, Homo sapiens
cagccaggcagaggttttaat

SEQ ID NO: 2323215 - DNA, 17 bp, Homo sapiens
cagccatcctccctcca

SEQ ID NO: 2323216 - DNA, 23 bp, Homo sapiens
cagccatcctccctccacctcaa

SEQ ID NO: 2323217 - DNA, 18 bp, Homo sapiens
cagccatgccagctggcc

SEQ ID NO: 2323218 - DNA, 14 bp, Homo sapiens
cagcccagagactt

SEQ ID NO: 2323219 - DNA, 17 bp, Homo sapiens
cagcccagcagtgtgga

SEQ ID NO: 2323220 - DNA, 22 bp, Homo sapiens
cagcccaggatactggcacaga

SEQ ID NO: 2323221 - DNA, 12 bp, Homo sapiens
cagcccaggctt

SEQ ID NO: 2323222 - DNA, 21 bp, Homo sapiens
cagcccatggagattgacctg

SEQ ID NO: 2323223 - DNA, 14 bp, Homo sapiens
cagccccactgcca

SEQ ID NO: 2323224 - DNA, 15 bp, Homo sapiens
cagccccactgccag

SEQ ID NO: 2323225 - DNA, 19 bp, Homo sapiens
cagccccactgccagcagc

SEQ ID NO: 2323226 - DNA, 20 bp, Homo sapiens
cagccccactgccagcagca

SEQ ID NO: 2323227 - DNA, 22 bp, Homo sapiens
cagccccactgccagcagcagc

SEQ ID NO: 2323228 - DNA, 13 bp, Homo sapiens
cagccccatcaga

SEQ ID NO: 2323229 - DNA, 21 bp, Homo sapiens
cagccccatcagaacctgagc

SEQ ID NO: 2323230 - DNA, 21 bp, Homo sapiens
cagccccgcgaccatgtggcc

SEQ ID NO: 2323231 - DNA, 19 bp, Homo sapiens
cagccccggcaagccacag

SEQ ID NO: 2323232 - DNA, 19 bp, Homo sapiens
cagccccggtggctgggca

SEQ ID NO: 2323233 - DNA, 20 bp, Homo sapiens
cagccccggtggctgggcag

SEQ ID NO: 2323234 - DNA, 20 bp, Homo sapiens
cagcccctactgctgtgaac

SEQ ID NO: 2323235 - DNA, 20 bp, Homo sapiens
cagcccctatagcactgagc

SEQ ID NO: 2323236 - DNA, 14 bp, Homo sapiens
cagcccctggggcc

SEQ ID NO: 2323237 - DNA, 13 bp, Homo sapiens
cagccctcagttc

SEQ ID NO: 2323238 - DNA, 18 bp, Homo sapiens
cagccctcagttccttca

SEQ ID NO: 2323239 - DNA, 15 bp, Homo sapiens
cagccctgcagccca

SEQ ID NO: 2323240 - DNA, 11 bp, Homo sapiens
cagccctgctg

SEQ ID NO: 2323241 - DNA, 12 bp, Homo sapiens
cagccctgctgg

SEQ ID NO: 2323242 - DNA, 13 bp, Homo sapiens
cagccctgctggg

SEQ ID NO: 2323243 - DNA, 16 bp, Homo sapiens
cagcccttccaaactc

SEQ ID NO: 2323244 - DNA, 15 bp, Homo sapiens
cagccgggggctggc

SEQ ID NO: 2323245 - DNA, 18 bp, Homo sapiens
cagcctagggcagacaat

SEQ ID NO: 2323246 - DNA, 13 bp, Homo sapiens
cagcctcagactg

SEQ ID NO: 2323247 - DNA, 17 bp, Homo sapiens
cagcctcatactcctgg

SEQ ID NO: 2323248 - DNA, 17 bp, Homo sapiens
cagcctcctctggacgg

SEQ ID NO: 2323249 - DNA, 15 bp, Homo sapiens
cagcctctcagtgcc

SEQ ID NO: 2323250 - DNA, 19 bp, Homo sapiens
cagcctctcagtgccctcc

SEQ ID NO: 2323251 - DNA, 21 bp, Homo sapiens
cagcctctcagtgccctccag

SEQ ID NO: 2323252 - DNA, 12 bp, Homo sapiens
cagcctgggcca

SEQ ID NO: 2323253 - DNA, 20 bp, Homo sapiens
cagcctgggccatctcttag

SEQ ID NO: 2323254 - DNA, 14 bp, Homo sapiens
cagcctgtcctggt

SEQ ID NO: 2323255 - DNA, 16 bp, Homo sapiens
cagcctgtcctggtac

SEQ ID NO: 2323256 - DNA, 16 bp, Homo sapiens
cagccttctccatatc

SEQ ID NO: 2323257 - DNA, 22 bp, Homo sapiens
cagccttctccatatctccatg

SEQ ID NO: 2323258 - DNA, 15 bp, Homo sapiens
cagccttgagccctg

SEQ ID NO: 2323259 - DNA, 15 bp, Homo sapiens
cagcctttgaatgta

SEQ ID NO: 2323260 - DNA, 23 bp, Homo sapiens
cagccttttttcctgggccagaa

SEQ ID NO: 2323261 - DNA, 14 bp, Homo sapiens
cagcgagggcagct

SEQ ID NO: 2323262 - DNA, 16 bp, Homo sapiens
cagcgcatcctgcagg

SEQ ID NO: 2323263 - DNA, 14 bp, Homo sapiens
cagcgccagcctca

SEQ ID NO: 2323264 - DNA, 14 bp, Homo sapiens
cagcggctcccctc

SEQ ID NO: 2323265 - DNA, 14 bp, Homo sapiens
cagcggggctgctc

SEQ ID NO: 2323266 - DNA, 13 bp, Homo sapiens
cagcgtccctggc

SEQ ID NO: 2323267 - DNA, 15 bp, Homo sapiens
cagcgtccctggcgc

SEQ ID NO: 2323268 - DNA, 21 bp, Homo sapiens
cagctacaaacttttaagatt

SEQ ID NO: 2323269 - DNA, 23 bp, Homo sapiens
cagctaccaccacggccaccact

SEQ ID NO: 2323270 - DNA, 18 bp, Homo sapiens
cagctaccaggtgttcta

SEQ ID NO: 2323271 - DNA, 16 bp, Homo sapiens
cagctacttgggaggc

SEQ ID NO: 2323272 - DNA, 18 bp, Homo sapiens
cagctacttgggaggctg

SEQ ID NO: 2323273 - DNA, 23 bp, Homo sapiens
cagctagattttgctgattttct

SEQ ID NO: 2323274 - DNA, 23 bp, Homo sapiens
cagctattggcaagttttaaacc

SEQ ID NO: 2323275 - DNA, 21 bp, Homo sapiens
cagctccagggaatccaagcc

SEQ ID NO: 2323276 - DNA, 22 bp, Homo sapiens
cagctccagggaatccaagcct

SEQ ID NO: 2323277 - DNA, 18 bp, Homo sapiens
cagctccctcctgcacac

SEQ ID NO: 2323278 - DNA, 14 bp, Homo sapiens
cagctccctttctc

SEQ ID NO: 2323279 - DNA, 16 bp, Homo sapiens
cagctccctttctcag

SEQ ID NO: 2323280 - DNA, 17 bp, Homo sapiens
cagctccctttctcagg

SEQ ID NO: 2323281 - DNA, 21 bp, Homo sapiens
cagctccctttctcaggagct

SEQ ID NO: 2323282 - DNA, 18 bp, Homo sapiens
cagctctccgccaatttc

SEQ ID NO: 2323283 - DNA, 12 bp, Homo sapiens
cagctctctgac

SEQ ID NO: 2323284 - DNA, 18 bp, Homo sapiens
cagctctctgacgcttgt

SEQ ID NO: 2323285 - DNA, 18 bp, Homo sapiens
cagctgccctatgggcct

SEQ ID NO: 2323286 - DNA, 14 bp, Homo sapiens
cagctgcctaccta

SEQ ID NO: 2323287 - DNA, 19 bp, Homo sapiens
cagctgcgcttgcttttct

SEQ ID NO: 2323288 - DNA, 16 bp, Homo sapiens
cagctgctatccccat

SEQ ID NO: 2323289 - DNA, 23 bp, Homo sapiens
cagctgctatccccatctccctg

SEQ ID NO: 2323290 - DNA, 18 bp, Homo sapiens
cagctgctccctggcatt

SEQ ID NO: 2323291 - DNA, 16 bp, Homo sapiens
cagctgctgttctcag

SEQ ID NO: 2323292 - DNA, 21 bp, Homo sapiens
cagctgctgttctcaggacag

SEQ ID NO: 2323293 - DNA, 13 bp, Homo sapiens
cagctggagaaat

SEQ ID NO: 2323294 - DNA, 14 bp, Homo sapiens
cagctggcctggac

SEQ ID NO: 2323295 - DNA, 16 bp, Homo sapiens
cagctggcctggacag

SEQ ID NO: 2323296 - DNA, 16 bp, Homo sapiens
cagctggctctccacc

SEQ ID NO: 2323297 - DNA, 18 bp, Homo sapiens
cagctggctctccacctt

SEQ ID NO: 2323298 - DNA, 18 bp, Homo sapiens
cagctggggccagaggct

SEQ ID NO: 2323299 - DNA, 18 bp, Homo sapiens
cagctggtcagtctttgc

SEQ ID NO: 2323300 - DNA, 20 bp, Homo sapiens
cagctggtcagtctttgctc

SEQ ID NO: 2323301 - DNA, 11 bp, Homo sapiens
cagctgtgtct

SEQ ID NO: 2323302 - DNA, 21 bp, Homo sapiens
cagctgtgtctgccaaacaca

SEQ ID NO: 2323303 - DNA, 23 bp, Homo sapiens
cagctgtgtgacatttggagagg

SEQ ID NO: 2323304 - DNA, 12 bp, Homo sapiens
cagcttccaaag

SEQ ID NO: 2323305 - DNA, 17 bp, Homo sapiens
cagcttccaaagcctag

SEQ ID NO: 2323306 - DNA, 14 bp, Homo sapiens
cagcttgagccggg

SEQ ID NO: 2323307 - DNA, 21 bp, Homo sapiens
cagcttggggccaccaaagct

SEQ ID NO: 2323308 - DNA, 13 bp, Homo sapiens
caggaaaccgagt

SEQ ID NO: 2323309 - DNA, 20 bp, Homo sapiens
caggaaactccacatctgcc

SEQ ID NO: 2323310 - DNA, 23 bp, Homo sapiens
caggaaactccacatctgcctta

SEQ ID NO: 2323311 - DNA, 23 bp, Homo sapiens
caggaaatatctgtgaaggactt

SEQ ID NO: 2323312 - DNA, 22 bp, Homo sapiens
caggaacaaacagggctgcctt

SEQ ID NO: 2323313 - DNA, 17 bp, Homo sapiens
caggaaggaggggagag

SEQ ID NO: 2323314 - DNA, 13 bp, Homo sapiens
caggaagggaagc

SEQ ID NO: 2323315 - DNA, 15 bp, Homo sapiens
caggaagggaagcgt

SEQ ID NO: 2323316 - DNA, 16 bp, Homo sapiens
caggaattctcaagac

SEQ ID NO: 2323317 - DNA, 21 bp, Homo sapiens
caggacaccacgattctccca

SEQ ID NO: 2323318 - DNA, 24 bp, Homo sapiens
caggacagcatcccttcccacatg

SEQ ID NO: 2323319 - DNA, 15 bp, Homo sapiens
caggacatgcaataa

SEQ ID NO: 2323320 - DNA, 21 bp, Homo sapiens
caggacatgcaataaaattta

SEQ ID NO: 2323321 - DNA, 17 bp, Homo sapiens
caggacggctcctcaga

SEQ ID NO: 2323322 - DNA, 12 bp, Homo sapiens
caggactctgac

SEQ ID NO: 2323323 - DNA, 14 bp, Homo sapiens
caggactctgaccc

SEQ ID NO: 2323324 - DNA, 13 bp, Homo sapiens
caggagacaaaag

SEQ ID NO: 2323325 - DNA, 13 bp, Homo sapiens
caggagagaagct

SEQ ID NO: 2323326 - DNA, 15 bp, Homo sapiens
caggagcaggcacgg

SEQ ID NO: 2323327 - DNA, 18 bp, Homo sapiens
caggagcaggcacgggtg

SEQ ID NO: 2323328 - DNA, 22 bp, Homo sapiens
catcttctcattcccatgtgga

SEQ ID NO: 2323329 - DNA, 23 bp, Homo sapiens
catcttctcattcccatgtggaa

SEQ ID NO: 2323330 - DNA, 14 bp, Homo sapiens
catcttgctggcta

SEQ ID NO: 2323331 - DNA, 23 bp, Homo sapiens
catcttggttatttctgaaggta

SEQ ID NO: 2323332 - DNA, 21 bp, Homo sapiens
catctttccatccattacctc

SEQ ID NO: 2323333 - DNA, 22 bp, Homo sapiens
catgaaaaacacggcagctgta

SEQ ID NO: 2323334 - DNA, 15 bp, Homo sapiens
catgaaaaagcagct

SEQ ID NO: 2323335 - DNA, 14 bp, Homo sapiens
catgaaaaagctgc

SEQ ID NO: 2323336 - DNA, 15 bp, Homo sapiens
catgaaaaagctgct

SEQ ID NO: 2323337 - DNA, 13 bp, Homo sapiens
catgaaataaaat

SEQ ID NO: 2323338 - DNA, 14 bp, Homo sapiens
catgaaataaaata

SEQ ID NO: 2323339 - DNA, 21 bp, Homo sapiens
catgaaataaaatatatctta

SEQ ID NO: 2323340 - DNA, 14 bp, Homo sapiens
catgaacttgatac

SEQ ID NO: 2323341 - DNA, 15 bp, Homo sapiens
catgaagcaggaggc

SEQ ID NO: 2323342 - DNA, 23 bp, Homo sapiens
catgaagcaggaggcccttgtcg

SEQ ID NO: 2323343 - DNA, 17 bp, Homo sapiens
catgaatctctgcctct

SEQ ID NO: 2323344 - DNA, 19 bp, Homo sapiens
catgaatctctgcctctcc

SEQ ID NO: 2323345 - DNA, 13 bp, Homo sapiens
catgaatgctttt

SEQ ID NO: 2323346 - DNA, 21 bp, Homo sapiens
catgaattacctggatgttct

SEQ ID NO: 2323347 - DNA, 15 bp, Homo sapiens
catgaattttaaagt

SEQ ID NO: 2323348 - DNA, 12 bp, Homo sapiens
catgacagaggc

SEQ ID NO: 2323349 - DNA, 13 bp, Homo sapiens
catgacagaggct

SEQ ID NO: 2323350 - DNA, 18 bp, Homo sapiens
catgacagcctgcagcag

SEQ ID NO: 2323351 - DNA, 15 bp, Homo sapiens
catgacataataaag

SEQ ID NO: 2323352 - DNA, 18 bp, Homo sapiens
catgacctagttttccat

SEQ ID NO: 2323353 - DNA, 19 bp, Homo sapiens
catgacctagttttccatg

SEQ ID NO: 2323354 - DNA, 14 bp, Homo sapiens
catgactaatgctt

SEQ ID NO: 2323355 - DNA, 20 bp, Homo sapiens
catgactaatgctttttaga

SEQ ID NO: 2323356 - DNA, 21 bp, Homo sapiens
catgactaatgctttttagaa

SEQ ID NO: 2323357 - DNA, 18 bp, Homo sapiens
catgacttccttatttct

SEQ ID NO: 2323358 - DNA, 21 bp, Homo sapiens
catgacttccttatttctgaa

SEQ ID NO: 2323359 - DNA, 11 bp, Homo sapiens
catgagaagcc

SEQ ID NO: 2323360 - DNA, 14 bp, Homo sapiens
catgagcctgctgg

SEQ ID NO: 2323361 - DNA, 12 bp, Homo sapiens
catgaggagggt

SEQ ID NO: 2323362 - DNA, 15 bp, Homo sapiens
catgaggggagagga

SEQ ID NO: 2323363 - DNA, 21 bp, Homo sapiens
catgagtagataatttcaggg

SEQ ID NO: 2323364 - DNA, 22 bp, Homo sapiens
catgagtagataatttcagggt

SEQ ID NO: 2323365 - DNA, 23 bp, Homo sapiens
catgagtagtgggctatgcagga

SEQ ID NO: 2323366 - DNA, 18 bp, Homo sapiens
catgagttatcatgaatt

SEQ ID NO: 2323367 - DNA, 19 bp, Homo sapiens
catgagttatcatgaattt

SEQ ID NO: 2323368 - DNA, 23 bp, Homo sapiens
catgagttatcatgaattttaaa

SEQ ID NO: 2323369 - DNA, 20 bp, Homo sapiens
catgatcagacatacagctg

SEQ ID NO: 2323370 - DNA, 13 bp, Homo sapiens
catgatgtatatc

SEQ ID NO: 2323371 - DNA, 20 bp, Homo sapiens
catgatttagggaagcaggg

SEQ ID NO: 2323372 - DNA, 15 bp, Homo sapiens
catgcaataaaattt

SEQ ID NO: 2323373 - DNA, 21 bp, Homo sapiens
catgcagacctcatgcccagc

SEQ ID NO: 2323374 - DNA, 11 bp, Homo sapiens
catgcaggagg

SEQ ID NO: 2323375 - DNA, 15 bp, Homo sapiens
catgcaggaggtgga

SEQ ID NO: 2323376 - DNA, 12 bp, Homo sapiens
catgcataaata

SEQ ID NO: 2323377 - DNA, 19 bp, Homo sapiens
catgcataaatatgcagtg

SEQ ID NO: 2323378 - DNA, 22 bp, Homo sapiens
catgcataaatatgcagtgata

SEQ ID NO: 2323379 - DNA, 12 bp, Homo sapiens
catgcatataat

SEQ ID NO: 2323380 - DNA, 16 bp, Homo sapiens
catgcatgtcctgtaa

SEQ ID NO: 2323381 - DNA, 17 bp, Homo sapiens
catgcatttgaggtcaa

SEQ ID NO: 2323382 - DNA, 19 bp, Homo sapiens
catgccagattctgcctct

SEQ ID NO: 2323383 - DNA, 21 bp, Homo sapiens
catgccagattctgcctctct

SEQ ID NO: 2323384 - DNA, 19 bp, Homo sapiens
catgccagtatttttaaag

SEQ ID NO: 2323385 - DNA, 15 bp, Homo sapiens
catgcccagctctct

SEQ ID NO: 2323386 - DNA, 24 bp, Homo sapiens
catgcctgcgcctgctgcctgctg

SEQ ID NO: 2323387 - DNA, 20 bp, Homo sapiens
catgccttaaacctacctcc

SEQ ID NO: 2323388 - DNA, 23 bp, Homo sapiens
catgcggtgccatgaagggaccc

SEQ ID NO: 2323389 - DNA, 18 bp, Homo sapiens
catgcggtgggtgctgcc

SEQ ID NO: 2323390 - DNA, 14 bp, Homo sapiens
catgctccaaatat

SEQ ID NO: 2323391 - DNA, 12 bp, Homo sapiens
catgctgaatgc

SEQ ID NO: 2323392 - DNA, 18 bp, Homo sapiens
catgctgaatgccccctg

SEQ ID NO: 2323393 - DNA, 14 bp, Homo sapiens
catgcttcctttct

SEQ ID NO: 2323394 - DNA, 16 bp, Homo sapiens
catgcttcctttctct

SEQ ID NO: 2323395 - DNA, 17 bp, Homo sapiens
catgcttcctttctctc

SEQ ID NO: 2323396 - DNA, 15 bp, Homo sapiens
catggacatttagaa

SEQ ID NO: 2323397 - DNA, 18 bp, Homo sapiens
catggacatttagaagaa

SEQ ID NO: 2323398 - DNA, 20 bp, Homo sapiens
catggacatttagaagaaag

SEQ ID NO: 2323399 - DNA, 23 bp, Homo sapiens
catggacctccaggctccagcac

SEQ ID NO: 2323400 - DNA, 18 bp, Homo sapiens
catggagattgacctgga

SEQ ID NO: 2323401 - DNA, 18 bp, Homo sapiens
catggatatagttttact

SEQ ID NO: 2323402 - DNA, 13 bp, Homo sapiens
catggatggctca

SEQ ID NO: 2323403 - DNA, 15 bp, Homo sapiens
catggcatccaagac

SEQ ID NO: 2323404 - DNA, 17 bp, Homo sapiens
catggcatccctttttc

SEQ ID NO: 2323405 - DNA, 19 bp, Homo sapiens
catggcctatgcacatatg

SEQ ID NO: 2323406 - DNA, 17 bp, Homo sapiens
catggcgccctgcctcc

SEQ ID NO: 2323407 - DNA, 20 bp, Homo sapiens
catggcgccctgcctcctgg

SEQ ID NO: 2323408 - DNA, 13 bp, Homo sapiens
catggctacctca

SEQ ID NO: 2323409 - DNA, 18 bp, Homo sapiens
catggctgctgttgctta

SEQ ID NO: 2323410 - DNA, 14 bp, Homo sapiens
catgggagggggct

SEQ ID NO: 2323411 - DNA, 15 bp, Homo sapiens
catgggcttcactgt

SEQ ID NO: 2323412 - DNA, 21 bp, Homo sapiens
catgggtcctagcccttccct

SEQ ID NO: 2323413 - DNA, 22 bp, Homo sapiens
catgggtcctagcccttccctg

SEQ ID NO: 2323414 - DNA, 19 bp, Homo sapiens
catggtgaaaccccgtctc

SEQ ID NO: 2323415 - DNA, 14 bp, Homo sapiens
catggtgaagtgct

SEQ ID NO: 2323416 - DNA, 17 bp, Homo sapiens
catggtgcctgagaggc

SEQ ID NO: 2323417 - DNA, 22 bp, Homo sapiens
catggtgcctgagaggcaggca

SEQ ID NO: 2323418 - DNA, 13 bp, Homo sapiens
catggtgtaataa

SEQ ID NO: 2323419 - DNA, 21 bp, Homo sapiens
catggtgtaataagacataac

SEQ ID NO: 2323420 - DNA, 17 bp, Homo sapiens
catggtgtgtttgtaat

SEQ ID NO: 2323421 - DNA, 14 bp, Homo sapiens
catggttgtcatca

SEQ ID NO: 2323422 - DNA, 19 bp, Homo sapiens
catgtaattttattttaaa

SEQ ID NO: 2323423 - DNA, 12 bp, Homo sapiens
catgtccaaaga

SEQ ID NO: 2323424 - DNA, 14 bp, Homo sapiens
catgtccaaagagg

SEQ ID NO: 2323425 - DNA, 17 bp, Homo sapiens
catgtccaaagaggctg

SEQ ID NO: 2323426 - DNA, 18 bp, Homo sapiens
catgtccaaagaggctgc

SEQ ID NO: 2323427 - DNA, 21 bp, Homo sapiens
catgtccaaagaggctgcccc

SEQ ID NO: 2323428 - DNA, 17 bp, Homo sapiens
catgtctattcagcttc

SEQ ID NO: 2323429 - DNA, 17 bp, Homo sapiens
catgtctgcagtgtgcc

SEQ ID NO: 2323430 - DNA, 14 bp, Homo sapiens
catgtcttgtacat

SEQ ID NO: 2323431 - DNA, 17 bp, Homo sapiens
catgtcttgtacatgtg

SEQ ID NO: 2323432 - DNA, 23 bp, Homo sapiens
catgtcttgtacatgtgtagcct

SEQ ID NO: 2323433 - DNA, 13 bp, Homo sapiens
catgtgaaacctt

SEQ ID NO: 2323434 - DNA, 18 bp, Homo sapiens
catgtgaaacctttttta

SEQ ID NO: 2323435 - DNA, 24 bp, Homo sapiens
catgtgaaaccttttttaagattt

SEQ ID NO: 2323436 - DNA, 16 bp, Homo sapiens
catgtgacacatatgc

SEQ ID NO: 2323437 - DNA, 21 bp, Homo sapiens
catgtgagtgacgatgatgta

SEQ ID NO: 2323438 - DNA, 19 bp, Homo sapiens
catgtgatggacactccag

SEQ ID NO: 2323439 - DNA, 16 bp, Homo sapiens
catgtgtagcctgtgc

SEQ ID NO: 2323440 - DNA, 15 bp, Homo sapiens
catgttgagccagtg

SEQ ID NO: 2323441 - DNA, 18 bp, Homo sapiens
cattaaagtcagaagttt

SEQ ID NO: 2323442 - DNA, 13 bp, Homo sapiens
cattaacaaataa

SEQ ID NO: 2323443 - DNA, 15 bp, Homo sapiens
ccatgccagctggcc

SEQ ID NO: 2323444 - DNA, 16 bp, Homo sapiens
ccatgccttaaaccta

SEQ ID NO: 2323445 - DNA, 14 bp, Homo sapiens
ccatgctgtccggc

SEQ ID NO: 2323446 - DNA, 16 bp, Homo sapiens
ccatggatctgatctg

SEQ ID NO: 2323447 - DNA, 16 bp, Homo sapiens
ccatggccctgtccca

SEQ ID NO: 2323448 - DNA, 16 bp, Homo sapiens
ccatgggcttcactgt

SEQ ID NO: 2323449 - DNA, 20 bp, Homo sapiens
ccatgggcttcactgtataa

SEQ ID NO: 2323450 - DNA, 20 bp, Homo sapiens
ccatgtccaaagaggctgcc

SEQ ID NO: 2323451 - DNA, 13 bp, Homo sapiens
ccatgtcccctcc

SEQ ID NO: 2323452 - DNA, 20 bp, Homo sapiens
ccatgtctgcagtgtgcccc

SEQ ID NO: 2323453 - DNA, 13 bp, Homo sapiens
ccatgtcttctcc

SEQ ID NO: 2323454 - DNA, 19 bp, Homo sapiens
ccatgtgcatagtttcttt

SEQ ID NO: 2323455 - DNA, 21 bp, Homo sapiens
ccatgtgcatagtttctttat

SEQ ID NO: 2323456 - DNA, 16 bp, Homo sapiens
ccatgttatgctggtg

SEQ ID NO: 2323457 - DNA, 13 bp, Homo sapiens
ccatgttgcccct

SEQ ID NO: 2323458 - DNA, 16 bp, Homo sapiens
ccattacctccatcca

SEQ ID NO: 2323459 - DNA, 20 bp, Homo sapiens
ccattcacttcataatccag

SEQ ID NO: 2323460 - DNA, 11 bp, Homo sapiens
ccattccaaaa

SEQ ID NO: 2323461 - DNA, 20 bp, Homo sapiens
ccattccagtacagtattct

SEQ ID NO: 2323462 - DNA, 19 bp, Homo sapiens
ccattccttgcgcctcagc

SEQ ID NO: 2323463 - DNA, 22 bp, Homo sapiens
ccattctcccaggtaccagctg

SEQ ID NO: 2323464 - DNA, 22 bp, Homo sapiens
ccattgctcttagtcccaagct

SEQ ID NO: 2323465 - DNA, 22 bp, Homo sapiens
ccattgggcacagtccagaccc

SEQ ID NO: 2323466 - DNA, 12 bp, Homo sapiens
ccattgtcctcc

SEQ ID NO: 2323467 - DNA, 15 bp, Homo sapiens
ccattgtcctccttt

SEQ ID NO: 2323468 - DNA, 17 bp, Homo sapiens
ccattgttgtcaaggaa

SEQ ID NO: 2323469 - DNA, 22 bp, Homo sapiens
ccatttccatgtcccctcccag

SEQ ID NO: 2323470 - DNA, 18 bp, Homo sapiens
ccatttgcaataacagct

SEQ ID NO: 2323471 - DNA, 22 bp, Homo sapiens
ccatttgcaataacagctgcaa

SEQ ID NO: 2323472 - DNA, 21 bp, Homo sapiens
ccattttaattttaaagtgca

SEQ ID NO: 2323473 - DNA, 20 bp, Homo sapiens
ccattttcaagcaaaacagt

SEQ ID NO: 2323474 - DNA, 12 bp, Homo sapiens
ccattttgtgaa

SEQ ID NO: 2323475 - DNA, 14 bp, Homo sapiens
ccattttgtgaatg

SEQ ID NO: 2323476 - DNA, 22 bp, Homo sapiens
ccattttttgtctgtgataaca

SEQ ID NO: 2323477 - DNA, 20 bp, Homo sapiens
cccaaagtgctgagattgca

SEQ ID NO: 2323478 - DNA, 16 bp, Homo sapiens
cccaaatcaatacact

SEQ ID NO: 2323479 - DNA, 18 bp, Homo sapiens
cccaaatggccattttaa

SEQ ID NO: 2323480 - DNA, 15 bp, Homo sapiens
cccaacctcagggct

SEQ ID NO: 2323481 - DNA, 19 bp, Homo sapiens
cccaacctcagggctccca

SEQ ID NO: 2323482 - DNA, 14 bp, Homo sapiens
cccaacctgctctc

SEQ ID NO: 2323483 - DNA, 21 bp, Homo sapiens
cccaacctgctctcctcttct

SEQ ID NO: 2323484 - DNA, 23 bp, Homo sapiens
cccaactcttgcacagtcactgc

SEQ ID NO: 2323485 - DNA, 14 bp, Homo sapiens
cccaagagaactcg

SEQ ID NO: 2323486 - DNA, 15 bp, Homo sapiens
cccaaggctgccaga

SEQ ID NO: 2323487 - DNA, 15 bp, Homo sapiens
cccaaggttggagcc

SEQ ID NO: 2323488 - DNA, 14 bp, Homo sapiens
cccaagtgcctcac

SEQ ID NO: 2323489 - DNA, 15 bp, Homo sapiens
cccaatcggactgcc

SEQ ID NO: 2323490 - DNA, 16 bp, Homo sapiens
cccaatcggactgcca

SEQ ID NO: 2323491 - DNA, 19 bp, Homo sapiens
cccaatcggactgccaaat

SEQ ID NO: 2323492 - DNA, 12 bp, Homo sapiens
cccaatgaatta

SEQ ID NO: 2323493 - DNA, 20 bp, Homo sapiens
cccaatgtatgtgtggctgt

SEQ ID NO: 2323494 - DNA, 18 bp, Homo sapiens
cccacatccaactccagc

SEQ ID NO: 2323495 - DNA, 14 bp, Homo sapiens
cccacccacatgtg

SEQ ID NO: 2323496 - DNA, 23 bp, Homo sapiens
cccacccagggctccctcctgga

SEQ ID NO: 2323497 - DNA, 14 bp, Homo sapiens
cccaccccctgccc

SEQ ID NO: 2323498 - DNA, 13 bp, Homo sapiens
cccaccccgggga

SEQ ID NO: 2323499 - DNA, 18 bp, Homo sapiens
cccaccccggggaccctg

SEQ ID NO: 2323500 - DNA, 13 bp, Homo sapiens
cccaccctcttcc

SEQ ID NO: 2323501 - DNA, 21 bp, Homo sapiens
cccaccctgcgggccagggtc

SEQ ID NO: 2323502 - DNA, 14 bp, Homo sapiens
cccaccctgttcct

SEQ ID NO: 2323503 - DNA, 18 bp, Homo sapiens
cccaccctgttcctgctg

SEQ ID NO: 2323504 - DNA, 15 bp, Homo sapiens
cccacctcctgacac

SEQ ID NO: 2323505 - DNA, 14 bp, Homo sapiens
cccacctgccggcc

SEQ ID NO: 2323506 - DNA, 15 bp, Homo sapiens
cccaccttgccaggg

SEQ ID NO: 2323507 - DNA, 15 bp, Homo sapiens
cccacggagacagag

SEQ ID NO: 2323508 - DNA, 23 bp, Homo sapiens
cccactcctctgctgacctgctg

SEQ ID NO: 2323509 - DNA, 18 bp, Homo sapiens
cccactgcatgcagaaac

SEQ ID NO: 2323510 - DNA, 15 bp, Homo sapiens
cccactggcagcatc

SEQ ID NO: 2323511 - DNA, 19 bp, Homo sapiens
cccagaaagcctctctctc

SEQ ID NO: 2323512 - DNA, 22 bp, Homo sapiens
cccagacagggtgggcttcctg

SEQ ID NO: 2323513 - DNA, 17 bp, Homo sapiens
cccagaccactgtctcc

SEQ ID NO: 2323514 - DNA, 24 bp, Homo sapiens
cccagactaaaggatccagagagc

SEQ ID NO: 2323515 - DNA, 19 bp, Homo sapiens
cccagactctttttttgag

SEQ ID NO: 2323516 - DNA, 11 bp, Homo sapiens
cccagagactt

SEQ ID NO: 2323517 - DNA, 21 bp, Homo sapiens
cccagagactttgtagatcct

SEQ ID NO: 2323518 - DNA, 17 bp, Homo sapiens
cccagagaggcactcag

SEQ ID NO: 2323519 - DNA, 19 bp, Homo sapiens
cccagagctggtggaccca

SEQ ID NO: 2323520 - DNA, 23 bp, Homo sapiens
cccagagctggtggacccaggga

SEQ ID NO: 2323521 - DNA, 18 bp, Homo sapiens
cccagaggtaacagaaca

SEQ ID NO: 2323522 - DNA, 15 bp, Homo sapiens
cccagagtggcccac

SEQ ID NO: 2323523 - DNA, 13 bp, Homo sapiens
cccagatgtgtcc

SEQ ID NO: 2323524 - DNA, 16 bp, Homo sapiens
cccagattcccctgtg

SEQ ID NO: 2323525 - DNA, 19 bp, Homo sapiens
cccagattcccctgtgtca

SEQ ID NO: 2323526 - DNA, 15 bp, Homo sapiens
cccagcagaggcagg

SEQ ID NO: 2323527 - DNA, 21 bp, Homo sapiens
cccagcagtgtggagaccctg

SEQ ID NO: 2323528 - DNA, 15 bp, Homo sapiens
cccagcattctcagg

SEQ ID NO: 2323529 - DNA, 13 bp, Homo sapiens
cccagccatccag

SEQ ID NO: 2323530 - DNA, 15 bp, Homo sapiens
cccagccatgccagc

SEQ ID NO: 2323531 - DNA, 22 bp, Homo sapiens
cccagccatgccagctggcctt

SEQ ID NO: 2323532 - DNA, 22 bp, Homo sapiens
cccagccccactcctctgctga

SEQ ID NO: 2323533 - DNA, 15 bp, Homo sapiens
cccagccccggggtg

SEQ ID NO: 2323534 - DNA, 14 bp, Homo sapiens
cccagccctgctgg

SEQ ID NO: 2323535 - DNA, 11 bp, Homo sapiens
cccagcctggg

SEQ ID NO: 2323536 - DNA, 18 bp, Homo sapiens
cccagcctgggccatctc

SEQ ID NO: 2323537 - DNA, 21 bp, Homo sapiens
cccagcctgtcctggtacagc

SEQ ID NO: 2323538 - DNA, 14 bp, Homo sapiens
cccagctctctgac

SEQ ID NO: 2323539 - DNA, 16 bp, Homo sapiens
cccagctctctgacgc

SEQ ID NO: 2323540 - DNA, 15 bp, Homo sapiens
cccaggactctgacc

SEQ ID NO: 2323541 - DNA, 23 bp, Homo sapiens
cccaggactctgaccccagcatt

SEQ ID NO: 2323542 - DNA, 21 bp, Homo sapiens
cccaggcaagcagctggtcag

SEQ ID NO: 2323543 - DNA, 17 bp, Homo sapiens
cccaggccccagacagg

SEQ ID NO: 2323544 - DNA, 14 bp, Homo sapiens
cccaggccggccca

SEQ ID NO: 2323545 - DNA, 17 bp, Homo sapiens
cccaggccggcccagat

SEQ ID NO: 2323546 - DNA, 16 bp, Homo sapiens
cccaggctggagaccc

SEQ ID NO: 2323547 - DNA, 14 bp, Homo sapiens
cccaggcttttgct

SEQ ID NO: 2323548 - DNA, 13 bp, Homo sapiens
cccagggagtcca

SEQ ID NO: 2323549 - DNA, 23 bp, Homo sapiens
cccagggcaagggttaaggcctg

SEQ ID NO: 2323550 - DNA, 17 bp, Homo sapiens
cccagggcatcttgctg

SEQ ID NO: 2323551 - DNA, 21 bp, Homo sapiens
cccagggcatcttgctggcta

SEQ ID NO: 2323552 - DNA, 17 bp, Homo sapiens
cccagggcctcctgggg

SEQ ID NO: 2323553 - DNA, 19 bp, Homo sapiens
cccaggggtctccctggct

SEQ ID NO: 2323554 - DNA, 21 bp, Homo sapiens
cccagtacctagctggctctg

SEQ ID NO: 2323555 - DNA, 15 bp, Homo sapiens
cccagtccccacccc

SEQ ID NO: 2323556 - DNA, 19 bp, Homo sapiens
cccagtccccacccctgcc

SEQ ID NO: 2323557 - DNA, 20 bp, Homo sapiens
cccagtccccacccctgccc

SEQ ID NO: 2323558 - DNA, 14 bp, Homo sapiens
cctccacagcgagg

SEQ ID NO: 2323559 - DNA, 11 bp, Homo sapiens
cctccacccat

SEQ ID NO: 2323560 - DNA, 17 bp, Homo sapiens
cctccagagacaacagg

SEQ ID NO: 2323561 - DNA, 20 bp, Homo sapiens
cctccagccccgcgaccatg

SEQ ID NO: 2323562 - DNA, 16 bp, Homo sapiens
cctccagcctgaacag

SEQ ID NO: 2323563 - DNA, 18 bp, Homo sapiens
cctccaggagcttcttgt

SEQ ID NO: 2323564 - DNA, 18 bp, Homo sapiens
cctccaggctccagcaca

SEQ ID NO: 2323565 - DNA, 19 bp, Homo sapiens
cctccagggaaggtggcca

SEQ ID NO: 2323566 - DNA, 17 bp, Homo sapiens
cctccatccatccttcc

SEQ ID NO: 2323567 - DNA, 16 bp, Homo sapiens
cctccattcatccttc

SEQ ID NO: 2323568 - DNA, 17 bp, Homo sapiens
cctccattcatccttcc

SEQ ID NO: 2323569 - DNA, 23 bp, Homo sapiens
cctccattcatccttccatccat

SEQ ID NO: 2323570 - DNA, 22 bp, Homo sapiens
cctccattgggcacagtccaga

SEQ ID NO: 2323571 - DNA, 20 bp, Homo sapiens
cctcccaaagtgctgagatt

SEQ ID NO: 2323572 - DNA, 23 bp, Homo sapiens
cctcccagagctggtggacccag

SEQ ID NO: 2323573 - DNA, 12 bp, Homo sapiens
cctcccaggcaa

SEQ ID NO: 2323574 - DNA, 12 bp, Homo sapiens
cctcccagggcc

SEQ ID NO: 2323575 - DNA, 20 bp, Homo sapiens
cctccccaaatcaatacact

SEQ ID NO: 2323576 - DNA, 14 bp, Homo sapiens
cctccccaggctgg

SEQ ID NO: 2323577 - DNA, 16 bp, Homo sapiens
cctccccatctgtcca

SEQ ID NO: 2323578 - DNA, 15 bp, Homo sapiens
cctccccatttccca

SEQ ID NO: 2323579 - DNA, 21 bp, Homo sapiens
cctcccccagccatgccagct

SEQ ID NO: 2323580 - DNA, 13 bp, Homo sapiens
cctccctgcctga

SEQ ID NO: 2323581 - DNA, 17 bp, Homo sapiens
cctcccttccttttccc

SEQ ID NO: 2323582 - DNA, 14 bp, Homo sapiens
cctccgagagggag

SEQ ID NO: 2323583 - DNA, 19 bp, Homo sapiens
cctcctatccttggagagc

SEQ ID NO: 2323584 - DNA, 19 bp, Homo sapiens
cctcctattctataaaact

SEQ ID NO: 2323585 - DNA, 15 bp, Homo sapiens
cctcctcacctcatg

SEQ ID NO: 2323586 - DNA, 16 bp, Homo sapiens
cctcctcacctcatgc

SEQ ID NO: 2323587 - DNA, 19 bp, Homo sapiens
cctcctcacctcatgccca

SEQ ID NO: 2323588 - DNA, 22 bp, Homo sapiens
cctcctcacctcatgcccaccc

SEQ ID NO: 2323589 - DNA, 21 bp, Homo sapiens
cctcctcagtatgtgggggct

SEQ ID NO: 2323590 - DNA, 15 bp, Homo sapiens
cctcctccactccac

SEQ ID NO: 2323591 - DNA, 19 bp, Homo sapiens
cctcctctcccatccttga

SEQ ID NO: 2323592 - DNA, 19 bp, Homo sapiens
cctcctctgcctacagcca

SEQ ID NO: 2323593 - DNA, 20 bp, Homo sapiens
cctcctgaaccgcacagctc

SEQ ID NO: 2323594 - DNA, 12 bp, Homo sapiens
cctcctgcctca

SEQ ID NO: 2323595 - DNA, 15 bp, Homo sapiens
cctcctgcctcagcc

SEQ ID NO: 2323596 - DNA, 13 bp, Homo sapiens
cctcctgtgcctg

SEQ ID NO: 2323597 - DNA, 19 bp, Homo sapiens
cctcctgtgcctggcccca

SEQ ID NO: 2323598 - DNA, 20 bp, Homo sapiens
cctcctgtgcctggccccag

SEQ ID NO: 2323599 - DNA, 20 bp, Homo sapiens
cctccttctgagctcctgtc

SEQ ID NO: 2323600 - DNA, 20 bp, Homo sapiens
cctccttttcactttattgc

SEQ ID NO: 2323601 - DNA, 21 bp, Homo sapiens
cctcgcaactgtccacgcgtg

SEQ ID NO: 2323602 - DNA, 19 bp, Homo sapiens
cctcgccggatctgaggga

SEQ ID NO: 2323603 - DNA, 15 bp, Homo sapiens
cctcgctcaccgctg

SEQ ID NO: 2323604 - DNA, 15 bp, Homo sapiens
cctcgtcccatccag

SEQ ID NO: 2323605 - DNA, 16 bp, Homo sapiens
cctctagaagccaagg

SEQ ID NO: 2323606 - DNA, 18 bp, Homo sapiens
cctctagaagccaaggga

SEQ ID NO: 2323607 - DNA, 15 bp, Homo sapiens
cctctaggtccccat

SEQ ID NO: 2323608 - DNA, 16 bp, Homo sapiens
cctctcagtgccctcc

SEQ ID NO: 2323609 - DNA, 17 bp, Homo sapiens
cctctccaaccactgtg

SEQ ID NO: 2323610 - DNA, 21 bp, Homo sapiens
cctctccaaccactgtgccac

SEQ ID NO: 2323611 - DNA, 16 bp, Homo sapiens
cctctccatctcccaa

SEQ ID NO: 2323612 - DNA, 18 bp, Homo sapiens
cctctccatctcccaagg

SEQ ID NO: 2323613 - DNA, 19 bp, Homo sapiens
cctctccatctcccaaggc

SEQ ID NO: 2323614 - DNA, 14 bp, Homo sapiens
cctctcccaccctc

SEQ ID NO: 2323615 - DNA, 20 bp, Homo sapiens
cctctcccttgggctctgat

SEQ ID NO: 2323616 - DNA, 18 bp, Homo sapiens
cctctcgccatgatcaga

SEQ ID NO: 2323617 - DNA, 20 bp, Homo sapiens
cctctctacagtctcgtctc

SEQ ID NO: 2323618 - DNA, 16 bp, Homo sapiens
cctctctctccctccc

SEQ ID NO: 2323619 - DNA, 19 bp, Homo sapiens
cctctctctccctccctct

SEQ ID NO: 2323620 - DNA, 13 bp, Homo sapiens
cctctctctcttc

SEQ ID NO: 2323621 - DNA, 23 bp, Homo sapiens
cctctctctttcctccacccata

SEQ ID NO: 2323622 - DNA, 20 bp, Homo sapiens
cctctctgatgtcccagtgc

SEQ ID NO: 2323623 - DNA, 18 bp, Homo sapiens
cctctgaaaagtgtgtat

SEQ ID NO: 2323624 - DNA, 19 bp, Homo sapiens
cctctgcacctttgcacgt

SEQ ID NO: 2323625 - DNA, 14 bp, Homo sapiens
cctctgcagaatcc

SEQ ID NO: 2323626 - DNA, 14 bp, Homo sapiens
cctctgcccgcaga

SEQ ID NO: 2323627 - DNA, 18 bp, Homo sapiens
cctctgcctacagccagg

SEQ ID NO: 2323628 - DNA, 13 bp, Homo sapiens
cctctgcctgccc

SEQ ID NO: 2323629 - DNA, 16 bp, Homo sapiens
cctctgcctgccccgc

SEQ ID NO: 2323630 - DNA, 15 bp, Homo sapiens
cctctgctcaccgcc

SEQ ID NO: 2323631 - DNA, 23 bp, Homo sapiens
cctctgctcaccgcccatcaggg

SEQ ID NO: 2323632 - DNA, 17 bp, Homo sapiens
cctctgctgacctgctg

SEQ ID NO: 2323633 - DNA, 15 bp, Homo sapiens
cctctgcttctcatc

SEQ ID NO: 2323634 - DNA, 18 bp, Homo sapiens
cctctgcttctcatccca

SEQ ID NO: 2323635 - DNA, 15 bp, Homo sapiens
cctctggacagccag

SEQ ID NO: 2323636 - DNA, 15 bp, Homo sapiens
cctctggacggcagg

SEQ ID NO: 2323637 - DNA, 16 bp, Homo sapiens
cctctggctttcccag

SEQ ID NO: 2323638 - DNA, 15 bp, Homo sapiens
cctctgtctaggact

SEQ ID NO: 2323639 - DNA, 22 bp, Homo sapiens
cctctgtctaggactgcagtgt

SEQ ID NO: 2323640 - DNA, 12 bp, Homo sapiens
cctcttccagtc

SEQ ID NO: 2323641 - DNA, 14 bp, Homo sapiens
cctcttccagtctt

SEQ ID NO: 2323642 - DNA, 18 bp, Homo sapiens
cctcttccagtgaacatt

SEQ ID NO: 2323643 - DNA, 13 bp, Homo sapiens
cctcttcccttct

SEQ ID NO: 2323644 - DNA, 15 bp, Homo sapiens
cctcttcctactggt

SEQ ID NO: 2323645 - DNA, 19 bp, Homo sapiens
cctcttcctactggtctct

SEQ ID NO: 2323646 - DNA, 15 bp, Homo sapiens
cctcttctactcact

SEQ ID NO: 2323647 - DNA, 21 bp, Homo sapiens
cctcttctactcacttttccc

SEQ ID NO: 2323648 - DNA, 13 bp, Homo sapiens
cctcttgcccatc

SEQ ID NO: 2323649 - DNA, 16 bp, Homo sapiens
cctcttgtaaagactg

SEQ ID NO: 2323650 - DNA, 14 bp, Homo sapiens
cctcttgtctgatt

SEQ ID NO: 2323651 - DNA, 22 bp, Homo sapiens
cctcttgtgcaaggtggccttt

SEQ ID NO: 2323652 - DNA, 22 bp, Homo sapiens
cctctttctgctctgccatctt

SEQ ID NO: 2323653 - DNA, 11 bp, Homo sapiens
cctctttgctc

SEQ ID NO: 2323654 - DNA, 14 bp, Homo sapiens
cctctttgctgcag

SEQ ID NO: 2323655 - DNA, 12 bp, Homo sapiens
cctcttttgtgc

SEQ ID NO: 2323656 - DNA, 13 bp, Homo sapiens
cctctttttcctc

SEQ ID NO: 2323657 - DNA, 18 bp, Homo sapiens
cctctttttcctcctgga

SEQ ID NO: 2323658 - DNA, 12 bp, Homo sapiens
cctgaaagccct

SEQ ID NO: 2323659 - DNA, 20 bp, Homo sapiens
cctgaaatattttctacttt

SEQ ID NO: 2323660 - DNA, 14 bp, Homo sapiens
cctgaaccatgtgg

SEQ ID NO: 2323661 - DNA, 15 bp, Homo sapiens
cctgaaccgcacagc

SEQ ID NO: 2323662 - DNA, 16 bp, Homo sapiens
cctgaaccgcacagct

SEQ ID NO: 2323663 - DNA, 18 bp, Homo sapiens
cctgaaccgcacagctca

SEQ ID NO: 2323664 - DNA, 18 bp, Homo sapiens
cctgaacgttttcttctt

SEQ ID NO: 2323665 - DNA, 22 bp, Homo sapiens
cctgaacgttttcttctttccc

SEQ ID NO: 2323666 - DNA, 18 bp, Homo sapiens
cctgaagccagctgccct

SEQ ID NO: 2323667 - DNA, 19 bp, Homo sapiens
cctgaatcatgagcctgct

SEQ ID NO: 2323668 - DNA, 20 bp, Homo sapiens
cctgaatccaaactaatcca

SEQ ID NO: 2323669 - DNA, 21 bp, Homo sapiens
cctgaccaagactgagccagc

SEQ ID NO: 2323670 - DNA, 18 bp, Homo sapiens
cctgaccccattcctgat

SEQ ID NO: 2323671 - DNA, 13 bp, Homo sapiens
cctgactgctcag

SEQ ID NO: 2323672 - DNA, 15 bp, Homo sapiens
cctgacttggctggg

SEQ ID NO: 2323673 - DNA, 14 bp, Homo sapiens
ctaatgacaagtga

SEQ ID NO: 2323674 - DNA, 17 bp, Homo sapiens
ctaatgtttatgagcca

SEQ ID NO: 2323675 - DNA, 14 bp, Homo sapiens
ctaattatttaatt

SEQ ID NO: 2323676 - DNA, 20 bp, Homo sapiens
ctaattgtaagtgaaattaa

SEQ ID NO: 2323677 - DNA, 18 bp, Homo sapiens
ctaattgtactaatctga

SEQ ID NO: 2323678 - DNA, 13 bp, Homo sapiens
ctaatttaacacc

SEQ ID NO: 2323679 - DNA, 18 bp, Homo sapiens
ctaatttctcctcccttc

SEQ ID NO: 2323680 - DNA, 19 bp, Homo sapiens
ctaatttctcctcccttcc

SEQ ID NO: 2323681 - DNA, 17 bp, Homo sapiens
ctaattttattatagta

SEQ ID NO: 2323682 - DNA, 13 bp, Homo sapiens
ctacaatctcttt

SEQ ID NO: 2323683 - DNA, 17 bp, Homo sapiens
ctacacccctgtgctcc

SEQ ID NO: 2323684 - DNA, 12 bp, Homo sapiens
ctacacctggct

SEQ ID NO: 2323685 - DNA, 13 bp, Homo sapiens
ctacacctggctg

SEQ ID NO: 2323686 - DNA, 23 bp, Homo sapiens
ctacactcttgtaataaaatgtc

SEQ ID NO: 2323687 - DNA, 21 bp, Homo sapiens
ctacagcctagggcagacaat

SEQ ID NO: 2323688 - DNA, 18 bp, Homo sapiens
ctacaggcctatttaaca

SEQ ID NO: 2323689 - DNA, 14 bp, Homo sapiens
ctacatgctgaaaa

SEQ ID NO: 2323690 - DNA, 15 bp, Homo sapiens
ctacatgctggggtc

SEQ ID NO: 2323691 - DNA, 15 bp, Homo sapiens
ctaccaggtgttcta

SEQ ID NO: 2323692 - DNA, 23 bp, Homo sapiens
ctaccttaattattgcactagag

SEQ ID NO: 2323693 - DNA, 13 bp, Homo sapiens
ctaccttcctgtc

SEQ ID NO: 2323694 - DNA, 12 bp, Homo sapiens
ctacgtttcttt

SEQ ID NO: 2323695 - DNA, 14 bp, Homo sapiens
ctacgtttctttaa

SEQ ID NO: 2323696 - DNA, 14 bp, Homo sapiens
ctactaaaaataca

SEQ ID NO: 2323697 - DNA, 15 bp, Homo sapiens
ctactaataaaccag

SEQ ID NO: 2323698 - DNA, 16 bp, Homo sapiens
ctactaataaaccagt

SEQ ID NO: 2323699 - DNA, 22 bp, Homo sapiens
ctactcaagcgggtggctctgg

SEQ ID NO: 2323700 - DNA, 15 bp, Homo sapiens
ctactcacttttccc

SEQ ID NO: 2323701 - DNA, 13 bp, Homo sapiens
ctactccctgcag

SEQ ID NO: 2323702 - DNA, 13 bp, Homo sapiens
ctactctggaatg

SEQ ID NO: 2323703 - DNA, 23 bp, Homo sapiens
ctactctggaatgtttttccctc

SEQ ID NO: 2323704 - DNA, 15 bp, Homo sapiens
ctactgaagtggctg

SEQ ID NO: 2323705 - DNA, 19 bp, Homo sapiens
ctactgacatatctacact

SEQ ID NO: 2323706 - DNA, 20 bp, Homo sapiens
ctactgctgtgaaccctggg

SEQ ID NO: 2323707 - DNA, 15 bp, Homo sapiens
ctactggggaaactg

SEQ ID NO: 2323708 - DNA, 19 bp, Homo sapiens
ctactggggaaactggcca

SEQ ID NO: 2323709 - DNA, 20 bp, Homo sapiens
ctactggggaaactggccat

SEQ ID NO: 2323710 - DNA, 13 bp, Homo sapiens
ctactggtctctc

SEQ ID NO: 2323711 - DNA, 15 bp, Homo sapiens
ctactggtctctcta

SEQ ID NO: 2323712 - DNA, 14 bp, Homo sapiens
ctactgtagaaaca

SEQ ID NO: 2323713 - DNA, 14 bp, Homo sapiens
ctacttatattctg

SEQ ID NO: 2323714 - DNA, 15 bp, Homo sapiens
ctacttatattctgc

SEQ ID NO: 2323715 - DNA, 12 bp, Homo sapiens
ctactttaaatt

SEQ ID NO: 2323716 - DNA, 15 bp, Homo sapiens
ctactttaaattgtg

SEQ ID NO: 2323717 - DNA, 20 bp, Homo sapiens
ctactttaaattgtggatga

SEQ ID NO: 2323718 - DNA, 18 bp, Homo sapiens
ctactttgactttttgca

SEQ ID NO: 2323719 - DNA, 19 bp, Homo sapiens
ctactttgactttttgcat

SEQ ID NO: 2323720 - DNA, 12 bp, Homo sapiens
ctagaaaaataa

SEQ ID NO: 2323721 - DNA, 18 bp, Homo sapiens
ctagaaaaataaaatgtt

SEQ ID NO: 2323722 - DNA, 20 bp, Homo sapiens
ctagaaaaataaaatgtttc

SEQ ID NO: 2323723 - DNA, 20 bp, Homo sapiens
ctagaacactaactcaccag

SEQ ID NO: 2323724 - DNA, 12 bp, Homo sapiens
ctagaagccaag

SEQ ID NO: 2323725 - DNA, 16 bp, Homo sapiens
ctagaagccaagggaa

SEQ ID NO: 2323726 - DNA, 17 bp, Homo sapiens
ctagaaggcttctctcc

SEQ ID NO: 2323727 - DNA, 15 bp, Homo sapiens
ctagacaacctttct

SEQ ID NO: 2323728 - DNA, 11 bp, Homo sapiens
ctagaccaata

SEQ ID NO: 2323729 - DNA, 22 bp, Homo sapiens
ctagactaccggacactcgtca

SEQ ID NO: 2323730 - DNA, 22 bp, Homo sapiens
ctagactgtttgctgatcccca

SEQ ID NO: 2323731 - DNA, 13 bp, Homo sapiens
ctagagaaaataa

SEQ ID NO: 2323732 - DNA, 16 bp, Homo sapiens
ctagagaaaataaatt

SEQ ID NO: 2323733 - DNA, 22 bp, Homo sapiens
ctagaggcttgcataataagct

SEQ ID NO: 2323734 - DNA, 15 bp, Homo sapiens
ctagaggtcaggacg

SEQ ID NO: 2323735 - DNA, 20 bp, Homo sapiens
ctagaggtcaggacggctcc

SEQ ID NO: 2323736 - DNA, 18 bp, Homo sapiens
ctagatggaatggaaaag

SEQ ID NO: 2323737 - DNA, 19 bp, Homo sapiens
ctagcaatctcttcattat

SEQ ID NO: 2323738 - DNA, 15 bp, Homo sapiens
ctagcaatgcctgag

SEQ ID NO: 2323739 - DNA, 17 bp, Homo sapiens
ctagcaggctgttccat

SEQ ID NO: 2323740 - DNA, 16 bp, Homo sapiens
ctagcccttccctgag

SEQ ID NO: 2323741 - DNA, 19 bp, Homo sapiens
ctagcccttccctgagtgc

SEQ ID NO: 2323742 - DNA, 17 bp, Homo sapiens
ctagcgatctctcctgg

SEQ ID NO: 2323743 - DNA, 18 bp, Homo sapiens
ctagcgatctctcctggc

SEQ ID NO: 2323744 - DNA, 16 bp, Homo sapiens
ctagctaattatttaa

SEQ ID NO: 2323745 - DNA, 15 bp, Homo sapiens
ctagctcctcccctt

SEQ ID NO: 2323746 - DNA, 13 bp, Homo sapiens
ctagctggctctg

SEQ ID NO: 2323747 - DNA, 23 bp, Homo sapiens
ctagcttctgcttttctgccctg

SEQ ID NO: 2323748 - DNA, 15 bp, Homo sapiens
ctagctttagaccct

SEQ ID NO: 2323749 - DNA, 14 bp, Homo sapiens
ctaggaaaataaaa

SEQ ID NO: 2323750 - DNA, 15 bp, Homo sapiens
ctaggaaaataaaac

SEQ ID NO: 2323751 - DNA, 15 bp, Homo sapiens
ctaggacacagttcc

SEQ ID NO: 2323752 - DNA, 19 bp, Homo sapiens
ctaggacacagttcctggg

SEQ ID NO: 2323753 - DNA, 21 bp, Homo sapiens
ctaggcataggtctctttgct

SEQ ID NO: 2323754 - DNA, 14 bp, Homo sapiens
ctaggcattctgga

SEQ ID NO: 2323755 - DNA, 12 bp, Homo sapiens
ctaggtctccag

SEQ ID NO: 2323756 - DNA, 13 bp, Homo sapiens
ctaggtctccagt

SEQ ID NO: 2323757 - DNA, 17 bp, Homo sapiens
ctagtaacaatacatga

SEQ ID NO: 2323758 - DNA, 22 bp, Homo sapiens
ctagtaagaagacaaactgctt

SEQ ID NO: 2323759 - DNA, 14 bp, Homo sapiens
ctagtgacttcctg

SEQ ID NO: 2323760 - DNA, 15 bp, Homo sapiens
ctagtggtctttgta

SEQ ID NO: 2323761 - DNA, 17 bp, Homo sapiens
ctagtggtctttgtaag

SEQ ID NO: 2323762 - DNA, 13 bp, Homo sapiens
ctagtgtgtgttt

SEQ ID NO: 2323763 - DNA, 18 bp, Homo sapiens
ctagttctcaatcactgc

SEQ ID NO: 2323764 - DNA, 18 bp, Homo sapiens
ctagtttgtgagaaacat

SEQ ID NO: 2323765 - DNA, 13 bp, Homo sapiens
ctataaaactctg

SEQ ID NO: 2323766 - DNA, 22 bp, Homo sapiens
ctataaaagcccatgcttaaat

SEQ ID NO: 2323767 - DNA, 21 bp, Homo sapiens
ctataagcaaattgctttttt

SEQ ID NO: 2323768 - DNA, 12 bp, Homo sapiens
ctataggcagct

SEQ ID NO: 2323769 - DNA, 15 bp, Homo sapiens
ctataggcagcttct

SEQ ID NO: 2323770 - DNA, 15 bp, Homo sapiens
ctatagtaaatgtgt

SEQ ID NO: 2323771 - DNA, 20 bp, Homo sapiens
ctatataatttatttccact

SEQ ID NO: 2323772 - DNA, 14 bp, Homo sapiens
ctatatatataaat

SEQ ID NO: 2323773 - DNA, 16 bp, Homo sapiens
ctatatatataaatgt

SEQ ID NO: 2323774 - DNA, 16 bp, Homo sapiens
ctatatggttctccaa

SEQ ID NO: 2323775 - DNA, 19 bp, Homo sapiens
ctatatttttctcaatgtt

SEQ ID NO: 2323776 - DNA, 21 bp, Homo sapiens
ctatccccatctccctgcctg

SEQ ID NO: 2323777 - DNA, 23 bp, Homo sapiens
ctatccccatctccctgcctggc

SEQ ID NO: 2323778 - DNA, 11 bp, Homo sapiens
ctatcctgatt

SEQ ID NO: 2323779 - DNA, 14 bp, Homo sapiens
ctatcctttcaaac

SEQ ID NO: 2323780 - DNA, 16 bp, Homo sapiens
ctatcgccctcctttc

SEQ ID NO: 2323781 - DNA, 19 bp, Homo sapiens
ctatcgccctcctttccct

SEQ ID NO: 2323782 - DNA, 13 bp, Homo sapiens
ctatctcccacaa

SEQ ID NO: 2323783 - DNA, 20 bp, Homo sapiens
ctatctcccacaaataagtt

SEQ ID NO: 2323784 - DNA, 12 bp, Homo sapiens
ctatctcctgac

SEQ ID NO: 2323785 - DNA, 19 bp, Homo sapiens
ctatctcctgacagaaggt

SEQ ID NO: 2323786 - DNA, 17 bp, Homo sapiens
ctatgagttgaaatgtt

SEQ ID NO: 2323787 - DNA, 21 bp, Homo sapiens
ctatgagttgaaatgttctgt

SEQ ID NO: 2323788 - DNA, 22 bp, Homo sapiens
ctatgcacatatggactctgca

SEQ ID NO: 2323789 - DNA, 16 bp, Homo sapiens
ctccggactggtgccc

SEQ ID NO: 2323790 - DNA, 20 bp, Homo sapiens
ctccggggccccactggctg

SEQ ID NO: 2323791 - DNA, 13 bp, Homo sapiens
ctccgtccatatc

SEQ ID NO: 2323792 - DNA, 23 bp, Homo sapiens
ctccgtccatatcagaactgtgc

SEQ ID NO: 2323793 - DNA, 14 bp, Homo sapiens
ctcctagctgtcct

SEQ ID NO: 2323794 - DNA, 21 bp, Homo sapiens
ctcctagctgtcctttttcct

SEQ ID NO: 2323795 - DNA, 15 bp, Homo sapiens
ctcctaggcattctg

SEQ ID NO: 2323796 - DNA, 23 bp, Homo sapiens
ctcctatgatctgagtcagagcc

SEQ ID NO: 2323797 - DNA, 14 bp, Homo sapiens
ctcctcaactcacc

SEQ ID NO: 2323798 - DNA, 15 bp, Homo sapiens
ctcctcacctcatgc

SEQ ID NO: 2323799 - DNA, 20 bp, Homo sapiens
ctcctcacctcatgcccacc

SEQ ID NO: 2323800 - DNA, 17 bp, Homo sapiens
ctcctcagagcgccagg

SEQ ID NO: 2323801 - DNA, 20 bp, Homo sapiens
ctcctcatggcagcctactc

SEQ ID NO: 2323802 - DNA, 14 bp, Homo sapiens
ctcctccaggcctg

SEQ ID NO: 2323803 - DNA, 15 bp, Homo sapiens
ctcctccaggcctgc

SEQ ID NO: 2323804 - DNA, 23 bp, Homo sapiens
ctcctccaggcctgcctcccact

SEQ ID NO: 2323805 - DNA, 13 bp, Homo sapiens
ctcctcccagggc

SEQ ID NO: 2323806 - DNA, 14 bp, Homo sapiens
ctcctccccaaatc

SEQ ID NO: 2323807 - DNA, 17 bp, Homo sapiens
ctcctccccaaatcaat

SEQ ID NO: 2323808 - DNA, 15 bp, Homo sapiens
ctcctccccttcctc

SEQ ID NO: 2323809 - DNA, 14 bp, Homo sapiens
ctcctcccttcctt

SEQ ID NO: 2323810 - DNA, 20 bp, Homo sapiens
ctcctcgtgaaagtgcattt

SEQ ID NO: 2323811 - DNA, 18 bp, Homo sapiens
ctcctctcccatccttga

SEQ ID NO: 2323812 - DNA, 12 bp, Homo sapiens
ctcctctccccc

SEQ ID NO: 2323813 - DNA, 15 bp, Homo sapiens
ctcctctctctttcc

SEQ ID NO: 2323814 - DNA, 23 bp, Homo sapiens
ctcctctctctttcctccaccca

SEQ ID NO: 2323815 - DNA, 20 bp, Homo sapiens
ctcctctgctgacctgctga

SEQ ID NO: 2323816 - DNA, 21 bp, Homo sapiens
ctcctctgctgacctgctgac

SEQ ID NO: 2323817 - DNA, 21 bp, Homo sapiens
ctcctctgcttctttgcctcc

SEQ ID NO: 2323818 - DNA, 21 bp, Homo sapiens
ctcctctggacggcaggctca

SEQ ID NO: 2323819 - DNA, 12 bp, Homo sapiens
ctcctctggctt

SEQ ID NO: 2323820 - DNA, 22 bp, Homo sapiens
ctcctctggctttcccaggaga

SEQ ID NO: 2323821 - DNA, 23 bp, Homo sapiens
ctcctcttctactcacttttccc

SEQ ID NO: 2323822 - DNA, 23 bp, Homo sapiens
ctcctgaaccgcacagctcagga

SEQ ID NO: 2323823 - DNA, 18 bp, Homo sapiens
ctcctgacacccttctcc

SEQ ID NO: 2323824 - DNA, 22 bp, Homo sapiens
ctcctgcacacagaatgctcag

SEQ ID NO: 2323825 - DNA, 23 bp, Homo sapiens
ctcctgcacacagaatgctcagg

SEQ ID NO: 2323826 - DNA, 14 bp, Homo sapiens
ctcctgccaggcac

SEQ ID NO: 2323827 - DNA, 19 bp, Homo sapiens
ctcctgcctcagccttcca

SEQ ID NO: 2323828 - DNA, 16 bp, Homo sapiens
ctcctggagcatccca

SEQ ID NO: 2323829 - DNA, 15 bp, Homo sapiens
ctcctggaggaccag

SEQ ID NO: 2323830 - DNA, 16 bp, Homo sapiens
ctcctggaggaccaga

SEQ ID NO: 2323831 - DNA, 18 bp, Homo sapiens
ctcctggcgagttctctt

SEQ ID NO: 2323832 - DNA, 14 bp, Homo sapiens
ctcctgggctcaag

SEQ ID NO: 2323833 - DNA, 19 bp, Homo sapiens
ctcctgggctcaagcaatc

SEQ ID NO: 2323834 - DNA, 14 bp, Homo sapiens
ctcctgtcccctgc

SEQ ID NO: 2323835 - DNA, 21 bp, Homo sapiens
ctcctgtcccctgctacacct

SEQ ID NO: 2323836 - DNA, 17 bp, Homo sapiens
ctcctgtccctgtagct

SEQ ID NO: 2323837 - DNA, 21 bp, Homo sapiens
ctcctgtccctgtagctcagt

SEQ ID NO: 2323838 - DNA, 16 bp, Homo sapiens
ctcctgtgcctggccc

SEQ ID NO: 2323839 - DNA, 22 bp, Homo sapiens
ctcctgtggaaggcagagaaat

SEQ ID NO: 2323840 - DNA, 16 bp, Homo sapiens
ctccttaaaaatgtat

SEQ ID NO: 2323841 - DNA, 12 bp, Homo sapiens
ctccttccccat

SEQ ID NO: 2323842 - DNA, 12 bp, Homo sapiens
ctccttcctggc

SEQ ID NO: 2323843 - DNA, 16 bp, Homo sapiens
ctccttcctggcctga

SEQ ID NO: 2323844 - DNA, 19 bp, Homo sapiens
ctccttgagtgtatgagta

SEQ ID NO: 2323845 - DNA, 21 bp, Homo sapiens
ctccttgccccccgccctcat

SEQ ID NO: 2323846 - DNA, 22 bp, Homo sapiens
ctccttgccccccgccctcatg

SEQ ID NO: 2323847 - DNA, 16 bp, Homo sapiens
ctccttgctgcattga

SEQ ID NO: 2323848 - DNA, 18 bp, Homo sapiens
ctcctttccataaatcct

SEQ ID NO: 2323849 - DNA, 12 bp, Homo sapiens
ctcctttgtgtg

SEQ ID NO: 2323850 - DNA, 15 bp, Homo sapiens
ctcctttgtgtgtgt

SEQ ID NO: 2323851 - DNA, 13 bp, Homo sapiens
ctccttttcactt

SEQ ID NO: 2323852 - DNA, 22 bp, Homo sapiens
ctcgcactgcccacatgggacc

SEQ ID NO: 2323853 - DNA, 16 bp, Homo sapiens
ctcgcgcttgctggcc

SEQ ID NO: 2323854 - DNA, 15 bp, Homo sapiens
ctcgctccctcccag

SEQ ID NO: 2323855 - DNA, 22 bp, Homo sapiens
ctcgctgagggcagactggggc

SEQ ID NO: 2323856 - DNA, 11 bp, Homo sapiens
ctcgctgccat

SEQ ID NO: 2323857 - DNA, 22 bp, Homo sapiens
ctcggatagttgctatttttgt

SEQ ID NO: 2323858 - DNA, 24 bp, Homo sapiens
ctcggatggaccaacctgctctgt

SEQ ID NO: 2323859 - DNA, 14 bp, Homo sapiens
ctcggtgggagcca

SEQ ID NO: 2323860 - DNA, 17 bp, Homo sapiens
ctcgtctcttttaccct

SEQ ID NO: 2323861 - DNA, 23 bp, Homo sapiens
ctcgtctcttttaccctggcccc

SEQ ID NO: 2323862 - DNA, 19 bp, Homo sapiens
ctcgtgcatccctgagaca

SEQ ID NO: 2323863 - DNA, 14 bp, Homo sapiens
ctcgtgtgtttcta

SEQ ID NO: 2323864 - DNA, 21 bp, Homo sapiens
ctctaccagataactgaggag

SEQ ID NO: 2323865 - DNA, 23 bp, Homo sapiens
ctctaccagataactgaggaggg

SEQ ID NO: 2323866 - DNA, 12 bp, Homo sapiens
ctctaccctgtc

SEQ ID NO: 2323867 - DNA, 13 bp, Homo sapiens
ctctaccctgtct

SEQ ID NO: 2323868 - DNA, 14 bp, Homo sapiens
ctctaccctgtctg

SEQ ID NO: 2323869 - DNA, 19 bp, Homo sapiens
ctctactaaaaatacaaaa

SEQ ID NO: 2323870 - DNA, 15 bp, Homo sapiens
ctctagaagccaagg

SEQ ID NO: 2323871 - DNA, 22 bp, Homo sapiens
ctctagaagccaagggaaaggg

SEQ ID NO: 2323872 - DNA, 17 bp, Homo sapiens
ctctagcagcacctcct

SEQ ID NO: 2323873 - DNA, 21 bp, Homo sapiens
ctctagggactgccaggctgt

SEQ ID NO: 2323874 - DNA, 23 bp, Homo sapiens
ctctcaaaagagaaaaacaaaac

SEQ ID NO: 2323875 - DNA, 19 bp, Homo sapiens
ctctcaccatgatgtgaag

SEQ ID NO: 2323876 - DNA, 22 bp, Homo sapiens
ctctcaccatgatgtgaagagt

SEQ ID NO: 2323877 - DNA, 13 bp, Homo sapiens
ctctcagaacata

SEQ ID NO: 2323878 - DNA, 12 bp, Homo sapiens
ctctcagatttc

SEQ ID NO: 2323879 - DNA, 17 bp, Homo sapiens
ctctcatcaactgaatg

SEQ ID NO: 2323880 - DNA, 18 bp, Homo sapiens
ctctcatcaactgaatga

SEQ ID NO: 2323881 - DNA, 14 bp, Homo sapiens
ctctccaaccactg

SEQ ID NO: 2323882 - DNA, 19 bp, Homo sapiens
ctctccaaccactgtgcca

SEQ ID NO: 2323883 - DNA, 21 bp, Homo sapiens
ctctccaaccactgtgccact

SEQ ID NO: 2323884 - DNA, 15 bp, Homo sapiens
ctctccacagtgttg

SEQ ID NO: 2323885 - DNA, 13 bp, Homo sapiens
ctctccactgctg

SEQ ID NO: 2323886 - DNA, 18 bp, Homo sapiens
ctctccactgctggacat

SEQ ID NO: 2323887 - DNA, 22 bp, Homo sapiens
ctctccatctcccaaggctgcc

SEQ ID NO: 2323888 - DNA, 16 bp, Homo sapiens
ctctccattctgctcc

SEQ ID NO: 2323889 - DNA, 13 bp, Homo sapiens
ctctcccaactct

SEQ ID NO: 2323890 - DNA, 14 bp, Homo sapiens
ctctcccaactctt

SEQ ID NO: 2323891 - DNA, 14 bp, Homo sapiens
ctctcccaccctct

SEQ ID NO: 2323892 - DNA, 19 bp, Homo sapiens
ctctcccagtgaactcctg

SEQ ID NO: 2323893 - DNA, 19 bp, Homo sapiens
ctctccccctcctccaggg

SEQ ID NO: 2323894 - DNA, 17 bp, Homo sapiens
ctctcccttgggctctg

SEQ ID NO: 2323895 - DNA, 22 bp, Homo sapiens
ctctcctaactgccagccccct

SEQ ID NO: 2323896 - DNA, 20 bp, Homo sapiens
ctctcctggcctatccgctg

SEQ ID NO: 2323897 - DNA, 23 bp, Homo sapiens
ctctcctggcctatccgctgcca

SEQ ID NO: 2323898 - DNA, 12 bp, Homo sapiens
ctctcctggctc

SEQ ID NO: 2323899 - DNA, 16 bp, Homo sapiens
ctctccttctcctagc

SEQ ID NO: 2323900 - DNA, 20 bp, Homo sapiens
ctctccttctcctagctctg

SEQ ID NO: 2323901 - DNA, 13 bp, Homo sapiens
ctctcgcacacct

SEQ ID NO: 2323902 - DNA, 22 bp, Homo sapiens
ctctctagcacaatttgcacta

SEQ ID NO: 2323903 - DNA, 13 bp, Homo sapiens
ctgctctggtggc

SEQ ID NO: 2323904 - DNA, 17 bp, Homo sapiens
ctgctgagatctgctgt

SEQ ID NO: 2323905 - DNA, 11 bp, Homo sapiens
ctgctgaggcc

SEQ ID NO: 2323906 - DNA, 17 bp, Homo sapiens
ctgctgaggcccagtgc

SEQ ID NO: 2323907 - DNA, 19 bp, Homo sapiens
ctgctgaggcccagtgcat

SEQ ID NO: 2323908 - DNA, 15 bp, Homo sapiens
ctgctgcccccaccc

SEQ ID NO: 2323909 - DNA, 12 bp, Homo sapiens
ctgctgcctctt

SEQ ID NO: 2323910 - DNA, 13 bp, Homo sapiens
ctgctgcctcttt

SEQ ID NO: 2323911 - DNA, 17 bp, Homo sapiens
ctgctgcctctttccct

SEQ ID NO: 2323912 - DNA, 16 bp, Homo sapiens
ctgctgcctgctgaga

SEQ ID NO: 2323913 - DNA, 16 bp, Homo sapiens
ctgctgcgtcagacca

SEQ ID NO: 2323914 - DNA, 20 bp, Homo sapiens
ctgctgcgtcagaccagtac

SEQ ID NO: 2323915 - DNA, 14 bp, Homo sapiens
ctgctggaagccca

SEQ ID NO: 2323916 - DNA, 15 bp, Homo sapiens
ctgctggaagcccag

SEQ ID NO: 2323917 - DNA, 17 bp, Homo sapiens
ctgctggaggcctcagg

SEQ ID NO: 2323918 - DNA, 22 bp, Homo sapiens
ctgctggccatgaatctctgcc

SEQ ID NO: 2323919 - DNA, 21 bp, Homo sapiens
ctgctggggaagggttttctt

SEQ ID NO: 2323920 - DNA, 17 bp, Homo sapiens
ctgctggggatccccgc

SEQ ID NO: 2323921 - DNA, 14 bp, Homo sapiens
ctgctggggcctgg

SEQ ID NO: 2323922 - DNA, 15 bp, Homo sapiens
ctgctggggcctggg

SEQ ID NO: 2323923 - DNA, 22 bp, Homo sapiens
ctgctggggcctgggacaactg

SEQ ID NO: 2323924 - DNA, 17 bp, Homo sapiens
ctgctggtatttctaat

SEQ ID NO: 2323925 - DNA, 14 bp, Homo sapiens
ctgctgtatgtgag

SEQ ID NO: 2323926 - DNA, 22 bp, Homo sapiens
ctgctgtgaaccctggggcctg

SEQ ID NO: 2323927 - DNA, 22 bp, Homo sapiens
ctgctgtgattccactacacct

SEQ ID NO: 2323928 - DNA, 19 bp, Homo sapiens
ctgctgtgcctcgcatcct

SEQ ID NO: 2323929 - DNA, 14 bp, Homo sapiens
ctgctgttctcagg

SEQ ID NO: 2323930 - DNA, 19 bp, Homo sapiens
ctgctgttctcaggacagc

SEQ ID NO: 2323931 - DNA, 22 bp, Homo sapiens
ctgctgttctcaggacagcatc

SEQ ID NO: 2323932 - DNA, 19 bp, Homo sapiens
ctgcttactaatgtgcccc

SEQ ID NO: 2323933 - DNA, 15 bp, Homo sapiens
ctgcttctcatccca

SEQ ID NO: 2323934 - DNA, 12 bp, Homo sapiens
ctgcttctcttt

SEQ ID NO: 2323935 - DNA, 13 bp, Homo sapiens
ctgcttgattttt

SEQ ID NO: 2323936 - DNA, 20 bp, Homo sapiens
ctgcttgatttttgcctctt

SEQ ID NO: 2323937 - DNA, 13 bp, Homo sapiens
ctgctttaatcag

SEQ ID NO: 2323938 - DNA, 21 bp, Homo sapiens
ctgcttttctgccctggctgc

SEQ ID NO: 2323939 - DNA, 24 bp, Homo sapiens
ctgcttttctgccctggctgctgc

SEQ ID NO: 2323940 - DNA, 11 bp, Homo sapiens
ctgcttttctt

SEQ ID NO: 2323941 - DNA, 21 bp, Homo sapiens
ctgcttttcttaagtgcccac

SEQ ID NO: 2323942 - DNA, 14 bp, Homo sapiens
ctgctttttggaaa

SEQ ID NO: 2323943 - DNA, 19 bp, Homo sapiens
ctggaaaaggagcttcagt

SEQ ID NO: 2323944 - DNA, 20 bp, Homo sapiens
ctggaaaccacacttcttga

SEQ ID NO: 2323945 - DNA, 21 bp, Homo sapiens
ctggaaacttttgttagggct

SEQ ID NO: 2323946 - DNA, 22 bp, Homo sapiens
ctggaaacttttgttagggctg

SEQ ID NO: 2323947 - DNA, 18 bp, Homo sapiens
ctggaaagaggctctgga

SEQ ID NO: 2323948 - DNA, 15 bp, Homo sapiens
ctggaaaggggagag

SEQ ID NO: 2323949 - DNA, 23 bp, Homo sapiens
ctggaaaggggagagcctgctgg

SEQ ID NO: 2323950 - DNA, 22 bp, Homo sapiens
ctggaagagcccagtctgttga

SEQ ID NO: 2323951 - DNA, 15 bp, Homo sapiens
ctggaagccagcttt

SEQ ID NO: 2323952 - DNA, 12 bp, Homo sapiens
ctggaagcccag

SEQ ID NO: 2323953 - DNA, 21 bp, Homo sapiens
ctggaagcccctgggcccagt

SEQ ID NO: 2323954 - DNA, 20 bp, Homo sapiens
ctggaagggaggaaggcctt

SEQ ID NO: 2323955 - DNA, 15 bp, Homo sapiens
ctggaataatattgg

SEQ ID NO: 2323956 - DNA, 18 bp, Homo sapiens
ctggaatctacaagccaa

SEQ ID NO: 2323957 - DNA, 16 bp, Homo sapiens
ctggaatgtttttccc

SEQ ID NO: 2323958 - DNA, 22 bp, Homo sapiens
ctggaatgtttttccctcccca

SEQ ID NO: 2323959 - DNA, 23 bp, Homo sapiens
ctggaatgtttttccctccccag

SEQ ID NO: 2323960 - DNA, 22 bp, Homo sapiens
ctggaattgtggctatcctgat

SEQ ID NO: 2323961 - DNA, 15 bp, Homo sapiens
ctggacagcagaagc

SEQ ID NO: 2323962 - DNA, 16 bp, Homo sapiens
ctggacagcagaagcc

SEQ ID NO: 2323963 - DNA, 17 bp, Homo sapiens
ctggacagcagaagcct

SEQ ID NO: 2323964 - DNA, 13 bp, Homo sapiens
ctggacagccagt

SEQ ID NO: 2323965 - DNA, 15 bp, Homo sapiens
ctggacagccagtga

SEQ ID NO: 2323966 - DNA, 16 bp, Homo sapiens
ctggacagtatcccac

SEQ ID NO: 2323967 - DNA, 20 bp, Homo sapiens
ctggacagtatcccacatcc

SEQ ID NO: 2323968 - DNA, 23 bp, Homo sapiens
ctggacatgagatggagaggctg

SEQ ID NO: 2323969 - DNA, 14 bp, Homo sapiens
ctggacggcaggct

SEQ ID NO: 2323970 - DNA, 18 bp, Homo sapiens
ctggactaaaggcatcct

SEQ ID NO: 2323971 - DNA, 15 bp, Homo sapiens
ctggacttctacctg

SEQ ID NO: 2323972 - DNA, 20 bp, Homo sapiens
ctggacttctacctgccctc

SEQ ID NO: 2323973 - DNA, 23 bp, Homo sapiens
ctggacttctacctgccctcaag

SEQ ID NO: 2323974 - DNA, 14 bp, Homo sapiens
ctggagaagcacca

SEQ ID NO: 2323975 - DNA, 12 bp, Homo sapiens
ctggagaccccc

SEQ ID NO: 2323976 - DNA, 22 bp, Homo sapiens
ctggagacccccccccaactcc

SEQ ID NO: 2323977 - DNA, 12 bp, Homo sapiens
ctggagccccca

SEQ ID NO: 2323978 - DNA, 15 bp, Homo sapiens
ctggagcccccagca

SEQ ID NO: 2323979 - DNA, 22 bp, Homo sapiens
ctggaggaagtggggtctggcc

SEQ ID NO: 2323980 - DNA, 15 bp, Homo sapiens
ctggaggcctcaggt

SEQ ID NO: 2323981 - DNA, 19 bp, Homo sapiens
ctggaggcctcaggtgctg

SEQ ID NO: 2323982 - DNA, 21 bp, Homo sapiens
ctggaggcctcaggtgctgtc

SEQ ID NO: 2323983 - DNA, 19 bp, Homo sapiens
ctggaggttgaagccaagt

SEQ ID NO: 2323984 - DNA, 16 bp, Homo sapiens
ctggagtctcctgagg

SEQ ID NO: 2323985 - DNA, 14 bp, Homo sapiens
ctggatagacgagt

SEQ ID NO: 2323986 - DNA, 22 bp, Homo sapiens
ctggatagacttgggatgggga

SEQ ID NO: 2323987 - DNA, 21 bp, Homo sapiens
ctggatggaaagacaaactgc

SEQ ID NO: 2323988 - DNA, 13 bp, Homo sapiens
ctggatggggcag

SEQ ID NO: 2323989 - DNA, 15 bp, Homo sapiens
ctggcaaaccctccc

SEQ ID NO: 2323990 - DNA, 18 bp, Homo sapiens
ctggcaaaccctcccaga

SEQ ID NO: 2323991 - DNA, 17 bp, Homo sapiens
ctggcaacatctttatc

SEQ ID NO: 2323992 - DNA, 14 bp, Homo sapiens
ctggcactgggagg

SEQ ID NO: 2323993 - DNA, 19 bp, Homo sapiens
ctggcagtgcaatgcttgt

SEQ ID NO: 2323994 - DNA, 21 bp, Homo sapiens
ctggcatctaattctgattct

SEQ ID NO: 2323995 - DNA, 18 bp, Homo sapiens
ctggccaaatagcaaaga

SEQ ID NO: 2323996 - DNA, 16 bp, Homo sapiens
ctggccaccagccatc

SEQ ID NO: 2323997 - DNA, 12 bp, Homo sapiens
ctggccaggagc

SEQ ID NO: 2323998 - DNA, 13 bp, Homo sapiens
ctggccaggagca

SEQ ID NO: 2323999 - DNA, 16 bp, Homo sapiens
ctggccatactgtgtc

SEQ ID NO: 2324000 - DNA, 23 bp, Homo sapiens
ctggccatgaatctctgcctctc

SEQ ID NO: 2324001 - DNA, 16 bp, Homo sapiens
ctggccatggcctgca

SEQ ID NO: 2324002 - DNA, 15 bp, Homo sapiens
ctggcccagaaagcc

SEQ ID NO: 2324003 - DNA, 14 bp, Homo sapiens
ctggccccagccct

SEQ ID NO: 2324004 - DNA, 15 bp, Homo sapiens
ctggccccagccctg

SEQ ID NO: 2324005 - DNA, 13 bp, Homo sapiens
ctggccccagcct

SEQ ID NO: 2324006 - DNA, 14 bp, Homo sapiens
ctggccccagcctg

SEQ ID NO: 2324007 - DNA, 17 bp, Homo sapiens
ctggccccaggccccag

SEQ ID NO: 2324008 - DNA, 17 bp, Homo sapiens
ctggcccccaacctcag

SEQ ID NO: 2324009 - DNA, 18 bp, Homo sapiens
ctggcccctgacccaggg

SEQ ID NO: 2324010 - DNA, 13 bp, Homo sapiens
ctggcccttagag

SEQ ID NO: 2324011 - DNA, 18 bp, Homo sapiens
ctggcccttagagacccc

SEQ ID NO: 2324012 - DNA, 21 bp, Homo sapiens
ctggcccttgcttacctctca

SEQ ID NO: 2324013 - DNA, 17 bp, Homo sapiens
ctggccgacccactgac

SEQ ID NO: 2324014 - DNA, 17 bp, Homo sapiens
ctggccgcttctcccca

SEQ ID NO: 2324015 - DNA, 18 bp, Homo sapiens
ctggccgcttctccccag

SEQ ID NO: 2324016 - DNA, 21 bp, Homo sapiens
ctggccgcttctccccagagc

SEQ ID NO: 2324017 - DNA, 16 bp, Homo sapiens
ctggcctctctagcac

SEQ ID NO: 2324018 - DNA, 11 bp, Homo sapiens
cttggactcat

SEQ ID NO: 2324019 - DNA, 13 bp, Homo sapiens
cttggagagcagc

SEQ ID NO: 2324020 - DNA, 14 bp, Homo sapiens
cttggagagcagct

SEQ ID NO: 2324021 - DNA, 16 bp, Homo sapiens
cttggagagcagctgg

SEQ ID NO: 2324022 - DNA, 20 bp, Homo sapiens
cttggagctattttccaggc

SEQ ID NO: 2324023 - DNA, 15 bp, Homo sapiens
cttggattcaatttt

SEQ ID NO: 2324024 - DNA, 16 bp, Homo sapiens
cttggattcaatttta

SEQ ID NO: 2324025 - DNA, 20 bp, Homo sapiens
cttggcacttattgaatata

SEQ ID NO: 2324026 - DNA, 14 bp, Homo sapiens
cttggctggggagg

SEQ ID NO: 2324027 - DNA, 20 bp, Homo sapiens
cttgggaagactcctagctg

SEQ ID NO: 2324028 - DNA, 21 bp, Homo sapiens
cttgggaagactcctagctgt

SEQ ID NO: 2324029 - DNA, 14 bp, Homo sapiens
cttgggaggctgag

SEQ ID NO: 2324030 - DNA, 23 bp, Homo sapiens
cttgggaggctgaggcaggagaa

SEQ ID NO: 2324031 - DNA, 13 bp, Homo sapiens
cttgggctctgat

SEQ ID NO: 2324032 - DNA, 23 bp, Homo sapiens
cttggggaaaatggccatgcagg

SEQ ID NO: 2324033 - DNA, 23 bp, Homo sapiens
cttggggagagggatttccctgc

SEQ ID NO: 2324034 - DNA, 22 bp, Homo sapiens
cttggggccaccaaagctgccc

SEQ ID NO: 2324035 - DNA, 22 bp, Homo sapiens
cttggggccttgatgactgcct

SEQ ID NO: 2324036 - DNA, 15 bp, Homo sapiens
cttggggctcgcccc

SEQ ID NO: 2324037 - DNA, 19 bp, Homo sapiens
cttggggctcgccccaccc

SEQ ID NO: 2324038 - DNA, 20 bp, Homo sapiens
cttgggtggccccctctcct

SEQ ID NO: 2324039 - DNA, 23 bp, Homo sapiens
cttgggtgtattctctgtaagtg

SEQ ID NO: 2324040 - DNA, 19 bp, Homo sapiens
cttggtgattacctgaaag

SEQ ID NO: 2324041 - DNA, 13 bp, Homo sapiens
cttggtttgctag

SEQ ID NO: 2324042 - DNA, 12 bp, Homo sapiens
cttgtaaagact

SEQ ID NO: 2324043 - DNA, 14 bp, Homo sapiens
cttgtaagaccctt

SEQ ID NO: 2324044 - DNA, 19 bp, Homo sapiens
cttgtacatgtgtagcctg

SEQ ID NO: 2324045 - DNA, 19 bp, Homo sapiens
cttgtactctacaaaatat

SEQ ID NO: 2324046 - DNA, 23 bp, Homo sapiens
cttgtaggggaggggctcctttc

SEQ ID NO: 2324047 - DNA, 14 bp, Homo sapiens
cttgtataaattat

SEQ ID NO: 2324048 - DNA, 21 bp, Homo sapiens
cttgtatagcatgaaataaaa

SEQ ID NO: 2324049 - DNA, 18 bp, Homo sapiens
cttgtatttaaaaacatt

SEQ ID NO: 2324050 - DNA, 14 bp, Homo sapiens
cttgtctgatttct

SEQ ID NO: 2324051 - DNA, 18 bp, Homo sapiens
cttgtcttctggtacttt

SEQ ID NO: 2324052 - DNA, 21 bp, Homo sapiens
cttgtcttctggtactttctg

SEQ ID NO: 2324053 - DNA, 15 bp, Homo sapiens
cttgtgacagtgcct

SEQ ID NO: 2324054 - DNA, 19 bp, Homo sapiens
cttgtgacagtgcctcttc

SEQ ID NO: 2324055 - DNA, 11 bp, Homo sapiens
cttgtgccata

SEQ ID NO: 2324056 - DNA, 19 bp, Homo sapiens
cttgtgccatagtcacatg

SEQ ID NO: 2324057 - DNA, 14 bp, Homo sapiens
cttgtggcctcaag

SEQ ID NO: 2324058 - DNA, 14 bp, Homo sapiens
cttgtggggcctgg

SEQ ID NO: 2324059 - DNA, 17 bp, Homo sapiens
cttgtggggcctgggag

SEQ ID NO: 2324060 - DNA, 23 bp, Homo sapiens
cttgtgtctttggaggtgctgct

SEQ ID NO: 2324061 - DNA, 21 bp, Homo sapiens
cttgtgttcagctctttccaa

SEQ ID NO: 2324062 - DNA, 22 bp, Homo sapiens
cttgtgttcagctctttccaaa

SEQ ID NO: 2324063 - DNA, 23 bp, Homo sapiens
cttgtgttcagctctttccaaat

SEQ ID NO: 2324064 - DNA, 19 bp, Homo sapiens
cttgttcaggaaaaggttg

SEQ ID NO: 2324065 - DNA, 16 bp, Homo sapiens
cttgttcatcatccag

SEQ ID NO: 2324066 - DNA, 15 bp, Homo sapiens
cttgttgtttcttgc

SEQ ID NO: 2324067 - DNA, 15 bp, Homo sapiens
cttgtttacctttct

SEQ ID NO: 2324068 - DNA, 12 bp, Homo sapiens
cttgtttctgaa

SEQ ID NO: 2324069 - DNA, 18 bp, Homo sapiens
cttgtttgagtttttcct

SEQ ID NO: 2324070 - DNA, 22 bp, Homo sapiens
cttgtttgagtttttcctccca

SEQ ID NO: 2324071 - DNA, 21 bp, Homo sapiens
cttgttttggatggcttgtct

SEQ ID NO: 2324072 - DNA, 14 bp, Homo sapiens
ctttaaaatattgt

SEQ ID NO: 2324073 - DNA, 22 bp, Homo sapiens
ctttaaatcatttttatattat

SEQ ID NO: 2324074 - DNA, 14 bp, Homo sapiens
ctttaaattgtgga

SEQ ID NO: 2324075 - DNA, 16 bp, Homo sapiens
ctttaaattgtggatg

SEQ ID NO: 2324076 - DNA, 18 bp, Homo sapiens
ctttaaattgtggatgaa

SEQ ID NO: 2324077 - DNA, 15 bp, Homo sapiens
ctttaaccttgtata

SEQ ID NO: 2324078 - DNA, 17 bp, Homo sapiens
ctttaaccttgtataaa

SEQ ID NO: 2324079 - DNA, 22 bp, Homo sapiens
ctttaagccatagaccctgagg

SEQ ID NO: 2324080 - DNA, 23 bp, Homo sapiens
ctttaatagtcaccttcatgatt

SEQ ID NO: 2324081 - DNA, 18 bp, Homo sapiens
ctttaattaccaacctgt

SEQ ID NO: 2324082 - DNA, 14 bp, Homo sapiens
ctttaattatatat

SEQ ID NO: 2324083 - DNA, 14 bp, Homo sapiens
ctttaccactgtgg

SEQ ID NO: 2324084 - DNA, 17 bp, Homo sapiens
ctttacccacctagaac

SEQ ID NO: 2324085 - DNA, 16 bp, Homo sapiens
ctttacgcccatctca

SEQ ID NO: 2324086 - DNA, 16 bp, Homo sapiens
ctttaggcagcctgcc

SEQ ID NO: 2324087 - DNA, 20 bp, Homo sapiens
ctttaggcagcctgccgccg

SEQ ID NO: 2324088 - DNA, 22 bp, Homo sapiens
ctttaggggtacacactttttg

SEQ ID NO: 2324089 - DNA, 17 bp, Homo sapiens
ctttagtacaatttcaa

SEQ ID NO: 2324090 - DNA, 23 bp, Homo sapiens
ctttagtgttctgtttgaaacta

SEQ ID NO: 2324091 - DNA, 13 bp, Homo sapiens
ctttagtttttgg

SEQ ID NO: 2324092 - DNA, 21 bp, Homo sapiens
ctttatcatgaatgcttttag

SEQ ID NO: 2324093 - DNA, 21 bp, Homo sapiens
ctttatctaatacctctgtgt

SEQ ID NO: 2324094 - DNA, 22 bp, Homo sapiens
ctttatctaatacctctgtgtg

SEQ ID NO: 2324095 - DNA, 13 bp, Homo sapiens
ctttatgtgaatt

SEQ ID NO: 2324096 - DNA, 16 bp, Homo sapiens
ctttattaagtaaaat

SEQ ID NO: 2324097 - DNA, 14 bp, Homo sapiens
ctttattaatgttt

SEQ ID NO: 2324098 - DNA, 13 bp, Homo sapiens
ctttattttgtgt

SEQ ID NO: 2324099 - DNA, 17 bp, Homo sapiens
ctttcaaacagctattg

SEQ ID NO: 2324100 - DNA, 11 bp, Homo sapiens
ctttcagaaag

SEQ ID NO: 2324101 - DNA, 21 bp, Homo sapiens
ctttcagaaatataacacatt

SEQ ID NO: 2324102 - DNA, 22 bp, Homo sapiens
ctttcagaaatataacacattt

SEQ ID NO: 2324103 - DNA, 18 bp, Homo sapiens
ctttccaaattaaaacaa

SEQ ID NO: 2324104 - DNA, 12 bp, Homo sapiens
ctttccaggcac

SEQ ID NO: 2324105 - DNA, 20 bp, Homo sapiens
ctttccaggcaccctcaggg

SEQ ID NO: 2324106 - DNA, 22 bp, Homo sapiens
ctttccatccattacctccatc

SEQ ID NO: 2324107 - DNA, 23 bp, Homo sapiens
ctttccctttaccactgtggttt

SEQ ID NO: 2324108 - DNA, 13 bp, Homo sapiens
ctttcctccaccc

SEQ ID NO: 2324109 - DNA, 15 bp, Homo sapiens
ctttcctccacccat

SEQ ID NO: 2324110 - DNA, 22 bp, Homo sapiens
ctttcctctttctgctctgcca

SEQ ID NO: 2324111 - DNA, 15 bp, Homo sapiens
ctttcctgaatccaa

SEQ ID NO: 2324112 - DNA, 14 bp, Homo sapiens
ctttcctgccctgt

SEQ ID NO: 2324113 - DNA, 18 bp, Homo sapiens
ctttcctgccctgtccaa

SEQ ID NO: 2324114 - DNA, 9 bp, Homo sapiens
ctttcctgt

SEQ ID NO: 2324115 - DNA, 13 bp, Homo sapiens
ctttccttccctc

SEQ ID NO: 2324116 - DNA, 14 bp, Homo sapiens
ctttccttccctct

SEQ ID NO: 2324117 - DNA, 13 bp, Homo sapiens
ctttcgaggcctg

SEQ ID NO: 2324118 - DNA, 19 bp, Homo sapiens
ctttctacaactgattgca

SEQ ID NO: 2324119 - DNA, 17 bp, Homo sapiens
ctttctagaccaataaa

SEQ ID NO: 2324120 - DNA, 21 bp, Homo sapiens
ctttctagagcagttggccaa

SEQ ID NO: 2324121 - DNA, 16 bp, Homo sapiens
ctttctagtggtcttt

SEQ ID NO: 2324122 - DNA, 14 bp, Homo sapiens
ctttctcaatgtct

SEQ ID NO: 2324123 - DNA, 21 bp, Homo sapiens
ctttctcaggagcttgggcag

SEQ ID NO: 2324124 - DNA, 16 bp, Homo sapiens
ctttctcagttttcat

SEQ ID NO: 2324125 - DNA, 17 bp, Homo sapiens
ctttctctcctggctcg

SEQ ID NO: 2324126 - DNA, 15 bp, Homo sapiens
ctttctcttccctga

SEQ ID NO: 2324127 - DNA, 17 bp, Homo sapiens
ctttctgaattgcacat

SEQ ID NO: 2324128 - DNA, 21 bp, Homo sapiens
ctttctgccatctagccagcc

SEQ ID NO: 2324129 - DNA, 16 bp, Homo sapiens
ctttctgctctgccat

SEQ ID NO: 2324130 - DNA, 13 bp, Homo sapiens
ctttctggctctc

SEQ ID NO: 2324131 - DNA, 21 bp, Homo sapiens
ctttctgggatgtcacagtcc

SEQ ID NO: 2324132 - DNA, 14 bp, Homo sapiens
ctttcttctgtgtt

SEQ ID NO: 2324133 - DNA, 18 bp, Homo sapiens
gaagacaagcatttttaa

SEQ ID NO: 2324134 - DNA, 15 bp, Homo sapiens
gaagacaccagagca

SEQ ID NO: 2324135 - DNA, 16 bp, Homo sapiens
gaagacaccagagcag

SEQ ID NO: 2324136 - DNA, 17 bp, Homo sapiens
gaagacaccagagcaga

SEQ ID NO: 2324137 - DNA, 18 bp, Homo sapiens
gaagacaccagagcagat

SEQ ID NO: 2324138 - DNA, 18 bp, Homo sapiens
gaagacatgaaccaagtg

SEQ ID NO: 2324139 - DNA, 20 bp, Homo sapiens
gaagaccctatctcccacaa

SEQ ID NO: 2324140 - DNA, 15 bp, Homo sapiens
gaagagccacctgca

SEQ ID NO: 2324141 - DNA, 16 bp, Homo sapiens
gaagagcccagtctgt

SEQ ID NO: 2324142 - DNA, 22 bp, Homo sapiens
gaagagcccgcagggccatgca

SEQ ID NO: 2324143 - DNA, 16 bp, Homo sapiens
gaagatagttgtaaag

SEQ ID NO: 2324144 - DNA, 13 bp, Homo sapiens
gaagcaagccaga

SEQ ID NO: 2324145 - DNA, 17 bp, Homo sapiens
gaagcaagccagaccta

SEQ ID NO: 2324146 - DNA, 17 bp, Homo sapiens
gaagcacagaatatttt

SEQ ID NO: 2324147 - DNA, 21 bp, Homo sapiens
gaagcactacaccttgccttg

SEQ ID NO: 2324148 - DNA, 13 bp, Homo sapiens
gaagcatgaaaaa

SEQ ID NO: 2324149 - DNA, 15 bp, Homo sapiens
gaagcattccttctt

SEQ ID NO: 2324150 - DNA, 10 bp, Homo sapiens
gaagccaaag

SEQ ID NO: 2324151 - DNA, 16 bp, Homo sapiens
gaagccaaagaaaaat

SEQ ID NO: 2324152 - DNA, 16 bp, Homo sapiens
gaagccaagggaaagg

SEQ ID NO: 2324153 - DNA, 20 bp, Homo sapiens
gaagccaagggaaaggggtg

SEQ ID NO: 2324154 - DNA, 13 bp, Homo sapiens
gaagccaagtggg

SEQ ID NO: 2324155 - DNA, 19 bp, Homo sapiens
gaagccaagtggggtgctg

SEQ ID NO: 2324156 - DNA, 21 bp, Homo sapiens
gaagccaagtggggtgctggg

SEQ ID NO: 2324157 - DNA, 12 bp, Homo sapiens
gaagccagctgc

SEQ ID NO: 2324158 - DNA, 19 bp, Homo sapiens
gaagccatctaaagtaaaa

SEQ ID NO: 2324159 - DNA, 19 bp, Homo sapiens
gaagcccagcccctactgc

SEQ ID NO: 2324160 - DNA, 22 bp, Homo sapiens
gaagcccagcccctactgctgt

SEQ ID NO: 2324161 - DNA, 18 bp, Homo sapiens
gaagccccctcttcctcc

SEQ ID NO: 2324162 - DNA, 20 bp, Homo sapiens
gaagcgtatatacttaagaa

SEQ ID NO: 2324163 - DNA, 13 bp, Homo sapiens
gaagctaattgta

SEQ ID NO: 2324164 - DNA, 15 bp, Homo sapiens
gaagctgcaggcttt

SEQ ID NO: 2324165 - DNA, 16 bp, Homo sapiens
gaagctgttgtacatt

SEQ ID NO: 2324166 - DNA, 21 bp, Homo sapiens
gaaggaaggcctgagcccctt

SEQ ID NO: 2324167 - DNA, 19 bp, Homo sapiens
gaaggaggggagagacagg

SEQ ID NO: 2324168 - DNA, 14 bp, Homo sapiens
gaaggattgtaaaa

SEQ ID NO: 2324169 - DNA, 14 bp, Homo sapiens
gaaggcaagagggg

SEQ ID NO: 2324170 - DNA, 22 bp, Homo sapiens
gaaggcaagagggggtggaggg

SEQ ID NO: 2324171 - DNA, 23 bp, Homo sapiens
gaaggcaagagggggtggagggg

SEQ ID NO: 2324172 - DNA, 18 bp, Homo sapiens
gaaggccctgctgagtca

SEQ ID NO: 2324173 - DNA, 13 bp, Homo sapiens
gaaggcctttctt

SEQ ID NO: 2324174 - DNA, 15 bp, Homo sapiens
gaaggcctttcttct

SEQ ID NO: 2324175 - DNA, 17 bp, Homo sapiens
gaaggcctttcttctgt

SEQ ID NO: 2324176 - DNA, 12 bp, Homo sapiens
gaaggctgtacg

SEQ ID NO: 2324177 - DNA, 22 bp, Homo sapiens
gaaggcttctctccacagtgtt

SEQ ID NO: 2324178 - DNA, 13 bp, Homo sapiens
gaagggatctgag

SEQ ID NO: 2324179 - DNA, 14 bp, Homo sapiens
gaagggcaagaaat

SEQ ID NO: 2324180 - DNA, 18 bp, Homo sapiens
gaagggggtctctgttaa

SEQ ID NO: 2324181 - DNA, 14 bp, Homo sapiens
gaaggtggccacag

SEQ ID NO: 2324182 - DNA, 24 bp, Homo sapiens
gaagtctggctttgctctattaag

SEQ ID NO: 2324183 - DNA, 13 bp, Homo sapiens
gaagtcttgaagt

SEQ ID NO: 2324184 - DNA, 18 bp, Homo sapiens
gaagtgaatctgattgca

SEQ ID NO: 2324185 - DNA, 22 bp, Homo sapiens
gaagtgcggggtaggggaagaa

SEQ ID NO: 2324186 - DNA, 16 bp, Homo sapiens
gaagtggctgccacac

SEQ ID NO: 2324187 - DNA, 19 bp, Homo sapiens
gaagtggctggtagaaaaa

SEQ ID NO: 2324188 - DNA, 14 bp, Homo sapiens
gaagtggggtctgg

SEQ ID NO: 2324189 - DNA, 13 bp, Homo sapiens
gaagttaaaatga

SEQ ID NO: 2324190 - DNA, 21 bp, Homo sapiens
gaagttattttctacagtggt

SEQ ID NO: 2324191 - DNA, 22 bp, Homo sapiens
gaagtttcaagttttaaagttc

SEQ ID NO: 2324192 - DNA, 14 bp, Homo sapiens
gaataaaattccta

SEQ ID NO: 2324193 - DNA, 20 bp, Homo sapiens
gaataaagaatgccatttct

SEQ ID NO: 2324194 - DNA, 12 bp, Homo sapiens
gaataaatgtgt

SEQ ID NO: 2324195 - DNA, 22 bp, Homo sapiens
gaataactctttttcagagctt

SEQ ID NO: 2324196 - DNA, 20 bp, Homo sapiens
gaataatatcaaataaaata

SEQ ID NO: 2324197 - DNA, 19 bp, Homo sapiens
gaataatcacgctttcctg

SEQ ID NO: 2324198 - DNA, 20 bp, Homo sapiens
gaataatgaaaataaaacac

SEQ ID NO: 2324199 - DNA, 13 bp, Homo sapiens
gaataatttctat

SEQ ID NO: 2324200 - DNA, 19 bp, Homo sapiens
gaatacagtcattccaaga

SEQ ID NO: 2324201 - DNA, 20 bp, Homo sapiens
gaatacattaacggtgctaa

SEQ ID NO: 2324202 - DNA, 21 bp, Homo sapiens
gaatacattaacggtgctaaa

SEQ ID NO: 2324203 - DNA, 22 bp, Homo sapiens
gaataccacatcaaataagaaa

SEQ ID NO: 2324204 - DNA, 22 bp, Homo sapiens
gaatagcctggccaccagccat

SEQ ID NO: 2324205 - DNA, 15 bp, Homo sapiens
gaatatgacggaaga

SEQ ID NO: 2324206 - DNA, 17 bp, Homo sapiens
gaatatgacggaagaac

SEQ ID NO: 2324207 - DNA, 19 bp, Homo sapiens
gaatatgacggaagaacat

SEQ ID NO: 2324208 - DNA, 13 bp, Homo sapiens
gaatattaaaaaa

SEQ ID NO: 2324209 - DNA, 20 bp, Homo sapiens
gaatatttttatatttcctt

SEQ ID NO: 2324210 - DNA, 22 bp, Homo sapiens
gaatcagaagatagtcttggaa

SEQ ID NO: 2324211 - DNA, 15 bp, Homo sapiens
gaatcatgagcctgc

SEQ ID NO: 2324212 - DNA, 20 bp, Homo sapiens
gaatcatgagcctgctggaa

SEQ ID NO: 2324213 - DNA, 15 bp, Homo sapiens
gaatccattggagaa

SEQ ID NO: 2324214 - DNA, 17 bp, Homo sapiens
gaatccattggagaagc

SEQ ID NO: 2324215 - DNA, 22 bp, Homo sapiens
gaatcccacccacatgtgacac

SEQ ID NO: 2324216 - DNA, 13 bp, Homo sapiens
gaatcctggcagc

SEQ ID NO: 2324217 - DNA, 21 bp, Homo sapiens
gaatctataagtagtaaatca

SEQ ID NO: 2324218 - DNA, 19 bp, Homo sapiens
gaatctcaagatgggggca

SEQ ID NO: 2324219 - DNA, 12 bp, Homo sapiens
gaatctgcaggg

SEQ ID NO: 2324220 - DNA, 13 bp, Homo sapiens
gaatgaaaataac

SEQ ID NO: 2324221 - DNA, 17 bp, Homo sapiens
gaatgaagcagtatttt

SEQ ID NO: 2324222 - DNA, 16 bp, Homo sapiens
gaatgaggaaaattct

SEQ ID NO: 2324223 - DNA, 23 bp, Homo sapiens
gaatgaggaaaattcttaaaagg

SEQ ID NO: 2324224 - DNA, 13 bp, Homo sapiens
gaatgccatttct

SEQ ID NO: 2324225 - DNA, 15 bp, Homo sapiens
gaatgccatttctca

SEQ ID NO: 2324226 - DNA, 17 bp, Homo sapiens
gaatgccatttctcacg

SEQ ID NO: 2324227 - DNA, 23 bp, Homo sapiens
gaatgctcagggtcactgaacca

SEQ ID NO: 2324228 - DNA, 13 bp, Homo sapiens
gaatggctttcaa

SEQ ID NO: 2324229 - DNA, 22 bp, Homo sapiens
gaatggtctggcaatattctgt

SEQ ID NO: 2324230 - DNA, 14 bp, Homo sapiens
gaatggtctttgct

SEQ ID NO: 2324231 - DNA, 11 bp, Homo sapiens
gaatgtaacca

SEQ ID NO: 2324232 - DNA, 14 bp, Homo sapiens
gaatgtatttgatt

SEQ ID NO: 2324233 - DNA, 13 bp, Homo sapiens
gaatgttaaaggg

SEQ ID NO: 2324234 - DNA, 21 bp, Homo sapiens
gaatgtttttccctccccaga

SEQ ID NO: 2324235 - DNA, 15 bp, Homo sapiens
gaattacgtgctctg

SEQ ID NO: 2324236 - DNA, 19 bp, Homo sapiens
gaattacgtgctctgtggg

SEQ ID NO: 2324237 - DNA, 14 bp, Homo sapiens
gaattattgacact

SEQ ID NO: 2324238 - DNA, 16 bp, Homo sapiens
gaattattgacactga

SEQ ID NO: 2324239 - DNA, 15 bp, Homo sapiens
gaattcataataaat

SEQ ID NO: 2324240 - DNA, 22 bp, Homo sapiens
gaattcataataaattttctaa

SEQ ID NO: 2324241 - DNA, 15 bp, Homo sapiens
gaattctgattgatt

SEQ ID NO: 2324242 - DNA, 19 bp, Homo sapiens
gaattctgtttaattttca

SEQ ID NO: 2324243 - DNA, 14 bp, Homo sapiens
gaattgaaaagttt

SEQ ID NO: 2324244 - DNA, 17 bp, Homo sapiens
gaattgaaaagtttttg

SEQ ID NO: 2324245 - DNA, 18 bp, Homo sapiens
gaattgtggctatcctga

SEQ ID NO: 2324246 - DNA, 11 bp, Homo sapiens
gaatttgagaa

SEQ ID NO: 2324247 - DNA, 22 bp, Homo sapiens
gaatttgatgattttcatttca

SEQ ID NO: 2324248 - DNA, 20 bp, Homo sapiens
gaggtcactggaaaggggag

SEQ ID NO: 2324249 - DNA, 23 bp, Homo sapiens
gaggtcagcatgtctattcagct

SEQ ID NO: 2324250 - DNA, 19 bp, Homo sapiens
gaggtccttaggcctctga

SEQ ID NO: 2324251 - DNA, 24 bp, Homo sapiens
gaggtgcgtgttcagcagaacctg

SEQ ID NO: 2324252 - DNA, 19 bp, Homo sapiens
gaggtggaagaagggagaa

SEQ ID NO: 2324253 - DNA, 12 bp, Homo sapiens
gaggtggagaaa

SEQ ID NO: 2324254 - DNA, 13 bp, Homo sapiens
gaggtggagaaaa

SEQ ID NO: 2324255 - DNA, 18 bp, Homo sapiens
gaggtggagggagggaag

SEQ ID NO: 2324256 - DNA, 22 bp, Homo sapiens
gaggtggatgttatgaacagct

SEQ ID NO: 2324257 - DNA, 21 bp, Homo sapiens
gaggtggccatgttatgctgg

SEQ ID NO: 2324258 - DNA, 15 bp, Homo sapiens
gaggtgtcaccctgc

SEQ ID NO: 2324259 - DNA, 19 bp, Homo sapiens
gaggtgtcaccctgcagag

SEQ ID NO: 2324260 - DNA, 18 bp, Homo sapiens
gaggttcctctgcctgcc

SEQ ID NO: 2324261 - DNA, 23 bp, Homo sapiens
gaggttgcagtgagccaaaatca

SEQ ID NO: 2324262 - DNA, 13 bp, Homo sapiens
gagtaaaaactag

SEQ ID NO: 2324263 - DNA, 20 bp, Homo sapiens
gagtaatactttttaaatta

SEQ ID NO: 2324264 - DNA, 20 bp, Homo sapiens
gagtaatgtgactaaaggaa

SEQ ID NO: 2324265 - DNA, 21 bp, Homo sapiens
gagtaccaaatccacaagcca

SEQ ID NO: 2324266 - DNA, 15 bp, Homo sapiens
gagtagaaaatgtga

SEQ ID NO: 2324267 - DNA, 23 bp, Homo sapiens
gagtagaaaatgtgaccctccaa

SEQ ID NO: 2324268 - DNA, 18 bp, Homo sapiens
gagtattccatgagctgc

SEQ ID NO: 2324269 - DNA, 21 bp, Homo sapiens
gagtattctcggatagttgct

SEQ ID NO: 2324270 - DNA, 21 bp, Homo sapiens
gagtattgtttaaaatgtaat

SEQ ID NO: 2324271 - DNA, 22 bp, Homo sapiens
gagtcaccttttctgtggctgg

SEQ ID NO: 2324272 - DNA, 15 bp, Homo sapiens
gagtcagagccatgt

SEQ ID NO: 2324273 - DNA, 16 bp, Homo sapiens
gagtcagggtgaactg

SEQ ID NO: 2324274 - DNA, 22 bp, Homo sapiens
gagtcatctgttagggccttgg

SEQ ID NO: 2324275 - DNA, 12 bp, Homo sapiens
gagtccaaggcc

SEQ ID NO: 2324276 - DNA, 14 bp, Homo sapiens
gagtccaaggccag

SEQ ID NO: 2324277 - DNA, 20 bp, Homo sapiens
gagtccagggtttctctgca

SEQ ID NO: 2324278 - DNA, 15 bp, Homo sapiens
gagtccagtgctctg

SEQ ID NO: 2324279 - DNA, 21 bp, Homo sapiens
gagtccagtgctctgcctcag

SEQ ID NO: 2324280 - DNA, 22 bp, Homo sapiens
gagtccagtgctctgcctcaga

SEQ ID NO: 2324281 - DNA, 20 bp, Homo sapiens
gagtccattctcccaggtac

SEQ ID NO: 2324282 - DNA, 20 bp, Homo sapiens
gagtccctacctgcttcacg

SEQ ID NO: 2324283 - DNA, 22 bp, Homo sapiens
gagtcgtacagaaagctgcctg

SEQ ID NO: 2324284 - DNA, 23 bp, Homo sapiens
gagtctggtgaagctcacttctg

SEQ ID NO: 2324285 - DNA, 14 bp, Homo sapiens
gagtcttaataaaa

SEQ ID NO: 2324286 - DNA, 19 bp, Homo sapiens
gagtgaaccccacgccctg

SEQ ID NO: 2324287 - DNA, 16 bp, Homo sapiens
gagtgacagctttctg

SEQ ID NO: 2324288 - DNA, 19 bp, Homo sapiens
gagtgagatgtagaaagtt

SEQ ID NO: 2324289 - DNA, 18 bp, Homo sapiens
gagtgcggaccaccctca

SEQ ID NO: 2324290 - DNA, 16 bp, Homo sapiens
gagtgcgggctgaggc

SEQ ID NO: 2324291 - DNA, 23 bp, Homo sapiens
gagtgcgggctgaggccagagtc

SEQ ID NO: 2324292 - DNA, 13 bp, Homo sapiens
gagtgtagaagca

SEQ ID NO: 2324293 - DNA, 14 bp, Homo sapiens
gagtgtagaagcat

SEQ ID NO: 2324294 - DNA, 16 bp, Homo sapiens
gagtgtagaagcattc

SEQ ID NO: 2324295 - DNA, 18 bp, Homo sapiens
gagtgtctggaattgtgg

SEQ ID NO: 2324296 - DNA, 13 bp, Homo sapiens
gagttaagaagct

SEQ ID NO: 2324297 - DNA, 16 bp, Homo sapiens
gagttaagaagctgtt

SEQ ID NO: 2324298 - DNA, 18 bp, Homo sapiens
gagttatcatgaatttta

SEQ ID NO: 2324299 - DNA, 19 bp, Homo sapiens
gagttatcatgaattttaa

SEQ ID NO: 2324300 - DNA, 20 bp, Homo sapiens
gagttatcatgaattttaaa

SEQ ID NO: 2324301 - DNA, 23 bp, Homo sapiens
gagttatcatgaattttaaagta

SEQ ID NO: 2324302 - DNA, 20 bp, Homo sapiens
gagttatgataacaccagtg

SEQ ID NO: 2324303 - DNA, 22 bp, Homo sapiens
gagttatgataacaccagtggg

SEQ ID NO: 2324304 - DNA, 22 bp, Homo sapiens
gagttcaataaatgtctgttga

SEQ ID NO: 2324305 - DNA, 22 bp, Homo sapiens
gagttcccttgaaactttggga

SEQ ID NO: 2324306 - DNA, 15 bp, Homo sapiens
gagttcttgtgccat

SEQ ID NO: 2324307 - DNA, 12 bp, Homo sapiens
gagttgaggcca

SEQ ID NO: 2324308 - DNA, 16 bp, Homo sapiens
gagttgattgtctagt

SEQ ID NO: 2324309 - DNA, 23 bp, Homo sapiens
gagttgattgtctagtgaggaag

SEQ ID NO: 2324310 - DNA, 16 bp, Homo sapiens
gagttttcattaaatc

SEQ ID NO: 2324311 - DNA, 15 bp, Homo sapiens
gagtttttcctccca

SEQ ID NO: 2324312 - DNA, 20 bp, Homo sapiens
gagtttttcctcccagtgag

SEQ ID NO: 2324313 - DNA, 17 bp, Homo sapiens
gataaaataaataattt

SEQ ID NO: 2324314 - DNA, 18 bp, Homo sapiens
gataaaataaataatttt

SEQ ID NO: 2324315 - DNA, 17 bp, Homo sapiens
gataaaccaaaaacatt

SEQ ID NO: 2324316 - DNA, 19 bp, Homo sapiens
gataaaccaaaaacatttg

SEQ ID NO: 2324317 - DNA, 13 bp, Homo sapiens
gataaagaaaaga

SEQ ID NO: 2324318 - DNA, 16 bp, Homo sapiens
gataaagaaaagacat

SEQ ID NO: 2324319 - DNA, 18 bp, Homo sapiens
gataaagaaaagacattt

SEQ ID NO: 2324320 - DNA, 17 bp, Homo sapiens
gataaatcataaagtca

SEQ ID NO: 2324321 - DNA, 15 bp, Homo sapiens
gataacaccagtggg

SEQ ID NO: 2324322 - DNA, 22 bp, Homo sapiens
gataacagagtgatttgtaaaa

SEQ ID NO: 2324323 - DNA, 14 bp, Homo sapiens
gataagggaaaaga

SEQ ID NO: 2324324 - DNA, 22 bp, Homo sapiens
gataatattgtttggtaaatgt

SEQ ID NO: 2324325 - DNA, 14 bp, Homo sapiens
gataatgttaaatt

SEQ ID NO: 2324326 - DNA, 21 bp, Homo sapiens
gataatgttaaatttgtaagt

SEQ ID NO: 2324327 - DNA, 14 bp, Homo sapiens
gatacaataaaaca

SEQ ID NO: 2324328 - DNA, 18 bp, Homo sapiens
gataccacaaaccctgct

SEQ ID NO: 2324329 - DNA, 22 bp, Homo sapiens
gatactttagtacaatttcaac

SEQ ID NO: 2324330 - DNA, 21 bp, Homo sapiens
gatagaaaacagcccccactc

SEQ ID NO: 2324331 - DNA, 21 bp, Homo sapiens
gatagacttgggatggggagg

SEQ ID NO: 2324332 - DNA, 13 bp, Homo sapiens
gatagtaagcata

SEQ ID NO: 2324333 - DNA, 23 bp, Homo sapiens
gatagtcttggaagctgtttgga

SEQ ID NO: 2324334 - DNA, 19 bp, Homo sapiens
gatatataggctattttct

SEQ ID NO: 2324335 - DNA, 21 bp, Homo sapiens
gatatataggctattttctaa

SEQ ID NO: 2324336 - DNA, 23 bp, Homo sapiens
gatatattttacaattttttatc

SEQ ID NO: 2324337 - DNA, 11 bp, Homo sapiens
gatatcctctc

SEQ ID NO: 2324338 - DNA, 20 bp, Homo sapiens
gatatcctctccccctcctc

SEQ ID NO: 2324339 - DNA, 23 bp, Homo sapiens
gatatcctctccccctcctccag

SEQ ID NO: 2324340 - DNA, 15 bp, Homo sapiens
gatatggcagaagac

SEQ ID NO: 2324341 - DNA, 17 bp, Homo sapiens
gatatggcagaagacac

SEQ ID NO: 2324342 - DNA, 14 bp, Homo sapiens
gatattatagaaaa

SEQ ID NO: 2324343 - DNA, 16 bp, Homo sapiens
gatattatagaaaatt

SEQ ID NO: 2324344 - DNA, 19 bp, Homo sapiens
gatattatttcttctctta

SEQ ID NO: 2324345 - DNA, 17 bp, Homo sapiens
gatattcagatgtatgt

SEQ ID NO: 2324346 - DNA, 16 bp, Homo sapiens
gatattgaatgttaaa

SEQ ID NO: 2324347 - DNA, 16 bp, Homo sapiens
gatattggttcttccc

SEQ ID NO: 2324348 - DNA, 17 bp, Homo sapiens
gatatttcctaaggcat

SEQ ID NO: 2324349 - DNA, 23 bp, Homo sapiens
gatattttatctattggcctgtt

SEQ ID NO: 2324350 - DNA, 15 bp, Homo sapiens
gatattttctgtgcc

SEQ ID NO: 2324351 - DNA, 17 bp, Homo sapiens
gatatttttatctttat

SEQ ID NO: 2324352 - DNA, 16 bp, Homo sapiens
gatcaaatagttgcat

SEQ ID NO: 2324353 - DNA, 18 bp, Homo sapiens
gatcacgatgtaaattat

SEQ ID NO: 2324354 - DNA, 21 bp, Homo sapiens
gatcagcctccgccattccaa

SEQ ID NO: 2324355 - DNA, 21 bp, Homo sapiens
gatcatagctcactgcagcct

SEQ ID NO: 2324356 - DNA, 15 bp, Homo sapiens
gatcatcaacaagat

SEQ ID NO: 2324357 - DNA, 14 bp, Homo sapiens
gatcatggtgtaat

SEQ ID NO: 2324358 - DNA, 18 bp, Homo sapiens
gatcatggtgtaataaga

SEQ ID NO: 2324359 - DNA, 23 bp, Homo sapiens
gatcatggtgtaataagacataa

SEQ ID NO: 2324360 - DNA, 14 bp, Homo sapiens
gatccactttgggg

SEQ ID NO: 2324361 - DNA, 19 bp, Homo sapiens
gcattttagaaactacaaa

SEQ ID NO: 2324362 - DNA, 21 bp, Homo sapiens
gcattttagaaactacaaata

SEQ ID NO: 2324363 - DNA, 22 bp, Homo sapiens
gcattttcacattttgcctttc

SEQ ID NO: 2324364 - DNA, 13 bp, Homo sapiens
gcattttcctcct

SEQ ID NO: 2324365 - DNA, 17 bp, Homo sapiens
gcattttcctcctctgc

SEQ ID NO: 2324366 - DNA, 13 bp, Homo sapiens
gcattttgaaaca

SEQ ID NO: 2324367 - DNA, 18 bp, Homo sapiens
gcatttttattaaagcat

SEQ ID NO: 2324368 - DNA, 19 bp, Homo sapiens
gcatttttattaaagcatt

SEQ ID NO: 2324369 - DNA, 20 bp, Homo sapiens
gcatttttcaatatattgaa

SEQ ID NO: 2324370 - DNA, 21 bp, Homo sapiens
gcatttttcaatatattgaac

SEQ ID NO: 2324371 - DNA, 13 bp, Homo sapiens
gccaaaaatacag

SEQ ID NO: 2324372 - DNA, 19 bp, Homo sapiens
gccaaaagtccctccctgc

SEQ ID NO: 2324373 - DNA, 23 bp, Homo sapiens
gccaaaagtccctccctgcctga

SEQ ID NO: 2324374 - DNA, 18 bp, Homo sapiens
gccaaaccaggaccctgt

SEQ ID NO: 2324375 - DNA, 15 bp, Homo sapiens
gccaaagatttcata

SEQ ID NO: 2324376 - DNA, 18 bp, Homo sapiens
gccaaagatttcatatct

SEQ ID NO: 2324377 - DNA, 15 bp, Homo sapiens
gccaaagtacagaat

SEQ ID NO: 2324378 - DNA, 15 bp, Homo sapiens
gccaaatagcaaaga

SEQ ID NO: 2324379 - DNA, 16 bp, Homo sapiens
gccaacaactctgcct

SEQ ID NO: 2324380 - DNA, 18 bp, Homo sapiens
gccaacaactctgccttt

SEQ ID NO: 2324381 - DNA, 12 bp, Homo sapiens
gccaagggaaag

SEQ ID NO: 2324382 - DNA, 19 bp, Homo sapiens
gccaagtggggtgctggga

SEQ ID NO: 2324383 - DNA, 16 bp, Homo sapiens
gccaatacagacaaag

SEQ ID NO: 2324384 - DNA, 18 bp, Homo sapiens
gccaatgccccactggca

SEQ ID NO: 2324385 - DNA, 22 bp, Homo sapiens
gccaatttcctctccactgctg

SEQ ID NO: 2324386 - DNA, 22 bp, Homo sapiens
gccacaagctgcactgtgaacc

SEQ ID NO: 2324387 - DNA, 23 bp, Homo sapiens
gccacagccagaggagggcagag

SEQ ID NO: 2324388 - DNA, 15 bp, Homo sapiens
gccacagcgccagcc

SEQ ID NO: 2324389 - DNA, 19 bp, Homo sapiens
gccacagctgctgttctca

SEQ ID NO: 2324390 - DNA, 20 bp, Homo sapiens
gccacaggaaggaggggaga

SEQ ID NO: 2324391 - DNA, 21 bp, Homo sapiens
gccacaggaaggaggggagag

SEQ ID NO: 2324392 - DNA, 16 bp, Homo sapiens
gccacatcaaaccttt

SEQ ID NO: 2324393 - DNA, 13 bp, Homo sapiens
gccaccacttcca

SEQ ID NO: 2324394 - DNA, 17 bp, Homo sapiens
gccaccacttccagagc

SEQ ID NO: 2324395 - DNA, 13 bp, Homo sapiens
gccaccagccccc

SEQ ID NO: 2324396 - DNA, 19 bp, Homo sapiens
gccacccagtagcccagag

SEQ ID NO: 2324397 - DNA, 22 bp, Homo sapiens
gccaccgcgggtgtgggaaagc

SEQ ID NO: 2324398 - DNA, 16 bp, Homo sapiens
gccaccgtgcctggct

SEQ ID NO: 2324399 - DNA, 17 bp, Homo sapiens
gccaccgtgcctggcta

SEQ ID NO: 2324400 - DNA, 11 bp, Homo sapiens
gccacctgcaa

SEQ ID NO: 2324401 - DNA, 13 bp, Homo sapiens
gccacctgcaaga

SEQ ID NO: 2324402 - DNA, 19 bp, Homo sapiens
gccacgcagtgcctggagt

SEQ ID NO: 2324403 - DNA, 16 bp, Homo sapiens
gccactcccctccact

SEQ ID NO: 2324404 - DNA, 16 bp, Homo sapiens
gccactgacttgctgt

SEQ ID NO: 2324405 - DNA, 18 bp, Homo sapiens
gccactgtgttccttccg

SEQ ID NO: 2324406 - DNA, 23 bp, Homo sapiens
gccactttacccacctagaacac

SEQ ID NO: 2324407 - DNA, 17 bp, Homo sapiens
gccagacaaaatttgag

SEQ ID NO: 2324408 - DNA, 21 bp, Homo sapiens
gccagacaaaatttgagaata

SEQ ID NO: 2324409 - DNA, 11 bp, Homo sapiens
gccagacatgg

SEQ ID NO: 2324410 - DNA, 13 bp, Homo sapiens
gccagacatggac

SEQ ID NO: 2324411 - DNA, 16 bp, Homo sapiens
gccagaccagcaggct

SEQ ID NO: 2324412 - DNA, 18 bp, Homo sapiens
gccagagccccaagcagg

SEQ ID NO: 2324413 - DNA, 17 bp, Homo sapiens
gccagaggaatcctggc

SEQ ID NO: 2324414 - DNA, 22 bp, Homo sapiens
gccagaggaatcctggcagccc

SEQ ID NO: 2324415 - DNA, 24 bp, Homo sapiens
gccagaggaatcctggcagcccag

SEQ ID NO: 2324416 - DNA, 13 bp, Homo sapiens
gccagaggagggc

SEQ ID NO: 2324417 - DNA, 19 bp, Homo sapiens
gccagagtcaccttttctg

SEQ ID NO: 2324418 - DNA, 20 bp, Homo sapiens
gccagattctgcctctctgg

SEQ ID NO: 2324419 - DNA, 16 bp, Homo sapiens
gccagcaaataaatac

SEQ ID NO: 2324420 - DNA, 19 bp, Homo sapiens
gccagcagcagcaggtgat

SEQ ID NO: 2324421 - DNA, 21 bp, Homo sapiens
gccagcattttcacattttgc

SEQ ID NO: 2324422 - DNA, 15 bp, Homo sapiens
gccagcccctcttcc

SEQ ID NO: 2324423 - DNA, 20 bp, Homo sapiens
gccagcccctcttccccaat

SEQ ID NO: 2324424 - DNA, 15 bp, Homo sapiens
gccagcccctggggc

SEQ ID NO: 2324425 - DNA, 21 bp, Homo sapiens
gccagcccctggggcccagcc

SEQ ID NO: 2324426 - DNA, 15 bp, Homo sapiens
gccagcctcagactg

SEQ ID NO: 2324427 - DNA, 17 bp, Homo sapiens
gccagcctcctctggac

SEQ ID NO: 2324428 - DNA, 18 bp, Homo sapiens
gccagccttgagccctgg

SEQ ID NO: 2324429 - DNA, 20 bp, Homo sapiens
gccagccttgagccctggct

SEQ ID NO: 2324430 - DNA, 13 bp, Homo sapiens
gccaggaagccag

SEQ ID NO: 2324431 - DNA, 15 bp, Homo sapiens
gccaggaagccagag

SEQ ID NO: 2324432 - DNA, 16 bp, Homo sapiens
gccaggaagccagagc

SEQ ID NO: 2324433 - DNA, 18 bp, Homo sapiens
gccaggaagccagagccc

SEQ ID NO: 2324434 - DNA, 17 bp, Homo sapiens
gccaggatcatggtgta

SEQ ID NO: 2324435 - DNA, 13 bp, Homo sapiens
gccaggccagcct

SEQ ID NO: 2324436 - DNA, 19 bp, Homo sapiens
gccaggccagcctccgaga

SEQ ID NO: 2324437 - DNA, 11 bp, Homo sapiens
gccaggcctgg

SEQ ID NO: 2324438 - DNA, 15 bp, Homo sapiens
gccaggctgtaagca

SEQ ID NO: 2324439 - DNA, 15 bp, Homo sapiens
gccagggcagggtct

SEQ ID NO: 2324440 - DNA, 22 bp, Homo sapiens
gccagggcctctccaaccactg

SEQ ID NO: 2324441 - DNA, 19 bp, Homo sapiens
gccagtccaccctgcctgc

SEQ ID NO: 2324442 - DNA, 20 bp, Homo sapiens
gccagtccccatttctgcct

SEQ ID NO: 2324443 - DNA, 23 bp, Homo sapiens
gccagtccccatttctgcctcgc

SEQ ID NO: 2324444 - DNA, 15 bp, Homo sapiens
gccagtgacctttga

SEQ ID NO: 2324445 - DNA, 18 bp, Homo sapiens
gccagttgatctgctctg

SEQ ID NO: 2324446 - DNA, 21 bp, Homo sapiens
gccagttgggctcgcactgcc

SEQ ID NO: 2324447 - DNA, 16 bp, Homo sapiens
gccataaacggttcct

SEQ ID NO: 2324448 - DNA, 16 bp, Homo sapiens
gccatagtcacatggc

SEQ ID NO: 2324449 - DNA, 20 bp, Homo sapiens
gccatatatgaccagaagcc

SEQ ID NO: 2324450 - DNA, 23 bp, Homo sapiens
gccatatatgaccagaagccttg

SEQ ID NO: 2324451 - DNA, 23 bp, Homo sapiens
gccatcctcaaacgacagaggag

SEQ ID NO: 2324452 - DNA, 21 bp, Homo sapiens
gccatctcatgaggggagagg

SEQ ID NO: 2324453 - DNA, 12 bp, Homo sapiens
gccatcttcagg

SEQ ID NO: 2324454 - DNA, 13 bp, Homo sapiens
gccatcttcagga

SEQ ID NO: 2324455 - DNA, 15 bp, Homo sapiens
gccatgaagggaccc

SEQ ID NO: 2324456 - DNA, 19 bp, Homo sapiens
gccatgaatctctgcctct

SEQ ID NO: 2324457 - DNA, 20 bp, Homo sapiens
gccatgaatctctgcctctc

SEQ ID NO: 2324458 - DNA, 14 bp, Homo sapiens
gccatgacagaggc

SEQ ID NO: 2324459 - DNA, 15 bp, Homo sapiens
gccatgacagaggct

SEQ ID NO: 2324460 - DNA, 19 bp, Homo sapiens
gccatgatcagacatacag

SEQ ID NO: 2324461 - DNA, 17 bp, Homo sapiens
gccatgcaggaggtgga

SEQ ID NO: 2324462 - DNA, 21 bp, Homo sapiens
gccatgcaggaggtggagaaa

SEQ ID NO: 2324463 - DNA, 14 bp, Homo sapiens
gccatgccagctgg

SEQ ID NO: 2324464 - DNA, 16 bp, Homo sapiens
gccatgccagctggcc

SEQ ID NO: 2324465 - DNA, 17 bp, Homo sapiens
gccatggaataaaccat

SEQ ID NO: 2324466 - DNA, 17 bp, Homo sapiens
gccatggcctgcaaact

SEQ ID NO: 2324467 - DNA, 23 bp, Homo sapiens
gccatggcctgcaaactgggaac

SEQ ID NO: 2324468 - DNA, 15 bp, Homo sapiens
gccatgggcctgctg

SEQ ID NO: 2324469 - DNA, 23 bp, Homo sapiens
gccatgtctgcagtgtgcccccc

SEQ ID NO: 2324470 - DNA, 14 bp, Homo sapiens
gccatgtcttctcc

SEQ ID NO: 2324471 - DNA, 12 bp, Homo sapiens
gccatgtgcata

SEQ ID NO: 2324472 - DNA, 15 bp, Homo sapiens
gccatgttgcccctt

SEQ ID NO: 2324473 - DNA, 22 bp, Homo sapiens
gccattcacttcataatccagt

SEQ ID NO: 2324474 - DNA, 22 bp, Homo sapiens
gccattctgccgccccctcctg

SEQ ID NO: 2324475 - DNA, 20 bp, Homo sapiens
gccttccagggatttgcctc

SEQ ID NO: 2324476 - DNA, 21 bp, Homo sapiens
gccttccagggatttgcctca

SEQ ID NO: 2324477 - DNA, 19 bp, Homo sapiens
gccttcccaagttgtgctt

SEQ ID NO: 2324478 - DNA, 23 bp, Homo sapiens
gccttccctagctttagaccctg

SEQ ID NO: 2324479 - DNA, 16 bp, Homo sapiens
gccttctcagaagcac

SEQ ID NO: 2324480 - DNA, 17 bp, Homo sapiens
gccttctcatgatccaa

SEQ ID NO: 2324481 - DNA, 15 bp, Homo sapiens
gccttctccatatct

SEQ ID NO: 2324482 - DNA, 23 bp, Homo sapiens
gccttctccatatctccatggcc

SEQ ID NO: 2324483 - DNA, 16 bp, Homo sapiens
gccttgagccctggct

SEQ ID NO: 2324484 - DNA, 23 bp, Homo sapiens
gccttgatgactgccttgcctcc

SEQ ID NO: 2324485 - DNA, 14 bp, Homo sapiens
gccttgcataccca

SEQ ID NO: 2324486 - DNA, 16 bp, Homo sapiens
gccttgcctcctcagt

SEQ ID NO: 2324487 - DNA, 17 bp, Homo sapiens
gccttgcctcctcagta

SEQ ID NO: 2324488 - DNA, 19 bp, Homo sapiens
gccttgctgtttgtcctga

SEQ ID NO: 2324489 - DNA, 23 bp, Homo sapiens
gccttggaaatagaaagaagcca

SEQ ID NO: 2324490 - DNA, 18 bp, Homo sapiens
gccttggaaccagcccca

SEQ ID NO: 2324491 - DNA, 23 bp, Homo sapiens
gccttggaaccagccccatcaga

SEQ ID NO: 2324492 - DNA, 12 bp, Homo sapiens
gccttggcctcc

SEQ ID NO: 2324493 - DNA, 19 bp, Homo sapiens
gccttgtataatattgaaa

SEQ ID NO: 2324494 - DNA, 13 bp, Homo sapiens
gcctttccttccc

SEQ ID NO: 2324495 - DNA, 16 bp, Homo sapiens
gcctttccttccctct

SEQ ID NO: 2324496 - DNA, 19 bp, Homo sapiens
gcctttccttccctctctg

SEQ ID NO: 2324497 - DNA, 15 bp, Homo sapiens
gcctttcgaggcctg

SEQ ID NO: 2324498 - DNA, 16 bp, Homo sapiens
gcctttcgaggcctga

SEQ ID NO: 2324499 - DNA, 19 bp, Homo sapiens
gcctttcgaggcctgaagc

SEQ ID NO: 2324500 - DNA, 22 bp, Homo sapiens
gcctttctcgtggtagaagcca

SEQ ID NO: 2324501 - DNA, 12 bp, Homo sapiens
gcctttcttctg

SEQ ID NO: 2324502 - DNA, 11 bp, Homo sapiens
gcctttgaatg

SEQ ID NO: 2324503 - DNA, 16 bp, Homo sapiens
gcctttgtgctgcgcc

SEQ ID NO: 2324504 - DNA, 13 bp, Homo sapiens
gccttttctgtga

SEQ ID NO: 2324505 - DNA, 15 bp, Homo sapiens
gccttttctgtgatt

SEQ ID NO: 2324506 - DNA, 19 bp, Homo sapiens
gccttttgttttcattggt

SEQ ID NO: 2324507 - DNA, 19 bp, Homo sapiens
gcgaagaccctcttgccca

SEQ ID NO: 2324508 - DNA, 22 bp, Homo sapiens
gcgaagaccctcttgcccatcc

SEQ ID NO: 2324509 - DNA, 12 bp, Homo sapiens
gcgagggcagct

SEQ ID NO: 2324510 - DNA, 13 bp, Homo sapiens
gcgagggcagctg

SEQ ID NO: 2324511 - DNA, 16 bp, Homo sapiens
gcgagtccaaggccag

SEQ ID NO: 2324512 - DNA, 17 bp, Homo sapiens
gcgagtctggggacctg

SEQ ID NO: 2324513 - DNA, 18 bp, Homo sapiens
gcgatctctcctggccta

SEQ ID NO: 2324514 - DNA, 19 bp, Homo sapiens
gcgcaggtgggctggactt

SEQ ID NO: 2324515 - DNA, 14 bp, Homo sapiens
gcgccaggaagcca

SEQ ID NO: 2324516 - DNA, 17 bp, Homo sapiens
gcgccaggaagccagag

SEQ ID NO: 2324517 - DNA, 19 bp, Homo sapiens
gcgccaggaagccagagcc

SEQ ID NO: 2324518 - DNA, 13 bp, Homo sapiens
gcgccagtcctgc

SEQ ID NO: 2324519 - DNA, 20 bp, Homo sapiens
gcgccctgcctcctggagga

SEQ ID NO: 2324520 - DNA, 23 bp, Homo sapiens
gcgccctgcctcctggaggacca

SEQ ID NO: 2324521 - DNA, 16 bp, Homo sapiens
gcgcccttggcttctg

SEQ ID NO: 2324522 - DNA, 15 bp, Homo sapiens
gcgcctcagccctca

SEQ ID NO: 2324523 - DNA, 14 bp, Homo sapiens
gcgcctgcaggcag

SEQ ID NO: 2324524 - DNA, 15 bp, Homo sapiens
gcgcctgcaggcaga

SEQ ID NO: 2324525 - DNA, 21 bp, Homo sapiens
gcgcctgcaggcagagctgga

SEQ ID NO: 2324526 - DNA, 12 bp, Homo sapiens
gcgcctgctgcc

SEQ ID NO: 2324527 - DNA, 14 bp, Homo sapiens
gcgcctgctgcctg

SEQ ID NO: 2324528 - DNA, 18 bp, Homo sapiens
gcgcctgctgcctgctga

SEQ ID NO: 2324529 - DNA, 17 bp, Homo sapiens
gcgcgccaccgtgcctg

SEQ ID NO: 2324530 - DNA, 18 bp, Homo sapiens
gcgcgccaccgtgcctgg

SEQ ID NO: 2324531 - DNA, 20 bp, Homo sapiens
gcgcggtggctcacgcctgt

SEQ ID NO: 2324532 - DNA, 15 bp, Homo sapiens
gcgctcagtaaacgg

SEQ ID NO: 2324533 - DNA, 17 bp, Homo sapiens
gcgctcagtaaacggga

SEQ ID NO: 2324534 - DNA, 14 bp, Homo sapiens
gcggcaaaaggaaa

SEQ ID NO: 2324535 - DNA, 20 bp, Homo sapiens
gcggcacgccaacagccccc

SEQ ID NO: 2324536 - DNA, 14 bp, Homo sapiens
gcggcctccttctg

SEQ ID NO: 2324537 - DNA, 19 bp, Homo sapiens
gcggcctccttctgagctc

SEQ ID NO: 2324538 - DNA, 16 bp, Homo sapiens
gcgggacagagtagcc

SEQ ID NO: 2324539 - DNA, 15 bp, Homo sapiens
gcgggtgatggccag

SEQ ID NO: 2324540 - DNA, 20 bp, Homo sapiens
gcgggtgatggccagcccct

SEQ ID NO: 2324541 - DNA, 19 bp, Homo sapiens
gcgggtggatcacgaggtc

SEQ ID NO: 2324542 - DNA, 21 bp, Homo sapiens
gcggtgccatgtctgcagtgt

SEQ ID NO: 2324543 - DNA, 15 bp, Homo sapiens
gcggtggctcacgcc

SEQ ID NO: 2324544 - DNA, 19 bp, Homo sapiens
gcggtttcacgccccacac

SEQ ID NO: 2324545 - DNA, 15 bp, Homo sapiens
gcgtagagagccggg

SEQ ID NO: 2324546 - DNA, 20 bp, Homo sapiens
gcgtcctcctcacctcatgc

SEQ ID NO: 2324547 - DNA, 13 bp, Homo sapiens
gcgtctgccccac

SEQ ID NO: 2324548 - DNA, 23 bp, Homo sapiens
gcgtggctctaaaaggtaatgtg

SEQ ID NO: 2324549 - DNA, 22 bp, Homo sapiens
gcgtgtgtagagttaagaagct

SEQ ID NO: 2324550 - DNA, 22 bp, Homo sapiens
gctaaaaatgagcttgattaaa

SEQ ID NO: 2324551 - DNA, 23 bp, Homo sapiens
gctaaagagcccttgcctcccca

SEQ ID NO: 2324552 - DNA, 14 bp, Homo sapiens
gctaacaaagacaa

SEQ ID NO: 2324553 - DNA, 20 bp, Homo sapiens
gctaacatggtgaaaccccg

SEQ ID NO: 2324554 - DNA, 14 bp, Homo sapiens
gctaagtgcttatt

SEQ ID NO: 2324555 - DNA, 13 bp, Homo sapiens
gctacaaactttt

SEQ ID NO: 2324556 - DNA, 23 bp, Homo sapiens
gctacacctattatcccagctgc

SEQ ID NO: 2324557 - DNA, 16 bp, Homo sapiens
gctacatgctggggtc

SEQ ID NO: 2324558 - DNA, 13 bp, Homo sapiens
gctacctcaaggg

SEQ ID NO: 2324559 - DNA, 13 bp, Homo sapiens
gctacctcagaaa

SEQ ID NO: 2324560 - DNA, 14 bp, Homo sapiens
gctactaatgatgt

SEQ ID NO: 2324561 - DNA, 18 bp, Homo sapiens
gctactaatgatgttttc

SEQ ID NO: 2324562 - DNA, 20 bp, Homo sapiens
gctactggggaaactggcca

SEQ ID NO: 2324563 - DNA, 17 bp, Homo sapiens
gctacttatattctgca

SEQ ID NO: 2324564 - DNA, 15 bp, Homo sapiens
gctagctgccacttt

SEQ ID NO: 2324565 - DNA, 16 bp, Homo sapiens
gctagctgccactttc

SEQ ID NO: 2324566 - DNA, 15 bp, Homo sapiens
gctagcttctgcttt

SEQ ID NO: 2324567 - DNA, 17 bp, Homo sapiens
gctagcttctgcttttc

SEQ ID NO: 2324568 - DNA, 22 bp, Homo sapiens
gctagcttctgcttttctgccc

SEQ ID NO: 2324569 - DNA, 16 bp, Homo sapiens
gctatcaggagaaagc

SEQ ID NO: 2324570 - DNA, 23 bp, Homo sapiens
gctatccccatctccctgcctgg

SEQ ID NO: 2324571 - DNA, 18 bp, Homo sapiens
gctatcgccctcctttcc

SEQ ID NO: 2324572 - DNA, 21 bp, Homo sapiens
gctatgagttgaaatgttctg

SEQ ID NO: 2324573 - DNA, 21 bp, Homo sapiens
gctatgcaaaaaattctttag

SEQ ID NO: 2324574 - DNA, 19 bp, Homo sapiens
gctatggcaggataagaaa

SEQ ID NO: 2324575 - DNA, 13 bp, Homo sapiens
gctattagccagg

SEQ ID NO: 2324576 - DNA, 19 bp, Homo sapiens
gctattagccaggatcatg

SEQ ID NO: 2324577 - DNA, 16 bp, Homo sapiens
gctattcacctcagta

SEQ ID NO: 2324578 - DNA, 22 bp, Homo sapiens
gctattcacctcagtagaaaag

SEQ ID NO: 2324579 - DNA, 21 bp, Homo sapiens
gctatttaagtggactgtatt

SEQ ID NO: 2324580 - DNA, 15 bp, Homo sapiens
gctatttattttcct

SEQ ID NO: 2324581 - DNA, 13 bp, Homo sapiens
gctattttccagg

SEQ ID NO: 2324582 - DNA, 24 bp, Homo sapiens
gctattttccaggcttctgctggg

SEQ ID NO: 2324583 - DNA, 15 bp, Homo sapiens
gctattttcctctgg

SEQ ID NO: 2324584 - DNA, 12 bp, Homo sapiens
gctatttttgta

SEQ ID NO: 2324585 - DNA, 15 bp, Homo sapiens
gctcaaatgaaatgt

SEQ ID NO: 2324586 - DNA, 17 bp, Homo sapiens
gctcaagcaatcctcct

SEQ ID NO: 2324587 - DNA, 19 bp, Homo sapiens
gctcaagtctgcacagagc

SEQ ID NO: 2324588 - DNA, 15 bp, Homo sapiens
gctcaccagccctgc

SEQ ID NO: 2324589 - DNA, 16 bp, Homo sapiens
gctcaccagccctgca

SEQ ID NO: 2324590 - DNA, 18 bp, Homo sapiens
ggaagccccctcttcctc

SEQ ID NO: 2324591 - DNA, 14 bp, Homo sapiens
ggaagcccctgggc

SEQ ID NO: 2324592 - DNA, 15 bp, Homo sapiens
ggaagcccctgggcc

SEQ ID NO: 2324593 - DNA, 14 bp, Homo sapiens
ggaaggatctgctg

SEQ ID NO: 2324594 - DNA, 13 bp, Homo sapiens
ggaaggattgtaa

SEQ ID NO: 2324595 - DNA, 15 bp, Homo sapiens
ggaaggcagagaaat

SEQ ID NO: 2324596 - DNA, 14 bp, Homo sapiens
ggaaggccctgagg

SEQ ID NO: 2324597 - DNA, 14 bp, Homo sapiens
ggaaggcctttctt

SEQ ID NO: 2324598 - DNA, 16 bp, Homo sapiens
ggaaggcctttcttct

SEQ ID NO: 2324599 - DNA, 18 bp, Homo sapiens
ggaaggcctttcttctgt

SEQ ID NO: 2324600 - DNA, 16 bp, Homo sapiens
ggaagggatctgagaa

SEQ ID NO: 2324601 - DNA, 22 bp, Homo sapiens
ggaaggggttcctcaaattttt

SEQ ID NO: 2324602 - DNA, 15 bp, Homo sapiens
ggaaggtggccacag

SEQ ID NO: 2324603 - DNA, 17 bp, Homo sapiens
ggaaggtggccacagca

SEQ ID NO: 2324604 - DNA, 16 bp, Homo sapiens
ggaagtaacagacaca

SEQ ID NO: 2324605 - DNA, 19 bp, Homo sapiens
ggaagtggggtctggcctg

SEQ ID NO: 2324606 - DNA, 16 bp, Homo sapiens
ggaagtttagctctga

SEQ ID NO: 2324607 - DNA, 18 bp, Homo sapiens
ggaagtttagctctgaga

SEQ ID NO: 2324608 - DNA, 22 bp, Homo sapiens
ggaataaaaggcttgaagctgt

SEQ ID NO: 2324609 - DNA, 21 bp, Homo sapiens
ggaatccaagcctccacagcg

SEQ ID NO: 2324610 - DNA, 16 bp, Homo sapiens
ggaatgaggaaaattc

SEQ ID NO: 2324611 - DNA, 17 bp, Homo sapiens
ggaatgaggaaaattct

SEQ ID NO: 2324612 - DNA, 21 bp, Homo sapiens
ggaatgaggtgggaggtggaa

SEQ ID NO: 2324613 - DNA, 16 bp, Homo sapiens
ggaatgcaccacggca

SEQ ID NO: 2324614 - DNA, 18 bp, Homo sapiens
ggaatgcaccacggcagc

SEQ ID NO: 2324615 - DNA, 18 bp, Homo sapiens
ggaattctcaagacctga

SEQ ID NO: 2324616 - DNA, 21 bp, Homo sapiens
ggacaactgctcccacctcct

SEQ ID NO: 2324617 - DNA, 13 bp, Homo sapiens
ggacacacagcct

SEQ ID NO: 2324618 - DNA, 17 bp, Homo sapiens
ggacacagacccaggac

SEQ ID NO: 2324619 - DNA, 16 bp, Homo sapiens
ggacacagttcctggg

SEQ ID NO: 2324620 - DNA, 21 bp, Homo sapiens
ggacacagttcctgggaacat

SEQ ID NO: 2324621 - DNA, 22 bp, Homo sapiens
ggacacattggaatgccttgga

SEQ ID NO: 2324622 - DNA, 21 bp, Homo sapiens
ggacaccattaccaaaataat

SEQ ID NO: 2324623 - DNA, 22 bp, Homo sapiens
ggacaccccccgccccccacct

SEQ ID NO: 2324624 - DNA, 18 bp, Homo sapiens
ggacactccagggacaca

SEQ ID NO: 2324625 - DNA, 22 bp, Homo sapiens
ggacactccagggacacacagc

SEQ ID NO: 2324626 - DNA, 20 bp, Homo sapiens
ggacactcgtcaccccagcc

SEQ ID NO: 2324627 - DNA, 17 bp, Homo sapiens
ggacactgtcagtgcta

SEQ ID NO: 2324628 - DNA, 14 bp, Homo sapiens
ggacagaaagagac

SEQ ID NO: 2324629 - DNA, 15 bp, Homo sapiens
ggacagcagaagcct

SEQ ID NO: 2324630 - DNA, 16 bp, Homo sapiens
ggacagcatcccttcc

SEQ ID NO: 2324631 - DNA, 15 bp, Homo sapiens
ggacagcgggaaaaa

SEQ ID NO: 2324632 - DNA, 21 bp, Homo sapiens
ggacatgatttagggaagcag

SEQ ID NO: 2324633 - DNA, 16 bp, Homo sapiens
ggacatttctataaaa

SEQ ID NO: 2324634 - DNA, 16 bp, Homo sapiens
ggaccaacctgctctg

SEQ ID NO: 2324635 - DNA, 23 bp, Homo sapiens
ggaccaacctgctctgtccccaa

SEQ ID NO: 2324636 - DNA, 17 bp, Homo sapiens
ggaccagggccctgggc

SEQ ID NO: 2324637 - DNA, 18 bp, Homo sapiens
ggaccagggccctgggca

SEQ ID NO: 2324638 - DNA, 13 bp, Homo sapiens
ggaccatgccaga

SEQ ID NO: 2324639 - DNA, 16 bp, Homo sapiens
ggacccagggaacagc

SEQ ID NO: 2324640 - DNA, 17 bp, Homo sapiens
ggaccccagccatccag

SEQ ID NO: 2324641 - DNA, 22 bp, Homo sapiens
ggaccctgtgacatggtgcctg

SEQ ID NO: 2324642 - DNA, 17 bp, Homo sapiens
ggaccgcgtagagagcc

SEQ ID NO: 2324643 - DNA, 18 bp, Homo sapiens
ggacctatcccaaatgtg

SEQ ID NO: 2324644 - DNA, 17 bp, Homo sapiens
ggacctgccaggcaggg

SEQ ID NO: 2324645 - DNA, 22 bp, Homo sapiens
ggacgcacgctcgctgccatca

SEQ ID NO: 2324646 - DNA, 21 bp, Homo sapiens
ggactctgcacatgtcttgta

SEQ ID NO: 2324647 - DNA, 12 bp, Homo sapiens
ggactgccaaat

SEQ ID NO: 2324648 - DNA, 9 bp, Homo sapiens
ggactggtg

SEQ ID NO: 2324649 - DNA, 23 bp, Homo sapiens
ggacttctacctgccctcaaggg

SEQ ID NO: 2324650 - DNA, 23 bp, Homo sapiens
ggagaaaattggaactctactca

SEQ ID NO: 2324651 - DNA, 13 bp, Homo sapiens
ggagaagcatgaa

SEQ ID NO: 2324652 - DNA, 20 bp, Homo sapiens
ggagaagggggtctctgtta

SEQ ID NO: 2324653 - DNA, 19 bp, Homo sapiens
ggagaatcgctcctgcagc

SEQ ID NO: 2324654 - DNA, 22 bp, Homo sapiens
ggagaatggtgtgaacccggga

SEQ ID NO: 2324655 - DNA, 15 bp, Homo sapiens
ggagacaaaagagca

SEQ ID NO: 2324656 - DNA, 16 bp, Homo sapiens
ggagacagaggaaagg

SEQ ID NO: 2324657 - DNA, 15 bp, Homo sapiens
ggagaccccccccca

SEQ ID NO: 2324658 - DNA, 12 bp, Homo sapiens
ggagaccctgcc

SEQ ID NO: 2324659 - DNA, 13 bp, Homo sapiens
ggagagacaggca

SEQ ID NO: 2324660 - DNA, 21 bp, Homo sapiens
ggagagacaggcagcccagca

SEQ ID NO: 2324661 - DNA, 19 bp, Homo sapiens
ggagagagagagagagagg

SEQ ID NO: 2324662 - DNA, 12 bp, Homo sapiens
ggagagcagctg

SEQ ID NO: 2324663 - DNA, 14 bp, Homo sapiens
ggagagcagctggc

SEQ ID NO: 2324664 - DNA, 15 bp, Homo sapiens
ggagagcagctggct

SEQ ID NO: 2324665 - DNA, 13 bp, Homo sapiens
ggagagcctgctg

SEQ ID NO: 2324666 - DNA, 18 bp, Homo sapiens
ggagagggatttccctgc

SEQ ID NO: 2324667 - DNA, 20 bp, Homo sapiens
ggagatgcttctctccttgc

SEQ ID NO: 2324668 - DNA, 12 bp, Homo sapiens
ggagcccagggc

SEQ ID NO: 2324669 - DNA, 22 bp, Homo sapiens
ggagcccccagcagaggcaggc

SEQ ID NO: 2324670 - DNA, 23 bp, Homo sapiens
ggagcctgcatttcctcgcagcc

SEQ ID NO: 2324671 - DNA, 21 bp, Homo sapiens
ggagccttcccaagttgtgct

SEQ ID NO: 2324672 - DNA, 23 bp, Homo sapiens
ggagccttcccaagttgtgcttg

SEQ ID NO: 2324673 - DNA, 21 bp, Homo sapiens
ggagcttgggcagtgccccag

SEQ ID NO: 2324674 - DNA, 13 bp, Homo sapiens
ggaggaaaattcc

SEQ ID NO: 2324675 - DNA, 18 bp, Homo sapiens
ggaggaagagccacctgc

SEQ ID NO: 2324676 - DNA, 13 bp, Homo sapiens
ggaggaaggcaag

SEQ ID NO: 2324677 - DNA, 21 bp, Homo sapiens
ggaggaaggcctttcttctgt

SEQ ID NO: 2324678 - DNA, 16 bp, Homo sapiens
ggaggaccagggccct

SEQ ID NO: 2324679 - DNA, 19 bp, Homo sapiens
ggaggaccagggccctggg

SEQ ID NO: 2324680 - DNA, 20 bp, Homo sapiens
ggaggaccagggccctgggc

SEQ ID NO: 2324681 - DNA, 22 bp, Homo sapiens
ggaggacggttgtaagcagttg

SEQ ID NO: 2324682 - DNA, 12 bp, Homo sapiens
ggaggagggaga

SEQ ID NO: 2324683 - DNA, 15 bp, Homo sapiens
ggaggagggggccgg

SEQ ID NO: 2324684 - DNA, 16 bp, Homo sapiens
ggaggcccttgtcgtg

SEQ ID NO: 2324685 - DNA, 16 bp, Homo sapiens
ggaggcctcaggtgct

SEQ ID NO: 2324686 - DNA, 23 bp, Homo sapiens
ggaggcgcccttggcttctgtga

SEQ ID NO: 2324687 - DNA, 15 bp, Homo sapiens
ggaggcttcctgcgt

SEQ ID NO: 2324688 - DNA, 18 bp, Homo sapiens
ggagggcaggcttgggga

SEQ ID NO: 2324689 - DNA, 20 bp, Homo sapiens
ggaggggagcgtctgggaac

SEQ ID NO: 2324690 - DNA, 17 bp, Homo sapiens
ggaggggtgtggcagtg

SEQ ID NO: 2324691 - DNA, 13 bp, Homo sapiens
ggagggtaaataa

SEQ ID NO: 2324692 - DNA, 13 bp, Homo sapiens
ggaggtcactgga

SEQ ID NO: 2324693 - DNA, 20 bp, Homo sapiens
ggaggtccttaggcctctga

SEQ ID NO: 2324694 - DNA, 20 bp, Homo sapiens
ggaggtgcgtgttcagcaga

SEQ ID NO: 2324695 - DNA, 14 bp, Homo sapiens
ggaggtgctgctct

SEQ ID NO: 2324696 - DNA, 22 bp, Homo sapiens
ggaggtgctgctctagggcagg

SEQ ID NO: 2324697 - DNA, 20 bp, Homo sapiens
ggaggtggaagaagggagaa

SEQ ID NO: 2324698 - DNA, 14 bp, Homo sapiens
ggaggttgaagcca

SEQ ID NO: 2324699 - DNA, 17 bp, Homo sapiens
ggagtgcagtggcatga

SEQ ID NO: 2324700 - DNA, 18 bp, Homo sapiens
ggagtggtgatttgaaaa

SEQ ID NO: 2324701 - DNA, 23 bp, Homo sapiens
ggagtgtaaaatgtatattttta

SEQ ID NO: 2324702 - DNA, 15 bp, Homo sapiens
ggagtgtgtctgctg

SEQ ID NO: 2324703 - DNA, 20 bp, Homo sapiens
ggagttttgtctgtctccct

SEQ ID NO: 2324704 - DNA, 18 bp, Homo sapiens
ggatactggcacagaggt

SEQ ID NO: 2324705 - DNA, 18 bp, Homo sapiens
ggtgctaaaaatgaaaat

SEQ ID NO: 2324706 - DNA, 18 bp, Homo sapiens
ggtgctactggggaaact

SEQ ID NO: 2324707 - DNA, 20 bp, Homo sapiens
ggtgctcggagaagagcgca

SEQ ID NO: 2324708 - DNA, 22 bp, Homo sapiens
ggtgctgccatgacagaggctg

SEQ ID NO: 2324709 - DNA, 23 bp, Homo sapiens
ggtgctgccatgacagaggctgc

SEQ ID NO: 2324710 - DNA, 14 bp, Homo sapiens
ggtgctgtgaggga

SEQ ID NO: 2324711 - DNA, 17 bp, Homo sapiens
ggtgctgtgagggaggg

SEQ ID NO: 2324712 - DNA, 18 bp, Homo sapiens
ggtggacccagggaacag

SEQ ID NO: 2324713 - DNA, 15 bp, Homo sapiens
ggtggaggcttcctg

SEQ ID NO: 2324714 - DNA, 21 bp, Homo sapiens
ggtggatgttatgaacagctg

SEQ ID NO: 2324715 - DNA, 22 bp, Homo sapiens
ggtggcaggtgggggtgggctg

SEQ ID NO: 2324716 - DNA, 17 bp, Homo sapiens
ggtggccacagcgccag

SEQ ID NO: 2324717 - DNA, 12 bp, Homo sapiens
ggtggctgggca

SEQ ID NO: 2324718 - DNA, 18 bp, Homo sapiens
ggtggcttaagtgagcag

SEQ ID NO: 2324719 - DNA, 17 bp, Homo sapiens
ggtgggagtgtgtctgc

SEQ ID NO: 2324720 - DNA, 16 bp, Homo sapiens
ggtgggctctgtgcag

SEQ ID NO: 2324721 - DNA, 15 bp, Homo sapiens
ggtgggcttcctgcc

SEQ ID NO: 2324722 - DNA, 22 bp, Homo sapiens
ggtgggcttcctgcccttccct

SEQ ID NO: 2324723 - DNA, 14 bp, Homo sapiens
ggtgggggagggag

SEQ ID NO: 2324724 - DNA, 16 bp, Homo sapiens
ggtgggggtggaggct

SEQ ID NO: 2324725 - DNA, 17 bp, Homo sapiens
ggtggttttttccccct

SEQ ID NO: 2324726 - DNA, 14 bp, Homo sapiens
ggtgtataaatgta

SEQ ID NO: 2324727 - DNA, 13 bp, Homo sapiens
ggtgtcaccctgc

SEQ ID NO: 2324728 - DNA, 19 bp, Homo sapiens
ggtgtcctgcctgtctgcc

SEQ ID NO: 2324729 - DNA, 16 bp, Homo sapiens
ggtgtgaacatgttct

SEQ ID NO: 2324730 - DNA, 15 bp, Homo sapiens
ggtgtgaacccggga

SEQ ID NO: 2324731 - DNA, 17 bp, Homo sapiens
ggtgtgaacccgggagc

SEQ ID NO: 2324732 - DNA, 21 bp, Homo sapiens
ggtgtgagaatgatcaaggat

SEQ ID NO: 2324733 - DNA, 22 bp, Homo sapiens
ggtgttctttcctgccctgtcc

SEQ ID NO: 2324734 - DNA, 16 bp, Homo sapiens
ggttaaggccagggcc

SEQ ID NO: 2324735 - DNA, 15 bp, Homo sapiens
ggttaataccagctt

SEQ ID NO: 2324736 - DNA, 15 bp, Homo sapiens
ggttacttcttctct

SEQ ID NO: 2324737 - DNA, 19 bp, Homo sapiens
ggttcaagccttccaggga

SEQ ID NO: 2324738 - DNA, 18 bp, Homo sapiens
ggttcaaggtcactgttt

SEQ ID NO: 2324739 - DNA, 19 bp, Homo sapiens
ggttccctcctagctctcc

SEQ ID NO: 2324740 - DNA, 21 bp, Homo sapiens
ggttccctcctagctctccca

SEQ ID NO: 2324741 - DNA, 21 bp, Homo sapiens
ggttcccttgagggctgcagt

SEQ ID NO: 2324742 - DNA, 16 bp, Homo sapiens
ggttcctaagcctgtt

SEQ ID NO: 2324743 - DNA, 17 bp, Homo sapiens
ggttcctctgcctgccc

SEQ ID NO: 2324744 - DNA, 18 bp, Homo sapiens
ggttcctggtgactcctg

SEQ ID NO: 2324745 - DNA, 17 bp, Homo sapiens
ggttcttaaaaaggaac

SEQ ID NO: 2324746 - DNA, 23 bp, Homo sapiens
ggttgatgccttttttttcatga

SEQ ID NO: 2324747 - DNA, 14 bp, Homo sapiens
ggttggagcccagg

SEQ ID NO: 2324748 - DNA, 14 bp, Homo sapiens
ggttggatggatgg

SEQ ID NO: 2324749 - DNA, 21 bp, Homo sapiens
ggttgggcagccagaccagca

SEQ ID NO: 2324750 - DNA, 14 bp, Homo sapiens
ggttgtgcactgtt

SEQ ID NO: 2324751 - DNA, 20 bp, Homo sapiens
ggtttaaacttgtttgctgt

SEQ ID NO: 2324752 - DNA, 23 bp, Homo sapiens
ggtttagcgttgttttgtggata

SEQ ID NO: 2324753 - DNA, 20 bp, Homo sapiens
gtaaaaaaaaatgcctttga

SEQ ID NO: 2324754 - DNA, 17 bp, Homo sapiens
gtaaaacagggccacat

SEQ ID NO: 2324755 - DNA, 18 bp, Homo sapiens
gtaaaagtggtctctgct

SEQ ID NO: 2324756 - DNA, 23 bp, Homo sapiens
gtaaaatccccttcgctgaaatt

SEQ ID NO: 2324757 - DNA, 20 bp, Homo sapiens
gtaaaggaaataagagcagt

SEQ ID NO: 2324758 - DNA, 17 bp, Homo sapiens
gtaaatacatgcatata

SEQ ID NO: 2324759 - DNA, 17 bp, Homo sapiens
gtaaatgcttaaatttc

SEQ ID NO: 2324760 - DNA, 23 bp, Homo sapiens
gtaaatggttaaattttacatga

SEQ ID NO: 2324761 - DNA, 12 bp, Homo sapiens
gtaaatgtcttc

SEQ ID NO: 2324762 - DNA, 11 bp, Homo sapiens
gtaaatgtttc

SEQ ID NO: 2324763 - DNA, 14 bp, Homo sapiens
gtaaatgtttcttt

SEQ ID NO: 2324764 - DNA, 20 bp, Homo sapiens
gtaacaatacatgagaaaga

SEQ ID NO: 2324765 - DNA, 14 bp, Homo sapiens
gtaacagaacagct

SEQ ID NO: 2324766 - DNA, 17 bp, Homo sapiens
gtaacagacacacgatg

SEQ ID NO: 2324767 - DNA, 17 bp, Homo sapiens
gtaacattcatgttcta

SEQ ID NO: 2324768 - DNA, 23 bp, Homo sapiens
gtaaccaatcctactaataaacc

SEQ ID NO: 2324769 - DNA, 22 bp, Homo sapiens
gtaactgccattttttgtctgt

SEQ ID NO: 2324770 - DNA, 23 bp, Homo sapiens
gtaagaacaactacctgagctaa

SEQ ID NO: 2324771 - DNA, 16 bp, Homo sapiens
gtaagaagacaaactg

SEQ ID NO: 2324772 - DNA, 13 bp, Homo sapiens
gtaagaaggcaat

SEQ ID NO: 2324773 - DNA, 19 bp, Homo sapiens
gtaagagaaaagagagaaa

SEQ ID NO: 2324774 - DNA, 18 bp, Homo sapiens
gtaagagcttgctccaga

SEQ ID NO: 2324775 - DNA, 16 bp, Homo sapiens
gtaagttatctttgaa

SEQ ID NO: 2324776 - DNA, 16 bp, Homo sapiens
gtaagtttcaggtgac

SEQ ID NO: 2324777 - DNA, 16 bp, Homo sapiens
gtaataatagactgta

SEQ ID NO: 2324778 - DNA, 19 bp, Homo sapiens
gtaatactttttaaattac

SEQ ID NO: 2324779 - DNA, 18 bp, Homo sapiens
gtaatatcagttacagtg

SEQ ID NO: 2324780 - DNA, 20 bp, Homo sapiens
gtaatatcagttacagtggc

SEQ ID NO: 2324781 - DNA, 12 bp, Homo sapiens
gtaatattatta

SEQ ID NO: 2324782 - DNA, 21 bp, Homo sapiens
gtaatattggtgctatttaac

SEQ ID NO: 2324783 - DNA, 17 bp, Homo sapiens
gtaatcccctaaaataa

SEQ ID NO: 2324784 - DNA, 13 bp, Homo sapiens
gtaattattttcc

SEQ ID NO: 2324785 - DNA, 12 bp, Homo sapiens
gtaattggtaat

SEQ ID NO: 2324786 - DNA, 18 bp, Homo sapiens
gtaattggtaattacctg

SEQ ID NO: 2324787 - DNA, 19 bp, Homo sapiens
gtaatttaaatgaaagaaa

SEQ ID NO: 2324788 - DNA, 23 bp, Homo sapiens
gtaatttaaatgaaagaaaattg

SEQ ID NO: 2324789 - DNA, 14 bp, Homo sapiens
gtaatttgaagatt

SEQ ID NO: 2324790 - DNA, 16 bp, Homo sapiens
gtaattttattttaaa

SEQ ID NO: 2324791 - DNA, 19 bp, Homo sapiens
gtaattttattttaaaatt

SEQ ID NO: 2324792 - DNA, 12 bp, Homo sapiens
gtacaaaattaa

SEQ ID NO: 2324793 - DNA, 14 bp, Homo sapiens
gtacaaaattaagc

SEQ ID NO: 2324794 - DNA, 20 bp, Homo sapiens
gtacaatagtatacatttta

SEQ ID NO: 2324795 - DNA, 19 bp, Homo sapiens
gtacaccactttcccacac

SEQ ID NO: 2324796 - DNA, 17 bp, Homo sapiens
gtacacgtgtcctgtag

SEQ ID NO: 2324797 - DNA, 21 bp, Homo sapiens
gtacacttctcttaagtggtc

SEQ ID NO: 2324798 - DNA, 19 bp, Homo sapiens
gtacagaccgagaggccag

SEQ ID NO: 2324799 - DNA, 20 bp, Homo sapiens
gtacagcagggtcttgctgt

SEQ ID NO: 2324800 - DNA, 13 bp, Homo sapiens
gtacagcggctcc

SEQ ID NO: 2324801 - DNA, 16 bp, Homo sapiens
gtacagtattctttta

SEQ ID NO: 2324802 - DNA, 20 bp, Homo sapiens
gtacatgtgtagcctgtgca

SEQ ID NO: 2324803 - DNA, 18 bp, Homo sapiens
gtacatttccaaatgaac

SEQ ID NO: 2324804 - DNA, 19 bp, Homo sapiens
gtaccaaaattttaaaaaa

SEQ ID NO: 2324805 - DNA, 19 bp, Homo sapiens
gtaccaaatccacaagcca

SEQ ID NO: 2324806 - DNA, 22 bp, Homo sapiens
gtacccaataggtaatttttca

SEQ ID NO: 2324807 - DNA, 22 bp, Homo sapiens
gtacctctcaagctagtgtttc

SEQ ID NO: 2324808 - DNA, 19 bp, Homo sapiens
gtactgaatttttttgtaa

SEQ ID NO: 2324809 - DNA, 20 bp, Homo sapiens
gtactgaatttttttgtaat

SEQ ID NO: 2324810 - DNA, 21 bp, Homo sapiens
gtacttcccgggccagggctg

SEQ ID NO: 2324811 - DNA, 22 bp, Homo sapiens
gtacttcccgggccagggctgc

SEQ ID NO: 2324812 - DNA, 18 bp, Homo sapiens
gtacttcttgaatataaa

SEQ ID NO: 2324813 - DNA, 19 bp, Homo sapiens
gtacttcttgaatataaaa

SEQ ID NO: 2324814 - DNA, 20 bp, Homo sapiens
gtacttcttgaatataaaaa

SEQ ID NO: 2324815 - DNA, 15 bp, Homo sapiens
gtactttatcatgaa

SEQ ID NO: 2324816 - DNA, 21 bp, Homo sapiens
gtactttctgttatgggcttt

SEQ ID NO: 2324817 - DNA, 13 bp, Homo sapiens
gtagaaaatgtga

SEQ ID NO: 2324818 - DNA, 15 bp, Homo sapiens
gtagaaaatgtgacc

SEQ ID NO: 2324819 - DNA, 19 bp, Homo sapiens
gtggcttaagtgagcagaa

SEQ ID NO: 2324820 - DNA, 22 bp, Homo sapiens
gtggctttccaggcaccctcag

SEQ ID NO: 2324821 - DNA, 22 bp, Homo sapiens
gtgggacagcttgtaggggagg

SEQ ID NO: 2324822 - DNA, 17 bp, Homo sapiens
gtgggaggtggaagaag

SEQ ID NO: 2324823 - DNA, 19 bp, Homo sapiens
gtgggagtgtgtctgctga

SEQ ID NO: 2324824 - DNA, 16 bp, Homo sapiens
gtgggatgaaccagcc

SEQ ID NO: 2324825 - DNA, 17 bp, Homo sapiens
gtgggatgaaccagccg

SEQ ID NO: 2324826 - DNA, 18 bp, Homo sapiens
gtgggctgctggccatga

SEQ ID NO: 2324827 - DNA, 17 bp, Homo sapiens
gtgggctggacttctac

SEQ ID NO: 2324828 - DNA, 15 bp, Homo sapiens
gtgggcttcctgccc

SEQ ID NO: 2324829 - DNA, 22 bp, Homo sapiens
gtgggcttgtggggcctgggag

SEQ ID NO: 2324830 - DNA, 17 bp, Homo sapiens
gtggggagatgcttctc

SEQ ID NO: 2324831 - DNA, 12 bp, Homo sapiens
gtggggcctggg

SEQ ID NO: 2324832 - DNA, 13 bp, Homo sapiens
gtgggggcttcat

SEQ ID NO: 2324833 - DNA, 20 bp, Homo sapiens
gtgggggtggaggcttcctg

SEQ ID NO: 2324834 - DNA, 20 bp, Homo sapiens
gtggggtggagcactggact

SEQ ID NO: 2324835 - DNA, 12 bp, Homo sapiens
gtgggtgctgcc

SEQ ID NO: 2324836 - DNA, 13 bp, Homo sapiens
gtgggtgggagtg

SEQ ID NO: 2324837 - DNA, 22 bp, Homo sapiens
gtgggtgtcctgcctgtctgcc

SEQ ID NO: 2324838 - DNA, 14 bp, Homo sapiens
gtggtagaagccag

SEQ ID NO: 2324839 - DNA, 15 bp, Homo sapiens
gtggtatgtctgcca

SEQ ID NO: 2324840 - DNA, 22 bp, Homo sapiens
gtggtcataaaatagaataatt

SEQ ID NO: 2324841 - DNA, 15 bp, Homo sapiens
gtggtctctgctggg

SEQ ID NO: 2324842 - DNA, 15 bp, Homo sapiens
gtggtctttgtaaga

SEQ ID NO: 2324843 - DNA, 15 bp, Homo sapiens
gtggtgtttattgca

SEQ ID NO: 2324844 - DNA, 16 bp, Homo sapiens
gtggttcctctgctca

SEQ ID NO: 2324845 - DNA, 13 bp, Homo sapiens
gtggttgtttttt

SEQ ID NO: 2324846 - DNA, 20 bp, Homo sapiens
gtggttttatactgaaggaa

SEQ ID NO: 2324847 - DNA, 15 bp, Homo sapiens
gtgtaaaaaaaccac

SEQ ID NO: 2324848 - DNA, 15 bp, Homo sapiens
gtgtaacttgcttaa

SEQ ID NO: 2324849 - DNA, 20 bp, Homo sapiens
gtgtaacttgcttaaatttc

SEQ ID NO: 2324850 - DNA, 15 bp, Homo sapiens
gtgtaatttgaagat

SEQ ID NO: 2324851 - DNA, 23 bp, Homo sapiens
gtgtacttcccgggccagggctg

SEQ ID NO: 2324852 - DNA, 13 bp, Homo sapiens
gtgtagaagcatt

SEQ ID NO: 2324853 - DNA, 17 bp, Homo sapiens
gtgtagagttaagaagc

SEQ ID NO: 2324854 - DNA, 23 bp, Homo sapiens
gtgtaggttccgtatctccctgg

SEQ ID NO: 2324855 - DNA, 19 bp, Homo sapiens
gtgtataaatgtacatttc

SEQ ID NO: 2324856 - DNA, 20 bp, Homo sapiens
gtgtattccaagacatgtct

SEQ ID NO: 2324857 - DNA, 19 bp, Homo sapiens
gtgtatttccagtgcaatt

SEQ ID NO: 2324858 - DNA, 14 bp, Homo sapiens
gtgtcaccctgcag

SEQ ID NO: 2324859 - DNA, 16 bp, Homo sapiens
gtgtcatttctcatcc

SEQ ID NO: 2324860 - DNA, 13 bp, Homo sapiens
gtgtccagcttcc

SEQ ID NO: 2324861 - DNA, 16 bp, Homo sapiens
gtgtccagcttccaaa

SEQ ID NO: 2324862 - DNA, 19 bp, Homo sapiens
gtgtccagcttccaaagcc

SEQ ID NO: 2324863 - DNA, 20 bp, Homo sapiens
gtgtcccccccaggccttgt

SEQ ID NO: 2324864 - DNA, 22 bp, Homo sapiens
gtgtcccccccaggccttgtcc

SEQ ID NO: 2324865 - DNA, 16 bp, Homo sapiens
gtgtcctccaggagct

SEQ ID NO: 2324866 - DNA, 16 bp, Homo sapiens
gtgtcctgcctgtctg

SEQ ID NO: 2324867 - DNA, 20 bp, Homo sapiens
gtgtcctgcctgtctgcccc

SEQ ID NO: 2324868 - DNA, 21 bp, Homo sapiens
gtgtcctgtagttgcgtggac

SEQ ID NO: 2324869 - DNA, 16 bp, Homo sapiens
gtgtctgccaaacaca

SEQ ID NO: 2324870 - DNA, 19 bp, Homo sapiens
gtgtgacagtttccaaatt

SEQ ID NO: 2324871 - DNA, 19 bp, Homo sapiens
gtgtgactattcatggcta

SEQ ID NO: 2324872 - DNA, 12 bp, Homo sapiens
gtgtgcataata

SEQ ID NO: 2324873 - DNA, 15 bp, Homo sapiens
gtgtgctctccattc

SEQ ID NO: 2324874 - DNA, 22 bp, Homo sapiens
gtgtgctgacaacttagctcag

SEQ ID NO: 2324875 - DNA, 23 bp, Homo sapiens
gtgtggattgcctctgaaaagtg

SEQ ID NO: 2324876 - DNA, 14 bp, Homo sapiens
gtgtgggtgtcctg

SEQ ID NO: 2324877 - DNA, 15 bp, Homo sapiens
gtgtgggttctacag

SEQ ID NO: 2324878 - DNA, 13 bp, Homo sapiens
gtgtgtagagtta

SEQ ID NO: 2324879 - DNA, 16 bp, Homo sapiens
gtgtgtagagttaaga

SEQ ID NO: 2324880 - DNA, 17 bp, Homo sapiens
gtgtgtagagttaagaa

SEQ ID NO: 2324881 - DNA, 21 bp, Homo sapiens
gtgtgtagagttaagaagctg

SEQ ID NO: 2324882 - DNA, 21 bp, Homo sapiens
gtgtgtatgactaaagagaga

SEQ ID NO: 2324883 - DNA, 19 bp, Homo sapiens
gtgtgtattcagaggcagt

SEQ ID NO: 2324884 - DNA, 22 bp, Homo sapiens
gtgtgtattcagaggcagtgat

SEQ ID NO: 2324885 - DNA, 23 bp, Homo sapiens
gtgttcagctctttccaaattaa

SEQ ID NO: 2324886 - DNA, 16 bp, Homo sapiens
gtgttctcatgaagca

SEQ ID NO: 2324887 - DNA, 12 bp, Homo sapiens
gtgttctgtggc

SEQ ID NO: 2324888 - DNA, 13 bp, Homo sapiens
gtgttctttcctg

SEQ ID NO: 2324889 - DNA, 16 bp, Homo sapiens
gtgttctttcctgccc

SEQ ID NO: 2324890 - DNA, 13 bp, Homo sapiens
gtgttttttaaga

SEQ ID NO: 2324891 - DNA, 23 bp, Homo sapiens
gtgttttttctttttttttaagt

SEQ ID NO: 2324892 - DNA, 13 bp, Homo sapiens
gttaaaaaaaaaa

SEQ ID NO: 2324893 - DNA, 17 bp, Homo sapiens
gttaaaagatggttgta

SEQ ID NO: 2324894 - DNA, 15 bp, Homo sapiens
gttaaataactgtgt

SEQ ID NO: 2324895 - DNA, 18 bp, Homo sapiens
gttaaatctcctgtggag

SEQ ID NO: 2324896 - DNA, 15 bp, Homo sapiens
gttaaatttgtaagt

SEQ ID NO: 2324897 - DNA, 16 bp, Homo sapiens
gttaaatttgtaagtt

SEQ ID NO: 2324898 - DNA, 17 bp, Homo sapiens
gttaaatttgtaagttt

SEQ ID NO: 2324899 - DNA, 23 bp, Homo sapiens
gttaaatttgtaagtttcaggtg

SEQ ID NO: 2324900 - DNA, 17 bp, Homo sapiens
gttaagaagctgttgta

SEQ ID NO: 2324901 - DNA, 11 bp, Homo sapiens
gttaaggcctg

SEQ ID NO: 2324902 - DNA, 12 bp, Homo sapiens
gttaaggcctga

SEQ ID NO: 2324903 - DNA, 16 bp, Homo sapiens
gttaaggcctgaatca

SEQ ID NO: 2324904 - DNA, 16 bp, Homo sapiens
gttaatccctttgtct

SEQ ID NO: 2324905 - DNA, 18 bp, Homo sapiens
gttacagtggcagtattg

SEQ ID NO: 2324906 - DNA, 21 bp, Homo sapiens
gttaccactcttttgctgtgc

SEQ ID NO: 2324907 - DNA, 16 bp, Homo sapiens
gttacgtgaagaaata

SEQ ID NO: 2324908 - DNA, 23 bp, Homo sapiens
gttacgtgaagaaataaatgaaa

SEQ ID NO: 2324909 - DNA, 13 bp, Homo sapiens
gttactaaaattt

SEQ ID NO: 2324910 - DNA, 16 bp, Homo sapiens
gttacttcttctctta

SEQ ID NO: 2324911 - DNA, 12 bp, Homo sapiens
gttactttcaaa

SEQ ID NO: 2324912 - DNA, 18 bp, Homo sapiens
gttagagaggtagcgagc

SEQ ID NO: 2324913 - DNA, 20 bp, Homo sapiens
gttagagaggtagcgagctg

SEQ ID NO: 2324914 - DNA, 22 bp, Homo sapiens
gttagagaggtagcgagctgct

SEQ ID NO: 2324915 - DNA, 13 bp, Homo sapiens
gttaggaggtcct

SEQ ID NO: 2324916 - DNA, 17 bp, Homo sapiens
gttagggctgcttttct

SEQ ID NO: 2324917 - DNA, 20 bp, Homo sapiens
gttagtcacctgccccagca

SEQ ID NO: 2324918 - DNA, 17 bp, Homo sapiens
gttagttaatccctttg

SEQ ID NO: 2324919 - DNA, 12 bp, Homo sapiens
gttataattttt

SEQ ID NO: 2324920 - DNA, 19 bp, Homo sapiens
gttatagaatagcctgagg

SEQ ID NO: 2324921 - DNA, 13 bp, Homo sapiens
gttatcatgaatt

SEQ ID NO: 2324922 - DNA, 17 bp, Homo sapiens
gttatcatgaattttaa

SEQ ID NO: 2324923 - DNA, 14 bp, Homo sapiens
gttatcgaaataac

SEQ ID NO: 2324924 - DNA, 15 bp, Homo sapiens
gttatcgaaataaca

SEQ ID NO: 2324925 - DNA, 17 bp, Homo sapiens
gttatcgaaataacaat

SEQ ID NO: 2324926 - DNA, 21 bp, Homo sapiens
gttatcgaaataacaatgtta

SEQ ID NO: 2324927 - DNA, 23 bp, Homo sapiens
gttatcgaaataacaatgttaag

SEQ ID NO: 2324928 - DNA, 13 bp, Homo sapiens
gttatgaacagct

SEQ ID NO: 2324929 - DNA, 15 bp, Homo sapiens
gttatgaacagctgt

SEQ ID NO: 2324930 - DNA, 16 bp, Homo sapiens
gttatgaacagctgtg

SEQ ID NO: 2324931 - DNA, 23 bp, Homo sapiens
gttatgaacagctgtgtctgcca

SEQ ID NO: 2324932 - DNA, 20 bp, Homo sapiens
gttatgatttttttttcata

SEQ ID NO: 2324933 - DNA, 22 bp, Homo sapiens
gttattgggagtcttaataaaa

SEQ ID NO: 2324934 - DNA, 19 bp, Homo sapiens
taaagctactgtagaaaca

SEQ ID NO: 2324935 - DNA, 17 bp, Homo sapiens
taaagctcaaatgaaat

SEQ ID NO: 2324936 - DNA, 16 bp, Homo sapiens
taaaggaaaagacaca

SEQ ID NO: 2324937 - DNA, 18 bp, Homo sapiens
taaaggaaataagagcag

SEQ ID NO: 2324938 - DNA, 14 bp, Homo sapiens
taaaggataaagaa

SEQ ID NO: 2324939 - DNA, 21 bp, Homo sapiens
taaaggcagacagttttgctt

SEQ ID NO: 2324940 - DNA, 22 bp, Homo sapiens
taaagggatatttttttctatt

SEQ ID NO: 2324941 - DNA, 22 bp, Homo sapiens
taaaggttacaagcctgcacaa

SEQ ID NO: 2324942 - DNA, 13 bp, Homo sapiens
taaagtaaataca

SEQ ID NO: 2324943 - DNA, 13 bp, Homo sapiens
taaagtacaaatg

SEQ ID NO: 2324944 - DNA, 15 bp, Homo sapiens
taaagtcagaagttt

SEQ ID NO: 2324945 - DNA, 15 bp, Homo sapiens
taaagttttgttttg

SEQ ID NO: 2324946 - DNA, 14 bp, Homo sapiens
taaataaaaactaa

SEQ ID NO: 2324947 - DNA, 19 bp, Homo sapiens
taaataaaaactaattaag

SEQ ID NO: 2324948 - DNA, 21 bp, Homo sapiens
taaataaaaatatgtaatttc

SEQ ID NO: 2324949 - DNA, 13 bp, Homo sapiens
taaataaaatttt

SEQ ID NO: 2324950 - DNA, 15 bp, Homo sapiens
taaataaaccactgt

SEQ ID NO: 2324951 - DNA, 21 bp, Homo sapiens
taaatacatgcatataatgaa

SEQ ID NO: 2324952 - DNA, 15 bp, Homo sapiens
taaatacgtgtcaaa

SEQ ID NO: 2324953 - DNA, 21 bp, Homo sapiens
taaataggagaggatgagagc

SEQ ID NO: 2324954 - DNA, 21 bp, Homo sapiens
taaatagtgtcatataaactc

SEQ ID NO: 2324955 - DNA, 22 bp, Homo sapiens
taaatcaaccacctatttttga

SEQ ID NO: 2324956 - DNA, 22 bp, Homo sapiens
taaatcagaaagtaacaatcta

SEQ ID NO: 2324957 - DNA, 17 bp, Homo sapiens
taaatcattcttactaa

SEQ ID NO: 2324958 - DNA, 20 bp, Homo sapiens
taaatcccacatcccagttt

SEQ ID NO: 2324959 - DNA, 16 bp, Homo sapiens
taaatctcctgtggag

SEQ ID NO: 2324960 - DNA, 14 bp, Homo sapiens
taaatgaaagaaaa

SEQ ID NO: 2324961 - DNA, 20 bp, Homo sapiens
taaatgcatatcctgagcca

SEQ ID NO: 2324962 - DNA, 22 bp, Homo sapiens
taaatgcttaaatttcagaatt

SEQ ID NO: 2324963 - DNA, 11 bp, Homo sapiens
taaatggaaac

SEQ ID NO: 2324964 - DNA, 19 bp, Homo sapiens
taaatggtaataagcactg

SEQ ID NO: 2324965 - DNA, 16 bp, Homo sapiens
taaatgtaaagatatt

SEQ ID NO: 2324966 - DNA, 17 bp, Homo sapiens
taaatgtaaagatattt

SEQ ID NO: 2324967 - DNA, 19 bp, Homo sapiens
taaatgtataaatatacag

SEQ ID NO: 2324968 - DNA, 12 bp, Homo sapiens
taaatgtctgtt

SEQ ID NO: 2324969 - DNA, 17 bp, Homo sapiens
taaatgtcttcatgttg

SEQ ID NO: 2324970 - DNA, 23 bp, Homo sapiens
taaatgtcttcatgttgatgtgt

SEQ ID NO: 2324971 - DNA, 18 bp, Homo sapiens
taaattacctttacatat

SEQ ID NO: 2324972 - DNA, 21 bp, Homo sapiens
taaattacctttacatatata

SEQ ID NO: 2324973 - DNA, 17 bp, Homo sapiens
taaattatagtgtagaa

SEQ ID NO: 2324974 - DNA, 12 bp, Homo sapiens
taaattatcatt

SEQ ID NO: 2324975 - DNA, 21 bp, Homo sapiens
taaattatcattgtttgtcct

SEQ ID NO: 2324976 - DNA, 20 bp, Homo sapiens
taaattatttgattatttaa

SEQ ID NO: 2324977 - DNA, 22 bp, Homo sapiens
taaattatttgattatttaaga

SEQ ID NO: 2324978 - DNA, 16 bp, Homo sapiens
taaattcaactttgta

SEQ ID NO: 2324979 - DNA, 18 bp, Homo sapiens
taaattcaactttgtaaa

SEQ ID NO: 2324980 - DNA, 12 bp, Homo sapiens
taaattgtggat

SEQ ID NO: 2324981 - DNA, 18 bp, Homo sapiens
taaatttaaacttacaaa

SEQ ID NO: 2324982 - DNA, 17 bp, Homo sapiens
taaatttaataccagat

SEQ ID NO: 2324983 - DNA, 13 bp, Homo sapiens
taaatttcagaat

SEQ ID NO: 2324984 - DNA, 15 bp, Homo sapiens
taaatttcttatgtg

SEQ ID NO: 2324985 - DNA, 12 bp, Homo sapiens
taaatttgtaag

SEQ ID NO: 2324986 - DNA, 15 bp, Homo sapiens
taaatttgtaagttt

SEQ ID NO: 2324987 - DNA, 16 bp, Homo sapiens
taaatttgtaagtttc

SEQ ID NO: 2324988 - DNA, 17 bp, Homo sapiens
taaatttgtaagtttca

SEQ ID NO: 2324989 - DNA, 16 bp, Homo sapiens
taaattttaaagccat

SEQ ID NO: 2324990 - DNA, 12 bp, Homo sapiens
taaattttctaa

SEQ ID NO: 2324991 - DNA, 14 bp, Homo sapiens
taacaaaatgagat

SEQ ID NO: 2324992 - DNA, 15 bp, Homo sapiens
taacaaaatttgaat

SEQ ID NO: 2324993 - DNA, 17 bp, Homo sapiens
taacaaatttttcaaat

SEQ ID NO: 2324994 - DNA, 15 bp, Homo sapiens
taacaacaattattt

SEQ ID NO: 2324995 - DNA, 12 bp, Homo sapiens
taacaatgttaa

SEQ ID NO: 2324996 - DNA, 15 bp, Homo sapiens
taacaatgttaagga

SEQ ID NO: 2324997 - DNA, 21 bp, Homo sapiens
taacaatgttaaggaaactct

SEQ ID NO: 2324998 - DNA, 20 bp, Homo sapiens
taacaattcagtaacaaagg

SEQ ID NO: 2324999 - DNA, 23 bp, Homo sapiens
taacaattcagtaacaaaggttt

SEQ ID NO: 2325000 - DNA, 14 bp, Homo sapiens
taacacaaaggaag

SEQ ID NO: 2325001 - DNA, 13 bp, Homo sapiens
taacaccagtggg

SEQ ID NO: 2325002 - DNA, 23 bp, Homo sapiens
taacagaaaaatgaaatttaagc

SEQ ID NO: 2325003 - DNA, 17 bp, Homo sapiens
taacagctacaaacttt

SEQ ID NO: 2325004 - DNA, 14 bp, Homo sapiens
taacagtccttgct

SEQ ID NO: 2325005 - DNA, 19 bp, Homo sapiens
taacataaataaaaattca

SEQ ID NO: 2325006 - DNA, 19 bp, Homo sapiens
taacatcgaaaagttattt

SEQ ID NO: 2325007 - DNA, 22 bp, Homo sapiens
taacatctttattgaaattcta

SEQ ID NO: 2325008 - DNA, 20 bp, Homo sapiens
taacatgaaaaacacggcag

SEQ ID NO: 2325009 - DNA, 22 bp, Homo sapiens
taacatgaaaaacacggcagct

SEQ ID NO: 2325010 - DNA, 17 bp, Homo sapiens
taacattaccttactgt

SEQ ID NO: 2325011 - DNA, 20 bp, Homo sapiens
taacattcttggtcacaaag

SEQ ID NO: 2325012 - DNA, 21 bp, Homo sapiens
taacattttacagtaaatgtt

SEQ ID NO: 2325013 - DNA, 19 bp, Homo sapiens
taaccaatcctactaataa

SEQ ID NO: 2325014 - DNA, 20 bp, Homo sapiens
taaccagaattatacagtaa

SEQ ID NO: 2325015 - DNA, 19 bp, Homo sapiens
taaccaggccatttttggt

SEQ ID NO: 2325016 - DNA, 19 bp, Homo sapiens
taacccccttaaatttaat

SEQ ID NO: 2325017 - DNA, 18 bp, Homo sapiens
taacccttcatcttcctg

SEQ ID NO: 2325018 - DNA, 19 bp, Homo sapiens
taaccctttgtgtgctctc

SEQ ID NO: 2325019 - DNA, 13 bp, Homo sapiens
taacctagttaaa

SEQ ID NO: 2325020 - DNA, 20 bp, Homo sapiens
taacctatgatattttctgt

SEQ ID NO: 2325021 - DNA, 22 bp, Homo sapiens
taacgcgtatctaggctttggt

SEQ ID NO: 2325022 - DNA, 13 bp, Homo sapiens
taacggtgctaaa

SEQ ID NO: 2325023 - DNA, 15 bp, Homo sapiens
taacgtttttccttt

SEQ ID NO: 2325024 - DNA, 14 bp, Homo sapiens
taactaaattttaa

SEQ ID NO: 2325025 - DNA, 15 bp, Homo sapiens
taactataagataca

SEQ ID NO: 2325026 - DNA, 16 bp, Homo sapiens
taactatttttttcaa

SEQ ID NO: 2325027 - DNA, 16 bp, Homo sapiens
taactcaccagcccca

SEQ ID NO: 2325028 - DNA, 13 bp, Homo sapiens
taactctctttcc

SEQ ID NO: 2325029 - DNA, 14 bp, Homo sapiens
taactgaaaatgtg

SEQ ID NO: 2325030 - DNA, 14 bp, Homo sapiens
taactgaaaggttg

SEQ ID NO: 2325031 - DNA, 15 bp, Homo sapiens
taactgtgtactgtt

SEQ ID NO: 2325032 - DNA, 14 bp, Homo sapiens
taacttaactgaaa

SEQ ID NO: 2325033 - DNA, 23 bp, Homo sapiens
taacttttttgtggcaattagtg

SEQ ID NO: 2325034 - DNA, 12 bp, Homo sapiens
taagaaacagtt

SEQ ID NO: 2325035 - DNA, 13 bp, Homo sapiens
taagaagctgttg

SEQ ID NO: 2325036 - DNA, 15 bp, Homo sapiens
taagaagctgttgta

SEQ ID NO: 2325037 - DNA, 19 bp, Homo sapiens
taagaagctgttgtacatt

SEQ ID NO: 2325038 - DNA, 22 bp, Homo sapiens
taagaagctgttgtacatttat

SEQ ID NO: 2325039 - DNA, 15 bp, Homo sapiens
taagaaggcaatatt

SEQ ID NO: 2325040 - DNA, 21 bp, Homo sapiens
taagacataacgtttttcctt

SEQ ID NO: 2325041 - DNA, 22 bp, Homo sapiens
taagacataacgtttttccttt

SEQ ID NO: 2325042 - DNA, 19 bp, Homo sapiens
taagacatttgtttgctgt

SEQ ID NO: 2325043 - DNA, 22 bp, Homo sapiens
taagacccttattgctgtcctg

SEQ ID NO: 2325044 - DNA, 20 bp, Homo sapiens
taagactatatatataaatg

SEQ ID NO: 2325045 - DNA, 23 bp, Homo sapiens
taagactatatatataaatgtat

SEQ ID NO: 2325046 - DNA, 15 bp, Homo sapiens
taagagcgaacttca

SEQ ID NO: 2325047 - DNA, 15 bp, Homo sapiens
taagagtaaagcaac

SEQ ID NO: 2325048 - DNA, 23 bp, Homo sapiens
taagagtattttaagaagacata

SEQ ID NO: 2325049 - DNA, 13 bp, Homo sapiens
tataattgtacaa

SEQ ID NO: 2325050 - DNA, 14 bp, Homo sapiens
tataattgtacaaa

SEQ ID NO: 2325051 - DNA, 15 bp, Homo sapiens
tatacaactgcctgg

SEQ ID NO: 2325052 - DNA, 16 bp, Homo sapiens
tatacaactgcctggg

SEQ ID NO: 2325053 - DNA, 14 bp, Homo sapiens
tatacaccagcaat

SEQ ID NO: 2325054 - DNA, 17 bp, Homo sapiens
tatacagtgcagagcct

SEQ ID NO: 2325055 - DNA, 15 bp, Homo sapiens
tatacatgtgataca

SEQ ID NO: 2325056 - DNA, 18 bp, Homo sapiens
tatacatgtgatacattt

SEQ ID NO: 2325057 - DNA, 20 bp, Homo sapiens
tatacatgtgatacattttt

SEQ ID NO: 2325058 - DNA, 12 bp, Homo sapiens
tatacattgctt

SEQ ID NO: 2325059 - DNA, 21 bp, Homo sapiens
tatacatttggttatgttgat

SEQ ID NO: 2325060 - DNA, 15 bp, Homo sapiens
tatacattttctaaa

SEQ ID NO: 2325061 - DNA, 16 bp, Homo sapiens
tataccaaattaaaaa

SEQ ID NO: 2325062 - DNA, 20 bp, Homo sapiens
tatacctgattttttttcct

SEQ ID NO: 2325063 - DNA, 20 bp, Homo sapiens
tatactgaaggaaaaacaca

SEQ ID NO: 2325064 - DNA, 22 bp, Homo sapiens
tatactgaaggaaaaacacaag

SEQ ID NO: 2325065 - DNA, 21 bp, Homo sapiens
tatacttccttacttttaagg

SEQ ID NO: 2325066 - DNA, 19 bp, Homo sapiens
tatactttagtagacattt

SEQ ID NO: 2325067 - DNA, 17 bp, Homo sapiens
tatagaatagcctgagg

SEQ ID NO: 2325068 - DNA, 14 bp, Homo sapiens
tatagcaactaatg

SEQ ID NO: 2325069 - DNA, 18 bp, Homo sapiens
tatagtaactataagata

SEQ ID NO: 2325070 - DNA, 15 bp, Homo sapiens
tatagtcaatggctt

SEQ ID NO: 2325071 - DNA, 16 bp, Homo sapiens
tatagtctaagactat

SEQ ID NO: 2325072 - DNA, 19 bp, Homo sapiens
tatagtctaagactatata

SEQ ID NO: 2325073 - DNA, 17 bp, Homo sapiens
tatagtgtagaaaagaa

SEQ ID NO: 2325074 - DNA, 17 bp, Homo sapiens
tatagttttacttttaa

SEQ ID NO: 2325075 - DNA, 22 bp, Homo sapiens
tatagttttacttttaaactgt

SEQ ID NO: 2325076 - DNA, 16 bp, Homo sapiens
tatataaactgtgcca

SEQ ID NO: 2325077 - DNA, 18 bp, Homo sapiens
tatataggctattttcta

SEQ ID NO: 2325078 - DNA, 13 bp, Homo sapiens
tatatataaatgt

SEQ ID NO: 2325079 - DNA, 15 bp, Homo sapiens
tatatataaatgtat

SEQ ID NO: 2325080 - DNA, 16 bp, Homo sapiens
tatatatataaatgta

SEQ ID NO: 2325081 - DNA, 18 bp, Homo sapiens
tatatattttgtgtgaaa

SEQ ID NO: 2325082 - DNA, 13 bp, Homo sapiens
tatatcacccaga

SEQ ID NO: 2325083 - DNA, 16 bp, Homo sapiens
tatatcagtacctctc

SEQ ID NO: 2325084 - DNA, 20 bp, Homo sapiens
tatatccaaaagctttttat

SEQ ID NO: 2325085 - DNA, 20 bp, Homo sapiens
tatatgaaataagtaaatgt

SEQ ID NO: 2325086 - DNA, 18 bp, Homo sapiens
tatatgaagaaaatcact

SEQ ID NO: 2325087 - DNA, 18 bp, Homo sapiens
tatatgccttaagccaat

SEQ ID NO: 2325088 - DNA, 14 bp, Homo sapiens
tatatgcttactga

SEQ ID NO: 2325089 - DNA, 16 bp, Homo sapiens
tatatgcttactgata

SEQ ID NO: 2325090 - DNA, 18 bp, Homo sapiens
tatatgctttattaatgt

SEQ ID NO: 2325091 - DNA, 23 bp, Homo sapiens
tatatggttctccaagaaactga

SEQ ID NO: 2325092 - DNA, 14 bp, Homo sapiens
tatatgtatgtagt

SEQ ID NO: 2325093 - DNA, 14 bp, Homo sapiens
tatatgtgtgccta

SEQ ID NO: 2325094 - DNA, 12 bp, Homo sapiens
tatatgttcata

SEQ ID NO: 2325095 - DNA, 17 bp, Homo sapiens
tatattacaatgatcac

SEQ ID NO: 2325096 - DNA, 23 bp, Homo sapiens
tatattactgacatttcttctag

SEQ ID NO: 2325097 - DNA, 17 bp, Homo sapiens
tatattctgcagaaaat

SEQ ID NO: 2325098 - DNA, 13 bp, Homo sapiens
tatattgaacttt

SEQ ID NO: 2325099 - DNA, 22 bp, Homo sapiens
tatattgaacttttgtactgaa

SEQ ID NO: 2325100 - DNA, 15 bp, Homo sapiens
tatattgttgaagag

SEQ ID NO: 2325101 - DNA, 12 bp, Homo sapiens
tatatttattga

SEQ ID NO: 2325102 - DNA, 11 bp, Homo sapiens
tatatttcctt

SEQ ID NO: 2325103 - DNA, 17 bp, Homo sapiens
tatatttcctttatgtg

SEQ ID NO: 2325104 - DNA, 15 bp, Homo sapiens
tatattttatattac

SEQ ID NO: 2325105 - DNA, 18 bp, Homo sapiens
tatattttgtgtgaaatt

SEQ ID NO: 2325106 - DNA, 18 bp, Homo sapiens
tatatttttaaagaatgt

SEQ ID NO: 2325107 - DNA, 20 bp, Homo sapiens
tatcaaagtcattaaagaca

SEQ ID NO: 2325108 - DNA, 14 bp, Homo sapiens
tatcaactctgaag

SEQ ID NO: 2325109 - DNA, 16 bp, Homo sapiens
tatcaactctgaagct

SEQ ID NO: 2325110 - DNA, 16 bp, Homo sapiens
tatcacactttaatgt

SEQ ID NO: 2325111 - DNA, 18 bp, Homo sapiens
tatcacattaatctcaaa

SEQ ID NO: 2325112 - DNA, 20 bp, Homo sapiens
tatcacattaatctcaaaga

SEQ ID NO: 2325113 - DNA, 22 bp, Homo sapiens
tatcacccagacataaaggaaa

SEQ ID NO: 2325114 - DNA, 23 bp, Homo sapiens
tatcacccagacataaaggaaaa

SEQ ID NO: 2325115 - DNA, 16 bp, Homo sapiens
tatcacgatttgcagg

SEQ ID NO: 2325116 - DNA, 15 bp, Homo sapiens
tatcaggtgtataaa

SEQ ID NO: 2325117 - DNA, 18 bp, Homo sapiens
tatcaggtgtataaatgt

SEQ ID NO: 2325118 - DNA, 12 bp, Homo sapiens
tatcagtacctc

SEQ ID NO: 2325119 - DNA, 21 bp, Homo sapiens
tatcagttacagtggcagtat

SEQ ID NO: 2325120 - DNA, 15 bp, Homo sapiens
tatcatgaattttaa

SEQ ID NO: 2325121 - DNA, 19 bp, Homo sapiens
tatcatgaattttaaagta

SEQ ID NO: 2325122 - DNA, 13 bp, Homo sapiens
tatcatgcaaaat

SEQ ID NO: 2325123 - DNA, 15 bp, Homo sapiens
tatcatgcaaaatat

SEQ ID NO: 2325124 - DNA, 21 bp, Homo sapiens
tatccaaggaaacattttatc

SEQ ID NO: 2325125 - DNA, 23 bp, Homo sapiens
tatccaaggaaacattttatcat

SEQ ID NO: 2325126 - DNA, 17 bp, Homo sapiens
tatccaggcaccaggac

SEQ ID NO: 2325127 - DNA, 14 bp, Homo sapiens
tatcccaaatgtgg

SEQ ID NO: 2325128 - DNA, 14 bp, Homo sapiens
tatcccagctgcct

SEQ ID NO: 2325129 - DNA, 17 bp, Homo sapiens
tatccccatctccctgc

SEQ ID NO: 2325130 - DNA, 20 bp, Homo sapiens
tatccccatctccctgcctg

SEQ ID NO: 2325131 - DNA, 17 bp, Homo sapiens
tatcctctctctcttct

SEQ ID NO: 2325132 - DNA, 18 bp, Homo sapiens
tatcctctctctcttcta

SEQ ID NO: 2325133 - DNA, 16 bp, Homo sapiens
tatccttggagagcag

SEQ ID NO: 2325134 - DNA, 18 bp, Homo sapiens
tatccttggagagcagct

SEQ ID NO: 2325135 - DNA, 19 bp, Homo sapiens
tatccttggagagcagctg

SEQ ID NO: 2325136 - DNA, 19 bp, Homo sapiens
tatccttgggggctcccag

SEQ ID NO: 2325137 - DNA, 16 bp, Homo sapiens
tatctaatacctctgt

SEQ ID NO: 2325138 - DNA, 18 bp, Homo sapiens
tatctagttctaacagtg

SEQ ID NO: 2325139 - DNA, 17 bp, Homo sapiens
tatctatttgaataaat

SEQ ID NO: 2325140 - DNA, 22 bp, Homo sapiens
tatctcagtcatgcataaatat

SEQ ID NO: 2325141 - DNA, 15 bp, Homo sapiens
tatctccatggccct

SEQ ID NO: 2325142 - DNA, 19 bp, Homo sapiens
tatctccatggccctgtcc

SEQ ID NO: 2325143 - DNA, 22 bp, Homo sapiens
tatctccatggccctgtcccag

SEQ ID NO: 2325144 - DNA, 12 bp, Homo sapiens
tatctcccacaa

SEQ ID NO: 2325145 - DNA, 14 bp, Homo sapiens
tatctccctggaga

SEQ ID NO: 2325146 - DNA, 13 bp, Homo sapiens
tatctcctgacag

SEQ ID NO: 2325147 - DNA, 23 bp, Homo sapiens
tatcttataaagtggaagtatgt

SEQ ID NO: 2325148 - DNA, 15 bp, Homo sapiens
tatcttattttctca

SEQ ID NO: 2325149 - DNA, 18 bp, Homo sapiens
tatcttcagcccaggctt

SEQ ID NO: 2325150 - DNA, 21 bp, Homo sapiens
tatcttgggtgtattctctgt

SEQ ID NO: 2325151 - DNA, 15 bp, Homo sapiens
tatctttgaatatgt

SEQ ID NO: 2325152 - DNA, 22 bp, Homo sapiens
tatgaaaatatagacattctca

SEQ ID NO: 2325153 - DNA, 16 bp, Homo sapiens
tatgaaataagtaaat

SEQ ID NO: 2325154 - DNA, 14 bp, Homo sapiens
tatgaacagctgtg

SEQ ID NO: 2325155 - DNA, 19 bp, Homo sapiens
tatgaacatattgttgaaa

SEQ ID NO: 2325156 - DNA, 14 bp, Homo sapiens
tatgacaaattcaa

SEQ ID NO: 2325157 - DNA, 17 bp, Homo sapiens
tatgacaaattcaagag

SEQ ID NO: 2325158 - DNA, 13 bp, Homo sapiens
tatgaccagaagc

SEQ ID NO: 2325159 - DNA, 15 bp, Homo sapiens
tatgaccagaagcct

SEQ ID NO: 2325160 - DNA, 20 bp, Homo sapiens
tatgacggaagaacatagaa

SEQ ID NO: 2325161 - DNA, 12 bp, Homo sapiens
tatgactaaaga

SEQ ID NO: 2325162 - DNA, 14 bp, Homo sapiens
tatgactaaagaga

SEQ ID NO: 2325163 - DNA, 15 bp, Homo sapiens
tatgactaaagagag

SEQ ID NO: 2325164 - DNA, 17 bp, Homo sapiens
tatttcccttccaaaga

SEQ ID NO: 2325165 - DNA, 17 bp, Homo sapiens
tatttcctttatgtgaa

SEQ ID NO: 2325166 - DNA, 16 bp, Homo sapiens
tatttcggctatgtct

SEQ ID NO: 2325167 - DNA, 24 bp, Homo sapiens
tatttctaattccacaggtcatca

SEQ ID NO: 2325168 - DNA, 16 bp, Homo sapiens
tatttctatgacaaat

SEQ ID NO: 2325169 - DNA, 14 bp, Homo sapiens
tatttgaataaatt

SEQ ID NO: 2325170 - DNA, 13 bp, Homo sapiens
tatttgattattt

SEQ ID NO: 2325171 - DNA, 14 bp, Homo sapiens
tatttgattattta

SEQ ID NO: 2325172 - DNA, 13 bp, Homo sapiens
tatttgatttata

SEQ ID NO: 2325173 - DNA, 18 bp, Homo sapiens
tatttgatttctaattgt

SEQ ID NO: 2325174 - DNA, 17 bp, Homo sapiens
tatttgcacatgggatt

SEQ ID NO: 2325175 - DNA, 20 bp, Homo sapiens
tatttgcaccttaaaagaca

SEQ ID NO: 2325176 - DNA, 17 bp, Homo sapiens
tatttgccatgggcttc

SEQ ID NO: 2325177 - DNA, 20 bp, Homo sapiens
tatttgctcataagtaaatg

SEQ ID NO: 2325178 - DNA, 13 bp, Homo sapiens
tattttaaaattt

SEQ ID NO: 2325179 - DNA, 18 bp, Homo sapiens
tattttaacctgcataaa

SEQ ID NO: 2325180 - DNA, 14 bp, Homo sapiens
tattttaattactg

SEQ ID NO: 2325181 - DNA, 13 bp, Homo sapiens
tattttcagtccc

SEQ ID NO: 2325182 - DNA, 21 bp, Homo sapiens
tattttctactttaaattgtg

SEQ ID NO: 2325183 - DNA, 22 bp, Homo sapiens
tattttgtctaggagatgcttt

SEQ ID NO: 2325184 - DNA, 13 bp, Homo sapiens
tattttgtgtaaa

SEQ ID NO: 2325185 - DNA, 16 bp, Homo sapiens
tattttgtgtaaaaaa

SEQ ID NO: 2325186 - DNA, 23 bp, Homo sapiens
tattttgtgtcctccaggagctt

SEQ ID NO: 2325187 - DNA, 18 bp, Homo sapiens
tatttttgacatggaaat

SEQ ID NO: 2325188 - DNA, 18 bp, Homo sapiens
tatttttgactgtagcca

SEQ ID NO: 2325189 - DNA, 17 bp, Homo sapiens
tattttttttttcttct

SEQ ID NO: 2325190 - DNA, 16 bp, Homo sapiens
tcaaaaaaaagaaaaa

SEQ ID NO: 2325191 - DNA, 11 bp, Homo sapiens
tcaaaaaatta

SEQ ID NO: 2325192 - DNA, 19 bp, Homo sapiens
tcaaaaaattatttgctat

SEQ ID NO: 2325193 - DNA, 15 bp, Homo sapiens
tcaaaaaccagccag

SEQ ID NO: 2325194 - DNA, 14 bp, Homo sapiens
tcaaaaagaactaa

SEQ ID NO: 2325195 - DNA, 11 bp, Homo sapiens
tcaaaaccaag

SEQ ID NO: 2325196 - DNA, 20 bp, Homo sapiens
tcaaaagagaaaaacaaaac

SEQ ID NO: 2325197 - DNA, 14 bp, Homo sapiens
tcaaaagtattgaa

SEQ ID NO: 2325198 - DNA, 18 bp, Homo sapiens
tcaaaatacatttgtaag

SEQ ID NO: 2325199 - DNA, 14 bp, Homo sapiens
tcaaaatgaatttt

SEQ ID NO: 2325200 - DNA, 18 bp, Homo sapiens
tcaaaatgatagacatat

SEQ ID NO: 2325201 - DNA, 12 bp, Homo sapiens
tcaaacaagtat

SEQ ID NO: 2325202 - DNA, 15 bp, Homo sapiens
tcaaactgaggaatt

SEQ ID NO: 2325203 - DNA, 14 bp, Homo sapiens
tcaaagactcaaat

SEQ ID NO: 2325204 - DNA, 16 bp, Homo sapiens
tcaaagactcaaattt

SEQ ID NO: 2325205 - DNA, 17 bp, Homo sapiens
tcaaagactcaaatttt

SEQ ID NO: 2325206 - DNA, 15 bp, Homo sapiens
tcaaagatgccccat

SEQ ID NO: 2325207 - DNA, 16 bp, Homo sapiens
tcaaagcagaagtctg

SEQ ID NO: 2325208 - DNA, 20 bp, Homo sapiens
tcaaagcatggacatttaga

SEQ ID NO: 2325209 - DNA, 13 bp, Homo sapiens
tcaaagttttgaa

SEQ ID NO: 2325210 - DNA, 17 bp, Homo sapiens
tcaaagttttgaaaagc

SEQ ID NO: 2325211 - DNA, 14 bp, Homo sapiens
tcaaatcattcctt

SEQ ID NO: 2325212 - DNA, 14 bp, Homo sapiens
tcaaatgaaatgta

SEQ ID NO: 2325213 - DNA, 23 bp, Homo sapiens
tcaaatgaaatgtatgcattcac

SEQ ID NO: 2325214 - DNA, 15 bp, Homo sapiens
tcaaatgaatgatta

SEQ ID NO: 2325215 - DNA, 18 bp, Homo sapiens
tcaaatgaatgattaaat

SEQ ID NO: 2325216 - DNA, 16 bp, Homo sapiens
tcaaattcttctgaac

SEQ ID NO: 2325217 - DNA, 13 bp, Homo sapiens
tcaaattttgtac

SEQ ID NO: 2325218 - DNA, 18 bp, Homo sapiens
tcaacaaatattcactgg

SEQ ID NO: 2325219 - DNA, 22 bp, Homo sapiens
tcaacaaatattcactggcccc

SEQ ID NO: 2325220 - DNA, 14 bp, Homo sapiens
tcaacactcttctt

SEQ ID NO: 2325221 - DNA, 16 bp, Homo sapiens
tcaacactcttcttga

SEQ ID NO: 2325222 - DNA, 19 bp, Homo sapiens
tcaacagcagggtgggctt

SEQ ID NO: 2325223 - DNA, 22 bp, Homo sapiens
tcaacccattgttgtcaaggaa

SEQ ID NO: 2325224 - DNA, 22 bp, Homo sapiens
tcaaccccaccatatgaattgt

SEQ ID NO: 2325225 - DNA, 16 bp, Homo sapiens
tcaactcacctaatgt

SEQ ID NO: 2325226 - DNA, 12 bp, Homo sapiens
tcaactgaaggg

SEQ ID NO: 2325227 - DNA, 16 bp, Homo sapiens
tcaacttattctttga

SEQ ID NO: 2325228 - DNA, 14 bp, Homo sapiens
tcaactttgtaaaa

SEQ ID NO: 2325229 - DNA, 19 bp, Homo sapiens
tcaagaagtcttgaagttg

SEQ ID NO: 2325230 - DNA, 21 bp, Homo sapiens
tcaagaataatcacgctttcc

SEQ ID NO: 2325231 - DNA, 15 bp, Homo sapiens
tcaagaatgaaaaat

SEQ ID NO: 2325232 - DNA, 23 bp, Homo sapiens
tcaagacccccatttgtcccaga

SEQ ID NO: 2325233 - DNA, 12 bp, Homo sapiens
tcaagacctgag

SEQ ID NO: 2325234 - DNA, 18 bp, Homo sapiens
tcaagacctgagtatttt

SEQ ID NO: 2325235 - DNA, 13 bp, Homo sapiens
tcaagaggagccc

SEQ ID NO: 2325236 - DNA, 20 bp, Homo sapiens
tcaagatgggggcagggctg

SEQ ID NO: 2325237 - DNA, 21 bp, Homo sapiens
tcaagatgggggcagggctgt

SEQ ID NO: 2325238 - DNA, 18 bp, Homo sapiens
tcaagattttgaatgctt

SEQ ID NO: 2325239 - DNA, 20 bp, Homo sapiens
tcaagcaaaacagttctcag

SEQ ID NO: 2325240 - DNA, 20 bp, Homo sapiens
tcaagcaatccacctgcctt

SEQ ID NO: 2325241 - DNA, 15 bp, Homo sapiens
tcaagcaatcctcct

SEQ ID NO: 2325242 - DNA, 17 bp, Homo sapiens
tcaagcaatcctcctgc

SEQ ID NO: 2325243 - DNA, 23 bp, Homo sapiens
tcaagcaatcctcctgcctcagc

SEQ ID NO: 2325244 - DNA, 14 bp, Homo sapiens
tcaagctagtgttt

SEQ ID NO: 2325245 - DNA, 16 bp, Homo sapiens
tcaaggaagaagaaat

SEQ ID NO: 2325246 - DNA, 22 bp, Homo sapiens
tcaaggatggttttgggactag

SEQ ID NO: 2325247 - DNA, 20 bp, Homo sapiens
tcaaggattcttctgattct

SEQ ID NO: 2325248 - DNA, 15 bp, Homo sapiens
tcaaggtcactgttt

SEQ ID NO: 2325249 - DNA, 18 bp, Homo sapiens
tcaaggtcactgtttcct

SEQ ID NO: 2325250 - DNA, 16 bp, Homo sapiens
tcaagtaagaagacat

SEQ ID NO: 2325251 - DNA, 17 bp, Homo sapiens
tcaagttttaaagttca

SEQ ID NO: 2325252 - DNA, 15 bp, Homo sapiens
tcaataaatgtctgt

SEQ ID NO: 2325253 - DNA, 22 bp, Homo sapiens
tcaatatattgaacttttgtac

SEQ ID NO: 2325254 - DNA, 17 bp, Homo sapiens
tcaatatgaatctataa

SEQ ID NO: 2325255 - DNA, 15 bp, Homo sapiens
tcaatcactgctccc

SEQ ID NO: 2325256 - DNA, 21 bp, Homo sapiens
tcaatcctaatttctcctccc

SEQ ID NO: 2325257 - DNA, 13 bp, Homo sapiens
tcaatgagagcat

SEQ ID NO: 2325258 - DNA, 12 bp, Homo sapiens
tcaatgtcttcc

SEQ ID NO: 2325259 - DNA, 15 bp, Homo sapiens
tcacaaagctattta

SEQ ID NO: 2325260 - DNA, 19 bp, Homo sapiens
tcacaaagctatttaagtg

SEQ ID NO: 2325261 - DNA, 17 bp, Homo sapiens
tcacaacagtcacctca

SEQ ID NO: 2325262 - DNA, 21 bp, Homo sapiens
tcacaagtggtgtttattgca

SEQ ID NO: 2325263 - DNA, 18 bp, Homo sapiens
tcacaatgagaaaaataa

SEQ ID NO: 2325264 - DNA, 15 bp, Homo sapiens
tcacaattatgtgca

SEQ ID NO: 2325265 - DNA, 14 bp, Homo sapiens
tcacacagacacta

SEQ ID NO: 2325266 - DNA, 16 bp, Homo sapiens
tcacactggtaaatgt

SEQ ID NO: 2325267 - DNA, 20 bp, Homo sapiens
tcacagcacttacaattttc

SEQ ID NO: 2325268 - DNA, 14 bp, Homo sapiens
tcacagtagagcca

SEQ ID NO: 2325269 - DNA, 16 bp, Homo sapiens
tcacagtagagccagc

SEQ ID NO: 2325270 - DNA, 20 bp, Homo sapiens
tcacagtccaaccagaaaca

SEQ ID NO: 2325271 - DNA, 19 bp, Homo sapiens
tcacagtctcagttctctt

SEQ ID NO: 2325272 - DNA, 21 bp, Homo sapiens
tcacataggaagggatctgag

SEQ ID NO: 2325273 - DNA, 18 bp, Homo sapiens
tcacatctacacgtggct

SEQ ID NO: 2325274 - DNA, 21 bp, Homo sapiens
tcacatggcctatgcacatat

SEQ ID NO: 2325275 - DNA, 15 bp, Homo sapiens
tcacattaggctgtt

SEQ ID NO: 2325276 - DNA, 19 bp, Homo sapiens
tcacattttgcctttctcg

SEQ ID NO: 2325277 - DNA, 18 bp, Homo sapiens
tcaccagatctgatttgt

SEQ ID NO: 2325278 - DNA, 22 bp, Homo sapiens
tcaccagccccactgccagcag

SEQ ID NO: 2325279 - DNA, 22 bp, Homo sapiens
tccccatctccctgcctggccc

SEQ ID NO: 2325280 - DNA, 16 bp, Homo sapiens
tccccatctgtccagc

SEQ ID NO: 2325281 - DNA, 20 bp, Homo sapiens
tccccatttcccatctgcac

SEQ ID NO: 2325282 - DNA, 20 bp, Homo sapiens
tcccccagccatgccagctg

SEQ ID NO: 2325283 - DNA, 21 bp, Homo sapiens
tcccccagccatgccagctgg

SEQ ID NO: 2325284 - DNA, 23 bp, Homo sapiens
tcccccagccatgccagctggcc

SEQ ID NO: 2325285 - DNA, 22 bp, Homo sapiens
tccccctctcctctcccccagg

SEQ ID NO: 2325286 - DNA, 16 bp, Homo sapiens
tccccgcctggccagg

SEQ ID NO: 2325287 - DNA, 19 bp, Homo sapiens
tccccgcctggccaggagc

SEQ ID NO: 2325288 - DNA, 20 bp, Homo sapiens
tccccgcctggccaggagca

SEQ ID NO: 2325289 - DNA, 20 bp, Homo sapiens
tcccctcacgcaagtgccag

SEQ ID NO: 2325290 - DNA, 18 bp, Homo sapiens
tcccctccggactggtgc

SEQ ID NO: 2325291 - DNA, 14 bp, Homo sapiens
tcccctctcagaac

SEQ ID NO: 2325292 - DNA, 14 bp, Homo sapiens
tcccctttcctgtc

SEQ ID NO: 2325293 - DNA, 12 bp, Homo sapiens
tcccgggcctca

SEQ ID NO: 2325294 - DNA, 15 bp, Homo sapiens
tcccggttcaccttg

SEQ ID NO: 2325295 - DNA, 22 bp, Homo sapiens
tcccgtgcatcccccctgctca

SEQ ID NO: 2325296 - DNA, 14 bp, Homo sapiens
tccctcccaggact

SEQ ID NO: 2325297 - DNA, 13 bp, Homo sapiens
tccctccccagaa

SEQ ID NO: 2325298 - DNA, 17 bp, Homo sapiens
tccctcctccaggcctg

SEQ ID NO: 2325299 - DNA, 14 bp, Homo sapiens
tccctcctgcacac

SEQ ID NO: 2325300 - DNA, 16 bp, Homo sapiens
tccctcctggagcatc

SEQ ID NO: 2325301 - DNA, 19 bp, Homo sapiens
tccctctaatgagactgac

SEQ ID NO: 2325302 - DNA, 19 bp, Homo sapiens
tccctctctgatgtcccag

SEQ ID NO: 2325303 - DNA, 21 bp, Homo sapiens
tccctcttagtctaggtcctt

SEQ ID NO: 2325304 - DNA, 18 bp, Homo sapiens
tccctgaacgttttcttc

SEQ ID NO: 2325305 - DNA, 20 bp, Homo sapiens
tccctgaacgttttcttctt

SEQ ID NO: 2325306 - DNA, 23 bp, Homo sapiens
tccctgaacgttttcttctttcc

SEQ ID NO: 2325307 - DNA, 15 bp, Homo sapiens
tccctgagacaggga

SEQ ID NO: 2325308 - DNA, 22 bp, Homo sapiens
tccctgaggatgggtcagagct

SEQ ID NO: 2325309 - DNA, 23 bp, Homo sapiens
tccctgaggatgggtcagagcta

SEQ ID NO: 2325310 - DNA, 16 bp, Homo sapiens
tccctgcagatgccac

SEQ ID NO: 2325311 - DNA, 23 bp, Homo sapiens
tccctgcagatgccaccctagcc

SEQ ID NO: 2325312 - DNA, 14 bp, Homo sapiens
tccctgcttccagg

SEQ ID NO: 2325313 - DNA, 24 bp, Homo sapiens
tccctggagtcagggtgaactgca

SEQ ID NO: 2325314 - DNA, 20 bp, Homo sapiens
tccctgggacacagacccag

SEQ ID NO: 2325315 - DNA, 19 bp, Homo sapiens
tccctgggggccccaggat

SEQ ID NO: 2325316 - DNA, 23 bp, Homo sapiens
tccctgtttattccaaatgccat

SEQ ID NO: 2325317 - DNA, 16 bp, Homo sapiens
tcccttattgcctccc

SEQ ID NO: 2325318 - DNA, 18 bp, Homo sapiens
tcccttccttttccctgc

SEQ ID NO: 2325319 - DNA, 19 bp, Homo sapiens
tcccttccttttccctgct

SEQ ID NO: 2325320 - DNA, 20 bp, Homo sapiens
tcccttgaaactttgggaaa

SEQ ID NO: 2325321 - DNA, 18 bp, Homo sapiens
tcccttgagggctgcagt

SEQ ID NO: 2325322 - DNA, 22 bp, Homo sapiens
tcccttgcctttcgaggcctga

SEQ ID NO: 2325323 - DNA, 17 bp, Homo sapiens
tcccttgctggccccag

SEQ ID NO: 2325324 - DNA, 19 bp, Homo sapiens
tcccttgctggccccagcc

SEQ ID NO: 2325325 - DNA, 16 bp, Homo sapiens
tcccttgggctctgat

SEQ ID NO: 2325326 - DNA, 21 bp, Homo sapiens
tccctttaccactgtggtttt

SEQ ID NO: 2325327 - DNA, 17 bp, Homo sapiens
tccctttgcacctgaga

SEQ ID NO: 2325328 - DNA, 20 bp, Homo sapiens
tccctttttcataaattatt

SEQ ID NO: 2325329 - DNA, 22 bp, Homo sapiens
tccgaagggaattaaaaagaag

SEQ ID NO: 2325330 - DNA, 13 bp, Homo sapiens
tccgagagggaga

SEQ ID NO: 2325331 - DNA, 14 bp, Homo sapiens
tccgagagggagag

SEQ ID NO: 2325332 - DNA, 17 bp, Homo sapiens
tccgcagtgtctccacc

SEQ ID NO: 2325333 - DNA, 13 bp, Homo sapiens
tccgccagcctcc

SEQ ID NO: 2325334 - DNA, 14 bp, Homo sapiens
tccgccagcctcct

SEQ ID NO: 2325335 - DNA, 18 bp, Homo sapiens
tccgccagcctcctctgg

SEQ ID NO: 2325336 - DNA, 15 bp, Homo sapiens
tccgccattccaagt

SEQ ID NO: 2325337 - DNA, 16 bp, Homo sapiens
tccgcctggcctggcc

SEQ ID NO: 2325338 - DNA, 17 bp, Homo sapiens
tccgcgccgatgccacc

SEQ ID NO: 2325339 - DNA, 18 bp, Homo sapiens
tccgcgccgatgccaccg

SEQ ID NO: 2325340 - DNA, 19 bp, Homo sapiens
tccgcgccgatgccaccgg

SEQ ID NO: 2325341 - DNA, 16 bp, Homo sapiens
tccgctgccagccttg

SEQ ID NO: 2325342 - DNA, 22 bp, Homo sapiens
tccgcttggagctattttccag

SEQ ID NO: 2325343 - DNA, 18 bp, Homo sapiens
tccggggccccactggct

SEQ ID NO: 2325344 - DNA, 23 bp, Homo sapiens
tccgtatctccctggagaagcac

SEQ ID NO: 2325345 - DNA, 15 bp, Homo sapiens
tccgtgtgtcccaga

SEQ ID NO: 2325346 - DNA, 20 bp, Homo sapiens
tcctaagatgtgttcttatt

SEQ ID NO: 2325347 - DNA, 21 bp, Homo sapiens
tcctaagcaactaggccttca

SEQ ID NO: 2325348 - DNA, 16 bp, Homo sapiens
tcctactcggctctgc

SEQ ID NO: 2325349 - DNA, 16 bp, Homo sapiens
tcctactggtctctct

SEQ ID NO: 2325350 - DNA, 12 bp, Homo sapiens
tcctagcccttc

SEQ ID NO: 2325351 - DNA, 15 bp, Homo sapiens
tcctagcccttccct

SEQ ID NO: 2325352 - DNA, 17 bp, Homo sapiens
tcctagcccttccctga

SEQ ID NO: 2325353 - DNA, 18 bp, Homo sapiens
tcctagcccttccctgag

SEQ ID NO: 2325354 - DNA, 19 bp, Homo sapiens
tcctagcccttccctgagt

SEQ ID NO: 2325355 - DNA, 18 bp, Homo sapiens
tcctagctctcccagtga

SEQ ID NO: 2325356 - DNA, 18 bp, Homo sapiens
tcctagctgtcctttttc

SEQ ID NO: 2325357 - DNA, 19 bp, Homo sapiens
tcctaggcattctggacct

SEQ ID NO: 2325358 - DNA, 20 bp, Homo sapiens
tcctataagcttaaatagga

SEQ ID NO: 2325359 - DNA, 21 bp, Homo sapiens
tcctataagcttaaataggaa

SEQ ID NO: 2325360 - DNA, 23 bp, Homo sapiens
tcctatgcttaataaaagaacat

SEQ ID NO: 2325361 - DNA, 18 bp, Homo sapiens
tcctcaaacgacagagga

SEQ ID NO: 2325362 - DNA, 19 bp, Homo sapiens
tcctcaaattttttgactt

SEQ ID NO: 2325363 - DNA, 21 bp, Homo sapiens
tcctcacctcatgcccacccc

SEQ ID NO: 2325364 - DNA, 22 bp, Homo sapiens
tcctcacgcccttcaatgctgc

SEQ ID NO: 2325365 - DNA, 23 bp, Homo sapiens
tcctcactcgggtttctctgtgg

SEQ ID NO: 2325366 - DNA, 23 bp, Homo sapiens
tcctcagagcgccaggaagccag

SEQ ID NO: 2325367 - DNA, 19 bp, Homo sapiens
tcctcagatcatccagaag

SEQ ID NO: 2325368 - DNA, 17 bp, Homo sapiens
tcctcaggtagtactgg

SEQ ID NO: 2325369 - DNA, 18 bp, Homo sapiens
tcctcagtatgtgggggc

SEQ ID NO: 2325370 - DNA, 17 bp, Homo sapiens
tcctccacccataataa

SEQ ID NO: 2325371 - DNA, 21 bp, Homo sapiens
tcctccagggaaggtggccac

SEQ ID NO: 2325372 - DNA, 19 bp, Homo sapiens
tcctcccagggcctcctgg

SEQ ID NO: 2325373 - DNA, 11 bp, Homo sapiens
tcctcccagtg

SEQ ID NO: 2325374 - DNA, 13 bp, Homo sapiens
tcctcccagtgag

SEQ ID NO: 2325375 - DNA, 16 bp, Homo sapiens
tcctccccttcctctt

SEQ ID NO: 2325376 - DNA, 18 bp, Homo sapiens
tcctcccttccttttccc

SEQ ID NO: 2325377 - DNA, 13 bp, Homo sapiens
tcctcctctgcct

SEQ ID NO: 2325378 - DNA, 19 bp, Homo sapiens
tcctcgcagcctctcagtg

SEQ ID NO: 2325379 - DNA, 17 bp, Homo sapiens
tcctctcccatccttga

SEQ ID NO: 2325380 - DNA, 13 bp, Homo sapiens
tcctctcccccag

SEQ ID NO: 2325381 - DNA, 21 bp, Homo sapiens
tcctctccccctcctccaggg

SEQ ID NO: 2325382 - DNA, 17 bp, Homo sapiens
tcctctggacggcaggc

SEQ ID NO: 2325383 - DNA, 20 bp, Homo sapiens
tcctctggacggcaggctca

SEQ ID NO: 2325384 - DNA, 16 bp, Homo sapiens
tcctctggccgcagag

SEQ ID NO: 2325385 - DNA, 17 bp, Homo sapiens
tcctctggccgcagagg

SEQ ID NO: 2325386 - DNA, 19 bp, Homo sapiens
tcctctggccgcagaggtg

SEQ ID NO: 2325387 - DNA, 18 bp, Homo sapiens
tcctctggctttcccagg

SEQ ID NO: 2325388 - DNA, 20 bp, Homo sapiens
tcctctggctttcccaggag

SEQ ID NO: 2325389 - DNA, 22 bp, Homo sapiens
tcctcttctactcacttttccc

SEQ ID NO: 2325390 - DNA, 12 bp, Homo sapiens
tcctctttctgc

SEQ ID NO: 2325391 - DNA, 16 bp, Homo sapiens
tcctctttctgctctg

SEQ ID NO: 2325392 - DNA, 17 bp, Homo sapiens
tctgtaataaaactgtt

SEQ ID NO: 2325393 - DNA, 16 bp, Homo sapiens
tctgtaataatagact

SEQ ID NO: 2325394 - DNA, 13 bp, Homo sapiens
tctgtagctcctc

SEQ ID NO: 2325395 - DNA, 14 bp, Homo sapiens
tctgtagctcctca

SEQ ID NO: 2325396 - DNA, 23 bp, Homo sapiens
tctgtattttatttagacaagag

SEQ ID NO: 2325397 - DNA, 14 bp, Homo sapiens
tctgtcaaatgtgt

SEQ ID NO: 2325398 - DNA, 20 bp, Homo sapiens
tctgtcaatcacagtctcag

SEQ ID NO: 2325399 - DNA, 12 bp, Homo sapiens
tctgtcagttct

SEQ ID NO: 2325400 - DNA, 20 bp, Homo sapiens
tctgtcccggttcaccttgc

SEQ ID NO: 2325401 - DNA, 14 bp, Homo sapiens
tctgtctcaaaaaa

SEQ ID NO: 2325402 - DNA, 22 bp, Homo sapiens
tctgtctcaaaaaaaaaaagaa

SEQ ID NO: 2325403 - DNA, 11 bp, Homo sapiens
tctgtctttcc

SEQ ID NO: 2325404 - DNA, 16 bp, Homo sapiens
tctgtgagccccacag

SEQ ID NO: 2325405 - DNA, 19 bp, Homo sapiens
tctgtggctggctctacct

SEQ ID NO: 2325406 - DNA, 23 bp, Homo sapiens
tctgtggctggctctaccttcct

SEQ ID NO: 2325407 - DNA, 16 bp, Homo sapiens
tctgtggttcctctgc

SEQ ID NO: 2325408 - DNA, 18 bp, Homo sapiens
tctgtggttcctctgctc

SEQ ID NO: 2325409 - DNA, 15 bp, Homo sapiens
tctgtgtcagcattc

SEQ ID NO: 2325410 - DNA, 20 bp, Homo sapiens
tctgtgttaattgcgtagag

SEQ ID NO: 2325411 - DNA, 17 bp, Homo sapiens
tctgttatgctgtgaca

SEQ ID NO: 2325412 - DNA, 16 bp, Homo sapiens
tctgttgtaatatcag

SEQ ID NO: 2325413 - DNA, 13 bp, Homo sapiens
tctgtttgaaact

SEQ ID NO: 2325414 - DNA, 20 bp, Homo sapiens
tctgttttgtggtttggaat

SEQ ID NO: 2325415 - DNA, 22 bp, Homo sapiens
tcttaaaataattcatatctaa

SEQ ID NO: 2325416 - DNA, 15 bp, Homo sapiens
tcttaagtggtctag

SEQ ID NO: 2325417 - DNA, 24 bp, Homo sapiens
tcttaataaaataaactagatatt

SEQ ID NO: 2325418 - DNA, 16 bp, Homo sapiens
tcttactaaaaagtat

SEQ ID NO: 2325419 - DNA, 17 bp, Homo sapiens
tcttactaaaaagtata

SEQ ID NO: 2325420 - DNA, 14 bp, Homo sapiens
tcttactctttcct

SEQ ID NO: 2325421 - DNA, 15 bp, Homo sapiens
tcttactctttccta

SEQ ID NO: 2325422 - DNA, 13 bp, Homo sapiens
tcttagattctta

SEQ ID NO: 2325423 - DNA, 14 bp, Homo sapiens
tcttagattcttaa

SEQ ID NO: 2325424 - DNA, 14 bp, Homo sapiens
tcttagctttttaa

SEQ ID NO: 2325425 - DNA, 22 bp, Homo sapiens
tcttagctttttaattgttgtt

SEQ ID NO: 2325426 - DNA, 12 bp, Homo sapiens
tcttagtcccaa

SEQ ID NO: 2325427 - DNA, 20 bp, Homo sapiens
tcttatctcagtcatgcata

SEQ ID NO: 2325428 - DNA, 16 bp, Homo sapiens
tcttatgaggagggga

SEQ ID NO: 2325429 - DNA, 17 bp, Homo sapiens
tcttatgtgaaaaatta

SEQ ID NO: 2325430 - DNA, 12 bp, Homo sapiens
tcttatgtgaca

SEQ ID NO: 2325431 - DNA, 21 bp, Homo sapiens
tcttatgtgacattaacaaat

SEQ ID NO: 2325432 - DNA, 13 bp, Homo sapiens
tcttatttcattt

SEQ ID NO: 2325433 - DNA, 20 bp, Homo sapiens
tcttcaacatgctccaaata

SEQ ID NO: 2325434 - DNA, 18 bp, Homo sapiens
tcttcacctcctgccagc

SEQ ID NO: 2325435 - DNA, 22 bp, Homo sapiens
tcttcactaccctgattcttga

SEQ ID NO: 2325436 - DNA, 12 bp, Homo sapiens
tcttcagcccag

SEQ ID NO: 2325437 - DNA, 22 bp, Homo sapiens
tcttcatggcatcttcaatatg

SEQ ID NO: 2325438 - DNA, 23 bp, Homo sapiens
tcttcatgttgatgtgtccgtga

SEQ ID NO: 2325439 - DNA, 16 bp, Homo sapiens
tcttccaacatgtgat

SEQ ID NO: 2325440 - DNA, 16 bp, Homo sapiens
tcttcctaatcgctaa

SEQ ID NO: 2325441 - DNA, 17 bp, Homo sapiens
tcttcctactggtctct

SEQ ID NO: 2325442 - DNA, 17 bp, Homo sapiens
tcttcctatccctctcc

SEQ ID NO: 2325443 - DNA, 17 bp, Homo sapiens
tcttcctccctgggggc

SEQ ID NO: 2325444 - DNA, 21 bp, Homo sapiens
tcttcctccctgggggcccca

SEQ ID NO: 2325445 - DNA, 15 bp, Homo sapiens
tcttcctgacacttt

SEQ ID NO: 2325446 - DNA, 13 bp, Homo sapiens
tcttcctgtgtcc

SEQ ID NO: 2325447 - DNA, 15 bp, Homo sapiens
tcttccttgatgttt

SEQ ID NO: 2325448 - DNA, 18 bp, Homo sapiens
tcttccttgatgtttggg

SEQ ID NO: 2325449 - DNA, 23 bp, Homo sapiens
tcttctagatgattttttgaaag

SEQ ID NO: 2325450 - DNA, 19 bp, Homo sapiens
tcttctcattcccatgtgg

SEQ ID NO: 2325451 - DNA, 15 bp, Homo sapiens
tcttctccctggaat

SEQ ID NO: 2325452 - DNA, 21 bp, Homo sapiens
tcttctcttatcctctctctc

SEQ ID NO: 2325453 - DNA, 19 bp, Homo sapiens
tcttctgaactcaaactga

SEQ ID NO: 2325454 - DNA, 24 bp, Homo sapiens
tcttctgaactcaaactgaggaat

SEQ ID NO: 2325455 - DNA, 20 bp, Homo sapiens
tcttctgggtagtcccctgt

SEQ ID NO: 2325456 - DNA, 14 bp, Homo sapiens
tcttctgtattttt

SEQ ID NO: 2325457 - DNA, 15 bp, Homo sapiens
tcttctgtccctgtt

SEQ ID NO: 2325458 - DNA, 16 bp, Homo sapiens
tcttctttccctggac

SEQ ID NO: 2325459 - DNA, 17 bp, Homo sapiens
tcttctttgtgcctgag

SEQ ID NO: 2325460 - DNA, 22 bp, Homo sapiens
tcttgagcagttagcagaccta

SEQ ID NO: 2325461 - DNA, 12 bp, Homo sapiens
tcttgagctggc

SEQ ID NO: 2325462 - DNA, 11 bp, Homo sapiens
tcttgctggct

SEQ ID NO: 2325463 - DNA, 22 bp, Homo sapiens
tcttgctgtaactcagacattc

SEQ ID NO: 2325464 - DNA, 19 bp, Homo sapiens
tcttggaagctgtttggaa

SEQ ID NO: 2325465 - DNA, 17 bp, Homo sapiens
tcttggacactgtacaa

SEQ ID NO: 2325466 - DNA, 17 bp, Homo sapiens
tcttgggatacagatct

SEQ ID NO: 2325467 - DNA, 20 bp, Homo sapiens
tcttggggctcgccccaccc

SEQ ID NO: 2325468 - DNA, 15 bp, Homo sapiens
tcttgggtgtattct

SEQ ID NO: 2325469 - DNA, 19 bp, Homo sapiens
tcttgggtgtattctctgt

SEQ ID NO: 2325470 - DNA, 20 bp, Homo sapiens
tcttgggtgtattctctgta

SEQ ID NO: 2325471 - DNA, 21 bp, Homo sapiens
tcttggtcacaaagctattta

SEQ ID NO: 2325472 - DNA, 14 bp, Homo sapiens
tcttgtaaagactg

SEQ ID NO: 2325473 - DNA, 15 bp, Homo sapiens
tcttgtaaagactgg

SEQ ID NO: 2325474 - DNA, 23 bp, Homo sapiens
tcttgtaaagactggttttctgc

SEQ ID NO: 2325475 - DNA, 14 bp, Homo sapiens
tcttgtacatgtgt

SEQ ID NO: 2325476 - DNA, 13 bp, Homo sapiens
tcttgtatttaaa

SEQ ID NO: 2325477 - DNA, 15 bp, Homo sapiens
tcttgtcttttcaga

SEQ ID NO: 2325478 - DNA, 20 bp, Homo sapiens
tcttgtgtctttggaggtgc

SEQ ID NO: 2325479 - DNA, 14 bp, Homo sapiens
tcttgtttctgaaa

SEQ ID NO: 2325480 - DNA, 16 bp, Homo sapiens
tctttaaaagaatgac

SEQ ID NO: 2325481 - DNA, 14 bp, Homo sapiens
tctttaaagttctt

SEQ ID NO: 2325482 - DNA, 22 bp, Homo sapiens
tctttaacatacaagaaaatgt

SEQ ID NO: 2325483 - DNA, 20 bp, Homo sapiens
tctttaatttatatcaggtg

SEQ ID NO: 2325484 - DNA, 17 bp, Homo sapiens
tctttcacaggtagcct

SEQ ID NO: 2325485 - DNA, 14 bp, Homo sapiens
tctttcagaaagct

SEQ ID NO: 2325486 - DNA, 23 bp, Homo sapiens
tctttcagaaatataacacattt

SEQ ID NO: 2325487 - DNA, 12 bp, Homo sapiens
tctttccaaatt

SEQ ID NO: 2325488 - DNA, 15 bp, Homo sapiens
tctttccaaattaaa

SEQ ID NO: 2325489 - DNA, 22 bp, Homo sapiens
tctttccaaattaaaacaaata

SEQ ID NO: 2325490 - DNA, 11 bp, Homo sapiens
tctttccctgg

SEQ ID NO: 2325491 - DNA, 12 bp, Homo sapiens
tctttccctgga

SEQ ID NO: 2325492 - DNA, 13 bp, Homo sapiens
tctttctagagca

SEQ ID NO: 2325493 - DNA, 16 bp, Homo sapiens
tctttctagtggtctt

SEQ ID NO: 2325494 - DNA, 13 bp, Homo sapiens
tctttctccctca

SEQ ID NO: 2325495 - DNA, 23 bp, Homo sapiens
tctttctggggggatatttccta

SEQ ID NO: 2325496 - DNA, 21 bp, Homo sapiens
tctttgacaattgggagctgc

SEQ ID NO: 2325497 - DNA, 14 bp, Homo sapiens
tctttgataatgtt

SEQ ID NO: 2325498 - DNA, 21 bp, Homo sapiens
tctttgataatgttaaatttg

SEQ ID NO: 2325499 - DNA, 20 bp, Homo sapiens
tctttgctcaacagaacata

SEQ ID NO: 2325500 - DNA, 12 bp, Homo sapiens
tctttgctcagt

SEQ ID NO: 2325501 - DNA, 17 bp, Homo sapiens
tctttgtaagagcaaaa

SEQ ID NO: 2325502 - DNA, 18 bp, Homo sapiens
tctttgtaagagtgtaga

SEQ ID NO: 2325503 - DNA, 22 bp, Homo sapiens
tctttgtaagagtgtagaagca

SEQ ID NO: 2325504 - DNA, 17 bp, Homo sapiens
tctttgtaccaaaattt

SEQ ID NO: 2325505 - DNA, 19 bp, Homo sapiens
tctttgtaccaaaatttta

SEQ ID NO: 2325506 - DNA, 14 bp, Homo sapiens
tctttgtgcctgag

SEQ ID NO: 2325507 - DNA, 14 bp, Homo sapiens
tgatgtggaggaag

SEQ ID NO: 2325508 - DNA, 18 bp, Homo sapiens
tgatgtggaggaagagcc

SEQ ID NO: 2325509 - DNA, 18 bp, Homo sapiens
tgatgttttcctataata

SEQ ID NO: 2325510 - DNA, 17 bp, Homo sapiens
tgattaagggacatttc

SEQ ID NO: 2325511 - DNA, 18 bp, Homo sapiens
tgattaagggacatttct

SEQ ID NO: 2325512 - DNA, 13 bp, Homo sapiens
tgattaataaaat

SEQ ID NO: 2325513 - DNA, 18 bp, Homo sapiens
tgattacctgaaagccct

SEQ ID NO: 2325514 - DNA, 18 bp, Homo sapiens
tgattatagcaactaatg

SEQ ID NO: 2325515 - DNA, 15 bp, Homo sapiens
tgattatcttcagcc

SEQ ID NO: 2325516 - DNA, 18 bp, Homo sapiens
tgattatcttcagcccag

SEQ ID NO: 2325517 - DNA, 16 bp, Homo sapiens
tgattcaatctgtaaa

SEQ ID NO: 2325518 - DNA, 19 bp, Homo sapiens
tgattccactacacctggc

SEQ ID NO: 2325519 - DNA, 21 bp, Homo sapiens
tgattcctggctctaccctgt

SEQ ID NO: 2325520 - DNA, 12 bp, Homo sapiens
tgattctgcctt

SEQ ID NO: 2325521 - DNA, 18 bp, Homo sapiens
tgattctggctttaagcc

SEQ ID NO: 2325522 - DNA, 21 bp, Homo sapiens
tgattctggctttaagccttc

SEQ ID NO: 2325523 - DNA, 17 bp, Homo sapiens
tgattcttgattcctgg

SEQ ID NO: 2325524 - DNA, 19 bp, Homo sapiens
tgattgaataatgccacca

SEQ ID NO: 2325525 - DNA, 16 bp, Homo sapiens
tgattggaccaggcca

SEQ ID NO: 2325526 - DNA, 17 bp, Homo sapiens
tgattggaccaggccat

SEQ ID NO: 2325527 - DNA, 16 bp, Homo sapiens
tgattgggaaaacatt

SEQ ID NO: 2325528 - DNA, 20 bp, Homo sapiens
tgattgggaaaacatttgct

SEQ ID NO: 2325529 - DNA, 23 bp, Homo sapiens
tgattgggtgggattttttccct

SEQ ID NO: 2325530 - DNA, 15 bp, Homo sapiens
tgatttaataaaata

SEQ ID NO: 2325531 - DNA, 20 bp, Homo sapiens
tgatttaataaaataattct

SEQ ID NO: 2325532 - DNA, 21 bp, Homo sapiens
tgatttaataaaataattcta

SEQ ID NO: 2325533 - DNA, 19 bp, Homo sapiens
tgatttactaacagtaact

SEQ ID NO: 2325534 - DNA, 20 bp, Homo sapiens
tgatttactaacagtaactg

SEQ ID NO: 2325535 - DNA, 19 bp, Homo sapiens
tgatttagggaagcaggga

SEQ ID NO: 2325536 - DNA, 15 bp, Homo sapiens
tgatttcagttctag

SEQ ID NO: 2325537 - DNA, 21 bp, Homo sapiens
tgatttcagttctaggaaaat

SEQ ID NO: 2325538 - DNA, 15 bp, Homo sapiens
tgatttccttcaatg

SEQ ID NO: 2325539 - DNA, 14 bp, Homo sapiens
tgatttctaattgt

SEQ ID NO: 2325540 - DNA, 20 bp, Homo sapiens
tgatttctttaaaagaatga

SEQ ID NO: 2325541 - DNA, 15 bp, Homo sapiens
tgatttgtaaaacag

SEQ ID NO: 2325542 - DNA, 19 bp, Homo sapiens
tgatttgtaaaacagtggt

SEQ ID NO: 2325543 - DNA, 20 bp, Homo sapiens
tgatttgtaacccactgaga

SEQ ID NO: 2325544 - DNA, 20 bp, Homo sapiens
tgatttgtgaaacagttgct

SEQ ID NO: 2325545 - DNA, 14 bp, Homo sapiens
tgattttaatacat

SEQ ID NO: 2325546 - DNA, 22 bp, Homo sapiens
tgatttttgcctcttccagtct

SEQ ID NO: 2325547 - DNA, 18 bp, Homo sapiens
tgattttttgaaagttaa

SEQ ID NO: 2325548 - DNA, 16 bp, Homo sapiens
tgcaaaaaattcttta

SEQ ID NO: 2325549 - DNA, 15 bp, Homo sapiens
tgcaaagagacattt

SEQ ID NO: 2325550 - DNA, 18 bp, Homo sapiens
tgcaaagctttggctgag

SEQ ID NO: 2325551 - DNA, 21 bp, Homo sapiens
tgcaaatgagctctgaaatct

SEQ ID NO: 2325552 - DNA, 17 bp, Homo sapiens
tgcaacctcaccttcct

SEQ ID NO: 2325553 - DNA, 21 bp, Homo sapiens
tgcaacctcaccttcctgtgg

SEQ ID NO: 2325554 - DNA, 17 bp, Homo sapiens
tgcaagaccctcccatg

SEQ ID NO: 2325555 - DNA, 13 bp, Homo sapiens
tgcaaggtggcct

SEQ ID NO: 2325556 - DNA, 12 bp, Homo sapiens
tgcaagtgctgg

SEQ ID NO: 2325557 - DNA, 13 bp, Homo sapiens
tgcaagtgctgga

SEQ ID NO: 2325558 - DNA, 15 bp, Homo sapiens
tgcaagtgctggagt

SEQ ID NO: 2325559 - DNA, 14 bp, Homo sapiens
tgcaataaaattta

SEQ ID NO: 2325560 - DNA, 15 bp, Homo sapiens
tgcaataaaatttaa

SEQ ID NO: 2325561 - DNA, 11 bp, Homo sapiens
tgcaataattt

SEQ ID NO: 2325562 - DNA, 17 bp, Homo sapiens
tgcaatgtatagtgtct

SEQ ID NO: 2325563 - DNA, 20 bp, Homo sapiens
tgcaattaaacttccaaaga

SEQ ID NO: 2325564 - DNA, 22 bp, Homo sapiens
tgcaattgtaggggtgtgtgtg

SEQ ID NO: 2325565 - DNA, 15 bp, Homo sapiens
tgcacaataaaaatg

SEQ ID NO: 2325566 - DNA, 20 bp, Homo sapiens
tgcacaataaaaatgtttaa

SEQ ID NO: 2325567 - DNA, 15 bp, Homo sapiens
tgcacacagaatgct

SEQ ID NO: 2325568 - DNA, 12 bp, Homo sapiens
tgcacacaggac

SEQ ID NO: 2325569 - DNA, 14 bp, Homo sapiens
tgcacacaggacag

SEQ ID NO: 2325570 - DNA, 17 bp, Homo sapiens
tgcacacaggacagcgg

SEQ ID NO: 2325571 - DNA, 16 bp, Homo sapiens
tgcacagctggagaaa

SEQ ID NO: 2325572 - DNA, 17 bp, Homo sapiens
tgcacagtcactgctct

SEQ ID NO: 2325573 - DNA, 22 bp, Homo sapiens
tgcacataagcttccattttaa

SEQ ID NO: 2325574 - DNA, 20 bp, Homo sapiens
tgcacatacgggctttaata

SEQ ID NO: 2325575 - DNA, 14 bp, Homo sapiens
tgcacatatggact

SEQ ID NO: 2325576 - DNA, 18 bp, Homo sapiens
tgcacatatggactctgc

SEQ ID NO: 2325577 - DNA, 23 bp, Homo sapiens
tgcacatgaatcccacccacatg

SEQ ID NO: 2325578 - DNA, 23 bp, Homo sapiens
tgcacatgtcttgtacatgtgta

SEQ ID NO: 2325579 - DNA, 17 bp, Homo sapiens
tgcacatttctttgcat

SEQ ID NO: 2325580 - DNA, 18 bp, Homo sapiens
tgcacatttctttgcatt

SEQ ID NO: 2325581 - DNA, 22 bp, Homo sapiens
tgcaccatactccttgcttcct

SEQ ID NO: 2325582 - DNA, 20 bp, Homo sapiens
tgcacccacctgttttctga

SEQ ID NO: 2325583 - DNA, 19 bp, Homo sapiens
tgcaccccttctctcctcc

SEQ ID NO: 2325584 - DNA, 23 bp, Homo sapiens
tgcacctacccatacaccccctc

SEQ ID NO: 2325585 - DNA, 13 bp, Homo sapiens
tgcacctgagacc

SEQ ID NO: 2325586 - DNA, 15 bp, Homo sapiens
tgcaccttaaaagac

SEQ ID NO: 2325587 - DNA, 15 bp, Homo sapiens
tgcactagagaaaat

SEQ ID NO: 2325588 - DNA, 18 bp, Homo sapiens
tgcactagagaaaataaa

SEQ ID NO: 2325589 - DNA, 13 bp, Homo sapiens
tgcactagcattt

SEQ ID NO: 2325590 - DNA, 17 bp, Homo sapiens
tgcactccagcctgggg

SEQ ID NO: 2325591 - DNA, 20 bp, Homo sapiens
tgcactgggaggctcccctt

SEQ ID NO: 2325592 - DNA, 19 bp, Homo sapiens
tgcacttttagaaatgcat

SEQ ID NO: 2325593 - DNA, 21 bp, Homo sapiens
tgcacttttagaaatgcatat

SEQ ID NO: 2325594 - DNA, 14 bp, Homo sapiens
tgcagaatcccttt

SEQ ID NO: 2325595 - DNA, 17 bp, Homo sapiens
tgcagacctcaagccat

SEQ ID NO: 2325596 - DNA, 18 bp, Homo sapiens
tgcagacctcaagccatc

SEQ ID NO: 2325597 - DNA, 14 bp, Homo sapiens
tgcagacctcatgc

SEQ ID NO: 2325598 - DNA, 18 bp, Homo sapiens
tgcagacctcatgcccag

SEQ ID NO: 2325599 - DNA, 22 bp, Homo sapiens
tgcagacctcatgcccagctct

SEQ ID NO: 2325600 - DNA, 19 bp, Homo sapiens
tgcagagaaacttaagcaa

SEQ ID NO: 2325601 - DNA, 19 bp, Homo sapiens
tgcagagccttctcagaag

SEQ ID NO: 2325602 - DNA, 22 bp, Homo sapiens
tgcagagccttctcagaagcac

SEQ ID NO: 2325603 - DNA, 17 bp, Homo sapiens
tgcagatgccaccctag

SEQ ID NO: 2325604 - DNA, 20 bp, Homo sapiens
tgcagatgccaccctagcca

SEQ ID NO: 2325605 - DNA, 21 bp, Homo sapiens
tgcagcctcatactcctgggc

SEQ ID NO: 2325606 - DNA, 13 bp, Homo sapiens
tgcagccttctcc

SEQ ID NO: 2325607 - DNA, 15 bp, Homo sapiens
tgcagccttctccat

SEQ ID NO: 2325608 - DNA, 15 bp, Homo sapiens
tgcagctttgcaaac

SEQ ID NO: 2325609 - DNA, 16 bp, Homo sapiens
tgcaggagagagcagc

SEQ ID NO: 2325610 - DNA, 21 bp, Homo sapiens
tgcaggagagagcagcactcc

SEQ ID NO: 2325611 - DNA, 13 bp, Homo sapiens
tgcaggaggtgga

SEQ ID NO: 2325612 - DNA, 14 bp, Homo sapiens
tgcaggaggtggag

SEQ ID NO: 2325613 - DNA, 16 bp, Homo sapiens
tgcaggattcccttct

SEQ ID NO: 2325614 - DNA, 21 bp, Homo sapiens
tgcaggattcccttctgggct

SEQ ID NO: 2325615 - DNA, 22 bp, Homo sapiens
tgcaggattcccttctgggctt

SEQ ID NO: 2325616 - DNA, 19 bp, Homo sapiens
tgcaggcagagctggagcc

SEQ ID NO: 2325617 - DNA, 15 bp, Homo sapiens
tgcagtcactggagg

SEQ ID NO: 2325618 - DNA, 23 bp, Homo sapiens
tgcagtcagcagatgctgttgtg

SEQ ID NO: 2325619 - DNA, 20 bp, Homo sapiens
tgcagtgagccaaaatcatg

SEQ ID NO: 2325620 - DNA, 21 bp, Homo sapiens
tgcagtgatatggcagaagac

SEQ ID NO: 2325621 - DNA, 15 bp, Homo sapiens
tggacagcagaagcc

SEQ ID NO: 2325622 - DNA, 19 bp, Homo sapiens
tggacagcagaagcctcca

SEQ ID NO: 2325623 - DNA, 15 bp, Homo sapiens
tggacaggcagcctc

SEQ ID NO: 2325624 - DNA, 17 bp, Homo sapiens
tggacatttagaagaaa

SEQ ID NO: 2325625 - DNA, 19 bp, Homo sapiens
tggacatttagaagaaaga

SEQ ID NO: 2325626 - DNA, 18 bp, Homo sapiens
tggaccaacctgctctgt

SEQ ID NO: 2325627 - DNA, 21 bp, Homo sapiens
tggaccaacctgctctgtccc

SEQ ID NO: 2325628 - DNA, 20 bp, Homo sapiens
tggaccaatagggctgagct

SEQ ID NO: 2325629 - DNA, 16 bp, Homo sapiens
tggaccactcctgtcc

SEQ ID NO: 2325630 - DNA, 15 bp, Homo sapiens
tggaccatgccagat

SEQ ID NO: 2325631 - DNA, 18 bp, Homo sapiens
tggacctccaggctccag

SEQ ID NO: 2325632 - DNA, 23 bp, Homo sapiens
tggacggcaggctcactgccagg

SEQ ID NO: 2325633 - DNA, 16 bp, Homo sapiens
tggactctgcacatga

SEQ ID NO: 2325634 - DNA, 18 bp, Homo sapiens
tggactctgcacatgtct

SEQ ID NO: 2325635 - DNA, 21 bp, Homo sapiens
tggactgtcacggggttccct

SEQ ID NO: 2325636 - DNA, 17 bp, Homo sapiens
tggacttctacctgccc

SEQ ID NO: 2325637 - DNA, 13 bp, Homo sapiens
tggagaagctgca

SEQ ID NO: 2325638 - DNA, 20 bp, Homo sapiens
tggagacaaggtgctaacat

SEQ ID NO: 2325639 - DNA, 22 bp, Homo sapiens
tggagaccctgccacagccaga

SEQ ID NO: 2325640 - DNA, 12 bp, Homo sapiens
tggagagcagct

SEQ ID NO: 2325641 - DNA, 20 bp, Homo sapiens
tggagagcagctggctctcc

SEQ ID NO: 2325642 - DNA, 16 bp, Homo sapiens
tggagagggggcctgg

SEQ ID NO: 2325643 - DNA, 15 bp, Homo sapiens
tggagcactggactc

SEQ ID NO: 2325644 - DNA, 13 bp, Homo sapiens
tggaggaagagcc

SEQ ID NO: 2325645 - DNA, 14 bp, Homo sapiens
tggaggaagagcca

SEQ ID NO: 2325646 - DNA, 16 bp, Homo sapiens
tggaggaagagccacc

SEQ ID NO: 2325647 - DNA, 23 bp, Homo sapiens
tggaggaagagccacctgcaaga

SEQ ID NO: 2325648 - DNA, 18 bp, Homo sapiens
tggaggattatcagtatc

SEQ ID NO: 2325649 - DNA, 20 bp, Homo sapiens
tggaggcctcaggtgctgtc

SEQ ID NO: 2325650 - DNA, 20 bp, Homo sapiens
tggaggcttcctgcgtcctc

SEQ ID NO: 2325651 - DNA, 18 bp, Homo sapiens
tggaggggtgtggcagtg

SEQ ID NO: 2325652 - DNA, 14 bp, Homo sapiens
tggagttcaccttg

SEQ ID NO: 2325653 - DNA, 17 bp, Homo sapiens
tggagttcaccttggaa

SEQ ID NO: 2325654 - DNA, 15 bp, Homo sapiens
tggagttcttgtgcc

SEQ ID NO: 2325655 - DNA, 20 bp, Homo sapiens
tggagttgactgactgagca

SEQ ID NO: 2325656 - DNA, 17 bp, Homo sapiens
tggataactagccagac

SEQ ID NO: 2325657 - DNA, 16 bp, Homo sapiens
tggatatagttttact

SEQ ID NO: 2325658 - DNA, 19 bp, Homo sapiens
tggatctgatctgtaccat

SEQ ID NO: 2325659 - DNA, 20 bp, Homo sapiens
tggatgcctcattatgtcaa

SEQ ID NO: 2325660 - DNA, 20 bp, Homo sapiens
tggatggcacctcaggctga

SEQ ID NO: 2325661 - DNA, 21 bp, Homo sapiens
tggatggcacctcaggctgag

SEQ ID NO: 2325662 - DNA, 18 bp, Homo sapiens
tggatggccgtggatgcg

SEQ ID NO: 2325663 - DNA, 18 bp, Homo sapiens
tggatggctcaagtctgc

SEQ ID NO: 2325664 - DNA, 23 bp, Homo sapiens
tggatggcttgtctatactcctt

SEQ ID NO: 2325665 - DNA, 15 bp, Homo sapiens
tggattatttaataa

SEQ ID NO: 2325666 - DNA, 17 bp, Homo sapiens
tggattatttaataaca

SEQ ID NO: 2325667 - DNA, 18 bp, Homo sapiens
tggattatttaataacat

SEQ ID NO: 2325668 - DNA, 17 bp, Homo sapiens
tggattggattatttaa

SEQ ID NO: 2325669 - DNA, 21 bp, Homo sapiens
tggatttggcactagccaaag

SEQ ID NO: 2325670 - DNA, 14 bp, Homo sapiens
tggattttcctgaa

SEQ ID NO: 2325671 - DNA, 17 bp, Homo sapiens
tggcaaacgctaaagag

SEQ ID NO: 2325672 - DNA, 20 bp, Homo sapiens
tggcaatattctgtaactat

SEQ ID NO: 2325673 - DNA, 16 bp, Homo sapiens
tggcaatgctaattca

SEQ ID NO: 2325674 - DNA, 19 bp, Homo sapiens
tggcaatgctaattcaatg

SEQ ID NO: 2325675 - DNA, 18 bp, Homo sapiens
tggcaattttatgttttt

SEQ ID NO: 2325676 - DNA, 23 bp, Homo sapiens
tggcacagaggtagtctcactgc

SEQ ID NO: 2325677 - DNA, 17 bp, Homo sapiens
tggcacctcaggctgag

SEQ ID NO: 2325678 - DNA, 22 bp, Homo sapiens
tggcacttgccattccaaaata

SEQ ID NO: 2325679 - DNA, 14 bp, Homo sapiens
tggcagaagacacc

SEQ ID NO: 2325680 - DNA, 21 bp, Homo sapiens
tggcagaagacaccagagcag

SEQ ID NO: 2325681 - DNA, 17 bp, Homo sapiens
tggcagatgtcttccct

SEQ ID NO: 2325682 - DNA, 19 bp, Homo sapiens
tggcagatgtcttccctgg

SEQ ID NO: 2325683 - DNA, 20 bp, Homo sapiens
tggcagatgtcttccctggg

SEQ ID NO: 2325684 - DNA, 20 bp, Homo sapiens
tggcaggtgggggtgggctg

SEQ ID NO: 2325685 - DNA, 15 bp, Homo sapiens
tggcataaattgcat

SEQ ID NO: 2325686 - DNA, 17 bp, Homo sapiens
tggcatcttcaatatga

SEQ ID NO: 2325687 - DNA, 13 bp, Homo sapiens
tggcatttccaaa

SEQ ID NO: 2325688 - DNA, 17 bp, Homo sapiens
tggcatttctctttaaa

SEQ ID NO: 2325689 - DNA, 21 bp, Homo sapiens
tggcatttggtctcaggcagc

SEQ ID NO: 2325690 - DNA, 13 bp, Homo sapiens
tggccacagcgcc

SEQ ID NO: 2325691 - DNA, 17 bp, Homo sapiens
tggccagcccctggggc

SEQ ID NO: 2325692 - DNA, 12 bp, Homo sapiens
tggccaggagca

SEQ ID NO: 2325693 - DNA, 14 bp, Homo sapiens
tggccaggagcagg

SEQ ID NO: 2325694 - DNA, 22 bp, Homo sapiens
tggccaggagcaggcacgggtg

SEQ ID NO: 2325695 - DNA, 16 bp, Homo sapiens
tggccatgcaggaggt

SEQ ID NO: 2325696 - DNA, 21 bp, Homo sapiens
tggccatgcaggaggtggaga

SEQ ID NO: 2325697 - DNA, 21 bp, Homo sapiens
tggccatggaataaaccattt

SEQ ID NO: 2325698 - DNA, 13 bp, Homo sapiens
tggccatggcctg

SEQ ID NO: 2325699 - DNA, 18 bp, Homo sapiens
tggccatgttatgctggt

SEQ ID NO: 2325700 - DNA, 16 bp, Homo sapiens
tggccattttaaaatg

SEQ ID NO: 2325701 - DNA, 19 bp, Homo sapiens
tggccccactttgaagggc

SEQ ID NO: 2325702 - DNA, 19 bp, Homo sapiens
tggccccagccctgctggg

SEQ ID NO: 2325703 - DNA, 20 bp, Homo sapiens
tggccccagccctgctgggg

SEQ ID NO: 2325704 - DNA, 21 bp, Homo sapiens
tggccccaggccccagacagg

SEQ ID NO: 2325705 - DNA, 15 bp, Homo sapiens
tggcccctactttgt

SEQ ID NO: 2325706 - DNA, 23 bp, Homo sapiens
tggccctgggagaatcgctcctg

SEQ ID NO: 2325707 - DNA, 16 bp, Homo sapiens
tggccctgtagctctg

SEQ ID NO: 2325708 - DNA, 14 bp, Homo sapiens
tggccctgtcccag

SEQ ID NO: 2325709 - DNA, 15 bp, Homo sapiens
tggccctgtcccagg

SEQ ID NO: 2325710 - DNA, 18 bp, Homo sapiens
tggccgcgctccgggctt

SEQ ID NO: 2325711 - DNA, 20 bp, Homo sapiens
tggccgcttctccccagagc

SEQ ID NO: 2325712 - DNA, 20 bp, Homo sapiens
tggccggcggctactctgga

SEQ ID NO: 2325713 - DNA, 19 bp, Homo sapiens
tggcctatccgctgccagc

SEQ ID NO: 2325714 - DNA, 19 bp, Homo sapiens
tggcctgagagtcagctct

SEQ ID NO: 2325715 - DNA, 15 bp, Homo sapiens
tggcctgcaaactgg

SEQ ID NO: 2325716 - DNA, 23 bp, Homo sapiens
tggcctgcaaactgggaacccct

SEQ ID NO: 2325717 - DNA, 11 bp, Homo sapiens
tggcctggaca

SEQ ID NO: 2325718 - DNA, 16 bp, Homo sapiens
tggcctggcacacatc

SEQ ID NO: 2325719 - DNA, 23 bp, Homo sapiens
tggccttctcctacttagggaag

SEQ ID NO: 2325720 - DNA, 12 bp, Homo sapiens
tggcctttcctt

SEQ ID NO: 2325721 - DNA, 18 bp, Homo sapiens
tggcctttgtaagtgcag

SEQ ID NO: 2325722 - DNA, 20 bp, Homo sapiens
tggcctttgtaagtgcagga

SEQ ID NO: 2325723 - DNA, 22 bp, Homo sapiens
tggcgagttctctttggaaata

SEQ ID NO: 2325724 - DNA, 16 bp, Homo sapiens
tggcgcaggtgggctg

SEQ ID NO: 2325725 - DNA, 14 bp, Homo sapiens
tggcgccctgcctc

SEQ ID NO: 2325726 - DNA, 21 bp, Homo sapiens
tggcgccctgcctcctggagg

SEQ ID NO: 2325727 - DNA, 20 bp, Homo sapiens
tggcgcttagagaggacaat

SEQ ID NO: 2325728 - DNA, 22 bp, Homo sapiens
tggcgtagcagagttaaatctc

SEQ ID NO: 2325729 - DNA, 12 bp, Homo sapiens
tggcgtgacccg

SEQ ID NO: 2325730 - DNA, 19 bp, Homo sapiens
tggctacgcctcttctgtc

SEQ ID NO: 2325731 - DNA, 18 bp, Homo sapiens
tggctcaagacaaggctg

SEQ ID NO: 2325732 - DNA, 22 bp, Homo sapiens
tggctcaagacaaggctggcaa

SEQ ID NO: 2325733 - DNA, 13 bp, Homo sapiens
tggctcacgcctg

SEQ ID NO: 2325734 - DNA, 14 bp, Homo sapiens
tggctcacgcctgt

SEQ ID NO: 2325735 - DNA, 14 bp, Homo sapiens
tgtataaataggag

SEQ ID NO: 2325736 - DNA, 18 bp, Homo sapiens
tgtataaataggagagga

SEQ ID NO: 2325737 - DNA, 11 bp, Homo sapiens
tgtataaatgt

SEQ ID NO: 2325738 - DNA, 18 bp, Homo sapiens
tgtataatagagataagt

SEQ ID NO: 2325739 - DNA, 22 bp, Homo sapiens
tgtatacagtgcagagccttct

SEQ ID NO: 2325740 - DNA, 13 bp, Homo sapiens
tgtatagcatgaa

SEQ ID NO: 2325741 - DNA, 21 bp, Homo sapiens
tgtatagtgtctattatcaca

SEQ ID NO: 2325742 - DNA, 22 bp, Homo sapiens
tgtatccaaggaaacattttat

SEQ ID NO: 2325743 - DNA, 18 bp, Homo sapiens
tgtatgaaaaattgggga

SEQ ID NO: 2325744 - DNA, 20 bp, Homo sapiens
tgtatgaaaaattggggagg

SEQ ID NO: 2325745 - DNA, 20 bp, Homo sapiens
tgtatgactaaagagagaat

SEQ ID NO: 2325746 - DNA, 17 bp, Homo sapiens
tgtatgagtagccaggg

SEQ ID NO: 2325747 - DNA, 23 bp, Homo sapiens
tgtatgtgagctgtaaaaatgtt

SEQ ID NO: 2325748 - DNA, 15 bp, Homo sapiens
tgtatgttaaagaga

SEQ ID NO: 2325749 - DNA, 18 bp, Homo sapiens
tgtattactgaataatat

SEQ ID NO: 2325750 - DNA, 16 bp, Homo sapiens
tgtattattgttctca

SEQ ID NO: 2325751 - DNA, 14 bp, Homo sapiens
tgtattcagaggca

SEQ ID NO: 2325752 - DNA, 19 bp, Homo sapiens
tgtattcctttaaaatatt

SEQ ID NO: 2325753 - DNA, 12 bp, Homo sapiens
tgtattctctgt

SEQ ID NO: 2325754 - DNA, 13 bp, Homo sapiens
tgtattctctgta

SEQ ID NO: 2325755 - DNA, 15 bp, Homo sapiens
tgtattctctgtaag

SEQ ID NO: 2325756 - DNA, 14 bp, Homo sapiens
tgtattctgaggat

SEQ ID NO: 2325757 - DNA, 18 bp, Homo sapiens
tgtattcttttctcagtg

SEQ ID NO: 2325758 - DNA, 18 bp, Homo sapiens
tgtattgtatattacaat

SEQ ID NO: 2325759 - DNA, 15 bp, Homo sapiens
tgtatttgagcatat

SEQ ID NO: 2325760 - DNA, 17 bp, Homo sapiens
tgtattttatcttattt

SEQ ID NO: 2325761 - DNA, 21 bp, Homo sapiens
tgtatttttttttctaagaga

SEQ ID NO: 2325762 - DNA, 22 bp, Homo sapiens
tgtatttttttttctaagagaa

SEQ ID NO: 2325763 - DNA, 18 bp, Homo sapiens
tgtcaagctggtgctact

SEQ ID NO: 2325764 - DNA, 13 bp, Homo sapiens
tgtcaaggaagaa

SEQ ID NO: 2325765 - DNA, 21 bp, Homo sapiens
tgtcacaagtggtgtttattg

SEQ ID NO: 2325766 - DNA, 22 bp, Homo sapiens
tgtcacaagtggtgtttattgc

SEQ ID NO: 2325767 - DNA, 19 bp, Homo sapiens
tgtcacaattatgtgcaaa

SEQ ID NO: 2325768 - DNA, 16 bp, Homo sapiens
tgtcaccctgcagagc

SEQ ID NO: 2325769 - DNA, 17 bp, Homo sapiens
tgtcaccctgcagagct

SEQ ID NO: 2325770 - DNA, 14 bp, Homo sapiens
tgtcagctgaggct

SEQ ID NO: 2325771 - DNA, 24 bp, Homo sapiens
tgtcagctgaggctgggggagagc

SEQ ID NO: 2325772 - DNA, 17 bp, Homo sapiens
tgtcagtactattcagg

SEQ ID NO: 2325773 - DNA, 21 bp, Homo sapiens
tgtcagtgctagatttagcac

SEQ ID NO: 2325774 - DNA, 19 bp, Homo sapiens
tgtccaaaagcgccctcac

SEQ ID NO: 2325775 - DNA, 15 bp, Homo sapiens
tgtccagcttccaaa

SEQ ID NO: 2325776 - DNA, 16 bp, Homo sapiens
tgtccagcttccaaag

SEQ ID NO: 2325777 - DNA, 13 bp, Homo sapiens
tgtccaggcagct

SEQ ID NO: 2325778 - DNA, 12 bp, Homo sapiens
tgtccagtgcct

SEQ ID NO: 2325779 - DNA, 16 bp, Homo sapiens
tgtccagtgcctacat

SEQ ID NO: 2325780 - DNA, 15 bp, Homo sapiens
tgtccataaataaag

SEQ ID NO: 2325781 - DNA, 20 bp, Homo sapiens
tgtccatacactttgttgca

SEQ ID NO: 2325782 - DNA, 18 bp, Homo sapiens
tgtcccagatgctgtcat

SEQ ID NO: 2325783 - DNA, 22 bp, Homo sapiens
tgtcccagatgctgtcattagt

SEQ ID NO: 2325784 - DNA, 13 bp, Homo sapiens
tgtcccagccagt

SEQ ID NO: 2325785 - DNA, 15 bp, Homo sapiens
tgtcccccaggctgg

SEQ ID NO: 2325786 - DNA, 16 bp, Homo sapiens
tgtcccctcccagagc

SEQ ID NO: 2325787 - DNA, 16 bp, Homo sapiens
tgtccctgtagctcag

SEQ ID NO: 2325788 - DNA, 17 bp, Homo sapiens
tgtccggaatgccaccc

SEQ ID NO: 2325789 - DNA, 21 bp, Homo sapiens
tgtccgtgaaagttgtgatct

SEQ ID NO: 2325790 - DNA, 21 bp, Homo sapiens
tgtcctccaggagcttcttgt

SEQ ID NO: 2325791 - DNA, 22 bp, Homo sapiens
tgtcctgaaacgctcctttgtg

SEQ ID NO: 2325792 - DNA, 14 bp, Homo sapiens
tgtcctgcctgtct

SEQ ID NO: 2325793 - DNA, 16 bp, Homo sapiens
tgtcctgcctgtctgc

SEQ ID NO: 2325794 - DNA, 17 bp, Homo sapiens
tgtcctgcctgtctgcc

SEQ ID NO: 2325795 - DNA, 19 bp, Homo sapiens
tgtcctgcctgtctgcccc

SEQ ID NO: 2325796 - DNA, 24 bp, Homo sapiens
tgtcctgtagttgcgtggactctg

SEQ ID NO: 2325797 - DNA, 13 bp, Homo sapiens
tgtcctttatgta

SEQ ID NO: 2325798 - DNA, 21 bp, Homo sapiens
tgtcctttatgtattctcttc

SEQ ID NO: 2325799 - DNA, 15 bp, Homo sapiens
tgtcctttttcactt

SEQ ID NO: 2325800 - DNA, 18 bp, Homo sapiens
tgtcctttttcactttga

SEQ ID NO: 2325801 - DNA, 20 bp, Homo sapiens
tgtcctttttcactttgaaa

SEQ ID NO: 2325802 - DNA, 17 bp, Homo sapiens
tgtcctttttcctctcc

SEQ ID NO: 2325803 - DNA, 12 bp, Homo sapiens
tgtctaaagatc

SEQ ID NO: 2325804 - DNA, 19 bp, Homo sapiens
tgtctaaagtgtattttca

SEQ ID NO: 2325805 - DNA, 23 bp, Homo sapiens
tgtctaaagtgtattttcagagc

SEQ ID NO: 2325806 - DNA, 17 bp, Homo sapiens
tgtctaggactgcagtg

SEQ ID NO: 2325807 - DNA, 18 bp, Homo sapiens
tgtctaggactgcagtgt

SEQ ID NO: 2325808 - DNA, 19 bp, Homo sapiens
tgtctaggactgcagtgtg

SEQ ID NO: 2325809 - DNA, 12 bp, Homo sapiens
tgtctcatgttt

SEQ ID NO: 2325810 - DNA, 20 bp, Homo sapiens
tgtctcatgttttatatgat

SEQ ID NO: 2325811 - DNA, 17 bp, Homo sapiens
tgtctccctcccctctc

SEQ ID NO: 2325812 - DNA, 21 bp, Homo sapiens
tgtctccctcccctctcagaa

SEQ ID NO: 2325813 - DNA, 21 bp, Homo sapiens
tgtctccttaagctgcagaga

SEQ ID NO: 2325814 - DNA, 13 bp, Homo sapiens
tgtctgatttctt

SEQ ID NO: 2325815 - DNA, 16 bp, Homo sapiens
tgtctgcagtgtgccc

SEQ ID NO: 2325816 - DNA, 19 bp, Homo sapiens
tgtctgcagtgtgcccccc

SEQ ID NO: 2325817 - DNA, 15 bp, Homo sapiens
tgtctgccaaacaca

SEQ ID NO: 2325818 - DNA, 18 bp, Homo sapiens
tgtctgccatgttgcccc

SEQ ID NO: 2325819 - DNA, 19 bp, Homo sapiens
tgtctgccccagcccagat

SEQ ID NO: 2325820 - DNA, 17 bp, Homo sapiens
tgtctgctggtatttct

SEQ ID NO: 2325821 - DNA, 15 bp, Homo sapiens
tgtctgggtgctact

SEQ ID NO: 2325822 - DNA, 16 bp, Homo sapiens
tgtctgtcaatcacag

SEQ ID NO: 2325823 - DNA, 12 bp, Homo sapiens
tgtctgtccctt

SEQ ID NO: 2325824 - DNA, 20 bp, Homo sapiens
tgtctgtcccttttctttga

SEQ ID NO: 2325825 - DNA, 12 bp, Homo sapiens
tgtctgtctccc

SEQ ID NO: 2325826 - DNA, 15 bp, Homo sapiens
tgtctgtctccctcc

SEQ ID NO: 2325827 - DNA, 21 bp, Homo sapiens
tgtctgtttattaactactga

SEQ ID NO: 2325828 - DNA, 21 bp, Homo sapiens
tgtcttatgtgaaaaattaac

SEQ ID NO: 2325829 - DNA, 22 bp, Homo sapiens
tgtcttatgtgaaaaattaact

SEQ ID NO: 2325830 - DNA, 12 bp, Homo sapiens
tgtcttattgca

SEQ ID NO: 2325831 - DNA, 13 bp, Homo sapiens
tgtcttattgcac

SEQ ID NO: 2325832 - DNA, 20 bp, Homo sapiens
tgtcttcaatggaatacagt

SEQ ID NO: 2325833 - DNA, 11 bp, Homo sapiens
tgtcttcctca

SEQ ID NO: 2325834 - DNA, 22 bp, Homo sapiens
tgtcttcctcaaaataaagaag

SEQ ID NO: 2325835 - DNA, 13 bp, Homo sapiens
tgtcttggacact

SEQ ID NO: 2325836 - DNA, 16 bp, Homo sapiens
tgtcttgtatttaaaa

SEQ ID NO: 2325837 - DNA, 16 bp, Homo sapiens
tgtctttcagatacat

SEQ ID NO: 2325838 - DNA, 19 bp, Homo sapiens
tgtctttcagatacatggt

SEQ ID NO: 2325839 - DNA, 14 bp, Homo sapiens
tgtgaaaaattaac

SEQ ID NO: 2325840 - DNA, 19 bp, Homo sapiens
tgtgaaacagttgctgtga

SEQ ID NO: 2325841 - DNA, 22 bp, Homo sapiens
tgtgaaaccttttttaagattt

SEQ ID NO: 2325842 - DNA, 20 bp, Homo sapiens
tgtgaaccctggggcctgac

SEQ ID NO: 2325843 - DNA, 22 bp, Homo sapiens
tgtgaaccctggggcctgactg

SEQ ID NO: 2325844 - DNA, 13 bp, Homo sapiens
tgtgaactttcat

SEQ ID NO: 2325845 - DNA, 18 bp, Homo sapiens
tgtgaagagggagaagca

SEQ ID NO: 2325846 - DNA, 16 bp, Homo sapiens
tgtgaatagcctggcc

SEQ ID NO: 2325847 - DNA, 15 bp, Homo sapiens
tgtgaattattgaca

SEQ ID NO: 2325848 - DNA, 17 bp, Homo sapiens
tgtgaattattgacact

SEQ ID NO: 2325849 - DNA, 19 bp, Homo sapiens
tgtgaattattgacactga

SEQ ID NO: 2325850 - DNA, 16 bp, Homo sapiens
ttaagattggaaatgt

SEQ ID NO: 2325851 - DNA, 16 bp, Homo sapiens
ttaagatttttctcaa

SEQ ID NO: 2325852 - DNA, 19 bp, Homo sapiens
ttaagcaaatgttaaaagt

SEQ ID NO: 2325853 - DNA, 22 bp, Homo sapiens
ttaagccaatatttactcatca

SEQ ID NO: 2325854 - DNA, 16 bp, Homo sapiens
ttaagccttcaaaact

SEQ ID NO: 2325855 - DNA, 16 bp, Homo sapiens
ttaagctttttggaat

SEQ ID NO: 2325856 - DNA, 14 bp, Homo sapiens
ttaaggaatttgat

SEQ ID NO: 2325857 - DNA, 18 bp, Homo sapiens
ttaagggaagaattccag

SEQ ID NO: 2325858 - DNA, 17 bp, Homo sapiens
ttaagggacatttctat

SEQ ID NO: 2325859 - DNA, 19 bp, Homo sapiens
ttaaggtgagcataaatca

SEQ ID NO: 2325860 - DNA, 21 bp, Homo sapiens
ttaagtaccaatgggaagcag

SEQ ID NO: 2325861 - DNA, 23 bp, Homo sapiens
ttaagtctcagactgatttcttg

SEQ ID NO: 2325862 - DNA, 14 bp, Homo sapiens
ttaagtgagcagaa

SEQ ID NO: 2325863 - DNA, 17 bp, Homo sapiens
ttaagtgcgtgtgtaga

SEQ ID NO: 2325864 - DNA, 12 bp, Homo sapiens
ttaagttcttat

SEQ ID NO: 2325865 - DNA, 18 bp, Homo sapiens
ttaagtttgtagtaaaag

SEQ ID NO: 2325866 - DNA, 11 bp, Homo sapiens
ttaataaaaga

SEQ ID NO: 2325867 - DNA, 20 bp, Homo sapiens
ttaataaaagaaaattacaa

SEQ ID NO: 2325868 - DNA, 14 bp, Homo sapiens
ttaataaaagaaca

SEQ ID NO: 2325869 - DNA, 20 bp, Homo sapiens
ttaataaaataattctaaag

SEQ ID NO: 2325870 - DNA, 16 bp, Homo sapiens
ttaataaagatgagtt

SEQ ID NO: 2325871 - DNA, 13 bp, Homo sapiens
ttaataaattttc

SEQ ID NO: 2325872 - DNA, 22 bp, Homo sapiens
ttaataacaaggagatttctta

SEQ ID NO: 2325873 - DNA, 17 bp, Homo sapiens
ttaataacattacctta

SEQ ID NO: 2325874 - DNA, 20 bp, Homo sapiens
ttaataagatttttcaaaat

SEQ ID NO: 2325875 - DNA, 14 bp, Homo sapiens
ttaatatactcctt

SEQ ID NO: 2325876 - DNA, 13 bp, Homo sapiens
ttaatatattaaa

SEQ ID NO: 2325877 - DNA, 20 bp, Homo sapiens
ttaatatattaaaattccaa

SEQ ID NO: 2325878 - DNA, 16 bp, Homo sapiens
ttaatcaagagaaact

SEQ ID NO: 2325879 - DNA, 19 bp, Homo sapiens
ttaatcaagagaaacttca

SEQ ID NO: 2325880 - DNA, 21 bp, Homo sapiens
ttaatccagttataagaagaa

SEQ ID NO: 2325881 - DNA, 18 bp, Homo sapiens
ttaatcttcaaagccttc

SEQ ID NO: 2325882 - DNA, 22 bp, Homo sapiens
ttaatgataaactcagatctga

SEQ ID NO: 2325883 - DNA, 21 bp, Homo sapiens
ttaatgctgtttctaagaaaa

SEQ ID NO: 2325884 - DNA, 21 bp, Homo sapiens
ttaatggcatttctctttaaa

SEQ ID NO: 2325885 - DNA, 14 bp, Homo sapiens
ttaatgttttcaaa

SEQ ID NO: 2325886 - DNA, 20 bp, Homo sapiens
ttaattaatttggagcacaa

SEQ ID NO: 2325887 - DNA, 13 bp, Homo sapiens
ttaattgaaatac

SEQ ID NO: 2325888 - DNA, 16 bp, Homo sapiens
ttaattgccagcaaat

SEQ ID NO: 2325889 - DNA, 17 bp, Homo sapiens
ttaattgccagcaaata

SEQ ID NO: 2325890 - DNA, 18 bp, Homo sapiens
ttaattgcgtagaggcta

SEQ ID NO: 2325891 - DNA, 13 bp, Homo sapiens
ttaatttcctttt

SEQ ID NO: 2325892 - DNA, 22 bp, Homo sapiens
ttaatttggagcacaaaattca

SEQ ID NO: 2325893 - DNA, 16 bp, Homo sapiens
ttaattttaaagtgca

SEQ ID NO: 2325894 - DNA, 12 bp, Homo sapiens
ttaattttcact

SEQ ID NO: 2325895 - DNA, 17 bp, Homo sapiens
ttacaataggagtggtg

SEQ ID NO: 2325896 - DNA, 17 bp, Homo sapiens
ttacaatagttctgtgg

SEQ ID NO: 2325897 - DNA, 21 bp, Homo sapiens
ttacaatattgattgggaaaa

SEQ ID NO: 2325898 - DNA, 15 bp, Homo sapiens
ttacaattttttatc

SEQ ID NO: 2325899 - DNA, 18 bp, Homo sapiens
ttacaattttttatcatg

SEQ ID NO: 2325900 - DNA, 14 bp, Homo sapiens
ttacacattatgtt

SEQ ID NO: 2325901 - DNA, 17 bp, Homo sapiens
ttacacattatgttaga

SEQ ID NO: 2325902 - DNA, 15 bp, Homo sapiens
ttacagaaatggact

SEQ ID NO: 2325903 - DNA, 20 bp, Homo sapiens
ttacagaatcttccttttat

SEQ ID NO: 2325904 - DNA, 14 bp, Homo sapiens
ttacagtggcagta

SEQ ID NO: 2325905 - DNA, 16 bp, Homo sapiens
ttacagtggcagtatt

SEQ ID NO: 2325906 - DNA, 19 bp, Homo sapiens
ttacagttctttcctcttt

SEQ ID NO: 2325907 - DNA, 17 bp, Homo sapiens
ttacatcttttctaatc

SEQ ID NO: 2325908 - DNA, 23 bp, Homo sapiens
ttacatggcgccctgcctcctgg

SEQ ID NO: 2325909 - DNA, 15 bp, Homo sapiens
ttacatggctgtggt

SEQ ID NO: 2325910 - DNA, 20 bp, Homo sapiens
ttaccaacctgttacctact

SEQ ID NO: 2325911 - DNA, 15 bp, Homo sapiens
ttaccattcacaata

SEQ ID NO: 2325912 - DNA, 17 bp, Homo sapiens
ttaccattcacaataaa

SEQ ID NO: 2325913 - DNA, 15 bp, Homo sapiens
ttaccctctttgctg

SEQ ID NO: 2325914 - DNA, 22 bp, Homo sapiens
ttaccctttggccccactttga

SEQ ID NO: 2325915 - DNA, 11 bp, Homo sapiens
ttacctgaaag

SEQ ID NO: 2325916 - DNA, 21 bp, Homo sapiens
ttacctggcttatttaatatg

SEQ ID NO: 2325917 - DNA, 16 bp, Homo sapiens
ttacctttacatatat

SEQ ID NO: 2325918 - DNA, 21 bp, Homo sapiens
ttacgtgaagaaataaatgaa

SEQ ID NO: 2325919 - DNA, 17 bp, Homo sapiens
ttactaaaaagtataaa

SEQ ID NO: 2325920 - DNA, 20 bp, Homo sapiens
ttactaacagtaactgccat

SEQ ID NO: 2325921 - DNA, 18 bp, Homo sapiens
ttactacagccttaatat

SEQ ID NO: 2325922 - DNA, 18 bp, Homo sapiens
ttactctgggagtaatac

SEQ ID NO: 2325923 - DNA, 20 bp, Homo sapiens
ttactgaataatatcaaata

SEQ ID NO: 2325924 - DNA, 17 bp, Homo sapiens
ttactgtggaggaagga

SEQ ID NO: 2325925 - DNA, 18 bp, Homo sapiens
ttactgtggaggaaggat

SEQ ID NO: 2325926 - DNA, 16 bp, Homo sapiens
ttactgttatagaata

SEQ ID NO: 2325927 - DNA, 18 bp, Homo sapiens
ttacttgctttacctttt

SEQ ID NO: 2325928 - DNA, 14 bp, Homo sapiens
ttactttcaaaatg

SEQ ID NO: 2325929 - DNA, 14 bp, Homo sapiens
ttactttcaagtaa

SEQ ID NO: 2325930 - DNA, 16 bp, Homo sapiens
ttacttttaaactgtg

SEQ ID NO: 2325931 - DNA, 19 bp, Homo sapiens
ttacttttaaactgtgtac

SEQ ID NO: 2325932 - DNA, 21 bp, Homo sapiens
ttagaaaacataatcttctgc

SEQ ID NO: 2325933 - DNA, 13 bp, Homo sapiens
ttagaaaagtgaa

SEQ ID NO: 2325934 - DNA, 13 bp, Homo sapiens
ttagaaatattca

SEQ ID NO: 2325935 - DNA, 15 bp, Homo sapiens
ttagaaatattcaca

SEQ ID NO: 2325936 - DNA, 12 bp, Homo sapiens
ttagaagaaaga

SEQ ID NO: 2325937 - DNA, 19 bp, Homo sapiens
ttagacaaagccttaagca

SEQ ID NO: 2325938 - DNA, 23 bp, Homo sapiens
ttagacaaagccttaagcaaatt

SEQ ID NO: 2325939 - DNA, 22 bp, Homo sapiens
ttagagtcaactacacaaagca

SEQ ID NO: 2325940 - DNA, 20 bp, Homo sapiens
ttagattcttaattcatgag

SEQ ID NO: 2325941 - DNA, 15 bp, Homo sapiens
ttagattgagaaatg

SEQ ID NO: 2325942 - DNA, 18 bp, Homo sapiens
ttagcacagtatttaaca

SEQ ID NO: 2325943 - DNA, 15 bp, Homo sapiens
ttagccaggatcatg

SEQ ID NO: 2325944 - DNA, 17 bp, Homo sapiens
ttagcgttgttttgtgg

SEQ ID NO: 2325945 - DNA, 20 bp, Homo sapiens
ttagcgttgttttgtggata

SEQ ID NO: 2325946 - DNA, 13 bp, Homo sapiens
ttagctctgagaa

SEQ ID NO: 2325947 - DNA, 17 bp, Homo sapiens
ttagctttttaattgtt

SEQ ID NO: 2325948 - DNA, 23 bp, Homo sapiens
ttaggaaatgtttttaataaaag

SEQ ID NO: 2325949 - DNA, 23 bp, Homo sapiens
ttagggactacccatagacatga

SEQ ID NO: 2325950 - DNA, 13 bp, Homo sapiens
ttagggctgcttt

SEQ ID NO: 2325951 - DNA, 14 bp, Homo sapiens
ttagtacaatagta

SEQ ID NO: 2325952 - DNA, 19 bp, Homo sapiens
ttagtaggtgatattcatt

SEQ ID NO: 2325953 - DNA, 13 bp, Homo sapiens
ttagtatgtgcat

SEQ ID NO: 2325954 - DNA, 18 bp, Homo sapiens
ttagtatgtgcatttaat

SEQ ID NO: 2325955 - DNA, 20 bp, Homo sapiens
ttagtcacctgccccagcac

SEQ ID NO: 2325956 - DNA, 17 bp, Homo sapiens
ttagtccctcatgcaaa

SEQ ID NO: 2325957 - DNA, 12 bp, Homo sapiens
ttagttctgttg

SEQ ID NO: 2325958 - DNA, 23 bp, Homo sapiens
ttagtttttggttgggaatgagg

SEQ ID NO: 2325959 - DNA, 17 bp, Homo sapiens
ttataaacagaaatgga

SEQ ID NO: 2325960 - DNA, 19 bp, Homo sapiens
ttataaagtggaagtatgt

SEQ ID NO: 2325961 - DNA, 23 bp, Homo sapiens
ttataacctagttaaagaaagga

SEQ ID NO: 2325962 - DNA, 21 bp, Homo sapiens
ttataagaagaagttcatgtc

SEQ ID NO: 2325963 - DNA, 20 bp, Homo sapiens
ttatacatgtgatacatttt

SEQ ID NO: 2325964 - DNA, 14 bp, Homo sapiens
ttatagtaactata

SEQ ID NO: 2325965 - DNA, 13 bp, Homo sapiens
ttgcttgatccag

SEQ ID NO: 2325966 - DNA, 14 bp, Homo sapiens
ttgcttgtcttctg

SEQ ID NO: 2325967 - DNA, 20 bp, Homo sapiens
ttggaaatagaaagaagcca

SEQ ID NO: 2325968 - DNA, 14 bp, Homo sapiens
ttggaaccagcccc

SEQ ID NO: 2325969 - DNA, 16 bp, Homo sapiens
ttggaaccagccccat

SEQ ID NO: 2325970 - DNA, 16 bp, Homo sapiens
ttggaactctgcttga

SEQ ID NO: 2325971 - DNA, 19 bp, Homo sapiens
ttggaagagaggcacctgc

SEQ ID NO: 2325972 - DNA, 22 bp, Homo sapiens
ttggaagagaggcacctgctgg

SEQ ID NO: 2325973 - DNA, 18 bp, Homo sapiens
ttggaagctgtttggaaa

SEQ ID NO: 2325974 - DNA, 13 bp, Homo sapiens
ttggaaggatctg

SEQ ID NO: 2325975 - DNA, 18 bp, Homo sapiens
ttggaagtttagctctga

SEQ ID NO: 2325976 - DNA, 20 bp, Homo sapiens
ttggaagtttagctctgaga

SEQ ID NO: 2325977 - DNA, 16 bp, Homo sapiens
ttggaatattaaaaaa

SEQ ID NO: 2325978 - DNA, 23 bp, Homo sapiens
ttggaatattaaaaaacttcatg

SEQ ID NO: 2325979 - DNA, 18 bp, Homo sapiens
ttggaccactcctgtccc

SEQ ID NO: 2325980 - DNA, 14 bp, Homo sapiens
ttggagagcagctg

SEQ ID NO: 2325981 - DNA, 21 bp, Homo sapiens
ttggagcacaaaattcaaagc

SEQ ID NO: 2325982 - DNA, 15 bp, Homo sapiens
ttggagcccagggca

SEQ ID NO: 2325983 - DNA, 13 bp, Homo sapiens
ttggagttaaaat

SEQ ID NO: 2325984 - DNA, 18 bp, Homo sapiens
ttggattatttaataaca

SEQ ID NO: 2325985 - DNA, 15 bp, Homo sapiens
ttggattcaatttta

SEQ ID NO: 2325986 - DNA, 15 bp, Homo sapiens
ttggcaatgctaatt

SEQ ID NO: 2325987 - DNA, 18 bp, Homo sapiens
ttggcacttattgaatat

SEQ ID NO: 2325988 - DNA, 19 bp, Homo sapiens
ttggcacttgccattccaa

SEQ ID NO: 2325989 - DNA, 15 bp, Homo sapiens
ttggccaagcagaaa

SEQ ID NO: 2325990 - DNA, 13 bp, Homo sapiens
ttggcgtgacccg

SEQ ID NO: 2325991 - DNA, 12 bp, Homo sapiens
ttggctgagacc

SEQ ID NO: 2325992 - DNA, 19 bp, Homo sapiens
ttggctggggaggaccagg

SEQ ID NO: 2325993 - DNA, 12 bp, Homo sapiens
ttgggaaaacat

SEQ ID NO: 2325994 - DNA, 16 bp, Homo sapiens
ttgggaaaacatgtta

SEQ ID NO: 2325995 - DNA, 16 bp, Homo sapiens
ttgggaggccgaggcg

SEQ ID NO: 2325996 - DNA, 19 bp, Homo sapiens
ttgggaggtgcgtgttcag

SEQ ID NO: 2325997 - DNA, 17 bp, Homo sapiens
ttgggatcagcctccgc

SEQ ID NO: 2325998 - DNA, 17 bp, Homo sapiens
ttgggcacagtccagac

SEQ ID NO: 2325999 - DNA, 22 bp, Homo sapiens
ttggggaggagggggccgggcg

SEQ ID NO: 2326000 - DNA, 23 bp, Homo sapiens
ttggggccaccaaagctgcccac

SEQ ID NO: 2326001 - DNA, 22 bp, Homo sapiens
ttgggtgggattttttcccttt

SEQ ID NO: 2326002 - DNA, 17 bp, Homo sapiens
ttgggtgtattctctgt

SEQ ID NO: 2326003 - DNA, 19 bp, Homo sapiens
ttgggtgtattctctgtaa

SEQ ID NO: 2326004 - DNA, 20 bp, Homo sapiens
ttgggtgtctccttaagctg

SEQ ID NO: 2326005 - DNA, 17 bp, Homo sapiens
ttggtaaaaacagcagc

SEQ ID NO: 2326006 - DNA, 20 bp, Homo sapiens
ttggtaaaactcactgtgat

SEQ ID NO: 2326007 - DNA, 22 bp, Homo sapiens
ttggtagattattcataatgtg

SEQ ID NO: 2326008 - DNA, 20 bp, Homo sapiens
ttggtcacaaagctatttaa

SEQ ID NO: 2326009 - DNA, 21 bp, Homo sapiens
ttggtctcaggcagcaccaca

SEQ ID NO: 2326010 - DNA, 13 bp, Homo sapiens
ttggtgcctggcc

SEQ ID NO: 2326011 - DNA, 20 bp, Homo sapiens
ttggtgcctggcctggcaca

SEQ ID NO: 2326012 - DNA, 22 bp, Homo sapiens
ttggtgcctggcctggcacaca

SEQ ID NO: 2326013 - DNA, 21 bp, Homo sapiens
ttggtgtggcccatggctgtt

SEQ ID NO: 2326014 - DNA, 17 bp, Homo sapiens
ttggttcttgtactcta

SEQ ID NO: 2326015 - DNA, 18 bp, Homo sapiens
ttggtttcacagataaca

SEQ ID NO: 2326016 - DNA, 17 bp, Homo sapiens
ttgtaaaaaaaaatgcc

SEQ ID NO: 2326017 - DNA, 19 bp, Homo sapiens
ttgtaaaaaaaaatgcctt

SEQ ID NO: 2326018 - DNA, 13 bp, Homo sapiens
ttgtaaaacagtg

SEQ ID NO: 2326019 - DNA, 18 bp, Homo sapiens
ttgtaaaatagaaaaagt

SEQ ID NO: 2326020 - DNA, 12 bp, Homo sapiens
ttgtaaagactg

SEQ ID NO: 2326021 - DNA, 22 bp, Homo sapiens
ttgtaaagatattgtatctcct

SEQ ID NO: 2326022 - DNA, 23 bp, Homo sapiens
ttgtaaagatattgtatctcctt

SEQ ID NO: 2326023 - DNA, 13 bp, Homo sapiens
ttgtaagaaggca

SEQ ID NO: 2326024 - DNA, 20 bp, Homo sapiens
ttgtaagaaggcaatattaa

SEQ ID NO: 2326025 - DNA, 21 bp, Homo sapiens
ttgtaagagtgtagaagcatt

SEQ ID NO: 2326026 - DNA, 16 bp, Homo sapiens
ttgtaagtttcaggtg

SEQ ID NO: 2326027 - DNA, 17 bp, Homo sapiens
ttgtaagtttcaggtga

SEQ ID NO: 2326028 - DNA, 14 bp, Homo sapiens
ttgtaataagcaat

SEQ ID NO: 2326029 - DNA, 20 bp, Homo sapiens
ttgtaataagcaatcaaggt

SEQ ID NO: 2326030 - DNA, 18 bp, Homo sapiens
ttgtaatattttgctgct

SEQ ID NO: 2326031 - DNA, 20 bp, Homo sapiens
ttgtacaaaattaagcaaat

SEQ ID NO: 2326032 - DNA, 21 bp, Homo sapiens
ttgtacagaatatttctattg

SEQ ID NO: 2326033 - DNA, 21 bp, Homo sapiens
ttgtacatgtgtagcctgtgc

SEQ ID NO: 2326034 - DNA, 15 bp, Homo sapiens
ttgtaccaaaatttt

SEQ ID NO: 2326035 - DNA, 21 bp, Homo sapiens
ttgtactgaatttttttgtaa

SEQ ID NO: 2326036 - DNA, 23 bp, Homo sapiens
ttgtacttaaatggtaataagca

SEQ ID NO: 2326037 - DNA, 15 bp, Homo sapiens
ttgtactttatcatg

SEQ ID NO: 2326038 - DNA, 21 bp, Homo sapiens
ttgtaggggaggggctccttt

SEQ ID NO: 2326039 - DNA, 14 bp, Homo sapiens
ttgtatattacaat

SEQ ID NO: 2326040 - DNA, 16 bp, Homo sapiens
ttgtatattacaatga

SEQ ID NO: 2326041 - DNA, 16 bp, Homo sapiens
ttgtatgtcaaagctt

SEQ ID NO: 2326042 - DNA, 16 bp, Homo sapiens
ttgtatttaaaaacat

SEQ ID NO: 2326043 - DNA, 16 bp, Homo sapiens
ttgtattttcatgaaa

SEQ ID NO: 2326044 - DNA, 22 bp, Homo sapiens
ttgtcaagaggataaattttag

SEQ ID NO: 2326045 - DNA, 21 bp, Homo sapiens
ttgtcaaggaagaagaaatct

SEQ ID NO: 2326046 - DNA, 23 bp, Homo sapiens
ttgtcaaggatggttttgggact

SEQ ID NO: 2326047 - DNA, 16 bp, Homo sapiens
ttgtcaccagatctga

SEQ ID NO: 2326048 - DNA, 17 bp, Homo sapiens
ttgtcctttatgtattc

SEQ ID NO: 2326049 - DNA, 16 bp, Homo sapiens
ttgtctaaagatcttt

SEQ ID NO: 2326050 - DNA, 11 bp, Homo sapiens
ttgtctgtctc

SEQ ID NO: 2326051 - DNA, 23 bp, Homo sapiens
ttgtgaaccatggtgaagtgctt

SEQ ID NO: 2326052 - DNA, 14 bp, Homo sapiens
ttgtgaagctaatg

SEQ ID NO: 2326053 - DNA, 17 bp, Homo sapiens
ttgtgaagctaatgtca

SEQ ID NO: 2326054 - DNA, 13 bp, Homo sapiens
ttgtgaatggatt

SEQ ID NO: 2326055 - DNA, 15 bp, Homo sapiens
ttgtgaatggattgg

SEQ ID NO: 2326056 - DNA, 19 bp, Homo sapiens
ttgtgacagtgcctcttcc

SEQ ID NO: 2326057 - DNA, 14 bp, Homo sapiens
ttgtgatttcttta

SEQ ID NO: 2326058 - DNA, 23 bp, Homo sapiens
ttgtgatttctttaaaagaatga

SEQ ID NO: 2326059 - DNA, 14 bp, Homo sapiens
ttgtgcacatttct

SEQ ID NO: 2326060 - DNA, 16 bp, Homo sapiens
ttgtgctcagagacac

SEQ ID NO: 2326061 - DNA, 14 bp, Homo sapiens
ttgtggggcctggg

SEQ ID NO: 2326062 - DNA, 13 bp, Homo sapiens
ttgtgtctgtaca

SEQ ID NO: 2326063 - DNA, 15 bp, Homo sapiens
ttgtgtctgtacacg

SEQ ID NO: 2326064 - DNA, 15 bp, Homo sapiens
ttgtgtgaaattgca

SEQ ID NO: 2326065 - DNA, 19 bp, Homo sapiens
ttgtgtgtattcagaggca

SEQ ID NO: 2326066 - DNA, 21 bp, Homo sapiens
ttgttagggctgcttttctta

SEQ ID NO: 2326067 - DNA, 13 bp, Homo sapiens
ttgttatattata

SEQ ID NO: 2326068 - DNA, 14 bp, Homo sapiens
ttgttatcaaaata

SEQ ID NO: 2326069 - DNA, 16 bp, Homo sapiens
ttgttattataacata

SEQ ID NO: 2326070 - DNA, 21 bp, Homo sapiens
ttgttattattagataatatt

SEQ ID NO: 2326071 - DNA, 14 bp, Homo sapiens
ttgttattttttca

SEQ ID NO: 2326072 - DNA, 23 bp, Homo sapiens
ttgttcaggaaaaggttgaataa

SEQ ID NO: 2326073 - DNA, 16 bp, Homo sapiens
ttgttctgcctggaga

SEQ ID NO: 2326074 - DNA, 15 bp, Homo sapiens
ttgttctttcagaaa

SEQ ID NO: 2326075 - DNA, 12 bp, Homo sapiens
ttgttgtactta

SEQ ID NO: 2326076 - DNA, 18 bp, Homo sapiens
ttgtttataataaaaata

SEQ ID NO: 2326077 - DNA, 19 bp, Homo sapiens
ttgtttggtaaatgtttct

SEQ ID NO: 2326078 - DNA, 15 bp, Homo sapiens
ttgtttgtcacaagt

SEQ ID NO: 2326079 - DNA, 14 bp, Homo sapiens
ttgttttgaaaata

SEQ ID NO: 2326080 - DNA, 22 bp, Homo sapiens
ttttggcaatgactcaaagtct

SEQ ID NO: 2326081 - DNA, 17 bp, Homo sapiens
ttttgtatgttaaagag

SEQ ID NO: 2326082 - DNA, 10 bp, Homo sapiens
ttttgtctgt

SEQ ID NO: 2326083 - DNA, 16 bp, Homo sapiens
ttttgtggtttggaat

SEQ ID NO: 2326084 - DNA, 13 bp, Homo sapiens
ttttgtgtcctcc

SEQ ID NO: 2326085 - DNA, 14 bp, Homo sapiens
ttttgtgtgaaatt

SEQ ID NO: 2326086 - DNA, 15 bp, Homo sapiens
ttttgtttgccagga

SEQ ID NO: 2326087 - DNA, 18 bp, Homo sapiens
ttttgtttggagacgttt

SEQ ID NO: 2326088 - DNA, 20 bp, Homo sapiens
tttttaaaaaggtaaatggt

SEQ ID NO: 2326089 - DNA, 14 bp, Homo sapiens
tttttaaaatagaa

SEQ ID NO: 2326090 - DNA, 20 bp, Homo sapiens
tttttaaatgtaaagatatt

SEQ ID NO: 2326091 - DNA, 16 bp, Homo sapiens
tttttaagatagtgta

SEQ ID NO: 2326092 - DNA, 13 bp, Homo sapiens
tttttaagatttt

SEQ ID NO: 2326093 - DNA, 16 bp, Homo sapiens
tttttaagcttcagtt

SEQ ID NO: 2326094 - DNA, 15 bp, Homo sapiens
tttttaagtgttctg

SEQ ID NO: 2326095 - DNA, 18 bp, Homo sapiens
tttttaattgttgtttct

SEQ ID NO: 2326096 - DNA, 16 bp, Homo sapiens
tttttaatttacttgt

SEQ ID NO: 2326097 - DNA, 12 bp, Homo sapiens
tttttagaacat

SEQ ID NO: 2326098 - DNA, 20 bp, Homo sapiens
tttttagattgagaaatgtg

SEQ ID NO: 2326099 - DNA, 12 bp, Homo sapiens
tttttaggaaat

SEQ ID NO: 2326100 - DNA, 20 bp, Homo sapiens
tttttatacaaacctaccaa

SEQ ID NO: 2326101 - DNA, 22 bp, Homo sapiens
tttttatatttcctttatgtga

SEQ ID NO: 2326102 - DNA, 21 bp, Homo sapiens
tttttcaaacaagtatgaatc

SEQ ID NO: 2326103 - DNA, 12 bp, Homo sapiens
tttttcaatata

SEQ ID NO: 2326104 - DNA, 16 bp, Homo sapiens
tttttcaatatattga

SEQ ID NO: 2326105 - DNA, 13 bp, Homo sapiens
tttttcacatttt

SEQ ID NO: 2326106 - DNA, 15 bp, Homo sapiens
tttttcactttgaaa

SEQ ID NO: 2326107 - DNA, 10 bp, Homo sapiens
tttttccctt

SEQ ID NO: 2326108 - DNA, 17 bp, Homo sapiens
tttttcggtttcaaagt

SEQ ID NO: 2326109 - DNA, 15 bp, Homo sapiens
tttttgacactgaaa

SEQ ID NO: 2326110 - DNA, 18 bp, Homo sapiens
tttttgacactgaaagtt

SEQ ID NO: 2326111 - DNA, 22 bp, Homo sapiens
tttttgacactgaaagttttgt

SEQ ID NO: 2326112 - DNA, 15 bp, Homo sapiens
tttttgagtgacagc

SEQ ID NO: 2326113 - DNA, 13 bp, Homo sapiens
tttttgatgtcag

SEQ ID NO: 2326114 - DNA, 19 bp, Homo sapiens
tttttgcatgcatgcaaat

SEQ ID NO: 2326115 - DNA, 23 bp, Homo sapiens
tttttgctgctgcctctttccct

SEQ ID NO: 2326116 - DNA, 19 bp, Homo sapiens
tttttgggttaaaagatgg

SEQ ID NO: 2326117 - DNA, 22 bp, Homo sapiens
tttttgtaaagcccttgcacag

SEQ ID NO: 2326118 - DNA, 12 bp, Homo sapiens
tttttgtatgtg

SEQ ID NO: 2326119 - DNA, 22 bp, Homo sapiens
tttttgtatttctctattttca

SEQ ID NO: 2326120 - DNA, 16 bp, Homo sapiens
tttttgttattaaaca

SEQ ID NO: 2326121 - DNA, 12 bp, Homo sapiens
tttttgtttgcc

SEQ ID NO: 2326122 - DNA, 14 bp, Homo sapiens
ttttttaaaataga

SEQ ID NO: 2326123 - DNA, 11 bp, Homo sapiens
ttttttaagat

SEQ ID NO: 2326124 - DNA, 12 bp, Homo sapiens
ttttttaagatt

SEQ ID NO: 2326125 - DNA, 13 bp, Homo sapiens
ttttttattaata

SEQ ID NO: 2326126 - DNA, 13 bp, Homo sapiens
ttttttgggttaa

SEQ ID NO: 2326127 - DNA, 20 bp, Homo sapiens
ttttttgggttaaaagatgg

SEQ ID NO: 2326128 - DNA, 13 bp, Homo sapiens
ttttttgtctgtg

SEQ ID NO: 2326129 - DNA, 14 bp, Homo sapiens
tttttttgttatta

SEQ ID NO: 2326130 - DNA, 19 bp, Homo sapiens
aaaggcagtattttgtgtc

SEQ ID NO: 2326131 - DNA, 13 bp, Homo sapiens
aaaggcctcttgt

SEQ ID NO: 2326132 - DNA, 14 bp, Homo sapiens
aaagggagtttttg

SEQ ID NO: 2326133 - DNA, 15 bp, Homo sapiens
aaagggagtttttga

SEQ ID NO: 2326134 - DNA, 19 bp, Homo sapiens
aaagggcccaatgaattat

SEQ ID NO: 2326135 - DNA, 18 bp, Homo sapiens
aaagggctggctccccct

SEQ ID NO: 2326136 - DNA, 16 bp, Homo sapiens
aaaggggagagcctgc

SEQ ID NO: 2326137 - DNA, 19 bp, Homo sapiens
aaaggggagagcctgctgg

SEQ ID NO: 2326138 - DNA, 21 bp, Homo sapiens
aaaggtaaatggttaaatttt

SEQ ID NO: 2326139 - DNA, 16 bp, Homo sapiens
aaagtaactgtgagaa

SEQ ID NO: 2326140 - DNA, 17 bp, Homo sapiens
aaagtacaaatgaagaa

SEQ ID NO: 2326141 - DNA, 13 bp, Homo sapiens
aaagtacagaatt

SEQ ID NO: 2326142 - DNA, 22 bp, Homo sapiens
aaagtacattctggggaaacaa

SEQ ID NO: 2326143 - DNA, 14 bp, Homo sapiens
aaagtactctttaa

SEQ ID NO: 2326144 - DNA, 21 bp, Homo sapiens
aaagtactctttaacatacaa

SEQ ID NO: 2326145 - DNA, 19 bp, Homo sapiens
aaagtagattcatgaaaat

SEQ ID NO: 2326146 - DNA, 20 bp, Homo sapiens
aaagtataatgtttattaaa

SEQ ID NO: 2326147 - DNA, 13 bp, Homo sapiens
aaagtatcacttt

SEQ ID NO: 2326148 - DNA, 17 bp, Homo sapiens
aaagtatcacttttctg

SEQ ID NO: 2326149 - DNA, 16 bp, Homo sapiens
aaagtcaaaaaattat

SEQ ID NO: 2326150 - DNA, 17 bp, Homo sapiens
aaagtcaccaaatagtg

SEQ ID NO: 2326151 - DNA, 13 bp, Homo sapiens
aaagtcagaagtt

SEQ ID NO: 2326152 - DNA, 14 bp, Homo sapiens
aaagtcagaatcag

SEQ ID NO: 2326153 - DNA, 14 bp, Homo sapiens
aaagtccctccctg

SEQ ID NO: 2326154 - DNA, 23 bp, Homo sapiens
aaagtccctccctgcctgagggc

SEQ ID NO: 2326155 - DNA, 22 bp, Homo sapiens
aaagtggcgtgggagccagcct

SEQ ID NO: 2326156 - DNA, 16 bp, Homo sapiens
aaagtggctgcggtgt

SEQ ID NO: 2326157 - DNA, 17 bp, Homo sapiens
aaagtggtctctgctgg

SEQ ID NO: 2326158 - DNA, 13 bp, Homo sapiens
aaagtgtgtaaat

SEQ ID NO: 2326159 - DNA, 16 bp, Homo sapiens
aaagtgtgtatatatt

SEQ ID NO: 2326160 - DNA, 12 bp, Homo sapiens
aaagttaacatt

SEQ ID NO: 2326161 - DNA, 15 bp, Homo sapiens
aaagttaacattaat

SEQ ID NO: 2326162 - DNA, 20 bp, Homo sapiens
aaagttggaaggatctgctg

SEQ ID NO: 2326163 - DNA, 22 bp, Homo sapiens
aaagttgtaaaatagaaaaagt

SEQ ID NO: 2326164 - DNA, 17 bp, Homo sapiens
aaagttttatatgcttt

SEQ ID NO: 2326165 - DNA, 16 bp, Homo sapiens
aaagttttgaaaagct

SEQ ID NO: 2326166 - DNA, 13 bp, Homo sapiens
aaagttttgtaaa

SEQ ID NO: 2326167 - DNA, 18 bp, Homo sapiens
aaagttttgtaaaagaaa

SEQ ID NO: 2326168 - DNA, 23 bp, Homo sapiens
aaagttttgttgtacttaaatgg

SEQ ID NO: 2326169 - DNA, 14 bp, Homo sapiens
aaataaaatgtttc

SEQ ID NO: 2326170 - DNA, 16 bp, Homo sapiens
aaataaaatgtttcat

SEQ ID NO: 2326171 - DNA, 13 bp, Homo sapiens
aaataaaccactg

SEQ ID NO: 2326172 - DNA, 12 bp, Homo sapiens
aaataaactaga

SEQ ID NO: 2326173 - DNA, 11 bp, Homo sapiens
aaataaagaag

SEQ ID NO: 2326174 - DNA, 16 bp, Homo sapiens
aaataaatatgaaagt

SEQ ID NO: 2326175 - DNA, 12 bp, Homo sapiens
aaataaatgaaa

SEQ ID NO: 2326176 - DNA, 14 bp, Homo sapiens
aaataacaatgtta

SEQ ID NO: 2326177 - DNA, 15 bp, Homo sapiens
aaataacaatgttaa

SEQ ID NO: 2326178 - DNA, 17 bp, Homo sapiens
aaataacaatgttaagg

SEQ ID NO: 2326179 - DNA, 18 bp, Homo sapiens
aaataacaatgttaagga

SEQ ID NO: 2326180 - DNA, 14 bp, Homo sapiens
aaataactgaattt

SEQ ID NO: 2326181 - DNA, 19 bp, Homo sapiens
aaataagtgccctctccca

SEQ ID NO: 2326182 - DNA, 15 bp, Homo sapiens
aaataattcatatct

SEQ ID NO: 2326183 - DNA, 16 bp, Homo sapiens
aaataattcatatcta

SEQ ID NO: 2326184 - DNA, 13 bp, Homo sapiens
aaataattttaat

SEQ ID NO: 2326185 - DNA, 14 bp, Homo sapiens
aaatacacatttgc

SEQ ID NO: 2326186 - DNA, 16 bp, Homo sapiens
aaatagaaagaagcca

SEQ ID NO: 2326187 - DNA, 14 bp, Homo sapiens
aaatagaataattc

SEQ ID NO: 2326188 - DNA, 16 bp, Homo sapiens
aaataggtcatcatga

SEQ ID NO: 2326189 - DNA, 16 bp, Homo sapiens
aaatagtatgaaaatg

SEQ ID NO: 2326190 - DNA, 19 bp, Homo sapiens
aaatagtatgaaaatggaa

SEQ ID NO: 2326191 - DNA, 20 bp, Homo sapiens
aaatagttgcatagcagtat

SEQ ID NO: 2326192 - DNA, 22 bp, Homo sapiens
aaatagttgcatagcagtatat

SEQ ID NO: 2326193 - DNA, 17 bp, Homo sapiens
aaatataagacatttgt

SEQ ID NO: 2326194 - DNA, 21 bp, Homo sapiens
aaatataagacatttgtttgc

SEQ ID NO: 2326195 - DNA, 13 bp, Homo sapiens
aaatatcataaag

SEQ ID NO: 2326196 - DNA, 16 bp, Homo sapiens
aaatatctatttgaat

SEQ ID NO: 2326197 - DNA, 21 bp, Homo sapiens
aaatatctatttgaataaatt

SEQ ID NO: 2326198 - DNA, 18 bp, Homo sapiens
aaatatgcagtgatatgg

SEQ ID NO: 2326199 - DNA, 23 bp, Homo sapiens
aaatatgcagtgatatggcagaa

SEQ ID NO: 2326200 - DNA, 12 bp, Homo sapiens
aaatatgtaatt

SEQ ID NO: 2326201 - DNA, 17 bp, Homo sapiens
aaatattcactggcccc

SEQ ID NO: 2326202 - DNA, 16 bp, Homo sapiens
aaatattcctttgcat

SEQ ID NO: 2326203 - DNA, 21 bp, Homo sapiens
aaatattgtttctgcattcat

SEQ ID NO: 2326204 - DNA, 16 bp, Homo sapiens
aaatattttctacttt

SEQ ID NO: 2326205 - DNA, 21 bp, Homo sapiens
aaatattttctactttaaatt

SEQ ID NO: 2326206 - DNA, 15 bp, Homo sapiens
aaatcaaatgaatga

SEQ ID NO: 2326207 - DNA, 17 bp, Homo sapiens
aaatcaatacactagtt

SEQ ID NO: 2326208 - DNA, 16 bp, Homo sapiens
aaatcagagacaaaat

SEQ ID NO: 2326209 - DNA, 14 bp, Homo sapiens
aaatcataaagtca

SEQ ID NO: 2326210 - DNA, 18 bp, Homo sapiens
aaatcatgccagtatttt

SEQ ID NO: 2326211 - DNA, 23 bp, Homo sapiens
aaatcatgttccccctaaacatg

SEQ ID NO: 2326212 - DNA, 21 bp, Homo sapiens
aaatcgatgagcgccacctct

SEQ ID NO: 2326213 - DNA, 15 bp, Homo sapiens
aaatctaagctgtgt

SEQ ID NO: 2326214 - DNA, 18 bp, Homo sapiens
aaatctcattatttcaaa

SEQ ID NO: 2326215 - DNA, 19 bp, Homo sapiens
aaatctcattatttcaaaa

SEQ ID NO: 2326216 - DNA, 15 bp, Homo sapiens
aaatctcctgtggag

SEQ ID NO: 2326217 - DNA, 16 bp, Homo sapiens
aaatctgaacattctc

SEQ ID NO: 2326218 - DNA, 18 bp, Homo sapiens
aaatgaaaacatgtaata

SEQ ID NO: 2326219 - DNA, 12 bp, Homo sapiens
aaatgaaaattg

SEQ ID NO: 2326220 - DNA, 20 bp, Homo sapiens
aaatgaaagaaaattgagtt

SEQ ID NO: 2326221 - DNA, 14 bp, Homo sapiens
aaatgaaatgcata

SEQ ID NO: 2326222 - DNA, 15 bp, Homo sapiens
aaatgaaatgtatgc

SEQ ID NO: 2326223 - DNA, 15 bp, Homo sapiens
aaatgaaatttaagc

SEQ ID NO: 2326224 - DNA, 14 bp, Homo sapiens
aaatgaatgattaa

SEQ ID NO: 2326225 - DNA, 22 bp, Homo sapiens
aaatgaatgattaaattatgaa

SEQ ID NO: 2326226 - DNA, 17 bp, Homo sapiens
aaatgaatttttattga

SEQ ID NO: 2326227 - DNA, 19 bp, Homo sapiens
aaatgagaatgacagcctt

SEQ ID NO: 2326228 - DNA, 20 bp, Homo sapiens
aaatgagaatgacagccttt

SEQ ID NO: 2326229 - DNA, 19 bp, Homo sapiens
aaatgagcttgattaaatc

SEQ ID NO: 2326230 - DNA, 20 bp, Homo sapiens
aaatgagtaaaaactagaag

SEQ ID NO: 2326231 - DNA, 15 bp, Homo sapiens
aaatgcaataatttt

SEQ ID NO: 2326232 - DNA, 17 bp, Homo sapiens
aaatgcaataattttac

SEQ ID NO: 2326233 - DNA, 13 bp, Homo sapiens
aaatgccctcttc

SEQ ID NO: 2326234 - DNA, 22 bp, Homo sapiens
aaatgccctcttctcgtgcctc

SEQ ID NO: 2326235 - DNA, 16 bp, Homo sapiens
aaatgcttcatttgta

SEQ ID NO: 2326236 - DNA, 19 bp, Homo sapiens
aaatgcttcatttgtatgt

SEQ ID NO: 2326237 - DNA, 12 bp, Homo sapiens
aaatggaaattt

SEQ ID NO: 2326238 - DNA, 16 bp, Homo sapiens
aaatggagaagctgca

SEQ ID NO: 2326239 - DNA, 18 bp, Homo sapiens
aaatggagaagctgcagg

SEQ ID NO: 2326240 - DNA, 15 bp, Homo sapiens
aaatggcatttagca

SEQ ID NO: 2326241 - DNA, 17 bp, Homo sapiens
aaatggcatttagcaca

SEQ ID NO: 2326242 - DNA, 17 bp, Homo sapiens
aaatggcgtctgctctg

SEQ ID NO: 2326243 - DNA, 21 bp, Homo sapiens
aaatggcgtctgctctggtgg

SEQ ID NO: 2326244 - DNA, 21 bp, Homo sapiens
aaatggttaaattttacatga

SEQ ID NO: 2326245 - DNA, 19 bp, Homo sapiens
aaatgtaatttaaatgaaa

SEQ ID NO: 2326246 - DNA, 22 bp, Homo sapiens
aaatgtacactaccaaacactc

SEQ ID NO: 2326247 - DNA, 18 bp, Homo sapiens
aaaatggcatttagcaca

SEQ ID NO: 2326248 - DNA, 18 bp, Homo sapiens
aaaatgtaatttaaatga

SEQ ID NO: 2326249 - DNA, 11 bp, Homo sapiens
aaaatgtatat

SEQ ID NO: 2326250 - DNA, 21 bp, Homo sapiens
aaaatgtatccaaggaaacat

SEQ ID NO: 2326251 - DNA, 15 bp, Homo sapiens
aaaatgttacgtgaa

SEQ ID NO: 2326252 - DNA, 20 bp, Homo sapiens
aaaatgttacgtgaagaaat

SEQ ID NO: 2326253 - DNA, 22 bp, Homo sapiens
aaaatgttacgtgaagaaataa

SEQ ID NO: 2326254 - DNA, 21 bp, Homo sapiens
aaaatgtttcattatgcactt

SEQ ID NO: 2326255 - DNA, 22 bp, Homo sapiens
aaaatgtttcattatgcacttt

SEQ ID NO: 2326256 - DNA, 21 bp, Homo sapiens
aacagctgcaattccctggat

SEQ ID NO: 2326257 - DNA, 23 bp, Homo sapiens
aacagctgtgtctgccaaacaca

SEQ ID NO: 2326258 - DNA, 12 bp, Homo sapiens
aacagtaactgc

SEQ ID NO: 2326259 - DNA, 21 bp, Homo sapiens
aacagtactggttactttcaa

SEQ ID NO: 2326260 - DNA, 13 bp, Homo sapiens
aacagttctcaga

SEQ ID NO: 2326261 - DNA, 20 bp, Homo sapiens
aacataatcttctgccttct

SEQ ID NO: 2326262 - DNA, 17 bp, Homo sapiens
aacatacaagaaaatgt

SEQ ID NO: 2326263 - DNA, 18 bp, Homo sapiens
aacatacaagaaaatgta

SEQ ID NO: 2326264 - DNA, 13 bp, Homo sapiens
aacatatgttgca

SEQ ID NO: 2326265 - DNA, 14 bp, Homo sapiens
aacatattgttgaa

SEQ ID NO: 2326266 - DNA, 21 bp, Homo sapiens
aacatgaaaaacacggcagct

SEQ ID NO: 2326267 - DNA, 23 bp, Homo sapiens
aacatgaaaaacacggcagctgt

SEQ ID NO: 2326268 - DNA, 23 bp, Homo sapiens
aacatgagtagataatttcaggg

SEQ ID NO: 2326269 - DNA, 24 bp, Homo sapiens
aacatgtaaaatgtttaatggtga

SEQ ID NO: 2326270 - DNA, 20 bp, Homo sapiens
aacatgttaatgacaatatt

SEQ ID NO: 2326271 - DNA, 13 bp, Homo sapiens
aacatgtttaatg

SEQ ID NO: 2326272 - DNA, 23 bp, Homo sapiens
aacattaatgcctgctttttgga

SEQ ID NO: 2326273 - DNA, 18 bp, Homo sapiens
aacattctcctgtggaag

SEQ ID NO: 2326274 - DNA, 13 bp, Homo sapiens
aacattgtgttcc

SEQ ID NO: 2326275 - DNA, 19 bp, Homo sapiens
aacatttgattaataaaat

SEQ ID NO: 2326276 - DNA, 21 bp, Homo sapiens
aacatttgattaataaaatat

SEQ ID NO: 2326277 - DNA, 13 bp, Homo sapiens
aacatttgctgcc

SEQ ID NO: 2326278 - DNA, 13 bp, Homo sapiens
aacattttttata

SEQ ID NO: 2326279 - DNA, 16 bp, Homo sapiens
aacattttttatacat

SEQ ID NO: 2326280 - DNA, 14 bp, Homo sapiens
aaccaaaaacattt

SEQ ID NO: 2326281 - DNA, 23 bp, Homo sapiens
aatgagtaaaaactagaaggctt

SEQ ID NO: 2326282 - DNA, 18 bp, Homo sapiens
aatgattaaattatgaag

SEQ ID NO: 2326283 - DNA, 22 bp, Homo sapiens
aatgattaagggacatttctat

SEQ ID NO: 2326284 - DNA, 16 bp, Homo sapiens
aatgcaataattttac

SEQ ID NO: 2326285 - DNA, 13 bp, Homo sapiens
aatgccatgaatt

SEQ ID NO: 2326286 - DNA, 19 bp, Homo sapiens
aatgccatttctcacgccc

SEQ ID NO: 2326287 - DNA, 14 bp, Homo sapiens
aatgcccttcactg

SEQ ID NO: 2326288 - DNA, 13 bp, Homo sapiens
aatgcctgctttt

SEQ ID NO: 2326289 - DNA, 21 bp, Homo sapiens
aatgcctgctttttggaaagt

SEQ ID NO: 2326290 - DNA, 16 bp, Homo sapiens
aatgcctttgagacag

SEQ ID NO: 2326291 - DNA, 16 bp, Homo sapiens
aatgctacaattttaa

SEQ ID NO: 2326292 - DNA, 13 bp, Homo sapiens
aatgctaccagga

SEQ ID NO: 2326293 - DNA, 20 bp, Homo sapiens
aatgctatttgtgtaactga

SEQ ID NO: 2326294 - DNA, 22 bp, Homo sapiens
aatgctcagggtcactgaacca

SEQ ID NO: 2326295 - DNA, 16 bp, Homo sapiens
aatgctccccacagcg

SEQ ID NO: 2326296 - DNA, 15 bp, Homo sapiens
aatgctgcaggatgg

SEQ ID NO: 2326297 - DNA, 17 bp, Homo sapiens
aatgctgctggccaaat

SEQ ID NO: 2326298 - DNA, 15 bp, Homo sapiens
aatgctgtttctaag

SEQ ID NO: 2326299 - DNA, 18 bp, Homo sapiens
aatgctgtttctaagaaa

SEQ ID NO: 2326300 - DNA, 14 bp, Homo sapiens
aatgcttcattatt

SEQ ID NO: 2326301 - DNA, 15 bp, Homo sapiens
aatgcttgtagaagt

SEQ ID NO: 2326302 - DNA, 14 bp, Homo sapiens
aatgcttttagtgt

SEQ ID NO: 2326303 - DNA, 21 bp, Homo sapiens
aatgcttttagtgtgtgcata

SEQ ID NO: 2326304 - DNA, 17 bp, Homo sapiens
aatggaaaattttctcc

SEQ ID NO: 2326305 - DNA, 20 bp, Homo sapiens
aatggaggatctctaaagag

SEQ ID NO: 2326306 - DNA, 17 bp, Homo sapiens
aatggaggccattgtgt

SEQ ID NO: 2326307 - DNA, 22 bp, Homo sapiens
aatggattggattatttaataa

SEQ ID NO: 2326308 - DNA, 16 bp, Homo sapiens
aatggcatttagcaca

SEQ ID NO: 2326309 - DNA, 18 bp, Homo sapiens
aatggcatttagcacagt

SEQ ID NO: 2326310 - DNA, 18 bp, Homo sapiens
aatggcatttctctttaa

SEQ ID NO: 2326311 - DNA, 19 bp, Homo sapiens
aatggcgtctgctctggtg

SEQ ID NO: 2326312 - DNA, 14 bp, Homo sapiens
aatggcttgttcat

SEQ ID NO: 2326313 - DNA, 20 bp, Homo sapiens
aatggggataataatactga

SEQ ID NO: 2326314 - DNA, 14 bp, Homo sapiens
aatggtaataagca

SEQ ID NO: 2326315 - DNA, 21 bp, Homo sapiens
aatggtcccaattaagaaatt

SEQ ID NO: 2326316 - DNA, 13 bp, Homo sapiens
aatggtctggcaa

SEQ ID NO: 2326317 - DNA, 14 bp, Homo sapiens
aatggtctttgctc

SEQ ID NO: 2326318 - DNA, 23 bp, Homo sapiens
aatggtctttgctccagataact

SEQ ID NO: 2326319 - DNA, 14 bp, Homo sapiens
aatggttaaatttt

SEQ ID NO: 2326320 - DNA, 13 bp, Homo sapiens
aatgtaatttaaa

SEQ ID NO: 2326321 - DNA, 17 bp, Homo sapiens
aatgtactgatttcagt

SEQ ID NO: 2326322 - DNA, 15 bp, Homo sapiens
aatgtataaatatac

SEQ ID NO: 2326323 - DNA, 16 bp, Homo sapiens
aatgtatattcccaca

SEQ ID NO: 2326324 - DNA, 15 bp, Homo sapiens
aatgtatatttttaa

SEQ ID NO: 2326325 - DNA, 19 bp, Homo sapiens
aatgtatatttttaaagaa

SEQ ID NO: 2326326 - DNA, 23 bp, Homo sapiens
aatgtatccaaggaaacatttta

SEQ ID NO: 2326327 - DNA, 17 bp, Homo sapiens
aatgtatgtgtggctgt

SEQ ID NO: 2326328 - DNA, 19 bp, Homo sapiens
aatgtatttgatttataag

SEQ ID NO: 2326329 - DNA, 21 bp, Homo sapiens
aatgtctcactttactttcaa

SEQ ID NO: 2326330 - DNA, 17 bp, Homo sapiens
aatgtctcatgtcaatg

SEQ ID NO: 2326331 - DNA, 17 bp, Homo sapiens
aatgtctgctggtattt

SEQ ID NO: 2326332 - DNA, 20 bp, Homo sapiens
aatgtctgctggtatttcta

SEQ ID NO: 2326333 - DNA, 23 bp, Homo sapiens
aatgtgtggattgcctctgaaaa

SEQ ID NO: 2326334 - DNA, 22 bp, Homo sapiens
acaaactcatcctcttttaatg

SEQ ID NO: 2326335 - DNA, 21 bp, Homo sapiens
acaaacttggacaacacggag

SEQ ID NO: 2326336 - DNA, 14 bp, Homo sapiens
acaaacttttaaga

SEQ ID NO: 2326337 - DNA, 18 bp, Homo sapiens
acaaagacaaaagtctgt

SEQ ID NO: 2326338 - DNA, 17 bp, Homo sapiens
acaaagcataatcaata

SEQ ID NO: 2326339 - DNA, 23 bp, Homo sapiens
acaaagccttaagcaaattttgt

SEQ ID NO: 2326340 - DNA, 19 bp, Homo sapiens
acaaagctatttaagtgga

SEQ ID NO: 2326341 - DNA, 16 bp, Homo sapiens
acaaagtactctttaa

SEQ ID NO: 2326342 - DNA, 23 bp, Homo sapiens
acaaagtactctttaacatacaa

SEQ ID NO: 2326343 - DNA, 19 bp, Homo sapiens
acaaagtttcagagtatat

SEQ ID NO: 2326344 - DNA, 14 bp, Homo sapiens
acaaataatttaga

SEQ ID NO: 2326345 - DNA, 19 bp, Homo sapiens
acaaataggatgcttggga

SEQ ID NO: 2326346 - DNA, 13 bp, Homo sapiens
acaaatgtggcca

SEQ ID NO: 2326347 - DNA, 18 bp, Homo sapiens
acaacacattgaaactgt

SEQ ID NO: 2326348 - DNA, 22 bp, Homo sapiens
acaacatagcagatctgttttg

SEQ ID NO: 2326349 - DNA, 13 bp, Homo sapiens
acaaccattaaag

SEQ ID NO: 2326350 - DNA, 15 bp, Homo sapiens
acaacctcaactgcc

SEQ ID NO: 2326351 - DNA, 12 bp, Homo sapiens
acaacctttctg

SEQ ID NO: 2326352 - DNA, 23 bp, Homo sapiens
acaacgcattgccacggaaacat

SEQ ID NO: 2326353 - DNA, 17 bp, Homo sapiens
acaactgctcccacctc

SEQ ID NO: 2326354 - DNA, 14 bp, Homo sapiens
acaacttagctcag

SEQ ID NO: 2326355 - DNA, 15 bp, Homo sapiens
acaacttagctcagg

SEQ ID NO: 2326356 - DNA, 22 bp, Homo sapiens
acaacttataggtgaatgagta

SEQ ID NO: 2326357 - DNA, 14 bp, Homo sapiens
acaactttcacttc

SEQ ID NO: 2326358 - DNA, 15 bp, Homo sapiens
acaactttcacttct

SEQ ID NO: 2326359 - DNA, 19 bp, Homo sapiens
acaagcatgcagctttgca

SEQ ID NO: 2326360 - DNA, 18 bp, Homo sapiens
acaagccaaaagtccctc

SEQ ID NO: 2326361 - DNA, 10 bp, Homo sapiens
acaaggactc

SEQ ID NO: 2326362 - DNA, 18 bp, Homo sapiens
acaagggaagatttatgt

SEQ ID NO: 2326363 - DNA, 19 bp, Homo sapiens
acaaggtaaacttcattgg

SEQ ID NO: 2326364 - DNA, 14 bp, Homo sapiens
acaagtaatattat

SEQ ID NO: 2326365 - DNA, 15 bp, Homo sapiens
acaagtaatttcagt

SEQ ID NO: 2326366 - DNA, 16 bp, Homo sapiens
acaagtaatttcagtg

SEQ ID NO: 2326367 - DNA, 18 bp, Homo sapiens
acaagtgacttatttgct

SEQ ID NO: 2326368 - DNA, 18 bp, Homo sapiens
acaagttgcttttacctg

SEQ ID NO: 2326369 - DNA, 18 bp, Homo sapiens
acaataaaacaaataaat

SEQ ID NO: 2326370 - DNA, 13 bp, Homo sapiens
acaataaaagctt

SEQ ID NO: 2326371 - DNA, 16 bp, Homo sapiens
acaatacatgagaaag

SEQ ID NO: 2326372 - DNA, 18 bp, Homo sapiens
acaatacatgagaaagat

SEQ ID NO: 2326373 - DNA, 11 bp, Homo sapiens
acaatagtata

SEQ ID NO: 2326374 - DNA, 17 bp, Homo sapiens
acaatagtatacatttt

SEQ ID NO: 2326375 - DNA, 21 bp, Homo sapiens
acaatgagaaaaataaatgga

SEQ ID NO: 2326376 - DNA, 20 bp, Homo sapiens
acaatgttaaggaaactctt

SEQ ID NO: 2326377 - DNA, 21 bp, Homo sapiens
acaatgttaaggaaactctta

SEQ ID NO: 2326378 - DNA, 20 bp, Homo sapiens
acaattgggagctgccaaga

SEQ ID NO: 2326379 - DNA, 19 bp, Homo sapiens
acacaacgattatagtaac

SEQ ID NO: 2326380 - DNA, 10 bp, Homo sapiens
acacacacac

SEQ ID NO: 2326381 - DNA, 11 bp, Homo sapiens
acacacacaca

SEQ ID NO: 2326382 - DNA, 15 bp, Homo sapiens
acacacacacgatgc

SEQ ID NO: 2326383 - DNA, 15 bp, Homo sapiens
acacacacgatgcat

SEQ ID NO: 2326384 - DNA, 14 bp, Homo sapiens
acacacagccccta

SEQ ID NO: 2326385 - DNA, 14 bp, Homo sapiens
acacacgatgcatt

SEQ ID NO: 2326386 - DNA, 14 bp, Homo sapiens
acacagaaatgctg

SEQ ID NO: 2326387 - DNA, 16 bp, Homo sapiens
acacagaaatgctgct

SEQ ID NO: 2326388 - DNA, 17 bp, Homo sapiens
accctctccatctccca

SEQ ID NO: 2326389 - DNA, 23 bp, Homo sapiens
accctctccatctcccaaggctg

SEQ ID NO: 2326390 - DNA, 15 bp, Homo sapiens
accctcttcctgtga

SEQ ID NO: 2326391 - DNA, 19 bp, Homo sapiens
accctcttcctgtgatcca

SEQ ID NO: 2326392 - DNA, 23 bp, Homo sapiens
accctcttgcccatcctgactga

SEQ ID NO: 2326393 - DNA, 23 bp, Homo sapiens
accctgaaatattttctacttta

SEQ ID NO: 2326394 - DNA, 13 bp, Homo sapiens
accctgacctggc

SEQ ID NO: 2326395 - DNA, 17 bp, Homo sapiens
accctgaggccctgggc

SEQ ID NO: 2326396 - DNA, 14 bp, Homo sapiens
accctgcagagcta

SEQ ID NO: 2326397 - DNA, 18 bp, Homo sapiens
accctgccacagccagag

SEQ ID NO: 2326398 - DNA, 20 bp, Homo sapiens
accctgccacagccagagga

SEQ ID NO: 2326399 - DNA, 13 bp, Homo sapiens
accctgcgggcca

SEQ ID NO: 2326400 - DNA, 18 bp, Homo sapiens
accctgctcatccactct

SEQ ID NO: 2326401 - DNA, 19 bp, Homo sapiens
accctgctgaacacagtgt

SEQ ID NO: 2326402 - DNA, 23 bp, Homo sapiens
accctgctgaacacagtgtctgt

SEQ ID NO: 2326403 - DNA, 17 bp, Homo sapiens
accctggcccctctccc

SEQ ID NO: 2326404 - DNA, 21 bp, Homo sapiens
accctgtctgtcccttttctt

SEQ ID NO: 2326405 - DNA, 22 bp, Homo sapiens
accctgtctgtcccttttcttt

SEQ ID NO: 2326406 - DNA, 19 bp, Homo sapiens
accctgtgacatggtgcct

SEQ ID NO: 2326407 - DNA, 15 bp, Homo sapiens
acccttattgctgtc

SEQ ID NO: 2326408 - DNA, 17 bp, Homo sapiens
acccttattgctgtcct

SEQ ID NO: 2326409 - DNA, 19 bp, Homo sapiens
acccttattgctgtcctgg

SEQ ID NO: 2326410 - DNA, 19 bp, Homo sapiens
acccttcatcttcctgtgt

SEQ ID NO: 2326411 - DNA, 20 bp, Homo sapiens
acccttcatcttcctgtgtc

SEQ ID NO: 2326412 - DNA, 18 bp, Homo sapiens
acccttctcccactctcc

SEQ ID NO: 2326413 - DNA, 16 bp, Homo sapiens
accctttggccccact

SEQ ID NO: 2326414 - DNA, 23 bp, Homo sapiens
accctttggtttttttcttctgt

SEQ ID NO: 2326415 - DNA, 12 bp, Homo sapiens
accgcacagctc

SEQ ID NO: 2326416 - DNA, 14 bp, Homo sapiens
accgcacagctcag

SEQ ID NO: 2326417 - DNA, 13 bp, Homo sapiens
accggagagagaa

SEQ ID NO: 2326418 - DNA, 24 bp, Homo sapiens
accggagtgtctggaattgtggct

SEQ ID NO: 2326419 - DNA, 14 bp, Homo sapiens
accggattctctct

SEQ ID NO: 2326420 - DNA, 19 bp, Homo sapiens
accggcctgtgggtctctg

SEQ ID NO: 2326421 - DNA, 22 bp, Homo sapiens
accggcctgtgggtctctgaag

SEQ ID NO: 2326422 - DNA, 19 bp, Homo sapiens
accgggccctgggttcctc

SEQ ID NO: 2326423 - DNA, 15 bp, Homo sapiens
accgtgcctggccag

SEQ ID NO: 2326424 - DNA, 17 bp, Homo sapiens
accgtggtatgtctgcc

SEQ ID NO: 2326425 - DNA, 13 bp, Homo sapiens
accgtgtcaagct

SEQ ID NO: 2326426 - DNA, 17 bp, Homo sapiens
accgtgtctgtctggca

SEQ ID NO: 2326427 - DNA, 20 bp, Homo sapiens
acctaacacattaaatgtgg

SEQ ID NO: 2326428 - DNA, 22 bp, Homo sapiens
acgtcaggccctgactcctctg

SEQ ID NO: 2326429 - DNA, 16 bp, Homo sapiens
acgtccaaggtggcag

SEQ ID NO: 2326430 - DNA, 23 bp, Homo sapiens
acgtccgtgtgtcccagatgctg

SEQ ID NO: 2326431 - DNA, 20 bp, Homo sapiens
acgtggcctccgcagtgtct

SEQ ID NO: 2326432 - DNA, 15 bp, Homo sapiens
acgttgccaggggct

SEQ ID NO: 2326433 - DNA, 11 bp, Homo sapiens
acgtttataaa

SEQ ID NO: 2326434 - DNA, 21 bp, Homo sapiens
acgtttataaacagaaatgga

SEQ ID NO: 2326435 - DNA, 17 bp, Homo sapiens
acgtttcttctttctag

SEQ ID NO: 2326436 - DNA, 14 bp, Homo sapiens
acgttttcttcttt

SEQ ID NO: 2326437 - DNA, 17 bp, Homo sapiens
acgttttcttctttccc

SEQ ID NO: 2326438 - DNA, 21 bp, Homo sapiens
acgttttcttctttccctgga

SEQ ID NO: 2326439 - DNA, 23 bp, Homo sapiens
acgttttcttctttccctggaca

SEQ ID NO: 2326440 - DNA, 14 bp, Homo sapiens
acgtttttccttta

SEQ ID NO: 2326441 - DNA, 20 bp, Homo sapiens
actaaaaagtataaaatagt

SEQ ID NO: 2326442 - DNA, 17 bp, Homo sapiens
actaaacatgtatgtaa

SEQ ID NO: 2326443 - DNA, 16 bp, Homo sapiens
actaaagagagaatgt

SEQ ID NO: 2326444 - DNA, 20 bp, Homo sapiens
actaaatatgcaatatatgt

SEQ ID NO: 2326445 - DNA, 15 bp, Homo sapiens
actaaatcagagaca

SEQ ID NO: 2326446 - DNA, 18 bp, Homo sapiens
actaaatcagagacaaaa

SEQ ID NO: 2326447 - DNA, 21 bp, Homo sapiens
actaaatcagagacaaaatat

SEQ ID NO: 2326448 - DNA, 15 bp, Homo sapiens
actaaattttaaagc

SEQ ID NO: 2326449 - DNA, 13 bp, Homo sapiens
actaacagataag

SEQ ID NO: 2326450 - DNA, 17 bp, Homo sapiens
actaacagataagcaag

SEQ ID NO: 2326451 - DNA, 18 bp, Homo sapiens
actaacagctacaaactt

SEQ ID NO: 2326452 - DNA, 22 bp, Homo sapiens
actaacagctacaaacttttaa

SEQ ID NO: 2326453 - DNA, 15 bp, Homo sapiens
actaactcaaataca

SEQ ID NO: 2326454 - DNA, 18 bp, Homo sapiens
actaactcaaatacacat

SEQ ID NO: 2326455 - DNA, 22 bp, Homo sapiens
actaactcaccagccccactgc

SEQ ID NO: 2326456 - DNA, 17 bp, Homo sapiens
actaagagtaaagcaac

SEQ ID NO: 2326457 - DNA, 11 bp, Homo sapiens
actaagccagg

SEQ ID NO: 2326458 - DNA, 12 bp, Homo sapiens
actaataaacca

SEQ ID NO: 2326459 - DNA, 13 bp, Homo sapiens
actacaagtcagc

SEQ ID NO: 2326460 - DNA, 18 bp, Homo sapiens
actacagtgattcatgta

SEQ ID NO: 2326461 - DNA, 17 bp, Homo sapiens
actagaaggcttctctc

SEQ ID NO: 2326462 - DNA, 12 bp, Homo sapiens
actagagaaaat

SEQ ID NO: 2326463 - DNA, 14 bp, Homo sapiens
actagccaaaccag

SEQ ID NO: 2326464 - DNA, 18 bp, Homo sapiens
actagccaaaccaggacc

SEQ ID NO: 2326465 - DNA, 21 bp, Homo sapiens
actagctgggactacaggtgc

SEQ ID NO: 2326466 - DNA, 21 bp, Homo sapiens
actagtcctgacactgaattt

SEQ ID NO: 2326467 - DNA, 11 bp, Homo sapiens
actagtggcaa

SEQ ID NO: 2326468 - DNA, 15 bp, Homo sapiens
actataaggtgcctc

SEQ ID NO: 2326469 - DNA, 19 bp, Homo sapiens
actatataatttatttcca

SEQ ID NO: 2326470 - DNA, 16 bp, Homo sapiens
actatatatataaatg

SEQ ID NO: 2326471 - DNA, 17 bp, Homo sapiens
actatatatataaatgt

SEQ ID NO: 2326472 - DNA, 20 bp, Homo sapiens
actatatatataaatgtata

SEQ ID NO: 2326473 - DNA, 22 bp, Homo sapiens
actatatatataaatgtataaa

SEQ ID NO: 2326474 - DNA, 19 bp, Homo sapiens
actatggtgtgttgtatct

SEQ ID NO: 2326475 - DNA, 22 bp, Homo sapiens
actattagagtatttcccttcc

SEQ ID NO: 2326476 - DNA, 15 bp, Homo sapiens
actattcatggctac

SEQ ID NO: 2326477 - DNA, 15 bp, Homo sapiens
actattgggtgaata

SEQ ID NO: 2326478 - DNA, 15 bp, Homo sapiens
actcaaaaaaacaaa

SEQ ID NO: 2326479 - DNA, 16 bp, Homo sapiens
actcaaatacacattt

SEQ ID NO: 2326480 - DNA, 18 bp, Homo sapiens
actcaagcgggtggctct

SEQ ID NO: 2326481 - DNA, 21 bp, Homo sapiens
actcaagcgggtggctctggg

SEQ ID NO: 2326482 - DNA, 21 bp, Homo sapiens
actcaaggataccttcttatt

SEQ ID NO: 2326483 - DNA, 17 bp, Homo sapiens
actcacctaatgtttat

SEQ ID NO: 2326484 - DNA, 13 bp, Homo sapiens
actcactaagttt

SEQ ID NO: 2326485 - DNA, 18 bp, Homo sapiens
actcacttttcccactcc

SEQ ID NO: 2326486 - DNA, 21 bp, Homo sapiens
actcagagaaaaatgctcccc

SEQ ID NO: 2326487 - DNA, 22 bp, Homo sapiens
actcagagaaaaatgctcccca

SEQ ID NO: 2326488 - DNA, 23 bp, Homo sapiens
actcagatctgatcaagagtccg

SEQ ID NO: 2326489 - DNA, 20 bp, Homo sapiens
actcagctttctttaaagtt

SEQ ID NO: 2326490 - DNA, 23 bp, Homo sapiens
actcagtgagcctcctgtgcctg

SEQ ID NO: 2326491 - DNA, 18 bp, Homo sapiens
actcatcttagtgcctga

SEQ ID NO: 2326492 - DNA, 15 bp, Homo sapiens
actcattctgaatta

SEQ ID NO: 2326493 - DNA, 15 bp, Homo sapiens
actccaagcccagcc

SEQ ID NO: 2326494 - DNA, 14 bp, Homo sapiens
actccacatctgcc

SEQ ID NO: 2326495 - DNA, 15 bp, Homo sapiens
actccacatctgcct

SEQ ID NO: 2326496 - DNA, 16 bp, Homo sapiens
actccacatctgcctt

SEQ ID NO: 2326497 - DNA, 15 bp, Homo sapiens
actccacctccaccc

SEQ ID NO: 2326498 - DNA, 15 bp, Homo sapiens
actccagcaacttct

SEQ ID NO: 2326499 - DNA, 14 bp, Homo sapiens
actccaggaaagag

SEQ ID NO: 2326500 - DNA, 17 bp, Homo sapiens
actccaggaaagagcag

SEQ ID NO: 2326501 - DNA, 18 bp, Homo sapiens
actccaggccctcctctc

SEQ ID NO: 2326502 - DNA, 20 bp, Homo sapiens
actccagggacacacagcct

SEQ ID NO: 2326503 - DNA, 20 bp, Homo sapiens
actccccacatcccatcgtc

SEQ ID NO: 2326504 - DNA, 14 bp, Homo sapiens
actccctgcagatg

SEQ ID NO: 2326505 - DNA, 17 bp, Homo sapiens
actccgcgccgatgcca

SEQ ID NO: 2326506 - DNA, 21 bp, Homo sapiens
actccgcgccgatgccaccgg

SEQ ID NO: 2326507 - DNA, 18 bp, Homo sapiens
actcctctggctttccca

SEQ ID NO: 2326508 - DNA, 14 bp, Homo sapiens
gcatcctatgctta

SEQ ID NO: 2326509 - DNA, 15 bp, Homo sapiens
gcatcctatgcttaa

SEQ ID NO: 2326510 - DNA, 21 bp, Homo sapiens
gcatcctatgcttaataaaag

SEQ ID NO: 2326511 - DNA, 20 bp, Homo sapiens
gcatcctgcagggcttctcc

SEQ ID NO: 2326512 - DNA, 16 bp, Homo sapiens
gcatcctgtgccacta

SEQ ID NO: 2326513 - DNA, 17 bp, Homo sapiens
gcatccttgtcttttga

SEQ ID NO: 2326514 - DNA, 14 bp, Homo sapiens
gcatctatctcatc

SEQ ID NO: 2326515 - DNA, 16 bp, Homo sapiens
gcatctcttccccaga

SEQ ID NO: 2326516 - DNA, 17 bp, Homo sapiens
gcatctcttccccagag

SEQ ID NO: 2326517 - DNA, 19 bp, Homo sapiens
gcatctcttccccagagag

SEQ ID NO: 2326518 - DNA, 20 bp, Homo sapiens
gcatctcttccccagagagg

SEQ ID NO: 2326519 - DNA, 12 bp, Homo sapiens
gcatctggggcc

SEQ ID NO: 2326520 - DNA, 20 bp, Homo sapiens
gcatctggggcccatactgg

SEQ ID NO: 2326521 - DNA, 16 bp, Homo sapiens
gcatctgtcccccttt

SEQ ID NO: 2326522 - DNA, 15 bp, Homo sapiens
gcatcttgctggcta

SEQ ID NO: 2326523 - DNA, 14 bp, Homo sapiens
gcatgacactctag

SEQ ID NO: 2326524 - DNA, 21 bp, Homo sapiens
gcatgactaatgctttttaga

SEQ ID NO: 2326525 - DNA, 22 bp, Homo sapiens
gcatgactaatgctttttagaa

SEQ ID NO: 2326526 - DNA, 14 bp, Homo sapiens
gcatgcatgcaaat

SEQ ID NO: 2326527 - DNA, 20 bp, Homo sapiens
gcatgcatgggaggaattca

SEQ ID NO: 2326528 - DNA, 16 bp, Homo sapiens
gcatgcttcctttctc

SEQ ID NO: 2326529 - DNA, 17 bp, Homo sapiens
gcatgcttcctttctct

SEQ ID NO: 2326530 - DNA, 18 bp, Homo sapiens
gcatgcttcctttctctc

SEQ ID NO: 2326531 - DNA, 20 bp, Homo sapiens
gcatggacatttagaagaaa

SEQ ID NO: 2326532 - DNA, 18 bp, Homo sapiens
gcattattaaattgtaaa

SEQ ID NO: 2326533 - DNA, 13 bp, Homo sapiens
gcattccttcttt

SEQ ID NO: 2326534 - DNA, 14 bp, Homo sapiens
gcattccttctttg

SEQ ID NO: 2326535 - DNA, 15 bp, Homo sapiens
gcattccttctttga

SEQ ID NO: 2326536 - DNA, 15 bp, Homo sapiens
gcattctgagctggg

SEQ ID NO: 2326537 - DNA, 16 bp, Homo sapiens
gcattctgagctgggc

SEQ ID NO: 2326538 - DNA, 16 bp, Homo sapiens
gcattctggacctctg

SEQ ID NO: 2326539 - DNA, 16 bp, Homo sapiens
gcattgagcttgcatg

SEQ ID NO: 2326540 - DNA, 15 bp, Homo sapiens
gcattgagtattgtt

SEQ ID NO: 2326541 - DNA, 13 bp, Homo sapiens
gcatttaaaaaaa

SEQ ID NO: 2326542 - DNA, 18 bp, Homo sapiens
gcatttaaaatggaaaat

SEQ ID NO: 2326543 - DNA, 15 bp, Homo sapiens
gcatttaataaagat

SEQ ID NO: 2326544 - DNA, 19 bp, Homo sapiens
gcatttaataaagatgagt

SEQ ID NO: 2326545 - DNA, 23 bp, Homo sapiens
gcatttagcacagtatttaacat

SEQ ID NO: 2326546 - DNA, 13 bp, Homo sapiens
gcatttccaaaca

SEQ ID NO: 2326547 - DNA, 14 bp, Homo sapiens
gcatttctctttaa

SEQ ID NO: 2326548 - DNA, 16 bp, Homo sapiens
gcatttctctttaaac

SEQ ID NO: 2326549 - DNA, 19 bp, Homo sapiens
gcatttggtctcaggcagc

SEQ ID NO: 2326550 - DNA, 16 bp, Homo sapiens
gcattttagaaactac

SEQ ID NO: 2326551 - DNA, 12 bp, Homo sapiens
gcattttcctcc

SEQ ID NO: 2326552 - DNA, 14 bp, Homo sapiens
gcatttttgtaaat

SEQ ID NO: 2326553 - DNA, 15 bp, Homo sapiens
gccaaaagtccctcc

SEQ ID NO: 2326554 - DNA, 15 bp, Homo sapiens
gccaaaatcaagagt

SEQ ID NO: 2326555 - DNA, 14 bp, Homo sapiens
gccaaatagcaaag

SEQ ID NO: 2326556 - DNA, 20 bp, Homo sapiens
gccaagcagaaaaaaaagtg

SEQ ID NO: 2326557 - DNA, 13 bp, Homo sapiens
gccaagtccctgg

SEQ ID NO: 2326558 - DNA, 20 bp, Homo sapiens
gccaatttcaagttccaagt

SEQ ID NO: 2326559 - DNA, 16 bp, Homo sapiens
gccacaagctgcactg

SEQ ID NO: 2326560 - DNA, 21 bp, Homo sapiens
gccacaagctgcactgtgaac

SEQ ID NO: 2326561 - DNA, 21 bp, Homo sapiens
gccacaatgcagttctgagca

SEQ ID NO: 2326562 - DNA, 17 bp, Homo sapiens
gccacactctccatcac

SEQ ID NO: 2326563 - DNA, 14 bp, Homo sapiens
gccacactgatggc

SEQ ID NO: 2326564 - DNA, 13 bp, Homo sapiens
gccacagccagag

SEQ ID NO: 2326565 - DNA, 16 bp, Homo sapiens
gccacagccagaggag

SEQ ID NO: 2326566 - DNA, 15 bp, Homo sapiens
gccacagtgggatga

SEQ ID NO: 2326567 - DNA, 15 bp, Homo sapiens
gccaccaaagctgcc

SEQ ID NO: 2326568 - DNA, 17 bp, Homo sapiens
gccaccaaagctgccca

SEQ ID NO: 2326569 - DNA, 19 bp, Homo sapiens
gccaccaaagctgcccact

SEQ ID NO: 2326570 - DNA, 20 bp, Homo sapiens
gccaccaaagctgcccactg

SEQ ID NO: 2326571 - DNA, 14 bp, Homo sapiens
gccaccagccatcc

SEQ ID NO: 2326572 - DNA, 19 bp, Homo sapiens
gccaccggcctgtgggtct

SEQ ID NO: 2326573 - DNA, 16 bp, Homo sapiens
gccaccgtgcctggcc

SEQ ID NO: 2326574 - DNA, 17 bp, Homo sapiens
gccacctgcaagatgga

SEQ ID NO: 2326575 - DNA, 15 bp, Homo sapiens
gccacgcagtgcctg

SEQ ID NO: 2326576 - DNA, 21 bp, Homo sapiens
gccactccagttttctcctct

SEQ ID NO: 2326577 - DNA, 15 bp, Homo sapiens
gccactccctgggac

SEQ ID NO: 2326578 - DNA, 18 bp, Homo sapiens
gccactttacccacctag

SEQ ID NO: 2326579 - DNA, 19 bp, Homo sapiens
gccactttacccacctaga

SEQ ID NO: 2326580 - DNA, 18 bp, Homo sapiens
gccagacatggacctcca

SEQ ID NO: 2326581 - DNA, 18 bp, Homo sapiens
gccagaccagcaggctgg

SEQ ID NO: 2326582 - DNA, 15 bp, Homo sapiens
gccagacctagcagg

SEQ ID NO: 2326583 - DNA, 19 bp, Homo sapiens
gccagacctagcaggctgt

SEQ ID NO: 2326584 - DNA, 22 bp, Homo sapiens
gccagacctagcaggctgttcc

SEQ ID NO: 2326585 - DNA, 18 bp, Homo sapiens
gccagaggaatcctggca

SEQ ID NO: 2326586 - DNA, 20 bp, Homo sapiens
gccagaggaatcctggcagc

SEQ ID NO: 2326587 - DNA, 16 bp, Homo sapiens
gccagaggagggcaga

SEQ ID NO: 2326588 - DNA, 22 bp, Homo sapiens
gccagaggagggcagagggaga

SEQ ID NO: 2326589 - DNA, 16 bp, Homo sapiens
gccagaggctgggagt

SEQ ID NO: 2326590 - DNA, 16 bp, Homo sapiens
gccagattctgcctct

SEQ ID NO: 2326591 - DNA, 17 bp, Homo sapiens
gccagattctgcctctc

SEQ ID NO: 2326592 - DNA, 18 bp, Homo sapiens
gccagattctgcctctct

SEQ ID NO: 2326593 - DNA, 19 bp, Homo sapiens
gccagattctgcctctctg

SEQ ID NO: 2326594 - DNA, 17 bp, Homo sapiens
gccagcccctggggccc

SEQ ID NO: 2326595 - DNA, 18 bp, Homo sapiens
gccagcccctggggccca

SEQ ID NO: 2326596 - DNA, 13 bp, Homo sapiens
gccagcctcctct

SEQ ID NO: 2326597 - DNA, 15 bp, Homo sapiens
gccagcctcctctgg

SEQ ID NO: 2326598 - DNA, 22 bp, Homo sapiens
gccagccttgagccctggctgt

SEQ ID NO: 2326599 - DNA, 18 bp, Homo sapiens
gccagcggggctgctcac

SEQ ID NO: 2326600 - DNA, 21 bp, Homo sapiens
gccagctgccctatgggcctg

SEQ ID NO: 2326601 - DNA, 15 bp, Homo sapiens
gccagctttccctgc

SEQ ID NO: 2326602 - DNA, 19 bp, Homo sapiens
gccaggaagccagagcccc

SEQ ID NO: 2326603 - DNA, 12 bp, Homo sapiens
gccaggcagagg

SEQ ID NO: 2326604 - DNA, 14 bp, Homo sapiens
gccaggcagaggtt

SEQ ID NO: 2326605 - DNA, 12 bp, Homo sapiens
gccaggccagcc

SEQ ID NO: 2326606 - DNA, 15 bp, Homo sapiens
gccaggccagcctcc

SEQ ID NO: 2326607 - DNA, 21 bp, Homo sapiens
gccaggctgtaagcattctga

SEQ ID NO: 2326608 - DNA, 13 bp, Homo sapiens
gccagggcctctc

SEQ ID NO: 2326609 - DNA, 16 bp, Homo sapiens
gccagggctgccccta

SEQ ID NO: 2326610 - DNA, 12 bp, Homo sapiens
gccagtccccat

SEQ ID NO: 2326611 - DNA, 16 bp, Homo sapiens
gccagttgatctgctc

SEQ ID NO: 2326612 - DNA, 19 bp, Homo sapiens
gccagttgggctcgcactg

SEQ ID NO: 2326613 - DNA, 17 bp, Homo sapiens
gccataaacggttcctg

SEQ ID NO: 2326614 - DNA, 18 bp, Homo sapiens
gccataaacggttcctgg

SEQ ID NO: 2326615 - DNA, 19 bp, Homo sapiens
gccataaacggttcctggt

SEQ ID NO: 2326616 - DNA, 19 bp, Homo sapiens
gccatacataaaagaaata

SEQ ID NO: 2326617 - DNA, 14 bp, Homo sapiens
gccatactgtgtcc

SEQ ID NO: 2326618 - DNA, 21 bp, Homo sapiens
gccatagaccctgaggccctg

SEQ ID NO: 2326619 - DNA, 16 bp, Homo sapiens
gccatattcacacctc

SEQ ID NO: 2326620 - DNA, 24 bp, Homo sapiens
gccatcctcaaacgacagaggagc

SEQ ID NO: 2326621 - DNA, 15 bp, Homo sapiens
gccatctagccagcc

SEQ ID NO: 2326622 - DNA, 16 bp, Homo sapiens
gccatctagccagccc

SEQ ID NO: 2326623 - DNA, 19 bp, Homo sapiens
gccatctcatgaggggaga

SEQ ID NO: 2326624 - DNA, 20 bp, Homo sapiens
gccatctcatgaggggagag

SEQ ID NO: 2326625 - DNA, 17 bp, Homo sapiens
gccatgacagaggctgc

SEQ ID NO: 2326626 - DNA, 16 bp, Homo sapiens
gccatgatcagacata

SEQ ID NO: 2326627 - DNA, 14 bp, Homo sapiens
gccatgcaggaggt

SEQ ID NO: 2326628 - DNA, 15 bp, Homo sapiens
gccatgccagctggc

SEQ ID NO: 2326629 - DNA, 18 bp, Homo sapiens
gccatgccgtctgccgga

SEQ ID NO: 2326630 - DNA, 14 bp, Homo sapiens
gccatggatctgat

SEQ ID NO: 2326631 - DNA, 21 bp, Homo sapiens
gccatggcctgcaaactggga

SEQ ID NO: 2326632 - DNA, 13 bp, Homo sapiens
gccatgggcctgc

SEQ ID NO: 2326633 - DNA, 18 bp, Homo sapiens
gccatggtgtgtttgtaa

SEQ ID NO: 2326634 - DNA, 22 bp, Homo sapiens
gccatgtccaaagaggctgccc

SEQ ID NO: 2326635 - DNA, 20 bp, Homo sapiens
gccatgtcgccaaaaataca

SEQ ID NO: 2326636 - DNA, 22 bp, Homo sapiens
gccatgtctgcagtgtgccccc

SEQ ID NO: 2326637 - DNA, 19 bp, Homo sapiens
gccatgtgcatagtttctt

SEQ ID NO: 2326638 - DNA, 20 bp, Homo sapiens
gccatttgcaataacagctg

SEQ ID NO: 2326639 - DNA, 23 bp, Homo sapiens
gccatttgcaataacagctgcaa

SEQ ID NO: 2326640 - DNA, 19 bp, Homo sapiens
gccattttgtgaatggatt

SEQ ID NO: 2326641 - DNA, 14 bp, Homo sapiens
gcccaatgaaatga

SEQ ID NO: 2326642 - DNA, 13 bp, Homo sapiens
gcccacatgggac

SEQ ID NO: 2326643 - DNA, 15 bp, Homo sapiens
gcccaccccctgccc

SEQ ID NO: 2326644 - DNA, 16 bp, Homo sapiens
gcccaccccctgccct

SEQ ID NO: 2326645 - DNA, 17 bp, Homo sapiens
gcccaccccctgccctg

SEQ ID NO: 2326646 - DNA, 18 bp, Homo sapiens
gcccaccccctgccctgc

SEQ ID NO: 2326647 - DNA, 20 bp, Homo sapiens
gcccaccccctgccctgcac

SEQ ID NO: 2326648 - DNA, 22 bp, Homo sapiens
gcccaccccctgccctgcacgt

SEQ ID NO: 2326649 - DNA, 13 bp, Homo sapiens
gcccacgcagagg

SEQ ID NO: 2326650 - DNA, 18 bp, Homo sapiens
gcccacgcagaggacgca

SEQ ID NO: 2326651 - DNA, 19 bp, Homo sapiens
gcccagaaagcctctctct

SEQ ID NO: 2326652 - DNA, 21 bp, Homo sapiens
gcccagatgtgtcccccccag

SEQ ID NO: 2326653 - DNA, 22 bp, Homo sapiens
gcccagcagtgtggagaccctg

SEQ ID NO: 2326654 - DNA, 23 bp, Homo sapiens
gcccagccccactcctctgctga

SEQ ID NO: 2326655 - DNA, 17 bp, Homo sapiens
gcccagcccctactgct

SEQ ID NO: 2326656 - DNA, 11 bp, Homo sapiens
gcccagcctgt

SEQ ID NO: 2326657 - DNA, 15 bp, Homo sapiens
gcccagcctgtcctg

SEQ ID NO: 2326658 - DNA, 18 bp, Homo sapiens
gcccagcctgtcctggta

SEQ ID NO: 2326659 - DNA, 22 bp, Homo sapiens
gcccaggatactggcacagagg

SEQ ID NO: 2326660 - DNA, 12 bp, Homo sapiens
gcccaggcctca

SEQ ID NO: 2326661 - DNA, 14 bp, Homo sapiens
gcccaggcctcacc

SEQ ID NO: 2326662 - DNA, 20 bp, Homo sapiens
gcccagggcatcttgctggc

SEQ ID NO: 2326663 - DNA, 15 bp, Homo sapiens
gcccagtctgttgag

SEQ ID NO: 2326664 - DNA, 18 bp, Homo sapiens
gcccagttcatcaccatt

SEQ ID NO: 2326665 - DNA, 14 bp, Homo sapiens
gcccatctcaggac

SEQ ID NO: 2326666 - DNA, 14 bp, Homo sapiens
gcccatgctgtccg

SEQ ID NO: 2326667 - DNA, 21 bp, Homo sapiens
gcccatggagattgacctgga

SEQ ID NO: 2326668 - DNA, 23 bp, Homo sapiens
gcccatggagattgacctggatg

SEQ ID NO: 2326669 - DNA, 14 bp, Homo sapiens
gcccattgtcctcc

SEQ ID NO: 2326670 - DNA, 17 bp, Homo sapiens
gcccattgtcctccttt

SEQ ID NO: 2326671 - DNA, 18 bp, Homo sapiens
gcccattgtcctcctttt

SEQ ID NO: 2326672 - DNA, 15 bp, Homo sapiens
gccccaagcaggacg

SEQ ID NO: 2326673 - DNA, 15 bp, Homo sapiens
gccccacatggctta

SEQ ID NO: 2326674 - DNA, 21 bp, Homo sapiens
gccccaccctcaaaccctgtg

SEQ ID NO: 2326675 - DNA, 20 bp, Homo sapiens
gccccacggagacagaggaa

SEQ ID NO: 2326676 - DNA, 20 bp, Homo sapiens
gccccactcccttgctggcc

SEQ ID NO: 2326677 - DNA, 22 bp, Homo sapiens
gccccactcccttgctggcccc

SEQ ID NO: 2326678 - DNA, 23 bp, Homo sapiens
gccccactcccttgctggcccca

SEQ ID NO: 2326679 - DNA, 20 bp, Homo sapiens
gccccactcctctgctgacc

SEQ ID NO: 2326680 - DNA, 15 bp, Homo sapiens
gccccactgccagca

SEQ ID NO: 2326681 - DNA, 17 bp, Homo sapiens
gccccactgccagcagc

SEQ ID NO: 2326682 - DNA, 23 bp, Homo sapiens
gccccactgccagcagcagcagg

SEQ ID NO: 2326683 - DNA, 13 bp, Homo sapiens
gccccactggctg

SEQ ID NO: 2326684 - DNA, 18 bp, Homo sapiens
gccccactggctggagga

SEQ ID NO: 2326685 - DNA, 16 bp, Homo sapiens
gccccagagtggccca

SEQ ID NO: 2326686 - DNA, 23 bp, Homo sapiens
gccccagcccagccccactcctc

SEQ ID NO: 2326687 - DNA, 15 bp, Homo sapiens
gccccagccctgctg

SEQ ID NO: 2326688 - DNA, 20 bp, Homo sapiens
gccccagccctgctggggat

SEQ ID NO: 2326689 - DNA, 15 bp, Homo sapiens
gccccaggccccaga

SEQ ID NO: 2326690 - DNA, 17 bp, Homo sapiens
gccccaggccccagaca

SEQ ID NO: 2326691 - DNA, 17 bp, Homo sapiens
gccccagggagtccagg

SEQ ID NO: 2326692 - DNA, 20 bp, Homo sapiens
gccccagggagtccagggtt

SEQ ID NO: 2326693 - DNA, 16 bp, Homo sapiens
gccccatcagaacctg

SEQ ID NO: 2326694 - DNA, 19 bp, Homo sapiens
gccccattccttgcgcctc

SEQ ID NO: 2326695 - DNA, 16 bp, Homo sapiens
gcccccaacctcaggg

SEQ ID NO: 2326696 - DNA, 17 bp, Homo sapiens
gcccccaccccggggac

SEQ ID NO: 2326697 - DNA, 14 bp, Homo sapiens
gcccccaccctgtt

SEQ ID NO: 2326698 - DNA, 23 bp, Homo sapiens
gcccccactccagtccactcctg

SEQ ID NO: 2326699 - DNA, 21 bp, Homo sapiens
gcccccagtccccacccctgc

SEQ ID NO: 2326700 - DNA, 19 bp, Homo sapiens
gccccccacccctggaaga

SEQ ID NO: 2326701 - DNA, 21 bp, Homo sapiens
gccccccacccctggaagagc

SEQ ID NO: 2326702 - DNA, 15 bp, Homo sapiens
gcccccctgccctgt

SEQ ID NO: 2326703 - DNA, 13 bp, Homo sapiens
gcccccgccccag

SEQ ID NO: 2326704 - DNA, 16 bp, Homo sapiens
gcccccgccccagagt

SEQ ID NO: 2326705 - DNA, 15 bp, Homo sapiens
gccccctccccccag

SEQ ID NO: 2326706 - DNA, 20 bp, Homo sapiens
gccccctccccccagactct

SEQ ID NO: 2326707 - DNA, 12 bp, Homo sapiens
gccccctcctga

SEQ ID NO: 2326708 - DNA, 13 bp, Homo sapiens
gccccgggatatt

SEQ ID NO: 2326709 - DNA, 22 bp, Homo sapiens
gccccgggatattatagaaaat

SEQ ID NO: 2326710 - DNA, 19 bp, Homo sapiens
gccccggtggctgggcaga

SEQ ID NO: 2326711 - DNA, 17 bp, Homo sapiens
gcccctaatctctgtag

SEQ ID NO: 2326712 - DNA, 14 bp, Homo sapiens
gcccctactgctgt

SEQ ID NO: 2326713 - DNA, 13 bp, Homo sapiens
gcccctcccccag

SEQ ID NO: 2326714 - DNA, 15 bp, Homo sapiens
gcccctctcaccaaa

SEQ ID NO: 2326715 - DNA, 12 bp, Homo sapiens
gcccctctccct

SEQ ID NO: 2326716 - DNA, 19 bp, Homo sapiens
gcccctggccgcgctccgg

SEQ ID NO: 2326717 - DNA, 21 bp, Homo sapiens
gcccctggccgcgctccgggc

SEQ ID NO: 2326718 - DNA, 11 bp, Homo sapiens
gcccctgggct

SEQ ID NO: 2326719 - DNA, 18 bp, Homo sapiens
gccccttcactcattttt

SEQ ID NO: 2326720 - DNA, 19 bp, Homo sapiens
gccccttccaaatgtccct

SEQ ID NO: 2326721 - DNA, 15 bp, Homo sapiens
gcccctttgcctgtc

SEQ ID NO: 2326722 - DNA, 19 bp, Homo sapiens
gcccgaaactaagccaggc

SEQ ID NO: 2326723 - DNA, 14 bp, Homo sapiens
gcccgactagcagg

SEQ ID NO: 2326724 - DNA, 12 bp, Homo sapiens
gcccgcagggcc

SEQ ID NO: 2326725 - DNA, 19 bp, Homo sapiens
gcccgcagggccatgcaga

SEQ ID NO: 2326726 - DNA, 18 bp, Homo sapiens
gccctaaccccttccaga

SEQ ID NO: 2326727 - DNA, 19 bp, Homo sapiens
gccctatgggcctgccggg

SEQ ID NO: 2326728 - DNA, 20 bp, Homo sapiens
gccctcactccctctgcaga

SEQ ID NO: 2326729 - DNA, 16 bp, Homo sapiens
gccctcagttccttca

SEQ ID NO: 2326730 - DNA, 22 bp, Homo sapiens
gccctcatgggtcctagccctt

SEQ ID NO: 2326731 - DNA, 21 bp, Homo sapiens
gccctcccctgcccctcacaa

SEQ ID NO: 2326732 - DNA, 16 bp, Homo sapiens
gccctcctttccctta

SEQ ID NO: 2326733 - DNA, 13 bp, Homo sapiens
gccctctcccacc

SEQ ID NO: 2326734 - DNA, 22 bp, Homo sapiens
gccctgaggcggaggctgtgct

SEQ ID NO: 2326735 - DNA, 15 bp, Homo sapiens
gccctgctcattcct

SEQ ID NO: 2326736 - DNA, 21 bp, Homo sapiens
gccctgctggggatccccgcc

SEQ ID NO: 2326737 - DNA, 16 bp, Homo sapiens
gccctggctgccggca

SEQ ID NO: 2326738 - DNA, 19 bp, Homo sapiens
gccctggctgctgccccca

SEQ ID NO: 2326739 - DNA, 15 bp, Homo sapiens
gccctggctgttctg

SEQ ID NO: 2326740 - DNA, 23 bp, Homo sapiens
gccctggctgttctgtggttcct

SEQ ID NO: 2326741 - DNA, 23 bp, Homo sapiens
gccctgggagaatcgctcctgca

SEQ ID NO: 2326742 - DNA, 20 bp, Homo sapiens
gccctgggctgggtgctggg

SEQ ID NO: 2326743 - DNA, 11 bp, Homo sapiens
gccctgtccaa

SEQ ID NO: 2326744 - DNA, 23 bp, Homo sapiens
gccctgtccaaaagcgccctcac

SEQ ID NO: 2326745 - DNA, 12 bp, Homo sapiens
gccctgtcccag

SEQ ID NO: 2326746 - DNA, 22 bp, Homo sapiens
gccctgtcccaggccggcccag

SEQ ID NO: 2326747 - DNA, 23 bp, Homo sapiens
gccctgtcccaggccggcccaga

SEQ ID NO: 2326748 - DNA, 20 bp, Homo sapiens
gccctgtgtgtgtcccctca

SEQ ID NO: 2326749 - DNA, 16 bp, Homo sapiens
gccctgttccctggag

SEQ ID NO: 2326750 - DNA, 21 bp, Homo sapiens
gccctgttccctggagtcagg

SEQ ID NO: 2326751 - DNA, 15 bp, Homo sapiens
gcccttccaaactct

SEQ ID NO: 2326752 - DNA, 16 bp, Homo sapiens
gcccttccctctgggc

SEQ ID NO: 2326753 - DNA, 13 bp, Homo sapiens
gcccttccctgag

SEQ ID NO: 2326754 - DNA, 23 bp, Homo sapiens
gcccttgcacagctggagaaatg

SEQ ID NO: 2326755 - DNA, 14 bp, Homo sapiens
gcccttgcctcccc

SEQ ID NO: 2326756 - DNA, 15 bp, Homo sapiens
gcccttggcttctgt

SEQ ID NO: 2326757 - DNA, 20 bp, Homo sapiens
gcccttgtcgtgggatggca

SEQ ID NO: 2326758 - DNA, 21 bp, Homo sapiens
gccgcagaggtgtaggggtgg

SEQ ID NO: 2326759 - DNA, 21 bp, Homo sapiens
gccgcggtaggtaagggccgc

SEQ ID NO: 2326760 - DNA, 20 bp, Homo sapiens
gccgcttctccccagagctg

SEQ ID NO: 2326761 - DNA, 22 bp, Homo sapiens
gccggcccagatgtgtcccccc

SEQ ID NO: 2326762 - DNA, 17 bp, Homo sapiens
gccggcggctactctgg

SEQ ID NO: 2326763 - DNA, 23 bp, Homo sapiens
gccggggccttatcgggctccag

SEQ ID NO: 2326764 - DNA, 18 bp, Homo sapiens
gccgggggctggccttct

SEQ ID NO: 2326765 - DNA, 12 bp, Homo sapiens
gccgtggatgcg

SEQ ID NO: 2326766 - DNA, 23 bp, Homo sapiens
gcctaagggatcctgcctgcccc

SEQ ID NO: 2326767 - DNA, 22 bp, Homo sapiens
gcctaattcctggcatgacact

SEQ ID NO: 2326768 - DNA, 13 bp, Homo sapiens
gcctacagccagg

SEQ ID NO: 2326769 - DNA, 18 bp, Homo sapiens
gcctagacaacctttctg

SEQ ID NO: 2326770 - DNA, 17 bp, Homo sapiens
gcctagggcagacaata

SEQ ID NO: 2326771 - DNA, 15 bp, Homo sapiens
gcctatagtaaatgt

SEQ ID NO: 2326772 - DNA, 20 bp, Homo sapiens
gcctatcagagttgctgcaa

SEQ ID NO: 2326773 - DNA, 13 bp, Homo sapiens
gcctatccgctgc

SEQ ID NO: 2326774 - DNA, 22 bp, Homo sapiens
gcctatgccaagtccctggaaa

SEQ ID NO: 2326775 - DNA, 21 bp, Homo sapiens
gcctcaagcaatccacctgcc

SEQ ID NO: 2326776 - DNA, 21 bp, Homo sapiens
gcctcaccatgtgagctcttc

SEQ ID NO: 2326777 - DNA, 20 bp, Homo sapiens
gcctcaccttggggccttga

SEQ ID NO: 2326778 - DNA, 20 bp, Homo sapiens
gcctcagacgttgcctgaga

SEQ ID NO: 2326779 - DNA, 12 bp, Homo sapiens
gcctcaggtgct

SEQ ID NO: 2326780 - DNA, 20 bp, Homo sapiens
gcctcaggtgctgtccatgg

SEQ ID NO: 2326781 - DNA, 13 bp, Homo sapiens
gcctcagtgcccc

SEQ ID NO: 2326782 - DNA, 18 bp, Homo sapiens
gcctcagttaaatctcct

SEQ ID NO: 2326783 - DNA, 19 bp, Homo sapiens
gcctcagttttccttctgt

SEQ ID NO: 2326784 - DNA, 17 bp, Homo sapiens
gcctcatactcctgggc

SEQ ID NO: 2326785 - DNA, 20 bp, Homo sapiens
gcctcatactcctgggctca

SEQ ID NO: 2326786 - DNA, 23 bp, Homo sapiens
gcctcatgggaagtcctggcaca

SEQ ID NO: 2326787 - DNA, 23 bp, Homo sapiens
gcctccaaggaggggctgtaaaa

SEQ ID NO: 2326788 - DNA, 14 bp, Homo sapiens
gcctccacagcgag

SEQ ID NO: 2326789 - DNA, 15 bp, Homo sapiens
gcctccacagcgagg

SEQ ID NO: 2326790 - DNA, 20 bp, Homo sapiens
gcctccacagcgagggcagc

SEQ ID NO: 2326791 - DNA, 23 bp, Homo sapiens
gcctccacagcgagggcagctgc

SEQ ID NO: 2326792 - DNA, 20 bp, Homo sapiens
gcctcccaggcaagcagctg

SEQ ID NO: 2326793 - DNA, 17 bp, Homo sapiens
gcctccccatctgtcca

SEQ ID NO: 2326794 - DNA, 13 bp, Homo sapiens
gcctccccatttc

SEQ ID NO: 2326795 - DNA, 20 bp, Homo sapiens
gcctccccatttcccatctg

SEQ ID NO: 2326796 - DNA, 21 bp, Homo sapiens
gcctccccatttcccatctgc

SEQ ID NO: 2326797 - DNA, 16 bp, Homo sapiens
gcctccgagagggaga

SEQ ID NO: 2326798 - DNA, 18 bp, Homo sapiens
gcctcctgtgcctggccc

SEQ ID NO: 2326799 - DNA, 18 bp, Homo sapiens
gcctccttctgagctcct

SEQ ID NO: 2326800 - DNA, 22 bp, Homo sapiens
gcctccttctgagctcctgtcc

SEQ ID NO: 2326801 - DNA, 19 bp, Homo sapiens
gcctcgctcaccgctggcc

SEQ ID NO: 2326802 - DNA, 15 bp, Homo sapiens
gcctctcagtgccct

SEQ ID NO: 2326803 - DNA, 18 bp, Homo sapiens
gcctctcatcaactgaat

SEQ ID NO: 2326804 - DNA, 22 bp, Homo sapiens
gcctctccaaccactgtgccac

SEQ ID NO: 2326805 - DNA, 16 bp, Homo sapiens
gcctctctctccctcc

SEQ ID NO: 2326806 - DNA, 15 bp, Homo sapiens
gcctctgcccgcaga

SEQ ID NO: 2326807 - DNA, 18 bp, Homo sapiens
gcctctgcccgcagagcc

SEQ ID NO: 2326808 - DNA, 18 bp, Homo sapiens
gcctctggacagccagtg

SEQ ID NO: 2326809 - DNA, 18 bp, Homo sapiens
gcctcttgtaaagactgg

SEQ ID NO: 2326810 - DNA, 17 bp, Homo sapiens
gcctgaactcctgccat

SEQ ID NO: 2326811 - DNA, 16 bp, Homo sapiens
gcctgaagccagctgc

SEQ ID NO: 2326812 - DNA, 18 bp, Homo sapiens
gcctgaatcatgagcctg

SEQ ID NO: 2326813 - DNA, 23 bp, Homo sapiens
gcctgacattcacttccagagag

SEQ ID NO: 2326814 - DNA, 18 bp, Homo sapiens
gcctgagaagaagtggct

SEQ ID NO: 2326815 - DNA, 20 bp, Homo sapiens
gcctgagaagaagtggctgc

SEQ ID NO: 2326816 - DNA, 16 bp, Homo sapiens
gcctgagaggcaggca

SEQ ID NO: 2326817 - DNA, 22 bp, Homo sapiens
gcctgagaggcaggcatagagg

SEQ ID NO: 2326818 - DNA, 13 bp, Homo sapiens
gcctgagagtatt

SEQ ID NO: 2326819 - DNA, 13 bp, Homo sapiens
gcctgagggcagt

SEQ ID NO: 2326820 - DNA, 22 bp, Homo sapiens
gcctgagtcagtgctctcagct

SEQ ID NO: 2326821 - DNA, 17 bp, Homo sapiens
gcctgcaaactgggaac

SEQ ID NO: 2326822 - DNA, 13 bp, Homo sapiens
gcctgcagcagga

SEQ ID NO: 2326823 - DNA, 20 bp, Homo sapiens
gcctgcaggagagagcagca

SEQ ID NO: 2326824 - DNA, 16 bp, Homo sapiens
gcctgcaggcagagct

SEQ ID NO: 2326825 - DNA, 19 bp, Homo sapiens
gcctgcatttcctcgcagc

SEQ ID NO: 2326826 - DNA, 21 bp, Homo sapiens
gcctgcccctaccctggactt

SEQ ID NO: 2326827 - DNA, 22 bp, Homo sapiens
gcctgcccctaccctggacttg

SEQ ID NO: 2326828 - DNA, 20 bp, Homo sapiens
gcctgccgccgtctctgtcc

SEQ ID NO: 2326829 - DNA, 13 bp, Homo sapiens
gcctgcctcccac

SEQ ID NO: 2326830 - DNA, 22 bp, Homo sapiens
gcctgctctgtgagccccacag

SEQ ID NO: 2326831 - DNA, 18 bp, Homo sapiens
gcctgctgagatgaggag

SEQ ID NO: 2326832 - DNA, 13 bp, Homo sapiens
gcctgctgcctgc

SEQ ID NO: 2326833 - DNA, 19 bp, Homo sapiens
gcctgctgcgtcagaccag

SEQ ID NO: 2326834 - DNA, 18 bp, Homo sapiens
gcctgctggaagcccagc

SEQ ID NO: 2326835 - DNA, 19 bp, Homo sapiens
gcctgctggaggcctcagg

SEQ ID NO: 2326836 - DNA, 21 bp, Homo sapiens
gcctgctttgaataaatgtgt

SEQ ID NO: 2326837 - DNA, 13 bp, Homo sapiens
gcctggagctaat

SEQ ID NO: 2326838 - DNA, 19 bp, Homo sapiens
gcctggagttgactgactg

SEQ ID NO: 2326839 - DNA, 16 bp, Homo sapiens
gcctggcacacatcag

SEQ ID NO: 2326840 - DNA, 18 bp, Homo sapiens
gcctggccaccagccatc

SEQ ID NO: 2326841 - DNA, 21 bp, Homo sapiens
gcctggccagatttttctttt

SEQ ID NO: 2326842 - DNA, 10 bp, Homo sapiens
gcctggcccc

SEQ ID NO: 2326843 - DNA, 20 bp, Homo sapiens
gcctggccccaggccccaga

SEQ ID NO: 2326844 - DNA, 20 bp, Homo sapiens
gcctgggggacagaaagaga

SEQ ID NO: 2326845 - DNA, 15 bp, Homo sapiens
gcctgtaatcccagc

SEQ ID NO: 2326846 - DNA, 15 bp, Homo sapiens
gcctgtggctgtcgg

SEQ ID NO: 2326847 - DNA, 23 bp, Homo sapiens
gcctgtggctgtcggtgggactc

SEQ ID NO: 2326848 - DNA, 19 bp, Homo sapiens
gcctgttgctgaagtcatt

SEQ ID NO: 2326849 - DNA, 14 bp, Homo sapiens
gccttaatttcctt

SEQ ID NO: 2326850 - DNA, 16 bp, Homo sapiens
gccttacatcttttct

SEQ ID NO: 2326851 - DNA, 19 bp, Homo sapiens
gccttatcgggctccagcc

SEQ ID NO: 2326852 - DNA, 19 bp, Homo sapiens
gccttccagggatttgcct

SEQ ID NO: 2326853 - DNA, 23 bp, Homo sapiens
gccttccagggatttgcctcacc

SEQ ID NO: 2326854 - DNA, 14 bp, Homo sapiens
gccttctggccttg

SEQ ID NO: 2326855 - DNA, 15 bp, Homo sapiens
gccttgagccctggc

SEQ ID NO: 2326856 - DNA, 14 bp, Homo sapiens
gacataaaggaaaa

SEQ ID NO: 2326857 - DNA, 17 bp, Homo sapiens
gacataaaggaaaagac

SEQ ID NO: 2326858 - DNA, 15 bp, Homo sapiens
gacataataaagtat

SEQ ID NO: 2326859 - DNA, 22 bp, Homo sapiens
gacatacagctgcctacctaat

SEQ ID NO: 2326860 - DNA, 21 bp, Homo sapiens
gacatgatttagggaagcagg

SEQ ID NO: 2326861 - DNA, 23 bp, Homo sapiens
gacatgatttagggaagcaggga

SEQ ID NO: 2326862 - DNA, 15 bp, Homo sapiens
gacatgcaataaaat

SEQ ID NO: 2326863 - DNA, 14 bp, Homo sapiens
gacatggaaatgaa

SEQ ID NO: 2326864 - DNA, 14 bp, Homo sapiens
gacatggtgcctga

SEQ ID NO: 2326865 - DNA, 20 bp, Homo sapiens
gacatggtgcctgagaggca

SEQ ID NO: 2326866 - DNA, 21 bp, Homo sapiens
gacatggtgcctgagaggcag

SEQ ID NO: 2326867 - DNA, 23 bp, Homo sapiens
gacatggtgcctgagaggcaggc

SEQ ID NO: 2326868 - DNA, 15 bp, Homo sapiens
gacatgtgaaacctt

SEQ ID NO: 2326869 - DNA, 21 bp, Homo sapiens
gacattaaatgcaataatttt

SEQ ID NO: 2326870 - DNA, 13 bp, Homo sapiens
gacattcacttcc

SEQ ID NO: 2326871 - DNA, 23 bp, Homo sapiens
gacattcttagctgtaacttaac

SEQ ID NO: 2326872 - DNA, 16 bp, Homo sapiens
gacatttggagagggg

SEQ ID NO: 2326873 - DNA, 20 bp, Homo sapiens
gacattttaaaaaatggtca

SEQ ID NO: 2326874 - DNA, 14 bp, Homo sapiens
gaccaccctcactg

SEQ ID NO: 2326875 - DNA, 19 bp, Homo sapiens
gaccaccgcccctggccgc

SEQ ID NO: 2326876 - DNA, 23 bp, Homo sapiens
gaccactcctgtccctgtagctc

SEQ ID NO: 2326877 - DNA, 21 bp, Homo sapiens
gaccactcttctttaagccat

SEQ ID NO: 2326878 - DNA, 22 bp, Homo sapiens
gaccactgtctccacccacctt

SEQ ID NO: 2326879 - DNA, 12 bp, Homo sapiens
gaccagaagcct

SEQ ID NO: 2326880 - DNA, 21 bp, Homo sapiens
gaccagatctttctcttccct

SEQ ID NO: 2326881 - DNA, 17 bp, Homo sapiens
gaccagcaggctggcct

SEQ ID NO: 2326882 - DNA, 18 bp, Homo sapiens
gaccagggccctgggcag

SEQ ID NO: 2326883 - DNA, 15 bp, Homo sapiens
gaccagtactgggaa

SEQ ID NO: 2326884 - DNA, 19 bp, Homo sapiens
gaccatatagattttatta

SEQ ID NO: 2326885 - DNA, 12 bp, Homo sapiens
gaccatgccaga

SEQ ID NO: 2326886 - DNA, 21 bp, Homo sapiens
gaccatgccagattctgcctc

SEQ ID NO: 2326887 - DNA, 14 bp, Homo sapiens
gaccatgtggccac

SEQ ID NO: 2326888 - DNA, 19 bp, Homo sapiens
gaccattttttaatttact

SEQ ID NO: 2326889 - DNA, 18 bp, Homo sapiens
gacccccatttgtcccag

SEQ ID NO: 2326890 - DNA, 21 bp, Homo sapiens
gacccccccccaactccagga

SEQ ID NO: 2326891 - DNA, 14 bp, Homo sapiens
gacccctctcctca

SEQ ID NO: 2326892 - DNA, 17 bp, Homo sapiens
gaccctatctcccacaa

SEQ ID NO: 2326893 - DNA, 13 bp, Homo sapiens
gaccctcccatgg

SEQ ID NO: 2326894 - DNA, 18 bp, Homo sapiens
gaccctcctccactccac

SEQ ID NO: 2326895 - DNA, 19 bp, Homo sapiens
gaccctcttgcccatcctg

SEQ ID NO: 2326896 - DNA, 14 bp, Homo sapiens
gaccctgaggccct

SEQ ID NO: 2326897 - DNA, 21 bp, Homo sapiens
gaccctgaggccctgggctgg

SEQ ID NO: 2326898 - DNA, 17 bp, Homo sapiens
gaccctgggtgggctct

SEQ ID NO: 2326899 - DNA, 18 bp, Homo sapiens
gaccctgggtgggctctg

SEQ ID NO: 2326900 - DNA, 22 bp, Homo sapiens
gaccctggttattgatgtggcc

SEQ ID NO: 2326901 - DNA, 21 bp, Homo sapiens
gaccctgtgacatggtgcctg

SEQ ID NO: 2326902 - DNA, 23 bp, Homo sapiens
gaccgtgatttggaagagaggca

SEQ ID NO: 2326903 - DNA, 18 bp, Homo sapiens
gacctatcccaaatgtgg

SEQ ID NO: 2326904 - DNA, 18 bp, Homo sapiens
gacctcaatgaagcagaa

SEQ ID NO: 2326905 - DNA, 22 bp, Homo sapiens
gacctcatgcccagctctctga

SEQ ID NO: 2326906 - DNA, 23 bp, Homo sapiens
gacctcatgcccagctctctgac

SEQ ID NO: 2326907 - DNA, 20 bp, Homo sapiens
gacctccacacccgtgagaa

SEQ ID NO: 2326908 - DNA, 12 bp, Homo sapiens
gacctccaggct

SEQ ID NO: 2326909 - DNA, 14 bp, Homo sapiens
gacctgagtatttt

SEQ ID NO: 2326910 - DNA, 23 bp, Homo sapiens
gacctgatcattacatggctgtg

SEQ ID NO: 2326911 - DNA, 17 bp, Homo sapiens
gacctggcactgggagg

SEQ ID NO: 2326912 - DNA, 20 bp, Homo sapiens
gacctggcatctaattctga

SEQ ID NO: 2326913 - DNA, 20 bp, Homo sapiens
gacctggccccaggctgtca

SEQ ID NO: 2326914 - DNA, 18 bp, Homo sapiens
gacctgggaacgactgga

SEQ ID NO: 2326915 - DNA, 14 bp, Homo sapiens
gacctgtgcacacc

SEQ ID NO: 2326916 - DNA, 17 bp, Homo sapiens
gacctttgggttctttc

SEQ ID NO: 2326917 - DNA, 17 bp, Homo sapiens
gacgagttgatttcctc

SEQ ID NO: 2326918 - DNA, 14 bp, Homo sapiens
gacgcacgctcgct

SEQ ID NO: 2326919 - DNA, 21 bp, Homo sapiens
gacgcacgctcgctgccatca

SEQ ID NO: 2326920 - DNA, 15 bp, Homo sapiens
gacgccactccctgg

SEQ ID NO: 2326921 - DNA, 21 bp, Homo sapiens
gacgcttgtgacagtgcctct

SEQ ID NO: 2326922 - DNA, 21 bp, Homo sapiens
gacggaggggagtagagaagt

SEQ ID NO: 2326923 - DNA, 16 bp, Homo sapiens
gacggcaggctcactg

SEQ ID NO: 2326924 - DNA, 19 bp, Homo sapiens
gacggcaggctcactgcca

SEQ ID NO: 2326925 - DNA, 23 bp, Homo sapiens
gacggtcctttaggcagcctgcc

SEQ ID NO: 2326926 - DNA, 14 bp, Homo sapiens
gacggttgtaagca

SEQ ID NO: 2326927 - DNA, 11 bp, Homo sapiens
gacgtgctggg

SEQ ID NO: 2326928 - DNA, 13 bp, Homo sapiens
gacgttgcctgag

SEQ ID NO: 2326929 - DNA, 16 bp, Homo sapiens
gacgtttcttctttct

SEQ ID NO: 2326930 - DNA, 13 bp, Homo sapiens
gactaaagagaga

SEQ ID NO: 2326931 - DNA, 14 bp, Homo sapiens
gactaaagagagaa

SEQ ID NO: 2326932 - DNA, 17 bp, Homo sapiens
gactaaagagagaatgt

SEQ ID NO: 2326933 - DNA, 23 bp, Homo sapiens
gactaaaggatccagagagcagc

SEQ ID NO: 2326934 - DNA, 23 bp, Homo sapiens
gactaatgctttttagaaagcat

SEQ ID NO: 2326935 - DNA, 18 bp, Homo sapiens
gactatatatataaatgt

SEQ ID NO: 2326936 - DNA, 19 bp, Homo sapiens
gactatatatataaatgta

SEQ ID NO: 2326937 - DNA, 20 bp, Homo sapiens
gactatatatataaatgtat

SEQ ID NO: 2326938 - DNA, 20 bp, Homo sapiens
gactatgcgtggctggaacc

SEQ ID NO: 2326939 - DNA, 15 bp, Homo sapiens
gactattcatggcta

SEQ ID NO: 2326940 - DNA, 13 bp, Homo sapiens
gactcatgaggag

SEQ ID NO: 2326941 - DNA, 15 bp, Homo sapiens
gactcatgaggaggg

SEQ ID NO: 2326942 - DNA, 22 bp, Homo sapiens
gactccggggccccactggctg

SEQ ID NO: 2326943 - DNA, 15 bp, Homo sapiens
gactcctagctgtcc

SEQ ID NO: 2326944 - DNA, 19 bp, Homo sapiens
gactcctagctgtcctttt

SEQ ID NO: 2326945 - DNA, 20 bp, Homo sapiens
gactcctctggctttcccag

SEQ ID NO: 2326946 - DNA, 14 bp, Homo sapiens
gactctagtattta

SEQ ID NO: 2326947 - DNA, 19 bp, Homo sapiens
gactctgcacatgtcttgt

SEQ ID NO: 2326948 - DNA, 13 bp, Homo sapiens
gactctggggcgc

SEQ ID NO: 2326949 - DNA, 16 bp, Homo sapiens
gactcttcctgcaaag

SEQ ID NO: 2326950 - DNA, 19 bp, Homo sapiens
gactgaaaatattgtttta

SEQ ID NO: 2326951 - DNA, 16 bp, Homo sapiens
gactgagcaccctctg

SEQ ID NO: 2326952 - DNA, 12 bp, Homo sapiens
gactgcagtgtg

SEQ ID NO: 2326953 - DNA, 18 bp, Homo sapiens
gagccctactccctgcag

SEQ ID NO: 2326954 - DNA, 22 bp, Homo sapiens
gagccctactccctgcagatgc

SEQ ID NO: 2326955 - DNA, 22 bp, Homo sapiens
gagcccttgcctccccatttcc

SEQ ID NO: 2326956 - DNA, 21 bp, Homo sapiens
gagccgcggggaagctggctt

SEQ ID NO: 2326957 - DNA, 16 bp, Homo sapiens
gagccgggcccctggg

SEQ ID NO: 2326958 - DNA, 16 bp, Homo sapiens
gagccgtggtccctga

SEQ ID NO: 2326959 - DNA, 19 bp, Homo sapiens
gagccgtggtccctgagga

SEQ ID NO: 2326960 - DNA, 15 bp, Homo sapiens
gagcctcctgtgcct

SEQ ID NO: 2326961 - DNA, 17 bp, Homo sapiens
gagcctcctgtgcctgg

SEQ ID NO: 2326962 - DNA, 19 bp, Homo sapiens
gagcctcctgtgcctggcc

SEQ ID NO: 2326963 - DNA, 10 bp, Homo sapiens
gagcctgctg

SEQ ID NO: 2326964 - DNA, 12 bp, Homo sapiens
gagcctgctgga

SEQ ID NO: 2326965 - DNA, 13 bp, Homo sapiens
gagcctgctggca

SEQ ID NO: 2326966 - DNA, 20 bp, Homo sapiens
gagcctggccccaggcccca

SEQ ID NO: 2326967 - DNA, 18 bp, Homo sapiens
gagccttctcagaagcac

SEQ ID NO: 2326968 - DNA, 15 bp, Homo sapiens
gagcgccaggaagcc

SEQ ID NO: 2326969 - DNA, 20 bp, Homo sapiens
gagctaaactccttcctggc

SEQ ID NO: 2326970 - DNA, 16 bp, Homo sapiens
gagctagctgccactt

SEQ ID NO: 2326971 - DNA, 14 bp, Homo sapiens
gagctattttcctc

SEQ ID NO: 2326972 - DNA, 21 bp, Homo sapiens
gagctgagatcgtgctactgc

SEQ ID NO: 2326973 - DNA, 17 bp, Homo sapiens
gagctgagcagcctctg

SEQ ID NO: 2326974 - DNA, 13 bp, Homo sapiens
gagctgctctgct

SEQ ID NO: 2326975 - DNA, 16 bp, Homo sapiens
gagctggtggacccag

SEQ ID NO: 2326976 - DNA, 23 bp, Homo sapiens
gagctggtggacccagggaacag

SEQ ID NO: 2326977 - DNA, 19 bp, Homo sapiens
gatgctgggcaatgaggca

SEQ ID NO: 2326978 - DNA, 16 bp, Homo sapiens
gatgcttgggaagact

SEQ ID NO: 2326979 - DNA, 18 bp, Homo sapiens
gatggaaaagtgtccttc

SEQ ID NO: 2326980 - DNA, 23 bp, Homo sapiens
gatggaatggaaaagcaacttca

SEQ ID NO: 2326981 - DNA, 16 bp, Homo sapiens
gatggacacgagccac

SEQ ID NO: 2326982 - DNA, 15 bp, Homo sapiens
gatggacactccagg

SEQ ID NO: 2326983 - DNA, 16 bp, Homo sapiens
gatggagggtggaaat

SEQ ID NO: 2326984 - DNA, 16 bp, Homo sapiens
gatggagttcttgtgc

SEQ ID NO: 2326985 - DNA, 23 bp, Homo sapiens
gatggcatttggtctcaggcagc

SEQ ID NO: 2326986 - DNA, 14 bp, Homo sapiens
gatggccttaattt

SEQ ID NO: 2326987 - DNA, 14 bp, Homo sapiens
gatggctgtggcat

SEQ ID NO: 2326988 - DNA, 21 bp, Homo sapiens
gatggctgtggcatttccaaa

SEQ ID NO: 2326989 - DNA, 22 bp, Homo sapiens
gatggctgtggcatttccaaac

SEQ ID NO: 2326990 - DNA, 15 bp, Homo sapiens
gatggcttgtctata

SEQ ID NO: 2326991 - DNA, 16 bp, Homo sapiens
gatgggggcagggctg

SEQ ID NO: 2326992 - DNA, 15 bp, Homo sapiens
gatgggtcagagcta

SEQ ID NO: 2326993 - DNA, 17 bp, Homo sapiens
gatggtgtgggtgtcct

SEQ ID NO: 2326994 - DNA, 18 bp, Homo sapiens
gatggttcttcacctcct

SEQ ID NO: 2326995 - DNA, 12 bp, Homo sapiens
gatgtcagcctt

SEQ ID NO: 2326996 - DNA, 16 bp, Homo sapiens
gatgtctttttattaa

SEQ ID NO: 2326997 - DNA, 18 bp, Homo sapiens
gatgtgaattattgacac

SEQ ID NO: 2326998 - DNA, 14 bp, Homo sapiens
gatgtgagccttgt

SEQ ID NO: 2326999 - DNA, 21 bp, Homo sapiens
gatgtgcggagcgggaggcgg

SEQ ID NO: 2327000 - DNA, 21 bp, Homo sapiens
gatgtggaggaagagccacct

SEQ ID NO: 2327001 - DNA, 21 bp, Homo sapiens
gatgtggctactgacatatct

SEQ ID NO: 2327002 - DNA, 14 bp, Homo sapiens
gatgtgttcttatt

SEQ ID NO: 2327003 - DNA, 14 bp, Homo sapiens
gatgttatgaacag

SEQ ID NO: 2327004 - DNA, 17 bp, Homo sapiens
gatgttatgaacagctg

SEQ ID NO: 2327005 - DNA, 18 bp, Homo sapiens
gatgttatgaacagctgt

SEQ ID NO: 2327006 - DNA, 19 bp, Homo sapiens
gatgttatgaacagctgtg

SEQ ID NO: 2327007 - DNA, 16 bp, Homo sapiens
gatgtttacatggcgc

SEQ ID NO: 2327008 - DNA, 23 bp, Homo sapiens
gatgtttacatggcgccctgcct

SEQ ID NO: 2327009 - DNA, 19 bp, Homo sapiens
gatgtttcattttactgta

SEQ ID NO: 2327010 - DNA, 22 bp, Homo sapiens
gatgtttggaaaaaactctgaa

SEQ ID NO: 2327011 - DNA, 22 bp, Homo sapiens
gattaaaaggtatactttagta

SEQ ID NO: 2327012 - DNA, 18 bp, Homo sapiens
gattaaattatcattgtt

SEQ ID NO: 2327013 - DNA, 15 bp, Homo sapiens
gattaagggacattt

SEQ ID NO: 2327014 - DNA, 14 bp, Homo sapiens
gattaataaaatat

SEQ ID NO: 2327015 - DNA, 20 bp, Homo sapiens
gattaataagatttttcaaa

SEQ ID NO: 2327016 - DNA, 17 bp, Homo sapiens
gattatatgaagtttaa

SEQ ID NO: 2327017 - DNA, 23 bp, Homo sapiens
gattatcagtatcacgatttgca

SEQ ID NO: 2327018 - DNA, 13 bp, Homo sapiens
gattatcttcagc

SEQ ID NO: 2327019 - DNA, 16 bp, Homo sapiens
gattatgtaagcattt

SEQ ID NO: 2327020 - DNA, 17 bp, Homo sapiens
gattatttaagactaaa

SEQ ID NO: 2327021 - DNA, 22 bp, Homo sapiens
gattattttttaaaaaggtaaa

SEQ ID NO: 2327022 - DNA, 14 bp, Homo sapiens
gattcaatctgtaa

SEQ ID NO: 2327023 - DNA, 16 bp, Homo sapiens
gattcaatctgtaaac

SEQ ID NO: 2327024 - DNA, 18 bp, Homo sapiens
gattcaatctgtaaactg

SEQ ID NO: 2327025 - DNA, 20 bp, Homo sapiens
gattcaatctgtaaactgtg

SEQ ID NO: 2327026 - DNA, 21 bp, Homo sapiens
gattcaatctgtaaactgtgt

SEQ ID NO: 2327027 - DNA, 20 bp, Homo sapiens
gattccactacacctggctg

SEQ ID NO: 2327028 - DNA, 21 bp, Homo sapiens
gattccactacacctggctga

SEQ ID NO: 2327029 - DNA, 14 bp, Homo sapiens
gattcccctgtgtc

SEQ ID NO: 2327030 - DNA, 12 bp, Homo sapiens
gattcctggctc

SEQ ID NO: 2327031 - DNA, 13 bp, Homo sapiens
gattctaaataca

SEQ ID NO: 2327032 - DNA, 13 bp, Homo sapiens
gattctgcctctc

SEQ ID NO: 2327033 - DNA, 15 bp, Homo sapiens
gattctgcctctctg

SEQ ID NO: 2327034 - DNA, 16 bp, Homo sapiens
gattctggctttaagc

SEQ ID NO: 2327035 - DNA, 18 bp, Homo sapiens
gattcttgattcctggct

SEQ ID NO: 2327036 - DNA, 23 bp, Homo sapiens
gattgactaactcaaatacacat

SEQ ID NO: 2327037 - DNA, 13 bp, Homo sapiens
gattgcctctgaa

SEQ ID NO: 2327038 - DNA, 14 bp, Homo sapiens
gattgcctctgaaa

SEQ ID NO: 2327039 - DNA, 22 bp, Homo sapiens
gattgggaggtgcgtgttcagc

SEQ ID NO: 2327040 - DNA, 18 bp, Homo sapiens
gattgtaaaaaaaaatgc

SEQ ID NO: 2327041 - DNA, 22 bp, Homo sapiens
gattgtaaaaaaaaatgccttt

SEQ ID NO: 2327042 - DNA, 22 bp, Homo sapiens
gatttaagggatggaaaaggaa

SEQ ID NO: 2327043 - DNA, 19 bp, Homo sapiens
gatttaagtgaatacatta

SEQ ID NO: 2327044 - DNA, 13 bp, Homo sapiens
gatttcatatcta

SEQ ID NO: 2327045 - DNA, 23 bp, Homo sapiens
gatttccctgcagacctcaagcc

SEQ ID NO: 2327046 - DNA, 15 bp, Homo sapiens
gatttccttgtgcaa

SEQ ID NO: 2327047 - DNA, 22 bp, Homo sapiens
gatttctaacagtccttgcttt

SEQ ID NO: 2327048 - DNA, 10 bp, Homo sapiens
gatttctaat

SEQ ID NO: 2327049 - DNA, 20 bp, Homo sapiens
gatttctttaaaagaatgac

SEQ ID NO: 2327050 - DNA, 15 bp, Homo sapiens
gatttgaaaaatata

SEQ ID NO: 2327051 - DNA, 19 bp, Homo sapiens
gatttgcaggattcccttc

SEQ ID NO: 2327052 - DNA, 22 bp, Homo sapiens
gatttgcaggattcccttctgg

SEQ ID NO: 2327053 - DNA, 12 bp, Homo sapiens
gatttgcctcac

SEQ ID NO: 2327054 - DNA, 13 bp, Homo sapiens
gatttggaagaga

SEQ ID NO: 2327055 - DNA, 21 bp, Homo sapiens
gatttggaagagaggcacctg

SEQ ID NO: 2327056 - DNA, 23 bp, Homo sapiens
gatttggaagagaggcacctgct

SEQ ID NO: 2327057 - DNA, 19 bp, Homo sapiens
gatttggcactagccaaag

SEQ ID NO: 2327058 - DNA, 21 bp, Homo sapiens
gatttgttgttctttcagaaa

SEQ ID NO: 2327059 - DNA, 19 bp, Homo sapiens
gattttcaagattctaaag

SEQ ID NO: 2327060 - DNA, 21 bp, Homo sapiens
gattttcaagattctaaagct

SEQ ID NO: 2327061 - DNA, 13 bp, Homo sapiens
gatttttaaatta

SEQ ID NO: 2327062 - DNA, 13 bp, Homo sapiens
gatttttctcaaa

SEQ ID NO: 2327063 - DNA, 18 bp, Homo sapiens
gcaaaaaaaaaaaaaagc

SEQ ID NO: 2327064 - DNA, 19 bp, Homo sapiens
gcaaaactcactaagttta

SEQ ID NO: 2327065 - DNA, 16 bp, Homo sapiens
gcaaaaggcctcttgt

SEQ ID NO: 2327066 - DNA, 16 bp, Homo sapiens
gcaaaatacattattc

SEQ ID NO: 2327067 - DNA, 10 bp, Homo sapiens
gcaaaatatg

SEQ ID NO: 2327068 - DNA, 13 bp, Homo sapiens
gcaaaatatgttt

SEQ ID NO: 2327069 - DNA, 17 bp, Homo sapiens
gcaaacccagaggtgga

SEQ ID NO: 2327070 - DNA, 22 bp, Homo sapiens
gcaaaccctcccagaaacatct

SEQ ID NO: 2327071 - DNA, 21 bp, Homo sapiens
gcaaacctgacccctgctcag

SEQ ID NO: 2327072 - DNA, 21 bp, Homo sapiens
gcaaactgaagctgcacagtg

SEQ ID NO: 2327073 - DNA, 17 bp, Homo sapiens
gcaaactgggaacccct

SEQ ID NO: 2327074 - DNA, 23 bp, Homo sapiens
gcaaactgggaacccctttccca

SEQ ID NO: 2327075 - DNA, 19 bp, Homo sapiens
gcaaagagacatttcaaaa

SEQ ID NO: 2327076 - DNA, 20 bp, Homo sapiens
gcaaataaatacgtgtcaaa

SEQ ID NO: 2327077 - DNA, 16 bp, Homo sapiens
gcaaatgagctctgaa

SEQ ID NO: 2327078 - DNA, 18 bp, Homo sapiens
gcaacagcctttgaatgt

SEQ ID NO: 2327079 - DNA, 22 bp, Homo sapiens
gcaacatttgtatggatttaag

SEQ ID NO: 2327080 - DNA, 22 bp, Homo sapiens
gcaacccagtcacactgtggcc

SEQ ID NO: 2327081 - DNA, 17 bp, Homo sapiens
gcaactctccactccat

SEQ ID NO: 2327082 - DNA, 23 bp, Homo sapiens
gcaagaaatggcgtctgctctgg

SEQ ID NO: 2327083 - DNA, 21 bp, Homo sapiens
gcaagaacccaagtgcctcac

SEQ ID NO: 2327084 - DNA, 17 bp, Homo sapiens
gcaagcagctggtcagt

SEQ ID NO: 2327085 - DNA, 13 bp, Homo sapiens
gcaagccacagga

SEQ ID NO: 2327086 - DNA, 22 bp, Homo sapiens
gcaagccagacctagcaggctg

SEQ ID NO: 2327087 - DNA, 14 bp, Homo sapiens
gcaagcttcttgct

SEQ ID NO: 2327088 - DNA, 17 bp, Homo sapiens
gcaaggagtgtaaaatg

SEQ ID NO: 2327089 - DNA, 22 bp, Homo sapiens
gcaaggtggcctttgtgctgcg

SEQ ID NO: 2327090 - DNA, 20 bp, Homo sapiens
gcaagtacagcggctcccct

SEQ ID NO: 2327091 - DNA, 15 bp, Homo sapiens
gcaataaaatttaaa

SEQ ID NO: 2327092 - DNA, 19 bp, Homo sapiens
gcaataaaatttaaaaaat

SEQ ID NO: 2327093 - DNA, 20 bp, Homo sapiens
gcaataatatgtgagaggac

SEQ ID NO: 2327094 - DNA, 21 bp, Homo sapiens
gcaatattctgtaactattgg

SEQ ID NO: 2327095 - DNA, 19 bp, Homo sapiens
gcaatcaaggttataattt

SEQ ID NO: 2327096 - DNA, 14 bp, Homo sapiens
gcaatcctcctgcc

SEQ ID NO: 2327097 - DNA, 18 bp, Homo sapiens
gcaattctctttctttta

SEQ ID NO: 2327098 - DNA, 12 bp, Homo sapiens
gcacaatttgca

SEQ ID NO: 2327099 - DNA, 19 bp, Homo sapiens
gcacaatttgcactaaatc

SEQ ID NO: 2327100 - DNA, 12 bp, Homo sapiens
gcacacaggaca

SEQ ID NO: 2327101 - DNA, 17 bp, Homo sapiens
gcacacaggacagcggg

SEQ ID NO: 2327102 - DNA, 14 bp, Homo sapiens
gcacagaatatttt

SEQ ID NO: 2327103 - DNA, 19 bp, Homo sapiens
gcacagagcctggccccag

SEQ ID NO: 2327104 - DNA, 20 bp, Homo sapiens
gcacagctcaggaggcgccc

SEQ ID NO: 2327105 - DNA, 18 bp, Homo sapiens
gcacagctggagaaatgg

SEQ ID NO: 2327106 - DNA, 22 bp, Homo sapiens
gcacagggagtgcacatatcca

SEQ ID NO: 2327107 - DNA, 16 bp, Homo sapiens
gcacagtatttaacat

SEQ ID NO: 2327108 - DNA, 17 bp, Homo sapiens
gcacagtttttgtaaag

SEQ ID NO: 2327109 - DNA, 18 bp, Homo sapiens
gcacatatggactctgca

SEQ ID NO: 2327110 - DNA, 14 bp, Homo sapiens
gcacatgggattgc

SEQ ID NO: 2327111 - DNA, 20 bp, Homo sapiens
gcacccaccgtggaggagga

SEQ ID NO: 2327112 - DNA, 23 bp, Homo sapiens
gcacccacctgttttctgaaaca

SEQ ID NO: 2327113 - DNA, 22 bp, Homo sapiens
gcaccccttctctcctccccaa

SEQ ID NO: 2327114 - DNA, 12 bp, Homo sapiens
gcaccctcaggg

SEQ ID NO: 2327115 - DNA, 14 bp, Homo sapiens
gcacctcaggctga

SEQ ID NO: 2327116 - DNA, 15 bp, Homo sapiens
gcacctgtagtccca

SEQ ID NO: 2327117 - DNA, 17 bp, Homo sapiens
gcacctgtagtcccagc

SEQ ID NO: 2327118 - DNA, 15 bp, Homo sapiens
gcaccttcagggctg

SEQ ID NO: 2327119 - DNA, 14 bp, Homo sapiens
gcaccttgtgtctg

SEQ ID NO: 2327120 - DNA, 20 bp, Homo sapiens
gcaccttgtgtctgtacacg

SEQ ID NO: 2327121 - DNA, 15 bp, Homo sapiens
gcacgctcgctgcca

SEQ ID NO: 2327122 - DNA, 15 bp, Homo sapiens
gcacggggcattcct

SEQ ID NO: 2327123 - DNA, 15 bp, Homo sapiens
gcacgggtggtcccc

SEQ ID NO: 2327124 - DNA, 16 bp, Homo sapiens
gcacgggtggtccccg

SEQ ID NO: 2327125 - DNA, 20 bp, Homo sapiens
gcactagcattttcttgaac

SEQ ID NO: 2327126 - DNA, 20 bp, Homo sapiens
gcactcagtgagcctcctgt

SEQ ID NO: 2327127 - DNA, 22 bp, Homo sapiens
gcactcagtgagcctcctgtgc

SEQ ID NO: 2327128 - DNA, 21 bp, Homo sapiens
gcactccgcgccgatgccacc

SEQ ID NO: 2327129 - DNA, 22 bp, Homo sapiens
gcactccgcgccgatgccaccg

SEQ ID NO: 2327130 - DNA, 22 bp, Homo sapiens
gcactgcccacatgggacctgg

SEQ ID NO: 2327131 - DNA, 15 bp, Homo sapiens
gcactggactccggg

SEQ ID NO: 2327132 - DNA, 14 bp, Homo sapiens
gcactgggaggcag

SEQ ID NO: 2327133 - DNA, 19 bp, Homo sapiens
gcactgggaggcagggctc

SEQ ID NO: 2327134 - DNA, 22 bp, Homo sapiens
gcactgtgaacctgggcactcc

SEQ ID NO: 2327135 - DNA, 17 bp, Homo sapiens
gcacttattgaatatat

SEQ ID NO: 2327136 - DNA, 17 bp, Homo sapiens
gcacttgttatattata

SEQ ID NO: 2327137 - DNA, 14 bp, Homo sapiens
gcacttttagaaat

SEQ ID NO: 2327138 - DNA, 19 bp, Homo sapiens
gcagaacctgcacacagga

SEQ ID NO: 2327139 - DNA, 19 bp, Homo sapiens
gcagaactaccaggtggca

SEQ ID NO: 2327140 - DNA, 14 bp, Homo sapiens
gcagaagacaccag

SEQ ID NO: 2327141 - DNA, 22 bp, Homo sapiens
gcagacaatagtatagaagtct

SEQ ID NO: 2327142 - DNA, 13 bp, Homo sapiens
gcagacctcatgc

SEQ ID NO: 2327143 - DNA, 14 bp, Homo sapiens
gcagacctcatgcc

SEQ ID NO: 2327144 - DNA, 23 bp, Homo sapiens
gcagagccttctcagaagcacag

SEQ ID NO: 2327145 - DNA, 14 bp, Homo sapiens
gcagaggacgcacg

SEQ ID NO: 2327146 - DNA, 14 bp, Homo sapiens
gcagaggcaggctg

SEQ ID NO: 2327147 - DNA, 16 bp, Homo sapiens
gcagaggcaggctggg

SEQ ID NO: 2327148 - DNA, 21 bp, Homo sapiens
gcagaggcaggctgggacgga

SEQ ID NO: 2327149 - DNA, 21 bp, Homo sapiens
gcagagggagaatccaagggt

SEQ ID NO: 2327150 - DNA, 16 bp, Homo sapiens
gcagaggttttaatgt

SEQ ID NO: 2327151 - DNA, 22 bp, Homo sapiens
gcagaggttttaatgtctgttt

SEQ ID NO: 2327152 - DNA, 23 bp, Homo sapiens
gcagaggttttaatgtctgttta

SEQ ID NO: 2327153 - DNA, 21 bp, Homo sapiens
gcagagttaaatctcaaatag

SEQ ID NO: 2327154 - DNA, 12 bp, Homo sapiens
gcagagttttca

SEQ ID NO: 2327155 - DNA, 16 bp, Homo sapiens
gcagatcttggactca

SEQ ID NO: 2327156 - DNA, 16 bp, Homo sapiens
gcagatgccaccctag

SEQ ID NO: 2327157 - DNA, 17 bp, Homo sapiens
gcagatgccaccctagc

SEQ ID NO: 2327158 - DNA, 18 bp, Homo sapiens
gcagatgccaccctagcc

SEQ ID NO: 2327159 - DNA, 20 bp, Homo sapiens
gcagatgtcttccctgggct

SEQ ID NO: 2327160 - DNA, 21 bp, Homo sapiens
gcagatgtcttccctgggctg

SEQ ID NO: 2327161 - DNA, 22 bp, Homo sapiens
gcagatgtcttccctgggctgc

SEQ ID NO: 2327162 - DNA, 21 bp, Homo sapiens
gcagattttcagcaaactctt

SEQ ID NO: 2327163 - DNA, 14 bp, Homo sapiens
gcagcaccacactg

SEQ ID NO: 2327164 - DNA, 13 bp, Homo sapiens
gcagcagcccaag

SEQ ID NO: 2327165 - DNA, 16 bp, Homo sapiens
gcagcagcttggggag

SEQ ID NO: 2327166 - DNA, 21 bp, Homo sapiens
gcagcaggaatatatgtgtgc

SEQ ID NO: 2327167 - DNA, 21 bp, Homo sapiens
gcagcaggtgattggaccagg

SEQ ID NO: 2327168 - DNA, 14 bp, Homo sapiens
gcagcatcttctgg

SEQ ID NO: 2327169 - DNA, 19 bp, Homo sapiens
gcagccagaccagcaggct

SEQ ID NO: 2327170 - DNA, 13 bp, Homo sapiens
gcagccagttcaa

SEQ ID NO: 2327171 - DNA, 15 bp, Homo sapiens
gcagcccaagcttcc

SEQ ID NO: 2327172 - DNA, 17 bp, Homo sapiens
gcagcccaagcttccct

SEQ ID NO: 2327173 - DNA, 18 bp, Homo sapiens
gcagcccaccagacgtca

SEQ ID NO: 2327174 - DNA, 13 bp, Homo sapiens
gcagcccagagac

SEQ ID NO: 2327175 - DNA, 14 bp, Homo sapiens
gcagcccagagact

SEQ ID NO: 2327176 - DNA, 22 bp, Homo sapiens
gcagcctcatactcctgggctc

SEQ ID NO: 2327177 - DNA, 14 bp, Homo sapiens
gcagcctcctttgt

SEQ ID NO: 2327178 - DNA, 17 bp, Homo sapiens
gcagcctcctttgtgtg

SEQ ID NO: 2327179 - DNA, 20 bp, Homo sapiens
gcagcctctggacagccagt

SEQ ID NO: 2327180 - DNA, 15 bp, Homo sapiens
gcagctggctctcca

SEQ ID NO: 2327181 - DNA, 18 bp, Homo sapiens
gcagctggctctccacct

SEQ ID NO: 2327182 - DNA, 18 bp, Homo sapiens
gcagctgtagctcccgag

SEQ ID NO: 2327183 - DNA, 19 bp, Homo sapiens
gcagcttataatgggctct

SEQ ID NO: 2327184 - DNA, 21 bp, Homo sapiens
gcagcttcaacttttctcttt

SEQ ID NO: 2327185 - DNA, 15 bp, Homo sapiens
gcaggaagggaagcg

SEQ ID NO: 2327186 - DNA, 21 bp, Homo sapiens
gcaggaatatatgtgtgccta

SEQ ID NO: 2327187 - DNA, 22 bp, Homo sapiens
gcaggaggcccttgtcgtggga

SEQ ID NO: 2327188 - DNA, 15 bp, Homo sapiens
gcaggaggtggagaa

SEQ ID NO: 2327189 - DNA, 16 bp, Homo sapiens
gcaggattcccttctg

SEQ ID NO: 2327190 - DNA, 22 bp, Homo sapiens
gcaggcaggaacaaacagggct

SEQ ID NO: 2327191 - DNA, 14 bp, Homo sapiens
gcaggctcactgcc

SEQ ID NO: 2327192 - DNA, 18 bp, Homo sapiens
gcaggctcactgccaggc

SEQ ID NO: 2327193 - DNA, 23 bp, Homo sapiens
gcaggctcactgccaggccagcc

SEQ ID NO: 2327194 - DNA, 14 bp, Homo sapiens
gcaggctgggccat

SEQ ID NO: 2327195 - DNA, 15 bp, Homo sapiens
gcaggcttggggaaa

SEQ ID NO: 2327196 - DNA, 23 bp, Homo sapiens
gcaggctttgccattgtgaacca

SEQ ID NO: 2327197 - DNA, 14 bp, Homo sapiens
gcagggacaccccc

SEQ ID NO: 2327198 - DNA, 15 bp, Homo sapiens
gcagggacacccccc

SEQ ID NO: 2327199 - DNA, 22 bp, Homo sapiens
gcagggacaccccccgcccccc

SEQ ID NO: 2327200 - DNA, 16 bp, Homo sapiens
gcagggccatgcagac

SEQ ID NO: 2327201 - DNA, 18 bp, Homo sapiens
gcagggccatgcagacct

SEQ ID NO: 2327202 - DNA, 13 bp, Homo sapiens
gcagggctgtgct

SEQ ID NO: 2327203 - DNA, 16 bp, Homo sapiens
gcagggtctgggctgg

SEQ ID NO: 2327204 - DNA, 22 bp, Homo sapiens
gcagggtgggcttgtggggcct

SEQ ID NO: 2327205 - DNA, 19 bp, Homo sapiens
gcaggtgggggtgggctgc

SEQ ID NO: 2327206 - DNA, 13 bp, Homo sapiens
gcagtaataaaaa

SEQ ID NO: 2327207 - DNA, 17 bp, Homo sapiens
gcagtattttgtgtcct

SEQ ID NO: 2327208 - DNA, 18 bp, Homo sapiens
gcagtcacaacagagtga

SEQ ID NO: 2327209 - DNA, 14 bp, Homo sapiens
gcagtcactggagg

SEQ ID NO: 2327210 - DNA, 13 bp, Homo sapiens
gcagtcagagtcc

SEQ ID NO: 2327211 - DNA, 20 bp, Homo sapiens
gcagtcctggaagccagctt

SEQ ID NO: 2327212 - DNA, 18 bp, Homo sapiens
gcagtgatgacttgctgt

SEQ ID NO: 2327213 - DNA, 16 bp, Homo sapiens
gcagtgccccagggag

SEQ ID NO: 2327214 - DNA, 22 bp, Homo sapiens
gcagtgtgaatagcctggccac

SEQ ID NO: 2327215 - DNA, 14 bp, Homo sapiens
gcagtgtgcccccc

SEQ ID NO: 2327216 - DNA, 22 bp, Homo sapiens
gcagtgtgccccccagccccgg

SEQ ID NO: 2327217 - DNA, 12 bp, Homo sapiens
gcagtgtggaga

SEQ ID NO: 2327218 - DNA, 23 bp, Homo sapiens
gcagtgtggagaccctgccacag

SEQ ID NO: 2327219 - DNA, 22 bp, Homo sapiens
gcagtgttttgcaagtgctgga

SEQ ID NO: 2327220 - DNA, 17 bp, Homo sapiens
gcagttagctgaagaat

SEQ ID NO: 2327221 - DNA, 22 bp, Homo sapiens
gcagttagctgaagaattgaaa

SEQ ID NO: 2327222 - DNA, 20 bp, Homo sapiens
gcagttctactcaggctggt

SEQ ID NO: 2327223 - DNA, 17 bp, Homo sapiens
gcagtttcttttcacat

SEQ ID NO: 2327224 - DNA, 13 bp, Homo sapiens
gcataaactaaaa

SEQ ID NO: 2327225 - DNA, 19 bp, Homo sapiens
gcataaagctcaaatgaaa

SEQ ID NO: 2327226 - DNA, 13 bp, Homo sapiens
gcataaagtaaat

SEQ ID NO: 2327227 - DNA, 13 bp, Homo sapiens
gcataaatatgca

SEQ ID NO: 2327228 - DNA, 20 bp, Homo sapiens
gcataatgataaaataaata

SEQ ID NO: 2327229 - DNA, 18 bp, Homo sapiens
gcatacccaaaccaggtg

SEQ ID NO: 2327230 - DNA, 13 bp, Homo sapiens
gcatactttttaa

SEQ ID NO: 2327231 - DNA, 16 bp, Homo sapiens
gcatagaggcttctcc

SEQ ID NO: 2327232 - DNA, 22 bp, Homo sapiens
gcatagaggcttctccgccagc

SEQ ID NO: 2327233 - DNA, 19 bp, Homo sapiens
gcatagataatattgtttg

SEQ ID NO: 2327234 - DNA, 17 bp, Homo sapiens
gcatagtttctttattt

SEQ ID NO: 2327235 - DNA, 17 bp, Homo sapiens
gcatataatgaataaat

SEQ ID NO: 2327236 - DNA, 23 bp, Homo sapiens
gcatattataaaggataaagaag

SEQ ID NO: 2327237 - DNA, 16 bp, Homo sapiens
gcatcacctcaccaag

SEQ ID NO: 2327238 - DNA, 15 bp, Homo sapiens
gcatcccccctgctc

SEQ ID NO: 2327239 - DNA, 17 bp, Homo sapiens
gcatcccccctgctcag

SEQ ID NO: 2327240 - DNA, 13 bp, Homo sapiens
gcatccctgagac

SEQ ID NO: 2327241 - DNA, 13 bp, Homo sapiens
gcatcccttccca

SEQ ID NO: 2327242 - DNA, 23 bp, Homo sapiens
gcatcccttcccacatgcctgcg

SEQ ID NO: 2327243 - DNA, 12 bp, Homo sapiens
ctgctgtctggg

SEQ ID NO: 2327244 - DNA, 16 bp, Homo sapiens
ctgctgtctgggtgct

SEQ ID NO: 2327245 - DNA, 17 bp, Homo sapiens
ctgctgtgaaccctggg

SEQ ID NO: 2327246 - DNA, 23 bp, Homo sapiens
ctgctgtgaaccctggggcctga

SEQ ID NO: 2327247 - DNA, 16 bp, Homo sapiens
ctgctgtgattccact

SEQ ID NO: 2327248 - DNA, 15 bp, Homo sapiens
ctgcttacttggtga

SEQ ID NO: 2327249 - DNA, 15 bp, Homo sapiens
ctgcttcccttactt

SEQ ID NO: 2327250 - DNA, 14 bp, Homo sapiens
ctgcttttctgccc

SEQ ID NO: 2327251 - DNA, 15 bp, Homo sapiens
ctgcttttctgccct

SEQ ID NO: 2327252 - DNA, 17 bp, Homo sapiens
ctgcttttctgccctgg

SEQ ID NO: 2327253 - DNA, 18 bp, Homo sapiens
ctgcttttctgccctggc

SEQ ID NO: 2327254 - DNA, 22 bp, Homo sapiens
ctgcttttctgccctggctgct

SEQ ID NO: 2327255 - DNA, 13 bp, Homo sapiens
ctgcttttcttaa

SEQ ID NO: 2327256 - DNA, 14 bp, Homo sapiens
ctgcttttcttaag

SEQ ID NO: 2327257 - DNA, 16 bp, Homo sapiens
ctgctttttggaaagt

SEQ ID NO: 2327258 - DNA, 13 bp, Homo sapiens
ctggaaaggggag

SEQ ID NO: 2327259 - DNA, 21 bp, Homo sapiens
ctggaaaggggagagcctgct

SEQ ID NO: 2327260 - DNA, 22 bp, Homo sapiens
ctggaaaggggagagcctgctg

SEQ ID NO: 2327261 - DNA, 15 bp, Homo sapiens
ctggaagagcccagt

SEQ ID NO: 2327262 - DNA, 14 bp, Homo sapiens
ctggaagcccagcc

SEQ ID NO: 2327263 - DNA, 17 bp, Homo sapiens
ctggaagcccagcccct

SEQ ID NO: 2327264 - DNA, 14 bp, Homo sapiens
ctggaataagttca

SEQ ID NO: 2327265 - DNA, 23 bp, Homo sapiens
ctggacacattggaatgccttgg

SEQ ID NO: 2327266 - DNA, 18 bp, Homo sapiens
ctggacagcagaagcctc

SEQ ID NO: 2327267 - DNA, 20 bp, Homo sapiens
ctggacagcagaagcctcca

SEQ ID NO: 2327268 - DNA, 22 bp, Homo sapiens
ctggacagcagaagcctccaag

SEQ ID NO: 2327269 - DNA, 14 bp, Homo sapiens
ctggacagccagtg

SEQ ID NO: 2327270 - DNA, 17 bp, Homo sapiens
ctggacatgagatggag

SEQ ID NO: 2327271 - DNA, 20 bp, Homo sapiens
ctggacggcaggctcactgc

SEQ ID NO: 2327272 - DNA, 22 bp, Homo sapiens
ctggactaaaggcatccttgtc

SEQ ID NO: 2327273 - DNA, 15 bp, Homo sapiens
ctggagaagcaccag

SEQ ID NO: 2327274 - DNA, 12 bp, Homo sapiens
ctggggcctgac

SEQ ID NO: 2327275 - DNA, 16 bp, Homo sapiens
ctggggcctgactgct

SEQ ID NO: 2327276 - DNA, 12 bp, Homo sapiens
ctggggcctggg

SEQ ID NO: 2327277 - DNA, 13 bp, Homo sapiens
ctggggcctggga

SEQ ID NO: 2327278 - DNA, 16 bp, Homo sapiens
ctggggcctgggacaa

SEQ ID NO: 2327279 - DNA, 15 bp, Homo sapiens
ctgggggacctttgt

SEQ ID NO: 2327280 - DNA, 14 bp, Homo sapiens
ctgggggagagccg

SEQ ID NO: 2327281 - DNA, 14 bp, Homo sapiens
ctgggggccccagg

SEQ ID NO: 2327282 - DNA, 17 bp, Homo sapiens
ctgggtcacatccatcc

SEQ ID NO: 2327283 - DNA, 17 bp, Homo sapiens
ctgggtcagaaccagag

SEQ ID NO: 2327284 - DNA, 13 bp, Homo sapiens
ctgggtccaccct

SEQ ID NO: 2327285 - DNA, 19 bp, Homo sapiens
ctgggtgcgtctccagtca

SEQ ID NO: 2327286 - DNA, 13 bp, Homo sapiens
ctgggtgggctct

SEQ ID NO: 2327287 - DNA, 14 bp, Homo sapiens
ctgggtgggctctg

SEQ ID NO: 2327288 - DNA, 20 bp, Homo sapiens
ctgggtggttttttccccct

SEQ ID NO: 2327289 - DNA, 16 bp, Homo sapiens
ctgggttgggatcagg

SEQ ID NO: 2327290 - DNA, 15 bp, Homo sapiens
ctggtacagcagggt

SEQ ID NO: 2327291 - DNA, 17 bp, Homo sapiens
ctggtacagcagggtct

SEQ ID NO: 2327292 - DNA, 22 bp, Homo sapiens
ctggtacagcagggtcttgctg

SEQ ID NO: 2327293 - DNA, 23 bp, Homo sapiens
ctggtagaaaaaggggcctgagt

SEQ ID NO: 2327294 - DNA, 20 bp, Homo sapiens
ctggtatatccaaaagcttt

SEQ ID NO: 2327295 - DNA, 15 bp, Homo sapiens
ctggtattgtttacg

SEQ ID NO: 2327296 - DNA, 17 bp, Homo sapiens
gaaataacaatgttaag

SEQ ID NO: 2327297 - DNA, 16 bp, Homo sapiens
gaaataagagcagtca

SEQ ID NO: 2327298 - DNA, 20 bp, Homo sapiens
gaaataagtgccctctccca

SEQ ID NO: 2327299 - DNA, 14 bp, Homo sapiens
gaaataatgctaca

SEQ ID NO: 2327300 - DNA, 19 bp, Homo sapiens
gaaataatgctacaatttt

SEQ ID NO: 2327301 - DNA, 22 bp, Homo sapiens
gaaggatctgctgaggcccagt

SEQ ID NO: 2327302 - DNA, 17 bp, Homo sapiens
gaaggcaagagggggtg

SEQ ID NO: 2327303 - DNA, 14 bp, Homo sapiens
gaaggcctgagccc

SEQ ID NO: 2327304 - DNA, 15 bp, Homo sapiens
gaaggcctgagcccc

SEQ ID NO: 2327305 - DNA, 14 bp, Homo sapiens
gaaggcttctctcc

SEQ ID NO: 2327306 - DNA, 23 bp, Homo sapiens
gaaggcttctctccacagtgttg

SEQ ID NO: 2327307 - DNA, 15 bp, Homo sapiens
gaagggaagagacag

SEQ ID NO: 2327308 - DNA, 16 bp, Homo sapiens
gaagggagaagaaagg

SEQ ID NO: 2327309 - DNA, 15 bp, Homo sapiens
gaagggggtctctgt

SEQ ID NO: 2327310 - DNA, 12 bp, Homo sapiens
ctccctcctgga

SEQ ID NO: 2327311 - DNA, 13 bp, Homo sapiens
ctccctgcctgag

SEQ ID NO: 2327312 - DNA, 12 bp, Homo sapiens
ctccctgcctgg

SEQ ID NO: 2327313 - DNA, 23 bp, Homo sapiens
ctccctggaatgagttgaggcca

SEQ ID NO: 2327314 - DNA, 16 bp, Homo sapiens
ctccctggctccctcc

SEQ ID NO: 2327315 - DNA, 20 bp, Homo sapiens
ctccctgttatctgctagat

SEQ ID NO: 2327316 - DNA, 20 bp, Homo sapiens
ctcccttccttttccctgct

SEQ ID NO: 2327317 - DNA, 23 bp, Homo sapiens
ctcccttgcctttcgaggcctga

SEQ ID NO: 2327318 - DNA, 14 bp, Homo sapiens
ctccgcatcacctc

SEQ ID NO: 2327319 - DNA, 18 bp, Homo sapiens
ctccgcatcacctcacca

SEQ ID NO: 2327320 - DNA, 14 bp, Homo sapiens
ctccgccagcctcc

SEQ ID NO: 2327321 - DNA, 15 bp, Homo sapiens
ctccgccagcctcct

SEQ ID NO: 2327322 - DNA, 18 bp, Homo sapiens
ctccgccagcctcctctg

SEQ ID NO: 2327323 - DNA, 13 bp, Homo sapiens
ctccgccatccac

SEQ ID NO: 2327324 - DNA, 20 bp, Homo sapiens
ctccgcgccgatgccaccgg

SEQ ID NO: 2327325 - DNA, 14 bp, Homo sapiens
ctccggggccattt

SEQ ID NO: 2327326 - DNA, 14 bp, Homo sapiens
ctcctatccttgga

SEQ ID NO: 2327327 - DNA, 19 bp, Homo sapiens
ctcctatgatctgagtcag

SEQ ID NO: 2327328 - DNA, 16 bp, Homo sapiens
ctcctattctataaaa

SEQ ID NO: 2327329 - DNA, 20 bp, Homo sapiens
ctcctattctataaaactct

SEQ ID NO: 2327330 - DNA, 12 bp, Homo sapiens
ctcctcacctca

SEQ ID NO: 2327331 - DNA, 14 bp, Homo sapiens
ctcctcacctcatg

SEQ ID NO: 2327332 - DNA, 16 bp, Homo sapiens
ctcctcacctcatgcc

SEQ ID NO: 2327333 - DNA, 21 bp, Homo sapiens
ctcctcagtatgtgggggctt

SEQ ID NO: 2327334 - DNA, 22 bp, Homo sapiens
ctcctcagtatgtgggggcttc

SEQ ID NO: 2327335 - DNA, 14 bp, Homo sapiens
ctcctccactccac

SEQ ID NO: 2327336 - DNA, 16 bp, Homo sapiens
ctcctccactccacct

SEQ ID NO: 2327337 - DNA, 13 bp, Homo sapiens
ctcctccaggcct

SEQ ID NO: 2327338 - DNA, 18 bp, Homo sapiens
ctcctccaggcctgcctc

SEQ ID NO: 2327339 - DNA, 19 bp, Homo sapiens
ctcctcccagggcctcctg

SEQ ID NO: 2327340 - DNA, 13 bp, Homo sapiens
ctcctcccttcct

SEQ ID NO: 2327341 - DNA, 12 bp, Homo sapiens
ctcctctgccta

SEQ ID NO: 2327342 - DNA, 20 bp, Homo sapiens
ctcctctgcctacagccagg

SEQ ID NO: 2327343 - DNA, 22 bp, Homo sapiens
ctcctctgcctacagccaggtt

SEQ ID NO: 2327344 - DNA, 12 bp, Homo sapiens
ctcctctgctga

SEQ ID NO: 2327345 - DNA, 14 bp, Homo sapiens
ctcctctgctgacc

SEQ ID NO: 2327346 - DNA, 17 bp, Homo sapiens
ctcctcttctactcact

SEQ ID NO: 2327347 - DNA, 19 bp, Homo sapiens
ctcctgaaccgcacagctc

SEQ ID NO: 2327348 - DNA, 21 bp, Homo sapiens
ctcctgaaccgcacagctcag

SEQ ID NO: 2327349 - DNA, 20 bp, Homo sapiens
ctcctgacacccttctccca

SEQ ID NO: 2327350 - DNA, 22 bp, Homo sapiens
ctcctgacacccttctcccact

SEQ ID NO: 2327351 - DNA, 14 bp, Homo sapiens
ctcctgacagaagg

SEQ ID NO: 2327352 - DNA, 18 bp, Homo sapiens
ctcctgacagaaggtgcc

SEQ ID NO: 2327353 - DNA, 20 bp, Homo sapiens
ctcctgacccctctcctcaa

SEQ ID NO: 2327354 - DNA, 19 bp, Homo sapiens
ctcctgcttaatcttcaaa

SEQ ID NO: 2327355 - DNA, 13 bp, Homo sapiens
ctcctggcctatc

SEQ ID NO: 2327356 - DNA, 18 bp, Homo sapiens
ctcctggcctatccgctg

SEQ ID NO: 2327357 - DNA, 22 bp, Homo sapiens
ctcctggcctatccgctgccag

SEQ ID NO: 2327358 - DNA, 18 bp, Homo sapiens
ctcctgtcccctgctaca

SEQ ID NO: 2327359 - DNA, 15 bp, Homo sapiens
ctcttactctttcct

SEQ ID NO: 2327360 - DNA, 18 bp, Homo sapiens
ctcttactctttcctatt

SEQ ID NO: 2327361 - DNA, 15 bp, Homo sapiens
ctcttatctcagtca

SEQ ID NO: 2327362 - DNA, 16 bp, Homo sapiens
ctcttcatctgcctgc

SEQ ID NO: 2327363 - DNA, 22 bp, Homo sapiens
ctcttccagtcttcctgacact

SEQ ID NO: 2327364 - DNA, 13 bp, Homo sapiens
ctcttccccagag

SEQ ID NO: 2327365 - DNA, 15 bp, Homo sapiens
ctcttcccccaccac

SEQ ID NO: 2327366 - DNA, 20 bp, Homo sapiens
ctcttcctactggtctctct

SEQ ID NO: 2327367 - DNA, 18 bp, Homo sapiens
ctcttctactcacttttc

SEQ ID NO: 2327368 - DNA, 21 bp, Homo sapiens
ctcttctagatgattttttga

SEQ ID NO: 2327369 - DNA, 21 bp, Homo sapiens
ctcttctgagctatttcatct

SEQ ID NO: 2327370 - DNA, 19 bp, Homo sapiens
ctcttctggggcaggctgg

SEQ ID NO: 2327371 - DNA, 14 bp, Homo sapiens
ctcttgagctggcc

SEQ ID NO: 2327372 - DNA, 15 bp, Homo sapiens
ctcttgcccatcctg

SEQ ID NO: 2327373 - DNA, 19 bp, Homo sapiens
ctcttgcccatcctgactg

SEQ ID NO: 2327374 - DNA, 22 bp, Homo sapiens
ctcttgtaaagactggttttct

SEQ ID NO: 2327375 - DNA, 22 bp, Homo sapiens
ctcttgtgatttctttaaaaga

SEQ ID NO: 2327376 - DNA, 20 bp, Homo sapiens
ctcttgtgcaaggtggcctt

SEQ ID NO: 2327377 - DNA, 15 bp, Homo sapiens
ctctttaaaaactca

SEQ ID NO: 2327378 - DNA, 15 bp, Homo sapiens
ctctttaaccctccc

SEQ ID NO: 2327379 - DNA, 13 bp, Homo sapiens
ctctttccaaatt

SEQ ID NO: 2327380 - DNA, 16 bp, Homo sapiens
ctctttccctaggaaa

SEQ ID NO: 2327381 - DNA, 22 bp, Homo sapiens
ctctttccttgagctgttgtga

SEQ ID NO: 2327382 - DNA, 18 bp, Homo sapiens
ctctttggaaatagcatg

SEQ ID NO: 2327383 - DNA, 19 bp, Homo sapiens
ctcttttaatggcatttct

SEQ ID NO: 2327384 - DNA, 14 bp, Homo sapiens
ctcttttaccctgg

SEQ ID NO: 2327385 - DNA, 20 bp, Homo sapiens
ctcttttgaaagtagagcta

SEQ ID NO: 2327386 - DNA, 14 bp, Homo sapiens
ctctttttcctcct

SEQ ID NO: 2327387 - DNA, 15 bp, Homo sapiens
ctctttttcctcctg

SEQ ID NO: 2327388 - DNA, 16 bp, Homo sapiens
ctctttttttgagtga

SEQ ID NO: 2327389 - DNA, 22 bp, Homo sapiens
ctctttttttgagtgacagctt

SEQ ID NO: 2327390 - DNA, 22 bp, Homo sapiens
ctgaaaacaatggagtattctc

SEQ ID NO: 2327391 - DNA, 18 bp, Homo sapiens
ctgaaaagaaggaaagat

SEQ ID NO: 2327392 - DNA, 13 bp, Homo sapiens
ctgaaacacacga

SEQ ID NO: 2327393 - DNA, 14 bp, Homo sapiens
ctgaaacacacgag

SEQ ID NO: 2327394 - DNA, 19 bp, Homo sapiens
ctgaaactcatagacactg

SEQ ID NO: 2327395 - DNA, 18 bp, Homo sapiens
ctgaaagttttgtaaaag

SEQ ID NO: 2327396 - DNA, 21 bp, Homo sapiens
ctgaaatcttcccatgcattc

SEQ ID NO: 2327397 - DNA, 23 bp, Homo sapiens
ctgaaatcttcccatgcattctg

SEQ ID NO: 2327398 - DNA, 19 bp, Homo sapiens
ctgaaattttatatgctta

SEQ ID NO: 2327399 - DNA, 15 bp, Homo sapiens
ctgaacacagtgtct

SEQ ID NO: 2327400 - DNA, 16 bp, Homo sapiens
ctgaacacagtgtctg

SEQ ID NO: 2327401 - DNA, 22 bp, Homo sapiens
ctgaacacagtgtctgttcagc

SEQ ID NO: 2327402 - DNA, 19 bp, Homo sapiens
ctgaaccgcacagctcagg

SEQ ID NO: 2327403 - DNA, 21 bp, Homo sapiens
ctgaaccgcacagctcaggag

SEQ ID NO: 2327404 - DNA, 23 bp, Homo sapiens
ctgaaccgcacagctcaggaggc

SEQ ID NO: 2327405 - DNA, 12 bp, Homo sapiens
ctgaaccttaat

SEQ ID NO: 2327406 - DNA, 15 bp, Homo sapiens
ctgaactcaaactga

SEQ ID NO: 2327407 - DNA, 18 bp, Homo sapiens
ctgaagaattgaaaagtt

SEQ ID NO: 2327408 - DNA, 14 bp, Homo sapiens
ctgaagccagctgc

SEQ ID NO: 2327409 - DNA, 11 bp, Homo sapiens
ctgaaggaaaa

SEQ ID NO: 2327410 - DNA, 16 bp, Homo sapiens
ctgaaggaaaaacaca

SEQ ID NO: 2327411 - DNA, 21 bp, Homo sapiens
ctgaaggaaaaacacaagcaa

SEQ ID NO: 2327412 - DNA, 21 bp, Homo sapiens
ctgaaggggtgcacccacctg

SEQ ID NO: 2327413 - DNA, 13 bp, Homo sapiens
ctgaagtggctgg

SEQ ID NO: 2327414 - DNA, 23 bp, Homo sapiens
ctgaagtttttttgctgctgcct

SEQ ID NO: 2327415 - DNA, 20 bp, Homo sapiens
ctgaatcatgagcctgctgg

SEQ ID NO: 2327416 - DNA, 19 bp, Homo sapiens
ctgaatgaatccattggag

SEQ ID NO: 2327417 - DNA, 16 bp, Homo sapiens
ctgaattgtgttttca

SEQ ID NO: 2327418 - DNA, 22 bp, Homo sapiens
ctgaatttggggctacttatat

SEQ ID NO: 2327419 - DNA, 18 bp, Homo sapiens
ctgaatttttttgtaata

SEQ ID NO: 2327420 - DNA, 20 bp, Homo sapiens
ctgaatttttttgtaataag

SEQ ID NO: 2327421 - DNA, 23 bp, Homo sapiens
ctgaatttttttgtaataagcaa

SEQ ID NO: 2327422 - DNA, 18 bp, Homo sapiens
ctgacaacttagctcagg

SEQ ID NO: 2327423 - DNA, 13 bp, Homo sapiens
ctgacaatcaact

SEQ ID NO: 2327424 - DNA, 16 bp, Homo sapiens
ctgacacccttctccc

SEQ ID NO: 2327425 - DNA, 17 bp, Homo sapiens
ctgacacccttctccca

SEQ ID NO: 2327426 - DNA, 21 bp, Homo sapiens
ctgacacccttctcccactct

SEQ ID NO: 2327427 - DNA, 19 bp, Homo sapiens
ctgacactttaattaccaa

SEQ ID NO: 2327428 - DNA, 21 bp, Homo sapiens
ctgacagaaggtgccacttta

SEQ ID NO: 2327429 - DNA, 16 bp, Homo sapiens
ctgacagagctctggg

SEQ ID NO: 2327430 - DNA, 16 bp, Homo sapiens
ctgacatatctacact

SEQ ID NO: 2327431 - DNA, 16 bp, Homo sapiens
ccccgcctggccagga

SEQ ID NO: 2327432 - DNA, 22 bp, Homo sapiens
ccccgcgaccatgtggccacaa

SEQ ID NO: 2327433 - DNA, 17 bp, Homo sapiens
ccccggtggctgggcag

SEQ ID NO: 2327434 - DNA, 22 bp, Homo sapiens
cccctaaccctttgtgtgctct

SEQ ID NO: 2327435 - DNA, 13 bp, Homo sapiens
cccctactgctgt

SEQ ID NO: 2327436 - DNA, 14 bp, Homo sapiens
cccctccagccaga

SEQ ID NO: 2327437 - DNA, 17 bp, Homo sapiens
cccctccccccagactc

SEQ ID NO: 2327438 - DNA, 18 bp, Homo sapiens
cccctccccccagactct

SEQ ID NO: 2327439 - DNA, 20 bp, Homo sapiens
cccctcctgaaccgcacagc

SEQ ID NO: 2327440 - DNA, 18 bp, Homo sapiens
cccctcgtcccatccagc

SEQ ID NO: 2327441 - DNA, 11 bp, Homo sapiens
cccctctcaga

SEQ ID NO: 2327442 - DNA, 22 bp, Homo sapiens
cccctctcagaacatactgatt

SEQ ID NO: 2327443 - DNA, 17 bp, Homo sapiens
cccctctccttctccta

SEQ ID NO: 2327444 - DNA, 13 bp, Homo sapiens
cccctctctctgg

SEQ ID NO: 2327445 - DNA, 14 bp, Homo sapiens
cccctgccacactg

SEQ ID NO: 2327446 - DNA, 12 bp, Homo sapiens
cccctgccctgc

SEQ ID NO: 2327447 - DNA, 14 bp, Homo sapiens
cccctgctcagcaa

SEQ ID NO: 2327448 - DNA, 16 bp, Homo sapiens
cccctggccgcgctcc

SEQ ID NO: 2327449 - DNA, 16 bp, Homo sapiens
cccctgggcttggcct

SEQ ID NO: 2327450 - DNA, 21 bp, Homo sapiens
cccctgggcttggcctgctgt

SEQ ID NO: 2327451 - DNA, 19 bp, Homo sapiens
cccctggggcccagcccct

SEQ ID NO: 2327452 - DNA, 20 bp, Homo sapiens
cccctgtgctcccctgccac

SEQ ID NO: 2327453 - DNA, 13 bp, Homo sapiens
cccctttcccacc

SEQ ID NO: 2327454 - DNA, 15 bp, Homo sapiens
cccgaggggagggca

SEQ ID NO: 2327455 - DNA, 21 bp, Homo sapiens
cccgcagggccatgcagacct

SEQ ID NO: 2327456 - DNA, 12 bp, Homo sapiens
cccgcctggcca

SEQ ID NO: 2327457 - DNA, 15 bp, Homo sapiens
cccgcctggccagga

SEQ ID NO: 2327458 - DNA, 17 bp, Homo sapiens
cccgcttattctcctcc

SEQ ID NO: 2327459 - DNA, 22 bp, Homo sapiens
cccgcttattctcctccctgtt

SEQ ID NO: 2327460 - DNA, 14 bp, Homo sapiens
cccgggagcggagg

SEQ ID NO: 2327461 - DNA, 17 bp, Homo sapiens
cccggggaccctgtgac

SEQ ID NO: 2327462 - DNA, 16 bp, Homo sapiens
cccggggtggccacag

SEQ ID NO: 2327463 - DNA, 13 bp, Homo sapiens
ccctaaacatggc

SEQ ID NO: 2327464 - DNA, 17 bp, Homo sapiens
ccctaaactttggcctt

SEQ ID NO: 2327465 - DNA, 17 bp, Homo sapiens
ccctaaccccttccaga

SEQ ID NO: 2327466 - DNA, 14 bp, Homo sapiens
ccctaccctggact

SEQ ID NO: 2327467 - DNA, 17 bp, Homo sapiens
ccctagctttagaccct

SEQ ID NO: 2327468 - DNA, 18 bp, Homo sapiens
ccctagctttagaccctg

SEQ ID NO: 2327469 - DNA, 19 bp, Homo sapiens
ccctagctttagaccctgg

SEQ ID NO: 2327470 - DNA, 21 bp, Homo sapiens
ccctagctttagaccctgggt

SEQ ID NO: 2327471 - DNA, 16 bp, Homo sapiens
ccctatctcctgacag

SEQ ID NO: 2327472 - DNA, 21 bp, Homo sapiens
ccctatgggcctgccgggctg

SEQ ID NO: 2327473 - DNA, 15 bp, Homo sapiens
ccctcaactgaaggg

SEQ ID NO: 2327474 - DNA, 21 bp, Homo sapiens
ccctcacaacagtcacctcac

SEQ ID NO: 2327475 - DNA, 20 bp, Homo sapiens
ccctcactggctctcctggc

SEQ ID NO: 2327476 - DNA, 14 bp, Homo sapiens
ccctccaccgagcc

SEQ ID NO: 2327477 - DNA, 15 bp, Homo sapiens
ccctccaccgagcca

SEQ ID NO: 2327478 - DNA, 10 bp, Homo sapiens
ccctcccaga

SEQ ID NO: 2327479 - DNA, 15 bp, Homo sapiens
ccctccccaggctgg

SEQ ID NO: 2327480 - DNA, 23 bp, Homo sapiens
ccctcccccagccatgccagctg

SEQ ID NO: 2327481 - DNA, 15 bp, Homo sapiens
ccctccccccagact

SEQ ID NO: 2327482 - DNA, 14 bp, Homo sapiens
ccctccccctgcca

SEQ ID NO: 2327483 - DNA, 21 bp, Homo sapiens
ccctccctgcctgagggcagt

SEQ ID NO: 2327484 - DNA, 12 bp, Homo sapiens
ccctcctagctc

SEQ ID NO: 2327485 - DNA, 13 bp, Homo sapiens
ccctcctcccagg

SEQ ID NO: 2327486 - DNA, 17 bp, Homo sapiens
ccctcctggagcatccc

SEQ ID NO: 2327487 - DNA, 15 bp, Homo sapiens
ccctcgtcccatcca

SEQ ID NO: 2327488 - DNA, 17 bp, Homo sapiens
ccctcgtcccatccagc

SEQ ID NO: 2327489 - DNA, 13 bp, Homo sapiens
ccctctcaccaaa

SEQ ID NO: 2327490 - DNA, 20 bp, Homo sapiens
ccctctccatctcccaaggc

SEQ ID NO: 2327491 - DNA, 15 bp, Homo sapiens
ccctctctctgggtc

SEQ ID NO: 2327492 - DNA, 19 bp, Homo sapiens
ccctctggattctgaatct

SEQ ID NO: 2327493 - DNA, 22 bp, Homo sapiens
ccctctgggcacgcctgctggc

SEQ ID NO: 2327494 - DNA, 14 bp, Homo sapiens
ccctctgtctagga

SEQ ID NO: 2327495 - DNA, 14 bp, Homo sapiens
ccctcttcctactg

SEQ ID NO: 2327496 - DNA, 12 bp, Homo sapiens
ccctcttcctcc

SEQ ID NO: 2327497 - DNA, 15 bp, Homo sapiens
ccctcttcctgtgat

SEQ ID NO: 2327498 - DNA, 15 bp, Homo sapiens
ccctctttgctgcag

SEQ ID NO: 2327499 - DNA, 19 bp, Homo sapiens
ccctctttgctgcagagaa

SEQ ID NO: 2327500 - DNA, 22 bp, Homo sapiens
ccctgaacgttttcttctttcc

SEQ ID NO: 2327501 - DNA, 16 bp, Homo sapiens
ccctgacctggccccc

SEQ ID NO: 2327502 - DNA, 14 bp, Homo sapiens
ccctgactcctctg

SEQ ID NO: 2327503 - DNA, 17 bp, Homo sapiens
ccctgactcctctggct

SEQ ID NO: 2327504 - DNA, 13 bp, Homo sapiens
ccctgaggccctg

SEQ ID NO: 2327505 - DNA, 17 bp, Homo sapiens
ccctgaggccctgggct

SEQ ID NO: 2327506 - DNA, 16 bp, Homo sapiens
ccctgaggcctagact

SEQ ID NO: 2327507 - DNA, 15 bp, Homo sapiens
ccctgcacgtcatgg

SEQ ID NO: 2327508 - DNA, 21 bp, Homo sapiens
ccctgcagagctatggtgagg

SEQ ID NO: 2327509 - DNA, 15 bp, Homo sapiens
ccctgcagatgccac

SEQ ID NO: 2327510 - DNA, 17 bp, Homo sapiens
ccctgcagcccaccaga

SEQ ID NO: 2327511 - DNA, 14 bp, Homo sapiens
ccctgccacagcca

SEQ ID NO: 2327512 - DNA, 17 bp, Homo sapiens
ccctgccacagccagag

SEQ ID NO: 2327513 - DNA, 12 bp, Homo sapiens
ccctgccctgtg

SEQ ID NO: 2327514 - DNA, 13 bp, Homo sapiens
ccctgccctgtgg

SEQ ID NO: 2327515 - DNA, 21 bp, Homo sapiens
ccctgcctcctggaggaccag

SEQ ID NO: 2327516 - DNA, 22 bp, Homo sapiens
ccctgcctctcatcaactgaat

SEQ ID NO: 2327517 - DNA, 15 bp, Homo sapiens
ccctgcctgccgtct

SEQ ID NO: 2327518 - DNA, 13 bp, Homo sapiens
ccctgcctggccc

SEQ ID NO: 2327519 - DNA, 14 bp, Homo sapiens
ccctggacctggga

SEQ ID NO: 2327520 - DNA, 19 bp, Homo sapiens
ccctggccgcttctcccca

SEQ ID NO: 2327521 - DNA, 13 bp, Homo sapiens
ccctggctccctc

SEQ ID NO: 2327522 - DNA, 14 bp, Homo sapiens
ccctggctgccggc

SEQ ID NO: 2327523 - DNA, 13 bp, Homo sapiens
ccctggctgctgc

SEQ ID NO: 2327524 - DNA, 15 bp, Homo sapiens
ccctggctgctgccc

SEQ ID NO: 2327525 - DNA, 22 bp, Homo sapiens
ccctggctgctgcccccacccc

SEQ ID NO: 2327526 - DNA, 18 bp, Homo sapiens
ccctgggcttggcctgct

SEQ ID NO: 2327527 - DNA, 17 bp, Homo sapiens
ccctgggtgggctctgt

SEQ ID NO: 2327528 - DNA, 18 bp, Homo sapiens
ccctgggtgggctctgtg

SEQ ID NO: 2327529 - DNA, 13 bp, Homo sapiens
ccctgtagctcag

SEQ ID NO: 2327530 - DNA, 14 bp, Homo sapiens
ccctgtagctcagt

SEQ ID NO: 2327531 - DNA, 17 bp, Homo sapiens
ccctgtgacatggtgcc

SEQ ID NO: 2327532 - DNA, 18 bp, Homo sapiens
ccctgtgacatggtgcct

SEQ ID NO: 2327533 - DNA, 15 bp, Homo sapiens
ccctgtggggcctga

SEQ ID NO: 2327534 - DNA, 14 bp, Homo sapiens
ccctgttccctgga

SEQ ID NO: 2327535 - DNA, 15 bp, Homo sapiens
ccctgttcctgctgc

SEQ ID NO: 2327536 - DNA, 23 bp, Homo sapiens
ccctgttgattatcttcagccca

SEQ ID NO: 2327537 - DNA, 17 bp, Homo sapiens
ccctgtttactggttct

SEQ ID NO: 2327538 - DNA, 16 bp, Homo sapiens
ccagcacatccccctc

SEQ ID NO: 2327539 - DNA, 14 bp, Homo sapiens
ccagcagaggcagg

SEQ ID NO: 2327540 - DNA, 16 bp, Homo sapiens
ccagcagaggcaggct

SEQ ID NO: 2327541 - DNA, 23 bp, Homo sapiens
ccagcaggcgtcaccatccacct

SEQ ID NO: 2327542 - DNA, 15 bp, Homo sapiens
ccagcagtgtggaga

SEQ ID NO: 2327543 - DNA, 21 bp, Homo sapiens
ccagcagtgtggagaccctgc

SEQ ID NO: 2327544 - DNA, 14 bp, Homo sapiens
ccagccagcagcag

SEQ ID NO: 2327545 - DNA, 16 bp, Homo sapiens
ccagccagcagcagcc

SEQ ID NO: 2327546 - DNA, 19 bp, Homo sapiens
ccagccagcagcagcccaa

SEQ ID NO: 2327547 - DNA, 13 bp, Homo sapiens
ccagccaggcaga

SEQ ID NO: 2327548 - DNA, 18 bp, Homo sapiens
ccagccatgccagctggc

SEQ ID NO: 2327549 - DNA, 20 bp, Homo sapiens
ccagccccactgccagcagc

SEQ ID NO: 2327550 - DNA, 17 bp, Homo sapiens
ccagcccctcttcccca

SEQ ID NO: 2327551 - DNA, 15 bp, Homo sapiens
ccagcccctggggcc

SEQ ID NO: 2327552 - DNA, 18 bp, Homo sapiens
ccagcccctggggcccag

SEQ ID NO: 2327553 - DNA, 13 bp, Homo sapiens
ccagccctgcagc

SEQ ID NO: 2327554 - DNA, 12 bp, Homo sapiens
ccagccctgctg

SEQ ID NO: 2327555 - DNA, 16 bp, Homo sapiens
ccagccctgctgggga

SEQ ID NO: 2327556 - DNA, 21 bp, Homo sapiens
ccagcctcatgggaagtcctg

SEQ ID NO: 2327557 - DNA, 19 bp, Homo sapiens
ccagcctgaacagaagctc

SEQ ID NO: 2327558 - DNA, 18 bp, Homo sapiens
ccagcctgtcctggtaca

SEQ ID NO: 2327559 - DNA, 17 bp, Homo sapiens
ccagccttgagccctgg

SEQ ID NO: 2327560 - DNA, 21 bp, Homo sapiens
ccagccttgagccctggctgt

SEQ ID NO: 2327561 - DNA, 18 bp, Homo sapiens
ccagcgatctctccactg

SEQ ID NO: 2327562 - DNA, 19 bp, Homo sapiens
ccagcgatctctccactgt

SEQ ID NO: 2327563 - DNA, 15 bp, Homo sapiens
ccagctacttgggag

SEQ ID NO: 2327564 - DNA, 12 bp, Homo sapiens
ccagctctctga

SEQ ID NO: 2327565 - DNA, 14 bp, Homo sapiens
ccagctctctgacg

SEQ ID NO: 2327566 - DNA, 23 bp, Homo sapiens
ccagctctctgacgcttgtgaca

SEQ ID NO: 2327567 - DNA, 16 bp, Homo sapiens
ccagctgccctatggg

SEQ ID NO: 2327568 - DNA, 22 bp, Homo sapiens
ccagctgcctagattcagggaa

SEQ ID NO: 2327569 - DNA, 17 bp, Homo sapiens
ccagctgcgcttgcttt

SEQ ID NO: 2327570 - DNA, 12 bp, Homo sapiens
ccagctggcctg

SEQ ID NO: 2327571 - DNA, 17 bp, Homo sapiens
ccagctggcctggacag

SEQ ID NO: 2327572 - DNA, 15 bp, Homo sapiens
ccagctggggccaga

SEQ ID NO: 2327573 - DNA, 16 bp, Homo sapiens
ccagctggggccagag

SEQ ID NO: 2327574 - DNA, 12 bp, Homo sapiens
ccagctttccct

SEQ ID NO: 2327575 - DNA, 19 bp, Homo sapiens
ccaggaaactccacatctg

SEQ ID NO: 2327576 - DNA, 23 bp, Homo sapiens
ccaggaaactccacatctgcctt

SEQ ID NO: 2327577 - DNA, 23 bp, Homo sapiens
ccaggaaagagcagtcagagtcc

SEQ ID NO: 2327578 - DNA, 16 bp, Homo sapiens
ccaggaagccagagcc

SEQ ID NO: 2327579 - DNA, 20 bp, Homo sapiens
ccaggacatgcaataaaatt

SEQ ID NO: 2327580 - DNA, 18 bp, Homo sapiens
ccaggactctgaccccag

SEQ ID NO: 2327581 - DNA, 15 bp, Homo sapiens
ccaggagatgggtcc

SEQ ID NO: 2327582 - DNA, 21 bp, Homo sapiens
ccaggatactggcacagaggt

SEQ ID NO: 2327583 - DNA, 20 bp, Homo sapiens
ccaggatgctaaagatgatg

SEQ ID NO: 2327584 - DNA, 21 bp, Homo sapiens
ccaggatgctaaagatgatga

SEQ ID NO: 2327585 - DNA, 17 bp, Homo sapiens
ccaggatttgcacagaa

SEQ ID NO: 2327586 - DNA, 14 bp, Homo sapiens
ccaggcaccctcag

SEQ ID NO: 2327587 - DNA, 18 bp, Homo sapiens
ccaggcaccctcagggag

SEQ ID NO: 2327588 - DNA, 16 bp, Homo sapiens
ccaggcacctcttcct

SEQ ID NO: 2327589 - DNA, 15 bp, Homo sapiens
ccaggcaggggtggg

SEQ ID NO: 2327590 - DNA, 11 bp, Homo sapiens
ccaggccagcc

SEQ ID NO: 2327591 - DNA, 13 bp, Homo sapiens
ccaggccccagac

SEQ ID NO: 2327592 - DNA, 16 bp, Homo sapiens
ccaggccccagacagg

SEQ ID NO: 2327593 - DNA, 20 bp, Homo sapiens
ccaggccccagacagggtgg

SEQ ID NO: 2327594 - DNA, 19 bp, Homo sapiens
ccaggccctcctctcccat

SEQ ID NO: 2327595 - DNA, 13 bp, Homo sapiens
ccaggcctggctg

SEQ ID NO: 2327596 - DNA, 23 bp, Homo sapiens
ccaggcgggcggcacgccaacag

SEQ ID NO: 2327597 - DNA, 17 bp, Homo sapiens
ccaggctccagcacatc

SEQ ID NO: 2327598 - DNA, 23 bp, Homo sapiens
ccaggctctcgcacacctctgca

SEQ ID NO: 2327599 - DNA, 23 bp, Homo sapiens
ccaggcttctgctggggcctggg

SEQ ID NO: 2327600 - DNA, 21 bp, Homo sapiens
ccagggacacacagcctagca

SEQ ID NO: 2327601 - DNA, 12 bp, Homo sapiens
ccagggactctc

SEQ ID NO: 2327602 - DNA, 13 bp, Homo sapiens
ccagggagtccag

SEQ ID NO: 2327603 - DNA, 16 bp, Homo sapiens
ccagggagtccagggt

SEQ ID NO: 2327604 - DNA, 22 bp, Homo sapiens
ccagggcaagggttaaggcctg

SEQ ID NO: 2327605 - DNA, 17 bp, Homo sapiens
ccagggcagggtctggg

SEQ ID NO: 2327606 - DNA, 20 bp, Homo sapiens
ccagggcagggtctgggctg

SEQ ID NO: 2327607 - DNA, 13 bp, Homo sapiens
ccagggccctggg

SEQ ID NO: 2327608 - DNA, 14 bp, Homo sapiens
ccagggcctcctgg

SEQ ID NO: 2327609 - DNA, 14 bp, Homo sapiens
ccagggcctctcca

SEQ ID NO: 2327610 - DNA, 18 bp, Homo sapiens
ccagggctccctcctgga

SEQ ID NO: 2327611 - DNA, 15 bp, Homo sapiens
ccagggctcttctca

SEQ ID NO: 2327612 - DNA, 14 bp, Homo sapiens
ccaggggaaggccc

SEQ ID NO: 2327613 - DNA, 16 bp, Homo sapiens
ccaggggaaggccctg

SEQ ID NO: 2327614 - DNA, 20 bp, Homo sapiens
ccaggggaaggccctgaggc

SEQ ID NO: 2327615 - DNA, 15 bp, Homo sapiens
ccaggggtctccctg

SEQ ID NO: 2327616 - DNA, 17 bp, Homo sapiens
ccaggggtctccctggc

SEQ ID NO: 2327617 - DNA, 21 bp, Homo sapiens
ccaggggtctccctggctccc

SEQ ID NO: 2327618 - DNA, 19 bp, Homo sapiens
ccaggggtctgtctgcttt

SEQ ID NO: 2327619 - DNA, 14 bp, Homo sapiens
ccagggtttctctg

SEQ ID NO: 2327620 - DNA, 15 bp, Homo sapiens
ccagggtttctctgc

SEQ ID NO: 2327621 - DNA, 15 bp, Homo sapiens
ccaggtaccagctgc

SEQ ID NO: 2327622 - DNA, 18 bp, Homo sapiens
ccaggtaccagctgcgct

SEQ ID NO: 2327623 - DNA, 23 bp, Homo sapiens
ccaggtaccagctgcgcttgctt

SEQ ID NO: 2327624 - DNA, 20 bp, Homo sapiens
ccaggtagaaaagaaatggt

SEQ ID NO: 2327625 - DNA, 22 bp, Homo sapiens
ccaggtatccaaaaatgtgtaa

SEQ ID NO: 2327626 - DNA, 17 bp, Homo sapiens
ccagtactgggaaggag

SEQ ID NO: 2327627 - DNA, 13 bp, Homo sapiens
ccagtagcccaga

SEQ ID NO: 2327628 - DNA, 21 bp, Homo sapiens
ccagtcatctgtaagagcttg

SEQ ID NO: 2327629 - DNA, 19 bp, Homo sapiens
ccagtccactcctgacccc

SEQ ID NO: 2327630 - DNA, 15 bp, Homo sapiens
ccagtccccacccct

SEQ ID NO: 2327631 - DNA, 17 bp, Homo sapiens
ccagtccccacccctgc

SEQ ID NO: 2327632 - DNA, 19 bp, Homo sapiens
ccagtccccacccctgccc

SEQ ID NO: 2327633 - DNA, 21 bp, Homo sapiens
ccagtccccacccctgccccc

SEQ ID NO: 2327634 - DNA, 13 bp, Homo sapiens
ccagtccctgtcc

SEQ ID NO: 2327635 - DNA, 21 bp, Homo sapiens
ccagtcctgctacctcccttg

SEQ ID NO: 2327636 - DNA, 22 bp, Homo sapiens
ccagtcttcctgacactttaat

SEQ ID NO: 2327637 - DNA, 18 bp, Homo sapiens
ccagtgaactcctgccag

SEQ ID NO: 2327638 - DNA, 22 bp, Homo sapiens
ccagtgaactcctgccaggcac

SEQ ID NO: 2327639 - DNA, 14 bp, Homo sapiens
ccagtgcctacatc

SEQ ID NO: 2327640 - DNA, 16 bp, Homo sapiens
ccagtgctctgcctca

SEQ ID NO: 2327641 - DNA, 18 bp, Homo sapiens
ccagtgctctgcctcaga

SEQ ID NO: 2327642 - DNA, 23 bp, Homo sapiens
ccagtgctggaagggaggaaggc

SEQ ID NO: 2327643 - DNA, 18 bp, Homo sapiens
ccagtgggccagccacag

SEQ ID NO: 2327644 - DNA, 15 bp, Homo sapiens
ccagttcctcttttg

SEQ ID NO: 2327645 - DNA, 16 bp, Homo sapiens
ccagttgatctgctct

SEQ ID NO: 2327646 - DNA, 11 bp, Homo sapiens
ccagtttctcc

SEQ ID NO: 2327647 - DNA, 13 bp, Homo sapiens
ccagtttctcctt

SEQ ID NO: 2327648 - DNA, 15 bp, Homo sapiens
ccataaaaccctata

SEQ ID NO: 2327649 - DNA, 16 bp, Homo sapiens
ccatacacagaggagt

SEQ ID NO: 2327650 - DNA, 17 bp, Homo sapiens
ccatacactttgttgca

SEQ ID NO: 2327651 - DNA, 16 bp, Homo sapiens
ccatatagctcgagca

SEQ ID NO: 2327652 - DNA, 19 bp, Homo sapiens
ccatatatgaccagaagcc

SEQ ID NO: 2327653 - DNA, 17 bp, Homo sapiens
cccagacataaaggaaa

SEQ ID NO: 2327654 - DNA, 23 bp, Homo sapiens
cccagactaaaggatccagagag

SEQ ID NO: 2327655 - DNA, 13 bp, Homo sapiens
cccagactctttt

SEQ ID NO: 2327656 - DNA, 20 bp, Homo sapiens
cccagaggtaacagaacagc

SEQ ID NO: 2327657 - DNA, 23 bp, Homo sapiens
cccagcactttgggaggccgagg

SEQ ID NO: 2327658 - DNA, 14 bp, Homo sapiens
cccagcagtgtgga

SEQ ID NO: 2327659 - DNA, 16 bp, Homo sapiens
cccagcattctcaggc

SEQ ID NO: 2327660 - DNA, 20 bp, Homo sapiens
cccagccccggtggctgggc

SEQ ID NO: 2327661 - DNA, 18 bp, Homo sapiens
cccagcccctactgctgt

SEQ ID NO: 2327662 - DNA, 13 bp, Homo sapiens
cccagcctgggcc

SEQ ID NO: 2327663 - DNA, 22 bp, Homo sapiens
cccagcctgggccatctcttag

SEQ ID NO: 2327664 - DNA, 14 bp, Homo sapiens
cccagcctgtcctg

SEQ ID NO: 2327665 - DNA, 15 bp, Homo sapiens
cccagcctgtcctgg

SEQ ID NO: 2327666 - DNA, 17 bp, Homo sapiens
cccagctacttgggagg

SEQ ID NO: 2327667 - DNA, 19 bp, Homo sapiens
cccaggagatgggtccagg

SEQ ID NO: 2327668 - DNA, 14 bp, Homo sapiens
cccaggcaagcagc

SEQ ID NO: 2327669 - DNA, 16 bp, Homo sapiens
cccaggccttgtccta

SEQ ID NO: 2327670 - DNA, 14 bp, Homo sapiens
cccaggctggagac

SEQ ID NO: 2327671 - DNA, 17 bp, Homo sapiens
cccaggctggagacccc

SEQ ID NO: 2327672 - DNA, 16 bp, Homo sapiens
cccaggcttttgctag

SEQ ID NO: 2327673 - DNA, 21 bp, Homo sapiens
cccaggggaaggccctgaggc

SEQ ID NO: 2327674 - DNA, 16 bp, Homo sapiens
cccaggggacaaggga

SEQ ID NO: 2327675 - DNA, 18 bp, Homo sapiens
cccaggggacaagggatt

SEQ ID NO: 2327676 - DNA, 20 bp, Homo sapiens
cccaggggtctccctggctc

SEQ ID NO: 2327677 - DNA, 16 bp, Homo sapiens
cccaggtaccagctgc

SEQ ID NO: 2327678 - DNA, 17 bp, Homo sapiens
cccaggtaccagctgcg

SEQ ID NO: 2327679 - DNA, 19 bp, Homo sapiens
cccaggtaccagctgcgct

SEQ ID NO: 2327680 - DNA, 15 bp, Homo sapiens
cccaggtggcctgga

SEQ ID NO: 2327681 - DNA, 14 bp, Homo sapiens
cccagtccccaccc

SEQ ID NO: 2327682 - DNA, 21 bp, Homo sapiens
cccagtccccacccctgcccc

SEQ ID NO: 2327683 - DNA, 23 bp, Homo sapiens
cccagtccccacccctgccccca

SEQ ID NO: 2327684 - DNA, 23 bp, Homo sapiens
cccagtcgtgatgtggaggaaga

SEQ ID NO: 2327685 - DNA, 23 bp, Homo sapiens
cccagtgaactcctgccaggcac

SEQ ID NO: 2327686 - DNA, 13 bp, Homo sapiens
cccagtgagactg

SEQ ID NO: 2327687 - DNA, 18 bp, Homo sapiens
cccagtgagactgcccca

SEQ ID NO: 2327688 - DNA, 12 bp, Homo sapiens
cccagtgctgga

SEQ ID NO: 2327689 - DNA, 18 bp, Homo sapiens
cccatcagaacctgagct

SEQ ID NO: 2327690 - DNA, 12 bp, Homo sapiens
cccatcctgcca

SEQ ID NO: 2327691 - DNA, 20 bp, Homo sapiens
cccatcgttgcccccatttc

SEQ ID NO: 2327692 - DNA, 22 bp, Homo sapiens
cccatcgttgcccccatttctg

SEQ ID NO: 2327693 - DNA, 13 bp, Homo sapiens
cccatctcaggac

SEQ ID NO: 2327694 - DNA, 17 bp, Homo sapiens
cccatctccctgcctgg

SEQ ID NO: 2327695 - DNA, 21 bp, Homo sapiens
cccatctcgctccctcccagg

SEQ ID NO: 2327696 - DNA, 12 bp, Homo sapiens
cccatctgtcca

SEQ ID NO: 2327697 - DNA, 15 bp, Homo sapiens
cccatcttcgggacc

SEQ ID NO: 2327698 - DNA, 13 bp, Homo sapiens
cccatgctgtccg

SEQ ID NO: 2327699 - DNA, 17 bp, Homo sapiens
cccatgctgtccggcct

SEQ ID NO: 2327700 - DNA, 20 bp, Homo sapiens
cccatggagattgacctgga

SEQ ID NO: 2327701 - DNA, 21 bp, Homo sapiens
cccattaaggggaagaatgaa

SEQ ID NO: 2327702 - DNA, 19 bp, Homo sapiens
cccattcctgatcccatgg

SEQ ID NO: 2327703 - DNA, 18 bp, Homo sapiens
cccattccttgcgcctca

SEQ ID NO: 2327704 - DNA, 19 bp, Homo sapiens
cccattgttgtcaaggaag

SEQ ID NO: 2327705 - DNA, 14 bp, Homo sapiens
cccatttcccatct

SEQ ID NO: 2327706 - DNA, 14 bp, Homo sapiens
cccatttgtcccag

SEQ ID NO: 2327707 - DNA, 16 bp, Homo sapiens
cccatttgtgccagag

SEQ ID NO: 2327708 - DNA, 18 bp, Homo sapiens
cccatttgtgccagagga

SEQ ID NO: 2327709 - DNA, 13 bp, Homo sapiens
cccatttttcctt

SEQ ID NO: 2327710 - DNA, 20 bp, Homo sapiens
ccccaaaggacgcctgcagg

SEQ ID NO: 2327711 - DNA, 14 bp, Homo sapiens
ccccaacctcaggg

SEQ ID NO: 2327712 - DNA, 20 bp, Homo sapiens
ccccaacctcagggctccca

SEQ ID NO: 2327713 - DNA, 13 bp, Homo sapiens
ccccaacctgctc

SEQ ID NO: 2327714 - DNA, 15 bp, Homo sapiens
ccccaacctgctctc

SEQ ID NO: 2327715 - DNA, 18 bp, Homo sapiens
ccccaatcggactgccaa

SEQ ID NO: 2327716 - DNA, 19 bp, Homo sapiens
ccccaatcggactgccaaa

SEQ ID NO: 2327717 - DNA, 20 bp, Homo sapiens
ccccaatcggactgccaaat

SEQ ID NO: 2327718 - DNA, 21 bp, Homo sapiens
ccccaatgtatgtgtggctgt

SEQ ID NO: 2327719 - DNA, 14 bp, Homo sapiens
ccccacagccctgc

SEQ ID NO: 2327720 - DNA, 19 bp, Homo sapiens
ccccaccccggggaccctg

SEQ ID NO: 2327721 - DNA, 23 bp, Homo sapiens
ccccaccccggggaccctgtgac

SEQ ID NO: 2327722 - DNA, 14 bp, Homo sapiens
ccccacccctgccc

SEQ ID NO: 2327723 - DNA, 17 bp, Homo sapiens
ccccacccctgccccca

SEQ ID NO: 2327724 - DNA, 23 bp, Homo sapiens
ccccacccctggaagagcccagt

SEQ ID NO: 2327725 - DNA, 22 bp, Homo sapiens
ccccaccctcaaaccctgtggg

SEQ ID NO: 2327726 - DNA, 18 bp, Homo sapiens
ccccaccctgttcctgct

SEQ ID NO: 2327727 - DNA, 21 bp, Homo sapiens
ccccaccctgttcctgctgct

SEQ ID NO: 2327728 - DNA, 18 bp, Homo sapiens
ccccaccggtccagctgg

SEQ ID NO: 2327729 - DNA, 19 bp, Homo sapiens
ccccaccttgccagggcag

SEQ ID NO: 2327730 - DNA, 14 bp, Homo sapiens
ccccacctttggga

SEQ ID NO: 2327731 - DNA, 19 bp, Homo sapiens
ccccacggagacagaggaa

SEQ ID NO: 2327732 - DNA, 23 bp, Homo sapiens
ccccactcccttgctggccccag

SEQ ID NO: 2327733 - DNA, 16 bp, Homo sapiens
ccccactcctctgctg

SEQ ID NO: 2327734 - DNA, 22 bp, Homo sapiens
ccccactgccagcagcagcagg

SEQ ID NO: 2327735 - DNA, 12 bp, Homo sapiens
ccccagagctgc

SEQ ID NO: 2327736 - DNA, 14 bp, Homo sapiens
ccccagcagaggca

SEQ ID NO: 2327737 - DNA, 15 bp, Homo sapiens
ccccagcagaggcag

SEQ ID NO: 2327738 - DNA, 19 bp, Homo sapiens
ccccagcattctcaggcac

SEQ ID NO: 2327739 - DNA, 20 bp, Homo sapiens
ccccagcattctcaggcacc

SEQ ID NO: 2327740 - DNA, 21 bp, Homo sapiens
ccccagcattctcaggcacca

SEQ ID NO: 2327741 - DNA, 12 bp, Homo sapiens
ccccagcccaga

SEQ ID NO: 2327742 - DNA, 11 bp, Homo sapiens
ccccagggagt

SEQ ID NO: 2327743 - DNA, 19 bp, Homo sapiens
ccccagtccccacccctgc

SEQ ID NO: 2327744 - DNA, 18 bp, Homo sapiens
ccccagttccgtccaagt

SEQ ID NO: 2327745 - DNA, 14 bp, Homo sapiens
ccccatctccctgc

SEQ ID NO: 2327746 - DNA, 19 bp, Homo sapiens
ccccatctccctgcctggc

SEQ ID NO: 2327747 - DNA, 22 bp, Homo sapiens
ccccatctcgctccctcccagg

SEQ ID NO: 2327748 - DNA, 14 bp, Homo sapiens
ccccatctgtccag

SEQ ID NO: 2327749 - DNA, 21 bp, Homo sapiens
ccccatctgtccagctggggc

SEQ ID NO: 2327750 - DNA, 16 bp, Homo sapiens
ccccatcttcgggacc

SEQ ID NO: 2327751 - DNA, 22 bp, Homo sapiens
ccccattccttgcgcctcagcc

SEQ ID NO: 2327752 - DNA, 16 bp, Homo sapiens
ccccatttcccatctg

SEQ ID NO: 2327753 - DNA, 17 bp, Homo sapiens
ccccatttcccatctgc

SEQ ID NO: 2327754 - DNA, 17 bp, Homo sapiens
ccccatttctgcctcgc

SEQ ID NO: 2327755 - DNA, 14 bp, Homo sapiens
cccccaacctcagg

SEQ ID NO: 2327756 - DNA, 15 bp, Homo sapiens
cccccaacctcaggg

SEQ ID NO: 2327757 - DNA, 11 bp, Homo sapiens
cccccaccctg

SEQ ID NO: 2327758 - DNA, 18 bp, Homo sapiens
cccccaccctgttcctgc

SEQ ID NO: 2327759 - DNA, 22 bp, Homo sapiens
cccccagcagaggcaggctggg

SEQ ID NO: 2327760 - DNA, 20 bp, Homo sapiens
cccccagccatgccagctgg

SEQ ID NO: 2327761 - DNA, 23 bp, Homo sapiens
cccccagccatgccagctggcct

SEQ ID NO: 2327762 - DNA, 16 bp, Homo sapiens
cccccatcttcgggac

SEQ ID NO: 2327763 - DNA, 21 bp, Homo sapiens
cccccatcttcgggaccagga

SEQ ID NO: 2327764 - DNA, 12 bp, Homo sapiens
cccccctgctca

SEQ ID NO: 2327765 - DNA, 13 bp, Homo sapiens
cagggagtccagg

SEQ ID NO: 2327766 - DNA, 14 bp, Homo sapiens
cagggagtccaggg

SEQ ID NO: 2327767 - DNA, 15 bp, Homo sapiens
cagggagtccagggt

SEQ ID NO: 2327768 - DNA, 22 bp, Homo sapiens
cagggagtccagggtttctctg

SEQ ID NO: 2327769 - DNA, 16 bp, Homo sapiens
cagggatttgcctcac

SEQ ID NO: 2327770 - DNA, 18 bp, Homo sapiens
cagggatttgcctcacct

SEQ ID NO: 2327771 - DNA, 22 bp, Homo sapiens
cagggcaagggttaaggcctga

SEQ ID NO: 2327772 - DNA, 15 bp, Homo sapiens
cagggcagggcagcc

SEQ ID NO: 2327773 - DNA, 14 bp, Homo sapiens
cagggccctgggca

SEQ ID NO: 2327774 - DNA, 12 bp, Homo sapiens
cagggcctcctg

SEQ ID NO: 2327775 - DNA, 12 bp, Homo sapiens
cagggctccctc

SEQ ID NO: 2327776 - DNA, 16 bp, Homo sapiens
cagggctccctcctgg

SEQ ID NO: 2327777 - DNA, 23 bp, Homo sapiens
cagggctccctcctggagcatcc

SEQ ID NO: 2327778 - DNA, 12 bp, Homo sapiens
cagggctctccc

SEQ ID NO: 2327779 - DNA, 18 bp, Homo sapiens
cagggctggctcctgatc

SEQ ID NO: 2327780 - DNA, 14 bp, Homo sapiens
cagggctgtgcttg

SEQ ID NO: 2327781 - DNA, 14 bp, Homo sapiens
caggggcttgagaa

SEQ ID NO: 2327782 - DNA, 16 bp, Homo sapiens
caggggcttgagaagg

SEQ ID NO: 2327783 - DNA, 19 bp, Homo sapiens
caggggtctccctggctcc

SEQ ID NO: 2327784 - DNA, 21 bp, Homo sapiens
caggggtctccctggctccct

SEQ ID NO: 2327785 - DNA, 14 bp, Homo sapiens
cagggtctgggctg

SEQ ID NO: 2327786 - DNA, 21 bp, Homo sapiens
cagggtctgggctgggcacct

SEQ ID NO: 2327787 - DNA, 22 bp, Homo sapiens
cagggtctgggctgggcacctg

SEQ ID NO: 2327788 - DNA, 23 bp, Homo sapiens
cagggtcttgctctgtcccccag

SEQ ID NO: 2327789 - DNA, 18 bp, Homo sapiens
cagggtgaactgcaaagc

SEQ ID NO: 2327790 - DNA, 19 bp, Homo sapiens
cagggtgggcttcctgccc

SEQ ID NO: 2327791 - DNA, 14 bp, Homo sapiens
cagggtttctctgc

SEQ ID NO: 2327792 - DNA, 22 bp, Homo sapiens
cagggtttctctgcagatgtgc

SEQ ID NO: 2327793 - DNA, 20 bp, Homo sapiens
caggtaaaacagggccacat

SEQ ID NO: 2327794 - DNA, 13 bp, Homo sapiens
caggtaccagctg

SEQ ID NO: 2327795 - DNA, 17 bp, Homo sapiens
caggtaccagctgcgct

SEQ ID NO: 2327796 - DNA, 18 bp, Homo sapiens
caggtaccagctgcgctt

SEQ ID NO: 2327797 - DNA, 21 bp, Homo sapiens
caggtaccagctgcgcttgct

SEQ ID NO: 2327798 - DNA, 13 bp, Homo sapiens
caggtagaaaaga

SEQ ID NO: 2327799 - DNA, 13 bp, Homo sapiens
caggtagcctatt

SEQ ID NO: 2327800 - DNA, 13 bp, Homo sapiens
caggtagtactgg

SEQ ID NO: 2327801 - DNA, 16 bp, Homo sapiens
caggtagtactgggaa

SEQ ID NO: 2327802 - DNA, 16 bp, Homo sapiens
caggtcatcagatgcc

SEQ ID NO: 2327803 - DNA, 12 bp, Homo sapiens
caggtgggctgg

SEQ ID NO: 2327804 - DNA, 22 bp, Homo sapiens
caggtgggctggacttctacct

SEQ ID NO: 2327805 - DNA, 23 bp, Homo sapiens
caggtgggctggacttctacctg

SEQ ID NO: 2327806 - DNA, 20 bp, Homo sapiens
caggtgggggtgggctgctg

SEQ ID NO: 2327807 - DNA, 14 bp, Homo sapiens
caggtgtataaatg

SEQ ID NO: 2327808 - DNA, 19 bp, Homo sapiens
caggtgtataaatgtacat

SEQ ID NO: 2327809 - DNA, 20 bp, Homo sapiens
caggttatcgaaataacaat

SEQ ID NO: 2327810 - DNA, 21 bp, Homo sapiens
caggttattgcaataaagtat

SEQ ID NO: 2327811 - DNA, 18 bp, Homo sapiens
cagtaaagaaagcagaat

SEQ ID NO: 2327812 - DNA, 15 bp, Homo sapiens
cagtaaagcacttgc

SEQ ID NO: 2327813 - DNA, 20 bp, Homo sapiens
cagtaaatagtgtcatataa

SEQ ID NO: 2327814 - DNA, 17 bp, Homo sapiens
cagtaaatgttacttct

SEQ ID NO: 2327815 - DNA, 20 bp, Homo sapiens
cagtaacccccttaaattta

SEQ ID NO: 2327816 - DNA, 22 bp, Homo sapiens
cagtaagtctcataggttaaaa

SEQ ID NO: 2327817 - DNA, 20 bp, Homo sapiens
cagtaagttatctttgaata

SEQ ID NO: 2327818 - DNA, 16 bp, Homo sapiens
cagtacatttaaattt

SEQ ID NO: 2327819 - DNA, 20 bp, Homo sapiens
cagtacatttaaattttttg

SEQ ID NO: 2327820 - DNA, 16 bp, Homo sapiens
cagtaccctccattgg

SEQ ID NO: 2327821 - DNA, 20 bp, Homo sapiens
cagtacctagctggctctgt

SEQ ID NO: 2327822 - DNA, 17 bp, Homo sapiens
cagtactggttactttc

SEQ ID NO: 2327823 - DNA, 19 bp, Homo sapiens
cagtactggttactttcaa

SEQ ID NO: 2327824 - DNA, 22 bp, Homo sapiens
cagtactggttactttcaaaat

SEQ ID NO: 2327825 - DNA, 12 bp, Homo sapiens
cagtagaactgt

SEQ ID NO: 2327826 - DNA, 12 bp, Homo sapiens
cagtagagccag

SEQ ID NO: 2327827 - DNA, 13 bp, Homo sapiens
cagtagagccagc

SEQ ID NO: 2327828 - DNA, 17 bp, Homo sapiens
cagtagagccagcttgg

SEQ ID NO: 2327829 - DNA, 17 bp, Homo sapiens
cagtaggactccttatt

SEQ ID NO: 2327830 - DNA, 16 bp, Homo sapiens
cagtatcccacatcca

SEQ ID NO: 2327831 - DNA, 18 bp, Homo sapiens
cagtatgtgggggcttca

SEQ ID NO: 2327832 - DNA, 13 bp, Homo sapiens
cagtatttaacat

SEQ ID NO: 2327833 - DNA, 18 bp, Homo sapiens
cagtatttttaaaggcat

SEQ ID NO: 2327834 - DNA, 22 bp, Homo sapiens
cagtcacaacagagtgaaaaat

SEQ ID NO: 2327835 - DNA, 20 bp, Homo sapiens
cagtcacactgtggccagta

SEQ ID NO: 2327836 - DNA, 12 bp, Homo sapiens
cagtcactgctc

SEQ ID NO: 2327837 - DNA, 14 bp, Homo sapiens
cagtcactggaggt

SEQ ID NO: 2327838 - DNA, 15 bp, Homo sapiens
cagtcagagtccagt

SEQ ID NO: 2327839 - DNA, 18 bp, Homo sapiens
cagtcagagtccagtgct

SEQ ID NO: 2327840 - DNA, 15 bp, Homo sapiens
cagtcatctcccctc

SEQ ID NO: 2327841 - DNA, 14 bp, Homo sapiens
cagtcatgcataaa

SEQ ID NO: 2327842 - DNA, 17 bp, Homo sapiens
cagtcatgcataaatat

SEQ ID NO: 2327843 - DNA, 18 bp, Homo sapiens
cagtcatgcataaatatg

SEQ ID NO: 2327844 - DNA, 19 bp, Homo sapiens
cagtcatgcataaatatgc

SEQ ID NO: 2327845 - DNA, 23 bp, Homo sapiens
cagtcatgcataaatatgcagtg

SEQ ID NO: 2327846 - DNA, 12 bp, Homo sapiens
cagtccactgtt

SEQ ID NO: 2327847 - DNA, 22 bp, Homo sapiens
cagtccactgttgagccccagt

SEQ ID NO: 2327848 - DNA, 12 bp, Homo sapiens
cagtccagaccc

SEQ ID NO: 2327849 - DNA, 12 bp, Homo sapiens
cagtccccaccc

SEQ ID NO: 2327850 - DNA, 15 bp, Homo sapiens
cagtccccacccctg

SEQ ID NO: 2327851 - DNA, 19 bp, Homo sapiens
cagtccccacccctgcccc

SEQ ID NO: 2327852 - DNA, 20 bp, Homo sapiens
cagtccccacccctgccccc

SEQ ID NO: 2327853 - DNA, 18 bp, Homo sapiens
cagtcccctctctctggg

SEQ ID NO: 2327854 - DNA, 20 bp, Homo sapiens
cagtcccctctctctgggtc

SEQ ID NO: 2327855 - DNA, 15 bp, Homo sapiens
cagtcgtgatgtgga

SEQ ID NO: 2327856 - DNA, 19 bp, Homo sapiens
cagtcgtgatgtggaggaa

SEQ ID NO: 2327857 - DNA, 18 bp, Homo sapiens
cagtctcagttctcttgc

SEQ ID NO: 2327858 - DNA, 19 bp, Homo sapiens
cagtctcagttctcttgct

SEQ ID NO: 2327859 - DNA, 21 bp, Homo sapiens
cagtctgcccacgcagaggac

SEQ ID NO: 2327860 - DNA, 16 bp, Homo sapiens
catggcctgcaaactg

SEQ ID NO: 2327861 - DNA, 18 bp, Homo sapiens
catggcgccctgcctcct

SEQ ID NO: 2327862 - DNA, 15 bp, Homo sapiens
catggctgctgttgc

SEQ ID NO: 2327863 - DNA, 22 bp, Homo sapiens
catgggagggggcttgaagcca

SEQ ID NO: 2327864 - DNA, 15 bp, Homo sapiens
catgggcctgctgcg

SEQ ID NO: 2327865 - DNA, 22 bp, Homo sapiens
catgggcctgctgcgtcagacc

SEQ ID NO: 2327866 - DNA, 12 bp, Homo sapiens
catgggcttcac

SEQ ID NO: 2327867 - DNA, 17 bp, Homo sapiens
catgggcttcactgtat

SEQ ID NO: 2327868 - DNA, 21 bp, Homo sapiens
catgggcttcactgtataaat

SEQ ID NO: 2327869 - DNA, 23 bp, Homo sapiens
catgggcttcactgtataaatag

SEQ ID NO: 2327870 - DNA, 15 bp, Homo sapiens
catggtgcctgagag

SEQ ID NO: 2327871 - DNA, 16 bp, Homo sapiens
catggtgcctgagagg

SEQ ID NO: 2327872 - DNA, 14 bp, Homo sapiens
catggtgtaataag

SEQ ID NO: 2327873 - DNA, 12 bp, Homo sapiens
catgtaaaatgt

SEQ ID NO: 2327874 - DNA, 16 bp, Homo sapiens
catgtaaactatttgt

SEQ ID NO: 2327875 - DNA, 21 bp, Homo sapiens
catgtaataaaaagtatatgt

SEQ ID NO: 2327876 - DNA, 18 bp, Homo sapiens
catgtatgaatgtaagga

SEQ ID NO: 2327877 - DNA, 22 bp, Homo sapiens
catgtatgtaaatagctaagat

SEQ ID NO: 2327878 - DNA, 17 bp, Homo sapiens
catgtatgtcttggaca

SEQ ID NO: 2327879 - DNA, 14 bp, Homo sapiens
catgtatttgagca

SEQ ID NO: 2327880 - DNA, 19 bp, Homo sapiens
catgtccaaacgtcctctt

SEQ ID NO: 2327881 - DNA, 13 bp, Homo sapiens
catgtccaaagag

SEQ ID NO: 2327882 - DNA, 19 bp, Homo sapiens
catgtccaaagaggctgcc

SEQ ID NO: 2327883 - DNA, 24 bp, Homo sapiens
catgtccaagtccaacctgcctgt

SEQ ID NO: 2327884 - DNA, 23 bp, Homo sapiens
catgtccatacactttgttgcaa

SEQ ID NO: 2327885 - DNA, 14 bp, Homo sapiens
catgtcctgtaaag

SEQ ID NO: 2327886 - DNA, 15 bp, Homo sapiens
catgtcctgtaaagg

SEQ ID NO: 2327887 - DNA, 19 bp, Homo sapiens
catgtcgccaaaaatacag

SEQ ID NO: 2327888 - DNA, 16 bp, Homo sapiens
catgtctattcagctt

SEQ ID NO: 2327889 - DNA, 15 bp, Homo sapiens
catgtcttgtacatg

SEQ ID NO: 2327890 - DNA, 12 bp, Homo sapiens
catgtgaaacct

SEQ ID NO: 2327891 - DNA, 22 bp, Homo sapiens
catgtgaaaccttttttaagat

SEQ ID NO: 2327892 - DNA, 20 bp, Homo sapiens
catgtgagcatgtcacttcc

SEQ ID NO: 2327893 - DNA, 15 bp, Homo sapiens
catgtgatacatttt

SEQ ID NO: 2327894 - DNA, 22 bp, Homo sapiens
catgtgatacattttttaagct

SEQ ID NO: 2327895 - DNA, 18 bp, Homo sapiens
catgtgatggacactcca

SEQ ID NO: 2327896 - DNA, 20 bp, Homo sapiens
catgtgatggacactccagg

SEQ ID NO: 2327897 - DNA, 16 bp, Homo sapiens
catgtgcatagtttct

SEQ ID NO: 2327898 - DNA, 18 bp, Homo sapiens
catgtgcatagtttcttt

SEQ ID NO: 2327899 - DNA, 24 bp, Homo sapiens
catgtggcctttatctcaacggaa

SEQ ID NO: 2327900 - DNA, 18 bp, Homo sapiens
catgtgtagcctgtgcat

SEQ ID NO: 2327901 - DNA, 20 bp, Homo sapiens
catgttcaaattttatcatg

SEQ ID NO: 2327902 - DNA, 13 bp, Homo sapiens
catgttcctcctt

SEQ ID NO: 2327903 - DNA, 22 bp, Homo sapiens
catgttctccattttcaagctg

SEQ ID NO: 2327904 - DNA, 17 bp, Homo sapiens
catgttgcccctttctc

SEQ ID NO: 2327905 - DNA, 22 bp, Homo sapiens
catgttgcccctttctcttttc

SEQ ID NO: 2327906 - DNA, 13 bp, Homo sapiens
cattaaagtcaga

SEQ ID NO: 2327907 - DNA, 17 bp, Homo sapiens
cattaaagtcagaagtt

SEQ ID NO: 2327908 - DNA, 17 bp, Homo sapiens
cattaacggtgctaaaa

SEQ ID NO: 2327909 - DNA, 21 bp, Homo sapiens
cattaactatttttttcaaag

SEQ ID NO: 2327910 - DNA, 22 bp, Homo sapiens
cattaattagttccagtttctc

SEQ ID NO: 2327911 - DNA, 14 bp, Homo sapiens
cattacatggctgt

SEQ ID NO: 2327912 - DNA, 15 bp, Homo sapiens
cattacatggctgtg

SEQ ID NO: 2327913 - DNA, 17 bp, Homo sapiens
cattacatggctgtggt

SEQ ID NO: 2327914 - DNA, 13 bp, Homo sapiens
cattaccttactg

SEQ ID NO: 2327915 - DNA, 17 bp, Homo sapiens
cattaccttactgtgga

SEQ ID NO: 2327916 - DNA, 13 bp, Homo sapiens
cattactgtcccc

SEQ ID NO: 2327917 - DNA, 18 bp, Homo sapiens
cattagagagtggcaata

SEQ ID NO: 2327918 - DNA, 17 bp, Homo sapiens
cattagagtcaactaca

SEQ ID NO: 2327919 - DNA, 20 bp, Homo sapiens
cattatgttagagaggtagc

SEQ ID NO: 2327920 - DNA, 17 bp, Homo sapiens
cattattaaattgtaaa

SEQ ID NO: 2327921 - DNA, 12 bp, Homo sapiens
cattatttcaaa

SEQ ID NO: 2327922 - DNA, 17 bp, Homo sapiens
cattatttcaaaatgat

SEQ ID NO: 2327923 - DNA, 14 bp, Homo sapiens
cattcagaaatgtt

SEQ ID NO: 2327924 - DNA, 16 bp, Homo sapiens
cattcatttttatagc

SEQ ID NO: 2327925 - DNA, 22 bp, Homo sapiens
cattccagctgtcactctgtgc

SEQ ID NO: 2327926 - DNA, 17 bp, Homo sapiens
cattccagtacagtatt

SEQ ID NO: 2327927 - DNA, 23 bp, Homo sapiens
cattccagtacagtattctttta

SEQ ID NO: 2327928 - DNA, 14 bp, Homo sapiens
cattcccatgtgga

SEQ ID NO: 2327929 - DNA, 18 bp, Homo sapiens
cattcccatgtggaacag

SEQ ID NO: 2327930 - DNA, 16 bp, Homo sapiens
cattccctacagccta

SEQ ID NO: 2327931 - DNA, 14 bp, Homo sapiens
cattcctctgccct

SEQ ID NO: 2327932 - DNA, 19 bp, Homo sapiens
cattccttctttgataatg

SEQ ID NO: 2327933 - DNA, 15 bp, Homo sapiens
cattccttgcgcctc

SEQ ID NO: 2327934 - DNA, 17 bp, Homo sapiens
cattccttgcgcctcag

SEQ ID NO: 2327935 - DNA, 20 bp, Homo sapiens
cattccttgcgcctcagccc

SEQ ID NO: 2327936 - DNA, 20 bp, Homo sapiens
cattcgaggtgtcaccctgc

SEQ ID NO: 2327937 - DNA, 14 bp, Homo sapiens
cattctcaggcacc

SEQ ID NO: 2327938 - DNA, 16 bp, Homo sapiens
cattctcaggcaccag

SEQ ID NO: 2327939 - DNA, 15 bp, Homo sapiens
cattctcccaggtac

SEQ ID NO: 2327940 - DNA, 21 bp, Homo sapiens
cattctgaattaattaatttg

SEQ ID NO: 2327941 - DNA, 21 bp, Homo sapiens
cattctgccgccccctcctga

SEQ ID NO: 2327942 - DNA, 22 bp, Homo sapiens
cattctgccgccccctcctgaa

SEQ ID NO: 2327943 - DNA, 18 bp, Homo sapiens
cattctggaaacttttgt

SEQ ID NO: 2327944 - DNA, 20 bp, Homo sapiens
cattctggggaaacaacatt

SEQ ID NO: 2327945 - DNA, 18 bp, Homo sapiens
cattcttactaaaaagta

SEQ ID NO: 2327946 - DNA, 19 bp, Homo sapiens
cattcttactaaaaagtat

SEQ ID NO: 2327947 - DNA, 16 bp, Homo sapiens
cattgacttttataaa

SEQ ID NO: 2327948 - DNA, 9 bp, Homo sapiens
cattgagta

SEQ ID NO: 2327949 - DNA, 10 bp, Homo sapiens
cattgagtat

SEQ ID NO: 2327950 - DNA, 23 bp, Homo sapiens
cattggagtctcatttgggctag

SEQ ID NO: 2327951 - DNA, 18 bp, Homo sapiens
cattgggcacagtccaga

SEQ ID NO: 2327952 - DNA, 19 bp, Homo sapiens
cattgtacttaaacctcct

SEQ ID NO: 2327953 - DNA, 13 bp, Homo sapiens
catttaaaacaga

SEQ ID NO: 2327954 - DNA, 17 bp, Homo sapiens
catttaaaacagacact

SEQ ID NO: 2327955 - DNA, 12 bp, Homo sapiens
catttaaatttt

SEQ ID NO: 2327956 - DNA, 14 bp, Homo sapiens
catttaataaagat

SEQ ID NO: 2327957 - DNA, 19 bp, Homo sapiens
catttaataaagatgagtt

SEQ ID NO: 2327958 - DNA, 12 bp, Homo sapiens
catttagaaaag

SEQ ID NO: 2327959 - DNA, 15 bp, Homo sapiens
catttagaaatgttt

SEQ ID NO: 2327960 - DNA, 13 bp, Homo sapiens
catttagaagaaa

SEQ ID NO: 2327961 - DNA, 15 bp, Homo sapiens
catttagcacagtat

SEQ ID NO: 2327962 - DNA, 16 bp, Homo sapiens
catttagcacagtatt

SEQ ID NO: 2327963 - DNA, 17 bp, Homo sapiens
catttagcacagtattt

SEQ ID NO: 2327964 - DNA, 20 bp, Homo sapiens
caagtgctggagtctcctga

SEQ ID NO: 2327965 - DNA, 15 bp, Homo sapiens
caagtggggtgctgg

SEQ ID NO: 2327966 - DNA, 19 bp, Homo sapiens
caagtggggtgctgggagg

SEQ ID NO: 2327967 - DNA, 19 bp, Homo sapiens
caagtgtgctaaaaatgag

SEQ ID NO: 2327968 - DNA, 15 bp, Homo sapiens
caagtgttcactgct

SEQ ID NO: 2327969 - DNA, 18 bp, Homo sapiens
caagttccaagttgctaa

SEQ ID NO: 2327970 - DNA, 15 bp, Homo sapiens
caagttttaaagttc

SEQ ID NO: 2327971 - DNA, 16 bp, Homo sapiens
caataaagcactgagc

SEQ ID NO: 2327972 - DNA, 14 bp, Homo sapiens
caataaatgtctgt

SEQ ID NO: 2327973 - DNA, 12 bp, Homo sapiens
caataacagctg

SEQ ID NO: 2327974 - DNA, 21 bp, Homo sapiens
caataaccgcttggtttgcaa

SEQ ID NO: 2327975 - DNA, 15 bp, Homo sapiens
caataagaaacagtt

SEQ ID NO: 2327976 - DNA, 23 bp, Homo sapiens
caataagaaacagtttaacagaa

SEQ ID NO: 2327977 - DNA, 22 bp, Homo sapiens
caatacccttttaagtttaaaa

SEQ ID NO: 2327978 - DNA, 13 bp, Homo sapiens
caatacttagaga

SEQ ID NO: 2327979 - DNA, 15 bp, Homo sapiens
caatagatctccagc

SEQ ID NO: 2327980 - DNA, 15 bp, Homo sapiens
caatagggtgcagtt

SEQ ID NO: 2327981 - DNA, 15 bp, Homo sapiens
caatatattgaactt

SEQ ID NO: 2327982 - DNA, 21 bp, Homo sapiens
caatattgattgggaaaacat

SEQ ID NO: 2327983 - DNA, 17 bp, Homo sapiens
caatatttactcatcag

SEQ ID NO: 2327984 - DNA, 16 bp, Homo sapiens
caatatttttatatca

SEQ ID NO: 2327985 - DNA, 18 bp, Homo sapiens
caatcaaggttataattt

SEQ ID NO: 2327986 - DNA, 19 bp, Homo sapiens
caatcaaggttataatttt

SEQ ID NO: 2327987 - DNA, 20 bp, Homo sapiens
caatcaaggttataattttt

SEQ ID NO: 2327988 - DNA, 16 bp, Homo sapiens
caatccacctgccttg

SEQ ID NO: 2327989 - DNA, 21 bp, Homo sapiens
caatcctaatttctcctccct

SEQ ID NO: 2327990 - DNA, 13 bp, Homo sapiens
caatcctcctgcc

SEQ ID NO: 2327991 - DNA, 20 bp, Homo sapiens
caatcctcctgcctcagcct

SEQ ID NO: 2327992 - DNA, 14 bp, Homo sapiens
caatcggactgcca

SEQ ID NO: 2327993 - DNA, 15 bp, Homo sapiens
caatcggactgccaa

SEQ ID NO: 2327994 - DNA, 21 bp, Homo sapiens
caatctatggcttatttctat

SEQ ID NO: 2327995 - DNA, 22 bp, Homo sapiens
caatctcttcattattctctgc

SEQ ID NO: 2327996 - DNA, 14 bp, Homo sapiens
caatctctttttgt

SEQ ID NO: 2327997 - DNA, 17 bp, Homo sapiens
caatctgtaaactgtgt

SEQ ID NO: 2327998 - DNA, 19 bp, Homo sapiens
caatgaaatgaattaaagt

SEQ ID NO: 2327999 - DNA, 15 bp, Homo sapiens
caatgaaccataaat

SEQ ID NO: 2328000 - DNA, 16 bp, Homo sapiens
caatgaaccataaatt

SEQ ID NO: 2328001 - DNA, 19 bp, Homo sapiens
caatgaggcagatagcact

SEQ ID NO: 2328002 - DNA, 15 bp, Homo sapiens
caatgataatgctaa

SEQ ID NO: 2328003 - DNA, 13 bp, Homo sapiens
caatgcttgtaga

SEQ ID NO: 2328004 - DNA, 20 bp, Homo sapiens
caatgcttgtagaagtagga

SEQ ID NO: 2328005 - DNA, 18 bp, Homo sapiens
caatgtgcataatgataa

SEQ ID NO: 2328006 - DNA, 22 bp, Homo sapiens
caatgtgcataatgataaaata

SEQ ID NO: 2328007 - DNA, 20 bp, Homo sapiens
caatgttaaggaaactctta

SEQ ID NO: 2328008 - DNA, 21 bp, Homo sapiens
caattatttgaagatttaatt

SEQ ID NO: 2328009 - DNA, 14 bp, Homo sapiens
caattcagacccct

SEQ ID NO: 2328010 - DNA, 17 bp, Homo sapiens
caattgggagctgccaa

SEQ ID NO: 2328011 - DNA, 21 bp, Homo sapiens
caattggtaaaactcactgtg

SEQ ID NO: 2328012 - DNA, 14 bp, Homo sapiens
caatttatgaattg

SEQ ID NO: 2328013 - DNA, 23 bp, Homo sapiens
caattttatgtttttatttatga

SEQ ID NO: 2328014 - DNA, 13 bp, Homo sapiens
cacaaaaaattta

SEQ ID NO: 2328015 - DNA, 21 bp, Homo sapiens
cacaaaacctgtattactgaa

SEQ ID NO: 2328016 - DNA, 13 bp, Homo sapiens
cacaaaccctgct

SEQ ID NO: 2328017 - DNA, 16 bp, Homo sapiens
cacaaagctatttaag

SEQ ID NO: 2328018 - DNA, 17 bp, Homo sapiens
cacaaagcttctaaagc

SEQ ID NO: 2328019 - DNA, 11 bp, Homo sapiens
cacaaaggaag

SEQ ID NO: 2328020 - DNA, 16 bp, Homo sapiens
cacaaatccttcaaaa

SEQ ID NO: 2328021 - DNA, 22 bp, Homo sapiens
cacaagcaaaaaaaaaaaaaag

SEQ ID NO: 2328022 - DNA, 20 bp, Homo sapiens
cacaagctgcactgtgaacc

SEQ ID NO: 2328023 - DNA, 18 bp, Homo sapiens
cacaatgcagttctgagc

SEQ ID NO: 2328024 - DNA, 13 bp, Homo sapiens
cacacacacacac

SEQ ID NO: 2328025 - DNA, 16 bp, Homo sapiens
cacacacacacacaca

SEQ ID NO: 2328026 - DNA, 14 bp, Homo sapiens
cacacacacacacg

SEQ ID NO: 2328027 - DNA, 15 bp, Homo sapiens
cacacacacgatgca

SEQ ID NO: 2328028 - DNA, 16 bp, Homo sapiens
cacacacacgatgcat

SEQ ID NO: 2328029 - DNA, 21 bp, Homo sapiens
cacacacgatgcatttaataa

SEQ ID NO: 2328030 - DNA, 22 bp, Homo sapiens
cacacacgatgcatttaataaa

SEQ ID NO: 2328031 - DNA, 13 bp, Homo sapiens
cacacagccccta

SEQ ID NO: 2328032 - DNA, 23 bp, Homo sapiens
cacacccgccctgtgtgtgtccc

SEQ ID NO: 2328033 - DNA, 22 bp, Homo sapiens
cacacctactagtcaccagaga

SEQ ID NO: 2328034 - DNA, 16 bp, Homo sapiens
cacacctcacgctctg

SEQ ID NO: 2328035 - DNA, 19 bp, Homo sapiens
cacacctcacgctctggac

SEQ ID NO: 2328036 - DNA, 18 bp, Homo sapiens
cacacgatgcatttaata

SEQ ID NO: 2328037 - DNA, 21 bp, Homo sapiens
cacacgatgcatttaataaag

SEQ ID NO: 2328038 - DNA, 14 bp, Homo sapiens
cacactcccaaggt

SEQ ID NO: 2328039 - DNA, 21 bp, Homo sapiens
cacactcccaaggttggagcc

SEQ ID NO: 2328040 - DNA, 23 bp, Homo sapiens
cacactcccaaggttggagccca

SEQ ID NO: 2328041 - DNA, 22 bp, Homo sapiens
cacacttcttgaaacagcctgg

SEQ ID NO: 2328042 - DNA, 17 bp, Homo sapiens
cacagaaatgctgctgg

SEQ ID NO: 2328043 - DNA, 18 bp, Homo sapiens
cacagaatatttttatat

SEQ ID NO: 2328044 - DNA, 21 bp, Homo sapiens
cacagcaagtacagcggctcc

SEQ ID NO: 2328045 - DNA, 23 bp, Homo sapiens
cacagcagtgtgaatagcctggc

SEQ ID NO: 2328046 - DNA, 11 bp, Homo sapiens
cacagccagag

SEQ ID NO: 2328047 - DNA, 12 bp, Homo sapiens
cacagccagagg

SEQ ID NO: 2328048 - DNA, 22 bp, Homo sapiens
cacagcccctatagcactgagc

SEQ ID NO: 2328049 - DNA, 20 bp, Homo sapiens
cacagcctagcacagcagct

SEQ ID NO: 2328050 - DNA, 17 bp, Homo sapiens
cacagcgagggcagctg

SEQ ID NO: 2328051 - DNA, 18 bp, Homo sapiens
cacagcgagggcagctgc

SEQ ID NO: 2328052 - DNA, 14 bp, Homo sapiens
cacagcgccagcct

SEQ ID NO: 2328053 - DNA, 16 bp, Homo sapiens
cacagcgccagcctca

SEQ ID NO: 2328054 - DNA, 15 bp, Homo sapiens
cacagcgtccctggc

SEQ ID NO: 2328055 - DNA, 15 bp, Homo sapiens
cacagctcaggaggc

SEQ ID NO: 2328056 - DNA, 19 bp, Homo sapiens
cacagctgctgttctcagg

SEQ ID NO: 2328057 - DNA, 24 bp, Homo sapiens
cacagctgctgttctcaggacagc

SEQ ID NO: 2328058 - DNA, 13 bp, Homo sapiens
cacaggacagcgg

SEQ ID NO: 2328059 - DNA, 22 bp, Homo sapiens
cacaggagggcggcctccttct

SEQ ID NO: 2328060 - DNA, 14 bp, Homo sapiens
cacagtagagccag

SEQ ID NO: 2328061 - DNA, 16 bp, Homo sapiens
cacagtagagccagct

SEQ ID NO: 2328062 - DNA, 14 bp, Homo sapiens
cacagtatttaaca

SEQ ID NO: 2328063 - DNA, 14 bp, Homo sapiens
cacagtattttgat

SEQ ID NO: 2328064 - DNA, 16 bp, Homo sapiens
cacagtccaaccagaa

SEQ ID NO: 2328065 - DNA, 18 bp, Homo sapiens
cacagtccaaccagaaac

SEQ ID NO: 2328066 - DNA, 18 bp, Homo sapiens
cacagtccagacccaagt

SEQ ID NO: 2328067 - DNA, 20 bp, Homo sapiens
cacagtgggatgaaccagcc

SEQ ID NO: 2328068 - DNA, 12 bp, Homo sapiens
cacagtgtctgt

SEQ ID NO: 2328069 - DNA, 20 bp, Homo sapiens
cacagtgtctgttcagcaaa

SEQ ID NO: 2328070 - DNA, 17 bp, Homo sapiens
cacagtgttgtgcccct

SEQ ID NO: 2328071 - DNA, 20 bp, Homo sapiens
cacatacacccaaacactta

SEQ ID NO: 2328072 - DNA, 11 bp, Homo sapiens
cacatactgtc

SEQ ID NO: 2328073 - DNA, 23 bp, Homo sapiens
cacatagcatgcttcctttctct

SEQ ID NO: 2328074 - DNA, 18 bp, Homo sapiens
cacatatccaggcaccag

SEQ ID NO: 2328075 - DNA, 22 bp, Homo sapiens
cacatatgcaccttgtgtctgt

SEQ ID NO: 2328076 - DNA, 12 bp, Homo sapiens
cacatccatccc

SEQ ID NO: 2328077 - DNA, 14 bp, Homo sapiens
cacatccccctctc

SEQ ID NO: 2328078 - DNA, 13 bp, Homo sapiens
cacatctgcctta

SEQ ID NO: 2328079 - DNA, 14 bp, Homo sapiens
cacatcttaaaagt

SEQ ID NO: 2328080 - DNA, 15 bp, Homo sapiens
cacatgggactggga

SEQ ID NO: 2328081 - DNA, 20 bp, Homo sapiens
cacatgtcttgtacatgtgt

SEQ ID NO: 2328082 - DNA, 17 bp, Homo sapiens
cacattaatctcaaaga

SEQ ID NO: 2328083 - DNA, 13 bp, Homo sapiens
cacattaatgata

SEQ ID NO: 2328084 - DNA, 18 bp, Homo sapiens
cacattatgttagagagg

SEQ ID NO: 2328085 - DNA, 21 bp, Homo sapiens
cacattatgttagagaggtag

SEQ ID NO: 2328086 - DNA, 23 bp, Homo sapiens
cacattgaaactgtatttacttg

SEQ ID NO: 2328087 - DNA, 23 bp, Homo sapiens
cacattgaagaatgttagagtaa

SEQ ID NO: 2328088 - DNA, 18 bp, Homo sapiens
cacatttaccctttggcc

SEQ ID NO: 2328089 - DNA, 15 bp, Homo sapiens
cacatttctttgcat

SEQ ID NO: 2328090 - DNA, 19 bp, Homo sapiens
cacatttctttgcattcca

SEQ ID NO: 2328091 - DNA, 17 bp, Homo sapiens
cacattttttaggaaat

SEQ ID NO: 2328092 - DNA, 13 bp, Homo sapiens
caccaaaaacaaa

SEQ ID NO: 2328093 - DNA, 14 bp, Homo sapiens
caccaaagctgccc

SEQ ID NO: 2328094 - DNA, 17 bp, Homo sapiens
caccacatagcatgctt

SEQ ID NO: 2328095 - DNA, 20 bp, Homo sapiens
caccaccctgctcatccact

SEQ ID NO: 2328096 - DNA, 16 bp, Homo sapiens
caccacgattctccca

SEQ ID NO: 2328097 - DNA, 16 bp, Homo sapiens
caccactttcccacac

SEQ ID NO: 2328098 - DNA, 21 bp, Homo sapiens
caccagccccactgccagcag

SEQ ID NO: 2328099 - DNA, 18 bp, Homo sapiens
caccagcccccgccccag

SEQ ID NO: 2328100 - DNA, 23 bp, Homo sapiens
caccagcccccgccccagagtgg

SEQ ID NO: 2328101 - DNA, 16 bp, Homo sapiens
caccaggactagggct

SEQ ID NO: 2328102 - DNA, 17 bp, Homo sapiens
caccaggccgtgccttg

SEQ ID NO: 2328103 - DNA, 20 bp, Homo sapiens
caccagtccctgtccggaat

SEQ ID NO: 2328104 - DNA, 23 bp, Homo sapiens
caccatacgagcacctccagcct

SEQ ID NO: 2328105 - DNA, 17 bp, Homo sapiens
caccatactccttgctt

SEQ ID NO: 2328106 - DNA, 18 bp, Homo sapiens
caccatactccttgcttc

SEQ ID NO: 2328107 - DNA, 14 bp, Homo sapiens
caccatatgaattg

SEQ ID NO: 2328108 - DNA, 24 bp, Homo sapiens
cacccaaccctatctcctgacaga

SEQ ID NO: 2328109 - DNA, 21 bp, Homo sapiens
cacccaggggaaggccctgag

SEQ ID NO: 2328110 - DNA, 15 bp, Homo sapiens
caccccaacctgctc

SEQ ID NO: 2328111 - DNA, 13 bp, Homo sapiens
cacccctctgtct

SEQ ID NO: 2328112 - DNA, 23 bp, Homo sapiens
cacccctctgtctaggactgcag

SEQ ID NO: 2328113 - DNA, 19 bp, Homo sapiens
cacccctggaagagcccag

SEQ ID NO: 2328114 - DNA, 12 bp, Homo sapiens
cacccctgtgct

SEQ ID NO: 2328115 - DNA, 20 bp, Homo sapiens
caccctcactggctctcctg

SEQ ID NO: 2328116 - DNA, 12 bp, Homo sapiens
caccctcttcct

SEQ ID NO: 2328117 - DNA, 15 bp, Homo sapiens
caccctcttcctgtg

SEQ ID NO: 2328118 - DNA, 19 bp, Homo sapiens
caccctgcagagctatggt

SEQ ID NO: 2328119 - DNA, 13 bp, Homo sapiens
caccctgcctgcc

SEQ ID NO: 2328120 - DNA, 14 bp, Homo sapiens
caccctgcgggcca

SEQ ID NO: 2328121 - DNA, 17 bp, Homo sapiens
caccctgcgggccaggg

SEQ ID NO: 2328122 - DNA, 20 bp, Homo sapiens
caccctgcgggccagggtcc

SEQ ID NO: 2328123 - DNA, 22 bp, Homo sapiens
caccctgcgggccagggtcctg

SEQ ID NO: 2328124 - DNA, 23 bp, Homo sapiens
cacccttctcccactctcctagg

SEQ ID NO: 2328125 - DNA, 15 bp, Homo sapiens
caccgactgaaaata

SEQ ID NO: 2328126 - DNA, 14 bp, Homo sapiens
caccgcccatcagg

SEQ ID NO: 2328127 - DNA, 19 bp, Homo sapiens
caccggcctgtgggtctct

SEQ ID NO: 2328128 - DNA, 16 bp, Homo sapiens
caccgtgaaccagagg

SEQ ID NO: 2328129 - DNA, 17 bp, Homo sapiens
caccgtgaaccagaggg

SEQ ID NO: 2328130 - DNA, 18 bp, Homo sapiens
caccgtgaaccagagggt

SEQ ID NO: 2328131 - DNA, 16 bp, Homo sapiens
caccgtgcctggccag

SEQ ID NO: 2328132 - DNA, 14 bp, Homo sapiens
caccgtgcctggct

SEQ ID NO: 2328133 - DNA, 20 bp, Homo sapiens
caccgtgtcaagctgctctg

SEQ ID NO: 2328134 - DNA, 18 bp, Homo sapiens
cacctacacccctgtgct

SEQ ID NO: 2328135 - DNA, 22 bp, Homo sapiens
cacctacttttctttcctcaga

SEQ ID NO: 2328136 - DNA, 16 bp, Homo sapiens
cacctcacgctctgga

SEQ ID NO: 2328137 - DNA, 18 bp, Homo sapiens
cacctcacgctctggaca

SEQ ID NO: 2328138 - DNA, 14 bp, Homo sapiens
cacctcatgcccac

SEQ ID NO: 2328139 - DNA, 15 bp, Homo sapiens
cacctcatgcccacc

SEQ ID NO: 2328140 - DNA, 17 bp, Homo sapiens
cacctcatgcccacccc

SEQ ID NO: 2328141 - DNA, 19 bp, Homo sapiens
cacctcatgcccaccccct

SEQ ID NO: 2328142 - DNA, 22 bp, Homo sapiens
cacctcatgcccaccccctgcc

SEQ ID NO: 2328143 - DNA, 19 bp, Homo sapiens
cacctccaagcatttcatg

SEQ ID NO: 2328144 - DNA, 14 bp, Homo sapiens
cacctccagcctga

SEQ ID NO: 2328145 - DNA, 19 bp, Homo sapiens
cacctcctgacacccttct

SEQ ID NO: 2328146 - DNA, 20 bp, Homo sapiens
cacctctttaaaaactcact

SEQ ID NO: 2328147 - DNA, 20 bp, Homo sapiens
cacctgacttggctggggag

SEQ ID NO: 2328148 - DNA, 14 bp, Homo sapiens
cacctgagacccta

SEQ ID NO: 2328149 - DNA, 17 bp, Homo sapiens
cacctgagaccctactg

SEQ ID NO: 2328150 - DNA, 18 bp, Homo sapiens
cacctgccttggcctccc

SEQ ID NO: 2328151 - DNA, 11 bp, Homo sapiens
cacctgctgga

SEQ ID NO: 2328152 - DNA, 16 bp, Homo sapiens
cacctggctctcacct

SEQ ID NO: 2328153 - DNA, 21 bp, Homo sapiens
cacctggctgaggttcctctg

SEQ ID NO: 2328154 - DNA, 16 bp, Homo sapiens
cacctgtagtcccagc

SEQ ID NO: 2328155 - DNA, 21 bp, Homo sapiens
caccttcccttctacaaggac

SEQ ID NO: 2328156 - DNA, 19 bp, Homo sapiens
caccttgacgtttcttctt

SEQ ID NO: 2328157 - DNA, 13 bp, Homo sapiens
caccttgccaggg

SEQ ID NO: 2328158 - DNA, 14 bp, Homo sapiens
caccttgccagggc

SEQ ID NO: 2328159 - DNA, 17 bp, Homo sapiens
caccttgccagggcagg

SEQ ID NO: 2328160 - DNA, 18 bp, Homo sapiens
caccttgccgagagaggc

SEQ ID NO: 2328161 - DNA, 23 bp, Homo sapiens
cacctttgggatcagcctccgcc

SEQ ID NO: 2328162 - DNA, 16 bp, Homo sapiens
caccttttctgtggct

SEQ ID NO: 2328163 - DNA, 12 bp, Homo sapiens
cacgactcttcc

SEQ ID NO: 2328164 - DNA, 19 bp, Homo sapiens
cacgactcttcctgcaaag

SEQ ID NO: 2328165 - DNA, 14 bp, Homo sapiens
cacgagcaaaccca

SEQ ID NO: 2328166 - DNA, 13 bp, Homo sapiens
cacgagccacaag

SEQ ID NO: 2328167 - DNA, 18 bp, Homo sapiens
cacgagccacaagctgca

SEQ ID NO: 2328168 - DNA, 18 bp, Homo sapiens
cacgatgcatttaataaa

SEQ ID NO: 2328169 - DNA, 19 bp, Homo sapiens
cacgatgcatttaataaag

SEQ ID NO: 2328170 - DNA, 20 bp, Homo sapiens
cacgatgcatttaataaaga

SEQ ID NO: 2328171 - DNA, 21 bp, Homo sapiens
cacgatttgcaggattccctt

SEQ ID NO: 2328172 - DNA, 23 bp, Homo sapiens
cacgcactgggttgcgggacaga

SEQ ID NO: 2328173 - DNA, 21 bp, Homo sapiens
cacgcagaggacgcacgctcg

SEQ ID NO: 2328174 - DNA, 21 bp, Homo sapiens
cacgcccttcaatgctgcagg

SEQ ID NO: 2328175 - DNA, 14 bp, Homo sapiens
cacgctcgctgcca

SEQ ID NO: 2328176 - DNA, 15 bp, Homo sapiens
cacgctcgctgccat

SEQ ID NO: 2328177 - DNA, 18 bp, Homo sapiens
cacgctcgctgccatcac

SEQ ID NO: 2328178 - DNA, 14 bp, Homo sapiens
cacgctctggacat

SEQ ID NO: 2328179 - DNA, 14 bp, Homo sapiens
cacgctttcctgaa

SEQ ID NO: 2328180 - DNA, 24 bp, Homo sapiens
cacggaaacatacagaggatgcct

SEQ ID NO: 2328181 - DNA, 22 bp, Homo sapiens
cacggggttccctcctagctct

SEQ ID NO: 2328182 - DNA, 15 bp, Homo sapiens
cacgggtggtccccg

SEQ ID NO: 2328183 - DNA, 13 bp, Homo sapiens
cactaaatcagag

SEQ ID NO: 2328184 - DNA, 14 bp, Homo sapiens
cactaactcaccag

SEQ ID NO: 2328185 - DNA, 19 bp, Homo sapiens
cactaactcaccagcccca

SEQ ID NO: 2328186 - DNA, 17 bp, Homo sapiens
cactagcattttcttga

SEQ ID NO: 2328187 - DNA, 19 bp, Homo sapiens
cactagcccaatgaaatga

SEQ ID NO: 2328188 - DNA, 14 bp, Homo sapiens
cactcagtgagcct

SEQ ID NO: 2328189 - DNA, 21 bp, Homo sapiens
cactccaagcccagcccatgg

SEQ ID NO: 2328190 - DNA, 16 bp, Homo sapiens
cactccacctccaccc

SEQ ID NO: 2328191 - DNA, 15 bp, Homo sapiens
cactccagcctgggg

SEQ ID NO: 2328192 - DNA, 19 bp, Homo sapiens
cactccagttttctcctct

SEQ ID NO: 2328193 - DNA, 19 bp, Homo sapiens
cactcccaaggttggagcc

SEQ ID NO: 2328194 - DNA, 20 bp, Homo sapiens
cactcccaaggttggagccc

SEQ ID NO: 2328195 - DNA, 14 bp, Homo sapiens
cactcccctagggg

SEQ ID NO: 2328196 - DNA, 22 bp, Homo sapiens
cactccgcgccgatgccaccgg

SEQ ID NO: 2328197 - DNA, 15 bp, Homo sapiens
cagacctcatgccca

SEQ ID NO: 2328198 - DNA, 17 bp, Homo sapiens
cagacctcatgcccagc

SEQ ID NO: 2328199 - DNA, 15 bp, Homo sapiens
cagacgtcaggccct

SEQ ID NO: 2328200 - DNA, 20 bp, Homo sapiens
cagactaaaggatccagaga

SEQ ID NO: 2328201 - DNA, 22 bp, Homo sapiens
cagactaaaggatccagagagc

SEQ ID NO: 2328202 - DNA, 22 bp, Homo sapiens
cagactctttttttgagtgaca

SEQ ID NO: 2328203 - DNA, 23 bp, Homo sapiens
cagactctttttttgagtgacag

SEQ ID NO: 2328204 - DNA, 14 bp, Homo sapiens
cagactggggcatc

SEQ ID NO: 2328205 - DNA, 14 bp, Homo sapiens
cagactgtgcaata

SEQ ID NO: 2328206 - DNA, 15 bp, Homo sapiens
cagactgttgagtta

SEQ ID NO: 2328207 - DNA, 18 bp, Homo sapiens
cagagaaaaatgctcccc

SEQ ID NO: 2328208 - DNA, 23 bp, Homo sapiens
cagagaaaaatgctccccacagc

SEQ ID NO: 2328209 - DNA, 20 bp, Homo sapiens
cagagaaatctaagctgtgt

SEQ ID NO: 2328210 - DNA, 15 bp, Homo sapiens
cagagaaattctgtg

SEQ ID NO: 2328211 - DNA, 22 bp, Homo sapiens
cagagacaacaggtaaaacagg

SEQ ID NO: 2328212 - DNA, 22 bp, Homo sapiens
cagagacagaggatgtggcctg

SEQ ID NO: 2328213 - DNA, 20 bp, Homo sapiens
cagagagaaataagtgccct

SEQ ID NO: 2328214 - DNA, 16 bp, Homo sapiens
cagagagacccttgtg

SEQ ID NO: 2328215 - DNA, 22 bp, Homo sapiens
cagagagaggggagaagcctgg

SEQ ID NO: 2328216 - DNA, 21 bp, Homo sapiens
cagagagccattttgtgaatg

SEQ ID NO: 2328217 - DNA, 23 bp, Homo sapiens
cagagagccattttgtgaatgga

SEQ ID NO: 2328218 - DNA, 20 bp, Homo sapiens
cagagatttctcattgactt

SEQ ID NO: 2328219 - DNA, 20 bp, Homo sapiens
cagagcaagagtctgtctca

SEQ ID NO: 2328220 - DNA, 20 bp, Homo sapiens
cagagcaagtcctcactctt

SEQ ID NO: 2328221 - DNA, 14 bp, Homo sapiens
cagagcagatgcag

SEQ ID NO: 2328222 - DNA, 15 bp, Homo sapiens
cagagcagatgcaga

SEQ ID NO: 2328223 - DNA, 19 bp, Homo sapiens
cagagcagatgcagagagc

SEQ ID NO: 2328224 - DNA, 20 bp, Homo sapiens
cagagcagatgcagagagcc

SEQ ID NO: 2328225 - DNA, 21 bp, Homo sapiens
cagagccatgtcttctccctg

SEQ ID NO: 2328226 - DNA, 15 bp, Homo sapiens
cagagccttctcaga

SEQ ID NO: 2328227 - DNA, 16 bp, Homo sapiens
cagagccttctcagaa

SEQ ID NO: 2328228 - DNA, 13 bp, Homo sapiens
cagagcgccagga

SEQ ID NO: 2328229 - DNA, 16 bp, Homo sapiens
cagagctatggtgagg

SEQ ID NO: 2328230 - DNA, 13 bp, Homo sapiens
cagagctctgggt

SEQ ID NO: 2328231 - DNA, 21 bp, Homo sapiens
cagagctctgggttgtgcaca

SEQ ID NO: 2328232 - DNA, 15 bp, Homo sapiens
cagagctggagcccc

SEQ ID NO: 2328233 - DNA, 18 bp, Homo sapiens
cagaggaatcctggcagc

SEQ ID NO: 2328234 - DNA, 19 bp, Homo sapiens
cagaggaatcctggcagcc

SEQ ID NO: 2328235 - DNA, 23 bp, Homo sapiens
cagaggaatcctggcagcccaga

SEQ ID NO: 2328236 - DNA, 20 bp, Homo sapiens
cagaggatgccttttctgtg

SEQ ID NO: 2328237 - DNA, 23 bp, Homo sapiens
cagaggatgccttttctgtgatt

SEQ ID NO: 2328238 - DNA, 18 bp, Homo sapiens
cagaggatgtggcctggt

SEQ ID NO: 2328239 - DNA, 15 bp, Homo sapiens
cagaggcaggctggg

SEQ ID NO: 2328240 - DNA, 23 bp, Homo sapiens
cagaggctgcacccctgggccag

SEQ ID NO: 2328241 - DNA, 20 bp, Homo sapiens
cagagggaaggggcctacac

SEQ ID NO: 2328242 - DNA, 15 bp, Homo sapiens
cagagggagaatcca

SEQ ID NO: 2328243 - DNA, 15 bp, Homo sapiens
cagagggtgtggctt

SEQ ID NO: 2328244 - DNA, 19 bp, Homo sapiens
cagagggtgtggctttcca

SEQ ID NO: 2328245 - DNA, 15 bp, Homo sapiens
cagaggtaacagaac

SEQ ID NO: 2328246 - DNA, 16 bp, Homo sapiens
cagaggtaacagaaca

SEQ ID NO: 2328247 - DNA, 22 bp, Homo sapiens
cagaggtagtctcactgcttga

SEQ ID NO: 2328248 - DNA, 18 bp, Homo sapiens
cagaggttgtgcactgtt

SEQ ID NO: 2328249 - DNA, 21 bp, Homo sapiens
cagagtcaccttttctgtggc

SEQ ID NO: 2328250 - DNA, 13 bp, Homo sapiens
cagagtccagtgc

SEQ ID NO: 2328251 - DNA, 17 bp, Homo sapiens
cagagtccagtgctctg

SEQ ID NO: 2328252 - DNA, 21 bp, Homo sapiens
cagagtgaaaaatcttaagta

SEQ ID NO: 2328253 - DNA, 16 bp, Homo sapiens
cagagtgatttgtaaa

SEQ ID NO: 2328254 - DNA, 13 bp, Homo sapiens
cagagtggcccac

SEQ ID NO: 2328255 - DNA, 12 bp, Homo sapiens
cagagtggtggg

SEQ ID NO: 2328256 - DNA, 17 bp, Homo sapiens
cagagttttcattaaat

SEQ ID NO: 2328257 - DNA, 22 bp, Homo sapiens
cagagttttcattaaatccttt

SEQ ID NO: 2328258 - DNA, 18 bp, Homo sapiens
cagataactctctttcct

SEQ ID NO: 2328259 - DNA, 13 bp, Homo sapiens
cagatcactgcca

SEQ ID NO: 2328260 - DNA, 15 bp, Homo sapiens
cagatcatccagaag

SEQ ID NO: 2328261 - DNA, 23 bp, Homo sapiens
cagatctgatttgtaacccactg

SEQ ID NO: 2328262 - DNA, 15 bp, Homo sapiens
cagatcttggactca

SEQ ID NO: 2328263 - DNA, 20 bp, Homo sapiens
cagatctttcagaaatataa

SEQ ID NO: 2328264 - DNA, 15 bp, Homo sapiens
cagatctttctcttc

SEQ ID NO: 2328265 - DNA, 20 bp, Homo sapiens
cagatctttctcttccctga

SEQ ID NO: 2328266 - DNA, 16 bp, Homo sapiens
cagatgcagagagcca

SEQ ID NO: 2328267 - DNA, 20 bp, Homo sapiens
cagatgccaccctagccaat

SEQ ID NO: 2328268 - DNA, 19 bp, Homo sapiens
cagatgcctgcttgataat

SEQ ID NO: 2328269 - DNA, 18 bp, Homo sapiens
cagatggaaaaactgagg

SEQ ID NO: 2328270 - DNA, 21 bp, Homo sapiens
cagatgggaactgaattgtgt

SEQ ID NO: 2328271 - DNA, 15 bp, Homo sapiens
cagatgtcttccctg

SEQ ID NO: 2328272 - DNA, 19 bp, Homo sapiens
cagatgtcttccctgggct

SEQ ID NO: 2328273 - DNA, 23 bp, Homo sapiens
cagatgtcttccctgggctgcca

SEQ ID NO: 2328274 - DNA, 15 bp, Homo sapiens
cagatgtgagccacc

SEQ ID NO: 2328275 - DNA, 20 bp, Homo sapiens
cagatgtgtcccccccaggc

SEQ ID NO: 2328276 - DNA, 16 bp, Homo sapiens
cagattctgcctctct

SEQ ID NO: 2328277 - DNA, 17 bp, Homo sapiens
cagattctgcctctctg

SEQ ID NO: 2328278 - DNA, 14 bp, Homo sapiens
cagattgctctgcc

SEQ ID NO: 2328279 - DNA, 17 bp, Homo sapiens
cagattgctctgcccca

SEQ ID NO: 2328280 - DNA, 17 bp, Homo sapiens
cagatttactaaatcaa

SEQ ID NO: 2328281 - DNA, 14 bp, Homo sapiens
cagatttctgagga

SEQ ID NO: 2328282 - DNA, 15 bp, Homo sapiens
cagattttcagcaaa

SEQ ID NO: 2328283 - DNA, 22 bp, Homo sapiens
cagattttcagcaaactctttt

SEQ ID NO: 2328284 - DNA, 18 bp, Homo sapiens
cagcaaacctctcctcat

SEQ ID NO: 2328285 - DNA, 19 bp, Homo sapiens
cagcaagtacagcggctcc

SEQ ID NO: 2328286 - DNA, 16 bp, Homo sapiens
cagcacttacaatttt

SEQ ID NO: 2328287 - DNA, 16 bp, Homo sapiens
cagcagaacctgcaca

SEQ ID NO: 2328288 - DNA, 15 bp, Homo sapiens
cagcagaagcctcca

SEQ ID NO: 2328289 - DNA, 12 bp, Homo sapiens
cagcagaggcag

SEQ ID NO: 2328290 - DNA, 15 bp, Homo sapiens
cagcagaggcaggct

SEQ ID NO: 2328291 - DNA, 14 bp, Homo sapiens
cagcagcagcaggt

SEQ ID NO: 2328292 - DNA, 16 bp, Homo sapiens
cagcagcagcccaagc

SEQ ID NO: 2328293 - DNA, 13 bp, Homo sapiens
cagcagcaggtga

SEQ ID NO: 2328294 - DNA, 13 bp, Homo sapiens
cagcagcccaagc

SEQ ID NO: 2328295 - DNA, 20 bp, Homo sapiens
cagcagcccaagcttccctc

SEQ ID NO: 2328296 - DNA, 21 bp, Homo sapiens
cagcaggtgattggaccaggc

SEQ ID NO: 2328297 - DNA, 18 bp, Homo sapiens
cagcagtgtggagaccct

SEQ ID NO: 2328298 - DNA, 19 bp, Homo sapiens
cagcagtgtggagaccctg

SEQ ID NO: 2328299 - DNA, 16 bp, Homo sapiens
cagcatcccttcccac

SEQ ID NO: 2328300 - DNA, 14 bp, Homo sapiens
cagcatctggaaga

SEQ ID NO: 2328301 - DNA, 18 bp, Homo sapiens
cagcatgtctattcagct

SEQ ID NO: 2328302 - DNA, 18 bp, Homo sapiens
cagcattctcaggcacca

SEQ ID NO: 2328303 - DNA, 19 bp, Homo sapiens
cagcattctcaggcaccag

SEQ ID NO: 2328304 - DNA, 18 bp, Homo sapiens
cagccagaggagggcaga

SEQ ID NO: 2328305 - DNA, 13 bp, Homo sapiens
cagccagcagcag

SEQ ID NO: 2328306 - DNA, 12 bp, Homo sapiens
cagccaggcaga

SEQ ID NO: 2328307 - DNA, 18 bp, Homo sapiens
cagccaggtttagcggca

SEQ ID NO: 2328308 - DNA, 16 bp, Homo sapiens
cagccagtgacctttg

SEQ ID NO: 2328309 - DNA, 15 bp, Homo sapiens
cagccagttcaaaaa

SEQ ID NO: 2328310 - DNA, 15 bp, Homo sapiens
cagccatcctccctc

SEQ ID NO: 2328311 - DNA, 16 bp, Homo sapiens
cagccatgccagctgg

SEQ ID NO: 2328312 - DNA, 17 bp, Homo sapiens
cagcccaatctgccaga

SEQ ID NO: 2328313 - DNA, 13 bp, Homo sapiens
cactcctctgctg

SEQ ID NO: 2328314 - DNA, 16 bp, Homo sapiens
cactcctctgctgacc

SEQ ID NO: 2328315 - DNA, 22 bp, Homo sapiens
cactcctctgctgacctgctga

SEQ ID NO: 2328316 - DNA, 21 bp, Homo sapiens
cactcctgacccctctcctca

SEQ ID NO: 2328317 - DNA, 19 bp, Homo sapiens
cactcctgcttaatcttca

SEQ ID NO: 2328318 - DNA, 15 bp, Homo sapiens
cactcctgtccctgt

SEQ ID NO: 2328319 - DNA, 19 bp, Homo sapiens
cactcctgtccctgtagct

SEQ ID NO: 2328320 - DNA, 14 bp, Homo sapiens
cactcgggtttctc

SEQ ID NO: 2328321 - DNA, 12 bp, Homo sapiens
cactcggtccca

SEQ ID NO: 2328322 - DNA, 14 bp, Homo sapiens
cactcggtcccagt

SEQ ID NO: 2328323 - DNA, 19 bp, Homo sapiens
cactcgtcaccccagccct

SEQ ID NO: 2328324 - DNA, 15 bp, Homo sapiens
cactcgtgtgtttct

SEQ ID NO: 2328325 - DNA, 21 bp, Homo sapiens
cactctaaaggcgctgagact

SEQ ID NO: 2328326 - DNA, 20 bp, Homo sapiens
cactctagtgacttcctggt

SEQ ID NO: 2328327 - DNA, 21 bp, Homo sapiens
cactctagtgacttcctggtg

SEQ ID NO: 2328328 - DNA, 22 bp, Homo sapiens
cactctagtgacttcctggtga

SEQ ID NO: 2328329 - DNA, 23 bp, Homo sapiens
cactctagtgacttcctggtgag

SEQ ID NO: 2328330 - DNA, 18 bp, Homo sapiens
cactctggatgatggatt

SEQ ID NO: 2328331 - DNA, 16 bp, Homo sapiens
cactcttcttgagcag

SEQ ID NO: 2328332 - DNA, 22 bp, Homo sapiens
cactcttctttaagccatagac

SEQ ID NO: 2328333 - DNA, 16 bp, Homo sapiens
cactgaaagttttgta

SEQ ID NO: 2328334 - DNA, 23 bp, Homo sapiens
cactgaaagttttgtaaaagaaa

SEQ ID NO: 2328335 - DNA, 16 bp, Homo sapiens
cactgaaccactgctt

SEQ ID NO: 2328336 - DNA, 15 bp, Homo sapiens
cactgacttgctgtg

SEQ ID NO: 2328337 - DNA, 16 bp, Homo sapiens
cactgacttgctgtgt

SEQ ID NO: 2328338 - DNA, 21 bp, Homo sapiens
cactgatggctcaagacaagg

SEQ ID NO: 2328339 - DNA, 20 bp, Homo sapiens
cactgccacactctccatca

SEQ ID NO: 2328340 - DNA, 14 bp, Homo sapiens
cactgccagcagca

SEQ ID NO: 2328341 - DNA, 19 bp, Homo sapiens
cactgccagcagcagcagg

SEQ ID NO: 2328342 - DNA, 19 bp, Homo sapiens
cagcctccgagagggagag

SEQ ID NO: 2328343 - DNA, 22 bp, Homo sapiens
cagcctcctctggacggcaggc

SEQ ID NO: 2328344 - DNA, 23 bp, Homo sapiens
cagcctcctctggacggcaggct

SEQ ID NO: 2328345 - DNA, 21 bp, Homo sapiens
cagcctctggacagccagtga

SEQ ID NO: 2328346 - DNA, 12 bp, Homo sapiens
cagcctgtcctg

SEQ ID NO: 2328347 - DNA, 17 bp, Homo sapiens
cagcctgtcctggtaca

SEQ ID NO: 2328348 - DNA, 22 bp, Homo sapiens
cagcctgtcctggtacagcagg

SEQ ID NO: 2328349 - DNA, 19 bp, Homo sapiens
cagccttagctctcccaac

SEQ ID NO: 2328350 - DNA, 19 bp, Homo sapiens
cagccttgagccctggctg

SEQ ID NO: 2328351 - DNA, 17 bp, Homo sapiens
cagcgagggcagctgct

SEQ ID NO: 2328352 - DNA, 18 bp, Homo sapiens
cagcgagggcagctgcta

SEQ ID NO: 2328353 - DNA, 17 bp, Homo sapiens
cagcggggctgctcacc

SEQ ID NO: 2328354 - DNA, 21 bp, Homo sapiens
cagcgtcagctgctccctggc

SEQ ID NO: 2328355 - DNA, 16 bp, Homo sapiens
cagcgtggctctaaaa

SEQ ID NO: 2328356 - DNA, 22 bp, Homo sapiens
cagctaaaccaaggactgagca

SEQ ID NO: 2328357 - DNA, 17 bp, Homo sapiens
cagctacaaacttttaa

SEQ ID NO: 2328358 - DNA, 19 bp, Homo sapiens
cagctactaatgatgtttt

SEQ ID NO: 2328359 - DNA, 21 bp, Homo sapiens
cagctagattttgctgatttt

SEQ ID NO: 2328360 - DNA, 14 bp, Homo sapiens
cagctccctcctgc

SEQ ID NO: 2328361 - DNA, 15 bp, Homo sapiens
cagctccctcctgca

SEQ ID NO: 2328362 - DNA, 18 bp, Homo sapiens
cagctccctttctcagga

SEQ ID NO: 2328363 - DNA, 14 bp, Homo sapiens
cagctctctgccct

SEQ ID NO: 2328364 - DNA, 19 bp, Homo sapiens
cagctctctgccctgtgta

SEQ ID NO: 2328365 - DNA, 14 bp, Homo sapiens
cagctctttccaaa

SEQ ID NO: 2328366 - DNA, 18 bp, Homo sapiens
cagctctttccaaattaa

SEQ ID NO: 2328367 - DNA, 12 bp, Homo sapiens
cagctgaggctg

SEQ ID NO: 2328368 - DNA, 18 bp, Homo sapiens
cagctgcaattccctgga

SEQ ID NO: 2328369 - DNA, 15 bp, Homo sapiens
cagctgccctatggg

SEQ ID NO: 2328370 - DNA, 17 bp, Homo sapiens
cagctgcgcttgctttt

SEQ ID NO: 2328371 - DNA, 22 bp, Homo sapiens
cagctgctatttattttcctaa

SEQ ID NO: 2328372 - DNA, 14 bp, Homo sapiens
cagctgctgttctc

SEQ ID NO: 2328373 - DNA, 17 bp, Homo sapiens
cagctggcctggacagt

SEQ ID NO: 2328374 - DNA, 20 bp, Homo sapiens
cagctggctctccaccttgt

SEQ ID NO: 2328375 - DNA, 20 bp, Homo sapiens
cagctgggccgggacccagg

SEQ ID NO: 2328376 - DNA, 23 bp, Homo sapiens
cagctgggccgggacccagggcc

SEQ ID NO: 2328377 - DNA, 15 bp, Homo sapiens
cagctggggccagag

SEQ ID NO: 2328378 - DNA, 17 bp, Homo sapiens
cagctggggccagaggc

SEQ ID NO: 2328379 - DNA, 17 bp, Homo sapiens
cagctgtagctcccgag

SEQ ID NO: 2328380 - DNA, 15 bp, Homo sapiens
cagctgtgtctgcca

SEQ ID NO: 2328381 - DNA, 18 bp, Homo sapiens
cagcttataatgggctct

SEQ ID NO: 2328382 - DNA, 21 bp, Homo sapiens
cagcttcaacttttctcttta

SEQ ID NO: 2328383 - DNA, 14 bp, Homo sapiens
cagcttcaggttat

SEQ ID NO: 2328384 - DNA, 13 bp, Homo sapiens
cagcttccaaagc

SEQ ID NO: 2328385 - DNA, 22 bp, Homo sapiens
cagcttcgtttattttcaagaa

SEQ ID NO: 2328386 - DNA, 12 bp, Homo sapiens
cagcttctaaga

SEQ ID NO: 2328387 - DNA, 14 bp, Homo sapiens
cagcttctaagagc

SEQ ID NO: 2328388 - DNA, 15 bp, Homo sapiens
cagctttctgggatg

SEQ ID NO: 2328389 - DNA, 16 bp, Homo sapiens
cagctttgagaagcct

SEQ ID NO: 2328390 - DNA, 20 bp, Homo sapiens
cagctttgagaagccttcag

SEQ ID NO: 2328391 - DNA, 23 bp, Homo sapiens
caggaaagagcagtcagagtcca

SEQ ID NO: 2328392 - DNA, 15 bp, Homo sapiens
caggaacaaacaggg

SEQ ID NO: 2328393 - DNA, 14 bp, Homo sapiens
caggaagccagagc

SEQ ID NO: 2328394 - DNA, 15 bp, Homo sapiens
caggaagccagagcc

SEQ ID NO: 2328395 - DNA, 17 bp, Homo sapiens
caggaataggcatttgc

SEQ ID NO: 2328396 - DNA, 17 bp, Homo sapiens
caggaatatatgtgtgc

SEQ ID NO: 2328397 - DNA, 19 bp, Homo sapiens
caggacagcatcccttccc

SEQ ID NO: 2328398 - DNA, 20 bp, Homo sapiens
caggaccagccagcagcagc

SEQ ID NO: 2328399 - DNA, 14 bp, Homo sapiens
caggacccccgagg

SEQ ID NO: 2328400 - DNA, 19 bp, Homo sapiens
caggacgaaaaagaggcat

SEQ ID NO: 2328401 - DNA, 16 bp, Homo sapiens
caggacggctcctcag

SEQ ID NO: 2328402 - DNA, 18 bp, Homo sapiens
caggacggctcctcagag

SEQ ID NO: 2328403 - DNA, 19 bp, Homo sapiens
caggacggctcctcagagc

SEQ ID NO: 2328404 - DNA, 22 bp, Homo sapiens
caggagatcgagaccatcctgg

SEQ ID NO: 2328405 - DNA, 20 bp, Homo sapiens
caggagatgggtccaggggt

SEQ ID NO: 2328406 - DNA, 17 bp, Homo sapiens
caggagcttgggcagtg

SEQ ID NO: 2328407 - DNA, 17 bp, Homo sapiens
caggagctttggaccta

SEQ ID NO: 2328408 - DNA, 21 bp, Homo sapiens
caggagggcggcctccttctg

SEQ ID NO: 2328409 - DNA, 22 bp, Homo sapiens
caggagggcggcctccttctga

SEQ ID NO: 2328410 - DNA, 14 bp, Homo sapiens
caggaggtggagaa

SEQ ID NO: 2328411 - DNA, 23 bp, Homo sapiens
caggagttcaataaatgtctgtt

SEQ ID NO: 2328412 - DNA, 15 bp, Homo sapiens
caggatactggcaca

SEQ ID NO: 2328413 - DNA, 20 bp, Homo sapiens
caggatactggcacagaggt

SEQ ID NO: 2328414 - DNA, 16 bp, Homo sapiens
caggatcatggtgtaa

SEQ ID NO: 2328415 - DNA, 13 bp, Homo sapiens
caggatggccttt

SEQ ID NO: 2328416 - DNA, 15 bp, Homo sapiens
caggatggcctttcc

SEQ ID NO: 2328417 - DNA, 20 bp, Homo sapiens
caggatggcctttccttccc

SEQ ID NO: 2328418 - DNA, 17 bp, Homo sapiens
caggattcccttctggg

SEQ ID NO: 2328419 - DNA, 14 bp, Homo sapiens
caggcaagcagctg

SEQ ID NO: 2328420 - DNA, 16 bp, Homo sapiens
caggcacacacagccc

SEQ ID NO: 2328421 - DNA, 16 bp, Homo sapiens
caggcaccagtccctg

SEQ ID NO: 2328422 - DNA, 13 bp, Homo sapiens
caggcaccctcag

SEQ ID NO: 2328423 - DNA, 20 bp, Homo sapiens
caggcaccctcagggagcct

SEQ ID NO: 2328424 - DNA, 22 bp, Homo sapiens
caggcaccctcagggagcctcc

SEQ ID NO: 2328425 - DNA, 15 bp, Homo sapiens
caggcacctcttcct

SEQ ID NO: 2328426 - DNA, 12 bp, Homo sapiens
caggcagagctg

SEQ ID NO: 2328427 - DNA, 12 bp, Homo sapiens
caggcagaggtt

SEQ ID NO: 2328428 - DNA, 17 bp, Homo sapiens
caggcagaggttttaat

SEQ ID NO: 2328429 - DNA, 12 bp, Homo sapiens
caggcagcccag

SEQ ID NO: 2328430 - DNA, 19 bp, Homo sapiens
caggcagcctcctttgtgt

SEQ ID NO: 2328431 - DNA, 22 bp, Homo sapiens
caggcagctccctcctgcacac

SEQ ID NO: 2328432 - DNA, 13 bp, Homo sapiens
caggcaggaacaa

SEQ ID NO: 2328433 - DNA, 20 bp, Homo sapiens
caggcaggaacaaacagggc

SEQ ID NO: 2328434 - DNA, 14 bp, Homo sapiens
actgaaaagaagga

SEQ ID NO: 2328435 - DNA, 17 bp, Homo sapiens
actgaaaagaaggaaag

SEQ ID NO: 2328436 - DNA, 15 bp, Homo sapiens
actgaaaatgtgcta

SEQ ID NO: 2328437 - DNA, 19 bp, Homo sapiens
actgaaaatgtgctatact

SEQ ID NO: 2328438 - DNA, 15 bp, Homo sapiens
actgaaagttttgta

SEQ ID NO: 2328439 - DNA, 17 bp, Homo sapiens
actgaaagttttgtaaa

SEQ ID NO: 2328440 - DNA, 14 bp, Homo sapiens
actgaaccactgct

SEQ ID NO: 2328441 - DNA, 19 bp, Homo sapiens
actgaaccactgcttctct

SEQ ID NO: 2328442 - DNA, 23 bp, Homo sapiens
actgaaggggtgcacccacctgt

SEQ ID NO: 2328443 - DNA, 21 bp, Homo sapiens
actgaatgaagcagtattttg

SEQ ID NO: 2328444 - DNA, 19 bp, Homo sapiens
actgaatgaatccattgga

SEQ ID NO: 2328445 - DNA, 20 bp, Homo sapiens
actgaatgaggtcagcatgt

SEQ ID NO: 2328446 - DNA, 13 bp, Homo sapiens
actgaatttggag

SEQ ID NO: 2328447 - DNA, 13 bp, Homo sapiens
actgacatttctt

SEQ ID NO: 2328448 - DNA, 19 bp, Homo sapiens
actgacccactcggatgga

SEQ ID NO: 2328449 - DNA, 13 bp, Homo sapiens
actgacctacctc

SEQ ID NO: 2328450 - DNA, 22 bp, Homo sapiens
actgacctgaccccattcctga

SEQ ID NO: 2328451 - DNA, 15 bp, Homo sapiens
actgacttgctgtgt

SEQ ID NO: 2328452 - DNA, 17 bp, Homo sapiens
actgaggaatttcacct

SEQ ID NO: 2328453 - DNA, 23 bp, Homo sapiens
actgaggatattcagatgtatgt

SEQ ID NO: 2328454 - DNA, 19 bp, Homo sapiens
actgatggctcaagacaag

SEQ ID NO: 2328455 - DNA, 13 bp, Homo sapiens
actgattgggagg

SEQ ID NO: 2328456 - DNA, 23 bp, Homo sapiens
actgcaaagctttggctgagacc

SEQ ID NO: 2328457 - DNA, 16 bp, Homo sapiens
actgcactccagcctg

SEQ ID NO: 2328458 - DNA, 20 bp, Homo sapiens
actgcactccagcctggggg

SEQ ID NO: 2328459 - DNA, 13 bp, Homo sapiens
actgcagggttca

SEQ ID NO: 2328460 - DNA, 14 bp, Homo sapiens
actgcagggttcaa

SEQ ID NO: 2328461 - DNA, 21 bp, Homo sapiens
actgcatcttggttatttctg

SEQ ID NO: 2328462 - DNA, 15 bp, Homo sapiens
actgccaggccagcc

SEQ ID NO: 2328463 - DNA, 17 bp, Homo sapiens
actgccaggccagcctc

SEQ ID NO: 2328464 - DNA, 12 bp, Homo sapiens
actgccattttt

SEQ ID NO: 2328465 - DNA, 15 bp, Homo sapiens
actgccttgcctcct

SEQ ID NO: 2328466 - DNA, 21 bp, Homo sapiens
actgcgaagaccctcttgccc

SEQ ID NO: 2328467 - DNA, 22 bp, Homo sapiens
actgcgaagaccctcttgccca

SEQ ID NO: 2328468 - DNA, 14 bp, Homo sapiens
actgcgttctgcaa

SEQ ID NO: 2328469 - DNA, 16 bp, Homo sapiens
actgctcccacctcct

SEQ ID NO: 2328470 - DNA, 19 bp, Homo sapiens
actgctcccacctcctgac

SEQ ID NO: 2328471 - DNA, 14 bp, Homo sapiens
actgctggacatga

SEQ ID NO: 2328472 - DNA, 19 bp, Homo sapiens
actgcttagcattttgcat

SEQ ID NO: 2328473 - DNA, 21 bp, Homo sapiens
actgcttcccttactttgctg

SEQ ID NO: 2328474 - DNA, 15 bp, Homo sapiens
actgcttgattttaa

SEQ ID NO: 2328475 - DNA, 15 bp, Homo sapiens
actggaaaggggaga

SEQ ID NO: 2328476 - DNA, 23 bp, Homo sapiens
actggaaaggggagagcctgctg

SEQ ID NO: 2328477 - DNA, 13 bp, Homo sapiens
actggatttgttg

SEQ ID NO: 2328478 - DNA, 21 bp, Homo sapiens
actggcccctactttgtggca

SEQ ID NO: 2328479 - DNA, 15 bp, Homo sapiens
actggctctcctggc

SEQ ID NO: 2328480 - DNA, 17 bp, Homo sapiens
actggctctcctggccc

SEQ ID NO: 2328481 - DNA, 18 bp, Homo sapiens
actggggaaactggccat

SEQ ID NO: 2328482 - DNA, 15 bp, Homo sapiens
actggggcatcctgt

SEQ ID NO: 2328483 - DNA, 21 bp, Homo sapiens
actggtccaaaagattgctga

SEQ ID NO: 2328484 - DNA, 16 bp, Homo sapiens
actggttactttcaaa

SEQ ID NO: 2328485 - DNA, 19 bp, Homo sapiens
actggttgtaaaagagaaa

SEQ ID NO: 2328486 - DNA, 14 bp, Homo sapiens
actggttttctgcc

SEQ ID NO: 2328487 - DNA, 22 bp, Homo sapiens
actgtaaatatttatttatgtg

SEQ ID NO: 2328488 - DNA, 20 bp, Homo sapiens
actgtaacttccaaataaat

SEQ ID NO: 2328489 - DNA, 16 bp, Homo sapiens
actgtaatacttcttt

SEQ ID NO: 2328490 - DNA, 15 bp, Homo sapiens
actgtagaaacaaag

SEQ ID NO: 2328491 - DNA, 20 bp, Homo sapiens
actgtagagtcctatttcag

SEQ ID NO: 2328492 - DNA, 21 bp, Homo sapiens
actgtataaataggagaggat

SEQ ID NO: 2328493 - DNA, 16 bp, Homo sapiens
actgtatcattttctt

SEQ ID NO: 2328494 - DNA, 20 bp, Homo sapiens
actgtcacggggttccctcc

SEQ ID NO: 2328495 - DNA, 21 bp, Homo sapiens
actgtcacggggttccctcct

SEQ ID NO: 2328496 - DNA, 21 bp, Homo sapiens
actgtcctttccttggcttta

SEQ ID NO: 2328497 - DNA, 13 bp, Homo sapiens
actgtcttcctca

SEQ ID NO: 2328498 - DNA, 18 bp, Homo sapiens
actgtcttcctcaaaata

SEQ ID NO: 2328499 - DNA, 15 bp, Homo sapiens
actgtggaggaagga

SEQ ID NO: 2328500 - DNA, 16 bp, Homo sapiens
actgtggaggaaggat

SEQ ID NO: 2328501 - DNA, 17 bp, Homo sapiens
actgtggaggaaggatt

SEQ ID NO: 2328502 - DNA, 16 bp, Homo sapiens
actgtgtacataactg

SEQ ID NO: 2328503 - DNA, 15 bp, Homo sapiens
actgtgtattccaag

SEQ ID NO: 2328504 - DNA, 16 bp, Homo sapiens
actgttcactcactct

SEQ ID NO: 2328505 - DNA, 23 bp, Homo sapiens
actgttcggaaggggttcctcaa

SEQ ID NO: 2328506 - DNA, 21 bp, Homo sapiens
actgttgagccccagtgctgg

SEQ ID NO: 2328507 - DNA, 22 bp, Homo sapiens
actgttgtaagaattctgattg

SEQ ID NO: 2328508 - DNA, 16 bp, Homo sapiens
actgtttctcttgagc

SEQ ID NO: 2328509 - DNA, 18 bp, Homo sapiens
actgtttctcttgagctg

SEQ ID NO: 2328510 - DNA, 19 bp, Homo sapiens
actgtttctcttgagctgg

SEQ ID NO: 2328511 - DNA, 20 bp, Homo sapiens
actgtttctcttgagctggc

SEQ ID NO: 2328512 - DNA, 13 bp, Homo sapiens
actgtttgaatgt

SEQ ID NO: 2328513 - DNA, 22 bp, Homo sapiens
actgtttgatataccaaattaa

SEQ ID NO: 2328514 - DNA, 17 bp, Homo sapiens
actgttttccagttcat

SEQ ID NO: 2328515 - DNA, 19 bp, Homo sapiens
acttaaagggcccaatgaa

SEQ ID NO: 2328516 - DNA, 21 bp, Homo sapiens
acttaaagggcccaatgaatt

SEQ ID NO: 2328517 - DNA, 13 bp, Homo sapiens
acttaactgaaat

SEQ ID NO: 2328518 - DNA, 15 bp, Homo sapiens
acttaactttaactt

SEQ ID NO: 2328519 - DNA, 15 bp, Homo sapiens
acttaataactgtgt

SEQ ID NO: 2328520 - DNA, 22 bp, Homo sapiens
acttagaatccgaagggaatta

SEQ ID NO: 2328521 - DNA, 15 bp, Homo sapiens
acttagctcaggtgc

SEQ ID NO: 2328522 - DNA, 21 bp, Homo sapiens
acttagggaagaaaaagcaag

SEQ ID NO: 2328523 - DNA, 17 bp, Homo sapiens
acttagggtttggagct

SEQ ID NO: 2328524 - DNA, 22 bp, Homo sapiens
acttatattctgcagaaaatta

SEQ ID NO: 2328525 - DNA, 13 bp, Homo sapiens
acttattgaatat

SEQ ID NO: 2328526 - DNA, 17 bp, Homo sapiens
acttattgaatatatga

SEQ ID NO: 2328527 - DNA, 20 bp, Homo sapiens
acttcatttgacacaaagct

SEQ ID NO: 2328528 - DNA, 16 bp, Homo sapiens
acttccaaagaaagtt

SEQ ID NO: 2328529 - DNA, 12 bp, Homo sapiens
acttccatgcct

SEQ ID NO: 2328530 - DNA, 20 bp, Homo sapiens
acttccatgccttaaaccta

SEQ ID NO: 2328531 - DNA, 18 bp, Homo sapiens
acttcccgggccagggct

SEQ ID NO: 2328532 - DNA, 19 bp, Homo sapiens
acttcccgggccagggctg

SEQ ID NO: 2328533 - DNA, 22 bp, Homo sapiens
acttcctggtgaggcccagcct

SEQ ID NO: 2328534 - DNA, 15 bp, Homo sapiens
acttccttatttctg

SEQ ID NO: 2328535 - DNA, 22 bp, Homo sapiens
acttcgcaccggagtgtctgga

SEQ ID NO: 2328536 - DNA, 12 bp, Homo sapiens
acttctcaagta

SEQ ID NO: 2328537 - DNA, 15 bp, Homo sapiens
acttctcaagtaaca

SEQ ID NO: 2328538 - DNA, 20 bp, Homo sapiens
acttctcggaattcataata

SEQ ID NO: 2328539 - DNA, 18 bp, Homo sapiens
acttctgatactttagta

SEQ ID NO: 2328540 - DNA, 16 bp, Homo sapiens
acttcttctcttagat

SEQ ID NO: 2328541 - DNA, 17 bp, Homo sapiens
acttcttgaaacagcct

SEQ ID NO: 2328542 - DNA, 20 bp, Homo sapiens
acttgaagccatctaaagta

SEQ ID NO: 2328543 - DNA, 19 bp, Homo sapiens
acttgatacgtccgtgtgt

SEQ ID NO: 2328544 - DNA, 15 bp, Homo sapiens
acttgctgtgtgacc

SEQ ID NO: 2328545 - DNA, 20 bp, Homo sapiens
acttgctgtgtgaccctggg

SEQ ID NO: 2328546 - DNA, 15 bp, Homo sapiens
agttgctatttttgt

SEQ ID NO: 2328547 - DNA, 19 bp, Homo sapiens
agttgctatttttgtaaag

SEQ ID NO: 2328548 - DNA, 16 bp, Homo sapiens
agttgctgcaaacctg

SEQ ID NO: 2328549 - DNA, 19 bp, Homo sapiens
agttgctgtgaactttcat

SEQ ID NO: 2328550 - DNA, 10 bp, Homo sapiens
agttggaagg

SEQ ID NO: 2328551 - DNA, 15 bp, Homo sapiens
agttggaaggatctg

SEQ ID NO: 2328552 - DNA, 15 bp, Homo sapiens
agttggccaagcaga

SEQ ID NO: 2328553 - DNA, 23 bp, Homo sapiens
agttgggatgccaatttcctctc

SEQ ID NO: 2328554 - DNA, 15 bp, Homo sapiens
agttgggtgtttcca

SEQ ID NO: 2328555 - DNA, 16 bp, Homo sapiens
agttggtgttgacata

SEQ ID NO: 2328556 - DNA, 22 bp, Homo sapiens
agttgtaaagatattgtatctc

SEQ ID NO: 2328557 - DNA, 22 bp, Homo sapiens
agttgtcttatgtgaaaaatta

SEQ ID NO: 2328558 - DNA, 13 bp, Homo sapiens
agttgtgatctgt

SEQ ID NO: 2328559 - DNA, 17 bp, Homo sapiens
agttgtgttttttaaga

SEQ ID NO: 2328560 - DNA, 19 bp, Homo sapiens
agttgtgttttttaagatg

SEQ ID NO: 2328561 - DNA, 12 bp, Homo sapiens
agtttaacagaa

SEQ ID NO: 2328562 - DNA, 18 bp, Homo sapiens
agtttacctggcttattt

SEQ ID NO: 2328563 - DNA, 15 bp, Homo sapiens
agtttcaagttttaa

SEQ ID NO: 2328564 - DNA, 22 bp, Homo sapiens
agtttcaggtgacatgtgaaac

SEQ ID NO: 2328565 - DNA, 14 bp, Homo sapiens
ataatattgaaaat

SEQ ID NO: 2328566 - DNA, 18 bp, Homo sapiens
ataatattgaaaattgaa

SEQ ID NO: 2328567 - DNA, 15 bp, Homo sapiens
ataatatttttgtat

SEQ ID NO: 2328568 - DNA, 19 bp, Homo sapiens
ataatatttttgtatttct

SEQ ID NO: 2328569 - DNA, 16 bp, Homo sapiens
ataatcacgctttcct

SEQ ID NO: 2328570 - DNA, 13 bp, Homo sapiens
ataatcagtaaat

SEQ ID NO: 2328571 - DNA, 15 bp, Homo sapiens
ataatcagtaaatag

SEQ ID NO: 2328572 - DNA, 20 bp, Homo sapiens
ataatcctgtgaaaatatga

SEQ ID NO: 2328573 - DNA, 14 bp, Homo sapiens
ataatcttctgcct

SEQ ID NO: 2328574 - DNA, 20 bp, Homo sapiens
ataatgattaagggacattt

SEQ ID NO: 2328575 - DNA, 22 bp, Homo sapiens
ataatgattaagggacatttct

SEQ ID NO: 2328576 - DNA, 15 bp, Homo sapiens
ataatgctaatttta

SEQ ID NO: 2328577 - DNA, 21 bp, Homo sapiens
ataatgcttttctaattaata

SEQ ID NO: 2328578 - DNA, 14 bp, Homo sapiens
ataatggccctgta

SEQ ID NO: 2328579 - DNA, 11 bp, Homo sapiens
ataatgttaaa

SEQ ID NO: 2328580 - DNA, 15 bp, Homo sapiens
ataattcatatctaa

SEQ ID NO: 2328581 - DNA, 12 bp, Homo sapiens
ataattctaaag

SEQ ID NO: 2328582 - DNA, 15 bp, Homo sapiens
ataattcttttctga

SEQ ID NO: 2328583 - DNA, 19 bp, Homo sapiens
ataattgtacaaaattaag

SEQ ID NO: 2328584 - DNA, 24 bp, Homo sapiens
ataattgtacaaaattaagcaaat

SEQ ID NO: 2328585 - DNA, 14 bp, Homo sapiens
ataatttagatggt

SEQ ID NO: 2328586 - DNA, 21 bp, Homo sapiens
ataatttagtggatggaatat

SEQ ID NO: 2328587 - DNA, 16 bp, Homo sapiens
ataatttgaatgtatt

SEQ ID NO: 2328588 - DNA, 22 bp, Homo sapiens
ataattttttttaaaatagaaa

SEQ ID NO: 2328589 - DNA, 13 bp, Homo sapiens
atatattgaactt

SEQ ID NO: 2328590 - DNA, 13 bp, Homo sapiens
atatatttattga

SEQ ID NO: 2328591 - DNA, 21 bp, Homo sapiens
atatatttattgagtacctac

SEQ ID NO: 2328592 - DNA, 16 bp, Homo sapiens
atatattttgtgtgaa

SEQ ID NO: 2328593 - DNA, 19 bp, Homo sapiens
atatattttgtgtgaaatt

SEQ ID NO: 2328594 - DNA, 20 bp, Homo sapiens
atatattttgtgtgaaattg

SEQ ID NO: 2328595 - DNA, 15 bp, Homo sapiens
atatcaactctgaag

SEQ ID NO: 2328596 - DNA, 20 bp, Homo sapiens
atatcaactctgaagctaat

SEQ ID NO: 2328597 - DNA, 17 bp, Homo sapiens
atatcaagaagtcttga

SEQ ID NO: 2328598 - DNA, 21 bp, Homo sapiens
atatcaggaaatatctgtgaa

SEQ ID NO: 2328599 - DNA, 15 bp, Homo sapiens
atatcaggtgtataa

SEQ ID NO: 2328600 - DNA, 20 bp, Homo sapiens
atatcaggtgtataaatgta

SEQ ID NO: 2328601 - DNA, 23 bp, Homo sapiens
atatcagtaacccccttaaattt

SEQ ID NO: 2328602 - DNA, 20 bp, Homo sapiens
atatcatgcaaaatatgttt

SEQ ID NO: 2328603 - DNA, 12 bp, Homo sapiens
atatccaaaagc

SEQ ID NO: 2328604 - DNA, 19 bp, Homo sapiens
atatccaaaagctttttat

SEQ ID NO: 2328605 - DNA, 20 bp, Homo sapiens
atatctatttgaataaatta

SEQ ID NO: 2328606 - DNA, 13 bp, Homo sapiens
atatctgtacaga

SEQ ID NO: 2328607 - DNA, 12 bp, Homo sapiens
atatgaatctat

SEQ ID NO: 2328608 - DNA, 16 bp, Homo sapiens
atatgaccagaagcct

SEQ ID NO: 2328609 - DNA, 18 bp, Homo sapiens
atatgacggaagaacata

SEQ ID NO: 2328610 - DNA, 23 bp, Homo sapiens
atatgacggaagaacatagaact

SEQ ID NO: 2328611 - DNA, 12 bp, Homo sapiens
atatgatgagca

SEQ ID NO: 2328612 - DNA, 17 bp, Homo sapiens
atatgcaccttgtgtct

SEQ ID NO: 2328613 - DNA, 19 bp, Homo sapiens
atatgcaccttgtgtctgt

SEQ ID NO: 2328614 - DNA, 20 bp, Homo sapiens
atatgcaccttgtgtctgta

SEQ ID NO: 2328615 - DNA, 21 bp, Homo sapiens
atatgcaccttgtgtctgtac

SEQ ID NO: 2328616 - DNA, 17 bp, Homo sapiens
atatgctgatcttttaa

SEQ ID NO: 2328617 - DNA, 14 bp, Homo sapiens
atatgctttattaa

SEQ ID NO: 2328618 - DNA, 15 bp, Homo sapiens
atatggaagaaagta

SEQ ID NO: 2328619 - DNA, 13 bp, Homo sapiens
atatggtggaaaa

SEQ ID NO: 2328620 - DNA, 14 bp, Homo sapiens
atatggttctccaa

SEQ ID NO: 2328621 - DNA, 17 bp, Homo sapiens
atatggttctccaagaa

SEQ ID NO: 2328622 - DNA, 19 bp, Homo sapiens
atatggttctccaagaaac

SEQ ID NO: 2328623 - DNA, 18 bp, Homo sapiens
atattaaaatctgatgta

SEQ ID NO: 2328624 - DNA, 21 bp, Homo sapiens
atattaaaattccaaattcat

SEQ ID NO: 2328625 - DNA, 20 bp, Homo sapiens
atattaaacaaagtttcaga

SEQ ID NO: 2328626 - DNA, 15 bp, Homo sapiens
atattactgacattt

SEQ ID NO: 2328627 - DNA, 16 bp, Homo sapiens
atattactgacatttc

SEQ ID NO: 2328628 - DNA, 13 bp, Homo sapiens
atattagatcaaa

SEQ ID NO: 2328629 - DNA, 21 bp, Homo sapiens
atattaggtccattcattaat

SEQ ID NO: 2328630 - DNA, 19 bp, Homo sapiens
atattagtattatcttgtt

SEQ ID NO: 2328631 - DNA, 13 bp, Homo sapiens
atattataaagga

SEQ ID NO: 2328632 - DNA, 20 bp, Homo sapiens
atattataaaggataaagaa

SEQ ID NO: 2328633 - DNA, 21 bp, Homo sapiens
atattataactctgtataata

SEQ ID NO: 2328634 - DNA, 17 bp, Homo sapiens
atattataattggaagt

SEQ ID NO: 2328635 - DNA, 14 bp, Homo sapiens
atattatagaaaat

SEQ ID NO: 2328636 - DNA, 22 bp, Homo sapiens
atattcacacctcacgctctgg

SEQ ID NO: 2328637 - DNA, 13 bp, Homo sapiens
atattcacatctt

SEQ ID NO: 2328638 - DNA, 16 bp, Homo sapiens
atattcagatgtatgt

SEQ ID NO: 2328639 - DNA, 19 bp, Homo sapiens
atattcagggtaaatagga

SEQ ID NO: 2328640 - DNA, 15 bp, Homo sapiens
atattccagatcttt

SEQ ID NO: 2328641 - DNA, 13 bp, Homo sapiens
atattcttttgtt

SEQ ID NO: 2328642 - DNA, 14 bp, Homo sapiens
atattgaaaattga

SEQ ID NO: 2328643 - DNA, 21 bp, Homo sapiens
atattgaaaattgaaaagtac

SEQ ID NO: 2328644 - DNA, 13 bp, Homo sapiens
atattgaatgtta

SEQ ID NO: 2328645 - DNA, 16 bp, Homo sapiens
atattggggaccaaat

SEQ ID NO: 2328646 - DNA, 17 bp, Homo sapiens
atattgtgattctgcct

SEQ ID NO: 2328647 - DNA, 14 bp, Homo sapiens
atattgtttctgca

SEQ ID NO: 2328648 - DNA, 16 bp, Homo sapiens
atattgtttggtaaat

SEQ ID NO: 2328649 - DNA, 19 bp, Homo sapiens
atattgtttggtaaatgtt

SEQ ID NO: 2328650 - DNA, 21 bp, Homo sapiens
atattgtttggtaaatgtttc

SEQ ID NO: 2328651 - DNA, 19 bp, Homo sapiens
atatttatgttgttgaact

SEQ ID NO: 2328652 - DNA, 17 bp, Homo sapiens
atatttcctaaggcatg

SEQ ID NO: 2328653 - DNA, 20 bp, Homo sapiens
atatttcctttatgtgaatt

SEQ ID NO: 2328654 - DNA, 21 bp, Homo sapiens
atatttcctttatgtgaattt

SEQ ID NO: 2328655 - DNA, 11 bp, Homo sapiens
atatttctcaa

SEQ ID NO: 2328656 - DNA, 15 bp, Homo sapiens
atatttgactattct

SEQ ID NO: 2328657 - DNA, 17 bp, Homo sapiens
atatttgcaaagtgtat

SEQ ID NO: 2328658 - DNA, 20 bp, Homo sapiens
atatttgcaaagtgtattag

SEQ ID NO: 2328659 - DNA, 21 bp, Homo sapiens
atatttgcacatgggattgct

SEQ ID NO: 2328660 - DNA, 24 bp, Homo sapiens
atattttcctagtagatctatatt

SEQ ID NO: 2328661 - DNA, 19 bp, Homo sapiens
atattttgctgctgaattt

SEQ ID NO: 2328662 - DNA, 18 bp, Homo sapiens
atattttgtgtgaaattg

SEQ ID NO: 2328663 - DNA, 22 bp, Homo sapiens
atattttgtgtgaaattgcata

SEQ ID NO: 2328664 - DNA, 11 bp, Homo sapiens
atatttttaaa

SEQ ID NO: 2328665 - DNA, 14 bp, Homo sapiens
atatttttaaagaa

SEQ ID NO: 2328666 - DNA, 18 bp, Homo sapiens
atatttttatatttcctt

SEQ ID NO: 2328667 - DNA, 22 bp, Homo sapiens
atattttttattaatatttgca

SEQ ID NO: 2328668 - DNA, 15 bp, Homo sapiens
atcaaacctttgagt

SEQ ID NO: 2328669 - DNA, 16 bp, Homo sapiens
atcaaagcagaagtct

SEQ ID NO: 2328670 - DNA, 21 bp, Homo sapiens
atcaaataaaatatcataaag

SEQ ID NO: 2328671 - DNA, 15 bp, Homo sapiens
atcaacaagatttcc

SEQ ID NO: 2328672 - DNA, 14 bp, Homo sapiens
atcgttgcccccat

SEQ ID NO: 2328673 - DNA, 21 bp, Homo sapiens
atctaaaatgttttatgacat

SEQ ID NO: 2328674 - DNA, 14 bp, Homo sapiens
atctaactttgtaa

SEQ ID NO: 2328675 - DNA, 17 bp, Homo sapiens
atctaatacctctgtgt

SEQ ID NO: 2328676 - DNA, 15 bp, Homo sapiens
atctaattctgattc

SEQ ID NO: 2328677 - DNA, 12 bp, Homo sapiens
atctagccagcc

SEQ ID NO: 2328678 - DNA, 22 bp, Homo sapiens
atctataggcagcttctaagag

SEQ ID NO: 2328679 - DNA, 18 bp, Homo sapiens
atctatggcttatttcta

SEQ ID NO: 2328680 - DNA, 19 bp, Homo sapiens
atctatggcttatttctat

SEQ ID NO: 2328681 - DNA, 21 bp, Homo sapiens
atctatggcttatttctatga

SEQ ID NO: 2328682 - DNA, 23 bp, Homo sapiens
atctatttgcaccttaaaagaca

SEQ ID NO: 2328683 - DNA, 22 bp, Homo sapiens
atctcaagatgggggcagggct

SEQ ID NO: 2328684 - DNA, 12 bp, Homo sapiens
atctcactctgc

SEQ ID NO: 2328685 - DNA, 16 bp, Homo sapiens
atctcactctgccccc

SEQ ID NO: 2328686 - DNA, 22 bp, Homo sapiens
atctcagctttgagaagccttc

SEQ ID NO: 2328687 - DNA, 11 bp, Homo sapiens
atctcattatt

SEQ ID NO: 2328688 - DNA, 18 bp, Homo sapiens
atctcattatttcaaaat

SEQ ID NO: 2328689 - DNA, 14 bp, Homo sapiens
atctcattatttct

SEQ ID NO: 2328690 - DNA, 16 bp, Homo sapiens
atctcattatttctgg

SEQ ID NO: 2328691 - DNA, 15 bp, Homo sapiens
atctccatggccctg

SEQ ID NO: 2328692 - DNA, 21 bp, Homo sapiens
atctcccaaggctgccagaca

SEQ ID NO: 2328693 - DNA, 17 bp, Homo sapiens
atctcctgacagaaggt

SEQ ID NO: 2328694 - DNA, 18 bp, Homo sapiens
atctcctgacagaaggtg

SEQ ID NO: 2328695 - DNA, 14 bp, Homo sapiens
atctctccactgtg

SEQ ID NO: 2328696 - DNA, 14 bp, Homo sapiens
atctctcctggcct

SEQ ID NO: 2328697 - DNA, 22 bp, Homo sapiens
atctctcctggcctatccgctg

SEQ ID NO: 2328698 - DNA, 18 bp, Homo sapiens
atctctgaagccacaaat

SEQ ID NO: 2328699 - DNA, 21 bp, Homo sapiens
atctctgcctctcccaggctg

SEQ ID NO: 2328700 - DNA, 21 bp, Homo sapiens
atctctggcccagaaagcctc

SEQ ID NO: 2328701 - DNA, 19 bp, Homo sapiens
atctcttcactaccctgat

SEQ ID NO: 2328702 - DNA, 20 bp, Homo sapiens
atctcttcattattctctgc

SEQ ID NO: 2328703 - DNA, 16 bp, Homo sapiens
atctctttttgtttgc

SEQ ID NO: 2328704 - DNA, 16 bp, Homo sapiens
atctgagtcagagcca

SEQ ID NO: 2328705 - DNA, 20 bp, Homo sapiens
atctgatatcaggaaatatc

SEQ ID NO: 2328706 - DNA, 22 bp, Homo sapiens
atctgatatcaggaaatatctg

SEQ ID NO: 2328707 - DNA, 23 bp, Homo sapiens
atctgatggccttaatttccttt

SEQ ID NO: 2328708 - DNA, 18 bp, Homo sapiens
atctgcaccccttctctc

SEQ ID NO: 2328709 - DNA, 12 bp, Homo sapiens
atctgcagggag

SEQ ID NO: 2328710 - DNA, 23 bp, Homo sapiens
aagtgccctctcccaccctcttc

SEQ ID NO: 2328711 - DNA, 15 bp, Homo sapiens
aagtgcccttcctgc

SEQ ID NO: 2328712 - DNA, 17 bp, Homo sapiens
aagtgcggtgctttagc

SEQ ID NO: 2328713 - DNA, 19 bp, Homo sapiens
aagtgcgtgtgtagagtta

SEQ ID NO: 2328714 - DNA, 21 bp, Homo sapiens
aagtgctgagattgcagatgt

SEQ ID NO: 2328715 - DNA, 17 bp, Homo sapiens
aagtgctgttgggatat

SEQ ID NO: 2328716 - DNA, 19 bp, Homo sapiens
aagtgcttattacatttta

SEQ ID NO: 2328717 - DNA, 14 bp, Homo sapiens
aagtggactgtatt

SEQ ID NO: 2328718 - DNA, 11 bp, Homo sapiens
aagtgggacag

SEQ ID NO: 2328719 - DNA, 13 bp, Homo sapiens
aagtggggtctgg

SEQ ID NO: 2328720 - DNA, 18 bp, Homo sapiens
aagtggggtgctgggagg

SEQ ID NO: 2328721 - DNA, 17 bp, Homo sapiens
aagtggtctctgctggg

SEQ ID NO: 2328722 - DNA, 17 bp, Homo sapiens
aagtggtgtttattgca

SEQ ID NO: 2328723 - DNA, 14 bp, Homo sapiens
aagtgtaaaaaatg

SEQ ID NO: 2328724 - DNA, 16 bp, Homo sapiens
aagtgtaaaaaatgtc

SEQ ID NO: 2328725 - DNA, 18 bp, Homo sapiens
aagtgtgtgattgaaggt

SEQ ID NO: 2328726 - DNA, 19 bp, Homo sapiens
aagtgttctcatgaagcag

SEQ ID NO: 2328727 - DNA, 20 bp, Homo sapiens
aagtgttctgtggctgattt

SEQ ID NO: 2328728 - DNA, 15 bp, Homo sapiens
aagtgtttatgttgt

SEQ ID NO: 2328729 - DNA, 23 bp, Homo sapiens
aagttacacagaaatgctgctgg

SEQ ID NO: 2328730 - DNA, 22 bp, Homo sapiens
aagttagtggaaatctgaacat

SEQ ID NO: 2328731 - DNA, 14 bp, Homo sapiens
aagttatctttgaa

SEQ ID NO: 2328732 - DNA, 22 bp, Homo sapiens
aagttatctttgaatatgtagt

SEQ ID NO: 2328733 - DNA, 17 bp, Homo sapiens
aagttatttttgtacat

SEQ ID NO: 2328734 - DNA, 21 bp, Homo sapiens
aagttcatgtccaaacgtcct

SEQ ID NO: 2328735 - DNA, 20 bp, Homo sapiens
aagttcattgcaattaaact

SEQ ID NO: 2328736 - DNA, 19 bp, Homo sapiens
aagttccaagttgctaata

SEQ ID NO: 2328737 - DNA, 11 bp, Homo sapiens
aagttcttatg

SEQ ID NO: 2328738 - DNA, 19 bp, Homo sapiens
aagttggaaggatctgctg

SEQ ID NO: 2328739 - DNA, 22 bp, Homo sapiens
aagttgtgatctgttgtaatat

SEQ ID NO: 2328740 - DNA, 20 bp, Homo sapiens
aagttgtgcttgagccagga

SEQ ID NO: 2328741 - DNA, 14 bp, Homo sapiens
aagtttagctctga

SEQ ID NO: 2328742 - DNA, 16 bp, Homo sapiens
aagtttagctctgaga

SEQ ID NO: 2328743 - DNA, 20 bp, Homo sapiens
aagtttcaagttttaaagtt

SEQ ID NO: 2328744 - DNA, 18 bp, Homo sapiens
aagtttcagagtatattg

SEQ ID NO: 2328745 - DNA, 12 bp, Homo sapiens
aagtttcaggtg

SEQ ID NO: 2328746 - DNA, 19 bp, Homo sapiens
aagtttcaggtgacatgtg

SEQ ID NO: 2328747 - DNA, 21 bp, Homo sapiens
aagttttaaacccaaaatata

SEQ ID NO: 2328748 - DNA, 12 bp, Homo sapiens
aagttttgaaaa

SEQ ID NO: 2328749 - DNA, 15 bp, Homo sapiens
aagttttgaaaagct

SEQ ID NO: 2328750 - DNA, 18 bp, Homo sapiens
aagttttgaaaagctatt

SEQ ID NO: 2328751 - DNA, 13 bp, Homo sapiens
aagttttgttgta

SEQ ID NO: 2328752 - DNA, 19 bp, Homo sapiens
aataaaaagatcactttct

SEQ ID NO: 2328753 - DNA, 23 bp, Homo sapiens
aataaaaagatcactttctcagt

SEQ ID NO: 2328754 - DNA, 20 bp, Homo sapiens
atgcaaatgagctctgaaat

SEQ ID NO: 2328755 - DNA, 17 bp, Homo sapiens
atgcaatatatgttcat

SEQ ID NO: 2328756 - DNA, 21 bp, Homo sapiens
atgcaccttgtgtctgtacac

SEQ ID NO: 2328757 - DNA, 16 bp, Homo sapiens
atgcacttttagaaat

SEQ ID NO: 2328758 - DNA, 22 bp, Homo sapiens
atgcacttttagaaatgcatat

SEQ ID NO: 2328759 - DNA, 18 bp, Homo sapiens
atgcagaaacttggatgt

SEQ ID NO: 2328760 - DNA, 21 bp, Homo sapiens
atgcagaaatagacaaaaagt

SEQ ID NO: 2328761 - DNA, 19 bp, Homo sapiens
atgcagacctcatgcccag

SEQ ID NO: 2328762 - DNA, 20 bp, Homo sapiens
atgcagacctcatgcccagc

SEQ ID NO: 2328763 - DNA, 20 bp, Homo sapiens
atgcagagagccattttgtg

SEQ ID NO: 2328764 - DNA, 14 bp, Homo sapiens
atgcagctttgcaa

SEQ ID NO: 2328765 - DNA, 22 bp, Homo sapiens
atgcagtgatatggcagaagac

SEQ ID NO: 2328766 - DNA, 20 bp, Homo sapiens
atgcagttagctgaagaatt

SEQ ID NO: 2328767 - DNA, 14 bp, Homo sapiens
atgcataaatatgc

SEQ ID NO: 2328768 - DNA, 21 bp, Homo sapiens
atgcataaatatgcagtgata

SEQ ID NO: 2328769 - DNA, 19 bp, Homo sapiens
atgcatataatgaataaat

SEQ ID NO: 2328770 - DNA, 12 bp, Homo sapiens
atgcatatttgc

SEQ ID NO: 2328771 - DNA, 21 bp, Homo sapiens
atgcatatttgcaaagtgtat

SEQ ID NO: 2328772 - DNA, 23 bp, Homo sapiens
atgcatcatttcaggagttactg

SEQ ID NO: 2328773 - DNA, 13 bp, Homo sapiens
atgcattattaaa

SEQ ID NO: 2328774 - DNA, 19 bp, Homo sapiens
atgcattcacatttagaaa

SEQ ID NO: 2328775 - DNA, 12 bp, Homo sapiens
atgcatttaata

SEQ ID NO: 2328776 - DNA, 14 bp, Homo sapiens
atgcatttaataaa

SEQ ID NO: 2328777 - DNA, 15 bp, Homo sapiens
atgcatttaataaag

SEQ ID NO: 2328778 - DNA, 13 bp, Homo sapiens
atgcatttgaggt

SEQ ID NO: 2328779 - DNA, 17 bp, Homo sapiens
atgcatttgaggtcaag

SEQ ID NO: 2328780 - DNA, 15 bp, Homo sapiens
atgccaatttcctct

SEQ ID NO: 2328781 - DNA, 14 bp, Homo sapiens
atgccaccctagcc

SEQ ID NO: 2328782 - DNA, 23 bp, Homo sapiens
atgccaccggcctgtgggtctct

SEQ ID NO: 2328783 - DNA, 13 bp, Homo sapiens
atgccagctggcc

SEQ ID NO: 2328784 - DNA, 13 bp, Homo sapiens
atgccagtatttt

SEQ ID NO: 2328785 - DNA, 18 bp, Homo sapiens
atgcccaccccctgccct

SEQ ID NO: 2328786 - DNA, 20 bp, Homo sapiens
atgcccaccccctgccctgc

SEQ ID NO: 2328787 - DNA, 13 bp, Homo sapiens
atgcccagctctc

SEQ ID NO: 2328788 - DNA, 23 bp, Homo sapiens
atgccctgttggtttcacagata

SEQ ID NO: 2328789 - DNA, 23 bp, Homo sapiens
atgcctgctttgaataaatgtgt

SEQ ID NO: 2328790 - DNA, 17 bp, Homo sapiens
atgcctgggttgctgct

SEQ ID NO: 2328791 - DNA, 21 bp, Homo sapiens
atgccttgtataatattgaaa

SEQ ID NO: 2328792 - DNA, 14 bp, Homo sapiens
atgcctttgagaca

SEQ ID NO: 2328793 - DNA, 13 bp, Homo sapiens
atgccttttctgt

SEQ ID NO: 2328794 - DNA, 19 bp, Homo sapiens
atgctaccaggatgctaaa

SEQ ID NO: 2328795 - DNA, 13 bp, Homo sapiens
atgctccccacag

SEQ ID NO: 2328796 - DNA, 21 bp, Homo sapiens
atgctccccacagcgtccctg

SEQ ID NO: 2328797 - DNA, 18 bp, Homo sapiens
atgctgaatgccccctgc

SEQ ID NO: 2328798 - DNA, 18 bp, Homo sapiens
atgctgatcttttaaaat

SEQ ID NO: 2328799 - DNA, 15 bp, Homo sapiens
atgctgcaggatgga

SEQ ID NO: 2328800 - DNA, 16 bp, Homo sapiens
atgcttaaatttcaga

SEQ ID NO: 2328801 - DNA, 23 bp, Homo sapiens
atgcttactgatatattttacaa

SEQ ID NO: 2328802 - DNA, 21 bp, Homo sapiens
atgcttagtccctcatgcaaa

SEQ ID NO: 2328803 - DNA, 23 bp, Homo sapiens
atgcttagtccctcatgcaaatc

SEQ ID NO: 2328804 - DNA, 22 bp, Homo sapiens
atgcttcctgacaatcaactct

SEQ ID NO: 2328805 - DNA, 14 bp, Homo sapiens
atgcttcctttctc

SEQ ID NO: 2328806 - DNA, 16 bp, Homo sapiens
atgcttcctttctctc

SEQ ID NO: 2328807 - DNA, 17 bp, Homo sapiens
atgcttcctttctctcc

SEQ ID NO: 2328808 - DNA, 18 bp, Homo sapiens
atgcttcctttctctcct

SEQ ID NO: 2328809 - DNA, 14 bp, Homo sapiens
atgcttctctcctt

SEQ ID NO: 2328810 - DNA, 17 bp, Homo sapiens
atgcttgcataagagct

SEQ ID NO: 2328811 - DNA, 14 bp, Homo sapiens
atgctttttagaaa

SEQ ID NO: 2328812 - DNA, 20 bp, Homo sapiens
atggaaaatgccatgaatta

SEQ ID NO: 2328813 - DNA, 16 bp, Homo sapiens
atggaaacaccactgc

SEQ ID NO: 2328814 - DNA, 14 bp, Homo sapiens
atggaagaaagtaa

SEQ ID NO: 2328815 - DNA, 18 bp, Homo sapiens
atggaatatcagaagtat

SEQ ID NO: 2328816 - DNA, 14 bp, Homo sapiens
atggacacgagcca

SEQ ID NO: 2328817 - DNA, 17 bp, Homo sapiens
atggaccaacctgctct

SEQ ID NO: 2328818 - DNA, 23 bp, Homo sapiens
atggaccaacctgctctgtcccc

SEQ ID NO: 2328819 - DNA, 16 bp, Homo sapiens
atggagaagctgcagg

SEQ ID NO: 2328820 - DNA, 14 bp, Homo sapiens
atggatctgatctg

SEQ ID NO: 2328821 - DNA, 19 bp, Homo sapiens
atggatggctcaagtctgc

SEQ ID NO: 2328822 - DNA, 17 bp, Homo sapiens
atggcacctcaggctga

SEQ ID NO: 2328823 - DNA, 20 bp, Homo sapiens
atggtcggatctcacaggct

SEQ ID NO: 2328824 - DNA, 12 bp, Homo sapiens
atggtctttgct

SEQ ID NO: 2328825 - DNA, 15 bp, Homo sapiens
atggtgcctgagagg

SEQ ID NO: 2328826 - DNA, 16 bp, Homo sapiens
atggtgcctgagaggc

SEQ ID NO: 2328827 - DNA, 14 bp, Homo sapiens
atggtgtaataaga

SEQ ID NO: 2328828 - DNA, 18 bp, Homo sapiens
atggtgtaataagacata

SEQ ID NO: 2328829 - DNA, 20 bp, Homo sapiens
atggtgtaataagacataac

SEQ ID NO: 2328830 - DNA, 18 bp, Homo sapiens
atggtgtgggtgtcctgc

SEQ ID NO: 2328831 - DNA, 13 bp, Homo sapiens
atggttaaacatt

SEQ ID NO: 2328832 - DNA, 13 bp, Homo sapiens
atggttaaatttt

SEQ ID NO: 2328833 - DNA, 18 bp, Homo sapiens
atggttacttcttctctt

SEQ ID NO: 2328834 - DNA, 12 bp, Homo sapiens
atggttgtagca

SEQ ID NO: 2328835 - DNA, 17 bp, Homo sapiens
atggttgtagcatttaa

SEQ ID NO: 2328836 - DNA, 14 bp, Homo sapiens
atgtaaagatattt

SEQ ID NO: 2328837 - DNA, 15 bp, Homo sapiens
atgtaacaacaatta

SEQ ID NO: 2328838 - DNA, 11 bp, Homo sapiens
atgtaaccaat

SEQ ID NO: 2328839 - DNA, 13 bp, Homo sapiens
atgtaatttaaat

SEQ ID NO: 2328840 - DNA, 20 bp, Homo sapiens
atgtaatttcaaaatacatt

SEQ ID NO: 2328841 - DNA, 20 bp, Homo sapiens
atgtaattttattttaaaat

SEQ ID NO: 2328842 - DNA, 15 bp, Homo sapiens
atgtacagattcttt

SEQ ID NO: 2328843 - DNA, 22 bp, Homo sapiens
atgtacatagttatttttctct

SEQ ID NO: 2328844 - DNA, 15 bp, Homo sapiens
atgtacatgggccgc

SEQ ID NO: 2328845 - DNA, 17 bp, Homo sapiens
atgtactgatttcagta

SEQ ID NO: 2328846 - DNA, 20 bp, Homo sapiens
atgtagaaagttgtaaaata

SEQ ID NO: 2328847 - DNA, 23 bp, Homo sapiens
atgtagatattgtgaagtacata

SEQ ID NO: 2328848 - DNA, 17 bp, Homo sapiens
atgtagatgtgcatttt

SEQ ID NO: 2328849 - DNA, 16 bp, Homo sapiens
atgtagcctttactgt

SEQ ID NO: 2328850 - DNA, 16 bp, Homo sapiens
atgtaggtaagactgt

SEQ ID NO: 2328851 - DNA, 20 bp, Homo sapiens
atgtaggtaagactgtagat

SEQ ID NO: 2328852 - DNA, 19 bp, Homo sapiens
atgtagtatctatatgact

SEQ ID NO: 2328853 - DNA, 14 bp, Homo sapiens
atgtataaattttt

SEQ ID NO: 2328854 - DNA, 20 bp, Homo sapiens
atgtatatccatataacaat

SEQ ID NO: 2328855 - DNA, 14 bp, Homo sapiens
atgtatattaaaaa

SEQ ID NO: 2328856 - DNA, 22 bp, Homo sapiens
atgtatatttttaaagaatgtt

SEQ ID NO: 2328857 - DNA, 20 bp, Homo sapiens
atgtatccaaggaaacattt

SEQ ID NO: 2328858 - DNA, 13 bp, Homo sapiens
atgtatgaatgta

SEQ ID NO: 2328859 - DNA, 14 bp, Homo sapiens
atgtatgtgtggct

SEQ ID NO: 2328860 - DNA, 17 bp, Homo sapiens
atgtattagaagatttt

SEQ ID NO: 2328861 - DNA, 17 bp, Homo sapiens
atgtattcctttaaaat

SEQ ID NO: 2328862 - DNA, 19 bp, Homo sapiens
atgtattcctttaaaatat

SEQ ID NO: 2328863 - DNA, 22 bp, Homo sapiens
atgtattcctttaaaatattgt

SEQ ID NO: 2328864 - DNA, 15 bp, Homo sapiens
atgtattctcttcta

SEQ ID NO: 2328865 - DNA, 14 bp, Homo sapiens
atgtatttgattta

SEQ ID NO: 2328866 - DNA, 23 bp, Homo sapiens
atgtcaaccaggtccagatgtgc

SEQ ID NO: 2328867 - DNA, 13 bp, Homo sapiens
atgtcacagtcca

SEQ ID NO: 2328868 - DNA, 19 bp, Homo sapiens
atgtcacagtccaaccaga

SEQ ID NO: 2328869 - DNA, 16 bp, Homo sapiens
atgtcacctacatatg

SEQ ID NO: 2328870 - DNA, 12 bp, Homo sapiens
atgtccaaagag

SEQ ID NO: 2328871 - DNA, 16 bp, Homo sapiens
atgtccaaagaggctg

SEQ ID NO: 2328872 - DNA, 18 bp, Homo sapiens
atgtccaaagaggctgcc

SEQ ID NO: 2328873 - DNA, 21 bp, Homo sapiens
atgtccaaagaggctgcccct

SEQ ID NO: 2328874 - DNA, 23 bp, Homo sapiens
atgtccaagtccaacctgcctgt

SEQ ID NO: 2328875 - DNA, 23 bp, Homo sapiens
atgtcccagtgctcaccagccct

SEQ ID NO: 2328876 - DNA, 16 bp, Homo sapiens
atgtctattcagcttc

SEQ ID NO: 2328877 - DNA, 21 bp, Homo sapiens
atgtctcactttactttcaag

SEQ ID NO: 2328878 - DNA, 13 bp, Homo sapiens
atgtctcttctga

SEQ ID NO: 2328879 - DNA, 17 bp, Homo sapiens
atgtctcttctgagcta

SEQ ID NO: 2328880 - DNA, 11 bp, Homo sapiens
atgtctgctgg

SEQ ID NO: 2328881 - DNA, 20 bp, Homo sapiens
atgtctgctggtatttctaa

SEQ ID NO: 2328882 - DNA, 15 bp, Homo sapiens
atgtctgtttattaa

SEQ ID NO: 2328883 - DNA, 13 bp, Homo sapiens
atgtcttggacac

SEQ ID NO: 2328884 - DNA, 21 bp, Homo sapiens
atgtcttgtatttaaaaacat

SEQ ID NO: 2328885 - DNA, 23 bp, Homo sapiens
atgtcttgtatttaaaaacattt

SEQ ID NO: 2328886 - DNA, 19 bp, Homo sapiens
atgtgaaaaattaactttt

SEQ ID NO: 2328887 - DNA, 13 bp, Homo sapiens
atgtgaaaccttt

SEQ ID NO: 2328888 - DNA, 13 bp, Homo sapiens
atttagaaatgtt

SEQ ID NO: 2328889 - DNA, 14 bp, Homo sapiens
atttagaagaaaga

SEQ ID NO: 2328890 - DNA, 15 bp, Homo sapiens
atttagaagaaagat

SEQ ID NO: 2328891 - DNA, 18 bp, Homo sapiens
atttagaagaaagatgtt

SEQ ID NO: 2328892 - DNA, 14 bp, Homo sapiens
atttagacaagaga

SEQ ID NO: 2328893 - DNA, 16 bp, Homo sapiens
atttagacaagagatg

SEQ ID NO: 2328894 - DNA, 20 bp, Homo sapiens
atttagacaagagatgggaa

SEQ ID NO: 2328895 - DNA, 12 bp, Homo sapiens
atttagcacagt

SEQ ID NO: 2328896 - DNA, 15 bp, Homo sapiens
atttagcacagtatt

SEQ ID NO: 2328897 - DNA, 17 bp, Homo sapiens
atttagcacagtattta

SEQ ID NO: 2328898 - DNA, 18 bp, Homo sapiens
atttagcacagtatttaa

SEQ ID NO: 2328899 - DNA, 20 bp, Homo sapiens
atttagcacagtatttaaca

SEQ ID NO: 2328900 - DNA, 14 bp, Homo sapiens
atttagggaagcag

SEQ ID NO: 2328901 - DNA, 15 bp, Homo sapiens
atttagtaagaatac

SEQ ID NO: 2328902 - DNA, 20 bp, Homo sapiens
atttagtgatattgtgggta

SEQ ID NO: 2328903 - DNA, 16 bp, Homo sapiens
atttataaggaaattt

SEQ ID NO: 2328904 - DNA, 17 bp, Homo sapiens
atttataatacagaatc

SEQ ID NO: 2328905 - DNA, 18 bp, Homo sapiens
atttataatacagaatct

SEQ ID NO: 2328906 - DNA, 17 bp, Homo sapiens
atttatacaagggttaa

SEQ ID NO: 2328907 - DNA, 20 bp, Homo sapiens
atttatacaccagcaattta

SEQ ID NO: 2328908 - DNA, 16 bp, Homo sapiens
atttatccttgttaag

SEQ ID NO: 2328909 - DNA, 23 bp, Homo sapiens
atttatctcctcttcatggcatc

SEQ ID NO: 2328910 - DNA, 12 bp, Homo sapiens
atttatgtagat

SEQ ID NO: 2328911 - DNA, 14 bp, Homo sapiens
atttatgtagatgt

SEQ ID NO: 2328912 - DNA, 22 bp, Homo sapiens
atttatgttgttgaactaatat

SEQ ID NO: 2328913 - DNA, 22 bp, Homo sapiens
atttattgagtacctactgtgt

SEQ ID NO: 2328914 - DNA, 22 bp, Homo sapiens
atttatttccactaaaaatatt

SEQ ID NO: 2328915 - DNA, 19 bp, Homo sapiens
atttattttcctaaagaga

SEQ ID NO: 2328916 - DNA, 22 bp, Homo sapiens
atttcaaaatacatttgtaagt

SEQ ID NO: 2328917 - DNA, 21 bp, Homo sapiens
atttcaaaatgatagacatat

SEQ ID NO: 2328918 - DNA, 21 bp, Homo sapiens
atttcaaaccattgctcttag

SEQ ID NO: 2328919 - DNA, 16 bp, Homo sapiens
atttcaactacagtga

SEQ ID NO: 2328920 - DNA, 11 bp, Homo sapiens
atttcaagttc

SEQ ID NO: 2328921 - DNA, 16 bp, Homo sapiens
atttcaagttccaagt

SEQ ID NO: 2328922 - DNA, 23 bp, Homo sapiens
atttcaagttccaagttgctaat

SEQ ID NO: 2328923 - DNA, 15 bp, Homo sapiens
atttcacctgtaaac

SEQ ID NO: 2328924 - DNA, 18 bp, Homo sapiens
atttcacctgtaaacctg

SEQ ID NO: 2328925 - DNA, 18 bp, Homo sapiens
atttcactactagattga

SEQ ID NO: 2328926 - DNA, 17 bp, Homo sapiens
atttcagtgtaaagtgt

SEQ ID NO: 2328927 - DNA, 19 bp, Homo sapiens
atttcagtgtaaagtgtgt

SEQ ID NO: 2328928 - DNA, 16 bp, Homo sapiens
atttcagttctaggaa

SEQ ID NO: 2328929 - DNA, 14 bp, Homo sapiens
atttcatctatttt

SEQ ID NO: 2328930 - DNA, 15 bp, Homo sapiens
atttcatgaaaatga

SEQ ID NO: 2328931 - DNA, 20 bp, Homo sapiens
atttccaccaggccgtgcct

SEQ ID NO: 2328932 - DNA, 23 bp, Homo sapiens
atttccatgtcccctcccagagc

SEQ ID NO: 2328933 - DNA, 21 bp, Homo sapiens
atttcccatttgtgccagagg

SEQ ID NO: 2328934 - DNA, 11 bp, Homo sapiens
atttccctgca

SEQ ID NO: 2328935 - DNA, 15 bp, Homo sapiens
atttcctaaggcatg

SEQ ID NO: 2328936 - DNA, 19 bp, Homo sapiens
atttcctagctgttctaat

SEQ ID NO: 2328937 - DNA, 21 bp, Homo sapiens
atttcctccctctgcccctcc

SEQ ID NO: 2328938 - DNA, 20 bp, Homo sapiens
atttccttggattttcctga

SEQ ID NO: 2328939 - DNA, 16 bp, Homo sapiens
caaaagattgctgaaa

SEQ ID NO: 2328940 - DNA, 21 bp, Homo sapiens
caaaagcgccctcactattct

SEQ ID NO: 2328941 - DNA, 13 bp, Homo sapiens
caaaatcaagagt

SEQ ID NO: 2328942 - DNA, 12 bp, Homo sapiens
caaaatctaaaa

SEQ ID NO: 2328943 - DNA, 15 bp, Homo sapiens
caaaatgaattttta

SEQ ID NO: 2328944 - DNA, 22 bp, Homo sapiens
caaaatgtattagaagatttta

SEQ ID NO: 2328945 - DNA, 12 bp, Homo sapiens
caaaatttgaga

SEQ ID NO: 2328946 - DNA, 14 bp, Homo sapiens
caaaattttaaaaa

SEQ ID NO: 2328947 - DNA, 16 bp, Homo sapiens
caaaattttaaaaaag

SEQ ID NO: 2328948 - DNA, 23 bp, Homo sapiens
caaacagctattggcaagtttta

SEQ ID NO: 2328949 - DNA, 23 bp, Homo sapiens
caaaccattgctcttagtcccaa

SEQ ID NO: 2328950 - DNA, 23 bp, Homo sapiens
caaaccctcccagaaacatctct

SEQ ID NO: 2328951 - DNA, 15 bp, Homo sapiens
caaacctttgagtag

SEQ ID NO: 2328952 - DNA, 22 bp, Homo sapiens
caaactactgaatgaagcagta

SEQ ID NO: 2328953 - DNA, 23 bp, Homo sapiens
caaactactgaatgaagcagtat

SEQ ID NO: 2328954 - DNA, 22 bp, Homo sapiens
caaactgaggaatttcacctgt

SEQ ID NO: 2328955 - DNA, 21 bp, Homo sapiens
caaactgcttcccttactttg

SEQ ID NO: 2328956 - DNA, 16 bp, Homo sapiens
caaactgggaacccct

SEQ ID NO: 2328957 - DNA, 21 bp, Homo sapiens
caaagaaaaaaaaaaaagcca

SEQ ID NO: 2328958 - DNA, 21 bp, Homo sapiens
caaagaaaatgaaatgcatat

SEQ ID NO: 2328959 - DNA, 13 bp, Homo sapiens
caaagaatagact

SEQ ID NO: 2328960 - DNA, 19 bp, Homo sapiens
caaagacaaaagtctgtct

SEQ ID NO: 2328961 - DNA, 14 bp, Homo sapiens
caaagactcaaatt

SEQ ID NO: 2328962 - DNA, 15 bp, Homo sapiens
caaagactcaaattt

SEQ ID NO: 2328963 - DNA, 16 bp, Homo sapiens
caaagagggcttcctc

SEQ ID NO: 2328964 - DNA, 17 bp, Homo sapiens
caaagcatggacattta

SEQ ID NO: 2328965 - DNA, 14 bp, Homo sapiens
caaagctcaaagta

SEQ ID NO: 2328966 - DNA, 18 bp, Homo sapiens
caaagctttcttttctaa

SEQ ID NO: 2328967 - DNA, 15 bp, Homo sapiens
caaagctttggctga

SEQ ID NO: 2328968 - DNA, 19 bp, Homo sapiens
caaagctttggctgagacc

SEQ ID NO: 2328969 - DNA, 17 bp, Homo sapiens
caaagggcagttttgag

SEQ ID NO: 2328970 - DNA, 13 bp, Homo sapiens
caaaggggacagc

SEQ ID NO: 2328971 - DNA, 16 bp, Homo sapiens
caaagggttttctttt

SEQ ID NO: 2328972 - DNA, 22 bp, Homo sapiens
caaaggtgtgcttcctgctgta

SEQ ID NO: 2328973 - DNA, 14 bp, Homo sapiens
caaagtactcttta

SEQ ID NO: 2328974 - DNA, 20 bp, Homo sapiens
caaagtactctttaacatac

SEQ ID NO: 2328975 - DNA, 20 bp, Homo sapiens
caaagtctgctctcatataa

SEQ ID NO: 2328976 - DNA, 22 bp, Homo sapiens
caaagtgctgagattgcagatg

SEQ ID NO: 2328977 - DNA, 16 bp, Homo sapiens
caaagtttcagagtat

SEQ ID NO: 2328978 - DNA, 22 bp, Homo sapiens
caaagttttgttgtacttaaat

SEQ ID NO: 2328979 - DNA, 17 bp, Homo sapiens
caaataaataattttca

SEQ ID NO: 2328980 - DNA, 15 bp, Homo sapiens
caaataaatatgaaa

SEQ ID NO: 2328981 - DNA, 13 bp, Homo sapiens
caaataatgcttt

SEQ ID NO: 2328982 - DNA, 17 bp, Homo sapiens
caaataatgcttttcta

SEQ ID NO: 2328983 - DNA, 20 bp, Homo sapiens
caaataatgcttttctaatt

SEQ ID NO: 2328984 - DNA, 24 bp, Homo sapiens
caaatactgcttagcattttgcat

SEQ ID NO: 2328985 - DNA, 17 bp, Homo sapiens
caaataggctattaaaa

SEQ ID NO: 2328986 - DNA, 15 bp, Homo sapiens
caaatataagacatt

SEQ ID NO: 2328987 - DNA, 23 bp, Homo sapiens
caaatataagacatttgtttgct

SEQ ID NO: 2328988 - DNA, 17 bp, Homo sapiens
caaatatacattttcta

SEQ ID NO: 2328989 - DNA, 21 bp, Homo sapiens
caaatatacattttctaaata

SEQ ID NO: 2328990 - DNA, 18 bp, Homo sapiens
caaatcagtttgactact

SEQ ID NO: 2328991 - DNA, 18 bp, Homo sapiens
caaatcattccttagata

SEQ ID NO: 2328992 - DNA, 18 bp, Homo sapiens
caaatgaaatgtatgcat

SEQ ID NO: 2328993 - DNA, 14 bp, Homo sapiens
caaatgaagaaagt

SEQ ID NO: 2328994 - DNA, 14 bp, Homo sapiens
caaatgaatgatta

SEQ ID NO: 2328995 - DNA, 19 bp, Homo sapiens
caaatgaatgattaaatta

SEQ ID NO: 2328996 - DNA, 20 bp, Homo sapiens
caaatgagctctgaaatctt

SEQ ID NO: 2328997 - DNA, 14 bp, Homo sapiens
caaatggaggaata

SEQ ID NO: 2328998 - DNA, 16 bp, Homo sapiens
caaatggccattttaa

SEQ ID NO: 2328999 - DNA, 13 bp, Homo sapiens
caaatgtttattt

SEQ ID NO: 2329000 - DNA, 14 bp, Homo sapiens
caaattaaaacaaa

SEQ ID NO: 2329001 - DNA, 17 bp, Homo sapiens
caaattaggaagtgttt

SEQ ID NO: 2329002 - DNA, 15 bp, Homo sapiens
caaattttttgactt

SEQ ID NO: 2329003 - DNA, 22 bp, Homo sapiens
caacaaatattcactggcccct

SEQ ID NO: 2329004 - DNA, 18 bp, Homo sapiens
caacaacctcaactgcct

SEQ ID NO: 2329005 - DNA, 19 bp, Homo sapiens
caacaattggtaaaactca

SEQ ID NO: 2329006 - DNA, 19 bp, Homo sapiens
caacacattgaaactgtat

SEQ ID NO: 2329007 - DNA, 15 bp, Homo sapiens
caacactcttcttga

SEQ ID NO: 2329008 - DNA, 22 bp, Homo sapiens
caacactcttcttgagcagacc

SEQ ID NO: 2329009 - DNA, 15 bp, Homo sapiens
caagaaaaaaaggga

SEQ ID NO: 2329010 - DNA, 21 bp, Homo sapiens
caagaaatggcgtctgctctg

SEQ ID NO: 2329011 - DNA, 16 bp, Homo sapiens
caagaacccaagtgcc

SEQ ID NO: 2329012 - DNA, 20 bp, Homo sapiens
caagaagatagttgtaaaga

SEQ ID NO: 2329013 - DNA, 23 bp, Homo sapiens
caagaataatcacgctttcctga

SEQ ID NO: 2329014 - DNA, 19 bp, Homo sapiens
caagaatgaaaaatataat

SEQ ID NO: 2329015 - DNA, 21 bp, Homo sapiens
caagaatgaaaaatataatgt

SEQ ID NO: 2329016 - DNA, 18 bp, Homo sapiens
caagacaaggctggcaaa

SEQ ID NO: 2329017 - DNA, 17 bp, Homo sapiens
caagacatgtctgttct

SEQ ID NO: 2329018 - DNA, 21 bp, Homo sapiens
caagacccccatttgtcccag

SEQ ID NO: 2329019 - DNA, 17 bp, Homo sapiens
caagacctcagtgcctt

SEQ ID NO: 2329020 - DNA, 13 bp, Homo sapiens
caagactgggccc

SEQ ID NO: 2329021 - DNA, 13 bp, Homo sapiens
caagagaaacttc

SEQ ID NO: 2329022 - DNA, 19 bp, Homo sapiens
caagagctagaaaaataaa

SEQ ID NO: 2329023 - DNA, 21 bp, Homo sapiens
caagagctagaaaaataaaat

SEQ ID NO: 2329024 - DNA, 19 bp, Homo sapiens
caagaggcaagctgaaatt

SEQ ID NO: 2329025 - DNA, 15 bp, Homo sapiens
caagagggggtggag

SEQ ID NO: 2329026 - DNA, 17 bp, Homo sapiens
caagagggggtggaggg

SEQ ID NO: 2329027 - DNA, 14 bp, Homo sapiens
caagagtccggatt

SEQ ID NO: 2329028 - DNA, 22 bp, Homo sapiens
caagagtccggatttctaacag

SEQ ID NO: 2329029 - DNA, 18 bp, Homo sapiens
caagatggacacgagcca

SEQ ID NO: 2329030 - DNA, 14 bp, Homo sapiens
caagatgtgaatta

SEQ ID NO: 2329031 - DNA, 16 bp, Homo sapiens
caagattctaaagctc

SEQ ID NO: 2329032 - DNA, 13 bp, Homo sapiens
caagatttccttg

SEQ ID NO: 2329033 - DNA, 14 bp, Homo sapiens
caagcaacagcctt

SEQ ID NO: 2329034 - DNA, 15 bp, Homo sapiens
caagcaacatttgta

SEQ ID NO: 2329035 - DNA, 14 bp, Homo sapiens
caagcaatcctcct

SEQ ID NO: 2329036 - DNA, 14 bp, Homo sapiens
caagcacagagcct

SEQ ID NO: 2329037 - DNA, 15 bp, Homo sapiens
caagcacagagcctg

SEQ ID NO: 2329038 - DNA, 16 bp, Homo sapiens
caagcacagagcctgg

SEQ ID NO: 2329039 - DNA, 19 bp, Homo sapiens
caagcagctggtcagtctt

SEQ ID NO: 2329040 - DNA, 13 bp, Homo sapiens
caagcatttcatg

SEQ ID NO: 2329041 - DNA, 20 bp, Homo sapiens
caagccaaaagtccctccct

SEQ ID NO: 2329042 - DNA, 15 bp, Homo sapiens
caagccacaggaagg

SEQ ID NO: 2329043 - DNA, 14 bp, Homo sapiens
caagccagacctag

SEQ ID NO: 2329044 - DNA, 15 bp, Homo sapiens
caagccagacctagc

SEQ ID NO: 2329045 - DNA, 13 bp, Homo sapiens
caagcctccacag

SEQ ID NO: 2329046 - DNA, 23 bp, Homo sapiens
caagcctgcacaataaaaatgtt

SEQ ID NO: 2329047 - DNA, 12 bp, Homo sapiens
caagcgctcatg

SEQ ID NO: 2329048 - DNA, 18 bp, Homo sapiens
caagcgggtggctctggg

SEQ ID NO: 2329049 - DNA, 16 bp, Homo sapiens
caagctagtgtttcta

SEQ ID NO: 2329050 - DNA, 17 bp, Homo sapiens
caagctagtgtttctag

SEQ ID NO: 2329051 - DNA, 13 bp, Homo sapiens
caagctgcactgt

SEQ ID NO: 2329052 - DNA, 16 bp, Homo sapiens
caagctgcactgtgaa

SEQ ID NO: 2329053 - DNA, 15 bp, Homo sapiens
caagctgctctgagc

SEQ ID NO: 2329054 - DNA, 18 bp, Homo sapiens
caagctgctctgagccac

SEQ ID NO: 2329055 - DNA, 23 bp, Homo sapiens
caagctggaagaagtgagcagtg

SEQ ID NO: 2329056 - DNA, 15 bp, Homo sapiens
caaggaagaagaaat

SEQ ID NO: 2329057 - DNA, 16 bp, Homo sapiens
caaggagtgtaaaatg

SEQ ID NO: 2329058 - DNA, 17 bp, Homo sapiens
caaggagtgtaaaatgt

SEQ ID NO: 2329059 - DNA, 17 bp, Homo sapiens
caaggatagaagtatac

SEQ ID NO: 2329060 - DNA, 20 bp, Homo sapiens
caaggccagtccccatttct

SEQ ID NO: 2329061 - DNA, 18 bp, Homo sapiens
caagggcaagaacccaag

SEQ ID NO: 2329062 - DNA, 17 bp, Homo sapiens
caagggctgtcattgca

SEQ ID NO: 2329063 - DNA, 23 bp, Homo sapiens
caagggttaaccattttttttaa

SEQ ID NO: 2329064 - DNA, 16 bp, Homo sapiens
caagggttaaggcctg

SEQ ID NO: 2329065 - DNA, 19 bp, Homo sapiens
caagggttgagagccagtg

SEQ ID NO: 2329066 - DNA, 19 bp, Homo sapiens
caaggtcactgtttcctgg

SEQ ID NO: 2329067 - DNA, 22 bp, Homo sapiens
caaggtgggccttgctacctca

SEQ ID NO: 2329068 - DNA, 17 bp, Homo sapiens
caaggttataatttttt

SEQ ID NO: 2329069 - DNA, 22 bp, Homo sapiens
caaggttataattttttttaaa

SEQ ID NO: 2329070 - DNA, 13 bp, Homo sapiens
caaggttggagcc

SEQ ID NO: 2329071 - DNA, 19 bp, Homo sapiens
caagtaacatgacttcctt

SEQ ID NO: 2329072 - DNA, 16 bp, Homo sapiens
caagtaagaagacatg

SEQ ID NO: 2329073 - DNA, 18 bp, Homo sapiens
caagtaagaagacatgaa

SEQ ID NO: 2329074 - DNA, 12 bp, Homo sapiens
caagtaatatta

SEQ ID NO: 2329075 - DNA, 19 bp, Homo sapiens
caagtatactaagagtaaa

SEQ ID NO: 2329076 - DNA, 17 bp, Homo sapiens
caagtatgaatctagtt

SEQ ID NO: 2329077 - DNA, 13 bp, Homo sapiens
caagtccaacctg

SEQ ID NO: 2329078 - DNA, 14 bp, Homo sapiens
caagtccaacctgc

SEQ ID NO: 2329079 - DNA, 18 bp, Homo sapiens
caagtccaacctgcctgt

SEQ ID NO: 2329080 - DNA, 14 bp, Homo sapiens
caagtccctggaaa

SEQ ID NO: 2329081 - DNA, 17 bp, Homo sapiens
caagtctgcacagagca

SEQ ID NO: 2329082 - DNA, 14 bp, Homo sapiens
caagtgcctcacct

SEQ ID NO: 2329083 - DNA, 22 bp, Homo sapiens
caagtgcctcacctcgaaagga

SEQ ID NO: 2329084 - DNA, 14 bp, Homo sapiens
caagtgctggagtc

SEQ ID NO: 2329085 - DNA, 20 bp, Homo sapiens
ttgacaataagaaacagttt

SEQ ID NO: 2329086 - DNA, 16 bp, Homo sapiens
ttgacaattgggagct

SEQ ID NO: 2329087 - DNA, 14 bp, Homo sapiens
ttgacacaaagctt

SEQ ID NO: 2329088 - DNA, 11 bp, Homo sapiens
ttgacactgaa

SEQ ID NO: 2329089 - DNA, 21 bp, Homo sapiens
ttgacactgaaagttttgtaa

SEQ ID NO: 2329090 - DNA, 22 bp, Homo sapiens
ttgacactgaaagttttgtaaa

SEQ ID NO: 2329091 - DNA, 17 bp, Homo sapiens
ttgaccagatctttctc

SEQ ID NO: 2329092 - DNA, 20 bp, Homo sapiens
ttgaccctgaaatattttct

SEQ ID NO: 2329093 - DNA, 19 bp, Homo sapiens
ttgacgaatattgcttact

SEQ ID NO: 2329094 - DNA, 23 bp, Homo sapiens
ttgacgtcactttttggccatgt

SEQ ID NO: 2329095 - DNA, 15 bp, Homo sapiens
ttgacgtttcttctt

SEQ ID NO: 2329096 - DNA, 19 bp, Homo sapiens
ttgacgtttcttctttcta

SEQ ID NO: 2329097 - DNA, 20 bp, Homo sapiens
ttgactaactcaaatacaca

SEQ ID NO: 2329098 - DNA, 22 bp, Homo sapiens
ttgactaactcaaatacacatt

SEQ ID NO: 2329099 - DNA, 22 bp, Homo sapiens
ttgactgactgagcaggctgtg

SEQ ID NO: 2329100 - DNA, 17 bp, Homo sapiens
ttgactttttgcattta

SEQ ID NO: 2329101 - DNA, 17 bp, Homo sapiens
ttgactttttttgtatg

SEQ ID NO: 2329102 - DNA, 22 bp, Homo sapiens
ttgagaaccttggaccactcct

SEQ ID NO: 2329103 - DNA, 21 bp, Homo sapiens
ttgagaagccttcagctccag

SEQ ID NO: 2329104 - DNA, 14 bp, Homo sapiens
ttgagacaatgttt

SEQ ID NO: 2329105 - DNA, 19 bp, Homo sapiens
ttgagacagtttcttagct

SEQ ID NO: 2329106 - DNA, 17 bp, Homo sapiens
ttgagactcaaaaaaac

SEQ ID NO: 2329107 - DNA, 23 bp, Homo sapiens
ttgagagaaatatgaagaactga

SEQ ID NO: 2329108 - DNA, 12 bp, Homo sapiens
ttgagagccagt

SEQ ID NO: 2329109 - DNA, 23 bp, Homo sapiens
ttgagattttccattaactattt

SEQ ID NO: 2329110 - DNA, 21 bp, Homo sapiens
ttgagcatgacagcctgcagc

SEQ ID NO: 2329111 - DNA, 14 bp, Homo sapiens
ttgagccctggctg

SEQ ID NO: 2329112 - DNA, 19 bp, Homo sapiens
ttgagccgggcccctgggc

SEQ ID NO: 2329113 - DNA, 14 bp, Homo sapiens
ttgagctgccttcc

SEQ ID NO: 2329114 - DNA, 15 bp, Homo sapiens
ttgagctgccttccc

SEQ ID NO: 2329115 - DNA, 11 bp, Homo sapiens
ttgagctggcc

SEQ ID NO: 2329116 - DNA, 23 bp, Homo sapiens
ttgaggagaagggggtctctgtt

SEQ ID NO: 2329117 - DNA, 13 bp, Homo sapiens
ttgagggctgcag

SEQ ID NO: 2329118 - DNA, 14 bp, Homo sapiens
ttgagggctgcagt

SEQ ID NO: 2329119 - DNA, 14 bp, Homo sapiens
ttgaggtgcaagga

SEQ ID NO: 2329120 - DNA, 14 bp, Homo sapiens
ttgagtgacagctt

SEQ ID NO: 2329121 - DNA, 21 bp, Homo sapiens
ttgagtgacagctttctggga

SEQ ID NO: 2329122 - DNA, 14 bp, Homo sapiens
ttgagtttttcctc

SEQ ID NO: 2329123 - DNA, 15 bp, Homo sapiens
ttgataatgttaaat

SEQ ID NO: 2329124 - DNA, 20 bp, Homo sapiens
ttgataatgttaaatttgta

SEQ ID NO: 2329125 - DNA, 19 bp, Homo sapiens
ttgatagggaactggggaa

SEQ ID NO: 2329126 - DNA, 13 bp, Homo sapiens
ttgatctctgctt

SEQ ID NO: 2329127 - DNA, 12 bp, Homo sapiens
ttgatctgctct

SEQ ID NO: 2329128 - DNA, 13 bp, Homo sapiens
ttgatgtcagcct

SEQ ID NO: 2329129 - DNA, 20 bp, Homo sapiens
ttgatgtggccctggctgcc

SEQ ID NO: 2329130 - DNA, 19 bp, Homo sapiens
ttgatgttccttccagtgt

SEQ ID NO: 2329131 - DNA, 14 bp, Homo sapiens
ttgattatcttcag

SEQ ID NO: 2329132 - DNA, 23 bp, Homo sapiens
ttgattattttttttttcttctt

SEQ ID NO: 2329133 - DNA, 22 bp, Homo sapiens
ttgattgggaaaacatttgctg

SEQ ID NO: 2329134 - DNA, 21 bp, Homo sapiens
ttgattgtcagctactaatga

SEQ ID NO: 2329135 - DNA, 11 bp, Homo sapiens
ttgatttcctc

SEQ ID NO: 2329136 - DNA, 19 bp, Homo sapiens
ttgcaaagagacatttcaa

SEQ ID NO: 2329137 - DNA, 17 bp, Homo sapiens
aaagccttaagcaaatt

SEQ ID NO: 2329138 - DNA, 22 bp, Homo sapiens
aaagccttaagcaaattttgta

SEQ ID NO: 2329139 - DNA, 22 bp, Homo sapiens
aaagctactgtagaaacaaagg

SEQ ID NO: 2329140 - DNA, 22 bp, Homo sapiens
aaagctattagccaggatcatg

SEQ ID NO: 2329141 - DNA, 14 bp, Homo sapiens
aaagctatttaagt

SEQ ID NO: 2329142 - DNA, 14 bp, Homo sapiens
aaagctcaaatgaa

SEQ ID NO: 2329143 - DNA, 24 bp, Homo sapiens
aaagctgcccactgtttctcttga

SEQ ID NO: 2329144 - DNA, 23 bp, Homo sapiens
aaagcttacattttcctgagacc

SEQ ID NO: 2329145 - DNA, 13 bp, Homo sapiens
aaagcttctaaag

SEQ ID NO: 2329146 - DNA, 17 bp, Homo sapiens
aaagctttcttttctaa

SEQ ID NO: 2329147 - DNA, 18 bp, Homo sapiens
aaaggaaagctgtgttta

SEQ ID NO: 2329148 - DNA, 13 bp, Homo sapiens
aaaggaagactag

SEQ ID NO: 2329149 - DNA, 19 bp, Homo sapiens
aaaggacgcctgcaggaga

SEQ ID NO: 2329150 - DNA, 21 bp, Homo sapiens
aaaggacgcctgcaggagaga

SEQ ID NO: 2329151 - DNA, 21 bp, Homo sapiens
aaaggaggccctgttccctgg

SEQ ID NO: 2329152 - DNA, 14 bp, Homo sapiens
aaaggataaagaag

SEQ ID NO: 2329153 - DNA, 17 bp, Homo sapiens
aaaggatctaagggaag

SEQ ID NO: 2329154 - DNA, 15 bp, Homo sapiens
tcctgctgctgtctg

SEQ ID NO: 2329155 - DNA, 13 bp, Homo sapiens
tcctgctgtgcct

SEQ ID NO: 2329156 - DNA, 14 bp, Homo sapiens
tcctggaagccagc

SEQ ID NO: 2329157 - DNA, 14 bp, Homo sapiens
tcctggagcatccc

SEQ ID NO: 2329158 - DNA, 11 bp, Homo sapiens
tcctggagggg

SEQ ID NO: 2329159 - DNA, 13 bp, Homo sapiens
tcctggcagccca

SEQ ID NO: 2329160 - DNA, 14 bp, Homo sapiens
tcctggcagcccag

SEQ ID NO: 2329161 - DNA, 16 bp, Homo sapiens
tcctggcatgacactc

SEQ ID NO: 2329162 - DNA, 23 bp, Homo sapiens
tcctggcctatccgctgccagcc

SEQ ID NO: 2329163 - DNA, 13 bp, Homo sapiens
tcctggcctgaga

SEQ ID NO: 2329164 - DNA, 19 bp, Homo sapiens
ttggaagtttagctctgag

SEQ ID NO: 2329165 - DNA, 21 bp, Homo sapiens
ttggaagtttagctctgagaa

SEQ ID NO: 2329166 - DNA, 15 bp, Homo sapiens
ttggaataatttcta

SEQ ID NO: 2329167 - DNA, 17 bp, Homo sapiens
ttggagagcagctggct

SEQ ID NO: 2329168 - DNA, 15 bp, Homo sapiens
ttggagcacaaaatt

SEQ ID NO: 2329169 - DNA, 20 bp, Homo sapiens
ttggagccccaggggacaag

SEQ ID NO: 2329170 - DNA, 16 bp, Homo sapiens
ttggagctattcaaga

SEQ ID NO: 2329171 - DNA, 17 bp, Homo sapiens
ttggattctaaatacat

SEQ ID NO: 2329172 - DNA, 14 bp, Homo sapiens
ttggcaatgctaat

SEQ ID NO: 2329173 - DNA, 20 bp, Homo sapiens
ttggcacttgccattccaaa

SEQ ID NO: 2329174 - DNA, 17 bp, Homo sapiens
ttggccccactttgaag

SEQ ID NO: 2329175 - DNA, 13 bp, Homo sapiens
ttggccctattta

SEQ ID NO: 2329176 - DNA, 18 bp, Homo sapiens
ttggctgagacctgggat

SEQ ID NO: 2329177 - DNA, 23 bp, Homo sapiens
ttggctgagatatgaacatattg

SEQ ID NO: 2329178 - DNA, 13 bp, Homo sapiens
ttggctgccctgt

SEQ ID NO: 2329179 - DNA, 17 bp, Homo sapiens
ttggctttatgcacatt

SEQ ID NO: 2329180 - DNA, 15 bp, Homo sapiens
ttgggaaaacatttg

SEQ ID NO: 2329181 - DNA, 16 bp, Homo sapiens
ttgggaaaacatttgc

SEQ ID NO: 2329182 - DNA, 13 bp, Homo sapiens
ttgggaaagtatt

SEQ ID NO: 2329183 - DNA, 20 bp, Homo sapiens
ttgggaatgaaattaacaca

SEQ ID NO: 2329184 - DNA, 15 bp, Homo sapiens
ttgggatcagcctcc

SEQ ID NO: 2329185 - DNA, 23 bp, Homo sapiens
ttgggcagccagaccagcaggct

SEQ ID NO: 2329186 - DNA, 16 bp, Homo sapiens
ttgggcagtgccccag

SEQ ID NO: 2329187 - DNA, 17 bp, Homo sapiens
ttgggcagtgccccagg

SEQ ID NO: 2329188 - DNA, 19 bp, Homo sapiens
ttggggctacttatattct

SEQ ID NO: 2329189 - DNA, 19 bp, Homo sapiens
ttgggtggccccctctcct

SEQ ID NO: 2329190 - DNA, 14 bp, Homo sapiens
ttgggtgtttccag

SEQ ID NO: 2329191 - DNA, 19 bp, Homo sapiens
ttgggttctttctgggggg

SEQ ID NO: 2329192 - DNA, 22 bp, Homo sapiens
ttggtaaaaacagcagctcata

SEQ ID NO: 2329193 - DNA, 14 bp, Homo sapiens
ttggtaaatgtttc

SEQ ID NO: 2329194 - DNA, 23 bp, Homo sapiens
ttggtcacaaagctatttaagtg

SEQ ID NO: 2329195 - DNA, 17 bp, Homo sapiens
ttggtctcaggcagcac

SEQ ID NO: 2329196 - DNA, 22 bp, Homo sapiens
ttggtctcccttctctacactc

SEQ ID NO: 2329197 - DNA, 22 bp, Homo sapiens
ttggtgaatcggttgttctttc

SEQ ID NO: 2329198 - DNA, 12 bp, Homo sapiens
ttggtgcctggc

SEQ ID NO: 2329199 - DNA, 17 bp, Homo sapiens
ttggtgtaatttgaaga

SEQ ID NO: 2329200 - DNA, 21 bp, Homo sapiens
ttggttcaataaagcactgag

SEQ ID NO: 2329201 - DNA, 14 bp, Homo sapiens
ttggttctgtgaac

SEQ ID NO: 2329202 - DNA, 15 bp, Homo sapiens
ttggttctgtgaaca

SEQ ID NO: 2329203 - DNA, 23 bp, Homo sapiens
ttggttttatggttacttcttct

SEQ ID NO: 2329204 - DNA, 15 bp, Homo sapiens
ttgtaaaaaaaaatg

SEQ ID NO: 2329205 - DNA, 20 bp, Homo sapiens
ttgtaaaaaaaaatgccttt

SEQ ID NO: 2329206 - DNA, 22 bp, Homo sapiens
ttgtaaaaatcttttgaagcat

SEQ ID NO: 2329207 - DNA, 22 bp, Homo sapiens
ttgtaaaagaaatcatgtccat

SEQ ID NO: 2329208 - DNA, 13 bp, Homo sapiens
ttgtaaagactgg

SEQ ID NO: 2329209 - DNA, 21 bp, Homo sapiens
ttgtaaagactggttttctgc

SEQ ID NO: 2329210 - DNA, 13 bp, Homo sapiens
ttgtaaagatatt

SEQ ID NO: 2329211 - DNA, 14 bp, Homo sapiens
ttcaaataatgctt

SEQ ID NO: 2329212 - DNA, 16 bp, Homo sapiens
ttcaaattcttctgaa

SEQ ID NO: 2329213 - DNA, 22 bp, Homo sapiens
ttcaacaaatattcactggccc

SEQ ID NO: 2329214 - DNA, 17 bp, Homo sapiens
ttcaactacagtgattc

SEQ ID NO: 2329215 - DNA, 12 bp, Homo sapiens
ttcaacttttct

SEQ ID NO: 2329216 - DNA, 16 bp, Homo sapiens
ttcaagaatgaaaaat

SEQ ID NO: 2329217 - DNA, 17 bp, Homo sapiens
ttcaagaatgaaaaata

SEQ ID NO: 2329218 - DNA, 20 bp, Homo sapiens
ttcaagaatgaaaaatataa

SEQ ID NO: 2329219 - DNA, 21 bp, Homo sapiens
ttcaagaatgaaaaatataat

SEQ ID NO: 2329220 - DNA, 21 bp, Homo sapiens
ttcaagaggagcccccaccct

SEQ ID NO: 2329221 - DNA, 15 bp, Homo sapiens
ttcaagattctaaag

SEQ ID NO: 2329222 - DNA, 17 bp, Homo sapiens
ttcaagattctaaagct

SEQ ID NO: 2329223 - DNA, 16 bp, Homo sapiens
ttcaaggaggcccact

SEQ ID NO: 2329224 - DNA, 22 bp, Homo sapiens
ttcaaggtcactgtttcctggg

SEQ ID NO: 2329225 - DNA, 19 bp, Homo sapiens
ttcaataaatgtctgttga

SEQ ID NO: 2329226 - DNA, 17 bp, Homo sapiens
ttcaatcctacttttcg

SEQ ID NO: 2329227 - DNA, 18 bp, Homo sapiens
ttcaatctgtaaactgtg

SEQ ID NO: 2329228 - DNA, 15 bp, Homo sapiens
ttcaatgtgcataat

SEQ ID NO: 2329229 - DNA, 20 bp, Homo sapiens
ttcaattttaaggcatattt

SEQ ID NO: 2329230 - DNA, 15 bp, Homo sapiens
ttcacagataacata

SEQ ID NO: 2329231 - DNA, 17 bp, Homo sapiens
ttcacagcacttacaat

SEQ ID NO: 2329232 - DNA, 17 bp, Homo sapiens
ttcacagtagagccagc

SEQ ID NO: 2329233 - DNA, 14 bp, Homo sapiens
ttcacatttagaaa

SEQ ID NO: 2329234 - DNA, 14 bp, Homo sapiens
ttcacctcagtaga

SEQ ID NO: 2329235 - DNA, 16 bp, Homo sapiens
ttcacctgtaaacctg

SEQ ID NO: 2329236 - DNA, 17 bp, Homo sapiens
ttcacctgtaaacctga

SEQ ID NO: 2329237 - DNA, 18 bp, Homo sapiens
ttcacctgtaaacctgag

SEQ ID NO: 2329238 - DNA, 16 bp, Homo sapiens
ttcactcactctaaag

SEQ ID NO: 2329239 - DNA, 17 bp, Homo sapiens
ttcactgccagttgtct

SEQ ID NO: 2329240 - DNA, 13 bp, Homo sapiens
ttcactgtataaa

SEQ ID NO: 2329241 - DNA, 15 bp, Homo sapiens
ttcactgtataaata

SEQ ID NO: 2329242 - DNA, 16 bp, Homo sapiens
ttcactgtataaatag

SEQ ID NO: 2329243 - DNA, 18 bp, Homo sapiens
ttcactgtataaatagga

SEQ ID NO: 2329244 - DNA, 19 bp, Homo sapiens
ttcactgtataaataggag

SEQ ID NO: 2329245 - DNA, 20 bp, Homo sapiens
ttcactgtcaccaccctgct

SEQ ID NO: 2329246 - DNA, 12 bp, Homo sapiens
ttcacttcttcc

SEQ ID NO: 2329247 - DNA, 19 bp, Homo sapiens
ttcacttgtgttttaaaat

SEQ ID NO: 2329248 - DNA, 14 bp, Homo sapiens
ttcactttgaaaag

SEQ ID NO: 2329249 - DNA, 12 bp, Homo sapiens
ttcagaaatgtt

SEQ ID NO: 2329250 - DNA, 20 bp, Homo sapiens
ttcagaagtgcccttcctgc

SEQ ID NO: 2329251 - DNA, 14 bp, Homo sapiens
ttcagactgtgcaa

SEQ ID NO: 2329252 - DNA, 16 bp, Homo sapiens
ttcagactgtgcaata

SEQ ID NO: 2329253 - DNA, 19 bp, Homo sapiens
ttcagcaagttagaactag

SEQ ID NO: 2329254 - DNA, 14 bp, Homo sapiens
ttcagctctttcca

SEQ ID NO: 2329255 - DNA, 22 bp, Homo sapiens
ttcagcttcgtttattttcaag

SEQ ID NO: 2329256 - DNA, 23 bp, Homo sapiens
ttcagggtgcagcccaatctgcc

SEQ ID NO: 2329257 - DNA, 13 bp, Homo sapiens
ttcaggtgacatg

SEQ ID NO: 2329258 - DNA, 14 bp, Homo sapiens
ttcaggtgacatgt

SEQ ID NO: 2329259 - DNA, 23 bp, Homo sapiens
ttcaggtgacatgtgaaaccttt

SEQ ID NO: 2329260 - DNA, 19 bp, Homo sapiens
ttcaggttatcgaaataac

SEQ ID NO: 2329261 - DNA, 15 bp, Homo sapiens
ttcagtcccctctct

SEQ ID NO: 2329262 - DNA, 17 bp, Homo sapiens
ttcagtcccctctctct

SEQ ID NO: 2329263 - DNA, 20 bp, Homo sapiens
ttcagtcccctctctctggg

SEQ ID NO: 2329264 - DNA, 16 bp, Homo sapiens
ttcagttctaggaaaa

SEQ ID NO: 2329265 - DNA, 19 bp, Homo sapiens
ttcagttctaggaaaataa

SEQ ID NO: 2329266 - DNA, 14 bp, Homo sapiens
ttcagttctttgga

SEQ ID NO: 2329267 - DNA, 20 bp, Homo sapiens
ttcagttctttggattctaa

SEQ ID NO: 2329268 - DNA, 12 bp, Homo sapiens
ttcataagtatt

SEQ ID NO: 2329269 - DNA, 13 bp, Homo sapiens
ttcataataaatt

SEQ ID NO: 2329270 - DNA, 15 bp, Homo sapiens
ttcataataaatttt

SEQ ID NO: 2329271 - DNA, 17 bp, Homo sapiens
tgggcttggcctgctgt

SEQ ID NO: 2329272 - DNA, 18 bp, Homo sapiens
tgggcttgtggggcctgg

SEQ ID NO: 2329273 - DNA, 20 bp, Homo sapiens
tgggcttttggggagccaga

SEQ ID NO: 2329274 - DNA, 21 bp, Homo sapiens
tgggcttttggggagccagaa

SEQ ID NO: 2329275 - DNA, 13 bp, Homo sapiens
tggggaaaatggc

SEQ ID NO: 2329276 - DNA, 21 bp, Homo sapiens
tggggaaaatggccatgcagg

SEQ ID NO: 2329277 - DNA, 21 bp, Homo sapiens
tggggaaacaacatttatatg

SEQ ID NO: 2329278 - DNA, 18 bp, Homo sapiens
tggggaaactggccatgg

SEQ ID NO: 2329279 - DNA, 18 bp, Homo sapiens
tggggacctggcactggg

SEQ ID NO: 2329280 - DNA, 16 bp, Homo sapiens
tggggacttgtgtctg

SEQ ID NO: 2329281 - DNA, 15 bp, Homo sapiens
tggggagatgcttct

SEQ ID NO: 2329282 - DNA, 18 bp, Homo sapiens
tggggataataatactga

SEQ ID NO: 2329283 - DNA, 22 bp, Homo sapiens
tggggatccccgcctggccagg

SEQ ID NO: 2329284 - DNA, 16 bp, Homo sapiens
tggggcacagatgcct

SEQ ID NO: 2329285 - DNA, 14 bp, Homo sapiens
tggggcaggctggg

SEQ ID NO: 2329286 - DNA, 15 bp, Homo sapiens
tggggcaggctgggc

SEQ ID NO: 2329287 - DNA, 18 bp, Homo sapiens
tggggcaggctgggccat

SEQ ID NO: 2329288 - DNA, 21 bp, Homo sapiens
tggggccaccaaagctgccca

SEQ ID NO: 2329289 - DNA, 17 bp, Homo sapiens
tggggccagaggctggg

SEQ ID NO: 2329290 - DNA, 21 bp, Homo sapiens
tggggcctagcgatctctcct

SEQ ID NO: 2329291 - DNA, 20 bp, Homo sapiens
tggggccttgatgactgcct

SEQ ID NO: 2329292 - DNA, 19 bp, Homo sapiens
tggggcgggtggggccata

SEQ ID NO: 2329293 - DNA, 22 bp, Homo sapiens
tggggctcgccccacccagggc

SEQ ID NO: 2329294 - DNA, 20 bp, Homo sapiens
tggggctgtgttatgaaaat

SEQ ID NO: 2329295 - DNA, 14 bp, Homo sapiens
tgggggagagccgt

SEQ ID NO: 2329296 - DNA, 23 bp, Homo sapiens
tgggggcatctcttccccagaga

SEQ ID NO: 2329297 - DNA, 14 bp, Homo sapiens
tgggggctagggag

SEQ ID NO: 2329298 - DNA, 23 bp, Homo sapiens
tgggggcttcatctctttagaga

SEQ ID NO: 2329299 - DNA, 15 bp, Homo sapiens
tggggggcattgagt

SEQ ID NO: 2329300 - DNA, 18 bp, Homo sapiens
tgggggtggaggcttcct

SEQ ID NO: 2329301 - DNA, 23 bp, Homo sapiens
tgggggtgggctgctggccatga

SEQ ID NO: 2329302 - DNA, 12 bp, Homo sapiens
tgggggttgctg

SEQ ID NO: 2329303 - DNA, 13 bp, Homo sapiens
tggggtgctggga

SEQ ID NO: 2329304 - DNA, 13 bp, Homo sapiens
tggggtggagcac

SEQ ID NO: 2329305 - DNA, 20 bp, Homo sapiens
tggggtggagcactggactc

SEQ ID NO: 2329306 - DNA, 14 bp, Homo sapiens
tgggtaacgtgaga

SEQ ID NO: 2329307 - DNA, 15 bp, Homo sapiens
tgggtatgctcaggt

SEQ ID NO: 2329308 - DNA, 21 bp, Homo sapiens
tgggtcctagcccttccctga

SEQ ID NO: 2329309 - DNA, 21 bp, Homo sapiens
tgggtctaggacacagttcct

SEQ ID NO: 2329310 - DNA, 14 bp, Homo sapiens
tgggtctctgaagg

SEQ ID NO: 2329311 - DNA, 23 bp, Homo sapiens
tgggtctctgaagggaccccccc

SEQ ID NO: 2329312 - DNA, 13 bp, Homo sapiens
tgggtgacggtcc

SEQ ID NO: 2329313 - DNA, 15 bp, Homo sapiens
tgggtgctgccatga

SEQ ID NO: 2329314 - DNA, 16 bp, Homo sapiens
tgggtgggctctgtgc

SEQ ID NO: 2329315 - DNA, 20 bp, Homo sapiens
tgggtggggggcattgagta

SEQ ID NO: 2329316 - DNA, 15 bp, Homo sapiens
tgggtgtattctctg

SEQ ID NO: 2329317 - DNA, 17 bp, Homo sapiens
tgggtgtattctctgta

SEQ ID NO: 2329318 - DNA, 12 bp, Homo sapiens
tgggtgtcctgc

SEQ ID NO: 2329319 - DNA, 13 bp, Homo sapiens
tgggtgtcctgcc

SEQ ID NO: 2329320 - DNA, 17 bp, Homo sapiens
tgggtgtctccttaagc

SEQ ID NO: 2329321 - DNA, 15 bp, Homo sapiens
tgggtgttctttcct

SEQ ID NO: 2329322 - DNA, 20 bp, Homo sapiens
tgggttcttcccagctctct

SEQ ID NO: 2329323 - DNA, 12 bp, Homo sapiens
tgggttctttct

SEQ ID NO: 2329324 - DNA, 18 bp, Homo sapiens
tgggttctttctgggggg

SEQ ID NO: 2329325 - DNA, 15 bp, Homo sapiens
tgggttgggatcagg

SEQ ID NO: 2329326 - DNA, 20 bp, Homo sapiens
tggtaaaactcactgtgatc

SEQ ID NO: 2329327 - DNA, 23 bp, Homo sapiens
tggtaatctttacctgtatacag

SEQ ID NO: 2329328 - DNA, 13 bp, Homo sapiens
tggtagaagccag

SEQ ID NO: 2329329 - DNA, 16 bp, Homo sapiens
tggtagaagccagtac

SEQ ID NO: 2329330 - DNA, 14 bp, Homo sapiens
tggtatttctaatt

SEQ ID NO: 2329331 - DNA, 15 bp, Homo sapiens
tggtcaagattttga

SEQ ID NO: 2329332 - DNA, 20 bp, Homo sapiens
tggtcacgtttggtgcttct

SEQ ID NO: 2329333 - DNA, 21 bp, Homo sapiens
tggtcataaaatagaataatt

SEQ ID NO: 2329334 - DNA, 17 bp, Homo sapiens
tggtcctagtaagaaga

SEQ ID NO: 2329335 - DNA, 17 bp, Homo sapiens
tggtctcaggcagcacc

SEQ ID NO: 2329336 - DNA, 20 bp, Homo sapiens
tggtctgtggatcagcattt

SEQ ID NO: 2329337 - DNA, 13 bp, Homo sapiens
tggtctttgctcc

SEQ ID NO: 2329338 - DNA, 14 bp, Homo sapiens
tggtctttgtaaga

SEQ ID NO: 2329339 - DNA, 15 bp, Homo sapiens
tggtgaggcccagcc

SEQ ID NO: 2329340 - DNA, 19 bp, Homo sapiens
tggtgaggcccagcctgtc

SEQ ID NO: 2329341 - DNA, 23 bp, Homo sapiens
tggtgagggtgccccgcctgagt

SEQ ID NO: 2329342 - DNA, 15 bp, Homo sapiens
tggtgccaatttcaa

SEQ ID NO: 2329343 - DNA, 20 bp, Homo sapiens
tggtgcctgagaggcaggca

SEQ ID NO: 2329344 - DNA, 13 bp, Homo sapiens
tggtgcctggcct

SEQ ID NO: 2329345 - DNA, 18 bp, Homo sapiens
tggtgcctggcctggcac

SEQ ID NO: 2329346 - DNA, 19 bp, Homo sapiens
tggtgcctggcctggcaca

SEQ ID NO: 2329347 - DNA, 13 bp, Homo sapiens
tggtgtaataaga

SEQ ID NO: 2329348 - DNA, 14 bp, Homo sapiens
tggtgtaataagac

SEQ ID NO: 2329349 - DNA, 16 bp, Homo sapiens
tggtgtaataagacat

SEQ ID NO: 2329350 - DNA, 19 bp, Homo sapiens
tggtgtaataagacataac

SEQ ID NO: 2329351 - DNA, 16 bp, Homo sapiens
tggtgtgaacccggga

SEQ ID NO: 2329352 - DNA, 14 bp, Homo sapiens
tggtgtggcctgtg

SEQ ID NO: 2329353 - DNA, 17 bp, Homo sapiens
tggtgtgggtgtcctgc

SEQ ID NO: 2329354 - DNA, 23 bp, Homo sapiens
tggtgtgggtgtcctgcctgtct

SEQ ID NO: 2329355 - DNA, 16 bp, Homo sapiens
tggtgttgacatacat

SEQ ID NO: 2329356 - DNA, 21 bp, Homo sapiens
tggttaaggccagggcctctc

SEQ ID NO: 2329357 - DNA, 21 bp, Homo sapiens
tggttacctgacctaaattag

SEQ ID NO: 2329358 - DNA, 14 bp, Homo sapiens
tggttacttcttct

SEQ ID NO: 2329359 - DNA, 18 bp, Homo sapiens
tggttacttcttctctta

SEQ ID NO: 2329360 - DNA, 21 bp, Homo sapiens
tggttacttcttctcttagat

SEQ ID NO: 2329361 - DNA, 14 bp, Homo sapiens
tggttactttcaaa

SEQ ID NO: 2329362 - DNA, 17 bp, Homo sapiens
tggttactttcaaaatg

SEQ ID NO: 2329363 - DNA, 21 bp, Homo sapiens
tggttagtcacctgccccagc

SEQ ID NO: 2329364 - DNA, 17 bp, Homo sapiens
tggttatgttgataaac

SEQ ID NO: 2329365 - DNA, 20 bp, Homo sapiens
tggttcccaatatcatgtga

SEQ ID NO: 2329366 - DNA, 13 bp, Homo sapiens
tggttctgtgaac

SEQ ID NO: 2329367 - DNA, 16 bp, Homo sapiens
tggttgtcttattgca

SEQ ID NO: 2329368 - DNA, 20 bp, Homo sapiens
tggttgttttttcattgtgt

SEQ ID NO: 2329369 - DNA, 16 bp, Homo sapiens
tggtttagatccaatt

SEQ ID NO: 2329370 - DNA, 22 bp, Homo sapiens
tggtttagcgttgttttgtgga

SEQ ID NO: 2329371 - DNA, 17 bp, Homo sapiens
tggtttggaatattaaa

SEQ ID NO: 2329372 - DNA, 20 bp, Homo sapiens
tggtttggaatattaaaaaa

SEQ ID NO: 2329373 - DNA, 16 bp, Homo sapiens
tggttttatactgaag

SEQ ID NO: 2329374 - DNA, 18 bp, Homo sapiens
tgtaaaaaaaaatgcctt

SEQ ID NO: 2329375 - DNA, 14 bp, Homo sapiens
tgtaaaaaaaccac

SEQ ID NO: 2329376 - DNA, 22 bp, Homo sapiens
tgtaaaaaatgtctcatgtcaa

SEQ ID NO: 2329377 - DNA, 12 bp, Homo sapiens
tgtaaaaatctt

SEQ ID NO: 2329378 - DNA, 14 bp, Homo sapiens
tgtaaaatgtatat

SEQ ID NO: 2329379 - DNA, 18 bp, Homo sapiens
tgtaaaatgtttaatggt

SEQ ID NO: 2329380 - DNA, 14 bp, Homo sapiens
tgtaaactgtgtat

SEQ ID NO: 2329381 - DNA, 22 bp, Homo sapiens
tgtaaactgtgtattccaagac

SEQ ID NO: 2329382 - DNA, 12 bp, Homo sapiens
tgtaaagactgg

SEQ ID NO: 2329383 - DNA, 22 bp, Homo sapiens
tgtaaagatattgtatctcctt

SEQ ID NO: 2329384 - DNA, 18 bp, Homo sapiens
tgtaaatatttatttatg

SEQ ID NO: 2329385 - DNA, 19 bp, Homo sapiens
tgtaaatgcttaaatttca

SEQ ID NO: 2329386 - DNA, 18 bp, Homo sapiens
tgtccccctcctcccagg

SEQ ID NO: 2329387 - DNA, 12 bp, Homo sapiens
tgtcccctccca

SEQ ID NO: 2329388 - DNA, 16 bp, Homo sapiens
tgtcccggtaccttcc

SEQ ID NO: 2329389 - DNA, 13 bp, Homo sapiens
tgtccctgttaga

SEQ ID NO: 2329390 - DNA, 12 bp, Homo sapiens
tgtcccttttct

SEQ ID NO: 2329391 - DNA, 13 bp, Homo sapiens
tgtcccttttctt

SEQ ID NO: 2329392 - DNA, 15 bp, Homo sapiens
tgtccgcctctgccc

SEQ ID NO: 2329393 - DNA, 16 bp, Homo sapiens
tgtcctacgtccaagg

SEQ ID NO: 2329394 - DNA, 16 bp, Homo sapiens
tgtcctccttttcact

SEQ ID NO: 2329395 - DNA, 17 bp, Homo sapiens
tgtcctccttttcactt

SEQ ID NO: 2329396 - DNA, 18 bp, Homo sapiens
tgtcctccttttcacttt

SEQ ID NO: 2329397 - DNA, 21 bp, Homo sapiens
tgtcctgcctgtctgccccag

SEQ ID NO: 2329398 - DNA, 18 bp, Homo sapiens
tgtcctggtacagcaggg

SEQ ID NO: 2329399 - DNA, 19 bp, Homo sapiens
tgtcctggtacagcagggt

SEQ ID NO: 2329400 - DNA, 22 bp, Homo sapiens
tgtcctgtaaaggttacaagcc

SEQ ID NO: 2329401 - DNA, 19 bp, Homo sapiens
tgtcctttatgtattctct

SEQ ID NO: 2329402 - DNA, 15 bp, Homo sapiens
tgtcctttttcctct

SEQ ID NO: 2329403 - DNA, 20 bp, Homo sapiens
tgtcgaaaagagtcttccaa

SEQ ID NO: 2329404 - DNA, 22 bp, Homo sapiens
tgtcgaaaagagtcttccaatt

SEQ ID NO: 2329405 - DNA, 21 bp, Homo sapiens
tgtctaaagatctttttttaa

SEQ ID NO: 2329406 - DNA, 20 bp, Homo sapiens
tgtctaggactgcagtgtgg

SEQ ID NO: 2329407 - DNA, 19 bp, Homo sapiens
tgtctatgtagctgaaaat

SEQ ID NO: 2329408 - DNA, 13 bp, Homo sapiens
tgtctattcagct

SEQ ID NO: 2329409 - DNA, 20 bp, Homo sapiens
tgtctatttttaatgtttgt

SEQ ID NO: 2329410 - DNA, 18 bp, Homo sapiens
tgtctcaaaggagctttc

SEQ ID NO: 2329411 - DNA, 19 bp, Homo sapiens
tgtctcaaaggagctttct

SEQ ID NO: 2329412 - DNA, 20 bp, Homo sapiens
tgtctcactttactttcaag

SEQ ID NO: 2329413 - DNA, 21 bp, Homo sapiens
tgtctcactttactttcaagt

SEQ ID NO: 2329414 - DNA, 23 bp, Homo sapiens
tgtctccctcccctctcagaaca

SEQ ID NO: 2329415 - DNA, 17 bp, Homo sapiens
tgtctccttaagctgca

SEQ ID NO: 2329416 - DNA, 19 bp, Homo sapiens
tgtctgcccaatgaataat

SEQ ID NO: 2329417 - DNA, 13 bp, Homo sapiens
tgtctgctttggt

SEQ ID NO: 2329418 - DNA, 21 bp, Homo sapiens
tgtctgggtgctactggggaa

SEQ ID NO: 2329419 - DNA, 13 bp, Homo sapiens
tgtctgtacacgt

SEQ ID NO: 2329420 - DNA, 21 bp, Homo sapiens
tgtctgtacacgtgtcctgta

SEQ ID NO: 2329421 - DNA, 23 bp, Homo sapiens
tgtctgtagctcctcaactcacc

SEQ ID NO: 2329422 - DNA, 15 bp, Homo sapiens
tgtctgtcaatcaca

SEQ ID NO: 2329423 - DNA, 14 bp, Homo sapiens
tgtctgtcctttat

SEQ ID NO: 2329424 - DNA, 21 bp, Homo sapiens
tgtctgtctccctcccctctc

SEQ ID NO: 2329425 - DNA, 14 bp, Homo sapiens
tgtctgtctggcac

SEQ ID NO: 2329426 - DNA, 14 bp, Homo sapiens
tgtctgtgaacaga

SEQ ID NO: 2329427 - DNA, 15 bp, Homo sapiens
tgtctgttctacata

SEQ ID NO: 2329428 - DNA, 20 bp, Homo sapiens
tgtctgtttattaactactg

SEQ ID NO: 2329429 - DNA, 16 bp, Homo sapiens
tgtcttatgtgaaaaa

SEQ ID NO: 2329430 - DNA, 12 bp, Homo sapiens
tgtcttccctgg

SEQ ID NO: 2329431 - DNA, 13 bp, Homo sapiens
tgtcttccctggg

SEQ ID NO: 2329432 - DNA, 15 bp, Homo sapiens
tgtcttccctgggct

SEQ ID NO: 2329433 - DNA, 13 bp, Homo sapiens
tgtcttctccctg

SEQ ID NO: 2329434 - DNA, 15 bp, Homo sapiens
tgtcttggacactgt

SEQ ID NO: 2329435 - DNA, 17 bp, Homo sapiens
tgtcttgtacatgtgta

SEQ ID NO: 2329436 - DNA, 22 bp, Homo sapiens
tgtcttgtacatgtgtagcctg

SEQ ID NO: 2329437 - DNA, 22 bp, Homo sapiens
tgtcttgtatttaaaaacattt

SEQ ID NO: 2329438 - DNA, 15 bp, Homo sapiens
tgtctttcagataca

SEQ ID NO: 2329439 - DNA, 16 bp, Homo sapiens
tgtctttggaggtgct

SEQ ID NO: 2329440 - DNA, 16 bp, Homo sapiens
tgtcttttcagaagca

SEQ ID NO: 2329441 - DNA, 20 bp, Homo sapiens
tgtgaaaccttttttaagat

SEQ ID NO: 2329442 - DNA, 13 bp, Homo sapiens
tgtgaaattgcat

SEQ ID NO: 2329443 - DNA, 15 bp, Homo sapiens
tgtgaacagagagac

SEQ ID NO: 2329444 - DNA, 23 bp, Homo sapiens
tgtgaacagagagacccttgtgg

SEQ ID NO: 2329445 - DNA, 18 bp, Homo sapiens
tgtgaaccctggggcctg

SEQ ID NO: 2329446 - DNA, 15 bp, Homo sapiens
tgtgaactaatgaca

SEQ ID NO: 2329447 - DNA, 15 bp, Homo sapiens
tgtgaatagcctggc

SEQ ID NO: 2329448 - DNA, 13 bp, Homo sapiens
tgtgaatggattg

SEQ ID NO: 2329449 - DNA, 20 bp, Homo sapiens
tgtgaattattgacactgaa

SEQ ID NO: 2329450 - DNA, 17 bp, Homo sapiens
tgtgaatttttaagctg

SEQ ID NO: 2329451 - DNA, 13 bp, Homo sapiens
tgtgacagtgcct

SEQ ID NO: 2329452 - DNA, 20 bp, Homo sapiens
tgtgacagtgcctcttccag

SEQ ID NO: 2329453 - DNA, 16 bp, Homo sapiens
tgtgacagtttccaaa

SEQ ID NO: 2329454 - DNA, 18 bp, Homo sapiens
tgtgacagtttccaaatt

SEQ ID NO: 2329455 - DNA, 16 bp, Homo sapiens
tgtgacatggtgcctg

SEQ ID NO: 2329456 - DNA, 13 bp, Homo sapiens
tgtgaccctccaa

SEQ ID NO: 2329457 - DNA, 15 bp, Homo sapiens
tgtgagccccacagc

SEQ ID NO: 2329458 - DNA, 17 bp, Homo sapiens
tgtgagctgtaaaaatg

SEQ ID NO: 2329459 - DNA, 22 bp, Homo sapiens
tgtgagggaggggaaaagcatt

SEQ ID NO: 2329460 - DNA, 21 bp, Homo sapiens
tgtgatacattttttaagctt

SEQ ID NO: 2329461 - DNA, 14 bp, Homo sapiens
tgtgatctgggcat

SEQ ID NO: 2329462 - DNA, 22 bp, Homo sapiens
tgtgatctgggcattttcctcc

SEQ ID NO: 2329463 - DNA, 16 bp, Homo sapiens
tgtgatcttaaaataa

SEQ ID NO: 2329464 - DNA, 15 bp, Homo sapiens
tgtgatgtgttgctc

SEQ ID NO: 2329465 - DNA, 16 bp, Homo sapiens
tgtgatgtgttgctct

SEQ ID NO: 2329466 - DNA, 16 bp, Homo sapiens
tgtgattcaatctgta

SEQ ID NO: 2329467 - DNA, 22 bp, Homo sapiens
tgtgattccactacacctggct

SEQ ID NO: 2329468 - DNA, 15 bp, Homo sapiens
tgtgatttgaattct

SEQ ID NO: 2329469 - DNA, 16 bp, Homo sapiens
tgtgatttgaattctg

SEQ ID NO: 2329470 - DNA, 17 bp, Homo sapiens
tgtgatttgaattctgt

SEQ ID NO: 2329471 - DNA, 21 bp, Homo sapiens
tgtgcaaggtggcctttgtgc

SEQ ID NO: 2329472 - DNA, 22 bp, Homo sapiens
tgtgcacctaccccttggaaat

SEQ ID NO: 2329473 - DNA, 18 bp, Homo sapiens
tgtgcagtcactggaggt

SEQ ID NO: 2329474 - DNA, 20 bp, Homo sapiens
tgtgcataatgataaaataa

SEQ ID NO: 2329475 - DNA, 16 bp, Homo sapiens
tgtgcatagtttcttt

SEQ ID NO: 2329476 - DNA, 20 bp, Homo sapiens
tgtgcatgtatgtcttggac

SEQ ID NO: 2329477 - DNA, 13 bp, Homo sapiens
tgtgcatttaatt

SEQ ID NO: 2329478 - DNA, 21 bp, Homo sapiens
tgtgccactaaactacattgt

SEQ ID NO: 2329479 - DNA, 22 bp, Homo sapiens
tgtgccagaggaatcctggcag

SEQ ID NO: 2329480 - DNA, 20 bp, Homo sapiens
tgtgccatggatctgatctg

SEQ ID NO: 2329481 - DNA, 13 bp, Homo sapiens
tgtgcctggcccc

SEQ ID NO: 2329482 - DNA, 23 bp, Homo sapiens
tgtgcctggccccagcctgggcc

SEQ ID NO: 2329483 - DNA, 17 bp, Homo sapiens
tgtgctatacacacaca

SEQ ID NO: 2329484 - DNA, 18 bp, Homo sapiens
tgtgctatacacacacac

SEQ ID NO: 2329485 - DNA, 19 bp, Homo sapiens
tgtgctgacaacttagctc

SEQ ID NO: 2329486 - DNA, 21 bp, Homo sapiens
tgtgctgacaacttagctcag

SEQ ID NO: 2329487 - DNA, 22 bp, Homo sapiens
tgtgcttcacagtagagccagc

SEQ ID NO: 2329488 - DNA, 19 bp, Homo sapiens
tgtgcttgagccaggaggc

SEQ ID NO: 2329489 - DNA, 15 bp, Homo sapiens
tgtgcttggtctgtt

SEQ ID NO: 2329490 - DNA, 18 bp, Homo sapiens
tgtgcttggtctgtttga

SEQ ID NO: 2329491 - DNA, 21 bp, Homo sapiens
tgtggaggaagagccacctgc

SEQ ID NO: 2329492 - DNA, 22 bp, Homo sapiens
tgtggaggaagagccacctgca

SEQ ID NO: 2329493 - DNA, 21 bp, Homo sapiens
tgtggaggaaggattgtaaaa

SEQ ID NO: 2329494 - DNA, 19 bp, Homo sapiens
tgtggataagaaaaatgct

SEQ ID NO: 2329495 - DNA, 20 bp, Homo sapiens
tgtggcatttccaaacatcc

SEQ ID NO: 2329496 - DNA, 16 bp, Homo sapiens
tgtggccctggctgcc

SEQ ID NO: 2329497 - DNA, 19 bp, Homo sapiens
tgtggcctttatctcaacg

SEQ ID NO: 2329498 - DNA, 17 bp, Homo sapiens
tgtggctactgacatat

SEQ ID NO: 2329499 - DNA, 16 bp, Homo sapiens
tgtggctgatttacta

SEQ ID NO: 2329500 - DNA, 22 bp, Homo sapiens
tgtggctggctctaccttcctg

SEQ ID NO: 2329501 - DNA, 17 bp, Homo sapiens
tgttttctgaaacacac

SEQ ID NO: 2329502 - DNA, 12 bp, Homo sapiens
tgttttcttcaa

SEQ ID NO: 2329503 - DNA, 14 bp, Homo sapiens
tgttttgtggataa

SEQ ID NO: 2329504 - DNA, 14 bp, Homo sapiens
tgttttttaagata

SEQ ID NO: 2329505 - DNA, 19 bp, Homo sapiens
tgttttttaagatggcaat

SEQ ID NO: 2329506 - DNA, 16 bp, Homo sapiens
tgtttttttgttatta

SEQ ID NO: 2329507 - DNA, 21 bp, Homo sapiens
ttaaaaaaaaaagtcaccaaa

SEQ ID NO: 2329508 - DNA, 16 bp, Homo sapiens
ttaaaaaaaaattgta

SEQ ID NO: 2329509 - DNA, 20 bp, Homo sapiens
ttaaaaaacttcatgtaatt

SEQ ID NO: 2329510 - DNA, 14 bp, Homo sapiens
ttaaaaaataaata

SEQ ID NO: 2329511 - DNA, 22 bp, Homo sapiens
ttaaaaacattttttatacatt

SEQ ID NO: 2329512 - DNA, 15 bp, Homo sapiens
ttaaaaaggtaaatg

SEQ ID NO: 2329513 - DNA, 19 bp, Homo sapiens
ttaaaaaggtaaatggtta

SEQ ID NO: 2329514 - DNA, 19 bp, Homo sapiens
ttaaaaatgagatttctta

SEQ ID NO: 2329515 - DNA, 17 bp, Homo sapiens
ttaaaacaaatatacat

SEQ ID NO: 2329516 - DNA, 14 bp, Homo sapiens
ttaaaacagacact

SEQ ID NO: 2329517 - DNA, 14 bp, Homo sapiens
ttaaaaccaaagag

SEQ ID NO: 2329518 - DNA, 13 bp, Homo sapiens
ttaaaactaaatt

SEQ ID NO: 2329519 - DNA, 12 bp, Homo sapiens
ttaaaagcattt

SEQ ID NO: 2329520 - DNA, 18 bp, Homo sapiens
ttaaaagcatttttatta

SEQ ID NO: 2329521 - DNA, 14 bp, Homo sapiens
ttaaaataaaatga

SEQ ID NO: 2329522 - DNA, 15 bp, Homo sapiens
ttaaaataattcata

SEQ ID NO: 2329523 - DNA, 22 bp, Homo sapiens
ttaaaatggaaaattttctcct

SEQ ID NO: 2329524 - DNA, 21 bp, Homo sapiens
ttaaaatgtaatttaaatgaa

SEQ ID NO: 2329525 - DNA, 15 bp, Homo sapiens
ttaaaatttgtctta

SEQ ID NO: 2329526 - DNA, 17 bp, Homo sapiens
ttaaacaaagtttcaga

SEQ ID NO: 2329527 - DNA, 22 bp, Homo sapiens
ttaaacggtgcccatcctgcca

SEQ ID NO: 2329528 - DNA, 22 bp, Homo sapiens
ttaaactattagagtatttccc

SEQ ID NO: 2329529 - DNA, 19 bp, Homo sapiens
ttaaactgtgtacataact

SEQ ID NO: 2329530 - DNA, 16 bp, Homo sapiens
ttaaacttccaaagaa

SEQ ID NO: 2329531 - DNA, 16 bp, Homo sapiens
ttaaagaaaggaaaag

SEQ ID NO: 2329532 - DNA, 17 bp, Homo sapiens
ttaaagaaaggaaaaga

SEQ ID NO: 2329533 - DNA, 19 bp, Homo sapiens
ttaaagaatgttagtaaag

SEQ ID NO: 2329534 - DNA, 18 bp, Homo sapiens
ttaaagacaggagacaaa

SEQ ID NO: 2329535 - DNA, 20 bp, Homo sapiens
ttaaagcatcaccactcatt

SEQ ID NO: 2329536 - DNA, 18 bp, Homo sapiens
ttaaagccattctgatta

SEQ ID NO: 2329537 - DNA, 21 bp, Homo sapiens
ttaaaggcagtattttgtgtc

SEQ ID NO: 2329538 - DNA, 23 bp, Homo sapiens
ttaaagtatgcattattaaattg

SEQ ID NO: 2329539 - DNA, 20 bp, Homo sapiens
ttaaataaaatttttatgta

SEQ ID NO: 2329540 - DNA, 17 bp, Homo sapiens
ttaaatgcaataatttt

SEQ ID NO: 2329541 - DNA, 12 bp, Homo sapiens
ttaaatttcaga

SEQ ID NO: 2329542 - DNA, 14 bp, Homo sapiens
ttaaatttgtaagt

SEQ ID NO: 2329543 - DNA, 16 bp, Homo sapiens
ttaaattttacatgac

SEQ ID NO: 2329544 - DNA, 16 bp, Homo sapiens
ttaacaagatgtttca

SEQ ID NO: 2329545 - DNA, 20 bp, Homo sapiens
ttaacaagatgtttcatttt

SEQ ID NO: 2329546 - DNA, 16 bp, Homo sapiens
ttaacatacaagaaaa

SEQ ID NO: 2329547 - DNA, 14 bp, Homo sapiens
ttaaccctcccctt

SEQ ID NO: 2329548 - DNA, 21 bp, Homo sapiens
ttaaccggtaagagtttcagt

SEQ ID NO: 2329549 - DNA, 21 bp, Homo sapiens
ttaaccttgtataaattattc

SEQ ID NO: 2329550 - DNA, 17 bp, Homo sapiens
ttaactataaggtgcct

SEQ ID NO: 2329551 - DNA, 22 bp, Homo sapiens
ttaactgtccgtaagcagtata

SEQ ID NO: 2329552 - DNA, 23 bp, Homo sapiens
ttaagaagctgttgtacatttat

SEQ ID NO: 2329553 - DNA, 16 bp, Homo sapiens
ttaagagattttatgt

SEQ ID NO: 2329554 - DNA, 22 bp, Homo sapiens
ttaagatgagcaaccacattta

SEQ ID NO: 2329555 - DNA, 21 bp, Homo sapiens
ttaagatggcaattactttgg

SEQ ID NO: 2329556 - DNA, 23 bp, Homo sapiens
ttaagcaaaggggacagctgtgt

SEQ ID NO: 2329557 - DNA, 14 bp, Homo sapiens
ttcccctttcctgt

SEQ ID NO: 2329558 - DNA, 15 bp, Homo sapiens
ttcccctttcctgtc

SEQ ID NO: 2329559 - DNA, 17 bp, Homo sapiens
ttcccgggccagggctg

SEQ ID NO: 2329560 - DNA, 15 bp, Homo sapiens
ttccctccccagaat

SEQ ID NO: 2329561 - DNA, 24 bp, Homo sapiens
ttccctctgggcacgcctgctggc

SEQ ID NO: 2329562 - DNA, 14 bp, Homo sapiens
ttccctgcctctca

SEQ ID NO: 2329563 - DNA, 20 bp, Homo sapiens
ttcccttattgcctcccagg

SEQ ID NO: 2329564 - DNA, 13 bp, Homo sapiens
ttcccttccaaag

SEQ ID NO: 2329565 - DNA, 22 bp, Homo sapiens
ttcccttctgggcttcattctg

SEQ ID NO: 2329566 - DNA, 14 bp, Homo sapiens
ttcccttgaaactt

SEQ ID NO: 2329567 - DNA, 22 bp, Homo sapiens
ttcccttgaaactttgggaaaa

SEQ ID NO: 2329568 - DNA, 14 bp, Homo sapiens
ttcctaacacagca

SEQ ID NO: 2329569 - DNA, 16 bp, Homo sapiens
ttcctactcacacttc

SEQ ID NO: 2329570 - DNA, 19 bp, Homo sapiens
ttcctcaaaataaagaagt

SEQ ID NO: 2329571 - DNA, 21 bp, Homo sapiens
ttcctcaaaataaagaagtat

SEQ ID NO: 2329572 - DNA, 12 bp, Homo sapiens
ttcctcctctgc

SEQ ID NO: 2329573 - DNA, 18 bp, Homo sapiens
ttcctcctttacctttca

SEQ ID NO: 2329574 - DNA, 14 bp, Homo sapiens
ttcctctccactgc

SEQ ID NO: 2329575 - DNA, 18 bp, Homo sapiens
ttcctctccactgctgga

SEQ ID NO: 2329576 - DNA, 15 bp, Homo sapiens
ttcctctgcctgccc

SEQ ID NO: 2329577 - DNA, 16 bp, Homo sapiens
ttcctctgcctgcccc

SEQ ID NO: 2329578 - DNA, 14 bp, Homo sapiens
ttcctctggccgca

SEQ ID NO: 2329579 - DNA, 18 bp, Homo sapiens
ttcctctttctgctctgc

SEQ ID NO: 2329580 - DNA, 21 bp, Homo sapiens
ttcctcttttgtgctgcttct

SEQ ID NO: 2329581 - DNA, 13 bp, Homo sapiens
ttcctgaatccaa

SEQ ID NO: 2329582 - DNA, 20 bp, Homo sapiens
ttcctgacctccgccatcca

SEQ ID NO: 2329583 - DNA, 14 bp, Homo sapiens
ttcctgcccttccc

SEQ ID NO: 2329584 - DNA, 15 bp, Homo sapiens
ttcctgcccttccct

SEQ ID NO: 2329585 - DNA, 18 bp, Homo sapiens
ttcctgcccttccctctg

SEQ ID NO: 2329586 - DNA, 19 bp, Homo sapiens
ttcctgcccttccctctgg

SEQ ID NO: 2329587 - DNA, 23 bp, Homo sapiens
ttcctgcccttccctctgggcac

SEQ ID NO: 2329588 - DNA, 16 bp, Homo sapiens
ttcctgcgtcctcctc

SEQ ID NO: 2329589 - DNA, 19 bp, Homo sapiens
ttcctgcgtcctcctcacc

SEQ ID NO: 2329590 - DNA, 11 bp, Homo sapiens
ttcctgctgct

SEQ ID NO: 2329591 - DNA, 13 bp, Homo sapiens
ttcctgctgctgt

SEQ ID NO: 2329592 - DNA, 15 bp, Homo sapiens
ttcctgctgctgtct

SEQ ID NO: 2329593 - DNA, 11 bp, Homo sapiens
ttcctgctgta

SEQ ID NO: 2329594 - DNA, 14 bp, Homo sapiens
ttcctggcctgaga

SEQ ID NO: 2329595 - DNA, 17 bp, Homo sapiens
ttcctgggccagaagta

SEQ ID NO: 2329596 - DNA, 21 bp, Homo sapiens
ttcctggggtaaagtatcact

SEQ ID NO: 2329597 - DNA, 15 bp, Homo sapiens
ttcctggtgactcct

SEQ ID NO: 2329598 - DNA, 16 bp, Homo sapiens
ttcctggtgactcctg

SEQ ID NO: 2329599 - DNA, 20 bp, Homo sapiens
ttcctggtgccaatttcaag

SEQ ID NO: 2329600 - DNA, 12 bp, Homo sapiens
ttcctgtactgt

SEQ ID NO: 2329601 - DNA, 23 bp, Homo sapiens
ttcctgtcccaccatacgagcac

SEQ ID NO: 2329602 - DNA, 17 bp, Homo sapiens
ttcctgtgatccaccca

SEQ ID NO: 2329603 - DNA, 20 bp, Homo sapiens
ttcctgtgggtgttctttcc

SEQ ID NO: 2329604 - DNA, 13 bp, Homo sapiens
ttccttacctttt

SEQ ID NO: 2329605 - DNA, 19 bp, Homo sapiens
ttccttcaatgtgcataat

SEQ ID NO: 2329606 - DNA, 14 bp, Homo sapiens
ttccttcatttcca

SEQ ID NO: 2329607 - DNA, 11 bp, Homo sapiens
ttccttccctc

SEQ ID NO: 2329608 - DNA, 13 bp, Homo sapiens
ttccttccctctc

SEQ ID NO: 2329609 - DNA, 15 bp, Homo sapiens
ttccttccctctctg

SEQ ID NO: 2329610 - DNA, 17 bp, Homo sapiens
ttccttctcacttagaa

SEQ ID NO: 2329611 - DNA, 18 bp, Homo sapiens
ttccttgcgcctcagccc

SEQ ID NO: 2329612 - DNA, 17 bp, Homo sapiens
ttcctttaaaaaaattt

SEQ ID NO: 2329613 - DNA, 15 bp, Homo sapiens
ttcctttatgtgaat

SEQ ID NO: 2329614 - DNA, 17 bp, Homo sapiens
ttccttttccctgcttc

SEQ ID NO: 2329615 - DNA, 12 bp, Homo sapiens
ttcgaggcctga

SEQ ID NO: 2329616 - DNA, 20 bp, Homo sapiens
ttcggaaggggttcctcaaa

SEQ ID NO: 2329617 - DNA, 18 bp, Homo sapiens
ttcggctatgtctcatgt

SEQ ID NO: 2329618 - DNA, 18 bp, Homo sapiens
ttcgggccaaggacctga

SEQ ID NO: 2329619 - DNA, 18 bp, Homo sapiens
ttctaaataaaaatatgt

SEQ ID NO: 2329620 - DNA, 17 bp, Homo sapiens
tgcctttgagacagttt

SEQ ID NO: 2329621 - DNA, 17 bp, Homo sapiens
tgccttttttttcatga

SEQ ID NO: 2329622 - DNA, 18 bp, Homo sapiens
tgcgaccttgcaacctca

SEQ ID NO: 2329623 - DNA, 18 bp, Homo sapiens
tgcgagtccaaggccagt

SEQ ID NO: 2329624 - DNA, 16 bp, Homo sapiens
tgcgccagtcctgcta

SEQ ID NO: 2329625 - DNA, 21 bp, Homo sapiens
tgcgcccttaactgcatccag

SEQ ID NO: 2329626 - DNA, 18 bp, Homo sapiens
tgcgcctcagccctcagt

SEQ ID NO: 2329627 - DNA, 16 bp, Homo sapiens
tgcgcctgcaggcaga

SEQ ID NO: 2329628 - DNA, 16 bp, Homo sapiens
tgcgcctgctgcctgc

SEQ ID NO: 2329629 - DNA, 17 bp, Homo sapiens
tgcgctctctttgcaac

SEQ ID NO: 2329630 - DNA, 18 bp, Homo sapiens
tgcggaccaccctcactg

SEQ ID NO: 2329631 - DNA, 22 bp, Homo sapiens
tgcgggccagggtcctgtcgcc

SEQ ID NO: 2329632 - DNA, 16 bp, Homo sapiens
tgcgggctgaggccag

SEQ ID NO: 2329633 - DNA, 15 bp, Homo sapiens
tgcggtgggtgctgc

SEQ ID NO: 2329634 - DNA, 17 bp, Homo sapiens
tgcgtagaggctacagg

SEQ ID NO: 2329635 - DNA, 14 bp, Homo sapiens
tgcgtcctcctcac

SEQ ID NO: 2329636 - DNA, 16 bp, Homo sapiens
tgcgtcttggtgtaat

SEQ ID NO: 2329637 - DNA, 17 bp, Homo sapiens
tgcgtggactctgcaca

SEQ ID NO: 2329638 - DNA, 18 bp, Homo sapiens
tgcgtggactctgcacat

SEQ ID NO: 2329639 - DNA, 14 bp, Homo sapiens
tgcgtgtgtagagt

SEQ ID NO: 2329640 - DNA, 19 bp, Homo sapiens
tgcgtgtgtagagttaaga

SEQ ID NO: 2329641 - DNA, 20 bp, Homo sapiens
tgcgtgtgtagagttaagaa

SEQ ID NO: 2329642 - DNA, 14 bp, Homo sapiens
tgcgtgttcagcag

SEQ ID NO: 2329643 - DNA, 15 bp, Homo sapiens
tgctaatgctatgca

SEQ ID NO: 2329644 - DNA, 14 bp, Homo sapiens
tgctacaattttaa

SEQ ID NO: 2329645 - DNA, 15 bp, Homo sapiens
tgctacctcccttgc

SEQ ID NO: 2329646 - DNA, 22 bp, Homo sapiens
tgctactggggaaactggccat

SEQ ID NO: 2329647 - DNA, 20 bp, Homo sapiens
tgctactgttgtaagaattc

SEQ ID NO: 2329648 - DNA, 15 bp, Homo sapiens
tgctagaagctgtaa

SEQ ID NO: 2329649 - DNA, 21 bp, Homo sapiens
tgctagggttaggaggtcctt

SEQ ID NO: 2329650 - DNA, 13 bp, Homo sapiens
tgctataatctgt

SEQ ID NO: 2329651 - DNA, 17 bp, Homo sapiens
tgctataatctgttttt

SEQ ID NO: 2329652 - DNA, 14 bp, Homo sapiens
tgctatacacacac

SEQ ID NO: 2329653 - DNA, 15 bp, Homo sapiens
tgctatacacacaca

SEQ ID NO: 2329654 - DNA, 19 bp, Homo sapiens
tgctatccccatctccctg

SEQ ID NO: 2329655 - DNA, 20 bp, Homo sapiens
tgctatccccatctccctgc

SEQ ID NO: 2329656 - DNA, 18 bp, Homo sapiens
tgctatcgccctcctttc

SEQ ID NO: 2329657 - DNA, 19 bp, Homo sapiens
tgctatttattttcctaaa

SEQ ID NO: 2329658 - DNA, 13 bp, Homo sapiens
tgctcaaggccag

SEQ ID NO: 2329659 - DNA, 13 bp, Homo sapiens
tgctcaccagccc

SEQ ID NO: 2329660 - DNA, 16 bp, Homo sapiens
tgctcaccagccctgc

SEQ ID NO: 2329661 - DNA, 19 bp, Homo sapiens
tgctcaccgcccatcaggg

SEQ ID NO: 2329662 - DNA, 23 bp, Homo sapiens
tgctcaccgcccatcagggttct

SEQ ID NO: 2329663 - DNA, 16 bp, Homo sapiens
tgctcagaacttgctg

SEQ ID NO: 2329664 - DNA, 17 bp, Homo sapiens
tgctcagaacttgctgc

SEQ ID NO: 2329665 - DNA, 20 bp, Homo sapiens
tgctcagaacttgctgctgt

SEQ ID NO: 2329666 - DNA, 21 bp, Homo sapiens
tgctcagaacttgctgctgtc

SEQ ID NO: 2329667 - DNA, 18 bp, Homo sapiens
tgctcagggtcactgaac

SEQ ID NO: 2329668 - DNA, 19 bp, Homo sapiens
tgctcattacagttctttc

SEQ ID NO: 2329669 - DNA, 20 bp, Homo sapiens
tgctcattacagttctttcc

SEQ ID NO: 2329670 - DNA, 14 bp, Homo sapiens
tgctccaaatataa

SEQ ID NO: 2329671 - DNA, 23 bp, Homo sapiens
tgctccagataactctctttcct

SEQ ID NO: 2329672 - DNA, 13 bp, Homo sapiens
tgctccagattct

SEQ ID NO: 2329673 - DNA, 16 bp, Homo sapiens
tgctccagattctgat

SEQ ID NO: 2329674 - DNA, 17 bp, Homo sapiens
tgctccagattctgatg

SEQ ID NO: 2329675 - DNA, 18 bp, Homo sapiens
tgctccagattctgatgc

SEQ ID NO: 2329676 - DNA, 11 bp, Homo sapiens
tgctccccaca

SEQ ID NO: 2329677 - DNA, 14 bp, Homo sapiens
tgctccccacagcg

SEQ ID NO: 2329678 - DNA, 19 bp, Homo sapiens
tgctccccacagcgtccct

SEQ ID NO: 2329679 - DNA, 24 bp, Homo sapiens
tgctcccctgccacactgatggct

SEQ ID NO: 2329680 - DNA, 20 bp, Homo sapiens
tgctccgccatggtgtcccg

SEQ ID NO: 2329681 - DNA, 16 bp, Homo sapiens
tgctccgcctggcctg

SEQ ID NO: 2329682 - DNA, 20 bp, Homo sapiens
tgctctattaagattggaaa

SEQ ID NO: 2329683 - DNA, 21 bp, Homo sapiens
tgctctattaagattggaaat

SEQ ID NO: 2329684 - DNA, 22 bp, Homo sapiens
tgctctattaagattggaaatg

SEQ ID NO: 2329685 - DNA, 17 bp, Homo sapiens
tgctctcagctggcagt

SEQ ID NO: 2329686 - DNA, 19 bp, Homo sapiens
tgctctccattctgctcct

SEQ ID NO: 2329687 - DNA, 20 bp, Homo sapiens
tgctctccattctgctcctt

SEQ ID NO: 2329688 - DNA, 16 bp, Homo sapiens
tgctctccattctttt

SEQ ID NO: 2329689 - DNA, 12 bp, Homo sapiens
tgctctcctctt

SEQ ID NO: 2329690 - DNA, 13 bp, Homo sapiens
tgctctcctcttc

SEQ ID NO: 2329691 - DNA, 15 bp, Homo sapiens
tgctctcctcttcta

SEQ ID NO: 2329692 - DNA, 19 bp, Homo sapiens
tgctctgccccaccttgcc

SEQ ID NO: 2329693 - DNA, 12 bp, Homo sapiens
tgctctgcctca

SEQ ID NO: 2329694 - DNA, 17 bp, Homo sapiens
tgctctgcctcagacgt

SEQ ID NO: 2329695 - DNA, 11 bp, Homo sapiens
tgctctgtccc

SEQ ID NO: 2329696 - DNA, 21 bp, Homo sapiens
tgctctgtcccccaggctgga

SEQ ID NO: 2329697 - DNA, 20 bp, Homo sapiens
tgctctgtgagccccacagc

SEQ ID NO: 2329698 - DNA, 17 bp, Homo sapiens
tgctgaacacagtgtct

SEQ ID NO: 2329699 - DNA, 22 bp, Homo sapiens
tgctgaacacagtgtctgttca

SEQ ID NO: 2329700 - DNA, 23 bp, Homo sapiens
tgctgaacacagtgtctgttcag

SEQ ID NO: 2329701 - DNA, 23 bp, Homo sapiens
tggacactccagggacacacagc

SEQ ID NO: 2329702 - DNA, 16 bp, Homo sapiens
tggacagcagaagcct

SEQ ID NO: 2329703 - DNA, 18 bp, Homo sapiens
tggacagccagtgacctt

SEQ ID NO: 2329704 - DNA, 21 bp, Homo sapiens
tggacaggcagcctcctttgt

SEQ ID NO: 2329705 - DNA, 19 bp, Homo sapiens
tggacatgagatggagagg

SEQ ID NO: 2329706 - DNA, 21 bp, Homo sapiens
tggacatgatttagggaagca

SEQ ID NO: 2329707 - DNA, 16 bp, Homo sapiens
tggaccaacctgctct

SEQ ID NO: 2329708 - DNA, 22 bp, Homo sapiens
tggaccaacctgctctgtcccc

SEQ ID NO: 2329709 - DNA, 22 bp, Homo sapiens
tggaccatgccagattctgcct

SEQ ID NO: 2329710 - DNA, 22 bp, Homo sapiens
tggacctaatccaagcatccct

SEQ ID NO: 2329711 - DNA, 19 bp, Homo sapiens
tggacctccaggctccagc

SEQ ID NO: 2329712 - DNA, 21 bp, Homo sapiens
tggacctttgggttctttctg

SEQ ID NO: 2329713 - DNA, 18 bp, Homo sapiens
tggacggcaggctcactg

SEQ ID NO: 2329714 - DNA, 20 bp, Homo sapiens
tggacggcaggctcactgcc

SEQ ID NO: 2329715 - DNA, 22 bp, Homo sapiens
tggacggcaggctcactgccag

SEQ ID NO: 2329716 - DNA, 23 bp, Homo sapiens
tggactaaaggcatccttgtctt

SEQ ID NO: 2329717 - DNA, 13 bp, Homo sapiens
tggactctgcaca

SEQ ID NO: 2329718 - DNA, 14 bp, Homo sapiens
tggactctgcacat

SEQ ID NO: 2329719 - DNA, 19 bp, Homo sapiens
tggactctgcacatgtctt

SEQ ID NO: 2329720 - DNA, 18 bp, Homo sapiens
tggacttctacctgccct

SEQ ID NO: 2329721 - DNA, 14 bp, Homo sapiens
tggacttgcctctg

SEQ ID NO: 2329722 - DNA, 22 bp, Homo sapiens
tggagaaccagggctcttctca

SEQ ID NO: 2329723 - DNA, 23 bp, Homo sapiens
tggagaaccagggctcttctcag

SEQ ID NO: 2329724 - DNA, 15 bp, Homo sapiens
tggagaactctggct

SEQ ID NO: 2329725 - DNA, 11 bp, Homo sapiens
tggagaagaat

SEQ ID NO: 2329726 - DNA, 19 bp, Homo sapiens
tggagaagaatggctttca

SEQ ID NO: 2329727 - DNA, 18 bp, Homo sapiens
tggagaagctgcaggctt

SEQ ID NO: 2329728 - DNA, 17 bp, Homo sapiens
tggagacaaggtgctaa

SEQ ID NO: 2329729 - DNA, 14 bp, Homo sapiens
tggagaccctgcca

SEQ ID NO: 2329730 - DNA, 16 bp, Homo sapiens
tggagagcagctggct

SEQ ID NO: 2329731 - DNA, 15 bp, Homo sapiens
tggagattgacctgg

SEQ ID NO: 2329732 - DNA, 21 bp, Homo sapiens
tggagattgggatactgtaat

SEQ ID NO: 2329733 - DNA, 17 bp, Homo sapiens
tggagcacaaaattcaa

SEQ ID NO: 2329734 - DNA, 14 bp, Homo sapiens
tggagcactggact

SEQ ID NO: 2329735 - DNA, 13 bp, Homo sapiens
tggagccccaggg

SEQ ID NO: 2329736 - DNA, 15 bp, Homo sapiens
tggagcccccagcag

SEQ ID NO: 2329737 - DNA, 17 bp, Homo sapiens
tggaggaagagccacct

SEQ ID NO: 2329738 - DNA, 18 bp, Homo sapiens
tggaggaagagccacctg

SEQ ID NO: 2329739 - DNA, 17 bp, Homo sapiens
tggaggaagtggggtct

SEQ ID NO: 2329740 - DNA, 18 bp, Homo sapiens
tggaggaagtggggtctg

SEQ ID NO: 2329741 - DNA, 14 bp, Homo sapiens
tctgatcaagagtc

SEQ ID NO: 2329742 - DNA, 15 bp, Homo sapiens
tctgatgaaaaattg

SEQ ID NO: 2329743 - DNA, 22 bp, Homo sapiens
tctgatgaaaaattgctgactg

SEQ ID NO: 2329744 - DNA, 20 bp, Homo sapiens
tctgatggccttaatttcct

SEQ ID NO: 2329745 - DNA, 14 bp, Homo sapiens
tctgatgtcccagt

SEQ ID NO: 2329746 - DNA, 14 bp, Homo sapiens
tctgcaacaagcat

SEQ ID NO: 2329747 - DNA, 23 bp, Homo sapiens
tctgcacatgaatcccacccaca

SEQ ID NO: 2329748 - DNA, 17 bp, Homo sapiens
tctgcacatgtcttgta

SEQ ID NO: 2329749 - DNA, 13 bp, Homo sapiens
tctgcagggagca

SEQ ID NO: 2329750 - DNA, 16 bp, Homo sapiens
tctgcagggagcaact

SEQ ID NO: 2329751 - DNA, 16 bp, Homo sapiens
tctgcagtgtgccccc

SEQ ID NO: 2329752 - DNA, 18 bp, Homo sapiens
tctgccatctagccagcc

SEQ ID NO: 2329753 - DNA, 19 bp, Homo sapiens
tctgccatgttgccccttt

SEQ ID NO: 2329754 - DNA, 12 bp, Homo sapiens
tctgccccaccc

SEQ ID NO: 2329755 - DNA, 13 bp, Homo sapiens
tctgccccaccct

SEQ ID NO: 2329756 - DNA, 18 bp, Homo sapiens
tctgccccaccttgccag

SEQ ID NO: 2329757 - DNA, 15 bp, Homo sapiens
tctgcccgcagagcc

SEQ ID NO: 2329758 - DNA, 13 bp, Homo sapiens
tctgccctggctg

SEQ ID NO: 2329759 - DNA, 15 bp, Homo sapiens
tctgccctggctgct

SEQ ID NO: 2329760 - DNA, 15 bp, Homo sapiens
tctgcctacagccag

SEQ ID NO: 2329761 - DNA, 14 bp, Homo sapiens
tctgcctgccccgc

SEQ ID NO: 2329762 - DNA, 23 bp, Homo sapiens
tctgccttaaacacacattgcag

SEQ ID NO: 2329763 - DNA, 22 bp, Homo sapiens
tctgcctttggggacttttctt

SEQ ID NO: 2329764 - DNA, 17 bp, Homo sapiens
tctgcggatctcagctt

SEQ ID NO: 2329765 - DNA, 15 bp, Homo sapiens
tctgctatatataaa

SEQ ID NO: 2329766 - DNA, 16 bp, Homo sapiens
tctgctatatataaaa

SEQ ID NO: 2329767 - DNA, 15 bp, Homo sapiens
tctgctcaccgccca

SEQ ID NO: 2329768 - DNA, 20 bp, Homo sapiens
tctgctcaccgcccatcagg

SEQ ID NO: 2329769 - DNA, 15 bp, Homo sapiens
tctgctccttcccca

SEQ ID NO: 2329770 - DNA, 12 bp, Homo sapiens
tctgctctgcca

SEQ ID NO: 2329771 - DNA, 18 bp, Homo sapiens
tctgctctgccatcttca

SEQ ID NO: 2329772 - DNA, 12 bp, Homo sapiens
tctgctgaggcc

SEQ ID NO: 2329773 - DNA, 23 bp, Homo sapiens
tctgctggggcctgggacaactg

SEQ ID NO: 2329774 - DNA, 17 bp, Homo sapiens
tctgctggtatttctaa

SEQ ID NO: 2329775 - DNA, 13 bp, Homo sapiens
tctgcttctcatc

SEQ ID NO: 2329776 - DNA, 15 bp, Homo sapiens
tctgcttctttgcct

SEQ ID NO: 2329777 - DNA, 18 bp, Homo sapiens
tctgcttgatttttgcct

SEQ ID NO: 2329778 - DNA, 19 bp, Homo sapiens
tctgcttttctgccctggc

SEQ ID NO: 2329779 - DNA, 20 bp, Homo sapiens
tctgcttttctgccctggct

SEQ ID NO: 2329780 - DNA, 18 bp, Homo sapiens
tctggaatgtttttccct

SEQ ID NO: 2329781 - DNA, 23 bp, Homo sapiens
tctggaatgtttttccctcccca

SEQ ID NO: 2329782 - DNA, 14 bp, Homo sapiens
tctggacagcagaa

SEQ ID NO: 2329783 - DNA, 15 bp, Homo sapiens
tctggacctctgggt

SEQ ID NO: 2329784 - DNA, 14 bp, Homo sapiens
tctggacggcaggc

SEQ ID NO: 2329785 - DNA, 17 bp, Homo sapiens
tctggaggtgctgctct

SEQ ID NO: 2329786 - DNA, 13 bp, Homo sapiens
tctggcccagaaa

SEQ ID NO: 2329787 - DNA, 21 bp, Homo sapiens
tctggcccagaaagcctctct

SEQ ID NO: 2329788 - DNA, 23 bp, Homo sapiens
tctggcccttgcttacctctcag

SEQ ID NO: 2329789 - DNA, 21 bp, Homo sapiens
tctggctttcccaggagatgg

SEQ ID NO: 2329790 - DNA, 22 bp, Homo sapiens
tctgggaacttgcgagtccaag

SEQ ID NO: 2329791 - DNA, 17 bp, Homo sapiens
tctgggcattttcctcc

SEQ ID NO: 2329792 - DNA, 13 bp, Homo sapiens
tctgggctgggca

SEQ ID NO: 2329793 - DNA, 14 bp, Homo sapiens
tctgggcttcattc

SEQ ID NO: 2329794 - DNA, 23 bp, Homo sapiens
tctggggctgtgttatgaaaata

SEQ ID NO: 2329795 - DNA, 19 bp, Homo sapiens
tctgggtgctactggggaa

SEQ ID NO: 2329796 - DNA, 14 bp, Homo sapiens
tctgggtttctaga

SEQ ID NO: 2329797 - DNA, 12 bp, Homo sapiens
tctgtaaactgt

SEQ ID NO: 2329798 - DNA, 15 bp, Homo sapiens
tctgtaaactgtgta

SEQ ID NO: 2329799 - DNA, 16 bp, Homo sapiens
tctgtaaactgtgtat

SEQ ID NO: 2329800 - DNA, 17 bp, Homo sapiens
tctgtaactattgggtg

SEQ ID NO: 2329801 - DNA, 16 bp, Homo sapiens
tctgtaagagcttgct

SEQ ID NO: 2329802 - DNA, 22 bp, Homo sapiens
tctgtaagagcttgctccagat

SEQ ID NO: 2329803 - DNA, 12 bp, Homo sapiens
tctgtaataata

SEQ ID NO: 2329804 - DNA, 13 bp, Homo sapiens
tctgtaataatag

SEQ ID NO: 2329805 - DNA, 15 bp, Homo sapiens
tctgtaataatagac

SEQ ID NO: 2329806 - DNA, 19 bp, Homo sapiens
tctgtaataatagactgta

SEQ ID NO: 2329807 - DNA, 13 bp, Homo sapiens
tctgtacacgtgt

SEQ ID NO: 2329808 - DNA, 22 bp, Homo sapiens
tctgtactaaacagtaagatat

SEQ ID NO: 2329809 - DNA, 23 bp, Homo sapiens
tctgtagctcctcaactcaccta

SEQ ID NO: 2329810 - DNA, 21 bp, Homo sapiens
tctgtccagctggggccagag

SEQ ID NO: 2329811 - DNA, 16 bp, Homo sapiens
tctgtcccccaggctg

SEQ ID NO: 2329812 - DNA, 23 bp, Homo sapiens
tctgtctccctcccctctcagaa

SEQ ID NO: 2329813 - DNA, 14 bp, Homo sapiens
tctgtctttcctga

SEQ ID NO: 2329814 - DNA, 17 bp, Homo sapiens
tctgtgaacagagagac

SEQ ID NO: 2329815 - DNA, 21 bp, Homo sapiens
tctgtgagggtgctgactggc

SEQ ID NO: 2329816 - DNA, 14 bp, Homo sapiens
tctgtggctggctc

SEQ ID NO: 2329817 - DNA, 23 bp, Homo sapiens
tctgtgggctacatgctggggtc

SEQ ID NO: 2329818 - DNA, 17 bp, Homo sapiens
tctgtggttcctctgct

SEQ ID NO: 2329819 - DNA, 13 bp, Homo sapiens
tctgttaatgctt

SEQ ID NO: 2329820 - DNA, 14 bp, Homo sapiens
tctgttagggcctt

SEQ ID NO: 2329821 - DNA, 23 bp, Homo sapiens
tctgttatgatttccttcaatgt

SEQ ID NO: 2329822 - DNA, 18 bp, Homo sapiens
tctgtttaattttcactt

SEQ ID NO: 2329823 - DNA, 20 bp, Homo sapiens
tcttaagtaccaatgggaag

SEQ ID NO: 2329824 - DNA, 21 bp, Homo sapiens
tcttagtatgtgcatttaatt

SEQ ID NO: 2329825 - DNA, 14 bp, Homo sapiens
tcttagtgcctgag

SEQ ID NO: 2329826 - DNA, 18 bp, Homo sapiens
tcttagtgcctgagagta

SEQ ID NO: 2329827 - DNA, 21 bp, Homo sapiens
tcttataaagtggaagtatgt

SEQ ID NO: 2329828 - DNA, 16 bp, Homo sapiens
tcttatcctctctctc

SEQ ID NO: 2329829 - DNA, 12 bp, Homo sapiens
tcttatctcagt

SEQ ID NO: 2329830 - DNA, 15 bp, Homo sapiens
tcttatgtgaaaaat

SEQ ID NO: 2329831 - DNA, 16 bp, Homo sapiens
tcttatgtgacattaa

SEQ ID NO: 2329832 - DNA, 19 bp, Homo sapiens
tcttatgtgacattaacaa

SEQ ID NO: 2329833 - DNA, 20 bp, Homo sapiens
tcttattaatcatacaaact

SEQ ID NO: 2329834 - DNA, 19 bp, Homo sapiens
tcttattttctcaatctcc

SEQ ID NO: 2329835 - DNA, 22 bp, Homo sapiens
tcttcaacatgctccaaatata

SEQ ID NO: 2329836 - DNA, 17 bp, Homo sapiens
tcttcaatatgaatcta

SEQ ID NO: 2329837 - DNA, 18 bp, Homo sapiens
tcttcaatatgaatctat

SEQ ID NO: 2329838 - DNA, 15 bp, Homo sapiens
tcttcaatggaatac

SEQ ID NO: 2329839 - DNA, 12 bp, Homo sapiens
tcttcatctgcc

SEQ ID NO: 2329840 - DNA, 15 bp, Homo sapiens
tcttcatctgcctgc

SEQ ID NO: 2329841 - DNA, 22 bp, Homo sapiens
tgcaaactgggaacccctttcc

SEQ ID NO: 2329842 - DNA, 14 bp, Homo sapiens
tgcaaagagacatt

SEQ ID NO: 2329843 - DNA, 20 bp, Homo sapiens
tgcaaagagacatttcaaaa

SEQ ID NO: 2329844 - DNA, 18 bp, Homo sapiens
tgcaaatgagctctgaaa

SEQ ID NO: 2329845 - DNA, 14 bp, Homo sapiens
tgcaaatgggagct

SEQ ID NO: 2329846 - DNA, 22 bp, Homo sapiens
tgcaaatgggagctgagcagcc

SEQ ID NO: 2329847 - DNA, 16 bp, Homo sapiens
tgcaaccgtctgttat

SEQ ID NO: 2329848 - DNA, 23 bp, Homo sapiens
tgcaacctcaccttcctgtgggt

SEQ ID NO: 2329849 - DNA, 22 bp, Homo sapiens
tgcaagaacactggacctttgg

SEQ ID NO: 2329850 - DNA, 23 bp, Homo sapiens
tgcaagatggacacgagccacaa

SEQ ID NO: 2329851 - DNA, 22 bp, Homo sapiens
tgcaaggtggcctttgtgctgc

SEQ ID NO: 2329852 - DNA, 17 bp, Homo sapiens
tgcaataaaatttaaaa

SEQ ID NO: 2329853 - DNA, 14 bp, Homo sapiens
tgcaataaagtata

SEQ ID NO: 2329854 - DNA, 15 bp, Homo sapiens
tgcaataaagtataa

SEQ ID NO: 2329855 - DNA, 12 bp, Homo sapiens
tgcaataacagc

SEQ ID NO: 2329856 - DNA, 16 bp, Homo sapiens
tgcaataacagctgca

SEQ ID NO: 2329857 - DNA, 14 bp, Homo sapiens
tgcaataattttac

SEQ ID NO: 2329858 - DNA, 12 bp, Homo sapiens
tgcaatgcttgt

SEQ ID NO: 2329859 - DNA, 16 bp, Homo sapiens
tgcaatgcttgtagaa

SEQ ID NO: 2329860 - DNA, 23 bp, Homo sapiens
tgcaattaaacttccaaagaaag

SEQ ID NO: 2329861 - DNA, 21 bp, Homo sapiens
tgcaattgtaggggtgtgtgt

SEQ ID NO: 2329862 - DNA, 21 bp, Homo sapiens
tgcacaataaaaatgtttaac

SEQ ID NO: 2329863 - DNA, 19 bp, Homo sapiens
tgcacacagaatgctcagg

SEQ ID NO: 2329864 - DNA, 16 bp, Homo sapiens
tgcacaccccactccc

SEQ ID NO: 2329865 - DNA, 18 bp, Homo sapiens
tgcacagagcaagtcctc

SEQ ID NO: 2329866 - DNA, 14 bp, Homo sapiens
tgcacagctggaga

SEQ ID NO: 2329867 - DNA, 15 bp, Homo sapiens
tgcacagctggagaa

SEQ ID NO: 2329868 - DNA, 21 bp, Homo sapiens
tgcacaggcagatgtttgcct

SEQ ID NO: 2329869 - DNA, 15 bp, Homo sapiens
tgcacatgtcttgta

SEQ ID NO: 2329870 - DNA, 13 bp, Homo sapiens
tgcacccacctgt

SEQ ID NO: 2329871 - DNA, 21 bp, Homo sapiens
tgcacccacctgttttctgaa

SEQ ID NO: 2329872 - DNA, 14 bp, Homo sapiens
tgcacccctgggcc

SEQ ID NO: 2329873 - DNA, 15 bp, Homo sapiens
tgcaccccttctctc

SEQ ID NO: 2329874 - DNA, 21 bp, Homo sapiens
tgcacctgagaccctactgaa

SEQ ID NO: 2329875 - DNA, 14 bp, Homo sapiens
tgcaccttgtgtct

SEQ ID NO: 2329876 - DNA, 22 bp, Homo sapiens
tgcactaaaacccatcttcccc

SEQ ID NO: 2329877 - DNA, 15 bp, Homo sapiens
tgcactccagcctgg

SEQ ID NO: 2329878 - DNA, 17 bp, Homo sapiens
tgcactgggaggctccc

SEQ ID NO: 2329879 - DNA, 21 bp, Homo sapiens
tgcactgggaggctccccttc

SEQ ID NO: 2329880 - DNA, 14 bp, Homo sapiens
tgcactgttctgat

SEQ ID NO: 2329881 - DNA, 18 bp, Homo sapiens
tgcacttgttatattata

SEQ ID NO: 2329882 - DNA, 16 bp, Homo sapiens
tgcagaaatagacaaa

SEQ ID NO: 2329883 - DNA, 15 bp, Homo sapiens
tgcagacctcatgcc

SEQ ID NO: 2329884 - DNA, 20 bp, Homo sapiens
tgcagagaaacttaagcaaa

SEQ ID NO: 2329885 - DNA, 21 bp, Homo sapiens
tgcagagaaacttaagcaaag

SEQ ID NO: 2329886 - DNA, 15 bp, Homo sapiens
tgcagagagccattt

SEQ ID NO: 2329887 - DNA, 18 bp, Homo sapiens
tgcagagagccattttgt

SEQ ID NO: 2329888 - DNA, 17 bp, Homo sapiens
tgcagagccttctcaga

SEQ ID NO: 2329889 - DNA, 20 bp, Homo sapiens
tgcagagccttctcagaagc

SEQ ID NO: 2329890 - DNA, 22 bp, Homo sapiens
tgcagcccaccagacgtcaggc

SEQ ID NO: 2329891 - DNA, 15 bp, Homo sapiens
tgcaggagagagcag

SEQ ID NO: 2329892 - DNA, 13 bp, Homo sapiens
tgcaggagcttct

SEQ ID NO: 2329893 - DNA, 16 bp, Homo sapiens
tgcaggcagagctgga

SEQ ID NO: 2329894 - DNA, 14 bp, Homo sapiens
tgcaggcaggaaca

SEQ ID NO: 2329895 - DNA, 20 bp, Homo sapiens
tgcaggcaggaacaaacagg

SEQ ID NO: 2329896 - DNA, 23 bp, Homo sapiens
tgcagggttcaagccttccaggg

SEQ ID NO: 2329897 - DNA, 14 bp, Homo sapiens
tgcaggttttctgt

SEQ ID NO: 2329898 - DNA, 17 bp, Homo sapiens
tgcagtcactggaggtt

SEQ ID NO: 2329899 - DNA, 17 bp, Homo sapiens
tgcagtcctactcaagc

SEQ ID NO: 2329900 - DNA, 13 bp, Homo sapiens
tgcagtgagctga

SEQ ID NO: 2329901 - DNA, 12 bp, Homo sapiens
tgcagtgtggag

SEQ ID NO: 2329902 - DNA, 17 bp, Homo sapiens
tgcagttctactcaggc

SEQ ID NO: 2329903 - DNA, 14 bp, Homo sapiens
tgcagttctgagca

SEQ ID NO: 2329904 - DNA, 18 bp, Homo sapiens
tgcagtttcttttcacat

SEQ ID NO: 2329905 - DNA, 13 bp, Homo sapiens
tgcataaatatgc

SEQ ID NO: 2329906 - DNA, 23 bp, Homo sapiens
tgcataataagctaaagaggctg

SEQ ID NO: 2329907 - DNA, 22 bp, Homo sapiens
tgcatactttgtattttgatta

SEQ ID NO: 2329908 - DNA, 19 bp, Homo sapiens
tgcatactttttaaatgta

SEQ ID NO: 2329909 - DNA, 23 bp, Homo sapiens
tgcatactttttaaatgtaaaga

SEQ ID NO: 2329910 - DNA, 15 bp, Homo sapiens
tgcatagcagtatat

SEQ ID NO: 2329911 - DNA, 16 bp, Homo sapiens
tgcatagcagtatatg

SEQ ID NO: 2329912 - DNA, 20 bp, Homo sapiens
tgcatataatgaataaatca

SEQ ID NO: 2329913 - DNA, 13 bp, Homo sapiens
tgcatatcctgag

SEQ ID NO: 2329914 - DNA, 16 bp, Homo sapiens
tgcatatcctgagcca

SEQ ID NO: 2329915 - DNA, 18 bp, Homo sapiens
tgcatatcctgagccatc

SEQ ID NO: 2329916 - DNA, 13 bp, Homo sapiens
tgcatattataaa

SEQ ID NO: 2329917 - DNA, 23 bp, Homo sapiens
tgcatattataaaggataaagaa

SEQ ID NO: 2329918 - DNA, 19 bp, Homo sapiens
tgcatcaagggctttatca

SEQ ID NO: 2329919 - DNA, 21 bp, Homo sapiens
tgcatcactgtatcattttct

SEQ ID NO: 2329920 - DNA, 17 bp, Homo sapiens
tgcatcccccctgctca

SEQ ID NO: 2329921 - DNA, 13 bp, Homo sapiens
tgcatccctgaga

SEQ ID NO: 2329922 - DNA, 15 bp, Homo sapiens
tgcatgcaaatgagc

SEQ ID NO: 2329923 - DNA, 18 bp, Homo sapiens
tgcatgcatgcaaatgag

SEQ ID NO: 2329924 - DNA, 17 bp, Homo sapiens
tgcatgggaggaattca

SEQ ID NO: 2329925 - DNA, 14 bp, Homo sapiens
tgcatgtatgtctt

SEQ ID NO: 2329926 - DNA, 15 bp, Homo sapiens
tgcatgtatgtcttg

SEQ ID NO: 2329927 - DNA, 16 bp, Homo sapiens
tgcatgtcctgtaaag

SEQ ID NO: 2329928 - DNA, 22 bp, Homo sapiens
tgaggctgtaactgagagaaag

SEQ ID NO: 2329929 - DNA, 18 bp, Homo sapiens
tgagggcagactggggca

SEQ ID NO: 2329930 - DNA, 22 bp, Homo sapiens
tgagggcctgctggaggcctca

SEQ ID NO: 2329931 - DNA, 13 bp, Homo sapiens
tgagggctgcagt

SEQ ID NO: 2329932 - DNA, 16 bp, Homo sapiens
tgaggggagaggagac

SEQ ID NO: 2329933 - DNA, 19 bp, Homo sapiens
tgagggtcttcttacatgc

SEQ ID NO: 2329934 - DNA, 21 bp, Homo sapiens
tgagggtgccccgcctgagtc

SEQ ID NO: 2329935 - DNA, 22 bp, Homo sapiens
tgagggtgccccgcctgagtca

SEQ ID NO: 2329936 - DNA, 15 bp, Homo sapiens
tgaggtgcactggga

SEQ ID NO: 2329937 - DNA, 21 bp, Homo sapiens
tgaggtgggaggtggaagaag

SEQ ID NO: 2329938 - DNA, 15 bp, Homo sapiens
tgaggttcctctgcc

SEQ ID NO: 2329939 - DNA, 18 bp, Homo sapiens
tgaggttcctctgcctgc

SEQ ID NO: 2329940 - DNA, 21 bp, Homo sapiens
tgagtagatccatttccattg

SEQ ID NO: 2329941 - DNA, 23 bp, Homo sapiens
tgagtattgtttaaaatgtaatt

SEQ ID NO: 2329942 - DNA, 21 bp, Homo sapiens
tgagtcagagccatgtcttct

SEQ ID NO: 2329943 - DNA, 20 bp, Homo sapiens
tgagtccattctcccaggta

SEQ ID NO: 2329944 - DNA, 22 bp, Homo sapiens
tgagtccattctcccaggtacc

SEQ ID NO: 2329945 - DNA, 17 bp, Homo sapiens
tgagtcgtacagaaagc

SEQ ID NO: 2329946 - DNA, 15 bp, Homo sapiens
tgagtgacagctttc

SEQ ID NO: 2329947 - DNA, 16 bp, Homo sapiens
tgagtgacagctttct

SEQ ID NO: 2329948 - DNA, 18 bp, Homo sapiens
tgagtgtatgagtagcca

SEQ ID NO: 2329949 - DNA, 16 bp, Homo sapiens
tgagttatcatgaatt

SEQ ID NO: 2329950 - DNA, 17 bp, Homo sapiens
tgagttccagttgaagt

SEQ ID NO: 2329951 - DNA, 19 bp, Homo sapiens
tgagttccagttgaagtta

SEQ ID NO: 2329952 - DNA, 14 bp, Homo sapiens
tgagttctgggttt

SEQ ID NO: 2329953 - DNA, 21 bp, Homo sapiens
tgagttgaaatgttctgtcaa

SEQ ID NO: 2329954 - DNA, 22 bp, Homo sapiens
tgagttgaaatgttctgtcaaa

SEQ ID NO: 2329955 - DNA, 19 bp, Homo sapiens
tgagtttgagctgccttcc

SEQ ID NO: 2329956 - DNA, 21 bp, Homo sapiens
tgagtttgagctgccttccct

SEQ ID NO: 2329957 - DNA, 18 bp, Homo sapiens
tgagtttttcctcccagt

SEQ ID NO: 2329958 - DNA, 19 bp, Homo sapiens
tgagtttttcctcccagtg

SEQ ID NO: 2329959 - DNA, 13 bp, Homo sapiens
tgataaaaactca

SEQ ID NO: 2329960 - DNA, 18 bp, Homo sapiens
tgataagggaaaagataa

SEQ ID NO: 2329961 - DNA, 14 bp, Homo sapiens
tgataatatatatt

SEQ ID NO: 2329962 - DNA, 15 bp, Homo sapiens
tgataatgttaaatt

SEQ ID NO: 2329963 - DNA, 17 bp, Homo sapiens
tgataatgttaaatttg

SEQ ID NO: 2329964 - DNA, 14 bp, Homo sapiens
tgatacaacattaa

SEQ ID NO: 2329965 - DNA, 23 bp, Homo sapiens
tgatacgtccgtgtgtcccagat

SEQ ID NO: 2329966 - DNA, 15 bp, Homo sapiens
tgatataccaaatta

SEQ ID NO: 2329967 - DNA, 16 bp, Homo sapiens
tgatataccaaattaa

SEQ ID NO: 2329968 - DNA, 20 bp, Homo sapiens
tgatatatgagactttatgt

SEQ ID NO: 2329969 - DNA, 22 bp, Homo sapiens
tgatatcaggaaatatctgtga

SEQ ID NO: 2329970 - DNA, 18 bp, Homo sapiens
tgatattatttcttctct

SEQ ID NO: 2329971 - DNA, 20 bp, Homo sapiens
tgatattttctgtgcctgaa

SEQ ID NO: 2329972 - DNA, 23 bp, Homo sapiens
tgatcaagagtccggatttctaa

SEQ ID NO: 2329973 - DNA, 16 bp, Homo sapiens
tgatcaatatttttat

SEQ ID NO: 2329974 - DNA, 22 bp, Homo sapiens
tgatcagacatacagctgccta

SEQ ID NO: 2329975 - DNA, 21 bp, Homo sapiens
tgatcatagctcactgcagcc

SEQ ID NO: 2329976 - DNA, 12 bp, Homo sapiens
tgatccagaaga

SEQ ID NO: 2329977 - DNA, 13 bp, Homo sapiens
tgatccagaagag

SEQ ID NO: 2329978 - DNA, 22 bp, Homo sapiens
tgatccagaagagcccatatca

SEQ ID NO: 2329979 - DNA, 12 bp, Homo sapiens
tgatctgctctg

SEQ ID NO: 2329980 - DNA, 13 bp, Homo sapiens
tgatctgctctgt

SEQ ID NO: 2329981 - DNA, 18 bp, Homo sapiens
tgatctgttgtaatatca

SEQ ID NO: 2329982 - DNA, 17 bp, Homo sapiens
tgatcttaaaataattc

SEQ ID NO: 2329983 - DNA, 21 bp, Homo sapiens
tgatcttaaaataattcatat

SEQ ID NO: 2329984 - DNA, 19 bp, Homo sapiens
tgatcttttaaaatcatga

SEQ ID NO: 2329985 - DNA, 19 bp, Homo sapiens
tgatgaaaaattgctgact

SEQ ID NO: 2329986 - DNA, 15 bp, Homo sapiens
tgatgacttgctgtc

SEQ ID NO: 2329987 - DNA, 19 bp, Homo sapiens
tgatgacttgctgtccagg

SEQ ID NO: 2329988 - DNA, 14 bp, Homo sapiens
tgatgatgttaacc

SEQ ID NO: 2329989 - DNA, 17 bp, Homo sapiens
tgatgattttcatttca

SEQ ID NO: 2329990 - DNA, 20 bp, Homo sapiens
tgatgccttttttttcatga

SEQ ID NO: 2329991 - DNA, 15 bp, Homo sapiens
tgatgctgggcaatg

SEQ ID NO: 2329992 - DNA, 17 bp, Homo sapiens
tgatggagggtggaaat

SEQ ID NO: 2329993 - DNA, 18 bp, Homo sapiens
tgatggccagcccctggg

SEQ ID NO: 2329994 - DNA, 12 bp, Homo sapiens
tgatgtcagcct

SEQ ID NO: 2329995 - DNA, 13 bp, Homo sapiens
tgatgtcagcctt

SEQ ID NO: 2329996 - DNA, 17 bp, Homo sapiens
tgatgtctttttattaa

SEQ ID NO: 2329997 - DNA, 21 bp, Homo sapiens
tgatgtggaggaagagccacc

SEQ ID NO: 2329998 - DNA, 22 bp, Homo sapiens
tgatgtggaggaagagccacct

SEQ ID NO: 2329999 - DNA, 23 bp, Homo sapiens
tgatgtggccctggctgccggca

SEQ ID NO: 2330000 - DNA, 13 bp, Homo sapiens
tgattaaattatg

SEQ ID NO: 2330001 - DNA, 15 bp, Homo sapiens
tgattaaattatgaa

SEQ ID NO: 2330002 - DNA, 19 bp, Homo sapiens
tgattaagggacatttcta

SEQ ID NO: 2330003 - DNA, 16 bp, Homo sapiens
tgattaataaaatatc

SEQ ID NO: 2330004 - DNA, 13 bp, Homo sapiens
tgattacctgaaa

SEQ ID NO: 2330005 - DNA, 20 bp, Homo sapiens
tgattatagcaactaatgtt

SEQ ID NO: 2330006 - DNA, 21 bp, Homo sapiens
tgattatagcaactaatgttt

SEQ ID NO: 2330007 - DNA, 14 bp, Homo sapiens
tgattatcttcagc

SEQ ID NO: 2330008 - DNA, 22 bp, Homo sapiens
tgattatttaagactaaaagtt

SEQ ID NO: 2330009 - DNA, 21 bp, Homo sapiens
tgattattttttttttcttct

SEQ ID NO: 2330010 - DNA, 23 bp, Homo sapiens
tgattcaacacttaagtctcaga

SEQ ID NO: 2330011 - DNA, 22 bp, Homo sapiens
tgattcaatctgtaaactgtgt

SEQ ID NO: 2330012 - DNA, 22 bp, Homo sapiens
tgattccactacacctggctga

SEQ ID NO: 2330013 - DNA, 14 bp, Homo sapiens
tgattctggcttta

SEQ ID NO: 2330014 - DNA, 17 bp, Homo sapiens
tgattctggctttaagc

SEQ ID NO: 2330015 - DNA, 21 bp, Homo sapiens
tgattcttgattcctggctct

SEQ ID NO: 2330016 - DNA, 15 bp, Homo sapiens
tccctggacaggcag

SEQ ID NO: 2330017 - DNA, 16 bp, Homo sapiens
tccctggacaggcagc

SEQ ID NO: 2330018 - DNA, 17 bp, Homo sapiens
tccctggagtcagggtg

SEQ ID NO: 2330019 - DNA, 21 bp, Homo sapiens
tccctggcgcaggtgggctgg

SEQ ID NO: 2330020 - DNA, 12 bp, Homo sapiens
tccctggctccc

SEQ ID NO: 2330021 - DNA, 19 bp, Homo sapiens
tccctgggacacagaccca

SEQ ID NO: 2330022 - DNA, 12 bp, Homo sapiens
tcccttccaaag

SEQ ID NO: 2330023 - DNA, 20 bp, Homo sapiens
tcccttccttttccctgctt

SEQ ID NO: 2330024 - DNA, 20 bp, Homo sapiens
tctagaagccaagggaaagg

SEQ ID NO: 2330025 - DNA, 21 bp, Homo sapiens
tctagatgattttttgaaagt

SEQ ID NO: 2330026 - DNA, 14 bp, Homo sapiens
tctagcacactctt

SEQ ID NO: 2330027 - DNA, 16 bp, Homo sapiens
tctagcagcacctcct

SEQ ID NO: 2330028 - DNA, 17 bp, Homo sapiens
tctagctaaataaatgg

SEQ ID NO: 2330029 - DNA, 22 bp, Homo sapiens
tctaggcccattgtcctccttt

SEQ ID NO: 2330030 - DNA, 21 bp, Homo sapiens
tctagggactgccaggctgtt

SEQ ID NO: 2330031 - DNA, 15 bp, Homo sapiens
tctaggtccccatac

SEQ ID NO: 2330032 - DNA, 16 bp, Homo sapiens
tctagtaacaatacat

SEQ ID NO: 2330033 - DNA, 19 bp, Homo sapiens
tctagtagttagaaattaa

SEQ ID NO: 2330034 - DNA, 22 bp, Homo sapiens
tctagtgaggaagacaagcatt

SEQ ID NO: 2330035 - DNA, 17 bp, Homo sapiens
tctagtggtctttgtaa

SEQ ID NO: 2330036 - DNA, 19 bp, Homo sapiens
tctagtggtctttgtaaga

SEQ ID NO: 2330037 - DNA, 21 bp, Homo sapiens
tctagtggtctttgtaagagt

SEQ ID NO: 2330038 - DNA, 23 bp, Homo sapiens
tcatgggtcctagcccttccctg

SEQ ID NO: 2330039 - DNA, 20 bp, Homo sapiens
tcatggtgtaataagacata

SEQ ID NO: 2330040 - DNA, 21 bp, Homo sapiens
tcatggtgtaataagacataa

SEQ ID NO: 2330041 - DNA, 13 bp, Homo sapiens
tcatgtaatttta

SEQ ID NO: 2330042 - DNA, 17 bp, Homo sapiens
tcatgttgatgtgtccg

SEQ ID NO: 2330043 - DNA, 18 bp, Homo sapiens
tcattatgcacttttaga

SEQ ID NO: 2330044 - DNA, 13 bp, Homo sapiens
tcattatgtcaac

SEQ ID NO: 2330045 - DNA, 13 bp, Homo sapiens
tcattattcaaga

SEQ ID NO: 2330046 - DNA, 14 bp, Homo sapiens
tcattattctctgc

SEQ ID NO: 2330047 - DNA, 15 bp, Homo sapiens
tcattatttcaaaat

SEQ ID NO: 2330048 - DNA, 14 bp, Homo sapiens
tcattcccatgtgg

SEQ ID NO: 2330049 - DNA, 18 bp, Homo sapiens
tcattcctaacacagcat

SEQ ID NO: 2330050 - DNA, 14 bp, Homo sapiens
tcattgacttttat

SEQ ID NO: 2330051 - DNA, 23 bp, Homo sapiens
tcattgcacataagcttccattt

SEQ ID NO: 2330052 - DNA, 14 bp, Homo sapiens
tcattgtgttttct

SEQ ID NO: 2330053 - DNA, 16 bp, Homo sapiens
tcatttcattcctaac

SEQ ID NO: 2330054 - DNA, 14 bp, Homo sapiens
tcatttctcatcca

SEQ ID NO: 2330055 - DNA, 16 bp, Homo sapiens
tcatttgtatgtcaaa

SEQ ID NO: 2330056 - DNA, 15 bp, Homo sapiens
tcattttatgttaag

SEQ ID NO: 2330057 - DNA, 20 bp, Homo sapiens
tccaaaagattgctgaaatt

SEQ ID NO: 2330058 - DNA, 17 bp, Homo sapiens
tccaaaagcgccctcac

SEQ ID NO: 2330059 - DNA, 16 bp, Homo sapiens
tccaaaagctttttat

SEQ ID NO: 2330060 - DNA, 15 bp, Homo sapiens
tccaaagaggctgcc

SEQ ID NO: 2330061 - DNA, 19 bp, Homo sapiens
tccaaagaggctgcccctc

SEQ ID NO: 2330062 - DNA, 19 bp, Homo sapiens
tccaaattaaaacaaatat

SEQ ID NO: 2330063 - DNA, 19 bp, Homo sapiens
tccaaattaggaagtgttt

SEQ ID NO: 2330064 - DNA, 22 bp, Homo sapiens
tccaaattaggaagtgtttcct

SEQ ID NO: 2330065 - DNA, 21 bp, Homo sapiens
tccaaatttttttttaaagca

SEQ ID NO: 2330066 - DNA, 19 bp, Homo sapiens
tccaaccactgtgccactg

SEQ ID NO: 2330067 - DNA, 23 bp, Homo sapiens
tccaaccactgtgccactgactt

SEQ ID NO: 2330068 - DNA, 22 bp, Homo sapiens
tccaactaatgccttactcttc

SEQ ID NO: 2330069 - DNA, 12 bp, Homo sapiens
tccaactccagc

SEQ ID NO: 2330070 - DNA, 17 bp, Homo sapiens
tccaagaaactgaatga

SEQ ID NO: 2330071 - DNA, 16 bp, Homo sapiens
tccaagcacagagcct

SEQ ID NO: 2330072 - DNA, 18 bp, Homo sapiens
tccaagcacagagcctgg

SEQ ID NO: 2330073 - DNA, 23 bp, Homo sapiens
tccaagcatttcatgaaaaagct

SEQ ID NO: 2330074 - DNA, 22 bp, Homo sapiens
tccaaggaaacattttatcatt

SEQ ID NO: 2330075 - DNA, 18 bp, Homo sapiens
tccaagggttgagagcca

SEQ ID NO: 2330076 - DNA, 19 bp, Homo sapiens
tccaagggttgagagccag

SEQ ID NO: 2330077 - DNA, 20 bp, Homo sapiens
tccaagggttgagagccagt

SEQ ID NO: 2330078 - DNA, 22 bp, Homo sapiens
tccaagggttgagagccagtgg

SEQ ID NO: 2330079 - DNA, 16 bp, Homo sapiens
tccaaggtgatgttgt

SEQ ID NO: 2330080 - DNA, 14 bp, Homo sapiens
tccaaggtggcaga

SEQ ID NO: 2330081 - DNA, 14 bp, Homo sapiens
tccaagtcaacact

SEQ ID NO: 2330082 - DNA, 18 bp, Homo sapiens
tccaagtccaacctgcct

SEQ ID NO: 2330083 - DNA, 19 bp, Homo sapiens
tccacacagtgctcaaggc

SEQ ID NO: 2330084 - DNA, 17 bp, Homo sapiens
tccacagcgagggcagc

SEQ ID NO: 2330085 - DNA, 18 bp, Homo sapiens
tccacagcgagggcagct

SEQ ID NO: 2330086 - DNA, 20 bp, Homo sapiens
tccacagcgagggcagctgc

SEQ ID NO: 2330087 - DNA, 21 bp, Homo sapiens
tccacaggtcatcagatgcct

SEQ ID NO: 2330088 - DNA, 21 bp, Homo sapiens
tccacagtgttgtgccccttc

SEQ ID NO: 2330089 - DNA, 24 bp, Homo sapiens
tccacagtgttgtgccccttcact

SEQ ID NO: 2330090 - DNA, 19 bp, Homo sapiens
tccacataccctgacctgg

SEQ ID NO: 2330091 - DNA, 13 bp, Homo sapiens
tccacatctgcct

SEQ ID NO: 2330092 - DNA, 14 bp, Homo sapiens
tccacatctgcctt

SEQ ID NO: 2330093 - DNA, 18 bp, Homo sapiens
tccacatctgccttaaaa

SEQ ID NO: 2330094 - DNA, 19 bp, Homo sapiens
tccaccaggccgtgccttg

SEQ ID NO: 2330095 - DNA, 20 bp, Homo sapiens
tccaccaggccgtgccttgt

SEQ ID NO: 2330096 - DNA, 23 bp, Homo sapiens
tccacccaaccctatctcctgac

SEQ ID NO: 2330097 - DNA, 22 bp, Homo sapiens
tccacccctttctagaccaata

SEQ ID NO: 2330098 - DNA, 23 bp, Homo sapiens
tccaccgtctttcttttatactg

SEQ ID NO: 2330099 - DNA, 21 bp, Homo sapiens
tccacctacacccctgtgctc

SEQ ID NO: 2330100 - DNA, 18 bp, Homo sapiens
tccacctcaagaccccca

SEQ ID NO: 2330101 - DNA, 13 bp, Homo sapiens
tccacctgccttg

SEQ ID NO: 2330102 - DNA, 22 bp, Homo sapiens
tccaccttcccttctacaagga

SEQ ID NO: 2330103 - DNA, 23 bp, Homo sapiens
tccaccttggctgggaagactat

SEQ ID NO: 2330104 - DNA, 21 bp, Homo sapiens
tccacgcgtgccgtggcacca

SEQ ID NO: 2330105 - DNA, 17 bp, Homo sapiens
tccactacacctggctg

SEQ ID NO: 2330106 - DNA, 15 bp, Homo sapiens
tccactcctgacccc

SEQ ID NO: 2330107 - DNA, 14 bp, Homo sapiens
tccactcgtgtgtt

SEQ ID NO: 2330108 - DNA, 16 bp, Homo sapiens
tccactcgtgtgtttc

SEQ ID NO: 2330109 - DNA, 23 bp, Homo sapiens
tccactgttgagccccagtgctg

SEQ ID NO: 2330110 - DNA, 13 bp, Homo sapiens
tccagacccaagt

SEQ ID NO: 2330111 - DNA, 14 bp, Homo sapiens
tccagagacaacag

SEQ ID NO: 2330112 - DNA, 12 bp, Homo sapiens
tccagagagcag

SEQ ID NO: 2330113 - DNA, 14 bp, Homo sapiens
tccagagagcagct

SEQ ID NO: 2330114 - DNA, 17 bp, Homo sapiens
tccagagagcagctccc

SEQ ID NO: 2330115 - DNA, 18 bp, Homo sapiens
tccagagagcagctccct

SEQ ID NO: 2330116 - DNA, 18 bp, Homo sapiens
tccagataactctctttc

SEQ ID NO: 2330117 - DNA, 22 bp, Homo sapiens
tccagataactctctttccttg

SEQ ID NO: 2330118 - DNA, 23 bp, Homo sapiens
tccagataactctctttccttga

SEQ ID NO: 2330119 - DNA, 13 bp, Homo sapiens
tccagatgtgtgc

SEQ ID NO: 2330120 - DNA, 13 bp, Homo sapiens
tccagattctgat

SEQ ID NO: 2330121 - DNA, 15 bp, Homo sapiens
tccagattctgatgc

SEQ ID NO: 2330122 - DNA, 18 bp, Homo sapiens
tccagattctgatgcata

SEQ ID NO: 2330123 - DNA, 23 bp, Homo sapiens
tccagccccgcgaccatgtggcc

SEQ ID NO: 2330124 - DNA, 20 bp, Homo sapiens
tccagctggggccagaggct

SEQ ID NO: 2330125 - DNA, 16 bp, Homo sapiens
tccaggagcttcttgt

SEQ ID NO: 2330126 - DNA, 17 bp, Homo sapiens
tccaggcaccctcaggg

SEQ ID NO: 2330127 - DNA, 18 bp, Homo sapiens
tccaggcaccctcaggga

SEQ ID NO: 2330128 - DNA, 19 bp, Homo sapiens
tccaggcagctccctcctg

SEQ ID NO: 2330129 - DNA, 13 bp, Homo sapiens
tccaggcctgcct

SEQ ID NO: 2330130 - DNA, 15 bp, Homo sapiens
tccaggcctgcctcc

SEQ ID NO: 2330131 - DNA, 16 bp, Homo sapiens
tccaggcctgcctccc

SEQ ID NO: 2330132 - DNA, 18 bp, Homo sapiens
tccaggcctgcctcccac

SEQ ID NO: 2330133 - DNA, 13 bp, Homo sapiens
tccaggctccagc

SEQ ID NO: 2330134 - DNA, 21 bp, Homo sapiens
tccagggaaggtggccacagc

SEQ ID NO: 2330135 - DNA, 17 bp, Homo sapiens
tccagggacacacagcc

SEQ ID NO: 2330136 - DNA, 14 bp, Homo sapiens
tccagggtttctct

SEQ ID NO: 2330137 - DNA, 16 bp, Homo sapiens
tccagggtttctctgc

SEQ ID NO: 2330138 - DNA, 18 bp, Homo sapiens
tccagggtttctctgcag

SEQ ID NO: 2330139 - DNA, 16 bp, Homo sapiens
tccagtaggatccagt

SEQ ID NO: 2330140 - DNA, 13 bp, Homo sapiens
tccagtgcctaca

SEQ ID NO: 2330141 - DNA, 17 bp, Homo sapiens
tccagtgctctgcctca

SEQ ID NO: 2330142 - DNA, 18 bp, Homo sapiens
tccagtgctctgcctcag

SEQ ID NO: 2330143 - DNA, 16 bp, Homo sapiens
tccagttataagaaga

SEQ ID NO: 2330144 - DNA, 21 bp, Homo sapiens
tccagttcatcgattttctat

SEQ ID NO: 2330145 - DNA, 13 bp, Homo sapiens
tccataaacatga

SEQ ID NO: 2330146 - DNA, 20 bp, Homo sapiens
tccataaagtacaaatgaag

SEQ ID NO: 2330147 - DNA, 14 bp, Homo sapiens
tccatacacagagg

SEQ ID NO: 2330148 - DNA, 14 bp, Homo sapiens
tccatataacaatt

SEQ ID NO: 2330149 - DNA, 20 bp, Homo sapiens
tccatatcagaactgtgcca

SEQ ID NO: 2330150 - DNA, 18 bp, Homo sapiens
tccatatttgatttctaa

SEQ ID NO: 2330151 - DNA, 13 bp, Homo sapiens
tccatccatcctt

SEQ ID NO: 2330152 - DNA, 13 bp, Homo sapiens
tccatccctccat

SEQ ID NO: 2330153 - DNA, 18 bp, Homo sapiens
tccatctcccaaggctgc

SEQ ID NO: 2330154 - DNA, 20 bp, Homo sapiens
tcaacttgggctactgaact

SEQ ID NO: 2330155 - DNA, 16 bp, Homo sapiens
tcaactttgtaaaaat

SEQ ID NO: 2330156 - DNA, 14 bp, Homo sapiens
tcaagaatgaaaaa

SEQ ID NO: 2330157 - DNA, 13 bp, Homo sapiens
tcaagagaaactt

SEQ ID NO: 2330158 - DNA, 15 bp, Homo sapiens
tcaagagaaacttca

SEQ ID NO: 2330159 - DNA, 20 bp, Homo sapiens
tcaagagctagaaaaataaa

SEQ ID NO: 2330160 - DNA, 17 bp, Homo sapiens
tcaagaggataaatttt

SEQ ID NO: 2330161 - DNA, 19 bp, Homo sapiens
tcaagatgggggcagggct

SEQ ID NO: 2330162 - DNA, 16 bp, Homo sapiens
tcaagattttgaatgc

SEQ ID NO: 2330163 - DNA, 19 bp, Homo sapiens
tcaagcaatcctcctgcct

SEQ ID NO: 2330164 - DNA, 21 bp, Homo sapiens
tcaagcaatcctcctgcctca

SEQ ID NO: 2330165 - DNA, 22 bp, Homo sapiens
tcaagcaatcctcctgcctcag

SEQ ID NO: 2330166 - DNA, 16 bp, Homo sapiens
tcaagctagtgtttct

SEQ ID NO: 2330167 - DNA, 17 bp, Homo sapiens
tcaagctagtgtttcta

SEQ ID NO: 2330168 - DNA, 14 bp, Homo sapiens
tcaagctgctctga

SEQ ID NO: 2330169 - DNA, 21 bp, Homo sapiens
tcaagctggaagaagtgagca

SEQ ID NO: 2330170 - DNA, 16 bp, Homo sapiens
tcaagggggactgtct

SEQ ID NO: 2330171 - DNA, 22 bp, Homo sapiens
tcaagtaagaagacatgaacca

SEQ ID NO: 2330172 - DNA, 23 bp, Homo sapiens
tcaagtaagaagacatgaaccaa

SEQ ID NO: 2330173 - DNA, 15 bp, Homo sapiens
tcaagtgtcctgaaa

SEQ ID NO: 2330174 - DNA, 15 bp, Homo sapiens
tcaagttataggaaa

SEQ ID NO: 2330175 - DNA, 19 bp, Homo sapiens
tcaagttataggaaaggaa

SEQ ID NO: 2330176 - DNA, 18 bp, Homo sapiens
tcaataaagcactgagca

SEQ ID NO: 2330177 - DNA, 21 bp, Homo sapiens
tcaataaagtgctttaaaaag

SEQ ID NO: 2330178 - DNA, 14 bp, Homo sapiens
tcaatacactagtt

SEQ ID NO: 2330179 - DNA, 15 bp, Homo sapiens
tcaatagttgaatta

SEQ ID NO: 2330180 - DNA, 16 bp, Homo sapiens
tcaatagttgaattag

SEQ ID NO: 2330181 - DNA, 20 bp, Homo sapiens
tcaatatattgaacttttgt

SEQ ID NO: 2330182 - DNA, 15 bp, Homo sapiens
tcaatatgaatctat

SEQ ID NO: 2330183 - DNA, 22 bp, Homo sapiens
tcaatcctaatttctcctccct

SEQ ID NO: 2330184 - DNA, 13 bp, Homo sapiens
tcaatctgtaaac

SEQ ID NO: 2330185 - DNA, 14 bp, Homo sapiens
tcaatctgtaaact

SEQ ID NO: 2330186 - DNA, 17 bp, Homo sapiens
tcaatgaaccataaatt

SEQ ID NO: 2330187 - DNA, 14 bp, Homo sapiens
tcaatgagagcata

SEQ ID NO: 2330188 - DNA, 15 bp, Homo sapiens
tcaatgtcttcccac

SEQ ID NO: 2330189 - DNA, 20 bp, Homo sapiens
tcaattactggtccaaaaga

SEQ ID NO: 2330190 - DNA, 18 bp, Homo sapiens
tcaattagtggtcataaa

SEQ ID NO: 2330191 - DNA, 20 bp, Homo sapiens
tcaattagtggtcataaaat

SEQ ID NO: 2330192 - DNA, 17 bp, Homo sapiens
tcacaaagctatttaag

SEQ ID NO: 2330193 - DNA, 20 bp, Homo sapiens
tcacaagtggtgtttattgc

SEQ ID NO: 2330194 - DNA, 16 bp, Homo sapiens
tcacagcaaacctctc

SEQ ID NO: 2330195 - DNA, 15 bp, Homo sapiens
tcacaggctgagaac

SEQ ID NO: 2330196 - DNA, 16 bp, Homo sapiens
tcacaggtagcctatt

SEQ ID NO: 2330197 - DNA, 17 bp, Homo sapiens
tcacagtagagccagct

SEQ ID NO: 2330198 - DNA, 15 bp, Homo sapiens
tcacagtccaaccag

SEQ ID NO: 2330199 - DNA, 18 bp, Homo sapiens
tcacagtctcagttctct

SEQ ID NO: 2330200 - DNA, 20 bp, Homo sapiens
tcacagtctcagttctcttg

SEQ ID NO: 2330201 - DNA, 20 bp, Homo sapiens
tcacataggaagggatctga

SEQ ID NO: 2330202 - DNA, 14 bp, Homo sapiens
tcacatccatccct

SEQ ID NO: 2330203 - DNA, 20 bp, Homo sapiens
tcacattaatctcaaagaga

SEQ ID NO: 2330204 - DNA, 14 bp, Homo sapiens
tcacattttccttt

SEQ ID NO: 2330205 - DNA, 17 bp, Homo sapiens
tcacattttccttttca

SEQ ID NO: 2330206 - DNA, 18 bp, Homo sapiens
tcacattttccttttcaa

SEQ ID NO: 2330207 - DNA, 17 bp, Homo sapiens
tcacattttgcctttct

SEQ ID NO: 2330208 - DNA, 17 bp, Homo sapiens
tcaccaaatagtgtgaa

SEQ ID NO: 2330209 - DNA, 14 bp, Homo sapiens
tcaccactcatttt

SEQ ID NO: 2330210 - DNA, 14 bp, Homo sapiens
tcaccagagacttt

SEQ ID NO: 2330211 - DNA, 15 bp, Homo sapiens
tcaccagagacttta

SEQ ID NO: 2330212 - DNA, 15 bp, Homo sapiens
tcaccagccccactg

SEQ ID NO: 2330213 - DNA, 19 bp, Homo sapiens
tcaccagccccactgccag

SEQ ID NO: 2330214 - DNA, 18 bp, Homo sapiens
tcaccatccaccttccct

SEQ ID NO: 2330215 - DNA, 15 bp, Homo sapiens
tcaccatgtaagcac

SEQ ID NO: 2330216 - DNA, 16 bp, Homo sapiens
tcaccatgtaagcact

SEQ ID NO: 2330217 - DNA, 18 bp, Homo sapiens
tcaccctcttcctgtgat

SEQ ID NO: 2330218 - DNA, 15 bp, Homo sapiens
tcaccctgcagagct

SEQ ID NO: 2330219 - DNA, 23 bp, Homo sapiens
tcaccctgcagagctatggtgag

SEQ ID NO: 2330220 - DNA, 14 bp, Homo sapiens
tcaccgctggccct

SEQ ID NO: 2330221 - DNA, 20 bp, Homo sapiens
tcaccgctggcccttagaga

SEQ ID NO: 2330222 - DNA, 15 bp, Homo sapiens
tcaccgctgggtggt

SEQ ID NO: 2330223 - DNA, 18 bp, Homo sapiens
tcaccggggtggtttagt

SEQ ID NO: 2330224 - DNA, 22 bp, Homo sapiens
tcacctacatatgctgatcttt

SEQ ID NO: 2330225 - DNA, 19 bp, Homo sapiens
tcacctccaagcatttcat

SEQ ID NO: 2330226 - DNA, 17 bp, Homo sapiens
tcacctgtaaacctgag

SEQ ID NO: 2330227 - DNA, 21 bp, Homo sapiens
tcaccttgccgagagaggcgc

SEQ ID NO: 2330228 - DNA, 14 bp, Homo sapiens
tcaccttggggcct

SEQ ID NO: 2330229 - DNA, 22 bp, Homo sapiens
tcacgatttgcaggattccctt

SEQ ID NO: 2330230 - DNA, 14 bp, Homo sapiens
tcacgctttcctga

SEQ ID NO: 2330231 - DNA, 15 bp, Homo sapiens
tcacgctttcctgaa

SEQ ID NO: 2330232 - DNA, 17 bp, Homo sapiens
tcacgctttcctgaatc

SEQ ID NO: 2330233 - DNA, 22 bp, Homo sapiens
tcacgctttcctgaatccaaac

SEQ ID NO: 2330234 - DNA, 20 bp, Homo sapiens
tcacggggttccctcctagc

SEQ ID NO: 2330235 - DNA, 23 bp, Homo sapiens
tcacgtggcctccgcagtgtctc

SEQ ID NO: 2330236 - DNA, 20 bp, Homo sapiens
tcacgttggggtgatttaat

SEQ ID NO: 2330237 - DNA, 18 bp, Homo sapiens
tcactacaagtcagctcc

SEQ ID NO: 2330238 - DNA, 13 bp, Homo sapiens
tcactaccctgat

SEQ ID NO: 2330239 - DNA, 21 bp, Homo sapiens
tcactattcttggaccatgcc

SEQ ID NO: 2330240 - DNA, 15 bp, Homo sapiens
tcactcactctaaag

SEQ ID NO: 2330241 - DNA, 14 bp, Homo sapiens
tcactgaaccactg

SEQ ID NO: 2330242 - DNA, 16 bp, Homo sapiens
tcactgaaccactgct

SEQ ID NO: 2330243 - DNA, 19 bp, Homo sapiens
tcactgaaccactgcttct

SEQ ID NO: 2330244 - DNA, 15 bp, Homo sapiens
tcactgccacactct

SEQ ID NO: 2330245 - DNA, 19 bp, Homo sapiens
tcactgccacactctccat

SEQ ID NO: 2330246 - DNA, 11 bp, Homo sapiens
tcactgccagg

SEQ ID NO: 2330247 - DNA, 14 bp, Homo sapiens
tcactgccaggcca

SEQ ID NO: 2330248 - DNA, 15 bp, Homo sapiens
tcactgccaggccag

SEQ ID NO: 2330249 - DNA, 18 bp, Homo sapiens
tcactgccaggccagcct

SEQ ID NO: 2330250 - DNA, 23 bp, Homo sapiens
tcactgccaggccagcctccgag

SEQ ID NO: 2330251 - DNA, 21 bp, Homo sapiens
tcactggaaaggggagagcct

SEQ ID NO: 2330252 - DNA, 23 bp, Homo sapiens
tcactggaaaggggagagcctgc

SEQ ID NO: 2330253 - DNA, 17 bp, Homo sapiens
tcactggctctcctggc

SEQ ID NO: 2330254 - DNA, 19 bp, Homo sapiens
tcactgggaagaagcaagg

SEQ ID NO: 2330255 - DNA, 22 bp, Homo sapiens
tcactgggaagaagcaagggca

SEQ ID NO: 2330256 - DNA, 22 bp, Homo sapiens
tcactgtagtttagttctgttg

SEQ ID NO: 2330257 - DNA, 24 bp, Homo sapiens
tcactgtataaataggagaggatg

SEQ ID NO: 2330258 - DNA, 23 bp, Homo sapiens
tcacttaactataaggtgcctca

SEQ ID NO: 2330259 - DNA, 15 bp, Homo sapiens
tcactttactttcaa

SEQ ID NO: 2330260 - DNA, 12 bp, Homo sapiens
tcactttcataa

SEQ ID NO: 2330261 - DNA, 14 bp, Homo sapiens
tcactttgaaaagt

SEQ ID NO: 2330262 - DNA, 21 bp, Homo sapiens
tcactttgaaaagttggaagg

SEQ ID NO: 2330263 - DNA, 13 bp, Homo sapiens
tcagaaagtaaca

SEQ ID NO: 2330264 - DNA, 13 bp, Homo sapiens
tcagaaatataac

SEQ ID NO: 2330265 - DNA, 12 bp, Homo sapiens
tcagaaccttgt

SEQ ID NO: 2330266 - DNA, 20 bp, Homo sapiens
tcagaaccttgtcccagcca

SEQ ID NO: 2330267 - DNA, 14 bp, Homo sapiens
tcagaactgtgcca

SEQ ID NO: 2330268 - DNA, 15 bp, Homo sapiens
tcagaactgtgccac

SEQ ID NO: 2330269 - DNA, 16 bp, Homo sapiens
gccttgatgactgcct

SEQ ID NO: 2330270 - DNA, 17 bp, Homo sapiens
gccttgatgactgcctt

SEQ ID NO: 2330271 - DNA, 15 bp, Homo sapiens
gccttgcctcctcag

SEQ ID NO: 2330272 - DNA, 22 bp, Homo sapiens
gccttgctgtttgtcctgagat

SEQ ID NO: 2330273 - DNA, 13 bp, Homo sapiens
gccttggaaattc

SEQ ID NO: 2330274 - DNA, 14 bp, Homo sapiens
gccttggaaattcc

SEQ ID NO: 2330275 - DNA, 14 bp, Homo sapiens
gccttggcctccca

SEQ ID NO: 2330276 - DNA, 22 bp, Homo sapiens
gccttgggtggccccctctcct

SEQ ID NO: 2330277 - DNA, 19 bp, Homo sapiens
gccttgtttgagtttttcc

SEQ ID NO: 2330278 - DNA, 14 bp, Homo sapiens
gcctttccttccct

SEQ ID NO: 2330279 - DNA, 22 bp, Homo sapiens
gcctttctacaactgattgcaa

SEQ ID NO: 2330280 - DNA, 13 bp, Homo sapiens
gcctttcttctgt

SEQ ID NO: 2330281 - DNA, 19 bp, Homo sapiens
gcctttgagacagtttctt

SEQ ID NO: 2330282 - DNA, 21 bp, Homo sapiens
gcctttgagacagtttcttag

SEQ ID NO: 2330283 - DNA, 17 bp, Homo sapiens
gccttttccacacgcat

SEQ ID NO: 2330284 - DNA, 15 bp, Homo sapiens
gccttttttttcatg

SEQ ID NO: 2330285 - DNA, 21 bp, Homo sapiens
gcgaacttcacataggaaggg

SEQ ID NO: 2330286 - DNA, 14 bp, Homo sapiens
gcgagctgctctgc

SEQ ID NO: 2330287 - DNA, 15 bp, Homo sapiens
gcgagggcagctgct

SEQ ID NO: 2330288 - DNA, 16 bp, Homo sapiens
gcgatctctcctggcc

SEQ ID NO: 2330289 - DNA, 18 bp, Homo sapiens
gcgcaggtgggctggact

SEQ ID NO: 2330290 - DNA, 22 bp, Homo sapiens
gcgcatcctgcagggcttctcc

SEQ ID NO: 2330291 - DNA, 11 bp, Homo sapiens
gcgcatctaac

SEQ ID NO: 2330292 - DNA, 17 bp, Homo sapiens
gcgccaccgtgcctggc

SEQ ID NO: 2330293 - DNA, 18 bp, Homo sapiens
gcgccaccgtgcctggct

SEQ ID NO: 2330294 - DNA, 15 bp, Homo sapiens
gcgccaggaagccag

SEQ ID NO: 2330295 - DNA, 22 bp, Homo sapiens
gcgcccttaactgcatccagcc

SEQ ID NO: 2330296 - DNA, 20 bp, Homo sapiens
gcgcccttggcttctgtgat

SEQ ID NO: 2330297 - DNA, 15 bp, Homo sapiens
gcgccgatgccaccg

SEQ ID NO: 2330298 - DNA, 18 bp, Homo sapiens
gcgccgatgccaccggcc

SEQ ID NO: 2330299 - DNA, 11 bp, Homo sapiens
gcgcctcagcc

SEQ ID NO: 2330300 - DNA, 16 bp, Homo sapiens
gcgcctgcaggcagag

SEQ ID NO: 2330301 - DNA, 19 bp, Homo sapiens
gcgcctgctgcctgctgag

SEQ ID NO: 2330302 - DNA, 20 bp, Homo sapiens
gcgcctgctgcctgctgaga

SEQ ID NO: 2330303 - DNA, 17 bp, Homo sapiens
gcgcggacgtgctgggc

SEQ ID NO: 2330304 - DNA, 15 bp, Homo sapiens
gcgcggtggctcacg

SEQ ID NO: 2330305 - DNA, 19 bp, Homo sapiens
gcgctcatgttgagccagt

SEQ ID NO: 2330306 - DNA, 14 bp, Homo sapiens
gcgctccgggcttt

SEQ ID NO: 2330307 - DNA, 16 bp, Homo sapiens
gcgctctctttgcaac

SEQ ID NO: 2330308 - DNA, 13 bp, Homo sapiens
gcgcttgctggcc

SEQ ID NO: 2330309 - DNA, 17 bp, Homo sapiens
gcggaccaccctcactg

SEQ ID NO: 2330310 - DNA, 13 bp, Homo sapiens
gcggagcgggagg

SEQ ID NO: 2330311 - DNA, 23 bp, Homo sapiens
gcggagcgggaggcggtggtaga

SEQ ID NO: 2330312 - DNA, 17 bp, Homo sapiens
gcggcaaacctttcccc

SEQ ID NO: 2330313 - DNA, 15 bp, Homo sapiens
gcggcctccttctga

SEQ ID NO: 2330314 - DNA, 12 bp, Homo sapiens
gcgggccagggt

SEQ ID NO: 2330315 - DNA, 14 bp, Homo sapiens
gcgggccagggtcc

SEQ ID NO: 2330316 - DNA, 15 bp, Homo sapiens
gcggtgccatgtctg

SEQ ID NO: 2330317 - DNA, 18 bp, Homo sapiens
gcggtggctcacgcctgt

SEQ ID NO: 2330318 - DNA, 13 bp, Homo sapiens
gcgtaaggatgtg

SEQ ID NO: 2330319 - DNA, 14 bp, Homo sapiens
gcgtcagctgctcc

SEQ ID NO: 2330320 - DNA, 11 bp, Homo sapiens
gcgtccctggc

SEQ ID NO: 2330321 - DNA, 13 bp, Homo sapiens
gcgtctccagtca

SEQ ID NO: 2330322 - DNA, 17 bp, Homo sapiens
gcgtctgccccaccctc

SEQ ID NO: 2330323 - DNA, 16 bp, Homo sapiens
gcgtctgctctggtgg

SEQ ID NO: 2330324 - DNA, 17 bp, Homo sapiens
gcgtgccgtggcaccag

SEQ ID NO: 2330325 - DNA, 13 bp, Homo sapiens
gcgtggactctgc

SEQ ID NO: 2330326 - DNA, 17 bp, Homo sapiens
gcgtggactctgcacat

SEQ ID NO: 2330327 - DNA, 18 bp, Homo sapiens
gcgtggactctgcacatg

SEQ ID NO: 2330328 - DNA, 12 bp, Homo sapiens
gcgtgtgtagag

SEQ ID NO: 2330329 - DNA, 15 bp, Homo sapiens
gcgtgtgtagagtta

SEQ ID NO: 2330330 - DNA, 21 bp, Homo sapiens
gcgtgtgtagagttaagaagc

SEQ ID NO: 2330331 - DNA, 17 bp, Homo sapiens
gcgtgttcagcagaacc

SEQ ID NO: 2330332 - DNA, 21 bp, Homo sapiens
gcgttgttttgtggataagaa

SEQ ID NO: 2330333 - DNA, 15 bp, Homo sapiens
gctaaaaatgaaaat

SEQ ID NO: 2330334 - DNA, 14 bp, Homo sapiens
gctaaagagccctt

SEQ ID NO: 2330335 - DNA, 22 bp, Homo sapiens
gctaaagagcccttgcctcccc

SEQ ID NO: 2330336 - DNA, 21 bp, Homo sapiens
taacttttaaaatttgtctta

SEQ ID NO: 2330337 - DNA, 12 bp, Homo sapiens
taagaaaatgta

SEQ ID NO: 2330338 - DNA, 17 bp, Homo sapiens
taagaaacagtttaaca

SEQ ID NO: 2330339 - DNA, 16 bp, Homo sapiens
taagaacaactacctg

SEQ ID NO: 2330340 - DNA, 18 bp, Homo sapiens
taagaaccattgatttaa

SEQ ID NO: 2330341 - DNA, 17 bp, Homo sapiens
taagaagaagttcatgt

SEQ ID NO: 2330342 - DNA, 14 bp, Homo sapiens
taagaagacatgaa

SEQ ID NO: 2330343 - DNA, 17 bp, Homo sapiens
taagaaggcaatattaa

SEQ ID NO: 2330344 - DNA, 23 bp, Homo sapiens
taagaataccacatcaaataaga

SEQ ID NO: 2330345 - DNA, 18 bp, Homo sapiens
taagaatagtagatgtgg

SEQ ID NO: 2330346 - DNA, 18 bp, Homo sapiens
taagaattctgattgatt

SEQ ID NO: 2330347 - DNA, 19 bp, Homo sapiens
taagacaaatattcctttg

SEQ ID NO: 2330348 - DNA, 17 bp, Homo sapiens
taagacataacgttttt

SEQ ID NO: 2330349 - DNA, 20 bp, Homo sapiens
taagacataacgtttttcct

SEQ ID NO: 2330350 - DNA, 17 bp, Homo sapiens
taagacatttgtttgct

SEQ ID NO: 2330351 - DNA, 20 bp, Homo sapiens
taagacatttgtttgctgta

SEQ ID NO: 2330352 - DNA, 20 bp, Homo sapiens
taagagaaaagagagaaaca

SEQ ID NO: 2330353 - DNA, 23 bp, Homo sapiens
taagagattttatgtttaaaatg

SEQ ID NO: 2330354 - DNA, 17 bp, Homo sapiens
taagagcttgctccaga

SEQ ID NO: 2330355 - DNA, 22 bp, Homo sapiens
taagagtgtagaagcattcctt

SEQ ID NO: 2330356 - DNA, 17 bp, Homo sapiens
taagatacaataaaaca

SEQ ID NO: 2330357 - DNA, 15 bp, Homo sapiens
taagatagtgtaact

SEQ ID NO: 2330358 - DNA, 17 bp, Homo sapiens
taagatatctcaatgaa

SEQ ID NO: 2330359 - DNA, 16 bp, Homo sapiens
taagatttttcaaaat

SEQ ID NO: 2330360 - DNA, 17 bp, Homo sapiens
taagcaaaggggacagc

SEQ ID NO: 2330361 - DNA, 19 bp, Homo sapiens
taagcaaattttgtattat

SEQ ID NO: 2330362 - DNA, 13 bp, Homo sapiens
taagcaagagaga

SEQ ID NO: 2330363 - DNA, 20 bp, Homo sapiens
taagcaataaggaaatgtat

SEQ ID NO: 2330364 - DNA, 15 bp, Homo sapiens
taagcattctgagct

SEQ ID NO: 2330365 - DNA, 17 bp, Homo sapiens
taagcattttgaaacaa

SEQ ID NO: 2330366 - DNA, 21 bp, Homo sapiens
taagcattttgaaacaaagta

SEQ ID NO: 2330367 - DNA, 16 bp, Homo sapiens
taagccaggcctggct

SEQ ID NO: 2330368 - DNA, 13 bp, Homo sapiens
taagcctgttgct

SEQ ID NO: 2330369 - DNA, 22 bp, Homo sapiens
taagctatgagttgaaatgttc

SEQ ID NO: 2330370 - DNA, 15 bp, Homo sapiens
taagctttttggaat

SEQ ID NO: 2330371 - DNA, 20 bp, Homo sapiens
taaggatgagggaagcgaag

SEQ ID NO: 2330372 - DNA, 17 bp, Homo sapiens
taaggcatatttaacaa

SEQ ID NO: 2330373 - DNA, 17 bp, Homo sapiens
taaggccagggcctctc

SEQ ID NO: 2330374 - DNA, 18 bp, Homo sapiens
taaggcttaggtgccagg

SEQ ID NO: 2330375 - DNA, 17 bp, Homo sapiens
taagggaaaagataaag

SEQ ID NO: 2330376 - DNA, 15 bp, Homo sapiens
taagggacatttcta

SEQ ID NO: 2330377 - DNA, 17 bp, Homo sapiens
taagggacatttctata

SEQ ID NO: 2330378 - DNA, 16 bp, Homo sapiens
taaggggaagaatgaa

SEQ ID NO: 2330379 - DNA, 17 bp, Homo sapiens
taaggtcttcttgtgtc

SEQ ID NO: 2330380 - DNA, 18 bp, Homo sapiens
taaggtgcctcagttttc

SEQ ID NO: 2330381 - DNA, 15 bp, Homo sapiens
taagtaaatgtcttc

SEQ ID NO: 2330382 - DNA, 20 bp, Homo sapiens
taagtaacttttaaaatttg

SEQ ID NO: 2330383 - DNA, 15 bp, Homo sapiens
taagtaccaatggga

SEQ ID NO: 2330384 - DNA, 16 bp, Homo sapiens
taagtagtaaatcaga

SEQ ID NO: 2330385 - DNA, 17 bp, Homo sapiens
taagtattatgtctctt

SEQ ID NO: 2330386 - DNA, 23 bp, Homo sapiens
taagtgacaaataagattaataa

SEQ ID NO: 2330387 - DNA, 18 bp, Homo sapiens
taagtgcccacatttgat

SEQ ID NO: 2330388 - DNA, 14 bp, Homo sapiens
taagtgccctctcc

SEQ ID NO: 2330389 - DNA, 21 bp, Homo sapiens
taagtgcgtgtgtagagttaa

SEQ ID NO: 2330390 - DNA, 22 bp, Homo sapiens
taagtggtttttatattttcac

SEQ ID NO: 2330391 - DNA, 18 bp, Homo sapiens
taagtgtgccaaatcagt

SEQ ID NO: 2330392 - DNA, 20 bp, Homo sapiens
taagtgttctcatgaagcag

SEQ ID NO: 2330393 - DNA, 15 bp, Homo sapiens
taagtgttctgtggc

SEQ ID NO: 2330394 - DNA, 18 bp, Homo sapiens
taagttatttttgtacat

SEQ ID NO: 2330395 - DNA, 19 bp, Homo sapiens
taagttcaaattcttctga

SEQ ID NO: 2330396 - DNA, 12 bp, Homo sapiens
taagttcttatg

SEQ ID NO: 2330397 - DNA, 16 bp, Homo sapiens
taagtttcaggtgaca

SEQ ID NO: 2330398 - DNA, 19 bp, Homo sapiens
taagtttcaggtgacatgt

SEQ ID NO: 2330399 - DNA, 13 bp, Homo sapiens
taataaaaccaaa

SEQ ID NO: 2330400 - DNA, 11 bp, Homo sapiens
taataaaagaa

SEQ ID NO: 2330401 - DNA, 12 bp, Homo sapiens
taataaaagaaa

SEQ ID NO: 2330402 - DNA, 14 bp, Homo sapiens
taataaaagaaaat

SEQ ID NO: 2330403 - DNA, 14 bp, Homo sapiens
taataaaagaacat

SEQ ID NO: 2330404 - DNA, 16 bp, Homo sapiens
taataaaataattcta

SEQ ID NO: 2330405 - DNA, 13 bp, Homo sapiens
taataaaccagtt

SEQ ID NO: 2330406 - DNA, 15 bp, Homo sapiens
taataaatatttatg

SEQ ID NO: 2330407 - DNA, 14 bp, Homo sapiens
taataaatgccctc

SEQ ID NO: 2330408 - DNA, 15 bp, Homo sapiens
taataaattttccat

SEQ ID NO: 2330409 - DNA, 21 bp, Homo sapiens
taataacattaccttactgtg

SEQ ID NO: 2330410 - DNA, 17 bp, Homo sapiens
taataactgtgtactgt

SEQ ID NO: 2330411 - DNA, 12 bp, Homo sapiens
taataagacata

SEQ ID NO: 2330412 - DNA, 14 bp, Homo sapiens
taataagacataac

SEQ ID NO: 2330413 - DNA, 17 bp, Homo sapiens
taataagacataacgtt

SEQ ID NO: 2330414 - DNA, 19 bp, Homo sapiens
taataagacataacgtttt

SEQ ID NO: 2330415 - DNA, 22 bp, Homo sapiens
taataagacataacgtttttcc

SEQ ID NO: 2330416 - DNA, 16 bp, Homo sapiens
taataagatttttcaa

SEQ ID NO: 2330417 - DNA, 18 bp, Homo sapiens
taataagctaaagaggct

SEQ ID NO: 2330418 - DNA, 12 bp, Homo sapiens
taataatcttgt

SEQ ID NO: 2330419 - DNA, 18 bp, Homo sapiens
taataatcttgtttctga

SEQ ID NO: 2330420 - DNA, 20 bp, Homo sapiens
taataatcttgtttctgaaa

SEQ ID NO: 2330421 - DNA, 18 bp, Homo sapiens
taatacagcaacaattta

SEQ ID NO: 2330422 - DNA, 22 bp, Homo sapiens
taatacttctttgttattataa

SEQ ID NO: 2330423 - DNA, 18 bp, Homo sapiens
taatactttttaaattac

SEQ ID NO: 2330424 - DNA, 13 bp, Homo sapiens
taatataaatgtt

SEQ ID NO: 2330425 - DNA, 14 bp, Homo sapiens
taatataaatgttg

SEQ ID NO: 2330426 - DNA, 20 bp, Homo sapiens
taatatactccttaaaaatg

SEQ ID NO: 2330427 - DNA, 21 bp, Homo sapiens
taatatactccttaaaaatgt

SEQ ID NO: 2330428 - DNA, 14 bp, Homo sapiens
taatatataaacaa

SEQ ID NO: 2330429 - DNA, 21 bp, Homo sapiens
taatatattaaaattccaaat

SEQ ID NO: 2330430 - DNA, 22 bp, Homo sapiens
taatatcagttacagtggcagt

SEQ ID NO: 2330431 - DNA, 22 bp, Homo sapiens
taatatgtttttttaaacctca

SEQ ID NO: 2330432 - DNA, 20 bp, Homo sapiens
taatattcagggtaaatagg

SEQ ID NO: 2330433 - DNA, 20 bp, Homo sapiens
taatattgaaaattgaaaag

SEQ ID NO: 2330434 - DNA, 21 bp, Homo sapiens
taatattgaaaattgaaaagt

SEQ ID NO: 2330435 - DNA, 16 bp, Homo sapiens
taatcaagagaaactt

SEQ ID NO: 2330436 - DNA, 15 bp, Homo sapiens
taatcaccatgtaag

SEQ ID NO: 2330437 - DNA, 17 bp, Homo sapiens
taatcacgctttcctga

SEQ ID NO: 2330438 - DNA, 22 bp, Homo sapiens
taatcagattgcttaaaagcat

SEQ ID NO: 2330439 - DNA, 17 bp, Homo sapiens
ctgcattgagcttgcat

SEQ ID NO: 2330440 - DNA, 13 bp, Homo sapiens
ctgccacacccag

SEQ ID NO: 2330441 - DNA, 16 bp, Homo sapiens
ctgccacacccagggg

SEQ ID NO: 2330442 - DNA, 17 bp, Homo sapiens
ctgccacactgatggct

SEQ ID NO: 2330443 - DNA, 22 bp, Homo sapiens
ctgccacactgatggctcaaga

SEQ ID NO: 2330444 - DNA, 14 bp, Homo sapiens
ctgccacagccaga

SEQ ID NO: 2330445 - DNA, 16 bp, Homo sapiens
ctgccacagccagagg

SEQ ID NO: 2330446 - DNA, 17 bp, Homo sapiens
ctgccacagccagagga

SEQ ID NO: 2330447 - DNA, 15 bp, Homo sapiens
ctgccaccagccccc

SEQ ID NO: 2330448 - DNA, 21 bp, Homo sapiens
ctgccactttcacgtggcctc

SEQ ID NO: 2330449 - DNA, 20 bp, Homo sapiens
ctgccagacatggacctcca

SEQ ID NO: 2330450 - DNA, 11 bp, Homo sapiens
ctgccagcagc

SEQ ID NO: 2330451 - DNA, 12 bp, Homo sapiens
ctgccagcagca

SEQ ID NO: 2330452 - DNA, 19 bp, Homo sapiens
ctgccagcagcagcaggtg

SEQ ID NO: 2330453 - DNA, 20 bp, Homo sapiens
ctgccagccttgagccctgg

SEQ ID NO: 2330454 - DNA, 22 bp, Homo sapiens
ctgccagccttgagccctggct

SEQ ID NO: 2330455 - DNA, 20 bp, Homo sapiens
ctgccaggcacacacagccc

SEQ ID NO: 2330456 - DNA, 20 bp, Homo sapiens
ctgccaggcaggggtggggg

SEQ ID NO: 2330457 - DNA, 15 bp, Homo sapiens
ctgccaggccagcct

SEQ ID NO: 2330458 - DNA, 17 bp, Homo sapiens
ctgccaggccagcctcc

SEQ ID NO: 2330459 - DNA, 14 bp, Homo sapiens
ctgccaggctgttt

SEQ ID NO: 2330460 - DNA, 19 bp, Homo sapiens
ctgccataaatatttctca

SEQ ID NO: 2330461 - DNA, 20 bp, Homo sapiens
ctgccatcaccgctgggtgg

SEQ ID NO: 2330462 - DNA, 23 bp, Homo sapiens
ctgccattacagaggtattaaaa

SEQ ID NO: 2330463 - DNA, 16 bp, Homo sapiens
ctgcccacgcagagga

SEQ ID NO: 2330464 - DNA, 18 bp, Homo sapiens
ctgccccacggagacaga

SEQ ID NO: 2330465 - DNA, 14 bp, Homo sapiens
ctgccccagcccag

SEQ ID NO: 2330466 - DNA, 17 bp, Homo sapiens
ctgccccgcccccagtc

SEQ ID NO: 2330467 - DNA, 20 bp, Homo sapiens
ctgcccctaatctctgtagg

SEQ ID NO: 2330468 - DNA, 16 bp, Homo sapiens
ctgcccctcccccagc

SEQ ID NO: 2330469 - DNA, 15 bp, Homo sapiens
ctgcccgcagagccc

SEQ ID NO: 2330470 - DNA, 17 bp, Homo sapiens
ctgcccgcagagcccac

SEQ ID NO: 2330471 - DNA, 16 bp, Homo sapiens
ctgccctatgggcctg

SEQ ID NO: 2330472 - DNA, 22 bp, Homo sapiens
ctgccctcactccctctgcaga

SEQ ID NO: 2330473 - DNA, 21 bp, Homo sapiens
ctgccctggctgctgccccca

SEQ ID NO: 2330474 - DNA, 18 bp, Homo sapiens
taatgataaaataaataa

SEQ ID NO: 2330475 - DNA, 23 bp, Homo sapiens
taatgatgaacttataatgatta

SEQ ID NO: 2330476 - DNA, 16 bp, Homo sapiens
taatgattaagggaca

SEQ ID NO: 2330477 - DNA, 20 bp, Homo sapiens
taatgattaagggacatttc

SEQ ID NO: 2330478 - DNA, 15 bp, Homo sapiens
taatgcctgcttttt

SEQ ID NO: 2330479 - DNA, 20 bp, Homo sapiens
taatgcctgctttttggaaa

SEQ ID NO: 2330480 - DNA, 14 bp, Homo sapiens
taatgctaccagga

SEQ ID NO: 2330481 - DNA, 15 bp, Homo sapiens
taatgctgtttctaa

SEQ ID NO: 2330482 - DNA, 21 bp, Homo sapiens
taatggaaaatgccatgaatt

SEQ ID NO: 2330483 - DNA, 14 bp, Homo sapiens
taatggtgaaagtt

SEQ ID NO: 2330484 - DNA, 15 bp, Homo sapiens
taatgtcagaacaga

SEQ ID NO: 2330485 - DNA, 21 bp, Homo sapiens
taatgtctcactttactttca

SEQ ID NO: 2330486 - DNA, 23 bp, Homo sapiens
taatgtgtggattgcctctgaaa

SEQ ID NO: 2330487 - DNA, 17 bp, Homo sapiens
taatgtttatgagccag

SEQ ID NO: 2330488 - DNA, 18 bp, Homo sapiens
taatgtttatgagccaga

SEQ ID NO: 2330489 - DNA, 16 bp, Homo sapiens
taatgtttattaaatg

SEQ ID NO: 2330490 - DNA, 14 bp, Homo sapiens
taatgtttgaacaa

SEQ ID NO: 2330491 - DNA, 14 bp, Homo sapiens
taatgttttcaaaa

SEQ ID NO: 2330492 - DNA, 20 bp, Homo sapiens
taattaatagccaaagattt

SEQ ID NO: 2330493 - DNA, 20 bp, Homo sapiens
taattaatatattaaaattc

SEQ ID NO: 2330494 - DNA, 20 bp, Homo sapiens
taattaatttggagcacaaa

SEQ ID NO: 2330495 - DNA, 17 bp, Homo sapiens
taattaccaacctgtta

SEQ ID NO: 2330496 - DNA, 21 bp, Homo sapiens
taattaccaacctgttaccta

SEQ ID NO: 2330497 - DNA, 15 bp, Homo sapiens
taattaccagttttc

SEQ ID NO: 2330498 - DNA, 21 bp, Homo sapiens
taattactgctataaataggt

SEQ ID NO: 2330499 - DNA, 22 bp, Homo sapiens
taattacttattgtatttatgt

SEQ ID NO: 2330500 - DNA, 24 bp, Homo sapiens
taattagttccagtttctccttga

SEQ ID NO: 2330501 - DNA, 21 bp, Homo sapiens
taattcaaatggcttaagcaa

SEQ ID NO: 2330502 - DNA, 18 bp, Homo sapiens
taattcaatcctactttt

SEQ ID NO: 2330503 - DNA, 15 bp, Homo sapiens
taattcatatctaaa

SEQ ID NO: 2330504 - DNA, 19 bp, Homo sapiens
taattccacaggtcatcag

SEQ ID NO: 2330505 - DNA, 15 bp, Homo sapiens
taattccattcaatt

SEQ ID NO: 2330506 - DNA, 15 bp, Homo sapiens
taattcttttctgag

SEQ ID NO: 2330507 - DNA, 18 bp, Homo sapiens
taattgccagcaaataaa

SEQ ID NO: 2330508 - DNA, 16 bp, Homo sapiens
taattggaagtgcagt

SEQ ID NO: 2330509 - DNA, 23 bp, Homo sapiens
taattgtacaaaattaagcaaat

SEQ ID NO: 2330510 - DNA, 15 bp, Homo sapiens
taattgtactaatct

SEQ ID NO: 2330511 - DNA, 22 bp, Homo sapiens
taatttaaaaatatatttataa

SEQ ID NO: 2330512 - DNA, 12 bp, Homo sapiens
taatttaaatga

SEQ ID NO: 2330513 - DNA, 20 bp, Homo sapiens
taatttacttgttttggatg

SEQ ID NO: 2330514 - DNA, 12 bp, Homo sapiens
taatttcagggt

SEQ ID NO: 2330515 - DNA, 11 bp, Homo sapiens
taatttcagtg

SEQ ID NO: 2330516 - DNA, 15 bp, Homo sapiens
taatttcagtgtaaa

SEQ ID NO: 2330517 - DNA, 16 bp, Homo sapiens
taatttcagtgtaaag

SEQ ID NO: 2330518 - DNA, 17 bp, Homo sapiens
taatttcctttttgaca

SEQ ID NO: 2330519 - DNA, 16 bp, Homo sapiens
taatttgaatgtattt

SEQ ID NO: 2330520 - DNA, 17 bp, Homo sapiens
taatttggagcacaaaa

SEQ ID NO: 2330521 - DNA, 15 bp, Homo sapiens
taatttgtgtgtttt

SEQ ID NO: 2330522 - DNA, 16 bp, Homo sapiens
taattttaatgctgtt

SEQ ID NO: 2330523 - DNA, 23 bp, Homo sapiens
taattttatggtggaaaagaact

SEQ ID NO: 2330524 - DNA, 19 bp, Homo sapiens
taattttattttaaaattt

SEQ ID NO: 2330525 - DNA, 16 bp, Homo sapiens
taattttggaataatt

SEQ ID NO: 2330526 - DNA, 20 bp, Homo sapiens
taattttggaataatttcta

SEQ ID NO: 2330527 - DNA, 21 bp, Homo sapiens
taattttggaataatttctat

SEQ ID NO: 2330528 - DNA, 13 bp, Homo sapiens
tacaaaaaaatta

SEQ ID NO: 2330529 - DNA, 23 bp, Homo sapiens
tacaaaattaagcaaatgttaaa

SEQ ID NO: 2330530 - DNA, 18 bp, Homo sapiens
tacaaacttggacaacac

SEQ ID NO: 2330531 - DNA, 13 bp, Homo sapiens
tacaaacttttaa

SEQ ID NO: 2330532 - DNA, 20 bp, Homo sapiens
tacaaacttttaagatttct

SEQ ID NO: 2330533 - DNA, 18 bp, Homo sapiens
tacaaagttaaaattgtt

SEQ ID NO: 2330534 - DNA, 15 bp, Homo sapiens
tacaaatgaagaaag

SEQ ID NO: 2330535 - DNA, 23 bp, Homo sapiens
tacaacacattgaaactgtattt

SEQ ID NO: 2330536 - DNA, 20 bp, Homo sapiens
tacaacaccagcaacattat

SEQ ID NO: 2330537 - DNA, 14 bp, Homo sapiens
tacaagaaaatgta

SEQ ID NO: 2330538 - DNA, 16 bp, Homo sapiens
tacaagcctgcacaat

SEQ ID NO: 2330539 - DNA, 18 bp, Homo sapiens
tacaagggcataaagtaa

SEQ ID NO: 2330540 - DNA, 14 bp, Homo sapiens
tacaagtcagtagg

SEQ ID NO: 2330541 - DNA, 15 bp, Homo sapiens
tacaagttagaaaac

SEQ ID NO: 2330542 - DNA, 18 bp, Homo sapiens
tacaataaaacaaataaa

SEQ ID NO: 2330543 - DNA, 22 bp, Homo sapiens
tacaataaaacaaataaatatg

SEQ ID NO: 2330544 - DNA, 16 bp, Homo sapiens
tacaataataaatcct

SEQ ID NO: 2330545 - DNA, 20 bp, Homo sapiens
tacaataataaatcctcagg

SEQ ID NO: 2330546 - DNA, 14 bp, Homo sapiens
tacaatacaacaca

SEQ ID NO: 2330547 - DNA, 14 bp, Homo sapiens
tacaatagtataca

SEQ ID NO: 2330548 - DNA, 18 bp, Homo sapiens
tacaatagtatacatttt

SEQ ID NO: 2330549 - DNA, 17 bp, Homo sapiens
tacaatctctttttgtt

SEQ ID NO: 2330550 - DNA, 23 bp, Homo sapiens
tacaattttttatcatgcatgtc

SEQ ID NO: 2330551 - DNA, 21 bp, Homo sapiens
tacacaaagctttcttttcta

SEQ ID NO: 2330552 - DNA, 22 bp, Homo sapiens
tacacaaagctttcttttctaa

SEQ ID NO: 2330553 - DNA, 17 bp, Homo sapiens
tacacagaaatgctgct

SEQ ID NO: 2330554 - DNA, 20 bp, Homo sapiens
tacacagaaatgctgctggc

SEQ ID NO: 2330555 - DNA, 21 bp, Homo sapiens
tacacagaaatgctgctggcc

SEQ ID NO: 2330556 - DNA, 18 bp, Homo sapiens
tacacagaggagtgcagc

SEQ ID NO: 2330557 - DNA, 17 bp, Homo sapiens
tacacatagttctgtaa

SEQ ID NO: 2330558 - DNA, 18 bp, Homo sapiens
tacaccactttcccacac

SEQ ID NO: 2330559 - DNA, 15 bp, Homo sapiens
tacacccctgtgctc

SEQ ID NO: 2330560 - DNA, 19 bp, Homo sapiens
tacactaccaaacactcag

SEQ ID NO: 2330561 - DNA, 20 bp, Homo sapiens
tacactaccaaacactcagt

SEQ ID NO: 2330562 - DNA, 14 bp, Homo sapiens
tacactagttgttt

SEQ ID NO: 2330563 - DNA, 14 bp, Homo sapiens
tacagaaagctgcc

SEQ ID NO: 2330564 - DNA, 18 bp, Homo sapiens
tacagaatatttctattg

SEQ ID NO: 2330565 - DNA, 14 bp, Homo sapiens
tacagaatttgaat

SEQ ID NO: 2330566 - DNA, 17 bp, Homo sapiens
tacagaatttgaattat

SEQ ID NO: 2330567 - DNA, 18 bp, Homo sapiens
tacagagaaattctgtgg

SEQ ID NO: 2330568 - DNA, 20 bp, Homo sapiens
tacagaggatgccttttctg

SEQ ID NO: 2330569 - DNA, 16 bp, Homo sapiens
tacagaggtattaaaa

SEQ ID NO: 2330570 - DNA, 13 bp, Homo sapiens
tacagatcaagaa

SEQ ID NO: 2330571 - DNA, 11 bp, Homo sapiens
tacagcagggt

SEQ ID NO: 2330572 - DNA, 22 bp, Homo sapiens
tacagcctagggcagacaatag

SEQ ID NO: 2330573 - DNA, 21 bp, Homo sapiens
tacagcctatagtaaatgtgt

SEQ ID NO: 2330574 - DNA, 14 bp, Homo sapiens
tacaggcaccgaga

SEQ ID NO: 2330575 - DNA, 19 bp, Homo sapiens
tacaggcaccgagaatgtt

SEQ ID NO: 2330576 - DNA, 18 bp, Homo sapiens
tacaggggttagcctgga

SEQ ID NO: 2330577 - DNA, 16 bp, Homo sapiens
tacagtaaatgttact

SEQ ID NO: 2330578 - DNA, 17 bp, Homo sapiens
tacatagatgcttagtc

SEQ ID NO: 2330579 - DNA, 21 bp, Homo sapiens
tacataggccgagctgtggac

SEQ ID NO: 2330580 - DNA, 13 bp, Homo sapiens
tacatatatacat

SEQ ID NO: 2330581 - DNA, 19 bp, Homo sapiens
tacatattaggaaaatatg

SEQ ID NO: 2330582 - DNA, 20 bp, Homo sapiens
tacatcaatgataatgctaa

SEQ ID NO: 2330583 - DNA, 21 bp, Homo sapiens
tacatcttctttggaaataaa

SEQ ID NO: 2330584 - DNA, 17 bp, Homo sapiens
tacatcttttctaatca

SEQ ID NO: 2330585 - DNA, 20 bp, Homo sapiens
tacatgacagatattttatc

SEQ ID NO: 2330586 - DNA, 17 bp, Homo sapiens
tacatgccacatcaaac

SEQ ID NO: 2330587 - DNA, 14 bp, Homo sapiens
tacatgctggggtc

SEQ ID NO: 2330588 - DNA, 18 bp, Homo sapiens
tacatgtgtagcctgtgc

SEQ ID NO: 2330589 - DNA, 14 bp, Homo sapiens
tacatttatgattt

SEQ ID NO: 2330590 - DNA, 22 bp, Homo sapiens
tacatttatgatttaataaaat

SEQ ID NO: 2330591 - DNA, 23 bp, Homo sapiens
tacatttatgatttaataaaata

SEQ ID NO: 2330592 - DNA, 23 bp, Homo sapiens
tacatttgtaagtgtaaaaaatg

SEQ ID NO: 2330593 - DNA, 23 bp, Homo sapiens
tacattttataatgatgaactta

SEQ ID NO: 2330594 - DNA, 13 bp, Homo sapiens
tacattttctaaa

SEQ ID NO: 2330595 - DNA, 14 bp, Homo sapiens
tacattttctaaat

SEQ ID NO: 2330596 - DNA, 16 bp, Homo sapiens
tacattttctaaataa

SEQ ID NO: 2330597 - DNA, 21 bp, Homo sapiens
tacattttctaaataaaaata

SEQ ID NO: 2330598 - DNA, 23 bp, Homo sapiens
taccaaaattttaaaaaagggag

SEQ ID NO: 2330599 - DNA, 17 bp, Homo sapiens
taccaaacactcagtcc

SEQ ID NO: 2330600 - DNA, 19 bp, Homo sapiens
taccaaattaaaaaaaaat

SEQ ID NO: 2330601 - DNA, 12 bp, Homo sapiens
taccaacctgtt

SEQ ID NO: 2330602 - DNA, 15 bp, Homo sapiens
taccaatgggaagca

SEQ ID NO: 2330603 - DNA, 17 bp, Homo sapiens
taccaatgggaagcagg

SEQ ID NO: 2330604 - DNA, 17 bp, Homo sapiens
taccacatcaaataaga

SEQ ID NO: 2330605 - DNA, 19 bp, Homo sapiens
taccactcttttgctgtgc

SEQ ID NO: 2330606 - DNA, 16 bp, Homo sapiens
taccagcaaagcaaat

SEQ ID NO: 2330607 - DNA, 13 bp, Homo sapiens
taccagctgcgct

SEQ ID NO: 2330608 - DNA, 16 bp, Homo sapiens
taccaggatgctaaag

SEQ ID NO: 2330609 - DNA, 17 bp, Homo sapiens
taccagtgaaaaaatgt

SEQ ID NO: 2330610 - DNA, 19 bp, Homo sapiens
taccatttagtaagaatac

SEQ ID NO: 2330611 - DNA, 16 bp, Homo sapiens
tacccatacaccccct

SEQ ID NO: 2330612 - DNA, 17 bp, Homo sapiens
tacccatagacatgaaa

SEQ ID NO: 2330613 - DNA, 19 bp, Homo sapiens
tacccatctttaatttata

SEQ ID NO: 2330614 - DNA, 15 bp, Homo sapiens
taccccttggaaatg

SEQ ID NO: 2330615 - DNA, 14 bp, Homo sapiens
taccctgacctggc

SEQ ID NO: 2330616 - DNA, 12 bp, Homo sapiens
taccctggcccc

SEQ ID NO: 2330617 - DNA, 14 bp, Homo sapiens
taccctggcccctc

SEQ ID NO: 2330618 - DNA, 21 bp, Homo sapiens
taccctggcccctctcccttg

SEQ ID NO: 2330619 - DNA, 13 bp, Homo sapiens
tacctaacatctg

SEQ ID NO: 2330620 - DNA, 21 bp, Homo sapiens
tacctactgtgtgccaggggc

SEQ ID NO: 2330621 - DNA, 14 bp, Homo sapiens
tacctcccacactc

SEQ ID NO: 2330622 - DNA, 17 bp, Homo sapiens
tacctcccacactccca

SEQ ID NO: 2330623 - DNA, 15 bp, Homo sapiens
tacctcccttgcctt

SEQ ID NO: 2330624 - DNA, 23 bp, Homo sapiens
tacctctcaagctagtgtttcta

SEQ ID NO: 2330625 - DNA, 12 bp, Homo sapiens
tacctcttttgc

SEQ ID NO: 2330626 - DNA, 20 bp, Homo sapiens
tacctgaaagcccttctcaa

SEQ ID NO: 2330627 - DNA, 12 bp, Homo sapiens
tacctgattttt

SEQ ID NO: 2330628 - DNA, 23 bp, Homo sapiens
tacctggagaagaatggctttca

SEQ ID NO: 2330629 - DNA, 20 bp, Homo sapiens
tacctgtatacagtgcagag

SEQ ID NO: 2330630 - DNA, 13 bp, Homo sapiens
taccttaattatt

SEQ ID NO: 2330631 - DNA, 12 bp, Homo sapiens
taccttactgtg

SEQ ID NO: 2330632 - DNA, 14 bp, Homo sapiens
taccttatcttaca

SEQ ID NO: 2330633 - DNA, 23 bp, Homo sapiens
taccttatcttacaatattgatt

SEQ ID NO: 2330634 - DNA, 18 bp, Homo sapiens
taccttccactctggaac

SEQ ID NO: 2330635 - DNA, 14 bp, Homo sapiens
taccttcctgtccc

SEQ ID NO: 2330636 - DNA, 20 bp, Homo sapiens
taccttctgatgaagttgta

SEQ ID NO: 2330637 - DNA, 12 bp, Homo sapiens
tacctttcttcc

SEQ ID NO: 2330638 - DNA, 21 bp, Homo sapiens
tacgagcacctccagcctgaa

SEQ ID NO: 2330639 - DNA, 22 bp, Homo sapiens
tacgagcacctccagcctgaac

SEQ ID NO: 2330640 - DNA, 13 bp, Homo sapiens
tacgcctcttctg

SEQ ID NO: 2330641 - DNA, 19 bp, Homo sapiens
tacgtgaagaaataaatga

SEQ ID NO: 2330642 - DNA, 14 bp, Homo sapiens
tacgtgtcaaaaaa

SEQ ID NO: 2330643 - DNA, 11 bp, Homo sapiens
tacgtttcttt

SEQ ID NO: 2330644 - DNA, 13 bp, Homo sapiens
tacgtttctttaa

SEQ ID NO: 2330645 - DNA, 19 bp, Homo sapiens
tactaaaaagtataaaata

SEQ ID NO: 2330646 - DNA, 13 bp, Homo sapiens
tactaaacatgta

SEQ ID NO: 2330647 - DNA, 14 bp, Homo sapiens
tactaaacatgtat

SEQ ID NO: 2330648 - DNA, 16 bp, Homo sapiens
tactaacagtaactgc

SEQ ID NO: 2330649 - DNA, 19 bp, Homo sapiens
tactaataatcttgtttct

SEQ ID NO: 2330650 - DNA, 12 bp, Homo sapiens
tactaatctgag

SEQ ID NO: 2330651 - DNA, 14 bp, Homo sapiens
tactaatctgagat

SEQ ID NO: 2330652 - DNA, 21 bp, Homo sapiens
tactagtcaccagagacttta

SEQ ID NO: 2330653 - DNA, 14 bp, Homo sapiens
tactattgcctcat

SEQ ID NO: 2330654 - DNA, 22 bp, Homo sapiens
tactcaacccattgttgtcaag

SEQ ID NO: 2330655 - DNA, 13 bp, Homo sapiens
tactcatgcgtga

SEQ ID NO: 2330656 - DNA, 13 bp, Homo sapiens
tactccctgcaga

SEQ ID NO: 2330657 - DNA, 18 bp, Homo sapiens
tactccctgcagatgcca

SEQ ID NO: 2330658 - DNA, 21 bp, Homo sapiens
tactccttaaaaatgtatgtt

SEQ ID NO: 2330659 - DNA, 14 bp, Homo sapiens
tactccttgcttcc

SEQ ID NO: 2330660 - DNA, 15 bp, Homo sapiens
tactctacaaaatat

SEQ ID NO: 2330661 - DNA, 16 bp, Homo sapiens
tactctcttgccagca

SEQ ID NO: 2330662 - DNA, 13 bp, Homo sapiens
tactctttcctat

SEQ ID NO: 2330663 - DNA, 14 bp, Homo sapiens
tactgaaggaaaaa

SEQ ID NO: 2330664 - DNA, 18 bp, Homo sapiens
tactgaaggaaaaacaca

SEQ ID NO: 2330665 - DNA, 23 bp, Homo sapiens
tactgaaggaaaaacacaagcaa

SEQ ID NO: 2330666 - DNA, 14 bp, Homo sapiens
tactgacatttctt

SEQ ID NO: 2330667 - DNA, 20 bp, Homo sapiens
tactgagaaaagcctctcca

SEQ ID NO: 2330668 - DNA, 15 bp, Homo sapiens
tactgagaatataca

SEQ ID NO: 2330669 - DNA, 14 bp, Homo sapiens
tactgagatgtctt

SEQ ID NO: 2330670 - DNA, 16 bp, Homo sapiens
tactgatatattttac

SEQ ID NO: 2330671 - DNA, 14 bp, Homo sapiens
tactgatttcagta

SEQ ID NO: 2330672 - DNA, 17 bp, Homo sapiens
tactgcactccagcctg

SEQ ID NO: 2330673 - DNA, 19 bp, Homo sapiens
tactgcactccagcctggg

SEQ ID NO: 2330674 - DNA, 15 bp, Homo sapiens
tactgcatacttttt

SEQ ID NO: 2330675 - DNA, 21 bp, Homo sapiens
tactgcatactttttaaatgt

SEQ ID NO: 2330676 - DNA, 18 bp, Homo sapiens
tactggcttacctcctca

SEQ ID NO: 2330677 - DNA, 19 bp, Homo sapiens
tactggggaaactggccat

SEQ ID NO: 2330678 - DNA, 21 bp, Homo sapiens
tactggggaaactggccatgg

SEQ ID NO: 2330679 - DNA, 18 bp, Homo sapiens
tactggtccaaaagattg

SEQ ID NO: 2330680 - DNA, 12 bp, Homo sapiens
tactggtctctc

SEQ ID NO: 2330681 - DNA, 15 bp, Homo sapiens
tactggttggctccc

SEQ ID NO: 2330682 - DNA, 17 bp, Homo sapiens
tactgtctattaatatt

SEQ ID NO: 2330683 - DNA, 18 bp, Homo sapiens
tactgtggaggaaggatt

SEQ ID NO: 2330684 - DNA, 23 bp, Homo sapiens
tactgtggaggaaggattgtaaa

SEQ ID NO: 2330685 - DNA, 13 bp, Homo sapiens
tactgtgtgccag

SEQ ID NO: 2330686 - DNA, 16 bp, Homo sapiens
tactgttatctatctg

SEQ ID NO: 2330687 - DNA, 23 bp, Homo sapiens
tacttaaatggtaataagcactg

SEQ ID NO: 2330688 - DNA, 17 bp, Homo sapiens
tacttaagaatacacag

SEQ ID NO: 2330689 - DNA, 20 bp, Homo sapiens
tacttagggaagaaaaagca

SEQ ID NO: 2330690 - DNA, 20 bp, Homo sapiens
tacttcccgggccagggctg

SEQ ID NO: 2330691 - DNA, 21 bp, Homo sapiens
tacttcccgggccagggctgc

SEQ ID NO: 2330692 - DNA, 16 bp, Homo sapiens
tacttctgatacttta

SEQ ID NO: 2330693 - DNA, 15 bp, Homo sapiens
tagcttctgcttttc

SEQ ID NO: 2330694 - DNA, 17 bp, Homo sapiens
tagcttgcagaactgta

SEQ ID NO: 2330695 - DNA, 17 bp, Homo sapiens
tagctttagaccctggg

SEQ ID NO: 2330696 - DNA, 16 bp, Homo sapiens
taggaaaggaagcaga

SEQ ID NO: 2330697 - DNA, 22 bp, Homo sapiens
taggaaatggctttgtgattca

SEQ ID NO: 2330698 - DNA, 17 bp, Homo sapiens
taggaagggatctgaga

SEQ ID NO: 2330699 - DNA, 16 bp, Homo sapiens
taggaatggaaaggat

SEQ ID NO: 2330700 - DNA, 13 bp, Homo sapiens
tatcataaagcat

SEQ ID NO: 2330701 - DNA, 12 bp, Homo sapiens
tatcatgaattt

SEQ ID NO: 2330702 - DNA, 24 bp, Homo sapiens
tatcatgaattttaaagtatgcat

SEQ ID NO: 2330703 - DNA, 17 bp, Homo sapiens
tatcatgcatgtcctgt

SEQ ID NO: 2330704 - DNA, 12 bp, Homo sapiens
tatcatgtatgg

SEQ ID NO: 2330705 - DNA, 12 bp, Homo sapiens
tatcatgtgatt

SEQ ID NO: 2330706 - DNA, 22 bp, Homo sapiens
tgcctgctttttggaaagtcag

SEQ ID NO: 2330707 - DNA, 22 bp, Homo sapiens
tgcctggagacaaggtgctaac

SEQ ID NO: 2330708 - DNA, 17 bp, Homo sapiens
tgcctggccagattttt

SEQ ID NO: 2330709 - DNA, 13 bp, Homo sapiens
tgcctggccccag

SEQ ID NO: 2330710 - DNA, 16 bp, Homo sapiens
tgcctggccccagcct

SEQ ID NO: 2330711 - DNA, 17 bp, Homo sapiens
tgcctggccccagcctg

SEQ ID NO: 2330712 - DNA, 19 bp, Homo sapiens
tgcctggccccagcctggg

SEQ ID NO: 2330713 - DNA, 21 bp, Homo sapiens
tgcctggccccagcctgggcc

SEQ ID NO: 2330714 - DNA, 16 bp, Homo sapiens
tgcctggcctggcaca

SEQ ID NO: 2330715 - DNA, 15 bp, Homo sapiens
tgcctggctaacttt

SEQ ID NO: 2330716 - DNA, 18 bp, Homo sapiens
tgcctgtcaagttgtaca

SEQ ID NO: 2330717 - DNA, 17 bp, Homo sapiens
tgccttaaacacacatt

SEQ ID NO: 2330718 - DNA, 15 bp, Homo sapiens
tgccttactcttctt

SEQ ID NO: 2330719 - DNA, 13 bp, Homo sapiens
tgccttccctagc

SEQ ID NO: 2330720 - DNA, 16 bp, Homo sapiens
tgccttccctagcttt

SEQ ID NO: 2330721 - DNA, 20 bp, Homo sapiens
tgccttgctgtttgtcctga

SEQ ID NO: 2330722 - DNA, 17 bp, Homo sapiens
tgccttggcctcccaaa

SEQ ID NO: 2330723 - DNA, 20 bp, Homo sapiens
tgccttgtttgagtttttcc

SEQ ID NO: 2330724 - DNA, 16 bp, Homo sapiens
tgcctttcgaggcctg

SEQ ID NO: 2330725 - DNA, 23 bp, Homo sapiens
tgcctttctcgtggtagaagcca

SEQ ID NO: 2330726 - DNA, 13 bp, Homo sapiens
tgccttttctgtg

SEQ ID NO: 2330727 - DNA, 14 bp, Homo sapiens
tgccttttctgtga

SEQ ID NO: 2330728 - DNA, 16 bp, Homo sapiens
tgcgagtccaaggcca

SEQ ID NO: 2330729 - DNA, 15 bp, Homo sapiens
tgcgccagtcctgct

SEQ ID NO: 2330730 - DNA, 12 bp, Homo sapiens
tgcgcctcagcc

SEQ ID NO: 2330731 - DNA, 15 bp, Homo sapiens
tgcgcctcagccctc

SEQ ID NO: 2330732 - DNA, 16 bp, Homo sapiens
tgcgcctcagccctca

SEQ ID NO: 2330733 - DNA, 17 bp, Homo sapiens
tgcgcctcagccctcag

SEQ ID NO: 2330734 - DNA, 22 bp, Homo sapiens
tgcggaccaccctcactggctc

SEQ ID NO: 2330735 - DNA, 17 bp, Homo sapiens
tgcggatctcagctttg

SEQ ID NO: 2330736 - DNA, 14 bp, Homo sapiens
tgcgggccagggtc

SEQ ID NO: 2330737 - DNA, 17 bp, Homo sapiens
tgcgggccagggtcctg

SEQ ID NO: 2330738 - DNA, 15 bp, Homo sapiens
tgcggggtgggggca

SEQ ID NO: 2330739 - DNA, 22 bp, Homo sapiens
tgcgtcctcctcacctcatgcc

SEQ ID NO: 2330740 - DNA, 22 bp, Homo sapiens
tgcgtggactctgcacatgtct

SEQ ID NO: 2330741 - DNA, 12 bp, Homo sapiens
tgcgtgtgtaga

SEQ ID NO: 2330742 - DNA, 24 bp, Homo sapiens
tgcgtgtgtagagttaagaagctg

SEQ ID NO: 2330743 - DNA, 18 bp, Homo sapiens
tgcgtgttcagcagaacc

SEQ ID NO: 2330744 - DNA, 13 bp, Homo sapiens
tgctaacaaagac

SEQ ID NO: 2330745 - DNA, 23 bp, Homo sapiens
tgctaacaaagacaaaagtctgt

SEQ ID NO: 2330746 - DNA, 20 bp, Homo sapiens
tgctactgcactccagcctg

SEQ ID NO: 2330747 - DNA, 18 bp, Homo sapiens
tgctactggggaaactgg

SEQ ID NO: 2330748 - DNA, 21 bp, Homo sapiens
tgctactgttgtaagaattct

SEQ ID NO: 2330749 - DNA, 22 bp, Homo sapiens
tgctatccccatctccctgcct

SEQ ID NO: 2330750 - DNA, 21 bp, Homo sapiens
tgctatcgccctcctttccct

SEQ ID NO: 2330751 - DNA, 22 bp, Homo sapiens
tgctatcgccctcctttccctt

SEQ ID NO: 2330752 - DNA, 20 bp, Homo sapiens
tgctatggcaggataagaaa

SEQ ID NO: 2330753 - DNA, 15 bp, Homo sapiens
tgctatttaacattt

SEQ ID NO: 2330754 - DNA, 16 bp, Homo sapiens
tgctatttaacatttt

SEQ ID NO: 2330755 - DNA, 18 bp, Homo sapiens
tgctatttattttcctaa

SEQ ID NO: 2330756 - DNA, 14 bp, Homo sapiens
tgctatttgtgtaa

SEQ ID NO: 2330757 - DNA, 19 bp, Homo sapiens
tgctatttgtgtaactgaa

SEQ ID NO: 2330758 - DNA, 20 bp, Homo sapiens
tgctatttgtgtaactgaaa

SEQ ID NO: 2330759 - DNA, 12 bp, Homo sapiens
tgctatttttgt

SEQ ID NO: 2330760 - DNA, 13 bp, Homo sapiens
tgctatttttgta

SEQ ID NO: 2330761 - DNA, 15 bp, Homo sapiens
tgctatttttgtaaa

SEQ ID NO: 2330762 - DNA, 17 bp, Homo sapiens
tgctatttttgtaaagt

SEQ ID NO: 2330763 - DNA, 17 bp, Homo sapiens
tgctcaccagccctgca

SEQ ID NO: 2330764 - DNA, 15 bp, Homo sapiens
tgctcacgactcttc

SEQ ID NO: 2330765 - DNA, 18 bp, Homo sapiens
tgctcacgactcttcctg

SEQ ID NO: 2330766 - DNA, 20 bp, Homo sapiens
tgctcacgactcttcctgca

SEQ ID NO: 2330767 - DNA, 21 bp, Homo sapiens
tgctcacgactcttcctgcaa

SEQ ID NO: 2330768 - DNA, 23 bp, Homo sapiens
tgctcacgactcttcctgcaaag

SEQ ID NO: 2330769 - DNA, 22 bp, Homo sapiens
tgctcagaacttgctgctgtct

SEQ ID NO: 2330770 - DNA, 21 bp, Homo sapiens
tgctcagcaattcagacccct

SEQ ID NO: 2330771 - DNA, 17 bp, Homo sapiens
tgctcagggtcactgaa

SEQ ID NO: 2330772 - DNA, 19 bp, Homo sapiens
tgctcagtgtccagcttcc

SEQ ID NO: 2330773 - DNA, 22 bp, Homo sapiens
tgctcagtgtccagcttccaaa

SEQ ID NO: 2330774 - DNA, 23 bp, Homo sapiens
tgctcagtgtccagcttccaaag

SEQ ID NO: 2330775 - DNA, 17 bp, Homo sapiens
tgctcatccactctact

SEQ ID NO: 2330776 - DNA, 22 bp, Homo sapiens
tgctcattcctcacgcccttca

SEQ ID NO: 2330777 - DNA, 22 bp, Homo sapiens
tgctccagataactctctttcc

SEQ ID NO: 2330778 - DNA, 15 bp, Homo sapiens
tgctccagattctga

SEQ ID NO: 2330779 - DNA, 12 bp, Homo sapiens
tgctcccacctc

SEQ ID NO: 2330780 - DNA, 21 bp, Homo sapiens
tgctccccacagcgtccctgg

SEQ ID NO: 2330781 - DNA, 22 bp, Homo sapiens
tgctccccacagcgtccctggc

SEQ ID NO: 2330782 - DNA, 14 bp, Homo sapiens
tgctccgcctggcc

SEQ ID NO: 2330783 - DNA, 19 bp, Homo sapiens
tgctcctccttggtgcctg

SEQ ID NO: 2330784 - DNA, 12 bp, Homo sapiens
tgctccttgctg

SEQ ID NO: 2330785 - DNA, 14 bp, Homo sapiens
tgctctattaagat

SEQ ID NO: 2330786 - DNA, 10 bp, Homo sapiens
tgctctcctc

SEQ ID NO: 2330787 - DNA, 14 bp, Homo sapiens
tgctctcctcttct

SEQ ID NO: 2330788 - DNA, 14 bp, Homo sapiens
tgctctgccatctt

SEQ ID NO: 2330789 - DNA, 13 bp, Homo sapiens
tgctctgcctcag

SEQ ID NO: 2330790 - DNA, 18 bp, Homo sapiens
tgctctgtcccccaggct

SEQ ID NO: 2330791 - DNA, 20 bp, Homo sapiens
tgctctgtcccccaggctgg

SEQ ID NO: 2330792 - DNA, 22 bp, Homo sapiens
tgctctgtcccccaggctggag

SEQ ID NO: 2330793 - DNA, 17 bp, Homo sapiens
tgctcttagtcccaagc

SEQ ID NO: 2330794 - DNA, 18 bp, Homo sapiens
tgctgaacacagtgtctg

SEQ ID NO: 2330795 - DNA, 20 bp, Homo sapiens
tgctgaacacagtgtctgtt

SEQ ID NO: 2330796 - DNA, 16 bp, Homo sapiens
tgctgacaacttagct

SEQ ID NO: 2330797 - DNA, 13 bp, Homo sapiens
tgctgacctgctg

SEQ ID NO: 2330798 - DNA, 14 bp, Homo sapiens
tgctgacctgctga

SEQ ID NO: 2330799 - DNA, 18 bp, Homo sapiens
tgctgactggcttcagca

SEQ ID NO: 2330800 - DNA, 22 bp, Homo sapiens
tgctgactgtagctttggaagt

SEQ ID NO: 2330801 - DNA, 16 bp, Homo sapiens
tgctgaggcccagtgc

SEQ ID NO: 2330802 - DNA, 19 bp, Homo sapiens
tgctgagtaaggaacacga

SEQ ID NO: 2330803 - DNA, 19 bp, Homo sapiens
tgctgagtcatctgttagg

SEQ ID NO: 2330804 - DNA, 21 bp, Homo sapiens
tgctgagtcatctgttagggc

SEQ ID NO: 2330805 - DNA, 22 bp, Homo sapiens
tgctgcagagaaacttaagcaa

SEQ ID NO: 2330806 - DNA, 18 bp, Homo sapiens
tgctgcattgatccagga

SEQ ID NO: 2330807 - DNA, 23 bp, Homo sapiens
tgctgccatgacagaggctgcac

SEQ ID NO: 2330808 - DNA, 19 bp, Homo sapiens
tgctgccattacagaggta

SEQ ID NO: 2330809 - DNA, 16 bp, Homo sapiens
tgctgcctgctgagat

SEQ ID NO: 2330810 - DNA, 20 bp, Homo sapiens
tgctgcgcctgcaggcagag

SEQ ID NO: 2330811 - DNA, 17 bp, Homo sapiens
tgctgctctagggcagg

SEQ ID NO: 2330812 - DNA, 13 bp, Homo sapiens
tgctgctggccaa

SEQ ID NO: 2330813 - DNA, 14 bp, Homo sapiens
tgctgctggccaaa

SEQ ID NO: 2330814 - DNA, 21 bp, Homo sapiens
tgctgctgtccagtgcctaca

SEQ ID NO: 2330815 - DNA, 18 bp, Homo sapiens
tgctggaaaccacacttc

SEQ ID NO: 2330816 - DNA, 19 bp, Homo sapiens
tgctggaagggaggaaggc

SEQ ID NO: 2330817 - DNA, 23 bp, Homo sapiens
tgctggacatgagatggagaggc

SEQ ID NO: 2330818 - DNA, 21 bp, Homo sapiens
tgctggaggcctcaggtgctg

SEQ ID NO: 2330819 - DNA, 18 bp, Homo sapiens
tgctggccaaatagcaaa

SEQ ID NO: 2330820 - DNA, 21 bp, Homo sapiens
tgctggccatgaatctctgcc

SEQ ID NO: 2330821 - DNA, 13 bp, Homo sapiens
tgctggccccagc

SEQ ID NO: 2330822 - DNA, 19 bp, Homo sapiens
tgctggccccagccctgct

SEQ ID NO: 2330823 - DNA, 21 bp, Homo sapiens
tgctggccccagccctgctgg

SEQ ID NO: 2330824 - DNA, 20 bp, Homo sapiens
tgctggcggcgcagagggaa

SEQ ID NO: 2330825 - DNA, 23 bp, Homo sapiens
tgctggggaagggttttcttttc

SEQ ID NO: 2330826 - DNA, 16 bp, Homo sapiens
tgctgtataagttatt

SEQ ID NO: 2330827 - DNA, 21 bp, Homo sapiens
tgctgtccaggcagctccctc

SEQ ID NO: 2330828 - DNA, 23 bp, Homo sapiens
tgctgtccaggcagctccctcct

SEQ ID NO: 2330829 - DNA, 18 bp, Homo sapiens
tgctgtgaaccctggggc

SEQ ID NO: 2330830 - DNA, 13 bp, Homo sapiens
tgctgttctcagg

SEQ ID NO: 2330831 - DNA, 14 bp, Homo sapiens
tgctgttctcagga

SEQ ID NO: 2330832 - DNA, 18 bp, Homo sapiens
tgcttaaaaatcattgat

SEQ ID NO: 2330833 - DNA, 16 bp, Homo sapiens
tgcttaaaagcatttt

SEQ ID NO: 2330834 - DNA, 22 bp, Homo sapiens
tgcttaaaagcatttttattat

SEQ ID NO: 2330835 - DNA, 23 bp, Homo sapiens
tgcttaaaagcatttttattata

SEQ ID NO: 2330836 - DNA, 17 bp, Homo sapiens
tgcttaaataaaaatta

SEQ ID NO: 2330837 - DNA, 13 bp, Homo sapiens
tgcttaaatttta

SEQ ID NO: 2330838 - DNA, 16 bp, Homo sapiens
tgcttaaattttaact

SEQ ID NO: 2330839 - DNA, 15 bp, Homo sapiens
tgcttaatcttcaaa

SEQ ID NO: 2330840 - DNA, 20 bp, Homo sapiens
tgcttaatcttcaaagcctt

SEQ ID NO: 2330841 - DNA, 14 bp, Homo sapiens
tgcttacctctcag

SEQ ID NO: 2330842 - DNA, 17 bp, Homo sapiens
tgcttattatgtaggta

SEQ ID NO: 2330843 - DNA, 16 bp, Homo sapiens
tgcttcacagtagagc

SEQ ID NO: 2330844 - DNA, 23 bp, Homo sapiens
tgcttcattattcaagaatgaaa

SEQ ID NO: 2330845 - DNA, 19 bp, Homo sapiens
tgcttccaggaaactccac

SEQ ID NO: 2330846 - DNA, 15 bp, Homo sapiens
tgcttcctgatgctg

SEQ ID NO: 2330847 - DNA, 16 bp, Homo sapiens
tgcttcctgatgctgg

SEQ ID NO: 2330848 - DNA, 20 bp, Homo sapiens
tgcttcctgatgctgggcaa

SEQ ID NO: 2330849 - DNA, 14 bp, Homo sapiens
tgcttcctgctgta

SEQ ID NO: 2330850 - DNA, 16 bp, Homo sapiens
tgcttcctgctgtatg

SEQ ID NO: 2330851 - DNA, 22 bp, Homo sapiens
tgcttcctgtcttatcctccac

SEQ ID NO: 2330852 - DNA, 14 bp, Homo sapiens
tgcttcctttctct

SEQ ID NO: 2330853 - DNA, 22 bp, Homo sapiens
tgcttctcagatttctgaggaa

SEQ ID NO: 2330854 - DNA, 14 bp, Homo sapiens
tgcttctctccttg

SEQ ID NO: 2330855 - DNA, 21 bp, Homo sapiens
tgcttgagccaggaggcctgc

SEQ ID NO: 2330856 - DNA, 17 bp, Homo sapiens
tgcttgcataagagctt

SEQ ID NO: 2330857 - DNA, 18 bp, Homo sapiens
tgcttgcggcaaaaggaa

SEQ ID NO: 2330858 - DNA, 19 bp, Homo sapiens
tgcttgcggcaaaaggaaa

SEQ ID NO: 2330859 - DNA, 13 bp, Homo sapiens
tgcttggtctgtt

SEQ ID NO: 2330860 - DNA, 16 bp, Homo sapiens
tgcttggtctgtttga

SEQ ID NO: 2330861 - DNA, 18 bp, Homo sapiens
tgctttaccttttcaggg

SEQ ID NO: 2330862 - DNA, 23 bp, Homo sapiens
tgctttcagaagtgcccttcctg

SEQ ID NO: 2330863 - DNA, 14 bp, Homo sapiens
tgctttgcattact

SEQ ID NO: 2330864 - DNA, 12 bp, Homo sapiens
tgctttgtattg

SEQ ID NO: 2330865 - DNA, 14 bp, Homo sapiens
tgcttttctaatta

SEQ ID NO: 2330866 - DNA, 15 bp, Homo sapiens
tgcttttctgccctg

SEQ ID NO: 2330867 - DNA, 22 bp, Homo sapiens
tgctttttcttgtttgtttaaa

SEQ ID NO: 2330868 - DNA, 20 bp, Homo sapiens
tggaaaactgtgttgccaca

SEQ ID NO: 2330869 - DNA, 15 bp, Homo sapiens
tggaaaaggaagact

SEQ ID NO: 2330870 - DNA, 22 bp, Homo sapiens
tggaaaaggaagactagaggct

SEQ ID NO: 2330871 - DNA, 21 bp, Homo sapiens
tggaaaataatttagtggatg

SEQ ID NO: 2330872 - DNA, 15 bp, Homo sapiens
tggaaacaccactgc

SEQ ID NO: 2330873 - DNA, 17 bp, Homo sapiens
tggaaagaggctctgga

SEQ ID NO: 2330874 - DNA, 17 bp, Homo sapiens
tggaaaggggagagcct

SEQ ID NO: 2330875 - DNA, 21 bp, Homo sapiens
tggaaaggggagagcctgctg

SEQ ID NO: 2330876 - DNA, 15 bp, Homo sapiens
tggaaagtaactgtg

SEQ ID NO: 2330877 - DNA, 12 bp, Homo sapiens
tggaaagtcaga

SEQ ID NO: 2330878 - DNA, 14 bp, Homo sapiens
tggaaataaaagat

SEQ ID NO: 2330879 - DNA, 16 bp, Homo sapiens
tggaaataaaagataa

SEQ ID NO: 2330880 - DNA, 15 bp, Homo sapiens
tggaaataatttgaa

SEQ ID NO: 2330881 - DNA, 14 bp, Homo sapiens
tggaaatagaaaga

SEQ ID NO: 2330882 - DNA, 19 bp, Homo sapiens
tggaaatagaaagaagcca

SEQ ID NO: 2330883 - DNA, 21 bp, Homo sapiens
tggaaatagaaagaagccata

SEQ ID NO: 2330884 - DNA, 17 bp, Homo sapiens
tggaaatgtctgctggt

SEQ ID NO: 2330885 - DNA, 14 bp, Homo sapiens
tggaacatactgtt

SEQ ID NO: 2330886 - DNA, 19 bp, Homo sapiens
tggaacatggactttcttg

SEQ ID NO: 2330887 - DNA, 23 bp, Homo sapiens
tggaaccagccccatcagaacct

SEQ ID NO: 2330888 - DNA, 17 bp, Homo sapiens
tggaagagaggcacctg

SEQ ID NO: 2330889 - DNA, 18 bp, Homo sapiens
tggaagagaggcacctgc

SEQ ID NO: 2330890 - DNA, 19 bp, Homo sapiens
tggaagagaggcacctgct

SEQ ID NO: 2330891 - DNA, 16 bp, Homo sapiens
tggaagccagctttcc

SEQ ID NO: 2330892 - DNA, 18 bp, Homo sapiens
tggaagccagctttccct

SEQ ID NO: 2330893 - DNA, 23 bp, Homo sapiens
tggaagggaggaaggcctttctt

SEQ ID NO: 2330894 - DNA, 19 bp, Homo sapiens
tggaagtgcagtcagcaga

SEQ ID NO: 2330895 - DNA, 18 bp, Homo sapiens
tggaagtttagctctgag

SEQ ID NO: 2330896 - DNA, 20 bp, Homo sapiens
tggaagtttagctctgagaa

SEQ ID NO: 2330897 - DNA, 15 bp, Homo sapiens
tggaataagttcaaa

SEQ ID NO: 2330898 - DNA, 17 bp, Homo sapiens
tggaataatttctatta

SEQ ID NO: 2330899 - DNA, 13 bp, Homo sapiens
tggaatacagtca

SEQ ID NO: 2330900 - DNA, 18 bp, Homo sapiens
tggaatctacaagccaaa

SEQ ID NO: 2330901 - DNA, 17 bp, Homo sapiens
tggaatgcccttcactg

SEQ ID NO: 2330902 - DNA, 17 bp, Homo sapiens
tggaatgtttttccctc

SEQ ID NO: 2330903 - DNA, 22 bp, Homo sapiens
tggaatgtttttccctccccag

SEQ ID NO: 2330904 - DNA, 14 bp, Homo sapiens
tggaattgtggcta

SEQ ID NO: 2330905 - DNA, 21 bp, Homo sapiens
tggacacattggaatgccttg

SEQ ID NO: 2330906 - DNA, 21 bp, Homo sapiens
tggacacgagccacaagctgc

SEQ ID NO: 2330907 - DNA, 16 bp, Homo sapiens
tggacactccagggac

SEQ ID NO: 2330908 - DNA, 19 bp, Homo sapiens
tggacactccagggacaca

SEQ ID NO: 2330909 - DNA, 24 bp, Homo sapiens
tggacactccagggacacacagcc

SEQ ID NO: 2330910 - DNA, 13 bp, Homo sapiens
tggacagccagtg

SEQ ID NO: 2330911 - DNA, 16 bp, Homo sapiens
tggacaggcagcctcc

SEQ ID NO: 2330912 - DNA, 22 bp, Homo sapiens
tggacatgagatggagaggctg

SEQ ID NO: 2330913 - DNA, 21 bp, Homo sapiens
tggaccaatagggctgagctc

SEQ ID NO: 2330914 - DNA, 18 bp, Homo sapiens
tggaccactcctgtccct

SEQ ID NO: 2330915 - DNA, 16 bp, Homo sapiens
tggacccagggaacag

SEQ ID NO: 2330916 - DNA, 14 bp, Homo sapiens
tggacctaatccaa

SEQ ID NO: 2330917 - DNA, 23 bp, Homo sapiens
tggacctgggaacgactggactg

SEQ ID NO: 2330918 - DNA, 15 bp, Homo sapiens
tggacggcaggctca

SEQ ID NO: 2330919 - DNA, 21 bp, Homo sapiens
tggacggcaggctcactgcca

SEQ ID NO: 2330920 - DNA, 15 bp, Homo sapiens
tggactctgcacatg

SEQ ID NO: 2330921 - DNA, 17 bp, Homo sapiens
tggactctgcacatgaa

SEQ ID NO: 2330922 - DNA, 22 bp, Homo sapiens
tggactctgcacatgtcttgta

SEQ ID NO: 2330923 - DNA, 18 bp, Homo sapiens
tggagaaaattggaactc

SEQ ID NO: 2330924 - DNA, 14 bp, Homo sapiens
tggagaagctgcag

SEQ ID NO: 2330925 - DNA, 16 bp, Homo sapiens
tggagacaaggtgcta

SEQ ID NO: 2330926 - DNA, 16 bp, Homo sapiens
tggagaccctgccaca

SEQ ID NO: 2330927 - DNA, 20 bp, Homo sapiens
tggagaccctgccacagcca

SEQ ID NO: 2330928 - DNA, 22 bp, Homo sapiens
tggagacgtttataaacagaaa

SEQ ID NO: 2330929 - DNA, 14 bp, Homo sapiens
tggagagcagctgg

SEQ ID NO: 2330930 - DNA, 16 bp, Homo sapiens
tggagattgacctgga

SEQ ID NO: 2330931 - DNA, 15 bp, Homo sapiens
tggagcacaaaattc

SEQ ID NO: 2330932 - DNA, 16 bp, Homo sapiens
tggagcacaaaattca

SEQ ID NO: 2330933 - DNA, 14 bp, Homo sapiens
tggagcatcccagg

SEQ ID NO: 2330934 - DNA, 15 bp, Homo sapiens
tggagcatcccaggc

SEQ ID NO: 2330935 - DNA, 14 bp, Homo sapiens
tggagcccagggca

SEQ ID NO: 2330936 - DNA, 22 bp, Homo sapiens
tggagcccagggcatcttgctg

SEQ ID NO: 2330937 - DNA, 21 bp, Homo sapiens
tggagcccccagcagaggcag

SEQ ID NO: 2330938 - DNA, 14 bp, Homo sapiens
tgaatggattggat

SEQ ID NO: 2330939 - DNA, 18 bp, Homo sapiens
tgaattagtgagtatagt

SEQ ID NO: 2330940 - DNA, 15 bp, Homo sapiens
tgaattatcagcaaa

SEQ ID NO: 2330941 - DNA, 21 bp, Homo sapiens
tgaattatcttggttgaaaat

SEQ ID NO: 2330942 - DNA, 18 bp, Homo sapiens
tgaattattatatacata

SEQ ID NO: 2330943 - DNA, 11 bp, Homo sapiens
tgaatttggag

SEQ ID NO: 2330944 - DNA, 18 bp, Homo sapiens
tgaatttggggctactta

SEQ ID NO: 2330945 - DNA, 20 bp, Homo sapiens
tgaatttggggctacttata

SEQ ID NO: 2330946 - DNA, 22 bp, Homo sapiens
tgaattttctaaaagctttcat

SEQ ID NO: 2330947 - DNA, 13 bp, Homo sapiens
tgaatttttaagc

SEQ ID NO: 2330948 - DNA, 22 bp, Homo sapiens
tgaatttttttgtaataagcaa

SEQ ID NO: 2330949 - DNA, 20 bp, Homo sapiens
tgacaaataaattaggacca

SEQ ID NO: 2330950 - DNA, 14 bp, Homo sapiens
tgacaaataagatt

SEQ ID NO: 2330951 - DNA, 16 bp, Homo sapiens
tgacaacttagctcag

SEQ ID NO: 2330952 - DNA, 20 bp, Homo sapiens
tgacaagaataattttggaa

SEQ ID NO: 2330953 - DNA, 21 bp, Homo sapiens
tgacaagagttggggacagaa

SEQ ID NO: 2330954 - DNA, 14 bp, Homo sapiens
tgacacaaagcttc

SEQ ID NO: 2330955 - DNA, 21 bp, Homo sapiens
tgacacatatgcaccttgtgt

SEQ ID NO: 2330956 - DNA, 22 bp, Homo sapiens
tgacacatatgcaccttgtgtc

SEQ ID NO: 2330957 - DNA, 16 bp, Homo sapiens
tgacacatggcccctc

SEQ ID NO: 2330958 - DNA, 17 bp, Homo sapiens
tgacacattaatgataa

SEQ ID NO: 2330959 - DNA, 16 bp, Homo sapiens
tgacacccttctccca

SEQ ID NO: 2330960 - DNA, 21 bp, Homo sapiens
tgacacccttctcccactctc

SEQ ID NO: 2330961 - DNA, 22 bp, Homo sapiens
tgacactagcccaatgaaatga

SEQ ID NO: 2330962 - DNA, 23 bp, Homo sapiens
tgacactagcccaatgaaatgaa

SEQ ID NO: 2330963 - DNA, 18 bp, Homo sapiens
tgacactgaaagttttgt

SEQ ID NO: 2330964 - DNA, 22 bp, Homo sapiens
tgacactgaaagttttgtaaaa

SEQ ID NO: 2330965 - DNA, 20 bp, Homo sapiens
tgacagaaggtgccacttta

SEQ ID NO: 2330966 - DNA, 17 bp, Homo sapiens
tgacagccttttttcct

SEQ ID NO: 2330967 - DNA, 23 bp, Homo sapiens
tgacagctttctgggatgtcaca

SEQ ID NO: 2330968 - DNA, 12 bp, Homo sapiens
tgacaggctgtt

SEQ ID NO: 2330969 - DNA, 17 bp, Homo sapiens
tgacagtgcctcttcca

SEQ ID NO: 2330970 - DNA, 17 bp, Homo sapiens
tgacagtttccaaattg

SEQ ID NO: 2330971 - DNA, 15 bp, Homo sapiens
tgacataataaagta

SEQ ID NO: 2330972 - DNA, 22 bp, Homo sapiens
tgacataataaagtattttctt

SEQ ID NO: 2330973 - DNA, 15 bp, Homo sapiens
tgacatatctacact

SEQ ID NO: 2330974 - DNA, 17 bp, Homo sapiens
tgacatcctttctttta

SEQ ID NO: 2330975 - DNA, 18 bp, Homo sapiens
tgacatggtgcctgagag

SEQ ID NO: 2330976 - DNA, 12 bp, Homo sapiens
tgacatgtgaaa

SEQ ID NO: 2330977 - DNA, 13 bp, Homo sapiens
tgacatgtgaaac

SEQ ID NO: 2330978 - DNA, 20 bp, Homo sapiens
tgacattaaatgcaataatt

SEQ ID NO: 2330979 - DNA, 19 bp, Homo sapiens
tgacattaacaaataaaaa

SEQ ID NO: 2330980 - DNA, 13 bp, Homo sapiens
tgacatttcttct

SEQ ID NO: 2330981 - DNA, 15 bp, Homo sapiens
tgacatttggagagg

SEQ ID NO: 2330982 - DNA, 21 bp, Homo sapiens
tgaccaagactgagccagctt

SEQ ID NO: 2330983 - DNA, 17 bp, Homo sapiens
tgaccagaagccttgga

SEQ ID NO: 2330984 - DNA, 22 bp, Homo sapiens
tgaccattttttaatttacttg

SEQ ID NO: 2330985 - DNA, 15 bp, Homo sapiens
tgacccctctcctca

SEQ ID NO: 2330986 - DNA, 21 bp, Homo sapiens
tgaccctatgggtctaggaca

SEQ ID NO: 2330987 - DNA, 14 bp, Homo sapiens
tgaccctccaaatg

SEQ ID NO: 2330988 - DNA, 20 bp, Homo sapiens
tgaccctgaaatattttcta

SEQ ID NO: 2330989 - DNA, 12 bp, Homo sapiens
tgaccctgggca

SEQ ID NO: 2330990 - DNA, 13 bp, Homo sapiens
tgaccctgggcaa

SEQ ID NO: 2330991 - DNA, 19 bp, Homo sapiens
tgacctacctcaaagggca

SEQ ID NO: 2330992 - DNA, 13 bp, Homo sapiens
tgacctgctgacc

SEQ ID NO: 2330993 - DNA, 18 bp, Homo sapiens
tgacctgctgacctgtgc

SEQ ID NO: 2330994 - DNA, 15 bp, Homo sapiens
tgacctggccccctc

SEQ ID NO: 2330995 - DNA, 14 bp, Homo sapiens
tgacgatgatgtac

SEQ ID NO: 2330996 - DNA, 20 bp, Homo sapiens
tgacgcttgtgacagtgcct

SEQ ID NO: 2330997 - DNA, 21 bp, Homo sapiens
tgacgcttgtgacagtgcctc

SEQ ID NO: 2330998 - DNA, 17 bp, Homo sapiens
tgacggtaagtgttctc

SEQ ID NO: 2330999 - DNA, 12 bp, Homo sapiens
tgacgtttacat

SEQ ID NO: 2331000 - DNA, 19 bp, Homo sapiens
tgacgtttcttctttctag

SEQ ID NO: 2331001 - DNA, 17 bp, Homo sapiens
tgactaaagagagaatg

SEQ ID NO: 2331002 - DNA, 15 bp, Homo sapiens
tgactaaattcgtga

SEQ ID NO: 2331003 - DNA, 22 bp, Homo sapiens
tgactaactcaaatacacattt

SEQ ID NO: 2331004 - DNA, 18 bp, Homo sapiens
tgactatataatttattt

SEQ ID NO: 2331005 - DNA, 23 bp, Homo sapiens
tgactatataatttatttccact

SEQ ID NO: 2331006 - DNA, 20 bp, Homo sapiens
tgactattctgtatctttca

SEQ ID NO: 2331007 - DNA, 19 bp, Homo sapiens
tgactcctctggctttccc

SEQ ID NO: 2331008 - DNA, 15 bp, Homo sapiens
tgactctataagcaa

SEQ ID NO: 2331009 - DNA, 22 bp, Homo sapiens
tgactgccttgcctcctcagta

SEQ ID NO: 2331010 - DNA, 20 bp, Homo sapiens
tgactgctcagaacttgctg

SEQ ID NO: 2331011 - DNA, 20 bp, Homo sapiens
tgactgtagccacagctgct

SEQ ID NO: 2331012 - DNA, 17 bp, Homo sapiens
tgacttaactttaactt

SEQ ID NO: 2331013 - DNA, 21 bp, Homo sapiens
tgacttaactttaacttttga

SEQ ID NO: 2331014 - DNA, 13 bp, Homo sapiens
tgacttagaaact

SEQ ID NO: 2331015 - DNA, 14 bp, Homo sapiens
tgacttcctggtga

SEQ ID NO: 2331016 - DNA, 17 bp, Homo sapiens
tgacttccttatttctg

SEQ ID NO: 2331017 - DNA, 18 bp, Homo sapiens
tgacttccttatttctga

SEQ ID NO: 2331018 - DNA, 18 bp, Homo sapiens
tgacttctcaagtaacat

SEQ ID NO: 2331019 - DNA, 21 bp, Homo sapiens
tgacttgctgtccaggcagct

SEQ ID NO: 2331020 - DNA, 21 bp, Homo sapiens
tgacttggctggggaggacca

SEQ ID NO: 2331021 - DNA, 18 bp, Homo sapiens
tgacttggggagatggag

SEQ ID NO: 2331022 - DNA, 14 bp, Homo sapiens
tgactttgcccagg

SEQ ID NO: 2331023 - DNA, 16 bp, Homo sapiens
tgacttttataaagca

SEQ ID NO: 2331024 - DNA, 17 bp, Homo sapiens
tgactttttgcatttaa

SEQ ID NO: 2331025 - DNA, 14 bp, Homo sapiens
tgactttttttgta

SEQ ID NO: 2331026 - DNA, 18 bp, Homo sapiens
tgactttttttgtatgtg

SEQ ID NO: 2331027 - DNA, 20 bp, Homo sapiens
tgagaaacatctcaataaag

SEQ ID NO: 2331028 - DNA, 20 bp, Homo sapiens
tgagaaatcacaatgagaaa

SEQ ID NO: 2331029 - DNA, 20 bp, Homo sapiens
tgagaaccttggaccactcc

SEQ ID NO: 2331030 - DNA, 19 bp, Homo sapiens
tgagaagaagtggctgcca

SEQ ID NO: 2331031 - DNA, 13 bp, Homo sapiens
tgagaagccaagc

SEQ ID NO: 2331032 - DNA, 17 bp, Homo sapiens
tgagaagccaagcgctc

SEQ ID NO: 2331033 - DNA, 15 bp, Homo sapiens
tgagaagccttcagc

SEQ ID NO: 2331034 - DNA, 20 bp, Homo sapiens
tgagaagccttcagctccag

SEQ ID NO: 2331035 - DNA, 15 bp, Homo sapiens
tgagaaggttactga

SEQ ID NO: 2331036 - DNA, 17 bp, Homo sapiens
tgagaatgacagccttt

SEQ ID NO: 2331037 - DNA, 19 bp, Homo sapiens
tgagacaatgttttcttca

SEQ ID NO: 2331038 - DNA, 15 bp, Homo sapiens
tgagacagtgaattt

SEQ ID NO: 2331039 - DNA, 13 bp, Homo sapiens
tgagaccacagag

SEQ ID NO: 2331040 - DNA, 13 bp, Homo sapiens
tgagaccctactg

SEQ ID NO: 2331041 - DNA, 19 bp, Homo sapiens
tgagacctgggatttgaga

SEQ ID NO: 2331042 - DNA, 20 bp, Homo sapiens
tgagagacgccactccctgg

SEQ ID NO: 2331043 - DNA, 22 bp, Homo sapiens
tgagagacgccactccctggga

SEQ ID NO: 2331044 - DNA, 13 bp, Homo sapiens
tgagagcataatt

SEQ ID NO: 2331045 - DNA, 19 bp, Homo sapiens
tgagagcccagaggtaaca

SEQ ID NO: 2331046 - DNA, 20 bp, Homo sapiens
tgagagccctgaggcctaga

SEQ ID NO: 2331047 - DNA, 16 bp, Homo sapiens
tgagagtcagctctct

SEQ ID NO: 2331048 - DNA, 21 bp, Homo sapiens
tgagagtcagctctctgccct

SEQ ID NO: 2331049 - DNA, 18 bp, Homo sapiens
tgagatggagaggctgag

SEQ ID NO: 2331050 - DNA, 22 bp, Homo sapiens
tgagatggttcccaatatcatg

SEQ ID NO: 2331051 - DNA, 12 bp, Homo sapiens
tgagatgtgagc

SEQ ID NO: 2331052 - DNA, 13 bp, Homo sapiens
tgagattggtttt

SEQ ID NO: 2331053 - DNA, 19 bp, Homo sapiens
tgagattggttttcctgtg

SEQ ID NO: 2331054 - DNA, 18 bp, Homo sapiens
tgagattgtgtttgttca

SEQ ID NO: 2331055 - DNA, 20 bp, Homo sapiens
tgagcaaccacatttagaaa

SEQ ID NO: 2331056 - DNA, 16 bp, Homo sapiens
tgagcaccctctggat

SEQ ID NO: 2331057 - DNA, 11 bp, Homo sapiens
tgagcagaccg

SEQ ID NO: 2331058 - DNA, 21 bp, Homo sapiens
tgagcagtgttggagtgagga

SEQ ID NO: 2331059 - DNA, 13 bp, Homo sapiens
tgagccaaaatca

SEQ ID NO: 2331060 - DNA, 20 bp, Homo sapiens
tgagccagacaaatggagga

SEQ ID NO: 2331061 - DNA, 13 bp, Homo sapiens
tgagccccacagc

SEQ ID NO: 2331062 - DNA, 15 bp, Homo sapiens
tgagccccagtgctg

SEQ ID NO: 2331063 - DNA, 20 bp, Homo sapiens
tgagcccctttgcctgtcaa

SEQ ID NO: 2331064 - DNA, 22 bp, Homo sapiens
tgagcccctttgcctgtcaagt

SEQ ID NO: 2331065 - DNA, 19 bp, Homo sapiens
tgagccctactccctgcag

SEQ ID NO: 2331066 - DNA, 13 bp, Homo sapiens
tgagccctggctg

SEQ ID NO: 2331067 - DNA, 22 bp, Homo sapiens
tgagccgcggggaagctggctt

SEQ ID NO: 2331068 - DNA, 23 bp, Homo sapiens
tgagccgcggggaagctggcttt

SEQ ID NO: 2331069 - DNA, 15 bp, Homo sapiens
tgagccgggcccctg

SEQ ID NO: 2331070 - DNA, 16 bp, Homo sapiens
tgagccgggcccctgg

SEQ ID NO: 2331071 - DNA, 20 bp, Homo sapiens
tgagccgggcccctgggctt

SEQ ID NO: 2331072 - DNA, 12 bp, Homo sapiens
tgagcctcctgt

SEQ ID NO: 2331073 - DNA, 16 bp, Homo sapiens
tgagcctcctgtgcct

SEQ ID NO: 2331074 - DNA, 21 bp, Homo sapiens
tgagcctgaaccttaatgtgg

SEQ ID NO: 2331075 - DNA, 17 bp, Homo sapiens
tgagcctgccctcactc

SEQ ID NO: 2331076 - DNA, 13 bp, Homo sapiens
tgagcctgctgga

SEQ ID NO: 2331077 - DNA, 17 bp, Homo sapiens
tgagctattttcctctg

SEQ ID NO: 2331078 - DNA, 19 bp, Homo sapiens
tgagctattttcctctggc

SEQ ID NO: 2331079 - DNA, 20 bp, Homo sapiens
tgagctattttcctctggcc

SEQ ID NO: 2331080 - DNA, 12 bp, Homo sapiens
tgagctctctgt

SEQ ID NO: 2331081 - DNA, 12 bp, Homo sapiens
tgagctctgaaa

SEQ ID NO: 2331082 - DNA, 16 bp, Homo sapiens
tgagctctgaaatctt

SEQ ID NO: 2331083 - DNA, 21 bp, Homo sapiens
tgagctcttcctatccctctc

SEQ ID NO: 2331084 - DNA, 16 bp, Homo sapiens
tgagctgccttcccta

SEQ ID NO: 2331085 - DNA, 17 bp, Homo sapiens
tgagctgccttccctag

SEQ ID NO: 2331086 - DNA, 19 bp, Homo sapiens
tgagctgccttccctagct

SEQ ID NO: 2331087 - DNA, 21 bp, Homo sapiens
tgagctgctcattacagttct

SEQ ID NO: 2331088 - DNA, 10 bp, Homo sapiens
tgagctggcc

SEQ ID NO: 2331089 - DNA, 21 bp, Homo sapiens
tgagctttagctctctctaga

SEQ ID NO: 2331090 - DNA, 15 bp, Homo sapiens
tgaggaaaattctta

SEQ ID NO: 2331091 - DNA, 18 bp, Homo sapiens
tgaggaagacaagcattt

SEQ ID NO: 2331092 - DNA, 11 bp, Homo sapiens
tgaggagaagg

SEQ ID NO: 2331093 - DNA, 22 bp, Homo sapiens
tgaggagaagggggtctctgtt

SEQ ID NO: 2331094 - DNA, 18 bp, Homo sapiens
tgaggatattcagatgta

SEQ ID NO: 2331095 - DNA, 15 bp, Homo sapiens
tgaggccactgtgtt

SEQ ID NO: 2331096 - DNA, 21 bp, Homo sapiens
tgaggccactgtgttccttcc

SEQ ID NO: 2331097 - DNA, 13 bp, Homo sapiens
tgaggcccagcct

SEQ ID NO: 2331098 - DNA, 17 bp, Homo sapiens
tgaggcccagcctgtcc

SEQ ID NO: 2331099 - DNA, 20 bp, Homo sapiens
tgaggcccagcctgtcctgg

SEQ ID NO: 2331100 - DNA, 15 bp, Homo sapiens
tgaggcccagtgcat

SEQ ID NO: 2331101 - DNA, 15 bp, Homo sapiens
tgaggccctgggctg

SEQ ID NO: 2331102 - DNA, 16 bp, Homo sapiens
tgaggcctagactctg

SEQ ID NO: 2331103 - DNA, 14 bp, Homo sapiens
tgagggaggggaaa

SEQ ID NO: 2331104 - DNA, 19 bp, Homo sapiens
tgagggcctgctggaggcc

SEQ ID NO: 2331105 - DNA, 12 bp, Homo sapiens
tgagggtcttct

SEQ ID NO: 2331106 - DNA, 23 bp, Homo sapiens
tgaggtcccctcgtcccatccag

SEQ ID NO: 2331107 - DNA, 22 bp, Homo sapiens
tgaggttaaacggtgcccatcc

SEQ ID NO: 2331108 - DNA, 20 bp, Homo sapiens
tgaggttcctctgcctgccc

SEQ ID NO: 2331109 - DNA, 21 bp, Homo sapiens
tgaggttcctctgcctgcccc

SEQ ID NO: 2331110 - DNA, 20 bp, Homo sapiens
tgagtattccatgagctgct

SEQ ID NO: 2331111 - DNA, 19 bp, Homo sapiens
tgagtattgtttaaaatgt

SEQ ID NO: 2331112 - DNA, 15 bp, Homo sapiens
tgagtcatctgttag

SEQ ID NO: 2331113 - DNA, 21 bp, Homo sapiens
tgagtcatctgttagggcctt

SEQ ID NO: 2331114 - DNA, 17 bp, Homo sapiens
tgagtccattctcccag

SEQ ID NO: 2331115 - DNA, 17 bp, Homo sapiens
tgagtgacagctttctg

SEQ ID NO: 2331116 - DNA, 20 bp, Homo sapiens
tgagtgacagctttctggga

SEQ ID NO: 2331117 - DNA, 19 bp, Homo sapiens
tgagtgcgggctgaggcca

SEQ ID NO: 2331118 - DNA, 21 bp, Homo sapiens
tgagtgcgggctgaggccaga

SEQ ID NO: 2331119 - DNA, 22 bp, Homo sapiens
tgagtgcgggctgaggccagag

SEQ ID NO: 2331120 - DNA, 23 bp, Homo sapiens
tgagtggcctgtagtccatctcc

SEQ ID NO: 2331121 - DNA, 23 bp, Homo sapiens
tgagttatcatgaattttaaagt

SEQ ID NO: 2331122 - DNA, 16 bp, Homo sapiens
tgagttgaaatgttct

SEQ ID NO: 2331123 - DNA, 18 bp, Homo sapiens
tgagttgaaatgttctgt

SEQ ID NO: 2331124 - DNA, 17 bp, Homo sapiens
tgagtttgagctgcctt

SEQ ID NO: 2331125 - DNA, 17 bp, Homo sapiens
tgagtttttcctcccag

SEQ ID NO: 2331126 - DNA, 20 bp, Homo sapiens
tgagtttttcctcccagtga

SEQ ID NO: 2331127 - DNA, 11 bp, Homo sapiens
tgataaaataa

SEQ ID NO: 2331128 - DNA, 19 bp, Homo sapiens
tgataaaataaataatttt

SEQ ID NO: 2331129 - DNA, 16 bp, Homo sapiens
tgataagggaaaagat

SEQ ID NO: 2331130 - DNA, 19 bp, Homo sapiens
tgataagggaaaagataaa

SEQ ID NO: 2331131 - DNA, 20 bp, Homo sapiens
tgataagggaaaagataaag

SEQ ID NO: 2331132 - DNA, 18 bp, Homo sapiens
tgataatgttaaatttgt

SEQ ID NO: 2331133 - DNA, 22 bp, Homo sapiens
tgataatgttaaatttgtaagt

SEQ ID NO: 2331134 - DNA, 18 bp, Homo sapiens
tgatacattttttaagct

SEQ ID NO: 2331135 - DNA, 14 bp, Homo sapiens
tgatagttgtgtgt

SEQ ID NO: 2331136 - DNA, 14 bp, Homo sapiens
tgatatattttaca

SEQ ID NO: 2331137 - DNA, 15 bp, Homo sapiens
tgatatattttacaa

SEQ ID NO: 2331138 - DNA, 11 bp, Homo sapiens
tgatatcagga

SEQ ID NO: 2331139 - DNA, 19 bp, Homo sapiens
tgatatggcagaagacacc

SEQ ID NO: 2331140 - DNA, 20 bp, Homo sapiens
tgatatggcagaagacacca

SEQ ID NO: 2331141 - DNA, 14 bp, Homo sapiens
tgatattatttctt

SEQ ID NO: 2331142 - DNA, 14 bp, Homo sapiens
tgatcaagtggttt

SEQ ID NO: 2331143 - DNA, 21 bp, Homo sapiens
tgatcaatatttttatatcat

SEQ ID NO: 2331144 - DNA, 17 bp, Homo sapiens
tgatcaccgactgaaaa

SEQ ID NO: 2331145 - DNA, 21 bp, Homo sapiens
tgatcacttttgcacattccc

SEQ ID NO: 2331146 - DNA, 17 bp, Homo sapiens
tgatcagacatacagct

SEQ ID NO: 2331147 - DNA, 20 bp, Homo sapiens
tgatcagacatacagctgcc

SEQ ID NO: 2331148 - DNA, 22 bp, Homo sapiens
tgatcattacatggctgtggtt

SEQ ID NO: 2331149 - DNA, 18 bp, Homo sapiens
tgatccagaagagcccat

SEQ ID NO: 2331150 - DNA, 19 bp, Homo sapiens
tgatcccttgagatatgga

SEQ ID NO: 2331151 - DNA, 15 bp, Homo sapiens
tgatccttacaagtt

SEQ ID NO: 2331152 - DNA, 16 bp, Homo sapiens
tgatcggaaagctctt

SEQ ID NO: 2331153 - DNA, 19 bp, Homo sapiens
tgatctgggcattttcctc

SEQ ID NO: 2331154 - DNA, 21 bp, Homo sapiens
tgatgaaaaattgctgactgt

SEQ ID NO: 2331155 - DNA, 23 bp, Homo sapiens
tgatgactttctttttgtagctg

SEQ ID NO: 2331156 - DNA, 18 bp, Homo sapiens
tgatgattgaactggaat

SEQ ID NO: 2331157 - DNA, 16 bp, Homo sapiens
tgatgattttcatttc

SEQ ID NO: 2331158 - DNA, 18 bp, Homo sapiens
tgatgccttttttttcat

SEQ ID NO: 2331159 - DNA, 18 bp, Homo sapiens
tgatggagggtggaaata

SEQ ID NO: 2331160 - DNA, 19 bp, Homo sapiens
tgatggccttaatttcctt

SEQ ID NO: 2331161 - DNA, 19 bp, Homo sapiens
tgatggttcttcacctcct

SEQ ID NO: 2331162 - DNA, 17 bp, Homo sapiens
tgatgtacagattcttt

SEQ ID NO: 2331163 - DNA, 18 bp, Homo sapiens
tgatgtcagccttgcatc

SEQ ID NO: 2331164 - DNA, 11 bp, Homo sapiens
tgatgtcccag

SEQ ID NO: 2331165 - DNA, 14 bp, Homo sapiens
tgatgtcccagtgc

SEQ ID NO: 2331166 - DNA, 21 bp, Homo sapiens
tgatgtgaagagtttcacaaa

SEQ ID NO: 2331167 - DNA, 23 bp, Homo sapiens
tgatgtggaggaagagccacctg

SEQ ID NO: 2331168 - DNA, 22 bp, Homo sapiens
tgatgtgtccgtgaaagttgtg

SEQ ID NO: 2331169 - DNA, 21 bp, Homo sapiens
tgatgttaacccattccagta

SEQ ID NO: 2331170 - DNA, 13 bp, Homo sapiens
tgatgttccttcc

SEQ ID NO: 2331171 - DNA, 12 bp, Homo sapiens
tgattaaattat

SEQ ID NO: 2331172 - DNA, 14 bp, Homo sapiens
tgattaataaaata

SEQ ID NO: 2331173 - DNA, 18 bp, Homo sapiens
tgattattttttttttct

SEQ ID NO: 2331174 - DNA, 17 bp, Homo sapiens
tgattcaatctgtaaac

SEQ ID NO: 2331175 - DNA, 21 bp, Homo sapiens
tgattcaatctgtaaactgtg

SEQ ID NO: 2331176 - DNA, 16 bp, Homo sapiens
tgattcacctcttctt

SEQ ID NO: 2331177 - DNA, 21 bp, Homo sapiens
tgattccactacacctggctg

SEQ ID NO: 2331178 - DNA, 11 bp, Homo sapiens
tgattcctggc

SEQ ID NO: 2331179 - DNA, 13 bp, Homo sapiens
tgattctgtttcc

SEQ ID NO: 2331180 - DNA, 14 bp, Homo sapiens
tgattctttgttac

SEQ ID NO: 2331181 - DNA, 19 bp, Homo sapiens
tgattctttgttacaggca

SEQ ID NO: 2331182 - DNA, 20 bp, Homo sapiens
tgattgaactggaataatat

SEQ ID NO: 2331183 - DNA, 17 bp, Homo sapiens
tgattgggaaaacattt

SEQ ID NO: 2331184 - DNA, 18 bp, Homo sapiens
tgattgggaggtgcgtgt

SEQ ID NO: 2331185 - DNA, 19 bp, Homo sapiens
tgatttaataaaataattc

SEQ ID NO: 2331186 - DNA, 17 bp, Homo sapiens
tgatttactaacagtaa

SEQ ID NO: 2331187 - DNA, 16 bp, Homo sapiens
tgatttcagtaagtct

SEQ ID NO: 2331188 - DNA, 18 bp, Homo sapiens
tgatttcagttctaggaa

SEQ ID NO: 2331189 - DNA, 15 bp, Homo sapiens
tgatttcctccctct

SEQ ID NO: 2331190 - DNA, 11 bp, Homo sapiens
tgatttctaat

SEQ ID NO: 2331191 - DNA, 12 bp, Homo sapiens
tgatttctaatt

SEQ ID NO: 2331192 - DNA, 22 bp, Homo sapiens
tgatttcttaggggaaggagaa

SEQ ID NO: 2331193 - DNA, 19 bp, Homo sapiens
tgatttggaagagaggcac

SEQ ID NO: 2331194 - DNA, 22 bp, Homo sapiens
tgatttggaagagaggcacctg

SEQ ID NO: 2331195 - DNA, 17 bp, Homo sapiens
tgattttcaagcagcat

SEQ ID NO: 2331196 - DNA, 14 bp, Homo sapiens
tgattttttgaaag

SEQ ID NO: 2331197 - DNA, 14 bp, Homo sapiens
tgcaaaaaattctt

SEQ ID NO: 2331198 - DNA, 16 bp, Homo sapiens
tgcaaagagacatttc

SEQ ID NO: 2331199 - DNA, 20 bp, Homo sapiens
tgcaaatgagctctgaaatc

SEQ ID NO: 2331200 - DNA, 15 bp, Homo sapiens
tgcaacaagcatgca

SEQ ID NO: 2331201 - DNA, 19 bp, Homo sapiens
tgcaacagactgttgagtt

SEQ ID NO: 2331202 - DNA, 18 bp, Homo sapiens
tgcaacctcaccttcctg

SEQ ID NO: 2331203 - DNA, 19 bp, Homo sapiens
tgcaacctcaccttcctgt

SEQ ID NO: 2331204 - DNA, 21 bp, Homo sapiens
tgcaagatggacacgagccac

SEQ ID NO: 2331205 - DNA, 22 bp, Homo sapiens
tgcaagatggacacgagccaca

SEQ ID NO: 2331206 - DNA, 14 bp, Homo sapiens
tgcaagatgtgaat

SEQ ID NO: 2331207 - DNA, 15 bp, Homo sapiens
tgcaagatgtgaatt

SEQ ID NO: 2331208 - DNA, 16 bp, Homo sapiens
tgcaagatgtgaatta

SEQ ID NO: 2331209 - DNA, 18 bp, Homo sapiens
tgcaagatgtgaattatt

SEQ ID NO: 2331210 - DNA, 16 bp, Homo sapiens
tgcaataaaatttaaa

SEQ ID NO: 2331211 - DNA, 18 bp, Homo sapiens
tgcaataacagctgcaat

SEQ ID NO: 2331212 - DNA, 15 bp, Homo sapiens
tgcaatgcttgtaga

SEQ ID NO: 2331213 - DNA, 22 bp, Homo sapiens
tgcaattaaacttccaaagaaa

SEQ ID NO: 2331214 - DNA, 24 bp, Homo sapiens
tgcaattaaacttccaaagaaagt

SEQ ID NO: 2331215 - DNA, 14 bp, Homo sapiens
tgcacacagaatgc

SEQ ID NO: 2331216 - DNA, 20 bp, Homo sapiens
tgcacacagaatgctcaggg

SEQ ID NO: 2331217 - DNA, 13 bp, Homo sapiens
tgcacacaggaca

SEQ ID NO: 2331218 - DNA, 18 bp, Homo sapiens
tgcacaccccactcccac

SEQ ID NO: 2331219 - DNA, 20 bp, Homo sapiens
tgcacaccctccagagacaa

SEQ ID NO: 2331220 - DNA, 20 bp, Homo sapiens
tgcacacctactagtcacca

SEQ ID NO: 2331221 - DNA, 22 bp, Homo sapiens
tgcacacctactagtcaccaga

SEQ ID NO: 2331222 - DNA, 22 bp, Homo sapiens
tgcacagagcaagtcctcactc

SEQ ID NO: 2331223 - DNA, 17 bp, Homo sapiens
tgcacagctggagaaat

SEQ ID NO: 2331224 - DNA, 19 bp, Homo sapiens
tgcacagctggagaaatgg

SEQ ID NO: 2331225 - DNA, 19 bp, Homo sapiens
tgcacagtgttggtttcct

SEQ ID NO: 2331226 - DNA, 15 bp, Homo sapiens
tgcacatatggactc

SEQ ID NO: 2331227 - DNA, 19 bp, Homo sapiens
tgcacatatggactctgca

SEQ ID NO: 2331228 - DNA, 22 bp, Homo sapiens
tgcacatgtcttgtacatgtgt

SEQ ID NO: 2331229 - DNA, 22 bp, Homo sapiens
tgcacccacctgttttctgaaa

SEQ ID NO: 2331230 - DNA, 20 bp, Homo sapiens
tgcaccccttctctcctccc

SEQ ID NO: 2331231 - DNA, 14 bp, Homo sapiens
tgcacctgagaccc

SEQ ID NO: 2331232 - DNA, 17 bp, Homo sapiens
tgcactagagaaaataa

SEQ ID NO: 2331233 - DNA, 13 bp, Homo sapiens
tgcactccagcct

SEQ ID NO: 2331234 - DNA, 18 bp, Homo sapiens
tgcactccagcctggggg

SEQ ID NO: 2331235 - DNA, 22 bp, Homo sapiens
tgcactgaggcagcgacctcaa

SEQ ID NO: 2331236 - DNA, 12 bp, Homo sapiens
tgcactgggagg

SEQ ID NO: 2331237 - DNA, 12 bp, Homo sapiens
tgcactgtgaac

SEQ ID NO: 2331238 - DNA, 19 bp, Homo sapiens
tgcacttattgaccatttt

SEQ ID NO: 2331239 - DNA, 17 bp, Homo sapiens
tgcagaaacttggatgt

SEQ ID NO: 2331240 - DNA, 20 bp, Homo sapiens
tgcagaaatagacaaaaagt

SEQ ID NO: 2331241 - DNA, 15 bp, Homo sapiens
tgcagaactgtagct

SEQ ID NO: 2331242 - DNA, 23 bp, Homo sapiens
tgcagaatccctttgcacctgag

SEQ ID NO: 2331243 - DNA, 16 bp, Homo sapiens
tgcagagagccatttt

SEQ ID NO: 2331244 - DNA, 17 bp, Homo sapiens
tgcagagagccattttg

SEQ ID NO: 2331245 - DNA, 23 bp, Homo sapiens
tgcagagagccattttgtgaatg

SEQ ID NO: 2331246 - DNA, 13 bp, Homo sapiens
tgcagagatttct

SEQ ID NO: 2331247 - DNA, 15 bp, Homo sapiens
tgcagagatttctca

SEQ ID NO: 2331248 - DNA, 20 bp, Homo sapiens
tgcagagatttctcattgac

SEQ ID NO: 2331249 - DNA, 15 bp, Homo sapiens
tgcagagccttctca

SEQ ID NO: 2331250 - DNA, 23 bp, Homo sapiens
tgcagcaggaatatatgtgtgcc

SEQ ID NO: 2331251 - DNA, 10 bp, Homo sapiens
tgcagcccac

SEQ ID NO: 2331252 - DNA, 16 bp, Homo sapiens
tgcagcccaccagacg

SEQ ID NO: 2331253 - DNA, 20 bp, Homo sapiens
tgcagcctcatactcctggg

SEQ ID NO: 2331254 - DNA, 14 bp, Homo sapiens
tgcagctttgcaaa

SEQ ID NO: 2331255 - DNA, 15 bp, Homo sapiens
tgcaggaggtggaga

SEQ ID NO: 2331256 - DNA, 17 bp, Homo sapiens
tgcaggattcccttctg

SEQ ID NO: 2331257 - DNA, 19 bp, Homo sapiens
tgcaggattcccttctggg

SEQ ID NO: 2331258 - DNA, 21 bp, Homo sapiens
tgcaggcagagctggagcccc

SEQ ID NO: 2331259 - DNA, 19 bp, Homo sapiens
tgcaggcaggaacaaacag

SEQ ID NO: 2331260 - DNA, 19 bp, Homo sapiens
tgcaggctttgccattgtg

SEQ ID NO: 2331261 - DNA, 20 bp, Homo sapiens
tgcagtgatatggcagaaga

SEQ ID NO: 2331262 - DNA, 22 bp, Homo sapiens
tgcagtgatatggcagaagaca

SEQ ID NO: 2331263 - DNA, 20 bp, Homo sapiens
tgcagtgtggagttcacctt

SEQ ID NO: 2331264 - DNA, 12 bp, Homo sapiens
tgcagtttcttt

SEQ ID NO: 2331265 - DNA, 16 bp, Homo sapiens
tgcagtttcttttcac

SEQ ID NO: 2331266 - DNA, 17 bp, Homo sapiens
tgcagtttcttttcaca

SEQ ID NO: 2331267 - DNA, 12 bp, Homo sapiens
tgcataaatatg

SEQ ID NO: 2331268 - DNA, 19 bp, Homo sapiens
tgcataataagctaaagag

SEQ ID NO: 2331269 - DNA, 24 bp, Homo sapiens
tgcataataagctaaagaggctga

SEQ ID NO: 2331270 - DNA, 17 bp, Homo sapiens
tgcataatgataaaata

SEQ ID NO: 2331271 - DNA, 20 bp, Homo sapiens
tgcataatgataaaataaat

SEQ ID NO: 2331272 - DNA, 13 bp, Homo sapiens
tgcatactttgta

SEQ ID NO: 2331273 - DNA, 21 bp, Homo sapiens
tgcatagttgtagacaaagta

SEQ ID NO: 2331274 - DNA, 13 bp, Homo sapiens
tgcatagtttctt

SEQ ID NO: 2331275 - DNA, 15 bp, Homo sapiens
tgcatagtttcttta

SEQ ID NO: 2331276 - DNA, 23 bp, Homo sapiens
tgcatagtttctttattttgtgt

SEQ ID NO: 2331277 - DNA, 17 bp, Homo sapiens
tgcatataatgaataaa

SEQ ID NO: 2331278 - DNA, 19 bp, Homo sapiens
tgcatatttgcaaagtgta

SEQ ID NO: 2331279 - DNA, 13 bp, Homo sapiens
tgcatatttgcca

SEQ ID NO: 2331280 - DNA, 13 bp, Homo sapiens
tgcatctggggcc

SEQ ID NO: 2331281 - DNA, 18 bp, Homo sapiens
tgcatgtagaggcttgtt

SEQ ID NO: 2331282 - DNA, 18 bp, Homo sapiens
tgcattattaaattgtaa

SEQ ID NO: 2331283 - DNA, 23 bp, Homo sapiens
tgcattcacatttagaaaagtga

SEQ ID NO: 2331284 - DNA, 15 bp, Homo sapiens
tgcatttaaaacaga

SEQ ID NO: 2331285 - DNA, 19 bp, Homo sapiens
tgcatttaaaacagacact

SEQ ID NO: 2331286 - DNA, 15 bp, Homo sapiens
tgcatttaataaaga

SEQ ID NO: 2331287 - DNA, 22 bp, Homo sapiens
tgcatttaataaagatgagttg

SEQ ID NO: 2331288 - DNA, 23 bp, Homo sapiens
tgcatttaataaagatgagttgg

SEQ ID NO: 2331289 - DNA, 19 bp, Homo sapiens
tgcattttaaccctatttt

SEQ ID NO: 2331290 - DNA, 11 bp, Homo sapiens
tgcatttttgt

SEQ ID NO: 2331291 - DNA, 22 bp, Homo sapiens
tgcatttttgtaaatgtgtaca

SEQ ID NO: 2331292 - DNA, 16 bp, Homo sapiens
tgcatttttgtgaaat

SEQ ID NO: 2331293 - DNA, 17 bp, Homo sapiens
tgccaagagtgaaggga

SEQ ID NO: 2331294 - DNA, 14 bp, Homo sapiens
tgccaagtccctgg

SEQ ID NO: 2331295 - DNA, 18 bp, Homo sapiens
tgccaagtccctggaaaa

SEQ ID NO: 2331296 - DNA, 13 bp, Homo sapiens
tgccaatttcaag

SEQ ID NO: 2331297 - DNA, 23 bp, Homo sapiens
tgccaatttcctctccactgctg

SEQ ID NO: 2331298 - DNA, 13 bp, Homo sapiens
tgccacactgatg

SEQ ID NO: 2331299 - DNA, 16 bp, Homo sapiens
tgccacactgatggct

SEQ ID NO: 2331300 - DNA, 19 bp, Homo sapiens
tgccacactgatggctcaa

SEQ ID NO: 2331301 - DNA, 21 bp, Homo sapiens
tgccacactgatggctcaaga

SEQ ID NO: 2331302 - DNA, 17 bp, Homo sapiens
tgccacagccagaggag

SEQ ID NO: 2331303 - DNA, 22 bp, Homo sapiens
tgccaccagcccccgccccaga

SEQ ID NO: 2331304 - DNA, 20 bp, Homo sapiens
tgccactttacccacctaga

SEQ ID NO: 2331305 - DNA, 22 bp, Homo sapiens
tgccactttacccacctagaac

SEQ ID NO: 2331306 - DNA, 15 bp, Homo sapiens
tgccagacatggacc

SEQ ID NO: 2331307 - DNA, 16 bp, Homo sapiens
tgccagattctgcctc

SEQ ID NO: 2331308 - DNA, 20 bp, Homo sapiens
tgccagattctgcctctctg

SEQ ID NO: 2331309 - DNA, 23 bp, Homo sapiens
tgccagcaaataaatacgtgtca

SEQ ID NO: 2331310 - DNA, 17 bp, Homo sapiens
tgccagcagcagcaggt

SEQ ID NO: 2331311 - DNA, 18 bp, Homo sapiens
tgccagcagcagcaggtg

SEQ ID NO: 2331312 - DNA, 23 bp, Homo sapiens
tgccagccccctaaaagcactcc

SEQ ID NO: 2331313 - DNA, 12 bp, Homo sapiens
tgccaggcaggg

SEQ ID NO: 2331314 - DNA, 16 bp, Homo sapiens
tgccaggctgtttcag

SEQ ID NO: 2331315 - DNA, 13 bp, Homo sapiens
tgccagtattttt

SEQ ID NO: 2331316 - DNA, 18 bp, Homo sapiens
tgccatagtcacatggcc

SEQ ID NO: 2331317 - DNA, 19 bp, Homo sapiens
tgccatagtcacatggcct

SEQ ID NO: 2331318 - DNA, 20 bp, Homo sapiens
tgccatagtcttaactggtc

SEQ ID NO: 2331319 - DNA, 21 bp, Homo sapiens
tgccatattaaaatctgatgt

SEQ ID NO: 2331320 - DNA, 15 bp, Homo sapiens
tgccatcagtgaaaa

SEQ ID NO: 2331321 - DNA, 21 bp, Homo sapiens
tgccatccagatgtgtgcaat

SEQ ID NO: 2331322 - DNA, 17 bp, Homo sapiens
tgccatgacagaggctg

SEQ ID NO: 2331323 - DNA, 14 bp, Homo sapiens
tgccatggatctga

SEQ ID NO: 2331324 - DNA, 22 bp, Homo sapiens
tgccatgggcttcactgtataa

SEQ ID NO: 2331325 - DNA, 22 bp, Homo sapiens
tgccatgtctgcagtgtgcccc

SEQ ID NO: 2331326 - DNA, 19 bp, Homo sapiens
tgccattttttgtctgtga

SEQ ID NO: 2331327 - DNA, 23 bp, Homo sapiens
tgccattttttgtctgtgataac

SEQ ID NO: 2331328 - DNA, 15 bp, Homo sapiens
tgcccacatactgtc

SEQ ID NO: 2331329 - DNA, 19 bp, Homo sapiens
tgcccacatgggacctggc

SEQ ID NO: 2331330 - DNA, 11 bp, Homo sapiens
tgcccaccccc

SEQ ID NO: 2331331 - DNA, 20 bp, Homo sapiens
tgcccaccccctgccctgca

SEQ ID NO: 2331332 - DNA, 16 bp, Homo sapiens
tgcccacctgccggcc

SEQ ID NO: 2331333 - DNA, 15 bp, Homo sapiens
tgcccacgcagagga

SEQ ID NO: 2331334 - DNA, 19 bp, Homo sapiens
tgcccacgcagaggacgca

SEQ ID NO: 2331335 - DNA, 21 bp, Homo sapiens
tgcccactgtttctcttgagc

SEQ ID NO: 2331336 - DNA, 15 bp, Homo sapiens
tgcccagctctctga

SEQ ID NO: 2331337 - DNA, 19 bp, Homo sapiens
tgcccagtacatttaaatt

SEQ ID NO: 2331338 - DNA, 14 bp, Homo sapiens
tgcccatcctgcca

SEQ ID NO: 2331339 - DNA, 17 bp, Homo sapiens
tgccccaccttgccagg

SEQ ID NO: 2331340 - DNA, 19 bp, Homo sapiens
tgccccacggagacagagg

SEQ ID NO: 2331341 - DNA, 14 bp, Homo sapiens
tgccccagcccaga

SEQ ID NO: 2331342 - DNA, 22 bp, Homo sapiens
tgcccccaccccggggaccctg

SEQ ID NO: 2331343 - DNA, 16 bp, Homo sapiens
tgcccccagccccggg

SEQ ID NO: 2331344 - DNA, 18 bp, Homo sapiens
tgcccccatttctgaggt

SEQ ID NO: 2331345 - DNA, 17 bp, Homo sapiens
tgccccccgccctcatg

SEQ ID NO: 2331346 - DNA, 20 bp, Homo sapiens
tgcccctaatctctgtagga

SEQ ID NO: 2331347 - DNA, 19 bp, Homo sapiens
tgcccctggacctgggaac

SEQ ID NO: 2331348 - DNA, 19 bp, Homo sapiens
tgcccgaaactaagccagg

SEQ ID NO: 2331349 - DNA, 16 bp, Homo sapiens
tgcccgcagagcccac

SEQ ID NO: 2331350 - DNA, 12 bp, Homo sapiens
tgccctcactcc

SEQ ID NO: 2331351 - DNA, 14 bp, Homo sapiens
tgccctcactccct

SEQ ID NO: 2331352 - DNA, 17 bp, Homo sapiens
tgccctcactccctctg

SEQ ID NO: 2331353 - DNA, 12 bp, Homo sapiens
tgccctctccca

SEQ ID NO: 2331354 - DNA, 21 bp, Homo sapiens
tgccctgtccaaaagcgccct

SEQ ID NO: 2331355 - DNA, 20 bp, Homo sapiens
tgccctgtgtacttcccggg

SEQ ID NO: 2331356 - DNA, 19 bp, Homo sapiens
tgcccttccctctgggcac

SEQ ID NO: 2331357 - DNA, 18 bp, Homo sapiens
tgccgccccctcctgaac

SEQ ID NO: 2331358 - DNA, 19 bp, Homo sapiens
tgccgccccctcctgaacc

SEQ ID NO: 2331359 - DNA, 18 bp, Homo sapiens
tgccgccgtctctgtccc

SEQ ID NO: 2331360 - DNA, 13 bp, Homo sapiens
tgccgtggcacca

SEQ ID NO: 2331361 - DNA, 22 bp, Homo sapiens
tgccgtggcaccaggcgctgcc

SEQ ID NO: 2331362 - DNA, 14 bp, Homo sapiens
tgcctaattcctgg

SEQ ID NO: 2331363 - DNA, 14 bp, Homo sapiens
tgcctacagccagg

SEQ ID NO: 2331364 - DNA, 15 bp, Homo sapiens
tgcctcacctcgaaa

SEQ ID NO: 2331365 - DNA, 15 bp, Homo sapiens
tgcctcaccttgggg

SEQ ID NO: 2331366 - DNA, 18 bp, Homo sapiens
tgcctcaccttggggcct

SEQ ID NO: 2331367 - DNA, 14 bp, Homo sapiens
tgcctcagccttcc

SEQ ID NO: 2331368 - DNA, 15 bp, Homo sapiens
tgcctcagttttcct

SEQ ID NO: 2331369 - DNA, 17 bp, Homo sapiens
tgcctcagttttccttc

SEQ ID NO: 2331370 - DNA, 18 bp, Homo sapiens
tgcctcagttttccttct

SEQ ID NO: 2331371 - DNA, 17 bp, Homo sapiens
tgcctcccacttcactg

SEQ ID NO: 2331372 - DNA, 21 bp, Homo sapiens
tgcctcccaggcaagcagctg

SEQ ID NO: 2331373 - DNA, 20 bp, Homo sapiens
tgcctccccatttcccatct

SEQ ID NO: 2331374 - DNA, 21 bp, Homo sapiens
tgcctccccatttcccatctg

SEQ ID NO: 2331375 - DNA, 23 bp, Homo sapiens
tgcctccccatttcccatctgca

SEQ ID NO: 2331376 - DNA, 13 bp, Homo sapiens
tgcctcctggagg

SEQ ID NO: 2331377 - DNA, 17 bp, Homo sapiens
tgcctcgctcaccgctg

SEQ ID NO: 2331378 - DNA, 22 bp, Homo sapiens
tgcctcgctcaccgctggccct

SEQ ID NO: 2331379 - DNA, 18 bp, Homo sapiens
tgcctctcatcaactgaa

SEQ ID NO: 2331380 - DNA, 12 bp, Homo sapiens
tgcctctctaca

SEQ ID NO: 2331381 - DNA, 16 bp, Homo sapiens
tgcctctctggaaaga

SEQ ID NO: 2331382 - DNA, 23 bp, Homo sapiens
tgcctctctggaaagaggctctg

SEQ ID NO: 2331383 - DNA, 14 bp, Homo sapiens
tgcctcttcattct

SEQ ID NO: 2331384 - DNA, 18 bp, Homo sapiens
tgcctcttccagtgaaca

SEQ ID NO: 2331385 - DNA, 15 bp, Homo sapiens
tgcctgaatatttgt

SEQ ID NO: 2331386 - DNA, 14 bp, Homo sapiens
tgcctgagaagaag

SEQ ID NO: 2331387 - DNA, 16 bp, Homo sapiens
tgcctgagaggcaggc

SEQ ID NO: 2331388 - DNA, 14 bp, Homo sapiens
tgcctgagggcagt

SEQ ID NO: 2331389 - DNA, 15 bp, Homo sapiens
tgcctgccaccttca

SEQ ID NO: 2331390 - DNA, 12 bp, Homo sapiens
tgcctgccccgc

SEQ ID NO: 2331391 - DNA, 15 bp, Homo sapiens
tgcctgcgcctgctg

SEQ ID NO: 2331392 - DNA, 18 bp, Homo sapiens
tgcctgcgcctgctgcct

SEQ ID NO: 2331393 - DNA, 15 bp, Homo sapiens
tggaggaagagccac

SEQ ID NO: 2331394 - DNA, 20 bp, Homo sapiens
tggaggaagagccacctgca

SEQ ID NO: 2331395 - DNA, 22 bp, Homo sapiens
tggaggaagagccacctgcaag

SEQ ID NO: 2331396 - DNA, 13 bp, Homo sapiens
tggaggaaggatt

SEQ ID NO: 2331397 - DNA, 19 bp, Homo sapiens
tggaggaaggattgtaaaa

SEQ ID NO: 2331398 - DNA, 20 bp, Homo sapiens
tggaggaaggattgtaaaaa

SEQ ID NO: 2331399 - DNA, 23 bp, Homo sapiens
tggaggaagtggggtctggcctg

SEQ ID NO: 2331400 - DNA, 15 bp, Homo sapiens
tggaggaccagattg

SEQ ID NO: 2331401 - DNA, 13 bp, Homo sapiens
tggaggaggaagg

SEQ ID NO: 2331402 - DNA, 14 bp, Homo sapiens
tggaggaggaaggc

SEQ ID NO: 2331403 - DNA, 22 bp, Homo sapiens
tggaggccattgtgtgagccta

SEQ ID NO: 2331404 - DNA, 14 bp, Homo sapiens
tggaggcctcaggt

SEQ ID NO: 2331405 - DNA, 17 bp, Homo sapiens
tggaggcctcaggtgct

SEQ ID NO: 2331406 - DNA, 17 bp, Homo sapiens
tggagggagggaagggt

SEQ ID NO: 2331407 - DNA, 16 bp, Homo sapiens
tggaggggctggggac

SEQ ID NO: 2331408 - DNA, 11 bp, Homo sapiens
tggaggggtgt

SEQ ID NO: 2331409 - DNA, 22 bp, Homo sapiens
tggaggtgctgctctagggcag

SEQ ID NO: 2331410 - DNA, 15 bp, Homo sapiens
tggaggttgaagcca

SEQ ID NO: 2331411 - DNA, 14 bp, Homo sapiens
tggagtctcctgag

SEQ ID NO: 2331412 - DNA, 19 bp, Homo sapiens
tggagttcaccttggaagg

SEQ ID NO: 2331413 - DNA, 14 bp, Homo sapiens
tggagttcttgtgc

SEQ ID NO: 2331414 - DNA, 15 bp, Homo sapiens
tggatagacttggga

SEQ ID NO: 2331415 - DNA, 17 bp, Homo sapiens
tggatcactcaccattc

SEQ ID NO: 2331416 - DNA, 20 bp, Homo sapiens
tggatgttatgaacagctgt

SEQ ID NO: 2331417 - DNA, 20 bp, Homo sapiens
tggattactgccattcactt

SEQ ID NO: 2331418 - DNA, 14 bp, Homo sapiens
tggattatttaata

SEQ ID NO: 2331419 - DNA, 14 bp, Homo sapiens
tggattctgaatct

SEQ ID NO: 2331420 - DNA, 16 bp, Homo sapiens
tggattggattattta

SEQ ID NO: 2331421 - DNA, 19 bp, Homo sapiens
tggattttcctgaaagtgt

SEQ ID NO: 2331422 - DNA, 14 bp, Homo sapiens
tggcaaaccctccc

SEQ ID NO: 2331423 - DNA, 20 bp, Homo sapiens
tggcaaaccctcccagaaac

SEQ ID NO: 2331424 - DNA, 15 bp, Homo sapiens
tggcaatattctgta

SEQ ID NO: 2331425 - DNA, 20 bp, Homo sapiens
tggcacccaccgtggaggag

SEQ ID NO: 2331426 - DNA, 13 bp, Homo sapiens
tggcacctcaggc

SEQ ID NO: 2331427 - DNA, 22 bp, Homo sapiens
tggcacctcaggctgagggccc

SEQ ID NO: 2331428 - DNA, 23 bp, Homo sapiens
tggcagaagacaccagagcagat

SEQ ID NO: 2331429 - DNA, 15 bp, Homo sapiens
tggcagatgtcttcc

SEQ ID NO: 2331430 - DNA, 18 bp, Homo sapiens
tggcagatgtcttccctg

SEQ ID NO: 2331431 - DNA, 11 bp, Homo sapiens
tggcagcccag

SEQ ID NO: 2331432 - DNA, 22 bp, Homo sapiens
tggcaggtgggggtgggctgct

SEQ ID NO: 2331433 - DNA, 11 bp, Homo sapiens
tggcagtattg

SEQ ID NO: 2331434 - DNA, 14 bp, Homo sapiens
tggcagtattgaca

SEQ ID NO: 2331435 - DNA, 22 bp, Homo sapiens
tggcagtctgaatttttaaaac

SEQ ID NO: 2331436 - DNA, 12 bp, Homo sapiens
tggcagtggttt

SEQ ID NO: 2331437 - DNA, 23 bp, Homo sapiens
tggcatatatgtgatctgggcat

SEQ ID NO: 2331438 - DNA, 20 bp, Homo sapiens
tggcatcttagacctccaca

SEQ ID NO: 2331439 - DNA, 21 bp, Homo sapiens
tggcatgatcatagctcactg

SEQ ID NO: 2331440 - DNA, 16 bp, Homo sapiens
tggcatgcttaaattt

SEQ ID NO: 2331441 - DNA, 18 bp, Homo sapiens
tggcatttccaaacatcc

SEQ ID NO: 2331442 - DNA, 13 bp, Homo sapiens
tggccaagcagaa

SEQ ID NO: 2331443 - DNA, 11 bp, Homo sapiens
tggccacagca

SEQ ID NO: 2331444 - DNA, 18 bp, Homo sapiens
tggccacagcgccagcct

SEQ ID NO: 2331445 - DNA, 19 bp, Homo sapiens
tggccaccagccatcctcc

SEQ ID NO: 2331446 - DNA, 15 bp, Homo sapiens
tggccagcccctggg

SEQ ID NO: 2331447 - DNA, 21 bp, Homo sapiens
tggccagtccaccctgcctgc

SEQ ID NO: 2331448 - DNA, 22 bp, Homo sapiens
tggccagtccaccctgcctgcc

SEQ ID NO: 2331449 - DNA, 19 bp, Homo sapiens
tggccatgcaggaggtgga

SEQ ID NO: 2331450 - DNA, 14 bp, Homo sapiens
tggcccaccgtggc

SEQ ID NO: 2331451 - DNA, 16 bp, Homo sapiens
tggcccaccgtggcac

SEQ ID NO: 2331452 - DNA, 20 bp, Homo sapiens
tggcccaccgtggcactaga

SEQ ID NO: 2331453 - DNA, 13 bp, Homo sapiens
tggcccagaaagc

SEQ ID NO: 2331454 - DNA, 22 bp, Homo sapiens
tggcccagaaagcctctctctc

SEQ ID NO: 2331455 - DNA, 13 bp, Homo sapiens
tggccccagccct

SEQ ID NO: 2331456 - DNA, 21 bp, Homo sapiens
tggccccagccctgctgggga

SEQ ID NO: 2331457 - DNA, 12 bp, Homo sapiens
tggccccaggcc

SEQ ID NO: 2331458 - DNA, 19 bp, Homo sapiens
tggccccaggccccagaca

SEQ ID NO: 2331459 - DNA, 15 bp, Homo sapiens
tggccccaggctgtc

SEQ ID NO: 2331460 - DNA, 19 bp, Homo sapiens
tggcccctccccctgccag

SEQ ID NO: 2331461 - DNA, 15 bp, Homo sapiens
tggcccctctccctt

SEQ ID NO: 2331462 - DNA, 14 bp, Homo sapiens
tggccctggctgcc

SEQ ID NO: 2331463 - DNA, 16 bp, Homo sapiens
tggccctgtcccaggc

SEQ ID NO: 2331464 - DNA, 18 bp, Homo sapiens
tggccctgtcccaggccg

SEQ ID NO: 2331465 - DNA, 14 bp, Homo sapiens
tggccgcagaggtg

SEQ ID NO: 2331466 - DNA, 16 bp, Homo sapiens
tggccgcgctccgggc

SEQ ID NO: 2331467 - DNA, 17 bp, Homo sapiens
tggccgtggatgcgcag

SEQ ID NO: 2331468 - DNA, 14 bp, Homo sapiens
tggccgtggatggc

SEQ ID NO: 2331469 - DNA, 21 bp, Homo sapiens
tggcctatccgctgccagcct

SEQ ID NO: 2331470 - DNA, 15 bp, Homo sapiens
tggcctatgcacata

SEQ ID NO: 2331471 - DNA, 20 bp, Homo sapiens
tggcctatgcacatatggac

SEQ ID NO: 2331472 - DNA, 16 bp, Homo sapiens
tggcctatgtggtcta

SEQ ID NO: 2331473 - DNA, 19 bp, Homo sapiens
tggcctatgtggtctaagg

SEQ ID NO: 2331474 - DNA, 18 bp, Homo sapiens
tggcctccgcagtgtctc

SEQ ID NO: 2331475 - DNA, 16 bp, Homo sapiens
tggcctgcaaactggg

SEQ ID NO: 2331476 - DNA, 11 bp, Homo sapiens
tggcctgctgt

SEQ ID NO: 2331477 - DNA, 15 bp, Homo sapiens
tggccttaatttcct

SEQ ID NO: 2331478 - DNA, 23 bp, Homo sapiens
tggccttgtaagacccttattgc

SEQ ID NO: 2331479 - DNA, 15 bp, Homo sapiens
tggcctttccttccc

SEQ ID NO: 2331480 - DNA, 21 bp, Homo sapiens
tggcctttccttccctctctg

SEQ ID NO: 2331481 - DNA, 22 bp, Homo sapiens
tggcgccctgcctcctggagga

SEQ ID NO: 2331482 - DNA, 13 bp, Homo sapiens
tggcgcttagaga

SEQ ID NO: 2331483 - DNA, 18 bp, Homo sapiens
tggcgtctgctctggtgg

SEQ ID NO: 2331484 - DNA, 19 bp, Homo sapiens
tggcgtctgctctggtggc

SEQ ID NO: 2331485 - DNA, 15 bp, Homo sapiens
tggctacgcctcttc

SEQ ID NO: 2331486 - DNA, 22 bp, Homo sapiens
tggctacgcctcttctgtccct

SEQ ID NO: 2331487 - DNA, 19 bp, Homo sapiens
tggctcaagacaaggctgg

SEQ ID NO: 2331488 - DNA, 17 bp, Homo sapiens
tggctccccctccccag

SEQ ID NO: 2331489 - DNA, 21 bp, Homo sapiens
tggctccccctccccaggctg

SEQ ID NO: 2331490 - DNA, 17 bp, Homo sapiens
tggctccctcctccagg

SEQ ID NO: 2331491 - DNA, 20 bp, Homo sapiens
tggctccctcctccaggcct

SEQ ID NO: 2331492 - DNA, 21 bp, Homo sapiens
tggctctaccctgtctgtccc

SEQ ID NO: 2331493 - DNA, 22 bp, Homo sapiens
tggctctaccctgtctgtccct

SEQ ID NO: 2331494 - DNA, 17 bp, Homo sapiens
tggctctaccttcctgt

SEQ ID NO: 2331495 - DNA, 13 bp, Homo sapiens
tggctctcctggc

SEQ ID NO: 2331496 - DNA, 14 bp, Homo sapiens
tggctctcctggcc

SEQ ID NO: 2331497 - DNA, 18 bp, Homo sapiens
tggctctgggatcctggg

SEQ ID NO: 2331498 - DNA, 14 bp, Homo sapiens
tggctgagacctgg

SEQ ID NO: 2331499 - DNA, 17 bp, Homo sapiens
tggctgaggttcctctg

SEQ ID NO: 2331500 - DNA, 18 bp, Homo sapiens
tggctgaggttcctctgc

SEQ ID NO: 2331501 - DNA, 20 bp, Homo sapiens
tggctgaggttcctctgcct

SEQ ID NO: 2331502 - DNA, 24 bp, Homo sapiens
tggctgaggttcctctgcctgccc

SEQ ID NO: 2331503 - DNA, 21 bp, Homo sapiens
tggctgatttactaacagtaa

SEQ ID NO: 2331504 - DNA, 12 bp, Homo sapiens
tggctgccacac

SEQ ID NO: 2331505 - DNA, 13 bp, Homo sapiens
tggctgccacacc

SEQ ID NO: 2331506 - DNA, 14 bp, Homo sapiens
tggctgctgttgct

SEQ ID NO: 2331507 - DNA, 22 bp, Homo sapiens
tggctggaggaagtggggtctg

SEQ ID NO: 2331508 - DNA, 23 bp, Homo sapiens
tggctggaggagcagcagcttgg

SEQ ID NO: 2331509 - DNA, 15 bp, Homo sapiens
tggctggtagaaaaa

SEQ ID NO: 2331510 - DNA, 19 bp, Homo sapiens
tggtatatccaaaagcttt

SEQ ID NO: 2331511 - DNA, 22 bp, Homo sapiens
tggtatatccaaaagcttttta

SEQ ID NO: 2331512 - DNA, 14 bp, Homo sapiens
tggtatcatatatt

SEQ ID NO: 2331513 - DNA, 13 bp, Homo sapiens
tggtatgtctgcc

SEQ ID NO: 2331514 - DNA, 12 bp, Homo sapiens
tggtatttctaa

SEQ ID NO: 2331515 - DNA, 15 bp, Homo sapiens
tggtcaggaagcaag

SEQ ID NO: 2331516 - DNA, 15 bp, Homo sapiens
tggtcagtctttgct

SEQ ID NO: 2331517 - DNA, 17 bp, Homo sapiens
tggtccccgttccaccc

SEQ ID NO: 2331518 - DNA, 16 bp, Homo sapiens
tggtcggatctcacag

SEQ ID NO: 2331519 - DNA, 18 bp, Homo sapiens
tggtctaaggttcagcct

SEQ ID NO: 2331520 - DNA, 21 bp, Homo sapiens
tggtctcaaacttgtggcctc

SEQ ID NO: 2331521 - DNA, 14 bp, Homo sapiens
tggtctcaggcagc

SEQ ID NO: 2331522 - DNA, 20 bp, Homo sapiens
tggtctcaggcagcaccaca

SEQ ID NO: 2331523 - DNA, 10 bp, Homo sapiens
tggtctctgc

SEQ ID NO: 2331524 - DNA, 16 bp, Homo sapiens
tggtctggttgggcag

SEQ ID NO: 2331525 - DNA, 15 bp, Homo sapiens
tggtctttgctccag

SEQ ID NO: 2331526 - DNA, 16 bp, Homo sapiens
tggtctttgctccaga

SEQ ID NO: 2331527 - DNA, 21 bp, Homo sapiens
tggtgaggcccagcctgtcct

SEQ ID NO: 2331528 - DNA, 14 bp, Homo sapiens
tggtgatttgaaaa

SEQ ID NO: 2331529 - DNA, 19 bp, Homo sapiens
tggtgatttgaaaaatata

SEQ ID NO: 2331530 - DNA, 22 bp, Homo sapiens
tggtgatttgaaaaatataaaa

SEQ ID NO: 2331531 - DNA, 23 bp, Homo sapiens
tggtgccccccacccctggaaga

SEQ ID NO: 2331532 - DNA, 17 bp, Homo sapiens
tggtgccctcctcactc

SEQ ID NO: 2331533 - DNA, 19 bp, Homo sapiens
tggtgcctgagaggcaggc

SEQ ID NO: 2331534 - DNA, 24 bp, Homo sapiens
tggtgcctggcctggcacacatca

SEQ ID NO: 2331535 - DNA, 16 bp, Homo sapiens
tggtgctatttaacat

SEQ ID NO: 2331536 - DNA, 22 bp, Homo sapiens
tggtgctcacgactcttcctgc

SEQ ID NO: 2331537 - DNA, 18 bp, Homo sapiens
tggtgctgccttgcttct

SEQ ID NO: 2331538 - DNA, 19 bp, Homo sapiens
tggtggcttaagtgagcag

SEQ ID NO: 2331539 - DNA, 22 bp, Homo sapiens
tggtggcttaagtgagcagaac

SEQ ID NO: 2331540 - DNA, 15 bp, Homo sapiens
tggtgtaataagaca

SEQ ID NO: 2331541 - DNA, 15 bp, Homo sapiens
tggtgtaatttgaag

SEQ ID NO: 2331542 - DNA, 22 bp, Homo sapiens
tggtgtcccggtaccttccata

SEQ ID NO: 2331543 - DNA, 15 bp, Homo sapiens
tggtgtggcctgtgg

SEQ ID NO: 2331544 - DNA, 15 bp, Homo sapiens
tggtgtgggtgtcct

SEQ ID NO: 2331545 - DNA, 22 bp, Homo sapiens
tggtgtgggtgtcctgcctgtc

SEQ ID NO: 2331546 - DNA, 13 bp, Homo sapiens
tggtgtttattgc

SEQ ID NO: 2331547 - DNA, 12 bp, Homo sapiens
tggttaaatttt

SEQ ID NO: 2331548 - DNA, 16 bp, Homo sapiens
tggttaaattttacat

SEQ ID NO: 2331549 - DNA, 13 bp, Homo sapiens
tggttactttcaa

SEQ ID NO: 2331550 - DNA, 16 bp, Homo sapiens
tggttactttcaaaat

SEQ ID NO: 2331551 - DNA, 19 bp, Homo sapiens
tggttcccaatatcatgtg

SEQ ID NO: 2331552 - DNA, 23 bp, Homo sapiens
tggttgggaatgaggaaaattct

SEQ ID NO: 2331553 - DNA, 19 bp, Homo sapiens
tggttgtcatcactagtgg

SEQ ID NO: 2331554 - DNA, 23 bp, Homo sapiens
tggtttagcgttgttttgtggat

SEQ ID NO: 2331555 - DNA, 17 bp, Homo sapiens
tggtttcacagataaca

SEQ ID NO: 2331556 - DNA, 23 bp, Homo sapiens
tggtttgcaacctctttgctcaa

SEQ ID NO: 2331557 - DNA, 11 bp, Homo sapiens
tggtttggaat

SEQ ID NO: 2331558 - DNA, 18 bp, Homo sapiens
tggttttctgccaatgac

SEQ ID NO: 2331559 - DNA, 15 bp, Homo sapiens
tggtttttatatttt

SEQ ID NO: 2331560 - DNA, 23 bp, Homo sapiens
tgtaaaaatcttttgaagcatag

SEQ ID NO: 2331561 - DNA, 12 bp, Homo sapiens
tgtaaaaatgtt

SEQ ID NO: 2331562 - DNA, 13 bp, Homo sapiens
tgtaaaaatgtta

SEQ ID NO: 2331563 - DNA, 14 bp, Homo sapiens
tgtaaaacagtggt

SEQ ID NO: 2331564 - DNA, 12 bp, Homo sapiens
tgtaaaatgttt

SEQ ID NO: 2331565 - DNA, 19 bp, Homo sapiens
tgtaaacctgagtcgtaca

SEQ ID NO: 2331566 - DNA, 13 bp, Homo sapiens
tgtaaactgtgta

SEQ ID NO: 2331567 - DNA, 18 bp, Homo sapiens
tgtaaactgtgtattcca

SEQ ID NO: 2331568 - DNA, 21 bp, Homo sapiens
tgtaaagatattgtatctcct

SEQ ID NO: 2331569 - DNA, 18 bp, Homo sapiens
tgtaaagatatttttatc

SEQ ID NO: 2331570 - DNA, 20 bp, Homo sapiens
tgtaaagtgtgtgattgaag

SEQ ID NO: 2331571 - DNA, 12 bp, Homo sapiens
tgtaacaacaat

SEQ ID NO: 2331572 - DNA, 18 bp, Homo sapiens
tgtaagagcttgctccag

SEQ ID NO: 2331573 - DNA, 18 bp, Homo sapiens
tgtaagagtgtagaagca

SEQ ID NO: 2331574 - DNA, 20 bp, Homo sapiens
tgtaagagtgtagaagcatt

SEQ ID NO: 2331575 - DNA, 21 bp, Homo sapiens
tgtaagagtgtagaagcattc

SEQ ID NO: 2331576 - DNA, 18 bp, Homo sapiens
tgtaagcactctggatga

SEQ ID NO: 2331577 - DNA, 20 bp, Homo sapiens
tgtaagcattctgagctggg

SEQ ID NO: 2331578 - DNA, 22 bp, Homo sapiens
tgtaagcattctgagctgggct

SEQ ID NO: 2331579 - DNA, 14 bp, Homo sapiens
tgtaaggtcttctt

SEQ ID NO: 2331580 - DNA, 15 bp, Homo sapiens
tgtaagtgtagctca

SEQ ID NO: 2331581 - DNA, 13 bp, Homo sapiens
tgtaagtttcagg

SEQ ID NO: 2331582 - DNA, 14 bp, Homo sapiens
tgtaagtttcaggt

SEQ ID NO: 2331583 - DNA, 21 bp, Homo sapiens
tgtaagtttcaggtgacatgt

SEQ ID NO: 2331584 - DNA, 13 bp, Homo sapiens
tgtaataagacat

SEQ ID NO: 2331585 - DNA, 15 bp, Homo sapiens
tgtaataagacataa

SEQ ID NO: 2331586 - DNA, 14 bp, Homo sapiens
tgtaatacttcttt

SEQ ID NO: 2331587 - DNA, 12 bp, Homo sapiens
tgtaatatcagt

SEQ ID NO: 2331588 - DNA, 16 bp, Homo sapiens
tgtaatatcagttaca

SEQ ID NO: 2331589 - DNA, 19 bp, Homo sapiens
tgtaatatcagttacagtg

SEQ ID NO: 2331590 - DNA, 17 bp, Homo sapiens
tgtaattacttattgta

SEQ ID NO: 2331591 - DNA, 16 bp, Homo sapiens
tgtaatttaaatgaaa

SEQ ID NO: 2331592 - DNA, 17 bp, Homo sapiens
tgtaatttaaatgaaag

SEQ ID NO: 2331593 - DNA, 15 bp, Homo sapiens
tgtacagaatatttc

SEQ ID NO: 2331594 - DNA, 21 bp, Homo sapiens
tgtacagaccgagaggccagt

SEQ ID NO: 2331595 - DNA, 18 bp, Homo sapiens
tgtacagaggtcagcaca

SEQ ID NO: 2331596 - DNA, 15 bp, Homo sapiens
tgtacataactgaaa

SEQ ID NO: 2331597 - DNA, 18 bp, Homo sapiens
tgtacataactgaaaatg

SEQ ID NO: 2331598 - DNA, 15 bp, Homo sapiens
tgtacatgtgtagcc

SEQ ID NO: 2331599 - DNA, 19 bp, Homo sapiens
tgtacccatctttaattta

SEQ ID NO: 2331600 - DNA, 19 bp, Homo sapiens
tgtactctacaaaatatag

SEQ ID NO: 2331601 - DNA, 17 bp, Homo sapiens
tgtactgatttcagtaa

SEQ ID NO: 2331602 - DNA, 13 bp, Homo sapiens
tgtagaaacaaag

SEQ ID NO: 2331603 - DNA, 15 bp, Homo sapiens
tgtagaactttatta

SEQ ID NO: 2331604 - DNA, 15 bp, Homo sapiens
tgtagaagcattcct

SEQ ID NO: 2331605 - DNA, 21 bp, Homo sapiens
tgggtgaatatggtggaaaat

SEQ ID NO: 2331606 - DNA, 15 bp, Homo sapiens
tgggtgcgtctccag

SEQ ID NO: 2331607 - DNA, 19 bp, Homo sapiens
tgggtgcgtctccagtcat

SEQ ID NO: 2331608 - DNA, 19 bp, Homo sapiens
tgggtgggagtgtgtctgc

SEQ ID NO: 2331609 - DNA, 23 bp, Homo sapiens
tgggtgggagtgtgtctgctgag

SEQ ID NO: 2331610 - DNA, 23 bp, Homo sapiens
tgggtgtcctgcctgtctgcccc

SEQ ID NO: 2331611 - DNA, 17 bp, Homo sapiens
tgggtgttctttcctgc

SEQ ID NO: 2331612 - DNA, 14 bp, Homo sapiens
tgggtgtttccaga

SEQ ID NO: 2331613 - DNA, 13 bp, Homo sapiens
tggtaaatgtttc

SEQ ID NO: 2331614 - DNA, 14 bp, Homo sapiens
tggtaaatgtttct

SEQ ID NO: 2331615 - DNA, 17 bp, Homo sapiens
tggtaatctttacctgt

SEQ ID NO: 2331616 - DNA, 20 bp, Homo sapiens
tggtagctgggaaagcataa

SEQ ID NO: 2331617 - DNA, 16 bp, Homo sapiens
tggtaggggagggcag

SEQ ID NO: 2331618 - DNA, 22 bp, Homo sapiens
tggtaggggagggcaggcttgg

SEQ ID NO: 2331619 - DNA, 23 bp, Homo sapiens
tggtaggggagggcaggcttggg

SEQ ID NO: 2331620 - DNA, 23 bp, Homo sapiens
tgtatgaataatgaaaataaaac

SEQ ID NO: 2331621 - DNA, 12 bp, Homo sapiens
tgtatgaatgta

SEQ ID NO: 2331622 - DNA, 14 bp, Homo sapiens
tgtatgactaaaga

SEQ ID NO: 2331623 - DNA, 16 bp, Homo sapiens
tgtatgagtagccagg

SEQ ID NO: 2331624 - DNA, 13 bp, Homo sapiens
tgtatggatttaa

SEQ ID NO: 2331625 - DNA, 14 bp, Homo sapiens
tgtatgtcttggac

SEQ ID NO: 2331626 - DNA, 18 bp, Homo sapiens
tgtattcataagattttt

SEQ ID NO: 2331627 - DNA, 21 bp, Homo sapiens
tgtattccaagacatgtctgt

SEQ ID NO: 2331628 - DNA, 14 bp, Homo sapiens
tgtattcctttaaa

SEQ ID NO: 2331629 - DNA, 18 bp, Homo sapiens
tgtattcctttaaaatat

SEQ ID NO: 2331630 - DNA, 16 bp, Homo sapiens
tgtattcttttctcag

SEQ ID NO: 2331631 - DNA, 19 bp, Homo sapiens
tgtattcttttctcagtgt

SEQ ID NO: 2331632 - DNA, 16 bp, Homo sapiens
tgtattgtatattaca

SEQ ID NO: 2331633 - DNA, 21 bp, Homo sapiens
tgtattgtatattacaatgat

SEQ ID NO: 2331634 - DNA, 22 bp, Homo sapiens
tgtatttacttgttatgttgta

SEQ ID NO: 2331635 - DNA, 23 bp, Homo sapiens
tgtatttacttgttatgttgtaa

SEQ ID NO: 2331636 - DNA, 22 bp, Homo sapiens
tgtattttatttagacaagaga

SEQ ID NO: 2331637 - DNA, 12 bp, Homo sapiens
tgtattttcatg

SEQ ID NO: 2331638 - DNA, 23 bp, Homo sapiens
tgtcaaaaaagaatctgtattca

SEQ ID NO: 2331639 - DNA, 14 bp, Homo sapiens
tgtcaagctgctct

SEQ ID NO: 2331640 - DNA, 18 bp, Homo sapiens
tgtcaagctgctctgagc

SEQ ID NO: 2331641 - DNA, 16 bp, Homo sapiens
tgtcaagctggtgcta

SEQ ID NO: 2331642 - DNA, 17 bp, Homo sapiens
tgtcaagctggtgctac

SEQ ID NO: 2331643 - DNA, 15 bp, Homo sapiens
tgtcaccagatctga

SEQ ID NO: 2331644 - DNA, 14 bp, Homo sapiens
tgtcaccctgcaga

SEQ ID NO: 2331645 - DNA, 22 bp, Homo sapiens
tgtcagcattcctattaatgtc

SEQ ID NO: 2331646 - DNA, 12 bp, Homo sapiens
tgtcagccttgc

SEQ ID NO: 2331647 - DNA, 17 bp, Homo sapiens
tgtcaggctgaaaacaa

SEQ ID NO: 2331648 - DNA, 20 bp, Homo sapiens
tgtcagttctctgggaagtg

SEQ ID NO: 2331649 - DNA, 19 bp, Homo sapiens
tgtcatagactcctttgct

SEQ ID NO: 2331650 - DNA, 17 bp, Homo sapiens
tgtccaaacgtcctctt

SEQ ID NO: 2331651 - DNA, 21 bp, Homo sapiens
tgtccaaacgtcctctttagt

SEQ ID NO: 2331652 - DNA, 20 bp, Homo sapiens
tgtccaaagaggctgcccct

SEQ ID NO: 2331653 - DNA, 23 bp, Homo sapiens
tgtccagctggggccagaggctg

SEQ ID NO: 2331654 - DNA, 21 bp, Homo sapiens
tgtccagcttccaaagcctag

SEQ ID NO: 2331655 - DNA, 12 bp, Homo sapiens
tgtccaggcagc

SEQ ID NO: 2331656 - DNA, 23 bp, Homo sapiens
tgtccaggcagctccctcctgca

SEQ ID NO: 2331657 - DNA, 15 bp, Homo sapiens
tgtccagtgcctaca

SEQ ID NO: 2331658 - DNA, 18 bp, Homo sapiens
tgtcccaccatacgagca

SEQ ID NO: 2331659 - DNA, 16 bp, Homo sapiens
tgtcccagatgctgtc

SEQ ID NO: 2331660 - DNA, 12 bp, Homo sapiens
tgtcccagcccc

SEQ ID NO: 2331661 - DNA, 13 bp, Homo sapiens
tgtcccagtgctc

SEQ ID NO: 2331662 - DNA, 23 bp, Homo sapiens
tgtcccagtgctcaccagccctg

SEQ ID NO: 2331663 - DNA, 22 bp, Homo sapiens
tgtccccctttagatctctgaa

SEQ ID NO: 2331664 - DNA, 13 bp, Homo sapiens
tgtcccctcccag

SEQ ID NO: 2331665 - DNA, 17 bp, Homo sapiens
tgtcccggtaccttcca

SEQ ID NO: 2331666 - DNA, 17 bp, Homo sapiens
tgtccctgtagctcagt

SEQ ID NO: 2331667 - DNA, 18 bp, Homo sapiens
tgtccctgtagctcagtc

SEQ ID NO: 2331668 - DNA, 23 bp, Homo sapiens
tgtccgcctctgcccgcagagcc

SEQ ID NO: 2331669 - DNA, 19 bp, Homo sapiens
tgtccgtgaaagttgtgat

SEQ ID NO: 2331670 - DNA, 11 bp, Homo sapiens
tgtcctccttt

SEQ ID NO: 2331671 - DNA, 22 bp, Homo sapiens
tgtcctctgcaagcttcttgct

SEQ ID NO: 2331672 - DNA, 15 bp, Homo sapiens
tgtcctgcctgtctg

SEQ ID NO: 2331673 - DNA, 15 bp, Homo sapiens
tgtcctggtacagca

SEQ ID NO: 2331674 - DNA, 17 bp, Homo sapiens
tgtcctttatgtattct

SEQ ID NO: 2331675 - DNA, 12 bp, Homo sapiens
tgtcctttcctt

SEQ ID NO: 2331676 - DNA, 23 bp, Homo sapiens
tgtcctttttcactttgaaaagt

SEQ ID NO: 2331677 - DNA, 16 bp, Homo sapiens
tgtcctttttcctctc

SEQ ID NO: 2331678 - DNA, 18 bp, Homo sapiens
tgtcctttttcctctcca

SEQ ID NO: 2331679 - DNA, 21 bp, Homo sapiens
tgtcctttttcctctccacac

SEQ ID NO: 2331680 - DNA, 13 bp, Homo sapiens
tgtcgtgggatgg

SEQ ID NO: 2331681 - DNA, 14 bp, Homo sapiens
tgtcgtgggatggc

SEQ ID NO: 2331682 - DNA, 16 bp, Homo sapiens
tgtcgtgggatggcat

SEQ ID NO: 2331683 - DNA, 12 bp, Homo sapiens
tgtctaaagtgt

SEQ ID NO: 2331684 - DNA, 19 bp, Homo sapiens
tgtctagtgaggaagacaa

SEQ ID NO: 2331685 - DNA, 18 bp, Homo sapiens
tgtctattatcacattaa

SEQ ID NO: 2331686 - DNA, 15 bp, Homo sapiens
tgtctcatgttttat

SEQ ID NO: 2331687 - DNA, 22 bp, Homo sapiens
tgtctccacctacacccctgtg

SEQ ID NO: 2331688 - DNA, 18 bp, Homo sapiens
tgtctccctcccctctca

SEQ ID NO: 2331689 - DNA, 20 bp, Homo sapiens
tgtctccctcccctctcaga

SEQ ID NO: 2331690 - DNA, 18 bp, Homo sapiens
tgtctctcttctcagagt

SEQ ID NO: 2331691 - DNA, 20 bp, Homo sapiens
tgtctctcttctcagagtgg

SEQ ID NO: 2331692 - DNA, 14 bp, Homo sapiens
tgtctgccccagcc

SEQ ID NO: 2331693 - DNA, 11 bp, Homo sapiens
tgtctgctggt

SEQ ID NO: 2331694 - DNA, 15 bp, Homo sapiens
tgtctggaattgtgg

SEQ ID NO: 2331695 - DNA, 16 bp, Homo sapiens
tgtctgggtgctactg

SEQ ID NO: 2331696 - DNA, 15 bp, Homo sapiens
tgtctgtacacgtgt

SEQ ID NO: 2331697 - DNA, 19 bp, Homo sapiens
tgtctgtacacgtgtcctg

SEQ ID NO: 2331698 - DNA, 17 bp, Homo sapiens
tgtctgtagctcctcaa

SEQ ID NO: 2331699 - DNA, 21 bp, Homo sapiens
tgtctgtcccttttctttgac

SEQ ID NO: 2331700 - DNA, 14 bp, Homo sapiens
tgtctgttcagcaa

SEQ ID NO: 2331701 - DNA, 22 bp, Homo sapiens
tgtctgtttattaactactgaa

SEQ ID NO: 2331702 - DNA, 18 bp, Homo sapiens
tgtcttaaaaatttatac

SEQ ID NO: 2331703 - DNA, 14 bp, Homo sapiens
tgtcttatgtgaaa

SEQ ID NO: 2331704 - DNA, 17 bp, Homo sapiens
tgtcttcatgttgatgt

SEQ ID NO: 2331705 - DNA, 23 bp, Homo sapiens
tgtcttccctgggctgccaccag

SEQ ID NO: 2331706 - DNA, 16 bp, Homo sapiens
tgtcttcctcaaaata

SEQ ID NO: 2331707 - DNA, 12 bp, Homo sapiens
tgtcttctccct

SEQ ID NO: 2331708 - DNA, 19 bp, Homo sapiens
tgtcttggacactgtacaa

SEQ ID NO: 2331709 - DNA, 13 bp, Homo sapiens
tgtcttgtacatg

SEQ ID NO: 2331710 - DNA, 14 bp, Homo sapiens
tgtgatttctttaa

SEQ ID NO: 2331711 - DNA, 21 bp, Homo sapiens
tgtgcacatacgggctttaat

SEQ ID NO: 2331712 - DNA, 14 bp, Homo sapiens
tgtgcacatttctt

SEQ ID NO: 2331713 - DNA, 23 bp, Homo sapiens
tgtgcacctaccccttggaaatg

SEQ ID NO: 2331714 - DNA, 18 bp, Homo sapiens
tgtgcataatgataaaat

SEQ ID NO: 2331715 - DNA, 21 bp, Homo sapiens
tgtgcataatgataaaataaa

SEQ ID NO: 2331716 - DNA, 14 bp, Homo sapiens
tgtgcatagtttct

SEQ ID NO: 2331717 - DNA, 15 bp, Homo sapiens
tgtgcatagtttctt

SEQ ID NO: 2331718 - DNA, 22 bp, Homo sapiens
tgtgccaatacagacaaagcat

SEQ ID NO: 2331719 - DNA, 13 bp, Homo sapiens
tgtgccactgact

SEQ ID NO: 2331720 - DNA, 21 bp, Homo sapiens
tgtgccagaggaatcctggca

SEQ ID NO: 2331721 - DNA, 17 bp, Homo sapiens
tgtgccagatgccctgt

SEQ ID NO: 2331722 - DNA, 16 bp, Homo sapiens
tgtgccccatgtccaa

SEQ ID NO: 2331723 - DNA, 13 bp, Homo sapiens
tgtgctatactgc

SEQ ID NO: 2331724 - DNA, 21 bp, Homo sapiens
tgtgctatactgcatactttt

SEQ ID NO: 2331725 - DNA, 15 bp, Homo sapiens
tgtgctcagagacac

SEQ ID NO: 2331726 - DNA, 22 bp, Homo sapiens
tgtgctccatatttgatttcta

SEQ ID NO: 2331727 - DNA, 17 bp, Homo sapiens
tgtgctcccctgccaca

SEQ ID NO: 2331728 - DNA, 16 bp, Homo sapiens
tgtgctcctccttggt

SEQ ID NO: 2331729 - DNA, 15 bp, Homo sapiens
tgtgcttgaaggccc

SEQ ID NO: 2331730 - DNA, 21 bp, Homo sapiens
tgtgcttgaaggccctgctga

SEQ ID NO: 2331731 - DNA, 21 bp, Homo sapiens
tgtggagaccctgccacagcc

SEQ ID NO: 2331732 - DNA, 17 bp, Homo sapiens
tgtggaggaagagccac

SEQ ID NO: 2331733 - DNA, 15 bp, Homo sapiens
tgtggaggaaggatt

SEQ ID NO: 2331734 - DNA, 16 bp, Homo sapiens
tgtggaggaaggattg

SEQ ID NO: 2331735 - DNA, 20 bp, Homo sapiens
tgtggagttcaccttggaag

SEQ ID NO: 2331736 - DNA, 21 bp, Homo sapiens
tgtggagttcaccttggaagg

SEQ ID NO: 2331737 - DNA, 13 bp, Homo sapiens
tgtggataagaaa

SEQ ID NO: 2331738 - DNA, 18 bp, Homo sapiens
tgtggataagaaaaatgc

SEQ ID NO: 2331739 - DNA, 20 bp, Homo sapiens
tgtggatcaaccatcgcttt

SEQ ID NO: 2331740 - DNA, 15 bp, Homo sapiens
tgtggcaaactgaag

SEQ ID NO: 2331741 - DNA, 18 bp, Homo sapiens
tgtggcaatctgtgggct

SEQ ID NO: 2331742 - DNA, 19 bp, Homo sapiens
tgtggcaattagtgtgaca

SEQ ID NO: 2331743 - DNA, 12 bp, Homo sapiens
tgtggcagtggt

SEQ ID NO: 2331744 - DNA, 15 bp, Homo sapiens
tgtggcagtggtttt

SEQ ID NO: 2331745 - DNA, 16 bp, Homo sapiens
tgtggctagtgacaaa

SEQ ID NO: 2331746 - DNA, 12 bp, Homo sapiens
tgtggctggctc

SEQ ID NO: 2331747 - DNA, 11 bp, Homo sapiens
tgtggctttcc

SEQ ID NO: 2331748 - DNA, 18 bp, Homo sapiens
tgtggggcacagatgcct

SEQ ID NO: 2331749 - DNA, 13 bp, Homo sapiens
tgtgggggcttca

SEQ ID NO: 2331750 - DNA, 19 bp, Homo sapiens
tgtgggggcttcatctctt

SEQ ID NO: 2331751 - DNA, 19 bp, Homo sapiens
tgtgggtgggagtgtgtct

SEQ ID NO: 2331752 - DNA, 13 bp, Homo sapiens
tgtgggtgtcctg

SEQ ID NO: 2331753 - DNA, 21 bp, Homo sapiens
tgtgggtgttctttcctgccc

SEQ ID NO: 2331754 - DNA, 13 bp, Homo sapiens
tgtggttcctctg

SEQ ID NO: 2331755 - DNA, 15 bp, Homo sapiens
tgtgtacataactga

SEQ ID NO: 2331756 - DNA, 14 bp, Homo sapiens
tgtgtagcctgtgc

SEQ ID NO: 2331757 - DNA, 23 bp, Homo sapiens
tgtgtagcctgtgcatgtatgtc

SEQ ID NO: 2331758 - DNA, 14 bp, Homo sapiens
tgtgtattccaaga

SEQ ID NO: 2331759 - DNA, 19 bp, Homo sapiens
tgtgtatttccagtgcaat

SEQ ID NO: 2331760 - DNA, 17 bp, Homo sapiens
tgtgtcagctgaggctg

SEQ ID NO: 2331761 - DNA, 17 bp, Homo sapiens
tgtgtcccagatgctgt

SEQ ID NO: 2331762 - DNA, 18 bp, Homo sapiens
tgtgtcctccaggagctt

SEQ ID NO: 2331763 - DNA, 15 bp, Homo sapiens
tgtgtctaggcaggc

SEQ ID NO: 2331764 - DNA, 21 bp, Homo sapiens
tgtgtctgccaaacacattta

SEQ ID NO: 2331765 - DNA, 22 bp, Homo sapiens
tgtgtctgctgagtaaggaaca

SEQ ID NO: 2331766 - DNA, 20 bp, Homo sapiens
tgtgtctttggaggtgctgc

SEQ ID NO: 2331767 - DNA, 15 bp, Homo sapiens
tgtgtggctgtgggt

SEQ ID NO: 2331768 - DNA, 16 bp, Homo sapiens
tgtgtgtctcacccct

SEQ ID NO: 2331769 - DNA, 15 bp, Homo sapiens
tgtgtgtgtgtatga

SEQ ID NO: 2331770 - DNA, 20 bp, Homo sapiens
tgtgttcagctctttccaaa

SEQ ID NO: 2331771 - DNA, 12 bp, Homo sapiens
tgtgttcatttc

SEQ ID NO: 2331772 - DNA, 14 bp, Homo sapiens
tgtgttcatttcat

SEQ ID NO: 2331773 - DNA, 17 bp, Homo sapiens
tgtgttcccatttcagc

SEQ ID NO: 2331774 - DNA, 17 bp, Homo sapiens
tgtgttggtgtggccca

SEQ ID NO: 2331775 - DNA, 15 bp, Homo sapiens
tgtgtttatatggaa

SEQ ID NO: 2331776 - DNA, 18 bp, Homo sapiens
tgtgttttcaggttttgt

SEQ ID NO: 2331777 - DNA, 19 bp, Homo sapiens
tgtgttttcttcgtggatt

SEQ ID NO: 2331778 - DNA, 14 bp, Homo sapiens
tgtgttttttaaga

SEQ ID NO: 2331779 - DNA, 17 bp, Homo sapiens
tgtgttttttaagatag

SEQ ID NO: 2331780 - DNA, 14 bp, Homo sapiens
tgttaaatttgtaa

SEQ ID NO: 2331781 - DNA, 16 bp, Homo sapiens
tgttaaatttgtaagt

SEQ ID NO: 2331782 - DNA, 18 bp, Homo sapiens
tgttaacccattccagta

SEQ ID NO: 2331783 - DNA, 15 bp, Homo sapiens
tgttaaggaaactct

SEQ ID NO: 2331784 - DNA, 16 bp, Homo sapiens
tgttaaggaaactctt

SEQ ID NO: 2331785 - DNA, 24 bp, Homo sapiens
tgttaagtatcagctacaattgta

SEQ ID NO: 2331786 - DNA, 17 bp, Homo sapiens
tgttacctgtgtgcttg

SEQ ID NO: 2331787 - DNA, 22 bp, Homo sapiens
tgttacgtgaagaaataaatga

SEQ ID NO: 2331788 - DNA, 20 bp, Homo sapiens
tgttatgaacagctgtgtct

SEQ ID NO: 2331789 - DNA, 24 bp, Homo sapiens
tgttatgaacagctgtgtctgcca

SEQ ID NO: 2331790 - DNA, 18 bp, Homo sapiens
tgttatgatttccttcaa

SEQ ID NO: 2331791 - DNA, 13 bp, Homo sapiens
tgttatgttgtaa

SEQ ID NO: 2331792 - DNA, 15 bp, Homo sapiens
tgttattataacata

SEQ ID NO: 2331793 - DNA, 16 bp, Homo sapiens
tgttattattagataa

SEQ ID NO: 2331794 - DNA, 14 bp, Homo sapiens
tgttcagcagaacc

SEQ ID NO: 2331795 - DNA, 18 bp, Homo sapiens
tgttcagcagaacctgca

SEQ ID NO: 2331796 - DNA, 16 bp, Homo sapiens
ttcaggtgacatgtga

SEQ ID NO: 2331797 - DNA, 18 bp, Homo sapiens
ttcaggtgacatgtgaaa

SEQ ID NO: 2331798 - DNA, 22 bp, Homo sapiens
ttcaggtgacatgtgaaacctt

SEQ ID NO: 2331799 - DNA, 24 bp, Homo sapiens
ttcaggttatcgaaataacaatgt

SEQ ID NO: 2331800 - DNA, 20 bp, Homo sapiens
ttcagtaagttatctttgaa

SEQ ID NO: 2331801 - DNA, 16 bp, Homo sapiens
ttcagtgtaaagtgtg

SEQ ID NO: 2331802 - DNA, 18 bp, Homo sapiens
ttcagttgcttgtcttct

SEQ ID NO: 2331803 - DNA, 19 bp, Homo sapiens
ttcagttgcttgtcttctg

SEQ ID NO: 2331804 - DNA, 19 bp, Homo sapiens
ttcataagtattatgtctc

SEQ ID NO: 2331805 - DNA, 17 bp, Homo sapiens
ttcataataaattttct

SEQ ID NO: 2331806 - DNA, 22 bp, Homo sapiens
ttcataataaattttctaaaag

SEQ ID NO: 2331807 - DNA, 13 bp, Homo sapiens
ttcataatcagta

SEQ ID NO: 2331808 - DNA, 24 bp, Homo sapiens
ttcatatctatgggaaaaatctaa

SEQ ID NO: 2331809 - DNA, 19 bp, Homo sapiens
ttcatctggcaacatcttt

SEQ ID NO: 2331810 - DNA, 13 bp, Homo sapiens
ttcatcttcctgt

SEQ ID NO: 2331811 - DNA, 14 bp, Homo sapiens
ttcatcttcctgtg

SEQ ID NO: 2331812 - DNA, 18 bp, Homo sapiens
ttcatcttcctgtgtcct

SEQ ID NO: 2331813 - DNA, 15 bp, Homo sapiens
ttcatgaaaatacca

SEQ ID NO: 2331814 - DNA, 16 bp, Homo sapiens
ttcatgattatagcaa

SEQ ID NO: 2331815 - DNA, 23 bp, Homo sapiens
ttcatgattatagcaactaatgt

SEQ ID NO: 2331816 - DNA, 22 bp, Homo sapiens
ttcatggctgctgttgcttaaa

SEQ ID NO: 2331817 - DNA, 13 bp, Homo sapiens
ttcatgtaatttt

SEQ ID NO: 2331818 - DNA, 21 bp, Homo sapiens
ttcatgtaattttattttaaa

SEQ ID NO: 2331819 - DNA, 23 bp, Homo sapiens
ttcattatgcacttttagaaatg

SEQ ID NO: 2331820 - DNA, 13 bp, Homo sapiens
ttcattcatcctg

SEQ ID NO: 2331821 - DNA, 18 bp, Homo sapiens
ttcattcctaacacagca

SEQ ID NO: 2331822 - DNA, 11 bp, Homo sapiens
ttcatttcatt

SEQ ID NO: 2331823 - DNA, 21 bp, Homo sapiens
ttcatttcctagctgttctaa

SEQ ID NO: 2331824 - DNA, 21 bp, Homo sapiens
ttcatttgacacaaagcttct

SEQ ID NO: 2331825 - DNA, 18 bp, Homo sapiens
ttcatttgtatgtcaaag

SEQ ID NO: 2331826 - DNA, 12 bp, Homo sapiens
ttccaaatgaac

SEQ ID NO: 2331827 - DNA, 16 bp, Homo sapiens
ttccaaatgtccctcc

SEQ ID NO: 2331828 - DNA, 13 bp, Homo sapiens
ttccaaattcatg

SEQ ID NO: 2331829 - DNA, 21 bp, Homo sapiens
ttccaagacatgtctgttcta

SEQ ID NO: 2331830 - DNA, 21 bp, Homo sapiens
ttccaagcaaaatctaaaatg

SEQ ID NO: 2331831 - DNA, 16 bp, Homo sapiens
ttccaagttgctaata

SEQ ID NO: 2331832 - DNA, 22 bp, Homo sapiens
ttccacaggtcatcagatgcct

SEQ ID NO: 2331833 - DNA, 14 bp, Homo sapiens
ttccaccaggccgt

SEQ ID NO: 2331834 - DNA, 15 bp, Homo sapiens
ttccaccaggccgtg

SEQ ID NO: 2331835 - DNA, 14 bp, Homo sapiens
ttccactaaaaata

SEQ ID NO: 2331836 - DNA, 15 bp, Homo sapiens
ttccactacacctgg

SEQ ID NO: 2331837 - DNA, 18 bp, Homo sapiens
ttccactacacctggctg

SEQ ID NO: 2331838 - DNA, 21 bp, Homo sapiens
ttccagaaccacacttgaaac

SEQ ID NO: 2331839 - DNA, 14 bp, Homo sapiens
ttccagagccagaa

SEQ ID NO: 2331840 - DNA, 21 bp, Homo sapiens
ttccaggaaactccacatctg

SEQ ID NO: 2331841 - DNA, 22 bp, Homo sapiens
ttccaggaaactccacatctgc

SEQ ID NO: 2331842 - DNA, 23 bp, Homo sapiens
ttccaggaaactccacatctgcc

SEQ ID NO: 2331843 - DNA, 20 bp, Homo sapiens
ttccaggcttctgctggggc

SEQ ID NO: 2331844 - DNA, 22 bp, Homo sapiens
ttccaggcttctgctggggcct

SEQ ID NO: 2331845 - DNA, 20 bp, Homo sapiens
ttccagggatttgcctcacc

SEQ ID NO: 2331846 - DNA, 21 bp, Homo sapiens
ttccagggatttgcctcacct

SEQ ID NO: 2331847 - DNA, 17 bp, Homo sapiens
ttccagtgaacattccc

SEQ ID NO: 2331848 - DNA, 23 bp, Homo sapiens
ttccagtgaacattcccagccca

SEQ ID NO: 2331849 - DNA, 14 bp, Homo sapiens
ttccagtttctcct

SEQ ID NO: 2331850 - DNA, 16 bp, Homo sapiens
ttccagtttctccttg

SEQ ID NO: 2331851 - DNA, 17 bp, Homo sapiens
ttccatacttctctcag

SEQ ID NO: 2331852 - DNA, 21 bp, Homo sapiens
ttccatccatctttccatcca

SEQ ID NO: 2331853 - DNA, 22 bp, Homo sapiens
ttccatccattacctccatcca

SEQ ID NO: 2331854 - DNA, 21 bp, Homo sapiens
ttccatgcgtgtttctgactc

SEQ ID NO: 2331855 - DNA, 13 bp, Homo sapiens
ttccattttaatt

SEQ ID NO: 2331856 - DNA, 18 bp, Homo sapiens
ttccattttaattttaaa

SEQ ID NO: 2331857 - DNA, 22 bp, Homo sapiens
ttccattttttttcaaacaagt

SEQ ID NO: 2331858 - DNA, 15 bp, Homo sapiens
ttcccaatatcatgt

SEQ ID NO: 2331859 - DNA, 21 bp, Homo sapiens
ttcccaccccaacctgctctc

SEQ ID NO: 2331860 - DNA, 14 bp, Homo sapiens
ttcccatctgcacc

SEQ ID NO: 2331861 - DNA, 13 bp, Homo sapiens
ttcccatgtggaa

SEQ ID NO: 2331862 - DNA, 15 bp, Homo sapiens
ttcccatgtggaaca

SEQ ID NO: 2331863 - DNA, 14 bp, Homo sapiens
ttcccattaaaaat

SEQ ID NO: 2331864 - DNA, 19 bp, Homo sapiens
ttcccattaaaaatgagat

SEQ ID NO: 2331865 - DNA, 14 bp, Homo sapiens
ttcccatttcagct

SEQ ID NO: 2331866 - DNA, 15 bp, Homo sapiens
ttcccatttcagctg

SEQ ID NO: 2331867 - DNA, 19 bp, Homo sapiens
ttccccagctttgctgcct

SEQ ID NO: 2331868 - DNA, 20 bp, Homo sapiens
ttccccatcgttgcccccat

SEQ ID NO: 2331869 - DNA, 23 bp, Homo sapiens
ttcccccaccaccaaaactgctc

SEQ ID NO: 2331870 - DNA, 12 bp, Homo sapiens
ttcccctgtgtc

SEQ ID NO: 2331871 - DNA, 13 bp, Homo sapiens
ttccctccccaga

SEQ ID NO: 2331872 - DNA, 19 bp, Homo sapiens
ttccctcctagctctccca

SEQ ID NO: 2331873 - DNA, 12 bp, Homo sapiens
ttccctctctga

SEQ ID NO: 2331874 - DNA, 21 bp, Homo sapiens
ttccctctctgatgtcccagt

SEQ ID NO: 2331875 - DNA, 20 bp, Homo sapiens
ttccctgaacgttttcttct

SEQ ID NO: 2331876 - DNA, 11 bp, Homo sapiens
ttccctgcaga

SEQ ID NO: 2331877 - DNA, 23 bp, Homo sapiens
ttccctgcctctcatcaactgaa

SEQ ID NO: 2331878 - DNA, 15 bp, Homo sapiens
ttccctgcttccagg

SEQ ID NO: 2331879 - DNA, 12 bp, Homo sapiens
ttccctggacag

SEQ ID NO: 2331880 - DNA, 17 bp, Homo sapiens
ttccctggacaggcagc

SEQ ID NO: 2331881 - DNA, 18 bp, Homo sapiens
ttccctggacaggcagcc

SEQ ID NO: 2331882 - DNA, 20 bp, Homo sapiens
ttccctggacaggcagcctc

SEQ ID NO: 2331883 - DNA, 22 bp, Homo sapiens
ttccctggccgcttctccccag

SEQ ID NO: 2331884 - DNA, 23 bp, Homo sapiens
ttccctggccgcttctccccaga

SEQ ID NO: 2331885 - DNA, 21 bp, Homo sapiens
ttcccttattgcctcccaggc

SEQ ID NO: 2331886 - DNA, 14 bp, Homo sapiens
ttcccttccaaaga

SEQ ID NO: 2331887 - DNA, 14 bp, Homo sapiens
ttcccttctgggct

SEQ ID NO: 2331888 - DNA, 18 bp, Homo sapiens
ttccctttaccactgtgg

SEQ ID NO: 2331889 - DNA, 23 bp, Homo sapiens
ttccgtatctccctggagaagca

SEQ ID NO: 2331890 - DNA, 16 bp, Homo sapiens
ttccgtgcgtggcact

SEQ ID NO: 2331891 - DNA, 18 bp, Homo sapiens
ttcctaacacagcatgtg

SEQ ID NO: 2331892 - DNA, 15 bp, Homo sapiens
ttcctaaggcatgtg

SEQ ID NO: 2331893 - DNA, 21 bp, Homo sapiens
ttcctacaggcctatttaaca

SEQ ID NO: 2331894 - DNA, 14 bp, Homo sapiens
ttcctacccccgtc

SEQ ID NO: 2331895 - DNA, 13 bp, Homo sapiens
ttcctcacatttg

SEQ ID NO: 2331896 - DNA, 19 bp, Homo sapiens
ttcctcccagtgagactgc

SEQ ID NO: 2331897 - DNA, 20 bp, Homo sapiens
ttcctcctctgcctacagcc

SEQ ID NO: 2331898 - DNA, 15 bp, Homo sapiens
ttcctctagaagcca

SEQ ID NO: 2331899 - DNA, 21 bp, Homo sapiens
ttcctctccactgctggacat

SEQ ID NO: 2331900 - DNA, 20 bp, Homo sapiens
ttcctctgcccttcctgcag

SEQ ID NO: 2331901 - DNA, 14 bp, Homo sapiens
ttcctctgcctgcc

SEQ ID NO: 2331902 - DNA, 15 bp, Homo sapiens
ttcctcttgtctgat

SEQ ID NO: 2331903 - DNA, 13 bp, Homo sapiens
ttcctctttctgc

SEQ ID NO: 2331904 - DNA, 14 bp, Homo sapiens
ttcctctttctgct

SEQ ID NO: 2331905 - DNA, 22 bp, Homo sapiens
ttcctctttctgctctgccatc

SEQ ID NO: 2331906 - DNA, 16 bp, Homo sapiens
ttcctgccctgtccaa

SEQ ID NO: 2331907 - DNA, 12 bp, Homo sapiens
ttcctgctgctg

SEQ ID NO: 2331908 - DNA, 14 bp, Homo sapiens
ttcctgctgctgtc

SEQ ID NO: 2331909 - DNA, 17 bp, Homo sapiens
ttcctgctgctgtctgg

SEQ ID NO: 2331910 - DNA, 18 bp, Homo sapiens
ttcctgctgctgtctggg

SEQ ID NO: 2331911 - DNA, 21 bp, Homo sapiens
ttcctgctgctgtctgggtgc

SEQ ID NO: 2331912 - DNA, 21 bp, Homo sapiens
tttcacactggtaaatgttac

SEQ ID NO: 2331913 - DNA, 17 bp, Homo sapiens
tttcacattaggctgtt

SEQ ID NO: 2331914 - DNA, 13 bp, Homo sapiens
tttcacattttcc

SEQ ID NO: 2331915 - DNA, 14 bp, Homo sapiens
tttcacggaaactc

SEQ ID NO: 2331916 - DNA, 18 bp, Homo sapiens
tttcacttgtgttttaaa

SEQ ID NO: 2331917 - DNA, 16 bp, Homo sapiens
tttcactttattgcta

SEQ ID NO: 2331918 - DNA, 14 bp, Homo sapiens
tttcagaaatataa

SEQ ID NO: 2331919 - DNA, 21 bp, Homo sapiens
tttcagaaatataacacattt

SEQ ID NO: 2331920 - DNA, 22 bp, Homo sapiens
tttcagaaatataacacatttt

SEQ ID NO: 2331921 - DNA, 15 bp, Homo sapiens
tttcagaagcaagcc

SEQ ID NO: 2331922 - DNA, 16 bp, Homo sapiens
tttcagactgtgcaat

SEQ ID NO: 2331923 - DNA, 13 bp, Homo sapiens
tttcagggctggc

SEQ ID NO: 2331924 - DNA, 15 bp, Homo sapiens
tttcagggctggctc

SEQ ID NO: 2331925 - DNA, 13 bp, Homo sapiens
tttcaggtgacat

SEQ ID NO: 2331926 - DNA, 15 bp, Homo sapiens
tttcaggtgacatgt

SEQ ID NO: 2331927 - DNA, 16 bp, Homo sapiens
tttcaggtgacatgtg

SEQ ID NO: 2331928 - DNA, 20 bp, Homo sapiens
tttcagtcccctctctctgg

SEQ ID NO: 2331929 - DNA, 15 bp, Homo sapiens
tttcagttctaggaa

SEQ ID NO: 2331930 - DNA, 12 bp, Homo sapiens
tttcatgaaaaa

SEQ ID NO: 2331931 - DNA, 19 bp, Homo sapiens
tttcatgacataataaagt

SEQ ID NO: 2331932 - DNA, 22 bp, Homo sapiens
tttccaaaacaaaaagatgtct

SEQ ID NO: 2331933 - DNA, 17 bp, Homo sapiens
tttccaaacatccaaaa

SEQ ID NO: 2331934 - DNA, 17 bp, Homo sapiens
tttccaaattaaaacaa

SEQ ID NO: 2331935 - DNA, 20 bp, Homo sapiens
tttccaaattaaaacaaata

SEQ ID NO: 2331936 - DNA, 21 bp, Homo sapiens
tttccagaaccacacttgaaa

SEQ ID NO: 2331937 - DNA, 16 bp, Homo sapiens
tttccaggcttctgct

SEQ ID NO: 2331938 - DNA, 21 bp, Homo sapiens
tttcccaccccaacctgctct

SEQ ID NO: 2331939 - DNA, 23 bp, Homo sapiens
tttcccaccccaacctgctctcc

SEQ ID NO: 2331940 - DNA, 23 bp, Homo sapiens
tttcccactcattctgaattaat

SEQ ID NO: 2331941 - DNA, 12 bp, Homo sapiens
tttcccactcca

SEQ ID NO: 2331942 - DNA, 18 bp, Homo sapiens
tttccctccccagaatca

SEQ ID NO: 2331943 - DNA, 15 bp, Homo sapiens
tttcccttattgcct

SEQ ID NO: 2331944 - DNA, 14 bp, Homo sapiens
tttcccttccaaag

SEQ ID NO: 2331945 - DNA, 20 bp, Homo sapiens
tttccctttaccactgtggt

SEQ ID NO: 2331946 - DNA, 19 bp, Homo sapiens
tttcctagctgttctaatt

SEQ ID NO: 2331947 - DNA, 16 bp, Homo sapiens
tttcctatttcagtgt

SEQ ID NO: 2331948 - DNA, 13 bp, Homo sapiens
tttcctcccagtg

SEQ ID NO: 2331949 - DNA, 10 bp, Homo sapiens
tttcctcctg

SEQ ID NO: 2331950 - DNA, 22 bp, Homo sapiens
tttcctcgcagcctctcagtgc

SEQ ID NO: 2331951 - DNA, 14 bp, Homo sapiens
tttcctctccacac

SEQ ID NO: 2331952 - DNA, 12 bp, Homo sapiens
tttcctcttgtg

SEQ ID NO: 2331953 - DNA, 12 bp, Homo sapiens
tttcctgccctg

SEQ ID NO: 2331954 - DNA, 16 bp, Homo sapiens
tttcctggtgccaatt

SEQ ID NO: 2331955 - DNA, 22 bp, Homo sapiens
tttcctggtgccaatttcaagt

SEQ ID NO: 2331956 - DNA, 22 bp, Homo sapiens
tttcctgtggcataaattgcat

SEQ ID NO: 2331957 - DNA, 11 bp, Homo sapiens
tttccttccct

SEQ ID NO: 2331958 - DNA, 14 bp, Homo sapiens
tttccttctgtatt

SEQ ID NO: 2331959 - DNA, 18 bp, Homo sapiens
tttccttctgttaaaatg

SEQ ID NO: 2331960 - DNA, 13 bp, Homo sapiens
tttcctttatgtg

SEQ ID NO: 2331961 - DNA, 19 bp, Homo sapiens
tttcctttatgtgaatttt

SEQ ID NO: 2331962 - DNA, 18 bp, Homo sapiens
ttttaaattgtcataatt

SEQ ID NO: 2331963 - DNA, 12 bp, Homo sapiens
ttttaagaagac

SEQ ID NO: 2331964 - DNA, 12 bp, Homo sapiens
ttttaagatttc

SEQ ID NO: 2331965 - DNA, 12 bp, Homo sapiens
ttttaagatttt

SEQ ID NO: 2331966 - DNA, 23 bp, Homo sapiens
ttttaaggataaatcataaagtc

SEQ ID NO: 2331967 - DNA, 22 bp, Homo sapiens
ttttaatgtctgtttattaact

SEQ ID NO: 2331968 - DNA, 22 bp, Homo sapiens
ttttaccctggcccctctccct

SEQ ID NO: 2331969 - DNA, 19 bp, Homo sapiens
ttttacctagctaattatt

SEQ ID NO: 2331970 - DNA, 17 bp, Homo sapiens
ttttacttttaaactgt

SEQ ID NO: 2331971 - DNA, 18 bp, Homo sapiens
ttttacttttaaactgtg

SEQ ID NO: 2331972 - DNA, 19 bp, Homo sapiens
ttttagtgtgtgcataata

SEQ ID NO: 2331973 - DNA, 16 bp, Homo sapiens
ttttataattgtacaa

SEQ ID NO: 2331974 - DNA, 14 bp, Homo sapiens
ttttatatttcctt

SEQ ID NO: 2331975 - DNA, 20 bp, Homo sapiens
ttttatatttcctttatgtg

SEQ ID NO: 2331976 - DNA, 18 bp, Homo sapiens
ttttatgtttaaaatggc

SEQ ID NO: 2331977 - DNA, 21 bp, Homo sapiens
ttttatgtttaaaatggcatt

SEQ ID NO: 2331978 - DNA, 19 bp, Homo sapiens
ttttattaaaatatttcag

SEQ ID NO: 2331979 - DNA, 20 bp, Homo sapiens
ttttattaaagcatttccta

SEQ ID NO: 2331980 - DNA, 13 bp, Homo sapiens
ttttattatgtta

SEQ ID NO: 2331981 - DNA, 16 bp, Homo sapiens
ttttattcttatttca

SEQ ID NO: 2331982 - DNA, 15 bp, Homo sapiens
ttttattgagatttt

SEQ ID NO: 2331983 - DNA, 13 bp, Homo sapiens
ttttcaaacaagt

SEQ ID NO: 2331984 - DNA, 14 bp, Homo sapiens
ttttcaagattcta

SEQ ID NO: 2331985 - DNA, 17 bp, Homo sapiens
ttttcaagcaaaacagt

SEQ ID NO: 2331986 - DNA, 22 bp, Homo sapiens
ttttcaagcagcatcttctggt

SEQ ID NO: 2331987 - DNA, 15 bp, Homo sapiens
ttttcaatatattga

SEQ ID NO: 2331988 - DNA, 18 bp, Homo sapiens
ttttcaatatattgaact

SEQ ID NO: 2331989 - DNA, 20 bp, Homo sapiens
ttttcaccttttcaggaaaa

SEQ ID NO: 2331990 - DNA, 12 bp, Homo sapiens
ttttcagaagca

SEQ ID NO: 2331991 - DNA, 20 bp, Homo sapiens
ttttcagaagcaagccagac

SEQ ID NO: 2331992 - DNA, 14 bp, Homo sapiens
ttttcagactgtgc

SEQ ID NO: 2331993 - DNA, 20 bp, Homo sapiens
ttttcatgacataataaagt

SEQ ID NO: 2331994 - DNA, 14 bp, Homo sapiens
ttttcatttcatga

SEQ ID NO: 2331995 - DNA, 13 bp, Homo sapiens
ttttccaaaacaa

SEQ ID NO: 2331996 - DNA, 19 bp, Homo sapiens
ttttccaggcttctgctgg

SEQ ID NO: 2331997 - DNA, 20 bp, Homo sapiens
ttttccatgcgtgtttctga

SEQ ID NO: 2331998 - DNA, 17 bp, Homo sapiens
ttttcctaaagagagta

SEQ ID NO: 2331999 - DNA, 12 bp, Homo sapiens
ttttcctcccag

SEQ ID NO: 2332000 - DNA, 16 bp, Homo sapiens
ttttcctctccacaca

SEQ ID NO: 2332001 - DNA, 13 bp, Homo sapiens
ttttcctctggcc

SEQ ID NO: 2332002 - DNA, 16 bp, Homo sapiens
ttttcctcttgtgatt

SEQ ID NO: 2332003 - DNA, 14 bp, Homo sapiens
ttttctaaaagctt

SEQ ID NO: 2332004 - DNA, 14 bp, Homo sapiens
ttttctaaagactt

SEQ ID NO: 2332005 - DNA, 16 bp, Homo sapiens
ttttctaaataaaaat

SEQ ID NO: 2332006 - DNA, 15 bp, Homo sapiens
ttttctaagagaagt

SEQ ID NO: 2332007 - DNA, 13 bp, Homo sapiens
ttttctacagtgg

SEQ ID NO: 2332008 - DNA, 12 bp, Homo sapiens
ttttctacttta

SEQ ID NO: 2332009 - DNA, 22 bp, Homo sapiens
ttttctactttaaattgtggat

SEQ ID NO: 2332010 - DNA, 19 bp, Homo sapiens
ttttctattatttttataa

SEQ ID NO: 2332011 - DNA, 14 bp, Homo sapiens
ttttctcctctgct

SEQ ID NO: 2332012 - DNA, 14 bp, Homo sapiens
ttttctctttgtgg

SEQ ID NO: 2332013 - DNA, 22 bp, Homo sapiens
ttttctgaggatagtagttaaa

SEQ ID NO: 2332014 - DNA, 23 bp, Homo sapiens
ttttctgaggatagtagttaaat

SEQ ID NO: 2332015 - DNA, 16 bp, Homo sapiens
ttttctgccctggctg

SEQ ID NO: 2332016 - DNA, 17 bp, Homo sapiens
ttttctgtgcctgaata

SEQ ID NO: 2332017 - DNA, 18 bp, Homo sapiens
ttttctgtgcctgaatat

SEQ ID NO: 2332018 - DNA, 17 bp, Homo sapiens
ttttcttcactcaaatt

SEQ ID NO: 2332019 - DNA, 22 bp, Homo sapiens
ttttcttccaacatgtgatgtg

SEQ ID NO: 2332020 - DNA, 22 bp, Homo sapiens
ttttctttttttttaagttctt

SEQ ID NO: 2332021 - DNA, 23 bp, Homo sapiens
ttttgaaaagctattagccagga

SEQ ID NO: 2332022 - DNA, 22 bp, Homo sapiens
ttttgaaacaaagtactcttta

SEQ ID NO: 2332023 - DNA, 13 bp, Homo sapiens
ttttgacactgaa

SEQ ID NO: 2332024 - DNA, 15 bp, Homo sapiens
ttttgacatggaaat

SEQ ID NO: 2332025 - DNA, 11 bp, Homo sapiens
ttttgagctat

SEQ ID NO: 2332026 - DNA, 17 bp, Homo sapiens
ttttggcgaatctcaaa

SEQ ID NO: 2332027 - DNA, 16 bp, Homo sapiens
ttttgggttaaaagat

SEQ ID NO: 2332028 - DNA, 12 bp, Homo sapiens
ttttgtaaaaga

SEQ ID NO: 2332029 - DNA, 11 bp, Homo sapiens
ttttgtacatg

SEQ ID NO: 2332030 - DNA, 18 bp, Homo sapiens
ttttgtattttcatgaaa

SEQ ID NO: 2332031 - DNA, 19 bp, Homo sapiens
ttttgtctgtgataacaga

SEQ ID NO: 2332032 - DNA, 22 bp, Homo sapiens
ttgtgccatagtcacatggcct

SEQ ID NO: 2332033 - DNA, 13 bp, Homo sapiens
ttgtgctgcttct

SEQ ID NO: 2332034 - DNA, 16 bp, Homo sapiens
ttgtgcttcacagtag

SEQ ID NO: 2332035 - DNA, 15 bp, Homo sapiens
ttgtggataagaaaa

SEQ ID NO: 2332036 - DNA, 15 bp, Homo sapiens
ttgtggcaattttat

SEQ ID NO: 2332037 - DNA, 14 bp, Homo sapiens
ttgtgtctgtacac

SEQ ID NO: 2332038 - DNA, 14 bp, Homo sapiens
ttgtgtgaaattgc

SEQ ID NO: 2332039 - DNA, 20 bp, Homo sapiens
ttgtgtgtgtgtcagctgag

SEQ ID NO: 2332040 - DNA, 17 bp, Homo sapiens
ttgtgttttcttcgtgg

SEQ ID NO: 2332041 - DNA, 15 bp, Homo sapiens
ttgtgttttttaaga

SEQ ID NO: 2332042 - DNA, 16 bp, Homo sapiens
ttgtgttttttaagat

SEQ ID NO: 2332043 - DNA, 21 bp, Homo sapiens
ttgtgttttttaagatagtgt

SEQ ID NO: 2332044 - DNA, 21 bp, Homo sapiens
ttgttacaggcaccgagaatg

SEQ ID NO: 2332045 - DNA, 19 bp, Homo sapiens
ttgttatattataattgga

SEQ ID NO: 2332046 - DNA, 12 bp, Homo sapiens
ttgttatcaaaa

SEQ ID NO: 2332047 - DNA, 15 bp, Homo sapiens
ttgttattataacat

SEQ ID NO: 2332048 - DNA, 16 bp, Homo sapiens
ttgttcatcatccaga

SEQ ID NO: 2332049 - DNA, 18 bp, Homo sapiens
ttgttcttattctggcat

SEQ ID NO: 2332050 - DNA, 18 bp, Homo sapiens
ttgttgcaagatgtgaat

SEQ ID NO: 2332051 - DNA, 19 bp, Homo sapiens
ttgttgcaagatgtgaatt

SEQ ID NO: 2332052 - DNA, 20 bp, Homo sapiens
ttgttgcaagatgtgaatta

SEQ ID NO: 2332053 - DNA, 15 bp, Homo sapiens
ttgtttataataaaa

SEQ ID NO: 2332054 - DNA, 16 bp, Homo sapiens
ttgtttataataaaaa

SEQ ID NO: 2332055 - DNA, 12 bp, Homo sapiens
ttgtttctgaaa

SEQ ID NO: 2332056 - DNA, 12 bp, Homo sapiens
ttgttttacaat

SEQ ID NO: 2332057 - DNA, 12 bp, Homo sapiens
ttgttttttcat

SEQ ID NO: 2332058 - DNA, 16 bp, Homo sapiens
tttaaaaaaatttaag

SEQ ID NO: 2332059 - DNA, 17 bp, Homo sapiens
tttaaaaaaatttaagt

SEQ ID NO: 2332060 - DNA, 18 bp, Homo sapiens
tttaaaaaaatttaagtg

SEQ ID NO: 2332061 - DNA, 12 bp, Homo sapiens
tttaaaaaataa

SEQ ID NO: 2332062 - DNA, 22 bp, Homo sapiens
tttaaaaaataaataaaaacta

SEQ ID NO: 2332063 - DNA, 13 bp, Homo sapiens
tttaaaaacattt

SEQ ID NO: 2332064 - DNA, 15 bp, Homo sapiens
tttaaaacagacact

SEQ ID NO: 2332065 - DNA, 18 bp, Homo sapiens
tttaaaataaaatgaaaa

SEQ ID NO: 2332066 - DNA, 13 bp, Homo sapiens
tttaaaatagaaa

SEQ ID NO: 2332067 - DNA, 23 bp, Homo sapiens
tttaaaatagaaattttgtaaga

SEQ ID NO: 2332068 - DNA, 22 bp, Homo sapiens
tttaaaatggaaaattttctcc

SEQ ID NO: 2332069 - DNA, 21 bp, Homo sapiens
tttaaaatgtaatttaaatga

SEQ ID NO: 2332070 - DNA, 17 bp, Homo sapiens
tttaaaattttgtatgt

SEQ ID NO: 2332071 - DNA, 21 bp, Homo sapiens
tttaaacgtgatttttaaatt

SEQ ID NO: 2332072 - DNA, 17 bp, Homo sapiens
tttaaagaccctcctat

SEQ ID NO: 2332073 - DNA, 15 bp, Homo sapiens
tttaaagtatgcatt

SEQ ID NO: 2332074 - DNA, 14 bp, Homo sapiens
tttaaagtgcaaaa

SEQ ID NO: 2332075 - DNA, 16 bp, Homo sapiens
tttaaataaagaacaa

SEQ ID NO: 2332076 - DNA, 20 bp, Homo sapiens
tttaaatacccatcttcatt

SEQ ID NO: 2332077 - DNA, 18 bp, Homo sapiens
tttaaatttttttcctta

SEQ ID NO: 2332078 - DNA, 18 bp, Homo sapiens
tttaacatacaagaaaat

SEQ ID NO: 2332079 - DNA, 21 bp, Homo sapiens
tttaacatacaagaaaatgta

SEQ ID NO: 2332080 - DNA, 23 bp, Homo sapiens
tttaacattcttggtcacaaagc

SEQ ID NO: 2332081 - DNA, 23 bp, Homo sapiens
tttaaccggtaagagtttcagtt

SEQ ID NO: 2332082 - DNA, 16 bp, Homo sapiens
tttaacctatgatatt

SEQ ID NO: 2332083 - DNA, 14 bp, Homo sapiens
tttaactaaatttt

SEQ ID NO: 2332084 - DNA, 22 bp, Homo sapiens
tttaactcataatttttgcaga

SEQ ID NO: 2332085 - DNA, 16 bp, Homo sapiens
tttaacttaactgaaa

SEQ ID NO: 2332086 - DNA, 23 bp, Homo sapiens
cttggttcaataaagcactgagc

SEQ ID NO: 2332087 - DNA, 16 bp, Homo sapiens
cttggttctgtgaaca

SEQ ID NO: 2332088 - DNA, 14 bp, Homo sapiens
cttggtttgctagt

SEQ ID NO: 2332089 - DNA, 13 bp, Homo sapiens
cttgtaaagactg

SEQ ID NO: 2332090 - DNA, 13 bp, Homo sapiens
cttgtacatgtgt

SEQ ID NO: 2332091 - DNA, 14 bp, Homo sapiens
cttgtacatgtgta

SEQ ID NO: 2332092 - DNA, 22 bp, Homo sapiens
cttgtacatgtgtagcctgtgc

SEQ ID NO: 2332093 - DNA, 18 bp, Homo sapiens
cttgtactctacaaaata

SEQ ID NO: 2332094 - DNA, 15 bp, Homo sapiens
cttgtatttaaaaac

SEQ ID NO: 2332095 - DNA, 19 bp, Homo sapiens
cttgtatttaaaaacattt

SEQ ID NO: 2332096 - DNA, 14 bp, Homo sapiens
cttgtcccagccag

SEQ ID NO: 2332097 - DNA, 15 bp, Homo sapiens
cttgtcccagccagt

SEQ ID NO: 2332098 - DNA, 14 bp, Homo sapiens
cttgtctaaagatc

SEQ ID NO: 2332099 - DNA, 14 bp, Homo sapiens
cttgtcttttcaga

SEQ ID NO: 2332100 - DNA, 12 bp, Homo sapiens
cttgtcttttga

SEQ ID NO: 2332101 - DNA, 16 bp, Homo sapiens
cttgtcttttgagcta

SEQ ID NO: 2332102 - DNA, 14 bp, Homo sapiens
cttgtgacagtgcc

SEQ ID NO: 2332103 - DNA, 17 bp, Homo sapiens
cttgtgacagtgcctct

SEQ ID NO: 2332104 - DNA, 18 bp, Homo sapiens
cttgtgacagtgcctctt

SEQ ID NO: 2332105 - DNA, 22 bp, Homo sapiens
cttgtgacagtgcctcttccag

SEQ ID NO: 2332106 - DNA, 16 bp, Homo sapiens
cttgtgatttctttaa

SEQ ID NO: 2332107 - DNA, 21 bp, Homo sapiens
cttgtgcaaaatatttgacta

SEQ ID NO: 2332108 - DNA, 15 bp, Homo sapiens
cttgtggggcctggg

SEQ ID NO: 2332109 - DNA, 18 bp, Homo sapiens
cttgtggggcctgggagg

SEQ ID NO: 2332110 - DNA, 18 bp, Homo sapiens
cttgtgtctgtacacgtg

SEQ ID NO: 2332111 - DNA, 22 bp, Homo sapiens
cttgtgtctttggaggtgctgc

SEQ ID NO: 2332112 - DNA, 15 bp, Homo sapiens
cttgttatgttgtaa

SEQ ID NO: 2332113 - DNA, 22 bp, Homo sapiens
cttgttcatcatccagatgtgg

SEQ ID NO: 2332114 - DNA, 16 bp, Homo sapiens
cttgttgtttcttgcc

SEQ ID NO: 2332115 - DNA, 22 bp, Homo sapiens
cttgttgtttttaagtcctgta

SEQ ID NO: 2332116 - DNA, 13 bp, Homo sapiens
cttgtttccttgt

SEQ ID NO: 2332117 - DNA, 21 bp, Homo sapiens
cttgtttggtttggtttgctt

SEQ ID NO: 2332118 - DNA, 16 bp, Homo sapiens
ctttaaaagaatgact

SEQ ID NO: 2332119 - DNA, 12 bp, Homo sapiens
ctttaaatcatt

SEQ ID NO: 2332120 - DNA, 18 bp, Homo sapiens
ctttaagccttcaaaact

SEQ ID NO: 2332121 - DNA, 23 bp, Homo sapiens
ctttaataacaaggagatttctt

SEQ ID NO: 2332122 - DNA, 19 bp, Homo sapiens
ctttaatatactccttaaa

SEQ ID NO: 2332123 - DNA, 22 bp, Homo sapiens
ctttaattatatattttcatcc

SEQ ID NO: 2332124 - DNA, 19 bp, Homo sapiens
ctttaccactgtggttttg

SEQ ID NO: 2332125 - DNA, 16 bp, Homo sapiens
ctttacccatttgggt

SEQ ID NO: 2332126 - DNA, 14 bp, Homo sapiens
ctttacctgtatac

SEQ ID NO: 2332127 - DNA, 16 bp, Homo sapiens
ctttactttcaagtaa

SEQ ID NO: 2332128 - DNA, 15 bp, Homo sapiens
cctgcgggccagggt

SEQ ID NO: 2332129 - DNA, 13 bp, Homo sapiens
cctgcgtcctcct

SEQ ID NO: 2332130 - DNA, 15 bp, Homo sapiens
cctgcgtcctcctca

SEQ ID NO: 2332131 - DNA, 20 bp, Homo sapiens
cctgcgtcctcctcacctca

SEQ ID NO: 2332132 - DNA, 22 bp, Homo sapiens
cctgcgtcctcctcacctcatg

SEQ ID NO: 2332133 - DNA, 13 bp, Homo sapiens
cctgctcatccac

SEQ ID NO: 2332134 - DNA, 12 bp, Homo sapiens
cctgctctcctc

SEQ ID NO: 2332135 - DNA, 13 bp, Homo sapiens
cctgctctgtccc

SEQ ID NO: 2332136 - DNA, 21 bp, Homo sapiens
cctgctctgtgagccccacag

SEQ ID NO: 2332137 - DNA, 22 bp, Homo sapiens
cctgctctgtgagccccacagc

SEQ ID NO: 2332138 - DNA, 20 bp, Homo sapiens
cctgctgaacacagtgtctg

SEQ ID NO: 2332139 - DNA, 13 bp, Homo sapiens
cctgctgacctgt

SEQ ID NO: 2332140 - DNA, 16 bp, Homo sapiens
cctgctgacctgtgca

SEQ ID NO: 2332141 - DNA, 18 bp, Homo sapiens
cctgctgacctgtgcaca

SEQ ID NO: 2332142 - DNA, 23 bp, Homo sapiens
cctgctgagatgaggaggggagc

SEQ ID NO: 2332143 - DNA, 16 bp, Homo sapiens
cttctgagctatttca

SEQ ID NO: 2332144 - DNA, 18 bp, Homo sapiens
cttctgagctatttcatc

SEQ ID NO: 2332145 - DNA, 12 bp, Homo sapiens
cttctgagctcc

SEQ ID NO: 2332146 - DNA, 19 bp, Homo sapiens
cttctgagctcctgtcccc

SEQ ID NO: 2332147 - DNA, 14 bp, Homo sapiens
cttctgccttctca

SEQ ID NO: 2332148 - DNA, 18 bp, Homo sapiens
cttctgctggggcctggg

SEQ ID NO: 2332149 - DNA, 21 bp, Homo sapiens
cttctgctggggcctgggaca

SEQ ID NO: 2332150 - DNA, 16 bp, Homo sapiens
cttctgcttttctgcc

SEQ ID NO: 2332151 - DNA, 18 bp, Homo sapiens
cttctgcttttctgccct

SEQ ID NO: 2332152 - DNA, 20 bp, Homo sapiens
cttctgcttttctgccctgg

SEQ ID NO: 2332153 - DNA, 14 bp, Homo sapiens
cttctggaaactgt

SEQ ID NO: 2332154 - DNA, 17 bp, Homo sapiens
cttctgggcttcattct

SEQ ID NO: 2332155 - DNA, 21 bp, Homo sapiens
cttctgggcttcattctggaa

SEQ ID NO: 2332156 - DNA, 18 bp, Homo sapiens
cttctgggtagtcccctg

SEQ ID NO: 2332157 - DNA, 24 bp, Homo sapiens
cttctgggtagtcccctgttgatt

SEQ ID NO: 2332158 - DNA, 14 bp, Homo sapiens
cttctgtatttcct

SEQ ID NO: 2332159 - DNA, 15 bp, Homo sapiens
cttctgtatttcctt

SEQ ID NO: 2332160 - DNA, 15 bp, Homo sapiens
cttcttacatgcatt

SEQ ID NO: 2332161 - DNA, 20 bp, Homo sapiens
cttcttgaaacagcctgggt

SEQ ID NO: 2332162 - DNA, 13 bp, Homo sapiens
cttcttgaatata

SEQ ID NO: 2332163 - DNA, 17 bp, Homo sapiens
cttcttgtttccttgtt

SEQ ID NO: 2332164 - DNA, 14 bp, Homo sapiens
cttctttccctgga

SEQ ID NO: 2332165 - DNA, 19 bp, Homo sapiens
cttctttgataatgttaaa

SEQ ID NO: 2332166 - DNA, 23 bp, Homo sapiens
cttctttgttattataacataaa

SEQ ID NO: 2332167 - DNA, 15 bp, Homo sapiens
cttgaaacagcctgg

SEQ ID NO: 2332168 - DNA, 16 bp, Homo sapiens
cttgaaactttgggaa

SEQ ID NO: 2332169 - DNA, 23 bp, Homo sapiens
cttgaaactttgggaaaacatgt

SEQ ID NO: 2332170 - DNA, 21 bp, Homo sapiens
cttgaagcactacaggaggaa

SEQ ID NO: 2332171 - DNA, 12 bp, Homo sapiens
cttgaagccaaa

SEQ ID NO: 2332172 - DNA, 13 bp, Homo sapiens
cttgaagccaaag

SEQ ID NO: 2332173 - DNA, 15 bp, Homo sapiens
cttgaagccaaagaa

SEQ ID NO: 2332174 - DNA, 11 bp, Homo sapiens
cttgaagctgt

SEQ ID NO: 2332175 - DNA, 18 bp, Homo sapiens
cttgaaggccctgctgag

SEQ ID NO: 2332176 - DNA, 21 bp, Homo sapiens
cttgaaggccctgctgagtca

SEQ ID NO: 2332177 - DNA, 20 bp, Homo sapiens
cttgaagttgggtgtttcca

SEQ ID NO: 2332178 - DNA, 23 bp, Homo sapiens
cttgaagttgggtgtttccagaa

SEQ ID NO: 2332179 - DNA, 20 bp, Homo sapiens
cttgacgtttcttctttcta

SEQ ID NO: 2332180 - DNA, 18 bp, Homo sapiens
cttgagacaatgttttct

SEQ ID NO: 2332181 - DNA, 22 bp, Homo sapiens
ctttggaagtttagctctgaga

SEQ ID NO: 2332182 - DNA, 17 bp, Homo sapiens
ctttggacctaatccaa

SEQ ID NO: 2332183 - DNA, 14 bp, Homo sapiens
ctttggattctaaa

SEQ ID NO: 2332184 - DNA, 17 bp, Homo sapiens
ctttggccccactttga

SEQ ID NO: 2332185 - DNA, 14 bp, Homo sapiens
ctttggctgagacc

SEQ ID NO: 2332186 - DNA, 22 bp, Homo sapiens
ctttggggaatttttttttaag

SEQ ID NO: 2332187 - DNA, 23 bp, Homo sapiens
ctttgggggaggagaacatgagt

SEQ ID NO: 2332188 - DNA, 16 bp, Homo sapiens
ctttggtactaataat

SEQ ID NO: 2332189 - DNA, 21 bp, Homo sapiens
ctttggtactaataatcttgt

SEQ ID NO: 2332190 - DNA, 19 bp, Homo sapiens
ctttggttaagggctccct

SEQ ID NO: 2332191 - DNA, 19 bp, Homo sapiens
ctttggtttttttcttctg

SEQ ID NO: 2332192 - DNA, 18 bp, Homo sapiens
ctttgtaagagtgtagaa

SEQ ID NO: 2332193 - DNA, 19 bp, Homo sapiens
ctttgtaagagtgtagaag

SEQ ID NO: 2332194 - DNA, 15 bp, Homo sapiens
ctttgtaccaaaatt

SEQ ID NO: 2332195 - DNA, 13 bp, Homo sapiens
ctttgtagatcct

SEQ ID NO: 2332196 - DNA, 21 bp, Homo sapiens
ctttgtagatccttagaggtc

SEQ ID NO: 2332197 - DNA, 22 bp, Homo sapiens
ctttgtgattcaatctgtaaac

SEQ ID NO: 2332198 - DNA, 15 bp, Homo sapiens
ctttgtgtgtgtgtc

SEQ ID NO: 2332199 - DNA, 16 bp, Homo sapiens
ctttgtgttcatttca

SEQ ID NO: 2332200 - DNA, 18 bp, Homo sapiens
ctttgtgttcatttcatt

SEQ ID NO: 2332201 - DNA, 24 bp, Homo sapiens
ctttgttattataacataaaagca

SEQ ID NO: 2332202 - DNA, 22 bp, Homo sapiens
ctttgtttgtcacaagtggtgt

SEQ ID NO: 2332203 - DNA, 12 bp, Homo sapiens
cttttaaagacc

SEQ ID NO: 2332204 - DNA, 23 bp, Homo sapiens
cttttaaggataaatcataaagt

SEQ ID NO: 2332205 - DNA, 15 bp, Homo sapiens
cttttaccctggccc

SEQ ID NO: 2332206 - DNA, 20 bp, Homo sapiens
cttttaccttttttttttct

SEQ ID NO: 2332207 - DNA, 18 bp, Homo sapiens
cttttattcttctttctt

SEQ ID NO: 2332208 - DNA, 23 bp, Homo sapiens
cttttcagggctggctcctgatc

SEQ ID NO: 2332209 - DNA, 18 bp, Homo sapiens
cttttccaagcaaaatct

SEQ ID NO: 2332210 - DNA, 15 bp, Homo sapiens
cttttcccctttcct

SEQ ID NO: 2332211 - DNA, 16 bp, Homo sapiens
cttttcccctttcctg

SEQ ID NO: 2332212 - DNA, 18 bp, Homo sapiens
cttttcccctttcctgtc

SEQ ID NO: 2332213 - DNA, 20 bp, Homo sapiens
cttttccctgcttccaggaa

SEQ ID NO: 2332214 - DNA, 14 bp, Homo sapiens
cttttctaactttt

SEQ ID NO: 2332215 - DNA, 15 bp, Homo sapiens
cttttctaattaata

SEQ ID NO: 2332216 - DNA, 13 bp, Homo sapiens
cttttctgtattt

SEQ ID NO: 2332217 - DNA, 18 bp, Homo sapiens
cttttctgtggctggctc

SEQ ID NO: 2332218 - DNA, 15 bp, Homo sapiens
cttttcttaaacctt

SEQ ID NO: 2332219 - DNA, 22 bp, Homo sapiens
cttttgaaaagaccaagacttt

SEQ ID NO: 2332220 - DNA, 21 bp, Homo sapiens
cttttggctgcaagtaacaga

SEQ ID NO: 2332221 - DNA, 17 bp, Homo sapiens
cttttgtactgaatttt

SEQ ID NO: 2332222 - DNA, 12 bp, Homo sapiens
cttttgtttcca

SEQ ID NO: 2332223 - DNA, 13 bp, Homo sapiens
cttttgtttccat

SEQ ID NO: 2332224 - DNA, 12 bp, Homo sapiens
cttttgtttggt

SEQ ID NO: 2332225 - DNA, 21 bp, Homo sapiens
ctttttaaatgtaaagatatt

SEQ ID NO: 2332226 - DNA, 16 bp, Homo sapiens
ctttttaaattacctt

SEQ ID NO: 2332227 - DNA, 16 bp, Homo sapiens
ctttttaattgttgtt

SEQ ID NO: 2332228 - DNA, 22 bp, Homo sapiens
ctttttaattgttgtttctttc

SEQ ID NO: 2332229 - DNA, 21 bp, Homo sapiens
gaaactcacactcccctaggg

SEQ ID NO: 2332230 - DNA, 16 bp, Homo sapiens
gaaactccacatctgc

SEQ ID NO: 2332231 - DNA, 18 bp, Homo sapiens
gaaactccacatctgcct

SEQ ID NO: 2332232 - DNA, 14 bp, Homo sapiens
gaaactcttatctc

SEQ ID NO: 2332233 - DNA, 16 bp, Homo sapiens
gaaactcttatctcag

SEQ ID NO: 2332234 - DNA, 20 bp, Homo sapiens
gaaactcttatctcagtcat

SEQ ID NO: 2332235 - DNA, 23 bp, Homo sapiens
gaaactcttatctcagtcatgca

SEQ ID NO: 2332236 - DNA, 18 bp, Homo sapiens
gaaactggccatggcctg

SEQ ID NO: 2332237 - DNA, 19 bp, Homo sapiens
gaaactggccatggcctgc

SEQ ID NO: 2332238 - DNA, 12 bp, Homo sapiens
gaaactgtattt

SEQ ID NO: 2332239 - DNA, 18 bp, Homo sapiens
gaaacttggccagtttgt

SEQ ID NO: 2332240 - DNA, 20 bp, Homo sapiens
gaaagaggtaaaattctcta

SEQ ID NO: 2332241 - DNA, 16 bp, Homo sapiens
gaaagagtctgggacc

SEQ ID NO: 2332242 - DNA, 19 bp, Homo sapiens
gaaagatggttaaacattt

SEQ ID NO: 2332243 - DNA, 17 bp, Homo sapiens
gaaagcctctctctccc

SEQ ID NO: 2332244 - DNA, 20 bp, Homo sapiens
gaaagcgcggacgtgctggg

SEQ ID NO: 2332245 - DNA, 21 bp, Homo sapiens
gaaaggaggccctgttccctg

SEQ ID NO: 2332246 - DNA, 15 bp, Homo sapiens
gaaagggctggctcc

SEQ ID NO: 2332247 - DNA, 22 bp, Homo sapiens
gaaaggtgagtttgagctgcct

SEQ ID NO: 2332248 - DNA, 21 bp, Homo sapiens
gaaagtagggggctttctggg

SEQ ID NO: 2332249 - DNA, 10 bp, Homo sapiens
gaaagtcaga

SEQ ID NO: 2332250 - DNA, 22 bp, Homo sapiens
gaaagtgggcttaatggagttc

SEQ ID NO: 2332251 - DNA, 13 bp, Homo sapiens
gaaagttttgtaa

SEQ ID NO: 2332252 - DNA, 19 bp, Homo sapiens
gaaataaaccaaaggaaaa

SEQ ID NO: 2332253 - DNA, 20 bp, Homo sapiens
gaaataaagtaatttttata

SEQ ID NO: 2332254 - DNA, 18 bp, Homo sapiens
gaaataacaatgttaagg

SEQ ID NO: 2332255 - DNA, 20 bp, Homo sapiens
gaaataacaatgttaaggaa

SEQ ID NO: 2332256 - DNA, 13 bp, Homo sapiens
gaaataagagcag

SEQ ID NO: 2332257 - DNA, 18 bp, Homo sapiens
gaaataagtgccctctcc

SEQ ID NO: 2332258 - DNA, 13 bp, Homo sapiens
gaaataatttgaa

SEQ ID NO: 2332259 - DNA, 17 bp, Homo sapiens
gaaataatttgaatgta

SEQ ID NO: 2332260 - DNA, 21 bp, Homo sapiens
gaaataatttgaatgtatttg

SEQ ID NO: 2332261 - DNA, 16 bp, Homo sapiens
gaaatagaaagaagcc

SEQ ID NO: 2332262 - DNA, 17 bp, Homo sapiens
gaaatagaaagaagcca

SEQ ID NO: 2332263 - DNA, 19 bp, Homo sapiens
gaaatagaaagaagccata

SEQ ID NO: 2332264 - DNA, 19 bp, Homo sapiens
gaaatagacaaaaagtata

SEQ ID NO: 2332265 - DNA, 20 bp, Homo sapiens
gaaatatattacttaactgt

SEQ ID NO: 2332266 - DNA, 23 bp, Homo sapiens
gaaatattttctactttaaattg

SEQ ID NO: 2332267 - DNA, 20 bp, Homo sapiens
gaaatcacaatgagaaaaat

SEQ ID NO: 2332268 - DNA, 21 bp, Homo sapiens
gaaatcacaatgagaaaaata

SEQ ID NO: 2332269 - DNA, 14 bp, Homo sapiens
gaaatgaggtgcca

SEQ ID NO: 2332270 - DNA, 17 bp, Homo sapiens
gaaatggcgtctgctct

SEQ ID NO: 2332271 - DNA, 16 bp, Homo sapiens
gaaatgtacactacca

SEQ ID NO: 2332272 - DNA, 15 bp, Homo sapiens
gaaatgtctgctggt

SEQ ID NO: 2332273 - DNA, 15 bp, Homo sapiens
gaaatgttctgtcaa

SEQ ID NO: 2332274 - DNA, 21 bp, Homo sapiens
gaaatgtttttaataaaagaa

SEQ ID NO: 2332275 - DNA, 18 bp, Homo sapiens
gaaattaagcattttgaa

SEQ ID NO: 2332276 - DNA, 22 bp, Homo sapiens
gaaattactgcccacttgtcaa

SEQ ID NO: 2332277 - DNA, 15 bp, Homo sapiens
gaaattttatatgct

SEQ ID NO: 2332278 - DNA, 12 bp, Homo sapiens
gaaattttgtaa

SEQ ID NO: 2332279 - DNA, 13 bp, Homo sapiens
gaaattttgtaag

SEQ ID NO: 2332280 - DNA, 12 bp, Homo sapiens
gaacacagtgtc

SEQ ID NO: 2332281 - DNA, 14 bp, Homo sapiens
gaacacgattttca

SEQ ID NO: 2332282 - DNA, 22 bp, Homo sapiens
gaacactaactcaccagcccca

SEQ ID NO: 2332283 - DNA, 21 bp, Homo sapiens
gaacagagagacccttgtggg

SEQ ID NO: 2332284 - DNA, 20 bp, Homo sapiens
gaataatcacgctttcctga

SEQ ID NO: 2332285 - DNA, 21 bp, Homo sapiens
gaataatcacgctttcctgaa

SEQ ID NO: 2332286 - DNA, 13 bp, Homo sapiens
gaataatgaaaat

SEQ ID NO: 2332287 - DNA, 18 bp, Homo sapiens
gaataatgaaaataaaac

SEQ ID NO: 2332288 - DNA, 16 bp, Homo sapiens
gaataccacatcaaat

SEQ ID NO: 2332289 - DNA, 12 bp, Homo sapiens
gaatagcctggc

SEQ ID NO: 2332290 - DNA, 14 bp, Homo sapiens
gaatagcctggcca

SEQ ID NO: 2332291 - DNA, 16 bp, Homo sapiens
gaatatccatgaccta

SEQ ID NO: 2332292 - DNA, 23 bp, Homo sapiens
gaatcaagcaatccagcctcatg

SEQ ID NO: 2332293 - DNA, 16 bp, Homo sapiens
gaatcatgagcctgct

SEQ ID NO: 2332294 - DNA, 17 bp, Homo sapiens
gaatcatgagcctgctg

SEQ ID NO: 2332295 - DNA, 18 bp, Homo sapiens
gaatcatgagcctgctgg

SEQ ID NO: 2332296 - DNA, 14 bp, Homo sapiens
gaatccaagcctcc

SEQ ID NO: 2332297 - DNA, 17 bp, Homo sapiens
gaatccaagcctccaca

SEQ ID NO: 2332298 - DNA, 18 bp, Homo sapiens
gaatcccacccacatgtg

SEQ ID NO: 2332299 - DNA, 22 bp, Homo sapiens
gaatccctttgcacctgagacc

SEQ ID NO: 2332300 - DNA, 15 bp, Homo sapiens
gaatccgaagggaat

SEQ ID NO: 2332301 - DNA, 14 bp, Homo sapiens
gaatcctggcagcc

SEQ ID NO: 2332302 - DNA, 16 bp, Homo sapiens
gaatcctggcagccca

SEQ ID NO: 2332303 - DNA, 17 bp, Homo sapiens
gaatcctggcagcccag

SEQ ID NO: 2332304 - DNA, 20 bp, Homo sapiens
gaatcgctcctgcagcccca

SEQ ID NO: 2332305 - DNA, 19 bp, Homo sapiens
gaatctataagtagtaaat

SEQ ID NO: 2332306 - DNA, 15 bp, Homo sapiens
gaatctcaaaattag

SEQ ID NO: 2332307 - DNA, 22 bp, Homo sapiens
gaatctctgcctctcccaggct

SEQ ID NO: 2332308 - DNA, 12 bp, Homo sapiens
gaatctcttcac

SEQ ID NO: 2332309 - DNA, 19 bp, Homo sapiens
gaatctgcagggagcaact

SEQ ID NO: 2332310 - DNA, 11 bp, Homo sapiens
gaatcttctgg

SEQ ID NO: 2332311 - DNA, 16 bp, Homo sapiens
gaatcttgttttgaaa

SEQ ID NO: 2332312 - DNA, 19 bp, Homo sapiens
gaatctttgtaccaaaatt

SEQ ID NO: 2332313 - DNA, 23 bp, Homo sapiens
gaatgaaaataactgaatttgga

SEQ ID NO: 2332314 - DNA, 20 bp, Homo sapiens
gaatgaaattaacacaaagg

SEQ ID NO: 2332315 - DNA, 16 bp, Homo sapiens
gaatgaagcagtattt

SEQ ID NO: 2332316 - DNA, 19 bp, Homo sapiens
gaatgacggtaagtgttct

SEQ ID NO: 2332317 - DNA, 20 bp, Homo sapiens
gaatgacggtaagtgttctc

SEQ ID NO: 2332318 - DNA, 17 bp, Homo sapiens
gaatgagagttccttct

SEQ ID NO: 2332319 - DNA, 19 bp, Homo sapiens
gaatgagagttccttctca

SEQ ID NO: 2332320 - DNA, 14 bp, Homo sapiens
gaatgaggtgggag

SEQ ID NO: 2332321 - DNA, 15 bp, Homo sapiens
gaatgaggtgggagg

SEQ ID NO: 2332322 - DNA, 13 bp, Homo sapiens
gaatgccttggaa

SEQ ID NO: 2332323 - DNA, 19 bp, Homo sapiens
gaatggattggattattta

SEQ ID NO: 2332324 - DNA, 19 bp, Homo sapiens
gaatggtctttgctccaga

SEQ ID NO: 2332325 - DNA, 19 bp, Homo sapiens
gaatgtaaccaatcctact

SEQ ID NO: 2332326 - DNA, 20 bp, Homo sapiens
gaatgtaaggatgagggaag

SEQ ID NO: 2332327 - DNA, 23 bp, Homo sapiens
gaatgttagagtaatgaaatgga

SEQ ID NO: 2332328 - DNA, 15 bp, Homo sapiens
gaatgtttttccctc

SEQ ID NO: 2332329 - DNA, 16 bp, Homo sapiens
gaatgtttttccctcc

SEQ ID NO: 2332330 - DNA, 19 bp, Homo sapiens
gaatgtttttccctcccca

SEQ ID NO: 2332331 - DNA, 22 bp, Homo sapiens
gaattaaagtggaccaataggg

SEQ ID NO: 2332332 - DNA, 18 bp, Homo sapiens
gaattaattaatttggag

SEQ ID NO: 2332333 - DNA, 15 bp, Homo sapiens
gaattattgacactg

SEQ ID NO: 2332334 - DNA, 17 bp, Homo sapiens
gaattattgacactgaa

SEQ ID NO: 2332335 - DNA, 19 bp, Homo sapiens
gaattcataataaattttc

SEQ ID NO: 2332336 - DNA, 14 bp, Homo sapiens
gaattgaaatgagg

SEQ ID NO: 2332337 - DNA, 12 bp, Homo sapiens
gaattgtacaga

SEQ ID NO: 2332338 - DNA, 20 bp, Homo sapiens
gaattgtggctatcctgatt

SEQ ID NO: 2332339 - DNA, 22 bp, Homo sapiens
gaattgtgttttcaggttttgt

SEQ ID NO: 2332340 - DNA, 12 bp, Homo sapiens
gaatttcacctg

SEQ ID NO: 2332341 - DNA, 17 bp, Homo sapiens
gaatttcacctgtaaac

SEQ ID NO: 2332342 - DNA, 9 bp, Homo sapiens
gaatttgag

SEQ ID NO: 2332343 - DNA, 13 bp, Homo sapiens
gaatttgagaacc

SEQ ID NO: 2332344 - DNA, 13 bp, Homo sapiens
gaattttaaagta

SEQ ID NO: 2332345 - DNA, 16 bp, Homo sapiens
gaattttctaaaagct

SEQ ID NO: 2332346 - DNA, 14 bp, Homo sapiens
gaatttttttgtaa

SEQ ID NO: 2332347 - DNA, 18 bp, Homo sapiens
gacaaaaagtatattaaa

SEQ ID NO: 2332348 - DNA, 24 bp, Homo sapiens
gacaaaatttgagaatacataaac

SEQ ID NO: 2332349 - DNA, 16 bp, Homo sapiens
gacaaagccttaagca

SEQ ID NO: 2332350 - DNA, 22 bp, Homo sapiens
gacaaatattcctttgcatatt

SEQ ID NO: 2332351 - DNA, 20 bp, Homo sapiens
gacaacaggtaaaacagggc

SEQ ID NO: 2332352 - DNA, 18 bp, Homo sapiens
gacaaccattaaagtcag

SEQ ID NO: 2332353 - DNA, 22 bp, Homo sapiens
gacaactgctcccacctcctga

SEQ ID NO: 2332354 - DNA, 16 bp, Homo sapiens
gacaacttagctcagg

SEQ ID NO: 2332355 - DNA, 21 bp, Homo sapiens
gacaacttagctcaggtgcct

SEQ ID NO: 2332356 - DNA, 14 bp, Homo sapiens
gacaagagatggga

SEQ ID NO: 2332357 - DNA, 21 bp, Homo sapiens
gacaagtgacttatttgctca

SEQ ID NO: 2332358 - DNA, 17 bp, Homo sapiens
gacaatgttttcttcaa

SEQ ID NO: 2332359 - DNA, 18 bp, Homo sapiens
gacacaaagcttctaaag

SEQ ID NO: 2332360 - DNA, 19 bp, Homo sapiens
gacacattggaatgccttg

SEQ ID NO: 2332361 - DNA, 20 bp, Homo sapiens
gacacattggaatgccttgg

SEQ ID NO: 2332362 - DNA, 19 bp, Homo sapiens
gacacattttttaggaaat

SEQ ID NO: 2332363 - DNA, 19 bp, Homo sapiens
gacaccacttagatttaaa

SEQ ID NO: 2332364 - DNA, 13 bp, Homo sapiens
gacaccagagcag

SEQ ID NO: 2332365 - DNA, 19 bp, Homo sapiens
gacacccttctcccactct

SEQ ID NO: 2332366 - DNA, 13 bp, Homo sapiens
gacacgagccaca

SEQ ID NO: 2332367 - DNA, 14 bp, Homo sapiens
gacacgagccacaa

SEQ ID NO: 2332368 - DNA, 20 bp, Homo sapiens
gacacgagccacaagctgca

SEQ ID NO: 2332369 - DNA, 21 bp, Homo sapiens
gacactccagggacacacagc

SEQ ID NO: 2332370 - DNA, 16 bp, Homo sapiens
gacactcgtcacccca

SEQ ID NO: 2332371 - DNA, 18 bp, Homo sapiens
gacactcgtcaccccagc

SEQ ID NO: 2332372 - DNA, 21 bp, Homo sapiens
gacactctagtgacttcctgg

SEQ ID NO: 2332373 - DNA, 13 bp, Homo sapiens
gacagaggaaagg

SEQ ID NO: 2332374 - DNA, 18 bp, Homo sapiens
gacagaggagcttttctg

SEQ ID NO: 2332375 - DNA, 14 bp, Homo sapiens
gacagatattttat

SEQ ID NO: 2332376 - DNA, 15 bp, Homo sapiens
gacagatattttatc

SEQ ID NO: 2332377 - DNA, 22 bp, Homo sapiens
gacagatattttatctattggc

SEQ ID NO: 2332378 - DNA, 13 bp, Homo sapiens
gacagcagaagcc

SEQ ID NO: 2332379 - DNA, 21 bp, Homo sapiens
gacagcatcccttcccacatg

SEQ ID NO: 2332380 - DNA, 21 bp, Homo sapiens
gacagcccaggatactggcac

SEQ ID NO: 2332381 - DNA, 22 bp, Homo sapiens
gacagcttgagccgggcccctg

SEQ ID NO: 2332382 - DNA, 17 bp, Homo sapiens
gacagctttctgggatg

SEQ ID NO: 2332383 - DNA, 20 bp, Homo sapiens
gacagctttctgggatgtca

SEQ ID NO: 2332384 - DNA, 22 bp, Homo sapiens
gacaggatctataggcagcttc

SEQ ID NO: 2332385 - DNA, 17 bp, Homo sapiens
gacaggcagcccagcag

SEQ ID NO: 2332386 - DNA, 17 bp, Homo sapiens
gacaggtcttttcaaat

SEQ ID NO: 2332387 - DNA, 16 bp, Homo sapiens
gacagtatcccacatc

SEQ ID NO: 2332388 - DNA, 12 bp, Homo sapiens
gacagtttctta

SEQ ID NO: 2332389 - DNA, 20 bp, Homo sapiens
gacagtttcttagcttttta

SEQ ID NO: 2332390 - DNA, 15 bp, Homo sapiens
gacataaaggaaaag

SEQ ID NO: 2332391 - DNA, 14 bp, Homo sapiens
gacataacgttttt

SEQ ID NO: 2332392 - DNA, 22 bp, Homo sapiens
gacataacgtttttcctttaaa

SEQ ID NO: 2332393 - DNA, 14 bp, Homo sapiens
gacataagtaactt

SEQ ID NO: 2332394 - DNA, 16 bp, Homo sapiens
gacataataaagtatt

SEQ ID NO: 2332395 - DNA, 14 bp, Homo sapiens
gacatacagctgcc

SEQ ID NO: 2332396 - DNA, 15 bp, Homo sapiens
gacatggaaatgaag

SEQ ID NO: 2332397 - DNA, 18 bp, Homo sapiens
gacatggtgcctgagagg

SEQ ID NO: 2332398 - DNA, 19 bp, Homo sapiens
gacatggtgcctgagaggc

SEQ ID NO: 2332399 - DNA, 15 bp, Homo sapiens
gacatgtctgttcta

SEQ ID NO: 2332400 - DNA, 14 bp, Homo sapiens
gacatgtgaaacct

SEQ ID NO: 2332401 - DNA, 13 bp, Homo sapiens
gacattctcacat

SEQ ID NO: 2332402 - DNA, 20 bp, Homo sapiens
gaccaacctgctctgtcccc

SEQ ID NO: 2332403 - DNA, 21 bp, Homo sapiens
gaccaagactgagccagctta

SEQ ID NO: 2332404 - DNA, 15 bp, Homo sapiens
gaccactcttcttta

SEQ ID NO: 2332405 - DNA, 22 bp, Homo sapiens
gaccactcttctttaagccata

SEQ ID NO: 2332406 - DNA, 15 bp, Homo sapiens
gaccagaagccttgg

SEQ ID NO: 2332407 - DNA, 17 bp, Homo sapiens
gaccagaagccttggaa

SEQ ID NO: 2332408 - DNA, 18 bp, Homo sapiens
gaccagatctttctcttc

SEQ ID NO: 2332409 - DNA, 12 bp, Homo sapiens
gaccagccagca

SEQ ID NO: 2332410 - DNA, 19 bp, Homo sapiens
gaccaggccattctgccgc

SEQ ID NO: 2332411 - DNA, 17 bp, Homo sapiens
gaccagggccctgggca

SEQ ID NO: 2332412 - DNA, 14 bp, Homo sapiens
gaccagtactggga

SEQ ID NO: 2332413 - DNA, 23 bp, Homo sapiens
gaccatgccagattctgcctctc

SEQ ID NO: 2332414 - DNA, 15 bp, Homo sapiens
gaccattcaattagt

SEQ ID NO: 2332415 - DNA, 23 bp, Homo sapiens
gaccattttttaatttacttgtt

SEQ ID NO: 2332416 - DNA, 17 bp, Homo sapiens
gacccaagtcaaagatg

SEQ ID NO: 2332417 - DNA, 18 bp, Homo sapiens
gacccaggacccccgagg

SEQ ID NO: 2332418 - DNA, 22 bp, Homo sapiens
gacccagggaacagccactccc

SEQ ID NO: 2332419 - DNA, 20 bp, Homo sapiens
gaccccagtcgtgatgtgga

SEQ ID NO: 2332420 - DNA, 15 bp, Homo sapiens
gaccccattcctgat

SEQ ID NO: 2332421 - DNA, 22 bp, Homo sapiens
gaccccattcctgatcccatgg

SEQ ID NO: 2332422 - DNA, 21 bp, Homo sapiens
gacccccccccaatcggactg

SEQ ID NO: 2332423 - DNA, 23 bp, Homo sapiens
gacccccccccaatcggactgcc

SEQ ID NO: 2332424 - DNA, 21 bp, Homo sapiens
gacccccgaggggagggcagg

SEQ ID NO: 2332425 - DNA, 23 bp, Homo sapiens
gacccctgctcagtaaagcactt

SEQ ID NO: 2332426 - DNA, 20 bp, Homo sapiens
gacccctttgagagacgcca

SEQ ID NO: 2332427 - DNA, 21 bp, Homo sapiens
gacccctttgagagacgccac

SEQ ID NO: 2332428 - DNA, 20 bp, Homo sapiens
gaccctatgggtctaggaca

SEQ ID NO: 2332429 - DNA, 21 bp, Homo sapiens
gaccctcctccactccacctc

SEQ ID NO: 2332430 - DNA, 23 bp, Homo sapiens
gaccctcctccactccacctcca

SEQ ID NO: 2332431 - DNA, 13 bp, Homo sapiens
gaccctcttgccc

SEQ ID NO: 2332432 - DNA, 20 bp, Homo sapiens
gaccctcttgcccatcctga

SEQ ID NO: 2332433 - DNA, 22 bp, Homo sapiens
gaccctcttgcccatcctgact

SEQ ID NO: 2332434 - DNA, 18 bp, Homo sapiens
gaccctgaggccctgggc

SEQ ID NO: 2332435 - DNA, 19 bp, Homo sapiens
gaccctgaggccctgggct

SEQ ID NO: 2332436 - DNA, 20 bp, Homo sapiens
gaccctgaggccctgggctg

SEQ ID NO: 2332437 - DNA, 12 bp, Homo sapiens
gaccctgccaca

SEQ ID NO: 2332438 - DNA, 13 bp, Homo sapiens
gaccctgccacag

SEQ ID NO: 2332439 - DNA, 17 bp, Homo sapiens
gaccctgccacagccag

SEQ ID NO: 2332440 - DNA, 23 bp, Homo sapiens
gaccctgccacagccagaggagg

SEQ ID NO: 2332441 - DNA, 20 bp, Homo sapiens
gaccctgtgacatggtgcct

SEQ ID NO: 2332442 - DNA, 16 bp, Homo sapiens
gacccttattgctgtc

SEQ ID NO: 2332443 - DNA, 20 bp, Homo sapiens
gacccttattgctgtcctgg

SEQ ID NO: 2332444 - DNA, 12 bp, Homo sapiens
gaccctttgggg

SEQ ID NO: 2332445 - DNA, 16 bp, Homo sapiens
gaccgcgtagagagcc

SEQ ID NO: 2332446 - DNA, 19 bp, Homo sapiens
gaccggcggaccccagcca

SEQ ID NO: 2332447 - DNA, 21 bp, Homo sapiens
gaccgtgatttggaagagagg

SEQ ID NO: 2332448 - DNA, 17 bp, Homo sapiens
gacctaaagcaagcctg

SEQ ID NO: 2332449 - DNA, 19 bp, Homo sapiens
gagatgaggagtaaaattc

SEQ ID NO: 2332450 - DNA, 18 bp, Homo sapiens
gagatggagttcttgtgc

SEQ ID NO: 2332451 - DNA, 14 bp, Homo sapiens
gagatggttcccaa

SEQ ID NO: 2332452 - DNA, 17 bp, Homo sapiens
gagattggttttcctgt

SEQ ID NO: 2332453 - DNA, 22 bp, Homo sapiens
gagcaaaagcctcagaaaggga

SEQ ID NO: 2332454 - DNA, 15 bp, Homo sapiens
gagcaaaattcaaaa

SEQ ID NO: 2332455 - DNA, 14 bp, Homo sapiens
gagcaaacccagag

SEQ ID NO: 2332456 - DNA, 16 bp, Homo sapiens
gagcaactctccactc

SEQ ID NO: 2332457 - DNA, 16 bp, Homo sapiens
gagcacaaaattcaaa

SEQ ID NO: 2332458 - DNA, 22 bp, Homo sapiens
gagcaccgtgtcaagctgctct

SEQ ID NO: 2332459 - DNA, 17 bp, Homo sapiens
gagcacctccagcctga

SEQ ID NO: 2332460 - DNA, 15 bp, Homo sapiens
gagcagaacaggtag

SEQ ID NO: 2332461 - DNA, 14 bp, Homo sapiens
gagcagatgcagag

SEQ ID NO: 2332462 - DNA, 19 bp, Homo sapiens
gagcagatgcagagagcca

SEQ ID NO: 2332463 - DNA, 21 bp, Homo sapiens
gagcagatgcagagagccatt

SEQ ID NO: 2332464 - DNA, 17 bp, Homo sapiens
gagcagcagcttgggga

SEQ ID NO: 2332465 - DNA, 21 bp, Homo sapiens
gagcagcctctggacagccag

SEQ ID NO: 2332466 - DNA, 16 bp, Homo sapiens
gagcagctccctttct

SEQ ID NO: 2332467 - DNA, 20 bp, Homo sapiens
gagcagctccctttctcagg

SEQ ID NO: 2332468 - DNA, 22 bp, Homo sapiens
gagcaggcacgggtggtccccg

SEQ ID NO: 2332469 - DNA, 15 bp, Homo sapiens
gagcagggagagctc

SEQ ID NO: 2332470 - DNA, 18 bp, Homo sapiens
gagcagtcagagtccagt

SEQ ID NO: 2332471 - DNA, 21 bp, Homo sapiens
gagcagtcagagtccagtgct

SEQ ID NO: 2332472 - DNA, 20 bp, Homo sapiens
gagcagttggccaagcagaa

SEQ ID NO: 2332473 - DNA, 12 bp, Homo sapiens
gagcataattta

SEQ ID NO: 2332474 - DNA, 16 bp, Homo sapiens
gagccacaagctgcac

SEQ ID NO: 2332475 - DNA, 23 bp, Homo sapiens
gagccacaagctgcactgtgaac

SEQ ID NO: 2332476 - DNA, 14 bp, Homo sapiens
gagccacagtggga

SEQ ID NO: 2332477 - DNA, 14 bp, Homo sapiens
gagccaccgtgcct

SEQ ID NO: 2332478 - DNA, 21 bp, Homo sapiens
gagccaccgtgcctggccaga

SEQ ID NO: 2332479 - DNA, 23 bp, Homo sapiens
gagccaccgtgcctggccagatt

SEQ ID NO: 2332480 - DNA, 11 bp, Homo sapiens
gagccacctgc

SEQ ID NO: 2332481 - DNA, 12 bp, Homo sapiens
gagccacctgca

SEQ ID NO: 2332482 - DNA, 14 bp, Homo sapiens
gagccacctgcaag

SEQ ID NO: 2332483 - DNA, 21 bp, Homo sapiens
gagccagtgggccagccacag

SEQ ID NO: 2332484 - DNA, 14 bp, Homo sapiens
gagccatacataaa

SEQ ID NO: 2332485 - DNA, 22 bp, Homo sapiens
gagcccagggcatcttgctggc

SEQ ID NO: 2332486 - DNA, 13 bp, Homo sapiens
gagccccaagcag

SEQ ID NO: 2332487 - DNA, 16 bp, Homo sapiens
gagccccacagccctg

SEQ ID NO: 2332488 - DNA, 16 bp, Homo sapiens
gagccccagtgctgga

SEQ ID NO: 2332489 - DNA, 14 bp, Homo sapiens
gagcccccaccctg

SEQ ID NO: 2332490 - DNA, 15 bp, Homo sapiens
gagcccccagcagag

SEQ ID NO: 2332491 - DNA, 19 bp, Homo sapiens
gagcccccagcagaggcag

SEQ ID NO: 2332492 - DNA, 23 bp, Homo sapiens
gagcccccagcagaggcaggctg

SEQ ID NO: 2332493 - DNA, 20 bp, Homo sapiens
gagcccgcagggccatgcag

SEQ ID NO: 2332494 - DNA, 17 bp, Homo sapiens
gagcccttgcctcccca

SEQ ID NO: 2332495 - DNA, 12 bp, Homo sapiens
gagccgcgggga

SEQ ID NO: 2332496 - DNA, 11 bp, Homo sapiens
gagcctcccca

SEQ ID NO: 2332497 - DNA, 21 bp, Homo sapiens
gagcctccccatctgtccagc

SEQ ID NO: 2332498 - DNA, 11 bp, Homo sapiens
gagcctgctgg

SEQ ID NO: 2332499 - DNA, 12 bp, Homo sapiens
gagcctgctggc

SEQ ID NO: 2332500 - DNA, 13 bp, Homo sapiens
gagccttctcaga

SEQ ID NO: 2332501 - DNA, 18 bp, Homo sapiens
gagcgccaggaagccaga

SEQ ID NO: 2332502 - DNA, 19 bp, Homo sapiens
gagctaaactccttcctgg

SEQ ID NO: 2332503 - DNA, 14 bp, Homo sapiens
gagctagctgccac

SEQ ID NO: 2332504 - DNA, 17 bp, Homo sapiens
gagctatcctttcaaac

SEQ ID NO: 2332505 - DNA, 17 bp, Homo sapiens
gagctattttcctctgg

SEQ ID NO: 2332506 - DNA, 21 bp, Homo sapiens
gagctcttcctatccctctcc

SEQ ID NO: 2332507 - DNA, 18 bp, Homo sapiens
gagctgagcagcctctgg

SEQ ID NO: 2332508 - DNA, 20 bp, Homo sapiens
gagctgagcagcctctggac

SEQ ID NO: 2332509 - DNA, 11 bp, Homo sapiens
gagctgccttc

SEQ ID NO: 2332510 - DNA, 14 bp, Homo sapiens
gagctggagccccc

SEQ ID NO: 2332511 - DNA, 15 bp, Homo sapiens
gagctggagccccca

SEQ ID NO: 2332512 - DNA, 19 bp, Homo sapiens
gagctggagcccccagcag

SEQ ID NO: 2332513 - DNA, 18 bp, Homo sapiens
gagctggatagacttggg

SEQ ID NO: 2332514 - DNA, 19 bp, Homo sapiens
gagctggatagacttggga

SEQ ID NO: 2332515 - DNA, 21 bp, Homo sapiens
gagctggatagacttgggatg

SEQ ID NO: 2332516 - DNA, 11 bp, Homo sapiens
gagctggcctc

SEQ ID NO: 2332517 - DNA, 13 bp, Homo sapiens
gagcttgctccag

SEQ ID NO: 2332518 - DNA, 18 bp, Homo sapiens
gagctttctcaatgtctt

SEQ ID NO: 2332519 - DNA, 13 bp, Homo sapiens
gaggaaaattctt

SEQ ID NO: 2332520 - DNA, 17 bp, Homo sapiens
gaggaagacaagcattt

SEQ ID NO: 2332521 - DNA, 13 bp, Homo sapiens
gaggaagagccac

SEQ ID NO: 2332522 - DNA, 15 bp, Homo sapiens
gaggaagagccacct

SEQ ID NO: 2332523 - DNA, 16 bp, Homo sapiens
gaggaaggcctttctt

SEQ ID NO: 2332524 - DNA, 17 bp, Homo sapiens
gaggaagtggggtctgg

SEQ ID NO: 2332525 - DNA, 20 bp, Homo sapiens
gaggaatcctggcagcccag

SEQ ID NO: 2332526 - DNA, 18 bp, Homo sapiens
gaggacagcttgagccgg

SEQ ID NO: 2332527 - DNA, 20 bp, Homo sapiens
gaggagcccccaccctgttc

SEQ ID NO: 2332528 - DNA, 23 bp, Homo sapiens
gaggagcccccaccctgttcctg

SEQ ID NO: 2332529 - DNA, 12 bp, Homo sapiens
gaggagggcaga

SEQ ID NO: 2332530 - DNA, 13 bp, Homo sapiens
gaggagggcagag

SEQ ID NO: 2332531 - DNA, 11 bp, Homo sapiens
gaggaggggag

SEQ ID NO: 2332532 - DNA, 21 bp, Homo sapiens
gaggagtaaaattcagttttt

SEQ ID NO: 2332533 - DNA, 14 bp, Homo sapiens
gaggagtgcagcct

SEQ ID NO: 2332534 - DNA, 16 bp, Homo sapiens
gaggagtgcagccttc

SEQ ID NO: 2332535 - DNA, 21 bp, Homo sapiens
gaggagtgcagccttctccat

SEQ ID NO: 2332536 - DNA, 17 bp, Homo sapiens
gaggatgagagcccaga

SEQ ID NO: 2332537 - DNA, 18 bp, Homo sapiens
gaggatgagagcccagag

SEQ ID NO: 2332538 - DNA, 16 bp, Homo sapiens
gaggatgccttttctg

SEQ ID NO: 2332539 - DNA, 17 bp, Homo sapiens
gaggatgggtcagagct

SEQ ID NO: 2332540 - DNA, 20 bp, Homo sapiens
gaggatttaagggatggaaa

SEQ ID NO: 2332541 - DNA, 15 bp, Homo sapiens
gaggcacttccacct

SEQ ID NO: 2332542 - DNA, 19 bp, Homo sapiens
gaggcatacacacagcagt

SEQ ID NO: 2332543 - DNA, 22 bp, Homo sapiens
gaggccagttgatctgctctgt

SEQ ID NO: 2332544 - DNA, 21 bp, Homo sapiens
gaggccatgtgcatagtttct

SEQ ID NO: 2332545 - DNA, 22 bp, Homo sapiens
gaggccatgtgcatagtttctt

SEQ ID NO: 2332546 - DNA, 19 bp, Homo sapiens
gaggccattgtgtgagcct

SEQ ID NO: 2332547 - DNA, 15 bp, Homo sapiens
gaggcccagcctgtc

SEQ ID NO: 2332548 - DNA, 14 bp, Homo sapiens
gaggccctgggctg

SEQ ID NO: 2332549 - DNA, 18 bp, Homo sapiens
gaggcccttgtcgtggga

SEQ ID NO: 2332550 - DNA, 14 bp, Homo sapiens
gaggcctcaggtgc

SEQ ID NO: 2332551 - DNA, 22 bp, Homo sapiens
gaggcctcaggtgctgtccatg

SEQ ID NO: 2332552 - DNA, 18 bp, Homo sapiens
gaggcctgaagccagctg

SEQ ID NO: 2332553 - DNA, 13 bp, Homo sapiens
gaggcggaggctg

SEQ ID NO: 2332554 - DNA, 18 bp, Homo sapiens
gaggcggaggctgtgctc

SEQ ID NO: 2332555 - DNA, 19 bp, Homo sapiens
gaggcggtggtagagagag

SEQ ID NO: 2332556 - DNA, 15 bp, Homo sapiens
gaggctgaggcagga

SEQ ID NO: 2332557 - DNA, 16 bp, Homo sapiens
gaggctgcacccctgg

SEQ ID NO: 2332558 - DNA, 19 bp, Homo sapiens
gaggctgcacccctgggcc

SEQ ID NO: 2332559 - DNA, 18 bp, Homo sapiens
gaggctgcccctctcacc

SEQ ID NO: 2332560 - DNA, 13 bp, Homo sapiens
gaggctgtgctcc

SEQ ID NO: 2332561 - DNA, 15 bp, Homo sapiens
gaggcttcctgcgtc

SEQ ID NO: 2332562 - DNA, 21 bp, Homo sapiens
gaggcttcctgcgtcctcctc

SEQ ID NO: 2332563 - DNA, 19 bp, Homo sapiens
gaggcttctccgccagcct

SEQ ID NO: 2332564 - DNA, 15 bp, Homo sapiens
gatctataggcagct

SEQ ID NO: 2332565 - DNA, 13 bp, Homo sapiens
gatctcactctgc

SEQ ID NO: 2332566 - DNA, 22 bp, Homo sapiens
gatctcagctttgagaagcctt

SEQ ID NO: 2332567 - DNA, 11 bp, Homo sapiens
gatctctgaag

SEQ ID NO: 2332568 - DNA, 22 bp, Homo sapiens
gatctgagaacacgttgccagg

SEQ ID NO: 2332569 - DNA, 23 bp, Homo sapiens
gatctgagaacacgttgccaggg

SEQ ID NO: 2332570 - DNA, 17 bp, Homo sapiens
gatctgcggatctcagc

SEQ ID NO: 2332571 - DNA, 17 bp, Homo sapiens
gatctgctgaggcccag

SEQ ID NO: 2332572 - DNA, 21 bp, Homo sapiens
gatctgggcattttcctcctc

SEQ ID NO: 2332573 - DNA, 22 bp, Homo sapiens
gatctgggcattttcctcctct

SEQ ID NO: 2332574 - DNA, 13 bp, Homo sapiens
gatctgttgtaat

SEQ ID NO: 2332575 - DNA, 15 bp, Homo sapiens
gatctttcagaaata

SEQ ID NO: 2332576 - DNA, 18 bp, Homo sapiens
gatctttcagaaatataa

SEQ ID NO: 2332577 - DNA, 12 bp, Homo sapiens
gatctttctctt

SEQ ID NO: 2332578 - DNA, 14 bp, Homo sapiens
gatctttctcttcc

SEQ ID NO: 2332579 - DNA, 16 bp, Homo sapiens
gatcttttaaaatcat

SEQ ID NO: 2332580 - DNA, 22 bp, Homo sapiens
gatctttttttaagtgttctgt

SEQ ID NO: 2332581 - DNA, 14 bp, Homo sapiens
gatgaacatctaac

SEQ ID NO: 2332582 - DNA, 23 bp, Homo sapiens
gatgaagaccctatctcccacaa

SEQ ID NO: 2332583 - DNA, 17 bp, Homo sapiens
gatgagagcccagaggt

SEQ ID NO: 2332584 - DNA, 18 bp, Homo sapiens
gatgagagcccagaggta

SEQ ID NO: 2332585 - DNA, 23 bp, Homo sapiens
gatgattttcatttcatgaaaat

SEQ ID NO: 2332586 - DNA, 18 bp, Homo sapiens
gatgattttttgaaagtt

SEQ ID NO: 2332587 - DNA, 14 bp, Homo sapiens
gatgcatttaataa

SEQ ID NO: 2332588 - DNA, 23 bp, Homo sapiens
gatgccaatttcctctccactgc

SEQ ID NO: 2332589 - DNA, 15 bp, Homo sapiens
gatgccaccggcctg

SEQ ID NO: 2332590 - DNA, 15 bp, Homo sapiens
gatgccttttctgtg

SEQ ID NO: 2332591 - DNA, 21 bp, Homo sapiens
gatgctgggcaatgaggcaga

SEQ ID NO: 2332592 - DNA, 14 bp, Homo sapiens
gatgcttctctcct

SEQ ID NO: 2332593 - DNA, 20 bp, Homo sapiens
gatgcttgcggcaaaaggaa

SEQ ID NO: 2332594 - DNA, 15 bp, Homo sapiens
gatggaaaaggaaga

SEQ ID NO: 2332595 - DNA, 17 bp, Homo sapiens
gatggacacgagccaca

SEQ ID NO: 2332596 - DNA, 23 bp, Homo sapiens
gatggacacgagccacaagctgc

SEQ ID NO: 2332597 - DNA, 20 bp, Homo sapiens
gatggcatttggtctcaggc

SEQ ID NO: 2332598 - DNA, 20 bp, Homo sapiens
gatggccagcccctggggcc

SEQ ID NO: 2332599 - DNA, 18 bp, Homo sapiens
gatggccgtggatggccg

SEQ ID NO: 2332600 - DNA, 17 bp, Homo sapiens
gatggccttaatttcct

SEQ ID NO: 2332601 - DNA, 17 bp, Homo sapiens
gatggctcaagacaagg

SEQ ID NO: 2332602 - DNA, 13 bp, Homo sapiens
gatggcttgtcta

SEQ ID NO: 2332603 - DNA, 23 bp, Homo sapiens
gatgggaatgaggtgggaggtgg

SEQ ID NO: 2332604 - DNA, 17 bp, Homo sapiens
gatgggggcagggctgt

SEQ ID NO: 2332605 - DNA, 20 bp, Homo sapiens
gatgggggcagggctgtgct

SEQ ID NO: 2332606 - DNA, 15 bp, Homo sapiens
gatgggtccaggggt

SEQ ID NO: 2332607 - DNA, 15 bp, Homo sapiens
gatggtaagagaaaa

SEQ ID NO: 2332608 - DNA, 15 bp, Homo sapiens
gatggtatcatatat

SEQ ID NO: 2332609 - DNA, 19 bp, Homo sapiens
gatggtgtggcctgtggct

SEQ ID NO: 2332610 - DNA, 14 bp, Homo sapiens
gatggttgtagcat

SEQ ID NO: 2332611 - DNA, 15 bp, Homo sapiens
gatgtcagccttgca

SEQ ID NO: 2332612 - DNA, 22 bp, Homo sapiens
gatgtcccagtgctcaccagcc

SEQ ID NO: 2332613 - DNA, 23 bp, Homo sapiens
gatgtctttttattaaaatattt

SEQ ID NO: 2332614 - DNA, 20 bp, Homo sapiens
gatgtgaattattgacactg

SEQ ID NO: 2332615 - DNA, 23 bp, Homo sapiens
gatgtgagccaccgtgcctggcc

SEQ ID NO: 2332616 - DNA, 17 bp, Homo sapiens
gatgtggaggaagagcc

SEQ ID NO: 2332617 - DNA, 18 bp, Homo sapiens
gatgtggaggaagagcca

SEQ ID NO: 2332618 - DNA, 20 bp, Homo sapiens
gatgtggaggaagagccacc

SEQ ID NO: 2332619 - DNA, 23 bp, Homo sapiens
gatgtggccctggctgccggcac

SEQ ID NO: 2332620 - DNA, 21 bp, Homo sapiens
gatgtgtccgtgaaagttgtg

SEQ ID NO: 2332621 - DNA, 17 bp, Homo sapiens
gatgtgtgcaatgtggc

SEQ ID NO: 2332622 - DNA, 13 bp, Homo sapiens
gattaataaaata

SEQ ID NO: 2332623 - DNA, 15 bp, Homo sapiens
gattaataaaatatc

SEQ ID NO: 2332624 - DNA, 17 bp, Homo sapiens
gattatagtaactataa

SEQ ID NO: 2332625 - DNA, 23 bp, Homo sapiens
gattatagtaactataagataca

SEQ ID NO: 2332626 - DNA, 20 bp, Homo sapiens
gattatcttcagcccaggct

SEQ ID NO: 2332627 - DNA, 14 bp, Homo sapiens
gattatttaataac

SEQ ID NO: 2332628 - DNA, 17 bp, Homo sapiens
gattattttttttttct

SEQ ID NO: 2332629 - DNA, 15 bp, Homo sapiens
gattcagggaaagtg

SEQ ID NO: 2332630 - DNA, 16 bp, Homo sapiens
gattctaaagctcaat

SEQ ID NO: 2332631 - DNA, 16 bp, Homo sapiens
gattctctctttaacc

SEQ ID NO: 2332632 - DNA, 15 bp, Homo sapiens
gattctgatgcatac

SEQ ID NO: 2332633 - DNA, 17 bp, Homo sapiens
gattcttgattcctggc

SEQ ID NO: 2332634 - DNA, 14 bp, Homo sapiens
gattggaccaggcc

SEQ ID NO: 2332635 - DNA, 15 bp, Homo sapiens
gattggaccaggcca

SEQ ID NO: 2332636 - DNA, 20 bp, Homo sapiens
gattggattatttaataaca

SEQ ID NO: 2332637 - DNA, 13 bp, Homo sapiens
gaacagctgtgtc

SEQ ID NO: 2332638 - DNA, 16 bp, Homo sapiens
gaacagcttcaggtta

SEQ ID NO: 2332639 - DNA, 17 bp, Homo sapiens
gaacagcttcaggttat

SEQ ID NO: 2332640 - DNA, 21 bp, Homo sapiens
gaacaggttcttaaaaaggaa

SEQ ID NO: 2332641 - DNA, 21 bp, Homo sapiens
gaacagtaaagaaagcagaat

SEQ ID NO: 2332642 - DNA, 12 bp, Homo sapiens
gaacatattgtt

SEQ ID NO: 2332643 - DNA, 18 bp, Homo sapiens
gaacatattgttgaaagg

SEQ ID NO: 2332644 - DNA, 15 bp, Homo sapiens
gaacatgtaaaatgt

SEQ ID NO: 2332645 - DNA, 17 bp, Homo sapiens
gaacatgtaaaatgttt

SEQ ID NO: 2332646 - DNA, 14 bp, Homo sapiens
gaacatgttctcca

SEQ ID NO: 2332647 - DNA, 13 bp, Homo sapiens
gaacattcccagc

SEQ ID NO: 2332648 - DNA, 19 bp, Homo sapiens
gaacattcgaggtgtcacc

SEQ ID NO: 2332649 - DNA, 17 bp, Homo sapiens
gaaccagccggggcctt

SEQ ID NO: 2332650 - DNA, 13 bp, Homo sapiens
gaaccataaattc

SEQ ID NO: 2332651 - DNA, 18 bp, Homo sapiens
gaaccatggtgaagtgct

SEQ ID NO: 2332652 - DNA, 16 bp, Homo sapiens
gaacccaagtgcctca

SEQ ID NO: 2332653 - DNA, 17 bp, Homo sapiens
gaacccaccaaccagaa

SEQ ID NO: 2332654 - DNA, 14 bp, Homo sapiens
gaacccctttccca

SEQ ID NO: 2332655 - DNA, 14 bp, Homo sapiens
gaaccgcacagctc

SEQ ID NO: 2332656 - DNA, 16 bp, Homo sapiens
gaaccgcacagctcag

SEQ ID NO: 2332657 - DNA, 22 bp, Homo sapiens
gaacctgagctattttcctctg

SEQ ID NO: 2332658 - DNA, 15 bp, Homo sapiens
gaacctgcacacagg

SEQ ID NO: 2332659 - DNA, 18 bp, Homo sapiens
gaacctgcacacaggaca

SEQ ID NO: 2332660 - DNA, 21 bp, Homo sapiens
gaacctgcacacaggacagcg

SEQ ID NO: 2332661 - DNA, 22 bp, Homo sapiens
gaacctgcacacaggacagcgg

SEQ ID NO: 2332662 - DNA, 17 bp, Homo sapiens
gaacctgggcactccgc

SEQ ID NO: 2332663 - DNA, 21 bp, Homo sapiens
gaaccttgtcccagccagtga

SEQ ID NO: 2332664 - DNA, 22 bp, Homo sapiens
gaacgttttcttctttccctgg

SEQ ID NO: 2332665 - DNA, 15 bp, Homo sapiens
gaactaatatatgaa

SEQ ID NO: 2332666 - DNA, 19 bp, Homo sapiens
gaactaatgacaagtgact

SEQ ID NO: 2332667 - DNA, 17 bp, Homo sapiens
gaactaggctgagcaat

SEQ ID NO: 2332668 - DNA, 19 bp, Homo sapiens
gaactatattagtatgtat

SEQ ID NO: 2332669 - DNA, 20 bp, Homo sapiens
gaactattgtgctcagagac

SEQ ID NO: 2332670 - DNA, 19 bp, Homo sapiens
gaactcgcgctcagtaaac

SEQ ID NO: 2332671 - DNA, 23 bp, Homo sapiens
gaactgcaaagctttggctgaga

SEQ ID NO: 2332672 - DNA, 14 bp, Homo sapiens
gaactggaataata

SEQ ID NO: 2332673 - DNA, 16 bp, Homo sapiens
gaactggaataatatt

SEQ ID NO: 2332674 - DNA, 16 bp, Homo sapiens
gaacttgcgagtccaa

SEQ ID NO: 2332675 - DNA, 18 bp, Homo sapiens
gaacttgctgctgtcttg

SEQ ID NO: 2332676 - DNA, 20 bp, Homo sapiens
gaacttttgtactgaatttt

SEQ ID NO: 2332677 - DNA, 22 bp, Homo sapiens
gaagaaagtcaaaaaattattt

SEQ ID NO: 2332678 - DNA, 14 bp, Homo sapiens
gaagaaataaatga

SEQ ID NO: 2332679 - DNA, 20 bp, Homo sapiens
gaagaaatctttctccctca

SEQ ID NO: 2332680 - DNA, 17 bp, Homo sapiens
gaagaagaaatctttct

SEQ ID NO: 2332681 - DNA, 14 bp, Homo sapiens
gaagaagggagaag

SEQ ID NO: 2332682 - DNA, 17 bp, Homo sapiens
gaagaagggagaagaaa

SEQ ID NO: 2332683 - DNA, 19 bp, Homo sapiens
gaagaagggagaagaaagg

SEQ ID NO: 2332684 - DNA, 16 bp, Homo sapiens
gaagaatgaaagctgt

SEQ ID NO: 2332685 - DNA, 17 bp, Homo sapiens
gaagaatggctttcaat

SEQ ID NO: 2332686 - DNA, 18 bp, Homo sapiens
gaagaattgaaaagtttt

SEQ ID NO: 2332687 - DNA, 22 bp, Homo sapiens
gaagacaccagagcagatgcag

SEQ ID NO: 2332688 - DNA, 12 bp, Homo sapiens
gaagagaggcac

SEQ ID NO: 2332689 - DNA, 13 bp, Homo sapiens
gaagagaggcacc

SEQ ID NO: 2332690 - DNA, 19 bp, Homo sapiens
gaagagaggcacctgctgg

SEQ ID NO: 2332691 - DNA, 23 bp, Homo sapiens
gaagagaggcacctgctggaaac

SEQ ID NO: 2332692 - DNA, 11 bp, Homo sapiens
gaagagccacc

SEQ ID NO: 2332693 - DNA, 14 bp, Homo sapiens
gaagagccacctgc

SEQ ID NO: 2332694 - DNA, 16 bp, Homo sapiens
gaagagccacctgcaa

SEQ ID NO: 2332695 - DNA, 18 bp, Homo sapiens
gaagagccacctgcaaga

SEQ ID NO: 2332696 - DNA, 17 bp, Homo sapiens
gaagagcccagtctgtt

SEQ ID NO: 2332697 - DNA, 17 bp, Homo sapiens
gaagagcccgcagggcc

SEQ ID NO: 2332698 - DNA, 20 bp, Homo sapiens
gaagagggagaagcatgaaa

SEQ ID NO: 2332699 - DNA, 22 bp, Homo sapiens
gaagatccgagtgtgatttgaa

SEQ ID NO: 2332700 - DNA, 21 bp, Homo sapiens
gaagatctcactctgcccccc

SEQ ID NO: 2332701 - DNA, 13 bp, Homo sapiens
gaagattatatga

SEQ ID NO: 2332702 - DNA, 15 bp, Homo sapiens
gaagcaagggcaaga

SEQ ID NO: 2332703 - DNA, 20 bp, Homo sapiens
gaagcacatgcacctaccca

SEQ ID NO: 2332704 - DNA, 23 bp, Homo sapiens
gaagcactttgggattctttcca

SEQ ID NO: 2332705 - DNA, 23 bp, Homo sapiens
gaagcagctaaaccaaggactga

SEQ ID NO: 2332706 - DNA, 12 bp, Homo sapiens
gaagcaggaggc

SEQ ID NO: 2332707 - DNA, 12 bp, Homo sapiens
gaagccaaagaa

SEQ ID NO: 2332708 - DNA, 13 bp, Homo sapiens
gaagccaaagaaa

SEQ ID NO: 2332709 - DNA, 19 bp, Homo sapiens
gaagccaagggaaaggggt

SEQ ID NO: 2332710 - DNA, 22 bp, Homo sapiens
gaagccaagtggggtgctggga

SEQ ID NO: 2332711 - DNA, 18 bp, Homo sapiens
gaagccagagccccaagc

SEQ ID NO: 2332712 - DNA, 21 bp, Homo sapiens
gaagccagagccccaagcagg

SEQ ID NO: 2332713 - DNA, 22 bp, Homo sapiens
gaagccatatatgaccagaagc

SEQ ID NO: 2332714 - DNA, 23 bp, Homo sapiens
gaagcccagcccctactgctgtg

SEQ ID NO: 2332715 - DNA, 18 bp, Homo sapiens
gaagcctccaagcacaga

SEQ ID NO: 2332716 - DNA, 21 bp, Homo sapiens
gaagcctccaagcacagagcc

SEQ ID NO: 2332717 - DNA, 23 bp, Homo sapiens
gaagcctccaagcacagagcctg

SEQ ID NO: 2332718 - DNA, 15 bp, Homo sapiens
gaagctggctttgaa

SEQ ID NO: 2332719 - DNA, 13 bp, Homo sapiens
gaagctgttgtac

SEQ ID NO: 2332720 - DNA, 18 bp, Homo sapiens
gaagctgttgtacattta

SEQ ID NO: 2332721 - DNA, 19 bp, Homo sapiens
gaagctgttgtacatttat

SEQ ID NO: 2332722 - DNA, 21 bp, Homo sapiens
gaagctgttgtacatttatga

SEQ ID NO: 2332723 - DNA, 21 bp, Homo sapiens
gaaggaggggagagacaggca

SEQ ID NO: 2332724 - DNA, 21 bp, Homo sapiens
gaaggatgatgtctttttatt

SEQ ID NO: 2332725 - DNA, 16 bp, Homo sapiens
gaaggcaagagggggt

SEQ ID NO: 2332726 - DNA, 13 bp, Homo sapiens
gaaggcagagaaa

SEQ ID NO: 2332727 - DNA, 19 bp, Homo sapiens
gaaggccaaaatcaagagt

SEQ ID NO: 2332728 - DNA, 16 bp, Homo sapiens
gaaggccctgctgagt

SEQ ID NO: 2332729 - DNA, 15 bp, Homo sapiens
gaaggcgagtctggg

SEQ ID NO: 2332730 - DNA, 13 bp, Homo sapiens
gaaggcttctctc

SEQ ID NO: 2332731 - DNA, 18 bp, Homo sapiens
gaagggaggaaggccttt

SEQ ID NO: 2332732 - DNA, 13 bp, Homo sapiens
gaagggcaagaaa

SEQ ID NO: 2332733 - DNA, 23 bp, Homo sapiens
gaaggggctcttcatctgcctgc

SEQ ID NO: 2332734 - DNA, 23 bp, Homo sapiens
gaaggtgataagggaaaagataa

SEQ ID NO: 2332735 - DNA, 18 bp, Homo sapiens
gaaggtggccacagcaag

SEQ ID NO: 2332736 - DNA, 23 bp, Homo sapiens
gaaggtggccacagcaagtacag

SEQ ID NO: 2332737 - DNA, 15 bp, Homo sapiens
gaagtaacagacaca

SEQ ID NO: 2332738 - DNA, 17 bp, Homo sapiens
gaagtaggaggaaacag

SEQ ID NO: 2332739 - DNA, 14 bp, Homo sapiens
gaagtatacctgat

SEQ ID NO: 2332740 - DNA, 21 bp, Homo sapiens
gaagtatgtatattaaaaaag

SEQ ID NO: 2332741 - DNA, 19 bp, Homo sapiens
gaagtcttgaagttgggtg

SEQ ID NO: 2332742 - DNA, 18 bp, Homo sapiens
gaagtgcagtcagcagat

SEQ ID NO: 2332743 - DNA, 24 bp, Homo sapiens
gaagtgcagtcagcagatgctgtt

SEQ ID NO: 2332744 - DNA, 23 bp, Homo sapiens
gaagtggctgccacacccagggg

SEQ ID NO: 2332745 - DNA, 15 bp, Homo sapiens
gaagtggctggtaga

SEQ ID NO: 2332746 - DNA, 18 bp, Homo sapiens
gaagtggggtctggcctg

SEQ ID NO: 2332747 - DNA, 16 bp, Homo sapiens
gaagtgtttatgttgt

SEQ ID NO: 2332748 - DNA, 22 bp, Homo sapiens
gaagttacacagaaatgctgct

SEQ ID NO: 2332749 - DNA, 15 bp, Homo sapiens
gaagttagtggaaat

SEQ ID NO: 2332750 - DNA, 12 bp, Homo sapiens
gaagttttccta

SEQ ID NO: 2332751 - DNA, 12 bp, Homo sapiens
gaataaattatg

SEQ ID NO: 2332752 - DNA, 19 bp, Homo sapiens
gaataatatcaaataaaat

SEQ ID NO: 2332753 - DNA, 14 bp, Homo sapiens
gctcaaggccagct

SEQ ID NO: 2332754 - DNA, 20 bp, Homo sapiens
gctcaattcaagtgacacat

SEQ ID NO: 2332755 - DNA, 22 bp, Homo sapiens
gctcaattcaagtgacacatta

SEQ ID NO: 2332756 - DNA, 18 bp, Homo sapiens
gctcaccagccctgcagc

SEQ ID NO: 2332757 - DNA, 20 bp, Homo sapiens
gctcaccagccctgcagccc

SEQ ID NO: 2332758 - DNA, 21 bp, Homo sapiens
gctcaccagccctgcagccca

SEQ ID NO: 2332759 - DNA, 17 bp, Homo sapiens
gctcaccgcccatcagg

SEQ ID NO: 2332760 - DNA, 19 bp, Homo sapiens
gctcaccgctggcccttag

SEQ ID NO: 2332761 - DNA, 23 bp, Homo sapiens
gctcacgactcttcctgcaaagg

SEQ ID NO: 2332762 - DNA, 17 bp, Homo sapiens
gctcactgcagcctcat

SEQ ID NO: 2332763 - DNA, 13 bp, Homo sapiens
gctcactgccagg

SEQ ID NO: 2332764 - DNA, 19 bp, Homo sapiens
gctcactgccaggccagcc

SEQ ID NO: 2332765 - DNA, 16 bp, Homo sapiens
gcccttgcctccccat

SEQ ID NO: 2332766 - DNA, 18 bp, Homo sapiens
gccgaggccatgtgcata

SEQ ID NO: 2332767 - DNA, 15 bp, Homo sapiens
gccgatgccaccggc

SEQ ID NO: 2332768 - DNA, 16 bp, Homo sapiens
gccgccccctcctgaa

SEQ ID NO: 2332769 - DNA, 17 bp, Homo sapiens
gccgcccctccacccat

SEQ ID NO: 2332770 - DNA, 15 bp, Homo sapiens
gccgcggagcctgca

SEQ ID NO: 2332771 - DNA, 20 bp, Homo sapiens
gccgcggtaggtaagggccg

SEQ ID NO: 2332772 - DNA, 22 bp, Homo sapiens
gccggacccggaggccgaggcc

SEQ ID NO: 2332773 - DNA, 20 bp, Homo sapiens
gccggaccgcgtagagagcc

SEQ ID NO: 2332774 - DNA, 16 bp, Homo sapiens
gccggcacggcccgtg

SEQ ID NO: 2332775 - DNA, 13 bp, Homo sapiens
gccggcccagatg

SEQ ID NO: 2332776 - DNA, 15 bp, Homo sapiens
gccggcccagatgtg

SEQ ID NO: 2332777 - DNA, 19 bp, Homo sapiens
gccggcccagatgtgtccc

SEQ ID NO: 2332778 - DNA, 14 bp, Homo sapiens
gccgggcccctggg

SEQ ID NO: 2332779 - DNA, 22 bp, Homo sapiens
gccgggcgcggtggctcacgcc

SEQ ID NO: 2332780 - DNA, 13 bp, Homo sapiens
gccgggctgaggg

SEQ ID NO: 2332781 - DNA, 13 bp, Homo sapiens
gccgtggatggcc

SEQ ID NO: 2332782 - DNA, 17 bp, Homo sapiens
gcctaattcctggcatg

SEQ ID NO: 2332783 - DNA, 14 bp, Homo sapiens
gcctacagccaggt

SEQ ID NO: 2332784 - DNA, 15 bp, Homo sapiens
gcctacagccaggtt

SEQ ID NO: 2332785 - DNA, 23 bp, Homo sapiens
gattgtgtgactattcatggcta

SEQ ID NO: 2332786 - DNA, 23 bp, Homo sapiens
gattgtgtttgttcataataaaa

SEQ ID NO: 2332787 - DNA, 22 bp, Homo sapiens
gatttaagtgaatacattaacg

SEQ ID NO: 2332788 - DNA, 13 bp, Homo sapiens
gatttaataaaat

SEQ ID NO: 2332789 - DNA, 17 bp, Homo sapiens
gatttaataaaataatt

SEQ ID NO: 2332790 - DNA, 22 bp, Homo sapiens
gatttaataaaataattctaaa

SEQ ID NO: 2332791 - DNA, 18 bp, Homo sapiens
gatttagggaagcaggga

SEQ ID NO: 2332792 - DNA, 22 bp, Homo sapiens
gatttcatatctaactttgtaa

SEQ ID NO: 2332793 - DNA, 19 bp, Homo sapiens
gatttccagaaccacactt

SEQ ID NO: 2332794 - DNA, 22 bp, Homo sapiens
gatttccagaaccacacttgaa

SEQ ID NO: 2332795 - DNA, 16 bp, Homo sapiens
gatttctaacagtcct

SEQ ID NO: 2332796 - DNA, 14 bp, Homo sapiens
gatttctgaggaaa

SEQ ID NO: 2332797 - DNA, 23 bp, Homo sapiens
gatttcttttgtaataaactatt

SEQ ID NO: 2332798 - DNA, 16 bp, Homo sapiens
gatttgaaaaatataa

SEQ ID NO: 2332799 - DNA, 15 bp, Homo sapiens
gatttgcctcacctt

SEQ ID NO: 2332800 - DNA, 19 bp, Homo sapiens
gatttggaagagaggcacc

SEQ ID NO: 2332801 - DNA, 18 bp, Homo sapiens
gatttgtaaaacagtggt

SEQ ID NO: 2332802 - DNA, 11 bp, Homo sapiens
gattttatgtt

SEQ ID NO: 2332803 - DNA, 18 bp, Homo sapiens
gattttcaagattctaaa

SEQ ID NO: 2332804 - DNA, 20 bp, Homo sapiens
gattttcaagattctaaagc

SEQ ID NO: 2332805 - DNA, 11 bp, Homo sapiens
gattttcttct

SEQ ID NO: 2332806 - DNA, 14 bp, Homo sapiens
gatttttaaattaa

SEQ ID NO: 2332807 - DNA, 18 bp, Homo sapiens
gatttttctcaaagtttt

SEQ ID NO: 2332808 - DNA, 14 bp, Homo sapiens
gattttttcccttt

SEQ ID NO: 2332809 - DNA, 16 bp, Homo sapiens
gattttttcccttttt

SEQ ID NO: 2332810 - DNA, 22 bp, Homo sapiens
gcaaaaaattctttagagatta

SEQ ID NO: 2332811 - DNA, 13 bp, Homo sapiens
gcaaaaataatca

SEQ ID NO: 2332812 - DNA, 18 bp, Homo sapiens
gcaaaagcctcagaaagg

SEQ ID NO: 2332813 - DNA, 13 bp, Homo sapiens
gcaaaaggcctct

SEQ ID NO: 2332814 - DNA, 17 bp, Homo sapiens
gcaaaaggcctcttgta

SEQ ID NO: 2332815 - DNA, 23 bp, Homo sapiens
gcaaaaggcctcttgtaaagact

SEQ ID NO: 2332816 - DNA, 16 bp, Homo sapiens
gcaaacccattaaggg

SEQ ID NO: 2332817 - DNA, 20 bp, Homo sapiens
gcaaaccctcccagaaacat

SEQ ID NO: 2332818 - DNA, 19 bp, Homo sapiens
gcaaacctgacccctgctc

SEQ ID NO: 2332819 - DNA, 12 bp, Homo sapiens
gcaaagaaaatg

SEQ ID NO: 2332820 - DNA, 16 bp, Homo sapiens
gcaaagagacatttca

SEQ ID NO: 2332821 - DNA, 22 bp, Homo sapiens
gcaaagagacatttcaaaactg

SEQ ID NO: 2332822 - DNA, 18 bp, Homo sapiens
gcaaaggtgtgcttcctg

SEQ ID NO: 2332823 - DNA, 19 bp, Homo sapiens
gcaaataaatacgtgtcaa

SEQ ID NO: 2332824 - DNA, 12 bp, Homo sapiens
ggtctccctggc

SEQ ID NO: 2332825 - DNA, 16 bp, Homo sapiens
ggtctccctggctccc

SEQ ID NO: 2332826 - DNA, 17 bp, Homo sapiens
ggtctccctggctccct

SEQ ID NO: 2332827 - DNA, 24 bp, Homo sapiens
ggtctccctggctccctcctccag

SEQ ID NO: 2332828 - DNA, 21 bp, Homo sapiens
ggtctcccttctctacactct

SEQ ID NO: 2332829 - DNA, 12 bp, Homo sapiens
ggtctctgctgg

SEQ ID NO: 2332830 - DNA, 13 bp, Homo sapiens
ggtctctttgctt

SEQ ID NO: 2332831 - DNA, 23 bp, Homo sapiens
ggtcttgctctgtcccccaggct

SEQ ID NO: 2332832 - DNA, 20 bp, Homo sapiens
ggtctttgtaagagtgtaga

SEQ ID NO: 2332833 - DNA, 14 bp, Homo sapiens
ggtgacatgtgaaa

SEQ ID NO: 2332834 - DNA, 21 bp, Homo sapiens
ggtgacggtcctttaggcagc

SEQ ID NO: 2332835 - DNA, 23 bp, Homo sapiens
ggtgacggtcctttaggcagcct

SEQ ID NO: 2332836 - DNA, 18 bp, Homo sapiens
ggtgagacagttgcccga

SEQ ID NO: 2332837 - DNA, 15 bp, Homo sapiens
ggtgaggcccagcct

SEQ ID NO: 2332838 - DNA, 21 bp, Homo sapiens
ggtgagtttgagctgccttcc

SEQ ID NO: 2332839 - DNA, 19 bp, Homo sapiens
ggtgatggccagcccctgg

SEQ ID NO: 2332840 - DNA, 18 bp, Homo sapiens
ggtgattggaccaggcca

SEQ ID NO: 2332841 - DNA, 14 bp, Homo sapiens
ggtgcacccacctg

SEQ ID NO: 2332842 - DNA, 20 bp, Homo sapiens
ggtgccacccagtagcccag

SEQ ID NO: 2332843 - DNA, 17 bp, Homo sapiens
ggtgccagttgggctcg

SEQ ID NO: 2332844 - DNA, 16 bp, Homo sapiens
ggtgcccatcctgcca

SEQ ID NO: 2332845 - DNA, 17 bp, Homo sapiens
ggtgcctgagaggcagg

SEQ ID NO: 2332846 - DNA, 19 bp, Homo sapiens
ggtgcctgagaggcaggca

SEQ ID NO: 2332847 - DNA, 14 bp, Homo sapiens
ggtgcgtctccagt

SEQ ID NO: 2332848 - DNA, 18 bp, Homo sapiens
ggtgctcacgactcttcc

SEQ ID NO: 2332849 - DNA, 22 bp, Homo sapiens
ggtgctcacgactcttcctgca

SEQ ID NO: 2332850 - DNA, 21 bp, Homo sapiens
ggtgctcggagaagagcgcag

SEQ ID NO: 2332851 - DNA, 11 bp, Homo sapiens
ggtgctgtcca

SEQ ID NO: 2332852 - DNA, 21 bp, Homo sapiens
ggtgcttttatagaggctagc

SEQ ID NO: 2332853 - DNA, 21 bp, Homo sapiens
ggtggaaataatttgaatgta

SEQ ID NO: 2332854 - DNA, 18 bp, Homo sapiens
ggtggagcactggactcc

SEQ ID NO: 2332855 - DNA, 18 bp, Homo sapiens
ggtggataactagccaga

SEQ ID NO: 2332856 - DNA, 18 bp, Homo sapiens
ggtggatgttatgaacag

SEQ ID NO: 2332857 - DNA, 17 bp, Homo sapiens
ggtggcagatgtcttcc

SEQ ID NO: 2332858 - DNA, 14 bp, Homo sapiens
ggtggcaggtgggg

SEQ ID NO: 2332859 - DNA, 13 bp, Homo sapiens
ggtggccacagca

SEQ ID NO: 2332860 - DNA, 18 bp, Homo sapiens
ggtggcctggaggtgggc

SEQ ID NO: 2332861 - DNA, 13 bp, Homo sapiens
ggtggctgggcag

SEQ ID NO: 2332862 - DNA, 23 bp, Homo sapiens
ggtggcttaagtgagcagaacag

SEQ ID NO: 2332863 - DNA, 19 bp, Homo sapiens
ggtgggagtgtgtctgctg

SEQ ID NO: 2332864 - DNA, 23 bp, Homo sapiens
ggtggggccataaacggttcctg

SEQ ID NO: 2332865 - DNA, 14 bp, Homo sapiens
ggtgtaataagaca

SEQ ID NO: 2332866 - DNA, 16 bp, Homo sapiens
ggtgtaataagacata

SEQ ID NO: 2332867 - DNA, 18 bp, Homo sapiens
ggtgtaataagacataac

SEQ ID NO: 2332868 - DNA, 13 bp, Homo sapiens
ggtgtataaatgt

SEQ ID NO: 2332869 - DNA, 15 bp, Homo sapiens
ggtgtcctgcctgtc

SEQ ID NO: 2332870 - DNA, 15 bp, Homo sapiens
ggtgtctccttaagc

SEQ ID NO: 2332871 - DNA, 16 bp, Homo sapiens
ggtgtgaacccgggag

SEQ ID NO: 2332872 - DNA, 17 bp, Homo sapiens
ggtgtggataaggctta

SEQ ID NO: 2332873 - DNA, 19 bp, Homo sapiens
ggtgtggctttccaggcac

SEQ ID NO: 2332874 - DNA, 13 bp, Homo sapiens
ggtgtgtttgtaa

SEQ ID NO: 2332875 - DNA, 16 bp, Homo sapiens
ggtgttctttcctgcc

SEQ ID NO: 2332876 - DNA, 19 bp, Homo sapiens
ggtgttctttcctgccctg

SEQ ID NO: 2332877 - DNA, 12 bp, Homo sapiens
ggtgtttattgc

SEQ ID NO: 2332878 - DNA, 14 bp, Homo sapiens
ggttaaggcctgaa

SEQ ID NO: 2332879 - DNA, 22 bp, Homo sapiens
ggttaccactcttttgctgtgc

SEQ ID NO: 2332880 - DNA, 17 bp, Homo sapiens
ggttatcgaaataacaa

SEQ ID NO: 2332881 - DNA, 16 bp, Homo sapiens
ggttcaaggtcactgt

SEQ ID NO: 2332882 - DNA, 14 bp, Homo sapiens
ggttcaccttgccg

SEQ ID NO: 2332883 - DNA, 24 bp, Homo sapiens
ggttccgtatctccctggagaagc

SEQ ID NO: 2332884 - DNA, 15 bp, Homo sapiens
ggttcctataattgt

SEQ ID NO: 2332885 - DNA, 16 bp, Homo sapiens
ggttcctcctctccta

SEQ ID NO: 2332886 - DNA, 15 bp, Homo sapiens
ggttcctctgcctgc

SEQ ID NO: 2332887 - DNA, 18 bp, Homo sapiens
ggttcctctgcctgcccc

SEQ ID NO: 2332888 - DNA, 23 bp, Homo sapiens
ggttctacagccttgtccccctc

SEQ ID NO: 2332889 - DNA, 17 bp, Homo sapiens
ggttgagagccagtggc

SEQ ID NO: 2332890 - DNA, 17 bp, Homo sapiens
ggttgcgggacagagta

SEQ ID NO: 2332891 - DNA, 16 bp, Homo sapiens
ggttgctccgcctggc

SEQ ID NO: 2332892 - DNA, 17 bp, Homo sapiens
ggttggagcccagggca

SEQ ID NO: 2332893 - DNA, 16 bp, Homo sapiens
ggttgtgcacatttct

SEQ ID NO: 2332894 - DNA, 20 bp, Homo sapiens
ggtttatgtagtcagttgca

SEQ ID NO: 2332895 - DNA, 15 bp, Homo sapiens
ggtttggtttgcttt

SEQ ID NO: 2332896 - DNA, 16 bp, Homo sapiens
ggttttatactgaagg

SEQ ID NO: 2332897 - DNA, 13 bp, Homo sapiens
ggttttcttttct

SEQ ID NO: 2332898 - DNA, 14 bp, Homo sapiens
ggttttttccccct

SEQ ID NO: 2332899 - DNA, 15 bp, Homo sapiens
gtaaaaagtggctgc

SEQ ID NO: 2332900 - DNA, 20 bp, Homo sapiens
gtaaaacagggccacataga

SEQ ID NO: 2332901 - DNA, 13 bp, Homo sapiens
gtaaaacagtggt

SEQ ID NO: 2332902 - DNA, 22 bp, Homo sapiens
gtaaacgggaacatgccccctg

SEQ ID NO: 2332903 - DNA, 16 bp, Homo sapiens
gtaaacttctgcaaca

SEQ ID NO: 2332904 - DNA, 14 bp, Homo sapiens
gtaaagactggttt

SEQ ID NO: 2332905 - DNA, 18 bp, Homo sapiens
gtaaaggaaataagagca

SEQ ID NO: 2332906 - DNA, 18 bp, Homo sapiens
gtaaagtatcacttttct

SEQ ID NO: 2332907 - DNA, 21 bp, Homo sapiens
gtaaagtttccgtgcgtggca

SEQ ID NO: 2332908 - DNA, 23 bp, Homo sapiens
gtaaatagtgtcatataaactca

SEQ ID NO: 2332909 - DNA, 15 bp, Homo sapiens
gtaaatcagaaagta

SEQ ID NO: 2332910 - DNA, 18 bp, Homo sapiens
gtaaatggttaaatttta

SEQ ID NO: 2332911 - DNA, 13 bp, Homo sapiens
gtaacaacaatta

SEQ ID NO: 2332912 - DNA, 15 bp, Homo sapiens
gtaacagaacagctt

SEQ ID NO: 2332913 - DNA, 11 bp, Homo sapiens
gtaacagacac

SEQ ID NO: 2332914 - DNA, 21 bp, Homo sapiens
gtaacatgacttccttatttc

SEQ ID NO: 2332915 - DNA, 12 bp, Homo sapiens
gtaactgaaagg

SEQ ID NO: 2332916 - DNA, 21 bp, Homo sapiens
gtaacttgcttaaatttctta

SEQ ID NO: 2332917 - DNA, 18 bp, Homo sapiens
gtaagaacaactacctga

SEQ ID NO: 2332918 - DNA, 11 bp, Homo sapiens
gtaagaaggca

SEQ ID NO: 2332919 - DNA, 13 bp, Homo sapiens
gtaagaattctga

SEQ ID NO: 2332920 - DNA, 17 bp, Homo sapiens
gtaagagcttgctccag

SEQ ID NO: 2332921 - DNA, 15 bp, Homo sapiens
gtaagagtgtagaag

SEQ ID NO: 2332922 - DNA, 17 bp, Homo sapiens
gtaagagtgtagaagca

SEQ ID NO: 2332923 - DNA, 21 bp, Homo sapiens
gtaagcattctgagctgggct

SEQ ID NO: 2332924 - DNA, 20 bp, Homo sapiens
gtaaggaacacgattttcaa

SEQ ID NO: 2332925 - DNA, 21 bp, Homo sapiens
gtaagtggtttttatattttc

SEQ ID NO: 2332926 - DNA, 22 bp, Homo sapiens
gtaagtggtttttatattttca

SEQ ID NO: 2332927 - DNA, 21 bp, Homo sapiens
gctgctatccccatctccctg

SEQ ID NO: 2332928 - DNA, 22 bp, Homo sapiens
gctgctatccccatctccctgc

SEQ ID NO: 2332929 - DNA, 23 bp, Homo sapiens
gctgctcacccacctcttgtgca

SEQ ID NO: 2332930 - DNA, 21 bp, Homo sapiens
gctgctcattacagttctttc

SEQ ID NO: 2332931 - DNA, 24 bp, Homo sapiens
gctgctcattacagttctttcctc

SEQ ID NO: 2332932 - DNA, 14 bp, Homo sapiens
gctgctctgagcca

SEQ ID NO: 2332933 - DNA, 13 bp, Homo sapiens
gctgctgtctggg

SEQ ID NO: 2332934 - DNA, 20 bp, Homo sapiens
gctgctgtctgggtgctact

SEQ ID NO: 2332935 - DNA, 22 bp, Homo sapiens
gctgctgtctgggtgctactgg

SEQ ID NO: 2332936 - DNA, 21 bp, Homo sapiens
ggctccccctccccaggctgg

SEQ ID NO: 2332937 - DNA, 23 bp, Homo sapiens
ggctccccctccccaggctggag

SEQ ID NO: 2332938 - DNA, 13 bp, Homo sapiens
gtgggtctctgaa

SEQ ID NO: 2332939 - DNA, 20 bp, Homo sapiens
gtgggtgcgtaaggatgtgt

SEQ ID NO: 2332940 - DNA, 21 bp, Homo sapiens
gtgggtgttctttcctgccct

SEQ ID NO: 2332941 - DNA, 14 bp, Homo sapiens
gtggtatgtctgcc

SEQ ID NO: 2332942 - DNA, 14 bp, Homo sapiens
gtggtctctgctgg

SEQ ID NO: 2332943 - DNA, 16 bp, Homo sapiens
gtggtctgtggatcag

SEQ ID NO: 2332944 - DNA, 19 bp, Homo sapiens
gtggtctttgtaagagtgt

SEQ ID NO: 2332945 - DNA, 18 bp, Homo sapiens
gtggtgatttgaaaaata

SEQ ID NO: 2332946 - DNA, 21 bp, Homo sapiens
gtggtgatttgaaaaatataa

SEQ ID NO: 2332947 - DNA, 18 bp, Homo sapiens
gtggttaaggccagggcc

SEQ ID NO: 2332948 - DNA, 12 bp, Homo sapiens
gtggtttggaat

SEQ ID NO: 2332949 - DNA, 21 bp, Homo sapiens
gtgtaacttgcttaaatttct

SEQ ID NO: 2332950 - DNA, 14 bp, Homo sapiens
gtgtaatttgaaga

SEQ ID NO: 2332951 - DNA, 14 bp, Homo sapiens
gtgtacataactga

SEQ ID NO: 2332952 - DNA, 19 bp, Homo sapiens
gtgtagaagcattccttct

SEQ ID NO: 2332953 - DNA, 23 bp, Homo sapiens
gtgtagaagcattccttctttga

SEQ ID NO: 2332954 - DNA, 20 bp, Homo sapiens
gtgtagagttaagaagctgt

SEQ ID NO: 2332955 - DNA, 15 bp, Homo sapiens
gtgtatataatttta

SEQ ID NO: 2332956 - DNA, 13 bp, Homo sapiens
gtgtattccaaga

SEQ ID NO: 2332957 - DNA, 16 bp, Homo sapiens
gtgtatttattacatt

SEQ ID NO: 2332958 - DNA, 17 bp, Homo sapiens
gtgtcaagctgctctga

SEQ ID NO: 2332959 - DNA, 21 bp, Homo sapiens
gtgtcaagctgctctgagcca

SEQ ID NO: 2332960 - DNA, 18 bp, Homo sapiens
gtgtcaccctgcagagct

SEQ ID NO: 2332961 - DNA, 16 bp, Homo sapiens
gtgtcagctgaggctg

SEQ ID NO: 2332962 - DNA, 17 bp, Homo sapiens
gtgtccagcttccaaag

SEQ ID NO: 2332963 - DNA, 15 bp, Homo sapiens
gtgtcccagatgctg

SEQ ID NO: 2332964 - DNA, 20 bp, Homo sapiens
gtgtcccctcacgcaagtgc

SEQ ID NO: 2332965 - DNA, 20 bp, Homo sapiens
gtgtcctgaaacgctccttt

SEQ ID NO: 2332966 - DNA, 13 bp, Homo sapiens
gtgtcctgcctgt

SEQ ID NO: 2332967 - DNA, 18 bp, Homo sapiens
gtgtctggaattgtggct

SEQ ID NO: 2332968 - DNA, 22 bp, Homo sapiens
gtgtctgtacacgtgtcctgta

SEQ ID NO: 2332969 - DNA, 12 bp, Homo sapiens
gtgtctttggag

SEQ ID NO: 2332970 - DNA, 15 bp, Homo sapiens
gtgtgaatagcctgg

SEQ ID NO: 2332971 - DNA, 17 bp, Homo sapiens
gtgtgacagtttccaaa

SEQ ID NO: 2332972 - DNA, 18 bp, Homo sapiens
gtgtgacagtttccaaat

SEQ ID NO: 2332973 - DNA, 21 bp, Homo sapiens
gtgtgctctccattctgctcc

SEQ ID NO: 2332974 - DNA, 22 bp, Homo sapiens
gtgtgctctccattctgctcct

SEQ ID NO: 2332975 - DNA, 14 bp, Homo sapiens
gtgtgctgacaact

SEQ ID NO: 2332976 - DNA, 20 bp, Homo sapiens
gtgtgctgacaacttagctc

SEQ ID NO: 2332977 - DNA, 16 bp, Homo sapiens
gtgtggagaccctgcc

SEQ ID NO: 2332978 - DNA, 21 bp, Homo sapiens
gtgtggagaccctgccacagc

SEQ ID NO: 2332979 - DNA, 15 bp, Homo sapiens
gtgtggcctgtggct

SEQ ID NO: 2332980 - DNA, 11 bp, Homo sapiens
gtgtggctttc

SEQ ID NO: 2332981 - DNA, 12 bp, Homo sapiens
gtgtgggaaagc

SEQ ID NO: 2332982 - DNA, 23 bp, Homo sapiens
gtgtgggtgtcctgcctgtctgc

SEQ ID NO: 2332983 - DNA, 18 bp, Homo sapiens
gtgtgtcccctcacgcaa

SEQ ID NO: 2332984 - DNA, 13 bp, Homo sapiens
gtgtgtctgctga

SEQ ID NO: 2332985 - DNA, 15 bp, Homo sapiens
gtgtgtgtgtcagct

SEQ ID NO: 2332986 - DNA, 14 bp, Homo sapiens
gtgtgtgtgtgtgt

SEQ ID NO: 2332987 - DNA, 13 bp, Homo sapiens
gtgtgtttgtaat

SEQ ID NO: 2332988 - DNA, 20 bp, Homo sapiens
gtgttaattgcgtagaggct

SEQ ID NO: 2332989 - DNA, 15 bp, Homo sapiens
gtgttacctgtgtgc

SEQ ID NO: 2332990 - DNA, 16 bp, Homo sapiens
gtgttacctgtgtgct

SEQ ID NO: 2332991 - DNA, 20 bp, Homo sapiens
gtgttcagctctttccaaat

SEQ ID NO: 2332992 - DNA, 21 bp, Homo sapiens
gtgttcagctctttccaaatt

SEQ ID NO: 2332993 - DNA, 14 bp, Homo sapiens
gtgttcatttcatt

SEQ ID NO: 2332994 - DNA, 17 bp, Homo sapiens
gtgttcccatttcagct

SEQ ID NO: 2332995 - DNA, 19 bp, Homo sapiens
gtgttgccacagtagaact

SEQ ID NO: 2332996 - DNA, 13 bp, Homo sapiens
gtgtttctgactc

SEQ ID NO: 2332997 - DNA, 23 bp, Homo sapiens
gtgtttgttcataataaaagtga

SEQ ID NO: 2332998 - DNA, 14 bp, Homo sapiens
gtgttttttaagat

SEQ ID NO: 2332999 - DNA, 15 bp, Homo sapiens
gtgttttttaagatg

SEQ ID NO: 2333000 - DNA, 13 bp, Homo sapiens
gttaaatttgtaa

SEQ ID NO: 2333001 - DNA, 14 bp, Homo sapiens
gttaaatttgtaag

SEQ ID NO: 2333002 - DNA, 17 bp, Homo sapiens
gttaacccattccagta

SEQ ID NO: 2333003 - DNA, 19 bp, Homo sapiens
gttaagaagctgttgtaca

SEQ ID NO: 2333004 - DNA, 12 bp, Homo sapiens
gttaaggaaact

SEQ ID NO: 2333005 - DNA, 14 bp, Homo sapiens
gttaaggccagggc

SEQ ID NO: 2333006 - DNA, 19 bp, Homo sapiens
gttaattgcgtagaggcta

SEQ ID NO: 2333007 - DNA, 16 bp, Homo sapiens
gttacagtggcagtat

SEQ ID NO: 2333008 - DNA, 13 bp, Homo sapiens
gttaccattcaca

SEQ ID NO: 2333009 - DNA, 19 bp, Homo sapiens
gttacctgacctaaattag

SEQ ID NO: 2333010 - DNA, 13 bp, Homo sapiens
gttacctgtgtgc

SEQ ID NO: 2333011 - DNA, 21 bp, Homo sapiens
gttacgtgaagaaataaatga

SEQ ID NO: 2333012 - DNA, 12 bp, Homo sapiens
gttactgagtga

SEQ ID NO: 2333013 - DNA, 21 bp, Homo sapiens
gttagagaggtagcgagctgc

SEQ ID NO: 2333014 - DNA, 17 bp, Homo sapiens
gttagctgaagaattga

SEQ ID NO: 2333015 - DNA, 16 bp, Homo sapiens
gttaggaatctcttca

SEQ ID NO: 2333016 - DNA, 20 bp, Homo sapiens
gttatagaatagcctgaggt

SEQ ID NO: 2333017 - DNA, 16 bp, Homo sapiens
gttatcatgaatttta

SEQ ID NO: 2333018 - DNA, 18 bp, Homo sapiens
gttatcatgaattttaaa

SEQ ID NO: 2333019 - DNA, 18 bp, Homo sapiens
gttatcgaaataacaatg

SEQ ID NO: 2333020 - DNA, 18 bp, Homo sapiens
gttatgaacagctgtgtc

SEQ ID NO: 2333021 - DNA, 23 bp, Homo sapiens
gttatgataacaccagtgggaat

SEQ ID NO: 2333022 - DNA, 23 bp, Homo sapiens
gttatgtcttgtatttaaaaaca

SEQ ID NO: 2333023 - DNA, 14 bp, Homo sapiens
gttattataacata

SEQ ID NO: 2333024 - DNA, 20 bp, Homo sapiens
gttattataacataaaagca

SEQ ID NO: 2333025 - DNA, 18 bp, Homo sapiens
gttattgcaataaagtat

SEQ ID NO: 2333026 - DNA, 17 bp, Homo sapiens
gttattttctacagtgg

SEQ ID NO: 2333027 - DNA, 20 bp, Homo sapiens
gttattttctacagtggttt

SEQ ID NO: 2333028 - DNA, 14 bp, Homo sapiens
gttatttttctctt

SEQ ID NO: 2333029 - DNA, 14 bp, Homo sapiens
gttcaaaatgtctg

SEQ ID NO: 2333030 - DNA, 14 bp, Homo sapiens
gttcaagccttcca

SEQ ID NO: 2333031 - DNA, 23 bp, Homo sapiens
gttcaataaagcactgagcaagt

SEQ ID NO: 2333032 - DNA, 22 bp, Homo sapiens
gttcaccttggaagggcgttct

SEQ ID NO: 2333033 - DNA, 22 bp, Homo sapiens
gttcagcagaacctgcacacag

SEQ ID NO: 2333034 - DNA, 17 bp, Homo sapiens
gttcagctctttccaaa

SEQ ID NO: 2333035 - DNA, 18 bp, Homo sapiens
gttcagctctttccaaat

SEQ ID NO: 2333036 - DNA, 17 bp, Homo sapiens
gttcataataaaagtga

SEQ ID NO: 2333037 - DNA, 12 bp, Homo sapiens
gttcatttcatt

SEQ ID NO: 2333038 - DNA, 12 bp, Homo sapiens
gttcatttccta

SEQ ID NO: 2333039 - DNA, 15 bp, Homo sapiens
gttccaccccaagag

SEQ ID NO: 2333040 - DNA, 20 bp, Homo sapiens
gttccatgagttatcatgaa

SEQ ID NO: 2333041 - DNA, 20 bp, Homo sapiens
gttccatgttctatttttga

SEQ ID NO: 2333042 - DNA, 18 bp, Homo sapiens
gttcccaatatcatgtga

SEQ ID NO: 2333043 - DNA, 12 bp, Homo sapiens
gttcccccatct

SEQ ID NO: 2333044 - DNA, 11 bp, Homo sapiens
gttcctgctgc

SEQ ID NO: 2333045 - DNA, 12 bp, Homo sapiens
gttcctttttca

SEQ ID NO: 2333046 - DNA, 20 bp, Homo sapiens
gttcctttttcaaaaaccag

SEQ ID NO: 2333047 - DNA, 13 bp, Homo sapiens
gttctaacctcct

SEQ ID NO: 2333048 - DNA, 23 bp, Homo sapiens
gttctaattaagaaaactattaa

SEQ ID NO: 2333049 - DNA, 12 bp, Homo sapiens
gttctaggaaaa

SEQ ID NO: 2333050 - DNA, 20 bp, Homo sapiens
gttctcacttattattaata

SEQ ID NO: 2333051 - DNA, 19 bp, Homo sapiens
gttctcagaaatgtcatga

SEQ ID NO: 2333052 - DNA, 15 bp, Homo sapiens
gttcttaaaaaggaa

SEQ ID NO: 2333053 - DNA, 14 bp, Homo sapiens
taaaagtgaagtga

SEQ ID NO: 2333054 - DNA, 18 bp, Homo sapiens
taaaagtgtgtaaatgct

SEQ ID NO: 2333055 - DNA, 19 bp, Homo sapiens
taaaagttttatatgcttt

SEQ ID NO: 2333056 - DNA, 15 bp, Homo sapiens
taaaataaaatgaaa

SEQ ID NO: 2333057 - DNA, 22 bp, Homo sapiens
taaaataaaatgaaaattgtat

SEQ ID NO: 2333058 - DNA, 14 bp, Homo sapiens
taaaataaataatt

SEQ ID NO: 2333059 - DNA, 15 bp, Homo sapiens
taaaataaataattt

SEQ ID NO: 2333060 - DNA, 16 bp, Homo sapiens
taaaataaataatttt

SEQ ID NO: 2333061 - DNA, 17 bp, Homo sapiens
taaaataaggatttttc

SEQ ID NO: 2333062 - DNA, 22 bp, Homo sapiens
taaaataaggatttttctctta

SEQ ID NO: 2333063 - DNA, 16 bp, Homo sapiens
taaaataattctaaag

SEQ ID NO: 2333064 - DNA, 22 bp, Homo sapiens
taaaatagaaattttgtaagaa

SEQ ID NO: 2333065 - DNA, 14 bp, Homo sapiens
taaaatagaataat

SEQ ID NO: 2333066 - DNA, 18 bp, Homo sapiens
taaaatagaataattctt

SEQ ID NO: 2333067 - DNA, 15 bp, Homo sapiens
taaaatatcataaag

SEQ ID NO: 2333068 - DNA, 20 bp, Homo sapiens
taaaatatcataaagcattt

SEQ ID NO: 2333069 - DNA, 21 bp, Homo sapiens
taaaatatctatttgaataaa

SEQ ID NO: 2333070 - DNA, 18 bp, Homo sapiens
taaaatggcatttagcac

SEQ ID NO: 2333071 - DNA, 12 bp, Homo sapiens
taaaatgtatat

SEQ ID NO: 2333072 - DNA, 17 bp, Homo sapiens
taaaatgtgtatttttc

SEQ ID NO: 2333073 - DNA, 21 bp, Homo sapiens
taaaatgtgtatttttcaagg

SEQ ID NO: 2333074 - DNA, 23 bp, Homo sapiens
taaaatgtttcattatgcacttt

SEQ ID NO: 2333075 - DNA, 20 bp, Homo sapiens
taaaatgttttatgacattt

SEQ ID NO: 2333076 - DNA, 18 bp, Homo sapiens
taaaattcaaaagtattg

SEQ ID NO: 2333077 - DNA, 12 bp, Homo sapiens
taaaattgttat

SEQ ID NO: 2333078 - DNA, 16 bp, Homo sapiens
taaaatttacacatct

SEQ ID NO: 2333079 - DNA, 16 bp, Homo sapiens
taaaattttgtatgtt

SEQ ID NO: 2333080 - DNA, 23 bp, Homo sapiens
taaaattttgtatgttaaagaga

SEQ ID NO: 2333081 - DNA, 18 bp, Homo sapiens
taaacatgtatgtaaata

SEQ ID NO: 2333082 - DNA, 18 bp, Homo sapiens
taaaccaaaaacatttga

SEQ ID NO: 2333083 - DNA, 17 bp, Homo sapiens
taacccactgagaggac

SEQ ID NO: 2333084 - DNA, 20 bp, Homo sapiens
taaccctttggtttttttct

SEQ ID NO: 2333085 - DNA, 19 bp, Homo sapiens
taacctagttaaagaaagg

SEQ ID NO: 2333086 - DNA, 20 bp, Homo sapiens
taacgtttttcctttaaaaa

SEQ ID NO: 2333087 - DNA, 15 bp, Homo sapiens
taactataaggtgcc

SEQ ID NO: 2333088 - DNA, 17 bp, Homo sapiens
taactatttttttcaaa

SEQ ID NO: 2333089 - DNA, 18 bp, Homo sapiens
taactatttttttcaaag

SEQ ID NO: 2333090 - DNA, 15 bp, Homo sapiens
taactcaaatacaca

SEQ ID NO: 2333091 - DNA, 18 bp, Homo sapiens
taactcaaatacacattt

SEQ ID NO: 2333092 - DNA, 21 bp, Homo sapiens
taactcaaatacacatttgct

SEQ ID NO: 2333093 - DNA, 21 bp, Homo sapiens
taactcaccagccccactgcc

SEQ ID NO: 2333094 - DNA, 16 bp, Homo sapiens
taactcataatttttg

SEQ ID NO: 2333095 - DNA, 21 bp, Homo sapiens
taactgaaaatgtgctatact

SEQ ID NO: 2333096 - DNA, 13 bp, Homo sapiens
taactgaatttgg

SEQ ID NO: 2333097 - DNA, 18 bp, Homo sapiens
taactgccattttttgtc

SEQ ID NO: 2333098 - DNA, 14 bp, Homo sapiens
taactttacagaaa

SEQ ID NO: 2333099 - DNA, 17 bp, Homo sapiens
taagaaaactattaaga

SEQ ID NO: 2333100 - DNA, 14 bp, Homo sapiens
taagaaagcaaaac

SEQ ID NO: 2333101 - DNA, 15 bp, Homo sapiens
taagaagacatgaac

SEQ ID NO: 2333102 - DNA, 18 bp, Homo sapiens
taagaagctgttgtacat

SEQ ID NO: 2333103 - DNA, 20 bp, Homo sapiens
taagaaggcaatattaacct

SEQ ID NO: 2333104 - DNA, 18 bp, Homo sapiens
taagaataccacatcaaa

SEQ ID NO: 2333105 - DNA, 22 bp, Homo sapiens
taagaataccacatcaaataag

SEQ ID NO: 2333106 - DNA, 20 bp, Homo sapiens
taagaattctgattgatttg

SEQ ID NO: 2333107 - DNA, 18 bp, Homo sapiens
taagactatatatataaa

SEQ ID NO: 2333108 - DNA, 19 bp, Homo sapiens
taagactatatatataaat

SEQ ID NO: 2333109 - DNA, 17 bp, Homo sapiens
taagactgtagatatgt

SEQ ID NO: 2333110 - DNA, 15 bp, Homo sapiens
taagagattttatgt

SEQ ID NO: 2333111 - DNA, 16 bp, Homo sapiens
taagagattttatgtt

SEQ ID NO: 2333112 - DNA, 14 bp, Homo sapiens
taagagcagtcaca

SEQ ID NO: 2333113 - DNA, 19 bp, Homo sapiens
taagagcagtcacaacaga

SEQ ID NO: 2333114 - DNA, 13 bp, Homo sapiens
taagagtaaagca

SEQ ID NO: 2333115 - DNA, 19 bp, Homo sapiens
taagagtgtagaagcattc

SEQ ID NO: 2333116 - DNA, 15 bp, Homo sapiens
taagatacaataaaa

SEQ ID NO: 2333117 - DNA, 16 bp, Homo sapiens
taagatagtgtaactt

SEQ ID NO: 2333118 - DNA, 14 bp, Homo sapiens
taagatatgtaaca

SEQ ID NO: 2333119 - DNA, 16 bp, Homo sapiens
taagatggctgtggca

SEQ ID NO: 2333120 - DNA, 22 bp, Homo sapiens
taagatggctgtggcatttcca

SEQ ID NO: 2333121 - DNA, 23 bp, Homo sapiens
taagatggctgtggcatttccaa

SEQ ID NO: 2333122 - DNA, 17 bp, Homo sapiens
taagattaataagattt

SEQ ID NO: 2333123 - DNA, 18 bp, Homo sapiens
taagattaataagatttt

SEQ ID NO: 2333124 - DNA, 19 bp, Homo sapiens
taagattgcactgttctga

SEQ ID NO: 2333125 - DNA, 14 bp, Homo sapiens
taagatttctctaa

SEQ ID NO: 2333126 - DNA, 14 bp, Homo sapiens
taagatttttcaaa

SEQ ID NO: 2333127 - DNA, 19 bp, Homo sapiens
taagcaaaggggacagctg

SEQ ID NO: 2333128 - DNA, 19 bp, Homo sapiens
taagcaaatgttaaaagtt

SEQ ID NO: 2333129 - DNA, 11 bp, Homo sapiens
taagcacaaaa

SEQ ID NO: 2333130 - DNA, 16 bp, Homo sapiens
taagcacaaaaaattt

SEQ ID NO: 2333131 - DNA, 21 bp, Homo sapiens
taagcattctgagctgggctt

SEQ ID NO: 2333132 - DNA, 17 bp, Homo sapiens
taagccaggcctggctg

SEQ ID NO: 2333133 - DNA, 21 bp, Homo sapiens
taagctaaagaggctgaaaga

SEQ ID NO: 2333134 - DNA, 16 bp, Homo sapiens
taagcttccattttaa

SEQ ID NO: 2333135 - DNA, 23 bp, Homo sapiens
taagcttccattttaattttaaa

SEQ ID NO: 2333136 - DNA, 10 bp, Homo sapiens
taaggaaact

SEQ ID NO: 2333137 - DNA, 15 bp, Homo sapiens
taaggaaactcttat

SEQ ID NO: 2333138 - DNA, 19 bp, Homo sapiens
taaggaaactcttatctca

SEQ ID NO: 2333139 - DNA, 20 bp, Homo sapiens
taaggaaactcttatctcag

SEQ ID NO: 2333140 - DNA, 17 bp, Homo sapiens
taaggaaatgtatattc

SEQ ID NO: 2333141 - DNA, 16 bp, Homo sapiens
taaggagctaaagctg

SEQ ID NO: 2333142 - DNA, 17 bp, Homo sapiens
taaggatttttctctta

SEQ ID NO: 2333143 - DNA, 21 bp, Homo sapiens
taaggcagattttacagagcg

SEQ ID NO: 2333144 - DNA, 18 bp, Homo sapiens
taaggccagggcctctcc

SEQ ID NO: 2333145 - DNA, 13 bp, Homo sapiens
taagggaagaatt

SEQ ID NO: 2333146 - DNA, 15 bp, Homo sapiens
taaggggaagaatga

SEQ ID NO: 2333147 - DNA, 20 bp, Homo sapiens
taaggtcttcttgtgtcctg

SEQ ID NO: 2333148 - DNA, 21 bp, Homo sapiens
taaggtgcctcagttttcctt

SEQ ID NO: 2333149 - DNA, 23 bp, Homo sapiens
taaggtgcctcagttttccttct

SEQ ID NO: 2333150 - DNA, 15 bp, Homo sapiens
taagtagtaaatcag

SEQ ID NO: 2333151 - DNA, 20 bp, Homo sapiens
taagtagtaaatcagaaagt

SEQ ID NO: 2333152 - DNA, 21 bp, Homo sapiens
taagtattatgtctcttctga

SEQ ID NO: 2333153 - DNA, 14 bp, Homo sapiens
taagtctttcatgg

SEQ ID NO: 2333154 - DNA, 16 bp, Homo sapiens
taagtgagcagaacag

SEQ ID NO: 2333155 - DNA, 16 bp, Homo sapiens
taagtgccctctccca

SEQ ID NO: 2333156 - DNA, 21 bp, Homo sapiens
taagtgccctctcccaccctc

SEQ ID NO: 2333157 - DNA, 15 bp, Homo sapiens
taagtggactgtatt

SEQ ID NO: 2333158 - DNA, 17 bp, Homo sapiens
taagtggactgtatttc

SEQ ID NO: 2333159 - DNA, 15 bp, Homo sapiens
taagtgtaaaaaatg

SEQ ID NO: 2333160 - DNA, 18 bp, Homo sapiens
taagtgtaaaaaatgtct

SEQ ID NO: 2333161 - DNA, 19 bp, Homo sapiens
taagtgtaaaaaatgtctc

SEQ ID NO: 2333162 - DNA, 14 bp, Homo sapiens
taagtgtagctcaa

SEQ ID NO: 2333163 - DNA, 20 bp, Homo sapiens
taagttcaaattcttctgaa

SEQ ID NO: 2333164 - DNA, 20 bp, Homo sapiens
taagttgacaccacttagat

SEQ ID NO: 2333165 - DNA, 16 bp, Homo sapiens
taataaaaccaaagaa

SEQ ID NO: 2333166 - DNA, 18 bp, Homo sapiens
taataaaactgtttgact

SEQ ID NO: 2333167 - DNA, 13 bp, Homo sapiens
taataaaagaaca

SEQ ID NO: 2333168 - DNA, 19 bp, Homo sapiens
taataaaataattctaaag

SEQ ID NO: 2333169 - DNA, 11 bp, Homo sapiens
taataaaccag

SEQ ID NO: 2333170 - DNA, 18 bp, Homo sapiens
taataaatgccctcttct

SEQ ID NO: 2333171 - DNA, 12 bp, Homo sapiens
taataacattac

SEQ ID NO: 2333172 - DNA, 15 bp, Homo sapiens
taataacattacctt

SEQ ID NO: 2333173 - DNA, 20 bp, Homo sapiens
taataagatttttcaaaatc

SEQ ID NO: 2333174 - DNA, 19 bp, Homo sapiens
taataagcatggtgtcagt

SEQ ID NO: 2333175 - DNA, 15 bp, Homo sapiens
taataatcttgtttc

SEQ ID NO: 2333176 - DNA, 14 bp, Homo sapiens
taataatgaagtag

SEQ ID NO: 2333177 - DNA, 18 bp, Homo sapiens
taatacctctgtgtgctc

SEQ ID NO: 2333178 - DNA, 17 bp, Homo sapiens
taatactttttaaatta

SEQ ID NO: 2333179 - DNA, 17 bp, Homo sapiens
taatagccaaagatttc

SEQ ID NO: 2333180 - DNA, 23 bp, Homo sapiens
taatagccaaagatttcatatct

SEQ ID NO: 2333181 - DNA, 16 bp, Homo sapiens
taatataaatgttgct

SEQ ID NO: 2333182 - DNA, 12 bp, Homo sapiens
taatatactcct

SEQ ID NO: 2333183 - DNA, 15 bp, Homo sapiens
taatatattaaaatt

SEQ ID NO: 2333184 - DNA, 21 bp, Homo sapiens
taatatcaaataaaatatcat

SEQ ID NO: 2333185 - DNA, 18 bp, Homo sapiens
taatatcaactctgaagc

SEQ ID NO: 2333186 - DNA, 17 bp, Homo sapiens
taatatcagttacagtg

SEQ ID NO: 2333187 - DNA, 20 bp, Homo sapiens
taatatgcttataacctagt

SEQ ID NO: 2333188 - DNA, 20 bp, Homo sapiens
taatatggtcaggaagcaag

SEQ ID NO: 2333189 - DNA, 17 bp, Homo sapiens
taatatgtgagaggaca

SEQ ID NO: 2333190 - DNA, 21 bp, Homo sapiens
taatattcagggtaaatagga

SEQ ID NO: 2333191 - DNA, 19 bp, Homo sapiens
taatattcttttgtttcca

SEQ ID NO: 2333192 - DNA, 13 bp, Homo sapiens
taatcaagagaaa

SEQ ID NO: 2333193 - DNA, 18 bp, Homo sapiens
taatcaagagaaacttca

SEQ ID NO: 2333194 - DNA, 15 bp, Homo sapiens
taatcacgctttcct

SEQ ID NO: 2333195 - DNA, 15 bp, Homo sapiens
taatcagattgctta

SEQ ID NO: 2333196 - DNA, 14 bp, Homo sapiens
taatcagtcatttc

SEQ ID NO: 2333197 - DNA, 15 bp, Homo sapiens
taatcatacaaactc

SEQ ID NO: 2333198 - DNA, 18 bp, Homo sapiens
taatcatacaaactctca

SEQ ID NO: 2333199 - DNA, 18 bp, Homo sapiens
taatctgtttatttacaa

SEQ ID NO: 2333200 - DNA, 19 bp, Homo sapiens
ggtattaaaactaaatttc

SEQ ID NO: 2333201 - DNA, 16 bp, Homo sapiens
ggtcacatccatccct

SEQ ID NO: 2333202 - DNA, 17 bp, Homo sapiens
ggtcagaaccagagggc

SEQ ID NO: 2333203 - DNA, 17 bp, Homo sapiens
ggtcaggagatcgagac

SEQ ID NO: 2333204 - DNA, 11 bp, Homo sapiens
ggtcataaaat

SEQ ID NO: 2333205 - DNA, 15 bp, Homo sapiens
ggtccagctggcctg

SEQ ID NO: 2333206 - DNA, 18 bp, Homo sapiens
ggtccagctggcctggac

SEQ ID NO: 2333207 - DNA, 20 bp, Homo sapiens
ggtccatagagatgagccca

SEQ ID NO: 2333208 - DNA, 14 bp, Homo sapiens
ggtcctagacaaac

SEQ ID NO: 2333209 - DNA, 17 bp, Homo sapiens
ggtcctagcccttccct

SEQ ID NO: 2333210 - DNA, 14 bp, Homo sapiens
ggtctaggacacag

SEQ ID NO: 2333211 - DNA, 22 bp, Homo sapiens
taaatttcttatgtgacattaa

SEQ ID NO: 2333212 - DNA, 13 bp, Homo sapiens
taaatttgtaagt

SEQ ID NO: 2333213 - DNA, 13 bp, Homo sapiens
taaattttaaagc

SEQ ID NO: 2333214 - DNA, 14 bp, Homo sapiens
taaatttttttcct

SEQ ID NO: 2333215 - DNA, 12 bp, Homo sapiens
taacaaataaaa

SEQ ID NO: 2333216 - DNA, 21 bp, Homo sapiens
taacaaataaaaaagctcttt

SEQ ID NO: 2333217 - DNA, 18 bp, Homo sapiens
taacaacaattatttgaa

SEQ ID NO: 2333218 - DNA, 15 bp, Homo sapiens
taacaaggagatttc

SEQ ID NO: 2333219 - DNA, 16 bp, Homo sapiens
taacaaggagatttct

SEQ ID NO: 2333220 - DNA, 18 bp, Homo sapiens
taacaaggagatttctta

SEQ ID NO: 2333221 - DNA, 18 bp, Homo sapiens
taacaatacatgagaaag

SEQ ID NO: 2333222 - DNA, 19 bp, Homo sapiens
taacaatacatgagaaaga

SEQ ID NO: 2333223 - DNA, 19 bp, Homo sapiens
taacaatgttaaggaaact

SEQ ID NO: 2333224 - DNA, 13 bp, Homo sapiens
taacacaaaggaa

SEQ ID NO: 2333225 - DNA, 20 bp, Homo sapiens
taacacatttttttgcatgc

SEQ ID NO: 2333226 - DNA, 17 bp, Homo sapiens
taacagaaactcctaat

SEQ ID NO: 2333227 - DNA, 16 bp, Homo sapiens
taacagaacagcttca

SEQ ID NO: 2333228 - DNA, 17 bp, Homo sapiens
taacagaacagcttcag

SEQ ID NO: 2333229 - DNA, 19 bp, Homo sapiens
taacagaacagcttcaggt

SEQ ID NO: 2333230 - DNA, 20 bp, Homo sapiens
taacagaacagcttcaggtt

SEQ ID NO: 2333231 - DNA, 21 bp, Homo sapiens
taacagaacagcttcaggtta

SEQ ID NO: 2333232 - DNA, 18 bp, Homo sapiens
taacagataagcaagaga

SEQ ID NO: 2333233 - DNA, 20 bp, Homo sapiens
taacagctacaaacttttaa

SEQ ID NO: 2333234 - DNA, 16 bp, Homo sapiens
taacagtaactgccat

SEQ ID NO: 2333235 - DNA, 19 bp, Homo sapiens
taacagtaactgccatttt

SEQ ID NO: 2333236 - DNA, 14 bp, Homo sapiens
taacataaataaaa

SEQ ID NO: 2333237 - DNA, 18 bp, Homo sapiens
taacataaataaaaattc

SEQ ID NO: 2333238 - DNA, 20 bp, Homo sapiens
taacatacaagaaaatgtat

SEQ ID NO: 2333239 - DNA, 23 bp, Homo sapiens
taacatacaagaaaatgtatcca

SEQ ID NO: 2333240 - DNA, 20 bp, Homo sapiens
taacatctttattgaaattc

SEQ ID NO: 2333241 - DNA, 19 bp, Homo sapiens
taacatgacttccttattt

SEQ ID NO: 2333242 - DNA, 15 bp, Homo sapiens
taacattcttggtca

SEQ ID NO: 2333243 - DNA, 16 bp, Homo sapiens
taacattcttggtcac

SEQ ID NO: 2333244 - DNA, 14 bp, Homo sapiens
taacattttacagt

SEQ ID NO: 2333245 - DNA, 15 bp, Homo sapiens
taaccagcattccct

SEQ ID NO: 2333246 - DNA, 11 bp, Homo sapiens
ccatggccctg

SEQ ID NO: 2333247 - DNA, 13 bp, Homo sapiens
ccatggccctgtc

SEQ ID NO: 2333248 - DNA, 18 bp, Homo sapiens
ccatggccctgtcccagg

SEQ ID NO: 2333249 - DNA, 16 bp, Homo sapiens
ccatggcctgcaaact

SEQ ID NO: 2333250 - DNA, 18 bp, Homo sapiens
ccatggcctgcaaactgg

SEQ ID NO: 2333251 - DNA, 21 bp, Homo sapiens
ccatggcctgcaaactgggaa

SEQ ID NO: 2333252 - DNA, 20 bp, Homo sapiens
ccatgggcctgctgcgtcag

SEQ ID NO: 2333253 - DNA, 23 bp, Homo sapiens
ccatgggcctgctgcgtcagacc

SEQ ID NO: 2333254 - DNA, 13 bp, Homo sapiens
ccatgggcttcac

SEQ ID NO: 2333255 - DNA, 18 bp, Homo sapiens
ccatggtgtgtttgtaat

SEQ ID NO: 2333256 - DNA, 19 bp, Homo sapiens
ccatggtgtgtttgtaata

SEQ ID NO: 2333257 - DNA, 13 bp, Homo sapiens
ccatgtcatgtga

SEQ ID NO: 2333258 - DNA, 13 bp, Homo sapiens
ccatgtccaaaga

SEQ ID NO: 2333259 - DNA, 14 bp, Homo sapiens
ccatgtccaaagag

SEQ ID NO: 2333260 - DNA, 19 bp, Homo sapiens
ccatgtccaaagaggctgc

SEQ ID NO: 2333261 - DNA, 15 bp, Homo sapiens
ccatgtcccctccca

SEQ ID NO: 2333262 - DNA, 16 bp, Homo sapiens
ccatgtcttctccctg

SEQ ID NO: 2333263 - DNA, 20 bp, Homo sapiens
ccatgtcttctccctggaat

SEQ ID NO: 2333264 - DNA, 12 bp, Homo sapiens
ccatgtggccac

SEQ ID NO: 2333265 - DNA, 22 bp, Homo sapiens
ccattaactatttttttcaaag

SEQ ID NO: 2333266 - DNA, 20 bp, Homo sapiens
ccattaaggggaagaatgaa

SEQ ID NO: 2333267 - DNA, 23 bp, Homo sapiens
ccattacagaggtattaaaacta

SEQ ID NO: 2333268 - DNA, 14 bp, Homo sapiens
ccattaccaaaata

SEQ ID NO: 2333269 - DNA, 13 bp, Homo sapiens
ccattacctccat

SEQ ID NO: 2333270 - DNA, 19 bp, Homo sapiens
ccattcacaataaaagctt

SEQ ID NO: 2333271 - DNA, 20 bp, Homo sapiens
ccattcacaataaaagctta

SEQ ID NO: 2333272 - DNA, 16 bp, Homo sapiens
ccattcatccttccat

SEQ ID NO: 2333273 - DNA, 22 bp, Homo sapiens
ccattcctgagttacttccctt

SEQ ID NO: 2333274 - DNA, 11 bp, Homo sapiens
ccattcctgat

SEQ ID NO: 2333275 - DNA, 18 bp, Homo sapiens
ccattccttgcgcctcag

SEQ ID NO: 2333276 - DNA, 11 bp, Homo sapiens
ccattctccca

SEQ ID NO: 2333277 - DNA, 13 bp, Homo sapiens
ccattctcccagg

SEQ ID NO: 2333278 - DNA, 22 bp, Homo sapiens
ccattctgccgccccctcctga

SEQ ID NO: 2333279 - DNA, 14 bp, Homo sapiens
ccattctgctcctt

SEQ ID NO: 2333280 - DNA, 16 bp, Homo sapiens
ccattggatctgcaag

SEQ ID NO: 2333281 - DNA, 19 bp, Homo sapiens
ccattgggcacagtccaga

SEQ ID NO: 2333282 - DNA, 19 bp, Homo sapiens
ccatttaaatttttttcct

SEQ ID NO: 2333283 - DNA, 13 bp, Homo sapiens
ccatttcccatct

SEQ ID NO: 2333284 - DNA, 16 bp, Homo sapiens
ccatttcccatctgca

SEQ ID NO: 2333285 - DNA, 18 bp, Homo sapiens
ccatttcccatctgcacc

SEQ ID NO: 2333286 - DNA, 13 bp, Homo sapiens
ccatttcctgaga

SEQ ID NO: 2333287 - DNA, 20 bp, Homo sapiens
ccatttccttgtctaaagat

SEQ ID NO: 2333288 - DNA, 19 bp, Homo sapiens
ccatttgcaataacagctg

SEQ ID NO: 2333289 - DNA, 13 bp, Homo sapiens
ccatttgtcccag

SEQ ID NO: 2333290 - DNA, 14 bp, Homo sapiens
ccatttgtgccaga

SEQ ID NO: 2333291 - DNA, 15 bp, Homo sapiens
ccatttgtgccagag

SEQ ID NO: 2333292 - DNA, 20 bp, Homo sapiens
cccaaccctatctcctgaca

SEQ ID NO: 2333293 - DNA, 13 bp, Homo sapiens
cccaacctcaggg

SEQ ID NO: 2333294 - DNA, 20 bp, Homo sapiens
cccaacctcagggctcccag

SEQ ID NO: 2333295 - DNA, 13 bp, Homo sapiens
cccaacctgctct

SEQ ID NO: 2333296 - DNA, 19 bp, Homo sapiens
cccaacctgctctcctctt

SEQ ID NO: 2333297 - DNA, 18 bp, Homo sapiens
cccaactccaggaaagag

SEQ ID NO: 2333298 - DNA, 16 bp, Homo sapiens
cccaaggctggcaggt

SEQ ID NO: 2333299 - DNA, 13 bp, Homo sapiens
cccaagtgcctca

SEQ ID NO: 2333300 - DNA, 14 bp, Homo sapiens
cccaatgtttaaaa

SEQ ID NO: 2333301 - DNA, 23 bp, Homo sapiens
cccacactcccaaggttggagcc

SEQ ID NO: 2333302 - DNA, 17 bp, Homo sapiens
cccacagcgtccctggc

SEQ ID NO: 2333303 - DNA, 21 bp, Homo sapiens
cccaccagacgtcaggccctg

SEQ ID NO: 2333304 - DNA, 15 bp, Homo sapiens
cccacccacatgtga

SEQ ID NO: 2333305 - DNA, 18 bp, Homo sapiens
cccaccccaacctgctct

SEQ ID NO: 2333306 - DNA, 15 bp, Homo sapiens
cccaccccctgccct

SEQ ID NO: 2333307 - DNA, 14 bp, Homo sapiens
cccaccccggggac

SEQ ID NO: 2333308 - DNA, 17 bp, Homo sapiens
cccaccccggggaccct

SEQ ID NO: 2333309 - DNA, 20 bp, Homo sapiens
cccaccccggggaccctgtg

SEQ ID NO: 2333310 - DNA, 21 bp, Homo sapiens
cccaccccggggaccctgtga

SEQ ID NO: 2333311 - DNA, 12 bp, Homo sapiens
cccacccctgcc

SEQ ID NO: 2333312 - DNA, 15 bp, Homo sapiens
cccaccctcttccta

SEQ ID NO: 2333313 - DNA, 15 bp, Homo sapiens
cccaccctgcgggcc

SEQ ID NO: 2333314 - DNA, 18 bp, Homo sapiens
cccaccctgcgggccagg

SEQ ID NO: 2333315 - DNA, 16 bp, Homo sapiens
cccaccctgttcctgc

SEQ ID NO: 2333316 - DNA, 17 bp, Homo sapiens
cccaccctgttcctgct

SEQ ID NO: 2333317 - DNA, 20 bp, Homo sapiens
cccaccctgttcctgctgct

SEQ ID NO: 2333318 - DNA, 20 bp, Homo sapiens
cccaccgtggaggaggaagg

SEQ ID NO: 2333319 - DNA, 13 bp, Homo sapiens
cccacctgccggc

SEQ ID NO: 2333320 - DNA, 22 bp, Homo sapiens
cccacctttgggatcagcctcc

SEQ ID NO: 2333321 - DNA, 13 bp, Homo sapiens
cccacgcagagga

SEQ ID NO: 2333322 - DNA, 20 bp, Homo sapiens
cactttgaaaagttggaagg

SEQ ID NO: 2333323 - DNA, 21 bp, Homo sapiens
cactttgttgcaagatgtgaa

SEQ ID NO: 2333324 - DNA, 23 bp, Homo sapiens
cactttgttgcaagatgtgaatt

SEQ ID NO: 2333325 - DNA, 12 bp, Homo sapiens
cacttttcccac

SEQ ID NO: 2333326 - DNA, 14 bp, Homo sapiens
cacttttcccactc

SEQ ID NO: 2333327 - DNA, 19 bp, Homo sapiens
cacttttcccactccaagc

SEQ ID NO: 2333328 - DNA, 22 bp, Homo sapiens
cactttttcatagtcattgtgg

SEQ ID NO: 2333329 - DNA, 20 bp, Homo sapiens
cagaaaaatgaaatttaagc

SEQ ID NO: 2333330 - DNA, 12 bp, Homo sapiens
cagaaacatctc

SEQ ID NO: 2333331 - DNA, 16 bp, Homo sapiens
cagaaacatctctggc

SEQ ID NO: 2333332 - DNA, 20 bp, Homo sapiens
cagaaagatttgatgggcca

SEQ ID NO: 2333333 - DNA, 21 bp, Homo sapiens
cagaaagatttgatgggccac

SEQ ID NO: 2333334 - DNA, 15 bp, Homo sapiens
cagaaagcctctctc

SEQ ID NO: 2333335 - DNA, 17 bp, Homo sapiens
cagaaagcctctctctc

SEQ ID NO: 2333336 - DNA, 14 bp, Homo sapiens
cagaaatagacaaa

SEQ ID NO: 2333337 - DNA, 21 bp, Homo sapiens
cagaaatataacacatttttt

SEQ ID NO: 2333338 - DNA, 14 bp, Homo sapiens
cagaaatgctgctg

SEQ ID NO: 2333339 - DNA, 16 bp, Homo sapiens
cagaaatgctgctggc

SEQ ID NO: 2333340 - DNA, 18 bp, Homo sapiens
cagaacctgagctatttt

SEQ ID NO: 2333341 - DNA, 18 bp, Homo sapiens
cagaacctgcacacagga

SEQ ID NO: 2333342 - DNA, 22 bp, Homo sapiens
cagaacctgcacacaggacagc

SEQ ID NO: 2333343 - DNA, 16 bp, Homo sapiens
cagaaccttgtcccag

SEQ ID NO: 2333344 - DNA, 18 bp, Homo sapiens
cagaaccttgtcccagcc

SEQ ID NO: 2333345 - DNA, 17 bp, Homo sapiens
cagaactaccaggtggc

SEQ ID NO: 2333346 - DNA, 16 bp, Homo sapiens
cagaactgtgccacaa

SEQ ID NO: 2333347 - DNA, 20 bp, Homo sapiens
cagaacttgctgctgtcttg

SEQ ID NO: 2333348 - DNA, 17 bp, Homo sapiens
cagaagacaccagagca

SEQ ID NO: 2333349 - DNA, 20 bp, Homo sapiens
cagaagacaccagagcagat

SEQ ID NO: 2333350 - DNA, 20 bp, Homo sapiens
cagaagcacagaatattttt

SEQ ID NO: 2333351 - DNA, 15 bp, Homo sapiens
cagaagcctccaagc

SEQ ID NO: 2333352 - DNA, 19 bp, Homo sapiens
cagaagcctccaagcacag

SEQ ID NO: 2333353 - DNA, 21 bp, Homo sapiens
cagaagcctccaagcacagag

SEQ ID NO: 2333354 - DNA, 18 bp, Homo sapiens
cccgccccagagtggccc

SEQ ID NO: 2333355 - DNA, 20 bp, Homo sapiens
cccgccgcccctccacccat

SEQ ID NO: 2333356 - DNA, 21 bp, Homo sapiens
cccggaggccgaggccatgtg

SEQ ID NO: 2333357 - DNA, 14 bp, Homo sapiens
cccgggatattata

SEQ ID NO: 2333358 - DNA, 18 bp, Homo sapiens
cccgggatattatagaaa

SEQ ID NO: 2333359 - DNA, 14 bp, Homo sapiens
cccgggccagggct

SEQ ID NO: 2333360 - DNA, 18 bp, Homo sapiens
cccggggaccctgtgaca

SEQ ID NO: 2333361 - DNA, 21 bp, Homo sapiens
cccggggaccctgtgacatgg

SEQ ID NO: 2333362 - DNA, 14 bp, Homo sapiens
cccggtaccttcca

SEQ ID NO: 2333363 - DNA, 18 bp, Homo sapiens
ccctaaactttggccttt

SEQ ID NO: 2333364 - DNA, 21 bp, Homo sapiens
ccctaaccccttccagatcac

SEQ ID NO: 2333365 - DNA, 14 bp, Homo sapiens
ccctaaccctttgt

SEQ ID NO: 2333366 - DNA, 13 bp, Homo sapiens
ccctacagcctag

SEQ ID NO: 2333367 - DNA, 12 bp, Homo sapiens
ccctacctgctt

SEQ ID NO: 2333368 - DNA, 14 bp, Homo sapiens
ccctacctgcttca

SEQ ID NO: 2333369 - DNA, 19 bp, Homo sapiens
ccctactccctgcagatgc

SEQ ID NO: 2333370 - DNA, 21 bp, Homo sapiens
ccctactccctgcagatgcca

SEQ ID NO: 2333371 - DNA, 20 bp, Homo sapiens
ccctagccaatgtctcctcc

SEQ ID NO: 2333372 - DNA, 18 bp, Homo sapiens
ccctatagcactgagctc

SEQ ID NO: 2333373 - DNA, 13 bp, Homo sapiens
ccctatctcctga

SEQ ID NO: 2333374 - DNA, 22 bp, Homo sapiens
ccctatctcctgacagaaggtg

SEQ ID NO: 2333375 - DNA, 14 bp, Homo sapiens
ccctatgggcctgc

SEQ ID NO: 2333376 - DNA, 21 bp, Homo sapiens
ccctattctatccatctcctg

SEQ ID NO: 2333377 - DNA, 21 bp, Homo sapiens
ccctcactattcttggaccat

SEQ ID NO: 2333378 - DNA, 14 bp, Homo sapiens
ccctcagggagcct

SEQ ID NO: 2333379 - DNA, 17 bp, Homo sapiens
ccctcagggagcctccc

SEQ ID NO: 2333380 - DNA, 15 bp, Homo sapiens
ccctcaggttccttt

SEQ ID NO: 2333381 - DNA, 16 bp, Homo sapiens
ccctcaggttcctttt

SEQ ID NO: 2333382 - DNA, 23 bp, Homo sapiens
ccctccaaatggagaagctgcag

SEQ ID NO: 2333383 - DNA, 17 bp, Homo sapiens
ccctccaccgagccacg

SEQ ID NO: 2333384 - DNA, 13 bp, Homo sapiens
ccctccacctcaa

SEQ ID NO: 2333385 - DNA, 23 bp, Homo sapiens
ccctccattgggcacagtccaga

SEQ ID NO: 2333386 - DNA, 24 bp, Homo sapiens
ccctccattgggcacagtccagac

SEQ ID NO: 2333387 - DNA, 13 bp, Homo sapiens
ccctccccccaga

SEQ ID NO: 2333388 - DNA, 16 bp, Homo sapiens
ccctccccccagactc

SEQ ID NO: 2333389 - DNA, 14 bp, Homo sapiens
ccctccctgcctga

SEQ ID NO: 2333390 - DNA, 23 bp, Homo sapiens
ccctcctccaggcctgcctccca

SEQ ID NO: 2333391 - DNA, 23 bp, Homo sapiens
ccctcctggcgagttctctttgg

SEQ ID NO: 2333392 - DNA, 16 bp, Homo sapiens
ccctcggtgggagcca

SEQ ID NO: 2333393 - DNA, 20 bp, Homo sapiens
ccctcgtcccatccagctac

SEQ ID NO: 2333394 - DNA, 19 bp, Homo sapiens
ccctctccatctcccaagg

SEQ ID NO: 2333395 - DNA, 11 bp, Homo sapiens
ccctctcccac

SEQ ID NO: 2333396 - DNA, 13 bp, Homo sapiens
ccctctcccaccc

SEQ ID NO: 2333397 - DNA, 14 bp, Homo sapiens
ccctctgcccctcc

SEQ ID NO: 2333398 - DNA, 22 bp, Homo sapiens
ccctctgtctaggactgcagtg

SEQ ID NO: 2333399 - DNA, 20 bp, Homo sapiens
ccctcttcccttctgagtct

SEQ ID NO: 2333400 - DNA, 22 bp, Homo sapiens
ccctcttcctactggtctctct

SEQ ID NO: 2333401 - DNA, 14 bp, Homo sapiens
ccctcttctgagca

SEQ ID NO: 2333402 - DNA, 15 bp, Homo sapiens
ccctcttctgagcac

SEQ ID NO: 2333403 - DNA, 15 bp, Homo sapiens
ccctcttgcccatcc

SEQ ID NO: 2333404 - DNA, 16 bp, Homo sapiens
ccctcttgcccatcct

SEQ ID NO: 2333405 - DNA, 15 bp, Homo sapiens
ccctgaacgttttct

SEQ ID NO: 2333406 - DNA, 18 bp, Homo sapiens
ccctgaacgttttcttct

SEQ ID NO: 2333407 - DNA, 19 bp, Homo sapiens
ccctgacctggccccctca

SEQ ID NO: 2333408 - DNA, 21 bp, Homo sapiens
ccctgaggatgggtcagagct

SEQ ID NO: 2333409 - DNA, 22 bp, Homo sapiens
ccctgaggatgggtcagagcta

SEQ ID NO: 2333410 - DNA, 18 bp, Homo sapiens
ccctgaggccctgggctg

SEQ ID NO: 2333411 - DNA, 17 bp, Homo sapiens
ccctgaggcggaggctg

SEQ ID NO: 2333412 - DNA, 14 bp, Homo sapiens
ccctgagtgcgggc

SEQ ID NO: 2333413 - DNA, 15 bp, Homo sapiens
ccctgagtgcgggct

SEQ ID NO: 2333414 - DNA, 13 bp, Homo sapiens
ccctgcacgtcat

SEQ ID NO: 2333415 - DNA, 12 bp, Homo sapiens
ccctgcagacct

SEQ ID NO: 2333416 - DNA, 18 bp, Homo sapiens
ccctgcagatgccaccct

SEQ ID NO: 2333417 - DNA, 13 bp, Homo sapiens
ccctgccacagcc

SEQ ID NO: 2333418 - DNA, 15 bp, Homo sapiens
ccctgccacagccag

SEQ ID NO: 2333419 - DNA, 12 bp, Homo sapiens
ccctgccctgca

SEQ ID NO: 2333420 - DNA, 15 bp, Homo sapiens
ccctgccctgtgggg

SEQ ID NO: 2333421 - DNA, 12 bp, Homo sapiens
ccctgcctgagg

SEQ ID NO: 2333422 - DNA, 17 bp, Homo sapiens
ccctgcctggcccccaa

SEQ ID NO: 2333423 - DNA, 21 bp, Homo sapiens
ccctgcctggcccccaacctc

SEQ ID NO: 2333424 - DNA, 14 bp, Homo sapiens
ccctgcgggccagg

SEQ ID NO: 2333425 - DNA, 18 bp, Homo sapiens
ccctgcgggccagggtcc

SEQ ID NO: 2333426 - DNA, 13 bp, Homo sapiens
ccctgctacacct

SEQ ID NO: 2333427 - DNA, 16 bp, Homo sapiens
ccctgctacacctatt

SEQ ID NO: 2333428 - DNA, 21 bp, Homo sapiens
ccctgctgaacacagtgtctg

SEQ ID NO: 2333429 - DNA, 18 bp, Homo sapiens
ccctgctgagtcatctgt

SEQ ID NO: 2333430 - DNA, 14 bp, Homo sapiens
ccctgcttccagga

SEQ ID NO: 2333431 - DNA, 16 bp, Homo sapiens
ccctgcttccaggaaa

SEQ ID NO: 2333432 - DNA, 15 bp, Homo sapiens
ccctggaagagccca

SEQ ID NO: 2333433 - DNA, 20 bp, Homo sapiens
ccctggacaggcagcctcct

SEQ ID NO: 2333434 - DNA, 22 bp, Homo sapiens
ccctggacaggcagcctccttt

SEQ ID NO: 2333435 - DNA, 13 bp, Homo sapiens
ccctggacctggg

SEQ ID NO: 2333436 - DNA, 20 bp, Homo sapiens
ccctggctccctcctccagg

SEQ ID NO: 2333437 - DNA, 23 bp, Homo sapiens
ccctggctccctcctccaggcct

SEQ ID NO: 2333438 - DNA, 18 bp, Homo sapiens
cccaggagatgggtccag

SEQ ID NO: 2333439 - DNA, 20 bp, Homo sapiens
cccaggagatgggtccaggg

SEQ ID NO: 2333440 - DNA, 20 bp, Homo sapiens
cccaggccggcccagatgtg

SEQ ID NO: 2333441 - DNA, 14 bp, Homo sapiens
cccagggagtccag

SEQ ID NO: 2333442 - DNA, 19 bp, Homo sapiens
cccagggcatcttgctggc

SEQ ID NO: 2333443 - DNA, 23 bp, Homo sapiens
cccagggccctcggtgggagcca

SEQ ID NO: 2333444 - DNA, 21 bp, Homo sapiens
cccagggctccctcctggagc

SEQ ID NO: 2333445 - DNA, 17 bp, Homo sapiens
cccaggggaaggccctg

SEQ ID NO: 2333446 - DNA, 19 bp, Homo sapiens
cccaggggaaggccctgag

SEQ ID NO: 2333447 - DNA, 16 bp, Homo sapiens
cccaggggtctccctg

SEQ ID NO: 2333448 - DNA, 17 bp, Homo sapiens
cccaggggtctccctgg

SEQ ID NO: 2333449 - DNA, 18 bp, Homo sapiens
cccaggggtctccctggc

SEQ ID NO: 2333450 - DNA, 22 bp, Homo sapiens
cccaggggtctccctggctccc

SEQ ID NO: 2333451 - DNA, 23 bp, Homo sapiens
cccaggggtctccctggctccct

SEQ ID NO: 2333452 - DNA, 14 bp, Homo sapiens
cccaggtaccagct

SEQ ID NO: 2333453 - DNA, 18 bp, Homo sapiens
cccagtccccacccctgc

SEQ ID NO: 2333454 - DNA, 17 bp, Homo sapiens
cccagtgagactgcccc

SEQ ID NO: 2333455 - DNA, 16 bp, Homo sapiens
cccagtgctcaccagc

SEQ ID NO: 2333456 - DNA, 22 bp, Homo sapiens
cccatcgtctcggccttcacaa

SEQ ID NO: 2333457 - DNA, 13 bp, Homo sapiens
cccatctgcaccc

SEQ ID NO: 2333458 - DNA, 22 bp, Homo sapiens
cccatctgtccagctggggcca

SEQ ID NO: 2333459 - DNA, 23 bp, Homo sapiens
cccatggagattgacctggatgg

SEQ ID NO: 2333460 - DNA, 21 bp, Homo sapiens
cccattccttgcgcctcagcc

SEQ ID NO: 2333461 - DNA, 20 bp, Homo sapiens
cccattgttgtcaaggaaga

SEQ ID NO: 2333462 - DNA, 12 bp, Homo sapiens
cccatttcagct

SEQ ID NO: 2333463 - DNA, 15 bp, Homo sapiens
cccatttcccatctg

SEQ ID NO: 2333464 - DNA, 16 bp, Homo sapiens
cccatttcccatctgc

SEQ ID NO: 2333465 - DNA, 19 bp, Homo sapiens
cccatttcccatctgcacc

SEQ ID NO: 2333466 - DNA, 18 bp, Homo sapiens
cccatttccttgtctaaa

SEQ ID NO: 2333467 - DNA, 15 bp, Homo sapiens
cccatttgtcccaga

SEQ ID NO: 2333468 - DNA, 12 bp, Homo sapiens
cccatttttcct

SEQ ID NO: 2333469 - DNA, 14 bp, Homo sapiens
ccccaaaggcatcc

SEQ ID NO: 2333470 - DNA, 13 bp, Homo sapiens
ccccaacctcagg

SEQ ID NO: 2333471 - DNA, 21 bp, Homo sapiens
ccccaacctcagggctcccag

SEQ ID NO: 2333472 - DNA, 16 bp, Homo sapiens
ccccaacctgctctcc

SEQ ID NO: 2333473 - DNA, 19 bp, Homo sapiens
ccccaacctgctctcctct

SEQ ID NO: 2333474 - DNA, 17 bp, Homo sapiens
ccccaactccaggaaag

SEQ ID NO: 2333475 - DNA, 17 bp, Homo sapiens
ccccaatcggactgcca

SEQ ID NO: 2333476 - DNA, 18 bp, Homo sapiens
ccccacagcgtccctggc

SEQ ID NO: 2333477 - DNA, 19 bp, Homo sapiens
ccccaccatatgaattgta

SEQ ID NO: 2333478 - DNA, 22 bp, Homo sapiens
ccccaccccggggaccctgtga

SEQ ID NO: 2333479 - DNA, 13 bp, Homo sapiens
ccccacccctgcc

SEQ ID NO: 2333480 - DNA, 20 bp, Homo sapiens
ccccaccctgttcctgctgc

SEQ ID NO: 2333481 - DNA, 17 bp, Homo sapiens
ccccaccggtccagctg

SEQ ID NO: 2333482 - DNA, 19 bp, Homo sapiens
ccccaccggtccagctggc

SEQ ID NO: 2333483 - DNA, 15 bp, Homo sapiens
ccccaccttgccagg

SEQ ID NO: 2333484 - DNA, 21 bp, Homo sapiens
ccccacggagacagaggaaag

SEQ ID NO: 2333485 - DNA, 14 bp, Homo sapiens
ccccactcccacat

SEQ ID NO: 2333486 - DNA, 15 bp, Homo sapiens
ccccactgccagcag

SEQ ID NO: 2333487 - DNA, 16 bp, Homo sapiens
ccccactgccagcagc

SEQ ID NO: 2333488 - DNA, 17 bp, Homo sapiens
ccccactgccagcagca

SEQ ID NO: 2333489 - DNA, 19 bp, Homo sapiens
ccccactgccagcagcagc

SEQ ID NO: 2333490 - DNA, 13 bp, Homo sapiens
ccccactggctgg

SEQ ID NO: 2333491 - DNA, 10 bp, Homo sapiens
ccccagagag

SEQ ID NO: 2333492 - DNA, 16 bp, Homo sapiens
ccccagagctgcctgc

SEQ ID NO: 2333493 - DNA, 15 bp, Homo sapiens
ccccagagtggccca

SEQ ID NO: 2333494 - DNA, 15 bp, Homo sapiens
ccccagcactcacac

SEQ ID NO: 2333495 - DNA, 18 bp, Homo sapiens
ccccagcattctcaggca

SEQ ID NO: 2333496 - DNA, 19 bp, Homo sapiens
ccccagccatgccagctgg

SEQ ID NO: 2333497 - DNA, 13 bp, Homo sapiens
ccccagccctgct

SEQ ID NO: 2333498 - DNA, 14 bp, Homo sapiens
ccccagccctgctg

SEQ ID NO: 2333499 - DNA, 16 bp, Homo sapiens
ccccagccctgctggg

SEQ ID NO: 2333500 - DNA, 20 bp, Homo sapiens
ccccagccctgctggggatc

SEQ ID NO: 2333501 - DNA, 13 bp, Homo sapiens
ccccagcctgggc

SEQ ID NO: 2333502 - DNA, 15 bp, Homo sapiens
ccccaggctggagac

SEQ ID NO: 2333503 - DNA, 19 bp, Homo sapiens
ccccaggctggagtgcagt

SEQ ID NO: 2333504 - DNA, 15 bp, Homo sapiens
ccccagtgctggaag

SEQ ID NO: 2333505 - DNA, 13 bp, Homo sapiens
ccccatctccctg

SEQ ID NO: 2333506 - DNA, 17 bp, Homo sapiens
ccccatctccctgcctg

SEQ ID NO: 2333507 - DNA, 18 bp, Homo sapiens
ccccatctccctgcctgg

SEQ ID NO: 2333508 - DNA, 19 bp, Homo sapiens
ccccatctgtccagctggg

SEQ ID NO: 2333509 - DNA, 20 bp, Homo sapiens
ccccattcctgatcccatgg

SEQ ID NO: 2333510 - DNA, 20 bp, Homo sapiens
ccccattccttgcgcctcag

SEQ ID NO: 2333511 - DNA, 14 bp, Homo sapiens
ccccatttctgagg

SEQ ID NO: 2333512 - DNA, 15 bp, Homo sapiens
ccccatttctgcctc

SEQ ID NO: 2333513 - DNA, 14 bp, Homo sapiens
cccccaccctgttc

SEQ ID NO: 2333514 - DNA, 16 bp, Homo sapiens
cccccaccggtccagc

SEQ ID NO: 2333515 - DNA, 21 bp, Homo sapiens
cccccaccggtccagctggcc

SEQ ID NO: 2333516 - DNA, 15 bp, Homo sapiens
cccccagactctttt

SEQ ID NO: 2333517 - DNA, 13 bp, Homo sapiens
cccccagccccgg

SEQ ID NO: 2333518 - DNA, 23 bp, Homo sapiens
ccttcctgtgggtgttctttcct

SEQ ID NO: 2333519 - DNA, 17 bp, Homo sapiens
ccttcctgtttttcaca

SEQ ID NO: 2333520 - DNA, 22 bp, Homo sapiens
ccttcctgtttttcacattttc

SEQ ID NO: 2333521 - DNA, 17 bp, Homo sapiens
ccttccttttccctgct

SEQ ID NO: 2333522 - DNA, 19 bp, Homo sapiens
ccttccttttccctgcttc

SEQ ID NO: 2333523 - DNA, 15 bp, Homo sapiens
ccttctacaaggact

SEQ ID NO: 2333524 - DNA, 15 bp, Homo sapiens
ccttctattggtctc

SEQ ID NO: 2333525 - DNA, 14 bp, Homo sapiens
ccttctatttgggg

SEQ ID NO: 2333526 - DNA, 13 bp, Homo sapiens
ccttctcccactc

SEQ ID NO: 2333527 - DNA, 15 bp, Homo sapiens
ccttctcccactctc

SEQ ID NO: 2333528 - DNA, 22 bp, Homo sapiens
ccttctccctagctcctcccct

SEQ ID NO: 2333529 - DNA, 23 bp, Homo sapiens
ccttctcctacttagggaagaaa

SEQ ID NO: 2333530 - DNA, 16 bp, Homo sapiens
ccttctcctagctctg

SEQ ID NO: 2333531 - DNA, 15 bp, Homo sapiens
ccttctctcctcccc

SEQ ID NO: 2333532 - DNA, 17 bp, Homo sapiens
ccttctctcctccccaa

SEQ ID NO: 2333533 - DNA, 20 bp, Homo sapiens
ccttctctcctccccaaatc

SEQ ID NO: 2333534 - DNA, 15 bp, Homo sapiens
ccttctgagctcctg

SEQ ID NO: 2333535 - DNA, 17 bp, Homo sapiens
ccttctgagctcctgtc

SEQ ID NO: 2333536 - DNA, 22 bp, Homo sapiens
ccttctgatgaagttgtacaac

SEQ ID NO: 2333537 - DNA, 19 bp, Homo sapiens
ccttctggaaactgtgaag

SEQ ID NO: 2333538 - DNA, 10 bp, Homo sapiens
ccttctggcc

SEQ ID NO: 2333539 - DNA, 16 bp, Homo sapiens
ccttctggccttgtaa

SEQ ID NO: 2333540 - DNA, 14 bp, Homo sapiens
ccttctgggcttca

SEQ ID NO: 2333541 - DNA, 18 bp, Homo sapiens
ccttgaaactttgggaaa

SEQ ID NO: 2333542 - DNA, 11 bp, Homo sapiens
ccttgagacca

SEQ ID NO: 2333543 - DNA, 14 bp, Homo sapiens
ccttgagccctggc

SEQ ID NO: 2333544 - DNA, 16 bp, Homo sapiens
ccttgagccctggctg

SEQ ID NO: 2333545 - DNA, 16 bp, Homo sapiens
ccttgagctgttgtga

SEQ ID NO: 2333546 - DNA, 22 bp, Homo sapiens
ccttgatataaaaaatctttag

SEQ ID NO: 2333547 - DNA, 15 bp, Homo sapiens
ccttgatgactgcct

SEQ ID NO: 2333548 - DNA, 23 bp, Homo sapiens
ccttgatgattgacaacacccat

SEQ ID NO: 2333549 - DNA, 18 bp, Homo sapiens
ccttgcacagctggagaa

SEQ ID NO: 2333550 - DNA, 14 bp, Homo sapiens
ccttgcctccccat

SEQ ID NO: 2333551 - DNA, 23 bp, Homo sapiens
ccttgcctccccatttcccatct

SEQ ID NO: 2333552 - DNA, 18 bp, Homo sapiens
ccttgcctttcgaggcct

SEQ ID NO: 2333553 - DNA, 14 bp, Homo sapiens
ccttgcgcctcagc

SEQ ID NO: 2333554 - DNA, 11 bp, Homo sapiens
ccttgctacct

SEQ ID NO: 2333555 - DNA, 14 bp, Homo sapiens
ccttgctacctcaa

SEQ ID NO: 2333556 - DNA, 13 bp, Homo sapiens
ccttgctggcccc

SEQ ID NO: 2333557 - DNA, 14 bp, Homo sapiens
ccttgctggcccca

SEQ ID NO: 2333558 - DNA, 20 bp, Homo sapiens
ccttgctggccccagccctg

SEQ ID NO: 2333559 - DNA, 19 bp, Homo sapiens
ccttgctgtttgtcctgag

SEQ ID NO: 2333560 - DNA, 18 bp, Homo sapiens
ccttggaaatagaaagaa

SEQ ID NO: 2333561 - DNA, 23 bp, Homo sapiens
ccttggaaatagaaagaagccat

SEQ ID NO: 2333562 - DNA, 17 bp, Homo sapiens
ccttggattttcctgaa

SEQ ID NO: 2333563 - DNA, 19 bp, Homo sapiens
ccttggctttatgcacatt

SEQ ID NO: 2333564 - DNA, 20 bp, Homo sapiens
ccttgggctctgatgaaaaa

SEQ ID NO: 2333565 - DNA, 21 bp, Homo sapiens
ccttggggccttgatgactgc

SEQ ID NO: 2333566 - DNA, 15 bp, Homo sapiens
ccttggtttgctagt

SEQ ID NO: 2333567 - DNA, 20 bp, Homo sapiens
ccttgtattctgaggatgtt

SEQ ID NO: 2333568 - DNA, 23 bp, Homo sapiens
ccttgtgttcagctctttccaaa

SEQ ID NO: 2333569 - DNA, 23 bp, Homo sapiens
ccttgttaagtatcagctacaat

SEQ ID NO: 2333570 - DNA, 23 bp, Homo sapiens
ccttgttggggagtgggtggcag

SEQ ID NO: 2333571 - DNA, 20 bp, Homo sapiens
ccttgtttgagtttttcctc

SEQ ID NO: 2333572 - DNA, 22 bp, Homo sapiens
cctttaccactgtggttttgac

SEQ ID NO: 2333573 - DNA, 14 bp, Homo sapiens
cctttatgatgcta

SEQ ID NO: 2333574 - DNA, 12 bp, Homo sapiens
cctttatgtgaa

SEQ ID NO: 2333575 - DNA, 14 bp, Homo sapiens
cctttatgtgaatt

SEQ ID NO: 2333576 - DNA, 17 bp, Homo sapiens
cctttatgtgaattttt

SEQ ID NO: 2333577 - DNA, 11 bp, Homo sapiens
cctttcccacc

SEQ ID NO: 2333578 - DNA, 12 bp, Homo sapiens
cctttcccaccc

SEQ ID NO: 2333579 - DNA, 22 bp, Homo sapiens
cctttcccaccccaacctgctc

SEQ ID NO: 2333580 - DNA, 15 bp, Homo sapiens
cctttcctgtcccac

SEQ ID NO: 2333581 - DNA, 15 bp, Homo sapiens
cctttcgaggcctga

SEQ ID NO: 2333582 - DNA, 16 bp, Homo sapiens
cctttcgaggcctgaa

SEQ ID NO: 2333583 - DNA, 11 bp, Homo sapiens
cctttctcagg

SEQ ID NO: 2333584 - DNA, 15 bp, Homo sapiens
cctttctctcctggc

SEQ ID NO: 2333585 - DNA, 16 bp, Homo sapiens
cctttctctcctggct

SEQ ID NO: 2333586 - DNA, 15 bp, Homo sapiens
cctttctctctctaa

SEQ ID NO: 2333587 - DNA, 10 bp, Homo sapiens
cctttcttct

SEQ ID NO: 2333588 - DNA, 17 bp, Homo sapiens
cctttgaatgtaaccaa

SEQ ID NO: 2333589 - DNA, 19 bp, Homo sapiens
cctttgagacagtttctta

SEQ ID NO: 2333590 - DNA, 15 bp, Homo sapiens
cctttgcacctgaga

SEQ ID NO: 2333591 - DNA, 17 bp, Homo sapiens
cctttgcacctgagacc

SEQ ID NO: 2333592 - DNA, 21 bp, Homo sapiens
cctttgggttctttctggggg

SEQ ID NO: 2333593 - DNA, 16 bp, Homo sapiens
cctttggtttttttct

SEQ ID NO: 2333594 - DNA, 22 bp, Homo sapiens
cctttgtgtgtattcagaggca

SEQ ID NO: 2333595 - DNA, 16 bp, Homo sapiens
ccttttcactttattg

SEQ ID NO: 2333596 - DNA, 13 bp, Homo sapiens
ccttttcagggct

SEQ ID NO: 2333597 - DNA, 14 bp, Homo sapiens
ccttttctgtggct

SEQ ID NO: 2333598 - DNA, 17 bp, Homo sapiens
cctttttatttgcatgt

SEQ ID NO: 2333599 - DNA, 13 bp, Homo sapiens
cctttttcctctc

SEQ ID NO: 2333600 - DNA, 16 bp, Homo sapiens
cctttttcctctccac

SEQ ID NO: 2333601 - DNA, 17 bp, Homo sapiens
cctttttcctctccaca

SEQ ID NO: 2333602 - DNA, 14 bp, Homo sapiens
cctttttgacactg

SEQ ID NO: 2333603 - DNA, 15 bp, Homo sapiens
cctttttgacactga

SEQ ID NO: 2333604 - DNA, 16 bp, Homo sapiens
cctttttgacactgaa

SEQ ID NO: 2333605 - DNA, 13 bp, Homo sapiens
ccttttttaagat

SEQ ID NO: 2333606 - DNA, 14 bp, Homo sapiens
ccttttttaagatt

SEQ ID NO: 2333607 - DNA, 18 bp, Homo sapiens
ccttttttaagatttttc

SEQ ID NO: 2333608 - DNA, 14 bp, Homo sapiens
ccttttttttcatg

SEQ ID NO: 2333609 - DNA, 11 bp, Homo sapiens
cgaaataacaa

SEQ ID NO: 2333610 - DNA, 17 bp, Homo sapiens
cgaaataacaatgttaa

SEQ ID NO: 2333611 - DNA, 23 bp, Homo sapiens
cgaagaccctcttgcccatcctg

SEQ ID NO: 2333612 - DNA, 22 bp, Homo sapiens
cgaatgaaaataactgaatttg

SEQ ID NO: 2333613 - DNA, 17 bp, Homo sapiens
cgaatgacggtaagtgt

SEQ ID NO: 2333614 - DNA, 22 bp, Homo sapiens
cgaatgacggtaagtgttctca

SEQ ID NO: 2333615 - DNA, 21 bp, Homo sapiens
cgaccaccgcccctggccgcg

SEQ ID NO: 2333616 - DNA, 16 bp, Homo sapiens
cgaccatgtggccaca

SEQ ID NO: 2333617 - DNA, 17 bp, Homo sapiens
cgactagcaggcatgcc

SEQ ID NO: 2333618 - DNA, 13 bp, Homo sapiens
cgactcttcctgc

SEQ ID NO: 2333619 - DNA, 15 bp, Homo sapiens
cgactcttcctgcaa

SEQ ID NO: 2333620 - DNA, 18 bp, Homo sapiens
cgactcttcctgcaaagg

SEQ ID NO: 2333621 - DNA, 18 bp, Homo sapiens
cgactgaaaatattgttt

SEQ ID NO: 2333622 - DNA, 13 bp, Homo sapiens
cgactggactgtc

SEQ ID NO: 2333623 - DNA, 13 bp, Homo sapiens
cgagaccatcctg

SEQ ID NO: 2333624 - DNA, 12 bp, Homo sapiens
cgagagaggcgc

SEQ ID NO: 2333625 - DNA, 22 bp, Homo sapiens
cgagaggccagttgatctgctc

SEQ ID NO: 2333626 - DNA, 13 bp, Homo sapiens
cgagagggagaga

SEQ ID NO: 2333627 - DNA, 18 bp, Homo sapiens
cgagccacaagctgcact

SEQ ID NO: 2333628 - DNA, 16 bp, Homo sapiens
cgagccacgcagtgcc

SEQ ID NO: 2333629 - DNA, 16 bp, Homo sapiens
cgagctactctcttgc

SEQ ID NO: 2333630 - DNA, 12 bp, Homo sapiens
cgagctgtggac

SEQ ID NO: 2333631 - DNA, 16 bp, Homo sapiens
cgagggcagctgctat

SEQ ID NO: 2333632 - DNA, 18 bp, Homo sapiens
cgaggtgtcaccctgcag

SEQ ID NO: 2333633 - DNA, 20 bp, Homo sapiens
cgaggtgtcaccctgcagag

SEQ ID NO: 2333634 - DNA, 21 bp, Homo sapiens
cgaggtgtcaccctgcagagc

SEQ ID NO: 2333635 - DNA, 17 bp, Homo sapiens
cgagttctctttggaaa

SEQ ID NO: 2333636 - DNA, 14 bp, Homo sapiens
cctctcagtgccct

SEQ ID NO: 2333637 - DNA, 18 bp, Homo sapiens
cctctcagtgccctccag

SEQ ID NO: 2333638 - DNA, 15 bp, Homo sapiens
cctctccaaccactg

SEQ ID NO: 2333639 - DNA, 13 bp, Homo sapiens
cctctccacacag

SEQ ID NO: 2333640 - DNA, 13 bp, Homo sapiens
cctctccactgct

SEQ ID NO: 2333641 - DNA, 13 bp, Homo sapiens
cctctcccaccct

SEQ ID NO: 2333642 - DNA, 16 bp, Homo sapiens
cctctcccaccctctt

SEQ ID NO: 2333643 - DNA, 15 bp, Homo sapiens
cctctcccaggctgt

SEQ ID NO: 2333644 - DNA, 14 bp, Homo sapiens
cctctcccccaggt

SEQ ID NO: 2333645 - DNA, 17 bp, Homo sapiens
cctctccccctcctcca

SEQ ID NO: 2333646 - DNA, 19 bp, Homo sapiens
cctctcccttgggctctga

SEQ ID NO: 2333647 - DNA, 22 bp, Homo sapiens
cctctcccttgggctctgatga

SEQ ID NO: 2333648 - DNA, 18 bp, Homo sapiens
cctctcctctcccccagg

SEQ ID NO: 2333649 - DNA, 15 bp, Homo sapiens
cctctccttctccta

SEQ ID NO: 2333650 - DNA, 15 bp, Homo sapiens
cctctctacagtctc

SEQ ID NO: 2333651 - DNA, 14 bp, Homo sapiens
cctctctcatgaga

SEQ ID NO: 2333652 - DNA, 10 bp, Homo sapiens
cctctctctc

SEQ ID NO: 2333653 - DNA, 14 bp, Homo sapiens
cctctctctcttct

SEQ ID NO: 2333654 - DNA, 18 bp, Homo sapiens
cctctctctttcctccac

SEQ ID NO: 2333655 - DNA, 17 bp, Homo sapiens
cgtgtcaagctgctctg

SEQ ID NO: 2333656 - DNA, 22 bp, Homo sapiens
cgtgtgtagagttaagaagctg

SEQ ID NO: 2333657 - DNA, 17 bp, Homo sapiens
cgtgtgtcccagatgct

SEQ ID NO: 2333658 - DNA, 15 bp, Homo sapiens
cgtgttcagcagaac

SEQ ID NO: 2333659 - DNA, 16 bp, Homo sapiens
cgtgttcagcagaacc

SEQ ID NO: 2333660 - DNA, 20 bp, Homo sapiens
cgtgtttctgactctgagct

SEQ ID NO: 2333661 - DNA, 21 bp, Homo sapiens
cgttccaccccaagagaactc

SEQ ID NO: 2333662 - DNA, 12 bp, Homo sapiens
cgttgccagggg

SEQ ID NO: 2333663 - DNA, 15 bp, Homo sapiens
cgttggttctgcact

SEQ ID NO: 2333664 - DNA, 14 bp, Homo sapiens
cgttgttttgtgga

SEQ ID NO: 2333665 - DNA, 21 bp, Homo sapiens
cgtttaaggtgagcataaatc

SEQ ID NO: 2333666 - DNA, 18 bp, Homo sapiens
cgtttataaacagaaatg

SEQ ID NO: 2333667 - DNA, 15 bp, Homo sapiens
cgttttcttctttcc

SEQ ID NO: 2333668 - DNA, 18 bp, Homo sapiens
cgttttcttctttccctg

SEQ ID NO: 2333669 - DNA, 19 bp, Homo sapiens
cgttttcttctttccctgg

SEQ ID NO: 2333670 - DNA, 15 bp, Homo sapiens
cgtttttgtattttc

SEQ ID NO: 2333671 - DNA, 14 bp, Homo sapiens
ctaaaaaaatgttt

SEQ ID NO: 2333672 - DNA, 13 bp, Homo sapiens
ctaaaaagtataa

SEQ ID NO: 2333673 - DNA, 16 bp, Homo sapiens
ctaaaaagtataaaat

SEQ ID NO: 2333674 - DNA, 13 bp, Homo sapiens
ctaaaaatacaaa

SEQ ID NO: 2333675 - DNA, 21 bp, Homo sapiens
ctaaaatgttttatgacattt

SEQ ID NO: 2333676 - DNA, 14 bp, Homo sapiens
ctaaaatttacaca

SEQ ID NO: 2333677 - DNA, 15 bp, Homo sapiens
ctaaacatgtatgta

SEQ ID NO: 2333678 - DNA, 15 bp, Homo sapiens
ctaaactccttcctg

SEQ ID NO: 2333679 - DNA, 17 bp, Homo sapiens
ctaaactttggcctttg

SEQ ID NO: 2333680 - DNA, 14 bp, Homo sapiens
ctaaaggatccaga

SEQ ID NO: 2333681 - DNA, 15 bp, Homo sapiens
ctaaaggatccagag

SEQ ID NO: 2333682 - DNA, 23 bp, Homo sapiens
ctaaaggatccagagagcagctc

SEQ ID NO: 2333683 - DNA, 16 bp, Homo sapiens
ctaaaggcatccttgt

SEQ ID NO: 2333684 - DNA, 19 bp, Homo sapiens
ctaaagtatacaactgcct

SEQ ID NO: 2333685 - DNA, 16 bp, Homo sapiens
ctaaataaaaatatgt

SEQ ID NO: 2333686 - DNA, 14 bp, Homo sapiens
ctaaatagtatttt

SEQ ID NO: 2333687 - DNA, 21 bp, Homo sapiens
ctaaatatgcaatatatgttc

SEQ ID NO: 2333688 - DNA, 15 bp, Homo sapiens
ctaaatcagagacaa

SEQ ID NO: 2333689 - DNA, 19 bp, Homo sapiens
ctaaatcagagacaaaata

SEQ ID NO: 2333690 - DNA, 16 bp, Homo sapiens
ctaaattttaaagcca

SEQ ID NO: 2333691 - DNA, 16 bp, Homo sapiens
ctaacacagcatgtgt

SEQ ID NO: 2333692 - DNA, 14 bp, Homo sapiens
ctaacagtaactgc

SEQ ID NO: 2333693 - DNA, 23 bp, Homo sapiens
ctaacccaagacatgacattctt

SEQ ID NO: 2333694 - DNA, 22 bp, Homo sapiens
ctaaccctttgtgtgctctcca

SEQ ID NO: 2333695 - DNA, 23 bp, Homo sapiens
ctaaccctttgtgtgctctccat

SEQ ID NO: 2333696 - DNA, 20 bp, Homo sapiens
ctaacgaaatatcaaagtca

SEQ ID NO: 2333697 - DNA, 15 bp, Homo sapiens
ctaactaaataccat

SEQ ID NO: 2333698 - DNA, 14 bp, Homo sapiens
ctaactcaccagcc

SEQ ID NO: 2333699 - DNA, 21 bp, Homo sapiens
ctaactcaccagccccactgc

SEQ ID NO: 2333700 - DNA, 16 bp, Homo sapiens
ctaagagaagttattt

SEQ ID NO: 2333701 - DNA, 16 bp, Homo sapiens
ctaagcaactaggcct

SEQ ID NO: 2333702 - DNA, 20 bp, Homo sapiens
ctaagggaagatcactgtag

SEQ ID NO: 2333703 - DNA, 21 bp, Homo sapiens
ctaagtgcttattacatttta

SEQ ID NO: 2333704 - DNA, 14 bp, Homo sapiens
ctaataaaccagtt

SEQ ID NO: 2333705 - DNA, 15 bp, Homo sapiens
ctaataatcttgttt

SEQ ID NO: 2333706 - DNA, 19 bp, Homo sapiens
ctaataatcttgtttctga

SEQ ID NO: 2333707 - DNA, 13 bp, Homo sapiens
ctaatacctctgt

SEQ ID NO: 2333708 - DNA, 17 bp, Homo sapiens
ctaatacctctgtgtgc

SEQ ID NO: 2333709 - DNA, 13 bp, Homo sapiens
ctaatatatgaaa

SEQ ID NO: 2333710 - DNA, 19 bp, Homo sapiens
ctaatatatgaaataagta

SEQ ID NO: 2333711 - DNA, 22 bp, Homo sapiens
ctaatcacagtgttgcatatga

SEQ ID NO: 2333712 - DNA, 20 bp, Homo sapiens
ctaatgtttatgagccagac

SEQ ID NO: 2333713 - DNA, 21 bp, Homo sapiens
ctaattaatagccaaagattt

SEQ ID NO: 2333714 - DNA, 13 bp, Homo sapiens
ctaattaatatat

SEQ ID NO: 2333715 - DNA, 21 bp, Homo sapiens
ctaattaatatattaaaattc

SEQ ID NO: 2333716 - DNA, 18 bp, Homo sapiens
ctaattatttaattgtcc

SEQ ID NO: 2333717 - DNA, 16 bp, Homo sapiens
ctaattgtaagtgaaa

SEQ ID NO: 2333718 - DNA, 17 bp, Homo sapiens
ctaattgtaagtgaaat

SEQ ID NO: 2333719 - DNA, 14 bp, Homo sapiens
ctaatttctcctcc

SEQ ID NO: 2333720 - DNA, 15 bp, Homo sapiens
ctaatttctcctccc

SEQ ID NO: 2333721 - DNA, 14 bp, Homo sapiens
ctacaaacttttaa

SEQ ID NO: 2333722 - DNA, 16 bp, Homo sapiens
ctacaactgattgcaa

SEQ ID NO: 2333723 - DNA, 19 bp, Homo sapiens
ctacaatacaacacattga

SEQ ID NO: 2333724 - DNA, 21 bp, Homo sapiens
ctacaatctctttttgtttgc

SEQ ID NO: 2333725 - DNA, 18 bp, Homo sapiens
ctacagccttgtccccct

SEQ ID NO: 2333726 - DNA, 19 bp, Homo sapiens
ctacaggggttagcctgga

SEQ ID NO: 2333727 - DNA, 21 bp, Homo sapiens
ctacagtggttttatactgaa

SEQ ID NO: 2333728 - DNA, 20 bp, Homo sapiens
ctacatcccgggcctcagtg

SEQ ID NO: 2333729 - DNA, 16 bp, Homo sapiens
ctacatgctgaaaaat

SEQ ID NO: 2333730 - DNA, 14 bp, Homo sapiens
ctacatgctggggt

SEQ ID NO: 2333731 - DNA, 13 bp, Homo sapiens
ctacatgtgagtg

SEQ ID NO: 2333732 - DNA, 16 bp, Homo sapiens
ctaccaaacactcagt

SEQ ID NO: 2333733 - DNA, 14 bp, Homo sapiens
ctaccaccacggcc

SEQ ID NO: 2333734 - DNA, 17 bp, Homo sapiens
ctaccaggatgctaaag

SEQ ID NO: 2333735 - DNA, 21 bp, Homo sapiens
ctaccccttggaaatgtctgc

SEQ ID NO: 2333736 - DNA, 14 bp, Homo sapiens
ctaccctgtctgtc

SEQ ID NO: 2333737 - DNA, 19 bp, Homo sapiens
ctaccctgtctgtcccttt

SEQ ID NO: 2333738 - DNA, 21 bp, Homo sapiens
ctaccctgtctgtcccttttc

SEQ ID NO: 2333739 - DNA, 21 bp, Homo sapiens
ctacctacatgctgaaaaata

SEQ ID NO: 2333740 - DNA, 14 bp, Homo sapiens
ctacctgccctcaa

SEQ ID NO: 2333741 - DNA, 19 bp, Homo sapiens
ctaccttcctgtccctgag

SEQ ID NO: 2333742 - DNA, 17 bp, Homo sapiens
ctactaataaaccagtt

SEQ ID NO: 2333743 - DNA, 15 bp, Homo sapiens
ctactagattgacta

SEQ ID NO: 2333744 - DNA, 20 bp, Homo sapiens
ctactcaagcgggtggctct

SEQ ID NO: 2333745 - DNA, 21 bp, Homo sapiens
ctactcaagcgggtggctctg

SEQ ID NO: 2333746 - DNA, 18 bp, Homo sapiens
ctactcacacttcagctg

SEQ ID NO: 2333747 - DNA, 22 bp, Homo sapiens
ctactccctgcagatgccaccc

SEQ ID NO: 2333748 - DNA, 15 bp, Homo sapiens
ctactctcttgccag

SEQ ID NO: 2333749 - DNA, 17 bp, Homo sapiens
ctactctcttgccagca

SEQ ID NO: 2333750 - DNA, 23 bp, Homo sapiens
ctactctcttgccagcattttca

SEQ ID NO: 2333751 - DNA, 21 bp, Homo sapiens
ctactctggaatgtttttccc

SEQ ID NO: 2333752 - DNA, 21 bp, Homo sapiens
ctactgaataatgctaccagg

SEQ ID NO: 2333753 - DNA, 20 bp, Homo sapiens
ctactgcactccagcctggg

SEQ ID NO: 2333754 - DNA, 21 bp, Homo sapiens
ctactgcactccagcctgggg

SEQ ID NO: 2333755 - DNA, 23 bp, Homo sapiens
ctactgcactccagcctggggga

SEQ ID NO: 2333756 - DNA, 11 bp, Homo sapiens
ctactgctgtg

SEQ ID NO: 2333757 - DNA, 17 bp, Homo sapiens
ctactgtagaaacaaag

SEQ ID NO: 2333758 - DNA, 22 bp, Homo sapiens
ctactgttgtaagaattctgat

SEQ ID NO: 2333759 - DNA, 15 bp, Homo sapiens
ctactgtttgatttg

SEQ ID NO: 2333760 - DNA, 20 bp, Homo sapiens
ctacttgggaggctgaggca

SEQ ID NO: 2333761 - DNA, 20 bp, Homo sapiens
ctactttgactttttgcatt

SEQ ID NO: 2333762 - DNA, 22 bp, Homo sapiens
ctagaacactaactcaccagcc

SEQ ID NO: 2333763 - DNA, 13 bp, Homo sapiens
ctagaagccaagg

SEQ ID NO: 2333764 - DNA, 20 bp, Homo sapiens
ctagaagccaagggaaaggg

SEQ ID NO: 2333765 - DNA, 17 bp, Homo sapiens
ctagacaacctttctgt

SEQ ID NO: 2333766 - DNA, 18 bp, Homo sapiens
ctagacaacctttctgta

SEQ ID NO: 2333767 - DNA, 12 bp, Homo sapiens
ctagaccaataa

SEQ ID NO: 2333768 - DNA, 17 bp, Homo sapiens
ctagatgattttttgaa

SEQ ID NO: 2333769 - DNA, 21 bp, Homo sapiens
ctcaagctatgatcagaagac

SEQ ID NO: 2333770 - DNA, 19 bp, Homo sapiens
ctcaaggtgggccttgcta

SEQ ID NO: 2333771 - DNA, 14 bp, Homo sapiens
ctcaatcactgctc

SEQ ID NO: 2333772 - DNA, 23 bp, Homo sapiens
ctcaatcactgctcccccgtgtg

SEQ ID NO: 2333773 - DNA, 14 bp, Homo sapiens
ctcaatcctaattt

SEQ ID NO: 2333774 - DNA, 19 bp, Homo sapiens
ctcaatcctaatttctcct

SEQ ID NO: 2333775 - DNA, 20 bp, Homo sapiens
ctcaatgaaccataaattca

SEQ ID NO: 2333776 - DNA, 14 bp, Homo sapiens
ctcaatgtcttccc

SEQ ID NO: 2333777 - DNA, 13 bp, Homo sapiens
ctcaccagcccca

SEQ ID NO: 2333778 - DNA, 20 bp, Homo sapiens
ctcaccagccccactgccag

SEQ ID NO: 2333779 - DNA, 12 bp, Homo sapiens
ctcaccagccct

SEQ ID NO: 2333780 - DNA, 14 bp, Homo sapiens
ctcaccgcccatca

SEQ ID NO: 2333781 - DNA, 21 bp, Homo sapiens
ctcaccgctggcccttagaga

SEQ ID NO: 2333782 - DNA, 23 bp, Homo sapiens
ctcacctcatgcccaccccctgc

SEQ ID NO: 2333783 - DNA, 14 bp, Homo sapiens
ctcacgactcttcc

SEQ ID NO: 2333784 - DNA, 19 bp, Homo sapiens
ctcacgactcttcctgcaa

SEQ ID NO: 2333785 - DNA, 14 bp, Homo sapiens
ctcactcccacctg

SEQ ID NO: 2333786 - DNA, 15 bp, Homo sapiens
ctcactccctctgca

SEQ ID NO: 2333787 - DNA, 22 bp, Homo sapiens
ctcactcgggtttctctgtggc

SEQ ID NO: 2333788 - DNA, 12 bp, Homo sapiens
ctcactgcagcc

SEQ ID NO: 2333789 - DNA, 11 bp, Homo sapiens
ctcactgccag

SEQ ID NO: 2333790 - DNA, 13 bp, Homo sapiens
ctcactgccaggc

SEQ ID NO: 2333791 - DNA, 14 bp, Homo sapiens
ctcactgccaggcc

SEQ ID NO: 2333792 - DNA, 20 bp, Homo sapiens
ctcactgccaggccagcctc

SEQ ID NO: 2333793 - DNA, 17 bp, Homo sapiens
ctcactggctctcctgg

SEQ ID NO: 2333794 - DNA, 12 bp, Homo sapiens
ctcactgtgatc

SEQ ID NO: 2333795 - DNA, 20 bp, Homo sapiens
ctcacttctgggcttcatct

SEQ ID NO: 2333796 - DNA, 15 bp, Homo sapiens
ctcactttactttca

SEQ ID NO: 2333797 - DNA, 17 bp, Homo sapiens
ctcactttactttcaag

SEQ ID NO: 2333798 - DNA, 12 bp, Homo sapiens
ctcacttttccc

SEQ ID NO: 2333799 - DNA, 14 bp, Homo sapiens
ctcacttttcccac

SEQ ID NO: 2333800 - DNA, 17 bp, Homo sapiens
ctcacttttcccactcc

SEQ ID NO: 2333801 - DNA, 18 bp, Homo sapiens
ctcacttttcccactcca

SEQ ID NO: 2333802 - DNA, 15 bp, Homo sapiens
ctcagaaatgtcatg

SEQ ID NO: 2333803 - DNA, 10 bp, Homo sapiens
ctcagaacat

SEQ ID NO: 2333804 - DNA, 21 bp, Homo sapiens
ctcagaaccttgtcccagcca

SEQ ID NO: 2333805 - DNA, 23 bp, Homo sapiens
ctcagaaccttgtcccagccagt

SEQ ID NO: 2333806 - DNA, 13 bp, Homo sapiens
ctcagaagcacag

SEQ ID NO: 2333807 - DNA, 22 bp, Homo sapiens
ctcagagacactgttgataaaa

SEQ ID NO: 2333808 - DNA, 23 bp, Homo sapiens
ctcagagcgccaggaagccagag

SEQ ID NO: 2333809 - DNA, 21 bp, Homo sapiens
ctcagagtggtgggggaaggc

SEQ ID NO: 2333810 - DNA, 18 bp, Homo sapiens
ctcagatttccacagaga

SEQ ID NO: 2333811 - DNA, 19 bp, Homo sapiens
ctcagcaatagggtgcagt

SEQ ID NO: 2333812 - DNA, 14 bp, Homo sapiens
ctcagccctcagtt

SEQ ID NO: 2333813 - DNA, 22 bp, Homo sapiens
ctcagccttccaactagctggg

SEQ ID NO: 2333814 - DNA, 15 bp, Homo sapiens
ctcagctggcagtgc

SEQ ID NO: 2333815 - DNA, 16 bp, Homo sapiens
ctcagctttgagaagc

SEQ ID NO: 2333816 - DNA, 16 bp, Homo sapiens
ctcaggacagcatccc

SEQ ID NO: 2333817 - DNA, 19 bp, Homo sapiens
ctcaggacagcatcccttc

SEQ ID NO: 2333818 - DNA, 21 bp, Homo sapiens
ctcaggacagcatcccttccc

SEQ ID NO: 2333819 - DNA, 14 bp, Homo sapiens
ctcaggcaccagtc

SEQ ID NO: 2333820 - DNA, 13 bp, Homo sapiens
ctcaggcagcacc

SEQ ID NO: 2333821 - DNA, 20 bp, Homo sapiens
ctcaggcagcaccacactgg

SEQ ID NO: 2333822 - DNA, 15 bp, Homo sapiens
ctcaggccaccacag

SEQ ID NO: 2333823 - DNA, 14 bp, Homo sapiens
ctcagggagcctcc

SEQ ID NO: 2333824 - DNA, 15 bp, Homo sapiens
ctcagggagcctccc

SEQ ID NO: 2333825 - DNA, 18 bp, Homo sapiens
ctcagggctcgggagcca

SEQ ID NO: 2333826 - DNA, 15 bp, Homo sapiens
ctcagggctgtccca

SEQ ID NO: 2333827 - DNA, 16 bp, Homo sapiens
ctcagggctgtcccag

SEQ ID NO: 2333828 - DNA, 17 bp, Homo sapiens
ctcagggctgtcccagc

SEQ ID NO: 2333829 - DNA, 22 bp, Homo sapiens
ctcagggctgtcccagccccgg

SEQ ID NO: 2333830 - DNA, 16 bp, Homo sapiens
ctcaggggctctaggg

SEQ ID NO: 2333831 - DNA, 21 bp, Homo sapiens
ctcagggtcactgaaccactg

SEQ ID NO: 2333832 - DNA, 17 bp, Homo sapiens
ctcaggtagtactggga

SEQ ID NO: 2333833 - DNA, 18 bp, Homo sapiens
ctcaggtagtactgggaa

SEQ ID NO: 2333834 - DNA, 12 bp, Homo sapiens
ctcaggtgcctt

SEQ ID NO: 2333835 - DNA, 15 bp, Homo sapiens
ctcaggtttgttttg

SEQ ID NO: 2333836 - DNA, 15 bp, Homo sapiens
ctcagtcatcaaagc

SEQ ID NO: 2333837 - DNA, 17 bp, Homo sapiens
ctcagtcatcaaagcag

SEQ ID NO: 2333838 - DNA, 15 bp, Homo sapiens
ctcagtcatgcataa

SEQ ID NO: 2333839 - DNA, 18 bp, Homo sapiens
ctcagtcatgcataaata

SEQ ID NO: 2333840 - DNA, 13 bp, Homo sapiens
ctcagtccactgt

SEQ ID NO: 2333841 - DNA, 15 bp, Homo sapiens
ctcagtgagcctcct

SEQ ID NO: 2333842 - DNA, 18 bp, Homo sapiens
ctcagtgagcctcctgtg

SEQ ID NO: 2333843 - DNA, 15 bp, Homo sapiens
ctcagtgccctccag

SEQ ID NO: 2333844 - DNA, 21 bp, Homo sapiens
ctcagtgtccagcttccaaag

SEQ ID NO: 2333845 - DNA, 22 bp, Homo sapiens
ctcagtgttggtatattttata

SEQ ID NO: 2333846 - DNA, 12 bp, Homo sapiens
ctcagttttcct

SEQ ID NO: 2333847 - DNA, 14 bp, Homo sapiens
ctcagttttccttc

SEQ ID NO: 2333848 - DNA, 15 bp, Homo sapiens
ctcagttttccttct

SEQ ID NO: 2333849 - DNA, 16 bp, Homo sapiens
ctcagttttccttctg

SEQ ID NO: 2333850 - DNA, 23 bp, Homo sapiens
ctcatagaattttgagtattcca

SEQ ID NO: 2333851 - DNA, 14 bp, Homo sapiens
ctcatagacactga

SEQ ID NO: 2333852 - DNA, 22 bp, Homo sapiens
ctcatccactctactaatgcct

SEQ ID NO: 2333853 - DNA, 22 bp, Homo sapiens
ctcatcccaacctctttttcct

SEQ ID NO: 2333854 - DNA, 18 bp, Homo sapiens
ctcatctatctcaatcct

SEQ ID NO: 2333855 - DNA, 13 bp, Homo sapiens
ctcatctgcaaaa

SEQ ID NO: 2333856 - DNA, 18 bp, Homo sapiens
ctcatcttagtgcctgag

SEQ ID NO: 2333857 - DNA, 14 bp, Homo sapiens
ctcatgaagcagga

SEQ ID NO: 2333858 - DNA, 16 bp, Homo sapiens
ctcatgactttatagt

SEQ ID NO: 2333859 - DNA, 10 bp, Homo sapiens
ctcatgagaa

SEQ ID NO: 2333860 - DNA, 13 bp, Homo sapiens
ctcatgcccaccc

SEQ ID NO: 2333861 - DNA, 20 bp, Homo sapiens
ctcatgcccaccccctgccc

SEQ ID NO: 2333862 - DNA, 14 bp, Homo sapiens
ctcatgcccagctc

SEQ ID NO: 2333863 - DNA, 19 bp, Homo sapiens
ctcatgcccagctctctga

SEQ ID NO: 2333864 - DNA, 19 bp, Homo sapiens
ctcatgggaagtcctggca

SEQ ID NO: 2333865 - DNA, 14 bp, Homo sapiens
ctcatgttgagcca

SEQ ID NO: 2333866 - DNA, 13 bp, Homo sapiens
ctcatgttttata

SEQ ID NO: 2333867 - DNA, 15 bp, Homo sapiens
ctcattacagttctt

SEQ ID NO: 2333868 - DNA, 17 bp, Homo sapiens
ctcattacagttctttc

SEQ ID NO: 2333869 - DNA, 20 bp, Homo sapiens
ctcattacagttctttcctc

SEQ ID NO: 2333870 - DNA, 13 bp, Homo sapiens
ctcattatttcaa

SEQ ID NO: 2333871 - DNA, 16 bp, Homo sapiens
ctcattatttcaaaat

SEQ ID NO: 2333872 - DNA, 16 bp, Homo sapiens
ctcattcccatgtgga

SEQ ID NO: 2333873 - DNA, 14 bp, Homo sapiens
ctcattgactttta

SEQ ID NO: 2333874 - DNA, 15 bp, Homo sapiens
ctccaaccactgtgc

SEQ ID NO: 2333875 - DNA, 19 bp, Homo sapiens
ctccaaccactgtgccact

SEQ ID NO: 2333876 - DNA, 21 bp, Homo sapiens
ctccaaccactgtgccactga

SEQ ID NO: 2333877 - DNA, 12 bp, Homo sapiens
ctccaagaaact

SEQ ID NO: 2333878 - DNA, 19 bp, Homo sapiens
ctccaagcacagagcctgg

SEQ ID NO: 2333879 - DNA, 14 bp, Homo sapiens
ctccaagcatttca

SEQ ID NO: 2333880 - DNA, 16 bp, Homo sapiens
ctccaagcatttcatg

SEQ ID NO: 2333881 - DNA, 19 bp, Homo sapiens
ctccaagcatttcatgaaa

SEQ ID NO: 2333882 - DNA, 19 bp, Homo sapiens
ctccaaggaggggctgtaa

SEQ ID NO: 2333883 - DNA, 13 bp, Homo sapiens
ctccacagcgagg

SEQ ID NO: 2333884 - DNA, 14 bp, Homo sapiens
ctccacagcgaggg

SEQ ID NO: 2333885 - DNA, 15 bp, Homo sapiens
ctcctgcctcagcct

SEQ ID NO: 2333886 - DNA, 16 bp, Homo sapiens
ctcctgcctcagcctt

SEQ ID NO: 2333887 - DNA, 14 bp, Homo sapiens
ctcctgctgtgcct

SEQ ID NO: 2333888 - DNA, 20 bp, Homo sapiens
ctcctggacacattggaatg

SEQ ID NO: 2333889 - DNA, 23 bp, Homo sapiens
ctcctggcctatccgctgccagc

SEQ ID NO: 2333890 - DNA, 21 bp, Homo sapiens
ctcctggcgagttctctttgg

SEQ ID NO: 2333891 - DNA, 13 bp, Homo sapiens
ctcctggctcggg

SEQ ID NO: 2333892 - DNA, 15 bp, Homo sapiens
cgatctctcctggcc

SEQ ID NO: 2333893 - DNA, 16 bp, Homo sapiens
cgatctctcctggcct

SEQ ID NO: 2333894 - DNA, 17 bp, Homo sapiens
cgatctctcctggccta

SEQ ID NO: 2333895 - DNA, 17 bp, Homo sapiens
cgatgcatttaataaag

SEQ ID NO: 2333896 - DNA, 19 bp, Homo sapiens
cgatgcatttaataaagat

SEQ ID NO: 2333897 - DNA, 15 bp, Homo sapiens
cgatgttgtcaagga

SEQ ID NO: 2333898 - DNA, 19 bp, Homo sapiens
cgcagaggacgcacgctcg

SEQ ID NO: 2333899 - DNA, 13 bp, Homo sapiens
cgcaggtgggctg

SEQ ID NO: 2333900 - DNA, 14 bp, Homo sapiens
cgccagcctcctct

SEQ ID NO: 2333901 - DNA, 15 bp, Homo sapiens
cgccagcctcctctg

SEQ ID NO: 2333902 - DNA, 15 bp, Homo sapiens
cgccaggaagccaga

SEQ ID NO: 2333903 - DNA, 19 bp, Homo sapiens
cgccaggaagccagagccc

SEQ ID NO: 2333904 - DNA, 14 bp, Homo sapiens
cgccatggtgtccc

SEQ ID NO: 2333905 - DNA, 14 bp, Homo sapiens
cgcccatgctgtcc

SEQ ID NO: 2333906 - DNA, 17 bp, Homo sapiens
cgcccggggtggccaca

SEQ ID NO: 2333907 - DNA, 13 bp, Homo sapiens
cgccctcctttcc

SEQ ID NO: 2333908 - DNA, 16 bp, Homo sapiens
cgccctcctttccctt

SEQ ID NO: 2333909 - DNA, 13 bp, Homo sapiens
cgccctgcctcct

SEQ ID NO: 2333910 - DNA, 17 bp, Homo sapiens
cgccctgcctcctggag

SEQ ID NO: 2333911 - DNA, 19 bp, Homo sapiens
cgccctgtgtgtgtcccct

SEQ ID NO: 2333912 - DNA, 19 bp, Homo sapiens
cgcccttcaatgctgcagg

SEQ ID NO: 2333913 - DNA, 17 bp, Homo sapiens
cgcccttggcttctgtg

SEQ ID NO: 2333914 - DNA, 15 bp, Homo sapiens
cgccggatctgaggg

SEQ ID NO: 2333915 - DNA, 14 bp, Homo sapiens
cgcctcagccctca

SEQ ID NO: 2333916 - DNA, 17 bp, Homo sapiens
cgcctcagccctcagtt

SEQ ID NO: 2333917 - DNA, 14 bp, Homo sapiens
cgcctgagtcagtg

SEQ ID NO: 2333918 - DNA, 22 bp, Homo sapiens
cgcctgagtcagtgctctcagc

SEQ ID NO: 2333919 - DNA, 23 bp, Homo sapiens
cgcctgcaggcagagctggagcc

SEQ ID NO: 2333920 - DNA, 15 bp, Homo sapiens
cgcctggccaggagc

SEQ ID NO: 2333921 - DNA, 14 bp, Homo sapiens
cgcctggcctggcc

SEQ ID NO: 2333922 - DNA, 15 bp, Homo sapiens
cgcgccgatgccacc

SEQ ID NO: 2333923 - DNA, 14 bp, Homo sapiens
cgcgcttgctggcc

SEQ ID NO: 2333924 - DNA, 16 bp, Homo sapiens
cgcgcttgctggccag

SEQ ID NO: 2333925 - DNA, 18 bp, Homo sapiens
cgcggggaagctggcttt

SEQ ID NO: 2333926 - DNA, 22 bp, Homo sapiens
cgcggtgccatgtctgcagtgt

SEQ ID NO: 2333927 - DNA, 15 bp, Homo sapiens
cgcgtcgccgccacc

SEQ ID NO: 2333928 - DNA, 14 bp, Homo sapiens
cgcgtctgccccac

SEQ ID NO: 2333929 - DNA, 19 bp, Homo sapiens
cgcgtctgccccaccctca

SEQ ID NO: 2333930 - DNA, 19 bp, Homo sapiens
cgctaaagagcccttgcct

SEQ ID NO: 2333931 - DNA, 18 bp, Homo sapiens
cgctaataagtgacaaat

SEQ ID NO: 2333932 - DNA, 21 bp, Homo sapiens
cgctcaccgctggcccttaga

SEQ ID NO: 2333933 - DNA, 18 bp, Homo sapiens
cgctcatgttgagccagt

SEQ ID NO: 2333934 - DNA, 15 bp, Homo sapiens
cgctccctcccagga

SEQ ID NO: 2333935 - DNA, 20 bp, Homo sapiens
cgctccctcccaggactctg

SEQ ID NO: 2333936 - DNA, 15 bp, Homo sapiens
cgctctctttgcaac

SEQ ID NO: 2333937 - DNA, 16 bp, Homo sapiens
cgctgagactgtgctg

SEQ ID NO: 2333938 - DNA, 14 bp, Homo sapiens
cgctgccagccttg

SEQ ID NO: 2333939 - DNA, 21 bp, Homo sapiens
cgcttctccccagagctgcct

SEQ ID NO: 2333940 - DNA, 14 bp, Homo sapiens
cgcttgtgacagtg

SEQ ID NO: 2333941 - DNA, 15 bp, Homo sapiens
cggaaacatacagag

SEQ ID NO: 2333942 - DNA, 13 bp, Homo sapiens
cggaaagctcttc

SEQ ID NO: 2333943 - DNA, 24 bp, Homo sapiens
cggaagccccctcttcctccctgg

SEQ ID NO: 2333944 - DNA, 19 bp, Homo sapiens
cggaattcataataaattt

SEQ ID NO: 2333945 - DNA, 18 bp, Homo sapiens
cggacactcgtcacccca

SEQ ID NO: 2333946 - DNA, 13 bp, Homo sapiens
cggaccgcgtaga

SEQ ID NO: 2333947 - DNA, 21 bp, Homo sapiens
cggatcatcaacaagatttcc

SEQ ID NO: 2333948 - DNA, 14 bp, Homo sapiens
cggcaagccacagg

SEQ ID NO: 2333949 - DNA, 16 bp, Homo sapiens
cggccaccactgcagc

SEQ ID NO: 2333950 - DNA, 17 bp, Homo sapiens
cggcccgcctctcctcg

SEQ ID NO: 2333951 - DNA, 16 bp, Homo sapiens
cggcccgtggctgttg

SEQ ID NO: 2333952 - DNA, 21 bp, Homo sapiens
cggcctgtgggtctctgaagg

SEQ ID NO: 2333953 - DNA, 22 bp, Homo sapiens
cggcgtggcccaaggctggcag

SEQ ID NO: 2333954 - DNA, 15 bp, Homo sapiens
cggctactctggaat

SEQ ID NO: 2333955 - DNA, 15 bp, Homo sapiens
cggctcctcagagcg

SEQ ID NO: 2333956 - DNA, 20 bp, Homo sapiens
cggctcctcagagcgccagg

SEQ ID NO: 2333957 - DNA, 17 bp, Homo sapiens
cgggaacatgccccctg

SEQ ID NO: 2333958 - DNA, 15 bp, Homo sapiens
cgggccaaggacctg

SEQ ID NO: 2333959 - DNA, 15 bp, Homo sapiens
cgggcccctgggctt

SEQ ID NO: 2333960 - DNA, 18 bp, Homo sapiens
cgggcctcagtgccccat

SEQ ID NO: 2333961 - DNA, 13 bp, Homo sapiens
cgggctccagcca

SEQ ID NO: 2333962 - DNA, 17 bp, Homo sapiens
cgggctgaggccagagt

SEQ ID NO: 2333963 - DNA, 19 bp, Homo sapiens
cgggctgagggcctgctgg

SEQ ID NO: 2333964 - DNA, 18 bp, Homo sapiens
cggggccccactggctgg

SEQ ID NO: 2333965 - DNA, 14 bp, Homo sapiens
cgggggagagagtt

SEQ ID NO: 2333966 - DNA, 16 bp, Homo sapiens
cggggtggccacagcg

SEQ ID NO: 2333967 - DNA, 13 bp, Homo sapiens
cggggttccctcc

SEQ ID NO: 2333968 - DNA, 19 bp, Homo sapiens
cgggtccatagagatgagc

SEQ ID NO: 2333969 - DNA, 19 bp, Homo sapiens
cgggtgatggccagcccct

SEQ ID NO: 2333970 - DNA, 18 bp, Homo sapiens
cgggtggctctgggatcc

SEQ ID NO: 2333971 - DNA, 21 bp, Homo sapiens
cgggtggggaaaggaggtggg

SEQ ID NO: 2333972 - DNA, 15 bp, Homo sapiens
cgggtttctctgtgg

SEQ ID NO: 2333973 - DNA, 20 bp, Homo sapiens
cggtaagtgttctcatgaag

SEQ ID NO: 2333974 - DNA, 22 bp, Homo sapiens
cggtaccttccatacacagagg

SEQ ID NO: 2333975 - DNA, 19 bp, Homo sapiens
cggtcctttaggcagcctg

SEQ ID NO: 2333976 - DNA, 20 bp, Homo sapiens
cggtcctttaggcagcctgc

SEQ ID NO: 2333977 - DNA, 17 bp, Homo sapiens
cggtgccatgaagggac

SEQ ID NO: 2333978 - DNA, 14 bp, Homo sapiens
cggtgccatgtctg

SEQ ID NO: 2333979 - DNA, 18 bp, Homo sapiens
cggtgctcggagaagagc

SEQ ID NO: 2333980 - DNA, 19 bp, Homo sapiens
cggtgctgtgagggagggg

SEQ ID NO: 2333981 - DNA, 21 bp, Homo sapiens
cggtggctgggcagagctgca

SEQ ID NO: 2333982 - DNA, 21 bp, Homo sapiens
cggtgtttggcaatgctaatt

SEQ ID NO: 2333983 - DNA, 11 bp, Homo sapiens
cggttcctggt

SEQ ID NO: 2333984 - DNA, 17 bp, Homo sapiens
cggttcctggtgactcc

SEQ ID NO: 2333985 - DNA, 21 bp, Homo sapiens
cggttgttctttcctcacatt

SEQ ID NO: 2333986 - DNA, 23 bp, Homo sapiens
cgtaagcagtatattagtattat

SEQ ID NO: 2333987 - DNA, 14 bp, Homo sapiens
cgtagatgatttca

SEQ ID NO: 2333988 - DNA, 19 bp, Homo sapiens
cgtatctccctggagaagc

SEQ ID NO: 2333989 - DNA, 21 bp, Homo sapiens
cgtatctccctggagaagcac

SEQ ID NO: 2333990 - DNA, 20 bp, Homo sapiens
cgtccatatcagaactgtgc

SEQ ID NO: 2333991 - DNA, 16 bp, Homo sapiens
cgtctcggccttcaca

SEQ ID NO: 2333992 - DNA, 16 bp, Homo sapiens
cgtctctactaaaaat

SEQ ID NO: 2333993 - DNA, 18 bp, Homo sapiens
cgtctgccccaccctcaa

SEQ ID NO: 2333994 - DNA, 12 bp, Homo sapiens
cgtctgctctgg

SEQ ID NO: 2333995 - DNA, 22 bp, Homo sapiens
cgtgaaagtgcatttttgtaaa

SEQ ID NO: 2333996 - DNA, 16 bp, Homo sapiens
cgtgaagaaataaatg

SEQ ID NO: 2333997 - DNA, 19 bp, Homo sapiens
cgtgaagaaataaatgaaa

SEQ ID NO: 2333998 - DNA, 22 bp, Homo sapiens
cgtgaagaaataaatgaaactt

SEQ ID NO: 2333999 - DNA, 23 bp, Homo sapiens
cgtgatgtggaggaagagccacc

SEQ ID NO: 2334000 - DNA, 21 bp, Homo sapiens
cgtgatttggaagagaggcac

SEQ ID NO: 2334001 - DNA, 23 bp, Homo sapiens
cgtgatttggaagagaggcacct

SEQ ID NO: 2334002 - DNA, 15 bp, Homo sapiens
cgtgccgtggcacca

SEQ ID NO: 2334003 - DNA, 17 bp, Homo sapiens
cgtggaggaggaaggca

SEQ ID NO: 2334004 - DNA, 18 bp, Homo sapiens
cgtggcactcgctgtatg

SEQ ID NO: 2334005 - DNA, 13 bp, Homo sapiens
cgtggcccaaggc

SEQ ID NO: 2334006 - DNA, 18 bp, Homo sapiens
cgtgggatggcatttggt

SEQ ID NO: 2334007 - DNA, 17 bp, Homo sapiens
cgtggtatgtctgccat

SEQ ID NO: 2334008 - DNA, 16 bp, Homo sapiens
cgtgtatttattacat

SEQ ID NO: 2334009 - DNA, 20 bp, Homo sapiens
cagaagccttggaaccagcc

SEQ ID NO: 2334010 - DNA, 22 bp, Homo sapiens
cagaagccttggaaccagcccc

SEQ ID NO: 2334011 - DNA, 22 bp, Homo sapiens
cagaaggtgccactttacccac

SEQ ID NO: 2334012 - DNA, 22 bp, Homo sapiens
cagaagtcacacattacaaagt

SEQ ID NO: 2334013 - DNA, 14 bp, Homo sapiens
cagaagtccctgtt

SEQ ID NO: 2334014 - DNA, 14 bp, Homo sapiens
cagaagtctggctt

SEQ ID NO: 2334015 - DNA, 19 bp, Homo sapiens
cagaatatttctattgaat

SEQ ID NO: 2334016 - DNA, 20 bp, Homo sapiens
cagaatcttgttttgaaaat

SEQ ID NO: 2334017 - DNA, 13 bp, Homo sapiens
cagaatgctcagg

SEQ ID NO: 2334018 - DNA, 14 bp, Homo sapiens
cagaattatacagt

SEQ ID NO: 2334019 - DNA, 16 bp, Homo sapiens
cagaattggtaaaaac

SEQ ID NO: 2334020 - DNA, 13 bp, Homo sapiens
cagaatttgaatt

SEQ ID NO: 2334021 - DNA, 14 bp, Homo sapiens
cagaatttgagaac

SEQ ID NO: 2334022 - DNA, 16 bp, Homo sapiens
cagaatttgagaacct

SEQ ID NO: 2334023 - DNA, 21 bp, Homo sapiens
cagaatttgagaaccttggac

SEQ ID NO: 2334024 - DNA, 19 bp, Homo sapiens
cagacactaacgaaatatc

SEQ ID NO: 2334025 - DNA, 22 bp, Homo sapiens
cagacagggtgggcttcctgcc

SEQ ID NO: 2334026 - DNA, 20 bp, Homo sapiens
cagacataaaggaaaagaca

SEQ ID NO: 2334027 - DNA, 13 bp, Homo sapiens
cagacatacagct

SEQ ID NO: 2334028 - DNA, 17 bp, Homo sapiens
cagacatggacctccag

SEQ ID NO: 2334029 - DNA, 15 bp, Homo sapiens
cagaccactgtctcc

SEQ ID NO: 2334030 - DNA, 17 bp, Homo sapiens
cagacctaaagcaagcc

SEQ ID NO: 2334031 - DNA, 16 bp, Homo sapiens
cagacctcaagccatc

SEQ ID NO: 2334032 - DNA, 16 bp, Homo sapiens
cagacctcatgcccag

SEQ ID NO: 2334033 - DNA, 16 bp, Homo sapiens
cagacgttgcctgaga

SEQ ID NO: 2334034 - DNA, 18 bp, Homo sapiens
cagacgttgcctgagaag

SEQ ID NO: 2334035 - DNA, 20 bp, Homo sapiens
cagactctttttttgagtga

SEQ ID NO: 2334036 - DNA, 16 bp, Homo sapiens
cagactggggcatcct

SEQ ID NO: 2334037 - DNA, 18 bp, Homo sapiens
cagactggggcatcctgt

SEQ ID NO: 2334038 - DNA, 21 bp, Homo sapiens
cagactggggcatcctgtgcc

SEQ ID NO: 2334039 - DNA, 20 bp, Homo sapiens
cagagaaaaatgctccccac

SEQ ID NO: 2334040 - DNA, 12 bp, Homo sapiens
cagagacaaaat

SEQ ID NO: 2334041 - DNA, 20 bp, Homo sapiens
cagagacaaaatatttccca

SEQ ID NO: 2334042 - DNA, 14 bp, Homo sapiens
cagagacaacaggt

SEQ ID NO: 2334043 - DNA, 19 bp, Homo sapiens
cagagactgtttgaatgtt

SEQ ID NO: 2334044 - DNA, 17 bp, Homo sapiens
cagagactttagggggt

SEQ ID NO: 2334045 - DNA, 14 bp, Homo sapiens
cagagagcagctcc

SEQ ID NO: 2334046 - DNA, 21 bp, Homo sapiens
cagagagcagctccctttctc

SEQ ID NO: 2334047 - DNA, 19 bp, Homo sapiens
cagagagccattttgtgaa

SEQ ID NO: 2334048 - DNA, 18 bp, Homo sapiens
cagagaggcactcagtga

SEQ ID NO: 2334049 - DNA, 21 bp, Homo sapiens
cagagatttctcattgacttt

SEQ ID NO: 2334050 - DNA, 16 bp, Homo sapiens
cagagcagatgcagag

SEQ ID NO: 2334051 - DNA, 14 bp, Homo sapiens
cagagccccaagca

SEQ ID NO: 2334052 - DNA, 20 bp, Homo sapiens
cagagccggcccgcctctcc

SEQ ID NO: 2334053 - DNA, 14 bp, Homo sapiens
cagagcctggcccc

SEQ ID NO: 2334054 - DNA, 16 bp, Homo sapiens
cagagcctggccccag

SEQ ID NO: 2334055 - DNA, 19 bp, Homo sapiens
cagagcctggccccaggcc

SEQ ID NO: 2334056 - DNA, 13 bp, Homo sapiens
cagagccttctca

SEQ ID NO: 2334057 - DNA, 18 bp, Homo sapiens
cagagccttctcagaagc

SEQ ID NO: 2334058 - DNA, 13 bp, Homo sapiens
cagagcgcacagg

SEQ ID NO: 2334059 - DNA, 19 bp, Homo sapiens
cagagcgccaggaagccag

SEQ ID NO: 2334060 - DNA, 20 bp, Homo sapiens
cagagcgccaggaagccaga

SEQ ID NO: 2334061 - DNA, 21 bp, Homo sapiens
cagagcggatgggcacacaca

SEQ ID NO: 2334062 - DNA, 18 bp, Homo sapiens
cagagctaaactccttcc

SEQ ID NO: 2334063 - DNA, 21 bp, Homo sapiens
cagagctgcctgctctgtgag

SEQ ID NO: 2334064 - DNA, 21 bp, Homo sapiens
cagagctggagcccccagcag

SEQ ID NO: 2334065 - DNA, 18 bp, Homo sapiens
cagagctggtggacccag

SEQ ID NO: 2334066 - DNA, 19 bp, Homo sapiens
cagaggaaagggctggctc

SEQ ID NO: 2334067 - DNA, 20 bp, Homo sapiens
cagaggaaagggctggctcc

SEQ ID NO: 2334068 - DNA, 22 bp, Homo sapiens
cagaggaatcctggcagcccag

SEQ ID NO: 2334069 - DNA, 11 bp, Homo sapiens
cagaggagctt

SEQ ID NO: 2334070 - DNA, 15 bp, Homo sapiens
cagaggagcttttct

SEQ ID NO: 2334071 - DNA, 20 bp, Homo sapiens
cagaggagcttttctggaat

SEQ ID NO: 2334072 - DNA, 14 bp, Homo sapiens
cagaggagggcaga

SEQ ID NO: 2334073 - DNA, 15 bp, Homo sapiens
cagaggagggcagag

SEQ ID NO: 2334074 - DNA, 20 bp, Homo sapiens
cagaggagtgcagccttctc

SEQ ID NO: 2334075 - DNA, 22 bp, Homo sapiens
cagaggagtgcagccttctcca

SEQ ID NO: 2334076 - DNA, 17 bp, Homo sapiens
cagaggatgccttttct

SEQ ID NO: 2334077 - DNA, 14 bp, Homo sapiens
cagaggcaggctgg

SEQ ID NO: 2334078 - DNA, 18 bp, Homo sapiens
cagagggaaggggcctac

SEQ ID NO: 2334079 - DNA, 19 bp, Homo sapiens
cagagggagaatccaaggg

SEQ ID NO: 2334080 - DNA, 15 bp, Homo sapiens
cagagggagtagaat

SEQ ID NO: 2334081 - DNA, 14 bp, Homo sapiens
cagagggcatgctg

SEQ ID NO: 2334082 - DNA, 16 bp, Homo sapiens
cagagggcatgctgaa

SEQ ID NO: 2334083 - DNA, 14 bp, Homo sapiens
cagaggtaacagaa

SEQ ID NO: 2334084 - DNA, 22 bp, Homo sapiens
cagaggtaacagaacagcttca

SEQ ID NO: 2334085 - DNA, 22 bp, Homo sapiens
cagaggtattaaaactaaattt

SEQ ID NO: 2334086 - DNA, 23 bp, Homo sapiens
cagaggtattaaaactaaatttc

SEQ ID NO: 2334087 - DNA, 18 bp, Homo sapiens
cagaggtggatgttatga

SEQ ID NO: 2334088 - DNA, 22 bp, Homo sapiens
cagagtcaccttttctgtggct

SEQ ID NO: 2334089 - DNA, 14 bp, Homo sapiens
cagagtccagtgct

SEQ ID NO: 2334090 - DNA, 15 bp, Homo sapiens
cagagtccagtgctc

SEQ ID NO: 2334091 - DNA, 20 bp, Homo sapiens
cagagtccagtgctctgcct

SEQ ID NO: 2334092 - DNA, 22 bp, Homo sapiens
cagagtgatttgtaaaacagtg

SEQ ID NO: 2334093 - DNA, 12 bp, Homo sapiens
cagagtggccca

SEQ ID NO: 2334094 - DNA, 14 bp, Homo sapiens
cagagtggcccacc

SEQ ID NO: 2334095 - DNA, 15 bp, Homo sapiens
cagagtggtggggga

SEQ ID NO: 2334096 - DNA, 17 bp, Homo sapiens
cagagttaaatctcaaa

SEQ ID NO: 2334097 - DNA, 15 bp, Homo sapiens
cagataactctcttt

SEQ ID NO: 2334098 - DNA, 14 bp, Homo sapiens
cagataactgagga

SEQ ID NO: 2334099 - DNA, 17 bp, Homo sapiens
cagatacatggttgtga

SEQ ID NO: 2334100 - DNA, 14 bp, Homo sapiens
cagatcactgccac

SEQ ID NO: 2334101 - DNA, 16 bp, Homo sapiens
cagatcactgccacac

SEQ ID NO: 2334102 - DNA, 13 bp, Homo sapiens
cagatctgttttg

SEQ ID NO: 2334103 - DNA, 18 bp, Homo sapiens
cagatcttggactcatga

SEQ ID NO: 2334104 - DNA, 19 bp, Homo sapiens
cagatcttggactcatgag

SEQ ID NO: 2334105 - DNA, 20 bp, Homo sapiens
cagatcttggactcatgagg

SEQ ID NO: 2334106 - DNA, 22 bp, Homo sapiens
cagatcttggactcatgaggag

SEQ ID NO: 2334107 - DNA, 15 bp, Homo sapiens
cagatctttcagaaa

SEQ ID NO: 2334108 - DNA, 12 bp, Homo sapiens
cagatctttctc

SEQ ID NO: 2334109 - DNA, 20 bp, Homo sapiens
cagatgggaacagtaaagaa

SEQ ID NO: 2334110 - DNA, 14 bp, Homo sapiens
cagatgtcttccct

SEQ ID NO: 2334111 - DNA, 23 bp, Homo sapiens
cagatgtgagccaccgtgcctgg

SEQ ID NO: 2334112 - DNA, 23 bp, Homo sapiens
cagatgtggctactgacatatct

SEQ ID NO: 2334113 - DNA, 14 bp, Homo sapiens
cagattctgatgca

SEQ ID NO: 2334114 - DNA, 17 bp, Homo sapiens
cagattgcttaaaagca

SEQ ID NO: 2334115 - DNA, 15 bp, Homo sapiens
cagatttctgaggaa

SEQ ID NO: 2334116 - DNA, 19 bp, Homo sapiens
cagattttacagagcgcac

SEQ ID NO: 2334117 - DNA, 19 bp, Homo sapiens
cagattttcagcaaactct

SEQ ID NO: 2334118 - DNA, 15 bp, Homo sapiens
cagcaaagaaaaaaa

SEQ ID NO: 2334119 - DNA, 23 bp, Homo sapiens
cagcaagttagaactagccaaac

SEQ ID NO: 2334120 - DNA, 17 bp, Homo sapiens
cagcaatagggtgcagt

SEQ ID NO: 2334121 - DNA, 21 bp, Homo sapiens
cagcaatagggtgcagttttc

SEQ ID NO: 2334122 - DNA, 15 bp, Homo sapiens
cagcaattctctttc

SEQ ID NO: 2334123 - DNA, 15 bp, Homo sapiens
cagcaccacactggg

SEQ ID NO: 2334124 - DNA, 17 bp, Homo sapiens
cagcaccacactgggtg

SEQ ID NO: 2334125 - DNA, 23 bp, Homo sapiens
cagcaccacactgggtgcgtctc

SEQ ID NO: 2334126 - DNA, 15 bp, Homo sapiens
cagcactttgggagg

SEQ ID NO: 2334127 - DNA, 21 bp, Homo sapiens
cagcagaacctgcacacagga

SEQ ID NO: 2334128 - DNA, 14 bp, Homo sapiens
cagcagatgctgtt

SEQ ID NO: 2334129 - DNA, 17 bp, Homo sapiens
cagcagatgctgttgtg

SEQ ID NO: 2334130 - DNA, 15 bp, Homo sapiens
cagcagcagcaggtg

SEQ ID NO: 2334131 - DNA, 16 bp, Homo sapiens
cagcagcagcaggtga

SEQ ID NO: 2334132 - DNA, 15 bp, Homo sapiens
cagcagcttataatg

SEQ ID NO: 2334133 - DNA, 21 bp, Homo sapiens
cagcagcttataatgggctct

SEQ ID NO: 2334134 - DNA, 23 bp, Homo sapiens
cagcaggtgattggaccaggcca

SEQ ID NO: 2334135 - DNA, 16 bp, Homo sapiens
cagcagtgcagccggg

SEQ ID NO: 2334136 - DNA, 15 bp, Homo sapiens
cagcagttgttccag

SEQ ID NO: 2334137 - DNA, 15 bp, Homo sapiens
cagcatcccttccca

SEQ ID NO: 2334138 - DNA, 14 bp, Homo sapiens
cagcatcttctggt

SEQ ID NO: 2334139 - DNA, 22 bp, Homo sapiens
cagcatgtgtatttccagtgca

SEQ ID NO: 2334140 - DNA, 13 bp, Homo sapiens
cagcattccctac

SEQ ID NO: 2334141 - DNA, 13 bp, Homo sapiens
cagcattttagaa

SEQ ID NO: 2334142 - DNA, 18 bp, Homo sapiens
cagcattttagaaactac

SEQ ID NO: 2334143 - DNA, 15 bp, Homo sapiens
cagcattttcacatt

SEQ ID NO: 2334144 - DNA, 19 bp, Homo sapiens
cagcattttcacattttgc

SEQ ID NO: 2334145 - DNA, 22 bp, Homo sapiens
cagccaagattttcctcttgtg

SEQ ID NO: 2334146 - DNA, 21 bp, Homo sapiens
cagccactcccctccactctc

SEQ ID NO: 2334147 - DNA, 22 bp, Homo sapiens
cagccagaggagggcagaggga

SEQ ID NO: 2334148 - DNA, 11 bp, Homo sapiens
cagccaggcag

SEQ ID NO: 2334149 - DNA, 22 bp, Homo sapiens
cagccagtgacctttgacctcg

SEQ ID NO: 2334150 - DNA, 20 bp, Homo sapiens
cagccatgccagctggcctt

SEQ ID NO: 2334151 - DNA, 21 bp, Homo sapiens
cagccatgccagctggccttt

SEQ ID NO: 2334152 - DNA, 22 bp, Homo sapiens
cagcccaccagacgtcaggccc

SEQ ID NO: 2334153 - DNA, 17 bp, Homo sapiens
cagcccagagactttgt

SEQ ID NO: 2334154 - DNA, 19 bp, Homo sapiens
cagcccagattcccctgtg

SEQ ID NO: 2334155 - DNA, 23 bp, Homo sapiens
cagcccagccccgccccgttgtg

SEQ ID NO: 2334156 - DNA, 22 bp, Homo sapiens
cagcccatggagattgacctgg

SEQ ID NO: 2334157 - DNA, 21 bp, Homo sapiens
cagccccactcctctgctgac

SEQ ID NO: 2334158 - DNA, 16 bp, Homo sapiens
cagcccccgccccaga

SEQ ID NO: 2334159 - DNA, 19 bp, Homo sapiens
cagcccccgccccagagtg

SEQ ID NO: 2334160 - DNA, 23 bp, Homo sapiens
cagcccccgccccagagtggccc

SEQ ID NO: 2334161 - DNA, 19 bp, Homo sapiens
cagccccctaaaagcactc

SEQ ID NO: 2334162 - DNA, 17 bp, Homo sapiens
cagccccgccccgttgt

SEQ ID NO: 2334163 - DNA, 17 bp, Homo sapiens
cagccccggcaagccac

SEQ ID NO: 2334164 - DNA, 16 bp, Homo sapiens
cagcccctactgctgt

SEQ ID NO: 2334165 - DNA, 22 bp, Homo sapiens
cagcccctatagcactgagctc

SEQ ID NO: 2334166 - DNA, 13 bp, Homo sapiens
cagcccctggggc

SEQ ID NO: 2334167 - DNA, 17 bp, Homo sapiens
cagcccctggggcccag

SEQ ID NO: 2334168 - DNA, 19 bp, Homo sapiens
cagcccctggggcccagcc

SEQ ID NO: 2334169 - DNA, 22 bp, Homo sapiens
cagcccctggggcccagcccct

SEQ ID NO: 2334170 - DNA, 21 bp, Homo sapiens
cagcccctgtttactggttct

SEQ ID NO: 2334171 - DNA, 15 bp, Homo sapiens
cagcctactctcctt

SEQ ID NO: 2334172 - DNA, 19 bp, Homo sapiens
cagcctcatactcctgggc

SEQ ID NO: 2334173 - DNA, 20 bp, Homo sapiens
cagcctcatactcctgggct

SEQ ID NO: 2334174 - DNA, 20 bp, Homo sapiens
cagcctccgagagggagaga

SEQ ID NO: 2334175 - DNA, 17 bp, Homo sapiens
cagcctccgccattcca

SEQ ID NO: 2334176 - DNA, 21 bp, Homo sapiens
cagcctcctctggacggcagg

SEQ ID NO: 2334177 - DNA, 14 bp, Homo sapiens
cagcctcctttgtg

SEQ ID NO: 2334178 - DNA, 20 bp, Homo sapiens
cagcctcctttgtgtgtatt

SEQ ID NO: 2334179 - DNA, 12 bp, Homo sapiens
cagcctctggac

SEQ ID NO: 2334180 - DNA, 13 bp, Homo sapiens
cagcctctggaca

SEQ ID NO: 2334181 - DNA, 20 bp, Homo sapiens
cagcctctggacagccagtg

SEQ ID NO: 2334182 - DNA, 18 bp, Homo sapiens
cagcctgaacagaagctc

SEQ ID NO: 2334183 - DNA, 20 bp, Homo sapiens
cagcctgccgccgtctctgt

SEQ ID NO: 2334184 - DNA, 13 bp, Homo sapiens
cagcctgtcctgg

SEQ ID NO: 2334185 - DNA, 23 bp, Homo sapiens
cagccttctccatatctccatgg

SEQ ID NO: 2334186 - DNA, 15 bp, Homo sapiens
cagcgagggcagctg

SEQ ID NO: 2334187 - DNA, 20 bp, Homo sapiens
cagcgatctctccactgtgc

SEQ ID NO: 2334188 - DNA, 22 bp, Homo sapiens
cagcggctcccctctgcttctc

SEQ ID NO: 2334189 - DNA, 14 bp, Homo sapiens
cagcgtccctggcg

SEQ ID NO: 2334190 - DNA, 20 bp, Homo sapiens
cagggagcaactctccactc

SEQ ID NO: 2334191 - DNA, 15 bp, Homo sapiens
cagggagcctcccca

SEQ ID NO: 2334192 - DNA, 23 bp, Homo sapiens
cagggagcctccccatctgtcca

SEQ ID NO: 2334193 - DNA, 17 bp, Homo sapiens
cagggatttgcctcacc

SEQ ID NO: 2334194 - DNA, 21 bp, Homo sapiens
cagggatttgcctcaccttgg

SEQ ID NO: 2334195 - DNA, 21 bp, Homo sapiens
cagggcaagggttaaggcctg

SEQ ID NO: 2334196 - DNA, 23 bp, Homo sapiens
cagggcaagggttaaggcctgaa

SEQ ID NO: 2334197 - DNA, 17 bp, Homo sapiens
cagggcagggcagcctg

SEQ ID NO: 2334198 - DNA, 14 bp, Homo sapiens
cagggcagggtctg

SEQ ID NO: 2334199 - DNA, 20 bp, Homo sapiens
cagggcagggtctgggctgg

SEQ ID NO: 2334200 - DNA, 18 bp, Homo sapiens
cagggcatcttgctggct

SEQ ID NO: 2334201 - DNA, 16 bp, Homo sapiens
cagggcctcctggggg

SEQ ID NO: 2334202 - DNA, 13 bp, Homo sapiens
cagggctggctcc

SEQ ID NO: 2334203 - DNA, 17 bp, Homo sapiens
cagggctgtcccagccc

SEQ ID NO: 2334204 - DNA, 19 bp, Homo sapiens
cagggctgtgcttgaaggc

SEQ ID NO: 2334205 - DNA, 13 bp, Homo sapiens
caggggtctccct

SEQ ID NO: 2334206 - DNA, 14 bp, Homo sapiens
caggggtctccctg

SEQ ID NO: 2334207 - DNA, 15 bp, Homo sapiens
caggggtctccctgg

SEQ ID NO: 2334208 - DNA, 18 bp, Homo sapiens
caggggtctccctggctc

SEQ ID NO: 2334209 - DNA, 20 bp, Homo sapiens
caggggtctccctggctccc

SEQ ID NO: 2334210 - DNA, 20 bp, Homo sapiens
caggggtgggggtggaggct

SEQ ID NO: 2334211 - DNA, 22 bp, Homo sapiens
caggggtgggggtggaggcttc

SEQ ID NO: 2334212 - DNA, 19 bp, Homo sapiens
cagggtcactgaaccactg

SEQ ID NO: 2334213 - DNA, 18 bp, Homo sapiens
cagggtctgggctgggca

SEQ ID NO: 2334214 - DNA, 14 bp, Homo sapiens
cagggtcttgctct

SEQ ID NO: 2334215 - DNA, 15 bp, Homo sapiens
cagggtcttgctctg

SEQ ID NO: 2334216 - DNA, 16 bp, Homo sapiens
cagggtcttgctctgt

SEQ ID NO: 2334217 - DNA, 18 bp, Homo sapiens
cagggtcttgctctgtcc

SEQ ID NO: 2334218 - DNA, 20 bp, Homo sapiens
cagggtcttgctctgtcccc

SEQ ID NO: 2334219 - DNA, 14 bp, Homo sapiens
cagggtcttggctg

SEQ ID NO: 2334220 - DNA, 20 bp, Homo sapiens
cagggtgaactgcaaagctt

SEQ ID NO: 2334221 - DNA, 18 bp, Homo sapiens
cagggttcaaaatgtctg

SEQ ID NO: 2334222 - DNA, 22 bp, Homo sapiens
cagggttcaagccttccaggga

SEQ ID NO: 2334223 - DNA, 14 bp, Homo sapiens
caggtaccagctgc

SEQ ID NO: 2334224 - DNA, 15 bp, Homo sapiens
caggtaccagctgcg

SEQ ID NO: 2334225 - DNA, 12 bp, Homo sapiens
caggtcatcaga

SEQ ID NO: 2334226 - DNA, 17 bp, Homo sapiens
caggtcatcagatgcct

SEQ ID NO: 2334227 - DNA, 16 bp, Homo sapiens
caggtgacatgtgaaa

SEQ ID NO: 2334228 - DNA, 21 bp, Homo sapiens
caggtgattggaccaggccat

SEQ ID NO: 2334229 - DNA, 21 bp, Homo sapiens
caggtgccttacatcttttct

SEQ ID NO: 2334230 - DNA, 23 bp, Homo sapiens
caggtgccttacatcttttctaa

SEQ ID NO: 2334231 - DNA, 13 bp, Homo sapiens
caggtgctgtcca

SEQ ID NO: 2334232 - DNA, 14 bp, Homo sapiens
caggtgctgtccat

SEQ ID NO: 2334233 - DNA, 15 bp, Homo sapiens
caggtgtataaatgt

SEQ ID NO: 2334234 - DNA, 23 bp, Homo sapiens
caggttatcgaaataacaatgtt

SEQ ID NO: 2334235 - DNA, 22 bp, Homo sapiens
caggttattgcaataaagtata

SEQ ID NO: 2334236 - DNA, 22 bp, Homo sapiens
caggttggggctgggtccaccc

SEQ ID NO: 2334237 - DNA, 21 bp, Homo sapiens
cagtaacccccttaaatttaa

SEQ ID NO: 2334238 - DNA, 15 bp, Homo sapiens
cagtaagttatcttt

SEQ ID NO: 2334239 - DNA, 22 bp, Homo sapiens
cagtacagagaaattctgtggt

SEQ ID NO: 2334240 - DNA, 23 bp, Homo sapiens
cagtacagagaaattctgtggtg

SEQ ID NO: 2334241 - DNA, 12 bp, Homo sapiens
cagtactgggaa

SEQ ID NO: 2334242 - DNA, 16 bp, Homo sapiens
caagttagaaaacata

SEQ ID NO: 2334243 - DNA, 17 bp, Homo sapiens
caagttattaaaaatgt

SEQ ID NO: 2334244 - DNA, 18 bp, Homo sapiens
caagttgtgcttgagcca

SEQ ID NO: 2334245 - DNA, 22 bp, Homo sapiens
caagttttaaacccaaaatata

SEQ ID NO: 2334246 - DNA, 14 bp, Homo sapiens
caagttttaaagtt

SEQ ID NO: 2334247 - DNA, 17 bp, Homo sapiens
caataaaaatgtttaac

SEQ ID NO: 2334248 - DNA, 13 bp, Homo sapiens
caataaaacaaat

SEQ ID NO: 2334249 - DNA, 12 bp, Homo sapiens
caataaaagctt

SEQ ID NO: 2334250 - DNA, 11 bp, Homo sapiens
caataaaattt

SEQ ID NO: 2334251 - DNA, 16 bp, Homo sapiens
caataaagtataatgt

SEQ ID NO: 2334252 - DNA, 15 bp, Homo sapiens
caataacagctgcaa

SEQ ID NO: 2334253 - DNA, 14 bp, Homo sapiens
caataagaaacagt

SEQ ID NO: 2334254 - DNA, 22 bp, Homo sapiens
caataagaaacagtttaacaga

SEQ ID NO: 2334255 - DNA, 17 bp, Homo sapiens
caatacactagttgttt

SEQ ID NO: 2334256 - DNA, 19 bp, Homo sapiens
caatactcttaaattttat

SEQ ID NO: 2334257 - DNA, 22 bp, Homo sapiens
caataggagtggtgatttgaaa

SEQ ID NO: 2334258 - DNA, 18 bp, Homo sapiens
caatagtatagaagtctg

SEQ ID NO: 2334259 - DNA, 15 bp, Homo sapiens
caatagttgaattag

SEQ ID NO: 2334260 - DNA, 13 bp, Homo sapiens
caatatcatgtga

SEQ ID NO: 2334261 - DNA, 15 bp, Homo sapiens
caatatcatgtgatt

SEQ ID NO: 2334262 - DNA, 16 bp, Homo sapiens
caatatgaatctataa

SEQ ID NO: 2334263 - DNA, 15 bp, Homo sapiens
caatattctgtaact

SEQ ID NO: 2334264 - DNA, 23 bp, Homo sapiens
caatattgattgggaaaacattt

SEQ ID NO: 2334265 - DNA, 16 bp, Homo sapiens
caatatttgttactgt

SEQ ID NO: 2334266 - DNA, 20 bp, Homo sapiens
caatatttttatatcatgca

SEQ ID NO: 2334267 - DNA, 22 bp, Homo sapiens
caatatttttatatcatgcaaa

SEQ ID NO: 2334268 - DNA, 15 bp, Homo sapiens
caatcaactctaata

SEQ ID NO: 2334269 - DNA, 20 bp, Homo sapiens
caatcctaatttctcctccc

SEQ ID NO: 2334270 - DNA, 14 bp, Homo sapiens
caatcctcctgcct

SEQ ID NO: 2334271 - DNA, 15 bp, Homo sapiens
caatcctcctgcctc

SEQ ID NO: 2334272 - DNA, 17 bp, Homo sapiens
caatcctcctgcctcag

SEQ ID NO: 2334273 - DNA, 17 bp, Homo sapiens
caatcggactgccaaat

SEQ ID NO: 2334274 - DNA, 20 bp, Homo sapiens
caatctatggcttatttcta

SEQ ID NO: 2334275 - DNA, 23 bp, Homo sapiens
caatctcctctctctttcctcca

SEQ ID NO: 2334276 - DNA, 15 bp, Homo sapiens
caatctcttcattat

SEQ ID NO: 2334277 - DNA, 12 bp, Homo sapiens
caatctgtaaac

SEQ ID NO: 2334278 - DNA, 14 bp, Homo sapiens
caatctgtcagttc

SEQ ID NO: 2334279 - DNA, 13 bp, Homo sapiens
caatgaaatgaat

SEQ ID NO: 2334280 - DNA, 19 bp, Homo sapiens
caatgaccattcaattagt

SEQ ID NO: 2334281 - DNA, 15 bp, Homo sapiens
caatgactcaaagtc

SEQ ID NO: 2334282 - DNA, 13 bp, Homo sapiens
caatgagaaaaat

SEQ ID NO: 2334283 - DNA, 13 bp, Homo sapiens
caatgagagcata

SEQ ID NO: 2334284 - DNA, 20 bp, Homo sapiens
caatgatcaccgactgaaaa

SEQ ID NO: 2334285 - DNA, 17 bp, Homo sapiens
caatgccgcaacatata

SEQ ID NO: 2334286 - DNA, 16 bp, Homo sapiens
caatgggaagcaggga

SEQ ID NO: 2334287 - DNA, 17 bp, Homo sapiens
caatgggacctgtggct

SEQ ID NO: 2334288 - DNA, 17 bp, Homo sapiens
caatgtatgtgtggctg

SEQ ID NO: 2334289 - DNA, 13 bp, Homo sapiens
caatgtgatttat

SEQ ID NO: 2334290 - DNA, 13 bp, Homo sapiens
caatgtgcataat

SEQ ID NO: 2334291 - DNA, 11 bp, Homo sapiens
caatgttaagg

SEQ ID NO: 2334292 - DNA, 18 bp, Homo sapiens
caatgttaaggaaactct

SEQ ID NO: 2334293 - DNA, 19 bp, Homo sapiens
caatgttaaggaaactctt

SEQ ID NO: 2334294 - DNA, 16 bp, Homo sapiens
caattaagaaattcca

SEQ ID NO: 2334295 - DNA, 17 bp, Homo sapiens
caattagtaacattcat

SEQ ID NO: 2334296 - DNA, 18 bp, Homo sapiens
caattagtaacattcatg

SEQ ID NO: 2334297 - DNA, 21 bp, Homo sapiens
caattagtggtcataaaatag

SEQ ID NO: 2334298 - DNA, 22 bp, Homo sapiens
caattatttgaagatttaatta

SEQ ID NO: 2334299 - DNA, 12 bp, Homo sapiens
caattcagaggc

SEQ ID NO: 2334300 - DNA, 17 bp, Homo sapiens
caattcccaccactaaa

SEQ ID NO: 2334301 - DNA, 20 bp, Homo sapiens
caattgacattcctttgaat

SEQ ID NO: 2334302 - DNA, 15 bp, Homo sapiens
caatttcctctccac

SEQ ID NO: 2334303 - DNA, 21 bp, Homo sapiens
caatttcctctccactgctgg

SEQ ID NO: 2334304 - DNA, 15 bp, Homo sapiens
caattttttttaatt

SEQ ID NO: 2334305 - DNA, 16 bp, Homo sapiens
cacaaaccctgctgaa

SEQ ID NO: 2334306 - DNA, 17 bp, Homo sapiens
cacaaaccctgctgaac

SEQ ID NO: 2334307 - DNA, 20 bp, Homo sapiens
cacaaagctatttaagtgga

SEQ ID NO: 2334308 - DNA, 13 bp, Homo sapiens
cacaaagcttcta

SEQ ID NO: 2334309 - DNA, 16 bp, Homo sapiens
cacaaagcttctaaag

SEQ ID NO: 2334310 - DNA, 19 bp, Homo sapiens
cacaacttcccattaaaaa

SEQ ID NO: 2334311 - DNA, 12 bp, Homo sapiens
cacaagctgcac

SEQ ID NO: 2334312 - DNA, 15 bp, Homo sapiens
cacaagctgcactgt

SEQ ID NO: 2334313 - DNA, 18 bp, Homo sapiens
cacaataaaaatgtttaa

SEQ ID NO: 2334314 - DNA, 15 bp, Homo sapiens
cacacacacacacga

SEQ ID NO: 2334315 - DNA, 13 bp, Homo sapiens
cacacacagcccc

SEQ ID NO: 2334316 - DNA, 14 bp, Homo sapiens
cacacctcacgctc

SEQ ID NO: 2334317 - DNA, 17 bp, Homo sapiens
cacacctcacgctctgg

SEQ ID NO: 2334318 - DNA, 10 bp, Homo sapiens
cacacgatgc

SEQ ID NO: 2334319 - DNA, 13 bp, Homo sapiens
cacacgatgcatt

SEQ ID NO: 2334320 - DNA, 20 bp, Homo sapiens
cacacgatgttgtcaaggat

SEQ ID NO: 2334321 - DNA, 14 bp, Homo sapiens
cacacgctgcacct

SEQ ID NO: 2334322 - DNA, 18 bp, Homo sapiens
cacactcgtctttccctt

SEQ ID NO: 2334323 - DNA, 19 bp, Homo sapiens
cacactgatggctcaagac

SEQ ID NO: 2334324 - DNA, 21 bp, Homo sapiens
cacactgggtgcgtctccagt

SEQ ID NO: 2334325 - DNA, 16 bp, Homo sapiens
cacacttgaaaccttt

SEQ ID NO: 2334326 - DNA, 15 bp, Homo sapiens
cacactttttgctta

SEQ ID NO: 2334327 - DNA, 21 bp, Homo sapiens
cacagaaatgctgctggccaa

SEQ ID NO: 2334328 - DNA, 14 bp, Homo sapiens
cacagacccaggac

SEQ ID NO: 2334329 - DNA, 16 bp, Homo sapiens
cacagacccaggaccc

SEQ ID NO: 2334330 - DNA, 21 bp, Homo sapiens
cacagacccaggacccccgag

SEQ ID NO: 2334331 - DNA, 13 bp, Homo sapiens
cacagagcctggc

SEQ ID NO: 2334332 - DNA, 14 bp, Homo sapiens
cacagagcctggcc

SEQ ID NO: 2334333 - DNA, 19 bp, Homo sapiens
cacagagcctggccccagg

SEQ ID NO: 2334334 - DNA, 16 bp, Homo sapiens
cacagaggagtgcagc

SEQ ID NO: 2334335 - DNA, 23 bp, Homo sapiens
cacagaggtagtctcactgcttg

SEQ ID NO: 2334336 - DNA, 16 bp, Homo sapiens
caccttcctgtgggtg

SEQ ID NO: 2334337 - DNA, 22 bp, Homo sapiens
caccttgccagggcagggtctg

SEQ ID NO: 2334338 - DNA, 12 bp, Homo sapiens
caccttggaagg

SEQ ID NO: 2334339 - DNA, 13 bp, Homo sapiens
caccttggaaggg

SEQ ID NO: 2334340 - DNA, 15 bp, Homo sapiens
caccttgtgtctgta

SEQ ID NO: 2334341 - DNA, 21 bp, Homo sapiens
caccttgtgtctgtacacgtg

SEQ ID NO: 2334342 - DNA, 18 bp, Homo sapiens
cacctttgggatcagcct

SEQ ID NO: 2334343 - DNA, 19 bp, Homo sapiens
cacctttgggatcagcctc

SEQ ID NO: 2334344 - DNA, 18 bp, Homo sapiens
caccttttaactcacctc

SEQ ID NO: 2334345 - DNA, 22 bp, Homo sapiens
caccttttctgtggctggctct

SEQ ID NO: 2334346 - DNA, 17 bp, Homo sapiens
cacgactcttcctgcaa

SEQ ID NO: 2334347 - DNA, 19 bp, Homo sapiens
cacgagcaaacccagaggt

SEQ ID NO: 2334348 - DNA, 20 bp, Homo sapiens
cacgagcaaacccagaggtg

SEQ ID NO: 2334349 - DNA, 17 bp, Homo sapiens
cacgagccacaagctgc

SEQ ID NO: 2334350 - DNA, 20 bp, Homo sapiens
cacgagccacaagctgcact

SEQ ID NO: 2334351 - DNA, 22 bp, Homo sapiens
cacgagccacaagctgcactgt

SEQ ID NO: 2334352 - DNA, 15 bp, Homo sapiens
cacgatgcatttaat

SEQ ID NO: 2334353 - DNA, 17 bp, Homo sapiens
cacgatgcatttaataa

SEQ ID NO: 2334354 - DNA, 16 bp, Homo sapiens
cacgattttcaagatt

SEQ ID NO: 2334355 - DNA, 19 bp, Homo sapiens
cacgattttcaagattcta

SEQ ID NO: 2334356 - DNA, 20 bp, Homo sapiens
cacgcagaggacgcacgctc

SEQ ID NO: 2334357 - DNA, 13 bp, Homo sapiens
cacgccccacact

SEQ ID NO: 2334358 - DNA, 16 bp, Homo sapiens
cacgcccgactagcag

SEQ ID NO: 2334359 - DNA, 20 bp, Homo sapiens
cacgcccttcaatgctgcag

SEQ ID NO: 2334360 - DNA, 17 bp, Homo sapiens
cacgcgtgccgtggcac

SEQ ID NO: 2334361 - DNA, 17 bp, Homo sapiens
cacgctcgctgccatca

SEQ ID NO: 2334362 - DNA, 19 bp, Homo sapiens
cacgctcgctgccatcacc

SEQ ID NO: 2334363 - DNA, 23 bp, Homo sapiens
caaattttttgactttttttgta

SEQ ID NO: 2334364 - DNA, 23 bp, Homo sapiens
caacaaatgtggccaagcctatc

SEQ ID NO: 2334365 - DNA, 16 bp, Homo sapiens
caacaacaattggtaa

SEQ ID NO: 2334366 - DNA, 14 bp, Homo sapiens
caacaactctgcct

SEQ ID NO: 2334367 - DNA, 20 bp, Homo sapiens
caacaactctgcctttatga

SEQ ID NO: 2334368 - DNA, 21 bp, Homo sapiens
caacaagatttccttgtgcaa

SEQ ID NO: 2334369 - DNA, 18 bp, Homo sapiens
caacaattggtaaaactc

SEQ ID NO: 2334370 - DNA, 16 bp, Homo sapiens
caacaatttatgaatt

SEQ ID NO: 2334371 - DNA, 17 bp, Homo sapiens
caacaatttatgaattg

SEQ ID NO: 2334372 - DNA, 13 bp, Homo sapiens
caacacagatccg

SEQ ID NO: 2334373 - DNA, 16 bp, Homo sapiens
caacacccatttttcc

SEQ ID NO: 2334374 - DNA, 21 bp, Homo sapiens
caacacggagcagggagagct

SEQ ID NO: 2334375 - DNA, 23 bp, Homo sapiens
caacagcctttgaatgtaaccaa

SEQ ID NO: 2334376 - DNA, 17 bp, Homo sapiens
caacaggtaaaacaggg

SEQ ID NO: 2334377 - DNA, 14 bp, Homo sapiens
caacagtcacctca

SEQ ID NO: 2334378 - DNA, 17 bp, Homo sapiens
caacatatatttattga

SEQ ID NO: 2334379 - DNA, 20 bp, Homo sapiens
caacatatatttattgagta

SEQ ID NO: 2334380 - DNA, 23 bp, Homo sapiens
caaccacatttagaaatgtttat

SEQ ID NO: 2334381 - DNA, 16 bp, Homo sapiens
caaccactgtgccact

SEQ ID NO: 2334382 - DNA, 23 bp, Homo sapiens
caaccagaaacacccctctgtct

SEQ ID NO: 2334383 - DNA, 19 bp, Homo sapiens
caaccaggcacctcttcct

SEQ ID NO: 2334384 - DNA, 13 bp, Homo sapiens
caaccatcgcttt

SEQ ID NO: 2334385 - DNA, 17 bp, Homo sapiens
caaccattaaagtcaga

SEQ ID NO: 2334386 - DNA, 16 bp, Homo sapiens
caaccctatctcctga

SEQ ID NO: 2334387 - DNA, 14 bp, Homo sapiens
caacctcagggctc

SEQ ID NO: 2334388 - DNA, 15 bp, Homo sapiens
caacctcagggctcc

SEQ ID NO: 2334389 - DNA, 12 bp, Homo sapiens
caacctgcctgt

SEQ ID NO: 2334390 - DNA, 17 bp, Homo sapiens
caacctgcctgtgcatg

SEQ ID NO: 2334391 - DNA, 16 bp, Homo sapiens
caacctgctctgtccc

SEQ ID NO: 2334392 - DNA, 17 bp, Homo sapiens
caacctgctctgtcccc

SEQ ID NO: 2334393 - DNA, 20 bp, Homo sapiens
caacctgttacctactttga

SEQ ID NO: 2334394 - DNA, 12 bp, Homo sapiens
caacctttctgt

SEQ ID NO: 2334395 - DNA, 11 bp, Homo sapiens
caactacctga

SEQ ID NO: 2334396 - DNA, 13 bp, Homo sapiens
caactagctggga

SEQ ID NO: 2334397 - DNA, 13 bp, Homo sapiens
caactccagcaac

SEQ ID NO: 2334398 - DNA, 15 bp, Homo sapiens
caactctccactcca

SEQ ID NO: 2334399 - DNA, 16 bp, Homo sapiens
caactctccactccat

SEQ ID NO: 2334400 - DNA, 23 bp, Homo sapiens
caactctgaagctaattgtacta

SEQ ID NO: 2334401 - DNA, 14 bp, Homo sapiens
caactctgccttta

SEQ ID NO: 2334402 - DNA, 14 bp, Homo sapiens
caactgaaggggtg

SEQ ID NO: 2334403 - DNA, 11 bp, Homo sapiens
caactgctccc

SEQ ID NO: 2334404 - DNA, 15 bp, Homo sapiens
caactgctcccacct

SEQ ID NO: 2334405 - DNA, 17 bp, Homo sapiens
caactgctcccacctcc

SEQ ID NO: 2334406 - DNA, 19 bp, Homo sapiens
caactgctggggagacaaa

SEQ ID NO: 2334407 - DNA, 14 bp, Homo sapiens
caacttagctcagg

SEQ ID NO: 2334408 - DNA, 17 bp, Homo sapiens
caacttagctcaggtgc

SEQ ID NO: 2334409 - DNA, 18 bp, Homo sapiens
caacttagctcaggtgcc

SEQ ID NO: 2334410 - DNA, 16 bp, Homo sapiens
caactttcacttcttc

SEQ ID NO: 2334411 - DNA, 17 bp, Homo sapiens
caactttcacttcttcc

SEQ ID NO: 2334412 - DNA, 13 bp, Homo sapiens
caagaaactgaat

SEQ ID NO: 2334413 - DNA, 18 bp, Homo sapiens
caagaaatggcgtctgct

SEQ ID NO: 2334414 - DNA, 17 bp, Homo sapiens
caagaataatcacgctt

SEQ ID NO: 2334415 - DNA, 18 bp, Homo sapiens
caagaataatcacgcttt

SEQ ID NO: 2334416 - DNA, 21 bp, Homo sapiens
caagaataatcacgctttcct

SEQ ID NO: 2334417 - DNA, 14 bp, Homo sapiens
caagacatgtctgt

SEQ ID NO: 2334418 - DNA, 20 bp, Homo sapiens
caagacccccatttgtccca

SEQ ID NO: 2334419 - DNA, 22 bp, Homo sapiens
caagacccccatttgtcccaga

SEQ ID NO: 2334420 - DNA, 23 bp, Homo sapiens
caagagaactcgcgctcagtaaa

SEQ ID NO: 2334421 - DNA, 13 bp, Homo sapiens
caagagagatgtt

SEQ ID NO: 2334422 - DNA, 16 bp, Homo sapiens
caagagataagtcttt

SEQ ID NO: 2334423 - DNA, 14 bp, Homo sapiens
caagaggagccccc

SEQ ID NO: 2334424 - DNA, 21 bp, Homo sapiens
caagaggagcccccaccctgt

SEQ ID NO: 2334425 - DNA, 14 bp, Homo sapiens
caagagggggtgga

SEQ ID NO: 2334426 - DNA, 21 bp, Homo sapiens
caagagggggtggaggggtgt

SEQ ID NO: 2334427 - DNA, 20 bp, Homo sapiens
caagatggacacgagccaca

SEQ ID NO: 2334428 - DNA, 23 bp, Homo sapiens
caagatgtgaattattgacactg

SEQ ID NO: 2334429 - DNA, 14 bp, Homo sapiens
caagattctaaagc

SEQ ID NO: 2334430 - DNA, 18 bp, Homo sapiens
caagattctaaagctcaa

SEQ ID NO: 2334431 - DNA, 16 bp, Homo sapiens
caagatttccttgtgc

SEQ ID NO: 2334432 - DNA, 19 bp, Homo sapiens
caagattttcctcttgtga

SEQ ID NO: 2334433 - DNA, 22 bp, Homo sapiens
caagcaacagcctttgaatgta

SEQ ID NO: 2334434 - DNA, 19 bp, Homo sapiens
caagcaatccacctgcctt

SEQ ID NO: 2334435 - DNA, 15 bp, Homo sapiens
caagcaatcctcctg

SEQ ID NO: 2334436 - DNA, 16 bp, Homo sapiens
caagcaatcctcctgc

SEQ ID NO: 2334437 - DNA, 18 bp, Homo sapiens
caagcaatcctcctgcct

SEQ ID NO: 2334438 - DNA, 21 bp, Homo sapiens
caagcaatcctcctgcctcag

SEQ ID NO: 2334439 - DNA, 18 bp, Homo sapiens
caagcacagagcctggcc

SEQ ID NO: 2334440 - DNA, 21 bp, Homo sapiens
caagcacagagcctggcccca

SEQ ID NO: 2334441 - DNA, 22 bp, Homo sapiens
caagcagctggtcagtctttgc

SEQ ID NO: 2334442 - DNA, 19 bp, Homo sapiens
caagcatttcatgaaaaag

SEQ ID NO: 2334443 - DNA, 20 bp, Homo sapiens
caagcatttcatgaaaaagc

SEQ ID NO: 2334444 - DNA, 16 bp, Homo sapiens
caagccacaggaagga

SEQ ID NO: 2334445 - DNA, 14 bp, Homo sapiens
caagcctccacagc

SEQ ID NO: 2334446 - DNA, 14 bp, Homo sapiens
caagctgaaatttt

SEQ ID NO: 2334447 - DNA, 21 bp, Homo sapiens
caagctgaaattttagaaata

SEQ ID NO: 2334448 - DNA, 16 bp, Homo sapiens
caagctgctctgagcc

SEQ ID NO: 2334449 - DNA, 22 bp, Homo sapiens
caagctgctctgagccacagtg

SEQ ID NO: 2334450 - DNA, 14 bp, Homo sapiens
caagcttcttgctg

SEQ ID NO: 2334451 - DNA, 14 bp, Homo sapiens
caagctttaaatta

SEQ ID NO: 2334452 - DNA, 15 bp, Homo sapiens
caaggaaacatttta

SEQ ID NO: 2334453 - DNA, 12 bp, Homo sapiens
caaggactgagc

SEQ ID NO: 2334454 - DNA, 13 bp, Homo sapiens
caaggagatttct

SEQ ID NO: 2334455 - DNA, 14 bp, Homo sapiens
caaggagatttctt

SEQ ID NO: 2334456 - DNA, 18 bp, Homo sapiens
caaggataccttcttatt

SEQ ID NO: 2334457 - DNA, 13 bp, Homo sapiens
caaggctgccaga

SEQ ID NO: 2334458 - DNA, 13 bp, Homo sapiens
caaggctggcagg

SEQ ID NO: 2334459 - DNA, 14 bp, Homo sapiens
caagggaaaggggt

SEQ ID NO: 2334460 - DNA, 20 bp, Homo sapiens
caagggaaaggggtgctttt

SEQ ID NO: 2334461 - DNA, 18 bp, Homo sapiens
caagggtatgggaagcca

SEQ ID NO: 2334462 - DNA, 19 bp, Homo sapiens
caagggtatgggaagccat

SEQ ID NO: 2334463 - DNA, 13 bp, Homo sapiens
atttcccatctgc

SEQ ID NO: 2334464 - DNA, 22 bp, Homo sapiens
atttcccatttgtgccagagga

SEQ ID NO: 2334465 - DNA, 14 bp, Homo sapiens
atttcccttccaaa

SEQ ID NO: 2334466 - DNA, 19 bp, Homo sapiens
atttcctccctctgcccct

SEQ ID NO: 2334467 - DNA, 11 bp, Homo sapiens
atttcctcctt

SEQ ID NO: 2334468 - DNA, 17 bp, Homo sapiens
atttcctcgcagcctct

SEQ ID NO: 2334469 - DNA, 19 bp, Homo sapiens
atttccttcaatgtgcata

SEQ ID NO: 2334470 - DNA, 14 bp, Homo sapiens
atttcggctatgtc

SEQ ID NO: 2334471 - DNA, 18 bp, Homo sapiens
atttctaacagtccttgc

SEQ ID NO: 2334472 - DNA, 15 bp, Homo sapiens
atttctataaaaata

SEQ ID NO: 2334473 - DNA, 15 bp, Homo sapiens
atttctatgacaaat

SEQ ID NO: 2334474 - DNA, 17 bp, Homo sapiens
atttctatgacaaattc

SEQ ID NO: 2334475 - DNA, 22 bp, Homo sapiens
atttctcattgacttttataaa

SEQ ID NO: 2334476 - DNA, 17 bp, Homo sapiens
atttctcctcccttcct

SEQ ID NO: 2334477 - DNA, 20 bp, Homo sapiens
atttctgaaggtagcattct

SEQ ID NO: 2334478 - DNA, 21 bp, Homo sapiens
atttctgaggtgcactgggag

SEQ ID NO: 2334479 - DNA, 15 bp, Homo sapiens
atttctgcctcgctc

SEQ ID NO: 2334480 - DNA, 18 bp, Homo sapiens
atttcttagttcatatat

SEQ ID NO: 2334481 - DNA, 13 bp, Homo sapiens
atttcttatgtga

SEQ ID NO: 2334482 - DNA, 16 bp, Homo sapiens
atttcttatgtgacat

SEQ ID NO: 2334483 - DNA, 21 bp, Homo sapiens
atttcttatgtgacattaaca

SEQ ID NO: 2334484 - DNA, 18 bp, Homo sapiens
atttctttaaaagaatga

SEQ ID NO: 2334485 - DNA, 22 bp, Homo sapiens
atttcttttgtaataaactatt

SEQ ID NO: 2334486 - DNA, 14 bp, Homo sapiens
atttgaaaaatata

SEQ ID NO: 2334487 - DNA, 20 bp, Homo sapiens
atttgaaaaatataaaatta

SEQ ID NO: 2334488 - DNA, 17 bp, Homo sapiens
atttgaagatttaatta

SEQ ID NO: 2334489 - DNA, 18 bp, Homo sapiens
atttgaattatcagcaaa

SEQ ID NO: 2334490 - DNA, 16 bp, Homo sapiens
atttgagaatacataa

SEQ ID NO: 2334491 - DNA, 18 bp, Homo sapiens
atttgagagaaatatgaa

SEQ ID NO: 2334492 - DNA, 22 bp, Homo sapiens
atttgattaataaaatatctat

SEQ ID NO: 2334493 - DNA, 16 bp, Homo sapiens
atttgattatttaaga

SEQ ID NO: 2334494 - DNA, 19 bp, Homo sapiens
atttgattatttaagacta

SEQ ID NO: 2334495 - DNA, 14 bp, Homo sapiens
atttgatttctaat

SEQ ID NO: 2334496 - DNA, 15 bp, Homo sapiens
atttgatttctaatt

SEQ ID NO: 2334497 - DNA, 19 bp, Homo sapiens
atttgcaataacagctgca

SEQ ID NO: 2334498 - DNA, 20 bp, Homo sapiens
atttgcaataacagctgcaa

SEQ ID NO: 2334499 - DNA, 18 bp, Homo sapiens
atttgcaggattcccttc

SEQ ID NO: 2334500 - DNA, 19 bp, Homo sapiens
atttgccatgggcttcact

SEQ ID NO: 2334501 - DNA, 24 bp, Homo sapiens
atttgccatgggcttcactgtata

SEQ ID NO: 2334502 - DNA, 20 bp, Homo sapiens
atttgcctaattcctggcat

SEQ ID NO: 2334503 - DNA, 15 bp, Homo sapiens
atttgctcataagta

SEQ ID NO: 2334504 - DNA, 22 bp, Homo sapiens
atttgctgacaaccattaaagt

SEQ ID NO: 2334505 - DNA, 13 bp, Homo sapiens
atttgctgccatt

SEQ ID NO: 2334506 - DNA, 20 bp, Homo sapiens
atttggaagagaggcacctg

SEQ ID NO: 2334507 - DNA, 23 bp, Homo sapiens
atttggaggctggagtaatcaga

SEQ ID NO: 2334508 - DNA, 17 bp, Homo sapiens
atttgtaaaacagtggt

SEQ ID NO: 2334509 - DNA, 18 bp, Homo sapiens
atttgtaagtttcaggtg

SEQ ID NO: 2334510 - DNA, 21 bp, Homo sapiens
atttgtaagtttcaggtgaca

SEQ ID NO: 2334511 - DNA, 21 bp, Homo sapiens
atttgtcaagaggataaattt

SEQ ID NO: 2334512 - DNA, 11 bp, Homo sapiens
atttgtcccag

SEQ ID NO: 2334513 - DNA, 19 bp, Homo sapiens
atttgtcttaaaaatttat

SEQ ID NO: 2334514 - DNA, 15 bp, Homo sapiens
atttgtgtaactgaa

SEQ ID NO: 2334515 - DNA, 20 bp, Homo sapiens
atttgttgttctttcagaaa

SEQ ID NO: 2334516 - DNA, 12 bp, Homo sapiens
attttaaaaaag

SEQ ID NO: 2334517 - DNA, 13 bp, Homo sapiens
attttaaaaaagg

SEQ ID NO: 2334518 - DNA, 17 bp, Homo sapiens
attttaaaaaatggtca

SEQ ID NO: 2334519 - DNA, 15 bp, Homo sapiens
attttaaaatttcat

SEQ ID NO: 2334520 - DNA, 15 bp, Homo sapiens
attttaaagacccct

SEQ ID NO: 2334521 - DNA, 16 bp, Homo sapiens
attttaactaaatttt

SEQ ID NO: 2334522 - DNA, 18 bp, Homo sapiens
attttaagaagacatact

SEQ ID NO: 2334523 - DNA, 20 bp, Homo sapiens
attttaagtttgtagtaaaa

SEQ ID NO: 2334524 - DNA, 13 bp, Homo sapiens
attttaatacaag

SEQ ID NO: 2334525 - DNA, 13 bp, Homo sapiens
attttaatagctt

SEQ ID NO: 2334526 - DNA, 18 bp, Homo sapiens
attttaatgctgtttcta

SEQ ID NO: 2334527 - DNA, 19 bp, Homo sapiens
attttaatgctgtttctaa

SEQ ID NO: 2334528 - DNA, 23 bp, Homo sapiens
attttaatgctgtttctaagaaa

SEQ ID NO: 2334529 - DNA, 22 bp, Homo sapiens
attttacaagggcataaagtaa

SEQ ID NO: 2334530 - DNA, 12 bp, Homo sapiens
attttacagtaa

SEQ ID NO: 2334531 - DNA, 17 bp, Homo sapiens
attttacagtaaatgtt

SEQ ID NO: 2334532 - DNA, 18 bp, Homo sapiens
attttacagtaaatgtta

SEQ ID NO: 2334533 - DNA, 16 bp, Homo sapiens
attttatatgcttact

SEQ ID NO: 2334534 - DNA, 18 bp, Homo sapiens
attttatatgcttactga

SEQ ID NO: 2334535 - DNA, 23 bp, Homo sapiens
attttatatgcttactgatatat

SEQ ID NO: 2334536 - DNA, 22 bp, Homo sapiens
attttatattactgacatttct

SEQ ID NO: 2334537 - DNA, 19 bp, Homo sapiens
attttatcattaaaaatta

SEQ ID NO: 2334538 - DNA, 20 bp, Homo sapiens
attttatcattaaaaattac

SEQ ID NO: 2334539 - DNA, 13 bp, Homo sapiens
attttatgtttaa

SEQ ID NO: 2334540 - DNA, 22 bp, Homo sapiens
attttattaagctttttggaat

SEQ ID NO: 2334541 - DNA, 19 bp, Homo sapiens
attttatttagacaagaga

SEQ ID NO: 2334542 - DNA, 20 bp, Homo sapiens
attttcaactgtcttcctca

SEQ ID NO: 2334543 - DNA, 20 bp, Homo sapiens
attttcaagcagcatcttct

SEQ ID NO: 2334544 - DNA, 21 bp, Homo sapiens
attttcaagcagcatcttctg

SEQ ID NO: 2334545 - DNA, 21 bp, Homo sapiens
attttcacactggtaaatgtt

SEQ ID NO: 2334546 - DNA, 18 bp, Homo sapiens
attttcagcaaactcttt

SEQ ID NO: 2334547 - DNA, 19 bp, Homo sapiens
attttcagcaaactctttt

SEQ ID NO: 2334548 - DNA, 14 bp, Homo sapiens
attttcctcctctg

SEQ ID NO: 2334549 - DNA, 15 bp, Homo sapiens
attttcctcctctgc

SEQ ID NO: 2334550 - DNA, 13 bp, Homo sapiens
attttcctctggc

SEQ ID NO: 2334551 - DNA, 22 bp, Homo sapiens
attttcctggtgccaatttcaa

SEQ ID NO: 2334552 - DNA, 19 bp, Homo sapiens
attttctaaaagctttcat

SEQ ID NO: 2334553 - DNA, 12 bp, Homo sapiens
attttctaaata

SEQ ID NO: 2334554 - DNA, 13 bp, Homo sapiens
attttctccttgg

SEQ ID NO: 2334555 - DNA, 20 bp, Homo sapiens
attttctgtgcctgaatatt

SEQ ID NO: 2334556 - DNA, 15 bp, Homo sapiens
attttgagtattcca

SEQ ID NO: 2334557 - DNA, 17 bp, Homo sapiens
attttgtaagaaggcaa

SEQ ID NO: 2334558 - DNA, 21 bp, Homo sapiens
attttgtaagaaggcaatatt

SEQ ID NO: 2334559 - DNA, 21 bp, Homo sapiens
attttgtaccaagtaaatcca

SEQ ID NO: 2334560 - DNA, 17 bp, Homo sapiens
attttgtagttaatata

SEQ ID NO: 2334561 - DNA, 20 bp, Homo sapiens
attttgtctaggagatgctt

SEQ ID NO: 2334562 - DNA, 13 bp, Homo sapiens
atttttaaagaat

SEQ ID NO: 2334563 - DNA, 17 bp, Homo sapiens
atttttatacaaaccta

SEQ ID NO: 2334564 - DNA, 20 bp, Homo sapiens
atttttatacaaacctacca

SEQ ID NO: 2334565 - DNA, 21 bp, Homo sapiens
atttttatagcaacaacaatt

SEQ ID NO: 2334566 - DNA, 13 bp, Homo sapiens
atttttatatcat

SEQ ID NO: 2334567 - DNA, 16 bp, Homo sapiens
atttttatatttcctt

SEQ ID NO: 2334568 - DNA, 21 bp, Homo sapiens
tgatcagacatacagctgcct

SEQ ID NO: 2334569 - DNA, 13 bp, Homo sapiens
tgatccaactaat

SEQ ID NO: 2334570 - DNA, 21 bp, Homo sapiens
tgatccacccaaccctatctc

SEQ ID NO: 2334571 - DNA, 23 bp, Homo sapiens
tgatccactttgggggaggagaa

SEQ ID NO: 2334572 - DNA, 17 bp, Homo sapiens
tgatccagaagagccca

SEQ ID NO: 2334573 - DNA, 20 bp, Homo sapiens
tgatctgggcattttcctcc

SEQ ID NO: 2334574 - DNA, 20 bp, Homo sapiens
tgatctgttgtaatatcagt

SEQ ID NO: 2334575 - DNA, 19 bp, Homo sapiens
tgatgaagttgtacaacac

SEQ ID NO: 2334576 - DNA, 20 bp, Homo sapiens
tgatgaatcactgttgcttt

SEQ ID NO: 2334577 - DNA, 14 bp, Homo sapiens
tgatgactgccttg

SEQ ID NO: 2334578 - DNA, 20 bp, Homo sapiens
tgatgactgccttgcctcct

SEQ ID NO: 2334579 - DNA, 14 bp, Homo sapiens
tgatgacttgctgt

SEQ ID NO: 2334580 - DNA, 18 bp, Homo sapiens
tgatgacttgctgtccag

SEQ ID NO: 2334581 - DNA, 22 bp, Homo sapiens
tgatgattgaactggaataata

SEQ ID NO: 2334582 - DNA, 14 bp, Homo sapiens
tgatggaaccttaa

SEQ ID NO: 2334583 - DNA, 21 bp, Homo sapiens
tgatggagggtggaaataatt

SEQ ID NO: 2334584 - DNA, 16 bp, Homo sapiens
tgatggccttaatttc

SEQ ID NO: 2334585 - DNA, 20 bp, Homo sapiens
tgatggtgtggcctgtggct

SEQ ID NO: 2334586 - DNA, 16 bp, Homo sapiens
tgatgtcagccttgca

SEQ ID NO: 2334587 - DNA, 17 bp, Homo sapiens
tgatgtcagccttgcat

SEQ ID NO: 2334588 - DNA, 20 bp, Homo sapiens
tgatgtgaagagtttcacaa

SEQ ID NO: 2334589 - DNA, 15 bp, Homo sapiens
tgatgtggaggaaga

SEQ ID NO: 2334590 - DNA, 16 bp, Homo sapiens
tgatgtggaggaagag

SEQ ID NO: 2334591 - DNA, 19 bp, Homo sapiens
tgatgtggccctggctgcc

SEQ ID NO: 2334592 - DNA, 20 bp, Homo sapiens
tgatgttaacccattccagt

SEQ ID NO: 2334593 - DNA, 19 bp, Homo sapiens
tgattaaattatcattgtt

SEQ ID NO: 2334594 - DNA, 21 bp, Homo sapiens
tgattaaattatcattgtttg

SEQ ID NO: 2334595 - DNA, 22 bp, Homo sapiens
tgattaagggacatttctataa

SEQ ID NO: 2334596 - DNA, 14 bp, Homo sapiens
tgattacctgaaag

SEQ ID NO: 2334597 - DNA, 13 bp, Homo sapiens
tgattatcttcag

SEQ ID NO: 2334598 - DNA, 19 bp, Homo sapiens
tgattatcttcagcccagg

SEQ ID NO: 2334599 - DNA, 16 bp, Homo sapiens
tgattatgtaagcatt

SEQ ID NO: 2334600 - DNA, 23 bp, Homo sapiens
tgattcaatctgtaaactgtgta

SEQ ID NO: 2334601 - DNA, 20 bp, Homo sapiens
tgattccactacacctggct

SEQ ID NO: 2334602 - DNA, 23 bp, Homo sapiens
tgattccactacacctggctgag

SEQ ID NO: 2334603 - DNA, 15 bp, Homo sapiens
tgattcctggctcta

SEQ ID NO: 2334604 - DNA, 20 bp, Homo sapiens
tgattcctggctctaccctg

SEQ ID NO: 2334605 - DNA, 13 bp, Homo sapiens
tgattctgccttt

SEQ ID NO: 2334606 - DNA, 14 bp, Homo sapiens
tgattctgtttcct

SEQ ID NO: 2334607 - DNA, 15 bp, Homo sapiens
tgattcttgattcct

SEQ ID NO: 2334608 - DNA, 16 bp, Homo sapiens
tgattcttgattcctg

SEQ ID NO: 2334609 - DNA, 19 bp, Homo sapiens
tgattcttgattcctggct

SEQ ID NO: 2334610 - DNA, 15 bp, Homo sapiens
tgattgggaaaacat

SEQ ID NO: 2334611 - DNA, 16 bp, Homo sapiens
tgattgggtgggattt

SEQ ID NO: 2334612 - DNA, 14 bp, Homo sapiens
tgatttaataaaat

SEQ ID NO: 2334613 - DNA, 17 bp, Homo sapiens
tgatttaataaaataat

SEQ ID NO: 2334614 - DNA, 23 bp, Homo sapiens
tgatttaataaaataattctaaa

SEQ ID NO: 2334615 - DNA, 21 bp, Homo sapiens
tgatttactaacagtaactgc

SEQ ID NO: 2334616 - DNA, 21 bp, Homo sapiens
tgatttcaaagttttgttgta

SEQ ID NO: 2334617 - DNA, 20 bp, Homo sapiens
tgatttcagttctaggaaaa

SEQ ID NO: 2334618 - DNA, 16 bp, Homo sapiens
tgatttccttcaatgt

SEQ ID NO: 2334619 - DNA, 22 bp, Homo sapiens
tgatttctaattgtaagtgaaa

SEQ ID NO: 2334620 - DNA, 21 bp, Homo sapiens
tgatttctttaaaagaatgac

SEQ ID NO: 2334621 - DNA, 17 bp, Homo sapiens
tgatttgtaacccactg

SEQ ID NO: 2334622 - DNA, 16 bp, Homo sapiens
tgattttcatttcatg

SEQ ID NO: 2334623 - DNA, 17 bp, Homo sapiens
tgattttcatttcatga

SEQ ID NO: 2334624 - DNA, 16 bp, Homo sapiens
tgattttttttccttt

SEQ ID NO: 2334625 - DNA, 21 bp, Homo sapiens
tgcaaaaaattctttagagat

SEQ ID NO: 2334626 - DNA, 17 bp, Homo sapiens
tgcaaaaataatcatga

SEQ ID NO: 2334627 - DNA, 23 bp, Homo sapiens
tgcaaactgggaacccctttccc

SEQ ID NO: 2334628 - DNA, 17 bp, Homo sapiens
tgcaaagagacatttca

SEQ ID NO: 2334629 - DNA, 18 bp, Homo sapiens
tgcaaagagacatttcaa

SEQ ID NO: 2334630 - DNA, 19 bp, Homo sapiens
tgcaaagagacatttcaaa

SEQ ID NO: 2334631 - DNA, 12 bp, Homo sapiens
tgcaaagctttg

SEQ ID NO: 2334632 - DNA, 14 bp, Homo sapiens
tgcaaatctgatgg

SEQ ID NO: 2334633 - DNA, 20 bp, Homo sapiens
tgcaaatgggagctgagcag

SEQ ID NO: 2334634 - DNA, 13 bp, Homo sapiens
tgcaacctcacct

SEQ ID NO: 2334635 - DNA, 13 bp, Homo sapiens
tgcaagatgtgaa

SEQ ID NO: 2334636 - DNA, 15 bp, Homo sapiens
tgcaagcttcttgct

SEQ ID NO: 2334637 - DNA, 14 bp, Homo sapiens
tgcaaggtggcctt

SEQ ID NO: 2334638 - DNA, 15 bp, Homo sapiens
tgcaaggtggccttt

SEQ ID NO: 2334639 - DNA, 23 bp, Homo sapiens
tgcaaggtggcctttgtgctgcg

SEQ ID NO: 2334640 - DNA, 23 bp, Homo sapiens
tgcaagtgctggagtctcctgag

SEQ ID NO: 2334641 - DNA, 16 bp, Homo sapiens
tgcaataaagtataat

SEQ ID NO: 2334642 - DNA, 14 bp, Homo sapiens
tgcaataacagctg

SEQ ID NO: 2334643 - DNA, 15 bp, Homo sapiens
tgcaataacagctgc

SEQ ID NO: 2334644 - DNA, 17 bp, Homo sapiens
tgcaataacagctgcaa

SEQ ID NO: 2334645 - DNA, 12 bp, Homo sapiens
tgcaataatttt

SEQ ID NO: 2334646 - DNA, 13 bp, Homo sapiens
tgcaatacttaga

SEQ ID NO: 2334647 - DNA, 19 bp, Homo sapiens
tgcaattaaacttccaaag

SEQ ID NO: 2334648 - DNA, 16 bp, Homo sapiens
tgcacacaggacagcg

SEQ ID NO: 2334649 - DNA, 19 bp, Homo sapiens
tgcacaccccactcccaca

SEQ ID NO: 2334650 - DNA, 14 bp, Homo sapiens
tgcacagaagcaca

SEQ ID NO: 2334651 - DNA, 21 bp, Homo sapiens
tgcacataagcttccatttta

SEQ ID NO: 2334652 - DNA, 17 bp, Homo sapiens
tgcacatatggactctg

SEQ ID NO: 2334653 - DNA, 19 bp, Homo sapiens
tgcacatgtcttgtacatg

SEQ ID NO: 2334654 - DNA, 16 bp, Homo sapiens
tgcacccacctgtttt

SEQ ID NO: 2334655 - DNA, 16 bp, Homo sapiens
tgcacccctgggccag

SEQ ID NO: 2334656 - DNA, 19 bp, Homo sapiens
tgcacctaccccttggaaa

SEQ ID NO: 2334657 - DNA, 19 bp, Homo sapiens
tgcacctgagaccctactg

SEQ ID NO: 2334658 - DNA, 15 bp, Homo sapiens
tgcaccttgtgtctg

SEQ ID NO: 2334659 - DNA, 16 bp, Homo sapiens
tgcaccttgtgtctgt

SEQ ID NO: 2334660 - DNA, 15 bp, Homo sapiens
tgcacgtcatgggag

SEQ ID NO: 2334661 - DNA, 18 bp, Homo sapiens
tgcactaaatcagagaca

SEQ ID NO: 2334662 - DNA, 19 bp, Homo sapiens
tgcactagcattttcttga

SEQ ID NO: 2334663 - DNA, 16 bp, Homo sapiens
tgcactccagcctggg

SEQ ID NO: 2334664 - DNA, 23 bp, Homo sapiens
tgcacttattgaccattttttaa

SEQ ID NO: 2334665 - DNA, 17 bp, Homo sapiens
tgcagaaatagacaaaa

SEQ ID NO: 2334666 - DNA, 19 bp, Homo sapiens
tgcagaaatagacaaaaag

SEQ ID NO: 2334667 - DNA, 21 bp, Homo sapiens
tgcagaaatagacaaaaagta

SEQ ID NO: 2334668 - DNA, 15 bp, Homo sapiens
tgcagacctcaagcc

SEQ ID NO: 2334669 - DNA, 21 bp, Homo sapiens
tgcagagagccattttgtgaa

SEQ ID NO: 2334670 - DNA, 22 bp, Homo sapiens
tgcagagagccattttgtgaat

SEQ ID NO: 2334671 - DNA, 16 bp, Homo sapiens
tgcagagccttctcag

SEQ ID NO: 2334672 - DNA, 14 bp, Homo sapiens
tgcagagctatggt

SEQ ID NO: 2334673 - DNA, 19 bp, Homo sapiens
tgcagagctatggtgaggt

SEQ ID NO: 2334674 - DNA, 16 bp, Homo sapiens
tgcagatgtgagccac

SEQ ID NO: 2334675 - DNA, 22 bp, Homo sapiens
tgcagcctcatactcctgggct

SEQ ID NO: 2334676 - DNA, 23 bp, Homo sapiens
tgcagcctcatactcctgggctc

SEQ ID NO: 2334677 - DNA, 20 bp, Homo sapiens
tgcagcttcaacttttctct

SEQ ID NO: 2334678 - DNA, 17 bp, Homo sapiens
tgcaggagagagcagca

SEQ ID NO: 2334679 - DNA, 16 bp, Homo sapiens
tgcaggaggtggagaa

SEQ ID NO: 2334680 - DNA, 15 bp, Homo sapiens
tgcaggattcccttc

SEQ ID NO: 2334681 - DNA, 18 bp, Homo sapiens
tgcaggattcccttctgg

SEQ ID NO: 2334682 - DNA, 19 bp, Homo sapiens
tgctgacaacttagctcag

SEQ ID NO: 2334683 - DNA, 23 bp, Homo sapiens
tgctgacctgctgacctgtgcac

SEQ ID NO: 2334684 - DNA, 14 bp, Homo sapiens
tgctgacctgtgca

SEQ ID NO: 2334685 - DNA, 17 bp, Homo sapiens
tgctgactgtagctttg

SEQ ID NO: 2334686 - DNA, 21 bp, Homo sapiens
tgctgagatgaggaggggagc

SEQ ID NO: 2334687 - DNA, 17 bp, Homo sapiens
tgctgagggtttgaata

SEQ ID NO: 2334688 - DNA, 17 bp, Homo sapiens
tgctgagtcatctgtta

SEQ ID NO: 2334689 - DNA, 20 bp, Homo sapiens
tgctgatcagagttcctcct

SEQ ID NO: 2334690 - DNA, 17 bp, Homo sapiens
tgctgatccccaacctg

SEQ ID NO: 2334691 - DNA, 15 bp, Homo sapiens
tgctgatcttttaaa

SEQ ID NO: 2334692 - DNA, 15 bp, Homo sapiens
tgctgatggagcctt

SEQ ID NO: 2334693 - DNA, 17 bp, Homo sapiens
tgctgatggagccttcc

SEQ ID NO: 2334694 - DNA, 14 bp, Homo sapiens
tgctgattttcttc

SEQ ID NO: 2334695 - DNA, 13 bp, Homo sapiens
tgctgcaaacctg

SEQ ID NO: 2334696 - DNA, 19 bp, Homo sapiens
tgctgcctctttccctagg

SEQ ID NO: 2334697 - DNA, 20 bp, Homo sapiens
tgctgcctgctgagatgagg

SEQ ID NO: 2334698 - DNA, 16 bp, Homo sapiens
tgctgcgcctgcaggc

SEQ ID NO: 2334699 - DNA, 19 bp, Homo sapiens
tgctgcgcctgcaggcaga

SEQ ID NO: 2334700 - DNA, 22 bp, Homo sapiens
tgctgcgcctgcaggcagagct

SEQ ID NO: 2334701 - DNA, 20 bp, Homo sapiens
tgctgcgtcagaccagtact

SEQ ID NO: 2334702 - DNA, 11 bp, Homo sapiens
tgctgctggcc

SEQ ID NO: 2334703 - DNA, 12 bp, Homo sapiens
tgctgctggcca

SEQ ID NO: 2334704 - DNA, 19 bp, Homo sapiens
tgctgctgtccagtgccta

SEQ ID NO: 2334705 - DNA, 14 bp, Homo sapiens
tgctggaagcccag

SEQ ID NO: 2334706 - DNA, 16 bp, Homo sapiens
tgctggaggcctcagg

SEQ ID NO: 2334707 - DNA, 20 bp, Homo sapiens
tgctggaggcctcaggtgct

SEQ ID NO: 2334708 - DNA, 18 bp, Homo sapiens
tgctggagtctcctgagg

SEQ ID NO: 2334709 - DNA, 19 bp, Homo sapiens
tgctggccaaatagcaaag

SEQ ID NO: 2334710 - DNA, 20 bp, Homo sapiens
tgctggccaaatagcaaaga

SEQ ID NO: 2334711 - DNA, 17 bp, Homo sapiens
tgctggcggcgcagagg

SEQ ID NO: 2334712 - DNA, 18 bp, Homo sapiens
tgctgggaggagggagag

SEQ ID NO: 2334713 - DNA, 13 bp, Homo sapiens
tgctgggcaatga

SEQ ID NO: 2334714 - DNA, 16 bp, Homo sapiens
tgctgggcggctgtgc

SEQ ID NO: 2334715 - DNA, 18 bp, Homo sapiens
tgctgggcggctgtgctt

SEQ ID NO: 2334716 - DNA, 13 bp, Homo sapiens
tgctggggaaggg

SEQ ID NO: 2334717 - DNA, 16 bp, Homo sapiens
tgctggtatttctaat

SEQ ID NO: 2334718 - DNA, 19 bp, Homo sapiens
tgctggtggttaaggccag

SEQ ID NO: 2334719 - DNA, 13 bp, Homo sapiens
tgctgtccaggca

SEQ ID NO: 2334720 - DNA, 14 bp, Homo sapiens
tgctgtccaggcag

SEQ ID NO: 2334721 - DNA, 16 bp, Homo sapiens
tgctgtccaggcagct

SEQ ID NO: 2334722 - DNA, 21 bp, Homo sapiens
tgctgtgaaccctggggcctg

SEQ ID NO: 2334723 - DNA, 16 bp, Homo sapiens
tgctgtgaactttcat

SEQ ID NO: 2334724 - DNA, 17 bp, Homo sapiens
tgctgtgagggagggga

SEQ ID NO: 2334725 - DNA, 18 bp, Homo sapiens
tgctgtgagggaggggaa

SEQ ID NO: 2334726 - DNA, 17 bp, Homo sapiens
tgctgtgtgaccctggg

SEQ ID NO: 2334727 - DNA, 19 bp, Homo sapiens
tgctgtgtgaccctgggca

SEQ ID NO: 2334728 - DNA, 24 bp, Homo sapiens
tgctgttctcaggacagcatccct

SEQ ID NO: 2334729 - DNA, 12 bp, Homo sapiens
tgctgttgctta

SEQ ID NO: 2334730 - DNA, 13 bp, Homo sapiens
tgctgtttctaag

SEQ ID NO: 2334731 - DNA, 16 bp, Homo sapiens
tgctgtttctaagaaa

SEQ ID NO: 2334732 - DNA, 17 bp, Homo sapiens
tgcttaaaaatcattga

SEQ ID NO: 2334733 - DNA, 19 bp, Homo sapiens
tgcttaaaaatcattgatt

SEQ ID NO: 2334734 - DNA, 14 bp, Homo sapiens
tgcttaaaccactt

SEQ ID NO: 2334735 - DNA, 17 bp, Homo sapiens
tgcttaataaaagaaca

SEQ ID NO: 2334736 - DNA, 16 bp, Homo sapiens
tgcttaatcttcaaag

SEQ ID NO: 2334737 - DNA, 22 bp, Homo sapiens
tgcttacctctcagccttagct

SEQ ID NO: 2334738 - DNA, 18 bp, Homo sapiens
tgcttactaatgtgcccc

SEQ ID NO: 2334739 - DNA, 22 bp, Homo sapiens
tgcttactgatatattttacaa

SEQ ID NO: 2334740 - DNA, 23 bp, Homo sapiens
tgcttataacctagttaaagaaa

SEQ ID NO: 2334741 - DNA, 13 bp, Homo sapiens
tgcttcacagtag

SEQ ID NO: 2334742 - DNA, 20 bp, Homo sapiens
tgcttcatttgtatgtcaaa

SEQ ID NO: 2334743 - DNA, 11 bp, Homo sapiens
tgcttcctgat

SEQ ID NO: 2334744 - DNA, 16 bp, Homo sapiens
tgcttcctttctctcc

SEQ ID NO: 2334745 - DNA, 20 bp, Homo sapiens
tgcttcctttctctcctggc

SEQ ID NO: 2334746 - DNA, 21 bp, Homo sapiens
tgcttcctttctctcctggct

SEQ ID NO: 2334747 - DNA, 18 bp, Homo sapiens
tgcttctcatcccaacct

SEQ ID NO: 2334748 - DNA, 17 bp, Homo sapiens
tgcttctgtatttcctt

SEQ ID NO: 2334749 - DNA, 19 bp, Homo sapiens
tgcttgaaggccctgctga

SEQ ID NO: 2334750 - DNA, 18 bp, Homo sapiens
tgcttgaccctgaaatat

SEQ ID NO: 2334751 - DNA, 15 bp, Homo sapiens
tgcttgataatatat

SEQ ID NO: 2334752 - DNA, 17 bp, Homo sapiens
tgcttgataatatataa

SEQ ID NO: 2334753 - DNA, 13 bp, Homo sapiens
tgcttgatccaga

SEQ ID NO: 2334754 - DNA, 14 bp, Homo sapiens
tgcttgccaaagta

SEQ ID NO: 2334755 - DNA, 15 bp, Homo sapiens
tgcttgccaaagtac

SEQ ID NO: 2334756 - DNA, 23 bp, Homo sapiens
tgcttgggaatgaaattaacaca

SEQ ID NO: 2334757 - DNA, 15 bp, Homo sapiens
tgcttgtcttctggt

SEQ ID NO: 2334758 - DNA, 18 bp, Homo sapiens
tgctttattaatgttttc

SEQ ID NO: 2334759 - DNA, 21 bp, Homo sapiens
tgctttattaatgttttcaaa

SEQ ID NO: 2334760 - DNA, 18 bp, Homo sapiens
tgctttgcattactgtcc

SEQ ID NO: 2334761 - DNA, 19 bp, Homo sapiens
tgcttttagtgtgtgcata

SEQ ID NO: 2334762 - DNA, 12 bp, Homo sapiens
tgctttttagaa

SEQ ID NO: 2334763 - DNA, 14 bp, Homo sapiens
tgctttttggaaag

SEQ ID NO: 2334764 - DNA, 15 bp, Homo sapiens
tggaaaaaactctga

SEQ ID NO: 2334765 - DNA, 18 bp, Homo sapiens
tggaaaagcaacttcatt

SEQ ID NO: 2334766 - DNA, 21 bp, Homo sapiens
tggaaaagcaacttcatttga

SEQ ID NO: 2334767 - DNA, 20 bp, Homo sapiens
tggaaaaggaagactagagg

SEQ ID NO: 2334768 - DNA, 16 bp, Homo sapiens
tggaaaattttctcct

SEQ ID NO: 2334769 - DNA, 20 bp, Homo sapiens
tggaaaattttctccttggt

SEQ ID NO: 2334770 - DNA, 15 bp, Homo sapiens
tggaaaccacacttc

SEQ ID NO: 2334771 - DNA, 20 bp, Homo sapiens
tggaaaccacacttcttgaa

SEQ ID NO: 2334772 - DNA, 22 bp, Homo sapiens
tggaaacttttgttagggctgc

SEQ ID NO: 2334773 - DNA, 22 bp, Homo sapiens
tggaaaggggagagcctgctgg

SEQ ID NO: 2334774 - DNA, 19 bp, Homo sapiens
tggaaataatttgaatgta

SEQ ID NO: 2334775 - DNA, 22 bp, Homo sapiens
tggaaatagaaagaagccatat

SEQ ID NO: 2334776 - DNA, 13 bp, Homo sapiens
tggaaatgtctgc

SEQ ID NO: 2334777 - DNA, 14 bp, Homo sapiens
tggaaattcctgta

SEQ ID NO: 2334778 - DNA, 13 bp, Homo sapiens
tggaaccagcccc

SEQ ID NO: 2334779 - DNA, 19 bp, Homo sapiens
tggaactctactcaaccca

SEQ ID NO: 2334780 - DNA, 13 bp, Homo sapiens
tggaactctgctt

SEQ ID NO: 2334781 - DNA, 14 bp, Homo sapiens
tggaagaaagtaag

SEQ ID NO: 2334782 - DNA, 19 bp, Homo sapiens
tggaagaagggagaagaaa

SEQ ID NO: 2334783 - DNA, 12 bp, Homo sapiens
tggaagagaggc

SEQ ID NO: 2334784 - DNA, 16 bp, Homo sapiens
tggaagagaggcacct

SEQ ID NO: 2334785 - DNA, 21 bp, Homo sapiens
tggaagagaggcacctgctgg

SEQ ID NO: 2334786 - DNA, 15 bp, Homo sapiens
tggaagccagctttc

SEQ ID NO: 2334787 - DNA, 23 bp, Homo sapiens
tggaagctgtttggaaaagacag

SEQ ID NO: 2334788 - DNA, 23 bp, Homo sapiens
tggaaggatctgctgaggcccag

SEQ ID NO: 2334789 - DNA, 14 bp, Homo sapiens
tggaaggcagagaa

SEQ ID NO: 2334790 - DNA, 19 bp, Homo sapiens
tggaagggcgttctaggta

SEQ ID NO: 2334791 - DNA, 22 bp, Homo sapiens
tggaagtatgtatattaaaaaa

SEQ ID NO: 2334792 - DNA, 19 bp, Homo sapiens
tggaagtttagctctgaga

SEQ ID NO: 2334793 - DNA, 19 bp, Homo sapiens
tggaagttttcctacactt

SEQ ID NO: 2334794 - DNA, 18 bp, Homo sapiens
tggaataaaaggcttgaa

SEQ ID NO: 2334795 - DNA, 14 bp, Homo sapiens
tggaataatttcta

SEQ ID NO: 2334796 - DNA, 16 bp, Homo sapiens
tggaataatttctatt

SEQ ID NO: 2334797 - DNA, 15 bp, Homo sapiens
atattagtatgtatg

SEQ ID NO: 2334798 - DNA, 20 bp, Homo sapiens
atattataactctgtataat

SEQ ID NO: 2334799 - DNA, 14 bp, Homo sapiens
atattataattgga

SEQ ID NO: 2334800 - DNA, 14 bp, Homo sapiens
atattatttcttct

SEQ ID NO: 2334801 - DNA, 15 bp, Homo sapiens
atattatttcttctc

SEQ ID NO: 2334802 - DNA, 18 bp, Homo sapiens
atattcatggatggctca

SEQ ID NO: 2334803 - DNA, 21 bp, Homo sapiens
atattccagatctttcagaaa

SEQ ID NO: 2334804 - DNA, 23 bp, Homo sapiens
atattcctttgcatattataaag

SEQ ID NO: 2334805 - DNA, 16 bp, Homo sapiens
atattctgcagaaaat

SEQ ID NO: 2334806 - DNA, 16 bp, Homo sapiens
atattcttttgtttcc

SEQ ID NO: 2334807 - DNA, 23 bp, Homo sapiens
atattgaaaattgaaaagtacaa

SEQ ID NO: 2334808 - DNA, 18 bp, Homo sapiens
atattgaacttttgtact

SEQ ID NO: 2334809 - DNA, 12 bp, Homo sapiens
atattgaatgtt

SEQ ID NO: 2334810 - DNA, 19 bp, Homo sapiens
atattgattgggaaaacat

SEQ ID NO: 2334811 - DNA, 21 bp, Homo sapiens
atattgattgggaaaacattt

SEQ ID NO: 2334812 - DNA, 24 bp, Homo sapiens
atattggtatgtaacacaggataa

SEQ ID NO: 2334813 - DNA, 22 bp, Homo sapiens
atattggtgctatttaacattt

SEQ ID NO: 2334814 - DNA, 12 bp, Homo sapiens
atattgtatctc

SEQ ID NO: 2334815 - DNA, 18 bp, Homo sapiens
atattgtttggtaaatgt

SEQ ID NO: 2334816 - DNA, 18 bp, Homo sapiens
atatttactaactaaata

SEQ ID NO: 2334817 - DNA, 14 bp, Homo sapiens
atatttatgtagat

SEQ ID NO: 2334818 - DNA, 20 bp, Homo sapiens
atatttatgtagatgtgcat

SEQ ID NO: 2334819 - DNA, 20 bp, Homo sapiens
atatttcaggttcttcagaa

SEQ ID NO: 2334820 - DNA, 10 bp, Homo sapiens
atatttcatt

SEQ ID NO: 2334821 - DNA, 16 bp, Homo sapiens
atatttcctaaggcat

SEQ ID NO: 2334822 - DNA, 12 bp, Homo sapiens
atatttccttta

SEQ ID NO: 2334823 - DNA, 15 bp, Homo sapiens
atatttcctttatgt

SEQ ID NO: 2334824 - DNA, 19 bp, Homo sapiens
atatttcctttatgtgaat

SEQ ID NO: 2334825 - DNA, 16 bp, Homo sapiens
atatttctattgaatt

SEQ ID NO: 2334826 - DNA, 18 bp, Homo sapiens
atatttgcacatgggatt

SEQ ID NO: 2334827 - DNA, 19 bp, Homo sapiens
atattttaacctgcataaa

SEQ ID NO: 2334828 - DNA, 21 bp, Homo sapiens
atattttcctagtagatctat

SEQ ID NO: 2334829 - DNA, 20 bp, Homo sapiens
atatttttatctttatatga

SEQ ID NO: 2334830 - DNA, 14 bp, Homo sapiens
atcaaaatagtcta

SEQ ID NO: 2334831 - DNA, 13 bp, Homo sapiens
atcaaatgaatga

SEQ ID NO: 2334832 - DNA, 23 bp, Homo sapiens
atcaaatgaatgattaaattatg

SEQ ID NO: 2334833 - DNA, 13 bp, Homo sapiens
atcaactctaata

SEQ ID NO: 2334834 - DNA, 21 bp, Homo sapiens
atcaagaaaaaaagggagaat

SEQ ID NO: 2334835 - DNA, 19 bp, Homo sapiens
atcaagagtccggatttct

SEQ ID NO: 2334836 - DNA, 20 bp, Homo sapiens
atcaagagtccggatttcta

SEQ ID NO: 2334837 - DNA, 17 bp, Homo sapiens
atcaatacactagttgt

SEQ ID NO: 2334838 - DNA, 14 bp, Homo sapiens
atcaatagttgaat

SEQ ID NO: 2334839 - DNA, 21 bp, Homo sapiens
atcacattaatctcaaagaga

SEQ ID NO: 2334840 - DNA, 15 bp, Homo sapiens
atcacccagacataa

SEQ ID NO: 2334841 - DNA, 23 bp, Homo sapiens
atcacccagacataaaggaaaag

SEQ ID NO: 2334842 - DNA, 16 bp, Homo sapiens
atcaccgactgaaaat

SEQ ID NO: 2334843 - DNA, 18 bp, Homo sapiens
atcaccgctgggtggttt

SEQ ID NO: 2334844 - DNA, 19 bp, Homo sapiens
atcacgatgtaaattatta

SEQ ID NO: 2334845 - DNA, 21 bp, Homo sapiens
atcactgccacactctccatc

SEQ ID NO: 2334846 - DNA, 22 bp, Homo sapiens
atcactgccacactctccatca

SEQ ID NO: 2334847 - DNA, 12 bp, Homo sapiens
atcactgctccc

SEQ ID NO: 2334848 - DNA, 19 bp, Homo sapiens
atcactgtatcattttctt

SEQ ID NO: 2334849 - DNA, 20 bp, Homo sapiens
atcacttaggaaatggcttt

SEQ ID NO: 2334850 - DNA, 20 bp, Homo sapiens
atcactttctcagttttcat

SEQ ID NO: 2334851 - DNA, 17 bp, Homo sapiens
atcagaagtatatctgt

SEQ ID NO: 2334852 - DNA, 15 bp, Homo sapiens
atcagacatacagct

SEQ ID NO: 2334853 - DNA, 17 bp, Homo sapiens
atcagagcgcacaggga

SEQ ID NO: 2334854 - DNA, 17 bp, Homo sapiens
atcagagttgctgcaaa

SEQ ID NO: 2334855 - DNA, 18 bp, Homo sapiens
atcagatgtgtgttctca

SEQ ID NO: 2334856 - DNA, 23 bp, Homo sapiens
atcagcaaagaaaaaaaaaaaag

SEQ ID NO: 2334857 - DNA, 20 bp, Homo sapiens
atcagcctcatgactttata

SEQ ID NO: 2334858 - DNA, 23 bp, Homo sapiens
atcaggaaatatctgtgaaggac

SEQ ID NO: 2334859 - DNA, 21 bp, Homo sapiens
atcaggtcattattttttaca

SEQ ID NO: 2334860 - DNA, 17 bp, Homo sapiens
atcaggtgtataaatgt

SEQ ID NO: 2334861 - DNA, 22 bp, Homo sapiens
atcagtaaatagtgtcatataa

SEQ ID NO: 2334862 - DNA, 22 bp, Homo sapiens
atcagtaacccccttaaattta

SEQ ID NO: 2334863 - DNA, 17 bp, Homo sapiens
atcagttacagtggcag

SEQ ID NO: 2334864 - DNA, 21 bp, Homo sapiens
atcagttacagtggcagtatt

SEQ ID NO: 2334865 - DNA, 20 bp, Homo sapiens
atcagttacccactcggtcc

SEQ ID NO: 2334866 - DNA, 23 bp, Homo sapiens
atcagttacccactcggtcccag

SEQ ID NO: 2334867 - DNA, 14 bp, Homo sapiens
atcataaagtcagt

SEQ ID NO: 2334868 - DNA, 20 bp, Homo sapiens
atcatagctcactgcagcct

SEQ ID NO: 2334869 - DNA, 23 bp, Homo sapiens
atcatagtgtacccatctttaat

SEQ ID NO: 2334870 - DNA, 13 bp, Homo sapiens
atcatgagcctgc

SEQ ID NO: 2334871 - DNA, 17 bp, Homo sapiens
atcatgagcctgctgga

SEQ ID NO: 2334872 - DNA, 16 bp, Homo sapiens
atcatggtgtaataag

SEQ ID NO: 2334873 - DNA, 16 bp, Homo sapiens
atcatgtccatacact

SEQ ID NO: 2334874 - DNA, 22 bp, Homo sapiens
atcatgttccccctaaacatgg

SEQ ID NO: 2334875 - DNA, 12 bp, Homo sapiens
atcattcagaaa

SEQ ID NO: 2334876 - DNA, 14 bp, Homo sapiens
atcattcttactaa

SEQ ID NO: 2334877 - DNA, 13 bp, Homo sapiens
atccaaaagcttt

SEQ ID NO: 2334878 - DNA, 18 bp, Homo sapiens
atccaactaatgccttac

SEQ ID NO: 2334879 - DNA, 20 bp, Homo sapiens
atccaactaatgccttactc

SEQ ID NO: 2334880 - DNA, 17 bp, Homo sapiens
atccaattgctctttca

SEQ ID NO: 2334881 - DNA, 22 bp, Homo sapiens
atccacataccctgacctggcc

SEQ ID NO: 2334882 - DNA, 14 bp, Homo sapiens
atccacctgccttg

SEQ ID NO: 2334883 - DNA, 14 bp, Homo sapiens
atccagatgtggct

SEQ ID NO: 2334884 - DNA, 21 bp, Homo sapiens
atccagcctggggctgaggct

SEQ ID NO: 2334885 - DNA, 15 bp, Homo sapiens
atccagctaccacca

SEQ ID NO: 2334886 - DNA, 17 bp, Homo sapiens
atccaggctttatgtac

SEQ ID NO: 2334887 - DNA, 17 bp, Homo sapiens
atccagggggcaagagg

SEQ ID NO: 2334888 - DNA, 16 bp, Homo sapiens
atccagtaggatccag

SEQ ID NO: 2334889 - DNA, 16 bp, Homo sapiens
atccagtgatccttac

SEQ ID NO: 2334890 - DNA, 18 bp, Homo sapiens
atccatgacctagttttc

SEQ ID NO: 2334891 - DNA, 16 bp, Homo sapiens
atccatttccattgct

SEQ ID NO: 2334892 - DNA, 15 bp, Homo sapiens
atcccccctgctcag

SEQ ID NO: 2334893 - DNA, 13 bp, Homo sapiens
atcccctaaaata

SEQ ID NO: 2334894 - DNA, 22 bp, Homo sapiens
atcccgggcctcagtgccccat

SEQ ID NO: 2334895 - DNA, 19 bp, Homo sapiens
atcccttcccacatgcctg

SEQ ID NO: 2334896 - DNA, 13 bp, Homo sapiens
atccgaagggaat

SEQ ID NO: 2334897 - DNA, 15 bp, Homo sapiens
atccgaagggaatta

SEQ ID NO: 2334898 - DNA, 16 bp, Homo sapiens
atcctaatttctcctc

SEQ ID NO: 2334899 - DNA, 18 bp, Homo sapiens
atcctaatttctcctccc

SEQ ID NO: 2334900 - DNA, 12 bp, Homo sapiens
atcctatgctta

SEQ ID NO: 2334901 - DNA, 11 bp, Homo sapiens
atcctcctgcc

SEQ ID NO: 2334902 - DNA, 17 bp, Homo sapiens
atcctcctgcctcagcc

SEQ ID NO: 2334903 - DNA, 14 bp, Homo sapiens
atcctctctctctt

SEQ ID NO: 2334904 - DNA, 16 bp, Homo sapiens
atcctctctctcttct

SEQ ID NO: 2334905 - DNA, 17 bp, Homo sapiens
atcctctctctcttcta

SEQ ID NO: 2334906 - DNA, 18 bp, Homo sapiens
atcctcttttaatggcat

SEQ ID NO: 2334907 - DNA, 24 bp, Homo sapiens
atcctgagccatcggtgaaactaa

SEQ ID NO: 2334908 - DNA, 14 bp, Homo sapiens
atcctgccatcctc

SEQ ID NO: 2334909 - DNA, 11 bp, Homo sapiens
atcctggcagc

SEQ ID NO: 2334910 - DNA, 13 bp, Homo sapiens
atcctggcagccc

SEQ ID NO: 2334911 - DNA, 19 bp, Homo sapiens
atcctggcagcccagagac

SEQ ID NO: 2334912 - DNA, 22 bp, Homo sapiens
atgctttattaatgttttcaaa

SEQ ID NO: 2334913 - DNA, 12 bp, Homo sapiens
atggaaaaggaa

SEQ ID NO: 2334914 - DNA, 14 bp, Homo sapiens
atggaaaaggaaga

SEQ ID NO: 2334915 - DNA, 15 bp, Homo sapiens
atggaaaattttctc

SEQ ID NO: 2334916 - DNA, 20 bp, Homo sapiens
atggaaaattttctccttgg

SEQ ID NO: 2334917 - DNA, 15 bp, Homo sapiens
atggaataaaccatt

SEQ ID NO: 2334918 - DNA, 23 bp, Homo sapiens
atggaatacagtcattccaagaa

SEQ ID NO: 2334919 - DNA, 20 bp, Homo sapiens
atggacacgagccacaagct

SEQ ID NO: 2334920 - DNA, 18 bp, Homo sapiens
atggacatttagaagaaa

SEQ ID NO: 2334921 - DNA, 20 bp, Homo sapiens
atggacatttagaagaaaga

SEQ ID NO: 2334922 - DNA, 20 bp, Homo sapiens
atggaccaacctgctctgtc

SEQ ID NO: 2334923 - DNA, 18 bp, Homo sapiens
atggacctccaggctcca

SEQ ID NO: 2334924 - DNA, 15 bp, Homo sapiens
atggactctgcacat

SEQ ID NO: 2334925 - DNA, 13 bp, Homo sapiens
atggagaggctga

SEQ ID NO: 2334926 - DNA, 17 bp, Homo sapiens
atggagattgacctgga

SEQ ID NO: 2334927 - DNA, 20 bp, Homo sapiens
atggagattgacctggatgg

SEQ ID NO: 2334928 - DNA, 13 bp, Homo sapiens
atggaggaatatg

SEQ ID NO: 2334929 - DNA, 12 bp, Homo sapiens
atggatctgatc

SEQ ID NO: 2334930 - DNA, 22 bp, Homo sapiens
atggatttggcactagccaaag

SEQ ID NO: 2334931 - DNA, 14 bp, Homo sapiens
atggcacctcaggc

SEQ ID NO: 2334932 - DNA, 18 bp, Homo sapiens
atggcacctcaggctgag

SEQ ID NO: 2334933 - DNA, 17 bp, Homo sapiens
atggcagaagacaccag

SEQ ID NO: 2334934 - DNA, 20 bp, Homo sapiens
atggcagaagacaccagagc

SEQ ID NO: 2334935 - DNA, 19 bp, Homo sapiens
atggcagcctactctcctt

SEQ ID NO: 2334936 - DNA, 17 bp, Homo sapiens
atggcatccctttttca

SEQ ID NO: 2334937 - DNA, 18 bp, Homo sapiens
atggcatttagcacagta

SEQ ID NO: 2334938 - DNA, 13 bp, Homo sapiens
atggcatttctct

SEQ ID NO: 2334939 - DNA, 16 bp, Homo sapiens
atggcatttctcttta

SEQ ID NO: 2334940 - DNA, 19 bp, Homo sapiens
atggcatttggtctcaggc

SEQ ID NO: 2334941 - DNA, 20 bp, Homo sapiens
atggcatttggtctcaggca

SEQ ID NO: 2334942 - DNA, 23 bp, Homo sapiens
atggcatttggtctcaggcagca

SEQ ID NO: 2334943 - DNA, 10 bp, Homo sapiens
atggccatgc

SEQ ID NO: 2334944 - DNA, 12 bp, Homo sapiens
atggccatggaa

SEQ ID NO: 2334945 - DNA, 14 bp, Homo sapiens
atggccctgtagct

SEQ ID NO: 2334946 - DNA, 16 bp, Homo sapiens
atggccctgtcccagg

SEQ ID NO: 2334947 - DNA, 17 bp, Homo sapiens
atggccctgtcccaggc

SEQ ID NO: 2334948 - DNA, 18 bp, Homo sapiens
atggcctgcaaactggga

SEQ ID NO: 2334949 - DNA, 17 bp, Homo sapiens
atggccttaatttcctt

SEQ ID NO: 2334950 - DNA, 18 bp, Homo sapiens
atggccttaatttccttt

SEQ ID NO: 2334951 - DNA, 13 bp, Homo sapiens
atggcgtctgctc

SEQ ID NO: 2334952 - DNA, 15 bp, Homo sapiens
atggcgtctgctctg

SEQ ID NO: 2334953 - DNA, 19 bp, Homo sapiens
atggcgtctgctctggtgg

SEQ ID NO: 2334954 - DNA, 18 bp, Homo sapiens
atggctcaagtctgcaca

SEQ ID NO: 2334955 - DNA, 15 bp, Homo sapiens
atggcttatttctat

SEQ ID NO: 2334956 - DNA, 22 bp, Homo sapiens
atgggaaaaatctaaaatgtgt

SEQ ID NO: 2334957 - DNA, 16 bp, Homo sapiens
atgggaactgaattgt

SEQ ID NO: 2334958 - DNA, 18 bp, Homo sapiens
atgggaactgaattgtgt

SEQ ID NO: 2334959 - DNA, 16 bp, Homo sapiens
atgggaagtcctggca

SEQ ID NO: 2334960 - DNA, 22 bp, Homo sapiens
atgggagggggcttgaagccaa

SEQ ID NO: 2334961 - DNA, 14 bp, Homo sapiens
atgggcacacacac

SEQ ID NO: 2334962 - DNA, 14 bp, Homo sapiens
atgggcccaggcct

SEQ ID NO: 2334963 - DNA, 18 bp, Homo sapiens
atgggcctgccgggctga

SEQ ID NO: 2334964 - DNA, 22 bp, Homo sapiens
atgggcctgccgggctgagggc

SEQ ID NO: 2334965 - DNA, 15 bp, Homo sapiens
atgggcttcactgta

SEQ ID NO: 2334966 - DNA, 19 bp, Homo sapiens
atgggcttcactgtataaa

SEQ ID NO: 2334967 - DNA, 22 bp, Homo sapiens
atgggcttttggggagccagaa

SEQ ID NO: 2334968 - DNA, 16 bp, Homo sapiens
atgggggcagggctgt

SEQ ID NO: 2334969 - DNA, 16 bp, Homo sapiens
atgggtatgctcaggt

SEQ ID NO: 2334970 - DNA, 22 bp, Homo sapiens
atgggtccaggggtctgtctgc

SEQ ID NO: 2334971 - DNA, 20 bp, Homo sapiens
atgggtcctagcccttccct

SEQ ID NO: 2334972 - DNA, 21 bp, Homo sapiens
atgggtcctagcccttccctg

SEQ ID NO: 2334973 - DNA, 14 bp, Homo sapiens
atgggttgcatttg

SEQ ID NO: 2334974 - DNA, 15 bp, Homo sapiens
atggtaagagaaaag

SEQ ID NO: 2334975 - DNA, 20 bp, Homo sapiens
atggtaataagcactgtaaa

SEQ ID NO: 2334976 - DNA, 16 bp, Homo sapiens
atggtaggggagggca

SEQ ID NO: 2334977 - DNA, 20 bp, Homo sapiens
atggtcacgtttggtgcttc

SEQ ID NO: 2334978 - DNA, 24 bp, Homo sapiens
atggtcacgtttggtgcttctcag

SEQ ID NO: 2334979 - DNA, 15 bp, Homo sapiens
atggtcggatctcac

SEQ ID NO: 2334980 - DNA, 22 bp, Homo sapiens
atggtcggatctcacaggctga

SEQ ID NO: 2334981 - DNA, 22 bp, Homo sapiens
atggtctgaagaaggaaggcct

SEQ ID NO: 2334982 - DNA, 17 bp, Homo sapiens
atggtctttgctccaga

SEQ ID NO: 2334983 - DNA, 19 bp, Homo sapiens
atggtgacagtctccccca

SEQ ID NO: 2334984 - DNA, 21 bp, Homo sapiens
atggtgcctgagaggcaggca

SEQ ID NO: 2334985 - DNA, 20 bp, Homo sapiens
atggtgctcacgactcttcc

SEQ ID NO: 2334986 - DNA, 12 bp, Homo sapiens
atggtgtaataa

SEQ ID NO: 2334987 - DNA, 22 bp, Homo sapiens
atggttcccaatatcatgtgat

SEQ ID NO: 2334988 - DNA, 14 bp, Homo sapiens
atggttcttcacct

SEQ ID NO: 2334989 - DNA, 13 bp, Homo sapiens
atgtaaaatgttt

SEQ ID NO: 2334990 - DNA, 17 bp, Homo sapiens
atgtaacaacaattatt

SEQ ID NO: 2334991 - DNA, 19 bp, Homo sapiens
atgtaataaaaagtatatg

SEQ ID NO: 2334992 - DNA, 21 bp, Homo sapiens
atgtaattatatatactatat

SEQ ID NO: 2334993 - DNA, 16 bp, Homo sapiens
atgtaatttaaatgaa

SEQ ID NO: 2334994 - DNA, 17 bp, Homo sapiens
atgtaatttaaatgaaa

SEQ ID NO: 2334995 - DNA, 17 bp, Homo sapiens
atgtaatttcaaaatac

SEQ ID NO: 2334996 - DNA, 21 bp, Homo sapiens
atgtaatttcaaaatacattt

SEQ ID NO: 2334997 - DNA, 14 bp, Homo sapiens
atgtacaaacatgt

SEQ ID NO: 2334998 - DNA, 15 bp, Homo sapiens
atgtacaaacatgtt

SEQ ID NO: 2334999 - DNA, 16 bp, Homo sapiens
atgtactgatttcagt

SEQ ID NO: 2335000 - DNA, 18 bp, Homo sapiens
atgtactttttaaatcat

SEQ ID NO: 2335001 - DNA, 22 bp, Homo sapiens
atgtagatattgtgaagtacat

SEQ ID NO: 2335002 - DNA, 15 bp, Homo sapiens
atgtagctgaaaata

SEQ ID NO: 2335003 - DNA, 19 bp, Homo sapiens
atgtaggtaagactgtaga

SEQ ID NO: 2335004 - DNA, 14 bp, Homo sapiens
atgtagtatctata

SEQ ID NO: 2335005 - DNA, 18 bp, Homo sapiens
atgtagtcagttgcattc

SEQ ID NO: 2335006 - DNA, 12 bp, Homo sapiens
atgtataaatat

SEQ ID NO: 2335007 - DNA, 16 bp, Homo sapiens
atgtataaatatacag

SEQ ID NO: 2335008 - DNA, 17 bp, Homo sapiens
atgtataaatatacagt

SEQ ID NO: 2335009 - DNA, 16 bp, Homo sapiens
atgtatattaaaaaag

SEQ ID NO: 2335010 - DNA, 17 bp, Homo sapiens
atgtatattaaaaaaga

SEQ ID NO: 2335011 - DNA, 22 bp, Homo sapiens
atgtatattaaaaaagagacat

SEQ ID NO: 2335012 - DNA, 14 bp, Homo sapiens
atgtatgcattcac

SEQ ID NO: 2335013 - DNA, 16 bp, Homo sapiens
atgtcagaacagagtg

SEQ ID NO: 2335014 - DNA, 21 bp, Homo sapiens
atgtccaccatgaacttgata

SEQ ID NO: 2335015 - DNA, 14 bp, Homo sapiens
atgtcccctcccag

SEQ ID NO: 2335016 - DNA, 17 bp, Homo sapiens
atgtccctccaacacag

SEQ ID NO: 2335017 - DNA, 14 bp, Homo sapiens
atgtcctgtaaagg

SEQ ID NO: 2335018 - DNA, 14 bp, Homo sapiens
atgtcgccaaaaat

SEQ ID NO: 2335019 - DNA, 14 bp, Homo sapiens
atgtctattcagct

SEQ ID NO: 2335020 - DNA, 20 bp, Homo sapiens
atgtctcactttactttcaa

SEQ ID NO: 2335021 - DNA, 13 bp, Homo sapiens
atgtctcatgttt

SEQ ID NO: 2335022 - DNA, 19 bp, Homo sapiens
atgtctgcagtgtgccccc

SEQ ID NO: 2335023 - DNA, 15 bp, Homo sapiens
atgtctgccatgttg

SEQ ID NO: 2335024 - DNA, 12 bp, Homo sapiens
atgtctgctggt

SEQ ID NO: 2335025 - DNA, 18 bp, Homo sapiens
atgtctgctggtatttct

SEQ ID NO: 2335026 - DNA, 18 bp, Homo sapiens
atgtctgtagctcctcaa

SEQ ID NO: 2335027 - DNA, 14 bp, Homo sapiens
aaaagggagttttt

SEQ ID NO: 2335028 - DNA, 16 bp, Homo sapiens
aaaagtataaaatagt

SEQ ID NO: 2335029 - DNA, 19 bp, Homo sapiens
aaaagtattgaaagccaac

SEQ ID NO: 2335030 - DNA, 13 bp, Homo sapiens
aaaagtccctccc

SEQ ID NO: 2335031 - DNA, 21 bp, Homo sapiens
aaaagtccctccctgcctgag

SEQ ID NO: 2335032 - DNA, 18 bp, Homo sapiens
aaaagtctgtctttcctg

SEQ ID NO: 2335033 - DNA, 21 bp, Homo sapiens
aaaagtgtctcaaaggagctt

SEQ ID NO: 2335034 - DNA, 20 bp, Homo sapiens
aaaagtgtgtatatattttg

SEQ ID NO: 2335035 - DNA, 22 bp, Homo sapiens
aaaagttggaaggatctgctga

SEQ ID NO: 2335036 - DNA, 22 bp, Homo sapiens
aaaataaaacccgttgattact

SEQ ID NO: 2335037 - DNA, 16 bp, Homo sapiens
aaaataaaatgtttca

SEQ ID NO: 2335038 - DNA, 14 bp, Homo sapiens
aaaataaagaagta

SEQ ID NO: 2335039 - DNA, 20 bp, Homo sapiens
aaaataaataaaaactaatt

SEQ ID NO: 2335040 - DNA, 12 bp, Homo sapiens
aaaataaatgga

SEQ ID NO: 2335041 - DNA, 16 bp, Homo sapiens
aaaataattcatatct

SEQ ID NO: 2335042 - DNA, 17 bp, Homo sapiens
aaaataattcatatcta

SEQ ID NO: 2335043 - DNA, 14 bp, Homo sapiens
aaaatactattgcc

SEQ ID NO: 2335044 - DNA, 20 bp, Homo sapiens
aaaatagaaattttgtaaga

SEQ ID NO: 2335045 - DNA, 18 bp, Homo sapiens
aaaatatatttataagga

SEQ ID NO: 2335046 - DNA, 13 bp, Homo sapiens
aaaatatctattt

SEQ ID NO: 2335047 - DNA, 14 bp, Homo sapiens
aaaatatgtaattt

SEQ ID NO: 2335048 - DNA, 17 bp, Homo sapiens
aaaatatgtaatttcaa

SEQ ID NO: 2335049 - DNA, 14 bp, Homo sapiens
aaaatattgtttct

SEQ ID NO: 2335050 - DNA, 22 bp, Homo sapiens
aaaatattgtttctgcattcat

SEQ ID NO: 2335051 - DNA, 19 bp, Homo sapiens
aaaatattgttttacaata

SEQ ID NO: 2335052 - DNA, 20 bp, Homo sapiens
aaaatattgttttacaatag

SEQ ID NO: 2335053 - DNA, 22 bp, Homo sapiens
aaaatcatgatccttgtgttca

SEQ ID NO: 2335054 - DNA, 12 bp, Homo sapiens
aaaatcattgat

SEQ ID NO: 2335055 - DNA, 22 bp, Homo sapiens
aaaatccccttcgctgaaattg

SEQ ID NO: 2335056 - DNA, 15 bp, Homo sapiens
aaaatcgatgagcgc

SEQ ID NO: 2335057 - DNA, 14 bp, Homo sapiens
aaaatctaaaatgt

SEQ ID NO: 2335058 - DNA, 16 bp, Homo sapiens
aaaatgaatttttatt

SEQ ID NO: 2335059 - DNA, 13 bp, Homo sapiens
aaaatgagatttc

SEQ ID NO: 2335060 - DNA, 17 bp, Homo sapiens
aaaatgatttacatagg

SEQ ID NO: 2335061 - DNA, 18 bp, Homo sapiens
aaaatgctccccacagcg

SEQ ID NO: 2335062 - DNA, 15 bp, Homo sapiens
aaaatggcatttagc

SEQ ID NO: 2335063 - DNA, 16 bp, Homo sapiens
aaaatggcatttagca

SEQ ID NO: 2335064 - DNA, 17 bp, Homo sapiens
aaaatggcatttagcac

SEQ ID NO: 2335065 - DNA, 18 bp, Homo sapiens
aaaatgtattcctttaaa

SEQ ID NO: 2335066 - DNA, 20 bp, Homo sapiens
aaaatgtattcctttaaaat

SEQ ID NO: 2335067 - DNA, 19 bp, Homo sapiens
aaaatgtgctatactgcat

SEQ ID NO: 2335068 - DNA, 20 bp, Homo sapiens
aaaatgtgctatactgcata

SEQ ID NO: 2335069 - DNA, 21 bp, Homo sapiens
aaaatgttggtcattttatgt

SEQ ID NO: 2335070 - DNA, 15 bp, Homo sapiens
aaaatgtttcattat

SEQ ID NO: 2335071 - DNA, 19 bp, Homo sapiens
aaaatgttttatgacattt

SEQ ID NO: 2335072 - DNA, 20 bp, Homo sapiens
aaaattaagcaaatgttaaa

SEQ ID NO: 2335073 - DNA, 12 bp, Homo sapiens
aaaatttaattt

SEQ ID NO: 2335074 - DNA, 21 bp, Homo sapiens
aaaatttatacaccagcaatt

SEQ ID NO: 2335075 - DNA, 18 bp, Homo sapiens
aaaattttgtatgttaaa

SEQ ID NO: 2335076 - DNA, 22 bp, Homo sapiens
aaaattttgtatgttaaagaga

SEQ ID NO: 2335077 - DNA, 19 bp, Homo sapiens
aaacaaaaacagaatttga

SEQ ID NO: 2335078 - DNA, 16 bp, Homo sapiens
aaacaaaaagatgtct

SEQ ID NO: 2335079 - DNA, 16 bp, Homo sapiens
aaacaaagggttttct

SEQ ID NO: 2335080 - DNA, 16 bp, Homo sapiens
aaacaaagtactcttt

SEQ ID NO: 2335081 - DNA, 15 bp, Homo sapiens
aaacaaagtttcaga

SEQ ID NO: 2335082 - DNA, 17 bp, Homo sapiens
aaacaacatttatatgt

SEQ ID NO: 2335083 - DNA, 18 bp, Homo sapiens
aaacaatggagtattctc

SEQ ID NO: 2335084 - DNA, 14 bp, Homo sapiens
aaacacacgagcaa

SEQ ID NO: 2335085 - DNA, 13 bp, Homo sapiens
aaacacccctctg

SEQ ID NO: 2335086 - DNA, 14 bp, Homo sapiens
aaacacccctctgt

SEQ ID NO: 2335087 - DNA, 20 bp, Homo sapiens
aaacactcagtccactgttg

SEQ ID NO: 2335088 - DNA, 13 bp, Homo sapiens
aaacagaatttga

SEQ ID NO: 2335089 - DNA, 12 bp, Homo sapiens
aaacagacactg

SEQ ID NO: 2335090 - DNA, 14 bp, Homo sapiens
aaacagcagctcat

SEQ ID NO: 2335091 - DNA, 22 bp, Homo sapiens
aaacagcttcctgttactgaga

SEQ ID NO: 2335092 - DNA, 22 bp, Homo sapiens
aaacagttctcactgggaagaa

SEQ ID NO: 2335093 - DNA, 15 bp, Homo sapiens
aaacagttgctgtga

SEQ ID NO: 2335094 - DNA, 16 bp, Homo sapiens
aaacagttgctgtgaa

SEQ ID NO: 2335095 - DNA, 19 bp, Homo sapiens
aaacatttgattaataaaa

SEQ ID NO: 2335096 - DNA, 22 bp, Homo sapiens
aaacatttgattaataaaatat

SEQ ID NO: 2335097 - DNA, 19 bp, Homo sapiens
aaacattttttatacattt

SEQ ID NO: 2335098 - DNA, 15 bp, Homo sapiens
aaaccaaaaacattt

SEQ ID NO: 2335099 - DNA, 17 bp, Homo sapiens
aaaccaaagagggcttc

SEQ ID NO: 2335100 - DNA, 19 bp, Homo sapiens
aaaccaaagagggcttcct

SEQ ID NO: 2335101 - DNA, 21 bp, Homo sapiens
aaaccaaagagggcttcctct

SEQ ID NO: 2335102 - DNA, 13 bp, Homo sapiens
aaaccctctccat

SEQ ID NO: 2335103 - DNA, 23 bp, Homo sapiens
aaacctcagggctgtcccagccc

SEQ ID NO: 2335104 - DNA, 22 bp, Homo sapiens
aaacctcatagcaaccagagga

SEQ ID NO: 2335105 - DNA, 21 bp, Homo sapiens
aaacctggaatctacaagcca

SEQ ID NO: 2335106 - DNA, 15 bp, Homo sapiens
aaaccttttttaaga

SEQ ID NO: 2335107 - DNA, 19 bp, Homo sapiens
aaaccttttttaagatttt

SEQ ID NO: 2335108 - DNA, 20 bp, Homo sapiens
aaaccttttttaagattttt

SEQ ID NO: 2335109 - DNA, 14 bp, Homo sapiens
aaacgctcctttgt

SEQ ID NO: 2335110 - DNA, 16 bp, Homo sapiens
aaacgctcctttgtgt

SEQ ID NO: 2335111 - DNA, 15 bp, Homo sapiens
aaacggttcctggtg

SEQ ID NO: 2335112 - DNA, 17 bp, Homo sapiens
aaacggttcctggtgac

SEQ ID NO: 2335113 - DNA, 12 bp, Homo sapiens
aaactaaaaact

SEQ ID NO: 2335114 - DNA, 13 bp, Homo sapiens
aaactaaatttca

SEQ ID NO: 2335115 - DNA, 21 bp, Homo sapiens
aaactaaccagcattccctac

SEQ ID NO: 2335116 - DNA, 13 bp, Homo sapiens
aaactaagccagg

SEQ ID NO: 2335117 - DNA, 17 bp, Homo sapiens
aaactattagagtattt

SEQ ID NO: 2335118 - DNA, 15 bp, Homo sapiens
aaactcagatctgat

SEQ ID NO: 2335119 - DNA, 19 bp, Homo sapiens
aaactcaggcaaagaaaat

SEQ ID NO: 2335120 - DNA, 18 bp, Homo sapiens
aaactctgaaggagagga

SEQ ID NO: 2335121 - DNA, 15 bp, Homo sapiens
aaactcttatctcag

SEQ ID NO: 2335122 - DNA, 16 bp, Homo sapiens
aaactcttatctcagt

SEQ ID NO: 2335123 - DNA, 20 bp, Homo sapiens
aaactgtatttacttgttat

SEQ ID NO: 2335124 - DNA, 18 bp, Homo sapiens
aaactgtgtattccaaga

SEQ ID NO: 2335125 - DNA, 19 bp, Homo sapiens
aaactgtgtattccaagac

SEQ ID NO: 2335126 - DNA, 16 bp, Homo sapiens
aaactgtgttgccaca

SEQ ID NO: 2335127 - DNA, 24 bp, Homo sapiens
aaacttgtggcctcaagcaatcca

SEQ ID NO: 2335128 - DNA, 16 bp, Homo sapiens
aaactttggcctttgt

SEQ ID NO: 2335129 - DNA, 13 bp, Homo sapiens
aaactttgggaaa

SEQ ID NO: 2335130 - DNA, 20 bp, Homo sapiens
aaactttgggaaaacatgtt

SEQ ID NO: 2335131 - DNA, 21 bp, Homo sapiens
aaacttttgttagggctgctt

SEQ ID NO: 2335132 - DNA, 20 bp, Homo sapiens
aaagaaaaatctcattattt

SEQ ID NO: 2335133 - DNA, 16 bp, Homo sapiens
aaagaaaagacatttt

SEQ ID NO: 2335134 - DNA, 17 bp, Homo sapiens
aaagaaaagacatttta

SEQ ID NO: 2335135 - DNA, 13 bp, Homo sapiens
aaagaaaattgag

SEQ ID NO: 2335136 - DNA, 18 bp, Homo sapiens
aaagaaatcatgtccata

SEQ ID NO: 2335137 - DNA, 12 bp, Homo sapiens
aaagaagccata

SEQ ID NO: 2335138 - DNA, 17 bp, Homo sapiens
aaagaaggaaagatggt

SEQ ID NO: 2335139 - DNA, 20 bp, Homo sapiens
aaagaatgccatttctcacg

SEQ ID NO: 2335140 - DNA, 22 bp, Homo sapiens
aaagacacattttttaggaaat

SEQ ID NO: 2335141 - DNA, 20 bp, Homo sapiens
aaagacattttaagtttgta

SEQ ID NO: 2335142 - DNA, 19 bp, Homo sapiens
aacaaataaaaaagctctt

SEQ ID NO: 2335143 - DNA, 12 bp, Homo sapiens
aacaaataaata

SEQ ID NO: 2335144 - DNA, 17 bp, Homo sapiens
aacaaataaatatgaaa

SEQ ID NO: 2335145 - DNA, 12 bp, Homo sapiens
aacaacaattat

SEQ ID NO: 2335146 - DNA, 16 bp, Homo sapiens
aacaactttcacttct

SEQ ID NO: 2335147 - DNA, 20 bp, Homo sapiens
aacaactttcacttcttcct

SEQ ID NO: 2335148 - DNA, 22 bp, Homo sapiens
aacaagacctcagtgccttcct

SEQ ID NO: 2335149 - DNA, 20 bp, Homo sapiens
aacaagatttccttgtgcaa

SEQ ID NO: 2335150 - DNA, 13 bp, Homo sapiens
aacaagcatgcag

SEQ ID NO: 2335151 - DNA, 22 bp, Homo sapiens
aacaataaaaacaactttcact

SEQ ID NO: 2335152 - DNA, 15 bp, Homo sapiens
aacaatggagtattc

SEQ ID NO: 2335153 - DNA, 11 bp, Homo sapiens
aacaatgttaa

SEQ ID NO: 2335154 - DNA, 21 bp, Homo sapiens
aacaatgttaaggaaactctt

SEQ ID NO: 2335155 - DNA, 22 bp, Homo sapiens
aacaatgttaaggaaactctta

SEQ ID NO: 2335156 - DNA, 16 bp, Homo sapiens
aacaattggtaaaact

SEQ ID NO: 2335157 - DNA, 22 bp, Homo sapiens
aacaattgtcgaaaagagtctt

SEQ ID NO: 2335158 - DNA, 12 bp, Homo sapiens
aacacaagcaaa

SEQ ID NO: 2335159 - DNA, 20 bp, Homo sapiens
aacacacgagcaaacccaga

SEQ ID NO: 2335160 - DNA, 18 bp, Homo sapiens
aacacagcatgtgtattt

SEQ ID NO: 2335161 - DNA, 14 bp, Homo sapiens
aacacagtgtctgt

SEQ ID NO: 2335162 - DNA, 22 bp, Homo sapiens
aacacattgaaactgtatttac

SEQ ID NO: 2335163 - DNA, 16 bp, Homo sapiens
aacaccagcaacatta

SEQ ID NO: 2335164 - DNA, 21 bp, Homo sapiens
aacaccagcaacattataatg

SEQ ID NO: 2335165 - DNA, 16 bp, Homo sapiens
aacacgattttcaaga

SEQ ID NO: 2335166 - DNA, 14 bp, Homo sapiens
aacacggcagctgt

SEQ ID NO: 2335167 - DNA, 18 bp, Homo sapiens
aacactaactcaccagcc

SEQ ID NO: 2335168 - DNA, 19 bp, Homo sapiens
aacactaactcaccagccc

SEQ ID NO: 2335169 - DNA, 20 bp, Homo sapiens
aacactcttcttgagcagac

SEQ ID NO: 2335170 - DNA, 20 bp, Homo sapiens
aacagaaaaatgaaatttaa

SEQ ID NO: 2335171 - DNA, 14 bp, Homo sapiens
aacagaaatggaaa

SEQ ID NO: 2335172 - DNA, 13 bp, Homo sapiens
aacagaacagctt

SEQ ID NO: 2335173 - DNA, 16 bp, Homo sapiens
aacagaacagcttcag

SEQ ID NO: 2335174 - DNA, 17 bp, Homo sapiens
aacagaatcttctgggt

SEQ ID NO: 2335175 - DNA, 15 bp, Homo sapiens
aacagagtgaaaaat

SEQ ID NO: 2335176 - DNA, 18 bp, Homo sapiens
aacagccaagattttcct

SEQ ID NO: 2335177 - DNA, 15 bp, Homo sapiens
aacagccactcccct

SEQ ID NO: 2335178 - DNA, 18 bp, Homo sapiens
aacagccactcccctcca

SEQ ID NO: 2335179 - DNA, 17 bp, Homo sapiens
aacagcccccactccag

SEQ ID NO: 2335180 - DNA, 18 bp, Homo sapiens
aacagcctttgaatgtaa

SEQ ID NO: 2335181 - DNA, 14 bp, Homo sapiens
aacagcttcaggtt

SEQ ID NO: 2335182 - DNA, 15 bp, Homo sapiens
aacagcttcaggtta

SEQ ID NO: 2335183 - DNA, 20 bp, Homo sapiens
aacaggattacagtgtagct

SEQ ID NO: 2335184 - DNA, 22 bp, Homo sapiens
aacaggttcttaaaaaggaaca

SEQ ID NO: 2335185 - DNA, 20 bp, Homo sapiens
aacagtactggttactttca

SEQ ID NO: 2335186 - DNA, 21 bp, Homo sapiens
aacagtatgtgggatattgaa

SEQ ID NO: 2335187 - DNA, 13 bp, Homo sapiens
aacagtccttgct

SEQ ID NO: 2335188 - DNA, 14 bp, Homo sapiens
aacagttgctgtga

SEQ ID NO: 2335189 - DNA, 15 bp, Homo sapiens
aacatacaagaaaat

SEQ ID NO: 2335190 - DNA, 18 bp, Homo sapiens
aacatacagaggatgcct

SEQ ID NO: 2335191 - DNA, 14 bp, Homo sapiens
aacatactgattgg

SEQ ID NO: 2335192 - DNA, 22 bp, Homo sapiens
aacatcgaaaagttattttgta

SEQ ID NO: 2335193 - DNA, 12 bp, Homo sapiens
aacatctctggc

SEQ ID NO: 2335194 - DNA, 18 bp, Homo sapiens
aacatctttattgaaatt

SEQ ID NO: 2335195 - DNA, 14 bp, Homo sapiens
aacatgacttcctt

SEQ ID NO: 2335196 - DNA, 24 bp, Homo sapiens
aacatgacttccttatttctgaac

SEQ ID NO: 2335197 - DNA, 14 bp, Homo sapiens
aacatgcagtattt

SEQ ID NO: 2335198 - DNA, 13 bp, Homo sapiens
aacatgccccctg

SEQ ID NO: 2335199 - DNA, 14 bp, Homo sapiens
aacatgccccctgc

SEQ ID NO: 2335200 - DNA, 13 bp, Homo sapiens
aacatgtaaaatg

SEQ ID NO: 2335201 - DNA, 15 bp, Homo sapiens
aacatgtaaaatgtt

SEQ ID NO: 2335202 - DNA, 22 bp, Homo sapiens
aacatgttaatgacaatattcc

SEQ ID NO: 2335203 - DNA, 14 bp, Homo sapiens
aacattcccagccc

SEQ ID NO: 2335204 - DNA, 18 bp, Homo sapiens
aacatttgattaataaaa

SEQ ID NO: 2335205 - DNA, 20 bp, Homo sapiens
aacatttgattaataaaata

SEQ ID NO: 2335206 - DNA, 12 bp, Homo sapiens
aacatttgctgc

SEQ ID NO: 2335207 - DNA, 23 bp, Homo sapiens
aacattttatcattaaaaattac

SEQ ID NO: 2335208 - DNA, 19 bp, Homo sapiens
aacattttttatacatttg

SEQ ID NO: 2335209 - DNA, 16 bp, Homo sapiens
aaccaaaaacatttga

SEQ ID NO: 2335210 - DNA, 15 bp, Homo sapiens
aaccaaatgtttatt

SEQ ID NO: 2335211 - DNA, 24 bp, Homo sapiens
aaccaagctataaaagcccatgct

SEQ ID NO: 2335212 - DNA, 23 bp, Homo sapiens
aaccaagtatcacactttaatgt

SEQ ID NO: 2335213 - DNA, 23 bp, Homo sapiens
aaccaatcctactaataaaccag

SEQ ID NO: 2335214 - DNA, 15 bp, Homo sapiens
aaccacacttcttga

SEQ ID NO: 2335215 - DNA, 14 bp, Homo sapiens
aaccacattgaaga

SEQ ID NO: 2335216 - DNA, 22 bp, Homo sapiens
aaccacattgaagaatgttaga

SEQ ID NO: 2335217 - DNA, 16 bp, Homo sapiens
aaccacctatttttga

SEQ ID NO: 2335218 - DNA, 22 bp, Homo sapiens
aaccacggaggatgatgccagt

SEQ ID NO: 2335219 - DNA, 17 bp, Homo sapiens
aaccactgcttctcttt

SEQ ID NO: 2335220 - DNA, 21 bp, Homo sapiens
aaccactgtgcgtcttggtgt

SEQ ID NO: 2335221 - DNA, 19 bp, Homo sapiens
aaccagaaacacccctctg

SEQ ID NO: 2335222 - DNA, 14 bp, Homo sapiens
aaccagcattccct

SEQ ID NO: 2335223 - DNA, 12 bp, Homo sapiens
aaccagccaggc

SEQ ID NO: 2335224 - DNA, 15 bp, Homo sapiens
aaccagccccatcag

SEQ ID NO: 2335225 - DNA, 18 bp, Homo sapiens
aaccaggcacctcttcct

SEQ ID NO: 2335226 - DNA, 16 bp, Homo sapiens
aacccaagcaacattt

SEQ ID NO: 2335227 - DNA, 20 bp, Homo sapiens
aaccccccgcccatgctgtc

SEQ ID NO: 2335228 - DNA, 18 bp, Homo sapiens
aacccctttcccacccca

SEQ ID NO: 2335229 - DNA, 23 bp, Homo sapiens
aacccgggagcggaggttgcagt

SEQ ID NO: 2335230 - DNA, 16 bp, Homo sapiens
aaccctatctcctgac

SEQ ID NO: 2335231 - DNA, 13 bp, Homo sapiens
aaccctcccagaa

SEQ ID NO: 2335232 - DNA, 16 bp, Homo sapiens
aaccctcccagaaaca

SEQ ID NO: 2335233 - DNA, 20 bp, Homo sapiens
aaccctcccagaaacatctc

SEQ ID NO: 2335234 - DNA, 20 bp, Homo sapiens
aaccctgctgaacacagtgt

SEQ ID NO: 2335235 - DNA, 23 bp, Homo sapiens
aaccctgctgaacacagtgtctg

SEQ ID NO: 2335236 - DNA, 18 bp, Homo sapiens
aaccctggggcctgactg

SEQ ID NO: 2335237 - DNA, 20 bp, Homo sapiens
aaccctggggcctgactgct

SEQ ID NO: 2335238 - DNA, 23 bp, Homo sapiens
aaccgagtagaaaatgtgaccct

SEQ ID NO: 2335239 - DNA, 13 bp, Homo sapiens
aaccgcacagctc

SEQ ID NO: 2335240 - DNA, 17 bp, Homo sapiens
aaccgtagatgatttca

SEQ ID NO: 2335241 - DNA, 22 bp, Homo sapiens
aaccgtctgttatgctgtgaca

SEQ ID NO: 2335242 - DNA, 21 bp, Homo sapiens
aacctaacacattaaatgtgg

SEQ ID NO: 2335243 - DNA, 20 bp, Homo sapiens
aacctaatcaccatgtaagc

SEQ ID NO: 2335244 - DNA, 14 bp, Homo sapiens
aacctaattaatat

SEQ ID NO: 2335245 - DNA, 18 bp, Homo sapiens
aacctaattaatatatta

SEQ ID NO: 2335246 - DNA, 20 bp, Homo sapiens
aacctagttaaagaaaggaa

SEQ ID NO: 2335247 - DNA, 21 bp, Homo sapiens
aacctagttaaagaaaggaaa

SEQ ID NO: 2335248 - DNA, 22 bp, Homo sapiens
aacctatgatattttctgtgcc

SEQ ID NO: 2335249 - DNA, 17 bp, Homo sapiens
aacctcaactgcctact

SEQ ID NO: 2335250 - DNA, 18 bp, Homo sapiens
aacctcagggctgtccca

SEQ ID NO: 2335251 - DNA, 15 bp, Homo sapiens
aacctcctgctgtgc

SEQ ID NO: 2335252 - DNA, 19 bp, Homo sapiens
aacctcgcgcttgctggcc

SEQ ID NO: 2335253 - DNA, 18 bp, Homo sapiens
aacctctttttcctcctg

SEQ ID NO: 2335254 - DNA, 19 bp, Homo sapiens
aacctgacccctgctcagt

SEQ ID NO: 2335255 - DNA, 21 bp, Homo sapiens
aacctgagctattttcctctg

SEQ ID NO: 2335256 - DNA, 15 bp, Homo sapiens
aagtgaattgaagtt

SEQ ID NO: 2335257 - DNA, 13 bp, Homo sapiens
aagtgacaaataa

SEQ ID NO: 2335258 - DNA, 17 bp, Homo sapiens
aagtgacaaataagatt

SEQ ID NO: 2335259 - DNA, 17 bp, Homo sapiens
aagtgagcagaacaggt

SEQ ID NO: 2335260 - DNA, 14 bp, Homo sapiens
aagtgcatttttgt

SEQ ID NO: 2335261 - DNA, 18 bp, Homo sapiens
aagtgccagggctgggcc

SEQ ID NO: 2335262 - DNA, 16 bp, Homo sapiens
aagtgcccacatttga

SEQ ID NO: 2335263 - DNA, 18 bp, Homo sapiens
aagtgcccacatttgatg

SEQ ID NO: 2335264 - DNA, 19 bp, Homo sapiens
aagtgccctctcccaccct

SEQ ID NO: 2335265 - DNA, 16 bp, Homo sapiens
aagtgcgtgtgtagag

SEQ ID NO: 2335266 - DNA, 17 bp, Homo sapiens
aagtgcgtgtgtagagt

SEQ ID NO: 2335267 - DNA, 18 bp, Homo sapiens
aagtgcgtgtgtagagtt

SEQ ID NO: 2335268 - DNA, 22 bp, Homo sapiens
aagtgcgtgtgtagagttaaga

SEQ ID NO: 2335269 - DNA, 19 bp, Homo sapiens
aagtgctggagtctcctga

SEQ ID NO: 2335270 - DNA, 22 bp, Homo sapiens
aagtgcttggaacatactgttc

SEQ ID NO: 2335271 - DNA, 23 bp, Homo sapiens
aagtgcttggaacatactgttca

SEQ ID NO: 2335272 - DNA, 14 bp, Homo sapiens
aagtgctttaaaaa

SEQ ID NO: 2335273 - DNA, 16 bp, Homo sapiens
aagtggaagtatgtat

SEQ ID NO: 2335274 - DNA, 20 bp, Homo sapiens
aagtggaccttgagaccaca

SEQ ID NO: 2335275 - DNA, 13 bp, Homo sapiens
aagtggactgtat

SEQ ID NO: 2335276 - DNA, 17 bp, Homo sapiens
aagtggctggtagaaaa

SEQ ID NO: 2335277 - DNA, 13 bp, Homo sapiens
aagtgggggcagc

SEQ ID NO: 2335278 - DNA, 16 bp, Homo sapiens
aagtggtctctgctgg

SEQ ID NO: 2335279 - DNA, 23 bp, Homo sapiens
aagtggtctgtggatcagcattt

SEQ ID NO: 2335280 - DNA, 16 bp, Homo sapiens
aagtggtgtttattgc

SEQ ID NO: 2335281 - DNA, 15 bp, Homo sapiens
aagtgtgtatatatt

SEQ ID NO: 2335282 - DNA, 16 bp, Homo sapiens
aagtgtgtatatattt

SEQ ID NO: 2335283 - DNA, 17 bp, Homo sapiens
aagtgtgtatatatttt

SEQ ID NO: 2335284 - DNA, 19 bp, Homo sapiens
aagtgtgtatatattttgt

SEQ ID NO: 2335285 - DNA, 21 bp, Homo sapiens
aagtgtgtatatattttgtgt

SEQ ID NO: 2335286 - DNA, 12 bp, Homo sapiens
aagtgttctcat

SEQ ID NO: 2335287 - DNA, 17 bp, Homo sapiens
aagtgttctcatgaagc

SEQ ID NO: 2335288 - DNA, 21 bp, Homo sapiens
aagtgttctcatgaagcagga

SEQ ID NO: 2335289 - DNA, 21 bp, Homo sapiens
aagttacacagaaatgctgct

SEQ ID NO: 2335290 - DNA, 22 bp, Homo sapiens
aagttacttaattgccagcaaa

SEQ ID NO: 2335291 - DNA, 23 bp, Homo sapiens
aagttacttaattgccagcaaat

SEQ ID NO: 2335292 - DNA, 22 bp, Homo sapiens
aagttagaactagccaaaccag

SEQ ID NO: 2335293 - DNA, 14 bp, Homo sapiens
aagttattttctac

SEQ ID NO: 2335294 - DNA, 15 bp, Homo sapiens
aagttatttttgtac

SEQ ID NO: 2335295 - DNA, 16 bp, Homo sapiens
aagttatttttgtaca

SEQ ID NO: 2335296 - DNA, 9 bp, Homo sapiens
aagttctta

SEQ ID NO: 2335297 - DNA, 20 bp, Homo sapiens
aagttcttatgaggagggga

SEQ ID NO: 2335298 - DNA, 14 bp, Homo sapiens
aagttggaaggatc

SEQ ID NO: 2335299 - DNA, 16 bp, Homo sapiens
aagttgggtgtttcca

SEQ ID NO: 2335300 - DNA, 15 bp, Homo sapiens
aagttgtaaaataga

SEQ ID NO: 2335301 - DNA, 19 bp, Homo sapiens
aagttgtgatctgttgtaa

SEQ ID NO: 2335302 - DNA, 14 bp, Homo sapiens
aagtttcaggtgac

SEQ ID NO: 2335303 - DNA, 15 bp, Homo sapiens
aagtttcaggtgaca

SEQ ID NO: 2335304 - DNA, 22 bp, Homo sapiens
aagtttcaggtgacatgtgaaa

SEQ ID NO: 2335305 - DNA, 20 bp, Homo sapiens
aagttttcctacacttgaga

SEQ ID NO: 2335306 - DNA, 13 bp, Homo sapiens
aagttttgaaaag

SEQ ID NO: 2335307 - DNA, 19 bp, Homo sapiens
aagttttgtaaaagaaatc

SEQ ID NO: 2335308 - DNA, 12 bp, Homo sapiens
aagtttttttgc

SEQ ID NO: 2335309 - DNA, 13 bp, Homo sapiens
aataaaaacaact

SEQ ID NO: 2335310 - DNA, 14 bp, Homo sapiens
aataaaaacaactt

SEQ ID NO: 2335311 - DNA, 11 bp, Homo sapiens
aataaaaatat

SEQ ID NO: 2335312 - DNA, 14 bp, Homo sapiens
aataaaaatatatt

SEQ ID NO: 2335313 - DNA, 17 bp, Homo sapiens
aataaaaatatgtaatt

SEQ ID NO: 2335314 - DNA, 12 bp, Homo sapiens
aataaaacaaat

SEQ ID NO: 2335315 - DNA, 20 bp, Homo sapiens
aataaaacccgttgattact

SEQ ID NO: 2335316 - DNA, 17 bp, Homo sapiens
aataaaagaacatgctt

SEQ ID NO: 2335317 - DNA, 15 bp, Homo sapiens
aataaaataattcta

SEQ ID NO: 2335318 - DNA, 15 bp, Homo sapiens
aataaaatatatctt

SEQ ID NO: 2335319 - DNA, 13 bp, Homo sapiens
aataaaatgaaaa

SEQ ID NO: 2335320 - DNA, 19 bp, Homo sapiens
aataaaatgaaaattgtat

SEQ ID NO: 2335321 - DNA, 18 bp, Homo sapiens
aataaaatgtttcattat

SEQ ID NO: 2335322 - DNA, 12 bp, Homo sapiens
aataaaatttaa

SEQ ID NO: 2335323 - DNA, 13 bp, Homo sapiens
aataaagatgagt

SEQ ID NO: 2335324 - DNA, 12 bp, Homo sapiens
aataaagtataa

SEQ ID NO: 2335325 - DNA, 13 bp, Homo sapiens
aataaatatgaaa

SEQ ID NO: 2335326 - DNA, 16 bp, Homo sapiens
aataaatatgaaagta

SEQ ID NO: 2335327 - DNA, 21 bp, Homo sapiens
aataaatcattcttactaaaa

SEQ ID NO: 2335328 - DNA, 12 bp, Homo sapiens
aataaatgtgtt

SEQ ID NO: 2335329 - DNA, 14 bp, Homo sapiens
aataacaatgttaa

SEQ ID NO: 2335330 - DNA, 20 bp, Homo sapiens
aataacaatgttaaggaaac

SEQ ID NO: 2335331 - DNA, 24 bp, Homo sapiens
aataacaatgttaaggaaactctt

SEQ ID NO: 2335332 - DNA, 12 bp, Homo sapiens
aataacagctgc

SEQ ID NO: 2335333 - DNA, 12 bp, Homo sapiens
aataactgtgta

SEQ ID NO: 2335334 - DNA, 17 bp, Homo sapiens
aataagaaacagtttaa

SEQ ID NO: 2335335 - DNA, 19 bp, Homo sapiens
aataagaaacagtttaaca

SEQ ID NO: 2335336 - DNA, 20 bp, Homo sapiens
aataagaaacagtttaacag

SEQ ID NO: 2335337 - DNA, 15 bp, Homo sapiens
aataagattaataag

SEQ ID NO: 2335338 - DNA, 16 bp, Homo sapiens
aataagatttttcaaa

SEQ ID NO: 2335339 - DNA, 18 bp, Homo sapiens
aataagatttttcaaaat

SEQ ID NO: 2335340 - DNA, 19 bp, Homo sapiens
aataagcactgtaaacttc

SEQ ID NO: 2335341 - DNA, 14 bp, Homo sapiens
aataaggatttttc

SEQ ID NO: 2335342 - DNA, 17 bp, Homo sapiens
aataagtgccctctccc

SEQ ID NO: 2335343 - DNA, 21 bp, Homo sapiens
aataagttcaaattcttctga

SEQ ID NO: 2335344 - DNA, 16 bp, Homo sapiens
aataataaatgccctc

SEQ ID NO: 2335345 - DNA, 20 bp, Homo sapiens
aataatactgacctacctca

SEQ ID NO: 2335346 - DNA, 14 bp, Homo sapiens
aataatagactgta

SEQ ID NO: 2335347 - DNA, 12 bp, Homo sapiens
aataatgaaaat

SEQ ID NO: 2335348 - DNA, 16 bp, Homo sapiens
aataatgcttttctaa

SEQ ID NO: 2335349 - DNA, 17 bp, Homo sapiens
aataatgcttttctaat

SEQ ID NO: 2335350 - DNA, 15 bp, Homo sapiens
aataattcatatcta

SEQ ID NO: 2335351 - DNA, 12 bp, Homo sapiens
aataatttgaat

SEQ ID NO: 2335352 - DNA, 18 bp, Homo sapiens
aataattttcattttgca

SEQ ID NO: 2335353 - DNA, 13 bp, Homo sapiens
aataattttggaa

SEQ ID NO: 2335354 - DNA, 22 bp, Homo sapiens
aatacaacacattgaaactgta

SEQ ID NO: 2335355 - DNA, 16 bp, Homo sapiens
aatacactagttgttt

SEQ ID NO: 2335356 - DNA, 15 bp, Homo sapiens
aatacagaatcttgt

SEQ ID NO: 2335357 - DNA, 18 bp, Homo sapiens
aatacagcaacaatttat

SEQ ID NO: 2335358 - DNA, 21 bp, Homo sapiens
aatacagcctatagtaaatgt

SEQ ID NO: 2335359 - DNA, 18 bp, Homo sapiens
aatacatgccacatcaaa

SEQ ID NO: 2335360 - DNA, 17 bp, Homo sapiens
aatacattaacggtgct

SEQ ID NO: 2335361 - DNA, 19 bp, Homo sapiens
aatacattaacggtgctaa

SEQ ID NO: 2335362 - DNA, 18 bp, Homo sapiens
aatactcttaaattttat

SEQ ID NO: 2335363 - DNA, 19 bp, Homo sapiens
aatactcttaaattttata

SEQ ID NO: 2335364 - DNA, 15 bp, Homo sapiens
aatactgcttagcat

SEQ ID NO: 2335365 - DNA, 15 bp, Homo sapiens
aatacttccagaagt

SEQ ID NO: 2335366 - DNA, 15 bp, Homo sapiens
aatacttctttgtta

SEQ ID NO: 2335367 - DNA, 20 bp, Homo sapiens
aatacttctttgttattata

SEQ ID NO: 2335368 - DNA, 12 bp, Homo sapiens
aatagaaaaagt

SEQ ID NO: 2335369 - DNA, 15 bp, Homo sapiens
aatagaaagaagcca

SEQ ID NO: 2335370 - DNA, 16 bp, Homo sapiens
aatagaaattttgtaa

SEQ ID NO: 2335371 - DNA, 15 bp, Homo sapiens
aatagacaaaaagta

SEQ ID NO: 2335372 - DNA, 14 bp, Homo sapiens
acacattaatgata

SEQ ID NO: 2335373 - DNA, 15 bp, Homo sapiens
acacattaatgataa

SEQ ID NO: 2335374 - DNA, 18 bp, Homo sapiens
acacattacaaagttaaa

SEQ ID NO: 2335375 - DNA, 19 bp, Homo sapiens
acacattatgttagagagg

SEQ ID NO: 2335376 - DNA, 17 bp, Homo sapiens
acacattgaaactgtat

SEQ ID NO: 2335377 - DNA, 22 bp, Homo sapiens
acacattgaaactgtatttact

SEQ ID NO: 2335378 - DNA, 15 bp, Homo sapiens
acacattttttagga

SEQ ID NO: 2335379 - DNA, 18 bp, Homo sapiens
acaccagagcagatgcag

SEQ ID NO: 2335380 - DNA, 16 bp, Homo sapiens
acaccagcaacattat

SEQ ID NO: 2335381 - DNA, 21 bp, Homo sapiens
acaccattaccaaaataataa

SEQ ID NO: 2335382 - DNA, 19 bp, Homo sapiens
acacccaggggaaggccct

SEQ ID NO: 2335383 - DNA, 22 bp, Homo sapiens
acacccaggggaaggccctgag

SEQ ID NO: 2335384 - DNA, 20 bp, Homo sapiens
acaccccccgccccccacct

SEQ ID NO: 2335385 - DNA, 14 bp, Homo sapiens
acacccctctgtct

SEQ ID NO: 2335386 - DNA, 21 bp, Homo sapiens
acacccctctgtctaggactg

SEQ ID NO: 2335387 - DNA, 14 bp, Homo sapiens
acacccctgtgctc

SEQ ID NO: 2335388 - DNA, 22 bp, Homo sapiens
acacccctgtgctcccctgcca

SEQ ID NO: 2335389 - DNA, 17 bp, Homo sapiens
acacccttctcccactc

SEQ ID NO: 2335390 - DNA, 22 bp, Homo sapiens
acacctattatcccagctgcct

SEQ ID NO: 2335391 - DNA, 18 bp, Homo sapiens
acacgagccacaagctgc

SEQ ID NO: 2335392 - DNA, 15 bp, Homo sapiens
acacgatgcatttaa

SEQ ID NO: 2335393 - DNA, 24 bp, Homo sapiens
acacgatgcatttaataaagatga

SEQ ID NO: 2335394 - DNA, 23 bp, Homo sapiens
acacgattttcaagattctaaag

SEQ ID NO: 2335395 - DNA, 12 bp, Homo sapiens
acacgtgtcctg

SEQ ID NO: 2335396 - DNA, 22 bp, Homo sapiens
acacgttgccaggggcttgaga

SEQ ID NO: 2335397 - DNA, 17 bp, Homo sapiens
acactaactcaccagcc

SEQ ID NO: 2335398 - DNA, 17 bp, Homo sapiens
acactcagtccactgtt

SEQ ID NO: 2335399 - DNA, 18 bp, Homo sapiens
acactcagtccactgttg

SEQ ID NO: 2335400 - DNA, 21 bp, Homo sapiens
acactcccaaggttggagccc

SEQ ID NO: 2335401 - DNA, 22 bp, Homo sapiens
acactctagtgacttcctggtg

SEQ ID NO: 2335402 - DNA, 13 bp, Homo sapiens
acactcttcttga

SEQ ID NO: 2335403 - DNA, 13 bp, Homo sapiens
acactgaaagttt

SEQ ID NO: 2335404 - DNA, 17 bp, Homo sapiens
acactgaaagttttgta

SEQ ID NO: 2335405 - DNA, 18 bp, Homo sapiens
acactgaaagttttgtaa

SEQ ID NO: 2335406 - DNA, 20 bp, Homo sapiens
acactgaaagttttgtaaaa

SEQ ID NO: 2335407 - DNA, 19 bp, Homo sapiens
acactgggtgcgtctccag

SEQ ID NO: 2335408 - DNA, 20 bp, Homo sapiens
acacttattggaactctgct

SEQ ID NO: 2335409 - DNA, 16 bp, Homo sapiens
acacttcttgaaacag

SEQ ID NO: 2335410 - DNA, 14 bp, Homo sapiens
acagaaatgctgct

SEQ ID NO: 2335411 - DNA, 21 bp, Homo sapiens
acagaaatgctgctggccaaa

SEQ ID NO: 2335412 - DNA, 17 bp, Homo sapiens
acagaaatggaaagcag

SEQ ID NO: 2335413 - DNA, 15 bp, Homo sapiens
acagaaatggactgg

SEQ ID NO: 2335414 - DNA, 13 bp, Homo sapiens
acagaacagcttc

SEQ ID NO: 2335415 - DNA, 18 bp, Homo sapiens
acagaacagcttcaggtt

SEQ ID NO: 2335416 - DNA, 20 bp, Homo sapiens
acagaacagcttcaggttat

SEQ ID NO: 2335417 - DNA, 16 bp, Homo sapiens
acagaatatttttata

SEQ ID NO: 2335418 - DNA, 19 bp, Homo sapiens
acagaatcttccttttatt

SEQ ID NO: 2335419 - DNA, 14 bp, Homo sapiens
acagaatcttctgg

SEQ ID NO: 2335420 - DNA, 13 bp, Homo sapiens
acagaatttgaat

SEQ ID NO: 2335421 - DNA, 23 bp, Homo sapiens
acagaatttgaattatcagcaaa

SEQ ID NO: 2335422 - DNA, 22 bp, Homo sapiens
acagacactaacgaaatatcaa

SEQ ID NO: 2335423 - DNA, 21 bp, Homo sapiens
acagagaaattctgtggtggg

SEQ ID NO: 2335424 - DNA, 11 bp, Homo sapiens
acagagccatg

SEQ ID NO: 2335425 - DNA, 14 bp, Homo sapiens
acagagctctgggt

SEQ ID NO: 2335426 - DNA, 17 bp, Homo sapiens
acagaggaaagggctgg

SEQ ID NO: 2335427 - DNA, 20 bp, Homo sapiens
acagaggaaagggctggctc

SEQ ID NO: 2335428 - DNA, 17 bp, Homo sapiens
acagaggagcttttctg

SEQ ID NO: 2335429 - DNA, 20 bp, Homo sapiens
acagaggatgccttttctgt

SEQ ID NO: 2335430 - DNA, 21 bp, Homo sapiens
acagaggatgccttttctgtg

SEQ ID NO: 2335431 - DNA, 19 bp, Homo sapiens
acagaggtattaaaactaa

SEQ ID NO: 2335432 - DNA, 17 bp, Homo sapiens
acagagtgaaaaatctt

SEQ ID NO: 2335433 - DNA, 15 bp, Homo sapiens
acagataacataaat

SEQ ID NO: 2335434 - DNA, 19 bp, Homo sapiens
acagatggaaaaactgagg

SEQ ID NO: 2335435 - DNA, 21 bp, Homo sapiens
acagatggaaaaactgaggct

SEQ ID NO: 2335436 - DNA, 20 bp, Homo sapiens
acagcaacaatttatgaatt

SEQ ID NO: 2335437 - DNA, 12 bp, Homo sapiens
acagcagaagcc

SEQ ID NO: 2335438 - DNA, 13 bp, Homo sapiens
acagcagaagcct

SEQ ID NO: 2335439 - DNA, 13 bp, Homo sapiens
acagcagctcata

SEQ ID NO: 2335440 - DNA, 16 bp, Homo sapiens
acagcagctcatagaa

SEQ ID NO: 2335441 - DNA, 22 bp, Homo sapiens
acagcagctcatagaattttga

SEQ ID NO: 2335442 - DNA, 18 bp, Homo sapiens
acagcagggtcttgctgt

SEQ ID NO: 2335443 - DNA, 18 bp, Homo sapiens
acagccagaggagggcag

SEQ ID NO: 2335444 - DNA, 19 bp, Homo sapiens
acagccagaggagggcaga

SEQ ID NO: 2335445 - DNA, 15 bp, Homo sapiens
acagcccaggatact

SEQ ID NO: 2335446 - DNA, 13 bp, Homo sapiens
acagcctttgaat

SEQ ID NO: 2335447 - DNA, 17 bp, Homo sapiens
acagcctttgaatgtaa

SEQ ID NO: 2335448 - DNA, 22 bp, Homo sapiens
acagcctttgaatgtaaccaat

SEQ ID NO: 2335449 - DNA, 15 bp, Homo sapiens
acagcgagggcagct

SEQ ID NO: 2335450 - DNA, 14 bp, Homo sapiens
acagcgtccctggc

SEQ ID NO: 2335451 - DNA, 14 bp, Homo sapiens
acagctcaggaggc

SEQ ID NO: 2335452 - DNA, 18 bp, Homo sapiens
acagctgcaattccctgg

SEQ ID NO: 2335453 - DNA, 17 bp, Homo sapiens
acagctgctgttctcag

SEQ ID NO: 2335454 - DNA, 12 bp, Homo sapiens
acagctgtgtct

SEQ ID NO: 2335455 - DNA, 14 bp, Homo sapiens
acagctgtgtctgc

SEQ ID NO: 2335456 - DNA, 22 bp, Homo sapiens
acagctgtgtctgccaaacaca

SEQ ID NO: 2335457 - DNA, 23 bp, Homo sapiens
acagctgtgtgacatttggagag

SEQ ID NO: 2335458 - DNA, 13 bp, Homo sapiens
acagcttcaggtt

SEQ ID NO: 2335459 - DNA, 22 bp, Homo sapiens
acagcttgagccgggcccctgg

SEQ ID NO: 2335460 - DNA, 14 bp, Homo sapiens
acagctttctggga

SEQ ID NO: 2335461 - DNA, 22 bp, Homo sapiens
acagctttctgggatgtcacag

SEQ ID NO: 2335462 - DNA, 15 bp, Homo sapiens
acaggagacaaaaga

SEQ ID NO: 2335463 - DNA, 9 bp, Homo sapiens
acaggcagc

SEQ ID NO: 2335464 - DNA, 11 bp, Homo sapiens
acaggcagccc

SEQ ID NO: 2335465 - DNA, 14 bp, Homo sapiens
acaggcagcccagc

SEQ ID NO: 2335466 - DNA, 17 bp, Homo sapiens
acaggccaggctccagc

SEQ ID NO: 2335467 - DNA, 15 bp, Homo sapiens
acagggtcttgctct

SEQ ID NO: 2335468 - DNA, 20 bp, Homo sapiens
acagggtcttgctctgtccc

SEQ ID NO: 2335469 - DNA, 14 bp, Homo sapiens
acaggtaaaacagg

SEQ ID NO: 2335470 - DNA, 15 bp, Homo sapiens
acaggtcttttcaaa

SEQ ID NO: 2335471 - DNA, 23 bp, Homo sapiens
acaggtgcgcgccaccgtgcctg

SEQ ID NO: 2335472 - DNA, 20 bp, Homo sapiens
acaggttcttaaaaaggaac

SEQ ID NO: 2335473 - DNA, 22 bp, Homo sapiens
acagtactggttactttcaaaa

SEQ ID NO: 2335474 - DNA, 19 bp, Homo sapiens
acagtagaactgtctgtga

SEQ ID NO: 2335475 - DNA, 14 bp, Homo sapiens
acagtagagccagc

SEQ ID NO: 2335476 - DNA, 23 bp, Homo sapiens
acagtatgtgggatattgaatgt

SEQ ID NO: 2335477 - DNA, 12 bp, Homo sapiens
acagtcacctca

SEQ ID NO: 2335478 - DNA, 17 bp, Homo sapiens
acagtgcctcttccagt

SEQ ID NO: 2335479 - DNA, 19 bp, Homo sapiens
acagtgcctcttccagtga

SEQ ID NO: 2335480 - DNA, 22 bp, Homo sapiens
acagtgcctcttccagtgaaca

SEQ ID NO: 2335481 - DNA, 14 bp, Homo sapiens
acagtggcagtatt

SEQ ID NO: 2335482 - DNA, 16 bp, Homo sapiens
acagtgttgtgcccct

SEQ ID NO: 2335483 - DNA, 16 bp, Homo sapiens
acagttctttcctctt

SEQ ID NO: 2335484 - DNA, 20 bp, Homo sapiens
acagttctttcctctttctg

SEQ ID NO: 2335485 - DNA, 21 bp, Homo sapiens
acagtttaacagaaaaatgaa

SEQ ID NO: 2335486 - DNA, 16 bp, Homo sapiens
acccttctcccactct

SEQ ID NO: 2335487 - DNA, 21 bp, Homo sapiens
accctttggtttttttcttct

SEQ ID NO: 2335488 - DNA, 23 bp, Homo sapiens
accgaatattcatggatggctca

SEQ ID NO: 2335489 - DNA, 18 bp, Homo sapiens
accgcacagctcaggagg

SEQ ID NO: 2335490 - DNA, 11 bp, Homo sapiens
accgcccatca

SEQ ID NO: 2335491 - DNA, 16 bp, Homo sapiens
accgcccctggccgcg

SEQ ID NO: 2335492 - DNA, 18 bp, Homo sapiens
accgcgggtgtgggaaag

SEQ ID NO: 2335493 - DNA, 15 bp, Homo sapiens
accgctggcccttag

SEQ ID NO: 2335494 - DNA, 18 bp, Homo sapiens
accgctggcccttagaga

SEQ ID NO: 2335495 - DNA, 13 bp, Homo sapiens
accgctgggtggt

SEQ ID NO: 2335496 - DNA, 17 bp, Homo sapiens
accgctgggtggttttt

SEQ ID NO: 2335497 - DNA, 18 bp, Homo sapiens
accggcctgtgggtctct

SEQ ID NO: 2335498 - DNA, 20 bp, Homo sapiens
accggcctgtgggtctctga

SEQ ID NO: 2335499 - DNA, 21 bp, Homo sapiens
accggcctgtgggtctctgaa

SEQ ID NO: 2335500 - DNA, 14 bp, Homo sapiens
accggtccagctgg

SEQ ID NO: 2335501 - DNA, 15 bp, Homo sapiens
accggtccagctggc

SEQ ID NO: 2335502 - DNA, 22 bp, Homo sapiens
accgtggaggaggaaggcaaga

SEQ ID NO: 2335503 - DNA, 17 bp, Homo sapiens
acctaaagcaagcctga

SEQ ID NO: 2335504 - DNA, 20 bp, Homo sapiens
acctaatgtttatgagccag

SEQ ID NO: 2335505 - DNA, 13 bp, Homo sapiens
acctacacccctg

SEQ ID NO: 2335506 - DNA, 18 bp, Homo sapiens
acctacacccctgtgctc

SEQ ID NO: 2335507 - DNA, 23 bp, Homo sapiens
acctacatatgctgatcttttaa

SEQ ID NO: 2335508 - DNA, 21 bp, Homo sapiens
acctactttgactttttgcat

SEQ ID NO: 2335509 - DNA, 21 bp, Homo sapiens
acctagcaggctgttccatgt

SEQ ID NO: 2335510 - DNA, 17 bp, Homo sapiens
acctatagcatcttctc

SEQ ID NO: 2335511 - DNA, 14 bp, Homo sapiens
acctcaaagggcag

SEQ ID NO: 2335512 - DNA, 20 bp, Homo sapiens
acctcaaagggcagttttga

SEQ ID NO: 2335513 - DNA, 21 bp, Homo sapiens
acctcaaagggcagttttgag

SEQ ID NO: 2335514 - DNA, 20 bp, Homo sapiens
acctcaagggggactgtctt

SEQ ID NO: 2335515 - DNA, 15 bp, Homo sapiens
acctcaccttcctgt

SEQ ID NO: 2335516 - DNA, 17 bp, Homo sapiens
acctcaccttcctgtgg

SEQ ID NO: 2335517 - DNA, 14 bp, Homo sapiens
acctcacgctctgg

SEQ ID NO: 2335518 - DNA, 12 bp, Homo sapiens
acctcagggctc

SEQ ID NO: 2335519 - DNA, 12 bp, Homo sapiens
acctcagtagaa

SEQ ID NO: 2335520 - DNA, 14 bp, Homo sapiens
acctcagtagaaaa

SEQ ID NO: 2335521 - DNA, 16 bp, Homo sapiens
acctcatgcccacccc

SEQ ID NO: 2335522 - DNA, 16 bp, Homo sapiens
acctcatgcccagctc

SEQ ID NO: 2335523 - DNA, 20 bp, Homo sapiens
acctcatgcccagctctctg

SEQ ID NO: 2335524 - DNA, 21 bp, Homo sapiens
acctcatgcccagctctctga

SEQ ID NO: 2335525 - DNA, 12 bp, Homo sapiens
acctccacccac

SEQ ID NO: 2335526 - DNA, 22 bp, Homo sapiens
acctccacccactgtccgcctc

SEQ ID NO: 2335527 - DNA, 13 bp, Homo sapiens
acctccaggctcc

SEQ ID NO: 2335528 - DNA, 20 bp, Homo sapiens
acctccaggctccagcacat

SEQ ID NO: 2335529 - DNA, 23 bp, Homo sapiens
acctccaggctccagcacatccc

SEQ ID NO: 2335530 - DNA, 19 bp, Homo sapiens
acctcctgacacccttctc

SEQ ID NO: 2335531 - DNA, 22 bp, Homo sapiens
acctcctgacacccttctccca

SEQ ID NO: 2335532 - DNA, 16 bp, Homo sapiens
acctctcaagctagtg

SEQ ID NO: 2335533 - DNA, 21 bp, Homo sapiens
acctctcgccatgatcagaca

SEQ ID NO: 2335534 - DNA, 16 bp, Homo sapiens
acctctttttcctcct

SEQ ID NO: 2335535 - DNA, 17 bp, Homo sapiens
acctctttttcctcctg

SEQ ID NO: 2335536 - DNA, 18 bp, Homo sapiens
acctctttttcctcctgg

SEQ ID NO: 2335537 - DNA, 21 bp, Homo sapiens
acctgaagtttttttgctgct

SEQ ID NO: 2335538 - DNA, 15 bp, Homo sapiens
acctgacccctgctc

SEQ ID NO: 2335539 - DNA, 16 bp, Homo sapiens
acctgacccctgctca

SEQ ID NO: 2335540 - DNA, 21 bp, Homo sapiens
acctgagctattttcctctgg

SEQ ID NO: 2335541 - DNA, 16 bp, Homo sapiens
acctgattttttttcc

SEQ ID NO: 2335542 - DNA, 13 bp, Homo sapiens
acctgcacacagg

SEQ ID NO: 2335543 - DNA, 14 bp, Homo sapiens
acctgcacacagga

SEQ ID NO: 2335544 - DNA, 18 bp, Homo sapiens
acctgcacacaggacagc

SEQ ID NO: 2335545 - DNA, 21 bp, Homo sapiens
acctgcacacaggacagcggg

SEQ ID NO: 2335546 - DNA, 16 bp, Homo sapiens
acctgcatctggggcc

SEQ ID NO: 2335547 - DNA, 15 bp, Homo sapiens
acctgccaggcaggg

SEQ ID NO: 2335548 - DNA, 13 bp, Homo sapiens
acctgccttggcc

SEQ ID NO: 2335549 - DNA, 14 bp, Homo sapiens
acctgctctcctct

SEQ ID NO: 2335550 - DNA, 15 bp, Homo sapiens
acctgctctcctctt

SEQ ID NO: 2335551 - DNA, 23 bp, Homo sapiens
acctgctctcctcttctactcac

SEQ ID NO: 2335552 - DNA, 16 bp, Homo sapiens
acctgctctgtcccca

SEQ ID NO: 2335553 - DNA, 19 bp, Homo sapiens
acctgctggaaaccacact

SEQ ID NO: 2335554 - DNA, 18 bp, Homo sapiens
acctgcttcacgttggcc

SEQ ID NO: 2335555 - DNA, 20 bp, Homo sapiens
acctggaatctacaagccaa

SEQ ID NO: 2335556 - DNA, 14 bp, Homo sapiens
acctggatggggca

SEQ ID NO: 2335557 - DNA, 16 bp, Homo sapiens
acctggcactgggagg

SEQ ID NO: 2335558 - DNA, 20 bp, Homo sapiens
acctggctctcacctctagg

SEQ ID NO: 2335559 - DNA, 14 bp, Homo sapiens
acctggcttattta

SEQ ID NO: 2335560 - DNA, 17 bp, Homo sapiens
acctggcttatttaata

SEQ ID NO: 2335561 - DNA, 15 bp, Homo sapiens
acctgggatttgaga

SEQ ID NO: 2335562 - DNA, 16 bp, Homo sapiens
acctgtagtcccagct

SEQ ID NO: 2335563 - DNA, 16 bp, Homo sapiens
acctgtatacagtgca

SEQ ID NO: 2335564 - DNA, 13 bp, Homo sapiens
acctgtgtgcttg

SEQ ID NO: 2335565 - DNA, 16 bp, Homo sapiens
acctgttttctgaaac

SEQ ID NO: 2335566 - DNA, 23 bp, Homo sapiens
accttaatgtggggcctcagtta

SEQ ID NO: 2335567 - DNA, 15 bp, Homo sapiens
accttaattattgca

SEQ ID NO: 2335568 - DNA, 22 bp, Homo sapiens
accttaattattgcactagaga

SEQ ID NO: 2335569 - DNA, 22 bp, Homo sapiens
accttcatgattatagcaacta

SEQ ID NO: 2335570 - DNA, 22 bp, Homo sapiens
accttccatacacagaggagtg

SEQ ID NO: 2335571 - DNA, 17 bp, Homo sapiens
accttcccttctacaag

SEQ ID NO: 2335572 - DNA, 22 bp, Homo sapiens
accttcccttctacaaggactc

SEQ ID NO: 2335573 - DNA, 18 bp, Homo sapiens
accttcctgtccctgagg

SEQ ID NO: 2335574 - DNA, 19 bp, Homo sapiens
accttcctgtccctgaggt

SEQ ID NO: 2335575 - DNA, 19 bp, Homo sapiens
accttctgatgaagttgta

SEQ ID NO: 2335576 - DNA, 21 bp, Homo sapiens
accttgcaacctcaccttcct

SEQ ID NO: 2335577 - DNA, 23 bp, Homo sapiens
accttggggccttgatgactgcc

SEQ ID NO: 2335578 - DNA, 12 bp, Homo sapiens
accttgtataaa

SEQ ID NO: 2335579 - DNA, 19 bp, Homo sapiens
acctttcagtgcagtttct

SEQ ID NO: 2335580 - DNA, 18 bp, Homo sapiens
acctttgggatcagcctc

SEQ ID NO: 2335581 - DNA, 18 bp, Homo sapiens
acctttgggttctttctg

SEQ ID NO: 2335582 - DNA, 16 bp, Homo sapiens
accttttttaagattt

SEQ ID NO: 2335583 - DNA, 14 bp, Homo sapiens
acgagccacaagct

SEQ ID NO: 2335584 - DNA, 15 bp, Homo sapiens
acgagccacaagctg

SEQ ID NO: 2335585 - DNA, 21 bp, Homo sapiens
acgagccacaagctgcactgt

SEQ ID NO: 2335586 - DNA, 20 bp, Homo sapiens
acgaggtcaggagatcgaga

SEQ ID NO: 2335587 - DNA, 15 bp, Homo sapiens
acgatgatgtacaga

SEQ ID NO: 2335588 - DNA, 19 bp, Homo sapiens
acgatgcatttaataaaga

SEQ ID NO: 2335589 - DNA, 20 bp, Homo sapiens
acgatgcatttaataaagat

SEQ ID NO: 2335590 - DNA, 23 bp, Homo sapiens
acgatgcatttaataaagatgag

SEQ ID NO: 2335591 - DNA, 17 bp, Homo sapiens
acgcacgctcgctgcca

SEQ ID NO: 2335592 - DNA, 18 bp, Homo sapiens
acgcacgctcgctgccat

SEQ ID NO: 2335593 - DNA, 16 bp, Homo sapiens
acgcagaggacgcacg

SEQ ID NO: 2335594 - DNA, 15 bp, Homo sapiens
acgcagtgcctggag

SEQ ID NO: 2335595 - DNA, 16 bp, Homo sapiens
acgccactccctggga

SEQ ID NO: 2335596 - DNA, 18 bp, Homo sapiens
acgccactccctgggaca

SEQ ID NO: 2335597 - DNA, 19 bp, Homo sapiens
acgccatgtgatggacact

SEQ ID NO: 2335598 - DNA, 15 bp, Homo sapiens
acgcccatctcagga

SEQ ID NO: 2335599 - DNA, 16 bp, Homo sapiens
acgctaaagagccctt

SEQ ID NO: 2335600 - DNA, 20 bp, Homo sapiens
agagaggcttgaaggccagc

SEQ ID NO: 2335601 - DNA, 15 bp, Homo sapiens
agagagttagcatgt

SEQ ID NO: 2335602 - DNA, 15 bp, Homo sapiens
agagataaaacagaa

SEQ ID NO: 2335603 - DNA, 15 bp, Homo sapiens
agagatccctgcaga

SEQ ID NO: 2335604 - DNA, 13 bp, Homo sapiens
agagatgagccca

SEQ ID NO: 2335605 - DNA, 14 bp, Homo sapiens
agagatgagcccac

SEQ ID NO: 2335606 - DNA, 19 bp, Homo sapiens
agagatgagcccaccctgc

SEQ ID NO: 2335607 - DNA, 12 bp, Homo sapiens
agagattataac

SEQ ID NO: 2335608 - DNA, 21 bp, Homo sapiens
agagcaaaagcctcagaaagg

SEQ ID NO: 2335609 - DNA, 14 bp, Homo sapiens
agagcagatgcaga

SEQ ID NO: 2335610 - DNA, 13 bp, Homo sapiens
agagcagcactcc

SEQ ID NO: 2335611 - DNA, 20 bp, Homo sapiens
agagcagctccctttctcag

SEQ ID NO: 2335612 - DNA, 18 bp, Homo sapiens
agagcagctggctctcca

SEQ ID NO: 2335613 - DNA, 14 bp, Homo sapiens
agagcataatttaa

SEQ ID NO: 2335614 - DNA, 10 bp, Homo sapiens
agagccacct

SEQ ID NO: 2335615 - DNA, 12 bp, Homo sapiens
agagccacctgc

SEQ ID NO: 2335616 - DNA, 13 bp, Homo sapiens
agagccacctgca

SEQ ID NO: 2335617 - DNA, 15 bp, Homo sapiens
agagccacctgcaag

SEQ ID NO: 2335618 - DNA, 16 bp, Homo sapiens
agagccacctgcaaga

SEQ ID NO: 2335619 - DNA, 17 bp, Homo sapiens
agagccacctgcaagat

SEQ ID NO: 2335620 - DNA, 20 bp, Homo sapiens
agagccacctgcaagatgga

SEQ ID NO: 2335621 - DNA, 18 bp, Homo sapiens
agagccagaaagggtgcc

SEQ ID NO: 2335622 - DNA, 11 bp, Homo sapiens
agagccagctt

SEQ ID NO: 2335623 - DNA, 12 bp, Homo sapiens
agagccagcttg

SEQ ID NO: 2335624 - DNA, 15 bp, Homo sapiens
agagccatacataaa

SEQ ID NO: 2335625 - DNA, 16 bp, Homo sapiens
agagccatacataaaa

SEQ ID NO: 2335626 - DNA, 19 bp, Homo sapiens
agagccatacataaaagaa

SEQ ID NO: 2335627 - DNA, 16 bp, Homo sapiens
agagccattttgtgaa

SEQ ID NO: 2335628 - DNA, 16 bp, Homo sapiens
agagcccagaggtaac

SEQ ID NO: 2335629 - DNA, 14 bp, Homo sapiens
agagccctgaggcc

SEQ ID NO: 2335630 - DNA, 16 bp, Homo sapiens
agagccgtggtccctg

SEQ ID NO: 2335631 - DNA, 12 bp, Homo sapiens
agagcctgctgg

SEQ ID NO: 2335632 - DNA, 18 bp, Homo sapiens
agagcctggccccaggcc

SEQ ID NO: 2335633 - DNA, 13 bp, Homo sapiens
agagccttctcag

SEQ ID NO: 2335634 - DNA, 17 bp, Homo sapiens
agagcgccaggaagcca

SEQ ID NO: 2335635 - DNA, 19 bp, Homo sapiens
agagctatggtgcttgctg

SEQ ID NO: 2335636 - DNA, 13 bp, Homo sapiens
agagctcaccatg

SEQ ID NO: 2335637 - DNA, 19 bp, Homo sapiens
agagctcaccatggaatga

SEQ ID NO: 2335638 - DNA, 22 bp, Homo sapiens
agagctggagcccccagcagag

SEQ ID NO: 2335639 - DNA, 14 bp, Homo sapiens
agagcttagatttc

SEQ ID NO: 2335640 - DNA, 14 bp, Homo sapiens
agagcttgctccag

SEQ ID NO: 2335641 - DNA, 23 bp, Homo sapiens
agagcttgctccagattctgatg

SEQ ID NO: 2335642 - DNA, 22 bp, Homo sapiens
agaggacctatcccaaatgtgg

SEQ ID NO: 2335643 - DNA, 17 bp, Homo sapiens
agaggacgcacgctcgc

SEQ ID NO: 2335644 - DNA, 13 bp, Homo sapiens
agaggagggcaga

SEQ ID NO: 2335645 - DNA, 17 bp, Homo sapiens
agaggatgccttttctg

SEQ ID NO: 2335646 - DNA, 14 bp, Homo sapiens
agaggcaggctggg

SEQ ID NO: 2335647 - DNA, 17 bp, Homo sapiens
agaggcaggctgggacg

SEQ ID NO: 2335648 - DNA, 20 bp, Homo sapiens
agaggccagttgatctgctc

SEQ ID NO: 2335649 - DNA, 21 bp, Homo sapiens
agaggccagttgatctgctct

SEQ ID NO: 2335650 - DNA, 17 bp, Homo sapiens
agaggcgcgtctgcccc

SEQ ID NO: 2335651 - DNA, 17 bp, Homo sapiens
agaggctagcttctgct

SEQ ID NO: 2335652 - DNA, 16 bp, Homo sapiens
agaggctctggacagc

SEQ ID NO: 2335653 - DNA, 19 bp, Homo sapiens
agaggctctggacagcaga

SEQ ID NO: 2335654 - DNA, 13 bp, Homo sapiens
agaggctgaggga

SEQ ID NO: 2335655 - DNA, 16 bp, Homo sapiens
agaggctgcacccctg

SEQ ID NO: 2335656 - DNA, 20 bp, Homo sapiens
agaggctgcacccctgggcc

SEQ ID NO: 2335657 - DNA, 14 bp, Homo sapiens
agaggctgcccctc

SEQ ID NO: 2335658 - DNA, 19 bp, Homo sapiens
agaggctgcccctctcacc

SEQ ID NO: 2335659 - DNA, 20 bp, Homo sapiens
agaggctgcccctctcacca

SEQ ID NO: 2335660 - DNA, 17 bp, Homo sapiens
agaggcttctccgccag

SEQ ID NO: 2335661 - DNA, 16 bp, Homo sapiens
agagggagaagcatga

SEQ ID NO: 2335662 - DNA, 18 bp, Homo sapiens
agagggatttccctgcag

SEQ ID NO: 2335663 - DNA, 22 bp, Homo sapiens
agagggggcctgggacttccat

SEQ ID NO: 2335664 - DNA, 18 bp, Homo sapiens
agaggtaacagaacagct

SEQ ID NO: 2335665 - DNA, 20 bp, Homo sapiens
agaggtaacagaacagcttc

SEQ ID NO: 2335666 - DNA, 19 bp, Homo sapiens
agaggtcaggacggctcct

SEQ ID NO: 2335667 - DNA, 20 bp, Homo sapiens
agaggtcaggacggctcctc

SEQ ID NO: 2335668 - DNA, 18 bp, Homo sapiens
agaggtcctctggagccc

SEQ ID NO: 2335669 - DNA, 21 bp, Homo sapiens
agaggtggatgttatgaacag

SEQ ID NO: 2335670 - DNA, 17 bp, Homo sapiens
agaggttttaatgtctg

SEQ ID NO: 2335671 - DNA, 18 bp, Homo sapiens
agaggttttaatgtctgt

SEQ ID NO: 2335672 - DNA, 15 bp, Homo sapiens
agagtatttcccttc

SEQ ID NO: 2335673 - DNA, 20 bp, Homo sapiens
agagtatttcccttccaaag

SEQ ID NO: 2335674 - DNA, 21 bp, Homo sapiens
agagtattttaagaagacata

SEQ ID NO: 2335675 - DNA, 21 bp, Homo sapiens
agagtcaactacacaaagcag

SEQ ID NO: 2335676 - DNA, 16 bp, Homo sapiens
agagtcagctctctgc

SEQ ID NO: 2335677 - DNA, 17 bp, Homo sapiens
agagtcagctctctgcc

SEQ ID NO: 2335678 - DNA, 20 bp, Homo sapiens
agagtcagctctctgccctg

SEQ ID NO: 2335679 - DNA, 21 bp, Homo sapiens
agagtcagctctctgccctgt

SEQ ID NO: 2335680 - DNA, 16 bp, Homo sapiens
agagtccggatttcta

SEQ ID NO: 2335681 - DNA, 22 bp, Homo sapiens
agagtgaagggaagagacagcc

SEQ ID NO: 2335682 - DNA, 20 bp, Homo sapiens
agagtgagctttagctctct

SEQ ID NO: 2335683 - DNA, 23 bp, Homo sapiens
agagtgatttgtaaaacagtggt

SEQ ID NO: 2335684 - DNA, 21 bp, Homo sapiens
agagtggtgggggaaggctgt

SEQ ID NO: 2335685 - DNA, 17 bp, Homo sapiens
agagtgtagaagcattc

SEQ ID NO: 2335686 - DNA, 18 bp, Homo sapiens
agagtgtagaagcattcc

SEQ ID NO: 2335687 - DNA, 17 bp, Homo sapiens
agagttaagaagctgtt

SEQ ID NO: 2335688 - DNA, 18 bp, Homo sapiens
agagttaagaagctgttg

SEQ ID NO: 2335689 - DNA, 20 bp, Homo sapiens
agagttcccttgaaactttg

SEQ ID NO: 2335690 - DNA, 12 bp, Homo sapiens
agagttcctcct

SEQ ID NO: 2335691 - DNA, 14 bp, Homo sapiens
agagttccttctca

SEQ ID NO: 2335692 - DNA, 16 bp, Homo sapiens
agagttccttctcact

SEQ ID NO: 2335693 - DNA, 19 bp, Homo sapiens
agagttgggtgtctcctta

SEQ ID NO: 2335694 - DNA, 22 bp, Homo sapiens
agagttgggtgtctccttaagc

SEQ ID NO: 2335695 - DNA, 21 bp, Homo sapiens
agagtttcagtttgttggaaa

SEQ ID NO: 2335696 - DNA, 20 bp, Homo sapiens
agataaaacagaatcttctg

SEQ ID NO: 2335697 - DNA, 15 bp, Homo sapiens
agataaaaggtggag

SEQ ID NO: 2335698 - DNA, 22 bp, Homo sapiens
agataaaaggtggagtttctct

SEQ ID NO: 2335699 - DNA, 16 bp, Homo sapiens
agataagcaagagaga

SEQ ID NO: 2335700 - DNA, 20 bp, Homo sapiens
agataagcaagagagatgtt

SEQ ID NO: 2335701 - DNA, 20 bp, Homo sapiens
agataatattgtttggtaaa

SEQ ID NO: 2335702 - DNA, 21 bp, Homo sapiens
agataatatttttgtatttct

SEQ ID NO: 2335703 - DNA, 15 bp, Homo sapiens
agataatttcagggt

SEQ ID NO: 2335704 - DNA, 21 bp, Homo sapiens
agatacatggttgtgacctga

SEQ ID NO: 2335705 - DNA, 21 bp, Homo sapiens
agataccttgaaaggcaggaa

SEQ ID NO: 2335706 - DNA, 15 bp, Homo sapiens
agatatgtattcttt

SEQ ID NO: 2335707 - DNA, 19 bp, Homo sapiens
agatattgtgaagtacata

SEQ ID NO: 2335708 - DNA, 19 bp, Homo sapiens
agatcaaatagttgcatag

SEQ ID NO: 2335709 - DNA, 14 bp, Homo sapiens
agatcactgccaca

SEQ ID NO: 2335710 - DNA, 11 bp, Homo sapiens
agatcactttc

SEQ ID NO: 2335711 - DNA, 16 bp, Homo sapiens
agatcctaagatgtgt

SEQ ID NO: 2335712 - DNA, 17 bp, Homo sapiens
agatcgagaccatcctg

SEQ ID NO: 2335713 - DNA, 20 bp, Homo sapiens
agatcgagaccatcctggct

SEQ ID NO: 2335714 - DNA, 12 bp, Homo sapiens
agatctccagcg

SEQ ID NO: 2335715 - DNA, 17 bp, Homo sapiens
aggatcatggtgtaata

SEQ ID NO: 2335716 - DNA, 18 bp, Homo sapiens
aggatcatggtgtaataa

SEQ ID NO: 2335717 - DNA, 13 bp, Homo sapiens
aggatccagagag

SEQ ID NO: 2335718 - DNA, 16 bp, Homo sapiens
aggatccagagagcag

SEQ ID NO: 2335719 - DNA, 23 bp, Homo sapiens
aggatcggactctgcccctggac

SEQ ID NO: 2335720 - DNA, 19 bp, Homo sapiens
aggatctataggcagcttc

SEQ ID NO: 2335721 - DNA, 15 bp, Homo sapiens
aggatctgctgaggc

SEQ ID NO: 2335722 - DNA, 23 bp, Homo sapiens
aggatctgctgaggcccagtgca

SEQ ID NO: 2335723 - DNA, 14 bp, Homo sapiens
aggatgagagccca

SEQ ID NO: 2335724 - DNA, 20 bp, Homo sapiens
aggatgagagcccagaggta

SEQ ID NO: 2335725 - DNA, 12 bp, Homo sapiens
aggatgcctttt

SEQ ID NO: 2335726 - DNA, 15 bp, Homo sapiens
aggatgctaaagatg

SEQ ID NO: 2335727 - DNA, 16 bp, Homo sapiens
aggatggcctttcctt

SEQ ID NO: 2335728 - DNA, 22 bp, Homo sapiens
aggatggcctttccttccctct

SEQ ID NO: 2335729 - DNA, 23 bp, Homo sapiens
aggatggttttgggactagaggc

SEQ ID NO: 2335730 - DNA, 13 bp, Homo sapiens
aggattgtaaaaa

SEQ ID NO: 2335731 - DNA, 23 bp, Homo sapiens
aggattttaacttaactgaaatg

SEQ ID NO: 2335732 - DNA, 17 bp, Homo sapiens
aggcaaagaaaatgaaa

SEQ ID NO: 2335733 - DNA, 15 bp, Homo sapiens
aggcaagctgaaatt

SEQ ID NO: 2335734 - DNA, 15 bp, Homo sapiens
aggcaccgagaatgt

SEQ ID NO: 2335735 - DNA, 14 bp, Homo sapiens
aggcacctcttcct

SEQ ID NO: 2335736 - DNA, 13 bp, Homo sapiens
aggcactcagtga

SEQ ID NO: 2335737 - DNA, 17 bp, Homo sapiens
aggcactcagtgagcct

SEQ ID NO: 2335738 - DNA, 13 bp, Homo sapiens
aggcagagaaatc

SEQ ID NO: 2335739 - DNA, 23 bp, Homo sapiens
aggcagagctggagcccccagca

SEQ ID NO: 2335740 - DNA, 15 bp, Homo sapiens
aggcagatgtttgcc

SEQ ID NO: 2335741 - DNA, 17 bp, Homo sapiens
aggcagattgaaaagga

SEQ ID NO: 2335742 - DNA, 20 bp, Homo sapiens
aggcagattttacagagcgc

SEQ ID NO: 2335743 - DNA, 13 bp, Homo sapiens
aggcagcccagca

SEQ ID NO: 2335744 - DNA, 20 bp, Homo sapiens
aggcagcccagcagtgtgga

SEQ ID NO: 2335745 - DNA, 22 bp, Homo sapiens
aggcagcccagcagtgtggaga

SEQ ID NO: 2335746 - DNA, 17 bp, Homo sapiens
aggcagcctcctttgtg

SEQ ID NO: 2335747 - DNA, 11 bp, Homo sapiens
aggcagcctgc

SEQ ID NO: 2335748 - DNA, 13 bp, Homo sapiens
aggcagctccctc

SEQ ID NO: 2335749 - DNA, 16 bp, Homo sapiens
aggcaggaagggaagc

SEQ ID NO: 2335750 - DNA, 15 bp, Homo sapiens
aggcagggctctccc

SEQ ID NO: 2335751 - DNA, 22 bp, Homo sapiens
aggcaggggtgggggtggaggc

SEQ ID NO: 2335752 - DNA, 19 bp, Homo sapiens
aggcagtattttgtgtcct

SEQ ID NO: 2335753 - DNA, 15 bp, Homo sapiens
aggcatagaggcttc

SEQ ID NO: 2335754 - DNA, 22 bp, Homo sapiens
aggcataggtctctttgctttc

SEQ ID NO: 2335755 - DNA, 14 bp, Homo sapiens
aggcatgtggcctt

SEQ ID NO: 2335756 - DNA, 21 bp, Homo sapiens
aggcatttgcctaattcctgg

SEQ ID NO: 2335757 - DNA, 14 bp, Homo sapiens
aggccagcctccga

SEQ ID NO: 2335758 - DNA, 17 bp, Homo sapiens
aggccagcctccgagag

SEQ ID NO: 2335759 - DNA, 18 bp, Homo sapiens
aggccagcctccgagagg

SEQ ID NO: 2335760 - DNA, 13 bp, Homo sapiens
aggccagggcctc

SEQ ID NO: 2335761 - DNA, 14 bp, Homo sapiens
aggccagggcctct

SEQ ID NO: 2335762 - DNA, 14 bp, Homo sapiens
aggccagtccccat

SEQ ID NO: 2335763 - DNA, 20 bp, Homo sapiens
aggccagttgatctgctctg

SEQ ID NO: 2335764 - DNA, 18 bp, Homo sapiens
aggcccagcctgtcctgg

SEQ ID NO: 2335765 - DNA, 19 bp, Homo sapiens
aggcccagcctgtcctggt

SEQ ID NO: 2335766 - DNA, 11 bp, Homo sapiens
aggccccagac

SEQ ID NO: 2335767 - DNA, 21 bp, Homo sapiens
aggccctcctctcccatcctt

SEQ ID NO: 2335768 - DNA, 23 bp, Homo sapiens
aggccctcctctcccatccttga

SEQ ID NO: 2335769 - DNA, 19 bp, Homo sapiens
aggccctgactcctctggc

SEQ ID NO: 2335770 - DNA, 20 bp, Homo sapiens
aggccctgactcctctggct

SEQ ID NO: 2335771 - DNA, 21 bp, Homo sapiens
aggccctgactcctctggctt

SEQ ID NO: 2335772 - DNA, 19 bp, Homo sapiens
aggccgaggccatgtgcat

SEQ ID NO: 2335773 - DNA, 16 bp, Homo sapiens
aggccgaggcgggtgg

SEQ ID NO: 2335774 - DNA, 15 bp, Homo sapiens
aggccggcccagatg

SEQ ID NO: 2335775 - DNA, 14 bp, Homo sapiens
aggccgtgccttgt

SEQ ID NO: 2335776 - DNA, 14 bp, Homo sapiens
aggcctatttaaca

SEQ ID NO: 2335777 - DNA, 18 bp, Homo sapiens
aggcctatttaacaagat

SEQ ID NO: 2335778 - DNA, 19 bp, Homo sapiens
aggcctcttgtaaagactg

SEQ ID NO: 2335779 - DNA, 19 bp, Homo sapiens
aggcctgaatcatgagcct

SEQ ID NO: 2335780 - DNA, 13 bp, Homo sapiens
aggcctgagcccc

SEQ ID NO: 2335781 - DNA, 22 bp, Homo sapiens
aggcctggctggaggagcagca

SEQ ID NO: 2335782 - DNA, 13 bp, Homo sapiens
aggccttgtccta

SEQ ID NO: 2335783 - DNA, 14 bp, Homo sapiens
aggcctttcttctg

SEQ ID NO: 2335784 - DNA, 15 bp, Homo sapiens
aggcctttcttctgt

SEQ ID NO: 2335785 - DNA, 22 bp, Homo sapiens
aggcgcgtctgccccaccctca

SEQ ID NO: 2335786 - DNA, 17 bp, Homo sapiens
aggcggaggctgtgctc

SEQ ID NO: 2335787 - DNA, 22 bp, Homo sapiens
aggctacaggggttagcctgga

SEQ ID NO: 2335788 - DNA, 19 bp, Homo sapiens
aggctattttctaaagact

SEQ ID NO: 2335789 - DNA, 13 bp, Homo sapiens
aggctcactgcca

SEQ ID NO: 2335790 - DNA, 17 bp, Homo sapiens
aggctcactgccaggcc

SEQ ID NO: 2335791 - DNA, 19 bp, Homo sapiens
aggctcactgccaggccag

SEQ ID NO: 2335792 - DNA, 20 bp, Homo sapiens
aggctcactgccaggccagc

SEQ ID NO: 2335793 - DNA, 22 bp, Homo sapiens
aggctcactgccaggccagcct

SEQ ID NO: 2335794 - DNA, 17 bp, Homo sapiens
aggctgaaagaggccaa

SEQ ID NO: 2335795 - DNA, 19 bp, Homo sapiens
aggctgcacccctgggcca

SEQ ID NO: 2335796 - DNA, 21 bp, Homo sapiens
aggctggcaaaccctcccaga

SEQ ID NO: 2335797 - DNA, 12 bp, Homo sapiens
aggctggcaggt

SEQ ID NO: 2335798 - DNA, 21 bp, Homo sapiens
aggctggcctatgtggtctaa

SEQ ID NO: 2335799 - DNA, 14 bp, Homo sapiens
aggctgggagtccc

SEQ ID NO: 2335800 - DNA, 12 bp, Homo sapiens
aggctgggccat

SEQ ID NO: 2335801 - DNA, 17 bp, Homo sapiens
aggctgggggagagccg

SEQ ID NO: 2335802 - DNA, 19 bp, Homo sapiens
aggctgtgctccgccatgg

SEQ ID NO: 2335803 - DNA, 18 bp, Homo sapiens
aggcttaggtgccaggct

SEQ ID NO: 2335804 - DNA, 20 bp, Homo sapiens
aggcttcctgcgtcctcctc

SEQ ID NO: 2335805 - DNA, 16 bp, Homo sapiens
aggcttctccgccagc

SEQ ID NO: 2335806 - DNA, 17 bp, Homo sapiens
aggcttctccgccagcc

SEQ ID NO: 2335807 - DNA, 19 bp, Homo sapiens
aggcttctccgccagcctc

SEQ ID NO: 2335808 - DNA, 20 bp, Homo sapiens
aggcttctccgccagcctcc

SEQ ID NO: 2335809 - DNA, 21 bp, Homo sapiens
aggcttctccgccagcctcct

SEQ ID NO: 2335810 - DNA, 13 bp, Homo sapiens
aggcttctctcca

SEQ ID NO: 2335811 - DNA, 21 bp, Homo sapiens
aggcttgcccagtacatttaa

SEQ ID NO: 2335812 - DNA, 21 bp, Homo sapiens
aggcttgtttacctttctctc

SEQ ID NO: 2335813 - DNA, 22 bp, Homo sapiens
aggcttgtttacctttctctct

SEQ ID NO: 2335814 - DNA, 14 bp, Homo sapiens
aggcttttgctaga

SEQ ID NO: 2335815 - DNA, 15 bp, Homo sapiens
agggaaaggggtgct

SEQ ID NO: 2335816 - DNA, 18 bp, Homo sapiens
agggaaaggggtgctttt

SEQ ID NO: 2335817 - DNA, 15 bp, Homo sapiens
agggaagaaaaagca

SEQ ID NO: 2335818 - DNA, 14 bp, Homo sapiens
agggaagaactatt

SEQ ID NO: 2335819 - DNA, 14 bp, Homo sapiens
agggaagagacagc

SEQ ID NO: 2335820 - DNA, 13 bp, Homo sapiens
agggaagcaggga

SEQ ID NO: 2335821 - DNA, 19 bp, Homo sapiens
agggacacacagcctagca

SEQ ID NO: 2335822 - DNA, 21 bp, Homo sapiens
agggacatttctataaaaata

SEQ ID NO: 2335823 - DNA, 16 bp, Homo sapiens
agggacccccccccaa

SEQ ID NO: 2335824 - DNA, 22 bp, Homo sapiens
agggaccggcggaccccagcca

SEQ ID NO: 2335825 - DNA, 22 bp, Homo sapiens
agggacttcaggatcaagtcct

SEQ ID NO: 2335826 - DNA, 23 bp, Homo sapiens
agggagagagagagagagaggac

SEQ ID NO: 2335827 - DNA, 20 bp, Homo sapiens
agggagagctcaccatggaa

SEQ ID NO: 2335828 - DNA, 23 bp, Homo sapiens
agggagcctccccatctgtccag

SEQ ID NO: 2335829 - DNA, 14 bp, Homo sapiens
attcttttgtttcc

SEQ ID NO: 2335830 - DNA, 18 bp, Homo sapiens
attcttttgtttccatgg

SEQ ID NO: 2335831 - DNA, 15 bp, Homo sapiens
attgaaactgtattt

SEQ ID NO: 2335832 - DNA, 18 bp, Homo sapiens
attgaactggaataatat

SEQ ID NO: 2335833 - DNA, 16 bp, Homo sapiens
attgaacttttgtact

SEQ ID NO: 2335834 - DNA, 18 bp, Homo sapiens
attgaacttttgtactga

SEQ ID NO: 2335835 - DNA, 10 bp, Homo sapiens
attgaagaat

SEQ ID NO: 2335836 - DNA, 16 bp, Homo sapiens
attgaagtttcaagtt

SEQ ID NO: 2335837 - DNA, 21 bp, Homo sapiens
attgaattatcttggttgaaa

SEQ ID NO: 2335838 - DNA, 17 bp, Homo sapiens
attgacaacacccattt

SEQ ID NO: 2335839 - DNA, 18 bp, Homo sapiens
attgacaataagaaacag

SEQ ID NO: 2335840 - DNA, 14 bp, Homo sapiens
attgacactgaact

SEQ ID NO: 2335841 - DNA, 16 bp, Homo sapiens
attgacactgaactta

SEQ ID NO: 2335842 - DNA, 18 bp, Homo sapiens
attgacactgaacttaat

SEQ ID NO: 2335843 - DNA, 18 bp, Homo sapiens
attgacaggtcttttcaa

SEQ ID NO: 2335844 - DNA, 20 bp, Homo sapiens
attgacaggtcttttcaaat

SEQ ID NO: 2335845 - DNA, 14 bp, Homo sapiens
attgacctggatgg

SEQ ID NO: 2335846 - DNA, 13 bp, Homo sapiens
attgagaaatgtg

SEQ ID NO: 2335847 - DNA, 23 bp, Homo sapiens
attgagtattgtttaaaatgtaa

SEQ ID NO: 2335848 - DNA, 13 bp, Homo sapiens
attgattgggaaa

SEQ ID NO: 2335849 - DNA, 18 bp, Homo sapiens
attgattgggaaaacatt

SEQ ID NO: 2335850 - DNA, 21 bp, Homo sapiens
attgattgggaaaacatttgc

SEQ ID NO: 2335851 - DNA, 14 bp, Homo sapiens
attgcaataaagta

SEQ ID NO: 2335852 - DNA, 16 bp, Homo sapiens
attgcaataaagtata

SEQ ID NO: 2335853 - DNA, 13 bp, Homo sapiens
attgcaattaaac

SEQ ID NO: 2335854 - DNA, 16 bp, Homo sapiens
attgcactagagaaaa

SEQ ID NO: 2335855 - DNA, 19 bp, Homo sapiens
attgcactgttctgattat

SEQ ID NO: 2335856 - DNA, 23 bp, Homo sapiens
attgcactgttctgattatgtaa

SEQ ID NO: 2335857 - DNA, 21 bp, Homo sapiens
attgcatactttgtattttga

SEQ ID NO: 2335858 - DNA, 15 bp, Homo sapiens
attgcatcactgtat

SEQ ID NO: 2335859 - DNA, 14 bp, Homo sapiens
attgcctcccaggc

SEQ ID NO: 2335860 - DNA, 19 bp, Homo sapiens
attgctatcgccctccttt

SEQ ID NO: 2335861 - DNA, 21 bp, Homo sapiens
attgctctgccccaccttgcc

SEQ ID NO: 2335862 - DNA, 14 bp, Homo sapiens
attgcttaaaagca

SEQ ID NO: 2335863 - DNA, 22 bp, Homo sapiens
attggaactctactcaacccat

SEQ ID NO: 2335864 - DNA, 14 bp, Homo sapiens
attggattatttaa

SEQ ID NO: 2335865 - DNA, 22 bp, Homo sapiens
attggattatttaataacatta

SEQ ID NO: 2335866 - DNA, 15 bp, Homo sapiens
attgggaaaacattt

SEQ ID NO: 2335867 - DNA, 14 bp, Homo sapiens
attggggaggaggg

SEQ ID NO: 2335868 - DNA, 22 bp, Homo sapiens
attgggtgaatatggtggaaaa

SEQ ID NO: 2335869 - DNA, 23 bp, Homo sapiens
attgggtgaatatggtggaaaat

SEQ ID NO: 2335870 - DNA, 22 bp, Homo sapiens
attggtaattacctggagaaga

SEQ ID NO: 2335871 - DNA, 13 bp, Homo sapiens
attggttcttccc

SEQ ID NO: 2335872 - DNA, 16 bp, Homo sapiens
attgtactaatctgag

SEQ ID NO: 2335873 - DNA, 18 bp, Homo sapiens
attgtagggctttagctt

SEQ ID NO: 2335874 - DNA, 19 bp, Homo sapiens
attgtatattacaatgatc

SEQ ID NO: 2335875 - DNA, 13 bp, Homo sapiens
attgtatctcctt

SEQ ID NO: 2335876 - DNA, 14 bp, Homo sapiens
attgtatctccttt

SEQ ID NO: 2335877 - DNA, 13 bp, Homo sapiens
attgtcagctact

SEQ ID NO: 2335878 - DNA, 14 bp, Homo sapiens
attgtccagtttgt

SEQ ID NO: 2335879 - DNA, 20 bp, Homo sapiens
attgtcctccttttcacttt

SEQ ID NO: 2335880 - DNA, 14 bp, Homo sapiens
attgtgaagtacat

SEQ ID NO: 2335881 - DNA, 18 bp, Homo sapiens
attgtgattctgcctttg

SEQ ID NO: 2335882 - DNA, 15 bp, Homo sapiens
attgtgctcagagac

SEQ ID NO: 2335883 - DNA, 18 bp, Homo sapiens
attgtgtttgttcataat

SEQ ID NO: 2335884 - DNA, 21 bp, Homo sapiens
attgtgttttcttcgtggatt

SEQ ID NO: 2335885 - DNA, 21 bp, Homo sapiens
attgttctcacttattattaa

SEQ ID NO: 2335886 - DNA, 14 bp, Homo sapiens
attgttgtttcttt

SEQ ID NO: 2335887 - DNA, 14 bp, Homo sapiens
attgtttaaaatgt

SEQ ID NO: 2335888 - DNA, 16 bp, Homo sapiens
attgtttaaaatgtaa

SEQ ID NO: 2335889 - DNA, 20 bp, Homo sapiens
attgtttacgtttgatacaa

SEQ ID NO: 2335890 - DNA, 18 bp, Homo sapiens
attgtttgtcctttatgt

SEQ ID NO: 2335891 - DNA, 18 bp, Homo sapiens
attgttttacaatagttc

SEQ ID NO: 2335892 - DNA, 17 bp, Homo sapiens
atttaaaaaataaataa

SEQ ID NO: 2335893 - DNA, 23 bp, Homo sapiens
atttaaacgtgatttttaaatta

SEQ ID NO: 2335894 - DNA, 17 bp, Homo sapiens
atttaaatgaaagaaaa

SEQ ID NO: 2335895 - DNA, 12 bp, Homo sapiens
atttaacatttt

SEQ ID NO: 2335896 - DNA, 15 bp, Homo sapiens
atttaacattttaca

SEQ ID NO: 2335897 - DNA, 15 bp, Homo sapiens
atttaagatatgtaa

SEQ ID NO: 2335898 - DNA, 17 bp, Homo sapiens
atttaagtggactgtat

SEQ ID NO: 2335899 - DNA, 21 bp, Homo sapiens
atttaagtggactgtatttcg

SEQ ID NO: 2335900 - DNA, 15 bp, Homo sapiens
atttaataaagatga

SEQ ID NO: 2335901 - DNA, 13 bp, Homo sapiens
atttaataacatt

SEQ ID NO: 2335902 - DNA, 20 bp, Homo sapiens
atttaatccagttataagaa

SEQ ID NO: 2335903 - DNA, 19 bp, Homo sapiens
atttaatcttttcttattt

SEQ ID NO: 2335904 - DNA, 16 bp, Homo sapiens
atttacacatcttaaa

SEQ ID NO: 2335905 - DNA, 14 bp, Homo sapiens
atttaccctttggc

SEQ ID NO: 2335906 - DNA, 14 bp, Homo sapiens
atttactaacagta

SEQ ID NO: 2335907 - DNA, 15 bp, Homo sapiens
atttactaacagtaa

SEQ ID NO: 2335908 - DNA, 13 bp, Homo sapiens
atttagcacagta

SEQ ID NO: 2335909 - DNA, 14 bp, Homo sapiens
atttagcacagtat

SEQ ID NO: 2335910 - DNA, 22 bp, Homo sapiens
atttagcacagtatttaacatt

SEQ ID NO: 2335911 - DNA, 16 bp, Homo sapiens
atttagccgggcgcgg

SEQ ID NO: 2335912 - DNA, 22 bp, Homo sapiens
atttaggcagattgaaaaggac

SEQ ID NO: 2335913 - DNA, 13 bp, Homo sapiens
atttatgatttaa

SEQ ID NO: 2335914 - DNA, 15 bp, Homo sapiens
atttatgatttaata

SEQ ID NO: 2335915 - DNA, 21 bp, Homo sapiens
atttatgtagatgtgcatttt

SEQ ID NO: 2335916 - DNA, 14 bp, Homo sapiens
atttattgccatat

SEQ ID NO: 2335917 - DNA, 15 bp, Homo sapiens
atttatttattttgt

SEQ ID NO: 2335918 - DNA, 21 bp, Homo sapiens
atttatttccactaaaaatat

SEQ ID NO: 2335919 - DNA, 21 bp, Homo sapiens
atttcaaaatacatttgtaag

SEQ ID NO: 2335920 - DNA, 19 bp, Homo sapiens
atttcaaaccattgctctt

SEQ ID NO: 2335921 - DNA, 19 bp, Homo sapiens
atttcaaagttttgttgta

SEQ ID NO: 2335922 - DNA, 12 bp, Homo sapiens
atttcaaatgta

SEQ ID NO: 2335923 - DNA, 19 bp, Homo sapiens
atttcacctgtaaacctga

SEQ ID NO: 2335924 - DNA, 12 bp, Homo sapiens
atttcagggtgc

SEQ ID NO: 2335925 - DNA, 18 bp, Homo sapiens
atttcagtaagtctcata

SEQ ID NO: 2335926 - DNA, 14 bp, Homo sapiens
atttcatgaaaaag

SEQ ID NO: 2335927 - DNA, 17 bp, Homo sapiens
atttcatgaaaaagctg

SEQ ID NO: 2335928 - DNA, 19 bp, Homo sapiens
atttcatgaaaaagctgct

SEQ ID NO: 2335929 - DNA, 14 bp, Homo sapiens
atttccaaacatcc

SEQ ID NO: 2335930 - DNA, 22 bp, Homo sapiens
atttccagaaccacacttgaaa

SEQ ID NO: 2335931 - DNA, 13 bp, Homo sapiens
atttccattgctt

SEQ ID NO: 2335932 - DNA, 14 bp, Homo sapiens
atttcccatctgca

SEQ ID NO: 2335933 - DNA, 14 bp, Homo sapiens
atttcctaaggcat

SEQ ID NO: 2335934 - DNA, 19 bp, Homo sapiens
atttcctcgcagcctctca

SEQ ID NO: 2335935 - DNA, 17 bp, Homo sapiens
atttcctctccactgct

SEQ ID NO: 2335936 - DNA, 12 bp, Homo sapiens
atttccttgtct

SEQ ID NO: 2335937 - DNA, 15 bp, Homo sapiens
atttccttgtgcaaa

SEQ ID NO: 2335938 - DNA, 16 bp, Homo sapiens
atttcctttatgtgaa

SEQ ID NO: 2335939 - DNA, 17 bp, Homo sapiens
atttcctttatgtgaat

SEQ ID NO: 2335940 - DNA, 19 bp, Homo sapiens
atttcctttatgtgaattt

SEQ ID NO: 2335941 - DNA, 20 bp, Homo sapiens
atttcctttatgtgaatttt

SEQ ID NO: 2335942 - DNA, 15 bp, Homo sapiens
atttcctttttgaca

SEQ ID NO: 2335943 - DNA, 17 bp, Homo sapiens
atttcctttttgacact

SEQ ID NO: 2335944 - DNA, 20 bp, Homo sapiens
atttcctttttgacactgaa

SEQ ID NO: 2335945 - DNA, 23 bp, Homo sapiens
caatgaaatgaattaaagtggac

SEQ ID NO: 2335946 - DNA, 17 bp, Homo sapiens
caatgaaccataaattc

SEQ ID NO: 2335947 - DNA, 13 bp, Homo sapiens
caatgaattatta

SEQ ID NO: 2335948 - DNA, 16 bp, Homo sapiens
caatgagaaaaataaa

SEQ ID NO: 2335949 - DNA, 19 bp, Homo sapiens
caatgagaaaaataaatgg

SEQ ID NO: 2335950 - DNA, 20 bp, Homo sapiens
caatgagaaaaataaatgga

SEQ ID NO: 2335951 - DNA, 19 bp, Homo sapiens
caatgagagcataatttaa

SEQ ID NO: 2335952 - DNA, 20 bp, Homo sapiens
caatgctgcaggatggactg

SEQ ID NO: 2335953 - DNA, 15 bp, Homo sapiens
caatgcttcattatt

SEQ ID NO: 2335954 - DNA, 15 bp, Homo sapiens
caatggagtattctc

SEQ ID NO: 2335955 - DNA, 18 bp, Homo sapiens
caatgtattttatcttat

SEQ ID NO: 2335956 - DNA, 14 bp, Homo sapiens
caatgtcttcccac

SEQ ID NO: 2335957 - DNA, 14 bp, Homo sapiens
caatgttaaggaaa

SEQ ID NO: 2335958 - DNA, 16 bp, Homo sapiens
caatgttaaggaaact

SEQ ID NO: 2335959 - DNA, 14 bp, Homo sapiens
caatgttttcttca

SEQ ID NO: 2335960 - DNA, 19 bp, Homo sapiens
caattaaacttccaaagaa

SEQ ID NO: 2335961 - DNA, 13 bp, Homo sapiens
caattaatgcttt

SEQ ID NO: 2335962 - DNA, 17 bp, Homo sapiens
caattactggtccaaaa

SEQ ID NO: 2335963 - DNA, 15 bp, Homo sapiens
caattactttggtag

SEQ ID NO: 2335964 - DNA, 19 bp, Homo sapiens
caattagtggtcataaaat

SEQ ID NO: 2335965 - DNA, 22 bp, Homo sapiens
caattagtgtgacagtttccaa

SEQ ID NO: 2335966 - DNA, 23 bp, Homo sapiens
caattagtgtgacagtttccaaa

SEQ ID NO: 2335967 - DNA, 15 bp, Homo sapiens
caattcagtaacaaa

SEQ ID NO: 2335968 - DNA, 20 bp, Homo sapiens
caattgggagctgccaagag

SEQ ID NO: 2335969 - DNA, 21 bp, Homo sapiens
caattgggagctgccaagagt

SEQ ID NO: 2335970 - DNA, 15 bp, Homo sapiens
caattgtaaactagt

SEQ ID NO: 2335971 - DNA, 13 bp, Homo sapiens
caatttagacaaa

SEQ ID NO: 2335972 - DNA, 20 bp, Homo sapiens
caatttgcactaaatcagag

SEQ ID NO: 2335973 - DNA, 21 bp, Homo sapiens
caatttgcactaaatcagaga

SEQ ID NO: 2335974 - DNA, 22 bp, Homo sapiens
caattttaaggcatatttaaca

SEQ ID NO: 2335975 - DNA, 16 bp, Homo sapiens
cacaaaaaatttaaga

SEQ ID NO: 2335976 - DNA, 13 bp, Homo sapiens
cacaaaattcaaa

SEQ ID NO: 2335977 - DNA, 22 bp, Homo sapiens
cacaaagctatttaagtggact

SEQ ID NO: 2335978 - DNA, 13 bp, Homo sapiens
cacaaagctttct

SEQ ID NO: 2335979 - DNA, 19 bp, Homo sapiens
cacaaagctttcttttcta

SEQ ID NO: 2335980 - DNA, 22 bp, Homo sapiens
cacaactgtgtgattaaaaggt

SEQ ID NO: 2335981 - DNA, 14 bp, Homo sapiens
cacaagctgcactg

SEQ ID NO: 2335982 - DNA, 16 bp, Homo sapiens
cacaagctgcactgtg

SEQ ID NO: 2335983 - DNA, 17 bp, Homo sapiens
cacaagctgcactgtga

SEQ ID NO: 2335984 - DNA, 19 bp, Homo sapiens
cacaagctgcactgtgaac

SEQ ID NO: 2335985 - DNA, 12 bp, Homo sapiens
cacaagtggtgt

SEQ ID NO: 2335986 - DNA, 17 bp, Homo sapiens
cacacaacgattatagt

SEQ ID NO: 2335987 - DNA, 9 bp, Homo sapiens
cacacacac

SEQ ID NO: 2335988 - DNA, 14 bp, Homo sapiens
cacacacacacaca

SEQ ID NO: 2335989 - DNA, 15 bp, Homo sapiens
cacacacacacacac

SEQ ID NO: 2335990 - DNA, 16 bp, Homo sapiens
cacacacacacacacg

SEQ ID NO: 2335991 - DNA, 13 bp, Homo sapiens
cacacacacccgc

SEQ ID NO: 2335992 - DNA, 17 bp, Homo sapiens
cacacagaatgctcagg

SEQ ID NO: 2335993 - DNA, 15 bp, Homo sapiens
cacacagcctagcac

SEQ ID NO: 2335994 - DNA, 14 bp, Homo sapiens
cacacaggacagcg

SEQ ID NO: 2335995 - DNA, 12 bp, Homo sapiens
cacaccccactc

SEQ ID NO: 2335996 - DNA, 17 bp, Homo sapiens
cacaccccactcccaca

SEQ ID NO: 2335997 - DNA, 23 bp, Homo sapiens
cacacgagcaaacccagaggtgg

SEQ ID NO: 2335998 - DNA, 11 bp, Homo sapiens
cacacgatgca

SEQ ID NO: 2335999 - DNA, 22 bp, Homo sapiens
cacactctccatcaccctcttc

SEQ ID NO: 2336000 - DNA, 13 bp, Homo sapiens
cacagaaatgctg

SEQ ID NO: 2336001 - DNA, 18 bp, Homo sapiens
cacagaaatgctgctggc

SEQ ID NO: 2336002 - DNA, 19 bp, Homo sapiens
cacagaaatgctgctggcc

SEQ ID NO: 2336003 - DNA, 22 bp, Homo sapiens
cacagaaatgctgctggccaaa

SEQ ID NO: 2336004 - DNA, 16 bp, Homo sapiens
cacagaagcacatgca

SEQ ID NO: 2336005 - DNA, 16 bp, Homo sapiens
cacagaatatttttat

SEQ ID NO: 2336006 - DNA, 14 bp, Homo sapiens
cacagaatgctcag

SEQ ID NO: 2336007 - DNA, 15 bp, Homo sapiens
cacagaatgctcagg

SEQ ID NO: 2336008 - DNA, 17 bp, Homo sapiens
cacagaatgctcagggt

SEQ ID NO: 2336009 - DNA, 16 bp, Homo sapiens
cacagagcaaaagagg

SEQ ID NO: 2336010 - DNA, 21 bp, Homo sapiens
cacagagcaagtcctcactct

SEQ ID NO: 2336011 - DNA, 15 bp, Homo sapiens
cacagagcctggccc

SEQ ID NO: 2336012 - DNA, 18 bp, Homo sapiens
cacagagcctggccccag

SEQ ID NO: 2336013 - DNA, 17 bp, Homo sapiens
cacagaggagtgcagcc

SEQ ID NO: 2336014 - DNA, 19 bp, Homo sapiens
cacagataacataaataaa

SEQ ID NO: 2336015 - DNA, 13 bp, Homo sapiens
cacagcagtgtga

SEQ ID NO: 2336016 - DNA, 22 bp, Homo sapiens
cacagcagtgtgaatagcctgg

SEQ ID NO: 2336017 - DNA, 14 bp, Homo sapiens
cacagccagaggag

SEQ ID NO: 2336018 - DNA, 13 bp, Homo sapiens
cacagcctagcac

SEQ ID NO: 2336019 - DNA, 14 bp, Homo sapiens
cacagcgagggcag

SEQ ID NO: 2336020 - DNA, 16 bp, Homo sapiens
cacagcgagggcagct

SEQ ID NO: 2336021 - DNA, 16 bp, Homo sapiens
cacagcgtccctggcg

SEQ ID NO: 2336022 - DNA, 18 bp, Homo sapiens
cacagcgtccctggcgca

SEQ ID NO: 2336023 - DNA, 21 bp, Homo sapiens
cacagctgctgttctcaggac

SEQ ID NO: 2336024 - DNA, 17 bp, Homo sapiens
cacaggaattctcaaga

SEQ ID NO: 2336025 - DNA, 15 bp, Homo sapiens
cacaggacagcggga

SEQ ID NO: 2336026 - DNA, 15 bp, Homo sapiens
cacaggataaagtta

SEQ ID NO: 2336027 - DNA, 15 bp, Homo sapiens
cacaggtagcctatt

SEQ ID NO: 2336028 - DNA, 22 bp, Homo sapiens
cacaggtcatcagatgcctgct

SEQ ID NO: 2336029 - DNA, 13 bp, Homo sapiens
cacagtagaactg

SEQ ID NO: 2336030 - DNA, 13 bp, Homo sapiens
cacagtattttga

SEQ ID NO: 2336031 - DNA, 15 bp, Homo sapiens
cacagtccagaccca

SEQ ID NO: 2336032 - DNA, 21 bp, Homo sapiens
cacagtttttgtaaagccctt

SEQ ID NO: 2336033 - DNA, 23 bp, Homo sapiens
cacagtttttgtaaagcccttgc

SEQ ID NO: 2336034 - DNA, 19 bp, Homo sapiens
cacataagcccagttcatc

SEQ ID NO: 2336035 - DNA, 16 bp, Homo sapiens
cacataccctgacctg

SEQ ID NO: 2336036 - DNA, 14 bp, Homo sapiens
cacatcaaaccttt

SEQ ID NO: 2336037 - DNA, 14 bp, Homo sapiens
cacatcaaataaga

SEQ ID NO: 2336038 - DNA, 12 bp, Homo sapiens
cacatccaactc

SEQ ID NO: 2336039 - DNA, 16 bp, Homo sapiens
cacatccaactccagc

SEQ ID NO: 2336040 - DNA, 18 bp, Homo sapiens
cacatccaactccagcaa

SEQ ID NO: 2336041 - DNA, 16 bp, Homo sapiens
cacatccatccctcca

SEQ ID NO: 2336042 - DNA, 24 bp, Homo sapiens
cacatgaatcccacccacatgtga

SEQ ID NO: 2336043 - DNA, 21 bp, Homo sapiens
cacatgcctgcgcctgctgcc

SEQ ID NO: 2336044 - DNA, 15 bp, Homo sapiens
cacatggcctatgca

SEQ ID NO: 2336045 - DNA, 13 bp, Homo sapiens
cacatgtgacaca

SEQ ID NO: 2336046 - DNA, 13 bp, Homo sapiens
cacattgaaactg

SEQ ID NO: 2336047 - DNA, 15 bp, Homo sapiens
cacattgaaactgta

SEQ ID NO: 2336048 - DNA, 17 bp, Homo sapiens
cacattgaaactgtatt

SEQ ID NO: 2336049 - DNA, 18 bp, Homo sapiens
cacattgaaactgtattt

SEQ ID NO: 2336050 - DNA, 19 bp, Homo sapiens
cacattgaaactgtattta

SEQ ID NO: 2336051 - DNA, 16 bp, Homo sapiens
cacatttagaaatgtt

SEQ ID NO: 2336052 - DNA, 23 bp, Homo sapiens
cacatttctttgcattccagctg

SEQ ID NO: 2336053 - DNA, 21 bp, Homo sapiens
cacatttgctactgttgtaag

SEQ ID NO: 2336054 - DNA, 13 bp, Homo sapiens
caccaaagctgcc

SEQ ID NO: 2336055 - DNA, 23 bp, Homo sapiens
caccaatgtttcaagaggagccc

SEQ ID NO: 2336056 - DNA, 22 bp, Homo sapiens
caccacatagcatgcttccttt

SEQ ID NO: 2336057 - DNA, 13 bp, Homo sapiens
caccactgcagcc

SEQ ID NO: 2336058 - DNA, 17 bp, Homo sapiens
caccagacgtcaggccc

SEQ ID NO: 2336059 - DNA, 16 bp, Homo sapiens
caccagagcagatgca

SEQ ID NO: 2336060 - DNA, 13 bp, Homo sapiens
caccagccatcct

SEQ ID NO: 2336061 - DNA, 15 bp, Homo sapiens
cagacgttgcctgag

SEQ ID NO: 2336062 - DNA, 20 bp, Homo sapiens
cagactttgtgttcatttca

SEQ ID NO: 2336063 - DNA, 21 bp, Homo sapiens
cagactttgtgttcatttcat

SEQ ID NO: 2336064 - DNA, 19 bp, Homo sapiens
cagagaaacttaagcaaag

SEQ ID NO: 2336065 - DNA, 16 bp, Homo sapiens
cagagaaattctgtgg

SEQ ID NO: 2336066 - DNA, 12 bp, Homo sapiens
cagagaataaaa

SEQ ID NO: 2336067 - DNA, 23 bp, Homo sapiens
cagagacaacaggtaaaacaggg

SEQ ID NO: 2336068 - DNA, 21 bp, Homo sapiens
cagagacactgttgataaaaa

SEQ ID NO: 2336069 - DNA, 19 bp, Homo sapiens
cagagagcagctccctttc

SEQ ID NO: 2336070 - DNA, 20 bp, Homo sapiens
cagagagccattttgtgaat

SEQ ID NO: 2336071 - DNA, 19 bp, Homo sapiens
cagagatttctcattgact

SEQ ID NO: 2336072 - DNA, 21 bp, Homo sapiens
cagagcaagtcctcactcttc

SEQ ID NO: 2336073 - DNA, 13 bp, Homo sapiens
cagagcagatgca

SEQ ID NO: 2336074 - DNA, 21 bp, Homo sapiens
cagagcagatgcagagagcca

SEQ ID NO: 2336075 - DNA, 18 bp, Homo sapiens
cagagccatgtcttctcc

SEQ ID NO: 2336076 - DNA, 20 bp, Homo sapiens
cagagccatgtcttctccct

SEQ ID NO: 2336077 - DNA, 15 bp, Homo sapiens
cagagcctggcccca

SEQ ID NO: 2336078 - DNA, 19 bp, Homo sapiens
cagagccttctcagaagca

SEQ ID NO: 2336079 - DNA, 19 bp, Homo sapiens
cagagctaaactccttcct

SEQ ID NO: 2336080 - DNA, 22 bp, Homo sapiens
cagagctaaactccttcctggc

SEQ ID NO: 2336081 - DNA, 17 bp, Homo sapiens
cagagctggtggaccca

SEQ ID NO: 2336082 - DNA, 20 bp, Homo sapiens
cagagctggtggacccaggg

SEQ ID NO: 2336083 - DNA, 21 bp, Homo sapiens
cagagctggtggacccaggga

SEQ ID NO: 2336084 - DNA, 21 bp, Homo sapiens
cagaggaaagggctggctccc

SEQ ID NO: 2336085 - DNA, 16 bp, Homo sapiens
cagaggaagaaaatga

SEQ ID NO: 2336086 - DNA, 17 bp, Homo sapiens
cagaggaatcctggcag

SEQ ID NO: 2336087 - DNA, 20 bp, Homo sapiens
cagaggaatcctggcagccc

SEQ ID NO: 2336088 - DNA, 14 bp, Homo sapiens
cagaggacgcacgc

SEQ ID NO: 2336089 - DNA, 23 bp, Homo sapiens
cagaggacgcacgctcgctgcca

SEQ ID NO: 2336090 - DNA, 15 bp, Homo sapiens
cagaggatgcctttt

SEQ ID NO: 2336091 - DNA, 18 bp, Homo sapiens
cagaggatgccttttctg

SEQ ID NO: 2336092 - DNA, 21 bp, Homo sapiens
cagaggcaggctgggacggac

SEQ ID NO: 2336093 - DNA, 21 bp, Homo sapiens
cagaggctgcacccctgggcc

SEQ ID NO: 2336094 - DNA, 14 bp, Homo sapiens
cagaggctgggagt

SEQ ID NO: 2336095 - DNA, 13 bp, Homo sapiens
cagaggtaacaga

SEQ ID NO: 2336096 - DNA, 17 bp, Homo sapiens
cagaggtaacagaacag

SEQ ID NO: 2336097 - DNA, 18 bp, Homo sapiens
cagaggtaacagaacagc

SEQ ID NO: 2336098 - DNA, 23 bp, Homo sapiens
cagaggtaacagaacagcttcag

SEQ ID NO: 2336099 - DNA, 23 bp, Homo sapiens
cagaggtggatgttatgaacagc

SEQ ID NO: 2336100 - DNA, 22 bp, Homo sapiens
cagagtccagtgctctgcctca

SEQ ID NO: 2336101 - DNA, 20 bp, Homo sapiens
cagagtgatttgtaaaacag

SEQ ID NO: 2336102 - DNA, 23 bp, Homo sapiens
cagagttttcattaaatcctttt

SEQ ID NO: 2336103 - DNA, 13 bp, Homo sapiens
cagataactgagg

SEQ ID NO: 2336104 - DNA, 20 bp, Homo sapiens
cagataactgaggaggggag

SEQ ID NO: 2336105 - DNA, 20 bp, Homo sapiens
cagataagcaagagagatgt

SEQ ID NO: 2336106 - DNA, 18 bp, Homo sapiens
cagataccttatcttaca

SEQ ID NO: 2336107 - DNA, 19 bp, Homo sapiens
cagataccttatcttacaa

SEQ ID NO: 2336108 - DNA, 22 bp, Homo sapiens
cagataccttatcttacaatat

SEQ ID NO: 2336109 - DNA, 23 bp, Homo sapiens
cagataccttatcttacaatatt

SEQ ID NO: 2336110 - DNA, 21 bp, Homo sapiens
cagatagaaaacagcccccac

SEQ ID NO: 2336111 - DNA, 12 bp, Homo sapiens
cagatattttat

SEQ ID NO: 2336112 - DNA, 17 bp, Homo sapiens
cagatctgatcaagagt

SEQ ID NO: 2336113 - DNA, 12 bp, Homo sapiens
cagatctgtttt

SEQ ID NO: 2336114 - DNA, 17 bp, Homo sapiens
cagatctttcagaaata

SEQ ID NO: 2336115 - DNA, 14 bp, Homo sapiens
cagatctttctctt

SEQ ID NO: 2336116 - DNA, 16 bp, Homo sapiens
cagatctttctcttcc

SEQ ID NO: 2336117 - DNA, 16 bp, Homo sapiens
cagatgccaccctagc

SEQ ID NO: 2336118 - DNA, 15 bp, Homo sapiens
cagatgcctgcttga

SEQ ID NO: 2336119 - DNA, 22 bp, Homo sapiens
cagatgcctgcttgataatata

SEQ ID NO: 2336120 - DNA, 17 bp, Homo sapiens
cagatgctgtcattagt

SEQ ID NO: 2336121 - DNA, 18 bp, Homo sapiens
cagatgctgttgtgaagc

SEQ ID NO: 2336122 - DNA, 23 bp, Homo sapiens
cagatgcttgcggcaaaaggaaa

SEQ ID NO: 2336123 - DNA, 17 bp, Homo sapiens
cagatgtcttccctggg

SEQ ID NO: 2336124 - DNA, 18 bp, Homo sapiens
cagatgtgctataatctg

SEQ ID NO: 2336125 - DNA, 22 bp, Homo sapiens
cagatgtgctataatctgtttt

SEQ ID NO: 2336126 - DNA, 20 bp, Homo sapiens
cagatgtggctactgacata

SEQ ID NO: 2336127 - DNA, 18 bp, Homo sapiens
cagatgtgtcccccccag

SEQ ID NO: 2336128 - DNA, 21 bp, Homo sapiens
cagatgtgtcccccccaggcc

SEQ ID NO: 2336129 - DNA, 22 bp, Homo sapiens
cagatgtgtcccccccaggcct

SEQ ID NO: 2336130 - DNA, 17 bp, Homo sapiens
cagatgttcccccatct

SEQ ID NO: 2336131 - DNA, 15 bp, Homo sapiens
cagatgtttgcctca

SEQ ID NO: 2336132 - DNA, 16 bp, Homo sapiens
cagatgtttgcctcat

SEQ ID NO: 2336133 - DNA, 16 bp, Homo sapiens
cagattcccctgtgtc

SEQ ID NO: 2336134 - DNA, 15 bp, Homo sapiens
cagattctgatgcat

SEQ ID NO: 2336135 - DNA, 14 bp, Homo sapiens
cagattctgcctct

SEQ ID NO: 2336136 - DNA, 15 bp, Homo sapiens
cagattctgcctctc

SEQ ID NO: 2336137 - DNA, 12 bp, Homo sapiens
cagattgaaaag

SEQ ID NO: 2336138 - DNA, 14 bp, Homo sapiens
cagattgaaaagga

SEQ ID NO: 2336139 - DNA, 15 bp, Homo sapiens
cagattttacagagc

SEQ ID NO: 2336140 - DNA, 13 bp, Homo sapiens
cagattttcagca

SEQ ID NO: 2336141 - DNA, 23 bp, Homo sapiens
cagcaaagcaaatgttgggaaag

SEQ ID NO: 2336142 - DNA, 22 bp, Homo sapiens
cagcaacattataatggccctg

SEQ ID NO: 2336143 - DNA, 22 bp, Homo sapiens
cagcaacttcttctccatccct

SEQ ID NO: 2336144 - DNA, 17 bp, Homo sapiens
cagcaagtacagcggct

SEQ ID NO: 2336145 - DNA, 16 bp, Homo sapiens
cagcacaggagggcgg

SEQ ID NO: 2336146 - DNA, 17 bp, Homo sapiens
cagcactccgcatcacc

SEQ ID NO: 2336147 - DNA, 21 bp, Homo sapiens
cagcactccgcatcacctcac

SEQ ID NO: 2336148 - DNA, 18 bp, Homo sapiens
cagcactttgggaggccg

SEQ ID NO: 2336149 - DNA, 19 bp, Homo sapiens
cagcagaacctgcacacag

SEQ ID NO: 2336150 - DNA, 12 bp, Homo sapiens
cagcagaagcct

SEQ ID NO: 2336151 - DNA, 16 bp, Homo sapiens
cagcagaggcaggctg

SEQ ID NO: 2336152 - DNA, 17 bp, Homo sapiens
cagcagaggcaggctgg

SEQ ID NO: 2336153 - DNA, 18 bp, Homo sapiens
cagcagaggcaggctggg

SEQ ID NO: 2336154 - DNA, 22 bp, Homo sapiens
cagcagatgctgttgtgaagct

SEQ ID NO: 2336155 - DNA, 13 bp, Homo sapiens
cagcagcagcagg

SEQ ID NO: 2336156 - DNA, 15 bp, Homo sapiens
cagcagcagcccaag

SEQ ID NO: 2336157 - DNA, 12 bp, Homo sapiens
cagcagcaggtg

SEQ ID NO: 2336158 - DNA, 19 bp, Homo sapiens
cagcagcccaagcttccct

SEQ ID NO: 2336159 - DNA, 14 bp, Homo sapiens
cagcaggctggcct

SEQ ID NO: 2336160 - DNA, 17 bp, Homo sapiens
cagcagggtcttgctgt

SEQ ID NO: 2336161 - DNA, 20 bp, Homo sapiens
cagcaggtgattggaccagg

SEQ ID NO: 2336162 - DNA, 22 bp, Homo sapiens
cagcagtgtgaatagcctggcc

SEQ ID NO: 2336163 - DNA, 14 bp, Homo sapiens
cagcagtgtggaga

SEQ ID NO: 2336164 - DNA, 21 bp, Homo sapiens
cagcatcccttcccacatgcc

SEQ ID NO: 2336165 - DNA, 23 bp, Homo sapiens
cagcatcccttcccacatgcctg

SEQ ID NO: 2336166 - DNA, 15 bp, Homo sapiens
cagcatcttctggtt

SEQ ID NO: 2336167 - DNA, 15 bp, Homo sapiens
cagcatggcatccaa

SEQ ID NO: 2336168 - DNA, 22 bp, Homo sapiens
cagcatggcatccaagactctt

SEQ ID NO: 2336169 - DNA, 16 bp, Homo sapiens
cagccaagattttcct

SEQ ID NO: 2336170 - DNA, 20 bp, Homo sapiens
cagccaagattttcctcttg

SEQ ID NO: 2336171 - DNA, 13 bp, Homo sapiens
cagccacagagca

SEQ ID NO: 2336172 - DNA, 23 bp, Homo sapiens
cagccacagagcaaaagagggtt

SEQ ID NO: 2336173 - DNA, 17 bp, Homo sapiens
cagccagaggagggcag

SEQ ID NO: 2336174 - DNA, 19 bp, Homo sapiens
cagccagaggagggcagag

SEQ ID NO: 2336175 - DNA, 23 bp, Homo sapiens
cagtatgtgggggcttcatctct

SEQ ID NO: 2336176 - DNA, 15 bp, Homo sapiens
cagtattcttttaaa

SEQ ID NO: 2336177 - DNA, 16 bp, Homo sapiens
cagtattttgtgtcct

SEQ ID NO: 2336178 - DNA, 14 bp, Homo sapiens
cagtatttttaaag

SEQ ID NO: 2336179 - DNA, 17 bp, Homo sapiens
cagtatttttaaaggca

SEQ ID NO: 2336180 - DNA, 19 bp, Homo sapiens
cagtatttttaaaggcatt

SEQ ID NO: 2336181 - DNA, 13 bp, Homo sapiens
cagtcagagtcca

SEQ ID NO: 2336182 - DNA, 18 bp, Homo sapiens
cagtcagcagatgctgtt

SEQ ID NO: 2336183 - DNA, 16 bp, Homo sapiens
cagtcatctgtaagag

SEQ ID NO: 2336184 - DNA, 13 bp, Homo sapiens
cagtcatgcataa

SEQ ID NO: 2336185 - DNA, 16 bp, Homo sapiens
cagtcatgcataaata

SEQ ID NO: 2336186 - DNA, 14 bp, Homo sapiens
cagtccaaccagaa

SEQ ID NO: 2336187 - DNA, 19 bp, Homo sapiens
cagtccaaccagaaacacc

SEQ ID NO: 2336188 - DNA, 17 bp, Homo sapiens
cagtccaccctgcctgc

SEQ ID NO: 2336189 - DNA, 18 bp, Homo sapiens
cagtccaccctgcctgcc

SEQ ID NO: 2336190 - DNA, 17 bp, Homo sapiens
cagtccagacccaagtc

SEQ ID NO: 2336191 - DNA, 13 bp, Homo sapiens
cagtccccacccc

SEQ ID NO: 2336192 - DNA, 21 bp, Homo sapiens
cagtccccacccctgccccca

SEQ ID NO: 2336193 - DNA, 13 bp, Homo sapiens
cagtcccctctct

SEQ ID NO: 2336194 - DNA, 16 bp, Homo sapiens
cagtcccctctctctg

SEQ ID NO: 2336195 - DNA, 22 bp, Homo sapiens
cagtcctggaagccagctttcc

SEQ ID NO: 2336196 - DNA, 12 bp, Homo sapiens
cagtcgtgatgt

SEQ ID NO: 2336197 - DNA, 19 bp, Homo sapiens
cagtctgcccacgcagagg

SEQ ID NO: 2336198 - DNA, 17 bp, Homo sapiens
cagtctttgctcagtgt

SEQ ID NO: 2336199 - DNA, 17 bp, Homo sapiens
cagtgaacattcccagc

SEQ ID NO: 2336200 - DNA, 20 bp, Homo sapiens
cagtgaacattcccagccca

SEQ ID NO: 2336201 - DNA, 15 bp, Homo sapiens
cagtgaactcctgcc

SEQ ID NO: 2336202 - DNA, 20 bp, Homo sapiens
cagtgaactcctgccaggca

SEQ ID NO: 2336203 - DNA, 18 bp, Homo sapiens
cagtgacacccagaggga

SEQ ID NO: 2336204 - DNA, 17 bp, Homo sapiens
cagtgagactgccccac

SEQ ID NO: 2336205 - DNA, 18 bp, Homo sapiens
cagtgagcctcctgtgcc

SEQ ID NO: 2336206 - DNA, 23 bp, Homo sapiens
cagtgagcctcctgtgcctggcc

SEQ ID NO: 2336207 - DNA, 23 bp, Homo sapiens
cagtgagggtcttcttacatgca

SEQ ID NO: 2336208 - DNA, 18 bp, Homo sapiens
cagtgatatggcagaaga

SEQ ID NO: 2336209 - DNA, 16 bp, Homo sapiens
cagtgatgacttgctg

SEQ ID NO: 2336210 - DNA, 17 bp, Homo sapiens
cagtgatgacttgctgt

SEQ ID NO: 2336211 - DNA, 22 bp, Homo sapiens
cagtgatgacttgctgtccagg

SEQ ID NO: 2336212 - DNA, 19 bp, Homo sapiens
cagtgcagagccttctcag

SEQ ID NO: 2336213 - DNA, 18 bp, Homo sapiens
cagtgcagtttcttttca

SEQ ID NO: 2336214 - DNA, 16 bp, Homo sapiens
cagtgccccagggagt

SEQ ID NO: 2336215 - DNA, 21 bp, Homo sapiens
cagtgccccagggagtccagg

SEQ ID NO: 2336216 - DNA, 13 bp, Homo sapiens
cagtgccctccag

SEQ ID NO: 2336217 - DNA, 16 bp, Homo sapiens
cagtgccctccagccc

SEQ ID NO: 2336218 - DNA, 23 bp, Homo sapiens
cagtgcctacatcccgggcctca

SEQ ID NO: 2336219 - DNA, 17 bp, Homo sapiens
cagtgctcaccagccct

SEQ ID NO: 2336220 - DNA, 21 bp, Homo sapiens
cagtgctcaccagccctgcag

SEQ ID NO: 2336221 - DNA, 19 bp, Homo sapiens
cagtgctctcagctggcag

SEQ ID NO: 2336222 - DNA, 16 bp, Homo sapiens
cagtgctctgcctcag

SEQ ID NO: 2336223 - DNA, 14 bp, Homo sapiens
cagtggcagtattg

SEQ ID NO: 2336224 - DNA, 15 bp, Homo sapiens
cagtggcagtattga

SEQ ID NO: 2336225 - DNA, 17 bp, Homo sapiens
cagtggtaagaatagta

SEQ ID NO: 2336226 - DNA, 15 bp, Homo sapiens
cagtggttttatact

SEQ ID NO: 2336227 - DNA, 17 bp, Homo sapiens
cagtgtctccacctaca

SEQ ID NO: 2336228 - DNA, 18 bp, Homo sapiens
cagtgtggagaccctgcc

SEQ ID NO: 2336229 - DNA, 14 bp, Homo sapiens
cagtgttacctgtg

SEQ ID NO: 2336230 - DNA, 17 bp, Homo sapiens
cagtgttacctgtgtgc

SEQ ID NO: 2336231 - DNA, 18 bp, Homo sapiens
cagtgttacctgtgtgct

SEQ ID NO: 2336232 - DNA, 14 bp, Homo sapiens
cagtgttgtcacca

SEQ ID NO: 2336233 - DNA, 20 bp, Homo sapiens
cagtgttgtcaccagatctg

SEQ ID NO: 2336234 - DNA, 13 bp, Homo sapiens
cagttacagtggc

SEQ ID NO: 2336235 - DNA, 14 bp, Homo sapiens
cagttacagtggca

SEQ ID NO: 2336236 - DNA, 21 bp, Homo sapiens
cagttacccactcggtcccag

SEQ ID NO: 2336237 - DNA, 15 bp, Homo sapiens
cagttataagaagaa

SEQ ID NO: 2336238 - DNA, 11 bp, Homo sapiens
cagttctagga

SEQ ID NO: 2336239 - DNA, 12 bp, Homo sapiens
cagttctaggaa

SEQ ID NO: 2336240 - DNA, 12 bp, Homo sapiens
cagttctctggg

SEQ ID NO: 2336241 - DNA, 16 bp, Homo sapiens
cagttctcttgctttc

SEQ ID NO: 2336242 - DNA, 14 bp, Homo sapiens
cagttctttcctct

SEQ ID NO: 2336243 - DNA, 17 bp, Homo sapiens
cagttctttcctctttc

SEQ ID NO: 2336244 - DNA, 22 bp, Homo sapiens
cagttctttcctctttctgctc

SEQ ID NO: 2336245 - DNA, 23 bp, Homo sapiens
cagttgctcaaaaagaaatcaat

SEQ ID NO: 2336246 - DNA, 20 bp, Homo sapiens
cagttgctgtgaactttcat

SEQ ID NO: 2336247 - DNA, 14 bp, Homo sapiens
cagttgcttgtctt

SEQ ID NO: 2336248 - DNA, 21 bp, Homo sapiens
cagttgggctcgcactgccca

SEQ ID NO: 2336249 - DNA, 21 bp, Homo sapiens
cagttgtcttatgtgaaaaat

SEQ ID NO: 2336250 - DNA, 12 bp, Homo sapiens
cagtttaacaga

SEQ ID NO: 2336251 - DNA, 16 bp, Homo sapiens
cagtttgtcttggata

SEQ ID NO: 2336252 - DNA, 14 bp, Homo sapiens
cagttttccttctg

SEQ ID NO: 2336253 - DNA, 12 bp, Homo sapiens
cagtttttgtaa

SEQ ID NO: 2336254 - DNA, 20 bp, Homo sapiens
cagtttttgtaaagcccttg

SEQ ID NO: 2336255 - DNA, 21 bp, Homo sapiens
cataaaatagaataattcttt

SEQ ID NO: 2336256 - DNA, 17 bp, Homo sapiens
cataaacggttcctggt

SEQ ID NO: 2336257 - DNA, 19 bp, Homo sapiens
cataaacggttcctggtga

SEQ ID NO: 2336258 - DNA, 17 bp, Homo sapiens
cataaagctcaaatgaa

SEQ ID NO: 2336259 - DNA, 21 bp, Homo sapiens
cataaagctcaaatgaaatgt

SEQ ID NO: 2336260 - DNA, 22 bp, Homo sapiens
cataaagtaaatacatgcatat

SEQ ID NO: 2336261 - DNA, 18 bp, Homo sapiens
cataaagtacaaatgaag

SEQ ID NO: 2336262 - DNA, 11 bp, Homo sapiens
cataaagtcag

SEQ ID NO: 2336263 - DNA, 12 bp, Homo sapiens
cataaataaagt

SEQ ID NO: 2336264 - DNA, 15 bp, Homo sapiens
cataaataaagtttc

SEQ ID NO: 2336265 - DNA, 12 bp, Homo sapiens
cataaatatgca

SEQ ID NO: 2336266 - DNA, 13 bp, Homo sapiens
cataaatatgcag

SEQ ID NO: 2336267 - DNA, 17 bp, Homo sapiens
cataaattatttgatta

SEQ ID NO: 2336268 - DNA, 22 bp, Homo sapiens
cataaattatttgattatttaa

SEQ ID NO: 2336269 - DNA, 16 bp, Homo sapiens
cataacgtttttcctt

SEQ ID NO: 2336270 - DNA, 17 bp, Homo sapiens
cataagcttccatttta

SEQ ID NO: 2336271 - DNA, 23 bp, Homo sapiens
cataagtaaatgtcttcatgttg

SEQ ID NO: 2336272 - DNA, 24 bp, Homo sapiens
cataagtaacttttaaaatttgtc

SEQ ID NO: 2336273 - DNA, 15 bp, Homo sapiens
cataataaagtattt

SEQ ID NO: 2336274 - DNA, 18 bp, Homo sapiens
cataataaagtattttct

SEQ ID NO: 2336275 - DNA, 15 bp, Homo sapiens
cataataaattttct

SEQ ID NO: 2336276 - DNA, 14 bp, Homo sapiens
cataatcagtaaat

SEQ ID NO: 2336277 - DNA, 13 bp, Homo sapiens
cataatcattacc

SEQ ID NO: 2336278 - DNA, 15 bp, Homo sapiens
cataatcattacctt

SEQ ID NO: 2336279 - DNA, 21 bp, Homo sapiens
cataatcttctgccttctcat

SEQ ID NO: 2336280 - DNA, 21 bp, Homo sapiens
cataatgagatgtgagccttg

SEQ ID NO: 2336281 - DNA, 17 bp, Homo sapiens
cataatgataaaataaa

SEQ ID NO: 2336282 - DNA, 12 bp, Homo sapiens
cataatgtgaga

SEQ ID NO: 2336283 - DNA, 22 bp, Homo sapiens
cataatgtgagatggttcccaa

SEQ ID NO: 2336284 - DNA, 14 bp, Homo sapiens
cataatttaaaaat

SEQ ID NO: 2336285 - DNA, 16 bp, Homo sapiens
catacaaactctcacc

SEQ ID NO: 2336286 - DNA, 14 bp, Homo sapiens
catacacacagcag

SEQ ID NO: 2336287 - DNA, 23 bp, Homo sapiens
catacaccccctcttctgagcac

SEQ ID NO: 2336288 - DNA, 23 bp, Homo sapiens
catacagaggatgccttttctgt

SEQ ID NO: 2336289 - DNA, 17 bp, Homo sapiens
catacagctgcctacct

SEQ ID NO: 2336290 - DNA, 14 bp, Homo sapiens
ccaaaaacatttga

SEQ ID NO: 2336291 - DNA, 11 bp, Homo sapiens
ccaaaactgct

SEQ ID NO: 2336292 - DNA, 12 bp, Homo sapiens
ccaaaactgctc

SEQ ID NO: 2336293 - DNA, 17 bp, Homo sapiens
ccaaaagtccctccctg

SEQ ID NO: 2336294 - DNA, 19 bp, Homo sapiens
ccaaaagtccctccctgcc

SEQ ID NO: 2336295 - DNA, 22 bp, Homo sapiens
ccaaaagtccctccctgcctga

SEQ ID NO: 2336296 - DNA, 20 bp, Homo sapiens
ccaaaatgttggtcatttta

SEQ ID NO: 2336297 - DNA, 21 bp, Homo sapiens
ccaaaatgttggtcattttat

SEQ ID NO: 2336298 - DNA, 12 bp, Homo sapiens
ccaaacactcag

SEQ ID NO: 2336299 - DNA, 12 bp, Homo sapiens
ccaaagaaagtt

SEQ ID NO: 2336300 - DNA, 13 bp, Homo sapiens
ccaaagaggctgc

SEQ ID NO: 2336301 - DNA, 17 bp, Homo sapiens
ccaaagagggcttcctc

SEQ ID NO: 2336302 - DNA, 19 bp, Homo sapiens
ccaaagagggcttcctcta

SEQ ID NO: 2336303 - DNA, 14 bp, Homo sapiens
ccaaagatttcata

SEQ ID NO: 2336304 - DNA, 13 bp, Homo sapiens
ccaaagctgccca

SEQ ID NO: 2336305 - DNA, 13 bp, Homo sapiens
ccaaagctggtct

SEQ ID NO: 2336306 - DNA, 20 bp, Homo sapiens
ccaaaggaaaatgtctgtaa

SEQ ID NO: 2336307 - DNA, 21 bp, Homo sapiens
ccaaagtgccggtgagaccca

SEQ ID NO: 2336308 - DNA, 13 bp, Homo sapiens
ccaaagtgctgag

SEQ ID NO: 2336309 - DNA, 20 bp, Homo sapiens
ccaaatataagacatttgtt

SEQ ID NO: 2336310 - DNA, 19 bp, Homo sapiens
ccaaatggccattttaaaa

SEQ ID NO: 2336311 - DNA, 15 bp, Homo sapiens
ccaaatgtccctcca

SEQ ID NO: 2336312 - DNA, 12 bp, Homo sapiens
ccaaattaaaaa

SEQ ID NO: 2336313 - DNA, 14 bp, Homo sapiens
ccaaattaaaacaa

SEQ ID NO: 2336314 - DNA, 17 bp, Homo sapiens
ccaacatatatttattg

SEQ ID NO: 2336315 - DNA, 16 bp, Homo sapiens
ccaaccactgtgccac

SEQ ID NO: 2336316 - DNA, 21 bp, Homo sapiens
ccaaccactgtgccactgact

SEQ ID NO: 2336317 - DNA, 19 bp, Homo sapiens
ccaaccctatctcctgaca

SEQ ID NO: 2336318 - DNA, 20 bp, Homo sapiens
ccaaccctatctcctgacag

SEQ ID NO: 2336319 - DNA, 17 bp, Homo sapiens
ccaacctctttttcctc

SEQ ID NO: 2336320 - DNA, 20 bp, Homo sapiens
ccaacctctttttcctcctg

SEQ ID NO: 2336321 - DNA, 20 bp, Homo sapiens
ccaacctgctctcctcttct

SEQ ID NO: 2336322 - DNA, 19 bp, Homo sapiens
ccaactaatgccttactct

SEQ ID NO: 2336323 - DNA, 20 bp, Homo sapiens
ccaactaatgccttactctt

SEQ ID NO: 2336324 - DNA, 14 bp, Homo sapiens
ccaactccagcaac

SEQ ID NO: 2336325 - DNA, 13 bp, Homo sapiens
ccaagcaacattt

SEQ ID NO: 2336326 - DNA, 15 bp, Homo sapiens
ccaagcacagagcct

SEQ ID NO: 2336327 - DNA, 18 bp, Homo sapiens
ccaagcacagagcctggc

SEQ ID NO: 2336328 - DNA, 20 bp, Homo sapiens
ccaagcacagagcctggccc

SEQ ID NO: 2336329 - DNA, 11 bp, Homo sapiens
ccaagcagaaa

SEQ ID NO: 2336330 - DNA, 15 bp, Homo sapiens
ccaagcccagcccat

SEQ ID NO: 2336331 - DNA, 13 bp, Homo sapiens
ccaagcctccaca

SEQ ID NO: 2336332 - DNA, 16 bp, Homo sapiens
ccaagcctccacagcg

SEQ ID NO: 2336333 - DNA, 18 bp, Homo sapiens
ccaagcctccacagcgag

SEQ ID NO: 2336334 - DNA, 20 bp, Homo sapiens
ccaagcctccacagcgaggg

SEQ ID NO: 2336335 - DNA, 18 bp, Homo sapiens
ccaaggatcggactctgc

SEQ ID NO: 2336336 - DNA, 20 bp, Homo sapiens
ccaaggatcggactctgccc

SEQ ID NO: 2336337 - DNA, 11 bp, Homo sapiens
ccaaggctgcc

SEQ ID NO: 2336338 - DNA, 16 bp, Homo sapiens
ccaaggctgccagaca

SEQ ID NO: 2336339 - DNA, 18 bp, Homo sapiens
ccaaggctgccagacatg

SEQ ID NO: 2336340 - DNA, 17 bp, Homo sapiens
ccaagggaaaggggtgc

SEQ ID NO: 2336341 - DNA, 21 bp, Homo sapiens
ccaagggaaaggggtgctttt

SEQ ID NO: 2336342 - DNA, 20 bp, Homo sapiens
ccaagggtatgggaagccat

SEQ ID NO: 2336343 - DNA, 19 bp, Homo sapiens
ccaagggttgagagccagt

SEQ ID NO: 2336344 - DNA, 20 bp, Homo sapiens
ccaagggttgagagccagtg

SEQ ID NO: 2336345 - DNA, 17 bp, Homo sapiens
ccaaggtggcagatgtc

SEQ ID NO: 2336346 - DNA, 18 bp, Homo sapiens
ccaagtcaacactcttct

SEQ ID NO: 2336347 - DNA, 18 bp, Homo sapiens
ccaagtccaacctgcctg

SEQ ID NO: 2336348 - DNA, 19 bp, Homo sapiens
ccaagtccaacctgcctgt

SEQ ID NO: 2336349 - DNA, 22 bp, Homo sapiens
ccaagtccctggaaaaggagct

SEQ ID NO: 2336350 - DNA, 13 bp, Homo sapiens
ccaagtgcctcac

SEQ ID NO: 2336351 - DNA, 14 bp, Homo sapiens
ccaagtgcctcacc

SEQ ID NO: 2336352 - DNA, 14 bp, Homo sapiens
ccaatcggactgcc

SEQ ID NO: 2336353 - DNA, 15 bp, Homo sapiens
ccaatcggactgcca

SEQ ID NO: 2336354 - DNA, 17 bp, Homo sapiens
ccaatgggaagcaggga

SEQ ID NO: 2336355 - DNA, 13 bp, Homo sapiens
ccaatttcctctc

SEQ ID NO: 2336356 - DNA, 15 bp, Homo sapiens
ccaatttcctctcca

SEQ ID NO: 2336357 - DNA, 16 bp, Homo sapiens
ccacaaaccctgctga

SEQ ID NO: 2336358 - DNA, 15 bp, Homo sapiens
ccacaactgtcttag

SEQ ID NO: 2336359 - DNA, 11 bp, Homo sapiens
ccacaagctgc

SEQ ID NO: 2336360 - DNA, 14 bp, Homo sapiens
ccacaagctgcact

SEQ ID NO: 2336361 - DNA, 22 bp, Homo sapiens
ccacacccaggggaaggccctg

SEQ ID NO: 2336362 - DNA, 22 bp, Homo sapiens
ccacactgggtgcgtctccagt

SEQ ID NO: 2336363 - DNA, 21 bp, Homo sapiens
ccacacttcttgaaacagcct

SEQ ID NO: 2336364 - DNA, 22 bp, Homo sapiens
ccacagagactgtttgaatgtt

SEQ ID NO: 2336365 - DNA, 12 bp, Homo sapiens
ccacagccagag

SEQ ID NO: 2336366 - DNA, 14 bp, Homo sapiens
ccacagccagagga

SEQ ID NO: 2336367 - DNA, 21 bp, Homo sapiens
ccacagccagaggagggcaga

SEQ ID NO: 2336368 - DNA, 21 bp, Homo sapiens
ccacagcgagggcagctgcta

SEQ ID NO: 2336369 - DNA, 13 bp, Homo sapiens
ccacagcgccagc

SEQ ID NO: 2336370 - DNA, 23 bp, Homo sapiens
ccacagcgccagcctcagactgg

SEQ ID NO: 2336371 - DNA, 21 bp, Homo sapiens
ccacagcgtccctggcgcagg

SEQ ID NO: 2336372 - DNA, 14 bp, Homo sapiens
ccacagctgctgtt

SEQ ID NO: 2336373 - DNA, 15 bp, Homo sapiens
ccacagctgctgttc

SEQ ID NO: 2336374 - DNA, 19 bp, Homo sapiens
ccacagctgctgttctcag

SEQ ID NO: 2336375 - DNA, 20 bp, Homo sapiens
ccacagctgctgttctcagg

SEQ ID NO: 2336376 - DNA, 19 bp, Homo sapiens
ccacaggaaggaggggaga

SEQ ID NO: 2336377 - DNA, 20 bp, Homo sapiens
ccacagtagaactgtctgtg

SEQ ID NO: 2336378 - DNA, 19 bp, Homo sapiens
ccacatccaactccagcaa

SEQ ID NO: 2336379 - DNA, 16 bp, Homo sapiens
ccacatcccatcgtct

SEQ ID NO: 2336380 - DNA, 12 bp, Homo sapiens
ccacatctgcct

SEQ ID NO: 2336381 - DNA, 13 bp, Homo sapiens
ccacatctgcctt

SEQ ID NO: 2336382 - DNA, 14 bp, Homo sapiens
ccacatctgcctta

SEQ ID NO: 2336383 - DNA, 22 bp, Homo sapiens
ccacatctgccttaaaaccaaa

SEQ ID NO: 2336384 - DNA, 19 bp, Homo sapiens
ccaccacttccagagccag

SEQ ID NO: 2336385 - DNA, 20 bp, Homo sapiens
ccaccacttccagagccaga

SEQ ID NO: 2336386 - DNA, 13 bp, Homo sapiens
ccaccagccatcc

SEQ ID NO: 2336387 - DNA, 20 bp, Homo sapiens
ccaccagcccccgccccaga

SEQ ID NO: 2336388 - DNA, 16 bp, Homo sapiens
ccacccaaccctatct

SEQ ID NO: 2336389 - DNA, 18 bp, Homo sapiens
ccacccagggctccctcc

SEQ ID NO: 2336390 - DNA, 21 bp, Homo sapiens
ccacccagggctccctcctgg

SEQ ID NO: 2336391 - DNA, 22 bp, Homo sapiens
ccaccccaacctgctctcctct

SEQ ID NO: 2336392 - DNA, 13 bp, Homo sapiens
ccaccccaagaga

SEQ ID NO: 2336393 - DNA, 15 bp, Homo sapiens
ccaccccaagagaac

SEQ ID NO: 2336394 - DNA, 17 bp, Homo sapiens
ccaccccaagagaactc

SEQ ID NO: 2336395 - DNA, 13 bp, Homo sapiens
ccaccccctgccc

SEQ ID NO: 2336396 - DNA, 18 bp, Homo sapiens
ccaccccctgccctgcac

SEQ ID NO: 2336397 - DNA, 18 bp, Homo sapiens
ccaccccggggaccctgt

SEQ ID NO: 2336398 - DNA, 21 bp, Homo sapiens
ccaccccggggaccctgtgac

SEQ ID NO: 2336399 - DNA, 14 bp, Homo sapiens
ccacccctggaaga

SEQ ID NO: 2336400 - DNA, 23 bp, Homo sapiens
ccacccctttctagaccaataaa

SEQ ID NO: 2336401 - DNA, 16 bp, Homo sapiens
ccaccctgcgggccag

SEQ ID NO: 2336402 - DNA, 17 bp, Homo sapiens
ccaccctgcgggccagg

SEQ ID NO: 2336403 - DNA, 20 bp, Homo sapiens
ccaccctgcgggccagggtc

SEQ ID NO: 2336404 - DNA, 16 bp, Homo sapiens
ccaccctgttcctgct

SEQ ID NO: 2336405 - DNA, 18 bp, Homo sapiens
cccagtgtttccacactt

SEQ ID NO: 2336406 - DNA, 21 bp, Homo sapiens
cccagttcatcaccatttcct

SEQ ID NO: 2336407 - DNA, 18 bp, Homo sapiens
cccatccagtggactctg

SEQ ID NO: 2336408 - DNA, 17 bp, Homo sapiens
cccatcctgccatcctc

SEQ ID NO: 2336409 - DNA, 14 bp, Homo sapiens
cccatctccctgcc

SEQ ID NO: 2336410 - DNA, 15 bp, Homo sapiens
cccatctccctgcct

SEQ ID NO: 2336411 - DNA, 18 bp, Homo sapiens
cccatctccctgcctggc

SEQ ID NO: 2336412 - DNA, 20 bp, Homo sapiens
cccatctccctgcctggccc

SEQ ID NO: 2336413 - DNA, 20 bp, Homo sapiens
cccatctcgctccctcccag

SEQ ID NO: 2336414 - DNA, 22 bp, Homo sapiens
cccatctcgctccctcccagga

SEQ ID NO: 2336415 - DNA, 23 bp, Homo sapiens
cccatctcgctccctcccaggac

SEQ ID NO: 2336416 - DNA, 19 bp, Homo sapiens
cccatctgcaccccttctc

SEQ ID NO: 2336417 - DNA, 18 bp, Homo sapiens
cccatcttcgggaccagg

SEQ ID NO: 2336418 - DNA, 21 bp, Homo sapiens
cccatcttcgggaccaggatt

SEQ ID NO: 2336419 - DNA, 21 bp, Homo sapiens
cccatggagattgacctggat

SEQ ID NO: 2336420 - DNA, 16 bp, Homo sapiens
cccattgtcctccttt

SEQ ID NO: 2336421 - DNA, 17 bp, Homo sapiens
cccattgttgtcaagga

SEQ ID NO: 2336422 - DNA, 21 bp, Homo sapiens
cccattgttgtcaaggaagaa

SEQ ID NO: 2336423 - DNA, 20 bp, Homo sapiens
cccatttaaatttttttcct

SEQ ID NO: 2336424 - DNA, 13 bp, Homo sapiens
cccatttctgagg

SEQ ID NO: 2336425 - DNA, 15 bp, Homo sapiens
cccatttctgcctcg

SEQ ID NO: 2336426 - DNA, 13 bp, Homo sapiens
cccatttttctct

SEQ ID NO: 2336427 - DNA, 23 bp, Homo sapiens
ccccaaaggacgcctgcaggaga

SEQ ID NO: 2336428 - DNA, 15 bp, Homo sapiens
ccccaaatcaataca

SEQ ID NO: 2336429 - DNA, 22 bp, Homo sapiens
ccccaacctcagggctcccagg

SEQ ID NO: 2336430 - DNA, 20 bp, Homo sapiens
ccccaacctgctctcctctt

SEQ ID NO: 2336431 - DNA, 17 bp, Homo sapiens
ccccacagcgtccctgg

SEQ ID NO: 2336432 - DNA, 21 bp, Homo sapiens
ccccaccggtccagctggcct

SEQ ID NO: 2336433 - DNA, 22 bp, Homo sapiens
ccccactccagtccactcctga

SEQ ID NO: 2336434 - DNA, 19 bp, Homo sapiens
ccccactcccttgctggcc

SEQ ID NO: 2336435 - DNA, 21 bp, Homo sapiens
ccccactcccttgctggcccc

SEQ ID NO: 2336436 - DNA, 21 bp, Homo sapiens
ccccactcctctgctgacctg

SEQ ID NO: 2336437 - DNA, 13 bp, Homo sapiens
ccccactttgaag

SEQ ID NO: 2336438 - DNA, 14 bp, Homo sapiens
ccccagagctgcct

SEQ ID NO: 2336439 - DNA, 16 bp, Homo sapiens
ccccagagtggcccac

SEQ ID NO: 2336440 - DNA, 22 bp, Homo sapiens
ccccagcagaggcaggctggga

SEQ ID NO: 2336441 - DNA, 22 bp, Homo sapiens
ccccagcattctcaggcaccag

SEQ ID NO: 2336442 - DNA, 13 bp, Homo sapiens
ccccagccccggg

SEQ ID NO: 2336443 - DNA, 14 bp, Homo sapiens
ccccaggccccaga

SEQ ID NO: 2336444 - DNA, 18 bp, Homo sapiens
ccccagtccccacccctg

SEQ ID NO: 2336445 - DNA, 22 bp, Homo sapiens
ccccagtcgtgatgtggaggaa

SEQ ID NO: 2336446 - DNA, 19 bp, Homo sapiens
ccccatcgttgcccccatt

SEQ ID NO: 2336447 - DNA, 18 bp, Homo sapiens
ccccatcttcgggaccag

SEQ ID NO: 2336448 - DNA, 21 bp, Homo sapiens
ccccattcctgatcccatggc

SEQ ID NO: 2336449 - DNA, 18 bp, Homo sapiens
ccccatttcccatctgca

SEQ ID NO: 2336450 - DNA, 18 bp, Homo sapiens
ccccatttctgcctcgct

SEQ ID NO: 2336451 - DNA, 14 bp, Homo sapiens
ccccatttgtccca

SEQ ID NO: 2336452 - DNA, 15 bp, Homo sapiens
ccccatttgtcccag

SEQ ID NO: 2336453 - DNA, 16 bp, Homo sapiens
cccccaactccaggaa

SEQ ID NO: 2336454 - DNA, 18 bp, Homo sapiens
cccccaccggtccagctg

SEQ ID NO: 2336455 - DNA, 15 bp, Homo sapiens
cccccagcagaggca

SEQ ID NO: 2336456 - DNA, 21 bp, Homo sapiens
cccccagccatgccagctggc

SEQ ID NO: 2336457 - DNA, 22 bp, Homo sapiens
cccccagtccccacccctgccc

SEQ ID NO: 2336458 - DNA, 18 bp, Homo sapiens
cccccatcttcgggacca

SEQ ID NO: 2336459 - DNA, 22 bp, Homo sapiens
ccccccagactctttttttgag

SEQ ID NO: 2336460 - DNA, 20 bp, Homo sapiens
ccccccttgaatctgcaggg

SEQ ID NO: 2336461 - DNA, 14 bp, Homo sapiens
cccccgccctcatg

SEQ ID NO: 2336462 - DNA, 16 bp, Homo sapiens
ccccctcccaccctgc

SEQ ID NO: 2336463 - DNA, 18 bp, Homo sapiens
ccccctcctcccagggcc

SEQ ID NO: 2336464 - DNA, 16 bp, Homo sapiens
cccccttaaatttaat

SEQ ID NO: 2336465 - DNA, 20 bp, Homo sapiens
cccccttgaatctgcaggga

SEQ ID NO: 2336466 - DNA, 16 bp, Homo sapiens
ccccgcccccagtccc

SEQ ID NO: 2336467 - DNA, 12 bp, Homo sapiens
ccccgcctgagt

SEQ ID NO: 2336468 - DNA, 16 bp, Homo sapiens
ccccgcctgagtcagt

SEQ ID NO: 2336469 - DNA, 16 bp, Homo sapiens
ccccggggaccctgtg

SEQ ID NO: 2336470 - DNA, 21 bp, Homo sapiens
cccctaaaagcactcctgctt

SEQ ID NO: 2336471 - DNA, 13 bp, Homo sapiens
cccctaaacatgg

SEQ ID NO: 2336472 - DNA, 23 bp, Homo sapiens
cccctaaccctttgtgtgctctc

SEQ ID NO: 2336473 - DNA, 14 bp, Homo sapiens
cccctactgctgtg

SEQ ID NO: 2336474 - DNA, 11 bp, Homo sapiens
cccctcaaccc

SEQ ID NO: 2336475 - DNA, 18 bp, Homo sapiens
cccctcacgcaagtgcca

SEQ ID NO: 2336476 - DNA, 14 bp, Homo sapiens
cccctccccccaga

SEQ ID NO: 2336477 - DNA, 22 bp, Homo sapiens
cccctcctcccagggcctcctg

SEQ ID NO: 2336478 - DNA, 18 bp, Homo sapiens
cccctcgcaactgtccac

SEQ ID NO: 2336479 - DNA, 12 bp, Homo sapiens
cccctctcacca

SEQ ID NO: 2336480 - DNA, 13 bp, Homo sapiens
cccctctcagaac

SEQ ID NO: 2336481 - DNA, 12 bp, Homo sapiens
cccctctccctt

SEQ ID NO: 2336482 - DNA, 22 bp, Homo sapiens
cccctctcccttgggctctgat

SEQ ID NO: 2336483 - DNA, 11 bp, Homo sapiens
cccctctcctc

SEQ ID NO: 2336484 - DNA, 12 bp, Homo sapiens
cccctgcccctc

SEQ ID NO: 2336485 - DNA, 14 bp, Homo sapiens
cccctgccctgcac

SEQ ID NO: 2336486 - DNA, 13 bp, Homo sapiens
cccctgctcagca

SEQ ID NO: 2336487 - DNA, 17 bp, Homo sapiens
cccctggaagagcccag

SEQ ID NO: 2336488 - DNA, 22 bp, Homo sapiens
ccccttccagatcactgccaca

SEQ ID NO: 2336489 - DNA, 19 bp, Homo sapiens
ccccttctctcctccccaa

SEQ ID NO: 2336490 - DNA, 21 bp, Homo sapiens
ccccttggaaatgtctgctgg

SEQ ID NO: 2336491 - DNA, 13 bp, Homo sapiens
cccctttcctgtc

SEQ ID NO: 2336492 - DNA, 15 bp, Homo sapiens
cccgactagcaggca

SEQ ID NO: 2336493 - DNA, 15 bp, Homo sapiens
cccgcagggccatgc

SEQ ID NO: 2336494 - DNA, 18 bp, Homo sapiens
cccgcagggccatgcaga

SEQ ID NO: 2336495 - DNA, 12 bp, Homo sapiens
cccgcctgagtc

SEQ ID NO: 2336496 - DNA, 16 bp, Homo sapiens
cccgcctggccaggag

SEQ ID NO: 2336497 - DNA, 17 bp, Homo sapiens
cccgcctggccaggagc

SEQ ID NO: 2336498 - DNA, 15 bp, Homo sapiens
cccgggccagggctg

SEQ ID NO: 2336499 - DNA, 16 bp, Homo sapiens
cccggggaccctgtga

SEQ ID NO: 2336500 - DNA, 17 bp, Homo sapiens
cccggttcaccttgccg

SEQ ID NO: 2336501 - DNA, 20 bp, Homo sapiens
cccgtgcatcccccctgctc

SEQ ID NO: 2336502 - DNA, 18 bp, Homo sapiens
cccgttccaccccaagag

SEQ ID NO: 2336503 - DNA, 15 bp, Homo sapiens
ccctacagcctaggg

SEQ ID NO: 2336504 - DNA, 17 bp, Homo sapiens
ccctacagcctagggca

SEQ ID NO: 2336505 - DNA, 15 bp, Homo sapiens
ccctactccctgcag

SEQ ID NO: 2336506 - DNA, 16 bp, Homo sapiens
ccctactccctgcaga

SEQ ID NO: 2336507 - DNA, 18 bp, Homo sapiens
ccctactccctgcagatg

SEQ ID NO: 2336508 - DNA, 14 bp, Homo sapiens
ccctactgctgtga

SEQ ID NO: 2336509 - DNA, 11 bp, Homo sapiens
ccctatctccc

SEQ ID NO: 2336510 - DNA, 17 bp, Homo sapiens
ccctatctcctgacaga

SEQ ID NO: 2336511 - DNA, 20 bp, Homo sapiens
ccctatctcctgacagaagg

SEQ ID NO: 2336512 - DNA, 15 bp, Homo sapiens
ccctcaaaccctgtg

SEQ ID NO: 2336513 - DNA, 16 bp, Homo sapiens
ccctcaaaccctgtgg

SEQ ID NO: 2336514 - DNA, 19 bp, Homo sapiens
ccctcactggctctcctgg

SEQ ID NO: 2336515 - DNA, 20 bp, Homo sapiens
ccctcagggagcctccccat

SEQ ID NO: 2336516 - DNA, 20 bp, Homo sapiens
ccctccacccatccagtgga

SEQ ID NO: 2336517 - DNA, 15 bp, Homo sapiens
ccctccacctcaaga

SEQ ID NO: 2336518 - DNA, 12 bp, Homo sapiens
ccctccactctc

SEQ ID NO: 2336519 - DNA, 13 bp, Homo sapiens
ccctccagagaca

SEQ ID NO: 2336520 - DNA, 18 bp, Homo sapiens
cctgacttggctggggag

SEQ ID NO: 2336521 - DNA, 19 bp, Homo sapiens
cctgacttggggagatgga

SEQ ID NO: 2336522 - DNA, 18 bp, Homo sapiens
cctgagaccacagagaga

SEQ ID NO: 2336523 - DNA, 14 bp, Homo sapiens
cctgagaggcaggc

SEQ ID NO: 2336524 - DNA, 18 bp, Homo sapiens
cctgagctattttcctct

SEQ ID NO: 2336525 - DNA, 22 bp, Homo sapiens
cctgagctattttcctctggcc

SEQ ID NO: 2336526 - DNA, 16 bp, Homo sapiens
cctgaggccctgggct

SEQ ID NO: 2336527 - DNA, 20 bp, Homo sapiens
cctgaggccctgggctgggt

SEQ ID NO: 2336528 - DNA, 12 bp, Homo sapiens
cctgagggcagt

SEQ ID NO: 2336529 - DNA, 14 bp, Homo sapiens
cctgaggtcccctc

SEQ ID NO: 2336530 - DNA, 14 bp, Homo sapiens
cctgagtcagtgct

SEQ ID NO: 2336531 - DNA, 21 bp, Homo sapiens
cctgagtcagtgctctcagct

SEQ ID NO: 2336532 - DNA, 19 bp, Homo sapiens
cctgagtcgtacagaaagc

SEQ ID NO: 2336533 - DNA, 19 bp, Homo sapiens
cctgagtgcgggctgaggc

SEQ ID NO: 2336534 - DNA, 20 bp, Homo sapiens
cctgatcattacatggctgt

SEQ ID NO: 2336535 - DNA, 22 bp, Homo sapiens
cctgatgaaaaatatgtgcttg

SEQ ID NO: 2336536 - DNA, 22 bp, Homo sapiens
cctgattcttgattcctggctc

SEQ ID NO: 2336537 - DNA, 20 bp, Homo sapiens
cctgcaaactgggaacccct

SEQ ID NO: 2336538 - DNA, 21 bp, Homo sapiens
cctgcaagatggacacgagcc

SEQ ID NO: 2336539 - DNA, 22 bp, Homo sapiens
cctgcaagatggacacgagcca

SEQ ID NO: 2336540 - DNA, 19 bp, Homo sapiens
cctgcacaataaaaatgtt

SEQ ID NO: 2336541 - DNA, 11 bp, Homo sapiens
cctgcacacag

SEQ ID NO: 2336542 - DNA, 18 bp, Homo sapiens
cctgcacgtcatgggagg

SEQ ID NO: 2336543 - DNA, 18 bp, Homo sapiens
cctgcagacctcaagcca

SEQ ID NO: 2336544 - DNA, 21 bp, Homo sapiens
cctgcagacctcaagccatca

SEQ ID NO: 2336545 - DNA, 15 bp, Homo sapiens
cctgcagagctatgg

SEQ ID NO: 2336546 - DNA, 14 bp, Homo sapiens
cctgcagatgccac

SEQ ID NO: 2336547 - DNA, 15 bp, Homo sapiens
cctgcagatgccacc

SEQ ID NO: 2336548 - DNA, 17 bp, Homo sapiens
cctgcaggagagagcag

SEQ ID NO: 2336549 - DNA, 17 bp, Homo sapiens
cctgcaggcagagctgg

SEQ ID NO: 2336550 - DNA, 23 bp, Homo sapiens
cctgcaggcaggaacaaacaggg

SEQ ID NO: 2336551 - DNA, 21 bp, Homo sapiens
cctgccacactgatggctcaa

SEQ ID NO: 2336552 - DNA, 23 bp, Homo sapiens
cctgccacactgatggctcaaga

SEQ ID NO: 2336553 - DNA, 12 bp, Homo sapiens
cctgccacagcc

SEQ ID NO: 2336554 - DNA, 15 bp, Homo sapiens
cctgccacagccaga

SEQ ID NO: 2336555 - DNA, 15 bp, Homo sapiens
cctgccaggcagggg

SEQ ID NO: 2336556 - DNA, 14 bp, Homo sapiens
cctgcccccagccc

SEQ ID NO: 2336557 - DNA, 18 bp, Homo sapiens
cctgcccccagccccggg

SEQ ID NO: 2336558 - DNA, 18 bp, Homo sapiens
cctgccctcaagggtgtg

SEQ ID NO: 2336559 - DNA, 13 bp, Homo sapiens
cctgccctcactc

SEQ ID NO: 2336560 - DNA, 13 bp, Homo sapiens
cctgccctgcacg

SEQ ID NO: 2336561 - DNA, 13 bp, Homo sapiens
cctgcccttccct

SEQ ID NO: 2336562 - DNA, 15 bp, Homo sapiens
cctgcccttccctct

SEQ ID NO: 2336563 - DNA, 21 bp, Homo sapiens
cctgccgggctgagggcctgc

SEQ ID NO: 2336564 - DNA, 23 bp, Homo sapiens
cctgccgggctgagggcctgctg

SEQ ID NO: 2336565 - DNA, 17 bp, Homo sapiens
cctgcctcagccttcca

SEQ ID NO: 2336566 - DNA, 13 bp, Homo sapiens
cctgcctgagggc

SEQ ID NO: 2336567 - DNA, 12 bp, Homo sapiens
cctgcctggccc

SEQ ID NO: 2336568 - DNA, 13 bp, Homo sapiens
cctgcctggcccc

SEQ ID NO: 2336569 - DNA, 16 bp, Homo sapiens
cctgcctgtctgcccc

SEQ ID NO: 2336570 - DNA, 13 bp, Homo sapiens
cctgcgcctgctg

SEQ ID NO: 2336571 - DNA, 12 bp, Homo sapiens
cctgcgggccag

SEQ ID NO: 2336572 - DNA, 17 bp, Homo sapiens
cctgcgggccagggtcc

SEQ ID NO: 2336573 - DNA, 16 bp, Homo sapiens
cctgcgtcctcctcac

SEQ ID NO: 2336574 - DNA, 20 bp, Homo sapiens
cctgctacacctattatccc

SEQ ID NO: 2336575 - DNA, 20 bp, Homo sapiens
cctgctcagcaattcagacc

SEQ ID NO: 2336576 - DNA, 23 bp, Homo sapiens
cctgctcattcctcacgcccttc

SEQ ID NO: 2336577 - DNA, 15 bp, Homo sapiens
cctgctctcctcttc

SEQ ID NO: 2336578 - DNA, 18 bp, Homo sapiens
cctgctctgtccccaaag

SEQ ID NO: 2336579 - DNA, 19 bp, Homo sapiens
cctgctgaacacagtgtct

SEQ ID NO: 2336580 - DNA, 21 bp, Homo sapiens
cctgctgaacacagtgtctgt

SEQ ID NO: 2336581 - DNA, 14 bp, Homo sapiens
cctgctgcgcagtt

SEQ ID NO: 2336582 - DNA, 18 bp, Homo sapiens
cctgctgcgtcagaccag

SEQ ID NO: 2336583 - DNA, 22 bp, Homo sapiens
cctgctgcgtcagaccagtact

SEQ ID NO: 2336584 - DNA, 20 bp, Homo sapiens
cctgctgctgtctgggtgct

SEQ ID NO: 2336585 - DNA, 23 bp, Homo sapiens
cctgctgctgtctgggtgctact

SEQ ID NO: 2336586 - DNA, 13 bp, Homo sapiens
cctgctggaagcc

SEQ ID NO: 2336587 - DNA, 16 bp, Homo sapiens
cctgctggaagcccag

SEQ ID NO: 2336588 - DNA, 17 bp, Homo sapiens
cctgctggaagcccagc

SEQ ID NO: 2336589 - DNA, 13 bp, Homo sapiens
cctgctggaggcc

SEQ ID NO: 2336590 - DNA, 14 bp, Homo sapiens
cctgctggaggcct

SEQ ID NO: 2336591 - DNA, 17 bp, Homo sapiens
cctgctggaggcctcag

SEQ ID NO: 2336592 - DNA, 18 bp, Homo sapiens
cctgctggaggcctcagg

SEQ ID NO: 2336593 - DNA, 21 bp, Homo sapiens
cctgctggaggcctcaggtgc

SEQ ID NO: 2336594 - DNA, 13 bp, Homo sapiens
cctgctggggatc

SEQ ID NO: 2336595 - DNA, 23 bp, Homo sapiens
cctgctgtgattccactacacct

SEQ ID NO: 2336596 - DNA, 12 bp, Homo sapiens
cctgctgtgcct

SEQ ID NO: 2336597 - DNA, 18 bp, Homo sapiens
cctgctgtgcctcgcatc

SEQ ID NO: 2336598 - DNA, 23 bp, Homo sapiens
cctgcttaatcttcaaagccttc

SEQ ID NO: 2336599 - DNA, 22 bp, Homo sapiens
cctgcttccaggaaactccaca

SEQ ID NO: 2336600 - DNA, 20 bp, Homo sapiens
cctgctttgaataaatgtgt

SEQ ID NO: 2336601 - DNA, 15 bp, Homo sapiens
cctggaagccagctt

SEQ ID NO: 2336602 - DNA, 11 bp, Homo sapiens
cctggacacat

SEQ ID NO: 2336603 - DNA, 18 bp, Homo sapiens
cctggacaggcagcctcc

SEQ ID NO: 2336604 - DNA, 19 bp, Homo sapiens
cctggacagtatcccacat

SEQ ID NO: 2336605 - DNA, 15 bp, Homo sapiens
cctggacctgggaac

SEQ ID NO: 2336606 - DNA, 23 bp, Homo sapiens
cctggactaaaggcatccttgtc

SEQ ID NO: 2336607 - DNA, 20 bp, Homo sapiens
cctggagacaaggtgctaac

SEQ ID NO: 2336608 - DNA, 16 bp, Homo sapiens
cctggatagacgagtt

SEQ ID NO: 2336609 - DNA, 13 bp, Homo sapiens
cctggcacacatc

SEQ ID NO: 2336610 - DNA, 15 bp, Homo sapiens
cctggcagcccagag

SEQ ID NO: 2336611 - DNA, 17 bp, Homo sapiens
cctggcagcccagagac

SEQ ID NO: 2336612 - DNA, 18 bp, Homo sapiens
cctggcagcccagagact

SEQ ID NO: 2336613 - DNA, 17 bp, Homo sapiens
cctggccccagcctggg

SEQ ID NO: 2336614 - DNA, 22 bp, Homo sapiens
cctggccccaggccccagacag

SEQ ID NO: 2336615 - DNA, 19 bp, Homo sapiens
cctggcccccaacctcagg

SEQ ID NO: 2336616 - DNA, 12 bp, Homo sapiens
cctggccccctc

SEQ ID NO: 2336617 - DNA, 12 bp, Homo sapiens
cctggcccctct

SEQ ID NO: 2336618 - DNA, 13 bp, Homo sapiens
cctggcccctctc

SEQ ID NO: 2336619 - DNA, 17 bp, Homo sapiens
cctggcccctctccctt

SEQ ID NO: 2336620 - DNA, 22 bp, Homo sapiens
cctggccgcttctccccagagc

SEQ ID NO: 2336621 - DNA, 23 bp, Homo sapiens
cctggcctatccgctgccagcct

SEQ ID NO: 2336622 - DNA, 19 bp, Homo sapiens
cctggcctggcacacatca

SEQ ID NO: 2336623 - DNA, 20 bp, Homo sapiens
cctggcgactgcccctgcct

SEQ ID NO: 2336624 - DNA, 19 bp, Homo sapiens
cctggctctaccctgtctg

SEQ ID NO: 2336625 - DNA, 15 bp, Homo sapiens
cctggctctcacctc

SEQ ID NO: 2336626 - DNA, 19 bp, Homo sapiens
cctggctgaggttcctctg

SEQ ID NO: 2336627 - DNA, 20 bp, Homo sapiens
cctggctgaggttcctctgc

SEQ ID NO: 2336628 - DNA, 21 bp, Homo sapiens
cctggctgaggttcctctgcc

SEQ ID NO: 2336629 - DNA, 14 bp, Homo sapiens
cctggctgctgccc

SEQ ID NO: 2336630 - DNA, 22 bp, Homo sapiens
cctggctggaggagcagcagct

SEQ ID NO: 2336631 - DNA, 23 bp, Homo sapiens
cctgggaaggcgagtctggggac

SEQ ID NO: 2336632 - DNA, 15 bp, Homo sapiens
cctgggacaactgct

SEQ ID NO: 2336633 - DNA, 18 bp, Homo sapiens
cctgggacggcggcagta

SEQ ID NO: 2336634 - DNA, 15 bp, Homo sapiens
cggactggtgccctc

SEQ ID NO: 2336635 - DNA, 21 bp, Homo sapiens
cggagacagaggaaagggctg

SEQ ID NO: 2336636 - DNA, 14 bp, Homo sapiens
cggaggctgtgctc

SEQ ID NO: 2336637 - DNA, 18 bp, Homo sapiens
cggagtgtctggaattgt

SEQ ID NO: 2336638 - DNA, 19 bp, Homo sapiens
cggatcatcaacaagattt

SEQ ID NO: 2336639 - DNA, 19 bp, Homo sapiens
cggatctcacaggctgaga

SEQ ID NO: 2336640 - DNA, 16 bp, Homo sapiens
cggatctgctgggctc

SEQ ID NO: 2336641 - DNA, 16 bp, Homo sapiens
cggatgggcacacaca

SEQ ID NO: 2336642 - DNA, 12 bp, Homo sapiens
cggatttctaac

SEQ ID NO: 2336643 - DNA, 15 bp, Homo sapiens
cggcaaacctttccc

SEQ ID NO: 2336644 - DNA, 13 bp, Homo sapiens
cggcaagccacag

SEQ ID NO: 2336645 - DNA, 18 bp, Homo sapiens
cggcaggctcactgccag

SEQ ID NO: 2336646 - DNA, 19 bp, Homo sapiens
cggcaggctcactgccagg

SEQ ID NO: 2336647 - DNA, 21 bp, Homo sapiens
cggcagtattgaagctcgtga

SEQ ID NO: 2336648 - DNA, 14 bp, Homo sapiens
cggccaccactgca

SEQ ID NO: 2336649 - DNA, 17 bp, Homo sapiens
cggcccagatgtgtccc

SEQ ID NO: 2336650 - DNA, 20 bp, Homo sapiens
cggccccctccccccagact

SEQ ID NO: 2336651 - DNA, 22 bp, Homo sapiens
cggccccctccccccagactct

SEQ ID NO: 2336652 - DNA, 12 bp, Homo sapiens
cggcctccttct

SEQ ID NO: 2336653 - DNA, 19 bp, Homo sapiens
cggcctgtgggtctctgaa

SEQ ID NO: 2336654 - DNA, 17 bp, Homo sapiens
cggcgtggcccaaggct

SEQ ID NO: 2336655 - DNA, 22 bp, Homo sapiens
cggctccccctccagccagaga

SEQ ID NO: 2336656 - DNA, 18 bp, Homo sapiens
cggctcccctctgcttct

SEQ ID NO: 2336657 - DNA, 23 bp, Homo sapiens
cggctcctcagagcgccaggaag

SEQ ID NO: 2336658 - DNA, 13 bp, Homo sapiens
cggctctgcagtc

SEQ ID NO: 2336659 - DNA, 14 bp, Homo sapiens
cgggacagagtagc

SEQ ID NO: 2336660 - DNA, 14 bp, Homo sapiens
cgggacccagggcc

SEQ ID NO: 2336661 - DNA, 13 bp, Homo sapiens
cgggagactgaac

SEQ ID NO: 2336662 - DNA, 18 bp, Homo sapiens
cgggccaaggacctgaga

SEQ ID NO: 2336663 - DNA, 23 bp, Homo sapiens
cgggcccctgggcttggcctgct

SEQ ID NO: 2336664 - DNA, 15 bp, Homo sapiens
cgggcctcagtgccc

SEQ ID NO: 2336665 - DNA, 15 bp, Homo sapiens
cgggctgaggccaga

SEQ ID NO: 2336666 - DNA, 16 bp, Homo sapiens
cgggctgagggcctgc

SEQ ID NO: 2336667 - DNA, 15 bp, Homo sapiens
cggggaagctggctt

SEQ ID NO: 2336668 - DNA, 22 bp, Homo sapiens
cggggccttatcgggctccagc

SEQ ID NO: 2336669 - DNA, 23 bp, Homo sapiens
cggggtgagtccattctcccagg

SEQ ID NO: 2336670 - DNA, 15 bp, Homo sapiens
cgggtgatggccagc

SEQ ID NO: 2336671 - DNA, 18 bp, Homo sapiens
cgggtgatggccagcccc

SEQ ID NO: 2336672 - DNA, 12 bp, Homo sapiens
cgggtggtcccc

SEQ ID NO: 2336673 - DNA, 14 bp, Homo sapiens
cgggtggtccccgt

SEQ ID NO: 2336674 - DNA, 13 bp, Homo sapiens
cggtccagctggc

SEQ ID NO: 2336675 - DNA, 21 bp, Homo sapiens
cggtccagctggcctggacag

SEQ ID NO: 2336676 - DNA, 17 bp, Homo sapiens
cggtcctttaggcagcc

SEQ ID NO: 2336677 - DNA, 16 bp, Homo sapiens
cggtgaccactcttct

SEQ ID NO: 2336678 - DNA, 17 bp, Homo sapiens
cggtgcccatcctgcca

SEQ ID NO: 2336679 - DNA, 18 bp, Homo sapiens
cggtgctaaaaatgaaaa

SEQ ID NO: 2336680 - DNA, 18 bp, Homo sapiens
cggtgctgtgagggaggg

SEQ ID NO: 2336681 - DNA, 12 bp, Homo sapiens
cggtggctgggc

SEQ ID NO: 2336682 - DNA, 22 bp, Homo sapiens
cggtgggactcgtggctgtcaa

SEQ ID NO: 2336683 - DNA, 13 bp, Homo sapiens
cggttcctggtga

SEQ ID NO: 2336684 - DNA, 18 bp, Homo sapiens
cggttcctggtgactcct

SEQ ID NO: 2336685 - DNA, 14 bp, Homo sapiens
cggttgttctttcc

SEQ ID NO: 2336686 - DNA, 22 bp, Homo sapiens
cgtcaggccctgactcctctgg

SEQ ID NO: 2336687 - DNA, 13 bp, Homo sapiens
cgtccatctccct

SEQ ID NO: 2336688 - DNA, 14 bp, Homo sapiens
cgtccctggcgcag

SEQ ID NO: 2336689 - DNA, 21 bp, Homo sapiens
cgtctcttttaccctggcccc

SEQ ID NO: 2336690 - DNA, 18 bp, Homo sapiens
cgtctgccggacccggag

SEQ ID NO: 2336691 - DNA, 17 bp, Homo sapiens
cgtgaaagtgcattttt

SEQ ID NO: 2336692 - DNA, 17 bp, Homo sapiens
cgtgaagaaataaatga

SEQ ID NO: 2336693 - DNA, 18 bp, Homo sapiens
cgtgacccgacctggccg

SEQ ID NO: 2336694 - DNA, 13 bp, Homo sapiens
cgtgatgtggagg

SEQ ID NO: 2336695 - DNA, 16 bp, Homo sapiens
cgtgatgtggaggaag

SEQ ID NO: 2336696 - DNA, 17 bp, Homo sapiens
cgtgcatccctgagaca

SEQ ID NO: 2336697 - DNA, 13 bp, Homo sapiens
cgtgcctggccag

SEQ ID NO: 2336698 - DNA, 18 bp, Homo sapiens
cgtggatgcgcagtgcct

SEQ ID NO: 2336699 - DNA, 19 bp, Homo sapiens
cgtggcctccgcagtgtct

SEQ ID NO: 2336700 - DNA, 13 bp, Homo sapiens
cgtggcttggagg

SEQ ID NO: 2336701 - DNA, 14 bp, Homo sapiens
cgtggtagaagcca

SEQ ID NO: 2336702 - DNA, 17 bp, Homo sapiens
cgtggtagaagccagta

SEQ ID NO: 2336703 - DNA, 21 bp, Homo sapiens
cgtggtttgcctgaggctgta

SEQ ID NO: 2336704 - DNA, 14 bp, Homo sapiens
cgtgtcaagctgct

SEQ ID NO: 2336705 - DNA, 18 bp, Homo sapiens
cgtgtgtcccagatgctg

SEQ ID NO: 2336706 - DNA, 17 bp, Homo sapiens
cgtgttcagcagaacct

SEQ ID NO: 2336707 - DNA, 20 bp, Homo sapiens
cgtgttcagcagaacctgca

SEQ ID NO: 2336708 - DNA, 15 bp, Homo sapiens
cgtgtttctgactct

SEQ ID NO: 2336709 - DNA, 22 bp, Homo sapiens
cgttcacctccaagcatttcat

SEQ ID NO: 2336710 - DNA, 23 bp, Homo sapiens
cgttcacctccaagcatttcatg

SEQ ID NO: 2336711 - DNA, 20 bp, Homo sapiens
cgttctaggtaggaagagcc

SEQ ID NO: 2336712 - DNA, 21 bp, Homo sapiens
cgttgcccccatttctgaggt

SEQ ID NO: 2336713 - DNA, 12 bp, Homo sapiens
cgttgtgagctg

SEQ ID NO: 2336714 - DNA, 18 bp, Homo sapiens
cgttgttttgtggataag

SEQ ID NO: 2336715 - DNA, 22 bp, Homo sapiens
cgtttctttaaccttgtataaa

SEQ ID NO: 2336716 - DNA, 16 bp, Homo sapiens
cgtttttgtttactgg

SEQ ID NO: 2336717 - DNA, 15 bp, Homo sapiens
ctaaaaatacaaaaa

SEQ ID NO: 2336718 - DNA, 15 bp, Homo sapiens
ctaaaaatgaaaatt

SEQ ID NO: 2336719 - DNA, 23 bp, Homo sapiens
ctaaacatgtatgtaaatagcta

SEQ ID NO: 2336720 - DNA, 17 bp, Homo sapiens
ctaaaccaaggactgag

SEQ ID NO: 2336721 - DNA, 16 bp, Homo sapiens
ctaaagagcccttgcc

SEQ ID NO: 2336722 - DNA, 19 bp, Homo sapiens
ctaaagagcccttgcctcc

SEQ ID NO: 2336723 - DNA, 17 bp, Homo sapiens
ctaaaggcatccttgtc

SEQ ID NO: 2336724 - DNA, 18 bp, Homo sapiens
ctaaagtatacaactgcc

SEQ ID NO: 2336725 - DNA, 15 bp, Homo sapiens
ctaaataaaaatatg

SEQ ID NO: 2336726 - DNA, 16 bp, Homo sapiens
ctaaatagtattttgt

SEQ ID NO: 2336727 - DNA, 14 bp, Homo sapiens
ctaaatcagagaca

SEQ ID NO: 2336728 - DNA, 21 bp, Homo sapiens
ctaaatgcatatcctgagcca

SEQ ID NO: 2336729 - DNA, 22 bp, Homo sapiens
ctaaattatagtgtagaaaaga

SEQ ID NO: 2336730 - DNA, 14 bp, Homo sapiens
ctaaattttaaagc

SEQ ID NO: 2336731 - DNA, 17 bp, Homo sapiens
ctaacacagcatgtgta

SEQ ID NO: 2336732 - DNA, 15 bp, Homo sapiens
ctaacacattaaatg

SEQ ID NO: 2336733 - DNA, 18 bp, Homo sapiens
ctaacagataagcaagag

SEQ ID NO: 2336734 - DNA, 20 bp, Homo sapiens
ctaacagctacaaactttta

SEQ ID NO: 2336735 - DNA, 21 bp, Homo sapiens
ctaacagctacaaacttttaa

SEQ ID NO: 2336736 - DNA, 12 bp, Homo sapiens
ctaacagtcctt

SEQ ID NO: 2336737 - DNA, 16 bp, Homo sapiens
ctaacagtccttgctt

SEQ ID NO: 2336738 - DNA, 14 bp, Homo sapiens
ctaaccccttccag

SEQ ID NO: 2336739 - DNA, 16 bp, Homo sapiens
ctaactaaataccatt

SEQ ID NO: 2336740 - DNA, 14 bp, Homo sapiens
ctaactcaaataca

SEQ ID NO: 2336741 - DNA, 19 bp, Homo sapiens
ctaagagaagttattttct

SEQ ID NO: 2336742 - DNA, 16 bp, Homo sapiens
ctaagagtaaagcaac

SEQ ID NO: 2336743 - DNA, 22 bp, Homo sapiens
ctaagccaggcctggctggagg

SEQ ID NO: 2336744 - DNA, 14 bp, Homo sapiens
ctaagcctgttgct

SEQ ID NO: 2336745 - DNA, 17 bp, Homo sapiens
ctaagtgctaagtgctt

SEQ ID NO: 2336746 - DNA, 15 bp, Homo sapiens
ctaatcacagtgttg

SEQ ID NO: 2336747 - DNA, 18 bp, Homo sapiens
ctaatcaccatgtaagca

SEQ ID NO: 2336748 - DNA, 23 bp, Homo sapiens
ctaatcagattgcttaaaagcat

SEQ ID NO: 2336749 - DNA, 22 bp, Homo sapiens
ctcagtgagcctcctgtgcctg

SEQ ID NO: 2336750 - DNA, 16 bp, Homo sapiens
ctcagtgccctccagc

SEQ ID NO: 2336751 - DNA, 20 bp, Homo sapiens
ctcagtgtccagcttccaaa

SEQ ID NO: 2336752 - DNA, 22 bp, Homo sapiens
ctcagtgtccagcttccaaagc

SEQ ID NO: 2336753 - DNA, 21 bp, Homo sapiens
ctcagtgttggtatattttat

SEQ ID NO: 2336754 - DNA, 22 bp, Homo sapiens
ctcagttaaatctcctgtggag

SEQ ID NO: 2336755 - DNA, 18 bp, Homo sapiens
ctcagttttccttctgtt

SEQ ID NO: 2336756 - DNA, 17 bp, Homo sapiens
ctcataagtaaatgtct

SEQ ID NO: 2336757 - DNA, 19 bp, Homo sapiens
ctcataagtaaatgtcttc

SEQ ID NO: 2336758 - DNA, 15 bp, Homo sapiens
ctcataggttaaaaa

SEQ ID NO: 2336759 - DNA, 22 bp, Homo sapiens
ctcataggttaaaaaaaaaagt

SEQ ID NO: 2336760 - DNA, 13 bp, Homo sapiens
ctcatataagaca

SEQ ID NO: 2336761 - DNA, 13 bp, Homo sapiens
ctcatattgtgat

SEQ ID NO: 2336762 - DNA, 21 bp, Homo sapiens
ctcatattgtgattctgcctt

SEQ ID NO: 2336763 - DNA, 18 bp, Homo sapiens
ctcatccacataccctga

SEQ ID NO: 2336764 - DNA, 13 bp, Homo sapiens
ctcatcccaacct

SEQ ID NO: 2336765 - DNA, 16 bp, Homo sapiens
ctcatcccaacctctt

SEQ ID NO: 2336766 - DNA, 23 bp, Homo sapiens
ctcatgaggaggggcccccctgc

SEQ ID NO: 2336767 - DNA, 14 bp, Homo sapiens
ctcatgaggggaga

SEQ ID NO: 2336768 - DNA, 16 bp, Homo sapiens
ctcatgcaaatcaatt

SEQ ID NO: 2336769 - DNA, 16 bp, Homo sapiens
ctcatgcccagctctc

SEQ ID NO: 2336770 - DNA, 22 bp, Homo sapiens
ctcatgggtcctagcccttccc

SEQ ID NO: 2336771 - DNA, 22 bp, Homo sapiens
ctcattacagttctttcctctt

SEQ ID NO: 2336772 - DNA, 17 bp, Homo sapiens
ctcattatttcaaaatg

SEQ ID NO: 2336773 - DNA, 18 bp, Homo sapiens
ctcattctgaattaatta

SEQ ID NO: 2336774 - DNA, 20 bp, Homo sapiens
ctccaaatggagaagctgca

SEQ ID NO: 2336775 - DNA, 22 bp, Homo sapiens
ctccaaatggagaagctgcagg

SEQ ID NO: 2336776 - DNA, 13 bp, Homo sapiens
ctccaaccactgt

SEQ ID NO: 2336777 - DNA, 13 bp, Homo sapiens
ctccaagaaactg

SEQ ID NO: 2336778 - DNA, 22 bp, Homo sapiens
ctccaagcccagcccatggaga

SEQ ID NO: 2336779 - DNA, 22 bp, Homo sapiens
ctccaaggaggggctgtaaaat

SEQ ID NO: 2336780 - DNA, 16 bp, Homo sapiens
ctccacaacccaagca

SEQ ID NO: 2336781 - DNA, 20 bp, Homo sapiens
ctccacacagtgctcaaggc

SEQ ID NO: 2336782 - DNA, 22 bp, Homo sapiens
ctccacagcgagggcagctgct

SEQ ID NO: 2336783 - DNA, 12 bp, Homo sapiens
ctccacagtgtt

SEQ ID NO: 2336784 - DNA, 14 bp, Homo sapiens
ctccacatctgcct

SEQ ID NO: 2336785 - DNA, 15 bp, Homo sapiens
ctccacatctgcctt

SEQ ID NO: 2336786 - DNA, 16 bp, Homo sapiens
ctccacatctgcctta

SEQ ID NO: 2336787 - DNA, 14 bp, Homo sapiens
ctccacccactgtc

SEQ ID NO: 2336788 - DNA, 13 bp, Homo sapiens
ctccactgctgga

SEQ ID NO: 2336789 - DNA, 16 bp, Homo sapiens
ctccactgctggacat

SEQ ID NO: 2336790 - DNA, 17 bp, Homo sapiens
ctccagataactctctt

SEQ ID NO: 2336791 - DNA, 21 bp, Homo sapiens
ctccagataactctctttcct

SEQ ID NO: 2336792 - DNA, 21 bp, Homo sapiens
ctccagcaacttcttctccat

SEQ ID NO: 2336793 - DNA, 20 bp, Homo sapiens
ctccagcctgaacagaagct

SEQ ID NO: 2336794 - DNA, 12 bp, Homo sapiens
ctccagcctggg

SEQ ID NO: 2336795 - DNA, 23 bp, Homo sapiens
ctccagcgtcagctgctccctgg

SEQ ID NO: 2336796 - DNA, 11 bp, Homo sapiens
ctccaggagct

SEQ ID NO: 2336797 - DNA, 17 bp, Homo sapiens
ctccaggcctgcctccc

SEQ ID NO: 2336798 - DNA, 18 bp, Homo sapiens
ctccaggcctgcctccca

SEQ ID NO: 2336799 - DNA, 14 bp, Homo sapiens
ctccaggctccagc

SEQ ID NO: 2336800 - DNA, 20 bp, Homo sapiens
ctccagggacacacagccta

SEQ ID NO: 2336801 - DNA, 18 bp, Homo sapiens
ctccagttttctcctctg

SEQ ID NO: 2336802 - DNA, 20 bp, Homo sapiens
ctccataaagtacaaatgaa

SEQ ID NO: 2336803 - DNA, 15 bp, Homo sapiens
ctccatcaccctctt

SEQ ID NO: 2336804 - DNA, 22 bp, Homo sapiens
ctccatccctctaatgagactg

SEQ ID NO: 2336805 - DNA, 18 bp, Homo sapiens
ctccatctcccaaggctg

SEQ ID NO: 2336806 - DNA, 19 bp, Homo sapiens
ctccatctcccaaggctgc

SEQ ID NO: 2336807 - DNA, 21 bp, Homo sapiens
ctccatctcccaaggctgcca

SEQ ID NO: 2336808 - DNA, 20 bp, Homo sapiens
ctccatggccctgtcccagg

SEQ ID NO: 2336809 - DNA, 14 bp, Homo sapiens
ctccattcatcctt

SEQ ID NO: 2336810 - DNA, 15 bp, Homo sapiens
ctccattcatccttc

SEQ ID NO: 2336811 - DNA, 15 bp, Homo sapiens
ctccattctgctcct

SEQ ID NO: 2336812 - DNA, 16 bp, Homo sapiens
ctccattctgctcctt

SEQ ID NO: 2336813 - DNA, 17 bp, Homo sapiens
ctccattcttttaaatc

SEQ ID NO: 2336814 - DNA, 21 bp, Homo sapiens
ctccattgggcacagtccaga

SEQ ID NO: 2336815 - DNA, 16 bp, Homo sapiens
ctcccaaggctgccag

SEQ ID NO: 2336816 - DNA, 17 bp, Homo sapiens
ctcccaaggctgccaga

SEQ ID NO: 2336817 - DNA, 19 bp, Homo sapiens
ctcccaaggctgccagaca

SEQ ID NO: 2336818 - DNA, 12 bp, Homo sapiens
ctcccaccctct

SEQ ID NO: 2336819 - DNA, 13 bp, Homo sapiens
ctcccacctcctg

SEQ ID NO: 2336820 - DNA, 21 bp, Homo sapiens
ctcccagaaacatctctggcc

SEQ ID NO: 2336821 - DNA, 17 bp, Homo sapiens
ctcccagagctggtgga

SEQ ID NO: 2336822 - DNA, 12 bp, Homo sapiens
ctcccaggcaag

SEQ ID NO: 2336823 - DNA, 18 bp, Homo sapiens
ctcccaggcaagcagctg

SEQ ID NO: 2336824 - DNA, 17 bp, Homo sapiens
ctcccagggcctcctgg

SEQ ID NO: 2336825 - DNA, 16 bp, Homo sapiens
ctcccaggggtctccc

SEQ ID NO: 2336826 - DNA, 16 bp, Homo sapiens
ctcccaggtaccagct

SEQ ID NO: 2336827 - DNA, 17 bp, Homo sapiens
ctcccaggtaccagctg

SEQ ID NO: 2336828 - DNA, 18 bp, Homo sapiens
ctcccaggtaccagctgc

SEQ ID NO: 2336829 - DNA, 15 bp, Homo sapiens
ctcccagtgaactcc

SEQ ID NO: 2336830 - DNA, 21 bp, Homo sapiens
ctcccagtgaactcctgccag

SEQ ID NO: 2336831 - DNA, 11 bp, Homo sapiens
ctccccacagc

SEQ ID NO: 2336832 - DNA, 18 bp, Homo sapiens
ctccccacagcgtccctg

SEQ ID NO: 2336833 - DNA, 11 bp, Homo sapiens
ctccccagaat

SEQ ID NO: 2336834 - DNA, 15 bp, Homo sapiens
ctccccagagctgcc

SEQ ID NO: 2336835 - DNA, 16 bp, Homo sapiens
ctccccagagctgcct

SEQ ID NO: 2336836 - DNA, 15 bp, Homo sapiens
ctccccatctgtcca

SEQ ID NO: 2336837 - DNA, 22 bp, Homo sapiens
ctccccatttcccatctgcacc

SEQ ID NO: 2336838 - DNA, 14 bp, Homo sapiens
ctccccctccccag

SEQ ID NO: 2336839 - DNA, 14 bp, Homo sapiens
ctccccctcctcca

SEQ ID NO: 2336840 - DNA, 15 bp, Homo sapiens
ctccccctcctccag

SEQ ID NO: 2336841 - DNA, 24 bp, Homo sapiens
ctcccctccggactggtgccctcc

SEQ ID NO: 2336842 - DNA, 14 bp, Homo sapiens
ctcccctctcagaa

SEQ ID NO: 2336843 - DNA, 20 bp, Homo sapiens
ctccccttttttcttctatt

SEQ ID NO: 2336844 - DNA, 23 bp, Homo sapiens
ctcccgagaccgggccctgggtt

SEQ ID NO: 2336845 - DNA, 11 bp, Homo sapiens
ctcccgcggtg

SEQ ID NO: 2336846 - DNA, 19 bp, Homo sapiens
ctccctaaactttggcctt

SEQ ID NO: 2336847 - DNA, 12 bp, Homo sapiens
ctccctcaactg

SEQ ID NO: 2336848 - DNA, 16 bp, Homo sapiens
ctccctcaactgaagg

SEQ ID NO: 2336849 - DNA, 16 bp, Homo sapiens
ctccctccacctcaag

SEQ ID NO: 2336850 - DNA, 17 bp, Homo sapiens
ctccctcccaggactct

SEQ ID NO: 2336851 - DNA, 15 bp, Homo sapiens
ctccctcctggagca

SEQ ID NO: 2336852 - DNA, 23 bp, Homo sapiens
ctccctctgcccctcccccagcc

SEQ ID NO: 2336853 - DNA, 15 bp, Homo sapiens
ctccctgcagatgcc

SEQ ID NO: 2336854 - DNA, 23 bp, Homo sapiens
ctccctgcagatgccaccctagc

SEQ ID NO: 2336855 - DNA, 18 bp, Homo sapiens
ctccctgcctggccccca

SEQ ID NO: 2336856 - DNA, 12 bp, Homo sapiens
ctccctggaatg

SEQ ID NO: 2336857 - DNA, 15 bp, Homo sapiens
ctccctggctccctc

SEQ ID NO: 2336858 - DNA, 12 bp, Homo sapiens
ctcccttccttt

SEQ ID NO: 2336859 - DNA, 14 bp, Homo sapiens
ctcccttgctggcc

SEQ ID NO: 2336860 - DNA, 19 bp, Homo sapiens
ctcccttgggctctgatga

SEQ ID NO: 2336861 - DNA, 16 bp, Homo sapiens
ctccgcagtgtctcca

SEQ ID NO: 2336862 - DNA, 13 bp, Homo sapiens
ctccgccagcctc

SEQ ID NO: 2336863 - DNA, 16 bp, Homo sapiens
ctccgcgccgatgcca

SEQ ID NO: 2336864 - DNA, 14 bp, Homo sapiens
ctgcacccctgggc

SEQ ID NO: 2336865 - DNA, 16 bp, Homo sapiens
ctgcacccctgggcca

SEQ ID NO: 2336866 - DNA, 17 bp, Homo sapiens
ctgcactccagcctggg

SEQ ID NO: 2336867 - DNA, 15 bp, Homo sapiens
ctgcagaacccacca

SEQ ID NO: 2336868 - DNA, 19 bp, Homo sapiens
ctgcagaatccctttgcac

SEQ ID NO: 2336869 - DNA, 13 bp, Homo sapiens
ctgcagacctcaa

SEQ ID NO: 2336870 - DNA, 22 bp, Homo sapiens
ctgcagatgccaccctagccaa

SEQ ID NO: 2336871 - DNA, 16 bp, Homo sapiens
ctgcagcccaccagac

SEQ ID NO: 2336872 - DNA, 17 bp, Homo sapiens
ctgcagcctcatactcc

SEQ ID NO: 2336873 - DNA, 21 bp, Homo sapiens
ctgcagcctcatactcctggg

SEQ ID NO: 2336874 - DNA, 18 bp, Homo sapiens
ctgcaggaaatagtcact

SEQ ID NO: 2336875 - DNA, 18 bp, Homo sapiens
ctgcaggagagagcagca

SEQ ID NO: 2336876 - DNA, 14 bp, Homo sapiens
ctgcaggatggact

SEQ ID NO: 2336877 - DNA, 21 bp, Homo sapiens
ctgcaggcagagctggagccc

SEQ ID NO: 2336878 - DNA, 15 bp, Homo sapiens
ctgcaggcaggaaca

SEQ ID NO: 2336879 - DNA, 23 bp, Homo sapiens
ctgcagggagcaactctccactc

SEQ ID NO: 2336880 - DNA, 16 bp, Homo sapiens
ctgcagtcatctcccc

SEQ ID NO: 2336881 - DNA, 23 bp, Homo sapiens
ctgcagtcctactcaagcgggtg

SEQ ID NO: 2336882 - DNA, 21 bp, Homo sapiens
ctgcagttttgctatctgggc

SEQ ID NO: 2336883 - DNA, 20 bp, Homo sapiens
ctgcatactttttaaatgta

SEQ ID NO: 2336884 - DNA, 14 bp, Homo sapiens
ctgcatctggggcc

SEQ ID NO: 2336885 - DNA, 15 bp, Homo sapiens
ctgcattcattttta

SEQ ID NO: 2336886 - DNA, 16 bp, Homo sapiens
ctgcattcatttttat

SEQ ID NO: 2336887 - DNA, 15 bp, Homo sapiens
ctgcatttaaaaaaa

SEQ ID NO: 2336888 - DNA, 13 bp, Homo sapiens
ctgccaaacacat

SEQ ID NO: 2336889 - DNA, 15 bp, Homo sapiens
ctgccacacccaggg

SEQ ID NO: 2336890 - DNA, 14 bp, Homo sapiens
ctgccacactgatg

SEQ ID NO: 2336891 - DNA, 12 bp, Homo sapiens
ctgccacagcca

SEQ ID NO: 2336892 - DNA, 22 bp, Homo sapiens
ctgccactttcacgtggcctcc

SEQ ID NO: 2336893 - DNA, 13 bp, Homo sapiens
ctgccagacatgg

SEQ ID NO: 2336894 - DNA, 13 bp, Homo sapiens
ctgccagcagcag

SEQ ID NO: 2336895 - DNA, 17 bp, Homo sapiens
ctgccagcagcagcagg

SEQ ID NO: 2336896 - DNA, 21 bp, Homo sapiens
ctgccagcagcagcaggtgat

SEQ ID NO: 2336897 - DNA, 15 bp, Homo sapiens
ctgccaggagctttg

SEQ ID NO: 2336898 - DNA, 17 bp, Homo sapiens
ctgccaggcaggggtgg

SEQ ID NO: 2336899 - DNA, 13 bp, Homo sapiens
ctgccaggccagc

SEQ ID NO: 2336900 - DNA, 16 bp, Homo sapiens
ctgccaggccagcctc

SEQ ID NO: 2336901 - DNA, 13 bp, Homo sapiens
ctgccaggctgtt

SEQ ID NO: 2336902 - DNA, 18 bp, Homo sapiens
ctgccatcaccgctgggt

SEQ ID NO: 2336903 - DNA, 19 bp, Homo sapiens
ctgccatcaccgctgggtg

SEQ ID NO: 2336904 - DNA, 14 bp, Homo sapiens
ctgccatctagcca

SEQ ID NO: 2336905 - DNA, 13 bp, Homo sapiens
ctgccatcttcag

SEQ ID NO: 2336906 - DNA, 20 bp, Homo sapiens
ctgccatgacagaggctgca

SEQ ID NO: 2336907 - DNA, 23 bp, Homo sapiens
ctgccatggctaggtagaagtga

SEQ ID NO: 2336908 - DNA, 16 bp, Homo sapiens
ctgccatgttgcccct

SEQ ID NO: 2336909 - DNA, 17 bp, Homo sapiens
ctgccattcacttcata

SEQ ID NO: 2336910 - DNA, 18 bp, Homo sapiens
ctgcccacatgggacctg

SEQ ID NO: 2336911 - DNA, 15 bp, Homo sapiens
ctgcccacctgccgg

SEQ ID NO: 2336912 - DNA, 22 bp, Homo sapiens
ctgcccactgtttctcttgagc

SEQ ID NO: 2336913 - DNA, 18 bp, Homo sapiens
ctgccccaccttgccagg

SEQ ID NO: 2336914 - DNA, 21 bp, Homo sapiens
ctgccccaccttgccagggca

SEQ ID NO: 2336915 - DNA, 15 bp, Homo sapiens
ctgccccagcactca

SEQ ID NO: 2336916 - DNA, 16 bp, Homo sapiens
ctgcccccagccccgg

SEQ ID NO: 2336917 - DNA, 19 bp, Homo sapiens
ctgccccccccccccatct

SEQ ID NO: 2336918 - DNA, 17 bp, Homo sapiens
ctgcccctaccctggac

SEQ ID NO: 2336919 - DNA, 17 bp, Homo sapiens
ctgcccctctcaccaaa

SEQ ID NO: 2336920 - DNA, 13 bp, Homo sapiens
ctgcccgcagagc

SEQ ID NO: 2336921 - DNA, 20 bp, Homo sapiens
ctgccctgcacgtcatggga

SEQ ID NO: 2336922 - DNA, 14 bp, Homo sapiens
ctgccctggctgct

SEQ ID NO: 2336923 - DNA, 13 bp, Homo sapiens
ctgccctgtccaa

SEQ ID NO: 2336924 - DNA, 17 bp, Homo sapiens
ctgccctgtccaaaagc

SEQ ID NO: 2336925 - DNA, 22 bp, Homo sapiens
ctgccctgtgtacttcccgggc

SEQ ID NO: 2336926 - DNA, 12 bp, Homo sapiens
ctgcccttccct

SEQ ID NO: 2336927 - DNA, 15 bp, Homo sapiens
ctgcccttcctgcag

SEQ ID NO: 2336928 - DNA, 18 bp, Homo sapiens
ctgccgggctgagggcct

SEQ ID NO: 2336929 - DNA, 14 bp, Homo sapiens
ctgcctacagccag

SEQ ID NO: 2336930 - DNA, 15 bp, Homo sapiens
ctgcctacagccagg

SEQ ID NO: 2336931 - DNA, 16 bp, Homo sapiens
ctgcctacagccaggt

SEQ ID NO: 2336932 - DNA, 21 bp, Homo sapiens
ctgcctcagacgttgcctgag

SEQ ID NO: 2336933 - DNA, 18 bp, Homo sapiens
ctgcctcccacttcactg

SEQ ID NO: 2336934 - DNA, 14 bp, Homo sapiens
ctgcctcctggagg

SEQ ID NO: 2336935 - DNA, 20 bp, Homo sapiens
ctgcctcctggaggaccaga

SEQ ID NO: 2336936 - DNA, 17 bp, Homo sapiens
ctgcctcgctcaccgct

SEQ ID NO: 2336937 - DNA, 17 bp, Homo sapiens
ctgcctctcccaggctg

SEQ ID NO: 2336938 - DNA, 14 bp, Homo sapiens
ctgcctgagggcag

SEQ ID NO: 2336939 - DNA, 15 bp, Homo sapiens
ctgcctgccccgccc

SEQ ID NO: 2336940 - DNA, 19 bp, Homo sapiens
ctgcctgccccgcccccag

SEQ ID NO: 2336941 - DNA, 12 bp, Homo sapiens
ctgcctggcccc

SEQ ID NO: 2336942 - DNA, 22 bp, Homo sapiens
ctgcctggcccccaacctcagg

SEQ ID NO: 2336943 - DNA, 23 bp, Homo sapiens
ctgcctggcccccaacctcaggg

SEQ ID NO: 2336944 - DNA, 14 bp, Homo sapiens
ctgcctgtctgccc

SEQ ID NO: 2336945 - DNA, 15 bp, Homo sapiens
ctgcctgtctgcccc

SEQ ID NO: 2336946 - DNA, 23 bp, Homo sapiens
ctgcctgtctgccccagcccaga

SEQ ID NO: 2336947 - DNA, 12 bp, Homo sapiens
ctgccttcccta

SEQ ID NO: 2336948 - DNA, 16 bp, Homo sapiens
ctgccttccctagctt

SEQ ID NO: 2336949 - DNA, 19 bp, Homo sapiens
ctgccttgcctcctcagta

SEQ ID NO: 2336950 - DNA, 14 bp, Homo sapiens
ctgccttggcctcc

SEQ ID NO: 2336951 - DNA, 15 bp, Homo sapiens
ctgccttggcctccc

SEQ ID NO: 2336952 - DNA, 21 bp, Homo sapiens
ctgcgaagaccctcttgccca

SEQ ID NO: 2336953 - DNA, 14 bp, Homo sapiens
ctgcgcctgcaggc

SEQ ID NO: 2336954 - DNA, 21 bp, Homo sapiens
ctgcgcctgcaggcagagctg

SEQ ID NO: 2336955 - DNA, 23 bp, Homo sapiens
ctgcgcctgcaggcagagctgga

SEQ ID NO: 2336956 - DNA, 16 bp, Homo sapiens
ctgcgcctgctgcctg

SEQ ID NO: 2336957 - DNA, 13 bp, Homo sapiens
ctgcgggccaggg

SEQ ID NO: 2336958 - DNA, 18 bp, Homo sapiens
ctgcgggccagggtcctg

SEQ ID NO: 2336959 - DNA, 19 bp, Homo sapiens
ctgcggtgtttggcaatgc

SEQ ID NO: 2336960 - DNA, 21 bp, Homo sapiens
ctgcgtcagaccagtactggg

SEQ ID NO: 2336961 - DNA, 15 bp, Homo sapiens
ctgcgtcctcctcac

SEQ ID NO: 2336962 - DNA, 13 bp, Homo sapiens
ctgcgttctgcaa

SEQ ID NO: 2336963 - DNA, 23 bp, Homo sapiens
ctgctacacctattatcccagct

SEQ ID NO: 2336964 - DNA, 16 bp, Homo sapiens
ctgctatccccatctc

SEQ ID NO: 2336965 - DNA, 23 bp, Homo sapiens
ctgctatccccatctccctgcct

SEQ ID NO: 2336966 - DNA, 19 bp, Homo sapiens
ctgctatttattttcctaa

SEQ ID NO: 2336967 - DNA, 20 bp, Homo sapiens
ctgctatttattttcctaaa

SEQ ID NO: 2336968 - DNA, 14 bp, Homo sapiens
ctgctcacccacct

SEQ ID NO: 2336969 - DNA, 15 bp, Homo sapiens
ctgctcaccgcccat

SEQ ID NO: 2336970 - DNA, 20 bp, Homo sapiens
ctgctcaccgcccatcaggg

SEQ ID NO: 2336971 - DNA, 19 bp, Homo sapiens
ctgctcagtaaagcacttg

SEQ ID NO: 2336972 - DNA, 15 bp, Homo sapiens
ctgctcatattgtga

SEQ ID NO: 2336973 - DNA, 23 bp, Homo sapiens
ctgctcattcctcacgcccttca

SEQ ID NO: 2336974 - DNA, 13 bp, Homo sapiens
ctgctccctggca

SEQ ID NO: 2336975 - DNA, 14 bp, Homo sapiens
ctgctccttcccca

SEQ ID NO: 2336976 - DNA, 17 bp, Homo sapiens
ctgctctcatataagac

SEQ ID NO: 2336977 - DNA, 12 bp, Homo sapiens
ctgctctgccat

SEQ ID NO: 2336978 - DNA, 19 bp, Homo sapiens
ctgctctgccatcttcagg

SEQ ID NO: 2336979 - DNA, 15 bp, Homo sapiens
cttaaaccttcagtt

SEQ ID NO: 2336980 - DNA, 19 bp, Homo sapiens
cttaaacgaagagttccct

SEQ ID NO: 2336981 - DNA, 16 bp, Homo sapiens
cttaaagctactgtag

SEQ ID NO: 2336982 - DNA, 15 bp, Homo sapiens
cttaaataaaaatta

SEQ ID NO: 2336983 - DNA, 14 bp, Homo sapiens
cttaaataggaaag

SEQ ID NO: 2336984 - DNA, 12 bp, Homo sapiens
cttaaatttaat

SEQ ID NO: 2336985 - DNA, 16 bp, Homo sapiens
cttaaatttaatacca

SEQ ID NO: 2336986 - DNA, 22 bp, Homo sapiens
cttaaatttcttatgtgacatt

SEQ ID NO: 2336987 - DNA, 23 bp, Homo sapiens
cttaaattttaactaaattttaa

SEQ ID NO: 2336988 - DNA, 19 bp, Homo sapiens
cttaactataaggtgcctc

SEQ ID NO: 2336989 - DNA, 23 bp, Homo sapiens
cttaactattaaggccttttcca

SEQ ID NO: 2336990 - DNA, 16 bp, Homo sapiens
cttaactggtctcctt

SEQ ID NO: 2336991 - DNA, 12 bp, Homo sapiens
cttaagcaaagg

SEQ ID NO: 2336992 - DNA, 19 bp, Homo sapiens
cttaagcaaaggggacagc

SEQ ID NO: 2336993 - DNA, 22 bp, Homo sapiens
cttaagcaaaggggacagctgt

SEQ ID NO: 2336994 - DNA, 12 bp, Homo sapiens
cttaagcaaatt

SEQ ID NO: 2336995 - DNA, 20 bp, Homo sapiens
cttaagcaaattttgtatta

SEQ ID NO: 2336996 - DNA, 20 bp, Homo sapiens
cttaaggggtatcatgtatg

SEQ ID NO: 2336997 - DNA, 22 bp, Homo sapiens
cttaagtaccaatgggaagcag

SEQ ID NO: 2336998 - DNA, 16 bp, Homo sapiens
cttaagtgagcagaac

SEQ ID NO: 2336999 - DNA, 12 bp, Homo sapiens
cttaatttcctt

SEQ ID NO: 2337000 - DNA, 20 bp, Homo sapiens
cttaatttcctttttgacac

SEQ ID NO: 2337001 - DNA, 11 bp, Homo sapiens
cttacaaactt

SEQ ID NO: 2337002 - DNA, 14 bp, Homo sapiens
cttacatcttttct

SEQ ID NO: 2337003 - DNA, 17 bp, Homo sapiens
cttacatcttttctaat

SEQ ID NO: 2337004 - DNA, 20 bp, Homo sapiens
cttacattttcctgagacct

SEQ ID NO: 2337005 - DNA, 15 bp, Homo sapiens
cttactcttcttgaa

SEQ ID NO: 2337006 - DNA, 12 bp, Homo sapiens
cttactctttcc

SEQ ID NO: 2337007 - DNA, 16 bp, Homo sapiens
cttactctttcctatt

SEQ ID NO: 2337008 - DNA, 15 bp, Homo sapiens
cttactgatatattt

SEQ ID NO: 2337009 - DNA, 17 bp, Homo sapiens
cttactgtggaggaagg

SEQ ID NO: 2337010 - DNA, 21 bp, Homo sapiens
cttagactctagtatttatgg

SEQ ID NO: 2337011 - DNA, 21 bp, Homo sapiens
cttagataccttgaaaggcag

SEQ ID NO: 2337012 - DNA, 23 bp, Homo sapiens
cttagatttaaaggcagacagtt

SEQ ID NO: 2337013 - DNA, 22 bp, Homo sapiens
cttagcaactgctggggagaca

SEQ ID NO: 2337014 - DNA, 15 bp, Homo sapiens
cttagcaccttcagg

SEQ ID NO: 2337015 - DNA, 16 bp, Homo sapiens
cttagcaccttcaggg

SEQ ID NO: 2337016 - DNA, 12 bp, Homo sapiens
cttagctcaggt

SEQ ID NO: 2337017 - DNA, 16 bp, Homo sapiens
cttagctcaggtgcct

SEQ ID NO: 2337018 - DNA, 17 bp, Homo sapiens
cttagctttttaattgt

SEQ ID NO: 2337019 - DNA, 19 bp, Homo sapiens
cttaggcttggctgccctg

SEQ ID NO: 2337020 - DNA, 20 bp, Homo sapiens
cttaggcttggctgccctgt

SEQ ID NO: 2337021 - DNA, 20 bp, Homo sapiens
cttagggaagaaaaagcaag

SEQ ID NO: 2337022 - DNA, 18 bp, Homo sapiens
cttaggtgccaggctgta

SEQ ID NO: 2337023 - DNA, 13 bp, Homo sapiens
cttataatgatta

SEQ ID NO: 2337024 - DNA, 15 bp, Homo sapiens
cttataatgggctct

SEQ ID NO: 2337025 - DNA, 18 bp, Homo sapiens
cttatcctctctctcttc

SEQ ID NO: 2337026 - DNA, 22 bp, Homo sapiens
cttatcctctctctcttctagg

SEQ ID NO: 2337027 - DNA, 21 bp, Homo sapiens
cttattaatcatacaaactct

SEQ ID NO: 2337028 - DNA, 21 bp, Homo sapiens
cttattattaataatgaagta

SEQ ID NO: 2337029 - DNA, 18 bp, Homo sapiens
cttattgcctcccaggca

SEQ ID NO: 2337030 - DNA, 19 bp, Homo sapiens
cttattgcctcccaggcaa

SEQ ID NO: 2337031 - DNA, 17 bp, Homo sapiens
cttattggaactctgct

SEQ ID NO: 2337032 - DNA, 17 bp, Homo sapiens
cttatttctatgacaaa

SEQ ID NO: 2337033 - DNA, 18 bp, Homo sapiens
cttatttctatgacaaat

SEQ ID NO: 2337034 - DNA, 17 bp, Homo sapiens
cttattttctcaatctc

SEQ ID NO: 2337035 - DNA, 13 bp, Homo sapiens
cttcaaacctcat

SEQ ID NO: 2337036 - DNA, 13 bp, Homo sapiens
cttcaaagccttc

SEQ ID NO: 2337037 - DNA, 15 bp, Homo sapiens
cttcaacatgctcca

SEQ ID NO: 2337038 - DNA, 19 bp, Homo sapiens
cttcaacatgctccaaata

SEQ ID NO: 2337039 - DNA, 16 bp, Homo sapiens
cttcaaggaggcccac

SEQ ID NO: 2337040 - DNA, 14 bp, Homo sapiens
cttcaatggaatac

SEQ ID NO: 2337041 - DNA, 18 bp, Homo sapiens
cttcaatggaatacagtc

SEQ ID NO: 2337042 - DNA, 18 bp, Homo sapiens
cttcaatgtgcataatga

SEQ ID NO: 2337043 - DNA, 21 bp, Homo sapiens
cttcacaatctgtcagttcta

SEQ ID NO: 2337044 - DNA, 15 bp, Homo sapiens
cttcacagtagagcc

SEQ ID NO: 2337045 - DNA, 20 bp, Homo sapiens
cttcacagtagagccagctt

SEQ ID NO: 2337046 - DNA, 21 bp, Homo sapiens
cttcacagtagagccagcttg

SEQ ID NO: 2337047 - DNA, 22 bp, Homo sapiens
cttcacataggaagggatctga

SEQ ID NO: 2337048 - DNA, 14 bp, Homo sapiens
cttcactaccctga

SEQ ID NO: 2337049 - DNA, 15 bp, Homo sapiens
cttcactaccctgat

SEQ ID NO: 2337050 - DNA, 23 bp, Homo sapiens
cttcactgtataaataggagagg

SEQ ID NO: 2337051 - DNA, 20 bp, Homo sapiens
cttcagcaagttagaactag

SEQ ID NO: 2337052 - DNA, 13 bp, Homo sapiens
cttcagcccaggc

SEQ ID NO: 2337053 - DNA, 16 bp, Homo sapiens
cttcagcccaggcttt

SEQ ID NO: 2337054 - DNA, 17 bp, Homo sapiens
cttcagcccaggctttt

SEQ ID NO: 2337055 - DNA, 22 bp, Homo sapiens
cttcagcccaggcttttgctag

SEQ ID NO: 2337056 - DNA, 23 bp, Homo sapiens
cttcaggatattggttcttcccc

SEQ ID NO: 2337057 - DNA, 19 bp, Homo sapiens
cttcagggctgagttctgg

SEQ ID NO: 2337058 - DNA, 16 bp, Homo sapiens
cttcagggtaaactag

SEQ ID NO: 2337059 - DNA, 21 bp, Homo sapiens
cttcaggttatcgaaataaca

SEQ ID NO: 2337060 - DNA, 17 bp, Homo sapiens
cttcatctgcctgcgct

SEQ ID NO: 2337061 - DNA, 13 bp, Homo sapiens
cttcatctggcaa

SEQ ID NO: 2337062 - DNA, 19 bp, Homo sapiens
cttcatctggcaacatctt

SEQ ID NO: 2337063 - DNA, 23 bp, Homo sapiens
cttcatctggcaacatctttatc

SEQ ID NO: 2337064 - DNA, 15 bp, Homo sapiens
cttcatcttcctgtg

SEQ ID NO: 2337065 - DNA, 16 bp, Homo sapiens
cttcatgtaattttat

SEQ ID NO: 2337066 - DNA, 21 bp, Homo sapiens
cttcatgtaattttattttaa

SEQ ID NO: 2337067 - DNA, 21 bp, Homo sapiens
cttcattattcaagaatgaaa

SEQ ID NO: 2337068 - DNA, 14 bp, Homo sapiens
cttcattattctct

SEQ ID NO: 2337069 - DNA, 12 bp, Homo sapiens
cttccaaagaaa

SEQ ID NO: 2337070 - DNA, 15 bp, Homo sapiens
cttccaaataaataa

SEQ ID NO: 2337071 - DNA, 17 bp, Homo sapiens
cttccaaatgtccctcc

SEQ ID NO: 2337072 - DNA, 21 bp, Homo sapiens
cttccaacatatatttattga

SEQ ID NO: 2337073 - DNA, 22 bp, Homo sapiens
cttccagagaggacctatccca

SEQ ID NO: 2337074 - DNA, 14 bp, Homo sapiens
cttccagagccaga

SEQ ID NO: 2337075 - DNA, 15 bp, Homo sapiens
cttccagatcactgc

SEQ ID NO: 2337076 - DNA, 13 bp, Homo sapiens
cttccaggaaact

SEQ ID NO: 2337077 - DNA, 20 bp, Homo sapiens
cttccagggatttgcctcac

SEQ ID NO: 2337078 - DNA, 21 bp, Homo sapiens
cttccagggatttgcctcacc

SEQ ID NO: 2337079 - DNA, 15 bp, Homo sapiens
cttccagtgaacatt

SEQ ID NO: 2337080 - DNA, 18 bp, Homo sapiens
cttccatacacagaggag

SEQ ID NO: 2337081 - DNA, 18 bp, Homo sapiens
cttcccatgcattctggt

SEQ ID NO: 2337082 - DNA, 12 bp, Homo sapiens
cttccccagaga

SEQ ID NO: 2337083 - DNA, 13 bp, Homo sapiens
cttccccagagag

SEQ ID NO: 2337084 - DNA, 16 bp, Homo sapiens
cttcccccaccaccaa

SEQ ID NO: 2337085 - DNA, 17 bp, Homo sapiens
cttcccgggccagggct

SEQ ID NO: 2337086 - DNA, 12 bp, Homo sapiens
cttccctctctg

SEQ ID NO: 2337087 - DNA, 12 bp, Homo sapiens
cttccctctggg

SEQ ID NO: 2337088 - DNA, 22 bp, Homo sapiens
cttccctgagtgcgggctgagg

SEQ ID NO: 2337089 - DNA, 14 bp, Homo sapiens
cttcctccctgggg

SEQ ID NO: 2337090 - DNA, 15 bp, Homo sapiens
cttcctgcgtcctcc

SEQ ID NO: 2337091 - DNA, 16 bp, Homo sapiens
cttcctgcgtcctcct

SEQ ID NO: 2337092 - DNA, 20 bp, Homo sapiens
cttcctgcgtcctcctcacc

SEQ ID NO: 2337093 - DNA, 12 bp, Homo sapiens
cttcctgctgta

SEQ ID NO: 2337094 - DNA, 19 bp, Homo sapiens
gaaacaaagggttttcttt

SEQ ID NO: 2337095 - DNA, 16 bp, Homo sapiens
gaaacacccctctgtc

SEQ ID NO: 2337096 - DNA, 17 bp, Homo sapiens
gaaacacccctctgtct

SEQ ID NO: 2337097 - DNA, 21 bp, Homo sapiens
gaaacacccctctgtctagga

SEQ ID NO: 2337098 - DNA, 14 bp, Homo sapiens
gaaacagtttaaca

SEQ ID NO: 2337099 - DNA, 15 bp, Homo sapiens
gaaacagtttaacag

SEQ ID NO: 2337100 - DNA, 19 bp, Homo sapiens
gaaaccaccgtgaaccaga

SEQ ID NO: 2337101 - DNA, 22 bp, Homo sapiens
gaaaccaccgtgaaccagaggg

SEQ ID NO: 2337102 - DNA, 15 bp, Homo sapiens
gaaacctcagggctg

SEQ ID NO: 2337103 - DNA, 19 bp, Homo sapiens
gaaaccttttttaagattt

SEQ ID NO: 2337104 - DNA, 15 bp, Homo sapiens
gaaactaagccaggc

SEQ ID NO: 2337105 - DNA, 23 bp, Homo sapiens
gaaactaagccaggcctggctgg

SEQ ID NO: 2337106 - DNA, 17 bp, Homo sapiens
gaaactccacatctgcc

SEQ ID NO: 2337107 - DNA, 15 bp, Homo sapiens
gaaactcttatctca

SEQ ID NO: 2337108 - DNA, 22 bp, Homo sapiens
gaaactggttgtaaaagagaaa

SEQ ID NO: 2337109 - DNA, 17 bp, Homo sapiens
gaaactttgggaaaaca

SEQ ID NO: 2337110 - DNA, 13 bp, Homo sapiens
gaaagacaaactg

SEQ ID NO: 2337111 - DNA, 18 bp, Homo sapiens
gaaagcataaagctcaaa

SEQ ID NO: 2337112 - DNA, 22 bp, Homo sapiens
gaaagcataaagctcaaatgaa

SEQ ID NO: 2337113 - DNA, 20 bp, Homo sapiens
gaaagccaacaactctgcct

SEQ ID NO: 2337114 - DNA, 15 bp, Homo sapiens
gaaagcctaaaattg

SEQ ID NO: 2337115 - DNA, 20 bp, Homo sapiens
gaaagctgtgtttatatgga

SEQ ID NO: 2337116 - DNA, 15 bp, Homo sapiens
gaaagcttacatttt

SEQ ID NO: 2337117 - DNA, 23 bp, Homo sapiens
gaaagctttgaatactaaattat

SEQ ID NO: 2337118 - DNA, 15 bp, Homo sapiens
gaaaggaggtggggg

SEQ ID NO: 2337119 - DNA, 20 bp, Homo sapiens
gaaaggcaggaagggaagcg

SEQ ID NO: 2337120 - DNA, 23 bp, Homo sapiens
gaaaggtgagtttgagctgcctt

SEQ ID NO: 2337121 - DNA, 16 bp, Homo sapiens
gaaaggttaaaaaagc

SEQ ID NO: 2337122 - DNA, 21 bp, Homo sapiens
gaaagtcagaatcagaagata

SEQ ID NO: 2337123 - DNA, 13 bp, Homo sapiens
gaaagtgcatttt

SEQ ID NO: 2337124 - DNA, 22 bp, Homo sapiens
gaaagttgtaaaatagaaaaag

SEQ ID NO: 2337125 - DNA, 15 bp, Homo sapiens
gaaagttttgtaaaa

SEQ ID NO: 2337126 - DNA, 18 bp, Homo sapiens
gaaagtttttttttatta

SEQ ID NO: 2337127 - DNA, 19 bp, Homo sapiens
gaaagtttttttttattat

SEQ ID NO: 2337128 - DNA, 12 bp, Homo sapiens
gaaataaatgaa

SEQ ID NO: 2337129 - DNA, 15 bp, Homo sapiens
gaaataacaatgtta

SEQ ID NO: 2337130 - DNA, 16 bp, Homo sapiens
gaaataagtaaatgta

SEQ ID NO: 2337131 - DNA, 21 bp, Homo sapiens
gaaataatgctacaattttaa

SEQ ID NO: 2337132 - DNA, 23 bp, Homo sapiens
gaaataatgctacaattttaaga

SEQ ID NO: 2337133 - DNA, 18 bp, Homo sapiens
gaaatagaaagaagccat

SEQ ID NO: 2337134 - DNA, 21 bp, Homo sapiens
gaaatagcatgacaggctgtt

SEQ ID NO: 2337135 - DNA, 16 bp, Homo sapiens
gaaatatcaaagtcat

SEQ ID NO: 2337136 - DNA, 14 bp, Homo sapiens
gaaatctgaacatt

SEQ ID NO: 2337137 - DNA, 15 bp, Homo sapiens
gaaatgcatatttgc

SEQ ID NO: 2337138 - DNA, 21 bp, Homo sapiens
gaaatggaggatctctaaaga

SEQ ID NO: 2337139 - DNA, 24 bp, Homo sapiens
gaaatggaggatctctaaagagca

SEQ ID NO: 2337140 - DNA, 24 bp, Homo sapiens
gaaatggcgtctgctctggtggct

SEQ ID NO: 2337141 - DNA, 16 bp, Homo sapiens
gaaatggctttgtgat

SEQ ID NO: 2337142 - DNA, 20 bp, Homo sapiens
gaaatgtacactaccaaaca

SEQ ID NO: 2337143 - DNA, 22 bp, Homo sapiens
gaaatgtacactaccaaacact

SEQ ID NO: 2337144 - DNA, 17 bp, Homo sapiens
gaaatgtcatgattgcc

SEQ ID NO: 2337145 - DNA, 22 bp, Homo sapiens
gaaatgtttttaataaaagaaa

SEQ ID NO: 2337146 - DNA, 12 bp, Homo sapiens
gaaattaacaca

SEQ ID NO: 2337147 - DNA, 23 bp, Homo sapiens
gaaattactgcccacttgtcaag

SEQ ID NO: 2337148 - DNA, 20 bp, Homo sapiens
gaaattctatttataataca

SEQ ID NO: 2337149 - DNA, 13 bp, Homo sapiens
gaaattgcatact

SEQ ID NO: 2337150 - DNA, 13 bp, Homo sapiens
gaaatttaagcac

SEQ ID NO: 2337151 - DNA, 22 bp, Homo sapiens
gaaatttaagcacaaaaaattt

SEQ ID NO: 2337152 - DNA, 19 bp, Homo sapiens
gaaattttatatgcttact

SEQ ID NO: 2337153 - DNA, 17 bp, Homo sapiens
gaaattttgtaagaagg

SEQ ID NO: 2337154 - DNA, 13 bp, Homo sapiens
gaacaagcttcag

SEQ ID NO: 2337155 - DNA, 21 bp, Homo sapiens
gaacaattttttttaattggc

SEQ ID NO: 2337156 - DNA, 15 bp, Homo sapiens
gaacacagtgtctgt

SEQ ID NO: 2337157 - DNA, 20 bp, Homo sapiens
gaacagagagacccttgtgg

SEQ ID NO: 2337158 - DNA, 14 bp, Homo sapiens
gaacagctgtgtct

SEQ ID NO: 2337159 - DNA, 15 bp, Homo sapiens
gaacagctgtgtctg

SEQ ID NO: 2337160 - DNA, 19 bp, Homo sapiens
gaacagctgtgtctgccaa

SEQ ID NO: 2337161 - DNA, 14 bp, Homo sapiens
gaacagcttcaggt

SEQ ID NO: 2337162 - DNA, 22 bp, Homo sapiens
gaacagtactggttactttcaa

SEQ ID NO: 2337163 - DNA, 16 bp, Homo sapiens
gaacatactgttcact

SEQ ID NO: 2337164 - DNA, 17 bp, Homo sapiens
gaacatcacattcctct

SEQ ID NO: 2337165 - DNA, 22 bp, Homo sapiens
gaacatggactttcttgcatga

SEQ ID NO: 2337166 - DNA, 16 bp, Homo sapiens
gaacatgtaaaatgtt

SEQ ID NO: 2337167 - DNA, 18 bp, Homo sapiens
gaacattcccagcccagc

SEQ ID NO: 2337168 - DNA, 21 bp, Homo sapiens
gaaccaagctataaaagccca

SEQ ID NO: 2337169 - DNA, 19 bp, Homo sapiens
gaaccacattgaagaatgt

SEQ ID NO: 2337170 - DNA, 12 bp, Homo sapiens
gaaccactgctt

SEQ ID NO: 2337171 - DNA, 15 bp, Homo sapiens
gaaccagagggcatg

SEQ ID NO: 2337172 - DNA, 20 bp, Homo sapiens
gaaccagccccatcagaacc

SEQ ID NO: 2337173 - DNA, 18 bp, Homo sapiens
gaaccagggctcttctca

SEQ ID NO: 2337174 - DNA, 15 bp, Homo sapiens
gaaccataaattcaa

SEQ ID NO: 2337175 - DNA, 15 bp, Homo sapiens
gaacccaagtgcctc

SEQ ID NO: 2337176 - DNA, 20 bp, Homo sapiens
gaacccgggagcggaggttg

SEQ ID NO: 2337177 - DNA, 16 bp, Homo sapiens
gaaccctggggcctga

SEQ ID NO: 2337178 - DNA, 13 bp, Homo sapiens
gaaccgcacagct

SEQ ID NO: 2337179 - DNA, 15 bp, Homo sapiens
gaaccgcacagctca

SEQ ID NO: 2337180 - DNA, 17 bp, Homo sapiens
gaaccgcacagctcagg

SEQ ID NO: 2337181 - DNA, 19 bp, Homo sapiens
gaaccgtggtatgtctgcc

SEQ ID NO: 2337182 - DNA, 12 bp, Homo sapiens
gaacctgagcta

SEQ ID NO: 2337183 - DNA, 18 bp, Homo sapiens
gaacctgagctattttcc

SEQ ID NO: 2337184 - DNA, 16 bp, Homo sapiens
gaacctgcacacagga

SEQ ID NO: 2337185 - DNA, 13 bp, Homo sapiens
gaacctgggcact

SEQ ID NO: 2337186 - DNA, 17 bp, Homo sapiens
gaaccttgtcccagcca

SEQ ID NO: 2337187 - DNA, 18 bp, Homo sapiens
gaaccttgtcccagccag

SEQ ID NO: 2337188 - DNA, 19 bp, Homo sapiens
gaacgttttcttctttccc

SEQ ID NO: 2337189 - DNA, 20 bp, Homo sapiens
gaacgttttcttctttccct

SEQ ID NO: 2337190 - DNA, 15 bp, Homo sapiens
gaactaggctgagca

SEQ ID NO: 2337191 - DNA, 19 bp, Homo sapiens
gaactataaacttaaagct

SEQ ID NO: 2337192 - DNA, 13 bp, Homo sapiens
gaactcctgccag

SEQ ID NO: 2337193 - DNA, 17 bp, Homo sapiens
gaactgtctgtgaacag

SEQ ID NO: 2337194 - DNA, 17 bp, Homo sapiens
gaacttcacataggaag

SEQ ID NO: 2337195 - DNA, 15 bp, Homo sapiens
gaacttgctgctgtc

SEQ ID NO: 2337196 - DNA, 16 bp, Homo sapiens
gaactttattaagtaa

SEQ ID NO: 2337197 - DNA, 21 bp, Homo sapiens
gaacttttgtactgaattttt

SEQ ID NO: 2337198 - DNA, 17 bp, Homo sapiens
gaagaaaaagcaagtgt

SEQ ID NO: 2337199 - DNA, 17 bp, Homo sapiens
gaagaaagtcaaaaaat

SEQ ID NO: 2337200 - DNA, 13 bp, Homo sapiens
gaagaacatagaa

SEQ ID NO: 2337201 - DNA, 22 bp, Homo sapiens
gaagaaggaaggcctgagcccc

SEQ ID NO: 2337202 - DNA, 18 bp, Homo sapiens
gaagaagggagaagaaag

SEQ ID NO: 2337203 - DNA, 12 bp, Homo sapiens
gaagaatgaaag

SEQ ID NO: 2337204 - DNA, 12 bp, Homo sapiens
gaagaatggctt

SEQ ID NO: 2337205 - DNA, 15 bp, Homo sapiens
gaagaatggctttca

SEQ ID NO: 2337206 - DNA, 19 bp, Homo sapiens
gaagaatgttagagtaatg

SEQ ID NO: 2337207 - DNA, 17 bp, Homo sapiens
gaagaattgaaaagttt

SEQ ID NO: 2337208 - DNA, 20 bp, Homo sapiens
gagccagcttggggccacca

SEQ ID NO: 2337209 - DNA, 22 bp, Homo sapiens
gagccatgtcttctccctggaa

SEQ ID NO: 2337210 - DNA, 16 bp, Homo sapiens
gagccattttgtgaat

SEQ ID NO: 2337211 - DNA, 21 bp, Homo sapiens
gagcccagaggtaacagaaca

SEQ ID NO: 2337212 - DNA, 22 bp, Homo sapiens
gagcccagaggtaacagaacag

SEQ ID NO: 2337213 - DNA, 23 bp, Homo sapiens
gagcccagaggtaacagaacagc

SEQ ID NO: 2337214 - DNA, 21 bp, Homo sapiens
gagcccgcagggccatgcaga

SEQ ID NO: 2337215 - DNA, 22 bp, Homo sapiens
gagcccgcagggccatgcagac

SEQ ID NO: 2337216 - DNA, 19 bp, Homo sapiens
gagccctaaccccttccag

SEQ ID NO: 2337217 - DNA, 20 bp, Homo sapiens
gagccctaaccccttccaga

SEQ ID NO: 2337218 - DNA, 21 bp, Homo sapiens
gagccctaaccccttccagat

SEQ ID NO: 2337219 - DNA, 16 bp, Homo sapiens
gagcccttgcctcccc

SEQ ID NO: 2337220 - DNA, 17 bp, Homo sapiens
gagccgcggggaagctg

SEQ ID NO: 2337221 - DNA, 20 bp, Homo sapiens
gagccgtggtccctgaggat

SEQ ID NO: 2337222 - DNA, 23 bp, Homo sapiens
gagcctgcatttcctcgcagcct

SEQ ID NO: 2337223 - DNA, 15 bp, Homo sapiens
gagcctgctggaagc

SEQ ID NO: 2337224 - DNA, 16 bp, Homo sapiens
gagcctgctggaagcc

SEQ ID NO: 2337225 - DNA, 20 bp, Homo sapiens
gagcctgctggaagcccagc

SEQ ID NO: 2337226 - DNA, 13 bp, Homo sapiens
gagcggaggttgc

SEQ ID NO: 2337227 - DNA, 18 bp, Homo sapiens
gagctaaactccttcctg

SEQ ID NO: 2337228 - DNA, 22 bp, Homo sapiens
gagctaaactccttcctggcct

SEQ ID NO: 2337229 - DNA, 17 bp, Homo sapiens
gagctactctcttgcca

SEQ ID NO: 2337230 - DNA, 19 bp, Homo sapiens
gagctactctcttgccagc

SEQ ID NO: 2337231 - DNA, 19 bp, Homo sapiens
gagctagaaaaataaaatg

SEQ ID NO: 2337232 - DNA, 15 bp, Homo sapiens
gagctagctgccact

SEQ ID NO: 2337233 - DNA, 19 bp, Homo sapiens
gagctcacatgggactggg

SEQ ID NO: 2337234 - DNA, 17 bp, Homo sapiens
gagctcctgtcccctgc

SEQ ID NO: 2337235 - DNA, 19 bp, Homo sapiens
gagctcctgtcccctgcta

SEQ ID NO: 2337236 - DNA, 15 bp, Homo sapiens
gagctctgaaatctt

SEQ ID NO: 2337237 - DNA, 16 bp, Homo sapiens
gagctctgaaatcttc

SEQ ID NO: 2337238 - DNA, 12 bp, Homo sapiens
gagctcttccta

SEQ ID NO: 2337239 - DNA, 12 bp, Homo sapiens
gagctgccaaga

SEQ ID NO: 2337240 - DNA, 23 bp, Homo sapiens
gagctgccttccctagctttaga

SEQ ID NO: 2337241 - DNA, 14 bp, Homo sapiens
gagctgctctgcta

SEQ ID NO: 2337242 - DNA, 15 bp, Homo sapiens
gagcttgattaaatc

SEQ ID NO: 2337243 - DNA, 14 bp, Homo sapiens
gagcttgctccaga

SEQ ID NO: 2337244 - DNA, 22 bp, Homo sapiens
gagcttgctccagattctgatg

SEQ ID NO: 2337245 - DNA, 20 bp, Homo sapiens
gagctttctcaatgtcttcc

SEQ ID NO: 2337246 - DNA, 12 bp, Homo sapiens
gaggaaaattct

SEQ ID NO: 2337247 - DNA, 21 bp, Homo sapiens
gaggaaacagttctcactggg

SEQ ID NO: 2337248 - DNA, 17 bp, Homo sapiens
gaggaaagggctggctc

SEQ ID NO: 2337249 - DNA, 14 bp, Homo sapiens
gaggaagagccacc

SEQ ID NO: 2337250 - DNA, 21 bp, Homo sapiens
gaggaagagccacctgcaaga

SEQ ID NO: 2337251 - DNA, 13 bp, Homo sapiens
gaggaaggcaaga

SEQ ID NO: 2337252 - DNA, 18 bp, Homo sapiens
gaggaaggcctttcttct

SEQ ID NO: 2337253 - DNA, 21 bp, Homo sapiens
gaggaagtggggtctggcctg

SEQ ID NO: 2337254 - DNA, 15 bp, Homo sapiens
gaggaatcctggcag

SEQ ID NO: 2337255 - DNA, 16 bp, Homo sapiens
gaggaatcctggcagc

SEQ ID NO: 2337256 - DNA, 17 bp, Homo sapiens
gaggaatcctggcagcc

SEQ ID NO: 2337257 - DNA, 19 bp, Homo sapiens
gaggaatcctggcagccca

SEQ ID NO: 2337258 - DNA, 14 bp, Homo sapiens
gaggaatttcacct

SEQ ID NO: 2337259 - DNA, 15 bp, Homo sapiens
gaggacagcttgagc

SEQ ID NO: 2337260 - DNA, 19 bp, Homo sapiens
gaggacgcacgctcgctgc

SEQ ID NO: 2337261 - DNA, 21 bp, Homo sapiens
gaggacgcacgctcgctgcca

SEQ ID NO: 2337262 - DNA, 23 bp, Homo sapiens
gaggacgcacgctcgctgccatc

SEQ ID NO: 2337263 - DNA, 20 bp, Homo sapiens
gaggagaagggggtctctgt

SEQ ID NO: 2337264 - DNA, 23 bp, Homo sapiens
gaggagacggaggggagtagaga

SEQ ID NO: 2337265 - DNA, 18 bp, Homo sapiens
gaggagcagcagcttggg

SEQ ID NO: 2337266 - DNA, 21 bp, Homo sapiens
gaggagcccccaccctgttcc

SEQ ID NO: 2337267 - DNA, 11 bp, Homo sapiens
gaggagggaga

SEQ ID NO: 2337268 - DNA, 12 bp, Homo sapiens
gaggaggggagg

SEQ ID NO: 2337269 - DNA, 21 bp, Homo sapiens
gaggaggggcccccctgccct

SEQ ID NO: 2337270 - DNA, 22 bp, Homo sapiens
gaggaggggcccccctgccctg

SEQ ID NO: 2337271 - DNA, 17 bp, Homo sapiens
gaggagggtgggggagg

SEQ ID NO: 2337272 - DNA, 16 bp, Homo sapiens
gaggataaagaaaaga

SEQ ID NO: 2337273 - DNA, 20 bp, Homo sapiens
gaggatgagagcccagaggt

SEQ ID NO: 2337274 - DNA, 17 bp, Homo sapiens
gaggatgccttttctgt

SEQ ID NO: 2337275 - DNA, 17 bp, Homo sapiens
gaggcaagctgaaattt

SEQ ID NO: 2337276 - DNA, 13 bp, Homo sapiens
gaggcaggctggg

SEQ ID NO: 2337277 - DNA, 17 bp, Homo sapiens
gaggcagggctctcccg

SEQ ID NO: 2337278 - DNA, 20 bp, Homo sapiens
gaggcagtgatgacttgctg

SEQ ID NO: 2337279 - DNA, 22 bp, Homo sapiens
gaggcatgactaatgcttttta

SEQ ID NO: 2337280 - DNA, 22 bp, Homo sapiens
gaggccagagtcaccttttctg

SEQ ID NO: 2337281 - DNA, 11 bp, Homo sapiens
gaggcccagcc

SEQ ID NO: 2337282 - DNA, 16 bp, Homo sapiens
gaggcccagcctgtcc

SEQ ID NO: 2337283 - DNA, 18 bp, Homo sapiens
gaggccctgggctgggtg

SEQ ID NO: 2337284 - DNA, 14 bp, Homo sapiens
gaggccgaggcggg

SEQ ID NO: 2337285 - DNA, 15 bp, Homo sapiens
gaggcctcaggtgct

SEQ ID NO: 2337286 - DNA, 16 bp, Homo sapiens
gaggcctcaggtgctg

SEQ ID NO: 2337287 - DNA, 20 bp, Homo sapiens
gaggcctgaagccagctgcc

SEQ ID NO: 2337288 - DNA, 22 bp, Homo sapiens
gaggcctgaagccagctgccct

SEQ ID NO: 2337289 - DNA, 22 bp, Homo sapiens
gaggcgcccttggcttctgtga

SEQ ID NO: 2337290 - DNA, 14 bp, Homo sapiens
gaggcgcggagtga

SEQ ID NO: 2337291 - DNA, 14 bp, Homo sapiens
gaggctctggacag

SEQ ID NO: 2337292 - DNA, 21 bp, Homo sapiens
gaggctctggacagcagaagc

SEQ ID NO: 2337293 - DNA, 22 bp, Homo sapiens
gaggctctggacagcagaagcc

SEQ ID NO: 2337294 - DNA, 20 bp, Homo sapiens
gaggctgaaagaggccaatg

SEQ ID NO: 2337295 - DNA, 14 bp, Homo sapiens
gaggctgcccctct

SEQ ID NO: 2337296 - DNA, 15 bp, Homo sapiens
gaggctgggagtccc

SEQ ID NO: 2337297 - DNA, 18 bp, Homo sapiens
gaggcttctccgccagcc

SEQ ID NO: 2337298 - DNA, 19 bp, Homo sapiens
gaggcttgtttacctttct

SEQ ID NO: 2337299 - DNA, 20 bp, Homo sapiens
gaggcttttatggggccctg

SEQ ID NO: 2337300 - DNA, 16 bp, Homo sapiens
gagggacaggatctat

SEQ ID NO: 2337301 - DNA, 16 bp, Homo sapiens
gagggagaacaagacc

SEQ ID NO: 2337302 - DNA, 13 bp, Homo sapiens
gagggagagagag

SEQ ID NO: 2337303 - DNA, 22 bp, Homo sapiens
gagggagagagagagagagagg

SEQ ID NO: 2337304 - DNA, 12 bp, Homo sapiens
gagggaggggaa

SEQ ID NO: 2337305 - DNA, 20 bp, Homo sapiens
gagggatgtttggaaaaaac

SEQ ID NO: 2337306 - DNA, 23 bp, Homo sapiens
gagggcagactggggcatcctgt

SEQ ID NO: 2337307 - DNA, 15 bp, Homo sapiens
gagggcagagggaga

SEQ ID NO: 2337308 - DNA, 16 bp, Homo sapiens
gagggcaggcttgggg

SEQ ID NO: 2337309 - DNA, 18 bp, Homo sapiens
gagggcaggcttggggaa

SEQ ID NO: 2337310 - DNA, 20 bp, Homo sapiens
gagggcaggcttggggaaaa

SEQ ID NO: 2337311 - DNA, 14 bp, Homo sapiens
gagggcctgctgga

SEQ ID NO: 2337312 - DNA, 20 bp, Homo sapiens
gagggcctgctggaggcctc

SEQ ID NO: 2337313 - DNA, 12 bp, Homo sapiens
gaggggagggta

SEQ ID NO: 2337314 - DNA, 20 bp, Homo sapiens
gagggggactaaactcaacc

SEQ ID NO: 2337315 - DNA, 17 bp, Homo sapiens
gagggggcttgaagcca

SEQ ID NO: 2337316 - DNA, 14 bp, Homo sapiens
gaggggtgtggcag

SEQ ID NO: 2337317 - DNA, 15 bp, Homo sapiens
gagggtaaataaacc

SEQ ID NO: 2337318 - DNA, 17 bp, Homo sapiens
gagggtgggggagggag

SEQ ID NO: 2337319 - DNA, 13 bp, Homo sapiens
gaggtaacagaac

SEQ ID NO: 2337320 - DNA, 14 bp, Homo sapiens
gaggtaacagaaca

SEQ ID NO: 2337321 - DNA, 14 bp, Homo sapiens
gaggtattaaaact

SEQ ID NO: 2337322 - DNA, 16 bp, Homo sapiens
gcagattttacagagc

SEQ ID NO: 2337323 - DNA, 12 bp, Homo sapiens
gcagcacctcct

SEQ ID NO: 2337324 - DNA, 21 bp, Homo sapiens
gcagcactccgcatcacctca

SEQ ID NO: 2337325 - DNA, 14 bp, Homo sapiens
gcagcagcccaagc

SEQ ID NO: 2337326 - DNA, 17 bp, Homo sapiens
gcagcagcttggggaga

SEQ ID NO: 2337327 - DNA, 21 bp, Homo sapiens
gcagcccaagcttccctccat

SEQ ID NO: 2337328 - DNA, 21 bp, Homo sapiens
gcagcctcatactcctgggct

SEQ ID NO: 2337329 - DNA, 15 bp, Homo sapiens
gcagcctctggacag

SEQ ID NO: 2337330 - DNA, 15 bp, Homo sapiens
gcagctccctcctgc

SEQ ID NO: 2337331 - DNA, 18 bp, Homo sapiens
gcagctccctttctcagg

SEQ ID NO: 2337332 - DNA, 19 bp, Homo sapiens
gcagctccctttctcagga

SEQ ID NO: 2337333 - DNA, 23 bp, Homo sapiens
gcagctgctatccccatctccct

SEQ ID NO: 2337334 - DNA, 13 bp, Homo sapiens
gcagctggctctc

SEQ ID NO: 2337335 - DNA, 15 bp, Homo sapiens
gcagcttggggagag

SEQ ID NO: 2337336 - DNA, 18 bp, Homo sapiens
gcaggaacaaacagggct

SEQ ID NO: 2337337 - DNA, 22 bp, Homo sapiens
gcaggaccagccagcagcagcc

SEQ ID NO: 2337338 - DNA, 17 bp, Homo sapiens
gcaggacgaaaaagagg

SEQ ID NO: 2337339 - DNA, 22 bp, Homo sapiens
gcaggagcttctgggagatttt

SEQ ID NO: 2337340 - DNA, 14 bp, Homo sapiens
gcaggaggtggaga

SEQ ID NO: 2337341 - DNA, 23 bp, Homo sapiens
gcaggatggcctttccttccctc

SEQ ID NO: 2337342 - DNA, 17 bp, Homo sapiens
gcaggattcccttctgg

SEQ ID NO: 2337343 - DNA, 21 bp, Homo sapiens
gcaggattcccttctgggctt

SEQ ID NO: 2337344 - DNA, 18 bp, Homo sapiens
gcaggcacgggtggtccc

SEQ ID NO: 2337345 - DNA, 19 bp, Homo sapiens
gcaggcacgggtggtcccc

SEQ ID NO: 2337346 - DNA, 17 bp, Homo sapiens
gcaggcatagaggcttc

SEQ ID NO: 2337347 - DNA, 17 bp, Homo sapiens
gcaggccacctggctct

SEQ ID NO: 2337348 - DNA, 18 bp, Homo sapiens
gcaggccacctggctctc

SEQ ID NO: 2337349 - DNA, 22 bp, Homo sapiens
gcaggctcactgccaggccagc

SEQ ID NO: 2337350 - DNA, 11 bp, Homo sapiens
gcaggctgggc

SEQ ID NO: 2337351 - DNA, 15 bp, Homo sapiens
gcaggctgggccatg

SEQ ID NO: 2337352 - DNA, 19 bp, Homo sapiens
gcagggagagctcaccatg

SEQ ID NO: 2337353 - DNA, 19 bp, Homo sapiens
gcagggagcaactctccac

SEQ ID NO: 2337354 - DNA, 18 bp, Homo sapiens
gcagggcagcctgtcacc

SEQ ID NO: 2337355 - DNA, 15 bp, Homo sapiens
gcagggccatgcaga

SEQ ID NO: 2337356 - DNA, 15 bp, Homo sapiens
gcagggctgtgcttg

SEQ ID NO: 2337357 - DNA, 23 bp, Homo sapiens
gcagggctgtgcttgaaggccct

SEQ ID NO: 2337358 - DNA, 20 bp, Homo sapiens
gcaggggtgggggtggaggc

SEQ ID NO: 2337359 - DNA, 20 bp, Homo sapiens
gcagggtctgggctgggcac

SEQ ID NO: 2337360 - DNA, 22 bp, Homo sapiens
gcaggtgattggaccaggccat

SEQ ID NO: 2337361 - DNA, 22 bp, Homo sapiens
gcagtaccctccattgggcaca

SEQ ID NO: 2337362 - DNA, 16 bp, Homo sapiens
gcagtattttgtgtcc

SEQ ID NO: 2337363 - DNA, 23 bp, Homo sapiens
gcagtattttgtgtcctccagga

SEQ ID NO: 2337364 - DNA, 23 bp, Homo sapiens
gcagtcactggaggttgaagcca

SEQ ID NO: 2337365 - DNA, 15 bp, Homo sapiens
gcagtcagagtccag

SEQ ID NO: 2337366 - DNA, 19 bp, Homo sapiens
gcagtcagcagatgctgtt

SEQ ID NO: 2337367 - DNA, 21 bp, Homo sapiens
gcagtctgcccacgcagagga

SEQ ID NO: 2337368 - DNA, 22 bp, Homo sapiens
gcagtctgcccacgcagaggac

SEQ ID NO: 2337369 - DNA, 16 bp, Homo sapiens
gcagtgatatggcaga

SEQ ID NO: 2337370 - DNA, 19 bp, Homo sapiens
gcagtgatatggcagaaga

SEQ ID NO: 2337371 - DNA, 21 bp, Homo sapiens
gcagtgatatggcagaagaca

SEQ ID NO: 2337372 - DNA, 22 bp, Homo sapiens
gcagtgatatggcagaagacac

SEQ ID NO: 2337373 - DNA, 16 bp, Homo sapiens
gcagtgattctgtttg

SEQ ID NO: 2337374 - DNA, 19 bp, Homo sapiens
gcagtgcaatgcttgtaga

SEQ ID NO: 2337375 - DNA, 13 bp, Homo sapiens
gcagtgccccagg

SEQ ID NO: 2337376 - DNA, 24 bp, Homo sapiens
gcagtggttttggcaaacgctaaa

SEQ ID NO: 2337377 - DNA, 13 bp, Homo sapiens
gcagtgtgccccc

SEQ ID NO: 2337378 - DNA, 12 bp, Homo sapiens
gcagtgtggagt

SEQ ID NO: 2337379 - DNA, 21 bp, Homo sapiens
gcagtgtggagttcaccttgg

SEQ ID NO: 2337380 - DNA, 18 bp, Homo sapiens
gcagtgttggagtgagga

SEQ ID NO: 2337381 - DNA, 15 bp, Homo sapiens
gcagtgttttgcaag

SEQ ID NO: 2337382 - DNA, 18 bp, Homo sapiens
gcagttctactcaggctg

SEQ ID NO: 2337383 - DNA, 19 bp, Homo sapiens
gcagttctactcaggctgg

SEQ ID NO: 2337384 - DNA, 18 bp, Homo sapiens
gcagttggccaagcagaa

SEQ ID NO: 2337385 - DNA, 15 bp, Homo sapiens
gcataaatatgcagt

SEQ ID NO: 2337386 - DNA, 15 bp, Homo sapiens
gcataaattgcatca

SEQ ID NO: 2337387 - DNA, 17 bp, Homo sapiens
gcataatttaaaaatat

SEQ ID NO: 2337388 - DNA, 20 bp, Homo sapiens
gcataatttaaaaatatatt

SEQ ID NO: 2337389 - DNA, 18 bp, Homo sapiens
gcatactgagaatataca

SEQ ID NO: 2337390 - DNA, 12 bp, Homo sapiens
gcatagtttctt

SEQ ID NO: 2337391 - DNA, 15 bp, Homo sapiens
gcatatcctgagcca

SEQ ID NO: 2337392 - DNA, 17 bp, Homo sapiens
gcatatgagcctgccct

SEQ ID NO: 2337393 - DNA, 17 bp, Homo sapiens
gcatatttaacaaaatt

SEQ ID NO: 2337394 - DNA, 17 bp, Homo sapiens
gcatcaatgtattttat

SEQ ID NO: 2337395 - DNA, 17 bp, Homo sapiens
gcatcacctcaccaagg

SEQ ID NO: 2337396 - DNA, 15 bp, Homo sapiens
gcatcattataagct

SEQ ID NO: 2337397 - DNA, 19 bp, Homo sapiens
gcatcattataagctatga

SEQ ID NO: 2337398 - DNA, 18 bp, Homo sapiens
gcatcccccctgctcagc

SEQ ID NO: 2337399 - DNA, 12 bp, Homo sapiens
gcatccctgaga

SEQ ID NO: 2337400 - DNA, 20 bp, Homo sapiens
gcatcccttcccacatgcct

SEQ ID NO: 2337401 - DNA, 16 bp, Homo sapiens
gcatcctatgcttaat

SEQ ID NO: 2337402 - DNA, 18 bp, Homo sapiens
gcatctcttccccagaga

SEQ ID NO: 2337403 - DNA, 22 bp, Homo sapiens
gcatctcttccccagagaggca

SEQ ID NO: 2337404 - DNA, 15 bp, Homo sapiens
gcatgaaataaaata

SEQ ID NO: 2337405 - DNA, 15 bp, Homo sapiens
gcatgacagcctgca

SEQ ID NO: 2337406 - DNA, 18 bp, Homo sapiens
gcatgactaatgcttttt

SEQ ID NO: 2337407 - DNA, 20 bp, Homo sapiens
gcatgatcatagctcactgc

SEQ ID NO: 2337408 - DNA, 14 bp, Homo sapiens
gcatgcagctttgc

SEQ ID NO: 2337409 - DNA, 14 bp, Homo sapiens
gcatgcttaaattt

SEQ ID NO: 2337410 - DNA, 18 bp, Homo sapiens
gcatgcttaaattttaac

SEQ ID NO: 2337411 - DNA, 12 bp, Homo sapiens
gcatgcttcctt

SEQ ID NO: 2337412 - DNA, 19 bp, Homo sapiens
gcatgcttcctttctctcc

SEQ ID NO: 2337413 - DNA, 20 bp, Homo sapiens
gcatggatatagttttactt

SEQ ID NO: 2337414 - DNA, 18 bp, Homo sapiens
gcatgtagaggcttgttt

SEQ ID NO: 2337415 - DNA, 14 bp, Homo sapiens
gcatgtatgtcttg

SEQ ID NO: 2337416 - DNA, 20 bp, Homo sapiens
gcatgtgtatttccagtgca

SEQ ID NO: 2337417 - DNA, 21 bp, Homo sapiens
gcatgttcacccttatagtct

SEQ ID NO: 2337418 - DNA, 14 bp, Homo sapiens
gcatgttcctcctt

SEQ ID NO: 2337419 - DNA, 21 bp, Homo sapiens
gcattactgtccccttgatat

SEQ ID NO: 2337420 - DNA, 14 bp, Homo sapiens
gcattattaaattg

SEQ ID NO: 2337421 - DNA, 22 bp, Homo sapiens
gcattattttatatatttttta

SEQ ID NO: 2337422 - DNA, 19 bp, Homo sapiens
gcattcacatttagaaaag

SEQ ID NO: 2337423 - DNA, 14 bp, Homo sapiens
gcattcataaactt

SEQ ID NO: 2337424 - DNA, 22 bp, Homo sapiens
gcattcataaacttttctctta

SEQ ID NO: 2337425 - DNA, 14 bp, Homo sapiens
gcattcatttttat

SEQ ID NO: 2337426 - DNA, 17 bp, Homo sapiens
gcattcatttttatagc

SEQ ID NO: 2337427 - DNA, 22 bp, Homo sapiens
gcattcatttttatagcaacaa

SEQ ID NO: 2337428 - DNA, 19 bp, Homo sapiens
gcattccttctttgataat

SEQ ID NO: 2337429 - DNA, 23 bp, Homo sapiens
gcattccttctttgataatgtta

SEQ ID NO: 2337430 - DNA, 23 bp, Homo sapiens
gcattcgttgtgttttttaagat

SEQ ID NO: 2337431 - DNA, 10 bp, Homo sapiens
gcattgagta

SEQ ID NO: 2337432 - DNA, 14 bp, Homo sapiens
gcatttaataaaga

SEQ ID NO: 2337433 - DNA, 13 bp, Homo sapiens
gcatttagcacag

SEQ ID NO: 2337434 - DNA, 17 bp, Homo sapiens
gcatttggtctcaggca

SEQ ID NO: 2337435 - DNA, 17 bp, Homo sapiens
gcattttagaaactaca

SEQ ID NO: 2337436 - DNA, 16 bp, Homo sapiens
gctcaccgcccatcag

SEQ ID NO: 2337437 - DNA, 15 bp, Homo sapiens
gctcaccgctggccc

SEQ ID NO: 2337438 - DNA, 16 bp, Homo sapiens
gctcacgactcttcct

SEQ ID NO: 2337439 - DNA, 12 bp, Homo sapiens
gctcactgcagc

SEQ ID NO: 2337440 - DNA, 15 bp, Homo sapiens
gctcactgccaggcc

SEQ ID NO: 2337441 - DNA, 17 bp, Homo sapiens
gctcactgccaggccag

SEQ ID NO: 2337442 - DNA, 20 bp, Homo sapiens
gctcactgccaggccagcct

SEQ ID NO: 2337443 - DNA, 21 bp, Homo sapiens
gctcactgccaggccagcctc

SEQ ID NO: 2337444 - DNA, 23 bp, Homo sapiens
gctcacttctgggcttcatctgg

SEQ ID NO: 2337445 - DNA, 15 bp, Homo sapiens
gctcactttttcata

SEQ ID NO: 2337446 - DNA, 17 bp, Homo sapiens
gctcagaacttgctgct

SEQ ID NO: 2337447 - DNA, 19 bp, Homo sapiens
gctcagggtcactgaacca

SEQ ID NO: 2337448 - DNA, 12 bp, Homo sapiens
gctcagtaaacg

SEQ ID NO: 2337449 - DNA, 23 bp, Homo sapiens
gctcagtgtccagcttccaaagc

SEQ ID NO: 2337450 - DNA, 19 bp, Homo sapiens
gctcataagtaaatgtctt

SEQ ID NO: 2337451 - DNA, 22 bp, Homo sapiens
gctcatagaattttgagtattc

SEQ ID NO: 2337452 - DNA, 15 bp, Homo sapiens
gctcatgttgagcca

SEQ ID NO: 2337453 - DNA, 17 bp, Homo sapiens
gctcatgttgagccagt

SEQ ID NO: 2337454 - DNA, 18 bp, Homo sapiens
gctcatgttgagccagtg

SEQ ID NO: 2337455 - DNA, 13 bp, Homo sapiens
gctccagattctg

SEQ ID NO: 2337456 - DNA, 14 bp, Homo sapiens
gctccagattctga

SEQ ID NO: 2337457 - DNA, 13 bp, Homo sapiens
gctccagccatct

SEQ ID NO: 2337458 - DNA, 14 bp, Homo sapiens
gctccagccatctc

SEQ ID NO: 2337459 - DNA, 17 bp, Homo sapiens
gctccagctttctgcca

SEQ ID NO: 2337460 - DNA, 23 bp, Homo sapiens
gctccagggaatccaagcctcca

SEQ ID NO: 2337461 - DNA, 22 bp, Homo sapiens
gctccatcccaaccaggcacct

SEQ ID NO: 2337462 - DNA, 16 bp, Homo sapiens
gctcccacctcctgac

SEQ ID NO: 2337463 - DNA, 19 bp, Homo sapiens
gctccccacagcgtccctg

SEQ ID NO: 2337464 - DNA, 14 bp, Homo sapiens
gctcccctgccaca

SEQ ID NO: 2337465 - DNA, 17 bp, Homo sapiens
gctcccgagctactctc

SEQ ID NO: 2337466 - DNA, 20 bp, Homo sapiens
gctccctaaactttggcctt

SEQ ID NO: 2337467 - DNA, 15 bp, Homo sapiens
gctccctcccaggac

SEQ ID NO: 2337468 - DNA, 18 bp, Homo sapiens
gctccctcccaggactct

SEQ ID NO: 2337469 - DNA, 14 bp, Homo sapiens
gctccctcctccag

SEQ ID NO: 2337470 - DNA, 16 bp, Homo sapiens
gctccctcctccaggc

SEQ ID NO: 2337471 - DNA, 22 bp, Homo sapiens
gctccctcctccaggcctgcct

SEQ ID NO: 2337472 - DNA, 12 bp, Homo sapiens
gctccctcctgc

SEQ ID NO: 2337473 - DNA, 13 bp, Homo sapiens
gctccctcctgca

SEQ ID NO: 2337474 - DNA, 13 bp, Homo sapiens
gctccctcctgga

SEQ ID NO: 2337475 - DNA, 15 bp, Homo sapiens
gctccctcctggagc

SEQ ID NO: 2337476 - DNA, 16 bp, Homo sapiens
gctccctcctggagca

SEQ ID NO: 2337477 - DNA, 17 bp, Homo sapiens
gctccctttctcaggag

SEQ ID NO: 2337478 - DNA, 17 bp, Homo sapiens
gctcctgtcccctgcta

SEQ ID NO: 2337479 - DNA, 11 bp, Homo sapiens
gctccttgctg

SEQ ID NO: 2337480 - DNA, 16 bp, Homo sapiens
gctcgagcaaaattca

SEQ ID NO: 2337481 - DNA, 17 bp, Homo sapiens
gctcgccccacccaggg

SEQ ID NO: 2337482 - DNA, 21 bp, Homo sapiens
gctcgctgccatcaccgctgg

SEQ ID NO: 2337483 - DNA, 23 bp, Homo sapiens
gctcggagaagagcgcagtgttt

SEQ ID NO: 2337484 - DNA, 21 bp, Homo sapiens
gctcggggtaaaaagtggctg

SEQ ID NO: 2337485 - DNA, 22 bp, Homo sapiens
gctcggggtaaaaagtggctgc

SEQ ID NO: 2337486 - DNA, 14 bp, Homo sapiens
gctctaaaaggtaa

SEQ ID NO: 2337487 - DNA, 16 bp, Homo sapiens
gctctaccctgtctgt

SEQ ID NO: 2337488 - DNA, 22 bp, Homo sapiens
gctctaccctgtctgtcccttt

SEQ ID NO: 2337489 - DNA, 18 bp, Homo sapiens
gctctaccttcctgtccc

SEQ ID NO: 2337490 - DNA, 22 bp, Homo sapiens
gctctaccttcctgtccctgag

SEQ ID NO: 2337491 - DNA, 23 bp, Homo sapiens
gctctaccttcctgtccctgagg

SEQ ID NO: 2337492 - DNA, 23 bp, Homo sapiens
gctctagggactgccaggctgtt

SEQ ID NO: 2337493 - DNA, 13 bp, Homo sapiens
gctctccaccttg

SEQ ID NO: 2337494 - DNA, 12 bp, Homo sapiens
gctctccattct

SEQ ID NO: 2337495 - DNA, 17 bp, Homo sapiens
gctctccattctgctcc

SEQ ID NO: 2337496 - DNA, 14 bp, Homo sapiens
gctctcccagtgaa

SEQ ID NO: 2337497 - DNA, 22 bp, Homo sapiens
gctctccggggccatttgcaat

SEQ ID NO: 2337498 - DNA, 13 bp, Homo sapiens
gctctcctcttct

SEQ ID NO: 2337499 - DNA, 14 bp, Homo sapiens
gctctcctggccct

SEQ ID NO: 2337500 - DNA, 17 bp, Homo sapiens
gctctctgacgcttgtg

SEQ ID NO: 2337501 - DNA, 20 bp, Homo sapiens
gctctctgtgggctggcagt

SEQ ID NO: 2337502 - DNA, 11 bp, Homo sapiens
gctctgagaac

SEQ ID NO: 2337503 - DNA, 18 bp, Homo sapiens
gctctgcagtcctactca

SEQ ID NO: 2337504 - DNA, 21 bp, Homo sapiens
gctctggacagcagaagcctc

SEQ ID NO: 2337505 - DNA, 14 bp, Homo sapiens
gctctggaggtgct

SEQ ID NO: 2337506 - DNA, 17 bp, Homo sapiens
gctctggaggtgctgct

SEQ ID NO: 2337507 - DNA, 15 bp, Homo sapiens
gctctgtccccaaag

SEQ ID NO: 2337508 - DNA, 15 bp, Homo sapiens
gctctgtcccccagg

SEQ ID NO: 2337509 - DNA, 18 bp, Homo sapiens
gctctgtcccccaggctg

SEQ ID NO: 2337510 - DNA, 20 bp, Homo sapiens
gctctgtcccccaggctgga

SEQ ID NO: 2337511 - DNA, 18 bp, Homo sapiens
gctctgtgagccccacag

SEQ ID NO: 2337512 - DNA, 22 bp, Homo sapiens
gctctgtgagggtgctgactgg

SEQ ID NO: 2337513 - DNA, 21 bp, Homo sapiens
gctctgtgcagtcactggagg

SEQ ID NO: 2337514 - DNA, 16 bp, Homo sapiens
gctcttagtcccaagc

SEQ ID NO: 2337515 - DNA, 18 bp, Homo sapiens
gctcttagtcccaagcta

SEQ ID NO: 2337516 - DNA, 20 bp, Homo sapiens
gctcttcatctgcctgcgct

SEQ ID NO: 2337517 - DNA, 21 bp, Homo sapiens
gctcttcatctgcctgcgctc

SEQ ID NO: 2337518 - DNA, 16 bp, Homo sapiens
gctgaagaattgaaaa

SEQ ID NO: 2337519 - DNA, 19 bp, Homo sapiens
gctgacaacttagctcagg

SEQ ID NO: 2337520 - DNA, 20 bp, Homo sapiens
gctgacaacttagctcaggt

SEQ ID NO: 2337521 - DNA, 17 bp, Homo sapiens
gctgacagagctctggg

SEQ ID NO: 2337522 - DNA, 13 bp, Homo sapiens
gctgacctgctga

SEQ ID NO: 2337523 - DNA, 17 bp, Homo sapiens
gctgacctgctgacctg

SEQ ID NO: 2337524 - DNA, 14 bp, Homo sapiens
gctgactgtagctt

SEQ ID NO: 2337525 - DNA, 16 bp, Homo sapiens
gctgagcagcctctgg

SEQ ID NO: 2337526 - DNA, 17 bp, Homo sapiens
gctgagcagcctctgga

SEQ ID NO: 2337527 - DNA, 19 bp, Homo sapiens
gctgaggccagagtcacct

SEQ ID NO: 2337528 - DNA, 19 bp, Homo sapiens
gctgaggcccagtgcatat

SEQ ID NO: 2337529 - DNA, 23 bp, Homo sapiens
gctgaggctgggggagagccgtg

SEQ ID NO: 2337530 - DNA, 17 bp, Homo sapiens
gctgagggcctgctgga

SEQ ID NO: 2337531 - DNA, 22 bp, Homo sapiens
gctgagggcctgctggaggcct

SEQ ID NO: 2337532 - DNA, 17 bp, Homo sapiens
gctgaggttcctctgcc

SEQ ID NO: 2337533 - DNA, 22 bp, Homo sapiens
gctgaggttcctctgcctgccc

SEQ ID NO: 2337534 - DNA, 15 bp, Homo sapiens
gctgagtcatctgtt

SEQ ID NO: 2337535 - DNA, 23 bp, Homo sapiens
gctgagtcatctgttagggcctt

SEQ ID NO: 2337536 - DNA, 19 bp, Homo sapiens
gctgatattatttcttctc

SEQ ID NO: 2337537 - DNA, 14 bp, Homo sapiens
gctgatccccaacc

SEQ ID NO: 2337538 - DNA, 20 bp, Homo sapiens
gctgcactgaggcagcgacc

SEQ ID NO: 2337539 - DNA, 11 bp, Homo sapiens
gctgcactgtg

SEQ ID NO: 2337540 - DNA, 21 bp, Homo sapiens
gctgcactgtgaacctgggca

SEQ ID NO: 2337541 - DNA, 20 bp, Homo sapiens
gctgcagagaaacttaagca

SEQ ID NO: 2337542 - DNA, 21 bp, Homo sapiens
gctgcagttttgctatctggg

SEQ ID NO: 2337543 - DNA, 20 bp, Homo sapiens
gctgccaagagtgaagggaa

SEQ ID NO: 2337544 - DNA, 14 bp, Homo sapiens
gctgccaccagccc

SEQ ID NO: 2337545 - DNA, 18 bp, Homo sapiens
gctgccagacatggacct

SEQ ID NO: 2337546 - DNA, 22 bp, Homo sapiens
gctgccagacatggacctccag

SEQ ID NO: 2337547 - DNA, 20 bp, Homo sapiens
gctgccagccttgagccctg

SEQ ID NO: 2337548 - DNA, 21 bp, Homo sapiens
gctgccagccttgagccctgg

SEQ ID NO: 2337549 - DNA, 16 bp, Homo sapiens
gctgccatcaccgctg

SEQ ID NO: 2337550 - DNA, 16 bp, Homo sapiens
ggatatagttttactt

SEQ ID NO: 2337551 - DNA, 14 bp, Homo sapiens
ggatattatagaaa

SEQ ID NO: 2337552 - DNA, 17 bp, Homo sapiens
ggatattatagaaaatt

SEQ ID NO: 2337553 - DNA, 18 bp, Homo sapiens
ggatattgaatgttaaag

SEQ ID NO: 2337554 - DNA, 12 bp, Homo sapiens
ggatatttccta

SEQ ID NO: 2337555 - DNA, 19 bp, Homo sapiens
ggatcagagcgcacaggga

SEQ ID NO: 2337556 - DNA, 16 bp, Homo sapiens
ggatcagcattttaga

SEQ ID NO: 2337557 - DNA, 11 bp, Homo sapiens
ggatcagcctc

SEQ ID NO: 2337558 - DNA, 12 bp, Homo sapiens
ggatcagcctcc

SEQ ID NO: 2337559 - DNA, 16 bp, Homo sapiens
ggatcatggtgtaata

SEQ ID NO: 2337560 - DNA, 19 bp, Homo sapiens
ggatccccgcctggccagg

SEQ ID NO: 2337561 - DNA, 17 bp, Homo sapiens
ggatctaaaaaaatgtt

SEQ ID NO: 2337562 - DNA, 15 bp, Homo sapiens
ggatctgctgaggcc

SEQ ID NO: 2337563 - DNA, 21 bp, Homo sapiens
ggatctgctgaggcccagtgc

SEQ ID NO: 2337564 - DNA, 16 bp, Homo sapiens
ggatgagagcccagag

SEQ ID NO: 2337565 - DNA, 18 bp, Homo sapiens
ggatgcaacaaatgtggc

SEQ ID NO: 2337566 - DNA, 16 bp, Homo sapiens
ggatgccaatttcctc

SEQ ID NO: 2337567 - DNA, 23 bp, Homo sapiens
ggatggaccaacctgctctgtcc

SEQ ID NO: 2337568 - DNA, 20 bp, Homo sapiens
ggatggcatttggtctcagg

SEQ ID NO: 2337569 - DNA, 18 bp, Homo sapiens
ggatggccgtggatggcc

SEQ ID NO: 2337570 - DNA, 20 bp, Homo sapiens
ggatggcctttccttccctc

SEQ ID NO: 2337571 - DNA, 12 bp, Homo sapiens
ggatgtcacagt

SEQ ID NO: 2337572 - DNA, 14 bp, Homo sapiens
ggatgtcacagtcc

SEQ ID NO: 2337573 - DNA, 18 bp, Homo sapiens
ggatgtgtgtctcacccc

SEQ ID NO: 2337574 - DNA, 16 bp, Homo sapiens
ggatgttatgaacagc

SEQ ID NO: 2337575 - DNA, 18 bp, Homo sapiens
ggatgttatgaacagctg

SEQ ID NO: 2337576 - DNA, 23 bp, Homo sapiens
ggatgttattatccttgggggct

SEQ ID NO: 2337577 - DNA, 19 bp, Homo sapiens
ggattatttaataacatta

SEQ ID NO: 2337578 - DNA, 22 bp, Homo sapiens
ggattccactcgtgtgtttcta

SEQ ID NO: 2337579 - DNA, 14 bp, Homo sapiens
ggattctaaataca

SEQ ID NO: 2337580 - DNA, 16 bp, Homo sapiens
ggattgctaaaacagc

SEQ ID NO: 2337581 - DNA, 16 bp, Homo sapiens
ggattggattatttaa

SEQ ID NO: 2337582 - DNA, 13 bp, Homo sapiens
ggatttccctgca

SEQ ID NO: 2337583 - DNA, 15 bp, Homo sapiens
ggatttccctgcaga

SEQ ID NO: 2337584 - DNA, 21 bp, Homo sapiens
ggatttctaacagtccttgct

SEQ ID NO: 2337585 - DNA, 13 bp, Homo sapiens
ggatttgcctcac

SEQ ID NO: 2337586 - DNA, 23 bp, Homo sapiens
ggatttgcctcaccttggggcct

SEQ ID NO: 2337587 - DNA, 13 bp, Homo sapiens
ggattttcctgaa

SEQ ID NO: 2337588 - DNA, 15 bp, Homo sapiens
ggattttttcccttt

SEQ ID NO: 2337589 - DNA, 14 bp, Homo sapiens
ggcacacacagccc

SEQ ID NO: 2337590 - DNA, 15 bp, Homo sapiens
ggcacacacagcccc

SEQ ID NO: 2337591 - DNA, 13 bp, Homo sapiens
ggcacagatgcct

SEQ ID NO: 2337592 - DNA, 13 bp, Homo sapiens
ggcacagtccaga

SEQ ID NO: 2337593 - DNA, 18 bp, Homo sapiens
ggcacagtttttgtaaag

SEQ ID NO: 2337594 - DNA, 20 bp, Homo sapiens
ggcacccaccgtggaggagg

SEQ ID NO: 2337595 - DNA, 18 bp, Homo sapiens
ggcacccatcagaaaaag

SEQ ID NO: 2337596 - DNA, 20 bp, Homo sapiens
ggcaccctcagggagcctcc

SEQ ID NO: 2337597 - DNA, 12 bp, Homo sapiens
ggcacctcttcc

SEQ ID NO: 2337598 - DNA, 16 bp, Homo sapiens
ggcacctgacttggct

SEQ ID NO: 2337599 - DNA, 19 bp, Homo sapiens
ggcacgccaacagcccccc

SEQ ID NO: 2337600 - DNA, 21 bp, Homo sapiens
ggcactccgcgccgatgccac

SEQ ID NO: 2337601 - DNA, 12 bp, Homo sapiens
ggcagaagacac

SEQ ID NO: 2337602 - DNA, 16 bp, Homo sapiens
ggcagaagacaccaga

SEQ ID NO: 2337603 - DNA, 17 bp, Homo sapiens
ggcagaagacaccagag

SEQ ID NO: 2337604 - DNA, 18 bp, Homo sapiens
ggcagaagacaccagagc

SEQ ID NO: 2337605 - DNA, 13 bp, Homo sapiens
ggcagagaataaa

SEQ ID NO: 2337606 - DNA, 14 bp, Homo sapiens
ggcagagaataaaa

SEQ ID NO: 2337607 - DNA, 14 bp, Homo sapiens
ggcagagctgcatc

SEQ ID NO: 2337608 - DNA, 20 bp, Homo sapiens
ggcagagctggagcccccag

SEQ ID NO: 2337609 - DNA, 24 bp, Homo sapiens
ggcagagctggagcccccagcaga

SEQ ID NO: 2337610 - DNA, 17 bp, Homo sapiens
ggcagatgtcttccctg

SEQ ID NO: 2337611 - DNA, 21 bp, Homo sapiens
ggcagatgtcttccctgggct

SEQ ID NO: 2337612 - DNA, 22 bp, Homo sapiens
ggcagatgtcttccctgggctg

SEQ ID NO: 2337613 - DNA, 15 bp, Homo sapiens
ggcagcaccacactg

SEQ ID NO: 2337614 - DNA, 11 bp, Homo sapiens
ggcagccagac

SEQ ID NO: 2337615 - DNA, 13 bp, Homo sapiens
ggcagccagacca

SEQ ID NO: 2337616 - DNA, 15 bp, Homo sapiens
ggcagcccagagact

SEQ ID NO: 2337617 - DNA, 13 bp, Homo sapiens
ggcagcccagcag

SEQ ID NO: 2337618 - DNA, 11 bp, Homo sapiens
ggcagcctgcc

SEQ ID NO: 2337619 - DNA, 14 bp, Homo sapiens
ggcagcctgccgcc

SEQ ID NO: 2337620 - DNA, 13 bp, Homo sapiens
ggcagctgtagct

SEQ ID NO: 2337621 - DNA, 15 bp, Homo sapiens
ggcaggaacaaacag

SEQ ID NO: 2337622 - DNA, 23 bp, Homo sapiens
ggcaggatggcctttccttccct

SEQ ID NO: 2337623 - DNA, 18 bp, Homo sapiens
ggcaggccacctggctct

SEQ ID NO: 2337624 - DNA, 16 bp, Homo sapiens
ggcaggctcactgcca

SEQ ID NO: 2337625 - DNA, 19 bp, Homo sapiens
ggcaggctcactgccaggc

SEQ ID NO: 2337626 - DNA, 10 bp, Homo sapiens
ggcaggctgg

SEQ ID NO: 2337627 - DNA, 14 bp, Homo sapiens
ggcaggctgggacg

SEQ ID NO: 2337628 - DNA, 16 bp, Homo sapiens
ggcaggctgggccatg

SEQ ID NO: 2337629 - DNA, 22 bp, Homo sapiens
ggcaggctgggccatgtccaaa

SEQ ID NO: 2337630 - DNA, 12 bp, Homo sapiens
ggcaggcttggg

SEQ ID NO: 2337631 - DNA, 11 bp, Homo sapiens
ggcagggctgt

SEQ ID NO: 2337632 - DNA, 14 bp, Homo sapiens
ggcaggggtggggg

SEQ ID NO: 2337633 - DNA, 16 bp, Homo sapiens
ggcagggtctgggctg

SEQ ID NO: 2337634 - DNA, 17 bp, Homo sapiens
ggcagtgcaatgcttgt

SEQ ID NO: 2337635 - DNA, 12 bp, Homo sapiens
ggcagtgcccca

SEQ ID NO: 2337636 - DNA, 17 bp, Homo sapiens
ggcagtgccccagggag

SEQ ID NO: 2337637 - DNA, 12 bp, Homo sapiens
ggcataaagtaa

SEQ ID NO: 2337638 - DNA, 16 bp, Homo sapiens
ggcatagaggcttctc

SEQ ID NO: 2337639 - DNA, 19 bp, Homo sapiens
ggcataggtctctttgctt

SEQ ID NO: 2337640 - DNA, 19 bp, Homo sapiens
ggcatctcttccccagaga

SEQ ID NO: 2337641 - DNA, 21 bp, Homo sapiens
ggcatctcttccccagagagg

SEQ ID NO: 2337642 - DNA, 15 bp, Homo sapiens
ggcatgacactctag

SEQ ID NO: 2337643 - DNA, 18 bp, Homo sapiens
ggcattctggacctctgg

SEQ ID NO: 2337644 - DNA, 14 bp, Homo sapiens
ggcattttcctcct

SEQ ID NO: 2337645 - DNA, 16 bp, Homo sapiens
ggcattttcctcctct

SEQ ID NO: 2337646 - DNA, 18 bp, Homo sapiens
ggcattttcctcctctgc

SEQ ID NO: 2337647 - DNA, 23 bp, Homo sapiens
ggccaaagtgccggtgagaccca

SEQ ID NO: 2337648 - DNA, 14 bp, Homo sapiens
ggccaagcagaaaa

SEQ ID NO: 2337649 - DNA, 15 bp, Homo sapiens
ggccaaggacctgag

SEQ ID NO: 2337650 - DNA, 17 bp, Homo sapiens
ggccacacgctgcacct

SEQ ID NO: 2337651 - DNA, 21 bp, Homo sapiens
ggccacagcaagtacagcggc

SEQ ID NO: 2337652 - DNA, 16 bp, Homo sapiens
ggccacatagatgctg

SEQ ID NO: 2337653 - DNA, 18 bp, Homo sapiens
ggccaccaaagctgccca

SEQ ID NO: 2337654 - DNA, 20 bp, Homo sapiens
ggccaccagccatcctccct

SEQ ID NO: 2337655 - DNA, 21 bp, Homo sapiens
ggccaccagccatcctccctc

SEQ ID NO: 2337656 - DNA, 23 bp, Homo sapiens
ggccaccagccatcctccctcca

SEQ ID NO: 2337657 - DNA, 23 bp, Homo sapiens
ggccagcccctggggcccagccc

SEQ ID NO: 2337658 - DNA, 20 bp, Homo sapiens
ggccagcctccgagagggag

SEQ ID NO: 2337659 - DNA, 22 bp, Homo sapiens
ggccagcctccgagagggagag

SEQ ID NO: 2337660 - DNA, 14 bp, Homo sapiens
ggccagggcctctc

SEQ ID NO: 2337661 - DNA, 20 bp, Homo sapiens
ggccagtccaccctgcctgc

SEQ ID NO: 2337662 - DNA, 13 bp, Homo sapiens
ggccagtccccat

SEQ ID NO: 2337663 - DNA, 22 bp, Homo sapiens
ggccagtccccatttctgcctc

SEQ ID NO: 2337664 - DNA, 16 bp, Homo sapiens
ggccagttgatctgct

SEQ ID NO: 2337665 - DNA, 23 bp, Homo sapiens
ggccagttgatctgctctgtttt

SEQ ID NO: 2337666 - DNA, 22 bp, Homo sapiens
gtagaaacaaagggttttcttt

SEQ ID NO: 2337667 - DNA, 17 bp, Homo sapiens
gtagaactccaggccct

SEQ ID NO: 2337668 - DNA, 20 bp, Homo sapiens
gtagaactttattaagtaaa

SEQ ID NO: 2337669 - DNA, 18 bp, Homo sapiens
gtagaatacgcagaacta

SEQ ID NO: 2337670 - DNA, 17 bp, Homo sapiens
gtagagctagctgccac

SEQ ID NO: 2337671 - DNA, 14 bp, Homo sapiens
gtagaggcttgttt

SEQ ID NO: 2337672 - DNA, 12 bp, Homo sapiens
gtagagttaaga

SEQ ID NO: 2337673 - DNA, 15 bp, Homo sapiens
gtagagttaagaagc

SEQ ID NO: 2337674 - DNA, 21 bp, Homo sapiens
gtagatgtgcatttttgtgaa

SEQ ID NO: 2337675 - DNA, 17 bp, Homo sapiens
gtagcagagttaaatct

SEQ ID NO: 2337676 - DNA, 21 bp, Homo sapiens
gtagcattctttggagttaaa

SEQ ID NO: 2337677 - DNA, 15 bp, Homo sapiens
gtagccacagctgct

SEQ ID NO: 2337678 - DNA, 23 bp, Homo sapiens
gtagcctaaaacgaatggtcttt

SEQ ID NO: 2337679 - DNA, 20 bp, Homo sapiens
gtagcctatttttttagatt

SEQ ID NO: 2337680 - DNA, 13 bp, Homo sapiens
gtagcgagctgct

SEQ ID NO: 2337681 - DNA, 15 bp, Homo sapiens
gtagcgagctgctct

SEQ ID NO: 2337682 - DNA, 22 bp, Homo sapiens
gtaggaaccgtggtatgtctgc

SEQ ID NO: 2337683 - DNA, 18 bp, Homo sapiens
gtaggtggcttgagctag

SEQ ID NO: 2337684 - DNA, 23 bp, Homo sapiens
gtagtaaaagtggtctctgctgg

SEQ ID NO: 2337685 - DNA, 23 bp, Homo sapiens
gtagtcccctgttgattatcttc

SEQ ID NO: 2337686 - DNA, 20 bp, Homo sapiens
gtagtctcactgcttgaact

SEQ ID NO: 2337687 - DNA, 13 bp, Homo sapiens
gtagttaatataa

SEQ ID NO: 2337688 - DNA, 17 bp, Homo sapiens
gtagttaatataaatgt

SEQ ID NO: 2337689 - DNA, 23 bp, Homo sapiens
gtataagttatttttgtacatgt

SEQ ID NO: 2337690 - DNA, 13 bp, Homo sapiens
gtataatattgaa

SEQ ID NO: 2337691 - DNA, 15 bp, Homo sapiens
gtatacctgattttt

SEQ ID NO: 2337692 - DNA, 21 bp, Homo sapiens
gtatactaagagtaaagcaac

SEQ ID NO: 2337693 - DNA, 21 bp, Homo sapiens
gtatagtgtctattatcacat

SEQ ID NO: 2337694 - DNA, 19 bp, Homo sapiens
gtatatacttaagaataca

SEQ ID NO: 2337695 - DNA, 14 bp, Homo sapiens
gtatattacaatga

SEQ ID NO: 2337696 - DNA, 15 bp, Homo sapiens
gtatcacgatttgca

SEQ ID NO: 2337697 - DNA, 16 bp, Homo sapiens
gtatcacgatttgcag

SEQ ID NO: 2337698 - DNA, 14 bp, Homo sapiens
gtatcatatattta

SEQ ID NO: 2337699 - DNA, 22 bp, Homo sapiens
gtatgaataatgaaaataaaac

SEQ ID NO: 2337700 - DNA, 14 bp, Homo sapiens
gtatgactaaagag

SEQ ID NO: 2337701 - DNA, 16 bp, Homo sapiens
gtatgcattattaaat

SEQ ID NO: 2337702 - DNA, 17 bp, Homo sapiens
gtatgcattattaaatt

SEQ ID NO: 2337703 - DNA, 17 bp, Homo sapiens
gtatggaagttttccta

SEQ ID NO: 2337704 - DNA, 14 bp, Homo sapiens
gtatggtaatcttt

SEQ ID NO: 2337705 - DNA, 22 bp, Homo sapiens
gtatggtaggggagggcaggct

SEQ ID NO: 2337706 - DNA, 11 bp, Homo sapiens
gtatgtctgcc

SEQ ID NO: 2337707 - DNA, 13 bp, Homo sapiens
gtatgtgagctgt

SEQ ID NO: 2337708 - DNA, 15 bp, Homo sapiens
gtatgtgggatattg

SEQ ID NO: 2337709 - DNA, 20 bp, Homo sapiens
gtatgtgggatattgaatgt

SEQ ID NO: 2337710 - DNA, 23 bp, Homo sapiens
gtatgtgggggcttcatctcttt

SEQ ID NO: 2337711 - DNA, 15 bp, Homo sapiens
gtatgtgtggctgtg

SEQ ID NO: 2337712 - DNA, 18 bp, Homo sapiens
gtatgttaaagagaatga

SEQ ID NO: 2337713 - DNA, 18 bp, Homo sapiens
gtattaaaactaaatttc

SEQ ID NO: 2337714 - DNA, 22 bp, Homo sapiens
gtattactgaataatatcaaat

SEQ ID NO: 2337715 - DNA, 20 bp, Homo sapiens
gtattatacatgtgatacat

SEQ ID NO: 2337716 - DNA, 22 bp, Homo sapiens
gtattcagtgagggtcttctta

SEQ ID NO: 2337717 - DNA, 18 bp, Homo sapiens
gtattccatgagctgctc

SEQ ID NO: 2337718 - DNA, 23 bp, Homo sapiens
gtattgacaataagaaacagttt

SEQ ID NO: 2337719 - DNA, 18 bp, Homo sapiens
gtatttcccttccaaaga

SEQ ID NO: 2337720 - DNA, 17 bp, Homo sapiens
gtatttcggctatgtct

SEQ ID NO: 2337721 - DNA, 18 bp, Homo sapiens
gtatttcggctatgtctc

SEQ ID NO: 2337722 - DNA, 15 bp, Homo sapiens
gtattttcatgaaaa

SEQ ID NO: 2337723 - DNA, 13 bp, Homo sapiens
gtatttttaaagg

SEQ ID NO: 2337724 - DNA, 22 bp, Homo sapiens
gtatttttttttctaagagaag

SEQ ID NO: 2337725 - DNA, 20 bp, Homo sapiens
gtcaaaaaattatttgctat

SEQ ID NO: 2337726 - DNA, 20 bp, Homo sapiens
gtcaaagatgccccattcct

SEQ ID NO: 2337727 - DNA, 14 bp, Homo sapiens
gtcaacactcttct

SEQ ID NO: 2337728 - DNA, 17 bp, Homo sapiens
gtcaacactcttcttga

SEQ ID NO: 2337729 - DNA, 18 bp, Homo sapiens
gtcaagctgctctgagcc

SEQ ID NO: 2337730 - DNA, 19 bp, Homo sapiens
gtcaagctgctctgagcca

SEQ ID NO: 2337731 - DNA, 20 bp, Homo sapiens
gtcaagctgctctgagccac

SEQ ID NO: 2337732 - DNA, 14 bp, Homo sapiens
gtcaagctggtgct

SEQ ID NO: 2337733 - DNA, 15 bp, Homo sapiens
gtcaagtaagaagac

SEQ ID NO: 2337734 - DNA, 21 bp, Homo sapiens
gtcaatggcttgttcatcatc

SEQ ID NO: 2337735 - DNA, 17 bp, Homo sapiens
gtcacaattatgtgcaa

SEQ ID NO: 2337736 - DNA, 17 bp, Homo sapiens
gtcaccaccctgctcat

SEQ ID NO: 2337737 - DNA, 13 bp, Homo sapiens
gtcaccagagact

SEQ ID NO: 2337738 - DNA, 19 bp, Homo sapiens
gtcaccctccaccgagcca

SEQ ID NO: 2337739 - DNA, 13 bp, Homo sapiens
gtcaccctgcaga

SEQ ID NO: 2337740 - DNA, 16 bp, Homo sapiens
gtcacctacatatgct

SEQ ID NO: 2337741 - DNA, 15 bp, Homo sapiens
gtcacctcacaaacc

SEQ ID NO: 2337742 - DNA, 22 bp, Homo sapiens
gtcaccttttctgtggctggct

SEQ ID NO: 2337743 - DNA, 19 bp, Homo sapiens
gtcacgtttggtgcttctc

SEQ ID NO: 2337744 - DNA, 15 bp, Homo sapiens
gtcactggaaagggg

SEQ ID NO: 2337745 - DNA, 13 bp, Homo sapiens
gtcagaatcagaa

SEQ ID NO: 2337746 - DNA, 22 bp, Homo sapiens
gtcagactttgtgttcatttca

SEQ ID NO: 2337747 - DNA, 22 bp, Homo sapiens
gtcagagccatgtcttctccct

SEQ ID NO: 2337748 - DNA, 13 bp, Homo sapiens
gtcagagtccagt

SEQ ID NO: 2337749 - DNA, 16 bp, Homo sapiens
gtcagcagatgctgtt

SEQ ID NO: 2337750 - DNA, 19 bp, Homo sapiens
gtcagctactaatgatgtt

SEQ ID NO: 2337751 - DNA, 13 bp, Homo sapiens
gtcagctccagct

SEQ ID NO: 2337752 - DNA, 20 bp, Homo sapiens
gtcagctgctccctggcatt

SEQ ID NO: 2337753 - DNA, 23 bp, Homo sapiens
gtcaggacggctcctcagagcgc

SEQ ID NO: 2337754 - DNA, 21 bp, Homo sapiens
gtcaggagatcgagaccatcc

SEQ ID NO: 2337755 - DNA, 17 bp, Homo sapiens
gtcaggccctgactcct

SEQ ID NO: 2337756 - DNA, 21 bp, Homo sapiens
gtcaggccctgactcctctgg

SEQ ID NO: 2337757 - DNA, 22 bp, Homo sapiens
gtcaggccctgactcctctggc

SEQ ID NO: 2337758 - DNA, 17 bp, Homo sapiens
gtcaggctgaaaacaat

SEQ ID NO: 2337759 - DNA, 15 bp, Homo sapiens
gtcatcaaagcagaa

SEQ ID NO: 2337760 - DNA, 21 bp, Homo sapiens
gtcatcccatcattttccata

SEQ ID NO: 2337761 - DNA, 17 bp, Homo sapiens
gtcatcggcgtggccca

SEQ ID NO: 2337762 - DNA, 16 bp, Homo sapiens
gtcatctcccctcctg

SEQ ID NO: 2337763 - DNA, 14 bp, Homo sapiens
gtcatctgtaagag

SEQ ID NO: 2337764 - DNA, 19 bp, Homo sapiens
gtcatctgtaagagcttgc

SEQ ID NO: 2337765 - DNA, 17 bp, Homo sapiens
gtcatctgttagggcct

SEQ ID NO: 2337766 - DNA, 18 bp, Homo sapiens
gtcatgcataaatatgca

SEQ ID NO: 2337767 - DNA, 19 bp, Homo sapiens
gtcatgcataaatatgcag

SEQ ID NO: 2337768 - DNA, 19 bp, Homo sapiens
gtccaaagaggctgcccct

SEQ ID NO: 2337769 - DNA, 15 bp, Homo sapiens
gtccaccctgcctgc

SEQ ID NO: 2337770 - DNA, 14 bp, Homo sapiens
gtccaccctgtcct

SEQ ID NO: 2337771 - DNA, 22 bp, Homo sapiens
gtccacgcgtgccgtggcacca

SEQ ID NO: 2337772 - DNA, 20 bp, Homo sapiens
gtccactgttgagccccagt

SEQ ID NO: 2337773 - DNA, 14 bp, Homo sapiens
gtccagacccaagt

SEQ ID NO: 2337774 - DNA, 14 bp, Homo sapiens
gtccagctggggcc

SEQ ID NO: 2337775 - DNA, 17 bp, Homo sapiens
gtccagctggggccaga

SEQ ID NO: 2337776 - DNA, 22 bp, Homo sapiens
gtccagctggggccagaggctg

SEQ ID NO: 2337777 - DNA, 12 bp, Homo sapiens
gtccaggcagct

SEQ ID NO: 2337778 - DNA, 20 bp, Homo sapiens
gtccaggcagctccctcctg

SEQ ID NO: 2337779 - DNA, 16 bp, Homo sapiens
gtccaggggtctgtct

SEQ ID NO: 2337780 - DNA, 15 bp, Homo sapiens
gttattttctacagt

SEQ ID NO: 2337781 - DNA, 14 bp, Homo sapiens
gttatttttgtaca

SEQ ID NO: 2337782 - DNA, 23 bp, Homo sapiens
gttattttttcagactgtgcaat

SEQ ID NO: 2337783 - DNA, 13 bp, Homo sapiens
gttcaaaatgtct

SEQ ID NO: 2337784 - DNA, 18 bp, Homo sapiens
gttcaagccttccaggga

SEQ ID NO: 2337785 - DNA, 22 bp, Homo sapiens
gttcaaggtcactgtttcctgg

SEQ ID NO: 2337786 - DNA, 20 bp, Homo sapiens
gttcatatatcaagaagtct

SEQ ID NO: 2337787 - DNA, 18 bp, Homo sapiens
gttcatcaccatttcctc

SEQ ID NO: 2337788 - DNA, 21 bp, Homo sapiens
gttcatcatccagatgtggct

SEQ ID NO: 2337789 - DNA, 21 bp, Homo sapiens
gttccaccccaagagaactcg

SEQ ID NO: 2337790 - DNA, 17 bp, Homo sapiens
gttccagtttctccttg

SEQ ID NO: 2337791 - DNA, 16 bp, Homo sapiens
gttcccaatatcatgt

SEQ ID NO: 2337792 - DNA, 16 bp, Homo sapiens
gttcccatttcagctg

SEQ ID NO: 2337793 - DNA, 19 bp, Homo sapiens
gttccctcctagctctccc

SEQ ID NO: 2337794 - DNA, 22 bp, Homo sapiens
gttcccttgaaactttgggaaa

SEQ ID NO: 2337795 - DNA, 20 bp, Homo sapiens
gttcccttgagggctgcagt

SEQ ID NO: 2337796 - DNA, 17 bp, Homo sapiens
gttcctactcacacttc

SEQ ID NO: 2337797 - DNA, 20 bp, Homo sapiens
gttcctcaaattttttgact

SEQ ID NO: 2337798 - DNA, 23 bp, Homo sapiens
gttcctcctacttacaacccagg

SEQ ID NO: 2337799 - DNA, 14 bp, Homo sapiens
gttcctctgcctgc

SEQ ID NO: 2337800 - DNA, 13 bp, Homo sapiens
gttcctctgctca

SEQ ID NO: 2337801 - DNA, 15 bp, Homo sapiens
gttcctgctgctgtc

SEQ ID NO: 2337802 - DNA, 23 bp, Homo sapiens
gttccttcatttccaccaggccg

SEQ ID NO: 2337803 - DNA, 21 bp, Homo sapiens
gttccttggtcctagtaagaa

SEQ ID NO: 2337804 - DNA, 22 bp, Homo sapiens
gttcgaaatagatatcctctcc

SEQ ID NO: 2337805 - DNA, 16 bp, Homo sapiens
gttctacactcatctt

SEQ ID NO: 2337806 - DNA, 16 bp, Homo sapiens
gttctactcaggctgg

SEQ ID NO: 2337807 - DNA, 17 bp, Homo sapiens
gttctaggaaaataaaa

SEQ ID NO: 2337808 - DNA, 12 bp, Homo sapiens
gttctcatgaag

SEQ ID NO: 2337809 - DNA, 16 bp, Homo sapiens
gttctgtaataaaact

SEQ ID NO: 2337810 - DNA, 14 bp, Homo sapiens
gttctgtggttcct

SEQ ID NO: 2337811 - DNA, 18 bp, Homo sapiens
gttctgtggttcctctgc

SEQ ID NO: 2337812 - DNA, 18 bp, Homo sapiens
gttctgttgacctgtgca

SEQ ID NO: 2337813 - DNA, 15 bp, Homo sapiens
gttcttatgaggagg

SEQ ID NO: 2337814 - DNA, 14 bp, Homo sapiens
gttctttcctcttt

SEQ ID NO: 2337815 - DNA, 20 bp, Homo sapiens
gttctttcctctttctgctc

SEQ ID NO: 2337816 - DNA, 21 bp, Homo sapiens
gttctttcctctttctgctct

SEQ ID NO: 2337817 - DNA, 17 bp, Homo sapiens
gttgaaatgttctgtca

SEQ ID NO: 2337818 - DNA, 12 bp, Homo sapiens
gttgagagccag

SEQ ID NO: 2337819 - DNA, 13 bp, Homo sapiens
gttgagagccagt

SEQ ID NO: 2337820 - DNA, 16 bp, Homo sapiens
gttgagcatctgtccc

SEQ ID NO: 2337821 - DNA, 21 bp, Homo sapiens
gttgagcatgacagcctgcag

SEQ ID NO: 2337822 - DNA, 14 bp, Homo sapiens
gttgaggccactgt

SEQ ID NO: 2337823 - DNA, 21 bp, Homo sapiens
gttgaggccactgtgttcctt

SEQ ID NO: 2337824 - DNA, 22 bp, Homo sapiens
gttgatgccttttttttcatga

SEQ ID NO: 2337825 - DNA, 13 bp, Homo sapiens
gttgattatcttc

SEQ ID NO: 2337826 - DNA, 14 bp, Homo sapiens
gttgcaagatgtga

SEQ ID NO: 2337827 - DNA, 18 bp, Homo sapiens
gttgcatatgagcctgcc

SEQ ID NO: 2337828 - DNA, 11 bp, Homo sapiens
gttgccccaga

SEQ ID NO: 2337829 - DNA, 21 bp, Homo sapiens
gttgcccgaaactaagccagg

SEQ ID NO: 2337830 - DNA, 20 bp, Homo sapiens
gttgcggatggatggaaggt

SEQ ID NO: 2337831 - DNA, 23 bp, Homo sapiens
gttgcgtggactctgcacatgtc

SEQ ID NO: 2337832 - DNA, 17 bp, Homo sapiens
gttgctatttttgtaaa

SEQ ID NO: 2337833 - DNA, 22 bp, Homo sapiens
gttgctccgcctggcctggcca

SEQ ID NO: 2337834 - DNA, 16 bp, Homo sapiens
gttggccaagcagaaa

SEQ ID NO: 2337835 - DNA, 22 bp, Homo sapiens
gttgggatcaggggtaggaatg

SEQ ID NO: 2337836 - DNA, 17 bp, Homo sapiens
gttgggctcgcactgcc

SEQ ID NO: 2337837 - DNA, 17 bp, Homo sapiens
gttgtaaaatagaaaaa

SEQ ID NO: 2337838 - DNA, 14 bp, Homo sapiens
gttgtaatatcagt

SEQ ID NO: 2337839 - DNA, 23 bp, Homo sapiens
gttgtaatatcagttacagtggc

SEQ ID NO: 2337840 - DNA, 16 bp, Homo sapiens
gttgtacatttatgat

SEQ ID NO: 2337841 - DNA, 15 bp, Homo sapiens
gttgtacttaaatgg

SEQ ID NO: 2337842 - DNA, 16 bp, Homo sapiens
gttgtcaccagatctg

SEQ ID NO: 2337843 - DNA, 15 bp, Homo sapiens
gttgtcttattgcac

SEQ ID NO: 2337844 - DNA, 13 bp, Homo sapiens
gttgtgagctgga

SEQ ID NO: 2337845 - DNA, 15 bp, Homo sapiens
gttgttctttcagaa

SEQ ID NO: 2337846 - DNA, 15 bp, Homo sapiens
gttgtttctttctag

SEQ ID NO: 2337847 - DNA, 20 bp, Homo sapiens
gtttaaaatgtaatttaaat

SEQ ID NO: 2337848 - DNA, 20 bp, Homo sapiens
gtttaaataaaatttaattt

SEQ ID NO: 2337849 - DNA, 16 bp, Homo sapiens
gtttagcagatttaag

SEQ ID NO: 2337850 - DNA, 20 bp, Homo sapiens
gtttagcgttgttttgtgga

SEQ ID NO: 2337851 - DNA, 16 bp, Homo sapiens
gtttagctctgagaac

SEQ ID NO: 2337852 - DNA, 15 bp, Homo sapiens
gtttataataaaaat

SEQ ID NO: 2337853 - DNA, 12 bp, Homo sapiens
gtttattttcag

SEQ ID NO: 2337854 - DNA, 17 bp, Homo sapiens
gtttattttctacgttt

SEQ ID NO: 2337855 - DNA, 13 bp, Homo sapiens
gtttcaagaggag

SEQ ID NO: 2337856 - DNA, 20 bp, Homo sapiens
gtttcaagaggagcccccac

SEQ ID NO: 2337857 - DNA, 15 bp, Homo sapiens
gtttcaggtgacatg

SEQ ID NO: 2337858 - DNA, 13 bp, Homo sapiens
gtttccgtgcgtg

SEQ ID NO: 2337859 - DNA, 17 bp, Homo sapiens
gtttccgtgcgtggcac

SEQ ID NO: 2337860 - DNA, 18 bp, Homo sapiens
gtttctaagaaaatgtag

SEQ ID NO: 2337861 - DNA, 14 bp, Homo sapiens
gtttctctgtggct

SEQ ID NO: 2337862 - DNA, 20 bp, Homo sapiens
gtttctcttctagatgattt

SEQ ID NO: 2337863 - DNA, 17 bp, Homo sapiens
gtttctcttgagctggc

SEQ ID NO: 2337864 - DNA, 18 bp, Homo sapiens
gtttctcttgagctggcc

SEQ ID NO: 2337865 - DNA, 20 bp, Homo sapiens
gtttctcttgagctggcctc

SEQ ID NO: 2337866 - DNA, 13 bp, Homo sapiens
gtttcttagcttt

SEQ ID NO: 2337867 - DNA, 19 bp, Homo sapiens
gtttctttaaccttgtata

SEQ ID NO: 2337868 - DNA, 23 bp, Homo sapiens
gtttcttttcacattaggctgtt

SEQ ID NO: 2337869 - DNA, 14 bp, Homo sapiens
gtttgagctgcctt

SEQ ID NO: 2337870 - DNA, 19 bp, Homo sapiens
gtttgagtttttcctccca

SEQ ID NO: 2337871 - DNA, 23 bp, Homo sapiens
gtttgccccgggatattatagaa

SEQ ID NO: 2337872 - DNA, 21 bp, Homo sapiens
gtttgctgatccccaacctgc

SEQ ID NO: 2337873 - DNA, 19 bp, Homo sapiens
gtttggtaaatgtttcttt

SEQ ID NO: 2337874 - DNA, 15 bp, Homo sapiens
gtttgtcctttatgt

SEQ ID NO: 2337875 - DNA, 17 bp, Homo sapiens
gtttgtcctttatgtat

SEQ ID NO: 2337876 - DNA, 21 bp, Homo sapiens
gtttgtcctttttcactttga

SEQ ID NO: 2337877 - DNA, 20 bp, Homo sapiens
gtttgtcttggatatatagg

SEQ ID NO: 2337878 - DNA, 20 bp, Homo sapiens
gtttgttcataataaaagtg

SEQ ID NO: 2337879 - DNA, 11 bp, Homo sapiens
gttttacaata

SEQ ID NO: 2337880 - DNA, 13 bp, Homo sapiens
gttttacaatagt

SEQ ID NO: 2337881 - DNA, 20 bp, Homo sapiens
gttttacaatagttctgtgg

SEQ ID NO: 2337882 - DNA, 13 bp, Homo sapiens
gttttacttttaa

SEQ ID NO: 2337883 - DNA, 15 bp, Homo sapiens
gttttatatgattaa

SEQ ID NO: 2337884 - DNA, 21 bp, Homo sapiens
gttttccccaaaccataaaac

SEQ ID NO: 2337885 - DNA, 17 bp, Homo sapiens
gttttctcctctgcttc

SEQ ID NO: 2337886 - DNA, 17 bp, Homo sapiens
gttttctgaaacacacg

SEQ ID NO: 2337887 - DNA, 17 bp, Homo sapiens
gttttcttctttccctg

SEQ ID NO: 2337888 - DNA, 21 bp, Homo sapiens
gttttcttctttccctggaca

SEQ ID NO: 2337889 - DNA, 14 bp, Homo sapiens
gttttgaaaagcta

SEQ ID NO: 2337890 - DNA, 14 bp, Homo sapiens
gttttgacttaaga

SEQ ID NO: 2337891 - DNA, 16 bp, Homo sapiens
gttttgacttaagaaa

SEQ ID NO: 2337892 - DNA, 18 bp, Homo sapiens
gttttgaggcatgactaa

SEQ ID NO: 2337893 - DNA, 17 bp, Homo sapiens
gttttgtggataagaaa

SEQ ID NO: 2337894 - DNA, 12 bp, Homo sapiens
gttttgttgagc

SEQ ID NO: 2337895 - DNA, 12 bp, Homo sapiens
taagagtgtaga

SEQ ID NO: 2337896 - DNA, 18 bp, Homo sapiens
taagagtgtagaagcatt

SEQ ID NO: 2337897 - DNA, 23 bp, Homo sapiens
taagagtgtagaagcattccttc

SEQ ID NO: 2337898 - DNA, 23 bp, Homo sapiens
taagatataatttaaacgtgatt

SEQ ID NO: 2337899 - DNA, 21 bp, Homo sapiens
taagatgagcaaccacattta

SEQ ID NO: 2337900 - DNA, 19 bp, Homo sapiens
taagatggctgtggcattt

SEQ ID NO: 2337901 - DNA, 21 bp, Homo sapiens
taagatggctgtggcatttcc

SEQ ID NO: 2337902 - DNA, 15 bp, Homo sapiens
taagatgtgttctta

SEQ ID NO: 2337903 - DNA, 22 bp, Homo sapiens
taagattaataagatttttcaa

SEQ ID NO: 2337904 - DNA, 23 bp, Homo sapiens
taagattaataagatttttcaaa

SEQ ID NO: 2337905 - DNA, 13 bp, Homo sapiens
taagattggaaat

SEQ ID NO: 2337906 - DNA, 17 bp, Homo sapiens
taagatttctctaatat

SEQ ID NO: 2337907 - DNA, 15 bp, Homo sapiens
taagatttttcaaaa

SEQ ID NO: 2337908 - DNA, 17 bp, Homo sapiens
taagatttttcaaaatc

SEQ ID NO: 2337909 - DNA, 18 bp, Homo sapiens
taagatttttctcaaagt

SEQ ID NO: 2337910 - DNA, 20 bp, Homo sapiens
taagatttttctcaaagttt

SEQ ID NO: 2337911 - DNA, 21 bp, Homo sapiens
taagatttttctcaaagtttt

SEQ ID NO: 2337912 - DNA, 18 bp, Homo sapiens
taagcaagagagatgttt

SEQ ID NO: 2337913 - DNA, 19 bp, Homo sapiens
taagcaataaggaaatgta

SEQ ID NO: 2337914 - DNA, 16 bp, Homo sapiens
taagcagatgggaact

SEQ ID NO: 2337915 - DNA, 22 bp, Homo sapiens
taagcatttgtacatcttcttt

SEQ ID NO: 2337916 - DNA, 13 bp, Homo sapiens
taagccaggcctg

SEQ ID NO: 2337917 - DNA, 20 bp, Homo sapiens
taagccatagaccctgaggc

SEQ ID NO: 2337918 - DNA, 14 bp, Homo sapiens
taagccttcaaaac

SEQ ID NO: 2337919 - DNA, 21 bp, Homo sapiens
taagctatgagttgaaatgtt

SEQ ID NO: 2337920 - DNA, 18 bp, Homo sapiens
taagctgatattatttct

SEQ ID NO: 2337921 - DNA, 21 bp, Homo sapiens
taagctgatattatttcttct

SEQ ID NO: 2337922 - DNA, 10 bp, Homo sapiens
taagctgcaa

SEQ ID NO: 2337923 - DNA, 13 bp, Homo sapiens
taagctgtgtctg

SEQ ID NO: 2337924 - DNA, 15 bp, Homo sapiens
taaggataaatcata

SEQ ID NO: 2337925 - DNA, 13 bp, Homo sapiens
taaggatgtgtga

SEQ ID NO: 2337926 - DNA, 16 bp, Homo sapiens
taagggaagatcactg

SEQ ID NO: 2337927 - DNA, 20 bp, Homo sapiens
taaggggaagaatgaaagct

SEQ ID NO: 2337928 - DNA, 12 bp, Homo sapiens
taagtaaatgta

SEQ ID NO: 2337929 - DNA, 21 bp, Homo sapiens
taagtaaatgtcttcatgttg

SEQ ID NO: 2337930 - DNA, 19 bp, Homo sapiens
taagtaccaatgggaagca

SEQ ID NO: 2337931 - DNA, 17 bp, Homo sapiens
taagtgcccacatttga

SEQ ID NO: 2337932 - DNA, 15 bp, Homo sapiens
taagtgccctctccc

SEQ ID NO: 2337933 - DNA, 16 bp, Homo sapiens
taagtgcgtgtgtaga

SEQ ID NO: 2337934 - DNA, 14 bp, Homo sapiens
taagtggactgtat

SEQ ID NO: 2337935 - DNA, 16 bp, Homo sapiens
taagtggactgtattt

SEQ ID NO: 2337936 - DNA, 21 bp, Homo sapiens
taagtggtttttatattttca

SEQ ID NO: 2337937 - DNA, 16 bp, Homo sapiens
taagtgtaaaaaatgt

SEQ ID NO: 2337938 - DNA, 15 bp, Homo sapiens
taagtgtagctcaaa

SEQ ID NO: 2337939 - DNA, 14 bp, Homo sapiens
taagtgttctcatg

SEQ ID NO: 2337940 - DNA, 21 bp, Homo sapiens
taagtgttctgtggctgattt

SEQ ID NO: 2337941 - DNA, 13 bp, Homo sapiens
taagttatctttg

SEQ ID NO: 2337942 - DNA, 19 bp, Homo sapiens
taagttatttttgtacatg

SEQ ID NO: 2337943 - DNA, 18 bp, Homo sapiens
taagtttcaggtgacatg

SEQ ID NO: 2337944 - DNA, 20 bp, Homo sapiens
taagtttcaggtgacatgtg

SEQ ID NO: 2337945 - DNA, 12 bp, Homo sapiens
taagtttgtagt

SEQ ID NO: 2337946 - DNA, 13 bp, Homo sapiens
taataaaagaaaa

SEQ ID NO: 2337947 - DNA, 19 bp, Homo sapiens
taataaaagaacatgcttg

SEQ ID NO: 2337948 - DNA, 12 bp, Homo sapiens
taataaaagtga

SEQ ID NO: 2337949 - DNA, 13 bp, Homo sapiens
taataaaataatt

SEQ ID NO: 2337950 - DNA, 12 bp, Homo sapiens
taataaaccagt

SEQ ID NO: 2337951 - DNA, 12 bp, Homo sapiens
taataaagtatt

SEQ ID NO: 2337952 - DNA, 17 bp, Homo sapiens
taataaagtattttctt

SEQ ID NO: 2337953 - DNA, 14 bp, Homo sapiens
taataaattttcta

SEQ ID NO: 2337954 - DNA, 20 bp, Homo sapiens
taataacattaccttactgt

SEQ ID NO: 2337955 - DNA, 14 bp, Homo sapiens
taataagatggctg

SEQ ID NO: 2337956 - DNA, 17 bp, Homo sapiens
taataagatggctgtgg

SEQ ID NO: 2337957 - DNA, 16 bp, Homo sapiens
taataagcactgtaaa

SEQ ID NO: 2337958 - DNA, 23 bp, Homo sapiens
taataagtgacaaataagattaa

SEQ ID NO: 2337959 - DNA, 12 bp, Homo sapiens
taataatactga

SEQ ID NO: 2337960 - DNA, 19 bp, Homo sapiens
taataatgaagtagaagtt

SEQ ID NO: 2337961 - DNA, 19 bp, Homo sapiens
taatacaagtaatattatt

SEQ ID NO: 2337962 - DNA, 22 bp, Homo sapiens
taatacagcaacaatttatgaa

SEQ ID NO: 2337963 - DNA, 13 bp, Homo sapiens
taatacctctgtg

SEQ ID NO: 2337964 - DNA, 14 bp, Homo sapiens
taatacctctgtgt

SEQ ID NO: 2337965 - DNA, 15 bp, Homo sapiens
taatacctctgtgtg

SEQ ID NO: 2337966 - DNA, 12 bp, Homo sapiens
taatactgacct

SEQ ID NO: 2337967 - DNA, 17 bp, Homo sapiens
taatactgacctacctc

SEQ ID NO: 2337968 - DNA, 21 bp, Homo sapiens
taatacttctttgttattata

SEQ ID NO: 2337969 - DNA, 13 bp, Homo sapiens
taatactttttaa

SEQ ID NO: 2337970 - DNA, 22 bp, Homo sapiens
taatagactgtaacttccaaat

SEQ ID NO: 2337971 - DNA, 18 bp, Homo sapiens
taatagccaaagatttca

SEQ ID NO: 2337972 - DNA, 18 bp, Homo sapiens
taatagggaaaattctaa

SEQ ID NO: 2337973 - DNA, 21 bp, Homo sapiens
taatagtgcttaaaaatcatt

SEQ ID NO: 2337974 - DNA, 15 bp, Homo sapiens
taatatactccttaa

SEQ ID NO: 2337975 - DNA, 23 bp, Homo sapiens
taatatactccttaaaaatgtat

SEQ ID NO: 2337976 - DNA, 15 bp, Homo sapiens
taatatataaacaat

SEQ ID NO: 2337977 - DNA, 19 bp, Homo sapiens
taatatatgaaataagtaa

SEQ ID NO: 2337978 - DNA, 14 bp, Homo sapiens
taatatcaaataaa

SEQ ID NO: 2337979 - DNA, 16 bp, Homo sapiens
taatatcaaataaaat

SEQ ID NO: 2337980 - DNA, 16 bp, Homo sapiens
taatatcaactctgaa

SEQ ID NO: 2337981 - DNA, 19 bp, Homo sapiens
taatattcttcaaatgtat

SEQ ID NO: 2337982 - DNA, 22 bp, Homo sapiens
taatattcttttgtttccatgg

SEQ ID NO: 2337983 - DNA, 17 bp, Homo sapiens
taatattgaaaattgaa

SEQ ID NO: 2337984 - DNA, 22 bp, Homo sapiens
taatattgaaaattgaaaagta

SEQ ID NO: 2337985 - DNA, 11 bp, Homo sapiens
taatatttgca

SEQ ID NO: 2337986 - DNA, 19 bp, Homo sapiens
taatatttttgtatttctc

SEQ ID NO: 2337987 - DNA, 11 bp, Homo sapiens
taatcaagaga

SEQ ID NO: 2337988 - DNA, 22 bp, Homo sapiens
taatcaagagaaacttcaaagt

SEQ ID NO: 2337989 - DNA, 20 bp, Homo sapiens
taatcaccatgtaagcactc

SEQ ID NO: 2337990 - DNA, 23 bp, Homo sapiens
taatcccagcactttgggaggcc

SEQ ID NO: 2337991 - DNA, 22 bp, Homo sapiens
taatcgtgtgccatggatctga

SEQ ID NO: 2337992 - DNA, 17 bp, Homo sapiens
taatcttaatctgttta

SEQ ID NO: 2337993 - DNA, 17 bp, Homo sapiens
taatcttcaaagccttc

SEQ ID NO: 2337994 - DNA, 14 bp, Homo sapiens
taatcttctgcctt

SEQ ID NO: 2337995 - DNA, 17 bp, Homo sapiens
taatcttgtttctgaaa

SEQ ID NO: 2337996 - DNA, 19 bp, Homo sapiens
taatctttacctgtataca

SEQ ID NO: 2337997 - DNA, 17 bp, Homo sapiens
taatgaaaataaaacac

SEQ ID NO: 2337998 - DNA, 14 bp, Homo sapiens
taatgacgaggaac

SEQ ID NO: 2337999 - DNA, 13 bp, Homo sapiens
taatgataaaata

SEQ ID NO: 2338000 - DNA, 17 bp, Homo sapiens
taatgataaaataaata

SEQ ID NO: 2338001 - DNA, 21 bp, Homo sapiens
taatgataaaataaataattt

SEQ ID NO: 2338002 - DNA, 14 bp, Homo sapiens
taatgataaactca

SEQ ID NO: 2338003 - DNA, 18 bp, Homo sapiens
taatgataaactcagatc

SEQ ID NO: 2338004 - DNA, 18 bp, Homo sapiens
taatgcctcttcattctt

SEQ ID NO: 2338005 - DNA, 15 bp, Homo sapiens
taatgccttactctt

SEQ ID NO: 2338006 - DNA, 15 bp, Homo sapiens
taatgctacaatttt

SEQ ID NO: 2338007 - DNA, 20 bp, Homo sapiens
taatgctaccaggatgctaa

SEQ ID NO: 2338008 - DNA, 17 bp, Homo sapiens
taatgctatgcaaaaaa

SEQ ID NO: 2338009 - DNA, 16 bp, Homo sapiens
taatgctgtttctaag

SEQ ID NO: 2338010 - DNA, 15 bp, Homo sapiens
tacctgtgaagtgtt

SEQ ID NO: 2338011 - DNA, 18 bp, Homo sapiens
taccttcctgtccctgag

SEQ ID NO: 2338012 - DNA, 16 bp, Homo sapiens
tacctttaattttaat

SEQ ID NO: 2338013 - DNA, 16 bp, Homo sapiens
tacctttacatatata

SEQ ID NO: 2338014 - DNA, 14 bp, Homo sapiens
taccttttcagggc

SEQ ID NO: 2338015 - DNA, 18 bp, Homo sapiens
taccttttcagggctggc

SEQ ID NO: 2338016 - DNA, 16 bp, Homo sapiens
taccttttttttttct

SEQ ID NO: 2338017 - DNA, 20 bp, Homo sapiens
taccttttttttttcttggt

SEQ ID NO: 2338018 - DNA, 21 bp, Homo sapiens
tacgacacgggtggggaaagg

SEQ ID NO: 2338019 - DNA, 23 bp, Homo sapiens
tacgtccgtgtgtcccagatgct

SEQ ID NO: 2338020 - DNA, 18 bp, Homo sapiens
tactaaaaagtataaaat

SEQ ID NO: 2338021 - DNA, 19 bp, Homo sapiens
tactaaacagtaagatatc

SEQ ID NO: 2338022 - DNA, 15 bp, Homo sapiens
tactaataaaccagt

SEQ ID NO: 2338023 - DNA, 23 bp, Homo sapiens
tactaatctgagattgtgtttgt

SEQ ID NO: 2338024 - DNA, 14 bp, Homo sapiens
tactaatgatgttt

SEQ ID NO: 2338025 - DNA, 15 bp, Homo sapiens
tactaatgatgtttt

SEQ ID NO: 2338026 - DNA, 18 bp, Homo sapiens
tactataaatgaaattga

SEQ ID NO: 2338027 - DNA, 13 bp, Homo sapiens
tactattgcctca

SEQ ID NO: 2338028 - DNA, 17 bp, Homo sapiens
tactcacacttcagctg

SEQ ID NO: 2338029 - DNA, 17 bp, Homo sapiens
tactcacttttcccact

SEQ ID NO: 2338030 - DNA, 17 bp, Homo sapiens
tactcctatgatctgag

SEQ ID NO: 2338031 - DNA, 15 bp, Homo sapiens
tactccttgcttcct

SEQ ID NO: 2338032 - DNA, 18 bp, Homo sapiens
tactccttgcttcctgat

SEQ ID NO: 2338033 - DNA, 23 bp, Homo sapiens
tactctggaatgtttttccctcc

SEQ ID NO: 2338034 - DNA, 14 bp, Homo sapiens
tactcttcttgaaa

SEQ ID NO: 2338035 - DNA, 17 bp, Homo sapiens
tactcttcttgaaattt

SEQ ID NO: 2338036 - DNA, 12 bp, Homo sapiens
tactctttccta

SEQ ID NO: 2338037 - DNA, 12 bp, Homo sapiens
tactgaaggaaa

SEQ ID NO: 2338038 - DNA, 13 bp, Homo sapiens
tactgaaggaaaa

SEQ ID NO: 2338039 - DNA, 20 bp, Homo sapiens
tactgaaggaaaaacacaag

SEQ ID NO: 2338040 - DNA, 15 bp, Homo sapiens
tactgaagtggctgg

SEQ ID NO: 2338041 - DNA, 20 bp, Homo sapiens
tactgaagtggctggtagaa

SEQ ID NO: 2338042 - DNA, 18 bp, Homo sapiens
tactgaataatgctacca

SEQ ID NO: 2338043 - DNA, 20 bp, Homo sapiens
tactgaataatgctaccagg

SEQ ID NO: 2338044 - DNA, 16 bp, Homo sapiens
tactgaatttttttgt

SEQ ID NO: 2338045 - DNA, 18 bp, Homo sapiens
tactgaatttttttgtaa

SEQ ID NO: 2338046 - DNA, 19 bp, Homo sapiens
tactgaatttttttgtaat

SEQ ID NO: 2338047 - DNA, 16 bp, Homo sapiens
tactgacatttcttct

SEQ ID NO: 2338048 - DNA, 11 bp, Homo sapiens
tactgacctac

SEQ ID NO: 2338049 - DNA, 14 bp, Homo sapiens
tactgagtgagtta

SEQ ID NO: 2338050 - DNA, 16 bp, Homo sapiens
tactgattgggaggtg

SEQ ID NO: 2338051 - DNA, 13 bp, Homo sapiens
tactgcatacttt

SEQ ID NO: 2338052 - DNA, 22 bp, Homo sapiens
tactgggaatggaaggctttgc

SEQ ID NO: 2338053 - DNA, 23 bp, Homo sapiens
tactggtccaaaagattgctgaa

SEQ ID NO: 2338054 - DNA, 13 bp, Homo sapiens
tactggtctctct

SEQ ID NO: 2338055 - DNA, 19 bp, Homo sapiens
tactggtctctctatgcct

SEQ ID NO: 2338056 - DNA, 16 bp, Homo sapiens
tactgtatattttgta

SEQ ID NO: 2338057 - DNA, 12 bp, Homo sapiens
tactgtggagga

SEQ ID NO: 2338058 - DNA, 13 bp, Homo sapiens
tactgttatagaa

SEQ ID NO: 2338059 - DNA, 17 bp, Homo sapiens
tactgttgtaagaattc

SEQ ID NO: 2338060 - DNA, 21 bp, Homo sapiens
tacttaaatggtaataagcac

SEQ ID NO: 2338061 - DNA, 21 bp, Homo sapiens
tacttagggaagaaaaagcaa

SEQ ID NO: 2338062 - DNA, 14 bp, Homo sapiens
tacttatattctgc

SEQ ID NO: 2338063 - DNA, 13 bp, Homo sapiens
tacttcttgaata

SEQ ID NO: 2338064 - DNA, 19 bp, Homo sapiens
tacttgctttaccttttca

SEQ ID NO: 2338065 - DNA, 15 bp, Homo sapiens
tacttgtgacaagaa

SEQ ID NO: 2338066 - DNA, 18 bp, Homo sapiens
tacttgttatgttgtaat

SEQ ID NO: 2338067 - DNA, 21 bp, Homo sapiens
tactttatcatgaatgctttt

SEQ ID NO: 2338068 - DNA, 22 bp, Homo sapiens
tactttatcatgaatgctttta

SEQ ID NO: 2338069 - DNA, 12 bp, Homo sapiens
tactttcaagta

SEQ ID NO: 2338070 - DNA, 14 bp, Homo sapiens
tactttcaagtaat

SEQ ID NO: 2338071 - DNA, 14 bp, Homo sapiens
tacttttaaactgt

SEQ ID NO: 2338072 - DNA, 14 bp, Homo sapiens
tactttttaaatgt

SEQ ID NO: 2338073 - DNA, 18 bp, Homo sapiens
tactttttaaattacctt

SEQ ID NO: 2338074 - DNA, 19 bp, Homo sapiens
tagaaaaaggggcctgagt

SEQ ID NO: 2338075 - DNA, 12 bp, Homo sapiens
tagaaaaataaa

SEQ ID NO: 2338076 - DNA, 16 bp, Homo sapiens
tagaaaagaactggaa

SEQ ID NO: 2338077 - DNA, 14 bp, Homo sapiens
tagaaaagtgaatt

SEQ ID NO: 2338078 - DNA, 16 bp, Homo sapiens
tagaaatgtttattga

SEQ ID NO: 2338079 - DNA, 18 bp, Homo sapiens
tagaaatgtttattgaca

SEQ ID NO: 2338080 - DNA, 16 bp, Homo sapiens
tagaacactaactcac

SEQ ID NO: 2338081 - DNA, 15 bp, Homo sapiens
tagaactgtctgtga

SEQ ID NO: 2338082 - DNA, 20 bp, Homo sapiens
tagaactttattaagtaaaa

SEQ ID NO: 2338083 - DNA, 22 bp, Homo sapiens
tagaagcactacaccttgcctt

SEQ ID NO: 2338084 - DNA, 14 bp, Homo sapiens
tagaagcattcctt

SEQ ID NO: 2338085 - DNA, 20 bp, Homo sapiens
tagaagcattccttctttga

SEQ ID NO: 2338086 - DNA, 23 bp, Homo sapiens
tagaagcattccttctttgataa

SEQ ID NO: 2338087 - DNA, 15 bp, Homo sapiens
tagaagccaagggaa

SEQ ID NO: 2338088 - DNA, 16 bp, Homo sapiens
tagaagccaagggaaa

SEQ ID NO: 2338089 - DNA, 19 bp, Homo sapiens
tagaagccaagggaaaggg

SEQ ID NO: 2338090 - DNA, 15 bp, Homo sapiens
tagaagtaggaggaa

SEQ ID NO: 2338091 - DNA, 15 bp, Homo sapiens
tagaagtctggaaaa

SEQ ID NO: 2338092 - DNA, 12 bp, Homo sapiens
tagaataattct

SEQ ID NO: 2338093 - DNA, 19 bp, Homo sapiens
tagaattttgagtattcca

SEQ ID NO: 2338094 - DNA, 13 bp, Homo sapiens
tagacaaaaagta

SEQ ID NO: 2338095 - DNA, 15 bp, Homo sapiens
tagacaaaaagtata

SEQ ID NO: 2338096 - DNA, 16 bp, Homo sapiens
tagacaaaaagtatat

SEQ ID NO: 2338097 - DNA, 22 bp, Homo sapiens
tagacatataccaaaaacaagt

SEQ ID NO: 2338098 - DNA, 11 bp, Homo sapiens
tagacatgaaa

SEQ ID NO: 2338099 - DNA, 12 bp, Homo sapiens
tagacatgaaag

SEQ ID NO: 2338100 - DNA, 12 bp, Homo sapiens
tagaccctgggt

SEQ ID NO: 2338101 - DNA, 20 bp, Homo sapiens
tagaccctgggtgggctctg

SEQ ID NO: 2338102 - DNA, 17 bp, Homo sapiens
tagactctgtctacctg

SEQ ID NO: 2338103 - DNA, 22 bp, Homo sapiens
tagactctgtctacctggtctg

SEQ ID NO: 2338104 - DNA, 14 bp, Homo sapiens
tagagaaaataaat

SEQ ID NO: 2338105 - DNA, 11 bp, Homo sapiens
tagagaccccg

SEQ ID NO: 2338106 - DNA, 17 bp, Homo sapiens
tagagaggtagcgagct

SEQ ID NO: 2338107 - DNA, 20 bp, Homo sapiens
tagagaggtagcgagctgct

SEQ ID NO: 2338108 - DNA, 14 bp, Homo sapiens
tagagatgagccca

SEQ ID NO: 2338109 - DNA, 14 bp, Homo sapiens
tagagctagctgcc

SEQ ID NO: 2338110 - DNA, 15 bp, Homo sapiens
tagagctagctgcca

SEQ ID NO: 2338111 - DNA, 17 bp, Homo sapiens
tagagctagctgccact

SEQ ID NO: 2338112 - DNA, 14 bp, Homo sapiens
tagaggcttctccg

SEQ ID NO: 2338113 - DNA, 19 bp, Homo sapiens
tagaggcttctccgccagc

SEQ ID NO: 2338114 - DNA, 20 bp, Homo sapiens
tagagtatttcccttccaaa

SEQ ID NO: 2338115 - DNA, 15 bp, Homo sapiens
tagagttaagaagct

SEQ ID NO: 2338116 - DNA, 16 bp, Homo sapiens
tagagttaagaagctg

SEQ ID NO: 2338117 - DNA, 23 bp, Homo sapiens
tagagttaagaagctgttgtaca

SEQ ID NO: 2338118 - DNA, 23 bp, Homo sapiens
tagagttgattgtctagtgagga

SEQ ID NO: 2338119 - DNA, 13 bp, Homo sapiens
tagataatattgt

SEQ ID NO: 2338120 - DNA, 22 bp, Homo sapiens
tagatatcctctccccctcctc

SEQ ID NO: 2338121 - DNA, 18 bp, Homo sapiens
tagatcaaatagttgcat

SEQ ID NO: 2338122 - DNA, 21 bp, Homo sapiens
tagatcctaagatgtgttctt

SEQ ID NO: 2338123 - DNA, 18 bp, Homo sapiens
tagatgatttcagttcta

SEQ ID NO: 2338124 - DNA, 21 bp, Homo sapiens
tagatgggacgcataatcatt

SEQ ID NO: 2338125 - DNA, 14 bp, Homo sapiens
tagatgtagtcttg

SEQ ID NO: 2338126 - DNA, 22 bp, Homo sapiens
tatgagacagggtcttgctctg

SEQ ID NO: 2338127 - DNA, 21 bp, Homo sapiens
tatgagcctgccctcactccc

SEQ ID NO: 2338128 - DNA, 13 bp, Homo sapiens
tatgaggagggga

SEQ ID NO: 2338129 - DNA, 14 bp, Homo sapiens
tatgaggaggggag

SEQ ID NO: 2338130 - DNA, 14 bp, Homo sapiens
tatgagtagccagg

SEQ ID NO: 2338131 - DNA, 17 bp, Homo sapiens
tatgagttgaaatgttc

SEQ ID NO: 2338132 - DNA, 19 bp, Homo sapiens
tatgattaaattatcattg

SEQ ID NO: 2338133 - DNA, 16 bp, Homo sapiens
tatgcaatatatgttc

SEQ ID NO: 2338134 - DNA, 20 bp, Homo sapiens
tatgcaatgtatagtgtcta

SEQ ID NO: 2338135 - DNA, 19 bp, Homo sapiens
tatgcacatatggactctg

SEQ ID NO: 2338136 - DNA, 18 bp, Homo sapiens
tatgcaccttgtgtctgt

SEQ ID NO: 2338137 - DNA, 20 bp, Homo sapiens
tatgcaccttgtgtctgtac

SEQ ID NO: 2338138 - DNA, 19 bp, Homo sapiens
tatgcacttttagaaatgc

SEQ ID NO: 2338139 - DNA, 18 bp, Homo sapiens
tatgcagaaatagacaaa

SEQ ID NO: 2338140 - DNA, 19 bp, Homo sapiens
tatgccaagtccctggaaa

SEQ ID NO: 2338141 - DNA, 19 bp, Homo sapiens
tatgccccaccaaggctga

SEQ ID NO: 2338142 - DNA, 11 bp, Homo sapiens
tatgctcaggt

SEQ ID NO: 2338143 - DNA, 12 bp, Homo sapiens
tatgctggtggt

SEQ ID NO: 2338144 - DNA, 14 bp, Homo sapiens
tatgcttaagcttt

SEQ ID NO: 2338145 - DNA, 17 bp, Homo sapiens
tatgcttaataaaagaa

SEQ ID NO: 2338146 - DNA, 20 bp, Homo sapiens
tatgcttaataaaagaacat

SEQ ID NO: 2338147 - DNA, 13 bp, Homo sapiens
tatgctttattaa

SEQ ID NO: 2338148 - DNA, 14 bp, Homo sapiens
tatggaagaaagta

SEQ ID NO: 2338149 - DNA, 12 bp, Homo sapiens
tatggcagaaga

SEQ ID NO: 2338150 - DNA, 16 bp, Homo sapiens
tatggcagaagacacc

SEQ ID NO: 2338151 - DNA, 22 bp, Homo sapiens
tatggggccctgtccaggtaga

SEQ ID NO: 2338152 - DNA, 19 bp, Homo sapiens
tatgggggcatctcttccc

SEQ ID NO: 2338153 - DNA, 22 bp, Homo sapiens
tatgggggcatctcttccccag

SEQ ID NO: 2338154 - DNA, 23 bp, Homo sapiens
tatgggggcatctcttccccaga

SEQ ID NO: 2338155 - DNA, 18 bp, Homo sapiens
tatggtaggggagggcag

SEQ ID NO: 2338156 - DNA, 14 bp, Homo sapiens
tatggttctccaag

SEQ ID NO: 2338157 - DNA, 20 bp, Homo sapiens
tatggttctccaagaaactg

SEQ ID NO: 2338158 - DNA, 21 bp, Homo sapiens
tatgtaacacaggataaagtt

SEQ ID NO: 2338159 - DNA, 22 bp, Homo sapiens
tatgtaacacaggataaagtta

SEQ ID NO: 2338160 - DNA, 17 bp, Homo sapiens
tatgtaatttcaaaata

SEQ ID NO: 2338161 - DNA, 19 bp, Homo sapiens
tatgtacaaacatgttgtt

SEQ ID NO: 2338162 - DNA, 12 bp, Homo sapiens
tatgtagatgtg

SEQ ID NO: 2338163 - DNA, 16 bp, Homo sapiens
tatgtagatgtgcatt

SEQ ID NO: 2338164 - DNA, 21 bp, Homo sapiens
tatgtaggtaagactgtagat

SEQ ID NO: 2338165 - DNA, 18 bp, Homo sapiens
tatgtatattaaaaaaga

SEQ ID NO: 2338166 - DNA, 15 bp, Homo sapiens
tatgtattctcttct

SEQ ID NO: 2338167 - DNA, 17 bp, Homo sapiens
tatgtcttggacactgt

SEQ ID NO: 2338168 - DNA, 14 bp, Homo sapiens
tatgtgaaaaatta

SEQ ID NO: 2338169 - DNA, 19 bp, Homo sapiens
tatgtgagctgtaaaaatg

SEQ ID NO: 2338170 - DNA, 23 bp, Homo sapiens
tatgtgagctgtaaaaatgttac

SEQ ID NO: 2338171 - DNA, 19 bp, Homo sapiens
tatgtgctatacacacaca

SEQ ID NO: 2338172 - DNA, 17 bp, Homo sapiens
tatgtgggcagattttc

SEQ ID NO: 2338173 - DNA, 21 bp, Homo sapiens
tatgtgggggcttcatctctt

SEQ ID NO: 2338174 - DNA, 13 bp, Homo sapiens
tatgtgtggctgt

SEQ ID NO: 2338175 - DNA, 14 bp, Homo sapiens
tatgttaaagagaa

SEQ ID NO: 2338176 - DNA, 13 bp, Homo sapiens
tatgttagagagg

SEQ ID NO: 2338177 - DNA, 21 bp, Homo sapiens
tatgttcctaacaaaatgaga

SEQ ID NO: 2338178 - DNA, 20 bp, Homo sapiens
tatgttgttgaactaatata

SEQ ID NO: 2338179 - DNA, 16 bp, Homo sapiens
tatgtttaaaagaaat

SEQ ID NO: 2338180 - DNA, 17 bp, Homo sapiens
tattaaaaaagagacat

SEQ ID NO: 2338181 - DNA, 23 bp, Homo sapiens
tattaaaaaagagacatccaaat

SEQ ID NO: 2338182 - DNA, 15 bp, Homo sapiens
tattaaaattccaaa

SEQ ID NO: 2338183 - DNA, 12 bp, Homo sapiens
tattaaacaaag

SEQ ID NO: 2338184 - DNA, 17 bp, Homo sapiens
tattaaagcatttccta

SEQ ID NO: 2338185 - DNA, 13 bp, Homo sapiens
tattaagcttttt

SEQ ID NO: 2338186 - DNA, 16 bp, Homo sapiens
tattaagctttttgga

SEQ ID NO: 2338187 - DNA, 22 bp, Homo sapiens
tattaagtgtgccaaatcagtt

SEQ ID NO: 2338188 - DNA, 20 bp, Homo sapiens
tattaatatcaactctgaag

SEQ ID NO: 2338189 - DNA, 22 bp, Homo sapiens
tattaatattcagggtaaatag

SEQ ID NO: 2338190 - DNA, 13 bp, Homo sapiens
tattaatatttgc

SEQ ID NO: 2338191 - DNA, 19 bp, Homo sapiens
tattaatcaagagaaactt

SEQ ID NO: 2338192 - DNA, 18 bp, Homo sapiens
tattagagtatttccctt

SEQ ID NO: 2338193 - DNA, 17 bp, Homo sapiens
tattagataatattttt

SEQ ID NO: 2338194 - DNA, 17 bp, Homo sapiens
tattagccaggatcatg

SEQ ID NO: 2338195 - DNA, 23 bp, Homo sapiens
tattagccaggatcatggtgtaa

SEQ ID NO: 2338196 - DNA, 19 bp, Homo sapiens
tattaggaagtgtttatgt

SEQ ID NO: 2338197 - DNA, 22 bp, Homo sapiens
tattaggactaaggaactaaaa

SEQ ID NO: 2338198 - DNA, 15 bp, Homo sapiens
tattataacataaaa

SEQ ID NO: 2338199 - DNA, 19 bp, Homo sapiens
tattatagaaaattatttg

SEQ ID NO: 2338200 - DNA, 18 bp, Homo sapiens
tattatgtaggtaagact

SEQ ID NO: 2338201 - DNA, 17 bp, Homo sapiens
tattatgtctcttctga

SEQ ID NO: 2338202 - DNA, 16 bp, Homo sapiens
tattattaataatgaa

SEQ ID NO: 2338203 - DNA, 12 bp, Homo sapiens
tattatttcttc

SEQ ID NO: 2338204 - DNA, 15 bp, Homo sapiens
tattatttcttctct

SEQ ID NO: 2338205 - DNA, 20 bp, Homo sapiens
tattatttttataattgtac

SEQ ID NO: 2338206 - DNA, 20 bp, Homo sapiens
tattatttttttaaaatttt

SEQ ID NO: 2338207 - DNA, 14 bp, Homo sapiens
tattcactggcccc

SEQ ID NO: 2338208 - DNA, 14 bp, Homo sapiens
tattcagaggcagt

SEQ ID NO: 2338209 - DNA, 18 bp, Homo sapiens
tattcagaggcagtgatg

SEQ ID NO: 2338210 - DNA, 15 bp, Homo sapiens
tattcagatgtatgt

SEQ ID NO: 2338211 - DNA, 16 bp, Homo sapiens
tattcagggtaaatag

SEQ ID NO: 2338212 - DNA, 17 bp, Homo sapiens
tattccaagacatgtct

SEQ ID NO: 2338213 - DNA, 16 bp, Homo sapiens
tattccatgagctgct

SEQ ID NO: 2338214 - DNA, 22 bp, Homo sapiens
tattcctgacctccgccatcca

SEQ ID NO: 2338215 - DNA, 14 bp, Homo sapiens
tattctcttctaca

SEQ ID NO: 2338216 - DNA, 19 bp, Homo sapiens
tattctgcagaaaattaat

SEQ ID NO: 2338217 - DNA, 18 bp, Homo sapiens
tattcttggaccatgcca

SEQ ID NO: 2338218 - DNA, 20 bp, Homo sapiens
tattgaaagagtctgggacc

SEQ ID NO: 2338219 - DNA, 13 bp, Homo sapiens
tattgaaattcta

SEQ ID NO: 2338220 - DNA, 14 bp, Homo sapiens
tattgaatgttaaa

SEQ ID NO: 2338221 - DNA, 19 bp, Homo sapiens
tattgagttccagttgaag

SEQ ID NO: 2338222 - DNA, 21 bp, Homo sapiens
tattgagttccagttgaagtt

SEQ ID NO: 2338223 - DNA, 14 bp, Homo sapiens
tattgattgggaaa

SEQ ID NO: 2338224 - DNA, 22 bp, Homo sapiens
tattgattgggaaaacatttgc

SEQ ID NO: 2338225 - DNA, 17 bp, Homo sapiens
tattgtatattacaatg

SEQ ID NO: 2338226 - DNA, 12 bp, Homo sapiens
tattgtttctgc

SEQ ID NO: 2338227 - DNA, 16 bp, Homo sapiens
tattgtttggtaaatg

SEQ ID NO: 2338228 - DNA, 14 bp, Homo sapiens
tatttaaaaacatt

SEQ ID NO: 2338229 - DNA, 18 bp, Homo sapiens
tatttaagtggactgtat

SEQ ID NO: 2338230 - DNA, 13 bp, Homo sapiens
tatttaataacat

SEQ ID NO: 2338231 - DNA, 14 bp, Homo sapiens
tatttaataacatt

SEQ ID NO: 2338232 - DNA, 17 bp, Homo sapiens
tatttactaactaaata

SEQ ID NO: 2338233 - DNA, 14 bp, Homo sapiens
tatttacttgttat

SEQ ID NO: 2338234 - DNA, 23 bp, Homo sapiens
tatttactttttcggtttcaaag

SEQ ID NO: 2338235 - DNA, 15 bp, Homo sapiens
tatttagacaagaga

SEQ ID NO: 2338236 - DNA, 15 bp, Homo sapiens
tatttatctttcaaa

SEQ ID NO: 2338237 - DNA, 23 bp, Homo sapiens
tatttattgagtacctactgtgt

SEQ ID NO: 2338238 - DNA, 17 bp, Homo sapiens
tatttcagtgttacctg

SEQ ID NO: 2338239 - DNA, 18 bp, Homo sapiens
tatttcagtgttacctgt

SEQ ID NO: 2338240 - DNA, 19 bp, Homo sapiens
tatttcagtgttacctgtg

SEQ ID NO: 2338241 - DNA, 21 bp, Homo sapiens
tccaagggttgagagccagtg

SEQ ID NO: 2338242 - DNA, 22 bp, Homo sapiens
tccaagtccaacctgcctgtgc

SEQ ID NO: 2338243 - DNA, 14 bp, Homo sapiens
tccaagtctccacc

SEQ ID NO: 2338244 - DNA, 22 bp, Homo sapiens
tccaagttgttcgggccaagga

SEQ ID NO: 2338245 - DNA, 22 bp, Homo sapiens
tccaattcccaccactaaaaaa

SEQ ID NO: 2338246 - DNA, 22 bp, Homo sapiens
tccacagagactgtttgaatgt

SEQ ID NO: 2338247 - DNA, 23 bp, Homo sapiens
tccacagagactgtttgaatgtt

SEQ ID NO: 2338248 - DNA, 19 bp, Homo sapiens
tccacagcgagggcagctg

SEQ ID NO: 2338249 - DNA, 22 bp, Homo sapiens
tccacagcgagggcagctgcta

SEQ ID NO: 2338250 - DNA, 17 bp, Homo sapiens
tccacagtgttgtgccc

SEQ ID NO: 2338251 - DNA, 15 bp, Homo sapiens
tccacatctgcctta

SEQ ID NO: 2338252 - DNA, 17 bp, Homo sapiens
tccaccaggccgtgcct

SEQ ID NO: 2338253 - DNA, 18 bp, Homo sapiens
tccaccccaagagaactc

SEQ ID NO: 2338254 - DNA, 15 bp, Homo sapiens
tccacctccacccac

SEQ ID NO: 2338255 - DNA, 12 bp, Homo sapiens
tccacctgcctt

SEQ ID NO: 2338256 - DNA, 18 bp, Homo sapiens
tccacctgccttggcctc

SEQ ID NO: 2338257 - DNA, 14 bp, Homo sapiens
tccactaaaaatat

SEQ ID NO: 2338258 - DNA, 16 bp, Homo sapiens
tccactacacctggct

SEQ ID NO: 2338259 - DNA, 17 bp, Homo sapiens
tccactccacctccacc

SEQ ID NO: 2338260 - DNA, 12 bp, Homo sapiens
tccactgctgga

SEQ ID NO: 2338261 - DNA, 15 bp, Homo sapiens
tccactgctggacat

SEQ ID NO: 2338262 - DNA, 16 bp, Homo sapiens
tccactgtgctttcag

SEQ ID NO: 2338263 - DNA, 22 bp, Homo sapiens
tccactgttgagccccagtgct

SEQ ID NO: 2338264 - DNA, 20 bp, Homo sapiens
tccagataactctctttcct

SEQ ID NO: 2338265 - DNA, 15 bp, Homo sapiens
tccagatcactgcca

SEQ ID NO: 2338266 - DNA, 17 bp, Homo sapiens
tccagattctgatgcat

SEQ ID NO: 2338267 - DNA, 19 bp, Homo sapiens
tccagcaacttcttctcca

SEQ ID NO: 2338268 - DNA, 19 bp, Homo sapiens
tccagcctggggctgaggc

SEQ ID NO: 2338269 - DNA, 11 bp, Homo sapiens
tccagctggcc

SEQ ID NO: 2338270 - DNA, 12 bp, Homo sapiens
tccagctggcct

SEQ ID NO: 2338271 - DNA, 17 bp, Homo sapiens
tccagctggcctggaca

SEQ ID NO: 2338272 - DNA, 18 bp, Homo sapiens
tccagctggggccagagg

SEQ ID NO: 2338273 - DNA, 22 bp, Homo sapiens
tccagctggggccagaggctgg

SEQ ID NO: 2338274 - DNA, 13 bp, Homo sapiens
tccagcttccaaa

SEQ ID NO: 2338275 - DNA, 16 bp, Homo sapiens
tccagctttctgccat

SEQ ID NO: 2338276 - DNA, 21 bp, Homo sapiens
tccaggaaactccacatctgc

SEQ ID NO: 2338277 - DNA, 21 bp, Homo sapiens
tccaggaaagagcagtcagag

SEQ ID NO: 2338278 - DNA, 19 bp, Homo sapiens
tccaggcaccctcagggag

SEQ ID NO: 2338279 - DNA, 22 bp, Homo sapiens
tccaggcaccctcagggagcct

SEQ ID NO: 2338280 - DNA, 18 bp, Homo sapiens
tccaggcagctccctcct

SEQ ID NO: 2338281 - DNA, 12 bp, Homo sapiens
tccaggctccag

SEQ ID NO: 2338282 - DNA, 23 bp, Homo sapiens
tccaggcttctgctggggcctgg

SEQ ID NO: 2338283 - DNA, 19 bp, Homo sapiens
tccagggaaggtggccaca

SEQ ID NO: 2338284 - DNA, 19 bp, Homo sapiens
tccagggaatccaagcctc

SEQ ID NO: 2338285 - DNA, 15 bp, Homo sapiens
tccagggtttctctg

SEQ ID NO: 2338286 - DNA, 20 bp, Homo sapiens
tccaggtgattctgtttcct

SEQ ID NO: 2338287 - DNA, 23 bp, Homo sapiens
tccagtcatctgtaagagcttgc

SEQ ID NO: 2338288 - DNA, 18 bp, Homo sapiens
tccagtgaacattcccag

SEQ ID NO: 2338289 - DNA, 15 bp, Homo sapiens
tccagtgctctgcct

SEQ ID NO: 2338290 - DNA, 13 bp, Homo sapiens
tccagtggactct

SEQ ID NO: 2338291 - DNA, 21 bp, Homo sapiens
tccagttgaagttagtggaaa

SEQ ID NO: 2338292 - DNA, 17 bp, Homo sapiens
tccagtttgtcttggat

SEQ ID NO: 2338293 - DNA, 13 bp, Homo sapiens
tccataaagtaca

SEQ ID NO: 2338294 - DNA, 18 bp, Homo sapiens
tccatacacagaggagtg

SEQ ID NO: 2338295 - DNA, 22 bp, Homo sapiens
tccatacactttgttgcaagat

SEQ ID NO: 2338296 - DNA, 18 bp, Homo sapiens
tccatagagatgagccca

SEQ ID NO: 2338297 - DNA, 20 bp, Homo sapiens
tccatagagatgagcccacc

SEQ ID NO: 2338298 - DNA, 17 bp, Homo sapiens
tccatcaccctcttcct

SEQ ID NO: 2338299 - DNA, 23 bp, Homo sapiens
tccatcaccctcttcctgtgatc

SEQ ID NO: 2338300 - DNA, 12 bp, Homo sapiens
tccatccatcct

SEQ ID NO: 2338301 - DNA, 17 bp, Homo sapiens
tccatccatccttccaa

SEQ ID NO: 2338302 - DNA, 12 bp, Homo sapiens
tccatccatctt

SEQ ID NO: 2338303 - DNA, 16 bp, Homo sapiens
tccatccatctttcca

SEQ ID NO: 2338304 - DNA, 21 bp, Homo sapiens
tccatccattacctccatcca

SEQ ID NO: 2338305 - DNA, 15 bp, Homo sapiens
tccatccctctaatg

SEQ ID NO: 2338306 - DNA, 13 bp, Homo sapiens
tccatctcccaag

SEQ ID NO: 2338307 - DNA, 20 bp, Homo sapiens
tccatgacctagttttccat

SEQ ID NO: 2338308 - DNA, 13 bp, Homo sapiens
tccatgagctgct

SEQ ID NO: 2338309 - DNA, 21 bp, Homo sapiens
tccatgccttaaacctacctc

SEQ ID NO: 2338310 - DNA, 19 bp, Homo sapiens
tccatgcgtgtttctgact

SEQ ID NO: 2338311 - DNA, 14 bp, Homo sapiens
tccatggccctgtc

SEQ ID NO: 2338312 - DNA, 18 bp, Homo sapiens
tccatggccctgtcccag

SEQ ID NO: 2338313 - DNA, 16 bp, Homo sapiens
tccatgtcccctccca

SEQ ID NO: 2338314 - DNA, 17 bp, Homo sapiens
tccatgtcccctcccag

SEQ ID NO: 2338315 - DNA, 16 bp, Homo sapiens
tccatgttctattttt

SEQ ID NO: 2338316 - DNA, 21 bp, Homo sapiens
tccattacctccatccatcct

SEQ ID NO: 2338317 - DNA, 21 bp, Homo sapiens
tccattagagagtggcaatag

SEQ ID NO: 2338318 - DNA, 15 bp, Homo sapiens
tccattatgattctt

SEQ ID NO: 2338319 - DNA, 23 bp, Homo sapiens
tccattggatctgcaagaacact

SEQ ID NO: 2338320 - DNA, 17 bp, Homo sapiens
tccattttaattttaaa

SEQ ID NO: 2338321 - DNA, 20 bp, Homo sapiens
tcccaacctctttttcctcc

SEQ ID NO: 2338322 - DNA, 15 bp, Homo sapiens
tcccaaggctgccag

SEQ ID NO: 2338323 - DNA, 18 bp, Homo sapiens
tcccaaggctgccagaca

SEQ ID NO: 2338324 - DNA, 14 bp, Homo sapiens
tcccacactgtgaa

SEQ ID NO: 2338325 - DNA, 22 bp, Homo sapiens
tcccacatccaactccagcaac

SEQ ID NO: 2338326 - DNA, 18 bp, Homo sapiens
tcccacccacatgtgaca

SEQ ID NO: 2338327 - DNA, 22 bp, Homo sapiens
tcccacccacatgtgacacata

SEQ ID NO: 2338328 - DNA, 19 bp, Homo sapiens
tcccaccccaacctgctct

SEQ ID NO: 2338329 - DNA, 20 bp, Homo sapiens
tcccaccccaacctgctctc

SEQ ID NO: 2338330 - DNA, 19 bp, Homo sapiens
tcccaccctgcgggccagg

SEQ ID NO: 2338331 - DNA, 19 bp, Homo sapiens
tcccacctgcatctggggc

SEQ ID NO: 2338332 - DNA, 20 bp, Homo sapiens
tcccacctgcatctggggcc

SEQ ID NO: 2338333 - DNA, 14 bp, Homo sapiens
tcccactccaagcc

SEQ ID NO: 2338334 - DNA, 23 bp, Homo sapiens
tcccagaaacatctctggcccag

SEQ ID NO: 2338335 - DNA, 21 bp, Homo sapiens
tcccagccccggcaagccaca

SEQ ID NO: 2338336 - DNA, 19 bp, Homo sapiens
tcccagctacttgggaggc

SEQ ID NO: 2338337 - DNA, 14 bp, Homo sapiens
tcccagctgcctag

SEQ ID NO: 2338338 - DNA, 20 bp, Homo sapiens
tcccaggggtctccctggct

SEQ ID NO: 2338339 - DNA, 21 bp, Homo sapiens
tcccaggggtctccctggctc

SEQ ID NO: 2338340 - DNA, 22 bp, Homo sapiens
tcccaggggtctccctggctcc

SEQ ID NO: 2338341 - DNA, 20 bp, Homo sapiens
tcccagtgaactcctgccag

SEQ ID NO: 2338342 - DNA, 22 bp, Homo sapiens
tcccagtgaactcctgccaggc

SEQ ID NO: 2338343 - DNA, 19 bp, Homo sapiens
tcccagtgagactgcccca

SEQ ID NO: 2338344 - DNA, 19 bp, Homo sapiens
tcccatctgcaccccttct

SEQ ID NO: 2338345 - DNA, 21 bp, Homo sapiens
tcccatgggggcacttgagtt

SEQ ID NO: 2338346 - DNA, 14 bp, Homo sapiens
tcccattaaaaatg

SEQ ID NO: 2338347 - DNA, 16 bp, Homo sapiens
tcccatttccttgtct

SEQ ID NO: 2338348 - DNA, 18 bp, Homo sapiens
tcccatttccttgtctaa

SEQ ID NO: 2338349 - DNA, 19 bp, Homo sapiens
tcccatttgtgccagagga

SEQ ID NO: 2338350 - DNA, 15 bp, Homo sapiens
tccccacccctgccc

SEQ ID NO: 2338351 - DNA, 11 bp, Homo sapiens
tccccagagag

SEQ ID NO: 2338352 - DNA, 21 bp, Homo sapiens
tccccagagctgcctgctctg

SEQ ID NO: 2338353 - DNA, 18 bp, Homo sapiens
tccccatcgttgccccca

SEQ ID NO: 2338354 - DNA, 16 bp, Homo sapiens
tccccatctccctgcc

SEQ ID NO: 2338355 - DNA, 13 bp, Homo sapiens
tctctatgcctct

SEQ ID NO: 2338356 - DNA, 23 bp, Homo sapiens
tctctattttcataatcagtaaa

SEQ ID NO: 2338357 - DNA, 19 bp, Homo sapiens
tctctcaggccaccacaga

SEQ ID NO: 2338358 - DNA, 16 bp, Homo sapiens
tctctcatgagaagcc

SEQ ID NO: 2338359 - DNA, 14 bp, Homo sapiens
tctctccacagtgt

SEQ ID NO: 2338360 - DNA, 18 bp, Homo sapiens
tctctccacagtgttgtg

SEQ ID NO: 2338361 - DNA, 13 bp, Homo sapiens
tctctccactgtg

SEQ ID NO: 2338362 - DNA, 12 bp, Homo sapiens
tctctcctggcc

SEQ ID NO: 2338363 - DNA, 13 bp, Homo sapiens
tctctcttctagg

SEQ ID NO: 2338364 - DNA, 16 bp, Homo sapiens
tctctcttctcagagt

SEQ ID NO: 2338365 - DNA, 18 bp, Homo sapiens
tctctctttaaccctccc

SEQ ID NO: 2338366 - DNA, 18 bp, Homo sapiens
tctctgacgcttgtgaca

SEQ ID NO: 2338367 - DNA, 16 bp, Homo sapiens
tctctgatgtcccagt

SEQ ID NO: 2338368 - DNA, 17 bp, Homo sapiens
tctctgatgtcccagtg

SEQ ID NO: 2338369 - DNA, 20 bp, Homo sapiens
tctctgcatttaaaaaaatc

SEQ ID NO: 2338370 - DNA, 12 bp, Homo sapiens
tctctgccctgt

SEQ ID NO: 2338371 - DNA, 14 bp, Homo sapiens
tctctgccctgtgt

SEQ ID NO: 2338372 - DNA, 10 bp, Homo sapiens
tctctgctgg

SEQ ID NO: 2338373 - DNA, 11 bp, Homo sapiens
tctctgctggg

SEQ ID NO: 2338374 - DNA, 22 bp, Homo sapiens
tctctgcttactaatgtgcccc

SEQ ID NO: 2338375 - DNA, 14 bp, Homo sapiens
tctctggaaagagg

SEQ ID NO: 2338376 - DNA, 15 bp, Homo sapiens
tctctggcccagaaa

SEQ ID NO: 2338377 - DNA, 18 bp, Homo sapiens
tctctggcccagaaagcc

SEQ ID NO: 2338378 - DNA, 22 bp, Homo sapiens
tctctggcccagaaagcctctc

SEQ ID NO: 2338379 - DNA, 12 bp, Homo sapiens
tctctgttaaca

SEQ ID NO: 2338380 - DNA, 15 bp, Homo sapiens
tctctgttaacatct

SEQ ID NO: 2338381 - DNA, 18 bp, Homo sapiens
tctctgttaacatctagc

SEQ ID NO: 2338382 - DNA, 22 bp, Homo sapiens
tctcttcactaccctgattctt

SEQ ID NO: 2338383 - DNA, 19 bp, Homo sapiens
tctcttctcagagtggtgg

SEQ ID NO: 2338384 - DNA, 17 bp, Homo sapiens
tctcttgagctggcctc

SEQ ID NO: 2338385 - DNA, 13 bp, Homo sapiens
tctcttgccagca

SEQ ID NO: 2338386 - DNA, 22 bp, Homo sapiens
tctctttccttgagctgttgtg

SEQ ID NO: 2338387 - DNA, 19 bp, Homo sapiens
tctctttggaaatagcatg

SEQ ID NO: 2338388 - DNA, 14 bp, Homo sapiens
tctcttttgaaagt

SEQ ID NO: 2338389 - DNA, 12 bp, Homo sapiens
tctctttttgtt

SEQ ID NO: 2338390 - DNA, 15 bp, Homo sapiens
tctgaaaagtgtgta

SEQ ID NO: 2338391 - DNA, 14 bp, Homo sapiens
tctgaactcaaact

SEQ ID NO: 2338392 - DNA, 16 bp, Homo sapiens
tctgaactcaaactga

SEQ ID NO: 2338393 - DNA, 21 bp, Homo sapiens
tctgaactcaaactgaggaat

SEQ ID NO: 2338394 - DNA, 20 bp, Homo sapiens
tctgaagaaggaaggcctga

SEQ ID NO: 2338395 - DNA, 21 bp, Homo sapiens
tctgaagaaggaaggcctgag

SEQ ID NO: 2338396 - DNA, 13 bp, Homo sapiens
tctgacgcttgtg

SEQ ID NO: 2338397 - DNA, 18 bp, Homo sapiens
tctgacgcttgtgacagt

SEQ ID NO: 2338398 - DNA, 17 bp, Homo sapiens
tctgagccacagtggga

SEQ ID NO: 2338399 - DNA, 23 bp, Homo sapiens
tctgaggtgcactgggaggctcc

SEQ ID NO: 2338400 - DNA, 15 bp, Homo sapiens
tctgagtcagagcca

SEQ ID NO: 2338401 - DNA, 20 bp, Homo sapiens
tctgagtcagagccatgtct

SEQ ID NO: 2338402 - DNA, 15 bp, Homo sapiens
tctgatactttagta

SEQ ID NO: 2338403 - DNA, 12 bp, Homo sapiens
tctgatatcagg

SEQ ID NO: 2338404 - DNA, 20 bp, Homo sapiens
tctgatatcaggaaatatct

SEQ ID NO: 2338405 - DNA, 21 bp, Homo sapiens
tctgatgaaaaattgctgact

SEQ ID NO: 2338406 - DNA, 15 bp, Homo sapiens
tctgatggccttaat

SEQ ID NO: 2338407 - DNA, 22 bp, Homo sapiens
tctgatggccttaatttccttt

SEQ ID NO: 2338408 - DNA, 22 bp, Homo sapiens
tctgattgatttgattgggatg

SEQ ID NO: 2338409 - DNA, 17 bp, Homo sapiens
tctgatttgtaacccac

SEQ ID NO: 2338410 - DNA, 17 bp, Homo sapiens
tctgcaacaagcatgca

SEQ ID NO: 2338411 - DNA, 12 bp, Homo sapiens
tctgcacatgtc

SEQ ID NO: 2338412 - DNA, 16 bp, Homo sapiens
tctgcacatgtcttgt

SEQ ID NO: 2338413 - DNA, 20 bp, Homo sapiens
tctgcacatgtcttgtacat

SEQ ID NO: 2338414 - DNA, 22 bp, Homo sapiens
tctgcacatgtcttgtacatgt

SEQ ID NO: 2338415 - DNA, 15 bp, Homo sapiens
tctgcaccccttctc

SEQ ID NO: 2338416 - DNA, 18 bp, Homo sapiens
tctgcaccccttctctcc

SEQ ID NO: 2338417 - DNA, 19 bp, Homo sapiens
tctgcaccccttctctcct

SEQ ID NO: 2338418 - DNA, 20 bp, Homo sapiens
tctgcaccccttctctcctc

SEQ ID NO: 2338419 - DNA, 21 bp, Homo sapiens
tctgcaccccttctctcctcc

SEQ ID NO: 2338420 - DNA, 22 bp, Homo sapiens
tctgcagaatccctttgcacct

SEQ ID NO: 2338421 - DNA, 19 bp, Homo sapiens
tctgcagtcctactcaagc

SEQ ID NO: 2338422 - DNA, 15 bp, Homo sapiens
tctgcatttaaaaaa

SEQ ID NO: 2338423 - DNA, 14 bp, Homo sapiens
tctgccaaacacat

SEQ ID NO: 2338424 - DNA, 15 bp, Homo sapiens
tctgccatcttcagg

SEQ ID NO: 2338425 - DNA, 20 bp, Homo sapiens
tctgcccacgcagaggacgc

SEQ ID NO: 2338426 - DNA, 15 bp, Homo sapiens
tctgccccaccctca

SEQ ID NO: 2338427 - DNA, 20 bp, Homo sapiens
tctgccccaccttgccaggg

SEQ ID NO: 2338428 - DNA, 22 bp, Homo sapiens
tctgccccaccttgccagggca

SEQ ID NO: 2338429 - DNA, 16 bp, Homo sapiens
tctgccccagcccaga

SEQ ID NO: 2338430 - DNA, 20 bp, Homo sapiens
tctgccccagcccagattcc

SEQ ID NO: 2338431 - DNA, 20 bp, Homo sapiens
tctgccccccccccccatct

SEQ ID NO: 2338432 - DNA, 13 bp, Homo sapiens
tctgcccgcagag

SEQ ID NO: 2338433 - DNA, 14 bp, Homo sapiens
tctgcccgcagagc

SEQ ID NO: 2338434 - DNA, 21 bp, Homo sapiens
tctgcccgcagagcccacgcc

SEQ ID NO: 2338435 - DNA, 21 bp, Homo sapiens
tctgccctggctgctgccccc

SEQ ID NO: 2338436 - DNA, 15 bp, Homo sapiens
tctgccctgtgtact

SEQ ID NO: 2338437 - DNA, 22 bp, Homo sapiens
tctgccggacccggaggccgag

SEQ ID NO: 2338438 - DNA, 21 bp, Homo sapiens
tctgccggtgctcggagaaga

SEQ ID NO: 2338439 - DNA, 20 bp, Homo sapiens
tctgcctcagacgttgcctg

SEQ ID NO: 2338440 - DNA, 13 bp, Homo sapiens
tctgcctcgctca

SEQ ID NO: 2338441 - DNA, 12 bp, Homo sapiens
tctgcctgcccc

SEQ ID NO: 2338442 - DNA, 19 bp, Homo sapiens
tctgcggatctcagctttg

SEQ ID NO: 2338443 - DNA, 21 bp, Homo sapiens
tctgctctgccatcttcagga

SEQ ID NO: 2338444 - DNA, 18 bp, Homo sapiens
tctgctgacctgctgacc

SEQ ID NO: 2338445 - DNA, 20 bp, Homo sapiens
tctgctgacctgctgacctg

SEQ ID NO: 2338446 - DNA, 20 bp, Homo sapiens
tctgctgaggcccagtgcat

SEQ ID NO: 2338447 - DNA, 19 bp, Homo sapiens
tctgctggggcctgggaca

SEQ ID NO: 2338448 - DNA, 18 bp, Homo sapiens
tctgctggtatttctaat

SEQ ID NO: 2338449 - DNA, 17 bp, Homo sapiens
tctgctgtcctgtttct

SEQ ID NO: 2338450 - DNA, 22 bp, Homo sapiens
tctgcttttctgccctggctgc

SEQ ID NO: 2338451 - DNA, 23 bp, Homo sapiens
tctggaacatggactttcttgca

SEQ ID NO: 2338452 - DNA, 18 bp, Homo sapiens
tctggaagcccctgggcc

SEQ ID NO: 2338453 - DNA, 15 bp, Homo sapiens
tctggaattgtggct

SEQ ID NO: 2338454 - DNA, 16 bp, Homo sapiens
tctggacagcagaagc

SEQ ID NO: 2338455 - DNA, 16 bp, Homo sapiens
tctggattctgaatct

SEQ ID NO: 2338456 - DNA, 15 bp, Homo sapiens
tctggctttcccagg

SEQ ID NO: 2338457 - DNA, 16 bp, Homo sapiens
tctggctttcccagga

SEQ ID NO: 2338458 - DNA, 12 bp, Homo sapiens
tctggctttgct

SEQ ID NO: 2338459 - DNA, 19 bp, Homo sapiens
tctggctttgctctattaa

SEQ ID NO: 2338460 - DNA, 20 bp, Homo sapiens
tctgggacctgccaggcagg

SEQ ID NO: 2338461 - DNA, 21 bp, Homo sapiens
tctgggacctgccaggcaggg

SEQ ID NO: 2338462 - DNA, 19 bp, Homo sapiens
tctgggatgtcacagtcca

SEQ ID NO: 2338463 - DNA, 22 bp, Homo sapiens
tctgggcattttcctcctctgc

SEQ ID NO: 2338464 - DNA, 19 bp, Homo sapiens
tctggggcaggctgggcca

SEQ ID NO: 2338465 - DNA, 20 bp, Homo sapiens
tctggggcaggctgggccat

SEQ ID NO: 2338466 - DNA, 15 bp, Homo sapiens
tctggggctgtgtta

SEQ ID NO: 2338467 - DNA, 14 bp, Homo sapiens
tctggtggtggcct

SEQ ID NO: 2338468 - DNA, 14 bp, Homo sapiens
tctgtaaactgtgt

SEQ ID NO: 2338469 - DNA, 17 bp, Homo sapiens
tctgtaagtgtagctca

SEQ ID NO: 2338470 - DNA, 15 bp, Homo sapiens
tgagatgtgagcctt

SEQ ID NO: 2338471 - DNA, 17 bp, Homo sapiens
tgagatgtgagccttgt

SEQ ID NO: 2338472 - DNA, 15 bp, Homo sapiens
tgagattggttttcc

SEQ ID NO: 2338473 - DNA, 13 bp, Homo sapiens
tgagattgtgttt

SEQ ID NO: 2338474 - DNA, 21 bp, Homo sapiens
tgagcaccgtgtcaagctgct

SEQ ID NO: 2338475 - DNA, 22 bp, Homo sapiens
tgagcaccgtgtcaagctgctc

SEQ ID NO: 2338476 - DNA, 13 bp, Homo sapiens
tgagcagaacagg

SEQ ID NO: 2338477 - DNA, 15 bp, Homo sapiens
tgagcagcctctgga

SEQ ID NO: 2338478 - DNA, 21 bp, Homo sapiens
tgagcagcctctggacagcca

SEQ ID NO: 2338479 - DNA, 16 bp, Homo sapiens
tgagcaggctgtgggg

SEQ ID NO: 2338480 - DNA, 18 bp, Homo sapiens
tgagcatctgtccccctt

SEQ ID NO: 2338481 - DNA, 19 bp, Homo sapiens
tgagcatgacagcctgcag

SEQ ID NO: 2338482 - DNA, 18 bp, Homo sapiens
tgagccaccgtgcctggc

SEQ ID NO: 2338483 - DNA, 20 bp, Homo sapiens
tgagccaccgtgcctggcca

SEQ ID NO: 2338484 - DNA, 23 bp, Homo sapiens
tgagccaccgtgcctggccagat

SEQ ID NO: 2338485 - DNA, 14 bp, Homo sapiens
tgagccagacaaat

SEQ ID NO: 2338486 - DNA, 16 bp, Homo sapiens
tgagccagcttagcaa

SEQ ID NO: 2338487 - DNA, 12 bp, Homo sapiens
tgagccccacag

SEQ ID NO: 2338488 - DNA, 17 bp, Homo sapiens
tgagccccacagccctg

SEQ ID NO: 2338489 - DNA, 17 bp, Homo sapiens
tgagccccagtgctgga

SEQ ID NO: 2338490 - DNA, 20 bp, Homo sapiens
tgagccctactccctgcaga

SEQ ID NO: 2338491 - DNA, 17 bp, Homo sapiens
tgagcctcctgtgcctg

SEQ ID NO: 2338492 - DNA, 13 bp, Homo sapiens
tgagcgccacctc

SEQ ID NO: 2338493 - DNA, 15 bp, Homo sapiens
tgagctattttcctc

SEQ ID NO: 2338494 - DNA, 16 bp, Homo sapiens
tgagctattttcctct

SEQ ID NO: 2338495 - DNA, 24 bp, Homo sapiens
tgagctattttcctctggccgcag

SEQ ID NO: 2338496 - DNA, 22 bp, Homo sapiens
tgagctcctgtcccctgctaca

SEQ ID NO: 2338497 - DNA, 12 bp, Homo sapiens
tgagctgccttc

SEQ ID NO: 2338498 - DNA, 20 bp, Homo sapiens
tgagctggatagacttggga

SEQ ID NO: 2338499 - DNA, 21 bp, Homo sapiens
tgagctggcctctctagcaca

SEQ ID NO: 2338500 - DNA, 20 bp, Homo sapiens
tgagctttgaagtaggtggc

SEQ ID NO: 2338501 - DNA, 15 bp, Homo sapiens
tgaggacttcaagcc

SEQ ID NO: 2338502 - DNA, 12 bp, Homo sapiens
tgaggaggggag

SEQ ID NO: 2338503 - DNA, 20 bp, Homo sapiens
tgaggaggggagcgtctggg

SEQ ID NO: 2338504 - DNA, 16 bp, Homo sapiens
tgaggaggggagggta

SEQ ID NO: 2338505 - DNA, 22 bp, Homo sapiens
tgaggaggggcccccctgccct

SEQ ID NO: 2338506 - DNA, 16 bp, Homo sapiens
tgaggagtaaaattca

SEQ ID NO: 2338507 - DNA, 23 bp, Homo sapiens
tgaggatgacagtgacacccaga

SEQ ID NO: 2338508 - DNA, 18 bp, Homo sapiens
tgaggatgggtcagagct

SEQ ID NO: 2338509 - DNA, 13 bp, Homo sapiens
tgaggccagagtc

SEQ ID NO: 2338510 - DNA, 14 bp, Homo sapiens
tgaggccagagtca

SEQ ID NO: 2338511 - DNA, 12 bp, Homo sapiens
tgaggcccagcc

SEQ ID NO: 2338512 - DNA, 15 bp, Homo sapiens
tgaggcccagcctgt

SEQ ID NO: 2338513 - DNA, 19 bp, Homo sapiens
tgaggcccagcctgtcctg

SEQ ID NO: 2338514 - DNA, 14 bp, Homo sapiens
tgaggccctgggct

SEQ ID NO: 2338515 - DNA, 16 bp, Homo sapiens
tgaggccctgggctgg

SEQ ID NO: 2338516 - DNA, 21 bp, Homo sapiens
tgaggccctgggctgggtgct

SEQ ID NO: 2338517 - DNA, 14 bp, Homo sapiens
tgaggcggaggctg

SEQ ID NO: 2338518 - DNA, 15 bp, Homo sapiens
tgaggcggaggctgt

SEQ ID NO: 2338519 - DNA, 16 bp, Homo sapiens
tgaggcggaggctgtg

SEQ ID NO: 2338520 - DNA, 13 bp, Homo sapiens
tgaggcttagaga

SEQ ID NO: 2338521 - DNA, 15 bp, Homo sapiens
tgagggaagcgaagg

SEQ ID NO: 2338522 - DNA, 13 bp, Homo sapiens
tgagggcctgctg

SEQ ID NO: 2338523 - DNA, 15 bp, Homo sapiens
tgagggcctgctgga

SEQ ID NO: 2338524 - DNA, 20 bp, Homo sapiens
tgagggcctgctggaggcct

SEQ ID NO: 2338525 - DNA, 21 bp, Homo sapiens
tgagggcctgctggaggcctc

SEQ ID NO: 2338526 - DNA, 20 bp, Homo sapiens
tgaggtgcaaggagtgtaaa

SEQ ID NO: 2338527 - DNA, 19 bp, Homo sapiens
tgaggtgcactgggaggct

SEQ ID NO: 2338528 - DNA, 22 bp, Homo sapiens
tgaggtgggaggtggaagaagg

SEQ ID NO: 2338529 - DNA, 14 bp, Homo sapiens
tgaggttcctctgc

SEQ ID NO: 2338530 - DNA, 17 bp, Homo sapiens
tgaggttcctctgcctg

SEQ ID NO: 2338531 - DNA, 16 bp, Homo sapiens
tgaggttgaggaatat

SEQ ID NO: 2338532 - DNA, 22 bp, Homo sapiens
tgagtaccaaatccacaagcca

SEQ ID NO: 2338533 - DNA, 18 bp, Homo sapiens
tgagtattccatgagctg

SEQ ID NO: 2338534 - DNA, 12 bp, Homo sapiens
tgagtattgttt

SEQ ID NO: 2338535 - DNA, 18 bp, Homo sapiens
tgagtccttgatttcaaa

SEQ ID NO: 2338536 - DNA, 19 bp, Homo sapiens
tgagtcgtacagaaagctg

SEQ ID NO: 2338537 - DNA, 14 bp, Homo sapiens
tgagtgacagcttt

SEQ ID NO: 2338538 - DNA, 23 bp, Homo sapiens
tgagtgacagctttctgggatgt

SEQ ID NO: 2338539 - DNA, 21 bp, Homo sapiens
tgagttatcatgaattttaaa

SEQ ID NO: 2338540 - DNA, 16 bp, Homo sapiens
tgagttccagttgaag

SEQ ID NO: 2338541 - DNA, 17 bp, Homo sapiens
tgagttgaaatgttctg

SEQ ID NO: 2338542 - DNA, 16 bp, Homo sapiens
tgagtttgagctgcct

SEQ ID NO: 2338543 - DNA, 14 bp, Homo sapiens
tgagtttttcctcc

SEQ ID NO: 2338544 - DNA, 18 bp, Homo sapiens
tgataaaccaaaaacatt

SEQ ID NO: 2338545 - DNA, 17 bp, Homo sapiens
tgataaactcagatctg

SEQ ID NO: 2338546 - DNA, 13 bp, Homo sapiens
tgataatgttaaa

SEQ ID NO: 2338547 - DNA, 21 bp, Homo sapiens
tgataatgttaaatttgtaag

SEQ ID NO: 2338548 - DNA, 21 bp, Homo sapiens
tgataccccgtctctactaaa

SEQ ID NO: 2338549 - DNA, 23 bp, Homo sapiens
tgatactttagtacaatttcaac

SEQ ID NO: 2338550 - DNA, 20 bp, Homo sapiens
tgatataccaaattaaaaaa

SEQ ID NO: 2338551 - DNA, 13 bp, Homo sapiens
tgatatattttac

SEQ ID NO: 2338552 - DNA, 15 bp, Homo sapiens
tgatatggcagaaga

SEQ ID NO: 2338553 - DNA, 16 bp, Homo sapiens
tgatatggcagaagac

SEQ ID NO: 2338554 - DNA, 18 bp, Homo sapiens
tgatatggcagaagacac

SEQ ID NO: 2338555 - DNA, 16 bp, Homo sapiens
tgatattatttcttct

SEQ ID NO: 2338556 - DNA, 24 bp, Homo sapiens
tgatattatttcttctcttatcct

SEQ ID NO: 2338557 - DNA, 17 bp, Homo sapiens
tgatattttctgtgcct

SEQ ID NO: 2338558 - DNA, 14 bp, Homo sapiens
tgatcaagagtccg

SEQ ID NO: 2338559 - DNA, 19 bp, Homo sapiens
tgatcaccgactgaaaata

SEQ ID NO: 2338560 - DNA, 22 bp, Homo sapiens
tgatcatagctcactgcagcct

SEQ ID NO: 2338561 - DNA, 21 bp, Homo sapiens
tgatcattacatggctgtggt

SEQ ID NO: 2338562 - DNA, 14 bp, Homo sapiens
tgatccaactaatg

SEQ ID NO: 2338563 - DNA, 15 bp, Homo sapiens
tgatccacccaaccc

SEQ ID NO: 2338564 - DNA, 16 bp, Homo sapiens
tgatccacccaaccct

SEQ ID NO: 2338565 - DNA, 17 bp, Homo sapiens
tgatcccttgagatatg

SEQ ID NO: 2338566 - DNA, 16 bp, Homo sapiens
tgatctgctctgtttt

SEQ ID NO: 2338567 - DNA, 21 bp, Homo sapiens
tgatctgttgtaatatcagtt

SEQ ID NO: 2338568 - DNA, 13 bp, Homo sapiens
tgatcttaaaata

SEQ ID NO: 2338569 - DNA, 13 bp, Homo sapiens
tgatcttttaaaa

SEQ ID NO: 2338570 - DNA, 13 bp, Homo sapiens
tgatgactgcctt

SEQ ID NO: 2338571 - DNA, 14 bp, Homo sapiens
tgatgagcagactt

SEQ ID NO: 2338572 - DNA, 21 bp, Homo sapiens
tgatgattttcatttcatgaa

SEQ ID NO: 2338573 - DNA, 16 bp, Homo sapiens
tgatggacactccagg

SEQ ID NO: 2338574 - DNA, 19 bp, Homo sapiens
tgatggacactccagggac

SEQ ID NO: 2338575 - DNA, 20 bp, Homo sapiens
tgatggagggtggaaataat

SEQ ID NO: 2338576 - DNA, 14 bp, Homo sapiens
tgatggccagcccc

SEQ ID NO: 2338577 - DNA, 15 bp, Homo sapiens
tgatggccagcccct

SEQ ID NO: 2338578 - DNA, 18 bp, Homo sapiens
tgatggccttaatttcct

SEQ ID NO: 2338579 - DNA, 20 bp, Homo sapiens
tgatggccttaatttccttt

SEQ ID NO: 2338580 - DNA, 18 bp, Homo sapiens
tgatggctcaagacaagg

SEQ ID NO: 2338581 - DNA, 21 bp, Homo sapiens
tgatggctcaagacaaggctg

SEQ ID NO: 2338582 - DNA, 15 bp, Homo sapiens
tgatgtcagccttgc

SEQ ID NO: 2338583 - DNA, 18 bp, Homo sapiens
tgatgtgaagagtttcac

SEQ ID NO: 2338584 - DNA, 19 bp, Homo sapiens
tgatgtgaagagtttcaca

SEQ ID NO: 2338585 - DNA, 19 bp, Homo sapiens
tgctggacatgagatggag

SEQ ID NO: 2338586 - DNA, 17 bp, Homo sapiens
tgctggaggcctcaggt

SEQ ID NO: 2338587 - DNA, 13 bp, Homo sapiens
tgctggccaaata

SEQ ID NO: 2338588 - DNA, 22 bp, Homo sapiens
tgctggccatgaatctctgcct

SEQ ID NO: 2338589 - DNA, 14 bp, Homo sapiens
tgctggccccagcc

SEQ ID NO: 2338590 - DNA, 16 bp, Homo sapiens
tgctggccccagccct

SEQ ID NO: 2338591 - DNA, 22 bp, Homo sapiens
tgctggccccagccctgctggg

SEQ ID NO: 2338592 - DNA, 18 bp, Homo sapiens
tgctggccgacccactga

SEQ ID NO: 2338593 - DNA, 16 bp, Homo sapiens
tgctggcggcgcagag

SEQ ID NO: 2338594 - DNA, 16 bp, Homo sapiens
tgctgggaagggaggg

SEQ ID NO: 2338595 - DNA, 17 bp, Homo sapiens
tgctgggaggagggaga

SEQ ID NO: 2338596 - DNA, 14 bp, Homo sapiens
tgctgggcggctgt

SEQ ID NO: 2338597 - DNA, 13 bp, Homo sapiens
tgctgggctctgc

SEQ ID NO: 2338598 - DNA, 14 bp, Homo sapiens
tgctggggcctggg

SEQ ID NO: 2338599 - DNA, 23 bp, Homo sapiens
tgctggggcctgggacaactgct

SEQ ID NO: 2338600 - DNA, 21 bp, Homo sapiens
tgctgtaactcagacattcca

SEQ ID NO: 2338601 - DNA, 14 bp, Homo sapiens
tgctgtacaaaagc

SEQ ID NO: 2338602 - DNA, 14 bp, Homo sapiens
tgctgtatgtgagc

SEQ ID NO: 2338603 - DNA, 15 bp, Homo sapiens
tgctgtccaggcagc

SEQ ID NO: 2338604 - DNA, 14 bp, Homo sapiens
tgctgtccagtgcc

SEQ ID NO: 2338605 - DNA, 17 bp, Homo sapiens
tgctgtccggcctggga

SEQ ID NO: 2338606 - DNA, 21 bp, Homo sapiens
tgctgtcctgtttctgtcaag

SEQ ID NO: 2338607 - DNA, 22 bp, Homo sapiens
tgctgtgaaccctggggcctga

SEQ ID NO: 2338608 - DNA, 23 bp, Homo sapiens
tgctgtgagggaggggaaaagca

SEQ ID NO: 2338609 - DNA, 23 bp, Homo sapiens
tgctgtgcctcgcatcctatgct

SEQ ID NO: 2338610 - DNA, 16 bp, Homo sapiens
tgctgttgtgaagcta

SEQ ID NO: 2338611 - DNA, 22 bp, Homo sapiens
tgctgttgtgaagctaatgtca

SEQ ID NO: 2338612 - DNA, 14 bp, Homo sapiens
tgctgttgttctcg

SEQ ID NO: 2338613 - DNA, 12 bp, Homo sapiens
tgctgtttctaa

SEQ ID NO: 2338614 - DNA, 23 bp, Homo sapiens
tgctgtttctaagaaaatgtagt

SEQ ID NO: 2338615 - DNA, 15 bp, Homo sapiens
tgcttaaatttcaga

SEQ ID NO: 2338616 - DNA, 22 bp, Homo sapiens
tgcttaaatttcttatgtgaca

SEQ ID NO: 2338617 - DNA, 20 bp, Homo sapiens
tgcttaataaaagaacatgc

SEQ ID NO: 2338618 - DNA, 23 bp, Homo sapiens
tgcttaataaaagaacatgcttg

SEQ ID NO: 2338619 - DNA, 14 bp, Homo sapiens
tgcttaatcttcaa

SEQ ID NO: 2338620 - DNA, 14 bp, Homo sapiens
tgcttactgatata

SEQ ID NO: 2338621 - DNA, 20 bp, Homo sapiens
tgcttcacagtagagccagc

SEQ ID NO: 2338622 - DNA, 21 bp, Homo sapiens
tgcttcacagtagagccagct

SEQ ID NO: 2338623 - DNA, 22 bp, Homo sapiens
tgcttcacagtagagccagctt

SEQ ID NO: 2338624 - DNA, 19 bp, Homo sapiens
tgcttcattattcaagaat

SEQ ID NO: 2338625 - DNA, 15 bp, Homo sapiens
tgcttcccttacttt

SEQ ID NO: 2338626 - DNA, 15 bp, Homo sapiens
tgcttctctccttgc

SEQ ID NO: 2338627 - DNA, 16 bp, Homo sapiens
tgcttctgtatttcct

SEQ ID NO: 2338628 - DNA, 20 bp, Homo sapiens
tgcttctgtatttccttgga

SEQ ID NO: 2338629 - DNA, 19 bp, Homo sapiens
tgcttctttgcctccctca

SEQ ID NO: 2338630 - DNA, 12 bp, Homo sapiens
tgcttgattttt

SEQ ID NO: 2338631 - DNA, 16 bp, Homo sapiens
tgcttgcataagagct

SEQ ID NO: 2338632 - DNA, 18 bp, Homo sapiens
tgcttgccaaagtacaga

SEQ ID NO: 2338633 - DNA, 17 bp, Homo sapiens
tgcttgcggcaaaagga

SEQ ID NO: 2338634 - DNA, 17 bp, Homo sapiens
tgcttggaacatactgt

SEQ ID NO: 2338635 - DNA, 15 bp, Homo sapiens
tgcttggtctgtttg

SEQ ID NO: 2338636 - DNA, 20 bp, Homo sapiens
tgctttagtacaatagtata

SEQ ID NO: 2338637 - DNA, 17 bp, Homo sapiens
tgctttattaatgtttt

SEQ ID NO: 2338638 - DNA, 20 bp, Homo sapiens
tgctttattaatgttttcaa

SEQ ID NO: 2338639 - DNA, 23 bp, Homo sapiens
tgctttattaatgttttcaaaag

SEQ ID NO: 2338640 - DNA, 11 bp, Homo sapiens
tgctttcacat

SEQ ID NO: 2338641 - DNA, 16 bp, Homo sapiens
tgctttcagaagtgcc

SEQ ID NO: 2338642 - DNA, 18 bp, Homo sapiens
tgctttgaataaatgtgt

SEQ ID NO: 2338643 - DNA, 19 bp, Homo sapiens
tgctttggggggtgtgctg

SEQ ID NO: 2338644 - DNA, 14 bp, Homo sapiens
tgcttttccatata

SEQ ID NO: 2338645 - DNA, 16 bp, Homo sapiens
tgcttttctgccctgg

SEQ ID NO: 2338646 - DNA, 18 bp, Homo sapiens
tgcttttctgccctggct

SEQ ID NO: 2338647 - DNA, 13 bp, Homo sapiens
tgctttttggaaa

SEQ ID NO: 2338648 - DNA, 19 bp, Homo sapiens
tgcttttttccaaaacaaa

SEQ ID NO: 2338649 - DNA, 20 bp, Homo sapiens
tgcttttttccaaaacaaaa

SEQ ID NO: 2338650 - DNA, 22 bp, Homo sapiens
tggaaaaaactctgaaggagag

SEQ ID NO: 2338651 - DNA, 12 bp, Homo sapiens
tggaaaagacag

SEQ ID NO: 2338652 - DNA, 16 bp, Homo sapiens
tggaaaaggaagacta

SEQ ID NO: 2338653 - DNA, 16 bp, Homo sapiens
tggaaaagtgtccttc

SEQ ID NO: 2338654 - DNA, 15 bp, Homo sapiens
tggaaaattttctcc

SEQ ID NO: 2338655 - DNA, 19 bp, Homo sapiens
tggaaaattttctccttgg

SEQ ID NO: 2338656 - DNA, 15 bp, Homo sapiens
tggaaacttttgtta

SEQ ID NO: 2338657 - DNA, 14 bp, Homo sapiens
tggaaaggggagag

SEQ ID NO: 2338658 - DNA, 16 bp, Homo sapiens
tggaaataatttgaat

SEQ ID NO: 2338659 - DNA, 12 bp, Homo sapiens
tggaaatgtctg

SEQ ID NO: 2338660 - DNA, 15 bp, Homo sapiens
tggaaatgtctgctg

SEQ ID NO: 2338661 - DNA, 18 bp, Homo sapiens
tggaaatgtctgctggta

SEQ ID NO: 2338662 - DNA, 19 bp, Homo sapiens
tggaaattcctgtactgtg

SEQ ID NO: 2338663 - DNA, 22 bp, Homo sapiens
tggaaattcctgtactgtgtct

SEQ ID NO: 2338664 - DNA, 16 bp, Homo sapiens
tggaacatactgttca

SEQ ID NO: 2338665 - DNA, 17 bp, Homo sapiens
tggaaccacattgaaga

SEQ ID NO: 2338666 - DNA, 12 bp, Homo sapiens
tggaaccagccc

SEQ ID NO: 2338667 - DNA, 15 bp, Homo sapiens
tggaaccagccccat

SEQ ID NO: 2338668 - DNA, 13 bp, Homo sapiens
tggaagaaagtaa

SEQ ID NO: 2338669 - DNA, 12 bp, Homo sapiens
tggaagaaggga

SEQ ID NO: 2338670 - DNA, 15 bp, Homo sapiens
tggaagaagggagaa

SEQ ID NO: 2338671 - DNA, 13 bp, Homo sapiens
tggaagagaggca

SEQ ID NO: 2338672 - DNA, 15 bp, Homo sapiens
tggaagagaggcacc

SEQ ID NO: 2338673 - DNA, 20 bp, Homo sapiens
tggaagagaggcacctgctg

SEQ ID NO: 2338674 - DNA, 17 bp, Homo sapiens
tggaagagcccagtctg

SEQ ID NO: 2338675 - DNA, 21 bp, Homo sapiens
tggaagagcccagtctgttga

SEQ ID NO: 2338676 - DNA, 20 bp, Homo sapiens
tggaagcccctgggcccagt

SEQ ID NO: 2338677 - DNA, 17 bp, Homo sapiens
tggaagctgtttggaaa

SEQ ID NO: 2338678 - DNA, 18 bp, Homo sapiens
tggaagctgtttggaaaa

SEQ ID NO: 2338679 - DNA, 20 bp, Homo sapiens
tggaagctgtttggaaaaga

SEQ ID NO: 2338680 - DNA, 19 bp, Homo sapiens
tggaaggatctgctgaggc

SEQ ID NO: 2338681 - DNA, 20 bp, Homo sapiens
tggaaggatctgctgaggcc

SEQ ID NO: 2338682 - DNA, 21 bp, Homo sapiens
tggaaggatctgctgaggccc

SEQ ID NO: 2338683 - DNA, 15 bp, Homo sapiens
tggaaggcagagaaa

SEQ ID NO: 2338684 - DNA, 18 bp, Homo sapiens
tggaagggcgttctaggt

SEQ ID NO: 2338685 - DNA, 21 bp, Homo sapiens
tggaagggcgttctaggtagg

SEQ ID NO: 2338686 - DNA, 15 bp, Homo sapiens
tggaataaaaggctt

SEQ ID NO: 2338687 - DNA, 22 bp, Homo sapiens
tggaataaaaggcttgaagctg

SEQ ID NO: 2338688 - DNA, 15 bp, Homo sapiens
tggaatacagtcatt

SEQ ID NO: 2338689 - DNA, 16 bp, Homo sapiens
tggaatacagtcattc

SEQ ID NO: 2338690 - DNA, 16 bp, Homo sapiens
tggaatctacaagcca

SEQ ID NO: 2338691 - DNA, 13 bp, Homo sapiens
tggaatgccttgg

SEQ ID NO: 2338692 - DNA, 13 bp, Homo sapiens
tggaatggaaaag

SEQ ID NO: 2338693 - DNA, 23 bp, Homo sapiens
tggaatgtttttccctccccaga

SEQ ID NO: 2338694 - DNA, 18 bp, Homo sapiens
tggaattgactgcctatg

SEQ ID NO: 2338695 - DNA, 20 bp, Homo sapiens
tggacacattggaatgcctt

SEQ ID NO: 2338696 - DNA, 15 bp, Homo sapiens
tggacacgagccaca

SEQ ID NO: 2338697 - DNA, 16 bp, Homo sapiens
tggacacgagccacaa

SEQ ID NO: 2338698 - DNA, 22 bp, Homo sapiens
tggacactccagggacacacag

SEQ ID NO: 2338699 - DNA, 14 bp, Homo sapiens
tggacagcagaagc

SEQ ID NO: 2338700 - DNA, 19 bp, Homo sapiens
tgtgaatttttaagctgca

SEQ ID NO: 2338701 - DNA, 22 bp, Homo sapiens
tgtgaatttttaagctgcaaat

SEQ ID NO: 2338702 - DNA, 14 bp, Homo sapiens
tgtgacagtgcctc

SEQ ID NO: 2338703 - DNA, 15 bp, Homo sapiens
tgtgacagtttccaa

SEQ ID NO: 2338704 - DNA, 17 bp, Homo sapiens
tgtgacagtttccaaat

SEQ ID NO: 2338705 - DNA, 21 bp, Homo sapiens
tgtgacagtttccaaattgcc

SEQ ID NO: 2338706 - DNA, 17 bp, Homo sapiens
tgtgacatggtgcctga

SEQ ID NO: 2338707 - DNA, 18 bp, Homo sapiens
tgtgacatggtgcctgag

SEQ ID NO: 2338708 - DNA, 20 bp, Homo sapiens
tgtgacatggtgcctgagag

SEQ ID NO: 2338709 - DNA, 22 bp, Homo sapiens
tgtgacatttggagagggggcc

SEQ ID NO: 2338710 - DNA, 18 bp, Homo sapiens
tgtgactattcatggcta

SEQ ID NO: 2338711 - DNA, 16 bp, Homo sapiens
tgtgagatggttccca

SEQ ID NO: 2338712 - DNA, 18 bp, Homo sapiens
tgtgagctggatagactt

SEQ ID NO: 2338713 - DNA, 16 bp, Homo sapiens
tgtgagctttgaagta

SEQ ID NO: 2338714 - DNA, 15 bp, Homo sapiens
tgtgagggtgctgac

SEQ ID NO: 2338715 - DNA, 18 bp, Homo sapiens
tgtgataacagagtgatt

SEQ ID NO: 2338716 - DNA, 13 bp, Homo sapiens
tgtgatcttaaaa

SEQ ID NO: 2338717 - DNA, 14 bp, Homo sapiens
tgtgatgagctgat

SEQ ID NO: 2338718 - DNA, 14 bp, Homo sapiens
tgtgattcaatctg

SEQ ID NO: 2338719 - DNA, 15 bp, Homo sapiens
tgtgattcaatctgt

SEQ ID NO: 2338720 - DNA, 19 bp, Homo sapiens
tgtgatttctttaaaagaa

SEQ ID NO: 2338721 - DNA, 21 bp, Homo sapiens
tgtgatttctttaaaagaatg

SEQ ID NO: 2338722 - DNA, 18 bp, Homo sapiens
tgtgcaaggtggcctttg

SEQ ID NO: 2338723 - DNA, 20 bp, Homo sapiens
tgtgccagaggaatcctggc

SEQ ID NO: 2338724 - DNA, 17 bp, Homo sapiens
tgtgccatggatctgat

SEQ ID NO: 2338725 - DNA, 22 bp, Homo sapiens
tgtgccccctcccaccctgcgg

SEQ ID NO: 2338726 - DNA, 16 bp, Homo sapiens
tgtgcctggccccagc

SEQ ID NO: 2338727 - DNA, 22 bp, Homo sapiens
tgtgcctggccccagcctgggc

SEQ ID NO: 2338728 - DNA, 20 bp, Homo sapiens
tgtgctatactgcatacttt

SEQ ID NO: 2338729 - DNA, 20 bp, Homo sapiens
tgtgctcccctgccacactg

SEQ ID NO: 2338730 - DNA, 23 bp, Homo sapiens
tgtgctcccctgccacactgatg

SEQ ID NO: 2338731 - DNA, 22 bp, Homo sapiens
tgtgctgacaacttagctcagg

SEQ ID NO: 2338732 - DNA, 20 bp, Homo sapiens
tgtgctgcgcctgcaggcag

SEQ ID NO: 2338733 - DNA, 22 bp, Homo sapiens
tgtgctgcgcctgcaggcagag

SEQ ID NO: 2338734 - DNA, 13 bp, Homo sapiens
tgtgctgcttctc

SEQ ID NO: 2338735 - DNA, 15 bp, Homo sapiens
tgtgcttcacagtag

SEQ ID NO: 2338736 - DNA, 23 bp, Homo sapiens
tgtgcttcacagtagagccagct

SEQ ID NO: 2338737 - DNA, 15 bp, Homo sapiens
tgtgcttcctcctgc

SEQ ID NO: 2338738 - DNA, 17 bp, Homo sapiens
tgtgcttgaaggccctg

SEQ ID NO: 2338739 - DNA, 21 bp, Homo sapiens
tgtggaaggaaaatatttcat

SEQ ID NO: 2338740 - DNA, 19 bp, Homo sapiens
tgtggagaccctgccacag

SEQ ID NO: 2338741 - DNA, 22 bp, Homo sapiens
tgtggagaccctgccacagcca

SEQ ID NO: 2338742 - DNA, 16 bp, Homo sapiens
tgtggaggaagagcca

SEQ ID NO: 2338743 - DNA, 20 bp, Homo sapiens
tgtggaggaagagccacctg

SEQ ID NO: 2338744 - DNA, 23 bp, Homo sapiens
tgtggaggaagagccacctgcaa

SEQ ID NO: 2338745 - DNA, 17 bp, Homo sapiens
tgtggaggaaggattgt

SEQ ID NO: 2338746 - DNA, 20 bp, Homo sapiens
tgtggaggaaggattgtaaa

SEQ ID NO: 2338747 - DNA, 18 bp, Homo sapiens
tgtggagttcaccttgga

SEQ ID NO: 2338748 - DNA, 22 bp, Homo sapiens
tgtggagttcaccttggaaggg

SEQ ID NO: 2338749 - DNA, 20 bp, Homo sapiens
tgtggataagaaaaatgctt

SEQ ID NO: 2338750 - DNA, 17 bp, Homo sapiens
tgtggcaatctgtgggc

SEQ ID NO: 2338751 - DNA, 15 bp, Homo sapiens
tgtggcatttccaaa

SEQ ID NO: 2338752 - DNA, 22 bp, Homo sapiens
tgtggcctcaagcaatccacct

SEQ ID NO: 2338753 - DNA, 14 bp, Homo sapiens
tgtggctccaggcc

SEQ ID NO: 2338754 - DNA, 17 bp, Homo sapiens
tgtggctccaggccaaa

SEQ ID NO: 2338755 - DNA, 17 bp, Homo sapiens
tgtggctggctctacct

SEQ ID NO: 2338756 - DNA, 13 bp, Homo sapiens
tgtggctttccag

SEQ ID NO: 2338757 - DNA, 12 bp, Homo sapiens
tgtggggcacag

SEQ ID NO: 2338758 - DNA, 14 bp, Homo sapiens
tgtggggcctggga

SEQ ID NO: 2338759 - DNA, 16 bp, Homo sapiens
tgtggggcctgggagg

SEQ ID NO: 2338760 - DNA, 22 bp, Homo sapiens
tgtggggtggagcactggactc

SEQ ID NO: 2338761 - DNA, 14 bp, Homo sapiens
tgtgggtctctgaa

SEQ ID NO: 2338762 - DNA, 14 bp, Homo sapiens
tgtgggtgtcctgc

SEQ ID NO: 2338763 - DNA, 18 bp, Homo sapiens
tgtgggtgttctttcctg

SEQ ID NO: 2338764 - DNA, 20 bp, Homo sapiens
tgtggtagcttatcttagaa

SEQ ID NO: 2338765 - DNA, 21 bp, Homo sapiens
tgtgtaaaaaaaccaccaaaa

SEQ ID NO: 2338766 - DNA, 20 bp, Homo sapiens
tgtgtaaatgcttaaatttc

SEQ ID NO: 2338767 - DNA, 15 bp, Homo sapiens
tgtgtaactgaaagg

SEQ ID NO: 2338768 - DNA, 18 bp, Homo sapiens
tgtgtagagttaagaagc

SEQ ID NO: 2338769 - DNA, 15 bp, Homo sapiens
tgtgtagcctgtgca

SEQ ID NO: 2338770 - DNA, 16 bp, Homo sapiens
tgtgtagcctgtgcat

SEQ ID NO: 2338771 - DNA, 15 bp, Homo sapiens
tgtgtcagctgaggc

SEQ ID NO: 2338772 - DNA, 12 bp, Homo sapiens
tgtgtcccctca

SEQ ID NO: 2338773 - DNA, 21 bp, Homo sapiens
tgtgtcccctcacgcaagtgc

SEQ ID NO: 2338774 - DNA, 22 bp, Homo sapiens
tgtgtccgtgaaagttgtgatc

SEQ ID NO: 2338775 - DNA, 17 bp, Homo sapiens
tgtgtcctccaggagct

SEQ ID NO: 2338776 - DNA, 21 bp, Homo sapiens
tgtgtcctccaggagcttctt

SEQ ID NO: 2338777 - DNA, 13 bp, Homo sapiens
tgtgtctgtacac

SEQ ID NO: 2338778 - DNA, 21 bp, Homo sapiens
tgtgtctgtacacgtgtcctg

SEQ ID NO: 2338779 - DNA, 15 bp, Homo sapiens
tgtgtgattaaaagg

SEQ ID NO: 2338780 - DNA, 23 bp, Homo sapiens
tgtgtggattgcctctgaaaagt

SEQ ID NO: 2338781 - DNA, 12 bp, Homo sapiens
tgtgtgtctcac

SEQ ID NO: 2338782 - DNA, 19 bp, Homo sapiens
tgtgttcagctctttccaa

SEQ ID NO: 2338783 - DNA, 21 bp, Homo sapiens
tgtgttcagctctttccaaat

SEQ ID NO: 2338784 - DNA, 15 bp, Homo sapiens
tgtgttcatttcatt

SEQ ID NO: 2338785 - DNA, 12 bp, Homo sapiens
tgtgtttatatg

SEQ ID NO: 2338786 - DNA, 18 bp, Homo sapiens
tgtgtttgttcataataa

SEQ ID NO: 2338787 - DNA, 15 bp, Homo sapiens
tgttaaaagttttat

SEQ ID NO: 2338788 - DNA, 20 bp, Homo sapiens
tgttaaaagttttatatgct

SEQ ID NO: 2338789 - DNA, 20 bp, Homo sapiens
tgttaaaatggggataataa

SEQ ID NO: 2338790 - DNA, 16 bp, Homo sapiens
tgttaaagagaatgag

SEQ ID NO: 2338791 - DNA, 19 bp, Homo sapiens
tgttaaatttgtaagtttc

SEQ ID NO: 2338792 - DNA, 12 bp, Homo sapiens
tgttaacatcta

SEQ ID NO: 2338793 - DNA, 14 bp, Homo sapiens
tgttaaggaaactc

SEQ ID NO: 2338794 - DNA, 17 bp, Homo sapiens
tgttaaggaaactctta

SEQ ID NO: 2338795 - DNA, 20 bp, Homo sapiens
tgttaagtatcagctacaat

SEQ ID NO: 2338796 - DNA, 21 bp, Homo sapiens
tgttacaggcaccgagaatgt

SEQ ID NO: 2338797 - DNA, 14 bp, Homo sapiens
tgttaccattcaca

SEQ ID NO: 2338798 - DNA, 15 bp, Homo sapiens
tgttacctgtgtgct

SEQ ID NO: 2338799 - DNA, 13 bp, Homo sapiens
tgttagggctgct

SEQ ID NO: 2338800 - DNA, 13 bp, Homo sapiens
tgttatcaaaata

SEQ ID NO: 2338801 - DNA, 21 bp, Homo sapiens
tgttatgatttccttcaatgt

SEQ ID NO: 2338802 - DNA, 14 bp, Homo sapiens
tgttattaaacaaa

SEQ ID NO: 2338803 - DNA, 14 bp, Homo sapiens
tgttattataacat

SEQ ID NO: 2338804 - DNA, 18 bp, Homo sapiens
tgttcactgctccttgct

SEQ ID NO: 2338805 - DNA, 20 bp, Homo sapiens
tgttcactgctccttgctgc

SEQ ID NO: 2338806 - DNA, 15 bp, Homo sapiens
tgttcagcagaacct

SEQ ID NO: 2338807 - DNA, 16 bp, Homo sapiens
tgttcagcagaacctg

SEQ ID NO: 2338808 - DNA, 19 bp, Homo sapiens
tgttcagctctttccaaat

SEQ ID NO: 2338809 - DNA, 20 bp, Homo sapiens
tgttcagctctttccaaatt

SEQ ID NO: 2338810 - DNA, 18 bp, Homo sapiens
tgttcatcatccagatgt

SEQ ID NO: 2338811 - DNA, 17 bp, Homo sapiens
tgttcccatttcagctg

SEQ ID NO: 2338812 - DNA, 20 bp, Homo sapiens
tgttcctaacaaaatgagat

SEQ ID NO: 2338813 - DNA, 19 bp, Homo sapiens
tgttcctactcacacttca

SEQ ID NO: 2338814 - DNA, 20 bp, Homo sapiens
ttatatattttcatcctata

SEQ ID NO: 2338815 - DNA, 20 bp, Homo sapiens
ttatatcatgcaaaatatgt

SEQ ID NO: 2338816 - DNA, 18 bp, Homo sapiens
ttatatggaagaaagtaa

SEQ ID NO: 2338817 - DNA, 21 bp, Homo sapiens
ttatattctgcagaaaattaa

SEQ ID NO: 2338818 - DNA, 13 bp, Homo sapiens
ttatatttccttt

SEQ ID NO: 2338819 - DNA, 14 bp, Homo sapiens
ttatcagcaaagaa

SEQ ID NO: 2338820 - DNA, 16 bp, Homo sapiens
ttatcattaaaaatta

SEQ ID NO: 2338821 - DNA, 17 bp, Homo sapiens
ttatcattaaaaattac

SEQ ID NO: 2338822 - DNA, 16 bp, Homo sapiens
ttatcctccaccgtct

SEQ ID NO: 2338823 - DNA, 15 bp, Homo sapiens
ttatcgaaataacaa

SEQ ID NO: 2338824 - DNA, 19 bp, Homo sapiens
ttatctcagtcatgcataa

SEQ ID NO: 2338825 - DNA, 21 bp, Homo sapiens
ttatctcagtcatgcataaat

SEQ ID NO: 2338826 - DNA, 14 bp, Homo sapiens
ttatcttattttct

SEQ ID NO: 2338827 - DNA, 12 bp, Homo sapiens
ttatgacatttt

SEQ ID NO: 2338828 - DNA, 20 bp, Homo sapiens
ttatgagattggttttcctg

SEQ ID NO: 2338829 - DNA, 13 bp, Homo sapiens
ttatgatctggcc

SEQ ID NO: 2338830 - DNA, 13 bp, Homo sapiens
ttatgatttaata

SEQ ID NO: 2338831 - DNA, 18 bp, Homo sapiens
ttatgcacttttagaaat

SEQ ID NO: 2338832 - DNA, 17 bp, Homo sapiens
ttatgctgtgacacatg

SEQ ID NO: 2338833 - DNA, 13 bp, Homo sapiens
ttatggaaaactg

SEQ ID NO: 2338834 - DNA, 14 bp, Homo sapiens
ttatggggccctgt

SEQ ID NO: 2338835 - DNA, 16 bp, Homo sapiens
ttatgtaagcatttgt

SEQ ID NO: 2338836 - DNA, 20 bp, Homo sapiens
ttatgtaagcatttgtacat

SEQ ID NO: 2338837 - DNA, 19 bp, Homo sapiens
ttatgtacaaacatgttgt

SEQ ID NO: 2338838 - DNA, 16 bp, Homo sapiens
ttatgtagatgtgcat

SEQ ID NO: 2338839 - DNA, 13 bp, Homo sapiens
ttatgtgaaaaat

SEQ ID NO: 2338840 - DNA, 17 bp, Homo sapiens
ttatgtgaatttttaag

SEQ ID NO: 2338841 - DNA, 14 bp, Homo sapiens
ttatgttagtttaa

SEQ ID NO: 2338842 - DNA, 23 bp, Homo sapiens
ttatgttagtttaaaaggtcaat

SEQ ID NO: 2338843 - DNA, 17 bp, Homo sapiens
ttatgtttaaaagaaat

SEQ ID NO: 2338844 - DNA, 14 bp, Homo sapiens
ttatgtttaaaatg

SEQ ID NO: 2338845 - DNA, 19 bp, Homo sapiens
ttatgtttaaaatggcatt

SEQ ID NO: 2338846 - DNA, 16 bp, Homo sapiens
ttattaaacaaataat

SEQ ID NO: 2338847 - DNA, 15 bp, Homo sapiens
ttattaagctttttg

SEQ ID NO: 2338848 - DNA, 14 bp, Homo sapiens
ttattaatatttgc

SEQ ID NO: 2338849 - DNA, 22 bp, Homo sapiens
ttattaatatttgcacatggga

SEQ ID NO: 2338850 - DNA, 13 bp, Homo sapiens
ttattaatgtttt

SEQ ID NO: 2338851 - DNA, 13 bp, Homo sapiens
ttattataacata

SEQ ID NO: 2338852 - DNA, 14 bp, Homo sapiens
ttattataacataa

SEQ ID NO: 2338853 - DNA, 17 bp, Homo sapiens
ttattcaagaatgaaaa

SEQ ID NO: 2338854 - DNA, 19 bp, Homo sapiens
ttattcaagaatgaaaaat

SEQ ID NO: 2338855 - DNA, 14 bp, Homo sapiens
ttattcataatgtg

SEQ ID NO: 2338856 - DNA, 16 bp, Homo sapiens
ttattcctcctgctca

SEQ ID NO: 2338857 - DNA, 13 bp, Homo sapiens
ttattgacactga

SEQ ID NO: 2338858 - DNA, 15 bp, Homo sapiens
ttattgacactgaac

SEQ ID NO: 2338859 - DNA, 21 bp, Homo sapiens
ttattgacaggtcttttcaaa

SEQ ID NO: 2338860 - DNA, 15 bp, Homo sapiens
ttattggctgagata

SEQ ID NO: 2338861 - DNA, 14 bp, Homo sapiens
ttattgtatttatg

SEQ ID NO: 2338862 - DNA, 15 bp, Homo sapiens
ttatttaagactaaa

SEQ ID NO: 2338863 - DNA, 13 bp, Homo sapiens
ttatttaataaca

SEQ ID NO: 2338864 - DNA, 14 bp, Homo sapiens
ttatttaataacat

SEQ ID NO: 2338865 - DNA, 14 bp, Homo sapiens
ttatttagacaaga

SEQ ID NO: 2338866 - DNA, 18 bp, Homo sapiens
ttatttagacaagagatg

SEQ ID NO: 2338867 - DNA, 20 bp, Homo sapiens
ttatttgattatttaagact

SEQ ID NO: 2338868 - DNA, 14 bp, Homo sapiens
ttatttgtttgtct

SEQ ID NO: 2338869 - DNA, 14 bp, Homo sapiens
ttattttgtgtaaa

SEQ ID NO: 2338870 - DNA, 18 bp, Homo sapiens
ttatttttataattgtac

SEQ ID NO: 2338871 - DNA, 14 bp, Homo sapiens
ttatttttgtacat

SEQ ID NO: 2338872 - DNA, 16 bp, Homo sapiens
ttatttttttaaaatt

SEQ ID NO: 2338873 - DNA, 18 bp, Homo sapiens
ttcaaaaaccagccaggc

SEQ ID NO: 2338874 - DNA, 20 bp, Homo sapiens
ttcaaaaaccagccaggcag

SEQ ID NO: 2338875 - DNA, 20 bp, Homo sapiens
ttcaaaaccaagtatcacac

SEQ ID NO: 2338876 - DNA, 12 bp, Homo sapiens
ttcaaaagtatt

SEQ ID NO: 2338877 - DNA, 15 bp, Homo sapiens
ttcaaaataaaaagt

SEQ ID NO: 2338878 - DNA, 18 bp, Homo sapiens
ttcaaaatgatagacata

SEQ ID NO: 2338879 - DNA, 17 bp, Homo sapiens
ttcaaagactcaaattt

SEQ ID NO: 2338880 - DNA, 18 bp, Homo sapiens
ttcaaagactcaaatttt

SEQ ID NO: 2338881 - DNA, 12 bp, Homo sapiens
ttcaaagccttc

SEQ ID NO: 2338882 - DNA, 20 bp, Homo sapiens
ttcaaagttttgttgtactt

SEQ ID NO: 2338883 - DNA, 21 bp, Homo sapiens
ttcaaagttttgttgtactta

SEQ ID NO: 2338884 - DNA, 19 bp, Homo sapiens
ttcaaatagggtctaactc

SEQ ID NO: 2338885 - DNA, 23 bp, Homo sapiens
ttcaaatcattccttagatacct

SEQ ID NO: 2338886 - DNA, 19 bp, Homo sapiens
ttcaaattcttctgaactc

SEQ ID NO: 2338887 - DNA, 15 bp, Homo sapiens
ttcaactgtcttcct

SEQ ID NO: 2338888 - DNA, 19 bp, Homo sapiens
ttcaactgtcttcctcaaa

SEQ ID NO: 2338889 - DNA, 23 bp, Homo sapiens
ttcaagaataatcacgctttcct

SEQ ID NO: 2338890 - DNA, 18 bp, Homo sapiens
ttcaagaatgaaaaatat

SEQ ID NO: 2338891 - DNA, 23 bp, Homo sapiens
ttcaagaggagcccccaccctgt

SEQ ID NO: 2338892 - DNA, 16 bp, Homo sapiens
ttcaagcagcatcttc

SEQ ID NO: 2338893 - DNA, 23 bp, Homo sapiens
ttcaagttccaagttgctaatac

SEQ ID NO: 2338894 - DNA, 18 bp, Homo sapiens
ttcaagttttaaagttca

SEQ ID NO: 2338895 - DNA, 16 bp, Homo sapiens
ttcaatatgaatctat

SEQ ID NO: 2338896 - DNA, 20 bp, Homo sapiens
ttcaatctgtaaactgtgta

SEQ ID NO: 2338897 - DNA, 16 bp, Homo sapiens
ttcaatgtgcataatg

SEQ ID NO: 2338898 - DNA, 19 bp, Homo sapiens
ttcacacctcacgctctgg

SEQ ID NO: 2338899 - DNA, 19 bp, Homo sapiens
ttcacagcacttacaattt

SEQ ID NO: 2338900 - DNA, 13 bp, Homo sapiens
ttcacctgtaaac

SEQ ID NO: 2338901 - DNA, 12 bp, Homo sapiens
ttcaccttggaa

SEQ ID NO: 2338902 - DNA, 14 bp, Homo sapiens
ttcaccttggaagg

SEQ ID NO: 2338903 - DNA, 18 bp, Homo sapiens
ttcacgtggcctccgcag

SEQ ID NO: 2338904 - DNA, 21 bp, Homo sapiens
ttcactaccctgattcttgat

SEQ ID NO: 2338905 - DNA, 22 bp, Homo sapiens
ttcactgtataaataggagagg

SEQ ID NO: 2338906 - DNA, 14 bp, Homo sapiens
ttcacttcttccta

SEQ ID NO: 2338907 - DNA, 16 bp, Homo sapiens
ttcactttattgctat

SEQ ID NO: 2338908 - DNA, 12 bp, Homo sapiens
ttcactttgaaa

SEQ ID NO: 2338909 - DNA, 21 bp, Homo sapiens
ttcagaaatataacacatttt

SEQ ID NO: 2338910 - DNA, 22 bp, Homo sapiens
ttcagaaatataacacattttt

SEQ ID NO: 2338911 - DNA, 18 bp, Homo sapiens
ttcagaagcaagccagac

SEQ ID NO: 2338912 - DNA, 22 bp, Homo sapiens
ttcagaagtcacacattacaaa

SEQ ID NO: 2338913 - DNA, 19 bp, Homo sapiens
ttcagcaaactaaccagca

SEQ ID NO: 2338914 - DNA, 23 bp, Homo sapiens
ttcagcaaactaaccagcattcc

SEQ ID NO: 2338915 - DNA, 20 bp, Homo sapiens
ttcagcaaactcttttccca

SEQ ID NO: 2338916 - DNA, 18 bp, Homo sapiens
ttcagctctttccaaatt

SEQ ID NO: 2338917 - DNA, 20 bp, Homo sapiens
ttcaggatattggttcttcc

SEQ ID NO: 2338918 - DNA, 14 bp, Homo sapiens
ttcagggtaaatag

SEQ ID NO: 2338919 - DNA, 17 bp, Homo sapiens
ttcaggtgacatgtgaa

SEQ ID NO: 2338920 - DNA, 19 bp, Homo sapiens
ttcaggtgacatgtgaaac

SEQ ID NO: 2338921 - DNA, 20 bp, Homo sapiens
ttcaggttatcgaaataaca

SEQ ID NO: 2338922 - DNA, 22 bp, Homo sapiens
ttcaggttatcgaaataacaat

SEQ ID NO: 2338923 - DNA, 15 bp, Homo sapiens
ttcagtaactgtcag

SEQ ID NO: 2338924 - DNA, 19 bp, Homo sapiens
ttcagtcccctctctctgg

SEQ ID NO: 2338925 - DNA, 20 bp, Homo sapiens
ttcagtgagggtcttcttac

SEQ ID NO: 2338926 - DNA, 21 bp, Homo sapiens
ttcagtgcagtttcttttcac

SEQ ID NO: 2338927 - DNA, 18 bp, Homo sapiens
ttcagtgttacctgtgtg

SEQ ID NO: 2338928 - DNA, 22 bp, Homo sapiens
ttcagtgttacctgtgtgcttg

SEQ ID NO: 2338929 - DNA, 17 bp, Homo sapiens
ttgttttttcattgtgt

SEQ ID NO: 2338930 - DNA, 14 bp, Homo sapiens
tttaaaaacatttt

SEQ ID NO: 2338931 - DNA, 17 bp, Homo sapiens
tttaaaaacatttttta

SEQ ID NO: 2338932 - DNA, 23 bp, Homo sapiens
tttaaaaacattttttatacatt

SEQ ID NO: 2338933 - DNA, 12 bp, Homo sapiens
tttaaaagaaat

SEQ ID NO: 2338934 - DNA, 17 bp, Homo sapiens
tttaaaataaaatgaaa

SEQ ID NO: 2338935 - DNA, 21 bp, Homo sapiens
tttaaaatagaaattttgtaa

SEQ ID NO: 2338936 - DNA, 10 bp, Homo sapiens
tttaaaattt

SEQ ID NO: 2338937 - DNA, 17 bp, Homo sapiens
tttaaacccaaaatata

SEQ ID NO: 2338938 - DNA, 14 bp, Homo sapiens
tttaaactgtgtac

SEQ ID NO: 2338939 - DNA, 21 bp, Homo sapiens
tttaaactgtgtacataactg

SEQ ID NO: 2338940 - DNA, 15 bp, Homo sapiens
tttaaagaatgttag

SEQ ID NO: 2338941 - DNA, 18 bp, Homo sapiens
tttaaagccattctgatt

SEQ ID NO: 2338942 - DNA, 15 bp, Homo sapiens
tttaaataaaattta

SEQ ID NO: 2338943 - DNA, 19 bp, Homo sapiens
tttaaatcctgaagagcat

SEQ ID NO: 2338944 - DNA, 15 bp, Homo sapiens
tttaaatgtaaagat

SEQ ID NO: 2338945 - DNA, 15 bp, Homo sapiens
tttaaattgtggatg

SEQ ID NO: 2338946 - DNA, 12 bp, Homo sapiens
tttaacaaaatt

SEQ ID NO: 2338947 - DNA, 13 bp, Homo sapiens
tttaacaaaattt

SEQ ID NO: 2338948 - DNA, 22 bp, Homo sapiens
tttaacagaaaaatgaaattta

SEQ ID NO: 2338949 - DNA, 19 bp, Homo sapiens
tttaacatacaagaaaatg

SEQ ID NO: 2338950 - DNA, 17 bp, Homo sapiens
tttaactaaattttaaa

SEQ ID NO: 2338951 - DNA, 12 bp, Homo sapiens
tttaacttttga

SEQ ID NO: 2338952 - DNA, 14 bp, Homo sapiens
tttaagagatttta

SEQ ID NO: 2338953 - DNA, 12 bp, Homo sapiens
tttaagattttt

SEQ ID NO: 2338954 - DNA, 16 bp, Homo sapiens
tttaagatttttctca

SEQ ID NO: 2338955 - DNA, 17 bp, Homo sapiens
tttaagatttttctcaa

SEQ ID NO: 2338956 - DNA, 21 bp, Homo sapiens
tttaagcttcagttgcttgtc

SEQ ID NO: 2338957 - DNA, 19 bp, Homo sapiens
tttaaggataaatcataaa

SEQ ID NO: 2338958 - DNA, 19 bp, Homo sapiens
tttaaggcatatttaacaa

SEQ ID NO: 2338959 - DNA, 18 bp, Homo sapiens
tttaagtggactgtattt

SEQ ID NO: 2338960 - DNA, 14 bp, Homo sapiens
tttaagtgttctgt

SEQ ID NO: 2338961 - DNA, 19 bp, Homo sapiens
tttaagtgttctgtggctg

SEQ ID NO: 2338962 - DNA, 19 bp, Homo sapiens
tttaagttcttatgaggag

SEQ ID NO: 2338963 - DNA, 16 bp, Homo sapiens
tttaataaagatgagt

SEQ ID NO: 2338964 - DNA, 17 bp, Homo sapiens
tttaataaagatgagtt

SEQ ID NO: 2338965 - DNA, 18 bp, Homo sapiens
tttaatagtcaccttcat

SEQ ID NO: 2338966 - DNA, 21 bp, Homo sapiens
tttaatattcttttgtttcca

SEQ ID NO: 2338967 - DNA, 23 bp, Homo sapiens
tttaattgttgtttctttctagt

SEQ ID NO: 2338968 - DNA, 13 bp, Homo sapiens
tttaattttaatg

SEQ ID NO: 2338969 - DNA, 15 bp, Homo sapiens
tttaattttaatgct

SEQ ID NO: 2338970 - DNA, 17 bp, Homo sapiens
tttaattttaatgctgt

SEQ ID NO: 2338971 - DNA, 14 bp, Homo sapiens
tttacacatcttaa

SEQ ID NO: 2338972 - DNA, 21 bp, Homo sapiens
tttacatggcgccctgcctcc

SEQ ID NO: 2338973 - DNA, 11 bp, Homo sapiens
tttaccactgt

SEQ ID NO: 2338974 - DNA, 15 bp, Homo sapiens
tttaccactgtggtt

SEQ ID NO: 2338975 - DNA, 22 bp, Homo sapiens
tttaccctttggccccactttg

SEQ ID NO: 2338976 - DNA, 18 bp, Homo sapiens
tttactaacagtaactgc

SEQ ID NO: 2338977 - DNA, 22 bp, Homo sapiens
tttactgtttgatataccaaat

SEQ ID NO: 2338978 - DNA, 22 bp, Homo sapiens
tttacttctcgaattgaagcaa

SEQ ID NO: 2338979 - DNA, 15 bp, Homo sapiens
tttacttgttttgga

SEQ ID NO: 2338980 - DNA, 18 bp, Homo sapiens
tttactttcaagtaatat

SEQ ID NO: 2338981 - DNA, 16 bp, Homo sapiens
tttacttttaaactgt

SEQ ID NO: 2338982 - DNA, 13 bp, Homo sapiens
tttagaaatgcat

SEQ ID NO: 2338983 - DNA, 18 bp, Homo sapiens
tttagaacatgtaaaatg

SEQ ID NO: 2338984 - DNA, 23 bp, Homo sapiens
tttagacaaagccttaagcaaat

SEQ ID NO: 2338985 - DNA, 17 bp, Homo sapiens
tttagcagatttaagat

SEQ ID NO: 2338986 - DNA, 13 bp, Homo sapiens
tttagctctgaga

SEQ ID NO: 2338987 - DNA, 14 bp, Homo sapiens
tttagctctgagaa

SEQ ID NO: 2338988 - DNA, 14 bp, Homo sapiens
tttagcttttttat

SEQ ID NO: 2338989 - DNA, 10 bp, Homo sapiens
tttaggaaat

SEQ ID NO: 2338990 - DNA, 21 bp, Homo sapiens
tttagtacaatagtatacatt

SEQ ID NO: 2338991 - DNA, 16 bp, Homo sapiens
tttataaacagaaatg

SEQ ID NO: 2338992 - DNA, 23 bp, Homo sapiens
tttataaacagaaatggaaagca

SEQ ID NO: 2338993 - DNA, 17 bp, Homo sapiens
tttataacatctttatt

SEQ ID NO: 2338994 - DNA, 14 bp, Homo sapiens
tttataataaaaat

SEQ ID NO: 2338995 - DNA, 16 bp, Homo sapiens
tttataataaaaatat

SEQ ID NO: 2338996 - DNA, 21 bp, Homo sapiens
tttataatacagaatcttgtt

SEQ ID NO: 2338997 - DNA, 21 bp, Homo sapiens
tttataatgatgaacttataa

SEQ ID NO: 2338998 - DNA, 17 bp, Homo sapiens
tttataattgtacaaaa

SEQ ID NO: 2338999 - DNA, 20 bp, Homo sapiens
tttataattgtacaaaatta

SEQ ID NO: 2339000 - DNA, 15 bp, Homo sapiens
tttatatcatgcaaa

SEQ ID NO: 2339001 - DNA, 16 bp, Homo sapiens
tttatatcatgcaaaa

SEQ ID NO: 2339002 - DNA, 14 bp, Homo sapiens
tttatatgaagaaa

SEQ ID NO: 2339003 - DNA, 21 bp, Homo sapiens
tttatatgaagaaaatcactt

SEQ ID NO: 2339004 - DNA, 19 bp, Homo sapiens
tttatatgattaaattatc

SEQ ID NO: 2339005 - DNA, 12 bp, Homo sapiens
tttatatgcttt

SEQ ID NO: 2339006 - DNA, 14 bp, Homo sapiens
tttatatttccttt

SEQ ID NO: 2339007 - DNA, 15 bp, Homo sapiens
tttatatttccttta

SEQ ID NO: 2339008 - DNA, 21 bp, Homo sapiens
tttatatttcctttatgtgaa

SEQ ID NO: 2339009 - DNA, 19 bp, Homo sapiens
tttatcatgaatgctttta

SEQ ID NO: 2339010 - DNA, 16 bp, Homo sapiens
tttatcatgcatgtcc

SEQ ID NO: 2339011 - DNA, 19 bp, Homo sapiens
tttatgagccagacaaatg

SEQ ID NO: 2339012 - DNA, 15 bp, Homo sapiens
tttatgatgctaagc

SEQ ID NO: 2339013 - DNA, 18 bp, Homo sapiens
tttatgatttaataaaat

SEQ ID NO: 2339014 - DNA, 15 bp, Homo sapiens
tttatgtgaattttt

SEQ ID NO: 2339015 - DNA, 16 bp, Homo sapiens
tttatgtgaattttta

SEQ ID NO: 2339016 - DNA, 15 bp, Homo sapiens
tttatgtttaaaatg

SEQ ID NO: 2339017 - DNA, 18 bp, Homo sapiens
tttatgtttaaaatggca

SEQ ID NO: 2339018 - DNA, 21 bp, Homo sapiens
tttattacatagctctgaagt

SEQ ID NO: 2339019 - DNA, 21 bp, Homo sapiens
tttattgagtacctactgtgt

SEQ ID NO: 2339020 - DNA, 23 bp, Homo sapiens
tttattgccatattaaaatctga

SEQ ID NO: 2339021 - DNA, 12 bp, Homo sapiens
tttatttccact

SEQ ID NO: 2339022 - DNA, 15 bp, Homo sapiens
tttattttcctaaag

SEQ ID NO: 2339023 - DNA, 15 bp, Homo sapiens
tttcaaaatgaattt

SEQ ID NO: 2339024 - DNA, 22 bp, Homo sapiens
tttcaaataatgcttttctaat

SEQ ID NO: 2339025 - DNA, 23 bp, Homo sapiens
tttcaaataatgcttttctaatt

SEQ ID NO: 2339026 - DNA, 19 bp, Homo sapiens
tttcaagctggaagaagtg

SEQ ID NO: 2339027 - DNA, 13 bp, Homo sapiens
tttcaatatattg

SEQ ID NO: 2339028 - DNA, 14 bp, Homo sapiens
tttcaatatattga

SEQ ID NO: 2339029 - DNA, 17 bp, Homo sapiens
tttcaatatattgaact

SEQ ID NO: 2339030 - DNA, 20 bp, Homo sapiens
tttcacaaatccttcaaaat

SEQ ID NO: 2339031 - DNA, 19 bp, Homo sapiens
tttcacactggtaaatgtt

SEQ ID NO: 2339032 - DNA, 18 bp, Homo sapiens
tttcaccttttcaggaaa

SEQ ID NO: 2339033 - DNA, 18 bp, Homo sapiens
tttcacggaaactcccga

SEQ ID NO: 2339034 - DNA, 15 bp, Homo sapiens
tttcactttattgct

SEQ ID NO: 2339035 - DNA, 15 bp, Homo sapiens
tttcactttgaaaag

SEQ ID NO: 2339036 - DNA, 16 bp, Homo sapiens
tttcactttgaaaagt

SEQ ID NO: 2339037 - DNA, 18 bp, Homo sapiens
tttcagaagcaagccaga

SEQ ID NO: 2339038 - DNA, 20 bp, Homo sapiens
tttcaggtgacatgtgaaac

SEQ ID NO: 2339039 - DNA, 22 bp, Homo sapiens
tttcaggtgacatgtgaaacct

SEQ ID NO: 2339040 - DNA, 19 bp, Homo sapiens
tttcagtcccctctctctg

SEQ ID NO: 2339041 - DNA, 18 bp, Homo sapiens
tttcagttctaggaaaat

SEQ ID NO: 2339042 - DNA, 18 bp, Homo sapiens
tttcataaattatttgat

SEQ ID NO: 2339043 - DNA, 19 bp, Homo sapiens
tttcataaattatttgatt

SEQ ID NO: 2339044 - DNA, 19 bp, Homo sapiens
taagtgcgtgtgtagagtt

SEQ ID NO: 2339045 - DNA, 23 bp, Homo sapiens
taagtgcgtgtgtagagttaaga

SEQ ID NO: 2339046 - DNA, 14 bp, Homo sapiens
taagtgtgccaaat

SEQ ID NO: 2339047 - DNA, 13 bp, Homo sapiens
taagtgttctgtg

SEQ ID NO: 2339048 - DNA, 17 bp, Homo sapiens
taagttatttttgtaca

SEQ ID NO: 2339049 - DNA, 17 bp, Homo sapiens
taagttcccatttcctt

SEQ ID NO: 2339050 - DNA, 23 bp, Homo sapiens
taagttcccatttccttgtctaa

SEQ ID NO: 2339051 - DNA, 21 bp, Homo sapiens
taagttcttatgaggagggga

SEQ ID NO: 2339052 - DNA, 17 bp, Homo sapiens
taagtttcaggtgacat

SEQ ID NO: 2339053 - DNA, 22 bp, Homo sapiens
taagtttcaggtgacatgtgaa

SEQ ID NO: 2339054 - DNA, 13 bp, Homo sapiens
taataaaaagatt

SEQ ID NO: 2339055 - DNA, 16 bp, Homo sapiens
taataaaaagattgaa

SEQ ID NO: 2339056 - DNA, 12 bp, Homo sapiens
taataaaactgt

SEQ ID NO: 2339057 - DNA, 23 bp, Homo sapiens
taataaaactgtttgacttctca

SEQ ID NO: 2339058 - DNA, 13 bp, Homo sapiens
taataaaagtgaa

SEQ ID NO: 2339059 - DNA, 18 bp, Homo sapiens
taataaaataattctaaa

SEQ ID NO: 2339060 - DNA, 13 bp, Homo sapiens
taataaaatatct

SEQ ID NO: 2339061 - DNA, 20 bp, Homo sapiens
taataaaatatctatttgaa

SEQ ID NO: 2339062 - DNA, 14 bp, Homo sapiens
taataaagatgagt

SEQ ID NO: 2339063 - DNA, 16 bp, Homo sapiens
taataaagtattttct

SEQ ID NO: 2339064 - DNA, 16 bp, Homo sapiens
taataaatatttatgt

SEQ ID NO: 2339065 - DNA, 15 bp, Homo sapiens
taataaattttctaa

SEQ ID NO: 2339066 - DNA, 17 bp, Homo sapiens
taataaattttctaaaa

SEQ ID NO: 2339067 - DNA, 18 bp, Homo sapiens
taataacaaggagatttc

SEQ ID NO: 2339068 - DNA, 20 bp, Homo sapiens
taataacaaggagatttctt

SEQ ID NO: 2339069 - DNA, 13 bp, Homo sapiens
taataactgtgta

SEQ ID NO: 2339070 - DNA, 20 bp, Homo sapiens
taataagacataacgttttt

SEQ ID NO: 2339071 - DNA, 17 bp, Homo sapiens
taataagagaatgttcc

SEQ ID NO: 2339072 - DNA, 19 bp, Homo sapiens
taataagagaatgttccta

SEQ ID NO: 2339073 - DNA, 17 bp, Homo sapiens
taataagatttttcaaa

SEQ ID NO: 2339074 - DNA, 15 bp, Homo sapiens
taataagcactgtaa

SEQ ID NO: 2339075 - DNA, 15 bp, Homo sapiens
taataagtgacaaat

SEQ ID NO: 2339076 - DNA, 21 bp, Homo sapiens
taataagtgacaaataagatt

SEQ ID NO: 2339077 - DNA, 21 bp, Homo sapiens
taatacagcaacaatttatga

SEQ ID NO: 2339078 - DNA, 20 bp, Homo sapiens
taataggaatgtccaccatg

SEQ ID NO: 2339079 - DNA, 22 bp, Homo sapiens
taataggaatgtccaccatgaa

SEQ ID NO: 2339080 - DNA, 16 bp, Homo sapiens
taatatactccttaaa

SEQ ID NO: 2339081 - DNA, 13 bp, Homo sapiens
taatatatgaaat

SEQ ID NO: 2339082 - DNA, 12 bp, Homo sapiens
taatatattaaa

SEQ ID NO: 2339083 - DNA, 16 bp, Homo sapiens
taatatattaaaattc

SEQ ID NO: 2339084 - DNA, 12 bp, Homo sapiens
taatatcagtta

SEQ ID NO: 2339085 - DNA, 16 bp, Homo sapiens
taatatcagttacagt

SEQ ID NO: 2339086 - DNA, 18 bp, Homo sapiens
taatattcttcaaatgta

SEQ ID NO: 2339087 - DNA, 19 bp, Homo sapiens
taatattggtgctatttaa

SEQ ID NO: 2339088 - DNA, 20 bp, Homo sapiens
taatattgtttggtaaatgt

SEQ ID NO: 2339089 - DNA, 21 bp, Homo sapiens
taatattgtttggtaaatgtt

SEQ ID NO: 2339090 - DNA, 19 bp, Homo sapiens
taatatttgcacatgggat

SEQ ID NO: 2339091 - DNA, 15 bp, Homo sapiens
taatcaagagaaact

SEQ ID NO: 2339092 - DNA, 18 bp, Homo sapiens
taatcacgctttcctgaa

SEQ ID NO: 2339093 - DNA, 13 bp, Homo sapiens
taatcagtaaata

SEQ ID NO: 2339094 - DNA, 15 bp, Homo sapiens
taatcatgaaccaat

SEQ ID NO: 2339095 - DNA, 19 bp, Homo sapiens
taatccagttataagaaga

SEQ ID NO: 2339096 - DNA, 23 bp, Homo sapiens
taatccagttataagaagaagtt

SEQ ID NO: 2339097 - DNA, 23 bp, Homo sapiens
taatctgagattgtgtttgttca

SEQ ID NO: 2339098 - DNA, 15 bp, Homo sapiens
taatcttctgccttc

SEQ ID NO: 2339099 - DNA, 23 bp, Homo sapiens
taatgaaaataaaacacacctcg

SEQ ID NO: 2339100 - DNA, 16 bp, Homo sapiens
taatgacaattcagag

SEQ ID NO: 2339101 - DNA, 15 bp, Homo sapiens
taatgataaaataaa

SEQ ID NO: 2339102 - DNA, 20 bp, Homo sapiens
taatgataaaataaataatt

SEQ ID NO: 2339103 - DNA, 12 bp, Homo sapiens
taatgataaact

SEQ ID NO: 2339104 - DNA, 21 bp, Homo sapiens
taatgataaactcagatctga

SEQ ID NO: 2339105 - DNA, 16 bp, Homo sapiens
taatgatgaacttata

SEQ ID NO: 2339106 - DNA, 19 bp, Homo sapiens
taatgattaagggacattt

SEQ ID NO: 2339107 - DNA, 21 bp, Homo sapiens
taatgccttactcttcttgaa

SEQ ID NO: 2339108 - DNA, 14 bp, Homo sapiens
taatgctacaattt

SEQ ID NO: 2339109 - DNA, 14 bp, Homo sapiens
taatgctgtttcta

SEQ ID NO: 2339110 - DNA, 17 bp, Homo sapiens
taatgctgtttctaaga

SEQ ID NO: 2339111 - DNA, 19 bp, Homo sapiens
taatgctgtttctaagaaa

SEQ ID NO: 2339112 - DNA, 20 bp, Homo sapiens
taatgctgtttctaagaaaa

SEQ ID NO: 2339113 - DNA, 14 bp, Homo sapiens
taatgcttttctaa

SEQ ID NO: 2339114 - DNA, 19 bp, Homo sapiens
taatgctttttagaaagca

SEQ ID NO: 2339115 - DNA, 19 bp, Homo sapiens
taatgtactgatttcagta

SEQ ID NO: 2339116 - DNA, 22 bp, Homo sapiens
taatgtctcactttactttcaa

SEQ ID NO: 2339117 - DNA, 17 bp, Homo sapiens
taatgtctgtttattaa

SEQ ID NO: 2339118 - DNA, 18 bp, Homo sapiens
taatgttaaatttgtaag

SEQ ID NO: 2339119 - DNA, 15 bp, Homo sapiens
taatgtttatgagcc

SEQ ID NO: 2339120 - DNA, 14 bp, Homo sapiens
taattaagaaaact

SEQ ID NO: 2339121 - DNA, 17 bp, Homo sapiens
taattaatatattaaaa

SEQ ID NO: 2339122 - DNA, 15 bp, Homo sapiens
taattaatttggagc

SEQ ID NO: 2339123 - DNA, 18 bp, Homo sapiens
taattattgcactagaga

SEQ ID NO: 2339124 - DNA, 11 bp, Homo sapiens
taattctaaag

SEQ ID NO: 2339125 - DNA, 20 bp, Homo sapiens
taattgccagcaaataaata

SEQ ID NO: 2339126 - DNA, 21 bp, Homo sapiens
taattgcgtagaggctacagg

SEQ ID NO: 2339127 - DNA, 14 bp, Homo sapiens
taattggatgttca

SEQ ID NO: 2339128 - DNA, 17 bp, Homo sapiens
taattgtacaaaattaa

SEQ ID NO: 2339129 - DNA, 22 bp, Homo sapiens
taattgtacaaaattaagcaaa

SEQ ID NO: 2339130 - DNA, 13 bp, Homo sapiens
taatttaaatgaa

SEQ ID NO: 2339131 - DNA, 19 bp, Homo sapiens
taatttaacaccctttaga

SEQ ID NO: 2339132 - DNA, 21 bp, Homo sapiens
taatttagtggatggaatatc

SEQ ID NO: 2339133 - DNA, 23 bp, Homo sapiens
taatttagtggatggaatatcag

SEQ ID NO: 2339134 - DNA, 16 bp, Homo sapiens
taatttcaaaatacat

SEQ ID NO: 2339135 - DNA, 19 bp, Homo sapiens
taatttcaaaatacatttg

SEQ ID NO: 2339136 - DNA, 13 bp, Homo sapiens
taatttcaaatgt

SEQ ID NO: 2339137 - DNA, 11 bp, Homo sapiens
taatttccttt

SEQ ID NO: 2339138 - DNA, 19 bp, Homo sapiens
taatttcctttttgacact

SEQ ID NO: 2339139 - DNA, 21 bp, Homo sapiens
taatttcctttttgacactga

SEQ ID NO: 2339140 - DNA, 12 bp, Homo sapiens
taatttctatta

SEQ ID NO: 2339141 - DNA, 14 bp, Homo sapiens
taatttctcctccc

SEQ ID NO: 2339142 - DNA, 13 bp, Homo sapiens
taatttgaagatt

SEQ ID NO: 2339143 - DNA, 14 bp, Homo sapiens
taatttgaagattg

SEQ ID NO: 2339144 - DNA, 19 bp, Homo sapiens
taatttgaatgtatttgat

SEQ ID NO: 2339145 - DNA, 15 bp, Homo sapiens
taatttgagagaaat

SEQ ID NO: 2339146 - DNA, 12 bp, Homo sapiens
taattttaaagt

SEQ ID NO: 2339147 - DNA, 17 bp, Homo sapiens
taattttaatattcttt

SEQ ID NO: 2339148 - DNA, 15 bp, Homo sapiens
taattttaatgctgt

SEQ ID NO: 2339149 - DNA, 18 bp, Homo sapiens
taattttattttaaaatt

SEQ ID NO: 2339150 - DNA, 15 bp, Homo sapiens
taatttttgcagaaa

SEQ ID NO: 2339151 - DNA, 14 bp, Homo sapiens
tacaaaattaagca

SEQ ID NO: 2339152 - DNA, 15 bp, Homo sapiens
tacaaaattaagcaa

SEQ ID NO: 2339153 - DNA, 13 bp, Homo sapiens
tacaaacctacca

SEQ ID NO: 2339154 - DNA, 13 bp, Homo sapiens
tacaaactctcac

SEQ ID NO: 2339155 - DNA, 18 bp, Homo sapiens
tacaaacttttaagattt

SEQ ID NO: 2339156 - DNA, 16 bp, Homo sapiens
tacaaatgaagaaagt

SEQ ID NO: 2339157 - DNA, 17 bp, Homo sapiens
tacaaatgaagaaagtc

SEQ ID NO: 2339158 - DNA, 21 bp, Homo sapiens
tacaaatgaagaaagtcaaaa

SEQ ID NO: 2339159 - DNA, 19 bp, Homo sapiens
tagcatttaaaatggaaaa

SEQ ID NO: 2339160 - DNA, 13 bp, Homo sapiens
tagccaaagattt

SEQ ID NO: 2339161 - DNA, 19 bp, Homo sapiens
tagccacagctgctgttct

SEQ ID NO: 2339162 - DNA, 18 bp, Homo sapiens
tagccagcccctcttccc

SEQ ID NO: 2339163 - DNA, 13 bp, Homo sapiens
tagcccagagtga

SEQ ID NO: 2339164 - DNA, 21 bp, Homo sapiens
tagcctaaaacgaatggtctt

SEQ ID NO: 2339165 - DNA, 22 bp, Homo sapiens
tagcctaaagtatacaactgcc

SEQ ID NO: 2339166 - DNA, 20 bp, Homo sapiens
tagcctggactaaaggcatc

SEQ ID NO: 2339167 - DNA, 22 bp, Homo sapiens
tagcctttacctgtgaagtgtt

SEQ ID NO: 2339168 - DNA, 18 bp, Homo sapiens
tagcgagctgctctgcta

SEQ ID NO: 2339169 - DNA, 16 bp, Homo sapiens
tagcgatctctcctgg

SEQ ID NO: 2339170 - DNA, 19 bp, Homo sapiens
tagcgatctctcctggcct

SEQ ID NO: 2339171 - DNA, 18 bp, Homo sapiens
tagcgttgttttgtggat

SEQ ID NO: 2339172 - DNA, 19 bp, Homo sapiens
tagctctgaatgctatttg

SEQ ID NO: 2339173 - DNA, 21 bp, Homo sapiens
tagctctggaggtgctgctct

SEQ ID NO: 2339174 - DNA, 22 bp, Homo sapiens
tagctctggaggtgctgctcta

SEQ ID NO: 2339175 - DNA, 15 bp, Homo sapiens
tagctgaagaattga

SEQ ID NO: 2339176 - DNA, 17 bp, Homo sapiens
tagctgccactttcacg

SEQ ID NO: 2339177 - DNA, 17 bp, Homo sapiens
tagctgtacttcttgaa

SEQ ID NO: 2339178 - DNA, 13 bp, Homo sapiens
tagctgtatattt

SEQ ID NO: 2339179 - DNA, 17 bp, Homo sapiens
tagctgttctaattaag

SEQ ID NO: 2339180 - DNA, 20 bp, Homo sapiens
tagctgttctaattaagaaa

SEQ ID NO: 2339181 - DNA, 16 bp, Homo sapiens
tagcttctgcttttct

SEQ ID NO: 2339182 - DNA, 22 bp, Homo sapiens
tagcttctgcttttctgccctg

SEQ ID NO: 2339183 - DNA, 16 bp, Homo sapiens
tagctttagaccctgg

SEQ ID NO: 2339184 - DNA, 20 bp, Homo sapiens
taggaatcattcagaaatgt

SEQ ID NO: 2339185 - DNA, 22 bp, Homo sapiens
taggaatcattcagaaatgttg

SEQ ID NO: 2339186 - DNA, 16 bp, Homo sapiens
taggaatctcttcact

SEQ ID NO: 2339187 - DNA, 19 bp, Homo sapiens
taggacacagttcctggga

SEQ ID NO: 2339188 - DNA, 14 bp, Homo sapiens
taggagaggatgag

SEQ ID NO: 2339189 - DNA, 22 bp, Homo sapiens
taggattattgaaagagtctgg

SEQ ID NO: 2339190 - DNA, 12 bp, Homo sapiens
taggcagcctgc

SEQ ID NO: 2339191 - DNA, 12 bp, Homo sapiens
taggcagcttct

SEQ ID NO: 2339192 - DNA, 17 bp, Homo sapiens
tagggaagaaaaagcaa

SEQ ID NO: 2339193 - DNA, 13 bp, Homo sapiens
tagggccttggtt

SEQ ID NO: 2339194 - DNA, 20 bp, Homo sapiens
taggtagaagtgagcaaaaa

SEQ ID NO: 2339195 - DNA, 16 bp, Homo sapiens
taggtcatcatgaaag

SEQ ID NO: 2339196 - DNA, 20 bp, Homo sapiens
taggttaaaaaaaaaagtca

SEQ ID NO: 2339197 - DNA, 21 bp, Homo sapiens
tagtaaaagtggtctctgctg

SEQ ID NO: 2339198 - DNA, 23 bp, Homo sapiens
tagtaaaagtggtctctgctggg

SEQ ID NO: 2339199 - DNA, 11 bp, Homo sapiens
tagtaaatgtg

SEQ ID NO: 2339200 - DNA, 22 bp, Homo sapiens
tagtaagaataccacatcaaat

SEQ ID NO: 2339201 - DNA, 12 bp, Homo sapiens
tagtaagcatag

SEQ ID NO: 2339202 - DNA, 15 bp, Homo sapiens
tagtacaatttcaac

SEQ ID NO: 2339203 - DNA, 21 bp, Homo sapiens
tagtatagaagtctggaaaaa

SEQ ID NO: 2339204 - DNA, 13 bp, Homo sapiens
tagtatgaaaatg

SEQ ID NO: 2339205 - DNA, 15 bp, Homo sapiens
tagtattacaccacc

SEQ ID NO: 2339206 - DNA, 22 bp, Homo sapiens
tagtattatcttgttcaggaaa

SEQ ID NO: 2339207 - DNA, 22 bp, Homo sapiens
tagtcctgacactgaatttttc

SEQ ID NO: 2339208 - DNA, 13 bp, Homo sapiens
tagtctctgccct

SEQ ID NO: 2339209 - DNA, 17 bp, Homo sapiens
tagtcttgacgaatatt

SEQ ID NO: 2339210 - DNA, 23 bp, Homo sapiens
tagtcttggaagctgtttggaaa

SEQ ID NO: 2339211 - DNA, 19 bp, Homo sapiens
tagtgaggaagacaagcat

SEQ ID NO: 2339212 - DNA, 16 bp, Homo sapiens
tagtgatagatgtagt

SEQ ID NO: 2339213 - DNA, 19 bp, Homo sapiens
tagtgatgatggttcacgt

SEQ ID NO: 2339214 - DNA, 15 bp, Homo sapiens
tagtggatggaatat

SEQ ID NO: 2339215 - DNA, 14 bp, Homo sapiens
tagtggtctttgta

SEQ ID NO: 2339216 - DNA, 18 bp, Homo sapiens
tagtggtctttgtaagag

SEQ ID NO: 2339217 - DNA, 23 bp, Homo sapiens
tagtgtaacttgcttaaatttct

SEQ ID NO: 2339218 - DNA, 17 bp, Homo sapiens
tagtgtgaaatatatta

SEQ ID NO: 2339219 - DNA, 17 bp, Homo sapiens
tagtgtttctagctaaa

SEQ ID NO: 2339220 - DNA, 20 bp, Homo sapiens
tagttaatcatcaagagaat

SEQ ID NO: 2339221 - DNA, 22 bp, Homo sapiens
tagttactaaacatgtatgtaa

SEQ ID NO: 2339222 - DNA, 14 bp, Homo sapiens
tagttccagtttct

SEQ ID NO: 2339223 - DNA, 16 bp, Homo sapiens
tagttccagtttctcc

SEQ ID NO: 2339224 - DNA, 20 bp, Homo sapiens
tagttccagtttctccttga

SEQ ID NO: 2339225 - DNA, 18 bp, Homo sapiens
tagttctgtaataaaact

SEQ ID NO: 2339226 - DNA, 20 bp, Homo sapiens
tagttctgtaataaaactgt

SEQ ID NO: 2339227 - DNA, 22 bp, Homo sapiens
tagttgcaaagagacatttcaa

SEQ ID NO: 2339228 - DNA, 19 bp, Homo sapiens
tagttgctatttttgtaaa

SEQ ID NO: 2339229 - DNA, 15 bp, Homo sapiens
tagttgggatgccaa

SEQ ID NO: 2339230 - DNA, 22 bp, Homo sapiens
tagttgggatgccaatttcctc

SEQ ID NO: 2339231 - DNA, 22 bp, Homo sapiens
tataaaaaatcatgccagtatt

SEQ ID NO: 2339232 - DNA, 20 bp, Homo sapiens
tataaaattatgagattggt

SEQ ID NO: 2339233 - DNA, 20 bp, Homo sapiens
tataaacaataaaaacaact

SEQ ID NO: 2339234 - DNA, 16 bp, Homo sapiens
tataaacagaaatgga

SEQ ID NO: 2339235 - DNA, 17 bp, Homo sapiens
tataaacagaaatggaa

SEQ ID NO: 2339236 - DNA, 17 bp, Homo sapiens
tataaacttaaagctac

SEQ ID NO: 2339237 - DNA, 19 bp, Homo sapiens
tataaagtggaagtatgta

SEQ ID NO: 2339238 - DNA, 13 bp, Homo sapiens
tataaataggaga

SEQ ID NO: 2339239 - DNA, 17 bp, Homo sapiens
tataaataggagaggat

SEQ ID NO: 2339240 - DNA, 12 bp, Homo sapiens
tataaatgtaca

SEQ ID NO: 2339241 - DNA, 23 bp, Homo sapiens
tataaatgtacatttccaaatga

SEQ ID NO: 2339242 - DNA, 12 bp, Homo sapiens
tataaatgtata

SEQ ID NO: 2339243 - DNA, 22 bp, Homo sapiens
tataacctagttaaagaaagga

SEQ ID NO: 2339244 - DNA, 13 bp, Homo sapiens
tataagcttaaat

SEQ ID NO: 2339245 - DNA, 15 bp, Homo sapiens
tataagcttaaatag

SEQ ID NO: 2339246 - DNA, 20 bp, Homo sapiens
tataagtagtaaatcagaaa

SEQ ID NO: 2339247 - DNA, 21 bp, Homo sapiens
tataagtagtaaatcagaaag

SEQ ID NO: 2339248 - DNA, 21 bp, Homo sapiens
tataagttatttttgtacatg

SEQ ID NO: 2339249 - DNA, 13 bp, Homo sapiens
tataataaaaata

SEQ ID NO: 2339250 - DNA, 23 bp, Homo sapiens
tataatgattaagggacatttct

SEQ ID NO: 2339251 - DNA, 17 bp, Homo sapiens
tataatgtttattaaat

SEQ ID NO: 2339252 - DNA, 16 bp, Homo sapiens
tataattgtacaaaat

SEQ ID NO: 2339253 - DNA, 14 bp, Homo sapiens
tatacacacacaca

SEQ ID NO: 2339254 - DNA, 22 bp, Homo sapiens
tatacagtatagatttttgggt

SEQ ID NO: 2339255 - DNA, 17 bp, Homo sapiens
tatacattttctaaata

SEQ ID NO: 2339256 - DNA, 18 bp, Homo sapiens
tataccacattttcttta

SEQ ID NO: 2339257 - DNA, 20 bp, Homo sapiens
tatactaagagtaaagcaac

SEQ ID NO: 2339258 - DNA, 20 bp, Homo sapiens
tatactccttaaaaatgtat

SEQ ID NO: 2339259 - DNA, 16 bp, Homo sapiens
tatactgcatactttt

SEQ ID NO: 2339260 - DNA, 17 bp, Homo sapiens
tatagacattctcacat

SEQ ID NO: 2339261 - DNA, 17 bp, Homo sapiens
tatagcaactaatgttt

SEQ ID NO: 2339262 - DNA, 19 bp, Homo sapiens
tatagcactgagctcacat

SEQ ID NO: 2339263 - DNA, 21 bp, Homo sapiens
tatagcatcttctcattccca

SEQ ID NO: 2339264 - DNA, 15 bp, Homo sapiens
tatagcttgcagaac

SEQ ID NO: 2339265 - DNA, 17 bp, Homo sapiens
tataggcagcttctaag

SEQ ID NO: 2339266 - DNA, 17 bp, Homo sapiens
tataggctattttctaa

SEQ ID NO: 2339267 - DNA, 18 bp, Homo sapiens
tataggtttgattcaaca

SEQ ID NO: 2339268 - DNA, 14 bp, Homo sapiens
tatagtaaatgtgt

SEQ ID NO: 2339269 - DNA, 20 bp, Homo sapiens
tatagtaatgtgacttggat

SEQ ID NO: 2339270 - DNA, 20 bp, Homo sapiens
tatagtctaagactatatat

SEQ ID NO: 2339271 - DNA, 16 bp, Homo sapiens
tatagttttactttta

SEQ ID NO: 2339272 - DNA, 23 bp, Homo sapiens
tatagttttacttttaaactgtg

SEQ ID NO: 2339273 - DNA, 12 bp, Homo sapiens
tattttcctaaa

SEQ ID NO: 2339274 - DNA, 14 bp, Homo sapiens
tattttctacgttt

SEQ ID NO: 2339275 - DNA, 17 bp, Homo sapiens
tattttgtgtgaaattg

SEQ ID NO: 2339276 - DNA, 15 bp, Homo sapiens
tatttttaaaggcat

SEQ ID NO: 2339277 - DNA, 20 bp, Homo sapiens
tatttttataattgtacaaa

SEQ ID NO: 2339278 - DNA, 19 bp, Homo sapiens
tatttttatatcatgcaaa

SEQ ID NO: 2339279 - DNA, 12 bp, Homo sapiens
tatttttatctt

SEQ ID NO: 2339280 - DNA, 15 bp, Homo sapiens
tatttttcaaggcat

SEQ ID NO: 2339281 - DNA, 15 bp, Homo sapiens
tatttttctctttgt

SEQ ID NO: 2339282 - DNA, 16 bp, Homo sapiens
tatttttgtaaagttt

SEQ ID NO: 2339283 - DNA, 13 bp, Homo sapiens
tatttttgtacat

SEQ ID NO: 2339284 - DNA, 17 bp, Homo sapiens
tattttttcagactgtg

SEQ ID NO: 2339285 - DNA, 16 bp, Homo sapiens
tatttttttaaaattt

SEQ ID NO: 2339286 - DNA, 19 bp, Homo sapiens
tatttttttttctaagaga

SEQ ID NO: 2339287 - DNA, 16 bp, Homo sapiens
tattttttttttcttc

SEQ ID NO: 2339288 - DNA, 21 bp, Homo sapiens
tattttttttttcttcttggg

SEQ ID NO: 2339289 - DNA, 14 bp, Homo sapiens
tcaaaaaaacaaaa

SEQ ID NO: 2339290 - DNA, 12 bp, Homo sapiens
tcaaaaaattat

SEQ ID NO: 2339291 - DNA, 16 bp, Homo sapiens
tcaaaaaccagccagg

SEQ ID NO: 2339292 - DNA, 19 bp, Homo sapiens
tcaaaaagaactaaatatg

SEQ ID NO: 2339293 - DNA, 19 bp, Homo sapiens
tcaaacaagtatgaatcta

SEQ ID NO: 2339294 - DNA, 22 bp, Homo sapiens
tcaaacaagtatgaatctagtt

SEQ ID NO: 2339295 - DNA, 19 bp, Homo sapiens
tcaaactgaggaatttcac

SEQ ID NO: 2339296 - DNA, 16 bp, Homo sapiens
tcaaagagattcgaat

SEQ ID NO: 2339297 - DNA, 21 bp, Homo sapiens
tcaaagatgccccattccttg

SEQ ID NO: 2339298 - DNA, 21 bp, Homo sapiens
tcaaagcagaagtctggcttt

SEQ ID NO: 2339299 - DNA, 22 bp, Homo sapiens
tcaaagcatggacatttagaag

SEQ ID NO: 2339300 - DNA, 11 bp, Homo sapiens
tcaaagccttc

SEQ ID NO: 2339301 - DNA, 18 bp, Homo sapiens
tcaaaggagctttctcaa

SEQ ID NO: 2339302 - DNA, 13 bp, Homo sapiens
tcaaagggcagtt

SEQ ID NO: 2339303 - DNA, 17 bp, Homo sapiens
tcaaagggcagttttga

SEQ ID NO: 2339304 - DNA, 13 bp, Homo sapiens
tcaaagtcattaa

SEQ ID NO: 2339305 - DNA, 14 bp, Homo sapiens
tcaaagttttgaaa

SEQ ID NO: 2339306 - DNA, 19 bp, Homo sapiens
tcaaagttttgaaaagcta

SEQ ID NO: 2339307 - DNA, 13 bp, Homo sapiens
tcaaagttttgtt

SEQ ID NO: 2339308 - DNA, 13 bp, Homo sapiens
tcaaataagaaat

SEQ ID NO: 2339309 - DNA, 19 bp, Homo sapiens
tcaaataatgcttttctaa

SEQ ID NO: 2339310 - DNA, 21 bp, Homo sapiens
tcaaataatgcttttctaatt

SEQ ID NO: 2339311 - DNA, 17 bp, Homo sapiens
tcaaatacacatttgct

SEQ ID NO: 2339312 - DNA, 20 bp, Homo sapiens
tcaaatgaaatgtatgcatt

SEQ ID NO: 2339313 - DNA, 14 bp, Homo sapiens
tcaaattttttgac

SEQ ID NO: 2339314 - DNA, 16 bp, Homo sapiens
tcaaattttttgactt

SEQ ID NO: 2339315 - DNA, 21 bp, Homo sapiens
tcaacactcttcttgagcaga

SEQ ID NO: 2339316 - DNA, 14 bp, Homo sapiens
tcaacagaacatat

SEQ ID NO: 2339317 - DNA, 16 bp, Homo sapiens
tcaaccatcgctttat

SEQ ID NO: 2339318 - DNA, 16 bp, Homo sapiens
tcaacccttctggaaa

SEQ ID NO: 2339319 - DNA, 15 bp, Homo sapiens
tcaaccgtacaatgg

SEQ ID NO: 2339320 - DNA, 21 bp, Homo sapiens
tcaactgaaggggtgcaccca

SEQ ID NO: 2339321 - DNA, 13 bp, Homo sapiens
tcaactttgtaaa

SEQ ID NO: 2339322 - DNA, 19 bp, Homo sapiens
tcaactttgtaaaaatctt

SEQ ID NO: 2339323 - DNA, 18 bp, Homo sapiens
tcaagaagatagttgtaa

SEQ ID NO: 2339324 - DNA, 23 bp, Homo sapiens
tcaagaagatagttgtaaagata

SEQ ID NO: 2339325 - DNA, 21 bp, Homo sapiens
tcaagaatgaaaaatataatg

SEQ ID NO: 2339326 - DNA, 22 bp, Homo sapiens
tcaagacccccatttgtcccag

SEQ ID NO: 2339327 - DNA, 12 bp, Homo sapiens
tcaagagaaact

SEQ ID NO: 2339328 - DNA, 16 bp, Homo sapiens
tcaagagaaacttcaa

SEQ ID NO: 2339329 - DNA, 19 bp, Homo sapiens
tcaagagtccggatttcta

SEQ ID NO: 2339330 - DNA, 21 bp, Homo sapiens
tcaagagtccggatttctaac

SEQ ID NO: 2339331 - DNA, 23 bp, Homo sapiens
tcaagagtgagatgtagaaagtt

SEQ ID NO: 2339332 - DNA, 14 bp, Homo sapiens
tcaagattctaaag

SEQ ID NO: 2339333 - DNA, 18 bp, Homo sapiens
tcaagattctaaagctca

SEQ ID NO: 2339334 - DNA, 19 bp, Homo sapiens
tcaagattctaaagctcaa

SEQ ID NO: 2339335 - DNA, 20 bp, Homo sapiens
tcaagattctaaagctcaat

SEQ ID NO: 2339336 - DNA, 21 bp, Homo sapiens
tcaagcaatccacctgccttg

SEQ ID NO: 2339337 - DNA, 22 bp, Homo sapiens
tcaagcaatccacctgccttgg

SEQ ID NO: 2339338 - DNA, 18 bp, Homo sapiens
tcaagcaatcctcctgcc

SEQ ID NO: 2339339 - DNA, 23 bp, Homo sapiens
tcaagccccaccacatagcatgc

SEQ ID NO: 2339340 - DNA, 24 bp, Homo sapiens
tcaagccccaccacatagcatgct

SEQ ID NO: 2339341 - DNA, 16 bp, Homo sapiens
tcaagccttccaggga

SEQ ID NO: 2339342 - DNA, 21 bp, Homo sapiens
tcaagcttttgcttgatccag

SEQ ID NO: 2339343 - DNA, 22 bp, Homo sapiens
tcaagcttttgcttgatccaga

SEQ ID NO: 2339344 - DNA, 15 bp, Homo sapiens
tcaagggctgtcatt

SEQ ID NO: 2339345 - DNA, 18 bp, Homo sapiens
tcaagtaagaagacatga

SEQ ID NO: 2339346 - DNA, 14 bp, Homo sapiens
tcaagtaatattgg

SEQ ID NO: 2339347 - DNA, 20 bp, Homo sapiens
tcaagtatactaagagtaaa

SEQ ID NO: 2339348 - DNA, 22 bp, Homo sapiens
tcaagttctggacctgggcatg

SEQ ID NO: 2339349 - DNA, 14 bp, Homo sapiens
tcaagttgtacatt

SEQ ID NO: 2339350 - DNA, 15 bp, Homo sapiens
tcaagttttaaagtt

SEQ ID NO: 2339351 - DNA, 16 bp, Homo sapiens
tcaataaatgtctgtt

SEQ ID NO: 2339352 - DNA, 19 bp, Homo sapiens
tcaatactcttaaatttta

SEQ ID NO: 2339353 - DNA, 12 bp, Homo sapiens
tcaatagttgaa

SEQ ID NO: 2339354 - DNA, 17 bp, Homo sapiens
tcaatatattgaacttt

SEQ ID NO: 2339355 - DNA, 15 bp, Homo sapiens
tcaatcacagtctca

SEQ ID NO: 2339356 - DNA, 16 bp, Homo sapiens
tcaatctgtaaactgt

SEQ ID NO: 2339357 - DNA, 16 bp, Homo sapiens
tcaatgaaccataaat

SEQ ID NO: 2339358 - DNA, 20 bp, Homo sapiens
tcaatgaccattcaattagt

SEQ ID NO: 2339359 - DNA, 19 bp, Homo sapiens
tcaatgagagcataattta

SEQ ID NO: 2339360 - DNA, 20 bp, Homo sapiens
tcaattagcgtttaaggtga

SEQ ID NO: 2339361 - DNA, 20 bp, Homo sapiens
tcaattagtaacattcatgt

SEQ ID NO: 2339362 - DNA, 19 bp, Homo sapiens
tcaattagtggtcataaaa

SEQ ID NO: 2339363 - DNA, 21 bp, Homo sapiens
tcaattagtggtcataaaata

SEQ ID NO: 2339364 - DNA, 17 bp, Homo sapiens
tcaattttagttgtcaa

SEQ ID NO: 2339365 - DNA, 14 bp, Homo sapiens
tcacaataaaagct

SEQ ID NO: 2339366 - DNA, 19 bp, Homo sapiens
tcacacctcacgctctgga

SEQ ID NO: 2339367 - DNA, 16 bp, Homo sapiens
tcacaggctgagaact

SEQ ID NO: 2339368 - DNA, 15 bp, Homo sapiens
tcacagtagagccag

SEQ ID NO: 2339369 - DNA, 18 bp, Homo sapiens
tcacagtagagccagctt

SEQ ID NO: 2339370 - DNA, 19 bp, Homo sapiens
tcacagtagagccagcttg

SEQ ID NO: 2339371 - DNA, 20 bp, Homo sapiens
tcacagtagagccagcttgg

SEQ ID NO: 2339372 - DNA, 21 bp, Homo sapiens
tcacagtagagccagcttggg

SEQ ID NO: 2339373 - DNA, 16 bp, Homo sapiens
tcacagtccaaccaga

SEQ ID NO: 2339374 - DNA, 14 bp, Homo sapiens
tcacagtgttgcat

SEQ ID NO: 2339375 - DNA, 22 bp, Homo sapiens
tcacataggaagggatctgaga

SEQ ID NO: 2339376 - DNA, 13 bp, Homo sapiens
tcacatccatccc

SEQ ID NO: 2339377 - DNA, 16 bp, Homo sapiens
tcacatggcctatgca

SEQ ID NO: 2339378 - DNA, 18 bp, Homo sapiens
tcacattaatctcaaaga

SEQ ID NO: 2339379 - DNA, 19 bp, Homo sapiens
tcacatttagaaaagtgaa

SEQ ID NO: 2339380 - DNA, 11 bp, Homo sapiens
tcacattttcc

SEQ ID NO: 2339381 - DNA, 15 bp, Homo sapiens
tcaccaatcatagtg

SEQ ID NO: 2339382 - DNA, 21 bp, Homo sapiens
tcaccagccccactgccagca

SEQ ID NO: 2339383 - DNA, 11 bp, Homo sapiens
tcaccagccct

SEQ ID NO: 2339384 - DNA, 18 bp, Homo sapiens
tcaccagccctgcagccc

SEQ ID NO: 2339385 - DNA, 15 bp, Homo sapiens
tcaccatgatgtgaa

SEQ ID NO: 2339386 - DNA, 17 bp, Homo sapiens
tcaccatgtaagcactc

SEQ ID NO: 2339387 - DNA, 21 bp, Homo sapiens
tcaccatgtaagcactctgga

SEQ ID NO: 2339388 - DNA, 14 bp, Homo sapiens
tccagatgtggcta

SEQ ID NO: 2339389 - DNA, 14 bp, Homo sapiens
tccagattctgatg

SEQ ID NO: 2339390 - DNA, 18 bp, Homo sapiens
tccagcaacttcttctcc

SEQ ID NO: 2339391 - DNA, 20 bp, Homo sapiens
tccagcaacttcttctccat

SEQ ID NO: 2339392 - DNA, 22 bp, Homo sapiens
tccagcacatccccctctcctc

SEQ ID NO: 2339393 - DNA, 15 bp, Homo sapiens
tccagccatctcatg

SEQ ID NO: 2339394 - DNA, 23 bp, Homo sapiens
tccagcctcatgggaagtcctgg

SEQ ID NO: 2339395 - DNA, 13 bp, Homo sapiens
tccagctggcctg

SEQ ID NO: 2339396 - DNA, 18 bp, Homo sapiens
tccagctggcctggacag

SEQ ID NO: 2339397 - DNA, 19 bp, Homo sapiens
tccagctggggccagaggc

SEQ ID NO: 2339398 - DNA, 23 bp, Homo sapiens
tccaggaaactccacatctgcct

SEQ ID NO: 2339399 - DNA, 20 bp, Homo sapiens
tccaggaaagagcagtcaga

SEQ ID NO: 2339400 - DNA, 23 bp, Homo sapiens
tccaggacaccacgattctccca

SEQ ID NO: 2339401 - DNA, 23 bp, Homo sapiens
tccaggagcttcttgtttccttg

SEQ ID NO: 2339402 - DNA, 21 bp, Homo sapiens
tccaggcaccaggactagggc

SEQ ID NO: 2339403 - DNA, 15 bp, Homo sapiens
tccaggcagctccct

SEQ ID NO: 2339404 - DNA, 19 bp, Homo sapiens
tccaggcctgcctcccact

SEQ ID NO: 2339405 - DNA, 17 bp, Homo sapiens
tccaggcttctgctggg

SEQ ID NO: 2339406 - DNA, 14 bp, Homo sapiens
tccagggaatccaa

SEQ ID NO: 2339407 - DNA, 18 bp, Homo sapiens
tccagggaatccaagcct

SEQ ID NO: 2339408 - DNA, 21 bp, Homo sapiens
tccagtcttcctgacacttta

SEQ ID NO: 2339409 - DNA, 22 bp, Homo sapiens
tccagtcttcctgacactttaa

SEQ ID NO: 2339410 - DNA, 23 bp, Homo sapiens
tccagtcttcctgacactttaat

SEQ ID NO: 2339411 - DNA, 23 bp, Homo sapiens
tccagtgaacattcccagcccag

SEQ ID NO: 2339412 - DNA, 14 bp, Homo sapiens
tccagtgcaattgt

SEQ ID NO: 2339413 - DNA, 10 bp, Homo sapiens
tccagtgcct

SEQ ID NO: 2339414 - DNA, 11 bp, Homo sapiens
tccagtgccta

SEQ ID NO: 2339415 - DNA, 14 bp, Homo sapiens
tccagtgctctgcc

SEQ ID NO: 2339416 - DNA, 16 bp, Homo sapiens
tccagtgctctgcctc

SEQ ID NO: 2339417 - DNA, 15 bp, Homo sapiens
tccagtggactctgg

SEQ ID NO: 2339418 - DNA, 13 bp, Homo sapiens
tccagttataaga

SEQ ID NO: 2339419 - DNA, 15 bp, Homo sapiens
tccagttataagaag

SEQ ID NO: 2339420 - DNA, 20 bp, Homo sapiens
tccagttcatcgattttcta

SEQ ID NO: 2339421 - DNA, 16 bp, Homo sapiens
tccagttttctcctct

SEQ ID NO: 2339422 - DNA, 16 bp, Homo sapiens
tccataaacatgaaaa

SEQ ID NO: 2339423 - DNA, 18 bp, Homo sapiens
tccataaagtacaaatga

SEQ ID NO: 2339424 - DNA, 17 bp, Homo sapiens
tccataaatccttgatg

SEQ ID NO: 2339425 - DNA, 15 bp, Homo sapiens
tccatacttctctca

SEQ ID NO: 2339426 - DNA, 17 bp, Homo sapiens
tccatacttctctcaga

SEQ ID NO: 2339427 - DNA, 21 bp, Homo sapiens
tccatagagatgagcccaccc

SEQ ID NO: 2339428 - DNA, 13 bp, Homo sapiens
tccatatcctggt

SEQ ID NO: 2339429 - DNA, 21 bp, Homo sapiens
tccatcaggtgaggtgtgctc

SEQ ID NO: 2339430 - DNA, 14 bp, Homo sapiens
tccatccatccttc

SEQ ID NO: 2339431 - DNA, 16 bp, Homo sapiens
tccatccctccattca

SEQ ID NO: 2339432 - DNA, 18 bp, Homo sapiens
tccatgcgtgtttctgac

SEQ ID NO: 2339433 - DNA, 20 bp, Homo sapiens
tccatgcgtgtttctgactc

SEQ ID NO: 2339434 - DNA, 21 bp, Homo sapiens
tccatgcgtgtttctgactct

SEQ ID NO: 2339435 - DNA, 19 bp, Homo sapiens
tccatggccctgtcccagg

SEQ ID NO: 2339436 - DNA, 20 bp, Homo sapiens
tccatggccctgtcccaggc

SEQ ID NO: 2339437 - DNA, 17 bp, Homo sapiens
tccatgggaaagatggt

SEQ ID NO: 2339438 - DNA, 15 bp, Homo sapiens
tccatgttctatttt

SEQ ID NO: 2339439 - DNA, 16 bp, Homo sapiens
tccattacctccatcc

SEQ ID NO: 2339440 - DNA, 17 bp, Homo sapiens
tccattacctccatcca

SEQ ID NO: 2339441 - DNA, 16 bp, Homo sapiens
tccattctcccaggta

SEQ ID NO: 2339442 - DNA, 16 bp, Homo sapiens
tccattggatctgcaa

SEQ ID NO: 2339443 - DNA, 19 bp, Homo sapiens
tccatttccattgcttatt

SEQ ID NO: 2339444 - DNA, 22 bp, Homo sapiens
tcccaacctctttttcctcctg

SEQ ID NO: 2339445 - DNA, 17 bp, Homo sapiens
tcccaaggttggagccc

SEQ ID NO: 2339446 - DNA, 23 bp, Homo sapiens
tcccaaggttggagcccagggca

SEQ ID NO: 2339447 - DNA, 21 bp, Homo sapiens
tcccacaaataagttcccatt

SEQ ID NO: 2339448 - DNA, 23 bp, Homo sapiens
tcccacatccaactccagcaact

SEQ ID NO: 2339449 - DNA, 15 bp, Homo sapiens
tcccacatgcctgcg

SEQ ID NO: 2339450 - DNA, 22 bp, Homo sapiens
tcccacatgcctgcgcctgctg

SEQ ID NO: 2339451 - DNA, 13 bp, Homo sapiens
tcccacatgggcc

SEQ ID NO: 2339452 - DNA, 16 bp, Homo sapiens
tcccacatgggcccag

SEQ ID NO: 2339453 - DNA, 22 bp, Homo sapiens
tcccacatgggcccaggcctca

SEQ ID NO: 2339454 - DNA, 15 bp, Homo sapiens
tcccacccacatgtg

SEQ ID NO: 2339455 - DNA, 21 bp, Homo sapiens
tcccaccctcttcctactggt

SEQ ID NO: 2339456 - DNA, 21 bp, Homo sapiens
tcccaccctgcgggccagggt

SEQ ID NO: 2339457 - DNA, 20 bp, Homo sapiens
tcccacctcctgacaccctt

SEQ ID NO: 2339458 - DNA, 13 bp, Homo sapiens
tcccactccaagc

SEQ ID NO: 2339459 - DNA, 17 bp, Homo sapiens
tcccactccaagcccag

SEQ ID NO: 2339460 - DNA, 16 bp, Homo sapiens
tcccactctcctaggc

SEQ ID NO: 2339461 - DNA, 16 bp, Homo sapiens
tcccagcactttggga

SEQ ID NO: 2339462 - DNA, 23 bp, Homo sapiens
tcccagccccggcaagccacagg

SEQ ID NO: 2339463 - DNA, 16 bp, Homo sapiens
tcccagctacttggga

SEQ ID NO: 2339464 - DNA, 21 bp, Homo sapiens
tcccaggagatgggtccaggg

SEQ ID NO: 2339465 - DNA, 18 bp, Homo sapiens
tcccaggccggcccagat

SEQ ID NO: 2339466 - DNA, 19 bp, Homo sapiens
tcccaggccggcccagatg

SEQ ID NO: 2339467 - DNA, 18 bp, Homo sapiens
tcccagggcctcctgggg

SEQ ID NO: 2339468 - DNA, 17 bp, Homo sapiens
tcccaggtaccagctgc

SEQ ID NO: 2339469 - DNA, 21 bp, Homo sapiens
tcccaggtaccagctgcgctt

SEQ ID NO: 2339470 - DNA, 18 bp, Homo sapiens
tcccagtgaactcctgcc

SEQ ID NO: 2339471 - DNA, 17 bp, Homo sapiens
tcccagtttctcagaag

SEQ ID NO: 2339472 - DNA, 12 bp, Homo sapiens
tcccattaaaaa

SEQ ID NO: 2339473 - DNA, 23 bp, Homo sapiens
tcccatttccttgtctaaagatc

SEQ ID NO: 2339474 - DNA, 17 bp, Homo sapiens
tcccatttgtgccagag

SEQ ID NO: 2339475 - DNA, 14 bp, Homo sapiens
tccccaaaggcatc

SEQ ID NO: 2339476 - DNA, 23 bp, Homo sapiens
tccccaaatcaatacactagttg

SEQ ID NO: 2339477 - DNA, 17 bp, Homo sapiens
tccccacagcgtccctg

SEQ ID NO: 2339478 - DNA, 18 bp, Homo sapiens
tccccacagcgtccctgg

SEQ ID NO: 2339479 - DNA, 16 bp, Homo sapiens
tccccacccctgcccc

SEQ ID NO: 2339480 - DNA, 15 bp, Homo sapiens
tccccagagctgcct

SEQ ID NO: 2339481 - DNA, 19 bp, Homo sapiens
tccccaggctggagacccc

SEQ ID NO: 2339482 - DNA, 14 bp, Homo sapiens
tccccatctccctg

SEQ ID NO: 2339483 - DNA, 19 bp, Homo sapiens
tccccatctccctgcctgg

SEQ ID NO: 2339484 - DNA, 17 bp, Homo sapiens
tccccatctgtccagct

SEQ ID NO: 2339485 - DNA, 19 bp, Homo sapiens
tccccatttcccatctgca

SEQ ID NO: 2339486 - DNA, 15 bp, Homo sapiens
tccccatttctgcct

SEQ ID NO: 2339487 - DNA, 16 bp, Homo sapiens
tccccatttctgcctc

SEQ ID NO: 2339488 - DNA, 17 bp, Homo sapiens
tccccatttctgcctcg

SEQ ID NO: 2339489 - DNA, 19 bp, Homo sapiens
tccccatttctgcctcgct

SEQ ID NO: 2339490 - DNA, 19 bp, Homo sapiens
tcccccaccggtccagctg

SEQ ID NO: 2339491 - DNA, 20 bp, Homo sapiens
tcccccaccggtccagctgg

SEQ ID NO: 2339492 - DNA, 22 bp, Homo sapiens
tcccccaccggtccagctggcc

SEQ ID NO: 2339493 - DNA, 17 bp, Homo sapiens
tccccctaaacatggct

SEQ ID NO: 2339494 - DNA, 13 bp, Homo sapiens
tccccctccccag

SEQ ID NO: 2339495 - DNA, 21 bp, Homo sapiens
tccccctctcctctcccccag

SEQ ID NO: 2339496 - DNA, 13 bp, Homo sapiens
tccccgcctggcc

SEQ ID NO: 2339497 - DNA, 15 bp, Homo sapiens
tccccgcctggccag

SEQ ID NO: 2339498 - DNA, 13 bp, Homo sapiens
tcccctcccagag

SEQ ID NO: 2339499 - DNA, 16 bp, Homo sapiens
tcccctccggactggt

SEQ ID NO: 2339500 - DNA, 17 bp, Homo sapiens
tcccctccggactggtg

SEQ ID NO: 2339501 - DNA, 15 bp, Homo sapiens
tcccctctcagaaca

SEQ ID NO: 2339502 - DNA, 16 bp, Homo sapiens
tctaagaaaatgtagt

SEQ ID NO: 2339503 - DNA, 23 bp, Homo sapiens
tctaagactatatatataaatgt

SEQ ID NO: 2339504 - DNA, 17 bp, Homo sapiens
tctaatacctctgtgtg

SEQ ID NO: 2339505 - DNA, 14 bp, Homo sapiens
tctaatcacagtgt

SEQ ID NO: 2339506 - DNA, 18 bp, Homo sapiens
tctaattaagaaaactat

SEQ ID NO: 2339507 - DNA, 20 bp, Homo sapiens
tctaattgtaagtgaaatta

SEQ ID NO: 2339508 - DNA, 21 bp, Homo sapiens
tctaattgtaagtgaaattaa

SEQ ID NO: 2339509 - DNA, 22 bp, Homo sapiens
tctaattgtaagtgaaattaag

SEQ ID NO: 2339510 - DNA, 22 bp, Homo sapiens
tctaatttgaactggtattgtt

SEQ ID NO: 2339511 - DNA, 13 bp, Homo sapiens
tctacaagccaaa

SEQ ID NO: 2339512 - DNA, 16 bp, Homo sapiens
tctacaatacaacaca

SEQ ID NO: 2339513 - DNA, 16 bp, Homo sapiens
tctacaatgacacaca

SEQ ID NO: 2339514 - DNA, 21 bp, Homo sapiens
tctacagtggttttatactga

SEQ ID NO: 2339515 - DNA, 13 bp, Homo sapiens
tctacagtgtcct

SEQ ID NO: 2339516 - DNA, 18 bp, Homo sapiens
tctaccggagagagaatg

SEQ ID NO: 2339517 - DNA, 18 bp, Homo sapiens
tctacctgccctcaaggg

SEQ ID NO: 2339518 - DNA, 15 bp, Homo sapiens
tctacctggtctggt

SEQ ID NO: 2339519 - DNA, 16 bp, Homo sapiens
tctaccttcctgtccc

SEQ ID NO: 2339520 - DNA, 22 bp, Homo sapiens
tctaccttcctgtccctgaggt

SEQ ID NO: 2339521 - DNA, 14 bp, Homo sapiens
tctacgtttcttta

SEQ ID NO: 2339522 - DNA, 20 bp, Homo sapiens
tctactcaacccattgttgt

SEQ ID NO: 2339523 - DNA, 22 bp, Homo sapiens
tctactcaacccattgttgtca

SEQ ID NO: 2339524 - DNA, 17 bp, Homo sapiens
tctagaagccaagggaa

SEQ ID NO: 2339525 - DNA, 23 bp, Homo sapiens
tctagaagccaagggaaaggggt

SEQ ID NO: 2339526 - DNA, 14 bp, Homo sapiens
tctagaccaataaa

SEQ ID NO: 2339527 - DNA, 23 bp, Homo sapiens
tctagaggtcaggacggctcctc

SEQ ID NO: 2339528 - DNA, 20 bp, Homo sapiens
tctaggcccattgtcctcct

SEQ ID NO: 2339529 - DNA, 21 bp, Homo sapiens
tctaggcccattgtcctcctt

SEQ ID NO: 2339530 - DNA, 23 bp, Homo sapiens
tctagggactgccaggctgtttc

SEQ ID NO: 2339531 - DNA, 20 bp, Homo sapiens
tctaggtaggaagagcccgc

SEQ ID NO: 2339532 - DNA, 22 bp, Homo sapiens
tctagtatttatgggtggattt

SEQ ID NO: 2339533 - DNA, 15 bp, Homo sapiens
tctagtgacttcctg

SEQ ID NO: 2339534 - DNA, 18 bp, Homo sapiens
tctagtgaggaagacaag

SEQ ID NO: 2339535 - DNA, 16 bp, Homo sapiens
tctagtggtctttgta

SEQ ID NO: 2339536 - DNA, 20 bp, Homo sapiens
tctagttctcaatcactgct

SEQ ID NO: 2339537 - DNA, 22 bp, Homo sapiens
tctagttctcaatcactgctcc

SEQ ID NO: 2339538 - DNA, 22 bp, Homo sapiens
tctagttggttgatgccttttt

SEQ ID NO: 2339539 - DNA, 12 bp, Homo sapiens
tctataaaactc

SEQ ID NO: 2339540 - DNA, 16 bp, Homo sapiens
tctataaaactctgca

SEQ ID NO: 2339541 - DNA, 22 bp, Homo sapiens
tctataagtagtaaatcagaaa

SEQ ID NO: 2339542 - DNA, 15 bp, Homo sapiens
tctataggcagcttc

SEQ ID NO: 2339543 - DNA, 16 bp, Homo sapiens
tctataggcagcttct

SEQ ID NO: 2339544 - DNA, 18 bp, Homo sapiens
tctatattagatcaaata

SEQ ID NO: 2339545 - DNA, 14 bp, Homo sapiens
tctatccatctcct

SEQ ID NO: 2339546 - DNA, 14 bp, Homo sapiens
tctatgacaaattc

SEQ ID NO: 2339547 - DNA, 15 bp, Homo sapiens
tctatgacaaattca

SEQ ID NO: 2339548 - DNA, 14 bp, Homo sapiens
tctattaatatcaa

SEQ ID NO: 2339549 - DNA, 22 bp, Homo sapiens
tctattaatatcaactctgaag

SEQ ID NO: 2339550 - DNA, 16 bp, Homo sapiens
tctattaatattcagg

SEQ ID NO: 2339551 - DNA, 23 bp, Homo sapiens
tctattaatcaagagaaacttca

SEQ ID NO: 2339552 - DNA, 12 bp, Homo sapiens
tctattggtctc

SEQ ID NO: 2339553 - DNA, 17 bp, Homo sapiens
tctattttaattactgc

SEQ ID NO: 2339554 - DNA, 14 bp, Homo sapiens
tctattttcataat

SEQ ID NO: 2339555 - DNA, 16 bp, Homo sapiens
tctattttcataatca

SEQ ID NO: 2339556 - DNA, 16 bp, Homo sapiens
tctcaaagttttgaaa

SEQ ID NO: 2339557 - DNA, 22 bp, Homo sapiens
tctcaaataggctattaaaaaa

SEQ ID NO: 2339558 - DNA, 22 bp, Homo sapiens
tctcaagatgggggcagggctg

SEQ ID NO: 2339559 - DNA, 18 bp, Homo sapiens
tctcaagctagtgtttct

SEQ ID NO: 2339560 - DNA, 19 bp, Homo sapiens
tctcaagctagtgtttcta

SEQ ID NO: 2339561 - DNA, 20 bp, Homo sapiens
tctcaaggtgggccttgcta

SEQ ID NO: 2339562 - DNA, 22 bp, Homo sapiens
tctcaatcctaatttctcctcc

SEQ ID NO: 2339563 - DNA, 23 bp, Homo sapiens
tctcaatcctaatttctcctccc

SEQ ID NO: 2339564 - DNA, 21 bp, Homo sapiens
tctcaatgaaccataaattca

SEQ ID NO: 2339565 - DNA, 13 bp, Homo sapiens
tctcacaggctga

SEQ ID NO: 2339566 - DNA, 18 bp, Homo sapiens
tctcacaggctgagaact

SEQ ID NO: 2339567 - DNA, 15 bp, Homo sapiens
tctcagaagcacaga

SEQ ID NO: 2339568 - DNA, 17 bp, Homo sapiens
tctcagatttccacaga

SEQ ID NO: 2339569 - DNA, 18 bp, Homo sapiens
tctcagatttccacagag

SEQ ID NO: 2339570 - DNA, 19 bp, Homo sapiens
tctcagctggcagtgcaat

SEQ ID NO: 2339571 - DNA, 22 bp, Homo sapiens
tctcaggacagcatcccttccc

SEQ ID NO: 2339572 - DNA, 20 bp, Homo sapiens
tctcaggcaccagtccctgt

SEQ ID NO: 2339573 - DNA, 17 bp, Homo sapiens
tctcaggccaccacaga

SEQ ID NO: 2339574 - DNA, 14 bp, Homo sapiens
tctcagggctcggg

SEQ ID NO: 2339575 - DNA, 20 bp, Homo sapiens
tctcaggtttgttttgtgaa

SEQ ID NO: 2339576 - DNA, 21 bp, Homo sapiens
tctcaggtttgttttgtgaat

SEQ ID NO: 2339577 - DNA, 16 bp, Homo sapiens
tctcagtcatgcataa

SEQ ID NO: 2339578 - DNA, 20 bp, Homo sapiens
tctcagtcatgcataaatat

SEQ ID NO: 2339579 - DNA, 16 bp, Homo sapiens
tctcatgaggggagag

SEQ ID NO: 2339580 - DNA, 12 bp, Homo sapiens
tctcattatttc

SEQ ID NO: 2339581 - DNA, 14 bp, Homo sapiens
tctcattatttcaa

SEQ ID NO: 2339582 - DNA, 15 bp, Homo sapiens
tctcattatttcaaa

SEQ ID NO: 2339583 - DNA, 16 bp, Homo sapiens
tctcattatttcaaaa

SEQ ID NO: 2339584 - DNA, 13 bp, Homo sapiens
tctccaaccactg

SEQ ID NO: 2339585 - DNA, 21 bp, Homo sapiens
tctccagcgtcagctgctccc

SEQ ID NO: 2339586 - DNA, 19 bp, Homo sapiens
tctccatatctccatggcc

SEQ ID NO: 2339587 - DNA, 15 bp, Homo sapiens
tctccatctcccaag

SEQ ID NO: 2339588 - DNA, 23 bp, Homo sapiens
tctccatctcccaaggctgccag

SEQ ID NO: 2339589 - DNA, 12 bp, Homo sapiens
tctccatggccc

SEQ ID NO: 2339590 - DNA, 13 bp, Homo sapiens
tctccatggccct

SEQ ID NO: 2339591 - DNA, 19 bp, Homo sapiens
tctccatggccctgtccca

SEQ ID NO: 2339592 - DNA, 21 bp, Homo sapiens
tctccatggccctgtcccagg

SEQ ID NO: 2339593 - DNA, 16 bp, Homo sapiens
tctccattttcaagct

SEQ ID NO: 2339594 - DNA, 19 bp, Homo sapiens
tctcccaactcttgcacag

SEQ ID NO: 2339595 - DNA, 13 bp, Homo sapiens
tctcccaaggctg

SEQ ID NO: 2339596 - DNA, 13 bp, Homo sapiens
tctcccaccctct

SEQ ID NO: 2339597 - DNA, 19 bp, Homo sapiens
tctcccaccctcttcctac

SEQ ID NO: 2339598 - DNA, 19 bp, Homo sapiens
tctcccaggtaccagctgc

SEQ ID NO: 2339599 - DNA, 20 bp, Homo sapiens
tctcccagtgaactcctgcc

SEQ ID NO: 2339600 - DNA, 20 bp, Homo sapiens
tctccctagctcctcccctt

SEQ ID NO: 2339601 - DNA, 17 bp, Homo sapiens
tctccctcaactgaagg

SEQ ID NO: 2339602 - DNA, 23 bp, Homo sapiens
tctccctcaactgaaggggtgca

SEQ ID NO: 2339603 - DNA, 13 bp, Homo sapiens
tctccctgcctgg

SEQ ID NO: 2339604 - DNA, 14 bp, Homo sapiens
tctccctgcctggc

SEQ ID NO: 2339605 - DNA, 16 bp, Homo sapiens
tctccctgcctggccc

SEQ ID NO: 2339606 - DNA, 14 bp, Homo sapiens
tctccctggctccc

SEQ ID NO: 2339607 - DNA, 23 bp, Homo sapiens
tctccctggctccctcctccagg

SEQ ID NO: 2339608 - DNA, 15 bp, Homo sapiens
tctcccttgggctct

SEQ ID NO: 2339609 - DNA, 18 bp, Homo sapiens
tctcccttgggctctgat

SEQ ID NO: 2339610 - DNA, 20 bp, Homo sapiens
tctcccttgggctctgatga

SEQ ID NO: 2339611 - DNA, 14 bp, Homo sapiens
tctccgccagcctc

SEQ ID NO: 2339612 - DNA, 16 bp, Homo sapiens
tctccggggccatttg

SEQ ID NO: 2339613 - DNA, 15 bp, Homo sapiens
tctcctaggcattct

SEQ ID NO: 2339614 - DNA, 23 bp, Homo sapiens
tctcctaggcattctggacctct

SEQ ID NO: 2339615 - DNA, 14 bp, Homo sapiens
tctcctcccttcct

SEQ ID NO: 2339616 - DNA, 20 bp, Homo sapiens
tggggcaggctgggccatgt

SEQ ID NO: 2339617 - DNA, 17 bp, Homo sapiens
tggggcatcctgtgcca

SEQ ID NO: 2339618 - DNA, 23 bp, Homo sapiens
tggggccataaacggttcctggt

SEQ ID NO: 2339619 - DNA, 18 bp, Homo sapiens
tggggcctgactgctcag

SEQ ID NO: 2339620 - DNA, 12 bp, Homo sapiens
tggggcctggga

SEQ ID NO: 2339621 - DNA, 14 bp, Homo sapiens
tggggcctgggaca

SEQ ID NO: 2339622 - DNA, 18 bp, Homo sapiens
tggggccttgatgactgc

SEQ ID NO: 2339623 - DNA, 22 bp, Homo sapiens
tggggccttgatgactgccttg

SEQ ID NO: 2339624 - DNA, 18 bp, Homo sapiens
tggggctcgccccaccca

SEQ ID NO: 2339625 - DNA, 20 bp, Homo sapiens
tgggggacagaaagagactc

SEQ ID NO: 2339626 - DNA, 18 bp, Homo sapiens
tgggggcagcacaggagg

SEQ ID NO: 2339627 - DNA, 21 bp, Homo sapiens
tgggggcatctcttccccaga

SEQ ID NO: 2339628 - DNA, 20 bp, Homo sapiens
tggggggatggtaagagaaa

SEQ ID NO: 2339629 - DNA, 18 bp, Homo sapiens
tggggtgctgggaggagg

SEQ ID NO: 2339630 - DNA, 17 bp, Homo sapiens
tgggtatgctcaggtca

SEQ ID NO: 2339631 - DNA, 22 bp, Homo sapiens
tgggtatgctcaggtcaactga

SEQ ID NO: 2339632 - DNA, 17 bp, Homo sapiens
tgggtccaccctgtcct

SEQ ID NO: 2339633 - DNA, 19 bp, Homo sapiens
tgggtcctagcccttccct

SEQ ID NO: 2339634 - DNA, 22 bp, Homo sapiens
tgggtctaggacacagttcctg

SEQ ID NO: 2339635 - DNA, 23 bp, Homo sapiens
tgggtgacggtcctttaggcagc

SEQ ID NO: 2339636 - DNA, 15 bp, Homo sapiens
tgggtgggctctgtg

SEQ ID NO: 2339637 - DNA, 17 bp, Homo sapiens
tgggtgtatataatttt

SEQ ID NO: 2339638 - DNA, 15 bp, Homo sapiens
tgggtgtcctgcctg

SEQ ID NO: 2339639 - DNA, 19 bp, Homo sapiens
tgggtgtcctgcctgtctg

SEQ ID NO: 2339640 - DNA, 14 bp, Homo sapiens
tgggtgttctttcc

SEQ ID NO: 2339641 - DNA, 16 bp, Homo sapiens
tgggtgttctttcctg

SEQ ID NO: 2339642 - DNA, 19 bp, Homo sapiens
tgggtgttctttcctgccc

SEQ ID NO: 2339643 - DNA, 14 bp, Homo sapiens
tgggttcctcctct

SEQ ID NO: 2339644 - DNA, 23 bp, Homo sapiens
tgggttgctgctgtccagtgcct

SEQ ID NO: 2339645 - DNA, 21 bp, Homo sapiens
tggtaaaaacagcagctcata

SEQ ID NO: 2339646 - DNA, 15 bp, Homo sapiens
tggtaaaactcactg

SEQ ID NO: 2339647 - DNA, 12 bp, Homo sapiens
tggtaagagaaa

SEQ ID NO: 2339648 - DNA, 14 bp, Homo sapiens
tggtaagagaaaag

SEQ ID NO: 2339649 - DNA, 16 bp, Homo sapiens
tggtaataagcactgt

SEQ ID NO: 2339650 - DNA, 23 bp, Homo sapiens
tggtaatcccctaaaataacagt

SEQ ID NO: 2339651 - DNA, 20 bp, Homo sapiens
tggtagaaaaaggggcctga

SEQ ID NO: 2339652 - DNA, 21 bp, Homo sapiens
tggtagaaaaaggggcctgag

SEQ ID NO: 2339653 - DNA, 12 bp, Homo sapiens
tggtagagagag

SEQ ID NO: 2339654 - DNA, 17 bp, Homo sapiens
tggtaggggagggcagg

SEQ ID NO: 2339655 - DNA, 21 bp, Homo sapiens
tggtaggggagggcaggcttg

SEQ ID NO: 2339656 - DNA, 16 bp, Homo sapiens
tggtatatccaaaagc

SEQ ID NO: 2339657 - DNA, 15 bp, Homo sapiens
tggtatgtagagctt

SEQ ID NO: 2339658 - DNA, 13 bp, Homo sapiens
tggtatttctaat

SEQ ID NO: 2339659 - DNA, 22 bp, Homo sapiens
tggtcaagattttgaatgcttc

SEQ ID NO: 2339660 - DNA, 23 bp, Homo sapiens
tggtcaagggctgtcattgcaca

SEQ ID NO: 2339661 - DNA, 16 bp, Homo sapiens
tggtcacaaagctatt

SEQ ID NO: 2339662 - DNA, 18 bp, Homo sapiens
tggtcacaaagctattta

SEQ ID NO: 2339663 - DNA, 19 bp, Homo sapiens
tggtcacgtttggtgcttc

SEQ ID NO: 2339664 - DNA, 18 bp, Homo sapiens
tggtcagtctttgctcag

SEQ ID NO: 2339665 - DNA, 13 bp, Homo sapiens
tggtcataaaata

SEQ ID NO: 2339666 - DNA, 18 bp, Homo sapiens
tggtcattttatgttaag

SEQ ID NO: 2339667 - DNA, 23 bp, Homo sapiens
tggtccaaaagattgctgaaatt

SEQ ID NO: 2339668 - DNA, 13 bp, Homo sapiens
tggtccctgagga

SEQ ID NO: 2339669 - DNA, 12 bp, Homo sapiens
tggtcctagaca

SEQ ID NO: 2339670 - DNA, 20 bp, Homo sapiens
tggtcggatctcacaggctg

SEQ ID NO: 2339671 - DNA, 17 bp, Homo sapiens
tggtctggttgggcagc

SEQ ID NO: 2339672 - DNA, 11 bp, Homo sapiens
tggtctttgct

SEQ ID NO: 2339673 - DNA, 14 bp, Homo sapiens
tggtctttgctcca

SEQ ID NO: 2339674 - DNA, 17 bp, Homo sapiens
tggtctttgctccagat

SEQ ID NO: 2339675 - DNA, 13 bp, Homo sapiens
tggtctttgtaag

SEQ ID NO: 2339676 - DNA, 23 bp, Homo sapiens
tggtctttgtaagagtgtagaag

SEQ ID NO: 2339677 - DNA, 17 bp, Homo sapiens
tggtgaggcccagcctg

SEQ ID NO: 2339678 - DNA, 14 bp, Homo sapiens
tggtgaggtgtgga

SEQ ID NO: 2339679 - DNA, 20 bp, Homo sapiens
tggtgatttgaaaaatataa

SEQ ID NO: 2339680 - DNA, 21 bp, Homo sapiens
tggtgatttgaaaaatataaa

SEQ ID NO: 2339681 - DNA, 16 bp, Homo sapiens
tggtgccccccacccc

SEQ ID NO: 2339682 - DNA, 13 bp, Homo sapiens
tggtgcctgagag

SEQ ID NO: 2339683 - DNA, 14 bp, Homo sapiens
tggtgcctgagagg

SEQ ID NO: 2339684 - DNA, 17 bp, Homo sapiens
tggtgcctgagaggcag

SEQ ID NO: 2339685 - DNA, 12 bp, Homo sapiens
tggtgcctggcc

SEQ ID NO: 2339686 - DNA, 17 bp, Homo sapiens
tggtgcctggcctggca

SEQ ID NO: 2339687 - DNA, 22 bp, Homo sapiens
tggtgcctggcctggcacacat

SEQ ID NO: 2339688 - DNA, 23 bp, Homo sapiens
tggtgcttctcagatttctgagg

SEQ ID NO: 2339689 - DNA, 22 bp, Homo sapiens
tggtgggcccagaccactgtct

SEQ ID NO: 2339690 - DNA, 17 bp, Homo sapiens
tggtgtaataagacata

SEQ ID NO: 2339691 - DNA, 20 bp, Homo sapiens
tggttaaggccagggcctct

SEQ ID NO: 2339692 - DNA, 23 bp, Homo sapiens
tggttaccactcttttgctgtgc

SEQ ID NO: 2339693 - DNA, 20 bp, Homo sapiens
tggttacctgacctaaatta

SEQ ID NO: 2339694 - DNA, 15 bp, Homo sapiens
tggttacttcttctc

SEQ ID NO: 2339695 - DNA, 14 bp, Homo sapiens
tggttcccaatatc

SEQ ID NO: 2339696 - DNA, 16 bp, Homo sapiens
tggttcctaagcctgt

SEQ ID NO: 2339697 - DNA, 12 bp, Homo sapiens
tggtttgctagt

SEQ ID NO: 2339698 - DNA, 13 bp, Homo sapiens
tggttttcctgtg

SEQ ID NO: 2339699 - DNA, 19 bp, Homo sapiens
tgtaaaaaaaaatgccttt

SEQ ID NO: 2339700 - DNA, 16 bp, Homo sapiens
tgtaaaaatcttttga

SEQ ID NO: 2339701 - DNA, 12 bp, Homo sapiens
tgtaaaagaaat

SEQ ID NO: 2339702 - DNA, 16 bp, Homo sapiens
tgtaaaatagaaaaag

SEQ ID NO: 2339703 - DNA, 20 bp, Homo sapiens
tgtaaatgcttaaatttcag

SEQ ID NO: 2339704 - DNA, 21 bp, Homo sapiens
tgtaaatgcttaaatttcaga

SEQ ID NO: 2339705 - DNA, 18 bp, Homo sapiens
tgtaactattgggtgaat

SEQ ID NO: 2339706 - DNA, 20 bp, Homo sapiens
tgtaacttgcttaaatttct

SEQ ID NO: 2339707 - DNA, 17 bp, Homo sapiens
tgtaagaaggcaatatt

SEQ ID NO: 2339708 - DNA, 18 bp, Homo sapiens
tgtaagacccttattgct

SEQ ID NO: 2339709 - DNA, 22 bp, Homo sapiens
tgtaagacccttattgctgtcc

SEQ ID NO: 2339710 - DNA, 22 bp, Homo sapiens
tgtaaggtcttcttgtgtcctg

SEQ ID NO: 2339711 - DNA, 23 bp, Homo sapiens
tgtaaggtcttcttgtgtcctga

SEQ ID NO: 2339712 - DNA, 15 bp, Homo sapiens
tgtaagtgaaattaa

SEQ ID NO: 2339713 - DNA, 23 bp, Homo sapiens
tgtaagtggtttttatattttca

SEQ ID NO: 2339714 - DNA, 13 bp, Homo sapiens
tgtaagtgtagct

SEQ ID NO: 2339715 - DNA, 18 bp, Homo sapiens
tgtaagtttcaggtgaca

SEQ ID NO: 2339716 - DNA, 20 bp, Homo sapiens
tgtaagtttcaggtgacatg

SEQ ID NO: 2339717 - DNA, 20 bp, Homo sapiens
tgtaataaaaagtatatgtt

SEQ ID NO: 2339718 - DNA, 13 bp, Homo sapiens
tgtaataaaactg

SEQ ID NO: 2339719 - DNA, 15 bp, Homo sapiens
tgtaataaaactgtt

SEQ ID NO: 2339720 - DNA, 18 bp, Homo sapiens
tgtaataagacataacgt

SEQ ID NO: 2339721 - DNA, 13 bp, Homo sapiens
tgtaataagcaat

SEQ ID NO: 2339722 - DNA, 18 bp, Homo sapiens
tgtaataataaaaccaaa

SEQ ID NO: 2339723 - DNA, 18 bp, Homo sapiens
tgtaatatcagttacagt

SEQ ID NO: 2339724 - DNA, 22 bp, Homo sapiens
tgtaatatcagttacagtggca

SEQ ID NO: 2339725 - DNA, 15 bp, Homo sapiens
tgtaatattttgctg

SEQ ID NO: 2339726 - DNA, 15 bp, Homo sapiens
tgtaatcgtgtgcca

SEQ ID NO: 2339727 - DNA, 16 bp, Homo sapiens
tgtaatcgtgtgccat

SEQ ID NO: 2339728 - DNA, 12 bp, Homo sapiens
tgtaatttcaaa

SEQ ID NO: 2339729 - DNA, 14 bp, Homo sapiens
tgtaatttcaaaat

SEQ ID NO: 2339730 - DNA, 19 bp, Homo sapiens
ttaaaagcatttttattat

SEQ ID NO: 2339731 - DNA, 20 bp, Homo sapiens
ttaaaaggatgtataaattt

SEQ ID NO: 2339732 - DNA, 21 bp, Homo sapiens
ttaaaagtgtgtaaatgctta

SEQ ID NO: 2339733 - DNA, 15 bp, Homo sapiens
ttaaaataaaatgaa

SEQ ID NO: 2339734 - DNA, 16 bp, Homo sapiens
ttaaaataattcatat

SEQ ID NO: 2339735 - DNA, 20 bp, Homo sapiens
ttaaaatagaaattttgtaa

SEQ ID NO: 2339736 - DNA, 20 bp, Homo sapiens
ttaaaatggcatttagcaca

SEQ ID NO: 2339737 - DNA, 11 bp, Homo sapiens
ttaaaatgtaa

SEQ ID NO: 2339738 - DNA, 20 bp, Homo sapiens
ttaaaatgtgtatttttcaa

SEQ ID NO: 2339739 - DNA, 14 bp, Homo sapiens
ttaaaccacttaaa

SEQ ID NO: 2339740 - DNA, 12 bp, Homo sapiens
ttaaaccagaac

SEQ ID NO: 2339741 - DNA, 23 bp, Homo sapiens
ttaaacctggaatctacaagcca

SEQ ID NO: 2339742 - DNA, 19 bp, Homo sapiens
ttaaacgtgatttttaaat

SEQ ID NO: 2339743 - DNA, 20 bp, Homo sapiens
ttaaactattagagtatttc

SEQ ID NO: 2339744 - DNA, 12 bp, Homo sapiens
ttaaactgtgta

SEQ ID NO: 2339745 - DNA, 14 bp, Homo sapiens
ttaaagaatgttag

SEQ ID NO: 2339746 - DNA, 21 bp, Homo sapiens
ttaaagaatgttagtaaagga

SEQ ID NO: 2339747 - DNA, 20 bp, Homo sapiens
ttaaagaccctcctattcta

SEQ ID NO: 2339748 - DNA, 14 bp, Homo sapiens
ttaaagagaatgag

SEQ ID NO: 2339749 - DNA, 15 bp, Homo sapiens
ttaaagcatttccta

SEQ ID NO: 2339750 - DNA, 16 bp, Homo sapiens
ttaaagctactgtaga

SEQ ID NO: 2339751 - DNA, 16 bp, Homo sapiens
ttaaaggcagacagtt

SEQ ID NO: 2339752 - DNA, 17 bp, Homo sapiens
ttaaagggcccaatgaa

SEQ ID NO: 2339753 - DNA, 20 bp, Homo sapiens
ttaaagtatgcattattaaa

SEQ ID NO: 2339754 - DNA, 14 bp, Homo sapiens
ttaaataactgtgt

SEQ ID NO: 2339755 - DNA, 22 bp, Homo sapiens
ttaaatggtaataagcactgta

SEQ ID NO: 2339756 - DNA, 13 bp, Homo sapiens
ttaaatgtaaaga

SEQ ID NO: 2339757 - DNA, 17 bp, Homo sapiens
ttaaatgtaaagatatt

SEQ ID NO: 2339758 - DNA, 13 bp, Homo sapiens
ttaaattatgaag

SEQ ID NO: 2339759 - DNA, 13 bp, Homo sapiens
ttaaattgtggat

SEQ ID NO: 2339760 - DNA, 19 bp, Homo sapiens
ttaaatttcttatgtgaca

SEQ ID NO: 2339761 - DNA, 22 bp, Homo sapiens
ttaaatttcttatgtgacatta

SEQ ID NO: 2339762 - DNA, 13 bp, Homo sapiens
ttaaatttgtaag

SEQ ID NO: 2339763 - DNA, 15 bp, Homo sapiens
ttaaatttgtaagtt

SEQ ID NO: 2339764 - DNA, 13 bp, Homo sapiens
ttaacaagatgtt

SEQ ID NO: 2339765 - DNA, 20 bp, Homo sapiens
ttaacatacaagaaaatgta

SEQ ID NO: 2339766 - DNA, 21 bp, Homo sapiens
ttaacccttcatcttcctgtg

SEQ ID NO: 2339767 - DNA, 17 bp, Homo sapiens
ttaactaaattttaaag

SEQ ID NO: 2339768 - DNA, 16 bp, Homo sapiens
ttaactttaacttttg

SEQ ID NO: 2339769 - DNA, 18 bp, Homo sapiens
ttaagaaagcaaaactca

SEQ ID NO: 2339770 - DNA, 16 bp, Homo sapiens
ttaagaagctgttgta

SEQ ID NO: 2339771 - DNA, 21 bp, Homo sapiens
ttaagaagctgttgtacattt

SEQ ID NO: 2339772 - DNA, 22 bp, Homo sapiens
ttaagaagctgttgtacattta

SEQ ID NO: 2339773 - DNA, 17 bp, Homo sapiens
ttaagatagtgtaactt

SEQ ID NO: 2339774 - DNA, 14 bp, Homo sapiens
ttaagatttttctc

SEQ ID NO: 2339775 - DNA, 15 bp, Homo sapiens
ttaagatttttctca

SEQ ID NO: 2339776 - DNA, 22 bp, Homo sapiens
ttaagatttttctcaaagtttt

SEQ ID NO: 2339777 - DNA, 16 bp, Homo sapiens
ttaagcaaaggggaca

SEQ ID NO: 2339778 - DNA, 21 bp, Homo sapiens
ttaagcacaaaaaatttaaga

SEQ ID NO: 2339779 - DNA, 22 bp, Homo sapiens
ttaagcacaaaaaatttaagag

SEQ ID NO: 2339780 - DNA, 23 bp, Homo sapiens
ttaagctgcagagatttctcatt

SEQ ID NO: 2339781 - DNA, 13 bp, Homo sapiens
ttaagctttttgg

SEQ ID NO: 2339782 - DNA, 22 bp, Homo sapiens
ttaaggataaatcataaagtca

SEQ ID NO: 2339783 - DNA, 18 bp, Homo sapiens
ttaaggggtatcatgtat

SEQ ID NO: 2339784 - DNA, 19 bp, Homo sapiens
ttaagtgaatacattaacg

SEQ ID NO: 2339785 - DNA, 18 bp, Homo sapiens
ttaagtgcgtgtgtagag

SEQ ID NO: 2339786 - DNA, 15 bp, Homo sapiens
ttaagtgttctgtgg

SEQ ID NO: 2339787 - DNA, 14 bp, Homo sapiens
ttaataaaagaaaa

SEQ ID NO: 2339788 - DNA, 15 bp, Homo sapiens
ttaataaaagaacat

SEQ ID NO: 2339789 - DNA, 18 bp, Homo sapiens
ttaataaaataaactaga

SEQ ID NO: 2339790 - DNA, 14 bp, Homo sapiens
ttaataaagatgag

SEQ ID NO: 2339791 - DNA, 16 bp, Homo sapiens
ttaataacattacctt

SEQ ID NO: 2339792 - DNA, 13 bp, Homo sapiens
ttaataagatttt

SEQ ID NO: 2339793 - DNA, 21 bp, Homo sapiens
ttaatacaagtaatattatta

SEQ ID NO: 2339794 - DNA, 19 bp, Homo sapiens
ttaatagccaaagatttca

SEQ ID NO: 2339795 - DNA, 21 bp, Homo sapiens
ttaatagccaaagatttcata

SEQ ID NO: 2339796 - DNA, 23 bp, Homo sapiens
ttaatagtcatcacatttctatg

SEQ ID NO: 2339797 - DNA, 18 bp, Homo sapiens
ttaatatattaaaattcc

SEQ ID NO: 2339798 - DNA, 18 bp, Homo sapiens
ttaatattcttcaaatgt

SEQ ID NO: 2339799 - DNA, 20 bp, Homo sapiens
ttaatattcttttgtttcca

SEQ ID NO: 2339800 - DNA, 15 bp, Homo sapiens
ttaatcatacaaact

SEQ ID NO: 2339801 - DNA, 16 bp, Homo sapiens
ttaatcatcaagagaa

SEQ ID NO: 2339802 - DNA, 17 bp, Homo sapiens
ttaatcatcaagagaat

SEQ ID NO: 2339803 - DNA, 18 bp, Homo sapiens
ttaatccagttataagaa

SEQ ID NO: 2339804 - DNA, 20 bp, Homo sapiens
ttaatctgtttatttacaag

SEQ ID NO: 2339805 - DNA, 14 bp, Homo sapiens
ttaatgacaatatt

SEQ ID NO: 2339806 - DNA, 23 bp, Homo sapiens
ttaatgataaactcagatctgat

SEQ ID NO: 2339807 - DNA, 14 bp, Homo sapiens
ttaatgctacatgt

SEQ ID NO: 2339808 - DNA, 16 bp, Homo sapiens
ttaatgctgtttctaa

SEQ ID NO: 2339809 - DNA, 22 bp, Homo sapiens
ttaatgctgtttctaagaaaat

SEQ ID NO: 2339810 - DNA, 15 bp, Homo sapiens
ttaatgttttcaaaa

SEQ ID NO: 2339811 - DNA, 16 bp, Homo sapiens
ttaattaccaacctgt

SEQ ID NO: 2339812 - DNA, 16 bp, Homo sapiens
ttaattactgctataa

SEQ ID NO: 2339813 - DNA, 20 bp, Homo sapiens
ttaattagttccagtttctc

SEQ ID NO: 2339814 - DNA, 22 bp, Homo sapiens
ttaatttcctttttgacactga

SEQ ID NO: 2339815 - DNA, 23 bp, Homo sapiens
ttaatttcctttttgacactgaa

SEQ ID NO: 2339816 - DNA, 19 bp, Homo sapiens
ttaattttaaagtgcaaaa

SEQ ID NO: 2339817 - DNA, 20 bp, Homo sapiens
ttaattttaatgctgtttct

SEQ ID NO: 2339818 - DNA, 20 bp, Homo sapiens
ttacaagggaagatttatgt

SEQ ID NO: 2339819 - DNA, 17 bp, Homo sapiens
ttacaattttttatcat

SEQ ID NO: 2339820 - DNA, 19 bp, Homo sapiens
ttacacagaaatgctgctg

SEQ ID NO: 2339821 - DNA, 20 bp, Homo sapiens
ttacacagaaatgctgctgg

SEQ ID NO: 2339822 - DNA, 23 bp, Homo sapiens
ttacacagaaatgctgctggcca

SEQ ID NO: 2339823 - DNA, 21 bp, Homo sapiens
ttacaccaccggccccctccc

SEQ ID NO: 2339824 - DNA, 21 bp, Homo sapiens
ttacagaggtattaaaactaa

SEQ ID NO: 2339825 - DNA, 15 bp, Homo sapiens
ttacaggcaccgaga

SEQ ID NO: 2339826 - DNA, 17 bp, Homo sapiens
ttacaggcaccgagaat

SEQ ID NO: 2339827 - DNA, 18 bp, Homo sapiens
ttacaggcaccgagaatg

SEQ ID NO: 2339828 - DNA, 17 bp, Homo sapiens
ttacagtggcagtattg

SEQ ID NO: 2339829 - DNA, 13 bp, Homo sapiens
ttacatcttttct

SEQ ID NO: 2339830 - DNA, 16 bp, Homo sapiens
ttacatggctgtggtt

SEQ ID NO: 2339831 - DNA, 12 bp, Homo sapiens
ttaccaacctgt

SEQ ID NO: 2339832 - DNA, 13 bp, Homo sapiens
ttaccaacctgtt

SEQ ID NO: 2339833 - DNA, 16 bp, Homo sapiens
ttacccacctagaaca

SEQ ID NO: 2339834 - DNA, 22 bp, Homo sapiens
ttacccacctagaacactaact

SEQ ID NO: 2339835 - DNA, 18 bp, Homo sapiens
ttacccactcggtcccag

SEQ ID NO: 2339836 - DNA, 13 bp, Homo sapiens
ttaccctctttgc

SEQ ID NO: 2339837 - DNA, 17 bp, Homo sapiens
ttaccctctttgctgca

SEQ ID NO: 2339838 - DNA, 20 bp, Homo sapiens
ttaccctggcccctctccct

SEQ ID NO: 2339839 - DNA, 13 bp, Homo sapiens
ttacctactttga

SEQ ID NO: 2339840 - DNA, 18 bp, Homo sapiens
ttacctagctaattattt

SEQ ID NO: 2339841 - DNA, 14 bp, Homo sapiens
ttacctccatccat

SEQ ID NO: 2339842 - DNA, 19 bp, Homo sapiens
ttacctgtgaagtgttact

SEQ ID NO: 2339843 - DNA, 13 bp, Homo sapiens
ttacctgtgtgct

SEQ ID NO: 2339844 - DNA, 13 bp, Homo sapiens
ttccctgcttcca

SEQ ID NO: 2339845 - DNA, 21 bp, Homo sapiens
ttccctggacaggcagcctcc

SEQ ID NO: 2339846 - DNA, 23 bp, Homo sapiens
ttccctgggctgccaccagcccc

SEQ ID NO: 2339847 - DNA, 22 bp, Homo sapiens
ttcccttaaggggtatcatgta

SEQ ID NO: 2339848 - DNA, 12 bp, Homo sapiens
ttcccttccaaa

SEQ ID NO: 2339849 - DNA, 21 bp, Homo sapiens
ttcccttctacaaggactcca

SEQ ID NO: 2339850 - DNA, 16 bp, Homo sapiens
ttccgtagactgttta

SEQ ID NO: 2339851 - DNA, 14 bp, Homo sapiens
ttccgtgcgtggca

SEQ ID NO: 2339852 - DNA, 16 bp, Homo sapiens
ttcctaacaaaatgag

SEQ ID NO: 2339853 - DNA, 12 bp, Homo sapiens
ttcctaaggcat

SEQ ID NO: 2339854 - DNA, 13 bp, Homo sapiens
ttcctaaggcatg

SEQ ID NO: 2339855 - DNA, 20 bp, Homo sapiens
ttcctactcacacttcagct

SEQ ID NO: 2339856 - DNA, 16 bp, Homo sapiens
ttcctagctgttctaa

SEQ ID NO: 2339857 - DNA, 19 bp, Homo sapiens
ttcctagctgttctaatta

SEQ ID NO: 2339858 - DNA, 20 bp, Homo sapiens
ttcctataatataataaata

SEQ ID NO: 2339859 - DNA, 23 bp, Homo sapiens
ttcctatttgccatgggcttcac

SEQ ID NO: 2339860 - DNA, 14 bp, Homo sapiens
ttcctcaaattttt

SEQ ID NO: 2339861 - DNA, 22 bp, Homo sapiens
ttcctcaaattttttgactttt

SEQ ID NO: 2339862 - DNA, 22 bp, Homo sapiens
ttcctcacgcccttcaatgctg

SEQ ID NO: 2339863 - DNA, 13 bp, Homo sapiens
ttcctccacccat

SEQ ID NO: 2339864 - DNA, 23 bp, Homo sapiens
ttcctcccagtgagactgcccca

SEQ ID NO: 2339865 - DNA, 15 bp, Homo sapiens
ttcctccctgggggc

SEQ ID NO: 2339866 - DNA, 22 bp, Homo sapiens
ttcctcctacttacaacccagg

SEQ ID NO: 2339867 - DNA, 15 bp, Homo sapiens
ttcctcctctgccta

SEQ ID NO: 2339868 - DNA, 13 bp, Homo sapiens
ttcctcctgctca

SEQ ID NO: 2339869 - DNA, 15 bp, Homo sapiens
ttcctcctgctcata

SEQ ID NO: 2339870 - DNA, 15 bp, Homo sapiens
ttcctctccacacag

SEQ ID NO: 2339871 - DNA, 11 bp, Homo sapiens
ttcctctgccc

SEQ ID NO: 2339872 - DNA, 12 bp, Homo sapiens
ttcctctgcctg

SEQ ID NO: 2339873 - DNA, 13 bp, Homo sapiens
ttcctctgcctgc

SEQ ID NO: 2339874 - DNA, 14 bp, Homo sapiens
ttcctctgctcacc

SEQ ID NO: 2339875 - DNA, 20 bp, Homo sapiens
ttcctctttctgctctgcca

SEQ ID NO: 2339876 - DNA, 13 bp, Homo sapiens
ttcctgacacttt

SEQ ID NO: 2339877 - DNA, 22 bp, Homo sapiens
ttcctgacactttaattaccaa

SEQ ID NO: 2339878 - DNA, 23 bp, Homo sapiens
ttcctgatgctgggcaatgaggc

SEQ ID NO: 2339879 - DNA, 13 bp, Homo sapiens
ttcctgccctgtc

SEQ ID NO: 2339880 - DNA, 15 bp, Homo sapiens
ttcctgccctgtcca

SEQ ID NO: 2339881 - DNA, 16 bp, Homo sapiens
ttcctgcccttccctc

SEQ ID NO: 2339882 - DNA, 17 bp, Homo sapiens
ttcctgcgtcctcctca

SEQ ID NO: 2339883 - DNA, 16 bp, Homo sapiens
ttcctgggaacatcac

SEQ ID NO: 2339884 - DNA, 22 bp, Homo sapiens
ttcctgtgatccacccaaccct

SEQ ID NO: 2339885 - DNA, 19 bp, Homo sapiens
ttcctgtttttcacatttt

SEQ ID NO: 2339886 - DNA, 23 bp, Homo sapiens
ttcctgtttttcacattttcctt

SEQ ID NO: 2339887 - DNA, 21 bp, Homo sapiens
ttccttcatttccaccaggcc

SEQ ID NO: 2339888 - DNA, 20 bp, Homo sapiens
ttccttccaggtgattctgt

SEQ ID NO: 2339889 - DNA, 15 bp, Homo sapiens
ttccttggctttatg

SEQ ID NO: 2339890 - DNA, 15 bp, Homo sapiens
ttccttgtctaaaga

SEQ ID NO: 2339891 - DNA, 23 bp, Homo sapiens
ttcctttaaaaaaatttaagtgc

SEQ ID NO: 2339892 - DNA, 19 bp, Homo sapiens
ttcctttgcatattataaa

SEQ ID NO: 2339893 - DNA, 17 bp, Homo sapiens
ttccttttgccgacccc

SEQ ID NO: 2339894 - DNA, 18 bp, Homo sapiens
ttcctttttgacactgaa

SEQ ID NO: 2339895 - DNA, 15 bp, Homo sapiens
ttcgaggtgtcaccc

SEQ ID NO: 2339896 - DNA, 19 bp, Homo sapiens
ttcgcgggtaactggggtt

SEQ ID NO: 2339897 - DNA, 12 bp, Homo sapiens
ttctaacttttc

SEQ ID NO: 2339898 - DNA, 18 bp, Homo sapiens
ttctaagagaagttattt

SEQ ID NO: 2339899 - DNA, 22 bp, Homo sapiens
ttctaagagcgaacttcacata

SEQ ID NO: 2339900 - DNA, 13 bp, Homo sapiens
ttctaattaagaa

SEQ ID NO: 2339901 - DNA, 14 bp, Homo sapiens
ttctacaaggactc

SEQ ID NO: 2339902 - DNA, 22 bp, Homo sapiens
ttctacaaggactccattggat

SEQ ID NO: 2339903 - DNA, 21 bp, Homo sapiens
ttctacaatacaacacattga

SEQ ID NO: 2339904 - DNA, 21 bp, Homo sapiens
ttctacagtggttttatactg

SEQ ID NO: 2339905 - DNA, 18 bp, Homo sapiens
ttctaccggagagagaat

SEQ ID NO: 2339906 - DNA, 20 bp, Homo sapiens
ttctacggatcatcaacaag

SEQ ID NO: 2339907 - DNA, 22 bp, Homo sapiens
ttctaggcccattgtcctcctt

SEQ ID NO: 2339908 - DNA, 15 bp, Homo sapiens
ttctagtgtgtgttt

SEQ ID NO: 2339909 - DNA, 16 bp, Homo sapiens
ttctatccatctcctg

SEQ ID NO: 2339910 - DNA, 19 bp, Homo sapiens
ttctattatggaaaactgt

SEQ ID NO: 2339911 - DNA, 13 bp, Homo sapiens
ttctatttataat

SEQ ID NO: 2339912 - DNA, 22 bp, Homo sapiens
ttctcaaagttttgaaaagcta

SEQ ID NO: 2339913 - DNA, 13 bp, Homo sapiens
ttctcagaagcac

SEQ ID NO: 2339914 - DNA, 19 bp, Homo sapiens
ttctcagagtggtggggga

SEQ ID NO: 2339915 - DNA, 15 bp, Homo sapiens
ttctcagatttctga

SEQ ID NO: 2339916 - DNA, 20 bp, Homo sapiens
ttctcagatttctgaggaaa

SEQ ID NO: 2339917 - DNA, 14 bp, Homo sapiens
ttctcatgatccaa

SEQ ID NO: 2339918 - DNA, 11 bp, Homo sapiens
ttctcccactc

SEQ ID NO: 2339919 - DNA, 12 bp, Homo sapiens
ttctcccactct

SEQ ID NO: 2339920 - DNA, 20 bp, Homo sapiens
ttctcccaggtaccagctgc

SEQ ID NO: 2339921 - DNA, 14 bp, Homo sapiens
ttctccgccagcct

SEQ ID NO: 2339922 - DNA, 16 bp, Homo sapiens
ttctccgccagcctcc

SEQ ID NO: 2339923 - DNA, 17 bp, Homo sapiens
ttctccgccagcctcct

SEQ ID NO: 2339924 - DNA, 18 bp, Homo sapiens
ttctccgccagcctcctc

SEQ ID NO: 2339925 - DNA, 22 bp, Homo sapiens
ttctcctacttagggaagaaaa

SEQ ID NO: 2339926 - DNA, 19 bp, Homo sapiens
ttctccttggtttgctagt

SEQ ID NO: 2339927 - DNA, 16 bp, Homo sapiens
ttctctccacagtgtt

SEQ ID NO: 2339928 - DNA, 12 bp, Homo sapiens
ttctctcctccc

SEQ ID NO: 2339929 - DNA, 11 bp, Homo sapiens
ttctctcctgg

SEQ ID NO: 2339930 - DNA, 13 bp, Homo sapiens
ttctctctctaag

SEQ ID NO: 2339931 - DNA, 18 bp, Homo sapiens
ttctcttatcctctctct

SEQ ID NO: 2339932 - DNA, 14 bp, Homo sapiens
ttctcttccctgaa

SEQ ID NO: 2339933 - DNA, 22 bp, Homo sapiens
ttctcttgagctggcctctcta

SEQ ID NO: 2339934 - DNA, 15 bp, Homo sapiens
ttctctttggaaata

SEQ ID NO: 2339935 - DNA, 20 bp, Homo sapiens
ttctcttttcccctttcctg

SEQ ID NO: 2339936 - DNA, 19 bp, Homo sapiens
ttctgaaggtagcattctt

SEQ ID NO: 2339937 - DNA, 17 bp, Homo sapiens
ttctgaggtgcactggg

SEQ ID NO: 2339938 - DNA, 13 bp, Homo sapiens
ttctgatgaagtt

SEQ ID NO: 2339939 - DNA, 20 bp, Homo sapiens
ttctgattatgtaagcattt

SEQ ID NO: 2339940 - DNA, 22 bp, Homo sapiens
ttctgattatgtaagcatttgt

SEQ ID NO: 2339941 - DNA, 13 bp, Homo sapiens
ttctgcagaaaat

SEQ ID NO: 2339942 - DNA, 20 bp, Homo sapiens
ttctgccctggctgctgccc

SEQ ID NO: 2339943 - DNA, 14 bp, Homo sapiens
ttctgcctctctgg

SEQ ID NO: 2339944 - DNA, 15 bp, Homo sapiens
ttctgctctgccatc

SEQ ID NO: 2339945 - DNA, 20 bp, Homo sapiens
ttctgctggggcctgggaca

SEQ ID NO: 2339946 - DNA, 19 bp, Homo sapiens
ttctgcttttctgccctgg

SEQ ID NO: 2339947 - DNA, 16 bp, Homo sapiens
ttctggctctcccatt

SEQ ID NO: 2339948 - DNA, 22 bp, Homo sapiens
ttctggctctcccatttcctga

SEQ ID NO: 2339949 - DNA, 14 bp, Homo sapiens
ttctgggcttcatt

SEQ ID NO: 2339950 - DNA, 19 bp, Homo sapiens
ttctggggcaggctgggcc

SEQ ID NO: 2339951 - DNA, 20 bp, Homo sapiens
ttctggggcaggctgggcca

SEQ ID NO: 2339952 - DNA, 21 bp, Homo sapiens
ttctggggcaggctgggccat

SEQ ID NO: 2339953 - DNA, 18 bp, Homo sapiens
ttctgggtagtcccctgt

SEQ ID NO: 2339954 - DNA, 23 bp, Homo sapiens
ttctgggtagtcccctgttgatt

SEQ ID NO: 2339955 - DNA, 15 bp, Homo sapiens
ttctgtaataaaact

SEQ ID NO: 2339956 - DNA, 17 bp, Homo sapiens
ttctgtgatgagctgat

SEQ ID NO: 2339957 - DNA, 13 bp, Homo sapiens
ttctgtgcctgaa

SEQ ID NO: 2339958 - DNA, 17 bp, Homo sapiens
ttctgtgcctgaatatt

SEQ ID NO: 2339959 - DNA, 20 bp, Homo sapiens
ttgtcttttcagaagcaagc

SEQ ID NO: 2339960 - DNA, 14 bp, Homo sapiens
ttgtgatctgttgt

SEQ ID NO: 2339961 - DNA, 23 bp, Homo sapiens
ttgtgattcaatctgtaaactgt

SEQ ID NO: 2339962 - DNA, 21 bp, Homo sapiens
ttgtgccagaggaatcctggc

SEQ ID NO: 2339963 - DNA, 16 bp, Homo sapiens
ttgtgccccttcactc

SEQ ID NO: 2339964 - DNA, 17 bp, Homo sapiens
ttgtgccccttcactca

SEQ ID NO: 2339965 - DNA, 19 bp, Homo sapiens
ttgtggggcacagatgcct

SEQ ID NO: 2339966 - DNA, 12 bp, Homo sapiens
ttgtgtgaaatt

SEQ ID NO: 2339967 - DNA, 14 bp, Homo sapiens
ttgtgtgctctcca

SEQ ID NO: 2339968 - DNA, 21 bp, Homo sapiens
ttgtgttcagctctttccaaa

SEQ ID NO: 2339969 - DNA, 16 bp, Homo sapiens
ttgtgttcatttcatt

SEQ ID NO: 2339970 - DNA, 20 bp, Homo sapiens
ttgtgttcccatttcagctg

SEQ ID NO: 2339971 - DNA, 22 bp, Homo sapiens
ttgttaagtatcagctacaatt

SEQ ID NO: 2339972 - DNA, 16 bp, Homo sapiens
ttgttatcaaaatagt

SEQ ID NO: 2339973 - DNA, 15 bp, Homo sapiens
ttgttattaaacaaa

SEQ ID NO: 2339974 - DNA, 17 bp, Homo sapiens
ttgttgcaagatgtgaa

SEQ ID NO: 2339975 - DNA, 21 bp, Homo sapiens
ttgtttaaaatgtaatttaaa

SEQ ID NO: 2339976 - DNA, 15 bp, Homo sapiens
ttgtttctttctagt

SEQ ID NO: 2339977 - DNA, 21 bp, Homo sapiens
ttgtttggagacgtttataaa

SEQ ID NO: 2339978 - DNA, 17 bp, Homo sapiens
ttgtttggtaaatgttt

SEQ ID NO: 2339979 - DNA, 20 bp, Homo sapiens
ttgtttgtctgtttttactc

SEQ ID NO: 2339980 - DNA, 15 bp, Homo sapiens
ttgttttgaaaataa

SEQ ID NO: 2339981 - DNA, 18 bp, Homo sapiens
tttaaaaaggtaaatggt

SEQ ID NO: 2339982 - DNA, 11 bp, Homo sapiens
tttaaaaatat

SEQ ID NO: 2339983 - DNA, 15 bp, Homo sapiens
tttaaaaattgttat

SEQ ID NO: 2339984 - DNA, 13 bp, Homo sapiens
tttaaaagaatga

SEQ ID NO: 2339985 - DNA, 15 bp, Homo sapiens
tttaaaataaaatga

SEQ ID NO: 2339986 - DNA, 14 bp, Homo sapiens
tttaaaatggcatt

SEQ ID NO: 2339987 - DNA, 12 bp, Homo sapiens
tttaaaatgtaa

SEQ ID NO: 2339988 - DNA, 18 bp, Homo sapiens
tttaaaatgtaatttaaa

SEQ ID NO: 2339989 - DNA, 23 bp, Homo sapiens
tttaaaatgtaatttaaatgaaa

SEQ ID NO: 2339990 - DNA, 13 bp, Homo sapiens
tttaaaatttcat

SEQ ID NO: 2339991 - DNA, 18 bp, Homo sapiens
tttaaaggcattagagtc

SEQ ID NO: 2339992 - DNA, 21 bp, Homo sapiens
tttaaagtatgcattattaaa

SEQ ID NO: 2339993 - DNA, 18 bp, Homo sapiens
tttaaatgtaaagatatt

SEQ ID NO: 2339994 - DNA, 19 bp, Homo sapiens
tttaaattacctttacata

SEQ ID NO: 2339995 - DNA, 11 bp, Homo sapiens
tttaacagaaa

SEQ ID NO: 2339996 - DNA, 18 bp, Homo sapiens
tttaacagaaaaatgaaa

SEQ ID NO: 2339997 - DNA, 14 bp, Homo sapiens
tttaacattttaca

SEQ ID NO: 2339998 - DNA, 20 bp, Homo sapiens
tttaacattttacagtaaat

SEQ ID NO: 2339999 - DNA, 16 bp, Homo sapiens
tttaaccttgtataaa

SEQ ID NO: 2340000 - DNA, 15 bp, Homo sapiens
tttaagatttctcta

SEQ ID NO: 2340001 - DNA, 16 bp, Homo sapiens
tttaagatttctctaa

SEQ ID NO: 2340002 - DNA, 21 bp, Homo sapiens
tttaagcacaaaaaatttaag

SEQ ID NO: 2340003 - DNA, 18 bp, Homo sapiens
tttaagccttcaaaacta

SEQ ID NO: 2340004 - DNA, 10 bp, Homo sapiens
tttaagtcct

SEQ ID NO: 2340005 - DNA, 13 bp, Homo sapiens
tttaagtgttctg

SEQ ID NO: 2340006 - DNA, 18 bp, Homo sapiens
tttaagtttgactacata

SEQ ID NO: 2340007 - DNA, 17 bp, Homo sapiens
tttaataaaataattct

SEQ ID NO: 2340008 - DNA, 20 bp, Homo sapiens
tttaataacaaggagatttc

SEQ ID NO: 2340009 - DNA, 22 bp, Homo sapiens
tttaataacaaggagatttctt

SEQ ID NO: 2340010 - DNA, 12 bp, Homo sapiens
tttaataacatt

SEQ ID NO: 2340011 - DNA, 18 bp, Homo sapiens
tttaataacattacctta

SEQ ID NO: 2340012 - DNA, 16 bp, Homo sapiens
tttaatatactcctta

SEQ ID NO: 2340013 - DNA, 22 bp, Homo sapiens
tttaatattcttttgtttccat

SEQ ID NO: 2340014 - DNA, 12 bp, Homo sapiens
tttaatcagaaa

SEQ ID NO: 2340015 - DNA, 13 bp, Homo sapiens
tttaatgtctgtt

SEQ ID NO: 2340016 - DNA, 16 bp, Homo sapiens
tttaattactgctata

SEQ ID NO: 2340017 - DNA, 20 bp, Homo sapiens
tttaattgtccagtttgtct

SEQ ID NO: 2340018 - DNA, 16 bp, Homo sapiens
tttaattgttgtttct

SEQ ID NO: 2340019 - DNA, 18 bp, Homo sapiens
tttaattgttgtttcttt

SEQ ID NO: 2340020 - DNA, 21 bp, Homo sapiens
tttaattgttgtttctttcta

SEQ ID NO: 2340021 - DNA, 22 bp, Homo sapiens
tttaattgttgtttctttctag

SEQ ID NO: 2340022 - DNA, 24 bp, Homo sapiens
tttaattgttgtttctttctagtg

SEQ ID NO: 2340023 - DNA, 16 bp, Homo sapiens
tttaatttatatcagg

SEQ ID NO: 2340024 - DNA, 22 bp, Homo sapiens
tttaatttatatcaggtgtata

SEQ ID NO: 2340025 - DNA, 14 bp, Homo sapiens
tttaattttcactt

SEQ ID NO: 2340026 - DNA, 20 bp, Homo sapiens
tttacaagggcataaagtaa

SEQ ID NO: 2340027 - DNA, 17 bp, Homo sapiens
tttacacatcttaaaag

SEQ ID NO: 2340028 - DNA, 16 bp, Homo sapiens
tttacagtaaatgtta

SEQ ID NO: 2340029 - DNA, 19 bp, Homo sapiens
tttacatataaaatgtaat

SEQ ID NO: 2340030 - DNA, 16 bp, Homo sapiens
tttacccacctagaac

SEQ ID NO: 2340031 - DNA, 14 bp, Homo sapiens
tttaccctggcccc

SEQ ID NO: 2340032 - DNA, 19 bp, Homo sapiens
tttaccctggcccctctcc

SEQ ID NO: 2340033 - DNA, 21 bp, Homo sapiens
tttacctggcttatttaatat

SEQ ID NO: 2340034 - DNA, 13 bp, Homo sapiens
tttacctgtttaa

SEQ ID NO: 2340035 - DNA, 16 bp, Homo sapiens
tttactaacagtaact

SEQ ID NO: 2340036 - DNA, 17 bp, Homo sapiens
tttactaacagtaactg

SEQ ID NO: 2340037 - DNA, 19 bp, Homo sapiens
tttactaactaaataccat

SEQ ID NO: 2340038 - DNA, 22 bp, Homo sapiens
tttactccaggttattgcaata

SEQ ID NO: 2340039 - DNA, 23 bp, Homo sapiens
tttactctgggagtaatactttt

SEQ ID NO: 2340040 - DNA, 13 bp, Homo sapiens
tttagaaatgttt

SEQ ID NO: 2340041 - DNA, 22 bp, Homo sapiens
tttagacaagagatgggaatga

SEQ ID NO: 2340042 - DNA, 18 bp, Homo sapiens
tttagattgagaaatgtg

SEQ ID NO: 2340043 - DNA, 11 bp, Homo sapiens
tttagctctga

SEQ ID NO: 2340044 - DNA, 17 bp, Homo sapiens
tttaggcagcctgccgc

SEQ ID NO: 2340045 - DNA, 13 bp, Homo sapiens
tttagggaagcag

SEQ ID NO: 2340046 - DNA, 16 bp, Homo sapiens
tttagggaagcaggga

SEQ ID NO: 2340047 - DNA, 16 bp, Homo sapiens
tttagtacaatttcaa

SEQ ID NO: 2340048 - DNA, 17 bp, Homo sapiens
tttagtacaatttcaac

SEQ ID NO: 2340049 - DNA, 23 bp, Homo sapiens
tttagttcaatatttgttactgt

SEQ ID NO: 2340050 - DNA, 14 bp, Homo sapiens
tttagttctgttga

SEQ ID NO: 2340051 - DNA, 15 bp, Homo sapiens
tttataaacagaaat

SEQ ID NO: 2340052 - DNA, 12 bp, Homo sapiens
tttataaagcat

SEQ ID NO: 2340053 - DNA, 20 bp, Homo sapiens
tttataacatctttattgaa

SEQ ID NO: 2340054 - DNA, 19 bp, Homo sapiens
tttataatgatgaacttat

SEQ ID NO: 2340055 - DNA, 15 bp, Homo sapiens
tttataattgtacaa

SEQ ID NO: 2340056 - DNA, 16 bp, Homo sapiens
tttatacaccagcaat

SEQ ID NO: 2340057 - DNA, 20 bp, Homo sapiens
tttatatgcttactgatata

SEQ ID NO: 2340058 - DNA, 12 bp, Homo sapiens
tttatattattg

SEQ ID NO: 2340059 - DNA, 18 bp, Homo sapiens
tttatatttcctttatgt

SEQ ID NO: 2340060 - DNA, 17 bp, Homo sapiens
tttatcatgaatgcttt

SEQ ID NO: 2340061 - DNA, 12 bp, Homo sapiens
tttatctttata

SEQ ID NO: 2340062 - DNA, 14 bp, Homo sapiens
tttatgatttaata

SEQ ID NO: 2340063 - DNA, 12 bp, Homo sapiens
tttatgtattct

SEQ ID NO: 2340064 - DNA, 21 bp, Homo sapiens
tttattaaaatatttcaggtt

SEQ ID NO: 2340065 - DNA, 20 bp, Homo sapiens
tttattaagctttttggaat

SEQ ID NO: 2340066 - DNA, 12 bp, Homo sapiens
tttattaatgtt

SEQ ID NO: 2340067 - DNA, 22 bp, Homo sapiens
tttattgacaggtcttttcaaa

SEQ ID NO: 2340068 - DNA, 16 bp, Homo sapiens
tttattggctgagata

SEQ ID NO: 2340069 - DNA, 22 bp, Homo sapiens
tttattttcagtcccctctctc

SEQ ID NO: 2340070 - DNA, 23 bp, Homo sapiens
tttattttcagtcccctctctct

SEQ ID NO: 2340071 - DNA, 15 bp, Homo sapiens
tttattttgtgtaaa

SEQ ID NO: 2340072 - DNA, 15 bp, Homo sapiens
tttcaaaatacattt

SEQ ID NO: 2340073 - DNA, 15 bp, Homo sapiens
tttcaaaatgataga

SEQ ID NO: 2340074 - DNA, 19 bp, Homo sapiens
ctttaaaaaaatttaagtg

SEQ ID NO: 2340075 - DNA, 12 bp, Homo sapiens
ctttaaattatg

SEQ ID NO: 2340076 - DNA, 16 bp, Homo sapiens
ctgtgcttgaaggccc

SEQ ID NO: 2340077 - DNA, 18 bp, Homo sapiens
ctgtggaaggcagagaaa

SEQ ID NO: 2340078 - DNA, 15 bp, Homo sapiens
ctgtggaggaaggat

SEQ ID NO: 2340079 - DNA, 16 bp, Homo sapiens
ctgtggaggaaggatt

SEQ ID NO: 2340080 - DNA, 17 bp, Homo sapiens
ctgtggaggaaggattg

SEQ ID NO: 2340081 - DNA, 19 bp, Homo sapiens
ctgtggaggaaggattgta

SEQ ID NO: 2340082 - DNA, 23 bp, Homo sapiens
ctgtggaggaaggattgtaaaaa

SEQ ID NO: 2340083 - DNA, 15 bp, Homo sapiens
ctgtggcataaattg

SEQ ID NO: 2340084 - DNA, 18 bp, Homo sapiens
ctgtggcataaattgcat

SEQ ID NO: 2340085 - DNA, 15 bp, Homo sapiens
ctgtggctagtgaca

SEQ ID NO: 2340086 - DNA, 15 bp, Homo sapiens
ctgtggctccaggcc

SEQ ID NO: 2340087 - DNA, 23 bp, Homo sapiens
ctgtggctgatttactaacagta

SEQ ID NO: 2340088 - DNA, 14 bp, Homo sapiens
ctgtggctggctct

SEQ ID NO: 2340089 - DNA, 16 bp, Homo sapiens
ctgtggggtggagcac

SEQ ID NO: 2340090 - DNA, 18 bp, Homo sapiens
ctgtggggtggagcactg

SEQ ID NO: 2340091 - DNA, 22 bp, Homo sapiens
ctgtggggtggagcactggact

SEQ ID NO: 2340092 - DNA, 16 bp, Homo sapiens
ctgtgggtctctgaag

SEQ ID NO: 2340093 - DNA, 18 bp, Homo sapiens
ctgtgggtctctgaaggg

SEQ ID NO: 2340094 - DNA, 20 bp, Homo sapiens
ctgtgggtgtgggtgggagt

SEQ ID NO: 2340095 - DNA, 22 bp, Homo sapiens
ctgtgggtgttctttcctgccc

SEQ ID NO: 2340096 - DNA, 20 bp, Homo sapiens
ctgtggttcctaagcctgtt

SEQ ID NO: 2340097 - DNA, 15 bp, Homo sapiens
ctgtggttcctctgc

SEQ ID NO: 2340098 - DNA, 12 bp, Homo sapiens
ctgtggttttga

SEQ ID NO: 2340099 - DNA, 15 bp, Homo sapiens
ctgtgtatgttcttg

SEQ ID NO: 2340100 - DNA, 20 bp, Homo sapiens
ctgtgtgaccctgggcaagt

SEQ ID NO: 2340101 - DNA, 14 bp, Homo sapiens
ctgtgtgattaaaa

SEQ ID NO: 2340102 - DNA, 15 bp, Homo sapiens
ctgtgtgcttggtct

SEQ ID NO: 2340103 - DNA, 22 bp, Homo sapiens
ctgtgttaattgcgtagaggct

SEQ ID NO: 2340104 - DNA, 15 bp, Homo sapiens
ctgtgttatgaaaat

SEQ ID NO: 2340105 - DNA, 13 bp, Homo sapiens
ctgtgttgccaca

SEQ ID NO: 2340106 - DNA, 22 bp, Homo sapiens
ctgtgtttatatggaagaaagt

SEQ ID NO: 2340107 - DNA, 22 bp, Homo sapiens
ctgttaacatctagcctaaagt

SEQ ID NO: 2340108 - DNA, 15 bp, Homo sapiens
ctgttaccattcaca

SEQ ID NO: 2340109 - DNA, 19 bp, Homo sapiens
ctgttatgatttccttcaa

SEQ ID NO: 2340110 - DNA, 16 bp, Homo sapiens
ctgttccccaaatggc

SEQ ID NO: 2340111 - DNA, 19 bp, Homo sapiens
ctgttccctggagtcaggg

SEQ ID NO: 2340112 - DNA, 18 bp, Homo sapiens
ctgttcctgctgctgtct

SEQ ID NO: 2340113 - DNA, 18 bp, Homo sapiens
ctgttcggaaggggttcc

SEQ ID NO: 2340114 - DNA, 19 bp, Homo sapiens
ctgttctacatagatgctt

SEQ ID NO: 2340115 - DNA, 19 bp, Homo sapiens
ctgttctgtggttcctctg

SEQ ID NO: 2340116 - DNA, 21 bp, Homo sapiens
ctgttctgtggttcctctgct

SEQ ID NO: 2340117 - DNA, 15 bp, Homo sapiens
ctgttgacctgtgca

SEQ ID NO: 2340118 - DNA, 15 bp, Homo sapiens
ctgttgagccccagt

SEQ ID NO: 2340119 - DNA, 20 bp, Homo sapiens
ctgttgagccccagtgctgg

SEQ ID NO: 2340120 - DNA, 15 bp, Homo sapiens
ctgttgataaaaact

SEQ ID NO: 2340121 - DNA, 14 bp, Homo sapiens
ctgttgattatctt

SEQ ID NO: 2340122 - DNA, 18 bp, Homo sapiens
ctgttgattatcttcagc

SEQ ID NO: 2340123 - DNA, 19 bp, Homo sapiens
ctgttgtaagaattctgat

SEQ ID NO: 2340124 - DNA, 21 bp, Homo sapiens
ctgttgtaatatcagttacag

SEQ ID NO: 2340125 - DNA, 12 bp, Homo sapiens
ctgttgtacatt

SEQ ID NO: 2340126 - DNA, 13 bp, Homo sapiens
ctgttgtacattt

SEQ ID NO: 2340127 - DNA, 20 bp, Homo sapiens
ctgttgtgagctttgaagta

SEQ ID NO: 2340128 - DNA, 19 bp, Homo sapiens
ctgttgtttggttcaggga

SEQ ID NO: 2340129 - DNA, 19 bp, Homo sapiens
ctgtttaggttcccctgtc

SEQ ID NO: 2340130 - DNA, 16 bp, Homo sapiens
ctgtttcctgggcacg

SEQ ID NO: 2340131 - DNA, 11 bp, Homo sapiens
ctgtttctaag

SEQ ID NO: 2340132 - DNA, 18 bp, Homo sapiens
ctgtttctaagaaaatgt

SEQ ID NO: 2340133 - DNA, 17 bp, Homo sapiens
ctgtttctcttgagctg

SEQ ID NO: 2340134 - DNA, 20 bp, Homo sapiens
ctgtttctcttgagctggcc

SEQ ID NO: 2340135 - DNA, 21 bp, Homo sapiens
ctgtttctcttgagctggcct

SEQ ID NO: 2340136 - DNA, 18 bp, Homo sapiens
ctgtttgaaagtaaaaac

SEQ ID NO: 2340137 - DNA, 16 bp, Homo sapiens
ctgtttgtcctgagat

SEQ ID NO: 2340138 - DNA, 22 bp, Homo sapiens
ctgtttgtcctgagatggaaaa

SEQ ID NO: 2340139 - DNA, 13 bp, Homo sapiens
ctgttttctgaaa

SEQ ID NO: 2340140 - DNA, 15 bp, Homo sapiens
ctgttttctgaaaca

SEQ ID NO: 2340141 - DNA, 17 bp, Homo sapiens
ctgttttctgaaacaca

SEQ ID NO: 2340142 - DNA, 20 bp, Homo sapiens
ctgttttgtggtttggaata

SEQ ID NO: 2340143 - DNA, 13 bp, Homo sapiens
ctgtttttcacat

SEQ ID NO: 2340144 - DNA, 15 bp, Homo sapiens
ctgtttttcacattt

SEQ ID NO: 2340145 - DNA, 14 bp, Homo sapiens
ctgtttttttgtta

SEQ ID NO: 2340146 - DNA, 13 bp, Homo sapiens
cttaaaaaggaac

SEQ ID NO: 2340147 - DNA, 12 bp, Homo sapiens
cttaaaaattta

SEQ ID NO: 2340148 - DNA, 13 bp, Homo sapiens
cttaaaaccaaag

SEQ ID NO: 2340149 - DNA, 14 bp, Homo sapiens
cttaaaaccaaaga

SEQ ID NO: 2340150 - DNA, 13 bp, Homo sapiens
cttaaaagcattt

SEQ ID NO: 2340151 - DNA, 19 bp, Homo sapiens
cttaaaataattcatatct

SEQ ID NO: 2340152 - DNA, 23 bp, Homo sapiens
cttaaaccttcagttatgatttt

SEQ ID NO: 2340153 - DNA, 17 bp, Homo sapiens
cttaaagctactgtaga

SEQ ID NO: 2340154 - DNA, 22 bp, Homo sapiens
cttaaagctactgtagaaacaa

SEQ ID NO: 2340155 - DNA, 22 bp, Homo sapiens
cttaaagggcccaatgaattat

SEQ ID NO: 2340156 - DNA, 14 bp, Homo sapiens
cttaaatttcttat

SEQ ID NO: 2340157 - DNA, 13 bp, Homo sapiens
cttaaattttaac

SEQ ID NO: 2340158 - DNA, 18 bp, Homo sapiens
cttaactataaggtgcct

SEQ ID NO: 2340159 - DNA, 20 bp, Homo sapiens
cttaactataaggtgcctca

SEQ ID NO: 2340160 - DNA, 13 bp, Homo sapiens
cttaactttaact

SEQ ID NO: 2340161 - DNA, 17 bp, Homo sapiens
cttaagcaaattttgta

SEQ ID NO: 2340162 - DNA, 14 bp, Homo sapiens
cttaagtaccaatg

SEQ ID NO: 2340163 - DNA, 15 bp, Homo sapiens
cttaagtaccaatgg

SEQ ID NO: 2340164 - DNA, 14 bp, Homo sapiens
cttaagtgagcaga

SEQ ID NO: 2340165 - DNA, 22 bp, Homo sapiens
cttaagtgagcagaacaggtag

SEQ ID NO: 2340166 - DNA, 20 bp, Homo sapiens
cttaagtgcccacatttgat

SEQ ID NO: 2340167 - DNA, 14 bp, Homo sapiens
cttaataaaagaac

SEQ ID NO: 2340168 - DNA, 18 bp, Homo sapiens
cttaataaaataaactag

SEQ ID NO: 2340169 - DNA, 21 bp, Homo sapiens
cttaatctgtttatttacaag

SEQ ID NO: 2340170 - DNA, 17 bp, Homo sapiens
cttaatggagttcttgt

SEQ ID NO: 2340171 - DNA, 18 bp, Homo sapiens
cttaatggagttcttgtg

SEQ ID NO: 2340172 - DNA, 23 bp, Homo sapiens
cttaattattgcactagagaaaa

SEQ ID NO: 2340173 - DNA, 21 bp, Homo sapiens
cttaattgccagcaaataaat

SEQ ID NO: 2340174 - DNA, 14 bp, Homo sapiens
cttaatttcctttt

SEQ ID NO: 2340175 - DNA, 21 bp, Homo sapiens
cttaatttcctttttgacact

SEQ ID NO: 2340176 - DNA, 23 bp, Homo sapiens
cttaatttcctttttgacactga

SEQ ID NO: 2340177 - DNA, 13 bp, Homo sapiens
cttagcaactgct

SEQ ID NO: 2340178 - DNA, 20 bp, Homo sapiens
cttagcaactgctggggaga

SEQ ID NO: 2340179 - DNA, 17 bp, Homo sapiens
cttagcaccttcagggc

SEQ ID NO: 2340180 - DNA, 19 bp, Homo sapiens
cttagctctcccaactctt

SEQ ID NO: 2340181 - DNA, 14 bp, Homo sapiens
cttagctttttaat

SEQ ID NO: 2340182 - DNA, 14 bp, Homo sapiens
cttagggaagaaaa

SEQ ID NO: 2340183 - DNA, 16 bp, Homo sapiens
cttagggtttggagct

SEQ ID NO: 2340184 - DNA, 15 bp, Homo sapiens
cttaggtgccaggct

SEQ ID NO: 2340185 - DNA, 21 bp, Homo sapiens
cttagtctaggtccttgttgt

SEQ ID NO: 2340186 - DNA, 21 bp, Homo sapiens
cttagtgattgagactcaaaa

SEQ ID NO: 2340187 - DNA, 19 bp, Homo sapiens
cttagttcatatatcaaga

SEQ ID NO: 2340188 - DNA, 17 bp, Homo sapiens
cttataacctagttaaa

SEQ ID NO: 2340189 - DNA, 19 bp, Homo sapiens
cttataacctagttaaaga

SEQ ID NO: 2340190 - DNA, 15 bp, Homo sapiens
cttatgaggagggga

SEQ ID NO: 2340191 - DNA, 18 bp, Homo sapiens
cttatgtgaaaaattaac

SEQ ID NO: 2340192 - DNA, 19 bp, Homo sapiens
cttatgtgaaaaattaact

SEQ ID NO: 2340193 - DNA, 23 bp, Homo sapiens
cttatgtgacattaacaaataaa

SEQ ID NO: 2340194 - DNA, 20 bp, Homo sapiens
cttattatgtaggtaagact

SEQ ID NO: 2340195 - DNA, 15 bp, Homo sapiens
cttattggaactctg

SEQ ID NO: 2340196 - DNA, 18 bp, Homo sapiens
cttattggaactctgctt

SEQ ID NO: 2340197 - DNA, 18 bp, Homo sapiens
cttatttgctcataagta

SEQ ID NO: 2340198 - DNA, 23 bp, Homo sapiens
cttatttgctcataagtaaatgt

SEQ ID NO: 2340199 - DNA, 18 bp, Homo sapiens
cttatttggcgtgacccg

SEQ ID NO: 2340200 - DNA, 15 bp, Homo sapiens
cttcaaagccttctc

SEQ ID NO: 2340201 - DNA, 18 bp, Homo sapiens
cttcaacttttctcttta

SEQ ID NO: 2340202 - DNA, 18 bp, Homo sapiens
cttcaaggaggcccactg

SEQ ID NO: 2340203 - DNA, 17 bp, Homo sapiens
cttcaatggaatacagt

SEQ ID NO: 2340204 - DNA, 13 bp, Homo sapiens
cttcagcacagga

SEQ ID NO: 2340205 - DNA, 12 bp, Homo sapiens
cttcagcccagg

SEQ ID NO: 2340206 - DNA, 13 bp, Homo sapiens
cttcagctccagg

SEQ ID NO: 2340207 - DNA, 20 bp, Homo sapiens
cttcaggatattggttcttc

SEQ ID NO: 2340208 - DNA, 15 bp, Homo sapiens
cttcagggctgagtt

SEQ ID NO: 2340209 - DNA, 17 bp, Homo sapiens
cttcagttatgattttt

SEQ ID NO: 2340210 - DNA, 14 bp, Homo sapiens
cttcagttgcttgt

SEQ ID NO: 2340211 - DNA, 15 bp, Homo sapiens
cttcagttgcttgtc

SEQ ID NO: 2340212 - DNA, 14 bp, Homo sapiens
cttcatctggcaac

SEQ ID NO: 2340213 - DNA, 13 bp, Homo sapiens
cttcatcttcctg

SEQ ID NO: 2340214 - DNA, 19 bp, Homo sapiens
cttcatcttcctgtgtcct

SEQ ID NO: 2340215 - DNA, 19 bp, Homo sapiens
cttcatttgacacaaagct

SEQ ID NO: 2340216 - DNA, 11 bp, Homo sapiens
cttcatttgta

SEQ ID NO: 2340217 - DNA, 14 bp, Homo sapiens
cttccaaataaata

SEQ ID NO: 2340218 - DNA, 15 bp, Homo sapiens
cttccaaatgtccct

SEQ ID NO: 2340219 - DNA, 17 bp, Homo sapiens
cttccaacatgtgatgt

SEQ ID NO: 2340220 - DNA, 16 bp, Homo sapiens
cttccaattaatgctt

SEQ ID NO: 2340221 - DNA, 16 bp, Homo sapiens
cttccagagaggacct

SEQ ID NO: 2340222 - DNA, 18 bp, Homo sapiens
cttccagatcactgccac

SEQ ID NO: 2340223 - DNA, 18 bp, Homo sapiens
cttccaggaaactccaca

SEQ ID NO: 2340224 - DNA, 21 bp, Homo sapiens
cttccaggaaactccacatct

SEQ ID NO: 2340225 - DNA, 20 bp, Homo sapiens
cttccagtcttcctgacact

SEQ ID NO: 2340226 - DNA, 14 bp, Homo sapiens
cttccagtgaacat

SEQ ID NO: 2340227 - DNA, 21 bp, Homo sapiens
cttccagtgaacattcccagc

SEQ ID NO: 2340228 - DNA, 17 bp, Homo sapiens
cttccagtgtcatttct

SEQ ID NO: 2340229 - DNA, 17 bp, Homo sapiens
cttccatacacagagga

SEQ ID NO: 2340230 - DNA, 13 bp, Homo sapiens
cttccatgcctta

SEQ ID NO: 2340231 - DNA, 15 bp, Homo sapiens
cttcccattaaaaat

SEQ ID NO: 2340232 - DNA, 22 bp, Homo sapiens
cttcccattaaaaatgagattt

SEQ ID NO: 2340233 - DNA, 19 bp, Homo sapiens
cttcccgggccagggctgc

SEQ ID NO: 2340234 - DNA, 20 bp, Homo sapiens
cttccctctctgatgtccca

SEQ ID NO: 2340235 - DNA, 19 bp, Homo sapiens
cttcctctagaagccaagg

SEQ ID NO: 2340236 - DNA, 13 bp, Homo sapiens
cttcctgcccttc

SEQ ID NO: 2340237 - DNA, 16 bp, Homo sapiens
cttcctgcccttccct

SEQ ID NO: 2340238 - DNA, 17 bp, Homo sapiens
cttcctgcccttccctc

SEQ ID NO: 2340239 - DNA, 18 bp, Homo sapiens
cttcctgcgtcctcctca

SEQ ID NO: 2340240 - DNA, 21 bp, Homo sapiens
cttcctgcgtcctcctcacct

SEQ ID NO: 2340241 - DNA, 12 bp, Homo sapiens
cttcctggcctg

SEQ ID NO: 2340242 - DNA, 15 bp, Homo sapiens
cttcctggcctgaga

SEQ ID NO: 2340243 - DNA, 20 bp, Homo sapiens
cttcctggtgaggcccagcc

SEQ ID NO: 2340244 - DNA, 12 bp, Homo sapiens
cttcctgtgtcc

SEQ ID NO: 2340245 - DNA, 15 bp, Homo sapiens
cttcctgtgtcctga

SEQ ID NO: 2340246 - DNA, 14 bp, Homo sapiens
cttcctttctctcc

SEQ ID NO: 2340247 - DNA, 15 bp, Homo sapiens
cttcctttctctcct

SEQ ID NO: 2340248 - DNA, 16 bp, Homo sapiens
cttccttttccctgct

SEQ ID NO: 2340249 - DNA, 15 bp, Homo sapiens
cttcgggaccaggat

SEQ ID NO: 2340250 - DNA, 13 bp, Homo sapiens
cttctaaatgcat

SEQ ID NO: 2340251 - DNA, 15 bp, Homo sapiens
cttctaaatgcatat

SEQ ID NO: 2340252 - DNA, 15 bp, Homo sapiens
cttctacctgccctc

SEQ ID NO: 2340253 - DNA, 16 bp, Homo sapiens
cttctacctgccctca

SEQ ID NO: 2340254 - DNA, 18 bp, Homo sapiens
cttctacctgccctcaag

SEQ ID NO: 2340255 - DNA, 18 bp, Homo sapiens
cttctactcacttttccc

SEQ ID NO: 2340256 - DNA, 23 bp, Homo sapiens
cttctactcacttttcccactcc

SEQ ID NO: 2340257 - DNA, 16 bp, Homo sapiens
cttctattaatcaaga

SEQ ID NO: 2340258 - DNA, 18 bp, Homo sapiens
cttctattaatcaagaga

SEQ ID NO: 2340259 - DNA, 13 bp, Homo sapiens
cttctattctagc

SEQ ID NO: 2340260 - DNA, 21 bp, Homo sapiens
cttctattctagcctgcattg

SEQ ID NO: 2340261 - DNA, 23 bp, Homo sapiens
cttctatttggggcttgatgact

SEQ ID NO: 2340262 - DNA, 14 bp, Homo sapiens
cttctcagaagcac

SEQ ID NO: 2340263 - DNA, 22 bp, Homo sapiens
cttctcagaagcacagaatatt

SEQ ID NO: 2340264 - DNA, 19 bp, Homo sapiens
cttctcagatttctgagga

SEQ ID NO: 2340265 - DNA, 14 bp, Homo sapiens
cttctcattcccat

SEQ ID NO: 2340266 - DNA, 13 bp, Homo sapiens
cttctcccactct

SEQ ID NO: 2340267 - DNA, 19 bp, Homo sapiens
cttctcccactctcctagg

SEQ ID NO: 2340268 - DNA, 14 bp, Homo sapiens
cttctccgccagcc

SEQ ID NO: 2340269 - DNA, 15 bp, Homo sapiens
cttctccgccagcct

SEQ ID NO: 2340270 - DNA, 16 bp, Homo sapiens
cttctccgccagcctc

SEQ ID NO: 2340271 - DNA, 17 bp, Homo sapiens
cttctccgccagcctcc

SEQ ID NO: 2340272 - DNA, 21 bp, Homo sapiens
cttctccgccagcctcctctg

SEQ ID NO: 2340273 - DNA, 24 bp, Homo sapiens
cttctccgccagcctcctctggac

SEQ ID NO: 2340274 - DNA, 17 bp, Homo sapiens
cttctgagctatttcat

SEQ ID NO: 2340275 - DNA, 20 bp, Homo sapiens
cttctgagctatttcatcta

SEQ ID NO: 2340276 - DNA, 13 bp, Homo sapiens
cttctgagctcct

SEQ ID NO: 2340277 - DNA, 16 bp, Homo sapiens
cttctgagctcctgtc

SEQ ID NO: 2340278 - DNA, 16 bp, Homo sapiens
cttctgccttctcatg

SEQ ID NO: 2340279 - DNA, 13 bp, Homo sapiens
cttctgctggggc

SEQ ID NO: 2340280 - DNA, 15 bp, Homo sapiens
cttctgctggggcct

SEQ ID NO: 2340281 - DNA, 13 bp, Homo sapiens
cttctggccttgt

SEQ ID NO: 2340282 - DNA, 23 bp, Homo sapiens
cttctgggcttcattctggaaac

SEQ ID NO: 2340283 - DNA, 23 bp, Homo sapiens
atagaaattttgtaagaaggcaa

SEQ ID NO: 2340284 - DNA, 15 bp, Homo sapiens
atagacaaaaagtat

SEQ ID NO: 2340285 - DNA, 12 bp, Homo sapiens
atagacatgaaa

SEQ ID NO: 2340286 - DNA, 16 bp, Homo sapiens
atagactcctttgcta

SEQ ID NO: 2340287 - DNA, 12 bp, Homo sapiens
atagacttggga

SEQ ID NO: 2340288 - DNA, 13 bp, Homo sapiens
atagacttgggat

SEQ ID NO: 2340289 - DNA, 19 bp, Homo sapiens
atagaggctagcttctgct

SEQ ID NO: 2340290 - DNA, 21 bp, Homo sapiens
atagaggcttctccgccagcc

SEQ ID NO: 2340291 - DNA, 13 bp, Homo sapiens
atagatctccagc

SEQ ID NO: 2340292 - DNA, 19 bp, Homo sapiens
atagatctccagcgtcagc

SEQ ID NO: 2340293 - DNA, 17 bp, Homo sapiens
atagattttattatgtt

SEQ ID NO: 2340294 - DNA, 16 bp, Homo sapiens
atagcatgaaataaaa

SEQ ID NO: 2340295 - DNA, 17 bp, Homo sapiens
atagctcactgcagcct

SEQ ID NO: 2340296 - DNA, 20 bp, Homo sapiens
atagctcactgcagcctcat

SEQ ID NO: 2340297 - DNA, 16 bp, Homo sapiens
atagctcgagcaaaat

SEQ ID NO: 2340298 - DNA, 15 bp, Homo sapiens
atagctgtacttctt

SEQ ID NO: 2340299 - DNA, 22 bp, Homo sapiens
atagctgtacttcttgaatata

SEQ ID NO: 2340300 - DNA, 17 bp, Homo sapiens
ataggaagggatctgag

SEQ ID NO: 2340301 - DNA, 18 bp, Homo sapiens
ataggaatcattcagaaa

SEQ ID NO: 2340302 - DNA, 21 bp, Homo sapiens
ataggaatcattcagaaatgt

SEQ ID NO: 2340303 - DNA, 23 bp, Homo sapiens
ataggagaggatgagagcccaga

SEQ ID NO: 2340304 - DNA, 18 bp, Homo sapiens
ataggccgagctgtggac

SEQ ID NO: 2340305 - DNA, 18 bp, Homo sapiens
ataggctattaaaaaagt

SEQ ID NO: 2340306 - DNA, 18 bp, Homo sapiens
ataggctattttctaaag

SEQ ID NO: 2340307 - DNA, 17 bp, Homo sapiens
atagggctgagctctct

SEQ ID NO: 2340308 - DNA, 17 bp, Homo sapiens
ataggtcatcatgaaag

SEQ ID NO: 2340309 - DNA, 21 bp, Homo sapiens
ataggttaaaaaaaaaagtca

SEQ ID NO: 2340310 - DNA, 16 bp, Homo sapiens
atagtaaatgtgtttc

SEQ ID NO: 2340311 - DNA, 14 bp, Homo sapiens
atagtaataagatg

SEQ ID NO: 2340312 - DNA, 20 bp, Homo sapiens
atagtaataagatggctgtg

SEQ ID NO: 2340313 - DNA, 15 bp, Homo sapiens
atagtgggatttcca

SEQ ID NO: 2340314 - DNA, 14 bp, Homo sapiens
atagtgtaacttgc

SEQ ID NO: 2340315 - DNA, 23 bp, Homo sapiens
atagtgtaacttgcttaaatttc

SEQ ID NO: 2340316 - DNA, 17 bp, Homo sapiens
atagttctgtaataaaa

SEQ ID NO: 2340317 - DNA, 15 bp, Homo sapiens
atagttgtaaagata

SEQ ID NO: 2340318 - DNA, 13 bp, Homo sapiens
atagtttctttat

SEQ ID NO: 2340319 - DNA, 19 bp, Homo sapiens
atagtttctttattttgtg

SEQ ID NO: 2340320 - DNA, 21 bp, Homo sapiens
atagttttacttttaaactgt

SEQ ID NO: 2340321 - DNA, 17 bp, Homo sapiens
atataaatgatgattga

SEQ ID NO: 2340322 - DNA, 18 bp, Homo sapiens
atataaatgtataaatat

SEQ ID NO: 2340323 - DNA, 14 bp, Homo sapiens
atataatgaacacg

SEQ ID NO: 2340324 - DNA, 11 bp, Homo sapiens
atataatttta

SEQ ID NO: 2340325 - DNA, 18 bp, Homo sapiens
atatacacatagttctgt

SEQ ID NO: 2340326 - DNA, 16 bp, Homo sapiens
atatacattgcttaga

SEQ ID NO: 2340327 - DNA, 17 bp, Homo sapiens
atatacattttctaaat

SEQ ID NO: 2340328 - DNA, 23 bp, Homo sapiens
atatacattttctaaataaaaat

SEQ ID NO: 2340329 - DNA, 13 bp, Homo sapiens
atatactatattt

SEQ ID NO: 2340330 - DNA, 15 bp, Homo sapiens
atatagattttatta

SEQ ID NO: 2340331 - DNA, 19 bp, Homo sapiens
atatagattttattatgtt

SEQ ID NO: 2340332 - DNA, 18 bp, Homo sapiens
atatagctcgagcaaaat

SEQ ID NO: 2340333 - DNA, 18 bp, Homo sapiens
atatagttgaggccgagg

SEQ ID NO: 2340334 - DNA, 18 bp, Homo sapiens
atatagttttacttttaa

SEQ ID NO: 2340335 - DNA, 21 bp, Homo sapiens
atatataaaacggtgctgtga

SEQ ID NO: 2340336 - DNA, 12 bp, Homo sapiens
atatataaatgt

SEQ ID NO: 2340337 - DNA, 16 bp, Homo sapiens
atatataaatgtataa

SEQ ID NO: 2340338 - DNA, 13 bp, Homo sapiens
atatatacatata

SEQ ID NO: 2340339 - DNA, 19 bp, Homo sapiens
atatatcaagaagtcttga

SEQ ID NO: 2340340 - DNA, 20 bp, Homo sapiens
atatatcaagaagtcttgaa

SEQ ID NO: 2340341 - DNA, 21 bp, Homo sapiens
atatatcacccagacataaag

SEQ ID NO: 2340342 - DNA, 13 bp, Homo sapiens
atatatgtgtgcc

SEQ ID NO: 2340343 - DNA, 14 bp, Homo sapiens
atatatgttcatat

SEQ ID NO: 2340344 - DNA, 15 bp, Homo sapiens
atatattgaactttt

SEQ ID NO: 2340345 - DNA, 18 bp, Homo sapiens
atatattttacaattttt

SEQ ID NO: 2340346 - DNA, 22 bp, Homo sapiens
atatattttgtgtgaaattgca

SEQ ID NO: 2340347 - DNA, 21 bp, Homo sapiens
atatattttttattaatattt

SEQ ID NO: 2340348 - DNA, 21 bp, Homo sapiens
atatattttttgttattatta

SEQ ID NO: 2340349 - DNA, 21 bp, Homo sapiens
atatcaaagtcattaaagaca

SEQ ID NO: 2340350 - DNA, 15 bp, Homo sapiens
atatcaaataaaata

SEQ ID NO: 2340351 - DNA, 17 bp, Homo sapiens
atatcaaataaaatatc

SEQ ID NO: 2340352 - DNA, 21 bp, Homo sapiens
atatcaaataaaatatcataa

SEQ ID NO: 2340353 - DNA, 14 bp, Homo sapiens
atatcaactctgaa

SEQ ID NO: 2340354 - DNA, 14 bp, Homo sapiens
atatcacccagaca

SEQ ID NO: 2340355 - DNA, 21 bp, Homo sapiens
atatcacccagacataaagga

SEQ ID NO: 2340356 - DNA, 19 bp, Homo sapiens
atatcaggtgtataaatgt

SEQ ID NO: 2340357 - DNA, 16 bp, Homo sapiens
atatcagttacagtgg

SEQ ID NO: 2340358 - DNA, 17 bp, Homo sapiens
atatcagttacagtggc

SEQ ID NO: 2340359 - DNA, 21 bp, Homo sapiens
atatcagttacagtggcagta

SEQ ID NO: 2340360 - DNA, 13 bp, Homo sapiens
atatcatgtgatt

SEQ ID NO: 2340361 - DNA, 19 bp, Homo sapiens
atatcctctccccctcctc

SEQ ID NO: 2340362 - DNA, 22 bp, Homo sapiens
atatcctctccccctcctccag

SEQ ID NO: 2340363 - DNA, 13 bp, Homo sapiens
atatcctgagcca

SEQ ID NO: 2340364 - DNA, 15 bp, Homo sapiens
atatctaaatagtat

SEQ ID NO: 2340365 - DNA, 16 bp, Homo sapiens
atatctaactttgtaa

SEQ ID NO: 2340366 - DNA, 23 bp, Homo sapiens
atatctaactttgtaaccagaat

SEQ ID NO: 2340367 - DNA, 14 bp, Homo sapiens
atatctatgggaaa

SEQ ID NO: 2340368 - DNA, 15 bp, Homo sapiens
atatctatttgaata

SEQ ID NO: 2340369 - DNA, 21 bp, Homo sapiens
atatctatttgaataaattat

SEQ ID NO: 2340370 - DNA, 22 bp, Homo sapiens
atatctccatggccctgtccca

SEQ ID NO: 2340371 - DNA, 20 bp, Homo sapiens
atatctgtacagatcaagaa

SEQ ID NO: 2340372 - DNA, 19 bp, Homo sapiens
atatgaaataagtaaatgt

SEQ ID NO: 2340373 - DNA, 15 bp, Homo sapiens
atatgaacatattgt

SEQ ID NO: 2340374 - DNA, 15 bp, Homo sapiens
atatgaattgtacag

SEQ ID NO: 2340375 - DNA, 15 bp, Homo sapiens
atatgaccagaagcc

SEQ ID NO: 2340376 - DNA, 16 bp, Homo sapiens
atatgacggaagaaca

SEQ ID NO: 2340377 - DNA, 20 bp, Homo sapiens
atatgacggaagaacataga

SEQ ID NO: 2340378 - DNA, 15 bp, Homo sapiens
atatgcaccttgtgt

SEQ ID NO: 2340379 - DNA, 14 bp, Homo sapiens
atatgccttgtata

SEQ ID NO: 2340380 - DNA, 15 bp, Homo sapiens
atatgctgatctttt

SEQ ID NO: 2340381 - DNA, 14 bp, Homo sapiens
atatgcttactgat

SEQ ID NO: 2340382 - DNA, 15 bp, Homo sapiens
atatggactctgcac

SEQ ID NO: 2340383 - DNA, 16 bp, Homo sapiens
atatggactctgcaca

SEQ ID NO: 2340384 - DNA, 12 bp, Homo sapiens
atatggcagaag

SEQ ID NO: 2340385 - DNA, 21 bp, Homo sapiens
atatgggggcatctcttcccc

SEQ ID NO: 2340386 - DNA, 20 bp, Homo sapiens
atatggttctccaagaaact

SEQ ID NO: 2340387 - DNA, 14 bp, Homo sapiens
atatgtaatttcaa

SEQ ID NO: 2340388 - DNA, 21 bp, Homo sapiens
atatgtaatttcaaaatacat

SEQ ID NO: 2340389 - DNA, 15 bp, Homo sapiens
atatgtagtatctat

SEQ ID NO: 2340390 - DNA, 13 bp, Homo sapiens
atatgtattcttt

SEQ ID NO: 2340391 - DNA, 14 bp, Homo sapiens
atatgtattctttt

SEQ ID NO: 2340392 - DNA, 21 bp, Homo sapiens
atatgtttaaaataaaatgaa

SEQ ID NO: 2340393 - DNA, 12 bp, Homo sapiens
atattaaaaaac

SEQ ID NO: 2340394 - DNA, 17 bp, Homo sapiens
atattaaaaaacttcat

SEQ ID NO: 2340395 - DNA, 22 bp, Homo sapiens
atattaaacaaagtttcagagt

SEQ ID NO: 2340396 - DNA, 13 bp, Homo sapiens
atattacaatgat

SEQ ID NO: 2340397 - DNA, 17 bp, Homo sapiens
atattactgacatttct

SEQ ID NO: 2340398 - DNA, 18 bp, Homo sapiens
atcctggctaacatggtg

SEQ ID NO: 2340399 - DNA, 19 bp, Homo sapiens
atccttagaggtcctctgg

SEQ ID NO: 2340400 - DNA, 20 bp, Homo sapiens
atccttcaaaataaaaagta

SEQ ID NO: 2340401 - DNA, 14 bp, Homo sapiens
atccttggagagca

SEQ ID NO: 2340402 - DNA, 19 bp, Homo sapiens
atccttgtcttttgagcta

SEQ ID NO: 2340403 - DNA, 20 bp, Homo sapiens
atccttgtgttcagctcttt

SEQ ID NO: 2340404 - DNA, 15 bp, Homo sapiens
atcgagaccatcctg

SEQ ID NO: 2340405 - DNA, 14 bp, Homo sapiens
atcggactctgccc

SEQ ID NO: 2340406 - DNA, 17 bp, Homo sapiens
atcggactctgcccctg

SEQ ID NO: 2340407 - DNA, 13 bp, Homo sapiens
atcggactgccaa

SEQ ID NO: 2340408 - DNA, 15 bp, Homo sapiens
atcggactgccaaat

SEQ ID NO: 2340409 - DNA, 21 bp, Homo sapiens
atcggtgaaactaacagataa

SEQ ID NO: 2340410 - DNA, 21 bp, Homo sapiens
atcgtgtgccatggatctgat

SEQ ID NO: 2340411 - DNA, 13 bp, Homo sapiens
atctaaagttttg

SEQ ID NO: 2340412 - DNA, 14 bp, Homo sapiens
atctaaagttttgt

SEQ ID NO: 2340413 - DNA, 14 bp, Homo sapiens
atctaaatagtatt

SEQ ID NO: 2340414 - DNA, 18 bp, Homo sapiens
atctaaatagtattttgt

SEQ ID NO: 2340415 - DNA, 12 bp, Homo sapiens
atctacaagcca

SEQ ID NO: 2340416 - DNA, 13 bp, Homo sapiens
atctacaagccaa

SEQ ID NO: 2340417 - DNA, 23 bp, Homo sapiens
atctacaatctctttttgtttgc

SEQ ID NO: 2340418 - DNA, 19 bp, Homo sapiens
atctagccagcccctcttc

SEQ ID NO: 2340419 - DNA, 20 bp, Homo sapiens
atctagcctaaagtatacaa

SEQ ID NO: 2340420 - DNA, 18 bp, Homo sapiens
atctataggcagcttcta

SEQ ID NO: 2340421 - DNA, 16 bp, Homo sapiens
atctatctagttctaa

SEQ ID NO: 2340422 - DNA, 19 bp, Homo sapiens
atctatctcatctatctca

SEQ ID NO: 2340423 - DNA, 15 bp, Homo sapiens
atctatgggaaaaat

SEQ ID NO: 2340424 - DNA, 20 bp, Homo sapiens
atctatttgaataaattatg

SEQ ID NO: 2340425 - DNA, 19 bp, Homo sapiens
atctatttttggcagtctg

SEQ ID NO: 2340426 - DNA, 14 bp, Homo sapiens
atctcaaaaaaaca

SEQ ID NO: 2340427 - DNA, 22 bp, Homo sapiens
atctcaaaaaaacaagttatta

SEQ ID NO: 2340428 - DNA, 23 bp, Homo sapiens
atctcaaataggctattaaaaaa

SEQ ID NO: 2340429 - DNA, 23 bp, Homo sapiens
atctcaagatgggggcagggctg

SEQ ID NO: 2340430 - DNA, 14 bp, Homo sapiens
atctcacaggctga

SEQ ID NO: 2340431 - DNA, 17 bp, Homo sapiens
atctcacaggctgagaa

SEQ ID NO: 2340432 - DNA, 12 bp, Homo sapiens
atctcagaacct

SEQ ID NO: 2340433 - DNA, 23 bp, Homo sapiens
atctcagctttgagaagccttca

SEQ ID NO: 2340434 - DNA, 18 bp, Homo sapiens
atctcagtcatgcataaa

SEQ ID NO: 2340435 - DNA, 21 bp, Homo sapiens
atctcagtcatgcataaatat

SEQ ID NO: 2340436 - DNA, 14 bp, Homo sapiens
atctccatggccct

SEQ ID NO: 2340437 - DNA, 21 bp, Homo sapiens
atctccatggccctgtcccag

SEQ ID NO: 2340438 - DNA, 15 bp, Homo sapiens
atctcccaaggctgc

SEQ ID NO: 2340439 - DNA, 22 bp, Homo sapiens
atctcccctcctggcgagttct

SEQ ID NO: 2340440 - DNA, 18 bp, Homo sapiens
atctccctgcctggcccc

SEQ ID NO: 2340441 - DNA, 20 bp, Homo sapiens
atctccctgcctggccccca

SEQ ID NO: 2340442 - DNA, 17 bp, Homo sapiens
atctcctggtgttctgc

SEQ ID NO: 2340443 - DNA, 19 bp, Homo sapiens
atctcctggtgttctgcag

SEQ ID NO: 2340444 - DNA, 15 bp, Homo sapiens
atctctaaagagcat

SEQ ID NO: 2340445 - DNA, 13 bp, Homo sapiens
atctcttcattat

SEQ ID NO: 2340446 - DNA, 14 bp, Homo sapiens
atctcttccccaga

SEQ ID NO: 2340447 - DNA, 15 bp, Homo sapiens
atctcttccccagag

SEQ ID NO: 2340448 - DNA, 21 bp, Homo sapiens
atctgaccctatgggtctagg

SEQ ID NO: 2340449 - DNA, 20 bp, Homo sapiens
atctgatcaagagtccggat

SEQ ID NO: 2340450 - DNA, 19 bp, Homo sapiens
atctgatggccttaatttc

SEQ ID NO: 2340451 - DNA, 21 bp, Homo sapiens
atctgatggccttaatttcct

SEQ ID NO: 2340452 - DNA, 22 bp, Homo sapiens
atctgatggccttaatttcctt

SEQ ID NO: 2340453 - DNA, 21 bp, Homo sapiens
atctgcaaaaggcctcttgta

SEQ ID NO: 2340454 - DNA, 22 bp, Homo sapiens
atctgcaaaaggcctcttgtaa

SEQ ID NO: 2340455 - DNA, 17 bp, Homo sapiens
atctgcaagaacactgg

SEQ ID NO: 2340456 - DNA, 10 bp, Homo sapiens
atctgcaccc

SEQ ID NO: 2340457 - DNA, 17 bp, Homo sapiens
atctgcaccccttctct

SEQ ID NO: 2340458 - DNA, 22 bp, Homo sapiens
atctgcaccccttctctcctcc

SEQ ID NO: 2340459 - DNA, 14 bp, Homo sapiens
atctgcagggagca

SEQ ID NO: 2340460 - DNA, 15 bp, Homo sapiens
atctgcctgcgctct

SEQ ID NO: 2340461 - DNA, 21 bp, Homo sapiens
atctgccttaaaaccaaagag

SEQ ID NO: 2340462 - DNA, 23 bp, Homo sapiens
atctgcggatctcagctttgaga

SEQ ID NO: 2340463 - DNA, 13 bp, Homo sapiens
atctgctcctccc

SEQ ID NO: 2340464 - DNA, 15 bp, Homo sapiens
atctgctctgtttta

SEQ ID NO: 2340465 - DNA, 17 bp, Homo sapiens
atctgggcattttcctc

SEQ ID NO: 2340466 - DNA, 20 bp, Homo sapiens
atctgtaagagcttgctcca

SEQ ID NO: 2340467 - DNA, 15 bp, Homo sapiens
atctgttagggcctt

SEQ ID NO: 2340468 - DNA, 14 bp, Homo sapiens
atctgttgtaatat

SEQ ID NO: 2340469 - DNA, 18 bp, Homo sapiens
atctgttgtaatatcagt

SEQ ID NO: 2340470 - DNA, 19 bp, Homo sapiens
atctgttgtaatatcagtt

SEQ ID NO: 2340471 - DNA, 16 bp, Homo sapiens
atctgtttatttacaa

SEQ ID NO: 2340472 - DNA, 22 bp, Homo sapiens
atctgtttgaagattatatgaa

SEQ ID NO: 2340473 - DNA, 22 bp, Homo sapiens
atcttaatctgtttatttacaa

SEQ ID NO: 2340474 - DNA, 17 bp, Homo sapiens
atcttacaatattgatt

SEQ ID NO: 2340475 - DNA, 21 bp, Homo sapiens
atcttagtgcctgagagtatt

SEQ ID NO: 2340476 - DNA, 24 bp, Homo sapiens
atcttataaagtggaagtatgtat

SEQ ID NO: 2340477 - DNA, 14 bp, Homo sapiens
atcttcccatgcat

SEQ ID NO: 2340478 - DNA, 13 bp, Homo sapiens
atcttcctgtgtc

SEQ ID NO: 2340479 - DNA, 14 bp, Homo sapiens
atcttcctgtgtcc

SEQ ID NO: 2340480 - DNA, 23 bp, Homo sapiens
atcttctcattcccatgtggaac

SEQ ID NO: 2340481 - DNA, 12 bp, Homo sapiens
atcttgctggct

SEQ ID NO: 2340482 - DNA, 20 bp, Homo sapiens
atcttgggtgtattctctgt

SEQ ID NO: 2340483 - DNA, 14 bp, Homo sapiens
atcttgttcaggaa

SEQ ID NO: 2340484 - DNA, 17 bp, Homo sapiens
atcttgttcaggaaaag

SEQ ID NO: 2340485 - DNA, 19 bp, Homo sapiens
atcttgttcaggaaaaggt

SEQ ID NO: 2340486 - DNA, 14 bp, Homo sapiens
atctttaatttata

SEQ ID NO: 2340487 - DNA, 17 bp, Homo sapiens
atctttacctgtataca

SEQ ID NO: 2340488 - DNA, 16 bp, Homo sapiens
atctttattgaaattc

SEQ ID NO: 2340489 - DNA, 17 bp, Homo sapiens
atctttcagaaatataa

SEQ ID NO: 2340490 - DNA, 19 bp, Homo sapiens
atctttctccctcaactga

SEQ ID NO: 2340491 - DNA, 23 bp, Homo sapiens
atctttctccctcaactgaaggg

SEQ ID NO: 2340492 - DNA, 15 bp, Homo sapiens
atctttctcttccct

SEQ ID NO: 2340493 - DNA, 18 bp, Homo sapiens
atctttctcttccctgaa

SEQ ID NO: 2340494 - DNA, 20 bp, Homo sapiens
atctttgtaccaaaatttta

SEQ ID NO: 2340495 - DNA, 21 bp, Homo sapiens
atctttgtaccaaaattttaa

SEQ ID NO: 2340496 - DNA, 17 bp, Homo sapiens
atcttttaaaatcatga

SEQ ID NO: 2340497 - DNA, 22 bp, Homo sapiens
atcttttctaatcacagtgttg

SEQ ID NO: 2340498 - DNA, 17 bp, Homo sapiens
atcttttgaagcataga

SEQ ID NO: 2340499 - DNA, 17 bp, Homo sapiens
atgaaaaagctgcttct

SEQ ID NO: 2340500 - DNA, 13 bp, Homo sapiens
atgaaaacatgta

SEQ ID NO: 2340501 - DNA, 12 bp, Homo sapiens
atgaaaatggaa

SEQ ID NO: 2340502 - DNA, 14 bp, Homo sapiens
atgaaaatgtattc

SEQ ID NO: 2340503 - DNA, 11 bp, Homo sapiens
atgaaaattgt

SEQ ID NO: 2340504 - DNA, 12 bp, Homo sapiens
atgaaagaaaat

SEQ ID NO: 2340505 - DNA, 16 bp, Homo sapiens
atgaaataaaatatat

SEQ ID NO: 2340506 - DNA, 18 bp, Homo sapiens
atgaaatgcatatttgca

SEQ ID NO: 2340507 - DNA, 15 bp, Homo sapiens
atgaaattcttccta

SEQ ID NO: 2340508 - DNA, 14 bp, Homo sapiens
atgaaatttaagca

SEQ ID NO: 2340509 - DNA, 18 bp, Homo sapiens
atgaaatttaagcacaaa

SEQ ID NO: 2340510 - DNA, 15 bp, Homo sapiens
atgaacagctgtgtc

SEQ ID NO: 2340511 - DNA, 14 bp, Homo sapiens
atgaagaactgagg

SEQ ID NO: 2340512 - DNA, 16 bp, Homo sapiens
atgaataatgaaaata

SEQ ID NO: 2340513 - DNA, 14 bp, Homo sapiens
atgtctgttctaca

SEQ ID NO: 2340514 - DNA, 16 bp, Homo sapiens
atgtctgttctacata

SEQ ID NO: 2340515 - DNA, 16 bp, Homo sapiens
atgtctgttgatgact

SEQ ID NO: 2340516 - DNA, 23 bp, Homo sapiens
atgtctgtttattaactactgaa

SEQ ID NO: 2340517 - DNA, 11 bp, Homo sapiens
atgtcttccct

SEQ ID NO: 2340518 - DNA, 16 bp, Homo sapiens
atgtcttccctgggct

SEQ ID NO: 2340519 - DNA, 16 bp, Homo sapiens
atgtcttggacactgt

SEQ ID NO: 2340520 - DNA, 17 bp, Homo sapiens
atgtgaaaaattaactt

SEQ ID NO: 2340521 - DNA, 12 bp, Homo sapiens
atgtgaaacctt

SEQ ID NO: 2340522 - DNA, 15 bp, Homo sapiens
atgtgaaaccttttt

SEQ ID NO: 2340523 - DNA, 23 bp, Homo sapiens
atgtgaaaccttttttaagattt

SEQ ID NO: 2340524 - DNA, 18 bp, Homo sapiens
atgtgaattattgacact

SEQ ID NO: 2340525 - DNA, 11 bp, Homo sapiens
atgtgaatttt

SEQ ID NO: 2340526 - DNA, 17 bp, Homo sapiens
atgtgaatttttaagct

SEQ ID NO: 2340527 - DNA, 19 bp, Homo sapiens
atgtgaatttttaagctgc

SEQ ID NO: 2340528 - DNA, 15 bp, Homo sapiens
atgtgacattaacaa

SEQ ID NO: 2340529 - DNA, 22 bp, Homo sapiens
atgtgactaaaggaaaaaactt

SEQ ID NO: 2340530 - DNA, 21 bp, Homo sapiens
atgtgagattactttgtcccg

SEQ ID NO: 2340531 - DNA, 21 bp, Homo sapiens
atgtgagccaccgtgcctggc

SEQ ID NO: 2340532 - DNA, 21 bp, Homo sapiens
atgtgagctgtaaaaatgtta

SEQ ID NO: 2340533 - DNA, 20 bp, Homo sapiens
atgtgagtgacgatgatgta

SEQ ID NO: 2340534 - DNA, 19 bp, Homo sapiens
atgtgatttataacgcaca

SEQ ID NO: 2340535 - DNA, 18 bp, Homo sapiens
atgtgcaaaggtgtgctt

SEQ ID NO: 2340536 - DNA, 20 bp, Homo sapiens
atgtgcatttttgtgaaatg

SEQ ID NO: 2340537 - DNA, 22 bp, Homo sapiens
atgtgctataatctgtttttac

SEQ ID NO: 2340538 - DNA, 15 bp, Homo sapiens
atgtgctatacacac

SEQ ID NO: 2340539 - DNA, 19 bp, Homo sapiens
atgtgctatactgcatact

SEQ ID NO: 2340540 - DNA, 18 bp, Homo sapiens
atgtggaggaagagccac

SEQ ID NO: 2340541 - DNA, 19 bp, Homo sapiens
atgtggaggaagagccacc

SEQ ID NO: 2340542 - DNA, 23 bp, Homo sapiens
atgtggaggaagagccacctgca

SEQ ID NO: 2340543 - DNA, 22 bp, Homo sapiens
atgtggccctggctgccggcac

SEQ ID NO: 2340544 - DNA, 22 bp, Homo sapiens
atgtgggggcttcatctcttta

SEQ ID NO: 2340545 - DNA, 23 bp, Homo sapiens
atgtgtagcctgtgcatgtatgt

SEQ ID NO: 2340546 - DNA, 20 bp, Homo sapiens
atgtgtccgtgaaagttgtg

SEQ ID NO: 2340547 - DNA, 14 bp, Homo sapiens
atgtgtctcacatc

SEQ ID NO: 2340548 - DNA, 15 bp, Homo sapiens
atgtgttgctctcca

SEQ ID NO: 2340549 - DNA, 17 bp, Homo sapiens
atgttaaagagaatgag

SEQ ID NO: 2340550 - DNA, 20 bp, Homo sapiens
atgttaaatttgtaagtttc

SEQ ID NO: 2340551 - DNA, 23 bp, Homo sapiens
atgttaaatttgtaagtttcagg

SEQ ID NO: 2340552 - DNA, 17 bp, Homo sapiens
atgttatgaacagctgt

SEQ ID NO: 2340553 - DNA, 23 bp, Homo sapiens
atgttcctccttttcttcaccct

SEQ ID NO: 2340554 - DNA, 11 bp, Homo sapiens
atgttccttcc

SEQ ID NO: 2340555 - DNA, 13 bp, Homo sapiens
atgttctccattt

SEQ ID NO: 2340556 - DNA, 22 bp, Homo sapiens
atgttgataaaccaaaaacatt

SEQ ID NO: 2340557 - DNA, 23 bp, Homo sapiens
atgttgataaaccaaaaacattt

SEQ ID NO: 2340558 - DNA, 22 bp, Homo sapiens
atgttgcccctttctcttttcc

SEQ ID NO: 2340559 - DNA, 15 bp, Homo sapiens
atgttgggaaagtat

SEQ ID NO: 2340560 - DNA, 21 bp, Homo sapiens
atgttgggaaagtatttactt

SEQ ID NO: 2340561 - DNA, 18 bp, Homo sapiens
atgttggtcattttatgt

SEQ ID NO: 2340562 - DNA, 18 bp, Homo sapiens
atgttgttgaactaatat

SEQ ID NO: 2340563 - DNA, 22 bp, Homo sapiens
atgttgtttataataaaaatat

SEQ ID NO: 2340564 - DNA, 15 bp, Homo sapiens
atgtttaaaagaaat

SEQ ID NO: 2340565 - DNA, 23 bp, Homo sapiens
atgtttaaaatggcatttagcac

SEQ ID NO: 2340566 - DNA, 20 bp, Homo sapiens
atgtttaatggtgaaagttg

SEQ ID NO: 2340567 - DNA, 16 bp, Homo sapiens
atgtttatgagccaga

SEQ ID NO: 2340568 - DNA, 20 bp, Homo sapiens
atgtttatgagccagacaaa

SEQ ID NO: 2340569 - DNA, 17 bp, Homo sapiens
atgtttattaaatgctt

SEQ ID NO: 2340570 - DNA, 19 bp, Homo sapiens
atgtttattaaatgcttca

SEQ ID NO: 2340571 - DNA, 20 bp, Homo sapiens
atgtttattaaatgcttcat

SEQ ID NO: 2340572 - DNA, 21 bp, Homo sapiens
atgtttcattatgcactttta

SEQ ID NO: 2340573 - DNA, 13 bp, Homo sapiens
atgtttgaacaaa

SEQ ID NO: 2340574 - DNA, 18 bp, Homo sapiens
atgtttgcctcataatag

SEQ ID NO: 2340575 - DNA, 12 bp, Homo sapiens
atgtttggggtc

SEQ ID NO: 2340576 - DNA, 15 bp, Homo sapiens
atgttttatgacatt

SEQ ID NO: 2340577 - DNA, 16 bp, Homo sapiens
atgttttcaaaaggta

SEQ ID NO: 2340578 - DNA, 14 bp, Homo sapiens
atgttttcttcaac

SEQ ID NO: 2340579 - DNA, 15 bp, Homo sapiens
atgtttttaataaaa

SEQ ID NO: 2340580 - DNA, 13 bp, Homo sapiens
atgtttttccctc

SEQ ID NO: 2340581 - DNA, 22 bp, Homo sapiens
attaaaaaacttcatgtaattt

SEQ ID NO: 2340582 - DNA, 13 bp, Homo sapiens
attaaaaaagaga

SEQ ID NO: 2340583 - DNA, 19 bp, Homo sapiens
attaaaacaaatatacatt

SEQ ID NO: 2340584 - DNA, 13 bp, Homo sapiens
attaaaatatttc

SEQ ID NO: 2340585 - DNA, 18 bp, Homo sapiens
attaaaggaagcactctg

SEQ ID NO: 2340586 - DNA, 19 bp, Homo sapiens
attaaagtcagaagtttta

SEQ ID NO: 2340587 - DNA, 20 bp, Homo sapiens
attaaataaaatttttatgt

SEQ ID NO: 2340588 - DNA, 10 bp, Homo sapiens
attaaatgtg

SEQ ID NO: 2340589 - DNA, 16 bp, Homo sapiens
attaaatgtggaagga

SEQ ID NO: 2340590 - DNA, 16 bp, Homo sapiens
attaaattatcattgt

SEQ ID NO: 2340591 - DNA, 15 bp, Homo sapiens
attaaattgtaaaac

SEQ ID NO: 2340592 - DNA, 19 bp, Homo sapiens
attaagaaaactattaaga

SEQ ID NO: 2340593 - DNA, 17 bp, Homo sapiens
attaagggacatttcta

SEQ ID NO: 2340594 - DNA, 13 bp, Homo sapiens
attaataaaatat

SEQ ID NO: 2340595 - DNA, 15 bp, Homo sapiens
attaataaaatatct

SEQ ID NO: 2340596 - DNA, 22 bp, Homo sapiens
attaataaaatatctatttgaa

SEQ ID NO: 2340597 - DNA, 15 bp, Homo sapiens
attaataagattttt

SEQ ID NO: 2340598 - DNA, 21 bp, Homo sapiens
attaataagatttttcaaaat

SEQ ID NO: 2340599 - DNA, 15 bp, Homo sapiens
attaataatgaagta

SEQ ID NO: 2340600 - DNA, 19 bp, Homo sapiens
attaatagccaaagatttc

SEQ ID NO: 2340601 - DNA, 17 bp, Homo sapiens
attaatatttgcacatg

SEQ ID NO: 2340602 - DNA, 20 bp, Homo sapiens
attaatatttgcacatggga

SEQ ID NO: 2340603 - DNA, 16 bp, Homo sapiens
attaatcaagagaaac

SEQ ID NO: 2340604 - DNA, 17 bp, Homo sapiens
attaatcaagagaaact

SEQ ID NO: 2340605 - DNA, 20 bp, Homo sapiens
attaatcaagagaaacttca

SEQ ID NO: 2340606 - DNA, 22 bp, Homo sapiens
attaatcaagagaaacttcaaa

SEQ ID NO: 2340607 - DNA, 16 bp, Homo sapiens
attaatcatacaaact

SEQ ID NO: 2340608 - DNA, 22 bp, Homo sapiens
attaatcatacaaactctcacc

SEQ ID NO: 2340609 - DNA, 13 bp, Homo sapiens
attaatctcaaag

SEQ ID NO: 2340610 - DNA, 18 bp, Homo sapiens
attaatgataaactcaga

SEQ ID NO: 2340611 - DNA, 17 bp, Homo sapiens
attaatgcctgcttttt

SEQ ID NO: 2340612 - DNA, 20 bp, Homo sapiens
attaatgtctcactttactt

SEQ ID NO: 2340613 - DNA, 21 bp, Homo sapiens
attaatttggagcacaaaatt

SEQ ID NO: 2340614 - DNA, 16 bp, Homo sapiens
attacagttctttcct

SEQ ID NO: 2340615 - DNA, 23 bp, Homo sapiens
attacattttattaagctttttg

SEQ ID NO: 2340616 - DNA, 12 bp, Homo sapiens
attaccaaaata

SEQ ID NO: 2340617 - DNA, 14 bp, Homo sapiens
attaccaacctgtt

SEQ ID NO: 2340618 - DNA, 20 bp, Homo sapiens
attacctccatccatccttc

SEQ ID NO: 2340619 - DNA, 22 bp, Homo sapiens
attacctccatccatccttcca

SEQ ID NO: 2340620 - DNA, 16 bp, Homo sapiens
attacctgaaagccct

SEQ ID NO: 2340621 - DNA, 22 bp, Homo sapiens
attacctgaaagcccttctcaa

SEQ ID NO: 2340622 - DNA, 19 bp, Homo sapiens
attacctggatgttctttt

SEQ ID NO: 2340623 - DNA, 19 bp, Homo sapiens
attaccttctattggtctc

SEQ ID NO: 2340624 - DNA, 16 bp, Homo sapiens
attacctttaatttta

SEQ ID NO: 2340625 - DNA, 14 bp, Homo sapiens
attacctttacata

SEQ ID NO: 2340626 - DNA, 21 bp, Homo sapiens
attactgaataatatcaaata

SEQ ID NO: 2340627 - DNA, 19 bp, Homo sapiens
tgagacagggtcttgctct

SEQ ID NO: 2340628 - DNA, 20 bp, Homo sapiens
tgagacagggtcttgctctg

SEQ ID NO: 2340629 - DNA, 14 bp, Homo sapiens
tgagacagtgaatt

SEQ ID NO: 2340630 - DNA, 14 bp, Homo sapiens
tgagacagtttctt

SEQ ID NO: 2340631 - DNA, 18 bp, Homo sapiens
tgagacagtttcttagct

SEQ ID NO: 2340632 - DNA, 20 bp, Homo sapiens
tgagacagtttcttagcttt

SEQ ID NO: 2340633 - DNA, 22 bp, Homo sapiens
tgagaccctactgaagtggctg

SEQ ID NO: 2340634 - DNA, 15 bp, Homo sapiens
tgagactgccccacg

SEQ ID NO: 2340635 - DNA, 13 bp, Homo sapiens
tgagactgtgctg

SEQ ID NO: 2340636 - DNA, 18 bp, Homo sapiens
tgagagacgccactccct

SEQ ID NO: 2340637 - DNA, 15 bp, Homo sapiens
tgagagcataattta

SEQ ID NO: 2340638 - DNA, 15 bp, Homo sapiens
tgagagcccagaggt

SEQ ID NO: 2340639 - DNA, 20 bp, Homo sapiens
tgagagcccagaggtaacag

SEQ ID NO: 2340640 - DNA, 14 bp, Homo sapiens
tgagaggcaggcat

SEQ ID NO: 2340641 - DNA, 16 bp, Homo sapiens
tgagaggcaggcatag

SEQ ID NO: 2340642 - DNA, 17 bp, Homo sapiens
tgagagtcagctctctg

SEQ ID NO: 2340643 - DNA, 22 bp, Homo sapiens
tgagagtcagctctctgccctg

SEQ ID NO: 2340644 - DNA, 16 bp, Homo sapiens
tgagagttccttctca

SEQ ID NO: 2340645 - DNA, 18 bp, Homo sapiens
tgagagttccttctcact

SEQ ID NO: 2340646 - DNA, 19 bp, Homo sapiens
tgagagttccttctcactt

SEQ ID NO: 2340647 - DNA, 20 bp, Homo sapiens
tgagatcgtgctactgcact

SEQ ID NO: 2340648 - DNA, 23 bp, Homo sapiens
tgagatcgtgctactgcactcca

SEQ ID NO: 2340649 - DNA, 21 bp, Homo sapiens
tgagatggaaaagtgtccttc

SEQ ID NO: 2340650 - DNA, 16 bp, Homo sapiens
tgagatggagaggctg

SEQ ID NO: 2340651 - DNA, 17 bp, Homo sapiens
tgagatgggtgtacaaa

SEQ ID NO: 2340652 - DNA, 16 bp, Homo sapiens
tgagatggttcccaat

SEQ ID NO: 2340653 - DNA, 23 bp, Homo sapiens
tgagatggttcccaatatcatgt

SEQ ID NO: 2340654 - DNA, 16 bp, Homo sapiens
tgagatgtgagccttg

SEQ ID NO: 2340655 - DNA, 18 bp, Homo sapiens
tgagattactttgtcccg

SEQ ID NO: 2340656 - DNA, 22 bp, Homo sapiens
tgagattggttttcctgtggca

SEQ ID NO: 2340657 - DNA, 19 bp, Homo sapiens
tgagcaaccacatttagaa

SEQ ID NO: 2340658 - DNA, 15 bp, Homo sapiens
tgagcaccctctgga

SEQ ID NO: 2340659 - DNA, 14 bp, Homo sapiens
tgagcagaacaggt

SEQ ID NO: 2340660 - DNA, 14 bp, Homo sapiens
tgagcagcctctgg

SEQ ID NO: 2340661 - DNA, 22 bp, Homo sapiens
tgagcagcctctggacagccag

SEQ ID NO: 2340662 - DNA, 13 bp, Homo sapiens
tgagcaggctgtg

SEQ ID NO: 2340663 - DNA, 16 bp, Homo sapiens
tgagcatctgtccccc

SEQ ID NO: 2340664 - DNA, 21 bp, Homo sapiens
tgagcatgacagcctgcagca

SEQ ID NO: 2340665 - DNA, 15 bp, Homo sapiens
tgagccaccgtgcct

SEQ ID NO: 2340666 - DNA, 16 bp, Homo sapiens
tgagccaccgtgcctg

SEQ ID NO: 2340667 - DNA, 19 bp, Homo sapiens
tgagccaccgtgcctggcc

SEQ ID NO: 2340668 - DNA, 21 bp, Homo sapiens
tgagccaccgtgcctggccag

SEQ ID NO: 2340669 - DNA, 23 bp, Homo sapiens
tgagccctactccctgcagatgc

SEQ ID NO: 2340670 - DNA, 12 bp, Homo sapiens
tgagccctggct

SEQ ID NO: 2340671 - DNA, 15 bp, Homo sapiens
tgagccgcggggaag

SEQ ID NO: 2340672 - DNA, 17 bp, Homo sapiens
tgagccgggcccctggg

SEQ ID NO: 2340673 - DNA, 15 bp, Homo sapiens
tgagcctcctgtgcc

SEQ ID NO: 2340674 - DNA, 19 bp, Homo sapiens
tgagcctcctgtgcctggc

SEQ ID NO: 2340675 - DNA, 14 bp, Homo sapiens
tgagcgccacctct

SEQ ID NO: 2340676 - DNA, 17 bp, Homo sapiens
tgagctatcctttcaaa

SEQ ID NO: 2340677 - DNA, 23 bp, Homo sapiens
tgagctattttcctctggccgca

SEQ ID NO: 2340678 - DNA, 18 bp, Homo sapiens
tgagctcacatgggactg

SEQ ID NO: 2340679 - DNA, 21 bp, Homo sapiens
tgagctcacatgggactggga

SEQ ID NO: 2340680 - DNA, 18 bp, Homo sapiens
tgagctcctgtcccctgc

SEQ ID NO: 2340681 - DNA, 17 bp, Homo sapiens
tgagctctgaaatcttc

SEQ ID NO: 2340682 - DNA, 16 bp, Homo sapiens
tgagctgatctgcgga

SEQ ID NO: 2340683 - DNA, 21 bp, Homo sapiens
tgagctggatagacttgggat

SEQ ID NO: 2340684 - DNA, 18 bp, Homo sapiens
tgagctggcctctctagc

SEQ ID NO: 2340685 - DNA, 19 bp, Homo sapiens
tgagctgtaaaaatgttac

SEQ ID NO: 2340686 - DNA, 21 bp, Homo sapiens
tgaggaatttcacctgtaaac

SEQ ID NO: 2340687 - DNA, 22 bp, Homo sapiens
tgaggaatttcacctgtaaacc

SEQ ID NO: 2340688 - DNA, 20 bp, Homo sapiens
tgaggagaagggggtctctg

SEQ ID NO: 2340689 - DNA, 13 bp, Homo sapiens
tgaggaggggagg

SEQ ID NO: 2340690 - DNA, 20 bp, Homo sapiens
tgaggagggtgggggaggga

SEQ ID NO: 2340691 - DNA, 20 bp, Homo sapiens
tgaggatagtagttaaataa

SEQ ID NO: 2340692 - DNA, 17 bp, Homo sapiens
tgaggatgacagtgaca

SEQ ID NO: 2340693 - DNA, 22 bp, Homo sapiens
tgaggatgacagtgacacccag

SEQ ID NO: 2340694 - DNA, 14 bp, Homo sapiens
tgaggcaggagaat

SEQ ID NO: 2340695 - DNA, 20 bp, Homo sapiens
tgaggcaggagaattgcttg

SEQ ID NO: 2340696 - DNA, 21 bp, Homo sapiens
tgaggcatgactaatgctttt

SEQ ID NO: 2340697 - DNA, 17 bp, Homo sapiens
tgagggagaacaagacc

SEQ ID NO: 2340698 - DNA, 22 bp, Homo sapiens
tgagggccaaaatatttggaat

SEQ ID NO: 2340699 - DNA, 18 bp, Homo sapiens
tgagggcctgctggaggc

SEQ ID NO: 2340700 - DNA, 20 bp, Homo sapiens
tgagggtgccccgcctgagt

SEQ ID NO: 2340701 - DNA, 20 bp, Homo sapiens
tgaggtcaagtaagaagaca

SEQ ID NO: 2340702 - DNA, 16 bp, Homo sapiens
tgaggtgcactgggag

SEQ ID NO: 2340703 - DNA, 13 bp, Homo sapiens
tgaggtgggaggt

SEQ ID NO: 2340704 - DNA, 18 bp, Homo sapiens
tgaggtgggaggtggaag

SEQ ID NO: 2340705 - DNA, 16 bp, Homo sapiens
tgaggttcctctgcct

SEQ ID NO: 2340706 - DNA, 19 bp, Homo sapiens
tgaggttcctctgcctgcc

SEQ ID NO: 2340707 - DNA, 21 bp, Homo sapiens
tgagtaaaaactagaaggctt

SEQ ID NO: 2340708 - DNA, 20 bp, Homo sapiens
tgagtaatgtgactaaagga

SEQ ID NO: 2340709 - DNA, 19 bp, Homo sapiens
tgagtagatccatttccat

SEQ ID NO: 2340710 - DNA, 15 bp, Homo sapiens
tgagtagttactaaa

SEQ ID NO: 2340711 - DNA, 19 bp, Homo sapiens
tgagtagttactaaaattt

SEQ ID NO: 2340712 - DNA, 15 bp, Homo sapiens
tgagtattgtttaaa

SEQ ID NO: 2340713 - DNA, 21 bp, Homo sapiens
tgagtattgtttaaaatgtaa

SEQ ID NO: 2340714 - DNA, 16 bp, Homo sapiens
tgagtattttttataa

SEQ ID NO: 2340715 - DNA, 13 bp, Homo sapiens
tgagtcagtgctc

SEQ ID NO: 2340716 - DNA, 16 bp, Homo sapiens
tgagtcagtgctctca

SEQ ID NO: 2340717 - DNA, 20 bp, Homo sapiens
tgagtcatctgttagggcct

SEQ ID NO: 2340718 - DNA, 19 bp, Homo sapiens
tgagtccattctcccaggt

SEQ ID NO: 2340719 - DNA, 21 bp, Homo sapiens
tgagtctgtactaaacagtaa

SEQ ID NO: 2340720 - DNA, 14 bp, Homo sapiens
tgagtgtatgagta

SEQ ID NO: 2340721 - DNA, 12 bp, Homo sapiens
tgagttatcatg

SEQ ID NO: 2340722 - DNA, 20 bp, Homo sapiens
tgagttatcatgaattttaa

SEQ ID NO: 2340723 - DNA, 16 bp, Homo sapiens
tgagttctgggtttct

SEQ ID NO: 2340724 - DNA, 18 bp, Homo sapiens
tgagtttgagctgccttc

SEQ ID NO: 2340725 - DNA, 19 bp, Homo sapiens
tgagtttgtagaactttat

SEQ ID NO: 2340726 - DNA, 15 bp, Homo sapiens
tgagtttttcctccc

SEQ ID NO: 2340727 - DNA, 14 bp, Homo sapiens
tgataaaaactcag

SEQ ID NO: 2340728 - DNA, 16 bp, Homo sapiens
tgataaaataaataat

SEQ ID NO: 2340729 - DNA, 17 bp, Homo sapiens
tgataaaataaataatt

SEQ ID NO: 2340730 - DNA, 19 bp, Homo sapiens
tgataaaccaaaaacattt

SEQ ID NO: 2340731 - DNA, 13 bp, Homo sapiens
tgataaactcaga

SEQ ID NO: 2340732 - DNA, 14 bp, Homo sapiens
tgataatgttaaat

SEQ ID NO: 2340733 - DNA, 16 bp, Homo sapiens
tgataatgttaaattt

SEQ ID NO: 2340734 - DNA, 21 bp, Homo sapiens
tgatacgtccgtgtgtcccag

SEQ ID NO: 2340735 - DNA, 14 bp, Homo sapiens
tgatagaaaagtgt

SEQ ID NO: 2340736 - DNA, 15 bp, Homo sapiens
tgatagggaactggg

SEQ ID NO: 2340737 - DNA, 17 bp, Homo sapiens
tgatatggcagaagaca

SEQ ID NO: 2340738 - DNA, 19 bp, Homo sapiens
tgatattatttcttctctt

SEQ ID NO: 2340739 - DNA, 20 bp, Homo sapiens
tgatattatttcttctctta

SEQ ID NO: 2340740 - DNA, 23 bp, Homo sapiens
tgatcagaagactttaattatat

SEQ ID NO: 2340741 - DNA, 15 bp, Homo sapiens
tgccctatgctgtgc

SEQ ID NO: 2340742 - DNA, 16 bp, Homo sapiens
tgccctatgggcctgc

SEQ ID NO: 2340743 - DNA, 21 bp, Homo sapiens
tgccctcactccctctgcaga

SEQ ID NO: 2340744 - DNA, 22 bp, Homo sapiens
tgccctgcacgtcatgggaggg

SEQ ID NO: 2340745 - DNA, 18 bp, Homo sapiens
tgccctggctgctgcccc

SEQ ID NO: 2340746 - DNA, 15 bp, Homo sapiens
tgccctgtgtacttc

SEQ ID NO: 2340747 - DNA, 11 bp, Homo sapiens
tgcccttccct

SEQ ID NO: 2340748 - DNA, 14 bp, Homo sapiens
tgcccttccctctg

SEQ ID NO: 2340749 - DNA, 22 bp, Homo sapiens
tgccgagagaggcgcgtctgcc

SEQ ID NO: 2340750 - DNA, 23 bp, Homo sapiens
tgccggacccggaggccgaggcc

SEQ ID NO: 2340751 - DNA, 13 bp, Homo sapiens
tgcctacagccag

SEQ ID NO: 2340752 - DNA, 15 bp, Homo sapiens
tgcctacatcccggg

SEQ ID NO: 2340753 - DNA, 18 bp, Homo sapiens
tgcctacatcccgggcct

SEQ ID NO: 2340754 - DNA, 20 bp, Homo sapiens
tgcctacatcccgggcctca

SEQ ID NO: 2340755 - DNA, 17 bp, Homo sapiens
tgcctagattcagggaa

SEQ ID NO: 2340756 - DNA, 17 bp, Homo sapiens
tgcctatttgtgtggac

SEQ ID NO: 2340757 - DNA, 14 bp, Homo sapiens
tgcctcacctcgaa

SEQ ID NO: 2340758 - DNA, 23 bp, Homo sapiens
tgcctcaccttggggccttgatg

SEQ ID NO: 2340759 - DNA, 22 bp, Homo sapiens
tgcctcagacgttgcctgagaa

SEQ ID NO: 2340760 - DNA, 16 bp, Homo sapiens
tgcctcagttttcctt

SEQ ID NO: 2340761 - DNA, 18 bp, Homo sapiens
tgcctcatattgtcctct

SEQ ID NO: 2340762 - DNA, 14 bp, Homo sapiens
tgcctcccaggcaa

SEQ ID NO: 2340763 - DNA, 15 bp, Homo sapiens
tgcctcccaggcaag

SEQ ID NO: 2340764 - DNA, 17 bp, Homo sapiens
tgcctcccaggcaagca

SEQ ID NO: 2340765 - DNA, 21 bp, Homo sapiens
tgcctctcccaggctgtcccc

SEQ ID NO: 2340766 - DNA, 16 bp, Homo sapiens
tgcctcttccagtgaa

SEQ ID NO: 2340767 - DNA, 11 bp, Homo sapiens
tgcctctttcc

SEQ ID NO: 2340768 - DNA, 17 bp, Homo sapiens
tgcctctttccctagga

SEQ ID NO: 2340769 - DNA, 22 bp, Homo sapiens
tgcctgagaagaagtggctgcc

SEQ ID NO: 2340770 - DNA, 14 bp, Homo sapiens
tgcctgagaggcag

SEQ ID NO: 2340771 - DNA, 16 bp, Homo sapiens
tgcctgcgcctgctgc

SEQ ID NO: 2340772 - DNA, 20 bp, Homo sapiens
tgcctgcgcctgctgcctgc

SEQ ID NO: 2340773 - DNA, 14 bp, Homo sapiens
tgcctgctttgaat

SEQ ID NO: 2340774 - DNA, 21 bp, Homo sapiens
tgcctgctttttggaaagtca

SEQ ID NO: 2340775 - DNA, 23 bp, Homo sapiens
tgcctggagacaaggtgctaaca

SEQ ID NO: 2340776 - DNA, 20 bp, Homo sapiens
tgcctggccccagcctgggc

SEQ ID NO: 2340777 - DNA, 12 bp, Homo sapiens
tgcctggccccc

SEQ ID NO: 2340778 - DNA, 16 bp, Homo sapiens
tgcctgtctgccccag

SEQ ID NO: 2340779 - DNA, 23 bp, Homo sapiens
tgcctgtgcatgacctgatcatt

SEQ ID NO: 2340780 - DNA, 16 bp, Homo sapiens
tgccttaaaaccaaag

SEQ ID NO: 2340781 - DNA, 18 bp, Homo sapiens
tgccttaaaaccaaagag

SEQ ID NO: 2340782 - DNA, 18 bp, Homo sapiens
tgccttacatcttttcta

SEQ ID NO: 2340783 - DNA, 18 bp, Homo sapiens
tgccttactcttcttgaa

SEQ ID NO: 2340784 - DNA, 16 bp, Homo sapiens
tgccttgcctcctcag

SEQ ID NO: 2340785 - DNA, 13 bp, Homo sapiens
tgccttgctgttt

SEQ ID NO: 2340786 - DNA, 23 bp, Homo sapiens
tgccttgtttgagtttttcctcc

SEQ ID NO: 2340787 - DNA, 17 bp, Homo sapiens
tgcctttcgaggcctga

SEQ ID NO: 2340788 - DNA, 12 bp, Homo sapiens
tgcctttgagac

SEQ ID NO: 2340789 - DNA, 18 bp, Homo sapiens
tgcctttgagacagtttc

SEQ ID NO: 2340790 - DNA, 20 bp, Homo sapiens
tgcctttgagacagtttctt

SEQ ID NO: 2340791 - DNA, 20 bp, Homo sapiens
tgcgagtccaaggccagtcc

SEQ ID NO: 2340792 - DNA, 14 bp, Homo sapiens
tgcgcagtgccttg

SEQ ID NO: 2340793 - DNA, 15 bp, Homo sapiens
tgcgcctgcaggcag

SEQ ID NO: 2340794 - DNA, 17 bp, Homo sapiens
tgcgcctgcaggcagag

SEQ ID NO: 2340795 - DNA, 12 bp, Homo sapiens
tgcgcctgctgc

SEQ ID NO: 2340796 - DNA, 15 bp, Homo sapiens
tgcgcctgctgcctg

SEQ ID NO: 2340797 - DNA, 17 bp, Homo sapiens
tgcgcctgctgcctgct

SEQ ID NO: 2340798 - DNA, 14 bp, Homo sapiens
tgcgcttgcttttc

SEQ ID NO: 2340799 - DNA, 15 bp, Homo sapiens
tgcggatctcagctt

SEQ ID NO: 2340800 - DNA, 15 bp, Homo sapiens
tgcggcaaaaggaaa

SEQ ID NO: 2340801 - DNA, 16 bp, Homo sapiens
tgcgggccagggtcct

SEQ ID NO: 2340802 - DNA, 13 bp, Homo sapiens
tgcgtagaggcta

SEQ ID NO: 2340803 - DNA, 19 bp, Homo sapiens
tgcgtcagaccagtactgg

SEQ ID NO: 2340804 - DNA, 20 bp, Homo sapiens
tgcgtctccagtcatctgta

SEQ ID NO: 2340805 - DNA, 16 bp, Homo sapiens
tgcgtggactctgcac

SEQ ID NO: 2340806 - DNA, 21 bp, Homo sapiens
tgcgtgtgtagagttaagaag

SEQ ID NO: 2340807 - DNA, 16 bp, Homo sapiens
tgcgtgttcagcagaa

SEQ ID NO: 2340808 - DNA, 16 bp, Homo sapiens
tgcgttctgcaagcat

SEQ ID NO: 2340809 - DNA, 23 bp, Homo sapiens
tgctaagtgcttattacatttta

SEQ ID NO: 2340810 - DNA, 22 bp, Homo sapiens
tgctacacctattatcccagct

SEQ ID NO: 2340811 - DNA, 18 bp, Homo sapiens
tgctaccaggatgctaaa

SEQ ID NO: 2340812 - DNA, 19 bp, Homo sapiens
tgctactggggaaactggc

SEQ ID NO: 2340813 - DNA, 13 bp, Homo sapiens
tgctactgttgta

SEQ ID NO: 2340814 - DNA, 20 bp, Homo sapiens
tgctagggttaggaggtcct

SEQ ID NO: 2340815 - DNA, 19 bp, Homo sapiens
tgctagtatcttgggtgta

SEQ ID NO: 2340816 - DNA, 18 bp, Homo sapiens
tgctataatctgttttta

SEQ ID NO: 2340817 - DNA, 16 bp, Homo sapiens
tgctatatattaggca

SEQ ID NO: 2340818 - DNA, 17 bp, Homo sapiens
tgctatcgccctccttt

SEQ ID NO: 2340819 - DNA, 19 bp, Homo sapiens
tgctatcgccctcctttcc

SEQ ID NO: 2340820 - DNA, 23 bp, Homo sapiens
tgctatcgccctcctttccctta

SEQ ID NO: 2340821 - DNA, 15 bp, Homo sapiens
tgctatttgtgtaac

SEQ ID NO: 2340822 - DNA, 22 bp, Homo sapiens
tgctatttttgtaaagtttccg

SEQ ID NO: 2340823 - DNA, 15 bp, Homo sapiens
tgctcaaaaagaaat

SEQ ID NO: 2340824 - DNA, 14 bp, Homo sapiens
tgctcaccagccct

SEQ ID NO: 2340825 - DNA, 18 bp, Homo sapiens
tgctcaccagccctgcag

SEQ ID NO: 2340826 - DNA, 13 bp, Homo sapiens
tgctcagtgtcca

SEQ ID NO: 2340827 - DNA, 15 bp, Homo sapiens
tgctcagtgtccagc

SEQ ID NO: 2340828 - DNA, 17 bp, Homo sapiens
tgctcagtgtccagctt

SEQ ID NO: 2340829 - DNA, 21 bp, Homo sapiens
tgctcatattgtgattctgcc

SEQ ID NO: 2340830 - DNA, 22 bp, Homo sapiens
tgctcatattgtgattctgcct

SEQ ID NO: 2340831 - DNA, 23 bp, Homo sapiens
tgctcatattgtgattctgcctt

SEQ ID NO: 2340832 - DNA, 18 bp, Homo sapiens
tgctcattacagttcttt

SEQ ID NO: 2340833 - DNA, 15 bp, Homo sapiens
tgctccatatttgat

SEQ ID NO: 2340834 - DNA, 14 bp, Homo sapiens
tgctcccacctcct

SEQ ID NO: 2340835 - DNA, 15 bp, Homo sapiens
tgctcccacctcctg

SEQ ID NO: 2340836 - DNA, 18 bp, Homo sapiens
tgctcccacctcctgaca

SEQ ID NO: 2340837 - DNA, 23 bp, Homo sapiens
tgctcccacctcctgacaccctt

SEQ ID NO: 2340838 - DNA, 20 bp, Homo sapiens
tgctccccacagcgtccctg

SEQ ID NO: 2340839 - DNA, 23 bp, Homo sapiens
tgctccccacagcgtccctggcg

SEQ ID NO: 2340840 - DNA, 16 bp, Homo sapiens
tgctcccctgccacac

SEQ ID NO: 2340841 - DNA, 19 bp, Homo sapiens
tgctcccctgccacactga

SEQ ID NO: 2340842 - DNA, 15 bp, Homo sapiens
tgctccgccatggtg

SEQ ID NO: 2340843 - DNA, 20 bp, Homo sapiens
tgctcggagaagagcgcagt

SEQ ID NO: 2340844 - DNA, 20 bp, Homo sapiens
tgctctacaatgacacacaa

SEQ ID NO: 2340845 - DNA, 14 bp, Homo sapiens
tgctctcagctggc

SEQ ID NO: 2340846 - DNA, 16 bp, Homo sapiens
tgctctcagctggcag

SEQ ID NO: 2340847 - DNA, 18 bp, Homo sapiens
tgctctccattcttttaa

SEQ ID NO: 2340848 - DNA, 16 bp, Homo sapiens
tgctctgagccacagt

SEQ ID NO: 2340849 - DNA, 11 bp, Homo sapiens
tgctctgccat

SEQ ID NO: 2340850 - DNA, 18 bp, Homo sapiens
tgctctgccatcttcagg

SEQ ID NO: 2340851 - DNA, 12 bp, Homo sapiens
tgctctgtcccc

SEQ ID NO: 2340852 - DNA, 19 bp, Homo sapiens
tgctctgtcccccaggctg

SEQ ID NO: 2340853 - DNA, 17 bp, Homo sapiens
tgctgaaaaatatagcc

SEQ ID NO: 2340854 - DNA, 17 bp, Homo sapiens
tgctgaaattttatatg

SEQ ID NO: 2340855 - DNA, 15 bp, Homo sapiens
tgctgaacacagtgt

SEQ ID NO: 2340856 - DNA, 15 bp, Homo sapiens
tggcctggacagtat

SEQ ID NO: 2340857 - DNA, 12 bp, Homo sapiens
tggcctggcaca

SEQ ID NO: 2340858 - DNA, 18 bp, Homo sapiens
tggcctgtagtccatctc

SEQ ID NO: 2340859 - DNA, 17 bp, Homo sapiens
tggcctgtggctgtcgg

SEQ ID NO: 2340860 - DNA, 16 bp, Homo sapiens
tggccttaatttcctt

SEQ ID NO: 2340861 - DNA, 18 bp, Homo sapiens
tggccttgtaagaccctt

SEQ ID NO: 2340862 - DNA, 14 bp, Homo sapiens
tggcctttccttcc

SEQ ID NO: 2340863 - DNA, 17 bp, Homo sapiens
tggcctttccttccctc

SEQ ID NO: 2340864 - DNA, 18 bp, Homo sapiens
tggcctttccttccctct

SEQ ID NO: 2340865 - DNA, 22 bp, Homo sapiens
tggcctttccttccctctctga

SEQ ID NO: 2340866 - DNA, 19 bp, Homo sapiens
tggcctttgtaagtgcagg

SEQ ID NO: 2340867 - DNA, 18 bp, Homo sapiens
tggcgaatctcaaaatta

SEQ ID NO: 2340868 - DNA, 15 bp, Homo sapiens
tggcgccctgcctcc

SEQ ID NO: 2340869 - DNA, 13 bp, Homo sapiens
tggcgtctgctct

SEQ ID NO: 2340870 - DNA, 15 bp, Homo sapiens
tggcgtctgctctgg

SEQ ID NO: 2340871 - DNA, 20 bp, Homo sapiens
tggcgtctgctctggtggct

SEQ ID NO: 2340872 - DNA, 21 bp, Homo sapiens
tggcgtgacccgacctggccg

SEQ ID NO: 2340873 - DNA, 17 bp, Homo sapiens
tggcgtgggagccagcc

SEQ ID NO: 2340874 - DNA, 19 bp, Homo sapiens
tggctaacttttcattttt

SEQ ID NO: 2340875 - DNA, 17 bp, Homo sapiens
tggctcaagacaaggct

SEQ ID NO: 2340876 - DNA, 16 bp, Homo sapiens
tggctccccctcccca

SEQ ID NO: 2340877 - DNA, 20 bp, Homo sapiens
tggctccccctccccaggct

SEQ ID NO: 2340878 - DNA, 22 bp, Homo sapiens
tggctccccctccccaggctgg

SEQ ID NO: 2340879 - DNA, 21 bp, Homo sapiens
tggctcggggtaaaaagtggc

SEQ ID NO: 2340880 - DNA, 17 bp, Homo sapiens
tggctctaccctgtctg

SEQ ID NO: 2340881 - DNA, 23 bp, Homo sapiens
tggctctaccttcctgtccctga

SEQ ID NO: 2340882 - DNA, 15 bp, Homo sapiens
tggctctcacctcta

SEQ ID NO: 2340883 - DNA, 16 bp, Homo sapiens
tggctctccaccttgt

SEQ ID NO: 2340884 - DNA, 21 bp, Homo sapiens
tggctgaggttcctctgcctg

SEQ ID NO: 2340885 - DNA, 22 bp, Homo sapiens
tggctgaggttcctctgcctgc

SEQ ID NO: 2340886 - DNA, 22 bp, Homo sapiens
tggctgccacacccaggggaag

SEQ ID NO: 2340887 - DNA, 12 bp, Homo sapiens
tggctgctgccc

SEQ ID NO: 2340888 - DNA, 20 bp, Homo sapiens
tggctgctgcccccaccccg

SEQ ID NO: 2340889 - DNA, 10 bp, Homo sapiens
tggctgggca

SEQ ID NO: 2340890 - DNA, 17 bp, Homo sapiens
tggctggggaggaccag

SEQ ID NO: 2340891 - DNA, 21 bp, Homo sapiens
tggctgtggttcctaagcctg

SEQ ID NO: 2340892 - DNA, 16 bp, Homo sapiens
tggcttaagtgagcag

SEQ ID NO: 2340893 - DNA, 17 bp, Homo sapiens
tggcttaagtgagcaga

SEQ ID NO: 2340894 - DNA, 19 bp, Homo sapiens
tggcttaagtgagcagaac

SEQ ID NO: 2340895 - DNA, 19 bp, Homo sapiens
tggcttatttaatatgctt

SEQ ID NO: 2340896 - DNA, 13 bp, Homo sapiens
tggcttatttcta

SEQ ID NO: 2340897 - DNA, 13 bp, Homo sapiens
tggcttctgtgat

SEQ ID NO: 2340898 - DNA, 21 bp, Homo sapiens
tggcttctgtgatgagctgat

SEQ ID NO: 2340899 - DNA, 15 bp, Homo sapiens
tggcttgagctagag

SEQ ID NO: 2340900 - DNA, 14 bp, Homo sapiens
tggctttccaggca

SEQ ID NO: 2340901 - DNA, 21 bp, Homo sapiens
tggctttccaggcaccctcag

SEQ ID NO: 2340902 - DNA, 13 bp, Homo sapiens
tggctttcccagg

SEQ ID NO: 2340903 - DNA, 17 bp, Homo sapiens
tggctttgaaacctcag

SEQ ID NO: 2340904 - DNA, 20 bp, Homo sapiens
tgggaaaaatctaaaatgtg

SEQ ID NO: 2340905 - DNA, 21 bp, Homo sapiens
tgggaaaacatgttaatgaca

SEQ ID NO: 2340906 - DNA, 14 bp, Homo sapiens
tgggaaaacatttg

SEQ ID NO: 2340907 - DNA, 23 bp, Homo sapiens
tgggaaagcgcggacgtgctggg

SEQ ID NO: 2340908 - DNA, 18 bp, Homo sapiens
tgggaacccctttcccac

SEQ ID NO: 2340909 - DNA, 15 bp, Homo sapiens
tgggaagcagggaat

SEQ ID NO: 2340910 - DNA, 21 bp, Homo sapiens
tgggaagcagggaattcctgg

SEQ ID NO: 2340911 - DNA, 16 bp, Homo sapiens
tgggaatgaggaaaat

SEQ ID NO: 2340912 - DNA, 23 bp, Homo sapiens
tgggacctgccaggcaggggtgg

SEQ ID NO: 2340913 - DNA, 14 bp, Homo sapiens
tgggacctggcccc

SEQ ID NO: 2340914 - DNA, 14 bp, Homo sapiens
tgggagctgagcag

SEQ ID NO: 2340915 - DNA, 18 bp, Homo sapiens
tgggagctgagcagcctc

SEQ ID NO: 2340916 - DNA, 16 bp, Homo sapiens
tgggagctgccaagag

SEQ ID NO: 2340917 - DNA, 20 bp, Homo sapiens
tgggaggcagaggttgcagt

SEQ ID NO: 2340918 - DNA, 15 bp, Homo sapiens
tgggaggctgaggca

SEQ ID NO: 2340919 - DNA, 18 bp, Homo sapiens
tgggaggtggaagaaggg

SEQ ID NO: 2340920 - DNA, 17 bp, Homo sapiens
tgggagtcttaataaaa

SEQ ID NO: 2340921 - DNA, 14 bp, Homo sapiens
tgggagtgtgtctg

SEQ ID NO: 2340922 - DNA, 17 bp, Homo sapiens
tgggagtgtgtctgctg

SEQ ID NO: 2340923 - DNA, 18 bp, Homo sapiens
tgggagtgttgagcatct

SEQ ID NO: 2340924 - DNA, 18 bp, Homo sapiens
tgggatattgaatgttaa

SEQ ID NO: 2340925 - DNA, 14 bp, Homo sapiens
tgggatcagcctcc

SEQ ID NO: 2340926 - DNA, 20 bp, Homo sapiens
tgggatggtcggatctcaca

SEQ ID NO: 2340927 - DNA, 15 bp, Homo sapiens
tgggcaagtcactta

SEQ ID NO: 2340928 - DNA, 17 bp, Homo sapiens
tgggcacacacacccgc

SEQ ID NO: 2340929 - DNA, 15 bp, Homo sapiens
tgggcacagtccaga

SEQ ID NO: 2340930 - DNA, 19 bp, Homo sapiens
tgggcacagtccagaccca

SEQ ID NO: 2340931 - DNA, 22 bp, Homo sapiens
tgggcactccgcgccgatgcca

SEQ ID NO: 2340932 - DNA, 18 bp, Homo sapiens
tgggcagtgccccaggga

SEQ ID NO: 2340933 - DNA, 24 bp, Homo sapiens
tgggcagtgccccagggagtccag

SEQ ID NO: 2340934 - DNA, 20 bp, Homo sapiens
tgggcatgacatcctttctt

SEQ ID NO: 2340935 - DNA, 17 bp, Homo sapiens
tgggccagcggggctgc

SEQ ID NO: 2340936 - DNA, 20 bp, Homo sapiens
tgggccagcggggctgctca

SEQ ID NO: 2340937 - DNA, 24 bp, Homo sapiens
tgggccatgtccaaagaggctgcc

SEQ ID NO: 2340938 - DNA, 21 bp, Homo sapiens
tgggcccagaccactgtctcc

SEQ ID NO: 2340939 - DNA, 22 bp, Homo sapiens
tgggcccagaccactgtctcca

SEQ ID NO: 2340940 - DNA, 15 bp, Homo sapiens
tgggcccaggcctca

SEQ ID NO: 2340941 - DNA, 15 bp, Homo sapiens
tgggccccttccaaa

SEQ ID NO: 2340942 - DNA, 12 bp, Homo sapiens
tgggcctgctgc

SEQ ID NO: 2340943 - DNA, 14 bp, Homo sapiens
tgggcggctgtgct

SEQ ID NO: 2340944 - DNA, 18 bp, Homo sapiens
tgggctcgcactgcccac

SEQ ID NO: 2340945 - DNA, 13 bp, Homo sapiens
tgggctctgatga

SEQ ID NO: 2340946 - DNA, 18 bp, Homo sapiens
tgggctgccaccagcccc

SEQ ID NO: 2340947 - DNA, 15 bp, Homo sapiens
tgggctgctggccat

SEQ ID NO: 2340948 - DNA, 12 bp, Homo sapiens
tgggctggactt

SEQ ID NO: 2340949 - DNA, 23 bp, Homo sapiens
tgggctggacttctacctgccct

SEQ ID NO: 2340950 - DNA, 19 bp, Homo sapiens
tgggctggcagtcctggaa

SEQ ID NO: 2340951 - DNA, 16 bp, Homo sapiens
tgggctgggtgctggg

SEQ ID NO: 2340952 - DNA, 17 bp, Homo sapiens
tgggctgggtgctggga

SEQ ID NO: 2340953 - DNA, 17 bp, Homo sapiens
tgggcttcactgtataa

SEQ ID NO: 2340954 - DNA, 23 bp, Homo sapiens
tgggcttcactgtataaatagga

SEQ ID NO: 2340955 - DNA, 13 bp, Homo sapiens
tgggcttcattct

SEQ ID NO: 2340956 - DNA, 17 bp, Homo sapiens
tgggcttcattctggaa

SEQ ID NO: 2340957 - DNA, 19 bp, Homo sapiens
tgggcttcctgcccttccc

SEQ ID NO: 2340958 - DNA, 14 bp, Homo sapiens
tgggcttggcctgc

SEQ ID NO: 2340959 - DNA, 22 bp, Homo sapiens
tgggcttttggggagccagaag

SEQ ID NO: 2340960 - DNA, 14 bp, Homo sapiens
tggggaaaatggcc

SEQ ID NO: 2340961 - DNA, 17 bp, Homo sapiens
tggggaaaggaggtggg

SEQ ID NO: 2340962 - DNA, 19 bp, Homo sapiens
tggggaaaggaggtggggg

SEQ ID NO: 2340963 - DNA, 20 bp, Homo sapiens
tggggagagggatttccctg

SEQ ID NO: 2340964 - DNA, 21 bp, Homo sapiens
tggggagagggatttccctgc

SEQ ID NO: 2340965 - DNA, 15 bp, Homo sapiens
tggggaggaccaggg

SEQ ID NO: 2340966 - DNA, 21 bp, Homo sapiens
tggggatccccgcctggccag

SEQ ID NO: 2340967 - DNA, 23 bp, Homo sapiens
tggggatccccgcctggccagga

SEQ ID NO: 2340968 - DNA, 18 bp, Homo sapiens
tggggcacagatgcctgg

SEQ ID NO: 2340969 - DNA, 21 bp, Homo sapiens
tggggcaggccacctggctct

SEQ ID NO: 2340970 - DNA, 12 bp, Homo sapiens
aaaaaaaagaag

SEQ ID NO: 2340971 - DNA, 13 bp, Homo sapiens
aaaaaaaattgta

SEQ ID NO: 2340972 - DNA, 13 bp, Homo sapiens
aaaaaagaaaaat

SEQ ID NO: 2340973 - DNA, 12 bp, Homo sapiens
aaaaaatttaag

SEQ ID NO: 2340974 - DNA, 14 bp, Homo sapiens
aaaaaatttaagtg

SEQ ID NO: 2340975 - DNA, 16 bp, Homo sapiens
aaaaacacggcagctg

SEQ ID NO: 2340976 - DNA, 17 bp, Homo sapiens
aaaaacagcagctcata

SEQ ID NO: 2340977 - DNA, 23 bp, Homo sapiens
aaaaacattttttatacatttgg

SEQ ID NO: 2340978 - DNA, 19 bp, Homo sapiens
aaaaaccaccaaaaacaaa

SEQ ID NO: 2340979 - DNA, 22 bp, Homo sapiens
aaaaactagaaggcttctctcc

SEQ ID NO: 2340980 - DNA, 22 bp, Homo sapiens
aaaaacttcatgtaattttatt

SEQ ID NO: 2340981 - DNA, 23 bp, Homo sapiens
aaaaacttcatgtaattttattt

SEQ ID NO: 2340982 - DNA, 13 bp, Homo sapiens
aaaaataaaatgt

SEQ ID NO: 2340983 - DNA, 12 bp, Homo sapiens
aaaaatataatg

SEQ ID NO: 2340984 - DNA, 11 bp, Homo sapiens
aaaaatattgt

SEQ ID NO: 2340985 - DNA, 12 bp, Homo sapiens
aaaaatattgtt

SEQ ID NO: 2340986 - DNA, 23 bp, Homo sapiens
aaaaatcgatgagcgccacctct

SEQ ID NO: 2340987 - DNA, 12 bp, Homo sapiens
aaaaatctaaaa

SEQ ID NO: 2340988 - DNA, 20 bp, Homo sapiens
aaaaatctagcacactcttc

SEQ ID NO: 2340989 - DNA, 10 bp, Homo sapiens
aaaaatctca

SEQ ID NO: 2340990 - DNA, 11 bp, Homo sapiens
aaaaatctcat

SEQ ID NO: 2340991 - DNA, 19 bp, Homo sapiens
aaaaatctcattatttcaa

SEQ ID NO: 2340992 - DNA, 20 bp, Homo sapiens
aaaaatctcattatttcaaa

SEQ ID NO: 2340993 - DNA, 14 bp, Homo sapiens
aaaaatgcctttga

SEQ ID NO: 2340994 - DNA, 22 bp, Homo sapiens
aaaaatgtttttagaacatgta

SEQ ID NO: 2340995 - DNA, 21 bp, Homo sapiens
aaaaattgctgactgtagctt

SEQ ID NO: 2340996 - DNA, 23 bp, Homo sapiens
aaaaattgctgactgtagctttg

SEQ ID NO: 2340997 - DNA, 13 bp, Homo sapiens
aaaaatttaagtg

SEQ ID NO: 2340998 - DNA, 17 bp, Homo sapiens
aaaacaactttcacttc

SEQ ID NO: 2340999 - DNA, 18 bp, Homo sapiens
aaaacaatggagtattct

SEQ ID NO: 2341000 - DNA, 15 bp, Homo sapiens
aaaacagaatcttct

SEQ ID NO: 2341001 - DNA, 17 bp, Homo sapiens
aaaacagaatcttctgg

SEQ ID NO: 2341002 - DNA, 16 bp, Homo sapiens
aaaacagcttcctgtt

SEQ ID NO: 2341003 - DNA, 18 bp, Homo sapiens
aaaacagggccacataga

SEQ ID NO: 2341004 - DNA, 23 bp, Homo sapiens
aaaacagggccacatagatgctg

SEQ ID NO: 2341005 - DNA, 11 bp, Homo sapiens
aaaacagtggt

SEQ ID NO: 2341006 - DNA, 20 bp, Homo sapiens
aaaacataatcttctgcctt

SEQ ID NO: 2341007 - DNA, 20 bp, Homo sapiens
aaaacattttttatacattt

SEQ ID NO: 2341008 - DNA, 18 bp, Homo sapiens
aaaaccaaatgtttattt

SEQ ID NO: 2341009 - DNA, 14 bp, Homo sapiens
aaaactcactgtga

SEQ ID NO: 2341010 - DNA, 11 bp, Homo sapiens
aaaactgctcc

SEQ ID NO: 2341011 - DNA, 17 bp, Homo sapiens
aaaactgtgttgccaca

SEQ ID NO: 2341012 - DNA, 20 bp, Homo sapiens
aaaactgtttgacttctcaa

SEQ ID NO: 2341013 - DNA, 19 bp, Homo sapiens
aaaacttggttttatggtt

SEQ ID NO: 2341014 - DNA, 13 bp, Homo sapiens
aaaagaaatgcaa

SEQ ID NO: 2341015 - DNA, 16 bp, Homo sapiens
aaaagaaatggtatgt

SEQ ID NO: 2341016 - DNA, 15 bp, Homo sapiens
aaaagagtcttccaa

SEQ ID NO: 2341017 - DNA, 19 bp, Homo sapiens
aaaagatggttgtagcatt

SEQ ID NO: 2341018 - DNA, 21 bp, Homo sapiens
aaaagattgaagtattttgct

SEQ ID NO: 2341019 - DNA, 16 bp, Homo sapiens
aaaagattgctgaaat

SEQ ID NO: 2341020 - DNA, 20 bp, Homo sapiens
aaaagcaagtgttcactgct

SEQ ID NO: 2341021 - DNA, 14 bp, Homo sapiens
aaaagcagacattt

SEQ ID NO: 2341022 - DNA, 14 bp, Homo sapiens
aaaagcagctacca

SEQ ID NO: 2341023 - DNA, 10 bp, Homo sapiens
aaaagcattt

SEQ ID NO: 2341024 - DNA, 15 bp, Homo sapiens
aaaagcatttttatt

SEQ ID NO: 2341025 - DNA, 20 bp, Homo sapiens
aaaagcatttttattatatt

SEQ ID NO: 2341026 - DNA, 17 bp, Homo sapiens
aaaagcatttttcaata

SEQ ID NO: 2341027 - DNA, 22 bp, Homo sapiens
aaaagccagccaagctttaaat

SEQ ID NO: 2341028 - DNA, 15 bp, Homo sapiens
aaaagcccatgctta

SEQ ID NO: 2341029 - DNA, 13 bp, Homo sapiens
aaaagctctttta

SEQ ID NO: 2341030 - DNA, 14 bp, Homo sapiens
aaaagctcttttaa

SEQ ID NO: 2341031 - DNA, 15 bp, Homo sapiens
aaaaggaagactaga

SEQ ID NO: 2341032 - DNA, 22 bp, Homo sapiens
aaaaggcctcttgtaaagactg

SEQ ID NO: 2341033 - DNA, 15 bp, Homo sapiens
aaaaggtctttaaaa

SEQ ID NO: 2341034 - DNA, 21 bp, Homo sapiens
aaaagtaatgacttagaaact

SEQ ID NO: 2341035 - DNA, 22 bp, Homo sapiens
aaaagtatattaaacaaagttt

SEQ ID NO: 2341036 - DNA, 23 bp, Homo sapiens
aaaagtcaccaaatagtgtgaaa

SEQ ID NO: 2341037 - DNA, 23 bp, Homo sapiens
aaaagtgaagtgaatctgattgc

SEQ ID NO: 2341038 - DNA, 15 bp, Homo sapiens
aaaagtggtctctgc

SEQ ID NO: 2341039 - DNA, 15 bp, Homo sapiens
aaaagtgtctcaaag

SEQ ID NO: 2341040 - DNA, 17 bp, Homo sapiens
aaaagtgtctcaaagga

SEQ ID NO: 2341041 - DNA, 21 bp, Homo sapiens
aaaagttggaaggatctgctg

SEQ ID NO: 2341042 - DNA, 13 bp, Homo sapiens
aaaataaaatgaa

SEQ ID NO: 2341043 - DNA, 21 bp, Homo sapiens
aaaataaaatgaaaattgtat

SEQ ID NO: 2341044 - DNA, 12 bp, Homo sapiens
aaaataaaatgt

SEQ ID NO: 2341045 - DNA, 14 bp, Homo sapiens
aaaataaaatgttt

SEQ ID NO: 2341046 - DNA, 15 bp, Homo sapiens
aaaataaataatttt

SEQ ID NO: 2341047 - DNA, 15 bp, Homo sapiens
aaaataactgaattt

SEQ ID NO: 2341048 - DNA, 14 bp, Homo sapiens
aaaataattctaaa

SEQ ID NO: 2341049 - DNA, 17 bp, Homo sapiens
aaaatagaaattttgta

SEQ ID NO: 2341050 - DNA, 16 bp, Homo sapiens
aaaatagaataattct

SEQ ID NO: 2341051 - DNA, 11 bp, Homo sapiens
aaaatatatac

SEQ ID NO: 2341052 - DNA, 12 bp, Homo sapiens
aaaatatatctt

SEQ ID NO: 2341053 - DNA, 15 bp, Homo sapiens
aaaatatgtaatttc

SEQ ID NO: 2341054 - DNA, 23 bp, Homo sapiens
aaaatattgtttctgcattcatt

SEQ ID NO: 2341055 - DNA, 21 bp, Homo sapiens
aaaatatttgactattctgta

SEQ ID NO: 2341056 - DNA, 17 bp, Homo sapiens
aaaatcactttcataat

SEQ ID NO: 2341057 - DNA, 17 bp, Homo sapiens
aaaatcatgccagtatt

SEQ ID NO: 2341058 - DNA, 17 bp, Homo sapiens
aaaatcccccagcactt

SEQ ID NO: 2341059 - DNA, 13 bp, Homo sapiens
aaaatctaaaatg

SEQ ID NO: 2341060 - DNA, 16 bp, Homo sapiens
aaaatctaaaatgtgt

SEQ ID NO: 2341061 - DNA, 13 bp, Homo sapiens
aaaatctcattat

SEQ ID NO: 2341062 - DNA, 19 bp, Homo sapiens
aaaatctcattatttcaaa

SEQ ID NO: 2341063 - DNA, 11 bp, Homo sapiens
aaaatgccttt

SEQ ID NO: 2341064 - DNA, 14 bp, Homo sapiens
aaaatgcctttgag

SEQ ID NO: 2341065 - DNA, 15 bp, Homo sapiens
aaaatgcttgaccct

SEQ ID NO: 2341066 - DNA, 11 bp, Homo sapiens
aaaatggaaaa

SEQ ID NO: 2341067 - DNA, 13 bp, Homo sapiens
aaaatggaaattt

SEQ ID NO: 2341068 - DNA, 14 bp, Homo sapiens
aaaatggaataaaa

SEQ ID NO: 2341069 - DNA, 12 bp, Homo sapiens
aaaatggcattt

SEQ ID NO: 2341070 - DNA, 14 bp, Homo sapiens
aaaatgtattcctt

SEQ ID NO: 2341071 - DNA, 15 bp, Homo sapiens
aaaatgtattccttt

SEQ ID NO: 2341072 - DNA, 17 bp, Homo sapiens
aaaatgtctgtaataat

SEQ ID NO: 2341073 - DNA, 18 bp, Homo sapiens
aaaatgtctgtaataata

SEQ ID NO: 2341074 - DNA, 13 bp, Homo sapiens
aaaatgtgaccct

SEQ ID NO: 2341075 - DNA, 13 bp, Homo sapiens
aaaatgtttttag

SEQ ID NO: 2341076 - DNA, 12 bp, Homo sapiens
aaaattaacttt

SEQ ID NO: 2341077 - DNA, 16 bp, Homo sapiens
aaaattaattgaaata

SEQ ID NO: 2341078 - DNA, 22 bp, Homo sapiens
aaaattcaaagcatggacattt

SEQ ID NO: 2341079 - DNA, 20 bp, Homo sapiens
aaaattgagttgcacttatt

SEQ ID NO: 2341080 - DNA, 14 bp, Homo sapiens
aaaatttatacacc

SEQ ID NO: 2341081 - DNA, 12 bp, Homo sapiens
aaaatttgaata

SEQ ID NO: 2341082 - DNA, 17 bp, Homo sapiens
aaaatttgtcttaaaaa

SEQ ID NO: 2341083 - DNA, 21 bp, Homo sapiens
aaaattttgtatgttaaagag

SEQ ID NO: 2341084 - DNA, 18 bp, Homo sapiens
aaaatttttatgtaatta

SEQ ID NO: 2341085 - DNA, 21 bp, Homo sapiens
aaacaaaacccctaagagact

SEQ ID NO: 2341086 - DNA, 17 bp, Homo sapiens
aaacaaagggttttctt

SEQ ID NO: 2341087 - DNA, 19 bp, Homo sapiens
aaacaacgcattgccacgg

SEQ ID NO: 2341088 - DNA, 16 bp, Homo sapiens
aaacaactttcacttc

SEQ ID NO: 2341089 - DNA, 16 bp, Homo sapiens
aaacacccctctgtct

SEQ ID NO: 2341090 - DNA, 20 bp, Homo sapiens
aaacacccgacgtcatgtat

SEQ ID NO: 2341091 - DNA, 15 bp, Homo sapiens
aaacagaatcttctg

SEQ ID NO: 2341092 - DNA, 17 bp, Homo sapiens
aaacagggccacataga

SEQ ID NO: 2341093 - DNA, 22 bp, Homo sapiens
aaacagggctgccttctggcct

SEQ ID NO: 2341094 - DNA, 23 bp, Homo sapiens
aaacagttgctgtgaactttcat

SEQ ID NO: 2341095 - DNA, 14 bp, Homo sapiens
aaacagtttaacag

SEQ ID NO: 2341096 - DNA, 20 bp, Homo sapiens
aaacataatcttctgccttc

SEQ ID NO: 2341097 - DNA, 12 bp, Homo sapiens
aaacatacagag

SEQ ID NO: 2341098 - DNA, 20 bp, Homo sapiens
aaacatacagaggatgcctt

SEQ ID NO: 2341099 - DNA, 19 bp, Homo sapiens
aaacatgaatcaagcaatc

SEQ ID NO: 2341100 - DNA, 16 bp, Homo sapiens
aaacatgttaatgaca

SEQ ID NO: 2341101 - DNA, 21 bp, Homo sapiens
aaacatttgattaataaaata

SEQ ID NO: 2341102 - DNA, 12 bp, Homo sapiens
aaacatttgctg

SEQ ID NO: 2341103 - DNA, 16 bp, Homo sapiens
aaacattttatcatta

SEQ ID NO: 2341104 - DNA, 22 bp, Homo sapiens
aaacattttatcattaaaaatt

SEQ ID NO: 2341105 - DNA, 23 bp, Homo sapiens
aaacattttatcattaaaaatta

SEQ ID NO: 2341106 - DNA, 20 bp, Homo sapiens
aaacattttttatacatttg

SEQ ID NO: 2341107 - DNA, 21 bp, Homo sapiens
aaacattttttatacatttgg

SEQ ID NO: 2341108 - DNA, 20 bp, Homo sapiens
aaaccaaagagggcttcctc

SEQ ID NO: 2341109 - DNA, 16 bp, Homo sapiens
aaaccacacttcttga

SEQ ID NO: 2341110 - DNA, 19 bp, Homo sapiens
aaaccaccgtgaaccagag

SEQ ID NO: 2341111 - DNA, 16 bp, Homo sapiens
aaaccagaacccagtg

SEQ ID NO: 2341112 - DNA, 18 bp, Homo sapiens
aaaccctcattgtgtttc

SEQ ID NO: 2341113 - DNA, 20 bp, Homo sapiens
aaaccctcccagaaacatct

SEQ ID NO: 2341114 - DNA, 15 bp, Homo sapiens
aaacctcagggctgt

SEQ ID NO: 2341115 - DNA, 14 bp, Homo sapiens
aaacctcctgctgt

SEQ ID NO: 2341116 - DNA, 17 bp, Homo sapiens
aaacctcctgctgtgcc

SEQ ID NO: 2341117 - DNA, 12 bp, Homo sapiens
aaacctttcccc

SEQ ID NO: 2341118 - DNA, 16 bp, Homo sapiens
aaaccttttttaagat

SEQ ID NO: 2341119 - DNA, 21 bp, Homo sapiens
aaaccttttttaagatttttc

SEQ ID NO: 2341120 - DNA, 23 bp, Homo sapiens
aaaccttttttaagatttttctc

SEQ ID NO: 2341121 - DNA, 14 bp, Homo sapiens
aaacgtcctcttta

SEQ ID NO: 2341122 - DNA, 23 bp, Homo sapiens
aaacgtcctctttagtttttggt

SEQ ID NO: 2341123 - DNA, 14 bp, Homo sapiens
aaactaagccaggc

SEQ ID NO: 2341124 - DNA, 11 bp, Homo sapiens
aaactaatcca

SEQ ID NO: 2341125 - DNA, 16 bp, Homo sapiens
aaactactgaatgaag

SEQ ID NO: 2341126 - DNA, 20 bp, Homo sapiens
aaactactgaatgaagcagt

SEQ ID NO: 2341127 - DNA, 19 bp, Homo sapiens
aaactagaaggcttctctc

SEQ ID NO: 2341128 - DNA, 22 bp, Homo sapiens
aaactagttactaaacatgtat

SEQ ID NO: 2341129 - DNA, 15 bp, Homo sapiens
aaactatgttcctaa

SEQ ID NO: 2341130 - DNA, 17 bp, Homo sapiens
aaactatgttcctaaca

SEQ ID NO: 2341131 - DNA, 18 bp, Homo sapiens
aaactattagagtatttc

SEQ ID NO: 2341132 - DNA, 23 bp, Homo sapiens
aaactattagagtatttcccttc

SEQ ID NO: 2341133 - DNA, 17 bp, Homo sapiens
aaactcaggcaaagaaa

SEQ ID NO: 2341134 - DNA, 14 bp, Homo sapiens
aaactcatttatct

SEQ ID NO: 2341135 - DNA, 16 bp, Homo sapiens
aaactccacatctgcc

SEQ ID NO: 2341136 - DNA, 19 bp, Homo sapiens
aaactccacatctgcctta

SEQ ID NO: 2341137 - DNA, 14 bp, Homo sapiens
aaactccttcctgg

SEQ ID NO: 2341138 - DNA, 19 bp, Homo sapiens
aaactgaggaatttcacct

SEQ ID NO: 2341139 - DNA, 10 bp, Homo sapiens
aaactgtgta

SEQ ID NO: 2341140 - DNA, 16 bp, Homo sapiens
aaactgtgtattccaa

SEQ ID NO: 2341141 - DNA, 14 bp, Homo sapiens
aaactgtgttgcca

SEQ ID NO: 2341142 - DNA, 17 bp, Homo sapiens
aaactgtgttgccacag

SEQ ID NO: 2341143 - DNA, 20 bp, Homo sapiens
aaacttaaagctactgtaga

SEQ ID NO: 2341144 - DNA, 16 bp, Homo sapiens
aaacttcatgtaattt

SEQ ID NO: 2341145 - DNA, 20 bp, Homo sapiens
aaacttcatgtaattttatt

SEQ ID NO: 2341146 - DNA, 20 bp, Homo sapiens
aaacttcattggtaagattg

SEQ ID NO: 2341147 - DNA, 20 bp, Homo sapiens
aaacttgtttgctgtgaaca

SEQ ID NO: 2341148 - DNA, 19 bp, Homo sapiens
aaacttttaagatttctct

SEQ ID NO: 2341149 - DNA, 21 bp, Homo sapiens
aaagaaaaaaaaaaaagccag

SEQ ID NO: 2341150 - DNA, 23 bp, Homo sapiens
aaagaaaaatctcattatttcaa

SEQ ID NO: 2341151 - DNA, 13 bp, Homo sapiens
aaagaaaattaca

SEQ ID NO: 2341152 - DNA, 12 bp, Homo sapiens
aaagaaaattga

SEQ ID NO: 2341153 - DNA, 13 bp, Homo sapiens
aaagaaagcagaa

SEQ ID NO: 2341154 - DNA, 12 bp, Homo sapiens
aaagaaaggaaa

SEQ ID NO: 2341155 - DNA, 13 bp, Homo sapiens
aaagaaataaacc

SEQ ID NO: 2341156 - DNA, 18 bp, Homo sapiens
aaagaaatatattttttg

SEQ ID NO: 2341157 - DNA, 23 bp, Homo sapiens
aaagaaccaacaacctcaactgc

SEQ ID NO: 2341158 - DNA, 18 bp, Homo sapiens
aaagacaaaagtctgtct

SEQ ID NO: 2341159 - DNA, 16 bp, Homo sapiens
aaagacttgagacaat

SEQ ID NO: 2341160 - DNA, 14 bp, Homo sapiens
aaagagacatttca

SEQ ID NO: 2341161 - DNA, 15 bp, Homo sapiens
aaagagcccttgcct

SEQ ID NO: 2341162 - DNA, 21 bp, Homo sapiens
aataatcacgctttcctgaat

SEQ ID NO: 2341163 - DNA, 14 bp, Homo sapiens
aataatcttgtttc

SEQ ID NO: 2341164 - DNA, 15 bp, Homo sapiens
aataatcttgtttct

SEQ ID NO: 2341165 - DNA, 13 bp, Homo sapiens
aataatgaaaata

SEQ ID NO: 2341166 - DNA, 19 bp, Homo sapiens
aataatgctacaattttaa

SEQ ID NO: 2341167 - DNA, 12 bp, Homo sapiens
aataattcatat

SEQ ID NO: 2341168 - DNA, 16 bp, Homo sapiens
aataattcttttctga

SEQ ID NO: 2341169 - DNA, 17 bp, Homo sapiens
aataattcttttctgag

SEQ ID NO: 2341170 - DNA, 20 bp, Homo sapiens
aataatttgaatgtatttga

SEQ ID NO: 2341171 - DNA, 22 bp, Homo sapiens
aataatttgaatgtatttgatt

SEQ ID NO: 2341172 - DNA, 23 bp, Homo sapiens
aataattttaatattcttttgtt

SEQ ID NO: 2341173 - DNA, 17 bp, Homo sapiens
aataattttggaataat

SEQ ID NO: 2341174 - DNA, 19 bp, Homo sapiens
aatacaagtaatattatta

SEQ ID NO: 2341175 - DNA, 14 bp, Homo sapiens
aatacacatttgct

SEQ ID NO: 2341176 - DNA, 17 bp, Homo sapiens
aatacactagttgtttc

SEQ ID NO: 2341177 - DNA, 15 bp, Homo sapiens
aatacatgcatataa

SEQ ID NO: 2341178 - DNA, 17 bp, Homo sapiens
aatacatttgtaagtgt

SEQ ID NO: 2341179 - DNA, 19 bp, Homo sapiens
aataccacatcaaataaga

SEQ ID NO: 2341180 - DNA, 21 bp, Homo sapiens
aataccacatcaaataagaaa

SEQ ID NO: 2341181 - DNA, 18 bp, Homo sapiens
aatactacaatagtttta

SEQ ID NO: 2341182 - DNA, 14 bp, Homo sapiens
aatacttccagaag

SEQ ID NO: 2341183 - DNA, 19 bp, Homo sapiens
aatacttctttgttattat

SEQ ID NO: 2341184 - DNA, 17 bp, Homo sapiens
aatactttttaaattac

SEQ ID NO: 2341185 - DNA, 15 bp, Homo sapiens
aatagaaattttgta

SEQ ID NO: 2341186 - DNA, 17 bp, Homo sapiens
aatagaataattctttt

SEQ ID NO: 2341187 - DNA, 18 bp, Homo sapiens
aatagacaaaaagtatat

SEQ ID NO: 2341188 - DNA, 20 bp, Homo sapiens
aatagccaaagatttcatat

SEQ ID NO: 2341189 - DNA, 13 bp, Homo sapiens
aatagcctggcca

SEQ ID NO: 2341190 - DNA, 20 bp, Homo sapiens
aataggaatcattcagaaat

SEQ ID NO: 2341191 - DNA, 22 bp, Homo sapiens
aataggaatcattcagaaatgt

SEQ ID NO: 2341192 - DNA, 20 bp, Homo sapiens
aataggagaggatgagagcc

SEQ ID NO: 2341193 - DNA, 20 bp, Homo sapiens
aataggctattaaaaaagtc

SEQ ID NO: 2341194 - DNA, 15 bp, Homo sapiens
aatagtatacatttt

SEQ ID NO: 2341195 - DNA, 22 bp, Homo sapiens
aatagtatacattttataatga

SEQ ID NO: 2341196 - DNA, 20 bp, Homo sapiens
aatagtgcttaaaaatcatt

SEQ ID NO: 2341197 - DNA, 18 bp, Homo sapiens
aatagtgtcatataaact

SEQ ID NO: 2341198 - DNA, 20 bp, Homo sapiens
aatagtgtcatataaactca

SEQ ID NO: 2341199 - DNA, 17 bp, Homo sapiens
aatagtgtgaaatatat

SEQ ID NO: 2341200 - DNA, 16 bp, Homo sapiens
aatataaaaaatcatg

SEQ ID NO: 2341201 - DNA, 12 bp, Homo sapiens
aatataaatgtt

SEQ ID NO: 2341202 - DNA, 14 bp, Homo sapiens
aatataacacattt

SEQ ID NO: 2341203 - DNA, 12 bp, Homo sapiens
aatataatgttg

SEQ ID NO: 2341204 - DNA, 18 bp, Homo sapiens
aatatacattttctaaat

SEQ ID NO: 2341205 - DNA, 20 bp, Homo sapiens
aatatacattttctaaataa

SEQ ID NO: 2341206 - DNA, 15 bp, Homo sapiens
aatatactccttaaa

SEQ ID NO: 2341207 - DNA, 19 bp, Homo sapiens
aatatactccttaaaaatg

SEQ ID NO: 2341208 - DNA, 19 bp, Homo sapiens
aatatagacattctcacat

SEQ ID NO: 2341209 - DNA, 20 bp, Homo sapiens
aatatagacattctcacata

SEQ ID NO: 2341210 - DNA, 15 bp, Homo sapiens
aatatagcctttaaa

SEQ ID NO: 2341211 - DNA, 20 bp, Homo sapiens
aatatagctttcataacatc

SEQ ID NO: 2341212 - DNA, 21 bp, Homo sapiens
aatatatacacatagttctgt

SEQ ID NO: 2341213 - DNA, 16 bp, Homo sapiens
aatatatattaagtgt

SEQ ID NO: 2341214 - DNA, 17 bp, Homo sapiens
aatatatgtgtgcctat

SEQ ID NO: 2341215 - DNA, 14 bp, Homo sapiens
aatatcaaagtcat

SEQ ID NO: 2341216 - DNA, 20 bp, Homo sapiens
aatatcaaagtcattaaaga

SEQ ID NO: 2341217 - DNA, 12 bp, Homo sapiens
aatatcaaataa

SEQ ID NO: 2341218 - DNA, 15 bp, Homo sapiens
aatatcaaataaaat

SEQ ID NO: 2341219 - DNA, 16 bp, Homo sapiens
aatatcaaataaaata

SEQ ID NO: 2341220 - DNA, 17 bp, Homo sapiens
aatatcaaataaaatat

SEQ ID NO: 2341221 - DNA, 15 bp, Homo sapiens
aatatcaactctgaa

SEQ ID NO: 2341222 - DNA, 22 bp, Homo sapiens
aatatcagttacagtggcagta

SEQ ID NO: 2341223 - DNA, 15 bp, Homo sapiens
aatatcataaagcat

SEQ ID NO: 2341224 - DNA, 16 bp, Homo sapiens
aatatcataaagcatt

SEQ ID NO: 2341225 - DNA, 14 bp, Homo sapiens
aatatctatttgaa

SEQ ID NO: 2341226 - DNA, 23 bp, Homo sapiens
aatatctatttgaataaattatg

SEQ ID NO: 2341227 - DNA, 15 bp, Homo sapiens
aatatggtggaaaat

SEQ ID NO: 2341228 - DNA, 16 bp, Homo sapiens
aatatgtagtatctat

SEQ ID NO: 2341229 - DNA, 20 bp, Homo sapiens
aatatgtttaaaataaaatg

SEQ ID NO: 2341230 - DNA, 22 bp, Homo sapiens
aatattaacctaatcaccatgt

SEQ ID NO: 2341231 - DNA, 17 bp, Homo sapiens
aatattattactttatg

SEQ ID NO: 2341232 - DNA, 20 bp, Homo sapiens
aatattcagggtaaatagga

SEQ ID NO: 2341233 - DNA, 11 bp, Homo sapiens
aatattcatgg

SEQ ID NO: 2341234 - DNA, 22 bp, Homo sapiens
aatattccagatctttcagaaa

SEQ ID NO: 2341235 - DNA, 23 bp, Homo sapiens
aatattccagatctttcagaaat

SEQ ID NO: 2341236 - DNA, 20 bp, Homo sapiens
aatattcctttgcatattat

SEQ ID NO: 2341237 - DNA, 21 bp, Homo sapiens
aatattcctttgcatattata

SEQ ID NO: 2341238 - DNA, 18 bp, Homo sapiens
aatattcttttgtttcca

SEQ ID NO: 2341239 - DNA, 13 bp, Homo sapiens
aatattgaaaatt

SEQ ID NO: 2341240 - DNA, 14 bp, Homo sapiens
aatattgaaaattg

SEQ ID NO: 2341241 - DNA, 20 bp, Homo sapiens
aatattgaaaattgaaaagt

SEQ ID NO: 2341242 - DNA, 20 bp, Homo sapiens
aatattgattgggaaaacat

SEQ ID NO: 2341243 - DNA, 22 bp, Homo sapiens
aatattgtttggtaaatgtttc

SEQ ID NO: 2341244 - DNA, 20 bp, Homo sapiens
aatatttcaggttcttcaga

SEQ ID NO: 2341245 - DNA, 12 bp, Homo sapiens
aatatttctatt

SEQ ID NO: 2341246 - DNA, 18 bp, Homo sapiens
aatatttgcacatgggat

SEQ ID NO: 2341247 - DNA, 12 bp, Homo sapiens
aatatttggaat

SEQ ID NO: 2341248 - DNA, 19 bp, Homo sapiens
aatatttttatatttcctt

SEQ ID NO: 2341249 - DNA, 20 bp, Homo sapiens
aatatttttgtatttctcta

SEQ ID NO: 2341250 - DNA, 14 bp, Homo sapiens
aatcaaatgaatga

SEQ ID NO: 2341251 - DNA, 20 bp, Homo sapiens
aatcaactttatcatatgct

SEQ ID NO: 2341252 - DNA, 19 bp, Homo sapiens
aatcaatacactagttgtt

SEQ ID NO: 2341253 - DNA, 21 bp, Homo sapiens
aatcacaatgagaaaaataaa

SEQ ID NO: 2341254 - DNA, 12 bp, Homo sapiens
aatcacagtgtt

SEQ ID NO: 2341255 - DNA, 16 bp, Homo sapiens
aatcacagtgttgcat

SEQ ID NO: 2341256 - DNA, 16 bp, Homo sapiens
aatcaccatgtaagca

SEQ ID NO: 2341257 - DNA, 19 bp, Homo sapiens
aatcaccatgtaagcactc

SEQ ID NO: 2341258 - DNA, 23 bp, Homo sapiens
aatcaccatgtaagcactctgga

SEQ ID NO: 2341259 - DNA, 18 bp, Homo sapiens
aatcactgttgctttgaa

SEQ ID NO: 2341260 - DNA, 22 bp, Homo sapiens
aatcactgttgctttgaaaaat

SEQ ID NO: 2341261 - DNA, 16 bp, Homo sapiens
aatcacttaggaaatg

SEQ ID NO: 2341262 - DNA, 15 bp, Homo sapiens
aatcactttcataat

SEQ ID NO: 2341263 - DNA, 13 bp, Homo sapiens
aatcagaaagtaa

SEQ ID NO: 2341264 - DNA, 21 bp, Homo sapiens
aatcagaagatagtcttggaa

SEQ ID NO: 2341265 - DNA, 20 bp, Homo sapiens
aatcagattgcttaaaagca

SEQ ID NO: 2341266 - DNA, 19 bp, Homo sapiens
aatcatacaaactctcacc

SEQ ID NO: 2341267 - DNA, 20 bp, Homo sapiens
aatcatacaaactctcacca

SEQ ID NO: 2341268 - DNA, 18 bp, Homo sapiens
aatcatgagcctgctgga

SEQ ID NO: 2341269 - DNA, 17 bp, Homo sapiens
aatcatgtccatacact

SEQ ID NO: 2341270 - DNA, 13 bp, Homo sapiens
aatcattcagaaa

SEQ ID NO: 2341271 - DNA, 19 bp, Homo sapiens
aatcattcagaaatgttga

SEQ ID NO: 2341272 - DNA, 14 bp, Homo sapiens
aatcattccttaga

SEQ ID NO: 2341273 - DNA, 20 bp, Homo sapiens
aatcatttttatattataac

SEQ ID NO: 2341274 - DNA, 17 bp, Homo sapiens
aatccaagcctccacag

SEQ ID NO: 2341275 - DNA, 18 bp, Homo sapiens
aatccacaagccattttt

SEQ ID NO: 2341276 - DNA, 17 bp, Homo sapiens
aatcccacccacatgtg

SEQ ID NO: 2341277 - DNA, 20 bp, Homo sapiens
aatcccagcactttgggagg

SEQ ID NO: 2341278 - DNA, 18 bp, Homo sapiens
aaagagcccttgcctccc

SEQ ID NO: 2341279 - DNA, 21 bp, Homo sapiens
aaagaggctctggacagcaga

SEQ ID NO: 2341280 - DNA, 23 bp, Homo sapiens
aaagaggctgcccctctcaccaa

SEQ ID NO: 2341281 - DNA, 19 bp, Homo sapiens
aaagagggtttattttcag

SEQ ID NO: 2341282 - DNA, 14 bp, Homo sapiens
aaagagtctgggac

SEQ ID NO: 2341283 - DNA, 20 bp, Homo sapiens
aaagatattgtatctccttt

SEQ ID NO: 2341284 - DNA, 16 bp, Homo sapiens
aaagatatttttatct

SEQ ID NO: 2341285 - DNA, 12 bp, Homo sapiens
aaagatgatgat

SEQ ID NO: 2341286 - DNA, 17 bp, Homo sapiens
aaagatgccccattcct

SEQ ID NO: 2341287 - DNA, 22 bp, Homo sapiens
aaagatgccccattccttgcgc

SEQ ID NO: 2341288 - DNA, 16 bp, Homo sapiens
aaagatggttgtagca

SEQ ID NO: 2341289 - DNA, 20 bp, Homo sapiens
aaagatggttgtagcattta

SEQ ID NO: 2341290 - DNA, 21 bp, Homo sapiens
aaagatttcatatctaacttt

SEQ ID NO: 2341291 - DNA, 24 bp, Homo sapiens
aaagcaggcttgcccagtacattt

SEQ ID NO: 2341292 - DNA, 22 bp, Homo sapiens
aaagcatgttcacccttatagt

SEQ ID NO: 2341293 - DNA, 19 bp, Homo sapiens
aaagccaacaactctgcct

SEQ ID NO: 2341294 - DNA, 16 bp, Homo sapiens
aaagcccttctcaaga

SEQ ID NO: 2341295 - DNA, 14 bp, Homo sapiens
aaagcctctctctc

SEQ ID NO: 2341296 - DNA, 17 bp, Homo sapiens
aaagcctctctctccct

SEQ ID NO: 2341297 - DNA, 15 bp, Homo sapiens
aaagctactgtagaa

SEQ ID NO: 2341298 - DNA, 20 bp, Homo sapiens
aaagctattagccaggatca

SEQ ID NO: 2341299 - DNA, 12 bp, Homo sapiens
aaagctcttcct

SEQ ID NO: 2341300 - DNA, 14 bp, Homo sapiens
aaagctgttccttg

SEQ ID NO: 2341301 - DNA, 18 bp, Homo sapiens
aaagcttggttctgtgaa

SEQ ID NO: 2341302 - DNA, 23 bp, Homo sapiens
aaagctttcatgtcccagaactt

SEQ ID NO: 2341303 - DNA, 18 bp, Homo sapiens
aaagctttggctgagacc

SEQ ID NO: 2341304 - DNA, 19 bp, Homo sapiens
aaagctttggctgagacct

SEQ ID NO: 2341305 - DNA, 13 bp, Homo sapiens
aaaggaaaagaca

SEQ ID NO: 2341306 - DNA, 12 bp, Homo sapiens
aaaggaagacta

SEQ ID NO: 2341307 - DNA, 17 bp, Homo sapiens
aaaggatgtataaattt

SEQ ID NO: 2341308 - DNA, 13 bp, Homo sapiens
aaaggcgctgaga

SEQ ID NO: 2341309 - DNA, 11 bp, Homo sapiens
aaagggaagta

SEQ ID NO: 2341310 - DNA, 14 bp, Homo sapiens
aaagggaattatga

SEQ ID NO: 2341311 - DNA, 13 bp, Homo sapiens
aaagggatatttt

SEQ ID NO: 2341312 - DNA, 14 bp, Homo sapiens
aaagggttttcttt

SEQ ID NO: 2341313 - DNA, 16 bp, Homo sapiens
aaaggtaaatggttaa

SEQ ID NO: 2341314 - DNA, 19 bp, Homo sapiens
aaaggtaaatggttaaatt

SEQ ID NO: 2341315 - DNA, 22 bp, Homo sapiens
aaaggtaaatggttaaatttta

SEQ ID NO: 2341316 - DNA, 16 bp, Homo sapiens
aaaggtaatgtgtgga

SEQ ID NO: 2341317 - DNA, 20 bp, Homo sapiens
aaaggtgagtttgagctgcc

SEQ ID NO: 2341318 - DNA, 22 bp, Homo sapiens
aaaggtgagtttgagctgcctt

SEQ ID NO: 2341319 - DNA, 16 bp, Homo sapiens
aaaggttgaataatat

SEQ ID NO: 2341320 - DNA, 21 bp, Homo sapiens
aaagtaaggtgcttggagttt

SEQ ID NO: 2341321 - DNA, 13 bp, Homo sapiens
aaagtactcttta

SEQ ID NO: 2341322 - DNA, 16 bp, Homo sapiens
aaagtactctttaaca

SEQ ID NO: 2341323 - DNA, 14 bp, Homo sapiens
aaagtatgcattat

SEQ ID NO: 2341324 - DNA, 18 bp, Homo sapiens
aaagtatgcattattaaa

SEQ ID NO: 2341325 - DNA, 23 bp, Homo sapiens
aaagtattgaaagccaacaactc

SEQ ID NO: 2341326 - DNA, 13 bp, Homo sapiens
aaagtccctccct

SEQ ID NO: 2341327 - DNA, 20 bp, Homo sapiens
aaagtccctccctgcctgag

SEQ ID NO: 2341328 - DNA, 16 bp, Homo sapiens
aaagtctgtctttcct

SEQ ID NO: 2341329 - DNA, 18 bp, Homo sapiens
aaagtcttttttttcctg

SEQ ID NO: 2341330 - DNA, 18 bp, Homo sapiens
aaagtggctgcggtgttt

SEQ ID NO: 2341331 - DNA, 17 bp, Homo sapiens
aaagtgggcttaatgga

SEQ ID NO: 2341332 - DNA, 21 bp, Homo sapiens
aaagtgtctcaaaggagcttt

SEQ ID NO: 2341333 - DNA, 19 bp, Homo sapiens
aaagtgtgtatatattttg

SEQ ID NO: 2341334 - DNA, 20 bp, Homo sapiens
aaagtgtgtatatattttgt

SEQ ID NO: 2341335 - DNA, 21 bp, Homo sapiens
aaagtgtgtatatattttgtg

SEQ ID NO: 2341336 - DNA, 23 bp, Homo sapiens
aaagttattcttgtcattttgaa

SEQ ID NO: 2341337 - DNA, 19 bp, Homo sapiens
aaagttggaaggatctgct

SEQ ID NO: 2341338 - DNA, 13 bp, Homo sapiens
aaagttgtaaaat

SEQ ID NO: 2341339 - DNA, 18 bp, Homo sapiens
aaagttgtaaaatagaaa

SEQ ID NO: 2341340 - DNA, 21 bp, Homo sapiens
aaagttgtgatctgttgtaat

SEQ ID NO: 2341341 - DNA, 16 bp, Homo sapiens
aaagttttgtaaaaga

SEQ ID NO: 2341342 - DNA, 19 bp, Homo sapiens
aaataaaaagtaatgactt

SEQ ID NO: 2341343 - DNA, 17 bp, Homo sapiens
aaataaaaatatgtaat

SEQ ID NO: 2341344 - DNA, 21 bp, Homo sapiens
aaataaaacccgttgattact

SEQ ID NO: 2341345 - DNA, 15 bp, Homo sapiens
aaataaaatgaaaat

SEQ ID NO: 2341346 - DNA, 21 bp, Homo sapiens
aaataaaatgaaaattgtatt

SEQ ID NO: 2341347 - DNA, 14 bp, Homo sapiens
aaataaagaagtat

SEQ ID NO: 2341348 - DNA, 18 bp, Homo sapiens
aaataaagtaatttttat

SEQ ID NO: 2341349 - DNA, 17 bp, Homo sapiens
aaataaataattttaat

SEQ ID NO: 2341350 - DNA, 15 bp, Homo sapiens
aaataaatgaaactt

SEQ ID NO: 2341351 - DNA, 20 bp, Homo sapiens
aaataacctaattaatatat

SEQ ID NO: 2341352 - DNA, 15 bp, Homo sapiens
aaataactgaatttg

SEQ ID NO: 2341353 - DNA, 13 bp, Homo sapiens
aaataatgctaca

SEQ ID NO: 2341354 - DNA, 13 bp, Homo sapiens
aaataattctaaa

SEQ ID NO: 2341355 - DNA, 22 bp, Homo sapiens
aaatacacatttgctactgttg

SEQ ID NO: 2341356 - DNA, 17 bp, Homo sapiens
aaatacagctgcactga

SEQ ID NO: 2341357 - DNA, 19 bp, Homo sapiens
aaatacatgcatataatga

SEQ ID NO: 2341358 - DNA, 19 bp, Homo sapiens
aaatacatgccacatcaaa

SEQ ID NO: 2341359 - DNA, 15 bp, Homo sapiens
aaataccattcacta

SEQ ID NO: 2341360 - DNA, 19 bp, Homo sapiens
aaatagaaattttgtaaga

SEQ ID NO: 2341361 - DNA, 16 bp, Homo sapiens
aaatagaataattctt

SEQ ID NO: 2341362 - DNA, 12 bp, Homo sapiens
aaatagcaaaga

SEQ ID NO: 2341363 - DNA, 20 bp, Homo sapiens
aaatagctaagatataattt

SEQ ID NO: 2341364 - DNA, 19 bp, Homo sapiens
aaataggaatcattcagaa

SEQ ID NO: 2341365 - DNA, 24 bp, Homo sapiens
aaataggagaggatgagagcccag

SEQ ID NO: 2341366 - DNA, 16 bp, Homo sapiens
aaatagggtctaactc

SEQ ID NO: 2341367 - DNA, 19 bp, Homo sapiens
aaataggtttatattattg

SEQ ID NO: 2341368 - DNA, 14 bp, Homo sapiens
aaatagtattttgt

SEQ ID NO: 2341369 - DNA, 23 bp, Homo sapiens
aaatagtgtcatataaactcatt

SEQ ID NO: 2341370 - DNA, 18 bp, Homo sapiens
aaatagtgtgaaatatat

SEQ ID NO: 2341371 - DNA, 23 bp, Homo sapiens
aaatagttgcatagcagtatatg

SEQ ID NO: 2341372 - DNA, 18 bp, Homo sapiens
aaatataaaattatgaga

SEQ ID NO: 2341373 - DNA, 14 bp, Homo sapiens
aaatataagacatt

SEQ ID NO: 2341374 - DNA, 22 bp, Homo sapiens
aaatataatgttgataatatat

SEQ ID NO: 2341375 - DNA, 15 bp, Homo sapiens
aaatatacattttct

SEQ ID NO: 2341376 - DNA, 20 bp, Homo sapiens
aaatatacattttctaaata

SEQ ID NO: 2341377 - DNA, 19 bp, Homo sapiens
aaatatattacttaactgt

SEQ ID NO: 2341378 - DNA, 21 bp, Homo sapiens
aaatatcaaagtcattaaaga

SEQ ID NO: 2341379 - DNA, 15 bp, Homo sapiens
aaatatcataaagca

SEQ ID NO: 2341380 - DNA, 16 bp, Homo sapiens
aaatattcacatcttc

SEQ ID NO: 2341381 - DNA, 15 bp, Homo sapiens
aaatattgtttctgc

SEQ ID NO: 2341382 - DNA, 22 bp, Homo sapiens
aaatattgtttctgcattcatt

SEQ ID NO: 2341383 - DNA, 17 bp, Homo sapiens
aaatatttcatttagct

SEQ ID NO: 2341384 - DNA, 14 bp, Homo sapiens
aaatatttctcaac

SEQ ID NO: 2341385 - DNA, 17 bp, Homo sapiens
aaatatttgactattct

SEQ ID NO: 2341386 - DNA, 17 bp, Homo sapiens
aaatattttctacttta

SEQ ID NO: 2341387 - DNA, 22 bp, Homo sapiens
aaatattttctactttaaattg

SEQ ID NO: 2341388 - DNA, 15 bp, Homo sapiens
aaatcaatacactag

SEQ ID NO: 2341389 - DNA, 19 bp, Homo sapiens
aaatcaattactggtccaa

SEQ ID NO: 2341390 - DNA, 23 bp, Homo sapiens
aaatcaattactggtccaaaaga

SEQ ID NO: 2341391 - DNA, 22 bp, Homo sapiens
aaatcacaatgagaaaaataaa

SEQ ID NO: 2341392 - DNA, 13 bp, Homo sapiens
aaatcagaaagta

SEQ ID NO: 2341393 - DNA, 17 bp, Homo sapiens
aaatcagaaagtaacaa

SEQ ID NO: 2341394 - DNA, 18 bp, Homo sapiens
aaatcagaaagtaacaat

SEQ ID NO: 2341395 - DNA, 20 bp, Homo sapiens
aaatccaggctttatgtaca

SEQ ID NO: 2341396 - DNA, 12 bp, Homo sapiens
aaatcccacatc

SEQ ID NO: 2341397 - DNA, 15 bp, Homo sapiens
aaatcctgaagagca

SEQ ID NO: 2341398 - DNA, 23 bp, Homo sapiens
aaatcgccaggactggtgaatat

SEQ ID NO: 2341399 - DNA, 12 bp, Homo sapiens
aaatctcattat

SEQ ID NO: 2341400 - DNA, 15 bp, Homo sapiens
aaatctcattatttc

SEQ ID NO: 2341401 - DNA, 13 bp, Homo sapiens
aaatctgaacatt

SEQ ID NO: 2341402 - DNA, 13 bp, Homo sapiens
aaatcttcccatg

SEQ ID NO: 2341403 - DNA, 19 bp, Homo sapiens
aaatctttagggaatgaga

SEQ ID NO: 2341404 - DNA, 15 bp, Homo sapiens
aaatcttttgaagca

SEQ ID NO: 2341405 - DNA, 17 bp, Homo sapiens
aaatcttttgaagcata

SEQ ID NO: 2341406 - DNA, 11 bp, Homo sapiens
aaatgaaaatt

SEQ ID NO: 2341407 - DNA, 13 bp, Homo sapiens
aaatgaaaattgt

SEQ ID NO: 2341408 - DNA, 14 bp, Homo sapiens
aaatgaaaattgta

SEQ ID NO: 2341409 - DNA, 16 bp, Homo sapiens
aaatgaaacttggcca

SEQ ID NO: 2341410 - DNA, 22 bp, Homo sapiens
aaatgaaacttggccagtttgt

SEQ ID NO: 2341411 - DNA, 14 bp, Homo sapiens
aaatgaaagaaaat

SEQ ID NO: 2341412 - DNA, 15 bp, Homo sapiens
aaatgaaagaaaatt

SEQ ID NO: 2341413 - DNA, 12 bp, Homo sapiens
aaatgaaatgca

SEQ ID NO: 2341414 - DNA, 16 bp, Homo sapiens
aaatgaaatttaagca

SEQ ID NO: 2341415 - DNA, 22 bp, Homo sapiens
aaatgaacttgcacttgttata

SEQ ID NO: 2341416 - DNA, 14 bp, Homo sapiens
aaatgaagaaagtc

SEQ ID NO: 2341417 - DNA, 21 bp, Homo sapiens
aaatgaatgattaaattatga

SEQ ID NO: 2341418 - DNA, 23 bp, Homo sapiens
aaatgaatgattaaattatgaag

SEQ ID NO: 2341419 - DNA, 17 bp, Homo sapiens
aaatgagatttcttatt

SEQ ID NO: 2341420 - DNA, 18 bp, Homo sapiens
aaatgagtaaaaactaga

SEQ ID NO: 2341421 - DNA, 16 bp, Homo sapiens
aaatgcctttgagaca

SEQ ID NO: 2341422 - DNA, 19 bp, Homo sapiens
aaatgcctttgagacagtt

SEQ ID NO: 2341423 - DNA, 16 bp, Homo sapiens
aaatgcttaaatttca

SEQ ID NO: 2341424 - DNA, 20 bp, Homo sapiens
aaatggaggatctctaaaga

SEQ ID NO: 2341425 - DNA, 22 bp, Homo sapiens
aaatggaggatctctaaagagc

SEQ ID NO: 2341426 - DNA, 11 bp, Homo sapiens
aaatggccatt

SEQ ID NO: 2341427 - DNA, 16 bp, Homo sapiens
aaatggcgtctgctct

SEQ ID NO: 2341428 - DNA, 21 bp, Homo sapiens
aaatgggtgtatataatttta

SEQ ID NO: 2341429 - DNA, 19 bp, Homo sapiens
aaatggttaaattttacat

SEQ ID NO: 2341430 - DNA, 23 bp, Homo sapiens
aaatggttatccaattgctcttt

SEQ ID NO: 2341431 - DNA, 19 bp, Homo sapiens
aaatgtacatttccaaatg

SEQ ID NO: 2341432 - DNA, 21 bp, Homo sapiens
aaatgtataaatatacagtat

SEQ ID NO: 2341433 - DNA, 13 bp, Homo sapiens
aaatgtatgcatt

SEQ ID NO: 2341434 - DNA, 17 bp, Homo sapiens
aaatgtcacagaagcag

SEQ ID NO: 2341435 - DNA, 12 bp, Homo sapiens
aaatgtctgctg

SEQ ID NO: 2341436 - DNA, 18 bp, Homo sapiens
aaatgtggccaagcctat

SEQ ID NO: 2341437 - DNA, 19 bp, Homo sapiens
aaatgtggccaagcctatc

SEQ ID NO: 2341438 - DNA, 23 bp, Homo sapiens
aaatgttaaaagttttatatgct

SEQ ID NO: 2341439 - DNA, 22 bp, Homo sapiens
aaatgttacgtgaagaaataaa

SEQ ID NO: 2341440 - DNA, 17 bp, Homo sapiens
aaatgtttaatggtgaa

SEQ ID NO: 2341441 - DNA, 14 bp, Homo sapiens
aaatgtttcttttg

SEQ ID NO: 2341442 - DNA, 13 bp, Homo sapiens
aaatgttttatga

SEQ ID NO: 2341443 - DNA, 17 bp, Homo sapiens
aaattaaaaaaaaattg

SEQ ID NO: 2341444 - DNA, 14 bp, Homo sapiens
aaattaaaacaaat

SEQ ID NO: 2341445 - DNA, 13 bp, Homo sapiens
aaattaaatctgt

SEQ ID NO: 2341446 - DNA, 13 bp, Homo sapiens
aaattaagcaaat

SEQ ID NO: 2341447 - DNA, 17 bp, Homo sapiens
aaattaagcaaatgtta

SEQ ID NO: 2341448 - DNA, 13 bp, Homo sapiens
aaattacctttaa

SEQ ID NO: 2341449 - DNA, 21 bp, Homo sapiens
aaattacctttaattttaatg

SEQ ID NO: 2341450 - DNA, 18 bp, Homo sapiens
aaattagataaattgtag

SEQ ID NO: 2341451 - DNA, 17 bp, Homo sapiens
aaattatgaagctcata

SEQ ID NO: 2341452 - DNA, 13 bp, Homo sapiens
aaattatttgcta

SEQ ID NO: 2341453 - DNA, 15 bp, Homo sapiens
aaattcaaaaagaac

SEQ ID NO: 2341454 - DNA, 16 bp, Homo sapiens
aaattcaaaagtattg

SEQ ID NO: 2341455 - DNA, 16 bp, Homo sapiens
aaattcaaccacagat

SEQ ID NO: 2341456 - DNA, 16 bp, Homo sapiens
aaattcaactttgtaa

SEQ ID NO: 2341457 - DNA, 20 bp, Homo sapiens
aaattcagtttttttccagt

SEQ ID NO: 2341458 - DNA, 22 bp, Homo sapiens
aaattccattagagagtggcaa

SEQ ID NO: 2341459 - DNA, 23 bp, Homo sapiens
aaattcttctgaactcaaactga

SEQ ID NO: 2341460 - DNA, 12 bp, Homo sapiens
aaattgcatact

SEQ ID NO: 2341461 - DNA, 13 bp, Homo sapiens
aaattggaactct

SEQ ID NO: 2341462 - DNA, 19 bp, Homo sapiens
aaattggggaggagggggc

SEQ ID NO: 2341463 - DNA, 18 bp, Homo sapiens
aaattgtatctcattact

SEQ ID NO: 2341464 - DNA, 11 bp, Homo sapiens
aaattgtggat

SEQ ID NO: 2341465 - DNA, 12 bp, Homo sapiens
aaattgtggatg

SEQ ID NO: 2341466 - DNA, 13 bp, Homo sapiens
aaattgtggatga

SEQ ID NO: 2341467 - DNA, 16 bp, Homo sapiens
aaattgttatcaaaat

SEQ ID NO: 2341468 - DNA, 19 bp, Homo sapiens
aaattgttatcaaaatagt

SEQ ID NO: 2341469 - DNA, 16 bp, Homo sapiens
aaatttaaaaaataaa

SEQ ID NO: 2341470 - DNA, 15 bp, Homo sapiens
aaatttaagcacaaa

SEQ ID NO: 2341471 - DNA, 16 bp, Homo sapiens
aaatttaagtgcgtgt

SEQ ID NO: 2341472 - DNA, 15 bp, Homo sapiens
aaatttcttatgtga

SEQ ID NO: 2341473 - DNA, 22 bp, Homo sapiens
aaatttgtaagtttcaggtgac

SEQ ID NO: 2341474 - DNA, 16 bp, Homo sapiens
aaatttgtcttaaaaa

SEQ ID NO: 2341475 - DNA, 15 bp, Homo sapiens
aaattttaactaaat

SEQ ID NO: 2341476 - DNA, 15 bp, Homo sapiens
aaattttagaaatat

SEQ ID NO: 2341477 - DNA, 12 bp, Homo sapiens
aaattttatatg

SEQ ID NO: 2341478 - DNA, 12 bp, Homo sapiens
aaattttctaaa

SEQ ID NO: 2341479 - DNA, 14 bp, Homo sapiens
aaattttgtaagaa

SEQ ID NO: 2341480 - DNA, 18 bp, Homo sapiens
aaatttttacctgtttaa

SEQ ID NO: 2341481 - DNA, 17 bp, Homo sapiens
aaatttttatgtaatta

SEQ ID NO: 2341482 - DNA, 19 bp, Homo sapiens
aaattttttgatgtcagcc

SEQ ID NO: 2341483 - DNA, 13 bp, Homo sapiens
aacaaaaagatgt

SEQ ID NO: 2341484 - DNA, 17 bp, Homo sapiens
aacaaagggttttcttt

SEQ ID NO: 2341485 - DNA, 22 bp, Homo sapiens
aacaaatatacattttctaaat

SEQ ID NO: 2341486 - DNA, 22 bp, Homo sapiens
aacaaatgtggccaagcctatc

SEQ ID NO: 2341487 - DNA, 23 bp, Homo sapiens
aacaagacctcagtgccttcctg

SEQ ID NO: 2341488 - DNA, 12 bp, Homo sapiens
aacaagatttcc

SEQ ID NO: 2341489 - DNA, 12 bp, Homo sapiens
aacaagcttcag

SEQ ID NO: 2341490 - DNA, 13 bp, Homo sapiens
aacaagtatgaat

SEQ ID NO: 2341491 - DNA, 15 bp, Homo sapiens
aacaatacatgagaa

SEQ ID NO: 2341492 - DNA, 17 bp, Homo sapiens
aacaatggagtattctc

SEQ ID NO: 2341493 - DNA, 12 bp, Homo sapiens
aacaatgttaag

SEQ ID NO: 2341494 - DNA, 14 bp, Homo sapiens
aacaattatttgaa

SEQ ID NO: 2341495 - DNA, 17 bp, Homo sapiens
aacaattcagtaacaaa

SEQ ID NO: 2341496 - DNA, 17 bp, Homo sapiens
aacaattggtaaaactc

SEQ ID NO: 2341497 - DNA, 13 bp, Homo sapiens
aacacaagcaaaa

SEQ ID NO: 2341498 - DNA, 10 bp, Homo sapiens
aacacacctc

SEQ ID NO: 2341499 - DNA, 13 bp, Homo sapiens
aacacatttctct

SEQ ID NO: 2341500 - DNA, 20 bp, Homo sapiens
aacacatttttttgcatgca

SEQ ID NO: 2341501 - DNA, 20 bp, Homo sapiens
aacacggagcagggagagct

SEQ ID NO: 2341502 - DNA, 23 bp, Homo sapiens
aacactagggccttggaaattcc

SEQ ID NO: 2341503 - DNA, 21 bp, Homo sapiens
aacactccccattaacagatg

SEQ ID NO: 2341504 - DNA, 22 bp, Homo sapiens
aacagaagctcttactctttcc

SEQ ID NO: 2341505 - DNA, 15 bp, Homo sapiens
aacagaatcttctgg

SEQ ID NO: 2341506 - DNA, 14 bp, Homo sapiens
aacagaatttgaga

SEQ ID NO: 2341507 - DNA, 15 bp, Homo sapiens
aacagaatttgagaa

SEQ ID NO: 2341508 - DNA, 19 bp, Homo sapiens
aacagcagctcatagaatt

SEQ ID NO: 2341509 - DNA, 19 bp, Homo sapiens
aacagccccccccttgaat

SEQ ID NO: 2341510 - DNA, 15 bp, Homo sapiens
aacagcctttgaatg

SEQ ID NO: 2341511 - DNA, 22 bp, Homo sapiens
aacagcctttgaatgtaaccaa

SEQ ID NO: 2341512 - DNA, 11 bp, Homo sapiens
aacagctgtgt

SEQ ID NO: 2341513 - DNA, 14 bp, Homo sapiens
aacagctgtgtctg

SEQ ID NO: 2341514 - DNA, 16 bp, Homo sapiens
aacagcttcaggttat

SEQ ID NO: 2341515 - DNA, 21 bp, Homo sapiens
aacagcttcctgttactgaga

SEQ ID NO: 2341516 - DNA, 14 bp, Homo sapiens
aacagggctgcctt

SEQ ID NO: 2341517 - DNA, 21 bp, Homo sapiens
aacagggctgccttctggcct

SEQ ID NO: 2341518 - DNA, 17 bp, Homo sapiens
aacagtaactgccattt

SEQ ID NO: 2341519 - DNA, 22 bp, Homo sapiens
aacagtactggttactttcaaa

SEQ ID NO: 2341520 - DNA, 14 bp, Homo sapiens
aacagtccttgctt

SEQ ID NO: 2341521 - DNA, 16 bp, Homo sapiens
aacagtttggaaaagt

SEQ ID NO: 2341522 - DNA, 17 bp, Homo sapiens
aacataaataaaaattc

SEQ ID NO: 2341523 - DNA, 22 bp, Homo sapiens
aacataatcttctgccttctca

SEQ ID NO: 2341524 - DNA, 21 bp, Homo sapiens
aacatagcagatctgttttgt

SEQ ID NO: 2341525 - DNA, 14 bp, Homo sapiens
aacatgatgtgaga

SEQ ID NO: 2341526 - DNA, 14 bp, Homo sapiens
aacattaaggaatt

SEQ ID NO: 2341527 - DNA, 17 bp, Homo sapiens
aacattaaggaatttga

SEQ ID NO: 2341528 - DNA, 19 bp, Homo sapiens
aacattaccttactgtgga

SEQ ID NO: 2341529 - DNA, 17 bp, Homo sapiens
aacattcccagcccagc

SEQ ID NO: 2341530 - DNA, 23 bp, Homo sapiens
aacattgtgttcccatttcagct

SEQ ID NO: 2341531 - DNA, 15 bp, Homo sapiens
aacatttatatgtag

SEQ ID NO: 2341532 - DNA, 16 bp, Homo sapiens
aacatttgctgccatt

SEQ ID NO: 2341533 - DNA, 19 bp, Homo sapiens
aacattttacagtaaatgt

SEQ ID NO: 2341534 - DNA, 19 bp, Homo sapiens
aacattttatcattaaaaa

SEQ ID NO: 2341535 - DNA, 15 bp, Homo sapiens
aaccaaaaacatttg

SEQ ID NO: 2341536 - DNA, 20 bp, Homo sapiens
aaccaaaaacatttgattaa

SEQ ID NO: 2341537 - DNA, 19 bp, Homo sapiens
aaccaaagagggcttcctc

SEQ ID NO: 2341538 - DNA, 22 bp, Homo sapiens
aaccaatcctactaataaacca

SEQ ID NO: 2341539 - DNA, 19 bp, Homo sapiens
aaccacacttgaaaccttt

SEQ ID NO: 2341540 - DNA, 18 bp, Homo sapiens
aaccacatttagaaatgt

SEQ ID NO: 2341541 - DNA, 16 bp, Homo sapiens
aaccaccaaaaacaaa

SEQ ID NO: 2341542 - DNA, 23 bp, Homo sapiens
aaccagagggcatgctgaatgcc

SEQ ID NO: 2341543 - DNA, 15 bp, Homo sapiens
aaccagcattcccta

SEQ ID NO: 2341544 - DNA, 16 bp, Homo sapiens
aaccaggcacctcttc

SEQ ID NO: 2341545 - DNA, 19 bp, Homo sapiens
aaccataaaaccctataca

SEQ ID NO: 2341546 - DNA, 19 bp, Homo sapiens
aaccatcttgtgtctttgg

SEQ ID NO: 2341547 - DNA, 19 bp, Homo sapiens
aacccaagcaacatttgta

SEQ ID NO: 2341548 - DNA, 14 bp, Homo sapiens
aacccaagtgcctc

SEQ ID NO: 2341549 - DNA, 16 bp, Homo sapiens
aacccactgcatgcag

SEQ ID NO: 2341550 - DNA, 17 bp, Homo sapiens
aacccatcttccccgga

SEQ ID NO: 2341551 - DNA, 17 bp, Homo sapiens
aaccctatacaagttgt

SEQ ID NO: 2341552 - DNA, 14 bp, Homo sapiens
aaccctgctgaaca

SEQ ID NO: 2341553 - DNA, 16 bp, Homo sapiens
aaccctttgtgtgctc

SEQ ID NO: 2341554 - DNA, 21 bp, Homo sapiens
aacctaatcaccatgtaagca

SEQ ID NO: 2341555 - DNA, 20 bp, Homo sapiens
aacctcaattgacattcctt

SEQ ID NO: 2341556 - DNA, 14 bp, Homo sapiens
aacctcaccttcct

SEQ ID NO: 2341557 - DNA, 15 bp, Homo sapiens
aacctcaccttcctg

SEQ ID NO: 2341558 - DNA, 13 bp, Homo sapiens
aacctcagggctg

SEQ ID NO: 2341559 - DNA, 22 bp, Homo sapiens
aacctcagggctgtcccagccc

SEQ ID NO: 2341560 - DNA, 23 bp, Homo sapiens
aacctcagggctgtcccagcccc

SEQ ID NO: 2341561 - DNA, 22 bp, Homo sapiens
aacctcatagcaaccagaggaa

SEQ ID NO: 2341562 - DNA, 15 bp, Homo sapiens
aacctctttttcctc

SEQ ID NO: 2341563 - DNA, 15 bp, Homo sapiens
aacctgaagtttttt

SEQ ID NO: 2341564 - DNA, 15 bp, Homo sapiens
aacctgcacacagga

SEQ ID NO: 2341565 - DNA, 16 bp, Homo sapiens
aacctgtattactgaa

SEQ ID NO: 2341566 - DNA, 21 bp, Homo sapiens
aacctgttacctactttgact

SEQ ID NO: 2341567 - DNA, 15 bp, Homo sapiens
aaccttggaccactc

SEQ ID NO: 2341568 - DNA, 22 bp, Homo sapiens
aaccttggaccactcctgtccc

SEQ ID NO: 2341569 - DNA, 14 bp, Homo sapiens
aacctttctgtagc

SEQ ID NO: 2341570 - DNA, 21 bp, Homo sapiens
aaccttttttaagatttttct

SEQ ID NO: 2341571 - DNA, 23 bp, Homo sapiens
aacgaagagttcccttgaaactt

SEQ ID NO: 2341572 - DNA, 19 bp, Homo sapiens
aacgaatggtctttgctcc

SEQ ID NO: 2341573 - DNA, 13 bp, Homo sapiens
aacgcattgccac

SEQ ID NO: 2341574 - DNA, 15 bp, Homo sapiens
aacgcattgccacgg

SEQ ID NO: 2341575 - DNA, 16 bp, Homo sapiens
aacgggaacatgcccc

SEQ ID NO: 2341576 - DNA, 13 bp, Homo sapiens
aacgggatacagg

SEQ ID NO: 2341577 - DNA, 14 bp, Homo sapiens
aacggtgctaaaaa

SEQ ID NO: 2341578 - DNA, 20 bp, Homo sapiens
aacggtgctgtgagggaggg

SEQ ID NO: 2341579 - DNA, 23 bp, Homo sapiens
aacgtggtttgcctgaggctgta

SEQ ID NO: 2341580 - DNA, 13 bp, Homo sapiens
aacgttttcttct

SEQ ID NO: 2341581 - DNA, 22 bp, Homo sapiens
aactaaatttcactactagatt

SEQ ID NO: 2341582 - DNA, 14 bp, Homo sapiens
aactaaattttaaa

SEQ ID NO: 2341583 - DNA, 20 bp, Homo sapiens
aactaagccaggcctggctg

SEQ ID NO: 2341584 - DNA, 15 bp, Homo sapiens
aactaccaggtggca

SEQ ID NO: 2341585 - DNA, 18 bp, Homo sapiens
aactactgaataatgcta

SEQ ID NO: 2341586 - DNA, 20 bp, Homo sapiens
aactagaaggcttctctcca

SEQ ID NO: 2341587 - DNA, 23 bp, Homo sapiens
aactagccagacaaaatttgaga

SEQ ID NO: 2341588 - DNA, 14 bp, Homo sapiens
aactagctgggact

SEQ ID NO: 2341589 - DNA, 22 bp, Homo sapiens
aactagctgggactacaggtgc

SEQ ID NO: 2341590 - DNA, 15 bp, Homo sapiens
aactaggctgagcaa

SEQ ID NO: 2341591 - DNA, 23 bp, Homo sapiens
aactataaggtgcctcagttttc

SEQ ID NO: 2341592 - DNA, 23 bp, Homo sapiens
aactatagcttgcagaactgtag

SEQ ID NO: 2341593 - DNA, 17 bp, Homo sapiens
aactatgttcctaacaa

SEQ ID NO: 2341594 - DNA, 21 bp, Homo sapiens
aactatgttcctaacaaaatg

SEQ ID NO: 2341595 - DNA, 22 bp, Homo sapiens
aactatgttcctaacaaaatga

SEQ ID NO: 2341596 - DNA, 21 bp, Homo sapiens
aactattagagtatttccctt

SEQ ID NO: 2341597 - DNA, 23 bp, Homo sapiens
aactattagagtatttcccttcc

SEQ ID NO: 2341598 - DNA, 22 bp, Homo sapiens
aactattgggtgaatatggtgg

SEQ ID NO: 2341599 - DNA, 17 bp, Homo sapiens
aactatttttttcaaag

SEQ ID NO: 2341600 - DNA, 23 bp, Homo sapiens
aactcaaggataccttcttattt

SEQ ID NO: 2341601 - DNA, 17 bp, Homo sapiens
aactcacctaatgttta

SEQ ID NO: 2341602 - DNA, 15 bp, Homo sapiens
aactcactgtgatca

SEQ ID NO: 2341603 - DNA, 17 bp, Homo sapiens
aactcaggcaaagaaaa

SEQ ID NO: 2341604 - DNA, 18 bp, Homo sapiens
aactcaggcaaagaaaat

SEQ ID NO: 2341605 - DNA, 16 bp, Homo sapiens
aactccacatctgcct

SEQ ID NO: 2341606 - DNA, 18 bp, Homo sapiens
aactccacatctgcctta

SEQ ID NO: 2341607 - DNA, 21 bp, Homo sapiens
aactccaggaaagagcagtca

SEQ ID NO: 2341608 - DNA, 16 bp, Homo sapiens
aactccaggccctcct

SEQ ID NO: 2341609 - DNA, 14 bp, Homo sapiens
aactccttcctggc

SEQ ID NO: 2341610 - DNA, 19 bp, Homo sapiens
aactctactcaacccattg

SEQ ID NO: 2341611 - DNA, 13 bp, Homo sapiens
aactctctttcct

SEQ ID NO: 2341612 - DNA, 16 bp, Homo sapiens
aactctctttccttga

SEQ ID NO: 2341613 - DNA, 13 bp, Homo sapiens
aactctgaagcta

SEQ ID NO: 2341614 - DNA, 11 bp, Homo sapiens
aactctgaagg

SEQ ID NO: 2341615 - DNA, 15 bp, Homo sapiens
aactgaatgaatcca

SEQ ID NO: 2341616 - DNA, 13 bp, Homo sapiens
aactgaatttgga

SEQ ID NO: 2341617 - DNA, 23 bp, Homo sapiens
aactgacctgaccccattcctga

SEQ ID NO: 2341618 - DNA, 15 bp, Homo sapiens
aactgagagaaagat

SEQ ID NO: 2341619 - DNA, 19 bp, Homo sapiens
aactgaggcttagagatag

SEQ ID NO: 2341620 - DNA, 18 bp, Homo sapiens
aactgccattttttgtct

SEQ ID NO: 2341621 - DNA, 23 bp, Homo sapiens
aactgcttcccttactttgctga

SEQ ID NO: 2341622 - DNA, 16 bp, Homo sapiens
aactggggttgagggc

SEQ ID NO: 2341623 - DNA, 22 bp, Homo sapiens
aactgtctctcttctcagagtg

SEQ ID NO: 2341624 - DNA, 14 bp, Homo sapiens
aactgtcttagact

SEQ ID NO: 2341625 - DNA, 16 bp, Homo sapiens
aactgtcttcctcaaa

SEQ ID NO: 2341626 - DNA, 20 bp, Homo sapiens
aactgtgtacataactgaaa

SEQ ID NO: 2341627 - DNA, 13 bp, Homo sapiens
aacttaactgaaa

SEQ ID NO: 2341628 - DNA, 17 bp, Homo sapiens
aacttattctttgagta

SEQ ID NO: 2341629 - DNA, 19 bp, Homo sapiens
aacttattttaaatatgcc

SEQ ID NO: 2341630 - DNA, 14 bp, Homo sapiens
aacttcatgtaatt

SEQ ID NO: 2341631 - DNA, 16 bp, Homo sapiens
aacttcatgtaatttt

SEQ ID NO: 2341632 - DNA, 15 bp, Homo sapiens
aacttccaaagaaag

SEQ ID NO: 2341633 - DNA, 23 bp, Homo sapiens
aacttccaaataaataattttca

SEQ ID NO: 2341634 - DNA, 16 bp, Homo sapiens
aacttcccattaaaaa

SEQ ID NO: 2341635 - DNA, 19 bp, Homo sapiens
aacttctgcaacaagcatg

SEQ ID NO: 2341636 - DNA, 21 bp, Homo sapiens
aacttcttctccatccctcta

SEQ ID NO: 2341637 - DNA, 15 bp, Homo sapiens
aacttttaagatttc

SEQ ID NO: 2341638 - DNA, 20 bp, Homo sapiens
aacttttgtactgaattttt

SEQ ID NO: 2341639 - DNA, 16 bp, Homo sapiens
aagaaacagtttaaca

SEQ ID NO: 2341640 - DNA, 14 bp, Homo sapiens
aagaaactgaatga

SEQ ID NO: 2341641 - DNA, 13 bp, Homo sapiens
aagaaagcagaat

SEQ ID NO: 2341642 - DNA, 16 bp, Homo sapiens
aagaaaggaaaagaaa

SEQ ID NO: 2341643 - DNA, 13 bp, Homo sapiens
aagaaagtggtct

SEQ ID NO: 2341644 - DNA, 17 bp, Homo sapiens
aagaaataaaccaaagg

SEQ ID NO: 2341645 - DNA, 15 bp, Homo sapiens
aagaaatatattttt

SEQ ID NO: 2341646 - DNA, 18 bp, Homo sapiens
aagaaatggcgtctgctc

SEQ ID NO: 2341647 - DNA, 22 bp, Homo sapiens
aagaaatggcgtctgctctggt

SEQ ID NO: 2341648 - DNA, 21 bp, Homo sapiens
aagaaattccatacttctctc

SEQ ID NO: 2341649 - DNA, 23 bp, Homo sapiens
aagaaattccatacttctctcag

SEQ ID NO: 2341650 - DNA, 22 bp, Homo sapiens
aagaacactggacctttgggtt

SEQ ID NO: 2341651 - DNA, 23 bp, Homo sapiens
aagaactattgtgctcagagaca

SEQ ID NO: 2341652 - DNA, 13 bp, Homo sapiens
aagaactctctgg

SEQ ID NO: 2341653 - DNA, 16 bp, Homo sapiens
aagaagacatgaacca

SEQ ID NO: 2341654 - DNA, 21 bp, Homo sapiens
aagaagatagttgtaaagata

SEQ ID NO: 2341655 - DNA, 11 bp, Homo sapiens
aagaagccata

SEQ ID NO: 2341656 - DNA, 23 bp, Homo sapiens
aagaagccatatatgaccagaag

SEQ ID NO: 2341657 - DNA, 17 bp, Homo sapiens
aagaagctgttgtacat

SEQ ID NO: 2341658 - DNA, 21 bp, Homo sapiens
aagaagctgttgtacatttat

SEQ ID NO: 2341659 - DNA, 14 bp, Homo sapiens
aagaaggaaagatg

SEQ ID NO: 2341660 - DNA, 18 bp, Homo sapiens
aagaaggaaagatggtta

SEQ ID NO: 2341661 - DNA, 19 bp, Homo sapiens
aagaaggaaggcctgagcc

SEQ ID NO: 2341662 - DNA, 14 bp, Homo sapiens
aagaaggatgatgt

SEQ ID NO: 2341663 - DNA, 15 bp, Homo sapiens
aagaaggcaatatta

SEQ ID NO: 2341664 - DNA, 15 bp, Homo sapiens
aagaagggagaagaa

SEQ ID NO: 2341665 - DNA, 20 bp, Homo sapiens
aagaagtggctgccacaccc

SEQ ID NO: 2341666 - DNA, 22 bp, Homo sapiens
aagaataatcacgctttcctga

SEQ ID NO: 2341667 - DNA, 23 bp, Homo sapiens
aagaataatcacgctttcctgaa

SEQ ID NO: 2341668 - DNA, 13 bp, Homo sapiens
aagaatgaaaaat

SEQ ID NO: 2341669 - DNA, 19 bp, Homo sapiens
aagaatgaaaaatataatg

SEQ ID NO: 2341670 - DNA, 19 bp, Homo sapiens
aagaatgaaagctgttcct

SEQ ID NO: 2341671 - DNA, 15 bp, Homo sapiens
aagaatggctttcaa

SEQ ID NO: 2341672 - DNA, 11 bp, Homo sapiens
aagaatgttag

SEQ ID NO: 2341673 - DNA, 20 bp, Homo sapiens
aagaatgttagagtaatgaa

SEQ ID NO: 2341674 - DNA, 12 bp, Homo sapiens
aagaatgttagt

SEQ ID NO: 2341675 - DNA, 18 bp, Homo sapiens
aagaattgaaaagttttt

SEQ ID NO: 2341676 - DNA, 19 bp, Homo sapiens
aagaattgaaaagtttttg

SEQ ID NO: 2341677 - DNA, 20 bp, Homo sapiens
aagaattgaaaagtttttgt

SEQ ID NO: 2341678 - DNA, 13 bp, Homo sapiens
aagacaaatattc

SEQ ID NO: 2341679 - DNA, 13 bp, Homo sapiens
aagacaccagagc

SEQ ID NO: 2341680 - DNA, 15 bp, Homo sapiens
aagacaccagagcag

SEQ ID NO: 2341681 - DNA, 23 bp, Homo sapiens
aagacaccagagcagatgcagag

SEQ ID NO: 2341682 - DNA, 19 bp, Homo sapiens
aagacataacgtttttcct

SEQ ID NO: 2341683 - DNA, 22 bp, Homo sapiens
aagacataacgtttttccttta

SEQ ID NO: 2341684 - DNA, 13 bp, Homo sapiens
aagacatgaacca

SEQ ID NO: 2341685 - DNA, 17 bp, Homo sapiens
aagacatgtctgttcta

SEQ ID NO: 2341686 - DNA, 18 bp, Homo sapiens
aagacattttaagtttgt

SEQ ID NO: 2341687 - DNA, 19 bp, Homo sapiens
aagacattttaagtttgta

SEQ ID NO: 2341688 - DNA, 19 bp, Homo sapiens
aagaccctatctcccacaa

SEQ ID NO: 2341689 - DNA, 22 bp, Homo sapiens
aagaccctcttgcccatcctga

SEQ ID NO: 2341690 - DNA, 12 bp, Homo sapiens
aagacctgagta

SEQ ID NO: 2341691 - DNA, 14 bp, Homo sapiens
aagactatatatat

SEQ ID NO: 2341692 - DNA, 18 bp, Homo sapiens
aagactgggccccacatg

SEQ ID NO: 2341693 - DNA, 15 bp, Homo sapiens
aagactggttttctg

SEQ ID NO: 2341694 - DNA, 17 bp, Homo sapiens
aagactggttttctgcc

SEQ ID NO: 2341695 - DNA, 17 bp, Homo sapiens
aagactgtagatatgta

SEQ ID NO: 2341696 - DNA, 20 bp, Homo sapiens
aagacttgagacaatgtttt

SEQ ID NO: 2341697 - DNA, 14 bp, Homo sapiens
aagactttaattat

SEQ ID NO: 2341698 - DNA, 11 bp, Homo sapiens
aagagaatgag

SEQ ID NO: 2341699 - DNA, 13 bp, Homo sapiens
aagagacactcca

SEQ ID NO: 2341700 - DNA, 15 bp, Homo sapiens
aagagacagcccagg

SEQ ID NO: 2341701 - DNA, 18 bp, Homo sapiens
aagagactgcgttctgca

SEQ ID NO: 2341702 - DNA, 13 bp, Homo sapiens
aagagagaatgta

SEQ ID NO: 2341703 - DNA, 18 bp, Homo sapiens
aagagaggcacctgctgg

SEQ ID NO: 2341704 - DNA, 20 bp, Homo sapiens
aagagcagtcagagtccagt

SEQ ID NO: 2341705 - DNA, 14 bp, Homo sapiens
aagagcatctgatt

SEQ ID NO: 2341706 - DNA, 18 bp, Homo sapiens
aagagcccagtctgttga

SEQ ID NO: 2341707 - DNA, 13 bp, Homo sapiens
aagagcccttgcc

SEQ ID NO: 2341708 - DNA, 16 bp, Homo sapiens
aagagcccttgcctcc

SEQ ID NO: 2341709 - DNA, 23 bp, Homo sapiens
aagagcttgctccagattctgat

SEQ ID NO: 2341710 - DNA, 23 bp, Homo sapiens
aagaggagcccccaccctgttcc

SEQ ID NO: 2341711 - DNA, 16 bp, Homo sapiens
aagaggctctggacag

SEQ ID NO: 2341712 - DNA, 22 bp, Homo sapiens
aagaggctgcccctctcaccaa

SEQ ID NO: 2341713 - DNA, 17 bp, Homo sapiens
aagagggagaagcatga

SEQ ID NO: 2341714 - DNA, 13 bp, Homo sapiens
aagagggggtgga

SEQ ID NO: 2341715 - DNA, 14 bp, Homo sapiens
aagagtaaagcaac

SEQ ID NO: 2341716 - DNA, 22 bp, Homo sapiens
aagagtattttaagaagacata

SEQ ID NO: 2341717 - DNA, 14 bp, Homo sapiens
aagagtcttccaat

SEQ ID NO: 2341718 - DNA, 12 bp, Homo sapiens
aagagtgtagaa

SEQ ID NO: 2341719 - DNA, 16 bp, Homo sapiens
aagagtgtagaagcat

SEQ ID NO: 2341720 - DNA, 19 bp, Homo sapiens
aagagtttcagtttgttgg

SEQ ID NO: 2341721 - DNA, 14 bp, Homo sapiens
aagagttttgggag

SEQ ID NO: 2341722 - DNA, 21 bp, Homo sapiens
aagatagtgtaacttgcttaa

SEQ ID NO: 2341723 - DNA, 16 bp, Homo sapiens
aagatagttgtaaaga

SEQ ID NO: 2341724 - DNA, 23 bp, Homo sapiens
aagatatgtaacaacaattattt

SEQ ID NO: 2341725 - DNA, 21 bp, Homo sapiens
aagatattgtatctcctttaa

SEQ ID NO: 2341726 - DNA, 19 bp, Homo sapiens
aagatatttttatctttat

SEQ ID NO: 2341727 - DNA, 12 bp, Homo sapiens
aagatcactgta

SEQ ID NO: 2341728 - DNA, 17 bp, Homo sapiens
aagatcactttctcagt

SEQ ID NO: 2341729 - DNA, 17 bp, Homo sapiens
aagatctttttttaagt

SEQ ID NO: 2341730 - DNA, 12 bp, Homo sapiens
aagatgagttgg

SEQ ID NO: 2341731 - DNA, 19 bp, Homo sapiens
aagatgggggcagggctgt

SEQ ID NO: 2341732 - DNA, 21 bp, Homo sapiens
aagatgggggcagggctgtgc

SEQ ID NO: 2341733 - DNA, 20 bp, Homo sapiens
aagatggtgtgggtgtcctg

SEQ ID NO: 2341734 - DNA, 14 bp, Homo sapiens
aagatggttgtagc

SEQ ID NO: 2341735 - DNA, 12 bp, Homo sapiens
aagatgtgaatt

SEQ ID NO: 2341736 - DNA, 18 bp, Homo sapiens
aagatgtgaattattgac

SEQ ID NO: 2341737 - DNA, 16 bp, Homo sapiens
aagatgtgttcttatt

SEQ ID NO: 2341738 - DNA, 22 bp, Homo sapiens
aagattaataagatttttcaaa

SEQ ID NO: 2341739 - DNA, 22 bp, Homo sapiens
aagattatatgaagtttaaatt

SEQ ID NO: 2341740 - DNA, 16 bp, Homo sapiens
aagattattttttaaa

SEQ ID NO: 2341741 - DNA, 17 bp, Homo sapiens
aagattctaaagctcaa

SEQ ID NO: 2341742 - DNA, 18 bp, Homo sapiens
aagattgccccatctaga

SEQ ID NO: 2341743 - DNA, 12 bp, Homo sapiens
aagattgctgaa

SEQ ID NO: 2341744 - DNA, 15 bp, Homo sapiens
aagattgctgaaatt

SEQ ID NO: 2341745 - DNA, 17 bp, Homo sapiens
aagatttccttgtgcaa

SEQ ID NO: 2341746 - DNA, 13 bp, Homo sapiens
aagatttttctca

SEQ ID NO: 2341747 - DNA, 12 bp, Homo sapiens
aagcaaaacagt

SEQ ID NO: 2341748 - DNA, 19 bp, Homo sapiens
aagcaaaacagttctcaga

SEQ ID NO: 2341749 - DNA, 14 bp, Homo sapiens
aagcaaaactcact

SEQ ID NO: 2341750 - DNA, 18 bp, Homo sapiens
aagcaaaggggacagctg

SEQ ID NO: 2341751 - DNA, 21 bp, Homo sapiens
aagcaaaggggacagctgtgt

SEQ ID NO: 2341752 - DNA, 20 bp, Homo sapiens
aagcaaattttgtattattg

SEQ ID NO: 2341753 - DNA, 21 bp, Homo sapiens
aagcaacagcctttgaatgta

SEQ ID NO: 2341754 - DNA, 13 bp, Homo sapiens
aagcaacatttgt

SEQ ID NO: 2341755 - DNA, 15 bp, Homo sapiens
aagcaagagagatgt

SEQ ID NO: 2341756 - DNA, 22 bp, Homo sapiens
aagcaagaggcaagctgaaatt

SEQ ID NO: 2341757 - DNA, 13 bp, Homo sapiens
aagcaagccagac

SEQ ID NO: 2341758 - DNA, 21 bp, Homo sapiens
aagcaatcctcctgcctcagc

SEQ ID NO: 2341759 - DNA, 12 bp, Homo sapiens
aagcacagagcc

SEQ ID NO: 2341760 - DNA, 13 bp, Homo sapiens
aagcacagagcct

SEQ ID NO: 2341761 - DNA, 19 bp, Homo sapiens
aagcactacaccttgcctt

SEQ ID NO: 2341762 - DNA, 14 bp, Homo sapiens
aagcagagttttca

SEQ ID NO: 2341763 - DNA, 17 bp, Homo sapiens
aagcaggaggcccttgt

SEQ ID NO: 2341764 - DNA, 20 bp, Homo sapiens
aagcagtatattagtattat

SEQ ID NO: 2341765 - DNA, 12 bp, Homo sapiens
aagcagtatttt

SEQ ID NO: 2341766 - DNA, 19 bp, Homo sapiens
aagcatcagttctacggat

SEQ ID NO: 2341767 - DNA, 13 bp, Homo sapiens
aagcatgaaaaag

SEQ ID NO: 2341768 - DNA, 18 bp, Homo sapiens
aagcatggtgtcagtttt

SEQ ID NO: 2341769 - DNA, 22 bp, Homo sapiens
aagcattccttctttgataatg

SEQ ID NO: 2341770 - DNA, 23 bp, Homo sapiens
aagcattccttctttgataatgt

SEQ ID NO: 2341771 - DNA, 16 bp, Homo sapiens
aagcatttcatgaaaa

SEQ ID NO: 2341772 - DNA, 17 bp, Homo sapiens
aagcattttgaaacaaa

SEQ ID NO: 2341773 - DNA, 13 bp, Homo sapiens
aagccaaagaaaa

SEQ ID NO: 2341774 - DNA, 18 bp, Homo sapiens
aagccaacaactctgcct

SEQ ID NO: 2341775 - DNA, 23 bp, Homo sapiens
aagccaacaactctgcctttatg

SEQ ID NO: 2341776 - DNA, 16 bp, Homo sapiens
aagccaagggaaaggg

SEQ ID NO: 2341777 - DNA, 21 bp, Homo sapiens
aagccaatatttactcatcag

SEQ ID NO: 2341778 - DNA, 19 bp, Homo sapiens
aagccaatctacaatctct

SEQ ID NO: 2341779 - DNA, 21 bp, Homo sapiens
aagccacaggaaggaggggag

SEQ ID NO: 2341780 - DNA, 22 bp, Homo sapiens
aagccagctgccctatgggcct

SEQ ID NO: 2341781 - DNA, 14 bp, Homo sapiens
aagccagctttccc

SEQ ID NO: 2341782 - DNA, 22 bp, Homo sapiens
aagccaggcctggctggaggag

SEQ ID NO: 2341783 - DNA, 19 bp, Homo sapiens
aagcccagcccctactgct

SEQ ID NO: 2341784 - DNA, 22 bp, Homo sapiens
aagcccagcccctactgctgtg

SEQ ID NO: 2341785 - DNA, 14 bp, Homo sapiens
aagcccctgggccc

SEQ ID NO: 2341786 - DNA, 17 bp, Homo sapiens
aagccgagagccttttg

SEQ ID NO: 2341787 - DNA, 13 bp, Homo sapiens
aagcctccacagc

SEQ ID NO: 2341788 - DNA, 15 bp, Homo sapiens
aagcctctctctccc

SEQ ID NO: 2341789 - DNA, 19 bp, Homo sapiens
aagcctctctctccctccc

SEQ ID NO: 2341790 - DNA, 23 bp, Homo sapiens
aagcctctctctccctccctctc

SEQ ID NO: 2341791 - DNA, 22 bp, Homo sapiens
aagcctgcacaataaaaatgtt

SEQ ID NO: 2341792 - DNA, 17 bp, Homo sapiens
aagcctgggattgacag

SEQ ID NO: 2341793 - DNA, 15 bp, Homo sapiens
aagccttcagctcca

SEQ ID NO: 2341794 - DNA, 21 bp, Homo sapiens
aagcgaaggaacctctcgcca

SEQ ID NO: 2341795 - DNA, 22 bp, Homo sapiens
aagcggtggataactagccaga

SEQ ID NO: 2341796 - DNA, 12 bp, Homo sapiens
aagctagtgttt

SEQ ID NO: 2341797 - DNA, 15 bp, Homo sapiens
aagctagtgtttcta

SEQ ID NO: 2341798 - DNA, 16 bp, Homo sapiens
aagctattagccagga

SEQ ID NO: 2341799 - DNA, 21 bp, Homo sapiens
aagctattagccaggatcatg

SEQ ID NO: 2341800 - DNA, 20 bp, Homo sapiens
aagctatttaagtggactgt

SEQ ID NO: 2341801 - DNA, 23 bp, Homo sapiens
aagctcacttctgggcttcatct

SEQ ID NO: 2341802 - DNA, 15 bp, Homo sapiens
aagctctgaagaact

SEQ ID NO: 2341803 - DNA, 15 bp, Homo sapiens
aagctgcaaatctga

SEQ ID NO: 2341804 - DNA, 17 bp, Homo sapiens
aagctgcagagatttct

SEQ ID NO: 2341805 - DNA, 15 bp, Homo sapiens
aagctgcctggtata

SEQ ID NO: 2341806 - DNA, 21 bp, Homo sapiens
aagctgtgtctgcccaatgaa

SEQ ID NO: 2341807 - DNA, 14 bp, Homo sapiens
aagctgttgtacat

SEQ ID NO: 2341808 - DNA, 14 bp, Homo sapiens
aagcttcttgctga

SEQ ID NO: 2341809 - DNA, 16 bp, Homo sapiens
aagcttggttctgtga

SEQ ID NO: 2341810 - DNA, 13 bp, Homo sapiens
aagctttaaatta

SEQ ID NO: 2341811 - DNA, 17 bp, Homo sapiens
aagctttaaattatgtg

SEQ ID NO: 2341812 - DNA, 21 bp, Homo sapiens
aagctttcatgtcccagaact

SEQ ID NO: 2341813 - DNA, 20 bp, Homo sapiens
aagctttgactctataagca

SEQ ID NO: 2341814 - DNA, 23 bp, Homo sapiens
aagcttttgcttgatccagaaga

SEQ ID NO: 2341815 - DNA, 23 bp, Homo sapiens
aagctttttattcctcctgctca

SEQ ID NO: 2341816 - DNA, 12 bp, Homo sapiens
aagctttttgga

SEQ ID NO: 2341817 - DNA, 13 bp, Homo sapiens
aagctttttggaa

SEQ ID NO: 2341818 - DNA, 20 bp, Homo sapiens
aaggaaaaacacaagcaaaa

SEQ ID NO: 2341819 - DNA, 17 bp, Homo sapiens
aaggaaaatatttcatt

SEQ ID NO: 2341820 - DNA, 16 bp, Homo sapiens
aaggaaacattttatc

SEQ ID NO: 2341821 - DNA, 12 bp, Homo sapiens
aaggaaactctt

SEQ ID NO: 2341822 - DNA, 16 bp, Homo sapiens
aaggaaactcttatct

SEQ ID NO: 2341823 - DNA, 23 bp, Homo sapiens
aaggaagcgaaggatatattatg

SEQ ID NO: 2341824 - DNA, 14 bp, Homo sapiens
aaggaatttgatga

SEQ ID NO: 2341825 - DNA, 13 bp, Homo sapiens
aaggagatttctt

SEQ ID NO: 2341826 - DNA, 14 bp, Homo sapiens
aaggagctttctca

SEQ ID NO: 2341827 - DNA, 17 bp, Homo sapiens
aaggaggcccactgtgt

SEQ ID NO: 2341828 - DNA, 21 bp, Homo sapiens
aaggaggccctgttccctgga

SEQ ID NO: 2341829 - DNA, 15 bp, Homo sapiens
aaggagtgtaaaatg

SEQ ID NO: 2341830 - DNA, 19 bp, Homo sapiens
aaggataaatcataaagtc

SEQ ID NO: 2341831 - DNA, 14 bp, Homo sapiens
aaggatagtaagca

SEQ ID NO: 2341832 - DNA, 15 bp, Homo sapiens
aaggatagtaagcat

SEQ ID NO: 2341833 - DNA, 21 bp, Homo sapiens
aaggatcggactctgcccctg

SEQ ID NO: 2341834 - DNA, 16 bp, Homo sapiens
aaggatctgctgaggc

SEQ ID NO: 2341835 - DNA, 20 bp, Homo sapiens
aaggatctgctgaggcccag

SEQ ID NO: 2341836 - DNA, 13 bp, Homo sapiens
aaggcaagagggg

SEQ ID NO: 2341837 - DNA, 22 bp, Homo sapiens
aaggcagagaaatctaagctgt

SEQ ID NO: 2341838 - DNA, 19 bp, Homo sapiens
aaggcaggaagggaagcgt

SEQ ID NO: 2341839 - DNA, 23 bp, Homo sapiens
aaggcagtagaactccaggccct

SEQ ID NO: 2341840 - DNA, 17 bp, Homo sapiens
aaggcatttattgccat

SEQ ID NO: 2341841 - DNA, 18 bp, Homo sapiens
aaggccaaaatcaagagt

SEQ ID NO: 2341842 - DNA, 22 bp, Homo sapiens
aaggccagtccccatttctgcc

SEQ ID NO: 2341843 - DNA, 20 bp, Homo sapiens
aaggcctcttgtaaagactg

SEQ ID NO: 2341844 - DNA, 12 bp, Homo sapiens
aaggcctttctt

SEQ ID NO: 2341845 - DNA, 22 bp, Homo sapiens
aaggctgagacagtgaatttgg

SEQ ID NO: 2341846 - DNA, 17 bp, Homo sapiens
aaggctgccagacatgg

SEQ ID NO: 2341847 - DNA, 13 bp, Homo sapiens
aaggctggcaggt

SEQ ID NO: 2341848 - DNA, 15 bp, Homo sapiens
aaggcttctctccac

SEQ ID NO: 2341849 - DNA, 14 bp, Homo sapiens
aaggcttgaagctg

SEQ ID NO: 2341850 - DNA, 21 bp, Homo sapiens
aaggctttgccatgggcctgc

SEQ ID NO: 2341851 - DNA, 12 bp, Homo sapiens
aagggatatttt

SEQ ID NO: 2341852 - DNA, 23 bp, Homo sapiens
aagggcaagaaatggcgtctgct

SEQ ID NO: 2341853 - DNA, 14 bp, Homo sapiens
aagggcataaagta

SEQ ID NO: 2341854 - DNA, 11 bp, Homo sapiens
aaggggacagc

SEQ ID NO: 2341855 - DNA, 12 bp, Homo sapiens
aaggggagagcc

SEQ ID NO: 2341856 - DNA, 22 bp, Homo sapiens
aaggggatctaaaaaaatgttt

SEQ ID NO: 2341857 - DNA, 14 bp, Homo sapiens
aagggggtctctgt

SEQ ID NO: 2341858 - DNA, 19 bp, Homo sapiens
aaggggtgcacccacctgt

SEQ ID NO: 2341859 - DNA, 17 bp, Homo sapiens
aaggggtgcttttatag

SEQ ID NO: 2341860 - DNA, 18 bp, Homo sapiens
aaggggttcctcaaattt

SEQ ID NO: 2341861 - DNA, 15 bp, Homo sapiens
aagggttgagagcca

SEQ ID NO: 2341862 - DNA, 16 bp, Homo sapiens
aagggttttcttttct

SEQ ID NO: 2341863 - DNA, 20 bp, Homo sapiens
aaggtagcattctttggagt

SEQ ID NO: 2341864 - DNA, 16 bp, Homo sapiens
aaggtattatacatgt

SEQ ID NO: 2341865 - DNA, 13 bp, Homo sapiens
aaggtcttcttgt

SEQ ID NO: 2341866 - DNA, 14 bp, Homo sapiens
aaggtgagaaatca

SEQ ID NO: 2341867 - DNA, 19 bp, Homo sapiens
aaggtgataagggaaaaga

SEQ ID NO: 2341868 - DNA, 14 bp, Homo sapiens
aaggtgcctcagtt

SEQ ID NO: 2341869 - DNA, 19 bp, Homo sapiens
aaggtgcctcagttttcct

SEQ ID NO: 2341870 - DNA, 20 bp, Homo sapiens
aaggtgcctcagttttcctt

SEQ ID NO: 2341871 - DNA, 17 bp, Homo sapiens
aaggtgggccttgctac

SEQ ID NO: 2341872 - DNA, 15 bp, Homo sapiens
aaggttataattttt

SEQ ID NO: 2341873 - DNA, 17 bp, Homo sapiens
aaggttgaataatatat

SEQ ID NO: 2341874 - DNA, 14 bp, Homo sapiens
aaggttggatggat

SEQ ID NO: 2341875 - DNA, 19 bp, Homo sapiens
aaggtttaaagtttgaaga

SEQ ID NO: 2341876 - DNA, 13 bp, Homo sapiens
aaggtttttagca

SEQ ID NO: 2341877 - DNA, 15 bp, Homo sapiens
aagtaaatgtagctc

SEQ ID NO: 2341878 - DNA, 18 bp, Homo sapiens
aagtaacttttaaaattt

SEQ ID NO: 2341879 - DNA, 19 bp, Homo sapiens
aagtaacttttaaaatttg

SEQ ID NO: 2341880 - DNA, 21 bp, Homo sapiens
aagtaacttttaaaatttgtc

SEQ ID NO: 2341881 - DNA, 13 bp, Homo sapiens
aagtaagaagaca

SEQ ID NO: 2341882 - DNA, 15 bp, Homo sapiens
aagtaatattattac

SEQ ID NO: 2341883 - DNA, 17 bp, Homo sapiens
aagtacaaatgaagaaa

SEQ ID NO: 2341884 - DNA, 14 bp, Homo sapiens
aagtacagaatttg

SEQ ID NO: 2341885 - DNA, 19 bp, Homo sapiens
aagtacagcggctcccctc

SEQ ID NO: 2341886 - DNA, 18 bp, Homo sapiens
aagtagattcatgaaaat

SEQ ID NO: 2341887 - DNA, 21 bp, Homo sapiens
aagtaggtggcttgagctaga

SEQ ID NO: 2341888 - DNA, 12 bp, Homo sapiens
aagtatattaaa

SEQ ID NO: 2341889 - DNA, 15 bp, Homo sapiens
aagtatcctgcgacc

SEQ ID NO: 2341890 - DNA, 18 bp, Homo sapiens
aagtatgcattattaaat

SEQ ID NO: 2341891 - DNA, 22 bp, Homo sapiens
aagtatgcattattaaattgta

SEQ ID NO: 2341892 - DNA, 19 bp, Homo sapiens
aagtatgtatattaaaaaa

SEQ ID NO: 2341893 - DNA, 13 bp, Homo sapiens
aagtattttcttt

SEQ ID NO: 2341894 - DNA, 15 bp, Homo sapiens
aagtattttgctgga

SEQ ID NO: 2341895 - DNA, 19 bp, Homo sapiens
aagtcaacactcttcttga

SEQ ID NO: 2341896 - DNA, 21 bp, Homo sapiens
aagtcacacattacaaagtta

SEQ ID NO: 2341897 - DNA, 13 bp, Homo sapiens
aagtcagaagttt

SEQ ID NO: 2341898 - DNA, 18 bp, Homo sapiens
aagtcagaatcagaagat

SEQ ID NO: 2341899 - DNA, 22 bp, Homo sapiens
aagtcagctccagctttctgcc

SEQ ID NO: 2341900 - DNA, 22 bp, Homo sapiens
aagtcagttgctcaaaaagaaa

SEQ ID NO: 2341901 - DNA, 19 bp, Homo sapiens
aagtccaagcaacagcctt

SEQ ID NO: 2341902 - DNA, 19 bp, Homo sapiens
aagtccattttttaaaaat

SEQ ID NO: 2341903 - DNA, 13 bp, Homo sapiens
aagtccctggaaa

SEQ ID NO: 2341904 - DNA, 23 bp, Homo sapiens
aagtcctggcacagtttttgtaa

SEQ ID NO: 2341905 - DNA, 18 bp, Homo sapiens
aagtcgggtcaaaaataa

SEQ ID NO: 2341906 - DNA, 21 bp, Homo sapiens
aagtcgggtcaaaaataaaat

SEQ ID NO: 2341907 - DNA, 22 bp, Homo sapiens
aagtctgctctcatataagaca

SEQ ID NO: 2341908 - DNA, 20 bp, Homo sapiens
aagtctggaaaaaaacaaaa

SEQ ID NO: 2341909 - DNA, 17 bp, Homo sapiens
aagtctggctttgctct

SEQ ID NO: 2341910 - DNA, 13 bp, Homo sapiens
aagtgaaattaag

SEQ ID NO: 2341911 - DNA, 17 bp, Homo sapiens
aagtgaatctgattgca

SEQ ID NO: 2341912 - DNA, 18 bp, Homo sapiens
aagtgacaaataagatta

SEQ ID NO: 2341913 - DNA, 12 bp, Homo sapiens
aagtgacttatt

SEQ ID NO: 2341914 - DNA, 12 bp, Homo sapiens
aagtgagcagaa

SEQ ID NO: 2341915 - DNA, 18 bp, Homo sapiens
aagtgcagtcagcagatg

SEQ ID NO: 2341916 - DNA, 15 bp, Homo sapiens
aagtgccagggctgg

SEQ ID NO: 2341917 - DNA, 21 bp, Homo sapiens
aagtgcgtgtgtagagttaag

SEQ ID NO: 2341918 - DNA, 23 bp, Homo sapiens
aagtgcgtgtgtagagttaagaa

SEQ ID NO: 2341919 - DNA, 13 bp, Homo sapiens
aagtggtctctgc

SEQ ID NO: 2341920 - DNA, 14 bp, Homo sapiens
aagtggtctctgct

SEQ ID NO: 2341921 - DNA, 15 bp, Homo sapiens
aagtgtaaaaaatgt

SEQ ID NO: 2341922 - DNA, 13 bp, Homo sapiens
aagtgtagctcaa

SEQ ID NO: 2341923 - DNA, 19 bp, Homo sapiens
aagtgtctcaaaggagctt

SEQ ID NO: 2341924 - DNA, 18 bp, Homo sapiens
aagtgttcactgctcctt

SEQ ID NO: 2341925 - DNA, 17 bp, Homo sapiens
aagtgttctgtggctga

SEQ ID NO: 2341926 - DNA, 19 bp, Homo sapiens
aagtgtttatgttgtttat

SEQ ID NO: 2341927 - DNA, 13 bp, Homo sapiens
aagttaaaattgt

SEQ ID NO: 2341928 - DNA, 19 bp, Homo sapiens
aagttacacagaaatgctg

SEQ ID NO: 2341929 - DNA, 13 bp, Homo sapiens
aagttatctttga

SEQ ID NO: 2341930 - DNA, 15 bp, Homo sapiens
aagttatctttgaat

SEQ ID NO: 2341931 - DNA, 21 bp, Homo sapiens
aagttattttctacagtggtt

SEQ ID NO: 2341932 - DNA, 23 bp, Homo sapiens
aagttcaaattcttctgaactca

SEQ ID NO: 2341933 - DNA, 23 bp, Homo sapiens
aagttcagcccaccatctgtttg

SEQ ID NO: 2341934 - DNA, 19 bp, Homo sapiens
aagttcttatgaggagggg

SEQ ID NO: 2341935 - DNA, 11 bp, Homo sapiens
aagttggaagg

SEQ ID NO: 2341936 - DNA, 13 bp, Homo sapiens
aagttggaaggat

SEQ ID NO: 2341937 - DNA, 21 bp, Homo sapiens
aagttgggttaataccagctt

SEQ ID NO: 2341938 - DNA, 15 bp, Homo sapiens
aagttgtgatctgtt

SEQ ID NO: 2341939 - DNA, 17 bp, Homo sapiens
aagttgtgatctgttgt

SEQ ID NO: 2341940 - DNA, 22 bp, Homo sapiens
aagttgttctagtaacaataca

SEQ ID NO: 2341941 - DNA, 13 bp, Homo sapiens
aagtttagctctg

SEQ ID NO: 2341942 - DNA, 15 bp, Homo sapiens
aagtttagctctgag

SEQ ID NO: 2341943 - DNA, 19 bp, Homo sapiens
aagtttcaagttttaaagt

SEQ ID NO: 2341944 - DNA, 16 bp, Homo sapiens
aagtttcagagtatat

SEQ ID NO: 2341945 - DNA, 16 bp, Homo sapiens
aagtttcaggtgacat

SEQ ID NO: 2341946 - DNA, 17 bp, Homo sapiens
aagtttcaggtgacatg

SEQ ID NO: 2341947 - DNA, 13 bp, Homo sapiens
aagttttaaagtt

SEQ ID NO: 2341948 - DNA, 13 bp, Homo sapiens
aagttttatatgc

SEQ ID NO: 2341949 - DNA, 13 bp, Homo sapiens
aagttttgtaaaa

SEQ ID NO: 2341950 - DNA, 12 bp, Homo sapiens
aagttttgttgt

SEQ ID NO: 2341951 - DNA, 17 bp, Homo sapiens
aataaaaagatcacttt

SEQ ID NO: 2341952 - DNA, 23 bp, Homo sapiens
aataaaactgtttgacttctcaa

SEQ ID NO: 2341953 - DNA, 12 bp, Homo sapiens
aataaaagaaca

SEQ ID NO: 2341954 - DNA, 19 bp, Homo sapiens
aataaaatatcataaagca

SEQ ID NO: 2341955 - DNA, 15 bp, Homo sapiens
aataaaattcctatc

SEQ ID NO: 2341956 - DNA, 13 bp, Homo sapiens
aataaaatttaaa

SEQ ID NO: 2341957 - DNA, 18 bp, Homo sapiens
aataaaccaaaggaaaat

SEQ ID NO: 2341958 - DNA, 14 bp, Homo sapiens
aataaaccattttt

SEQ ID NO: 2341959 - DNA, 20 bp, Homo sapiens
aataaagaagtatggtaatc

SEQ ID NO: 2341960 - DNA, 16 bp, Homo sapiens
aataaagtattttctt

SEQ ID NO: 2341961 - DNA, 12 bp, Homo sapiens
aataaataattt

SEQ ID NO: 2341962 - DNA, 16 bp, Homo sapiens
aataaataattttcat

SEQ ID NO: 2341963 - DNA, 14 bp, Homo sapiens
aataaatatttatg

SEQ ID NO: 2341964 - DNA, 22 bp, Homo sapiens
aataaatgaaacttggccagtt

SEQ ID NO: 2341965 - DNA, 15 bp, Homo sapiens
aataaatgccctctt

SEQ ID NO: 2341966 - DNA, 11 bp, Homo sapiens
aataaatgtgt

SEQ ID NO: 2341967 - DNA, 13 bp, Homo sapiens
aataaattttcta

SEQ ID NO: 2341968 - DNA, 16 bp, Homo sapiens
aataaattttctaaaa

SEQ ID NO: 2341969 - DNA, 18 bp, Homo sapiens
aataacaaggagatttct

SEQ ID NO: 2341970 - DNA, 13 bp, Homo sapiens
aataacaatgtta

SEQ ID NO: 2341971 - DNA, 15 bp, Homo sapiens
aataacaatgttaag

SEQ ID NO: 2341972 - DNA, 13 bp, Homo sapiens
aataacagctgca

SEQ ID NO: 2341973 - DNA, 20 bp, Homo sapiens
aataacattaccttactgtg

SEQ ID NO: 2341974 - DNA, 16 bp, Homo sapiens
aataactgaatttgga

SEQ ID NO: 2341975 - DNA, 15 bp, Homo sapiens
aataactgtgtactg

SEQ ID NO: 2341976 - DNA, 23 bp, Homo sapiens
aataacttagactctagtattta

SEQ ID NO: 2341977 - DNA, 18 bp, Homo sapiens
aataagagaatgttccta

SEQ ID NO: 2341978 - DNA, 14 bp, Homo sapiens
aataagtaaatgta

SEQ ID NO: 2341979 - DNA, 20 bp, Homo sapiens
aataagtgacaaataagatt

SEQ ID NO: 2341980 - DNA, 16 bp, Homo sapiens
acaaatctcagaacct

SEQ ID NO: 2341981 - DNA, 15 bp, Homo sapiens
acaaatgaagaaagt

SEQ ID NO: 2341982 - DNA, 14 bp, Homo sapiens
acaacaatccttct

SEQ ID NO: 2341983 - DNA, 18 bp, Homo sapiens
acaacaattggtaaaact

SEQ ID NO: 2341984 - DNA, 23 bp, Homo sapiens
acaacacggagcagggagagctc

SEQ ID NO: 2341985 - DNA, 18 bp, Homo sapiens
acaaccattaaagtcaga

SEQ ID NO: 2341986 - DNA, 13 bp, Homo sapiens
acaacctttctgt

SEQ ID NO: 2341987 - DNA, 13 bp, Homo sapiens
acaactgcctggg

SEQ ID NO: 2341988 - DNA, 20 bp, Homo sapiens
acaacttagctcaggtgcct

SEQ ID NO: 2341989 - DNA, 19 bp, Homo sapiens
acaacttcccattaaaaat

SEQ ID NO: 2341990 - DNA, 12 bp, Homo sapiens
acaactttcact

SEQ ID NO: 2341991 - DNA, 20 bp, Homo sapiens
acaagccaaaagtccctccc

SEQ ID NO: 2341992 - DNA, 22 bp, Homo sapiens
acaagccaaaagtccctccctg

SEQ ID NO: 2341993 - DNA, 16 bp, Homo sapiens
acaagctgcactgtga

SEQ ID NO: 2341994 - DNA, 16 bp, Homo sapiens
acaagcttcagtaagt

SEQ ID NO: 2341995 - DNA, 19 bp, Homo sapiens
acaagcttcagtaagttat

SEQ ID NO: 2341996 - DNA, 9 bp, Homo sapiens
acaaggact

SEQ ID NO: 2341997 - DNA, 20 bp, Homo sapiens
acaagggaagatttatgttt

SEQ ID NO: 2341998 - DNA, 21 bp, Homo sapiens
acaaggtacccctttctggct

SEQ ID NO: 2341999 - DNA, 15 bp, Homo sapiens
acaaggtgctaacat

SEQ ID NO: 2342000 - DNA, 15 bp, Homo sapiens
acaagtaatattatt

SEQ ID NO: 2342001 - DNA, 14 bp, Homo sapiens
acaagtatgaatct

SEQ ID NO: 2342002 - DNA, 22 bp, Homo sapiens
acaagtcagctccagctttctg

SEQ ID NO: 2342003 - DNA, 15 bp, Homo sapiens
acaagtctataatgt

SEQ ID NO: 2342004 - DNA, 19 bp, Homo sapiens
acaagtggtgtttattgca

SEQ ID NO: 2342005 - DNA, 16 bp, Homo sapiens
acaataaaaatgttta

SEQ ID NO: 2342006 - DNA, 14 bp, Homo sapiens
acaataaaacaaat

SEQ ID NO: 2342007 - DNA, 16 bp, Homo sapiens
acaataaaacaaataa

SEQ ID NO: 2342008 - DNA, 18 bp, Homo sapiens
acaataataaatcctcag

SEQ ID NO: 2342009 - DNA, 22 bp, Homo sapiens
acaataggagtggtgatttgaa

SEQ ID NO: 2342010 - DNA, 23 bp, Homo sapiens
acaataggagtggtgatttgaaa

SEQ ID NO: 2342011 - DNA, 20 bp, Homo sapiens
acaatagtatacattttata

SEQ ID NO: 2342012 - DNA, 15 bp, Homo sapiens
acaatagtatagaag

SEQ ID NO: 2342013 - DNA, 19 bp, Homo sapiens
acaatagtatagaagtctg

SEQ ID NO: 2342014 - DNA, 17 bp, Homo sapiens
acaatattccagatctt

SEQ ID NO: 2342015 - DNA, 18 bp, Homo sapiens
acaatattgattgggaaa

SEQ ID NO: 2342016 - DNA, 17 bp, Homo sapiens
acaatctatggcttatt

SEQ ID NO: 2342017 - DNA, 20 bp, Homo sapiens
acaatctatggcttatttct

SEQ ID NO: 2342018 - DNA, 22 bp, Homo sapiens
acaatctatggcttatttctat

SEQ ID NO: 2342019 - DNA, 15 bp, Homo sapiens
acaatggccatggaa

SEQ ID NO: 2342020 - DNA, 19 bp, Homo sapiens
acaatgttaaggaaactct

SEQ ID NO: 2342021 - DNA, 13 bp, Homo sapiens
acaattgggagct

SEQ ID NO: 2342022 - DNA, 22 bp, Homo sapiens
acaattggtaaaactcactgtg

SEQ ID NO: 2342023 - DNA, 21 bp, Homo sapiens
acaattgtcgaaaagagtctt

SEQ ID NO: 2342024 - DNA, 18 bp, Homo sapiens
acaatttatgaattgaat

SEQ ID NO: 2342025 - DNA, 20 bp, Homo sapiens
acaatttgcactaaatcaga

SEQ ID NO: 2342026 - DNA, 12 bp, Homo sapiens
acaattttaaga

SEQ ID NO: 2342027 - DNA, 14 bp, Homo sapiens
acacacacacacac

SEQ ID NO: 2342028 - DNA, 16 bp, Homo sapiens
acacacacacacgatg

SEQ ID NO: 2342029 - DNA, 22 bp, Homo sapiens
acacacacgatgcatttaataa

SEQ ID NO: 2342030 - DNA, 15 bp, Homo sapiens
acacacgatgcattt

SEQ ID NO: 2342031 - DNA, 18 bp, Homo sapiens
acacacgatgcatttaat

SEQ ID NO: 2342032 - DNA, 19 bp, Homo sapiens
acacacgatgcatttaata

SEQ ID NO: 2342033 - DNA, 21 bp, Homo sapiens
acacacgatgcatttaataaa

SEQ ID NO: 2342034 - DNA, 17 bp, Homo sapiens
acacagaatgctcaggg

SEQ ID NO: 2342035 - DNA, 21 bp, Homo sapiens
acacagacactaacgaaatat

SEQ ID NO: 2342036 - DNA, 14 bp, Homo sapiens
acacagacccagga

SEQ ID NO: 2342037 - DNA, 14 bp, Homo sapiens
acacagcagtgtga

SEQ ID NO: 2342038 - DNA, 13 bp, Homo sapiens
acacagtgtctgt

SEQ ID NO: 2342039 - DNA, 16 bp, Homo sapiens
acacagttcctgggaa

SEQ ID NO: 2342040 - DNA, 18 bp, Homo sapiens
acacagttcctgggaaca

SEQ ID NO: 2342041 - DNA, 21 bp, Homo sapiens
acacatagttctgtaataaaa

SEQ ID NO: 2342042 - DNA, 14 bp, Homo sapiens
acacattaaatgtg

SEQ ID NO: 2342043 - DNA, 23 bp, Homo sapiens
acacattaatgataaactcagat

SEQ ID NO: 2342044 - DNA, 14 bp, Homo sapiens
acacattacaaagt

SEQ ID NO: 2342045 - DNA, 18 bp, Homo sapiens
acacattgaaactgtatt

SEQ ID NO: 2342046 - DNA, 19 bp, Homo sapiens
acacattgaaactgtattt

SEQ ID NO: 2342047 - DNA, 20 bp, Homo sapiens
acacattggaatgccttgga

SEQ ID NO: 2342048 - DNA, 17 bp, Homo sapiens
acacatttgctactgtt

SEQ ID NO: 2342049 - DNA, 17 bp, Homo sapiens
acaccaccggccccctc

SEQ ID NO: 2342050 - DNA, 18 bp, Homo sapiens
acaccacttagatttaaa

SEQ ID NO: 2342051 - DNA, 18 bp, Homo sapiens
acaccactttcccacact

SEQ ID NO: 2342052 - DNA, 13 bp, Homo sapiens
acaccagagcaga

SEQ ID NO: 2342053 - DNA, 17 bp, Homo sapiens
acaccagagcagatgca

SEQ ID NO: 2342054 - DNA, 19 bp, Homo sapiens
acaccagagcagatgcaga

SEQ ID NO: 2342055 - DNA, 22 bp, Homo sapiens
acaccagagcagatgcagagag

SEQ ID NO: 2342056 - DNA, 20 bp, Homo sapiens
acaccattaccaaaataata

SEQ ID NO: 2342057 - DNA, 21 bp, Homo sapiens
acaccccccgccccccacctt

SEQ ID NO: 2342058 - DNA, 15 bp, Homo sapiens
acaccttttaactca

SEQ ID NO: 2342059 - DNA, 13 bp, Homo sapiens
acacgagcaaacc

SEQ ID NO: 2342060 - DNA, 20 bp, Homo sapiens
acacgagcaaacccagaggt

SEQ ID NO: 2342061 - DNA, 13 bp, Homo sapiens
acacgatgcattt

SEQ ID NO: 2342062 - DNA, 19 bp, Homo sapiens
acacgatgcatttaataaa

SEQ ID NO: 2342063 - DNA, 20 bp, Homo sapiens
acacgatgcatttaataaag

SEQ ID NO: 2342064 - DNA, 19 bp, Homo sapiens
acacggatctgctgggctc

SEQ ID NO: 2342065 - DNA, 13 bp, Homo sapiens
acacggcagctgt

SEQ ID NO: 2342066 - DNA, 13 bp, Homo sapiens
acacgttgccagg

SEQ ID NO: 2342067 - DNA, 17 bp, Homo sapiens
acactaacgaaatatca

SEQ ID NO: 2342068 - DNA, 21 bp, Homo sapiens
acactaacgaaatatcaaagt

SEQ ID NO: 2342069 - DNA, 18 bp, Homo sapiens
acactaccaaacactcag

SEQ ID NO: 2342070 - DNA, 13 bp, Homo sapiens
acactcttagcta

SEQ ID NO: 2342071 - DNA, 20 bp, Homo sapiens
acactcttcttgagcagacc

SEQ ID NO: 2342072 - DNA, 14 bp, Homo sapiens
acactgaaagtttt

SEQ ID NO: 2342073 - DNA, 15 bp, Homo sapiens
acactgatggctcaa

SEQ ID NO: 2342074 - DNA, 22 bp, Homo sapiens
acactgatggctcaagacaagg

SEQ ID NO: 2342075 - DNA, 16 bp, Homo sapiens
acactggacctttggg

SEQ ID NO: 2342076 - DNA, 16 bp, Homo sapiens
acactgggtgcgtctc

SEQ ID NO: 2342077 - DNA, 20 bp, Homo sapiens
acactgtcagtgctagattt

SEQ ID NO: 2342078 - DNA, 22 bp, Homo sapiens
acactgtgaactaatgacaagt

SEQ ID NO: 2342079 - DNA, 19 bp, Homo sapiens
acacttcttgaaacagcct

SEQ ID NO: 2342080 - DNA, 21 bp, Homo sapiens
acacttcttgaaacagcctgg

SEQ ID NO: 2342081 - DNA, 13 bp, Homo sapiens
acacttgaaacct

SEQ ID NO: 2342082 - DNA, 14 bp, Homo sapiens
acacttgaaacctt

SEQ ID NO: 2342083 - DNA, 23 bp, Homo sapiens
acactttgttgcaagatgtgaat

SEQ ID NO: 2342084 - DNA, 21 bp, Homo sapiens
acagaaaaatgaaatttaagc

SEQ ID NO: 2342085 - DNA, 15 bp, Homo sapiens
acagaaatgctgctg

SEQ ID NO: 2342086 - DNA, 20 bp, Homo sapiens
acagaaatgctgctggccaa

SEQ ID NO: 2342087 - DNA, 12 bp, Homo sapiens
acagaacagctt

SEQ ID NO: 2342088 - DNA, 14 bp, Homo sapiens
acagaacagcttca

SEQ ID NO: 2342089 - DNA, 14 bp, Homo sapiens
acagaagcacatgc

SEQ ID NO: 2342090 - DNA, 22 bp, Homo sapiens
acagaatatttttatatttcct

SEQ ID NO: 2342091 - DNA, 15 bp, Homo sapiens
acagaatcttctggg

SEQ ID NO: 2342092 - DNA, 19 bp, Homo sapiens
acagaatcttgttttgaaa

SEQ ID NO: 2342093 - DNA, 13 bp, Homo sapiens
acagaatgctcag

SEQ ID NO: 2342094 - DNA, 22 bp, Homo sapiens
acagaatgctcagggtcactga

SEQ ID NO: 2342095 - DNA, 12 bp, Homo sapiens
acagacccagga

SEQ ID NO: 2342096 - DNA, 13 bp, Homo sapiens
acagacccaggac

SEQ ID NO: 2342097 - DNA, 18 bp, Homo sapiens
acagaccgagaggccagt

SEQ ID NO: 2342098 - DNA, 21 bp, Homo sapiens
acagaccgagaggccagttga

SEQ ID NO: 2342099 - DNA, 16 bp, Homo sapiens
acagactgttgagtta

SEQ ID NO: 2342100 - DNA, 18 bp, Homo sapiens
acagagaaattctgtggt

SEQ ID NO: 2342101 - DNA, 20 bp, Homo sapiens
acagagagagattccatctc

SEQ ID NO: 2342102 - DNA, 18 bp, Homo sapiens
acagagcaagtcctcact

SEQ ID NO: 2342103 - DNA, 20 bp, Homo sapiens
acagagcctggccccaggcc

SEQ ID NO: 2342104 - DNA, 13 bp, Homo sapiens
acagagctctggg

SEQ ID NO: 2342105 - DNA, 24 bp, Homo sapiens
acagaggctgcacccctgggccag

SEQ ID NO: 2342106 - DNA, 19 bp, Homo sapiens
acagagtagccaggttctg

SEQ ID NO: 2342107 - DNA, 14 bp, Homo sapiens
acagagtgaaaaat

SEQ ID NO: 2342108 - DNA, 21 bp, Homo sapiens
acagagtgaaaaatcttaagt

SEQ ID NO: 2342109 - DNA, 17 bp, Homo sapiens
acagagtgatttgtaaa

SEQ ID NO: 2342110 - DNA, 16 bp, Homo sapiens
acagataacataaata

SEQ ID NO: 2342111 - DNA, 17 bp, Homo sapiens
acagataacataaataa

SEQ ID NO: 2342112 - DNA, 15 bp, Homo sapiens
acagataagcaagag

SEQ ID NO: 2342113 - DNA, 18 bp, Homo sapiens
acagataagcaagagaga

SEQ ID NO: 2342114 - DNA, 19 bp, Homo sapiens
acagataagcaagagagat

SEQ ID NO: 2342115 - DNA, 14 bp, Homo sapiens
acagatattttatc

SEQ ID NO: 2342116 - DNA, 20 bp, Homo sapiens
acagatctcagggctcggga

SEQ ID NO: 2342117 - DNA, 19 bp, Homo sapiens
acagatgttcccccatctc

SEQ ID NO: 2342118 - DNA, 19 bp, Homo sapiens
acagattctttcagttctt

SEQ ID NO: 2342119 - DNA, 21 bp, Homo sapiens
acagattctttcagttctttg

SEQ ID NO: 2342120 - DNA, 19 bp, Homo sapiens
acagcaagtacagcggctc

SEQ ID NO: 2342121 - DNA, 17 bp, Homo sapiens
acagcacttacaatttt

SEQ ID NO: 2342122 - DNA, 12 bp, Homo sapiens
acagcagctcat

SEQ ID NO: 2342123 - DNA, 22 bp, Homo sapiens
acagcagcttataatgggctct

SEQ ID NO: 2342124 - DNA, 15 bp, Homo sapiens
acagccagaggaggg

SEQ ID NO: 2342125 - DNA, 17 bp, Homo sapiens
acagcccccactccagt

SEQ ID NO: 2342126 - DNA, 23 bp, Homo sapiens
acagcccctatagcactgagctc

SEQ ID NO: 2342127 - DNA, 19 bp, Homo sapiens
acagcctatagtaaatgtg

SEQ ID NO: 2342128 - DNA, 15 bp, Homo sapiens
acagcctttgaatgt

SEQ ID NO: 2342129 - DNA, 20 bp, Homo sapiens
acagcctttgaatgtaacca

SEQ ID NO: 2342130 - DNA, 14 bp, Homo sapiens
acagcgagggcagc

SEQ ID NO: 2342131 - DNA, 16 bp, Homo sapiens
acagcgagggcagctg

SEQ ID NO: 2342132 - DNA, 17 bp, Homo sapiens
acagctacaaactttta

SEQ ID NO: 2342133 - DNA, 16 bp, Homo sapiens
acagctaccaccctta

SEQ ID NO: 2342134 - DNA, 20 bp, Homo sapiens
acagctattggcaagtttta

SEQ ID NO: 2342135 - DNA, 22 bp, Homo sapiens
acagctattggcaagttttaaa

SEQ ID NO: 2342136 - DNA, 19 bp, Homo sapiens
acagctcaggaggcgccct

SEQ ID NO: 2342137 - DNA, 13 bp, Homo sapiens
acagctgcactga

SEQ ID NO: 2342138 - DNA, 22 bp, Homo sapiens
acagctgctgttctcaggacag

SEQ ID NO: 2342139 - DNA, 19 bp, Homo sapiens
acagctggagaaatggcat

SEQ ID NO: 2342140 - DNA, 21 bp, Homo sapiens
acagctggagaaatggcatca

SEQ ID NO: 2342141 - DNA, 20 bp, Homo sapiens
acagcttcaggttatcgaaa

SEQ ID NO: 2342142 - DNA, 21 bp, Homo sapiens
acagcttgagccgggcccctg

SEQ ID NO: 2342143 - DNA, 16 bp, Homo sapiens
acagctttctgggatg

SEQ ID NO: 2342144 - DNA, 19 bp, Homo sapiens
acagctttctgggatgtca

SEQ ID NO: 2342145 - DNA, 14 bp, Homo sapiens
acaggaaggagggg

SEQ ID NO: 2342146 - DNA, 17 bp, Homo sapiens
acaggaaggaggggaga

SEQ ID NO: 2342147 - DNA, 19 bp, Homo sapiens
acaggagggcggcctcctt

SEQ ID NO: 2342148 - DNA, 20 bp, Homo sapiens
acaggagggcggcctccttc

SEQ ID NO: 2342149 - DNA, 20 bp, Homo sapiens
acaggatgcccacatactgt

SEQ ID NO: 2342150 - DNA, 14 bp, Homo sapiens
acaggcaccgagaa

SEQ ID NO: 2342151 - DNA, 20 bp, Homo sapiens
acaggcaccgagaatgttgt

SEQ ID NO: 2342152 - DNA, 20 bp, Homo sapiens
acaggcagcctcctttgtgt

SEQ ID NO: 2342153 - DNA, 15 bp, Homo sapiens
acagggccacataga

SEQ ID NO: 2342154 - DNA, 16 bp, Homo sapiens
acagggctgccttctg

SEQ ID NO: 2342155 - DNA, 19 bp, Homo sapiens
acaggggttagcctggact

SEQ ID NO: 2342156 - DNA, 15 bp, Homo sapiens
acaggtaaaacaggg

SEQ ID NO: 2342157 - DNA, 16 bp, Homo sapiens
acaggtaaaacagggc

SEQ ID NO: 2342158 - DNA, 22 bp, Homo sapiens
acaggtaaaacagggccacata

SEQ ID NO: 2342159 - DNA, 15 bp, Homo sapiens
acaggtcatcagatg

SEQ ID NO: 2342160 - DNA, 21 bp, Homo sapiens
acaggtcatcagatgcctgct

SEQ ID NO: 2342161 - DNA, 14 bp, Homo sapiens
acaggtcttttcaa

SEQ ID NO: 2342162 - DNA, 19 bp, Homo sapiens
acaggttcttaaaaaggaa

SEQ ID NO: 2342163 - DNA, 21 bp, Homo sapiens
acaggttcttaaaaaggaaca

SEQ ID NO: 2342164 - DNA, 17 bp, Homo sapiens
acagtaaagaaagcaga

SEQ ID NO: 2342165 - DNA, 19 bp, Homo sapiens
acagtactggttactttca

SEQ ID NO: 2342166 - DNA, 21 bp, Homo sapiens
acagtactggttactttcaaa

SEQ ID NO: 2342167 - DNA, 13 bp, Homo sapiens
acagtagagccag

SEQ ID NO: 2342168 - DNA, 15 bp, Homo sapiens
acagtatcccacatc

SEQ ID NO: 2342169 - DNA, 15 bp, Homo sapiens
acagtatttaacatt

SEQ ID NO: 2342170 - DNA, 15 bp, Homo sapiens
acagtcacctcacaa

SEQ ID NO: 2342171 - DNA, 14 bp, Homo sapiens
acagtcactgctct

SEQ ID NO: 2342172 - DNA, 20 bp, Homo sapiens
acagtccaaccagaaacacc

SEQ ID NO: 2342173 - DNA, 14 bp, Homo sapiens
acagtccagaccca

SEQ ID NO: 2342174 - DNA, 16 bp, Homo sapiens
acagtgaagttttact

SEQ ID NO: 2342175 - DNA, 20 bp, Homo sapiens
acagtgcagagccttctcag

SEQ ID NO: 2342176 - DNA, 22 bp, Homo sapiens
acagtgcagagccttctcagaa

SEQ ID NO: 2342177 - DNA, 15 bp, Homo sapiens
acagtgcctcttcca

SEQ ID NO: 2342178 - DNA, 23 bp, Homo sapiens
acagtggttgttttttcattgtg

SEQ ID NO: 2342179 - DNA, 15 bp, Homo sapiens
acagtgtctgttcag

SEQ ID NO: 2342180 - DNA, 18 bp, Homo sapiens
acagtgtctgttcagcaa

SEQ ID NO: 2342181 - DNA, 21 bp, Homo sapiens
acagtgttgtgccccttcact

SEQ ID NO: 2342182 - DNA, 15 bp, Homo sapiens
acagttctcactggg

SEQ ID NO: 2342183 - DNA, 16 bp, Homo sapiens
acagttctcactggga

SEQ ID NO: 2342184 - DNA, 13 bp, Homo sapiens
acagttctttcct

SEQ ID NO: 2342185 - DNA, 17 bp, Homo sapiens
acagttctttcctcttt

SEQ ID NO: 2342186 - DNA, 21 bp, Homo sapiens
acagttctttcctctttctgc

SEQ ID NO: 2342187 - DNA, 13 bp, Homo sapiens
acagttgctgtga

SEQ ID NO: 2342188 - DNA, 23 bp, Homo sapiens
acagttgctgtgaactttcatgt

SEQ ID NO: 2342189 - DNA, 18 bp, Homo sapiens
acagtttaacagaaaaat

SEQ ID NO: 2342190 - DNA, 20 bp, Homo sapiens
acagtttaacagaaaaatga

SEQ ID NO: 2342191 - DNA, 14 bp, Homo sapiens
acagtttccaaatt

SEQ ID NO: 2342192 - DNA, 17 bp, Homo sapiens
acagtttcttagctttt

SEQ ID NO: 2342193 - DNA, 18 bp, Homo sapiens
acagtttcttagcttttt

SEQ ID NO: 2342194 - DNA, 22 bp, Homo sapiens
acagtttcttagctttttaatt

SEQ ID NO: 2342195 - DNA, 12 bp, Homo sapiens
acataaaggaaa

SEQ ID NO: 2342196 - DNA, 23 bp, Homo sapiens
acataacgtttttcctttaaaaa

SEQ ID NO: 2342197 - DNA, 17 bp, Homo sapiens
acataagcttccatttt

SEQ ID NO: 2342198 - DNA, 18 bp, Homo sapiens
acataagcttccatttta

SEQ ID NO: 2342199 - DNA, 13 bp, Homo sapiens
acataaggctgga

SEQ ID NO: 2342200 - DNA, 18 bp, Homo sapiens
acataagtaacttttaaa

SEQ ID NO: 2342201 - DNA, 23 bp, Homo sapiens
acataatcttctgccttctcatg

SEQ ID NO: 2342202 - DNA, 13 bp, Homo sapiens
acatacaagaaaa

SEQ ID NO: 2342203 - DNA, 14 bp, Homo sapiens
acatacaagaaaat

SEQ ID NO: 2342204 - DNA, 16 bp, Homo sapiens
acataccctgacctgg

SEQ ID NO: 2342205 - DNA, 10 bp, Homo sapiens
acatactgtc

SEQ ID NO: 2342206 - DNA, 20 bp, Homo sapiens
acatagctctgaagttaaaa

SEQ ID NO: 2342207 - DNA, 18 bp, Homo sapiens
acatagttctgtaataaa

SEQ ID NO: 2342208 - DNA, 15 bp, Homo sapiens
acatatgcaccttgt

SEQ ID NO: 2342209 - DNA, 16 bp, Homo sapiens
acatatgcaccttgtg

SEQ ID NO: 2342210 - DNA, 19 bp, Homo sapiens
acatatgctgatcttttaa

SEQ ID NO: 2342211 - DNA, 23 bp, Homo sapiens
acatatggactctgcacatgaat

SEQ ID NO: 2342212 - DNA, 20 bp, Homo sapiens
aatgttacttctgatacttt

SEQ ID NO: 2342213 - DNA, 23 bp, Homo sapiens
aatgttggtcattttatgttaag

SEQ ID NO: 2342214 - DNA, 18 bp, Homo sapiens
aatgtttatgagccagac

SEQ ID NO: 2342215 - DNA, 21 bp, Homo sapiens
aatgtttcttttgtttggtaa

SEQ ID NO: 2342216 - DNA, 15 bp, Homo sapiens
aatgtttggatggtt

SEQ ID NO: 2342217 - DNA, 21 bp, Homo sapiens
aatgtttttagaacatgtaaa

SEQ ID NO: 2342218 - DNA, 13 bp, Homo sapiens
aattaaaacaaat

SEQ ID NO: 2342219 - DNA, 16 bp, Homo sapiens
aattaaacttccaaag

SEQ ID NO: 2342220 - DNA, 15 bp, Homo sapiens
aattaagaaaactat

SEQ ID NO: 2342221 - DNA, 15 bp, Homo sapiens
aattaagcaaatgtt

SEQ ID NO: 2342222 - DNA, 18 bp, Homo sapiens
aattaagcaaatgttaaa

SEQ ID NO: 2342223 - DNA, 23 bp, Homo sapiens
aattaagcaaatgttaaaagttt

SEQ ID NO: 2342224 - DNA, 21 bp, Homo sapiens
aattaagcattttgaaacaaa

SEQ ID NO: 2342225 - DNA, 17 bp, Homo sapiens
aattacctttaatttta

SEQ ID NO: 2342226 - DNA, 17 bp, Homo sapiens
aattacctttacatata

SEQ ID NO: 2342227 - DNA, 20 bp, Homo sapiens
aattacctttacatatatag

SEQ ID NO: 2342228 - DNA, 14 bp, Homo sapiens
aattacgtgctctg

SEQ ID NO: 2342229 - DNA, 14 bp, Homo sapiens
aattactttggtag

SEQ ID NO: 2342230 - DNA, 17 bp, Homo sapiens
aattagataaattgtag

SEQ ID NO: 2342231 - DNA, 23 bp, Homo sapiens
aattagataaattgtagggcttt

SEQ ID NO: 2342232 - DNA, 13 bp, Homo sapiens
aattagtaacatt

SEQ ID NO: 2342233 - DNA, 18 bp, Homo sapiens
aattagtggtcataaaat

SEQ ID NO: 2342234 - DNA, 19 bp, Homo sapiens
aattagtggtcataaaata

SEQ ID NO: 2342235 - DNA, 13 bp, Homo sapiens
aattatcagcaaa

SEQ ID NO: 2342236 - DNA, 13 bp, Homo sapiens
aattatcattgtt

SEQ ID NO: 2342237 - DNA, 21 bp, Homo sapiens
aattatgaagctcatatcctt

SEQ ID NO: 2342238 - DNA, 22 bp, Homo sapiens
aattatgagctatcctttcaaa

SEQ ID NO: 2342239 - DNA, 13 bp, Homo sapiens
aattattgacact

SEQ ID NO: 2342240 - DNA, 15 bp, Homo sapiens
aattattgacactga

SEQ ID NO: 2342241 - DNA, 16 bp, Homo sapiens
aattattgacactgaa

SEQ ID NO: 2342242 - DNA, 21 bp, Homo sapiens
aattattgcactagagaaaat

SEQ ID NO: 2342243 - DNA, 23 bp, Homo sapiens
aattcaaaaagaactaaatatgc

SEQ ID NO: 2342244 - DNA, 22 bp, Homo sapiens
aattcaaaagtattgaaagcca

SEQ ID NO: 2342245 - DNA, 22 bp, Homo sapiens
aattcaactttgtaaaaatctt

SEQ ID NO: 2342246 - DNA, 21 bp, Homo sapiens
aattcaatgccgcaacatata

SEQ ID NO: 2342247 - DNA, 17 bp, Homo sapiens
aattccatacttctctc

SEQ ID NO: 2342248 - DNA, 21 bp, Homo sapiens
aattcctggcatgacactcta

SEQ ID NO: 2342249 - DNA, 23 bp, Homo sapiens
aattctagtgtccataaataaag

SEQ ID NO: 2342250 - DNA, 18 bp, Homo sapiens
aattcttctgaactcaaa

SEQ ID NO: 2342251 - DNA, 23 bp, Homo sapiens
aattcttctgaactcaaactgag

SEQ ID NO: 2342252 - DNA, 13 bp, Homo sapiens
aattcttttctga

SEQ ID NO: 2342253 - DNA, 17 bp, Homo sapiens
aattgccagcaaataaa

SEQ ID NO: 2342254 - DNA, 14 bp, Homo sapiens
aattggccatgtcg

SEQ ID NO: 2342255 - DNA, 16 bp, Homo sapiens
aattggggaggagggg

SEQ ID NO: 2342256 - DNA, 15 bp, Homo sapiens
aattggtaaaaacag

SEQ ID NO: 2342257 - DNA, 17 bp, Homo sapiens
aattggtaaaaacagca

SEQ ID NO: 2342258 - DNA, 20 bp, Homo sapiens
aattggtaaaactcactgtg

SEQ ID NO: 2342259 - DNA, 21 bp, Homo sapiens
aattggtaaaactcactgtga

SEQ ID NO: 2342260 - DNA, 10 bp, Homo sapiens
aattgtaagt

SEQ ID NO: 2342261 - DNA, 12 bp, Homo sapiens
aattgtacaaaa

SEQ ID NO: 2342262 - DNA, 13 bp, Homo sapiens
aattgtacaaaat

SEQ ID NO: 2342263 - DNA, 19 bp, Homo sapiens
aattgtacaaaattaagca

SEQ ID NO: 2342264 - DNA, 18 bp, Homo sapiens
aattgtaggggtgtgtgt

SEQ ID NO: 2342265 - DNA, 19 bp, Homo sapiens
aattgtctttggtgctttt

SEQ ID NO: 2342266 - DNA, 19 bp, Homo sapiens
aattgtggctatcctgatt

SEQ ID NO: 2342267 - DNA, 17 bp, Homo sapiens
aattgttgtttctttct

SEQ ID NO: 2342268 - DNA, 16 bp, Homo sapiens
aatttaaatgaaagaa

SEQ ID NO: 2342269 - DNA, 18 bp, Homo sapiens
aatttaaatgaaagaaaa

SEQ ID NO: 2342270 - DNA, 19 bp, Homo sapiens
aatttaaatgaaagaaaat

SEQ ID NO: 2342271 - DNA, 19 bp, Homo sapiens
aatttaacaccctttagaa

SEQ ID NO: 2342272 - DNA, 14 bp, Homo sapiens
aatttaagcacaaa

SEQ ID NO: 2342273 - DNA, 16 bp, Homo sapiens
aatttaagtgcgtgtg

SEQ ID NO: 2342274 - DNA, 20 bp, Homo sapiens
aatttacacatcttaaaagt

SEQ ID NO: 2342275 - DNA, 15 bp, Homo sapiens
aatttacttgttttg

SEQ ID NO: 2342276 - DNA, 16 bp, Homo sapiens
aatttacttgttttgg

SEQ ID NO: 2342277 - DNA, 21 bp, Homo sapiens
aatttagtggatggaatatca

SEQ ID NO: 2342278 - DNA, 23 bp, Homo sapiens
aatttatatcaggtgtataaatg

SEQ ID NO: 2342279 - DNA, 21 bp, Homo sapiens
aatttcaaaatacatttgtaa

SEQ ID NO: 2342280 - DNA, 23 bp, Homo sapiens
aatttcaaaatacatttgtaagt

SEQ ID NO: 2342281 - DNA, 22 bp, Homo sapiens
aatttcactactagattgacta

SEQ ID NO: 2342282 - DNA, 16 bp, Homo sapiens
aatttcagggtgcagc

SEQ ID NO: 2342283 - DNA, 16 bp, Homo sapiens
aatttcattcaattta

SEQ ID NO: 2342284 - DNA, 18 bp, Homo sapiens
aatttcattcaatttaag

SEQ ID NO: 2342285 - DNA, 15 bp, Homo sapiens
aatttctattaatat

SEQ ID NO: 2342286 - DNA, 14 bp, Homo sapiens
aatttctcctccct

SEQ ID NO: 2342287 - DNA, 16 bp, Homo sapiens
aatttgaatgtatttg

SEQ ID NO: 2342288 - DNA, 18 bp, Homo sapiens
aatttggagcacaaaatt

SEQ ID NO: 2342289 - DNA, 19 bp, Homo sapiens
aatttgtaagtttcaggtg

SEQ ID NO: 2342290 - DNA, 20 bp, Homo sapiens
aatttgtcttaaaaatttat

SEQ ID NO: 2342291 - DNA, 17 bp, Homo sapiens
aatttgtgtgtttttag

SEQ ID NO: 2342292 - DNA, 21 bp, Homo sapiens
aatttgtgtgtttttagctgt

SEQ ID NO: 2342293 - DNA, 23 bp, Homo sapiens
aatttgtgtgtttttagctgtga

SEQ ID NO: 2342294 - DNA, 13 bp, Homo sapiens
aattttaaagtat

SEQ ID NO: 2342295 - DNA, 13 bp, Homo sapiens
aattttaaagtgc

SEQ ID NO: 2342296 - DNA, 17 bp, Homo sapiens
aattttaaagtgcaaaa

SEQ ID NO: 2342297 - DNA, 19 bp, Homo sapiens
aattttaacctatgatatt

SEQ ID NO: 2342298 - DNA, 16 bp, Homo sapiens
aattttaatgctgttt

SEQ ID NO: 2342299 - DNA, 18 bp, Homo sapiens
aattttaatgctgtttct

SEQ ID NO: 2342300 - DNA, 19 bp, Homo sapiens
aattttaatgctgtttcta

SEQ ID NO: 2342301 - DNA, 20 bp, Homo sapiens
aattttaatgctgtttctaa

SEQ ID NO: 2342302 - DNA, 21 bp, Homo sapiens
aattttaatgctgtttctaag

SEQ ID NO: 2342303 - DNA, 19 bp, Homo sapiens
aattttattttaaaatttc

SEQ ID NO: 2342304 - DNA, 22 bp, Homo sapiens
aattttcaactgtcttcctcaa

SEQ ID NO: 2342305 - DNA, 17 bp, Homo sapiens
aattttgagtattccat

SEQ ID NO: 2342306 - DNA, 13 bp, Homo sapiens
aattttgtaagaa

SEQ ID NO: 2342307 - DNA, 16 bp, Homo sapiens
aattttgtatgttaaa

SEQ ID NO: 2342308 - DNA, 20 bp, Homo sapiens
aatttttatgtaattatata

SEQ ID NO: 2342309 - DNA, 20 bp, Homo sapiens
aatttttttccttacctttt

SEQ ID NO: 2342310 - DNA, 14 bp, Homo sapiens
acaaaaaaaaattt

SEQ ID NO: 2342311 - DNA, 19 bp, Homo sapiens
acaaaaacagaatttgaga

SEQ ID NO: 2342312 - DNA, 16 bp, Homo sapiens
acaaaaagatgtctca

SEQ ID NO: 2342313 - DNA, 13 bp, Homo sapiens
acaaaagagcagt

SEQ ID NO: 2342314 - DNA, 16 bp, Homo sapiens
acaaaatatttcccat

SEQ ID NO: 2342315 - DNA, 20 bp, Homo sapiens
acaaaattaagcaaatgtta

SEQ ID NO: 2342316 - DNA, 21 bp, Homo sapiens
acaaaatttgagaatacataa

SEQ ID NO: 2342317 - DNA, 16 bp, Homo sapiens
acaaactctcaccatg

SEQ ID NO: 2342318 - DNA, 22 bp, Homo sapiens
acaaacttggacaacacggagc

SEQ ID NO: 2342319 - DNA, 15 bp, Homo sapiens
acaaacttttaagat

SEQ ID NO: 2342320 - DNA, 17 bp, Homo sapiens
acaaagccttaagcaaa

SEQ ID NO: 2342321 - DNA, 18 bp, Homo sapiens
acaaagccttaagcaaat

SEQ ID NO: 2342322 - DNA, 15 bp, Homo sapiens
acaaagctatttaag

SEQ ID NO: 2342323 - DNA, 15 bp, Homo sapiens
acaaagggttttctt

SEQ ID NO: 2342324 - DNA, 19 bp, Homo sapiens
acaaaggtttaaagtttga

SEQ ID NO: 2342325 - DNA, 18 bp, Homo sapiens
acaaagttaaaattgtta

SEQ ID NO: 2342326 - DNA, 14 bp, Homo sapiens
acaaagtttcagag

SEQ ID NO: 2342327 - DNA, 23 bp, Homo sapiens
acaaataagttcccatttccttg

SEQ ID NO: 2342328 - DNA, 14 bp, Homo sapiens
acatcaaataagaa

SEQ ID NO: 2342329 - DNA, 12 bp, Homo sapiens
acatccatccct

SEQ ID NO: 2342330 - DNA, 20 bp, Homo sapiens
acatcctttcttttaatgat

SEQ ID NO: 2342331 - DNA, 24 bp, Homo sapiens
acatcttccatttccatgtcccct

SEQ ID NO: 2342332 - DNA, 12 bp, Homo sapiens
acatcttttcta

SEQ ID NO: 2342333 - DNA, 19 bp, Homo sapiens
acatgacagatattttatc

SEQ ID NO: 2342334 - DNA, 13 bp, Homo sapiens
acatgagaaagat

SEQ ID NO: 2342335 - DNA, 22 bp, Homo sapiens
acatgagtagataatttcaggg

SEQ ID NO: 2342336 - DNA, 19 bp, Homo sapiens
acatgatttagggaagcag

SEQ ID NO: 2342337 - DNA, 18 bp, Homo sapiens
acatgcaataaaatttaa

SEQ ID NO: 2342338 - DNA, 20 bp, Homo sapiens
acatgcataaactaaaaact

SEQ ID NO: 2342339 - DNA, 23 bp, Homo sapiens
acatgcatataatgaataaatca

SEQ ID NO: 2342340 - DNA, 17 bp, Homo sapiens
acatgcatttgaggtca

SEQ ID NO: 2342341 - DNA, 19 bp, Homo sapiens
acatgccacatcaaacctt

SEQ ID NO: 2342342 - DNA, 12 bp, Homo sapiens
acatgccccctg

SEQ ID NO: 2342343 - DNA, 16 bp, Homo sapiens
acatggcgccctgcct

SEQ ID NO: 2342344 - DNA, 14 bp, Homo sapiens
acatgggacctggc

SEQ ID NO: 2342345 - DNA, 12 bp, Homo sapiens
acatgggactgg

SEQ ID NO: 2342346 - DNA, 18 bp, Homo sapiens
acatggtgcctgagaggc

SEQ ID NO: 2342347 - DNA, 19 bp, Homo sapiens
acatggtgcctgagaggca

SEQ ID NO: 2342348 - DNA, 18 bp, Homo sapiens
acatgtctgttctacata

SEQ ID NO: 2342349 - DNA, 14 bp, Homo sapiens
acatgtcttgtaca

SEQ ID NO: 2342350 - DNA, 19 bp, Homo sapiens
acatgtcttgtacatgtgt

SEQ ID NO: 2342351 - DNA, 15 bp, Homo sapiens
acatgtgaaaccttt

SEQ ID NO: 2342352 - DNA, 20 bp, Homo sapiens
acatgtgaaaccttttttaa

SEQ ID NO: 2342353 - DNA, 21 bp, Homo sapiens
acatgtgaaaccttttttaag

SEQ ID NO: 2342354 - DNA, 21 bp, Homo sapiens
acatgtgacacatatgcacct

SEQ ID NO: 2342355 - DNA, 15 bp, Homo sapiens
acatgtgatacattt

SEQ ID NO: 2342356 - DNA, 17 bp, Homo sapiens
acatgtgatacattttt

SEQ ID NO: 2342357 - DNA, 12 bp, Homo sapiens
acatgttctcca

SEQ ID NO: 2342358 - DNA, 15 bp, Homo sapiens
acattaacaaataaa

SEQ ID NO: 2342359 - DNA, 18 bp, Homo sapiens
acattaacggtgctaaaa

SEQ ID NO: 2342360 - DNA, 14 bp, Homo sapiens
acattaaggaattt

SEQ ID NO: 2342361 - DNA, 15 bp, Homo sapiens
acattaagtggcttt

SEQ ID NO: 2342362 - DNA, 16 bp, Homo sapiens
acattaccttactgtg

SEQ ID NO: 2342363 - DNA, 18 bp, Homo sapiens
acattcacttccagagag

SEQ ID NO: 2342364 - DNA, 22 bp, Homo sapiens
acattcccttgatggtctcaag

SEQ ID NO: 2342365 - DNA, 13 bp, Homo sapiens
acattctcacata

SEQ ID NO: 2342366 - DNA, 18 bp, Homo sapiens
acattctcacataagccc

SEQ ID NO: 2342367 - DNA, 12 bp, Homo sapiens
acattgaagaat

SEQ ID NO: 2342368 - DNA, 23 bp, Homo sapiens
acattggagtctcatttgggcta

SEQ ID NO: 2342369 - DNA, 22 bp, Homo sapiens
acatttaccctttggccccact

SEQ ID NO: 2342370 - DNA, 17 bp, Homo sapiens
acatttagaaatgttta

SEQ ID NO: 2342371 - DNA, 16 bp, Homo sapiens
acatttagaagaaaga

SEQ ID NO: 2342372 - DNA, 14 bp, Homo sapiens
acatttatgattta

SEQ ID NO: 2342373 - DNA, 19 bp, Homo sapiens
acatttatgatttaataaa

SEQ ID NO: 2342374 - DNA, 21 bp, Homo sapiens
acatttctataaaaatactac

SEQ ID NO: 2342375 - DNA, 15 bp, Homo sapiens
acatttgaaataaag

SEQ ID NO: 2342376 - DNA, 22 bp, Homo sapiens
acatttgatggagggtggaaat

SEQ ID NO: 2342377 - DNA, 16 bp, Homo sapiens
acatttgtttgctgta

SEQ ID NO: 2342378 - DNA, 12 bp, Homo sapiens
acattttacagt

SEQ ID NO: 2342379 - DNA, 19 bp, Homo sapiens
acattttatcattaaaaat

SEQ ID NO: 2342380 - DNA, 22 bp, Homo sapiens
acattttatcattaaaaattac

SEQ ID NO: 2342381 - DNA, 13 bp, Homo sapiens
acattttattaag

SEQ ID NO: 2342382 - DNA, 12 bp, Homo sapiens
acattttctaaa

SEQ ID NO: 2342383 - DNA, 14 bp, Homo sapiens
acattttctaaata

SEQ ID NO: 2342384 - DNA, 14 bp, Homo sapiens
acattttttaagct

SEQ ID NO: 2342385 - DNA, 16 bp, Homo sapiens
acattttttatacatt

SEQ ID NO: 2342386 - DNA, 14 bp, Homo sapiens
accaaaactgctcc

SEQ ID NO: 2342387 - DNA, 18 bp, Homo sapiens
accaaagagggcttcctc

SEQ ID NO: 2342388 - DNA, 13 bp, Homo sapiens
accaaagctgccc

SEQ ID NO: 2342389 - DNA, 18 bp, Homo sapiens
accaaagctgcccactgt

SEQ ID NO: 2342390 - DNA, 18 bp, Homo sapiens
accaaatagtgtgaaata

SEQ ID NO: 2342391 - DNA, 18 bp, Homo sapiens
accaaatgtttattttct

SEQ ID NO: 2342392 - DNA, 15 bp, Homo sapiens
accaaattaaaaaaa

SEQ ID NO: 2342393 - DNA, 13 bp, Homo sapiens
accaacaatgtga

SEQ ID NO: 2342394 - DNA, 19 bp, Homo sapiens
accaagctataaaagccca

SEQ ID NO: 2342395 - DNA, 18 bp, Homo sapiens
accaagtgtgctaaaaat

SEQ ID NO: 2342396 - DNA, 22 bp, Homo sapiens
accaatcctactaataaaccag

SEQ ID NO: 2342397 - DNA, 18 bp, Homo sapiens
accacactgggtgcgtct

SEQ ID NO: 2342398 - DNA, 22 bp, Homo sapiens
accacactgggtgcgtctccag

SEQ ID NO: 2342399 - DNA, 14 bp, Homo sapiens
accacacttcttga

SEQ ID NO: 2342400 - DNA, 18 bp, Homo sapiens
accacacttcttgaaaca

SEQ ID NO: 2342401 - DNA, 17 bp, Homo sapiens
accacagggttcaaaat

SEQ ID NO: 2342402 - DNA, 23 bp, Homo sapiens
accacagggttcaaaatgtctgt

SEQ ID NO: 2342403 - DNA, 14 bp, Homo sapiens
accaccaaaaacaa

SEQ ID NO: 2342404 - DNA, 12 bp, Homo sapiens
accactaaaaaa

SEQ ID NO: 2342405 - DNA, 17 bp, Homo sapiens
accactcgtgcatccct

SEQ ID NO: 2342406 - DNA, 22 bp, Homo sapiens
accactcttctttaagccatag

SEQ ID NO: 2342407 - DNA, 14 bp, Homo sapiens
accactgtgccact

SEQ ID NO: 2342408 - DNA, 23 bp, Homo sapiens
accactgtgccactgacttgctg

SEQ ID NO: 2342409 - DNA, 16 bp, Homo sapiens
accagagggcatgctg

SEQ ID NO: 2342410 - DNA, 22 bp, Homo sapiens
accagagggtgtggctttccag

SEQ ID NO: 2342411 - DNA, 22 bp, Homo sapiens
accagataccttatcttacaat

SEQ ID NO: 2342412 - DNA, 15 bp, Homo sapiens
accagatctttctct

SEQ ID NO: 2342413 - DNA, 17 bp, Homo sapiens
accagatctttctcttc

SEQ ID NO: 2342414 - DNA, 20 bp, Homo sapiens
accagatctttctcttccct

SEQ ID NO: 2342415 - DNA, 21 bp, Homo sapiens
accagatctttctcttccctg

SEQ ID NO: 2342416 - DNA, 22 bp, Homo sapiens
accagatctttctcttccctga

SEQ ID NO: 2342417 - DNA, 14 bp, Homo sapiens
accagcaatttaga

SEQ ID NO: 2342418 - DNA, 13 bp, Homo sapiens
accagccaggcag

SEQ ID NO: 2342419 - DNA, 14 bp, Homo sapiens
accagccaggcaga

SEQ ID NO: 2342420 - DNA, 18 bp, Homo sapiens
accagccccactgccagc

SEQ ID NO: 2342421 - DNA, 22 bp, Homo sapiens
accagccccactgccagcagca

SEQ ID NO: 2342422 - DNA, 13 bp, Homo sapiens
accagccctgcag

SEQ ID NO: 2342423 - DNA, 18 bp, Homo sapiens
accagctgcgcttgcttt

SEQ ID NO: 2342424 - DNA, 17 bp, Homo sapiens
accagcttaaaggcagt

SEQ ID NO: 2342425 - DNA, 12 bp, Homo sapiens
accaggaccctg

SEQ ID NO: 2342426 - DNA, 22 bp, Homo sapiens
accaggactagggctggagtga

SEQ ID NO: 2342427 - DNA, 16 bp, Homo sapiens
accagggccctgggca

SEQ ID NO: 2342428 - DNA, 17 bp, Homo sapiens
accagggccctgggcag

SEQ ID NO: 2342429 - DNA, 22 bp, Homo sapiens
accaggtgggagcgttttgttg

SEQ ID NO: 2342430 - DNA, 14 bp, Homo sapiens
accataaattcaac

SEQ ID NO: 2342431 - DNA, 13 bp, Homo sapiens
accataatgagat

SEQ ID NO: 2342432 - DNA, 13 bp, Homo sapiens
accatatgaattg

SEQ ID NO: 2342433 - DNA, 14 bp, Homo sapiens
accatccaccttcc

SEQ ID NO: 2342434 - DNA, 23 bp, Homo sapiens
accatctgtttgaagattatatg

SEQ ID NO: 2342435 - DNA, 14 bp, Homo sapiens
accatgctggcggc

SEQ ID NO: 2342436 - DNA, 16 bp, Homo sapiens
accatggtgaagtgct

SEQ ID NO: 2342437 - DNA, 22 bp, Homo sapiens
accatgtggataactttacaga

SEQ ID NO: 2342438 - DNA, 15 bp, Homo sapiens
accattaaagtcaga

SEQ ID NO: 2342439 - DNA, 17 bp, Homo sapiens
accattcacaataaaag

SEQ ID NO: 2342440 - DNA, 22 bp, Homo sapiens
accattcactactcatgcgtga

SEQ ID NO: 2342441 - DNA, 12 bp, Homo sapiens
acccaaaatata

SEQ ID NO: 2342442 - DNA, 15 bp, Homo sapiens
acccaaaatatatac

SEQ ID NO: 2342443 - DNA, 22 bp, Homo sapiens
acccaaccctatctcctgacag

SEQ ID NO: 2342444 - DNA, 14 bp, Homo sapiens
acccaagtgcctca

SEQ ID NO: 2342445 - DNA, 14 bp, Homo sapiens
aatcccctaaaata

SEQ ID NO: 2342446 - DNA, 13 bp, Homo sapiens
aatccctttgcac

SEQ ID NO: 2342447 - DNA, 17 bp, Homo sapiens
aatcctactaataaacc

SEQ ID NO: 2342448 - DNA, 18 bp, Homo sapiens
aatcctactaataaacca

SEQ ID NO: 2342449 - DNA, 13 bp, Homo sapiens
aatcctcctgcct

SEQ ID NO: 2342450 - DNA, 21 bp, Homo sapiens
aatcctggagagggtattttt

SEQ ID NO: 2342451 - DNA, 16 bp, Homo sapiens
aatcctggcagcccag

SEQ ID NO: 2342452 - DNA, 20 bp, Homo sapiens
aatccttcaaaataaaaagt

SEQ ID NO: 2342453 - DNA, 24 bp, Homo sapiens
aatcgccaggactggtgaatataa

SEQ ID NO: 2342454 - DNA, 12 bp, Homo sapiens
aatcggactgcc

SEQ ID NO: 2342455 - DNA, 20 bp, Homo sapiens
aatcggactgccaaattctc

SEQ ID NO: 2342456 - DNA, 23 bp, Homo sapiens
aatcgtgtgccatggatctgatc

SEQ ID NO: 2342457 - DNA, 12 bp, Homo sapiens
aatctaaaatgt

SEQ ID NO: 2342458 - DNA, 14 bp, Homo sapiens
aatctaaaatgttt

SEQ ID NO: 2342459 - DNA, 20 bp, Homo sapiens
aatctacaatctctttttgt

SEQ ID NO: 2342460 - DNA, 14 bp, Homo sapiens
aatctcattatttc

SEQ ID NO: 2342461 - DNA, 15 bp, Homo sapiens
aatctcattatttca

SEQ ID NO: 2342462 - DNA, 18 bp, Homo sapiens
aatctcattatttcaaaa

SEQ ID NO: 2342463 - DNA, 18 bp, Homo sapiens
aatctcttcattattctc

SEQ ID NO: 2342464 - DNA, 21 bp, Homo sapiens
aatctcttcattattctctgc

SEQ ID NO: 2342465 - DNA, 17 bp, Homo sapiens
aatctgatggccttaat

SEQ ID NO: 2342466 - DNA, 11 bp, Homo sapiens
aatctgcaggg

SEQ ID NO: 2342467 - DNA, 18 bp, Homo sapiens
aatctgcagggagcaact

SEQ ID NO: 2342468 - DNA, 21 bp, Homo sapiens
aatctggatgcctcattatgt

SEQ ID NO: 2342469 - DNA, 15 bp, Homo sapiens
aatctgtaaactgtg

SEQ ID NO: 2342470 - DNA, 19 bp, Homo sapiens
aatctgtttttacgtatgt

SEQ ID NO: 2342471 - DNA, 16 bp, Homo sapiens
aatcttcaaagccttc

SEQ ID NO: 2342472 - DNA, 17 bp, Homo sapiens
aatcttgttttgaaaat

SEQ ID NO: 2342473 - DNA, 23 bp, Homo sapiens
aatctttacctgtatacagtgca

SEQ ID NO: 2342474 - DNA, 18 bp, Homo sapiens
aatctttgtaccaaaatt

SEQ ID NO: 2342475 - DNA, 23 bp, Homo sapiens
aatctttgtaccaaaattttaaa

SEQ ID NO: 2342476 - DNA, 17 bp, Homo sapiens
aatgaaaataaaacaca

SEQ ID NO: 2342477 - DNA, 14 bp, Homo sapiens
aatgaaatgcatat

SEQ ID NO: 2342478 - DNA, 12 bp, Homo sapiens
aatgaagaaagt

SEQ ID NO: 2342479 - DNA, 10 bp, Homo sapiens
aatgaataat

SEQ ID NO: 2342480 - DNA, 21 bp, Homo sapiens
aatgacattaaatgcaataat

SEQ ID NO: 2342481 - DNA, 23 bp, Homo sapiens
aatgacattaaatgcaataattt

SEQ ID NO: 2342482 - DNA, 15 bp, Homo sapiens
aatgaccattcaatt

SEQ ID NO: 2342483 - DNA, 14 bp, Homo sapiens
aatgacgtttacat

SEQ ID NO: 2342484 - DNA, 17 bp, Homo sapiens
aatgagatttcttattt

SEQ ID NO: 2342485 - DNA, 17 bp, Homo sapiens
aatgaggaaaattctta

SEQ ID NO: 2342486 - DNA, 19 bp, Homo sapiens
aatgaggaaaattcttaaa

SEQ ID NO: 2342487 - DNA, 18 bp, Homo sapiens
aatgagtaaaaactagaa

SEQ ID NO: 2342488 - DNA, 20 bp, Homo sapiens
aatgataaaataaataattt

SEQ ID NO: 2342489 - DNA, 22 bp, Homo sapiens
aatgataaactcagatctgatc

SEQ ID NO: 2342490 - DNA, 14 bp, Homo sapiens
aatgatagacatat

SEQ ID NO: 2342491 - DNA, 20 bp, Homo sapiens
aatgattaagggacatttct

SEQ ID NO: 2342492 - DNA, 21 bp, Homo sapiens
aatgattaagggacatttcta

SEQ ID NO: 2342493 - DNA, 14 bp, Homo sapiens
aatgatttacatag

SEQ ID NO: 2342494 - DNA, 13 bp, Homo sapiens
aatgcaataattt

SEQ ID NO: 2342495 - DNA, 19 bp, Homo sapiens
aatgcacatatagacacat

SEQ ID NO: 2342496 - DNA, 21 bp, Homo sapiens
aatgcaccacggcagctctcc

SEQ ID NO: 2342497 - DNA, 14 bp, Homo sapiens
aatgcatatttgca

SEQ ID NO: 2342498 - DNA, 18 bp, Homo sapiens
aatgcatatttgcaaagt

SEQ ID NO: 2342499 - DNA, 17 bp, Homo sapiens
aatgccatctatctagt

SEQ ID NO: 2342500 - DNA, 17 bp, Homo sapiens
aatgcccttcactgtca

SEQ ID NO: 2342501 - DNA, 13 bp, Homo sapiens
aatgcctttgaga

SEQ ID NO: 2342502 - DNA, 22 bp, Homo sapiens
aatgcctttgagacagtttctt

SEQ ID NO: 2342503 - DNA, 14 bp, Homo sapiens
aatgctaattttat

SEQ ID NO: 2342504 - DNA, 15 bp, Homo sapiens
aatgctacatgtgag

SEQ ID NO: 2342505 - DNA, 11 bp, Homo sapiens
aatgctatttg

SEQ ID NO: 2342506 - DNA, 16 bp, Homo sapiens
aatgctatttgtgtaa

SEQ ID NO: 2342507 - DNA, 13 bp, Homo sapiens
aatgctgtttcta

SEQ ID NO: 2342508 - DNA, 22 bp, Homo sapiens
aatgctgtttctaagaaaatgt

SEQ ID NO: 2342509 - DNA, 16 bp, Homo sapiens
aatgcttttagtgtgt

SEQ ID NO: 2342510 - DNA, 16 bp, Homo sapiens
aatgcttttctaatta

SEQ ID NO: 2342511 - DNA, 17 bp, Homo sapiens
aatgctttttagaaagc

SEQ ID NO: 2342512 - DNA, 19 bp, Homo sapiens
aatgctttttagaaagcat

SEQ ID NO: 2342513 - DNA, 22 bp, Homo sapiens
aatggaataaaaggcttgaagc

SEQ ID NO: 2342514 - DNA, 23 bp, Homo sapiens
aatggaatacagtcattccaaga

SEQ ID NO: 2342515 - DNA, 16 bp, Homo sapiens
aatggagaagctgcag

SEQ ID NO: 2342516 - DNA, 17 bp, Homo sapiens
aatggagaagctgcagg

SEQ ID NO: 2342517 - DNA, 16 bp, Homo sapiens
aatggattggattatt

SEQ ID NO: 2342518 - DNA, 23 bp, Homo sapiens
aatggattggattatttaataac

SEQ ID NO: 2342519 - DNA, 22 bp, Homo sapiens
aatggcatcattataagctatg

SEQ ID NO: 2342520 - DNA, 17 bp, Homo sapiens
aatggcatttagcacag

SEQ ID NO: 2342521 - DNA, 21 bp, Homo sapiens
aatggcatttagcacagtatt

SEQ ID NO: 2342522 - DNA, 10 bp, Homo sapiens
aatggccatg

SEQ ID NO: 2342523 - DNA, 17 bp, Homo sapiens
aatggccatgcaggagg

SEQ ID NO: 2342524 - DNA, 23 bp, Homo sapiens
aatggccatgcaggaggtggaga

SEQ ID NO: 2342525 - DNA, 14 bp, Homo sapiens
aatggccattttaa

SEQ ID NO: 2342526 - DNA, 16 bp, Homo sapiens
aatgggaagcagggaa

SEQ ID NO: 2342527 - DNA, 14 bp, Homo sapiens
aatgggacctgtgg

SEQ ID NO: 2342528 - DNA, 22 bp, Homo sapiens
aatgggatggtcggatctcaca

SEQ ID NO: 2342529 - DNA, 18 bp, Homo sapiens
aatgggtgtatataattt

SEQ ID NO: 2342530 - DNA, 20 bp, Homo sapiens
aatgggtgtatataatttta

SEQ ID NO: 2342531 - DNA, 18 bp, Homo sapiens
aatggtcccaattaagaa

SEQ ID NO: 2342532 - DNA, 15 bp, Homo sapiens
aatggtctggcaata

SEQ ID NO: 2342533 - DNA, 15 bp, Homo sapiens
aatggtctttgctcc

SEQ ID NO: 2342534 - DNA, 18 bp, Homo sapiens
aatggtctttgctccaga

SEQ ID NO: 2342535 - DNA, 22 bp, Homo sapiens
aatggtgtgaacccgggagcgg

SEQ ID NO: 2342536 - DNA, 15 bp, Homo sapiens
aatggttaaatttta

SEQ ID NO: 2342537 - DNA, 17 bp, Homo sapiens
aatggttgatgatactt

SEQ ID NO: 2342538 - DNA, 16 bp, Homo sapiens
aatgtaatagggaaaa

SEQ ID NO: 2342539 - DNA, 16 bp, Homo sapiens
aatgtaatttaaatga

SEQ ID NO: 2342540 - DNA, 22 bp, Homo sapiens
aatgtacatttccaaatgaact

SEQ ID NO: 2342541 - DNA, 19 bp, Homo sapiens
aatgtactgatttcagtaa

SEQ ID NO: 2342542 - DNA, 13 bp, Homo sapiens
aatgtataaatat

SEQ ID NO: 2342543 - DNA, 14 bp, Homo sapiens
aatgtataaatata

SEQ ID NO: 2342544 - DNA, 14 bp, Homo sapiens
aatgtatattttta

SEQ ID NO: 2342545 - DNA, 20 bp, Homo sapiens
aatgtatgcattcacattta

SEQ ID NO: 2342546 - DNA, 16 bp, Homo sapiens
aatgtattcctttaaa

SEQ ID NO: 2342547 - DNA, 22 bp, Homo sapiens
aatgtccaccatgaacttgata

SEQ ID NO: 2342548 - DNA, 22 bp, Homo sapiens
aatgtctcactttactttcaag

SEQ ID NO: 2342549 - DNA, 13 bp, Homo sapiens
aatgtctcctccc

SEQ ID NO: 2342550 - DNA, 21 bp, Homo sapiens
aatgtctgctggtatttctaa

SEQ ID NO: 2342551 - DNA, 22 bp, Homo sapiens
aatgtctgctggtatttctaat

SEQ ID NO: 2342552 - DNA, 16 bp, Homo sapiens
aatgtctgtaataata

SEQ ID NO: 2342553 - DNA, 17 bp, Homo sapiens
aatgtctgtaataatag

SEQ ID NO: 2342554 - DNA, 19 bp, Homo sapiens
aatgtctgtaataatagac

SEQ ID NO: 2342555 - DNA, 10 bp, Homo sapiens
aatgtctgtt

SEQ ID NO: 2342556 - DNA, 14 bp, Homo sapiens
aatgtcttcatgtt

SEQ ID NO: 2342557 - DNA, 19 bp, Homo sapiens
aatgtgacttggattcaat

SEQ ID NO: 2342558 - DNA, 22 bp, Homo sapiens
aatgtgagtagttactaaaatt

SEQ ID NO: 2342559 - DNA, 21 bp, Homo sapiens
aatgtgcataatgataaaata

SEQ ID NO: 2342560 - DNA, 21 bp, Homo sapiens
aatgtgtaagaacaactacct

SEQ ID NO: 2342561 - DNA, 16 bp, Homo sapiens
acccacatgtgacaca

SEQ ID NO: 2342562 - DNA, 13 bp, Homo sapiens
acccacctagaac

SEQ ID NO: 2342563 - DNA, 17 bp, Homo sapiens
acccacctgttttctga

SEQ ID NO: 2342564 - DNA, 18 bp, Homo sapiens
acccacctgttttctgaa

SEQ ID NO: 2342565 - DNA, 18 bp, Homo sapiens
acccactgtccgcctctg

SEQ ID NO: 2342566 - DNA, 15 bp, Homo sapiens
acccagacataaagg

SEQ ID NO: 2342567 - DNA, 17 bp, Homo sapiens
acccagacataaaggaa

SEQ ID NO: 2342568 - DNA, 16 bp, Homo sapiens
acccagggactctcca

SEQ ID NO: 2342569 - DNA, 20 bp, Homo sapiens
acccagggctccctcctgga

SEQ ID NO: 2342570 - DNA, 24 bp, Homo sapiens
acccataataagagaatgttccta

SEQ ID NO: 2342571 - DNA, 15 bp, Homo sapiens
acccatcttccccgg

SEQ ID NO: 2342572 - DNA, 22 bp, Homo sapiens
acccattaaggggaagaatgaa

SEQ ID NO: 2342573 - DNA, 23 bp, Homo sapiens
acccattgttgtcaaggaagaag

SEQ ID NO: 2342574 - DNA, 23 bp, Homo sapiens
acccatttaaatttttttcctta

SEQ ID NO: 2342575 - DNA, 17 bp, Homo sapiens
acccatttttccttttg

SEQ ID NO: 2342576 - DNA, 15 bp, Homo sapiens
accccaacctgctct

SEQ ID NO: 2342577 - DNA, 20 bp, Homo sapiens
accccaacctgctctcctct

SEQ ID NO: 2342578 - DNA, 16 bp, Homo sapiens
accccaagagaactcg

SEQ ID NO: 2342579 - DNA, 19 bp, Homo sapiens
accccaccatatgaattgt

SEQ ID NO: 2342580 - DNA, 14 bp, Homo sapiens
accccactcccaca

SEQ ID NO: 2342581 - DNA, 23 bp, Homo sapiens
accccagcattctcaggcaccag

SEQ ID NO: 2342582 - DNA, 12 bp, Homo sapiens
accccattcctg

SEQ ID NO: 2342583 - DNA, 15 bp, Homo sapiens
acccccgaggggagg

SEQ ID NO: 2342584 - DNA, 16 bp, Homo sapiens
acccccgaggggaggg

SEQ ID NO: 2342585 - DNA, 17 bp, Homo sapiens
acccccgaggggagggc

SEQ ID NO: 2342586 - DNA, 22 bp, Homo sapiens
accccctcttctgagcacagat

SEQ ID NO: 2342587 - DNA, 14 bp, Homo sapiens
accccctgccctgc

SEQ ID NO: 2342588 - DNA, 16 bp, Homo sapiens
accccggggaccctgt

SEQ ID NO: 2342589 - DNA, 18 bp, Homo sapiens
accccggggaccctgtga

SEQ ID NO: 2342590 - DNA, 14 bp, Homo sapiens
acccctaagagact

SEQ ID NO: 2342591 - DNA, 20 bp, Homo sapiens
acccctgcccccagccccgg

SEQ ID NO: 2342592 - DNA, 18 bp, Homo sapiens
acccctgtgctcccctgc

SEQ ID NO: 2342593 - DNA, 13 bp, Homo sapiens
accccttccagat

SEQ ID NO: 2342594 - DNA, 15 bp, Homo sapiens
accccttccagatca

SEQ ID NO: 2342595 - DNA, 21 bp, Homo sapiens
accccttccagatcactgcca

SEQ ID NO: 2342596 - DNA, 15 bp, Homo sapiens
accccttctctcctc

SEQ ID NO: 2342597 - DNA, 20 bp, Homo sapiens
accccttggaaatgtctgct

SEQ ID NO: 2342598 - DNA, 21 bp, Homo sapiens
accccttggaaatgtctgctg

SEQ ID NO: 2342599 - DNA, 22 bp, Homo sapiens
accccttggaaatgtctgctgg

SEQ ID NO: 2342600 - DNA, 13 bp, Homo sapiens
acccctttcccac

SEQ ID NO: 2342601 - DNA, 16 bp, Homo sapiens
accctacataaggctg

SEQ ID NO: 2342602 - DNA, 14 bp, Homo sapiens
accctatctcctga

SEQ ID NO: 2342603 - DNA, 18 bp, Homo sapiens
accctatctcctgacaga

SEQ ID NO: 2342604 - DNA, 21 bp, Homo sapiens
accctattctatccatctcct

SEQ ID NO: 2342605 - DNA, 17 bp, Homo sapiens
accctcaaaccctgtgg

SEQ ID NO: 2342606 - DNA, 11 bp, Homo sapiens
accctccaaat

SEQ ID NO: 2342607 - DNA, 22 bp, Homo sapiens
accctccaaatggagaagctgc

SEQ ID NO: 2342608 - DNA, 19 bp, Homo sapiens
accctcccagaaacatctc

SEQ ID NO: 2342609 - DNA, 14 bp, Homo sapiens
accctcctccactc

SEQ ID NO: 2342610 - DNA, 18 bp, Homo sapiens
accctctccatctcccaa

SEQ ID NO: 2342611 - DNA, 19 bp, Homo sapiens
accctctccatctcccaag

SEQ ID NO: 2342612 - DNA, 22 bp, Homo sapiens
accctcttgcccatcctgactg

SEQ ID NO: 2342613 - DNA, 20 bp, Homo sapiens
accctctttgctgcagagaa

SEQ ID NO: 2342614 - DNA, 20 bp, Homo sapiens
accctgacctggccccctca

SEQ ID NO: 2342615 - DNA, 18 bp, Homo sapiens
accctgaggccctgggct

SEQ ID NO: 2342616 - DNA, 15 bp, Homo sapiens
accctgattcttgat

SEQ ID NO: 2342617 - DNA, 19 bp, Homo sapiens
accctgccacagccagagg

SEQ ID NO: 2342618 - DNA, 15 bp, Homo sapiens
accctgcgggccagg

SEQ ID NO: 2342619 - DNA, 21 bp, Homo sapiens
accctgcgggccagggtcctg

SEQ ID NO: 2342620 - DNA, 15 bp, Homo sapiens
accctggcccctctc

SEQ ID NO: 2342621 - DNA, 16 bp, Homo sapiens
accctggcccctctcc

SEQ ID NO: 2342622 - DNA, 19 bp, Homo sapiens
accctggcccctctccctt

SEQ ID NO: 2342623 - DNA, 22 bp, Homo sapiens
accctggggcctgactgctcag

SEQ ID NO: 2342624 - DNA, 19 bp, Homo sapiens
accctgggtgggctctgtg

SEQ ID NO: 2342625 - DNA, 15 bp, Homo sapiens
accctgtctgtccct

SEQ ID NO: 2342626 - DNA, 21 bp, Homo sapiens
accctgtgacatggtgcctga

SEQ ID NO: 2342627 - DNA, 13 bp, Homo sapiens
accctgttcctgc

SEQ ID NO: 2342628 - DNA, 15 bp, Homo sapiens
accctgttcctgctg

SEQ ID NO: 2342629 - DNA, 18 bp, Homo sapiens
accctgttcctgctgctg

SEQ ID NO: 2342630 - DNA, 15 bp, Homo sapiens
acccttcatcttcct

SEQ ID NO: 2342631 - DNA, 18 bp, Homo sapiens
acccttctggaaactgtg

SEQ ID NO: 2342632 - DNA, 13 bp, Homo sapiens
accctttgggggt

SEQ ID NO: 2342633 - DNA, 12 bp, Homo sapiens
accctttggttt

SEQ ID NO: 2342634 - DNA, 23 bp, Homo sapiens
accctttgtgtgctctccattct

SEQ ID NO: 2342635 - DNA, 15 bp, Homo sapiens
accgcccctggccgc

SEQ ID NO: 2342636 - DNA, 13 bp, Homo sapiens
accgctggccctt

SEQ ID NO: 2342637 - DNA, 23 bp, Homo sapiens
accggcggaccccagccatccag

SEQ ID NO: 2342638 - DNA, 16 bp, Homo sapiens
accgtgaaccagaggg

SEQ ID NO: 2342639 - DNA, 20 bp, Homo sapiens
accgtgatttggaagagagg

SEQ ID NO: 2342640 - DNA, 23 bp, Homo sapiens
accgtgatttggaagagaggcac

SEQ ID NO: 2342641 - DNA, 16 bp, Homo sapiens
accgtgcctggccaga

SEQ ID NO: 2342642 - DNA, 20 bp, Homo sapiens
accgtggtatgtctgccatg

SEQ ID NO: 2342643 - DNA, 19 bp, Homo sapiens
accgtgtcaagctgctctg

SEQ ID NO: 2342644 - DNA, 21 bp, Homo sapiens
acctaaagcctaccctattct

SEQ ID NO: 2342645 - DNA, 20 bp, Homo sapiens
acctaatcaccatgtaagca

SEQ ID NO: 2342646 - DNA, 20 bp, Homo sapiens
acctactttgactttttgca

SEQ ID NO: 2342647 - DNA, 20 bp, Homo sapiens
acctagagacttcacccggg

SEQ ID NO: 2342648 - DNA, 14 bp, Homo sapiens
acctagcaggctgt

SEQ ID NO: 2342649 - DNA, 16 bp, Homo sapiens
acctattatcccagct

SEQ ID NO: 2342650 - DNA, 20 bp, Homo sapiens
acctatttttgacatggaaa

SEQ ID NO: 2342651 - DNA, 16 bp, Homo sapiens
acctcaactgcctact

SEQ ID NO: 2342652 - DNA, 22 bp, Homo sapiens
acctcaactgcctactccaaaa

SEQ ID NO: 2342653 - DNA, 13 bp, Homo sapiens
acctcaagccatc

SEQ ID NO: 2342654 - DNA, 10 bp, Homo sapiens
acctcaaggg

SEQ ID NO: 2342655 - DNA, 19 bp, Homo sapiens
acctcaccttcctgtgggt

SEQ ID NO: 2342656 - DNA, 16 bp, Homo sapiens
acctcagggctcccag

SEQ ID NO: 2342657 - DNA, 12 bp, Homo sapiens
acctcagggctg

SEQ ID NO: 2342658 - DNA, 18 bp, Homo sapiens
acctcagttcattgtggt

SEQ ID NO: 2342659 - DNA, 19 bp, Homo sapiens
acctcataaaaatctagca

SEQ ID NO: 2342660 - DNA, 17 bp, Homo sapiens
acctcatgcccagctct

SEQ ID NO: 2342661 - DNA, 22 bp, Homo sapiens
acctcatgcccagctctctgac

SEQ ID NO: 2342662 - DNA, 18 bp, Homo sapiens
acctccacccactgtccg

SEQ ID NO: 2342663 - DNA, 19 bp, Homo sapiens
acctccaggctccagcaca

SEQ ID NO: 2342664 - DNA, 16 bp, Homo sapiens
acctcccacactccca

SEQ ID NO: 2342665 - DNA, 21 bp, Homo sapiens
acctcctatccttggagagca

SEQ ID NO: 2342666 - DNA, 17 bp, Homo sapiens
acctcctgacacccttc

SEQ ID NO: 2342667 - DNA, 18 bp, Homo sapiens
acctcggtgaccactctt

SEQ ID NO: 2342668 - DNA, 22 bp, Homo sapiens
acctctcaagctagtgtttcta

SEQ ID NO: 2342669 - DNA, 18 bp, Homo sapiens
acctctgggttgggatca

SEQ ID NO: 2342670 - DNA, 11 bp, Homo sapiens
acctctgtgtg

SEQ ID NO: 2342671 - DNA, 15 bp, Homo sapiens
acctctgtgtgctcc

SEQ ID NO: 2342672 - DNA, 15 bp, Homo sapiens
acctctttttcctcc

SEQ ID NO: 2342673 - DNA, 19 bp, Homo sapiens
acctctttttcctcctgga

SEQ ID NO: 2342674 - DNA, 14 bp, Homo sapiens
acctgaaagccctt

SEQ ID NO: 2342675 - DNA, 22 bp, Homo sapiens
acctgaaagcccttctcaagac

SEQ ID NO: 2342676 - DNA, 15 bp, Homo sapiens
acctgaagggttgac

SEQ ID NO: 2342677 - DNA, 16 bp, Homo sapiens
actttgatctctgctt

SEQ ID NO: 2342678 - DNA, 18 bp, Homo sapiens
actttgatctctgcttac

SEQ ID NO: 2342679 - DNA, 22 bp, Homo sapiens
actttggtagctgggaaagcat

SEQ ID NO: 2342680 - DNA, 19 bp, Homo sapiens
actttgtgttcatttcatt

SEQ ID NO: 2342681 - DNA, 17 bp, Homo sapiens
acttttataaagcatgt

SEQ ID NO: 2342682 - DNA, 11 bp, Homo sapiens
acttttctggg

SEQ ID NO: 2342683 - DNA, 18 bp, Homo sapiens
acttttgtactgaatttt

SEQ ID NO: 2342684 - DNA, 18 bp, Homo sapiens
actttttaaatgtaaaga

SEQ ID NO: 2342685 - DNA, 22 bp, Homo sapiens
agaaaaaaaaaagaaatgcaaa

SEQ ID NO: 2342686 - DNA, 16 bp, Homo sapiens
agaaaaaaagggagaa

SEQ ID NO: 2342687 - DNA, 18 bp, Homo sapiens
agaaaaagcaagtgttca

SEQ ID NO: 2342688 - DNA, 16 bp, Homo sapiens
agaaaaataaatggaa

SEQ ID NO: 2342689 - DNA, 14 bp, Homo sapiens
agaaaaatctcatt

SEQ ID NO: 2342690 - DNA, 18 bp, Homo sapiens
agaaaacacccaatacct

SEQ ID NO: 2342691 - DNA, 18 bp, Homo sapiens
agaaaagaaatggtatgt

SEQ ID NO: 2342692 - DNA, 14 bp, Homo sapiens
agaaaagacatttt

SEQ ID NO: 2342693 - DNA, 13 bp, Homo sapiens
agaaaatcactta

SEQ ID NO: 2342694 - DNA, 21 bp, Homo sapiens
agaaaatgaaatgcatatttg

SEQ ID NO: 2342695 - DNA, 11 bp, Homo sapiens
agaaaatgtga

SEQ ID NO: 2342696 - DNA, 21 bp, Homo sapiens
agaaacacccctctgtctagg

SEQ ID NO: 2342697 - DNA, 16 bp, Homo sapiens
agaaacactgaaaaga

SEQ ID NO: 2342698 - DNA, 22 bp, Homo sapiens
agaaacatctctggcccagaaa

SEQ ID NO: 2342699 - DNA, 21 bp, Homo sapiens
agaaaccctcattgtgtttct

SEQ ID NO: 2342700 - DNA, 15 bp, Homo sapiens
agaaactgaatgaat

SEQ ID NO: 2342701 - DNA, 18 bp, Homo sapiens
agaaacttaagcaaaggg

SEQ ID NO: 2342702 - DNA, 14 bp, Homo sapiens
agaaacttggatgt

SEQ ID NO: 2342703 - DNA, 17 bp, Homo sapiens
agaaagcattttgggat

SEQ ID NO: 2342704 - DNA, 14 bp, Homo sapiens
agaaagcctctctc

SEQ ID NO: 2342705 - DNA, 15 bp, Homo sapiens
agaaagcctctctct

SEQ ID NO: 2342706 - DNA, 18 bp, Homo sapiens
agaaagcctctctctccc

SEQ ID NO: 2342707 - DNA, 13 bp, Homo sapiens
agaaagctgcctg

SEQ ID NO: 2342708 - DNA, 22 bp, Homo sapiens
agaaagtaaggtgcttggagtt

SEQ ID NO: 2342709 - DNA, 18 bp, Homo sapiens
agaaagtcaaaaaattat

SEQ ID NO: 2342710 - DNA, 19 bp, Homo sapiens
agaaagtcaaaaaattatt

SEQ ID NO: 2342711 - DNA, 14 bp, Homo sapiens
agaaataaatgaaa

SEQ ID NO: 2342712 - DNA, 20 bp, Homo sapiens
agaaataatgctacaatttt

SEQ ID NO: 2342713 - DNA, 22 bp, Homo sapiens
agaaatagacaaaaagtatatt

SEQ ID NO: 2342714 - DNA, 18 bp, Homo sapiens
agaaatataacacatttt

SEQ ID NO: 2342715 - DNA, 19 bp, Homo sapiens
agaaatataacacattttt

SEQ ID NO: 2342716 - DNA, 16 bp, Homo sapiens
agaaatatattttttg

SEQ ID NO: 2342717 - DNA, 19 bp, Homo sapiens
agaaatcaatagttgaatt

SEQ ID NO: 2342718 - DNA, 16 bp, Homo sapiens
agaaatcatgtccata

SEQ ID NO: 2342719 - DNA, 15 bp, Homo sapiens
agaaatgcatatttg

SEQ ID NO: 2342720 - DNA, 13 bp, Homo sapiens
agaaatgctgctg

SEQ ID NO: 2342721 - DNA, 17 bp, Homo sapiens
agaaatgctgctggcca

SEQ ID NO: 2342722 - DNA, 16 bp, Homo sapiens
agaaatggaaagcaga

SEQ ID NO: 2342723 - DNA, 21 bp, Homo sapiens
agaaatgtgtagctgcaaaaa

SEQ ID NO: 2342724 - DNA, 15 bp, Homo sapiens
agaaattaaatctgt

SEQ ID NO: 2342725 - DNA, 13 bp, Homo sapiens
agaaattctgtgg

SEQ ID NO: 2342726 - DNA, 16 bp, Homo sapiens
agaaattttgtaagaa

SEQ ID NO: 2342727 - DNA, 22 bp, Homo sapiens
agaaattttgtaagaaggcaat

SEQ ID NO: 2342728 - DNA, 18 bp, Homo sapiens
agaacagcttcaggttat

SEQ ID NO: 2342729 - DNA, 22 bp, Homo sapiens
agaacagcttcaggttatcgaa

SEQ ID NO: 2342730 - DNA, 20 bp, Homo sapiens
agaaccacacttgaaacctt

SEQ ID NO: 2342731 - DNA, 12 bp, Homo sapiens
agaaccagaggg

SEQ ID NO: 2342732 - DNA, 14 bp, Homo sapiens
agaacccaagtgcc

SEQ ID NO: 2342733 - DNA, 19 bp, Homo sapiens
agaaccgtagatgatttca

SEQ ID NO: 2342734 - DNA, 14 bp, Homo sapiens
agaaccttggacca

SEQ ID NO: 2342735 - DNA, 20 bp, Homo sapiens
agaaccttggaccactcctg

SEQ ID NO: 2342736 - DNA, 22 bp, Homo sapiens
agaaccttgtcccagccagtga

SEQ ID NO: 2342737 - DNA, 15 bp, Homo sapiens
agaacgttaaactat

SEQ ID NO: 2342738 - DNA, 21 bp, Homo sapiens
agaactagccaaaccaggacc

SEQ ID NO: 2342739 - DNA, 20 bp, Homo sapiens
agaactctgggctgccatgt

SEQ ID NO: 2342740 - DNA, 16 bp, Homo sapiens
agaactgtgccacaat

SEQ ID NO: 2342741 - DNA, 16 bp, Homo sapiens
agaacttgctgctgtc

SEQ ID NO: 2342742 - DNA, 22 bp, Homo sapiens
agaactttattaagtaaaatcc

SEQ ID NO: 2342743 - DNA, 15 bp, Homo sapiens
agaagaaagatgttt

SEQ ID NO: 2342744 - DNA, 19 bp, Homo sapiens
agaagaagtggctgccaca

SEQ ID NO: 2342745 - DNA, 13 bp, Homo sapiens
agaagaatggctt

SEQ ID NO: 2342746 - DNA, 18 bp, Homo sapiens
agaagacaccagagcaga

SEQ ID NO: 2342747 - DNA, 16 bp, Homo sapiens
agaagacatgaaccaa

SEQ ID NO: 2342748 - DNA, 18 bp, Homo sapiens
agaagactttaattatat

SEQ ID NO: 2342749 - DNA, 12 bp, Homo sapiens
agaagagcgcag

SEQ ID NO: 2342750 - DNA, 17 bp, Homo sapiens
agaagatagtcttggaa

SEQ ID NO: 2342751 - DNA, 20 bp, Homo sapiens
agaagatagttgtaaagata

SEQ ID NO: 2342752 - DNA, 16 bp, Homo sapiens
agaagatgaatggtct

SEQ ID NO: 2342753 - DNA, 13 bp, Homo sapiens
agaagcaagccag

SEQ ID NO: 2342754 - DNA, 14 bp, Homo sapiens
agaagcaagccaga

SEQ ID NO: 2342755 - DNA, 15 bp, Homo sapiens
agaagcaagggcaag

SEQ ID NO: 2342756 - DNA, 16 bp, Homo sapiens
agaagcaagggcaaga

SEQ ID NO: 2342757 - DNA, 16 bp, Homo sapiens
agaagcacagaatatt

SEQ ID NO: 2342758 - DNA, 13 bp, Homo sapiens
agaagcatgaaaa

SEQ ID NO: 2342759 - DNA, 19 bp, Homo sapiens
agaagcattccttctttga

SEQ ID NO: 2342760 - DNA, 22 bp, Homo sapiens
agaagcattccttctttgataa

SEQ ID NO: 2342761 - DNA, 11 bp, Homo sapiens
agaagccaagc

SEQ ID NO: 2342762 - DNA, 16 bp, Homo sapiens
agaagccaagggaaag

SEQ ID NO: 2342763 - DNA, 22 bp, Homo sapiens
agaagccaagggaaaggggtgc

SEQ ID NO: 2342764 - DNA, 22 bp, Homo sapiens
agaagccatatatgaccagaag

SEQ ID NO: 2342765 - DNA, 19 bp, Homo sapiens
agaagcctccaagcacaga

SEQ ID NO: 2342766 - DNA, 20 bp, Homo sapiens
agaagcctccaagcacagag

SEQ ID NO: 2342767 - DNA, 22 bp, Homo sapiens
agaagccttggaaccagcccca

SEQ ID NO: 2342768 - DNA, 24 bp, Homo sapiens
agaagccttggaaccagccccatc

SEQ ID NO: 2342769 - DNA, 12 bp, Homo sapiens
agaagctgcagg

SEQ ID NO: 2342770 - DNA, 18 bp, Homo sapiens
agaagctgttgtacattt

SEQ ID NO: 2342771 - DNA, 23 bp, Homo sapiens
agaagctgttgtacatttatgat

SEQ ID NO: 2342772 - DNA, 14 bp, Homo sapiens
agaaggcttctctc

SEQ ID NO: 2342773 - DNA, 18 bp, Homo sapiens
agaaggcttctctccaca

SEQ ID NO: 2342774 - DNA, 15 bp, Homo sapiens
agaaggtgccacttt

SEQ ID NO: 2342775 - DNA, 19 bp, Homo sapiens
agaagtaggaggaaacagt

SEQ ID NO: 2342776 - DNA, 20 bp, Homo sapiens
agaagtctggaaaaaaacaa

SEQ ID NO: 2342777 - DNA, 13 bp, Homo sapiens
agaagtcttgaag

SEQ ID NO: 2342778 - DNA, 19 bp, Homo sapiens
agaataaaattcctatctc

SEQ ID NO: 2342779 - DNA, 19 bp, Homo sapiens
agaataattcttttctgag

SEQ ID NO: 2342780 - DNA, 16 bp, Homo sapiens
agaatacataaacaac

SEQ ID NO: 2342781 - DNA, 16 bp, Homo sapiens
agaataccacatcaaa

SEQ ID NO: 2342782 - DNA, 17 bp, Homo sapiens
agaatacgcagaactac

SEQ ID NO: 2342783 - DNA, 13 bp, Homo sapiens
agaatatttctat

SEQ ID NO: 2342784 - DNA, 16 bp, Homo sapiens
agaatatttctattga

SEQ ID NO: 2342785 - DNA, 17 bp, Homo sapiens
agaatcagaagatagtc

SEQ ID NO: 2342786 - DNA, 23 bp, Homo sapiens
agaatccctttgcacctgagacc

SEQ ID NO: 2342787 - DNA, 22 bp, Homo sapiens
agaatcttgttttgaaaataac

SEQ ID NO: 2342788 - DNA, 15 bp, Homo sapiens
agaatgacagccttt

SEQ ID NO: 2342789 - DNA, 19 bp, Homo sapiens
agaatgatcaaggatctgg

SEQ ID NO: 2342790 - DNA, 16 bp, Homo sapiens
agaatgccatttctca

SEQ ID NO: 2342791 - DNA, 21 bp, Homo sapiens
agaatgccatttctcacgccc

SEQ ID NO: 2342792 - DNA, 19 bp, Homo sapiens
agaatggtgtgaacccggg

SEQ ID NO: 2342793 - DNA, 20 bp, Homo sapiens
agaatggtgtgaacccggga

SEQ ID NO: 2342794 - DNA, 16 bp, Homo sapiens
agaatgttagagtaat

SEQ ID NO: 2342795 - DNA, 22 bp, Homo sapiens
agaatgttcctactcacacttc

SEQ ID NO: 2342796 - DNA, 18 bp, Homo sapiens
agaatgttgtattcagtg

SEQ ID NO: 2342797 - DNA, 19 bp, Homo sapiens
agaatgttgtattcagtga

SEQ ID NO: 2342798 - DNA, 19 bp, Homo sapiens
agaattctttccttcatgt

SEQ ID NO: 2342799 - DNA, 16 bp, Homo sapiens
agaattgaaaagtttt

SEQ ID NO: 2342800 - DNA, 17 bp, Homo sapiens
agaattgaaaagttttt

SEQ ID NO: 2342801 - DNA, 14 bp, Homo sapiens
agaatttgaattat

SEQ ID NO: 2342802 - DNA, 15 bp, Homo sapiens
agacaaaagagcagt

SEQ ID NO: 2342803 - DNA, 16 bp, Homo sapiens
agacaaaatttgagaa

SEQ ID NO: 2342804 - DNA, 18 bp, Homo sapiens
agacaaaatttgagaata

SEQ ID NO: 2342805 - DNA, 22 bp, Homo sapiens
agacaaatattcctttgcatat

SEQ ID NO: 2342806 - DNA, 23 bp, Homo sapiens
agacaacaggtaaaacagggcca

SEQ ID NO: 2342807 - DNA, 13 bp, Homo sapiens
agacaaggtgcta

SEQ ID NO: 2342808 - DNA, 15 bp, Homo sapiens
agacaccagagcaga

SEQ ID NO: 2342809 - DNA, 20 bp, Homo sapiens
agacaccagagcagatgcag

SEQ ID NO: 2342810 - DNA, 21 bp, Homo sapiens
agacagaggaaagggctggct

SEQ ID NO: 2342811 - DNA, 15 bp, Homo sapiens
agacaggagacaaaa

SEQ ID NO: 2342812 - DNA, 11 bp, Homo sapiens
agacaggcagc

SEQ ID NO: 2342813 - DNA, 18 bp, Homo sapiens
agacaggcagcccagcag

SEQ ID NO: 2342814 - DNA, 18 bp, Homo sapiens
agacagggtgggcttcct

SEQ ID NO: 2342815 - DNA, 20 bp, Homo sapiens
agacagggtgggcttcctgc

SEQ ID NO: 2342816 - DNA, 16 bp, Homo sapiens
agacagttttgcttta

SEQ ID NO: 2342817 - DNA, 21 bp, Homo sapiens
agacataaaggaaaagacaca

SEQ ID NO: 2342818 - DNA, 19 bp, Homo sapiens
agacatataccaaaaacaa

SEQ ID NO: 2342819 - DNA, 19 bp, Homo sapiens
agacatggacctccaggct

SEQ ID NO: 2342820 - DNA, 14 bp, Homo sapiens
agacattctcacat

SEQ ID NO: 2342821 - DNA, 15 bp, Homo sapiens
agacatttgtttgct

SEQ ID NO: 2342822 - DNA, 22 bp, Homo sapiens
agacattttaaaaaatggtcac

SEQ ID NO: 2342823 - DNA, 21 bp, Homo sapiens
agacattttaagtttgtagta

SEQ ID NO: 2342824 - DNA, 14 bp, Homo sapiens
agaccagaaattcc

SEQ ID NO: 2342825 - DNA, 15 bp, Homo sapiens
agaccatcctggcta

SEQ ID NO: 2342826 - DNA, 23 bp, Homo sapiens
agacccaagtcaaagatgcccca

SEQ ID NO: 2342827 - DNA, 20 bp, Homo sapiens
agacccccatttgtcccaga

SEQ ID NO: 2342828 - DNA, 23 bp, Homo sapiens
agaccccgaggtaggggtgggga

SEQ ID NO: 2342829 - DNA, 15 bp, Homo sapiens
agaccctcttgccca

SEQ ID NO: 2342830 - DNA, 20 bp, Homo sapiens
agaccctcttgcccatcctg

SEQ ID NO: 2342831 - DNA, 12 bp, Homo sapiens
agaccctgaggc

SEQ ID NO: 2342832 - DNA, 21 bp, Homo sapiens
agaccctgaggccctgggctg

SEQ ID NO: 2342833 - DNA, 20 bp, Homo sapiens
agaccctgccacagccagag

SEQ ID NO: 2342834 - DNA, 17 bp, Homo sapiens
agaccctgggtgggctc

SEQ ID NO: 2342835 - DNA, 18 bp, Homo sapiens
agacctaaagcaagcctg

SEQ ID NO: 2342836 - DNA, 16 bp, Homo sapiens
agacctagcaggctgt

SEQ ID NO: 2342837 - DNA, 18 bp, Homo sapiens
agacctagcaggctgttc

SEQ ID NO: 2342838 - DNA, 20 bp, Homo sapiens
agacctagcaggctgttcca

SEQ ID NO: 2342839 - DNA, 13 bp, Homo sapiens
agacctcatgccc

SEQ ID NO: 2342840 - DNA, 19 bp, Homo sapiens
agacctcatgcccagctct

SEQ ID NO: 2342841 - DNA, 22 bp, Homo sapiens
agacctcatgcccagctctctg

SEQ ID NO: 2342842 - DNA, 17 bp, Homo sapiens
agacctgggatttgaga

SEQ ID NO: 2342843 - DNA, 17 bp, Homo sapiens
agacgccactccctggg

SEQ ID NO: 2342844 - DNA, 23 bp, Homo sapiens
agacgccactccctgggacacag

SEQ ID NO: 2342845 - DNA, 13 bp, Homo sapiens
agacgtttataaa

SEQ ID NO: 2342846 - DNA, 18 bp, Homo sapiens
agactaaaggatccagag

SEQ ID NO: 2342847 - DNA, 22 bp, Homo sapiens
agactaaaggatccagagagca

SEQ ID NO: 2342848 - DNA, 14 bp, Homo sapiens
agactatggtgctg

SEQ ID NO: 2342849 - DNA, 17 bp, Homo sapiens
agactcctagctgtcct

SEQ ID NO: 2342850 - DNA, 17 bp, Homo sapiens
agactctagtatttatg

SEQ ID NO: 2342851 - DNA, 22 bp, Homo sapiens
agactctttttttgagtgacag

SEQ ID NO: 2342852 - DNA, 15 bp, Homo sapiens
agactgccttctcca

SEQ ID NO: 2342853 - DNA, 12 bp, Homo sapiens
agactgctagct

SEQ ID NO: 2342854 - DNA, 16 bp, Homo sapiens
agactggttttctgcc

SEQ ID NO: 2342855 - DNA, 18 bp, Homo sapiens
agactggttttctgccaa

SEQ ID NO: 2342856 - DNA, 22 bp, Homo sapiens
agactgtaacttccaaataaat

SEQ ID NO: 2342857 - DNA, 17 bp, Homo sapiens
agactgtagatatgtat

SEQ ID NO: 2342858 - DNA, 19 bp, Homo sapiens
agactgtggctagtgacaa

SEQ ID NO: 2342859 - DNA, 16 bp, Homo sapiens
agactgtttgaatgtt

SEQ ID NO: 2342860 - DNA, 20 bp, Homo sapiens
agactgtttgctgatcccca

SEQ ID NO: 2342861 - DNA, 21 bp, Homo sapiens
agactgtttgctgatccccaa

SEQ ID NO: 2342862 - DNA, 22 bp, Homo sapiens
agactgtttgctgatccccaac

SEQ ID NO: 2342863 - DNA, 15 bp, Homo sapiens
agacttgagacaatg

SEQ ID NO: 2342864 - DNA, 23 bp, Homo sapiens
agagaaataagtgccctctccca

SEQ ID NO: 2342865 - DNA, 21 bp, Homo sapiens
agagaagctggtctagactgt

SEQ ID NO: 2342866 - DNA, 18 bp, Homo sapiens
agagaatgagtccttgat

SEQ ID NO: 2342867 - DNA, 17 bp, Homo sapiens
agagaatgtagatattg

SEQ ID NO: 2342868 - DNA, 15 bp, Homo sapiens
agagacaagtaattt

SEQ ID NO: 2342869 - DNA, 19 bp, Homo sapiens
agagacaagtaatttcagt

SEQ ID NO: 2342870 - DNA, 22 bp, Homo sapiens
agagacactgttgataaaaact

SEQ ID NO: 2342871 - DNA, 14 bp, Homo sapiens
agagacagcccagg

SEQ ID NO: 2342872 - DNA, 13 bp, Homo sapiens
agagacaggcagc

SEQ ID NO: 2342873 - DNA, 15 bp, Homo sapiens
agagacaggcagccc

SEQ ID NO: 2342874 - DNA, 19 bp, Homo sapiens
agagacgccactccctggg

SEQ ID NO: 2342875 - DNA, 21 bp, Homo sapiens
agagacgccactccctgggac

SEQ ID NO: 2342876 - DNA, 17 bp, Homo sapiens
agagactgtttgaatgt

SEQ ID NO: 2342877 - DNA, 15 bp, Homo sapiens
agagagagagagaga

SEQ ID NO: 2342878 - DNA, 13 bp, Homo sapiens
agagagagagagg

SEQ ID NO: 2342879 - DNA, 18 bp, Homo sapiens
agagagataaaaggtgga

SEQ ID NO: 2342880 - DNA, 15 bp, Homo sapiens
agagaggcacctgct

SEQ ID NO: 2342881 - DNA, 19 bp, Homo sapiens
agagaggcacctgctggaa

SEQ ID NO: 2342882 - DNA, 17 bp, Homo sapiens
agagaggcttgaaggcc

SEQ ID NO: 2342883 - DNA, 16 bp, Homo sapiens
agagaggtagcgagct

SEQ ID NO: 2342884 - DNA, 19 bp, Homo sapiens
agagaggtagcgagctgct

SEQ ID NO: 2342885 - DNA, 22 bp, Homo sapiens
agagaggtagcgagctgctctg

SEQ ID NO: 2342886 - DNA, 12 bp, Homo sapiens
agagagtggcaa

SEQ ID NO: 2342887 - DNA, 19 bp, Homo sapiens
agagatccctgcagaaccc

SEQ ID NO: 2342888 - DNA, 12 bp, Homo sapiens
agagatgagccc

SEQ ID NO: 2342889 - DNA, 14 bp, Homo sapiens
agagattttatgtt

SEQ ID NO: 2342890 - DNA, 16 bp, Homo sapiens
agagattttatgttta

SEQ ID NO: 2342891 - DNA, 20 bp, Homo sapiens
agagcaagagataagtcttt

SEQ ID NO: 2342892 - DNA, 12 bp, Homo sapiens
agagcagatgca

SEQ ID NO: 2342893 - DNA, 18 bp, Homo sapiens
agagcagatgcagagagc

SEQ ID NO: 2342894 - DNA, 13 bp, Homo sapiens
agagcagctggct

SEQ ID NO: 2342895 - DNA, 16 bp, Homo sapiens
agagcagctggctctc

SEQ ID NO: 2342896 - DNA, 19 bp, Homo sapiens
agagcagtcagagtccagt

SEQ ID NO: 2342897 - DNA, 23 bp, Homo sapiens
agagccagtggcgggtgatggcc

SEQ ID NO: 2342898 - DNA, 18 bp, Homo sapiens
agagccatacataaaaga

SEQ ID NO: 2342899 - DNA, 21 bp, Homo sapiens
agagccatacataaaagaaat

SEQ ID NO: 2342900 - DNA, 21 bp, Homo sapiens
agagccatggtgtgtttgtaa

SEQ ID NO: 2342901 - DNA, 14 bp, Homo sapiens
agagcccagaggta

SEQ ID NO: 2342902 - DNA, 24 bp, Homo sapiens
agagcccagaggtaacagaacagc

SEQ ID NO: 2342903 - DNA, 14 bp, Homo sapiens
agagcccgcagggc

SEQ ID NO: 2342904 - DNA, 24 bp, Homo sapiens
agagcctgctggcacccaccgtgg

SEQ ID NO: 2342905 - DNA, 19 bp, Homo sapiens
agagccttctcagaagcac

SEQ ID NO: 2342906 - DNA, 15 bp, Homo sapiens
agagccttttgtgca

SEQ ID NO: 2342907 - DNA, 14 bp, Homo sapiens
agagcgcacaggga

SEQ ID NO: 2342908 - DNA, 23 bp, Homo sapiens
agagcgccaggaagccagagccc

SEQ ID NO: 2342909 - DNA, 19 bp, Homo sapiens
agagctaaactccttcctg

SEQ ID NO: 2342910 - DNA, 18 bp, Homo sapiens
acctgaccccattcctga

SEQ ID NO: 2342911 - DNA, 23 bp, Homo sapiens
acctgacccctgctcagtaaagc

SEQ ID NO: 2342912 - DNA, 15 bp, Homo sapiens
acctgagacctgaag

SEQ ID NO: 2342913 - DNA, 22 bp, Homo sapiens
acctgagctaaataaagatatt

SEQ ID NO: 2342914 - DNA, 17 bp, Homo sapiens
acctgagctattttcct

SEQ ID NO: 2342915 - DNA, 11 bp, Homo sapiens
acctgattttt

SEQ ID NO: 2342916 - DNA, 16 bp, Homo sapiens
acctgcacacaggaca

SEQ ID NO: 2342917 - DNA, 20 bp, Homo sapiens
acctgcacacaggacagcgg

SEQ ID NO: 2342918 - DNA, 19 bp, Homo sapiens
acctgcacggggcattcct

SEQ ID NO: 2342919 - DNA, 13 bp, Homo sapiens
acctgctctgtcc

SEQ ID NO: 2342920 - DNA, 17 bp, Homo sapiens
acctgctctgtccccaa

SEQ ID NO: 2342921 - DNA, 16 bp, Homo sapiens
acctgctgacctgtgc

SEQ ID NO: 2342922 - DNA, 17 bp, Homo sapiens
acctgctgacctgtgca

SEQ ID NO: 2342923 - DNA, 23 bp, Homo sapiens
acctgcttggtgtgtaggttccg

SEQ ID NO: 2342924 - DNA, 19 bp, Homo sapiens
acctggaatctacaagcca

SEQ ID NO: 2342925 - DNA, 21 bp, Homo sapiens
acctggaatctacaagccaaa

SEQ ID NO: 2342926 - DNA, 21 bp, Homo sapiens
acctggcatctaattctgatt

SEQ ID NO: 2342927 - DNA, 20 bp, Homo sapiens
acctggccgcggagcctgca

SEQ ID NO: 2342928 - DNA, 13 bp, Homo sapiens
acctggctgaggt

SEQ ID NO: 2342929 - DNA, 22 bp, Homo sapiens
acctggctgaggttcctctgcc

SEQ ID NO: 2342930 - DNA, 14 bp, Homo sapiens
acctgtagtcccag

SEQ ID NO: 2342931 - DNA, 11 bp, Homo sapiens
acctgtgtgct

SEQ ID NO: 2342932 - DNA, 15 bp, Homo sapiens
acctgttttctgaaa

SEQ ID NO: 2342933 - DNA, 21 bp, Homo sapiens
acctgttttctgaaacacacg

SEQ ID NO: 2342934 - DNA, 21 bp, Homo sapiens
accttaaaagacagctagatt

SEQ ID NO: 2342935 - DNA, 19 bp, Homo sapiens
accttcagttatgattttt

SEQ ID NO: 2342936 - DNA, 18 bp, Homo sapiens
accttcttatttaatctt

SEQ ID NO: 2342937 - DNA, 17 bp, Homo sapiens
accttgaaaggcaggaa

SEQ ID NO: 2342938 - DNA, 20 bp, Homo sapiens
accttgacgtttcttctttc

SEQ ID NO: 2342939 - DNA, 15 bp, Homo sapiens
accttgcaaagcaac

SEQ ID NO: 2342940 - DNA, 13 bp, Homo sapiens
accttgccagggc

SEQ ID NO: 2342941 - DNA, 16 bp, Homo sapiens
accttgccagggcagg

SEQ ID NO: 2342942 - DNA, 16 bp, Homo sapiens
accttgccgagagagg

SEQ ID NO: 2342943 - DNA, 18 bp, Homo sapiens
accttggaccactcctgt

SEQ ID NO: 2342944 - DNA, 24 bp, Homo sapiens
accttggggccttgatgactgcct

SEQ ID NO: 2342945 - DNA, 21 bp, Homo sapiens
accttgtgtctgtacacgtgt

SEQ ID NO: 2342946 - DNA, 23 bp, Homo sapiens
acctttcagtgcagtttcttttc

SEQ ID NO: 2342947 - DNA, 13 bp, Homo sapiens
acctttctctctc

SEQ ID NO: 2342948 - DNA, 15 bp, Homo sapiens
acctttctgtagcct

SEQ ID NO: 2342949 - DNA, 16 bp, Homo sapiens
acctttctgtagccta

SEQ ID NO: 2342950 - DNA, 17 bp, Homo sapiens
acctttgggttctttct

SEQ ID NO: 2342951 - DNA, 14 bp, Homo sapiens
accttttaactcac

SEQ ID NO: 2342952 - DNA, 21 bp, Homo sapiens
accttttctgtggctggctct

SEQ ID NO: 2342953 - DNA, 19 bp, Homo sapiens
acctttttatttgcatgtg

SEQ ID NO: 2342954 - DNA, 22 bp, Homo sapiens
accttttttaagatttttctca

SEQ ID NO: 2342955 - DNA, 21 bp, Homo sapiens
acgaatggtctttgctccaga

SEQ ID NO: 2342956 - DNA, 20 bp, Homo sapiens
acgacacgggtggggaaagg

SEQ ID NO: 2342957 - DNA, 12 bp, Homo sapiens
acgacagaggag

SEQ ID NO: 2342958 - DNA, 11 bp, Homo sapiens
acgactcttcc

SEQ ID NO: 2342959 - DNA, 19 bp, Homo sapiens
acgagcacctccagcctga

SEQ ID NO: 2342960 - DNA, 20 bp, Homo sapiens
acgagccacaagctgcactg

SEQ ID NO: 2342961 - DNA, 21 bp, Homo sapiens
acgatttgcaggattcccttc

SEQ ID NO: 2342962 - DNA, 13 bp, Homo sapiens
acgcaagtgccag

SEQ ID NO: 2342963 - DNA, 20 bp, Homo sapiens
acgcccttcaatgctgcagg

SEQ ID NO: 2342964 - DNA, 14 bp, Homo sapiens
acgcctgcaggaga

SEQ ID NO: 2342965 - DNA, 13 bp, Homo sapiens
acgcctgctggcc

SEQ ID NO: 2342966 - DNA, 14 bp, Homo sapiens
acgcctgctggccg

SEQ ID NO: 2342967 - DNA, 23 bp, Homo sapiens
acgcgcctcgccggatctgaggg

SEQ ID NO: 2342968 - DNA, 16 bp, Homo sapiens
acgcgcgtcgccgcca

SEQ ID NO: 2342969 - DNA, 20 bp, Homo sapiens
acgcgtatctaggctttggt

SEQ ID NO: 2342970 - DNA, 20 bp, Homo sapiens
acgctaaagagcccttgcct

SEQ ID NO: 2342971 - DNA, 21 bp, Homo sapiens
acgctaataagtgacaaataa

SEQ ID NO: 2342972 - DNA, 13 bp, Homo sapiens
acgctcctttgtg

SEQ ID NO: 2342973 - DNA, 22 bp, Homo sapiens
acgctcctttgtgtgtgtgtca

SEQ ID NO: 2342974 - DNA, 15 bp, Homo sapiens
acgctcgctgccatc

SEQ ID NO: 2342975 - DNA, 23 bp, Homo sapiens
acgctcgctgccatcaccgctgg

SEQ ID NO: 2342976 - DNA, 13 bp, Homo sapiens
acgctctggacat

SEQ ID NO: 2342977 - DNA, 15 bp, Homo sapiens
acggcagctgtagct

SEQ ID NO: 2342978 - DNA, 15 bp, Homo sapiens
acggcaggctcactg

SEQ ID NO: 2342979 - DNA, 17 bp, Homo sapiens
acggcaggctcactgcc

SEQ ID NO: 2342980 - DNA, 15 bp, Homo sapiens
acggctcctcagagc

SEQ ID NO: 2342981 - DNA, 18 bp, Homo sapiens
acgggaacatgccccctg

SEQ ID NO: 2342982 - DNA, 15 bp, Homo sapiens
acggggttccctcct

SEQ ID NO: 2342983 - DNA, 14 bp, Homo sapiens
acgggtggggaaag

SEQ ID NO: 2342984 - DNA, 15 bp, Homo sapiens
acggtaagtgttctc

SEQ ID NO: 2342985 - DNA, 19 bp, Homo sapiens
acggtcctttaggcagcct

SEQ ID NO: 2342986 - DNA, 21 bp, Homo sapiens
acggtcctttaggcagcctgc

SEQ ID NO: 2342987 - DNA, 13 bp, Homo sapiens
acggtgctaaaaa

SEQ ID NO: 2342988 - DNA, 20 bp, Homo sapiens
acggtgctgtgagggagggg

SEQ ID NO: 2342989 - DNA, 21 bp, Homo sapiens
acggtggtcggtgggaccctg

SEQ ID NO: 2342990 - DNA, 18 bp, Homo sapiens
acgtcaggccctgactcc

SEQ ID NO: 2342991 - DNA, 18 bp, Homo sapiens
acgtcatgtatttgagca

SEQ ID NO: 2342992 - DNA, 16 bp, Homo sapiens
acgtgaagaaataaat

SEQ ID NO: 2342993 - DNA, 18 bp, Homo sapiens
acgtgaagaaataaatga

SEQ ID NO: 2342994 - DNA, 16 bp, Homo sapiens
acgtgatttttaaatt

SEQ ID NO: 2342995 - DNA, 21 bp, Homo sapiens
acgtggcctccgcagtgtctc

SEQ ID NO: 2342996 - DNA, 20 bp, Homo sapiens
acgttgccaggggcttgaga

SEQ ID NO: 2342997 - DNA, 19 bp, Homo sapiens
acgtttataaacagaaatg

SEQ ID NO: 2342998 - DNA, 20 bp, Homo sapiens
acgtttctttaaccttgtat

SEQ ID NO: 2342999 - DNA, 15 bp, Homo sapiens
acgttttcttctttc

SEQ ID NO: 2343000 - DNA, 20 bp, Homo sapiens
acgttttcttctttccctgg

SEQ ID NO: 2343001 - DNA, 15 bp, Homo sapiens
actaaaaaaccaaca

SEQ ID NO: 2343002 - DNA, 13 bp, Homo sapiens
actaaaatttaca

SEQ ID NO: 2343003 - DNA, 14 bp, Homo sapiens
actaaaatttacac

SEQ ID NO: 2343004 - DNA, 16 bp, Homo sapiens
actaaaatttacacat

SEQ ID NO: 2343005 - DNA, 14 bp, Homo sapiens
actaaagagagaat

SEQ ID NO: 2343006 - DNA, 21 bp, Homo sapiens
actaaagagagaatgtagata

SEQ ID NO: 2343007 - DNA, 19 bp, Homo sapiens
actaacagctacaaacttt

SEQ ID NO: 2343008 - DNA, 21 bp, Homo sapiens
actaacagctacaaactttta

SEQ ID NO: 2343009 - DNA, 22 bp, Homo sapiens
actaactcaaatacacatttgc

SEQ ID NO: 2343010 - DNA, 18 bp, Homo sapiens
actaagccaggcctggct

SEQ ID NO: 2343011 - DNA, 21 bp, Homo sapiens
actaagccaggcctggctgga

SEQ ID NO: 2343012 - DNA, 19 bp, Homo sapiens
actaaggaactaaaacttg

SEQ ID NO: 2343013 - DNA, 23 bp, Homo sapiens
actaataatcttgtttctgaaaa

SEQ ID NO: 2343014 - DNA, 17 bp, Homo sapiens
actaatgacaagtgact

SEQ ID NO: 2343015 - DNA, 13 bp, Homo sapiens
actaatgatgttt

SEQ ID NO: 2343016 - DNA, 24 bp, Homo sapiens
actaatgccttactcttcttgaaa

SEQ ID NO: 2343017 - DNA, 13 bp, Homo sapiens
actaatgcttttt

SEQ ID NO: 2343018 - DNA, 21 bp, Homo sapiens
actaatgctttttagaaagca

SEQ ID NO: 2343019 - DNA, 13 bp, Homo sapiens
actacacctggct

SEQ ID NO: 2343020 - DNA, 23 bp, Homo sapiens
actaccaaacactcagtccactg

SEQ ID NO: 2343021 - DNA, 16 bp, Homo sapiens
actaccctgattcttg

SEQ ID NO: 2343022 - DNA, 18 bp, Homo sapiens
actagaaggcttctctcc

SEQ ID NO: 2343023 - DNA, 21 bp, Homo sapiens
actagaggaaaccagtttggt

SEQ ID NO: 2343024 - DNA, 13 bp, Homo sapiens
actagattgacta

SEQ ID NO: 2343025 - DNA, 15 bp, Homo sapiens
actagattgtgatcc

SEQ ID NO: 2343026 - DNA, 14 bp, Homo sapiens
actagccagacaaa

SEQ ID NO: 2343027 - DNA, 17 bp, Homo sapiens
actagcccaatgaaatg

SEQ ID NO: 2343028 - DNA, 20 bp, Homo sapiens
actataaacttaaagctact

SEQ ID NO: 2343029 - DNA, 16 bp, Homo sapiens
actataaggtgcctca

SEQ ID NO: 2343030 - DNA, 17 bp, Homo sapiens
actataaggtgcctcag

SEQ ID NO: 2343031 - DNA, 20 bp, Homo sapiens
actatagcttgcagaactgt

SEQ ID NO: 2343032 - DNA, 20 bp, Homo sapiens
actatatttttctcaatgtt

SEQ ID NO: 2343033 - DNA, 19 bp, Homo sapiens
actatgcgtggctggaacc

SEQ ID NO: 2343034 - DNA, 23 bp, Homo sapiens
actatgcgtggctggaaccacat

SEQ ID NO: 2343035 - DNA, 17 bp, Homo sapiens
actatggtgctgccttg

SEQ ID NO: 2343036 - DNA, 16 bp, Homo sapiens
actattagagtatttc

SEQ ID NO: 2343037 - DNA, 17 bp, Homo sapiens
actattagagtatttcc

SEQ ID NO: 2343038 - DNA, 21 bp, Homo sapiens
actattagagtatttcccttc

SEQ ID NO: 2343039 - DNA, 17 bp, Homo sapiens
actattctgtatctttc

SEQ ID NO: 2343040 - DNA, 20 bp, Homo sapiens
actcaaaaaaacaaaaaaga

SEQ ID NO: 2343041 - DNA, 14 bp, Homo sapiens
actcaaactgagga

SEQ ID NO: 2343042 - DNA, 14 bp, Homo sapiens
actcaaattttgta

SEQ ID NO: 2343043 - DNA, 16 bp, Homo sapiens
actcaaattttgtacc

SEQ ID NO: 2343044 - DNA, 22 bp, Homo sapiens
actcaaattttgtaccaagtaa

SEQ ID NO: 2343045 - DNA, 17 bp, Homo sapiens
actcaagcgggtggctc

SEQ ID NO: 2343046 - DNA, 21 bp, Homo sapiens
actcaccagccccactgccag

SEQ ID NO: 2343047 - DNA, 22 bp, Homo sapiens
actcaccagccccactgccagc

SEQ ID NO: 2343048 - DNA, 13 bp, Homo sapiens
actcactctaaag

SEQ ID NO: 2343049 - DNA, 16 bp, Homo sapiens
actcacttttcccact

SEQ ID NO: 2343050 - DNA, 13 bp, Homo sapiens
actcagatctgat

SEQ ID NO: 2343051 - DNA, 16 bp, Homo sapiens
actcagtccactgttg

SEQ ID NO: 2343052 - DNA, 21 bp, Homo sapiens
actcagtgagcctcctgtgcc

SEQ ID NO: 2343053 - DNA, 23 bp, Homo sapiens
actcatcctcttttaatggcatt

SEQ ID NO: 2343054 - DNA, 16 bp, Homo sapiens
actcatttttttttga

SEQ ID NO: 2343055 - DNA, 22 bp, Homo sapiens
actccaaaatgttggtcatttt

SEQ ID NO: 2343056 - DNA, 13 bp, Homo sapiens
actccacatctgc

SEQ ID NO: 2343057 - DNA, 17 bp, Homo sapiens
actccacatctgcctta

SEQ ID NO: 2343058 - DNA, 15 bp, Homo sapiens
actccaggccctcct

SEQ ID NO: 2343059 - DNA, 24 bp, Homo sapiens
actccagggacacacagcctagca

SEQ ID NO: 2343060 - DNA, 19 bp, Homo sapiens
actcccaaggttggagccc

SEQ ID NO: 2343061 - DNA, 18 bp, Homo sapiens
actccctgggacacagac

SEQ ID NO: 2343062 - DNA, 21 bp, Homo sapiens
actccctgggacacagaccca

SEQ ID NO: 2343063 - DNA, 16 bp, Homo sapiens
actcccttgctggccc

SEQ ID NO: 2343064 - DNA, 19 bp, Homo sapiens
actcccttgctggccccag

SEQ ID NO: 2343065 - DNA, 21 bp, Homo sapiens
actcccttgctggccccagcc

SEQ ID NO: 2343066 - DNA, 23 bp, Homo sapiens
actcccttgctggccccagccct

SEQ ID NO: 2343067 - DNA, 23 bp, Homo sapiens
actccgcgccgatgccaccggcc

SEQ ID NO: 2343068 - DNA, 21 bp, Homo sapiens
actccggggccccactggctg

SEQ ID NO: 2343069 - DNA, 13 bp, Homo sapiens
actcctctgctga

SEQ ID NO: 2343070 - DNA, 21 bp, Homo sapiens
actcctctgctgacctgctga

SEQ ID NO: 2343071 - DNA, 22 bp, Homo sapiens
actcctctggctttcccaggag

SEQ ID NO: 2343072 - DNA, 16 bp, Homo sapiens
actcctgccaggcaca

SEQ ID NO: 2343073 - DNA, 23 bp, Homo sapiens
actcctgccaggcacacacagcc

SEQ ID NO: 2343074 - DNA, 14 bp, Homo sapiens
actccttaaaaatg

SEQ ID NO: 2343075 - DNA, 13 bp, Homo sapiens
actccttcctggc

SEQ ID NO: 2343076 - DNA, 15 bp, Homo sapiens
actccttcctggcct

SEQ ID NO: 2343077 - DNA, 16 bp, Homo sapiens
actccttcctggcctg

SEQ ID NO: 2343078 - DNA, 17 bp, Homo sapiens
actccttcctggcctga

SEQ ID NO: 2343079 - DNA, 23 bp, Homo sapiens
actccttcctggcctgagagtca

SEQ ID NO: 2343080 - DNA, 14 bp, Homo sapiens
actccttgcttcct

SEQ ID NO: 2343081 - DNA, 15 bp, Homo sapiens
actcgcgctcagtaa

SEQ ID NO: 2343082 - DNA, 15 bp, Homo sapiens
actcgctgtatgaaa

SEQ ID NO: 2343083 - DNA, 22 bp, Homo sapiens
actcggcagcccttccaaactc

SEQ ID NO: 2343084 - DNA, 16 bp, Homo sapiens
actcggctctgcagtc

SEQ ID NO: 2343085 - DNA, 23 bp, Homo sapiens
actcgtgtgtttctattttttga

SEQ ID NO: 2343086 - DNA, 16 bp, Homo sapiens
actctagtgacttcct

SEQ ID NO: 2343087 - DNA, 23 bp, Homo sapiens
actctagtgacttcctggtgagg

SEQ ID NO: 2343088 - DNA, 22 bp, Homo sapiens
actctcaccatgatgtgaagag

SEQ ID NO: 2343089 - DNA, 23 bp, Homo sapiens
actctcctaggcattctggacct

SEQ ID NO: 2343090 - DNA, 22 bp, Homo sapiens
actctctggaagcccctgggcc

SEQ ID NO: 2343091 - DNA, 21 bp, Homo sapiens
actctctttccttgagctgtt

SEQ ID NO: 2343092 - DNA, 13 bp, Homo sapiens
actctgcacatgt

SEQ ID NO: 2343093 - DNA, 13 bp, Homo sapiens
actctgccccccc

SEQ ID NO: 2343094 - DNA, 20 bp, Homo sapiens
actctgccccccccccccat

SEQ ID NO: 2343095 - DNA, 19 bp, Homo sapiens
actctgcccctggacctgg

SEQ ID NO: 2343096 - DNA, 20 bp, Homo sapiens
actctgcccctggacctggg

SEQ ID NO: 2343097 - DNA, 18 bp, Homo sapiens
actctgcttgatttttgc

SEQ ID NO: 2343098 - DNA, 21 bp, Homo sapiens
actctgtataatagagataag

SEQ ID NO: 2343099 - DNA, 22 bp, Homo sapiens
actcttatctcagtcatgcata

SEQ ID NO: 2343100 - DNA, 16 bp, Homo sapiens
actcttcttgaaattt

SEQ ID NO: 2343101 - DNA, 19 bp, Homo sapiens
actcttcttgaaattttaa

SEQ ID NO: 2343102 - DNA, 23 bp, Homo sapiens
actctttttttgagtgacagctt

SEQ ID NO: 2343103 - DNA, 12 bp, Homo sapiens
actgaaccactg

SEQ ID NO: 2343104 - DNA, 15 bp, Homo sapiens
actgaaccactgctt

SEQ ID NO: 2343105 - DNA, 18 bp, Homo sapiens
actgaagacctccacatt

SEQ ID NO: 2343106 - DNA, 13 bp, Homo sapiens
actgaagtggctg

SEQ ID NO: 2343107 - DNA, 15 bp, Homo sapiens
actgaagtggctggt

SEQ ID NO: 2343108 - DNA, 18 bp, Homo sapiens
actgaataatatcaaata

SEQ ID NO: 2343109 - DNA, 20 bp, Homo sapiens
actgaatgaagcagtatttt

SEQ ID NO: 2343110 - DNA, 15 bp, Homo sapiens
actgaatttttttgt

SEQ ID NO: 2343111 - DNA, 16 bp, Homo sapiens
actgaatttttttgta

SEQ ID NO: 2343112 - DNA, 17 bp, Homo sapiens
actgaatttttttgtaa

SEQ ID NO: 2343113 - DNA, 13 bp, Homo sapiens
actgacttgctgt

SEQ ID NO: 2343114 - DNA, 22 bp, Homo sapiens
actgagctcacatgggactggg

SEQ ID NO: 2343115 - DNA, 19 bp, Homo sapiens
actgaggaatttcacctgt

SEQ ID NO: 2343116 - DNA, 19 bp, Homo sapiens
actgaggcagcgacctcaa

SEQ ID NO: 2343117 - DNA, 17 bp, Homo sapiens
actgatatattttacaa

SEQ ID NO: 2343118 - DNA, 20 bp, Homo sapiens
actgatggctcaagacaagg

SEQ ID NO: 2343119 - DNA, 15 bp, Homo sapiens
actgatttcagtaag

SEQ ID NO: 2343120 - DNA, 14 bp, Homo sapiens
actgatttcttgcg

SEQ ID NO: 2343121 - DNA, 17 bp, Homo sapiens
actgcactccagcctgg

SEQ ID NO: 2343122 - DNA, 18 bp, Homo sapiens
actgcactccagcctggg

SEQ ID NO: 2343123 - DNA, 19 bp, Homo sapiens
actgcactccagcctgggg

SEQ ID NO: 2343124 - DNA, 13 bp, Homo sapiens
actgcatactttt

SEQ ID NO: 2343125 - DNA, 16 bp, Homo sapiens
actgcatactttttaa

SEQ ID NO: 2343126 - DNA, 23 bp, Homo sapiens
actgcatactttttaaatgtaaa

SEQ ID NO: 2343127 - DNA, 14 bp, Homo sapiens
actgcatccagcct

SEQ ID NO: 2343128 - DNA, 18 bp, Homo sapiens
actgccacactctccatc

SEQ ID NO: 2343129 - DNA, 14 bp, Homo sapiens
actgccattttttg

SEQ ID NO: 2343130 - DNA, 22 bp, Homo sapiens
actgcccacatgggacctggcc

SEQ ID NO: 2343131 - DNA, 20 bp, Homo sapiens
actgccccacggagacagag

SEQ ID NO: 2343132 - DNA, 18 bp, Homo sapiens
actgccttgcctcctcag

SEQ ID NO: 2343133 - DNA, 20 bp, Homo sapiens
actgcgttctgcaagcatca

SEQ ID NO: 2343134 - DNA, 22 bp, Homo sapiens
actgctcagaacttgctgctgt

SEQ ID NO: 2343135 - DNA, 15 bp, Homo sapiens
actgctcccacctcc

SEQ ID NO: 2343136 - DNA, 13 bp, Homo sapiens
actgctcctcctc

SEQ ID NO: 2343137 - DNA, 12 bp, Homo sapiens
actgctggacat

SEQ ID NO: 2343138 - DNA, 22 bp, Homo sapiens
actgctgtgaaccctggggcct

SEQ ID NO: 2343139 - DNA, 23 bp, Homo sapiens
actgctgtgaaccctggggcctg

SEQ ID NO: 2343140 - DNA, 17 bp, Homo sapiens
actgcttctcttttgaa

SEQ ID NO: 2343141 - DNA, 17 bp, Homo sapiens
actggaaaggggagagc

SEQ ID NO: 2343142 - DNA, 21 bp, Homo sapiens
actggaaaggggagagcctgc

SEQ ID NO: 2343143 - DNA, 22 bp, Homo sapiens
actggaaaggggagagcctgct

SEQ ID NO: 2343144 - DNA, 13 bp, Homo sapiens
actggaataatat

SEQ ID NO: 2343145 - DNA, 17 bp, Homo sapiens
actggaggttgaagcca

SEQ ID NO: 2343146 - DNA, 18 bp, Homo sapiens
actggaggttgaagccaa

SEQ ID NO: 2343147 - DNA, 15 bp, Homo sapiens
actggatggaaagac

SEQ ID NO: 2343148 - DNA, 12 bp, Homo sapiens
actggcacagag

SEQ ID NO: 2343149 - DNA, 14 bp, Homo sapiens
actggcagcatctt

SEQ ID NO: 2343150 - DNA, 15 bp, Homo sapiens
actggccatggcctg

SEQ ID NO: 2343151 - DNA, 22 bp, Homo sapiens
actggcccctgacccagggact

SEQ ID NO: 2343152 - DNA, 18 bp, Homo sapiens
actggcttacctcctcat

SEQ ID NO: 2343153 - DNA, 13 bp, Homo sapiens
actggcttcagca

SEQ ID NO: 2343154 - DNA, 15 bp, Homo sapiens
actggcttcagcaag

SEQ ID NO: 2343155 - DNA, 16 bp, Homo sapiens
actgggaacccctttc

SEQ ID NO: 2343156 - DNA, 14 bp, Homo sapiens
actgggaggcaggg

SEQ ID NO: 2343157 - DNA, 17 bp, Homo sapiens
actgggaggctcccctt

SEQ ID NO: 2343158 - DNA, 16 bp, Homo sapiens
actgggtgcgtctcca

SEQ ID NO: 2343159 - DNA, 19 bp, Homo sapiens
actgggtgcgtctccagtc

SEQ ID NO: 2343160 - DNA, 15 bp, Homo sapiens
actgggttgcgggac

SEQ ID NO: 2343161 - DNA, 16 bp, Homo sapiens
actggtgaatataaat

SEQ ID NO: 2343162 - DNA, 18 bp, Homo sapiens
actggtgaatataaatga

SEQ ID NO: 2343163 - DNA, 19 bp, Homo sapiens
actggtgaatataaatgat

SEQ ID NO: 2343164 - DNA, 15 bp, Homo sapiens
actggttactttcaa

SEQ ID NO: 2343165 - DNA, 22 bp, Homo sapiens
actggttggctcccgcggtgcc

SEQ ID NO: 2343166 - DNA, 17 bp, Homo sapiens
actgtaaacttctgcaa

SEQ ID NO: 2343167 - DNA, 20 bp, Homo sapiens
actgtaatacttctttgtta

SEQ ID NO: 2343168 - DNA, 15 bp, Homo sapiens
actgtagatatgtat

SEQ ID NO: 2343169 - DNA, 15 bp, Homo sapiens
actgtagccacagct

SEQ ID NO: 2343170 - DNA, 22 bp, Homo sapiens
actgtataaataggagaggatg

SEQ ID NO: 2343171 - DNA, 14 bp, Homo sapiens
actgtatattttgt

SEQ ID NO: 2343172 - DNA, 23 bp, Homo sapiens
actgtcagttctctgggaagtgg

SEQ ID NO: 2343173 - DNA, 15 bp, Homo sapiens
actgtctgtgaacag

SEQ ID NO: 2343174 - DNA, 14 bp, Homo sapiens
actgtcttcctcaa

SEQ ID NO: 2343175 - DNA, 20 bp, Homo sapiens
actgtcttcctcaaaataaa

SEQ ID NO: 2343176 - DNA, 16 bp, Homo sapiens
actgtgcaatacttag

SEQ ID NO: 2343177 - DNA, 12 bp, Homo sapiens
actgtgccacaa

SEQ ID NO: 2343178 - DNA, 23 bp, Homo sapiens
actgtgccacaatgcagttctga

SEQ ID NO: 2343179 - DNA, 12 bp, Homo sapiens
actgtgccactg

SEQ ID NO: 2343180 - DNA, 20 bp, Homo sapiens
actgtgccactgacttgctg

SEQ ID NO: 2343181 - DNA, 17 bp, Homo sapiens
actgtgctgttgttctc

SEQ ID NO: 2343182 - DNA, 12 bp, Homo sapiens
actgtggaggaa

SEQ ID NO: 2343183 - DNA, 12 bp, Homo sapiens
actgtgtacata

SEQ ID NO: 2343184 - DNA, 18 bp, Homo sapiens
actgtgtacataactgaa

SEQ ID NO: 2343185 - DNA, 14 bp, Homo sapiens
actgtgtactgttc

SEQ ID NO: 2343186 - DNA, 12 bp, Homo sapiens
actgttctgatt

SEQ ID NO: 2343187 - DNA, 13 bp, Homo sapiens
actgttctgttca

SEQ ID NO: 2343188 - DNA, 18 bp, Homo sapiens
actgttgagccccagtgc

SEQ ID NO: 2343189 - DNA, 19 bp, Homo sapiens
actgttgctttgaaaaatc

SEQ ID NO: 2343190 - DNA, 15 bp, Homo sapiens
actgttgtaagaatt

SEQ ID NO: 2343191 - DNA, 21 bp, Homo sapiens
actgttgtaagaattctgatt

SEQ ID NO: 2343192 - DNA, 23 bp, Homo sapiens
actgtttgatataccaaattaaa

SEQ ID NO: 2343193 - DNA, 22 bp, Homo sapiens
acttaactgaaatgcctgcttt

SEQ ID NO: 2343194 - DNA, 13 bp, Homo sapiens
acttaataactgt

SEQ ID NO: 2343195 - DNA, 18 bp, Homo sapiens
acttaataactgtgtact

SEQ ID NO: 2343196 - DNA, 18 bp, Homo sapiens
acttaattgccagcaaat

SEQ ID NO: 2343197 - DNA, 23 bp, Homo sapiens
acttacaaactttgtttgtcaca

SEQ ID NO: 2343198 - DNA, 13 bp, Homo sapiens
acttacaattttc

SEQ ID NO: 2343199 - DNA, 12 bp, Homo sapiens
acttagaaactg

SEQ ID NO: 2343200 - DNA, 17 bp, Homo sapiens
acttagcctttacctgt

SEQ ID NO: 2343201 - DNA, 11 bp, Homo sapiens
acttagctcag

SEQ ID NO: 2343202 - DNA, 12 bp, Homo sapiens
acttagctcagg

SEQ ID NO: 2343203 - DNA, 17 bp, Homo sapiens
acttagctcaggtgcct

SEQ ID NO: 2343204 - DNA, 21 bp, Homo sapiens
acttaggcttggctgccctgt

SEQ ID NO: 2343205 - DNA, 16 bp, Homo sapiens
acttagggaagaaaaa

SEQ ID NO: 2343206 - DNA, 20 bp, Homo sapiens
acttattattaataatgaag

SEQ ID NO: 2343207 - DNA, 15 bp, Homo sapiens
acttattgaatatat

SEQ ID NO: 2343208 - DNA, 18 bp, Homo sapiens
acttattgaatatatgat

SEQ ID NO: 2343209 - DNA, 20 bp, Homo sapiens
acttattggaactctgcttg

SEQ ID NO: 2343210 - DNA, 21 bp, Homo sapiens
acttattggaactctgcttga

SEQ ID NO: 2343211 - DNA, 22 bp, Homo sapiens
acttcatgtaattttattttaa

SEQ ID NO: 2343212 - DNA, 17 bp, Homo sapiens
acttccaaagaaagttc

SEQ ID NO: 2343213 - DNA, 16 bp, Homo sapiens
acttccagagccagaa

SEQ ID NO: 2343214 - DNA, 22 bp, Homo sapiens
acttcccattaaaaatgagatt

SEQ ID NO: 2343215 - DNA, 23 bp, Homo sapiens
acttcctggtgaggcccagcctg

SEQ ID NO: 2343216 - DNA, 15 bp, Homo sapiens
acttccttactttta

SEQ ID NO: 2343217 - DNA, 16 bp, Homo sapiens
acttccttatttctga

SEQ ID NO: 2343218 - DNA, 21 bp, Homo sapiens
acttctcaagtaacatgactt

SEQ ID NO: 2343219 - DNA, 19 bp, Homo sapiens
acttctcggaattcataat

SEQ ID NO: 2343220 - DNA, 22 bp, Homo sapiens
acttctcggaattcataataaa

SEQ ID NO: 2343221 - DNA, 22 bp, Homo sapiens
acttctgatactttagtacaat

SEQ ID NO: 2343222 - DNA, 18 bp, Homo sapiens
acttctgcaacaagcatg

SEQ ID NO: 2343223 - DNA, 19 bp, Homo sapiens
acttctgcaacaagcatgc

SEQ ID NO: 2343224 - DNA, 13 bp, Homo sapiens
acttcttctctta

SEQ ID NO: 2343225 - DNA, 18 bp, Homo sapiens
acttcttctcttagattc

SEQ ID NO: 2343226 - DNA, 24 bp, Homo sapiens
acttcttgaaacagcctgggtgac

SEQ ID NO: 2343227 - DNA, 21 bp, Homo sapiens
acttcttgaatataaaaaatc

SEQ ID NO: 2343228 - DNA, 23 bp, Homo sapiens
acttgaataactctttttcagag

SEQ ID NO: 2343229 - DNA, 17 bp, Homo sapiens
acttgagacaatgtttt

SEQ ID NO: 2343230 - DNA, 21 bp, Homo sapiens
acttgagacaatgttttcttc

SEQ ID NO: 2343231 - DNA, 21 bp, Homo sapiens
acttgccattccaaaatatta

SEQ ID NO: 2343232 - DNA, 13 bp, Homo sapiens
acttgctgctgtc

SEQ ID NO: 2343233 - DNA, 13 bp, Homo sapiens
acttgctgtccag

SEQ ID NO: 2343234 - DNA, 13 bp, Homo sapiens
acttgctgtgtga

SEQ ID NO: 2343235 - DNA, 19 bp, Homo sapiens
acttgcttaaatttcttat

SEQ ID NO: 2343236 - DNA, 17 bp, Homo sapiens
acttggttttatggtta

SEQ ID NO: 2343237 - DNA, 22 bp, Homo sapiens
acttgtcatagactcctttgct

SEQ ID NO: 2343238 - DNA, 15 bp, Homo sapiens
acttgtggcctcaag

SEQ ID NO: 2343239 - DNA, 15 bp, Homo sapiens
actttaaattgtgga

SEQ ID NO: 2343240 - DNA, 22 bp, Homo sapiens
actttaattaccaacctgttac

SEQ ID NO: 2343241 - DNA, 21 bp, Homo sapiens
actttaattatatattttcat

SEQ ID NO: 2343242 - DNA, 23 bp, Homo sapiens
actttaattatatattttcatcc

SEQ ID NO: 2343243 - DNA, 13 bp, Homo sapiens
actttacccacct

SEQ ID NO: 2343244 - DNA, 13 bp, Homo sapiens
actttatcatgaa

SEQ ID NO: 2343245 - DNA, 16 bp, Homo sapiens
actttatcatgaatgc

SEQ ID NO: 2343246 - DNA, 18 bp, Homo sapiens
actttcacgtggcctccg

SEQ ID NO: 2343247 - DNA, 23 bp, Homo sapiens
actttcacgtggcctccgcagtg

SEQ ID NO: 2343248 - DNA, 15 bp, Homo sapiens
actttcacttcttcc

SEQ ID NO: 2343249 - DNA, 12 bp, Homo sapiens
actttcccacac

SEQ ID NO: 2343250 - DNA, 15 bp, Homo sapiens
actttcccacactgt

SEQ ID NO: 2343251 - DNA, 18 bp, Homo sapiens
actttcccacactgtgaa

SEQ ID NO: 2343252 - DNA, 17 bp, Homo sapiens
actttctcagttttcat

SEQ ID NO: 2343253 - DNA, 14 bp, Homo sapiens
actttctgttatgg

SEQ ID NO: 2343254 - DNA, 15 bp, Homo sapiens
actttcttgcatgaa

SEQ ID NO: 2343255 - DNA, 16 bp, Homo sapiens
actttgaaaagttgga

SEQ ID NO: 2343256 - DNA, 19 bp, Homo sapiens
actttgaagggcaagaaat

SEQ ID NO: 2343257 - DNA, 20 bp, Homo sapiens
actttgactttttgcattta

SEQ ID NO: 2343258 - DNA, 16 bp, Homo sapiens
agccagcagcagccca

SEQ ID NO: 2343259 - DNA, 24 bp, Homo sapiens
agccagccaagctttaaattatgt

SEQ ID NO: 2343260 - DNA, 13 bp, Homo sapiens
agccagcttagca

SEQ ID NO: 2343261 - DNA, 16 bp, Homo sapiens
agccagcttagcaact

SEQ ID NO: 2343262 - DNA, 12 bp, Homo sapiens
agccagcttggg

SEQ ID NO: 2343263 - DNA, 14 bp, Homo sapiens
agccaggatcatgg

SEQ ID NO: 2343264 - DNA, 18 bp, Homo sapiens
agccaggatcatggtgta

SEQ ID NO: 2343265 - DNA, 11 bp, Homo sapiens
agccaggcaga

SEQ ID NO: 2343266 - DNA, 13 bp, Homo sapiens
agccaggcagagg

SEQ ID NO: 2343267 - DNA, 12 bp, Homo sapiens
agccaggcctgg

SEQ ID NO: 2343268 - DNA, 17 bp, Homo sapiens
agccaggtttagcggca

SEQ ID NO: 2343269 - DNA, 17 bp, Homo sapiens
agccatacataaaagaa

SEQ ID NO: 2343270 - DNA, 22 bp, Homo sapiens
agccatacataaaagaaataaa

SEQ ID NO: 2343271 - DNA, 23 bp, Homo sapiens
agccatacataaaagaaataaac

SEQ ID NO: 2343272 - DNA, 18 bp, Homo sapiens
agccatattcacacctca

SEQ ID NO: 2343273 - DNA, 22 bp, Homo sapiens
agccatcggtgaaactaacaga

SEQ ID NO: 2343274 - DNA, 14 bp, Homo sapiens
agccatgccagctg

SEQ ID NO: 2343275 - DNA, 21 bp, Homo sapiens
agccatgtcttctccctggaa

SEQ ID NO: 2343276 - DNA, 14 bp, Homo sapiens
agccattttgtgaa

SEQ ID NO: 2343277 - DNA, 19 bp, Homo sapiens
agccattttttgaggagag

SEQ ID NO: 2343278 - DNA, 23 bp, Homo sapiens
agcccacgcccgactagcaggca

SEQ ID NO: 2343279 - DNA, 12 bp, Homo sapiens
agcccagagact

SEQ ID NO: 2343280 - DNA, 18 bp, Homo sapiens
agcccagaggtaacagaa

SEQ ID NO: 2343281 - DNA, 20 bp, Homo sapiens
agcccagattcccctgtgtc

SEQ ID NO: 2343282 - DNA, 19 bp, Homo sapiens
agcccagcagtgtggagac

SEQ ID NO: 2343283 - DNA, 22 bp, Homo sapiens
agcccagcagtgtggagaccct

SEQ ID NO: 2343284 - DNA, 14 bp, Homo sapiens
agcccagccccgcc

SEQ ID NO: 2343285 - DNA, 21 bp, Homo sapiens
agcccaggatactggcacaga

SEQ ID NO: 2343286 - DNA, 22 bp, Homo sapiens
agcccagggcatcttgctggct

SEQ ID NO: 2343287 - DNA, 12 bp, Homo sapiens
agccccactgcc

SEQ ID NO: 2343288 - DNA, 14 bp, Homo sapiens
agccccactgccag

SEQ ID NO: 2343289 - DNA, 15 bp, Homo sapiens
agccccactgccagc

SEQ ID NO: 2343290 - DNA, 19 bp, Homo sapiens
agccccactgccagcagca

SEQ ID NO: 2343291 - DNA, 20 bp, Homo sapiens
agccccatcagaacctgagc

SEQ ID NO: 2343292 - DNA, 22 bp, Homo sapiens
agcccccaccctgttcctgctg

SEQ ID NO: 2343293 - DNA, 23 bp, Homo sapiens
agcccccagcagaggcaggctgg

SEQ ID NO: 2343294 - DNA, 22 bp, Homo sapiens
agccccccccttgaatctgcag

SEQ ID NO: 2343295 - DNA, 16 bp, Homo sapiens
agcccccgccccagag

SEQ ID NO: 2343296 - DNA, 20 bp, Homo sapiens
agccccggcaagccacagga

SEQ ID NO: 2343297 - DNA, 24 bp, Homo sapiens
agccccggggtgagtccattctcc

SEQ ID NO: 2343298 - DNA, 16 bp, Homo sapiens
agcccctactgctgtg

SEQ ID NO: 2343299 - DNA, 23 bp, Homo sapiens
agcccctactgctgtgaaccctg

SEQ ID NO: 2343300 - DNA, 14 bp, Homo sapiens
agcccctgggccca

SEQ ID NO: 2343301 - DNA, 21 bp, Homo sapiens
agcccctggggcccagcccct

SEQ ID NO: 2343302 - DNA, 19 bp, Homo sapiens
agcccgcagggccatgcag

SEQ ID NO: 2343303 - DNA, 21 bp, Homo sapiens
agcccgcagggccatgcagac

SEQ ID NO: 2343304 - DNA, 17 bp, Homo sapiens
agccctaaccccttcca

SEQ ID NO: 2343305 - DNA, 18 bp, Homo sapiens
agccctaaccccttccag

SEQ ID NO: 2343306 - DNA, 16 bp, Homo sapiens
agccctactccctgca

SEQ ID NO: 2343307 - DNA, 18 bp, Homo sapiens
agccctactccctgcaga

SEQ ID NO: 2343308 - DNA, 20 bp, Homo sapiens
agccctactccctgcagatg

SEQ ID NO: 2343309 - DNA, 23 bp, Homo sapiens
agccctcgggtccatagagatga

SEQ ID NO: 2343310 - DNA, 22 bp, Homo sapiens
agccctgcagcccaccagacgt

SEQ ID NO: 2343311 - DNA, 12 bp, Homo sapiens
agcccttgcctc

SEQ ID NO: 2343312 - DNA, 14 bp, Homo sapiens
agcccttgcctccc

SEQ ID NO: 2343313 - DNA, 19 bp, Homo sapiens
agccgcggggaagctggct

SEQ ID NO: 2343314 - DNA, 21 bp, Homo sapiens
agccgcggggaagctggcttt

SEQ ID NO: 2343315 - DNA, 14 bp, Homo sapiens
agccgggcccctgg

SEQ ID NO: 2343316 - DNA, 16 bp, Homo sapiens
agccgggcccctgggc

SEQ ID NO: 2343317 - DNA, 23 bp, Homo sapiens
agccggggccttatcgggctcca

SEQ ID NO: 2343318 - DNA, 15 bp, Homo sapiens
agccgggggctggcc

SEQ ID NO: 2343319 - DNA, 15 bp, Homo sapiens
agccgtggtccctga

SEQ ID NO: 2343320 - DNA, 21 bp, Homo sapiens
agcctaaagtatacaactgcc

SEQ ID NO: 2343321 - DNA, 19 bp, Homo sapiens
agcctagacaacctttctg

SEQ ID NO: 2343322 - DNA, 19 bp, Homo sapiens
agcctatcaaaggaaatga

SEQ ID NO: 2343323 - DNA, 15 bp, Homo sapiens
agcctcatgacttta

SEQ ID NO: 2343324 - DNA, 20 bp, Homo sapiens
agcctccaagcacagagcct

SEQ ID NO: 2343325 - DNA, 23 bp, Homo sapiens
agcctccaagcacagagcctggc

SEQ ID NO: 2343326 - DNA, 13 bp, Homo sapiens
agcctccacagcg

SEQ ID NO: 2343327 - DNA, 21 bp, Homo sapiens
agcctccccatctgtccagct

SEQ ID NO: 2343328 - DNA, 16 bp, Homo sapiens
agcctccgagagggag

SEQ ID NO: 2343329 - DNA, 14 bp, Homo sapiens
agcctcctctggac

SEQ ID NO: 2343330 - DNA, 14 bp, Homo sapiens
agcctcctgtgcct

SEQ ID NO: 2343331 - DNA, 16 bp, Homo sapiens
agcctcctgtgcctgg

SEQ ID NO: 2343332 - DNA, 17 bp, Homo sapiens
agcctcctgtgcctggc

SEQ ID NO: 2343333 - DNA, 21 bp, Homo sapiens
agcctcctgtgcctggcccca

SEQ ID NO: 2343334 - DNA, 14 bp, Homo sapiens
agcctctggacagc

SEQ ID NO: 2343335 - DNA, 16 bp, Homo sapiens
agcctgaacagaagct

SEQ ID NO: 2343336 - DNA, 17 bp, Homo sapiens
agcctgaggtcccctcg

SEQ ID NO: 2343337 - DNA, 22 bp, Homo sapiens
agcctgcattgagcttgcatgc

SEQ ID NO: 2343338 - DNA, 23 bp, Homo sapiens
agcctgcattgagcttgcatgct

SEQ ID NO: 2343339 - DNA, 20 bp, Homo sapiens
agcctgccctcactccctct

SEQ ID NO: 2343340 - DNA, 23 bp, Homo sapiens
agcctgccctcactccctctgca

SEQ ID NO: 2343341 - DNA, 23 bp, Homo sapiens
agcctgccgccgtctctgtcccg

SEQ ID NO: 2343342 - DNA, 10 bp, Homo sapiens
agcctgctgg

SEQ ID NO: 2343343 - DNA, 12 bp, Homo sapiens
agcctgctggaa

SEQ ID NO: 2343344 - DNA, 19 bp, Homo sapiens
agcctgctggaagcccagc

SEQ ID NO: 2343345 - DNA, 11 bp, Homo sapiens
agcctgctggc

SEQ ID NO: 2343346 - DNA, 17 bp, Homo sapiens
agcctgctggcacccac

SEQ ID NO: 2343347 - DNA, 21 bp, Homo sapiens
agcctggactaaaggcatcct

SEQ ID NO: 2343348 - DNA, 14 bp, Homo sapiens
agcctggccaccag

SEQ ID NO: 2343349 - DNA, 13 bp, Homo sapiens
agcctggccccag

SEQ ID NO: 2343350 - DNA, 19 bp, Homo sapiens
agcctggggcactcctcct

SEQ ID NO: 2343351 - DNA, 21 bp, Homo sapiens
agcctgtcctggtacagcagg

SEQ ID NO: 2343352 - DNA, 20 bp, Homo sapiens
agccttcaaaactatagctt

SEQ ID NO: 2343353 - DNA, 17 bp, Homo sapiens
agccttccaactagctg

SEQ ID NO: 2343354 - DNA, 21 bp, Homo sapiens
agccttccaactagctgggac

SEQ ID NO: 2343355 - DNA, 22 bp, Homo sapiens
agccttccagggatttgcctca

SEQ ID NO: 2343356 - DNA, 20 bp, Homo sapiens
agccttctccctagctcctc

SEQ ID NO: 2343357 - DNA, 15 bp, Homo sapiens
agccttggaaccagc

SEQ ID NO: 2343358 - DNA, 15 bp, Homo sapiens
agccttgtccccctc

SEQ ID NO: 2343359 - DNA, 15 bp, Homo sapiens
agcctttgaatgtaa

SEQ ID NO: 2343360 - DNA, 17 bp, Homo sapiens
agcctttgaatgtaacc

SEQ ID NO: 2343361 - DNA, 15 bp, Homo sapiens
agcgagggcagctgc

SEQ ID NO: 2343362 - DNA, 16 bp, Homo sapiens
agcgatctctccactg

SEQ ID NO: 2343363 - DNA, 19 bp, Homo sapiens
agcgccagcctcagactgg

SEQ ID NO: 2343364 - DNA, 20 bp, Homo sapiens
agcgccaggaagccagagcc

SEQ ID NO: 2343365 - DNA, 22 bp, Homo sapiens
agcgccaggaagccagagcccc

SEQ ID NO: 2343366 - DNA, 22 bp, Homo sapiens
agcgccctcactattcttggac

SEQ ID NO: 2343367 - DNA, 15 bp, Homo sapiens
agcggctcccctctg

SEQ ID NO: 2343368 - DNA, 19 bp, Homo sapiens
agcgtatatacttaagaat

SEQ ID NO: 2343369 - DNA, 15 bp, Homo sapiens
agcgtcagctgctcc

SEQ ID NO: 2343370 - DNA, 19 bp, Homo sapiens
agctaaaccaaggactgag

SEQ ID NO: 2343371 - DNA, 23 bp, Homo sapiens
agctaaactccttcctggcctga

SEQ ID NO: 2343372 - DNA, 13 bp, Homo sapiens
agctaaagaggct

SEQ ID NO: 2343373 - DNA, 16 bp, Homo sapiens
agctacaaacttttaa

SEQ ID NO: 2343374 - DNA, 16 bp, Homo sapiens
agagctagaaaaataa

SEQ ID NO: 2343375 - DNA, 21 bp, Homo sapiens
agagctagaaaaataaaatgt

SEQ ID NO: 2343376 - DNA, 17 bp, Homo sapiens
agagctatcaggagaaa

SEQ ID NO: 2343377 - DNA, 16 bp, Homo sapiens
agagctcaccatggaa

SEQ ID NO: 2343378 - DNA, 23 bp, Homo sapiens
agagctggagcccccagcagagg

SEQ ID NO: 2343379 - DNA, 15 bp, Homo sapiens
agaggaatcctggca

SEQ ID NO: 2343380 - DNA, 17 bp, Homo sapiens
agaggaatcctggcagc

SEQ ID NO: 2343381 - DNA, 22 bp, Homo sapiens
agaggacgcacgctcgctgcca

SEQ ID NO: 2343382 - DNA, 15 bp, Homo sapiens
agaggagcttttctg

SEQ ID NO: 2343383 - DNA, 14 bp, Homo sapiens
agaggagggcagag

SEQ ID NO: 2343384 - DNA, 18 bp, Homo sapiens
agaggagggcagagggag

SEQ ID NO: 2343385 - DNA, 22 bp, Homo sapiens
agaggatgagagcccagaggta

SEQ ID NO: 2343386 - DNA, 13 bp, Homo sapiens
agaggatgccttt

SEQ ID NO: 2343387 - DNA, 21 bp, Homo sapiens
agaggatgtggcctggttcaa

SEQ ID NO: 2343388 - DNA, 16 bp, Homo sapiens
agaggcaagctgaaat

SEQ ID NO: 2343389 - DNA, 15 bp, Homo sapiens
agaggcacctgctgg

SEQ ID NO: 2343390 - DNA, 19 bp, Homo sapiens
agaggcactcagtgagcct

SEQ ID NO: 2343391 - DNA, 17 bp, Homo sapiens
agaggcagtgatgactt

SEQ ID NO: 2343392 - DNA, 16 bp, Homo sapiens
agaggcatacacacag

SEQ ID NO: 2343393 - DNA, 22 bp, Homo sapiens
agaggccagttgatctgctctg

SEQ ID NO: 2343394 - DNA, 12 bp, Homo sapiens
agaggctctgga

SEQ ID NO: 2343395 - DNA, 22 bp, Homo sapiens
agaggctctggacagcagaagc

SEQ ID NO: 2343396 - DNA, 22 bp, Homo sapiens
agaggctgcacccctgggccag

SEQ ID NO: 2343397 - DNA, 12 bp, Homo sapiens
agaggctgcccc

SEQ ID NO: 2343398 - DNA, 16 bp, Homo sapiens
agaggctgcccctctc

SEQ ID NO: 2343399 - DNA, 22 bp, Homo sapiens
agaggctgggagtccctacctg

SEQ ID NO: 2343400 - DNA, 12 bp, Homo sapiens
agaggcttctcc

SEQ ID NO: 2343401 - DNA, 18 bp, Homo sapiens
agaggcttgaaggccagc

SEQ ID NO: 2343402 - DNA, 21 bp, Homo sapiens
agaggcttgaaggccagcagc

SEQ ID NO: 2343403 - DNA, 14 bp, Homo sapiens
agaggcttgtttac

SEQ ID NO: 2343404 - DNA, 12 bp, Homo sapiens
agagggagagag

SEQ ID NO: 2343405 - DNA, 13 bp, Homo sapiens
agagggagagaga

SEQ ID NO: 2343406 - DNA, 13 bp, Homo sapiens
agagggcttcctc

SEQ ID NO: 2343407 - DNA, 22 bp, Homo sapiens
agagggcttcctctagaagcca

SEQ ID NO: 2343408 - DNA, 12 bp, Homo sapiens
agagggggcctg

SEQ ID NO: 2343409 - DNA, 19 bp, Homo sapiens
agagggggcctgggacttc

SEQ ID NO: 2343410 - DNA, 19 bp, Homo sapiens
agagggggtggaggggtgt

SEQ ID NO: 2343411 - DNA, 16 bp, Homo sapiens
agaggtaacagaacag

SEQ ID NO: 2343412 - DNA, 17 bp, Homo sapiens
agaggtaacagaacagc

SEQ ID NO: 2343413 - DNA, 15 bp, Homo sapiens
agaggtagcgagctg

SEQ ID NO: 2343414 - DNA, 19 bp, Homo sapiens
agaggttttaatgtctgtt

SEQ ID NO: 2343415 - DNA, 13 bp, Homo sapiens
agagtaaagcaac

SEQ ID NO: 2343416 - DNA, 14 bp, Homo sapiens
agagtaccatgctg

SEQ ID NO: 2343417 - DNA, 21 bp, Homo sapiens
agagtatttcccttccaaaga

SEQ ID NO: 2343418 - DNA, 22 bp, Homo sapiens
agagtccagtgctctgcctcag

SEQ ID NO: 2343419 - DNA, 14 bp, Homo sapiens
agagtgtagaagca

SEQ ID NO: 2343420 - DNA, 12 bp, Homo sapiens
agagttaagaag

SEQ ID NO: 2343421 - DNA, 14 bp, Homo sapiens
agagttaagaagct

SEQ ID NO: 2343422 - DNA, 16 bp, Homo sapiens
agagttaagaagctgt

SEQ ID NO: 2343423 - DNA, 21 bp, Homo sapiens
agagttaagaagctgttgtac

SEQ ID NO: 2343424 - DNA, 17 bp, Homo sapiens
agagttccttctcactt

SEQ ID NO: 2343425 - DNA, 20 bp, Homo sapiens
agagtttcagtttgttggaa

SEQ ID NO: 2343426 - DNA, 12 bp, Homo sapiens
agagttttggga

SEQ ID NO: 2343427 - DNA, 23 bp, Homo sapiens
agataaaaggtggagtttctctg

SEQ ID NO: 2343428 - DNA, 12 bp, Homo sapiens
agataacataaa

SEQ ID NO: 2343429 - DNA, 17 bp, Homo sapiens
agataactctctttcct

SEQ ID NO: 2343430 - DNA, 22 bp, Homo sapiens
agataagcaagagagatgtttt

SEQ ID NO: 2343431 - DNA, 15 bp, Homo sapiens
agataatatttttgt

SEQ ID NO: 2343432 - DNA, 16 bp, Homo sapiens
agataatttcagggtg

SEQ ID NO: 2343433 - DNA, 13 bp, Homo sapiens
agatacaataaaa

SEQ ID NO: 2343434 - DNA, 19 bp, Homo sapiens
agataccttatcttacaat

SEQ ID NO: 2343435 - DNA, 21 bp, Homo sapiens
agatatcctctccccctcctc

SEQ ID NO: 2343436 - DNA, 18 bp, Homo sapiens
agatatgaacatattgtt

SEQ ID NO: 2343437 - DNA, 14 bp, Homo sapiens
agatatgtattctt

SEQ ID NO: 2343438 - DNA, 18 bp, Homo sapiens
agatcaagaaaaaaaggg

SEQ ID NO: 2343439 - DNA, 19 bp, Homo sapiens
agatcactttctcagtttt

SEQ ID NO: 2343440 - DNA, 23 bp, Homo sapiens
agatcactttctcagttttcata

SEQ ID NO: 2343441 - DNA, 18 bp, Homo sapiens
agatccatttccattgct

SEQ ID NO: 2343442 - DNA, 16 bp, Homo sapiens
agatccctgcagaacc

SEQ ID NO: 2343443 - DNA, 18 bp, Homo sapiens
agatcgagaccatcctgg

SEQ ID NO: 2343444 - DNA, 16 bp, Homo sapiens
agatctcactctgccc

SEQ ID NO: 2343445 - DNA, 14 bp, Homo sapiens
agatctgatcaaga

SEQ ID NO: 2343446 - DNA, 23 bp, Homo sapiens
agatctgttttgtggtttggaat

SEQ ID NO: 2343447 - DNA, 19 bp, Homo sapiens
agatctttcagaaatataa

SEQ ID NO: 2343448 - DNA, 17 bp, Homo sapiens
agatctttctcttccct

SEQ ID NO: 2343449 - DNA, 20 bp, Homo sapiens
agatctttctcttccctgaa

SEQ ID NO: 2343450 - DNA, 19 bp, Homo sapiens
agatctttttttaagtgtt

SEQ ID NO: 2343451 - DNA, 16 bp, Homo sapiens
agatgaaggggctctt

SEQ ID NO: 2343452 - DNA, 11 bp, Homo sapiens
agatgagccca

SEQ ID NO: 2343453 - DNA, 15 bp, Homo sapiens
agatgaggaggggag

SEQ ID NO: 2343454 - DNA, 20 bp, Homo sapiens
agatgaggagtaaaattcag

SEQ ID NO: 2343455 - DNA, 18 bp, Homo sapiens
agatgaggtcagttgtgt

SEQ ID NO: 2343456 - DNA, 15 bp, Homo sapiens
agatgattttttgaa

SEQ ID NO: 2343457 - DNA, 17 bp, Homo sapiens
agatgattttttgaaag

SEQ ID NO: 2343458 - DNA, 14 bp, Homo sapiens
agatgcagagagcc

SEQ ID NO: 2343459 - DNA, 15 bp, Homo sapiens
agatgcagagagcca

SEQ ID NO: 2343460 - DNA, 19 bp, Homo sapiens
agatgcagagagccatttt

SEQ ID NO: 2343461 - DNA, 23 bp, Homo sapiens
agatgctgtcattagtctatatg

SEQ ID NO: 2343462 - DNA, 15 bp, Homo sapiens
agatggaatggaaaa

SEQ ID NO: 2343463 - DNA, 17 bp, Homo sapiens
agatggacacgagccac

SEQ ID NO: 2343464 - DNA, 23 bp, Homo sapiens
agatggacacgagccacaagctg

SEQ ID NO: 2343465 - DNA, 17 bp, Homo sapiens
agatggagttcttgtgc

SEQ ID NO: 2343466 - DNA, 19 bp, Homo sapiens
agatggagttcttgtgcca

SEQ ID NO: 2343467 - DNA, 23 bp, Homo sapiens
agatggcatatatgtgatctggg

SEQ ID NO: 2343468 - DNA, 23 bp, Homo sapiens
agatggctgtggcatttccaaac

SEQ ID NO: 2343469 - DNA, 13 bp, Homo sapiens
agatgggaatgag

SEQ ID NO: 2343470 - DNA, 16 bp, Homo sapiens
agatgggggcagggct

SEQ ID NO: 2343471 - DNA, 17 bp, Homo sapiens
agatggttaaacatttt

SEQ ID NO: 2343472 - DNA, 14 bp, Homo sapiens
agatgtcttccctg

SEQ ID NO: 2343473 - DNA, 19 bp, Homo sapiens
agatgtcttccctgggctg

SEQ ID NO: 2343474 - DNA, 22 bp, Homo sapiens
agatgtgaattattgacactga

SEQ ID NO: 2343475 - DNA, 20 bp, Homo sapiens
agatgtgagccaccgtgcct

SEQ ID NO: 2343476 - DNA, 14 bp, Homo sapiens
agatgtgagccttg

SEQ ID NO: 2343477 - DNA, 21 bp, Homo sapiens
agatgtgagccttgtgcatgt

SEQ ID NO: 2343478 - DNA, 21 bp, Homo sapiens
agatgtgtcccccccaggcct

SEQ ID NO: 2343479 - DNA, 15 bp, Homo sapiens
agattaataagattt

SEQ ID NO: 2343480 - DNA, 17 bp, Homo sapiens
agattattttttaaaaa

SEQ ID NO: 2343481 - DNA, 14 bp, Homo sapiens
agattcaaggcccc

SEQ ID NO: 2343482 - DNA, 13 bp, Homo sapiens
agattctaaagct

SEQ ID NO: 2343483 - DNA, 13 bp, Homo sapiens
agattgacctgga

SEQ ID NO: 2343484 - DNA, 12 bp, Homo sapiens
agattgagaaat

SEQ ID NO: 2343485 - DNA, 16 bp, Homo sapiens
agattgagaaatgtgt

SEQ ID NO: 2343486 - DNA, 16 bp, Homo sapiens
agattgctctgcccca

SEQ ID NO: 2343487 - DNA, 21 bp, Homo sapiens
agattgcttaaaagcattttt

SEQ ID NO: 2343488 - DNA, 23 bp, Homo sapiens
agattgggatactgtaatacttc

SEQ ID NO: 2343489 - DNA, 22 bp, Homo sapiens
agatttaagtgaatacattaac

SEQ ID NO: 2343490 - DNA, 15 bp, Homo sapiens
agatttcatatctaa

SEQ ID NO: 2343491 - DNA, 16 bp, Homo sapiens
agatttctcattgact

SEQ ID NO: 2343492 - DNA, 15 bp, Homo sapiens
agatttctgaggaaa

SEQ ID NO: 2343493 - DNA, 17 bp, Homo sapiens
agattttcctcttgtga

SEQ ID NO: 2343494 - DNA, 20 bp, Homo sapiens
agattttcctcttgtgattt

SEQ ID NO: 2343495 - DNA, 14 bp, Homo sapiens
agatttttcaaaat

SEQ ID NO: 2343496 - DNA, 23 bp, Homo sapiens
agcaaaaaaaaaaaaaagcatct

SEQ ID NO: 2343497 - DNA, 17 bp, Homo sapiens
agcaaaacagttctcag

SEQ ID NO: 2343498 - DNA, 21 bp, Homo sapiens
agcaaaatctaaaatgtttta

SEQ ID NO: 2343499 - DNA, 14 bp, Homo sapiens
agcaaacccagagg

SEQ ID NO: 2343500 - DNA, 13 bp, Homo sapiens
agcaaactctttt

SEQ ID NO: 2343501 - DNA, 21 bp, Homo sapiens
agcaaataaatacgtgtcaaa

SEQ ID NO: 2343502 - DNA, 15 bp, Homo sapiens
agcaacaatttatga

SEQ ID NO: 2343503 - DNA, 23 bp, Homo sapiens
agcaacagcctttgaatgtaacc

SEQ ID NO: 2343504 - DNA, 24 bp, Homo sapiens
agcaacagcctttgaatgtaacca

SEQ ID NO: 2343505 - DNA, 14 bp, Homo sapiens
agcaacatttgtat

SEQ ID NO: 2343506 - DNA, 14 bp, Homo sapiens
agcaaccacattta

SEQ ID NO: 2343507 - DNA, 16 bp, Homo sapiens
agcaactaatgtttga

SEQ ID NO: 2343508 - DNA, 18 bp, Homo sapiens
agcaacttcttctccatc

SEQ ID NO: 2343509 - DNA, 12 bp, Homo sapiens
agcaagccagac

SEQ ID NO: 2343510 - DNA, 15 bp, Homo sapiens
agcaaggtgagaaat

SEQ ID NO: 2343511 - DNA, 22 bp, Homo sapiens
agcaagtacagcggctcccctc

SEQ ID NO: 2343512 - DNA, 16 bp, Homo sapiens
agcaagtgttcactgc

SEQ ID NO: 2343513 - DNA, 17 bp, Homo sapiens
agcaagtgttcactgct

SEQ ID NO: 2343514 - DNA, 17 bp, Homo sapiens
agcaatccacctgcctt

SEQ ID NO: 2343515 - DNA, 18 bp, Homo sapiens
agcaatccacctgccttg

SEQ ID NO: 2343516 - DNA, 14 bp, Homo sapiens
agcaatcctcctgc

SEQ ID NO: 2343517 - DNA, 17 bp, Homo sapiens
agcaatcctcctgcctc

SEQ ID NO: 2343518 - DNA, 22 bp, Homo sapiens
agcaatcctcctgcctcagcct

SEQ ID NO: 2343519 - DNA, 18 bp, Homo sapiens
agcacaaaaaatttaaga

SEQ ID NO: 2343520 - DNA, 17 bp, Homo sapiens
agcacagagcctggccc

SEQ ID NO: 2343521 - DNA, 12 bp, Homo sapiens
agcacagtattt

SEQ ID NO: 2343522 - DNA, 18 bp, Homo sapiens
agcacatccccctctcct

SEQ ID NO: 2343523 - DNA, 13 bp, Homo sapiens
agcaccacactgg

SEQ ID NO: 2343524 - DNA, 16 bp, Homo sapiens
agcacctccagcctga

SEQ ID NO: 2343525 - DNA, 17 bp, Homo sapiens
agcaccttcagggctga

SEQ ID NO: 2343526 - DNA, 18 bp, Homo sapiens
agcactacaccttgcctt

SEQ ID NO: 2343527 - DNA, 19 bp, Homo sapiens
agcactccgcatcacctca

SEQ ID NO: 2343528 - DNA, 16 bp, Homo sapiens
agcactcctgcttaat

SEQ ID NO: 2343529 - DNA, 20 bp, Homo sapiens
agcactcctgcttaatcttc

SEQ ID NO: 2343530 - DNA, 11 bp, Homo sapiens
agcactgagca

SEQ ID NO: 2343531 - DNA, 12 bp, Homo sapiens
agcactgagctc

SEQ ID NO: 2343532 - DNA, 21 bp, Homo sapiens
agcactgagctcacatgggac

SEQ ID NO: 2343533 - DNA, 15 bp, Homo sapiens
agcactgtaaacttc

SEQ ID NO: 2343534 - DNA, 16 bp, Homo sapiens
agcagaacctgcacac

SEQ ID NO: 2343535 - DNA, 20 bp, Homo sapiens
agcagaacctgcacacagga

SEQ ID NO: 2343536 - DNA, 23 bp, Homo sapiens
agcagaacctgcacacaggacag

SEQ ID NO: 2343537 - DNA, 23 bp, Homo sapiens
agcagaagcctccaagcacagag

SEQ ID NO: 2343538 - DNA, 16 bp, Homo sapiens
agcagaggcaggctgg

SEQ ID NO: 2343539 - DNA, 14 bp, Homo sapiens
agcagagttaaatc

SEQ ID NO: 2343540 - DNA, 17 bp, Homo sapiens
agcagatgcagagagcc

SEQ ID NO: 2343541 - DNA, 21 bp, Homo sapiens
agcagatgcagagagccattt

SEQ ID NO: 2343542 - DNA, 13 bp, Homo sapiens
agcagcacctcct

SEQ ID NO: 2343543 - DNA, 13 bp, Homo sapiens
agcagcagcaggt

SEQ ID NO: 2343544 - DNA, 12 bp, Homo sapiens
agcagcaggtga

SEQ ID NO: 2343545 - DNA, 13 bp, Homo sapiens
agcagcaggtgat

SEQ ID NO: 2343546 - DNA, 12 bp, Homo sapiens
agcagcctctgg

SEQ ID NO: 2343547 - DNA, 21 bp, Homo sapiens
agcagcctctggacagccagt

SEQ ID NO: 2343548 - DNA, 22 bp, Homo sapiens
agcagcctctggacagccagtg

SEQ ID NO: 2343549 - DNA, 20 bp, Homo sapiens
agcagctaaaccaaggactg

SEQ ID NO: 2343550 - DNA, 19 bp, Homo sapiens
agcagctccctttctcagg

SEQ ID NO: 2343551 - DNA, 20 bp, Homo sapiens
agcagctggctctccacctt

SEQ ID NO: 2343552 - DNA, 20 bp, Homo sapiens
agcagctggtcagtctttgc

SEQ ID NO: 2343553 - DNA, 14 bp, Homo sapiens
agcagcttggggag

SEQ ID NO: 2343554 - DNA, 19 bp, Homo sapiens
agcagggagagctcaccat

SEQ ID NO: 2343555 - DNA, 16 bp, Homo sapiens
agcagggtcttgctgt

SEQ ID NO: 2343556 - DNA, 15 bp, Homo sapiens
agcagtatatgttaa

SEQ ID NO: 2343557 - DNA, 16 bp, Homo sapiens
agcagtatattagtat

SEQ ID NO: 2343558 - DNA, 17 bp, Homo sapiens
agcagtcagagtccagt

SEQ ID NO: 2343559 - DNA, 16 bp, Homo sapiens
agcataatttaaaaat

SEQ ID NO: 2343560 - DNA, 20 bp, Homo sapiens
agcataatttaaaaatatat

SEQ ID NO: 2343561 - DNA, 21 bp, Homo sapiens
agcataatttaaaaatatatt

SEQ ID NO: 2343562 - DNA, 19 bp, Homo sapiens
agcatagataatattgttt

SEQ ID NO: 2343563 - DNA, 15 bp, Homo sapiens
agcatcccttcccac

SEQ ID NO: 2343564 - DNA, 15 bp, Homo sapiens
agcatctatctcatc

SEQ ID NO: 2343565 - DNA, 15 bp, Homo sapiens
agcatctgtccccct

SEQ ID NO: 2343566 - DNA, 18 bp, Homo sapiens
agcatcttcacttctaaa

SEQ ID NO: 2343567 - DNA, 13 bp, Homo sapiens
agcatgaaaaagc

SEQ ID NO: 2343568 - DNA, 14 bp, Homo sapiens
agcatgaaaaagca

SEQ ID NO: 2343569 - DNA, 14 bp, Homo sapiens
agcatgacagcctg

SEQ ID NO: 2343570 - DNA, 17 bp, Homo sapiens
agcatgcttcctttctc

SEQ ID NO: 2343571 - DNA, 18 bp, Homo sapiens
agcatgcttcctttctct

SEQ ID NO: 2343572 - DNA, 20 bp, Homo sapiens
agcatgcttcctttctctcc

SEQ ID NO: 2343573 - DNA, 22 bp, Homo sapiens
agcatgcttcctttctctcctg

SEQ ID NO: 2343574 - DNA, 18 bp, Homo sapiens
agcatggacatttagaag

SEQ ID NO: 2343575 - DNA, 14 bp, Homo sapiens
agcatgttcctcct

SEQ ID NO: 2343576 - DNA, 22 bp, Homo sapiens
agcatgttcctccttttcttca

SEQ ID NO: 2343577 - DNA, 15 bp, Homo sapiens
agcattccttctttg

SEQ ID NO: 2343578 - DNA, 17 bp, Homo sapiens
agcattccttctttgat

SEQ ID NO: 2343579 - DNA, 19 bp, Homo sapiens
agcattctcaggcaccagt

SEQ ID NO: 2343580 - DNA, 18 bp, Homo sapiens
agcatttagtcttgccag

SEQ ID NO: 2343581 - DNA, 18 bp, Homo sapiens
agcatttcatgaaaaagc

SEQ ID NO: 2343582 - DNA, 13 bp, Homo sapiens
agcatttttcaat

SEQ ID NO: 2343583 - DNA, 23 bp, Homo sapiens
agcatttttcaatatattgaact

SEQ ID NO: 2343584 - DNA, 14 bp, Homo sapiens
agccaaaagtccct

SEQ ID NO: 2343585 - DNA, 15 bp, Homo sapiens
agccaaaagtccctc

SEQ ID NO: 2343586 - DNA, 13 bp, Homo sapiens
agccaaagaaaaa

SEQ ID NO: 2343587 - DNA, 23 bp, Homo sapiens
agccaacaactctgcctttatga

SEQ ID NO: 2343588 - DNA, 19 bp, Homo sapiens
agccaagctttaaattatg

SEQ ID NO: 2343589 - DNA, 20 bp, Homo sapiens
agccaagctttaaattatgt

SEQ ID NO: 2343590 - DNA, 23 bp, Homo sapiens
agccaagggaaaggggtgctttt

SEQ ID NO: 2343591 - DNA, 20 bp, Homo sapiens
agccaagtggggtgctggga

SEQ ID NO: 2343592 - DNA, 20 bp, Homo sapiens
agccaatgtctcctcccctt

SEQ ID NO: 2343593 - DNA, 13 bp, Homo sapiens
agccacaggaagg

SEQ ID NO: 2343594 - DNA, 15 bp, Homo sapiens
agccacaggaaggag

SEQ ID NO: 2343595 - DNA, 17 bp, Homo sapiens
agccaccgtgcctggcc

SEQ ID NO: 2343596 - DNA, 19 bp, Homo sapiens
agccaccgtgcctggccag

SEQ ID NO: 2343597 - DNA, 12 bp, Homo sapiens
agccacctgcaa

SEQ ID NO: 2343598 - DNA, 19 bp, Homo sapiens
agccactcccctccactct

SEQ ID NO: 2343599 - DNA, 14 bp, Homo sapiens
agccagagacagag

SEQ ID NO: 2343600 - DNA, 22 bp, Homo sapiens
agccagagacagaggatgtggc

SEQ ID NO: 2343601 - DNA, 13 bp, Homo sapiens
agccagagcccca

SEQ ID NO: 2343602 - DNA, 14 bp, Homo sapiens
agccagagccccaa

SEQ ID NO: 2343603 - DNA, 16 bp, Homo sapiens
agccagagccccaagc

SEQ ID NO: 2343604 - DNA, 20 bp, Homo sapiens
agccagagccccaagcagga

SEQ ID NO: 2343605 - DNA, 16 bp, Homo sapiens
agccagaggagggcag

SEQ ID NO: 2343606 - DNA, 18 bp, Homo sapiens
agccagaggagggcagag

SEQ ID NO: 2343607 - DNA, 21 bp, Homo sapiens
agccagaggagggcagaggga

SEQ ID NO: 2343608 - DNA, 13 bp, Homo sapiens
aggccccagacag

SEQ ID NO: 2343609 - DNA, 22 bp, Homo sapiens
aggccctgactcctctggcttt

SEQ ID NO: 2343610 - DNA, 12 bp, Homo sapiens
aggccctgcccc

SEQ ID NO: 2343611 - DNA, 20 bp, Homo sapiens
aggccctgggctgggtgctg

SEQ ID NO: 2343612 - DNA, 16 bp, Homo sapiens
aggccctgttccctgg

SEQ ID NO: 2343613 - DNA, 17 bp, Homo sapiens
aggcccttgtcgtggga

SEQ ID NO: 2343614 - DNA, 13 bp, Homo sapiens
aggccggcccaga

SEQ ID NO: 2343615 - DNA, 21 bp, Homo sapiens
aggcctatttaacaagatgtt

SEQ ID NO: 2343616 - DNA, 15 bp, Homo sapiens
aggcctcaggtgctg

SEQ ID NO: 2343617 - DNA, 19 bp, Homo sapiens
aggcctgaagccagctgcc

SEQ ID NO: 2343618 - DNA, 20 bp, Homo sapiens
aggcctgaatcatgagcctg

SEQ ID NO: 2343619 - DNA, 12 bp, Homo sapiens
aggcctgagccc

SEQ ID NO: 2343620 - DNA, 14 bp, Homo sapiens
aggcctgagcccct

SEQ ID NO: 2343621 - DNA, 21 bp, Homo sapiens
aggcctggctggaggagcagc

SEQ ID NO: 2343622 - DNA, 16 bp, Homo sapiens
aggcgagtctggggac

SEQ ID NO: 2343623 - DNA, 16 bp, Homo sapiens
aggcgcgtctgcccca

SEQ ID NO: 2343624 - DNA, 19 bp, Homo sapiens
aggcgctgagactgtgctg

SEQ ID NO: 2343625 - DNA, 22 bp, Homo sapiens
aggcggaggctgtgctccgcca

SEQ ID NO: 2343626 - DNA, 19 bp, Homo sapiens
aggcgtcaccatccacctt

SEQ ID NO: 2343627 - DNA, 17 bp, Homo sapiens
aggctattttctaaaga

SEQ ID NO: 2343628 - DNA, 14 bp, Homo sapiens
aggctcactgccag

SEQ ID NO: 2343629 - DNA, 13 bp, Homo sapiens
aggctccagcaca

SEQ ID NO: 2343630 - DNA, 14 bp, Homo sapiens
aggctgaaaacaat

SEQ ID NO: 2343631 - DNA, 19 bp, Homo sapiens
aggctgccagacatggacc

SEQ ID NO: 2343632 - DNA, 12 bp, Homo sapiens
aggctggagacc

SEQ ID NO: 2343633 - DNA, 16 bp, Homo sapiens
aggctggatggcacct

SEQ ID NO: 2343634 - DNA, 20 bp, Homo sapiens
aggctggatggcacctcagg

SEQ ID NO: 2343635 - DNA, 18 bp, Homo sapiens
aggctgggccatgtccaa

SEQ ID NO: 2343636 - DNA, 21 bp, Homo sapiens
aggctgggccatgtccaaaga

SEQ ID NO: 2343637 - DNA, 22 bp, Homo sapiens
aggctgggccatgtccaaagag

SEQ ID NO: 2343638 - DNA, 19 bp, Homo sapiens
aggctgggggagagccgtg

SEQ ID NO: 2343639 - DNA, 22 bp, Homo sapiens
aggctgtaagcattctgagctg

SEQ ID NO: 2343640 - DNA, 15 bp, Homo sapiens
aggcttaggtgccag

SEQ ID NO: 2343641 - DNA, 21 bp, Homo sapiens
aggcttcctgcgtcctcctca

SEQ ID NO: 2343642 - DNA, 22 bp, Homo sapiens
aggcttcctgcgtcctcctcac

SEQ ID NO: 2343643 - DNA, 22 bp, Homo sapiens
aggcttctccgccagcctcctc

SEQ ID NO: 2343644 - DNA, 23 bp, Homo sapiens
aggcttctccgccagcctcctct

SEQ ID NO: 2343645 - DNA, 19 bp, Homo sapiens
aggcttctctccacagtgt

SEQ ID NO: 2343646 - DNA, 14 bp, Homo sapiens
aggcttctgctggg

SEQ ID NO: 2343647 - DNA, 13 bp, Homo sapiens
aggcttgaagctg

SEQ ID NO: 2343648 - DNA, 16 bp, Homo sapiens
aggcttgaaggccagc

SEQ ID NO: 2343649 - DNA, 16 bp, Homo sapiens
aggcttggctgccctg

SEQ ID NO: 2343650 - DNA, 17 bp, Homo sapiens
aggcttggctgccctgt

SEQ ID NO: 2343651 - DNA, 19 bp, Homo sapiens
aggcttggggaaaatggcc

SEQ ID NO: 2343652 - DNA, 16 bp, Homo sapiens
aggctttatgtacaaa

SEQ ID NO: 2343653 - DNA, 18 bp, Homo sapiens
aggctttggtaactgcgg

SEQ ID NO: 2343654 - DNA, 23 bp, Homo sapiens
agggaagaaaaagcaagtgttca

SEQ ID NO: 2343655 - DNA, 14 bp, Homo sapiens
agggaagcagggac

SEQ ID NO: 2343656 - DNA, 14 bp, Homo sapiens
agggaaggatttaa

SEQ ID NO: 2343657 - DNA, 15 bp, Homo sapiens
agggaaggatttaag

SEQ ID NO: 2343658 - DNA, 19 bp, Homo sapiens
agggaatccaagcctccac

SEQ ID NO: 2343659 - DNA, 22 bp, Homo sapiens
agggaattaaaaagaagatgaa

SEQ ID NO: 2343660 - DNA, 15 bp, Homo sapiens
agggacacacagcct

SEQ ID NO: 2343661 - DNA, 23 bp, Homo sapiens
agggacatttctataaaaatact

SEQ ID NO: 2343662 - DNA, 16 bp, Homo sapiens
agggaccctttggggg

SEQ ID NO: 2343663 - DNA, 22 bp, Homo sapiens
agggactacccatagacatgaa

SEQ ID NO: 2343664 - DNA, 18 bp, Homo sapiens
agggactgccaggctgtt

SEQ ID NO: 2343665 - DNA, 19 bp, Homo sapiens
agggagaataaaattccta

SEQ ID NO: 2343666 - DNA, 19 bp, Homo sapiens
agggagagctcaccatgga

SEQ ID NO: 2343667 - DNA, 15 bp, Homo sapiens
agggaggaaggcctt

SEQ ID NO: 2343668 - DNA, 19 bp, Homo sapiens
agggaggaaggcctttctt

SEQ ID NO: 2343669 - DNA, 12 bp, Homo sapiens
agggagtccagg

SEQ ID NO: 2343670 - DNA, 13 bp, Homo sapiens
agggagtccaggg

SEQ ID NO: 2343671 - DNA, 20 bp, Homo sapiens
agggagttttgtctgtctcc

SEQ ID NO: 2343672 - DNA, 13 bp, Homo sapiens
agggagtttttga

SEQ ID NO: 2343673 - DNA, 17 bp, Homo sapiens
agggatttgcctcacct

SEQ ID NO: 2343674 - DNA, 20 bp, Homo sapiens
agggatttgcctcaccttgg

SEQ ID NO: 2343675 - DNA, 20 bp, Homo sapiens
agggcaagaacccaagtgcc

SEQ ID NO: 2343676 - DNA, 22 bp, Homo sapiens
agggcaagaacccaagtgcctc

SEQ ID NO: 2343677 - DNA, 21 bp, Homo sapiens
agggcagacaatagtatagaa

SEQ ID NO: 2343678 - DNA, 20 bp, Homo sapiens
agggcaggatggcctttcct

SEQ ID NO: 2343679 - DNA, 17 bp, Homo sapiens
agggcaggcttggggaa

SEQ ID NO: 2343680 - DNA, 19 bp, Homo sapiens
agggcaggcttggggaaaa

SEQ ID NO: 2343681 - DNA, 11 bp, Homo sapiens
agggcagggtc

SEQ ID NO: 2343682 - DNA, 18 bp, Homo sapiens
agggccacatagatgctg

SEQ ID NO: 2343683 - DNA, 13 bp, Homo sapiens
agggccctgggca

SEQ ID NO: 2343684 - DNA, 14 bp, Homo sapiens
agggccctgggcag

SEQ ID NO: 2343685 - DNA, 19 bp, Homo sapiens
agggcctctccaaccactg

SEQ ID NO: 2343686 - DNA, 13 bp, Homo sapiens
agggcctgctgga

SEQ ID NO: 2343687 - DNA, 18 bp, Homo sapiens
agggcctgctggaggcct

SEQ ID NO: 2343688 - DNA, 19 bp, Homo sapiens
agggcctgctggaggcctc

SEQ ID NO: 2343689 - DNA, 14 bp, Homo sapiens
agggctcccagggg

SEQ ID NO: 2343690 - DNA, 22 bp, Homo sapiens
agggctcccaggggtctccctg

SEQ ID NO: 2343691 - DNA, 14 bp, Homo sapiens
agggctccctcctg

SEQ ID NO: 2343692 - DNA, 17 bp, Homo sapiens
agggctccctcctggag

SEQ ID NO: 2343693 - DNA, 20 bp, Homo sapiens
agggctccctcctggagcat

SEQ ID NO: 2343694 - DNA, 11 bp, Homo sapiens
agggctgcagt

SEQ ID NO: 2343695 - DNA, 12 bp, Homo sapiens
agggctggctcc

SEQ ID NO: 2343696 - DNA, 16 bp, Homo sapiens
agggctggctccccct

SEQ ID NO: 2343697 - DNA, 22 bp, Homo sapiens
agggctggctccccctccccag

SEQ ID NO: 2343698 - DNA, 14 bp, Homo sapiens
agggctggctcctg

SEQ ID NO: 2343699 - DNA, 13 bp, Homo sapiens
agggctgtcccag

SEQ ID NO: 2343700 - DNA, 15 bp, Homo sapiens
agggctgtcccagcc

SEQ ID NO: 2343701 - DNA, 18 bp, Homo sapiens
agggctgtcccagccccg

SEQ ID NO: 2343702 - DNA, 21 bp, Homo sapiens
agggctgtgcttgaaggccct

SEQ ID NO: 2343703 - DNA, 22 bp, Homo sapiens
agggctgtgcttgaaggccctg

SEQ ID NO: 2343704 - DNA, 21 bp, Homo sapiens
agggcttcctctagaagccaa

SEQ ID NO: 2343705 - DNA, 16 bp, Homo sapiens
agggcttctcctcctc

SEQ ID NO: 2343706 - DNA, 13 bp, Homo sapiens
aggggaagaatga

SEQ ID NO: 2343707 - DNA, 17 bp, Homo sapiens
aggggaaggagaagtaa

SEQ ID NO: 2343708 - DNA, 21 bp, Homo sapiens
aggggaaggccctgaggcgga

SEQ ID NO: 2343709 - DNA, 14 bp, Homo sapiens
aggggagagctctc

SEQ ID NO: 2343710 - DNA, 14 bp, Homo sapiens
aggggagggcaggc

SEQ ID NO: 2343711 - DNA, 20 bp, Homo sapiens
aggggaggggctcctttcca

SEQ ID NO: 2343712 - DNA, 18 bp, Homo sapiens
aggggcccccctgccctg

SEQ ID NO: 2343713 - DNA, 20 bp, Homo sapiens
aggggcccccctgccctgtg

SEQ ID NO: 2343714 - DNA, 21 bp, Homo sapiens
aggggcccccctgccctgtgg

SEQ ID NO: 2343715 - DNA, 22 bp, Homo sapiens
aggggcccccctgccctgtggg

SEQ ID NO: 2343716 - DNA, 16 bp, Homo sapiens
aggggctcctttccat

SEQ ID NO: 2343717 - DNA, 23 bp, Homo sapiens
aggggcttgagaaggttactgag

SEQ ID NO: 2343718 - DNA, 18 bp, Homo sapiens
agggggcttgaagccaaa

SEQ ID NO: 2343719 - DNA, 16 bp, Homo sapiens
aggggtctccctggct

SEQ ID NO: 2343720 - DNA, 17 bp, Homo sapiens
aggggtctccctggctc

SEQ ID NO: 2343721 - DNA, 20 bp, Homo sapiens
aggggttcccttgagggctg

SEQ ID NO: 2343722 - DNA, 23 bp, Homo sapiens
aggggttcccttgagggctgcag

SEQ ID NO: 2343723 - DNA, 14 bp, Homo sapiens
aggggttcctcaaa

SEQ ID NO: 2343724 - DNA, 22 bp, Homo sapiens
agctaccacccttaggggtaat

SEQ ID NO: 2343725 - DNA, 23 bp, Homo sapiens
agctacctacatgctgaaaaata

SEQ ID NO: 2343726 - DNA, 16 bp, Homo sapiens
agctactaatgatgtt

SEQ ID NO: 2343727 - DNA, 18 bp, Homo sapiens
agctagaaaaataaaatg

SEQ ID NO: 2343728 - DNA, 19 bp, Homo sapiens
agctagaaaaataaaatgt

SEQ ID NO: 2343729 - DNA, 15 bp, Homo sapiens
agctatcctttcaaa

SEQ ID NO: 2343730 - DNA, 14 bp, Homo sapiens
agctattttcctct

SEQ ID NO: 2343731 - DNA, 16 bp, Homo sapiens
agctcacatgggactg

SEQ ID NO: 2343732 - DNA, 11 bp, Homo sapiens
agctcagtcat

SEQ ID NO: 2343733 - DNA, 19 bp, Homo sapiens
agctcagtcatcaaagcag

SEQ ID NO: 2343734 - DNA, 13 bp, Homo sapiens
agctccctcctgc

SEQ ID NO: 2343735 - DNA, 21 bp, Homo sapiens
agctccctcctgcacacagaa

SEQ ID NO: 2343736 - DNA, 17 bp, Homo sapiens
agctccctttctcagga

SEQ ID NO: 2343737 - DNA, 23 bp, Homo sapiens
agctcctcaactcacctaatgtt

SEQ ID NO: 2343738 - DNA, 20 bp, Homo sapiens
agctcctgtcccctgctaca

SEQ ID NO: 2343739 - DNA, 12 bp, Homo sapiens
agctctcccagt

SEQ ID NO: 2343740 - DNA, 15 bp, Homo sapiens
agctctcccagtgaa

SEQ ID NO: 2343741 - DNA, 17 bp, Homo sapiens
agctctcccagtgaact

SEQ ID NO: 2343742 - DNA, 14 bp, Homo sapiens
agctctctgccctg

SEQ ID NO: 2343743 - DNA, 17 bp, Homo sapiens
agctctctgccctgtgt

SEQ ID NO: 2343744 - DNA, 16 bp, Homo sapiens
agctctgaaatcttcc

SEQ ID NO: 2343745 - DNA, 22 bp, Homo sapiens
agctctggaggtgctgctctag

SEQ ID NO: 2343746 - DNA, 22 bp, Homo sapiens
agctctgggttgtgcacatttc

SEQ ID NO: 2343747 - DNA, 19 bp, Homo sapiens
agctcttcctatccctctc

SEQ ID NO: 2343748 - DNA, 11 bp, Homo sapiens
agctcttttaa

SEQ ID NO: 2343749 - DNA, 18 bp, Homo sapiens
agctgaaaattaaatttt

SEQ ID NO: 2343750 - DNA, 17 bp, Homo sapiens
agctgaaattttagaaa

SEQ ID NO: 2343751 - DNA, 20 bp, Homo sapiens
agctgaaattttagaaatat

SEQ ID NO: 2343752 - DNA, 18 bp, Homo sapiens
agctgaagaattgaaaag

SEQ ID NO: 2343753 - DNA, 20 bp, Homo sapiens
agctgatattatttcttctc

SEQ ID NO: 2343754 - DNA, 22 bp, Homo sapiens
agctgatattatttcttctctt

SEQ ID NO: 2343755 - DNA, 17 bp, Homo sapiens
agctgcaattccctgga

SEQ ID NO: 2343756 - DNA, 14 bp, Homo sapiens
agctgcactgtgaa

SEQ ID NO: 2343757 - DNA, 16 bp, Homo sapiens
agctgcactgtgaacc

SEQ ID NO: 2343758 - DNA, 16 bp, Homo sapiens
agctgcagagatttct

SEQ ID NO: 2343759 - DNA, 15 bp, Homo sapiens
agctgccatggctag

SEQ ID NO: 2343760 - DNA, 22 bp, Homo sapiens
agctgcctacctaatgaggact

SEQ ID NO: 2343761 - DNA, 21 bp, Homo sapiens
agctgcctagattcagggaaa

SEQ ID NO: 2343762 - DNA, 10 bp, Homo sapiens
agctgccttc

SEQ ID NO: 2343763 - DNA, 16 bp, Homo sapiens
agctgccttccctagc

SEQ ID NO: 2343764 - DNA, 18 bp, Homo sapiens
agctgccttccctagctt

SEQ ID NO: 2343765 - DNA, 19 bp, Homo sapiens
agctgctatccccatctcc

SEQ ID NO: 2343766 - DNA, 23 bp, Homo sapiens
agctgctcattacagttctttcc

SEQ ID NO: 2343767 - DNA, 16 bp, Homo sapiens
agctgctctgagccac

SEQ ID NO: 2343768 - DNA, 16 bp, Homo sapiens
agctgctgttctcagg

SEQ ID NO: 2343769 - DNA, 18 bp, Homo sapiens
agctgctgttctcaggac

SEQ ID NO: 2343770 - DNA, 20 bp, Homo sapiens
agctgctgttctcaggacag

SEQ ID NO: 2343771 - DNA, 15 bp, Homo sapiens
agctggagaaatggc

SEQ ID NO: 2343772 - DNA, 20 bp, Homo sapiens
agctggagcccccagcagag

SEQ ID NO: 2343773 - DNA, 23 bp, Homo sapiens
agctggagcccccagcagaggca

SEQ ID NO: 2343774 - DNA, 18 bp, Homo sapiens
agctggcagtgcaatgct

SEQ ID NO: 2343775 - DNA, 16 bp, Homo sapiens
agctggcctctctagc

SEQ ID NO: 2343776 - DNA, 20 bp, Homo sapiens
agctggctctgtgagggtgc

SEQ ID NO: 2343777 - DNA, 22 bp, Homo sapiens
agctggctttgaaacctcaggg

SEQ ID NO: 2343778 - DNA, 14 bp, Homo sapiens
agctggggccagag

SEQ ID NO: 2343779 - DNA, 15 bp, Homo sapiens
agctggggccagagg

SEQ ID NO: 2343780 - DNA, 21 bp, Homo sapiens
agctggggccagaggctggga

SEQ ID NO: 2343781 - DNA, 20 bp, Homo sapiens
agctgggtcacatccatccc

SEQ ID NO: 2343782 - DNA, 13 bp, Homo sapiens
agctgtaaaaatg

SEQ ID NO: 2343783 - DNA, 18 bp, Homo sapiens
agctgtaaaaatgttacg

SEQ ID NO: 2343784 - DNA, 17 bp, Homo sapiens
agctgtagctcccgagc

SEQ ID NO: 2343785 - DNA, 20 bp, Homo sapiens
agctgtcctttttcctctcc

SEQ ID NO: 2343786 - DNA, 23 bp, Homo sapiens
agctgtcctttttcctctccaca

SEQ ID NO: 2343787 - DNA, 15 bp, Homo sapiens
agctgtgtctgccaa

SEQ ID NO: 2343788 - DNA, 23 bp, Homo sapiens
agctgtgtgacatttggagaggg

SEQ ID NO: 2343789 - DNA, 15 bp, Homo sapiens
agctgttaccattca

SEQ ID NO: 2343790 - DNA, 19 bp, Homo sapiens
agctgttaccattcacaat

SEQ ID NO: 2343791 - DNA, 15 bp, Homo sapiens
agctgttctaattaa

SEQ ID NO: 2343792 - DNA, 22 bp, Homo sapiens
agctgttctaattaagaaaact

SEQ ID NO: 2343793 - DNA, 19 bp, Homo sapiens
agctgttgtgagctttgaa

SEQ ID NO: 2343794 - DNA, 16 bp, Homo sapiens
agcttacattttcctg

SEQ ID NO: 2343795 - DNA, 17 bp, Homo sapiens
agcttacattttcctga

SEQ ID NO: 2343796 - DNA, 15 bp, Homo sapiens
agcttataatgggct

SEQ ID NO: 2343797 - DNA, 18 bp, Homo sapiens
agcttcaacttttctctt

SEQ ID NO: 2343798 - DNA, 23 bp, Homo sapiens
agcttcaggttatcgaaataaca

SEQ ID NO: 2343799 - DNA, 21 bp, Homo sapiens
agcttcagtaagttatctttg

SEQ ID NO: 2343800 - DNA, 15 bp, Homo sapiens
agcttcagttgcttg

SEQ ID NO: 2343801 - DNA, 16 bp, Homo sapiens
agcttcagttgcttgt

SEQ ID NO: 2343802 - DNA, 13 bp, Homo sapiens
agcttccaaagcc

SEQ ID NO: 2343803 - DNA, 15 bp, Homo sapiens
agcttccattttaat

SEQ ID NO: 2343804 - DNA, 20 bp, Homo sapiens
agcttccattttaattttaa

SEQ ID NO: 2343805 - DNA, 17 bp, Homo sapiens
agcttcctgttactgag

SEQ ID NO: 2343806 - DNA, 21 bp, Homo sapiens
agcttcctgttactgagatgt

SEQ ID NO: 2343807 - DNA, 22 bp, Homo sapiens
agcttctgcttttctgccctgg

SEQ ID NO: 2343808 - DNA, 23 bp, Homo sapiens
agcttctgcttttctgccctggc

SEQ ID NO: 2343809 - DNA, 14 bp, Homo sapiens
agcttcttgtttcc

SEQ ID NO: 2343810 - DNA, 17 bp, Homo sapiens
agcttcttgtttccttg

SEQ ID NO: 2343811 - DNA, 24 bp, Homo sapiens
agcttgagccgggcccctgggctt

SEQ ID NO: 2343812 - DNA, 15 bp, Homo sapiens
agcttgattaaatca

SEQ ID NO: 2343813 - DNA, 20 bp, Homo sapiens
agcttgctccagattctgat

SEQ ID NO: 2343814 - DNA, 22 bp, Homo sapiens
agcttgctccagattctgatgc

SEQ ID NO: 2343815 - DNA, 20 bp, Homo sapiens
agcttgggcagtgccccagg

SEQ ID NO: 2343816 - DNA, 21 bp, Homo sapiens
agcttgggcagtgccccaggg

SEQ ID NO: 2343817 - DNA, 16 bp, Homo sapiens
agctttagaccctggg

SEQ ID NO: 2343818 - DNA, 11 bp, Homo sapiens
agctttctcaa

SEQ ID NO: 2343819 - DNA, 14 bp, Homo sapiens
agctttctcaatgt

SEQ ID NO: 2343820 - DNA, 20 bp, Homo sapiens
agctttctcaatgtcttccc

SEQ ID NO: 2343821 - DNA, 19 bp, Homo sapiens
agctttgactctataagca

SEQ ID NO: 2343822 - DNA, 19 bp, Homo sapiens
agctttggacctaatccaa

SEQ ID NO: 2343823 - DNA, 17 bp, Homo sapiens
agctttttaattgttgt

SEQ ID NO: 2343824 - DNA, 22 bp, Homo sapiens
agctttttattcctcctgctca

SEQ ID NO: 2343825 - DNA, 17 bp, Homo sapiens
agcttttttattttaat

SEQ ID NO: 2343826 - DNA, 13 bp, Homo sapiens
aggaaacatttta

SEQ ID NO: 2343827 - DNA, 18 bp, Homo sapiens
aggaaacattttatcatt

SEQ ID NO: 2343828 - DNA, 19 bp, Homo sapiens
aggaaactccacatctgcc

SEQ ID NO: 2343829 - DNA, 20 bp, Homo sapiens
aggaaactccacatctgcct

SEQ ID NO: 2343830 - DNA, 21 bp, Homo sapiens
aggaaactccacatctgcctt

SEQ ID NO: 2343831 - DNA, 22 bp, Homo sapiens
aggaaactccacatctgcctta

SEQ ID NO: 2343832 - DNA, 13 bp, Homo sapiens
aggaaactcttat

SEQ ID NO: 2343833 - DNA, 18 bp, Homo sapiens
aggaaagagcagtcagag

SEQ ID NO: 2343834 - DNA, 22 bp, Homo sapiens
aggaaagggctggctccccctc

SEQ ID NO: 2343835 - DNA, 13 bp, Homo sapiens
aggaaatatctgt

SEQ ID NO: 2343836 - DNA, 21 bp, Homo sapiens
aggaaatatctgtgaaggact

SEQ ID NO: 2343837 - DNA, 23 bp, Homo sapiens
aggaaatgtcacagaagcagcta

SEQ ID NO: 2343838 - DNA, 20 bp, Homo sapiens
aggaaatgtttttaataaaa

SEQ ID NO: 2343839 - DNA, 22 bp, Homo sapiens
aggaaatgtttttaataaaaga

SEQ ID NO: 2343840 - DNA, 13 bp, Homo sapiens
aggaacaaacagg

SEQ ID NO: 2343841 - DNA, 14 bp, Homo sapiens
aggaacaaacaggg

SEQ ID NO: 2343842 - DNA, 22 bp, Homo sapiens
aggaaccgtggtatgtctgcca

SEQ ID NO: 2343843 - DNA, 12 bp, Homo sapiens
aggaagagccac

SEQ ID NO: 2343844 - DNA, 19 bp, Homo sapiens
aggaagagccacctgcaag

SEQ ID NO: 2343845 - DNA, 12 bp, Homo sapiens
aggaagccagag

SEQ ID NO: 2343846 - DNA, 19 bp, Homo sapiens
aggaagccagagccccaag

SEQ ID NO: 2343847 - DNA, 14 bp, Homo sapiens
aggaaggaggggag

SEQ ID NO: 2343848 - DNA, 14 bp, Homo sapiens
aggaaggattgtaa

SEQ ID NO: 2343849 - DNA, 15 bp, Homo sapiens
aggaaggattgtaaa

SEQ ID NO: 2343850 - DNA, 16 bp, Homo sapiens
aggaaggattgtaaaa

SEQ ID NO: 2343851 - DNA, 14 bp, Homo sapiens
aggaaggcaagagg

SEQ ID NO: 2343852 - DNA, 17 bp, Homo sapiens
aggaaggcctgagcccc

SEQ ID NO: 2343853 - DNA, 12 bp, Homo sapiens
aggaaggccttt

SEQ ID NO: 2343854 - DNA, 16 bp, Homo sapiens
aggaaggcctttcttc

SEQ ID NO: 2343855 - DNA, 19 bp, Homo sapiens
aggaaggcctttcttctgt

SEQ ID NO: 2343856 - DNA, 14 bp, Homo sapiens
aggaagtgtttatg

SEQ ID NO: 2343857 - DNA, 20 bp, Homo sapiens
aggaatatgacggaagaaca

SEQ ID NO: 2343858 - DNA, 22 bp, Homo sapiens
aggaatcattcagaaatgttga

SEQ ID NO: 2343859 - DNA, 23 bp, Homo sapiens
aggaatcattcagaaatgttgag

SEQ ID NO: 2343860 - DNA, 13 bp, Homo sapiens
aggaatcctggca

SEQ ID NO: 2343861 - DNA, 16 bp, Homo sapiens
aggaatcctggcagcc

SEQ ID NO: 2343862 - DNA, 13 bp, Homo sapiens
aggaatctcttca

SEQ ID NO: 2343863 - DNA, 18 bp, Homo sapiens
aggaatttcacctgtaaa

SEQ ID NO: 2343864 - DNA, 15 bp, Homo sapiens
aggacacagttcctg

SEQ ID NO: 2343865 - DNA, 14 bp, Homo sapiens
aggacacttccgta

SEQ ID NO: 2343866 - DNA, 15 bp, Homo sapiens
aggacagagagaaat

SEQ ID NO: 2343867 - DNA, 16 bp, Homo sapiens
aggacatgcaataaaa

SEQ ID NO: 2343868 - DNA, 21 bp, Homo sapiens
aggacatgcaataaaatttaa

SEQ ID NO: 2343869 - DNA, 23 bp, Homo sapiens
aggaccacagagctcctggccct

SEQ ID NO: 2343870 - DNA, 22 bp, Homo sapiens
aggaccagattgctctgcccca

SEQ ID NO: 2343871 - DNA, 15 bp, Homo sapiens
aggaccagggccctg

SEQ ID NO: 2343872 - DNA, 22 bp, Homo sapiens
aggacctatcccaaatgtggaa

SEQ ID NO: 2343873 - DNA, 21 bp, Homo sapiens
aggacgcacgctcgctgccat

SEQ ID NO: 2343874 - DNA, 23 bp, Homo sapiens
aggacggctcctcagagcgccag

SEQ ID NO: 2343875 - DNA, 16 bp, Homo sapiens
aggacggttgtaagca

SEQ ID NO: 2343876 - DNA, 13 bp, Homo sapiens
aggactgcagtgt

SEQ ID NO: 2343877 - DNA, 16 bp, Homo sapiens
aggactgcagtgtgga

SEQ ID NO: 2343878 - DNA, 21 bp, Homo sapiens
aggactggtgaatataaatga

SEQ ID NO: 2343879 - DNA, 23 bp, Homo sapiens
aggactggtgaatataaatgatg

SEQ ID NO: 2343880 - DNA, 20 bp, Homo sapiens
aggagaattgcttgaacctg

SEQ ID NO: 2343881 - DNA, 16 bp, Homo sapiens
aggagacggaggggag

SEQ ID NO: 2343882 - DNA, 20 bp, Homo sapiens
aggagatcgagaccatcctg

SEQ ID NO: 2343883 - DNA, 12 bp, Homo sapiens
aggagcagcagc

SEQ ID NO: 2343884 - DNA, 13 bp, Homo sapiens
aggagcagcagct

SEQ ID NO: 2343885 - DNA, 12 bp, Homo sapiens
aggagcccccac

SEQ ID NO: 2343886 - DNA, 19 bp, Homo sapiens
aggagcccccaccctgttc

SEQ ID NO: 2343887 - DNA, 19 bp, Homo sapiens
aggagctttctcaatgtct

SEQ ID NO: 2343888 - DNA, 13 bp, Homo sapiens
aggagcttttctg

SEQ ID NO: 2343889 - DNA, 14 bp, Homo sapiens
aggaggaaggcaag

SEQ ID NO: 2343890 - DNA, 23 bp, Homo sapiens
aggaggaattagttgggatgcca

SEQ ID NO: 2343891 - DNA, 20 bp, Homo sapiens
aggaggccctgttccctgga

SEQ ID NO: 2343892 - DNA, 23 bp, Homo sapiens
aggaggcccttgtcgtgggatgg

SEQ ID NO: 2343893 - DNA, 15 bp, Homo sapiens
aggagggagagggag

SEQ ID NO: 2343894 - DNA, 15 bp, Homo sapiens
aggagggcagaggga

SEQ ID NO: 2343895 - DNA, 21 bp, Homo sapiens
aggaggggcccccctgccctg

SEQ ID NO: 2343896 - DNA, 23 bp, Homo sapiens
aggaggggcccccctgccctgtg

SEQ ID NO: 2343897 - DNA, 13 bp, Homo sapiens
aggagggtggggg

SEQ ID NO: 2343898 - DNA, 21 bp, Homo sapiens
aggagggtgggggagggaggt

SEQ ID NO: 2343899 - DNA, 23 bp, Homo sapiens
aggaggtccttaggcctctgaga

SEQ ID NO: 2343900 - DNA, 13 bp, Homo sapiens
aggaggtggagaa

SEQ ID NO: 2343901 - DNA, 16 bp, Homo sapiens
aggagtgcagccttct

SEQ ID NO: 2343902 - DNA, 18 bp, Homo sapiens
aggataaattttagaaaa

SEQ ID NO: 2343903 - DNA, 18 bp, Homo sapiens
aggatactggcacagagg

SEQ ID NO: 2343904 - DNA, 21 bp, Homo sapiens
aggatattggttcttcccctc

SEQ ID NO: 2343905 - DNA, 15 bp, Homo sapiens
aggatccagagagca

SEQ ID NO: 2343906 - DNA, 15 bp, Homo sapiens
aggatctaagggaag

SEQ ID NO: 2343907 - DNA, 19 bp, Homo sapiens
aggatctctaaagagcatc

SEQ ID NO: 2343908 - DNA, 22 bp, Homo sapiens
aggatctgctgaggcccagtgc

SEQ ID NO: 2343909 - DNA, 15 bp, Homo sapiens
aggatgagagcccag

SEQ ID NO: 2343910 - DNA, 16 bp, Homo sapiens
aggatgagagcccaga

SEQ ID NO: 2343911 - DNA, 13 bp, Homo sapiens
aggatgagggaag

SEQ ID NO: 2343912 - DNA, 17 bp, Homo sapiens
aggatgccttttctgtg

SEQ ID NO: 2343913 - DNA, 14 bp, Homo sapiens
aggattcccttctg

SEQ ID NO: 2343914 - DNA, 23 bp, Homo sapiens
aggattgtaaaaaaaaatgcctt

SEQ ID NO: 2343915 - DNA, 13 bp, Homo sapiens
aggatttaaggag

SEQ ID NO: 2343916 - DNA, 20 bp, Homo sapiens
aggatttaaggaggtgaagt

SEQ ID NO: 2343917 - DNA, 15 bp, Homo sapiens
aggatttcctacccc

SEQ ID NO: 2343918 - DNA, 23 bp, Homo sapiens
aggatttgcacagaagcacatgc

SEQ ID NO: 2343919 - DNA, 14 bp, Homo sapiens
aggcacacacagcc

SEQ ID NO: 2343920 - DNA, 22 bp, Homo sapiens
aggcaccctcagggagcctccc

SEQ ID NO: 2343921 - DNA, 22 bp, Homo sapiens
aggcagattttacagagcgcac

SEQ ID NO: 2343922 - DNA, 13 bp, Homo sapiens
aggcagcaccaca

SEQ ID NO: 2343923 - DNA, 19 bp, Homo sapiens
aggcagcaccacactgggt

SEQ ID NO: 2343924 - DNA, 21 bp, Homo sapiens
aggcagcaccacactgggtgc

SEQ ID NO: 2343925 - DNA, 19 bp, Homo sapiens
aggcagcctcctttgtgtg

SEQ ID NO: 2343926 - DNA, 16 bp, Homo sapiens
aggcagcgacctcaag

SEQ ID NO: 2343927 - DNA, 23 bp, Homo sapiens
aggcagcgacctcaagtgtcctg

SEQ ID NO: 2343928 - DNA, 14 bp, Homo sapiens
aggcagcttctaag

SEQ ID NO: 2343929 - DNA, 19 bp, Homo sapiens
aggcaggaacaaacagggc

SEQ ID NO: 2343930 - DNA, 12 bp, Homo sapiens
aggcaggaaggg

SEQ ID NO: 2343931 - DNA, 18 bp, Homo sapiens
aggcaggagaatggtgtg

SEQ ID NO: 2343932 - DNA, 13 bp, Homo sapiens
aggcaggctggga

SEQ ID NO: 2343933 - DNA, 15 bp, Homo sapiens
aggcaggggtggggg

SEQ ID NO: 2343934 - DNA, 21 bp, Homo sapiens
aggcagtattttgtgtcctcc

SEQ ID NO: 2343935 - DNA, 18 bp, Homo sapiens
aggcagtgatgacttgct

SEQ ID NO: 2343936 - DNA, 20 bp, Homo sapiens
aggcagtgatgacttgctgt

SEQ ID NO: 2343937 - DNA, 14 bp, Homo sapiens
aggcataggtctct

SEQ ID NO: 2343938 - DNA, 20 bp, Homo sapiens
aggcatatttaacaaaattt

SEQ ID NO: 2343939 - DNA, 16 bp, Homo sapiens
aggcatccttgtcttt

SEQ ID NO: 2343940 - DNA, 19 bp, Homo sapiens
aggcatgaaattcttccta

SEQ ID NO: 2343941 - DNA, 18 bp, Homo sapiens
aggcatgactaatgcttt

SEQ ID NO: 2343942 - DNA, 20 bp, Homo sapiens
aggcatgactaatgcttttt

SEQ ID NO: 2343943 - DNA, 16 bp, Homo sapiens
aggcattctggacctc

SEQ ID NO: 2343944 - DNA, 20 bp, Homo sapiens
aggcattctggacctctggg

SEQ ID NO: 2343945 - DNA, 15 bp, Homo sapiens
aggccaaaatcaaga

SEQ ID NO: 2343946 - DNA, 21 bp, Homo sapiens
aggccacctggctctcacctc

SEQ ID NO: 2343947 - DNA, 14 bp, Homo sapiens
aggccactgtgttc

SEQ ID NO: 2343948 - DNA, 10 bp, Homo sapiens
aggccagcct

SEQ ID NO: 2343949 - DNA, 22 bp, Homo sapiens
aggccagcctccgagagggaga

SEQ ID NO: 2343950 - DNA, 23 bp, Homo sapiens
aggccagcctccgagagggagag

SEQ ID NO: 2343951 - DNA, 20 bp, Homo sapiens
aggccagtccccatttctgc

SEQ ID NO: 2343952 - DNA, 19 bp, Homo sapiens
aggccagttgatctgctct

SEQ ID NO: 2343953 - DNA, 22 bp, Homo sapiens
aggccatggcatccctttttca

SEQ ID NO: 2343954 - DNA, 14 bp, Homo sapiens
aggccatttttggt

SEQ ID NO: 2343955 - DNA, 13 bp, Homo sapiens
ataaaagaacatg

SEQ ID NO: 2343956 - DNA, 13 bp, Homo sapiens
ataaaagataaaa

SEQ ID NO: 2343957 - DNA, 11 bp, Homo sapiens
ataaaagccca

SEQ ID NO: 2343958 - DNA, 20 bp, Homo sapiens
ataaaaggcttgaagctgtg

SEQ ID NO: 2343959 - DNA, 21 bp, Homo sapiens
ataaaaggtggagtttctctg

SEQ ID NO: 2343960 - DNA, 15 bp, Homo sapiens
ataaaataattctaa

SEQ ID NO: 2343961 - DNA, 16 bp, Homo sapiens
ataaaataattctaaa

SEQ ID NO: 2343962 - DNA, 17 bp, Homo sapiens
ataaaataattctaaag

SEQ ID NO: 2343963 - DNA, 12 bp, Homo sapiens
ataaaatatcat

SEQ ID NO: 2343964 - DNA, 17 bp, Homo sapiens
ataaaatatcataaagc

SEQ ID NO: 2343965 - DNA, 19 bp, Homo sapiens
ataaaatgaaaattgtatt

SEQ ID NO: 2343966 - DNA, 12 bp, Homo sapiens
ataaacatgaaa

SEQ ID NO: 2343967 - DNA, 16 bp, Homo sapiens
ataaacggttcctggt

SEQ ID NO: 2343968 - DNA, 23 bp, Homo sapiens
ataaacggttcctggtgactcct

SEQ ID NO: 2343969 - DNA, 16 bp, Homo sapiens
ataaactcagatctga

SEQ ID NO: 2343970 - DNA, 21 bp, Homo sapiens
ataaagaatgccatttctcac

SEQ ID NO: 2343971 - DNA, 13 bp, Homo sapiens
ataaagatgagtt

SEQ ID NO: 2343972 - DNA, 19 bp, Homo sapiens
ataaagattattttttgat

SEQ ID NO: 2343973 - DNA, 18 bp, Homo sapiens
ataaaggaaaagacacat

SEQ ID NO: 2343974 - DNA, 15 bp, Homo sapiens
ataaagtaattttta

SEQ ID NO: 2343975 - DNA, 13 bp, Homo sapiens
ataaagtacaaat

SEQ ID NO: 2343976 - DNA, 22 bp, Homo sapiens
ataaagtacaaatgaagaaagt

SEQ ID NO: 2343977 - DNA, 14 bp, Homo sapiens
ataaagtattttct

SEQ ID NO: 2343978 - DNA, 22 bp, Homo sapiens
ataaagttattcttgtcatttt

SEQ ID NO: 2343979 - DNA, 14 bp, Homo sapiens
ataaataaagtttc

SEQ ID NO: 2343980 - DNA, 12 bp, Homo sapiens
ataaataatttt

SEQ ID NO: 2343981 - DNA, 16 bp, Homo sapiens
ataaataggagaggat

SEQ ID NO: 2343982 - DNA, 20 bp, Homo sapiens
ataaatatttatgtagatgt

SEQ ID NO: 2343983 - DNA, 18 bp, Homo sapiens
ataaatcataaagtcagt

SEQ ID NO: 2343984 - DNA, 21 bp, Homo sapiens
ataaatgggtgtatataattt

SEQ ID NO: 2343985 - DNA, 19 bp, Homo sapiens
ataaatgtataaatataca

SEQ ID NO: 2343986 - DNA, 17 bp, Homo sapiens
ataaattatttgattat

SEQ ID NO: 2343987 - DNA, 15 bp, Homo sapiens
ataaattcaactttg

SEQ ID NO: 2343988 - DNA, 22 bp, Homo sapiens
ataaattgtagggctttagctt

SEQ ID NO: 2343989 - DNA, 22 bp, Homo sapiens
ataacaatgttaaggaaactct

SEQ ID NO: 2343990 - DNA, 13 bp, Homo sapiens
ataacacattttt

SEQ ID NO: 2343991 - DNA, 19 bp, Homo sapiens
ataacagagtgatttgtaa

SEQ ID NO: 2343992 - DNA, 13 bp, Homo sapiens
ataacagctgcaa

SEQ ID NO: 2343993 - DNA, 19 bp, Homo sapiens
ataacatcgaaaagttatt

SEQ ID NO: 2343994 - DNA, 19 bp, Homo sapiens
ataacattaccttactgtg

SEQ ID NO: 2343995 - DNA, 17 bp, Homo sapiens
ataacctagttaaagaa

SEQ ID NO: 2343996 - DNA, 19 bp, Homo sapiens
ataacctagttaaagaaag

SEQ ID NO: 2343997 - DNA, 13 bp, Homo sapiens
ataacgtttttcc

SEQ ID NO: 2343998 - DNA, 16 bp, Homo sapiens
ataactctctttcctt

SEQ ID NO: 2343999 - DNA, 18 bp, Homo sapiens
ataacttttacacgacca

SEQ ID NO: 2344000 - DNA, 20 bp, Homo sapiens
ataagaaacatgatgtgaga

SEQ ID NO: 2344001 - DNA, 21 bp, Homo sapiens
ataagaaataatgctacaatt

SEQ ID NO: 2344002 - DNA, 22 bp, Homo sapiens
ataagaaataatgctacaattt

SEQ ID NO: 2344003 - DNA, 17 bp, Homo sapiens
ataagagaatgttccta

SEQ ID NO: 2344004 - DNA, 18 bp, Homo sapiens
ataagatacaataaaaca

SEQ ID NO: 2344005 - DNA, 13 bp, Homo sapiens
ataagctaaagag

SEQ ID NO: 2344006 - DNA, 21 bp, Homo sapiens
ataagctatgagttgaaatgt

SEQ ID NO: 2344007 - DNA, 15 bp, Homo sapiens
ataagcttaaatagg

SEQ ID NO: 2344008 - DNA, 13 bp, Homo sapiens
ataagggaaaaga

SEQ ID NO: 2344009 - DNA, 13 bp, Homo sapiens
ataagtagtaaat

SEQ ID NO: 2344010 - DNA, 22 bp, Homo sapiens
ataagttatttttgtacatgtt

SEQ ID NO: 2344011 - DNA, 18 bp, Homo sapiens
ataagttcaaattcttct

SEQ ID NO: 2344012 - DNA, 20 bp, Homo sapiens
ataagttcaaattcttctga

SEQ ID NO: 2344013 - DNA, 21 bp, Homo sapiens
ataagttcaaattcttctgaa

SEQ ID NO: 2344014 - DNA, 13 bp, Homo sapiens
ataataaaaatat

SEQ ID NO: 2344015 - DNA, 14 bp, Homo sapiens
ataataaagtattt

SEQ ID NO: 2344016 - DNA, 13 bp, Homo sapiens
ataataaattttc

SEQ ID NO: 2344017 - DNA, 14 bp, Homo sapiens
ataataaattttct

SEQ ID NO: 2344018 - DNA, 15 bp, Homo sapiens
ataataaattttcta

SEQ ID NO: 2344019 - DNA, 17 bp, Homo sapiens
ataataaattttctaaa

SEQ ID NO: 2344020 - DNA, 23 bp, Homo sapiens
ataataagagaatgttcctactc

SEQ ID NO: 2344021 - DNA, 15 bp, Homo sapiens
ataataagctaaaga

SEQ ID NO: 2344022 - DNA, 18 bp, Homo sapiens
ataatacagaatcttgtt

SEQ ID NO: 2344023 - DNA, 12 bp, Homo sapiens
ataataggaatg

SEQ ID NO: 2344024 - DNA, 15 bp, Homo sapiens
ataatatataaacaa

SEQ ID NO: 2344025 - DNA, 13 bp, Homo sapiens
ataatatcaaata

SEQ ID NO: 2344026 - DNA, 12 bp, Homo sapiens
ataatattgaaa

SEQ ID NO: 2344027 - DNA, 19 bp, Homo sapiens
ataatattgaaaattgaaa

SEQ ID NO: 2344028 - DNA, 16 bp, Homo sapiens
ataatattgtttggta

SEQ ID NO: 2344029 - DNA, 21 bp, Homo sapiens
ataatattgtttggtaaatgt

SEQ ID NO: 2344030 - DNA, 22 bp, Homo sapiens
ataatattgtttggtaaatgtt

SEQ ID NO: 2344031 - DNA, 18 bp, Homo sapiens
ataatcacgctttcctga

SEQ ID NO: 2344032 - DNA, 20 bp, Homo sapiens
ataatcttctgccttctcat

SEQ ID NO: 2344033 - DNA, 21 bp, Homo sapiens
ataatcttgtttctgaaaaga

SEQ ID NO: 2344034 - DNA, 21 bp, Homo sapiens
ataatgaaaataaaacacacc

SEQ ID NO: 2344035 - DNA, 13 bp, Homo sapiens
ataatgatgaact

SEQ ID NO: 2344036 - DNA, 17 bp, Homo sapiens
ataatgctacaatttta

SEQ ID NO: 2344037 - DNA, 22 bp, Homo sapiens
ataatggaaaatgccatgaatt

SEQ ID NO: 2344038 - DNA, 12 bp, Homo sapiens
ataatgttaaat

SEQ ID NO: 2344039 - DNA, 22 bp, Homo sapiens
ataatgttaaatttgtaagttt

SEQ ID NO: 2344040 - DNA, 17 bp, Homo sapiens
ataatgtttattaaatg

SEQ ID NO: 2344041 - DNA, 14 bp, Homo sapiens
ataattcatatcta

SEQ ID NO: 2344042 - DNA, 13 bp, Homo sapiens
ataattcttttct

SEQ ID NO: 2344043 - DNA, 15 bp, Homo sapiens
ataattgtacaaaat

SEQ ID NO: 2344044 - DNA, 17 bp, Homo sapiens
ataatttaaaaatatat

SEQ ID NO: 2344045 - DNA, 21 bp, Homo sapiens
ataatttaaaaatatatttat

SEQ ID NO: 2344046 - DNA, 20 bp, Homo sapiens
ataatttatttccactaaaa

SEQ ID NO: 2344047 - DNA, 13 bp, Homo sapiens
ataatttcagggt

SEQ ID NO: 2344048 - DNA, 11 bp, Homo sapiens
ataatttgaat

SEQ ID NO: 2344049 - DNA, 21 bp, Homo sapiens
ataatttgaatgtatttgatt

SEQ ID NO: 2344050 - DNA, 18 bp, Homo sapiens
ataattttttttaaaata

SEQ ID NO: 2344051 - DNA, 18 bp, Homo sapiens
atacaaacctaccaaaat

SEQ ID NO: 2344052 - DNA, 13 bp, Homo sapiens
atacaaactctca

SEQ ID NO: 2344053 - DNA, 14 bp, Homo sapiens
atacaagaaaatgt

SEQ ID NO: 2344054 - DNA, 15 bp, Homo sapiens
atacaagaaaatgta

SEQ ID NO: 2344055 - DNA, 13 bp, Homo sapiens
atacaataaaaca

SEQ ID NO: 2344056 - DNA, 23 bp, Homo sapiens
atacaataaaacaaataaatatg

SEQ ID NO: 2344057 - DNA, 22 bp, Homo sapiens
atacacaaagctttcttttcta

SEQ ID NO: 2344058 - DNA, 14 bp, Homo sapiens
atacacacacacac

SEQ ID NO: 2344059 - DNA, 19 bp, Homo sapiens
atacacactcgaatcattg

SEQ ID NO: 2344060 - DNA, 18 bp, Homo sapiens
atacacatagttctgtaa

SEQ ID NO: 2344061 - DNA, 22 bp, Homo sapiens
atacacttattggaactctgct

SEQ ID NO: 2344062 - DNA, 15 bp, Homo sapiens
atacagaggatgcct

SEQ ID NO: 2344063 - DNA, 16 bp, Homo sapiens
atacagcaacaattta

SEQ ID NO: 2344064 - DNA, 20 bp, Homo sapiens
atacagcctatagtaaatgt

SEQ ID NO: 2344065 - DNA, 15 bp, Homo sapiens
atacagctgcactga

SEQ ID NO: 2344066 - DNA, 17 bp, Homo sapiens
atacagtcattccaaga

SEQ ID NO: 2344067 - DNA, 13 bp, Homo sapiens
atacagtgcagag

SEQ ID NO: 2344068 - DNA, 21 bp, Homo sapiens
atacagtgcagagccttctca

SEQ ID NO: 2344069 - DNA, 18 bp, Homo sapiens
atacatgtgatacatttt

SEQ ID NO: 2344070 - DNA, 19 bp, Homo sapiens
atacatgtgatacattttt

SEQ ID NO: 2344071 - DNA, 17 bp, Homo sapiens
atacattaacggtgcta

SEQ ID NO: 2344072 - DNA, 16 bp, Homo sapiens
agtgctctgcctcaga

SEQ ID NO: 2344073 - DNA, 19 bp, Homo sapiens
agtgctggagtctcctgag

SEQ ID NO: 2344074 - DNA, 22 bp, Homo sapiens
agtgctggagtctcctgaggac

SEQ ID NO: 2344075 - DNA, 19 bp, Homo sapiens
agtggaccttgagaccaca

SEQ ID NO: 2344076 - DNA, 20 bp, Homo sapiens
agtggactctggggcgcggc

SEQ ID NO: 2344077 - DNA, 17 bp, Homo sapiens
agtggaggattatcagt

SEQ ID NO: 2344078 - DNA, 20 bp, Homo sapiens
agtggatggaatatcagaag

SEQ ID NO: 2344079 - DNA, 20 bp, Homo sapiens
agtggctgccacacccaggg

SEQ ID NO: 2344080 - DNA, 15 bp, Homo sapiens
agtggctggtagaaa

SEQ ID NO: 2344081 - DNA, 17 bp, Homo sapiens
agtgggccagccacaga

SEQ ID NO: 2344082 - DNA, 14 bp, Homo sapiens
agtggtctctgctg

SEQ ID NO: 2344083 - DNA, 22 bp, Homo sapiens
agtggtctctgctggggaaggg

SEQ ID NO: 2344084 - DNA, 16 bp, Homo sapiens
agtggtctttgtaaga

SEQ ID NO: 2344085 - DNA, 19 bp, Homo sapiens
agtggtctttgtaagagtg

SEQ ID NO: 2344086 - DNA, 20 bp, Homo sapiens
agtggtctttgtaagagtgt

SEQ ID NO: 2344087 - DNA, 16 bp, Homo sapiens
agtggtgtttattgca

SEQ ID NO: 2344088 - DNA, 19 bp, Homo sapiens
agtgtaaaatgtatatttt

SEQ ID NO: 2344089 - DNA, 12 bp, Homo sapiens
agtgtagaagca

SEQ ID NO: 2344090 - DNA, 14 bp, Homo sapiens
agtgtagaagcatt

SEQ ID NO: 2344091 - DNA, 15 bp, Homo sapiens
agtgtagaagcattc

SEQ ID NO: 2344092 - DNA, 18 bp, Homo sapiens
agtgtccagcttccaaag

SEQ ID NO: 2344093 - DNA, 18 bp, Homo sapiens
agtgtgaatagcctggcc

SEQ ID NO: 2344094 - DNA, 21 bp, Homo sapiens
agtgtgaatagcctggccacc

SEQ ID NO: 2344095 - DNA, 17 bp, Homo sapiens
agtgtgacagtttccaa

SEQ ID NO: 2344096 - DNA, 12 bp, Homo sapiens
agtgtggagacc

SEQ ID NO: 2344097 - DNA, 23 bp, Homo sapiens
agtgtggagttcaccttggaagg

SEQ ID NO: 2344098 - DNA, 11 bp, Homo sapiens
agtgtgtctgc

SEQ ID NO: 2344099 - DNA, 12 bp, Homo sapiens
agtgtgtctgct

SEQ ID NO: 2344100 - DNA, 14 bp, Homo sapiens
agtgtgtctgctga

SEQ ID NO: 2344101 - DNA, 17 bp, Homo sapiens
agtgttacctgtgtgct

SEQ ID NO: 2344102 - DNA, 22 bp, Homo sapiens
agtgttactacagccttaatat

SEQ ID NO: 2344103 - DNA, 14 bp, Homo sapiens
agtgttctcatgaa

SEQ ID NO: 2344104 - DNA, 20 bp, Homo sapiens
agtgttctcatgaagcagga

SEQ ID NO: 2344105 - DNA, 20 bp, Homo sapiens
agtgttgagcatctgtcccc

SEQ ID NO: 2344106 - DNA, 18 bp, Homo sapiens
agtgtttatgttgtttat

SEQ ID NO: 2344107 - DNA, 21 bp, Homo sapiens
agtgtttctagctaaataaat

SEQ ID NO: 2344108 - DNA, 22 bp, Homo sapiens
agttaaaattgttatcaaaata

SEQ ID NO: 2344109 - DNA, 12 bp, Homo sapiens
agttaagaagct

SEQ ID NO: 2344110 - DNA, 16 bp, Homo sapiens
agttaagaagctgttg

SEQ ID NO: 2344111 - DNA, 17 bp, Homo sapiens
agttaagaagctgttgt

SEQ ID NO: 2344112 - DNA, 20 bp, Homo sapiens
agttaagaagctgttgtaca

SEQ ID NO: 2344113 - DNA, 15 bp, Homo sapiens
agttaatcatcaaga

SEQ ID NO: 2344114 - DNA, 22 bp, Homo sapiens
agttacacagaaatgctgctgg

SEQ ID NO: 2344115 - DNA, 18 bp, Homo sapiens
agttacagtggcagtatt

SEQ ID NO: 2344116 - DNA, 22 bp, Homo sapiens
agttacttaattgccagcaaat

SEQ ID NO: 2344117 - DNA, 23 bp, Homo sapiens
agttacttaattgccagcaaata

SEQ ID NO: 2344118 - DNA, 18 bp, Homo sapiens
agttagctgaagaattga

SEQ ID NO: 2344119 - DNA, 17 bp, Homo sapiens
agttagtggaaatctga

SEQ ID NO: 2344120 - DNA, 14 bp, Homo sapiens
agttataagaagaa

SEQ ID NO: 2344121 - DNA, 16 bp, Homo sapiens
agttatcatgaatttt

SEQ ID NO: 2344122 - DNA, 23 bp, Homo sapiens
agttatggtgccgaattgtcttt

SEQ ID NO: 2344123 - DNA, 21 bp, Homo sapiens
agttatgtcttgtatttaaaa

SEQ ID NO: 2344124 - DNA, 16 bp, Homo sapiens
agttatttttgtacat

SEQ ID NO: 2344125 - DNA, 16 bp, Homo sapiens
agttcccatttccttg

SEQ ID NO: 2344126 - DNA, 14 bp, Homo sapiens
agttcctcctactt

SEQ ID NO: 2344127 - DNA, 17 bp, Homo sapiens
agttctactcaggctgg

SEQ ID NO: 2344128 - DNA, 19 bp, Homo sapiens
agttctcactgggaagaag

SEQ ID NO: 2344129 - DNA, 22 bp, Homo sapiens
agttctctgggaagtggtcagc

SEQ ID NO: 2344130 - DNA, 16 bp, Homo sapiens
agttctctttggaaat

SEQ ID NO: 2344131 - DNA, 17 bp, Homo sapiens
agttctctttggaaata

SEQ ID NO: 2344132 - DNA, 17 bp, Homo sapiens
agttcttatgaggaggg

SEQ ID NO: 2344133 - DNA, 12 bp, Homo sapiens
agttcttgtgcc

SEQ ID NO: 2344134 - DNA, 15 bp, Homo sapiens
agttctttggattct

SEQ ID NO: 2344135 - DNA, 19 bp, Homo sapiens
agttgaaatgttctgtcaa

SEQ ID NO: 2344136 - DNA, 17 bp, Homo sapiens
agttgactgactgagca

SEQ ID NO: 2344137 - DNA, 16 bp, Homo sapiens
agttgatctgctctgt

SEQ ID NO: 2344138 - DNA, 17 bp, Homo sapiens
agttgcaaagagacatt

SEQ ID NO: 2344139 - DNA, 18 bp, Homo sapiens
agttgcatagcagtatat

SEQ ID NO: 2344140 - DNA, 22 bp, Homo sapiens
agttgcccgaaactaagccagg

SEQ ID NO: 2344141 - DNA, 23 bp, Homo sapiens
agttgctatttttgtaaagtttc

SEQ ID NO: 2344142 - DNA, 15 bp, Homo sapiens
agttgctcaaaaaga

SEQ ID NO: 2344143 - DNA, 16 bp, Homo sapiens
agttgctcaaaaagaa

SEQ ID NO: 2344144 - DNA, 17 bp, Homo sapiens
agttgctgcaaacctga

SEQ ID NO: 2344145 - DNA, 19 bp, Homo sapiens
agttgcttgtcttctggta

SEQ ID NO: 2344146 - DNA, 12 bp, Homo sapiens
agttggaaggat

SEQ ID NO: 2344147 - DNA, 22 bp, Homo sapiens
agttgggatgccaatttcctct

SEQ ID NO: 2344148 - DNA, 20 bp, Homo sapiens
agttgggctcgcactgccca

SEQ ID NO: 2344149 - DNA, 17 bp, Homo sapiens
agttggggacagaactc

SEQ ID NO: 2344150 - DNA, 16 bp, Homo sapiens
agttgtaaaatagaaa

SEQ ID NO: 2344151 - DNA, 18 bp, Homo sapiens
agttgtagacaaagtaca

SEQ ID NO: 2344152 - DNA, 13 bp, Homo sapiens
agttgtcaacttg

SEQ ID NO: 2344153 - DNA, 21 bp, Homo sapiens
agttgtcttatgtgaaaaatt

SEQ ID NO: 2344154 - DNA, 16 bp, Homo sapiens
agttgtgtgtatgtgt

SEQ ID NO: 2344155 - DNA, 21 bp, Homo sapiens
agttgtgttttttaagatggc

SEQ ID NO: 2344156 - DNA, 23 bp, Homo sapiens
agtttaaaatgtgtatttttcaa

SEQ ID NO: 2344157 - DNA, 14 bp, Homo sapiens
agtttaaattctag

SEQ ID NO: 2344158 - DNA, 19 bp, Homo sapiens
agtttagttctgttgacct

SEQ ID NO: 2344159 - DNA, 20 bp, Homo sapiens
agtttcaagttttaaagttc

SEQ ID NO: 2344160 - DNA, 17 bp, Homo sapiens
agtttcagagtatattg

SEQ ID NO: 2344161 - DNA, 17 bp, Homo sapiens
agtttcaggtgacatgt

SEQ ID NO: 2344162 - DNA, 20 bp, Homo sapiens
agtttcaggtgacatgtgaa

SEQ ID NO: 2344163 - DNA, 21 bp, Homo sapiens
agtttcaggtgacatgtgaaa

SEQ ID NO: 2344164 - DNA, 18 bp, Homo sapiens
agtttcagtttgttggaa

SEQ ID NO: 2344165 - DNA, 19 bp, Homo sapiens
agtttcagtttgttggaaa

SEQ ID NO: 2344166 - DNA, 12 bp, Homo sapiens
agtttctctgtt

SEQ ID NO: 2344167 - DNA, 16 bp, Homo sapiens
agtttctttattttgt

SEQ ID NO: 2344168 - DNA, 22 bp, Homo sapiens
agtttctttattttgtgtaaaa

SEQ ID NO: 2344169 - DNA, 14 bp, Homo sapiens
agtttgagctgcct

SEQ ID NO: 2344170 - DNA, 13 bp, Homo sapiens
agtttgttggaaa

SEQ ID NO: 2344171 - DNA, 17 bp, Homo sapiens
agttttatatgctttat

SEQ ID NO: 2344172 - DNA, 15 bp, Homo sapiens
agttttcattaaatc

SEQ ID NO: 2344173 - DNA, 12 bp, Homo sapiens
agttttccttct

SEQ ID NO: 2344174 - DNA, 12 bp, Homo sapiens
agttttgaaaag

SEQ ID NO: 2344175 - DNA, 14 bp, Homo sapiens
agttttgaaaagct

SEQ ID NO: 2344176 - DNA, 15 bp, Homo sapiens
agttttgaaaagcta

SEQ ID NO: 2344177 - DNA, 12 bp, Homo sapiens
agttttgtctgt

SEQ ID NO: 2344178 - DNA, 14 bp, Homo sapiens
agtttttcctccca

SEQ ID NO: 2344179 - DNA, 16 bp, Homo sapiens
agtttttggttgggaa

SEQ ID NO: 2344180 - DNA, 12 bp, Homo sapiens
agtttttgtttg

SEQ ID NO: 2344181 - DNA, 20 bp, Homo sapiens
ataaaaaatctttagggaat

SEQ ID NO: 2344182 - DNA, 18 bp, Homo sapiens
ataaaaacaactttcact

SEQ ID NO: 2344183 - DNA, 13 bp, Homo sapiens
ataaaaatatatt

SEQ ID NO: 2344184 - DNA, 14 bp, Homo sapiens
ataaaacacacctc

SEQ ID NO: 2344185 - DNA, 18 bp, Homo sapiens
ataaaaccctatacaagt

SEQ ID NO: 2344186 - DNA, 17 bp, Homo sapiens
ataaaactgtttgactt

SEQ ID NO: 2344187 - DNA, 19 bp, Homo sapiens
ataaaactgtttgacttct

SEQ ID NO: 2344188 - DNA, 22 bp, Homo sapiens
ataaaactgtttgacttctcaa

SEQ ID NO: 2344189 - DNA, 20 bp, Homo sapiens
aggggttcctcaaatttttt

SEQ ID NO: 2344190 - DNA, 17 bp, Homo sapiens
agggtatgggaagccat

SEQ ID NO: 2344191 - DNA, 12 bp, Homo sapiens
agggtctgggct

SEQ ID NO: 2344192 - DNA, 18 bp, Homo sapiens
agggtctgggctgggcac

SEQ ID NO: 2344193 - DNA, 23 bp, Homo sapiens
agggtcttgctctgtcccccagg

SEQ ID NO: 2344194 - DNA, 13 bp, Homo sapiens
agggtcttgctgt

SEQ ID NO: 2344195 - DNA, 14 bp, Homo sapiens
agggtgcagcccaa

SEQ ID NO: 2344196 - DNA, 14 bp, Homo sapiens
agggtgctgactgg

SEQ ID NO: 2344197 - DNA, 12 bp, Homo sapiens
agggtggaaata

SEQ ID NO: 2344198 - DNA, 19 bp, Homo sapiens
agggtggaaataatttgaa

SEQ ID NO: 2344199 - DNA, 23 bp, Homo sapiens
agggtgggcttgtggggcctggg

SEQ ID NO: 2344200 - DNA, 18 bp, Homo sapiens
agggtgggggagggaggt

SEQ ID NO: 2344201 - DNA, 18 bp, Homo sapiens
agggttaggaatctcttc

SEQ ID NO: 2344202 - DNA, 19 bp, Homo sapiens
agggttaggaatctcttca

SEQ ID NO: 2344203 - DNA, 20 bp, Homo sapiens
agggttaggaatctcttcac

SEQ ID NO: 2344204 - DNA, 22 bp, Homo sapiens
agggttcaaaatgtctgtagct

SEQ ID NO: 2344205 - DNA, 12 bp, Homo sapiens
agggtttctctg

SEQ ID NO: 2344206 - DNA, 16 bp, Homo sapiens
agggttttcttttctt

SEQ ID NO: 2344207 - DNA, 19 bp, Homo sapiens
aggtaaatggttaaatttt

SEQ ID NO: 2344208 - DNA, 22 bp, Homo sapiens
aggtaaatggttaaattttaca

SEQ ID NO: 2344209 - DNA, 15 bp, Homo sapiens
aggtaacagaacagc

SEQ ID NO: 2344210 - DNA, 22 bp, Homo sapiens
aggtaacagaacagcttcaggt

SEQ ID NO: 2344211 - DNA, 16 bp, Homo sapiens
aggtaccagctgcgct

SEQ ID NO: 2344212 - DNA, 21 bp, Homo sapiens
aggtacccctttctggctctc

SEQ ID NO: 2344213 - DNA, 20 bp, Homo sapiens
aggtagcattctttggagtt

SEQ ID NO: 2344214 - DNA, 19 bp, Homo sapiens
aggtagcgagctgctctgc

SEQ ID NO: 2344215 - DNA, 20 bp, Homo sapiens
aggtagcgagctgctctgct

SEQ ID NO: 2344216 - DNA, 20 bp, Homo sapiens
aggtagtattacaccaccgg

SEQ ID NO: 2344217 - DNA, 17 bp, Homo sapiens
aggtcaagtaagaagac

SEQ ID NO: 2344218 - DNA, 19 bp, Homo sapiens
aggtcaagtaagaagacat

SEQ ID NO: 2344219 - DNA, 20 bp, Homo sapiens
aggtcactggaaaggggaga

SEQ ID NO: 2344220 - DNA, 16 bp, Homo sapiens
aggtcactgtttcctg

SEQ ID NO: 2344221 - DNA, 18 bp, Homo sapiens
aggtcactgtttcctggg

SEQ ID NO: 2344222 - DNA, 16 bp, Homo sapiens
aggtcagcatgtctat

SEQ ID NO: 2344223 - DNA, 19 bp, Homo sapiens
aggtcagttgtgtttttta

SEQ ID NO: 2344224 - DNA, 21 bp, Homo sapiens
aggtctccagttggctttact

SEQ ID NO: 2344225 - DNA, 16 bp, Homo sapiens
aggtgacatgtgaaac

SEQ ID NO: 2344226 - DNA, 20 bp, Homo sapiens
aggtgagtttgagctgcctt

SEQ ID NO: 2344227 - DNA, 22 bp, Homo sapiens
aggtgagtttgagctgccttcc

SEQ ID NO: 2344228 - DNA, 15 bp, Homo sapiens
aggtgataagggaaa

SEQ ID NO: 2344229 - DNA, 21 bp, Homo sapiens
aggtgcaaggagtgtaaaatg

SEQ ID NO: 2344230 - DNA, 23 bp, Homo sapiens
aggtgccactttacccacctaga

SEQ ID NO: 2344231 - DNA, 23 bp, Homo sapiens
aggtgcgcgccaccgtgcctggc

SEQ ID NO: 2344232 - DNA, 19 bp, Homo sapiens
aggtgcgtgttcagcagaa

SEQ ID NO: 2344233 - DNA, 16 bp, Homo sapiens
aggtgctaacatagat

SEQ ID NO: 2344234 - DNA, 18 bp, Homo sapiens
aggtgctaacatagattt

SEQ ID NO: 2344235 - DNA, 14 bp, Homo sapiens
aggtgctgtccatg

SEQ ID NO: 2344236 - DNA, 22 bp, Homo sapiens
aggtggaagaagggagaagaaa

SEQ ID NO: 2344237 - DNA, 23 bp, Homo sapiens
aggtggatgttatgaacagctgt

SEQ ID NO: 2344238 - DNA, 20 bp, Homo sapiens
aggtggccatgttatgctgg

SEQ ID NO: 2344239 - DNA, 13 bp, Homo sapiens
aggtggcctttgt

SEQ ID NO: 2344240 - DNA, 19 bp, Homo sapiens
aggtggcctttgtgctgcg

SEQ ID NO: 2344241 - DNA, 22 bp, Homo sapiens
aggtggcctttgtgctgcgcct

SEQ ID NO: 2344242 - DNA, 17 bp, Homo sapiens
aggtgtcaccctgcaga

SEQ ID NO: 2344243 - DNA, 21 bp, Homo sapiens
aggtgtcaccctgcagagcta

SEQ ID NO: 2344244 - DNA, 17 bp, Homo sapiens
aggtgtgcttcctgctg

SEQ ID NO: 2344245 - DNA, 19 bp, Homo sapiens
aggtgtgcttcctgctgta

SEQ ID NO: 2344246 - DNA, 20 bp, Homo sapiens
aggtgttctacactcatctt

SEQ ID NO: 2344247 - DNA, 18 bp, Homo sapiens
aggttaaaaaaaaaagtc

SEQ ID NO: 2344248 - DNA, 18 bp, Homo sapiens
aggttaaacggtgcccat

SEQ ID NO: 2344249 - DNA, 21 bp, Homo sapiens
aggttacaagcctgcacaata

SEQ ID NO: 2344250 - DNA, 17 bp, Homo sapiens
aggttactgagtgagtt

SEQ ID NO: 2344251 - DNA, 20 bp, Homo sapiens
aggttatcgaaataacaatg

SEQ ID NO: 2344252 - DNA, 21 bp, Homo sapiens
aggttattgcaataaagtata

SEQ ID NO: 2344253 - DNA, 18 bp, Homo sapiens
aggttccgtatctccctg

SEQ ID NO: 2344254 - DNA, 17 bp, Homo sapiens
aggttcttaaaaaggaa

SEQ ID NO: 2344255 - DNA, 15 bp, Homo sapiens
aggttgaataatata

SEQ ID NO: 2344256 - DNA, 13 bp, Homo sapiens
aggtttaaagttt

SEQ ID NO: 2344257 - DNA, 22 bp, Homo sapiens
aggtttacaataggagtggtga

SEQ ID NO: 2344258 - DNA, 17 bp, Homo sapiens
aggtttgttttgtgaat

SEQ ID NO: 2344259 - DNA, 20 bp, Homo sapiens
aggtttgttttgtgaatttt

SEQ ID NO: 2344260 - DNA, 17 bp, Homo sapiens
agtaaatcagaaagtaa

SEQ ID NO: 2344261 - DNA, 15 bp, Homo sapiens
agtaacaatacatga

SEQ ID NO: 2344262 - DNA, 13 bp, Homo sapiens
agtaacagacaca

SEQ ID NO: 2344263 - DNA, 21 bp, Homo sapiens
agtaacatgacttccttattt

SEQ ID NO: 2344264 - DNA, 21 bp, Homo sapiens
agtaacccccttaaatttaat

SEQ ID NO: 2344265 - DNA, 13 bp, Homo sapiens
agtaacttttaaa

SEQ ID NO: 2344266 - DNA, 14 bp, Homo sapiens
agtaagatatctca

SEQ ID NO: 2344267 - DNA, 19 bp, Homo sapiens
agtaaggtgcttggagttt

SEQ ID NO: 2344268 - DNA, 23 bp, Homo sapiens
agtaatattggtgctatttaaca

SEQ ID NO: 2344269 - DNA, 15 bp, Homo sapiens
agtaatgaaatggag

SEQ ID NO: 2344270 - DNA, 16 bp, Homo sapiens
agtaatgacttagaaa

SEQ ID NO: 2344271 - DNA, 19 bp, Homo sapiens
agtaatgacttagaaactg

SEQ ID NO: 2344272 - DNA, 19 bp, Homo sapiens
agtaatttcagtgtaaagt

SEQ ID NO: 2344273 - DNA, 18 bp, Homo sapiens
agtacaaatgaagaaagt

SEQ ID NO: 2344274 - DNA, 13 bp, Homo sapiens
agtacaatttcaa

SEQ ID NO: 2344275 - DNA, 14 bp, Homo sapiens
agtacagaatttga

SEQ ID NO: 2344276 - DNA, 21 bp, Homo sapiens
agtacagagaaattctgtggt

SEQ ID NO: 2344277 - DNA, 22 bp, Homo sapiens
agtacagcggctcccctctgct

SEQ ID NO: 2344278 - DNA, 17 bp, Homo sapiens
agtacatattaggaaaa

SEQ ID NO: 2344279 - DNA, 15 bp, Homo sapiens
agtacatttaaattt

SEQ ID NO: 2344280 - DNA, 21 bp, Homo sapiens
agtaccaaatccacaagccat

SEQ ID NO: 2344281 - DNA, 18 bp, Homo sapiens
agtaccaatgggaagcag

SEQ ID NO: 2344282 - DNA, 21 bp, Homo sapiens
agtaccaatgggaagcaggga

SEQ ID NO: 2344283 - DNA, 19 bp, Homo sapiens
agtaccctccattgggcac

SEQ ID NO: 2344284 - DNA, 23 bp, Homo sapiens
agtacctctcaagctagtgtttc

SEQ ID NO: 2344285 - DNA, 17 bp, Homo sapiens
agtaccttgaactctta

SEQ ID NO: 2344286 - DNA, 12 bp, Homo sapiens
agtactctttaa

SEQ ID NO: 2344287 - DNA, 14 bp, Homo sapiens
agtactctttaaca

SEQ ID NO: 2344288 - DNA, 22 bp, Homo sapiens
agtactctttaacatacaagaa

SEQ ID NO: 2344289 - DNA, 15 bp, Homo sapiens
agtactgggaaggag

SEQ ID NO: 2344290 - DNA, 15 bp, Homo sapiens
agtactggttacttt

SEQ ID NO: 2344291 - DNA, 18 bp, Homo sapiens
agtactggttactttcaa

SEQ ID NO: 2344292 - DNA, 19 bp, Homo sapiens
agtactggttactttcaaa

SEQ ID NO: 2344293 - DNA, 20 bp, Homo sapiens
agtactggttactttcaaaa

SEQ ID NO: 2344294 - DNA, 21 bp, Homo sapiens
agtactggttactttcaaaat

SEQ ID NO: 2344295 - DNA, 17 bp, Homo sapiens
agtagagctagctgcca

SEQ ID NO: 2344296 - DNA, 19 bp, Homo sapiens
agtagagctagctgccact

SEQ ID NO: 2344297 - DNA, 18 bp, Homo sapiens
agtagataatttcagggt

SEQ ID NO: 2344298 - DNA, 19 bp, Homo sapiens
agtagataatttcagggtg

SEQ ID NO: 2344299 - DNA, 16 bp, Homo sapiens
agtagatccatttcca

SEQ ID NO: 2344300 - DNA, 23 bp, Homo sapiens
agtagatccatttccattgctta

SEQ ID NO: 2344301 - DNA, 15 bp, Homo sapiens
agtagatctatatta

SEQ ID NO: 2344302 - DNA, 16 bp, Homo sapiens
agtaggtggcttgagc

SEQ ID NO: 2344303 - DNA, 21 bp, Homo sapiens
agtagtatatttaattttgac

SEQ ID NO: 2344304 - DNA, 23 bp, Homo sapiens
agtagtgtcactgcttgttatgc

SEQ ID NO: 2344305 - DNA, 22 bp, Homo sapiens
agtagttactaaaatttacaca

SEQ ID NO: 2344306 - DNA, 22 bp, Homo sapiens
agtataaaatagtatgaaaatg

SEQ ID NO: 2344307 - DNA, 18 bp, Homo sapiens
agtataatgtttattaaa

SEQ ID NO: 2344308 - DNA, 19 bp, Homo sapiens
agtatacattttataatga

SEQ ID NO: 2344309 - DNA, 20 bp, Homo sapiens
agtatacattttataatgat

SEQ ID NO: 2344310 - DNA, 22 bp, Homo sapiens
agtatactaagagtaaagcaac

SEQ ID NO: 2344311 - DNA, 15 bp, Homo sapiens
agtatcacttttctg

SEQ ID NO: 2344312 - DNA, 15 bp, Homo sapiens
agtatcttgggtgta

SEQ ID NO: 2344313 - DNA, 14 bp, Homo sapiens
agtatgcaatgctt

SEQ ID NO: 2344314 - DNA, 23 bp, Homo sapiens
agtatggtaggggagggcaggct

SEQ ID NO: 2344315 - DNA, 15 bp, Homo sapiens
agtatgtatattaaa

SEQ ID NO: 2344316 - DNA, 18 bp, Homo sapiens
agtatgtatattaaaaaa

SEQ ID NO: 2344317 - DNA, 22 bp, Homo sapiens
agtatgtatattaaaaaagaga

SEQ ID NO: 2344318 - DNA, 20 bp, Homo sapiens
agtattatataaactgtgcc

SEQ ID NO: 2344319 - DNA, 21 bp, Homo sapiens
agtattccatgagctgctcat

SEQ ID NO: 2344320 - DNA, 23 bp, Homo sapiens
agtattctcggatagttgctatt

SEQ ID NO: 2344321 - DNA, 21 bp, Homo sapiens
agtattgaaagccaacaactc

SEQ ID NO: 2344322 - DNA, 14 bp, Homo sapiens
agtattgtttaaaa

SEQ ID NO: 2344323 - DNA, 13 bp, Homo sapiens
agtatttactttt

SEQ ID NO: 2344324 - DNA, 12 bp, Homo sapiens
agtatttccctt

SEQ ID NO: 2344325 - DNA, 14 bp, Homo sapiens
agtatttcccttcc

SEQ ID NO: 2344326 - DNA, 17 bp, Homo sapiens
agtattttgctggaata

SEQ ID NO: 2344327 - DNA, 19 bp, Homo sapiens
agtatttttatacaaacct

SEQ ID NO: 2344328 - DNA, 14 bp, Homo sapiens
agtcaaaaaattat

SEQ ID NO: 2344329 - DNA, 20 bp, Homo sapiens
agtcaaaaaattatttgcta

SEQ ID NO: 2344330 - DNA, 21 bp, Homo sapiens
agtcaacactcttcttgagca

SEQ ID NO: 2344331 - DNA, 21 bp, Homo sapiens
agtcaacttattctttgagta

SEQ ID NO: 2344332 - DNA, 14 bp, Homo sapiens
agtcaatggcttgt

SEQ ID NO: 2344333 - DNA, 15 bp, Homo sapiens
agtcacactgtggcc

SEQ ID NO: 2344334 - DNA, 14 bp, Homo sapiens
agtcaccagagact

SEQ ID NO: 2344335 - DNA, 14 bp, Homo sapiens
agtcacctgcccca

SEQ ID NO: 2344336 - DNA, 20 bp, Homo sapiens
agtcacctgccccagcactc

SEQ ID NO: 2344337 - DNA, 19 bp, Homo sapiens
agtcaccttttctgtggct

SEQ ID NO: 2344338 - DNA, 22 bp, Homo sapiens
agtcagggtgaactgcaaagct

SEQ ID NO: 2344339 - DNA, 15 bp, Homo sapiens
agtcagtgctctcag

SEQ ID NO: 2344340 - DNA, 17 bp, Homo sapiens
agtcagtgctctcagct

SEQ ID NO: 2344341 - DNA, 20 bp, Homo sapiens
agtcatctgtaagagcttgc

SEQ ID NO: 2344342 - DNA, 16 bp, Homo sapiens
agtcatgcataaatat

SEQ ID NO: 2344343 - DNA, 20 bp, Homo sapiens
agtcatgcataaatatgcag

SEQ ID NO: 2344344 - DNA, 22 bp, Homo sapiens
agtcatgcataaatatgcagtg

SEQ ID NO: 2344345 - DNA, 23 bp, Homo sapiens
agtcattaaagacaggagacaaa

SEQ ID NO: 2344346 - DNA, 17 bp, Homo sapiens
agtcattccaagaacta

SEQ ID NO: 2344347 - DNA, 18 bp, Homo sapiens
agtcattgtcgctcagca

SEQ ID NO: 2344348 - DNA, 21 bp, Homo sapiens
agtccaaccagaaacacccct

SEQ ID NO: 2344349 - DNA, 16 bp, Homo sapiens
agtccaacctgcctgt

SEQ ID NO: 2344350 - DNA, 18 bp, Homo sapiens
agtccaacctgcctgtgc

SEQ ID NO: 2344351 - DNA, 21 bp, Homo sapiens
agtccactgttgagccccagt

SEQ ID NO: 2344352 - DNA, 15 bp, Homo sapiens
agtccagtgctctgc

SEQ ID NO: 2344353 - DNA, 20 bp, Homo sapiens
agtccagtgctctgcctcag

SEQ ID NO: 2344354 - DNA, 16 bp, Homo sapiens
agtccattctcccagg

SEQ ID NO: 2344355 - DNA, 19 bp, Homo sapiens
agtccattttttaaaaatg

SEQ ID NO: 2344356 - DNA, 20 bp, Homo sapiens
agtcccagctacttgggagg

SEQ ID NO: 2344357 - DNA, 12 bp, Homo sapiens
agtccccacccc

SEQ ID NO: 2344358 - DNA, 15 bp, Homo sapiens
agtccccacccctgc

SEQ ID NO: 2344359 - DNA, 18 bp, Homo sapiens
agtccccacccctgcccc

SEQ ID NO: 2344360 - DNA, 14 bp, Homo sapiens
agtcccctctctct

SEQ ID NO: 2344361 - DNA, 16 bp, Homo sapiens
agtcccctctctctgg

SEQ ID NO: 2344362 - DNA, 12 bp, Homo sapiens
agtcccctgttg

SEQ ID NO: 2344363 - DNA, 17 bp, Homo sapiens
agtccctccctgcctga

SEQ ID NO: 2344364 - DNA, 18 bp, Homo sapiens
agtccctccctgcctgag

SEQ ID NO: 2344365 - DNA, 19 bp, Homo sapiens
agtccctccctgcctgagg

SEQ ID NO: 2344366 - DNA, 16 bp, Homo sapiens
agtccggatttctaac

SEQ ID NO: 2344367 - DNA, 18 bp, Homo sapiens
agtcctgacactgaattt

SEQ ID NO: 2344368 - DNA, 17 bp, Homo sapiens
agtcctggcacagtttt

SEQ ID NO: 2344369 - DNA, 18 bp, Homo sapiens
agtcgtacagaaagctgc

SEQ ID NO: 2344370 - DNA, 14 bp, Homo sapiens
agtcgtgatgtgga

SEQ ID NO: 2344371 - DNA, 22 bp, Homo sapiens
agtctatatggttctccaagaa

SEQ ID NO: 2344372 - DNA, 16 bp, Homo sapiens
agtctcagttctcttg

SEQ ID NO: 2344373 - DNA, 16 bp, Homo sapiens
agtctgaatttttaaa

SEQ ID NO: 2344374 - DNA, 14 bp, Homo sapiens
agtcttaactggtc

SEQ ID NO: 2344375 - DNA, 23 bp, Homo sapiens
agtcttaataaaataaactagat

SEQ ID NO: 2344376 - DNA, 12 bp, Homo sapiens
agtcttgaagtt

SEQ ID NO: 2344377 - DNA, 19 bp, Homo sapiens
agtcttgaagttgggtgtt

SEQ ID NO: 2344378 - DNA, 23 bp, Homo sapiens
agtcttgaagttgggtgtttcca

SEQ ID NO: 2344379 - DNA, 16 bp, Homo sapiens
agtcttggaagctgtt

SEQ ID NO: 2344380 - DNA, 22 bp, Homo sapiens
agtcttggaagctgtttggaaa

SEQ ID NO: 2344381 - DNA, 14 bp, Homo sapiens
agtctttgctcagt

SEQ ID NO: 2344382 - DNA, 14 bp, Homo sapiens
agtgaaaaagatgt

SEQ ID NO: 2344383 - DNA, 13 bp, Homo sapiens
agtgaaaaatctt

SEQ ID NO: 2344384 - DNA, 20 bp, Homo sapiens
agtgaacattcccagcccag

SEQ ID NO: 2344385 - DNA, 21 bp, Homo sapiens
agtgaacattcccagcccagc

SEQ ID NO: 2344386 - DNA, 14 bp, Homo sapiens
agtgaactcctgcc

SEQ ID NO: 2344387 - DNA, 15 bp, Homo sapiens
agtgaactcctgcca

SEQ ID NO: 2344388 - DNA, 15 bp, Homo sapiens
agtgaatacattaac

SEQ ID NO: 2344389 - DNA, 22 bp, Homo sapiens
agtgaatacattaacggtgcta

SEQ ID NO: 2344390 - DNA, 13 bp, Homo sapiens
agtgaatctgatt

SEQ ID NO: 2344391 - DNA, 16 bp, Homo sapiens
agtgacacccagaggg

SEQ ID NO: 2344392 - DNA, 17 bp, Homo sapiens
agtgacacccagaggga

SEQ ID NO: 2344393 - DNA, 21 bp, Homo sapiens
agtgacagctttctgggatgt

SEQ ID NO: 2344394 - DNA, 13 bp, Homo sapiens
agtgacttcctgg

SEQ ID NO: 2344395 - DNA, 18 bp, Homo sapiens
agtgacttcctggtgagg

SEQ ID NO: 2344396 - DNA, 18 bp, Homo sapiens
agtgagcagaacaggtag

SEQ ID NO: 2344397 - DNA, 19 bp, Homo sapiens
agtgagcagaacaggtagt

SEQ ID NO: 2344398 - DNA, 21 bp, Homo sapiens
agtgatatggcagaagacacc

SEQ ID NO: 2344399 - DNA, 24 bp, Homo sapiens
agtgatatggcagaagacaccaga

SEQ ID NO: 2344400 - DNA, 16 bp, Homo sapiens
agtgatccttacaagt

SEQ ID NO: 2344401 - DNA, 21 bp, Homo sapiens
agtgatttgtaaaacagtggt

SEQ ID NO: 2344402 - DNA, 22 bp, Homo sapiens
agtgcaatgcttgtagaagtag

SEQ ID NO: 2344403 - DNA, 17 bp, Homo sapiens
agtgcagagccttctca

SEQ ID NO: 2344404 - DNA, 19 bp, Homo sapiens
agtgcagagccttctcaga

SEQ ID NO: 2344405 - DNA, 14 bp, Homo sapiens
agtgcatatgcaat

SEQ ID NO: 2344406 - DNA, 20 bp, Homo sapiens
agtgcatttttgtaaatgtg

SEQ ID NO: 2344407 - DNA, 20 bp, Homo sapiens
agtgccccattctcactgct

SEQ ID NO: 2344408 - DNA, 12 bp, Homo sapiens
agtgccctccag

SEQ ID NO: 2344409 - DNA, 13 bp, Homo sapiens
agtgccctccagc

SEQ ID NO: 2344410 - DNA, 17 bp, Homo sapiens
agtgccctccagccccg

SEQ ID NO: 2344411 - DNA, 13 bp, Homo sapiens
agtgccctctccc

SEQ ID NO: 2344412 - DNA, 22 bp, Homo sapiens
agtgccctctcccaccctcttc

SEQ ID NO: 2344413 - DNA, 17 bp, Homo sapiens
agtgcctcacctcgaaa

SEQ ID NO: 2344414 - DNA, 13 bp, Homo sapiens
agtgcgtgtgtag

SEQ ID NO: 2344415 - DNA, 16 bp, Homo sapiens
agtgcgtgtgtagagt

SEQ ID NO: 2344416 - DNA, 18 bp, Homo sapiens
agtgcgtgtgtagagtta

SEQ ID NO: 2344417 - DNA, 22 bp, Homo sapiens
agtgctcaccagccctgcagcc

SEQ ID NO: 2344418 - DNA, 14 bp, Homo sapiens
agtgctctcagctg

SEQ ID NO: 2344419 - DNA, 12 bp, Homo sapiens
agtgctctgcct

SEQ ID NO: 2344420 - DNA, 12 bp, Homo sapiens
atacattttata

SEQ ID NO: 2344421 - DNA, 14 bp, Homo sapiens
atacattttataat

SEQ ID NO: 2344422 - DNA, 13 bp, Homo sapiens
atacattttctaa

SEQ ID NO: 2344423 - DNA, 16 bp, Homo sapiens
atacattttctaaata

SEQ ID NO: 2344424 - DNA, 22 bp, Homo sapiens
atacattttctaaataaaaata

SEQ ID NO: 2344425 - DNA, 15 bp, Homo sapiens
ataccacatcaaata

SEQ ID NO: 2344426 - DNA, 14 bp, Homo sapiens
ataccacattttct

SEQ ID NO: 2344427 - DNA, 15 bp, Homo sapiens
ataccctgacctggc

SEQ ID NO: 2344428 - DNA, 16 bp, Homo sapiens
atacctctgtgtgctc

SEQ ID NO: 2344429 - DNA, 17 bp, Homo sapiens
atacctctgtgtgctcc

SEQ ID NO: 2344430 - DNA, 16 bp, Homo sapiens
atactccttaaaaatg

SEQ ID NO: 2344431 - DNA, 17 bp, Homo sapiens
atactccttaaaaatgt

SEQ ID NO: 2344432 - DNA, 22 bp, Homo sapiens
atactccttaaaaatgtatgtt

SEQ ID NO: 2344433 - DNA, 18 bp, Homo sapiens
atactccttgcttcctga

SEQ ID NO: 2344434 - DNA, 18 bp, Homo sapiens
atactgattgggaggtgc

SEQ ID NO: 2344435 - DNA, 22 bp, Homo sapiens
atactgattgggaggtgcgtgt

SEQ ID NO: 2344436 - DNA, 15 bp, Homo sapiens
atactgcatactttt

SEQ ID NO: 2344437 - DNA, 21 bp, Homo sapiens
atactgcatactttttaaatg

SEQ ID NO: 2344438 - DNA, 13 bp, Homo sapiens
atactggcacaga

SEQ ID NO: 2344439 - DNA, 15 bp, Homo sapiens
atactggcacagagg

SEQ ID NO: 2344440 - DNA, 20 bp, Homo sapiens
atactttagtacaatttcaa

SEQ ID NO: 2344441 - DNA, 13 bp, Homo sapiens
atactttgtattt

SEQ ID NO: 2344442 - DNA, 14 bp, Homo sapiens
atagaaagaagcca

SEQ ID NO: 2344443 - DNA, 16 bp, Homo sapiens
atagacaaaaagtata

SEQ ID NO: 2344444 - DNA, 16 bp, Homo sapiens
atagacattctcacat

SEQ ID NO: 2344445 - DNA, 19 bp, Homo sapiens
atagactgtaacttccaaa

SEQ ID NO: 2344446 - DNA, 23 bp, Homo sapiens
atagaggatagggagaatattta

SEQ ID NO: 2344447 - DNA, 20 bp, Homo sapiens
atagaggctagcttctgctt

SEQ ID NO: 2344448 - DNA, 22 bp, Homo sapiens
atagaggcttctccgccagcct

SEQ ID NO: 2344449 - DNA, 16 bp, Homo sapiens
atagagttgattgtct

SEQ ID NO: 2344450 - DNA, 23 bp, Homo sapiens
atagatcctggttaccactcttt

SEQ ID NO: 2344451 - DNA, 14 bp, Homo sapiens
atagcaaatgacat

SEQ ID NO: 2344452 - DNA, 16 bp, Homo sapiens
atagcaacaacaattg

SEQ ID NO: 2344453 - DNA, 19 bp, Homo sapiens
atagcaacaacaattggta

SEQ ID NO: 2344454 - DNA, 14 bp, Homo sapiens
atagcaactaatgt

SEQ ID NO: 2344455 - DNA, 16 bp, Homo sapiens
atagcaactaatgttt

SEQ ID NO: 2344456 - DNA, 19 bp, Homo sapiens
atagcagatctgttttgtg

SEQ ID NO: 2344457 - DNA, 18 bp, Homo sapiens
atagcagtatatgttaat

SEQ ID NO: 2344458 - DNA, 20 bp, Homo sapiens
atagcatgacaggctgttca

SEQ ID NO: 2344459 - DNA, 14 bp, Homo sapiens
atagcatgcttcct

SEQ ID NO: 2344460 - DNA, 21 bp, Homo sapiens
atagcatgcttcctttctctc

SEQ ID NO: 2344461 - DNA, 15 bp, Homo sapiens
atagcctgaggtccc

SEQ ID NO: 2344462 - DNA, 20 bp, Homo sapiens
atagcctggccaccagccat

SEQ ID NO: 2344463 - DNA, 22 bp, Homo sapiens
atagctaagatataatttaaac

SEQ ID NO: 2344464 - DNA, 16 bp, Homo sapiens
atagctaataatacct

SEQ ID NO: 2344465 - DNA, 20 bp, Homo sapiens
ataggaatcattcagaaatg

SEQ ID NO: 2344466 - DNA, 19 bp, Homo sapiens
ataggagaggatgagagcc

SEQ ID NO: 2344467 - DNA, 21 bp, Homo sapiens
ataggagaggatgagagccca

SEQ ID NO: 2344468 - DNA, 22 bp, Homo sapiens
ataggctattttctaaagactt

SEQ ID NO: 2344469 - DNA, 20 bp, Homo sapiens
atagggagaatatttactaa

SEQ ID NO: 2344470 - DNA, 14 bp, Homo sapiens
atagggtctaactc

SEQ ID NO: 2344471 - DNA, 17 bp, Homo sapiens
atagtagttacttgtga

SEQ ID NO: 2344472 - DNA, 16 bp, Homo sapiens
atagtataaaaaatgg

SEQ ID NO: 2344473 - DNA, 15 bp, Homo sapiens
atagtatacatttta

SEQ ID NO: 2344474 - DNA, 18 bp, Homo sapiens
atagtctaagactatata

SEQ ID NO: 2344475 - DNA, 22 bp, Homo sapiens
atagtcttggaagctgtttgga

SEQ ID NO: 2344476 - DNA, 19 bp, Homo sapiens
atagtgtcatataaactca

SEQ ID NO: 2344477 - DNA, 20 bp, Homo sapiens
atagtgtcatataaactcat

SEQ ID NO: 2344478 - DNA, 18 bp, Homo sapiens
atagttctgtaataaaac

SEQ ID NO: 2344479 - DNA, 12 bp, Homo sapiens
atagttgaatta

SEQ ID NO: 2344480 - DNA, 20 bp, Homo sapiens
atagttgcatagcagtatat

SEQ ID NO: 2344481 - DNA, 21 bp, Homo sapiens
atagttgtaaagatattgtat

SEQ ID NO: 2344482 - DNA, 23 bp, Homo sapiens
atagttgtaaagatattgtatct

SEQ ID NO: 2344483 - DNA, 19 bp, Homo sapiens
atagttgtagacaaagtac

SEQ ID NO: 2344484 - DNA, 22 bp, Homo sapiens
atagttttacttttaaactgtg

SEQ ID NO: 2344485 - DNA, 14 bp, Homo sapiens
atataaactcattt

SEQ ID NO: 2344486 - DNA, 15 bp, Homo sapiens
atataaactgtgcca

SEQ ID NO: 2344487 - DNA, 12 bp, Homo sapiens
atataaatgttg

SEQ ID NO: 2344488 - DNA, 12 bp, Homo sapiens
atataacacatt

SEQ ID NO: 2344489 - DNA, 15 bp, Homo sapiens
atataagacatttgt

SEQ ID NO: 2344490 - DNA, 15 bp, Homo sapiens
atataatgttgataa

SEQ ID NO: 2344491 - DNA, 17 bp, Homo sapiens
atatacagtatagattt

SEQ ID NO: 2344492 - DNA, 18 bp, Homo sapiens
atatacatactgcatctt

SEQ ID NO: 2344493 - DNA, 14 bp, Homo sapiens
atatacattttcta

SEQ ID NO: 2344494 - DNA, 14 bp, Homo sapiens
atatagattttatt

SEQ ID NO: 2344495 - DNA, 22 bp, Homo sapiens
atataggctattttctaaagac

SEQ ID NO: 2344496 - DNA, 20 bp, Homo sapiens
atatagtatctttaaaattt

SEQ ID NO: 2344497 - DNA, 17 bp, Homo sapiens
atatataaaacggtgct

SEQ ID NO: 2344498 - DNA, 13 bp, Homo sapiens
atatataaatgta

SEQ ID NO: 2344499 - DNA, 15 bp, Homo sapiens
atatataaatgtata

SEQ ID NO: 2344500 - DNA, 17 bp, Homo sapiens
atatataatgttgccag

SEQ ID NO: 2344501 - DNA, 15 bp, Homo sapiens
atatatataaatgta

SEQ ID NO: 2344502 - DNA, 12 bp, Homo sapiens
atatatatacat

SEQ ID NO: 2344503 - DNA, 15 bp, Homo sapiens
atatatcaagaagtc

SEQ ID NO: 2344504 - DNA, 17 bp, Homo sapiens
atatatcaagaagtctt

SEQ ID NO: 2344505 - DNA, 18 bp, Homo sapiens
atatatgaccagaagcct

SEQ ID NO: 2344506 - DNA, 16 bp, Homo sapiens
atatattaaaattcca

SEQ ID NO: 2344507 - DNA, 20 bp, Homo sapiens
atatattaaaattccaaatt

SEQ ID NO: 2344508 - DNA, 17 bp, Homo sapiens
atatattgaacttttgt

SEQ ID NO: 2344509 - DNA, 18 bp, Homo sapiens
atatattgaacttttgta

SEQ ID NO: 2344510 - DNA, 16 bp, Homo sapiens
atatattttacaattt

SEQ ID NO: 2344511 - DNA, 12 bp, Homo sapiens
atatattttcat

SEQ ID NO: 2344512 - DNA, 13 bp, Homo sapiens
atatcaaagtcat

SEQ ID NO: 2344513 - DNA, 23 bp, Homo sapiens
atatcaaataaaatatcataaag

SEQ ID NO: 2344514 - DNA, 18 bp, Homo sapiens
atatcaggaaatatctgt

SEQ ID NO: 2344515 - DNA, 18 bp, Homo sapiens
atatcaggtgtataaatg

SEQ ID NO: 2344516 - DNA, 23 bp, Homo sapiens
atatcaggtgtataaatgtacat

SEQ ID NO: 2344517 - DNA, 16 bp, Homo sapiens
atatcataaagcattt

SEQ ID NO: 2344518 - DNA, 21 bp, Homo sapiens
atatccatgacctagttttcc

SEQ ID NO: 2344519 - DNA, 17 bp, Homo sapiens
atatcctctccccctcc

SEQ ID NO: 2344520 - DNA, 20 bp, Homo sapiens
atatcctctccccctcctcc

SEQ ID NO: 2344521 - DNA, 16 bp, Homo sapiens
atatctatttgaataa

SEQ ID NO: 2344522 - DNA, 23 bp, Homo sapiens
atatctcaatgaaccataaattc

SEQ ID NO: 2344523 - DNA, 19 bp, Homo sapiens
atatgaacatattgttgaa

SEQ ID NO: 2344524 - DNA, 14 bp, Homo sapiens
atatgaatctataa

SEQ ID NO: 2344525 - DNA, 12 bp, Homo sapiens
atatgaccagaa

SEQ ID NO: 2344526 - DNA, 16 bp, Homo sapiens
atatgattaaattatc

SEQ ID NO: 2344527 - DNA, 19 bp, Homo sapiens
atatgctttattaatgttt

SEQ ID NO: 2344528 - DNA, 20 bp, Homo sapiens
atatgctttattaatgtttt

SEQ ID NO: 2344529 - DNA, 14 bp, Homo sapiens
atatggaagaaagt

SEQ ID NO: 2344530 - DNA, 15 bp, Homo sapiens
atatggcagaagaca

SEQ ID NO: 2344531 - DNA, 17 bp, Homo sapiens
atatgggggcatctctt

SEQ ID NO: 2344532 - DNA, 22 bp, Homo sapiens
atatggttctccaagaaactga

SEQ ID NO: 2344533 - DNA, 20 bp, Homo sapiens
atatgtattcttttctcagt

SEQ ID NO: 2344534 - DNA, 16 bp, Homo sapiens
atatgtgatctgggca

SEQ ID NO: 2344535 - DNA, 16 bp, Homo sapiens
atatgttaatttgtgt

SEQ ID NO: 2344536 - DNA, 24 bp, Homo sapiens
atattaaaaaacttcatgtaattt

SEQ ID NO: 2344537 - DNA, 17 bp, Homo sapiens
atattaaaaaagagaca

SEQ ID NO: 2344538 - DNA, 15 bp, Homo sapiens
atattaaaattccaa

SEQ ID NO: 2344539 - DNA, 22 bp, Homo sapiens
atattaagtgtgccaaatcagt

SEQ ID NO: 2344540 - DNA, 15 bp, Homo sapiens
atattaggaaaatat

SEQ ID NO: 2344541 - DNA, 19 bp, Homo sapiens
atattataaaggataaaga

SEQ ID NO: 2344542 - DNA, 23 bp, Homo sapiens
atattataaaggataaagaagga

SEQ ID NO: 2344543 - DNA, 16 bp, Homo sapiens
atattataactctgta

SEQ ID NO: 2344544 - DNA, 11 bp, Homo sapiens
atattatagaa

SEQ ID NO: 2344545 - DNA, 12 bp, Homo sapiens
atattatttctt

SEQ ID NO: 2344546 - DNA, 20 bp, Homo sapiens
atattcagggtaaataggaa

SEQ ID NO: 2344547 - DNA, 17 bp, Homo sapiens
atattccagatctttca

SEQ ID NO: 2344548 - DNA, 12 bp, Homo sapiens
atattcctttgc

SEQ ID NO: 2344549 - DNA, 17 bp, Homo sapiens
atattcttttgtttcca

SEQ ID NO: 2344550 - DNA, 20 bp, Homo sapiens
atattgaacttttgtactga

SEQ ID NO: 2344551 - DNA, 15 bp, Homo sapiens
atattgattgggaaa

SEQ ID NO: 2344552 - DNA, 20 bp, Homo sapiens
atattggggaccaaatcaaa

SEQ ID NO: 2344553 - DNA, 21 bp, Homo sapiens
atattggggaccaaatcaaat

SEQ ID NO: 2344554 - DNA, 14 bp, Homo sapiens
atattggttcttcc

SEQ ID NO: 2344555 - DNA, 17 bp, Homo sapiens
atattggtttatgtagt

SEQ ID NO: 2344556 - DNA, 14 bp, Homo sapiens
atattgtgattctg

SEQ ID NO: 2344557 - DNA, 19 bp, Homo sapiens
atattgtgattctgccttt

SEQ ID NO: 2344558 - DNA, 19 bp, Homo sapiens
atattgtttctgcattcat

SEQ ID NO: 2344559 - DNA, 14 bp, Homo sapiens
atattgtttggtaa

SEQ ID NO: 2344560 - DNA, 19 bp, Homo sapiens
atattgttttacaatagtt

SEQ ID NO: 2344561 - DNA, 10 bp, Homo sapiens
atatttccta

SEQ ID NO: 2344562 - DNA, 14 bp, Homo sapiens
atatttcctttatg

SEQ ID NO: 2344563 - DNA, 17 bp, Homo sapiens
atatttcctttatgtga

SEQ ID NO: 2344564 - DNA, 18 bp, Homo sapiens
atatttcctttatgtgaa

SEQ ID NO: 2344565 - DNA, 14 bp, Homo sapiens
atatttctattgaa

SEQ ID NO: 2344566 - DNA, 14 bp, Homo sapiens
atatttgatttcta

SEQ ID NO: 2344567 - DNA, 15 bp, Homo sapiens
atatttgcacatggg

SEQ ID NO: 2344568 - DNA, 16 bp, Homo sapiens
atatttgcacatggga

SEQ ID NO: 2344569 - DNA, 15 bp, Homo sapiens
atatttgttatgtag

SEQ ID NO: 2344570 - DNA, 14 bp, Homo sapiens
atattttatattac

SEQ ID NO: 2344571 - DNA, 13 bp, Homo sapiens
atattttgctgct

SEQ ID NO: 2344572 - DNA, 15 bp, Homo sapiens
atatttttatcttta

SEQ ID NO: 2344573 - DNA, 22 bp, Homo sapiens
atatttttatctttatatgaag

SEQ ID NO: 2344574 - DNA, 16 bp, Homo sapiens
atatttttgtatttct

SEQ ID NO: 2344575 - DNA, 19 bp, Homo sapiens
atatttttgtatttctcta

SEQ ID NO: 2344576 - DNA, 19 bp, Homo sapiens
atcaaagtcattaaagaca

SEQ ID NO: 2344577 - DNA, 22 bp, Homo sapiens
atcaaagtcattaaagacagga

SEQ ID NO: 2344578 - DNA, 14 bp, Homo sapiens
atcaaataagaaat

SEQ ID NO: 2344579 - DNA, 23 bp, Homo sapiens
atcaaccacctatttttgacatg

SEQ ID NO: 2344580 - DNA, 13 bp, Homo sapiens
atcaactctgaag

SEQ ID NO: 2344581 - DNA, 12 bp, Homo sapiens
atcaagagaaac

SEQ ID NO: 2344582 - DNA, 14 bp, Homo sapiens
atcaagagaaactt

SEQ ID NO: 2344583 - DNA, 19 bp, Homo sapiens
atcaatacactagttgttt

SEQ ID NO: 2344584 - DNA, 18 bp, Homo sapiens
atcaatgataatgctaat

SEQ ID NO: 2344585 - DNA, 14 bp, Homo sapiens
atcacaaatggaat

SEQ ID NO: 2344586 - DNA, 16 bp, Homo sapiens
atcacaatgagaaaaa

SEQ ID NO: 2344587 - DNA, 16 bp, Homo sapiens
atcacactcgtctttc

SEQ ID NO: 2344588 - DNA, 14 bp, Homo sapiens
atcacagtctcagt

SEQ ID NO: 2344589 - DNA, 17 bp, Homo sapiens
atcacagtctcagttct

SEQ ID NO: 2344590 - DNA, 14 bp, Homo sapiens
atcacatttctatg

SEQ ID NO: 2344591 - DNA, 15 bp, Homo sapiens
atcaccctcttcctg

SEQ ID NO: 2344592 - DNA, 16 bp, Homo sapiens
atcaccctcttcctgt

SEQ ID NO: 2344593 - DNA, 18 bp, Homo sapiens
atcacgatgtaaattatt

SEQ ID NO: 2344594 - DNA, 18 bp, Homo sapiens
atcacgctttcctgaatc

SEQ ID NO: 2344595 - DNA, 23 bp, Homo sapiens
atcactgtagtttagttctgttg

SEQ ID NO: 2344596 - DNA, 17 bp, Homo sapiens
atcactgttgctttgaa

SEQ ID NO: 2344597 - DNA, 20 bp, Homo sapiens
atcactgttgctttgaaaaa

SEQ ID NO: 2344598 - DNA, 12 bp, Homo sapiens
atcactttcata

SEQ ID NO: 2344599 - DNA, 16 bp, Homo sapiens
atcactttctcagttt

SEQ ID NO: 2344600 - DNA, 18 bp, Homo sapiens
atcactttctcagttttc

SEQ ID NO: 2344601 - DNA, 15 bp, Homo sapiens
atcagaaaaagcata

SEQ ID NO: 2344602 - DNA, 15 bp, Homo sapiens
atcagatgcctgctt

SEQ ID NO: 2344603 - DNA, 13 bp, Homo sapiens
atcagcaaagaaa

SEQ ID NO: 2344604 - DNA, 14 bp, Homo sapiens
atcagcattttaga

SEQ ID NO: 2344605 - DNA, 16 bp, Homo sapiens
atcagctacaattgta

SEQ ID NO: 2344606 - DNA, 23 bp, Homo sapiens
atcaggagaaagcttggttctgt

SEQ ID NO: 2344607 - DNA, 12 bp, Homo sapiens
atcagtaaatag

SEQ ID NO: 2344608 - DNA, 22 bp, Homo sapiens
atcagttacagtggcagtattg

SEQ ID NO: 2344609 - DNA, 22 bp, Homo sapiens
atcagttacccactcggtccca

SEQ ID NO: 2344610 - DNA, 14 bp, Homo sapiens
atcataaagcattt

SEQ ID NO: 2344611 - DNA, 16 bp, Homo sapiens
atcatacaaactctca

SEQ ID NO: 2344612 - DNA, 20 bp, Homo sapiens
atcatcaacaagatttcctt

SEQ ID NO: 2344613 - DNA, 17 bp, Homo sapiens
atcatccagatgtggct

SEQ ID NO: 2344614 - DNA, 15 bp, Homo sapiens
atcatgaattttaaa

SEQ ID NO: 2344615 - DNA, 18 bp, Homo sapiens
atcatgaattttaaagta

SEQ ID NO: 2344616 - DNA, 19 bp, Homo sapiens
atcatgccagtatttttaa

SEQ ID NO: 2344617 - DNA, 21 bp, Homo sapiens
atcatgcggtgggtgctgcca

SEQ ID NO: 2344618 - DNA, 18 bp, Homo sapiens
atcatggtgtaataagac

SEQ ID NO: 2344619 - DNA, 21 bp, Homo sapiens
atcatgttccccctaaacatg

SEQ ID NO: 2344620 - DNA, 13 bp, Homo sapiens
atcattcagaaat

SEQ ID NO: 2344621 - DNA, 23 bp, Homo sapiens
atcattcttactaaaaagtataa

SEQ ID NO: 2344622 - DNA, 19 bp, Homo sapiens
atcattgtttgtcctttat

SEQ ID NO: 2344623 - DNA, 21 bp, Homo sapiens
atcattgtttgtcctttatgt

SEQ ID NO: 2344624 - DNA, 16 bp, Homo sapiens
atcatttcaggagtta

SEQ ID NO: 2344625 - DNA, 17 bp, Homo sapiens
atcatttttatattata

SEQ ID NO: 2344626 - DNA, 20 bp, Homo sapiens
atccaaaaaaagggaaggat

SEQ ID NO: 2344627 - DNA, 16 bp, Homo sapiens
atccaactaatgcctt

SEQ ID NO: 2344628 - DNA, 16 bp, Homo sapiens
atccaactccagcaac

SEQ ID NO: 2344629 - DNA, 16 bp, Homo sapiens
atccaagcctccacag

SEQ ID NO: 2344630 - DNA, 21 bp, Homo sapiens
atccaagcctccacagcgagg

SEQ ID NO: 2344631 - DNA, 19 bp, Homo sapiens
atccaaggaaacattttat

SEQ ID NO: 2344632 - DNA, 21 bp, Homo sapiens
atccaccttcccttctacaag

SEQ ID NO: 2344633 - DNA, 15 bp, Homo sapiens
atccagaagagccca

SEQ ID NO: 2344634 - DNA, 14 bp, Homo sapiens
atccagagagcagc

SEQ ID NO: 2344635 - DNA, 15 bp, Homo sapiens
atccagagagcagct

SEQ ID NO: 2344636 - DNA, 19 bp, Homo sapiens
atccagcctggggctgagg

SEQ ID NO: 2344637 - DNA, 22 bp, Homo sapiens
atccatgacctagttttccatg

SEQ ID NO: 2344638 - DNA, 15 bp, Homo sapiens
atccattacctccat

SEQ ID NO: 2344639 - DNA, 14 bp, Homo sapiens
atccattggagaag

SEQ ID NO: 2344640 - DNA, 17 bp, Homo sapiens
atccatttccattgctt

SEQ ID NO: 2344641 - DNA, 22 bp, Homo sapiens
atcccaaccaggcacctcttcc

SEQ ID NO: 2344642 - DNA, 19 bp, Homo sapiens
atcccaacctctttttcct

SEQ ID NO: 2344643 - DNA, 22 bp, Homo sapiens
atcccacatccaactccagcaa

SEQ ID NO: 2344644 - DNA, 20 bp, Homo sapiens
atcccacccacatgtgacac

SEQ ID NO: 2344645 - DNA, 23 bp, Homo sapiens
atcccacccacatgtgacacata

SEQ ID NO: 2344646 - DNA, 13 bp, Homo sapiens
atcccagctgcct

SEQ ID NO: 2344647 - DNA, 23 bp, Homo sapiens
atcccatcgtctcggccttcaca

SEQ ID NO: 2344648 - DNA, 18 bp, Homo sapiens
atccccatctccctgcct

SEQ ID NO: 2344649 - DNA, 13 bp, Homo sapiens
atcccccctgctc

SEQ ID NO: 2344650 - DNA, 19 bp, Homo sapiens
atcccgggcctcagtgccc

SEQ ID NO: 2344651 - DNA, 23 bp, Homo sapiens
atccctctaatgagactgaccat

SEQ ID NO: 2344652 - DNA, 22 bp, Homo sapiens
atccctttttcataaattattt

SEQ ID NO: 2344653 - DNA, 15 bp, Homo sapiens
atcctaatttctcct

SEQ ID NO: 2344654 - DNA, 19 bp, Homo sapiens
atcctaatttctcctccct

SEQ ID NO: 2344655 - DNA, 18 bp, Homo sapiens
atcctcaggtagtactgg

SEQ ID NO: 2344656 - DNA, 22 bp, Homo sapiens
atcctcaggtagtactgggaat

SEQ ID NO: 2344657 - DNA, 17 bp, Homo sapiens
atcctccctccacctca

SEQ ID NO: 2344658 - DNA, 12 bp, Homo sapiens
atcctcctgcct

SEQ ID NO: 2344659 - DNA, 15 bp, Homo sapiens
atcctcctgcctcag

SEQ ID NO: 2344660 - DNA, 20 bp, Homo sapiens
atcctcctgcctcagccttc

SEQ ID NO: 2344661 - DNA, 15 bp, Homo sapiens
atcctctctctcttc

SEQ ID NO: 2344662 - DNA, 20 bp, Homo sapiens
atcctgagcttttctcctca

SEQ ID NO: 2344663 - DNA, 19 bp, Homo sapiens
atcctgcagggcttctcct

SEQ ID NO: 2344664 - DNA, 18 bp, Homo sapiens
atcctgggggcctgggtt

SEQ ID NO: 2344665 - DNA, 21 bp, Homo sapiens
atcctgggggcctgggttggg

SEQ ID NO: 2344666 - DNA, 13 bp, Homo sapiens
atccttacaagtt

SEQ ID NO: 2344667 - DNA, 13 bp, Homo sapiens
atccttagaggtc

SEQ ID NO: 2344668 - DNA, 18 bp, Homo sapiens
atccttcaaaataaaaag

SEQ ID NO: 2344669 - DNA, 14 bp, Homo sapiens
atccttcagcacag

SEQ ID NO: 2344670 - DNA, 24 bp, Homo sapiens
atccttggagagcagctggctctc

SEQ ID NO: 2344671 - DNA, 22 bp, Homo sapiens
atccttgggggctcccagggca

SEQ ID NO: 2344672 - DNA, 12 bp, Homo sapiens
atccttgtcttt

SEQ ID NO: 2344673 - DNA, 21 bp, Homo sapiens
atccttgtcttttgagctatt

SEQ ID NO: 2344674 - DNA, 11 bp, Homo sapiens
atcctttcaaa

SEQ ID NO: 2344675 - DNA, 22 bp, Homo sapiens
atccttttgaaggtagttgcaa

SEQ ID NO: 2344676 - DNA, 14 bp, Homo sapiens
atcgaaaagttatt

SEQ ID NO: 2344677 - DNA, 19 bp, Homo sapiens
atcgaaataacaatgttaa

SEQ ID NO: 2344678 - DNA, 19 bp, Homo sapiens
atcgagaccatcctggcta

SEQ ID NO: 2344679 - DNA, 19 bp, Homo sapiens
atcgccctcctttccctta

SEQ ID NO: 2344680 - DNA, 19 bp, Homo sapiens
atcggtgaaactaacagat

SEQ ID NO: 2344681 - DNA, 16 bp, Homo sapiens
atcggttgttctttcc

SEQ ID NO: 2344682 - DNA, 14 bp, Homo sapiens
atcgtgctactgca

SEQ ID NO: 2344683 - DNA, 22 bp, Homo sapiens
atcgtgtgccatggatctgatc

SEQ ID NO: 2344684 - DNA, 15 bp, Homo sapiens
atcgtttttgtattt

SEQ ID NO: 2344685 - DNA, 16 bp, Homo sapiens
atctaaaaaaatgttt

SEQ ID NO: 2344686 - DNA, 19 bp, Homo sapiens
atctaaaatgttttatgac

SEQ ID NO: 2344687 - DNA, 15 bp, Homo sapiens
atctaatacctctgt

SEQ ID NO: 2344688 - DNA, 19 bp, Homo sapiens
atctaatacctctgtgtgc

SEQ ID NO: 2344689 - DNA, 17 bp, Homo sapiens
atctacaagccaaaagt

SEQ ID NO: 2344690 - DNA, 19 bp, Homo sapiens
atctacaatctctttttgt

SEQ ID NO: 2344691 - DNA, 22 bp, Homo sapiens
atctaggagcaaggtgagaaat

SEQ ID NO: 2344692 - DNA, 22 bp, Homo sapiens
atctataagtagtaaatcagaa

SEQ ID NO: 2344693 - DNA, 23 bp, Homo sapiens
atctataagtagtaaatcagaaa

SEQ ID NO: 2344694 - DNA, 17 bp, Homo sapiens
atctataggcagcttct

SEQ ID NO: 2344695 - DNA, 21 bp, Homo sapiens
atctataggcagcttctaaga

SEQ ID NO: 2344696 - DNA, 12 bp, Homo sapiens
atctatattaga

SEQ ID NO: 2344697 - DNA, 13 bp, Homo sapiens
atctatggcttat

SEQ ID NO: 2344698 - DNA, 14 bp, Homo sapiens
atctatttgaataa

SEQ ID NO: 2344699 - DNA, 16 bp, Homo sapiens
atctatttgaataaat

SEQ ID NO: 2344700 - DNA, 23 bp, Homo sapiens
atctatttttggcagtctgaatt

SEQ ID NO: 2344701 - DNA, 23 bp, Homo sapiens
atctcaatgaaccataaattcaa

SEQ ID NO: 2344702 - DNA, 16 bp, Homo sapiens
atctcacaggctgaga

SEQ ID NO: 2344703 - DNA, 14 bp, Homo sapiens
atctcactctgccc

SEQ ID NO: 2344704 - DNA, 22 bp, Homo sapiens
atctcagaaccttgtcccagcc

SEQ ID NO: 2344705 - DNA, 23 bp, Homo sapiens
atctcagaaccttgtcccagcca

SEQ ID NO: 2344706 - DNA, 19 bp, Homo sapiens
atctcaggacacttccgta

SEQ ID NO: 2344707 - DNA, 16 bp, Homo sapiens
atctcagtcatgcata

SEQ ID NO: 2344708 - DNA, 20 bp, Homo sapiens
atctcagtcatgcataaata

SEQ ID NO: 2344709 - DNA, 22 bp, Homo sapiens
atctcagtcatgcataaatatg

SEQ ID NO: 2344710 - DNA, 13 bp, Homo sapiens
atctcattatttc

SEQ ID NO: 2344711 - DNA, 15 bp, Homo sapiens
atctcattatttcaa

SEQ ID NO: 2344712 - DNA, 17 bp, Homo sapiens
atctcattatttcaaaa

SEQ ID NO: 2344713 - DNA, 21 bp, Homo sapiens
atctcattatttcaaaatgat

SEQ ID NO: 2344714 - DNA, 16 bp, Homo sapiens
atctcccaaggctgcc

SEQ ID NO: 2344715 - DNA, 17 bp, Homo sapiens
atctcccaaggctgcca

SEQ ID NO: 2344716 - DNA, 18 bp, Homo sapiens
atctcccaaggctgccag

SEQ ID NO: 2344717 - DNA, 14 bp, Homo sapiens
atctccctgcctgg

SEQ ID NO: 2344718 - DNA, 17 bp, Homo sapiens
atctccctgcctggccc

SEQ ID NO: 2344719 - DNA, 14 bp, Homo sapiens
atctccctggagaa

SEQ ID NO: 2344720 - DNA, 22 bp, Homo sapiens
atctccctggagaagcaccagc

SEQ ID NO: 2344721 - DNA, 15 bp, Homo sapiens
atctcctgacagaag

SEQ ID NO: 2344722 - DNA, 20 bp, Homo sapiens
atctctggcccagaaagcct

SEQ ID NO: 2344723 - DNA, 18 bp, Homo sapiens
atctcttcactaccctga

SEQ ID NO: 2344724 - DNA, 16 bp, Homo sapiens
atctcttccccagaga

SEQ ID NO: 2344725 - DNA, 13 bp, Homo sapiens
atctgaacattct

SEQ ID NO: 2344726 - DNA, 20 bp, Homo sapiens
atctgagaacacgttgccag

SEQ ID NO: 2344727 - DNA, 13 bp, Homo sapiens
atctgatatcagg

SEQ ID NO: 2344728 - DNA, 16 bp, Homo sapiens
atctgatctgtaccat

SEQ ID NO: 2344729 - DNA, 21 bp, Homo sapiens
atctgatttgtaacccactga

SEQ ID NO: 2344730 - DNA, 11 bp, Homo sapiens
atctgcaaaag

SEQ ID NO: 2344731 - DNA, 23 bp, Homo sapiens
atctgcaccccttctctcctccc

SEQ ID NO: 2344732 - DNA, 17 bp, Homo sapiens
atctgccagacttaaaa

SEQ ID NO: 2344733 - DNA, 17 bp, Homo sapiens
atctgccttaaaaccaa

SEQ ID NO: 2344734 - DNA, 20 bp, Homo sapiens
atctggatgcctcattatgt

SEQ ID NO: 2344735 - DNA, 16 bp, Homo sapiens
atctggcaacatcttt

SEQ ID NO: 2344736 - DNA, 22 bp, Homo sapiens
atctggctgcagttttgctatc

SEQ ID NO: 2344737 - DNA, 17 bp, Homo sapiens
atctgggctgtgggcaa

SEQ ID NO: 2344738 - DNA, 17 bp, Homo sapiens
atctgtaaactgtgtat

SEQ ID NO: 2344739 - DNA, 21 bp, Homo sapiens
atctgtaagagcttgctccag

SEQ ID NO: 2344740 - DNA, 12 bp, Homo sapiens
atctgtcagttc

SEQ ID NO: 2344741 - DNA, 14 bp, Homo sapiens
atctgttagggcct

SEQ ID NO: 2344742 - DNA, 16 bp, Homo sapiens
atctgttagggccttg

SEQ ID NO: 2344743 - DNA, 12 bp, Homo sapiens
atctgttgtaat

SEQ ID NO: 2344744 - DNA, 20 bp, Homo sapiens
atctgttgtaatatcagtta

SEQ ID NO: 2344745 - DNA, 18 bp, Homo sapiens
atctgtttttacgtatgt

SEQ ID NO: 2344746 - DNA, 18 bp, Homo sapiens
atcttaaaataattcata

SEQ ID NO: 2344747 - DNA, 15 bp, Homo sapiens
atcttacaatattga

SEQ ID NO: 2344748 - DNA, 21 bp, Homo sapiens
atcttattttctcaatctcct

SEQ ID NO: 2344749 - DNA, 20 bp, Homo sapiens
atcttcaatatgaatctata

SEQ ID NO: 2344750 - DNA, 13 bp, Homo sapiens
atcttcacttcta

SEQ ID NO: 2344751 - DNA, 23 bp, Homo sapiens
atcttcacttctaaatgcatatc

SEQ ID NO: 2344752 - DNA, 15 bp, Homo sapiens
atcttcagcccaggc

SEQ ID NO: 2344753 - DNA, 15 bp, Homo sapiens
atcttcctgtgtcct

SEQ ID NO: 2344754 - DNA, 18 bp, Homo sapiens
atcttctgccttctcatg

SEQ ID NO: 2344755 - DNA, 20 bp, Homo sapiens
atcttctgggtagtcccctg

SEQ ID NO: 2344756 - DNA, 21 bp, Homo sapiens
atcttctttggaaataaaaga

SEQ ID NO: 2344757 - DNA, 22 bp, Homo sapiens
atcttgggtgtattctctgtaa

SEQ ID NO: 2344758 - DNA, 17 bp, Homo sapiens
atcttgttttgaaaata

SEQ ID NO: 2344759 - DNA, 17 bp, Homo sapiens
atctttgtaccaaaatt

SEQ ID NO: 2344760 - DNA, 14 bp, Homo sapiens
atcttttaaaatca

SEQ ID NO: 2344761 - DNA, 14 bp, Homo sapiens
atcttttctaatca

SEQ ID NO: 2344762 - DNA, 16 bp, Homo sapiens
atgaaaaagctgcttc

SEQ ID NO: 2344763 - DNA, 18 bp, Homo sapiens
atgaaaaattggggagga

SEQ ID NO: 2344764 - DNA, 16 bp, Homo sapiens
atgaaaataaaacaca

SEQ ID NO: 2344765 - DNA, 20 bp, Homo sapiens
atgaaaataaaacacacctc

SEQ ID NO: 2344766 - DNA, 19 bp, Homo sapiens
atgaaaataactgaatttg

SEQ ID NO: 2344767 - DNA, 14 bp, Homo sapiens
atgaaaattgtatt

SEQ ID NO: 2344768 - DNA, 15 bp, Homo sapiens
atgaaaattgtatta

SEQ ID NO: 2344769 - DNA, 15 bp, Homo sapiens
atgaaacttggccag

SEQ ID NO: 2344770 - DNA, 21 bp, Homo sapiens
atgaaaggttaaaaaagcgag

SEQ ID NO: 2344771 - DNA, 14 bp, Homo sapiens
atgaacactcccca

SEQ ID NO: 2344772 - DNA, 17 bp, Homo sapiens
atgaacagctgtgtctg

SEQ ID NO: 2344773 - DNA, 20 bp, Homo sapiens
atgaaccagccggggcctta

SEQ ID NO: 2344774 - DNA, 15 bp, Homo sapiens
atgaaccataaattc

SEQ ID NO: 2344775 - DNA, 13 bp, Homo sapiens
atgaagcagtatt

SEQ ID NO: 2344776 - DNA, 13 bp, Homo sapiens
atgaagtttaaat

SEQ ID NO: 2344777 - DNA, 23 bp, Homo sapiens
atgaataaagaatgccatttctc

SEQ ID NO: 2344778 - DNA, 22 bp, Homo sapiens
atgaatagactatctagaactt

SEQ ID NO: 2344779 - DNA, 21 bp, Homo sapiens
atgaatcactgttgctttgaa

SEQ ID NO: 2344780 - DNA, 20 bp, Homo sapiens
atgaatccattggagaagcg

SEQ ID NO: 2344781 - DNA, 21 bp, Homo sapiens
atgaatcccacccacatgtga

SEQ ID NO: 2344782 - DNA, 16 bp, Homo sapiens
atgaatctctgcctct

SEQ ID NO: 2344783 - DNA, 15 bp, Homo sapiens
atgaatgattaaatt

SEQ ID NO: 2344784 - DNA, 20 bp, Homo sapiens
atgaatgattaaattatgaa

SEQ ID NO: 2344785 - DNA, 14 bp, Homo sapiens
atgaattaaagtgg

SEQ ID NO: 2344786 - DNA, 13 bp, Homo sapiens
atgaattgtacag

SEQ ID NO: 2344787 - DNA, 22 bp, Homo sapiens
atgacactctagtgacttcctg

SEQ ID NO: 2344788 - DNA, 15 bp, Homo sapiens
atgacagaggctgca

SEQ ID NO: 2344789 - DNA, 15 bp, Homo sapiens
atgacagcctgcagc

SEQ ID NO: 2344790 - DNA, 15 bp, Homo sapiens
atgacaggctgttca

SEQ ID NO: 2344791 - DNA, 17 bp, Homo sapiens
atgacaggctgttcagc

SEQ ID NO: 2344792 - DNA, 22 bp, Homo sapiens
atgacataataaagtattttct

SEQ ID NO: 2344793 - DNA, 19 bp, Homo sapiens
atgacattaaatgcaataa

SEQ ID NO: 2344794 - DNA, 23 bp, Homo sapiens
atgacattaaatgcaataatttt

SEQ ID NO: 2344795 - DNA, 14 bp, Homo sapiens
atgaccagaagcct

SEQ ID NO: 2344796 - DNA, 15 bp, Homo sapiens
atgacggaagaacat

SEQ ID NO: 2344797 - DNA, 16 bp, Homo sapiens
atgacggaagaacata

SEQ ID NO: 2344798 - DNA, 18 bp, Homo sapiens
atgacggtaagtgttctc

SEQ ID NO: 2344799 - DNA, 11 bp, Homo sapiens
atgactaaaga

SEQ ID NO: 2344800 - DNA, 14 bp, Homo sapiens
atgactaaagagag

SEQ ID NO: 2344801 - DNA, 17 bp, Homo sapiens
atgactaaagagagaat

SEQ ID NO: 2344802 - DNA, 18 bp, Homo sapiens
atgactaaagagagaatg

SEQ ID NO: 2344803 - DNA, 20 bp, Homo sapiens
atgactaaagagagaatgta

SEQ ID NO: 2344804 - DNA, 21 bp, Homo sapiens
atgactaaagagagaatgtag

SEQ ID NO: 2344805 - DNA, 14 bp, Homo sapiens
atgactaatgcttt

SEQ ID NO: 2344806 - DNA, 14 bp, Homo sapiens
atgactcaaagtct

SEQ ID NO: 2344807 - DNA, 11 bp, Homo sapiens
atgactgcctt

SEQ ID NO: 2344808 - DNA, 12 bp, Homo sapiens
atgactgccttg

SEQ ID NO: 2344809 - DNA, 23 bp, Homo sapiens
atgactgccttgcctcctcagta

SEQ ID NO: 2344810 - DNA, 15 bp, Homo sapiens
atgacttagaaactg

SEQ ID NO: 2344811 - DNA, 15 bp, Homo sapiens
atgacttgctgtcca

SEQ ID NO: 2344812 - DNA, 21 bp, Homo sapiens
atgacttgctgtccaggcagc

SEQ ID NO: 2344813 - DNA, 21 bp, Homo sapiens
atgactttctttttgtagctg

SEQ ID NO: 2344814 - DNA, 22 bp, Homo sapiens
atgagaaaaataaatggaaaca

SEQ ID NO: 2344815 - DNA, 23 bp, Homo sapiens
atgagacagggtcttgctctgtc

SEQ ID NO: 2344816 - DNA, 13 bp, Homo sapiens
atgagagcataat

SEQ ID NO: 2344817 - DNA, 16 bp, Homo sapiens
atgagagcataattta

SEQ ID NO: 2344818 - DNA, 14 bp, Homo sapiens
atgagagcccagag

SEQ ID NO: 2344819 - DNA, 20 bp, Homo sapiens
atgagagcccagaggtaaca

SEQ ID NO: 2344820 - DNA, 22 bp, Homo sapiens
atgagcaaccacatttagaaat

SEQ ID NO: 2344821 - DNA, 11 bp, Homo sapiens
atgagccagac

SEQ ID NO: 2344822 - DNA, 12 bp, Homo sapiens
atgagcctgctg

SEQ ID NO: 2344823 - DNA, 15 bp, Homo sapiens
atgagcgccacctct

SEQ ID NO: 2344824 - DNA, 19 bp, Homo sapiens
atgagctatcctttcaaac

SEQ ID NO: 2344825 - DNA, 17 bp, Homo sapiens
atgagctctgaaatctt

SEQ ID NO: 2344826 - DNA, 22 bp, Homo sapiens
atgagctctgaaatcttcccat

SEQ ID NO: 2344827 - DNA, 12 bp, Homo sapiens
atgaggagggga

SEQ ID NO: 2344828 - DNA, 22 bp, Homo sapiens
atgaggagggtgggggagggag

SEQ ID NO: 2344829 - DNA, 14 bp, Homo sapiens
atgaggtgggaggt

SEQ ID NO: 2344830 - DNA, 14 bp, Homo sapiens
atgaggtttcttca

SEQ ID NO: 2344831 - DNA, 17 bp, Homo sapiens
atgagtaaaaactagaa

SEQ ID NO: 2344832 - DNA, 13 bp, Homo sapiens
atgagtagccagg

SEQ ID NO: 2344833 - DNA, 21 bp, Homo sapiens
atgagtccttgatttcaaagt

SEQ ID NO: 2344834 - DNA, 14 bp, Homo sapiens
atgagttgaaatgt

SEQ ID NO: 2344835 - DNA, 15 bp, Homo sapiens
atgataaactcagat

SEQ ID NO: 2344836 - DNA, 18 bp, Homo sapiens
atgatgaacttataatga

SEQ ID NO: 2344837 - DNA, 22 bp, Homo sapiens
atgatgaacttataatgattaa

SEQ ID NO: 2344838 - DNA, 19 bp, Homo sapiens
atgatgtctttttattaaa

SEQ ID NO: 2344839 - DNA, 19 bp, Homo sapiens
atgattaaattatcattgt

SEQ ID NO: 2344840 - DNA, 23 bp, Homo sapiens
atgattaagggacatttctataa

SEQ ID NO: 2344841 - DNA, 22 bp, Homo sapiens
atgatttaataaaataattcta

SEQ ID NO: 2344842 - DNA, 21 bp, Homo sapiens
atgatttcagttctaggaaaa

SEQ ID NO: 2344843 - DNA, 20 bp, Homo sapiens
atgatttccttcaatgtgca

SEQ ID NO: 2344844 - DNA, 18 bp, Homo sapiens
atgattttcatttcatga

SEQ ID NO: 2344845 - DNA, 17 bp, Homo sapiens
atgattttttgaaagtt

SEQ ID NO: 2344846 - DNA, 17 bp, Homo sapiens
atgatttttttttcata

SEQ ID NO: 2344847 - DNA, 17 bp, Homo sapiens
atgcaaaaaattcttta

SEQ ID NO: 2344848 - DNA, 18 bp, Homo sapiens
atgcaaatcaattactgg

SEQ ID NO: 2344849 - DNA, 23 bp, Homo sapiens
atgcaacaaatgtggccaagcct

SEQ ID NO: 2344850 - DNA, 23 bp, Homo sapiens
atgcaataaaatttaaaaaataa

SEQ ID NO: 2344851 - DNA, 23 bp, Homo sapiens
atgcaatgcttcattattcaaga

SEQ ID NO: 2344852 - DNA, 21 bp, Homo sapiens
atgcacatatggactctgcac

SEQ ID NO: 2344853 - DNA, 15 bp, Homo sapiens
atgcaccttgtgtct

SEQ ID NO: 2344854 - DNA, 18 bp, Homo sapiens
atgcaccttgtgtctgta

SEQ ID NO: 2344855 - DNA, 20 bp, Homo sapiens
atgcacttttagaaatgcat

SEQ ID NO: 2344856 - DNA, 11 bp, Homo sapiens
atgcagaaata

SEQ ID NO: 2344857 - DNA, 22 bp, Homo sapiens
atgcagaaatagacaaaaagta

SEQ ID NO: 2344858 - DNA, 14 bp, Homo sapiens
atgcagagagccat

SEQ ID NO: 2344859 - DNA, 19 bp, Homo sapiens
atgcagagagccattttgt

SEQ ID NO: 2344860 - DNA, 22 bp, Homo sapiens
atgcagagagccattttgtgaa

SEQ ID NO: 2344861 - DNA, 14 bp, Homo sapiens
atgcaggaggtgga

SEQ ID NO: 2344862 - DNA, 20 bp, Homo sapiens
atgcaggaggtggagaaaat

SEQ ID NO: 2344863 - DNA, 15 bp, Homo sapiens
atgcataaatatgca

SEQ ID NO: 2344864 - DNA, 16 bp, Homo sapiens
atgcataaatatgcag

SEQ ID NO: 2344865 - DNA, 18 bp, Homo sapiens
atgcatataatgaataaa

SEQ ID NO: 2344866 - DNA, 14 bp, Homo sapiens
atgcatatttgcca

SEQ ID NO: 2344867 - DNA, 13 bp, Homo sapiens
atgcatgcaaatg

SEQ ID NO: 2344868 - DNA, 14 bp, Homo sapiens
atgcatgtaaggtc

SEQ ID NO: 2344869 - DNA, 21 bp, Homo sapiens
atgcatgtaaggtcttcttgt

SEQ ID NO: 2344870 - DNA, 16 bp, Homo sapiens
atgcatgtcctgtaaa

SEQ ID NO: 2344871 - DNA, 22 bp, Homo sapiens
atgcattcacatttagaaaagt

SEQ ID NO: 2344872 - DNA, 22 bp, Homo sapiens
atgcatttaataaagatgagtt

SEQ ID NO: 2344873 - DNA, 14 bp, Homo sapiens
atgccaatttcctc

SEQ ID NO: 2344874 - DNA, 15 bp, Homo sapiens
atgccacccacatct

SEQ ID NO: 2344875 - DNA, 19 bp, Homo sapiens
atgccagattctgcctctc

SEQ ID NO: 2344876 - DNA, 12 bp, Homo sapiens
atgccagctggc

SEQ ID NO: 2344877 - DNA, 19 bp, Homo sapiens
atgccatccagatgtgtgc

SEQ ID NO: 2344878 - DNA, 15 bp, Homo sapiens
atgcccaccccctgc

SEQ ID NO: 2344879 - DNA, 16 bp, Homo sapiens
atgcccaccccctgcc

SEQ ID NO: 2344880 - DNA, 17 bp, Homo sapiens
atgcccagctctctgac

SEQ ID NO: 2344881 - DNA, 16 bp, Homo sapiens
atgccccattccttgc

SEQ ID NO: 2344882 - DNA, 10 bp, Homo sapiens
atgccccctg

SEQ ID NO: 2344883 - DNA, 14 bp, Homo sapiens
atgccccctgctta

SEQ ID NO: 2344884 - DNA, 16 bp, Homo sapiens
atgccccctgcttact

SEQ ID NO: 2344885 - DNA, 17 bp, Homo sapiens
atgcctgcgcctgctgc

SEQ ID NO: 2344886 - DNA, 18 bp, Homo sapiens
atgcctgcgcctgctgcc

SEQ ID NO: 2344887 - DNA, 23 bp, Homo sapiens
atgcctgctttttggaaagtcag

SEQ ID NO: 2344888 - DNA, 12 bp, Homo sapiens
atgcctttgaga

SEQ ID NO: 2344889 - DNA, 16 bp, Homo sapiens
atgcctttgagacagt

SEQ ID NO: 2344890 - DNA, 20 bp, Homo sapiens
atgcctttgagacagtttct

SEQ ID NO: 2344891 - DNA, 21 bp, Homo sapiens
atgcctttgagacagtttctt

SEQ ID NO: 2344892 - DNA, 19 bp, Homo sapiens
atgcctttttttctctgca

SEQ ID NO: 2344893 - DNA, 14 bp, Homo sapiens
atgcgcagtgcctt

SEQ ID NO: 2344894 - DNA, 18 bp, Homo sapiens
atgcggtgggtgctgcca

SEQ ID NO: 2344895 - DNA, 17 bp, Homo sapiens
atgctaaagatgatgat

SEQ ID NO: 2344896 - DNA, 15 bp, Homo sapiens
atgctaacaaagaca

SEQ ID NO: 2344897 - DNA, 17 bp, Homo sapiens
atgctacaattttaaga

SEQ ID NO: 2344898 - DNA, 22 bp, Homo sapiens
atgctccccacagcgtccctgg

SEQ ID NO: 2344899 - DNA, 23 bp, Homo sapiens
atgctccccacagcgtccctggc

SEQ ID NO: 2344900 - DNA, 17 bp, Homo sapiens
atgctgaaaaatatagc

SEQ ID NO: 2344901 - DNA, 17 bp, Homo sapiens
atgctgaatgccccctg

SEQ ID NO: 2344902 - DNA, 21 bp, Homo sapiens
atgctgatcttttaaaatcat

SEQ ID NO: 2344903 - DNA, 13 bp, Homo sapiens
atgctgatggagc

SEQ ID NO: 2344904 - DNA, 23 bp, Homo sapiens
atgctgtgacacatggcccctcc

SEQ ID NO: 2344905 - DNA, 16 bp, Homo sapiens
atgctgttgtgaagct

SEQ ID NO: 2344906 - DNA, 13 bp, Homo sapiens
atgctgtttctaa

SEQ ID NO: 2344907 - DNA, 22 bp, Homo sapiens
atgctgtttctaagaaaatgta

SEQ ID NO: 2344908 - DNA, 24 bp, Homo sapiens
atgctgtttctaagaaaatgtagt

SEQ ID NO: 2344909 - DNA, 14 bp, Homo sapiens
atgcttaaatttta

SEQ ID NO: 2344910 - DNA, 13 bp, Homo sapiens
atgcttcattatt

SEQ ID NO: 2344911 - DNA, 16 bp, Homo sapiens
atgcttcatttgtatg

SEQ ID NO: 2344912 - DNA, 15 bp, Homo sapiens
atgcttcctgacaat

SEQ ID NO: 2344913 - DNA, 19 bp, Homo sapiens
atgcttcctttctctcctg

SEQ ID NO: 2344914 - DNA, 22 bp, Homo sapiens
atgcttgcggcaaaaggaaagc

SEQ ID NO: 2344915 - DNA, 19 bp, Homo sapiens
atgctttttagaaagcatt

SEQ ID NO: 2344916 - DNA, 19 bp, Homo sapiens
atggaaaactgtgttgcca

SEQ ID NO: 2344917 - DNA, 22 bp, Homo sapiens
atggaaaagcaacttcatttga

SEQ ID NO: 2344918 - DNA, 21 bp, Homo sapiens
atggaaaattttctccttggt

SEQ ID NO: 2344919 - DNA, 16 bp, Homo sapiens
atggaaagacaaactg

SEQ ID NO: 2344920 - DNA, 15 bp, Homo sapiens
atggaagttttccta

SEQ ID NO: 2344921 - DNA, 13 bp, Homo sapiens
atggaataaaagg

SEQ ID NO: 2344922 - DNA, 14 bp, Homo sapiens
atggaatatatcag

SEQ ID NO: 2344923 - DNA, 15 bp, Homo sapiens
atggaatatcagaag

SEQ ID NO: 2344924 - DNA, 15 bp, Homo sapiens
atggaatggaaaagc

SEQ ID NO: 2344925 - DNA, 23 bp, Homo sapiens
atggacacgagccacaagctgca

SEQ ID NO: 2344926 - DNA, 15 bp, Homo sapiens
atggacactccaggg

SEQ ID NO: 2344927 - DNA, 19 bp, Homo sapiens
atggacctccaggctccag

SEQ ID NO: 2344928 - DNA, 13 bp, Homo sapiens
atggactttcttg

SEQ ID NO: 2344929 - DNA, 14 bp, Homo sapiens
atggagaggctgag

SEQ ID NO: 2344930 - DNA, 19 bp, Homo sapiens
atggaggatctctaaagag

SEQ ID NO: 2344931 - DNA, 22 bp, Homo sapiens
atggagggtggaaataatttga

SEQ ID NO: 2344932 - DNA, 12 bp, Homo sapiens
atggagtattct

SEQ ID NO: 2344933 - DNA, 16 bp, Homo sapiens
atggagtgtacaagta

SEQ ID NO: 2344934 - DNA, 22 bp, Homo sapiens
atggatatagttttacttttaa

SEQ ID NO: 2344935 - DNA, 19 bp, Homo sapiens
atggatctgatctgtacca

SEQ ID NO: 2344936 - DNA, 15 bp, Homo sapiens
atggattggattatt

SEQ ID NO: 2344937 - DNA, 20 bp, Homo sapiens
atggattggattatttaata

SEQ ID NO: 2344938 - DNA, 21 bp, Homo sapiens
atggcaattggcatcattctc

SEQ ID NO: 2344939 - DNA, 20 bp, Homo sapiens
atggcacctcaggctgaggg

SEQ ID NO: 2344940 - DNA, 21 bp, Homo sapiens
atggcagaagacaccagagca

SEQ ID NO: 2344941 - DNA, 22 bp, Homo sapiens
atggcagaagacaccagagcag

SEQ ID NO: 2344942 - DNA, 16 bp, Homo sapiens
atggcatttagcacag

SEQ ID NO: 2344943 - DNA, 21 bp, Homo sapiens
atggcatttctctttaaacta

SEQ ID NO: 2344944 - DNA, 21 bp, Homo sapiens
atggcatttggtctcaggcag

SEQ ID NO: 2344945 - DNA, 12 bp, Homo sapiens
atggccagcccc

SEQ ID NO: 2344946 - DNA, 20 bp, Homo sapiens
atggccaggtggttgtctta

SEQ ID NO: 2344947 - DNA, 16 bp, Homo sapiens
atggccatgcaggagg

SEQ ID NO: 2344948 - DNA, 17 bp, Homo sapiens
atggccctgtagctctg

SEQ ID NO: 2344949 - DNA, 14 bp, Homo sapiens
atggccctgtccca

SEQ ID NO: 2344950 - DNA, 15 bp, Homo sapiens
atggccctgtcccag

SEQ ID NO: 2344951 - DNA, 20 bp, Homo sapiens
atggccctgtcccaggccgg

SEQ ID NO: 2344952 - DNA, 14 bp, Homo sapiens
atggcctttccttc

SEQ ID NO: 2344953 - DNA, 22 bp, Homo sapiens
atggcctttccttccctctctg

SEQ ID NO: 2344954 - DNA, 16 bp, Homo sapiens
atggcgccctgcctcc

SEQ ID NO: 2344955 - DNA, 14 bp, Homo sapiens
atggcgtctgctct

SEQ ID NO: 2344956 - DNA, 17 bp, Homo sapiens
atggcgtctgctctggt

SEQ ID NO: 2344957 - DNA, 13 bp, Homo sapiens
atggctacctcag

SEQ ID NO: 2344958 - DNA, 17 bp, Homo sapiens
atggctcaagtctgcac

SEQ ID NO: 2344959 - DNA, 17 bp, Homo sapiens
atggctttgtgattcaa

SEQ ID NO: 2344960 - DNA, 21 bp, Homo sapiens
atgggaaaaatctaaaatgtg

SEQ ID NO: 2344961 - DNA, 12 bp, Homo sapiens
atgggaagcagg

SEQ ID NO: 2344962 - DNA, 12 bp, Homo sapiens
atgggacctggc

SEQ ID NO: 2344963 - DNA, 21 bp, Homo sapiens
atgggatggtcggatctcaca

SEQ ID NO: 2344964 - DNA, 13 bp, Homo sapiens
atgggcctgctgc

SEQ ID NO: 2344965 - DNA, 15 bp, Homo sapiens
atggggcaggccacc

SEQ ID NO: 2344966 - DNA, 22 bp, Homo sapiens
atggggccctgtccaggtagaa

SEQ ID NO: 2344967 - DNA, 18 bp, Homo sapiens
atgggggcatctcttccc

SEQ ID NO: 2344968 - DNA, 23 bp, Homo sapiens
atgggggcatctcttccccagag

SEQ ID NO: 2344969 - DNA, 13 bp, Homo sapiens
atgggtcagagct

SEQ ID NO: 2344970 - DNA, 22 bp, Homo sapiens
atgggtcctagcccttccctga

SEQ ID NO: 2344971 - DNA, 16 bp, Homo sapiens
atggtaagagaaaaga

SEQ ID NO: 2344972 - DNA, 23 bp, Homo sapiens
atggtaatctttacctgtataca

SEQ ID NO: 2344973 - DNA, 13 bp, Homo sapiens
atggtctttgctc

SEQ ID NO: 2344974 - DNA, 14 bp, Homo sapiens
atggtgcctgagag

SEQ ID NO: 2344975 - DNA, 17 bp, Homo sapiens
atggtgcctgagaggca

SEQ ID NO: 2344976 - DNA, 20 bp, Homo sapiens
atggtgcctgagaggcaggc

SEQ ID NO: 2344977 - DNA, 23 bp, Homo sapiens
atggtgcctgagaggcaggcata

SEQ ID NO: 2344978 - DNA, 12 bp, Homo sapiens
atggtgtcccgg

SEQ ID NO: 2344979 - DNA, 15 bp, Homo sapiens
atggtgtggcctgtg

SEQ ID NO: 2344980 - DNA, 20 bp, Homo sapiens
atggtgtgggtgtcctgcct

SEQ ID NO: 2344981 - DNA, 17 bp, Homo sapiens
atggttgatgatacttc

SEQ ID NO: 2344982 - DNA, 22 bp, Homo sapiens
atggtttgttgttctgcctgga

SEQ ID NO: 2344983 - DNA, 14 bp, Homo sapiens
atgtaaggatgagg

SEQ ID NO: 2344984 - DNA, 20 bp, Homo sapiens
atgtaatttaaatgaaagaa

SEQ ID NO: 2344985 - DNA, 13 bp, Homo sapiens
atgtaatttcaaa

SEQ ID NO: 2344986 - DNA, 19 bp, Homo sapiens
atgtaatttcaaaatacat

SEQ ID NO: 2344987 - DNA, 16 bp, Homo sapiens
atgtacagattctttc

SEQ ID NO: 2344988 - DNA, 21 bp, Homo sapiens
atgtacatagttatttttctc

SEQ ID NO: 2344989 - DNA, 20 bp, Homo sapiens
atgtacatttccaaatgaac

SEQ ID NO: 2344990 - DNA, 18 bp, Homo sapiens
atgtactgatttcagtaa

SEQ ID NO: 2344991 - DNA, 19 bp, Homo sapiens
atgtactgatttcagtaag

SEQ ID NO: 2344992 - DNA, 19 bp, Homo sapiens
atgtagataacaagacctc

SEQ ID NO: 2344993 - DNA, 22 bp, Homo sapiens
atgtagcctttactgtttgata

SEQ ID NO: 2344994 - DNA, 14 bp, Homo sapiens
atgtagctgaaaat

SEQ ID NO: 2344995 - DNA, 18 bp, Homo sapiens
atgtaggtaagactgtag

SEQ ID NO: 2344996 - DNA, 15 bp, Homo sapiens
atgtagtcagttgca

SEQ ID NO: 2344997 - DNA, 18 bp, Homo sapiens
atgtagtcttgacgaata

SEQ ID NO: 2344998 - DNA, 20 bp, Homo sapiens
atgtatattaaaaaagagac

SEQ ID NO: 2344999 - DNA, 22 bp, Homo sapiens
atgtatccaaggaaacatttta

SEQ ID NO: 2345000 - DNA, 17 bp, Homo sapiens
atgtattcttttctcag

SEQ ID NO: 2345001 - DNA, 15 bp, Homo sapiens
atgtatttgctgaca

SEQ ID NO: 2345002 - DNA, 23 bp, Homo sapiens
atgtcaatgaccattcaattagt

SEQ ID NO: 2345003 - DNA, 23 bp, Homo sapiens
atgtcacagtccaaccagaaaca

SEQ ID NO: 2345004 - DNA, 12 bp, Homo sapiens
atgtcagccttg

SEQ ID NO: 2345005 - DNA, 13 bp, Homo sapiens
atgtcagccttgc

SEQ ID NO: 2345006 - DNA, 14 bp, Homo sapiens
atgtcatgattgcc

SEQ ID NO: 2345007 - DNA, 19 bp, Homo sapiens
atgtccaaagaggctgccc

SEQ ID NO: 2345008 - DNA, 20 bp, Homo sapiens
atgtccaaagaggctgcccc

SEQ ID NO: 2345009 - DNA, 21 bp, Homo sapiens
atgtccatacactttgttgca

SEQ ID NO: 2345010 - DNA, 16 bp, Homo sapiens
atgtccctccaacaca

SEQ ID NO: 2345011 - DNA, 13 bp, Homo sapiens
atgtcctgtaaag

SEQ ID NO: 2345012 - DNA, 18 bp, Homo sapiens
atgtcgccaaaaatacag

SEQ ID NO: 2345013 - DNA, 15 bp, Homo sapiens
atgtctattcagctt

SEQ ID NO: 2345014 - DNA, 16 bp, Homo sapiens
atgtctcttctgagct

SEQ ID NO: 2345015 - DNA, 20 bp, Homo sapiens
atgtctgcagtgtgcccccc

SEQ ID NO: 2345016 - DNA, 19 bp, Homo sapiens
atgtctgtagctcctcaac

SEQ ID NO: 2345017 - DNA, 17 bp, Homo sapiens
atgtcttcaatggaata

SEQ ID NO: 2345018 - DNA, 12 bp, Homo sapiens
atgtcttccctg

SEQ ID NO: 2345019 - DNA, 14 bp, Homo sapiens
atgtcttccctggg

SEQ ID NO: 2345020 - DNA, 14 bp, Homo sapiens
atgtcttctccctg

SEQ ID NO: 2345021 - DNA, 19 bp, Homo sapiens
atgtcttggacactgtaca

SEQ ID NO: 2345022 - DNA, 20 bp, Homo sapiens
atgtcttgtatttaaaaaca

SEQ ID NO: 2345023 - DNA, 22 bp, Homo sapiens
atgtctttttattaaaatattt

SEQ ID NO: 2345024 - DNA, 20 bp, Homo sapiens
atgtgaaaaattaacttttt

SEQ ID NO: 2345025 - DNA, 21 bp, Homo sapiens
atgtgaaaccttttttaagat

SEQ ID NO: 2345026 - DNA, 19 bp, Homo sapiens
atgtgaattattgacactg

SEQ ID NO: 2345027 - DNA, 20 bp, Homo sapiens
atgtgaattattgacactga

SEQ ID NO: 2345028 - DNA, 21 bp, Homo sapiens
atgtgaattattgacactgaa

SEQ ID NO: 2345029 - DNA, 10 bp, Homo sapiens
atgtgaattt

SEQ ID NO: 2345030 - DNA, 12 bp, Homo sapiens
atgtgaattttt

SEQ ID NO: 2345031 - DNA, 22 bp, Homo sapiens
atgtgagccaccgtgcctggcc

SEQ ID NO: 2345032 - DNA, 17 bp, Homo sapiens
atgtgagtagttactaa

SEQ ID NO: 2345033 - DNA, 15 bp, Homo sapiens
atgtgatacattttt

SEQ ID NO: 2345034 - DNA, 23 bp, Homo sapiens
atgtgatctgggcattttcctcc

SEQ ID NO: 2345035 - DNA, 17 bp, Homo sapiens
atgtgcatagtttcttt

SEQ ID NO: 2345036 - DNA, 21 bp, Homo sapiens
atgtgcatttttgtgaaatga

SEQ ID NO: 2345037 - DNA, 18 bp, Homo sapiens
atgtgccccatgtccaag

SEQ ID NO: 2345038 - DNA, 16 bp, Homo sapiens
atgtgctatacacaca

SEQ ID NO: 2345039 - DNA, 18 bp, Homo sapiens
atgtgctatactgcatac

SEQ ID NO: 2345040 - DNA, 23 bp, Homo sapiens
atgtggaaggaaaatatttcatt

SEQ ID NO: 2345041 - DNA, 17 bp, Homo sapiens
atgtggaggaagagcca

SEQ ID NO: 2345042 - DNA, 20 bp, Homo sapiens
atgtggaggaagagccacct

SEQ ID NO: 2345043 - DNA, 22 bp, Homo sapiens
atgtggaggaagagccacctgc

SEQ ID NO: 2345044 - DNA, 17 bp, Homo sapiens
atgtggccaagcctatc

SEQ ID NO: 2345045 - DNA, 16 bp, Homo sapiens
atgtggcctttgaatt

SEQ ID NO: 2345046 - DNA, 20 bp, Homo sapiens
atgtggcctttgaattctgt

SEQ ID NO: 2345047 - DNA, 17 bp, Homo sapiens
atgtgggatattgaatg

SEQ ID NO: 2345048 - DNA, 22 bp, Homo sapiens
atgtgggggaggagggagagag

SEQ ID NO: 2345049 - DNA, 16 bp, Homo sapiens
atgtgggggcttcatc

SEQ ID NO: 2345050 - DNA, 18 bp, Homo sapiens
atgtgggggcttcatctc

SEQ ID NO: 2345051 - DNA, 14 bp, Homo sapiens
atgtgtagcctgtg

SEQ ID NO: 2345052 - DNA, 16 bp, Homo sapiens
atgtgtagcctgtgca

SEQ ID NO: 2345053 - DNA, 17 bp, Homo sapiens
atgtgtagcctgtgcat

SEQ ID NO: 2345054 - DNA, 21 bp, Homo sapiens
atgtgtagctgcaaaaataat

SEQ ID NO: 2345055 - DNA, 20 bp, Homo sapiens
atgtgtatttccagtgcaat

SEQ ID NO: 2345056 - DNA, 20 bp, Homo sapiens
atgtgtatttttcaaggcat

SEQ ID NO: 2345057 - DNA, 22 bp, Homo sapiens
atgtgttgctctccattctttt

SEQ ID NO: 2345058 - DNA, 12 bp, Homo sapiens
atgttaaatttg

SEQ ID NO: 2345059 - DNA, 14 bp, Homo sapiens
atgttaaatttgta

SEQ ID NO: 2345060 - DNA, 16 bp, Homo sapiens
atgttaaatttgtaag

SEQ ID NO: 2345061 - DNA, 22 bp, Homo sapiens
atgttaaatttgtaagtttcag

SEQ ID NO: 2345062 - DNA, 23 bp, Homo sapiens
atgttaaggaaactcttatctca

SEQ ID NO: 2345063 - DNA, 20 bp, Homo sapiens
atgttaagggaagaattcca

SEQ ID NO: 2345064 - DNA, 17 bp, Homo sapiens
atgttacgtgaagaaat

SEQ ID NO: 2345065 - DNA, 14 bp, Homo sapiens
atgttatgaacagc

SEQ ID NO: 2345066 - DNA, 19 bp, Homo sapiens
atgttcctaacaaaatgag

SEQ ID NO: 2345067 - DNA, 12 bp, Homo sapiens
atgttcctcctt

SEQ ID NO: 2345068 - DNA, 12 bp, Homo sapiens
atgttccttcca

SEQ ID NO: 2345069 - DNA, 15 bp, Homo sapiens
atgttcgggtgtggg

SEQ ID NO: 2345070 - DNA, 16 bp, Homo sapiens
atgtttaaaagaaata

SEQ ID NO: 2345071 - DNA, 17 bp, Homo sapiens
atgtttaaaataaaatg

SEQ ID NO: 2345072 - DNA, 13 bp, Homo sapiens
atgtttaaaatgg

SEQ ID NO: 2345073 - DNA, 22 bp, Homo sapiens
atgtttaaaatggcatttagca

SEQ ID NO: 2345074 - DNA, 15 bp, Homo sapiens
atgtttcaagaggag

SEQ ID NO: 2345075 - DNA, 21 bp, Homo sapiens
atgtttcaagaggagccccca

SEQ ID NO: 2345076 - DNA, 14 bp, Homo sapiens
atgtttggatggtt

SEQ ID NO: 2345077 - DNA, 18 bp, Homo sapiens
atgtttggtgaactatat

SEQ ID NO: 2345078 - DNA, 16 bp, Homo sapiens
atgtttttaataaaag

SEQ ID NO: 2345079 - DNA, 19 bp, Homo sapiens
atgtttttaataaaagaaa

SEQ ID NO: 2345080 - DNA, 15 bp, Homo sapiens
atgtttttccctccc

SEQ ID NO: 2345081 - DNA, 22 bp, Homo sapiens
attaaaaaagagacatccaaat

SEQ ID NO: 2345082 - DNA, 13 bp, Homo sapiens
attaaaaaagtct

SEQ ID NO: 2345083 - DNA, 14 bp, Homo sapiens
attaaaaacatgaa

SEQ ID NO: 2345084 - DNA, 13 bp, Homo sapiens
attaaaaattacc

SEQ ID NO: 2345085 - DNA, 17 bp, Homo sapiens
attaaaactaaatttca

SEQ ID NO: 2345086 - DNA, 17 bp, Homo sapiens
attaaaatatttcaggt

SEQ ID NO: 2345087 - DNA, 14 bp, Homo sapiens
attaaaatctgatg

SEQ ID NO: 2345088 - DNA, 19 bp, Homo sapiens
attaaacagatgtgaatat

SEQ ID NO: 2345089 - DNA, 22 bp, Homo sapiens
attaaagacaggagacaaaaga

SEQ ID NO: 2345090 - DNA, 16 bp, Homo sapiens
attaaagcatttccta

SEQ ID NO: 2345091 - DNA, 11 bp, Homo sapiens
attaaagtcag

SEQ ID NO: 2345092 - DNA, 13 bp, Homo sapiens
attaaagtcagaa

SEQ ID NO: 2345093 - DNA, 22 bp, Homo sapiens
attaaataaaatttttatgtaa

SEQ ID NO: 2345094 - DNA, 19 bp, Homo sapiens
attaaatgtggaaggaaaa

SEQ ID NO: 2345095 - DNA, 20 bp, Homo sapiens
attaactatttttttcaaag

SEQ ID NO: 2345096 - DNA, 13 bp, Homo sapiens
attaagaaaacta

SEQ ID NO: 2345097 - DNA, 21 bp, Homo sapiens
attaagcattttgaaacaaag

SEQ ID NO: 2345098 - DNA, 18 bp, Homo sapiens
attaagctttttggaatc

SEQ ID NO: 2345099 - DNA, 16 bp, Homo sapiens
attaagggacatttct

SEQ ID NO: 2345100 - DNA, 19 bp, Homo sapiens
attaaggggaagaatgaaa

SEQ ID NO: 2345101 - DNA, 22 bp, Homo sapiens
attaatagccaaagatttcata

SEQ ID NO: 2345102 - DNA, 13 bp, Homo sapiens
attaatatattaa

SEQ ID NO: 2345103 - DNA, 14 bp, Homo sapiens
attaatatattaaa

SEQ ID NO: 2345104 - DNA, 23 bp, Homo sapiens
attaatattcagggtaaatagga

SEQ ID NO: 2345105 - DNA, 11 bp, Homo sapiens
attaatcaaga

SEQ ID NO: 2345106 - DNA, 13 bp, Homo sapiens
attaatcaagaga

SEQ ID NO: 2345107 - DNA, 14 bp, Homo sapiens
attaatcatacaaa

SEQ ID NO: 2345108 - DNA, 16 bp, Homo sapiens
attaatgtctcacttt

SEQ ID NO: 2345109 - DNA, 17 bp, Homo sapiens
attaatgttttcaaaag

SEQ ID NO: 2345110 - DNA, 15 bp, Homo sapiens
attaattaatttgga

SEQ ID NO: 2345111 - DNA, 24 bp, Homo sapiens
attacaaagttaaaattgttatca

SEQ ID NO: 2345112 - DNA, 20 bp, Homo sapiens
attaccagttttccagaaca

SEQ ID NO: 2345113 - DNA, 12 bp, Homo sapiens
attacctgaaag

SEQ ID NO: 2345114 - DNA, 15 bp, Homo sapiens
attacctttaatttt

SEQ ID NO: 2345115 - DNA, 17 bp, Homo sapiens
attacctttacatatat

SEQ ID NO: 2345116 - DNA, 13 bp, Homo sapiens
attacgtgctctg

SEQ ID NO: 2345117 - DNA, 13 bp, Homo sapiens
attactgacattt

SEQ ID NO: 2345118 - DNA, 15 bp, Homo sapiens
attactgacatttct

SEQ ID NO: 2345119 - DNA, 21 bp, Homo sapiens
attactgacatttcttctagt

SEQ ID NO: 2345120 - DNA, 13 bp, Homo sapiens
attgagtattgtt

SEQ ID NO: 2345121 - DNA, 16 bp, Homo sapiens
attgagtattgtttaa

SEQ ID NO: 2345122 - DNA, 20 bp, Homo sapiens
attgagtattgtttaaaatg

SEQ ID NO: 2345123 - DNA, 21 bp, Homo sapiens
attgagtattgtttaaaatgt

SEQ ID NO: 2345124 - DNA, 17 bp, Homo sapiens
attgagttccagttgaa

SEQ ID NO: 2345125 - DNA, 21 bp, Homo sapiens
attgatgtggccctggctgcc

SEQ ID NO: 2345126 - DNA, 22 bp, Homo sapiens
attgattgggaaaacatttgct

SEQ ID NO: 2345127 - DNA, 23 bp, Homo sapiens
attgattgggaaaacatttgctg

SEQ ID NO: 2345128 - DNA, 17 bp, Homo sapiens
attgcaataaagtataa

SEQ ID NO: 2345129 - DNA, 13 bp, Homo sapiens
attgcactagaga

SEQ ID NO: 2345130 - DNA, 20 bp, Homo sapiens
attgcactagagaaaataaa

SEQ ID NO: 2345131 - DNA, 18 bp, Homo sapiens
attgcagtaacaaaagca

SEQ ID NO: 2345132 - DNA, 15 bp, Homo sapiens
attgcatactttgta

SEQ ID NO: 2345133 - DNA, 14 bp, Homo sapiens
attgcatcactgta

SEQ ID NO: 2345134 - DNA, 16 bp, Homo sapiens
attgccagcaaataaa

SEQ ID NO: 2345135 - DNA, 22 bp, Homo sapiens
attgccatattaaaatctgatg

SEQ ID NO: 2345136 - DNA, 15 bp, Homo sapiens
attgcgtagaggcta

SEQ ID NO: 2345137 - DNA, 14 bp, Homo sapiens
attgctaaaacagc

SEQ ID NO: 2345138 - DNA, 20 bp, Homo sapiens
attgctatcgccctcctttc

SEQ ID NO: 2345139 - DNA, 21 bp, Homo sapiens
attgctatcgccctcctttcc

SEQ ID NO: 2345140 - DNA, 22 bp, Homo sapiens
attgctatcgccctcctttccc

SEQ ID NO: 2345141 - DNA, 13 bp, Homo sapiens
attgctctgcccc

SEQ ID NO: 2345142 - DNA, 14 bp, Homo sapiens
attgctgtcctgga

SEQ ID NO: 2345143 - DNA, 16 bp, Homo sapiens
attggattatttaata

SEQ ID NO: 2345144 - DNA, 17 bp, Homo sapiens
attggattatttaataa

SEQ ID NO: 2345145 - DNA, 18 bp, Homo sapiens
attggattatttaataac

SEQ ID NO: 2345146 - DNA, 17 bp, Homo sapiens
attgggcacagtccaga

SEQ ID NO: 2345147 - DNA, 20 bp, Homo sapiens
attgggtgggattttttccc

SEQ ID NO: 2345148 - DNA, 15 bp, Homo sapiens
attggtaattacctg

SEQ ID NO: 2345149 - DNA, 17 bp, Homo sapiens
attggtgctatttaaca

SEQ ID NO: 2345150 - DNA, 21 bp, Homo sapiens
attgtaaaaaaaaatgccttt

SEQ ID NO: 2345151 - DNA, 18 bp, Homo sapiens
attgtaagtgaaattaag

SEQ ID NO: 2345152 - DNA, 20 bp, Homo sapiens
attgtaagtgaaattaagca

SEQ ID NO: 2345153 - DNA, 23 bp, Homo sapiens
attgtaagtgaaattaagcattt

SEQ ID NO: 2345154 - DNA, 18 bp, Homo sapiens
attgtacaaaattaagca

SEQ ID NO: 2345155 - DNA, 21 bp, Homo sapiens
attgtacaaaattaagcaaat

SEQ ID NO: 2345156 - DNA, 17 bp, Homo sapiens
attgtactaatctgaga

SEQ ID NO: 2345157 - DNA, 15 bp, Homo sapiens
attgtatattacaat

SEQ ID NO: 2345158 - DNA, 17 bp, Homo sapiens
attgtatattacaatga

SEQ ID NO: 2345159 - DNA, 15 bp, Homo sapiens
attgtatttatgtgt

SEQ ID NO: 2345160 - DNA, 23 bp, Homo sapiens
attgtccagtttgtcttggatat

SEQ ID NO: 2345161 - DNA, 22 bp, Homo sapiens
attgtcgaaaagagtcttccaa

SEQ ID NO: 2345162 - DNA, 15 bp, Homo sapiens
attgtgaagtacata

SEQ ID NO: 2345163 - DNA, 15 bp, Homo sapiens
attgtgcttcacagt

SEQ ID NO: 2345164 - DNA, 20 bp, Homo sapiens
attgtgcttcacagtagagc

SEQ ID NO: 2345165 - DNA, 14 bp, Homo sapiens
attgtggatgaaga

SEQ ID NO: 2345166 - DNA, 18 bp, Homo sapiens
attgtggctatcctgatt

SEQ ID NO: 2345167 - DNA, 20 bp, Homo sapiens
attgtgttcccatttcagct

SEQ ID NO: 2345168 - DNA, 22 bp, Homo sapiens
attgtgtttctaccggagagag

SEQ ID NO: 2345169 - DNA, 16 bp, Homo sapiens
attgttgtttctttct

SEQ ID NO: 2345170 - DNA, 15 bp, Homo sapiens
attgtttaaaatgta

SEQ ID NO: 2345171 - DNA, 12 bp, Homo sapiens
attgtttctgca

SEQ ID NO: 2345172 - DNA, 18 bp, Homo sapiens
attgtttggtaaatgttt

SEQ ID NO: 2345173 - DNA, 19 bp, Homo sapiens
attgtttggtaaatgtttc

SEQ ID NO: 2345174 - DNA, 13 bp, Homo sapiens
attgttttacaat

SEQ ID NO: 2345175 - DNA, 14 bp, Homo sapiens
attgttttacaata

SEQ ID NO: 2345176 - DNA, 22 bp, Homo sapiens
atttaaaaaataaataaaaact

SEQ ID NO: 2345177 - DNA, 13 bp, Homo sapiens
atttaaaaacatt

SEQ ID NO: 2345178 - DNA, 15 bp, Homo sapiens
atttaaaaacatttt

SEQ ID NO: 2345179 - DNA, 14 bp, Homo sapiens
atttaaaacagaca

SEQ ID NO: 2345180 - DNA, 18 bp, Homo sapiens
atttaaaacagacactgg

SEQ ID NO: 2345181 - DNA, 23 bp, Homo sapiens
atttaaaacagacactggcatgg

SEQ ID NO: 2345182 - DNA, 20 bp, Homo sapiens
atttaaaatggaaaattttc

SEQ ID NO: 2345183 - DNA, 14 bp, Homo sapiens
atttaacattttac

SEQ ID NO: 2345184 - DNA, 17 bp, Homo sapiens
atttaacattttacagt

SEQ ID NO: 2345185 - DNA, 18 bp, Homo sapiens
atttaacattttacagta

SEQ ID NO: 2345186 - DNA, 22 bp, Homo sapiens
atttaagagattttatgtttaa

SEQ ID NO: 2345187 - DNA, 19 bp, Homo sapiens
atttaagcacaaaaaattt

SEQ ID NO: 2345188 - DNA, 14 bp, Homo sapiens
atttaagtgcgtgt

SEQ ID NO: 2345189 - DNA, 23 bp, Homo sapiens
atttaagtggactgtatttcggc

SEQ ID NO: 2345190 - DNA, 12 bp, Homo sapiens
atttaataacat

SEQ ID NO: 2345191 - DNA, 18 bp, Homo sapiens
atttaataacattacctt

SEQ ID NO: 2345192 - DNA, 19 bp, Homo sapiens
atttaataacattacctta

SEQ ID NO: 2345193 - DNA, 23 bp, Homo sapiens
atttaatccagttataagaagaa

SEQ ID NO: 2345194 - DNA, 19 bp, Homo sapiens
atttaattacttcttagta

SEQ ID NO: 2345195 - DNA, 21 bp, Homo sapiens
atttacaagggaagatttatg

SEQ ID NO: 2345196 - DNA, 20 bp, Homo sapiens
atttacacatcttaaaagtg

SEQ ID NO: 2345197 - DNA, 16 bp, Homo sapiens
atttactaactaaata

SEQ ID NO: 2345198 - DNA, 16 bp, Homo sapiens
atttacttgttttgga

SEQ ID NO: 2345199 - DNA, 23 bp, Homo sapiens
atttacttgttttggatggcttg

SEQ ID NO: 2345200 - DNA, 21 bp, Homo sapiens
atttagaaaagtgaattgaag

SEQ ID NO: 2345201 - DNA, 16 bp, Homo sapiens
atttagcacagtattt

SEQ ID NO: 2345202 - DNA, 21 bp, Homo sapiens
atttagcacagtatttaacat

SEQ ID NO: 2345203 - DNA, 14 bp, Homo sapiens
atttagtaagaata

SEQ ID NO: 2345204 - DNA, 18 bp, Homo sapiens
atttagtggatggaatat

SEQ ID NO: 2345205 - DNA, 15 bp, Homo sapiens
atttataatacagaa

SEQ ID NO: 2345206 - DNA, 15 bp, Homo sapiens
atttatacaccagca

SEQ ID NO: 2345207 - DNA, 16 bp, Homo sapiens
atttatatcaggtgta

SEQ ID NO: 2345208 - DNA, 23 bp, Homo sapiens
atttatgaataaagaatgccatt

SEQ ID NO: 2345209 - DNA, 16 bp, Homo sapiens
atttatgatttaataa

SEQ ID NO: 2345210 - DNA, 17 bp, Homo sapiens
atttatgatttaataaa

SEQ ID NO: 2345211 - DNA, 19 bp, Homo sapiens
atttatgatttaataaaat

SEQ ID NO: 2345212 - DNA, 16 bp, Homo sapiens
atttattttcctaaag

SEQ ID NO: 2345213 - DNA, 17 bp, Homo sapiens
atttattttcctaaaga

SEQ ID NO: 2345214 - DNA, 14 bp, Homo sapiens
atttcaaaatacat

SEQ ID NO: 2345215 - DNA, 19 bp, Homo sapiens
atttcaaaatacatttgta

SEQ ID NO: 2345216 - DNA, 14 bp, Homo sapiens
atttcaaaatgata

SEQ ID NO: 2345217 - DNA, 16 bp, Homo sapiens
atttcaaaatgataga

SEQ ID NO: 2345218 - DNA, 21 bp, Homo sapiens
atttcaaaatggacgtactgg

SEQ ID NO: 2345219 - DNA, 18 bp, Homo sapiens
atttcaaagttttgttgt

SEQ ID NO: 2345220 - DNA, 14 bp, Homo sapiens
atttcacctgtaaa

SEQ ID NO: 2345221 - DNA, 16 bp, Homo sapiens
atttcagaattaccat

SEQ ID NO: 2345222 - DNA, 15 bp, Homo sapiens
atttcagggtgcagc

SEQ ID NO: 2345223 - DNA, 14 bp, Homo sapiens
atttcagtaagtct

SEQ ID NO: 2345224 - DNA, 19 bp, Homo sapiens
atttcagtgttacctgtgt

SEQ ID NO: 2345225 - DNA, 18 bp, Homo sapiens
atttcagttctaggaaaa

SEQ ID NO: 2345226 - DNA, 19 bp, Homo sapiens
atttcagttctaggaaaat

SEQ ID NO: 2345227 - DNA, 13 bp, Homo sapiens
atttcatatctaa

SEQ ID NO: 2345228 - DNA, 17 bp, Homo sapiens
atttcatatctaacttt

SEQ ID NO: 2345229 - DNA, 19 bp, Homo sapiens
atttcatatctaactttgt

SEQ ID NO: 2345230 - DNA, 13 bp, Homo sapiens
atttcatctattt

SEQ ID NO: 2345231 - DNA, 16 bp, Homo sapiens
atttcatgaaaaagct

SEQ ID NO: 2345232 - DNA, 18 bp, Homo sapiens
atttcatgaaaaagctgc

SEQ ID NO: 2345233 - DNA, 14 bp, Homo sapiens
atttcattcctaac

SEQ ID NO: 2345234 - DNA, 12 bp, Homo sapiens
atttcatttagc

SEQ ID NO: 2345235 - DNA, 20 bp, Homo sapiens
atttccatgtcccctcccag

SEQ ID NO: 2345236 - DNA, 20 bp, Homo sapiens
attactgccattcacttcat

SEQ ID NO: 2345237 - DNA, 14 bp, Homo sapiens
attactgtcccctt

SEQ ID NO: 2345238 - DNA, 17 bp, Homo sapiens
attagagtatttccctt

SEQ ID NO: 2345239 - DNA, 19 bp, Homo sapiens
attagagtatttcccttcc

SEQ ID NO: 2345240 - DNA, 15 bp, Homo sapiens
attagataatatttt

SEQ ID NO: 2345241 - DNA, 19 bp, Homo sapiens
attagatcctaagatgtgt

SEQ ID NO: 2345242 - DNA, 21 bp, Homo sapiens
attagttccagtttctccttg

SEQ ID NO: 2345243 - DNA, 14 bp, Homo sapiens
attagttgggatgc

SEQ ID NO: 2345244 - DNA, 15 bp, Homo sapiens
attatacagtaagtt

SEQ ID NO: 2345245 - DNA, 15 bp, Homo sapiens
attatacatgtgata

SEQ ID NO: 2345246 - DNA, 14 bp, Homo sapiens
attatagaaaatta

SEQ ID NO: 2345247 - DNA, 21 bp, Homo sapiens
attatagaaaattatttgtat

SEQ ID NO: 2345248 - DNA, 16 bp, Homo sapiens
attatagtgtagaaaa

SEQ ID NO: 2345249 - DNA, 12 bp, Homo sapiens
attatatgaagt

SEQ ID NO: 2345250 - DNA, 23 bp, Homo sapiens
attatatgaagtttaaattctag

SEQ ID NO: 2345251 - DNA, 16 bp, Homo sapiens
attatcagcaaagaaa

SEQ ID NO: 2345252 - DNA, 13 bp, Homo sapiens
attatcattgttt

SEQ ID NO: 2345253 - DNA, 16 bp, Homo sapiens
attatcattgtttgtc

SEQ ID NO: 2345254 - DNA, 21 bp, Homo sapiens
attatgagctatcctttcaaa

SEQ ID NO: 2345255 - DNA, 23 bp, Homo sapiens
attatgcacttttagaaatgcat

SEQ ID NO: 2345256 - DNA, 14 bp, Homo sapiens
attatggaaaactg

SEQ ID NO: 2345257 - DNA, 15 bp, Homo sapiens
attatggaaaactgt

SEQ ID NO: 2345258 - DNA, 20 bp, Homo sapiens
attatgtgaccataatgtac

SEQ ID NO: 2345259 - DNA, 19 bp, Homo sapiens
attattcaagaatgaaaaa

SEQ ID NO: 2345260 - DNA, 20 bp, Homo sapiens
attattcaagaatgaaaaat

SEQ ID NO: 2345261 - DNA, 15 bp, Homo sapiens
attattcataatgtg

SEQ ID NO: 2345262 - DNA, 12 bp, Homo sapiens
attattctctgc

SEQ ID NO: 2345263 - DNA, 20 bp, Homo sapiens
attattgagttccagttgaa

SEQ ID NO: 2345264 - DNA, 21 bp, Homo sapiens
attattgagttccagttgaag

SEQ ID NO: 2345265 - DNA, 16 bp, Homo sapiens
attattgcactagaga

SEQ ID NO: 2345266 - DNA, 20 bp, Homo sapiens
attattgcactagagaaaat

SEQ ID NO: 2345267 - DNA, 22 bp, Homo sapiens
attattgcactagagaaaataa

SEQ ID NO: 2345268 - DNA, 19 bp, Homo sapiens
attatttaagactaaaagt

SEQ ID NO: 2345269 - DNA, 18 bp, Homo sapiens
attatttaataacattac

SEQ ID NO: 2345270 - DNA, 21 bp, Homo sapiens
attatttaataacattacctt

SEQ ID NO: 2345271 - DNA, 12 bp, Homo sapiens
attatttcttct

SEQ ID NO: 2345272 - DNA, 15 bp, Homo sapiens
attatttgattattt

SEQ ID NO: 2345273 - DNA, 22 bp, Homo sapiens
attatttgattatttaagacta

SEQ ID NO: 2345274 - DNA, 11 bp, Homo sapiens
attatttgtat

SEQ ID NO: 2345275 - DNA, 18 bp, Homo sapiens
attatttttataattgta

SEQ ID NO: 2345276 - DNA, 19 bp, Homo sapiens
attatttttataattgtac

SEQ ID NO: 2345277 - DNA, 17 bp, Homo sapiens
attatttttttaaaatt

SEQ ID NO: 2345278 - DNA, 18 bp, Homo sapiens
attatttttttaaaattt

SEQ ID NO: 2345279 - DNA, 14 bp, Homo sapiens
attcaaaagtattg

SEQ ID NO: 2345280 - DNA, 14 bp, Homo sapiens
attcaactttgtaa

SEQ ID NO: 2345281 - DNA, 15 bp, Homo sapiens
attcaactttgtaaa

SEQ ID NO: 2345282 - DNA, 21 bp, Homo sapiens
attcaagaagatagttgtaaa

SEQ ID NO: 2345283 - DNA, 18 bp, Homo sapiens
attcaagaatgaaaaata

SEQ ID NO: 2345284 - DNA, 15 bp, Homo sapiens
attcaatctgtaaac

SEQ ID NO: 2345285 - DNA, 22 bp, Homo sapiens
attcaatctgtaaactgtgtat

SEQ ID NO: 2345286 - DNA, 21 bp, Homo sapiens
attcaattagtggtcataaaa

SEQ ID NO: 2345287 - DNA, 22 bp, Homo sapiens
attcaattagtggtcataaaat

SEQ ID NO: 2345288 - DNA, 20 bp, Homo sapiens
attcacacctcacgctctgg

SEQ ID NO: 2345289 - DNA, 20 bp, Homo sapiens
attcagggaaagtgggacag

SEQ ID NO: 2345290 - DNA, 18 bp, Homo sapiens
attcagggtaaataggaa

SEQ ID NO: 2345291 - DNA, 13 bp, Homo sapiens
attcatccttcca

SEQ ID NO: 2345292 - DNA, 16 bp, Homo sapiens
attcatgaaaatgtat

SEQ ID NO: 2345293 - DNA, 20 bp, Homo sapiens
attcatggcatgcttaaatt

SEQ ID NO: 2345294 - DNA, 12 bp, Homo sapiens
attcatggctac

SEQ ID NO: 2345295 - DNA, 22 bp, Homo sapiens
attccaaattaggaagtgtttc

SEQ ID NO: 2345296 - DNA, 21 bp, Homo sapiens
attccaagtcaacactcttct

SEQ ID NO: 2345297 - DNA, 23 bp, Homo sapiens
attccacaggtcatcagatgcct

SEQ ID NO: 2345298 - DNA, 22 bp, Homo sapiens
attccactacacctggctgagg

SEQ ID NO: 2345299 - DNA, 23 bp, Homo sapiens
attccagtacagtattcttttaa

SEQ ID NO: 2345300 - DNA, 17 bp, Homo sapiens
attccctacagcctagg

SEQ ID NO: 2345301 - DNA, 12 bp, Homo sapiens
attcccttctgg

SEQ ID NO: 2345302 - DNA, 16 bp, Homo sapiens
attcctcctgctcata

SEQ ID NO: 2345303 - DNA, 16 bp, Homo sapiens
attcctgatcccatgg

SEQ ID NO: 2345304 - DNA, 19 bp, Homo sapiens
attcctggcatgacactct

SEQ ID NO: 2345305 - DNA, 16 bp, Homo sapiens
attcctggctctaccc

SEQ ID NO: 2345306 - DNA, 16 bp, Homo sapiens
attccttctttgataa

SEQ ID NO: 2345307 - DNA, 16 bp, Homo sapiens
attccttgcgcctcag

SEQ ID NO: 2345308 - DNA, 18 bp, Homo sapiens
attccttgcgcctcagcc

SEQ ID NO: 2345309 - DNA, 19 bp, Homo sapiens
attccttgcgcctcagccc

SEQ ID NO: 2345310 - DNA, 16 bp, Homo sapiens
attcctttaaaatatt

SEQ ID NO: 2345311 - DNA, 19 bp, Homo sapiens
attcgaggtgtcaccctgc

SEQ ID NO: 2345312 - DNA, 22 bp, Homo sapiens
attcgaggtgtcaccctgcaga

SEQ ID NO: 2345313 - DNA, 20 bp, Homo sapiens
attcggaactgtcctttcct

SEQ ID NO: 2345314 - DNA, 20 bp, Homo sapiens
attcgttgtgttttttaaga

SEQ ID NO: 2345315 - DNA, 22 bp, Homo sapiens
attcgttgtgttttttaagata

SEQ ID NO: 2345316 - DNA, 14 bp, Homo sapiens
attctaaatacatg

SEQ ID NO: 2345317 - DNA, 15 bp, Homo sapiens
attctagtgtccata

SEQ ID NO: 2345318 - DNA, 13 bp, Homo sapiens
attctataaaact

SEQ ID NO: 2345319 - DNA, 24 bp, Homo sapiens
attctataaaactctgcatgtaga

SEQ ID NO: 2345320 - DNA, 17 bp, Homo sapiens
attctatccatctcctg

SEQ ID NO: 2345321 - DNA, 18 bp, Homo sapiens
attctcaagacctgagta

SEQ ID NO: 2345322 - DNA, 21 bp, Homo sapiens
attctgattctggctttaagc

SEQ ID NO: 2345323 - DNA, 20 bp, Homo sapiens
attctgccgccccctcctga

SEQ ID NO: 2345324 - DNA, 15 bp, Homo sapiens
attctgcctctctgg

SEQ ID NO: 2345325 - DNA, 17 bp, Homo sapiens
attctgcctctctggaa

SEQ ID NO: 2345326 - DNA, 21 bp, Homo sapiens
attctgcctctctggaaagag

SEQ ID NO: 2345327 - DNA, 13 bp, Homo sapiens
attctgctccttc

SEQ ID NO: 2345328 - DNA, 16 bp, Homo sapiens
attctggctttaagcc

SEQ ID NO: 2345329 - DNA, 20 bp, Homo sapiens
attctgtatctttcatcctt

SEQ ID NO: 2345330 - DNA, 13 bp, Homo sapiens
attcttactaaaa

SEQ ID NO: 2345331 - DNA, 22 bp, Homo sapiens
attcttcctaatgtcagaacag

SEQ ID NO: 2345332 - DNA, 17 bp, Homo sapiens
attcttggaccatgcca

SEQ ID NO: 2345333 - DNA, 21 bp, Homo sapiens
attcttggaccatgccagatt

SEQ ID NO: 2345334 - DNA, 19 bp, Homo sapiens
attcttgttgctgtacaaa

SEQ ID NO: 2345335 - DNA, 21 bp, Homo sapiens
attcttgttgctgtacaaaag

SEQ ID NO: 2345336 - DNA, 15 bp, Homo sapiens
attcttttgtttcca

SEQ ID NO: 2345337 - DNA, 16 bp, Homo sapiens
attcttttgtttccat

SEQ ID NO: 2345338 - DNA, 16 bp, Homo sapiens
attgaaaagtttttgt

SEQ ID NO: 2345339 - DNA, 16 bp, Homo sapiens
attgaaaattgaaaag

SEQ ID NO: 2345340 - DNA, 13 bp, Homo sapiens
attgaaactgtat

SEQ ID NO: 2345341 - DNA, 17 bp, Homo sapiens
attgaaactgtatttac

SEQ ID NO: 2345342 - DNA, 12 bp, Homo sapiens
attgaaattcta

SEQ ID NO: 2345343 - DNA, 20 bp, Homo sapiens
attgaacttttgtactgaat

SEQ ID NO: 2345344 - DNA, 22 bp, Homo sapiens
attgaagctcgtgacaagtgcc

SEQ ID NO: 2345345 - DNA, 20 bp, Homo sapiens
attgaaggtgataagggaaa

SEQ ID NO: 2345346 - DNA, 22 bp, Homo sapiens
attgaaggtgataagggaaaag

SEQ ID NO: 2345347 - DNA, 13 bp, Homo sapiens
attgaagtttcaa

SEQ ID NO: 2345348 - DNA, 13 bp, Homo sapiens
attgaattatctt

SEQ ID NO: 2345349 - DNA, 17 bp, Homo sapiens
attgacattcctttgaa

SEQ ID NO: 2345350 - DNA, 18 bp, Homo sapiens
attgactgcctatgccaa

SEQ ID NO: 2345351 - DNA, 14 bp, Homo sapiens
attgagcttgcatg

SEQ ID NO: 2345352 - DNA, 13 bp, Homo sapiens
caaggtgctaaca

SEQ ID NO: 2345353 - DNA, 14 bp, Homo sapiens
caaggtggcagatg

SEQ ID NO: 2345354 - DNA, 13 bp, Homo sapiens
caagtaagaagac

SEQ ID NO: 2345355 - DNA, 13 bp, Homo sapiens
caagtaatattat

SEQ ID NO: 2345356 - DNA, 20 bp, Homo sapiens
caagtatggtaggggagggc

SEQ ID NO: 2345357 - DNA, 22 bp, Homo sapiens
caagtatgtgggcagattttca

SEQ ID NO: 2345358 - DNA, 16 bp, Homo sapiens
caagtcagctccagct

SEQ ID NO: 2345359 - DNA, 22 bp, Homo sapiens
caagtcagtaggactccttatt

SEQ ID NO: 2345360 - DNA, 18 bp, Homo sapiens
caagtccctggaaaagga

SEQ ID NO: 2345361 - DNA, 16 bp, Homo sapiens
caagtgcctcacctcg

SEQ ID NO: 2345362 - DNA, 18 bp, Homo sapiens
caagtggggtgctgggag

SEQ ID NO: 2345363 - DNA, 21 bp, Homo sapiens
caagtggggtgctgggaggag

SEQ ID NO: 2345364 - DNA, 17 bp, Homo sapiens
caagtggtgtttattgc

SEQ ID NO: 2345365 - DNA, 18 bp, Homo sapiens
caagtggtgtttattgca

SEQ ID NO: 2345366 - DNA, 20 bp, Homo sapiens
caagtggtgtttattgcaat

SEQ ID NO: 2345367 - DNA, 16 bp, Homo sapiens
caagtgttcactgctc

SEQ ID NO: 2345368 - DNA, 18 bp, Homo sapiens
caagtgttcactgctcct

SEQ ID NO: 2345369 - DNA, 22 bp, Homo sapiens
atttttatgtaattatatatac

SEQ ID NO: 2345370 - DNA, 21 bp, Homo sapiens
atttttattaaagcatttcct

SEQ ID NO: 2345371 - DNA, 18 bp, Homo sapiens
atttttcaatatattgaa

SEQ ID NO: 2345372 - DNA, 20 bp, Homo sapiens
atttttcaatatattgaact

SEQ ID NO: 2345373 - DNA, 17 bp, Homo sapiens
atttttctcaaagtttt

SEQ ID NO: 2345374 - DNA, 21 bp, Homo sapiens
atttttctcaaagttttgaaa

SEQ ID NO: 2345375 - DNA, 20 bp, Homo sapiens
atttttgactgtagccacag

SEQ ID NO: 2345376 - DNA, 18 bp, Homo sapiens
atttttgcctcttccagt

SEQ ID NO: 2345377 - DNA, 13 bp, Homo sapiens
atttttgtaaagt

SEQ ID NO: 2345378 - DNA, 12 bp, Homo sapiens
atttttgtacat

SEQ ID NO: 2345379 - DNA, 14 bp, Homo sapiens
atttttgtatttct

SEQ ID NO: 2345380 - DNA, 12 bp, Homo sapiens
attttttaagct

SEQ ID NO: 2345381 - DNA, 13 bp, Homo sapiens
attttttcccttt

SEQ ID NO: 2345382 - DNA, 16 bp, Homo sapiens
attttttgaaaagcag

SEQ ID NO: 2345383 - DNA, 13 bp, Homo sapiens
attttttgaaagt

SEQ ID NO: 2345384 - DNA, 23 bp, Homo sapiens
attttttgactttttttgtatgt

SEQ ID NO: 2345385 - DNA, 16 bp, Homo sapiens
attttttggcacttgc

SEQ ID NO: 2345386 - DNA, 15 bp, Homo sapiens
atttttttaaaattt

SEQ ID NO: 2345387 - DNA, 23 bp, Homo sapiens
atttttttcaaagactcaaattt

SEQ ID NO: 2345388 - DNA, 13 bp, Homo sapiens
atttttttctatt

SEQ ID NO: 2345389 - DNA, 23 bp, Homo sapiens
atttttttgcatgcatgcaaatg

SEQ ID NO: 2345390 - DNA, 13 bp, Homo sapiens
atttttttgtaat

SEQ ID NO: 2345391 - DNA, 14 bp, Homo sapiens
atttttttgtaata

SEQ ID NO: 2345392 - DNA, 15 bp, Homo sapiens
atttttttgtaataa

SEQ ID NO: 2345393 - DNA, 19 bp, Homo sapiens
attttttttaaaatagaaa

SEQ ID NO: 2345394 - DNA, 22 bp, Homo sapiens
attttttttaaaatagaaattt

SEQ ID NO: 2345395 - DNA, 15 bp, Homo sapiens
attttttttcttcca

SEQ ID NO: 2345396 - DNA, 24 bp, Homo sapiens
attttttttcttccaacatgtgat

SEQ ID NO: 2345397 - DNA, 14 bp, Homo sapiens
atttttttttctaa

SEQ ID NO: 2345398 - DNA, 19 bp, Homo sapiens
atttttttttctaagagaa

SEQ ID NO: 2345399 - DNA, 22 bp, Homo sapiens
caaaaaaaaaaaaaagcatcta

SEQ ID NO: 2345400 - DNA, 20 bp, Homo sapiens
caaaaaaagggaaggattta

SEQ ID NO: 2345401 - DNA, 16 bp, Homo sapiens
caaaaacagaatttga

SEQ ID NO: 2345402 - DNA, 12 bp, Homo sapiens
caaaaacatttg

SEQ ID NO: 2345403 - DNA, 15 bp, Homo sapiens
caaaaaccaaatgtt

SEQ ID NO: 2345404 - DNA, 16 bp, Homo sapiens
caaaaaccagccaggc

SEQ ID NO: 2345405 - DNA, 19 bp, Homo sapiens
caaaaagaactaaatatgc

SEQ ID NO: 2345406 - DNA, 14 bp, Homo sapiens
caaaaagtatatta

SEQ ID NO: 2345407 - DNA, 14 bp, Homo sapiens
caaaaataaaatat

SEQ ID NO: 2345408 - DNA, 11 bp, Homo sapiens
caaaacaaaaa

SEQ ID NO: 2345409 - DNA, 18 bp, Homo sapiens
caaaacaaaaagatgtct

SEQ ID NO: 2345410 - DNA, 23 bp, Homo sapiens
caaaacctgtattactgaataat

SEQ ID NO: 2345411 - DNA, 14 bp, Homo sapiens
caaaagagggttta

SEQ ID NO: 2345412 - DNA, 14 bp, Homo sapiens
caaaagtccctccc

SEQ ID NO: 2345413 - DNA, 23 bp, Homo sapiens
caaaataaaccgtgtatttatta

SEQ ID NO: 2345414 - DNA, 14 bp, Homo sapiens
caaaataataaaaa

SEQ ID NO: 2345415 - DNA, 15 bp, Homo sapiens
caaaatacatttgta

SEQ ID NO: 2345416 - DNA, 19 bp, Homo sapiens
caaaatctaaaatgtttta

SEQ ID NO: 2345417 - DNA, 22 bp, Homo sapiens
caaaatgatagacatataccaa

SEQ ID NO: 2345418 - DNA, 23 bp, Homo sapiens
caaaatgatagacatataccaaa

SEQ ID NO: 2345419 - DNA, 16 bp, Homo sapiens
caaaatggaataaaag

SEQ ID NO: 2345420 - DNA, 21 bp, Homo sapiens
caaaatgttggtcattttatg

SEQ ID NO: 2345421 - DNA, 16 bp, Homo sapiens
caaaattaagcaaatg

SEQ ID NO: 2345422 - DNA, 22 bp, Homo sapiens
caaaattaagcaaatgttaaaa

SEQ ID NO: 2345423 - DNA, 21 bp, Homo sapiens
caaaattagatcctaagatgt

SEQ ID NO: 2345424 - DNA, 15 bp, Homo sapiens
caaaattcaaagcat

SEQ ID NO: 2345425 - DNA, 18 bp, Homo sapiens
caaacagccaagattttc

SEQ ID NO: 2345426 - DNA, 15 bp, Homo sapiens
caaacaggaacaatc

SEQ ID NO: 2345427 - DNA, 21 bp, Homo sapiens
caaacaggccaggctccagca

SEQ ID NO: 2345428 - DNA, 14 bp, Homo sapiens
caaaccaggaccct

SEQ ID NO: 2345429 - DNA, 15 bp, Homo sapiens
caaaccctcccagaa

SEQ ID NO: 2345430 - DNA, 21 bp, Homo sapiens
caaaccctcccagaaacatct

SEQ ID NO: 2345431 - DNA, 20 bp, Homo sapiens
caaacctgacccctgctcag

SEQ ID NO: 2345432 - DNA, 16 bp, Homo sapiens
caaacgacagaggagc

SEQ ID NO: 2345433 - DNA, 21 bp, Homo sapiens
caaacgctaaagagcccttgc

SEQ ID NO: 2345434 - DNA, 22 bp, Homo sapiens
caaacgctaaagagcccttgcc

SEQ ID NO: 2345435 - DNA, 16 bp, Homo sapiens
caaactactgaatgaa

SEQ ID NO: 2345436 - DNA, 21 bp, Homo sapiens
caaactactgaatgaagcagt

SEQ ID NO: 2345437 - DNA, 17 bp, Homo sapiens
caaactgaggaatttca

SEQ ID NO: 2345438 - DNA, 22 bp, Homo sapiens
caaactgggaacccctttccca

SEQ ID NO: 2345439 - DNA, 14 bp, Homo sapiens
caaagaaaatgaaa

SEQ ID NO: 2345440 - DNA, 17 bp, Homo sapiens
caaagactcaaattttg

SEQ ID NO: 2345441 - DNA, 17 bp, Homo sapiens
caaagagacatttcaaa

SEQ ID NO: 2345442 - DNA, 19 bp, Homo sapiens
caaagagattcgaatgacg

SEQ ID NO: 2345443 - DNA, 16 bp, Homo sapiens
caaagaggctgcccct

SEQ ID NO: 2345444 - DNA, 23 bp, Homo sapiens
caaagaggctgcccctctcacca

SEQ ID NO: 2345445 - DNA, 15 bp, Homo sapiens
caaagagggcttcct

SEQ ID NO: 2345446 - DNA, 18 bp, Homo sapiens
caaagagggcttcctcta

SEQ ID NO: 2345447 - DNA, 17 bp, Homo sapiens
caaagatttcatatcta

SEQ ID NO: 2345448 - DNA, 18 bp, Homo sapiens
caaagatttcatatctaa

SEQ ID NO: 2345449 - DNA, 17 bp, Homo sapiens
caaagcaaatgttggga

SEQ ID NO: 2345450 - DNA, 18 bp, Homo sapiens
caaagcagaagtctggct

SEQ ID NO: 2345451 - DNA, 24 bp, Homo sapiens
caaagcatggacatttagaagaaa

SEQ ID NO: 2345452 - DNA, 21 bp, Homo sapiens
caaagcctagacaacctttct

SEQ ID NO: 2345453 - DNA, 23 bp, Homo sapiens
caaagcctagacaacctttctgt

SEQ ID NO: 2345454 - DNA, 16 bp, Homo sapiens
caaagccttaagcaaa

SEQ ID NO: 2345455 - DNA, 18 bp, Homo sapiens
caaagccttaagcaaatt

SEQ ID NO: 2345456 - DNA, 16 bp, Homo sapiens
caaagccttctcccta

SEQ ID NO: 2345457 - DNA, 12 bp, Homo sapiens
caaagctattta

SEQ ID NO: 2345458 - DNA, 18 bp, Homo sapiens
caaagctatttaagtgga

SEQ ID NO: 2345459 - DNA, 16 bp, Homo sapiens
caaaggagctttctca

SEQ ID NO: 2345460 - DNA, 20 bp, Homo sapiens
caaagggaagtaacagacac

SEQ ID NO: 2345461 - DNA, 19 bp, Homo sapiens
caaagtaaagcagaggatg

SEQ ID NO: 2345462 - DNA, 15 bp, Homo sapiens
caaagtacagaattt

SEQ ID NO: 2345463 - DNA, 17 bp, Homo sapiens
caaagtcattaaagaca

SEQ ID NO: 2345464 - DNA, 23 bp, Homo sapiens
caaagtctgctctcatataagac

SEQ ID NO: 2345465 - DNA, 19 bp, Homo sapiens
caaagttaatgggatggtc

SEQ ID NO: 2345466 - DNA, 18 bp, Homo sapiens
caaagtttcagagtatat

SEQ ID NO: 2345467 - DNA, 21 bp, Homo sapiens
caaagttttgaaaagctatta

SEQ ID NO: 2345468 - DNA, 19 bp, Homo sapiens
caaataaatacgtgtcaaa

SEQ ID NO: 2345469 - DNA, 22 bp, Homo sapiens
caaataagattaataagatttt

SEQ ID NO: 2345470 - DNA, 13 bp, Homo sapiens
caaatacacattt

SEQ ID NO: 2345471 - DNA, 20 bp, Homo sapiens
caaataggctattaaaaaag

SEQ ID NO: 2345472 - DNA, 14 bp, Homo sapiens
caaataggtcatca

SEQ ID NO: 2345473 - DNA, 13 bp, Homo sapiens
caaatagttgcat

SEQ ID NO: 2345474 - DNA, 19 bp, Homo sapiens
caaatagttgcatagcagt

SEQ ID NO: 2345475 - DNA, 18 bp, Homo sapiens
caaatattcactggcccc

SEQ ID NO: 2345476 - DNA, 14 bp, Homo sapiens
caaatcaatacact

SEQ ID NO: 2345477 - DNA, 15 bp, Homo sapiens
caaatcaatacacta

SEQ ID NO: 2345478 - DNA, 18 bp, Homo sapiens
caaatcgtagcgtttgtt

SEQ ID NO: 2345479 - DNA, 13 bp, Homo sapiens
caaatgaaatgta

SEQ ID NO: 2345480 - DNA, 22 bp, Homo sapiens
caaatgaagaaagtcaaaaaat

SEQ ID NO: 2345481 - DNA, 17 bp, Homo sapiens
caaatgaatgattaaat

SEQ ID NO: 2345482 - DNA, 21 bp, Homo sapiens
caaatgaatgattaaattatg

SEQ ID NO: 2345483 - DNA, 22 bp, Homo sapiens
caaatgaatgattaaattatga

SEQ ID NO: 2345484 - DNA, 15 bp, Homo sapiens
caaatgaccttccaa

SEQ ID NO: 2345485 - DNA, 21 bp, Homo sapiens
caaatgagctctgaaatcttc

SEQ ID NO: 2345486 - DNA, 17 bp, Homo sapiens
caaatggagaagctgca

SEQ ID NO: 2345487 - DNA, 20 bp, Homo sapiens
caaatggccattttaaaatg

SEQ ID NO: 2345488 - DNA, 17 bp, Homo sapiens
caaatgggagctgagca

SEQ ID NO: 2345489 - DNA, 20 bp, Homo sapiens
caaatgggagctgagcagcc

SEQ ID NO: 2345490 - DNA, 14 bp, Homo sapiens
caaatgtttatttt

SEQ ID NO: 2345491 - DNA, 19 bp, Homo sapiens
caaattaaaacaaatatac

SEQ ID NO: 2345492 - DNA, 21 bp, Homo sapiens
caaattaaaacaaatatacat

SEQ ID NO: 2345493 - DNA, 21 bp, Homo sapiens
caaattcaagagctagaaaaa

SEQ ID NO: 2345494 - DNA, 22 bp, Homo sapiens
caaattcaagagctagaaaaat

SEQ ID NO: 2345495 - DNA, 23 bp, Homo sapiens
caaattcatggcatgcttaaatt

SEQ ID NO: 2345496 - DNA, 16 bp, Homo sapiens
cacatcttaaaagtgt

SEQ ID NO: 2345497 - DNA, 14 bp, Homo sapiens
cacatgcctgcgcc

SEQ ID NO: 2345498 - DNA, 23 bp, Homo sapiens
cacatggcccctccccctgccag

SEQ ID NO: 2345499 - DNA, 14 bp, Homo sapiens
cacatgggacctgg

SEQ ID NO: 2345500 - DNA, 15 bp, Homo sapiens
cacatgtgacacata

SEQ ID NO: 2345501 - DNA, 19 bp, Homo sapiens
cacattaatctcaaagaga

SEQ ID NO: 2345502 - DNA, 15 bp, Homo sapiens
cacattaggctgttg

SEQ ID NO: 2345503 - DNA, 16 bp, Homo sapiens
cacattgaaactgtat

SEQ ID NO: 2345504 - DNA, 13 bp, Homo sapiens
cacattgaagaat

SEQ ID NO: 2345505 - DNA, 17 bp, Homo sapiens
cacattggaatgccttg

SEQ ID NO: 2345506 - DNA, 22 bp, Homo sapiens
cacatttagaaatgtttattga

SEQ ID NO: 2345507 - DNA, 20 bp, Homo sapiens
cacatttgaaataaagtaat

SEQ ID NO: 2345508 - DNA, 18 bp, Homo sapiens
cacattttccttttcaaa

SEQ ID NO: 2345509 - DNA, 12 bp, Homo sapiens
caccaaaaacaa

SEQ ID NO: 2345510 - DNA, 18 bp, Homo sapiens
caccaaagctgcccactg

SEQ ID NO: 2345511 - DNA, 22 bp, Homo sapiens
caccaaatcgtagcgtttgtta

SEQ ID NO: 2345512 - DNA, 20 bp, Homo sapiens
caccacatagcatgcttcct

SEQ ID NO: 2345513 - DNA, 17 bp, Homo sapiens
caccaccggccccctcc

SEQ ID NO: 2345514 - DNA, 17 bp, Homo sapiens
caccacggccaccactg

SEQ ID NO: 2345515 - DNA, 18 bp, Homo sapiens
caccacggccaccactgc

SEQ ID NO: 2345516 - DNA, 13 bp, Homo sapiens
caccactaaaaaa

SEQ ID NO: 2345517 - DNA, 16 bp, Homo sapiens
caccacttccagagcc

SEQ ID NO: 2345518 - DNA, 19 bp, Homo sapiens
caccagacgtcaggccctg

SEQ ID NO: 2345519 - DNA, 17 bp, Homo sapiens
caccagagcagatgcag

SEQ ID NO: 2345520 - DNA, 18 bp, Homo sapiens
caccagagcagatgcaga

SEQ ID NO: 2345521 - DNA, 20 bp, Homo sapiens
caccagagcagatgcagaga

SEQ ID NO: 2345522 - DNA, 13 bp, Homo sapiens
caccagatctgat

SEQ ID NO: 2345523 - DNA, 12 bp, Homo sapiens
caccagccccac

SEQ ID NO: 2345524 - DNA, 21 bp, Homo sapiens
caccagcccccgccccagagt

SEQ ID NO: 2345525 - DNA, 14 bp, Homo sapiens
caccagccctgcag

SEQ ID NO: 2345526 - DNA, 20 bp, Homo sapiens
caccagccctgcagcccacc

SEQ ID NO: 2345527 - DNA, 22 bp, Homo sapiens
caccatactccttgcttcctga

SEQ ID NO: 2345528 - DNA, 19 bp, Homo sapiens
caccatatgaattgtacag

SEQ ID NO: 2345529 - DNA, 20 bp, Homo sapiens
caccatccaccttcccttct

SEQ ID NO: 2345530 - DNA, 18 bp, Homo sapiens
caccatgatgtgaagagt

SEQ ID NO: 2345531 - DNA, 22 bp, Homo sapiens
cacccaaccctatctcctgaca

SEQ ID NO: 2345532 - DNA, 18 bp, Homo sapiens
cacccacctgttttctga

SEQ ID NO: 2345533 - DNA, 19 bp, Homo sapiens
cacccaccttgacgtttct

SEQ ID NO: 2345534 - DNA, 22 bp, Homo sapiens
cacccaccttgacgtttcttct

SEQ ID NO: 2345535 - DNA, 14 bp, Homo sapiens
cacccagagggagt

SEQ ID NO: 2345536 - DNA, 21 bp, Homo sapiens
cacccagggctccctcctgga

SEQ ID NO: 2345537 - DNA, 24 bp, Homo sapiens
cacccagggctccctcctggagca

SEQ ID NO: 2345538 - DNA, 23 bp, Homo sapiens
cacccaggggaaggccctgaggc

SEQ ID NO: 2345539 - DNA, 17 bp, Homo sapiens
cacccagtagcccagag

SEQ ID NO: 2345540 - DNA, 18 bp, Homo sapiens
cacccatttttccttttg

SEQ ID NO: 2345541 - DNA, 21 bp, Homo sapiens
caccccaacctgctctcctct

SEQ ID NO: 2345542 - DNA, 22 bp, Homo sapiens
caccccaacctgctctcctctt

SEQ ID NO: 2345543 - DNA, 20 bp, Homo sapiens
caccccggggaccctgtgac

SEQ ID NO: 2345544 - DNA, 22 bp, Homo sapiens
cacccctctgtctaggactgca

SEQ ID NO: 2345545 - DNA, 11 bp, Homo sapiens
cacccctgccc

SEQ ID NO: 2345546 - DNA, 12 bp, Homo sapiens
caccccttctct

SEQ ID NO: 2345547 - DNA, 20 bp, Homo sapiens
cacccgtcttggggctcgcc

SEQ ID NO: 2345548 - DNA, 14 bp, Homo sapiens
caccctcagggagc

SEQ ID NO: 2345549 - DNA, 14 bp, Homo sapiens
caccctcttcctac

SEQ ID NO: 2345550 - DNA, 15 bp, Homo sapiens
caccctcttcctact

SEQ ID NO: 2345551 - DNA, 17 bp, Homo sapiens
caccctcttcctactgg

SEQ ID NO: 2345552 - DNA, 14 bp, Homo sapiens
caccctcttcctgt

SEQ ID NO: 2345553 - DNA, 11 bp, Homo sapiens
caccctgcaga

SEQ ID NO: 2345554 - DNA, 14 bp, Homo sapiens
caccctgcagagct

SEQ ID NO: 2345555 - DNA, 17 bp, Homo sapiens
caccctgtcctatgact

SEQ ID NO: 2345556 - DNA, 14 bp, Homo sapiens
caccctgttcctgc

SEQ ID NO: 2345557 - DNA, 17 bp, Homo sapiens
caccctgttcctgctgc

SEQ ID NO: 2345558 - DNA, 18 bp, Homo sapiens
caccctgttcctgctgct

SEQ ID NO: 2345559 - DNA, 15 bp, Homo sapiens
cacccttctcccact

SEQ ID NO: 2345560 - DNA, 13 bp, Homo sapiens
caccgagaatgtt

SEQ ID NO: 2345561 - DNA, 20 bp, Homo sapiens
caccgctgggtggttttttc

SEQ ID NO: 2345562 - DNA, 18 bp, Homo sapiens
caccggcctgtgggtctc

SEQ ID NO: 2345563 - DNA, 22 bp, Homo sapiens
caccggcctgtgggtctctgaa

SEQ ID NO: 2345564 - DNA, 15 bp, Homo sapiens
caccgtgaaccagag

SEQ ID NO: 2345565 - DNA, 17 bp, Homo sapiens
caccgtggaggaggaag

SEQ ID NO: 2345566 - DNA, 22 bp, Homo sapiens
cacctaaagcctaccctattct

SEQ ID NO: 2345567 - DNA, 20 bp, Homo sapiens
cacctaatgtttatgagcca

SEQ ID NO: 2345568 - DNA, 23 bp, Homo sapiens
cacctagaacactaactcaccag

SEQ ID NO: 2345569 - DNA, 15 bp, Homo sapiens
cacctcaccaaggat

SEQ ID NO: 2345570 - DNA, 19 bp, Homo sapiens
cacctcacgctctggacat

SEQ ID NO: 2345571 - DNA, 12 bp, Homo sapiens
cacctcatgccc

SEQ ID NO: 2345572 - DNA, 22 bp, Homo sapiens
cacctctaggtccccatactcc

SEQ ID NO: 2345573 - DNA, 18 bp, Homo sapiens
cacctctttaaaaactca

SEQ ID NO: 2345574 - DNA, 15 bp, Homo sapiens
cacctgacttggctg

SEQ ID NO: 2345575 - DNA, 12 bp, Homo sapiens
cacctgcaagat

SEQ ID NO: 2345576 - DNA, 17 bp, Homo sapiens
cacctgccccagcactc

SEQ ID NO: 2345577 - DNA, 16 bp, Homo sapiens
cacctgccttggcctc

SEQ ID NO: 2345578 - DNA, 22 bp, Homo sapiens
cacctgctggaaaccacacttc

SEQ ID NO: 2345579 - DNA, 18 bp, Homo sapiens
cacctggctctcacctct

SEQ ID NO: 2345580 - DNA, 20 bp, Homo sapiens
cacctggctgaggttcctct

SEQ ID NO: 2345581 - DNA, 14 bp, Homo sapiens
cacctgtaaacctg

SEQ ID NO: 2345582 - DNA, 17 bp, Homo sapiens
cacctgtagtcccagct

SEQ ID NO: 2345583 - DNA, 13 bp, Homo sapiens
caccttcagggct

SEQ ID NO: 2345584 - DNA, 13 bp, Homo sapiens
caccttcccttct

SEQ ID NO: 2345585 - DNA, 17 bp, Homo sapiens
cacggagacagaggaaa

SEQ ID NO: 2345586 - DNA, 13 bp, Homo sapiens
cacgggtggtccc

SEQ ID NO: 2345587 - DNA, 14 bp, Homo sapiens
cacgtggcttggag

SEQ ID NO: 2345588 - DNA, 21 bp, Homo sapiens
cacgttggggtgatttaatcc

SEQ ID NO: 2345589 - DNA, 16 bp, Homo sapiens
cactaaatcagagaca

SEQ ID NO: 2345590 - DNA, 16 bp, Homo sapiens
cactaacgaaatatca

SEQ ID NO: 2345591 - DNA, 18 bp, Homo sapiens
cactaactcaccagcccc

SEQ ID NO: 2345592 - DNA, 22 bp, Homo sapiens
cactacaggaggaatgcaccac

SEQ ID NO: 2345593 - DNA, 21 bp, Homo sapiens
cactaccaaacactcagtcca

SEQ ID NO: 2345594 - DNA, 16 bp, Homo sapiens
cactagagaaaataaa

SEQ ID NO: 2345595 - DNA, 23 bp, Homo sapiens
cactagcccaatgaaatgaatta

SEQ ID NO: 2345596 - DNA, 18 bp, Homo sapiens
cactcagtgagcctcctg

SEQ ID NO: 2345597 - DNA, 19 bp, Homo sapiens
cactcagtgagcctcctgt

SEQ ID NO: 2345598 - DNA, 20 bp, Homo sapiens
cactcagtgagcctcctgtg

SEQ ID NO: 2345599 - DNA, 22 bp, Homo sapiens
cactcagtgagcctcctgtgcc

SEQ ID NO: 2345600 - DNA, 16 bp, Homo sapiens
cactccaagcccagcc

SEQ ID NO: 2345601 - DNA, 20 bp, Homo sapiens
cactccagggacacacagcc

SEQ ID NO: 2345602 - DNA, 22 bp, Homo sapiens
cactcccacctgcatctggggc

SEQ ID NO: 2345603 - DNA, 16 bp, Homo sapiens
cactcccctccactct

SEQ ID NO: 2345604 - DNA, 22 bp, Homo sapiens
cactccctgggacacagaccca

SEQ ID NO: 2345605 - DNA, 17 bp, Homo sapiens
cactccgcgccgatgcc

SEQ ID NO: 2345606 - DNA, 15 bp, Homo sapiens
cactcgaatcattga

SEQ ID NO: 2345607 - DNA, 20 bp, Homo sapiens
cactcgggtttctctgtggc

SEQ ID NO: 2345608 - DNA, 21 bp, Homo sapiens
cactcgtcaccccagccctcg

SEQ ID NO: 2345609 - DNA, 17 bp, Homo sapiens
cactcgtgcatccctga

SEQ ID NO: 2345610 - DNA, 16 bp, Homo sapiens
cactcgtgtgtttcta

SEQ ID NO: 2345611 - DNA, 18 bp, Homo sapiens
cactctagtgacttcctg

SEQ ID NO: 2345612 - DNA, 19 bp, Homo sapiens
cactctagtgacttcctgg

SEQ ID NO: 2345613 - DNA, 15 bp, Homo sapiens
cactctctaccagat

SEQ ID NO: 2345614 - DNA, 23 bp, Homo sapiens
cactctgccccccccccccatct

SEQ ID NO: 2345615 - DNA, 17 bp, Homo sapiens
cactcttctcttgagca

SEQ ID NO: 2345616 - DNA, 18 bp, Homo sapiens
cactcttcttgagcagac

SEQ ID NO: 2345617 - DNA, 20 bp, Homo sapiens
cactcttcttgagcagaccg

SEQ ID NO: 2345618 - DNA, 16 bp, Homo sapiens
cactcttttgctgtgc

SEQ ID NO: 2345619 - DNA, 13 bp, Homo sapiens
cactgaaagtttt

SEQ ID NO: 2345620 - DNA, 19 bp, Homo sapiens
cactgaaagttttgtaaaa

SEQ ID NO: 2345621 - DNA, 20 bp, Homo sapiens
cactgaaagttttgtaaaag

SEQ ID NO: 2345622 - DNA, 13 bp, Homo sapiens
cactgaaccactg

SEQ ID NO: 2345623 - DNA, 14 bp, Homo sapiens
cactgaaccactgc

SEQ ID NO: 2345624 - DNA, 18 bp, Homo sapiens
cactgaaccactgcttct

SEQ ID NO: 2345625 - DNA, 21 bp, Homo sapiens
cactgacccactcggatggac

SEQ ID NO: 2345626 - DNA, 14 bp, Homo sapiens
cactgacttgctgt

SEQ ID NO: 2345627 - DNA, 21 bp, Homo sapiens
cactgagaggacagagagaaa

SEQ ID NO: 2345628 - DNA, 15 bp, Homo sapiens
cactgatggctcaag

SEQ ID NO: 2345629 - DNA, 13 bp, Homo sapiens
cactgccagcagc

SEQ ID NO: 2345630 - DNA, 16 bp, Homo sapiens
cactgccagcagcagc

SEQ ID NO: 2345631 - DNA, 22 bp, Homo sapiens
cactgccagcagcagcaggtga

SEQ ID NO: 2345632 - DNA, 21 bp, Homo sapiens
cactgctaggggagagctctc

SEQ ID NO: 2345633 - DNA, 14 bp, Homo sapiens
cactgctccttgct

SEQ ID NO: 2345634 - DNA, 13 bp, Homo sapiens
cactgctggacat

SEQ ID NO: 2345635 - DNA, 17 bp, Homo sapiens
cactgctggacatgaga

SEQ ID NO: 2345636 - DNA, 17 bp, Homo sapiens
cactgcttctcttttga

SEQ ID NO: 2345637 - DNA, 24 bp, Homo sapiens
cactggaaaggggagagcctgctg

SEQ ID NO: 2345638 - DNA, 18 bp, Homo sapiens
cactggaggttgaagcca

SEQ ID NO: 2345639 - DNA, 21 bp, Homo sapiens
cactggaggttgaagccaagt

SEQ ID NO: 2345640 - DNA, 13 bp, Homo sapiens
cactggcgaggag

SEQ ID NO: 2345641 - DNA, 15 bp, Homo sapiens
cactggctctcctgg

SEQ ID NO: 2345642 - DNA, 21 bp, Homo sapiens
cactgggttgcgggacagagt

SEQ ID NO: 2345643 - DNA, 14 bp, Homo sapiens
cactggtaaatgtt

SEQ ID NO: 2345644 - DNA, 15 bp, Homo sapiens
cactggtaaatgtta

SEQ ID NO: 2345645 - DNA, 16 bp, Homo sapiens
cactgtataaatagga

SEQ ID NO: 2345646 - DNA, 17 bp, Homo sapiens
cactgtataaataggag

SEQ ID NO: 2345647 - DNA, 19 bp, Homo sapiens
cactgtataaataggagag

SEQ ID NO: 2345648 - DNA, 17 bp, Homo sapiens
cactgtccgcctctgcc

SEQ ID NO: 2345649 - DNA, 17 bp, Homo sapiens
cactgtgttccttccgc

SEQ ID NO: 2345650 - DNA, 19 bp, Homo sapiens
cactgttctgattatgtaa

SEQ ID NO: 2345651 - DNA, 21 bp, Homo sapiens
cactgttctgttcatttccta

SEQ ID NO: 2345652 - DNA, 14 bp, Homo sapiens
cactgtttcctggg

SEQ ID NO: 2345653 - DNA, 15 bp, Homo sapiens
cactgtttcctgggc

SEQ ID NO: 2345654 - DNA, 19 bp, Homo sapiens
cactgtttctcttgagctg

SEQ ID NO: 2345655 - DNA, 21 bp, Homo sapiens
cactgtttctcttgagctggc

SEQ ID NO: 2345656 - DNA, 22 bp, Homo sapiens
cacttaactataaggtgcctca

SEQ ID NO: 2345657 - DNA, 17 bp, Homo sapiens
cacttacgtttgtcctt

SEQ ID NO: 2345658 - DNA, 23 bp, Homo sapiens
cacttattattaataatgaagta

SEQ ID NO: 2345659 - DNA, 17 bp, Homo sapiens
cacttattgaatatatg

SEQ ID NO: 2345660 - DNA, 21 bp, Homo sapiens
cacttcactgcgaagaccctc

SEQ ID NO: 2345661 - DNA, 15 bp, Homo sapiens
cacttcataatccag

SEQ ID NO: 2345662 - DNA, 20 bp, Homo sapiens
cacttctgggcttcatctgg

SEQ ID NO: 2345663 - DNA, 17 bp, Homo sapiens
cacttcttgaaacagcc

SEQ ID NO: 2345664 - DNA, 19 bp, Homo sapiens
cacttgaagccatctaaag

SEQ ID NO: 2345665 - DNA, 19 bp, Homo sapiens
cactttacccacctagaac

SEQ ID NO: 2345666 - DNA, 14 bp, Homo sapiens
cactttactttcaa

SEQ ID NO: 2345667 - DNA, 13 bp, Homo sapiens
cactttcccacac

SEQ ID NO: 2345668 - DNA, 14 bp, Homo sapiens
cactttgaaaagtt

SEQ ID NO: 2345669 - DNA, 19 bp, Homo sapiens
cacagatgttcccccatct

SEQ ID NO: 2345670 - DNA, 15 bp, Homo sapiens
cacagcaagtacagc

SEQ ID NO: 2345671 - DNA, 19 bp, Homo sapiens
cacagcaagtacagcggct

SEQ ID NO: 2345672 - DNA, 18 bp, Homo sapiens
cacagcctagcacagcag

SEQ ID NO: 2345673 - DNA, 19 bp, Homo sapiens
cacagcgagggcagctgct

SEQ ID NO: 2345674 - DNA, 13 bp, Homo sapiens
cacagctcaggag

SEQ ID NO: 2345675 - DNA, 16 bp, Homo sapiens
cacagctgctgttctc

SEQ ID NO: 2345676 - DNA, 19 bp, Homo sapiens
cacaggagggcggcctcct

SEQ ID NO: 2345677 - DNA, 17 bp, Homo sapiens
cacaggctgagaactcg

SEQ ID NO: 2345678 - DNA, 20 bp, Homo sapiens
cacagggagtgcacatatcc

SEQ ID NO: 2345679 - DNA, 17 bp, Homo sapiens
cacagtaccggattctc

SEQ ID NO: 2345680 - DNA, 18 bp, Homo sapiens
cacagtaccggattctct

SEQ ID NO: 2345681 - DNA, 19 bp, Homo sapiens
cacagtccagacccaagtc

SEQ ID NO: 2345682 - DNA, 15 bp, Homo sapiens
cacagtctcagttct

SEQ ID NO: 2345683 - DNA, 19 bp, Homo sapiens
cacagtgggatgaaccagc

SEQ ID NO: 2345684 - DNA, 15 bp, Homo sapiens
cacagtgttgtgccc

SEQ ID NO: 2345685 - DNA, 14 bp, Homo sapiens
cacagttcctggga

SEQ ID NO: 2345686 - DNA, 22 bp, Homo sapiens
cacagtttttgtaaagcccttg

SEQ ID NO: 2345687 - DNA, 15 bp, Homo sapiens
cacatagcatgcttc

SEQ ID NO: 2345688 - DNA, 17 bp, Homo sapiens
cacatagcatgcttcct

SEQ ID NO: 2345689 - DNA, 19 bp, Homo sapiens
cacatatccaggcaccagg

SEQ ID NO: 2345690 - DNA, 18 bp, Homo sapiens
cacatatgcaccttgtgt

SEQ ID NO: 2345691 - DNA, 19 bp, Homo sapiens
cacatccaactccagcaac

SEQ ID NO: 2345692 - DNA, 12 bp, Homo sapiens
cacatctgcctt

SEQ ID NO: 2345693 - DNA, 15 bp, Homo sapiens
ccagattgctctgcc

SEQ ID NO: 2345694 - DNA, 15 bp, Homo sapiens
ccagcactttgggag

SEQ ID NO: 2345695 - DNA, 14 bp, Homo sapiens
ccagcagcagcagg

SEQ ID NO: 2345696 - DNA, 15 bp, Homo sapiens
ccagcagcagcccaa

SEQ ID NO: 2345697 - DNA, 23 bp, Homo sapiens
ccagcagcagcccaagcttccct

SEQ ID NO: 2345698 - DNA, 15 bp, Homo sapiens
ccagcagttgttcca

SEQ ID NO: 2345699 - DNA, 14 bp, Homo sapiens
ccagcatctggaag

SEQ ID NO: 2345700 - DNA, 18 bp, Homo sapiens
ccagcatctggaagatgt

SEQ ID NO: 2345701 - DNA, 14 bp, Homo sapiens
ccagcattctcagg

SEQ ID NO: 2345702 - DNA, 20 bp, Homo sapiens
ccagcattctcaggcaccag

SEQ ID NO: 2345703 - DNA, 22 bp, Homo sapiens
ccagccagcagcagcccaagct

SEQ ID NO: 2345704 - DNA, 22 bp, Homo sapiens
ccagccagtgaggatgacagtg

SEQ ID NO: 2345705 - DNA, 21 bp, Homo sapiens
ccagcccagattcccctgtgt

SEQ ID NO: 2345706 - DNA, 13 bp, Homo sapiens
ccagccccactgc

SEQ ID NO: 2345707 - DNA, 16 bp, Homo sapiens
ccagcccccgccccag

SEQ ID NO: 2345708 - DNA, 18 bp, Homo sapiens
ccagcccccgccccagag

SEQ ID NO: 2345709 - DNA, 23 bp, Homo sapiens
ccagcccccgccccagagtggcc

SEQ ID NO: 2345710 - DNA, 17 bp, Homo sapiens
ccagccccggcaagcca

SEQ ID NO: 2345711 - DNA, 19 bp, Homo sapiens
ccagccccggcaagccaca

SEQ ID NO: 2345712 - DNA, 21 bp, Homo sapiens
ccagccccggcaagccacagg

SEQ ID NO: 2345713 - DNA, 17 bp, Homo sapiens
ccagccccggggtgagt

SEQ ID NO: 2345714 - DNA, 18 bp, Homo sapiens
ccagccccggtggctggg

SEQ ID NO: 2345715 - DNA, 20 bp, Homo sapiens
ccagccccggtggctgggca

SEQ ID NO: 2345716 - DNA, 14 bp, Homo sapiens
ccagcccctactgc

SEQ ID NO: 2345717 - DNA, 10 bp, Homo sapiens
ccagcccctg

SEQ ID NO: 2345718 - DNA, 16 bp, Homo sapiens
ccagcccctggggccc

SEQ ID NO: 2345719 - DNA, 22 bp, Homo sapiens
ccagcccctgtttactggttct

SEQ ID NO: 2345720 - DNA, 14 bp, Homo sapiens
ccagccctgctggg

SEQ ID NO: 2345721 - DNA, 19 bp, Homo sapiens
ccagcctccgagagggaga

SEQ ID NO: 2345722 - DNA, 11 bp, Homo sapiens
ccagcctcctc

SEQ ID NO: 2345723 - DNA, 14 bp, Homo sapiens
ccagcctcctctgg

SEQ ID NO: 2345724 - DNA, 23 bp, Homo sapiens
ccagcctcctctggacggcaggc

SEQ ID NO: 2345725 - DNA, 21 bp, Homo sapiens
ccagcgatctctccactgtgc

SEQ ID NO: 2345726 - DNA, 12 bp, Homo sapiens
ccagcggggctg

SEQ ID NO: 2345727 - DNA, 14 bp, Homo sapiens
ccagcggggctgct

SEQ ID NO: 2345728 - DNA, 17 bp, Homo sapiens
ccagctacttgggaggc

SEQ ID NO: 2345729 - DNA, 13 bp, Homo sapiens
ccagctctctgac

SEQ ID NO: 2345730 - DNA, 16 bp, Homo sapiens
ccagctctctgacgct

SEQ ID NO: 2345731 - DNA, 22 bp, Homo sapiens
ccagctctttattacatagctc

SEQ ID NO: 2345732 - DNA, 21 bp, Homo sapiens
ccagctgccctatgggcctgc

SEQ ID NO: 2345733 - DNA, 19 bp, Homo sapiens
ccagctgcgcttgcttttc

SEQ ID NO: 2345734 - DNA, 20 bp, Homo sapiens
ccagctgcgcttgcttttct

SEQ ID NO: 2345735 - DNA, 21 bp, Homo sapiens
ccagctgcgcttgcttttctg

SEQ ID NO: 2345736 - DNA, 13 bp, Homo sapiens
ccagctggcctgg

SEQ ID NO: 2345737 - DNA, 15 bp, Homo sapiens
ccagctggcctggac

SEQ ID NO: 2345738 - DNA, 16 bp, Homo sapiens
ccagctggcctggaca

SEQ ID NO: 2345739 - DNA, 12 bp, Homo sapiens
ccagctggcctt

SEQ ID NO: 2345740 - DNA, 14 bp, Homo sapiens
ccagctggcctttg

SEQ ID NO: 2345741 - DNA, 19 bp, Homo sapiens
ccagctggggccagaggct

SEQ ID NO: 2345742 - DNA, 20 bp, Homo sapiens
ccagcttatagtcatatata

SEQ ID NO: 2345743 - DNA, 14 bp, Homo sapiens
ccagcttccaaagc

SEQ ID NO: 2345744 - DNA, 13 bp, Homo sapiens
ccaggaagccaga

SEQ ID NO: 2345745 - DNA, 14 bp, Homo sapiens
ccaggaagccagag

SEQ ID NO: 2345746 - DNA, 22 bp, Homo sapiens
ccaggaaggccaaaatcaagag

SEQ ID NO: 2345747 - DNA, 11 bp, Homo sapiens
ccaggactctg

SEQ ID NO: 2345748 - DNA, 13 bp, Homo sapiens
ccaggactctgac

SEQ ID NO: 2345749 - DNA, 14 bp, Homo sapiens
ccaggactctgacc

SEQ ID NO: 2345750 - DNA, 18 bp, Homo sapiens
ccaggagatgggtccagg

SEQ ID NO: 2345751 - DNA, 17 bp, Homo sapiens
ccaggatactggcacag

SEQ ID NO: 2345752 - DNA, 14 bp, Homo sapiens
ccaggatcatggtg

SEQ ID NO: 2345753 - DNA, 15 bp, Homo sapiens
ccaggcacacacagc

SEQ ID NO: 2345754 - DNA, 16 bp, Homo sapiens
ccaggcaccctcaggg

SEQ ID NO: 2345755 - DNA, 22 bp, Homo sapiens
ccaggcagaggttttaatgtct

SEQ ID NO: 2345756 - DNA, 17 bp, Homo sapiens
ccaggcagctccctcct

SEQ ID NO: 2345757 - DNA, 21 bp, Homo sapiens
ccaggcatgaaattcttccta

SEQ ID NO: 2345758 - DNA, 14 bp, Homo sapiens
ccaggccagcctcc

SEQ ID NO: 2345759 - DNA, 15 bp, Homo sapiens
ccaggccagcctccg

SEQ ID NO: 2345760 - DNA, 19 bp, Homo sapiens
ccaggccagcctccgagag

SEQ ID NO: 2345761 - DNA, 15 bp, Homo sapiens
ccaggccattctgcc

SEQ ID NO: 2345762 - DNA, 17 bp, Homo sapiens
ccaggccattctgccgc

SEQ ID NO: 2345763 - DNA, 15 bp, Homo sapiens
ccaggccggcccaga

SEQ ID NO: 2345764 - DNA, 20 bp, Homo sapiens
ccaggccgtggactggctca

SEQ ID NO: 2345765 - DNA, 12 bp, Homo sapiens
ccaggccttgtc

SEQ ID NO: 2345766 - DNA, 13 bp, Homo sapiens
ccaggccttgtcc

SEQ ID NO: 2345767 - DNA, 13 bp, Homo sapiens
ccaggctgtttca

SEQ ID NO: 2345768 - DNA, 13 bp, Homo sapiens
ccaggcttctgct

SEQ ID NO: 2345769 - DNA, 16 bp, Homo sapiens
ccaggcttctgctggg

SEQ ID NO: 2345770 - DNA, 19 bp, Homo sapiens
ccagggaaggtggccacag

SEQ ID NO: 2345771 - DNA, 22 bp, Homo sapiens
ccagggaaggtggccacagcaa

SEQ ID NO: 2345772 - DNA, 14 bp, Homo sapiens
ccagggactctcca

SEQ ID NO: 2345773 - DNA, 21 bp, Homo sapiens
ccagggagcttctacctggaa

SEQ ID NO: 2345774 - DNA, 14 bp, Homo sapiens
ccagggagtccagg

SEQ ID NO: 2345775 - DNA, 14 bp, Homo sapiens
ccagggcagggtct

SEQ ID NO: 2345776 - DNA, 22 bp, Homo sapiens
ccagggcagggtctgggctggg

SEQ ID NO: 2345777 - DNA, 16 bp, Homo sapiens
ccagggccctgggcag

SEQ ID NO: 2345778 - DNA, 12 bp, Homo sapiens
ccagggcctcct

SEQ ID NO: 2345779 - DNA, 21 bp, Homo sapiens
ccagggcctcctgggggacct

SEQ ID NO: 2345780 - DNA, 15 bp, Homo sapiens
ccagggggcaagagg

SEQ ID NO: 2345781 - DNA, 15 bp, Homo sapiens
ccaggggtctgtctg

SEQ ID NO: 2345782 - DNA, 16 bp, Homo sapiens
ccaggggtctgtctgc

SEQ ID NO: 2345783 - DNA, 18 bp, Homo sapiens
ccagtacctagctggctc

SEQ ID NO: 2345784 - DNA, 20 bp, Homo sapiens
ccagtaggagaaatctcagc

SEQ ID NO: 2345785 - DNA, 14 bp, Homo sapiens
ccagtatttttaaa

SEQ ID NO: 2345786 - DNA, 15 bp, Homo sapiens
ccagtcatctgtaag

SEQ ID NO: 2345787 - DNA, 17 bp, Homo sapiens
ccagtccaccctgcctg

SEQ ID NO: 2345788 - DNA, 14 bp, Homo sapiens
ccagtccactcctg

SEQ ID NO: 2345789 - DNA, 16 bp, Homo sapiens
ccagtccccacccctg

SEQ ID NO: 2345790 - DNA, 22 bp, Homo sapiens
ccagtccccacccctgccccca

SEQ ID NO: 2345791 - DNA, 21 bp, Homo sapiens
ccagtccccatttctgcctcg

SEQ ID NO: 2345792 - DNA, 11 bp, Homo sapiens
ccagtcctgct

SEQ ID NO: 2345793 - DNA, 22 bp, Homo sapiens
ccagtcgtgatgtggaggaaga

SEQ ID NO: 2345794 - DNA, 17 bp, Homo sapiens
ccagtcttcctgacact

SEQ ID NO: 2345795 - DNA, 14 bp, Homo sapiens
ccagtgaactcctg

SEQ ID NO: 2345796 - DNA, 19 bp, Homo sapiens
ccagtgagactgccccacg

SEQ ID NO: 2345797 - DNA, 18 bp, Homo sapiens
ccagtgctcaccagccct

SEQ ID NO: 2345798 - DNA, 20 bp, Homo sapiens
ccagtgctcaccagccctgc

SEQ ID NO: 2345799 - DNA, 22 bp, Homo sapiens
ccagtgctcaccagccctgcag

SEQ ID NO: 2345800 - DNA, 13 bp, Homo sapiens
ccagtgctctgcc

SEQ ID NO: 2345801 - DNA, 17 bp, Homo sapiens
ccagtgctctgcctcag

SEQ ID NO: 2345802 - DNA, 20 bp, Homo sapiens
ccagtgctctgcctcagacg

SEQ ID NO: 2345803 - DNA, 20 bp, Homo sapiens
ccagtgggccagccacagag

SEQ ID NO: 2345804 - DNA, 19 bp, Homo sapiens
ccagttgggctcgcactgc

SEQ ID NO: 2345805 - DNA, 16 bp, Homo sapiens
ccataaacggttcctg

SEQ ID NO: 2345806 - DNA, 17 bp, Homo sapiens
ccataaacggttcctgg

SEQ ID NO: 2345807 - DNA, 20 bp, Homo sapiens
ccatactccttgcttcctga

SEQ ID NO: 2345808 - DNA, 19 bp, Homo sapiens
ccatagaccctgaggccct

SEQ ID NO: 2345809 - DNA, 18 bp, Homo sapiens
ccatagagatgagcccac

SEQ ID NO: 2345810 - DNA, 15 bp, Homo sapiens
ccatagtcttaactg

SEQ ID NO: 2345811 - DNA, 21 bp, Homo sapiens
ccatagtggatcactcaccat

SEQ ID NO: 2345812 - DNA, 22 bp, Homo sapiens
ccatatagctcgagcaaaattc

SEQ ID NO: 2345813 - DNA, 15 bp, Homo sapiens
ccatatatgaccaga

SEQ ID NO: 2345814 - DNA, 18 bp, Homo sapiens
ccatatatgaccagaagc

SEQ ID NO: 2345815 - DNA, 14 bp, Homo sapiens
ccatatgcagaaat

SEQ ID NO: 2345816 - DNA, 14 bp, Homo sapiens
ccatattaaaatct

SEQ ID NO: 2345817 - DNA, 15 bp, Homo sapiens
ccatattcacacctc

SEQ ID NO: 2345818 - DNA, 16 bp, Homo sapiens
ccatattcacacctca

SEQ ID NO: 2345819 - DNA, 21 bp, Homo sapiens
ccatattgtgcttcacagtag

SEQ ID NO: 2345820 - DNA, 16 bp, Homo sapiens
ccatatttgatttcta

SEQ ID NO: 2345821 - DNA, 20 bp, Homo sapiens
ccatcaccctcttcctgtga

SEQ ID NO: 2345822 - DNA, 19 bp, Homo sapiens
ccatcagggttctcttagc

SEQ ID NO: 2345823 - DNA, 20 bp, Homo sapiens
ccatcagggttctcttagca

SEQ ID NO: 2345824 - DNA, 16 bp, Homo sapiens
ccatccagatgtgtgc

SEQ ID NO: 2345825 - DNA, 17 bp, Homo sapiens
ccatccagtggactctg

SEQ ID NO: 2345826 - DNA, 22 bp, Homo sapiens
ccatcctcaaacgacagaggag

SEQ ID NO: 2345827 - DNA, 20 bp, Homo sapiens
ccatcctccctccacctcaa

SEQ ID NO: 2345828 - DNA, 14 bp, Homo sapiens
ccatctagccagcc

SEQ ID NO: 2345829 - DNA, 12 bp, Homo sapiens
ccatctcccaag

SEQ ID NO: 2345830 - DNA, 19 bp, Homo sapiens
ccatctcccaaggctgcca

SEQ ID NO: 2345831 - DNA, 16 bp, Homo sapiens
ccatctccctgcctgg

SEQ ID NO: 2345832 - DNA, 14 bp, Homo sapiens
ccatctgcacccct

SEQ ID NO: 2345833 - DNA, 18 bp, Homo sapiens
ccatcttcgggaccagga

SEQ ID NO: 2345834 - DNA, 14 bp, Homo sapiens
ccatgaacttgata

SEQ ID NO: 2345835 - DNA, 20 bp, Homo sapiens
ccatgaatctctgcctctcc

SEQ ID NO: 2345836 - DNA, 14 bp, Homo sapiens
ccatgacagaggct

SEQ ID NO: 2345837 - DNA, 15 bp, Homo sapiens
ccatgacagaggctg

SEQ ID NO: 2345838 - DNA, 16 bp, Homo sapiens
ccatgacagaggctgc

SEQ ID NO: 2345839 - DNA, 19 bp, Homo sapiens
ccatgacagaggctgcacc

SEQ ID NO: 2345840 - DNA, 23 bp, Homo sapiens
ccatgatcagacatacagctgcc

SEQ ID NO: 2345841 - DNA, 18 bp, Homo sapiens
ccatgcagacctcatgcc

SEQ ID NO: 2345842 - DNA, 21 bp, Homo sapiens
ccatgcagacctcatgcccag

SEQ ID NO: 2345843 - DNA, 22 bp, Homo sapiens
ccatgcagacctcatgcccagc

SEQ ID NO: 2345844 - DNA, 23 bp, Homo sapiens
ccatgccagattctgcctctctg

SEQ ID NO: 2345845 - DNA, 17 bp, Homo sapiens
ccatgccgtctgccgga

SEQ ID NO: 2345846 - DNA, 19 bp, Homo sapiens
ccatgctggcggcgcagag

SEQ ID NO: 2345847 - DNA, 21 bp, Homo sapiens
ccatgctggcggcgcagaggg

SEQ ID NO: 2345848 - DNA, 12 bp, Homo sapiens
ccatgctgtccg

SEQ ID NO: 2345849 - DNA, 16 bp, Homo sapiens
ccatgctgtccggcct

SEQ ID NO: 2345850 - DNA, 18 bp, Homo sapiens
ccatggagattgacctgg

SEQ ID NO: 2345851 - DNA, 13 bp, Homo sapiens
catgtcttgtaca

SEQ ID NO: 2345852 - DNA, 13 bp, Homo sapiens
catgtgaagaggg

SEQ ID NO: 2345853 - DNA, 12 bp, Homo sapiens
catgtgacacat

SEQ ID NO: 2345854 - DNA, 14 bp, Homo sapiens
catgtgacacatat

SEQ ID NO: 2345855 - DNA, 15 bp, Homo sapiens
catgtgacacatatg

SEQ ID NO: 2345856 - DNA, 14 bp, Homo sapiens
catgtgagctcttc

SEQ ID NO: 2345857 - DNA, 18 bp, Homo sapiens
catgtgagctcttcctat

SEQ ID NO: 2345858 - DNA, 21 bp, Homo sapiens
catgtgatggacactccaggg

SEQ ID NO: 2345859 - DNA, 22 bp, Homo sapiens
catgtgatggacactccaggga

SEQ ID NO: 2345860 - DNA, 15 bp, Homo sapiens
catgtgcatagtttc

SEQ ID NO: 2345861 - DNA, 17 bp, Homo sapiens
catgtgcatagtttctt

SEQ ID NO: 2345862 - DNA, 17 bp, Homo sapiens
catgtggcctttatctc

SEQ ID NO: 2345863 - DNA, 23 bp, Homo sapiens
catgtggcctttatctcaacgga

SEQ ID NO: 2345864 - DNA, 18 bp, Homo sapiens
catgtgggggaggaggga

SEQ ID NO: 2345865 - DNA, 14 bp, Homo sapiens
catgtgtagcctgt

SEQ ID NO: 2345866 - DNA, 20 bp, Homo sapiens
catgttctatttttgactgt

SEQ ID NO: 2345867 - DNA, 20 bp, Homo sapiens
catgtttaatgggtatgctc

SEQ ID NO: 2345868 - DNA, 16 bp, Homo sapiens
catgttttacttttat

SEQ ID NO: 2345869 - DNA, 22 bp, Homo sapiens
catgttttacttttatctaaag

SEQ ID NO: 2345870 - DNA, 19 bp, Homo sapiens
cattaaaaatgagatttct

SEQ ID NO: 2345871 - DNA, 13 bp, Homo sapiens
cattaaaaattac

SEQ ID NO: 2345872 - DNA, 15 bp, Homo sapiens
cattaaagtcagaag

SEQ ID NO: 2345873 - DNA, 18 bp, Homo sapiens
cattaaatgcaataattt

SEQ ID NO: 2345874 - DNA, 19 bp, Homo sapiens
cattaaatgcaataatttt

SEQ ID NO: 2345875 - DNA, 15 bp, Homo sapiens
cattaacaaataaaa

SEQ ID NO: 2345876 - DNA, 16 bp, Homo sapiens
cattaacaaataaaaa

SEQ ID NO: 2345877 - DNA, 16 bp, Homo sapiens
cattaacggtgctaaa

SEQ ID NO: 2345878 - DNA, 20 bp, Homo sapiens
cattaactatttttttcaaa

SEQ ID NO: 2345879 - DNA, 13 bp, Homo sapiens
cattaatctcaaa

SEQ ID NO: 2345880 - DNA, 16 bp, Homo sapiens
cattaatctcaaagag

SEQ ID NO: 2345881 - DNA, 22 bp, Homo sapiens
cattaatgataaactcagatct

SEQ ID NO: 2345882 - DNA, 19 bp, Homo sapiens
cattaatgcctgctttttg

SEQ ID NO: 2345883 - DNA, 21 bp, Homo sapiens
cattaatgcctgctttttgga

SEQ ID NO: 2345884 - DNA, 22 bp, Homo sapiens
cattaatgcctgctttttggaa

SEQ ID NO: 2345885 - DNA, 12 bp, Homo sapiens
cattacagttct

SEQ ID NO: 2345886 - DNA, 16 bp, Homo sapiens
cattacagttctttcc

SEQ ID NO: 2345887 - DNA, 17 bp, Homo sapiens
cattacagttctttcct

SEQ ID NO: 2345888 - DNA, 23 bp, Homo sapiens
cattaccaaaataataaaaatca

SEQ ID NO: 2345889 - DNA, 24 bp, Homo sapiens
cattacctccatccatccttccaa

SEQ ID NO: 2345890 - DNA, 20 bp, Homo sapiens
cattaccttactgtggagga

SEQ ID NO: 2345891 - DNA, 13 bp, Homo sapiens
cattatgattctt

SEQ ID NO: 2345892 - DNA, 13 bp, Homo sapiens
cattattaaattg

SEQ ID NO: 2345893 - DNA, 18 bp, Homo sapiens
cattattcaagaatgaaa

SEQ ID NO: 2345894 - DNA, 22 bp, Homo sapiens
cattattctctgctatatataa

SEQ ID NO: 2345895 - DNA, 18 bp, Homo sapiens
cattattttatatatttt

SEQ ID NO: 2345896 - DNA, 15 bp, Homo sapiens
cattcacatttagaa

SEQ ID NO: 2345897 - DNA, 11 bp, Homo sapiens
cattcacttca

SEQ ID NO: 2345898 - DNA, 15 bp, Homo sapiens
cattcagaaatgttg

SEQ ID NO: 2345899 - DNA, 20 bp, Homo sapiens
cattcagaaatgttgagtct

SEQ ID NO: 2345900 - DNA, 18 bp, Homo sapiens
cattcagagctatggtgc

SEQ ID NO: 2345901 - DNA, 14 bp, Homo sapiens
cattcataaacttt

SEQ ID NO: 2345902 - DNA, 16 bp, Homo sapiens
cattcatcctgaccaa

SEQ ID NO: 2345903 - DNA, 14 bp, Homo sapiens
cattcatccttcca

SEQ ID NO: 2345904 - DNA, 11 bp, Homo sapiens
cattcattttt

SEQ ID NO: 2345905 - DNA, 23 bp, Homo sapiens
cattccaagggtatgggaagcca

SEQ ID NO: 2345906 - DNA, 20 bp, Homo sapiens
cattccaagtcaacactctt

SEQ ID NO: 2345907 - DNA, 14 bp, Homo sapiens
cattcccagcccag

SEQ ID NO: 2345908 - DNA, 20 bp, Homo sapiens
cattcctaacacagcatgtg

SEQ ID NO: 2345909 - DNA, 13 bp, Homo sapiens
cattcctgcttct

SEQ ID NO: 2345910 - DNA, 15 bp, Homo sapiens
cattccttctttgat

SEQ ID NO: 2345911 - DNA, 18 bp, Homo sapiens
cattccttctttgataat

SEQ ID NO: 2345912 - DNA, 18 bp, Homo sapiens
cattcgaggtgtcaccct

SEQ ID NO: 2345913 - DNA, 23 bp, Homo sapiens
cattcgaggtgtcaccctgcaga

SEQ ID NO: 2345914 - DNA, 13 bp, Homo sapiens
cattctcaggcac

SEQ ID NO: 2345915 - DNA, 17 bp, Homo sapiens
cattctcaggcaccagt

SEQ ID NO: 2345916 - DNA, 12 bp, Homo sapiens
cattctcccagg

SEQ ID NO: 2345917 - DNA, 18 bp, Homo sapiens
cattctgccgccccctcc

SEQ ID NO: 2345918 - DNA, 14 bp, Homo sapiens
cattctggaaactt

SEQ ID NO: 2345919 - DNA, 16 bp, Homo sapiens
cattctggacctctgg

SEQ ID NO: 2345920 - DNA, 17 bp, Homo sapiens
cattctggacctctggg

SEQ ID NO: 2345921 - DNA, 21 bp, Homo sapiens
cattctggtcaagggctgtca

SEQ ID NO: 2345922 - DNA, 15 bp, Homo sapiens
cattgaaactgtatt

SEQ ID NO: 2345923 - DNA, 14 bp, Homo sapiens
cattgagtattgtt

SEQ ID NO: 2345924 - DNA, 17 bp, Homo sapiens
cattgatccaggagata

SEQ ID NO: 2345925 - DNA, 17 bp, Homo sapiens
cattgattgtcagctac

SEQ ID NO: 2345926 - DNA, 18 bp, Homo sapiens
cattgattgtcagctact

SEQ ID NO: 2345927 - DNA, 20 bp, Homo sapiens
cattgctcttagtcccaagc

SEQ ID NO: 2345928 - DNA, 17 bp, Homo sapiens
cattggaatgccttgga

SEQ ID NO: 2345929 - DNA, 22 bp, Homo sapiens
cattggagaagcggtggataac

SEQ ID NO: 2345930 - DNA, 17 bp, Homo sapiens
cattgggcacagtccag

SEQ ID NO: 2345931 - DNA, 19 bp, Homo sapiens
cattgggcacagtccagac

SEQ ID NO: 2345932 - DNA, 22 bp, Homo sapiens
cattgggcacagtccagaccca

SEQ ID NO: 2345933 - DNA, 18 bp, Homo sapiens
catttaaaacagacactg

SEQ ID NO: 2345934 - DNA, 23 bp, Homo sapiens
catttaaaacagacactggcatg

SEQ ID NO: 2345935 - DNA, 14 bp, Homo sapiens
catttaaaatggaa

SEQ ID NO: 2345936 - DNA, 17 bp, Homo sapiens
catttaataaagatgag

SEQ ID NO: 2345937 - DNA, 15 bp, Homo sapiens
catttagaaaagtga

SEQ ID NO: 2345938 - DNA, 16 bp, Homo sapiens
catttagaagaaagat

SEQ ID NO: 2345939 - DNA, 17 bp, Homo sapiens
catttagaagaaagatg

SEQ ID NO: 2345940 - DNA, 20 bp, Homo sapiens
catttagaagaaagatgttt

SEQ ID NO: 2345941 - DNA, 20 bp, Homo sapiens
catttcatgaaaaagctgct

SEQ ID NO: 2345942 - DNA, 16 bp, Homo sapiens
catttccaaatgaact

SEQ ID NO: 2345943 - DNA, 16 bp, Homo sapiens
catttccattgcttat

SEQ ID NO: 2345944 - DNA, 20 bp, Homo sapiens
catttcccatctgcacccct

SEQ ID NO: 2345945 - DNA, 18 bp, Homo sapiens
catttcctcgcagcctct

SEQ ID NO: 2345946 - DNA, 15 bp, Homo sapiens
catttccttgtctaa

SEQ ID NO: 2345947 - DNA, 14 bp, Homo sapiens
catttctctttaaa

SEQ ID NO: 2345948 - DNA, 18 bp, Homo sapiens
catttctgaggtgcactg

SEQ ID NO: 2345949 - DNA, 13 bp, Homo sapiens
catttctttgcat

SEQ ID NO: 2345950 - DNA, 19 bp, Homo sapiens
catttgacacaaagcttct

SEQ ID NO: 2345951 - DNA, 23 bp, Homo sapiens
catttgacacaaagcttctaaag

SEQ ID NO: 2345952 - DNA, 11 bp, Homo sapiens
catttgattaa

SEQ ID NO: 2345953 - DNA, 18 bp, Homo sapiens
catttgattaataaaata

SEQ ID NO: 2345954 - DNA, 19 bp, Homo sapiens
catttgattaataaaatat

SEQ ID NO: 2345955 - DNA, 19 bp, Homo sapiens
catttgcaataacagctgc

SEQ ID NO: 2345956 - DNA, 22 bp, Homo sapiens
catttgctactgttgtaagaat

SEQ ID NO: 2345957 - DNA, 14 bp, Homo sapiens
catttggtctcagg

SEQ ID NO: 2345958 - DNA, 21 bp, Homo sapiens
catttggtctcaggcagcacc

SEQ ID NO: 2345959 - DNA, 20 bp, Homo sapiens
catttgtatgtcaaagcttt

SEQ ID NO: 2345960 - DNA, 21 bp, Homo sapiens
catttgtcccagactaaagga

SEQ ID NO: 2345961 - DNA, 15 bp, Homo sapiens
catttgtgccagagg

SEQ ID NO: 2345962 - DNA, 18 bp, Homo sapiens
cattttaattttaaagtg

SEQ ID NO: 2345963 - DNA, 14 bp, Homo sapiens
cattttacagtaaa

SEQ ID NO: 2345964 - DNA, 17 bp, Homo sapiens
cattttagaaactacaa

SEQ ID NO: 2345965 - DNA, 22 bp, Homo sapiens
cattttataatgatgaacttat

SEQ ID NO: 2345966 - DNA, 23 bp, Homo sapiens
ccacaaaccctgctgaacacagt

SEQ ID NO: 2345967 - DNA, 23 bp, Homo sapiens
ccacaagccattttttgaggaga

SEQ ID NO: 2345968 - DNA, 18 bp, Homo sapiens
ccacaagctgcactgtga

SEQ ID NO: 2345969 - DNA, 19 bp, Homo sapiens
ccacaagctgcactgtgaa

SEQ ID NO: 2345970 - DNA, 23 bp, Homo sapiens
ccacacagtgctcaaggccagct

SEQ ID NO: 2345971 - DNA, 13 bp, Homo sapiens
ccacactctccat

SEQ ID NO: 2345972 - DNA, 19 bp, Homo sapiens
ccacactgatggctcaaga

SEQ ID NO: 2345973 - DNA, 13 bp, Homo sapiens
ccacacttcttga

SEQ ID NO: 2345974 - DNA, 16 bp, Homo sapiens
ccacacttgaaacctt

SEQ ID NO: 2345975 - DNA, 22 bp, Homo sapiens
ccacagagggcaggggatggtt

SEQ ID NO: 2345976 - DNA, 13 bp, Homo sapiens
ccacagccagagg

SEQ ID NO: 2345977 - DNA, 17 bp, Homo sapiens
ccacagccagaggaggg

SEQ ID NO: 2345978 - DNA, 19 bp, Homo sapiens
ccacagcgagggcagctgc

SEQ ID NO: 2345979 - DNA, 15 bp, Homo sapiens
ccacagcgtccctgg

SEQ ID NO: 2345980 - DNA, 12 bp, Homo sapiens
ccacagctgctg

SEQ ID NO: 2345981 - DNA, 13 bp, Homo sapiens
ccacagctgctgt

SEQ ID NO: 2345982 - DNA, 23 bp, Homo sapiens
ccacagctgctgttctcaggaca

SEQ ID NO: 2345983 - DNA, 21 bp, Homo sapiens
ccacaggtcatcagatgcctg

SEQ ID NO: 2345984 - DNA, 18 bp, Homo sapiens
ccacagtgttgtgcccct

SEQ ID NO: 2345985 - DNA, 23 bp, Homo sapiens
ccacagtgttgtgccccttcact

SEQ ID NO: 2345986 - DNA, 20 bp, Homo sapiens
ccacatagcatgcttccttt

SEQ ID NO: 2345987 - DNA, 23 bp, Homo sapiens
ccacatggcttagagaggcttga

SEQ ID NO: 2345988 - DNA, 14 bp, Homo sapiens
ccacatgggacctg

SEQ ID NO: 2345989 - DNA, 15 bp, Homo sapiens
ccaccaaaactgctc

SEQ ID NO: 2345990 - DNA, 16 bp, Homo sapiens
ccaccaaaactgctcc

SEQ ID NO: 2345991 - DNA, 13 bp, Homo sapiens
ccaccaaagctgc

SEQ ID NO: 2345992 - DNA, 14 bp, Homo sapiens
ccaccaaagctgcc

SEQ ID NO: 2345993 - DNA, 20 bp, Homo sapiens
ccaccagccatcctccctcc

SEQ ID NO: 2345994 - DNA, 11 bp, Homo sapiens
ccaccagcccc

SEQ ID NO: 2345995 - DNA, 19 bp, Homo sapiens
ccaccatatgaattgtaca

SEQ ID NO: 2345996 - DNA, 19 bp, Homo sapiens
ccacccaaccctatctcct

SEQ ID NO: 2345997 - DNA, 15 bp, Homo sapiens
ccacccagggctccc

SEQ ID NO: 2345998 - DNA, 23 bp, Homo sapiens
ccacccagggctccctcctggag

SEQ ID NO: 2345999 - DNA, 19 bp, Homo sapiens
ccaccccaagagaactcgc

SEQ ID NO: 2346000 - DNA, 16 bp, Homo sapiens
ccaccccctgccctgc

SEQ ID NO: 2346001 - DNA, 22 bp, Homo sapiens
ccacccctggaagagcccagtc

SEQ ID NO: 2346002 - DNA, 17 bp, Homo sapiens
ccaccctcactggctct

SEQ ID NO: 2346003 - DNA, 16 bp, Homo sapiens
ccaccctgtcctatga

SEQ ID NO: 2346004 - DNA, 14 bp, Homo sapiens
ccaccgcgggtgtg

SEQ ID NO: 2346005 - DNA, 15 bp, Homo sapiens
ccaccggtccagctg

SEQ ID NO: 2346006 - DNA, 17 bp, Homo sapiens
ccaccggtccagctggc

SEQ ID NO: 2346007 - DNA, 18 bp, Homo sapiens
ccaccggtccagctggcc

SEQ ID NO: 2346008 - DNA, 15 bp, Homo sapiens
ccaccgtgaaccaga

SEQ ID NO: 2346009 - DNA, 19 bp, Homo sapiens
ccaccgtgcctggccagat

SEQ ID NO: 2346010 - DNA, 16 bp, Homo sapiens
ccaccgtgcctggcta

SEQ ID NO: 2346011 - DNA, 13 bp, Homo sapiens
ccaccgtggagga

SEQ ID NO: 2346012 - DNA, 14 bp, Homo sapiens
ccacctacacccct

SEQ ID NO: 2346013 - DNA, 21 bp, Homo sapiens
ccacctacacccctgtgctcc

SEQ ID NO: 2346014 - DNA, 14 bp, Homo sapiens
ccacctcctgacac

SEQ ID NO: 2346015 - DNA, 14 bp, Homo sapiens
ccacctcttgtgca

SEQ ID NO: 2346016 - DNA, 17 bp, Homo sapiens
cctatgggcctgccggg

SEQ ID NO: 2346017 - DNA, 12 bp, Homo sapiens
cctattatccca

SEQ ID NO: 2346018 - DNA, 16 bp, Homo sapiens
cctattctataaaact

SEQ ID NO: 2346019 - DNA, 20 bp, Homo sapiens
cctattctatccatctcctg

SEQ ID NO: 2346020 - DNA, 19 bp, Homo sapiens
cctattgtgacagagccat

SEQ ID NO: 2346021 - DNA, 14 bp, Homo sapiens
cctatttaacaaga

SEQ ID NO: 2346022 - DNA, 12 bp, Homo sapiens
cctatttgtgtg

SEQ ID NO: 2346023 - DNA, 20 bp, Homo sapiens
cctatttttgacatggaaat

SEQ ID NO: 2346024 - DNA, 23 bp, Homo sapiens
cctatttttgacatggaaatgaa

SEQ ID NO: 2346025 - DNA, 14 bp, Homo sapiens
cctcaaagggcagt

SEQ ID NO: 2346026 - DNA, 22 bp, Homo sapiens
cctcaaattttttgactttttt

SEQ ID NO: 2346027 - DNA, 18 bp, Homo sapiens
cctcaattgacattcctt

SEQ ID NO: 2346028 - DNA, 15 bp, Homo sapiens
cctcacctcatgccc

SEQ ID NO: 2346029 - DNA, 17 bp, Homo sapiens
cctcacctcatgcccac

SEQ ID NO: 2346030 - DNA, 14 bp, Homo sapiens
cctcacgcaagtgc

SEQ ID NO: 2346031 - DNA, 22 bp, Homo sapiens
cctcacgcaagtgccagggctg

SEQ ID NO: 2346032 - DNA, 21 bp, Homo sapiens
cctcacgcccttcaatgctgc

SEQ ID NO: 2346033 - DNA, 13 bp, Homo sapiens
cctcactccctct

SEQ ID NO: 2346034 - DNA, 19 bp, Homo sapiens
cctcactggctctcctggc

SEQ ID NO: 2346035 - DNA, 16 bp, Homo sapiens
cctcagacgttgcctg

SEQ ID NO: 2346036 - DNA, 17 bp, Homo sapiens
cctcagacgttgcctga

SEQ ID NO: 2346037 - DNA, 17 bp, Homo sapiens
cctcagagcgccaggaa

SEQ ID NO: 2346038 - DNA, 19 bp, Homo sapiens
cctcagagcgccaggaagc

SEQ ID NO: 2346039 - DNA, 15 bp, Homo sapiens
cctcagccctcagtt

SEQ ID NO: 2346040 - DNA, 15 bp, Homo sapiens
cctcagggctcccag

SEQ ID NO: 2346041 - DNA, 14 bp, Homo sapiens
cctcaggtgctgtc

SEQ ID NO: 2346042 - DNA, 16 bp, Homo sapiens
cctcaggtgctgtcca

SEQ ID NO: 2346043 - DNA, 23 bp, Homo sapiens
cctcagtatgtgggggcttcatc

SEQ ID NO: 2346044 - DNA, 13 bp, Homo sapiens
cctcagttttcct

SEQ ID NO: 2346045 - DNA, 23 bp, Homo sapiens
cctcataaaaatctagcacactc

SEQ ID NO: 2346046 - DNA, 13 bp, Homo sapiens
cctcatgcccacc

SEQ ID NO: 2346047 - DNA, 24 bp, Homo sapiens
cctcatgcccaccccctgccctgc

SEQ ID NO: 2346048 - DNA, 14 bp, Homo sapiens
cctcatgcccagct

SEQ ID NO: 2346049 - DNA, 19 bp, Homo sapiens
cctccaaatggagaagctg

SEQ ID NO: 2346050 - DNA, 23 bp, Homo sapiens
cctccaaatggagaagctgcagg

SEQ ID NO: 2346051 - DNA, 16 bp, Homo sapiens
cctccaagcacagagc

SEQ ID NO: 2346052 - DNA, 13 bp, Homo sapiens
cctccacagcgag

SEQ ID NO: 2346053 - DNA, 21 bp, Homo sapiens
cctccacattaagtggctttt

SEQ ID NO: 2346054 - DNA, 15 bp, Homo sapiens
cctccacccatccag

SEQ ID NO: 2346055 - DNA, 16 bp, Homo sapiens
cctccactccacctcc

SEQ ID NO: 2346056 - DNA, 23 bp, Homo sapiens
cctccaggagcttcttgtttcct

SEQ ID NO: 2346057 - DNA, 13 bp, Homo sapiens
cctccaggcctgc

SEQ ID NO: 2346058 - DNA, 21 bp, Homo sapiens
cctccaggcctgcctcccact

SEQ ID NO: 2346059 - DNA, 16 bp, Homo sapiens
cctccagggaaggtgg

SEQ ID NO: 2346060 - DNA, 22 bp, Homo sapiens
cctccattcatccttccatcca

SEQ ID NO: 2346061 - DNA, 20 bp, Homo sapiens
cctccattgggcacagtcca

SEQ ID NO: 2346062 - DNA, 21 bp, Homo sapiens
cctccattgggcacagtccag

SEQ ID NO: 2346063 - DNA, 16 bp, Homo sapiens
cctcccacactcccaa

SEQ ID NO: 2346064 - DNA, 19 bp, Homo sapiens
cctcccagtgagactgccc

SEQ ID NO: 2346065 - DNA, 21 bp, Homo sapiens
cctcccagtgagactgcccca

SEQ ID NO: 2346066 - DNA, 17 bp, Homo sapiens
cctccccatctgtccag

SEQ ID NO: 2346067 - DNA, 23 bp, Homo sapiens
cctccccatttcccatctgcacc

SEQ ID NO: 2346068 - DNA, 16 bp, Homo sapiens
cctccccctgccagga

SEQ ID NO: 2346069 - DNA, 14 bp, Homo sapiens
cctcccctctcaga

SEQ ID NO: 2346070 - DNA, 15 bp, Homo sapiens
cctcccctctcagaa

SEQ ID NO: 2346071 - DNA, 18 bp, Homo sapiens
cctcccctctcagaacat

SEQ ID NO: 2346072 - DNA, 13 bp, Homo sapiens
cctccccttccct

SEQ ID NO: 2346073 - DNA, 15 bp, Homo sapiens
cctccctccacctca

SEQ ID NO: 2346074 - DNA, 13 bp, Homo sapiens
cctcccttccttt

SEQ ID NO: 2346075 - DNA, 15 bp, Homo sapiens
cctcccttccttttc

SEQ ID NO: 2346076 - DNA, 16 bp, Homo sapiens
cctccgagagggagag

SEQ ID NO: 2346077 - DNA, 15 bp, Homo sapiens
cctccgcagtgtctc

SEQ ID NO: 2346078 - DNA, 17 bp, Homo sapiens
cctccgcagtgtctcca

SEQ ID NO: 2346079 - DNA, 18 bp, Homo sapiens
cctccgcagtgtctccac

SEQ ID NO: 2346080 - DNA, 15 bp, Homo sapiens
cctccggactggtgc

SEQ ID NO: 2346081 - DNA, 18 bp, Homo sapiens
cctcctagctctcccagt

SEQ ID NO: 2346082 - DNA, 16 bp, Homo sapiens
cctcctatccttggag

SEQ ID NO: 2346083 - DNA, 13 bp, Homo sapiens
cctcctcacctca

SEQ ID NO: 2346084 - DNA, 12 bp, Homo sapiens
cctcctccactc

SEQ ID NO: 2346085 - DNA, 13 bp, Homo sapiens
cctcctcccaggg

SEQ ID NO: 2346086 - DNA, 19 bp, Homo sapiens
cctcctcccagggcctcct

SEQ ID NO: 2346087 - DNA, 17 bp, Homo sapiens
cctcctctgcctacagc

SEQ ID NO: 2346088 - DNA, 18 bp, Homo sapiens
cctcctctgcctacagcc

SEQ ID NO: 2346089 - DNA, 22 bp, Homo sapiens
cctcctgaaccgcacagctcag

SEQ ID NO: 2346090 - DNA, 15 bp, Homo sapiens
cctcctgacaccctt

SEQ ID NO: 2346091 - DNA, 18 bp, Homo sapiens
cctcctgacacccttctc

SEQ ID NO: 2346092 - DNA, 22 bp, Homo sapiens
cctcctgacacccttctcccac

SEQ ID NO: 2346093 - DNA, 13 bp, Homo sapiens
cctcctgcctcag

SEQ ID NO: 2346094 - DNA, 18 bp, Homo sapiens
cctcctgcctcagccttc

SEQ ID NO: 2346095 - DNA, 11 bp, Homo sapiens
cctcctgctca

SEQ ID NO: 2346096 - DNA, 20 bp, Homo sapiens
cctcctggagcatcccaggc

SEQ ID NO: 2346097 - DNA, 19 bp, Homo sapiens
cctccttctgagctcctgt

SEQ ID NO: 2346098 - DNA, 15 bp, Homo sapiens
cctccttggtgcctg

SEQ ID NO: 2346099 - DNA, 18 bp, Homo sapiens
cctcctttcccttattgc

SEQ ID NO: 2346100 - DNA, 19 bp, Homo sapiens
cctccttttcactttattg

SEQ ID NO: 2346101 - DNA, 22 bp, Homo sapiens
cctcgcagcctctcagtgccct

SEQ ID NO: 2346102 - DNA, 18 bp, Homo sapiens
cctcgccggatctgaggg

SEQ ID NO: 2346103 - DNA, 14 bp, Homo sapiens
cctcgctcaccgct

SEQ ID NO: 2346104 - DNA, 21 bp, Homo sapiens
cctcgctcaccgctggccctt

SEQ ID NO: 2346105 - DNA, 16 bp, Homo sapiens
cctcgtcccatccagc

SEQ ID NO: 2346106 - DNA, 23 bp, Homo sapiens
cctcgtcccatccagctaccacc

SEQ ID NO: 2346107 - DNA, 22 bp, Homo sapiens
cctctaggtccccatactccta

SEQ ID NO: 2346108 - DNA, 18 bp, Homo sapiens
cctctagtagtatattta

SEQ ID NO: 2346109 - DNA, 14 bp, Homo sapiens
cctctattttaatt

SEQ ID NO: 2346110 - DNA, 21 bp, Homo sapiens
cctctcaagctagtgtttcta

SEQ ID NO: 2346111 - DNA, 15 bp, Homo sapiens
cccacgcagaggacg

SEQ ID NO: 2346112 - DNA, 14 bp, Homo sapiens
cccacggagacaga

SEQ ID NO: 2346113 - DNA, 17 bp, Homo sapiens
cccacggagacagagga

SEQ ID NO: 2346114 - DNA, 12 bp, Homo sapiens
cccactcccaca

SEQ ID NO: 2346115 - DNA, 15 bp, Homo sapiens
cccactctcctaggc

SEQ ID NO: 2346116 - DNA, 14 bp, Homo sapiens
cccactgccagcag

SEQ ID NO: 2346117 - DNA, 17 bp, Homo sapiens
cccagaaacatctctgg

SEQ ID NO: 2346118 - DNA, 20 bp, Homo sapiens
cccagacagggtgggcttcc

SEQ ID NO: 2346119 - DNA, 22 bp, Homo sapiens
cccagactaaaggatccagaga

SEQ ID NO: 2346120 - DNA, 19 bp, Homo sapiens
cccagagactttgtagatc

SEQ ID NO: 2346121 - DNA, 22 bp, Homo sapiens
cccagagaggcactcagtgagc

SEQ ID NO: 2346122 - DNA, 13 bp, Homo sapiens
cccagagctgcct

SEQ ID NO: 2346123 - DNA, 13 bp, Homo sapiens
cccagaggtaaca

SEQ ID NO: 2346124 - DNA, 23 bp, Homo sapiens
cccagaggtaacagaacagcttc

SEQ ID NO: 2346125 - DNA, 12 bp, Homo sapiens
cccagaggtgga

SEQ ID NO: 2346126 - DNA, 15 bp, Homo sapiens
cccagatgtgtcccc

SEQ ID NO: 2346127 - DNA, 17 bp, Homo sapiens
cccagcactttgggagg

SEQ ID NO: 2346128 - DNA, 18 bp, Homo sapiens
cccagcactttgggaggc

SEQ ID NO: 2346129 - DNA, 19 bp, Homo sapiens
cccagcagaggcaggctgg

SEQ ID NO: 2346130 - DNA, 17 bp, Homo sapiens
cccagcattctcaggca

SEQ ID NO: 2346131 - DNA, 17 bp, Homo sapiens
cccagccatgccagctg

SEQ ID NO: 2346132 - DNA, 19 bp, Homo sapiens
cccagccatgccagctggc

SEQ ID NO: 2346133 - DNA, 12 bp, Homo sapiens
cccagcccagat

SEQ ID NO: 2346134 - DNA, 20 bp, Homo sapiens
cccagcccagattcccctgt

SEQ ID NO: 2346135 - DNA, 15 bp, Homo sapiens
cccagcccatggaga

SEQ ID NO: 2346136 - DNA, 16 bp, Homo sapiens
cccagccccactcctc

SEQ ID NO: 2346137 - DNA, 22 bp, Homo sapiens
cccagccccggtggctgggcag

SEQ ID NO: 2346138 - DNA, 15 bp, Homo sapiens
cccagcccctactgc

SEQ ID NO: 2346139 - DNA, 19 bp, Homo sapiens
cccagcccctactgctgtg

SEQ ID NO: 2346140 - DNA, 12 bp, Homo sapiens
cccagccctgct

SEQ ID NO: 2346141 - DNA, 17 bp, Homo sapiens
cccagccctgctgggga

SEQ ID NO: 2346142 - DNA, 14 bp, Homo sapiens
cccagcctgggcca

SEQ ID NO: 2346143 - DNA, 13 bp, Homo sapiens
cccagcctgtcct

SEQ ID NO: 2346144 - DNA, 22 bp, Homo sapiens
cccagcctgtcctggtacagca

SEQ ID NO: 2346145 - DNA, 18 bp, Homo sapiens
cccagctacttgggaggc

SEQ ID NO: 2346146 - DNA, 13 bp, Homo sapiens
cccagctctctga

SEQ ID NO: 2346147 - DNA, 19 bp, Homo sapiens
cccaggactctgaccccag

SEQ ID NO: 2346148 - DNA, 16 bp, Homo sapiens
cccttagcaccttcag

SEQ ID NO: 2346149 - DNA, 21 bp, Homo sapiens
cccttattgcctcccaggcaa

SEQ ID NO: 2346150 - DNA, 15 bp, Homo sapiens
cccttcaatgctgca

SEQ ID NO: 2346151 - DNA, 23 bp, Homo sapiens
cccttcaatgctgcaggatggac

SEQ ID NO: 2346152 - DNA, 16 bp, Homo sapiens
cccttcatcttcctgt

SEQ ID NO: 2346153 - DNA, 11 bp, Homo sapiens
cccttccaaag

SEQ ID NO: 2346154 - DNA, 22 bp, Homo sapiens
cccttccaaatgtccctccaac

SEQ ID NO: 2346155 - DNA, 20 bp, Homo sapiens
cccttccagatcactgccac

SEQ ID NO: 2346156 - DNA, 16 bp, Homo sapiens
cccttccctctgggca

SEQ ID NO: 2346157 - DNA, 18 bp, Homo sapiens
cccttccttttccctgct

SEQ ID NO: 2346158 - DNA, 19 bp, Homo sapiens
cccttccttttccctgctt

SEQ ID NO: 2346159 - DNA, 23 bp, Homo sapiens
cccttctatttggggcttgatga

SEQ ID NO: 2346160 - DNA, 17 bp, Homo sapiens
cccttgagggctgcagt

SEQ ID NO: 2346161 - DNA, 19 bp, Homo sapiens
cccttgcctccccatttcc

SEQ ID NO: 2346162 - DNA, 19 bp, Homo sapiens
cccttggaaatgtctgctg

SEQ ID NO: 2346163 - DNA, 18 bp, Homo sapiens
cccttggcttctgtgatg

SEQ ID NO: 2346164 - DNA, 10 bp, Homo sapiens
cccttgtggg

SEQ ID NO: 2346165 - DNA, 18 bp, Homo sapiens
ccctttagatctctgaag

SEQ ID NO: 2346166 - DNA, 15 bp, Homo sapiens
ccctttcctgtccca

SEQ ID NO: 2346167 - DNA, 16 bp, Homo sapiens
ccctttctagaccaat

SEQ ID NO: 2346168 - DNA, 18 bp, Homo sapiens
ccctttgcacctgagacc

SEQ ID NO: 2346169 - DNA, 13 bp, Homo sapiens
cccttttctttga

SEQ ID NO: 2346170 - DNA, 20 bp, Homo sapiens
ccgactgaaaatattgtttt

SEQ ID NO: 2346171 - DNA, 18 bp, Homo sapiens
ccgagccacgcagtgcct

SEQ ID NO: 2346172 - DNA, 22 bp, Homo sapiens
ccgagctactctcttgccagca

SEQ ID NO: 2346173 - DNA, 20 bp, Homo sapiens
ccgaggcgggtggatcacga

SEQ ID NO: 2346174 - DNA, 16 bp, Homo sapiens
ccgaggggagggcagg

SEQ ID NO: 2346175 - DNA, 14 bp, Homo sapiens
ccgcacagctcagg

SEQ ID NO: 2346176 - DNA, 16 bp, Homo sapiens
ccgcacagctcaggag

SEQ ID NO: 2346177 - DNA, 15 bp, Homo sapiens
ccgcagagcccacgc

SEQ ID NO: 2346178 - DNA, 17 bp, Homo sapiens
ccgcagggccatgcaga

SEQ ID NO: 2346179 - DNA, 13 bp, Homo sapiens
ccgccagcctcct

SEQ ID NO: 2346180 - DNA, 23 bp, Homo sapiens
ccgccagcctcctctggacggca

SEQ ID NO: 2346181 - DNA, 16 bp, Homo sapiens
ccgcccctccacccat

SEQ ID NO: 2346182 - DNA, 21 bp, Homo sapiens
ccgccggaccgcgtagagagc

SEQ ID NO: 2346183 - DNA, 23 bp, Homo sapiens
ccgcctctcctcggttcaaggtc

SEQ ID NO: 2346184 - DNA, 16 bp, Homo sapiens
ccgcctctgcccgcag

SEQ ID NO: 2346185 - DNA, 17 bp, Homo sapiens
ccgcctggccaggagca

SEQ ID NO: 2346186 - DNA, 21 bp, Homo sapiens
ccgcctggccaggagcaggca

SEQ ID NO: 2346187 - DNA, 15 bp, Homo sapiens
ccgctggcccttaga

SEQ ID NO: 2346188 - DNA, 22 bp, Homo sapiens
ccgctggcccttagagaccccg

SEQ ID NO: 2346189 - DNA, 13 bp, Homo sapiens
ccgcttctcccca

SEQ ID NO: 2346190 - DNA, 23 bp, Homo sapiens
ccggacggacgttggttctgcac

SEQ ID NO: 2346191 - DNA, 12 bp, Homo sapiens
ccggactggtgc

SEQ ID NO: 2346192 - DNA, 13 bp, Homo sapiens
ccggatttctaac

SEQ ID NO: 2346193 - DNA, 22 bp, Homo sapiens
ccggatttctaacagtccttgc

SEQ ID NO: 2346194 - DNA, 14 bp, Homo sapiens
ccggcaagccacag

SEQ ID NO: 2346195 - DNA, 15 bp, Homo sapiens
ccggcaagccacagg

SEQ ID NO: 2346196 - DNA, 18 bp, Homo sapiens
ccggcccagatgtgtccc

SEQ ID NO: 2346197 - DNA, 17 bp, Homo sapiens
ccgggatattatagaaa

SEQ ID NO: 2346198 - DNA, 21 bp, Homo sapiens
ccgggcccctgggcttggcct

SEQ ID NO: 2346199 - DNA, 15 bp, Homo sapiens
ccgggctgagggcct

SEQ ID NO: 2346200 - DNA, 17 bp, Homo sapiens
ccggggccccactggct

SEQ ID NO: 2346201 - DNA, 15 bp, Homo sapiens
ccggtccagctggcc

SEQ ID NO: 2346202 - DNA, 14 bp, Homo sapiens
ccgtgaaagttgtg

SEQ ID NO: 2346203 - DNA, 14 bp, Homo sapiens
ccgtgcatcccccc

SEQ ID NO: 2346204 - DNA, 20 bp, Homo sapiens
ccgtgcatcccccctgctca

SEQ ID NO: 2346205 - DNA, 14 bp, Homo sapiens
ccgtgcctggccag

SEQ ID NO: 2346206 - DNA, 16 bp, Homo sapiens
ccgtgcctggccagat

SEQ ID NO: 2346207 - DNA, 23 bp, Homo sapiens
ccgtggaggaggaaggcaagagg

SEQ ID NO: 2346208 - DNA, 21 bp, Homo sapiens
ccgtggatggccgtggatgcg

SEQ ID NO: 2346209 - DNA, 16 bp, Homo sapiens
ccgtggtccctgagga

SEQ ID NO: 2346210 - DNA, 18 bp, Homo sapiens
ccgtgtcaagctgctctg

SEQ ID NO: 2346211 - DNA, 22 bp, Homo sapiens
ccgtgtgtcccagatgctgtca

SEQ ID NO: 2346212 - DNA, 12 bp, Homo sapiens
ccgttgtgagct

SEQ ID NO: 2346213 - DNA, 13 bp, Homo sapiens
ccgttgtgagctg

SEQ ID NO: 2346214 - DNA, 23 bp, Homo sapiens
cctaaaacgaatggtctttgctc

SEQ ID NO: 2346215 - DNA, 13 bp, Homo sapiens
cctaaaagcactc

SEQ ID NO: 2346216 - DNA, 13 bp, Homo sapiens
cctaaagagagta

SEQ ID NO: 2346217 - DNA, 18 bp, Homo sapiens
cctaacacagcatgtgta

SEQ ID NO: 2346218 - DNA, 16 bp, Homo sapiens
cctaaccccttccaga

SEQ ID NO: 2346219 - DNA, 13 bp, Homo sapiens
cctaaccctttgt

SEQ ID NO: 2346220 - DNA, 19 bp, Homo sapiens
cctaagatgtgttcttatt

SEQ ID NO: 2346221 - DNA, 12 bp, Homo sapiens
cctaagcctgtt

SEQ ID NO: 2346222 - DNA, 11 bp, Homo sapiens
cctaaggcatg

SEQ ID NO: 2346223 - DNA, 13 bp, Homo sapiens
cctaatctctgta

SEQ ID NO: 2346224 - DNA, 21 bp, Homo sapiens
cctaattaatatattaaaatt

SEQ ID NO: 2346225 - DNA, 14 bp, Homo sapiens
cctaattcctggca

SEQ ID NO: 2346226 - DNA, 14 bp, Homo sapiens
cctaatttctcctc

SEQ ID NO: 2346227 - DNA, 15 bp, Homo sapiens
cctacacccctgtgc

SEQ ID NO: 2346228 - DNA, 14 bp, Homo sapiens
cctaccctggactt

SEQ ID NO: 2346229 - DNA, 20 bp, Homo sapiens
cctactccctgcagatgcca

SEQ ID NO: 2346230 - DNA, 16 bp, Homo sapiens
cctacttagggaagaa

SEQ ID NO: 2346231 - DNA, 22 bp, Homo sapiens
cctacttagggaagaaaaagca

SEQ ID NO: 2346232 - DNA, 23 bp, Homo sapiens
cctacttagggaagaaaaagcaa

SEQ ID NO: 2346233 - DNA, 21 bp, Homo sapiens
cctactttgactttttgcatt

SEQ ID NO: 2346234 - DNA, 23 bp, Homo sapiens
cctagacaacctttctgtagcct

SEQ ID NO: 2346235 - DNA, 20 bp, Homo sapiens
cctagactctgtctacctgg

SEQ ID NO: 2346236 - DNA, 16 bp, Homo sapiens
cctagattcagggaaa

SEQ ID NO: 2346237 - DNA, 16 bp, Homo sapiens
cctagcaggctgttcc

SEQ ID NO: 2346238 - DNA, 21 bp, Homo sapiens
ctagatgattttttgaaagtt

SEQ ID NO: 2346239 - DNA, 14 bp, Homo sapiens
ctagattcagggaa

SEQ ID NO: 2346240 - DNA, 12 bp, Homo sapiens
ctagattgacta

SEQ ID NO: 2346241 - DNA, 17 bp, Homo sapiens
ctagcacaatttgcact

SEQ ID NO: 2346242 - DNA, 21 bp, Homo sapiens
ctagccagacaaaatttgaga

SEQ ID NO: 2346243 - DNA, 18 bp, Homo sapiens
ctagcccaatgaaatgaa

SEQ ID NO: 2346244 - DNA, 15 bp, Homo sapiens
ctagcccttccctga

SEQ ID NO: 2346245 - DNA, 17 bp, Homo sapiens
ctagcccttccctgagt

SEQ ID NO: 2346246 - DNA, 22 bp, Homo sapiens
ctagcctaaagtatacaactgc

SEQ ID NO: 2346247 - DNA, 23 bp, Homo sapiens
ctagcctaaagtatacaactgcc

SEQ ID NO: 2346248 - DNA, 13 bp, Homo sapiens
ctagctaaataaa

SEQ ID NO: 2346249 - DNA, 22 bp, Homo sapiens
ctagctctcccagtgaactcct

SEQ ID NO: 2346250 - DNA, 10 bp, Homo sapiens
ctagctctgg

SEQ ID NO: 2346251 - DNA, 12 bp, Homo sapiens
ctagctgccact

SEQ ID NO: 2346252 - DNA, 13 bp, Homo sapiens
ctagctgccactt

SEQ ID NO: 2346253 - DNA, 17 bp, Homo sapiens
ctagctgtcctttttcc

SEQ ID NO: 2346254 - DNA, 15 bp, Homo sapiens
ctagcttctgctttt

SEQ ID NO: 2346255 - DNA, 14 bp, Homo sapiens
ctaggcaggcaaga

SEQ ID NO: 2346256 - DNA, 23 bp, Homo sapiens
ctagtaacaatacatgagaaaga

SEQ ID NO: 2346257 - DNA, 14 bp, Homo sapiens
ctagtggtctttgt

SEQ ID NO: 2346258 - DNA, 19 bp, Homo sapiens
ctagtggtctttgtaagag

SEQ ID NO: 2346259 - DNA, 20 bp, Homo sapiens
ctagtggtctttgtaagagt

SEQ ID NO: 2346260 - DNA, 22 bp, Homo sapiens
ctagtggtctttgtaagagtgt

SEQ ID NO: 2346261 - DNA, 21 bp, Homo sapiens
ctagtgtttctagctaaataa

SEQ ID NO: 2346262 - DNA, 18 bp, Homo sapiens
ctagttaaagaaaggaaa

SEQ ID NO: 2346263 - DNA, 16 bp, Homo sapiens
ctagttctaacagtga

SEQ ID NO: 2346264 - DNA, 20 bp, Homo sapiens
ctagttctcaatcactgctc

SEQ ID NO: 2346265 - DNA, 20 bp, Homo sapiens
ctagtttgtgagaaacatct

SEQ ID NO: 2346266 - DNA, 15 bp, Homo sapiens
ctataaaactctgca

SEQ ID NO: 2346267 - DNA, 13 bp, Homo sapiens
ctataaaagccca

SEQ ID NO: 2346268 - DNA, 21 bp, Homo sapiens
ctataagatacaataaaacaa

SEQ ID NO: 2346269 - DNA, 19 bp, Homo sapiens
ctataagcttaaataggaa

SEQ ID NO: 2346270 - DNA, 13 bp, Homo sapiens
ctataaggtgcct

SEQ ID NO: 2346271 - DNA, 15 bp, Homo sapiens
ctatacacacacaca

SEQ ID NO: 2346272 - DNA, 19 bp, Homo sapiens
ctatactgcatacttttta

SEQ ID NO: 2346273 - DNA, 13 bp, Homo sapiens
ctatagtaaatgt

SEQ ID NO: 2346274 - DNA, 17 bp, Homo sapiens
ctatatatataaatgta

SEQ ID NO: 2346275 - DNA, 17 bp, Homo sapiens
ctatccccatctccctg

SEQ ID NO: 2346276 - DNA, 18 bp, Homo sapiens
ctatccccatctccctgc

SEQ ID NO: 2346277 - DNA, 19 bp, Homo sapiens
ctatccttggagagcagct

SEQ ID NO: 2346278 - DNA, 13 bp, Homo sapiens
ctatcctttcaaa

SEQ ID NO: 2346279 - DNA, 22 bp, Homo sapiens
ctatcgccctcctttcccttat

SEQ ID NO: 2346280 - DNA, 18 bp, Homo sapiens
ctatctagttctaacagt

SEQ ID NO: 2346281 - DNA, 12 bp, Homo sapiens
ctatctcatcta

SEQ ID NO: 2346282 - DNA, 15 bp, Homo sapiens
ctatctcctgacaga

SEQ ID NO: 2346283 - DNA, 15 bp, Homo sapiens
ctatgacaaattcaa

SEQ ID NO: 2346284 - DNA, 20 bp, Homo sapiens
ctatgcaaaaaattctttag

SEQ ID NO: 2346285 - DNA, 18 bp, Homo sapiens
ctatgcacatatggactc

SEQ ID NO: 2346286 - DNA, 21 bp, Homo sapiens
ctatgcacatatggactctgc

SEQ ID NO: 2346287 - DNA, 20 bp, Homo sapiens
ctatgccaagtccctggaaa

SEQ ID NO: 2346288 - DNA, 16 bp, Homo sapiens
ctatgcctctctacag

SEQ ID NO: 2346289 - DNA, 19 bp, Homo sapiens
ctatgcttaataaaagaac

SEQ ID NO: 2346290 - DNA, 20 bp, Homo sapiens
ctatggcaggataagaaagc

SEQ ID NO: 2346291 - DNA, 21 bp, Homo sapiens
ctatggcttatttctatgaca

SEQ ID NO: 2346292 - DNA, 19 bp, Homo sapiens
ctatgggtctaggacacag

SEQ ID NO: 2346293 - DNA, 15 bp, Homo sapiens
ctatggtgaggtgtg

SEQ ID NO: 2346294 - DNA, 15 bp, Homo sapiens
ctatgtctcatgttt

SEQ ID NO: 2346295 - DNA, 13 bp, Homo sapiens
ctattaaaaaagt

SEQ ID NO: 2346296 - DNA, 23 bp, Homo sapiens
ctattaaaaaagtctacaacata

SEQ ID NO: 2346297 - DNA, 20 bp, Homo sapiens
ctattaatatcaactctgaa

SEQ ID NO: 2346298 - DNA, 14 bp, Homo sapiens
ctattaatcaagag

SEQ ID NO: 2346299 - DNA, 18 bp, Homo sapiens
ctattagagtatttccct

SEQ ID NO: 2346300 - DNA, 20 bp, Homo sapiens
ctattagagtatttcccttc

SEQ ID NO: 2346301 - DNA, 16 bp, Homo sapiens
ctattagccaggatca

SEQ ID NO: 2346302 - DNA, 17 bp, Homo sapiens
ctattatggaaaactgt

SEQ ID NO: 2346303 - DNA, 16 bp, Homo sapiens
ctattatttttataat

SEQ ID NO: 2346304 - DNA, 18 bp, Homo sapiens
ctattatttttataattg

SEQ ID NO: 2346305 - DNA, 15 bp, Homo sapiens
ctattctagcctgca

SEQ ID NO: 2346306 - DNA, 23 bp, Homo sapiens
ctattctagcctgcattgagctt

SEQ ID NO: 2346307 - DNA, 22 bp, Homo sapiens
ctattctataaaactctgcatg

SEQ ID NO: 2346308 - DNA, 21 bp, Homo sapiens
ctattctatccatctcctggt

SEQ ID NO: 2346309 - DNA, 21 bp, Homo sapiens
ctattcttggaccatgccaga

SEQ ID NO: 2346310 - DNA, 23 bp, Homo sapiens
ctattcttggaccatgccagatt

SEQ ID NO: 2346311 - DNA, 20 bp, Homo sapiens
ctattgaattcggaactgtc

SEQ ID NO: 2346312 - DNA, 19 bp, Homo sapiens
ctattgtaatcgtgtgcca

SEQ ID NO: 2346313 - DNA, 14 bp, Homo sapiens
ctatttaacatttt

SEQ ID NO: 2346314 - DNA, 19 bp, Homo sapiens
ctatttaagtggactgtat

SEQ ID NO: 2346315 - DNA, 22 bp, Homo sapiens
ctatttaagtggactgtatttc

SEQ ID NO: 2346316 - DNA, 13 bp, Homo sapiens
ctatttattttcc

SEQ ID NO: 2346317 - DNA, 17 bp, Homo sapiens
ctatttattttcctaaa

SEQ ID NO: 2346318 - DNA, 21 bp, Homo sapiens
ctatttattttcctaaagaga

SEQ ID NO: 2346319 - DNA, 19 bp, Homo sapiens
ctatttgcaccttaaaaga

SEQ ID NO: 2346320 - DNA, 21 bp, Homo sapiens
ctatttgcaccttaaaagaca

SEQ ID NO: 2346321 - DNA, 23 bp, Homo sapiens
ctatttgccatgggcttcactgt

SEQ ID NO: 2346322 - DNA, 23 bp, Homo sapiens
ctatttgtggcaattttatgttt

SEQ ID NO: 2346323 - DNA, 16 bp, Homo sapiens
ctatttgtgtaactga

SEQ ID NO: 2346324 - DNA, 21 bp, Homo sapiens
ctattttccaggcttctgctg

SEQ ID NO: 2346325 - DNA, 14 bp, Homo sapiens
ctattttcctctgg

SEQ ID NO: 2346326 - DNA, 15 bp, Homo sapiens
ctattttctaaagac

SEQ ID NO: 2346327 - DNA, 21 bp, Homo sapiens
ctatttttgactgtagccaca

SEQ ID NO: 2346328 - DNA, 22 bp, Homo sapiens
ctatttttgactgtagccacag

SEQ ID NO: 2346329 - DNA, 18 bp, Homo sapiens
ctatttttggcagtctga

SEQ ID NO: 2346330 - DNA, 21 bp, Homo sapiens
ctatttttggcagtctgaatt

SEQ ID NO: 2346331 - DNA, 22 bp, Homo sapiens
ctatttttggcagtctgaattt

SEQ ID NO: 2346332 - DNA, 13 bp, Homo sapiens
ctatttttgtaaa

SEQ ID NO: 2346333 - DNA, 13 bp, Homo sapiens
ctatttttttaga

SEQ ID NO: 2346334 - DNA, 17 bp, Homo sapiens
ctatttttttagattga

SEQ ID NO: 2346335 - DNA, 13 bp, Homo sapiens
ctcaaaattagat

SEQ ID NO: 2346336 - DNA, 16 bp, Homo sapiens
ctcaaacgacagagga

SEQ ID NO: 2346337 - DNA, 19 bp, Homo sapiens
ctcaaactgaggaatttca

SEQ ID NO: 2346338 - DNA, 15 bp, Homo sapiens
ctcaaacttgtggcc

SEQ ID NO: 2346339 - DNA, 17 bp, Homo sapiens
ctcaaaggagctttctc

SEQ ID NO: 2346340 - DNA, 19 bp, Homo sapiens
ctcaaaggagctttctcaa

SEQ ID NO: 2346341 - DNA, 18 bp, Homo sapiens
ctcaaagttttgaaaagc

SEQ ID NO: 2346342 - DNA, 17 bp, Homo sapiens
ctcaaatacacatttgc

SEQ ID NO: 2346343 - DNA, 21 bp, Homo sapiens
ctcaaataggctattaaaaaa

SEQ ID NO: 2346344 - DNA, 21 bp, Homo sapiens
ctcaaccccaccatatgaatt

SEQ ID NO: 2346345 - DNA, 22 bp, Homo sapiens
ctcaacggaagccccctcttcc

SEQ ID NO: 2346346 - DNA, 17 bp, Homo sapiens
ctcaactcacctaatgt

SEQ ID NO: 2346347 - DNA, 15 bp, Homo sapiens
ctcaactgcctactc

SEQ ID NO: 2346348 - DNA, 23 bp, Homo sapiens
ctcaagacccccatttgtcccag

SEQ ID NO: 2346349 - DNA, 19 bp, Homo sapiens
ctcaagcaatccacctgcc

SEQ ID NO: 2346350 - DNA, 22 bp, Homo sapiens
ctcaagcaatcctcctgcctca

SEQ ID NO: 2346351 - DNA, 18 bp, Homo sapiens
ctcaagcgggtggctctg

SEQ ID NO: 2346352 - DNA, 19 bp, Homo sapiens
ctccacagcgagggcagct

SEQ ID NO: 2346353 - DNA, 13 bp, Homo sapiens
ctccacagtgttg

SEQ ID NO: 2346354 - DNA, 18 bp, Homo sapiens
ctccacagtgttgtgccc

SEQ ID NO: 2346355 - DNA, 20 bp, Homo sapiens
ctccacattaagtggctttt

SEQ ID NO: 2346356 - DNA, 21 bp, Homo sapiens
ctccacccataataagagaat

SEQ ID NO: 2346357 - DNA, 14 bp, Homo sapiens
ctccactctctacc

SEQ ID NO: 2346358 - DNA, 18 bp, Homo sapiens
ctccagataactctcttt

SEQ ID NO: 2346359 - DNA, 13 bp, Homo sapiens
ctccagattctga

SEQ ID NO: 2346360 - DNA, 15 bp, Homo sapiens
ctccagcaacttctt

SEQ ID NO: 2346361 - DNA, 11 bp, Homo sapiens
ctccagcctga

SEQ ID NO: 2346362 - DNA, 21 bp, Homo sapiens
ctccaggaaagagcagtcaga

SEQ ID NO: 2346363 - DNA, 22 bp, Homo sapiens
ctccaggaaagagcagtcagag

SEQ ID NO: 2346364 - DNA, 17 bp, Homo sapiens
ctccaggagcttcttgt

SEQ ID NO: 2346365 - DNA, 20 bp, Homo sapiens
ctccaggccctcctctccca

SEQ ID NO: 2346366 - DNA, 19 bp, Homo sapiens
ctccaggcctgcctcccac

SEQ ID NO: 2346367 - DNA, 20 bp, Homo sapiens
ctccaggcctgcctcccact

SEQ ID NO: 2346368 - DNA, 22 bp, Homo sapiens
ctccaggcctgcctcccacttc

SEQ ID NO: 2346369 - DNA, 17 bp, Homo sapiens
ctccaggctccagcaca

SEQ ID NO: 2346370 - DNA, 16 bp, Homo sapiens
ctccagggaatccaag

SEQ ID NO: 2346371 - DNA, 22 bp, Homo sapiens
ctccagggaatccaagcctcca

SEQ ID NO: 2346372 - DNA, 22 bp, Homo sapiens
ctccagggacacacagcctagc

SEQ ID NO: 2346373 - DNA, 22 bp, Homo sapiens
ctccagtcatctgtaagagctt

SEQ ID NO: 2346374 - DNA, 22 bp, Homo sapiens
ctccataaacatgaaaacactt

SEQ ID NO: 2346375 - DNA, 19 bp, Homo sapiens
ctccataaagtacaaatga

SEQ ID NO: 2346376 - DNA, 15 bp, Homo sapiens
ctccatccatccttc

SEQ ID NO: 2346377 - DNA, 16 bp, Homo sapiens
ctccatccatccttcc

SEQ ID NO: 2346378 - DNA, 23 bp, Homo sapiens
ctccatccccctttaccctcttt

SEQ ID NO: 2346379 - DNA, 13 bp, Homo sapiens
ctccatccctcta

SEQ ID NO: 2346380 - DNA, 15 bp, Homo sapiens
ctccatccctctaat

SEQ ID NO: 2346381 - DNA, 17 bp, Homo sapiens
ctccatctcccaaggct

SEQ ID NO: 2346382 - DNA, 23 bp, Homo sapiens
ctccatctcccaaggctgccaga

SEQ ID NO: 2346383 - DNA, 15 bp, Homo sapiens
ctccatggccctgtc

SEQ ID NO: 2346384 - DNA, 18 bp, Homo sapiens
ctccatggccctgtccca

SEQ ID NO: 2346385 - DNA, 19 bp, Homo sapiens
ctccatggccctgtcccag

SEQ ID NO: 2346386 - DNA, 20 bp, Homo sapiens
ctccattgggcacagtccag

SEQ ID NO: 2346387 - DNA, 21 bp, Homo sapiens
ctcccaaggttggagcccagg

SEQ ID NO: 2346388 - DNA, 23 bp, Homo sapiens
ctcccacatgggcccaggcctca

SEQ ID NO: 2346389 - DNA, 21 bp, Homo sapiens
ctcccaccctcttcctactgg

SEQ ID NO: 2346390 - DNA, 20 bp, Homo sapiens
ctcccaccctgcgggccagg

SEQ ID NO: 2346391 - DNA, 15 bp, Homo sapiens
ctcccacctcctgac

SEQ ID NO: 2346392 - DNA, 17 bp, Homo sapiens
ctcccactctcctaggc

SEQ ID NO: 2346393 - DNA, 17 bp, Homo sapiens
ctcccaggcaagcagct

SEQ ID NO: 2346394 - DNA, 16 bp, Homo sapiens
ctcccagggcctcctg

SEQ ID NO: 2346395 - DNA, 21 bp, Homo sapiens
ctcccaggggtctccctggct

SEQ ID NO: 2346396 - DNA, 22 bp, Homo sapiens
ctcccaggggtctccctggctc

SEQ ID NO: 2346397 - DNA, 19 bp, Homo sapiens
ctcccaggtaccagctgcg

SEQ ID NO: 2346398 - DNA, 24 bp, Homo sapiens
ctcccaggtaccagctgcgcttgc

SEQ ID NO: 2346399 - DNA, 20 bp, Homo sapiens
ctcccagtgaactcctgcca

SEQ ID NO: 2346400 - DNA, 22 bp, Homo sapiens
ctcccagtgaactcctgccagg

SEQ ID NO: 2346401 - DNA, 14 bp, Homo sapiens
ctcccatttcctga

SEQ ID NO: 2346402 - DNA, 20 bp, Homo sapiens
ctccccacagcgtccctggc

SEQ ID NO: 2346403 - DNA, 13 bp, Homo sapiens
ctccccagagctg

SEQ ID NO: 2346404 - DNA, 19 bp, Homo sapiens
ctccccatttcccatctgc

SEQ ID NO: 2346405 - DNA, 20 bp, Homo sapiens
ctccccatttcccatctgca

SEQ ID NO: 2346406 - DNA, 21 bp, Homo sapiens
ctccccatttcccatctgcac

SEQ ID NO: 2346407 - DNA, 22 bp, Homo sapiens
ctcccccagccatgccagctgg

SEQ ID NO: 2346408 - DNA, 22 bp, Homo sapiens
ctccccctagtttgtgagaaac

SEQ ID NO: 2346409 - DNA, 16 bp, Homo sapiens
ctccccctcctccagg

SEQ ID NO: 2346410 - DNA, 23 bp, Homo sapiens
ctcccctctcagaacatactgat

SEQ ID NO: 2346411 - DNA, 14 bp, Homo sapiens
ctcccctctgcttc

SEQ ID NO: 2346412 - DNA, 13 bp, Homo sapiens
ctcccctgccaca

SEQ ID NO: 2346413 - DNA, 16 bp, Homo sapiens
ctcccctgccacactg

SEQ ID NO: 2346414 - DNA, 15 bp, Homo sapiens
ctccctcaactgaag

SEQ ID NO: 2346415 - DNA, 13 bp, Homo sapiens
ctccctcccagga

SEQ ID NO: 2346416 - DNA, 14 bp, Homo sapiens
ctccctcccaggac

SEQ ID NO: 2346417 - DNA, 19 bp, Homo sapiens
ctccctcccctctcagaac

SEQ ID NO: 2346418 - DNA, 13 bp, Homo sapiens
ctccctccctctc

SEQ ID NO: 2346419 - DNA, 15 bp, Homo sapiens
ctccctcctccaggc

SEQ ID NO: 2346420 - DNA, 11 bp, Homo sapiens
ctccctctctc

SEQ ID NO: 2346421 - DNA, 16 bp, Homo sapiens
ctccctgcagatgcca

SEQ ID NO: 2346422 - DNA, 15 bp, Homo sapiens
ctccctgcctggccc

SEQ ID NO: 2346423 - DNA, 16 bp, Homo sapiens
ctccctggagaagcac

SEQ ID NO: 2346424 - DNA, 12 bp, Homo sapiens
ctccctggctcc

SEQ ID NO: 2346425 - DNA, 14 bp, Homo sapiens
ctccctggctccct

SEQ ID NO: 2346426 - DNA, 16 bp, Homo sapiens
ctccctgggacacaga

SEQ ID NO: 2346427 - DNA, 19 bp, Homo sapiens
ctccctgggacacagaccc

SEQ ID NO: 2346428 - DNA, 21 bp, Homo sapiens
ctcccttctctacactcttgt

SEQ ID NO: 2346429 - DNA, 21 bp, Homo sapiens
ctcccttgcctttcgaggcct

SEQ ID NO: 2346430 - DNA, 22 bp, Homo sapiens
ctcccttgcctttcgaggcctg

SEQ ID NO: 2346431 - DNA, 15 bp, Homo sapiens
ctcccttgctggccc

SEQ ID NO: 2346432 - DNA, 18 bp, Homo sapiens
ctcccttgctggccccag

SEQ ID NO: 2346433 - DNA, 16 bp, Homo sapiens
ctcccttgggctctga

SEQ ID NO: 2346434 - DNA, 18 bp, Homo sapiens
ctcccttgggctctgatg

SEQ ID NO: 2346435 - DNA, 23 bp, Homo sapiens
ctcccttgggctctgatgaaaaa

SEQ ID NO: 2346436 - DNA, 16 bp, Homo sapiens
ctccgagagggagaga

SEQ ID NO: 2346437 - DNA, 15 bp, Homo sapiens
ctccgcgccgatgcc

SEQ ID NO: 2346438 - DNA, 15 bp, Homo sapiens
ctccggactggtgcc

SEQ ID NO: 2346439 - DNA, 20 bp, Homo sapiens
ctcctaactgccagccccct

SEQ ID NO: 2346440 - DNA, 22 bp, Homo sapiens
ctcctaagcaactaggccttca

SEQ ID NO: 2346441 - DNA, 13 bp, Homo sapiens
ctcctaccttaat

SEQ ID NO: 2346442 - DNA, 18 bp, Homo sapiens
ctcctacttagggaagaa

SEQ ID NO: 2346443 - DNA, 21 bp, Homo sapiens
ctcctacttagggaagaaaaa

SEQ ID NO: 2346444 - DNA, 16 bp, Homo sapiens
ctcctagctctcccag

SEQ ID NO: 2346445 - DNA, 18 bp, Homo sapiens
ctcctagctctcccagtg

SEQ ID NO: 2346446 - DNA, 19 bp, Homo sapiens
ctcctaggcattctggacc

SEQ ID NO: 2346447 - DNA, 17 bp, Homo sapiens
ctcctcacctcatgccc

SEQ ID NO: 2346448 - DNA, 15 bp, Homo sapiens
ctcctccactccacc

SEQ ID NO: 2346449 - DNA, 17 bp, Homo sapiens
ctcctccactccacctc

SEQ ID NO: 2346450 - DNA, 19 bp, Homo sapiens
ctcctccaggcctgcctcc

SEQ ID NO: 2346451 - DNA, 14 bp, Homo sapiens
ctcctccagggaag

SEQ ID NO: 2346452 - DNA, 14 bp, Homo sapiens
ctcctcccagggcc

SEQ ID NO: 2346453 - DNA, 15 bp, Homo sapiens
ctcctcccttccttt

SEQ ID NO: 2346454 - DNA, 21 bp, Homo sapiens
ctcctcccttccttttccctg

SEQ ID NO: 2346455 - DNA, 22 bp, Homo sapiens
ctcctcccttccttttccctgc

SEQ ID NO: 2346456 - DNA, 14 bp, Homo sapiens
ctcctctcccccag

SEQ ID NO: 2346457 - DNA, 15 bp, Homo sapiens
ctcctctcccccagg

SEQ ID NO: 2346458 - DNA, 21 bp, Homo sapiens
ctcctctcctactcggctctg

SEQ ID NO: 2346459 - DNA, 18 bp, Homo sapiens
ctcctctgcctacagcca

SEQ ID NO: 2346460 - DNA, 11 bp, Homo sapiens
ctcctctgctg

SEQ ID NO: 2346461 - DNA, 19 bp, Homo sapiens
ctcctctgctgacctgctg

SEQ ID NO: 2346462 - DNA, 18 bp, Homo sapiens
ctcctctggctttcccag

SEQ ID NO: 2346463 - DNA, 20 bp, Homo sapiens
ctcctgaaccgcacagctca

SEQ ID NO: 2346464 - DNA, 17 bp, Homo sapiens
ctcctgacacccttctc

SEQ ID NO: 2346465 - DNA, 15 bp, Homo sapiens
ctcctgcagccccag

SEQ ID NO: 2346466 - DNA, 22 bp, Homo sapiens
cctctctctttcctccacccat

SEQ ID NO: 2346467 - DNA, 18 bp, Homo sapiens
cctctctgatgtcccagt

SEQ ID NO: 2346468 - DNA, 19 bp, Homo sapiens
cctctctgatgtcccagtg

SEQ ID NO: 2346469 - DNA, 22 bp, Homo sapiens
cctctctggaaagaggctctgg

SEQ ID NO: 2346470 - DNA, 19 bp, Homo sapiens
cctctgcacaccctccaga

SEQ ID NO: 2346471 - DNA, 20 bp, Homo sapiens
cctctgcacaccctccagag

SEQ ID NO: 2346472 - DNA, 15 bp, Homo sapiens
cctctgcccgcagag

SEQ ID NO: 2346473 - DNA, 19 bp, Homo sapiens
cctctgcccttcctgcagg

SEQ ID NO: 2346474 - DNA, 17 bp, Homo sapiens
cctctgcctacagccag

SEQ ID NO: 2346475 - DNA, 11 bp, Homo sapiens
cctctgcctgc

SEQ ID NO: 2346476 - DNA, 12 bp, Homo sapiens
cctctgcctgcc

SEQ ID NO: 2346477 - DNA, 16 bp, Homo sapiens
cctctggacggcaggc

SEQ ID NO: 2346478 - DNA, 15 bp, Homo sapiens
cctctggccgcagag

SEQ ID NO: 2346479 - DNA, 17 bp, Homo sapiens
cctctggctttcccagg

SEQ ID NO: 2346480 - DNA, 19 bp, Homo sapiens
cctctggctttcccaggag

SEQ ID NO: 2346481 - DNA, 19 bp, Homo sapiens
cctctgggcacgcctgctg

SEQ ID NO: 2346482 - DNA, 21 bp, Homo sapiens
cctctgtctaggactgcagtg

SEQ ID NO: 2346483 - DNA, 15 bp, Homo sapiens
cctcttcctccctgg

SEQ ID NO: 2346484 - DNA, 17 bp, Homo sapiens
cctcttcctccctgggg

SEQ ID NO: 2346485 - DNA, 13 bp, Homo sapiens
cctcttcctgtga

SEQ ID NO: 2346486 - DNA, 20 bp, Homo sapiens
cctcttctgtccctgttaga

SEQ ID NO: 2346487 - DNA, 12 bp, Homo sapiens
cctctttctgct

SEQ ID NO: 2346488 - DNA, 15 bp, Homo sapiens
cctctttctgctctg

SEQ ID NO: 2346489 - DNA, 19 bp, Homo sapiens
cctctttctgctctgccat

SEQ ID NO: 2346490 - DNA, 19 bp, Homo sapiens
cctgaaacgctcctttgtg

SEQ ID NO: 2346491 - DNA, 14 bp, Homo sapiens
cctgaacagaagct

SEQ ID NO: 2346492 - DNA, 20 bp, Homo sapiens
cctgaaccgcacagctcagg

SEQ ID NO: 2346493 - DNA, 16 bp, Homo sapiens
cctgaacgttttcttc

SEQ ID NO: 2346494 - DNA, 21 bp, Homo sapiens
cctgaacgttttcttctttcc

SEQ ID NO: 2346495 - DNA, 17 bp, Homo sapiens
cctgaatcatgagcctg

SEQ ID NO: 2346496 - DNA, 22 bp, Homo sapiens
cctgaatcatgagcctgctgga

SEQ ID NO: 2346497 - DNA, 21 bp, Homo sapiens
cctgaatccaaactaatccat

SEQ ID NO: 2346498 - DNA, 14 bp, Homo sapiens
cctgacacccttct

SEQ ID NO: 2346499 - DNA, 13 bp, Homo sapiens
cctgacactttaa

SEQ ID NO: 2346500 - DNA, 22 bp, Homo sapiens
cctgacccagggactctccaaa

SEQ ID NO: 2346501 - DNA, 17 bp, Homo sapiens
cctgacccctctcctca

SEQ ID NO: 2346502 - DNA, 21 bp, Homo sapiens
cctgaccctcctccactccac

SEQ ID NO: 2346503 - DNA, 18 bp, Homo sapiens
cctgactcctctggcttt

SEQ ID NO: 2346504 - DNA, 14 bp, Homo sapiens
cctgactgctcaga

SEQ ID NO: 2346505 - DNA, 23 bp, Homo sapiens
cctgagaagaagtggctgccaca

SEQ ID NO: 2346506 - DNA, 19 bp, Homo sapiens
cctgagaccctactgaagt

SEQ ID NO: 2346507 - DNA, 13 bp, Homo sapiens
cctgagacctcaa

SEQ ID NO: 2346508 - DNA, 13 bp, Homo sapiens
cctgagaggcagg

SEQ ID NO: 2346509 - DNA, 15 bp, Homo sapiens
cctgagaggcaggca

SEQ ID NO: 2346510 - DNA, 18 bp, Homo sapiens
cctgagaggcaggcatag

SEQ ID NO: 2346511 - DNA, 15 bp, Homo sapiens
cctgagagtcagctc

SEQ ID NO: 2346512 - DNA, 23 bp, Homo sapiens
cctgagagtcagctctctgccct

SEQ ID NO: 2346513 - DNA, 10 bp, Homo sapiens
cctgagcccc

SEQ ID NO: 2346514 - DNA, 19 bp, Homo sapiens
cctgagccctactccctgc

SEQ ID NO: 2346515 - DNA, 21 bp, Homo sapiens
cctgagccctactccctgcag

SEQ ID NO: 2346516 - DNA, 22 bp, Homo sapiens
cctgagccctactccctgcaga

SEQ ID NO: 2346517 - DNA, 21 bp, Homo sapiens
cctgagctattttcctctggc

SEQ ID NO: 2346518 - DNA, 19 bp, Homo sapiens
cctgaggatgggtcagagc

SEQ ID NO: 2346519 - DNA, 20 bp, Homo sapiens
cctgaggatgggtcagagct

SEQ ID NO: 2346520 - DNA, 15 bp, Homo sapiens
cctgaggccctgggc

SEQ ID NO: 2346521 - DNA, 19 bp, Homo sapiens
cctgaggtcatcggcgtgg

SEQ ID NO: 2346522 - DNA, 23 bp, Homo sapiens
cctgaggttaaacggtgcccatc

SEQ ID NO: 2346523 - DNA, 16 bp, Homo sapiens
cctgagtcagtgctct

SEQ ID NO: 2346524 - DNA, 21 bp, Homo sapiens
cctgattcttgattcctggct

SEQ ID NO: 2346525 - DNA, 16 bp, Homo sapiens
cctgcaaactgggaac

SEQ ID NO: 2346526 - DNA, 15 bp, Homo sapiens
cctgcaagatggaca

SEQ ID NO: 2346527 - DNA, 20 bp, Homo sapiens
cctgcacaataaaaatgttt

SEQ ID NO: 2346528 - DNA, 22 bp, Homo sapiens
cctgcacacagaatgctcaggg

SEQ ID NO: 2346529 - DNA, 14 bp, Homo sapiens
cctgcacacaggac

SEQ ID NO: 2346530 - DNA, 16 bp, Homo sapiens
cctgcacacaggacag

SEQ ID NO: 2346531 - DNA, 20 bp, Homo sapiens
cctgcacacaggacagcggg

SEQ ID NO: 2346532 - DNA, 13 bp, Homo sapiens
cctgcagatgcca

SEQ ID NO: 2346533 - DNA, 20 bp, Homo sapiens
cctgcagatgccaccctagc

SEQ ID NO: 2346534 - DNA, 23 bp, Homo sapiens
cctgcagcaggaatatatgtgtg

SEQ ID NO: 2346535 - DNA, 13 bp, Homo sapiens
cctgcagcccacc

SEQ ID NO: 2346536 - DNA, 18 bp, Homo sapiens
cctgcagcccaccagacg

SEQ ID NO: 2346537 - DNA, 18 bp, Homo sapiens
cctgccacagccagagga

SEQ ID NO: 2346538 - DNA, 19 bp, Homo sapiens
cctgccacagccagaggag

SEQ ID NO: 2346539 - DNA, 13 bp, Homo sapiens
cctgccaggcaca

SEQ ID NO: 2346540 - DNA, 21 bp, Homo sapiens
cctgccaggcacacacagccc

SEQ ID NO: 2346541 - DNA, 14 bp, Homo sapiens
cctgccaggcaggg

SEQ ID NO: 2346542 - DNA, 15 bp, Homo sapiens
cctgcccccagcccc

SEQ ID NO: 2346543 - DNA, 18 bp, Homo sapiens
cctgccccgcccccagtc

SEQ ID NO: 2346544 - DNA, 20 bp, Homo sapiens
cctgccccgcccccagtccc

SEQ ID NO: 2346545 - DNA, 14 bp, Homo sapiens
cctgccctcaaggg

SEQ ID NO: 2346546 - DNA, 12 bp, Homo sapiens
cctgccctcact

SEQ ID NO: 2346547 - DNA, 16 bp, Homo sapiens
cctgccctcactccct

SEQ ID NO: 2346548 - DNA, 12 bp, Homo sapiens
cctgccctgtcc

SEQ ID NO: 2346549 - DNA, 17 bp, Homo sapiens
cctgcccttccctctgg

SEQ ID NO: 2346550 - DNA, 16 bp, Homo sapiens
cctgccgggctgaggg

SEQ ID NO: 2346551 - DNA, 19 bp, Homo sapiens
cctgccgggctgagggcct

SEQ ID NO: 2346552 - DNA, 16 bp, Homo sapiens
cctgcctcagccttcc

SEQ ID NO: 2346553 - DNA, 21 bp, Homo sapiens
cctgcctcctggaggaccaga

SEQ ID NO: 2346554 - DNA, 20 bp, Homo sapiens
cctgcctctcatcaactgaa

SEQ ID NO: 2346555 - DNA, 12 bp, Homo sapiens
cctgcctgaggg

SEQ ID NO: 2346556 - DNA, 16 bp, Homo sapiens
cctgcctgagggcagt

SEQ ID NO: 2346557 - DNA, 15 bp, Homo sapiens
cctgcctggccccca

SEQ ID NO: 2346558 - DNA, 14 bp, Homo sapiens
cctgcctgtctgcc

SEQ ID NO: 2346559 - DNA, 11 bp, Homo sapiens
cctgccttggc

SEQ ID NO: 2346560 - DNA, 20 bp, Homo sapiens
cctgccttggcctcccaaag

SEQ ID NO: 2346561 - DNA, 17 bp, Homo sapiens
cctgcgccagtcctgct

SEQ ID NO: 2346562 - DNA, 18 bp, Homo sapiens
cctgcgcctgctgcctgc

SEQ ID NO: 2346563 - DNA, 13 bp, Homo sapiens
cctgcgggccagg

SEQ ID NO: 2346564 - DNA, 13 bp, Homo sapiens
ctcctgtcccctg

SEQ ID NO: 2346565 - DNA, 14 bp, Homo sapiens
ctcctgtccctgta

SEQ ID NO: 2346566 - DNA, 11 bp, Homo sapiens
ctcctgtgcct

SEQ ID NO: 2346567 - DNA, 17 bp, Homo sapiens
ctcctgtgcctggcccc

SEQ ID NO: 2346568 - DNA, 18 bp, Homo sapiens
ctcctgtgcctggcccca

SEQ ID NO: 2346569 - DNA, 23 bp, Homo sapiens
ctccttaagctgcagagatttct

SEQ ID NO: 2346570 - DNA, 19 bp, Homo sapiens
ctccttatttggcgtgacc

SEQ ID NO: 2346571 - DNA, 17 bp, Homo sapiens
ctccttcctggcctgag

SEQ ID NO: 2346572 - DNA, 14 bp, Homo sapiens
ctccttctgagctc

SEQ ID NO: 2346573 - DNA, 16 bp, Homo sapiens
ctccttctgagctcct

SEQ ID NO: 2346574 - DNA, 20 bp, Homo sapiens
ctccttgccccccgccctca

SEQ ID NO: 2346575 - DNA, 14 bp, Homo sapiens
ctccttggtgcctg

SEQ ID NO: 2346576 - DNA, 15 bp, Homo sapiens
ctccttggtgcctgg

SEQ ID NO: 2346577 - DNA, 15 bp, Homo sapiens
ctccttggtttgcta

SEQ ID NO: 2346578 - DNA, 16 bp, Homo sapiens
ctccttggtttgctag

SEQ ID NO: 2346579 - DNA, 13 bp, Homo sapiens
ctcctttccctta

SEQ ID NO: 2346580 - DNA, 15 bp, Homo sapiens
ctccttttcacttta

SEQ ID NO: 2346581 - DNA, 15 bp, Homo sapiens
ctcgagcaaaattca

SEQ ID NO: 2346582 - DNA, 16 bp, Homo sapiens
ctcgagcaaaattcaa

SEQ ID NO: 2346583 - DNA, 23 bp, Homo sapiens
ctcgcactacatctgatatcagg

SEQ ID NO: 2346584 - DNA, 23 bp, Homo sapiens
ctcgcatcctatgcttaataaaa

SEQ ID NO: 2346585 - DNA, 12 bp, Homo sapiens
ctcgccccaccc

SEQ ID NO: 2346586 - DNA, 17 bp, Homo sapiens
ctcgccggatctgaggg

SEQ ID NO: 2346587 - DNA, 18 bp, Homo sapiens
ctcgccggatctgaggga

SEQ ID NO: 2346588 - DNA, 18 bp, Homo sapiens
ctcgctcaccgctggccc

SEQ ID NO: 2346589 - DNA, 18 bp, Homo sapiens
ctcgctccctcccaggac

SEQ ID NO: 2346590 - DNA, 12 bp, Homo sapiens
ctcgctgagggc

SEQ ID NO: 2346591 - DNA, 21 bp, Homo sapiens
ctcgctgccatcaccgctggg

SEQ ID NO: 2346592 - DNA, 16 bp, Homo sapiens
ctcggaattcataata

SEQ ID NO: 2346593 - DNA, 21 bp, Homo sapiens
ctcggaattcataataaattt

SEQ ID NO: 2346594 - DNA, 18 bp, Homo sapiens
ctcggatagttgctattt

SEQ ID NO: 2346595 - DNA, 13 bp, Homo sapiens
ctcggctctgcag

SEQ ID NO: 2346596 - DNA, 17 bp, Homo sapiens
ctcggggtaaaaagtgg

SEQ ID NO: 2346597 - DNA, 17 bp, Homo sapiens
ctcgggtttctctgtgg

SEQ ID NO: 2346598 - DNA, 14 bp, Homo sapiens
ctcgtggctgtcaa

SEQ ID NO: 2346599 - DNA, 17 bp, Homo sapiens
ctcgtggtagaagccag

SEQ ID NO: 2346600 - DNA, 22 bp, Homo sapiens
ctctaatcagattgcttaaaag

SEQ ID NO: 2346601 - DNA, 15 bp, Homo sapiens
ctctacactcttgta

SEQ ID NO: 2346602 - DNA, 21 bp, Homo sapiens
ctctaccctgtctgtcccttt

SEQ ID NO: 2346603 - DNA, 12 bp, Homo sapiens
ctctaccttcct

SEQ ID NO: 2346604 - DNA, 18 bp, Homo sapiens
ctctacctttcttccttg

SEQ ID NO: 2346605 - DNA, 15 bp, Homo sapiens
ctctagatttattag

SEQ ID NO: 2346606 - DNA, 22 bp, Homo sapiens
ctctagtgacttcctggtgagg

SEQ ID NO: 2346607 - DNA, 22 bp, Homo sapiens
ctctataagcaaattgcttttt

SEQ ID NO: 2346608 - DNA, 18 bp, Homo sapiens
ctctcaagctagtgtttc

SEQ ID NO: 2346609 - DNA, 14 bp, Homo sapiens
ctctcacctctagg

SEQ ID NO: 2346610 - DNA, 15 bp, Homo sapiens
ctctcagctggcagt

SEQ ID NO: 2346611 - DNA, 20 bp, Homo sapiens
ctctcagctggcagtgcaat

SEQ ID NO: 2346612 - DNA, 17 bp, Homo sapiens
ctctcagtgccctccag

SEQ ID NO: 2346613 - DNA, 16 bp, Homo sapiens
ctctccaaccactgtg

SEQ ID NO: 2346614 - DNA, 22 bp, Homo sapiens
ctctccaaccactgtgccactg

SEQ ID NO: 2346615 - DNA, 13 bp, Homo sapiens
ctctccacagtgt

SEQ ID NO: 2346616 - DNA, 14 bp, Homo sapiens
ctctccacagtgtt

SEQ ID NO: 2346617 - DNA, 16 bp, Homo sapiens
ctctccatctcccaag

SEQ ID NO: 2346618 - DNA, 20 bp, Homo sapiens
ctctccatctcccaaggctg

SEQ ID NO: 2346619 - DNA, 12 bp, Homo sapiens
ctctccattctg

SEQ ID NO: 2346620 - DNA, 19 bp, Homo sapiens
ctctccattctgctccttc

SEQ ID NO: 2346621 - DNA, 20 bp, Homo sapiens
ctctccattctgctccttcc

SEQ ID NO: 2346622 - DNA, 13 bp, Homo sapiens
ctctcccagtgaa

SEQ ID NO: 2346623 - DNA, 17 bp, Homo sapiens
ctctcccagtgaactcc

SEQ ID NO: 2346624 - DNA, 14 bp, Homo sapiens
ctctcccatttcct

SEQ ID NO: 2346625 - DNA, 14 bp, Homo sapiens
ctctcccttgggct

SEQ ID NO: 2346626 - DNA, 16 bp, Homo sapiens
ctctcccttgggctct

SEQ ID NO: 2346627 - DNA, 21 bp, Homo sapiens
ctctcccttgggctctgatga

SEQ ID NO: 2346628 - DNA, 16 bp, Homo sapiens
ctctccggggccattt

SEQ ID NO: 2346629 - DNA, 19 bp, Homo sapiens
ctctcctactcggctctgc

SEQ ID NO: 2346630 - DNA, 21 bp, Homo sapiens
ctctcctaggcattctggacc

SEQ ID NO: 2346631 - DNA, 11 bp, Homo sapiens
ctctcctcccc

SEQ ID NO: 2346632 - DNA, 15 bp, Homo sapiens
ctctcctccccaaat

SEQ ID NO: 2346633 - DNA, 14 bp, Homo sapiens
ctctccttgagtgt

SEQ ID NO: 2346634 - DNA, 15 bp, Homo sapiens
ctctccttgcccccc

SEQ ID NO: 2346635 - DNA, 16 bp, Homo sapiens
ctctctacagtctcgt

SEQ ID NO: 2346636 - DNA, 18 bp, Homo sapiens
ctctctacagtctcgtct

SEQ ID NO: 2346637 - DNA, 19 bp, Homo sapiens
ctctctagaatgagcaaga

SEQ ID NO: 2346638 - DNA, 20 bp, Homo sapiens
ctctctcatgagaagccaag

SEQ ID NO: 2346639 - DNA, 20 bp, Homo sapiens
ctctctccctccctctctca

SEQ ID NO: 2346640 - DNA, 14 bp, Homo sapiens
ctctctctcttcta

SEQ ID NO: 2346641 - DNA, 14 bp, Homo sapiens
ctctctctgggtca

SEQ ID NO: 2346642 - DNA, 23 bp, Homo sapiens
ctctctgacgcttgtgacagtgc

SEQ ID NO: 2346643 - DNA, 19 bp, Homo sapiens
ctctctgatgtcccagtgc

SEQ ID NO: 2346644 - DNA, 11 bp, Homo sapiens
ctctctgccct

SEQ ID NO: 2346645 - DNA, 20 bp, Homo sapiens
ctctctggaaagaggctctg

SEQ ID NO: 2346646 - DNA, 21 bp, Homo sapiens
ctctctggaaagaggctctgg

SEQ ID NO: 2346647 - DNA, 16 bp, Homo sapiens
ctctcttctaggccca

SEQ ID NO: 2346648 - DNA, 11 bp, Homo sapiens
ctctctttcct

SEQ ID NO: 2346649 - DNA, 18 bp, Homo sapiens
ctctctttccttgagctg

SEQ ID NO: 2346650 - DNA, 21 bp, Homo sapiens
ctctctttccttgagctgttg

SEQ ID NO: 2346651 - DNA, 17 bp, Homo sapiens
ctctgaagccacaaata

SEQ ID NO: 2346652 - DNA, 17 bp, Homo sapiens
ctctgaatgctatttgt

SEQ ID NO: 2346653 - DNA, 17 bp, Homo sapiens
ctctgacgcttgtgaca

SEQ ID NO: 2346654 - DNA, 18 bp, Homo sapiens
ctctgacgcttgtgacag

SEQ ID NO: 2346655 - DNA, 16 bp, Homo sapiens
ctctgagccacagtgg

SEQ ID NO: 2346656 - DNA, 18 bp, Homo sapiens
ctctgagccacagtggga

SEQ ID NO: 2346657 - DNA, 22 bp, Homo sapiens
ctctgatgaaaaattgctgact

SEQ ID NO: 2346658 - DNA, 23 bp, Homo sapiens
ctctgatgaaaaattgctgactg

SEQ ID NO: 2346659 - DNA, 13 bp, Homo sapiens
ctctgatgtccca

SEQ ID NO: 2346660 - DNA, 20 bp, Homo sapiens
ctctgcaagcttcttgctga

SEQ ID NO: 2346661 - DNA, 22 bp, Homo sapiens
ctctgcaagcttcttgctgatc

SEQ ID NO: 2346662 - DNA, 20 bp, Homo sapiens
ctctgcacaccctccagaga

SEQ ID NO: 2346663 - DNA, 18 bp, Homo sapiens
ctctgcacatgtcttgta

SEQ ID NO: 2346664 - DNA, 19 bp, Homo sapiens
ctctgcccctcccccagcc

SEQ ID NO: 2346665 - DNA, 23 bp, Homo sapiens
ctctgcccctcccccagccatgc

SEQ ID NO: 2346666 - DNA, 20 bp, Homo sapiens
ctctgcccctggacctggga

SEQ ID NO: 2346667 - DNA, 13 bp, Homo sapiens
ctctgccctgtgt

SEQ ID NO: 2346668 - DNA, 14 bp, Homo sapiens
ctctgcctacagcc

SEQ ID NO: 2346669 - DNA, 14 bp, Homo sapiens
ctctgcctctccca

SEQ ID NO: 2346670 - DNA, 14 bp, Homo sapiens
ctctgcctttatga

SEQ ID NO: 2346671 - DNA, 23 bp, Homo sapiens
ctctgctatatgccttaagccaa

SEQ ID NO: 2346672 - DNA, 16 bp, Homo sapiens
ctctgctgacctgctg

SEQ ID NO: 2346673 - DNA, 19 bp, Homo sapiens
ctctggaaagaggctctgg

SEQ ID NO: 2346674 - DNA, 17 bp, Homo sapiens
ctctggaatgtttttcc

SEQ ID NO: 2346675 - DNA, 22 bp, Homo sapiens
ctctggacagcagaagcctcca

SEQ ID NO: 2346676 - DNA, 14 bp, Homo sapiens
ctctggacagccag

SEQ ID NO: 2346677 - DNA, 16 bp, Homo sapiens
ctctggacagccagtg

SEQ ID NO: 2346678 - DNA, 17 bp, Homo sapiens
ctctggacagccagtga

SEQ ID NO: 2346679 - DNA, 18 bp, Homo sapiens
ctctggcccagaaagcct

SEQ ID NO: 2346680 - DNA, 10 bp, Homo sapiens
ctctggcttt

SEQ ID NO: 2346681 - DNA, 14 bp, Homo sapiens
ctgagcaccctctg

SEQ ID NO: 2346682 - DNA, 16 bp, Homo sapiens
ctgagcaccctctgga

SEQ ID NO: 2346683 - DNA, 17 bp, Homo sapiens
ctgagcaccgtgtcaag

SEQ ID NO: 2346684 - DNA, 13 bp, Homo sapiens
ctgagcagcctct

SEQ ID NO: 2346685 - DNA, 17 bp, Homo sapiens
ctgagcagcctctggac

SEQ ID NO: 2346686 - DNA, 18 bp, Homo sapiens
ctgagcaggctgtggggt

SEQ ID NO: 2346687 - DNA, 23 bp, Homo sapiens
ctgagccctactccctgcagatg

SEQ ID NO: 2346688 - DNA, 21 bp, Homo sapiens
ctgagctatttcatctatttt

SEQ ID NO: 2346689 - DNA, 19 bp, Homo sapiens
ctgagctattttcctctgg

SEQ ID NO: 2346690 - DNA, 22 bp, Homo sapiens
ctgagctattttcctctggccg

SEQ ID NO: 2346691 - DNA, 24 bp, Homo sapiens
ctgagctattttcctctggccgca

SEQ ID NO: 2346692 - DNA, 12 bp, Homo sapiens
ctgagctcctgt

SEQ ID NO: 2346693 - DNA, 22 bp, Homo sapiens
ctgagctcctgtcccctgctac

SEQ ID NO: 2346694 - DNA, 12 bp, Homo sapiens
ctgagctgggct

SEQ ID NO: 2346695 - DNA, 12 bp, Homo sapiens
ctgaggccagag

SEQ ID NO: 2346696 - DNA, 14 bp, Homo sapiens
ctgaggccagagtc

SEQ ID NO: 2346697 - DNA, 14 bp, Homo sapiens
ctgaggcccagtgc

SEQ ID NO: 2346698 - DNA, 17 bp, Homo sapiens
ctgaggccctgggctgg

SEQ ID NO: 2346699 - DNA, 15 bp, Homo sapiens
ctgaggcctagactc

SEQ ID NO: 2346700 - DNA, 15 bp, Homo sapiens
ctgaggcggaggctg

SEQ ID NO: 2346701 - DNA, 19 bp, Homo sapiens
ctgaggcggaggctgtgct

SEQ ID NO: 2346702 - DNA, 23 bp, Homo sapiens
ctgaggcggaggctgtgctccgc

SEQ ID NO: 2346703 - DNA, 12 bp, Homo sapiens
ctgaggctgagg

SEQ ID NO: 2346704 - DNA, 20 bp, Homo sapiens
ctgaggctgggggagagccg

SEQ ID NO: 2346705 - DNA, 16 bp, Homo sapiens
ctgagggacaggatct

SEQ ID NO: 2346706 - DNA, 18 bp, Homo sapiens
ctgaggtgcactgggagg

SEQ ID NO: 2346707 - DNA, 19 bp, Homo sapiens
ctgaggttcctctgcctgc

SEQ ID NO: 2346708 - DNA, 21 bp, Homo sapiens
ctgaggttcctctgcctgccc

SEQ ID NO: 2346709 - DNA, 15 bp, Homo sapiens
ctgagtattttttat

SEQ ID NO: 2346710 - DNA, 22 bp, Homo sapiens
ctgagtcatctgttagggcctt

SEQ ID NO: 2346711 - DNA, 22 bp, Homo sapiens
ctgagtgcgggctgaggccaga

SEQ ID NO: 2346712 - DNA, 18 bp, Homo sapiens
ctgatatattttacaatt

SEQ ID NO: 2346713 - DNA, 20 bp, Homo sapiens
ctgatattatttcttctctt

SEQ ID NO: 2346714 - DNA, 22 bp, Homo sapiens
ctgatcattacatggctgtggt

SEQ ID NO: 2346715 - DNA, 12 bp, Homo sapiens
ctgatccccaac

SEQ ID NO: 2346716 - DNA, 21 bp, Homo sapiens
ctgatctccataaacatgaaa

SEQ ID NO: 2346717 - DNA, 12 bp, Homo sapiens
ctgatctgcgga

SEQ ID NO: 2346718 - DNA, 18 bp, Homo sapiens
ctgatcttttaaaatcat

SEQ ID NO: 2346719 - DNA, 15 bp, Homo sapiens
ctgatgctgggcaat

SEQ ID NO: 2346720 - DNA, 21 bp, Homo sapiens
ctgatggccttaatttccttt

SEQ ID NO: 2346721 - DNA, 16 bp, Homo sapiens
ctgatggtgctcacga

SEQ ID NO: 2346722 - DNA, 23 bp, Homo sapiens
ctgatggtgctcacgactcttcc

SEQ ID NO: 2346723 - DNA, 15 bp, Homo sapiens
ctgatgtcccagtgc

SEQ ID NO: 2346724 - DNA, 16 bp, Homo sapiens
ctgattcttgattcct

SEQ ID NO: 2346725 - DNA, 18 bp, Homo sapiens
ctgattcttgattcctgg

SEQ ID NO: 2346726 - DNA, 19 bp, Homo sapiens
ctgattcttgattcctggc

SEQ ID NO: 2346727 - DNA, 20 bp, Homo sapiens
ctgattcttgattcctggct

SEQ ID NO: 2346728 - DNA, 22 bp, Homo sapiens
ctgattcttgttgctgtacaaa

SEQ ID NO: 2346729 - DNA, 17 bp, Homo sapiens
ctgattgggaggtgcgt

SEQ ID NO: 2346730 - DNA, 22 bp, Homo sapiens
ctgatttactaacagtaactgc

SEQ ID NO: 2346731 - DNA, 15 bp, Homo sapiens
ctgattttttttcct

SEQ ID NO: 2346732 - DNA, 22 bp, Homo sapiens
ctgcaaaatacattattcttct

SEQ ID NO: 2346733 - DNA, 13 bp, Homo sapiens
ctgcaaactggga

SEQ ID NO: 2346734 - DNA, 14 bp, Homo sapiens
ctgcaaactgggaa

SEQ ID NO: 2346735 - DNA, 23 bp, Homo sapiens
ctgcaaactgggaacccctttcc

SEQ ID NO: 2346736 - DNA, 22 bp, Homo sapiens
ctgcaaagctttggctgagacc

SEQ ID NO: 2346737 - DNA, 13 bp, Homo sapiens
ctgcaagatggac

SEQ ID NO: 2346738 - DNA, 14 bp, Homo sapiens
ctgcaattccctgg

SEQ ID NO: 2346739 - DNA, 15 bp, Homo sapiens
ctgcacaataaaaat

SEQ ID NO: 2346740 - DNA, 22 bp, Homo sapiens
ctgcacaataaaaatgtttaac

SEQ ID NO: 2346741 - DNA, 19 bp, Homo sapiens
ctgcacacagaatgctcag

SEQ ID NO: 2346742 - DNA, 21 bp, Homo sapiens
ctgcacacagaatgctcaggg

SEQ ID NO: 2346743 - DNA, 22 bp, Homo sapiens
ctgcacacagaatgctcagggt

SEQ ID NO: 2346744 - DNA, 12 bp, Homo sapiens
ctgcacacagga

SEQ ID NO: 2346745 - DNA, 16 bp, Homo sapiens
ctgcacacaggacagc

SEQ ID NO: 2346746 - DNA, 20 bp, Homo sapiens
ctgcacacaggacagcggga

SEQ ID NO: 2346747 - DNA, 15 bp, Homo sapiens
ctgcacagagcaagt

SEQ ID NO: 2346748 - DNA, 22 bp, Homo sapiens
ctgcacagagcaagtcctcact

SEQ ID NO: 2346749 - DNA, 23 bp, Homo sapiens
ctgcacatgaatcccacccacat

SEQ ID NO: 2346750 - DNA, 19 bp, Homo sapiens
ctgcaccccttctctcctc

SEQ ID NO: 2346751 - DNA, 20 bp, Homo sapiens
ctgcaccccttctctcctcc

SEQ ID NO: 2346752 - DNA, 21 bp, Homo sapiens
ctgcaccccttctctcctccc

SEQ ID NO: 2346753 - DNA, 14 bp, Homo sapiens
ctgcactccagcct

SEQ ID NO: 2346754 - DNA, 12 bp, Homo sapiens
ctgcagaaccca

SEQ ID NO: 2346755 - DNA, 17 bp, Homo sapiens
ctgcagacctcaagcca

SEQ ID NO: 2346756 - DNA, 19 bp, Homo sapiens
ctgcagacctcaagccatc

SEQ ID NO: 2346757 - DNA, 22 bp, Homo sapiens
ctgcagagaaacttaagcaaag

SEQ ID NO: 2346758 - DNA, 23 bp, Homo sapiens
ctgcagagaaacttaagcaaagg

SEQ ID NO: 2346759 - DNA, 23 bp, Homo sapiens
ctgcagagatttctcattgactt

SEQ ID NO: 2346760 - DNA, 19 bp, Homo sapiens
ctgcagcccaccagacgtc

SEQ ID NO: 2346761 - DNA, 23 bp, Homo sapiens
ctgcagcctcatactcctgggct

SEQ ID NO: 2346762 - DNA, 16 bp, Homo sapiens
ctgcaggcagagctgg

SEQ ID NO: 2346763 - DNA, 14 bp, Homo sapiens
ctgcagggcttctc

SEQ ID NO: 2346764 - DNA, 16 bp, Homo sapiens
ctgcagggcttctcct

SEQ ID NO: 2346765 - DNA, 21 bp, Homo sapiens
ctgcagtcatctcccctcctg

SEQ ID NO: 2346766 - DNA, 23 bp, Homo sapiens
ctgcagtcatctcccctcctggc

SEQ ID NO: 2346767 - DNA, 16 bp, Homo sapiens
ctgcagtgtggagttc

SEQ ID NO: 2346768 - DNA, 18 bp, Homo sapiens
ctgcagttctactcaggc

SEQ ID NO: 2346769 - DNA, 15 bp, Homo sapiens
ctgcagttttgctat

SEQ ID NO: 2346770 - DNA, 16 bp, Homo sapiens
ctgcagttttgctatc

SEQ ID NO: 2346771 - DNA, 22 bp, Homo sapiens
ctgcataaaaaggtctttaaaa

SEQ ID NO: 2346772 - DNA, 13 bp, Homo sapiens
ctgcatccagcct

SEQ ID NO: 2346773 - DNA, 18 bp, Homo sapiens
ctgcatctggggcccata

SEQ ID NO: 2346774 - DNA, 20 bp, Homo sapiens
ctgcatgtagaggcttgttt

SEQ ID NO: 2346775 - DNA, 17 bp, Homo sapiens
ctgcatttcctcgcagc

SEQ ID NO: 2346776 - DNA, 19 bp, Homo sapiens
ctgcatttcctcgcagcct

SEQ ID NO: 2346777 - DNA, 12 bp, Homo sapiens
ctgccaaacaca

SEQ ID NO: 2346778 - DNA, 14 bp, Homo sapiens
gcactgcccacatg

SEQ ID NO: 2346779 - DNA, 15 bp, Homo sapiens
gcactgggaggcagg

SEQ ID NO: 2346780 - DNA, 13 bp, Homo sapiens
gcacttacaattt

SEQ ID NO: 2346781 - DNA, 18 bp, Homo sapiens
gcacttattgaatatatg

SEQ ID NO: 2346782 - DNA, 20 bp, Homo sapiens
gcacttattgaatatatgat

SEQ ID NO: 2346783 - DNA, 18 bp, Homo sapiens
gcacttattgaccatttt

SEQ ID NO: 2346784 - DNA, 15 bp, Homo sapiens
gcacttgttatatta

SEQ ID NO: 2346785 - DNA, 16 bp, Homo sapiens
gcagaaatagacaaaa

SEQ ID NO: 2346786 - DNA, 18 bp, Homo sapiens
gcagaacctgcacacagg

SEQ ID NO: 2346787 - DNA, 21 bp, Homo sapiens
gcagaacctgcacacaggaca

SEQ ID NO: 2346788 - DNA, 23 bp, Homo sapiens
gcagaacctgcacacaggacagc

SEQ ID NO: 2346789 - DNA, 15 bp, Homo sapiens
gcagaagacaccaga

SEQ ID NO: 2346790 - DNA, 21 bp, Homo sapiens
gcagaagacaccagagcagat

SEQ ID NO: 2346791 - DNA, 14 bp, Homo sapiens
gcagaagtctggct

SEQ ID NO: 2346792 - DNA, 12 bp, Homo sapiens
gcagacctcaag

SEQ ID NO: 2346793 - DNA, 21 bp, Homo sapiens
gcagacctcatgcccagctct

SEQ ID NO: 2346794 - DNA, 20 bp, Homo sapiens
gcagactggggcatcctgtg

SEQ ID NO: 2346795 - DNA, 15 bp, Homo sapiens
gcagagagccatttt

SEQ ID NO: 2346796 - DNA, 19 bp, Homo sapiens
gcagagagccattttgtga

SEQ ID NO: 2346797 - DNA, 16 bp, Homo sapiens
gcagagatttctcatt

SEQ ID NO: 2346798 - DNA, 23 bp, Homo sapiens
gcagagatttctcattgactttt

SEQ ID NO: 2346799 - DNA, 16 bp, Homo sapiens
gcagagccttctcaga

SEQ ID NO: 2346800 - DNA, 13 bp, Homo sapiens
gcagagctggagc

SEQ ID NO: 2346801 - DNA, 14 bp, Homo sapiens
gcagagctggagcc

SEQ ID NO: 2346802 - DNA, 22 bp, Homo sapiens
gcagagctggagcccccagcag

SEQ ID NO: 2346803 - DNA, 20 bp, Homo sapiens
gcagaggacgcacgctcgct

SEQ ID NO: 2346804 - DNA, 24 bp, Homo sapiens
gcagaggacgcacgctcgctgcca

SEQ ID NO: 2346805 - DNA, 13 bp, Homo sapiens
gcagagttaaatc

SEQ ID NO: 2346806 - DNA, 17 bp, Homo sapiens
gcagatgcagagagcca

SEQ ID NO: 2346807 - DNA, 16 bp, Homo sapiens
gcagatgtcttccctg

SEQ ID NO: 2346808 - DNA, 17 bp, Homo sapiens
gcagatgtcttccctgg

SEQ ID NO: 2346809 - DNA, 15 bp, Homo sapiens
gcagatgtgagccac

SEQ ID NO: 2346810 - DNA, 17 bp, Homo sapiens
gcagatgtgagccaccg

SEQ ID NO: 2346811 - DNA, 16 bp, Homo sapiens
gcagatgtttgcctca

SEQ ID NO: 2346812 - DNA, 13 bp, Homo sapiens
gcagcaccacact

SEQ ID NO: 2346813 - DNA, 15 bp, Homo sapiens
gcagcaccacactgg

SEQ ID NO: 2346814 - DNA, 15 bp, Homo sapiens
gcagcagcaggtgat

SEQ ID NO: 2346815 - DNA, 21 bp, Homo sapiens
gcagcagcccaagcttccctc

SEQ ID NO: 2346816 - DNA, 19 bp, Homo sapiens
gcagcatcttcacttctaa

SEQ ID NO: 2346817 - DNA, 18 bp, Homo sapiens
gcagcccagagactttgt

SEQ ID NO: 2346818 - DNA, 22 bp, Homo sapiens
gcagcccagagactttgtagat

SEQ ID NO: 2346819 - DNA, 13 bp, Homo sapiens
gcagcccagcagt

SEQ ID NO: 2346820 - DNA, 14 bp, Homo sapiens
gcagcccttccaaa

SEQ ID NO: 2346821 - DNA, 12 bp, Homo sapiens
gcagcctccttt

SEQ ID NO: 2346822 - DNA, 22 bp, Homo sapiens
gcagcctctcagtgccctccag

SEQ ID NO: 2346823 - DNA, 12 bp, Homo sapiens
gcagcctctgga

SEQ ID NO: 2346824 - DNA, 21 bp, Homo sapiens
gcagcctctggacagccagtg

SEQ ID NO: 2346825 - DNA, 13 bp, Homo sapiens
gcagctccctcct

SEQ ID NO: 2346826 - DNA, 14 bp, Homo sapiens
gcagctccctcctg

SEQ ID NO: 2346827 - DNA, 22 bp, Homo sapiens
gcagctctccgccaatttctct

SEQ ID NO: 2346828 - DNA, 22 bp, Homo sapiens
gcagctgctatttattttccta

SEQ ID NO: 2346829 - DNA, 21 bp, Homo sapiens
gcagctggtcagtctttgctc

SEQ ID NO: 2346830 - DNA, 23 bp, Homo sapiens
gcagctggtcagtctttgctcag

SEQ ID NO: 2346831 - DNA, 15 bp, Homo sapiens
gcagctgtgcattga

SEQ ID NO: 2346832 - DNA, 17 bp, Homo sapiens
gcagcttctaagagcga

SEQ ID NO: 2346833 - DNA, 16 bp, Homo sapiens
gcaggaagggaagcgt

SEQ ID NO: 2346834 - DNA, 15 bp, Homo sapiens
gcaggatggactggc

SEQ ID NO: 2346835 - DNA, 21 bp, Homo sapiens
gcaggatggcctttccttccc

SEQ ID NO: 2346836 - DNA, 15 bp, Homo sapiens
gcaggattcccttct

SEQ ID NO: 2346837 - DNA, 18 bp, Homo sapiens
gcaggattcccttctggg

SEQ ID NO: 2346838 - DNA, 23 bp, Homo sapiens
gcaggcaagagaattgaaatgag

SEQ ID NO: 2346839 - DNA, 18 bp, Homo sapiens
gcaggcaggaacaaacag

SEQ ID NO: 2346840 - DNA, 12 bp, Homo sapiens
gcaggcatgccg

SEQ ID NO: 2346841 - DNA, 21 bp, Homo sapiens
gcaggccacctggctctcacc

SEQ ID NO: 2346842 - DNA, 17 bp, Homo sapiens
gcaggctcactgccagg

SEQ ID NO: 2346843 - DNA, 10 bp, Homo sapiens
gcaggctggg

SEQ ID NO: 2346844 - DNA, 12 bp, Homo sapiens
gcaggctgggcc

SEQ ID NO: 2346845 - DNA, 13 bp, Homo sapiens
gcagggcttctcc

SEQ ID NO: 2346846 - DNA, 14 bp, Homo sapiens
gcagggcttctcct

SEQ ID NO: 2346847 - DNA, 23 bp, Homo sapiens
gcaggggtgggggtggaggcttc

SEQ ID NO: 2346848 - DNA, 19 bp, Homo sapiens
gcagggtctgggctgggca

SEQ ID NO: 2346849 - DNA, 21 bp, Homo sapiens
gcagggtctgggctgggcacc

SEQ ID NO: 2346850 - DNA, 19 bp, Homo sapiens
gcagggttcaagccttcca

SEQ ID NO: 2346851 - DNA, 18 bp, Homo sapiens
gcaggtgattggaccagg

SEQ ID NO: 2346852 - DNA, 17 bp, Homo sapiens
gcagtagaactccaggc

SEQ ID NO: 2346853 - DNA, 23 bp, Homo sapiens
gcagtcagcagatgctgttgtga

SEQ ID NO: 2346854 - DNA, 20 bp, Homo sapiens
gcagtctgcccacgcagagg

SEQ ID NO: 2346855 - DNA, 14 bp, Homo sapiens
gcagtgccccaggg

SEQ ID NO: 2346856 - DNA, 21 bp, Homo sapiens
gcagtgccccagggagtccag

SEQ ID NO: 2346857 - DNA, 14 bp, Homo sapiens
gcagtgcctggagt

SEQ ID NO: 2346858 - DNA, 13 bp, Homo sapiens
gcagtgccttgca

SEQ ID NO: 2346859 - DNA, 22 bp, Homo sapiens
gcagtgtggagaccctgccaca

SEQ ID NO: 2346860 - DNA, 19 bp, Homo sapiens
gcagttggccaagcagaaa

SEQ ID NO: 2346861 - DNA, 15 bp, Homo sapiens
gcagttttccaggaa

SEQ ID NO: 2346862 - DNA, 16 bp, Homo sapiens
gcataaagtaaataca

SEQ ID NO: 2346863 - DNA, 14 bp, Homo sapiens
gcataataagctaa

SEQ ID NO: 2346864 - DNA, 18 bp, Homo sapiens
gcataataagctaaagag

SEQ ID NO: 2346865 - DNA, 17 bp, Homo sapiens
gcataatgataaaataa

SEQ ID NO: 2346866 - DNA, 22 bp, Homo sapiens
gcataatgataaaataaataat

SEQ ID NO: 2346867 - DNA, 19 bp, Homo sapiens
gcataatttaaaaatatat

SEQ ID NO: 2346868 - DNA, 16 bp, Homo sapiens
gcatacacacagcagt

SEQ ID NO: 2346869 - DNA, 18 bp, Homo sapiens
gcatactttgtattttga

SEQ ID NO: 2346870 - DNA, 17 bp, Homo sapiens
gcataggtctctttgct

SEQ ID NO: 2346871 - DNA, 15 bp, Homo sapiens
gcatagtttctttat

SEQ ID NO: 2346872 - DNA, 18 bp, Homo sapiens
gcatataatgaataaatc

SEQ ID NO: 2346873 - DNA, 19 bp, Homo sapiens
gcatataatgaataaatca

SEQ ID NO: 2346874 - DNA, 23 bp, Homo sapiens
gcatatgagcctgccctcactcc

SEQ ID NO: 2346875 - DNA, 18 bp, Homo sapiens
gcatatggtcctagacaa

SEQ ID NO: 2346876 - DNA, 16 bp, Homo sapiens
gcatcaagggctttat

SEQ ID NO: 2346877 - DNA, 11 bp, Homo sapiens
gcatccagcct

SEQ ID NO: 2346878 - DNA, 18 bp, Homo sapiens
gcatcctatgcttaataa

SEQ ID NO: 2346879 - DNA, 23 bp, Homo sapiens
gcatctcttccccagagaggcac

SEQ ID NO: 2346880 - DNA, 14 bp, Homo sapiens
gcatgacagcctgc

SEQ ID NO: 2346881 - DNA, 16 bp, Homo sapiens
gcatgacagcctgcag

SEQ ID NO: 2346882 - DNA, 18 bp, Homo sapiens
gcatgacagcctgcagca

SEQ ID NO: 2346883 - DNA, 21 bp, Homo sapiens
gcatgacatcctttcttttaa

SEQ ID NO: 2346884 - DNA, 16 bp, Homo sapiens
gcatgcaaatgagctc

SEQ ID NO: 2346885 - DNA, 18 bp, Homo sapiens
gcatgcaaatgagctctg

SEQ ID NO: 2346886 - DNA, 21 bp, Homo sapiens
gcatgcaaatgagctctgaaa

SEQ ID NO: 2346887 - DNA, 15 bp, Homo sapiens
gcatgcttcctttct

SEQ ID NO: 2346888 - DNA, 23 bp, Homo sapiens
gcatgcttcctttctctcctggc

SEQ ID NO: 2346889 - DNA, 14 bp, Homo sapiens
gcatgtatgaatgt

SEQ ID NO: 2346890 - DNA, 15 bp, Homo sapiens
gcatgtatgtcttgg

SEQ ID NO: 2346891 - DNA, 20 bp, Homo sapiens
gcatgtggcctttatctcaa

SEQ ID NO: 2346892 - DNA, 13 bp, Homo sapiens
gcatgttcctcct

SEQ ID NO: 2346893 - DNA, 21 bp, Homo sapiens
gcattagagtcaactacacaa

SEQ ID NO: 2346894 - DNA, 19 bp, Homo sapiens
gcattcatttttatagcaa

SEQ ID NO: 2346895 - DNA, 14 bp, Homo sapiens
ctgccccacggaga

SEQ ID NO: 2346896 - DNA, 15 bp, Homo sapiens
ctgcccccaccccgg

SEQ ID NO: 2346897 - DNA, 14 bp, Homo sapiens
ctgccccgccccca

SEQ ID NO: 2346898 - DNA, 16 bp, Homo sapiens
ctgccccgcccccagt

SEQ ID NO: 2346899 - DNA, 23 bp, Homo sapiens
ctgccccgcccccagtccccacc

SEQ ID NO: 2346900 - DNA, 21 bp, Homo sapiens
ctgcccctaccctggacttgc

SEQ ID NO: 2346901 - DNA, 13 bp, Homo sapiens
ctgcccctcacaa

SEQ ID NO: 2346902 - DNA, 14 bp, Homo sapiens
ctgcccctggacct

SEQ ID NO: 2346903 - DNA, 14 bp, Homo sapiens
ctgcccgcagagcc

SEQ ID NO: 2346904 - DNA, 17 bp, Homo sapiens
ctgccctatgggcctgc

SEQ ID NO: 2346905 - DNA, 12 bp, Homo sapiens
ctgccctcactc

SEQ ID NO: 2346906 - DNA, 17 bp, Homo sapiens
ctgccctgcacgtcatg

SEQ ID NO: 2346907 - DNA, 12 bp, Homo sapiens
ctgccctggctg

SEQ ID NO: 2346908 - DNA, 16 bp, Homo sapiens
ctgccctggctgctgc

SEQ ID NO: 2346909 - DNA, 18 bp, Homo sapiens
ctgccctggctgctgccc

SEQ ID NO: 2346910 - DNA, 20 bp, Homo sapiens
ctgccctggctgctgccccc

SEQ ID NO: 2346911 - DNA, 11 bp, Homo sapiens
ctgccctgtgg

SEQ ID NO: 2346912 - DNA, 13 bp, Homo sapiens
ctgccctgtgtac

SEQ ID NO: 2346913 - DNA, 15 bp, Homo sapiens
ctgcccttccctctg

SEQ ID NO: 2346914 - DNA, 18 bp, Homo sapiens
ctgccgccccctcctgaa

SEQ ID NO: 2346915 - DNA, 21 bp, Homo sapiens
ctgccggacccggaggccgag

SEQ ID NO: 2346916 - DNA, 19 bp, Homo sapiens
ctgccgggctgagggcctg

SEQ ID NO: 2346917 - DNA, 21 bp, Homo sapiens
ctgccgggctgagggcctgct

SEQ ID NO: 2346918 - DNA, 15 bp, Homo sapiens
ctgcctagattcagg

SEQ ID NO: 2346919 - DNA, 19 bp, Homo sapiens
ctgcctagattcagggaaa

SEQ ID NO: 2346920 - DNA, 22 bp, Homo sapiens
ctgcctcagacgttgcctgaga

SEQ ID NO: 2346921 - DNA, 17 bp, Homo sapiens
ctgcctcagccttccaa

SEQ ID NO: 2346922 - DNA, 15 bp, Homo sapiens
ctgcctcccacttca

SEQ ID NO: 2346923 - DNA, 14 bp, Homo sapiens
ctgcctcgctcacc

SEQ ID NO: 2346924 - DNA, 18 bp, Homo sapiens
ctgcctctcccaggctgt

SEQ ID NO: 2346925 - DNA, 12 bp, Homo sapiens
ctgcctctctgg

SEQ ID NO: 2346926 - DNA, 14 bp, Homo sapiens
ctgcctctttccct

SEQ ID NO: 2346927 - DNA, 20 bp, Homo sapiens
ctgcctggagacaaggtgct

SEQ ID NO: 2346928 - DNA, 15 bp, Homo sapiens
ctgcctggcccccaa

SEQ ID NO: 2346929 - DNA, 13 bp, Homo sapiens
ctgcctgggaagg

SEQ ID NO: 2346930 - DNA, 20 bp, Homo sapiens
ctgcctggtatatccaaaag

SEQ ID NO: 2346931 - DNA, 12 bp, Homo sapiens
ctgcctgtctgc

SEQ ID NO: 2346932 - DNA, 18 bp, Homo sapiens
ctgcctgtgcatgacctg

SEQ ID NO: 2346933 - DNA, 19 bp, Homo sapiens
ctgcctgtgcatgacctga

SEQ ID NO: 2346934 - DNA, 13 bp, Homo sapiens
ctgcctgtgggct

SEQ ID NO: 2346935 - DNA, 17 bp, Homo sapiens
ctgccttaaaaccaaag

SEQ ID NO: 2346936 - DNA, 22 bp, Homo sapiens
ctgccttaaaaccaaagagggc

SEQ ID NO: 2346937 - DNA, 18 bp, Homo sapiens
ctgccttgcctcctcagt

SEQ ID NO: 2346938 - DNA, 16 bp, Homo sapiens
ctgccttgcttctgta

SEQ ID NO: 2346939 - DNA, 23 bp, Homo sapiens
ctgccttgcttctgtatttcctt

SEQ ID NO: 2346940 - DNA, 22 bp, Homo sapiens
ctgcgaagaccctcttgcccat

SEQ ID NO: 2346941 - DNA, 16 bp, Homo sapiens
ctgcgcctgcaggcag

SEQ ID NO: 2346942 - DNA, 17 bp, Homo sapiens
ctgcgcctgcaggcaga

SEQ ID NO: 2346943 - DNA, 17 bp, Homo sapiens
ctgcgcctgctgcctgc

SEQ ID NO: 2346944 - DNA, 18 bp, Homo sapiens
ctgcgctctctttgcaac

SEQ ID NO: 2346945 - DNA, 13 bp, Homo sapiens
ctgcgcttgcttt

SEQ ID NO: 2346946 - DNA, 17 bp, Homo sapiens
ctgcgcttgcttttctg

SEQ ID NO: 2346947 - DNA, 20 bp, Homo sapiens
ctgcgtcagaccagtactgg

SEQ ID NO: 2346948 - DNA, 18 bp, Homo sapiens
ctgcgtcctcctcacctc

SEQ ID NO: 2346949 - DNA, 15 bp, Homo sapiens
ctgcgttctgcaagc

SEQ ID NO: 2346950 - DNA, 18 bp, Homo sapiens
ctgctacctcccttgcct

SEQ ID NO: 2346951 - DNA, 19 bp, Homo sapiens
ctgctacctcccttgcctt

SEQ ID NO: 2346952 - DNA, 20 bp, Homo sapiens
ctgctatatgccttaagcca

SEQ ID NO: 2346953 - DNA, 17 bp, Homo sapiens
ctgctatttattttcct

SEQ ID NO: 2346954 - DNA, 19 bp, Homo sapiens
ctgctcacccacctcttgt

SEQ ID NO: 2346955 - DNA, 23 bp, Homo sapiens
ctgctcaccgcccatcagggttc

SEQ ID NO: 2346956 - DNA, 18 bp, Homo sapiens
ctgctcagtaaagcactt

SEQ ID NO: 2346957 - DNA, 13 bp, Homo sapiens
ctgctcatccact

SEQ ID NO: 2346958 - DNA, 21 bp, Homo sapiens
ctgctcattacagttctttcc

SEQ ID NO: 2346959 - DNA, 22 bp, Homo sapiens
ctgctcattacagttctttcct

SEQ ID NO: 2346960 - DNA, 16 bp, Homo sapiens
ctgctcccacctcctg

SEQ ID NO: 2346961 - DNA, 17 bp, Homo sapiens
ctgctcccacctcctga

SEQ ID NO: 2346962 - DNA, 17 bp, Homo sapiens
ctgctctcctcttctac

SEQ ID NO: 2346963 - DNA, 18 bp, Homo sapiens
ctgctctgccatcttcag

SEQ ID NO: 2346964 - DNA, 17 bp, Homo sapiens
ctgctctgtccccaaag

SEQ ID NO: 2346965 - DNA, 17 bp, Homo sapiens
ctgctctgtgagcccca

SEQ ID NO: 2346966 - DNA, 14 bp, Homo sapiens
ctgctgaacacagt

SEQ ID NO: 2346967 - DNA, 21 bp, Homo sapiens
ctgctgaacacagtgtctgtt

SEQ ID NO: 2346968 - DNA, 13 bp, Homo sapiens
ctgctgacctgct

SEQ ID NO: 2346969 - DNA, 14 bp, Homo sapiens
ctgctgacctgctg

SEQ ID NO: 2346970 - DNA, 22 bp, Homo sapiens
ctgctgagatgaggaggggagc

SEQ ID NO: 2346971 - DNA, 13 bp, Homo sapiens
ctgctgaggccca

SEQ ID NO: 2346972 - DNA, 20 bp, Homo sapiens
ctgctgaggcccagtgcata

SEQ ID NO: 2346973 - DNA, 13 bp, Homo sapiens
ctgctgagtaagg

SEQ ID NO: 2346974 - DNA, 14 bp, Homo sapiens
ctgctgcccccacc

SEQ ID NO: 2346975 - DNA, 21 bp, Homo sapiens
ctgctgcctctttccctagga

SEQ ID NO: 2346976 - DNA, 22 bp, Homo sapiens
ctgctgcctctttccctaggaa

SEQ ID NO: 2346977 - DNA, 16 bp, Homo sapiens
ctgctgctgtctgggt

SEQ ID NO: 2346978 - DNA, 14 bp, Homo sapiens
ctgctggaggcctc

SEQ ID NO: 2346979 - DNA, 15 bp, Homo sapiens
ctgctggaggcctca

SEQ ID NO: 2346980 - DNA, 16 bp, Homo sapiens
ctgctggaggcctcag

SEQ ID NO: 2346981 - DNA, 21 bp, Homo sapiens
ctgctggaggcctcaggtgct

SEQ ID NO: 2346982 - DNA, 14 bp, Homo sapiens
ctgctggccgaccc

SEQ ID NO: 2346983 - DNA, 13 bp, Homo sapiens
ctgctgggctctg

SEQ ID NO: 2346984 - DNA, 20 bp, Homo sapiens
ctgctggggaagggttttct

SEQ ID NO: 2346985 - DNA, 21 bp, Homo sapiens
ctgctggggatccccgcctgg

SEQ ID NO: 2346986 - DNA, 13 bp, Homo sapiens
ctgctggggcctg

SEQ ID NO: 2346987 - DNA, 15 bp, Homo sapiens
ctgctggtatttcta

SEQ ID NO: 2346988 - DNA, 19 bp, Homo sapiens
ctgctgtccagtgcctaca

SEQ ID NO: 2346989 - DNA, 15 bp, Homo sapiens
ctgctgtgaaccctg

SEQ ID NO: 2346990 - DNA, 20 bp, Homo sapiens
ctgctgttctcaggacagca

SEQ ID NO: 2346991 - DNA, 22 bp, Homo sapiens
ctgcttaatcttcaaagccttc

SEQ ID NO: 2346992 - DNA, 23 bp, Homo sapiens
ctgcttaatcttcaaagccttct

SEQ ID NO: 2346993 - DNA, 20 bp, Homo sapiens
ctgcttcccttactttgctg

SEQ ID NO: 2346994 - DNA, 13 bp, Homo sapiens
ctgcttctctttt

SEQ ID NO: 2346995 - DNA, 13 bp, Homo sapiens
ctgctttgaataa

SEQ ID NO: 2346996 - DNA, 19 bp, Homo sapiens
ctgctttgaataaatgtgt

SEQ ID NO: 2346997 - DNA, 19 bp, Homo sapiens
ctgcttttctgccctggct

SEQ ID NO: 2346998 - DNA, 20 bp, Homo sapiens
ctgcttttctgccctggctg

SEQ ID NO: 2346999 - DNA, 18 bp, Homo sapiens
ctgctttttggaaagtca

SEQ ID NO: 2347000 - DNA, 19 bp, Homo sapiens
ctggaaagaggctctggac

SEQ ID NO: 2347001 - DNA, 16 bp, Homo sapiens
ctggaaaggggagagc

SEQ ID NO: 2347002 - DNA, 18 bp, Homo sapiens
ctggaaaggggagagcct

SEQ ID NO: 2347003 - DNA, 20 bp, Homo sapiens
ctggaaaggggagagcctgc

SEQ ID NO: 2347004 - DNA, 17 bp, Homo sapiens
ctggaaccacattgaag

SEQ ID NO: 2347005 - DNA, 20 bp, Homo sapiens
ctggaaccacattgaagaat

SEQ ID NO: 2347006 - DNA, 16 bp, Homo sapiens
ctggaagccagctttc

SEQ ID NO: 2347007 - DNA, 21 bp, Homo sapiens
ctggaagcccagcccctactg

SEQ ID NO: 2347008 - DNA, 17 bp, Homo sapiens
ctggaagcccctgggcc

SEQ ID NO: 2347009 - DNA, 20 bp, Homo sapiens
ctggaagcccctgggcccag

SEQ ID NO: 2347010 - DNA, 19 bp, Homo sapiens
ctggaatgagttgaggcca

SEQ ID NO: 2347011 - DNA, 24 bp, Homo sapiens
ctggaatgagttgaggccactgtg

SEQ ID NO: 2347012 - DNA, 17 bp, Homo sapiens
gacctaaattagataaa

SEQ ID NO: 2347013 - DNA, 13 bp, Homo sapiens
gacctagcaggct

SEQ ID NO: 2347014 - DNA, 16 bp, Homo sapiens
gacctagcaggctgtt

SEQ ID NO: 2347015 - DNA, 14 bp, Homo sapiens
gacctcaagccatc

SEQ ID NO: 2347016 - DNA, 17 bp, Homo sapiens
gacctcaagtgtcctga

SEQ ID NO: 2347017 - DNA, 14 bp, Homo sapiens
gacctcatgcccag

SEQ ID NO: 2347018 - DNA, 19 bp, Homo sapiens
gacctcatgcccagctctc

SEQ ID NO: 2347019 - DNA, 21 bp, Homo sapiens
gacctcggtgaccactcttct

SEQ ID NO: 2347020 - DNA, 24 bp, Homo sapiens
gacctgaagggttgactttaccca

SEQ ID NO: 2347021 - DNA, 12 bp, Homo sapiens
gacctgagtatt

SEQ ID NO: 2347022 - DNA, 19 bp, Homo sapiens
gacctgagtattttttata

SEQ ID NO: 2347023 - DNA, 17 bp, Homo sapiens
gacctgccaggcagggg

SEQ ID NO: 2347024 - DNA, 18 bp, Homo sapiens
gacctgccaggcaggggt

SEQ ID NO: 2347025 - DNA, 21 bp, Homo sapiens
gacctgccaggcaggggtggg

SEQ ID NO: 2347026 - DNA, 10 bp, Homo sapiens
gacctgctga

SEQ ID NO: 2347027 - DNA, 20 bp, Homo sapiens
gacctggcactgggaggcag

SEQ ID NO: 2347028 - DNA, 17 bp, Homo sapiens
gacctggccccaggctg

SEQ ID NO: 2347029 - DNA, 17 bp, Homo sapiens
gacctgggaacgactgg

SEQ ID NO: 2347030 - DNA, 16 bp, Homo sapiens
gacctgggatttgaga

SEQ ID NO: 2347031 - DNA, 22 bp, Homo sapiens
gaccttgcaacctcaccttcct

SEQ ID NO: 2347032 - DNA, 15 bp, Homo sapiens
gacgagttgatttcc

SEQ ID NO: 2347033 - DNA, 17 bp, Homo sapiens
gacgcacgctcgctgcc

SEQ ID NO: 2347034 - DNA, 18 bp, Homo sapiens
gacgcacgctcgctgcca

SEQ ID NO: 2347035 - DNA, 20 bp, Homo sapiens
gacgccactccctgggacac

SEQ ID NO: 2347036 - DNA, 16 bp, Homo sapiens
gacgccatgtgatgga

SEQ ID NO: 2347037 - DNA, 12 bp, Homo sapiens
gacgcctgcagg

SEQ ID NO: 2347038 - DNA, 17 bp, Homo sapiens
gacgcctgcaggagaga

SEQ ID NO: 2347039 - DNA, 16 bp, Homo sapiens
gacgcttgtgacagtg

SEQ ID NO: 2347040 - DNA, 11 bp, Homo sapiens
gacggcaggct

SEQ ID NO: 2347041 - DNA, 13 bp, Homo sapiens
gacggctcctcag

SEQ ID NO: 2347042 - DNA, 22 bp, Homo sapiens
gacggctcctcagagcgccagg

SEQ ID NO: 2347043 - DNA, 23 bp, Homo sapiens
gacggctcctcagagcgccagga

SEQ ID NO: 2347044 - DNA, 20 bp, Homo sapiens
gacgtcactttttggccatg

SEQ ID NO: 2347045 - DNA, 13 bp, Homo sapiens
gacgtcaggccct

SEQ ID NO: 2347046 - DNA, 19 bp, Homo sapiens
gacgtcaggccctgactcc

SEQ ID NO: 2347047 - DNA, 23 bp, Homo sapiens
gacgtcaggccctgactcctctg

SEQ ID NO: 2347048 - DNA, 14 bp, Homo sapiens
gacgttgcctgaga

SEQ ID NO: 2347049 - DNA, 17 bp, Homo sapiens
gacgttggttctgcact

SEQ ID NO: 2347050 - DNA, 18 bp, Homo sapiens
gactaaagagagaatgta

SEQ ID NO: 2347051 - DNA, 16 bp, Homo sapiens
gactaactcaaataca

SEQ ID NO: 2347052 - DNA, 23 bp, Homo sapiens
gactaaggaactaaaacttgagg

SEQ ID NO: 2347053 - DNA, 16 bp, Homo sapiens
gactagaggcttgcat

SEQ ID NO: 2347054 - DNA, 17 bp, Homo sapiens
gactagcaatctcttca

SEQ ID NO: 2347055 - DNA, 12 bp, Homo sapiens
gactatggtgct

SEQ ID NO: 2347056 - DNA, 23 bp, Homo sapiens
gactatggtgctgccttgcttct

SEQ ID NO: 2347057 - DNA, 18 bp, Homo sapiens
gactcaaaaaaacaaaaa

SEQ ID NO: 2347058 - DNA, 18 bp, Homo sapiens
gactccggggccccactg

SEQ ID NO: 2347059 - DNA, 21 bp, Homo sapiens
gactccggggccccactggct

SEQ ID NO: 2347060 - DNA, 12 bp, Homo sapiens
gactctgcacat

SEQ ID NO: 2347061 - DNA, 14 bp, Homo sapiens
gactctgcacatga

SEQ ID NO: 2347062 - DNA, 16 bp, Homo sapiens
gactgccttgcctcct

SEQ ID NO: 2347063 - DNA, 15 bp, Homo sapiens
gactgctcagaactt

SEQ ID NO: 2347064 - DNA, 20 bp, Homo sapiens
gactgctcagaacttgctgc

SEQ ID NO: 2347065 - DNA, 22 bp, Homo sapiens
gactggctcatgcctcagcccg

SEQ ID NO: 2347066 - DNA, 20 bp, Homo sapiens
gactgggccccacatggctt

SEQ ID NO: 2347067 - DNA, 20 bp, Homo sapiens
gactgtagatatgtattctt

SEQ ID NO: 2347068 - DNA, 13 bp, Homo sapiens
gactgtctttcag

SEQ ID NO: 2347069 - DNA, 23 bp, Homo sapiens
gacttaaagggcccaatgaatta

SEQ ID NO: 2347070 - DNA, 23 bp, Homo sapiens
gacttcctggtgaggcccagcct

SEQ ID NO: 2347071 - DNA, 17 bp, Homo sapiens
gacttgctgtccaggca

SEQ ID NO: 2347072 - DNA, 18 bp, Homo sapiens
gacttgctgtccaggcag

SEQ ID NO: 2347073 - DNA, 20 bp, Homo sapiens
gacttggggagatggagttc

SEQ ID NO: 2347074 - DNA, 22 bp, Homo sapiens
gacttgtatagcatgaaataaa

SEQ ID NO: 2347075 - DNA, 22 bp, Homo sapiens
gactttatctaatacctctgtg

SEQ ID NO: 2347076 - DNA, 14 bp, Homo sapiens
gagaaaagagagaa

SEQ ID NO: 2347077 - DNA, 16 bp, Homo sapiens
gagaacccagtttccc

SEQ ID NO: 2347078 - DNA, 20 bp, Homo sapiens
gagaactcgcgctcagtaaa

SEQ ID NO: 2347079 - DNA, 14 bp, Homo sapiens
gagaactctggctt

SEQ ID NO: 2347080 - DNA, 12 bp, Homo sapiens
gagaagccaagc

SEQ ID NO: 2347081 - DNA, 20 bp, Homo sapiens
gagaagctggtctagactgt

SEQ ID NO: 2347082 - DNA, 21 bp, Homo sapiens
gagaatccaagggttgagagc

SEQ ID NO: 2347083 - DNA, 18 bp, Homo sapiens
gagacaaaatatttccca

SEQ ID NO: 2347084 - DNA, 16 bp, Homo sapiens
gagacaaggtgctaac

SEQ ID NO: 2347085 - DNA, 23 bp, Homo sapiens
gagacagaggaaagggctggctc

SEQ ID NO: 2347086 - DNA, 15 bp, Homo sapiens
gagacagaggatgtg

SEQ ID NO: 2347087 - DNA, 13 bp, Homo sapiens
gagacagtgaatt

SEQ ID NO: 2347088 - DNA, 16 bp, Homo sapiens
gagacagtttcttagc

SEQ ID NO: 2347089 - DNA, 22 bp, Homo sapiens
gagacagtttcttagcttttta

SEQ ID NO: 2347090 - DNA, 12 bp, Homo sapiens
gagaccatcctg

SEQ ID NO: 2347091 - DNA, 15 bp, Homo sapiens
gagaccatcctggct

SEQ ID NO: 2347092 - DNA, 20 bp, Homo sapiens
gagaccccagtcgtgatgtg

SEQ ID NO: 2347093 - DNA, 20 bp, Homo sapiens
gagaccctactgaagtggct

SEQ ID NO: 2347094 - DNA, 19 bp, Homo sapiens
gagaccctgccacagccag

SEQ ID NO: 2347095 - DNA, 23 bp, Homo sapiens
gagaccctgccacagccagagga

SEQ ID NO: 2347096 - DNA, 18 bp, Homo sapiens
gagaccgggccctgggtt

SEQ ID NO: 2347097 - DNA, 23 bp, Homo sapiens
gagactgcgttctgcaagcatca

SEQ ID NO: 2347098 - DNA, 12 bp, Homo sapiens
gagactgtgctg

SEQ ID NO: 2347099 - DNA, 13 bp, Homo sapiens
gagactgtgctgt

SEQ ID NO: 2347100 - DNA, 16 bp, Homo sapiens
gagactgtttgaatgt

SEQ ID NO: 2347101 - DNA, 14 bp, Homo sapiens
gagagacaggcagc

SEQ ID NO: 2347102 - DNA, 21 bp, Homo sapiens
gagagacaggcagcccagcag

SEQ ID NO: 2347103 - DNA, 14 bp, Homo sapiens
gagagagagagagg

SEQ ID NO: 2347104 - DNA, 14 bp, Homo sapiens
gagagcagctccct

SEQ ID NO: 2347105 - DNA, 15 bp, Homo sapiens
gagagcagctccctt

SEQ ID NO: 2347106 - DNA, 11 bp, Homo sapiens
gagagcagctg

SEQ ID NO: 2347107 - DNA, 14 bp, Homo sapiens
gagagccattttgt

SEQ ID NO: 2347108 - DNA, 19 bp, Homo sapiens
gagagccgtggtccctgag

SEQ ID NO: 2347109 - DNA, 20 bp, Homo sapiens
gagagccgtggtccctgagg

SEQ ID NO: 2347110 - DNA, 13 bp, Homo sapiens
gagagcctgctgg

SEQ ID NO: 2347111 - DNA, 19 bp, Homo sapiens
gagaggacaatactggggt

SEQ ID NO: 2347112 - DNA, 19 bp, Homo sapiens
gagaggatgagagcccaga

SEQ ID NO: 2347113 - DNA, 20 bp, Homo sapiens
gagaggatgagagcccagag

SEQ ID NO: 2347114 - DNA, 17 bp, Homo sapiens
gagaggcacctgctgga

SEQ ID NO: 2347115 - DNA, 22 bp, Homo sapiens
gagaggcactcagtgagcctcc

SEQ ID NO: 2347116 - DNA, 15 bp, Homo sapiens
gagaggcaggcatag

SEQ ID NO: 2347117 - DNA, 23 bp, Homo sapiens
gagaggcgcgtctgccccaccct

SEQ ID NO: 2347118 - DNA, 14 bp, Homo sapiens
gagagggagagaga

SEQ ID NO: 2347119 - DNA, 17 bp, Homo sapiens
gagagtatttttataca

SEQ ID NO: 2347120 - DNA, 22 bp, Homo sapiens
gagagttagcatgtatgaatgt

SEQ ID NO: 2347121 - DNA, 23 bp, Homo sapiens
gagagttagcatgtatgaatgta

SEQ ID NO: 2347122 - DNA, 21 bp, Homo sapiens
gagataaaacagaatcttctg

SEQ ID NO: 2347123 - DNA, 12 bp, Homo sapiens
gagataattgtt

SEQ ID NO: 2347124 - DNA, 17 bp, Homo sapiens
gagatcgagaccatcct

SEQ ID NO: 2347125 - DNA, 18 bp, Homo sapiens
gagatgaggaggggagcg

SEQ ID NO: 2347126 - DNA, 20 bp, Homo sapiens
gaggcttctccgccagcctc

SEQ ID NO: 2347127 - DNA, 23 bp, Homo sapiens
gaggcttgtttacctttctctct

SEQ ID NO: 2347128 - DNA, 20 bp, Homo sapiens
gagggaagggtttctctatt

SEQ ID NO: 2347129 - DNA, 14 bp, Homo sapiens
gagggagaagcatg

SEQ ID NO: 2347130 - DNA, 15 bp, Homo sapiens
gagggagagagagag

SEQ ID NO: 2347131 - DNA, 13 bp, Homo sapiens
gagggagagggag

SEQ ID NO: 2347132 - DNA, 21 bp, Homo sapiens
gagggaggggaaaagcatttt

SEQ ID NO: 2347133 - DNA, 15 bp, Homo sapiens
gagggagtagaatac

SEQ ID NO: 2347134 - DNA, 22 bp, Homo sapiens
gagggagttttgtctgtctccc

SEQ ID NO: 2347135 - DNA, 15 bp, Homo sapiens
gagggatttccctgc

SEQ ID NO: 2347136 - DNA, 17 bp, Homo sapiens
gagggcagactggggca

SEQ ID NO: 2347137 - DNA, 21 bp, Homo sapiens
gagggcagactggggcatcct

SEQ ID NO: 2347138 - DNA, 14 bp, Homo sapiens
gagggcagctgcta

SEQ ID NO: 2347139 - DNA, 13 bp, Homo sapiens
gagggcaggcttg

SEQ ID NO: 2347140 - DNA, 14 bp, Homo sapiens
gagggcaggcttgg

SEQ ID NO: 2347141 - DNA, 19 bp, Homo sapiens
gagggcaggcttggggaaa

SEQ ID NO: 2347142 - DNA, 23 bp, Homo sapiens
gaggggagagacaggcagcccag

SEQ ID NO: 2347143 - DNA, 19 bp, Homo sapiens
gaggggagcgtctgggaac

SEQ ID NO: 2347144 - DNA, 17 bp, Homo sapiens
gaggggtgtggcagtgg

SEQ ID NO: 2347145 - DNA, 22 bp, Homo sapiens
gagggtgtggctttccaggcac

SEQ ID NO: 2347146 - DNA, 21 bp, Homo sapiens
gaggtaacagaacagcttcag

SEQ ID NO: 2347147 - DNA, 21 bp, Homo sapiens
gaggtagcgagctgctctgct

SEQ ID NO: 2347148 - DNA, 16 bp, Homo sapiens
gaggtcactggaaagg

SEQ ID NO: 2347149 - DNA, 21 bp, Homo sapiens
gaggtcactggaaaggggaga

SEQ ID NO: 2347150 - DNA, 17 bp, Homo sapiens
gaggtcaggacggctcc

SEQ ID NO: 2347151 - DNA, 22 bp, Homo sapiens
gaggtcccctcgtcccatccag

SEQ ID NO: 2347152 - DNA, 16 bp, Homo sapiens
gaggtgcactgggagg

SEQ ID NO: 2347153 - DNA, 23 bp, Homo sapiens
gaggtgccacccagtagcccaga

SEQ ID NO: 2347154 - DNA, 18 bp, Homo sapiens
gaggtgtcaccctgcaga

SEQ ID NO: 2347155 - DNA, 20 bp, Homo sapiens
gaggtgtcaccctgcagagc

SEQ ID NO: 2347156 - DNA, 21 bp, Homo sapiens
gaggtgtcaccctgcagagct

SEQ ID NO: 2347157 - DNA, 18 bp, Homo sapiens
gaggttaaacggtgccca

SEQ ID NO: 2347158 - DNA, 19 bp, Homo sapiens
gaggttcctctgcctgccc

SEQ ID NO: 2347159 - DNA, 13 bp, Homo sapiens
gaggttgaagcca

SEQ ID NO: 2347160 - DNA, 15 bp, Homo sapiens
gaggttgaagccaag

SEQ ID NO: 2347161 - DNA, 18 bp, Homo sapiens
gaggttttaatgtctgtt

SEQ ID NO: 2347162 - DNA, 16 bp, Homo sapiens
gagtagaaaatgtgac

SEQ ID NO: 2347163 - DNA, 21 bp, Homo sapiens
gagtattccatgagctgctca

SEQ ID NO: 2347164 - DNA, 19 bp, Homo sapiens
gagtatttcccttccaaag

SEQ ID NO: 2347165 - DNA, 20 bp, Homo sapiens
gagtatttcccttccaaaga

SEQ ID NO: 2347166 - DNA, 21 bp, Homo sapiens
gagtcaccttttctgtggctg

SEQ ID NO: 2347167 - DNA, 13 bp, Homo sapiens
gagtccaaggcca

SEQ ID NO: 2347168 - DNA, 17 bp, Homo sapiens
gagtccaaggccagtcc

SEQ ID NO: 2347169 - DNA, 18 bp, Homo sapiens
gagtccagggtttctctg

SEQ ID NO: 2347170 - DNA, 14 bp, Homo sapiens
gagtccagtgctct

SEQ ID NO: 2347171 - DNA, 19 bp, Homo sapiens
gagtccagtgctctgcctc

SEQ ID NO: 2347172 - DNA, 17 bp, Homo sapiens
gagtccctacctgcttc

SEQ ID NO: 2347173 - DNA, 14 bp, Homo sapiens
gagtccggatttct

SEQ ID NO: 2347174 - DNA, 17 bp, Homo sapiens
gagtcgtacagaaagct

SEQ ID NO: 2347175 - DNA, 22 bp, Homo sapiens
gagtgaaaaatcttaagtacca

SEQ ID NO: 2347176 - DNA, 23 bp, Homo sapiens
gagtgaaaaatcttaagtaccaa

SEQ ID NO: 2347177 - DNA, 12 bp, Homo sapiens
gagtgacagctt

SEQ ID NO: 2347178 - DNA, 17 bp, Homo sapiens
gagtgacagctttctgg

SEQ ID NO: 2347179 - DNA, 21 bp, Homo sapiens
gagtgacagctttctgggatg

SEQ ID NO: 2347180 - DNA, 23 bp, Homo sapiens
gagtgacagctttctgggatgtc

SEQ ID NO: 2347181 - DNA, 16 bp, Homo sapiens
gagtgaggtgcaggga

SEQ ID NO: 2347182 - DNA, 22 bp, Homo sapiens
gagtgatttgtaaaacagtggt

SEQ ID NO: 2347183 - DNA, 12 bp, Homo sapiens
gagtgcagcctt

SEQ ID NO: 2347184 - DNA, 15 bp, Homo sapiens
gagtgcagccttctc

SEQ ID NO: 2347185 - DNA, 14 bp, Homo sapiens
gagtgcgggctgag

SEQ ID NO: 2347186 - DNA, 10 bp, Homo sapiens
gagtggccca

SEQ ID NO: 2347187 - DNA, 17 bp, Homo sapiens
gagtgtaaaatgtatat

SEQ ID NO: 2347188 - DNA, 11 bp, Homo sapiens
gagtgtagaag

SEQ ID NO: 2347189 - DNA, 15 bp, Homo sapiens
gagtgtagactgtgg

SEQ ID NO: 2347190 - DNA, 17 bp, Homo sapiens
gagtgtagactgtggct

SEQ ID NO: 2347191 - DNA, 17 bp, Homo sapiens
gagtgtctggaattgtg

SEQ ID NO: 2347192 - DNA, 17 bp, Homo sapiens
gagttctgggtttctag

SEQ ID NO: 2347193 - DNA, 23 bp, Homo sapiens
gagttctgggtttctagaggtca

SEQ ID NO: 2347194 - DNA, 19 bp, Homo sapiens
gagttgaaatgttctgtca

SEQ ID NO: 2347195 - DNA, 16 bp, Homo sapiens
gataaagaccagaaat

SEQ ID NO: 2347196 - DNA, 20 bp, Homo sapiens
gataacagagtgatttgtaa

SEQ ID NO: 2347197 - DNA, 14 bp, Homo sapiens
gataactagccaga

SEQ ID NO: 2347198 - DNA, 16 bp, Homo sapiens
gataactctctttcct

SEQ ID NO: 2347199 - DNA, 22 bp, Homo sapiens
gataataatactgacctacctc

SEQ ID NO: 2347200 - DNA, 20 bp, Homo sapiens
gatacacaaagctttctttt

SEQ ID NO: 2347201 - DNA, 20 bp, Homo sapiens
gataccacaaaccctgctga

SEQ ID NO: 2347202 - DNA, 22 bp, Homo sapiens
gataccacaaaccctgctgaac

SEQ ID NO: 2347203 - DNA, 21 bp, Homo sapiens
gatacgtccgtgtgtcccaga

SEQ ID NO: 2347204 - DNA, 22 bp, Homo sapiens
gatagtagttaaataactgtgt

SEQ ID NO: 2347205 - DNA, 17 bp, Homo sapiens
gatagtgggatttccag

SEQ ID NO: 2347206 - DNA, 19 bp, Homo sapiens
gatagtgggatttccagaa

SEQ ID NO: 2347207 - DNA, 15 bp, Homo sapiens
gatagttgctatttt

SEQ ID NO: 2347208 - DNA, 23 bp, Homo sapiens
gatagttgctatttttgtaaagt

SEQ ID NO: 2347209 - DNA, 13 bp, Homo sapiens
gatataatttaaa

SEQ ID NO: 2347210 - DNA, 13 bp, Homo sapiens
gatataccaaatt

SEQ ID NO: 2347211 - DNA, 20 bp, Homo sapiens
gatatagtagttacttgtga

SEQ ID NO: 2347212 - DNA, 16 bp, Homo sapiens
gatatcctctccccct

SEQ ID NO: 2347213 - DNA, 12 bp, Homo sapiens
gatattatagaa

SEQ ID NO: 2347214 - DNA, 14 bp, Homo sapiens
gatattatttcttc

SEQ ID NO: 2347215 - DNA, 18 bp, Homo sapiens
gatattggttcttcccct

SEQ ID NO: 2347216 - DNA, 11 bp, Homo sapiens
gatatttccta

SEQ ID NO: 2347217 - DNA, 23 bp, Homo sapiens
gatattttggggggcagagaata

SEQ ID NO: 2347218 - DNA, 22 bp, Homo sapiens
gatcaagagtccggatttctaa

SEQ ID NO: 2347219 - DNA, 19 bp, Homo sapiens
gatcaatatttttatatca

SEQ ID NO: 2347220 - DNA, 13 bp, Homo sapiens
gatcactgccaca

SEQ ID NO: 2347221 - DNA, 22 bp, Homo sapiens
gatcactgtagtttagttctgt

SEQ ID NO: 2347222 - DNA, 22 bp, Homo sapiens
gatcactttctcagttttcata

SEQ ID NO: 2347223 - DNA, 23 bp, Homo sapiens
gatcagtgggcctccaaggaggg

SEQ ID NO: 2347224 - DNA, 17 bp, Homo sapiens
gatcatagctcactgca

SEQ ID NO: 2347225 - DNA, 21 bp, Homo sapiens
gatcatggtgtaataagacat

SEQ ID NO: 2347226 - DNA, 18 bp, Homo sapiens
gatcattacatggctgtg

SEQ ID NO: 2347227 - DNA, 20 bp, Homo sapiens
gatccaactaatgccttact

SEQ ID NO: 2347228 - DNA, 16 bp, Homo sapiens
gatccacccaacccta

SEQ ID NO: 2347229 - DNA, 17 bp, Homo sapiens
gatccatttccattgct

SEQ ID NO: 2347230 - DNA, 14 bp, Homo sapiens
gatccccaacctgc

SEQ ID NO: 2347231 - DNA, 15 bp, Homo sapiens
gatccccgcctggcc

SEQ ID NO: 2347232 - DNA, 16 bp, Homo sapiens
gatccccgcctggcca

SEQ ID NO: 2347233 - DNA, 19 bp, Homo sapiens
gatccccgcctggccagga

SEQ ID NO: 2347234 - DNA, 23 bp, Homo sapiens
gatccgagtgtgatttgaattct

SEQ ID NO: 2347235 - DNA, 16 bp, Homo sapiens
gatccgcaagagtaaa

SEQ ID NO: 2347236 - DNA, 22 bp, Homo sapiens
gatcctgggtcaaaaaaaagaa

SEQ ID NO: 2347237 - DNA, 16 bp, Homo sapiens
gatccttcagcacagg

SEQ ID NO: 2347238 - DNA, 16 bp, Homo sapiens
gatcggactctgcccc

SEQ ID NO: 2347239 - DNA, 22 bp, Homo sapiens
gatctaagggaagatcactgta

SEQ ID NO: 2347240 - DNA, 18 bp, Homo sapiens
gcaaattttgtattattg

SEQ ID NO: 2347241 - DNA, 19 bp, Homo sapiens
gcaacaaatgtggccaagc

SEQ ID NO: 2347242 - DNA, 22 bp, Homo sapiens
gcaacaacaattggtaaaactc

SEQ ID NO: 2347243 - DNA, 22 bp, Homo sapiens
gcaaccacatttagaaatgttt

SEQ ID NO: 2347244 - DNA, 17 bp, Homo sapiens
gcaacctcaccttcctg

SEQ ID NO: 2347245 - DNA, 18 bp, Homo sapiens
gcaacttcttctccatcc

SEQ ID NO: 2347246 - DNA, 20 bp, Homo sapiens
gcaacttcttctccatccct

SEQ ID NO: 2347247 - DNA, 18 bp, Homo sapiens
gcaagaacccaagtgcct

SEQ ID NO: 2347248 - DNA, 17 bp, Homo sapiens
gcaagagagatgttttg

SEQ ID NO: 2347249 - DNA, 19 bp, Homo sapiens
gcaagaggcaagctgaaat

SEQ ID NO: 2347250 - DNA, 19 bp, Homo sapiens
gcaagagtctgtctcaaaa

SEQ ID NO: 2347251 - DNA, 13 bp, Homo sapiens
gcaagatgtgaat

SEQ ID NO: 2347252 - DNA, 17 bp, Homo sapiens
gcaagatgtgaattatt

SEQ ID NO: 2347253 - DNA, 11 bp, Homo sapiens
gcaagccacag

SEQ ID NO: 2347254 - DNA, 23 bp, Homo sapiens
gcaagccagacctagcaggctgt

SEQ ID NO: 2347255 - DNA, 17 bp, Homo sapiens
gcaagctgaaattttag

SEQ ID NO: 2347256 - DNA, 18 bp, Homo sapiens
gcaagggttaaggcctga

SEQ ID NO: 2347257 - DNA, 15 bp, Homo sapiens
gcaagtgctggagtc

SEQ ID NO: 2347258 - DNA, 22 bp, Homo sapiens
gcaagttttaaacccaaaatat

SEQ ID NO: 2347259 - DNA, 23 bp, Homo sapiens
gcaagttttaaacccaaaatata

SEQ ID NO: 2347260 - DNA, 14 bp, Homo sapiens
gcaataaaatttaa

SEQ ID NO: 2347261 - DNA, 21 bp, Homo sapiens
gcaataaaatttaaaaaataa

SEQ ID NO: 2347262 - DNA, 21 bp, Homo sapiens
gcaataatatgtgagaggaca

SEQ ID NO: 2347263 - DNA, 18 bp, Homo sapiens
gcaatccacctgccttgg

SEQ ID NO: 2347264 - DNA, 20 bp, Homo sapiens
gcaatcctcctgcctcagcc

SEQ ID NO: 2347265 - DNA, 17 bp, Homo sapiens
gcaatctcttcattatt

SEQ ID NO: 2347266 - DNA, 15 bp, Homo sapiens
gcacaaaaaatttaa

SEQ ID NO: 2347267 - DNA, 18 bp, Homo sapiens
gcacaaaaaatttaagag

SEQ ID NO: 2347268 - DNA, 16 bp, Homo sapiens
gcacaataaaaatgtt

SEQ ID NO: 2347269 - DNA, 14 bp, Homo sapiens
gcacaatttgcact

SEQ ID NO: 2347270 - DNA, 13 bp, Homo sapiens
gcacacaggacag

SEQ ID NO: 2347271 - DNA, 14 bp, Homo sapiens
gcacacaggacagc

SEQ ID NO: 2347272 - DNA, 13 bp, Homo sapiens
gcacacattattt

SEQ ID NO: 2347273 - DNA, 14 bp, Homo sapiens
gcacaccccactcc

SEQ ID NO: 2347274 - DNA, 20 bp, Homo sapiens
gcacactcttctcttgagca

SEQ ID NO: 2347275 - DNA, 16 bp, Homo sapiens
gcacagagcctggccc

SEQ ID NO: 2347276 - DNA, 20 bp, Homo sapiens
gcacagagcctggccccagg

SEQ ID NO: 2347277 - DNA, 22 bp, Homo sapiens
gcacagagcctggccccaggcc

SEQ ID NO: 2347278 - DNA, 16 bp, Homo sapiens
gcacagctggagaaat

SEQ ID NO: 2347279 - DNA, 11 bp, Homo sapiens
gcacagtattt

SEQ ID NO: 2347280 - DNA, 13 bp, Homo sapiens
gcacagtatttaa

SEQ ID NO: 2347281 - DNA, 15 bp, Homo sapiens
gcacagtccagaccc

SEQ ID NO: 2347282 - DNA, 15 bp, Homo sapiens
gcacagtttttgtaa

SEQ ID NO: 2347283 - DNA, 24 bp, Homo sapiens
gcacagtttttgtaaagcccttgc

SEQ ID NO: 2347284 - DNA, 23 bp, Homo sapiens
gcacatacgggctttaatagtca

SEQ ID NO: 2347285 - DNA, 15 bp, Homo sapiens
gcacatgggattgct

SEQ ID NO: 2347286 - DNA, 21 bp, Homo sapiens
gcacatgtcttgtacatgtgt

SEQ ID NO: 2347287 - DNA, 14 bp, Homo sapiens
gcaccactgttctg

SEQ ID NO: 2347288 - DNA, 14 bp, Homo sapiens
gcaccagtccctgt

SEQ ID NO: 2347289 - DNA, 19 bp, Homo sapiens
gcaccataatgagatgtga

SEQ ID NO: 2347290 - DNA, 20 bp, Homo sapiens
gcacccacctgttttctgaa

SEQ ID NO: 2347291 - DNA, 21 bp, Homo sapiens
gcacccacctgttttctgaaa

SEQ ID NO: 2347292 - DNA, 13 bp, Homo sapiens
gcacccctgggcc

SEQ ID NO: 2347293 - DNA, 19 bp, Homo sapiens
gcaccccttctctcctccc

SEQ ID NO: 2347294 - DNA, 20 bp, Homo sapiens
gcaccccttctctcctcccc

SEQ ID NO: 2347295 - DNA, 21 bp, Homo sapiens
gcaccccttctctcctcccca

SEQ ID NO: 2347296 - DNA, 13 bp, Homo sapiens
gcaccctcaggga

SEQ ID NO: 2347297 - DNA, 22 bp, Homo sapiens
gcaccctcagggagcctcccca

SEQ ID NO: 2347298 - DNA, 19 bp, Homo sapiens
gcaccgtgtcaagctgctc

SEQ ID NO: 2347299 - DNA, 14 bp, Homo sapiens
gcacctcttccttg

SEQ ID NO: 2347300 - DNA, 20 bp, Homo sapiens
gcacctcttccttgatgttt

SEQ ID NO: 2347301 - DNA, 13 bp, Homo sapiens
gcacctgagaccc

SEQ ID NO: 2347302 - DNA, 18 bp, Homo sapiens
gcacctgagaccctactg

SEQ ID NO: 2347303 - DNA, 12 bp, Homo sapiens
gcacctgctgga

SEQ ID NO: 2347304 - DNA, 18 bp, Homo sapiens
gcacctgtagtcccagct

SEQ ID NO: 2347305 - DNA, 20 bp, Homo sapiens
gcaccttcagggctgagttc

SEQ ID NO: 2347306 - DNA, 13 bp, Homo sapiens
gcacgtcatggga

SEQ ID NO: 2347307 - DNA, 23 bp, Homo sapiens
gcactaaaacccatcttccccgg

SEQ ID NO: 2347308 - DNA, 17 bp, Homo sapiens
gcactacaccttgcctt

SEQ ID NO: 2347309 - DNA, 22 bp, Homo sapiens
gcactagcattttcttgaacca

SEQ ID NO: 2347310 - DNA, 18 bp, Homo sapiens
gcactcagtgagcctcct

SEQ ID NO: 2347311 - DNA, 15 bp, Homo sapiens
gcactccagcctggg

SEQ ID NO: 2347312 - DNA, 19 bp, Homo sapiens
gcactccagcctgggggac

SEQ ID NO: 2347313 - DNA, 22 bp, Homo sapiens
gcactctagggtgaaccaagct

SEQ ID NO: 2347314 - DNA, 22 bp, Homo sapiens
gcactctggatgatggattcca

SEQ ID NO: 2347315 - DNA, 20 bp, Homo sapiens
gcactgagctcacatgggac

SEQ ID NO: 2347316 - DNA, 22 bp, Homo sapiens
gcactgagctcacatgggactg

SEQ ID NO: 2347317 - DNA, 17 bp, Homo sapiens
gccacaagctgcactgt

SEQ ID NO: 2347318 - DNA, 23 bp, Homo sapiens
gccacacccaggggaaggccctg

SEQ ID NO: 2347319 - DNA, 17 bp, Homo sapiens
gccacagccagaggagg

SEQ ID NO: 2347320 - DNA, 18 bp, Homo sapiens
gccacagcgccagcctca

SEQ ID NO: 2347321 - DNA, 18 bp, Homo sapiens
gccacagctgctgttctc

SEQ ID NO: 2347322 - DNA, 20 bp, Homo sapiens
gccacagctgctgttctcag

SEQ ID NO: 2347323 - DNA, 15 bp, Homo sapiens
gccacaggaaggagg

SEQ ID NO: 2347324 - DNA, 15 bp, Homo sapiens
gccacagtagaactg

SEQ ID NO: 2347325 - DNA, 15 bp, Homo sapiens
gccacatcaaacctt

SEQ ID NO: 2347326 - DNA, 16 bp, Homo sapiens
gccaccaaagctgccc

SEQ ID NO: 2347327 - DNA, 21 bp, Homo sapiens
gccaccacttccagagccaga

SEQ ID NO: 2347328 - DNA, 20 bp, Homo sapiens
gccaccagccatcctccctc

SEQ ID NO: 2347329 - DNA, 22 bp, Homo sapiens
gccaccctagccaatgtctcct

SEQ ID NO: 2347330 - DNA, 15 bp, Homo sapiens
gccaccggcctgtgg

SEQ ID NO: 2347331 - DNA, 21 bp, Homo sapiens
gccaccggcctgtgggtctct

SEQ ID NO: 2347332 - DNA, 22 bp, Homo sapiens
gccaccggcctgtgggtctctg

SEQ ID NO: 2347333 - DNA, 13 bp, Homo sapiens
gccaccgtgcctg

SEQ ID NO: 2347334 - DNA, 15 bp, Homo sapiens
gccaccgtgcctggc

SEQ ID NO: 2347335 - DNA, 10 bp, Homo sapiens
gccacctgca

SEQ ID NO: 2347336 - DNA, 12 bp, Homo sapiens
gccacctgcaag

SEQ ID NO: 2347337 - DNA, 18 bp, Homo sapiens
gccacctgcaagatggac

SEQ ID NO: 2347338 - DNA, 18 bp, Homo sapiens
gccacgcagtgcctggag

SEQ ID NO: 2347339 - DNA, 20 bp, Homo sapiens
gccactgtgttccttccgct

SEQ ID NO: 2347340 - DNA, 20 bp, Homo sapiens
gccactttacccacctagaa

SEQ ID NO: 2347341 - DNA, 21 bp, Homo sapiens
gccactttcacgtggcctccg

SEQ ID NO: 2347342 - DNA, 18 bp, Homo sapiens
gccagacaaaatttgaga

SEQ ID NO: 2347343 - DNA, 16 bp, Homo sapiens
gccagacctagcaggc

SEQ ID NO: 2347344 - DNA, 21 bp, Homo sapiens
gccagaggaatcctggcagcc

SEQ ID NO: 2347345 - DNA, 23 bp, Homo sapiens
gccagaggaatcctggcagccca

SEQ ID NO: 2347346 - DNA, 20 bp, Homo sapiens
gccagaggagggcagaggga

SEQ ID NO: 2347347 - DNA, 20 bp, Homo sapiens
gccagaggctgggagtccct

SEQ ID NO: 2347348 - DNA, 14 bp, Homo sapiens
gccagattctgcct

SEQ ID NO: 2347349 - DNA, 13 bp, Homo sapiens
gccagcaaataaa

SEQ ID NO: 2347350 - DNA, 11 bp, Homo sapiens
gccagcccctg

SEQ ID NO: 2347351 - DNA, 20 bp, Homo sapiens
gccagcctccgagagggaga

SEQ ID NO: 2347352 - DNA, 12 bp, Homo sapiens
gccagcctcctc

SEQ ID NO: 2347353 - DNA, 16 bp, Homo sapiens
gccagcctcctctgga

SEQ ID NO: 2347354 - DNA, 14 bp, Homo sapiens
gccagcggggctgc

SEQ ID NO: 2347355 - DNA, 15 bp, Homo sapiens
gccagcggggctgct

SEQ ID NO: 2347356 - DNA, 17 bp, Homo sapiens
gccagcggggctgctca

SEQ ID NO: 2347357 - DNA, 18 bp, Homo sapiens
gccagctggcctttgtaa

SEQ ID NO: 2347358 - DNA, 18 bp, Homo sapiens
gccagcttggggccacca

SEQ ID NO: 2347359 - DNA, 14 bp, Homo sapiens
gccaggaagccaga

SEQ ID NO: 2347360 - DNA, 22 bp, Homo sapiens
gccaggacatgcaataaaattt

SEQ ID NO: 2347361 - DNA, 21 bp, Homo sapiens
gccaggagcaggcacgggtgg

SEQ ID NO: 2347362 - DNA, 22 bp, Homo sapiens
gccaggatcatggtgtaataag

SEQ ID NO: 2347363 - DNA, 17 bp, Homo sapiens
gccaggcacacacagcc

SEQ ID NO: 2347364 - DNA, 14 bp, Homo sapiens
gccaggcaggggtg

SEQ ID NO: 2347365 - DNA, 15 bp, Homo sapiens
gccaggcaggggtgg

SEQ ID NO: 2347366 - DNA, 16 bp, Homo sapiens
gccaggcaggggtggg

SEQ ID NO: 2347367 - DNA, 15 bp, Homo sapiens
gccaggcctggctgg

SEQ ID NO: 2347368 - DNA, 16 bp, Homo sapiens
gccagggcagggtctg

SEQ ID NO: 2347369 - DNA, 19 bp, Homo sapiens
gccagggcagggtctgggc

SEQ ID NO: 2347370 - DNA, 20 bp, Homo sapiens
gccagggcagggtctgggct

SEQ ID NO: 2347371 - DNA, 21 bp, Homo sapiens
gccagggcagggtctgggctg

SEQ ID NO: 2347372 - DNA, 17 bp, Homo sapiens
gccagggcctctccaac

SEQ ID NO: 2347373 - DNA, 11 bp, Homo sapiens
gccagggctgc

SEQ ID NO: 2347374 - DNA, 14 bp, Homo sapiens
gccagggctgcccc

SEQ ID NO: 2347375 - DNA, 15 bp, Homo sapiens
gccagggctgcccct

SEQ ID NO: 2347376 - DNA, 20 bp, Homo sapiens
gccaggtggttgtcttattg

SEQ ID NO: 2347377 - DNA, 16 bp, Homo sapiens
gccagtccccatttct

SEQ ID NO: 2347378 - DNA, 15 bp, Homo sapiens
gccagtcctgctacc

SEQ ID NO: 2347379 - DNA, 22 bp, Homo sapiens
gccagtcctgctacctcccttg

SEQ ID NO: 2347380 - DNA, 19 bp, Homo sapiens
gccagttgatctgctctgt

SEQ ID NO: 2347381 - DNA, 22 bp, Homo sapiens
gccagttgggctcgcactgccc

SEQ ID NO: 2347382 - DNA, 20 bp, Homo sapiens
gccataaacggttcctggtg

SEQ ID NO: 2347383 - DNA, 21 bp, Homo sapiens
gccataaacggttcctggtga

SEQ ID NO: 2347384 - DNA, 19 bp, Homo sapiens
gccatatatgaccagaagc

SEQ ID NO: 2347385 - DNA, 21 bp, Homo sapiens
gccatcaagcactcctacctt

SEQ ID NO: 2347386 - DNA, 15 bp, Homo sapiens
gccatcaccgctggg

SEQ ID NO: 2347387 - DNA, 16 bp, Homo sapiens
gccatcaccgctgggt

SEQ ID NO: 2347388 - DNA, 17 bp, Homo sapiens
gccatcaccgctgggtg

SEQ ID NO: 2347389 - DNA, 18 bp, Homo sapiens
gccatcaccgctgggtgg

SEQ ID NO: 2347390 - DNA, 12 bp, Homo sapiens
gccatcctccct

SEQ ID NO: 2347391 - DNA, 15 bp, Homo sapiens
gccatcctccctcca

SEQ ID NO: 2347392 - DNA, 16 bp, Homo sapiens
gccatgaagggaccct

SEQ ID NO: 2347393 - DNA, 16 bp, Homo sapiens
gccatgaatctctgcc

SEQ ID NO: 2347394 - DNA, 17 bp, Homo sapiens
gccatgaatctctgcct

SEQ ID NO: 2347395 - DNA, 21 bp, Homo sapiens
gccatgaatctctgcctctcc

SEQ ID NO: 2347396 - DNA, 11 bp, Homo sapiens
gccatgaatta

SEQ ID NO: 2347397 - DNA, 20 bp, Homo sapiens
gccatgacagaggctgcacc

SEQ ID NO: 2347398 - DNA, 14 bp, Homo sapiens
gccatgatgtatat

SEQ ID NO: 2347399 - DNA, 14 bp, Homo sapiens
gccatgcagacctc

SEQ ID NO: 2347400 - DNA, 13 bp, Homo sapiens
gccatgccagctg

SEQ ID NO: 2347401 - DNA, 23 bp, Homo sapiens
gccatggatctgatctgtaccat

SEQ ID NO: 2347402 - DNA, 18 bp, Homo sapiens
gccatggcctgcaaactg

SEQ ID NO: 2347403 - DNA, 16 bp, Homo sapiens
gccatgggcctgctgc

SEQ ID NO: 2347404 - DNA, 18 bp, Homo sapiens
gccatgtccaaagaggct

SEQ ID NO: 2347405 - DNA, 19 bp, Homo sapiens
gccatgtccaaagaggctg

SEQ ID NO: 2347406 - DNA, 22 bp, Homo sapiens
gccatgtcttctccctggaatg

SEQ ID NO: 2347407 - DNA, 17 bp, Homo sapiens
gccatgtgaagagggag

SEQ ID NO: 2347408 - DNA, 20 bp, Homo sapiens
gccatgtgcatagtttcttt

SEQ ID NO: 2347409 - DNA, 16 bp, Homo sapiens
gccattccaaaatatt

SEQ ID NO: 2347410 - DNA, 22 bp, Homo sapiens
gccattccaagtcaacactctt

SEQ ID NO: 2347411 - DNA, 12 bp, Homo sapiens
gccatttgcaat

SEQ ID NO: 2347412 - DNA, 17 bp, Homo sapiens
gccatttgcaataacag

SEQ ID NO: 2347413 - DNA, 13 bp, Homo sapiens
gccattttgtgaa

SEQ ID NO: 2347414 - DNA, 15 bp, Homo sapiens
gcccaagcttccctc

SEQ ID NO: 2347415 - DNA, 18 bp, Homo sapiens
gcccaagcttccctccat

SEQ ID NO: 2347416 - DNA, 14 bp, Homo sapiens
gcccaatgaataat

SEQ ID NO: 2347417 - DNA, 14 bp, Homo sapiens
gcccaccccctgcc

SEQ ID NO: 2347418 - DNA, 12 bp, Homo sapiens
gcccagaaagcc

SEQ ID NO: 2347419 - DNA, 17 bp, Homo sapiens
gcccagaaagcctctct

SEQ ID NO: 2347420 - DNA, 18 bp, Homo sapiens
gcccagaaagcctctctc

SEQ ID NO: 2347421 - DNA, 12 bp, Homo sapiens
gcccagagactt

SEQ ID NO: 2347422 - DNA, 12 bp, Homo sapiens
gcccagaggtaa

SEQ ID NO: 2347423 - DNA, 16 bp, Homo sapiens
gcccagaggtaacaga

SEQ ID NO: 2347424 - DNA, 20 bp, Homo sapiens
gcccagagtgagctttagct

SEQ ID NO: 2347425 - DNA, 20 bp, Homo sapiens
gcccagatgtgtccccccca

SEQ ID NO: 2347426 - DNA, 19 bp, Homo sapiens
gcccagattcccctgtgtc

SEQ ID NO: 2347427 - DNA, 21 bp, Homo sapiens
gcccagattcccctgtgtcat

SEQ ID NO: 2347428 - DNA, 19 bp, Homo sapiens
gcccagcccctgtttactg

SEQ ID NO: 2347429 - DNA, 21 bp, Homo sapiens
gcctacatcccgggcctcagt

SEQ ID NO: 2347430 - DNA, 22 bp, Homo sapiens
gcctacatcccgggcctcagtg

SEQ ID NO: 2347431 - DNA, 17 bp, Homo sapiens
gcctagcgatctctcct

SEQ ID NO: 2347432 - DNA, 22 bp, Homo sapiens
gcctagcgatctctcctggcct

SEQ ID NO: 2347433 - DNA, 12 bp, Homo sapiens
gcctagggcaga

SEQ ID NO: 2347434 - DNA, 23 bp, Homo sapiens
gcctatgcacatatggactctgc

SEQ ID NO: 2347435 - DNA, 18 bp, Homo sapiens
gcctatgtggtctaaggt

SEQ ID NO: 2347436 - DNA, 15 bp, Homo sapiens
gcctattgatacttg

SEQ ID NO: 2347437 - DNA, 16 bp, Homo sapiens
gcctatttaacaagat

SEQ ID NO: 2347438 - DNA, 21 bp, Homo sapiens
gcctatttaacaagatgtttc

SEQ ID NO: 2347439 - DNA, 20 bp, Homo sapiens
gcctcaagcaatccacctgc

SEQ ID NO: 2347440 - DNA, 13 bp, Homo sapiens
gcctcagccctca

SEQ ID NO: 2347441 - DNA, 14 bp, Homo sapiens
gcctcagccctcag

SEQ ID NO: 2347442 - DNA, 15 bp, Homo sapiens
gcctcagccctcagt

SEQ ID NO: 2347443 - DNA, 19 bp, Homo sapiens
gcctcagccctcagttcct

SEQ ID NO: 2347444 - DNA, 17 bp, Homo sapiens
gcctcaggtgctgtcca

SEQ ID NO: 2347445 - DNA, 17 bp, Homo sapiens
gcctcagttttccttct

SEQ ID NO: 2347446 - DNA, 15 bp, Homo sapiens
gcctcatactcctgg

SEQ ID NO: 2347447 - DNA, 16 bp, Homo sapiens
gcctcatactcctggg

SEQ ID NO: 2347448 - DNA, 18 bp, Homo sapiens
gcctcatactcctgggct

SEQ ID NO: 2347449 - DNA, 22 bp, Homo sapiens
gcctcatactcctgggctcaag

SEQ ID NO: 2347450 - DNA, 19 bp, Homo sapiens
gcctccaagcacagagcct

SEQ ID NO: 2347451 - DNA, 20 bp, Homo sapiens
gcctccaagcacagagcctg

SEQ ID NO: 2347452 - DNA, 23 bp, Homo sapiens
gcctccaagcacagagcctggcc

SEQ ID NO: 2347453 - DNA, 21 bp, Homo sapiens
gcctccacagcgagggcagct

SEQ ID NO: 2347454 - DNA, 14 bp, Homo sapiens
gcctcccaggcaag

SEQ ID NO: 2347455 - DNA, 19 bp, Homo sapiens
gcctcccaggcaagcagct

SEQ ID NO: 2347456 - DNA, 16 bp, Homo sapiens
gcctccccatttccca

SEQ ID NO: 2347457 - DNA, 18 bp, Homo sapiens
gcctccccatttcccatc

SEQ ID NO: 2347458 - DNA, 18 bp, Homo sapiens
gcctccgagagggagaga

SEQ ID NO: 2347459 - DNA, 14 bp, Homo sapiens
gcctcctgtgcctg

SEQ ID NO: 2347460 - DNA, 20 bp, Homo sapiens
gcctccttctgagctcctgt

SEQ ID NO: 2347461 - DNA, 21 bp, Homo sapiens
gcctccttctgagctcctgtc

SEQ ID NO: 2347462 - DNA, 14 bp, Homo sapiens
gcctcgcatcctat

SEQ ID NO: 2347463 - DNA, 16 bp, Homo sapiens
gcctctcatcaactga

SEQ ID NO: 2347464 - DNA, 17 bp, Homo sapiens
gcctctccaaccactgt

SEQ ID NO: 2347465 - DNA, 21 bp, Homo sapiens
gcctctccaaccactgtgcca

SEQ ID NO: 2347466 - DNA, 13 bp, Homo sapiens
gcctctcccaggc

SEQ ID NO: 2347467 - DNA, 18 bp, Homo sapiens
gcctctcccaggctgtcc

SEQ ID NO: 2347468 - DNA, 13 bp, Homo sapiens
gcctctctagcac

SEQ ID NO: 2347469 - DNA, 21 bp, Homo sapiens
gcctctctggaaagaggctct

SEQ ID NO: 2347470 - DNA, 19 bp, Homo sapiens
gcctctgagaagctctgaa

SEQ ID NO: 2347471 - DNA, 17 bp, Homo sapiens
gcctctgcccgcagagc

SEQ ID NO: 2347472 - DNA, 16 bp, Homo sapiens
gcctctggacagccag

SEQ ID NO: 2347473 - DNA, 17 bp, Homo sapiens
gcctctggacagccagt

SEQ ID NO: 2347474 - DNA, 19 bp, Homo sapiens
gcctctggacagccagtga

SEQ ID NO: 2347475 - DNA, 17 bp, Homo sapiens
gcctcttgtaaagactg

SEQ ID NO: 2347476 - DNA, 16 bp, Homo sapiens
gcctctttccctagga

SEQ ID NO: 2347477 - DNA, 20 bp, Homo sapiens
gcctgaacagaagctcttac

SEQ ID NO: 2347478 - DNA, 17 bp, Homo sapiens
gcctgaatcatgagcct

SEQ ID NO: 2347479 - DNA, 23 bp, Homo sapiens
gcctgaatcatgagcctgctgga

SEQ ID NO: 2347480 - DNA, 14 bp, Homo sapiens
gcctgagaggcagg

SEQ ID NO: 2347481 - DNA, 18 bp, Homo sapiens
gcctgagaggcaggcata

SEQ ID NO: 2347482 - DNA, 19 bp, Homo sapiens
gcctgagaggcaggcatag

SEQ ID NO: 2347483 - DNA, 21 bp, Homo sapiens
gcctgagagtatttaggcaga

SEQ ID NO: 2347484 - DNA, 20 bp, Homo sapiens
gcctgagagtcagctctctg

SEQ ID NO: 2347485 - DNA, 11 bp, Homo sapiens
gcctgagcccc

SEQ ID NO: 2347486 - DNA, 12 bp, Homo sapiens
gcctgagcccct

SEQ ID NO: 2347487 - DNA, 21 bp, Homo sapiens
gcctgagcccctttgcctgtc

SEQ ID NO: 2347488 - DNA, 16 bp, Homo sapiens
gcctgaggtcccctcg

SEQ ID NO: 2347489 - DNA, 16 bp, Homo sapiens
gcctgagtcagtgctc

SEQ ID NO: 2347490 - DNA, 13 bp, Homo sapiens
gcctgcaaactgg

SEQ ID NO: 2347491 - DNA, 16 bp, Homo sapiens
gcctgcaaactgggaa

SEQ ID NO: 2347492 - DNA, 17 bp, Homo sapiens
gcctgcaggcagagctg

SEQ ID NO: 2347493 - DNA, 16 bp, Homo sapiens
gcctgcattgagcttg

SEQ ID NO: 2347494 - DNA, 21 bp, Homo sapiens
gcctgcattgagcttgcatgc

SEQ ID NO: 2347495 - DNA, 14 bp, Homo sapiens
gcctgcatttcctc

SEQ ID NO: 2347496 - DNA, 20 bp, Homo sapiens
gcctgccgggctgagggcct

SEQ ID NO: 2347497 - DNA, 15 bp, Homo sapiens
gcctgcgcctgctgc

SEQ ID NO: 2347498 - DNA, 17 bp, Homo sapiens
gcctgcgcctgctgcct

SEQ ID NO: 2347499 - DNA, 17 bp, Homo sapiens
gcctgctggaagcccag

SEQ ID NO: 2347500 - DNA, 17 bp, Homo sapiens
gcctgctggaggcctca

SEQ ID NO: 2347501 - DNA, 16 bp, Homo sapiens
gcctgctggcacccac

SEQ ID NO: 2347502 - DNA, 17 bp, Homo sapiens
gcctgctggcacccacc

SEQ ID NO: 2347503 - DNA, 19 bp, Homo sapiens
gcctgctggcacccaccgt

SEQ ID NO: 2347504 - DNA, 21 bp, Homo sapiens
gcctgctggccgacccactga

SEQ ID NO: 2347505 - DNA, 21 bp, Homo sapiens
gcctggagacaaggtgctaac

SEQ ID NO: 2347506 - DNA, 14 bp, Homo sapiens
gcctggcacacatc

SEQ ID NO: 2347507 - DNA, 14 bp, Homo sapiens
gcctggccaccagc

SEQ ID NO: 2347508 - DNA, 16 bp, Homo sapiens
gcctggccaccagcca

SEQ ID NO: 2347509 - DNA, 17 bp, Homo sapiens
gcctggccaccagccat

SEQ ID NO: 2347510 - DNA, 15 bp, Homo sapiens
gcctggccaggagca

SEQ ID NO: 2347511 - DNA, 17 bp, Homo sapiens
gcctggccaggagcagg

SEQ ID NO: 2347512 - DNA, 13 bp, Homo sapiens
gcctggccccagc

SEQ ID NO: 2347513 - DNA, 17 bp, Homo sapiens
gcctggccccagcctgg

SEQ ID NO: 2347514 - DNA, 15 bp, Homo sapiens
gcctggccccaggcc

SEQ ID NO: 2347515 - DNA, 13 bp, Homo sapiens
gcctggcccccaa

SEQ ID NO: 2347516 - DNA, 16 bp, Homo sapiens
gcctggcctggcacac

SEQ ID NO: 2347517 - DNA, 13 bp, Homo sapiens
gcctggcctggcc

SEQ ID NO: 2347518 - DNA, 16 bp, Homo sapiens
gcctgggaaaccctct

SEQ ID NO: 2347519 - DNA, 22 bp, Homo sapiens
gcctgggacaactgctcccacc

SEQ ID NO: 2347520 - DNA, 17 bp, Homo sapiens
gcctgggacttccatgc

SEQ ID NO: 2347521 - DNA, 21 bp, Homo sapiens
gcctgggacttccatgcctta

SEQ ID NO: 2347522 - DNA, 10 bp, Homo sapiens
gcctgggagg

SEQ ID NO: 2347523 - DNA, 12 bp, Homo sapiens
gcctgtcctggt

SEQ ID NO: 2347524 - DNA, 16 bp, Homo sapiens
gcctgtcctggtacag

SEQ ID NO: 2347525 - DNA, 21 bp, Homo sapiens
gcctgtctgccccagcccaga

SEQ ID NO: 2347526 - DNA, 15 bp, Homo sapiens
gctttccctgcctct

SEQ ID NO: 2347527 - DNA, 13 bp, Homo sapiens
gctttctcaatgt

SEQ ID NO: 2347528 - DNA, 21 bp, Homo sapiens
gctttctctctagtagttaga

SEQ ID NO: 2347529 - DNA, 14 bp, Homo sapiens
gctttctgggatgt

SEQ ID NO: 2347530 - DNA, 22 bp, Homo sapiens
gctttctgggatgtcacagtcc

SEQ ID NO: 2347531 - DNA, 16 bp, Homo sapiens
gctttgaaacctcagg

SEQ ID NO: 2347532 - DNA, 19 bp, Homo sapiens
gctttgactctataagcaa

SEQ ID NO: 2347533 - DNA, 14 bp, Homo sapiens
gctttgagaagcct

SEQ ID NO: 2347534 - DNA, 19 bp, Homo sapiens
gctttgatgttccttccag

SEQ ID NO: 2347535 - DNA, 20 bp, Homo sapiens
gctttgatgttccttccagt

SEQ ID NO: 2347536 - DNA, 19 bp, Homo sapiens
gctttgccatgggcctgct

SEQ ID NO: 2347537 - DNA, 21 bp, Homo sapiens
gctttgccatgggcctgctgc

SEQ ID NO: 2347538 - DNA, 16 bp, Homo sapiens
gctttggctgagacct

SEQ ID NO: 2347539 - DNA, 19 bp, Homo sapiens
gcttttatagaggctagct

SEQ ID NO: 2347540 - DNA, 13 bp, Homo sapiens
gcttttctaatta

SEQ ID NO: 2347541 - DNA, 14 bp, Homo sapiens
gcttttctgccctg

SEQ ID NO: 2347542 - DNA, 18 bp, Homo sapiens
gcttttgcttgatccaga

SEQ ID NO: 2347543 - DNA, 13 bp, Homo sapiens
gctttttaattgt

SEQ ID NO: 2347544 - DNA, 20 bp, Homo sapiens
gctttttaattgttgtttct

SEQ ID NO: 2347545 - DNA, 22 bp, Homo sapiens
gctttttaattgttgtttcttt

SEQ ID NO: 2347546 - DNA, 20 bp, Homo sapiens
gcttttttccaaaacaaaaa

SEQ ID NO: 2347547 - DNA, 15 bp, Homo sapiens
ggaaaaaaacaaaaa

SEQ ID NO: 2347548 - DNA, 12 bp, Homo sapiens
ggaaaacatttg

SEQ ID NO: 2347549 - DNA, 17 bp, Homo sapiens
ggaaaagacacattttt

SEQ ID NO: 2347550 - DNA, 18 bp, Homo sapiens
ggaaaagataaagaccag

SEQ ID NO: 2347551 - DNA, 16 bp, Homo sapiens
ggaaaatggccatgca

SEQ ID NO: 2347552 - DNA, 17 bp, Homo sapiens
ggaaaatggccatgcag

SEQ ID NO: 2347553 - DNA, 23 bp, Homo sapiens
ggaaacatacagaggatgccttt

SEQ ID NO: 2347554 - DNA, 18 bp, Homo sapiens
ggaaactccacatctgcc

SEQ ID NO: 2347555 - DNA, 23 bp, Homo sapiens
ggaaagctcttcctaatcgctaa

SEQ ID NO: 2347556 - DNA, 15 bp, Homo sapiens
ggaaagggctggctc

SEQ ID NO: 2347557 - DNA, 19 bp, Homo sapiens
ggaaaggggagagcctgct

SEQ ID NO: 2347558 - DNA, 15 bp, Homo sapiens
ggaaatgaagcaggg

SEQ ID NO: 2347559 - DNA, 16 bp, Homo sapiens
ggaaattcctgtactg

SEQ ID NO: 2347560 - DNA, 14 bp, Homo sapiens
ggaacaaacagggc

SEQ ID NO: 2347561 - DNA, 21 bp, Homo sapiens
ggaacagtaaagaaagcagaa

SEQ ID NO: 2347562 - DNA, 14 bp, Homo sapiens
ggaacatactgttc

SEQ ID NO: 2347563 - DNA, 15 bp, Homo sapiens
ggaacatgccccctg

SEQ ID NO: 2347564 - DNA, 19 bp, Homo sapiens
ggaacccctttcccacccc

SEQ ID NO: 2347565 - DNA, 14 bp, Homo sapiens
ggaacgactggact

SEQ ID NO: 2347566 - DNA, 16 bp, Homo sapiens
ggaactgtcctttcct

SEQ ID NO: 2347567 - DNA, 14 bp, Homo sapiens
ggaagaacatagaa

SEQ ID NO: 2347568 - DNA, 22 bp, Homo sapiens
ggaagaagaaatctttctccct

SEQ ID NO: 2347569 - DNA, 15 bp, Homo sapiens
ggaagaagggagaag

SEQ ID NO: 2347570 - DNA, 16 bp, Homo sapiens
ggaagaagggagaaga

SEQ ID NO: 2347571 - DNA, 18 bp, Homo sapiens
ggaagaagggagaagaaa

SEQ ID NO: 2347572 - DNA, 17 bp, Homo sapiens
ggaagaagtgagcagtg

SEQ ID NO: 2347573 - DNA, 16 bp, Homo sapiens
ggaagaatgaaagctg

SEQ ID NO: 2347574 - DNA, 14 bp, Homo sapiens
ggaagagaggcacc

SEQ ID NO: 2347575 - DNA, 15 bp, Homo sapiens
ggaagagaggcacct

SEQ ID NO: 2347576 - DNA, 15 bp, Homo sapiens
ggaagagcccagtct

SEQ ID NO: 2347577 - DNA, 16 bp, Homo sapiens
ggaagagcccagtctg

SEQ ID NO: 2347578 - DNA, 15 bp, Homo sapiens
ggaagatcactgtag

SEQ ID NO: 2347579 - DNA, 19 bp, Homo sapiens
ggaagcagggaattcctgg

SEQ ID NO: 2347580 - DNA, 12 bp, Homo sapiens
ggaagccagagc

SEQ ID NO: 2347581 - DNA, 13 bp, Homo sapiens
ggaagccagagcc

SEQ ID NO: 2347582 - DNA, 16 bp, Homo sapiens
ggaagccagctttccc

SEQ ID NO: 2347583 - DNA, 20 bp, Homo sapiens
ggaagccatattcacacctc

SEQ ID NO: 2347584 - DNA, 16 bp, Homo sapiens
ggaaggagaagtaaga

SEQ ID NO: 2347585 - DNA, 13 bp, Homo sapiens
ggaaggatctgct

SEQ ID NO: 2347586 - DNA, 18 bp, Homo sapiens
ggaaggatctgctgaggc

SEQ ID NO: 2347587 - DNA, 15 bp, Homo sapiens
ggaaggcctgagccc

SEQ ID NO: 2347588 - DNA, 16 bp, Homo sapiens
ggaaggcctgagcccc

SEQ ID NO: 2347589 - DNA, 19 bp, Homo sapiens
ggaaggcgagtctggggac

SEQ ID NO: 2347590 - DNA, 15 bp, Homo sapiens
ggaagggaaagtttt

SEQ ID NO: 2347591 - DNA, 12 bp, Homo sapiens
ggaagggaagcg

SEQ ID NO: 2347592 - DNA, 15 bp, Homo sapiens
ggaagggtttctcta

SEQ ID NO: 2347593 - DNA, 15 bp, Homo sapiens
ggaagtcctggcaca

SEQ ID NO: 2347594 - DNA, 15 bp, Homo sapiens
ggaagtttagctctg

SEQ ID NO: 2347595 - DNA, 17 bp, Homo sapiens
ggaagtttagctctgag

SEQ ID NO: 2347596 - DNA, 18 bp, Homo sapiens
ggaataaaaggcttgaag

SEQ ID NO: 2347597 - DNA, 21 bp, Homo sapiens
ggaataacttttacacgacca

SEQ ID NO: 2347598 - DNA, 12 bp, Homo sapiens
ggaatcctggca

SEQ ID NO: 2347599 - DNA, 21 bp, Homo sapiens
ggaatcctggcagcccagaga

SEQ ID NO: 2347600 - DNA, 15 bp, Homo sapiens
ggaatggaaggcttt

SEQ ID NO: 2347601 - DNA, 19 bp, Homo sapiens
ggaatggaaggctttgcca

SEQ ID NO: 2347602 - DNA, 20 bp, Homo sapiens
ggaatgtttttccctcccca

SEQ ID NO: 2347603 - DNA, 22 bp, Homo sapiens
ggaatgtttttccctccccaga

SEQ ID NO: 2347604 - DNA, 14 bp, Homo sapiens
ggacacacagccta

SEQ ID NO: 2347605 - DNA, 13 bp, Homo sapiens
ggacacagaccca

SEQ ID NO: 2347606 - DNA, 23 bp, Homo sapiens
ggacacgagccacaagctgcact

SEQ ID NO: 2347607 - DNA, 20 bp, Homo sapiens
ggacacgcgcgtcgccgcca

SEQ ID NO: 2347608 - DNA, 14 bp, Homo sapiens
ggacactccaggga

SEQ ID NO: 2347609 - DNA, 23 bp, Homo sapiens
ggacactcgtcaccccagccctc

SEQ ID NO: 2347610 - DNA, 17 bp, Homo sapiens
ggacagcatcccttccc

SEQ ID NO: 2347611 - DNA, 19 bp, Homo sapiens
ggacagcttgagccgggcc

SEQ ID NO: 2347612 - DNA, 16 bp, Homo sapiens
ggacaggcagcctcct

SEQ ID NO: 2347613 - DNA, 20 bp, Homo sapiens
ggacatgatttagggaagca

SEQ ID NO: 2347614 - DNA, 16 bp, Homo sapiens
ggacatgcaataaaat

SEQ ID NO: 2347615 - DNA, 22 bp, Homo sapiens
ggacatgcaataaaatttaaaa

SEQ ID NO: 2347616 - DNA, 17 bp, Homo sapiens
ggaccaacctgctctgt

SEQ ID NO: 2347617 - DNA, 20 bp, Homo sapiens
ggaccaacctgctctgtccc

SEQ ID NO: 2347618 - DNA, 22 bp, Homo sapiens
ggaccaccctcactggctctcc

SEQ ID NO: 2347619 - DNA, 14 bp, Homo sapiens
ggaccactcctgtc

SEQ ID NO: 2347620 - DNA, 15 bp, Homo sapiens
ggaccagccagcagc

SEQ ID NO: 2347621 - DNA, 14 bp, Homo sapiens
ggaccagggccctg

SEQ ID NO: 2347622 - DNA, 23 bp, Homo sapiens
ggaccatgccagattctgcctct

SEQ ID NO: 2347623 - DNA, 22 bp, Homo sapiens
ggacccagggaacagccactcc

SEQ ID NO: 2347624 - DNA, 16 bp, Homo sapiens
ggaccgcgtagagagc

SEQ ID NO: 2347625 - DNA, 16 bp, Homo sapiens
ggacctgccaggcagg

SEQ ID NO: 2347626 - DNA, 18 bp, Homo sapiens
ggacctggccccaggctg

SEQ ID NO: 2347627 - DNA, 11 bp, Homo sapiens
ggacctgggaa

SEQ ID NO: 2347628 - DNA, 16 bp, Homo sapiens
ggacctgtggctgtcg

SEQ ID NO: 2347629 - DNA, 18 bp, Homo sapiens
ggacgcacgctcgctgcc

SEQ ID NO: 2347630 - DNA, 19 bp, Homo sapiens
ggacgcacgctcgctgcca

SEQ ID NO: 2347631 - DNA, 21 bp, Homo sapiens
ggacgcacgctcgctgccatc

SEQ ID NO: 2347632 - DNA, 24 bp, Homo sapiens
ggacgcacgctcgctgccatcacc

SEQ ID NO: 2347633 - DNA, 17 bp, Homo sapiens
ggacgcctgcaggagag

SEQ ID NO: 2347634 - DNA, 14 bp, Homo sapiens
ggacggctcctcag

SEQ ID NO: 2347635 - DNA, 15 bp, Homo sapiens
ggacggctcctcaga

SEQ ID NO: 2347636 - DNA, 14 bp, Homo sapiens
ggacgttggttctg

SEQ ID NO: 2347637 - DNA, 20 bp, Homo sapiens
ggactctgcacatgtcttgt

SEQ ID NO: 2347638 - DNA, 14 bp, Homo sapiens
ggactctgcccctg

SEQ ID NO: 2347639 - DNA, 16 bp, Homo sapiens
ggactgcagtgtggag

SEQ ID NO: 2347640 - DNA, 17 bp, Homo sapiens
ggactgccaggctgttt

SEQ ID NO: 2347641 - DNA, 15 bp, Homo sapiens
ggactggtgccctcc

SEQ ID NO: 2347642 - DNA, 17 bp, Homo sapiens
ggactggtgccctcctc

SEQ ID NO: 2347643 - DNA, 15 bp, Homo sapiens
ggactgtaagggatt

SEQ ID NO: 2347644 - DNA, 21 bp, Homo sapiens
ggacttggtgattacctgaaa

SEQ ID NO: 2347645 - DNA, 12 bp, Homo sapiens
ggacttgtgtct

SEQ ID NO: 2347646 - DNA, 24 bp, Homo sapiens
ggagaaagcttggttctgtgaaca

SEQ ID NO: 2347647 - DNA, 21 bp, Homo sapiens
ggagaaccagggctcttctca

SEQ ID NO: 2347648 - DNA, 18 bp, Homo sapiens
ggagaagcaccagcaatt

SEQ ID NO: 2347649 - DNA, 21 bp, Homo sapiens
ggagacagaggaaagggctgg

SEQ ID NO: 2347650 - DNA, 22 bp, Homo sapiens
ggagacccccccccaactccag

SEQ ID NO: 2347651 - DNA, 22 bp, Homo sapiens
ggagaccctgccacagccagag

SEQ ID NO: 2347652 - DNA, 23 bp, Homo sapiens
ggagaccctgccacagccagagg

SEQ ID NO: 2347653 - DNA, 19 bp, Homo sapiens
ggagacgccatgtgatgga

SEQ ID NO: 2347654 - DNA, 15 bp, Homo sapiens
ggagagaagctggtc

SEQ ID NO: 2347655 - DNA, 10 bp, Homo sapiens
ggagagcagc

SEQ ID NO: 2347656 - DNA, 13 bp, Homo sapiens
ggagagcagctgg

SEQ ID NO: 2347657 - DNA, 17 bp, Homo sapiens
ggagagcagctggctct

SEQ ID NO: 2347658 - DNA, 14 bp, Homo sapiens
ggagagcctgctgg

SEQ ID NO: 2347659 - DNA, 16 bp, Homo sapiens
ggagagcctgctggca

SEQ ID NO: 2347660 - DNA, 13 bp, Homo sapiens
ggagaggatgaga

SEQ ID NO: 2347661 - DNA, 22 bp, Homo sapiens
ggagaggatgagagcccagagg

SEQ ID NO: 2347662 - DNA, 13 bp, Homo sapiens
ggagagggaggtc

SEQ ID NO: 2347663 - DNA, 17 bp, Homo sapiens
ggagagggaggtcactg

SEQ ID NO: 2347664 - DNA, 18 bp, Homo sapiens
ggagatgcttctctcctt

SEQ ID NO: 2347665 - DNA, 13 bp, Homo sapiens
ggagcatcccagg

SEQ ID NO: 2347666 - DNA, 15 bp, Homo sapiens
ggagccagcctccct

SEQ ID NO: 2347667 - DNA, 13 bp, Homo sapiens
ggagcccagggca

SEQ ID NO: 2347668 - DNA, 15 bp, Homo sapiens
ggagcccagggcatc

SEQ ID NO: 2347669 - DNA, 19 bp, Homo sapiens
ggagcggaggttgcagtga

SEQ ID NO: 2347670 - DNA, 12 bp, Homo sapiens
ggagctattttc

SEQ ID NO: 2347671 - DNA, 20 bp, Homo sapiens
ggagcttcttgtttccttgt

SEQ ID NO: 2347672 - DNA, 22 bp, Homo sapiens
ggagcttgggcagtgccccagg

SEQ ID NO: 2347673 - DNA, 20 bp, Homo sapiens
ggaggaagagccacctgcaa

SEQ ID NO: 2347674 - DNA, 23 bp, Homo sapiens
ggaggaagagccacctgcaagat

SEQ ID NO: 2347675 - DNA, 17 bp, Homo sapiens
ggaggaaggcctttctt

SEQ ID NO: 2347676 - DNA, 15 bp, Homo sapiens
ggaggaggaaggcaa

SEQ ID NO: 2347677 - DNA, 22 bp, Homo sapiens
ggaggatttcctacccccgtcc

SEQ ID NO: 2347678 - DNA, 16 bp, Homo sapiens
ggaggcagggctctcc

SEQ ID NO: 2347679 - DNA, 19 bp, Homo sapiens
ggaggcccttgtcgtggga

SEQ ID NO: 2347680 - DNA, 13 bp, Homo sapiens
ggaggcgcccttg

SEQ ID NO: 2347681 - DNA, 21 bp, Homo sapiens
ggagggcaaggggttcccttg

SEQ ID NO: 2347682 - DNA, 14 bp, Homo sapiens
ggaggggagggtaa

SEQ ID NO: 2347683 - DNA, 18 bp, Homo sapiens
ggaggggctcctttccat

SEQ ID NO: 2347684 - DNA, 18 bp, Homo sapiens
ggagggggcttgaagcca

SEQ ID NO: 2347685 - DNA, 21 bp, Homo sapiens
ggagggggcttgaagccaaag

SEQ ID NO: 2347686 - DNA, 17 bp, Homo sapiens
ggaggtggaagaaggga

SEQ ID NO: 2347687 - DNA, 12 bp, Homo sapiens
ggagtagaatac

SEQ ID NO: 2347688 - DNA, 12 bp, Homo sapiens
ggagtcagggtg

SEQ ID NO: 2347689 - DNA, 17 bp, Homo sapiens
ggagtgcagccttctcc

SEQ ID NO: 2347690 - DNA, 17 bp, Homo sapiens
ggagtgggtggcaggtg

SEQ ID NO: 2347691 - DNA, 21 bp, Homo sapiens
ggagttcaccttggaagggcg

SEQ ID NO: 2347692 - DNA, 19 bp, Homo sapiens
ggagttgactgactgagca

SEQ ID NO: 2347693 - DNA, 15 bp, Homo sapiens
ggataagaaaaatgc

SEQ ID NO: 2347694 - DNA, 12 bp, Homo sapiens
ggataagaaagc

SEQ ID NO: 2347695 - DNA, 17 bp, Homo sapiens
ggataccttcttattta

SEQ ID NO: 2347696 - DNA, 17 bp, Homo sapiens
ggatactggcacagagg

SEQ ID NO: 2347697 - DNA, 19 bp, Homo sapiens
ggatcatggtgtaataaga

SEQ ID NO: 2347698 - DNA, 21 bp, Homo sapiens
ggatcatggtgtaataagaca

SEQ ID NO: 2347699 - DNA, 22 bp, Homo sapiens
ggatccccgcctggccaggagc

SEQ ID NO: 2347700 - DNA, 23 bp, Homo sapiens
ggatccccgcctggccaggagca

SEQ ID NO: 2347701 - DNA, 17 bp, Homo sapiens
ggatccttcagcacagg

SEQ ID NO: 2347702 - DNA, 16 bp, Homo sapiens
ggatcggactctgccc

SEQ ID NO: 2347703 - DNA, 15 bp, Homo sapiens
ggatctcagctttga

SEQ ID NO: 2347704 - DNA, 18 bp, Homo sapiens
ggatctgctgaggcccag

SEQ ID NO: 2347705 - DNA, 19 bp, Homo sapiens
ggatgagagcccagaggta

SEQ ID NO: 2347706 - DNA, 20 bp, Homo sapiens
ggatgagagcccagaggtaa

SEQ ID NO: 2347707 - DNA, 23 bp, Homo sapiens
ggatgagagcccagaggtaacag

SEQ ID NO: 2347708 - DNA, 14 bp, Homo sapiens
ggatgcgcagtgcc

SEQ ID NO: 2347709 - DNA, 19 bp, Homo sapiens
ggatggaaggttggatgga

SEQ ID NO: 2347710 - DNA, 18 bp, Homo sapiens
ggatggaccaacctgctc

SEQ ID NO: 2347711 - DNA, 17 bp, Homo sapiens
ggatggcctttccttcc

SEQ ID NO: 2347712 - DNA, 18 bp, Homo sapiens
ggatggggacatttgaac

SEQ ID NO: 2347713 - DNA, 16 bp, Homo sapiens
ggatgggtcagagcta

SEQ ID NO: 2347714 - DNA, 16 bp, Homo sapiens
ggatgggtggatggcc

SEQ ID NO: 2347715 - DNA, 14 bp, Homo sapiens
ggatgtataaattt

SEQ ID NO: 2347716 - DNA, 20 bp, Homo sapiens
ggatgttatgaacagctgtg

SEQ ID NO: 2347717 - DNA, 14 bp, Homo sapiens
ggattcaattttaa

SEQ ID NO: 2347718 - DNA, 15 bp, Homo sapiens
ggattctaaatacat

SEQ ID NO: 2347719 - DNA, 15 bp, Homo sapiens
ggattgcctctgaaa

SEQ ID NO: 2347720 - DNA, 23 bp, Homo sapiens
ggattgctttgcattactgtccc

SEQ ID NO: 2347721 - DNA, 22 bp, Homo sapiens
ggattgtaaaaaaaaatgcctt

SEQ ID NO: 2347722 - DNA, 22 bp, Homo sapiens
ggatttgcacagaagcacatgc

SEQ ID NO: 2347723 - DNA, 14 bp, Homo sapiens
ggattttttccctt

SEQ ID NO: 2347724 - DNA, 16 bp, Homo sapiens
ggcaaaccctcccaga

SEQ ID NO: 2347725 - DNA, 14 bp, Homo sapiens
ggcaacatctttat

SEQ ID NO: 2347726 - DNA, 13 bp, Homo sapiens
ggcaagcagctgg

SEQ ID NO: 2347727 - DNA, 13 bp, Homo sapiens
ggcaagccacagg

SEQ ID NO: 2347728 - DNA, 16 bp, Homo sapiens
ggcaagccacaggaag

SEQ ID NO: 2347729 - DNA, 17 bp, Homo sapiens
ggcaagggttaaggcct

SEQ ID NO: 2347730 - DNA, 16 bp, Homo sapiens
ggcaagtcacttaact

SEQ ID NO: 2347731 - DNA, 17 bp, Homo sapiens
ggcacagtccagaccca

SEQ ID NO: 2347732 - DNA, 17 bp, Homo sapiens
ggcaccagtccctgtcc

SEQ ID NO: 2347733 - DNA, 21 bp, Homo sapiens
ggcacccaccgtggaggagga

SEQ ID NO: 2347734 - DNA, 19 bp, Homo sapiens
ggcaccctcagggagcctc

SEQ ID NO: 2347735 - DNA, 15 bp, Homo sapiens
ggcaccgagaatgtt

SEQ ID NO: 2347736 - DNA, 22 bp, Homo sapiens
ggcacctgacttggctggggag

SEQ ID NO: 2347737 - DNA, 15 bp, Homo sapiens
ggcacgctcctgcct

SEQ ID NO: 2347738 - DNA, 17 bp, Homo sapiens
ggcacgggtggtccccg

SEQ ID NO: 2347739 - DNA, 22 bp, Homo sapiens
ggcactccgcgccgatgccacc

SEQ ID NO: 2347740 - DNA, 23 bp, Homo sapiens
ggcactccgcgccgatgccaccg

SEQ ID NO: 2347741 - DNA, 22 bp, Homo sapiens
ggcagaggttttaatgtctgtt

SEQ ID NO: 2347742 - DNA, 18 bp, Homo sapiens
ggcagatgtcttccctgg

SEQ ID NO: 2347743 - DNA, 17 bp, Homo sapiens
ggcagatgtttgcctca

SEQ ID NO: 2347744 - DNA, 21 bp, Homo sapiens
ggcagattttacagagcgcac

SEQ ID NO: 2347745 - DNA, 14 bp, Homo sapiens
ggcagccagaccag

SEQ ID NO: 2347746 - DNA, 15 bp, Homo sapiens
ggcagccagaccagc

SEQ ID NO: 2347747 - DNA, 15 bp, Homo sapiens
ggcagcctcctttgt

SEQ ID NO: 2347748 - DNA, 12 bp, Homo sapiens
ggcagcctgccg

SEQ ID NO: 2347749 - DNA, 11 bp, Homo sapiens
ggcagctgcta

SEQ ID NO: 2347750 - DNA, 16 bp, Homo sapiens
ggcaggaagggaagcg

SEQ ID NO: 2347751 - DNA, 16 bp, Homo sapiens
ggcaggatggcctttc

SEQ ID NO: 2347752 - DNA, 17 bp, Homo sapiens
ggcaggatggcctttcc

SEQ ID NO: 2347753 - DNA, 21 bp, Homo sapiens
ggcaggatggcctttccttcc

SEQ ID NO: 2347754 - DNA, 13 bp, Homo sapiens
ggcaggctcactg

SEQ ID NO: 2347755 - DNA, 12 bp, Homo sapiens
ggcaggctgggc

SEQ ID NO: 2347756 - DNA, 15 bp, Homo sapiens
ggcagggctctcccg

SEQ ID NO: 2347757 - DNA, 13 bp, Homo sapiens
ggcaggggtgggg

SEQ ID NO: 2347758 - DNA, 16 bp, Homo sapiens
ggcaggggtgggggtg

SEQ ID NO: 2347759 - DNA, 19 bp, Homo sapiens
ggcaggtgggggtgggctg

SEQ ID NO: 2347760 - DNA, 14 bp, Homo sapiens
ggcagtaataaaaa

SEQ ID NO: 2347761 - DNA, 14 bp, Homo sapiens
ggcagtgattctgt

SEQ ID NO: 2347762 - DNA, 13 bp, Homo sapiens
ggcagtgccccag

SEQ ID NO: 2347763 - DNA, 17 bp, Homo sapiens
ggcatacacacagcagt

SEQ ID NO: 2347764 - DNA, 18 bp, Homo sapiens
ggcatccttgtcttttga

SEQ ID NO: 2347765 - DNA, 17 bp, Homo sapiens
ggcatcttgctggctac

SEQ ID NO: 2347766 - DNA, 20 bp, Homo sapiens
ggcatgatcatagctcactg

SEQ ID NO: 2347767 - DNA, 21 bp, Homo sapiens
ggcatgtggcctttatctcaa

SEQ ID NO: 2347768 - DNA, 19 bp, Homo sapiens
ggcattctggacctctggg

SEQ ID NO: 2347769 - DNA, 11 bp, Homo sapiens
ggcattgagta

SEQ ID NO: 2347770 - DNA, 19 bp, Homo sapiens
ggcatttagcacagtattt

SEQ ID NO: 2347771 - DNA, 22 bp, Homo sapiens
ggcatttagcacagtatttaac

SEQ ID NO: 2347772 - DNA, 20 bp, Homo sapiens
ggcatttggtctcaggcagc

SEQ ID NO: 2347773 - DNA, 20 bp, Homo sapiens
ggcattttcctcctctgcct

SEQ ID NO: 2347774 - DNA, 12 bp, Homo sapiens
ggccaagcagaa

SEQ ID NO: 2347775 - DNA, 13 bp, Homo sapiens
ggccaagcctatc

SEQ ID NO: 2347776 - DNA, 17 bp, Homo sapiens
ggccacagcgccagcct

SEQ ID NO: 2347777 - DNA, 15 bp, Homo sapiens
ggccaccaaagctgc

SEQ ID NO: 2347778 - DNA, 15 bp, Homo sapiens
ggccaccagccatcc

SEQ ID NO: 2347779 - DNA, 16 bp, Homo sapiens
ggccacctggctctca

SEQ ID NO: 2347780 - DNA, 22 bp, Homo sapiens
ggccacctggctctcacctcta

SEQ ID NO: 2347781 - DNA, 13 bp, Homo sapiens
ggccagaggctgg

SEQ ID NO: 2347782 - DNA, 15 bp, Homo sapiens
ggccagaggctggga

SEQ ID NO: 2347783 - DNA, 13 bp, Homo sapiens
ggccagcccctgg

SEQ ID NO: 2347784 - DNA, 16 bp, Homo sapiens
ggccagcccctggggc

SEQ ID NO: 2347785 - DNA, 20 bp, Homo sapiens
ggccagcccctggggcccag

SEQ ID NO: 2347786 - DNA, 22 bp, Homo sapiens
ggccagcccctggggcccagcc

SEQ ID NO: 2347787 - DNA, 14 bp, Homo sapiens
ggccagcggggctg

SEQ ID NO: 2347788 - DNA, 13 bp, Homo sapiens
ggccaggagcagg

SEQ ID NO: 2347789 - DNA, 21 bp, Homo sapiens
ggccaggagcaggcacgggtg

SEQ ID NO: 2347790 - DNA, 23 bp, Homo sapiens
ggccataaacggttcctggtgac

SEQ ID NO: 2347791 - DNA, 14 bp, Homo sapiens
ggccatgcagacct

SEQ ID NO: 2347792 - DNA, 11 bp, Homo sapiens
ggccatgcagg

SEQ ID NO: 2347793 - DNA, 15 bp, Homo sapiens
ggccatgcaggaggt

SEQ ID NO: 2347794 - DNA, 22 bp, Homo sapiens
ggccatgtccaaagaggctgcc

SEQ ID NO: 2347795 - DNA, 18 bp, Homo sapiens
ggcccagaaagcctctct

SEQ ID NO: 2347796 - DNA, 17 bp, Homo sapiens
ggcccagaccactgtct

SEQ ID NO: 2347797 - DNA, 17 bp, Homo sapiens
ggcccagcctgtcctgg

SEQ ID NO: 2347798 - DNA, 11 bp, Homo sapiens
ggccccacttt

SEQ ID NO: 2347799 - DNA, 14 bp, Homo sapiens
ggccccagccctgc

SEQ ID NO: 2347800 - DNA, 18 bp, Homo sapiens
ggccccagccctgctggg

SEQ ID NO: 2347801 - DNA, 22 bp, Homo sapiens
ggccccagccctgctggggatc

SEQ ID NO: 2347802 - DNA, 11 bp, Homo sapiens
ggccccagcct

SEQ ID NO: 2347803 - DNA, 22 bp, Homo sapiens
ggccccagcctgggccatctct

SEQ ID NO: 2347804 - DNA, 13 bp, Homo sapiens
ggccccaggcccc

SEQ ID NO: 2347805 - DNA, 16 bp, Homo sapiens
ggcccccaacctcagg

SEQ ID NO: 2347806 - DNA, 23 bp, Homo sapiens
ggcccccaacctcagggctccca

SEQ ID NO: 2347807 - DNA, 12 bp, Homo sapiens
ggcccctctccc

SEQ ID NO: 2347808 - DNA, 19 bp, Homo sapiens
ggcccgcctctcctcggtt

SEQ ID NO: 2347809 - DNA, 15 bp, Homo sapiens
ggccctgactcctct

SEQ ID NO: 2347810 - DNA, 11 bp, Homo sapiens
ggccctgaggc

SEQ ID NO: 2347811 - DNA, 14 bp, Homo sapiens
ggccctgggcaggg

SEQ ID NO: 2347812 - DNA, 22 bp, Homo sapiens
ggccctgtccaggtagaaaaga

SEQ ID NO: 2347813 - DNA, 17 bp, Homo sapiens
ggccctgtcccaggccg

SEQ ID NO: 2347814 - DNA, 18 bp, Homo sapiens
ggccctgttccctggagt

SEQ ID NO: 2347815 - DNA, 22 bp, Homo sapiens
ggccctgttccctggagtcagg

SEQ ID NO: 2347816 - DNA, 16 bp, Homo sapiens
ggcccttagagacccc

SEQ ID NO: 2347817 - DNA, 18 bp, Homo sapiens
ggccgcttctccccagag

SEQ ID NO: 2347818 - DNA, 23 bp, Homo sapiens
ggccgcttctccccagagctgcc

SEQ ID NO: 2347819 - DNA, 13 bp, Homo sapiens
ggcctagactctg

SEQ ID NO: 2347820 - DNA, 21 bp, Homo sapiens
ggcctatgcacatatggactc

SEQ ID NO: 2347821 - DNA, 19 bp, Homo sapiens
ggcctcagctcaatgcagt

SEQ ID NO: 2347822 - DNA, 18 bp, Homo sapiens
ggcctcaggtgctgtcca

SEQ ID NO: 2347823 - DNA, 19 bp, Homo sapiens
ggcctcaggtgctgtccat

SEQ ID NO: 2347824 - DNA, 16 bp, Homo sapiens
ggcctcagtgccccat

SEQ ID NO: 2347825 - DNA, 12 bp, Homo sapiens
ggcctcccaaag

SEQ ID NO: 2347826 - DNA, 18 bp, Homo sapiens
ggcctcctgggggacctt

SEQ ID NO: 2347827 - DNA, 23 bp, Homo sapiens
ggcctctccaaccactgtgccac

SEQ ID NO: 2347828 - DNA, 18 bp, Homo sapiens
ggcctgaagccagctgcc

SEQ ID NO: 2347829 - DNA, 20 bp, Homo sapiens
ggcctgaagccagctgccct

SEQ ID NO: 2347830 - DNA, 14 bp, Homo sapiens
ggcctgactgctca

SEQ ID NO: 2347831 - DNA, 15 bp, Homo sapiens
ggcctgagagtcagc

SEQ ID NO: 2347832 - DNA, 18 bp, Homo sapiens
ggcctgcaaactgggaac

SEQ ID NO: 2347833 - DNA, 18 bp, Homo sapiens
ggcctgctgcgtcagacc

SEQ ID NO: 2347834 - DNA, 19 bp, Homo sapiens
ggcctgctgcgtcagacca

SEQ ID NO: 2347835 - DNA, 15 bp, Homo sapiens
ggcctgctggaggcc

SEQ ID NO: 2347836 - DNA, 18 bp, Homo sapiens
ggcctgctggaggcctca

SEQ ID NO: 2347837 - DNA, 10 bp, Homo sapiens
ggcctgctgt

SEQ ID NO: 2347838 - DNA, 19 bp, Homo sapiens
ggcctgctgtgattccact

SEQ ID NO: 2347839 - DNA, 20 bp, Homo sapiens
ggcctgtgggtctctgaagg

SEQ ID NO: 2347840 - DNA, 20 bp, Homo sapiens
ggcctgtttgaaagtaaaaa

SEQ ID NO: 2347841 - DNA, 17 bp, Homo sapiens
ggccttaatttcctttt

SEQ ID NO: 2347842 - DNA, 20 bp, Homo sapiens
ggccttaatttcctttttga

SEQ ID NO: 2347843 - DNA, 22 bp, Homo sapiens
ggccttatcgggctccagccat

SEQ ID NO: 2347844 - DNA, 20 bp, Homo sapiens
ggccttcacaatctgtcagt

SEQ ID NO: 2347845 - DNA, 18 bp, Homo sapiens
ggccttgatgactgcctt

SEQ ID NO: 2347846 - DNA, 13 bp, Homo sapiens
ggcgaatctcaaa

SEQ ID NO: 2347847 - DNA, 17 bp, Homo sapiens
ggcgaccaccgcccctg

SEQ ID NO: 2347848 - DNA, 20 bp, Homo sapiens
ggcgcaggtgggctggactt

SEQ ID NO: 2347849 - DNA, 21 bp, Homo sapiens
ggcgccctgcctcctggagga

SEQ ID NO: 2347850 - DNA, 16 bp, Homo sapiens
ggcggcgcagagggaa

SEQ ID NO: 2347851 - DNA, 16 bp, Homo sapiens
ggcgggtgatggccag

SEQ ID NO: 2347852 - DNA, 16 bp, Homo sapiens
ggcgtggcccaaggct

SEQ ID NO: 2347853 - DNA, 13 bp, Homo sapiens
ggctacgcctctt

SEQ ID NO: 2347854 - DNA, 22 bp, Homo sapiens
ggctagcttctgcttttctgcc

SEQ ID NO: 2347855 - DNA, 22 bp, Homo sapiens
ggctagggagacgccatgtgat

SEQ ID NO: 2347856 - DNA, 13 bp, Homo sapiens
ggctatcctgatt

SEQ ID NO: 2347857 - DNA, 21 bp, Homo sapiens
ggctcaagcaatcctcctgcc

SEQ ID NO: 2347858 - DNA, 22 bp, Homo sapiens
ggctcaagcaatcctcctgcct

SEQ ID NO: 2347859 - DNA, 12 bp, Homo sapiens
ggctcaagtctg

SEQ ID NO: 2347860 - DNA, 23 bp, Homo sapiens
ggctcacgcctgtaatcccagca

SEQ ID NO: 2347861 - DNA, 13 bp, Homo sapiens
ggctcactgccag

SEQ ID NO: 2347862 - DNA, 15 bp, Homo sapiens
ggctcactgccaggc

SEQ ID NO: 2347863 - DNA, 16 bp, Homo sapiens
ggctcactgccaggcc

SEQ ID NO: 2347864 - DNA, 20 bp, Homo sapiens
ggctcactgccaggccagcc

SEQ ID NO: 2347865 - DNA, 22 bp, Homo sapiens
ggctcactgccaggccagcctc

SEQ ID NO: 2347866 - DNA, 21 bp, Homo sapiens
ggctcataaaacatgaatcaa

SEQ ID NO: 2347867 - DNA, 20 bp, Homo sapiens
ggctcccaggggtctccctg

SEQ ID NO: 2347868 - DNA, 16 bp, Homo sapiens
gggcaggcttggggaa

SEQ ID NO: 2347869 - DNA, 15 bp, Homo sapiens
gggcagggtctgggc

SEQ ID NO: 2347870 - DNA, 18 bp, Homo sapiens
gggcagtgccccagggag

SEQ ID NO: 2347871 - DNA, 16 bp, Homo sapiens
gggcatcttgctggct

SEQ ID NO: 2347872 - DNA, 13 bp, Homo sapiens
gggcattttcctc

SEQ ID NO: 2347873 - DNA, 15 bp, Homo sapiens
gggccagaggctggg

SEQ ID NO: 2347874 - DNA, 16 bp, Homo sapiens
gggccagggctgcccc

SEQ ID NO: 2347875 - DNA, 15 bp, Homo sapiens
gccttctcagaagca

SEQ ID NO: 2347876 - DNA, 15 bp, Homo sapiens
gccttgatgactgcc

SEQ ID NO: 2347877 - DNA, 22 bp, Homo sapiens
gccttgatgactgccttgcctc

SEQ ID NO: 2347878 - DNA, 12 bp, Homo sapiens
gccttgcctcct

SEQ ID NO: 2347879 - DNA, 19 bp, Homo sapiens
gccttgctacctcaagggg

SEQ ID NO: 2347880 - DNA, 17 bp, Homo sapiens
gccttgctgtttgtcct

SEQ ID NO: 2347881 - DNA, 21 bp, Homo sapiens
gccttgcttctgtatttcctt

SEQ ID NO: 2347882 - DNA, 17 bp, Homo sapiens
gccttggaaccagcccc

SEQ ID NO: 2347883 - DNA, 22 bp, Homo sapiens
gccttgtataatattgaaaatt

SEQ ID NO: 2347884 - DNA, 20 bp, Homo sapiens
gcctttccttccctctctga

SEQ ID NO: 2347885 - DNA, 11 bp, Homo sapiens
gcctttcttct

SEQ ID NO: 2347886 - DNA, 16 bp, Homo sapiens
gcctttcttctgtgtt

SEQ ID NO: 2347887 - DNA, 13 bp, Homo sapiens
gcctttgaatgta

SEQ ID NO: 2347888 - DNA, 15 bp, Homo sapiens
gcctttgaatgtaac

SEQ ID NO: 2347889 - DNA, 20 bp, Homo sapiens
gcctttgagacagtttctta

SEQ ID NO: 2347890 - DNA, 17 bp, Homo sapiens
gcctttgtaagtgcagg

SEQ ID NO: 2347891 - DNA, 22 bp, Homo sapiens
gcctttgtgctgcgcctgcagg

SEQ ID NO: 2347892 - DNA, 21 bp, Homo sapiens
gccttttccacacgcattaat

SEQ ID NO: 2347893 - DNA, 13 bp, Homo sapiens
gcgagctgctctg

SEQ ID NO: 2347894 - DNA, 15 bp, Homo sapiens
gcgagctgctctgct

SEQ ID NO: 2347895 - DNA, 16 bp, Homo sapiens
gcgagggcagctgcta

SEQ ID NO: 2347896 - DNA, 14 bp, Homo sapiens
gcgagtccaaggcc

SEQ ID NO: 2347897 - DNA, 14 bp, Homo sapiens
gcgagtctggggac

SEQ ID NO: 2347898 - DNA, 17 bp, Homo sapiens
gcgcagtgttttgcaag

SEQ ID NO: 2347899 - DNA, 14 bp, Homo sapiens
gcgccagtcctgct

SEQ ID NO: 2347900 - DNA, 21 bp, Homo sapiens
gcgccctcactattcttggac

SEQ ID NO: 2347901 - DNA, 14 bp, Homo sapiens
gcgccgatgccacc

SEQ ID NO: 2347902 - DNA, 16 bp, Homo sapiens
gcgcctcagccctcag

SEQ ID NO: 2347903 - DNA, 17 bp, Homo sapiens
gcgcctcagccctcagt

SEQ ID NO: 2347904 - DNA, 18 bp, Homo sapiens
gcgcctgcaggcagagct

SEQ ID NO: 2347905 - DNA, 19 bp, Homo sapiens
gcgcctgcaggcagagctg

SEQ ID NO: 2347906 - DNA, 11 bp, Homo sapiens
gcgcctgctgc

SEQ ID NO: 2347907 - DNA, 20 bp, Homo sapiens
gcgcggtggcgggcacctgt

SEQ ID NO: 2347908 - DNA, 14 bp, Homo sapiens
gcgctcagtaaacg

SEQ ID NO: 2347909 - DNA, 19 bp, Homo sapiens
gcgctctctttgcaactgt

SEQ ID NO: 2347910 - DNA, 19 bp, Homo sapiens
gcggaggttgcagtgagct

SEQ ID NO: 2347911 - DNA, 23 bp, Homo sapiens
gcggcaaacctttcccccttagc

SEQ ID NO: 2347912 - DNA, 12 bp, Homo sapiens
gcggcgcagagg

SEQ ID NO: 2347913 - DNA, 18 bp, Homo sapiens
gcggctcccctctgcttc

SEQ ID NO: 2347914 - DNA, 22 bp, Homo sapiens
gcggctcccctctgcttctcat

SEQ ID NO: 2347915 - DNA, 12 bp, Homo sapiens
gcggctgtgctt

SEQ ID NO: 2347916 - DNA, 20 bp, Homo sapiens
gcgggagggttccgccactc

SEQ ID NO: 2347917 - DNA, 11 bp, Homo sapiens
gcgggccaggg

SEQ ID NO: 2347918 - DNA, 15 bp, Homo sapiens
gcgggccagggtcct

SEQ ID NO: 2347919 - DNA, 18 bp, Homo sapiens
gcgggctgaggccagagt

SEQ ID NO: 2347920 - DNA, 23 bp, Homo sapiens
gcgggtcatattcataccttctg

SEQ ID NO: 2347921 - DNA, 13 bp, Homo sapiens
gcggtgggtgctg

SEQ ID NO: 2347922 - DNA, 14 bp, Homo sapiens
gcgtagagagccgg

SEQ ID NO: 2347923 - DNA, 19 bp, Homo sapiens
gcgtatatacttaagaata

SEQ ID NO: 2347924 - DNA, 17 bp, Homo sapiens
gcgtcagctgctccctg

SEQ ID NO: 2347925 - DNA, 12 bp, Homo sapiens
gcgtccctggcg

SEQ ID NO: 2347926 - DNA, 14 bp, Homo sapiens
gcgtccctggcgca

SEQ ID NO: 2347927 - DNA, 18 bp, Homo sapiens
gcgtccctggcgcaggtg

SEQ ID NO: 2347928 - DNA, 15 bp, Homo sapiens
gcgtctgccccaccc

SEQ ID NO: 2347929 - DNA, 15 bp, Homo sapiens
gcgtggcccaaggct

SEQ ID NO: 2347930 - DNA, 15 bp, Homo sapiens
gcgtgggagccagcc

SEQ ID NO: 2347931 - DNA, 15 bp, Homo sapiens
gcgtgttcagcagaa

SEQ ID NO: 2347932 - DNA, 18 bp, Homo sapiens
gctaaaaatgagcttgat

SEQ ID NO: 2347933 - DNA, 13 bp, Homo sapiens
gctaaaacagctt

SEQ ID NO: 2347934 - DNA, 23 bp, Homo sapiens
gctaaactccttcctggcctgag

SEQ ID NO: 2347935 - DNA, 18 bp, Homo sapiens
gctaaagagcccttgcct

SEQ ID NO: 2347936 - DNA, 17 bp, Homo sapiens
gctaagatataatttaa

SEQ ID NO: 2347937 - DNA, 20 bp, Homo sapiens
gctaatgctatgcaaaaaat

SEQ ID NO: 2347938 - DNA, 21 bp, Homo sapiens
gctaattgtactaatctgaga

SEQ ID NO: 2347939 - DNA, 14 bp, Homo sapiens
gctaatttaacacc

SEQ ID NO: 2347940 - DNA, 13 bp, Homo sapiens
gctacaattttaa

SEQ ID NO: 2347941 - DNA, 17 bp, Homo sapiens
gctacctcaagggggac

SEQ ID NO: 2347942 - DNA, 17 bp, Homo sapiens
gctacgcctcttctgtc

SEQ ID NO: 2347943 - DNA, 14 bp, Homo sapiens
gctactctcttgcc

SEQ ID NO: 2347944 - DNA, 14 bp, Homo sapiens
gctactctggaatg

SEQ ID NO: 2347945 - DNA, 18 bp, Homo sapiens
gctactgcactccagcct

SEQ ID NO: 2347946 - DNA, 21 bp, Homo sapiens
gctactgcactccagcctggg

SEQ ID NO: 2347947 - DNA, 17 bp, Homo sapiens
gctactggggaaactgg

SEQ ID NO: 2347948 - DNA, 18 bp, Homo sapiens
gctactggggaaactggc

SEQ ID NO: 2347949 - DNA, 18 bp, Homo sapiens
gctactgttgtaagaatt

SEQ ID NO: 2347950 - DNA, 19 bp, Homo sapiens
gctactgttgtaagaattc

SEQ ID NO: 2347951 - DNA, 13 bp, Homo sapiens
gctagaaaaataa

SEQ ID NO: 2347952 - DNA, 18 bp, Homo sapiens
gctagatggaatggaaaa

SEQ ID NO: 2347953 - DNA, 11 bp, Homo sapiens
gctagctgcca

SEQ ID NO: 2347954 - DNA, 12 bp, Homo sapiens
gctagctgccac

SEQ ID NO: 2347955 - DNA, 12 bp, Homo sapiens
gctagcttctgc

SEQ ID NO: 2347956 - DNA, 13 bp, Homo sapiens
gctagtgtttcta

SEQ ID NO: 2347957 - DNA, 18 bp, Homo sapiens
gctatccccatctccctg

SEQ ID NO: 2347958 - DNA, 12 bp, Homo sapiens
gctatcctgatt

SEQ ID NO: 2347959 - DNA, 14 bp, Homo sapiens
gctatcgccctcct

SEQ ID NO: 2347960 - DNA, 15 bp, Homo sapiens
gctatcgccctcctt

SEQ ID NO: 2347961 - DNA, 16 bp, Homo sapiens
gctatcgccctccttt

SEQ ID NO: 2347962 - DNA, 19 bp, Homo sapiens
gctatcgccctcctttccc

SEQ ID NO: 2347963 - DNA, 20 bp, Homo sapiens
gctatcgccctcctttccct

SEQ ID NO: 2347964 - DNA, 17 bp, Homo sapiens
gctattagccaggatca

SEQ ID NO: 2347965 - DNA, 21 bp, Homo sapiens
gctattagccaggatcatggt

SEQ ID NO: 2347966 - DNA, 14 bp, Homo sapiens
gctattcacctcag

SEQ ID NO: 2347967 - DNA, 12 bp, Homo sapiens
gctatttaagtg

SEQ ID NO: 2347968 - DNA, 20 bp, Homo sapiens
gctatttattttcctaaaga

SEQ ID NO: 2347969 - DNA, 13 bp, Homo sapiens
gctatttgtgtaa

SEQ ID NO: 2347970 - DNA, 23 bp, Homo sapiens
gctattttcctctggccgcagag

SEQ ID NO: 2347971 - DNA, 17 bp, Homo sapiens
gctattttctaaagact

SEQ ID NO: 2347972 - DNA, 15 bp, Homo sapiens
gctatttttgtaaag

SEQ ID NO: 2347973 - DNA, 20 bp, Homo sapiens
gctatttttgtaaagtttcc

SEQ ID NO: 2347974 - DNA, 21 bp, Homo sapiens
gctcaaataggtcatcatgaa

SEQ ID NO: 2347975 - DNA, 16 bp, Homo sapiens
gctcaagacaaggctg

SEQ ID NO: 2347976 - DNA, 24 bp, Homo sapiens
gctcaagcaatcctcctgcctcag

SEQ ID NO: 2347977 - DNA, 16 bp, Homo sapiens
tagttaaataactgtg

SEQ ID NO: 2347978 - DNA, 16 bp, Homo sapiens
tagttaatcatcaaga

SEQ ID NO: 2347979 - DNA, 16 bp, Homo sapiens
tagttatttttctctt

SEQ ID NO: 2347980 - DNA, 22 bp, Homo sapiens
tagttctcaatcactgctcccc

SEQ ID NO: 2347981 - DNA, 19 bp, Homo sapiens
tagttctgtaataaaactg

SEQ ID NO: 2347982 - DNA, 21 bp, Homo sapiens
tagttctgtaataaaactgtt

SEQ ID NO: 2347983 - DNA, 18 bp, Homo sapiens
tagttgcaaagagacatt

SEQ ID NO: 2347984 - DNA, 13 bp, Homo sapiens
tagttgctatttt

SEQ ID NO: 2347985 - DNA, 14 bp, Homo sapiens
tagttgtaaagata

SEQ ID NO: 2347986 - DNA, 12 bp, Homo sapiens
tagtttctttat

SEQ ID NO: 2347987 - DNA, 22 bp, Homo sapiens
tagtttctttattttgtgtaaa

SEQ ID NO: 2347988 - DNA, 13 bp, Homo sapiens
tagtttgtgagaa

SEQ ID NO: 2347989 - DNA, 22 bp, Homo sapiens
tagttttacttttaaactgtgt

SEQ ID NO: 2347990 - DNA, 12 bp, Homo sapiens
tataaaaaatgg

SEQ ID NO: 2347991 - DNA, 19 bp, Homo sapiens
tataaaagcccatgcttaa

SEQ ID NO: 2347992 - DNA, 12 bp, Homo sapiens
tataaaattatg

SEQ ID NO: 2347993 - DNA, 18 bp, Homo sapiens
tataaacagaaatggaaa

SEQ ID NO: 2347994 - DNA, 16 bp, Homo sapiens
tataaacttaaagcta

SEQ ID NO: 2347995 - DNA, 16 bp, Homo sapiens
tataaaggataaagaa

SEQ ID NO: 2347996 - DNA, 19 bp, Homo sapiens
tataaataggagaggatga

SEQ ID NO: 2347997 - DNA, 14 bp, Homo sapiens
tataaatatacagt

SEQ ID NO: 2347998 - DNA, 15 bp, Homo sapiens
tataaatatacagta

SEQ ID NO: 2347999 - DNA, 20 bp, Homo sapiens
tataaatgtacatttccaaa

SEQ ID NO: 2348000 - DNA, 14 bp, Homo sapiens
tataaatgtataaa

SEQ ID NO: 2348001 - DNA, 13 bp, Homo sapiens
tataacacatttt

SEQ ID NO: 2348002 - DNA, 20 bp, Homo sapiens
tataagatacaataaaacaa

SEQ ID NO: 2348003 - DNA, 21 bp, Homo sapiens
tataagctatgagttgaaatg

SEQ ID NO: 2348004 - DNA, 15 bp, Homo sapiens
tataaggtgcctcag

SEQ ID NO: 2348005 - DNA, 15 bp, Homo sapiens
tataagtagtaaatc

SEQ ID NO: 2348006 - DNA, 19 bp, Homo sapiens
tataagttatttttgtaca

SEQ ID NO: 2348007 - DNA, 20 bp, Homo sapiens
tataagttatttttgtacat

SEQ ID NO: 2348008 - DNA, 22 bp, Homo sapiens
tataagttatttttgtacatgt

SEQ ID NO: 2348009 - DNA, 12 bp, Homo sapiens
tataataaaaat

SEQ ID NO: 2348010 - DNA, 20 bp, Homo sapiens
tataatacagaatcttgttt

SEQ ID NO: 2348011 - DNA, 16 bp, Homo sapiens
tataatgaataaatca

SEQ ID NO: 2348012 - DNA, 21 bp, Homo sapiens
tataatgtgagtagttactaa

SEQ ID NO: 2348013 - DNA, 19 bp, Homo sapiens
tataatgttgataatatat

SEQ ID NO: 2348014 - DNA, 18 bp, Homo sapiens
tataatgtttattaaatg

SEQ ID NO: 2348015 - DNA, 23 bp, Homo sapiens
tataattgtacaaaattaagcaa

SEQ ID NO: 2348016 - DNA, 20 bp, Homo sapiens
tataatttaaacgtgatttt

SEQ ID NO: 2348017 - DNA, 13 bp, Homo sapiens
tataattttatgg

SEQ ID NO: 2348018 - DNA, 22 bp, Homo sapiens
tatacaaacctaccaaaatgga

SEQ ID NO: 2348019 - DNA, 13 bp, Homo sapiens
tatacattttcta

SEQ ID NO: 2348020 - DNA, 19 bp, Homo sapiens
tatacattttctaaataaa

SEQ ID NO: 2348021 - DNA, 22 bp, Homo sapiens
tataccaaaaacaagtctataa

SEQ ID NO: 2348022 - DNA, 12 bp, Homo sapiens
tatacctgattt

SEQ ID NO: 2348023 - DNA, 15 bp, Homo sapiens
tatactatatttttc

SEQ ID NO: 2348024 - DNA, 12 bp, Homo sapiens
tatactccttaa

SEQ ID NO: 2348025 - DNA, 18 bp, Homo sapiens
tatactccttaaaaatgt

SEQ ID NO: 2348026 - DNA, 12 bp, Homo sapiens
tatactgaagga

SEQ ID NO: 2348027 - DNA, 17 bp, Homo sapiens
tatactgcatacttttt

SEQ ID NO: 2348028 - DNA, 21 bp, Homo sapiens
tatagaggctagcttctgctt

SEQ ID NO: 2348029 - DNA, 15 bp, Homo sapiens
tatagcactgagctc

SEQ ID NO: 2348030 - DNA, 17 bp, Homo sapiens
tatagcatcttctcatt

SEQ ID NO: 2348031 - DNA, 20 bp, Homo sapiens
tatagcatgaaataaaatat

SEQ ID NO: 2348032 - DNA, 13 bp, Homo sapiens
tataggctatttt

SEQ ID NO: 2348033 - DNA, 18 bp, Homo sapiens
tatagtagttacttgtga

SEQ ID NO: 2348034 - DNA, 18 bp, Homo sapiens
tatagtctaagactatat

SEQ ID NO: 2348035 - DNA, 15 bp, Homo sapiens
tatagttttactttt

SEQ ID NO: 2348036 - DNA, 23 bp, Homo sapiens
tatataaacaataaaaacaactt

SEQ ID NO: 2348037 - DNA, 12 bp, Homo sapiens
tatataaatgta

SEQ ID NO: 2348038 - DNA, 13 bp, Homo sapiens
tatataattttat

SEQ ID NO: 2348039 - DNA, 14 bp, Homo sapiens
tatatatataaatg

SEQ ID NO: 2348040 - DNA, 14 bp, Homo sapiens
tatatattaagtgt

SEQ ID NO: 2348041 - DNA, 16 bp, Homo sapiens
tatatattttgtgtga

SEQ ID NO: 2348042 - DNA, 23 bp, Homo sapiens
tatatattttgtgtgaaattgca

SEQ ID NO: 2348043 - DNA, 22 bp, Homo sapiens
tatatcacccagacataaagga

SEQ ID NO: 2348044 - DNA, 17 bp, Homo sapiens
tatatcaggtgtataaa

SEQ ID NO: 2348045 - DNA, 22 bp, Homo sapiens
tatatcaggtgtataaatgtac

SEQ ID NO: 2348046 - DNA, 23 bp, Homo sapiens
tatatcaggtgtataaatgtaca

SEQ ID NO: 2348047 - DNA, 13 bp, Homo sapiens
tatatcatgcaaa

SEQ ID NO: 2348048 - DNA, 14 bp, Homo sapiens
tatatgaccagaag

SEQ ID NO: 2348049 - DNA, 17 bp, Homo sapiens
tatatgaccagaagcct

SEQ ID NO: 2348050 - DNA, 14 bp, Homo sapiens
tatatgattaaatt

SEQ ID NO: 2348051 - DNA, 16 bp, Homo sapiens
tatatggaagaaagta

SEQ ID NO: 2348052 - DNA, 16 bp, Homo sapiens
tatattactgacattt

SEQ ID NO: 2348053 - DNA, 22 bp, Homo sapiens
tatattagatcaaatagttgca

SEQ ID NO: 2348054 - DNA, 15 bp, Homo sapiens
tatattattgattca

SEQ ID NO: 2348055 - DNA, 15 bp, Homo sapiens
tatatttaattttga

SEQ ID NO: 2348056 - DNA, 15 bp, Homo sapiens
tatatttataaggaa

SEQ ID NO: 2348057 - DNA, 13 bp, Homo sapiens
tatatttccttta

SEQ ID NO: 2348058 - DNA, 18 bp, Homo sapiens
tatatttcctttatgtga

SEQ ID NO: 2348059 - DNA, 19 bp, Homo sapiens
tatatttcctttatgtgaa

SEQ ID NO: 2348060 - DNA, 20 bp, Homo sapiens
tatatttcctttatgtgaat

SEQ ID NO: 2348061 - DNA, 19 bp, Homo sapiens
tatattttgtgtgaaattg

SEQ ID NO: 2348062 - DNA, 22 bp, Homo sapiens
tatattttgtgtgaaattgcat

SEQ ID NO: 2348063 - DNA, 16 bp, Homo sapiens
tatcaaataaaatatc

SEQ ID NO: 2348064 - DNA, 20 bp, Homo sapiens
tatcacccagacataaagga

SEQ ID NO: 2348065 - DNA, 15 bp, Homo sapiens
tatcacgatttgcag

SEQ ID NO: 2348066 - DNA, 15 bp, Homo sapiens
tatcacttttctggg

SEQ ID NO: 2348067 - DNA, 14 bp, Homo sapiens
tatcagcaaagaaa

SEQ ID NO: 2348068 - DNA, 16 bp, Homo sapiens
tatcagctacaattgt

SEQ ID NO: 2348069 - DNA, 17 bp, Homo sapiens
tatcaggtgtataaatg

SEQ ID NO: 2348070 - DNA, 22 bp, Homo sapiens
tatcagttacagtggcagtatt

SEQ ID NO: 2348071 - DNA, 19 bp, Homo sapiens
tatcatatatttaatctta

SEQ ID NO: 2348072 - DNA, 19 bp, Homo sapiens
tatcatgcatgtcctgtaa

SEQ ID NO: 2348073 - DNA, 16 bp, Homo sapiens
tatcattgtttgtcct

SEQ ID NO: 2348074 - DNA, 20 bp, Homo sapiens
tatcattgtttgtcctttat

SEQ ID NO: 2348075 - DNA, 20 bp, Homo sapiens
tatcattttcttttttaacc

SEQ ID NO: 2348076 - DNA, 13 bp, Homo sapiens
tatccaaaagctt

SEQ ID NO: 2348077 - DNA, 17 bp, Homo sapiens
tatccaaggaaacattt

SEQ ID NO: 2348078 - DNA, 13 bp, Homo sapiens
tatccatctcctg

SEQ ID NO: 2348079 - DNA, 16 bp, Homo sapiens
tatcccagctgcctag

SEQ ID NO: 2348080 - DNA, 13 bp, Homo sapiens
tatccccatctcc

SEQ ID NO: 2348081 - DNA, 22 bp, Homo sapiens
tatccccatctccctgcctggc

SEQ ID NO: 2348082 - DNA, 19 bp, Homo sapiens
tatcctctccccctcctcc

SEQ ID NO: 2348083 - DNA, 13 bp, Homo sapiens
tatcctgagccat

SEQ ID NO: 2348084 - DNA, 11 bp, Homo sapiens
tatcctggtgc

SEQ ID NO: 2348085 - DNA, 15 bp, Homo sapiens
tatcgaaataacaat

SEQ ID NO: 2348086 - DNA, 16 bp, Homo sapiens
tatcgaaataacaatg

SEQ ID NO: 2348087 - DNA, 19 bp, Homo sapiens
tatcgaaataacaatgtta

SEQ ID NO: 2348088 - DNA, 12 bp, Homo sapiens
tatcgtttttgt

SEQ ID NO: 2348089 - DNA, 21 bp, Homo sapiens
tatctaaatagtattttgtct

SEQ ID NO: 2348090 - DNA, 16 bp, Homo sapiens
tatctcctttaatata

SEQ ID NO: 2348091 - DNA, 22 bp, Homo sapiens
tatcttataaagtggaagtatg

SEQ ID NO: 2348092 - DNA, 13 bp, Homo sapiens
tatcttcagccca

SEQ ID NO: 2348093 - DNA, 22 bp, Homo sapiens
tatcttgggtgtattctctgta

SEQ ID NO: 2348094 - DNA, 18 bp, Homo sapiens
taatgaaaataaaacaca

SEQ ID NO: 2348095 - DNA, 21 bp, Homo sapiens
taatgaaaataaaacacacct

SEQ ID NO: 2348096 - DNA, 13 bp, Homo sapiens
taatgaaatggag

SEQ ID NO: 2348097 - DNA, 14 bp, Homo sapiens
taatgacttagaaa

SEQ ID NO: 2348098 - DNA, 16 bp, Homo sapiens
taatgacttagaaact

SEQ ID NO: 2348099 - DNA, 17 bp, Homo sapiens
taatgacttagaaactg

SEQ ID NO: 2348100 - DNA, 20 bp, Homo sapiens
taatgataaactcagatctg

SEQ ID NO: 2348101 - DNA, 11 bp, Homo sapiens
taatgatgttt

SEQ ID NO: 2348102 - DNA, 21 bp, Homo sapiens
taatgattaagggacatttct

SEQ ID NO: 2348103 - DNA, 22 bp, Homo sapiens
taatgattaagggacatttcta

SEQ ID NO: 2348104 - DNA, 23 bp, Homo sapiens
taatgattaagggacatttctat

SEQ ID NO: 2348105 - DNA, 14 bp, Homo sapiens
taatgcttgctttt

SEQ ID NO: 2348106 - DNA, 15 bp, Homo sapiens
taatgcttttctaat

SEQ ID NO: 2348107 - DNA, 14 bp, Homo sapiens
taatgctttttaga

SEQ ID NO: 2348108 - DNA, 18 bp, Homo sapiens
taatgtactgatttcagt

SEQ ID NO: 2348109 - DNA, 14 bp, Homo sapiens
taatgtctcacttt

SEQ ID NO: 2348110 - DNA, 16 bp, Homo sapiens
taatgttaaatttgta

SEQ ID NO: 2348111 - DNA, 17 bp, Homo sapiens
taatgttaaatttgtaa

SEQ ID NO: 2348112 - DNA, 20 bp, Homo sapiens
taatgttaaatttgtaagtt

SEQ ID NO: 2348113 - DNA, 13 bp, Homo sapiens
taatgttgataat

SEQ ID NO: 2348114 - DNA, 19 bp, Homo sapiens
taatgttgataatatatat

SEQ ID NO: 2348115 - DNA, 16 bp, Homo sapiens
taatgtttatgagcca

SEQ ID NO: 2348116 - DNA, 22 bp, Homo sapiens
taatgtttatgagccagacaaa

SEQ ID NO: 2348117 - DNA, 15 bp, Homo sapiens
taatgtttattaaat

SEQ ID NO: 2348118 - DNA, 17 bp, Homo sapiens
taatgtttattaaatgc

SEQ ID NO: 2348119 - DNA, 22 bp, Homo sapiens
taatgtttattaaatgcttcat

SEQ ID NO: 2348120 - DNA, 13 bp, Homo sapiens
taatgttttcaaa

SEQ ID NO: 2348121 - DNA, 22 bp, Homo sapiens
taattaatatattaaaattcca

SEQ ID NO: 2348122 - DNA, 16 bp, Homo sapiens
taattaccaacctgtt

SEQ ID NO: 2348123 - DNA, 14 bp, Homo sapiens
taattcatatctaa

SEQ ID NO: 2348124 - DNA, 18 bp, Homo sapiens
taattcatatctaaatag

SEQ ID NO: 2348125 - DNA, 16 bp, Homo sapiens
taattgccagcaaata

SEQ ID NO: 2348126 - DNA, 18 bp, Homo sapiens
taattgtaagtgaaatta

SEQ ID NO: 2348127 - DNA, 15 bp, Homo sapiens
taattgtacaaaatt

SEQ ID NO: 2348128 - DNA, 14 bp, Homo sapiens
taattgtctctgag

SEQ ID NO: 2348129 - DNA, 15 bp, Homo sapiens
taattgttgtttctt

SEQ ID NO: 2348130 - DNA, 16 bp, Homo sapiens
taattgttgtttcttt

SEQ ID NO: 2348131 - DNA, 19 bp, Homo sapiens
taattgttgtttctttcta

SEQ ID NO: 2348132 - DNA, 22 bp, Homo sapiens
taattgttgtttctttctagtg

SEQ ID NO: 2348133 - DNA, 14 bp, Homo sapiens
taatttaaaaatat

SEQ ID NO: 2348134 - DNA, 19 bp, Homo sapiens
taatttatttccactaaaa

SEQ ID NO: 2348135 - DNA, 14 bp, Homo sapiens
taatttcaaaatac

SEQ ID NO: 2348136 - DNA, 21 bp, Homo sapiens
taatttcaaaatacatttgta

SEQ ID NO: 2348137 - DNA, 10 bp, Homo sapiens
taatttcctt

SEQ ID NO: 2348138 - DNA, 20 bp, Homo sapiens
taatttcctttttgacactg

SEQ ID NO: 2348139 - DNA, 22 bp, Homo sapiens
taatttcctttttgacactgaa

SEQ ID NO: 2348140 - DNA, 12 bp, Homo sapiens
taatttgaactg

SEQ ID NO: 2348141 - DNA, 13 bp, Homo sapiens
taatttgaatgta

SEQ ID NO: 2348142 - DNA, 17 bp, Homo sapiens
taatttgaatgtatttg

SEQ ID NO: 2348143 - DNA, 15 bp, Homo sapiens
taattttggaataat

SEQ ID NO: 2348144 - DNA, 19 bp, Homo sapiens
taattttggaataatttct

SEQ ID NO: 2348145 - DNA, 13 bp, Homo sapiens
taattttttttaa

SEQ ID NO: 2348146 - DNA, 17 bp, Homo sapiens
taattttttttaaaata

SEQ ID NO: 2348147 - DNA, 14 bp, Homo sapiens
tacaaactctcacc

SEQ ID NO: 2348148 - DNA, 12 bp, Homo sapiens
tacaaactttta

SEQ ID NO: 2348149 - DNA, 15 bp, Homo sapiens
tacaaacttttaaga

SEQ ID NO: 2348150 - DNA, 23 bp, Homo sapiens
tacaaacttttaagatttctcta

SEQ ID NO: 2348151 - DNA, 17 bp, Homo sapiens
tacaaagttaaaattgt

SEQ ID NO: 2348152 - DNA, 15 bp, Homo sapiens
tacaaatataggttt

SEQ ID NO: 2348153 - DNA, 14 bp, Homo sapiens
tacaaatgaagaaa

SEQ ID NO: 2348154 - DNA, 18 bp, Homo sapiens
tacaacacattgaaactg

SEQ ID NO: 2348155 - DNA, 21 bp, Homo sapiens
tacaacacattgaaactgtat

SEQ ID NO: 2348156 - DNA, 20 bp, Homo sapiens
tacaactaacgcaaccaagt

SEQ ID NO: 2348157 - DNA, 17 bp, Homo sapiens
tacaactgattgcaaca

SEQ ID NO: 2348158 - DNA, 15 bp, Homo sapiens
tacaagaaaatgtat

SEQ ID NO: 2348159 - DNA, 23 bp, Homo sapiens
tacaagccaaaagtccctccctg

SEQ ID NO: 2348160 - DNA, 16 bp, Homo sapiens
tacaagtaatattatt

SEQ ID NO: 2348161 - DNA, 13 bp, Homo sapiens
tacaagttagaaa

SEQ ID NO: 2348162 - DNA, 21 bp, Homo sapiens
tacaataaaacaaataaatat

SEQ ID NO: 2348163 - DNA, 18 bp, Homo sapiens
tacaatacaacacattga

SEQ ID NO: 2348164 - DNA, 16 bp, Homo sapiens
tacaatagtatacatt

SEQ ID NO: 2348165 - DNA, 17 bp, Homo sapiens
tacaatagtatacattt

SEQ ID NO: 2348166 - DNA, 22 bp, Homo sapiens
tacaatagtatacattttataa

SEQ ID NO: 2348167 - DNA, 19 bp, Homo sapiens
tacaatattgattgggaaa

SEQ ID NO: 2348168 - DNA, 23 bp, Homo sapiens
tacaatattgattgggaaaacat

SEQ ID NO: 2348169 - DNA, 13 bp, Homo sapiens
tacaatggccatg

SEQ ID NO: 2348170 - DNA, 15 bp, Homo sapiens
tacaatttcaactac

SEQ ID NO: 2348171 - DNA, 21 bp, Homo sapiens
tacaattttccctcttcactt

SEQ ID NO: 2348172 - DNA, 21 bp, Homo sapiens
tacacatagttctgtaataaa

SEQ ID NO: 2348173 - DNA, 13 bp, Homo sapiens
tacacatcttaaa

SEQ ID NO: 2348174 - DNA, 23 bp, Homo sapiens
tacaccactttcccacactgtga

SEQ ID NO: 2348175 - DNA, 16 bp, Homo sapiens
tacacctattatccca

SEQ ID NO: 2348176 - DNA, 12 bp, Homo sapiens
tacacctggctg

SEQ ID NO: 2348177 - DNA, 13 bp, Homo sapiens
tacacctggctga

SEQ ID NO: 2348178 - DNA, 14 bp, Homo sapiens
tacacctggctgag

SEQ ID NO: 2348179 - DNA, 15 bp, Homo sapiens
tacacctggctgagg

SEQ ID NO: 2348180 - DNA, 22 bp, Homo sapiens
tacacctggctgaggttcctct

SEQ ID NO: 2348181 - DNA, 20 bp, Homo sapiens
tacaccttgccttgctgttt

SEQ ID NO: 2348182 - DNA, 17 bp, Homo sapiens
tacacgtgtcctgtagt

SEQ ID NO: 2348183 - DNA, 13 bp, Homo sapiens
tacactttgttgc

SEQ ID NO: 2348184 - DNA, 13 bp, Homo sapiens
tacagaatatttc

SEQ ID NO: 2348185 - DNA, 16 bp, Homo sapiens
tacagaatttgaatta

SEQ ID NO: 2348186 - DNA, 20 bp, Homo sapiens
tacagaccgagaggccagtt

SEQ ID NO: 2348187 - DNA, 19 bp, Homo sapiens
tacagagaaattctgtggt

SEQ ID NO: 2348188 - DNA, 17 bp, Homo sapiens
tacagaggatgcctttt

SEQ ID NO: 2348189 - DNA, 19 bp, Homo sapiens
tacagaggatgccttttct

SEQ ID NO: 2348190 - DNA, 16 bp, Homo sapiens
tacagatctcagggct

SEQ ID NO: 2348191 - DNA, 22 bp, Homo sapiens
tacagcaacaatttatgaattg

SEQ ID NO: 2348192 - DNA, 18 bp, Homo sapiens
tacagcagggtcttgctg

SEQ ID NO: 2348193 - DNA, 19 bp, Homo sapiens
tacagcctatagtaaatgt

SEQ ID NO: 2348194 - DNA, 12 bp, Homo sapiens
tacagtaaatgt

SEQ ID NO: 2348195 - DNA, 14 bp, Homo sapiens
tacagtaaatgtta

SEQ ID NO: 2348196 - DNA, 17 bp, Homo sapiens
tacagtattcttttaaa

SEQ ID NO: 2348197 - DNA, 16 bp, Homo sapiens
tacagtcattccaaga

SEQ ID NO: 2348198 - DNA, 22 bp, Homo sapiens
tacagtgcatagttgtagacaa

SEQ ID NO: 2348199 - DNA, 15 bp, Homo sapiens
tacagtggcagtatt

SEQ ID NO: 2348200 - DNA, 13 bp, Homo sapiens
tacagttctttcc

SEQ ID NO: 2348201 - DNA, 17 bp, Homo sapiens
tacagttctttcctctt

SEQ ID NO: 2348202 - DNA, 18 bp, Homo sapiens
tacagttctttcctcttt

SEQ ID NO: 2348203 - DNA, 21 bp, Homo sapiens
tacataaacaacgcattgcca

SEQ ID NO: 2348204 - DNA, 13 bp, Homo sapiens
tacataactgaaa

SEQ ID NO: 2348205 - DNA, 14 bp, Homo sapiens
tacatagatgctta

SEQ ID NO: 2348206 - DNA, 20 bp, Homo sapiens
tacatagttatttttctctt

SEQ ID NO: 2348207 - DNA, 20 bp, Homo sapiens
tacatataaaatgtaattac

SEQ ID NO: 2348208 - DNA, 19 bp, Homo sapiens
tacatatgctgatctttta

SEQ ID NO: 2348209 - DNA, 22 bp, Homo sapiens
tacatcccgggcctcagtgccc

SEQ ID NO: 2348210 - DNA, 18 bp, Homo sapiens
tacatctgatatcaggaa

SEQ ID NO: 2348211 - DNA, 20 bp, Homo sapiens
tacatctgatatcaggaaat

SEQ ID NO: 2348212 - DNA, 14 bp, Homo sapiens
tacatgagaaagat

SEQ ID NO: 2348213 - DNA, 15 bp, Homo sapiens
tacatgcataaacta

SEQ ID NO: 2348214 - DNA, 20 bp, Homo sapiens
tacatggcgccctgcctcct

SEQ ID NO: 2348215 - DNA, 18 bp, Homo sapiens
tacatgtgatacattttt

SEQ ID NO: 2348216 - DNA, 14 bp, Homo sapiens
tacattaacggtgc

SEQ ID NO: 2348217 - DNA, 14 bp, Homo sapiens
tacatttaaatttt

SEQ ID NO: 2348218 - DNA, 12 bp, Homo sapiens
tacatttatgat

SEQ ID NO: 2348219 - DNA, 19 bp, Homo sapiens
tacatttatgatttaataa

SEQ ID NO: 2348220 - DNA, 20 bp, Homo sapiens
tacattttctaaataaaaat

SEQ ID NO: 2348221 - DNA, 15 bp, Homo sapiens
tacattttttaagct

SEQ ID NO: 2348222 - DNA, 18 bp, Homo sapiens
taccaaatccacaagcca

SEQ ID NO: 2348223 - DNA, 23 bp, Homo sapiens
taccaaattaaaaaaaaattgta

SEQ ID NO: 2348224 - DNA, 21 bp, Homo sapiens
taccacaaaccctgctgaaca

SEQ ID NO: 2348225 - DNA, 19 bp, Homo sapiens
taccagaggttgtgcactg

SEQ ID NO: 2348226 - DNA, 14 bp, Homo sapiens
taccagctgcgctt

SEQ ID NO: 2348227 - DNA, 14 bp, Homo sapiens
taccaggtgttcta

SEQ ID NO: 2348228 - DNA, 21 bp, Homo sapiens
taccattcacaataaaagctt

SEQ ID NO: 2348229 - DNA, 18 bp, Homo sapiens
taccatttagtaagaata

SEQ ID NO: 2348230 - DNA, 22 bp, Homo sapiens
tacccaataggtaatttttcat

SEQ ID NO: 2348231 - DNA, 22 bp, Homo sapiens
tacccacctagaacactaactc

SEQ ID NO: 2348232 - DNA, 15 bp, Homo sapiens
tacccatagacatga

SEQ ID NO: 2348233 - DNA, 16 bp, Homo sapiens
tacccatagacatgaa

SEQ ID NO: 2348234 - DNA, 22 bp, Homo sapiens
taccccttggaaatgtctgctg

SEQ ID NO: 2348235 - DNA, 18 bp, Homo sapiens
tacccctttctggctctc

SEQ ID NO: 2348236 - DNA, 23 bp, Homo sapiens
taccctattctatccatctcctg

SEQ ID NO: 2348237 - DNA, 15 bp, Homo sapiens
taccctctttgctgc

SEQ ID NO: 2348238 - DNA, 16 bp, Homo sapiens
taccctctttgctgca

SEQ ID NO: 2348239 - DNA, 19 bp, Homo sapiens
taccctctttgctgcagag

SEQ ID NO: 2348240 - DNA, 16 bp, Homo sapiens
taccctggcccctctc

SEQ ID NO: 2348241 - DNA, 15 bp, Homo sapiens
taccctgtctgtccc

SEQ ID NO: 2348242 - DNA, 21 bp, Homo sapiens
taccctgtctgtcccttttct

SEQ ID NO: 2348243 - DNA, 22 bp, Homo sapiens
taccctgtctgtcccttttctt

SEQ ID NO: 2348244 - DNA, 17 bp, Homo sapiens
taccggagagagaatgt

SEQ ID NO: 2348245 - DNA, 14 bp, Homo sapiens
tacctactttgact

SEQ ID NO: 2348246 - DNA, 18 bp, Homo sapiens
tacctagctaattattta

SEQ ID NO: 2348247 - DNA, 18 bp, Homo sapiens
tacctcaaagggcagttt

SEQ ID NO: 2348248 - DNA, 11 bp, Homo sapiens
tacctcagaaa

SEQ ID NO: 2348249 - DNA, 20 bp, Homo sapiens
tacctccatccatccttcca

SEQ ID NO: 2348250 - DNA, 21 bp, Homo sapiens
tacctctcaagctagtgtttc

SEQ ID NO: 2348251 - DNA, 14 bp, Homo sapiens
tacctctgtgtgct

SEQ ID NO: 2348252 - DNA, 19 bp, Homo sapiens
tacctggagaagaatggct

SEQ ID NO: 2348253 - DNA, 15 bp, Homo sapiens
tacctggatgttctt

SEQ ID NO: 2348254 - DNA, 13 bp, Homo sapiens
tacctgtgtgctt

SEQ ID NO: 2348255 - DNA, 19 bp, Homo sapiens
taccttccatacacagagg

SEQ ID NO: 2348256 - DNA, 21 bp, Homo sapiens
taccttccatacacagaggag

SEQ ID NO: 2348257 - DNA, 15 bp, Homo sapiens
taccttcctgtccct

SEQ ID NO: 2348258 - DNA, 18 bp, Homo sapiens
taccttctgatgaagttg

SEQ ID NO: 2348259 - DNA, 19 bp, Homo sapiens
taccttctgatgaagttgt

SEQ ID NO: 2348260 - DNA, 17 bp, Homo sapiens
taccttttcagggctgg

SEQ ID NO: 2348261 - DNA, 20 bp, Homo sapiens
tacctttttatttgcatgtg

SEQ ID NO: 2348262 - DNA, 20 bp, Homo sapiens
tacgagcacctccagcctga

SEQ ID NO: 2348263 - DNA, 16 bp, Homo sapiens
tacgcccatctcagga

SEQ ID NO: 2348264 - DNA, 17 bp, Homo sapiens
tacgcccatctcaggac

SEQ ID NO: 2348265 - DNA, 21 bp, Homo sapiens
tacggctatattggtttatgt

SEQ ID NO: 2348266 - DNA, 21 bp, Homo sapiens
tacgtgaagaaataaatgaaa

SEQ ID NO: 2348267 - DNA, 17 bp, Homo sapiens
tacgtgtcaaaaaagaa

SEQ ID NO: 2348268 - DNA, 16 bp, Homo sapiens
tactaaaaagtataaa

SEQ ID NO: 2348269 - DNA, 21 bp, Homo sapiens
tactaaaaagtataaaatagt

SEQ ID NO: 2348270 - DNA, 13 bp, Homo sapiens
tactaataaacca

SEQ ID NO: 2348271 - DNA, 13 bp, Homo sapiens
tactaatctgaga

SEQ ID NO: 2348272 - DNA, 13 bp, Homo sapiens
tactaatgatgtt

SEQ ID NO: 2348273 - DNA, 20 bp, Homo sapiens
tactagtcaccagagacttt

SEQ ID NO: 2348274 - DNA, 22 bp, Homo sapiens
tactagtcaccagagactttag

SEQ ID NO: 2348275 - DNA, 18 bp, Homo sapiens
tactatggtgtgttgtat

SEQ ID NO: 2348276 - DNA, 19 bp, Homo sapiens
tactattcaggtaacacta

SEQ ID NO: 2348277 - DNA, 16 bp, Homo sapiens
tactcacttttcccac

SEQ ID NO: 2348278 - DNA, 18 bp, Homo sapiens
tactcacttttcccactc

SEQ ID NO: 2348279 - DNA, 16 bp, Homo sapiens
tactccctgcagatgc

SEQ ID NO: 2348280 - DNA, 19 bp, Homo sapiens
tactcctatgatctgagtc

SEQ ID NO: 2348281 - DNA, 19 bp, Homo sapiens
tagaaaattatttgtatga

SEQ ID NO: 2348282 - DNA, 17 bp, Homo sapiens
tagaaacaaacatctaa

SEQ ID NO: 2348283 - DNA, 13 bp, Homo sapiens
tagaaactacaaa

SEQ ID NO: 2348284 - DNA, 16 bp, Homo sapiens
tagaaagaagccatat

SEQ ID NO: 2348285 - DNA, 13 bp, Homo sapiens
tagaaagcatttt

SEQ ID NO: 2348286 - DNA, 13 bp, Homo sapiens
tagaaattttgta

SEQ ID NO: 2348287 - DNA, 18 bp, Homo sapiens
tagaacgttaaactatta

SEQ ID NO: 2348288 - DNA, 14 bp, Homo sapiens
tagaactagccaaa

SEQ ID NO: 2348289 - DNA, 19 bp, Homo sapiens
tagaactccaggccctcct

SEQ ID NO: 2348290 - DNA, 21 bp, Homo sapiens
tagaagcactacaccttgcct

SEQ ID NO: 2348291 - DNA, 12 bp, Homo sapiens
tagaagccaagg

SEQ ID NO: 2348292 - DNA, 15 bp, Homo sapiens
tagaaggcttctctc

SEQ ID NO: 2348293 - DNA, 18 bp, Homo sapiens
tagaaggcttctctccac

SEQ ID NO: 2348294 - DNA, 14 bp, Homo sapiens
tagaagtctggaaa

SEQ ID NO: 2348295 - DNA, 20 bp, Homo sapiens
tagaataattcttttctgag

SEQ ID NO: 2348296 - DNA, 22 bp, Homo sapiens
tagaattttgagtattccatga

SEQ ID NO: 2348297 - DNA, 21 bp, Homo sapiens
tagacaaagccttaagcaaat

SEQ ID NO: 2348298 - DNA, 22 bp, Homo sapiens
tagacaaagccttaagcaaatt

SEQ ID NO: 2348299 - DNA, 15 bp, Homo sapiens
tagacaacctttctg

SEQ ID NO: 2348300 - DNA, 18 bp, Homo sapiens
tagaccctgaggccctgg

SEQ ID NO: 2348301 - DNA, 21 bp, Homo sapiens
tagactagcaatctcttcatt

SEQ ID NO: 2348302 - DNA, 18 bp, Homo sapiens
tagaggcttctccgccag

SEQ ID NO: 2348303 - DNA, 20 bp, Homo sapiens
tagaggcttctccgccagcc

SEQ ID NO: 2348304 - DNA, 23 bp, Homo sapiens
tagaggcttctccgccagcctcc

SEQ ID NO: 2348305 - DNA, 15 bp, Homo sapiens
tagagtaatgaaatg

SEQ ID NO: 2348306 - DNA, 14 bp, Homo sapiens
tagagtatttccct

SEQ ID NO: 2348307 - DNA, 17 bp, Homo sapiens
tagagtatttcccttcc

SEQ ID NO: 2348308 - DNA, 21 bp, Homo sapiens
tagagtatttcccttccaaag

SEQ ID NO: 2348309 - DNA, 12 bp, Homo sapiens
tagagttaagaa

SEQ ID NO: 2348310 - DNA, 21 bp, Homo sapiens
tagataaattgtagggcttta

SEQ ID NO: 2348311 - DNA, 23 bp, Homo sapiens
tagataacaagacctcagtgcct

SEQ ID NO: 2348312 - DNA, 15 bp, Homo sapiens
tagataatattgttt

SEQ ID NO: 2348313 - DNA, 21 bp, Homo sapiens
tagatattaggtccattcatt

SEQ ID NO: 2348314 - DNA, 21 bp, Homo sapiens
tagatccatttccattgctta

SEQ ID NO: 2348315 - DNA, 22 bp, Homo sapiens
tagatgatttcagttctaggaa

SEQ ID NO: 2348316 - DNA, 18 bp, Homo sapiens
tagatgattttttgaaag

SEQ ID NO: 2348317 - DNA, 22 bp, Homo sapiens
tagatgtgcatttttgtgaaat

SEQ ID NO: 2348318 - DNA, 20 bp, Homo sapiens
tagatttaaaggcagacagt

SEQ ID NO: 2348319 - DNA, 14 bp, Homo sapiens
tagattttattatg

SEQ ID NO: 2348320 - DNA, 16 bp, Homo sapiens
tagcaacaacaattgg

SEQ ID NO: 2348321 - DNA, 14 bp, Homo sapiens
tagcaatctcttca

SEQ ID NO: 2348322 - DNA, 23 bp, Homo sapiens
tagcagacctaaagcaagcctga

SEQ ID NO: 2348323 - DNA, 17 bp, Homo sapiens
tagcagatctgttttgt

SEQ ID NO: 2348324 - DNA, 14 bp, Homo sapiens
tagcagcacctcct

SEQ ID NO: 2348325 - DNA, 18 bp, Homo sapiens
tagcagccagttcaaaaa

SEQ ID NO: 2348326 - DNA, 20 bp, Homo sapiens
tagcatcttctcattcccat

SEQ ID NO: 2348327 - DNA, 16 bp, Homo sapiens
tagcattttcttgaac

SEQ ID NO: 2348328 - DNA, 19 bp, Homo sapiens
tagcattttcttgaaccaa

SEQ ID NO: 2348329 - DNA, 23 bp, Homo sapiens
tagccaaagatttcatatctaac

SEQ ID NO: 2348330 - DNA, 16 bp, Homo sapiens
tagccacagctgctgt

SEQ ID NO: 2348331 - DNA, 13 bp, Homo sapiens
tagccaggatcat

SEQ ID NO: 2348332 - DNA, 20 bp, Homo sapiens
tagccaggatcatggtgtaa

SEQ ID NO: 2348333 - DNA, 18 bp, Homo sapiens
tagcccttccctgagtgc

SEQ ID NO: 2348334 - DNA, 17 bp, Homo sapiens
tagcctggccaccagcc

SEQ ID NO: 2348335 - DNA, 14 bp, Homo sapiens
tagcgagctgctct

SEQ ID NO: 2348336 - DNA, 17 bp, Homo sapiens
tagcgatctctcctggc

SEQ ID NO: 2348337 - DNA, 20 bp, Homo sapiens
tagcgatctctcctggccta

SEQ ID NO: 2348338 - DNA, 21 bp, Homo sapiens
tagcggcaaacctttccccct

SEQ ID NO: 2348339 - DNA, 23 bp, Homo sapiens
tagctacctacatgctgaaaaat

SEQ ID NO: 2348340 - DNA, 15 bp, Homo sapiens
tagctcaggtgcctt

SEQ ID NO: 2348341 - DNA, 19 bp, Homo sapiens
tagctcagtcatcaaagca

SEQ ID NO: 2348342 - DNA, 21 bp, Homo sapiens
tagctccataaagtacaaatg

SEQ ID NO: 2348343 - DNA, 16 bp, Homo sapiens
tagctcctccccttcc

SEQ ID NO: 2348344 - DNA, 11 bp, Homo sapiens
tagctctccca

SEQ ID NO: 2348345 - DNA, 14 bp, Homo sapiens
tagctctcccagtg

SEQ ID NO: 2348346 - DNA, 17 bp, Homo sapiens
tagctctgaatgctatt

SEQ ID NO: 2348347 - DNA, 12 bp, Homo sapiens
tagctctgagaa

SEQ ID NO: 2348348 - DNA, 13 bp, Homo sapiens
tagctctgagaac

SEQ ID NO: 2348349 - DNA, 17 bp, Homo sapiens
tagctgaagaattgaaa

SEQ ID NO: 2348350 - DNA, 21 bp, Homo sapiens
tagctgaagaattgaaaagtt

SEQ ID NO: 2348351 - DNA, 12 bp, Homo sapiens
tagctgccactt

SEQ ID NO: 2348352 - DNA, 22 bp, Homo sapiens
tagctggctctgtgagggtgct

SEQ ID NO: 2348353 - DNA, 18 bp, Homo sapiens
tagctgggaaagcataaa

SEQ ID NO: 2348354 - DNA, 18 bp, Homo sapiens
tagctttagaccctgggt

SEQ ID NO: 2348355 - DNA, 17 bp, Homo sapiens
tagctttggaagtttag

SEQ ID NO: 2348356 - DNA, 22 bp, Homo sapiens
tagctttggaagtttagctctg

SEQ ID NO: 2348357 - DNA, 16 bp, Homo sapiens
tagctttttaattgtt

SEQ ID NO: 2348358 - DNA, 13 bp, Homo sapiens
taggaaaataaaa

SEQ ID NO: 2348359 - DNA, 21 bp, Homo sapiens
taggaaatgtttttaataaaa

SEQ ID NO: 2348360 - DNA, 21 bp, Homo sapiens
taggaagagcccgcagggcca

SEQ ID NO: 2348361 - DNA, 13 bp, Homo sapiens
taggaatgtccac

SEQ ID NO: 2348362 - DNA, 15 bp, Homo sapiens
taggaggaaaattcc

SEQ ID NO: 2348363 - DNA, 19 bp, Homo sapiens
taggagtggtgatttgaaa

SEQ ID NO: 2348364 - DNA, 23 bp, Homo sapiens
taggattttaacttaactgaaat

SEQ ID NO: 2348365 - DNA, 20 bp, Homo sapiens
taggcagattgaaaaggaca

SEQ ID NO: 2348366 - DNA, 13 bp, Homo sapiens
taggcagcctgcc

SEQ ID NO: 2348367 - DNA, 14 bp, Homo sapiens
taggcagcctgccg

SEQ ID NO: 2348368 - DNA, 16 bp, Homo sapiens
taggctattaaaaaag

SEQ ID NO: 2348369 - DNA, 16 bp, Homo sapiens
taggcttaaacctgga

SEQ ID NO: 2348370 - DNA, 14 bp, Homo sapiens
tagggaagcaggga

SEQ ID NO: 2348371 - DNA, 21 bp, Homo sapiens
tagggaagcagggacaccccc

SEQ ID NO: 2348372 - DNA, 19 bp, Homo sapiens
tagggactacccatagaca

SEQ ID NO: 2348373 - DNA, 18 bp, Homo sapiens
tagggctttagctttctt

SEQ ID NO: 2348374 - DNA, 21 bp, Homo sapiens
taggggaggggctcctttcca

SEQ ID NO: 2348375 - DNA, 12 bp, Homo sapiens
taggtctccagt

SEQ ID NO: 2348376 - DNA, 20 bp, Homo sapiens
tagtaaaagtggtctctgct

SEQ ID NO: 2348377 - DNA, 22 bp, Homo sapiens
tagtaaaagtggtctctgctgg

SEQ ID NO: 2348378 - DNA, 18 bp, Homo sapiens
tagtaagaagacaaactg

SEQ ID NO: 2348379 - DNA, 15 bp, Homo sapiens
tagtaagcatagaaa

SEQ ID NO: 2348380 - DNA, 20 bp, Homo sapiens
tagtacaatagtatacattt

SEQ ID NO: 2348381 - DNA, 14 bp, Homo sapiens
tagtacaatttcaa

SEQ ID NO: 2348382 - DNA, 23 bp, Homo sapiens
tagtagttagaaattaaatctgt

SEQ ID NO: 2348383 - DNA, 15 bp, Homo sapiens
tagtatagaagtctg

SEQ ID NO: 2348384 - DNA, 15 bp, Homo sapiens
tagtatctatatgac

SEQ ID NO: 2348385 - DNA, 13 bp, Homo sapiens
tagtctaagacta

SEQ ID NO: 2348386 - DNA, 17 bp, Homo sapiens
tagtctaagactatata

SEQ ID NO: 2348387 - DNA, 19 bp, Homo sapiens
tagtctcactgcttgaact

SEQ ID NO: 2348388 - DNA, 20 bp, Homo sapiens
tagtcttgacgaatattgct

SEQ ID NO: 2348389 - DNA, 14 bp, Homo sapiens
tagtgacttcctgg

SEQ ID NO: 2348390 - DNA, 20 bp, Homo sapiens
tagtgaggaagacaagcatt

SEQ ID NO: 2348391 - DNA, 21 bp, Homo sapiens
tagtgcttaaaaatcattgat

SEQ ID NO: 2348392 - DNA, 16 bp, Homo sapiens
tagtggtctttgtaag

SEQ ID NO: 2348393 - DNA, 14 bp, Homo sapiens
tagtgtcactgctt

SEQ ID NO: 2348394 - DNA, 16 bp, Homo sapiens
tagtgtccataaataa

SEQ ID NO: 2348395 - DNA, 22 bp, Homo sapiens
tagtgtttctagctaaataaat

SEQ ID NO: 2348396 - DNA, 13 bp, Homo sapiens
tagttaaagaaag

SEQ ID NO: 2348397 - DNA, 13 bp, Homo sapiens
tcacttttcccac

SEQ ID NO: 2348398 - DNA, 20 bp, Homo sapiens
tcagaaaccctcattgtgtt

SEQ ID NO: 2348399 - DNA, 21 bp, Homo sapiens
tcagaaaccctcattgtgttt

SEQ ID NO: 2348400 - DNA, 18 bp, Homo sapiens
tcagaaagtaacaatcta

SEQ ID NO: 2348401 - DNA, 19 bp, Homo sapiens
tcagaaatataacacattt

SEQ ID NO: 2348402 - DNA, 14 bp, Homo sapiens
tcagaaatgtcatg

SEQ ID NO: 2348403 - DNA, 16 bp, Homo sapiens
tcagaacatactgatt

SEQ ID NO: 2348404 - DNA, 23 bp, Homo sapiens
tcagaaccagagggcatgctgaa

SEQ ID NO: 2348405 - DNA, 13 bp, Homo sapiens
tcagaacttgctg

SEQ ID NO: 2348406 - DNA, 16 bp, Homo sapiens
tcagaacttgctgctg

SEQ ID NO: 2348407 - DNA, 17 bp, Homo sapiens
tcagaacttgctgctgt

SEQ ID NO: 2348408 - DNA, 19 bp, Homo sapiens
tcagacatacagctgccta

SEQ ID NO: 2348409 - DNA, 15 bp, Homo sapiens
tcagacattccaagg

SEQ ID NO: 2348410 - DNA, 22 bp, Homo sapiens
tcagactttgtgttcatttcat

SEQ ID NO: 2348411 - DNA, 21 bp, Homo sapiens
tcagagacaaaatatttccca

SEQ ID NO: 2348412 - DNA, 22 bp, Homo sapiens
tcagagacaaaatatttcccat

SEQ ID NO: 2348413 - DNA, 18 bp, Homo sapiens
tcagagatgaacatctaa

SEQ ID NO: 2348414 - DNA, 14 bp, Homo sapiens
tcagagcgcacagg

SEQ ID NO: 2348415 - DNA, 16 bp, Homo sapiens
tcagagcgcacaggga

SEQ ID NO: 2348416 - DNA, 17 bp, Homo sapiens
tcagagcgccaggaagc

SEQ ID NO: 2348417 - DNA, 19 bp, Homo sapiens
tcagagcgccaggaagcca

SEQ ID NO: 2348418 - DNA, 18 bp, Homo sapiens
tcagagctaaactccttc

SEQ ID NO: 2348419 - DNA, 21 bp, Homo sapiens
tcagagttgctgcaaacctga

SEQ ID NO: 2348420 - DNA, 15 bp, Homo sapiens
tcagatgggaacagt

SEQ ID NO: 2348421 - DNA, 16 bp, Homo sapiens
tcagatttccacagag

SEQ ID NO: 2348422 - DNA, 22 bp, Homo sapiens
tcagcacaggaattctcaagac

SEQ ID NO: 2348423 - DNA, 17 bp, Homo sapiens
tcagcagaacctgcaca

SEQ ID NO: 2348424 - DNA, 21 bp, Homo sapiens
tcagcagaacctgcacacagg

SEQ ID NO: 2348425 - DNA, 21 bp, Homo sapiens
tcagcatgtctattcagcttc

SEQ ID NO: 2348426 - DNA, 13 bp, Homo sapiens
tcagcattttaga

SEQ ID NO: 2348427 - DNA, 22 bp, Homo sapiens
tcagctccagggaatccaagcc

SEQ ID NO: 2348428 - DNA, 23 bp, Homo sapiens
tcagctccagggaatccaagcct

SEQ ID NO: 2348429 - DNA, 19 bp, Homo sapiens
tcagctctctgccctgtgt

SEQ ID NO: 2348430 - DNA, 20 bp, Homo sapiens
tcagctctctgccctgtgta

SEQ ID NO: 2348431 - DNA, 17 bp, Homo sapiens
tcagctctttccaaatt

SEQ ID NO: 2348432 - DNA, 20 bp, Homo sapiens
tcagctggcagtgcaatgct

SEQ ID NO: 2348433 - DNA, 22 bp, Homo sapiens
tcagctgggtcacatccatccc

SEQ ID NO: 2348434 - DNA, 19 bp, Homo sapiens
tcagcttcgtttattttca

SEQ ID NO: 2348435 - DNA, 21 bp, Homo sapiens
tcagcttcgtttattttcaag

SEQ ID NO: 2348436 - DNA, 19 bp, Homo sapiens
tcaggaaaaggttgaataa

SEQ ID NO: 2348437 - DNA, 18 bp, Homo sapiens
tcaggaaatatctgtgaa

SEQ ID NO: 2348438 - DNA, 20 bp, Homo sapiens
tcaggacagcatcccttccc

SEQ ID NO: 2348439 - DNA, 21 bp, Homo sapiens
tcaggacagcatcccttccca

SEQ ID NO: 2348440 - DNA, 22 bp, Homo sapiens
tcaggacagcatcccttcccac

SEQ ID NO: 2348441 - DNA, 17 bp, Homo sapiens
tcaggacggctcctcag

SEQ ID NO: 2348442 - DNA, 20 bp, Homo sapiens
tcaggacggctcctcagagc

SEQ ID NO: 2348443 - DNA, 22 bp, Homo sapiens
tcaggagatcgagaccatcctg

SEQ ID NO: 2348444 - DNA, 21 bp, Homo sapiens
tcaggagcttgggcagtgccc

SEQ ID NO: 2348445 - DNA, 12 bp, Homo sapiens
tcaggaggcgcc

SEQ ID NO: 2348446 - DNA, 21 bp, Homo sapiens
tcaggagttactggatttgtt

SEQ ID NO: 2348447 - DNA, 20 bp, Homo sapiens
tcaggatattggttcttccc

SEQ ID NO: 2348448 - DNA, 16 bp, Homo sapiens
tcaggcaaagaaaatg

SEQ ID NO: 2348449 - DNA, 12 bp, Homo sapiens
tcaggcaccagt

SEQ ID NO: 2348450 - DNA, 18 bp, Homo sapiens
tcaggcaccagtccctgt

SEQ ID NO: 2348451 - DNA, 19 bp, Homo sapiens
tcaggcaccagtccctgtc

SEQ ID NO: 2348452 - DNA, 18 bp, Homo sapiens
tcaggcagcaccacactg

SEQ ID NO: 2348453 - DNA, 20 bp, Homo sapiens
tcaggccctgactcctctgg

SEQ ID NO: 2348454 - DNA, 16 bp, Homo sapiens
tcaggctgaaaacaat

SEQ ID NO: 2348455 - DNA, 18 bp, Homo sapiens
tcagggaaagtgggacag

SEQ ID NO: 2348456 - DNA, 18 bp, Homo sapiens
tcagggagcctccccatc

SEQ ID NO: 2348457 - DNA, 18 bp, Homo sapiens
tcagggctgtcccagccc

SEQ ID NO: 2348458 - DNA, 19 bp, Homo sapiens
tcagggctgtcccagcccc

SEQ ID NO: 2348459 - DNA, 20 bp, Homo sapiens
tcaggggctctagggactgc

SEQ ID NO: 2348460 - DNA, 18 bp, Homo sapiens
tcagggtgaactgcaaag

SEQ ID NO: 2348461 - DNA, 16 bp, Homo sapiens
tcaggtgacatgtgaa

SEQ ID NO: 2348462 - DNA, 19 bp, Homo sapiens
tcaggtgatttgtatgctc

SEQ ID NO: 2348463 - DNA, 23 bp, Homo sapiens
tcaggtgccttacatcttttcta

SEQ ID NO: 2348464 - DNA, 13 bp, Homo sapiens
tcaggtgctgtcc

SEQ ID NO: 2348465 - DNA, 16 bp, Homo sapiens
tcaggtgctgtccatg

SEQ ID NO: 2348466 - DNA, 14 bp, Homo sapiens
tattaaaaatgtat

SEQ ID NO: 2348467 - DNA, 12 bp, Homo sapiens
tattaaaactaa

SEQ ID NO: 2348468 - DNA, 17 bp, Homo sapiens
tattaaaactaaatttc

SEQ ID NO: 2348469 - DNA, 19 bp, Homo sapiens
tattaaaactaaatttcac

SEQ ID NO: 2348470 - DNA, 18 bp, Homo sapiens
tattaaacaaagtttcag

SEQ ID NO: 2348471 - DNA, 23 bp, Homo sapiens
tattaaatgcttcatttgtatgt

SEQ ID NO: 2348472 - DNA, 14 bp, Homo sapiens
tattaagattggaa

SEQ ID NO: 2348473 - DNA, 19 bp, Homo sapiens
tattaagctttttggaatc

SEQ ID NO: 2348474 - DNA, 12 bp, Homo sapiens
tattaatatcaa

SEQ ID NO: 2348475 - DNA, 17 bp, Homo sapiens
tattaatatcaactctg

SEQ ID NO: 2348476 - DNA, 14 bp, Homo sapiens
tattaatcaagaga

SEQ ID NO: 2348477 - DNA, 20 bp, Homo sapiens
tattaatcaagagaaacttc

SEQ ID NO: 2348478 - DNA, 18 bp, Homo sapiens
tattaatgttttcaaaag

SEQ ID NO: 2348479 - DNA, 14 bp, Homo sapiens
tattacaatgatca

SEQ ID NO: 2348480 - DNA, 15 bp, Homo sapiens
tattacaatgatcac

SEQ ID NO: 2348481 - DNA, 14 bp, Homo sapiens
tattacatagctct

SEQ ID NO: 2348482 - DNA, 16 bp, Homo sapiens
tattactgaataatat

SEQ ID NO: 2348483 - DNA, 23 bp, Homo sapiens
tattactgaataatatcaaataa

SEQ ID NO: 2348484 - DNA, 15 bp, Homo sapiens
tattagagtatttcc

SEQ ID NO: 2348485 - DNA, 18 bp, Homo sapiens
tattagccaggatcatgg

SEQ ID NO: 2348486 - DNA, 19 bp, Homo sapiens
tattatacatgtgatacat

SEQ ID NO: 2348487 - DNA, 21 bp, Homo sapiens
tattatgtctcttctgagcta

SEQ ID NO: 2348488 - DNA, 18 bp, Homo sapiens
tattcaagaatgaaaaat

SEQ ID NO: 2348489 - DNA, 17 bp, Homo sapiens
tattcacctcagtagaa

SEQ ID NO: 2348490 - DNA, 19 bp, Homo sapiens
tattcacctcagtagaaaa

SEQ ID NO: 2348491 - DNA, 23 bp, Homo sapiens
tattcataccttctgatgaagtt

SEQ ID NO: 2348492 - DNA, 13 bp, Homo sapiens
tattcatggctac

SEQ ID NO: 2348493 - DNA, 19 bp, Homo sapiens
tattccaagacatgtctgt

SEQ ID NO: 2348494 - DNA, 22 bp, Homo sapiens
tattccagatctttcagaaata

SEQ ID NO: 2348495 - DNA, 16 bp, Homo sapiens
tattctagcctgcatt

SEQ ID NO: 2348496 - DNA, 21 bp, Homo sapiens
tattctagcctgcattgagct

SEQ ID NO: 2348497 - DNA, 22 bp, Homo sapiens
tattctatccatctcctggtgt

SEQ ID NO: 2348498 - DNA, 13 bp, Homo sapiens
tattctctgtaag

SEQ ID NO: 2348499 - DNA, 16 bp, Homo sapiens
tattcttcaaatgtat

SEQ ID NO: 2348500 - DNA, 19 bp, Homo sapiens
tattgaaaattgaaaagta

SEQ ID NO: 2348501 - DNA, 20 bp, Homo sapiens
tattgaaaattgaaaagtac

SEQ ID NO: 2348502 - DNA, 21 bp, Homo sapiens
tattgaaagccaacaactctg

SEQ ID NO: 2348503 - DNA, 11 bp, Homo sapiens
tattgacactg

SEQ ID NO: 2348504 - DNA, 19 bp, Homo sapiens
tattgacaggtcttttcaa

SEQ ID NO: 2348505 - DNA, 16 bp, Homo sapiens
tattgagattttccat

SEQ ID NO: 2348506 - DNA, 18 bp, Homo sapiens
tattgattgggaaaacat

SEQ ID NO: 2348507 - DNA, 14 bp, Homo sapiens
tattgcaataaagt

SEQ ID NO: 2348508 - DNA, 18 bp, Homo sapiens
tattgcaataaagtataa

SEQ ID NO: 2348509 - DNA, 20 bp, Homo sapiens
tattgggagtcttaataaaa

SEQ ID NO: 2348510 - DNA, 15 bp, Homo sapiens
tattgtatttatgtg

SEQ ID NO: 2348511 - DNA, 15 bp, Homo sapiens
tattgtgaagtacat

SEQ ID NO: 2348512 - DNA, 19 bp, Homo sapiens
tattgtgaagtacatatta

SEQ ID NO: 2348513 - DNA, 17 bp, Homo sapiens
tattgtgctcagagaca

SEQ ID NO: 2348514 - DNA, 16 bp, Homo sapiens
tattgtttaaaatgta

SEQ ID NO: 2348515 - DNA, 13 bp, Homo sapiens
tattgtttctgca

SEQ ID NO: 2348516 - DNA, 17 bp, Homo sapiens
tattgtttggtaaatgt

SEQ ID NO: 2348517 - DNA, 15 bp, Homo sapiens
tattgttttacaata

SEQ ID NO: 2348518 - DNA, 22 bp, Homo sapiens
tattgttttacaatagttctgt

SEQ ID NO: 2348519 - DNA, 14 bp, Homo sapiens
tatttaacaaaatt

SEQ ID NO: 2348520 - DNA, 19 bp, Homo sapiens
tatttaacaaaatttgaat

SEQ ID NO: 2348521 - DNA, 15 bp, Homo sapiens
tatttaacaagatgt

SEQ ID NO: 2348522 - DNA, 18 bp, Homo sapiens
tatttaacaagatgtttc

SEQ ID NO: 2348523 - DNA, 12 bp, Homo sapiens
tatttaacattc

SEQ ID NO: 2348524 - DNA, 12 bp, Homo sapiens
tatttaacattt

SEQ ID NO: 2348525 - DNA, 22 bp, Homo sapiens
tatttaactcataatttttgca

SEQ ID NO: 2348526 - DNA, 21 bp, Homo sapiens
tatttaagtggactgtatttc

SEQ ID NO: 2348527 - DNA, 13 bp, Homo sapiens
tatttactaacta

SEQ ID NO: 2348528 - DNA, 20 bp, Homo sapiens
tatttattttcctaaagaga

SEQ ID NO: 2348529 - DNA, 14 bp, Homo sapiens
tatttccactaaaa

SEQ ID NO: 2348530 - DNA, 13 bp, Homo sapiens
tcaggtgtataaa

SEQ ID NO: 2348531 - DNA, 15 bp, Homo sapiens
tcaggtgtataaatg

SEQ ID NO: 2348532 - DNA, 19 bp, Homo sapiens
tcaggttatcgaaataaca

SEQ ID NO: 2348533 - DNA, 20 bp, Homo sapiens
tcaggttatcgaaataacaa

SEQ ID NO: 2348534 - DNA, 13 bp, Homo sapiens
tcaggttcctttt

SEQ ID NO: 2348535 - DNA, 14 bp, Homo sapiens
tcaggtttgttttg

SEQ ID NO: 2348536 - DNA, 21 bp, Homo sapiens
tcagtaaacgggaacatgccc

SEQ ID NO: 2348537 - DNA, 20 bp, Homo sapiens
tcagtaaatagtgtcatata

SEQ ID NO: 2348538 - DNA, 22 bp, Homo sapiens
tcagtaacccccttaaatttaa

SEQ ID NO: 2348539 - DNA, 14 bp, Homo sapiens
tcagtaagttatct

SEQ ID NO: 2348540 - DNA, 18 bp, Homo sapiens
tcagtagaaaaggatcta

SEQ ID NO: 2348541 - DNA, 18 bp, Homo sapiens
tcagtaggactccttatt

SEQ ID NO: 2348542 - DNA, 17 bp, Homo sapiens
tcagtcatgcataaata

SEQ ID NO: 2348543 - DNA, 13 bp, Homo sapiens
tcagtctttgctc

SEQ ID NO: 2348544 - DNA, 14 bp, Homo sapiens
tcagtctttgctca

SEQ ID NO: 2348545 - DNA, 16 bp, Homo sapiens
tcagtctttgctcagt

SEQ ID NO: 2348546 - DNA, 16 bp, Homo sapiens
tcagtgagcctcctgt

SEQ ID NO: 2348547 - DNA, 13 bp, Homo sapiens
tcagtgcagtttc

SEQ ID NO: 2348548 - DNA, 14 bp, Homo sapiens
tcagtgcagtttct

SEQ ID NO: 2348549 - DNA, 14 bp, Homo sapiens
tcagtgccctccag

SEQ ID NO: 2348550 - DNA, 14 bp, Homo sapiens
tcagtggtgggaga

SEQ ID NO: 2348551 - DNA, 14 bp, Homo sapiens
tcagtgtaaagtgt

SEQ ID NO: 2348552 - DNA, 19 bp, Homo sapiens
tcagtgtccagcttccaaa

SEQ ID NO: 2348553 - DNA, 17 bp, Homo sapiens
tcagtgttacctgtgtg

SEQ ID NO: 2348554 - DNA, 20 bp, Homo sapiens
tcagttaaatctcctgtgga

SEQ ID NO: 2348555 - DNA, 20 bp, Homo sapiens
tcagttacagtggcagtatt

SEQ ID NO: 2348556 - DNA, 13 bp, Homo sapiens
tcagttctaggaa

SEQ ID NO: 2348557 - DNA, 16 bp, Homo sapiens
tcagttctcttgcttt

SEQ ID NO: 2348558 - DNA, 17 bp, Homo sapiens
tcagttgggaagctttt

SEQ ID NO: 2348559 - DNA, 12 bp, Homo sapiens
tcagttgtgttt

SEQ ID NO: 2348560 - DNA, 14 bp, Homo sapiens
tcagttgtgttttt

SEQ ID NO: 2348561 - DNA, 19 bp, Homo sapiens
tcagtttgttggaaagtaa

SEQ ID NO: 2348562 - DNA, 14 bp, Homo sapiens
tcagttttccttct

SEQ ID NO: 2348563 - DNA, 11 bp, Homo sapiens
tcataaagtca

SEQ ID NO: 2348564 - DNA, 13 bp, Homo sapiens
tcataaattattt

SEQ ID NO: 2348565 - DNA, 20 bp, Homo sapiens
tcataagtattatgtctctt

SEQ ID NO: 2348566 - DNA, 14 bp, Homo sapiens
tcatagaattttga

SEQ ID NO: 2348567 - DNA, 21 bp, Homo sapiens
tcatagacttgaataactctt

SEQ ID NO: 2348568 - DNA, 20 bp, Homo sapiens
tcatagctcactgcagcctc

SEQ ID NO: 2348569 - DNA, 14 bp, Homo sapiens
tcataggttaaaaa

SEQ ID NO: 2348570 - DNA, 15 bp, Homo sapiens
tcataggttaaaaaa

SEQ ID NO: 2348571 - DNA, 23 bp, Homo sapiens
tcataggttaaaaaaaaaagtca

SEQ ID NO: 2348572 - DNA, 15 bp, Homo sapiens
tcatataaactcatt

SEQ ID NO: 2348573 - DNA, 14 bp, Homo sapiens
tcatatccttttga

SEQ ID NO: 2348574 - DNA, 13 bp, Homo sapiens
tcatatctaaata

SEQ ID NO: 2348575 - DNA, 16 bp, Homo sapiens
tcatatctatgggaaa

SEQ ID NO: 2348576 - DNA, 19 bp, Homo sapiens
tcatcaacaagatttcctt

SEQ ID NO: 2348577 - DNA, 15 bp, Homo sapiens
tcatcaactgaatga

SEQ ID NO: 2348578 - DNA, 22 bp, Homo sapiens
tcatcaactgaatgaggtcagc

SEQ ID NO: 2348579 - DNA, 21 bp, Homo sapiens
tcatcaagagaatttggggct

SEQ ID NO: 2348580 - DNA, 20 bp, Homo sapiens
tcatcagatgcctgcttgat

SEQ ID NO: 2348581 - DNA, 22 bp, Homo sapiens
tcatcagatgcttgcggcaaaa

SEQ ID NO: 2348582 - DNA, 17 bp, Homo sapiens
tcatcatccagatgtgg

SEQ ID NO: 2348583 - DNA, 19 bp, Homo sapiens
tcatccacataccctgacc

SEQ ID NO: 2348584 - DNA, 12 bp, Homo sapiens
tcatcccaacct

SEQ ID NO: 2348585 - DNA, 17 bp, Homo sapiens
tcatcctcttttaatgg

SEQ ID NO: 2348586 - DNA, 13 bp, Homo sapiens
tcatcctgaccaa

SEQ ID NO: 2348587 - DNA, 17 bp, Homo sapiens
tcatctcccctcctggc

SEQ ID NO: 2348588 - DNA, 15 bp, Homo sapiens
tcatctctttagaga

SEQ ID NO: 2348589 - DNA, 12 bp, Homo sapiens
tcatctgcaaaa

SEQ ID NO: 2348590 - DNA, 19 bp, Homo sapiens
tcatctgttagggccttgg

SEQ ID NO: 2348591 - DNA, 12 bp, Homo sapiens
tcatcttcctgt

SEQ ID NO: 2348592 - DNA, 13 bp, Homo sapiens
tcatcttcctgtg

SEQ ID NO: 2348593 - DNA, 14 bp, Homo sapiens
tcatcttcctgtgt

SEQ ID NO: 2348594 - DNA, 19 bp, Homo sapiens
tcatcttcctgtgtcctga

SEQ ID NO: 2348595 - DNA, 16 bp, Homo sapiens
tcatgaaaataccatt

SEQ ID NO: 2348596 - DNA, 20 bp, Homo sapiens
tcatgaaaatgtattccttt

SEQ ID NO: 2348597 - DNA, 16 bp, Homo sapiens
tcatgaagcaggaggc

SEQ ID NO: 2348598 - DNA, 13 bp, Homo sapiens
tcatgaatgcttt

SEQ ID NO: 2348599 - DNA, 15 bp, Homo sapiens
tcatgaattttaaag

SEQ ID NO: 2348600 - DNA, 16 bp, Homo sapiens
tcatgaattttaaagt

SEQ ID NO: 2348601 - DNA, 12 bp, Homo sapiens
tcatgactttat

SEQ ID NO: 2348602 - DNA, 16 bp, Homo sapiens
tcatgagaagccaagc

SEQ ID NO: 2348603 - DNA, 14 bp, Homo sapiens
tcatgagcctgctg

SEQ ID NO: 2348604 - DNA, 19 bp, Homo sapiens
tcatgaggagggtggggga

SEQ ID NO: 2348605 - DNA, 18 bp, Homo sapiens
tcatgattatagcaacta

SEQ ID NO: 2348606 - DNA, 19 bp, Homo sapiens
tcatgcataaatatgcagt

SEQ ID NO: 2348607 - DNA, 15 bp, Homo sapiens
tcatgccagtatttt

SEQ ID NO: 2348608 - DNA, 13 bp, Homo sapiens
tcatgcccacccc

SEQ ID NO: 2348609 - DNA, 15 bp, Homo sapiens
tcatgcccaccccct

SEQ ID NO: 2348610 - DNA, 16 bp, Homo sapiens
tcatgcccaccccctg

SEQ ID NO: 2348611 - DNA, 18 bp, Homo sapiens
tcatgcccaccccctgcc

SEQ ID NO: 2348612 - DNA, 21 bp, Homo sapiens
tcatgcccaccccctgccctg

SEQ ID NO: 2348613 - DNA, 22 bp, Homo sapiens
tcatgcccaccccctgccctgc

SEQ ID NO: 2348614 - DNA, 23 bp, Homo sapiens
tcatgcccaccccctgccctgca

SEQ ID NO: 2348615 - DNA, 22 bp, Homo sapiens
tcatgggtcctagcccttccct

SEQ ID NO: 2348616 - DNA, 18 bp, Homo sapiens
tcatggtgtaataagaca

SEQ ID NO: 2348617 - DNA, 18 bp, Homo sapiens
tcatgtatttgagcatat

SEQ ID NO: 2348618 - DNA, 13 bp, Homo sapiens
tcattaaaaatta

SEQ ID NO: 2348619 - DNA, 18 bp, Homo sapiens
tcattacagttctttcct

SEQ ID NO: 2348620 - DNA, 17 bp, Homo sapiens
tcattaccttaaagcat

SEQ ID NO: 2348621 - DNA, 18 bp, Homo sapiens
tcattaccttaaagcatc

SEQ ID NO: 2348622 - DNA, 15 bp, Homo sapiens
tcattataagctatg

SEQ ID NO: 2348623 - DNA, 18 bp, Homo sapiens
tcattatgtcaaccaggt

SEQ ID NO: 2348624 - DNA, 16 bp, Homo sapiens
tcattatttcaaaatg

SEQ ID NO: 2348625 - DNA, 13 bp, Homo sapiens
tcattatttctgg

SEQ ID NO: 2348626 - DNA, 21 bp, Homo sapiens
tcattcaatttaagtatattt

SEQ ID NO: 2348627 - DNA, 15 bp, Homo sapiens
tcattccaagaacta

SEQ ID NO: 2348628 - DNA, 16 bp, Homo sapiens
tcattcccatgtggaa

SEQ ID NO: 2348629 - DNA, 17 bp, Homo sapiens
tcattcccatgtggaac

SEQ ID NO: 2348630 - DNA, 17 bp, Homo sapiens
tcattcctaacacagca

SEQ ID NO: 2348631 - DNA, 20 bp, Homo sapiens
tcattcttactaaaaagtat

SEQ ID NO: 2348632 - DNA, 19 bp, Homo sapiens
tcattgaactttaagaagc

SEQ ID NO: 2348633 - DNA, 11 bp, Homo sapiens
tcattgacttt

SEQ ID NO: 2348634 - DNA, 24 bp, Homo sapiens
tcattgacttttataaagcatgtt

SEQ ID NO: 2348635 - DNA, 18 bp, Homo sapiens
tcattgattgtcagctac

SEQ ID NO: 2348636 - DNA, 15 bp, Homo sapiens
tcattgtcgctcagc

SEQ ID NO: 2348637 - DNA, 16 bp, Homo sapiens
tcattgtcgctcagca

SEQ ID NO: 2348638 - DNA, 21 bp, Homo sapiens
tcatttattttttgtttgttt

SEQ ID NO: 2348639 - DNA, 23 bp, Homo sapiens
tcatttgacacaaagcttctaaa

SEQ ID NO: 2348640 - DNA, 14 bp, Homo sapiens
tcatttttatagca

SEQ ID NO: 2348641 - DNA, 12 bp, Homo sapiens
tcattttttccc

SEQ ID NO: 2348642 - DNA, 16 bp, Homo sapiens
tccaaaagattgctga

SEQ ID NO: 2348643 - DNA, 22 bp, Homo sapiens
tccaaaagattgctgaaatttt

SEQ ID NO: 2348644 - DNA, 14 bp, Homo sapiens
tccaaatgtccctc

SEQ ID NO: 2348645 - DNA, 21 bp, Homo sapiens
tccaaatgtccctccaacaca

SEQ ID NO: 2348646 - DNA, 18 bp, Homo sapiens
tccaaattaaaacaaata

SEQ ID NO: 2348647 - DNA, 17 bp, Homo sapiens
tccaacatgtgatgtgt

SEQ ID NO: 2348648 - DNA, 20 bp, Homo sapiens
tcggaattcataataaattt

SEQ ID NO: 2348649 - DNA, 13 bp, Homo sapiens
tcggactgccaaa

SEQ ID NO: 2348650 - DNA, 13 bp, Homo sapiens
tcggatctcacag

SEQ ID NO: 2348651 - DNA, 18 bp, Homo sapiens
tcggatctcacaggctga

SEQ ID NO: 2348652 - DNA, 21 bp, Homo sapiens
tcggatggaccaacctgctct

SEQ ID NO: 2348653 - DNA, 17 bp, Homo sapiens
tcggcgtggcccaaggc

SEQ ID NO: 2348654 - DNA, 21 bp, Homo sapiens
tcggctctgcagtcctactca

SEQ ID NO: 2348655 - DNA, 18 bp, Homo sapiens
tcggcttttaatgtactt

SEQ ID NO: 2348656 - DNA, 11 bp, Homo sapiens
tcgggaccagg

SEQ ID NO: 2348657 - DNA, 14 bp, Homo sapiens
tcgggctccagcca

SEQ ID NO: 2348658 - DNA, 23 bp, Homo sapiens
tcgggtccatagagatgagccca

SEQ ID NO: 2348659 - DNA, 16 bp, Homo sapiens
tcgtacagaaagctgc

SEQ ID NO: 2348660 - DNA, 14 bp, Homo sapiens
tcgtcccatccagc

SEQ ID NO: 2348661 - DNA, 21 bp, Homo sapiens
tcgtctcggccttcacaatct

SEQ ID NO: 2348662 - DNA, 23 bp, Homo sapiens
tcgtctcttttaccctggcccct

SEQ ID NO: 2348663 - DNA, 22 bp, Homo sapiens
tcgtgaaagtgcatttttgtaa

SEQ ID NO: 2348664 - DNA, 12 bp, Homo sapiens
tcgtgatgtgga

SEQ ID NO: 2348665 - DNA, 20 bp, Homo sapiens
tcgtgatgtggaggaagagc

SEQ ID NO: 2348666 - DNA, 23 bp, Homo sapiens
tcgtgatgtggaggaagagccac

SEQ ID NO: 2348667 - DNA, 20 bp, Homo sapiens
tcgtgattttcaagcagcat

SEQ ID NO: 2348668 - DNA, 23 bp, Homo sapiens
tctcctttaatatactccttaaa

SEQ ID NO: 2348669 - DNA, 14 bp, Homo sapiens
tctcgtctctttta

SEQ ID NO: 2348670 - DNA, 19 bp, Homo sapiens
tctcgtggtagaagccagt

SEQ ID NO: 2348671 - DNA, 23 bp, Homo sapiens
tctcgttttgttgccaaagctgg

SEQ ID NO: 2348672 - DNA, 21 bp, Homo sapiens
tctctacagtctcgtctcttt

SEQ ID NO: 2348673 - DNA, 18 bp, Homo sapiens
tctctactaaaaatacaa

SEQ ID NO: 2348674 - DNA, 15 bp, Homo sapiens
tctctattttcataa

SEQ ID NO: 2348675 - DNA, 24 bp, Homo sapiens
tctctccctccctctctcatgaga

SEQ ID NO: 2348676 - DNA, 13 bp, Homo sapiens
tctctcctcccca

SEQ ID NO: 2348677 - DNA, 14 bp, Homo sapiens
tctctcctggctcg

SEQ ID NO: 2348678 - DNA, 13 bp, Homo sapiens
tctctctatgcct

SEQ ID NO: 2348679 - DNA, 14 bp, Homo sapiens
tctctctgggtcag

SEQ ID NO: 2348680 - DNA, 14 bp, Homo sapiens
tctctcttctgcct

SEQ ID NO: 2348681 - DNA, 18 bp, Homo sapiens
tctctctttcctccaccc

SEQ ID NO: 2348682 - DNA, 18 bp, Homo sapiens
tctctgaagggacccccc

SEQ ID NO: 2348683 - DNA, 23 bp, Homo sapiens
tctctgacgcttgtgacagtgcc

SEQ ID NO: 2348684 - DNA, 15 bp, Homo sapiens
tctctgatgtcccag

SEQ ID NO: 2348685 - DNA, 11 bp, Homo sapiens
tctctgcctct

SEQ ID NO: 2348686 - DNA, 12 bp, Homo sapiens
tctctgcctctc

SEQ ID NO: 2348687 - DNA, 21 bp, Homo sapiens
tctctgcctctcccaggctgt

SEQ ID NO: 2348688 - DNA, 19 bp, Homo sapiens
tctctggaagcccctgggc

SEQ ID NO: 2348689 - DNA, 16 bp, Homo sapiens
tctctgggtcagaacc

SEQ ID NO: 2348690 - DNA, 18 bp, Homo sapiens
tctctgggtcagaaccag

SEQ ID NO: 2348691 - DNA, 15 bp, Homo sapiens
tctcttaagtggtct

SEQ ID NO: 2348692 - DNA, 17 bp, Homo sapiens
tctcttccccagagagg

SEQ ID NO: 2348693 - DNA, 12 bp, Homo sapiens
tctcttccctga

SEQ ID NO: 2348694 - DNA, 14 bp, Homo sapiens
tctcttctcagagt

SEQ ID NO: 2348695 - DNA, 21 bp, Homo sapiens
tctcttctgagctatttcatc

SEQ ID NO: 2348696 - DNA, 14 bp, Homo sapiens
tctcttgagctggc

SEQ ID NO: 2348697 - DNA, 16 bp, Homo sapiens
tctcttgagctggcct

SEQ ID NO: 2348698 - DNA, 14 bp, Homo sapiens
tctctttaaactat

SEQ ID NO: 2348699 - DNA, 11 bp, Homo sapiens
tctctttcctt

SEQ ID NO: 2348700 - DNA, 12 bp, Homo sapiens
tctctttccttg

SEQ ID NO: 2348701 - DNA, 13 bp, Homo sapiens
tctctttccttga

SEQ ID NO: 2348702 - DNA, 22 bp, Homo sapiens
tctcttttcccctttcctgtcc

SEQ ID NO: 2348703 - DNA, 23 bp, Homo sapiens
tctgaaaagtgtgtatatatttt

SEQ ID NO: 2348704 - DNA, 17 bp, Homo sapiens
tctgaaacacacgagca

SEQ ID NO: 2348705 - DNA, 14 bp, Homo sapiens
tctgactctgagct

SEQ ID NO: 2348706 - DNA, 24 bp, Homo sapiens
tctgagaagctctgaagaactctc

SEQ ID NO: 2348707 - DNA, 12 bp, Homo sapiens
tctgagctcctg

SEQ ID NO: 2348708 - DNA, 16 bp, Homo sapiens
tctgaggtgcactggg

SEQ ID NO: 2348709 - DNA, 22 bp, Homo sapiens
tctgatatcaggaaatatctgt

SEQ ID NO: 2348710 - DNA, 16 bp, Homo sapiens
tctgatgaagttgtac

SEQ ID NO: 2348711 - DNA, 13 bp, Homo sapiens
tctgatggcctta

SEQ ID NO: 2348712 - DNA, 13 bp, Homo sapiens
tctgattatgtaa

SEQ ID NO: 2348713 - DNA, 18 bp, Homo sapiens
tctgattatgtaagcatt

SEQ ID NO: 2348714 - DNA, 16 bp, Homo sapiens
tctgcaacaagcatgc

SEQ ID NO: 2348715 - DNA, 13 bp, Homo sapiens
tctgcaagaacac

SEQ ID NO: 2348716 - DNA, 18 bp, Homo sapiens
tctgcaagcttcttgctg

SEQ ID NO: 2348717 - DNA, 22 bp, Homo sapiens
tctgcacaccctccagagacaa

SEQ ID NO: 2348718 - DNA, 15 bp, Homo sapiens
tctgcacatgtcttg

SEQ ID NO: 2348719 - DNA, 21 bp, Homo sapiens
tctgcacatgtcttgtacatg

SEQ ID NO: 2348720 - DNA, 22 bp, Homo sapiens
tctgcaccccttctctcctccc

SEQ ID NO: 2348721 - DNA, 21 bp, Homo sapiens
tctgcattcatttttatagca

SEQ ID NO: 2348722 - DNA, 13 bp, Homo sapiens
tctgccaaacaca

SEQ ID NO: 2348723 - DNA, 17 bp, Homo sapiens
tctgcccacgcagagga

SEQ ID NO: 2348724 - DNA, 21 bp, Homo sapiens
tctgcccacgcagaggacgca

SEQ ID NO: 2348725 - DNA, 15 bp, Homo sapiens
tctgccccagcccag

SEQ ID NO: 2348726 - DNA, 17 bp, Homo sapiens
tctgccccagcccagat

SEQ ID NO: 2348727 - DNA, 14 bp, Homo sapiens
tctgccctggctgc

SEQ ID NO: 2348728 - DNA, 16 bp, Homo sapiens
tctgccctggctgctg

SEQ ID NO: 2348729 - DNA, 18 bp, Homo sapiens
tctgccgccccctcctga

SEQ ID NO: 2348730 - DNA, 16 bp, Homo sapiens
tctgcctacagccagg

SEQ ID NO: 2348731 - DNA, 14 bp, Homo sapiens
tctgcctctcccag

SEQ ID NO: 2348732 - DNA, 15 bp, Homo sapiens
tctgcctctcccagg

SEQ ID NO: 2348733 - DNA, 12 bp, Homo sapiens
tctgcctctctg

SEQ ID NO: 2348734 - DNA, 23 bp, Homo sapiens
tctgcctggagacaaggtgctaa

SEQ ID NO: 2348735 - DNA, 16 bp, Homo sapiens
tctgccttaaaaccaa

SEQ ID NO: 2348736 - DNA, 20 bp, Homo sapiens
tctgccttaaaaccaaagag

SEQ ID NO: 2348737 - DNA, 14 bp, Homo sapiens
tctgcctttatgat

SEQ ID NO: 2348738 - DNA, 14 bp, Homo sapiens
tctgctatatataa

SEQ ID NO: 2348739 - DNA, 12 bp, Homo sapiens
tctgctccttcc

SEQ ID NO: 2348740 - DNA, 13 bp, Homo sapiens
tctgctctgccat

SEQ ID NO: 2348741 - DNA, 14 bp, Homo sapiens
tctgctctgccatc

SEQ ID NO: 2348742 - DNA, 17 bp, Homo sapiens
tctgctctggtggctta

SEQ ID NO: 2348743 - DNA, 19 bp, Homo sapiens
tctgctgacctgctgacct

SEQ ID NO: 2348744 - DNA, 19 bp, Homo sapiens
tctgctgaggcccagtgca

SEQ ID NO: 2348745 - DNA, 17 bp, Homo sapiens
tctgctgggctctgcct

SEQ ID NO: 2348746 - DNA, 15 bp, Homo sapiens
tctgctggtatttct

SEQ ID NO: 2348747 - DNA, 16 bp, Homo sapiens
tctgcttttctgccct

SEQ ID NO: 2348748 - DNA, 17 bp, Homo sapiens
tctgcttttctgccctg

SEQ ID NO: 2348749 - DNA, 18 bp, Homo sapiens
tctgcttttctgccctgg

SEQ ID NO: 2348750 - DNA, 21 bp, Homo sapiens
tctgcttttctgccctggctg

SEQ ID NO: 2348751 - DNA, 23 bp, Homo sapiens
tctggaaaaaaacaaaaacagaa

SEQ ID NO: 2348752 - DNA, 21 bp, Homo sapiens
tctggaatgtttttccctccc

SEQ ID NO: 2348753 - DNA, 13 bp, Homo sapiens
tctggacagcaga

SEQ ID NO: 2348754 - DNA, 18 bp, Homo sapiens
tctggacagcagaagcct

SEQ ID NO: 2348755 - DNA, 15 bp, Homo sapiens
tctggacggcaggct

SEQ ID NO: 2348756 - DNA, 22 bp, Homo sapiens
tctggacggcaggctcactgcc

SEQ ID NO: 2348757 - DNA, 23 bp, Homo sapiens
tctggacggcaggctcactgcca

SEQ ID NO: 2348758 - DNA, 21 bp, Homo sapiens
tctggagccctaaccccttcc

SEQ ID NO: 2348759 - DNA, 18 bp, Homo sapiens
tctggaggtgctgctcta

SEQ ID NO: 2348760 - DNA, 21 bp, Homo sapiens
tctggattctgaatctcaaga

SEQ ID NO: 2348761 - DNA, 15 bp, Homo sapiens
tctggcaatattctg

SEQ ID NO: 2348762 - DNA, 19 bp, Homo sapiens
tctggctgtgatcttaaaa

SEQ ID NO: 2348763 - DNA, 17 bp, Homo sapiens
tctggctttaagccttc

SEQ ID NO: 2348764 - DNA, 13 bp, Homo sapiens
tctggctttccca

SEQ ID NO: 2348765 - DNA, 16 bp, Homo sapiens
tctggctttgctctat

SEQ ID NO: 2348766 - DNA, 22 bp, Homo sapiens
tctgggacctgccaggcagggg

SEQ ID NO: 2348767 - DNA, 23 bp, Homo sapiens
tctgggagtaatactttttaaat

SEQ ID NO: 2348768 - DNA, 18 bp, Homo sapiens
tctgggcattttcctcct

SEQ ID NO: 2348769 - DNA, 18 bp, Homo sapiens
tctgggccccctcctccc

SEQ ID NO: 2348770 - DNA, 14 bp, Homo sapiens
tctgggctgggcac

SEQ ID NO: 2348771 - DNA, 14 bp, Homo sapiens
tctgggctgtgggc

SEQ ID NO: 2348772 - DNA, 18 bp, Homo sapiens
tctggggcaggctgggcc

SEQ ID NO: 2348773 - DNA, 15 bp, Homo sapiens
tctgggtcagaacca

SEQ ID NO: 2348774 - DNA, 24 bp, Homo sapiens
tctggtagcatgatggctgtagct

SEQ ID NO: 2348775 - DNA, 17 bp, Homo sapiens
tctggtgaagctcactt

SEQ ID NO: 2348776 - DNA, 12 bp, Homo sapiens
tctggtggctta

SEQ ID NO: 2348777 - DNA, 13 bp, Homo sapiens
tctgtaaactgtg

SEQ ID NO: 2348778 - DNA, 19 bp, Homo sapiens
tctgtaaactgtgtattcc

SEQ ID NO: 2348779 - DNA, 22 bp, Homo sapiens
tctgtaaactgtgtattccaag

SEQ ID NO: 2348780 - DNA, 13 bp, Homo sapiens
tctgtaagagctt

SEQ ID NO: 2348781 - DNA, 13 bp, Homo sapiens
ttctcttccctga

SEQ ID NO: 2348782 - DNA, 19 bp, Homo sapiens
ttctctttggaaatagcat

SEQ ID NO: 2348783 - DNA, 20 bp, Homo sapiens
ttctctttggaaatagcatg

SEQ ID NO: 2348784 - DNA, 23 bp, Homo sapiens
ttctctttggaaatagcatgaca

SEQ ID NO: 2348785 - DNA, 22 bp, Homo sapiens
ttctgaactcaaactgaggaat

SEQ ID NO: 2348786 - DNA, 16 bp, Homo sapiens
ttctgactctgagcta

SEQ ID NO: 2348787 - DNA, 16 bp, Homo sapiens
ttctgagctatttcat

SEQ ID NO: 2348788 - DNA, 23 bp, Homo sapiens
ttctgagctatttcatctatttt

SEQ ID NO: 2348789 - DNA, 17 bp, Homo sapiens
ttctgattctagtgtgt

SEQ ID NO: 2348790 - DNA, 23 bp, Homo sapiens
ttctgattctggctttaagcctt

SEQ ID NO: 2348791 - DNA, 19 bp, Homo sapiens
ttctgcattcatttttata

SEQ ID NO: 2348792 - DNA, 19 bp, Homo sapiens
ttctgccatctagccagcc

SEQ ID NO: 2348793 - DNA, 19 bp, Homo sapiens
ttctgccctggctgctgcc

SEQ ID NO: 2348794 - DNA, 15 bp, Homo sapiens
ttctgccgccccctc

SEQ ID NO: 2348795 - DNA, 21 bp, Homo sapiens
ttctgccgccccctcctgaac

SEQ ID NO: 2348796 - DNA, 22 bp, Homo sapiens
ttctgccgccccctcctgaacc

SEQ ID NO: 2348797 - DNA, 14 bp, Homo sapiens
ttctgccttctcat

SEQ ID NO: 2348798 - DNA, 16 bp, Homo sapiens
ttctgccttctcatga

SEQ ID NO: 2348799 - DNA, 16 bp, Homo sapiens
ttctgctccttcccca

SEQ ID NO: 2348800 - DNA, 13 bp, Homo sapiens
ttctgctctgcca

SEQ ID NO: 2348801 - DNA, 18 bp, Homo sapiens
ttctgcttttctgccctg

SEQ ID NO: 2348802 - DNA, 15 bp, Homo sapiens
ttctggacctctggg

SEQ ID NO: 2348803 - DNA, 19 bp, Homo sapiens
ttctggctgtgatcttaaa

SEQ ID NO: 2348804 - DNA, 22 bp, Homo sapiens
ttctggctgtgatcttaaaata

SEQ ID NO: 2348805 - DNA, 19 bp, Homo sapiens
ttctggggggatatttcct

SEQ ID NO: 2348806 - DNA, 15 bp, Homo sapiens
ttctggtactttctg

SEQ ID NO: 2348807 - DNA, 21 bp, Homo sapiens
ttctggtggtggcctgtttga

SEQ ID NO: 2348808 - DNA, 18 bp, Homo sapiens
ttctgtagcctaaaacga

SEQ ID NO: 2348809 - DNA, 14 bp, Homo sapiens
ttctgtcaaatgtg

SEQ ID NO: 2348810 - DNA, 16 bp, Homo sapiens
ttctgtgcctgaatat

SEQ ID NO: 2348811 - DNA, 23 bp, Homo sapiens
ttctgtggctgatttactaacag

SEQ ID NO: 2348812 - DNA, 23 bp, Homo sapiens
ttctgtggctggctctaccttcc

SEQ ID NO: 2348813 - DNA, 16 bp, Homo sapiens
ttcttacatgcatttg

SEQ ID NO: 2348814 - DNA, 18 bp, Homo sapiens
ttcttactaaaaagtata

SEQ ID NO: 2348815 - DNA, 20 bp, Homo sapiens
ttcttagtatgtgcatttaa

SEQ ID NO: 2348816 - DNA, 18 bp, Homo sapiens
ttcttatgaggaggggag

SEQ ID NO: 2348817 - DNA, 21 bp, Homo sapiens
ttcttatgtgacattaacaaa

SEQ ID NO: 2348818 - DNA, 18 bp, Homo sapiens
ttcttatttaatcttttc

SEQ ID NO: 2348819 - DNA, 21 bp, Homo sapiens
ttcttatttaatcttttctta

SEQ ID NO: 2348820 - DNA, 13 bp, Homo sapiens
ttcttatttcatt

SEQ ID NO: 2348821 - DNA, 21 bp, Homo sapiens
ttcttcaacatgctccaaata

SEQ ID NO: 2348822 - DNA, 14 bp, Homo sapiens
ttcttccaacatgt

SEQ ID NO: 2348823 - DNA, 21 bp, Homo sapiens
ttcttcctatttgccatgggc

SEQ ID NO: 2348824 - DNA, 19 bp, Homo sapiens
ttcttctcttagattctta

SEQ ID NO: 2348825 - DNA, 13 bp, Homo sapiens
ttcttctgaactc

SEQ ID NO: 2348826 - DNA, 20 bp, Homo sapiens
ttcttctgaactcaaactga

SEQ ID NO: 2348827 - DNA, 13 bp, Homo sapiens
ttcttctgtgtta

SEQ ID NO: 2348828 - DNA, 15 bp, Homo sapiens
ttcttctttctagag

SEQ ID NO: 2348829 - DNA, 16 bp, Homo sapiens
ttgaggtcaagtaaga

SEQ ID NO: 2348830 - DNA, 19 bp, Homo sapiens
ttgagtacctactgtgtgc

SEQ ID NO: 2348831 - DNA, 21 bp, Homo sapiens
ttgagtacctactgtgtgcca

SEQ ID NO: 2348832 - DNA, 14 bp, Homo sapiens
ttgagtattgttta

SEQ ID NO: 2348833 - DNA, 20 bp, Homo sapiens
ttgagtattgtttaaaatgt

SEQ ID NO: 2348834 - DNA, 17 bp, Homo sapiens
ttgagtctgtactaaac

SEQ ID NO: 2348835 - DNA, 16 bp, Homo sapiens
ttgagtttttcctccc

SEQ ID NO: 2348836 - DNA, 21 bp, Homo sapiens
ttgagtttttcctcccagtga

SEQ ID NO: 2348837 - DNA, 18 bp, Homo sapiens
ttgataaaccaaaaacat

SEQ ID NO: 2348838 - DNA, 14 bp, Homo sapiens
ttgataatgttaaa

SEQ ID NO: 2348839 - DNA, 19 bp, Homo sapiens
ttgataatgttaaatttgt

SEQ ID NO: 2348840 - DNA, 22 bp, Homo sapiens
ttgataatgttaaatttgtaag

SEQ ID NO: 2348841 - DNA, 23 bp, Homo sapiens
ttgatacgtccgtgtgtcccaga

SEQ ID NO: 2348842 - DNA, 16 bp, Homo sapiens
ttgatagggaactggg

SEQ ID NO: 2348843 - DNA, 13 bp, Homo sapiens
ttgatctgctctg

SEQ ID NO: 2348844 - DNA, 14 bp, Homo sapiens
ttgatctgctctgt

SEQ ID NO: 2348845 - DNA, 11 bp, Homo sapiens
ttgatgactgc

SEQ ID NO: 2348846 - DNA, 12 bp, Homo sapiens
ttgatgactgcc

SEQ ID NO: 2348847 - DNA, 14 bp, Homo sapiens
ttgatgactgcctt

SEQ ID NO: 2348848 - DNA, 13 bp, Homo sapiens
ttgatgtggccct

SEQ ID NO: 2348849 - DNA, 19 bp, Homo sapiens
ttgattatcttcagcccag

SEQ ID NO: 2348850 - DNA, 14 bp, Homo sapiens
ttgatttcaaagtt

SEQ ID NO: 2348851 - DNA, 18 bp, Homo sapiens
ttgatttgattgggatga

SEQ ID NO: 2348852 - DNA, 15 bp, Homo sapiens
ttgattttaatacat

SEQ ID NO: 2348853 - DNA, 20 bp, Homo sapiens
ttgatttttgcctcttccag

SEQ ID NO: 2348854 - DNA, 12 bp, Homo sapiens
ttgcaaagcaac

SEQ ID NO: 2348855 - DNA, 18 bp, Homo sapiens
ttgcaacctctttgctca

SEQ ID NO: 2348856 - DNA, 15 bp, Homo sapiens
ttgcaagatgtgaat

SEQ ID NO: 2348857 - DNA, 16 bp, Homo sapiens
ttgcaagtgctggagt

SEQ ID NO: 2348858 - DNA, 16 bp, Homo sapiens
ttgcaataacagctgc

SEQ ID NO: 2348859 - DNA, 20 bp, Homo sapiens
ttgcaataacagctgcaatt

SEQ ID NO: 2348860 - DNA, 20 bp, Homo sapiens
ttgcaccatactccttgctt

SEQ ID NO: 2348861 - DNA, 23 bp, Homo sapiens
ttgcaccatactccttgcttcct

SEQ ID NO: 2348862 - DNA, 22 bp, Homo sapiens
ttgcactgttctgattatgtaa

SEQ ID NO: 2348863 - DNA, 16 bp, Homo sapiens
ttgcagaactgtagct

SEQ ID NO: 2348864 - DNA, 22 bp, Homo sapiens
ttgcaggattcccttctgggct

SEQ ID NO: 2348865 - DNA, 23 bp, Homo sapiens
ttgcaggtgggggttgctgtata

SEQ ID NO: 2348866 - DNA, 13 bp, Homo sapiens
ttgcataagagct

SEQ ID NO: 2348867 - DNA, 17 bp, Homo sapiens
ttgcatactttgtattt

SEQ ID NO: 2348868 - DNA, 21 bp, Homo sapiens
ttgcatactttgtattttgat

SEQ ID NO: 2348869 - DNA, 19 bp, Homo sapiens
ttgcatatgagcctgccct

SEQ ID NO: 2348870 - DNA, 11 bp, Homo sapiens
ttgcatgcatg

SEQ ID NO: 2348871 - DNA, 15 bp, Homo sapiens
ttgcatttaaaacag

SEQ ID NO: 2348872 - DNA, 21 bp, Homo sapiens
ttgcatttaaaacagacactg

SEQ ID NO: 2348873 - DNA, 17 bp, Homo sapiens
ttgcatttttattaaag

SEQ ID NO: 2348874 - DNA, 21 bp, Homo sapiens
ttgcatttttattaaagcatt

SEQ ID NO: 2348875 - DNA, 17 bp, Homo sapiens
ttgccacagtagaactg

SEQ ID NO: 2348876 - DNA, 18 bp, Homo sapiens
ttgccacagtagaactgt

SEQ ID NO: 2348877 - DNA, 17 bp, Homo sapiens
ttgccagcaaataaata

SEQ ID NO: 2348878 - DNA, 15 bp, Homo sapiens
ttgccagggcagggt

SEQ ID NO: 2348879 - DNA, 15 bp, Homo sapiens
ttgccatgggcctgc

SEQ ID NO: 2348880 - DNA, 20 bp, Homo sapiens
ttgccatgggcttcactgta

SEQ ID NO: 2348881 - DNA, 22 bp, Homo sapiens
ttgccatgggcttcactgtata

SEQ ID NO: 2348882 - DNA, 21 bp, Homo sapiens
ttgcccgaaactaagccaggc

SEQ ID NO: 2348883 - DNA, 14 bp, Homo sapiens
ttgccgagagaggc

SEQ ID NO: 2348884 - DNA, 19 bp, Homo sapiens
ttgcctcccaggcaagcag

SEQ ID NO: 2348885 - DNA, 22 bp, Homo sapiens
ttgcctccccatttcccatctg

SEQ ID NO: 2348886 - DNA, 19 bp, Homo sapiens
ttgcctcttccagtcttcc

SEQ ID NO: 2348887 - DNA, 19 bp, Homo sapiens
ttgcctgaactcctgccat

SEQ ID NO: 2348888 - DNA, 21 bp, Homo sapiens
ttgcctgagaagaagtggctg

SEQ ID NO: 2348889 - DNA, 22 bp, Homo sapiens
ttgcctgagaagaagtggctgc

SEQ ID NO: 2348890 - DNA, 14 bp, Homo sapiens
ttgcgagtccaagg

SEQ ID NO: 2348891 - DNA, 16 bp, Homo sapiens
ttgcggcaaaaggaaa

SEQ ID NO: 2348892 - DNA, 18 bp, Homo sapiens
ttgctaatgctatgcaaa

SEQ ID NO: 2348893 - DNA, 22 bp, Homo sapiens
ttgctatcgccctcctttccct

SEQ ID NO: 2348894 - DNA, 16 bp, Homo sapiens
ttgctatttttgtaaa

SEQ ID NO: 2348895 - DNA, 17 bp, Homo sapiens
ttgctccagattctgat

SEQ ID NO: 2348896 - DNA, 17 bp, Homo sapiens
ttgctccgcctggcctg

SEQ ID NO: 2348897 - DNA, 21 bp, Homo sapiens
ttgctctgtcccccaggctgg

SEQ ID NO: 2348898 - DNA, 22 bp, Homo sapiens
ttgctctgtcccccaggctgga

SEQ ID NO: 2348899 - DNA, 19 bp, Homo sapiens
ttgctgaaattttatatgc

SEQ ID NO: 2348900 - DNA, 21 bp, Homo sapiens
ttgctgatcagagttcctcct

SEQ ID NO: 2348901 - DNA, 13 bp, Homo sapiens
ttgctgcaaacct

SEQ ID NO: 2348902 - DNA, 15 bp, Homo sapiens
ttgctgcaaacctga

SEQ ID NO: 2348903 - DNA, 23 bp, Homo sapiens
ttgctgcattgatccaggagata

SEQ ID NO: 2348904 - DNA, 20 bp, Homo sapiens
ttgctgccattacagaggta

SEQ ID NO: 2348905 - DNA, 18 bp, Homo sapiens
ttgctgctgtccagtgcc

SEQ ID NO: 2348906 - DNA, 22 bp, Homo sapiens
ttgctggccagtccaccctgcc

SEQ ID NO: 2348907 - DNA, 14 bp, Homo sapiens
ttgctggccccagc

SEQ ID NO: 2348908 - DNA, 16 bp, Homo sapiens
ttgctgtataagttat

SEQ ID NO: 2348909 - DNA, 17 bp, Homo sapiens
ttgctgtccaggcagct

SEQ ID NO: 2348910 - DNA, 18 bp, Homo sapiens
ttgctgtgaacaattgtc

SEQ ID NO: 2348911 - DNA, 15 bp, Homo sapiens
ttgcttaaaagcatt

SEQ ID NO: 2348912 - DNA, 18 bp, Homo sapiens
ttgcttaaaccacttaaa

SEQ ID NO: 2348913 - DNA, 13 bp, Homo sapiens
ttgcttactggtg

SEQ ID NO: 2348914 - DNA, 16 bp, Homo sapiens
ttgcttgccaaagtac

SEQ ID NO: 2348915 - DNA, 14 bp, Homo sapiens
ttgctttggggggt

SEQ ID NO: 2348916 - DNA, 21 bp, Homo sapiens
ttgctttggggggtgtgctga

SEQ ID NO: 2348917 - DNA, 22 bp, Homo sapiens
ttggaaatagaaagaagccata

SEQ ID NO: 2348918 - DNA, 23 bp, Homo sapiens
ttggaaatagaaagaagccatat

SEQ ID NO: 2348919 - DNA, 18 bp, Homo sapiens
ttggaaatgtctgctggt

SEQ ID NO: 2348920 - DNA, 11 bp, Homo sapiens
ttggaaattcc

SEQ ID NO: 2348921 - DNA, 14 bp, Homo sapiens
ttggaactctactc

SEQ ID NO: 2348922 - DNA, 22 bp, Homo sapiens
ttggaactctactcaacccatt

SEQ ID NO: 2348923 - DNA, 18 bp, Homo sapiens
ttggaaggatctgctgag

SEQ ID NO: 2348924 - DNA, 20 bp, Homo sapiens
ttggaaggatctgctgaggc

SEQ ID NO: 2348925 - DNA, 22 bp, Homo sapiens
ttggaagtgcagtcagcagatg

SEQ ID NO: 2348926 - DNA, 13 bp, Homo sapiens
ttggaatattaaa

SEQ ID NO: 2348927 - DNA, 15 bp, Homo sapiens
ttggacactgtacaa

SEQ ID NO: 2348928 - DNA, 15 bp, Homo sapiens
ttggaccatgccaga

SEQ ID NO: 2348929 - DNA, 22 bp, Homo sapiens
ttggagaaccagggctcttctc

SEQ ID NO: 2348930 - DNA, 16 bp, Homo sapiens
ttggatggcttgtcta

SEQ ID NO: 2348931 - DNA, 17 bp, Homo sapiens
ttggattatttaataac

SEQ ID NO: 2348932 - DNA, 20 bp, Homo sapiens
ttggattatttaataacatt

SEQ ID NO: 2348933 - DNA, 14 bp, Homo sapiens
ttggcagtctgaat

SEQ ID NO: 2348934 - DNA, 12 bp, Homo sapiens
ttggcctgctgt

SEQ ID NO: 2348935 - DNA, 18 bp, Homo sapiens
ttggcgaatctcaaaatt

SEQ ID NO: 2348936 - DNA, 19 bp, Homo sapiens
ttggcgtagcagagttaaa

SEQ ID NO: 2348937 - DNA, 13 bp, Homo sapiens
ttgggaaaacatg

SEQ ID NO: 2348938 - DNA, 11 bp, Homo sapiens
ttgggaggtgc

SEQ ID NO: 2348939 - DNA, 14 bp, Homo sapiens
ttgggatactgtaa

SEQ ID NO: 2348940 - DNA, 14 bp, Homo sapiens
ttgggatccttcag

SEQ ID NO: 2348941 - DNA, 21 bp, Homo sapiens
ttgggatccttcagcacagga

SEQ ID NO: 2348942 - DNA, 20 bp, Homo sapiens
ttgggcagtgccccagggag

SEQ ID NO: 2348943 - DNA, 11 bp, Homo sapiens
tttaagccata

SEQ ID NO: 2348944 - DNA, 19 bp, Homo sapiens
tttaaggggatctaaaaaa

SEQ ID NO: 2348945 - DNA, 23 bp, Homo sapiens
tttaaggggatctaaaaaaatgt

SEQ ID NO: 2348946 - DNA, 18 bp, Homo sapiens
tttaagtgcgtgtgtaga

SEQ ID NO: 2348947 - DNA, 20 bp, Homo sapiens
tttaagtgcgtgtgtagagt

SEQ ID NO: 2348948 - DNA, 16 bp, Homo sapiens
tttaagtggactgtat

SEQ ID NO: 2348949 - DNA, 17 bp, Homo sapiens
tttaagtggactgtatt

SEQ ID NO: 2348950 - DNA, 22 bp, Homo sapiens
tttaagtggactgtatttcggc

SEQ ID NO: 2348951 - DNA, 20 bp, Homo sapiens
tttaataacattaccttact

SEQ ID NO: 2348952 - DNA, 23 bp, Homo sapiens
tttaataacattaccttactgtg

SEQ ID NO: 2348953 - DNA, 12 bp, Homo sapiens
tttaatccagtt

SEQ ID NO: 2348954 - DNA, 21 bp, Homo sapiens
tttaatgtaatagggaaaatt

SEQ ID NO: 2348955 - DNA, 15 bp, Homo sapiens
tttaatgtctgttta

SEQ ID NO: 2348956 - DNA, 16 bp, Homo sapiens
tttaatttcaaatgta

SEQ ID NO: 2348957 - DNA, 19 bp, Homo sapiens
tttacaattttttatcatg

SEQ ID NO: 2348958 - DNA, 13 bp, Homo sapiens
tttacagaaatgg

SEQ ID NO: 2348959 - DNA, 17 bp, Homo sapiens
tttaccctggcccctct

SEQ ID NO: 2348960 - DNA, 23 bp, Homo sapiens
tttactgtctattaatattcagg

SEQ ID NO: 2348961 - DNA, 15 bp, Homo sapiens
tttacttttaaactg

SEQ ID NO: 2348962 - DNA, 24 bp, Homo sapiens
tttagacaaagccttaagcaaatt

SEQ ID NO: 2348963 - DNA, 19 bp, Homo sapiens
tttagcacagtatttaaca

SEQ ID NO: 2348964 - DNA, 13 bp, Homo sapiens
tttaggcagcctg

SEQ ID NO: 2348965 - DNA, 20 bp, Homo sapiens
tttaggcagcctgccgccgt

SEQ ID NO: 2348966 - DNA, 22 bp, Homo sapiens
tttagtgatagatgtagtcttg

SEQ ID NO: 2348967 - DNA, 18 bp, Homo sapiens
tttagtgtttatgtttaa

SEQ ID NO: 2348968 - DNA, 13 bp, Homo sapiens
tttataagttttt

SEQ ID NO: 2348969 - DNA, 14 bp, Homo sapiens
tttataatgatgaa

SEQ ID NO: 2348970 - DNA, 20 bp, Homo sapiens
tttataatgatgaacttata

SEQ ID NO: 2348971 - DNA, 16 bp, Homo sapiens
tttatactgaaggaaa

SEQ ID NO: 2348972 - DNA, 18 bp, Homo sapiens
tttatagcaacaacaatt

SEQ ID NO: 2348973 - DNA, 23 bp, Homo sapiens
tttatatcaggtgtataaatgta

SEQ ID NO: 2348974 - DNA, 14 bp, Homo sapiens
tttatatgattaaa

SEQ ID NO: 2348975 - DNA, 15 bp, Homo sapiens
tttatatgattaaat

SEQ ID NO: 2348976 - DNA, 19 bp, Homo sapiens
tttatatttcctttatgtg

SEQ ID NO: 2348977 - DNA, 20 bp, Homo sapiens
tttatatttcctttatgtga

SEQ ID NO: 2348978 - DNA, 20 bp, Homo sapiens
tttatctaatacctctgtgt

SEQ ID NO: 2348979 - DNA, 15 bp, Homo sapiens
tttatcttattttct

SEQ ID NO: 2348980 - DNA, 17 bp, Homo sapiens
tttatgagccagacaaa

SEQ ID NO: 2348981 - DNA, 12 bp, Homo sapiens
tttatgatttaa

SEQ ID NO: 2348982 - DNA, 21 bp, Homo sapiens
tttatggttacttcttctctt

SEQ ID NO: 2348983 - DNA, 12 bp, Homo sapiens
tttatgtaatta

SEQ ID NO: 2348984 - DNA, 13 bp, Homo sapiens
tttatgtgaattt

SEQ ID NO: 2348985 - DNA, 18 bp, Homo sapiens
tttatgtttaaaagaaat

SEQ ID NO: 2348986 - DNA, 18 bp, Homo sapiens
tttattaaagcatttcct

SEQ ID NO: 2348987 - DNA, 19 bp, Homo sapiens
tttattaaagcatttccta

SEQ ID NO: 2348988 - DNA, 12 bp, Homo sapiens
tttattgagtac

SEQ ID NO: 2348989 - DNA, 20 bp, Homo sapiens
tttatttccactaaaaatat

SEQ ID NO: 2348990 - DNA, 12 bp, Homo sapiens
tttattttccta

SEQ ID NO: 2348991 - DNA, 17 bp, Homo sapiens
tttcaaaaaccagccag

SEQ ID NO: 2348992 - DNA, 21 bp, Homo sapiens
tttcaaaaggtattatacatg

SEQ ID NO: 2348993 - DNA, 13 bp, Homo sapiens
tttcaaaatacat

SEQ ID NO: 2348994 - DNA, 12 bp, Homo sapiens
tttcaaagtttt

SEQ ID NO: 2348995 - DNA, 16 bp, Homo sapiens
tttcaaataatgcttt

SEQ ID NO: 2348996 - DNA, 21 bp, Homo sapiens
tttcaaataatgcttttctaa

SEQ ID NO: 2348997 - DNA, 16 bp, Homo sapiens
tttcaaatcattcctt

SEQ ID NO: 2348998 - DNA, 21 bp, Homo sapiens
tttcaaatcattccttagata

SEQ ID NO: 2348999 - DNA, 23 bp, Homo sapiens
tttcaagaataatcacgctttcc

SEQ ID NO: 2349000 - DNA, 12 bp, Homo sapiens
tttcaagattct

SEQ ID NO: 2349001 - DNA, 16 bp, Homo sapiens
tttcaagattctaaag

SEQ ID NO: 2349002 - DNA, 21 bp, Homo sapiens
tttcaaggcatttattgccat

SEQ ID NO: 2349003 - DNA, 22 bp, Homo sapiens
tttcaagttccaagttgctaat

SEQ ID NO: 2349004 - DNA, 17 bp, Homo sapiens
tttcaatacccttttaa

SEQ ID NO: 2349005 - DNA, 19 bp, Homo sapiens
tttcaatatattgaacttt

SEQ ID NO: 2349006 - DNA, 18 bp, Homo sapiens
tttcctttttgacactga

SEQ ID NO: 2349007 - DNA, 13 bp, Homo sapiens
tttctaaaagctt

SEQ ID NO: 2349008 - DNA, 12 bp, Homo sapiens
tttctaaagact

SEQ ID NO: 2349009 - DNA, 20 bp, Homo sapiens
tttctaaataaaaatatgta

SEQ ID NO: 2349010 - DNA, 18 bp, Homo sapiens
tttctaacagtccttgct

SEQ ID NO: 2349011 - DNA, 11 bp, Homo sapiens
tttctaagaga

SEQ ID NO: 2349012 - DNA, 12 bp, Homo sapiens
tttctaattgta

SEQ ID NO: 2349013 - DNA, 22 bp, Homo sapiens
tttctaattgtaagtgaaatta

SEQ ID NO: 2349014 - DNA, 15 bp, Homo sapiens
tttctatgacaaatt

SEQ ID NO: 2349015 - DNA, 20 bp, Homo sapiens
tttctattaatatcaactct

SEQ ID NO: 2349016 - DNA, 20 bp, Homo sapiens
tttctcagtgttggtatatt

SEQ ID NO: 2349017 - DNA, 16 bp, Homo sapiens
tttctcctcccttcct

SEQ ID NO: 2349018 - DNA, 11 bp, Homo sapiens
tttctccttgg

SEQ ID NO: 2349019 - DNA, 12 bp, Homo sapiens
tttctccttggt

SEQ ID NO: 2349020 - DNA, 16 bp, Homo sapiens
tttctccttggtttgc

SEQ ID NO: 2349021 - DNA, 19 bp, Homo sapiens
tttctcgtggtagaagcca

SEQ ID NO: 2349022 - DNA, 20 bp, Homo sapiens
tttctctccagcctgacttg

SEQ ID NO: 2349023 - DNA, 22 bp, Homo sapiens
tttctctgcatttaaaaaaatc

SEQ ID NO: 2349024 - DNA, 16 bp, Homo sapiens
tttctctgtggctcca

SEQ ID NO: 2349025 - DNA, 14 bp, Homo sapiens
tttctctttaaact

SEQ ID NO: 2349026 - DNA, 13 bp, Homo sapiens
tttctgaaaagat

SEQ ID NO: 2349027 - DNA, 14 bp, Homo sapiens
tttctgaaacacac

SEQ ID NO: 2349028 - DNA, 21 bp, Homo sapiens
tttctgaggtgcactgggagg

SEQ ID NO: 2349029 - DNA, 14 bp, Homo sapiens
tttctgccctggct

SEQ ID NO: 2349030 - DNA, 15 bp, Homo sapiens
tttctgccctggctg

SEQ ID NO: 2349031 - DNA, 11 bp, Homo sapiens
tttctgcctcg

SEQ ID NO: 2349032 - DNA, 14 bp, Homo sapiens
tttctgctctgcca

SEQ ID NO: 2349033 - DNA, 14 bp, Homo sapiens
tttctggggcctag

SEQ ID NO: 2349034 - DNA, 18 bp, Homo sapiens
tttctgtagcctaaaacg

SEQ ID NO: 2349035 - DNA, 17 bp, Homo sapiens
tttctgtggctggctct

SEQ ID NO: 2349036 - DNA, 16 bp, Homo sapiens
tttcttaaaccttcag

SEQ ID NO: 2349037 - DNA, 22 bp, Homo sapiens
tttcttagctttttaattgttg

SEQ ID NO: 2349038 - DNA, 13 bp, Homo sapiens
tttcttatgtgac

SEQ ID NO: 2349039 - DNA, 15 bp, Homo sapiens
tttcttatttttgtc

SEQ ID NO: 2349040 - DNA, 18 bp, Homo sapiens
tttcttcaacatgctcca

SEQ ID NO: 2349041 - DNA, 14 bp, Homo sapiens
tttcttcagggtaa

SEQ ID NO: 2349042 - DNA, 13 bp, Homo sapiens
tttcttctattaa

SEQ ID NO: 2349043 - DNA, 19 bp, Homo sapiens
tttcttctcttatcctctc

SEQ ID NO: 2349044 - DNA, 23 bp, Homo sapiens
tttcttctcttatcctctctctc

SEQ ID NO: 2349045 - DNA, 15 bp, Homo sapiens
tttcttctttccctg

SEQ ID NO: 2349046 - DNA, 14 bp, Homo sapiens
tttcttctttctag

SEQ ID NO: 2349047 - DNA, 12 bp, Homo sapiens
tttctttctagt

SEQ ID NO: 2349048 - DNA, 14 bp, Homo sapiens
tttctttgaccaga

SEQ ID NO: 2349049 - DNA, 15 bp, Homo sapiens
tttctttgcattcca

SEQ ID NO: 2349050 - DNA, 19 bp, Homo sapiens
tttcttttgtaataaacta

SEQ ID NO: 2349051 - DNA, 18 bp, Homo sapiens
tttctttttttctttaat

SEQ ID NO: 2349052 - DNA, 14 bp, Homo sapiens
tttgaaaaatctca

SEQ ID NO: 2349053 - DNA, 16 bp, Homo sapiens
tttgaaaagcagacat

SEQ ID NO: 2349054 - DNA, 17 bp, Homo sapiens
tttgaaaagttggaagg

SEQ ID NO: 2349055 - DNA, 20 bp, Homo sapiens
tttgaaacaaagtactcttt

SEQ ID NO: 2349056 - DNA, 17 bp, Homo sapiens
tttgaaagtagagctag

SEQ ID NO: 2349057 - DNA, 20 bp, Homo sapiens
tttgaacatgtttaatgggt

SEQ ID NO: 2349058 - DNA, 22 bp, Homo sapiens
tttgaagtaggtggcttgagct

SEQ ID NO: 2349059 - DNA, 15 bp, Homo sapiens
tttgaataaatgtgt

SEQ ID NO: 2349060 - DNA, 16 bp, Homo sapiens
tttgaatgcttcctga

SEQ ID NO: 2349061 - DNA, 16 bp, Homo sapiens
tttgaatgtatttgat

SEQ ID NO: 2349062 - DNA, 12 bp, Homo sapiens
tttgacactgaa

SEQ ID NO: 2349063 - DNA, 22 bp, Homo sapiens
tttgaccatatagattttatta

SEQ ID NO: 2349064 - DNA, 19 bp, Homo sapiens
tttgagacagtttcttagc

SEQ ID NO: 2349065 - DNA, 14 bp, Homo sapiens
tttgagtaatgtga

SEQ ID NO: 2349066 - DNA, 19 bp, Homo sapiens
tttgagtttttcctcccag

SEQ ID NO: 2349067 - DNA, 15 bp, Homo sapiens
tttgataatgttaaa

SEQ ID NO: 2349068 - DNA, 17 bp, Homo sapiens
tttgataatgttaaatt

SEQ ID NO: 2349069 - DNA, 21 bp, Homo sapiens
tttgatataccaaattaaaaa

SEQ ID NO: 2349070 - DNA, 22 bp, Homo sapiens
tttgatataccaaattaaaaaa

SEQ ID NO: 2349071 - DNA, 15 bp, Homo sapiens
tttgatgtcagcctt

SEQ ID NO: 2349072 - DNA, 16 bp, Homo sapiens
tttgatgtcagccttg

SEQ ID NO: 2349073 - DNA, 17 bp, Homo sapiens
tttgatgttccttccag

SEQ ID NO: 2349074 - DNA, 17 bp, Homo sapiens
tttgattgggatgaatg

SEQ ID NO: 2349075 - DNA, 18 bp, Homo sapiens
tttgcacatgggattgct

SEQ ID NO: 2349076 - DNA, 14 bp, Homo sapiens
tttgcactaaatca

SEQ ID NO: 2349077 - DNA, 19 bp, Homo sapiens
tttgcactaaatcagagac

SEQ ID NO: 2349078 - DNA, 20 bp, Homo sapiens
tttgcactaaatcagagaca

SEQ ID NO: 2349079 - DNA, 19 bp, Homo sapiens
tttgcatttaaaacagaca

SEQ ID NO: 2349080 - DNA, 17 bp, Homo sapiens
tttgcctcttccagtct

SEQ ID NO: 2349081 - DNA, 16 bp, Homo sapiens
tttgcctgaggctgta

SEQ ID NO: 2349082 - DNA, 22 bp, Homo sapiens
tttgctcataagtaaatgtctt

SEQ ID NO: 2349083 - DNA, 23 bp, Homo sapiens
tttgctccagataactctctttc

SEQ ID NO: 2349084 - DNA, 18 bp, Homo sapiens
tttgctttcttgtctttt

SEQ ID NO: 2349085 - DNA, 15 bp, Homo sapiens
tttggaaaaaactct

SEQ ID NO: 2349086 - DNA, 20 bp, Homo sapiens
tttggagagggggcctggga

SEQ ID NO: 2349087 - DNA, 18 bp, Homo sapiens
tttggattctaaatacat

SEQ ID NO: 2349088 - DNA, 19 bp, Homo sapiens
tttggattctaaatacatg

SEQ ID NO: 2349089 - DNA, 15 bp, Homo sapiens
tttggggcttgatga

SEQ ID NO: 2349090 - DNA, 20 bp, Homo sapiens
tttggggggcagagaataaa

SEQ ID NO: 2349091 - DNA, 19 bp, Homo sapiens
tttggggggtgtgctgaca

SEQ ID NO: 2349092 - DNA, 19 bp, Homo sapiens
tttggtagctgggaaagca

SEQ ID NO: 2349093 - DNA, 21 bp, Homo sapiens
tttggtagctgggaaagcata

SEQ ID NO: 2349094 - DNA, 22 bp, Homo sapiens
tttgtaaaaatcttttgaagca

SEQ ID NO: 2349095 - DNA, 16 bp, Homo sapiens
tttgtaaaacagtggt

SEQ ID NO: 2349096 - DNA, 18 bp, Homo sapiens
tttgtaaattatttatgt

SEQ ID NO: 2349097 - DNA, 19 bp, Homo sapiens
tttgtaacccactgagagg

SEQ ID NO: 2349098 - DNA, 16 bp, Homo sapiens
tttgtaagagtgtaga

SEQ ID NO: 2349099 - DNA, 14 bp, Homo sapiens
tttgtaagtttcag

SEQ ID NO: 2349100 - DNA, 16 bp, Homo sapiens
tttgtaccaagtaaat

SEQ ID NO: 2349101 - DNA, 16 bp, Homo sapiens
tttgtactgaattttt

SEQ ID NO: 2349102 - DNA, 13 bp, Homo sapiens
tttgtattttcat

SEQ ID NO: 2349103 - DNA, 10 bp, Homo sapiens
tttgtcccag

SEQ ID NO: 2349104 - DNA, 21 bp, Homo sapiens
tttgtgaaacagttgctgtga

SEQ ID NO: 2349105 - DNA, 15 bp, Homo sapiens
tttgtgattcaatct

SEQ ID NO: 2349106 - DNA, 15 bp, Homo sapiens
tttgtgcaaagccaa

SEQ ID NO: 2349107 - DNA, 16 bp, Homo sapiens
tttgtggtttggaata

SEQ ID NO: 2349108 - DNA, 13 bp, Homo sapiens
tttgtgtaactga

SEQ ID NO: 2349109 - DNA, 11 bp, Homo sapiens
tttgtgtcctc

SEQ ID NO: 2349110 - DNA, 15 bp, Homo sapiens
tttgtgtgtgtgtca

SEQ ID NO: 2349111 - DNA, 18 bp, Homo sapiens
tttgttcataataaaagt

SEQ ID NO: 2349112 - DNA, 14 bp, Homo sapiens
tttgttgccccaga

SEQ ID NO: 2349113 - DNA, 18 bp, Homo sapiens
tttgttgtacttaaatgg

SEQ ID NO: 2349114 - DNA, 13 bp, Homo sapiens
ttttaaaaaccta

SEQ ID NO: 2349115 - DNA, 17 bp, Homo sapiens
ttttaaaaaggtaaatg

SEQ ID NO: 2349116 - DNA, 14 bp, Homo sapiens
ttttaaaatagaaa

SEQ ID NO: 2349117 - DNA, 15 bp, Homo sapiens
ttttaaaatttcata

SEQ ID NO: 2349118 - DNA, 23 bp, Homo sapiens
ttttaaagaccctcctattctat

SEQ ID NO: 2349119 - DNA, 13 bp, Homo sapiens
ttttaaagtgcaa

SEQ ID NO: 2349120 - DNA, 12 bp, Homo sapiens
ttttaaagttca

SEQ ID NO: 2349121 - DNA, 18 bp, Homo sapiens
ttttaaagttcattgcaa

SEQ ID NO: 2349122 - DNA, 15 bp, Homo sapiens
ttttgttattaaaca

SEQ ID NO: 2349123 - DNA, 16 bp, Homo sapiens
ttttgtttggtaaatg

SEQ ID NO: 2349124 - DNA, 19 bp, Homo sapiens
tttttaaaaaggtaaatgg

SEQ ID NO: 2349125 - DNA, 12 bp, Homo sapiens
tttttaaaattt

SEQ ID NO: 2349126 - DNA, 15 bp, Homo sapiens
tttttaaagaatgtt

SEQ ID NO: 2349127 - DNA, 15 bp, Homo sapiens
tttttaaatcatgtt

SEQ ID NO: 2349128 - DNA, 19 bp, Homo sapiens
tttttagattgagaaatgt

SEQ ID NO: 2349129 - DNA, 13 bp, Homo sapiens
tttttaggaaatg

SEQ ID NO: 2349130 - DNA, 13 bp, Homo sapiens
tttttataattgt

SEQ ID NO: 2349131 - DNA, 21 bp, Homo sapiens
tttttatatcatgcaaaatat

SEQ ID NO: 2349132 - DNA, 17 bp, Homo sapiens
tttttatcatgcatgtc

SEQ ID NO: 2349133 - DNA, 14 bp, Homo sapiens
tttttattaaaata

SEQ ID NO: 2349134 - DNA, 21 bp, Homo sapiens
tttttattaaagcatttccta

SEQ ID NO: 2349135 - DNA, 13 bp, Homo sapiens
tttttcattgtgt

SEQ ID NO: 2349136 - DNA, 11 bp, Homo sapiens
tttttcctcct

SEQ ID NO: 2349137 - DNA, 15 bp, Homo sapiens
tttttctaagagaag

SEQ ID NO: 2349138 - DNA, 16 bp, Homo sapiens
tttttctcaaagtttt

SEQ ID NO: 2349139 - DNA, 18 bp, Homo sapiens
tttttctcaaagttttga

SEQ ID NO: 2349140 - DNA, 23 bp, Homo sapiens
tttttcttctattaatcaagaga

SEQ ID NO: 2349141 - DNA, 11 bp, Homo sapiens
tttttgtttgg

SEQ ID NO: 2349142 - DNA, 12 bp, Homo sapiens
ttttttaagctt

SEQ ID NO: 2349143 - DNA, 23 bp, Homo sapiens
ttttttaagcttcagttgcttgt

SEQ ID NO: 2349144 - DNA, 18 bp, Homo sapiens
ttttttaagttcttatga

SEQ ID NO: 2349145 - DNA, 13 bp, Homo sapiens
ttttttatacatt

SEQ ID NO: 2349146 - DNA, 11 bp, Homo sapiens
ttttttattat

SEQ ID NO: 2349147 - DNA, 15 bp, Homo sapiens
ttttttctaagagaa

SEQ ID NO: 2349148 - DNA, 13 bp, Homo sapiens
ttttttgtatgtg

SEQ ID NO: 2349149 - DNA, 12 bp, Homo sapiens
tttttttaagtg

SEQ ID NO: 2349150 - DNA, 19 bp, Homo sapiens
ccccctcttcctccctggg

SEQ ID NO: 2349151 - DNA, 12 bp, Homo sapiens
ccccctgccctg

SEQ ID NO: 2349152 - DNA, 13 bp, Homo sapiens
ccccctgccctgc

SEQ ID NO: 2349153 - DNA, 14 bp, Homo sapiens
ccccctgccctgca

SEQ ID NO: 2349154 - DNA, 21 bp, Homo sapiens
ccccctttagatctctgaagc

SEQ ID NO: 2349155 - DNA, 12 bp, Homo sapiens
ccccgcccccag

SEQ ID NO: 2349156 - DNA, 14 bp, Homo sapiens
ccccgcctggccag

SEQ ID NO: 2349157 - DNA, 13 bp, Homo sapiens
ctgtgatgagctg

SEQ ID NO: 2349158 - DNA, 14 bp, Homo sapiens
ctgtgatgagctga

SEQ ID NO: 2349159 - DNA, 22 bp, Homo sapiens
ctgtgattccactacacctggc

SEQ ID NO: 2349160 - DNA, 19 bp, Homo sapiens
ctgtgattgggtgggattt

SEQ ID NO: 2349161 - DNA, 22 bp, Homo sapiens
ctgtgcacaccccactcccaca

SEQ ID NO: 2349162 - DNA, 13 bp, Homo sapiens
ctgtgcacctacc

SEQ ID NO: 2349163 - DNA, 15 bp, Homo sapiens
ctgtgcatgtatgtc

SEQ ID NO: 2349164 - DNA, 14 bp, Homo sapiens
ctgtgccactgact

SEQ ID NO: 2349165 - DNA, 20 bp, Homo sapiens
ctgtgccactgacttgctgt

SEQ ID NO: 2349166 - DNA, 22 bp, Homo sapiens
ctgtgccactgacttgctgtgt

SEQ ID NO: 2349167 - DNA, 21 bp, Homo sapiens
ctgtgccccctcccaccctgc

SEQ ID NO: 2349168 - DNA, 15 bp, Homo sapiens
ctgtgcctggcccca

SEQ ID NO: 2349169 - DNA, 20 bp, Homo sapiens
ctgtgcctggccccagcctg

SEQ ID NO: 2349170 - DNA, 21 bp, Homo sapiens
ctgtgcgtcttggtgtaattt

SEQ ID NO: 2349171 - DNA, 17 bp, Homo sapiens
ctgtgctcccctgccac

SEQ ID NO: 2349172 - DNA, 18 bp, Homo sapiens
ctgtgctcccctgccaca

SEQ ID NO: 2349173 - DNA, 20 bp, Homo sapiens
ttctaaatgcatatcctgag

SEQ ID NO: 2349174 - DNA, 13 bp, Homo sapiens
ttctaacagtcct

SEQ ID NO: 2349175 - DNA, 13 bp, Homo sapiens
ttctaagagaagt

SEQ ID NO: 2349176 - DNA, 20 bp, Homo sapiens
ttctacaactgattgcaaca

SEQ ID NO: 2349177 - DNA, 16 bp, Homo sapiens
ttctacaaggactcca

SEQ ID NO: 2349178 - DNA, 17 bp, Homo sapiens
ttctactttaaattgtg

SEQ ID NO: 2349179 - DNA, 11 bp, Homo sapiens
ttctaggaaaa

SEQ ID NO: 2349180 - DNA, 21 bp, Homo sapiens
ttctaggcccattgtcctcct

SEQ ID NO: 2349181 - DNA, 18 bp, Homo sapiens
ttctagtggtctttgtaa

SEQ ID NO: 2349182 - DNA, 20 bp, Homo sapiens
ttctagtggtctttgtaaga

SEQ ID NO: 2349183 - DNA, 11 bp, Homo sapiens
ttctataaaaa

SEQ ID NO: 2349184 - DNA, 21 bp, Homo sapiens
ttctataaaactctgcatgta

SEQ ID NO: 2349185 - DNA, 17 bp, Homo sapiens
ttctatgacaaattcaa

SEQ ID NO: 2349186 - DNA, 22 bp, Homo sapiens
ttctattaatatcaactctgaa

SEQ ID NO: 2349187 - DNA, 17 bp, Homo sapiens
ttctattaatcaagaga

SEQ ID NO: 2349188 - DNA, 22 bp, Homo sapiens
ttctattaatcaagagaaactt

SEQ ID NO: 2349189 - DNA, 18 bp, Homo sapiens
ttctattatggaaaactg

SEQ ID NO: 2349190 - DNA, 14 bp, Homo sapiens
ttctatttggggct

SEQ ID NO: 2349191 - DNA, 18 bp, Homo sapiens
ttctatttggggcttgat

SEQ ID NO: 2349192 - DNA, 15 bp, Homo sapiens
ttctcaaagttttga

SEQ ID NO: 2349193 - DNA, 13 bp, Homo sapiens
ttctcaagacctg

SEQ ID NO: 2349194 - DNA, 23 bp, Homo sapiens
ttctcaggacagcatcccttccc

SEQ ID NO: 2349195 - DNA, 19 bp, Homo sapiens
ttctcattcccatgtggaa

SEQ ID NO: 2349196 - DNA, 20 bp, Homo sapiens
ttctcattgacttttataaa

SEQ ID NO: 2349197 - DNA, 12 bp, Homo sapiens
ttctccatccct

SEQ ID NO: 2349198 - DNA, 18 bp, Homo sapiens
ttctcccactctcctagg

SEQ ID NO: 2349199 - DNA, 18 bp, Homo sapiens
ttctccccagagctgcct

SEQ ID NO: 2349200 - DNA, 19 bp, Homo sapiens
ttctccccagagctgcctg

SEQ ID NO: 2349201 - DNA, 13 bp, Homo sapiens
ttctccgccagcc

SEQ ID NO: 2349202 - DNA, 15 bp, Homo sapiens
ttctccgccagcctc

SEQ ID NO: 2349203 - DNA, 20 bp, Homo sapiens
ttctccgccagcctcctctg

SEQ ID NO: 2349204 - DNA, 21 bp, Homo sapiens
ttctccgccagcctcctctgg

SEQ ID NO: 2349205 - DNA, 19 bp, Homo sapiens
ttctcctcccttccttttc

SEQ ID NO: 2349206 - DNA, 15 bp, Homo sapiens
ttctcggaattcata

SEQ ID NO: 2349207 - DNA, 17 bp, Homo sapiens
ttctcgtgcctccccac

SEQ ID NO: 2349208 - DNA, 21 bp, Homo sapiens
ttctctgctatatataaaacg

SEQ ID NO: 2349209 - DNA, 15 bp, Homo sapiens
ttctcttaagtggtc

SEQ ID NO: 2349210 - DNA, 19 bp, Homo sapiens
ttctcttatcctctctctc

SEQ ID NO: 2349211 - DNA, 14 bp, Homo sapiens
ttctcttgagctgg

SEQ ID NO: 2349212 - DNA, 16 bp, Homo sapiens
ttctcttgagctggcc

SEQ ID NO: 2349213 - DNA, 19 bp, Homo sapiens
ttctctttgtggtttcttg

SEQ ID NO: 2349214 - DNA, 21 bp, Homo sapiens
ttctcttttcccctttcctgt

SEQ ID NO: 2349215 - DNA, 22 bp, Homo sapiens
ttctcttttcccctttcctgtc

SEQ ID NO: 2349216 - DNA, 18 bp, Homo sapiens
ttctgaaacacacgagca

SEQ ID NO: 2349217 - DNA, 18 bp, Homo sapiens
ttctgaactcaaactgag

SEQ ID NO: 2349218 - DNA, 13 bp, Homo sapiens
ttctgagctcctg

SEQ ID NO: 2349219 - DNA, 15 bp, Homo sapiens
ttctgagctcctgtc

SEQ ID NO: 2349220 - DNA, 14 bp, Homo sapiens
ttctgatactttag

SEQ ID NO: 2349221 - DNA, 17 bp, Homo sapiens
ttctgcaacaagcatgc

SEQ ID NO: 2349222 - DNA, 14 bp, Homo sapiens
ttctgccctggctg

SEQ ID NO: 2349223 - DNA, 16 bp, Homo sapiens
ttctgccctggctgct

SEQ ID NO: 2349224 - DNA, 22 bp, Homo sapiens
ttctgcctttggggacttttct

SEQ ID NO: 2349225 - DNA, 21 bp, Homo sapiens
ttctgctggggcctgggacaa

SEQ ID NO: 2349226 - DNA, 22 bp, Homo sapiens
ttgcaaagagacatttcaaaac

SEQ ID NO: 2349227 - DNA, 13 bp, Homo sapiens
ttgcaaagtgtat

SEQ ID NO: 2349228 - DNA, 14 bp, Homo sapiens
ttgcaaccgtctgt

SEQ ID NO: 2349229 - DNA, 14 bp, Homo sapiens
ttgcaagatgtgaa

SEQ ID NO: 2349230 - DNA, 21 bp, Homo sapiens
ttgcaagatgtgaattattga

SEQ ID NO: 2349231 - DNA, 22 bp, Homo sapiens
ttgcaagatgtgaattattgac

SEQ ID NO: 2349232 - DNA, 23 bp, Homo sapiens
ttgcaagatgtgaattattgaca

SEQ ID NO: 2349233 - DNA, 18 bp, Homo sapiens
ttgcaataacagctgcaa

SEQ ID NO: 2349234 - DNA, 16 bp, Homo sapiens
ttgcacagctggagaa

SEQ ID NO: 2349235 - DNA, 19 bp, Homo sapiens
ttgcacttgttatattata

SEQ ID NO: 2349236 - DNA, 15 bp, Homo sapiens
ttgcaggattccctt

SEQ ID NO: 2349237 - DNA, 16 bp, Homo sapiens
ttgcaggattcccttc

SEQ ID NO: 2349238 - DNA, 19 bp, Homo sapiens
ttgcaggattcccttctgg

SEQ ID NO: 2349239 - DNA, 20 bp, Homo sapiens
ttgcatcactgtatcatttt

SEQ ID NO: 2349240 - DNA, 13 bp, Homo sapiens
ttgcatgcatgca

SEQ ID NO: 2349241 - DNA, 15 bp, Homo sapiens
ttgcatgcatgcaaa

SEQ ID NO: 2349242 - DNA, 17 bp, Homo sapiens
ttgcatgcatgcaaatg

SEQ ID NO: 2349243 - DNA, 15 bp, Homo sapiens
ttgcatgtggatcaa

SEQ ID NO: 2349244 - DNA, 22 bp, Homo sapiens
ttgcatttaaaacagacactgg

SEQ ID NO: 2349245 - DNA, 16 bp, Homo sapiens
ttgccaaagtacagaa

SEQ ID NO: 2349246 - DNA, 20 bp, Homo sapiens
ttgccacagtagaactgtct

SEQ ID NO: 2349247 - DNA, 13 bp, Homo sapiens
ttgccagcaaata

SEQ ID NO: 2349248 - DNA, 15 bp, Homo sapiens
ttgccaggacatgca

SEQ ID NO: 2349249 - DNA, 17 bp, Homo sapiens
ttgccaggacatgcaat

SEQ ID NO: 2349250 - DNA, 21 bp, Homo sapiens
ttgccatgggcttcactgtat

SEQ ID NO: 2349251 - DNA, 18 bp, Homo sapiens
ttgccatttgtagctttg

SEQ ID NO: 2349252 - DNA, 20 bp, Homo sapiens
ttgcccagtacatttaaatt

SEQ ID NO: 2349253 - DNA, 17 bp, Homo sapiens
ttgcccatcctgactga

SEQ ID NO: 2349254 - DNA, 13 bp, Homo sapiens
ttgcccccatttc

SEQ ID NO: 2349255 - DNA, 19 bp, Homo sapiens
ttgcccctttctcttttcc

SEQ ID NO: 2349256 - DNA, 19 bp, Homo sapiens
ttgcccgaaactaagccag

SEQ ID NO: 2349257 - DNA, 19 bp, Homo sapiens
ttgccctcccctgcccctc

SEQ ID NO: 2349258 - DNA, 13 bp, Homo sapiens
ttgcctcaccttg

SEQ ID NO: 2349259 - DNA, 21 bp, Homo sapiens
ttgcctcccaggcaagcagct

SEQ ID NO: 2349260 - DNA, 17 bp, Homo sapiens
ttgcctccccatttccc

SEQ ID NO: 2349261 - DNA, 16 bp, Homo sapiens
ttgcctttcgaggcct

SEQ ID NO: 2349262 - DNA, 17 bp, Homo sapiens
ttgcctttcgaggcctg

SEQ ID NO: 2349263 - DNA, 17 bp, Homo sapiens
ttgcggcaaaaggaaag

SEQ ID NO: 2349264 - DNA, 13 bp, Homo sapiens
ttgcgtagaggct

SEQ ID NO: 2349265 - DNA, 18 bp, Homo sapiens
ttgcgtggactctgcaca

SEQ ID NO: 2349266 - DNA, 20 bp, Homo sapiens
ttgctaaaacagcttcctgt

SEQ ID NO: 2349267 - DNA, 17 bp, Homo sapiens
ttgctagtatcttgggt

SEQ ID NO: 2349268 - DNA, 23 bp, Homo sapiens
ttgctatggcaggataagaaagc

SEQ ID NO: 2349269 - DNA, 18 bp, Homo sapiens
ttgctcagtgtccagctt

SEQ ID NO: 2349270 - DNA, 15 bp, Homo sapiens
ttgctcataagtaaa

SEQ ID NO: 2349271 - DNA, 12 bp, Homo sapiens
ttgctccagata

SEQ ID NO: 2349272 - DNA, 20 bp, Homo sapiens
ttgctccagattctgatgca

SEQ ID NO: 2349273 - DNA, 16 bp, Homo sapiens
ttgctctccattcttt

SEQ ID NO: 2349274 - DNA, 11 bp, Homo sapiens
ttgctctgccc

SEQ ID NO: 2349275 - DNA, 23 bp, Homo sapiens
ttgctgacaaccattaaagtcag

SEQ ID NO: 2349276 - DNA, 12 bp, Homo sapiens
ttgctgcagaga

SEQ ID NO: 2349277 - DNA, 19 bp, Homo sapiens
ttgctgctgtccagtgcct

SEQ ID NO: 2349278 - DNA, 19 bp, Homo sapiens
ttgctggtgcctgccacct

SEQ ID NO: 2349279 - DNA, 16 bp, Homo sapiens
ttgctgtccaggcagc

SEQ ID NO: 2349280 - DNA, 23 bp, Homo sapiens
ttgcttaaatttcttatgtgaca

SEQ ID NO: 2349281 - DNA, 11 bp, Homo sapiens
ttgcttcctga

SEQ ID NO: 2349282 - DNA, 12 bp, Homo sapiens
ttgctttctggt

SEQ ID NO: 2349283 - DNA, 17 bp, Homo sapiens
ttgctttgaaaaatctc

SEQ ID NO: 2349284 - DNA, 20 bp, Homo sapiens
ttgctttgtattgtatatta

SEQ ID NO: 2349285 - DNA, 15 bp, Homo sapiens
ttgcttttttccaaa

SEQ ID NO: 2349286 - DNA, 17 bp, Homo sapiens
ttggaaaaaactctgaa

SEQ ID NO: 2349287 - DNA, 14 bp, Homo sapiens
ttggaaagtcagaa

SEQ ID NO: 2349288 - DNA, 18 bp, Homo sapiens
ttggaaataaaagataaa

SEQ ID NO: 2349289 - DNA, 17 bp, Homo sapiens
ttggaaatgtctgctgg

SEQ ID NO: 2349290 - DNA, 23 bp, Homo sapiens
ttggaagagaggcacctgctgga

SEQ ID NO: 2349291 - DNA, 12 bp, Homo sapiens
tttcattgtgtt

SEQ ID NO: 2349292 - DNA, 15 bp, Homo sapiens
tttccaaaacaaaaa

SEQ ID NO: 2349293 - DNA, 13 bp, Homo sapiens
tttccaaattaaa

SEQ ID NO: 2349294 - DNA, 14 bp, Homo sapiens
tttccacacgcatt

SEQ ID NO: 2349295 - DNA, 18 bp, Homo sapiens
tttccacacgcattaata

SEQ ID NO: 2349296 - DNA, 22 bp, Homo sapiens
tttcccaaagcatccctcttag

SEQ ID NO: 2349297 - DNA, 13 bp, Homo sapiens
tttcccacactgt

SEQ ID NO: 2349298 - DNA, 18 bp, Homo sapiens
tttcccacactgtgaact

SEQ ID NO: 2349299 - DNA, 21 bp, Homo sapiens
tttcccactgtttaaggagtt

SEQ ID NO: 2349300 - DNA, 12 bp, Homo sapiens
tttcccatctgc

SEQ ID NO: 2349301 - DNA, 22 bp, Homo sapiens
tttcccatctgcaccccttctc

SEQ ID NO: 2349302 - DNA, 13 bp, Homo sapiens
tttccctggacag

SEQ ID NO: 2349303 - DNA, 23 bp, Homo sapiens
tttccctggacaggcagcctcct

SEQ ID NO: 2349304 - DNA, 15 bp, Homo sapiens
tttcccttccaaaga

SEQ ID NO: 2349305 - DNA, 20 bp, Homo sapiens
tttcctagctgttctaatta

SEQ ID NO: 2349306 - DNA, 20 bp, Homo sapiens
tttcctccctctgcccctcc

SEQ ID NO: 2349307 - DNA, 14 bp, Homo sapiens
tttcctcctctgcc

SEQ ID NO: 2349308 - DNA, 15 bp, Homo sapiens
tttcctcctctgcct

SEQ ID NO: 2349309 - DNA, 11 bp, Homo sapiens
tttcctcctgg

SEQ ID NO: 2349310 - DNA, 12 bp, Homo sapiens
tttcctctccac

SEQ ID NO: 2349311 - DNA, 19 bp, Homo sapiens
tttcctctccactgctgga

SEQ ID NO: 2349312 - DNA, 13 bp, Homo sapiens
tttcctcttgtga

SEQ ID NO: 2349313 - DNA, 14 bp, Homo sapiens
tttcctggtgccaa

SEQ ID NO: 2349314 - DNA, 15 bp, Homo sapiens
tttccttgtgcaaaa

SEQ ID NO: 2349315 - DNA, 15 bp, Homo sapiens
tttcctttatgtgaa

SEQ ID NO: 2349316 - DNA, 23 bp, Homo sapiens
tttcctttatgtgaatttttaag

SEQ ID NO: 2349317 - DNA, 17 bp, Homo sapiens
tttcctttttgacactg

SEQ ID NO: 2349318 - DNA, 13 bp, Homo sapiens
tttcgaggcctga

SEQ ID NO: 2349319 - DNA, 16 bp, Homo sapiens
tttctaaaagctttca

SEQ ID NO: 2349320 - DNA, 19 bp, Homo sapiens
tttctaaaagctttcatgt

SEQ ID NO: 2349321 - DNA, 14 bp, Homo sapiens
tttctaaataaaaa

SEQ ID NO: 2349322 - DNA, 17 bp, Homo sapiens
tttctaaataaaaatat

SEQ ID NO: 2349323 - DNA, 14 bp, Homo sapiens
tttctaacagtcct

SEQ ID NO: 2349324 - DNA, 15 bp, Homo sapiens
tttctaagaaaatgt

SEQ ID NO: 2349325 - DNA, 13 bp, Homo sapiens
tttctaattgtaa

SEQ ID NO: 2349326 - DNA, 19 bp, Homo sapiens
tttctacagtggttttata

SEQ ID NO: 2349327 - DNA, 21 bp, Homo sapiens
tttctactttaaattgtggat

SEQ ID NO: 2349328 - DNA, 13 bp, Homo sapiens
tttctagaccaat

SEQ ID NO: 2349329 - DNA, 17 bp, Homo sapiens
tttctagtggtctttgt

SEQ ID NO: 2349330 - DNA, 18 bp, Homo sapiens
tttctagtggtctttgta

SEQ ID NO: 2349331 - DNA, 19 bp, Homo sapiens
tttctagtggtctttgtaa

SEQ ID NO: 2349332 - DNA, 21 bp, Homo sapiens
tttctagtggtctttgtaaga

SEQ ID NO: 2349333 - DNA, 13 bp, Homo sapiens
tttctatgacaaa

SEQ ID NO: 2349334 - DNA, 13 bp, Homo sapiens
tttctcaaagttt

SEQ ID NO: 2349335 - DNA, 16 bp, Homo sapiens
tttctcaaagttttga

SEQ ID NO: 2349336 - DNA, 18 bp, Homo sapiens
tttctcaatgtcttccca

SEQ ID NO: 2349337 - DNA, 17 bp, Homo sapiens
tttctcagtgttggtat

SEQ ID NO: 2349338 - DNA, 15 bp, Homo sapiens
tttctcctcccttcc

SEQ ID NO: 2349339 - DNA, 17 bp, Homo sapiens
tttctccttaccgtctt

SEQ ID NO: 2349340 - DNA, 14 bp, Homo sapiens
tttctccttgaaat

SEQ ID NO: 2349341 - DNA, 12 bp, Homo sapiens
tttctctctcta

SEQ ID NO: 2349342 - DNA, 16 bp, Homo sapiens
tttctcttgagctggc

SEQ ID NO: 2349343 - DNA, 17 bp, Homo sapiens
tttctcttgagctggcc

SEQ ID NO: 2349344 - DNA, 22 bp, Homo sapiens
tttctcttttcccctttcctgt

SEQ ID NO: 2349345 - DNA, 19 bp, Homo sapiens
tttctgaaggtagcattct

SEQ ID NO: 2349346 - DNA, 20 bp, Homo sapiens
tttctggctgtgatcttaaa

SEQ ID NO: 2349347 - DNA, 20 bp, Homo sapiens
tttctggggggatatttcct

SEQ ID NO: 2349348 - DNA, 21 bp, Homo sapiens
tttctggggggatatttccta

SEQ ID NO: 2349349 - DNA, 13 bp, Homo sapiens
tttctgtagccta

SEQ ID NO: 2349350 - DNA, 17 bp, Homo sapiens
tttctgtgcctgaatat

SEQ ID NO: 2349351 - DNA, 21 bp, Homo sapiens
tttcttagctttttaattgtt

SEQ ID NO: 2349352 - DNA, 14 bp, Homo sapiens
tttcttatgtgaca

SEQ ID NO: 2349353 - DNA, 17 bp, Homo sapiens
tttcttatgtgacatta

SEQ ID NO: 2349354 - DNA, 15 bp, Homo sapiens
tttcttccaacatgt

SEQ ID NO: 2349355 - DNA, 14 bp, Homo sapiens
tttcttctgtgtta

SEQ ID NO: 2349356 - DNA, 16 bp, Homo sapiens
tttcttctttccctgg

SEQ ID NO: 2349357 - DNA, 14 bp, Homo sapiens
tttcttttgtaata

SEQ ID NO: 2349358 - DNA, 18 bp, Homo sapiens
tttctttttttttaagtt

SEQ ID NO: 2349359 - DNA, 13 bp, Homo sapiens
tttgaaaaatata

SEQ ID NO: 2349360 - DNA, 21 bp, Homo sapiens
tttgaaaaatataaaattatg

SEQ ID NO: 2349361 - DNA, 13 bp, Homo sapiens
tttgaaaagcaga

SEQ ID NO: 2349362 - DNA, 14 bp, Homo sapiens
tttgaaaagctatt

SEQ ID NO: 2349363 - DNA, 15 bp, Homo sapiens
tttgaaaagctatta

SEQ ID NO: 2349364 - DNA, 19 bp, Homo sapiens
tttgaaaagctattagcca

SEQ ID NO: 2349365 - DNA, 14 bp, Homo sapiens
tttgaaaagttgga

SEQ ID NO: 2349366 - DNA, 15 bp, Homo sapiens
tttgaaacaaagtac

SEQ ID NO: 2349367 - DNA, 23 bp, Homo sapiens
tttgaaagtaaaaacctgcttgg

SEQ ID NO: 2349368 - DNA, 23 bp, Homo sapiens
tttgaaagtagagctagctgcca

SEQ ID NO: 2349369 - DNA, 19 bp, Homo sapiens
tttgaactggtattgttta

SEQ ID NO: 2349370 - DNA, 18 bp, Homo sapiens
tttgaagatttaattact

SEQ ID NO: 2349371 - DNA, 23 bp, Homo sapiens
tttgaagtaggtggcttgagcta

SEQ ID NO: 2349372 - DNA, 17 bp, Homo sapiens
tttgaataaattatgag

SEQ ID NO: 2349373 - DNA, 14 bp, Homo sapiens
tttgaatatgtagt

SEQ ID NO: 2349374 - DNA, 13 bp, Homo sapiens
tttgaatgtaacc

SEQ ID NO: 2349375 - DNA, 15 bp, Homo sapiens
tttgaatgtaaccaa

SEQ ID NO: 2349376 - DNA, 12 bp, Homo sapiens
tttgaatgtttt

SEQ ID NO: 2349377 - DNA, 22 bp, Homo sapiens
tttgacacaaagcttctaaagc

SEQ ID NO: 2349378 - DNA, 17 bp, Homo sapiens
tttgacactgaaagttt

SEQ ID NO: 2349379 - DNA, 19 bp, Homo sapiens
tttgacactgaaagttttg

SEQ ID NO: 2349380 - DNA, 18 bp, Homo sapiens
tttgacttaagaaagcaa

SEQ ID NO: 2349381 - DNA, 15 bp, Homo sapiens
tttgagacagtttct

SEQ ID NO: 2349382 - DNA, 16 bp, Homo sapiens
tttgagacagtttctt

SEQ ID NO: 2349383 - DNA, 18 bp, Homo sapiens
tttgagacagtttcttag

SEQ ID NO: 2349384 - DNA, 20 bp, Homo sapiens
tttgagacagtttcttagct

SEQ ID NO: 2349385 - DNA, 22 bp, Homo sapiens
tttgagacagtttcttagcttt

SEQ ID NO: 2349386 - DNA, 19 bp, Homo sapiens
tttgagctattcacctcag

SEQ ID NO: 2349387 - DNA, 12 bp, Homo sapiens
tttgagctgcct

SEQ ID NO: 2349388 - DNA, 22 bp, Homo sapiens
tttgaggagaagggggtctctg

SEQ ID NO: 2349389 - DNA, 23 bp, Homo sapiens
tttgaggagaagggggtctctgt

SEQ ID NO: 2349390 - DNA, 19 bp, Homo sapiens
tttgagtcaaagacttaaa

SEQ ID NO: 2349391 - DNA, 13 bp, Homo sapiens
tttgagtgacagc

SEQ ID NO: 2349392 - DNA, 22 bp, Homo sapiens
tttgagtgacagctttctggga

SEQ ID NO: 2349393 - DNA, 16 bp, Homo sapiens
tttgagtttttcctcc

SEQ ID NO: 2349394 - DNA, 14 bp, Homo sapiens
tttgataatgttaa

SEQ ID NO: 2349395 - DNA, 19 bp, Homo sapiens
tttgatggagggtggaaat

SEQ ID NO: 2349396 - DNA, 15 bp, Homo sapiens
tttgatgttccttcc

SEQ ID NO: 2349397 - DNA, 17 bp, Homo sapiens
tttgattatttaagact

SEQ ID NO: 2349398 - DNA, 21 bp, Homo sapiens
tttgattgaataatgccacca

SEQ ID NO: 2349399 - DNA, 12 bp, Homo sapiens
tttgatttctaa

SEQ ID NO: 2349400 - DNA, 15 bp, Homo sapiens
tttgcaataacagct

SEQ ID NO: 2349401 - DNA, 21 bp, Homo sapiens
tttgcatgttttacttttatc

SEQ ID NO: 2349402 - DNA, 16 bp, Homo sapiens
tttgcatttaaaacag

SEQ ID NO: 2349403 - DNA, 19 bp, Homo sapiens
tttgccatgggcctgctgc

SEQ ID NO: 2349404 - DNA, 17 bp, Homo sapiens
tttgccccgggatatta

SEQ ID NO: 2349405 - DNA, 21 bp, Homo sapiens
tttgctactgttgtaagaatt

SEQ ID NO: 2349406 - DNA, 15 bp, Homo sapiens
tttgctagatggaat

SEQ ID NO: 2349407 - DNA, 19 bp, Homo sapiens
tttgctcataagtaaatgt

SEQ ID NO: 2349408 - DNA, 15 bp, Homo sapiens
tttgctgatccccaa

SEQ ID NO: 2349409 - DNA, 14 bp, Homo sapiens
tttaaaacccattt

SEQ ID NO: 2349410 - DNA, 21 bp, Homo sapiens
tttaaaacccatttaaatttt

SEQ ID NO: 2349411 - DNA, 17 bp, Homo sapiens
tttaaaaggatgtataa

SEQ ID NO: 2349412 - DNA, 16 bp, Homo sapiens
tttaaaataaaatgaa

SEQ ID NO: 2349413 - DNA, 19 bp, Homo sapiens
tttaaaataaaatgaaaat

SEQ ID NO: 2349414 - DNA, 22 bp, Homo sapiens
tttaaaataaaatgaaaattgt

SEQ ID NO: 2349415 - DNA, 22 bp, Homo sapiens
tttaaaatagaaattttgtaag

SEQ ID NO: 2349416 - DNA, 20 bp, Homo sapiens
tttaaaatattgttttccta

SEQ ID NO: 2349417 - DNA, 19 bp, Homo sapiens
tttaaaatgcttgggtaca

SEQ ID NO: 2349418 - DNA, 19 bp, Homo sapiens
tttaaaatggcatttagca

SEQ ID NO: 2349419 - DNA, 21 bp, Homo sapiens
tttaaaatggcatttagcaca

SEQ ID NO: 2349420 - DNA, 22 bp, Homo sapiens
tttaaaatgtaatttaaatgaa

SEQ ID NO: 2349421 - DNA, 21 bp, Homo sapiens
tttaaaattttgtatgttaaa

SEQ ID NO: 2349422 - DNA, 23 bp, Homo sapiens
tttaaacccaaaatatatacaca

SEQ ID NO: 2349423 - DNA, 15 bp, Homo sapiens
tttaaactgtgtaca

SEQ ID NO: 2349424 - DNA, 19 bp, Homo sapiens
tttaaactgtgtacataac

SEQ ID NO: 2349425 - DNA, 22 bp, Homo sapiens
tttaaactgtgtacataactga

SEQ ID NO: 2349426 - DNA, 22 bp, Homo sapiens
tttaaattacctttacatatat

SEQ ID NO: 2349427 - DNA, 14 bp, Homo sapiens
tttaacaagatgtt

SEQ ID NO: 2349428 - DNA, 22 bp, Homo sapiens
tttaacttttgaaaagaccaag

SEQ ID NO: 2349429 - DNA, 15 bp, Homo sapiens
tttaagagattttat

SEQ ID NO: 2349430 - DNA, 14 bp, Homo sapiens
tttaagatagtgta

SEQ ID NO: 2349431 - DNA, 14 bp, Homo sapiens
tttaagatttttct

SEQ ID NO: 2349432 - DNA, 18 bp, Homo sapiens
tttaagatttttctcaaa

SEQ ID NO: 2349433 - DNA, 17 bp, Homo sapiens
tttaagcacaaaaaatt

SEQ ID NO: 2349434 - DNA, 20 bp, Homo sapiens
tttaagctgcaaatctgatg

SEQ ID NO: 2349435 - DNA, 14 bp, Homo sapiens
tttaagcttcagtt

SEQ ID NO: 2349436 - DNA, 22 bp, Homo sapiens
tttaaggcagattttacagagc

SEQ ID NO: 2349437 - DNA, 20 bp, Homo sapiens
tttaagtgaatacattaacg

SEQ ID NO: 2349438 - DNA, 21 bp, Homo sapiens
tttaagtgcgtgtgtagagtt

SEQ ID NO: 2349439 - DNA, 12 bp, Homo sapiens
tttaataaaaga

SEQ ID NO: 2349440 - DNA, 16 bp, Homo sapiens
tttaataaaataattc

SEQ ID NO: 2349441 - DNA, 20 bp, Homo sapiens
tttaataaaataattctaaa

SEQ ID NO: 2349442 - DNA, 15 bp, Homo sapiens
tttaataaagatgag

SEQ ID NO: 2349443 - DNA, 15 bp, Homo sapiens
tttaataacattacc

SEQ ID NO: 2349444 - DNA, 22 bp, Homo sapiens
tttaataacattaccttactgt

SEQ ID NO: 2349445 - DNA, 22 bp, Homo sapiens
tttaatatactccttaaaaatg

SEQ ID NO: 2349446 - DNA, 17 bp, Homo sapiens
tttacaatagttctgtg

SEQ ID NO: 2349447 - DNA, 15 bp, Homo sapiens
tttacacatcttaaa

SEQ ID NO: 2349448 - DNA, 21 bp, Homo sapiens
tttacatgacagatattttat

SEQ ID NO: 2349449 - DNA, 22 bp, Homo sapiens
tttacatgacagatattttatc

SEQ ID NO: 2349450 - DNA, 20 bp, Homo sapiens
tttacatggcgccctgcctc

SEQ ID NO: 2349451 - DNA, 16 bp, Homo sapiens
tttaccctctttgctg

SEQ ID NO: 2349452 - DNA, 20 bp, Homo sapiens
tttaccctggcccctctccc

SEQ ID NO: 2349453 - DNA, 17 bp, Homo sapiens
tttacctttcagtgcag

SEQ ID NO: 2349454 - DNA, 13 bp, Homo sapiens
ttttaaactgtgt

SEQ ID NO: 2349455 - DNA, 23 bp, Homo sapiens
ttttaaactgtgtacataactga

SEQ ID NO: 2349456 - DNA, 15 bp, Homo sapiens
ttttaaagaatgtta

SEQ ID NO: 2349457 - DNA, 18 bp, Homo sapiens
ttttaaagacccctaacc

SEQ ID NO: 2349458 - DNA, 13 bp, Homo sapiens
ttttaaaggcatt

SEQ ID NO: 2349459 - DNA, 20 bp, Homo sapiens
ttttaactaaattttaaagc

SEQ ID NO: 2349460 - DNA, 12 bp, Homo sapiens
ttttaactcacc

SEQ ID NO: 2349461 - DNA, 13 bp, Homo sapiens
ttttaagatagtg

SEQ ID NO: 2349462 - DNA, 14 bp, Homo sapiens
ttttaagatagtgt

SEQ ID NO: 2349463 - DNA, 18 bp, Homo sapiens
ttttaagatttctctaat

SEQ ID NO: 2349464 - DNA, 12 bp, Homo sapiens
ttttaagttctt

SEQ ID NO: 2349465 - DNA, 15 bp, Homo sapiens
ttttaagttcttatg

SEQ ID NO: 2349466 - DNA, 21 bp, Homo sapiens
ttttaagtttaaaatgtgtat

SEQ ID NO: 2349467 - DNA, 22 bp, Homo sapiens
ttttaatacattgatcaggcca

SEQ ID NO: 2349468 - DNA, 21 bp, Homo sapiens
ttttaatgctgtttctaagaa

SEQ ID NO: 2349469 - DNA, 13 bp, Homo sapiens
ttttacagtaaat

SEQ ID NO: 2349470 - DNA, 22 bp, Homo sapiens
ttttactccaggttattgcaat

SEQ ID NO: 2349471 - DNA, 16 bp, Homo sapiens
ttttagaaatgcatat

SEQ ID NO: 2349472 - DNA, 15 bp, Homo sapiens
ttttagaacatgtaa

SEQ ID NO: 2349473 - DNA, 20 bp, Homo sapiens
ttttagattgagaaatgtgt

SEQ ID NO: 2349474 - DNA, 21 bp, Homo sapiens
ttttataacatctttattgaa

SEQ ID NO: 2349475 - DNA, 23 bp, Homo sapiens
ttttatatttcctttatgtgaat

SEQ ID NO: 2349476 - DNA, 19 bp, Homo sapiens
ttttatcattaaaaattac

SEQ ID NO: 2349477 - DNA, 15 bp, Homo sapiens
ttttcaaacaagtat

SEQ ID NO: 2349478 - DNA, 20 bp, Homo sapiens
ttttcaaacaagtatgaatc

SEQ ID NO: 2349479 - DNA, 17 bp, Homo sapiens
ttttcaaataatgcttt

SEQ ID NO: 2349480 - DNA, 18 bp, Homo sapiens
ttttcaagattctaaagc

SEQ ID NO: 2349481 - DNA, 19 bp, Homo sapiens
ttttcaagcaaaacagttc

SEQ ID NO: 2349482 - DNA, 21 bp, Homo sapiens
ttttcaatatattgaactttt

SEQ ID NO: 2349483 - DNA, 18 bp, Homo sapiens
ttttcagactgtgcaata

SEQ ID NO: 2349484 - DNA, 19 bp, Homo sapiens
ttttcagcaaactcttttc

SEQ ID NO: 2349485 - DNA, 23 bp, Homo sapiens
ttttcataaattatttgattatt

SEQ ID NO: 2349486 - DNA, 14 bp, Homo sapiens
ttttcatgacataa

SEQ ID NO: 2349487 - DNA, 23 bp, Homo sapiens
ttttcatgacataataaagtatt

SEQ ID NO: 2349488 - DNA, 20 bp, Homo sapiens
ttttcccaaagcatccctct

SEQ ID NO: 2349489 - DNA, 20 bp, Homo sapiens
ttttccccaaaccataaaac

SEQ ID NO: 2349490 - DNA, 16 bp, Homo sapiens
ttttccttctgttaaa

SEQ ID NO: 2349491 - DNA, 17 bp, Homo sapiens
ttttccttctgttaaaa

SEQ ID NO: 2349492 - DNA, 18 bp, Homo sapiens
ttttctaatcacagtgtt

SEQ ID NO: 2349493 - DNA, 18 bp, Homo sapiens
ttttctacagtggtttta

SEQ ID NO: 2349494 - DNA, 16 bp, Homo sapiens
ttttctacgtttcttt

SEQ ID NO: 2349495 - DNA, 19 bp, Homo sapiens
ttttctattatggaaaact

SEQ ID NO: 2349496 - DNA, 23 bp, Homo sapiens
ttttctattatggaaaactgtgt

SEQ ID NO: 2349497 - DNA, 23 bp, Homo sapiens
ttttctcaaagttttgaaaagct

SEQ ID NO: 2349498 - DNA, 12 bp, Homo sapiens
ttttctgaaaca

SEQ ID NO: 2349499 - DNA, 15 bp, Homo sapiens
ttttctgaaacacac

SEQ ID NO: 2349500 - DNA, 12 bp, Homo sapiens
ttttctgtattt

SEQ ID NO: 2349501 - DNA, 12 bp, Homo sapiens
ttttctttaata

SEQ ID NO: 2349502 - DNA, 21 bp, Homo sapiens
ttttcttttttaaatgtttct

SEQ ID NO: 2349503 - DNA, 16 bp, Homo sapiens
ttttgaaaagctatta

SEQ ID NO: 2349504 - DNA, 15 bp, Homo sapiens
ttttgaaacaaagta

SEQ ID NO: 2349505 - DNA, 12 bp, Homo sapiens
ttttgacactga

SEQ ID NO: 2349506 - DNA, 18 bp, Homo sapiens
ttttgacactgaaagttt

SEQ ID NO: 2349507 - DNA, 17 bp, Homo sapiens
ttttgaccatatagatt

SEQ ID NO: 2349508 - DNA, 19 bp, Homo sapiens
ttttgaccatatagatttt

SEQ ID NO: 2349509 - DNA, 18 bp, Homo sapiens
ttttgactgtagccacag

SEQ ID NO: 2349510 - DNA, 19 bp, Homo sapiens
ttttgcatgcatgcaaatg

SEQ ID NO: 2349511 - DNA, 21 bp, Homo sapiens
ttttgcatgcatgcaaatgag

SEQ ID NO: 2349512 - DNA, 14 bp, Homo sapiens
ttttggaaagtcag

SEQ ID NO: 2349513 - DNA, 23 bp, Homo sapiens
ttttggcaatgactcaaagtctg

SEQ ID NO: 2349514 - DNA, 22 bp, Homo sapiens
ttttggcacttgccattccaaa

SEQ ID NO: 2349515 - DNA, 16 bp, Homo sapiens
ttttggggagccagaa

SEQ ID NO: 2349516 - DNA, 14 bp, Homo sapiens
ttttgtaaagtttc

SEQ ID NO: 2349517 - DNA, 11 bp, Homo sapiens
ttttgtaagaa

SEQ ID NO: 2349518 - DNA, 22 bp, Homo sapiens
ttttgtaataagcaatcaaggt

SEQ ID NO: 2349519 - DNA, 14 bp, Homo sapiens
ttttgtatgtgtgt

SEQ ID NO: 2349520 - DNA, 24 bp, Homo sapiens
ttttgtgaaatgaaaacatgtaat

SEQ ID NO: 2349521 - DNA, 15 bp, Homo sapiens
ttttgtgctgcttct

SEQ ID NO: 2349522 - DNA, 17 bp, Homo sapiens
ttttgtggtttggaata

SEQ ID NO: 2349523 - DNA, 19 bp, Homo sapiens
ttttgttgtacttaaatgg

SEQ ID NO: 2349524 - DNA, 14 bp, Homo sapiens
tttttaaagaatgt

SEQ ID NO: 2349525 - DNA, 12 bp, Homo sapiens
tttttaaattac

SEQ ID NO: 2349526 - DNA, 11 bp, Homo sapiens
tttttaagata

SEQ ID NO: 2349527 - DNA, 11 bp, Homo sapiens
tcttctgggta

SEQ ID NO: 2349528 - DNA, 12 bp, Homo sapiens
tcttctgtccct

SEQ ID NO: 2349529 - DNA, 17 bp, Homo sapiens
tcttcttgaaattttaa

SEQ ID NO: 2349530 - DNA, 20 bp, Homo sapiens
tcttcttgagcagaccgtga

SEQ ID NO: 2349531 - DNA, 16 bp, Homo sapiens
tcttcttgtgtcctga

SEQ ID NO: 2349532 - DNA, 11 bp, Homo sapiens
tcttctttccc

SEQ ID NO: 2349533 - DNA, 13 bp, Homo sapiens
tcttctttccctg

SEQ ID NO: 2349534 - DNA, 14 bp, Homo sapiens
tcttctttccctgg

SEQ ID NO: 2349535 - DNA, 18 bp, Homo sapiens
tcttctttccctggacag

SEQ ID NO: 2349536 - DNA, 20 bp, Homo sapiens
tcttctttggaaataaaaga

SEQ ID NO: 2349537 - DNA, 15 bp, Homo sapiens
tcttgaaacagcctg

SEQ ID NO: 2349538 - DNA, 23 bp, Homo sapiens
tcttgagctggcctctctagcac

SEQ ID NO: 2349539 - DNA, 20 bp, Homo sapiens
tcttgatcggaaagctcttc

SEQ ID NO: 2349540 - DNA, 23 bp, Homo sapiens
tcttgctggctacgcctcttctg

SEQ ID NO: 2349541 - DNA, 20 bp, Homo sapiens
tcttggaagctgtttggaaa

SEQ ID NO: 2349542 - DNA, 19 bp, Homo sapiens
tcttggctgcctgtgggct

SEQ ID NO: 2349543 - DNA, 13 bp, Homo sapiens
tcttggggctcgc

SEQ ID NO: 2349544 - DNA, 21 bp, Homo sapiens
tcttgggtgtattctctgtaa

SEQ ID NO: 2349545 - DNA, 19 bp, Homo sapiens
tcttggtcacaaagctatt

SEQ ID NO: 2349546 - DNA, 19 bp, Homo sapiens
tcttgtacatgtgtagcct

SEQ ID NO: 2349547 - DNA, 24 bp, Homo sapiens
tcttgtacatgtgtagcctgtgca

SEQ ID NO: 2349548 - DNA, 18 bp, Homo sapiens
tcttgtatttaaaaacat

SEQ ID NO: 2349549 - DNA, 16 bp, Homo sapiens
tcttgtctgatttctt

SEQ ID NO: 2349550 - DNA, 15 bp, Homo sapiens
tcttgtgtctttgga

SEQ ID NO: 2349551 - DNA, 15 bp, Homo sapiens
tctttaaaagaatga

SEQ ID NO: 2349552 - DNA, 21 bp, Homo sapiens
tctttaaaattttttatttta

SEQ ID NO: 2349553 - DNA, 16 bp, Homo sapiens
tctttaaccttgtata

SEQ ID NO: 2349554 - DNA, 23 bp, Homo sapiens
tctttaagccatagaccctgagg

SEQ ID NO: 2349555 - DNA, 23 bp, Homo sapiens
tctttaataacaaggagatttct

SEQ ID NO: 2349556 - DNA, 18 bp, Homo sapiens
tctttagagattataaca

SEQ ID NO: 2349557 - DNA, 20 bp, Homo sapiens
tctttagagattataacaaa

SEQ ID NO: 2349558 - DNA, 23 bp, Homo sapiens
tctttagtttttggttgggaatg

SEQ ID NO: 2349559 - DNA, 17 bp, Homo sapiens
tctttattttgtgtaaa

SEQ ID NO: 2349560 - DNA, 18 bp, Homo sapiens
tctttattttgtgtaaaa

SEQ ID NO: 2349561 - DNA, 11 bp, Homo sapiens
tctttcagaaa

SEQ ID NO: 2349562 - DNA, 18 bp, Homo sapiens
tctttcagaaatataaca

SEQ ID NO: 2349563 - DNA, 11 bp, Homo sapiens
tctttccaaat

SEQ ID NO: 2349564 - DNA, 19 bp, Homo sapiens
tctttccattatgattctt

SEQ ID NO: 2349565 - DNA, 24 bp, Homo sapiens
tctttcctatttcagtgttacctg

SEQ ID NO: 2349566 - DNA, 15 bp, Homo sapiens
tctttcctcacattt

SEQ ID NO: 2349567 - DNA, 17 bp, Homo sapiens
tctttcctctttctgct

SEQ ID NO: 2349568 - DNA, 16 bp, Homo sapiens
tctttcctgaaccatg

SEQ ID NO: 2349569 - DNA, 20 bp, Homo sapiens
tctttctagtggtctttgta

SEQ ID NO: 2349570 - DNA, 16 bp, Homo sapiens
tctttgagtaatgtga

SEQ ID NO: 2349571 - DNA, 17 bp, Homo sapiens
tctttgataatgttaaa

SEQ ID NO: 2349572 - DNA, 13 bp, Homo sapiens
tctttgcaactgt

SEQ ID NO: 2349573 - DNA, 23 bp, Homo sapiens
tctttgctcagtgtccagcttcc

SEQ ID NO: 2349574 - DNA, 12 bp, Homo sapiens
tctttggaaata

SEQ ID NO: 2349575 - DNA, 17 bp, Homo sapiens
tctttggaaataaaaga

SEQ ID NO: 2349576 - DNA, 16 bp, Homo sapiens
tctttggaaatagcat

SEQ ID NO: 2349577 - DNA, 14 bp, Homo sapiens
tctttggagttaaa

SEQ ID NO: 2349578 - DNA, 20 bp, Homo sapiens
tctttggagttaaaatgcac

SEQ ID NO: 2349579 - DNA, 15 bp, Homo sapiens
tctttggattctaaa

SEQ ID NO: 2349580 - DNA, 16 bp, Homo sapiens
tctttggattctaaat

SEQ ID NO: 2349581 - DNA, 15 bp, Homo sapiens
tctttgtaagagcaa

SEQ ID NO: 2349582 - DNA, 14 bp, Homo sapiens
tctttgtaagagtg

SEQ ID NO: 2349583 - DNA, 18 bp, Homo sapiens
tctttgttattataacat

SEQ ID NO: 2349584 - DNA, 13 bp, Homo sapiens
tcttttaaagacc

SEQ ID NO: 2349585 - DNA, 17 bp, Homo sapiens
tcttttaccctggcccc

SEQ ID NO: 2349586 - DNA, 22 bp, Homo sapiens
tcttttaccctggcccctctcc

SEQ ID NO: 2349587 - DNA, 18 bp, Homo sapiens
tcttttactgttatagaa

SEQ ID NO: 2349588 - DNA, 20 bp, Homo sapiens
tcttttactgttatagaata

SEQ ID NO: 2349589 - DNA, 14 bp, Homo sapiens
tcttttcagaagca

SEQ ID NO: 2349590 - DNA, 18 bp, Homo sapiens
tcttttcccctttcctgt

SEQ ID NO: 2349591 - DNA, 19 bp, Homo sapiens
tcttttcccctttcctgtc

SEQ ID NO: 2349592 - DNA, 12 bp, Homo sapiens
tcttttcttatt

SEQ ID NO: 2349593 - DNA, 12 bp, Homo sapiens
tcttttgtttcc

SEQ ID NO: 2349594 - DNA, 15 bp, Homo sapiens
tcttttgtttccatg

SEQ ID NO: 2349595 - DNA, 12 bp, Homo sapiens
tcttttgtttgg

SEQ ID NO: 2349596 - DNA, 15 bp, Homo sapiens
tcttttttgctttct

SEQ ID NO: 2349597 - DNA, 16 bp, Homo sapiens
tcttttttgctttctt

SEQ ID NO: 2349598 - DNA, 22 bp, Homo sapiens
tctttttttaagtgttctgtgg

SEQ ID NO: 2349599 - DNA, 15 bp, Homo sapiens
tctttttttttaagt

SEQ ID NO: 2349600 - DNA, 16 bp, Homo sapiens
tctttttttttaagtt

SEQ ID NO: 2349601 - DNA, 19 bp, Homo sapiens
tgaaaaacacggcagctgt

SEQ ID NO: 2349602 - DNA, 12 bp, Homo sapiens
tgaaaaatataa

SEQ ID NO: 2349603 - DNA, 15 bp, Homo sapiens
tgaaaaatatgtgct

SEQ ID NO: 2349604 - DNA, 16 bp, Homo sapiens
tgaaaaatatgtgctt

SEQ ID NO: 2349605 - DNA, 20 bp, Homo sapiens
tgaaaaatatgtgcttgaaa

SEQ ID NO: 2349606 - DNA, 14 bp, Homo sapiens
tgaaaaattaactt

SEQ ID NO: 2349607 - DNA, 17 bp, Homo sapiens
tgaaaaattaacttttt

SEQ ID NO: 2349608 - DNA, 22 bp, Homo sapiens
tgaaaaattgctgactgtagct

SEQ ID NO: 2349609 - DNA, 23 bp, Homo sapiens
tgaaaagctattagccaggatca

SEQ ID NO: 2349610 - DNA, 14 bp, Homo sapiens
tgaaaagtgtgtat

SEQ ID NO: 2349611 - DNA, 13 bp, Homo sapiens
tgaaaagttggaa

SEQ ID NO: 2349612 - DNA, 21 bp, Homo sapiens
tgaaaagttggaaggatctgc

SEQ ID NO: 2349613 - DNA, 22 bp, Homo sapiens
tgaaaagttggaaggatctgct

SEQ ID NO: 2349614 - DNA, 23 bp, Homo sapiens
tgaaaagttggaaggatctgctg

SEQ ID NO: 2349615 - DNA, 15 bp, Homo sapiens
tgaaaagtttttgtt

SEQ ID NO: 2349616 - DNA, 21 bp, Homo sapiens
tgaaaataaaaagatcacttt

SEQ ID NO: 2349617 - DNA, 15 bp, Homo sapiens
tgaaaataaaacaca

SEQ ID NO: 2349618 - DNA, 16 bp, Homo sapiens
tgaaaataaaacacac

SEQ ID NO: 2349619 - DNA, 20 bp, Homo sapiens
tgaaaataaaacacacctcg

SEQ ID NO: 2349620 - DNA, 16 bp, Homo sapiens
tgaaaataactgaatt

SEQ ID NO: 2349621 - DNA, 15 bp, Homo sapiens
tgaaaatatagacat

SEQ ID NO: 2349622 - DNA, 20 bp, Homo sapiens
tgaaaatgtattcctttaaa

SEQ ID NO: 2349623 - DNA, 21 bp, Homo sapiens
tgaaaatgtgctatactgcat

SEQ ID NO: 2349624 - DNA, 22 bp, Homo sapiens
tcctggctctaccctgtctgtc

SEQ ID NO: 2349625 - DNA, 17 bp, Homo sapiens
tcctggtacagcagggt

SEQ ID NO: 2349626 - DNA, 18 bp, Homo sapiens
tcctggtacagcagggtc

SEQ ID NO: 2349627 - DNA, 16 bp, Homo sapiens
tcctggtgaggcccag

SEQ ID NO: 2349628 - DNA, 19 bp, Homo sapiens
tcctggtgaggcccagcct

SEQ ID NO: 2349629 - DNA, 20 bp, Homo sapiens
tcctggtgccaatttcaagt

SEQ ID NO: 2349630 - DNA, 21 bp, Homo sapiens
tcctggtgccaatttcaagtt

SEQ ID NO: 2349631 - DNA, 19 bp, Homo sapiens
tcctgtaaaggttacaagc

SEQ ID NO: 2349632 - DNA, 16 bp, Homo sapiens
tcctgtagctctccct

SEQ ID NO: 2349633 - DNA, 11 bp, Homo sapiens
tcctgtccctg

SEQ ID NO: 2349634 - DNA, 16 bp, Homo sapiens
tcctgtccctgaggtt

SEQ ID NO: 2349635 - DNA, 15 bp, Homo sapiens
tcctgtccctgtagc

SEQ ID NO: 2349636 - DNA, 13 bp, Homo sapiens
tcctgtgcctggc

SEQ ID NO: 2349637 - DNA, 14 bp, Homo sapiens
tcctgtgcctggcc

SEQ ID NO: 2349638 - DNA, 16 bp, Homo sapiens
tcctgtgcctggcccc

SEQ ID NO: 2349639 - DNA, 22 bp, Homo sapiens
tcctgtggaaggcagagaaatc

SEQ ID NO: 2349640 - DNA, 16 bp, Homo sapiens
tcctgtggcataaatt

SEQ ID NO: 2349641 - DNA, 20 bp, Homo sapiens
tcctgtggcataaattgcat

SEQ ID NO: 2349642 - DNA, 23 bp, Homo sapiens
tcctgtgggtgttctttcctgcc

SEQ ID NO: 2349643 - DNA, 18 bp, Homo sapiens
tcctgttactgagatgtc

SEQ ID NO: 2349644 - DNA, 16 bp, Homo sapiens
tcctgtttctgtcaag

SEQ ID NO: 2349645 - DNA, 17 bp, Homo sapiens
tccttaaaaatgtatgt

SEQ ID NO: 2349646 - DNA, 20 bp, Homo sapiens
tccttaagctgcagagattt

SEQ ID NO: 2349647 - DNA, 21 bp, Homo sapiens
tccttacaagttagaaaacat

SEQ ID NO: 2349648 - DNA, 15 bp, Homo sapiens
tccttacctttttat

SEQ ID NO: 2349649 - DNA, 18 bp, Homo sapiens
tccttagataccttgaaa

SEQ ID NO: 2349650 - DNA, 17 bp, Homo sapiens
tccttaggcctctgaga

SEQ ID NO: 2349651 - DNA, 20 bp, Homo sapiens
tccttatttggcgtgacccg

SEQ ID NO: 2349652 - DNA, 13 bp, Homo sapiens
tccttcagcacag

SEQ ID NO: 2349653 - DNA, 13 bp, Homo sapiens
tccttccatccat

SEQ ID NO: 2349654 - DNA, 12 bp, Homo sapiens
tccttctgttaa

SEQ ID NO: 2349655 - DNA, 16 bp, Homo sapiens
tccttctttgataatg

SEQ ID NO: 2349656 - DNA, 20 bp, Homo sapiens
tccttgaaatgagtaaaaac

SEQ ID NO: 2349657 - DNA, 14 bp, Homo sapiens
tccttgagctgttg

SEQ ID NO: 2349658 - DNA, 16 bp, Homo sapiens
tccttgcgcctcagcc

SEQ ID NO: 2349659 - DNA, 17 bp, Homo sapiens
tccttgcgcctcagccc

SEQ ID NO: 2349660 - DNA, 15 bp, Homo sapiens
tccttgcttcctgat

SEQ ID NO: 2349661 - DNA, 20 bp, Homo sapiens
tccttggctttatgcacatt

SEQ ID NO: 2349662 - DNA, 14 bp, Homo sapiens
tccttggtgcctgg

SEQ ID NO: 2349663 - DNA, 18 bp, Homo sapiens
tccttggtgcctggcctg

SEQ ID NO: 2349664 - DNA, 20 bp, Homo sapiens
tccttgtctaaagatctttt

SEQ ID NO: 2349665 - DNA, 21 bp, Homo sapiens
tccttgttgtttcttgcctga

SEQ ID NO: 2349666 - DNA, 21 bp, Homo sapiens
tcctttaggcagcctgccgcc

SEQ ID NO: 2349667 - DNA, 15 bp, Homo sapiens
tcctttatgtattct

SEQ ID NO: 2349668 - DNA, 15 bp, Homo sapiens
tcctttatgtgaatt

SEQ ID NO: 2349669 - DNA, 14 bp, Homo sapiens
tccttttccctgct

SEQ ID NO: 2349670 - DNA, 19 bp, Homo sapiens
tccttttcttcaccctccc

SEQ ID NO: 2349671 - DNA, 22 bp, Homo sapiens
tcctttttcaaaaaccagccag

SEQ ID NO: 2349672 - DNA, 18 bp, Homo sapiens
tcgaaataacaatgttaa

SEQ ID NO: 2349673 - DNA, 16 bp, Homo sapiens
tcgagaccatcctggc

SEQ ID NO: 2349674 - DNA, 14 bp, Homo sapiens
tcgaggtgtcaccc

SEQ ID NO: 2349675 - DNA, 15 bp, Homo sapiens
tcgaggtgtcaccct

SEQ ID NO: 2349676 - DNA, 20 bp, Homo sapiens
tcgaggtgtcaccctgcaga

SEQ ID NO: 2349677 - DNA, 22 bp, Homo sapiens
tcgcaccggagtgtctggaatt

SEQ ID NO: 2349678 - DNA, 13 bp, Homo sapiens
tcgccccacccag

SEQ ID NO: 2349679 - DNA, 15 bp, Homo sapiens
tcgccctcctttccc

SEQ ID NO: 2349680 - DNA, 16 bp, Homo sapiens
tcgccctcctttccct

SEQ ID NO: 2349681 - DNA, 16 bp, Homo sapiens
tcgctcaccgctggcc

SEQ ID NO: 2349682 - DNA, 13 bp, Homo sapiens
tcgctccctccca

SEQ ID NO: 2349683 - DNA, 15 bp, Homo sapiens
tcgctccctcccagg

SEQ ID NO: 2349684 - DNA, 14 bp, Homo sapiens
tcgctgaaattgct

SEQ ID NO: 2349685 - DNA, 19 bp, Homo sapiens
tcggaactgtcctttcctt

SEQ ID NO: 2349686 - DNA, 18 bp, Homo sapiens
tcggaattcataataaat

SEQ ID NO: 2349687 - DNA, 11 bp, Homo sapiens
tcggactgcca

SEQ ID NO: 2349688 - DNA, 21 bp, Homo sapiens
tcggagaagagcgcagtgttt

SEQ ID NO: 2349689 - DNA, 22 bp, Homo sapiens
tcggatggaccaacctgctctg

SEQ ID NO: 2349690 - DNA, 17 bp, Homo sapiens
tcggctatgtctcatgt

SEQ ID NO: 2349691 - DNA, 10 bp, Homo sapiens
tcgggaccag

SEQ ID NO: 2349692 - DNA, 20 bp, Homo sapiens
tcggggtaaaaagtggctgc

SEQ ID NO: 2349693 - DNA, 21 bp, Homo sapiens
tcggggtaaaaagtggctgcg

SEQ ID NO: 2349694 - DNA, 14 bp, Homo sapiens
tcgtcaccccagcc

SEQ ID NO: 2349695 - DNA, 22 bp, Homo sapiens
tcgtctttccctttaccactgt

SEQ ID NO: 2349696 - DNA, 20 bp, Homo sapiens
tcgtttttgtattttcatga

SEQ ID NO: 2349697 - DNA, 13 bp, Homo sapiens
tctaaaatgtttt

SEQ ID NO: 2349698 - DNA, 17 bp, Homo sapiens
tctaaaatgttttatga

SEQ ID NO: 2349699 - DNA, 22 bp, Homo sapiens
tctaaagatctttttttaagtg

SEQ ID NO: 2349700 - DNA, 14 bp, Homo sapiens
tctaaagtaaaaag

SEQ ID NO: 2349701 - DNA, 23 bp, Homo sapiens
tctaaatgcatatcctgagccat

SEQ ID NO: 2349702 - DNA, 12 bp, Homo sapiens
tctaacagtcct

SEQ ID NO: 2349703 - DNA, 13 bp, Homo sapiens
tctaactttgtaa

SEQ ID NO: 2349704 - DNA, 14 bp, Homo sapiens
tctaagaaaatgta

SEQ ID NO: 2349705 - DNA, 16 bp, Homo sapiens
tctaagactatatata

SEQ ID NO: 2349706 - DNA, 21 bp, Homo sapiens
tctaagactatatatataaat

SEQ ID NO: 2349707 - DNA, 13 bp, Homo sapiens
tctaatagtgctt

SEQ ID NO: 2349708 - DNA, 16 bp, Homo sapiens
tctaatcacagtgttg

SEQ ID NO: 2349709 - DNA, 17 bp, Homo sapiens
tctaatcagattgctta

SEQ ID NO: 2349710 - DNA, 23 bp, Homo sapiens
tctaatcagattgcttaaaagca

SEQ ID NO: 2349711 - DNA, 22 bp, Homo sapiens
tctaattaatagccaaagattt

SEQ ID NO: 2349712 - DNA, 12 bp, Homo sapiens
tctaattctgat

SEQ ID NO: 2349713 - DNA, 15 bp, Homo sapiens
tctaatttgaactgg

SEQ ID NO: 2349714 - DNA, 15 bp, Homo sapiens
tctacaaggactcca

SEQ ID NO: 2349715 - DNA, 22 bp, Homo sapiens
tctacaaggactccattggatc

SEQ ID NO: 2349716 - DNA, 15 bp, Homo sapiens
tctacactcatctta

SEQ ID NO: 2349717 - DNA, 19 bp, Homo sapiens
tctacactcttgtaataaa

SEQ ID NO: 2349718 - DNA, 18 bp, Homo sapiens
tctacagtctcgtctctt

SEQ ID NO: 2349719 - DNA, 13 bp, Homo sapiens
tctacagtggttt

SEQ ID NO: 2349720 - DNA, 22 bp, Homo sapiens
tctacagtggttttatactgaa

SEQ ID NO: 2349721 - DNA, 23 bp, Homo sapiens
tctacagtggttttatactgaag

SEQ ID NO: 2349722 - DNA, 23 bp, Homo sapiens
tctaccctgtctgtcccttttct

SEQ ID NO: 2349723 - DNA, 18 bp, Homo sapiens
tctacggatcatcaacaa

SEQ ID NO: 2349724 - DNA, 12 bp, Homo sapiens
tctacgtttctt

SEQ ID NO: 2349725 - DNA, 13 bp, Homo sapiens
tctacgtttcttt

SEQ ID NO: 2349726 - DNA, 19 bp, Homo sapiens
tctactaatgcctcttcat

SEQ ID NO: 2349727 - DNA, 18 bp, Homo sapiens
tctcttttgaaagtagag

SEQ ID NO: 2349728 - DNA, 14 bp, Homo sapiens
tctctttttgtttg

SEQ ID NO: 2349729 - DNA, 17 bp, Homo sapiens
tctgaagaaggaaggcc

SEQ ID NO: 2349730 - DNA, 13 bp, Homo sapiens
tctgaaggagagg

SEQ ID NO: 2349731 - DNA, 20 bp, Homo sapiens
tctgaaggagaggaggaatt

SEQ ID NO: 2349732 - DNA, 21 bp, Homo sapiens
tctgaattaattaatttggag

SEQ ID NO: 2349733 - DNA, 17 bp, Homo sapiens
tctgacgcttgtgacag

SEQ ID NO: 2349734 - DNA, 22 bp, Homo sapiens
tctgacgcttgtgacagtgcct

SEQ ID NO: 2349735 - DNA, 17 bp, Homo sapiens
tctgagctatttcatct

SEQ ID NO: 2349736 - DNA, 20 bp, Homo sapiens
tctgagctatttcatctatt

SEQ ID NO: 2349737 - DNA, 22 bp, Homo sapiens
tctgagctatttcatctatttt

SEQ ID NO: 2349738 - DNA, 20 bp, Homo sapiens
tctgagctcctgtcccctgc

SEQ ID NO: 2349739 - DNA, 22 bp, Homo sapiens
tctgaggatagtagttaaataa

SEQ ID NO: 2349740 - DNA, 23 bp, Homo sapiens
tctgaggatagtagttaaataac

SEQ ID NO: 2349741 - DNA, 13 bp, Homo sapiens
tctgatcaagagt

SEQ ID NO: 2349742 - DNA, 22 bp, Homo sapiens
tccatctcccaaggctgccaga

SEQ ID NO: 2349743 - DNA, 14 bp, Homo sapiens
tccatgagctgctc

SEQ ID NO: 2349744 - DNA, 16 bp, Homo sapiens
tccatgagctgctcat

SEQ ID NO: 2349745 - DNA, 22 bp, Homo sapiens
tccatgcgtgtttctgactctg

SEQ ID NO: 2349746 - DNA, 16 bp, Homo sapiens
tccatggccctgtccc

SEQ ID NO: 2349747 - DNA, 18 bp, Homo sapiens
tccattacctccatccat

SEQ ID NO: 2349748 - DNA, 20 bp, Homo sapiens
tccattcatccttccatcca

SEQ ID NO: 2349749 - DNA, 14 bp, Homo sapiens
tccattctcccagg

SEQ ID NO: 2349750 - DNA, 15 bp, Homo sapiens
tccattctcccaggt

SEQ ID NO: 2349751 - DNA, 20 bp, Homo sapiens
tccattctgctccttcccca

SEQ ID NO: 2349752 - DNA, 15 bp, Homo sapiens
tccatttccattgct

SEQ ID NO: 2349753 - DNA, 14 bp, Homo sapiens
tccattttcaagct

SEQ ID NO: 2349754 - DNA, 15 bp, Homo sapiens
tcccaaccaggcacc

SEQ ID NO: 2349755 - DNA, 19 bp, Homo sapiens
tcccaaggctgccagacat

SEQ ID NO: 2349756 - DNA, 20 bp, Homo sapiens
tcccaaggctgccagacatg

SEQ ID NO: 2349757 - DNA, 21 bp, Homo sapiens
tcccaaggctgccagacatgg

SEQ ID NO: 2349758 - DNA, 16 bp, Homo sapiens
tcccaagttgtgcttg

SEQ ID NO: 2349759 - DNA, 19 bp, Homo sapiens
tcccacatccaactccagc

SEQ ID NO: 2349760 - DNA, 16 bp, Homo sapiens
tcccacccacatgtga

SEQ ID NO: 2349761 - DNA, 21 bp, Homo sapiens
tcccaccccaacctgctctcc

SEQ ID NO: 2349762 - DNA, 23 bp, Homo sapiens
tcccaccccaacctgctctcctc

SEQ ID NO: 2349763 - DNA, 15 bp, Homo sapiens
tcccaccctcttcct

SEQ ID NO: 2349764 - DNA, 18 bp, Homo sapiens
tcccagaaacatctctgg

SEQ ID NO: 2349765 - DNA, 22 bp, Homo sapiens
tcccagaaacatctctggccca

SEQ ID NO: 2349766 - DNA, 23 bp, Homo sapiens
tcccagactaaaggatccagaga

SEQ ID NO: 2349767 - DNA, 21 bp, Homo sapiens
tcccagagctggtggacccag

SEQ ID NO: 2349768 - DNA, 19 bp, Homo sapiens
tcccagcactttgggaggc

SEQ ID NO: 2349769 - DNA, 18 bp, Homo sapiens
tcccagctacttgggagg

SEQ ID NO: 2349770 - DNA, 12 bp, Homo sapiens
tcccagctgcct

SEQ ID NO: 2349771 - DNA, 18 bp, Homo sapiens
tcccaggagatgggtcca

SEQ ID NO: 2349772 - DNA, 14 bp, Homo sapiens
tcccaggcaagcag

SEQ ID NO: 2349773 - DNA, 17 bp, Homo sapiens
tcccaggccggcccaga

SEQ ID NO: 2349774 - DNA, 14 bp, Homo sapiens
tcccagggcctcct

SEQ ID NO: 2349775 - DNA, 17 bp, Homo sapiens
tcccagggcctcctggg

SEQ ID NO: 2349776 - DNA, 17 bp, Homo sapiens
tcccaggggtctccctg

SEQ ID NO: 2349777 - DNA, 18 bp, Homo sapiens
tcccaggtaccagctgcg

SEQ ID NO: 2349778 - DNA, 19 bp, Homo sapiens
tcccagtgaactcctgcca

SEQ ID NO: 2349779 - DNA, 15 bp, Homo sapiens
tcccagtgagactgc

SEQ ID NO: 2349780 - DNA, 13 bp, Homo sapiens
tcccagttttgtt

SEQ ID NO: 2349781 - DNA, 20 bp, Homo sapiens
tcccatcgtctcggccttca

SEQ ID NO: 2349782 - DNA, 22 bp, Homo sapiens
tcccatcgtctcggccttcaca

SEQ ID NO: 2349783 - DNA, 22 bp, Homo sapiens
tcccatgggggcacttgagttt

SEQ ID NO: 2349784 - DNA, 18 bp, Homo sapiens
tccccaaaccataaaacc

SEQ ID NO: 2349785 - DNA, 15 bp, Homo sapiens
tccccaaaggcatcc

SEQ ID NO: 2349786 - DNA, 22 bp, Homo sapiens
tccccaaccgtgtctgtctggc

SEQ ID NO: 2349787 - DNA, 19 bp, Homo sapiens
tccccacagcgtccctggc

SEQ ID NO: 2349788 - DNA, 19 bp, Homo sapiens
tccccagagaggcactcag

SEQ ID NO: 2349789 - DNA, 16 bp, Homo sapiens
tccccagagctgcctg

SEQ ID NO: 2349790 - DNA, 17 bp, Homo sapiens
tccccagagctgcctgc

SEQ ID NO: 2349791 - DNA, 13 bp, Homo sapiens
tccccaggctgga

SEQ ID NO: 2349792 - DNA, 22 bp, Homo sapiens
tccccatcgttgcccccatttc

SEQ ID NO: 2349793 - DNA, 14 bp, Homo sapiens
tccccatctgtcca

SEQ ID NO: 2349794 - DNA, 16 bp, Homo sapiens
tccccatttcccatct

SEQ ID NO: 2349795 - DNA, 18 bp, Homo sapiens
tccccatttcccatctgc

SEQ ID NO: 2349796 - DNA, 23 bp, Homo sapiens
tcccccaccggtccagctggcct

SEQ ID NO: 2349797 - DNA, 14 bp, Homo sapiens
tcccccaggctgga

SEQ ID NO: 2349798 - DNA, 23 bp, Homo sapiens
tcccccatctcgctccctcccag

SEQ ID NO: 2349799 - DNA, 14 bp, Homo sapiens
tccccctccccagg

SEQ ID NO: 2349800 - DNA, 16 bp, Homo sapiens
tccccctccccaggct

SEQ ID NO: 2349801 - DNA, 21 bp, Homo sapiens
tccccctccccaggctggaga

SEQ ID NO: 2349802 - DNA, 14 bp, Homo sapiens
tccccgcctggcca

SEQ ID NO: 2349803 - DNA, 17 bp, Homo sapiens
tccccgcctggccagga

SEQ ID NO: 2349804 - DNA, 18 bp, Homo sapiens
tccccgcctggccaggag

SEQ ID NO: 2349805 - DNA, 21 bp, Homo sapiens
tcccctccggactggtgccct

SEQ ID NO: 2349806 - DNA, 20 bp, Homo sapiens
tcccctcgtcccatccagct

SEQ ID NO: 2349807 - DNA, 23 bp, Homo sapiens
tcccctctcagaacatactgatt

SEQ ID NO: 2349808 - DNA, 15 bp, Homo sapiens
tcccctctctctggg

SEQ ID NO: 2349809 - DNA, 13 bp, Homo sapiens
tcccctctgcttc

SEQ ID NO: 2349810 - DNA, 16 bp, Homo sapiens
tcccctgccacactga

SEQ ID NO: 2349811 - DNA, 17 bp, Homo sapiens
tcccctgcccctcacaa

SEQ ID NO: 2349812 - DNA, 19 bp, Homo sapiens
tcccctgttgattatcttc

SEQ ID NO: 2349813 - DNA, 18 bp, Homo sapiens
tccccttcctcttgtctg

SEQ ID NO: 2349814 - DNA, 18 bp, Homo sapiens
tccccttcgctgaaattg

SEQ ID NO: 2349815 - DNA, 12 bp, Homo sapiens
tcccctttcctg

SEQ ID NO: 2349816 - DNA, 13 bp, Homo sapiens
tcccctttcctgt

SEQ ID NO: 2349817 - DNA, 17 bp, Homo sapiens
tcccctttcctgtccca

SEQ ID NO: 2349818 - DNA, 21 bp, Homo sapiens
tcccgagctactctcttgcca

SEQ ID NO: 2349819 - DNA, 12 bp, Homo sapiens
tcccgcggtgcc

SEQ ID NO: 2349820 - DNA, 18 bp, Homo sapiens
tcccgggcctcagtgccc

SEQ ID NO: 2349821 - DNA, 16 bp, Homo sapiens
tccctaaactttggcc

SEQ ID NO: 2349822 - DNA, 18 bp, Homo sapiens
tccctaaactttggcctt

SEQ ID NO: 2349823 - DNA, 15 bp, Homo sapiens
tccctacagcctagg

SEQ ID NO: 2349824 - DNA, 14 bp, Homo sapiens
tccctacctgcttc

SEQ ID NO: 2349825 - DNA, 19 bp, Homo sapiens
tccctagctttagaccctg

SEQ ID NO: 2349826 - DNA, 22 bp, Homo sapiens
tccctattgtgacagagccatg

SEQ ID NO: 2349827 - DNA, 18 bp, Homo sapiens
tccctcaactgaaggggt

SEQ ID NO: 2349828 - DNA, 20 bp, Homo sapiens
tccctcaggttcctttttca

SEQ ID NO: 2349829 - DNA, 20 bp, Homo sapiens
tccctccacctcaagacccc

SEQ ID NO: 2349830 - DNA, 13 bp, Homo sapiens
tccctcccctctc

SEQ ID NO: 2349831 - DNA, 17 bp, Homo sapiens
tccctcccctctcagaa

SEQ ID NO: 2349832 - DNA, 21 bp, Homo sapiens
tccctcccctctcagaacata

SEQ ID NO: 2349833 - DNA, 14 bp, Homo sapiens
tccctccctgcctg

SEQ ID NO: 2349834 - DNA, 13 bp, Homo sapiens
tccctcctagctc

SEQ ID NO: 2349835 - DNA, 15 bp, Homo sapiens
tccctcctagctctc

SEQ ID NO: 2349836 - DNA, 14 bp, Homo sapiens
tccctcctccaggc

SEQ ID NO: 2349837 - DNA, 16 bp, Homo sapiens
tccctcctccaggcct

SEQ ID NO: 2349838 - DNA, 17 bp, Homo sapiens
tccctctctcatgagaa

SEQ ID NO: 2349839 - DNA, 20 bp, Homo sapiens
tccctctctcatgagaagcc

SEQ ID NO: 2349840 - DNA, 16 bp, Homo sapiens
tccctctgcagaatcc

SEQ ID NO: 2349841 - DNA, 15 bp, Homo sapiens
tccctctgcccctcc

SEQ ID NO: 2349842 - DNA, 19 bp, Homo sapiens
tccctgaacgttttcttct

SEQ ID NO: 2349843 - DNA, 22 bp, Homo sapiens
tccctgaacgttttcttctttc

SEQ ID NO: 2349844 - DNA, 15 bp, Homo sapiens
tccctgaggatgggt

SEQ ID NO: 2349845 - DNA, 21 bp, Homo sapiens
tccctgagtgcgggctgaggc

SEQ ID NO: 2349846 - DNA, 14 bp, Homo sapiens
tccctgcctgaggg

SEQ ID NO: 2349847 - DNA, 20 bp, Homo sapiens
tccctggaatgagttgaggc

SEQ ID NO: 2349848 - DNA, 22 bp, Homo sapiens
tccctggaatgagttgaggcca

SEQ ID NO: 2349849 - DNA, 11 bp, Homo sapiens
tccctggacag

SEQ ID NO: 2349850 - DNA, 16 bp, Homo sapiens
tcaactgtcttcctca

SEQ ID NO: 2349851 - DNA, 23 bp, Homo sapiens
tcaactgtcttcctcaaaataaa

SEQ ID NO: 2349852 - DNA, 19 bp, Homo sapiens
tcagaacttgctgctgtct

SEQ ID NO: 2349853 - DNA, 18 bp, Homo sapiens
tcagaagcacagaatatt

SEQ ID NO: 2349854 - DNA, 20 bp, Homo sapiens
tcagaagcacagaatatttt

SEQ ID NO: 2349855 - DNA, 15 bp, Homo sapiens
tcagacatacagctg

SEQ ID NO: 2349856 - DNA, 18 bp, Homo sapiens
tcagaccagtactgggaa

SEQ ID NO: 2349857 - DNA, 18 bp, Homo sapiens
tcagacccctttgagaga

SEQ ID NO: 2349858 - DNA, 18 bp, Homo sapiens
tcagacgttgcctgagaa

SEQ ID NO: 2349859 - DNA, 23 bp, Homo sapiens
tcagactttgtgttcatttcatt

SEQ ID NO: 2349860 - DNA, 14 bp, Homo sapiens
tcagagacaaaata

SEQ ID NO: 2349861 - DNA, 22 bp, Homo sapiens
tcagagccatgtcttctccctg

SEQ ID NO: 2349862 - DNA, 21 bp, Homo sapiens
tcagagcgccaggaagccaga

SEQ ID NO: 2349863 - DNA, 19 bp, Homo sapiens
tcagagtccagtgctctgc

SEQ ID NO: 2349864 - DNA, 22 bp, Homo sapiens
tcagagtccagtgctctgcctc

SEQ ID NO: 2349865 - DNA, 15 bp, Homo sapiens
tcagatgcctgcttg

SEQ ID NO: 2349866 - DNA, 19 bp, Homo sapiens
tcagattgcttaaaagcat

SEQ ID NO: 2349867 - DNA, 19 bp, Homo sapiens
tcagcaagttagaactagc

SEQ ID NO: 2349868 - DNA, 21 bp, Homo sapiens
tcagcaagttagaactagcca

SEQ ID NO: 2349869 - DNA, 17 bp, Homo sapiens
tcagcagcctccctgaa

SEQ ID NO: 2349870 - DNA, 12 bp, Homo sapiens
tcagcatgtcta

SEQ ID NO: 2349871 - DNA, 21 bp, Homo sapiens
tcagcccaggcttttgctaga

SEQ ID NO: 2349872 - DNA, 24 bp, Homo sapiens
tcagccctcagttccttcatttcc

SEQ ID NO: 2349873 - DNA, 15 bp, Homo sapiens
tcagctactaatgat

SEQ ID NO: 2349874 - DNA, 12 bp, Homo sapiens
tcagctccagct

SEQ ID NO: 2349875 - DNA, 16 bp, Homo sapiens
tcagctctttccaaat

SEQ ID NO: 2349876 - DNA, 15 bp, Homo sapiens
tcagctgctccctgg

SEQ ID NO: 2349877 - DNA, 23 bp, Homo sapiens
tcagctgggtcacatccatccct

SEQ ID NO: 2349878 - DNA, 15 bp, Homo sapiens
tcaggaaaaggttga

SEQ ID NO: 2349879 - DNA, 14 bp, Homo sapiens
tcaggacggctcct

SEQ ID NO: 2349880 - DNA, 15 bp, Homo sapiens
tcaggacggctcctc

SEQ ID NO: 2349881 - DNA, 22 bp, Homo sapiens
tcaggacggctcctcagagcgc

SEQ ID NO: 2349882 - DNA, 16 bp, Homo sapiens
tcaggccctgactcct

SEQ ID NO: 2349883 - DNA, 18 bp, Homo sapiens
tcaggccctgactcctct

SEQ ID NO: 2349884 - DNA, 15 bp, Homo sapiens
tcaggctgaaaacaa

SEQ ID NO: 2349885 - DNA, 13 bp, Homo sapiens
tcagggagcctcc

SEQ ID NO: 2349886 - DNA, 16 bp, Homo sapiens
tcagggctcccagggg

SEQ ID NO: 2349887 - DNA, 19 bp, Homo sapiens
tcagggctggctcctgatc

SEQ ID NO: 2349888 - DNA, 15 bp, Homo sapiens
tcaggtgacatgtga

SEQ ID NO: 2349889 - DNA, 17 bp, Homo sapiens
tcaggtgacatgtgaaa

SEQ ID NO: 2349890 - DNA, 21 bp, Homo sapiens
tcaggttatcgaaataacaat

SEQ ID NO: 2349891 - DNA, 16 bp, Homo sapiens
tcagtatgtgggggct

SEQ ID NO: 2349892 - DNA, 18 bp, Homo sapiens
tcagtatgtgggggcttc

SEQ ID NO: 2349893 - DNA, 21 bp, Homo sapiens
tcagtatgtgggggcttcatc

SEQ ID NO: 2349894 - DNA, 22 bp, Homo sapiens
tcagtatgtgggggcttcatct

SEQ ID NO: 2349895 - DNA, 18 bp, Homo sapiens
tcagtcatcaaagcagaa

SEQ ID NO: 2349896 - DNA, 20 bp, Homo sapiens
tcagtcatgcataaatatgc

SEQ ID NO: 2349897 - DNA, 17 bp, Homo sapiens
tcagtcccctctctctg

SEQ ID NO: 2349898 - DNA, 19 bp, Homo sapiens
tcagtcccctctctctggg

SEQ ID NO: 2349899 - DNA, 22 bp, Homo sapiens
tcagtcccctctctctgggtca

SEQ ID NO: 2349900 - DNA, 24 bp, Homo sapiens
tcagtctttgctcagtgtccagct

SEQ ID NO: 2349901 - DNA, 13 bp, Homo sapiens
tcagtgagcctcc

SEQ ID NO: 2349902 - DNA, 22 bp, Homo sapiens
tcagtgagcctcctgtgcctgg

SEQ ID NO: 2349903 - DNA, 22 bp, Homo sapiens
tcagtgccccattctcactgct

SEQ ID NO: 2349904 - DNA, 16 bp, Homo sapiens
tcagtgctctcagctg

SEQ ID NO: 2349905 - DNA, 15 bp, Homo sapiens
tcagtgtccagcttc

SEQ ID NO: 2349906 - DNA, 16 bp, Homo sapiens
tcagtgtccagcttcc

SEQ ID NO: 2349907 - DNA, 20 bp, Homo sapiens
tcagtgtccagcttccaaag

SEQ ID NO: 2349908 - DNA, 21 bp, Homo sapiens
tcagtgtccagcttccaaagc

SEQ ID NO: 2349909 - DNA, 14 bp, Homo sapiens
tcagtgtgatgaat

SEQ ID NO: 2349910 - DNA, 19 bp, Homo sapiens
tcagtgttacctgtgtgct

SEQ ID NO: 2349911 - DNA, 15 bp, Homo sapiens
tcagtgttggtatat

SEQ ID NO: 2349912 - DNA, 21 bp, Homo sapiens
tcagttacagtggcagtattg

SEQ ID NO: 2349913 - DNA, 18 bp, Homo sapiens
tcagttacccactcggtc

SEQ ID NO: 2349914 - DNA, 19 bp, Homo sapiens
tcagttcattgtggtcctt

SEQ ID NO: 2349915 - DNA, 19 bp, Homo sapiens
tcagttctacggatcatca

SEQ ID NO: 2349916 - DNA, 20 bp, Homo sapiens
tcagttgctcaaaaagaaat

SEQ ID NO: 2349917 - DNA, 15 bp, Homo sapiens
tcagttgcttgtctt

SEQ ID NO: 2349918 - DNA, 16 bp, Homo sapiens
tcagttgtgtttttta

SEQ ID NO: 2349919 - DNA, 14 bp, Homo sapiens
tcagtttgttggaa

SEQ ID NO: 2349920 - DNA, 13 bp, Homo sapiens
tcagttttccttc

SEQ ID NO: 2349921 - DNA, 20 bp, Homo sapiens
tcataaaaatctagcacact

SEQ ID NO: 2349922 - DNA, 21 bp, Homo sapiens
tcataaaatagaataattctt

SEQ ID NO: 2349923 - DNA, 11 bp, Homo sapiens
tcataaattat

SEQ ID NO: 2349924 - DNA, 15 bp, Homo sapiens
tcatactcctgggct

SEQ ID NO: 2349925 - DNA, 18 bp, Homo sapiens
tcatagactcctttgcta

SEQ ID NO: 2349926 - DNA, 20 bp, Homo sapiens
tcatagactcctttgctaat

SEQ ID NO: 2349927 - DNA, 19 bp, Homo sapiens
tcatagctcactgcagcct

SEQ ID NO: 2349928 - DNA, 21 bp, Homo sapiens
tcataggttaaaaaaaaaagt

SEQ ID NO: 2349929 - DNA, 17 bp, Homo sapiens
tcatagtaataagatgg

SEQ ID NO: 2349930 - DNA, 18 bp, Homo sapiens
tcatagtcattgtggttt

SEQ ID NO: 2349931 - DNA, 22 bp, Homo sapiens
tcatagtcattgtggtttagat

SEQ ID NO: 2349932 - DNA, 16 bp, Homo sapiens
tcatataaactcattt

SEQ ID NO: 2349933 - DNA, 17 bp, Homo sapiens
tcatataaactcattta

SEQ ID NO: 2349934 - DNA, 22 bp, Homo sapiens
tcatatatatcacccagacata

SEQ ID NO: 2349935 - DNA, 18 bp, Homo sapiens
tcatatctaactttgtaa

SEQ ID NO: 2349936 - DNA, 22 bp, Homo sapiens
tcatatctatgggaaaaatcta

SEQ ID NO: 2349937 - DNA, 22 bp, Homo sapiens
tcatattcataccttctgatga

SEQ ID NO: 2349938 - DNA, 17 bp, Homo sapiens
tcatcaaagcagaagtc

SEQ ID NO: 2349939 - DNA, 19 bp, Homo sapiens
tcatcaagagaatttgggg

SEQ ID NO: 2349940 - DNA, 23 bp, Homo sapiens
tcatcacatttctatgccaaaca

SEQ ID NO: 2349941 - DNA, 14 bp, Homo sapiens
tcatcaccatttcc

SEQ ID NO: 2349942 - DNA, 16 bp, Homo sapiens
tcatcagatgcctgct

SEQ ID NO: 2349943 - DNA, 20 bp, Homo sapiens
tcatccagatgtggctactg

SEQ ID NO: 2349944 - DNA, 15 bp, Homo sapiens
tcatcctgaccaaga

SEQ ID NO: 2349945 - DNA, 13 bp, Homo sapiens
tcatctcccctcc

SEQ ID NO: 2349946 - DNA, 16 bp, Homo sapiens
tcatctctttagagaa

SEQ ID NO: 2349947 - DNA, 13 bp, Homo sapiens
tcatctgcaaaag

SEQ ID NO: 2349948 - DNA, 19 bp, Homo sapiens
tcatctggcaacatcttta

SEQ ID NO: 2349949 - DNA, 22 bp, Homo sapiens
tcatctgtaagagcttgctcca

SEQ ID NO: 2349950 - DNA, 16 bp, Homo sapiens
tcatctgttagggcct

SEQ ID NO: 2349951 - DNA, 15 bp, Homo sapiens
tcatcttcctgtgtc

SEQ ID NO: 2349952 - DNA, 15 bp, Homo sapiens
tcatgaaaatgacat

SEQ ID NO: 2349953 - DNA, 18 bp, Homo sapiens
tcatgaattttaaagtat

SEQ ID NO: 2349954 - DNA, 16 bp, Homo sapiens
tcatgacataataaag

SEQ ID NO: 2349955 - DNA, 14 bp, Homo sapiens
tcatgactttatag

SEQ ID NO: 2349956 - DNA, 15 bp, Homo sapiens
tcatgagaagccaag

SEQ ID NO: 2349957 - DNA, 13 bp, Homo sapiens
tcatgatccaact

SEQ ID NO: 2349958 - DNA, 11 bp, Homo sapiens
tcatgcaaaat

SEQ ID NO: 2349959 - DNA, 14 bp, Homo sapiens
tcatgcataaatat

SEQ ID NO: 2349960 - DNA, 18 bp, Homo sapiens
tcatgcatgtcctgtaaa

SEQ ID NO: 2349961 - DNA, 14 bp, Homo sapiens
tcatgcccagctct

SEQ ID NO: 2349962 - DNA, 16 bp, Homo sapiens
tcatgcccagctctct

SEQ ID NO: 2349963 - DNA, 19 bp, Homo sapiens
tcatgcccagctctctgac

SEQ ID NO: 2349964 - DNA, 20 bp, Homo sapiens
tcatgcccagctctctgacg

SEQ ID NO: 2349965 - DNA, 19 bp, Homo sapiens
tcatggctaatttaacacc

SEQ ID NO: 2349966 - DNA, 15 bp, Homo sapiens
tcatgggtcctagcc

SEQ ID NO: 2349967 - DNA, 20 bp, Homo sapiens
tcccttgcctttcgaggcct

SEQ ID NO: 2349968 - DNA, 21 bp, Homo sapiens
tcccttgcctttcgaggcctg

SEQ ID NO: 2349969 - DNA, 15 bp, Homo sapiens
tcccttgctggcccc

SEQ ID NO: 2349970 - DNA, 16 bp, Homo sapiens
tcccttgctggcccca

SEQ ID NO: 2349971 - DNA, 23 bp, Homo sapiens
tcccttgctggccccagccctgc

SEQ ID NO: 2349972 - DNA, 13 bp, Homo sapiens
tccctttctcagg

SEQ ID NO: 2349973 - DNA, 18 bp, Homo sapiens
tccctttgcacctgagac

SEQ ID NO: 2349974 - DNA, 20 bp, Homo sapiens
tcccttttcaccttttcagg

SEQ ID NO: 2349975 - DNA, 14 bp, Homo sapiens
tcccttttctttga

SEQ ID NO: 2349976 - DNA, 17 bp, Homo sapiens
tccctttttttgttatt

SEQ ID NO: 2349977 - DNA, 20 bp, Homo sapiens
tccgcaagagtaaaggaaat

SEQ ID NO: 2349978 - DNA, 12 bp, Homo sapiens
tccgccagcctc

SEQ ID NO: 2349979 - DNA, 15 bp, Homo sapiens
tccgccagcctcctc

SEQ ID NO: 2349980 - DNA, 16 bp, Homo sapiens
tccgccagcctcctct

SEQ ID NO: 2349981 - DNA, 17 bp, Homo sapiens
tccgccagcctcctctg

SEQ ID NO: 2349982 - DNA, 16 bp, Homo sapiens
tccggaatgccaccca

SEQ ID NO: 2349983 - DNA, 18 bp, Homo sapiens
tccggaatgccacccaca

SEQ ID NO: 2349984 - DNA, 16 bp, Homo sapiens
tccggactggtgccct

SEQ ID NO: 2349985 - DNA, 20 bp, Homo sapiens
tccggatttctaacagtcct

SEQ ID NO: 2349986 - DNA, 15 bp, Homo sapiens
tccgtatctccctgg

SEQ ID NO: 2349987 - DNA, 15 bp, Homo sapiens
tccgtgaaagttgtg

SEQ ID NO: 2349988 - DNA, 20 bp, Homo sapiens
tccgtgtgtcccagatgctg

SEQ ID NO: 2349989 - DNA, 18 bp, Homo sapiens
tcctaaagagagtatttt

SEQ ID NO: 2349990 - DNA, 16 bp, Homo sapiens
tcctaacacagcatgt

SEQ ID NO: 2349991 - DNA, 23 bp, Homo sapiens
tcctaagatgtgttcttattttt

SEQ ID NO: 2349992 - DNA, 15 bp, Homo sapiens
tcctaatttctcctc

SEQ ID NO: 2349993 - DNA, 19 bp, Homo sapiens
tcctacaggcctatttaac

SEQ ID NO: 2349994 - DNA, 21 bp, Homo sapiens
tcctacaggcctatttaacaa

SEQ ID NO: 2349995 - DNA, 15 bp, Homo sapiens
tcctacgtccaaggt

SEQ ID NO: 2349996 - DNA, 14 bp, Homo sapiens
tcctactaataaac

SEQ ID NO: 2349997 - DNA, 16 bp, Homo sapiens
tcctactaataaacca

SEQ ID NO: 2349998 - DNA, 19 bp, Homo sapiens
tcctactcggctctgcagt

SEQ ID NO: 2349999 - DNA, 14 bp, Homo sapiens
tcctagcccttccc

SEQ ID NO: 2350000 - DNA, 15 bp, Homo sapiens
tcctagctctcccag

SEQ ID NO: 2350001 - DNA, 12 bp, Homo sapiens
tcctagctctgg

SEQ ID NO: 2350002 - DNA, 17 bp, Homo sapiens
tcctagctgttctaatt

SEQ ID NO: 2350003 - DNA, 18 bp, Homo sapiens
tcctaggaggaaaattcc

SEQ ID NO: 2350004 - DNA, 22 bp, Homo sapiens
tcctatccttggagagcagctg

SEQ ID NO: 2350005 - DNA, 15 bp, Homo sapiens
tcctatgcttaataa

SEQ ID NO: 2350006 - DNA, 15 bp, Homo sapiens
tcctattctataaaa

SEQ ID NO: 2350007 - DNA, 20 bp, Homo sapiens
tcctcaaacgacagaggagc

SEQ ID NO: 2350008 - DNA, 14 bp, Homo sapiens
tcctcaagggaagg

SEQ ID NO: 2350009 - DNA, 15 bp, Homo sapiens
tcctcacctcatgcc

SEQ ID NO: 2350010 - DNA, 21 bp, Homo sapiens
tcctcactcttcaaggaggcc

SEQ ID NO: 2350011 - DNA, 14 bp, Homo sapiens
tcctcagagcgcca

SEQ ID NO: 2350012 - DNA, 15 bp, Homo sapiens
tcctcagagcgccag

SEQ ID NO: 2350013 - DNA, 20 bp, Homo sapiens
tcctcagagcgccaggaagc

SEQ ID NO: 2350014 - DNA, 19 bp, Homo sapiens
tcctcatggcagcctactc

SEQ ID NO: 2350015 - DNA, 16 bp, Homo sapiens
tcctccactccacctc

SEQ ID NO: 2350016 - DNA, 17 bp, Homo sapiens
tcctccactccacctcc

SEQ ID NO: 2350017 - DNA, 13 bp, Homo sapiens
tcctccaggagct

SEQ ID NO: 2350018 - DNA, 13 bp, Homo sapiens
tcctccaggcctg

SEQ ID NO: 2350019 - DNA, 13 bp, Homo sapiens
tcctccagggaag

SEQ ID NO: 2350020 - DNA, 22 bp, Homo sapiens
tcctccagggaaggtggccaca

SEQ ID NO: 2350021 - DNA, 12 bp, Homo sapiens
tcctcccagtga

SEQ ID NO: 2350022 - DNA, 14 bp, Homo sapiens
tcctcccagtgaga

SEQ ID NO: 2350023 - DNA, 21 bp, Homo sapiens
tcctccccaaatcaatacact

SEQ ID NO: 2350024 - DNA, 22 bp, Homo sapiens
tcctccgtccatatcagaactg

SEQ ID NO: 2350025 - DNA, 14 bp, Homo sapiens
tcctcctacttaca

SEQ ID NO: 2350026 - DNA, 12 bp, Homo sapiens
tcctcctcacct

SEQ ID NO: 2350027 - DNA, 16 bp, Homo sapiens
tcctcctcacctcatg

SEQ ID NO: 2350028 - DNA, 22 bp, Homo sapiens
tcctcctctgcctacagccagg

SEQ ID NO: 2350029 - DNA, 14 bp, Homo sapiens
tcctcctgcctcag

SEQ ID NO: 2350030 - DNA, 21 bp, Homo sapiens
tcctcctgcctcagccttcca

SEQ ID NO: 2350031 - DNA, 13 bp, Homo sapiens
tcctcctggacac

SEQ ID NO: 2350032 - DNA, 16 bp, Homo sapiens
tcctccttggtgcctg

SEQ ID NO: 2350033 - DNA, 17 bp, Homo sapiens
tcctccttggtgcctgg

SEQ ID NO: 2350034 - DNA, 14 bp, Homo sapiens
tcctccttttcact

SEQ ID NO: 2350035 - DNA, 21 bp, Homo sapiens
tcctcgcagcctctcagtgcc

SEQ ID NO: 2350036 - DNA, 14 bp, Homo sapiens
tcctctagaagcca

SEQ ID NO: 2350037 - DNA, 18 bp, Homo sapiens
tcctctagaagccaaggg

SEQ ID NO: 2350038 - DNA, 18 bp, Homo sapiens
tcctctccactgctggac

SEQ ID NO: 2350039 - DNA, 22 bp, Homo sapiens
tcctctccactgctggacatga

SEQ ID NO: 2350040 - DNA, 11 bp, Homo sapiens
tcctctctctc

SEQ ID NO: 2350041 - DNA, 22 bp, Homo sapiens
tcctctgcaagcttcttgctga

SEQ ID NO: 2350042 - DNA, 20 bp, Homo sapiens
tcctctgcctacagccaggt

SEQ ID NO: 2350043 - DNA, 12 bp, Homo sapiens
tcctctgcctgc

SEQ ID NO: 2350044 - DNA, 13 bp, Homo sapiens
tcctctgcctgcc

SEQ ID NO: 2350045 - DNA, 22 bp, Homo sapiens
tcctctgcctgccccgccccca

SEQ ID NO: 2350046 - DNA, 20 bp, Homo sapiens
tcctctgctcaccgcccatc

SEQ ID NO: 2350047 - DNA, 12 bp, Homo sapiens
tcctctggagcc

SEQ ID NO: 2350048 - DNA, 18 bp, Homo sapiens
tcctctggccgcagaggt

SEQ ID NO: 2350049 - DNA, 20 bp, Homo sapiens
tcctcttctactcacttttc

SEQ ID NO: 2350050 - DNA, 23 bp, Homo sapiens
tcctcttctactcacttttccca

SEQ ID NO: 2350051 - DNA, 20 bp, Homo sapiens
tcctcttgtctgatttctta

SEQ ID NO: 2350052 - DNA, 19 bp, Homo sapiens
tcctctttagtttttggtt

SEQ ID NO: 2350053 - DNA, 11 bp, Homo sapiens
tcctctttctg

SEQ ID NO: 2350054 - DNA, 19 bp, Homo sapiens
tcctctttctgctctgcca

SEQ ID NO: 2350055 - DNA, 21 bp, Homo sapiens
tcctgaaacgctcctttgtgt

SEQ ID NO: 2350056 - DNA, 22 bp, Homo sapiens
tcctgaaacgctcctttgtgtg

SEQ ID NO: 2350057 - DNA, 22 bp, Homo sapiens
tcctgaaagtgtttttaaataa

SEQ ID NO: 2350058 - DNA, 22 bp, Homo sapiens
tcctgaaccgcacagctcagga

SEQ ID NO: 2350059 - DNA, 20 bp, Homo sapiens
tcctgacacccttctcccac

SEQ ID NO: 2350060 - DNA, 16 bp, Homo sapiens
tcctgagaccacagag

SEQ ID NO: 2350061 - DNA, 21 bp, Homo sapiens
tcctgatccactttgggggag

SEQ ID NO: 2350062 - DNA, 23 bp, Homo sapiens
tcctgatgaaaaatatgtgcttg

SEQ ID NO: 2350063 - DNA, 13 bp, Homo sapiens
tcctgcagcccca

SEQ ID NO: 2350064 - DNA, 22 bp, Homo sapiens
tcctgccaggcacacacagccc

SEQ ID NO: 2350065 - DNA, 14 bp, Homo sapiens
tcctgccatcctca

SEQ ID NO: 2350066 - DNA, 15 bp, Homo sapiens
tcctgccctgtccaa

SEQ ID NO: 2350067 - DNA, 13 bp, Homo sapiens
tcctgcctcagcc

SEQ ID NO: 2350068 - DNA, 16 bp, Homo sapiens
tcctgcctgtctgccc

SEQ ID NO: 2350069 - DNA, 20 bp, Homo sapiens
tcctgcctgtctgccccagc

SEQ ID NO: 2350070 - DNA, 14 bp, Homo sapiens
tcctgcgtcctcct

SEQ ID NO: 2350071 - DNA, 16 bp, Homo sapiens
tcctgcgtcctcctca

SEQ ID NO: 2350072 - DNA, 21 bp, Homo sapiens
tcctgctacctcccttgcctt

SEQ ID NO: 2350073 - DNA, 23 bp, Homo sapiens
tcctgctacctcccttgcctttc

SEQ ID NO: 2350074 - DNA, 17 bp, Homo sapiens
gtgtggctgtgggtgtg

SEQ ID NO: 2350075 - DNA, 13 bp, Homo sapiens
gtgtgtgtgtgtg

SEQ ID NO: 2350076 - DNA, 17 bp, Homo sapiens
gtgttcagctctttcca

SEQ ID NO: 2350077 - DNA, 14 bp, Homo sapiens
gtgttccttccgct

SEQ ID NO: 2350078 - DNA, 20 bp, Homo sapiens
gtgttctcatgaagcaggag

SEQ ID NO: 2350079 - DNA, 17 bp, Homo sapiens
gtgttctttcctgccct

SEQ ID NO: 2350080 - DNA, 22 bp, Homo sapiens
gtgttgagcatctgtccccctt

SEQ ID NO: 2350081 - DNA, 13 bp, Homo sapiens
gtgtttattgcaa

SEQ ID NO: 2350082 - DNA, 12 bp, Homo sapiens
gtgtttccagaa

SEQ ID NO: 2350083 - DNA, 14 bp, Homo sapiens
gtgttttcttcgtg

SEQ ID NO: 2350084 - DNA, 14 bp, Homo sapiens
gttaaaaaagcgag

SEQ ID NO: 2350085 - DNA, 19 bp, Homo sapiens
gttaaacggtgcccatcct

SEQ ID NO: 2350086 - DNA, 23 bp, Homo sapiens
gttaaactattagagtatttccc

SEQ ID NO: 2350087 - DNA, 15 bp, Homo sapiens
gttaaagaaaggaaa

SEQ ID NO: 2350088 - DNA, 15 bp, Homo sapiens
gttaaagagaatgag

SEQ ID NO: 2350089 - DNA, 18 bp, Homo sapiens
gttaaatttgtaagtttc

SEQ ID NO: 2350090 - DNA, 19 bp, Homo sapiens
gttaaatttgtaagtttca

SEQ ID NO: 2350091 - DNA, 22 bp, Homo sapiens
gttaacccttcatcttcctgtg

SEQ ID NO: 2350092 - DNA, 13 bp, Homo sapiens
gttaagaagctgt

SEQ ID NO: 2350093 - DNA, 21 bp, Homo sapiens
gttaagaagctgttgtacatt

SEQ ID NO: 2350094 - DNA, 14 bp, Homo sapiens
gttaaggaaactct

SEQ ID NO: 2350095 - DNA, 19 bp, Homo sapiens
gttaaggaaactcttatct

SEQ ID NO: 2350096 - DNA, 18 bp, Homo sapiens
gttaatttgtgtgttttt

SEQ ID NO: 2350097 - DNA, 20 bp, Homo sapiens
gttacacagaaatgctgctg

SEQ ID NO: 2350098 - DNA, 21 bp, Homo sapiens
gttacacagaaatgctgctgg

SEQ ID NO: 2350099 - DNA, 22 bp, Homo sapiens
gttacacagaaatgctgctggc

SEQ ID NO: 2350100 - DNA, 16 bp, Homo sapiens
gttacctactttgact

SEQ ID NO: 2350101 - DNA, 21 bp, Homo sapiens
gttactgagatgtcttcaatg

SEQ ID NO: 2350102 - DNA, 16 bp, Homo sapiens
gttactttcaaaatga

SEQ ID NO: 2350103 - DNA, 18 bp, Homo sapiens
gttagcatgtatgaatgt

SEQ ID NO: 2350104 - DNA, 19 bp, Homo sapiens
gttagcatgtatgaatgta

SEQ ID NO: 2350105 - DNA, 13 bp, Homo sapiens
gttagtcacctgc

SEQ ID NO: 2350106 - DNA, 13 bp, Homo sapiens
gttataagaagaa

SEQ ID NO: 2350107 - DNA, 23 bp, Homo sapiens
gttataattttttttaaaataga

SEQ ID NO: 2350108 - DNA, 14 bp, Homo sapiens
gttatcatgaattt

SEQ ID NO: 2350109 - DNA, 22 bp, Homo sapiens
gttatcatgaattttaaagtat

SEQ ID NO: 2350110 - DNA, 17 bp, Homo sapiens
gttatgaacagctgtgt

SEQ ID NO: 2350111 - DNA, 21 bp, Homo sapiens
gttatgaacagctgtgtctgc

SEQ ID NO: 2350112 - DNA, 13 bp, Homo sapiens
gttatgcatcatt

SEQ ID NO: 2350113 - DNA, 17 bp, Homo sapiens
gttatgttgataaacca

SEQ ID NO: 2350114 - DNA, 13 bp, Homo sapiens
gttatgttgtaat

SEQ ID NO: 2350115 - DNA, 22 bp, Homo sapiens
gttatgttgtaatattttgctg

SEQ ID NO: 2350116 - DNA, 17 bp, Homo sapiens
gttattgcaataaagta

SEQ ID NO: 2350117 - DNA, 14 bp, Homo sapiens
gttattttctacag

SEQ ID NO: 2350118 - DNA, 15 bp, Homo sapiens
gttatttttgtacat

SEQ ID NO: 2350119 - DNA, 18 bp, Homo sapiens
gttcaaggtcactgtttc

SEQ ID NO: 2350120 - DNA, 21 bp, Homo sapiens
gttcacctccaagcatttcat

SEQ ID NO: 2350121 - DNA, 22 bp, Homo sapiens
gttcacctccaagcatttcatg

SEQ ID NO: 2350122 - DNA, 22 bp, Homo sapiens
gttcagcaaactaaccagcatt

SEQ ID NO: 2350123 - DNA, 24 bp, Homo sapiens
gttcagcaaactaaccagcattcc

SEQ ID NO: 2350124 - DNA, 12 bp, Homo sapiens
gttcagcagaac

SEQ ID NO: 2350125 - DNA, 15 bp, Homo sapiens
gttcagcagaacctg

SEQ ID NO: 2350126 - DNA, 19 bp, Homo sapiens
gttcagcatggcatccaag

SEQ ID NO: 2350127 - DNA, 21 bp, Homo sapiens
gttcagctctttccaaattaa

SEQ ID NO: 2350128 - DNA, 18 bp, Homo sapiens
gttcataataaaagtgaa

SEQ ID NO: 2350129 - DNA, 20 bp, Homo sapiens
gttcatatctatgggaaaaa

SEQ ID NO: 2350130 - DNA, 20 bp, Homo sapiens
gttcatcaccatttcctcct

SEQ ID NO: 2350131 - DNA, 14 bp, Homo sapiens
gttcatcatccaga

SEQ ID NO: 2350132 - DNA, 22 bp, Homo sapiens
gttcatcatccagatgtggcta

SEQ ID NO: 2350133 - DNA, 16 bp, Homo sapiens
gttcatcgattttcta

SEQ ID NO: 2350134 - DNA, 18 bp, Homo sapiens
gttcattgcaattaaact

SEQ ID NO: 2350135 - DNA, 14 bp, Homo sapiens
gttccagtttctcc

SEQ ID NO: 2350136 - DNA, 15 bp, Homo sapiens
gttccagtttctcct

SEQ ID NO: 2350137 - DNA, 18 bp, Homo sapiens
gttccagtttctccttga

SEQ ID NO: 2350138 - DNA, 20 bp, Homo sapiens
gttccagtttctccttgaaa

SEQ ID NO: 2350139 - DNA, 20 bp, Homo sapiens
gttccctcctagctctccca

SEQ ID NO: 2350140 - DNA, 21 bp, Homo sapiens
gttccctcctagctctcccag

SEQ ID NO: 2350141 - DNA, 21 bp, Homo sapiens
gttcccttgaaactttgggaa

SEQ ID NO: 2350142 - DNA, 19 bp, Homo sapiens
gttccgtatctccctggag

SEQ ID NO: 2350143 - DNA, 15 bp, Homo sapiens
gttcctcaaattttt

SEQ ID NO: 2350144 - DNA, 19 bp, Homo sapiens
gttcctccttttcttcacc

SEQ ID NO: 2350145 - DNA, 12 bp, Homo sapiens
gttcctctgcct

SEQ ID NO: 2350146 - DNA, 13 bp, Homo sapiens
gttcctctgcctg

SEQ ID NO: 2350147 - DNA, 16 bp, Homo sapiens
gttcctctgcctgccc

SEQ ID NO: 2350148 - DNA, 14 bp, Homo sapiens
gttcctgctgctgt

SEQ ID NO: 2350149 - DNA, 17 bp, Homo sapiens
gttcctgctgctgtctg

SEQ ID NO: 2350150 - DNA, 17 bp, Homo sapiens
gttcctggtgactcctg

SEQ ID NO: 2350151 - DNA, 22 bp, Homo sapiens
gttctaacagtgaagttttact

SEQ ID NO: 2350152 - DNA, 19 bp, Homo sapiens
gttctacggatcatcaaca

SEQ ID NO: 2350153 - DNA, 16 bp, Homo sapiens
gttctcaggacagcat

SEQ ID NO: 2350154 - DNA, 14 bp, Homo sapiens
gttctcatgaagca

SEQ ID NO: 2350155 - DNA, 21 bp, Homo sapiens
gttctcttgctttcacattgt

SEQ ID NO: 2350156 - DNA, 14 bp, Homo sapiens
gttctctttggaaa

SEQ ID NO: 2350157 - DNA, 15 bp, Homo sapiens
gttctctttggaaat

SEQ ID NO: 2350158 - DNA, 12 bp, Homo sapiens
gttctgcctgga

SEQ ID NO: 2350159 - DNA, 17 bp, Homo sapiens
gttctggacctgggcat

SEQ ID NO: 2350160 - DNA, 12 bp, Homo sapiens
gttctttcagaa

SEQ ID NO: 2350161 - DNA, 18 bp, Homo sapiens
gttctttcctctttctgc

SEQ ID NO: 2350162 - DNA, 23 bp, Homo sapiens
gttctttcctctttctgctctgc

SEQ ID NO: 2350163 - DNA, 14 bp, Homo sapiens
gttctttcctgccc

SEQ ID NO: 2350164 - DNA, 16 bp, Homo sapiens
gttctttcctgccctg

SEQ ID NO: 2350165 - DNA, 16 bp, Homo sapiens
gttgagccccagtgct

SEQ ID NO: 2350166 - DNA, 15 bp, Homo sapiens
gttgagtctgtacta

SEQ ID NO: 2350167 - DNA, 12 bp, Homo sapiens
gttgataaaaac

SEQ ID NO: 2350168 - DNA, 21 bp, Homo sapiens
gttgataaaccaaaaacattt

SEQ ID NO: 2350169 - DNA, 22 bp, Homo sapiens
gttgataaaccaaaaacatttg

SEQ ID NO: 2350170 - DNA, 16 bp, Homo sapiens
gttgcaagatgtgaat

SEQ ID NO: 2350171 - DNA, 17 bp, Homo sapiens
gttgcaagatgtgaatt

SEQ ID NO: 2350172 - DNA, 18 bp, Homo sapiens
gttgcatagcagtatatg

SEQ ID NO: 2350173 - DNA, 23 bp, Homo sapiens
gttgcattttaaccctattttac

SEQ ID NO: 2350174 - DNA, 19 bp, Homo sapiens
gttgccaaagctggtctca

SEQ ID NO: 2350175 - DNA, 13 bp, Homo sapiens
gttgcgggacaga

SEQ ID NO: 2350176 - DNA, 19 bp, Homo sapiens
gttgctccgcctggcctgg

SEQ ID NO: 2350177 - DNA, 13 bp, Homo sapiens
gttgcttgtcttc

SEQ ID NO: 2350178 - DNA, 14 bp, Homo sapiens
gttgcttgtcttct

SEQ ID NO: 2350179 - DNA, 23 bp, Homo sapiens
gttgctttgaaaaatctcattat

SEQ ID NO: 2350180 - DNA, 17 bp, Homo sapiens
gttggaaggatctgctg

SEQ ID NO: 2350181 - DNA, 22 bp, Homo sapiens
gttggatggatgggtggatggc

SEQ ID NO: 2350182 - DNA, 15 bp, Homo sapiens
gttggccggcggcta

SEQ ID NO: 2350183 - DNA, 17 bp, Homo sapiens
gttgtaaagatattgta

SEQ ID NO: 2350184 - DNA, 20 bp, Homo sapiens
gttgtaatatcagttacagt

SEQ ID NO: 2350185 - DNA, 19 bp, Homo sapiens
gttgtaatattttgctgct

SEQ ID NO: 2350186 - DNA, 18 bp, Homo sapiens
gttgtacatttatgattt

SEQ ID NO: 2350187 - DNA, 23 bp, Homo sapiens
gttgtacatttatgatttaataa

SEQ ID NO: 2350188 - DNA, 23 bp, Homo sapiens
gttgtacctcttttgcttgccaa

SEQ ID NO: 2350189 - DNA, 15 bp, Homo sapiens
gttgtagacaaagta

SEQ ID NO: 2350190 - DNA, 15 bp, Homo sapiens
tacagtatagatttt

SEQ ID NO: 2350191 - DNA, 15 bp, Homo sapiens
tacagtctcgtctct

SEQ ID NO: 2350192 - DNA, 21 bp, Homo sapiens
tacagtgcagagccttctcag

SEQ ID NO: 2350193 - DNA, 22 bp, Homo sapiens
tacagtgcagagccttctcaga

SEQ ID NO: 2350194 - DNA, 21 bp, Homo sapiens
tacagtggttttatactgaag

SEQ ID NO: 2350195 - DNA, 20 bp, Homo sapiens
tacagttctttcctctttct

SEQ ID NO: 2350196 - DNA, 21 bp, Homo sapiens
tacagttctttcctctttctg

SEQ ID NO: 2350197 - DNA, 15 bp, Homo sapiens
tacataactgaaaat

SEQ ID NO: 2350198 - DNA, 21 bp, Homo sapiens
tacataactgaaaatgtgcta

SEQ ID NO: 2350199 - DNA, 15 bp, Homo sapiens
tacatactgcatctt

SEQ ID NO: 2350200 - DNA, 18 bp, Homo sapiens
tacttgggaggctgaggc

SEQ ID NO: 2350201 - DNA, 19 bp, Homo sapiens
tacttgttatgttgtaata

SEQ ID NO: 2350202 - DNA, 13 bp, Homo sapiens
tacttgttttgga

SEQ ID NO: 2350203 - DNA, 12 bp, Homo sapiens
tactttcaaaat

SEQ ID NO: 2350204 - DNA, 14 bp, Homo sapiens
tactttgacttttt

SEQ ID NO: 2350205 - DNA, 16 bp, Homo sapiens
tactttgtattttgat

SEQ ID NO: 2350206 - DNA, 21 bp, Homo sapiens
tactttgtattttgattattt

SEQ ID NO: 2350207 - DNA, 18 bp, Homo sapiens
tagaaaaaggggcctgag

SEQ ID NO: 2350208 - DNA, 15 bp, Homo sapiens
tagaaaaataaaatg

SEQ ID NO: 2350209 - DNA, 18 bp, Homo sapiens
tagaaaagtgaattgaag

SEQ ID NO: 2350210 - DNA, 12 bp, Homo sapiens
tagaaaatgtga

SEQ ID NO: 2350211 - DNA, 21 bp, Homo sapiens
tagaaaatgtgaccctccaaa

SEQ ID NO: 2350212 - DNA, 15 bp, Homo sapiens
tagaaactacaaata

SEQ ID NO: 2350213 - DNA, 15 bp, Homo sapiens
tagaaagaagccata

SEQ ID NO: 2350214 - DNA, 12 bp, Homo sapiens
tagaaagcattt

SEQ ID NO: 2350215 - DNA, 15 bp, Homo sapiens
tagaaatattcacat

SEQ ID NO: 2350216 - DNA, 13 bp, Homo sapiens
tagaaatgcatat

SEQ ID NO: 2350217 - DNA, 14 bp, Homo sapiens
tagaaatgcatatt

SEQ ID NO: 2350218 - DNA, 11 bp, Homo sapiens
tagaaatgttt

SEQ ID NO: 2350219 - DNA, 15 bp, Homo sapiens
tagaaattttgtaag

SEQ ID NO: 2350220 - DNA, 16 bp, Homo sapiens
tagaaattttgtaaga

SEQ ID NO: 2350221 - DNA, 22 bp, Homo sapiens
tagaaattttgtaagaaggcaa

SEQ ID NO: 2350222 - DNA, 16 bp, Homo sapiens
tagaactccaggccct

SEQ ID NO: 2350223 - DNA, 20 bp, Homo sapiens
tagaagtaggaggaaacagt

SEQ ID NO: 2350224 - DNA, 20 bp, Homo sapiens
tagaagtgagcaaaaaagag

SEQ ID NO: 2350225 - DNA, 11 bp, Homo sapiens
tagaataattc

SEQ ID NO: 2350226 - DNA, 13 bp, Homo sapiens
tagaataattctt

SEQ ID NO: 2350227 - DNA, 14 bp, Homo sapiens
tagaataattcttt

SEQ ID NO: 2350228 - DNA, 14 bp, Homo sapiens
tagaatagcctgag

SEQ ID NO: 2350229 - DNA, 19 bp, Homo sapiens
tagaatgcatgtaaggtct

SEQ ID NO: 2350230 - DNA, 20 bp, Homo sapiens
tagaatgcatgtaaggtctt

SEQ ID NO: 2350231 - DNA, 20 bp, Homo sapiens
tagacaaaccatctcctcct

SEQ ID NO: 2350232 - DNA, 20 bp, Homo sapiens
tagacaaagccttaagcaaa

SEQ ID NO: 2350233 - DNA, 12 bp, Homo sapiens
tagacaaagtac

SEQ ID NO: 2350234 - DNA, 14 bp, Homo sapiens
tagacaaagtacat

SEQ ID NO: 2350235 - DNA, 14 bp, Homo sapiens
tagacaacctttct

SEQ ID NO: 2350236 - DNA, 16 bp, Homo sapiens
tagacaacctttctgt

SEQ ID NO: 2350237 - DNA, 17 bp, Homo sapiens
tagacaacctttctgta

SEQ ID NO: 2350238 - DNA, 10 bp, Homo sapiens
tagaccaata

SEQ ID NO: 2350239 - DNA, 19 bp, Homo sapiens
tagaccctgaggccctggg

SEQ ID NO: 2350240 - DNA, 16 bp, Homo sapiens
tagaccctgggtgggc

SEQ ID NO: 2350241 - DNA, 16 bp, Homo sapiens
tagactctagtattta

SEQ ID NO: 2350242 - DNA, 13 bp, Homo sapiens
tagagaaaataaa

SEQ ID NO: 2350243 - DNA, 15 bp, Homo sapiens
tagagaagtccaagc

SEQ ID NO: 2350244 - DNA, 21 bp, Homo sapiens
tagagaggacaatactggggt

SEQ ID NO: 2350245 - DNA, 22 bp, Homo sapiens
tagagaggacaatactggggtt

SEQ ID NO: 2350246 - DNA, 20 bp, Homo sapiens
tagagataaaacagaatctt

SEQ ID NO: 2350247 - DNA, 13 bp, Homo sapiens
tagagatgagccc

SEQ ID NO: 2350248 - DNA, 20 bp, Homo sapiens
tagagattgcatttttatta

SEQ ID NO: 2350249 - DNA, 16 bp, Homo sapiens
tagagctagctgccac

SEQ ID NO: 2350250 - DNA, 18 bp, Homo sapiens
tagagctagctgccactt

SEQ ID NO: 2350251 - DNA, 17 bp, Homo sapiens
tagagcttagatttccc

SEQ ID NO: 2350252 - DNA, 21 bp, Homo sapiens
tagaggctcagtggtgggaga

SEQ ID NO: 2350253 - DNA, 22 bp, Homo sapiens
tagaggcttctccgccagcctc

SEQ ID NO: 2350254 - DNA, 17 bp, Homo sapiens
tagaggtcctctggagc

SEQ ID NO: 2350255 - DNA, 18 bp, Homo sapiens
tagaggtcctctggagcc

SEQ ID NO: 2350256 - DNA, 19 bp, Homo sapiens
tagaggtcctctggagccc

SEQ ID NO: 2350257 - DNA, 12 bp, Homo sapiens
tagagtaatgaa

SEQ ID NO: 2350258 - DNA, 15 bp, Homo sapiens
tagagtatttccctt

SEQ ID NO: 2350259 - DNA, 16 bp, Homo sapiens
tagagtatttcccttc

SEQ ID NO: 2350260 - DNA, 18 bp, Homo sapiens
tagagtcaactacacaaa

SEQ ID NO: 2350261 - DNA, 21 bp, Homo sapiens
tagagtcaactacacaaagca

SEQ ID NO: 2350262 - DNA, 13 bp, Homo sapiens
tagagttaagaag

SEQ ID NO: 2350263 - DNA, 17 bp, Homo sapiens
tagagttaagaagctgt

SEQ ID NO: 2350264 - DNA, 13 bp, Homo sapiens
tagataaattgta

SEQ ID NO: 2350265 - DNA, 14 bp, Homo sapiens
tagatatcctctcc

SEQ ID NO: 2350266 - DNA, 16 bp, Homo sapiens
tagatatcctctcccc

SEQ ID NO: 2350267 - DNA, 18 bp, Homo sapiens
tagatccatttccattgc

SEQ ID NO: 2350268 - DNA, 19 bp, Homo sapiens
tagatgattttttgaaagt

SEQ ID NO: 2350269 - DNA, 16 bp, Homo sapiens
tagatggaatggaaaa

SEQ ID NO: 2350270 - DNA, 23 bp, Homo sapiens
tagatggaatggaaaagcaactt

SEQ ID NO: 2350271 - DNA, 18 bp, Homo sapiens
tagcaacaacaattggta

SEQ ID NO: 2350272 - DNA, 12 bp, Homo sapiens
tagcacagtatt

SEQ ID NO: 2350273 - DNA, 14 bp, Homo sapiens
tagcacagtattta

SEQ ID NO: 2350274 - DNA, 18 bp, Homo sapiens
tagcacagtatttaacat

SEQ ID NO: 2350275 - DNA, 19 bp, Homo sapiens
tagcacagtatttaacatt

SEQ ID NO: 2350276 - DNA, 21 bp, Homo sapiens
tagcacagtatttaacattct

SEQ ID NO: 2350277 - DNA, 18 bp, Homo sapiens
tagcaccttcagggctga

SEQ ID NO: 2350278 - DNA, 22 bp, Homo sapiens
tagcaccttcagggctgagttc

SEQ ID NO: 2350279 - DNA, 13 bp, Homo sapiens
tagcagagttaaa

SEQ ID NO: 2350280 - DNA, 14 bp, Homo sapiens
tagcagagttaaat

SEQ ID NO: 2350281 - DNA, 16 bp, Homo sapiens
tagcagagttaaatct

SEQ ID NO: 2350282 - DNA, 12 bp, Homo sapiens
tagcaggctgtt

SEQ ID NO: 2350283 - DNA, 14 bp, Homo sapiens
tagcatgcttcctt

SEQ ID NO: 2350284 - DNA, 17 bp, Homo sapiens
tagcatgcttcctttct

SEQ ID NO: 2350285 - DNA, 21 bp, Homo sapiens
tagcatgcttcctttctctcc

SEQ ID NO: 2350286 - DNA, 22 bp, Homo sapiens
tagcatgcttcctttctctcct

SEQ ID NO: 2350287 - DNA, 20 bp, Homo sapiens
tagcattctttggagttaaa

SEQ ID NO: 2350288 - DNA, 22 bp, Homo sapiens
tagccacagctgctgttctcag

SEQ ID NO: 2350289 - DNA, 22 bp, Homo sapiens
tagccaggatcatggtgtaata

SEQ ID NO: 2350290 - DNA, 23 bp, Homo sapiens
tagccaggatcatggtgtaataa

SEQ ID NO: 2350291 - DNA, 18 bp, Homo sapiens
tagcccaatgaaatgaat

SEQ ID NO: 2350292 - DNA, 12 bp, Homo sapiens
tagcccttccct

SEQ ID NO: 2350293 - DNA, 13 bp, Homo sapiens
tagcccttccctg

SEQ ID NO: 2350294 - DNA, 14 bp, Homo sapiens
tagcccttccctga

SEQ ID NO: 2350295 - DNA, 18 bp, Homo sapiens
tagcctgaggtcccctcg

SEQ ID NO: 2350296 - DNA, 17 bp, Homo sapiens
tagcgagctgctctgct

SEQ ID NO: 2350297 - DNA, 22 bp, Homo sapiens
tagcgtttaaggtgagcataaa

SEQ ID NO: 2350298 - DNA, 15 bp, Homo sapiens
tagctacagtgcata

SEQ ID NO: 2350299 - DNA, 18 bp, Homo sapiens
tagctcactgcagcctca

SEQ ID NO: 2350300 - DNA, 14 bp, Homo sapiens
tagctcaggtgcct

SEQ ID NO: 2350301 - DNA, 11 bp, Homo sapiens
tagctcagtca

SEQ ID NO: 2350302 - DNA, 18 bp, Homo sapiens
tagctcagtcatcaaagc

SEQ ID NO: 2350303 - DNA, 23 bp, Homo sapiens
tagctcccgagctactctcttgc

SEQ ID NO: 2350304 - DNA, 15 bp, Homo sapiens
tagctcgagcaaaat

SEQ ID NO: 2350305 - DNA, 11 bp, Homo sapiens
tagctctgaga

SEQ ID NO: 2350306 - DNA, 15 bp, Homo sapiens
tagctgcaaaaataa

SEQ ID NO: 2350307 - DNA, 16 bp, Homo sapiens
tagctgccactttcac

SEQ ID NO: 2350308 - DNA, 23 bp, Homo sapiens
tagctgtacttcttgaatataaa

SEQ ID NO: 2350309 - DNA, 16 bp, Homo sapiens
tagctgtatatttatc

SEQ ID NO: 2350310 - DNA, 19 bp, Homo sapiens
taggaatgtccaccatgaa

SEQ ID NO: 2350311 - DNA, 22 bp, Homo sapiens
taggaatgtccaccatgaactt

SEQ ID NO: 2350312 - DNA, 14 bp, Homo sapiens
taggaccaagaaag

SEQ ID NO: 2350313 - DNA, 18 bp, Homo sapiens
taggagaggatgagagcc

SEQ ID NO: 2350314 - DNA, 13 bp, Homo sapiens
taggaggaaaatt

SEQ ID NO: 2350315 - DNA, 22 bp, Homo sapiens
taggaggaaacagttctcactg

SEQ ID NO: 2350316 - DNA, 17 bp, Homo sapiens
taggcagcttctaagag

SEQ ID NO: 2350317 - DNA, 20 bp, Homo sapiens
taggcattctggacctctgg

SEQ ID NO: 2350318 - DNA, 20 bp, Homo sapiens
taggcccattgtcctccttt

SEQ ID NO: 2350319 - DNA, 15 bp, Homo sapiens
taggcgaccaccgcc

SEQ ID NO: 2350320 - DNA, 17 bp, Homo sapiens
taggctattaaaaaagt

SEQ ID NO: 2350321 - DNA, 20 bp, Homo sapiens
taggctattttctaaagact

SEQ ID NO: 2350322 - DNA, 20 bp, Homo sapiens
tagggactacccatagacat

SEQ ID NO: 2350323 - DNA, 21 bp, Homo sapiens
tagggactgccaggctgtttc

SEQ ID NO: 2350324 - DNA, 18 bp, Homo sapiens
tagggagaatatttacta

SEQ ID NO: 2350325 - DNA, 16 bp, Homo sapiens
tagggctgcttttctt

SEQ ID NO: 2350326 - DNA, 18 bp, Homo sapiens
taggggaaggagaagtaa

SEQ ID NO: 2350327 - DNA, 15 bp, Homo sapiens
taggggagggcaggc

SEQ ID NO: 2350328 - DNA, 18 bp, Homo sapiens
taggggaggggctccttt

SEQ ID NO: 2350329 - DNA, 12 bp, Homo sapiens
taggtaagggcc

SEQ ID NO: 2350330 - DNA, 14 bp, Homo sapiens
taggtaggaagagc

SEQ ID NO: 2350331 - DNA, 19 bp, Homo sapiens
tagtaaaagtggtctctgc

SEQ ID NO: 2350332 - DNA, 15 bp, Homo sapiens
tagtaactataagat

SEQ ID NO: 2350333 - DNA, 11 bp, Homo sapiens
tagtaagaata

SEQ ID NO: 2350334 - DNA, 11 bp, Homo sapiens
tagtaagcata

SEQ ID NO: 2350335 - DNA, 16 bp, Homo sapiens
tagtaagcatagaaac

SEQ ID NO: 2350336 - DNA, 21 bp, Homo sapiens
tagtacaatttcaactacagt

SEQ ID NO: 2350337 - DNA, 11 bp, Homo sapiens
tagtagcattt

SEQ ID NO: 2350338 - DNA, 16 bp, Homo sapiens
tagtagttaaataact

SEQ ID NO: 2350339 - DNA, 13 bp, Homo sapiens
tagtagttagaaa

SEQ ID NO: 2350340 - DNA, 16 bp, Homo sapiens
tagtatctatatgact

SEQ ID NO: 2350341 - DNA, 23 bp, Homo sapiens
tagtatgtgcatttaattagaaa

SEQ ID NO: 2350342 - DNA, 20 bp, Homo sapiens
tagtatttatgggtggattt

SEQ ID NO: 2350343 - DNA, 18 bp, Homo sapiens
tagtcaatggcttgttca

SEQ ID NO: 2350344 - DNA, 18 bp, Homo sapiens
tagtcaccagagacttta

SEQ ID NO: 2350345 - DNA, 23 bp, Homo sapiens
tagtcccagctacttgggaggct

SEQ ID NO: 2350346 - DNA, 13 bp, Homo sapiens
tagtgatagatgt

SEQ ID NO: 2350347 - DNA, 22 bp, Homo sapiens
tagtgcctgagagtatttaggc

SEQ ID NO: 2350348 - DNA, 17 bp, Homo sapiens
tagtggattactgccat

SEQ ID NO: 2350349 - DNA, 23 bp, Homo sapiens
tagtggattactgccattcactt

SEQ ID NO: 2350350 - DNA, 14 bp, Homo sapiens
tagtggtcataaaa

SEQ ID NO: 2350351 - DNA, 13 bp, Homo sapiens
tagtggtctttgt

SEQ ID NO: 2350352 - DNA, 15 bp, Homo sapiens
tagtggtctttgtaa

SEQ ID NO: 2350353 - DNA, 21 bp, Homo sapiens
tagtggtctttgtaagagtgt

SEQ ID NO: 2350354 - DNA, 23 bp, Homo sapiens
tagtggtctttgtaagagtgtag

SEQ ID NO: 2350355 - DNA, 19 bp, Homo sapiens
tagtgtgacagtttccaaa

SEQ ID NO: 2350356 - DNA, 21 bp, Homo sapiens
tagtgtgacagtttccaaatt

SEQ ID NO: 2350357 - DNA, 18 bp, Homo sapiens
tagttaaagaaaggaaaa

SEQ ID NO: 2350358 - DNA, 21 bp, Homo sapiens
tagttaaagaaaggaaaagaa

SEQ ID NO: 2350359 - DNA, 14 bp, Homo sapiens
tagttactaaaatt

SEQ ID NO: 2350360 - DNA, 23 bp, Homo sapiens
tagttgcaaagagacatttcaaa

SEQ ID NO: 2350361 - DNA, 19 bp, Homo sapiens
tagttgcatagcagtatat

SEQ ID NO: 2350362 - DNA, 13 bp, Homo sapiens
tagttgtaaagat

SEQ ID NO: 2350363 - DNA, 14 bp, Homo sapiens
tagttttactttta

SEQ ID NO: 2350364 - DNA, 20 bp, Homo sapiens
tagttttacttttaaactgt

SEQ ID NO: 2350365 - DNA, 12 bp, Homo sapiens
tataaaagccca

SEQ ID NO: 2350366 - DNA, 21 bp, Homo sapiens
tataaacagaaatggaaagca

SEQ ID NO: 2350367 - DNA, 15 bp, Homo sapiens
tataaatttttacct

SEQ ID NO: 2350368 - DNA, 20 bp, Homo sapiens
tataacaattcagtaacaaa

SEQ ID NO: 2350369 - DNA, 19 bp, Homo sapiens
tataagcaaattgcttttt

SEQ ID NO: 2350370 - DNA, 16 bp, Homo sapiens
tataagtagtaaatca

SEQ ID NO: 2350371 - DNA, 14 bp, Homo sapiens
tataataaaaatat

SEQ ID NO: 2350372 - DNA, 18 bp, Homo sapiens
tataataaaaatatattt

SEQ ID NO: 2350373 - DNA, 16 bp, Homo sapiens
tataatattgaaaatt

SEQ ID NO: 2350374 - DNA, 19 bp, Homo sapiens
tataatattgaaaattgaa

SEQ ID NO: 2350375 - DNA, 13 bp, Homo sapiens
tataatgaataaa

SEQ ID NO: 2350376 - DNA, 20 bp, Homo sapiens
tataatgttgataatatata

SEQ ID NO: 2350377 - DNA, 19 bp, Homo sapiens
tataatttatttccactaa

SEQ ID NO: 2350378 - DNA, 18 bp, Homo sapiens
tatacagtgcagagcctt

SEQ ID NO: 2350379 - DNA, 19 bp, Homo sapiens
tatacattttataatgatg

SEQ ID NO: 2350380 - DNA, 22 bp, Homo sapiens
tatacattttctaaataaaaat

SEQ ID NO: 2350381 - DNA, 19 bp, Homo sapiens
tatactccttaaaaatgta

SEQ ID NO: 2350382 - DNA, 12 bp, Homo sapiens
tatactgcatac

SEQ ID NO: 2350383 - DNA, 12 bp, Homo sapiens
tatacttaagaa

SEQ ID NO: 2350384 - DNA, 12 bp, Homo sapiens
tatactttagta

SEQ ID NO: 2350385 - DNA, 17 bp, Homo sapiens
tatagaagtctggaaaa

SEQ ID NO: 2350386 - DNA, 14 bp, Homo sapiens
tatagattttatta

SEQ ID NO: 2350387 - DNA, 16 bp, Homo sapiens
tatagcaacaacaatt

SEQ ID NO: 2350388 - DNA, 14 bp, Homo sapiens
tatagcatcttctc

SEQ ID NO: 2350389 - DNA, 16 bp, Homo sapiens
tatagcatgaaataaa

SEQ ID NO: 2350390 - DNA, 14 bp, Homo sapiens
tataggcagcttct

SEQ ID NO: 2350391 - DNA, 21 bp, Homo sapiens
tataggctattttctaaagac

SEQ ID NO: 2350392 - DNA, 22 bp, Homo sapiens
tatagtcaatggcttgttcatc

SEQ ID NO: 2350393 - DNA, 14 bp, Homo sapiens
tatataaacaataa

SEQ ID NO: 2350394 - DNA, 14 bp, Homo sapiens
tatataattttatg

SEQ ID NO: 2350395 - DNA, 15 bp, Homo sapiens
tatatacattgctta

SEQ ID NO: 2350396 - DNA, 14 bp, Homo sapiens
tatataggctattt

SEQ ID NO: 2350397 - DNA, 23 bp, Homo sapiens
tatataggctattttctaaagac

SEQ ID NO: 2350398 - DNA, 13 bp, Homo sapiens
tatatataaaacg

SEQ ID NO: 2350399 - DNA, 15 bp, Homo sapiens
tatatgaccagaagc

SEQ ID NO: 2350400 - DNA, 19 bp, Homo sapiens
tatatgaccagaagccttg

SEQ ID NO: 2350401 - DNA, 18 bp, Homo sapiens
tatatgagactttatgtg

SEQ ID NO: 2350402 - DNA, 15 bp, Homo sapiens
tatatggaagaaagt

SEQ ID NO: 2350403 - DNA, 18 bp, Homo sapiens
tatatggttctccaagaa

SEQ ID NO: 2350404 - DNA, 22 bp, Homo sapiens
tatatggttctccaagaaactg

SEQ ID NO: 2350405 - DNA, 18 bp, Homo sapiens
tatattaaaaaagagaca

SEQ ID NO: 2350406 - DNA, 13 bp, Homo sapiens
tatattaaaattc

SEQ ID NO: 2350407 - DNA, 21 bp, Homo sapiens
tatattaaaattccaaattca

SEQ ID NO: 2350408 - DNA, 20 bp, Homo sapiens
tatattaagtgtgccaaatc

SEQ ID NO: 2350409 - DNA, 12 bp, Homo sapiens
tatattacaatg

SEQ ID NO: 2350410 - DNA, 16 bp, Homo sapiens
tatattagtatgtatg

SEQ ID NO: 2350411 - DNA, 12 bp, Homo sapiens
tatattgaactt

SEQ ID NO: 2350412 - DNA, 21 bp, Homo sapiens
tatattgaacttttgtactga

SEQ ID NO: 2350413 - DNA, 16 bp, Homo sapiens
tatatttcctttatgt

SEQ ID NO: 2350414 - DNA, 14 bp, Homo sapiens
tatcaaaatagtct

SEQ ID NO: 2350415 - DNA, 17 bp, Homo sapiens
tatcaaataaaatatca

SEQ ID NO: 2350416 - DNA, 18 bp, Homo sapiens
tatcaaataaaatatcat

SEQ ID NO: 2350417 - DNA, 21 bp, Homo sapiens
tatcaggtgtataaatgtaca

SEQ ID NO: 2350418 - DNA, 21 bp, Homo sapiens
tatcagtatcacgatttgcag

SEQ ID NO: 2350419 - DNA, 16 bp, Homo sapiens
tatcagttacccactc

SEQ ID NO: 2350420 - DNA, 13 bp, Homo sapiens
tatcattaaaaat

SEQ ID NO: 2350421 - DNA, 12 bp, Homo sapiens
tatccaaggaaa

SEQ ID NO: 2350422 - DNA, 15 bp, Homo sapiens
tatccaggcaccagg

SEQ ID NO: 2350423 - DNA, 21 bp, Homo sapiens
tatccccatctccctgcctgg

SEQ ID NO: 2350424 - DNA, 15 bp, Homo sapiens
tatcctccaccgtct

SEQ ID NO: 2350425 - DNA, 20 bp, Homo sapiens
tatcctctccccctcctcca

SEQ ID NO: 2350426 - DNA, 22 bp, Homo sapiens
tatcctgattataggattttaa

SEQ ID NO: 2350427 - DNA, 17 bp, Homo sapiens
tatccttggagagcagc

SEQ ID NO: 2350428 - DNA, 20 bp, Homo sapiens
tatccttggagagcagctgg

SEQ ID NO: 2350429 - DNA, 20 bp, Homo sapiens
tatcgaaataacaatgttaa

SEQ ID NO: 2350430 - DNA, 18 bp, Homo sapiens
tatcgccctcctttccct

SEQ ID NO: 2350431 - DNA, 18 bp, Homo sapiens
tatcgtttttgtattttc

SEQ ID NO: 2350432 - DNA, 20 bp, Homo sapiens
tatcgtttttgtattttcat

SEQ ID NO: 2350433 - DNA, 15 bp, Homo sapiens
tatctaactttgtaa

SEQ ID NO: 2350434 - DNA, 15 bp, Homo sapiens
tatctaatacctctg

SEQ ID NO: 2350435 - DNA, 20 bp, Homo sapiens
tatctaatacctctgtgtgc

SEQ ID NO: 2350436 - DNA, 21 bp, Homo sapiens
tatctatttgaataaattatg

SEQ ID NO: 2350437 - DNA, 16 bp, Homo sapiens
tatctcaatgaaccat

SEQ ID NO: 2350438 - DNA, 19 bp, Homo sapiens
tatctccctggagaagcac

SEQ ID NO: 2350439 - DNA, 11 bp, Homo sapiens
tatctcctgac

SEQ ID NO: 2350440 - DNA, 14 bp, Homo sapiens
tatctcctgacaga

SEQ ID NO: 2350441 - DNA, 18 bp, Homo sapiens
tatctgggctgtgggcaa

SEQ ID NO: 2350442 - DNA, 16 bp, Homo sapiens
tatctgtgaaggactt

SEQ ID NO: 2350443 - DNA, 14 bp, Homo sapiens
tatcttacaatatt

SEQ ID NO: 2350444 - DNA, 23 bp, Homo sapiens
tatcttcagcccaggcttttgct

SEQ ID NO: 2350445 - DNA, 19 bp, Homo sapiens
tatcttgggtgtattctct

SEQ ID NO: 2350446 - DNA, 20 bp, Homo sapiens
tatcttgggtgtattctctg

SEQ ID NO: 2350447 - DNA, 17 bp, Homo sapiens
tatcttgttcaggaaaa

SEQ ID NO: 2350448 - DNA, 15 bp, Homo sapiens
tatctttcaaaatgt

SEQ ID NO: 2350449 - DNA, 17 bp, Homo sapiens
tatctttcaaaatgtat

SEQ ID NO: 2350450 - DNA, 16 bp, Homo sapiens
tatgaaagtagattca

SEQ ID NO: 2350451 - DNA, 21 bp, Homo sapiens
tatgaaagtagattcatgaaa

SEQ ID NO: 2350452 - DNA, 22 bp, Homo sapiens
tatgaaagtagattcatgaaaa

SEQ ID NO: 2350453 - DNA, 16 bp, Homo sapiens
tatgaacagctgtgtc

SEQ ID NO: 2350454 - DNA, 17 bp, Homo sapiens
tatgaacagctgtgtct

SEQ ID NO: 2350455 - DNA, 14 bp, Homo sapiens
tatgaacatattgt

SEQ ID NO: 2350456 - DNA, 17 bp, Homo sapiens
tatgaagaactgaggag

SEQ ID NO: 2350457 - DNA, 13 bp, Homo sapiens
tatgaattgtaca

SEQ ID NO: 2350458 - DNA, 14 bp, Homo sapiens
tatgaattgtacag

SEQ ID NO: 2350459 - DNA, 17 bp, Homo sapiens
tatgaccagaagccttg

SEQ ID NO: 2350460 - DNA, 18 bp, Homo sapiens
tatgaccagaagccttgg

SEQ ID NO: 2350461 - DNA, 16 bp, Homo sapiens
tatgactaaagagaga

SEQ ID NO: 2350462 - DNA, 17 bp, Homo sapiens
tatgactaaagagagaa

SEQ ID NO: 2350463 - DNA, 18 bp, Homo sapiens
tatgactaaagagagaat

SEQ ID NO: 2350464 - DNA, 19 bp, Homo sapiens
tatgactaaagagagaatg

SEQ ID NO: 2350465 - DNA, 23 bp, Homo sapiens
tatgagacagggtcttgctctgt

SEQ ID NO: 2350466 - DNA, 15 bp, Homo sapiens
tatgagactttatgt

SEQ ID NO: 2350467 - DNA, 14 bp, Homo sapiens
tatgagattggttt

SEQ ID NO: 2350468 - DNA, 16 bp, Homo sapiens
tatgagccagacaaat

SEQ ID NO: 2350469 - DNA, 20 bp, Homo sapiens
tatgagcctgccctcactcc

SEQ ID NO: 2350470 - DNA, 22 bp, Homo sapiens
tatgagcctgccctcactccct

SEQ ID NO: 2350471 - DNA, 16 bp, Homo sapiens
tatgatgctaagctga

SEQ ID NO: 2350472 - DNA, 14 bp, Homo sapiens
tatgatttaataaa

SEQ ID NO: 2350473 - DNA, 17 bp, Homo sapiens
tatgatttaataaaata

SEQ ID NO: 2350474 - DNA, 18 bp, Homo sapiens
tatgatttaataaaataa

SEQ ID NO: 2350475 - DNA, 17 bp, Homo sapiens
tatgatttttttttcat

SEQ ID NO: 2350476 - DNA, 16 bp, Homo sapiens
tatgcaaaaaattctt

SEQ ID NO: 2350477 - DNA, 14 bp, Homo sapiens
tatgcaccttgtgt

SEQ ID NO: 2350478 - DNA, 19 bp, Homo sapiens
tatgcaccttgtgtctgta

SEQ ID NO: 2350479 - DNA, 23 bp, Homo sapiens
tatgcacttttagaaatgcatat

SEQ ID NO: 2350480 - DNA, 21 bp, Homo sapiens
tatgcagaaatagacaaaaag

SEQ ID NO: 2350481 - DNA, 19 bp, Homo sapiens
tatgcagtgatatggcaga

SEQ ID NO: 2350482 - DNA, 22 bp, Homo sapiens
tatgcattcacatttagaaaag

SEQ ID NO: 2350483 - DNA, 19 bp, Homo sapiens
tatgcttaataaaagaaca

SEQ ID NO: 2350484 - DNA, 21 bp, Homo sapiens
tatgcttactgatatatttta

SEQ ID NO: 2350485 - DNA, 12 bp, Homo sapiens
tatggactctgc

SEQ ID NO: 2350486 - DNA, 14 bp, Homo sapiens
tatggatttaagag

SEQ ID NO: 2350487 - DNA, 21 bp, Homo sapiens
tatggatttaagagtatttta

SEQ ID NO: 2350488 - DNA, 14 bp, Homo sapiens
tatggcagaagaca

SEQ ID NO: 2350489 - DNA, 14 bp, Homo sapiens
tatggcttatttct

SEQ ID NO: 2350490 - DNA, 15 bp, Homo sapiens
tatgggggcatctct

SEQ ID NO: 2350491 - DNA, 14 bp, Homo sapiens
tatgggtctaggac

SEQ ID NO: 2350492 - DNA, 23 bp, Homo sapiens
tatggtgtgttgtatctttgtaa

SEQ ID NO: 2350493 - DNA, 20 bp, Homo sapiens
tatggttacttcttctctta

SEQ ID NO: 2350494 - DNA, 22 bp, Homo sapiens
tatggttacttcttctcttaga

SEQ ID NO: 2350495 - DNA, 15 bp, Homo sapiens
tatgtaacaacaatt

SEQ ID NO: 2350496 - DNA, 18 bp, Homo sapiens
tatgtaagcatttgtaca

SEQ ID NO: 2350497 - DNA, 19 bp, Homo sapiens
tatgtaatttcaaaataca

SEQ ID NO: 2350498 - DNA, 19 bp, Homo sapiens
tatgtagagcttagatttc

SEQ ID NO: 2350499 - DNA, 14 bp, Homo sapiens
tatgtattcttttc

SEQ ID NO: 2350500 - DNA, 15 bp, Homo sapiens
tatgtcagtactatt

SEQ ID NO: 2350501 - DNA, 19 bp, Homo sapiens
tatgtctcttctgagctat

SEQ ID NO: 2350502 - DNA, 14 bp, Homo sapiens
tatgtcttggacac

SEQ ID NO: 2350503 - DNA, 19 bp, Homo sapiens
tatgtcttggacactgtac

SEQ ID NO: 2350504 - DNA, 22 bp, Homo sapiens
tatgtcttgtatttaaaaacat

SEQ ID NO: 2350505 - DNA, 14 bp, Homo sapiens
tatgtgcatttaat

SEQ ID NO: 2350506 - DNA, 19 bp, Homo sapiens
tatgtgggatattgaatgt

SEQ ID NO: 2350507 - DNA, 23 bp, Homo sapiens
tatgtgggcagattttcagcaaa

SEQ ID NO: 2350508 - DNA, 18 bp, Homo sapiens
tatgttgtttataataaa

SEQ ID NO: 2350509 - DNA, 19 bp, Homo sapiens
tatgtttaaaatggcattt

SEQ ID NO: 2350510 - DNA, 17 bp, Homo sapiens
tatgtttttatttatga

SEQ ID NO: 2350511 - DNA, 20 bp, Homo sapiens
tatgtttttatttatgaata

SEQ ID NO: 2350512 - DNA, 15 bp, Homo sapiens
tattaaaaaagtcta

SEQ ID NO: 2350513 - DNA, 14 bp, Homo sapiens
tattaaaactaaat

SEQ ID NO: 2350514 - DNA, 17 bp, Homo sapiens
tattaaaatatttcagg

SEQ ID NO: 2350515 - DNA, 23 bp, Homo sapiens
tattaaaggaagcactctgtata

SEQ ID NO: 2350516 - DNA, 14 bp, Homo sapiens
tattaactactgaa

SEQ ID NO: 2350517 - DNA, 17 bp, Homo sapiens
tattaagattggaaatg

SEQ ID NO: 2350518 - DNA, 16 bp, Homo sapiens
tattaataatgaagta

SEQ ID NO: 2350519 - DNA, 16 bp, Homo sapiens
tattaatatttgcaca

SEQ ID NO: 2350520 - DNA, 17 bp, Homo sapiens
tattaatatttgcacat

SEQ ID NO: 2350521 - DNA, 22 bp, Homo sapiens
tattaatgtctcactttacttt

SEQ ID NO: 2350522 - DNA, 22 bp, Homo sapiens
tattacaccaccggccccctcc

SEQ ID NO: 2350523 - DNA, 16 bp, Homo sapiens
tattactgacatttct

SEQ ID NO: 2350524 - DNA, 17 bp, Homo sapiens
tattactgacatttctt

SEQ ID NO: 2350525 - DNA, 18 bp, Homo sapiens
tattactgacatttcttc

SEQ ID NO: 2350526 - DNA, 21 bp, Homo sapiens
tattactttatgaacaatttt

SEQ ID NO: 2350527 - DNA, 16 bp, Homo sapiens
tattagagtatttccc

SEQ ID NO: 2350528 - DNA, 13 bp, Homo sapiens
tattagccaggat

SEQ ID NO: 2350529 - DNA, 19 bp, Homo sapiens
tattagccaggatcatggt

SEQ ID NO: 2350530 - DNA, 18 bp, Homo sapiens
tattataaaggataaaga

SEQ ID NO: 2350531 - DNA, 14 bp, Homo sapiens
tattatacatgtga

SEQ ID NO: 2350532 - DNA, 14 bp, Homo sapiens
tattatagaaaatt

SEQ ID NO: 2350533 - DNA, 15 bp, Homo sapiens
tattatataaactgt

SEQ ID NO: 2350534 - DNA, 22 bp, Homo sapiens
tattatcacattaatctcaaag

SEQ ID NO: 2350535 - DNA, 15 bp, Homo sapiens
tattatcccagctgc

SEQ ID NO: 2350536 - DNA, 18 bp, Homo sapiens
tattatcttgttcaggaa

SEQ ID NO: 2350537 - DNA, 21 bp, Homo sapiens
tattatcttgttcaggaaaag

SEQ ID NO: 2350538 - DNA, 17 bp, Homo sapiens
tattattagataatatt

SEQ ID NO: 2350539 - DNA, 13 bp, Homo sapiens
tattatttcttct

SEQ ID NO: 2350540 - DNA, 14 bp, Homo sapiens
tattatttcttctc

SEQ ID NO: 2350541 - DNA, 16 bp, Homo sapiens
tattatttcttctctt

SEQ ID NO: 2350542 - DNA, 17 bp, Homo sapiens
tattatttcttctctta

SEQ ID NO: 2350543 - DNA, 17 bp, Homo sapiens
tattcaagaatgaaaaa

SEQ ID NO: 2350544 - DNA, 15 bp, Homo sapiens
tattcagggtaaata

SEQ ID NO: 2350545 - DNA, 17 bp, Homo sapiens
tattcatggatggctca

SEQ ID NO: 2350546 - DNA, 12 bp, Homo sapiens
tattcatggcta

SEQ ID NO: 2350547 - DNA, 21 bp, Homo sapiens
tattccatgagctgctcatta

SEQ ID NO: 2350548 - DNA, 18 bp, Homo sapiens
tattcctcctgctcatat

SEQ ID NO: 2350549 - DNA, 16 bp, Homo sapiens
tattcctttaaaatat

SEQ ID NO: 2350550 - DNA, 19 bp, Homo sapiens
tattctataaaactctgca

SEQ ID NO: 2350551 - DNA, 15 bp, Homo sapiens
tattctcctccctgt

SEQ ID NO: 2350552 - DNA, 16 bp, Homo sapiens
tattctcctccctgtt

SEQ ID NO: 2350553 - DNA, 11 bp, Homo sapiens
tattcttcttt

SEQ ID NO: 2350554 - DNA, 20 bp, Homo sapiens
tattcttggaccatgccaga

SEQ ID NO: 2350555 - DNA, 15 bp, Homo sapiens
tattcttttgtttcc

SEQ ID NO: 2350556 - DNA, 14 bp, Homo sapiens
tattgaaaattgaa

SEQ ID NO: 2350557 - DNA, 23 bp, Homo sapiens
tattgaaagagtctgggaccctt

SEQ ID NO: 2350558 - DNA, 19 bp, Homo sapiens
tattgaacttttgtactga

SEQ ID NO: 2350559 - DNA, 17 bp, Homo sapiens
tattgacaataagaaac

SEQ ID NO: 2350560 - DNA, 16 bp, Homo sapiens
tattgacactgaactt

SEQ ID NO: 2350561 - DNA, 19 bp, Homo sapiens
tattgacactgaacttaat

SEQ ID NO: 2350562 - DNA, 15 bp, Homo sapiens
tattgacaggtcttt

SEQ ID NO: 2350563 - DNA, 21 bp, Homo sapiens
tattgacaggtcttttcaaat

SEQ ID NO: 2350564 - DNA, 19 bp, Homo sapiens
tattgattgggaaaacatt

SEQ ID NO: 2350565 - DNA, 20 bp, Homo sapiens
tattgattgggaaaacattt

SEQ ID NO: 2350566 - DNA, 20 bp, Homo sapiens
tattgcactagagaaaataa

SEQ ID NO: 2350567 - DNA, 19 bp, Homo sapiens
tattggggaccaaatcaaa

SEQ ID NO: 2350568 - DNA, 22 bp, Homo sapiens
tattggggaccaaatcaaatga

SEQ ID NO: 2350569 - DNA, 13 bp, Homo sapiens
tattggttcttcc

SEQ ID NO: 2350570 - DNA, 17 bp, Homo sapiens
tattgtgaagtacatat

SEQ ID NO: 2350571 - DNA, 15 bp, Homo sapiens
tattgtttctgcatt

SEQ ID NO: 2350572 - DNA, 15 bp, Homo sapiens
tatttaaaaacattt

SEQ ID NO: 2350573 - DNA, 16 bp, Homo sapiens
tatttaacaaaatttg

SEQ ID NO: 2350574 - DNA, 11 bp, Homo sapiens
tatttaacaag

SEQ ID NO: 2350575 - DNA, 16 bp, Homo sapiens
tatttaacaagatgtt

SEQ ID NO: 2350576 - DNA, 17 bp, Homo sapiens
tatttaacaagatgttt

SEQ ID NO: 2350577 - DNA, 19 bp, Homo sapiens
tatttaagtggactgtatt

SEQ ID NO: 2350578 - DNA, 10 bp, Homo sapiens
tatttaataa

SEQ ID NO: 2350579 - DNA, 11 bp, Homo sapiens
tatttaataac

SEQ ID NO: 2350580 - DNA, 12 bp, Homo sapiens
tatttacttgtt

SEQ ID NO: 2350581 - DNA, 19 bp, Homo sapiens
tatttagacaagagatggg

SEQ ID NO: 2350582 - DNA, 17 bp, Homo sapiens
tatttaggcagattgaa

SEQ ID NO: 2350583 - DNA, 18 bp, Homo sapiens
tatttataatacagaatc

SEQ ID NO: 2350584 - DNA, 15 bp, Homo sapiens
tatttatttattttg

SEQ ID NO: 2350585 - DNA, 15 bp, Homo sapiens
tatttccactaaaaa

SEQ ID NO: 2350586 - DNA, 17 bp, Homo sapiens
tatttccactaaaaata

SEQ ID NO: 2350587 - DNA, 15 bp, Homo sapiens
tatttcccttccaaa

SEQ ID NO: 2350588 - DNA, 22 bp, Homo sapiens
tatttccttggattttcctgaa

SEQ ID NO: 2350589 - DNA, 14 bp, Homo sapiens
tatttcggctatgt

SEQ ID NO: 2350590 - DNA, 20 bp, Homo sapiens
tatttcggctatgtctcatg

SEQ ID NO: 2350591 - DNA, 20 bp, Homo sapiens
tatttgaagatttaattact

SEQ ID NO: 2350592 - DNA, 14 bp, Homo sapiens
tatttgatttctaa

SEQ ID NO: 2350593 - DNA, 16 bp, Homo sapiens
tatttgccatgggctt

SEQ ID NO: 2350594 - DNA, 18 bp, Homo sapiens
tatttgctgacaaccatt

SEQ ID NO: 2350595 - DNA, 20 bp, Homo sapiens
tattttcatgaaaataccat

SEQ ID NO: 2350596 - DNA, 16 bp, Homo sapiens
tattttcctaaagaga

SEQ ID NO: 2350597 - DNA, 15 bp, Homo sapiens
tattttctacagtgg

SEQ ID NO: 2350598 - DNA, 20 bp, Homo sapiens
tattttctacgtttctttaa

SEQ ID NO: 2350599 - DNA, 12 bp, Homo sapiens
tattttctactt

SEQ ID NO: 2350600 - DNA, 21 bp, Homo sapiens
tattttctgtgcctgaatatt

SEQ ID NO: 2350601 - DNA, 21 bp, Homo sapiens
tattttgtagcgtacatcaat

SEQ ID NO: 2350602 - DNA, 15 bp, Homo sapiens
tattttgtgtgaaat

SEQ ID NO: 2350603 - DNA, 17 bp, Homo sapiens
tatttttatacaaacct

SEQ ID NO: 2350604 - DNA, 20 bp, Homo sapiens
tatttttatatcatgcaaaa

SEQ ID NO: 2350605 - DNA, 16 bp, Homo sapiens
tatttttatatttcct

SEQ ID NO: 2350606 - DNA, 17 bp, Homo sapiens
tatttttatatttcctt

SEQ ID NO: 2350607 - DNA, 21 bp, Homo sapiens
tatttttatatttcctttatg

SEQ ID NO: 2350608 - DNA, 16 bp, Homo sapiens
tatttttcaaggcatt

SEQ ID NO: 2350609 - DNA, 19 bp, Homo sapiens
tatttttggcagtctgaat

SEQ ID NO: 2350610 - DNA, 12 bp, Homo sapiens
tatttttgtaaa

SEQ ID NO: 2350611 - DNA, 16 bp, Homo sapiens
tattttttattaatat

SEQ ID NO: 2350612 - DNA, 22 bp, Homo sapiens
tattttttcagactgtgcaata

SEQ ID NO: 2350613 - DNA, 13 bp, Homo sapiens
tattttttgaaaa

SEQ ID NO: 2350614 - DNA, 15 bp, Homo sapiens
tatttttttaaaatt

SEQ ID NO: 2350615 - DNA, 20 bp, Homo sapiens
tcaaaaggtattatacatgt

SEQ ID NO: 2350616 - DNA, 21 bp, Homo sapiens
tcaaaaggtattatacatgtg

SEQ ID NO: 2350617 - DNA, 17 bp, Homo sapiens
tcaaaataaagaagtat

SEQ ID NO: 2350618 - DNA, 14 bp, Homo sapiens
tcaaaatgtctgta

SEQ ID NO: 2350619 - DNA, 16 bp, Homo sapiens
tcaaacttgtggcctc

SEQ ID NO: 2350620 - DNA, 15 bp, Homo sapiens
tcaaagactcaaatt

SEQ ID NO: 2350621 - DNA, 20 bp, Homo sapiens
tcaaagcagaagtctggctt

SEQ ID NO: 2350622 - DNA, 16 bp, Homo sapiens
tcaaaggagctttctc

SEQ ID NO: 2350623 - DNA, 17 bp, Homo sapiens
tcaaaggagctttctca

SEQ ID NO: 2350624 - DNA, 14 bp, Homo sapiens
tcaaagtatgcaat

SEQ ID NO: 2350625 - DNA, 18 bp, Homo sapiens
tcaaagtatgcaatgctt

SEQ ID NO: 2350626 - DNA, 18 bp, Homo sapiens
tcaaagtcattaaagaca

SEQ ID NO: 2350627 - DNA, 22 bp, Homo sapiens
tcaaagttttgaaaagctatta

SEQ ID NO: 2350628 - DNA, 17 bp, Homo sapiens
tcaaataaaatatcata

SEQ ID NO: 2350629 - DNA, 19 bp, Homo sapiens
tcaaataaaatatcataaa

SEQ ID NO: 2350630 - DNA, 20 bp, Homo sapiens
tcaaataatgcttttctaat

SEQ ID NO: 2350631 - DNA, 14 bp, Homo sapiens
tcaaatacacattt

SEQ ID NO: 2350632 - DNA, 16 bp, Homo sapiens
tcaaatacacatttgc

SEQ ID NO: 2350633 - DNA, 20 bp, Homo sapiens
tcaaataggctattaaaaaa

SEQ ID NO: 2350634 - DNA, 15 bp, Homo sapiens
tcaaatgtgtctcac

SEQ ID NO: 2350635 - DNA, 15 bp, Homo sapiens
tcaaattcttctgaa

SEQ ID NO: 2350636 - DNA, 21 bp, Homo sapiens
tcaaattcttctgaactcaaa

SEQ ID NO: 2350637 - DNA, 21 bp, Homo sapiens
tcaaattttgtaccaagtaaa

SEQ ID NO: 2350638 - DNA, 22 bp, Homo sapiens
tcaacaagatttccttgtgcaa

SEQ ID NO: 2350639 - DNA, 20 bp, Homo sapiens
tcaacagaacatatgttgca

SEQ ID NO: 2350640 - DNA, 20 bp, Homo sapiens
tcaacatgctccaaatataa

SEQ ID NO: 2350641 - DNA, 20 bp, Homo sapiens
tcaaccccaccatatgaatt

SEQ ID NO: 2350642 - DNA, 21 bp, Homo sapiens
tcaacctcgcgcttgctggcc

SEQ ID NO: 2350643 - DNA, 12 bp, Homo sapiens
tcaactctgaag

SEQ ID NO: 2350644 - DNA, 23 bp, Homo sapiens
tcaactgacctgaccccattcct

SEQ ID NO: 2350645 - DNA, 18 bp, Homo sapiens
tcaactgcctactccaaa

SEQ ID NO: 2350646 - DNA, 20 bp, Homo sapiens
tcaactgcctactccaaaat

SEQ ID NO: 2350647 - DNA, 15 bp, Homo sapiens
ggtgataagggaaaa

SEQ ID NO: 2350648 - DNA, 15 bp, Homo sapiens
ggtgcacccacctgt

SEQ ID NO: 2350649 - DNA, 17 bp, Homo sapiens
ggtgcacccacctgttt

SEQ ID NO: 2350650 - DNA, 22 bp, Homo sapiens
ggtgcacccacctgttttctga

SEQ ID NO: 2350651 - DNA, 14 bp, Homo sapiens
ggtgcactgggagg

SEQ ID NO: 2350652 - DNA, 18 bp, Homo sapiens
ggtgcagttttccaggaa

SEQ ID NO: 2350653 - DNA, 19 bp, Homo sapiens
ggtgccactttacccacct

SEQ ID NO: 2350654 - DNA, 22 bp, Homo sapiens
ggtgcctgccaccttcaagttc

SEQ ID NO: 2350655 - DNA, 19 bp, Homo sapiens
ggtgccttacatcttttct

SEQ ID NO: 2350656 - DNA, 22 bp, Homo sapiens
ggtgcgcgccaccgtgcctggc

SEQ ID NO: 2350657 - DNA, 16 bp, Homo sapiens
ggtgcgtgttcagcag

SEQ ID NO: 2350658 - DNA, 20 bp, Homo sapiens
ggtgcgtgttcagcagaacc

SEQ ID NO: 2350659 - DNA, 20 bp, Homo sapiens
ggtgctgggaggagggagag

SEQ ID NO: 2350660 - DNA, 18 bp, Homo sapiens
ggtggaaataatttgaat

SEQ ID NO: 2350661 - DNA, 19 bp, Homo sapiens
ggtggaagaagggagaaga

SEQ ID NO: 2350662 - DNA, 21 bp, Homo sapiens
ggtggagaaaattggaactct

SEQ ID NO: 2350663 - DNA, 22 bp, Homo sapiens
ggtggatcacgaggtcaggaga

SEQ ID NO: 2350664 - DNA, 21 bp, Homo sapiens
ggtggcagatgtcttccctgg

SEQ ID NO: 2350665 - DNA, 14 bp, Homo sapiens
ggtgggctggactt

SEQ ID NO: 2350666 - DNA, 23 bp, Homo sapiens
ggtgggcttcctgcccttccctc

SEQ ID NO: 2350667 - DNA, 12 bp, Homo sapiens
ggtggggaaagg

SEQ ID NO: 2350668 - DNA, 13 bp, Homo sapiens
ggtgggtgctgcc

SEQ ID NO: 2350669 - DNA, 20 bp, Homo sapiens
ggtgtcctgcctgtctgccc

SEQ ID NO: 2350670 - DNA, 18 bp, Homo sapiens
ggctcgggagccatgtca

SEQ ID NO: 2350671 - DNA, 14 bp, Homo sapiens
ggctctaccttcct

SEQ ID NO: 2350672 - DNA, 19 bp, Homo sapiens
ggctctaccttcctgtccc

SEQ ID NO: 2350673 - DNA, 23 bp, Homo sapiens
ggctctaccttcctgtccctgag

SEQ ID NO: 2350674 - DNA, 23 bp, Homo sapiens
ggctctccggggccatttgcaat

SEQ ID NO: 2350675 - DNA, 14 bp, Homo sapiens
ggctctcctggccc

SEQ ID NO: 2350676 - DNA, 14 bp, Homo sapiens
ggctctgcagtcct

SEQ ID NO: 2350677 - DNA, 19 bp, Homo sapiens
ggctcttcatctgcctgcg

SEQ ID NO: 2350678 - DNA, 21 bp, Homo sapiens
ggctcttcatctgcctgcgct

SEQ ID NO: 2350679 - DNA, 15 bp, Homo sapiens
ggctgagatatgaac

SEQ ID NO: 2350680 - DNA, 12 bp, Homo sapiens
ggctgagggcct

SEQ ID NO: 2350681 - DNA, 16 bp, Homo sapiens
ggctgagggcctgctg

SEQ ID NO: 2350682 - DNA, 16 bp, Homo sapiens
ggctgaggttcctctg

SEQ ID NO: 2350683 - DNA, 21 bp, Homo sapiens
ggctgaggttcctctgcctgc

SEQ ID NO: 2350684 - DNA, 23 bp, Homo sapiens
ggctgaggttcctctgcctgccc

SEQ ID NO: 2350685 - DNA, 17 bp, Homo sapiens
ggctgccaccagccccc

SEQ ID NO: 2350686 - DNA, 23 bp, Homo sapiens
ggctgcccctaatctctgtagga

SEQ ID NO: 2350687 - DNA, 13 bp, Homo sapiens
ggctgcccctctc

SEQ ID NO: 2350688 - DNA, 19 bp, Homo sapiens
ggctgccctgtctggaaca

SEQ ID NO: 2350689 - DNA, 11 bp, Homo sapiens
ggctgctgccc

SEQ ID NO: 2350690 - DNA, 17 bp, Homo sapiens
ggctgctgcccccaccc

SEQ ID NO: 2350691 - DNA, 12 bp, Homo sapiens
ggctgctggcca

SEQ ID NO: 2350692 - DNA, 13 bp, Homo sapiens
ggctgctggccat

SEQ ID NO: 2350693 - DNA, 21 bp, Homo sapiens
ggctggacttctacctgccct

SEQ ID NO: 2350694 - DNA, 18 bp, Homo sapiens
ggctggaggaagtggggt

SEQ ID NO: 2350695 - DNA, 13 bp, Homo sapiens
ggctggctcctga

SEQ ID NO: 2350696 - DNA, 19 bp, Homo sapiens
ggctggctctaccttcctg

SEQ ID NO: 2350697 - DNA, 13 bp, Homo sapiens
ggctgggcacctg

SEQ ID NO: 2350698 - DNA, 14 bp, Homo sapiens
ggctgggcagagct

SEQ ID NO: 2350699 - DNA, 17 bp, Homo sapiens
ggctgggccatgtccaa

SEQ ID NO: 2350700 - DNA, 15 bp, Homo sapiens
ggctgggggagagcc

SEQ ID NO: 2350701 - DNA, 20 bp, Homo sapiens
ggctgggtccaccctgtcct

SEQ ID NO: 2350702 - DNA, 23 bp, Homo sapiens
ggctgtgcttgaaggccctgctg

SEQ ID NO: 2350703 - DNA, 14 bp, Homo sapiens
ggctgtgggcaagc

SEQ ID NO: 2350704 - DNA, 24 bp, Homo sapiens
ggctgtggggtggagcactggact

SEQ ID NO: 2350705 - DNA, 13 bp, Homo sapiens
ggctgtgggtgtg

SEQ ID NO: 2350706 - DNA, 16 bp, Homo sapiens
ggctgttccatgttct

SEQ ID NO: 2350707 - DNA, 21 bp, Homo sapiens
ggctgttctgtggttcctctg

SEQ ID NO: 2350708 - DNA, 13 bp, Homo sapiens
ggcttatttctat

SEQ ID NO: 2350709 - DNA, 22 bp, Homo sapiens
ggcttcactgtataaataggag

SEQ ID NO: 2350710 - DNA, 13 bp, Homo sapiens
ggcttcatctctt

SEQ ID NO: 2350711 - DNA, 18 bp, Homo sapiens
ggcttcatctctttagag

SEQ ID NO: 2350712 - DNA, 19 bp, Homo sapiens
ggcttcatctctttagaga

SEQ ID NO: 2350713 - DNA, 16 bp, Homo sapiens
ggcttcattctggaaa

SEQ ID NO: 2350714 - DNA, 13 bp, Homo sapiens
ggcttcctgccct

SEQ ID NO: 2350715 - DNA, 18 bp, Homo sapiens
ggcttcctgcccttccct

SEQ ID NO: 2350716 - DNA, 18 bp, Homo sapiens
ggcttctctccacagtgt

SEQ ID NO: 2350717 - DNA, 15 bp, Homo sapiens
ggcttgaagccaaag

SEQ ID NO: 2350718 - DNA, 15 bp, Homo sapiens
ggcttggcctgctgt

SEQ ID NO: 2350719 - DNA, 23 bp, Homo sapiens
ggcttggggaaaatggccatgca

SEQ ID NO: 2350720 - DNA, 22 bp, Homo sapiens
ggcttgtctatactccttccct

SEQ ID NO: 2350721 - DNA, 17 bp, Homo sapiens
ggcttgtttacctttct

SEQ ID NO: 2350722 - DNA, 14 bp, Homo sapiens
ggctttccaggcac

SEQ ID NO: 2350723 - DNA, 12 bp, Homo sapiens
ggctttcccagg

SEQ ID NO: 2350724 - DNA, 22 bp, Homo sapiens
ggctttgccatgggcctgctgc

SEQ ID NO: 2350725 - DNA, 17 bp, Homo sapiens
ggctttgccattgtgaa

SEQ ID NO: 2350726 - DNA, 23 bp, Homo sapiens
gggaaaagcatttttcaatatat

SEQ ID NO: 2350727 - DNA, 22 bp, Homo sapiens
gggaaaatggccatgcaggagg

SEQ ID NO: 2350728 - DNA, 23 bp, Homo sapiens
gggaaaccctctccatctcccaa

SEQ ID NO: 2350729 - DNA, 13 bp, Homo sapiens
gggaaaggggtgc

SEQ ID NO: 2350730 - DNA, 22 bp, Homo sapiens
gggaacagccactcccctccac

SEQ ID NO: 2350731 - DNA, 18 bp, Homo sapiens
gggaagagacagcccagg

SEQ ID NO: 2350732 - DNA, 12 bp, Homo sapiens
gggaagcaggga

SEQ ID NO: 2350733 - DNA, 15 bp, Homo sapiens
gggaaggccctgagg

SEQ ID NO: 2350734 - DNA, 19 bp, Homo sapiens
gggaaggccctgaggcgga

SEQ ID NO: 2350735 - DNA, 19 bp, Homo sapiens
gggacaactgctcccacct

SEQ ID NO: 2350736 - DNA, 11 bp, Homo sapiens
gggacagctgt

SEQ ID NO: 2350737 - DNA, 22 bp, Homo sapiens
gggacccttgttggggagtggg

SEQ ID NO: 2350738 - DNA, 17 bp, Homo sapiens
gggacggaccagcatct

SEQ ID NO: 2350739 - DNA, 17 bp, Homo sapiens
gggacgggatgaggagc

SEQ ID NO: 2350740 - DNA, 12 bp, Homo sapiens
gggactctccaa

SEQ ID NO: 2350741 - DNA, 13 bp, Homo sapiens
gggacttgtgtct

SEQ ID NO: 2350742 - DNA, 16 bp, Homo sapiens
gggagagacaggcagc

SEQ ID NO: 2350743 - DNA, 20 bp, Homo sapiens
gggagagacaggcagcccag

SEQ ID NO: 2350744 - DNA, 21 bp, Homo sapiens
gggagagacaggcagcccagc

SEQ ID NO: 2350745 - DNA, 14 bp, Homo sapiens
gggagagagagaga

SEQ ID NO: 2350746 - DNA, 21 bp, Homo sapiens
gggagagatccctgcagaacc

SEQ ID NO: 2350747 - DNA, 18 bp, Homo sapiens
gggagagggatttccctg

SEQ ID NO: 2350748 - DNA, 21 bp, Homo sapiens
gggagatgcttctctccttgc

SEQ ID NO: 2350749 - DNA, 11 bp, Homo sapiens
gggagccagcc

SEQ ID NO: 2350750 - DNA, 23 bp, Homo sapiens
gggagcctccccatctgtccagc

SEQ ID NO: 2350751 - DNA, 13 bp, Homo sapiens
gggagcggaggtt

SEQ ID NO: 2350752 - DNA, 18 bp, Homo sapiens
gggagctgagcagcctct

SEQ ID NO: 2350753 - DNA, 12 bp, Homo sapiens
gggagctgccaa

SEQ ID NO: 2350754 - DNA, 13 bp, Homo sapiens
gggaggagggaga

SEQ ID NO: 2350755 - DNA, 17 bp, Homo sapiens
gggaggagggagaggga

SEQ ID NO: 2350756 - DNA, 14 bp, Homo sapiens
gggaggcagggctc

SEQ ID NO: 2350757 - DNA, 19 bp, Homo sapiens
gggaggctgaggcaggaga

SEQ ID NO: 2350758 - DNA, 11 bp, Homo sapiens
gggagggaggg

SEQ ID NO: 2350759 - DNA, 11 bp, Homo sapiens
gggagggcagg

SEQ ID NO: 2350760 - DNA, 17 bp, Homo sapiens
gggagtccctacctgct

SEQ ID NO: 2350761 - DNA, 13 bp, Homo sapiens
gggatatttccta

SEQ ID NO: 2350762 - DNA, 15 bp, Homo sapiens
gggatatttttttct

SEQ ID NO: 2350763 - DNA, 19 bp, Homo sapiens
gggatccccgcctggccag

SEQ ID NO: 2350764 - DNA, 12 bp, Homo sapiens
gggatggggagg

SEQ ID NO: 2350765 - DNA, 19 bp, Homo sapiens
gggatggtaagagaaaaga

SEQ ID NO: 2350766 - DNA, 23 bp, Homo sapiens
gggattttttccctttttatgtg

SEQ ID NO: 2350767 - DNA, 18 bp, Homo sapiens
gggcacacacacccgccc

SEQ ID NO: 2350768 - DNA, 14 bp, Homo sapiens
gggcacagatgcct

SEQ ID NO: 2350769 - DNA, 14 bp, Homo sapiens
gggcacgcctgctg

SEQ ID NO: 2350770 - DNA, 22 bp, Homo sapiens
gggcactccgcgccgatgccac

SEQ ID NO: 2350771 - DNA, 21 bp, Homo sapiens
gggcaggccacctggctctca

SEQ ID NO: 2350772 - DNA, 13 bp, Homo sapiens
gggcaggctgggc

SEQ ID NO: 2350773 - DNA, 16 bp, Homo sapiens
gggcaggctgggccat

SEQ ID NO: 2350774 - DNA, 16 bp, Homo sapiens
gggcagggctgtgctt

SEQ ID NO: 2350775 - DNA, 13 bp, Homo sapiens
gggcagggtctgg

SEQ ID NO: 2350776 - DNA, 16 bp, Homo sapiens
gggcagggtctgggct

SEQ ID NO: 2350777 - DNA, 14 bp, Homo sapiens
gggcataaagtaaa

SEQ ID NO: 2350778 - DNA, 13 bp, Homo sapiens
gggcatctcttcc

SEQ ID NO: 2350779 - DNA, 17 bp, Homo sapiens
gggcatcttgctggcta

SEQ ID NO: 2350780 - DNA, 18 bp, Homo sapiens
gggcattttcctcctctg

SEQ ID NO: 2350781 - DNA, 19 bp, Homo sapiens
gggcattttcctcctctgc

SEQ ID NO: 2350782 - DNA, 21 bp, Homo sapiens
gggcattttcctcctctgcct

SEQ ID NO: 2350783 - DNA, 19 bp, Homo sapiens
gggccacatagatgctgat

SEQ ID NO: 2350784 - DNA, 17 bp, Homo sapiens
gggccaccaaagctgcc

SEQ ID NO: 2350785 - DNA, 14 bp, Homo sapiens
gggccagaggctgg

SEQ ID NO: 2350786 - DNA, 16 bp, Homo sapiens
gggccagaggctggga

SEQ ID NO: 2350787 - DNA, 11 bp, Homo sapiens
gtactctttaa

SEQ ID NO: 2350788 - DNA, 14 bp, Homo sapiens
gtactctttaacat

SEQ ID NO: 2350789 - DNA, 14 bp, Homo sapiens
gtactgaatttttt

SEQ ID NO: 2350790 - DNA, 20 bp, Homo sapiens
gtactgatttcagtaagtct

SEQ ID NO: 2350791 - DNA, 19 bp, Homo sapiens
gtactggttactttcaaaa

SEQ ID NO: 2350792 - DNA, 22 bp, Homo sapiens
gtactgttcggaaggggttcct

SEQ ID NO: 2350793 - DNA, 13 bp, Homo sapiens
gtacttcccgggc

SEQ ID NO: 2350794 - DNA, 20 bp, Homo sapiens
gtacttcccgggccagggct

SEQ ID NO: 2350795 - DNA, 18 bp, Homo sapiens
gtagaaaatgtgaccctc

SEQ ID NO: 2350796 - DNA, 15 bp, Homo sapiens
gtagaagcattcctt

SEQ ID NO: 2350797 - DNA, 21 bp, Homo sapiens
gtagaagcattccttctttga

SEQ ID NO: 2350798 - DNA, 20 bp, Homo sapiens
gtagaagtaggaggaaacag

SEQ ID NO: 2350799 - DNA, 14 bp, Homo sapiens
gtagagccagcttg

SEQ ID NO: 2350800 - DNA, 20 bp, Homo sapiens
gtagagtgtagactgtggct

SEQ ID NO: 2350801 - DNA, 17 bp, Homo sapiens
gtagagttaagaagctg

SEQ ID NO: 2350802 - DNA, 18 bp, Homo sapiens
gtagagttaagaagctgt

SEQ ID NO: 2350803 - DNA, 16 bp, Homo sapiens
gtagataatttcaggg

SEQ ID NO: 2350804 - DNA, 17 bp, Homo sapiens
gtagataatttcagggt

SEQ ID NO: 2350805 - DNA, 15 bp, Homo sapiens
gtagatccatttcca

SEQ ID NO: 2350806 - DNA, 17 bp, Homo sapiens
gtagattattcataatg

SEQ ID NO: 2350807 - DNA, 21 bp, Homo sapiens
gtagccacagctgctgttctc

SEQ ID NO: 2350808 - DNA, 23 bp, Homo sapiens
gtagctcctcaactcacctaatg

SEQ ID NO: 2350809 - DNA, 12 bp, Homo sapiens
gtagctggggct

SEQ ID NO: 2350810 - DNA, 15 bp, Homo sapiens
gtaggactccttatt

SEQ ID NO: 2350811 - DNA, 21 bp, Homo sapiens
gtaggttccgtatctccctgg

SEQ ID NO: 2350812 - DNA, 13 bp, Homo sapiens
gtagtaaaagtgg

SEQ ID NO: 2350813 - DNA, 14 bp, Homo sapiens
gtagtaaaagtggt

SEQ ID NO: 2350814 - DNA, 19 bp, Homo sapiens
gtagttaatataaatgttg

SEQ ID NO: 2350815 - DNA, 17 bp, Homo sapiens
gtagtttagttctgttg

SEQ ID NO: 2350816 - DNA, 13 bp, Homo sapiens
gtataaataggag

SEQ ID NO: 2350817 - DNA, 23 bp, Homo sapiens
gtataaatgtacatttccaaatg

SEQ ID NO: 2350818 - DNA, 12 bp, Homo sapiens
gtataagttatt

SEQ ID NO: 2350819 - DNA, 21 bp, Homo sapiens
gtataagttatttttgtacat

SEQ ID NO: 2350820 - DNA, 22 bp, Homo sapiens
gtataagttatttttgtacatg

SEQ ID NO: 2350821 - DNA, 13 bp, Homo sapiens
gtataatagagat

SEQ ID NO: 2350822 - DNA, 15 bp, Homo sapiens
gtataatgtttatta

SEQ ID NO: 2350823 - DNA, 17 bp, Homo sapiens
gtatacaactgcctggg

SEQ ID NO: 2350824 - DNA, 18 bp, Homo sapiens
gtatagaagtctggaaaa

SEQ ID NO: 2350825 - DNA, 13 bp, Homo sapiens
gtatataatttta

SEQ ID NO: 2350826 - DNA, 13 bp, Homo sapiens
gtatatattttgt

SEQ ID NO: 2350827 - DNA, 22 bp, Homo sapiens
gtatatattttgtgtgaaattg

SEQ ID NO: 2350828 - DNA, 19 bp, Homo sapiens
gtatattaaaaaagagaca

SEQ ID NO: 2350829 - DNA, 15 bp, Homo sapiens
gtatattacaatgat

SEQ ID NO: 2350830 - DNA, 22 bp, Homo sapiens
gtatattgtataggggcaactg

SEQ ID NO: 2350831 - DNA, 16 bp, Homo sapiens
gtatattttgtagtta

SEQ ID NO: 2350832 - DNA, 18 bp, Homo sapiens
gtatctccctggagaagc

SEQ ID NO: 2350833 - DNA, 23 bp, Homo sapiens
gtatcttgggtgtattctctgta

SEQ ID NO: 2350834 - DNA, 19 bp, Homo sapiens
gtatgaataatgaaaataa

SEQ ID NO: 2350835 - DNA, 18 bp, Homo sapiens
gtatgactaaagagagaa

SEQ ID NO: 2350836 - DNA, 18 bp, Homo sapiens
gtatgcattattaaattg

SEQ ID NO: 2350837 - DNA, 16 bp, Homo sapiens
gtatggaagttttcct

SEQ ID NO: 2350838 - DNA, 23 bp, Homo sapiens
gtatgggaagccatattcacacc

SEQ ID NO: 2350839 - DNA, 15 bp, Homo sapiens
gtatggttgacacta

SEQ ID NO: 2350840 - DNA, 20 bp, Homo sapiens
gtatgtgctatacacacaca

SEQ ID NO: 2350841 - DNA, 13 bp, Homo sapiens
gtattaagccaat

SEQ ID NO: 2350842 - DNA, 22 bp, Homo sapiens
gtattatacatgtgatacattt

SEQ ID NO: 2350843 - DNA, 20 bp, Homo sapiens
gtattatcttgttcaggaaa

SEQ ID NO: 2350844 - DNA, 19 bp, Homo sapiens
gtattcagaggcagtgatg

SEQ ID NO: 2350845 - DNA, 17 bp, Homo sapiens
gtattcctttaaaatat

SEQ ID NO: 2350846 - DNA, 17 bp, Homo sapiens
gtattgacaataagaaa

SEQ ID NO: 2350847 - DNA, 13 bp, Homo sapiens
gtatttacttgtt

SEQ ID NO: 2350848 - DNA, 16 bp, Homo sapiens
gtatttccagtgcaat

SEQ ID NO: 2350849 - DNA, 19 bp, Homo sapiens
gtattttcatgaaaatacc

SEQ ID NO: 2350850 - DNA, 15 bp, Homo sapiens
gtattttgtgtcctc

SEQ ID NO: 2350851 - DNA, 16 bp, Homo sapiens
gtatttttcaaggcat

SEQ ID NO: 2350852 - DNA, 19 bp, Homo sapiens
gtcaaaaaattatttgcta

SEQ ID NO: 2350853 - DNA, 14 bp, Homo sapiens
gtcaaagatgcccc

SEQ ID NO: 2350854 - DNA, 22 bp, Homo sapiens
gtcaaagctttgactctataag

SEQ ID NO: 2350855 - DNA, 15 bp, Homo sapiens
gtcaacccttctgga

SEQ ID NO: 2350856 - DNA, 17 bp, Homo sapiens
gtcaacccttctggaaa

SEQ ID NO: 2350857 - DNA, 19 bp, Homo sapiens
gtcaacccttctggaaact

SEQ ID NO: 2350858 - DNA, 13 bp, Homo sapiens
gtcaagctgctct

SEQ ID NO: 2350859 - DNA, 14 bp, Homo sapiens
gtcaagctgctctg

SEQ ID NO: 2350860 - DNA, 17 bp, Homo sapiens
gtcaagctgctctgagc

SEQ ID NO: 2350861 - DNA, 23 bp, Homo sapiens
gtcaagctgctctgagccacagt

SEQ ID NO: 2350862 - DNA, 22 bp, Homo sapiens
gtcaagggctgtcattgcacat

SEQ ID NO: 2350863 - DNA, 14 bp, Homo sapiens
gtcaagtaagaaga

SEQ ID NO: 2350864 - DNA, 19 bp, Homo sapiens
gtcacacattacaaagtta

SEQ ID NO: 2350865 - DNA, 21 bp, Homo sapiens
gtcacagtccaaccagaaaca

SEQ ID NO: 2350866 - DNA, 16 bp, Homo sapiens
gtcaccagagacttta

SEQ ID NO: 2350867 - DNA, 15 bp, Homo sapiens
gtcaccctgcagagc

SEQ ID NO: 2350868 - DNA, 17 bp, Homo sapiens
gtcacctgccccagcac

SEQ ID NO: 2350869 - DNA, 12 bp, Homo sapiens
gtcactggaaag

SEQ ID NO: 2350870 - DNA, 18 bp, Homo sapiens
gtcactggaaaggggaga

SEQ ID NO: 2350871 - DNA, 20 bp, Homo sapiens
gtcactggaaaggggagagc

SEQ ID NO: 2350872 - DNA, 23 bp, Homo sapiens
gtcactggaaaggggagagcctg

SEQ ID NO: 2350873 - DNA, 23 bp, Homo sapiens
gtcactggaggttgaagccaagt

SEQ ID NO: 2350874 - DNA, 20 bp, Homo sapiens
gtcagagccatgtcttctcc

SEQ ID NO: 2350875 - DNA, 16 bp, Homo sapiens
gtcagagtccagtgct

SEQ ID NO: 2350876 - DNA, 20 bp, Homo sapiens
gtcagagtccagtgctctgc

SEQ ID NO: 2350877 - DNA, 22 bp, Homo sapiens
gtcagccttgcatcaagggctt

SEQ ID NO: 2350878 - DNA, 14 bp, Homo sapiens
gtcagctactaatg

SEQ ID NO: 2350879 - DNA, 16 bp, Homo sapiens
gtcagctctctgccct

SEQ ID NO: 2350880 - DNA, 18 bp, Homo sapiens
gtcagctctctgccctgt

SEQ ID NO: 2350881 - DNA, 23 bp, Homo sapiens
gtcagctgaggctgggggagagc

SEQ ID NO: 2350882 - DNA, 15 bp, Homo sapiens
gtcaggacggctcct

SEQ ID NO: 2350883 - DNA, 21 bp, Homo sapiens
gtcaggacggctcctcagagc

SEQ ID NO: 2350884 - DNA, 23 bp, Homo sapiens
gtcagtgctctcagctggcagtg

SEQ ID NO: 2350885 - DNA, 19 bp, Homo sapiens
gtcatagactcctttgcta

SEQ ID NO: 2350886 - DNA, 13 bp, Homo sapiens
gtcatcaaagcag

SEQ ID NO: 2350887 - DNA, 20 bp, Homo sapiens
gtcatcagatgcctgcttga

SEQ ID NO: 2350888 - DNA, 17 bp, Homo sapiens
gtcatctgtaagagctt

SEQ ID NO: 2350889 - DNA, 13 bp, Homo sapiens
gtcatgcataaat

SEQ ID NO: 2350890 - DNA, 17 bp, Homo sapiens
gtccaaaagcgccctca

SEQ ID NO: 2350891 - DNA, 15 bp, Homo sapiens
gtccaaccagaaaca

SEQ ID NO: 2350892 - DNA, 15 bp, Homo sapiens
gtccaacctgcctgt

SEQ ID NO: 2350893 - DNA, 17 bp, Homo sapiens
gtccaaggtggcagatg

SEQ ID NO: 2350894 - DNA, 23 bp, Homo sapiens
gtccaaggtggcagatgtcttcc

SEQ ID NO: 2350895 - DNA, 12 bp, Homo sapiens
gtccaccatgaa

SEQ ID NO: 2350896 - DNA, 15 bp, Homo sapiens
gtccaccctgtccta

SEQ ID NO: 2350897 - DNA, 18 bp, Homo sapiens
gtccaccctgtcctatga

SEQ ID NO: 2350898 - DNA, 16 bp, Homo sapiens
gtccacgcgtgccgtg

SEQ ID NO: 2350899 - DNA, 19 bp, Homo sapiens
gtccagctggcctggacag

SEQ ID NO: 2350900 - DNA, 14 bp, Homo sapiens
gtccagcttccaaa

SEQ ID NO: 2350901 - DNA, 15 bp, Homo sapiens
gtccaggcagctccc

SEQ ID NO: 2350902 - DNA, 22 bp, Homo sapiens
gtccaggcagctccctcctgca

SEQ ID NO: 2350903 - DNA, 15 bp, Homo sapiens
gtgcctgagaggcag

SEQ ID NO: 2350904 - DNA, 12 bp, Homo sapiens
gtgcctgagagt

SEQ ID NO: 2350905 - DNA, 14 bp, Homo sapiens
gtgcctggccagat

SEQ ID NO: 2350906 - DNA, 15 bp, Homo sapiens
gtgcctggcctggca

SEQ ID NO: 2350907 - DNA, 18 bp, Homo sapiens
gtgccttacatcttttct

SEQ ID NO: 2350908 - DNA, 23 bp, Homo sapiens
gtgcgcgccaccgtgcctggcta

SEQ ID NO: 2350909 - DNA, 15 bp, Homo sapiens
gtgcggaccaccctc

SEQ ID NO: 2350910 - DNA, 17 bp, Homo sapiens
gtgcgtgtgtagagtta

SEQ ID NO: 2350911 - DNA, 16 bp, Homo sapiens
gtgctaaaaatgaaaa

SEQ ID NO: 2350912 - DNA, 18 bp, Homo sapiens
gtgctactggggaaactg

SEQ ID NO: 2350913 - DNA, 20 bp, Homo sapiens
gtgctatttaacattttaca

SEQ ID NO: 2350914 - DNA, 18 bp, Homo sapiens
gtgctcaccagccctgca

SEQ ID NO: 2350915 - DNA, 20 bp, Homo sapiens
gtgctcacgactcttcctgc

SEQ ID NO: 2350916 - DNA, 15 bp, Homo sapiens
gtgctcccctgccac

SEQ ID NO: 2350917 - DNA, 21 bp, Homo sapiens
gtgctcccctgccacactgat

SEQ ID NO: 2350918 - DNA, 21 bp, Homo sapiens
gtgctcggagaagagcgcagt

SEQ ID NO: 2350919 - DNA, 16 bp, Homo sapiens
gtgctgccttgcttct

SEQ ID NO: 2350920 - DNA, 13 bp, Homo sapiens
gtgctgtgaggga

SEQ ID NO: 2350921 - DNA, 15 bp, Homo sapiens
gtgctgtgagggagg

SEQ ID NO: 2350922 - DNA, 14 bp, Homo sapiens
gtgcttgaaggccc

SEQ ID NO: 2350923 - DNA, 19 bp, Homo sapiens
gtgcttgaaggccctgctg

SEQ ID NO: 2350924 - DNA, 14 bp, Homo sapiens
gtgcttgagccagg

SEQ ID NO: 2350925 - DNA, 16 bp, Homo sapiens
gtggaaataatttgaa

SEQ ID NO: 2350926 - DNA, 15 bp, Homo sapiens
gtggaagaagggaga

SEQ ID NO: 2350927 - DNA, 18 bp, Homo sapiens
gtggaagaagggagaaga

SEQ ID NO: 2350928 - DNA, 17 bp, Homo sapiens
gtggactctgcacatgt

SEQ ID NO: 2350929 - DNA, 15 bp, Homo sapiens
gtggaggaagagcca

SEQ ID NO: 2350930 - DNA, 17 bp, Homo sapiens
gtggaggaagagccacc

SEQ ID NO: 2350931 - DNA, 14 bp, Homo sapiens
gtggaggaaggatt

SEQ ID NO: 2350932 - DNA, 19 bp, Homo sapiens
gtggaggaaggattgtaaa

SEQ ID NO: 2350933 - DNA, 14 bp, Homo sapiens
gtggaggcttcctg

SEQ ID NO: 2350934 - DNA, 15 bp, Homo sapiens
gtggaggggtgtggc

SEQ ID NO: 2350935 - DNA, 19 bp, Homo sapiens
gtggagttcaccttggaag

SEQ ID NO: 2350936 - DNA, 15 bp, Homo sapiens
gtggattgttttttc

SEQ ID NO: 2350937 - DNA, 12 bp, Homo sapiens
gtggcaattagt

SEQ ID NO: 2350938 - DNA, 21 bp, Homo sapiens
gtggcagtggttttggcaaac

SEQ ID NO: 2350939 - DNA, 14 bp, Homo sapiens
gtggcatttccaaa

SEQ ID NO: 2350940 - DNA, 16 bp, Homo sapiens
gtggcatttccaaaca

SEQ ID NO: 2350941 - DNA, 11 bp, Homo sapiens
gtggccacagc

SEQ ID NO: 2350942 - DNA, 17 bp, Homo sapiens
gtggccacagcgccagc

SEQ ID NO: 2350943 - DNA, 13 bp, Homo sapiens
gtggccccctctc

SEQ ID NO: 2350944 - DNA, 18 bp, Homo sapiens
gtggcctccgcagtgtct

SEQ ID NO: 2350945 - DNA, 17 bp, Homo sapiens
gtggcctgtggctgtcg

SEQ ID NO: 2350946 - DNA, 18 bp, Homo sapiens
gtggcctgtggctgtcgg

SEQ ID NO: 2350947 - DNA, 23 bp, Homo sapiens
gtggcctgtttgaaagtaaaaac

SEQ ID NO: 2350948 - DNA, 23 bp, Homo sapiens
gtggcgggtgatggccagcccct

SEQ ID NO: 2350949 - DNA, 14 bp, Homo sapiens
gtggctactgacat

SEQ ID NO: 2350950 - DNA, 22 bp, Homo sapiens
gtggctgatttactaacagtaa

SEQ ID NO: 2350951 - DNA, 21 bp, Homo sapiens
gtggctggctctaccttcctg

SEQ ID NO: 2350952 - DNA, 16 bp, Homo sapiens
gtggctggtagaaaaa

SEQ ID NO: 2350953 - DNA, 22 bp, Homo sapiens
gtggctgtcaatgggacctgtg

SEQ ID NO: 2350954 - DNA, 16 bp, Homo sapiens
gtggctttccaggcac

SEQ ID NO: 2350955 - DNA, 23 bp, Homo sapiens
gtggctttccaggcaccctcagg

SEQ ID NO: 2350956 - DNA, 12 bp, Homo sapiens
gtgggaacattc

SEQ ID NO: 2350957 - DNA, 21 bp, Homo sapiens
gtgggagtgtgtctgctgagt

SEQ ID NO: 2350958 - DNA, 18 bp, Homo sapiens
gtgggattttttcccttt

SEQ ID NO: 2350959 - DNA, 19 bp, Homo sapiens
gtgggccagccacagagca

SEQ ID NO: 2350960 - DNA, 14 bp, Homo sapiens
gtgggcttcctgcc

SEQ ID NO: 2350961 - DNA, 21 bp, Homo sapiens
gtggggagatgcttctctcct

SEQ ID NO: 2350962 - DNA, 17 bp, Homo sapiens
gtggggcacagatgcct

SEQ ID NO: 2350963 - DNA, 14 bp, Homo sapiens
gtggggcctgatgg

SEQ ID NO: 2350964 - DNA, 14 bp, Homo sapiens
gtgggggagggagg

SEQ ID NO: 2350965 - DNA, 18 bp, Homo sapiens
gtgggggttgctgtataa

SEQ ID NO: 2350966 - DNA, 15 bp, Homo sapiens
gtggggtctggcctg

SEQ ID NO: 2350967 - DNA, 11 bp, Homo sapiens
gtgggtctctg

SEQ ID NO: 2350968 - DNA, 14 bp, Homo sapiens
gtgggtctctgaag

SEQ ID NO: 2350969 - DNA, 14 bp, Homo sapiens
gtggtcataaaata

SEQ ID NO: 2350970 - DNA, 15 bp, Homo sapiens
gtggtcggtgggacc

SEQ ID NO: 2350971 - DNA, 16 bp, Homo sapiens
gtggtcggtgggaccc

SEQ ID NO: 2350972 - DNA, 16 bp, Homo sapiens
gtggttttttccccct

SEQ ID NO: 2350973 - DNA, 15 bp, Homo sapiens
gtgtaaaatgtatat

SEQ ID NO: 2350974 - DNA, 13 bp, Homo sapiens
gtgtaataagaca

SEQ ID NO: 2350975 - DNA, 15 bp, Homo sapiens
gtgtaataagacata

SEQ ID NO: 2350976 - DNA, 16 bp, Homo sapiens
gtgtacataactgaaa

SEQ ID NO: 2350977 - DNA, 23 bp, Homo sapiens
gtgtacccatctttaatttatat

SEQ ID NO: 2350978 - DNA, 19 bp, Homo sapiens
gtgtacttcccgggccagg

SEQ ID NO: 2350979 - DNA, 18 bp, Homo sapiens
gtgtagagttaagaagct

SEQ ID NO: 2350980 - DNA, 17 bp, Homo sapiens
gtgtagctgcaaaaata

SEQ ID NO: 2350981 - DNA, 14 bp, Homo sapiens
gtgtataaatgtac

SEQ ID NO: 2350982 - DNA, 16 bp, Homo sapiens
gtgtataaatgtacat

SEQ ID NO: 2350983 - DNA, 17 bp, Homo sapiens
gtgtatataattttatg

SEQ ID NO: 2350984 - DNA, 16 bp, Homo sapiens
gtgtatgactaaagag

SEQ ID NO: 2350985 - DNA, 14 bp, Homo sapiens
gtgtattcagaggc

SEQ ID NO: 2350986 - DNA, 16 bp, Homo sapiens
gtgtattcagaggcag

SEQ ID NO: 2350987 - DNA, 17 bp, Homo sapiens
gtgtcaccctgcagagc

SEQ ID NO: 2350988 - DNA, 17 bp, Homo sapiens
gtgtcagctgaggctgg

SEQ ID NO: 2350989 - DNA, 21 bp, Homo sapiens
gtgtcatataaactcatttat

SEQ ID NO: 2350990 - DNA, 22 bp, Homo sapiens
gtgtccagcttccaaagcctag

SEQ ID NO: 2350991 - DNA, 21 bp, Homo sapiens
gtgtccataaataaagtttca

SEQ ID NO: 2350992 - DNA, 23 bp, Homo sapiens
gtgtcccctcacgcaagtgccag

SEQ ID NO: 2350993 - DNA, 21 bp, Homo sapiens
gtgtcctgaaacgctcctttg

SEQ ID NO: 2350994 - DNA, 17 bp, Homo sapiens
gtgtcctgcctgtctgc

SEQ ID NO: 2350995 - DNA, 22 bp, Homo sapiens
gtgtctccttaagctgcagaga

SEQ ID NO: 2350996 - DNA, 19 bp, Homo sapiens
gtgtctggaattgtggcta

SEQ ID NO: 2350997 - DNA, 23 bp, Homo sapiens
gtgtctggaattgtggctatcct

SEQ ID NO: 2350998 - DNA, 13 bp, Homo sapiens
gtgtgaaatatat

SEQ ID NO: 2350999 - DNA, 13 bp, Homo sapiens
gtgtgaccctggg

SEQ ID NO: 2351000 - DNA, 15 bp, Homo sapiens
gtgtgctaaaaatga

SEQ ID NO: 2351001 - DNA, 19 bp, Homo sapiens
gtgtggattgcctctgaaa

SEQ ID NO: 2351002 - DNA, 18 bp, Homo sapiens
gataaatcataaagtcag

SEQ ID NO: 2351003 - DNA, 19 bp, Homo sapiens
gataaatcataaagtcagt

SEQ ID NO: 2351004 - DNA, 15 bp, Homo sapiens
gataacagagtgatt

SEQ ID NO: 2351005 - DNA, 17 bp, Homo sapiens
gataactctctttcctt

SEQ ID NO: 2351006 - DNA, 19 bp, Homo sapiens
gataactctctttccttga

SEQ ID NO: 2351007 - DNA, 16 bp, Homo sapiens
gataagggaaaagata

SEQ ID NO: 2351008 - DNA, 19 bp, Homo sapiens
gataatatataaacaataa

SEQ ID NO: 2351009 - DNA, 15 bp, Homo sapiens
gataatattgtttgg

SEQ ID NO: 2351010 - DNA, 22 bp, Homo sapiens
gataatatttttgtatttctct

SEQ ID NO: 2351011 - DNA, 11 bp, Homo sapiens
gataatgttaa

SEQ ID NO: 2351012 - DNA, 19 bp, Homo sapiens
gataatgttaaatttgtaa

SEQ ID NO: 2351013 - DNA, 16 bp, Homo sapiens
gatacagatctcaggg

SEQ ID NO: 2351014 - DNA, 18 bp, Homo sapiens
gataccttgcaaagcaac

SEQ ID NO: 2351015 - DNA, 13 bp, Homo sapiens
gatagacatatac

SEQ ID NO: 2351016 - DNA, 13 bp, Homo sapiens
gatagacttggga

SEQ ID NO: 2351017 - DNA, 15 bp, Homo sapiens
gatagacttgggatg

SEQ ID NO: 2351018 - DNA, 14 bp, Homo sapiens
gatagtaagcatag

SEQ ID NO: 2351019 - DNA, 22 bp, Homo sapiens
gatagttgctatttttgtaaag

SEQ ID NO: 2351020 - DNA, 19 bp, Homo sapiens
gatatagttttacttttaa

SEQ ID NO: 2351021 - DNA, 21 bp, Homo sapiens
gatatcaggaaatatctgtga

SEQ ID NO: 2351022 - DNA, 15 bp, Homo sapiens
gatattatagaaaat

SEQ ID NO: 2351023 - DNA, 15 bp, Homo sapiens
gatattatttcttct

SEQ ID NO: 2351024 - DNA, 18 bp, Homo sapiens
gatattatttcttctctt

SEQ ID NO: 2351025 - DNA, 15 bp, Homo sapiens
gatattcagatgtat

SEQ ID NO: 2351026 - DNA, 13 bp, Homo sapiens
gatattgaatgtt

SEQ ID NO: 2351027 - DNA, 19 bp, Homo sapiens
gatattgtatctcctttaa

SEQ ID NO: 2351028 - DNA, 17 bp, Homo sapiens
gatattgtgaagtacat

SEQ ID NO: 2351029 - DNA, 12 bp, Homo sapiens
gatatttcctaa

SEQ ID NO: 2351030 - DNA, 21 bp, Homo sapiens
gatattttctgtgcctgaata

SEQ ID NO: 2351031 - DNA, 21 bp, Homo sapiens
gatcactgtagtttagttctg

SEQ ID NO: 2351032 - DNA, 20 bp, Homo sapiens
gatcagcattttagaaacta

SEQ ID NO: 2351033 - DNA, 19 bp, Homo sapiens
gatcattacatggctgtgg

SEQ ID NO: 2351034 - DNA, 19 bp, Homo sapiens
gatccaactaatgccttac

SEQ ID NO: 2351035 - DNA, 17 bp, Homo sapiens
gatccacccaaccctat

SEQ ID NO: 2351036 - DNA, 23 bp, Homo sapiens
gatccatttccattgcttattat

SEQ ID NO: 2351037 - DNA, 14 bp, Homo sapiens
gatcccatggccag

SEQ ID NO: 2351038 - DNA, 13 bp, Homo sapiens
gatccccgcctgg

SEQ ID NO: 2351039 - DNA, 18 bp, Homo sapiens
gatccccgcctggccagg

SEQ ID NO: 2351040 - DNA, 20 bp, Homo sapiens
gatccccgcctggccaggag

SEQ ID NO: 2351041 - DNA, 21 bp, Homo sapiens
gatccccgcctggccaggagc

SEQ ID NO: 2351042 - DNA, 19 bp, Homo sapiens
gatcctgggggcctgggtt

SEQ ID NO: 2351043 - DNA, 21 bp, Homo sapiens
gatccttgtgttcagctcttt

SEQ ID NO: 2351044 - DNA, 18 bp, Homo sapiens
gatcgagaccatcctggc

SEQ ID NO: 2351045 - DNA, 16 bp, Homo sapiens
gatctaaaaaaatgtt

SEQ ID NO: 2351046 - DNA, 21 bp, Homo sapiens
gatctagttctcaatcactgc

SEQ ID NO: 2351047 - DNA, 14 bp, Homo sapiens
gatctcagctttga

SEQ ID NO: 2351048 - DNA, 11 bp, Homo sapiens
gatctccagcg

SEQ ID NO: 2351049 - DNA, 14 bp, Homo sapiens
gatctctgaagcca

SEQ ID NO: 2351050 - DNA, 19 bp, Homo sapiens
gatctctgaagccacaaat

SEQ ID NO: 2351051 - DNA, 13 bp, Homo sapiens
gatctgagggaga

SEQ ID NO: 2351052 - DNA, 17 bp, Homo sapiens
gatctgagtcagagcca

SEQ ID NO: 2351053 - DNA, 17 bp, Homo sapiens
gatctgatctgtaccat

SEQ ID NO: 2351054 - DNA, 22 bp, Homo sapiens
gatctgcaagaacactggacct

SEQ ID NO: 2351055 - DNA, 18 bp, Homo sapiens
gatctgcggatctcagct

SEQ ID NO: 2351056 - DNA, 21 bp, Homo sapiens
gatctgcggatctcagctttg

SEQ ID NO: 2351057 - DNA, 21 bp, Homo sapiens
gatctgctgaggcccagtgca

SEQ ID NO: 2351058 - DNA, 18 bp, Homo sapiens
gatctgctgggctctgcc

SEQ ID NO: 2351059 - DNA, 19 bp, Homo sapiens
gatctgctgggctctgcct

SEQ ID NO: 2351060 - DNA, 20 bp, Homo sapiens
gatctgggcattttcctcct

SEQ ID NO: 2351061 - DNA, 14 bp, Homo sapiens
gatctgtaccatga

SEQ ID NO: 2351062 - DNA, 12 bp, Homo sapiens
gatctgttgtaa

SEQ ID NO: 2351063 - DNA, 22 bp, Homo sapiens
gatctgttttgtggtttggaat

SEQ ID NO: 2351064 - DNA, 10 bp, Homo sapiens
gatcttaaaa

SEQ ID NO: 2351065 - DNA, 12 bp, Homo sapiens
gatctttcagaa

SEQ ID NO: 2351066 - DNA, 16 bp, Homo sapiens
gatctttttttaagtg

SEQ ID NO: 2351067 - DNA, 19 bp, Homo sapiens
gatgaagaccctatctccc

SEQ ID NO: 2351068 - DNA, 17 bp, Homo sapiens
gatgacttgctgtccag

SEQ ID NO: 2351069 - DNA, 18 bp, Homo sapiens
gatgagcaaccacattta

SEQ ID NO: 2351070 - DNA, 14 bp, Homo sapiens
gatgagcccaccct

SEQ ID NO: 2351071 - DNA, 16 bp, Homo sapiens
gatgagcgccacctct

SEQ ID NO: 2351072 - DNA, 16 bp, Homo sapiens
gatgatttcagttcta

SEQ ID NO: 2351073 - DNA, 19 bp, Homo sapiens
gatgattttcatttcatga

SEQ ID NO: 2351074 - DNA, 21 bp, Homo sapiens
gatgattttcatttcatgaaa

SEQ ID NO: 2351075 - DNA, 16 bp, Homo sapiens
gatgcatttaataaag

SEQ ID NO: 2351076 - DNA, 18 bp, Homo sapiens
gatgcatttaataaagat

SEQ ID NO: 2351077 - DNA, 21 bp, Homo sapiens
gatgcatttaataaagatgag

SEQ ID NO: 2351078 - DNA, 18 bp, Homo sapiens
gatgccaatttcctctcc

SEQ ID NO: 2351079 - DNA, 18 bp, Homo sapiens
gatgccagttacttgctt

SEQ ID NO: 2351080 - DNA, 22 bp, Homo sapiens
gatgccctgttggtttcacaga

SEQ ID NO: 2351081 - DNA, 13 bp, Homo sapiens
gatgcctgcttga

SEQ ID NO: 2351082 - DNA, 14 bp, Homo sapiens
gatgcgcagtgcct

SEQ ID NO: 2351083 - DNA, 16 bp, Homo sapiens
gatgctaaagatgatg

SEQ ID NO: 2351084 - DNA, 14 bp, Homo sapiens
gatgctgatggagc

SEQ ID NO: 2351085 - DNA, 18 bp, Homo sapiens
gcttttggggagccagaa

SEQ ID NO: 2351086 - DNA, 20 bp, Homo sapiens
gcttttttattttaatacaa

SEQ ID NO: 2351087 - DNA, 17 bp, Homo sapiens
gcttttttccaaaacaa

SEQ ID NO: 2351088 - DNA, 14 bp, Homo sapiens
ggaaaactgtgttg

SEQ ID NO: 2351089 - DNA, 19 bp, Homo sapiens
ggaaaatgccatgaattac

SEQ ID NO: 2351090 - DNA, 18 bp, Homo sapiens
ggaaaattctaacccagg

SEQ ID NO: 2351091 - DNA, 15 bp, Homo sapiens
ggaaaattttctcct

SEQ ID NO: 2351092 - DNA, 15 bp, Homo sapiens
ggaaacaacatttat

SEQ ID NO: 2351093 - DNA, 17 bp, Homo sapiens
ggaaactcttatctcag

SEQ ID NO: 2351094 - DNA, 23 bp, Homo sapiens
ggaaagatggtgtgggtgtcctg

SEQ ID NO: 2351095 - DNA, 18 bp, Homo sapiens
ggaaaggggagagcctgc

SEQ ID NO: 2351096 - DNA, 18 bp, Homo sapiens
ggaaagtcagaatcagaa

SEQ ID NO: 2351097 - DNA, 13 bp, Homo sapiens
ggaaatagaaaga

SEQ ID NO: 2351098 - DNA, 23 bp, Homo sapiens
ggaaattttacaagggcataaag

SEQ ID NO: 2351099 - DNA, 15 bp, Homo sapiens
ggaacaaacagggct

SEQ ID NO: 2351100 - DNA, 13 bp, Homo sapiens
ggaacccctttcc

SEQ ID NO: 2351101 - DNA, 19 bp, Homo sapiens
ggaactgaagacctccaca

SEQ ID NO: 2351102 - DNA, 19 bp, Homo sapiens
ggaacttgcgagtccaagg

SEQ ID NO: 2351103 - DNA, 13 bp, Homo sapiens
ggaagaacataga

SEQ ID NO: 2351104 - DNA, 12 bp, Homo sapiens
ggaagaagaaat

SEQ ID NO: 2351105 - DNA, 14 bp, Homo sapiens
ggaagaagcaaggg

SEQ ID NO: 2351106 - DNA, 11 bp, Homo sapiens
ggaagaatgaa

SEQ ID NO: 2351107 - DNA, 16 bp, Homo sapiens
ggaagagacagcccag

SEQ ID NO: 2351108 - DNA, 17 bp, Homo sapiens
ggaagagacagcccagg

SEQ ID NO: 2351109 - DNA, 14 bp, Homo sapiens
ggaagagccacctg

SEQ ID NO: 2351110 - DNA, 15 bp, Homo sapiens
ggaagagccacctgc

SEQ ID NO: 2351111 - DNA, 19 bp, Homo sapiens
ggaagagccacctgcaaga

SEQ ID NO: 2351112 - DNA, 20 bp, Homo sapiens
ggaagagcccagtctgttga

SEQ ID NO: 2351113 - DNA, 17 bp, Homo sapiens
ggaagagcccgcagggc

SEQ ID NO: 2351114 - DNA, 14 bp, Homo sapiens
ggaagcagggaatt

SEQ ID NO: 2351115 - DNA, 17 bp, Homo sapiens
ggaagcagggacacccc

SEQ ID NO: 2351116 - DNA, 19 bp, Homo sapiens
ggaaggatctgctgaggcc

SEQ ID NO: 2351117 - DNA, 22 bp, Homo sapiens
ggaaggatctgctgaggcccag

SEQ ID NO: 2351118 - DNA, 12 bp, Homo sapiens
ggaagggatctg

SEQ ID NO: 2351119 - DNA, 19 bp, Homo sapiens
ggaaggggttcctcaaatt

SEQ ID NO: 2351120 - DNA, 21 bp, Homo sapiens
ggaaggggttcctcaaatttt

SEQ ID NO: 2351121 - DNA, 14 bp, Homo sapiens
ggaagggttttctt

SEQ ID NO: 2351122 - DNA, 16 bp, Homo sapiens
ggaaggtggccacagc

SEQ ID NO: 2351123 - DNA, 14 bp, Homo sapiens
ggaataaaaggctt

SEQ ID NO: 2351124 - DNA, 15 bp, Homo sapiens
ggaataaaaggcttg

SEQ ID NO: 2351125 - DNA, 22 bp, Homo sapiens
ggaatatatcagtacctctcaa

SEQ ID NO: 2351126 - DNA, 15 bp, Homo sapiens
ggaatattaaaaaac

SEQ ID NO: 2351127 - DNA, 13 bp, Homo sapiens
ggaatcctggcag

SEQ ID NO: 2351128 - DNA, 21 bp, Homo sapiens
ggaatctttgtaccaaaattt

SEQ ID NO: 2351129 - DNA, 19 bp, Homo sapiens
ggaatgcccttcactgtca

SEQ ID NO: 2351130 - DNA, 18 bp, Homo sapiens
ggaatgtttttccctccc

SEQ ID NO: 2351131 - DNA, 19 bp, Homo sapiens
ggaattacgtgctctgtgg

SEQ ID NO: 2351132 - DNA, 23 bp, Homo sapiens
ggaattgtggctatcctgattat

SEQ ID NO: 2351133 - DNA, 22 bp, Homo sapiens
ggacaactgctcccacctcctg

SEQ ID NO: 2351134 - DNA, 17 bp, Homo sapiens
ggagctgagcagcctct

SEQ ID NO: 2351135 - DNA, 17 bp, Homo sapiens
ggagcttgggcagtgcc

SEQ ID NO: 2351136 - DNA, 14 bp, Homo sapiens
ggagctttctcaat

SEQ ID NO: 2351137 - DNA, 19 bp, Homo sapiens
ggagctttctcaatgtctt

SEQ ID NO: 2351138 - DNA, 23 bp, Homo sapiens
ggagctttctcaatgtcttccca

SEQ ID NO: 2351139 - DNA, 15 bp, Homo sapiens
ggaggaagagccacc

SEQ ID NO: 2351140 - DNA, 16 bp, Homo sapiens
ggaggaagagccacct

SEQ ID NO: 2351141 - DNA, 22 bp, Homo sapiens
ggaggaagtggggtctggcctg

SEQ ID NO: 2351142 - DNA, 13 bp, Homo sapiens
ggaggaggaaggc

SEQ ID NO: 2351143 - DNA, 13 bp, Homo sapiens
ggaggagggagag

SEQ ID NO: 2351144 - DNA, 13 bp, Homo sapiens
ggaggcagggctc

SEQ ID NO: 2351145 - DNA, 13 bp, Homo sapiens
ggaggccgaggcc

SEQ ID NO: 2351146 - DNA, 18 bp, Homo sapiens
ggaggccgaggccatgtg

SEQ ID NO: 2351147 - DNA, 13 bp, Homo sapiens
ggaggcctcaggt

SEQ ID NO: 2351148 - DNA, 15 bp, Homo sapiens
ggaggcctcaggtgc

SEQ ID NO: 2351149 - DNA, 22 bp, Homo sapiens
ggaggctcctgcctgagcttcc

SEQ ID NO: 2351150 - DNA, 21 bp, Homo sapiens
ggagggagttttgtctgtctc

SEQ ID NO: 2351151 - DNA, 22 bp, Homo sapiens
ggaggtgcgtgttcagcagaac

SEQ ID NO: 2351152 - DNA, 13 bp, Homo sapiens
ggagtattgaatg

SEQ ID NO: 2351153 - DNA, 21 bp, Homo sapiens
ggagtattgaatggtggtgga

SEQ ID NO: 2351154 - DNA, 20 bp, Homo sapiens
ggagtccagggtttctctgc

SEQ ID NO: 2351155 - DNA, 18 bp, Homo sapiens
ggagtgcggaccaccctc

SEQ ID NO: 2351156 - DNA, 18 bp, Homo sapiens
ggagtgtctggaattgtg

SEQ ID NO: 2351157 - DNA, 16 bp, Homo sapiens
ggagtgtgtctgctga

SEQ ID NO: 2351158 - DNA, 22 bp, Homo sapiens
ggagttggtgaatcggttgttc

SEQ ID NO: 2351159 - DNA, 12 bp, Homo sapiens
ggagtttctctg

SEQ ID NO: 2351160 - DNA, 19 bp, Homo sapiens
ggataaagaaaagacattt

SEQ ID NO: 2351161 - DNA, 21 bp, Homo sapiens
ggataagaaagcctaaaattg

SEQ ID NO: 2351162 - DNA, 22 bp, Homo sapiens
ggatacaggagagaagctggtc

SEQ ID NO: 2351163 - DNA, 16 bp, Homo sapiens
ggatagttgctatttt

SEQ ID NO: 2351164 - DNA, 12 bp, Homo sapiens
ggatattataga

SEQ ID NO: 2351165 - DNA, 19 bp, Homo sapiens
ggatattatagaaaattat

SEQ ID NO: 2351166 - DNA, 22 bp, Homo sapiens
ggatcagcctccgccattccaa

SEQ ID NO: 2351167 - DNA, 19 bp, Homo sapiens
ggatcatcaacaagatttc

SEQ ID NO: 2351168 - DNA, 16 bp, Homo sapiens
ggatccccgcctggcc

SEQ ID NO: 2351169 - DNA, 15 bp, Homo sapiens
ggatcggactctgcc

SEQ ID NO: 2351170 - DNA, 17 bp, Homo sapiens
ggatcggactctgcccc

SEQ ID NO: 2351171 - DNA, 22 bp, Homo sapiens
ggatctaaaaaaatgtttttag

SEQ ID NO: 2351172 - DNA, 22 bp, Homo sapiens
ggatctataggcagcttctaag

SEQ ID NO: 2351173 - DNA, 22 bp, Homo sapiens
ggatctcagctttgagaagcct

SEQ ID NO: 2351174 - DNA, 15 bp, Homo sapiens
ggatgaagaccctat

SEQ ID NO: 2351175 - DNA, 17 bp, Homo sapiens
ggatgccttttctgtga

SEQ ID NO: 2351176 - DNA, 16 bp, Homo sapiens
ggatgcgcagtgcctt

SEQ ID NO: 2351177 - DNA, 19 bp, Homo sapiens
ggatggaaaaggaagacta

SEQ ID NO: 2351178 - DNA, 12 bp, Homo sapiens
ggatggactggc

SEQ ID NO: 2351179 - DNA, 12 bp, Homo sapiens
ggatggccgtgg

SEQ ID NO: 2351180 - DNA, 19 bp, Homo sapiens
ggatggcctttccttccct

SEQ ID NO: 2351181 - DNA, 18 bp, Homo sapiens
ggatggttagtcacctgc

SEQ ID NO: 2351182 - DNA, 11 bp, Homo sapiens
ggatggtttgt

SEQ ID NO: 2351183 - DNA, 15 bp, Homo sapiens
ggatgttatgaacag

SEQ ID NO: 2351184 - DNA, 19 bp, Homo sapiens
ggatgttatgaacagctgt

SEQ ID NO: 2351185 - DNA, 15 bp, Homo sapiens
ggatgtttggaaaaa

SEQ ID NO: 2351186 - DNA, 23 bp, Homo sapiens
ggatgtttggaaaaaactctgaa

SEQ ID NO: 2351187 - DNA, 22 bp, Homo sapiens
ggattatttaataacattacct

SEQ ID NO: 2351188 - DNA, 11 bp, Homo sapiens
ggattcccttc

SEQ ID NO: 2351189 - DNA, 15 bp, Homo sapiens
ggattcccttctggg

SEQ ID NO: 2351190 - DNA, 18 bp, Homo sapiens
ggattctttccattatga

SEQ ID NO: 2351191 - DNA, 18 bp, Homo sapiens
ggattggattatttaata

SEQ ID NO: 2351192 - DNA, 22 bp, Homo sapiens
ggatttctaacagtccttgctt

SEQ ID NO: 2351193 - DNA, 18 bp, Homo sapiens
ggatttgcctcaccttgg

SEQ ID NO: 2351194 - DNA, 15 bp, Homo sapiens
ggcaaacctttcccc

SEQ ID NO: 2351195 - DNA, 18 bp, Homo sapiens
ggcaagaacccaagtgcc

SEQ ID NO: 2351196 - DNA, 21 bp, Homo sapiens
ggcaagaacccaagtgcctca

SEQ ID NO: 2351197 - DNA, 16 bp, Homo sapiens
ggcaagagggggtgga

SEQ ID NO: 2351198 - DNA, 17 bp, Homo sapiens
ggcaagcagctggtcag

SEQ ID NO: 2351199 - DNA, 20 bp, Homo sapiens
ggcaagccacaggaaggagg

SEQ ID NO: 2351200 - DNA, 19 bp, Homo sapiens
ggcaagggttaaggcctga

SEQ ID NO: 2351201 - DNA, 14 bp, Homo sapiens
ggcaatattaacct

SEQ ID NO: 2351202 - DNA, 11 bp, Homo sapiens
ggcaattagtg

SEQ ID NO: 2351203 - DNA, 18 bp, Homo sapiens
ggcaattagtgtgacagt

SEQ ID NO: 2351204 - DNA, 13 bp, Homo sapiens
ggcacacacagcc

SEQ ID NO: 2351205 - DNA, 15 bp, Homo sapiens
ggcaccagtccctgt

SEQ ID NO: 2351206 - DNA, 18 bp, Homo sapiens
ggcaccagtccctgtccg

SEQ ID NO: 2351207 - DNA, 13 bp, Homo sapiens
ggcaccctcaggg

SEQ ID NO: 2351208 - DNA, 14 bp, Homo sapiens
ggcaccgagaatgt

SEQ ID NO: 2351209 - DNA, 12 bp, Homo sapiens
ggcacctgctgg

SEQ ID NO: 2351210 - DNA, 17 bp, Homo sapiens
ggcacgcactgggttgc

SEQ ID NO: 2351211 - DNA, 18 bp, Homo sapiens
ggcacgccaacagccccc

SEQ ID NO: 2351212 - DNA, 14 bp, Homo sapiens
ggcacgcctgctgg

SEQ ID NO: 2351213 - DNA, 14 bp, Homo sapiens
ggcacgggtggtcc

SEQ ID NO: 2351214 - DNA, 17 bp, Homo sapiens
ggcactcagtgagcctc

SEQ ID NO: 2351215 - DNA, 18 bp, Homo sapiens
ggcactcagtgagcctcc

SEQ ID NO: 2351216 - DNA, 19 bp, Homo sapiens
ggcactcagtgagcctcct

SEQ ID NO: 2351217 - DNA, 22 bp, Homo sapiens
ggcactcagtgagcctcctgtg

SEQ ID NO: 2351218 - DNA, 16 bp, Homo sapiens
ggcactggcgaggaga

SEQ ID NO: 2351219 - DNA, 20 bp, Homo sapiens
ggcactgggaggcagggctc

SEQ ID NO: 2351220 - DNA, 19 bp, Homo sapiens
ggcagaagacaccagagca

SEQ ID NO: 2351221 - DNA, 21 bp, Homo sapiens
ggcagaagacaccagagcaga

SEQ ID NO: 2351222 - DNA, 12 bp, Homo sapiens
ggcagagaataa

SEQ ID NO: 2351223 - DNA, 20 bp, Homo sapiens
ggcagagggagaatccaagg

SEQ ID NO: 2351224 - DNA, 21 bp, Homo sapiens
ggcagaggttttaatgtctgt

SEQ ID NO: 2351225 - DNA, 15 bp, Homo sapiens
ggcagatgtcttccc

SEQ ID NO: 2351226 - DNA, 13 bp, Homo sapiens
ggcagattgaaaa

SEQ ID NO: 2351227 - DNA, 20 bp, Homo sapiens
ggcagattttacagagcgca

SEQ ID NO: 2351228 - DNA, 21 bp, Homo sapiens
ggcagcccagagactttgtag

SEQ ID NO: 2351229 - DNA, 22 bp, Homo sapiens
ggcagcccagagactttgtaga

SEQ ID NO: 2351230 - DNA, 14 bp, Homo sapiens
ggcagcccagcagt

SEQ ID NO: 2351231 - DNA, 22 bp, Homo sapiens
ggcagcctgccgccgtctctgt

SEQ ID NO: 2351232 - DNA, 23 bp, Homo sapiens
ggcagcgacctcaagtgtcctga

SEQ ID NO: 2351233 - DNA, 13 bp, Homo sapiens
ggcagctccctcc

SEQ ID NO: 2351234 - DNA, 14 bp, Homo sapiens
ggcaggatggcctt

SEQ ID NO: 2351235 - DNA, 15 bp, Homo sapiens
ggcaggccacctggc

SEQ ID NO: 2351236 - DNA, 15 bp, Homo sapiens
ggcaggctcactgcc

SEQ ID NO: 2351237 - DNA, 22 bp, Homo sapiens
ggcaggctcactgccaggccag

SEQ ID NO: 2351238 - DNA, 13 bp, Homo sapiens
ggcaggctgggcc

SEQ ID NO: 2351239 - DNA, 14 bp, Homo sapiens
ggcaggctgggcca

SEQ ID NO: 2351240 - DNA, 16 bp, Homo sapiens
ggcaggcttggggaaa

SEQ ID NO: 2351241 - DNA, 14 bp, Homo sapiens
ggcagggcagcctg

SEQ ID NO: 2351242 - DNA, 14 bp, Homo sapiens
ggcagggctctccc

SEQ ID NO: 2351243 - DNA, 15 bp, Homo sapiens
ggcagggtctgggct

SEQ ID NO: 2351244 - DNA, 13 bp, Homo sapiens
ggcaggtgggggt

SEQ ID NO: 2351245 - DNA, 19 bp, Homo sapiens
ggcagtattttgtgtcctc

SEQ ID NO: 2351246 - DNA, 19 bp, Homo sapiens
ggcagtctgaatttttaaa

SEQ ID NO: 2351247 - DNA, 17 bp, Homo sapiens
ggcagtgattctgtttg

SEQ ID NO: 2351248 - DNA, 14 bp, Homo sapiens
ggcagtgccccagg

SEQ ID NO: 2351249 - DNA, 15 bp, Homo sapiens
ggcagtgccccaggg

SEQ ID NO: 2351250 - DNA, 16 bp, Homo sapiens
ggcagtgccccaggga

SEQ ID NO: 2351251 - DNA, 18 bp, Homo sapiens
ggcagtgccccagggagt

SEQ ID NO: 2351252 - DNA, 21 bp, Homo sapiens
ggcagtgccccagggagtcca

SEQ ID NO: 2351253 - DNA, 22 bp, Homo sapiens
ggcatagaggcttctccgccag

SEQ ID NO: 2351254 - DNA, 21 bp, Homo sapiens
ggcatatggtcctagacaaac

SEQ ID NO: 2351255 - DNA, 15 bp, Homo sapiens
ggcatcattctcctt

SEQ ID NO: 2351256 - DNA, 14 bp, Homo sapiens
ggcatctcttcccc

SEQ ID NO: 2351257 - DNA, 17 bp, Homo sapiens
ggcatctcttccccaga

SEQ ID NO: 2351258 - DNA, 18 bp, Homo sapiens
ggcatctcttccccagag

SEQ ID NO: 2351259 - DNA, 15 bp, Homo sapiens
ggcatcttgctggct

SEQ ID NO: 2351260 - DNA, 16 bp, Homo sapiens
ggcatcttgctggcta

SEQ ID NO: 2351261 - DNA, 14 bp, Homo sapiens
ggcatgacactcta

SEQ ID NO: 2351262 - DNA, 23 bp, Homo sapiens
ggcatgacactctagtgacttcc

SEQ ID NO: 2351263 - DNA, 12 bp, Homo sapiens
ggcatgctgaat

SEQ ID NO: 2351264 - DNA, 15 bp, Homo sapiens
ggcattttcctcctc

SEQ ID NO: 2351265 - DNA, 17 bp, Homo sapiens
ggcattttcctcctctg

SEQ ID NO: 2351266 - DNA, 19 bp, Homo sapiens
ggcattttcctcctctgcc

SEQ ID NO: 2351267 - DNA, 16 bp, Homo sapiens
ggccaaaatcaagagt

SEQ ID NO: 2351268 - DNA, 13 bp, Homo sapiens
ggccaagcagaaa

SEQ ID NO: 2351269 - DNA, 16 bp, Homo sapiens
ggccaaggacctgaga

SEQ ID NO: 2351270 - DNA, 19 bp, Homo sapiens
ggccaaggacctgagacct

SEQ ID NO: 2351271 - DNA, 13 bp, Homo sapiens
ggccaccaaagct

SEQ ID NO: 2351272 - DNA, 16 bp, Homo sapiens
ggccaccaaagctgcc

SEQ ID NO: 2351273 - DNA, 13 bp, Homo sapiens
ggccaccacagag

SEQ ID NO: 2351274 - DNA, 14 bp, Homo sapiens
ggccaccactgcag

SEQ ID NO: 2351275 - DNA, 22 bp, Homo sapiens
ggccaccagccatcctccctcc

SEQ ID NO: 2351276 - DNA, 17 bp, Homo sapiens
ggccacctggctctcac

SEQ ID NO: 2351277 - DNA, 16 bp, Homo sapiens
ggccactgtgttcctt

SEQ ID NO: 2351278 - DNA, 14 bp, Homo sapiens
ggccagaggctggg

SEQ ID NO: 2351279 - DNA, 18 bp, Homo sapiens
ggccagcggggctgctca

SEQ ID NO: 2351280 - DNA, 22 bp, Homo sapiens
ggccagcggggctgctcaccca

SEQ ID NO: 2351281 - DNA, 13 bp, Homo sapiens
ggccagcgtggct

SEQ ID NO: 2351282 - DNA, 22 bp, Homo sapiens
ggccagggcctctccaaccact

SEQ ID NO: 2351283 - DNA, 12 bp, Homo sapiens
ggccagtcccca

SEQ ID NO: 2351284 - DNA, 20 bp, Homo sapiens
ggccagttgatctgctctgt

SEQ ID NO: 2351285 - DNA, 18 bp, Homo sapiens
ggccataaacggttcctg

SEQ ID NO: 2351286 - DNA, 20 bp, Homo sapiens
ggccataaacggttcctggt

SEQ ID NO: 2351287 - DNA, 21 bp, Homo sapiens
ggccataaacggttcctggtg

SEQ ID NO: 2351288 - DNA, 15 bp, Homo sapiens
ggccatgcagacctc

SEQ ID NO: 2351289 - DNA, 23 bp, Homo sapiens
ggccatgcaggaggtggagaaaa

SEQ ID NO: 2351290 - DNA, 13 bp, Homo sapiens
ggccatggcctgc

SEQ ID NO: 2351291 - DNA, 23 bp, Homo sapiens
ggccatgtgcatagtttctttat

SEQ ID NO: 2351292 - DNA, 18 bp, Homo sapiens
ggccatttgcaataacag

SEQ ID NO: 2351293 - DNA, 20 bp, Homo sapiens
ggccatttgcaataacagct

SEQ ID NO: 2351294 - DNA, 21 bp, Homo sapiens
ggcccagaaagcctctctctc

SEQ ID NO: 2351295 - DNA, 22 bp, Homo sapiens
ggcccagtacctagctggctct

SEQ ID NO: 2351296 - DNA, 23 bp, Homo sapiens
ggcccatggctgttggtgggacc

SEQ ID NO: 2351297 - DNA, 23 bp, Homo sapiens
ggccccactcccttgctggcccc

SEQ ID NO: 2351298 - DNA, 17 bp, Homo sapiens
ggccccactggctggag

SEQ ID NO: 2351299 - DNA, 15 bp, Homo sapiens
ggccccagccctgct

SEQ ID NO: 2351300 - DNA, 20 bp, Homo sapiens
ggcccccaacctcagggctc

SEQ ID NO: 2351301 - DNA, 14 bp, Homo sapiens
ggcccccctgccct

SEQ ID NO: 2351302 - DNA, 23 bp, Homo sapiens
ggcccctctcccttgggctctga

SEQ ID NO: 2351303 - DNA, 21 bp, Homo sapiens
ggcccctgggcttggcctgct

SEQ ID NO: 2351304 - DNA, 17 bp, Homo sapiens
ggccctgactcctctgg

SEQ ID NO: 2351305 - DNA, 22 bp, Homo sapiens
ggccctgactcctctggctttc

SEQ ID NO: 2351306 - DNA, 11 bp, Homo sapiens
ggccctgggct

SEQ ID NO: 2351307 - DNA, 22 bp, Homo sapiens
ggccctgggctgggtgctggga

SEQ ID NO: 2351308 - DNA, 15 bp, Homo sapiens
ggccctgttccctgg

SEQ ID NO: 2351309 - DNA, 17 bp, Homo sapiens
ggccgacccactgaccc

SEQ ID NO: 2351310 - DNA, 15 bp, Homo sapiens
ggccgagctgtggac

SEQ ID NO: 2351311 - DNA, 12 bp, Homo sapiens
ggccgaggcggg

SEQ ID NO: 2351312 - DNA, 14 bp, Homo sapiens
ggccggcccagatg

SEQ ID NO: 2351313 - DNA, 18 bp, Homo sapiens
ggcctagactctgtctac

SEQ ID NO: 2351314 - DNA, 22 bp, Homo sapiens
ggcctagcgatctctcctggcc

SEQ ID NO: 2351315 - DNA, 23 bp, Homo sapiens
ggcctagcgatctctcctggcct

SEQ ID NO: 2351316 - DNA, 20 bp, Homo sapiens
ggcctatgcacatatggact

SEQ ID NO: 2351317 - DNA, 14 bp, Homo sapiens
ggcctatttaacaa

SEQ ID NO: 2351318 - DNA, 14 bp, Homo sapiens
ggcctcagtgcccc

SEQ ID NO: 2351319 - DNA, 23 bp, Homo sapiens
ggcctcccaaagtgctgagattg

SEQ ID NO: 2351320 - DNA, 19 bp, Homo sapiens
ggcctgaatcatgagcctg

SEQ ID NO: 2351321 - DNA, 21 bp, Homo sapiens
ggcctgaatcatgagcctgct

SEQ ID NO: 2351322 - DNA, 22 bp, Homo sapiens
ggcctgaatcatgagcctgctg

SEQ ID NO: 2351323 - DNA, 23 bp, Homo sapiens
ggcctgaatcatgagcctgctgg

SEQ ID NO: 2351324 - DNA, 13 bp, Homo sapiens
ggcctgactgctc

SEQ ID NO: 2351325 - DNA, 15 bp, Homo sapiens
ggcctgactgctcag

SEQ ID NO: 2351326 - DNA, 15 bp, Homo sapiens
ggcctgcaaactggg

SEQ ID NO: 2351327 - DNA, 11 bp, Homo sapiens
ggcctgctgcg

SEQ ID NO: 2351328 - DNA, 17 bp, Homo sapiens
ggcctgggacttccatg

SEQ ID NO: 2351329 - DNA, 22 bp, Homo sapiens
ggcctggttcaaagtaaagcag

SEQ ID NO: 2351330 - DNA, 18 bp, Homo sapiens
ggcctgtgggtctctgaa

SEQ ID NO: 2351331 - DNA, 21 bp, Homo sapiens
ggcctgtgggtctctgaaggg

SEQ ID NO: 2351332 - DNA, 22 bp, Homo sapiens
ggcctgttgatgtttacatggc

SEQ ID NO: 2351333 - DNA, 17 bp, Homo sapiens
ggcctgtttgaaagtaa

SEQ ID NO: 2351334 - DNA, 13 bp, Homo sapiens
ggccttaatttcc

SEQ ID NO: 2351335 - DNA, 15 bp, Homo sapiens
ggccttaatttcctt

SEQ ID NO: 2351336 - DNA, 12 bp, Homo sapiens
ggccttcacaat

SEQ ID NO: 2351337 - DNA, 17 bp, Homo sapiens
ggccttgatgactgcct

SEQ ID NO: 2351338 - DNA, 12 bp, Homo sapiens
ggccttggaaat

SEQ ID NO: 2351339 - DNA, 21 bp, Homo sapiens
ggcctttccttccctctctga

SEQ ID NO: 2351340 - DNA, 14 bp, Homo sapiens
ggcctttcttctgt

SEQ ID NO: 2351341 - DNA, 14 bp, Homo sapiens
ggcgagtctgggga

SEQ ID NO: 2351342 - DNA, 19 bp, Homo sapiens
ggcgagttctctttggaaa

SEQ ID NO: 2351343 - DNA, 13 bp, Homo sapiens
ggcgcagagggaa

SEQ ID NO: 2351344 - DNA, 12 bp, Homo sapiens
ggcgccctgcct

SEQ ID NO: 2351345 - DNA, 19 bp, Homo sapiens
ggcgccctgcctcctggag

SEQ ID NO: 2351346 - DNA, 21 bp, Homo sapiens
ggcggcacgccaacagccccc

SEQ ID NO: 2351347 - DNA, 14 bp, Homo sapiens
ggcggcgcagaggg

SEQ ID NO: 2351348 - DNA, 14 bp, Homo sapiens
ggcggctactctgg

SEQ ID NO: 2351349 - DNA, 15 bp, Homo sapiens
ggcggctactctgga

SEQ ID NO: 2351350 - DNA, 12 bp, Homo sapiens
ggcgtctgctct

SEQ ID NO: 2351351 - DNA, 13 bp, Homo sapiens
ggcgtctgctctg

SEQ ID NO: 2351352 - DNA, 18 bp, Homo sapiens
ggcgtgggagccagcctc

SEQ ID NO: 2351353 - DNA, 21 bp, Homo sapiens
ggctatgtctcatgttttata

SEQ ID NO: 2351354 - DNA, 20 bp, Homo sapiens
ggctcaagcaatcctcctgc

SEQ ID NO: 2351355 - DNA, 23 bp, Homo sapiens
ggctcaagcaatcctcctgcctc

SEQ ID NO: 2351356 - DNA, 18 bp, Homo sapiens
ggctcactgccaggccag

SEQ ID NO: 2351357 - DNA, 21 bp, Homo sapiens
ggctcactgccaggccagcct

SEQ ID NO: 2351358 - DNA, 15 bp, Homo sapiens
ggctccagccatctc

SEQ ID NO: 2351359 - DNA, 12 bp, Homo sapiens
ggctcccagggg

SEQ ID NO: 2351360 - DNA, 16 bp, Homo sapiens
ggctccccctccccag

SEQ ID NO: 2351361 - DNA, 21 bp, Homo sapiens
ggctccctaaactttggcctt

SEQ ID NO: 2351362 - DNA, 16 bp, Homo sapiens
ggctccctcctccagg

SEQ ID NO: 2351363 - DNA, 20 bp, Homo sapiens
ggctccctcctccaggcctg

SEQ ID NO: 2351364 - DNA, 13 bp, Homo sapiens
ggctcctcagagc

SEQ ID NO: 2351365 - DNA, 21 bp, Homo sapiens
ggctcctcagagcgccaggaa

SEQ ID NO: 2351366 - DNA, 13 bp, Homo sapiens
ggctcgcactgcc

SEQ ID NO: 2351367 - DNA, 19 bp, Homo sapiens
ggctcgcactgcccacatg

SEQ ID NO: 2351368 - DNA, 17 bp, Homo sapiens
aagctgcactgtgaacc

SEQ ID NO: 2351369 - DNA, 18 bp, Homo sapiens
aagctgcccactgtttct

SEQ ID NO: 2351370 - DNA, 12 bp, Homo sapiens
aagctgctctga

SEQ ID NO: 2351371 - DNA, 16 bp, Homo sapiens
aagctgctctgagcca

SEQ ID NO: 2351372 - DNA, 21 bp, Homo sapiens
aagctggctttgaaacctcag

SEQ ID NO: 2351373 - DNA, 23 bp, Homo sapiens
aagctgtgtctgcccaatgaata

SEQ ID NO: 2351374 - DNA, 12 bp, Homo sapiens
aagctgttgtac

SEQ ID NO: 2351375 - DNA, 18 bp, Homo sapiens
aagctgttgtacatttat

SEQ ID NO: 2351376 - DNA, 17 bp, Homo sapiens
aagctgtttggaaaaga

SEQ ID NO: 2351377 - DNA, 11 bp, Homo sapiens
aagcttccctc

SEQ ID NO: 2351378 - DNA, 16 bp, Homo sapiens
aagctttcttttctaa

SEQ ID NO: 2351379 - DNA, 18 bp, Homo sapiens
aagctttcttttctaact

SEQ ID NO: 2351380 - DNA, 14 bp, Homo sapiens
aagctttggctgag

SEQ ID NO: 2351381 - DNA, 14 bp, Homo sapiens
aagctttttggaat

SEQ ID NO: 2351382 - DNA, 18 bp, Homo sapiens
aagctttttggaatcttt

SEQ ID NO: 2351383 - DNA, 19 bp, Homo sapiens
aaggaaaaacacaagcaaa

SEQ ID NO: 2351384 - DNA, 17 bp, Homo sapiens
aaggaaggcctgagccc

SEQ ID NO: 2351385 - DNA, 21 bp, Homo sapiens
aaggactgagcaccctctgga

SEQ ID NO: 2351386 - DNA, 20 bp, Homo sapiens
aaggagatttcttagttcat

SEQ ID NO: 2351387 - DNA, 20 bp, Homo sapiens
aaggagctttctcaatgtct

SEQ ID NO: 2351388 - DNA, 21 bp, Homo sapiens
aaggaggggagagacaggcag

SEQ ID NO: 2351389 - DNA, 13 bp, Homo sapiens
aaggataaagaag

SEQ ID NO: 2351390 - DNA, 15 bp, Homo sapiens
aaggataaatcataa

SEQ ID NO: 2351391 - DNA, 17 bp, Homo sapiens
aaggataccttcttatt

SEQ ID NO: 2351392 - DNA, 19 bp, Homo sapiens
aaggataccttcttattta

SEQ ID NO: 2351393 - DNA, 14 bp, Homo sapiens
aaggatatattatg

SEQ ID NO: 2351394 - DNA, 13 bp, Homo sapiens
aaggatctgctga

SEQ ID NO: 2351395 - DNA, 14 bp, Homo sapiens
aaggatctgctgag

SEQ ID NO: 2351396 - DNA, 14 bp, Homo sapiens
aaggattcttctga

SEQ ID NO: 2351397 - DNA, 21 bp, Homo sapiens
aaggattgtaaaaaaaaatgc

SEQ ID NO: 2351398 - DNA, 12 bp, Homo sapiens
aaggatttttct

SEQ ID NO: 2351399 - DNA, 21 bp, Homo sapiens
aaggcaagagggggtggaggg

SEQ ID NO: 2351400 - DNA, 17 bp, Homo sapiens
aaggcaatattaaccta

SEQ ID NO: 2351401 - DNA, 17 bp, Homo sapiens
aaggcatccttgtcttt

SEQ ID NO: 2351402 - DNA, 17 bp, Homo sapiens
aaggccaaaatcaagag

SEQ ID NO: 2351403 - DNA, 21 bp, Homo sapiens
aaggccagtccccatttctgc

SEQ ID NO: 2351404 - DNA, 13 bp, Homo sapiens
aaggccctgctga

SEQ ID NO: 2351405 - DNA, 21 bp, Homo sapiens
aaggcctcttgtaaagactgg

SEQ ID NO: 2351406 - DNA, 16 bp, Homo sapiens
aaggcctttcttctgt

SEQ ID NO: 2351407 - DNA, 17 bp, Homo sapiens
aaggcctttcttctgtg

SEQ ID NO: 2351408 - DNA, 16 bp, Homo sapiens
aaggctttgccatggg

SEQ ID NO: 2351409 - DNA, 15 bp, Homo sapiens
aagggaaagtttttt

SEQ ID NO: 2351410 - DNA, 21 bp, Homo sapiens
aagggacatttctataaaaat

SEQ ID NO: 2351411 - DNA, 15 bp, Homo sapiens
aagggagaagaaagg

SEQ ID NO: 2351412 - DNA, 19 bp, Homo sapiens
aagggaggaaggcctttct

SEQ ID NO: 2351413 - DNA, 20 bp, Homo sapiens
aagggaggaaggcctttctt

SEQ ID NO: 2351414 - DNA, 21 bp, Homo sapiens
aagggaggaaggcctttcttc

SEQ ID NO: 2351415 - DNA, 22 bp, Homo sapiens
aagggaggaaggcctttcttct

SEQ ID NO: 2351416 - DNA, 22 bp, Homo sapiens
aagggatgttattatccttggg

SEQ ID NO: 2351417 - DNA, 13 bp, Homo sapiens
aagggctggctcc

SEQ ID NO: 2351418 - DNA, 14 bp, Homo sapiens
aaggggagagcctg

SEQ ID NO: 2351419 - DNA, 19 bp, Homo sapiens
aaggggagagcctgctggc

SEQ ID NO: 2351420 - DNA, 15 bp, Homo sapiens
aagggggtctctgtt

SEQ ID NO: 2351421 - DNA, 16 bp, Homo sapiens
aaggggtgcacccacc

SEQ ID NO: 2351422 - DNA, 18 bp, Homo sapiens
aaggggtgcacccacctg

SEQ ID NO: 2351423 - DNA, 14 bp, Homo sapiens
aaggggttcctcaa

SEQ ID NO: 2351424 - DNA, 19 bp, Homo sapiens
aaggggttcctcaaatttt

SEQ ID NO: 2351425 - DNA, 15 bp, Homo sapiens
aagggttaaggcctg

SEQ ID NO: 2351426 - DNA, 16 bp, Homo sapiens
aagggttaaggcctga

SEQ ID NO: 2351427 - DNA, 12 bp, Homo sapiens
aagggttttctt

SEQ ID NO: 2351428 - DNA, 13 bp, Homo sapiens
aagggttttcttt

SEQ ID NO: 2351429 - DNA, 17 bp, Homo sapiens
aaggtaaatcccacatc

SEQ ID NO: 2351430 - DNA, 18 bp, Homo sapiens
aaggtagcattctttgga

SEQ ID NO: 2351431 - DNA, 22 bp, Homo sapiens
aaggtattatacatgtgataca

SEQ ID NO: 2351432 - DNA, 23 bp, Homo sapiens
aaggtcttcttgtgtcctgatga

SEQ ID NO: 2351433 - DNA, 20 bp, Homo sapiens
aaggtgagtttgagctgcct

SEQ ID NO: 2351434 - DNA, 21 bp, Homo sapiens
aaggtgagtttgagctgcctt

SEQ ID NO: 2351435 - DNA, 13 bp, Homo sapiens
aaggtgccacttt

SEQ ID NO: 2351436 - DNA, 13 bp, Homo sapiens
aaggtgctaacat

SEQ ID NO: 2351437 - DNA, 16 bp, Homo sapiens
aaggtgcttggagttt

SEQ ID NO: 2351438 - DNA, 22 bp, Homo sapiens
aaggtgggccttgctacctcaa

SEQ ID NO: 2351439 - DNA, 16 bp, Homo sapiens
aaggttggagcccagg

SEQ ID NO: 2351440 - DNA, 18 bp, Homo sapiens
aaggttggagcccagggc

SEQ ID NO: 2351441 - DNA, 16 bp, Homo sapiens
aaggtttaaagtttga

SEQ ID NO: 2351442 - DNA, 14 bp, Homo sapiens
aagtaactgtgaga

SEQ ID NO: 2351443 - DNA, 15 bp, Homo sapiens
aagtaagaagacatg

SEQ ID NO: 2351444 - DNA, 20 bp, Homo sapiens
aagtaatgacttagaaactg

SEQ ID NO: 2351445 - DNA, 13 bp, Homo sapiens
aagtacagaattt

SEQ ID NO: 2351446 - DNA, 19 bp, Homo sapiens
aagtaccaatgggaagcag

SEQ ID NO: 2351447 - DNA, 20 bp, Homo sapiens
aagtagagctagctgccact

SEQ ID NO: 2351448 - DNA, 22 bp, Homo sapiens
aagtataaaatagtatgaaaat

SEQ ID NO: 2351449 - DNA, 13 bp, Homo sapiens
aagtataatgttt

SEQ ID NO: 2351450 - DNA, 20 bp, Homo sapiens
aagtataatgtttattaaat

SEQ ID NO: 2351451 - DNA, 16 bp, Homo sapiens
aagtatcacttttctg

SEQ ID NO: 2351452 - DNA, 16 bp, Homo sapiens
aagtatcctgcgacct

SEQ ID NO: 2351453 - DNA, 21 bp, Homo sapiens
aagtatgcaatgcttcattat

SEQ ID NO: 2351454 - DNA, 20 bp, Homo sapiens
aagtatgtatattaaaaaag

SEQ ID NO: 2351455 - DNA, 21 bp, Homo sapiens
aagtatgtatattaaaaaaga

SEQ ID NO: 2351456 - DNA, 15 bp, Homo sapiens
aagtattatgtctct

SEQ ID NO: 2351457 - DNA, 16 bp, Homo sapiens
aagtcaacactcttct

SEQ ID NO: 2351458 - DNA, 17 bp, Homo sapiens
aagtcaacactcttctt

SEQ ID NO: 2351459 - DNA, 23 bp, Homo sapiens
aagtcagaatcagaagatagtct

SEQ ID NO: 2351460 - DNA, 15 bp, Homo sapiens
aagtcagctccagct

SEQ ID NO: 2351461 - DNA, 15 bp, Homo sapiens
aagtcattaaagaca

SEQ ID NO: 2351462 - DNA, 16 bp, Homo sapiens
aagtccaacctgcctg

SEQ ID NO: 2351463 - DNA, 19 bp, Homo sapiens
aagtccaacctgcctgtgc

SEQ ID NO: 2351464 - DNA, 13 bp, Homo sapiens
aagtccctccctg

SEQ ID NO: 2351465 - DNA, 18 bp, Homo sapiens
aagtccctccctgcctga

SEQ ID NO: 2351466 - DNA, 17 bp, Homo sapiens
aagtccctggaaaagga

SEQ ID NO: 2351467 - DNA, 20 bp, Homo sapiens
aagtctcataggttaaaaaa

SEQ ID NO: 2351468 - DNA, 15 bp, Homo sapiens
aagtctggctttgct

SEQ ID NO: 2351469 - DNA, 22 bp, Homo sapiens
aagtctgtctttcctgaaccat

SEQ ID NO: 2351470 - DNA, 15 bp, Homo sapiens
aagtctttcatggct

SEQ ID NO: 2351471 - DNA, 15 bp, Homo sapiens
aagtcttttttttcc

SEQ ID NO: 2351472 - DNA, 18 bp, Homo sapiens
aagtgaatctgattgcac

SEQ ID NO: 2351473 - DNA, 14 bp, Homo sapiens
aagtgaattgaagt

SEQ ID NO: 2351474 - DNA, 19 bp, Homo sapiens
aagtgacacattaatgata

SEQ ID NO: 2351475 - DNA, 11 bp, Homo sapiens
aagtgagcaga

SEQ ID NO: 2351476 - DNA, 16 bp, Homo sapiens
aagtgagcagaacagg

SEQ ID NO: 2351477 - DNA, 23 bp, Homo sapiens
aagtgcagtcagcagatgctgtt

SEQ ID NO: 2351478 - DNA, 16 bp, Homo sapiens
aagtgcatttttgtaa

SEQ ID NO: 2351479 - DNA, 17 bp, Homo sapiens
aagtgcccacatttgat

SEQ ID NO: 2351480 - DNA, 13 bp, Homo sapiens
aagtgccctctcc

SEQ ID NO: 2351481 - DNA, 23 bp, Homo sapiens
aatcattcagaaatgttgagtct

SEQ ID NO: 2351482 - DNA, 23 bp, Homo sapiens
aatccaagcctccacagcgaggg

SEQ ID NO: 2351483 - DNA, 22 bp, Homo sapiens
aatccaagggttgagagccagt

SEQ ID NO: 2351484 - DNA, 13 bp, Homo sapiens
aatccacctgcct

SEQ ID NO: 2351485 - DNA, 16 bp, Homo sapiens
aatccacctgccttgg

SEQ ID NO: 2351486 - DNA, 19 bp, Homo sapiens
aatccagttataagaagaa

SEQ ID NO: 2351487 - DNA, 18 bp, Homo sapiens
aatcccacccacatgtga

SEQ ID NO: 2351488 - DNA, 17 bp, Homo sapiens
aatcccctaaaataaca

SEQ ID NO: 2351489 - DNA, 20 bp, Homo sapiens
aatccgaagggaattaaaaa

SEQ ID NO: 2351490 - DNA, 16 bp, Homo sapiens
aatcctaatttctcct

SEQ ID NO: 2351491 - DNA, 24 bp, Homo sapiens
aatcctaatttctcctcccttcct

SEQ ID NO: 2351492 - DNA, 20 bp, Homo sapiens
aatcctcctgcctcagcctt

SEQ ID NO: 2351493 - DNA, 12 bp, Homo sapiens
aatcctggcagc

SEQ ID NO: 2351494 - DNA, 13 bp, Homo sapiens
aatcctggcagcc

SEQ ID NO: 2351495 - DNA, 22 bp, Homo sapiens
aatccttctattctagcctgca

SEQ ID NO: 2351496 - DNA, 17 bp, Homo sapiens
aatccttgatgattgac

SEQ ID NO: 2351497 - DNA, 16 bp, Homo sapiens
aatcggactgccaaat

SEQ ID NO: 2351498 - DNA, 15 bp, Homo sapiens
aatcgtgtgccatgg

SEQ ID NO: 2351499 - DNA, 22 bp, Homo sapiens
aatcgtgtgccatggatctgat

SEQ ID NO: 2351500 - DNA, 13 bp, Homo sapiens
aatctaaaatgtt

SEQ ID NO: 2351501 - DNA, 20 bp, Homo sapiens
aatctataagtagtaaatca

SEQ ID NO: 2351502 - DNA, 22 bp, Homo sapiens
aatctatggcttatttctatga

SEQ ID NO: 2351503 - DNA, 12 bp, Homo sapiens
aatctcaaatag

SEQ ID NO: 2351504 - DNA, 22 bp, Homo sapiens
aatctcaaataggctattaaaa

SEQ ID NO: 2351505 - DNA, 11 bp, Homo sapiens
aatctcattat

SEQ ID NO: 2351506 - DNA, 22 bp, Homo sapiens
aatctcctctctctttcctcca

SEQ ID NO: 2351507 - DNA, 13 bp, Homo sapiens
aatctcttcacta

SEQ ID NO: 2351508 - DNA, 20 bp, Homo sapiens
aatctcttcactaccctgat

SEQ ID NO: 2351509 - DNA, 17 bp, Homo sapiens
aatctctttttgtttgc

SEQ ID NO: 2351510 - DNA, 20 bp, Homo sapiens
aatctgatggccttaatttc

SEQ ID NO: 2351511 - DNA, 21 bp, Homo sapiens
aatctgatggccttaatttcc

SEQ ID NO: 2351512 - DNA, 23 bp, Homo sapiens
aatctgatggccttaatttcctt

SEQ ID NO: 2351513 - DNA, 18 bp, Homo sapiens
aatctgatgtaacaaggt

SEQ ID NO: 2351514 - DNA, 19 bp, Homo sapiens
aatctggatgcctcattat

SEQ ID NO: 2351515 - DNA, 11 bp, Homo sapiens
aatctgtaaac

SEQ ID NO: 2351516 - DNA, 12 bp, Homo sapiens
aatctgtaaact

SEQ ID NO: 2351517 - DNA, 21 bp, Homo sapiens
aatctgtaaactgtgtattcc

SEQ ID NO: 2351518 - DNA, 23 bp, Homo sapiens
aatctgtaaactgtgtattccaa

SEQ ID NO: 2351519 - DNA, 17 bp, Homo sapiens
aatcttgtttctgaaaa

SEQ ID NO: 2351520 - DNA, 19 bp, Homo sapiens
aatcttgtttctgaaaaga

SEQ ID NO: 2351521 - DNA, 20 bp, Homo sapiens
aatctttacctgtatacagt

SEQ ID NO: 2351522 - DNA, 22 bp, Homo sapiens
aatctttacctgtatacagtgc

SEQ ID NO: 2351523 - DNA, 20 bp, Homo sapiens
aatctttgtaccaaaatttt

SEQ ID NO: 2351524 - DNA, 13 bp, Homo sapiens
aatcttttcttat

SEQ ID NO: 2351525 - DNA, 13 bp, Homo sapiens
aatgaaaattgta

SEQ ID NO: 2351526 - DNA, 13 bp, Homo sapiens
aatgaaagaaaat

SEQ ID NO: 2351527 - DNA, 16 bp, Homo sapiens
aatgaaagaaaattga

SEQ ID NO: 2351528 - DNA, 16 bp, Homo sapiens
aatgaaagctgttcct

SEQ ID NO: 2351529 - DNA, 15 bp, Homo sapiens
aatgaaatttaagca

SEQ ID NO: 2351530 - DNA, 18 bp, Homo sapiens
aatgaaatttaagcacaa

SEQ ID NO: 2351531 - DNA, 18 bp, Homo sapiens
aatgaaccataaattcaa

SEQ ID NO: 2351532 - DNA, 16 bp, Homo sapiens
aatgaagcagaaatgt

SEQ ID NO: 2351533 - DNA, 16 bp, Homo sapiens
aatgaagcagtatttt

SEQ ID NO: 2351534 - DNA, 17 bp, Homo sapiens
aatgaataatggaaaat

SEQ ID NO: 2351535 - DNA, 23 bp, Homo sapiens
aatgaatttttattgagattttc

SEQ ID NO: 2351536 - DNA, 24 bp, Homo sapiens
aatgacggtaagtgttctcatgaa

SEQ ID NO: 2351537 - DNA, 21 bp, Homo sapiens
aatgactatataatttatttc

SEQ ID NO: 2351538 - DNA, 15 bp, Homo sapiens
aatgacttagaaact

SEQ ID NO: 2351539 - DNA, 22 bp, Homo sapiens
aatgagaaaaataaatggaaac

SEQ ID NO: 2351540 - DNA, 18 bp, Homo sapiens
aatgagagttccttctca

SEQ ID NO: 2351541 - DNA, 17 bp, Homo sapiens
aatgagcaagactgggc

SEQ ID NO: 2351542 - DNA, 14 bp, Homo sapiens
aatgagctctgaaa

SEQ ID NO: 2351543 - DNA, 17 bp, Homo sapiens
aatgagtaaaaactaga

SEQ ID NO: 2351544 - DNA, 19 bp, Homo sapiens
acagcatcccttcccacat

SEQ ID NO: 2351545 - DNA, 20 bp, Homo sapiens
acagccaagattttcctctt

SEQ ID NO: 2351546 - DNA, 20 bp, Homo sapiens
acagccactcccctccactc

SEQ ID NO: 2351547 - DNA, 12 bp, Homo sapiens
acagccagagga

SEQ ID NO: 2351548 - DNA, 13 bp, Homo sapiens
acagccagaggag

SEQ ID NO: 2351549 - DNA, 21 bp, Homo sapiens
acagcccaggatactggcaca

SEQ ID NO: 2351550 - DNA, 20 bp, Homo sapiens
acagcccctatagcactgag

SEQ ID NO: 2351551 - DNA, 18 bp, Homo sapiens
acagcctatagtaaatgt

SEQ ID NO: 2351552 - DNA, 19 bp, Homo sapiens
acagcctttgaatgtaacc

SEQ ID NO: 2351553 - DNA, 17 bp, Homo sapiens
acagcgagggcagctgc

SEQ ID NO: 2351554 - DNA, 23 bp, Homo sapiens
acagcgagggcagctgctattta

SEQ ID NO: 2351555 - DNA, 15 bp, Homo sapiens
acagcgccagcctca

SEQ ID NO: 2351556 - DNA, 18 bp, Homo sapiens
acagcgccagcctcagac

SEQ ID NO: 2351557 - DNA, 19 bp, Homo sapiens
acagcggctcccctctgct

SEQ ID NO: 2351558 - DNA, 18 bp, Homo sapiens
acagctacaaacttttaa

SEQ ID NO: 2351559 - DNA, 21 bp, Homo sapiens
acagctattggcaagttttaa

SEQ ID NO: 2351560 - DNA, 13 bp, Homo sapiens
acagctgctgttc

SEQ ID NO: 2351561 - DNA, 16 bp, Homo sapiens
acagctggagaaatgg

SEQ ID NO: 2351562 - DNA, 10 bp, Homo sapiens
acagctgtgt

SEQ ID NO: 2351563 - DNA, 13 bp, Homo sapiens
acagctgtgtctg

SEQ ID NO: 2351564 - DNA, 17 bp, Homo sapiens
acagcttgtaggggagg

SEQ ID NO: 2351565 - DNA, 12 bp, Homo sapiens
acagctttctgg

SEQ ID NO: 2351566 - DNA, 13 bp, Homo sapiens
acagctttctggg

SEQ ID NO: 2351567 - DNA, 14 bp, Homo sapiens
acaggacagcggga

SEQ ID NO: 2351568 - DNA, 14 bp, Homo sapiens
acaggagagaagct

SEQ ID NO: 2351569 - DNA, 23 bp, Homo sapiens
acaggatctataggcagcttcta

SEQ ID NO: 2351570 - DNA, 17 bp, Homo sapiens
acaggcaccgagaatgt

SEQ ID NO: 2351571 - DNA, 21 bp, Homo sapiens
acaggcaccgagaatgttgta

SEQ ID NO: 2351572 - DNA, 22 bp, Homo sapiens
acaggcagcctcctttgtgtgt

SEQ ID NO: 2351573 - DNA, 15 bp, Homo sapiens
acaggctgagaactc

SEQ ID NO: 2351574 - DNA, 17 bp, Homo sapiens
acagggtcttgctctgt

SEQ ID NO: 2351575 - DNA, 13 bp, Homo sapiens
acagggtgggctt

SEQ ID NO: 2351576 - DNA, 21 bp, Homo sapiens
acagggtgggcttcctgccct

SEQ ID NO: 2351577 - DNA, 19 bp, Homo sapiens
acaggtcatcagatgcctg

SEQ ID NO: 2351578 - DNA, 12 bp, Homo sapiens
acagtaaatgtt

SEQ ID NO: 2351579 - DNA, 16 bp, Homo sapiens
acagtaactgccattt

SEQ ID NO: 2351580 - DNA, 18 bp, Homo sapiens
acagtagaactgtctgtg

SEQ ID NO: 2351581 - DNA, 15 bp, Homo sapiens
acagtagagccagct

SEQ ID NO: 2351582 - DNA, 16 bp, Homo sapiens
acagtagagccagctt

SEQ ID NO: 2351583 - DNA, 21 bp, Homo sapiens
acagtatcccacatccaactc

SEQ ID NO: 2351584 - DNA, 13 bp, Homo sapiens
acagtatttaaca

SEQ ID NO: 2351585 - DNA, 14 bp, Homo sapiens
acagtatttaacat

SEQ ID NO: 2351586 - DNA, 18 bp, Homo sapiens
acagtatttaacattctt

SEQ ID NO: 2351587 - DNA, 13 bp, Homo sapiens
acagtcacctcac

SEQ ID NO: 2351588 - DNA, 15 bp, Homo sapiens
acagtcattccaaga

SEQ ID NO: 2351589 - DNA, 21 bp, Homo sapiens
acagtgcagagccttctcaga

SEQ ID NO: 2351590 - DNA, 12 bp, Homo sapiens
acagtgcctctt

SEQ ID NO: 2351591 - DNA, 23 bp, Homo sapiens
acagtgcctcttccagtgaacat

SEQ ID NO: 2351592 - DNA, 15 bp, Homo sapiens
acagtggcagtattg

SEQ ID NO: 2351593 - DNA, 17 bp, Homo sapiens
accacttccagagccag

SEQ ID NO: 2351594 - DNA, 15 bp, Homo sapiens
accactttcccacac

SEQ ID NO: 2351595 - DNA, 21 bp, Homo sapiens
accagaacgtggtttgcctga

SEQ ID NO: 2351596 - DNA, 15 bp, Homo sapiens
accagaagccttgga

SEQ ID NO: 2351597 - DNA, 16 bp, Homo sapiens
accagagcagatgcag

SEQ ID NO: 2351598 - DNA, 17 bp, Homo sapiens
accagagcagatgcaga

SEQ ID NO: 2351599 - DNA, 15 bp, Homo sapiens
accagagggtgtggc

SEQ ID NO: 2351600 - DNA, 16 bp, Homo sapiens
accagatctttctctt

SEQ ID NO: 2351601 - DNA, 19 bp, Homo sapiens
accagattgctctgcccca

SEQ ID NO: 2351602 - DNA, 16 bp, Homo sapiens
accagcattccctaca

SEQ ID NO: 2351603 - DNA, 11 bp, Homo sapiens
accagccaggc

SEQ ID NO: 2351604 - DNA, 16 bp, Homo sapiens
accagccatcctccct

SEQ ID NO: 2351605 - DNA, 21 bp, Homo sapiens
accagccccactgccagcagc

SEQ ID NO: 2351606 - DNA, 23 bp, Homo sapiens
accagccccactgccagcagcag

SEQ ID NO: 2351607 - DNA, 16 bp, Homo sapiens
accagccccatcagaa

SEQ ID NO: 2351608 - DNA, 23 bp, Homo sapiens
accagcccccgccccagagtggc

SEQ ID NO: 2351609 - DNA, 14 bp, Homo sapiens
accagccctgcagc

SEQ ID NO: 2351610 - DNA, 16 bp, Homo sapiens
accagctgcgcttgct

SEQ ID NO: 2351611 - DNA, 19 bp, Homo sapiens
accagctgcgcttgctttt

SEQ ID NO: 2351612 - DNA, 20 bp, Homo sapiens
accaggaactctggagttca

SEQ ID NO: 2351613 - DNA, 16 bp, Homo sapiens
accaggcacctcttcc

SEQ ID NO: 2351614 - DNA, 14 bp, Homo sapiens
accagggccctggg

SEQ ID NO: 2351615 - DNA, 19 bp, Homo sapiens
accaggtgttctacactca

SEQ ID NO: 2351616 - DNA, 20 bp, Homo sapiens
accaggtgttctacactcat

SEQ ID NO: 2351617 - DNA, 23 bp, Homo sapiens
accaggtgttctacactcatctt

SEQ ID NO: 2351618 - DNA, 20 bp, Homo sapiens
accataaaaccctatacaag

SEQ ID NO: 2351619 - DNA, 18 bp, Homo sapiens
accatccaccttcccttc

SEQ ID NO: 2351620 - DNA, 22 bp, Homo sapiens
accatcctggctaacatggtga

SEQ ID NO: 2351621 - DNA, 21 bp, Homo sapiens
accatgccagattctgcctct

SEQ ID NO: 2351622 - DNA, 21 bp, Homo sapiens
accatgctggcggcgcagagg

SEQ ID NO: 2351623 - DNA, 21 bp, Homo sapiens
accatgtaagcactctggatg

SEQ ID NO: 2351624 - DNA, 16 bp, Homo sapiens
accatgtgagctcttc

SEQ ID NO: 2351625 - DNA, 19 bp, Homo sapiens
accatgtgagctcttccta

SEQ ID NO: 2351626 - DNA, 21 bp, Homo sapiens
accattccaagtctccacccc

SEQ ID NO: 2351627 - DNA, 15 bp, Homo sapiens
accattttttttaag

SEQ ID NO: 2351628 - DNA, 15 bp, Homo sapiens
acccacatgtgacac

SEQ ID NO: 2351629 - DNA, 18 bp, Homo sapiens
acccactgcatgcagaaa

SEQ ID NO: 2351630 - DNA, 18 bp, Homo sapiens
acccagacataaaggaaa

SEQ ID NO: 2351631 - DNA, 22 bp, Homo sapiens
acccagggaacagccactcccc

SEQ ID NO: 2351632 - DNA, 19 bp, Homo sapiens
acccagggactctccaaac

SEQ ID NO: 2351633 - DNA, 22 bp, Homo sapiens
acccagggctccctcctggagc

SEQ ID NO: 2351634 - DNA, 20 bp, Homo sapiens
acccaggggaaggccctgag

SEQ ID NO: 2351635 - DNA, 14 bp, Homo sapiens
acccatccagtgga

SEQ ID NO: 2351636 - DNA, 20 bp, Homo sapiens
acccatctttaatttatatc

SEQ ID NO: 2351637 - DNA, 20 bp, Homo sapiens
acccatttaaatttttttcc

SEQ ID NO: 2351638 - DNA, 13 bp, Homo sapiens
accccaagagaac

SEQ ID NO: 2351639 - DNA, 18 bp, Homo sapiens
accccaagagaactcgcg

SEQ ID NO: 2351640 - DNA, 22 bp, Homo sapiens
accccagcattctcaggcacca

SEQ ID NO: 2351641 - DNA, 13 bp, Homo sapiens
accccattcctga

SEQ ID NO: 2351642 - DNA, 20 bp, Homo sapiens
acccccgaggggagggcagg

SEQ ID NO: 2351643 - DNA, 14 bp, Homo sapiens
accccgaggtaggg

SEQ ID NO: 2351644 - DNA, 16 bp, Homo sapiens
accccgtctctactaa

SEQ ID NO: 2351645 - DNA, 13 bp, Homo sapiens
acccctgccccca

SEQ ID NO: 2351646 - DNA, 17 bp, Homo sapiens
acccctgtgctcccctg

SEQ ID NO: 2351647 - DNA, 16 bp, Homo sapiens
accccttccagatcac

SEQ ID NO: 2351648 - DNA, 18 bp, Homo sapiens
accccttggaaatgtctg

SEQ ID NO: 2351649 - DNA, 14 bp, Homo sapiens
acccctttcccacc

SEQ ID NO: 2351650 - DNA, 21 bp, Homo sapiens
acccctttctagaccaataaa

SEQ ID NO: 2351651 - DNA, 17 bp, Homo sapiens
acccctttctggctctc

SEQ ID NO: 2351652 - DNA, 19 bp, Homo sapiens
accctactgaagtggctgg

SEQ ID NO: 2351653 - DNA, 12 bp, Homo sapiens
accctatctccc

SEQ ID NO: 2351654 - DNA, 15 bp, Homo sapiens
accctatctcctgac

SEQ ID NO: 2351655 - DNA, 16 bp, Homo sapiens
accctatgggtctagg

SEQ ID NO: 2351656 - DNA, 19 bp, Homo sapiens
accctatgggtctaggaca

SEQ ID NO: 2351657 - DNA, 23 bp, Homo sapiens
accctatgggtctaggacacagt

SEQ ID NO: 2351658 - DNA, 15 bp, Homo sapiens
accctcactggctct

SEQ ID NO: 2351659 - DNA, 22 bp, Homo sapiens
accctcactggctctcctggcc

SEQ ID NO: 2351660 - DNA, 16 bp, Homo sapiens
accctcattgtgtttc

SEQ ID NO: 2351661 - DNA, 23 bp, Homo sapiens
accctccaaatggagaagctgca

SEQ ID NO: 2351662 - DNA, 22 bp, Homo sapiens
accctcccagaaacatctctgg

SEQ ID NO: 2351663 - DNA, 19 bp, Homo sapiens
accctccccttttttcttc

SEQ ID NO: 2351664 - DNA, 19 bp, Homo sapiens
actcctctggctttcccag

SEQ ID NO: 2351665 - DNA, 20 bp, Homo sapiens
actcctgacccctctcctca

SEQ ID NO: 2351666 - DNA, 15 bp, Homo sapiens
actcctgccaggcac

SEQ ID NO: 2351667 - DNA, 13 bp, Homo sapiens
actcctgcttaat

SEQ ID NO: 2351668 - DNA, 16 bp, Homo sapiens
actcctgtccctgtag

SEQ ID NO: 2351669 - DNA, 23 bp, Homo sapiens
actcctgtccctgtagctcagtc

SEQ ID NO: 2351670 - DNA, 17 bp, Homo sapiens
actccttaaaaatgtat

SEQ ID NO: 2351671 - DNA, 19 bp, Homo sapiens
actccttcctggcctgaga

SEQ ID NO: 2351672 - DNA, 20 bp, Homo sapiens
actccttcctggcctgagag

SEQ ID NO: 2351673 - DNA, 13 bp, Homo sapiens
actccttgcttcc

SEQ ID NO: 2351674 - DNA, 16 bp, Homo sapiens
actcgcgctcagtaaa

SEQ ID NO: 2351675 - DNA, 15 bp, Homo sapiens
actcggctctgcagt

SEQ ID NO: 2351676 - DNA, 22 bp, Homo sapiens
actcgttcacctccaagcattt
